United States Patent 7,655,785 (BIOINFORMATICALLY DETECTABLE GROUP OF NOVEL REGULATORY OLIGONUCLEOTIDES AND USES THEREOF) - sequence listing, part 39

SEQ ID NO: 1606557 - RNA, 14 nt, Homo sapiens
cugcucuuguucua

SEQ ID NO: 1606558 - RNA, 18 nt, Homo sapiens
cugcugaaacaacaaaua

SEQ ID NO: 1606559 - RNA, 13 nt, Homo sapiens
cugcugaaacugc

SEQ ID NO: 1606560 - RNA, 23 nt, Homo sapiens
cugcugaaggcagucauaucaaa

SEQ ID NO: 1606561 - RNA, 22 nt, Homo sapiens
cugcugacugccaauaacauuc

SEQ ID NO: 1606562 - RNA, 13 nt, Homo sapiens
cugcugauccaga

SEQ ID NO: 1606563 - RNA, 16 nt, Homo sapiens
cugcuggaugacuuga

SEQ ID NO: 1606564 - RNA, 16 nt, Homo sapiens
cugcuggcuaagcauu

SEQ ID NO: 1606565 - RNA, 21 nt, Homo sapiens
cugcuggcucccuuacuuuac

SEQ ID NO: 1606566 - RNA, 21 nt, Homo sapiens
cugcugggacuugaacaaaga

SEQ ID NO: 1606567 - RNA, 20 nt, Homo sapiens
cugcuggggaagaacagccc

SEQ ID NO: 1606568 - RNA, 18 nt, Homo sapiens
cugcugguugacaucaga

SEQ ID NO: 1606569 - RNA, 19 nt, Homo sapiens
cugcugguugacaucagac

SEQ ID NO: 1606570 - RNA, 22 nt, Homo sapiens
cugcuguagaaaaaaaaauuca

SEQ ID NO: 1606571 - RNA, 21 nt, Homo sapiens
cugcuguuuggcuuaacacau

SEQ ID NO: 1606572 - RNA, 20 nt, Homo sapiens
cugcuucacgauucuuaccc

SEQ ID NO: 1606573 - RNA, 21 nt, Homo sapiens
cugcuuguucaaauacugugu

SEQ ID NO: 1606574 - RNA, 17 nt, Homo sapiens
cugcuuuccagacuuug

SEQ ID NO: 1606575 - RNA, 17 nt, Homo sapiens
cugcuuuuuuucaggga

SEQ ID NO: 1606576 - RNA, 17 nt, Homo sapiens
cuggaaaacagaaacca

SEQ ID NO: 1606577 - RNA, 23 nt, Homo sapiens
cuggaaaacagaaaccauucuag

SEQ ID NO: 1606578 - RNA, 13 nt, Homo sapiens
cuggaacacaggg

SEQ ID NO: 1606579 - RNA, 19 nt, Homo sapiens
cuggaacagaaaaagauca

SEQ ID NO: 1606580 - RNA, 16 nt, Homo sapiens
cuggaaccugcaaaaa

SEQ ID NO: 1606581 - RNA, 19 nt, Homo sapiens
cuggaacuugcucucauuu

SEQ ID NO: 1606582 - RNA, 21 nt, Homo sapiens
cuggaacuuuuuagauuauuc

SEQ ID NO: 1606583 - RNA, 17 nt, Homo sapiens
cuggaagcuaauuugca

SEQ ID NO: 1606584 - RNA, 18 nt, Homo sapiens
cuggaagucaucucauuc

SEQ ID NO: 1606585 - RNA, 12 nt, Homo sapiens
cuggaauggugu

SEQ ID NO: 1606586 - RNA, 16 nt, Homo sapiens
cuggacacuguccaug

SEQ ID NO: 1606587 - RNA, 23 nt, Homo sapiens
cuggacacuguccaugaagcacu

SEQ ID NO: 1606588 - RNA, 16 nt, Homo sapiens
cuggaccaagcacaaa

SEQ ID NO: 1606589 - RNA, 18 nt, Homo sapiens
cuggaccagccucuccac

SEQ ID NO: 1606590 - RNA, 21 nt, Homo sapiens
cuggagccaucucuuccucau

SEQ ID NO: 1606591 - RNA, 22 nt, Homo sapiens
cuggagcccccagcagaggcag

SEQ ID NO: 1606592 - RNA, 16 nt, Homo sapiens
cuggagccucagaaau

SEQ ID NO: 1606593 - RNA, 18 nt, Homo sapiens
cuggaggcugccucccaa

SEQ ID NO: 1606594 - RNA, 12 nt, Homo sapiens
cuggagggcuag

SEQ ID NO: 1606595 - RNA, 17 nt, Homo sapiens
cuggagguugaagccaa

SEQ ID NO: 1606596 - RNA, 20 nt, Homo sapiens
cuggagugcaguggcgcaau

SEQ ID NO: 1606597 - RNA, 20 nt, Homo sapiens
cuggagugcaguggugccau

SEQ ID NO: 1606598 - RNA, 21 nt, Homo sapiens
cuggaguuucauguacaagau

SEQ ID NO: 1606599 - RNA, 22 nt, Homo sapiens
cuggaguuuuguuggugugaaa

SEQ ID NO: 1606600 - RNA, 13 nt, Homo sapiens
cuggaucaguaaa

SEQ ID NO: 1606601 - RNA, 17 nt, Homo sapiens
cuggauuucauacugua

SEQ ID NO: 1606602 - RNA, 21 nt, Homo sapiens
cuggcaauucacaaauagcca

SEQ ID NO: 1606603 - RNA, 22 nt, Homo sapiens
cuggcacaguguaauccagggg

SEQ ID NO: 1606604 - RNA, 18 nt, Homo sapiens
cuuagagcuuuaccuaaa

SEQ ID NO: 1606605 - RNA, 22 nt, Homo sapiens
cuuagauaacuucuugaaaaag

SEQ ID NO: 1606606 - RNA, 20 nt, Homo sapiens
cuuagaucucuccugcaaaa

SEQ ID NO: 1606607 - RNA, 18 nt, Homo sapiens
cuuagaugggcauggugg

SEQ ID NO: 1606608 - RNA, 15 nt, Homo sapiens
cuuagauugaaucug

SEQ ID NO: 1606609 - RNA, 18 nt, Homo sapiens
cuuagcaacucagagaaa

SEQ ID NO: 1606610 - RNA, 15 nt, Homo sapiens
cuuagccccagacuc

SEQ ID NO: 1606611 - RNA, 22 nt, Homo sapiens
cuuagcuauccuuggcuuucag

SEQ ID NO: 1606612 - RNA, 18 nt, Homo sapiens
cuuagggcagauuuucau

SEQ ID NO: 1606613 - RNA, 14 nt, Homo sapiens
cuuagggggcccug

SEQ ID NO: 1606614 - RNA, 23 nt, Homo sapiens
cuuaguccaauuccuugcacaua

SEQ ID NO: 1606615 - RNA, 21 nt, Homo sapiens
cuuaguucuucuccugccuaa

SEQ ID NO: 1606616 - RNA, 14 nt, Homo sapiens
cuuauacuguacaa

SEQ ID NO: 1606617 - RNA, 20 nt, Homo sapiens
cuuauaugagggcagauuca

SEQ ID NO: 1606618 - RNA, 19 nt, Homo sapiens
cuuaucucucaaaacaaua

SEQ ID NO: 1606619 - RNA, 18 nt, Homo sapiens
cuuaugagauacuuugca

SEQ ID NO: 1606620 - RNA, 23 nt, Homo sapiens
cuuauggaauugauuugcauuga

SEQ ID NO: 1606621 - RNA, 16 nt, Homo sapiens
cuuauucaaccugucc

SEQ ID NO: 1606622 - RNA, 12 nt, Homo sapiens
cuuauucuuaac

SEQ ID NO: 1606623 - RNA, 16 nt, Homo sapiens
cuuauuguauuccuca

SEQ ID NO: 1606624 - RNA, 17 nt, Homo sapiens
cuuauuuuaccuucuca

SEQ ID NO: 1606625 - RNA, 13 nt, Homo sapiens
cuucaaacuuuag

SEQ ID NO: 1606626 - RNA, 19 nt, Homo sapiens
cuucaaagaggaaccagga

SEQ ID NO: 1606627 - RNA, 14 nt, Homo sapiens
cuucaaagccacau

SEQ ID NO: 1606628 - RNA, 19 nt, Homo sapiens
cuucaaaguuaaugggaug

SEQ ID NO: 1606629 - RNA, 13 nt, Homo sapiens
cuucaagugccaa

SEQ ID NO: 1606630 - RNA, 17 nt, Homo sapiens
cuucacaguacccaaac

SEQ ID NO: 1606631 - RNA, 11 nt, Homo sapiens
cuucaccaucu

SEQ ID NO: 1606632 - RNA, 21 nt, Homo sapiens
cuucaccccaguggccacuca

SEQ ID NO: 1606633 - RNA, 18 nt, Homo sapiens
cuucacguauucuuguau

SEQ ID NO: 1606634 - RNA, 22 nt, Homo sapiens
cuucacugcagaauguaaaggu

SEQ ID NO: 1606635 - RNA, 17 nt, Homo sapiens
cuucacugcugugacuu

SEQ ID NO: 1606636 - RNA, 20 nt, Homo sapiens
cuucacuuacccauuagcca

SEQ ID NO: 1606637 - RNA, 17 nt, Homo sapiens
cuucagaccaucaguua

SEQ ID NO: 1606638 - RNA, 16 nt, Homo sapiens
cuucagauuaaacccu

SEQ ID NO: 1606639 - RNA, 14 nt, Homo sapiens
cuucagauuugccu

SEQ ID NO: 1606640 - RNA, 18 nt, Homo sapiens
cuucagcaugauguguug

SEQ ID NO: 1606641 - RNA, 11 nt, Homo sapiens
cuucagcauuu

SEQ ID NO: 1606642 - RNA, 17 nt, Homo sapiens
cuucagccuuaauggaa

SEQ ID NO: 1606643 - RNA, 23 nt, Homo sapiens
cuucagcuauacuuacacuguau

SEQ ID NO: 1606644 - RNA, 22 nt, Homo sapiens
cuucagugaauuuugauaaugg

SEQ ID NO: 1606645 - RNA, 17 nt, Homo sapiens
cuucaguuucacagaaa

SEQ ID NO: 1606646 - RNA, 23 nt, Homo sapiens
cuucaguuuuucacuucuaccua

SEQ ID NO: 1606647 - RNA, 14 nt, Homo sapiens
cuucauagcaaugu

SEQ ID NO: 1606648 - RNA, 19 nt, Homo sapiens
cuucauauaccagcaauau

SEQ ID NO: 1606649 - RNA, 21 nt, Homo sapiens
cuucauaugucaccuuugcua

SEQ ID NO: 1606650 - RNA, 15 nt, Homo sapiens
cuucaucugggacaa

SEQ ID NO: 1606651 - RNA, 21 nt, Homo sapiens
cuucaucugugggaugcugaa

SEQ ID NO: 1606652 - RNA, 18 nt, Homo sapiens
cuucaucuucacugcaau

SEQ ID NO: 1606653 - RNA, 21 nt, Homo sapiens
cuucaugaucaucacaaucau

SEQ ID NO: 1606654 - RNA, 19 nt, Homo sapiens
cuucaugcuugacauaccu

SEQ ID NO: 1606655 - RNA, 23 nt, Homo sapiens
cuucaugcuuuugcuugcaaugu

SEQ ID NO: 1606656 - RNA, 17 nt, Homo sapiens
cuucauuaccucaguga

SEQ ID NO: 1606657 - RNA, 17 nt, Homo sapiens
cuuccaaauccaaaagc

SEQ ID NO: 1606658 - RNA, 23 nt, Homo sapiens
cuuccaaauccuggaaggacaca

SEQ ID NO: 1606659 - RNA, 15 nt, Homo sapiens
cuuccacccgucucu

SEQ ID NO: 1606660 - RNA, 20 nt, Homo sapiens
cuuccagauccucucugggg

SEQ ID NO: 1606661 - RNA, 15 nt, Homo sapiens
cuuccaugugccuuu

SEQ ID NO: 1606662 - RNA, 18 nt, Homo sapiens
cuuccauuugcaagggaa

SEQ ID NO: 1606663 - RNA, 16 nt, Homo sapiens
cuucccaaaaacagcc

SEQ ID NO: 1606664 - RNA, 19 nt, Homo sapiens
cuucccaggaucugcucca

SEQ ID NO: 1606665 - RNA, 16 nt, Homo sapiens
cuucccccacauuggg

SEQ ID NO: 1606666 - RNA, 20 nt, Homo sapiens
cuuccccuuagaaacacugc

SEQ ID NO: 1606667 - RNA, 13 nt, Homo sapiens
cuucccuaccuca

SEQ ID NO: 1606668 - RNA, 16 nt, Homo sapiens
cuucccucccuaucua

SEQ ID NO: 1606669 - RNA, 22 nt, Homo sapiens
cuucccucucugcagacuuccc

SEQ ID NO: 1606670 - RNA, 18 nt, Homo sapiens
cuucccugauggccuuug

SEQ ID NO: 1606671 - RNA, 15 nt, Homo sapiens
cuucccugcauuaac

SEQ ID NO: 1606672 - RNA, 23 nt, Homo sapiens
cuucccugcauuaacugcacaaa

SEQ ID NO: 1606673 - RNA, 22 nt, Homo sapiens
cuucccuuauucuaaagcugcc

SEQ ID NO: 1606674 - RNA, 19 nt, Homo sapiens
cuucccuuuauuacaagaa

SEQ ID NO: 1606675 - RNA, 22 nt, Homo sapiens
cuuccgacaggagcacugcaug

SEQ ID NO: 1606676 - RNA, 16 nt, Homo sapiens
cuuccgggaacuggag

SEQ ID NO: 1606677 - RNA, 13 nt, Homo sapiens
cuuccgugagaca

SEQ ID NO: 1606678 - RNA, 20 nt, Homo sapiens
cuuccuaaacuuuccaaaac

SEQ ID NO: 1606679 - RNA, 21 nt, Homo sapiens
cuuccucaaauacaugcacag

SEQ ID NO: 1606680 - RNA, 23 nt, Homo sapiens
cuuccuccccuguucauucugca

SEQ ID NO: 1606681 - RNA, 18 nt, Homo sapiens
cuuccucuagaagccaag

SEQ ID NO: 1606682 - RNA, 21 nt, Homo sapiens
cuuccucucaggcucuugacu

SEQ ID NO: 1606683 - RNA, 22 nt, Homo sapiens
cuuccugcugaguccuuuccag

SEQ ID NO: 1606684 - RNA, 22 nt, Homo sapiens
cuuccugcuuaaacuugaccca

SEQ ID NO: 1606685 - RNA, 23 nt, Homo sapiens
cuuccuggguccuguucccuacc

SEQ ID NO: 1606686 - RNA, 14 nt, Homo sapiens
cuuccuucaggacu

SEQ ID NO: 1606687 - RNA, 18 nt, Homo sapiens
cuuccuucaggacucugc

SEQ ID NO: 1606688 - RNA, 21 nt, Homo sapiens
cuuccuucuuuauugccccuu

SEQ ID NO: 1606689 - RNA, 16 nt, Homo sapiens
cuucguaagaaggaau

SEQ ID NO: 1606690 - RNA, 16 nt, Homo sapiens
cuucguuagaccgcuc

SEQ ID NO: 1606691 - RNA, 16 nt, Homo sapiens
cuucuaaaccaaaaau

SEQ ID NO: 1606692 - RNA, 19 nt, Homo sapiens
cuucuaaacccaauccaaa

SEQ ID NO: 1606693 - RNA, 21 nt, Homo sapiens
cuucuaaacccaauccaaaug

SEQ ID NO: 1606694 - RNA, 19 nt, Homo sapiens
cuucuaaaugagucacuga

SEQ ID NO: 1606695 - RNA, 16 nt, Homo sapiens
cuucuaagucauucau

SEQ ID NO: 1606696 - RNA, 16 nt, Homo sapiens
cuucuacugcuaucua

SEQ ID NO: 1606697 - RNA, 12 nt, Homo sapiens
cuucuacuuuua

SEQ ID NO: 1606698 - RNA, 16 nt, Homo sapiens
cuucuagagcuuagca

SEQ ID NO: 1606699 - RNA, 14 nt, Homo sapiens
cuucuagugcuuuu

SEQ ID NO: 1606700 - RNA, 18 nt, Homo sapiens
cuucucagaagcacagaa

SEQ ID NO: 1606701 - RNA, 17 nt, Homo sapiens
cuucuccaauucugaaa

SEQ ID NO: 1606702 - RNA, 15 nt, Homo sapiens
cuucuccaguuagaa

SEQ ID NO: 1606703 - RNA, 17 nt, Homo sapiens
cuucucccaagcccacg

SEQ ID NO: 1606704 - RNA, 18 nt, Homo sapiens
cuucucgugacaccacca

SEQ ID NO: 1606705 - RNA, 14 nt, Homo sapiens
cuucucuccuugcc

SEQ ID NO: 1606706 - RNA, 16 nt, Homo sapiens
cuucucugcacuuaua

SEQ ID NO: 1606707 - RNA, 17 nt, Homo sapiens
cuucucuugagcaguua

SEQ ID NO: 1606708 - RNA, 16 nt, Homo sapiens
cuucugauaaacacaa

SEQ ID NO: 1606709 - RNA, 17 nt, Homo sapiens
cuucugcaacaucuuaa

SEQ ID NO: 1606710 - RNA, 18 nt, Homo sapiens
cuucugccuucucaggaa

SEQ ID NO: 1606711 - RNA, 20 nt, Homo sapiens
cuucugcuuuuuuucaggga

SEQ ID NO: 1606712 - RNA, 19 nt, Homo sapiens
cuucugguucuaacugcug

SEQ ID NO: 1606713 - RNA, 14 nt, Homo sapiens
cuucuguaguguau

SEQ ID NO: 1606714 - RNA, 21 nt, Homo sapiens
cuucuuagcuauugcucugag

SEQ ID NO: 1606715 - RNA, 15 nt, Homo sapiens
cuucuuagcugucac

SEQ ID NO: 1606716 - RNA, 14 nt, Homo sapiens
cuucuuaugguggu

SEQ ID NO: 1606717 - RNA, 16 nt, Homo sapiens
cuucuuauuaaucaua

SEQ ID NO: 1606718 - RNA, 15 nt, Homo sapiens
cuucuuggucucagu

SEQ ID NO: 1606719 - RNA, 21 nt, Homo sapiens
cuucuuguucugagauucaau

SEQ ID NO: 1606720 - RNA, 18 nt, Homo sapiens
cuucuuuacuuaguucaa

SEQ ID NO: 1606721 - RNA, 20 nt, Homo sapiens
gaagaaaagcaugcauauca

SEQ ID NO: 1606722 - RNA, 12 nt, Homo sapiens
gaagaaagcaaa

SEQ ID NO: 1606723 - RNA, 18 nt, Homo sapiens
gaagaaccaaauaccuca

SEQ ID NO: 1606724 - RNA, 21 nt, Homo sapiens
gaagaaccgauacacuuggca

SEQ ID NO: 1606725 - RNA, 21 nt, Homo sapiens
gaagaacuggaaccccagcuu

SEQ ID NO: 1606726 - RNA, 21 nt, Homo sapiens
gaagacaaagcacaccauaug

SEQ ID NO: 1606727 - RNA, 22 nt, Homo sapiens
gaagacauuugccuuuuguuaa

SEQ ID NO: 1606728 - RNA, 17 nt, Homo sapiens
gaagacccacgugcuag

SEQ ID NO: 1606729 - RNA, 17 nt, Homo sapiens
gaagacuucaaaauauu

SEQ ID NO: 1606730 - RNA, 21 nt, Homo sapiens
gaagagauccuuccauuccau

SEQ ID NO: 1606731 - RNA, 15 nt, Homo sapiens
gaagaggaaagggag

SEQ ID NO: 1606732 - RNA, 13 nt, Homo sapiens
gaagagggucccu

SEQ ID NO: 1606733 - RNA, 12 nt, Homo sapiens
gaagagucauuu

SEQ ID NO: 1606734 - RNA, 23 nt, Homo sapiens
gaagauauuacuacuuaccauuu

SEQ ID NO: 1606735 - RNA, 18 nt, Homo sapiens
gaagauccccaacugcuc

SEQ ID NO: 1606736 - RNA, 20 nt, Homo sapiens
gaagauccccaacugcucca

SEQ ID NO: 1606737 - RNA, 16 nt, Homo sapiens
gaagauguguaaacag

SEQ ID NO: 1606738 - RNA, 17 nt, Homo sapiens
gaagauguguaaacagg

SEQ ID NO: 1606739 - RNA, 20 nt, Homo sapiens
gaagauucucgccccuuccc

SEQ ID NO: 1606740 - RNA, 18 nt, Homo sapiens
gaagcaaaaguaaucacu

SEQ ID NO: 1606741 - RNA, 14 nt, Homo sapiens
gaagcaacccaaau

SEQ ID NO: 1606742 - RNA, 17 nt, Homo sapiens
gaagcaacuaggaaaau

SEQ ID NO: 1606743 - RNA, 14 nt, Homo sapiens
gaagcaaucuuuga

SEQ ID NO: 1606744 - RNA, 13 nt, Homo sapiens
gaagcagcacugu

SEQ ID NO: 1606745 - RNA, 23 nt, Homo sapiens
gaagccauguacucaaguaccac

SEQ ID NO: 1606746 - RNA, 14 nt, Homo sapiens
gaagcccauaucac

SEQ ID NO: 1606747 - RNA, 18 nt, Homo sapiens
gaagcucgcauccagaca

SEQ ID NO: 1606748 - RNA, 15 nt, Homo sapiens
gaagcugaaaugcag

SEQ ID NO: 1606749 - RNA, 21 nt, Homo sapiens
gaagcuguguccuugcaccug

SEQ ID NO: 1606750 - RNA, 22 nt, Homo sapiens
gaagcuguguccuugcaccugc

SEQ ID NO: 1606751 - RNA, 14 nt, Homo sapiens
gaaggaaagcacua

SEQ ID NO: 1606752 - RNA, 14 nt, Homo sapiens
gaaggaauggugcg

SEQ ID NO: 1606753 - RNA, 14 nt, Homo sapiens
gaaggaauuauucc

SEQ ID NO: 1606754 - RNA, 12 nt, Homo sapiens
gaaggacuauca

SEQ ID NO: 1606755 - RNA, 18 nt, Homo sapiens
gaaggagugcgugccugc

SEQ ID NO: 1606756 - RNA, 13 nt, Homo sapiens
gaaggauuaccug

SEQ ID NO: 1606757 - RNA, 16 nt, Homo sapiens
gaaggcaaaagaaaga

SEQ ID NO: 1606758 - RNA, 23 nt, Homo sapiens
gaaggcacagcuaaccacuucgc

SEQ ID NO: 1606759 - RNA, 14 nt, Homo sapiens
gaaggccagcugaa

SEQ ID NO: 1606760 - RNA, 14 nt, Homo sapiens
gaaggcuaugggga

SEQ ID NO: 1606761 - RNA, 15 nt, Homo sapiens
gaagggcaauaucua

SEQ ID NO: 1606762 - RNA, 15 nt, Homo sapiens
gaagggguuccucaa

SEQ ID NO: 1606763 - RNA, 13 nt, Homo sapiens
gaaggucaccagc

SEQ ID NO: 1606764 - RNA, 15 nt, Homo sapiens
gaaggucacuacugc

SEQ ID NO: 1606765 - RNA, 14 nt, Homo sapiens
gaaguaaaagcaaa

SEQ ID NO: 1606766 - RNA, 20 nt, Homo sapiens
gaaguacagcagaagcccca

SEQ ID NO: 1606767 - RNA, 19 nt, Homo sapiens
gaaguacucauacauguua

SEQ ID NO: 1606768 - RNA, 18 nt, Homo sapiens
gaaguaggcauauaucac

SEQ ID NO: 1606769 - RNA, 14 nt, Homo sapiens
gaagucaucauucc

SEQ ID NO: 1606770 - RNA, 15 nt, Homo sapiens
gaaguccagaacaag

SEQ ID NO: 1606771 - RNA, 19 nt, Homo sapiens
gaagucgaggcugcaguca

SEQ ID NO: 1606772 - RNA, 22 nt, Homo sapiens
gaagucgggcaugguggcucau

SEQ ID NO: 1606773 - RNA, 15 nt, Homo sapiens
gaagucuaacgcuga

SEQ ID NO: 1606774 - RNA, 19 nt, Homo sapiens
gaagucucaggagucucug

SEQ ID NO: 1606775 - RNA, 17 nt, Homo sapiens
gaagugcagcagguuaa

SEQ ID NO: 1606776 - RNA, 11 nt, Homo sapiens
gaagugcuugc

SEQ ID NO: 1606777 - RNA, 15 nt, Homo sapiens
gaaguggucucccca

SEQ ID NO: 1606778 - RNA, 17 nt, Homo sapiens
gaagugugggucugugu

SEQ ID NO: 1606779 - RNA, 20 nt, Homo sapiens
gaaguuaacaugaacucuug

SEQ ID NO: 1606780 - RNA, 19 nt, Homo sapiens
gaaguugugcuaaaccaag

SEQ ID NO: 1606781 - RNA, 17 nt, Homo sapiens
gaauaaaauugccucuc

SEQ ID NO: 1606782 - RNA, 19 nt, Homo sapiens
gaauaaagaugguccaaaa

SEQ ID NO: 1606783 - RNA, 22 nt, Homo sapiens
gaauaaagccuuugaugcacaa

SEQ ID NO: 1606784 - RNA, 18 nt, Homo sapiens
gaauaaauggagauucag

SEQ ID NO: 1606785 - RNA, 19 nt, Homo sapiens
gaauaacauuuaaauucca

SEQ ID NO: 1606786 - RNA, 21 nt, Homo sapiens
gaauaacauuuaaauuccaca

SEQ ID NO: 1606787 - RNA, 19 nt, Homo sapiens
gaauaaguaccuuuguguc

SEQ ID NO: 1606788 - RNA, 15 nt, Homo sapiens
gaauaaugcuguuuu

SEQ ID NO: 1606789 - RNA, 14 nt, Homo sapiens
gaauacauugcaau

SEQ ID NO: 1606790 - RNA, 17 nt, Homo sapiens
gaauacugcauuuacag

SEQ ID NO: 1606791 - RNA, 23 nt, Homo sapiens
gaauagaaauaaaggaugugauu

SEQ ID NO: 1606792 - RNA, 15 nt, Homo sapiens
gaauagccuggccac

SEQ ID NO: 1606793 - RNA, 17 nt, Homo sapiens
gaauauaaaacagucau

SEQ ID NO: 1606794 - RNA, 18 nt, Homo sapiens
gaauauaaggaaagcaau

SEQ ID NO: 1606795 - RNA, 23 nt, Homo sapiens
gaauauauggcauuugcagauuu

SEQ ID NO: 1606796 - RNA, 21 nt, Homo sapiens
gaauaugauaaaacacugccc

SEQ ID NO: 1606797 - RNA, 19 nt, Homo sapiens
gaauaugaucaaaccuuca

SEQ ID NO: 1606798 - RNA, 21 nt, Homo sapiens
gaauauguguguccuuuuaau

SEQ ID NO: 1606799 - RNA, 12 nt, Homo sapiens
gaaucaagcaau

SEQ ID NO: 1606800 - RNA, 23 nt, Homo sapiens
gaaucaagguaagcucaggauau

SEQ ID NO: 1606801 - RNA, 19 nt, Homo sapiens
gaaucaccccucugccccu

SEQ ID NO: 1606802 - RNA, 18 nt, Homo sapiens
gaaucacuuaagccugga

SEQ ID NO: 1606803 - RNA, 18 nt, Homo sapiens
gaaucagacuucacacug

SEQ ID NO: 1606804 - RNA, 20 nt, Homo sapiens
gaaucauacuuaacauuuca

SEQ ID NO: 1606805 - RNA, 21 nt, Homo sapiens
gaaucauacuuaacauuucau

SEQ ID NO: 1606806 - RNA, 18 nt, Homo sapiens
gaaucauauucauaugca

SEQ ID NO: 1606807 - RNA, 17 nt, Homo sapiens
gaaucaugaaguaaauu

SEQ ID NO: 1606808 - RNA, 16 nt, Homo sapiens
gaaucccccuugccac

SEQ ID NO: 1606809 - RNA, 21 nt, Homo sapiens
gaauccuggaccaagcacaaa

SEQ ID NO: 1606810 - RNA, 15 nt, Homo sapiens
gaaucuagagcaaag

SEQ ID NO: 1606811 - RNA, 21 nt, Homo sapiens
gaaucugugugaaacuuucau

SEQ ID NO: 1606812 - RNA, 17 nt, Homo sapiens
gaaucugugugcauauu

SEQ ID NO: 1606813 - RNA, 17 nt, Homo sapiens
gaaucuuuguaccaaaa

SEQ ID NO: 1606814 - RNA, 16 nt, Homo sapiens
gaaugacaacaccugg

SEQ ID NO: 1606815 - RNA, 15 nt, Homo sapiens
gaaugacugacaaag

SEQ ID NO: 1606816 - RNA, 15 nt, Homo sapiens
gaaugacuuacuuuc

SEQ ID NO: 1606817 - RNA, 16 nt, Homo sapiens
gaaugaugcucaaaau

SEQ ID NO: 1606818 - RNA, 20 nt, Homo sapiens
gaaugcggccgcauucccug

SEQ ID NO: 1606819 - RNA, 11 nt, Homo sapiens
gaaugcuuaau

SEQ ID NO: 1606820 - RNA, 15 nt, Homo sapiens
gaaugcuuaauucaa

SEQ ID NO: 1606821 - RNA, 17 nt, Homo sapiens
gaauggagcucaggucc

SEQ ID NO: 1606822 - RNA, 15 nt, Homo sapiens
gaauggaggcuccca

SEQ ID NO: 1606823 - RNA, 13 nt, Homo sapiens
gaauggcaauaaa

SEQ ID NO: 1606824 - RNA, 18 nt, Homo sapiens
gaaugguguuguaugccu

SEQ ID NO: 1606825 - RNA, 16 nt, Homo sapiens
gaaugguguuuuguca

SEQ ID NO: 1606826 - RNA, 19 nt, Homo sapiens
gaauguuauccaacuauua

SEQ ID NO: 1606827 - RNA, 12 nt, Homo sapiens
gaauguugcauu

SEQ ID NO: 1606828 - RNA, 20 nt, Homo sapiens
gaauguuuucaaauguucuc

SEQ ID NO: 1606829 - RNA, 13 nt, Homo sapiens
gaauuaagcagaa

SEQ ID NO: 1606830 - RNA, 21 nt, Homo sapiens
gaauuaggcuguaacuacuuu

SEQ ID NO: 1606831 - RNA, 15 nt, Homo sapiens
gaauucacgccucuc

SEQ ID NO: 1606832 - RNA, 21 nt, Homo sapiens
gaauucuaaauaaauuuccca

SEQ ID NO: 1606833 - RNA, 15 nt, Homo sapiens
gaauucuacuggaaa

SEQ ID NO: 1606834 - RNA, 14 nt, Homo sapiens
gaauugaccaaaua

SEQ ID NO: 1606835 - RNA, 22 nt, Homo sapiens
gaauugauauugaaugauguga

SEQ ID NO: 1606836 - RNA, 14 nt, Homo sapiens
gaauugaugaugca

SEQ ID NO: 1606837 - RNA, 16 nt, Homo sapiens
gaauugcgcucagggg

SEQ ID NO: 1606838 - RNA, 22 nt, Homo sapiens
gaauugcuccugcaugcaacua

SEQ ID NO: 1606839 - RNA, 16 nt, Homo sapiens
gagaucucccuucuca

SEQ ID NO: 1606840 - RNA, 12 nt, Homo sapiens
gagaucugcaca

SEQ ID NO: 1606841 - RNA, 21 nt, Homo sapiens
gagaucuuucuuuccaaaaca

SEQ ID NO: 1606842 - RNA, 17 nt, Homo sapiens
gagaugaagccuaagaa

SEQ ID NO: 1606843 - RNA, 15 nt, Homo sapiens
gagaugaccagggau

SEQ ID NO: 1606844 - RNA, 13 nt, Homo sapiens
gagaugcagcuac

SEQ ID NO: 1606845 - RNA, 18 nt, Homo sapiens
gagaugcagcuacuggaa

SEQ ID NO: 1606846 - RNA, 21 nt, Homo sapiens
gagaugcuucucuccuugccc

SEQ ID NO: 1606847 - RNA, 15 nt, Homo sapiens
gagauggccaugcuc

SEQ ID NO: 1606848 - RNA, 21 nt, Homo sapiens
gagaugggagaaucacuugaa

SEQ ID NO: 1606849 - RNA, 12 nt, Homo sapiens
gagauggucaca

SEQ ID NO: 1606850 - RNA, 20 nt, Homo sapiens
gagauugcacuauugcacuc

SEQ ID NO: 1606851 - RNA, 15 nt, Homo sapiens
gagauuggauuugcu

SEQ ID NO: 1606852 - RNA, 18 nt, Homo sapiens
gagauugugguggugcua

SEQ ID NO: 1606853 - RNA, 17 nt, Homo sapiens
gagauuucaucugcucu

SEQ ID NO: 1606854 - RNA, 18 nt, Homo sapiens
gagauuucuuguugcuca

SEQ ID NO: 1606855 - RNA, 12 nt, Homo sapiens
gagcaaacagaa

SEQ ID NO: 1606856 - RNA, 16 nt, Homo sapiens
gagcaaacagcuguau

SEQ ID NO: 1606857 - RNA, 23 nt, Homo sapiens
gagcaaacuaacuugacuuuuaa

SEQ ID NO: 1606858 - RNA, 13 nt, Homo sapiens
gagcaaauaacua

SEQ ID NO: 1606859 - RNA, 21 nt, Homo sapiens
gagcaaucagaauugugcuuu

SEQ ID NO: 1606860 - RNA, 16 nt, Homo sapiens
gagcacccauuccaaa

SEQ ID NO: 1606861 - RNA, 16 nt, Homo sapiens
gagcacuugagaacca

SEQ ID NO: 1606862 - RNA, 19 nt, Homo sapiens
gagcagaagcuggaggcac

SEQ ID NO: 1606863 - RNA, 13 nt, Homo sapiens
gagcagcauuccc

SEQ ID NO: 1606864 - RNA, 12 nt, Homo sapiens
gagcagccugug

SEQ ID NO: 1606865 - RNA, 18 nt, Homo sapiens
gagcaggaccuacuagga

SEQ ID NO: 1606866 - RNA, 14 nt, Homo sapiens
gagcaggcuacugu

SEQ ID NO: 1606867 - RNA, 13 nt, Homo sapiens
gagcaggguccug

SEQ ID NO: 1606868 - RNA, 21 nt, Homo sapiens
gagcagugaaugauucagugu

SEQ ID NO: 1606869 - RNA, 18 nt, Homo sapiens
gagcaucacuagugacaa

SEQ ID NO: 1606870 - RNA, 22 nt, Homo sapiens
gagcaucccccaccuacucuca

SEQ ID NO: 1606871 - RNA, 20 nt, Homo sapiens
gagcaugcucaguuggugcu

SEQ ID NO: 1606872 - RNA, 16 nt, Homo sapiens
gagcauggaugcauuu

SEQ ID NO: 1606873 - RNA, 22 nt, Homo sapiens
gagccaagaucgcaccacugca

SEQ ID NO: 1606874 - RNA, 19 nt, Homo sapiens
gagccaccgcgcccggccu

SEQ ID NO: 1606875 - RNA, 17 nt, Homo sapiens
gagccagcggcuccaac

SEQ ID NO: 1606876 - RNA, 20 nt, Homo sapiens
gagccaguccuccacucgac

SEQ ID NO: 1606877 - RNA, 21 nt, Homo sapiens
gagccaugauuucccacugca

SEQ ID NO: 1606878 - RNA, 15 nt, Homo sapiens
gagcccauucccacc

SEQ ID NO: 1606879 - RNA, 15 nt, Homo sapiens
gagcccccaccggaa

SEQ ID NO: 1606880 - RNA, 15 nt, Homo sapiens
gagcccccauuccac

SEQ ID NO: 1606881 - RNA, 14 nt, Homo sapiens
gagccccccuagca

SEQ ID NO: 1606882 - RNA, 21 nt, Homo sapiens
gagccucacuggggcagacaa

SEQ ID NO: 1606883 - RNA, 14 nt, Homo sapiens
gagccucauccagc

SEQ ID NO: 1606884 - RNA, 15 nt, Homo sapiens
gagccugguccuucc

SEQ ID NO: 1606885 - RNA, 12 nt, Homo sapiens
gagcgacaguga

SEQ ID NO: 1606886 - RNA, 16 nt, Homo sapiens
gagcggaagagcaugu

SEQ ID NO: 1606887 - RNA, 13 nt, Homo sapiens
gagcuagaaccua

SEQ ID NO: 1606888 - RNA, 19 nt, Homo sapiens
gagcuauuuuccucuggcc

SEQ ID NO: 1606889 - RNA, 21 nt, Homo sapiens
gagcucacaugggacugggau

SEQ ID NO: 1606890 - RNA, 14 nt, Homo sapiens
gagcugcugaguga

SEQ ID NO: 1606891 - RNA, 17 nt, Homo sapiens
gagcuggccuccuaugc

SEQ ID NO: 1606892 - RNA, 14 nt, Homo sapiens
gagcugucaccucu

SEQ ID NO: 1606893 - RNA, 19 nt, Homo sapiens
gagcuguguaaauacuuca

SEQ ID NO: 1606894 - RNA, 15 nt, Homo sapiens
gagcuuaaucuuuga

SEQ ID NO: 1606895 - RNA, 18 nt, Homo sapiens
gagcuucauauaccagca

SEQ ID NO: 1606896 - RNA, 18 nt, Homo sapiens
gagcuugggcaauuuauc

SEQ ID NO: 1606897 - RNA, 22 nt, Homo sapiens
gaggaaaaggccccugcaaugu

SEQ ID NO: 1606898 - RNA, 15 nt, Homo sapiens
gaggaaucagcucaa

SEQ ID NO: 1606899 - RNA, 17 nt, Homo sapiens
gaggacaggaaaggccc

SEQ ID NO: 1606900 - RNA, 22 nt, Homo sapiens
gaggacaugcaugacacuucca

SEQ ID NO: 1606901 - RNA, 16 nt, Homo sapiens
gaggagccaccaguuc

SEQ ID NO: 1606902 - RNA, 16 nt, Homo sapiens
gaggagcuggaaccau

SEQ ID NO: 1606903 - RNA, 14 nt, Homo sapiens
gaggaggccuccau

SEQ ID NO: 1606904 - RNA, 16 nt, Homo sapiens
gaggagggagugcugu

SEQ ID NO: 1606905 - RNA, 15 nt, Homo sapiens
gaggaguaccgccag

SEQ ID NO: 1606906 - RNA, 19 nt, Homo sapiens
gaggaguccagcacaaccu

SEQ ID NO: 1606907 - RNA, 22 nt, Homo sapiens
gaggcaagguugggcuggugcu

SEQ ID NO: 1606908 - RNA, 21 nt, Homo sapiens
gaggcaagugugggggguccu

SEQ ID NO: 1606909 - RNA, 19 nt, Homo sapiens
gaggcaaugugggaucuca

SEQ ID NO: 1606910 - RNA, 20 nt, Homo sapiens
gaggcagagguugcagugag

SEQ ID NO: 1606911 - RNA, 20 nt, Homo sapiens
gaggcaggagagucacuuga

SEQ ID NO: 1606912 - RNA, 17 nt, Homo sapiens
gaggcauacacacagca

SEQ ID NO: 1606913 - RNA, 20 nt, Homo sapiens
gaggcauagaauacacauuu

SEQ ID NO: 1606914 - RNA, 12 nt, Homo sapiens
gaggccacagaa

SEQ ID NO: 1606915 - RNA, 13 nt, Homo sapiens
gaggccacagaau

SEQ ID NO: 1606916 - RNA, 13 nt, Homo sapiens
gaggccacuguuu

SEQ ID NO: 1606917 - RNA, 12 nt, Homo sapiens
gaggccaucuca

SEQ ID NO: 1606918 - RNA, 17 nt, Homo sapiens
gaggccauucuuuccca

SEQ ID NO: 1606919 - RNA, 10 nt, Homo sapiens
gaggcccaaa

SEQ ID NO: 1606920 - RNA, 18 nt, Homo sapiens
gaggccgaggcgggugga

SEQ ID NO: 1606921 - RNA, 14 nt, Homo sapiens
gaggcucaaaaacu

SEQ ID NO: 1606922 - RNA, 17 nt, Homo sapiens
gaggcugaggcacuggc

SEQ ID NO: 1606923 - RNA, 16 nt, Homo sapiens
gaggcugccccucuca

SEQ ID NO: 1606924 - RNA, 20 nt, Homo sapiens
gaggcugggccccugggaug

SEQ ID NO: 1606925 - RNA, 16 nt, Homo sapiens
gagggaaaacagaaaa

SEQ ID NO: 1606926 - RNA, 14 nt, Homo sapiens
gagggaagcagugu

SEQ ID NO: 1606927 - RNA, 15 nt, Homo sapiens
gagggagagggaggu

SEQ ID NO: 1606928 - RNA, 16 nt, Homo sapiens
gagggcccagcccaga

SEQ ID NO: 1606929 - RNA, 19 nt, Homo sapiens
gaggggacucaaacagucu

SEQ ID NO: 1606930 - RNA, 21 nt, Homo sapiens
gaggggggggugggugagaga

SEQ ID NO: 1606931 - RNA, 16 nt, Homo sapiens
gagggguguaccuaaa

SEQ ID NO: 1606932 - RNA, 21 nt, Homo sapiens
gagggugggaaggaaacaacc

SEQ ID NO: 1606933 - RNA, 13 nt, Homo sapiens
gagguaaagggug

SEQ ID NO: 1606934 - RNA, 20 nt, Homo sapiens
gaggugggguacauuucucu

SEQ ID NO: 1606935 - RNA, 14 nt, Homo sapiens
gagguuacagugau

SEQ ID NO: 1606936 - RNA, 14 nt, Homo sapiens
gaguaaaacuguau

SEQ ID NO: 1606937 - RNA, 21 nt, Homo sapiens
gaguaaaacuguauaaacaaa

SEQ ID NO: 1606938 - RNA, 17 nt, Homo sapiens
gaguacacucagccacu

SEQ ID NO: 1606939 - RNA, 16 nt, Homo sapiens
gaguagggaguucauc

SEQ ID NO: 1606940 - RNA, 13 nt, Homo sapiens
gaguauaccauga

SEQ ID NO: 1606941 - RNA, 22 nt, Homo sapiens
gagucaauccccucauucagga

SEQ ID NO: 1606942 - RNA, 13 nt, Homo sapiens
gagucaccaggaa

SEQ ID NO: 1606943 - RNA, 16 nt, Homo sapiens
gagucagaucuuucuc

SEQ ID NO: 1606944 - RNA, 13 nt, Homo sapiens
gagucaugaugaa

SEQ ID NO: 1606945 - RNA, 18 nt, Homo sapiens
gagucauggcuaauuuaa

SEQ ID NO: 1606946 - RNA, 21 nt, Homo sapiens
gagucauggcuaauuuaacac

SEQ ID NO: 1606947 - RNA, 16 nt, Homo sapiens
gagucauugacuucau

SEQ ID NO: 1606948 - RNA, 21 nt, Homo sapiens
gaguccagaaugguacacaau

SEQ ID NO: 1606949 - RNA, 23 nt, Homo sapiens
gaguccagccccuccucccucag

SEQ ID NO: 1606950 - RNA, 11 nt, Homo sapiens
gagucucugau

SEQ ID NO: 1606951 - RNA, 17 nt, Homo sapiens
gagucugggcacaagug

SEQ ID NO: 1606952 - RNA, 10 nt, Homo sapiens
gagucuucac

SEQ ID NO: 1606953 - RNA, 16 nt, Homo sapiens
gagucuuguguucacc

SEQ ID NO: 1606954 - RNA, 19 nt, Homo sapiens
gagugagacuccaucucaa

SEQ ID NO: 1606955 - RNA, 11 nt, Homo sapiens
gagugcacaug

SEQ ID NO: 1606956 - RNA, 19 nt, Homo sapiens
gagugcaguggugugaucu

SEQ ID NO: 1606957 - RNA, 22 nt, Homo sapiens
gaguguuccccuuccacugagg

SEQ ID NO: 1606958 - RNA, 20 nt, Homo sapiens
gguuuauuuucauucugcca

SEQ ID NO: 1606959 - RNA, 14 nt, Homo sapiens
gguuuccacugucu

SEQ ID NO: 1606960 - RNA, 16 nt, Homo sapiens
gguuuuacugucaagu

SEQ ID NO: 1606961 - RNA, 15 nt, Homo sapiens
gguuuucauuugcca

SEQ ID NO: 1606962 - RNA, 20 nt, Homo sapiens
gguuuuguuuuuuuucagcc

SEQ ID NO: 1606963 - RNA, 22 nt, Homo sapiens
guaaaaaaguaugcuuguuaau

SEQ ID NO: 1606964 - RNA, 13 nt, Homo sapiens
guaaaacagucau

SEQ ID NO: 1606965 - RNA, 16 nt, Homo sapiens
guaaaacaguuucauc

SEQ ID NO: 1606966 - RNA, 15 nt, Homo sapiens
guaaaacauuacuua

SEQ ID NO: 1606967 - RNA, 16 nt, Homo sapiens
guaaaaccacagcagu

SEQ ID NO: 1606968 - RNA, 12 nt, Homo sapiens
guaaaacuguau

SEQ ID NO: 1606969 - RNA, 16 nt, Homo sapiens
guaaaaugaggccgga

SEQ ID NO: 1606970 - RNA, 19 nt, Homo sapiens
guaaaaugcaccaaucagc

SEQ ID NO: 1606971 - RNA, 19 nt, Homo sapiens
guaaaaugcacccaucagc

SEQ ID NO: 1606972 - RNA, 20 nt, Homo sapiens
guaaagaacguggucagagu

SEQ ID NO: 1606973 - RNA, 18 nt, Homo sapiens
guaaagacugguuuucug

SEQ ID NO: 1606974 - RNA, 17 nt, Homo sapiens
guaaaggaaacauauuu

SEQ ID NO: 1606975 - RNA, 13 nt, Homo sapiens
guaaagugccuua

SEQ ID NO: 1606976 - RNA, 22 nt, Homo sapiens
guaaauagggaaaauaaucuca

SEQ ID NO: 1606977 - RNA, 23 nt, Homo sapiens
guaaaugugacauugauuugcuc

SEQ ID NO: 1606978 - RNA, 18 nt, Homo sapiens
guaaauguguuagcacug

SEQ ID NO: 1606979 - RNA, 19 nt, Homo sapiens
guaaauuauauuugugcua

SEQ ID NO: 1606980 - RNA, 13 nt, Homo sapiens
guaacuaacacac

SEQ ID NO: 1606981 - RNA, 17 nt, Homo sapiens
guaacuccccucaggga

SEQ ID NO: 1606982 - RNA, 14 nt, Homo sapiens
guaacugaaggugu

SEQ ID NO: 1606983 - RNA, 19 nt, Homo sapiens
guaacugcagaaacauaac

SEQ ID NO: 1606984 - RNA, 18 nt, Homo sapiens
guaagaaagugaagcaaa

SEQ ID NO: 1606985 - RNA, 17 nt, Homo sapiens
guaagacagugcccuga

SEQ ID NO: 1606986 - RNA, 17 nt, Homo sapiens
guaagagaacacaaucu

SEQ ID NO: 1606987 - RNA, 14 nt, Homo sapiens
guaagcaacuugcu

SEQ ID NO: 1606988 - RNA, 22 nt, Homo sapiens
guaagcauuuccagccuaucua

SEQ ID NO: 1606989 - RNA, 19 nt, Homo sapiens
guaagcauuuguacaucuu

SEQ ID NO: 1606990 - RNA, 15 nt, Homo sapiens
guaaggcacacccaa

SEQ ID NO: 1606991 - RNA, 15 nt, Homo sapiens
guaagggaaacugcc

SEQ ID NO: 1606992 - RNA, 17 nt, Homo sapiens
guaagggaaacugccag

SEQ ID NO: 1606993 - RNA, 20 nt, Homo sapiens
guaagguguguacucagggc

SEQ ID NO: 1606994 - RNA, 18 nt, Homo sapiens
guaaguaaacagauuuga

SEQ ID NO: 1606995 - RNA, 20 nt, Homo sapiens
guaaguauuuccauagucaa

SEQ ID NO: 1606996 - RNA, 18 nt, Homo sapiens
guaauaaagugaacuuug

SEQ ID NO: 1606997 - RNA, 21 nt, Homo sapiens
guaauaaguaucacacuguau

SEQ ID NO: 1606998 - RNA, 13 nt, Homo sapiens
guaauacaaacua

SEQ ID NO: 1606999 - RNA, 15 nt, Homo sapiens
guaauacaucaaaga

SEQ ID NO: 1607000 - RNA, 16 nt, Homo sapiens
guaauacaucaaagag

SEQ ID NO: 1607001 - RNA, 19 nt, Homo sapiens
guaauacguagcucucuua

SEQ ID NO: 1607002 - RNA, 20 nt, Homo sapiens
guaauacuuuacaaaccauu

SEQ ID NO: 1607003 - RNA, 16 nt, Homo sapiens
guaauaguucuauccu

SEQ ID NO: 1607004 - RNA, 18 nt, Homo sapiens
guaauauuggcauagaaa

SEQ ID NO: 1607005 - RNA, 22 nt, Homo sapiens
guaauccuguacaauugcauca

SEQ ID NO: 1607006 - RNA, 14 nt, Homo sapiens
guaaucuaaguaua

SEQ ID NO: 1607007 - RNA, 15 nt, Homo sapiens
guaaucucagcacuu

SEQ ID NO: 1607008 - RNA, 14 nt, Homo sapiens
guaaugauacugau

SEQ ID NO: 1607009 - RNA, 19 nt, Homo sapiens
guaauggaacuuagccauu

SEQ ID NO: 1607010 - RNA, 11 nt, Homo sapiens
guaauggagca

SEQ ID NO: 1607011 - RNA, 15 nt, Homo sapiens
guaauguucauuucc

SEQ ID NO: 1607012 - RNA, 19 nt, Homo sapiens
guaauuuauuaacuaauca

SEQ ID NO: 1607013 - RNA, 16 nt, Homo sapiens
guaauuucgccuuaaa

SEQ ID NO: 1607014 - RNA, 15 nt, Homo sapiens
guaauuuugcaaaac

SEQ ID NO: 1607015 - RNA, 21 nt, Homo sapiens
guacaaaagaagggcugguau

SEQ ID NO: 1607016 - RNA, 22 nt, Homo sapiens
guacaauuucaacuacagugau

SEQ ID NO: 1607017 - RNA, 15 nt, Homo sapiens
guacagcugcucuua

SEQ ID NO: 1607018 - RNA, 21 nt, Homo sapiens
guacaguauguuuuacaugua

SEQ ID NO: 1607019 - RNA, 14 nt, Homo sapiens
guacaguugagcuc

SEQ ID NO: 1607020 - RNA, 17 nt, Homo sapiens
guacaugguguuugugg

SEQ ID NO: 1607021 - RNA, 20 nt, Homo sapiens
guacauucuuccaucaucac

SEQ ID NO: 1607022 - RNA, 17 nt, Homo sapiens
guacauuguauucuguu

SEQ ID NO: 1607023 - RNA, 13 nt, Homo sapiens
guaccgacuuuga

SEQ ID NO: 1607024 - RNA, 14 nt, Homo sapiens
guaccgucuucucc

SEQ ID NO: 1607025 - RNA, 13 nt, Homo sapiens
guacggauuuguc

SEQ ID NO: 1607026 - RNA, 17 nt, Homo sapiens
guacggcugguguguca

SEQ ID NO: 1607027 - RNA, 19 nt, Homo sapiens
guacuacagcuauauuuga

SEQ ID NO: 1607028 - RNA, 18 nt, Homo sapiens
guacuaguacuauugcua

SEQ ID NO: 1607029 - RNA, 22 nt, Homo sapiens
guacuaugucugaacauagaaa

SEQ ID NO: 1607030 - RNA, 16 nt, Homo sapiens
guacuauuacuauuac

SEQ ID NO: 1607031 - RNA, 11 nt, Homo sapiens
guacucagggc

SEQ ID NO: 1607032 - RNA, 19 nt, Homo sapiens
guacucuucugacugcccc

SEQ ID NO: 1607033 - RNA, 18 nt, Homo sapiens
guacugaaagccuuaggg

SEQ ID NO: 1607034 - RNA, 20 nt, Homo sapiens
guacuucuucauccauagac

SEQ ID NO: 1607035 - RNA, 19 nt, Homo sapiens
guagaaaagggaacugaac

SEQ ID NO: 1607036 - RNA, 13 nt, Homo sapiens
guagaaaaugagg

SEQ ID NO: 1607037 - RNA, 14 nt, Homo sapiens
guagaacucacaga

SEQ ID NO: 1607038 - RNA, 20 nt, Homo sapiens
guagagacgguguuuugcca

SEQ ID NO: 1607039 - RNA, 20 nt, Homo sapiens
guagaggggagacauuagaa

SEQ ID NO: 1607040 - RNA, 13 nt, Homo sapiens
guagaugacaaau

SEQ ID NO: 1607041 - RNA, 20 nt, Homo sapiens
guagaugacaaauauucuga

SEQ ID NO: 1607042 - RNA, 21 nt, Homo sapiens
guagauuacugaaaaaugcaa

SEQ ID NO: 1607043 - RNA, 17 nt, Homo sapiens
guagcaaauguuuacug

SEQ ID NO: 1607044 - RNA, 11 nt, Homo sapiens
guagcuuccca

SEQ ID NO: 1607045 - RNA, 14 nt, Homo sapiens
guaggaacugcugg

SEQ ID NO: 1607046 - RNA, 17 nt, Homo sapiens
guaggcacaagaccaag

SEQ ID NO: 1607047 - RNA, 15 nt, Homo sapiens
guagguaauguuccu

SEQ ID NO: 1607048 - RNA, 17 nt, Homo sapiens
guaggugucugccuuca

SEQ ID NO: 1607049 - RNA, 21 nt, Homo sapiens
guagucucuccccuggccaca

SEQ ID NO: 1607050 - RNA, 15 nt, Homo sapiens
guagugccacuguug

SEQ ID NO: 1607051 - RNA, 14 nt, Homo sapiens
guaguuauucugcc

SEQ ID NO: 1607052 - RNA, 17 nt, Homo sapiens
guaguuguuggucugua

SEQ ID NO: 1607053 - RNA, 20 nt, Homo sapiens
guaguuguuggucuguagca

SEQ ID NO: 1607054 - RNA, 15 nt, Homo sapiens
guauaauacuuugua

SEQ ID NO: 1607055 - RNA, 22 nt, Homo sapiens
guauaauagagauaaguccauu

SEQ ID NO: 1607056 - RNA, 16 nt, Homo sapiens
guauacauacauguau

SEQ ID NO: 1607057 - RNA, 22 nt, Homo sapiens
guauacuuuaguagacauuuau

SEQ ID NO: 1607058 - RNA, 13 nt, Homo sapiens
guauauccaaaag

SEQ ID NO: 1607059 - RNA, 18 nt, Homo sapiens
guauauuacaaugaucac

SEQ ID NO: 1607060 - RNA, 14 nt, Homo sapiens
guaucaaaugugac

SEQ ID NO: 1607061 - RNA, 21 nt, Homo sapiens
guaucaaaugugacauuauau

SEQ ID NO: 1607062 - RNA, 12 nt, Homo sapiens
guauccaaagga

SEQ ID NO: 1607063 - RNA, 18 nt, Homo sapiens
guaucuauucuucugacc

SEQ ID NO: 1607064 - RNA, 22 nt, Homo sapiens
guaugcaugcacaaacaugugu

SEQ ID NO: 1607065 - RNA, 17 nt, Homo sapiens
guaugguauaugcacaa

SEQ ID NO: 1607066 - RNA, 16 nt, Homo sapiens
guaugucagugucacu

SEQ ID NO: 1607067 - RNA, 18 nt, Homo sapiens
guauuaaauuagauaucu

SEQ ID NO: 1607068 - RNA, 14 nt, Homo sapiens
guauuaauaccaaa

SEQ ID NO: 1607069 - RNA, 20 nt, Homo sapiens
guauuaccuggucauuucaa

SEQ ID NO: 1607070 - RNA, 19 nt, Homo sapiens
guauucaacuaauacaugg

SEQ ID NO: 1607071 - RNA, 18 nt, Homo sapiens
guauucagagucucugau

SEQ ID NO: 1607072 - RNA, 19 nt, Homo sapiens
guauuccucaugucaucaa

SEQ ID NO: 1607073 - RNA, 16 nt, Homo sapiens
guauucucuuccucau

SEQ ID NO: 1607074 - RNA, 19 nt, Homo sapiens
guauucuuaaaaugcaaua

SEQ ID NO: 1607075 - RNA, 22 nt, Homo sapiens
guauucuugagggacaaugcca

SEQ ID NO: 1607076 - RNA, 22 nt, Homo sapiens
guugagcuucauauaccagcaa

SEQ ID NO: 1607077 - RNA, 21 nt, Homo sapiens
guugagggcccuucacuucca

SEQ ID NO: 1607078 - RNA, 15 nt, Homo sapiens
guugauacuugaaua

SEQ ID NO: 1607079 - RNA, 16 nt, Homo sapiens
guugauagacugcuac

SEQ ID NO: 1607080 - RNA, 22 nt, Homo sapiens
guugcacccagcccuggucuca

SEQ ID NO: 1607081 - RNA, 13 nt, Homo sapiens
guugcaucauguu

SEQ ID NO: 1607082 - RNA, 19 nt, Homo sapiens
guugcauuuaugaugcagu

SEQ ID NO: 1607083 - RNA, 20 nt, Homo sapiens
guugccacaguagaacuguc

SEQ ID NO: 1607084 - RNA, 21 nt, Homo sapiens
guugcccgaaacuaagccagg

SEQ ID NO: 1607085 - RNA, 17 nt, Homo sapiens
guugccuaagcauugcc

SEQ ID NO: 1607086 - RNA, 15 nt, Homo sapiens
guugcugcaucuccc

SEQ ID NO: 1607087 - RNA, 15 nt, Homo sapiens
guugcuuuuuuucca

SEQ ID NO: 1607088 - RNA, 20 nt, Homo sapiens
guuggacuucagucuugccu

SEQ ID NO: 1607089 - RNA, 17 nt, Homo sapiens
guugggcuuccaugccu

SEQ ID NO: 1607090 - RNA, 18 nt, Homo sapiens
guuggucaggcgcagugg

SEQ ID NO: 1607091 - RNA, 14 nt, Homo sapiens
guugguucaucccu

SEQ ID NO: 1607092 - RNA, 14 nt, Homo sapiens
guugucaccaagcu

SEQ ID NO: 1607093 - RNA, 14 nt, Homo sapiens
guugucaggccaua

SEQ ID NO: 1607094 - RNA, 15 nt, Homo sapiens
guugucgaacaguag

SEQ ID NO: 1607095 - RNA, 13 nt, Homo sapiens
guugugcagcauu

SEQ ID NO: 1607096 - RNA, 16 nt, Homo sapiens
guuguuaaaaauguca

SEQ ID NO: 1607097 - RNA, 15 nt, Homo sapiens
guuguugacugugau

SEQ ID NO: 1607098 - RNA, 20 nt, Homo sapiens
guuguuugguuagugacuga

SEQ ID NO: 1607099 - RNA, 14 nt, Homo sapiens
guuuaaacccaagu

SEQ ID NO: 1607100 - RNA, 19 nt, Homo sapiens
guuuaaaguggcaaucuca

SEQ ID NO: 1607101 - RNA, 16 nt, Homo sapiens
guuuaaccuguuuuca

SEQ ID NO: 1607102 - RNA, 20 nt, Homo sapiens
guuuaagcccagccaaguaa

SEQ ID NO: 1607103 - RNA, 14 nt, Homo sapiens
guuuaagucauuuu

SEQ ID NO: 1607104 - RNA, 18 nt, Homo sapiens
guuuaaugggcacagggu

SEQ ID NO: 1607105 - RNA, 15 nt, Homo sapiens
guuuacagcacuacu

SEQ ID NO: 1607106 - RNA, 17 nt, Homo sapiens
guuuacagcacuacucu

SEQ ID NO: 1607107 - RNA, 19 nt, Homo sapiens
guuuaccuggugcucucaa

SEQ ID NO: 1607108 - RNA, 17 nt, Homo sapiens
guuuaguuuuacauuuu

SEQ ID NO: 1607109 - RNA, 14 nt, Homo sapiens
guuuaucagcaaaa

SEQ ID NO: 1607110 - RNA, 18 nt, Homo sapiens
guuuauuaaauugcaaga

SEQ ID NO: 1607111 - RNA, 11 nt, Homo sapiens
guuuauuccaa

SEQ ID NO: 1607112 - RNA, 16 nt, Homo sapiens
guuuauugaaugugau

SEQ ID NO: 1607113 - RNA, 12 nt, Homo sapiens
guuucaacagag

SEQ ID NO: 1607114 - RNA, 20 nt, Homo sapiens
guuucaccauauuggucacg

SEQ ID NO: 1607115 - RNA, 22 nt, Homo sapiens
guuucauauugaugugugucua

SEQ ID NO: 1607116 - RNA, 21 nt, Homo sapiens
guuucccaucagacugucaag

SEQ ID NO: 1607117 - RNA, 23 nt, Homo sapiens
guuuccgaaggguuuugcuacau

SEQ ID NO: 1607118 - RNA, 11 nt, Homo sapiens
guuuccugaca

SEQ ID NO: 1607119 - RNA, 12 nt, Homo sapiens
guuuccugguca

SEQ ID NO: 1607120 - RNA, 22 nt, Homo sapiens
guuucuacacauugcuaccuca

SEQ ID NO: 1607121 - RNA, 19 nt, Homo sapiens
guuucucccccugccaguc

SEQ ID NO: 1607122 - RNA, 14 nt, Homo sapiens
guuucuggaauuga

SEQ ID NO: 1607123 - RNA, 13 nt, Homo sapiens
guuucugucaagc

SEQ ID NO: 1607124 - RNA, 23 nt, Homo sapiens
guuucuugcucccagaccaaggc

SEQ ID NO: 1607125 - RNA, 20 nt, Homo sapiens
guuugaauggagauucugau

SEQ ID NO: 1607126 - RNA, 14 nt, Homo sapiens
guuugauauggaga

SEQ ID NO: 1607127 - RNA, 21 nt, Homo sapiens
guuugccaagcuaaucugccu

SEQ ID NO: 1607128 - RNA, 16 nt, Homo sapiens
guuugcuaauguuucc

SEQ ID NO: 1607129 - RNA, 14 nt, Homo sapiens
guuugcugugaaca

SEQ ID NO: 1607130 - RNA, 17 nt, Homo sapiens
guuuggacagcugauaa

SEQ ID NO: 1607131 - RNA, 22 nt, Homo sapiens
guuuggauugauaucgugaaau

SEQ ID NO: 1607132 - RNA, 14 nt, Homo sapiens
guuuguagugaaau

SEQ ID NO: 1607133 - RNA, 17 nt, Homo sapiens
guuugugggacuggguu

SEQ ID NO: 1607134 - RNA, 20 nt, Homo sapiens
guuuguuacugucauuccca

SEQ ID NO: 1607135 - RNA, 12 nt, Homo sapiens
guuuuaacugua

SEQ ID NO: 1607136 - RNA, 20 nt, Homo sapiens
guuuuacagagcuaauuguc

SEQ ID NO: 1607137 - RNA, 13 nt, Homo sapiens
guuuuacagcugc

SEQ ID NO: 1607138 - RNA, 12 nt, Homo sapiens
guuuuagcugua

SEQ ID NO: 1607139 - RNA, 15 nt, Homo sapiens
guuuuauaauuuaau

SEQ ID NO: 1607140 - RNA, 21 nt, Homo sapiens
guuuuauucugacuuccucug

SEQ ID NO: 1607141 - RNA, 18 nt, Homo sapiens
guuuucagcccaucuccu

SEQ ID NO: 1607142 - RNA, 15 nt, Homo sapiens
guuuucaggcuauca

SEQ ID NO: 1607143 - RNA, 14 nt, Homo sapiens
guuuucauuaucuc

SEQ ID NO: 1607144 - RNA, 13 nt, Homo sapiens
guuuuccaaagag

SEQ ID NO: 1607145 - RNA, 15 nt, Homo sapiens
guuuuccacugugcu

SEQ ID NO: 1607146 - RNA, 23 nt, Homo sapiens
guuuuccaguucaucgauuuucu

SEQ ID NO: 1607147 - RNA, 18 nt, Homo sapiens
guuuuccccaaaccauaa

SEQ ID NO: 1607148 - RNA, 17 nt, Homo sapiens
guuuucuuucucaccca

SEQ ID NO: 1607149 - RNA, 15 nt, Homo sapiens
guuuugcuacauucu

SEQ ID NO: 1607150 - RNA, 16 nt, Homo sapiens
guuuugucaaacugua

SEQ ID NO: 1607151 - RNA, 14 nt, Homo sapiens
guuuugugugguau

SEQ ID NO: 1607152 - RNA, 15 nt, Homo sapiens
guuuuuaacauguca

SEQ ID NO: 1607153 - RNA, 15 nt, Homo sapiens
guuuuuagugcugac

SEQ ID NO: 1607154 - RNA, 18 nt, Homo sapiens
guuuuucauucacuuuaa

SEQ ID NO: 1607155 - RNA, 15 nt, Homo sapiens
guuuuucuggugcuu

SEQ ID NO: 1607156 - RNA, 17 nt, Homo sapiens
guuuuuguuuuuugcca

SEQ ID NO: 1607157 - RNA, 18 nt, Homo sapiens
guuuuuguuuuuugccau

SEQ ID NO: 1607158 - RNA, 12 nt, Homo sapiens
guuuuuugccau

SEQ ID NO: 1607159 - RNA, 22 nt, Homo sapiens
guuuuuuuucagccacuaagaa

SEQ ID NO: 1607160 - RNA, 22 nt, Homo sapiens
uaaaaaaaagaaucaccaaauc

SEQ ID NO: 1607161 - RNA, 18 nt, Homo sapiens
uaaaaaaauuuuaauucc

SEQ ID NO: 1607162 - RNA, 22 nt, Homo sapiens
uaaaaacaacaaaaacaaacaa

SEQ ID NO: 1607163 - RNA, 22 nt, Homo sapiens
uaaaaagaaacaaaaucuauaa

SEQ ID NO: 1607164 - RNA, 19 nt, Homo sapiens
uaaaaagcaacaggccauu

SEQ ID NO: 1607165 - RNA, 17 nt, Homo sapiens
uaaaaagcuucagggaa

SEQ ID NO: 1607166 - RNA, 14 nt, Homo sapiens
uaaaaagcuuccau

SEQ ID NO: 1607167 - RNA, 12 nt, Homo sapiens
uaaaaaggaaua

SEQ ID NO: 1607168 - RNA, 16 nt, Homo sapiens
uaaaaagguuggccuu

SEQ ID NO: 1607169 - RNA, 13 nt, Homo sapiens
uaaaaagguuuaa

SEQ ID NO: 1607170 - RNA, 12 nt, Homo sapiens
uaaaaaguaaug

SEQ ID NO: 1607171 - RNA, 13 nt, Homo sapiens
uaaaaauagacac

SEQ ID NO: 1607172 - RNA, 17 nt, Homo sapiens
uaaaaauagucuuccac

SEQ ID NO: 1607173 - RNA, 19 nt, Homo sapiens
uaaaaauauaaauuguaca

SEQ ID NO: 1607174 - RNA, 18 nt, Homo sapiens
uaaaaaucacuuucauaa

SEQ ID NO: 1607175 - RNA, 18 nt, Homo sapiens
uaaaaaucauaguacucu

SEQ ID NO: 1607176 - RNA, 16 nt, Homo sapiens
uaaaaaugaaaauucu

SEQ ID NO: 1607177 - RNA, 16 nt, Homo sapiens
uaaaaaugucaucuca

SEQ ID NO: 1607178 - RNA, 15 nt, Homo sapiens
uaaaacaaaaccaac

SEQ ID NO: 1607179 - RNA, 17 nt, Homo sapiens
uaaaacaaaauuugacu

SEQ ID NO: 1607180 - RNA, 16 nt, Homo sapiens
uaaaacaauaauaaua

SEQ ID NO: 1607181 - RNA, 15 nt, Homo sapiens
uaaaacacaccaauc

SEQ ID NO: 1607182 - RNA, 16 nt, Homo sapiens
uaaaacacaccaauca

SEQ ID NO: 1607183 - RNA, 21 nt, Homo sapiens
uaaaacagguuauaacagugu

SEQ ID NO: 1607184 - RNA, 22 nt, Homo sapiens
uaaaacagguuauaacaguguu

SEQ ID NO: 1607185 - RNA, 12 nt, Homo sapiens
uaaaacagucau

SEQ ID NO: 1607186 - RNA, 17 nt, Homo sapiens
uaaaaccaaacaugcuu

SEQ ID NO: 1607187 - RNA, 14 nt, Homo sapiens
uaaaaccacagcag

SEQ ID NO: 1607188 - RNA, 16 nt, Homo sapiens
uaaaacgcaccaauca

SEQ ID NO: 1607189 - RNA, 17 nt, Homo sapiens
uaaaacggugcugugag

SEQ ID NO: 1607190 - RNA, 18 nt, Homo sapiens
uaaaacuaaggcuuuuau

SEQ ID NO: 1607191 - RNA, 20 nt, Homo sapiens
uaaaacucacugugaucaau

SEQ ID NO: 1607192 - RNA, 21 nt, Homo sapiens
uaaaacugcgaggacaucaaa

SEQ ID NO: 1607193 - RNA, 17 nt, Homo sapiens
uaaaacuuaacauucau

SEQ ID NO: 1607194 - RNA, 14 nt, Homo sapiens
uaaaagacaugcau

SEQ ID NO: 1607195 - RNA, 13 nt, Homo sapiens
uacagacucugau

SEQ ID NO: 1607196 - RNA, 17 nt, Homo sapiens
uacagacucugauucua

SEQ ID NO: 1607197 - RNA, 15 nt, Homo sapiens
uacagagcuaauugu

SEQ ID NO: 1607198 - RNA, 14 nt, Homo sapiens
uacagaggacagua

SEQ ID NO: 1607199 - RNA, 17 nt, Homo sapiens
uacagaggcugacuuca

SEQ ID NO: 1607200 - RNA, 21 nt, Homo sapiens
uacagauagaaaauaugauau

SEQ ID NO: 1607201 - RNA, 14 nt, Homo sapiens
uacagcacuacucu

SEQ ID NO: 1607202 - RNA, 16 nt, Homo sapiens
uacagcacuacucugu

SEQ ID NO: 1607203 - RNA, 16 nt, Homo sapiens
uacagcuccuuugaaa

SEQ ID NO: 1607204 - RNA, 14 nt, Homo sapiens
uacagcuucaguga

SEQ ID NO: 1607205 - RNA, 17 nt, Homo sapiens
uacaggaagcaccccau

SEQ ID NO: 1607206 - RNA, 19 nt, Homo sapiens
uacaggagaugcugucacu

SEQ ID NO: 1607207 - RNA, 19 nt, Homo sapiens
uacaggaggcagacaauga

SEQ ID NO: 1607208 - RNA, 14 nt, Homo sapiens
uacaggcgugagcc

SEQ ID NO: 1607209 - RNA, 20 nt, Homo sapiens
uacagggacacuaucacuca

SEQ ID NO: 1607210 - RNA, 18 nt, Homo sapiens
uacaggugaaggcucuca

SEQ ID NO: 1607211 - RNA, 22 nt, Homo sapiens
uacaguaggagcccagcucuga

SEQ ID NO: 1607212 - RNA, 18 nt, Homo sapiens
uacagucugucaugaaca

SEQ ID NO: 1607213 - RNA, 16 nt, Homo sapiens
uacagugauagagcaa

SEQ ID NO: 1607214 - RNA, 17 nt, Homo sapiens
uacagugcagagccuuc

SEQ ID NO: 1607215 - RNA, 17 nt, Homo sapiens
uacaguguccuaccacu

SEQ ID NO: 1607216 - RNA, 23 nt, Homo sapiens
uacaguguccuaccacucuaauc

SEQ ID NO: 1607217 - RNA, 17 nt, Homo sapiens
uacaguuacaguugaug

SEQ ID NO: 1607218 - RNA, 17 nt, Homo sapiens
uacaguuagcagggaug

SEQ ID NO: 1607219 - RNA, 20 nt, Homo sapiens
uacaguucugggguacaugu

SEQ ID NO: 1607220 - RNA, 17 nt, Homo sapiens
uacaguucugugguuuc

SEQ ID NO: 1607221 - RNA, 16 nt, Homo sapiens
uacauacuauggaauu

SEQ ID NO: 1607222 - RNA, 13 nt, Homo sapiens
uacauagcauuaa

SEQ ID NO: 1607223 - RNA, 13 nt, Homo sapiens
uacauauuaucuc

SEQ ID NO: 1607224 - RNA, 15 nt, Homo sapiens
uacauauuaucucau

SEQ ID NO: 1607225 - RNA, 17 nt, Homo sapiens
uacaucaguuuguuccu

SEQ ID NO: 1607226 - RNA, 14 nt, Homo sapiens
uacauccucugaua

SEQ ID NO: 1607227 - RNA, 21 nt, Homo sapiens
uacaucuuaaaucuuuucaau

SEQ ID NO: 1607228 - RNA, 21 nt, Homo sapiens
uacaucuuuuuuucuaugaaa

SEQ ID NO: 1607229 - RNA, 16 nt, Homo sapiens
uacaugcacagucaua

SEQ ID NO: 1607230 - RNA, 19 nt, Homo sapiens
uacaugcagcccaugccca

SEQ ID NO: 1607231 - RNA, 17 nt, Homo sapiens
uacaugcauaaacuaaa

SEQ ID NO: 1607232 - RNA, 21 nt, Homo sapiens
uacaugucuagagaacacugu

SEQ ID NO: 1607233 - RNA, 23 nt, Homo sapiens
uacaugugauugugauucaucau

SEQ ID NO: 1607234 - RNA, 21 nt, Homo sapiens
uacauguuuauauuaaucucu

SEQ ID NO: 1607235 - RNA, 11 nt, Homo sapiens
uacauucuucc

SEQ ID NO: 1607236 - RNA, 12 nt, Homo sapiens
uacauucuucca

SEQ ID NO: 1607237 - RNA, 17 nt, Homo sapiens
uacauugaguagacaca

SEQ ID NO: 1607238 - RNA, 23 nt, Homo sapiens
uacauugcuuaaaauauauagug

SEQ ID NO: 1607239 - RNA, 20 nt, Homo sapiens
uacauuguauuaauaccaaa

SEQ ID NO: 1607240 - RNA, 19 nt, Homo sapiens
uacauuuaauagacuuaca

SEQ ID NO: 1607241 - RNA, 15 nt, Homo sapiens
uacauuuauaaucua

SEQ ID NO: 1607242 - RNA, 17 nt, Homo sapiens
uacauuugagccauguc

SEQ ID NO: 1607243 - RNA, 14 nt, Homo sapiens
uacauuugcaauua

SEQ ID NO: 1607244 - RNA, 19 nt, Homo sapiens
uacauuuuauuaagcuuuu

SEQ ID NO: 1607245 - RNA, 19 nt, Homo sapiens
uacauuuuguaaaauauua

SEQ ID NO: 1607246 - RNA, 21 nt, Homo sapiens
uacauuuuuugggcagcaauu

SEQ ID NO: 1607247 - RNA, 23 nt, Homo sapiens
uacauuuuuugggcagcaauuua

SEQ ID NO: 1607248 - RNA, 20 nt, Homo sapiens
uaccaaaaacaagucuauaa

SEQ ID NO: 1607249 - RNA, 23 nt, Homo sapiens
uaccaaaaauuuugugacauucc

SEQ ID NO: 1607250 - RNA, 14 nt, Homo sapiens
uaccaaagcaucaa

SEQ ID NO: 1607251 - RNA, 21 nt, Homo sapiens
uaccaaaguguuuggucauuu

SEQ ID NO: 1607252 - RNA, 23 nt, Homo sapiens
uaccaaaguguuuggucauuuua

SEQ ID NO: 1607253 - RNA, 19 nt, Homo sapiens
uaccaagaacagagucuca

SEQ ID NO: 1607254 - RNA, 22 nt, Homo sapiens
uaccaagugcuuccuacaaaga

SEQ ID NO: 1607255 - RNA, 17 nt, Homo sapiens
uaccacaagccugagaa

SEQ ID NO: 1607256 - RNA, 15 nt, Homo sapiens
uaccacucuaaucaa

SEQ ID NO: 1607257 - RNA, 19 nt, Homo sapiens
uaccacugauuuggagaua

SEQ ID NO: 1607258 - RNA, 23 nt, Homo sapiens
uaccagaacgguucuuugaccag

SEQ ID NO: 1607259 - RNA, 23 nt, Homo sapiens
uaccagaaggaaagcacuaagaa

SEQ ID NO: 1607260 - RNA, 18 nt, Homo sapiens
uaccaggcagccuaugaa

SEQ ID NO: 1607261 - RNA, 17 nt, Homo sapiens
uaccaguauaagcaucu

SEQ ID NO: 1607262 - RNA, 13 nt, Homo sapiens
uaccagugugcuu

SEQ ID NO: 1607263 - RNA, 15 nt, Homo sapiens
uaccaguuuuccaga

SEQ ID NO: 1607264 - RNA, 18 nt, Homo sapiens
uaccaguuuuccagaaca

SEQ ID NO: 1607265 - RNA, 14 nt, Homo sapiens
uaccccaguuccua

SEQ ID NO: 1607266 - RNA, 16 nt, Homo sapiens
uacccccccuccugcu

SEQ ID NO: 1607267 - RNA, 15 nt, Homo sapiens
uaccccugcucccau

SEQ ID NO: 1607268 - RNA, 16 nt, Homo sapiens
uacccuauacauccac

SEQ ID NO: 1607269 - RNA, 12 nt, Homo sapiens
uacccucccacc

SEQ ID NO: 1607270 - RNA, 23 nt, Homo sapiens
uacccugacacaagaaguucuug

SEQ ID NO: 1607271 - RNA, 18 nt, Homo sapiens
uaccggacacucgucacc

SEQ ID NO: 1607272 - RNA, 16 nt, Homo sapiens
uaccuaaugaaaguga

SEQ ID NO: 1607273 - RNA, 14 nt, Homo sapiens
uaccuagcacuuua

SEQ ID NO: 1607274 - RNA, 20 nt, Homo sapiens
uaccuaggcaccaucauuua

SEQ ID NO: 1607275 - RNA, 18 nt, Homo sapiens
uaccucagaaagauuuga

SEQ ID NO: 1607276 - RNA, 14 nt, Homo sapiens
uaccuccugagaaa

SEQ ID NO: 1607277 - RNA, 14 nt, Homo sapiens
uaccugacacuccc

SEQ ID NO: 1607278 - RNA, 13 nt, Homo sapiens
uaccugagcauuc

SEQ ID NO: 1607279 - RNA, 14 nt, Homo sapiens
uaccugcacacugu

SEQ ID NO: 1607280 - RNA, 21 nt, Homo sapiens
uaccuggugcucucaacagga

SEQ ID NO: 1607281 - RNA, 22 nt, Homo sapiens
uaccuggugcucucaacaggac

SEQ ID NO: 1607282 - RNA, 17 nt, Homo sapiens
uaccuguguauuuggaa

SEQ ID NO: 1607283 - RNA, 13 nt, Homo sapiens
uacgaaccaugcc

SEQ ID NO: 1607284 - RNA, 18 nt, Homo sapiens
uacggcuggugugucaua

SEQ ID NO: 1607285 - RNA, 20 nt, Homo sapiens
uacguucaucaccugcuaga

SEQ ID NO: 1607286 - RNA, 18 nt, Homo sapiens
uacguuuuucuggugcuu

SEQ ID NO: 1607287 - RNA, 17 nt, Homo sapiens
uacuaaauuacaaaugc

SEQ ID NO: 1607288 - RNA, 20 nt, Homo sapiens
uacuaaauuacaaaugcaau

SEQ ID NO: 1607289 - RNA, 15 nt, Homo sapiens
uacuaaggagcauga

SEQ ID NO: 1607290 - RNA, 12 nt, Homo sapiens
uacuaaugaagu

SEQ ID NO: 1607291 - RNA, 17 nt, Homo sapiens
uacuacauuccaaagaa

SEQ ID NO: 1607292 - RNA, 21 nt, Homo sapiens
uacuagccagcacaaaaggca

SEQ ID NO: 1607293 - RNA, 19 nt, Homo sapiens
uacuaggagaggggggcca

SEQ ID NO: 1607294 - RNA, 22 nt, Homo sapiens
uacuauaaucaaaugauuucau

SEQ ID NO: 1607295 - RNA, 21 nt, Homo sapiens
uacuauccuguaaauauaucu

SEQ ID NO: 1607296 - RNA, 18 nt, Homo sapiens
uacuaugacacuguuaau

SEQ ID NO: 1607297 - RNA, 15 nt, Homo sapiens
uacuauuaacucugc

SEQ ID NO: 1607298 - RNA, 16 nt, Homo sapiens
uacuauuaacucugca

SEQ ID NO: 1607299 - RNA, 22 nt, Homo sapiens
uacucaagcagaucucaucuca

SEQ ID NO: 1607300 - RNA, 16 nt, Homo sapiens
uacucaggaaccucac

SEQ ID NO: 1607301 - RNA, 17 nt, Homo sapiens
uacucaggaaccucacc

SEQ ID NO: 1607302 - RNA, 14 nt, Homo sapiens
uacucccagcacuu

SEQ ID NO: 1607303 - RNA, 22 nt, Homo sapiens
uacuccgcggagugaucaugga

SEQ ID NO: 1607304 - RNA, 14 nt, Homo sapiens
uacucugcagugau

SEQ ID NO: 1607305 - RNA, 18 nt, Homo sapiens
uacucuuaaaugagaaag

SEQ ID NO: 1607306 - RNA, 15 nt, Homo sapiens
uacugcaucccagcc

SEQ ID NO: 1607307 - RNA, 19 nt, Homo sapiens
uacuggaaaaaaauacaaa

SEQ ID NO: 1607308 - RNA, 23 nt, Homo sapiens
uacuggaaaaaaauacaaaaagc

SEQ ID NO: 1607309 - RNA, 23 nt, Homo sapiens
uacuggaaugguguuuugucaga

SEQ ID NO: 1607310 - RNA, 17 nt, Homo sapiens
uacugggacugugcuca

SEQ ID NO: 1607311 - RNA, 23 nt, Homo sapiens
uacugucaaacaauaaagggaga

SEQ ID NO: 1607312 - RNA, 21 nt, Homo sapiens
uacugucuuacuauuauagca

SEQ ID NO: 1607313 - RNA, 16 nt, Homo sapiens
uauuacauauuuacac

SEQ ID NO: 1607314 - RNA, 17 nt, Homo sapiens
uauuacauuuucaguga

SEQ ID NO: 1607315 - RNA, 16 nt, Homo sapiens
uauuaccauuacuugu

SEQ ID NO: 1607316 - RNA, 17 nt, Homo sapiens
uauuagcauggcauauu

SEQ ID NO: 1607317 - RNA, 17 nt, Homo sapiens
uauuauaacucauuugu

SEQ ID NO: 1607318 - RNA, 17 nt, Homo sapiens
uauuauaagugcuucac

SEQ ID NO: 1607319 - RNA, 17 nt, Homo sapiens
uauuauacgcuggcaac

SEQ ID NO: 1607320 - RNA, 14 nt, Homo sapiens
uauuaugcuggaau

SEQ ID NO: 1607321 - RNA, 20 nt, Homo sapiens
uauuauuuguguuuccuaaa

SEQ ID NO: 1607322 - RNA, 14 nt, Homo sapiens
uauucaauacacag

SEQ ID NO: 1607323 - RNA, 18 nt, Homo sapiens
uauucagagucucugaua

SEQ ID NO: 1607324 - RNA, 17 nt, Homo sapiens
uauucauggauggcuca

SEQ ID NO: 1607325 - RNA, 18 nt, Homo sapiens
uauucauggauggcucaa

SEQ ID NO: 1607326 - RNA, 23 nt, Homo sapiens
uauucccccaaacuuuuuguuca

SEQ ID NO: 1607327 - RNA, 14 nt, Homo sapiens
uauuccuaugcugc

SEQ ID NO: 1607328 - RNA, 15 nt, Homo sapiens
uauuccuaugcugca

SEQ ID NO: 1607329 - RNA, 14 nt, Homo sapiens
uauuccucagugag

SEQ ID NO: 1607330 - RNA, 15 nt, Homo sapiens
uauucuaaagcugcc

SEQ ID NO: 1607331 - RNA, 23 nt, Homo sapiens
uauucuguuuuguuaauauaccc

SEQ ID NO: 1607332 - RNA, 17 nt, Homo sapiens
uauucuuacuaaucuga

SEQ ID NO: 1607333 - RNA, 22 nt, Homo sapiens
uauugaaaugauuucacagugu

SEQ ID NO: 1607334 - RNA, 20 nt, Homo sapiens
uauugaaugaugugauacaa

SEQ ID NO: 1607335 - RNA, 19 nt, Homo sapiens
uauugacagcgauauaauu

SEQ ID NO: 1607336 - RNA, 17 nt, Homo sapiens
uauugagcagaauucau

SEQ ID NO: 1607337 - RNA, 14 nt, Homo sapiens
uauugagugugauu

SEQ ID NO: 1607338 - RNA, 20 nt, Homo sapiens
uauugauuuuaaauggaugu

SEQ ID NO: 1607339 - RNA, 15 nt, Homo sapiens
uauugcagcuuauau

SEQ ID NO: 1607340 - RNA, 18 nt, Homo sapiens
uauugcauuuauauguac

SEQ ID NO: 1607341 - RNA, 12 nt, Homo sapiens
uauugcuaguac

SEQ ID NO: 1607342 - RNA, 19 nt, Homo sapiens
uauugcuuaccugaucuca

SEQ ID NO: 1607343 - RNA, 14 nt, Homo sapiens
uauuggucacguca

SEQ ID NO: 1607344 - RNA, 14 nt, Homo sapiens
uauugguuugcaca

SEQ ID NO: 1607345 - RNA, 17 nt, Homo sapiens
uauugucauugucacaa

SEQ ID NO: 1607346 - RNA, 16 nt, Homo sapiens
uauugucgcuauguga

SEQ ID NO: 1607347 - RNA, 21 nt, Homo sapiens
uauugucgguuaccucugcau

SEQ ID NO: 1607348 - RNA, 22 nt, Homo sapiens
uauugucugucucuauauugcu

SEQ ID NO: 1607349 - RNA, 16 nt, Homo sapiens
uauuguuucaauugca

SEQ ID NO: 1607350 - RNA, 15 nt, Homo sapiens
uauuuaaacucgcuc

SEQ ID NO: 1607351 - RNA, 23 nt, Homo sapiens
uauuuaaaucauuuuaacuucua

SEQ ID NO: 1607352 - RNA, 15 nt, Homo sapiens
uauuuacacuccucu

SEQ ID NO: 1607353 - RNA, 15 nt, Homo sapiens
uauuuacaugugauu

SEQ ID NO: 1607354 - RNA, 16 nt, Homo sapiens
uauuuaccuagugcaa

SEQ ID NO: 1607355 - RNA, 12 nt, Homo sapiens
uauuuaccugaa

SEQ ID NO: 1607356 - RNA, 22 nt, Homo sapiens
uauuuagaagccaacuaugauu

SEQ ID NO: 1607357 - RNA, 17 nt, Homo sapiens
uauuuaucaaguguauu

SEQ ID NO: 1607358 - RNA, 22 nt, Homo sapiens
uauuuauguuguugaacuaaua

SEQ ID NO: 1607359 - RNA, 22 nt, Homo sapiens
uauuucaagugccuagacuguu

SEQ ID NO: 1607360 - RNA, 19 nt, Homo sapiens
uauuucaauaaaucuuuca

SEQ ID NO: 1607361 - RNA, 11 nt, Homo sapiens
uauuucacuua

SEQ ID NO: 1607362 - RNA, 20 nt, Homo sapiens
uauuucacuuaaacuuuguc

SEQ ID NO: 1607363 - RNA, 16 nt, Homo sapiens
uauuucauccaguuug

SEQ ID NO: 1607364 - RNA, 16 nt, Homo sapiens
uauuuccaaaagcaca

SEQ ID NO: 1607365 - RNA, 17 nt, Homo sapiens
uauuuccucugugcaaa

SEQ ID NO: 1607366 - RNA, 22 nt, Homo sapiens
uauuuccuuaaauguuuugcca

SEQ ID NO: 1607367 - RNA, 16 nt, Homo sapiens
uauuucuccuuugcaa

SEQ ID NO: 1607368 - RNA, 23 nt, Homo sapiens
uauuucuucaaauaaaucucucc

SEQ ID NO: 1607369 - RNA, 17 nt, Homo sapiens
uauuucuuccuaccaag

SEQ ID NO: 1607370 - RNA, 23 nt, Homo sapiens
uauuucuugaagaauaaauucua

SEQ ID NO: 1607371 - RNA, 21 nt, Homo sapiens
uauuucuuuuagaaaaggcca

SEQ ID NO: 1607372 - RNA, 15 nt, Homo sapiens
uauuugcaguaugaa

SEQ ID NO: 1607373 - RNA, 17 nt, Homo sapiens
uauuugcuaaaugcugu

SEQ ID NO: 1607374 - RNA, 17 nt, Homo sapiens
uauuugcuuuaaugaga

SEQ ID NO: 1607375 - RNA, 12 nt, Homo sapiens
uauuuggcuuaa

SEQ ID NO: 1607376 - RNA, 13 nt, Homo sapiens
uauuugguacugu

SEQ ID NO: 1607377 - RNA, 23 nt, Homo sapiens
uauuugucuguaaaaaauggagc

SEQ ID NO: 1607378 - RNA, 20 nt, Homo sapiens
uauuuguuuuaauaccacag

SEQ ID NO: 1607379 - RNA, 18 nt, Homo sapiens
uauuuuaaccuguauacu

SEQ ID NO: 1607380 - RNA, 15 nt, Homo sapiens
uauuuuaagacguga

SEQ ID NO: 1607381 - RNA, 13 nt, Homo sapiens
uauuuuaaucacc

SEQ ID NO: 1607382 - RNA, 22 nt, Homo sapiens
uauuuuacaaucaacaaaaugg

SEQ ID NO: 1607383 - RNA, 22 nt, Homo sapiens
uauuuuagacacuucccugcau

SEQ ID NO: 1607384 - RNA, 23 nt, Homo sapiens
uauuuuauauaauaaaguauucc

SEQ ID NO: 1607385 - RNA, 17 nt, Homo sapiens
uauuuuauaucaauuua

SEQ ID NO: 1607386 - RNA, 17 nt, Homo sapiens
uauuuuaugaacauugu

SEQ ID NO: 1607387 - RNA, 23 nt, Homo sapiens
uauuuuggaggugcuugaucuau

SEQ ID NO: 1607388 - RNA, 19 nt, Homo sapiens
uauuuuuauaucaugcaaa

SEQ ID NO: 1607389 - RNA, 16 nt, Homo sapiens
uauuuuugaagacuau

SEQ ID NO: 1607390 - RNA, 16 nt, Homo sapiens
uauuuuuguacauuug

SEQ ID NO: 1607391 - RNA, 18 nt, Homo sapiens
uauuuuuuagugaugaga

SEQ ID NO: 1607392 - RNA, 18 nt, Homo sapiens
ucaaaaaagauagaucua

SEQ ID NO: 1607393 - RNA, 13 nt, Homo sapiens
ucaaaacagagaa

SEQ ID NO: 1607394 - RNA, 17 nt, Homo sapiens
ucaaaacucaaauguga

SEQ ID NO: 1607395 - RNA, 18 nt, Homo sapiens
ucaaaacuggagucccaa

SEQ ID NO: 1607396 - RNA, 19 nt, Homo sapiens
ucaaaacuguaaaaaucau

SEQ ID NO: 1607397 - RNA, 12 nt, Homo sapiens
ucaaaauacuuc

SEQ ID NO: 1607398 - RNA, 16 nt, Homo sapiens
ucaaaauauacauuca

SEQ ID NO: 1607399 - RNA, 22 nt, Homo sapiens
ucaaaaucugugaccugucaga

SEQ ID NO: 1607400 - RNA, 13 nt, Homo sapiens
ucaaaaucuuucc

SEQ ID NO: 1607401 - RNA, 14 nt, Homo sapiens
ucaaaauuacauau

SEQ ID NO: 1607402 - RNA, 16 nt, Homo sapiens
ucaaacauuauucuca

SEQ ID NO: 1607403 - RNA, 16 nt, Homo sapiens
ucaaaccaauuucaaa

SEQ ID NO: 1607404 - RNA, 14 nt, Homo sapiens
ucaaaccacaugga

SEQ ID NO: 1607405 - RNA, 22 nt, Homo sapiens
ucaaaccucugccgcccuccac

SEQ ID NO: 1607406 - RNA, 14 nt, Homo sapiens
ucaaacuacuggca

SEQ ID NO: 1607407 - RNA, 19 nt, Homo sapiens
ucaaacucccgaccucagg

SEQ ID NO: 1607408 - RNA, 12 nt, Homo sapiens
ucaaacucccua

SEQ ID NO: 1607409 - RNA, 20 nt, Homo sapiens
ucaaagcuuugacucuauaa

SEQ ID NO: 1607410 - RNA, 16 nt, Homo sapiens
ucaaaggaagacuuga

SEQ ID NO: 1607411 - RNA, 22 nt, Homo sapiens
ucaaagggagagagugcuauug

SEQ ID NO: 1607412 - RNA, 17 nt, Homo sapiens
ucaaaguacuacagcaa

SEQ ID NO: 1607413 - RNA, 21 nt, Homo sapiens
ucaaagugguaaauacuguga

SEQ ID NO: 1607414 - RNA, 16 nt, Homo sapiens
ucaaaguguaacagau

SEQ ID NO: 1607415 - RNA, 16 nt, Homo sapiens
ucaaauacaugcacag

SEQ ID NO: 1607416 - RNA, 20 nt, Homo sapiens
ucaaauacaugcacagucau

SEQ ID NO: 1607417 - RNA, 21 nt, Homo sapiens
ucaaauacuuagagcagugaa

SEQ ID NO: 1607418 - RNA, 19 nt, Homo sapiens
ucaaauaguugcauagcag

SEQ ID NO: 1607419 - RNA, 14 nt, Homo sapiens
ucaaauaugcaaag

SEQ ID NO: 1607420 - RNA, 16 nt, Homo sapiens
ucaaauauuccauucu

SEQ ID NO: 1607421 - RNA, 16 nt, Homo sapiens
ucaaaucaaaaacagg

SEQ ID NO: 1607422 - RNA, 21 nt, Homo sapiens
ucaaaugaauaaugccuuugu

SEQ ID NO: 1607423 - RNA, 15 nt, Homo sapiens
ucaaaugaucaauaa

SEQ ID NO: 1607424 - RNA, 13 nt, Homo sapiens
ucaaaugauuuca

SEQ ID NO: 1607425 - RNA, 12 nt, Homo sapiens
ucaaauguucuc

SEQ ID NO: 1607426 - RNA, 16 nt, Homo sapiens
ucaaauguuguucucu

SEQ ID NO: 1607427 - RNA, 21 nt, Homo sapiens
ucaaauguuuuaaaguuuaau

SEQ ID NO: 1607428 - RNA, 15 nt, Homo sapiens
ucaaauuacuaauga

SEQ ID NO: 1607429 - RNA, 17 nt, Homo sapiens
ucaaauucagcucugau

SEQ ID NO: 1607430 - RNA, 19 nt, Homo sapiens
ucaaauuccgagugcagaa

SEQ ID NO: 1607431 - RNA, 14 nt, Homo sapiens
ugcacaauauuucu

SEQ ID NO: 1607432 - RNA, 14 nt, Homo sapiens
ugcacaccuuggaa

SEQ ID NO: 1607433 - RNA, 20 nt, Homo sapiens
ugcacagagcaaguccucac

SEQ ID NO: 1607434 - RNA, 17 nt, Homo sapiens
ugcacagggauucucac

SEQ ID NO: 1607435 - RNA, 21 nt, Homo sapiens
ugcacagggcagcugggccca

SEQ ID NO: 1607436 - RNA, 23 nt, Homo sapiens
ugcacauaguagguacccaauuc

SEQ ID NO: 1607437 - RNA, 12 nt, Homo sapiens
ugcaccaaagac

SEQ ID NO: 1607438 - RNA, 18 nt, Homo sapiens
ugcaccaaagacaucagu

SEQ ID NO: 1607439 - RNA, 16 nt, Homo sapiens
ugcaccaagcaggaaa

SEQ ID NO: 1607440 - RNA, 19 nt, Homo sapiens
ugcacguugugcacaugua

SEQ ID NO: 1607441 - RNA, 14 nt, Homo sapiens
ugcacuagugcaau

SEQ ID NO: 1607442 - RNA, 19 nt, Homo sapiens
ugcacuccagccuggcaau

SEQ ID NO: 1607443 - RNA, 21 nt, Homo sapiens
ugcacuccagccugggggaca

SEQ ID NO: 1607444 - RNA, 18 nt, Homo sapiens
ugcacuccccguguucau

SEQ ID NO: 1607445 - RNA, 19 nt, Homo sapiens
ugcacuccccguguucaua

SEQ ID NO: 1607446 - RNA, 12 nt, Homo sapiens
ugcacugaacag

SEQ ID NO: 1607447 - RNA, 18 nt, Homo sapiens
ugcacuguaaauaucccu

SEQ ID NO: 1607448 - RNA, 18 nt, Homo sapiens
ugcacuuuaaauggaaua

SEQ ID NO: 1607449 - RNA, 12 nt, Homo sapiens
ugcacuuucuau

SEQ ID NO: 1607450 - RNA, 21 nt, Homo sapiens
ugcagaaaauucugugccuug

SEQ ID NO: 1607451 - RNA, 15 nt, Homo sapiens
ugcagaaaccuuuaa

SEQ ID NO: 1607452 - RNA, 23 nt, Homo sapiens
ugcagaacuuaaucuggacacac

SEQ ID NO: 1607453 - RNA, 14 nt, Homo sapiens
ugcagaagacagua

SEQ ID NO: 1607454 - RNA, 20 nt, Homo sapiens
ugcagaauuguuuuuugcuc

SEQ ID NO: 1607455 - RNA, 16 nt, Homo sapiens
ugcagacaacaccuuc

SEQ ID NO: 1607456 - RNA, 16 nt, Homo sapiens
ugcagaggcaccucaa

SEQ ID NO: 1607457 - RNA, 14 nt, Homo sapiens
ugcagauaucacag

SEQ ID NO: 1607458 - RNA, 23 nt, Homo sapiens
ugcagcaacucccacgacuguug

SEQ ID NO: 1607459 - RNA, 21 nt, Homo sapiens
ugcagcauuaaaaaaaaucaa

SEQ ID NO: 1607460 - RNA, 16 nt, Homo sapiens
ugcagccaccacaucc

SEQ ID NO: 1607461 - RNA, 21 nt, Homo sapiens
ugcagccaccacaucccuuca

SEQ ID NO: 1607462 - RNA, 18 nt, Homo sapiens
ugcagcuguaaacauauu

SEQ ID NO: 1607463 - RNA, 17 nt, Homo sapiens
ugcagcuucgaggacag

SEQ ID NO: 1607464 - RNA, 20 nt, Homo sapiens
ugcagcuucgaggacaggaa

SEQ ID NO: 1607465 - RNA, 13 nt, Homo sapiens
ugcagggagacau

SEQ ID NO: 1607466 - RNA, 17 nt, Homo sapiens
ugcagguucauggauua

SEQ ID NO: 1607467 - RNA, 14 nt, Homo sapiens
ugcaguaguauuua

SEQ ID NO: 1607468 - RNA, 16 nt, Homo sapiens
ugcaguaucucuuaca

SEQ ID NO: 1607469 - RNA, 14 nt, Homo sapiens
ugcagucacuggag

SEQ ID NO: 1607470 - RNA, 15 nt, Homo sapiens
ugcaguccauuuccu

SEQ ID NO: 1607471 - RNA, 16 nt, Homo sapiens
ugcaguggugccauca

SEQ ID NO: 1607472 - RNA, 18 nt, Homo sapiens
ugcaguggugccaucacc

SEQ ID NO: 1607473 - RNA, 17 nt, Homo sapiens
ugcaguggugugaucuc

SEQ ID NO: 1607474 - RNA, 16 nt, Homo sapiens
ugcaguuggacucuca

SEQ ID NO: 1607475 - RNA, 15 nt, Homo sapiens
ugcaguuucauguau

SEQ ID NO: 1607476 - RNA, 16 nt, Homo sapiens
ugcaguuucauguaug

SEQ ID NO: 1607477 - RNA, 20 nt, Homo sapiens
ugcaguuucuuuucacauua

SEQ ID NO: 1607478 - RNA, 14 nt, Homo sapiens
ugcaguuugaaauu

SEQ ID NO: 1607479 - RNA, 22 nt, Homo sapiens
ugcauaccuucgggguacaagu

SEQ ID NO: 1607480 - RNA, 19 nt, Homo sapiens
ugcauacuguaggucauuu

SEQ ID NO: 1607481 - RNA, 17 nt, Homo sapiens
ugcauagcaagugaaag

SEQ ID NO: 1607482 - RNA, 12 nt, Homo sapiens
ugcauaucauua

SEQ ID NO: 1607483 - RNA, 15 nt, Homo sapiens
ugcaucagcugcuga

SEQ ID NO: 1607484 - RNA, 19 nt, Homo sapiens
ugcaucauuaauaccuaaa

SEQ ID NO: 1607485 - RNA, 20 nt, Homo sapiens
ugcauccuuuucaaaaccua

SEQ ID NO: 1607486 - RNA, 16 nt, Homo sapiens
ugcaucuccccucaga

SEQ ID NO: 1607487 - RNA, 22 nt, Homo sapiens
ugcaucuccccucagauuccac

SEQ ID NO: 1607488 - RNA, 14 nt, Homo sapiens
ugcaucuguuacuu

SEQ ID NO: 1607489 - RNA, 21 nt, Homo sapiens
ugcaucuuuguuacuuccuua

SEQ ID NO: 1607490 - RNA, 23 nt, Homo sapiens
ugcaucuuuguuacuuccuuaug

SEQ ID NO: 1607491 - RNA, 17 nt, Homo sapiens
ugcaugauuuacucuua

SEQ ID NO: 1607492 - RNA, 14 nt, Homo sapiens
ugcaugcuugcaua

SEQ ID NO: 1607493 - RNA, 19 nt, Homo sapiens
ugcauguaauacacaguga

SEQ ID NO: 1607494 - RNA, 20 nt, Homo sapiens
ugcaugucugccuaugcacu

SEQ ID NO: 1607495 - RNA, 21 nt, Homo sapiens
ugcaugucugccuaugcacug

SEQ ID NO: 1607496 - RNA, 18 nt, Homo sapiens
ugcaugugcgucaccguc

SEQ ID NO: 1607497 - RNA, 14 nt, Homo sapiens
ugcauuauaucaaa

SEQ ID NO: 1607498 - RNA, 22 nt, Homo sapiens
ugcauucauuuuuauagcaaca

SEQ ID NO: 1607499 - RNA, 13 nt, Homo sapiens
ugcauuccagaac

SEQ ID NO: 1607500 - RNA, 16 nt, Homo sapiens
ugcauuccagaacaaa

SEQ ID NO: 1607501 - RNA, 13 nt, Homo sapiens
ugcauugagcucu

SEQ ID NO: 1607502 - RNA, 18 nt, Homo sapiens
ugcauugccaagugccau

SEQ ID NO: 1607503 - RNA, 18 nt, Homo sapiens
ugcauugguuuuccauga

SEQ ID NO: 1607504 - RNA, 13 nt, Homo sapiens
ugcauuuauagca

SEQ ID NO: 1607505 - RNA, 10 nt, Homo sapiens
ugcauuucau

SEQ ID NO: 1607506 - RNA, 19 nt, Homo sapiens
ugccaaaaaggauacauaa

SEQ ID NO: 1607507 - RNA, 15 nt, Homo sapiens
ugccaaaaaucuuuu

SEQ ID NO: 1607508 - RNA, 14 nt, Homo sapiens
ugccaaaaccaaac

SEQ ID NO: 1607509 - RNA, 16 nt, Homo sapiens
ugccaaaauauaauca

SEQ ID NO: 1607510 - RNA, 14 nt, Homo sapiens
ugccaaccagacac

SEQ ID NO: 1607511 - RNA, 13 nt, Homo sapiens
ugccaacugccag

SEQ ID NO: 1607512 - RNA, 18 nt, Homo sapiens
ugccaacuugauguucca

SEQ ID NO: 1607513 - RNA, 13 nt, Homo sapiens
ugccaagacuccu

SEQ ID NO: 1607514 - RNA, 19 nt, Homo sapiens
ugccaagggguuaaugaaa

SEQ ID NO: 1607515 - RNA, 13 nt, Homo sapiens
ugccaagugccau

SEQ ID NO: 1607516 - RNA, 15 nt, Homo sapiens
ugccaauacagacaa

SEQ ID NO: 1607517 - RNA, 20 nt, Homo sapiens
ugccaaugaacaucucaugu

SEQ ID NO: 1607518 - RNA, 19 nt, Homo sapiens
ugccacaguucacaugcca

SEQ ID NO: 1607519 - RNA, 15 nt, Homo sapiens
ugccacauacuugca

SEQ ID NO: 1607520 - RNA, 17 nt, Homo sapiens
ugccacucacacagcca

SEQ ID NO: 1607521 - RNA, 17 nt, Homo sapiens
ugccacuugucaaagaa

SEQ ID NO: 1607522 - RNA, 15 nt, Homo sapiens
ugccagcauuucccu

SEQ ID NO: 1607523 - RNA, 16 nt, Homo sapiens
ugccagccacugugau

SEQ ID NO: 1607524 - RNA, 23 nt, Homo sapiens
ugccaggugcaaucuacuggaaa

SEQ ID NO: 1607525 - RNA, 13 nt, Homo sapiens
ugccagugccuua

SEQ ID NO: 1607526 - RNA, 22 nt, Homo sapiens
ugccagugccuuaccuccugcc

SEQ ID NO: 1607527 - RNA, 15 nt, Homo sapiens
ugccaguuguggcag

SEQ ID NO: 1607528 - RNA, 19 nt, Homo sapiens
ugccauaucuucaggccau

SEQ ID NO: 1607529 - RNA, 20 nt, Homo sapiens
ugccaugccaggaaccuguc

SEQ ID NO: 1607530 - RNA, 20 nt, Homo sapiens
ugccauguaaaggccuuuaa

SEQ ID NO: 1607531 - RNA, 17 nt, Homo sapiens
ugccauugaaacuaaga

SEQ ID NO: 1607532 - RNA, 16 nt, Homo sapiens
ugccauugguuccuug

SEQ ID NO: 1607533 - RNA, 17 nt, Homo sapiens
ugccauuucugaacugu

SEQ ID NO: 1607534 - RNA, 16 nt, Homo sapiens
ugcccaaaaugugaag

SEQ ID NO: 1607535 - RNA, 18 nt, Homo sapiens
ugcccaccacaacuaaca

SEQ ID NO: 1607536 - RNA, 15 nt, Homo sapiens
ugcccagacuacagg

SEQ ID NO: 1607537 - RNA, 22 nt, Homo sapiens
ugcccagcccuggcccaggugc

SEQ ID NO: 1607538 - RNA, 14 nt, Homo sapiens
ugcccaggagacag

SEQ ID NO: 1607539 - RNA, 17 nt, Homo sapiens
ugcccaggccacagaga

SEQ ID NO: 1607540 - RNA, 21 nt, Homo sapiens
ugcccaggccucuggcuuuuu

SEQ ID NO: 1607541 - RNA, 22 nt, Homo sapiens
ugcccagggcugcgucugcaaa

SEQ ID NO: 1607542 - RNA, 16 nt, Homo sapiens
ugcccaggguuggcau

SEQ ID NO: 1607543 - RNA, 13 nt, Homo sapiens
ugcccauaauccc

SEQ ID NO: 1607544 - RNA, 22 nt, Homo sapiens
ugcccauaaucccagcacuuug

SEQ ID NO: 1607545 - RNA, 14 nt, Homo sapiens
ugcccaugggcuau

SEQ ID NO: 1607546 - RNA, 14 nt, Homo sapiens
ugcccauuccugcc

SEQ ID NO: 1607547 - RNA, 16 nt, Homo sapiens
ugccccaccccaucca

SEQ ID NO: 1607548 - RNA, 17 nt, Homo sapiens
ugcccccaccccgggga

SEQ ID NO: 1607549 - RNA, 17 nt, Homo sapiens
ugccccccaugaggaag

SEQ ID NO: 1607550 - RNA, 16 nt, Homo sapiens
uggauccugggucaaa

SEQ ID NO: 1607551 - RNA, 15 nt, Homo sapiens
uggaucuaccagcau

SEQ ID NO: 1607552 - RNA, 17 nt, Homo sapiens
uggaucuaccagcauaa

SEQ ID NO: 1607553 - RNA, 19 nt, Homo sapiens
uggaucuggggacugagug

SEQ ID NO: 1607554 - RNA, 23 nt, Homo sapiens
uggaucuggggugggaguaacag

SEQ ID NO: 1607555 - RNA, 21 nt, Homo sapiens
uggaugccauccaaguuguau

SEQ ID NO: 1607556 - RNA, 20 nt, Homo sapiens
uggaugcuggguccauauca

SEQ ID NO: 1607557 - RNA, 21 nt, Homo sapiens
uggaugcuggguccauaucac

SEQ ID NO: 1607558 - RNA, 13 nt, Homo sapiens
uggaugguucuca

SEQ ID NO: 1607559 - RNA, 17 nt, Homo sapiens
uggaugucaaacaguaa

SEQ ID NO: 1607560 - RNA, 16 nt, Homo sapiens
uggauuagaccaauua

SEQ ID NO: 1607561 - RNA, 16 nt, Homo sapiens
uggauugggggggcca

SEQ ID NO: 1607562 - RNA, 18 nt, Homo sapiens
uggauugggggggccaaa

SEQ ID NO: 1607563 - RNA, 23 nt, Homo sapiens
uggauugugccuaauguguuuga

SEQ ID NO: 1607564 - RNA, 15 nt, Homo sapiens
uggauuuaguuucag

SEQ ID NO: 1607565 - RNA, 23 nt, Homo sapiens
uggauuuaucccccgcaaagaca

SEQ ID NO: 1607566 - RNA, 17 nt, Homo sapiens
uggauuucauacuguaa

SEQ ID NO: 1607567 - RNA, 15 nt, Homo sapiens
uggauuuuuccuuaa

SEQ ID NO: 1607568 - RNA, 18 nt, Homo sapiens
uggcaaaaaggagccuuu

SEQ ID NO: 1607569 - RNA, 22 nt, Homo sapiens
uggcaaaaccaguagcuuccca

SEQ ID NO: 1607570 - RNA, 13 nt, Homo sapiens
uggcaaaagaaaa

SEQ ID NO: 1607571 - RNA, 14 nt, Homo sapiens
uggcaaaauugcca

SEQ ID NO: 1607572 - RNA, 19 nt, Homo sapiens
uggcaaagaacucauuuga

SEQ ID NO: 1607573 - RNA, 20 nt, Homo sapiens
uggcaaagaacucauuugaa

SEQ ID NO: 1607574 - RNA, 21 nt, Homo sapiens
uggcaaagaacucauuugaau

SEQ ID NO: 1607575 - RNA, 16 nt, Homo sapiens
uggcaaaugaaagcau

SEQ ID NO: 1607576 - RNA, 18 nt, Homo sapiens
uggcaaaugccugacuca

SEQ ID NO: 1607577 - RNA, 20 nt, Homo sapiens
uggcaaaugccugacucagu

SEQ ID NO: 1607578 - RNA, 19 nt, Homo sapiens
uggcacaguuuucugagaa

SEQ ID NO: 1607579 - RNA, 18 nt, Homo sapiens
uggcacauguauacauau

SEQ ID NO: 1607580 - RNA, 23 nt, Homo sapiens
uggcacccagagaaaaggacucc

SEQ ID NO: 1607581 - RNA, 12 nt, Homo sapiens
uggcaccugcag

SEQ ID NO: 1607582 - RNA, 17 nt, Homo sapiens
uggcacgggaccacucc

SEQ ID NO: 1607583 - RNA, 15 nt, Homo sapiens
uggcacuacaggcac

SEQ ID NO: 1607584 - RNA, 19 nt, Homo sapiens
uggcacucagggagcauuu

SEQ ID NO: 1607585 - RNA, 15 nt, Homo sapiens
uggcacucagucucu

SEQ ID NO: 1607586 - RNA, 19 nt, Homo sapiens
uggcagucugaauuuuuaa

SEQ ID NO: 1607587 - RNA, 14 nt, Homo sapiens
uggcaguggacuca

SEQ ID NO: 1607588 - RNA, 17 nt, Homo sapiens
uggcaguuauauuuuaa

SEQ ID NO: 1607589 - RNA, 22 nt, Homo sapiens
uggcauaaggaguuagaaccac

SEQ ID NO: 1607590 - RNA, 19 nt, Homo sapiens
uggcaucagauaaugccac

SEQ ID NO: 1607591 - RNA, 14 nt, Homo sapiens
uggcaucuaucugg

SEQ ID NO: 1607592 - RNA, 15 nt, Homo sapiens
uggcauuaucucuuu

SEQ ID NO: 1607593 - RNA, 14 nt, Homo sapiens
uggccaacauggug

SEQ ID NO: 1607594 - RNA, 22 nt, Homo sapiens
uggccaagaagcaguggccuua

SEQ ID NO: 1607595 - RNA, 13 nt, Homo sapiens
uggccaaugagau

SEQ ID NO: 1607596 - RNA, 15 nt, Homo sapiens
uggccacacacugag

SEQ ID NO: 1607597 - RNA, 23 nt, Homo sapiens
uggccacacacugaguugcacau

SEQ ID NO: 1607598 - RNA, 12 nt, Homo sapiens
uggccagcauuu

SEQ ID NO: 1607599 - RNA, 19 nt, Homo sapiens
uggccaggacccugaccuc

SEQ ID NO: 1607600 - RNA, 21 nt, Homo sapiens
uggccaggccucuuggcaguc

SEQ ID NO: 1607601 - RNA, 18 nt, Homo sapiens
uggccagggcuuccucaa

SEQ ID NO: 1607602 - RNA, 22 nt, Homo sapiens
uggccaucucccuccccagaaa

SEQ ID NO: 1607603 - RNA, 13 nt, Homo sapiens
uggccaugcagaa

SEQ ID NO: 1607604 - RNA, 21 nt, Homo sapiens
uggcccacccaguccaugcuc

SEQ ID NO: 1607605 - RNA, 22 nt, Homo sapiens
uggcccuccccacaaugccaga

SEQ ID NO: 1607606 - RNA, 22 nt, Homo sapiens
uggcccuuuccuuccagauccu

SEQ ID NO: 1607607 - RNA, 23 nt, Homo sapiens
uggccgucccuaagcaugugucc

SEQ ID NO: 1607608 - RNA, 16 nt, Homo sapiens
uggccuauccgcugcc

SEQ ID NO: 1607609 - RNA, 19 nt, Homo sapiens
uggccucagcccugcuccc

SEQ ID NO: 1607610 - RNA, 14 nt, Homo sapiens
uggccucaucucag

SEQ ID NO: 1607611 - RNA, 20 nt, Homo sapiens
uggccucccugcugugccau

SEQ ID NO: 1607612 - RNA, 23 nt, Homo sapiens
uggccuggggcaggucacuuuac

SEQ ID NO: 1607613 - RNA, 13 nt, Homo sapiens
uggccugugaagc

SEQ ID NO: 1607614 - RNA, 17 nt, Homo sapiens
uggcuaaaagacaugca

SEQ ID NO: 1607615 - RNA, 15 nt, Homo sapiens
uggcuaagcauuuau

SEQ ID NO: 1607616 - RNA, 12 nt, Homo sapiens
uggcuacugcac

SEQ ID NO: 1607617 - RNA, 16 nt, Homo sapiens
uggcucaacauugugu

SEQ ID NO: 1607618 - RNA, 15 nt, Homo sapiens
uggcucaagucugca

SEQ ID NO: 1607619 - RNA, 18 nt, Homo sapiens
uggcucaagucugcacag

SEQ ID NO: 1607620 - RNA, 15 nt, Homo sapiens
uggcucacacugaga

SEQ ID NO: 1607621 - RNA, 20 nt, Homo sapiens
uggcucagugccaccuaugc

SEQ ID NO: 1607622 - RNA, 12 nt, Homo sapiens
uggcucaugccu

SEQ ID NO: 1607623 - RNA, 14 nt, Homo sapiens
uggcucaugccugu

SEQ ID NO: 1607624 - RNA, 22 nt, Homo sapiens
uggcucaugccuguaaucucag

SEQ ID NO: 1607625 - RNA, 16 nt, Homo sapiens
uggcuccuaucugugu

SEQ ID NO: 1607626 - RNA, 23 nt, Homo sapiens
uggcucuggugugaaguuugcuu

SEQ ID NO: 1607627 - RNA, 14 nt, Homo sapiens
uggcucuucugccc

SEQ ID NO: 1607628 - RNA, 17 nt, Homo sapiens
uggcuggaaggggucca

SEQ ID NO: 1607629 - RNA, 15 nt, Homo sapiens
uggcuggaucuguga

SEQ ID NO: 1607630 - RNA, 15 nt, Homo sapiens
uggcugugaaauuca

SEQ ID NO: 1607631 - RNA, 14 nt, Homo sapiens
uggcuuagugccac

SEQ ID NO: 1607632 - RNA, 14 nt, Homo sapiens
uggcuugacuggau

SEQ ID NO: 1607633 - RNA, 16 nt, Homo sapiens
uggcuuucagagccag

SEQ ID NO: 1607634 - RNA, 21 nt, Homo sapiens
uggcuuuuccuggacagcuag

SEQ ID NO: 1607635 - RNA, 19 nt, Homo sapiens
ugggaagaaagaaugcaag

SEQ ID NO: 1607636 - RNA, 20 nt, Homo sapiens
ugggaagagaagagggccca

SEQ ID NO: 1607637 - RNA, 17 nt, Homo sapiens
ugggaaggcaauuucau

SEQ ID NO: 1607638 - RNA, 22 nt, Homo sapiens
ugggaaggcuugggauuugcug

SEQ ID NO: 1607639 - RNA, 19 nt, Homo sapiens
ugggaaugaaauuaacaca

SEQ ID NO: 1607640 - RNA, 16 nt, Homo sapiens
ugggaauugcgcucag

SEQ ID NO: 1607641 - RNA, 14 nt, Homo sapiens
ugggacaaccagac

SEQ ID NO: 1607642 - RNA, 19 nt, Homo sapiens
ugggaccagaaguguuuca

SEQ ID NO: 1607643 - RNA, 18 nt, Homo sapiens
ugggaccaucacugagag

SEQ ID NO: 1607644 - RNA, 21 nt, Homo sapiens
ugggacccccaacauucugcc

SEQ ID NO: 1607645 - RNA, 20 nt, Homo sapiens
ugggacuguacacacuuuau

SEQ ID NO: 1607646 - RNA, 20 nt, Homo sapiens
ugggacuugaacaaagacau

SEQ ID NO: 1607647 - RNA, 19 nt, Homo sapiens
ugggagcacggacugucag

SEQ ID NO: 1607648 - RNA, 22 nt, Homo sapiens
ugggagccaguccuccacucga

SEQ ID NO: 1607649 - RNA, 18 nt, Homo sapiens
ugggaggagggagaggga

SEQ ID NO: 1607650 - RNA, 17 nt, Homo sapiens
ugggagggaaaagggaa

SEQ ID NO: 1607651 - RNA, 12 nt, Homo sapiens
ugggaguaauac

SEQ ID NO: 1607652 - RNA, 14 nt, Homo sapiens
ugggauauucccaa

SEQ ID NO: 1607653 - RNA, 15 nt, Homo sapiens
ugggauccacacuga

SEQ ID NO: 1607654 - RNA, 16 nt, Homo sapiens
ugggauccacacugag

SEQ ID NO: 1607655 - RNA, 17 nt, Homo sapiens
ugggaucgcauugcaua

SEQ ID NO: 1607656 - RNA, 20 nt, Homo sapiens
ugggaucugucacaccagcc

SEQ ID NO: 1607657 - RNA, 11 nt, Homo sapiens
ugggaugccag

SEQ ID NO: 1607658 - RNA, 19 nt, Homo sapiens
ugggcaaaagcuuacaaau

SEQ ID NO: 1607659 - RNA, 19 nt, Homo sapiens
ugggcaaagggaaguaaca

SEQ ID NO: 1607660 - RNA, 19 nt, Homo sapiens
ugggcaacaagagcaaaac

SEQ ID NO: 1607661 - RNA, 13 nt, Homo sapiens
ugggcagccagga

SEQ ID NO: 1607662 - RNA, 21 nt, Homo sapiens
ugggcagcccagugcugccac

SEQ ID NO: 1607663 - RNA, 14 nt, Homo sapiens
ugggccauguccaa

SEQ ID NO: 1607664 - RNA, 15 nt, Homo sapiens
ugggccauguccaaa

SEQ ID NO: 1607665 - RNA, 17 nt, Homo sapiens
ugggccauuaaaaacua

SEQ ID NO: 1607666 - RNA, 14 nt, Homo sapiens
ugggcccagaucug

SEQ ID NO: 1607667 - RNA, 18 nt, Homo sapiens
ugggcucucuucuguccc

SEQ ID NO: 1607668 - RNA, 16 nt, Homo sapiens
uuaaaaaaaaauuccc

SEQ ID NO: 1607669 - RNA, 14 nt, Homo sapiens
uuaaaaaacuucau

SEQ ID NO: 1607670 - RNA, 16 nt, Homo sapiens
uuaaaaaucuguaaau

SEQ ID NO: 1607671 - RNA, 17 nt, Homo sapiens
uuaaaaaugagauuucu

SEQ ID NO: 1607672 - RNA, 17 nt, Homo sapiens
uuaaaaauucauaacag

SEQ ID NO: 1607673 - RNA, 13 nt, Homo sapiens
uuaaaacaaaaga

SEQ ID NO: 1607674 - RNA, 14 nt, Homo sapiens
uuaaaacaaaagag

SEQ ID NO: 1607675 - RNA, 16 nt, Homo sapiens
uuaaaacagacacugg

SEQ ID NO: 1607676 - RNA, 20 nt, Homo sapiens
uuaaaacuauaacauuauau

SEQ ID NO: 1607677 - RNA, 17 nt, Homo sapiens
uuaaaacucaucacaua

SEQ ID NO: 1607678 - RNA, 19 nt, Homo sapiens
uuaaaacucaucacauaaa

SEQ ID NO: 1607679 - RNA, 22 nt, Homo sapiens
uuaaaacuucaguuucacagaa

SEQ ID NO: 1607680 - RNA, 20 nt, Homo sapiens
uuaaaagaaauauacaguuu

SEQ ID NO: 1607681 - RNA, 15 nt, Homo sapiens
uuaaaagucauuauu

SEQ ID NO: 1607682 - RNA, 22 nt, Homo sapiens
uuaaaauaaugaacacuacaga

SEQ ID NO: 1607683 - RNA, 15 nt, Homo sapiens
uuaaaaucagcuauu

SEQ ID NO: 1607684 - RNA, 13 nt, Homo sapiens
uuaaaaucuguca

SEQ ID NO: 1607685 - RNA, 17 nt, Homo sapiens
uuaaacaaucuuucaug

SEQ ID NO: 1607686 - RNA, 18 nt, Homo sapiens
uuaaacagugaacuuguc

SEQ ID NO: 1607687 - RNA, 15 nt, Homo sapiens
uuaaacccauacaau

SEQ ID NO: 1607688 - RNA, 18 nt, Homo sapiens
uuaaacccuuuggugcua

SEQ ID NO: 1607689 - RNA, 19 nt, Homo sapiens
uuaaacucuacuucaagaa

SEQ ID NO: 1607690 - RNA, 12 nt, Homo sapiens
uuaaacugugua

SEQ ID NO: 1607691 - RNA, 11 nt, Homo sapiens
uuaaacuugua

SEQ ID NO: 1607692 - RNA, 13 nt, Homo sapiens
uuaaagaaagugu

SEQ ID NO: 1607693 - RNA, 23 nt, Homo sapiens
uuaaagaccugacagcuugagaa

SEQ ID NO: 1607694 - RNA, 23 nt, Homo sapiens
uuaaagacuaggauauugaaugu

SEQ ID NO: 1607695 - RNA, 16 nt, Homo sapiens
uuaaagccuguuccau

SEQ ID NO: 1607696 - RNA, 12 nt, Homo sapiens
uuaaagcuaaac

SEQ ID NO: 1607697 - RNA, 15 nt, Homo sapiens
uuaaagcugcuguca

SEQ ID NO: 1607698 - RNA, 20 nt, Homo sapiens
uuaaagcuuauuaaaacuca

SEQ ID NO: 1607699 - RNA, 22 nt, Homo sapiens
uuaaaggaaaaucacaucucca

SEQ ID NO: 1607700 - RNA, 18 nt, Homo sapiens
uuaaaggcaucuacacaa

SEQ ID NO: 1607701 - RNA, 17 nt, Homo sapiens
uuaaaggggguauguga

SEQ ID NO: 1607702 - RNA, 15 nt, Homo sapiens
uuaaaguauguccuu

SEQ ID NO: 1607703 - RNA, 15 nt, Homo sapiens
uuaaauaacagggac

SEQ ID NO: 1607704 - RNA, 17 nt, Homo sapiens
uuaaauacagucuucca

SEQ ID NO: 1607705 - RNA, 14 nt, Homo sapiens
uuaaauacauaaau

SEQ ID NO: 1607706 - RNA, 15 nt, Homo sapiens
uuaaauacauaaaua

SEQ ID NO: 1607707 - RNA, 12 nt, Homo sapiens
uuaaauagugug

SEQ ID NO: 1607708 - RNA, 14 nt, Homo sapiens
uuaaauaucugaac

SEQ ID NO: 1607709 - RNA, 16 nt, Homo sapiens
uuaaaugaacuugaua

SEQ ID NO: 1607710 - RNA, 20 nt, Homo sapiens
uuaaaugaacuugauagcua

SEQ ID NO: 1607711 - RNA, 14 nt, Homo sapiens
uuaaaugaagccaa

SEQ ID NO: 1607712 - RNA, 16 nt, Homo sapiens
uuaaaugacaauuuau

SEQ ID NO: 1607713 - RNA, 18 nt, Homo sapiens
uuaaauguaaguugagaa

SEQ ID NO: 1607714 - RNA, 14 nt, Homo sapiens
uuaaauuacaauuu

SEQ ID NO: 1607715 - RNA, 23 nt, Homo sapiens
uuaaauuacagcuuuuauggaug

SEQ ID NO: 1607716 - RNA, 24 nt, Homo sapiens
uuaaauuccaaacuaugacuacua

SEQ ID NO: 1607717 - RNA, 12 nt, Homo sapiens
uuaaauuccaca

SEQ ID NO: 1607718 - RNA, 18 nt, Homo sapiens
uuaaauuccugguggaua

SEQ ID NO: 1607719 - RNA, 17 nt, Homo sapiens
uuaaauuuuaacuaaau

SEQ ID NO: 1607720 - RNA, 19 nt, Homo sapiens
uuaaauuuuguaugccaau

SEQ ID NO: 1607721 - RNA, 12 nt, Homo sapiens
uuaacaaagcaa

SEQ ID NO: 1607722 - RNA, 11 nt, Homo sapiens
uuaacaaucua

SEQ ID NO: 1607723 - RNA, 19 nt, Homo sapiens
uuaacaguuguauuuaaca

SEQ ID NO: 1607724 - RNA, 15 nt, Homo sapiens
uuaacaucaaagacu

SEQ ID NO: 1607725 - RNA, 18 nt, Homo sapiens
uuaacauuaucuaguuca

SEQ ID NO: 1607726 - RNA, 23 nt, Homo sapiens
uuaacauuaucuaguucauugaa

SEQ ID NO: 1607727 - RNA, 21 nt, Homo sapiens
uuaacauuguuuuuguauauu

SEQ ID NO: 1607728 - RNA, 22 nt, Homo sapiens
uuaacauuucaccccacucugu

SEQ ID NO: 1607729 - RNA, 13 nt, Homo sapiens
uuaacggugcuaa

SEQ ID NO: 1607730 - RNA, 15 nt, Homo sapiens
uuaacggugcuaaaa

SEQ ID NO: 1607731 - RNA, 17 nt, Homo sapiens
uuaacggugcuaaaaau

SEQ ID NO: 1607732 - RNA, 15 nt, Homo sapiens
uuaacuaauaaaaua

SEQ ID NO: 1607733 - RNA, 11 nt, Homo sapiens
uuaacuaugaa

SEQ ID NO: 1607734 - RNA, 17 nt, Homo sapiens
uuaacuaugaacugaag

SEQ ID NO: 1607735 - RNA, 23 nt, Homo sapiens
uuaacugugaaauguacgucauu

SEQ ID NO: 1607736 - RNA, 16 nt, Homo sapiens
uuaacuuccacuguua

SEQ ID NO: 1607737 - RNA, 16 nt, Homo sapiens
uuaacuuuaccaugcu

SEQ ID NO: 1607738 - RNA, 17 nt, Homo sapiens
uuaacuuuaccaugcuc

SEQ ID NO: 1607739 - RNA, 17 nt, Homo sapiens
uuaagaaaaacaauaaa

SEQ ID NO: 1607740 - RNA, 15 nt, Homo sapiens
uuaagaaagcacuua

SEQ ID NO: 1607741 - RNA, 22 nt, Homo sapiens
uuaagaacuagggagggggaaa

SEQ ID NO: 1607742 - RNA, 17 nt, Homo sapiens
uuaagacaagcuguaua

SEQ ID NO: 1607743 - RNA, 12 nt, Homo sapiens
uuaagcucaaaa

SEQ ID NO: 1607744 - RNA, 18 nt, Homo sapiens
uuaagcuucuuaacugcc

SEQ ID NO: 1607745 - RNA, 17 nt, Homo sapiens
uuaaguacaugugccag

SEQ ID NO: 1607746 - RNA, 16 nt, Homo sapiens
uuaagugaauacauua

SEQ ID NO: 1607747 - RNA, 13 nt, Homo sapiens
uuaagugauguca

SEQ ID NO: 1607748 - RNA, 13 nt, Homo sapiens
uuaagugcugcag

SEQ ID NO: 1607749 - RNA, 16 nt, Homo sapiens
uuaaguggguuugccc

SEQ ID NO: 1607750 - RNA, 23 nt, Homo sapiens
uuaaguugagaacuuauguguuu

SEQ ID NO: 1607751 - RNA, 22 nt, Homo sapiens
uuaaguuugaaacuaacucaua

SEQ ID NO: 1607752 - RNA, 16 nt, Homo sapiens
uuaaguuuucaugaau

SEQ ID NO: 1607753 - RNA, 22 nt, Homo sapiens
uuaauaaacaugucacaauaca

SEQ ID NO: 1607754 - RNA, 15 nt, Homo sapiens
uuaauaaacuacucu

SEQ ID NO: 1607755 - RNA, 14 nt, Homo sapiens
uuaauaaucuuggc

SEQ ID NO: 1607756 - RNA, 14 nt, Homo sapiens
uuaauacaugcaac

SEQ ID NO: 1607757 - RNA, 18 nt, Homo sapiens
uuaauacaugcaacagaa

SEQ ID NO: 1607758 - RNA, 12 nt, Homo sapiens
uuaauaccaaag

SEQ ID NO: 1607759 - RNA, 20 nt, Homo sapiens
uuaauaccacaaacacugug

SEQ ID NO: 1607760 - RNA, 13 nt, Homo sapiens
uuaauacuauuaa

SEQ ID NO: 1607761 - RNA, 20 nt, Homo sapiens
uuaauagcaacagagcacuu

SEQ ID NO: 1607762 - RNA, 23 nt, Homo sapiens
uuaauaggugcagucuuugagau

SEQ ID NO: 1607763 - RNA, 15 nt, Homo sapiens
uuaauaguacuauua

SEQ ID NO: 1607764 - RNA, 18 nt, Homo sapiens
uuaauauacuugaaugaa

SEQ ID NO: 1607765 - RNA, 18 nt, Homo sapiens
uuaauauaugggggaaaa

SEQ ID NO: 1607766 - RNA, 14 nt, Homo sapiens
uuaauaucugaggu

SEQ ID NO: 1607767 - RNA, 20 nt, Homo sapiens
uuaauccaauauuuugccuu

SEQ ID NO: 1607768 - RNA, 15 nt, Homo sapiens
uuaauccaauccacu

SEQ ID NO: 1607769 - RNA, 19 nt, Homo sapiens
uuaauccuguuuuuagugc

SEQ ID NO: 1607770 - RNA, 20 nt, Homo sapiens
uuaaugccugcuuuuuggaa

SEQ ID NO: 1607771 - RNA, 22 nt, Homo sapiens
uuaauggucaaugcuagcacaa

SEQ ID NO: 1607772 - RNA, 19 nt, Homo sapiens
uuaauguaauaaagugaac

SEQ ID NO: 1607773 - RNA, 16 nt, Homo sapiens
uuaauguuaacaagac

SEQ ID NO: 1607774 - RNA, 21 nt, Homo sapiens
uuaauguucccaaaccagaga

SEQ ID NO: 1607775 - RNA, 11 nt, Homo sapiens
uuaauuacuuu

SEQ ID NO: 1607776 - RNA, 21 nt, Homo sapiens
uuaauuaugaaaacuagcauu

SEQ ID NO: 1607777 - RNA, 24 nt, Homo sapiens
uuaauuuacagaaaucaaugguag

SEQ ID NO: 1607778 - RNA, 13 nt, Homo sapiens
uuaauuucaggaa

SEQ ID NO: 1607779 - RNA, 19 nt, Homo sapiens
uuaauuuccuuuuugacac

SEQ ID NO: 1607780 - RNA, 22 nt, Homo sapiens
uuaauuuccuuuuugacacuga

SEQ ID NO: 1607781 - RNA, 18 nt, Homo sapiens
uuaauuuuuauuucuucc

SEQ ID NO: 1607782 - RNA, 15 nt, Homo sapiens
uuacaaaaguauuau

SEQ ID NO: 1607783 - RNA, 16 nt, Homo sapiens
uuacaaaccauuaccu

SEQ ID NO: 1607784 - RNA, 24 nt, Homo sapiens
uuacaaagggccaucguucaucca

SEQ ID NO: 1607785 - RNA, 14 nt, Homo sapiens
uuacaaaugcaauu

SEQ ID NO: 1607786 - RNA, 19 nt, Homo sapiens
uuacaaucgagacugcaau

SEQ ID NO: 1607787 - RNA, 13 nt, Homo sapiens
uucucucaucucu

SEQ ID NO: 1607788 - RNA, 17 nt, Homo sapiens
uucucugccuguacuga

SEQ ID NO: 1607789 - RNA, 21 nt, Homo sapiens
uucucugccuuuuuacuauac

SEQ ID NO: 1607790 - RNA, 11 nt, Homo sapiens
uucucuuucac

SEQ ID NO: 1607791 - RNA, 16 nt, Homo sapiens
uucucuuucucuccuu

SEQ ID NO: 1607792 - RNA, 20 nt, Homo sapiens
uucugaaaaccuaccagcca

SEQ ID NO: 1607793 - RNA, 19 nt, Homo sapiens
uucugaaucaccaauuaaa

SEQ ID NO: 1607794 - RNA, 15 nt, Homo sapiens
uucugaauuguccuu

SEQ ID NO: 1607795 - RNA, 16 nt, Homo sapiens
uucugaauuugcaaag

SEQ ID NO: 1607796 - RNA, 20 nt, Homo sapiens
uucugagugaguuuuacucu

SEQ ID NO: 1607797 - RNA, 17 nt, Homo sapiens
uucugauauguauccau

SEQ ID NO: 1607798 - RNA, 17 nt, Homo sapiens
uucugaugaaucucaaa

SEQ ID NO: 1607799 - RNA, 22 nt, Homo sapiens
uucugauuccccuccaccaaac

SEQ ID NO: 1607800 - RNA, 17 nt, Homo sapiens
uucugcauauguugaau

SEQ ID NO: 1607801 - RNA, 14 nt, Homo sapiens
uucugcauuacuau

SEQ ID NO: 1607802 - RNA, 18 nt, Homo sapiens
uucugcccgcuccaugga

SEQ ID NO: 1607803 - RNA, 23 nt, Homo sapiens
uucugcccgggaaggucaccagc

SEQ ID NO: 1607804 - RNA, 17 nt, Homo sapiens
uucugccuucucaggaa

SEQ ID NO: 1607805 - RNA, 18 nt, Homo sapiens
uucugcuagagcagacag

SEQ ID NO: 1607806 - RNA, 23 nt, Homo sapiens
uucugcuaugugugguacuuugc

SEQ ID NO: 1607807 - RNA, 22 nt, Homo sapiens
uucugcuguugccucucuuuga

SEQ ID NO: 1607808 - RNA, 17 nt, Homo sapiens
uucuggaaguuucuggu

SEQ ID NO: 1607809 - RNA, 20 nt, Homo sapiens
uucuggaaucuuugagacca

SEQ ID NO: 1607810 - RNA, 18 nt, Homo sapiens
uucuggcuaccuguuuga

SEQ ID NO: 1607811 - RNA, 22 nt, Homo sapiens
uucugggaagggagaguucuuu

SEQ ID NO: 1607812 - RNA, 21 nt, Homo sapiens
uucugggccacucaggccagu

SEQ ID NO: 1607813 - RNA, 18 nt, Homo sapiens
uucuggguguugaccacu

SEQ ID NO: 1607814 - RNA, 16 nt, Homo sapiens
uucuguaaaacagguu

SEQ ID NO: 1607815 - RNA, 13 nt, Homo sapiens
uucuguaauuuga

SEQ ID NO: 1607816 - RNA, 14 nt, Homo sapiens
uucuguacaugcau

SEQ ID NO: 1607817 - RNA, 15 nt, Homo sapiens
uucuguacucaaaug

SEQ ID NO: 1607818 - RNA, 16 nt, Homo sapiens
uucuguauaacagccu

SEQ ID NO: 1607819 - RNA, 20 nt, Homo sapiens
uucugucccacuacaucugg

SEQ ID NO: 1607820 - RNA, 19 nt, Homo sapiens
uucugugguuucauguuag

SEQ ID NO: 1607821 - RNA, 15 nt, Homo sapiens
uucuuaaauaagaaa

SEQ ID NO: 1607822 - RNA, 11 nt, Homo sapiens
uucuucacugg

SEQ ID NO: 1607823 - RNA, 14 nt, Homo sapiens
uucuucacugguga

SEQ ID NO: 1607824 - RNA, 14 nt, Homo sapiens
uucuucaugaggcc

SEQ ID NO: 1607825 - RNA, 20 nt, Homo sapiens
uucuucauggggguaagaaa

SEQ ID NO: 1607826 - RNA, 19 nt, Homo sapiens
uucuucaugucaucaaaau

SEQ ID NO: 1607827 - RNA, 16 nt, Homo sapiens
uucuucauuaccucag

SEQ ID NO: 1607828 - RNA, 15 nt, Homo sapiens
uucuucuacugcuau

SEQ ID NO: 1607829 - RNA, 20 nt, Homo sapiens
uucuugcuuucaauuacaaa

SEQ ID NO: 1607830 - RNA, 19 nt, Homo sapiens
uucuuggagcuuuggaaua

SEQ ID NO: 1607831 - RNA, 16 nt, Homo sapiens
uucuuggauuacuuua

SEQ ID NO: 1607832 - RNA, 15 nt, Homo sapiens
uucuuguaaggcaua

SEQ ID NO: 1607833 - RNA, 19 nt, Homo sapiens
uucuuguucugcccuccag

SEQ ID NO: 1607834 - RNA, 21 nt, Homo sapiens
uucuuguuuuaagagacagag

SEQ ID NO: 1607835 - RNA, 21 nt, Homo sapiens
uucuuuacuuaucucucaaaa

SEQ ID NO: 1607836 - RNA, 10 nt, Homo sapiens
uucuuuccaa

SEQ ID NO: 1607837 - RNA, 15 nt, Homo sapiens
uucuuuccacugaau

SEQ ID NO: 1607838 - RNA, 13 nt, Homo sapiens
uucuuuccagaaa

SEQ ID NO: 1607839 - RNA, 22 nt, Homo sapiens
uucuuuccguuucucuauugua

SEQ ID NO: 1607840 - RNA, 12 nt, Homo sapiens
uucuuucugucu

SEQ ID NO: 1607841 - RNA, 16 nt, Homo sapiens
uucuuugcaccaaaga

SEQ ID NO: 1607842 - RNA, 12 nt, Homo sapiens
uucuuugccucu

SEQ ID NO: 1607843 - RNA, 20 nt, Homo sapiens
uucuuugcugcagucaucua

SEQ ID NO: 1607844 - RNA, 13 nt, Homo sapiens
uucuuugugccuu

SEQ ID NO: 1607845 - RNA, 20 nt, Homo sapiens
uucuuuuaauccaauccacu

SEQ ID NO: 1607846 - RNA, 16 nt, Homo sapiens
uucuuuuuaacuuuac

SEQ ID NO: 1607847 - RNA, 13 nt, Homo sapiens
uucuuuuuccaca

SEQ ID NO: 1607848 - RNA, 21 nt, Homo sapiens
uugaaaaaaagggcacucuga

SEQ ID NO: 1607849 - RNA, 15 nt, Homo sapiens
uugaaaaugggcuca

SEQ ID NO: 1607850 - RNA, 17 nt, Homo sapiens
uugaaaauguccaggaa

SEQ ID NO: 1607851 - RNA, 20 nt, Homo sapiens
uugaaaauuuuuaaauauuc

SEQ ID NO: 1607852 - RNA, 16 nt, Homo sapiens
uugaaaccccaucucu

SEQ ID NO: 1607853 - RNA, 20 nt, Homo sapiens
uugaaacuaucucaugccag

SEQ ID NO: 1607854 - RNA, 16 nt, Homo sapiens
uugaaacuuugaaugu

SEQ ID NO: 1607855 - RNA, 14 nt, Homo sapiens
uugaaagacugugc

SEQ ID NO: 1607856 - RNA, 17 nt, Homo sapiens
uugaaagcccaaggugc

SEQ ID NO: 1607857 - RNA, 16 nt, Homo sapiens
uugaaauggcauuuaa

SEQ ID NO: 1607858 - RNA, 12 nt, Homo sapiens
uugaaaugucaa

SEQ ID NO: 1607859 - RNA, 19 nt, Homo sapiens
uugaaauuuugcaccagcg

SEQ ID NO: 1607860 - RNA, 20 nt, Homo sapiens
uugaacccgggggacagagg

SEQ ID NO: 1607861 - RNA, 14 nt, Homo sapiens
uugaagagauuuua

SEQ ID NO: 1607862 - RNA, 12 nt, Homo sapiens
uugaagagcaaa

SEQ ID NO: 1607863 - RNA, 16 nt, Homo sapiens
uugaagaucaggcaca

SEQ ID NO: 1607864 - RNA, 23 nt, Homo sapiens
uugaauaaaaauagaaaccugaa

SEQ ID NO: 1607865 - RNA, 17 nt, Homo sapiens
uugaauaauaagcagga

SEQ ID NO: 1607866 - RNA, 14 nt, Homo sapiens
uugaauacaacauu

SEQ ID NO: 1607867 - RNA, 14 nt, Homo sapiens
uugaauacugcauu

SEQ ID NO: 1607868 - RNA, 17 nt, Homo sapiens
uugaaugcuuaauucaa

SEQ ID NO: 1607869 - RNA, 20 nt, Homo sapiens
uugaauguacaccacaugcu

SEQ ID NO: 1607870 - RNA, 15 nt, Homo sapiens
uugaauuccauggaa

SEQ ID NO: 1607871 - RNA, 18 nt, Homo sapiens
uugacaauugggagcugc

SEQ ID NO: 1607872 - RNA, 15 nt, Homo sapiens
uugacacugcucuaa

SEQ ID NO: 1607873 - RNA, 20 nt, Homo sapiens
uugacacuuaaaaaugguuu

SEQ ID NO: 1607874 - RNA, 17 nt, Homo sapiens
uugacacuuguugucca

SEQ ID NO: 1607875 - RNA, 19 nt, Homo sapiens
uugacauaccuaccaguau

SEQ ID NO: 1607876 - RNA, 21 nt, Homo sapiens
uugacauaggcaauaauaagu

SEQ ID NO: 1607877 - RNA, 20 nt, Homo sapiens
uugaccacaucgcucuagga

SEQ ID NO: 1607878 - RNA, 20 nt, Homo sapiens
uugacuccuuuccaauagaa

SEQ ID NO: 1607879 - RNA, 24 nt, Homo sapiens
uugacuucucaaguaacaugacuu

SEQ ID NO: 1607880 - RNA, 15 nt, Homo sapiens
uugagaagcugccau

SEQ ID NO: 1607881 - RNA, 16 nt, Homo sapiens
uugagacagucucacu

SEQ ID NO: 1607882 - RNA, 14 nt, Homo sapiens
uugagaguuaauaa

SEQ ID NO: 1607883 - RNA, 16 nt, Homo sapiens
uugagcaggucucaua

SEQ ID NO: 1607884 - RNA, 18 nt, Homo sapiens
uugagcccaggaguucaa

SEQ ID NO: 1607885 - RNA, 21 nt, Homo sapiens
uugaggaucuauuacugaccg

SEQ ID NO: 1607886 - RNA, 22 nt, Homo sapiens
uugagugagcaccuccccagau

SEQ ID NO: 1607887 - RNA, 18 nt, Homo sapiens
uugaguuuaaaaccuggg

SEQ ID NO: 1607888 - RNA, 22 nt, Homo sapiens
uugaguuuuuccucccagugag

SEQ ID NO: 1607889 - RNA, 17 nt, Homo sapiens
uugauagauuucuacac

SEQ ID NO: 1607890 - RNA, 19 nt, Homo sapiens
uugauaggauguggauuaa

SEQ ID NO: 1607891 - RNA, 18 nt, Homo sapiens
uugauaguuuggcuauaa

SEQ ID NO: 1607892 - RNA, 17 nt, Homo sapiens
uugauauaaucuuucaa

SEQ ID NO: 1607893 - RNA, 14 nt, Homo sapiens
uugaucuacuugcc

SEQ ID NO: 1607894 - RNA, 21 nt, Homo sapiens
uugaucuucagggaacugcau

SEQ ID NO: 1607895 - RNA, 12 nt, Homo sapiens
uugaugaugcag

SEQ ID NO: 1607896 - RNA, 14 nt, Homo sapiens
uugaugcaugcacu

SEQ ID NO: 1607897 - RNA, 22 nt, Homo sapiens
uugauguacauaacuccugucc

SEQ ID NO: 1607898 - RNA, 14 nt, Homo sapiens
uugauuaaugaacu

SEQ ID NO: 1607899 - RNA, 23 nt, Homo sapiens
uugauuagaagauaaaaguacau

SEQ ID NO: 1607900 - RNA, 12 nt, Homo sapiens
uugcaaaguaag

SEQ ID NO: 1607901 - RNA, 20 nt, Homo sapiens
uugcaacaauaaaguacuuu

SEQ ID NO: 1607902 - RNA, 22 nt, Homo sapiens
uugcaacagcaguguucugggu

SEQ ID NO: 1607903 - RNA, 17 nt, Homo sapiens
uugcaagaugugaauua

SEQ ID NO: 1607904 - RNA, 17 nt, Homo sapiens
uugcaauacauuucaau

SEQ ID NO: 1607905 - RNA, 20 nt, Homo sapiens
uuguauuuaccuucuaccuc

SEQ ID NO: 1607906 - RNA, 20 nt, Homo sapiens
uugucaaagaaggugcugau

SEQ ID NO: 1607907 - RNA, 18 nt, Homo sapiens
uugucaagccugugcaaa

SEQ ID NO: 1607908 - RNA, 21 nt, Homo sapiens
uugucaagccugugcaaaaaa

SEQ ID NO: 1607909 - RNA, 19 nt, Homo sapiens
uugucacuuuuuaugcuau

SEQ ID NO: 1607910 - RNA, 13 nt, Homo sapiens
uugucauacaaau

SEQ ID NO: 1607911 - RNA, 13 nt, Homo sapiens
uugucaugcccuu

SEQ ID NO: 1607912 - RNA, 13 nt, Homo sapiens
uuguccacccacc

SEQ ID NO: 1607913 - RNA, 16 nt, Homo sapiens
uugucccaagugccaa

SEQ ID NO: 1607914 - RNA, 14 nt, Homo sapiens
uugucgcuauguga

SEQ ID NO: 1607915 - RNA, 16 nt, Homo sapiens
uugucgguuaccucug

SEQ ID NO: 1607916 - RNA, 22 nt, Homo sapiens
uugucucaauucaaauccauag

SEQ ID NO: 1607917 - RNA, 22 nt, Homo sapiens
uugugaaaaugaauaucaugca

SEQ ID NO: 1607918 - RNA, 12 nt, Homo sapiens
uugugaacugga

SEQ ID NO: 1607919 - RNA, 18 nt, Homo sapiens
uugugacagucacugcau

SEQ ID NO: 1607920 - RNA, 15 nt, Homo sapiens
uugugagucuucacu

SEQ ID NO: 1607921 - RNA, 14 nt, Homo sapiens
uugugaucucacac

SEQ ID NO: 1607922 - RNA, 13 nt, Homo sapiens
uugugaugaacau

SEQ ID NO: 1607923 - RNA, 16 nt, Homo sapiens
uugugaugaacauauu

SEQ ID NO: 1607924 - RNA, 16 nt, Homo sapiens
uugugcuccaaacaaa

SEQ ID NO: 1607925 - RNA, 15 nt, Homo sapiens
uuguguucaguucca

SEQ ID NO: 1607926 - RNA, 14 nt, Homo sapiens
uuguguucugcucc

SEQ ID NO: 1607927 - RNA, 23 nt, Homo sapiens
uuguuaaguauugugcacuguau

SEQ ID NO: 1607928 - RNA, 21 nt, Homo sapiens
uuguuaauacuauauugcugu

SEQ ID NO: 1607929 - RNA, 14 nt, Homo sapiens
uuguuaauacugua

SEQ ID NO: 1607930 - RNA, 21 nt, Homo sapiens
uuguuaauacuguauugcugu

SEQ ID NO: 1607931 - RNA, 13 nt, Homo sapiens
uuguuaaugcauu

SEQ ID NO: 1607932 - RNA, 21 nt, Homo sapiens
uuguuacuuuuaguucuauaa

SEQ ID NO: 1607933 - RNA, 17 nt, Homo sapiens
uuguuaggaaaugucau

SEQ ID NO: 1607934 - RNA, 17 nt, Homo sapiens
uuguuccaaugccacau

SEQ ID NO: 1607935 - RNA, 16 nt, Homo sapiens
uuguucucccaaaaca

SEQ ID NO: 1607936 - RNA, 19 nt, Homo sapiens
uuguucugcccuccagaga

SEQ ID NO: 1607937 - RNA, 18 nt, Homo sapiens
uuguucugcugucuggga

SEQ ID NO: 1607938 - RNA, 14 nt, Homo sapiens
uuguucuucaggag

SEQ ID NO: 1607939 - RNA, 20 nt, Homo sapiens
uuguucuuucauauggaaug

SEQ ID NO: 1607940 - RNA, 14 nt, Homo sapiens
uuguugacugugau

SEQ ID NO: 1607941 - RNA, 21 nt, Homo sapiens
uuguuucaaaugaaacuuuaa

SEQ ID NO: 1607942 - RNA, 15 nt, Homo sapiens
uuguuugcaucugaa

SEQ ID NO: 1607943 - RNA, 19 nt, Homo sapiens
uuguuugugacccugagaa

SEQ ID NO: 1607944 - RNA, 14 nt, Homo sapiens
uuguuuuuacugua

SEQ ID NO: 1607945 - RNA, 18 nt, Homo sapiens
uuguuuuuauuguaaaac

SEQ ID NO: 1607946 - RNA, 15 nt, Homo sapiens
uuguuuuugcaugaa

SEQ ID NO: 1607947 - RNA, 16 nt, Homo sapiens
uuuaaaaaagcuuaaa

SEQ ID NO: 1607948 - RNA, 19 nt, Homo sapiens
uuuaaaaaauauuuucucu

SEQ ID NO: 1607949 - RNA, 17 nt, Homo sapiens
uuuaaaaauacauagca

SEQ ID NO: 1607950 - RNA, 20 nt, Homo sapiens
uuuaaaaauguuuuccccaa

SEQ ID NO: 1607951 - RNA, 22 nt, Homo sapiens
uuuaaaaauuauauacauauau

SEQ ID NO: 1607952 - RNA, 20 nt, Homo sapiens
uuuaaaacuaguuagauuca

SEQ ID NO: 1607953 - RNA, 14 nt, Homo sapiens
uuuaaaaugaagcu

SEQ ID NO: 1607954 - RNA, 21 nt, Homo sapiens
uuuaaacuacugauugaaugu

SEQ ID NO: 1607955 - RNA, 18 nt, Homo sapiens
uuuaaacuauaagcaaga

SEQ ID NO: 1607956 - RNA, 11 nt, Homo sapiens
uuuaaacugua

SEQ ID NO: 1607957 - RNA, 17 nt, Homo sapiens
uuuaaagacaaagacau

SEQ ID NO: 1607958 - RNA, 22 nt, Homo sapiens
uuuaaagacaaagacauuauuu

SEQ ID NO: 1607959 - RNA, 22 nt, Homo sapiens
uuuaaagcauauuggugcuaga

SEQ ID NO: 1607960 - RNA, 17 nt, Homo sapiens
uuuaaagccauucugau

SEQ ID NO: 1607961 - RNA, 12 nt, Homo sapiens
uuuaaagucaca

SEQ ID NO: 1607962 - RNA, 14 nt, Homo sapiens
uuuaaaguggcaau

SEQ ID NO: 1607963 - RNA, 18 nt, Homo sapiens
uuuaaauaaaagcacaag

SEQ ID NO: 1607964 - RNA, 16 nt, Homo sapiens
uuuaaauagcauaaaa

SEQ ID NO: 1607965 - RNA, 14 nt, Homo sapiens
uuuaaaucaaggaa

SEQ ID NO: 1607966 - RNA, 14 nt, Homo sapiens
uuuaaaucugugau

SEQ ID NO: 1607967 - RNA, 17 nt, Homo sapiens
uuuaaauguauuuuaca

SEQ ID NO: 1607968 - RNA, 18 nt, Homo sapiens
uuuaaauguguacaaugu

SEQ ID NO: 1607969 - RNA, 22 nt, Homo sapiens
uuuaaauuaaacucuacuucaa

SEQ ID NO: 1607970 - RNA, 15 nt, Homo sapiens
uuuaaauuccacuga

SEQ ID NO: 1607971 - RNA, 12 nt, Homo sapiens
uuuaaauucucu

SEQ ID NO: 1607972 - RNA, 15 nt, Homo sapiens
uuuaaauugauagca

SEQ ID NO: 1607973 - RNA, 12 nt, Homo sapiens
uuuaaauuuugu

SEQ ID NO: 1607974 - RNA, 23 nt, Homo sapiens
uuuaacacccuuuagaaccuuaa

SEQ ID NO: 1607975 - RNA, 18 nt, Homo sapiens
uuuaacauuuuacaguaa

SEQ ID NO: 1607976 - RNA, 11 nt, Homo sapiens
uuuaaccuuaa

SEQ ID NO: 1607977 - RNA, 20 nt, Homo sapiens
uuuaacucaguuucuaggca

SEQ ID NO: 1607978 - RNA, 23 nt, Homo sapiens
uuuaacuuuuuguuuuuauuucu

SEQ ID NO: 1607979 - RNA, 19 nt, Homo sapiens
uuuaagauauauacaugga

SEQ ID NO: 1607980 - RNA, 21 nt, Homo sapiens
uuuaagcaaguuaaguguccu

SEQ ID NO: 1607981 - RNA, 11 nt, Homo sapiens
uuuaagccaua

SEQ ID NO: 1607982 - RNA, 23 nt, Homo sapiens
uuuaagccgaagggcaauaucua

SEQ ID NO: 1607983 - RNA, 17 nt, Homo sapiens
uuuaaguaguaagaaua

SEQ ID NO: 1607984 - RNA, 14 nt, Homo sapiens
uuuaagugcaauua

SEQ ID NO: 1607985 - RNA, 12 nt, Homo sapiens
uuuaauagcaaa

SEQ ID NO: 1607986 - RNA, 17 nt, Homo sapiens
uuuaauagguaaaccaa

SEQ ID NO: 1607987 - RNA, 17 nt, Homo sapiens
uuuaaugauaacuaaaa

SEQ ID NO: 1607988 - RNA, 13 nt, Homo sapiens
uuuaauggcagca

SEQ ID NO: 1607989 - RNA, 17 nt, Homo sapiens
uuuaaugggcacagggu

SEQ ID NO: 1607990 - RNA, 19 nt, Homo sapiens
uuuaauguaauagggaaaa

SEQ ID NO: 1607991 - RNA, 15 nt, Homo sapiens
uuuaauugcauuuaa

SEQ ID NO: 1607992 - RNA, 15 nt, Homo sapiens
uuuacacaaagggaa

SEQ ID NO: 1607993 - RNA, 17 nt, Homo sapiens
uuuacagagaacagaaa

SEQ ID NO: 1607994 - RNA, 17 nt, Homo sapiens
uuuacaguaaauguuac

SEQ ID NO: 1607995 - RNA, 17 nt, Homo sapiens
uuuacaguuacaguuga

SEQ ID NO: 1607996 - RNA, 20 nt, Homo sapiens
uuuacauacacuguauguua

SEQ ID NO: 1607997 - RNA, 14 nt, Homo sapiens
uuuacauccaugaa

SEQ ID NO: 1607998 - RNA, 23 nt, Homo sapiens
uuuacauguauuuaaaguagcau

SEQ ID NO: 1607999 - RNA, 11 nt, Homo sapiens
uuuaccaaagc

SEQ ID NO: 1608000 - RNA, 17 nt, Homo sapiens
uuuaccuggugcucuca

SEQ ID NO: 1608001 - RNA, 19 nt, Homo sapiens
uuuaccuguauacagugca

SEQ ID NO: 1608002 - RNA, 17 nt, Homo sapiens
uuuaccuuuaucuuuca

SEQ ID NO: 1608003 - RNA, 18 nt, Homo sapiens
uuuacuauuuauuuacau

SEQ ID NO: 1608004 - RNA, 18 nt, Homo sapiens
uuuacugcuugcuuucca

SEQ ID NO: 1608005 - RNA, 18 nt, Homo sapiens
uuuagaaaaaaaacugaa

SEQ ID NO: 1608006 - RNA, 14 nt, Homo sapiens
uuuagaaagcuuaa

SEQ ID NO: 1608007 - RNA, 16 nt, Homo sapiens
uuuagaaaugcaaaau

SEQ ID NO: 1608008 - RNA, 15 nt, Homo sapiens
uuuagaauaaaucaa

SEQ ID NO: 1608009 - RNA, 18 nt, Homo sapiens
uuuagauuuucuuuugcc

SEQ ID NO: 1608010 - RNA, 18 nt, Homo sapiens
uuuagccauuuucuuuaa

SEQ ID NO: 1608011 - RNA, 19 nt, Homo sapiens
uuuaggaaaagugaaucuu

SEQ ID NO: 1608012 - RNA, 19 nt, Homo sapiens
uuuaggaagcaagcuuaau

SEQ ID NO: 1608013 - RNA, 14 nt, Homo sapiens
uuuaggaguauuau

SEQ ID NO: 1608014 - RNA, 21 nt, Homo sapiens
uuuaguaauauuuuacuuuga

SEQ ID NO: 1608015 - RNA, 18 nt, Homo sapiens
uuuaguacuuguucccuc

SEQ ID NO: 1608016 - RNA, 23 nt, Homo sapiens
uuuagucagcacccccaccaaac

SEQ ID NO: 1608017 - RNA, 17 nt, Homo sapiens
uuuaguuauauucacug

SEQ ID NO: 1608018 - RNA, 19 nt, Homo sapiens
uuuaguuuuacacuaggaa

SEQ ID NO: 1608019 - RNA, 14 nt, Homo sapiens
uuuauaaacuacca

SEQ ID NO: 1608020 - RNA, 19 nt, Homo sapiens
uuuauaaaucuuaugcucu

SEQ ID NO: 1608021 - RNA, 14 nt, Homo sapiens
uuuauaauacccuu

SEQ ID NO: 1608022 - RNA, 14 nt, Homo sapiens
uuuauaguguugcu

SEQ ID NO: 1608023 - RNA, 16 nt, Homo sapiens
uuuauauaauaucuaa

SEQ ID NO: 1608024 - RNA, 23 nt, Homo sapiens
aacaaaaaucuguguaacuguaa

SEQ ID NO: 1608025 - RNA, 20 nt, Homo sapiens
aacaaaaauuaaaauccuca

SEQ ID NO: 1608026 - RNA, 22 nt, Homo sapiens
aacaaaacccucagcacuguua

SEQ ID NO: 1608027 - RNA, 12 nt, Homo sapiens
aacaaaacuaua

SEQ ID NO: 1608028 - RNA, 16 nt, Homo sapiens
aacaaaaguacauugc

SEQ ID NO: 1608029 - RNA, 14 nt, Homo sapiens
aacaaacaaugaaa

SEQ ID NO: 1608030 - RNA, 13 nt, Homo sapiens
aacaaagaacuga

SEQ ID NO: 1608031 - RNA, 13 nt, Homo sapiens
aacaaagacauuu

SEQ ID NO: 1608032 - RNA, 23 nt, Homo sapiens
aacaaauguaauuaauaacuuuc

SEQ ID NO: 1608033 - RNA, 16 nt, Homo sapiens
aacaaauguauuucaa

SEQ ID NO: 1608034 - RNA, 14 nt, Homo sapiens
aacaacaaagacau

SEQ ID NO: 1608035 - RNA, 13 nt, Homo sapiens
aacaacuaccuga

SEQ ID NO: 1608036 - RNA, 21 nt, Homo sapiens
aacaaggcauucagcaguuuc

SEQ ID NO: 1608037 - RNA, 15 nt, Homo sapiens
aacaauaaagauaca

SEQ ID NO: 1608038 - RNA, 18 nt, Homo sapiens
aacaauaaaguacuuuac

SEQ ID NO: 1608039 - RNA, 16 nt, Homo sapiens
aacaauaacgauacaa

SEQ ID NO: 1608040 - RNA, 18 nt, Homo sapiens
aacaauaacgauacaaau

SEQ ID NO: 1608041 - RNA, 17 nt, Homo sapiens
aacaauauaauuuucac

SEQ ID NO: 1608042 - RNA, 21 nt, Homo sapiens
aacaauggaagauuugcccau

SEQ ID NO: 1608043 - RNA, 15 nt, Homo sapiens
aacaauucugugaca

SEQ ID NO: 1608044 - RNA, 24 nt, Homo sapiens
aacaauugguaaaacucacuguga

SEQ ID NO: 1608045 - RNA, 14 nt, Homo sapiens
aacaauuguggucu

SEQ ID NO: 1608046 - RNA, 20 nt, Homo sapiens
aacacacagcaacauccaga

SEQ ID NO: 1608047 - RNA, 13 nt, Homo sapiens
aacacagaggcag

SEQ ID NO: 1608048 - RNA, 22 nt, Homo sapiens
aacaccagccgaggccacagaa

SEQ ID NO: 1608049 - RNA, 13 nt, Homo sapiens
aacacccuuucau

SEQ ID NO: 1608050 - RNA, 17 nt, Homo sapiens
aacacccuuucaucuca

SEQ ID NO: 1608051 - RNA, 21 nt, Homo sapiens
aacacgugaaggcaaugcuca

SEQ ID NO: 1608052 - RNA, 17 nt, Homo sapiens
aacacguggagauggaa

SEQ ID NO: 1608053 - RNA, 20 nt, Homo sapiens
aacacugucacuagucucac

SEQ ID NO: 1608054 - RNA, 20 nt, Homo sapiens
aacagaacauagacagaaga

SEQ ID NO: 1608055 - RNA, 23 nt, Homo sapiens
aacagacaaagcugggauuucag

SEQ ID NO: 1608056 - RNA, 22 nt, Homo sapiens
aacagacucaaaccacauggac

SEQ ID NO: 1608057 - RNA, 12 nt, Homo sapiens
aacagacuugaa

SEQ ID NO: 1608058 - RNA, 22 nt, Homo sapiens
aacagagcaagacccugucuca

SEQ ID NO: 1608059 - RNA, 15 nt, Homo sapiens
aacagagcugggcua

SEQ ID NO: 1608060 - RNA, 13 nt, Homo sapiens
aacagaugaauaa

SEQ ID NO: 1608061 - RNA, 11 nt, Homo sapiens
aacagcacuuu

SEQ ID NO: 1608062 - RNA, 22 nt, Homo sapiens
aacagcauuacccuccucucuc

SEQ ID NO: 1608063 - RNA, 15 nt, Homo sapiens
aacagccaacuagcc

SEQ ID NO: 1608064 - RNA, 16 nt, Homo sapiens
aacagccugacaacau

SEQ ID NO: 1608065 - RNA, 23 nt, Homo sapiens
aacaguaguugcaauguuuuaga

SEQ ID NO: 1608066 - RNA, 15 nt, Homo sapiens
aacagucacuggaaa

SEQ ID NO: 1608067 - RNA, 12 nt, Homo sapiens
aacagugccauu

SEQ ID NO: 1608068 - RNA, 14 nt, Homo sapiens
aacaguugccacau

SEQ ID NO: 1608069 - RNA, 23 nt, Homo sapiens
aacauaccauuucuacaccucaa

SEQ ID NO: 1608070 - RNA, 16 nt, Homo sapiens
aacauagacagaagaa

SEQ ID NO: 1608071 - RNA, 17 nt, Homo sapiens
aacauaguaacuuuaca

SEQ ID NO: 1608072 - RNA, 22 nt, Homo sapiens
aacauauccaaaauaaugagga

SEQ ID NO: 1608073 - RNA, 13 nt, Homo sapiens
aacauaucuugag

SEQ ID NO: 1608074 - RNA, 19 nt, Homo sapiens
aacauaugaggaaucugca

SEQ ID NO: 1608075 - RNA, 12 nt, Homo sapiens
aacauaugucac

SEQ ID NO: 1608076 - RNA, 22 nt, Homo sapiens
aacauaugucacgaacuugaaa

SEQ ID NO: 1608077 - RNA, 23 nt, Homo sapiens
aacauauuggaauguacauguca

SEQ ID NO: 1608078 - RNA, 20 nt, Homo sapiens
aacaucaacaggacuuaaca

SEQ ID NO: 1608079 - RNA, 23 nt, Homo sapiens
aacauccguuuucauuguucacu

SEQ ID NO: 1608080 - RNA, 16 nt, Homo sapiens
aacaucuguuaucaaa

SEQ ID NO: 1608081 - RNA, 13 nt, Homo sapiens
aacaucuuuucac

SEQ ID NO: 1608082 - RNA, 16 nt, Homo sapiens
aacaugcuugcauuau

SEQ ID NO: 1608083 - RNA, 19 nt, Homo sapiens
aacauggaaacaacuucua

SEQ ID NO: 1608084 - RNA, 19 nt, Homo sapiens
aacauggcacauguauaca

SEQ ID NO: 1608085 - RNA, 23 nt, Homo sapiens
aacauggugaaacccccaucucu

SEQ ID NO: 1608086 - RNA, 19 nt, Homo sapiens
aacauguaagcauaacuua

SEQ ID NO: 1608087 - RNA, 16 nt, Homo sapiens
aacauguacuacagcu

SEQ ID NO: 1608088 - RNA, 16 nt, Homo sapiens
aacauguacuuugagc

SEQ ID NO: 1608089 - RNA, 16 nt, Homo sapiens
aacauguauguauaca

SEQ ID NO: 1608090 - RNA, 22 nt, Homo sapiens
aacaugucucuguguaguucca

SEQ ID NO: 1608091 - RNA, 23 nt, Homo sapiens
aacaugugagagguuugacuaga

SEQ ID NO: 1608092 - RNA, 14 nt, Homo sapiens
aacauguguaugua

SEQ ID NO: 1608093 - RNA, 22 nt, Homo sapiens
aacauguguuuucaucauuuca

SEQ ID NO: 1608094 - RNA, 16 nt, Homo sapiens
aacauuauauugcaau

SEQ ID NO: 1608095 - RNA, 23 nt, Homo sapiens
aacauugaucuguuuuacaggaa

SEQ ID NO: 1608096 - RNA, 16 nt, Homo sapiens
aacauuuaaauuccac

SEQ ID NO: 1608097 - RNA, 19 nt, Homo sapiens
aacauuuaaauuccacaga

SEQ ID NO: 1608098 - RNA, 21 nt, Homo sapiens
aacauuuaaauuccacagauu

SEQ ID NO: 1608099 - RNA, 13 nt, Homo sapiens
aacauuucucacu

SEQ ID NO: 1608100 - RNA, 20 nt, Homo sapiens
aacauuucuggacaguaccu

SEQ ID NO: 1608101 - RNA, 22 nt, Homo sapiens
aacauuuguuucccccacaguu

SEQ ID NO: 1608102 - RNA, 17 nt, Homo sapiens
aaccaaacccagguuca

SEQ ID NO: 1608103 - RNA, 14 nt, Homo sapiens
aaccaaagucacaa

SEQ ID NO: 1608104 - RNA, 15 nt, Homo sapiens
aaccaaagugcagga

SEQ ID NO: 1608105 - RNA, 17 nt, Homo sapiens
aaccaacccccaucucc

SEQ ID NO: 1608106 - RNA, 24 nt, Homo sapiens
aaccaagauuaugugacuugcaau

SEQ ID NO: 1608107 - RNA, 12 nt, Homo sapiens
aaccaaugcaag

SEQ ID NO: 1608108 - RNA, 21 nt, Homo sapiens
aaccacauuuagaaauguuua

SEQ ID NO: 1608109 - RNA, 17 nt, Homo sapiens
aaccaccaggugucaaa

SEQ ID NO: 1608110 - RNA, 23 nt, Homo sapiens
aaccacgccucuugaccaggcug

SEQ ID NO: 1608111 - RNA, 15 nt, Homo sapiens
aaccacucauugucu

SEQ ID NO: 1608112 - RNA, 13 nt, Homo sapiens
aaccacugggauc

SEQ ID NO: 1608113 - RNA, 11 nt, Homo sapiens
aaccacuguac

SEQ ID NO: 1608114 - RNA, 13 nt, Homo sapiens
aaccacuuucuaa

SEQ ID NO: 1608115 - RNA, 16 nt, Homo sapiens
aaccagaaaagcaaua

SEQ ID NO: 1608116 - RNA, 19 nt, Homo sapiens
aaccagaacccaguguuuc

SEQ ID NO: 1608117 - RNA, 14 nt, Homo sapiens
aaccagacaccucc

SEQ ID NO: 1608118 - RNA, 20 nt, Homo sapiens
aaccagaccaaccgccugca

SEQ ID NO: 1608119 - RNA, 14 nt, Homo sapiens
aaccaguaaggaaa

SEQ ID NO: 1608120 - RNA, 19 nt, Homo sapiens
aaccaguauuuuugcugcu

SEQ ID NO: 1608121 - RNA, 23 nt, Homo sapiens
aaccaguauuuuugcugcuucug

SEQ ID NO: 1608122 - RNA, 13 nt, Homo sapiens
aaccagugugaac

SEQ ID NO: 1608123 - RNA, 18 nt, Homo sapiens
aaccaucgguccacaccu

SEQ ID NO: 1608124 - RNA, 23 nt, Homo sapiens
aaccauguauaugagcuuauaaa

SEQ ID NO: 1608125 - RNA, 20 nt, Homo sapiens
aaccauucacagugcaagaa

SEQ ID NO: 1608126 - RNA, 19 nt, Homo sapiens
aaccauucuaaaacacaac

SEQ ID NO: 1608127 - RNA, 22 nt, Homo sapiens
aacccacuagaagcaacuagga

SEQ ID NO: 1608128 - RNA, 21 nt, Homo sapiens
aacccacugaaccuucugagc

SEQ ID NO: 1608129 - RNA, 23 nt, Homo sapiens
aacccacuuuaaaauaucuacau

SEQ ID NO: 1608130 - RNA, 16 nt, Homo sapiens
aacccagucucagaca

SEQ ID NO: 1608131 - RNA, 15 nt, Homo sapiens
aacccauacaaugua

SEQ ID NO: 1608132 - RNA, 23 nt, Homo sapiens
aacccauacaauguauguacaau

SEQ ID NO: 1608133 - RNA, 19 nt, Homo sapiens
aacccauguugaucuuucu

SEQ ID NO: 1608134 - RNA, 13 nt, Homo sapiens
aacccccaucucu

SEQ ID NO: 1608135 - RNA, 18 nt, Homo sapiens
aaccccccacacuccacu

SEQ ID NO: 1608136 - RNA, 18 nt, Homo sapiens
aaccccccaccuccacuc

SEQ ID NO: 1608137 - RNA, 16 nt, Homo sapiens
aaccccgucucuacua

SEQ ID NO: 1608138 - RNA, 20 nt, Homo sapiens
aaccccucugcuuuuaacuc

SEQ ID NO: 1608139 - RNA, 18 nt, Homo sapiens
aaccccuugguacugaaa

SEQ ID NO: 1608140 - RNA, 20 nt, Homo sapiens
aacccuucagauuugccuua

SEQ ID NO: 1608141 - RNA, 23 nt, Homo sapiens
aagguuuggugcaaaguauugua

SEQ ID NO: 1608142 - RNA, 15 nt, Homo sapiens
aagguuuucauuugc

SEQ ID NO: 1608143 - RNA, 18 nt, Homo sapiens
aagguuuucuucauucau

SEQ ID NO: 1608144 - RNA, 16 nt, Homo sapiens
aaguaaaacagucauc

SEQ ID NO: 1608145 - RNA, 13 nt, Homo sapiens
aaguaaaaccaca

SEQ ID NO: 1608146 - RNA, 15 nt, Homo sapiens
aaguaaaaccacagc

SEQ ID NO: 1608147 - RNA, 14 nt, Homo sapiens
aaguaagcauuucc

SEQ ID NO: 1608148 - RNA, 15 nt, Homo sapiens
aaguaauaucuuuca

SEQ ID NO: 1608149 - RNA, 14 nt, Homo sapiens
aaguaaucacuuaa

SEQ ID NO: 1608150 - RNA, 14 nt, Homo sapiens
aaguaauugugaaa

SEQ ID NO: 1608151 - RNA, 13 nt, Homo sapiens
aaguagaggaauc

SEQ ID NO: 1608152 - RNA, 18 nt, Homo sapiens
aaguagcaaauguuuacu

SEQ ID NO: 1608153 - RNA, 21 nt, Homo sapiens
aaguagcugucagaugucaca

SEQ ID NO: 1608154 - RNA, 16 nt, Homo sapiens
aaguaggacuaucaca

SEQ ID NO: 1608155 - RNA, 14 nt, Homo sapiens
aaguagggacuucu

SEQ ID NO: 1608156 - RNA, 22 nt, Homo sapiens
aaguagucucuccccuggccac

SEQ ID NO: 1608157 - RNA, 18 nt, Homo sapiens
aaguaucuugcacugaua

SEQ ID NO: 1608158 - RNA, 16 nt, Homo sapiens
aaguauuauuuuacaa

SEQ ID NO: 1608159 - RNA, 13 nt, Homo sapiens
aaguauugaauua

SEQ ID NO: 1608160 - RNA, 16 nt, Homo sapiens
aaguauuuacagggug

SEQ ID NO: 1608161 - RNA, 14 nt, Homo sapiens
aagucaaccugccu

SEQ ID NO: 1608162 - RNA, 23 nt, Homo sapiens
aagucaccaaauagugugaaaua

SEQ ID NO: 1608163 - RNA, 15 nt, Homo sapiens
aagucaccuguauaa

SEQ ID NO: 1608164 - RNA, 20 nt, Homo sapiens
aagucacuggccaguggcug

SEQ ID NO: 1608165 - RNA, 23 nt, Homo sapiens
aagucauagguuacagaccucag

SEQ ID NO: 1608166 - RNA, 17 nt, Homo sapiens
aagucaucauuccucuc

SEQ ID NO: 1608167 - RNA, 13 nt, Homo sapiens
aagucaucuugcu

SEQ ID NO: 1608168 - RNA, 14 nt, Homo sapiens
aagucauggucaca

SEQ ID NO: 1608169 - RNA, 13 nt, Homo sapiens
aaguccagccacu

SEQ ID NO: 1608170 - RNA, 13 nt, Homo sapiens
aaguccagcucau

SEQ ID NO: 1608171 - RNA, 20 nt, Homo sapiens
aagucccugucauuugaacc

SEQ ID NO: 1608172 - RNA, 17 nt, Homo sapiens
aaguccggcggaauuca

SEQ ID NO: 1608173 - RNA, 21 nt, Homo sapiens
aaguccuccagacaacccuca

SEQ ID NO: 1608174 - RNA, 21 nt, Homo sapiens
aagucuaagaaagcaaugcaa

SEQ ID NO: 1608175 - RNA, 14 nt, Homo sapiens
aagucuagaaucau

SEQ ID NO: 1608176 - RNA, 15 nt, Homo sapiens
aagucuagaaucaua

SEQ ID NO: 1608177 - RNA, 20 nt, Homo sapiens
aagucucacuuuuauugaua

SEQ ID NO: 1608178 - RNA, 19 nt, Homo sapiens
aagucuccaaaacauuucu

SEQ ID NO: 1608179 - RNA, 19 nt, Homo sapiens
aagucugcauuucauauua

SEQ ID NO: 1608180 - RNA, 17 nt, Homo sapiens
aagugaaauaagccaga

SEQ ID NO: 1608181 - RNA, 18 nt, Homo sapiens
aagugauucccugcacac

SEQ ID NO: 1608182 - RNA, 11 nt, Homo sapiens
aagugccaaac

SEQ ID NO: 1608183 - RNA, 18 nt, Homo sapiens
aagugccuagacuguuac

SEQ ID NO: 1608184 - RNA, 15 nt, Homo sapiens
aagugcugcacucaa

SEQ ID NO: 1608185 - RNA, 21 nt, Homo sapiens
aagugcugccgcgcagugugg

SEQ ID NO: 1608186 - RNA, 12 nt, Homo sapiens
aagugcuucaca

SEQ ID NO: 1608187 - RNA, 15 nt, Homo sapiens
aaguggagacauauu

SEQ ID NO: 1608188 - RNA, 18 nt, Homo sapiens
aaguggagaccuuucuag

SEQ ID NO: 1608189 - RNA, 17 nt, Homo sapiens
aagugggaucugucaca

SEQ ID NO: 1608190 - RNA, 15 nt, Homo sapiens
aagugguuaaaacau

SEQ ID NO: 1608191 - RNA, 18 nt, Homo sapiens
aagugguuaaaacauagc

SEQ ID NO: 1608192 - RNA, 21 nt, Homo sapiens
aagugguuaaaacauagcuuu

SEQ ID NO: 1608193 - RNA, 15 nt, Homo sapiens
aaguguacacuauug

SEQ ID NO: 1608194 - RNA, 15 nt, Homo sapiens
aagugucaacucuuu

SEQ ID NO: 1608195 - RNA, 13 nt, Homo sapiens
aaguguggaugca

SEQ ID NO: 1608196 - RNA, 20 nt, Homo sapiens
aaguguuuguuggcaauuau

SEQ ID NO: 1608197 - RNA, 21 nt, Homo sapiens
aaguuaaacuauuuugagcau

SEQ ID NO: 1608198 - RNA, 17 nt, Homo sapiens
aaguuaauccacuguga

SEQ ID NO: 1608199 - RNA, 17 nt, Homo sapiens
aaguuacaugcuguaua

SEQ ID NO: 1608200 - RNA, 15 nt, Homo sapiens
aaguuauugugauaa

SEQ ID NO: 1608201 - RNA, 18 nt, Homo sapiens
aaguucuuaguugcugua

SEQ ID NO: 1608202 - RNA, 22 nt, Homo sapiens
aaguugacuuauaguacaugau

SEQ ID NO: 1608203 - RNA, 21 nt, Homo sapiens
aaguugagauucaaacccagg

SEQ ID NO: 1608204 - RNA, 14 nt, Homo sapiens
aaguugauacuuga

SEQ ID NO: 1608205 - RNA, 19 nt, Homo sapiens
aaguugauuagaaagacca

SEQ ID NO: 1608206 - RNA, 23 nt, Homo sapiens
aaguugcuaacuuaaaaaacugc

SEQ ID NO: 1608207 - RNA, 18 nt, Homo sapiens
aaguugcugcuugugauc

SEQ ID NO: 1608208 - RNA, 14 nt, Homo sapiens
aaguuguacaugau

SEQ ID NO: 1608209 - RNA, 13 nt, Homo sapiens
aaguugugcuuga

SEQ ID NO: 1608210 - RNA, 17 nt, Homo sapiens
aaguuguugacugugau

SEQ ID NO: 1608211 - RNA, 22 nt, Homo sapiens
aaguuguugacugugauuagau

SEQ ID NO: 1608212 - RNA, 20 nt, Homo sapiens
aaguuguugcuauacauguu

SEQ ID NO: 1608213 - RNA, 14 nt, Homo sapiens
aaguuucacucaca

SEQ ID NO: 1608214 - RNA, 19 nt, Homo sapiens
aaguuuuuuuagaagacaa

SEQ ID NO: 1608215 - RNA, 16 nt, Homo sapiens
aauaaaaaucauucua

SEQ ID NO: 1608216 - RNA, 23 nt, Homo sapiens
aauaaaaauguucuuacacaagg

SEQ ID NO: 1608217 - RNA, 16 nt, Homo sapiens
aauaaaauaaguggau

SEQ ID NO: 1608218 - RNA, 16 nt, Homo sapiens
aauaaaaucauguagu

SEQ ID NO: 1608219 - RNA, 17 nt, Homo sapiens
aauaaaauuauuugcag

SEQ ID NO: 1608220 - RNA, 13 nt, Homo sapiens
aauaaacacugug

SEQ ID NO: 1608221 - RNA, 19 nt, Homo sapiens
aauaaaccacgccaugagg

SEQ ID NO: 1608222 - RNA, 12 nt, Homo sapiens
aauaaaccacuu

SEQ ID NO: 1608223 - RNA, 16 nt, Homo sapiens
aauaaaccagugugaa

SEQ ID NO: 1608224 - RNA, 13 nt, Homo sapiens
aauaaacuacucu

SEQ ID NO: 1608225 - RNA, 14 nt, Homo sapiens
aauaaagugaacuu

SEQ ID NO: 1608226 - RNA, 13 nt, Homo sapiens
aauaaaguuauuc

SEQ ID NO: 1608227 - RNA, 21 nt, Homo sapiens
aauaaauaagcaaaaugccaa

SEQ ID NO: 1608228 - RNA, 16 nt, Homo sapiens
aauaaauacucaguga

SEQ ID NO: 1608229 - RNA, 20 nt, Homo sapiens
aauaaauauuguguugugca

SEQ ID NO: 1608230 - RNA, 17 nt, Homo sapiens
aauaaaucacuugcucu

SEQ ID NO: 1608231 - RNA, 16 nt, Homo sapiens
aauaaaucuaggaugu

SEQ ID NO: 1608232 - RNA, 16 nt, Homo sapiens
aauaaaugugacucag

SEQ ID NO: 1608233 - RNA, 18 nt, Homo sapiens
aauaaaugugacucagca

SEQ ID NO: 1608234 - RNA, 15 nt, Homo sapiens
aauaaauuaugagcu

SEQ ID NO: 1608235 - RNA, 14 nt, Homo sapiens
aauaaauuaugcaa

SEQ ID NO: 1608236 - RNA, 15 nt, Homo sapiens
aauaaauuaugcaau

SEQ ID NO: 1608237 - RNA, 18 nt, Homo sapiens
aauaaauucccaacuucu

SEQ ID NO: 1608238 - RNA, 22 nt, Homo sapiens
aauaacauuuaaauuccacaga

SEQ ID NO: 1608239 - RNA, 14 nt, Homo sapiens
aauaaccaucugaa

SEQ ID NO: 1608240 - RNA, 17 nt, Homo sapiens
aauaacuauuuuuccuc

SEQ ID NO: 1608241 - RNA, 17 nt, Homo sapiens
aauaacugagauauuau

SEQ ID NO: 1608242 - RNA, 19 nt, Homo sapiens
aauaacuuucucugugaaa

SEQ ID NO: 1608243 - RNA, 22 nt, Homo sapiens
aauaagacaagagaucuacaca

SEQ ID NO: 1608244 - RNA, 22 nt, Homo sapiens
aauaagauugcgccugagauac

SEQ ID NO: 1608245 - RNA, 18 nt, Homo sapiens
aauaagcaaucaagguua

SEQ ID NO: 1608246 - RNA, 15 nt, Homo sapiens
aauaaggcccagagc

SEQ ID NO: 1608247 - RNA, 17 nt, Homo sapiens
aauaaguuaaucaggaa

SEQ ID NO: 1608248 - RNA, 14 nt, Homo sapiens
aauaaguucuuaaa

SEQ ID NO: 1608249 - RNA, 20 nt, Homo sapiens
aauaaucacgcuuuccugaa

SEQ ID NO: 1608250 - RNA, 15 nt, Homo sapiens
aauaaucuauauuaa

SEQ ID NO: 1608251 - RNA, 14 nt, Homo sapiens
aauaaucuuggcaa

SEQ ID NO: 1608252 - RNA, 18 nt, Homo sapiens
aauaaugaguaguguaaa

SEQ ID NO: 1608253 - RNA, 12 nt, Homo sapiens
aauaaugcuuuu

SEQ ID NO: 1608254 - RNA, 23 nt, Homo sapiens
aauaaugugaaugcuauguucug

SEQ ID NO: 1608255 - RNA, 22 nt, Homo sapiens
aauaauuuagacuucaagcaug

SEQ ID NO: 1608256 - RNA, 15 nt, Homo sapiens
aauaauuuucauuuc

SEQ ID NO: 1608257 - RNA, 13 nt, Homo sapiens
aauacaacacuga

SEQ ID NO: 1608258 - RNA, 15 nt, Homo sapiens
aauacaacauugcca

SEQ ID NO: 1608259 - RNA, 22 nt, Homo sapiens
aauacacaguauucagagucuc

SEQ ID NO: 1608260 - RNA, 14 nt, Homo sapiens
acaaaccauuuugu

SEQ ID NO: 1608261 - RNA, 13 nt, Homo sapiens
acaaacucucacc

SEQ ID NO: 1608262 - RNA, 16 nt, Homo sapiens
acaaagacaaccacug

SEQ ID NO: 1608263 - RNA, 13 nt, Homo sapiens
acaaagaugacug

SEQ ID NO: 1608264 - RNA, 15 nt, Homo sapiens
acaaagcacuagaga

SEQ ID NO: 1608265 - RNA, 21 nt, Homo sapiens
acaaaggaaauaucaaagugu

SEQ ID NO: 1608266 - RNA, 19 nt, Homo sapiens
acaaaggcugacauucacu

SEQ ID NO: 1608267 - RNA, 14 nt, Homo sapiens
acaaaguacauucu

SEQ ID NO: 1608268 - RNA, 16 nt, Homo sapiens
acaaagucaacuucca

SEQ ID NO: 1608269 - RNA, 18 nt, Homo sapiens
acaaauaaacucauuuaa

SEQ ID NO: 1608270 - RNA, 14 nt, Homo sapiens
acaaauauugucau

SEQ ID NO: 1608271 - RNA, 18 nt, Homo sapiens
acaaaugacgucuucacc

SEQ ID NO: 1608272 - RNA, 17 nt, Homo sapiens
acaaaugggucccucag

SEQ ID NO: 1608273 - RNA, 18 nt, Homo sapiens
acaaauuauaaaaaccau

SEQ ID NO: 1608274 - RNA, 22 nt, Homo sapiens
acaaauugauagucaauaucaa

SEQ ID NO: 1608275 - RNA, 16 nt, Homo sapiens
acaacaauccuucuau

SEQ ID NO: 1608276 - RNA, 16 nt, Homo sapiens
acaacacugagccauu

SEQ ID NO: 1608277 - RNA, 13 nt, Homo sapiens
acaacagcacaca

SEQ ID NO: 1608278 - RNA, 19 nt, Homo sapiens
acaacaguucugagcugua

SEQ ID NO: 1608279 - RNA, 11 nt, Homo sapiens
acaaccaggau

SEQ ID NO: 1608280 - RNA, 17 nt, Homo sapiens
acaacucauuccagauc

SEQ ID NO: 1608281 - RNA, 20 nt, Homo sapiens
acaacucauuccagauccca

SEQ ID NO: 1608282 - RNA, 22 nt, Homo sapiens
acaacucccuuaaggucuccaa

SEQ ID NO: 1608283 - RNA, 15 nt, Homo sapiens
acaacugcauaaccu

SEQ ID NO: 1608284 - RNA, 20 nt, Homo sapiens
acaacugccagcucucugau

SEQ ID NO: 1608285 - RNA, 14 nt, Homo sapiens
acaacugugugauu

SEQ ID NO: 1608286 - RNA, 16 nt, Homo sapiens
acaagaaacauuucag

SEQ ID NO: 1608287 - RNA, 22 nt, Homo sapiens
acaagaaagucauuagacggua

SEQ ID NO: 1608288 - RNA, 20 nt, Homo sapiens
acaagaacuuuaaauugugu

SEQ ID NO: 1608289 - RNA, 20 nt, Homo sapiens
acaagacacagaauaguuua

SEQ ID NO: 1608290 - RNA, 15 nt, Homo sapiens
acaagagaucuacac

SEQ ID NO: 1608291 - RNA, 17 nt, Homo sapiens
acaagagaucuacacau

SEQ ID NO: 1608292 - RNA, 23 nt, Homo sapiens
acaagaggauuguaaaaugcacc

SEQ ID NO: 1608293 - RNA, 22 nt, Homo sapiens
acaagaggccauuuaaguaucu

SEQ ID NO: 1608294 - RNA, 21 nt, Homo sapiens
acaagucaguuucuacacugg

SEQ ID NO: 1608295 - RNA, 14 nt, Homo sapiens
acaaguccagcugg

SEQ ID NO: 1608296 - RNA, 21 nt, Homo sapiens
acaagucugcauuucauauua

SEQ ID NO: 1608297 - RNA, 15 nt, Homo sapiens
acaauaaaguacuuu

SEQ ID NO: 1608298 - RNA, 14 nt, Homo sapiens
acaauacaguauua

SEQ ID NO: 1608299 - RNA, 17 nt, Homo sapiens
acaauacaucaacaaga

SEQ ID NO: 1608300 - RNA, 17 nt, Homo sapiens
acaauagacauugcaaa

SEQ ID NO: 1608301 - RNA, 16 nt, Homo sapiens
acaauaggucuuucuc

SEQ ID NO: 1608302 - RNA, 13 nt, Homo sapiens
acaauaugugcca

SEQ ID NO: 1608303 - RNA, 20 nt, Homo sapiens
acaaucauuguuuugaauau

SEQ ID NO: 1608304 - RNA, 23 nt, Homo sapiens
acaauccuucuauucuagccugc

SEQ ID NO: 1608305 - RNA, 14 nt, Homo sapiens
acaaucugaaacag

SEQ ID NO: 1608306 - RNA, 17 nt, Homo sapiens
acaaugaaaacaaauaa

SEQ ID NO: 1608307 - RNA, 21 nt, Homo sapiens
acaaugauaggaaaaauccau

SEQ ID NO: 1608308 - RNA, 11 nt, Homo sapiens
acaaugccaau

SEQ ID NO: 1608309 - RNA, 14 nt, Homo sapiens
acaaugccaauagg

SEQ ID NO: 1608310 - RNA, 21 nt, Homo sapiens
acaaugccagaccgcagagag

SEQ ID NO: 1608311 - RNA, 23 nt, Homo sapiens
acaauggggggaaggauagcauu

SEQ ID NO: 1608312 - RNA, 20 nt, Homo sapiens
acaauguauacaaugcacuu

SEQ ID NO: 1608313 - RNA, 23 nt, Homo sapiens
acaauguugcauuuaugaugcag

SEQ ID NO: 1608314 - RNA, 23 nt, Homo sapiens
acaauuaacauacaucauuccac

SEQ ID NO: 1608315 - RNA, 15 nt, Homo sapiens
acaauuuaugaauug

SEQ ID NO: 1608316 - RNA, 17 nt, Homo sapiens
acaauuuguuuuugcau

SEQ ID NO: 1608317 - RNA, 14 nt, Homo sapiens
acaauuuuuauuuc

SEQ ID NO: 1608318 - RNA, 13 nt, Homo sapiens
acacaaccagagg

SEQ ID NO: 1608319 - RNA, 13 nt, Homo sapiens
acacaaucucugu

SEQ ID NO: 1608320 - RNA, 15 nt, Homo sapiens
acacaaucugaaaca

SEQ ID NO: 1608321 - RNA, 13 nt, Homo sapiens
acacacaauaaag

SEQ ID NO: 1608322 - RNA, 15 nt, Homo sapiens
acacacacaaaaaau

SEQ ID NO: 1608323 - RNA, 12 nt, Homo sapiens
acacacaguacg

SEQ ID NO: 1608324 - RNA, 14 nt, Homo sapiens
acacacaugcauac

SEQ ID NO: 1608325 - RNA, 23 nt, Homo sapiens
acacacaugcauacuuacagacu

SEQ ID NO: 1608326 - RNA, 21 nt, Homo sapiens
acacaccccuccggacaucca

SEQ ID NO: 1608327 - RNA, 11 nt, Homo sapiens
acacacugagu

SEQ ID NO: 1608328 - RNA, 16 nt, Homo sapiens
acacagaugugaaaug

SEQ ID NO: 1608329 - RNA, 16 nt, Homo sapiens
acacagcaacaaugac

SEQ ID NO: 1608330 - RNA, 19 nt, Homo sapiens
acacagcaacauccagaaa

SEQ ID NO: 1608331 - RNA, 12 nt, Homo sapiens
acacagcaucag

SEQ ID NO: 1608332 - RNA, 15 nt, Homo sapiens
acacagcaucagcuc

SEQ ID NO: 1608333 - RNA, 21 nt, Homo sapiens
acacagcccuggaaacauaca

SEQ ID NO: 1608334 - RNA, 17 nt, Homo sapiens
acacagggcccggccac

SEQ ID NO: 1608335 - RNA, 22 nt, Homo sapiens
acacagguagcacagauuuuga

SEQ ID NO: 1608336 - RNA, 15 nt, Homo sapiens
acacaggucccugag

SEQ ID NO: 1608337 - RNA, 16 nt, Homo sapiens
acacaugcccaugaug

SEQ ID NO: 1608338 - RNA, 16 nt, Homo sapiens
acacauuucacuguga

SEQ ID NO: 1608339 - RNA, 21 nt, Homo sapiens
acacauuucuuaaaacacaug

SEQ ID NO: 1608340 - RNA, 22 nt, Homo sapiens
acacauuucuuaaaacacauga

SEQ ID NO: 1608341 - RNA, 21 nt, Homo sapiens
acaccacgguagugccugaaa

SEQ ID NO: 1608342 - RNA, 23 nt, Homo sapiens
acaccacuuuacuuguguuauau

SEQ ID NO: 1608343 - RNA, 21 nt, Homo sapiens
acaccauucaucucuaacaua

SEQ ID NO: 1608344 - RNA, 15 nt, Homo sapiens
acaccauucauucca

SEQ ID NO: 1608345 - RNA, 18 nt, Homo sapiens
acacccaaggauucuguu

SEQ ID NO: 1608346 - RNA, 13 nt, Homo sapiens
acacccaguggga

SEQ ID NO: 1608347 - RNA, 21 nt, Homo sapiens
acacccagugggaagagugug

SEQ ID NO: 1608348 - RNA, 22 nt, Homo sapiens
acacccuggccugaacugagga

SEQ ID NO: 1608349 - RNA, 15 nt, Homo sapiens
acacccuuucaucuc

SEQ ID NO: 1608350 - RNA, 13 nt, Homo sapiens
acaccgaccggag

SEQ ID NO: 1608351 - RNA, 17 nt, Homo sapiens
acaccguguccaaaaag

SEQ ID NO: 1608352 - RNA, 21 nt, Homo sapiens
acaccuacaugaaaagcagaa

SEQ ID NO: 1608353 - RNA, 23 nt, Homo sapiens
acaccucccccuuucacacugga

SEQ ID NO: 1608354 - RNA, 17 nt, Homo sapiens
acaccucuaaacaucuc

SEQ ID NO: 1608355 - RNA, 17 nt, Homo sapiens
acaccugccucugaccc

SEQ ID NO: 1608356 - RNA, 12 nt, Homo sapiens
acaccuggacug

SEQ ID NO: 1608357 - RNA, 16 nt, Homo sapiens
acaccuuagucuuucc

SEQ ID NO: 1608358 - RNA, 14 nt, Homo sapiens
acacgaguuccaga

SEQ ID NO: 1608359 - RNA, 14 nt, Homo sapiens
acacgcucaguuga

SEQ ID NO: 1608360 - RNA, 21 nt, Homo sapiens
acacggaugacuuaacugcau

SEQ ID NO: 1608361 - RNA, 22 nt, Homo sapiens
acacggcuugugggcacugugc

SEQ ID NO: 1608362 - RNA, 13 nt, Homo sapiens
acacuaacaucaa

SEQ ID NO: 1608363 - RNA, 13 nt, Homo sapiens
acacuaaccaaac

SEQ ID NO: 1608364 - RNA, 23 nt, Homo sapiens
acacucaccugcacuaacagagu

SEQ ID NO: 1608365 - RNA, 18 nt, Homo sapiens
acacucagccacugucac

SEQ ID NO: 1608366 - RNA, 20 nt, Homo sapiens
acacuccacuccacacucuu

SEQ ID NO: 1608367 - RNA, 17 nt, Homo sapiens
acacuccaguuugccca

SEQ ID NO: 1608368 - RNA, 19 nt, Homo sapiens
acacucuauaagauuccaa

SEQ ID NO: 1608369 - RNA, 23 nt, Homo sapiens
acacucuauaagauuccaaaaag

SEQ ID NO: 1608370 - RNA, 13 nt, Homo sapiens
acacugaguugca

SEQ ID NO: 1608371 - RNA, 20 nt, Homo sapiens
acacuguauauaaacauauc

SEQ ID NO: 1608372 - RNA, 21 nt, Homo sapiens
acacuguauguuauagaacuu

SEQ ID NO: 1608373 - RNA, 12 nt, Homo sapiens
acacuguccaug

SEQ ID NO: 1608374 - RNA, 16 nt, Homo sapiens
acacuguccaugaagc

SEQ ID NO: 1608375 - RNA, 21 nt, Homo sapiens
acacuguccaugaagcacuga

SEQ ID NO: 1608376 - RNA, 18 nt, Homo sapiens
acacuuaaauucucuaac

SEQ ID NO: 1608377 - RNA, 14 nt, Homo sapiens
acacuugucuuuac

SEQ ID NO: 1608378 - RNA, 15 nt, Homo sapiens
acccuggaaauggac

SEQ ID NO: 1608379 - RNA, 17 nt, Homo sapiens
acccuggagagugcaca

SEQ ID NO: 1608380 - RNA, 14 nt, Homo sapiens
acccugggcagcua

SEQ ID NO: 1608381 - RNA, 15 nt, Homo sapiens
acccuugcugugaau

SEQ ID NO: 1608382 - RNA, 16 nt, Homo sapiens
acccuuuagugcuuug

SEQ ID NO: 1608383 - RNA, 15 nt, Homo sapiens
accgagacacuuuau

SEQ ID NO: 1608384 - RNA, 18 nt, Homo sapiens
accgaggcuacagcucca

SEQ ID NO: 1608385 - RNA, 20 nt, Homo sapiens
accgcgcccggccucagugc

SEQ ID NO: 1608386 - RNA, 16 nt, Homo sapiens
accgcgucccagcucc

SEQ ID NO: 1608387 - RNA, 18 nt, Homo sapiens
accgggcucacuugcuca

SEQ ID NO: 1608388 - RNA, 22 nt, Homo sapiens
accguggaggaggaaggcaaga

SEQ ID NO: 1608389 - RNA, 17 nt, Homo sapiens
accgugggcucccugac

SEQ ID NO: 1608390 - RNA, 22 nt, Homo sapiens
accuaaaaacauuuacugacca

SEQ ID NO: 1608391 - RNA, 13 nt, Homo sapiens
accuaaacuguau

SEQ ID NO: 1608392 - RNA, 14 nt, Homo sapiens
accuaaugcacucu

SEQ ID NO: 1608393 - RNA, 19 nt, Homo sapiens
accuacaugagguacugag

SEQ ID NO: 1608394 - RNA, 17 nt, Homo sapiens
accuagacaaccagagg

SEQ ID NO: 1608395 - RNA, 12 nt, Homo sapiens
accucaccaaaa

SEQ ID NO: 1608396 - RNA, 13 nt, Homo sapiens
accucaccaaaac

SEQ ID NO: 1608397 - RNA, 13 nt, Homo sapiens
accucaccaagga

SEQ ID NO: 1608398 - RNA, 20 nt, Homo sapiens
accucacuguccaauaugaa

SEQ ID NO: 1608399 - RNA, 16 nt, Homo sapiens
accucagcacugugga

SEQ ID NO: 1608400 - RNA, 19 nt, Homo sapiens
accucagccucccaaagug

SEQ ID NO: 1608401 - RNA, 21 nt, Homo sapiens
accucaggugauccaccugcc

SEQ ID NO: 1608402 - RNA, 18 nt, Homo sapiens
accucaguuuccucaucu

SEQ ID NO: 1608403 - RNA, 14 nt, Homo sapiens
accuccacauccca

SEQ ID NO: 1608404 - RNA, 16 nt, Homo sapiens
accucccauuggccaa

SEQ ID NO: 1608405 - RNA, 14 nt, Homo sapiens
accuccguggaaua

SEQ ID NO: 1608406 - RNA, 20 nt, Homo sapiens
accuccuauggguugucacc

SEQ ID NO: 1608407 - RNA, 17 nt, Homo sapiens
accuccuguguggaaga

SEQ ID NO: 1608408 - RNA, 15 nt, Homo sapiens
accuccuuagcccug

SEQ ID NO: 1608409 - RNA, 19 nt, Homo sapiens
accuccuucuuccuagcca

SEQ ID NO: 1608410 - RNA, 21 nt, Homo sapiens
accucgaguacugugggcaau

SEQ ID NO: 1608411 - RNA, 22 nt, Homo sapiens
accucuaguaaauuuaagucca

SEQ ID NO: 1608412 - RNA, 23 nt, Homo sapiens
accucuaguaaauuuaaguccac

SEQ ID NO: 1608413 - RNA, 20 nt, Homo sapiens
accucucaacauuaccaaaa

SEQ ID NO: 1608414 - RNA, 15 nt, Homo sapiens
accucuccauccugc

SEQ ID NO: 1608415 - RNA, 22 nt, Homo sapiens
accucuccuucaugacagccuc

SEQ ID NO: 1608416 - RNA, 19 nt, Homo sapiens
accucugagaagacacaag

SEQ ID NO: 1608417 - RNA, 10 nt, Homo sapiens
accucugcau

SEQ ID NO: 1608418 - RNA, 18 nt, Homo sapiens
accucuucuuuaccagaa

SEQ ID NO: 1608419 - RNA, 15 nt, Homo sapiens
accucuuucaggguu

SEQ ID NO: 1608420 - RNA, 18 nt, Homo sapiens
accugaaaacacugugca

SEQ ID NO: 1608421 - RNA, 17 nt, Homo sapiens
accugagaaauggccaa

SEQ ID NO: 1608422 - RNA, 22 nt, Homo sapiens
accugauugaucacacaguguu

SEQ ID NO: 1608423 - RNA, 11 nt, Homo sapiens
accugcacaac

SEQ ID NO: 1608424 - RNA, 21 nt, Homo sapiens
accugcacguugugcacaugu

SEQ ID NO: 1608425 - RNA, 20 nt, Homo sapiens
accugcagggccaauggccu

SEQ ID NO: 1608426 - RNA, 14 nt, Homo sapiens
accugccacucaca

SEQ ID NO: 1608427 - RNA, 21 nt, Homo sapiens
accugccagccgguucugcua

SEQ ID NO: 1608428 - RNA, 23 nt, Homo sapiens
accugcugcagggacagcccuga

SEQ ID NO: 1608429 - RNA, 17 nt, Homo sapiens
accugcuuggucuuuca

SEQ ID NO: 1608430 - RNA, 16 nt, Homo sapiens
accuggaaacugcuca

SEQ ID NO: 1608431 - RNA, 14 nt, Homo sapiens
accuggacugagcc

SEQ ID NO: 1608432 - RNA, 22 nt, Homo sapiens
accuggagggcuagaaccuaga

SEQ ID NO: 1608433 - RNA, 12 nt, Homo sapiens
accuggauccag

SEQ ID NO: 1608434 - RNA, 17 nt, Homo sapiens
accuggauccagcacug

SEQ ID NO: 1608435 - RNA, 21 nt, Homo sapiens
accuggcaacaaaaaguaaug

SEQ ID NO: 1608436 - RNA, 18 nt, Homo sapiens
accuggcccugugccuug

SEQ ID NO: 1608437 - RNA, 16 nt, Homo sapiens
accuggcgugcucaga

SEQ ID NO: 1608438 - RNA, 17 nt, Homo sapiens
accuggucaauagugau

SEQ ID NO: 1608439 - RNA, 19 nt, Homo sapiens
accuggucugguugggcag

SEQ ID NO: 1608440 - RNA, 14 nt, Homo sapiens
accugguuuguucu

SEQ ID NO: 1608441 - RNA, 15 nt, Homo sapiens
accuguaaucccagc

SEQ ID NO: 1608442 - RNA, 21 nt, Homo sapiens
accuguaccuccaaaagugac

SEQ ID NO: 1608443 - RNA, 14 nt, Homo sapiens
accuguagauucag

SEQ ID NO: 1608444 - RNA, 18 nt, Homo sapiens
accuguauacagugcaga

SEQ ID NO: 1608445 - RNA, 12 nt, Homo sapiens
accugugcugug

SEQ ID NO: 1608446 - RNA, 22 nt, Homo sapiens
accuguuaauuuuuauacugac

SEQ ID NO: 1608447 - RNA, 19 nt, Homo sapiens
accuguugguuagauucaa

SEQ ID NO: 1608448 - RNA, 22 nt, Homo sapiens
accuguugguuagauucaaggc

SEQ ID NO: 1608449 - RNA, 16 nt, Homo sapiens
accuguuuuuguuucu

SEQ ID NO: 1608450 - RNA, 19 nt, Homo sapiens
accuuaaauuaaacaauuu

SEQ ID NO: 1608451 - RNA, 15 nt, Homo sapiens
accuuaaugacaaca

SEQ ID NO: 1608452 - RNA, 15 nt, Homo sapiens
accuuaguuccuuac

SEQ ID NO: 1608453 - RNA, 13 nt, Homo sapiens
accuuauccugca

SEQ ID NO: 1608454 - RNA, 20 nt, Homo sapiens
accuuaugagaaacugcaug

SEQ ID NO: 1608455 - RNA, 23 nt, Homo sapiens
accuucacgauuaacugugaaau

SEQ ID NO: 1608456 - RNA, 18 nt, Homo sapiens
accuucaugcuuacuauu

SEQ ID NO: 1608457 - RNA, 14 nt, Homo sapiens
accuugaaauggaa

SEQ ID NO: 1608458 - RNA, 13 nt, Homo sapiens
accuuggaccuca

SEQ ID NO: 1608459 - RNA, 14 nt, Homo sapiens
accuuggaccucag

SEQ ID NO: 1608460 - RNA, 16 nt, Homo sapiens
accuuggaccucagug

SEQ ID NO: 1608461 - RNA, 12 nt, Homo sapiens
accuugugagag

SEQ ID NO: 1608462 - RNA, 18 nt, Homo sapiens
accuuguuugaguuauca

SEQ ID NO: 1608463 - RNA, 20 nt, Homo sapiens
accuuuaggucaaacucccu

SEQ ID NO: 1608464 - RNA, 21 nt, Homo sapiens
accuuucacgaacaugggcau

SEQ ID NO: 1608465 - RNA, 14 nt, Homo sapiens
accuuuccauuuau

SEQ ID NO: 1608466 - RNA, 19 nt, Homo sapiens
accuuuggaagucaugagc

SEQ ID NO: 1608467 - RNA, 13 nt, Homo sapiens
accuuuguuccca

SEQ ID NO: 1608468 - RNA, 22 nt, Homo sapiens
accuuuuauguguugaugacuc

SEQ ID NO: 1608469 - RNA, 18 nt, Homo sapiens
acgaaaauaguauuucag

SEQ ID NO: 1608470 - RNA, 19 nt, Homo sapiens
acgaaugaaugaacagcca

SEQ ID NO: 1608471 - RNA, 14 nt, Homo sapiens
acgacacauuugcc

SEQ ID NO: 1608472 - RNA, 20 nt, Homo sapiens
acgacccuugagaagcugcc

SEQ ID NO: 1608473 - RNA, 20 nt, Homo sapiens
acgagugcucucggcccaac

SEQ ID NO: 1608474 - RNA, 15 nt, Homo sapiens
acgauuaacugugaa

SEQ ID NO: 1608475 - RNA, 14 nt, Homo sapiens
acgcaaggugugcu

SEQ ID NO: 1608476 - RNA, 22 nt, Homo sapiens
acgcaaggugugcucugagcca

SEQ ID NO: 1608477 - RNA, 15 nt, Homo sapiens
acgcaccaaucagca

SEQ ID NO: 1608478 - RNA, 20 nt, Homo sapiens
acgccacucauuucaucuca

SEQ ID NO: 1608479 - RNA, 20 nt, Homo sapiens
acgccccgaaccucaccuga

SEQ ID NO: 1608480 - RNA, 21 nt, Homo sapiens
acgcccgucucuuucucaccu

SEQ ID NO: 1608481 - RNA, 15 nt, Homo sapiens
acgccuccuggccag

SEQ ID NO: 1608482 - RNA, 17 nt, Homo sapiens
acgccuguaaucccagc

SEQ ID NO: 1608483 - RNA, 21 nt, Homo sapiens
acgcuggggaauauacgugcu

SEQ ID NO: 1608484 - RNA, 20 nt, Homo sapiens
acgcuuaaaggugucuuccu

SEQ ID NO: 1608485 - RNA, 13 nt, Homo sapiens
acgcuugcucugu

SEQ ID NO: 1608486 - RNA, 18 nt, Homo sapiens
acggacaaagagauugag

SEQ ID NO: 1608487 - RNA, 17 nt, Homo sapiens
acggacucaugauuucu

SEQ ID NO: 1608488 - RNA, 20 nt, Homo sapiens
acggacugugcauacuuucc

SEQ ID NO: 1608489 - RNA, 20 nt, Homo sapiens
acggagccacuccucugacu

SEQ ID NO: 1608490 - RNA, 21 nt, Homo sapiens
acggaucugcugggcucugcc

SEQ ID NO: 1608491 - RNA, 18 nt, Homo sapiens
acggcuccuccuuaugac

SEQ ID NO: 1608492 - RNA, 17 nt, Homo sapiens
acgggcaaucaugagca

SEQ ID NO: 1608493 - RNA, 15 nt, Homo sapiens
acgggcagucugcuc

SEQ ID NO: 1608494 - RNA, 16 nt, Homo sapiens
acgggcagucugcucu

SEQ ID NO: 1608495 - RNA, 20 nt, Homo sapiens
acgguguccaugccuuccau

SEQ ID NO: 1608496 - RNA, 17 nt, Homo sapiens
aguagacuuggacccaa

SEQ ID NO: 1608497 - RNA, 20 nt, Homo sapiens
aguagagaugggguuucacc

SEQ ID NO: 1608498 - RNA, 18 nt, Homo sapiens
aguagauauugauuacua

SEQ ID NO: 1608499 - RNA, 17 nt, Homo sapiens
aguagcugaaaugcaag

SEQ ID NO: 1608500 - RNA, 14 nt, Homo sapiens
aguaggaugaauca

SEQ ID NO: 1608501 - RNA, 19 nt, Homo sapiens
aguaggcaucaguauguca

SEQ ID NO: 1608502 - RNA, 23 nt, Homo sapiens
aguaguacuucuucuguaauauu

SEQ ID NO: 1608503 - RNA, 18 nt, Homo sapiens
aguagucaaaaacaaagc

SEQ ID NO: 1608504 - RNA, 17 nt, Homo sapiens
aguaguccuuggcauag

SEQ ID NO: 1608505 - RNA, 17 nt, Homo sapiens
aguaguggccacugggg

SEQ ID NO: 1608506 - RNA, 22 nt, Homo sapiens
aguaguucacauacaaaucauc

SEQ ID NO: 1608507 - RNA, 12 nt, Homo sapiens
aguauaacaguu

SEQ ID NO: 1608508 - RNA, 22 nt, Homo sapiens
aguauauggacacuacacuggg

SEQ ID NO: 1608509 - RNA, 12 nt, Homo sapiens
aguauauguuaa

SEQ ID NO: 1608510 - RNA, 17 nt, Homo sapiens
aguaucacacuguauau

SEQ ID NO: 1608511 - RNA, 14 nt, Homo sapiens
aguaucagcacuag

SEQ ID NO: 1608512 - RNA, 21 nt, Homo sapiens
aguaucuuuuuuccuuaucua

SEQ ID NO: 1608513 - RNA, 14 nt, Homo sapiens
aguaugaaguauaa

SEQ ID NO: 1608514 - RNA, 17 nt, Homo sapiens
aguaugguaaucuuuac

SEQ ID NO: 1608515 - RNA, 14 nt, Homo sapiens
aguauguaaaacau

SEQ ID NO: 1608516 - RNA, 18 nt, Homo sapiens
aguauguccgaugguauc

SEQ ID NO: 1608517 - RNA, 13 nt, Homo sapiens
aguauuacaugau

SEQ ID NO: 1608518 - RNA, 18 nt, Homo sapiens
aguauuauuuuacaauca

SEQ ID NO: 1608519 - RNA, 17 nt, Homo sapiens
aguauuuaggaaauggg

SEQ ID NO: 1608520 - RNA, 23 nt, Homo sapiens
aguauuuuuuaauccuaccucaa

SEQ ID NO: 1608521 - RNA, 17 nt, Homo sapiens
agucaaccaauguagaa

SEQ ID NO: 1608522 - RNA, 21 nt, Homo sapiens
agucaaccugccugacauuug

SEQ ID NO: 1608523 - RNA, 22 nt, Homo sapiens
agucaagcuguugaagucucag

SEQ ID NO: 1608524 - RNA, 13 nt, Homo sapiens
agucacacagugu

SEQ ID NO: 1608525 - RNA, 21 nt, Homo sapiens
agucacauaggaaacuugaaa

SEQ ID NO: 1608526 - RNA, 17 nt, Homo sapiens
agucacaucucuuccuc

SEQ ID NO: 1608527 - RNA, 12 nt, Homo sapiens
agucacauuugc

SEQ ID NO: 1608528 - RNA, 15 nt, Homo sapiens
agucacucacauuga

SEQ ID NO: 1608529 - RNA, 14 nt, Homo sapiens
agucagacugacac

SEQ ID NO: 1608530 - RNA, 21 nt, Homo sapiens
agucagaggagaagagacaug

SEQ ID NO: 1608531 - RNA, 16 nt, Homo sapiens
agucagggaccugcug

SEQ ID NO: 1608532 - RNA, 22 nt, Homo sapiens
agucagggaccugcugcucagu

SEQ ID NO: 1608533 - RNA, 17 nt, Homo sapiens
agucauaucaaagggua

SEQ ID NO: 1608534 - RNA, 16 nt, Homo sapiens
agucaucaaugcaaua

SEQ ID NO: 1608535 - RNA, 23 nt, Homo sapiens
agucaucagauaugcuuacuaaa

SEQ ID NO: 1608536 - RNA, 18 nt, Homo sapiens
agucauccagucuauuca

SEQ ID NO: 1608537 - RNA, 14 nt, Homo sapiens
agucaugaugaauc

SEQ ID NO: 1608538 - RNA, 19 nt, Homo sapiens
agucauuaugagaggcaau

SEQ ID NO: 1608539 - RNA, 13 nt, Homo sapiens
aguccaccuucau

SEQ ID NO: 1608540 - RNA, 19 nt, Homo sapiens
aguccagagggacagucag

SEQ ID NO: 1608541 - RNA, 16 nt, Homo sapiens
aguccagcacaaccuu

SEQ ID NO: 1608542 - RNA, 20 nt, Homo sapiens
aguccaggcccccagccccu

SEQ ID NO: 1608543 - RNA, 13 nt, Homo sapiens
aguccaugcauga

SEQ ID NO: 1608544 - RNA, 19 nt, Homo sapiens
agucccaaaugucaucagg

SEQ ID NO: 1608545 - RNA, 15 nt, Homo sapiens
agucccacuacuugu

SEQ ID NO: 1608546 - RNA, 17 nt, Homo sapiens
agucccugccaucaugu

SEQ ID NO: 1608547 - RNA, 17 nt, Homo sapiens
aguccgcagaagcccug

SEQ ID NO: 1608548 - RNA, 19 nt, Homo sapiens
aguccggccccaguacaca

SEQ ID NO: 1608549 - RNA, 15 nt, Homo sapiens
aguccuagcuacuca

SEQ ID NO: 1608550 - RNA, 20 nt, Homo sapiens
aguccuauuuuucaauggga

SEQ ID NO: 1608551 - RNA, 18 nt, Homo sapiens
aguccuccacucgaccca

SEQ ID NO: 1608552 - RNA, 22 nt, Homo sapiens
aguccuccagacaacccucaga

SEQ ID NO: 1608553 - RNA, 13 nt, Homo sapiens
aguccuuauguua

SEQ ID NO: 1608554 - RNA, 20 nt, Homo sapiens
aguccuuauguuaagcccug

SEQ ID NO: 1608555 - RNA, 17 nt, Homo sapiens
aguccuuuuugucaugc

SEQ ID NO: 1608556 - RNA, 15 nt, Homo sapiens
agucgaacaauucau

SEQ ID NO: 1608557 - RNA, 23 nt, Homo sapiens
agucgaaccauggugaacuccac

SEQ ID NO: 1608558 - RNA, 14 nt, Homo sapiens
agucggaaugucau

SEQ ID NO: 1608559 - RNA, 14 nt, Homo sapiens
agucuauggguuua

SEQ ID NO: 1608560 - RNA, 15 nt, Homo sapiens
agucucauagguuaa

SEQ ID NO: 1608561 - RNA, 18 nt, Homo sapiens
agucuccaaaacauuucu

SEQ ID NO: 1608562 - RNA, 21 nt, Homo sapiens
agucuccucacucugucccug

SEQ ID NO: 1608563 - RNA, 20 nt, Homo sapiens
agucucugaauacacaguau

SEQ ID NO: 1608564 - RNA, 20 nt, Homo sapiens
agucucugauacacaguaau

SEQ ID NO: 1608565 - RNA, 13 nt, Homo sapiens
agucucugcugcu

SEQ ID NO: 1608566 - RNA, 13 nt, Homo sapiens
agucucuucugau

SEQ ID NO: 1608567 - RNA, 23 nt, Homo sapiens
agucugaagcucgcauccagaca

SEQ ID NO: 1608568 - RNA, 20 nt, Homo sapiens
agucugaccccugccaccuu

SEQ ID NO: 1608569 - RNA, 12 nt, Homo sapiens
agucugccaagu

SEQ ID NO: 1608570 - RNA, 21 nt, Homo sapiens
agucugcucugcugcucugac

SEQ ID NO: 1608571 - RNA, 15 nt, Homo sapiens
agucuguucacugca

SEQ ID NO: 1608572 - RNA, 19 nt, Homo sapiens
agucuuagagcuuuaccua

SEQ ID NO: 1608573 - RNA, 23 nt, Homo sapiens
agucuuauuuacgucgucaaaaa

SEQ ID NO: 1608574 - RNA, 14 nt, Homo sapiens
agucuucuauuuau

SEQ ID NO: 1608575 - RNA, 13 nt, Homo sapiens
agucuugugccaa

SEQ ID NO: 1608576 - RNA, 13 nt, Homo sapiens
agucuuugccagu

SEQ ID NO: 1608577 - RNA, 17 nt, Homo sapiens
agugaaaaaggaaugau

SEQ ID NO: 1608578 - RNA, 20 nt, Homo sapiens
agugaaacguaauuguacaa

SEQ ID NO: 1608579 - RNA, 23 nt, Homo sapiens
agugaaacuugggcacaugcuca

SEQ ID NO: 1608580 - RNA, 20 nt, Homo sapiens
agugaacaaauuuacagaga

SEQ ID NO: 1608581 - RNA, 14 nt, Homo sapiens
agugaagacuggaa

SEQ ID NO: 1608582 - RNA, 14 nt, Homo sapiens
agugaauacauuaa

SEQ ID NO: 1608583 - RNA, 14 nt, Homo sapiens
agugaaucuguauu

SEQ ID NO: 1608584 - RNA, 15 nt, Homo sapiens
agugaauuuuugcaa

SEQ ID NO: 1608585 - RNA, 18 nt, Homo sapiens
agugacaacaucgcaaua

SEQ ID NO: 1608586 - RNA, 22 nt, Homo sapiens
agugacaugugcuggacacugu

SEQ ID NO: 1608587 - RNA, 14 nt, Homo sapiens
agugaccagugccu

SEQ ID NO: 1608588 - RNA, 14 nt, Homo sapiens
agugaccauuauuc

SEQ ID NO: 1608589 - RNA, 20 nt, Homo sapiens
agugacucagaacuucugcc

SEQ ID NO: 1608590 - RNA, 18 nt, Homo sapiens
agugacugcaagcauuuu

SEQ ID NO: 1608591 - RNA, 20 nt, Homo sapiens
agugacugcagcuugccaaa

SEQ ID NO: 1608592 - RNA, 13 nt, Homo sapiens
agugagaagccag

SEQ ID NO: 1608593 - RNA, 17 nt, Homo sapiens
agugagacuguacauaa

SEQ ID NO: 1608594 - RNA, 16 nt, Homo sapiens
agugauaagucauuca

SEQ ID NO: 1608595 - RNA, 15 nt, Homo sapiens
agugauuaucucuuu

SEQ ID NO: 1608596 - RNA, 19 nt, Homo sapiens
agugcaaaagauuaagauu

SEQ ID NO: 1608597 - RNA, 21 nt, Homo sapiens
agugcacugcauuccugugcc

SEQ ID NO: 1608598 - RNA, 12 nt, Homo sapiens
agugcacugcuc

SEQ ID NO: 1608599 - RNA, 19 nt, Homo sapiens
agugcacuuuaagaggugg

SEQ ID NO: 1608600 - RNA, 20 nt, Homo sapiens
agugcagggcaaaauauuca

SEQ ID NO: 1608601 - RNA, 19 nt, Homo sapiens
agugccagguggcucagug

SEQ ID NO: 1608602 - RNA, 19 nt, Homo sapiens
agugccauugucuuuauau

SEQ ID NO: 1608603 - RNA, 20 nt, Homo sapiens
agugcccaacccuaucccag

SEQ ID NO: 1608604 - RNA, 9 nt, Homo sapiens
agugcccua

SEQ ID NO: 1608605 - RNA, 20 nt, Homo sapiens
agugccucucccugcugcuc

SEQ ID NO: 1608606 - RNA, 13 nt, Homo sapiens
agugcgguuuacu

SEQ ID NO: 1608607 - RNA, 15 nt, Homo sapiens
agugcuccuggaaac

SEQ ID NO: 1608608 - RNA, 18 nt, Homo sapiens
agugcuguccaugcuucu

SEQ ID NO: 1608609 - RNA, 14 nt, Homo sapiens
agugcuuguuagag

SEQ ID NO: 1608610 - RNA, 22 nt, Homo sapiens
agugcuuuucagugauacucac

SEQ ID NO: 1608611 - RNA, 16 nt, Homo sapiens
aguggaaugacugaaa

SEQ ID NO: 1608612 - RNA, 17 nt, Homo sapiens
aguggacgugguaugaa

SEQ ID NO: 1608613 - RNA, 14 nt, Homo sapiens
aguggacgugucag

SEQ ID NO: 1608614 - RNA, 14 nt, Homo sapiens
auauuguguugcaa

SEQ ID NO: 1608615 - RNA, 18 nt, Homo sapiens
auauuguguugugcagca

SEQ ID NO: 1608616 - RNA, 14 nt, Homo sapiens
auauuguuuuacaa

SEQ ID NO: 1608617 - RNA, 16 nt, Homo sapiens
auauuuaagugaagga

SEQ ID NO: 1608618 - RNA, 20 nt, Homo sapiens
auauuuagccccauuacacu

SEQ ID NO: 1608619 - RNA, 16 nt, Homo sapiens
auauuuaucauauccu

SEQ ID NO: 1608620 - RNA, 19 nt, Homo sapiens
auauuuauggggggagaac

SEQ ID NO: 1608621 - RNA, 21 nt, Homo sapiens
auauuucugggagacagaaaa

SEQ ID NO: 1608622 - RNA, 13 nt, Homo sapiens
auauuuuacauac

SEQ ID NO: 1608623 - RNA, 15 nt, Homo sapiens
auauuuucaccauuu

SEQ ID NO: 1608624 - RNA, 23 nt, Homo sapiens
auauuuucauucacaacuaugaa

SEQ ID NO: 1608625 - RNA, 20 nt, Homo sapiens
aucaaaacagagaaagcaga

SEQ ID NO: 1608626 - RNA, 19 nt, Homo sapiens
aucaaaacuaaccaucuga

SEQ ID NO: 1608627 - RNA, 13 nt, Homo sapiens
aucaaaagaaaga

SEQ ID NO: 1608628 - RNA, 13 nt, Homo sapiens
aucaaaaggccca

SEQ ID NO: 1608629 - RNA, 17 nt, Homo sapiens
aucaaagcauaagcuca

SEQ ID NO: 1608630 - RNA, 20 nt, Homo sapiens
aucaaauaugcaaagcacug

SEQ ID NO: 1608631 - RNA, 18 nt, Homo sapiens
aucaaaugaaacagggaa

SEQ ID NO: 1608632 - RNA, 22 nt, Homo sapiens
aucaaaugugacauuauaugca

SEQ ID NO: 1608633 - RNA, 18 nt, Homo sapiens
aucaaauucaauaaucuu

SEQ ID NO: 1608634 - RNA, 12 nt, Homo sapiens
aucaacaaagaa

SEQ ID NO: 1608635 - RNA, 13 nt, Homo sapiens
aucaacagcauuu

SEQ ID NO: 1608636 - RNA, 13 nt, Homo sapiens
aucaacauuucuc

SEQ ID NO: 1608637 - RNA, 18 nt, Homo sapiens
aucaacauuuguuccaug

SEQ ID NO: 1608638 - RNA, 12 nt, Homo sapiens
aucaagacuauc

SEQ ID NO: 1608639 - RNA, 20 nt, Homo sapiens
aucaauaaagaccacuuuac

SEQ ID NO: 1608640 - RNA, 19 nt, Homo sapiens
aucaauagcaccccuacuc

SEQ ID NO: 1608641 - RNA, 21 nt, Homo sapiens
aucaauaguguccuaugcaau

SEQ ID NO: 1608642 - RNA, 22 nt, Homo sapiens
aucaauaguguccuaugcaaua

SEQ ID NO: 1608643 - RNA, 22 nt, Homo sapiens
aucaauauuuuuauaucaugca

SEQ ID NO: 1608644 - RNA, 10 nt, Homo sapiens
aucaaugugu

SEQ ID NO: 1608645 - RNA, 20 nt, Homo sapiens
aucaauuacugguccaaaag

SEQ ID NO: 1608646 - RNA, 20 nt, Homo sapiens
aucaauuucuaauguuuacu

SEQ ID NO: 1608647 - RNA, 19 nt, Homo sapiens
aucacaaacugaaugacuu

SEQ ID NO: 1608648 - RNA, 21 nt, Homo sapiens
aucacaaacugaaugacuuga

SEQ ID NO: 1608649 - RNA, 23 nt, Homo sapiens
aucacaaaggcugacauucacug

SEQ ID NO: 1608650 - RNA, 13 nt, Homo sapiens
aucacacaauaua

SEQ ID NO: 1608651 - RNA, 23 nt, Homo sapiens
aucacacuguauauaaacauauc

SEQ ID NO: 1608652 - RNA, 22 nt, Homo sapiens
aucacacuuuguaauuugcaaa

SEQ ID NO: 1608653 - RNA, 19 nt, Homo sapiens
aucacagucaauggaucca

SEQ ID NO: 1608654 - RNA, 19 nt, Homo sapiens
aucaccagaaaugauagcg

SEQ ID NO: 1608655 - RNA, 17 nt, Homo sapiens
aucaccauuucuuggca

SEQ ID NO: 1608656 - RNA, 18 nt, Homo sapiens
aucaccucccaguacaac

SEQ ID NO: 1608657 - RNA, 20 nt, Homo sapiens
aucaccugccaaaugaauaa

SEQ ID NO: 1608658 - RNA, 15 nt, Homo sapiens
aucacucaaccuuau

SEQ ID NO: 1608659 - RNA, 17 nt, Homo sapiens
aucacuguaaugaguca

SEQ ID NO: 1608660 - RNA, 16 nt, Homo sapiens
aucagaaaaccaaagg

SEQ ID NO: 1608661 - RNA, 22 nt, Homo sapiens
aucagaaaaccaaagggugcua

SEQ ID NO: 1608662 - RNA, 15 nt, Homo sapiens
aucagacagcuugaa

SEQ ID NO: 1608663 - RNA, 15 nt, Homo sapiens
aucagagggugacug

SEQ ID NO: 1608664 - RNA, 15 nt, Homo sapiens
aucagauaaugccac

SEQ ID NO: 1608665 - RNA, 20 nt, Homo sapiens
aucagcaucucuucuucccu

SEQ ID NO: 1608666 - RNA, 15 nt, Homo sapiens
aucagcaucugacag

SEQ ID NO: 1608667 - RNA, 22 nt, Homo sapiens
aucagccugggcaacaugguga

SEQ ID NO: 1608668 - RNA, 18 nt, Homo sapiens
aucagcgccgcaccagcc

SEQ ID NO: 1608669 - RNA, 18 nt, Homo sapiens
aucaggacagguggugca

SEQ ID NO: 1608670 - RNA, 14 nt, Homo sapiens
aucaggucuuuacu

SEQ ID NO: 1608671 - RNA, 19 nt, Homo sapiens
aucaggugugcucagggga

SEQ ID NO: 1608672 - RNA, 19 nt, Homo sapiens
aucaguaaaauuauacugu

SEQ ID NO: 1608673 - RNA, 17 nt, Homo sapiens
aucaguagcaucuguaa

SEQ ID NO: 1608674 - RNA, 19 nt, Homo sapiens
aucagugaauaaaccauca

SEQ ID NO: 1608675 - RNA, 16 nt, Homo sapiens
aucaguguaccauuug

SEQ ID NO: 1608676 - RNA, 10 nt, Homo sapiens
aucaguugau

SEQ ID NO: 1608677 - RNA, 20 nt, Homo sapiens
aucaguuugcuaauguuucc

SEQ ID NO: 1608678 - RNA, 20 nt, Homo sapiens
aucauaaaacuuuuguguca

SEQ ID NO: 1608679 - RNA, 10 nt, Homo sapiens
aucauauuca

SEQ ID NO: 1608680 - RNA, 19 nt, Homo sapiens
aucaucaacaagauuuccu

SEQ ID NO: 1608681 - RNA, 19 nt, Homo sapiens
aucaucaaguaauacaaac

SEQ ID NO: 1608682 - RNA, 17 nt, Homo sapiens
aucaucacccuuucauu

SEQ ID NO: 1608683 - RNA, 13 nt, Homo sapiens
aucaucacuguaa

SEQ ID NO: 1608684 - RNA, 22 nt, Homo sapiens
aucaucagagccuuuccucaaa

SEQ ID NO: 1608685 - RNA, 14 nt, Homo sapiens
aucaucauucucau

SEQ ID NO: 1608686 - RNA, 21 nt, Homo sapiens
aucaucugucauuauauucua

SEQ ID NO: 1608687 - RNA, 21 nt, Homo sapiens
aucaugaagcacaucaauuac

SEQ ID NO: 1608688 - RNA, 23 nt, Homo sapiens
aucaugagcaagugaacacuguu

SEQ ID NO: 1608689 - RNA, 20 nt, Homo sapiens
aucaugauccucccuaucaa

SEQ ID NO: 1608690 - RNA, 23 nt, Homo sapiens
aucaugaugcuagccagcaaaga

SEQ ID NO: 1608691 - RNA, 14 nt, Homo sapiens
aucauggaaaugua

SEQ ID NO: 1608692 - RNA, 17 nt, Homo sapiens
aucauggggaguaauag

SEQ ID NO: 1608693 - RNA, 16 nt, Homo sapiens
aucauguccauacacu

SEQ ID NO: 1608694 - RNA, 19 nt, Homo sapiens
aucauguccauacacuuug

SEQ ID NO: 1608695 - RNA, 21 nt, Homo sapiens
aucauguugaauaaugcuguu

SEQ ID NO: 1608696 - RNA, 20 nt, Homo sapiens
aucauuaccuuuuaccagcu

SEQ ID NO: 1608697 - RNA, 20 nt, Homo sapiens
aucauuacugccaucuuuau

SEQ ID NO: 1608698 - RNA, 15 nt, Homo sapiens
aucauuaucagccug

SEQ ID NO: 1608699 - RNA, 15 nt, Homo sapiens
aucauucaacucucc

SEQ ID NO: 1608700 - RNA, 20 nt, Homo sapiens
aucauucagcgcaugcaccu

SEQ ID NO: 1608701 - RNA, 17 nt, Homo sapiens
aucauucucugucucau

SEQ ID NO: 1608702 - RNA, 12 nt, Homo sapiens
aucauugguucg

SEQ ID NO: 1608703 - RNA, 14 nt, Homo sapiens
aucauuuaauguga

SEQ ID NO: 1608704 - RNA, 10 nt, Homo sapiens
aucauuuaga

SEQ ID NO: 1608705 - RNA, 17 nt, Homo sapiens
aucauuucaagacuaga

SEQ ID NO: 1608706 - RNA, 22 nt, Homo sapiens
aucauuucuauuucuccuccau

SEQ ID NO: 1608707 - RNA, 20 nt, Homo sapiens
auccaaaaauagcccugcaa

SEQ ID NO: 1608708 - RNA, 13 nt, Homo sapiens
auccaacuauuaa

SEQ ID NO: 1608709 - RNA, 23 nt, Homo sapiens
auccaagcaucccuuugcccaga

SEQ ID NO: 1608710 - RNA, 23 nt, Homo sapiens
auccaaggguugagagccagugg

SEQ ID NO: 1608711 - RNA, 13 nt, Homo sapiens
auccaaugcacug

SEQ ID NO: 1608712 - RNA, 14 nt, Homo sapiens
auccaauguaugaa

SEQ ID NO: 1608713 - RNA, 20 nt, Homo sapiens
auccacaaaugaagggauau

SEQ ID NO: 1608714 - RNA, 18 nt, Homo sapiens
auccacaacuuguaccaa

SEQ ID NO: 1608715 - RNA, 20 nt, Homo sapiens
auccacacaugaaucugcac

SEQ ID NO: 1608716 - RNA, 14 nt, Homo sapiens
auccacacugagag

SEQ ID NO: 1608717 - RNA, 12 nt, Homo sapiens
auccaccugccu

SEQ ID NO: 1608718 - RNA, 16 nt, Homo sapiens
auccagaaauacuuaa

SEQ ID NO: 1608719 - RNA, 17 nt, Homo sapiens
auccagcaguacaauaa

SEQ ID NO: 1608720 - RNA, 15 nt, Homo sapiens
auccagccagacccc

SEQ ID NO: 1608721 - RNA, 16 nt, Homo sapiens
auccaggcuguucuca

SEQ ID NO: 1608722 - RNA, 19 nt, Homo sapiens
auccagguaauccaagaua

SEQ ID NO: 1608723 - RNA, 18 nt, Homo sapiens
auccagugagcacuagaa

SEQ ID NO: 1608724 - RNA, 18 nt, Homo sapiens
auccauagacacaguauu

SEQ ID NO: 1608725 - RNA, 21 nt, Homo sapiens
auccauagauuucgaagccac

SEQ ID NO: 1608726 - RNA, 17 nt, Homo sapiens
auccauauugagucaaa

SEQ ID NO: 1608727 - RNA, 17 nt, Homo sapiens
auccaugaaccaagacc

SEQ ID NO: 1608728 - RNA, 17 nt, Homo sapiens
auccaugcaccuaccuu

SEQ ID NO: 1608729 - RNA, 19 nt, Homo sapiens
auccaugcaccuaccuuag

SEQ ID NO: 1608730 - RNA, 18 nt, Homo sapiens
auccauguaaauugcaaa

SEQ ID NO: 1608731 - RNA, 21 nt, Homo sapiens
aucccaaagcaaggagaucau

SEQ ID NO: 1608732 - RNA, 23 nt, Homo sapiens
auguacguugagaaucacugcuc

SEQ ID NO: 1608733 - RNA, 21 nt, Homo sapiens
auguagaauauucagacaaaa

SEQ ID NO: 1608734 - RNA, 17 nt, Homo sapiens
auguagacugugccaga

SEQ ID NO: 1608735 - RNA, 21 nt, Homo sapiens
auguagcgcuuugaauaugaa

SEQ ID NO: 1608736 - RNA, 14 nt, Homo sapiens
auguauaugcacuu

SEQ ID NO: 1608737 - RNA, 14 nt, Homo sapiens
auguaucugcauau

SEQ ID NO: 1608738 - RNA, 14 nt, Homo sapiens
auguaugugugcuu

SEQ ID NO: 1608739 - RNA, 23 nt, Homo sapiens
auguauuucugauguguucucug

SEQ ID NO: 1608740 - RNA, 22 nt, Homo sapiens
auguauuugaaaauuacauguu

SEQ ID NO: 1608741 - RNA, 19 nt, Homo sapiens
auguauuuguaguguuauu

SEQ ID NO: 1608742 - RNA, 16 nt, Homo sapiens
augucaaacaguaaua

SEQ ID NO: 1608743 - RNA, 18 nt, Homo sapiens
augucagcacacacuuac

SEQ ID NO: 1608744 - RNA, 22 nt, Homo sapiens
augucauagaaauauugacuca

SEQ ID NO: 1608745 - RNA, 19 nt, Homo sapiens
augucaucaaaaucugcac

SEQ ID NO: 1608746 - RNA, 20 nt, Homo sapiens
augucauuuuuaauguaucu

SEQ ID NO: 1608747 - RNA, 21 nt, Homo sapiens
auguccacuguucuguucuca

SEQ ID NO: 1608748 - RNA, 12 nt, Homo sapiens
auguccuauuac

SEQ ID NO: 1608749 - RNA, 16 nt, Homo sapiens
augucuauaacuccuu

SEQ ID NO: 1608750 - RNA, 15 nt, Homo sapiens
augucuauucagcuu

SEQ ID NO: 1608751 - RNA, 21 nt, Homo sapiens
augucucugugagacucgaga

SEQ ID NO: 1608752 - RNA, 19 nt, Homo sapiens
augucugagaucagugccu

SEQ ID NO: 1608753 - RNA, 15 nt, Homo sapiens
augucugccuaugca

SEQ ID NO: 1608754 - RNA, 13 nt, Homo sapiens
augucuguagcau

SEQ ID NO: 1608755 - RNA, 21 nt, Homo sapiens
augucuguuaccuuguuaaua

SEQ ID NO: 1608756 - RNA, 19 nt, Homo sapiens
augucuguucuacauagau

SEQ ID NO: 1608757 - RNA, 17 nt, Homo sapiens
augugaaaauauacuug

SEQ ID NO: 1608758 - RNA, 18 nt, Homo sapiens
augugaccgaacacugca

SEQ ID NO: 1608759 - RNA, 19 nt, Homo sapiens
augugaccgaacacugcag

SEQ ID NO: 1608760 - RNA, 15 nt, Homo sapiens
augugacuugcaaua

SEQ ID NO: 1608761 - RNA, 13 nt, Homo sapiens
augugauacaaau

SEQ ID NO: 1608762 - RNA, 14 nt, Homo sapiens
augugauacaaauu

SEQ ID NO: 1608763 - RNA, 21 nt, Homo sapiens
augugaucauaugaggaccuu

SEQ ID NO: 1608764 - RNA, 11 nt, Homo sapiens
augugaugaau

SEQ ID NO: 1608765 - RNA, 14 nt, Homo sapiens
augugcccaaagcu

SEQ ID NO: 1608766 - RNA, 21 nt, Homo sapiens
auguggaagaacuuaggcauc

SEQ ID NO: 1608767 - RNA, 20 nt, Homo sapiens
auguggacuuauucauuccu

SEQ ID NO: 1608768 - RNA, 16 nt, Homo sapiens
auguggauaacuuuac

SEQ ID NO: 1608769 - RNA, 19 nt, Homo sapiens
auguggcccucuggaucca

SEQ ID NO: 1608770 - RNA, 13 nt, Homo sapiens
augugggaucuca

SEQ ID NO: 1608771 - RNA, 21 nt, Homo sapiens
auguggucuaagguucagccu

SEQ ID NO: 1608772 - RNA, 16 nt, Homo sapiens
augugguugcuuaauu

SEQ ID NO: 1608773 - RNA, 13 nt, Homo sapiens
auguguaaagauu

SEQ ID NO: 1608774 - RNA, 16 nt, Homo sapiens
auguguaaagauuuau

SEQ ID NO: 1608775 - RNA, 19 nt, Homo sapiens
augugucauuggaagccau

SEQ ID NO: 1608776 - RNA, 21 nt, Homo sapiens
auguguccccucacucuguca

SEQ ID NO: 1608777 - RNA, 22 nt, Homo sapiens
augugucuuaccagaucuaaua

SEQ ID NO: 1608778 - RNA, 12 nt, Homo sapiens
augugugcucac

SEQ ID NO: 1608779 - RNA, 16 nt, Homo sapiens
augugugguacuuugc

SEQ ID NO: 1608780 - RNA, 18 nt, Homo sapiens
augugugguacuuugcag

SEQ ID NO: 1608781 - RNA, 18 nt, Homo sapiens
auguguuaucuaccucaa

SEQ ID NO: 1608782 - RNA, 20 nt, Homo sapiens
auguguuauuugucacaaau

SEQ ID NO: 1608783 - RNA, 22 nt, Homo sapiens
auguuaaaaaaauaagaagaau

SEQ ID NO: 1608784 - RNA, 17 nt, Homo sapiens
auguuaacaccuaccuc

SEQ ID NO: 1608785 - RNA, 20 nt, Homo sapiens
auguuaagcauggauuuucc

SEQ ID NO: 1608786 - RNA, 19 nt, Homo sapiens
auguuaauauugugcaaac

SEQ ID NO: 1608787 - RNA, 21 nt, Homo sapiens
auguuaauuuuuugguacaaa

SEQ ID NO: 1608788 - RNA, 21 nt, Homo sapiens
auguuacggcaucacacuuau

SEQ ID NO: 1608789 - RNA, 15 nt, Homo sapiens
auguuacugccuuaa

SEQ ID NO: 1608790 - RNA, 18 nt, Homo sapiens
auguuagccacaguguau

SEQ ID NO: 1608791 - RNA, 22 nt, Homo sapiens
auguuauacaaccuucauuuaa

SEQ ID NO: 1608792 - RNA, 18 nt, Homo sapiens
auguuauccaacuauuaa

SEQ ID NO: 1608793 - RNA, 15 nt, Homo sapiens
auguuaugacuaugu

SEQ ID NO: 1608794 - RNA, 17 nt, Homo sapiens
auguuaugcuccugcug

SEQ ID NO: 1608795 - RNA, 22 nt, Homo sapiens
auguucacuuuugacaaaggca

SEQ ID NO: 1608796 - RNA, 19 nt, Homo sapiens
auguuccaauaaaacuuua

SEQ ID NO: 1608797 - RNA, 19 nt, Homo sapiens
auguuccugaaaauugcaa

SEQ ID NO: 1608798 - RNA, 23 nt, Homo sapiens
auguucugggaaaauccacuaug

SEQ ID NO: 1608799 - RNA, 17 nt, Homo sapiens
auguucugguaugcauu

SEQ ID NO: 1608800 - RNA, 22 nt, Homo sapiens
auguugcauuuaugaugcaguu

SEQ ID NO: 1608801 - RNA, 20 nt, Homo sapiens
auguuggccaggauggucuc

SEQ ID NO: 1608802 - RNA, 21 nt, Homo sapiens
auguuguguuuuuaacauguc

SEQ ID NO: 1608803 - RNA, 21 nt, Homo sapiens
auguuuaugaaggguaaggga

SEQ ID NO: 1608804 - RNA, 23 nt, Homo sapiens
auguuuaugaaggguaagggaau

SEQ ID NO: 1608805 - RNA, 20 nt, Homo sapiens
auguuucagagcucaccagg

SEQ ID NO: 1608806 - RNA, 22 nt, Homo sapiens
auguuuuaauguagaaccucaa

SEQ ID NO: 1608807 - RNA, 20 nt, Homo sapiens
auguuuuucuguauaacagc

SEQ ID NO: 1608808 - RNA, 20 nt, Homo sapiens
auguuuuuuuaaaccucaua

SEQ ID NO: 1608809 - RNA, 18 nt, Homo sapiens
auuaaaauuccaaauuca

SEQ ID NO: 1608810 - RNA, 12 nt, Homo sapiens
auuaaagagcca

SEQ ID NO: 1608811 - RNA, 13 nt, Homo sapiens
auuaaagagccag

SEQ ID NO: 1608812 - RNA, 14 nt, Homo sapiens
auuaaagagccagu

SEQ ID NO: 1608813 - RNA, 17 nt, Homo sapiens
auuaaagagccaguuua

SEQ ID NO: 1608814 - RNA, 14 nt, Homo sapiens
auuaaauccaauaa

SEQ ID NO: 1608815 - RNA, 14 nt, Homo sapiens
auuaaauucacaaa

SEQ ID NO: 1608816 - RNA, 15 nt, Homo sapiens
auuaacaucaaagac

SEQ ID NO: 1608817 - RNA, 13 nt, Homo sapiens
auuaaccuaauca

SEQ ID NO: 1608818 - RNA, 13 nt, Homo sapiens
auuaacucugcau

SEQ ID NO: 1608819 - RNA, 18 nt, Homo sapiens
auuaacucugcauagaca

SEQ ID NO: 1608820 - RNA, 14 nt, Homo sapiens
auuaagaaugccag

SEQ ID NO: 1608821 - RNA, 21 nt, Homo sapiens
auuaagauccuaaacucucua

SEQ ID NO: 1608822 - RNA, 21 nt, Homo sapiens
auuaagcccaauuaauuccug

SEQ ID NO: 1608823 - RNA, 17 nt, Homo sapiens
auuaaguacaugugcca

SEQ ID NO: 1608824 - RNA, 19 nt, Homo sapiens
auuaauaccuaaacuguau

SEQ ID NO: 1608825 - RNA, 17 nt, Homo sapiens
auuaauacucugcagug

SEQ ID NO: 1608826 - RNA, 19 nt, Homo sapiens
auuaauauuuguuuaguuc

SEQ ID NO: 1608827 - RNA, 17 nt, Homo sapiens
auuaaucauacaaacuc

SEQ ID NO: 1608828 - RNA, 22 nt, Homo sapiens
auuaaucuacuguaucaauaaa

SEQ ID NO: 1608829 - RNA, 18 nt, Homo sapiens
auuaauuacuucacuaua

SEQ ID NO: 1608830 - RNA, 20 nt, Homo sapiens
auuaauucuauaaggccaua

SEQ ID NO: 1608831 - RNA, 17 nt, Homo sapiens
auuaauugucauuauuu

SEQ ID NO: 1608832 - RNA, 23 nt, Homo sapiens
auuaauuuggagcacaaaauuca

SEQ ID NO: 1608833 - RNA, 23 nt, Homo sapiens
auuaauuuucuugguucuuucag

SEQ ID NO: 1608834 - RNA, 20 nt, Homo sapiens
auuaauuuugauauaaucuu

SEQ ID NO: 1608835 - RNA, 13 nt, Homo sapiens
auuacaaaugcaa

SEQ ID NO: 1608836 - RNA, 13 nt, Homo sapiens
auuacaagcccug

SEQ ID NO: 1608837 - RNA, 20 nt, Homo sapiens
auuacaauguguaauggaaa

SEQ ID NO: 1608838 - RNA, 14 nt, Homo sapiens
auuacacauuucac

SEQ ID NO: 1608839 - RNA, 13 nt, Homo sapiens
auuacauacuauu

SEQ ID NO: 1608840 - RNA, 11 nt, Homo sapiens
auuacauauuu

SEQ ID NO: 1608841 - RNA, 21 nt, Homo sapiens
auuaccaaccuguuaccuacu

SEQ ID NO: 1608842 - RNA, 21 nt, Homo sapiens
auuaccacucaggcauuugac

SEQ ID NO: 1608843 - RNA, 16 nt, Homo sapiens
auuaccuccugagaaa

SEQ ID NO: 1608844 - RNA, 23 nt, Homo sapiens
auuacuacuuaccauuugcuacu

SEQ ID NO: 1608845 - RNA, 21 nt, Homo sapiens
auuacuccuucagcucugggg

SEQ ID NO: 1608846 - RNA, 18 nt, Homo sapiens
auuacugaugugugcaac

SEQ ID NO: 1608847 - RNA, 13 nt, Homo sapiens
auuacugccuuac

SEQ ID NO: 1608848 - RNA, 15 nt, Homo sapiens
auuacuggaucucuu

SEQ ID NO: 1608849 - RNA, 22 nt, Homo sapiens
caaaaaaaaaaaaauacaacuc

SEQ ID NO: 1608850 - RNA, 19 nt, Homo sapiens
caaaaaaauuaaaauggau

SEQ ID NO: 1608851 - RNA, 20 nt, Homo sapiens
caaaaaaguccaauuuuaau

SEQ ID NO: 1608852 - RNA, 18 nt, Homo sapiens
caaaaaaucauguuuauu

SEQ ID NO: 1608853 - RNA, 13 nt, Homo sapiens
caaaaacacaaau

SEQ ID NO: 1608854 - RNA, 20 nt, Homo sapiens
caaaaacauuugauuaauaa

SEQ ID NO: 1608855 - RNA, 21 nt, Homo sapiens
caaaaacuugaucacaugcuu

SEQ ID NO: 1608856 - RNA, 15 nt, Homo sapiens
caaaaagucugccaa

SEQ ID NO: 1608857 - RNA, 22 nt, Homo sapiens
caaaaauagaaauuagauuugu

SEQ ID NO: 1608858 - RNA, 17 nt, Homo sapiens
caaaaaucaaacuuuac

SEQ ID NO: 1608859 - RNA, 22 nt, Homo sapiens
caaaaaucuguguaacuguaaa

SEQ ID NO: 1608860 - RNA, 19 nt, Homo sapiens
caaaaaugaaauccaguga

SEQ ID NO: 1608861 - RNA, 16 nt, Homo sapiens
caaaaauguaugccac

SEQ ID NO: 1608862 - RNA, 14 nt, Homo sapiens
caaaaauuaucuau

SEQ ID NO: 1608863 - RNA, 14 nt, Homo sapiens
caaaacaaaaagau

SEQ ID NO: 1608864 - RNA, 12 nt, Homo sapiens
caaaacauacca

SEQ ID NO: 1608865 - RNA, 12 nt, Homo sapiens
caaaacauaucu

SEQ ID NO: 1608866 - RNA, 15 nt, Homo sapiens
caaaacccauauccc

SEQ ID NO: 1608867 - RNA, 18 nt, Homo sapiens
caaaacgcuacugaguca

SEQ ID NO: 1608868 - RNA, 14 nt, Homo sapiens
caaaacuacaugag

SEQ ID NO: 1608869 - RNA, 14 nt, Homo sapiens
caaaacuccaggca

SEQ ID NO: 1608870 - RNA, 17 nt, Homo sapiens
caaaacugcacugucaa

SEQ ID NO: 1608871 - RNA, 13 nt, Homo sapiens
caaaacuguaaaa

SEQ ID NO: 1608872 - RNA, 17 nt, Homo sapiens
caaaagcagauacuuga

SEQ ID NO: 1608873 - RNA, 14 nt, Homo sapiens
caaaagcuuacaaa

SEQ ID NO: 1608874 - RNA, 14 nt, Homo sapiens
caaaaggcugagaa

SEQ ID NO: 1608875 - RNA, 18 nt, Homo sapiens
caaaaggguguauagugu

SEQ ID NO: 1608876 - RNA, 18 nt, Homo sapiens
caaaaguuauaggauuag

SEQ ID NO: 1608877 - RNA, 19 nt, Homo sapiens
caaaauaccaugccauuua

SEQ ID NO: 1608878 - RNA, 13 nt, Homo sapiens
caaaauacuucuu

SEQ ID NO: 1608879 - RNA, 19 nt, Homo sapiens
caaaauauuaacauucuuu

SEQ ID NO: 1608880 - RNA, 12 nt, Homo sapiens
caaaaucucuac

SEQ ID NO: 1608881 - RNA, 15 nt, Homo sapiens
caaaaugauuuugaa

SEQ ID NO: 1608882 - RNA, 19 nt, Homo sapiens
caaaaugcucuaaugagca

SEQ ID NO: 1608883 - RNA, 13 nt, Homo sapiens
caaaaugcuuuuu

SEQ ID NO: 1608884 - RNA, 23 nt, Homo sapiens
caaaaugggagaaaacgccagug

SEQ ID NO: 1608885 - RNA, 18 nt, Homo sapiens
caaaauguagaauauuca

SEQ ID NO: 1608886 - RNA, 16 nt, Homo sapiens
caaaauguucaguuua

SEQ ID NO: 1608887 - RNA, 16 nt, Homo sapiens
caaaauuaaauacaua

SEQ ID NO: 1608888 - RNA, 15 nt, Homo sapiens
caaaauuguuuacca

SEQ ID NO: 1608889 - RNA, 20 nt, Homo sapiens
caaaauuuuguaaauaugca

SEQ ID NO: 1608890 - RNA, 21 nt, Homo sapiens
caaaauuuuguaaauaugcaa

SEQ ID NO: 1608891 - RNA, 23 nt, Homo sapiens
caaacaaaaauauuuugaucaug

SEQ ID NO: 1608892 - RNA, 14 nt, Homo sapiens
caaacaaaauuucu

SEQ ID NO: 1608893 - RNA, 20 nt, Homo sapiens
caaacacauuauaaaguuca

SEQ ID NO: 1608894 - RNA, 21 nt, Homo sapiens
caaacaccacuuuacuugugu

SEQ ID NO: 1608895 - RNA, 23 nt, Homo sapiens
caaacaccacuuuacuuguguua

SEQ ID NO: 1608896 - RNA, 21 nt, Homo sapiens
caaacagauguuuguuuucaa

SEQ ID NO: 1608897 - RNA, 22 nt, Homo sapiens
caaacauggagaaaucuacuga

SEQ ID NO: 1608898 - RNA, 21 nt, Homo sapiens
caaacauguguguacaugugc

SEQ ID NO: 1608899 - RNA, 16 nt, Homo sapiens
caaacauuauucucaa

SEQ ID NO: 1608900 - RNA, 23 nt, Homo sapiens
caaaccaauuucaaauuauuuug

SEQ ID NO: 1608901 - RNA, 24 nt, Homo sapiens
caaaccacgccucuugaccaggcu

SEQ ID NO: 1608902 - RNA, 15 nt, Homo sapiens
caaaccagacaccug

SEQ ID NO: 1608903 - RNA, 15 nt, Homo sapiens
caaaccaucuccucc

SEQ ID NO: 1608904 - RNA, 14 nt, Homo sapiens
caaacccagucuca

SEQ ID NO: 1608905 - RNA, 13 nt, Homo sapiens
caaaccuauggaa

SEQ ID NO: 1608906 - RNA, 14 nt, Homo sapiens
caaaccuccuguca

SEQ ID NO: 1608907 - RNA, 21 nt, Homo sapiens
caaacuacuggcaauuuguaa

SEQ ID NO: 1608908 - RNA, 21 nt, Homo sapiens
caaacucauugcagcagauaa

SEQ ID NO: 1608909 - RNA, 19 nt, Homo sapiens
caaacuccauucuccaggg

SEQ ID NO: 1608910 - RNA, 15 nt, Homo sapiens
caaacuccuauuuca

SEQ ID NO: 1608911 - RNA, 15 nt, Homo sapiens
caaacuccugaccuc

SEQ ID NO: 1608912 - RNA, 12 nt, Homo sapiens
caaacugaucua

SEQ ID NO: 1608913 - RNA, 19 nt, Homo sapiens
caaacugugaaaauagugu

SEQ ID NO: 1608914 - RNA, 14 nt, Homo sapiens
caaacuuccaguca

SEQ ID NO: 1608915 - RNA, 21 nt, Homo sapiens
caaacuugagaaaauaucuug

SEQ ID NO: 1608916 - RNA, 22 nt, Homo sapiens
caaacuuggauacuuggauuua

SEQ ID NO: 1608917 - RNA, 11 nt, Homo sapiens
caaacuuuuca

SEQ ID NO: 1608918 - RNA, 21 nt, Homo sapiens
caaagaacggugauguaguau

SEQ ID NO: 1608919 - RNA, 20 nt, Homo sapiens
caaagaagcuuccacaaaau

SEQ ID NO: 1608920 - RNA, 12 nt, Homo sapiens
caaagaauucca

SEQ ID NO: 1608921 - RNA, 13 nt, Homo sapiens
caaagaauuccaa

SEQ ID NO: 1608922 - RNA, 18 nt, Homo sapiens
caaagacaucagucucca

SEQ ID NO: 1608923 - RNA, 20 nt, Homo sapiens
caaagaggcugccccucuca

SEQ ID NO: 1608924 - RNA, 18 nt, Homo sapiens
caaagauaauuuauuuca

SEQ ID NO: 1608925 - RNA, 23 nt, Homo sapiens
caaagaugucuuaaccucaggga

SEQ ID NO: 1608926 - RNA, 23 nt, Homo sapiens
caaagauguuaugguguuuagau

SEQ ID NO: 1608927 - RNA, 16 nt, Homo sapiens
caaagauuaaaugugu

SEQ ID NO: 1608928 - RNA, 21 nt, Homo sapiens
caaagauuaaaugugucauug

SEQ ID NO: 1608929 - RNA, 21 nt, Homo sapiens
caaagauuuuuggcacuuugu

SEQ ID NO: 1608930 - RNA, 22 nt, Homo sapiens
caaagcauuuugccuaccuggg

SEQ ID NO: 1608931 - RNA, 16 nt, Homo sapiens
caaagccaagaccuca

SEQ ID NO: 1608932 - RNA, 16 nt, Homo sapiens
caaagccggcuugauu

SEQ ID NO: 1608933 - RNA, 22 nt, Homo sapiens
caaagcggucccugucccucua

SEQ ID NO: 1608934 - RNA, 20 nt, Homo sapiens
caaaggaaguccaaccugag

SEQ ID NO: 1608935 - RNA, 12 nt, Homo sapiens
caaaggaaguuu

SEQ ID NO: 1608936 - RNA, 20 nt, Homo sapiens
caaaggagaagaguguaaga

SEQ ID NO: 1608937 - RNA, 15 nt, Homo sapiens
caaaggagacauauc

SEQ ID NO: 1608938 - RNA, 23 nt, Homo sapiens
caaaggcccccuacgccaaucaa

SEQ ID NO: 1608939 - RNA, 20 nt, Homo sapiens
caaaggcugacauucacuga

SEQ ID NO: 1608940 - RNA, 21 nt, Homo sapiens
caaaggcugacauucacugag

SEQ ID NO: 1608941 - RNA, 13 nt, Homo sapiens
caaagggugcuag

SEQ ID NO: 1608942 - RNA, 19 nt, Homo sapiens
caaagguuuauuccagaga

SEQ ID NO: 1608943 - RNA, 17 nt, Homo sapiens
caaaguacuguaagaau

SEQ ID NO: 1608944 - RNA, 15 nt, Homo sapiens
caaagucaacuucca

SEQ ID NO: 1608945 - RNA, 12 nt, Homo sapiens
caaagugcccau

SEQ ID NO: 1608946 - RNA, 21 nt, Homo sapiens
caaagugcccgcagagcccac

SEQ ID NO: 1608947 - RNA, 11 nt, Homo sapiens
caaagugcugg

SEQ ID NO: 1608948 - RNA, 17 nt, Homo sapiens
caaagugcugggauuac

SEQ ID NO: 1608949 - RNA, 20 nt, Homo sapiens
caaagugguucccucucuua

SEQ ID NO: 1608950 - RNA, 22 nt, Homo sapiens
caaaguguugggauuacaggcg

SEQ ID NO: 1608951 - RNA, 16 nt, Homo sapiens
caaaguugauuaagaa

SEQ ID NO: 1608952 - RNA, 11 nt, Homo sapiens
caaaguuucaa

SEQ ID NO: 1608953 - RNA, 16 nt, Homo sapiens
caaauaaaaugaaaua

SEQ ID NO: 1608954 - RNA, 17 nt, Homo sapiens
caaauaaguaauaucuu

SEQ ID NO: 1608955 - RNA, 21 nt, Homo sapiens
caaauacuguauauucaggac

SEQ ID NO: 1608956 - RNA, 13 nt, Homo sapiens
caaauagccacaa

SEQ ID NO: 1608957 - RNA, 16 nt, Homo sapiens
caaauauauuuuggaa

SEQ ID NO: 1608958 - RNA, 20 nt, Homo sapiens
caaauauugguuaguauuua

SEQ ID NO: 1608959 - RNA, 18 nt, Homo sapiens
caaaucagaaacuuguga

SEQ ID NO: 1608960 - RNA, 21 nt, Homo sapiens
caaaucaguauauuuucugua

SEQ ID NO: 1608961 - RNA, 21 nt, Homo sapiens
caaaucagugugaggagguag

SEQ ID NO: 1608962 - RNA, 20 nt, Homo sapiens
caaaucauccauccuugcca

SEQ ID NO: 1608963 - RNA, 21 nt, Homo sapiens
caaaucauccauccuugccaa

SEQ ID NO: 1608964 - RNA, 23 nt, Homo sapiens
caaauccuggaaggacacaguga

SEQ ID NO: 1608965 - RNA, 22 nt, Homo sapiens
caaaucguggcacguauugcug

SEQ ID NO: 1608966 - RNA, 18 nt, Homo sapiens
caaaucuaccacuguaug

SEQ ID NO: 1608967 - RNA, 13 nt, Homo sapiens
cauuggaagccau

SEQ ID NO: 1608968 - RNA, 19 nt, Homo sapiens
cauuggaauucuacuggaa

SEQ ID NO: 1608969 - RNA, 16 nt, Homo sapiens
cauugggagucuguag

SEQ ID NO: 1608970 - RNA, 13 nt, Homo sapiens
cauuggugacuca

SEQ ID NO: 1608971 - RNA, 12 nt, Homo sapiens
cauugguguuga

SEQ ID NO: 1608972 - RNA, 19 nt, Homo sapiens
cauugguguugacauacau

SEQ ID NO: 1608973 - RNA, 14 nt, Homo sapiens
cauuguaaucacug

SEQ ID NO: 1608974 - RNA, 19 nt, Homo sapiens
cauuguauguggucaugga

SEQ ID NO: 1608975 - RNA, 17 nt, Homo sapiens
cauuguauuaauaccaa

SEQ ID NO: 1608976 - RNA, 22 nt, Homo sapiens
cauugucucaauucaaauccau

SEQ ID NO: 1608977 - RNA, 21 nt, Homo sapiens
cauuguggcuccuaucugugu

SEQ ID NO: 1608978 - RNA, 16 nt, Homo sapiens
cauuguggucacagga

SEQ ID NO: 1608979 - RNA, 14 nt, Homo sapiens
cauuguuagcacua

SEQ ID NO: 1608980 - RNA, 12 nt, Homo sapiens
cauuguuuauug

SEQ ID NO: 1608981 - RNA, 19 nt, Homo sapiens
cauuguuuauuguauacug

SEQ ID NO: 1608982 - RNA, 19 nt, Homo sapiens
cauuguuucguaacacagc

SEQ ID NO: 1608983 - RNA, 14 nt, Homo sapiens
cauuuaaauuccac

SEQ ID NO: 1608984 - RNA, 23 nt, Homo sapiens
cauuuaaccccuugguacugaaa

SEQ ID NO: 1608985 - RNA, 23 nt, Homo sapiens
cauuuaagaacugaggaaccuga

SEQ ID NO: 1608986 - RNA, 21 nt, Homo sapiens
cauuuacaacucauuccagau

SEQ ID NO: 1608987 - RNA, 13 nt, Homo sapiens
cauuuacacuuuu

SEQ ID NO: 1608988 - RNA, 15 nt, Homo sapiens
cauuuagcccucaca

SEQ ID NO: 1608989 - RNA, 19 nt, Homo sapiens
cauuuauaaagggacacuu

SEQ ID NO: 1608990 - RNA, 16 nt, Homo sapiens
cauuuaugaugcaguu

SEQ ID NO: 1608991 - RNA, 19 nt, Homo sapiens
cauuuauuucucuggcaaa

SEQ ID NO: 1608992 - RNA, 12 nt, Homo sapiens
cauuucaucuca

SEQ ID NO: 1608993 - RNA, 21 nt, Homo sapiens
cauuucaucucauuuaaggga

SEQ ID NO: 1608994 - RNA, 17 nt, Homo sapiens
cauuucauuaguauucc

SEQ ID NO: 1608995 - RNA, 14 nt, Homo sapiens
cauuucccauuaaa

SEQ ID NO: 1608996 - RNA, 21 nt, Homo sapiens
cauuuccgugguuucucauga

SEQ ID NO: 1608997 - RNA, 14 nt, Homo sapiens
cauuucgaagucau

SEQ ID NO: 1608998 - RNA, 21 nt, Homo sapiens
cauuucgaagucaucauuccu

SEQ ID NO: 1608999 - RNA, 21 nt, Homo sapiens
cauuucucaagggccaugugg

SEQ ID NO: 1609000 - RNA, 20 nt, Homo sapiens
cauuucucuuccccuuagaa

SEQ ID NO: 1609001 - RNA, 12 nt, Homo sapiens
cauuucuuccca

SEQ ID NO: 1609002 - RNA, 14 nt, Homo sapiens
cauuugaaugcuua

SEQ ID NO: 1609003 - RNA, 19 nt, Homo sapiens
cauuugaaugcuuaauuca

SEQ ID NO: 1609004 - RNA, 19 nt, Homo sapiens
cauuugacuccacuuuucc

SEQ ID NO: 1609005 - RNA, 21 nt, Homo sapiens
cauuugacugaagaugcagcu

SEQ ID NO: 1609006 - RNA, 15 nt, Homo sapiens
cauuugaguuugcaa

SEQ ID NO: 1609007 - RNA, 22 nt, Homo sapiens
cauuugauaaugauaaaacacc

SEQ ID NO: 1609008 - RNA, 12 nt, Homo sapiens
cauuugaugaua

SEQ ID NO: 1609009 - RNA, 16 nt, Homo sapiens
cauuugccugcuucuu

SEQ ID NO: 1609010 - RNA, 16 nt, Homo sapiens
cauuuggcaaugccau

SEQ ID NO: 1609011 - RNA, 21 nt, Homo sapiens
cauuuggcagagucugaagaa

SEQ ID NO: 1609012 - RNA, 20 nt, Homo sapiens
cauuugggugaacuguggac

SEQ ID NO: 1609013 - RNA, 18 nt, Homo sapiens
cauuuuaaaaaauggaac

SEQ ID NO: 1609014 - RNA, 13 nt, Homo sapiens
cauuuuacuauuu

SEQ ID NO: 1609015 - RNA, 23 nt, Homo sapiens
cauuuuauaaaugauaucaaaga

SEQ ID NO: 1609016 - RNA, 21 nt, Homo sapiens
cauuuugauggugucugugac

SEQ ID NO: 1609017 - RNA, 16 nt, Homo sapiens
cauuuuuaauguaucu

SEQ ID NO: 1609018 - RNA, 13 nt, Homo sapiens
cauuuuuugccac

SEQ ID NO: 1609019 - RNA, 19 nt, Homo sapiens
cauuuuuugggcagcaauu

SEQ ID NO: 1609020 - RNA, 15 nt, Homo sapiens
ccaaaaauuacugau

SEQ ID NO: 1609021 - RNA, 15 nt, Homo sapiens
ccaaaaauuacuuug

SEQ ID NO: 1609022 - RNA, 21 nt, Homo sapiens
ccaaaaauuuugugacauucc

SEQ ID NO: 1609023 - RNA, 11 nt, Homo sapiens
ccaaaaccuuc

SEQ ID NO: 1609024 - RNA, 21 nt, Homo sapiens
ccaaaagguauuuuaaucacc

SEQ ID NO: 1609025 - RNA, 13 nt, Homo sapiens
ccaaaauaaucua

SEQ ID NO: 1609026 - RNA, 19 nt, Homo sapiens
ccaaaauaguuaagacaug

SEQ ID NO: 1609027 - RNA, 18 nt, Homo sapiens
ccaaaauauuaacauucu

SEQ ID NO: 1609028 - RNA, 22 nt, Homo sapiens
ccaaaaugggagaaaacgccag

SEQ ID NO: 1609029 - RNA, 12 nt, Homo sapiens
ccaaaauuugau

SEQ ID NO: 1609030 - RNA, 14 nt, Homo sapiens
ccaaaccacuccac

SEQ ID NO: 1609031 - RNA, 16 nt, Homo sapiens
ccaaacccaccugcua

SEQ ID NO: 1609032 - RNA, 22 nt, Homo sapiens
ccaaacggaagacuacagcaug

SEQ ID NO: 1609033 - RNA, 13 nt, Homo sapiens
ccaaagaaaugaa

SEQ ID NO: 1609034 - RNA, 22 nt, Homo sapiens
ccaaagcacuugcuuacauccu

SEQ ID NO: 1609035 - RNA, 21 nt, Homo sapiens
ccaaagcucugaauaguuaaa

SEQ ID NO: 1609036 - RNA, 20 nt, Homo sapiens
ccaaaggacacggcucagca

SEQ ID NO: 1609037 - RNA, 14 nt, Homo sapiens
ccaaagugguauag

SEQ ID NO: 1609038 - RNA, 14 nt, Homo sapiens
ccaaauaccaugua

SEQ ID NO: 1609039 - RNA, 21 nt, Homo sapiens
ccaaauccaaggaaacaugca

SEQ ID NO: 1609040 - RNA, 17 nt, Homo sapiens
ccaaaugaaaugccaaa

SEQ ID NO: 1609041 - RNA, 15 nt, Homo sapiens
ccaaaugcagggagg

SEQ ID NO: 1609042 - RNA, 15 nt, Homo sapiens
ccaaauuacagcaua

SEQ ID NO: 1609043 - RNA, 21 nt, Homo sapiens
ccaaauuguguauauaucuua

SEQ ID NO: 1609044 - RNA, 22 nt, Homo sapiens
ccaacaagaacugcaucuggca

SEQ ID NO: 1609045 - RNA, 18 nt, Homo sapiens
ccaacacugccagcauuu

SEQ ID NO: 1609046 - RNA, 21 nt, Homo sapiens
ccaacacugucacuagucuca

SEQ ID NO: 1609047 - RNA, 16 nt, Homo sapiens
ccaacagcuuuuccca

SEQ ID NO: 1609048 - RNA, 15 nt, Homo sapiens
ccaacaugcacugau

SEQ ID NO: 1609049 - RNA, 12 nt, Homo sapiens
ccaacaugguga

SEQ ID NO: 1609050 - RNA, 16 nt, Homo sapiens
ccaacauucuuggcau

SEQ ID NO: 1609051 - RNA, 21 nt, Homo sapiens
ccaaccacagcaucgggagca

SEQ ID NO: 1609052 - RNA, 13 nt, Homo sapiens
ccaaccccagugg

SEQ ID NO: 1609053 - RNA, 20 nt, Homo sapiens
ccaaccccaguggauucuca

SEQ ID NO: 1609054 - RNA, 20 nt, Homo sapiens
ccaaccccccagcacugagg

SEQ ID NO: 1609055 - RNA, 15 nt, Homo sapiens
ccaaccugcucauuu

SEQ ID NO: 1609056 - RNA, 20 nt, Homo sapiens
ccaacgagacacauugccuu

SEQ ID NO: 1609057 - RNA, 14 nt, Homo sapiens
ccaacguccccucc

SEQ ID NO: 1609058 - RNA, 18 nt, Homo sapiens
ccaacuccaucuucaaua

SEQ ID NO: 1609059 - RNA, 18 nt, Homo sapiens
ccaacugguucaggcuca

SEQ ID NO: 1609060 - RNA, 23 nt, Homo sapiens
ccaacuuacaaaaacacuucguu

SEQ ID NO: 1609061 - RNA, 16 nt, Homo sapiens
ccaagaaaauaucacu

SEQ ID NO: 1609062 - RNA, 17 nt, Homo sapiens
ccaagaaaauaucacug

SEQ ID NO: 1609063 - RNA, 12 nt, Homo sapiens
ccaagaacagag

SEQ ID NO: 1609064 - RNA, 16 nt, Homo sapiens
ccaagaacuugcaaua

SEQ ID NO: 1609065 - RNA, 15 nt, Homo sapiens
ccaagaagcaugcag

SEQ ID NO: 1609066 - RNA, 15 nt, Homo sapiens
ccaagacaugacauu

SEQ ID NO: 1609067 - RNA, 20 nt, Homo sapiens
ccaagaggaaccucugauuu

SEQ ID NO: 1609068 - RNA, 19 nt, Homo sapiens
ccaagaggacugagacugg

SEQ ID NO: 1609069 - RNA, 15 nt, Homo sapiens
ccaagagugaaggga

SEQ ID NO: 1609070 - RNA, 22 nt, Homo sapiens
ccaagauuaugugacuugcaau

SEQ ID NO: 1609071 - RNA, 14 nt, Homo sapiens
ccaagauuauucaa

SEQ ID NO: 1609072 - RNA, 19 nt, Homo sapiens
ccaagauuguccuuuucuc

SEQ ID NO: 1609073 - RNA, 22 nt, Homo sapiens
ccaagcaggcugguuugcaaga

SEQ ID NO: 1609074 - RNA, 13 nt, Homo sapiens
ccaagcauuucau

SEQ ID NO: 1609075 - RNA, 23 nt, Homo sapiens
ccaagcgcgguuacuauggccag

SEQ ID NO: 1609076 - RNA, 22 nt, Homo sapiens
ccaaggaacucuacuucaguca

SEQ ID NO: 1609077 - RNA, 16 nt, Homo sapiens
ccaaggaccucucuca

SEQ ID NO: 1609078 - RNA, 15 nt, Homo sapiens
ccaaggacucuucca

SEQ ID NO: 1609079 - RNA, 19 nt, Homo sapiens
ccaaggaggggcuguaaaa

SEQ ID NO: 1609080 - RNA, 21 nt, Homo sapiens
ccaaggaggguguaauggagc

SEQ ID NO: 1609081 - RNA, 20 nt, Homo sapiens
ccaagggguuaaugaaacaa

SEQ ID NO: 1609082 - RNA, 18 nt, Homo sapiens
ccaaggguugagagccag

SEQ ID NO: 1609083 - RNA, 14 nt, Homo sapiens
ccaaguaccaguau

SEQ ID NO: 1609084 - RNA, 17 nt, Homo sapiens
ccaagugcugcacaaaa

SEQ ID NO: 1609085 - RNA, 13 nt, Homo sapiens
ccggccacacccc

SEQ ID NO: 1609086 - RNA, 18 nt, Homo sapiens
ccggcgcugauuccucgu

SEQ ID NO: 1609087 - RNA, 17 nt, Homo sapiens
ccggcggcuacucugga

SEQ ID NO: 1609088 - RNA, 22 nt, Homo sapiens
ccgggaacuggagucugucucu

SEQ ID NO: 1609089 - RNA, 14 nt, Homo sapiens
ccgggacacagaau

SEQ ID NO: 1609090 - RNA, 16 nt, Homo sapiens
ccggggccagcacuuc

SEQ ID NO: 1609091 - RNA, 20 nt, Homo sapiens
ccgggucaucuguaccucug

SEQ ID NO: 1609092 - RNA, 20 nt, Homo sapiens
ccggguucaagcaauucucc

SEQ ID NO: 1609093 - RNA, 19 nt, Homo sapiens
ccggucagccaagugcaga

SEQ ID NO: 1609094 - RNA, 23 nt, Homo sapiens
ccgguuaaauuccauaugcucca

SEQ ID NO: 1609095 - RNA, 14 nt, Homo sapiens
ccguaucacagugu

SEQ ID NO: 1609096 - RNA, 12 nt, Homo sapiens
ccgucauuucau

SEQ ID NO: 1609097 - RNA, 14 nt, Homo sapiens
ccgucuugaucgga

SEQ ID NO: 1609098 - RNA, 15 nt, Homo sapiens
ccgugaacucuggug

SEQ ID NO: 1609099 - RNA, 14 nt, Homo sapiens
ccgugagaacauca

SEQ ID NO: 1609100 - RNA, 13 nt, Homo sapiens
ccgugccaaaaau

SEQ ID NO: 1609101 - RNA, 21 nt, Homo sapiens
ccgugccaaaaaucuuuucau

SEQ ID NO: 1609102 - RNA, 17 nt, Homo sapiens
ccgugggcugugccaag

SEQ ID NO: 1609103 - RNA, 14 nt, Homo sapiens
ccuaaaacaauccu

SEQ ID NO: 1609104 - RNA, 16 nt, Homo sapiens
ccuaaacccuguuccu

SEQ ID NO: 1609105 - RNA, 11 nt, Homo sapiens
ccuaacuguga

SEQ ID NO: 1609106 - RNA, 17 nt, Homo sapiens
ccuaacuuauggacugu

SEQ ID NO: 1609107 - RNA, 15 nt, Homo sapiens
ccuaacuuucugaau

SEQ ID NO: 1609108 - RNA, 22 nt, Homo sapiens
ccuaagagacugcguucugcaa

SEQ ID NO: 1609109 - RNA, 21 nt, Homo sapiens
ccuaagaucucgguuugccaa

SEQ ID NO: 1609110 - RNA, 14 nt, Homo sapiens
ccuaagaugaagcu

SEQ ID NO: 1609111 - RNA, 19 nt, Homo sapiens
ccuaaugaaagugaugaca

SEQ ID NO: 1609112 - RNA, 19 nt, Homo sapiens
ccuaaugagagugcacugc

SEQ ID NO: 1609113 - RNA, 14 nt, Homo sapiens
ccuaauggaccucc

SEQ ID NO: 1609114 - RNA, 23 nt, Homo sapiens
ccuaauggucucuaccuaaugga

SEQ ID NO: 1609115 - RNA, 17 nt, Homo sapiens
ccuaauuccacacccuc

SEQ ID NO: 1609116 - RNA, 12 nt, Homo sapiens
ccuacagccagc

SEQ ID NO: 1609117 - RNA, 14 nt, Homo sapiens
ccuaccacuuuucu

SEQ ID NO: 1609118 - RNA, 15 nt, Homo sapiens
ccuaccauacaauau

SEQ ID NO: 1609119 - RNA, 21 nt, Homo sapiens
ccuacccccuaagagccauuu

SEQ ID NO: 1609120 - RNA, 13 nt, Homo sapiens
ccuacccuuccag

SEQ ID NO: 1609121 - RNA, 15 nt, Homo sapiens
ccuacccuucccgcc

SEQ ID NO: 1609122 - RNA, 11 nt, Homo sapiens
ccuaccucagc

SEQ ID NO: 1609123 - RNA, 21 nt, Homo sapiens
ccuaccuuagaaaacaaguau

SEQ ID NO: 1609124 - RNA, 21 nt, Homo sapiens
ccuagaaauauauccugugua

SEQ ID NO: 1609125 - RNA, 22 nt, Homo sapiens
ccuagagugacucuaccugcaa

SEQ ID NO: 1609126 - RNA, 13 nt, Homo sapiens
ccuagcacuuuau

SEQ ID NO: 1609127 - RNA, 20 nt, Homo sapiens
ccuagccaggcuaucuggcc

SEQ ID NO: 1609128 - RNA, 18 nt, Homo sapiens
ccuagcuuuuugcagaua

SEQ ID NO: 1609129 - RNA, 23 nt, Homo sapiens
ccuaggaaagccaguuacauaaa

SEQ ID NO: 1609130 - RNA, 17 nt, Homo sapiens
ccuagggauauaauucu

SEQ ID NO: 1609131 - RNA, 22 nt, Homo sapiens
ccuaguacugccccccaugagg

SEQ ID NO: 1609132 - RNA, 20 nt, Homo sapiens
ccuaguagcugggaugacag

SEQ ID NO: 1609133 - RNA, 18 nt, Homo sapiens
ccuauccccauucucugc

SEQ ID NO: 1609134 - RNA, 21 nt, Homo sapiens
ccuaugacuaauucacaaaaa

SEQ ID NO: 1609135 - RNA, 22 nt, Homo sapiens
ccuauguuugcggaaugcauug

SEQ ID NO: 1609136 - RNA, 23 nt, Homo sapiens
ccuauguuuuuguucaaagccag

SEQ ID NO: 1609137 - RNA, 21 nt, Homo sapiens
ccuauucccucucucucccag

SEQ ID NO: 1609138 - RNA, 14 nt, Homo sapiens
ccuauuguaguaaa

SEQ ID NO: 1609139 - RNA, 21 nt, Homo sapiens
ccucaaacuuccagucaggua

SEQ ID NO: 1609140 - RNA, 18 nt, Homo sapiens
ccucaaagaagucggaau

SEQ ID NO: 1609141 - RNA, 15 nt, Homo sapiens
ccucaaauacaugca

SEQ ID NO: 1609142 - RNA, 21 nt, Homo sapiens
ccucaacaagaagaauuugaa

SEQ ID NO: 1609143 - RNA, 13 nt, Homo sapiens
ccucaacaagcaa

SEQ ID NO: 1609144 - RNA, 19 nt, Homo sapiens
ccucaacaagcaagaucug

SEQ ID NO: 1609145 - RNA, 20 nt, Homo sapiens
ccucaauccuccauuugcug

SEQ ID NO: 1609146 - RNA, 21 nt, Homo sapiens
ccucaccaagcucaacggcuc

SEQ ID NO: 1609147 - RNA, 22 nt, Homo sapiens
ccucacugcuguagacauuugc

SEQ ID NO: 1609148 - RNA, 11 nt, Homo sapiens
ccucacuuuag

SEQ ID NO: 1609149 - RNA, 17 nt, Homo sapiens
ccucagaaaaaacaggc

SEQ ID NO: 1609150 - RNA, 14 nt, Homo sapiens
ccucagacccagga

SEQ ID NO: 1609151 - RNA, 11 nt, Homo sapiens
ccucagaugau

SEQ ID NO: 1609152 - RNA, 22 nt, Homo sapiens
ccucagauuccaccuagagcua

SEQ ID NO: 1609153 - RNA, 19 nt, Homo sapiens
ccucagccccagcccagac

SEQ ID NO: 1609154 - RNA, 18 nt, Homo sapiens
ccucagcuucuucacagg

SEQ ID NO: 1609155 - RNA, 16 nt, Homo sapiens
ccucaggccugaacuc

SEQ ID NO: 1609156 - RNA, 15 nt, Homo sapiens
ccucagggacagaga

SEQ ID NO: 1609157 - RNA, 15 nt, Homo sapiens
ccucaggggccucuc

SEQ ID NO: 1609158 - RNA, 13 nt, Homo sapiens
ccucagucuggca

SEQ ID NO: 1609159 - RNA, 18 nt, Homo sapiens
ccucagugcuccuggaaa

SEQ ID NO: 1609160 - RNA, 22 nt, Homo sapiens
ccucauaaaaaucuagcacacu

SEQ ID NO: 1609161 - RNA, 13 nt, Homo sapiens
ccucaucaucaga

SEQ ID NO: 1609162 - RNA, 16 nt, Homo sapiens
ccucaucuuucuucca

SEQ ID NO: 1609163 - RNA, 23 nt, Homo sapiens
ccucauggcucuggcacagugua

SEQ ID NO: 1609164 - RNA, 15 nt, Homo sapiens
ccucauuauuaucua

SEQ ID NO: 1609165 - RNA, 19 nt, Homo sapiens
ccucauuccuucccagaga

SEQ ID NO: 1609166 - RNA, 13 nt, Homo sapiens
ccuccaagcauuu

SEQ ID NO: 1609167 - RNA, 13 nt, Homo sapiens
ccuccacaccucu

SEQ ID NO: 1609168 - RNA, 12 nt, Homo sapiens
ccuccacagaga

SEQ ID NO: 1609169 - RNA, 12 nt, Homo sapiens
ccuccaccaaac

SEQ ID NO: 1609170 - RNA, 16 nt, Homo sapiens
ccuccagaauggagcu

SEQ ID NO: 1609171 - RNA, 16 nt, Homo sapiens
ccuccagagacacuga

SEQ ID NO: 1609172 - RNA, 18 nt, Homo sapiens
ccuccagagacacugagc

SEQ ID NO: 1609173 - RNA, 12 nt, Homo sapiens
ccuccagccuuc

SEQ ID NO: 1609174 - RNA, 10 nt, Homo sapiens
ccuccaggga

SEQ ID NO: 1609175 - RNA, 14 nt, Homo sapiens
ccucccaagguccu

SEQ ID NO: 1609176 - RNA, 16 nt, Homo sapiens
ccucccaaucuugccc

SEQ ID NO: 1609177 - RNA, 13 nt, Homo sapiens
ccucccaccagag

SEQ ID NO: 1609178 - RNA, 14 nt, Homo sapiens
ccucccaccagagc

SEQ ID NO: 1609179 - RNA, 20 nt, Homo sapiens
ccucccauaauugcuuugcc

SEQ ID NO: 1609180 - RNA, 18 nt, Homo sapiens
ccuccccaguucuacuga

SEQ ID NO: 1609181 - RNA, 16 nt, Homo sapiens
ccucccccaguguccc

SEQ ID NO: 1609182 - RNA, 15 nt, Homo sapiens
ccucccccaguuccu

SEQ ID NO: 1609183 - RNA, 22 nt, Homo sapiens
ccucccucucucuucugcucca

SEQ ID NO: 1609184 - RNA, 16 nt, Homo sapiens
ccucccugacuuuucu

SEQ ID NO: 1609185 - RNA, 18 nt, Homo sapiens
ccucccuggcucccauga

SEQ ID NO: 1609186 - RNA, 21 nt, Homo sapiens
ccucccuguauaagacacuuu

SEQ ID NO: 1609187 - RNA, 20 nt, Homo sapiens
ccucccuuccccuuuuccca

SEQ ID NO: 1609188 - RNA, 17 nt, Homo sapiens
ccucccuucucuucaca

SEQ ID NO: 1609189 - RNA, 17 nt, Homo sapiens
ccuccuaaaacaauccu

SEQ ID NO: 1609190 - RNA, 21 nt, Homo sapiens
ccuccuagcucucccagugaa

SEQ ID NO: 1609191 - RNA, 18 nt, Homo sapiens
ccuccuauggguugucac

SEQ ID NO: 1609192 - RNA, 16 nt, Homo sapiens
ccuccucaggcacaca

SEQ ID NO: 1609193 - RNA, 14 nt, Homo sapiens
ccuccuccagggaa

SEQ ID NO: 1609194 - RNA, 19 nt, Homo sapiens
ccuccucggaucaccgaga

SEQ ID NO: 1609195 - RNA, 16 nt, Homo sapiens
ccuccucugcccggga

SEQ ID NO: 1609196 - RNA, 18 nt, Homo sapiens
ccuccugaagccacagca

SEQ ID NO: 1609197 - RNA, 19 nt, Homo sapiens
ccuccugaguaauaagcau

SEQ ID NO: 1609198 - RNA, 20 nt, Homo sapiens
ccuccugaguagcugggacu

SEQ ID NO: 1609199 - RNA, 16 nt, Homo sapiens
ccuccugggcccucuc

SEQ ID NO: 1609200 - RNA, 15 nt, Homo sapiens
ccuccugucccucau

SEQ ID NO: 1609201 - RNA, 18 nt, Homo sapiens
ccuccugucccucaucca

SEQ ID NO: 1609202 - RNA, 23 nt, Homo sapiens
ccuccugugccucccuuuucucc

SEQ ID NO: 1609203 - RNA, 16 nt, Homo sapiens
ccuccugugucacuga

SEQ ID NO: 1609204 - RNA, 20 nt, Homo sapiens
cuaaauucaaagaaguacuu

SEQ ID NO: 1609205 - RNA, 21 nt, Homo sapiens
cuaaauuuacccucuugaaua

SEQ ID NO: 1609206 - RNA, 16 nt, Homo sapiens
cuaaauuuuucauaga

SEQ ID NO: 1609207 - RNA, 17 nt, Homo sapiens
cuaacaauaauauuuca

SEQ ID NO: 1609208 - RNA, 16 nt, Homo sapiens
cuaacaaugacauuua

SEQ ID NO: 1609209 - RNA, 22 nt, Homo sapiens
cuaacagcccuccucugcacuc

SEQ ID NO: 1609210 - RNA, 15 nt, Homo sapiens
cuaacaguaguugca

SEQ ID NO: 1609211 - RNA, 19 nt, Homo sapiens
cuaacaguugccacaucac

SEQ ID NO: 1609212 - RNA, 18 nt, Homo sapiens
cuaacauuauauugcaau

SEQ ID NO: 1609213 - RNA, 11 nt, Homo sapiens
cuaaccaucug

SEQ ID NO: 1609214 - RNA, 23 nt, Homo sapiens
cuaacccccagcccacagagccu

SEQ ID NO: 1609215 - RNA, 23 nt, Homo sapiens
cuaaccuucacgauuaacuguga

SEQ ID NO: 1609216 - RNA, 15 nt, Homo sapiens
cuaacuccugccauu

SEQ ID NO: 1609217 - RNA, 16 nt, Homo sapiens
cuaacuccugccauuc

SEQ ID NO: 1609218 - RNA, 19 nt, Homo sapiens
cuaacuuuguaaccagaau

SEQ ID NO: 1609219 - RNA, 20 nt, Homo sapiens
cuaagaaaaaaagcacaaag

SEQ ID NO: 1609220 - RNA, 13 nt, Homo sapiens
cuaagaagacauu

SEQ ID NO: 1609221 - RNA, 23 nt, Homo sapiens
cuaagacauauucagacaucaac

SEQ ID NO: 1609222 - RNA, 12 nt, Homo sapiens
cuaagacuacua

SEQ ID NO: 1609223 - RNA, 20 nt, Homo sapiens
cuaagaucucgguuugccaa

SEQ ID NO: 1609224 - RNA, 18 nt, Homo sapiens
cuaagcaaauaggcaaaa

SEQ ID NO: 1609225 - RNA, 19 nt, Homo sapiens
cuaagcaagugaacucauc

SEQ ID NO: 1609226 - RNA, 14 nt, Homo sapiens
cuaagcacauucca

SEQ ID NO: 1609227 - RNA, 17 nt, Homo sapiens
cuaagcagaccacugau

SEQ ID NO: 1609228 - RNA, 14 nt, Homo sapiens
cuaagcaugugucc

SEQ ID NO: 1609229 - RNA, 18 nt, Homo sapiens
cuaagccgaaguuuugua

SEQ ID NO: 1609230 - RNA, 22 nt, Homo sapiens
cuaagccuuugccgugagcaug

SEQ ID NO: 1609231 - RNA, 20 nt, Homo sapiens
cuaaggaaguaucagcacua

SEQ ID NO: 1609232 - RNA, 16 nt, Homo sapiens
cuaaggagccuggaaa

SEQ ID NO: 1609233 - RNA, 21 nt, Homo sapiens
cuaaggaugguuuuaucuucc

SEQ ID NO: 1609234 - RNA, 22 nt, Homo sapiens
cuaaggcagcugauccaggcaa

SEQ ID NO: 1609235 - RNA, 20 nt, Homo sapiens
cuaaguagucaucaaugcaa

SEQ ID NO: 1609236 - RNA, 18 nt, Homo sapiens
cuaaguuuuuauaccagc

SEQ ID NO: 1609237 - RNA, 19 nt, Homo sapiens
cuaauaauaguacuauuac

SEQ ID NO: 1609238 - RNA, 18 nt, Homo sapiens
cuaauaugccuagcacaa

SEQ ID NO: 1609239 - RNA, 23 nt, Homo sapiens
cuaauauuaguuggcuuucauaa

SEQ ID NO: 1609240 - RNA, 12 nt, Homo sapiens
cuaaugcucaac

SEQ ID NO: 1609241 - RNA, 18 nt, Homo sapiens
cuaaugggggcagucucc

SEQ ID NO: 1609242 - RNA, 17 nt, Homo sapiens
cuaaugugaucauauga

SEQ ID NO: 1609243 - RNA, 19 nt, Homo sapiens
cuaauucagugucacauga

SEQ ID NO: 1609244 - RNA, 16 nt, Homo sapiens
cuaauuuacuggacaa

SEQ ID NO: 1609245 - RNA, 19 nt, Homo sapiens
cuaauuuguaggaaaaagc

SEQ ID NO: 1609246 - RNA, 20 nt, Homo sapiens
cuaauuuguaggaaaaagca

SEQ ID NO: 1609247 - RNA, 18 nt, Homo sapiens
cuacaaaggaaauaucaa

SEQ ID NO: 1609248 - RNA, 22 nt, Homo sapiens
cuacaaaggagacgggggagca

SEQ ID NO: 1609249 - RNA, 11 nt, Homo sapiens
cuacaagccaa

SEQ ID NO: 1609250 - RNA, 13 nt, Homo sapiens
cuacaaguauuau

SEQ ID NO: 1609251 - RNA, 21 nt, Homo sapiens
cuacacagagcaggacugcac

SEQ ID NO: 1609252 - RNA, 19 nt, Homo sapiens
cuacacugagcagggagac

SEQ ID NO: 1609253 - RNA, 21 nt, Homo sapiens
cuacagagagaaaaauugccu

SEQ ID NO: 1609254 - RNA, 17 nt, Homo sapiens
cuacagaguacgugaaa

SEQ ID NO: 1609255 - RNA, 20 nt, Homo sapiens
cuacagcaaagccuagccug

SEQ ID NO: 1609256 - RNA, 17 nt, Homo sapiens
cuacagcacuacugggu

SEQ ID NO: 1609257 - RNA, 17 nt, Homo sapiens
cuacaggcccaccccug

SEQ ID NO: 1609258 - RNA, 19 nt, Homo sapiens
cuacagggacacuaucacu

SEQ ID NO: 1609259 - RNA, 19 nt, Homo sapiens
cuacaggugaaggcucuca

SEQ ID NO: 1609260 - RNA, 17 nt, Homo sapiens
cuacaguuuuaacugug

SEQ ID NO: 1609261 - RNA, 13 nt, Homo sapiens
cuacaucagccuu

SEQ ID NO: 1609262 - RNA, 21 nt, Homo sapiens
cuacauccuaagguucuugcu

SEQ ID NO: 1609263 - RNA, 16 nt, Homo sapiens
cuacaugccaugccua

SEQ ID NO: 1609264 - RNA, 14 nt, Homo sapiens
cuacauuccaaaga

SEQ ID NO: 1609265 - RNA, 16 nt, Homo sapiens
cuaccacacacagccu

SEQ ID NO: 1609266 - RNA, 23 nt, Homo sapiens
cuacccugagaucugcacaguca

SEQ ID NO: 1609267 - RNA, 13 nt, Homo sapiens
cuacccugccucc

SEQ ID NO: 1609268 - RNA, 21 nt, Homo sapiens
cuacccuuuuccuuugugguu

SEQ ID NO: 1609269 - RNA, 14 nt, Homo sapiens
cuaccucagccucc

SEQ ID NO: 1609270 - RNA, 13 nt, Homo sapiens
cuaccucuuggcu

SEQ ID NO: 1609271 - RNA, 15 nt, Homo sapiens
cuaccugagcauuca

SEQ ID NO: 1609272 - RNA, 20 nt, Homo sapiens
cuaccuuagaaaacaaguau

SEQ ID NO: 1609273 - RNA, 22 nt, Homo sapiens
cuaccuugguucccccacugau

SEQ ID NO: 1609274 - RNA, 20 nt, Homo sapiens
cuacgccaauguuaugccag

SEQ ID NO: 1609275 - RNA, 14 nt, Homo sapiens
cuacuaaaaacaca

SEQ ID NO: 1609276 - RNA, 19 nt, Homo sapiens
cuacuacaaacuucaaaga

SEQ ID NO: 1609277 - RNA, 15 nt, Homo sapiens
cuacuagagcuccau

SEQ ID NO: 1609278 - RNA, 22 nt, Homo sapiens
cuacuccuagaagaaccaaaua

SEQ ID NO: 1609279 - RNA, 21 nt, Homo sapiens
cuacuccucugcagugccuug

SEQ ID NO: 1609280 - RNA, 14 nt, Homo sapiens
cuacugacuuuucc

SEQ ID NO: 1609281 - RNA, 20 nt, Homo sapiens
cuacugagucacaauaaaga

SEQ ID NO: 1609282 - RNA, 15 nt, Homo sapiens
cuacuggaauggugu

SEQ ID NO: 1609283 - RNA, 15 nt, Homo sapiens
cuacuggcccaagau

SEQ ID NO: 1609284 - RNA, 19 nt, Homo sapiens
cuacugggugucauuucau

SEQ ID NO: 1609285 - RNA, 15 nt, Homo sapiens
cuacuguucuugaca

SEQ ID NO: 1609286 - RNA, 20 nt, Homo sapiens
cuacuuuaaguauacaaucu

SEQ ID NO: 1609287 - RNA, 20 nt, Homo sapiens
cuacuuuaauauaaacccau

SEQ ID NO: 1609288 - RNA, 18 nt, Homo sapiens
cuagaaaaccagcuugcg

SEQ ID NO: 1609289 - RNA, 18 nt, Homo sapiens
cuagaaaaggcagcuaaa

SEQ ID NO: 1609290 - RNA, 21 nt, Homo sapiens
cuagaaaauuagacugugauu

SEQ ID NO: 1609291 - RNA, 16 nt, Homo sapiens
cuagaaagacagaagc

SEQ ID NO: 1609292 - RNA, 12 nt, Homo sapiens
cuagaagccaag

SEQ ID NO: 1609293 - RNA, 24 nt, Homo sapiens
cuagaauauuuaaaacaucauuac

SEQ ID NO: 1609294 - RNA, 23 nt, Homo sapiens
cuagaaucauacuuaacauuuca

SEQ ID NO: 1609295 - RNA, 21 nt, Homo sapiens
cuagacauucuuuuaaugcca

SEQ ID NO: 1609296 - RNA, 21 nt, Homo sapiens
cuagagaaggcugugagccaa

SEQ ID NO: 1609297 - RNA, 18 nt, Homo sapiens
cuagagcuagaugugucu

SEQ ID NO: 1609298 - RNA, 23 nt, Homo sapiens
cuagagcuagaugugucuuacca

SEQ ID NO: 1609299 - RNA, 12 nt, Homo sapiens
cuagagcuccau

SEQ ID NO: 1609300 - RNA, 14 nt, Homo sapiens
cuagaguccucacu

SEQ ID NO: 1609301 - RNA, 15 nt, Homo sapiens
cuagaguucauggau

SEQ ID NO: 1609302 - RNA, 19 nt, Homo sapiens
cuagaugauggaugccaau

SEQ ID NO: 1609303 - RNA, 17 nt, Homo sapiens
cuagaugugucuuacca

SEQ ID NO: 1609304 - RNA, 20 nt, Homo sapiens
cuagauuaccaugaagaaca

SEQ ID NO: 1609305 - RNA, 21 nt, Homo sapiens
cuagcacccuggagagugcac

SEQ ID NO: 1609306 - RNA, 19 nt, Homo sapiens
cuagcagaggaaaguguaa

SEQ ID NO: 1609307 - RNA, 14 nt, Homo sapiens
cuagccagcaaaga

SEQ ID NO: 1609308 - RNA, 13 nt, Homo sapiens
cuagccugcacuu

SEQ ID NO: 1609309 - RNA, 19 nt, Homo sapiens
cuaggaaaaucacuugcca

SEQ ID NO: 1609310 - RNA, 13 nt, Homo sapiens
cuaggaaggugaa

SEQ ID NO: 1609311 - RNA, 21 nt, Homo sapiens
cuaggauaacuggcacccaga

SEQ ID NO: 1609312 - RNA, 16 nt, Homo sapiens
cuaggaugaagcccua

SEQ ID NO: 1609313 - RNA, 14 nt, Homo sapiens
cuaggcugagcaau

SEQ ID NO: 1609314 - RNA, 16 nt, Homo sapiens
cuagggccaagcccag

SEQ ID NO: 1609315 - RNA, 17 nt, Homo sapiens
cuaggggcagccugaau

SEQ ID NO: 1609316 - RNA, 14 nt, Homo sapiens
cuagguagggucac

SEQ ID NO: 1609317 - RNA, 14 nt, Homo sapiens
cuaguaaauuuaau

SEQ ID NO: 1609318 - RNA, 19 nt, Homo sapiens
cuaguaaguaauuaugcac

SEQ ID NO: 1609319 - RNA, 14 nt, Homo sapiens
cuaguaccaaaagu

SEQ ID NO: 1609320 - RNA, 13 nt, Homo sapiens
cuaguacuaguac

SEQ ID NO: 1609321 - RNA, 18 nt, Homo sapiens
cuaguacuauuacuagua

SEQ ID NO: 1609322 - RNA, 15 nt, Homo sapiens
cucuuucccaacccc

SEQ ID NO: 1609323 - RNA, 18 nt, Homo sapiens
cucuuucuguauauacuu

SEQ ID NO: 1609324 - RNA, 16 nt, Homo sapiens
cucuuucuuugcaaca

SEQ ID NO: 1609325 - RNA, 13 nt, Homo sapiens
cucuuuggggcua

SEQ ID NO: 1609326 - RNA, 14 nt, Homo sapiens
cucuuuucaaugug

SEQ ID NO: 1609327 - RNA, 14 nt, Homo sapiens
cugaaaaaugcaaa

SEQ ID NO: 1609328 - RNA, 12 nt, Homo sapiens
cugaaaauugca

SEQ ID NO: 1609329 - RNA, 14 nt, Homo sapiens
cugaaagacuugaa

SEQ ID NO: 1609330 - RNA, 20 nt, Homo sapiens
cugaaaggagacauugcucu

SEQ ID NO: 1609331 - RNA, 23 nt, Homo sapiens
cugaaaguaauauaaugaugcug

SEQ ID NO: 1609332 - RNA, 17 nt, Homo sapiens
cugaaaugacauuucac

SEQ ID NO: 1609333 - RNA, 22 nt, Homo sapiens
cugaaaugcaagaccccaagag

SEQ ID NO: 1609334 - RNA, 23 nt, Homo sapiens
cugaaauuuuaaugaagugcaau

SEQ ID NO: 1609335 - RNA, 15 nt, Homo sapiens
cugaaccauguggca

SEQ ID NO: 1609336 - RNA, 23 nt, Homo sapiens
cugaaccucuucaagagcaucug

SEQ ID NO: 1609337 - RNA, 12 nt, Homo sapiens
cugaacucagaa

SEQ ID NO: 1609338 - RNA, 15 nt, Homo sapiens
cugaacucagcacau

SEQ ID NO: 1609339 - RNA, 12 nt, Homo sapiens
cugaacuccaua

SEQ ID NO: 1609340 - RNA, 16 nt, Homo sapiens
cugaacugacaaugaa

SEQ ID NO: 1609341 - RNA, 19 nt, Homo sapiens
cugaacugacaaugaaggg

SEQ ID NO: 1609342 - RNA, 22 nt, Homo sapiens
cugaagagcuauuauauaaaaa

SEQ ID NO: 1609343 - RNA, 16 nt, Homo sapiens
cugaagagcucuuggc

SEQ ID NO: 1609344 - RNA, 19 nt, Homo sapiens
cugaagcaaagugcccaug

SEQ ID NO: 1609345 - RNA, 16 nt, Homo sapiens
cugaagcugaaaugca

SEQ ID NO: 1609346 - RNA, 22 nt, Homo sapiens
cugaaggcacagcuaaccacuu

SEQ ID NO: 1609347 - RNA, 20 nt, Homo sapiens
cugaaggcagucauaucaaa

SEQ ID NO: 1609348 - RNA, 17 nt, Homo sapiens
cugaaggggaggucaca

SEQ ID NO: 1609349 - RNA, 19 nt, Homo sapiens
cugaaggguggaugugcug

SEQ ID NO: 1609350 - RNA, 19 nt, Homo sapiens
cugaaguacaaacaugaaa

SEQ ID NO: 1609351 - RNA, 12 nt, Homo sapiens
cugaaucuaccu

SEQ ID NO: 1609352 - RNA, 14 nt, Homo sapiens
cugaaucuagagaa

SEQ ID NO: 1609353 - RNA, 17 nt, Homo sapiens
cugaaucuauggcuuua

SEQ ID NO: 1609354 - RNA, 16 nt, Homo sapiens
cugaaucugcuaccaa

SEQ ID NO: 1609355 - RNA, 18 nt, Homo sapiens
cugaauuggcuuccagau

SEQ ID NO: 1609356 - RNA, 22 nt, Homo sapiens
cugaauuuuuaaaacccauuua

SEQ ID NO: 1609357 - RNA, 16 nt, Homo sapiens
cugacaaugaagggaa

SEQ ID NO: 1609358 - RNA, 22 nt, Homo sapiens
cugacacucaauaaacagucac

SEQ ID NO: 1609359 - RNA, 23 nt, Homo sapiens
cugacaguuaauaaaccuuugca

SEQ ID NO: 1609360 - RNA, 12 nt, Homo sapiens
cugacauucacu

SEQ ID NO: 1609361 - RNA, 17 nt, Homo sapiens
cugaccaagugcuggcc

SEQ ID NO: 1609362 - RNA, 20 nt, Homo sapiens
cugaccaauauuguacaguu

SEQ ID NO: 1609363 - RNA, 21 nt, Homo sapiens
cugaccaauauuguacaguuu

SEQ ID NO: 1609364 - RNA, 13 nt, Homo sapiens
cugacccccaugu

SEQ ID NO: 1609365 - RNA, 22 nt, Homo sapiens
cugacccucaucuuucuuccaa

SEQ ID NO: 1609366 - RNA, 16 nt, Homo sapiens
cugacccuucucucac

SEQ ID NO: 1609367 - RNA, 17 nt, Homo sapiens
cugaccucgugauccac

SEQ ID NO: 1609368 - RNA, 17 nt, Homo sapiens
cugaccuugugauccac

SEQ ID NO: 1609369 - RNA, 16 nt, Homo sapiens
cugaccuuuguccuua

SEQ ID NO: 1609370 - RNA, 23 nt, Homo sapiens
cugacuucagaguggacuugugu

SEQ ID NO: 1609371 - RNA, 13 nt, Homo sapiens
cugacuuccucug

SEQ ID NO: 1609372 - RNA, 18 nt, Homo sapiens
cugagaacuccucauucc

SEQ ID NO: 1609373 - RNA, 17 nt, Homo sapiens
cugagaaggcaaaagaa

SEQ ID NO: 1609374 - RNA, 18 nt, Homo sapiens
cugagaagugcacuuuaa

SEQ ID NO: 1609375 - RNA, 16 nt, Homo sapiens
cugagacagugaauuu

SEQ ID NO: 1609376 - RNA, 18 nt, Homo sapiens
cugagaccaggguggcca

SEQ ID NO: 1609377 - RNA, 22 nt, Homo sapiens
cugagagaggccauucuuuccc

SEQ ID NO: 1609378 - RNA, 23 nt, Homo sapiens
cugagagaguggagagugacaug

SEQ ID NO: 1609379 - RNA, 14 nt, Homo sapiens
cugagauaccagcg

SEQ ID NO: 1609380 - RNA, 18 nt, Homo sapiens
cugagauugcagauguga

SEQ ID NO: 1609381 - RNA, 19 nt, Homo sapiens
cugagcaccgaauauugag

SEQ ID NO: 1609382 - RNA, 20 nt, Homo sapiens
cugagcagaagcuggaggca

SEQ ID NO: 1609383 - RNA, 19 nt, Homo sapiens
cugagcagguguucuucau

SEQ ID NO: 1609384 - RNA, 22 nt, Homo sapiens
cugagcagugaaugauucagug

SEQ ID NO: 1609385 - RNA, 19 nt, Homo sapiens
cugagccacagcagcauuu

SEQ ID NO: 1609386 - RNA, 20 nt, Homo sapiens
cugagcccccacugcuucua

SEQ ID NO: 1609387 - RNA, 16 nt, Homo sapiens
cugagcuuuugccacu

SEQ ID NO: 1609388 - RNA, 19 nt, Homo sapiens
cugaggagccugcaacaug

SEQ ID NO: 1609389 - RNA, 22 nt, Homo sapiens
cugaggcaggagagucacuuga

SEQ ID NO: 1609390 - RNA, 16 nt, Homo sapiens
cugaggccuccaagga

SEQ ID NO: 1609391 - RNA, 21 nt, Homo sapiens
cugaggcggagaauugcuuga

SEQ ID NO: 1609392 - RNA, 15 nt, Homo sapiens
cugagggcaguucug

SEQ ID NO: 1609393 - RNA, 20 nt, Homo sapiens
cugaggggauaccauaaaaa

SEQ ID NO: 1609394 - RNA, 23 nt, Homo sapiens
cugaggguugggguggggaagca

SEQ ID NO: 1609395 - RNA, 19 nt, Homo sapiens
cugagguuugccagcauuu

SEQ ID NO: 1609396 - RNA, 19 nt, Homo sapiens
cugaguaagcccucaggag

SEQ ID NO: 1609397 - RNA, 21 nt, Homo sapiens
cugaguccuuuccaggggcca

SEQ ID NO: 1609398 - RNA, 18 nt, Homo sapiens
cugagugaaauacuguac

SEQ ID NO: 1609399 - RNA, 17 nt, Homo sapiens
cugaguggugucugcuu

SEQ ID NO: 1609400 - RNA, 14 nt, Homo sapiens
cugagugugaugaa

SEQ ID NO: 1609401 - RNA, 17 nt, Homo sapiens
cugaguguuuaauuuca

SEQ ID NO: 1609402 - RNA, 12 nt, Homo sapiens
cugaguugcaca

SEQ ID NO: 1609403 - RNA, 14 nt, Homo sapiens
cugaguugcuuuua

SEQ ID NO: 1609404 - RNA, 21 nt, Homo sapiens
cugaguuuuguuucacuuuga

SEQ ID NO: 1609405 - RNA, 18 nt, Homo sapiens
cugauacuuauuuaccua

SEQ ID NO: 1609406 - RNA, 15 nt, Homo sapiens
cugauacuuuagcca

SEQ ID NO: 1609407 - RNA, 14 nt, Homo sapiens
cugauagggguuca

SEQ ID NO: 1609408 - RNA, 17 nt, Homo sapiens
cugaucccccagaugca

SEQ ID NO: 1609409 - RNA, 14 nt, Homo sapiens
cugauccuugcacg

SEQ ID NO: 1609410 - RNA, 18 nt, Homo sapiens
cugaucugugcuuuccag

SEQ ID NO: 1609411 - RNA, 17 nt, Homo sapiens
cugaugagcacaucucu

SEQ ID NO: 1609412 - RNA, 14 nt, Homo sapiens
cugaugccauguaa

SEQ ID NO: 1609413 - RNA, 16 nt, Homo sapiens
cugauggaaaauacca

SEQ ID NO: 1609414 - RNA, 15 nt, Homo sapiens
cugaugggaaaacug

SEQ ID NO: 1609415 - RNA, 20 nt, Homo sapiens
cugaugggggacaggauuug

SEQ ID NO: 1609416 - RNA, 19 nt, Homo sapiens
cugaugucccagugcucac

SEQ ID NO: 1609417 - RNA, 18 nt, Homo sapiens
cugauguguccucaggga

SEQ ID NO: 1609418 - RNA, 22 nt, Homo sapiens
cugauguuuugguguauuguca

SEQ ID NO: 1609419 - RNA, 20 nt, Homo sapiens
cugauuaaaaauaccuucua

SEQ ID NO: 1609420 - RNA, 22 nt, Homo sapiens
cugauuaauccauuuuaacaaa

SEQ ID NO: 1609421 - RNA, 14 nt, Homo sapiens
cugauuaugaaaug

SEQ ID NO: 1609422 - RNA, 13 nt, Homo sapiens
cugauuccagaac

SEQ ID NO: 1609423 - RNA, 19 nt, Homo sapiens
cugauuccuucaacuggcu

SEQ ID NO: 1609424 - RNA, 19 nt, Homo sapiens
cugauuuuggccaucagga

SEQ ID NO: 1609425 - RNA, 14 nt, Homo sapiens
cugcaaaccuuccu

SEQ ID NO: 1609426 - RNA, 23 nt, Homo sapiens
cugcaaauauuagcaaagaagcu

SEQ ID NO: 1609427 - RNA, 12 nt, Homo sapiens
cugcaacuccau

SEQ ID NO: 1609428 - RNA, 18 nt, Homo sapiens
cugcaaggacauuucuca

SEQ ID NO: 1609429 - RNA, 19 nt, Homo sapiens
cugcaaguguaucuccuuu

SEQ ID NO: 1609430 - RNA, 22 nt, Homo sapiens
cugcaauacauuaaaauaacua

SEQ ID NO: 1609431 - RNA, 18 nt, Homo sapiens
cugcaauaugaauucaag

SEQ ID NO: 1609432 - RNA, 16 nt, Homo sapiens
cugcaauccaaugcac

SEQ ID NO: 1609433 - RNA, 23 nt, Homo sapiens
cugcacaaaagcagauacuugag

SEQ ID NO: 1609434 - RNA, 18 nt, Homo sapiens
cugcacacacaugcauac

SEQ ID NO: 1609435 - RNA, 16 nt, Homo sapiens
cugcaccccugggcca

SEQ ID NO: 1609436 - RNA, 20 nt, Homo sapiens
cugcacccuguuuaacauuu

SEQ ID NO: 1609437 - RNA, 14 nt, Homo sapiens
cugcacuaauauaa

SEQ ID NO: 1609438 - RNA, 19 nt, Homo sapiens
cugcacuccagccuggcaa

SEQ ID NO: 1609439 - RNA, 15 nt, Homo sapiens
cugcacuggggccac

SEQ ID NO: 1609440 - RNA, 23 nt, Homo sapiens
gaguaaugauguaacagugcaag

SEQ ID NO: 1609441 - RNA, 23 nt, Homo sapiens
gaguaguuguuggucuguagcaa

SEQ ID NO: 1609442 - RNA, 18 nt, Homo sapiens
gagucaacuggcuggcca

SEQ ID NO: 1609443 - RNA, 19 nt, Homo sapiens
gagucacugccaagucaua

SEQ ID NO: 1609444 - RNA, 11 nt, Homo sapiens
gagucacugua

SEQ ID NO: 1609445 - RNA, 23 nt, Homo sapiens
gagucaggaguuuuacugccugu

SEQ ID NO: 1609446 - RNA, 21 nt, Homo sapiens
gagucaugauccuugcugaua

SEQ ID NO: 1609447 - RNA, 14 nt, Homo sapiens
gaguccacaggcuc

SEQ ID NO: 1609448 - RNA, 16 nt, Homo sapiens
gaguccuaggacuuaa

SEQ ID NO: 1609449 - RNA, 15 nt, Homo sapiens
gaguccucacuccca

SEQ ID NO: 1609450 - RNA, 19 nt, Homo sapiens
gagucucauuugggcuaga

SEQ ID NO: 1609451 - RNA, 18 nt, Homo sapiens
gagucuucacuaaccuuu

SEQ ID NO: 1609452 - RNA, 20 nt, Homo sapiens
gagucuuguguucacccgug

SEQ ID NO: 1609453 - RNA, 19 nt, Homo sapiens
gagugaaacuccgucucaa

SEQ ID NO: 1609454 - RNA, 21 nt, Homo sapiens
gagugacagagcgagacucca

SEQ ID NO: 1609455 - RNA, 14 nt, Homo sapiens
gagugacagucaua

SEQ ID NO: 1609456 - RNA, 19 nt, Homo sapiens
gagugagaccauguuucaa

SEQ ID NO: 1609457 - RNA, 13 nt, Homo sapiens
gagugagacucca

SEQ ID NO: 1609458 - RNA, 16 nt, Homo sapiens
gagugauugguugcau

SEQ ID NO: 1609459 - RNA, 16 nt, Homo sapiens
gagugcaguggcacaa

SEQ ID NO: 1609460 - RNA, 16 nt, Homo sapiens
gagugcaguggcgcga

SEQ ID NO: 1609461 - RNA, 16 nt, Homo sapiens
gaguguccucuucccu

SEQ ID NO: 1609462 - RNA, 15 nt, Homo sapiens
gaguucaagccugug

SEQ ID NO: 1609463 - RNA, 20 nt, Homo sapiens
gaguucauggauauguuaua

SEQ ID NO: 1609464 - RNA, 19 nt, Homo sapiens
gaguuccccugucuguccc

SEQ ID NO: 1609465 - RNA, 23 nt, Homo sapiens
gaguugcauagcugauaugucag

SEQ ID NO: 1609466 - RNA, 20 nt, Homo sapiens
gaguugccaggcacuuugag

SEQ ID NO: 1609467 - RNA, 16 nt, Homo sapiens
gaguuguacacccaag

SEQ ID NO: 1609468 - RNA, 20 nt, Homo sapiens
gaguuuaaaaaugguaucaa

SEQ ID NO: 1609469 - RNA, 15 nt, Homo sapiens
gaguuuguauuauua

SEQ ID NO: 1609470 - RNA, 18 nt, Homo sapiens
gaguuuguauuauuacaa

SEQ ID NO: 1609471 - RNA, 15 nt, Homo sapiens
gaguuuuacugccug

SEQ ID NO: 1609472 - RNA, 13 nt, Homo sapiens
gaguuuucagugg

SEQ ID NO: 1609473 - RNA, 22 nt, Homo sapiens
gauaaaagagaagccaaacagc

SEQ ID NO: 1609474 - RNA, 13 nt, Homo sapiens
gauaaaagcaauu

SEQ ID NO: 1609475 - RNA, 17 nt, Homo sapiens
gauaaaaucuuccaaau

SEQ ID NO: 1609476 - RNA, 12 nt, Homo sapiens
gauaaaccaaaa

SEQ ID NO: 1609477 - RNA, 21 nt, Homo sapiens
gauaaaccauggccaauucag

SEQ ID NO: 1609478 - RNA, 14 nt, Homo sapiens
gauaaaugacuguu

SEQ ID NO: 1609479 - RNA, 17 nt, Homo sapiens
gauaacccuuauuccau

SEQ ID NO: 1609480 - RNA, 14 nt, Homo sapiens
gauaaggcucugaa

SEQ ID NO: 1609481 - RNA, 18 nt, Homo sapiens
gauaaguggggacuagug

SEQ ID NO: 1609482 - RNA, 11 nt, Homo sapiens
gauaaugccuu

SEQ ID NO: 1609483 - RNA, 15 nt, Homo sapiens
gauaauuauuuacaa

SEQ ID NO: 1609484 - RNA, 20 nt, Homo sapiens
gauaauuuauuauacaccuu

SEQ ID NO: 1609485 - RNA, 13 nt, Homo sapiens
gauacauaaagac

SEQ ID NO: 1609486 - RNA, 20 nt, Homo sapiens
gauacuaacauuuucauuga

SEQ ID NO: 1609487 - RNA, 23 nt, Homo sapiens
gauacuaauaggugugugaggcu

SEQ ID NO: 1609488 - RNA, 23 nt, Homo sapiens
gauacuccgcugucggcacauuc

SEQ ID NO: 1609489 - RNA, 19 nt, Homo sapiens
gauagaaccaccauaguga

SEQ ID NO: 1609490 - RNA, 15 nt, Homo sapiens
gauaggaaaaaucca

SEQ ID NO: 1609491 - RNA, 21 nt, Homo sapiens
gauaggguuucuaaugguuau

SEQ ID NO: 1609492 - RNA, 13 nt, Homo sapiens
gauagguaccuga

SEQ ID NO: 1609493 - RNA, 15 nt, Homo sapiens
gauauaaaagacuga

SEQ ID NO: 1609494 - RNA, 22 nt, Homo sapiens
gauauaaucuuucaaaccagcu

SEQ ID NO: 1609495 - RNA, 20 nt, Homo sapiens
gauauaauuuuauuacauau

SEQ ID NO: 1609496 - RNA, 21 nt, Homo sapiens
gauauaauuuuauuacauaug

SEQ ID NO: 1609497 - RNA, 21 nt, Homo sapiens
gauauacauuuauuuacacuc

SEQ ID NO: 1609498 - RNA, 21 nt, Homo sapiens
gauauauguguauacauacau

SEQ ID NO: 1609499 - RNA, 22 nt, Homo sapiens
gauaucacagaggccuauaacu

SEQ ID NO: 1609500 - RNA, 11 nt, Homo sapiens
gauaucuugga

SEQ ID NO: 1609501 - RNA, 23 nt, Homo sapiens
gauaugcacuugaaaugauggua

SEQ ID NO: 1609502 - RNA, 14 nt, Homo sapiens
gauauguuaagcau

SEQ ID NO: 1609503 - RNA, 20 nt, Homo sapiens
gauauuaauagauaauauga

SEQ ID NO: 1609504 - RNA, 13 nt, Homo sapiens
gauauugcagcuu

SEQ ID NO: 1609505 - RNA, 17 nt, Homo sapiens
gaucaaagaacugaaag

SEQ ID NO: 1609506 - RNA, 13 nt, Homo sapiens
gaucacacagugu

SEQ ID NO: 1609507 - RNA, 19 nt, Homo sapiens
gaucagacagcuugaauca

SEQ ID NO: 1609508 - RNA, 15 nt, Homo sapiens
gaucagcacugccag

SEQ ID NO: 1609509 - RNA, 18 nt, Homo sapiens
gaucagccccgccuguca

SEQ ID NO: 1609510 - RNA, 21 nt, Homo sapiens
gaucagccccgccugucacaa

SEQ ID NO: 1609511 - RNA, 12 nt, Homo sapiens
gaucagcuggug

SEQ ID NO: 1609512 - RNA, 15 nt, Homo sapiens
gaucaggcacagugg

SEQ ID NO: 1609513 - RNA, 23 nt, Homo sapiens
gaucaucuuugccaccaccuggg

SEQ ID NO: 1609514 - RNA, 14 nt, Homo sapiens
gauccacccaccuc

SEQ ID NO: 1609515 - RNA, 17 nt, Homo sapiens
gauccacgcugggccua

SEQ ID NO: 1609516 - RNA, 17 nt, Homo sapiens
gauccagccucauaccu

SEQ ID NO: 1609517 - RNA, 22 nt, Homo sapiens
gauccagucuggaaaacagaaa

SEQ ID NO: 1609518 - RNA, 22 nt, Homo sapiens
gauccccaacugcuccagccuc

SEQ ID NO: 1609519 - RNA, 12 nt, Homo sapiens
gauccugcacuc

SEQ ID NO: 1609520 - RNA, 17 nt, Homo sapiens
gauccuguuacuugcuu

SEQ ID NO: 1609521 - RNA, 19 nt, Homo sapiens
gauccuguuccucaacaag

SEQ ID NO: 1609522 - RNA, 15 nt, Homo sapiens
gaucgacgugaucaa

SEQ ID NO: 1609523 - RNA, 20 nt, Homo sapiens
gaucgcaccacugcacucca

SEQ ID NO: 1609524 - RNA, 14 nt, Homo sapiens
gaucgcugcacaug

SEQ ID NO: 1609525 - RNA, 14 nt, Homo sapiens
gaucggacucugcc

SEQ ID NO: 1609526 - RNA, 11 nt, Homo sapiens
gaucucucuug

SEQ ID NO: 1609527 - RNA, 24 nt, Homo sapiens
gaucugaacauacagagcccacau

SEQ ID NO: 1609528 - RNA, 18 nt, Homo sapiens
gaucuguuuugaaggcaa

SEQ ID NO: 1609529 - RNA, 18 nt, Homo sapiens
gaucuucagaacugcccu

SEQ ID NO: 1609530 - RNA, 19 nt, Homo sapiens
gaucuucagggaacugcau

SEQ ID NO: 1609531 - RNA, 17 nt, Homo sapiens
gaucuucauuaccaaua

SEQ ID NO: 1609532 - RNA, 19 nt, Homo sapiens
gaucuuucuuuccaaaaca

SEQ ID NO: 1609533 - RNA, 15 nt, Homo sapiens
gaucuuugagcccau

SEQ ID NO: 1609534 - RNA, 13 nt, Homo sapiens
gaucuuugcaaag

SEQ ID NO: 1609535 - RNA, 20 nt, Homo sapiens
gaucuuuguuuaaaugccaa

SEQ ID NO: 1609536 - RNA, 22 nt, Homo sapiens
gaugaaagaggggugggaucca

SEQ ID NO: 1609537 - RNA, 21 nt, Homo sapiens
gaugacaaaagaaaauuuucc

SEQ ID NO: 1609538 - RNA, 16 nt, Homo sapiens
gaugauucaagccauu

SEQ ID NO: 1609539 - RNA, 17 nt, Homo sapiens
gaugauucuaugucuca

SEQ ID NO: 1609540 - RNA, 17 nt, Homo sapiens
gaugcacuuauucaaua

SEQ ID NO: 1609541 - RNA, 16 nt, Homo sapiens
gaugcagucuccucuu

SEQ ID NO: 1609542 - RNA, 21 nt, Homo sapiens
gaugccacuucucacucacca

SEQ ID NO: 1609543 - RNA, 17 nt, Homo sapiens
gaugcccaugguccagg

SEQ ID NO: 1609544 - RNA, 19 nt, Homo sapiens
gaugccucgcucuuuucaa

SEQ ID NO: 1609545 - RNA, 10 nt, Homo sapiens
gaugccuuga

SEQ ID NO: 1609546 - RNA, 17 nt, Homo sapiens
gaugcugccaaaccugc

SEQ ID NO: 1609547 - RNA, 20 nt, Homo sapiens
gaugcuggccagcauuuuca

SEQ ID NO: 1609548 - RNA, 13 nt, Homo sapiens
gauggaacaucag

SEQ ID NO: 1609549 - RNA, 16 nt, Homo sapiens
gauggaccccagcauu

SEQ ID NO: 1609550 - RNA, 17 nt, Homo sapiens
gauggagcugauccagu

SEQ ID NO: 1609551 - RNA, 13 nt, Homo sapiens
gauggagcuuugu

SEQ ID NO: 1609552 - RNA, 14 nt, Homo sapiens
gauggagcuuugua

SEQ ID NO: 1609553 - RNA, 23 nt, Homo sapiens
gauggaggcgggaaaaucauuug

SEQ ID NO: 1609554 - RNA, 20 nt, Homo sapiens
gauggagucuugcucuguca

SEQ ID NO: 1609555 - RNA, 23 nt, Homo sapiens
gauggcauaggccuuagcaguaa

SEQ ID NO: 1609556 - RNA, 16 nt, Homo sapiens
gauggccccuccacug

SEQ ID NO: 1609557 - RNA, 21 nt, Homo sapiens
gauggccucucucaaaagaga

SEQ ID NO: 1609558 - RNA, 20 nt, Homo sapiens
gccaugcucaggagccacca

SEQ ID NO: 1609559 - RNA, 23 nt, Homo sapiens
gccauggaagguucucugugcuc

SEQ ID NO: 1609560 - RNA, 16 nt, Homo sapiens
gccauguccaaagagg

SEQ ID NO: 1609561 - RNA, 18 nt, Homo sapiens
gccauuaugcaaauggag

SEQ ID NO: 1609562 - RNA, 13 nt, Homo sapiens
gccauucaugucc

SEQ ID NO: 1609563 - RNA, 19 nt, Homo sapiens
gccauugaacaaaugugug

SEQ ID NO: 1609564 - RNA, 13 nt, Homo sapiens
gccauugucuuua

SEQ ID NO: 1609565 - RNA, 20 nt, Homo sapiens
gccauugugaaccaaugcaa

SEQ ID NO: 1609566 - RNA, 14 nt, Homo sapiens
gcccaaacccuuaa

SEQ ID NO: 1609567 - RNA, 15 nt, Homo sapiens
gcccaacagcacuuu

SEQ ID NO: 1609568 - RNA, 21 nt, Homo sapiens
gcccaagauuauucaauuuau

SEQ ID NO: 1609569 - RNA, 16 nt, Homo sapiens
gcccaaggccuacccc

SEQ ID NO: 1609570 - RNA, 18 nt, Homo sapiens
gcccaaucugcaaggaca

SEQ ID NO: 1609571 - RNA, 21 nt, Homo sapiens
gcccacccccacccccagugc

SEQ ID NO: 1609572 - RNA, 18 nt, Homo sapiens
gcccacggcucaagugaa

SEQ ID NO: 1609573 - RNA, 23 nt, Homo sapiens
gcccacucugcaagaagaaauca

SEQ ID NO: 1609574 - RNA, 18 nt, Homo sapiens
gcccacuucuucucagaa

SEQ ID NO: 1609575 - RNA, 16 nt, Homo sapiens
gcccagcuaaagcaau

SEQ ID NO: 1609576 - RNA, 18 nt, Homo sapiens
gcccaggacuguggagug

SEQ ID NO: 1609577 - RNA, 20 nt, Homo sapiens
gcccaggcuggacugcagug

SEQ ID NO: 1609578 - RNA, 19 nt, Homo sapiens
gcccagggcugcgucugca

SEQ ID NO: 1609579 - RNA, 15 nt, Homo sapiens
gcccagugcugccac

SEQ ID NO: 1609580 - RNA, 16 nt, Homo sapiens
gcccauucuucugggu

SEQ ID NO: 1609581 - RNA, 16 nt, Homo sapiens
gccccaccagugccuc

SEQ ID NO: 1609582 - RNA, 20 nt, Homo sapiens
gccccacuucacccccaacu

SEQ ID NO: 1609583 - RNA, 16 nt, Homo sapiens
gccccagccccuucca

SEQ ID NO: 1609584 - RNA, 19 nt, Homo sapiens
gccccagggaguccagggu

SEQ ID NO: 1609585 - RNA, 16 nt, Homo sapiens
gccccagucggcccca

SEQ ID NO: 1609586 - RNA, 13 nt, Homo sapiens
gccccauguaucu

SEQ ID NO: 1609587 - RNA, 21 nt, Homo sapiens
gcccccaauaaaccaguguga

SEQ ID NO: 1609588 - RNA, 23 nt, Homo sapiens
gcccccagccccuccucccucaa

SEQ ID NO: 1609589 - RNA, 17 nt, Homo sapiens
gccccccaucaccagag

SEQ ID NO: 1609590 - RNA, 16 nt, Homo sapiens
gcccccugccagugaa

SEQ ID NO: 1609591 - RNA, 17 nt, Homo sapiens
gcccccuggucaccgag

SEQ ID NO: 1609592 - RNA, 19 nt, Homo sapiens
gcccccuguggaugcugcu

SEQ ID NO: 1609593 - RNA, 23 nt, Homo sapiens
gccccgaaccucaccugaccuca

SEQ ID NO: 1609594 - RNA, 20 nt, Homo sapiens
gccccggcaagccacaggaa

SEQ ID NO: 1609595 - RNA, 17 nt, Homo sapiens
gccccgucucucuugga

SEQ ID NO: 1609596 - RNA, 18 nt, Homo sapiens
gccccuccacuggggaau

SEQ ID NO: 1609597 - RNA, 22 nt, Homo sapiens
gccccuccccagacucucaggu

SEQ ID NO: 1609598 - RNA, 16 nt, Homo sapiens
gccccuccucccucag

SEQ ID NO: 1609599 - RNA, 20 nt, Homo sapiens
gccccugaccccaugucucc

SEQ ID NO: 1609600 - RNA, 13 nt, Homo sapiens
gccccugcacucc

SEQ ID NO: 1609601 - RNA, 17 nt, Homo sapiens
gccccuuugccugucaa

SEQ ID NO: 1609602 - RNA, 21 nt, Homo sapiens
gcccgcagagcccaccuugag

SEQ ID NO: 1609603 - RNA, 18 nt, Homo sapiens
gcccggcgccgggcacca

SEQ ID NO: 1609604 - RNA, 23 nt, Homo sapiens
gcccgugagggugggggggaccg

SEQ ID NO: 1609605 - RNA, 15 nt, Homo sapiens
gcccuauauaccuca

SEQ ID NO: 1609606 - RNA, 17 nt, Homo sapiens
gcccucacaucuuccac

SEQ ID NO: 1609607 - RNA, 16 nt, Homo sapiens
gcccucagaacaaucc

SEQ ID NO: 1609608 - RNA, 21 nt, Homo sapiens
gcccuccagagauuugcucaa

SEQ ID NO: 1609609 - RNA, 22 nt, Homo sapiens
gcccucucccuguguucugggc

SEQ ID NO: 1609610 - RNA, 15 nt, Homo sapiens
gcccucucucugggc

SEQ ID NO: 1609611 - RNA, 23 nt, Homo sapiens
gcccucuggauccagccaugccu

SEQ ID NO: 1609612 - RNA, 20 nt, Homo sapiens
gcccugauguguccucaggg

SEQ ID NO: 1609613 - RNA, 21 nt, Homo sapiens
gcccugauguguccucaggga

SEQ ID NO: 1609614 - RNA, 18 nt, Homo sapiens
gcccugcagcccaccaga

SEQ ID NO: 1609615 - RNA, 15 nt, Homo sapiens
gcccugcccacagaa

SEQ ID NO: 1609616 - RNA, 17 nt, Homo sapiens
gcccugccccaccccau

SEQ ID NO: 1609617 - RNA, 15 nt, Homo sapiens
gcccugcucccugcc

SEQ ID NO: 1609618 - RNA, 18 nt, Homo sapiens
gcccuggcccaggugccc

SEQ ID NO: 1609619 - RNA, 17 nt, Homo sapiens
gcccugggcuggcacag

SEQ ID NO: 1609620 - RNA, 20 nt, Homo sapiens
gcccuucuauacccacccag

SEQ ID NO: 1609621 - RNA, 20 nt, Homo sapiens
gcccuugagugcuuguuaga

SEQ ID NO: 1609622 - RNA, 20 nt, Homo sapiens
gccgaauuugguacacaugu

SEQ ID NO: 1609623 - RNA, 18 nt, Homo sapiens
gccgcagggcacugaaag

SEQ ID NO: 1609624 - RNA, 17 nt, Homo sapiens
gccgccaguacuuguca

SEQ ID NO: 1609625 - RNA, 14 nt, Homo sapiens
gccgccaugagcaa

SEQ ID NO: 1609626 - RNA, 19 nt, Homo sapiens
gccgcccuccacaccucua

SEQ ID NO: 1609627 - RNA, 23 nt, Homo sapiens
gccgcugccaugcuuugagucca

SEQ ID NO: 1609628 - RNA, 23 nt, Homo sapiens
gccgguccuucccucucaugacu

SEQ ID NO: 1609629 - RNA, 12 nt, Homo sapiens
gccgugccuugu

SEQ ID NO: 1609630 - RNA, 20 nt, Homo sapiens
gccuaaaagugggcuugauu

SEQ ID NO: 1609631 - RNA, 21 nt, Homo sapiens
gccuaaaagugggcuugauuc

SEQ ID NO: 1609632 - RNA, 13 nt, Homo sapiens
gccuaaaguacag

SEQ ID NO: 1609633 - RNA, 15 nt, Homo sapiens
gccuaagaaacacuc

SEQ ID NO: 1609634 - RNA, 23 nt, Homo sapiens
gccuaauaguaacugguuaaaaa

SEQ ID NO: 1609635 - RNA, 17 nt, Homo sapiens
gccuacagaagggcagu

SEQ ID NO: 1609636 - RNA, 21 nt, Homo sapiens
gccuaccucuuagacauguug

SEQ ID NO: 1609637 - RNA, 22 nt, Homo sapiens
gccuagcgaucucuccuggccu

SEQ ID NO: 1609638 - RNA, 20 nt, Homo sapiens
gccuauagcagaagcacauu

SEQ ID NO: 1609639 - RNA, 23 nt, Homo sapiens
gccuauagcagaagcacauuuuc

SEQ ID NO: 1609640 - RNA, 18 nt, Homo sapiens
gccuauagucccacuacu

SEQ ID NO: 1609641 - RNA, 15 nt, Homo sapiens
gccuaucaaaggaaa

SEQ ID NO: 1609642 - RNA, 14 nt, Homo sapiens
gccuaucugaccaa

SEQ ID NO: 1609643 - RNA, 23 nt, Homo sapiens
gccuauguuugcggaaugcauug

SEQ ID NO: 1609644 - RNA, 22 nt, Homo sapiens
gccuauuaucugucagcugcaa

SEQ ID NO: 1609645 - RNA, 14 nt, Homo sapiens
gccucaaagcaagc

SEQ ID NO: 1609646 - RNA, 19 nt, Homo sapiens
gccucaccguccucaccca

SEQ ID NO: 1609647 - RNA, 20 nt, Homo sapiens
gccucaccuccucugugauu

SEQ ID NO: 1609648 - RNA, 12 nt, Homo sapiens
gccucacugggg

SEQ ID NO: 1609649 - RNA, 13 nt, Homo sapiens
gccucacuggggc

SEQ ID NO: 1609650 - RNA, 14 nt, Homo sapiens
gccucagaagugca

SEQ ID NO: 1609651 - RNA, 22 nt, Homo sapiens
gccucagagaucucccuucuca

SEQ ID NO: 1609652 - RNA, 12 nt, Homo sapiens
gccucagccagg

SEQ ID NO: 1609653 - RNA, 16 nt, Homo sapiens
gccuccaaacacagau

SEQ ID NO: 1609654 - RNA, 16 nt, Homo sapiens
gccuccaagcacagag

SEQ ID NO: 1609655 - RNA, 11 nt, Homo sapiens
gccuccagggc

SEQ ID NO: 1609656 - RNA, 23 nt, Homo sapiens
gccuccaucucauguaucaucug

SEQ ID NO: 1609657 - RNA, 17 nt, Homo sapiens
gccucccaaagugcugg

SEQ ID NO: 1609658 - RNA, 21 nt, Homo sapiens
gccucccccucagaugaucuc

SEQ ID NO: 1609659 - RNA, 17 nt, Homo sapiens
gccuccccgugccaaaa

SEQ ID NO: 1609660 - RNA, 20 nt, Homo sapiens
gccucccggguucacgccau

SEQ ID NO: 1609661 - RNA, 17 nt, Homo sapiens
gccucccuugacuuugc

SEQ ID NO: 1609662 - RNA, 14 nt, Homo sapiens
gccucccuuucaua

SEQ ID NO: 1609663 - RNA, 13 nt, Homo sapiens
gccuccugugguc

SEQ ID NO: 1609664 - RNA, 16 nt, Homo sapiens
gccucgaaacacagaa

SEQ ID NO: 1609665 - RNA, 17 nt, Homo sapiens
gccucgcggucuugggc

SEQ ID NO: 1609666 - RNA, 17 nt, Homo sapiens
gccucgugccaugaucu

SEQ ID NO: 1609667 - RNA, 22 nt, Homo sapiens
gccucuccuguauuuaacaaaa

SEQ ID NO: 1609668 - RNA, 15 nt, Homo sapiens
gccucuccuuggaag

SEQ ID NO: 1609669 - RNA, 22 nt, Homo sapiens
gccucucuuucacacaaugccc

SEQ ID NO: 1609670 - RNA, 16 nt, Homo sapiens
gccucuggacagccag

SEQ ID NO: 1609671 - RNA, 16 nt, Homo sapiens
gccucugguugccucc

SEQ ID NO: 1609672 - RNA, 18 nt, Homo sapiens
gccucugugccauggaug

SEQ ID NO: 1609673 - RNA, 13 nt, Homo sapiens
gccucuuggcagu

SEQ ID NO: 1609674 - RNA, 21 nt, Homo sapiens
gccugaaacccgcccucaggg

SEQ ID NO: 1609675 - RNA, 18 nt, Homo sapiens
ggagccccgccacagccu

SEQ ID NO: 1609676 - RNA, 14 nt, Homo sapiens
ggagccugcaacau

SEQ ID NO: 1609677 - RNA, 17 nt, Homo sapiens
ggagcucaggucccagg

SEQ ID NO: 1609678 - RNA, 23 nt, Homo sapiens
ggagcucuucaggccucccucuc

SEQ ID NO: 1609679 - RNA, 13 nt, Homo sapiens
ggagcugcugagu

SEQ ID NO: 1609680 - RNA, 14 nt, Homo sapiens
ggagcuuuguaaug

SEQ ID NO: 1609681 - RNA, 18 nt, Homo sapiens
ggaggaagcuacccaagg

SEQ ID NO: 1609682 - RNA, 21 nt, Homo sapiens
ggaggacccuggaaauggacu

SEQ ID NO: 1609683 - RNA, 19 nt, Homo sapiens
ggaggacggugcaacccaa

SEQ ID NO: 1609684 - RNA, 20 nt, Homo sapiens
ggaggcagagguugcaguga

SEQ ID NO: 1609685 - RNA, 19 nt, Homo sapiens
ggaggccaagaacuugcaa

SEQ ID NO: 1609686 - RNA, 18 nt, Homo sapiens
ggaggcggugguagagag

SEQ ID NO: 1609687 - RNA, 21 nt, Homo sapiens
ggaggcuccagagggcacucu

SEQ ID NO: 1609688 - RNA, 18 nt, Homo sapiens
ggaggcuggggccccauc

SEQ ID NO: 1609689 - RNA, 14 nt, Homo sapiens
ggaggcuucagaag

SEQ ID NO: 1609690 - RNA, 12 nt, Homo sapiens
ggaggggaccaa

SEQ ID NO: 1609691 - RNA, 19 nt, Homo sapiens
ggagguaucuagcaaugga

SEQ ID NO: 1609692 - RNA, 15 nt, Homo sapiens
ggaggugcgcagugg

SEQ ID NO: 1609693 - RNA, 14 nt, Homo sapiens
ggagguugcaguga

SEQ ID NO: 1609694 - RNA, 16 nt, Homo sapiens
ggagguuguugcagug

SEQ ID NO: 1609695 - RNA, 17 nt, Homo sapiens
ggaguaaaacuguauaa

SEQ ID NO: 1609696 - RNA, 13 nt, Homo sapiens
ggaguaaaauuca

SEQ ID NO: 1609697 - RNA, 18 nt, Homo sapiens
ggaguagaaaaaucucau

SEQ ID NO: 1609698 - RNA, 18 nt, Homo sapiens
ggaguccagcacaaccuu

SEQ ID NO: 1609699 - RNA, 22 nt, Homo sapiens
ggaguccaggcccccagccccu

SEQ ID NO: 1609700 - RNA, 21 nt, Homo sapiens
ggagucccaaaugucaucagg

SEQ ID NO: 1609701 - RNA, 18 nt, Homo sapiens
ggagucugccacuuguca

SEQ ID NO: 1609702 - RNA, 22 nt, Homo sapiens
ggagucuuagagcuuuaccuaa

SEQ ID NO: 1609703 - RNA, 17 nt, Homo sapiens
ggagucuuguguucacc

SEQ ID NO: 1609704 - RNA, 14 nt, Homo sapiens
ggagugauucccaa

SEQ ID NO: 1609705 - RNA, 17 nt, Homo sapiens
ggagugcaguggcacaa

SEQ ID NO: 1609706 - RNA, 16 nt, Homo sapiens
ggaguucagauguuuu

SEQ ID NO: 1609707 - RNA, 18 nt, Homo sapiens
ggaguuugggcuggagcu

SEQ ID NO: 1609708 - RNA, 19 nt, Homo sapiens
ggauaaaucauaaagucag

SEQ ID NO: 1609709 - RNA, 22 nt, Homo sapiens
ggauaauaaagauacuagagaa

SEQ ID NO: 1609710 - RNA, 19 nt, Homo sapiens
ggauauaaaaauaauguca

SEQ ID NO: 1609711 - RNA, 19 nt, Homo sapiens
ggauauaagagggcuuuuu

SEQ ID NO: 1609712 - RNA, 21 nt, Homo sapiens
ggauauauuugaaauaguaua

SEQ ID NO: 1609713 - RNA, 21 nt, Homo sapiens
ggauauuuaggguacuauuca

SEQ ID NO: 1609714 - RNA, 16 nt, Homo sapiens
ggaucagaagauaucu

SEQ ID NO: 1609715 - RNA, 16 nt, Homo sapiens
ggauccagagagcagc

SEQ ID NO: 1609716 - RNA, 12 nt, Homo sapiens
ggauccagcacu

SEQ ID NO: 1609717 - RNA, 23 nt, Homo sapiens
ggauccuguaggcuaaaaggcuu

SEQ ID NO: 1609718 - RNA, 14 nt, Homo sapiens
ggaucgaugugcuc

SEQ ID NO: 1609719 - RNA, 17 nt, Homo sapiens
ggaucucuuaagacagc

SEQ ID NO: 1609720 - RNA, 12 nt, Homo sapiens
ggaucugaggga

SEQ ID NO: 1609721 - RNA, 13 nt, Homo sapiens
ggaucuucccaca

SEQ ID NO: 1609722 - RNA, 23 nt, Homo sapiens
ggaucuucccacaggagggccag

SEQ ID NO: 1609723 - RNA, 19 nt, Homo sapiens
ggaugagcaugcuguuuau

SEQ ID NO: 1609724 - RNA, 22 nt, Homo sapiens
ggaugagcaugcuguuuaugaa

SEQ ID NO: 1609725 - RNA, 22 nt, Homo sapiens
ggaugauuauuuucuguucuau

SEQ ID NO: 1609726 - RNA, 19 nt, Homo sapiens
ggaugccacagcccagcuu

SEQ ID NO: 1609727 - RNA, 12 nt, Homo sapiens
ggaugccaguug

SEQ ID NO: 1609728 - RNA, 18 nt, Homo sapiens
ggauggggcuucacugcu

SEQ ID NO: 1609729 - RNA, 20 nt, Homo sapiens
ggauggggcuucacugcugu

SEQ ID NO: 1609730 - RNA, 15 nt, Homo sapiens
ggauggugugccuuc

SEQ ID NO: 1609731 - RNA, 14 nt, Homo sapiens
ggauguaagccugg

SEQ ID NO: 1609732 - RNA, 18 nt, Homo sapiens
ggauguaagccuggagcu

SEQ ID NO: 1609733 - RNA, 14 nt, Homo sapiens
ggaugucuguagca

SEQ ID NO: 1609734 - RNA, 11 nt, Homo sapiens
ggaugugauga

SEQ ID NO: 1609735 - RNA, 19 nt, Homo sapiens
ggauguugcuuuugcaccu

SEQ ID NO: 1609736 - RNA, 17 nt, Homo sapiens
ggauuacaguguagcua

SEQ ID NO: 1609737 - RNA, 19 nt, Homo sapiens
ggauucacuucuauuuauu

SEQ ID NO: 1609738 - RNA, 18 nt, Homo sapiens
ggauucuguucugcaacu

SEQ ID NO: 1609739 - RNA, 23 nt, Homo sapiens
ggauuuaauacguacuuuagcug

SEQ ID NO: 1609740 - RNA, 15 nt, Homo sapiens
ggauuuucacauucu

SEQ ID NO: 1609741 - RNA, 21 nt, Homo sapiens
ggauuuucuuuuuaacuuuac

SEQ ID NO: 1609742 - RNA, 14 nt, Homo sapiens
ggauuuuucuuuaa

SEQ ID NO: 1609743 - RNA, 18 nt, Homo sapiens
ggcaaaacaaaaguacau

SEQ ID NO: 1609744 - RNA, 16 nt, Homo sapiens
ggcaaacccuggugcu

SEQ ID NO: 1609745 - RNA, 18 nt, Homo sapiens
ggcaaacuuuucuuucuu

SEQ ID NO: 1609746 - RNA, 20 nt, Homo sapiens
ggcaaagaacucauuugaau

SEQ ID NO: 1609747 - RNA, 13 nt, Homo sapiens
ggcaaagguuuau

SEQ ID NO: 1609748 - RNA, 13 nt, Homo sapiens
ggcaaaugaauuu

SEQ ID NO: 1609749 - RNA, 17 nt, Homo sapiens
ggcaagagaauugaaau

SEQ ID NO: 1609750 - RNA, 21 nt, Homo sapiens
ggcaagccugucuucagagaa

SEQ ID NO: 1609751 - RNA, 20 nt, Homo sapiens
ggcaaggagaagagcaaagu

SEQ ID NO: 1609752 - RNA, 19 nt, Homo sapiens
ggcaagugugggggguccu

SEQ ID NO: 1609753 - RNA, 20 nt, Homo sapiens
ggcaaucaugagcaagugaa

SEQ ID NO: 1609754 - RNA, 16 nt, Homo sapiens
ggcaauccaaguacau

SEQ ID NO: 1609755 - RNA, 16 nt, Homo sapiens
ggcaaucucagaugca

SEQ ID NO: 1609756 - RNA, 19 nt, Homo sapiens
ggcaaucucagaugcaguu

SEQ ID NO: 1609757 - RNA, 18 nt, Homo sapiens
ggcaaugaaaauuuuaag

SEQ ID NO: 1609758 - RNA, 19 nt, Homo sapiens
ggcaauuauuccccuaggc

SEQ ID NO: 1609759 - RNA, 13 nt, Homo sapiens
ggcacacacugug

SEQ ID NO: 1609760 - RNA, 17 nt, Homo sapiens
ggcacaguccagaccca

SEQ ID NO: 1609761 - RNA, 23 nt, Homo sapiens
ggcacauguauacauauguagcu

SEQ ID NO: 1609762 - RNA, 9 nt, Homo sapiens
ggcacauug

SEQ ID NO: 1609763 - RNA, 15 nt, Homo sapiens
ggcacccccaugcug

SEQ ID NO: 1609764 - RNA, 20 nt, Homo sapiens
ggcaccuuccgacaucccag

SEQ ID NO: 1609765 - RNA, 22 nt, Homo sapiens
ggcacucagaaguugugcuaaa

SEQ ID NO: 1609766 - RNA, 23 nt, Homo sapiens
ggcacucagaaguugugcuaaac

SEQ ID NO: 1609767 - RNA, 18 nt, Homo sapiens
ggcacucagggagcauuu

SEQ ID NO: 1609768 - RNA, 16 nt, Homo sapiens
ggcacugcacccuguu

SEQ ID NO: 1609769 - RNA, 17 nt, Homo sapiens
ggcacuuuuauuuucau

SEQ ID NO: 1609770 - RNA, 18 nt, Homo sapiens
ggcacuuuugaugaaaua

SEQ ID NO: 1609771 - RNA, 17 nt, Homo sapiens
ggcagaaagcuguggga

SEQ ID NO: 1609772 - RNA, 17 nt, Homo sapiens
ggcagacucgggaccaa

SEQ ID NO: 1609773 - RNA, 13 nt, Homo sapiens
ggcagagccagug

SEQ ID NO: 1609774 - RNA, 16 nt, Homo sapiens
ggcagagccagugugc

SEQ ID NO: 1609775 - RNA, 17 nt, Homo sapiens
ggcagauuuucaugcaa

SEQ ID NO: 1609776 - RNA, 11 nt, Homo sapiens
ggcagcauuuu

SEQ ID NO: 1609777 - RNA, 16 nt, Homo sapiens
ggcagccauagugcau

SEQ ID NO: 1609778 - RNA, 19 nt, Homo sapiens
ggcagcccaacagcacuuu

SEQ ID NO: 1609779 - RNA, 13 nt, Homo sapiens
ggcagccuuuacg

SEQ ID NO: 1609780 - RNA, 16 nt, Homo sapiens
ggcagcuagugccuuu

SEQ ID NO: 1609781 - RNA, 19 nt, Homo sapiens
ggcagcugauccaggcaau

SEQ ID NO: 1609782 - RNA, 22 nt, Homo sapiens
ggcagcugcuauccccaucucc

SEQ ID NO: 1609783 - RNA, 17 nt, Homo sapiens
ggcaggaccuguggcca

SEQ ID NO: 1609784 - RNA, 18 nt, Homo sapiens
ggcaggagaaucacuuga

SEQ ID NO: 1609785 - RNA, 21 nt, Homo sapiens
ggcagggcugaggccucucau

SEQ ID NO: 1609786 - RNA, 21 nt, Homo sapiens
ggcaggggugcuuccuccuca

SEQ ID NO: 1609787 - RNA, 24 nt, Homo sapiens
ggcaggugaaaaggguacagaugu

SEQ ID NO: 1609788 - RNA, 11 nt, Homo sapiens
ggcaguacugu

SEQ ID NO: 1609789 - RNA, 16 nt, Homo sapiens
ggcaguccaggccucu

SEQ ID NO: 1609790 - RNA, 20 nt, Homo sapiens
ggcagucugagagaggccau

SEQ ID NO: 1609791 - RNA, 13 nt, Homo sapiens
ggcagucugcucu

SEQ ID NO: 1609792 - RNA, 21 nt, Homo sapiens
ggcagugagaaggcaaccaaa

SEQ ID NO: 1609793 - RNA, 13 nt, Homo sapiens
uacuguagccuca

SEQ ID NO: 1609794 - RNA, 20 nt, Homo sapiens
uacuguuugauauaccaaau

SEQ ID NO: 1609795 - RNA, 21 nt, Homo sapiens
uacuuaaaaaauccugcccaa

SEQ ID NO: 1609796 - RNA, 15 nt, Homo sapiens
uacuuaauuuacuua

SEQ ID NO: 1609797 - RNA, 14 nt, Homo sapiens
uacuuacacuguau

SEQ ID NO: 1609798 - RNA, 16 nt, Homo sapiens
uacuuaccauuugcua

SEQ ID NO: 1609799 - RNA, 20 nt, Homo sapiens
uacuuaugaaaagaauuuga

SEQ ID NO: 1609800 - RNA, 14 nt, Homo sapiens
uacuuaugaugaug

SEQ ID NO: 1609801 - RNA, 19 nt, Homo sapiens
uacuuaugaugaugaaggg

SEQ ID NO: 1609802 - RNA, 15 nt, Homo sapiens
uacuuauguugcaca

SEQ ID NO: 1609803 - RNA, 17 nt, Homo sapiens
uacuuauuaaucuguau

SEQ ID NO: 1609804 - RNA, 16 nt, Homo sapiens
uacuucaagaucugaa

SEQ ID NO: 1609805 - RNA, 20 nt, Homo sapiens
uacuucaguauuaaauuaga

SEQ ID NO: 1609806 - RNA, 22 nt, Homo sapiens
uacuucuacauccaauguauga

SEQ ID NO: 1609807 - RNA, 20 nt, Homo sapiens
uacuucuggaagucaucuca

SEQ ID NO: 1609808 - RNA, 16 nt, Homo sapiens
uacuucuuuuucauua

SEQ ID NO: 1609809 - RNA, 21 nt, Homo sapiens
uacuugaaacagucacuauca

SEQ ID NO: 1609810 - RNA, 14 nt, Homo sapiens
uacuugucauauca

SEQ ID NO: 1609811 - RNA, 21 nt, Homo sapiens
uacuugucauaucacuaaaua

SEQ ID NO: 1609812 - RNA, 16 nt, Homo sapiens
uacuuuacaaaccauu

SEQ ID NO: 1609813 - RNA, 16 nt, Homo sapiens
uacuuuaucaaugugu

SEQ ID NO: 1609814 - RNA, 16 nt, Homo sapiens
uacuuucuaugugaca

SEQ ID NO: 1609815 - RNA, 22 nt, Homo sapiens
uacuuucuguguugaagcacug

SEQ ID NO: 1609816 - RNA, 17 nt, Homo sapiens
uacuuugacuuuuugca

SEQ ID NO: 1609817 - RNA, 22 nt, Homo sapiens
uacuuugcaauccaaauaaaga

SEQ ID NO: 1609818 - RNA, 18 nt, Homo sapiens
uacuuuuaaacuguguac

SEQ ID NO: 1609819 - RNA, 14 nt, Homo sapiens
uacuuuucugccaa

SEQ ID NO: 1609820 - RNA, 21 nt, Homo sapiens
uacuuuugcccuuugauuaaa

SEQ ID NO: 1609821 - RNA, 21 nt, Homo sapiens
uagaaaaauauuauaacucau

SEQ ID NO: 1609822 - RNA, 21 nt, Homo sapiens
uagaaaaggcagcuaaaggaa

SEQ ID NO: 1609823 - RNA, 16 nt, Homo sapiens
uagaaaagggaacuga

SEQ ID NO: 1609824 - RNA, 15 nt, Homo sapiens
uagaaaagugaauug

SEQ ID NO: 1609825 - RNA, 13 nt, Homo sapiens
uagaaaaugagga

SEQ ID NO: 1609826 - RNA, 22 nt, Homo sapiens
uagaaaaugaggaaaugccaca

SEQ ID NO: 1609827 - RNA, 14 nt, Homo sapiens
uagaaaauucauaa

SEQ ID NO: 1609828 - RNA, 17 nt, Homo sapiens
uagaaagagaaacaguu

SEQ ID NO: 1609829 - RNA, 22 nt, Homo sapiens
uagaaagugaggcucagauuaa

SEQ ID NO: 1609830 - RNA, 18 nt, Homo sapiens
uagaaauucagcauuuga

SEQ ID NO: 1609831 - RNA, 13 nt, Homo sapiens
uagaaauugaaca

SEQ ID NO: 1609832 - RNA, 22 nt, Homo sapiens
uagaacaguggaaacuaugugu

SEQ ID NO: 1609833 - RNA, 23 nt, Homo sapiens
uagaacauucacuuuuguuaaca

SEQ ID NO: 1609834 - RNA, 11 nt, Homo sapiens
uagaaccagcc

SEQ ID NO: 1609835 - RNA, 18 nt, Homo sapiens
uagaacuagccaaaccag

SEQ ID NO: 1609836 - RNA, 19 nt, Homo sapiens
uagaacuaucauuuuuaca

SEQ ID NO: 1609837 - RNA, 16 nt, Homo sapiens
uagaacugucugugaa

SEQ ID NO: 1609838 - RNA, 18 nt, Homo sapiens
uagaacugucugugaaca

SEQ ID NO: 1609839 - RNA, 19 nt, Homo sapiens
uagaagaaccaaauaccuc

SEQ ID NO: 1609840 - RNA, 22 nt, Homo sapiens
uagaagcaacuaggaaaaucac

SEQ ID NO: 1609841 - RNA, 22 nt, Homo sapiens
uagaagcuaauaaauaaucauc

SEQ ID NO: 1609842 - RNA, 22 nt, Homo sapiens
uagaagcuucagcaggaggcaa

SEQ ID NO: 1609843 - RNA, 23 nt, Homo sapiens
uagaaggacucaguauuauuuca

SEQ ID NO: 1609844 - RNA, 24 nt, Homo sapiens
uagaaggauggcaucuccauguag

SEQ ID NO: 1609845 - RNA, 12 nt, Homo sapiens
uagaagggcaaa

SEQ ID NO: 1609846 - RNA, 22 nt, Homo sapiens
uagaagggccaguccugccugg

SEQ ID NO: 1609847 - RNA, 20 nt, Homo sapiens
uagaagggcuagaaccugga

SEQ ID NO: 1609848 - RNA, 15 nt, Homo sapiens
uagaauaaaugaaga

SEQ ID NO: 1609849 - RNA, 16 nt, Homo sapiens
uagaauaaauucccaa

SEQ ID NO: 1609850 - RNA, 19 nt, Homo sapiens
uagaauaggcagggggccc

SEQ ID NO: 1609851 - RNA, 13 nt, Homo sapiens
uagaaucaauuua

SEQ ID NO: 1609852 - RNA, 14 nt, Homo sapiens
uagaaucagaauaa

SEQ ID NO: 1609853 - RNA, 18 nt, Homo sapiens
uagaauuauaacuguaaa

SEQ ID NO: 1609854 - RNA, 22 nt, Homo sapiens
uagacaaaggccuuaacaaacg

SEQ ID NO: 1609855 - RNA, 13 nt, Homo sapiens
uagacaaccagag

SEQ ID NO: 1609856 - RNA, 21 nt, Homo sapiens
uagacagugcccuuggugcga

SEQ ID NO: 1609857 - RNA, 14 nt, Homo sapiens
uagaccaccuaaua

SEQ ID NO: 1609858 - RNA, 18 nt, Homo sapiens
uagaccaccuaauaucaa

SEQ ID NO: 1609859 - RNA, 18 nt, Homo sapiens
uagaccugccagccacug

SEQ ID NO: 1609860 - RNA, 20 nt, Homo sapiens
uagacucaugguguguuaca

SEQ ID NO: 1609861 - RNA, 12 nt, Homo sapiens
uagacugauuac

SEQ ID NO: 1609862 - RNA, 21 nt, Homo sapiens
uagacuguuucacauugcacu

SEQ ID NO: 1609863 - RNA, 17 nt, Homo sapiens
uagacuuacugcaguua

SEQ ID NO: 1609864 - RNA, 20 nt, Homo sapiens
uagagaaggcugugagccaa

SEQ ID NO: 1609865 - RNA, 13 nt, Homo sapiens
uagagauacagua

SEQ ID NO: 1609866 - RNA, 13 nt, Homo sapiens
uagagaugauuca

SEQ ID NO: 1609867 - RNA, 17 nt, Homo sapiens
uagagaugauucagagg

SEQ ID NO: 1609868 - RNA, 21 nt, Homo sapiens
uagagaugauucagaggucac

SEQ ID NO: 1609869 - RNA, 16 nt, Homo sapiens
uagagcuuagcauauc

SEQ ID NO: 1609870 - RNA, 21 nt, Homo sapiens
uagaguaacacauaacauugu

SEQ ID NO: 1609871 - RNA, 19 nt, Homo sapiens
uagagucggccaccacaga

SEQ ID NO: 1609872 - RNA, 17 nt, Homo sapiens
uagagugauuuugaaau

SEQ ID NO: 1609873 - RNA, 21 nt, Homo sapiens
uagaguguuuuaaaacauuca

SEQ ID NO: 1609874 - RNA, 22 nt, Homo sapiens
uagauaauaugaaaaucuccau

SEQ ID NO: 1609875 - RNA, 16 nt, Homo sapiens
uagauaaucuugugca

SEQ ID NO: 1609876 - RNA, 17 nt, Homo sapiens
uagauauguuaagcaug

SEQ ID NO: 1609877 - RNA, 13 nt, Homo sapiens
uagauauugcuac

SEQ ID NO: 1609878 - RNA, 18 nt, Homo sapiens
uagauauugcuacuauaa

SEQ ID NO: 1609879 - RNA, 16 nt, Homo sapiens
uagaucugaacuccuu

SEQ ID NO: 1609880 - RNA, 22 nt, Homo sapiens
uagaugacaaccuccauucuau

SEQ ID NO: 1609881 - RNA, 11 nt, Homo sapiens
uagaugccaaa

SEQ ID NO: 1609882 - RNA, 13 nt, Homo sapiens
uagauuacugaug

SEQ ID NO: 1609883 - RNA, 18 nt, Homo sapiens
uagauuacugaugugaua

SEQ ID NO: 1609884 - RNA, 23 nt, Homo sapiens
uagauugcagaaaauucugugcc

SEQ ID NO: 1609885 - RNA, 13 nt, Homo sapiens
uagauuucuccuc

SEQ ID NO: 1609886 - RNA, 19 nt, Homo sapiens
uagauuuucuuuugccuuu

SEQ ID NO: 1609887 - RNA, 20 nt, Homo sapiens
uagauuuuguuauguucaau

SEQ ID NO: 1609888 - RNA, 18 nt, Homo sapiens
uagcaaaaauguuuucca

SEQ ID NO: 1609889 - RNA, 19 nt, Homo sapiens
uagcaaaaauguuuuccaa

SEQ ID NO: 1609890 - RNA, 13 nt, Homo sapiens
uagcaaaagaaga

SEQ ID NO: 1609891 - RNA, 15 nt, Homo sapiens
uagcaaacuuuucac

SEQ ID NO: 1609892 - RNA, 19 nt, Homo sapiens
uagcaaagaagcuucaugc

SEQ ID NO: 1609893 - RNA, 23 nt, Homo sapiens
uagcaaagauuaaaugugucauu

SEQ ID NO: 1609894 - RNA, 22 nt, Homo sapiens
uagcaaugugccuugauugauu

SEQ ID NO: 1609895 - RNA, 23 nt, Homo sapiens
uagcaccgcuuauccccucagaa

SEQ ID NO: 1609896 - RNA, 18 nt, Homo sapiens
uagcagaaugugcuucuc

SEQ ID NO: 1609897 - RNA, 18 nt, Homo sapiens
uagcagacauuguuacaa

SEQ ID NO: 1609898 - RNA, 19 nt, Homo sapiens
uagcagaguuaaaucucaa

SEQ ID NO: 1609899 - RNA, 19 nt, Homo sapiens
uagcagggauucucucauc

SEQ ID NO: 1609900 - RNA, 13 nt, Homo sapiens
uagcauacgguau

SEQ ID NO: 1609901 - RNA, 19 nt, Homo sapiens
uagcaucagaccugcauug

SEQ ID NO: 1609902 - RNA, 20 nt, Homo sapiens
uagccaaaccaggacccugu

SEQ ID NO: 1609903 - RNA, 21 nt, Homo sapiens
uagccaaggauagaagcugca

SEQ ID NO: 1609904 - RNA, 16 nt, Homo sapiens
uagccaucuaaugcuu

SEQ ID NO: 1609905 - RNA, 16 nt, Homo sapiens
uagccaugcuuuaugu

SEQ ID NO: 1609906 - RNA, 20 nt, Homo sapiens
uagccauuuuucaaagcaau

SEQ ID NO: 1609907 - RNA, 22 nt, Homo sapiens
uagccauuuuucaaagcaauug

SEQ ID NO: 1609908 - RNA, 14 nt, Homo sapiens
uagcccauguuaag

SEQ ID NO: 1609909 - RNA, 18 nt, Homo sapiens
uagccgauaucagaauuu

SEQ ID NO: 1609910 - RNA, 16 nt, Homo sapiens
ucacaugaugcacuuc

SEQ ID NO: 1609911 - RNA, 17 nt, Homo sapiens
ucacaugucaguaccuu

SEQ ID NO: 1609912 - RNA, 22 nt, Homo sapiens
ucacauguccuauuacugaugu

SEQ ID NO: 1609913 - RNA, 16 nt, Homo sapiens
ucacauguuuaacuuu

SEQ ID NO: 1609914 - RNA, 19 nt, Homo sapiens
ucacauuuagaaaagugaa

SEQ ID NO: 1609915 - RNA, 13 nt, Homo sapiens
ucacauuuucuca

SEQ ID NO: 1609916 - RNA, 23 nt, Homo sapiens
ucaccaagcucaacggcuccauc

SEQ ID NO: 1609917 - RNA, 13 nt, Homo sapiens
ucaccagcugcaa

SEQ ID NO: 1609918 - RNA, 13 nt, Homo sapiens
ucaccagucccau

SEQ ID NO: 1609919 - RNA, 16 nt, Homo sapiens
ucaccauugcugucaa

SEQ ID NO: 1609920 - RNA, 23 nt, Homo sapiens
ucaccauuucuuggcauuggaau

SEQ ID NO: 1609921 - RNA, 21 nt, Homo sapiens
ucaccucaaccuccgccuccc

SEQ ID NO: 1609922 - RNA, 17 nt, Homo sapiens
ucaccuccucugugauu

SEQ ID NO: 1609923 - RNA, 16 nt, Homo sapiens
ucaccucucagcugcu

SEQ ID NO: 1609924 - RNA, 23 nt, Homo sapiens
ucaccucucagcugcuggaugac

SEQ ID NO: 1609925 - RNA, 15 nt, Homo sapiens
ucaccuuagugcaac

SEQ ID NO: 1609926 - RNA, 15 nt, Homo sapiens
ucaccuuggacggaa

SEQ ID NO: 1609927 - RNA, 17 nt, Homo sapiens
ucaccuuuucuguggcu

SEQ ID NO: 1609928 - RNA, 20 nt, Homo sapiens
ucaccuuuuuuuaaguagua

SEQ ID NO: 1609929 - RNA, 19 nt, Homo sapiens
ucacgccuguaaucccagc

SEQ ID NO: 1609930 - RNA, 18 nt, Homo sapiens
ucacggaccacucgaggc

SEQ ID NO: 1609931 - RNA, 20 nt, Homo sapiens
ucacgucacguuggucuuga

SEQ ID NO: 1609932 - RNA, 14 nt, Homo sapiens
ucacuaaugcucaa

SEQ ID NO: 1609933 - RNA, 13 nt, Homo sapiens
ucacuagucucac

SEQ ID NO: 1609934 - RNA, 15 nt, Homo sapiens
ucacucaauuucucu

SEQ ID NO: 1609935 - RNA, 17 nt, Homo sapiens
ucacucaccuagacaac

SEQ ID NO: 1609936 - RNA, 15 nt, Homo sapiens
ucacucacucauucc

SEQ ID NO: 1609937 - RNA, 13 nt, Homo sapiens
ucacucacucuga

SEQ ID NO: 1609938 - RNA, 14 nt, Homo sapiens
ucacucccagucca

SEQ ID NO: 1609939 - RNA, 11 nt, Homo sapiens
ucacucuguca

SEQ ID NO: 1609940 - RNA, 15 nt, Homo sapiens
ucacucuucaaggag

SEQ ID NO: 1609941 - RNA, 23 nt, Homo sapiens
ucacugaugggaaaacugccaau

SEQ ID NO: 1609942 - RNA, 15 nt, Homo sapiens
ucacugcagccucag

SEQ ID NO: 1609943 - RNA, 18 nt, Homo sapiens
ucacugcauccucugccu

SEQ ID NO: 1609944 - RNA, 13 nt, Homo sapiens
ucacugcauuugc

SEQ ID NO: 1609945 - RNA, 15 nt, Homo sapiens
ucacugcauuugccu

SEQ ID NO: 1609946 - RNA, 21 nt, Homo sapiens
ucacugcugcaaauacuguau

SEQ ID NO: 1609947 - RNA, 14 nt, Homo sapiens
ucacuggaaauuga

SEQ ID NO: 1609948 - RNA, 22 nt, Homo sapiens
ucacuggaugucaaacaguaau

SEQ ID NO: 1609949 - RNA, 18 nt, Homo sapiens
ucacuggggcaugagauu

SEQ ID NO: 1609950 - RNA, 17 nt, Homo sapiens
ucacugguccaccuccu

SEQ ID NO: 1609951 - RNA, 16 nt, Homo sapiens
ucacugucaucuucaa

SEQ ID NO: 1609952 - RNA, 22 nt, Homo sapiens
ucacugucuuuaauucuguauc

SEQ ID NO: 1609953 - RNA, 21 nt, Homo sapiens
ucacugugauguauauugugu

SEQ ID NO: 1609954 - RNA, 21 nt, Homo sapiens
ucacuuaaacuuugucacuuc

SEQ ID NO: 1609955 - RNA, 15 nt, Homo sapiens
ucacuuaagccugga

SEQ ID NO: 1609956 - RNA, 15 nt, Homo sapiens
ucacuuaauaaucaa

SEQ ID NO: 1609957 - RNA, 21 nt, Homo sapiens
ucacuuaauaaucaaccuggg

SEQ ID NO: 1609958 - RNA, 15 nt, Homo sapiens
ucacuucauagcuca

SEQ ID NO: 1609959 - RNA, 16 nt, Homo sapiens
ucacuucuaaaccaaa

SEQ ID NO: 1609960 - RNA, 18 nt, Homo sapiens
ucacuucucacaaugucc

SEQ ID NO: 1609961 - RNA, 13 nt, Homo sapiens
ucacuucucuuaa

SEQ ID NO: 1609962 - RNA, 15 nt, Homo sapiens
ucacuucugcuguac

SEQ ID NO: 1609963 - RNA, 17 nt, Homo sapiens
ucacuucugcuguacag

SEQ ID NO: 1609964 - RNA, 13 nt, Homo sapiens
ucacuugcucaaa

SEQ ID NO: 1609965 - RNA, 14 nt, Homo sapiens
ucacuuugccauua

SEQ ID NO: 1609966 - RNA, 15 nt, Homo sapiens
ucacuuuuauugaua

SEQ ID NO: 1609967 - RNA, 13 nt, Homo sapiens
ucagaaaacaggg

SEQ ID NO: 1609968 - RNA, 18 nt, Homo sapiens
ucagaaaagaagugaagu

SEQ ID NO: 1609969 - RNA, 22 nt, Homo sapiens
ucagaacuucugccucuaagcu

SEQ ID NO: 1609970 - RNA, 21 nt, Homo sapiens
ucagaagagguugggcuucca

SEQ ID NO: 1609971 - RNA, 13 nt, Homo sapiens
ucagaagauaucu

SEQ ID NO: 1609972 - RNA, 17 nt, Homo sapiens
ucagaauuuguguugaa

SEQ ID NO: 1609973 - RNA, 16 nt, Homo sapiens
ucagacaaauuacuga

SEQ ID NO: 1609974 - RNA, 14 nt, Homo sapiens
ucagacagcuugaa

SEQ ID NO: 1609975 - RNA, 15 nt, Homo sapiens
ucagacccaacagca

SEQ ID NO: 1609976 - RNA, 19 nt, Homo sapiens
ucagaccugcauugaacag

SEQ ID NO: 1609977 - RNA, 23 nt, Homo sapiens
ucagacgggcugagaggaugaac

SEQ ID NO: 1609978 - RNA, 20 nt, Homo sapiens
ucagacucuuggcuacagug

SEQ ID NO: 1609979 - RNA, 19 nt, Homo sapiens
ucagacuugucaagccugu

SEQ ID NO: 1609980 - RNA, 22 nt, Homo sapiens
ucagacuuuguguucauuucau

SEQ ID NO: 1609981 - RNA, 19 nt, Homo sapiens
ucagagaaaggacugugga

SEQ ID NO: 1609982 - RNA, 15 nt, Homo sapiens
ucagagaacuuuccc

SEQ ID NO: 1609983 - RNA, 14 nt, Homo sapiens
ucagagcugggaaa

SEQ ID NO: 1609984 - RNA, 18 nt, Homo sapiens
ucagaggccugcugccag

SEQ ID NO: 1609985 - RNA, 23 nt, Homo sapiens
ucagaggccugcugccagugcag

SEQ ID NO: 1609986 - RNA, 13 nt, Homo sapiens
ucagagguccagg

SEQ ID NO: 1609987 - RNA, 14 nt, Homo sapiens
ucagagguccaggc

SEQ ID NO: 1609988 - RNA, 16 nt, Homo sapiens
ucagagugacagucau

SEQ ID NO: 1609989 - RNA, 13 nt, Homo sapiens
ucagagugccacu

SEQ ID NO: 1609990 - RNA, 23 nt, Homo sapiens
ucagauauaaaagacugaccaau

SEQ ID NO: 1609991 - RNA, 14 nt, Homo sapiens
ucagaucauuauca

SEQ ID NO: 1609992 - RNA, 21 nt, Homo sapiens
ucagaucuggggcagcacccu

SEQ ID NO: 1609993 - RNA, 23 nt, Homo sapiens
ucagaugcuguuaguaccuacau

SEQ ID NO: 1609994 - RNA, 15 nt, Homo sapiens
ucagauuccaccuag

SEQ ID NO: 1609995 - RNA, 11 nt, Homo sapiens
ucagcaaaaaa

SEQ ID NO: 1609996 - RNA, 20 nt, Homo sapiens
ucagcaacccuacaguauau

SEQ ID NO: 1609997 - RNA, 20 nt, Homo sapiens
ucagcaacuguuagcuggga

SEQ ID NO: 1609998 - RNA, 15 nt, Homo sapiens
ucagcaagacauaaa

SEQ ID NO: 1609999 - RNA, 22 nt, Homo sapiens
ucagcaauacauagaacugaaa

SEQ ID NO: 1610000 - RNA, 15 nt, Homo sapiens
ucagcacacacuuac

SEQ ID NO: 1610001 - RNA, 19 nt, Homo sapiens
ucagcacguguggccuguu

SEQ ID NO: 1610002 - RNA, 14 nt, Homo sapiens
ucagcacucuguaa

SEQ ID NO: 1610003 - RNA, 17 nt, Homo sapiens
ucagcacucuguaaaau

SEQ ID NO: 1610004 - RNA, 23 nt, Homo sapiens
ucagcacugauggaaaauaccag

SEQ ID NO: 1610005 - RNA, 11 nt, Homo sapiens
ucagcacugcc

SEQ ID NO: 1610006 - RNA, 13 nt, Homo sapiens
ucagcaguauucu

SEQ ID NO: 1610007 - RNA, 21 nt, Homo sapiens
ucagcaguucagcuccuucca

SEQ ID NO: 1610008 - RNA, 22 nt, Homo sapiens
ucagcaucacccgggaacuuuu

SEQ ID NO: 1610009 - RNA, 23 nt, Homo sapiens
ucagcaugauguguuguguauaa

SEQ ID NO: 1610010 - RNA, 11 nt, Homo sapiens
ucagcauuucc

SEQ ID NO: 1610011 - RNA, 18 nt, Homo sapiens
ucagccaaaacauaccau

SEQ ID NO: 1610012 - RNA, 15 nt, Homo sapiens
ucagccaagugcaga

SEQ ID NO: 1610013 - RNA, 20 nt, Homo sapiens
ucagccaauccgauugccuu

SEQ ID NO: 1610014 - RNA, 18 nt, Homo sapiens
ucagccacauauugagau

SEQ ID NO: 1610015 - RNA, 19 nt, Homo sapiens
ucagccacauauugagaug

SEQ ID NO: 1610016 - RNA, 10 nt, Homo sapiens
ucagccaggc

SEQ ID NO: 1610017 - RNA, 18 nt, Homo sapiens
ucagccaggcccugagau

SEQ ID NO: 1610018 - RNA, 16 nt, Homo sapiens
ucagccauaggugcag

SEQ ID NO: 1610019 - RNA, 13 nt, Homo sapiens
ucagcccucagaa

SEQ ID NO: 1610020 - RNA, 15 nt, Homo sapiens
ucagcccuuccccau

SEQ ID NO: 1610021 - RNA, 18 nt, Homo sapiens
ucagccuaagaaacacuc

SEQ ID NO: 1610022 - RNA, 13 nt, Homo sapiens
ucagccucccaca

SEQ ID NO: 1610023 - RNA, 21 nt, Homo sapiens
ucagccugcuuuccugcagca

SEQ ID NO: 1610024 - RNA, 22 nt, Homo sapiens
ucagccugcuuuccugcagcag

SEQ ID NO: 1610025 - RNA, 17 nt, Homo sapiens
ucagccuuaagaaccau

SEQ ID NO: 1610026 - RNA, 18 nt, Homo sapiens
ucagccuugggcucucuu

SEQ ID NO: 1610027 - RNA, 12 nt, Homo sapiens
ucagcucugauc

SEQ ID NO: 1610028 - RNA, 20 nt, Homo sapiens
ucagcugagguucauuacaa

SEQ ID NO: 1610029 - RNA, 18 nt, Homo sapiens
uccuuuccccucccucag

SEQ ID NO: 1610030 - RNA, 16 nt, Homo sapiens
uccuuuccuaucuucc

SEQ ID NO: 1610031 - RNA, 18 nt, Homo sapiens
uccuuuccuuuuuugaga

SEQ ID NO: 1610032 - RNA, 16 nt, Homo sapiens
uccuuugaagcuuuag

SEQ ID NO: 1610033 - RNA, 20 nt, Homo sapiens
uccuuuuaucucacaaauaa

SEQ ID NO: 1610034 - RNA, 13 nt, Homo sapiens
uccuuuuccuuau

SEQ ID NO: 1610035 - RNA, 16 nt, Homo sapiens
uccuuuuggccugggg

SEQ ID NO: 1610036 - RNA, 15 nt, Homo sapiens
ucgaacaauucauau

SEQ ID NO: 1610037 - RNA, 17 nt, Homo sapiens
ucgaauucucacaagga

SEQ ID NO: 1610038 - RNA, 19 nt, Homo sapiens
ucgacaaaggccacaggca

SEQ ID NO: 1610039 - RNA, 14 nt, Homo sapiens
ucgacccugugcag

SEQ ID NO: 1610040 - RNA, 15 nt, Homo sapiens
ucgagacugcaaugu

SEQ ID NO: 1610041 - RNA, 23 nt, Homo sapiens
ucgagauguucgcucgugcagua

SEQ ID NO: 1610042 - RNA, 16 nt, Homo sapiens
ucgagauugcacugcu

SEQ ID NO: 1610043 - RNA, 22 nt, Homo sapiens
ucgaggcugcagucagcccuga

SEQ ID NO: 1610044 - RNA, 17 nt, Homo sapiens
ucgaggggcccagggaa

SEQ ID NO: 1610045 - RNA, 17 nt, Homo sapiens
ucgagguagguggauca

SEQ ID NO: 1610046 - RNA, 13 nt, Homo sapiens
ucgagguggauca

SEQ ID NO: 1610047 - RNA, 13 nt, Homo sapiens
ucgauagccugag

SEQ ID NO: 1610048 - RNA, 19 nt, Homo sapiens
ucgauccuggauucacuca

SEQ ID NO: 1610049 - RNA, 14 nt, Homo sapiens
ucgaucuccugacc

SEQ ID NO: 1610050 - RNA, 14 nt, Homo sapiens
ucgaugugcucagc

SEQ ID NO: 1610051 - RNA, 14 nt, Homo sapiens
ucgauguggucaca

SEQ ID NO: 1610052 - RNA, 17 nt, Homo sapiens
ucgauugaaauuuugca

SEQ ID NO: 1610053 - RNA, 15 nt, Homo sapiens
ucgauugauaugcuu

SEQ ID NO: 1610054 - RNA, 18 nt, Homo sapiens
ucgauuuucuauuaugga

SEQ ID NO: 1610055 - RNA, 20 nt, Homo sapiens
ucgcaucuugugucgcugaa

SEQ ID NO: 1610056 - RNA, 20 nt, Homo sapiens
ucgcuaugugacuugcgcuu

SEQ ID NO: 1610057 - RNA, 21 nt, Homo sapiens
ucgcuaugugacuugcgcuua

SEQ ID NO: 1610058 - RNA, 16 nt, Homo sapiens
ucgcucagucuguuca

SEQ ID NO: 1610059 - RNA, 21 nt, Homo sapiens
ucgcuuucuaaaggaaaucaa

SEQ ID NO: 1610060 - RNA, 17 nt, Homo sapiens
ucggagcggcgucccuu

SEQ ID NO: 1610061 - RNA, 18 nt, Homo sapiens
ucggagugaauguggcag

SEQ ID NO: 1610062 - RNA, 18 nt, Homo sapiens
ucggugugaacuuuucuc

SEQ ID NO: 1610063 - RNA, 19 nt, Homo sapiens
ucggugugcugccaacuug

SEQ ID NO: 1610064 - RNA, 20 nt, Homo sapiens
ucguaauggguauauugaua

SEQ ID NO: 1610065 - RNA, 14 nt, Homo sapiens
ucgucaacuuuccu

SEQ ID NO: 1610066 - RNA, 18 nt, Homo sapiens
ucgucaucaggugcauag

SEQ ID NO: 1610067 - RNA, 18 nt, Homo sapiens
ucgugcauaggcaaagaa

SEQ ID NO: 1610068 - RNA, 15 nt, Homo sapiens
ucguggacugugcug

SEQ ID NO: 1610069 - RNA, 19 nt, Homo sapiens
ucgugguaggacuguagaa

SEQ ID NO: 1610070 - RNA, 22 nt, Homo sapiens
ucguuuugcccgauuccguauu

SEQ ID NO: 1610071 - RNA, 16 nt, Homo sapiens
ucuaaaacucauacaa

SEQ ID NO: 1610072 - RNA, 16 nt, Homo sapiens
ucuaaaaugcaaagaa

SEQ ID NO: 1610073 - RNA, 14 nt, Homo sapiens
ucuaaaccaaaaau

SEQ ID NO: 1610074 - RNA, 21 nt, Homo sapiens
ucuaaaccaaaaauuaugugu

SEQ ID NO: 1610075 - RNA, 12 nt, Homo sapiens
ucuaaagaccau

SEQ ID NO: 1610076 - RNA, 20 nt, Homo sapiens
ucuaaaggaaaucaaaugaa

SEQ ID NO: 1610077 - RNA, 18 nt, Homo sapiens
ucuaaaguuuugcaacaa

SEQ ID NO: 1610078 - RNA, 14 nt, Homo sapiens
ucuaaauagcacuu

SEQ ID NO: 1610079 - RNA, 13 nt, Homo sapiens
ucuaaaucauaua

SEQ ID NO: 1610080 - RNA, 19 nt, Homo sapiens
ucuaaauuacagugcaguu

SEQ ID NO: 1610081 - RNA, 19 nt, Homo sapiens
ucuaacauaugauacugau

SEQ ID NO: 1610082 - RNA, 20 nt, Homo sapiens
ucuaaccgaauauucaugga

SEQ ID NO: 1610083 - RNA, 20 nt, Homo sapiens
ucuaagacuacuaugaacag

SEQ ID NO: 1610084 - RNA, 22 nt, Homo sapiens
ucuaagauacacugcacuuugu

SEQ ID NO: 1610085 - RNA, 19 nt, Homo sapiens
ucuaaguaaaaccacagca

SEQ ID NO: 1610086 - RNA, 14 nt, Homo sapiens
ucuaagucuuucca

SEQ ID NO: 1610087 - RNA, 14 nt, Homo sapiens
ucuaagugggagaa

SEQ ID NO: 1610088 - RNA, 19 nt, Homo sapiens
ucuaaguuuuguguacaga

SEQ ID NO: 1610089 - RNA, 21 nt, Homo sapiens
ucuaauaguuuuucacuuugu

SEQ ID NO: 1610090 - RNA, 14 nt, Homo sapiens
ucuaauauggccac

SEQ ID NO: 1610091 - RNA, 14 nt, Homo sapiens
ucuaaugagcauuu

SEQ ID NO: 1610092 - RNA, 16 nt, Homo sapiens
ucuacaaaaauuuauu

SEQ ID NO: 1610093 - RNA, 14 nt, Homo sapiens
ucuacaacauagca

SEQ ID NO: 1610094 - RNA, 21 nt, Homo sapiens
ucuacacagauggaaucucuu

SEQ ID NO: 1610095 - RNA, 20 nt, Homo sapiens
ucuacacauugcuaccucag

SEQ ID NO: 1610096 - RNA, 19 nt, Homo sapiens
ucuacagugauagagcaaa

SEQ ID NO: 1610097 - RNA, 15 nt, Homo sapiens
ucuacauacuaugga

SEQ ID NO: 1610098 - RNA, 22 nt, Homo sapiens
ucuacaugugagauaguuuuca

SEQ ID NO: 1610099 - RNA, 15 nt, Homo sapiens
ucuaccaaaaaaagg

SEQ ID NO: 1610100 - RNA, 18 nt, Homo sapiens
ucuaccaaaaaauaaaaa

SEQ ID NO: 1610101 - RNA, 12 nt, Homo sapiens
ucuaccaagaac

SEQ ID NO: 1610102 - RNA, 13 nt, Homo sapiens
ucuaccaagaaca

SEQ ID NO: 1610103 - RNA, 18 nt, Homo sapiens
ucuaccuuuucuggcaaa

SEQ ID NO: 1610104 - RNA, 21 nt, Homo sapiens
ucuacuaacaaucagcuccuu

SEQ ID NO: 1610105 - RNA, 20 nt, Homo sapiens
ucuacuacaaacuucaaaga

SEQ ID NO: 1610106 - RNA, 15 nt, Homo sapiens
ucuacugaaugucau

SEQ ID NO: 1610107 - RNA, 19 nt, Homo sapiens
ucuacugaccuuuguccuu

SEQ ID NO: 1610108 - RNA, 18 nt, Homo sapiens
ucuacugacuuuucccau

SEQ ID NO: 1610109 - RNA, 21 nt, Homo sapiens
ucuacugacuuuucccauuca

SEQ ID NO: 1610110 - RNA, 21 nt, Homo sapiens
ucuacuggaaauguagcacuu

SEQ ID NO: 1610111 - RNA, 14 nt, Homo sapiens
ucuacuguuauuau

SEQ ID NO: 1610112 - RNA, 22 nt, Homo sapiens
ucuacuucuggaagucaucuca

SEQ ID NO: 1610113 - RNA, 21 nt, Homo sapiens
ucuacuugccucauuucccua

SEQ ID NO: 1610114 - RNA, 13 nt, Homo sapiens
ucuacuugcugaa

SEQ ID NO: 1610115 - RNA, 12 nt, Homo sapiens
ucuagaagccaa

SEQ ID NO: 1610116 - RNA, 20 nt, Homo sapiens
ucuagaauuuagugauacug

SEQ ID NO: 1610117 - RNA, 12 nt, Homo sapiens
ucuagaauuugg

SEQ ID NO: 1610118 - RNA, 22 nt, Homo sapiens
ucuagagaugguuucuacuggc

SEQ ID NO: 1610119 - RNA, 15 nt, Homo sapiens
ucuagauaaucuuuc

SEQ ID NO: 1610120 - RNA, 20 nt, Homo sapiens
ucuagauagaauguuuucau

SEQ ID NO: 1610121 - RNA, 18 nt, Homo sapiens
ucuagauccugcacccca

SEQ ID NO: 1610122 - RNA, 19 nt, Homo sapiens
ucuagcauucuaguuucau

SEQ ID NO: 1610123 - RNA, 18 nt, Homo sapiens
ucuaggaugggaacaagg

SEQ ID NO: 1610124 - RNA, 13 nt, Homo sapiens
ucuaggaugugau

SEQ ID NO: 1610125 - RNA, 14 nt, Homo sapiens
ucuaggaugugaug

SEQ ID NO: 1610126 - RNA, 22 nt, Homo sapiens
ucuaggcaggcaagagaauuga

SEQ ID NO: 1610127 - RNA, 13 nt, Homo sapiens
ucuaggguccagu

SEQ ID NO: 1610128 - RNA, 15 nt, Homo sapiens
ucuaggugccccuga

SEQ ID NO: 1610129 - RNA, 19 nt, Homo sapiens
ucuaguaaauuuaagucca

SEQ ID NO: 1610130 - RNA, 13 nt, Homo sapiens
ucuagugcaaaag

SEQ ID NO: 1610131 - RNA, 20 nt, Homo sapiens
ucuauaaaaauacuacaaua

SEQ ID NO: 1610132 - RNA, 18 nt, Homo sapiens
ucuauaaacagacaggcu

SEQ ID NO: 1610133 - RNA, 14 nt, Homo sapiens
ucuauaaggccaua

SEQ ID NO: 1610134 - RNA, 15 nt, Homo sapiens
ucuauagaacaucca

SEQ ID NO: 1610135 - RNA, 16 nt, Homo sapiens
ucuauaggaacauaug

SEQ ID NO: 1610136 - RNA, 20 nt, Homo sapiens
ucuauauuagaucaaauagu

SEQ ID NO: 1610137 - RNA, 16 nt, Homo sapiens
ucuauccucuguaaac

SEQ ID NO: 1610138 - RNA, 16 nt, Homo sapiens
ucuauccuguuuaaua

SEQ ID NO: 1610139 - RNA, 16 nt, Homo sapiens
ucuauccuuuugccug

SEQ ID NO: 1610140 - RNA, 20 nt, Homo sapiens
ucuaugacuuagguaaaaua

SEQ ID NO: 1610141 - RNA, 14 nt, Homo sapiens
ucuauugacuuuuc

SEQ ID NO: 1610142 - RNA, 13 nt, Homo sapiens
ucuauugggauau

SEQ ID NO: 1610143 - RNA, 19 nt, Homo sapiens
ucuauugucgcuaugugac

SEQ ID NO: 1610144 - RNA, 20 nt, Homo sapiens
ucuauuugccuccagugcag

SEQ ID NO: 1610145 - RNA, 20 nt, Homo sapiens
ucucaaaacaauauuacuuu

SEQ ID NO: 1610146 - RNA, 17 nt, Homo sapiens
ucucaaagaaggcauuu

SEQ ID NO: 1610147 - RNA, 20 nt, Homo sapiens
ucuugcuggaucuguaguga

SEQ ID NO: 1610148 - RNA, 16 nt, Homo sapiens
ucuuggccuaaaccuc

SEQ ID NO: 1610149 - RNA, 17 nt, Homo sapiens
ucuuggcuuaaucauuu

SEQ ID NO: 1610150 - RNA, 17 nt, Homo sapiens
ucuuggucucaguguca

SEQ ID NO: 1610151 - RNA, 22 nt, Homo sapiens
ucuugguugaggaaacaaacau

SEQ ID NO: 1610152 - RNA, 16 nt, Homo sapiens
ucuuguuacugcugau

SEQ ID NO: 1610153 - RNA, 18 nt, Homo sapiens
ucuuguuguuauucagaa

SEQ ID NO: 1610154 - RNA, 15 nt, Homo sapiens
ucuuuauagugcaca

SEQ ID NO: 1610155 - RNA, 19 nt, Homo sapiens
ucuuuaucaugaagcacau

SEQ ID NO: 1610156 - RNA, 12 nt, Homo sapiens
ucuuucacuuca

SEQ ID NO: 1610157 - RNA, 22 nt, Homo sapiens
ucuuuccaggcuucccugacuu

SEQ ID NO: 1610158 - RNA, 20 nt, Homo sapiens
ucuuuccugaaccaugugga

SEQ ID NO: 1610159 - RNA, 15 nt, Homo sapiens
ucuuucucucuuucc

SEQ ID NO: 1610160 - RNA, 13 nt, Homo sapiens
ucuuucuuuccaa

SEQ ID NO: 1610161 - RNA, 20 nt, Homo sapiens
ucuuucuuugcaccaaagac

SEQ ID NO: 1610162 - RNA, 17 nt, Homo sapiens
ucuuugcaccaaagaca

SEQ ID NO: 1610163 - RNA, 20 nt, Homo sapiens
ucuuugcaccaaagacauca

SEQ ID NO: 1610164 - RNA, 22 nt, Homo sapiens
ucuuugcaggaggcccaaccuc

SEQ ID NO: 1610165 - RNA, 17 nt, Homo sapiens
ucuuugccagucauuca

SEQ ID NO: 1610166 - RNA, 16 nt, Homo sapiens
ucuuugcuaguaccaa

SEQ ID NO: 1610167 - RNA, 20 nt, Homo sapiens
ucuuugcuaguaccaaaagu

SEQ ID NO: 1610168 - RNA, 18 nt, Homo sapiens
ucuuugcucccugcaaga

SEQ ID NO: 1610169 - RNA, 19 nt, Homo sapiens
ucuuugcucccugcaagaa

SEQ ID NO: 1610170 - RNA, 20 nt, Homo sapiens
ucuuugcucccugcaagaaa

SEQ ID NO: 1610171 - RNA, 19 nt, Homo sapiens
ucuuuggaaaguacacucu

SEQ ID NO: 1610172 - RNA, 15 nt, Homo sapiens
ucuuuggcgaccucc

SEQ ID NO: 1610173 - RNA, 15 nt, Homo sapiens
ucuuugggcaucaga

SEQ ID NO: 1610174 - RNA, 19 nt, Homo sapiens
ucuuuguaugucuguuacc

SEQ ID NO: 1610175 - RNA, 14 nt, Homo sapiens
ucuuugucuugccc

SEQ ID NO: 1610176 - RNA, 14 nt, Homo sapiens
ucuuuguucaagau

SEQ ID NO: 1610177 - RNA, 13 nt, Homo sapiens
ucuuuguuuaugc

SEQ ID NO: 1610178 - RNA, 15 nt, Homo sapiens
ucuuuuaaaguauuu

SEQ ID NO: 1610179 - RNA, 14 nt, Homo sapiens
ucuuuuaacagccu

SEQ ID NO: 1610180 - RNA, 15 nt, Homo sapiens
ucuuuuauccuggga

SEQ ID NO: 1610181 - RNA, 14 nt, Homo sapiens
ucuuuucaaugugu

SEQ ID NO: 1610182 - RNA, 18 nt, Homo sapiens
ucuuuucuucuauggggu

SEQ ID NO: 1610183 - RNA, 18 nt, Homo sapiens
ucuuuugagggcuaaaaa

SEQ ID NO: 1610184 - RNA, 12 nt, Homo sapiens
ucuuuugccuuu

SEQ ID NO: 1610185 - RNA, 16 nt, Homo sapiens
ucuuuugucccagaaa

SEQ ID NO: 1610186 - RNA, 14 nt, Homo sapiens
ucuuuuguucuaaa

SEQ ID NO: 1610187 - RNA, 16 nt, Homo sapiens
ugaaaaaaaacagugg

SEQ ID NO: 1610188 - RNA, 20 nt, Homo sapiens
ugaaaaaaagggcacucuga

SEQ ID NO: 1610189 - RNA, 23 nt, Homo sapiens
ugaaaaaagguuguguagcugug

SEQ ID NO: 1610190 - RNA, 21 nt, Homo sapiens
ugaaaaagccucuaauggacu

SEQ ID NO: 1610191 - RNA, 18 nt, Homo sapiens
ugaaaaauuccacucaaa

SEQ ID NO: 1610192 - RNA, 23 nt, Homo sapiens
ugaaaacauguacuacagcuaua

SEQ ID NO: 1610193 - RNA, 20 nt, Homo sapiens
ugaaaaccguaaagugccuu

SEQ ID NO: 1610194 - RNA, 13 nt, Homo sapiens
ugaaaacuuguaa

SEQ ID NO: 1610195 - RNA, 16 nt, Homo sapiens
ugaaaagaauuugaug

SEQ ID NO: 1610196 - RNA, 16 nt, Homo sapiens
ugaaaagacuccaaag

SEQ ID NO: 1610197 - RNA, 22 nt, Homo sapiens
ugaaaagagccucuggaugcau

SEQ ID NO: 1610198 - RNA, 21 nt, Homo sapiens
ugaaaagauacugaugcauug

SEQ ID NO: 1610199 - RNA, 13 nt, Homo sapiens
ugaaaagccaaau

SEQ ID NO: 1610200 - RNA, 16 nt, Homo sapiens
ugaaaaggaacuugcc

SEQ ID NO: 1610201 - RNA, 19 nt, Homo sapiens
ugaaaaggguguugcuaag

SEQ ID NO: 1610202 - RNA, 15 nt, Homo sapiens
ugaaaagguugccug

SEQ ID NO: 1610203 - RNA, 22 nt, Homo sapiens
ugaaaaguuugauuaaaauuca

SEQ ID NO: 1610204 - RNA, 14 nt, Homo sapiens
ugaaaauagcaacc

SEQ ID NO: 1610205 - RNA, 23 nt, Homo sapiens
ugaaaaucuacacuccagugaga

SEQ ID NO: 1610206 - RNA, 17 nt, Homo sapiens
ugaaaaucuccaucuca

SEQ ID NO: 1610207 - RNA, 12 nt, Homo sapiens
ugaaaaugugac

SEQ ID NO: 1610208 - RNA, 14 nt, Homo sapiens
ugaaaauugcaaua

SEQ ID NO: 1610209 - RNA, 15 nt, Homo sapiens
ugaaacacuuugccu

SEQ ID NO: 1610210 - RNA, 16 nt, Homo sapiens
ugaaacauguacuuug

SEQ ID NO: 1610211 - RNA, 14 nt, Homo sapiens
ugaaacauuuuagc

SEQ ID NO: 1610212 - RNA, 15 nt, Homo sapiens
ugaaacccccaucuc

SEQ ID NO: 1610213 - RNA, 15 nt, Homo sapiens
ugaaaccccgucucu

SEQ ID NO: 1610214 - RNA, 12 nt, Homo sapiens
ugaaacuaucuc

SEQ ID NO: 1610215 - RNA, 20 nt, Homo sapiens
ugaaacuauuuuaccugaac

SEQ ID NO: 1610216 - RNA, 21 nt, Homo sapiens
ugaaacucauagacacugauc

SEQ ID NO: 1610217 - RNA, 15 nt, Homo sapiens
ugaaacuccgucuca

SEQ ID NO: 1610218 - RNA, 22 nt, Homo sapiens
ugaaagaggggugggauccaca

SEQ ID NO: 1610219 - RNA, 20 nt, Homo sapiens
ugaaagauugauuaaugaac

SEQ ID NO: 1610220 - RNA, 18 nt, Homo sapiens
ugaaagcagggacuugaa

SEQ ID NO: 1610221 - RNA, 21 nt, Homo sapiens
ugaaaggauaugaaucugaga

SEQ ID NO: 1610222 - RNA, 19 nt, Homo sapiens
ugaaaggggacaccuguac

SEQ ID NO: 1610223 - RNA, 13 nt, Homo sapiens
ugaaaguggacaa

SEQ ID NO: 1610224 - RNA, 22 nt, Homo sapiens
ugaaaguguuuugcccuauaua

SEQ ID NO: 1610225 - RNA, 16 nt, Homo sapiens
ugaaaguuaauccacu

SEQ ID NO: 1610226 - RNA, 20 nt, Homo sapiens
ugaaaguuguauucucauau

SEQ ID NO: 1610227 - RNA, 22 nt, Homo sapiens
ugaaauaaaagcacacugcuua

SEQ ID NO: 1610228 - RNA, 21 nt, Homo sapiens
ugaaauaagccagacaucaac

SEQ ID NO: 1610229 - RNA, 23 nt, Homo sapiens
ugaaauaagccagacaucaacag

SEQ ID NO: 1610230 - RNA, 14 nt, Homo sapiens
ugaaauaaguaaau

SEQ ID NO: 1610231 - RNA, 20 nt, Homo sapiens
ugaaauauaguaaacacuug

SEQ ID NO: 1610232 - RNA, 22 nt, Homo sapiens
ugaaauaugauaauaaaggcau

SEQ ID NO: 1610233 - RNA, 16 nt, Homo sapiens
ugaaauauugugacuc

SEQ ID NO: 1610234 - RNA, 14 nt, Homo sapiens
ugaaaugaaaggga

SEQ ID NO: 1610235 - RNA, 15 nt, Homo sapiens
ugaaaugaaagggaa

SEQ ID NO: 1610236 - RNA, 16 nt, Homo sapiens
ugaaaugaaugauucu

SEQ ID NO: 1610237 - RNA, 23 nt, Homo sapiens
ugaaaugacauuucacuaaaagu

SEQ ID NO: 1610238 - RNA, 15 nt, Homo sapiens
ugaaaugccaaagga

SEQ ID NO: 1610239 - RNA, 18 nt, Homo sapiens
ugaaaugcuguuaguaaa

SEQ ID NO: 1610240 - RNA, 15 nt, Homo sapiens
ugaaauggccaggau

SEQ ID NO: 1610241 - RNA, 18 nt, Homo sapiens
ugaaauguucaagucaug

SEQ ID NO: 1610242 - RNA, 22 nt, Homo sapiens
ugaaauuaugugacauuuuaca

SEQ ID NO: 1610243 - RNA, 16 nt, Homo sapiens
ugaaauuguaucucag

SEQ ID NO: 1610244 - RNA, 18 nt, Homo sapiens
ugaaauuugauacuaaaa

SEQ ID NO: 1610245 - RNA, 20 nt, Homo sapiens
ugaaauuuuaaccuaugaua

SEQ ID NO: 1610246 - RNA, 20 nt, Homo sapiens
ugaaauuuuagaaauauuca

SEQ ID NO: 1610247 - RNA, 13 nt, Homo sapiens
ugaacaaaugaca

SEQ ID NO: 1610248 - RNA, 19 nt, Homo sapiens
ugaacaaauuuacagagac

SEQ ID NO: 1610249 - RNA, 23 nt, Homo sapiens
ugaacacucaguggcccauggca

SEQ ID NO: 1610250 - RNA, 20 nt, Homo sapiens
ugaacacucuuuugcuuuau

SEQ ID NO: 1610251 - RNA, 20 nt, Homo sapiens
ugaacagccacgucagcuuu

SEQ ID NO: 1610252 - RNA, 23 nt, Homo sapiens
ugaacagguucucuuccuggcau

SEQ ID NO: 1610253 - RNA, 21 nt, Homo sapiens
ugaacaucccuuuuucaauga

SEQ ID NO: 1610254 - RNA, 22 nt, Homo sapiens
ugaacauuaaaauauagagaca

SEQ ID NO: 1610255 - RNA, 23 nt, Homo sapiens
ugaacauuaauccacauguuuca

SEQ ID NO: 1610256 - RNA, 11 nt, Homo sapiens
ugaacauucca

SEQ ID NO: 1610257 - RNA, 12 nt, Homo sapiens
ugaacauuccag

SEQ ID NO: 1610258 - RNA, 15 nt, Homo sapiens
ugaacauuguacugu

SEQ ID NO: 1610259 - RNA, 19 nt, Homo sapiens
ugaaccagaggguguggcu

SEQ ID NO: 1610260 - RNA, 15 nt, Homo sapiens
ugaaccaugaaguca

SEQ ID NO: 1610261 - RNA, 20 nt, Homo sapiens
ugaaccauucacagugcaag

SEQ ID NO: 1610262 - RNA, 16 nt, Homo sapiens
ugaacccugccucuug

SEQ ID NO: 1610263 - RNA, 16 nt, Homo sapiens
ugaacgacuguauauu

SEQ ID NO: 1610264 - RNA, 17 nt, Homo sapiens
ugaacuaggcugagcaa

SEQ ID NO: 1610265 - RNA, 12 nt, Homo sapiens
uuacaugugauu

SEQ ID NO: 1610266 - RNA, 17 nt, Homo sapiens
uuacaugugauugugau

SEQ ID NO: 1610267 - RNA, 16 nt, Homo sapiens
uuaccaaaaaccaugu

SEQ ID NO: 1610268 - RNA, 19 nt, Homo sapiens
uuaccaaagcaucaauaca

SEQ ID NO: 1610269 - RNA, 14 nt, Homo sapiens
uuaccaaaucucag

SEQ ID NO: 1610270 - RNA, 20 nt, Homo sapiens
uuaccaaaugaaaugccaaa

SEQ ID NO: 1610271 - RNA, 19 nt, Homo sapiens
uuaccaaggaugaaagagg

SEQ ID NO: 1610272 - RNA, 20 nt, Homo sapiens
uuaccaaggaugaaagagga

SEQ ID NO: 1610273 - RNA, 15 nt, Homo sapiens
uuaccaauugcuaag

SEQ ID NO: 1610274 - RNA, 16 nt, Homo sapiens
uuaccagagaaaaagg

SEQ ID NO: 1610275 - RNA, 10 nt, Homo sapiens
uuaccaucug

SEQ ID NO: 1610276 - RNA, 12 nt, Homo sapiens
uuaccuuucaua

SEQ ID NO: 1610277 - RNA, 23 nt, Homo sapiens
uuacuaaguggacuggugucaua

SEQ ID NO: 1610278 - RNA, 18 nt, Homo sapiens
uuacuaguacuauuacua

SEQ ID NO: 1610279 - RNA, 22 nt, Homo sapiens
uuacuauuauagcaacuuuaag

SEQ ID NO: 1610280 - RNA, 18 nt, Homo sapiens
uuacucacucacucugau

SEQ ID NO: 1610281 - RNA, 21 nt, Homo sapiens
uuacugaaagaaaaagaccua

SEQ ID NO: 1610282 - RNA, 13 nt, Homo sapiens
uuacugaugugau

SEQ ID NO: 1610283 - RNA, 18 nt, Homo sapiens
uuacugcuugaccaaaga

SEQ ID NO: 1610284 - RNA, 13 nt, Homo sapiens
uuacugugauuca

SEQ ID NO: 1610285 - RNA, 17 nt, Homo sapiens
uuacuuaugaugaugaa

SEQ ID NO: 1610286 - RNA, 20 nt, Homo sapiens
uuacuuaugaugaugaaggg

SEQ ID NO: 1610287 - RNA, 24 nt, Homo sapiens
uuacuucucacuaauuuguaggaa

SEQ ID NO: 1610288 - RNA, 20 nt, Homo sapiens
uuagaaaaagaacaugcagu

SEQ ID NO: 1610289 - RNA, 21 nt, Homo sapiens
uuagaaaaagaacaugcaguu

SEQ ID NO: 1610290 - RNA, 15 nt, Homo sapiens
uuagaaacaccagcc

SEQ ID NO: 1610291 - RNA, 14 nt, Homo sapiens
uuagaaagcuaaau

SEQ ID NO: 1610292 - RNA, 12 nt, Homo sapiens
uuagaaaguaau

SEQ ID NO: 1610293 - RNA, 13 nt, Homo sapiens
uuagaaaguaaua

SEQ ID NO: 1610294 - RNA, 14 nt, Homo sapiens
uuagaaauuacuaa

SEQ ID NO: 1610295 - RNA, 21 nt, Homo sapiens
uuagaacaaaagaauaacauu

SEQ ID NO: 1610296 - RNA, 14 nt, Homo sapiens
uuagaacauucacu

SEQ ID NO: 1610297 - RNA, 20 nt, Homo sapiens
uuagaauguugaaaaguaau

SEQ ID NO: 1610298 - RNA, 19 nt, Homo sapiens
uuagaauuaaaaaagcaua

SEQ ID NO: 1610299 - RNA, 20 nt, Homo sapiens
uuagaccugccagccacugu

SEQ ID NO: 1610300 - RNA, 24 nt, Homo sapiens
uuagagacccuuugucucugagaa

SEQ ID NO: 1610301 - RNA, 21 nt, Homo sapiens
uuagagccaggcacacacugu

SEQ ID NO: 1610302 - RNA, 20 nt, Homo sapiens
uuagagcugccugugccuuu

SEQ ID NO: 1610303 - RNA, 17 nt, Homo sapiens
uuagauauguuaagcau

SEQ ID NO: 1610304 - RNA, 19 nt, Homo sapiens
uuagauauugcuacuauaa

SEQ ID NO: 1610305 - RNA, 15 nt, Homo sapiens
uuagaugaaugucag

SEQ ID NO: 1610306 - RNA, 20 nt, Homo sapiens
uuagcagggauucucucauc

SEQ ID NO: 1610307 - RNA, 12 nt, Homo sapiens
uuagcccaagag

SEQ ID NO: 1610308 - RNA, 15 nt, Homo sapiens
uuagccccauuacac

SEQ ID NO: 1610309 - RNA, 20 nt, Homo sapiens
uuaggaaaggaugaucaaaa

SEQ ID NO: 1610310 - RNA, 16 nt, Homo sapiens
uuaggauggggcuccc

SEQ ID NO: 1610311 - RNA, 15 nt, Homo sapiens
uuaggcaaagauaau

SEQ ID NO: 1610312 - RNA, 12 nt, Homo sapiens
uuagggggaaaa

SEQ ID NO: 1610313 - RNA, 21 nt, Homo sapiens
uuaguaaauaaacaagucaaa

SEQ ID NO: 1610314 - RNA, 18 nt, Homo sapiens
uuaguaaauuucugugau

SEQ ID NO: 1610315 - RNA, 19 nt, Homo sapiens
uuagugaccauuauucaca

SEQ ID NO: 1610316 - RNA, 13 nt, Homo sapiens
uuagugcuuugug

SEQ ID NO: 1610317 - RNA, 18 nt, Homo sapiens
uuaguggauuacugccau

SEQ ID NO: 1610318 - RNA, 19 nt, Homo sapiens
uuagugugaauauuccuuu

SEQ ID NO: 1610319 - RNA, 23 nt, Homo sapiens
uuaguguucuguuugaaacuaau

SEQ ID NO: 1610320 - RNA, 16 nt, Homo sapiens
uuaguuuuauauugcu

SEQ ID NO: 1610321 - RNA, 22 nt, Homo sapiens
uuauaaaucuuucucucacugu

SEQ ID NO: 1610322 - RNA, 13 nt, Homo sapiens
uuauaacaguguu

SEQ ID NO: 1610323 - RNA, 17 nt, Homo sapiens
uuauaacguguucaaua

SEQ ID NO: 1610324 - RNA, 13 nt, Homo sapiens
uuauaacuguaaa

SEQ ID NO: 1610325 - RNA, 14 nt, Homo sapiens
uuauaagacuggaa

SEQ ID NO: 1610326 - RNA, 23 nt, Homo sapiens
uuauaagcagguguauacuuuua

SEQ ID NO: 1610327 - RNA, 14 nt, Homo sapiens
uuauaagcauuugu

SEQ ID NO: 1610328 - RNA, 22 nt, Homo sapiens
uuauaagugagagaaaugaagu

SEQ ID NO: 1610329 - RNA, 14 nt, Homo sapiens
uuauaauuuuacuc

SEQ ID NO: 1610330 - RNA, 23 nt, Homo sapiens
uuauaccugcucuuguucuacug

SEQ ID NO: 1610331 - RNA, 14 nt, Homo sapiens
uuauacugagcuuu

SEQ ID NO: 1610332 - RNA, 12 nt, Homo sapiens
uuauacugcacu

SEQ ID NO: 1610333 - RNA, 16 nt, Homo sapiens
uuauagaccucuagua

SEQ ID NO: 1610334 - RNA, 15 nt, Homo sapiens
uuauagcaacuuuaa

SEQ ID NO: 1610335 - RNA, 12 nt, Homo sapiens
uuauagcuauga

SEQ ID NO: 1610336 - RNA, 19 nt, Homo sapiens
uuauagcuuccagauuaca

SEQ ID NO: 1610337 - RNA, 15 nt, Homo sapiens
uuauaggcauaccuc

SEQ ID NO: 1610338 - RNA, 17 nt, Homo sapiens
uuauaggccugugugua

SEQ ID NO: 1610339 - RNA, 14 nt, Homo sapiens
uuauauaauucaag

SEQ ID NO: 1610340 - RNA, 16 nt, Homo sapiens
uuauauacaguacaca

SEQ ID NO: 1610341 - RNA, 19 nt, Homo sapiens
uuauaucauacaguuuuca

SEQ ID NO: 1610342 - RNA, 13 nt, Homo sapiens
uuauaucaugcaa

SEQ ID NO: 1610343 - RNA, 20 nt, Homo sapiens
uuauaucuguaaugauacug

SEQ ID NO: 1610344 - RNA, 18 nt, Homo sapiens
uuauaugaacauagacua

SEQ ID NO: 1610345 - RNA, 23 nt, Homo sapiens
uuauaugaacauagacuagagaa

SEQ ID NO: 1610346 - RNA, 21 nt, Homo sapiens
uuauauguauaucacauuccc

SEQ ID NO: 1610347 - RNA, 14 nt, Homo sapiens
uuauauucauucuu

SEQ ID NO: 1610348 - RNA, 12 nt, Homo sapiens
uuauauugcuag

SEQ ID NO: 1610349 - RNA, 23 nt, Homo sapiens
uuauauuuguaaauuuaugugau

SEQ ID NO: 1610350 - RNA, 19 nt, Homo sapiens
uuauauuuuaugaacauug

SEQ ID NO: 1610351 - RNA, 13 nt, Homo sapiens
uuaucacacuuug

SEQ ID NO: 1610352 - RNA, 12 nt, Homo sapiens
uuaucacuuaau

SEQ ID NO: 1610353 - RNA, 14 nt, Homo sapiens
uuaucaguuaucug

SEQ ID NO: 1610354 - RNA, 15 nt, Homo sapiens
uuaucauccuuucag

SEQ ID NO: 1610355 - RNA, 21 nt, Homo sapiens
uuaucaugcauguccuguaaa

SEQ ID NO: 1610356 - RNA, 13 nt, Homo sapiens
uuaucauugcuaa

SEQ ID NO: 1610357 - RNA, 14 nt, Homo sapiens
uuauccaacuauua

SEQ ID NO: 1610358 - RNA, 18 nt, Homo sapiens
uuaucccagugaucaccu

SEQ ID NO: 1610359 - RNA, 21 nt, Homo sapiens
uuaucccauuuagugugaaua

SEQ ID NO: 1610360 - RNA, 18 nt, Homo sapiens
uuauccccguuucuugca

SEQ ID NO: 1610361 - RNA, 16 nt, Homo sapiens
uuauccuuuuaucuca

SEQ ID NO: 1610362 - RNA, 19 nt, Homo sapiens
uuaucuggaaauaauauca

SEQ ID NO: 1610363 - RNA, 15 nt, Homo sapiens
uuaucugucuugacu

SEQ ID NO: 1610364 - RNA, 18 nt, Homo sapiens
uuaucuugaguugcagcu

SEQ ID NO: 1610365 - RNA, 19 nt, Homo sapiens
uuaucuuuuguauaucuaa

SEQ ID NO: 1610366 - RNA, 21 nt, Homo sapiens
uuaugaaaauauagacauucu

SEQ ID NO: 1610367 - RNA, 21 nt, Homo sapiens
uuaugaaccgcaauaugggag

SEQ ID NO: 1610368 - RNA, 21 nt, Homo sapiens
uuauggaauaucaucugucau

SEQ ID NO: 1610369 - RNA, 23 nt, Homo sapiens
uuauggcagaagggaauugcuca

SEQ ID NO: 1610370 - RNA, 22 nt, Homo sapiens
uuaugggagaauugcacacaga

SEQ ID NO: 1610371 - RNA, 18 nt, Homo sapiens
uuauguaguaauugacau

SEQ ID NO: 1610372 - RNA, 14 nt, Homo sapiens
uuaugucuauaacu

SEQ ID NO: 1610373 - RNA, 12 nt, Homo sapiens
uuaugucuauau

SEQ ID NO: 1610374 - RNA, 20 nt, Homo sapiens
uuaugucucuugagcaucaa

SEQ ID NO: 1610375 - RNA, 21 nt, Homo sapiens
uuaugucuggggcagaaacac

SEQ ID NO: 1610376 - RNA, 15 nt, Homo sapiens
uuaugugaacaacug

SEQ ID NO: 1610377 - RNA, 16 nt, Homo sapiens
uuaugugacuugcaau

SEQ ID NO: 1610378 - RNA, 20 nt, Homo sapiens
uuaugugagagaaaguguga

SEQ ID NO: 1610379 - RNA, 21 nt, Homo sapiens
uuaugugcaaaaucuguuaua

SEQ ID NO: 1610380 - RNA, 17 nt, Homo sapiens
uuauuaaaauucugaau

SEQ ID NO: 1610381 - RNA, 19 nt, Homo sapiens
uuauuaaagguaugcauuu

SEQ ID NO: 1610382 - RNA, 23 nt, Homo sapiens
uuauuaaucauacaaacucucac

SEQ ID NO: 1610383 - RNA, 16 nt, Homo sapiens
uugaugaugcaguuuu

SEQ ID NO: 1610384 - RNA, 14 nt, Homo sapiens
uugaugauuuccua

SEQ ID NO: 1610385 - RNA, 14 nt, Homo sapiens
uugauggucucaag

SEQ ID NO: 1610386 - RNA, 19 nt, Homo sapiens
uugauuuuaauccuguaua

SEQ ID NO: 1610387 - RNA, 22 nt, Homo sapiens
uugauuuuuauaaauacugcaa

SEQ ID NO: 1610388 - RNA, 18 nt, Homo sapiens
uugcaaagagacauuuca

SEQ ID NO: 1610389 - RNA, 13 nt, Homo sapiens
uugcaaagauuua

SEQ ID NO: 1610390 - RNA, 22 nt, Homo sapiens
uugcaaauauugguuaguauuu

SEQ ID NO: 1610391 - RNA, 20 nt, Homo sapiens
uugcaagaugugaauuauug

SEQ ID NO: 1610392 - RNA, 15 nt, Homo sapiens
uugcaauaaugcagu

SEQ ID NO: 1610393 - RNA, 16 nt, Homo sapiens
uugcacacagauguga

SEQ ID NO: 1610394 - RNA, 13 nt, Homo sapiens
uugcacauaguag

SEQ ID NO: 1610395 - RNA, 22 nt, Homo sapiens
uugcacauaguagguacccaau

SEQ ID NO: 1610396 - RNA, 18 nt, Homo sapiens
uugcacauuaaucagauu

SEQ ID NO: 1610397 - RNA, 14 nt, Homo sapiens
uugcaccaaaagaa

SEQ ID NO: 1610398 - RNA, 18 nt, Homo sapiens
uugcaccaaagacaucag

SEQ ID NO: 1610399 - RNA, 18 nt, Homo sapiens
uugcacuccuacugaguu

SEQ ID NO: 1610400 - RNA, 14 nt, Homo sapiens
uugcacugcugcau

SEQ ID NO: 1610401 - RNA, 20 nt, Homo sapiens
uugcagcuuauauucaucca

SEQ ID NO: 1610402 - RNA, 21 nt, Homo sapiens
uugcagcuuauauucauccau

SEQ ID NO: 1610403 - RNA, 21 nt, Homo sapiens
uugcauaucuuaaaacuaaau

SEQ ID NO: 1610404 - RNA, 23 nt, Homo sapiens
uugccaaaaucaauacaauccuu

SEQ ID NO: 1610405 - RNA, 12 nt, Homo sapiens
uugccacaaagc

SEQ ID NO: 1610406 - RNA, 18 nt, Homo sapiens
uugccauuuguagcuuug

SEQ ID NO: 1610407 - RNA, 20 nt, Homo sapiens
uugcccagccuggaugccau

SEQ ID NO: 1610408 - RNA, 21 nt, Homo sapiens
uugcccaggcuggagugcagu

SEQ ID NO: 1610409 - RNA, 14 nt, Homo sapiens
uugccgagcccagc

SEQ ID NO: 1610410 - RNA, 16 nt, Homo sapiens
uugccgcuguauaaag

SEQ ID NO: 1610411 - RNA, 15 nt, Homo sapiens
uugccuaagcauugc

SEQ ID NO: 1610412 - RNA, 21 nt, Homo sapiens
uugccucuucuuugugccuuu

SEQ ID NO: 1610413 - RNA, 12 nt, Homo sapiens
uugccugcaaaa

SEQ ID NO: 1610414 - RNA, 18 nt, Homo sapiens
uugccuucucuguucccu

SEQ ID NO: 1610415 - RNA, 23 nt, Homo sapiens
uugccuucugguuucuuccagcc

SEQ ID NO: 1610416 - RNA, 15 nt, Homo sapiens
uugccuugaaauuua

SEQ ID NO: 1610417 - RNA, 16 nt, Homo sapiens
uugcgucucaaucucc

SEQ ID NO: 1610418 - RNA, 14 nt, Homo sapiens
uugcuacauucuaa

SEQ ID NO: 1610419 - RNA, 11 nt, Homo sapiens
uugcuacugua

SEQ ID NO: 1610420 - RNA, 21 nt, Homo sapiens
uugcuagguuuugcuacauga

SEQ ID NO: 1610421 - RNA, 17 nt, Homo sapiens
uugcucaaaaucuguga

SEQ ID NO: 1610422 - RNA, 13 nt, Homo sapiens
uugcucccugcaa

SEQ ID NO: 1610423 - RNA, 15 nt, Homo sapiens
uugcucccugcaaga

SEQ ID NO: 1610424 - RNA, 20 nt, Homo sapiens
uugcucuaugucugccuucg

SEQ ID NO: 1610425 - RNA, 11 nt, Homo sapiens
uugcugaaugu

SEQ ID NO: 1610426 - RNA, 22 nt, Homo sapiens
uugcugaccauuuuggauguca

SEQ ID NO: 1610427 - RNA, 15 nt, Homo sapiens
uugcugcugugaauc

SEQ ID NO: 1610428 - RNA, 13 nt, Homo sapiens
uugcugugaauua

SEQ ID NO: 1610429 - RNA, 13 nt, Homo sapiens
uugcuguguaaaa

SEQ ID NO: 1610430 - RNA, 15 nt, Homo sapiens
uugcuguugugugau

SEQ ID NO: 1610431 - RNA, 19 nt, Homo sapiens
uugcuuauaauaaaauaau

SEQ ID NO: 1610432 - RNA, 23 nt, Homo sapiens
uugcuuccugauuaccagucuga

SEQ ID NO: 1610433 - RNA, 13 nt, Homo sapiens
uugcuugagcuca

SEQ ID NO: 1610434 - RNA, 11 nt, Homo sapiens
uugcuugauau

SEQ ID NO: 1610435 - RNA, 10 nt, Homo sapiens
uugcuuuaac

SEQ ID NO: 1610436 - RNA, 22 nt, Homo sapiens
uugcuuuugaaaaacaacugca

SEQ ID NO: 1610437 - RNA, 15 nt, Homo sapiens
uugcuuuugcuucua

SEQ ID NO: 1610438 - RNA, 19 nt, Homo sapiens
uuggaaagcagguuucaag

SEQ ID NO: 1610439 - RNA, 19 nt, Homo sapiens
uuggaauauuuuauccugu

SEQ ID NO: 1610440 - RNA, 17 nt, Homo sapiens
uuggacugucuauauca

SEQ ID NO: 1610441 - RNA, 15 nt, Homo sapiens
uuggagaaaaugggu

SEQ ID NO: 1610442 - RNA, 16 nt, Homo sapiens
uuggaggaaaugugcu

SEQ ID NO: 1610443 - RNA, 17 nt, Homo sapiens
uuggaggaaaugugcuc

SEQ ID NO: 1610444 - RNA, 15 nt, Homo sapiens
uuggaggaucaaaga

SEQ ID NO: 1610445 - RNA, 17 nt, Homo sapiens
uuggagguuaaggcaua

SEQ ID NO: 1610446 - RNA, 17 nt, Homo sapiens
uuggaugagaagugucu

SEQ ID NO: 1610447 - RNA, 18 nt, Homo sapiens
uuggaugagcauggagcu

SEQ ID NO: 1610448 - RNA, 13 nt, Homo sapiens
uuggcaaugccau

SEQ ID NO: 1610449 - RNA, 23 nt, Homo sapiens
uuggcaugccauugaaacuaaga

SEQ ID NO: 1610450 - RNA, 22 nt, Homo sapiens
uuggcauuggaauucuacugga

SEQ ID NO: 1610451 - RNA, 17 nt, Homo sapiens
uuggccacacacugagu

SEQ ID NO: 1610452 - RNA, 22 nt, Homo sapiens
uuggccucagaauucacaaaau

SEQ ID NO: 1610453 - RNA, 17 nt, Homo sapiens
uuggccucugcuaaggu

SEQ ID NO: 1610454 - RNA, 17 nt, Homo sapiens
uuggccugacucaggaa

SEQ ID NO: 1610455 - RNA, 15 nt, Homo sapiens
uuggccugcugugau

SEQ ID NO: 1610456 - RNA, 16 nt, Homo sapiens
uuggcucacacugaga

SEQ ID NO: 1610457 - RNA, 17 nt, Homo sapiens
uuggcuuaaaccagaac

SEQ ID NO: 1610458 - RNA, 18 nt, Homo sapiens
uuggcuuuuguuacccac

SEQ ID NO: 1610459 - RNA, 16 nt, Homo sapiens
uugggaccaucacuga

SEQ ID NO: 1610460 - RNA, 22 nt, Homo sapiens
uugggaggcugaggcaggagaa

SEQ ID NO: 1610461 - RNA, 16 nt, Homo sapiens
uugggcugcuccucau

SEQ ID NO: 1610462 - RNA, 21 nt, Homo sapiens
uuggggaggggccucccugug

SEQ ID NO: 1610463 - RNA, 23 nt, Homo sapiens
uuggguuaagcauuaccacucag

SEQ ID NO: 1610464 - RNA, 14 nt, Homo sapiens
uugguaagauugca

SEQ ID NO: 1610465 - RNA, 12 nt, Homo sapiens
uugguacugaaa

SEQ ID NO: 1610466 - RNA, 17 nt, Homo sapiens
uugguagaaggacugaa

SEQ ID NO: 1610467 - RNA, 13 nt, Homo sapiens
uugguagaugaca

SEQ ID NO: 1610468 - RNA, 18 nt, Homo sapiens
uuggugacaaaauucauu

SEQ ID NO: 1610469 - RNA, 14 nt, Homo sapiens
uuguaaauaugcaa

SEQ ID NO: 1610470 - RNA, 17 nt, Homo sapiens
uuguaaguugaagcaaa

SEQ ID NO: 1610471 - RNA, 15 nt, Homo sapiens
uuguaaugaauuccu

SEQ ID NO: 1610472 - RNA, 18 nt, Homo sapiens
uuguaaugagcaccugga

SEQ ID NO: 1610473 - RNA, 18 nt, Homo sapiens
uuguacaccaauauucau

SEQ ID NO: 1610474 - RNA, 15 nt, Homo sapiens
uuguacauuuuucag

SEQ ID NO: 1610475 - RNA, 14 nt, Homo sapiens
uuguagacaugccc

SEQ ID NO: 1610476 - RNA, 19 nt, Homo sapiens
uuguauaaucccacccacc

SEQ ID NO: 1610477 - RNA, 22 nt, Homo sapiens
uuguauauauggaucagaggag

SEQ ID NO: 1610478 - RNA, 16 nt, Homo sapiens
uuguaucuuuuauccu

SEQ ID NO: 1610479 - RNA, 19 nt, Homo sapiens
uuguaugaaauauauguga

SEQ ID NO: 1610480 - RNA, 13 nt, Homo sapiens
uuguaugguucca

SEQ ID NO: 1610481 - RNA, 15 nt, Homo sapiens
uuguauguugaggau

SEQ ID NO: 1610482 - RNA, 20 nt, Homo sapiens
uuguauguuuuucuguauaa

SEQ ID NO: 1610483 - RNA, 13 nt, Homo sapiens
uugucaacaaagu

SEQ ID NO: 1610484 - RNA, 20 nt, Homo sapiens
uugucacaaauaaacauaau

SEQ ID NO: 1610485 - RNA, 14 nt, Homo sapiens
uugucaccaugauc

SEQ ID NO: 1610486 - RNA, 19 nt, Homo sapiens
uugucauugaaauuuggca

SEQ ID NO: 1610487 - RNA, 16 nt, Homo sapiens
uugucauugacucgau

SEQ ID NO: 1610488 - RNA, 21 nt, Homo sapiens
uuguccaccaugcucucucac

SEQ ID NO: 1610489 - RNA, 13 nt, Homo sapiens
uuguccaggaaag

SEQ ID NO: 1610490 - RNA, 21 nt, Homo sapiens
uugucuggcaaggacuuugua

SEQ ID NO: 1610491 - RNA, 13 nt, Homo sapiens
uugucugugaucu

SEQ ID NO: 1610492 - RNA, 21 nt, Homo sapiens
uugucuguuaaaugaacuuga

SEQ ID NO: 1610493 - RNA, 18 nt, Homo sapiens
uugucuugccccuaggaa

SEQ ID NO: 1610494 - RNA, 15 nt, Homo sapiens
uugugaaagaguuga

SEQ ID NO: 1610495 - RNA, 19 nt, Homo sapiens
uugugaauagaacucugaa

SEQ ID NO: 1610496 - RNA, 14 nt, Homo sapiens
uugugagucuucac

SEQ ID NO: 1610497 - RNA, 15 nt, Homo sapiens
uugugaugauagcac

SEQ ID NO: 1610498 - RNA, 17 nt, Homo sapiens
uugugcaaacauggaga

SEQ ID NO: 1610499 - RNA, 22 nt, Homo sapiens
uuguggcaucagauaaugccac

SEQ ID NO: 1610500 - RNA, 15 nt, Homo sapiens
uugugggcacugugc

SEQ ID NO: 1610501 - RNA, 14 nt, Homo sapiens
uuguggugcauuga

SEQ ID NO: 1610502 - RNA, 23 nt, Homo sapiens
uuugccauauuuucaccauuuga

SEQ ID NO: 1610503 - RNA, 23 nt, Homo sapiens
uuugcccccauucacuuugucag

SEQ ID NO: 1610504 - RNA, 17 nt, Homo sapiens
uuuggaacuguguuuca

SEQ ID NO: 1610505 - RNA, 19 nt, Homo sapiens
uuuggagcauuaacuaaau

SEQ ID NO: 1610506 - RNA, 16 nt, Homo sapiens
uuuggagucacuguag

SEQ ID NO: 1610507 - RNA, 16 nt, Homo sapiens
uuuggaugauugucau

SEQ ID NO: 1610508 - RNA, 18 nt, Homo sapiens
uuuggaugucuguagcau

SEQ ID NO: 1610509 - RNA, 12 nt, Homo sapiens
uuuggcaauuuc

SEQ ID NO: 1610510 - RNA, 15 nt, Homo sapiens
uuuggcgaaucucaa

SEQ ID NO: 1610511 - RNA, 21 nt, Homo sapiens
uuugggagcacggacugucag

SEQ ID NO: 1610512 - RNA, 19 nt, Homo sapiens
uuugggagggaaaagggaa

SEQ ID NO: 1610513 - RNA, 19 nt, Homo sapiens
uuugggauagagaauguuc

SEQ ID NO: 1610514 - RNA, 20 nt, Homo sapiens
uuugggauguuaccuucaca

SEQ ID NO: 1610515 - RNA, 20 nt, Homo sapiens
uuuggggcucagaguggggu

SEQ ID NO: 1610516 - RNA, 20 nt, Homo sapiens
uuugggguccuagcccagug

SEQ ID NO: 1610517 - RNA, 19 nt, Homo sapiens
uuugguaaaaaugcugcuc

SEQ ID NO: 1610518 - RNA, 21 nt, Homo sapiens
uuugguagaaggacugaacaa

SEQ ID NO: 1610519 - RNA, 18 nt, Homo sapiens
uuugguuagaaggguuac

SEQ ID NO: 1610520 - RNA, 18 nt, Homo sapiens
uuugguuuugugugguau

SEQ ID NO: 1610521 - RNA, 15 nt, Homo sapiens
uuuguaaaaugcacc

SEQ ID NO: 1610522 - RNA, 16 nt, Homo sapiens
uuuguaaauaugcaaa

SEQ ID NO: 1610523 - RNA, 18 nt, Homo sapiens
uuuguaauauuuuccaua

SEQ ID NO: 1610524 - RNA, 22 nt, Homo sapiens
uuuguaaugauuuuggaacugu

SEQ ID NO: 1610525 - RNA, 13 nt, Homo sapiens
uuuguaaugcugc

SEQ ID NO: 1610526 - RNA, 19 nt, Homo sapiens
uuuguauguauuucugaug

SEQ ID NO: 1610527 - RNA, 22 nt, Homo sapiens
uuuguauuuuaagauccagaaa

SEQ ID NO: 1610528 - RNA, 16 nt, Homo sapiens
uuugucagagugcaca

SEQ ID NO: 1610529 - RNA, 12 nt, Homo sapiens
uuugucaugccc

SEQ ID NO: 1610530 - RNA, 16 nt, Homo sapiens
uuugucccaagugcca

SEQ ID NO: 1610531 - RNA, 14 nt, Homo sapiens
uuugugguaguccu

SEQ ID NO: 1610532 - RNA, 18 nt, Homo sapiens
uuugugucaaaaggacau

SEQ ID NO: 1610533 - RNA, 18 nt, Homo sapiens
uuuguuacauaaggauga

SEQ ID NO: 1610534 - RNA, 23 nt, Homo sapiens
uuuguuccccuccuccacucucc

SEQ ID NO: 1610535 - RNA, 12 nt, Homo sapiens
uuuguuuaccag

SEQ ID NO: 1610536 - RNA, 16 nt, Homo sapiens
uuuguuuccagcauga

SEQ ID NO: 1610537 - RNA, 22 nt, Homo sapiens
uuuguuuugauguuuguggccu

SEQ ID NO: 1610538 - RNA, 15 nt, Homo sapiens
uuuuaaaaauugauu

SEQ ID NO: 1610539 - RNA, 17 nt, Homo sapiens
uuuuaaaacccauuuaa

SEQ ID NO: 1610540 - RNA, 18 nt, Homo sapiens
uuuuaaaauuuauuugca

SEQ ID NO: 1610541 - RNA, 14 nt, Homo sapiens
uuuuaaacuacuga

SEQ ID NO: 1610542 - RNA, 18 nt, Homo sapiens
uuuuaaauguauacuaua

SEQ ID NO: 1610543 - RNA, 18 nt, Homo sapiens
uuuuaacacuaaccaaac

SEQ ID NO: 1610544 - RNA, 14 nt, Homo sapiens
uuuuaaguugucaa

SEQ ID NO: 1610545 - RNA, 17 nt, Homo sapiens
uuuuaaguugucugucu

SEQ ID NO: 1610546 - RNA, 15 nt, Homo sapiens
uuuuaauccuaccuc

SEQ ID NO: 1610547 - RNA, 16 nt, Homo sapiens
uuuuaaugcaccaauc

SEQ ID NO: 1610548 - RNA, 17 nt, Homo sapiens
uuuuaaugcuauuugaa

SEQ ID NO: 1610549 - RNA, 12 nt, Homo sapiens
uuuuaaugugcu

SEQ ID NO: 1610550 - RNA, 23 nt, Homo sapiens
uuuuacaagaaaacaauggggcu

SEQ ID NO: 1610551 - RNA, 15 nt, Homo sapiens
uuuuacacacugaaa

SEQ ID NO: 1610552 - RNA, 12 nt, Homo sapiens
uuuuacauuuca

SEQ ID NO: 1610553 - RNA, 17 nt, Homo sapiens
uuuuacugaaugaucua

SEQ ID NO: 1610554 - RNA, 22 nt, Homo sapiens
uuuuacuugaaucagauggugu

SEQ ID NO: 1610555 - RNA, 24 nt, Homo sapiens
uuuuagauguaaccuacaauucag

SEQ ID NO: 1610556 - RNA, 22 nt, Homo sapiens
uuuuagauuauuccaagccuua

SEQ ID NO: 1610557 - RNA, 21 nt, Homo sapiens
uuuuaggaaaagugaaucuug

SEQ ID NO: 1610558 - RNA, 19 nt, Homo sapiens
uuuuaggaaaggaugauca

SEQ ID NO: 1610559 - RNA, 14 nt, Homo sapiens
uuuuagugugugca

SEQ ID NO: 1610560 - RNA, 16 nt, Homo sapiens
uuuuauaucaugcaaa

SEQ ID NO: 1610561 - RNA, 21 nt, Homo sapiens
uuuuauaugcuuacugauaua

SEQ ID NO: 1610562 - RNA, 12 nt, Homo sapiens
uuuuaucaugau

SEQ ID NO: 1610563 - RNA, 16 nt, Homo sapiens
uuuuaugaacauugua

SEQ ID NO: 1610564 - RNA, 14 nt, Homo sapiens
uuuuauucuauauu

SEQ ID NO: 1610565 - RNA, 12 nt, Homo sapiens
uuuuauugcucg

SEQ ID NO: 1610566 - RNA, 15 nt, Homo sapiens
uuuuauuggagauca

SEQ ID NO: 1610567 - RNA, 14 nt, Homo sapiens
uuuuauuuaugaua

SEQ ID NO: 1610568 - RNA, 16 nt, Homo sapiens
uuuucaacuuugaaua

SEQ ID NO: 1610569 - RNA, 15 nt, Homo sapiens
uuuucaagacuuccu

SEQ ID NO: 1610570 - RNA, 23 nt, Homo sapiens
uuuucaauguuagccacagugua

SEQ ID NO: 1610571 - RNA, 23 nt, Homo sapiens
uuuucagggaagcugccaaagaa

SEQ ID NO: 1610572 - RNA, 16 nt, Homo sapiens
uuuucaggguuuuaaa

SEQ ID NO: 1610573 - RNA, 22 nt, Homo sapiens
uuuucaucccguaucacagugu

SEQ ID NO: 1610574 - RNA, 13 nt, Homo sapiens
uuuucaugcaaaa

SEQ ID NO: 1610575 - RNA, 14 nt, Homo sapiens
uuuucauuaucuca

SEQ ID NO: 1610576 - RNA, 14 nt, Homo sapiens
uuuuccaacuacua

SEQ ID NO: 1610577 - RNA, 16 nt, Homo sapiens
uuuuccacauaggaaa

SEQ ID NO: 1610578 - RNA, 11 nt, Homo sapiens
uuuuccagaac

SEQ ID NO: 1610579 - RNA, 13 nt, Homo sapiens
uuuucccaccacc

SEQ ID NO: 1610580 - RNA, 14 nt, Homo sapiens
uuuucccauuucaa

SEQ ID NO: 1610581 - RNA, 15 nt, Homo sapiens
uuuuccucaccaguc

SEQ ID NO: 1610582 - RNA, 16 nt, Homo sapiens
uuuuccucuucuagau

SEQ ID NO: 1610583 - RNA, 14 nt, Homo sapiens
uuuuccuguccugc

SEQ ID NO: 1610584 - RNA, 20 nt, Homo sapiens
uuuucgucuucccugcuuca

SEQ ID NO: 1610585 - RNA, 12 nt, Homo sapiens
uuuucucuugcc

SEQ ID NO: 1610586 - RNA, 15 nt, Homo sapiens
uuuucugauaaaaga

SEQ ID NO: 1610587 - RNA, 14 nt, Homo sapiens
uuuucugccaggga

SEQ ID NO: 1610588 - RNA, 22 nt, Homo sapiens
uuuucuucagguaacacuacag

SEQ ID NO: 1610589 - RNA, 17 nt, Homo sapiens
uuuugaaauuaaccucu

SEQ ID NO: 1610590 - RNA, 14 nt, Homo sapiens
uuuugaaggcaaaa

SEQ ID NO: 1610591 - RNA, 16 nt, Homo sapiens
uuuugagggcuaaaaa

SEQ ID NO: 1610592 - RNA, 17 nt, Homo sapiens
uuuugccauuagccaag

SEQ ID NO: 1610593 - RNA, 15 nt, Homo sapiens
uuuugccuguaagaa

SEQ ID NO: 1610594 - RNA, 13 nt, Homo sapiens
uuuugcuguagaa

SEQ ID NO: 1610595 - RNA, 16 nt, Homo sapiens
uuuugcuuuauggguu

SEQ ID NO: 1610596 - RNA, 14 nt, Homo sapiens
uuuuggaaagucag

SEQ ID NO: 1610597 - RNA, 22 nt, Homo sapiens
uuuugggcuuucauaguguuca

SEQ ID NO: 1610598 - RNA, 12 nt, Homo sapiens
uuuugguaucua

SEQ ID NO: 1610599 - RNA, 22 nt, Homo sapiens
uuuugucagaggcuccaaauag

SEQ ID NO: 1610600 - RNA, 15 nt, Homo sapiens
uuuugugaagccaug

SEQ ID NO: 1610601 - RNA, 11 nt, Homo sapiens
uuuuguucuaa

SEQ ID NO: 1610602 - RNA, 17 nt, Homo sapiens
uuuuguuggcauagcuc

SEQ ID NO: 1610603 - RNA, 17 nt, Homo sapiens
uuuuuaaauagggaaua

SEQ ID NO: 1610604 - RNA, 15 nt, Homo sapiens
uuuuuaaauuaugca

SEQ ID NO: 1610605 - RNA, 18 nt, Homo sapiens
uuuuuaacuuuaccaugc

SEQ ID NO: 1610606 - RNA, 18 nt, Homo sapiens
uuuuuaccuaggcaccau

SEQ ID NO: 1610607 - RNA, 17 nt, Homo sapiens
uuuuuagucuggcugca

SEQ ID NO: 1610608 - RNA, 14 nt, Homo sapiens
uuuuucaaagcaau

SEQ ID NO: 1610609 - RNA, 13 nt, Homo sapiens
uuuuucaagccug

SEQ ID NO: 1610610 - RNA, 14 nt, Homo sapiens
uuuuuccucugcau

SEQ ID NO: 1610611 - RNA, 19 nt, Homo sapiens
uuuuucucuuugugguuuc

SEQ ID NO: 1610612 - RNA, 21 nt, Homo sapiens
uuuuugacauuuacuguggau

SEQ ID NO: 1610613 - RNA, 21 nt, Homo sapiens
uuuuugagguaucacugcagu

SEQ ID NO: 1610614 - RNA, 11 nt, Homo sapiens
uuuuugccaug

SEQ ID NO: 1610615 - RNA, 11 nt, Homo sapiens
uuuuugcucuc

SEQ ID NO: 1610616 - RNA, 17 nt, Homo sapiens
uuuuuggauggcuuaag

SEQ ID NO: 1610617 - RNA, 19 nt, Homo sapiens
uuuuuguuaucagucaaua

SEQ ID NO: 1610618 - RNA, 15 nt, Homo sapiens
uuuuuuaaagccagu

SEQ ID NO: 1610619 - RNA, 12 nt, Homo sapiens
aauuuaacaaga

SEQ ID NO: 1610620 - RNA, 15 nt, Homo sapiens
aauuuaaguccaccu

SEQ ID NO: 1610621 - RNA, 14 nt, Homo sapiens
aauuuaauuccucu

SEQ ID NO: 1610622 - RNA, 18 nt, Homo sapiens
aauuuauuaacuaaucaa

SEQ ID NO: 1610623 - RNA, 15 nt, Homo sapiens
aauuuauuacugaaa

SEQ ID NO: 1610624 - RNA, 23 nt, Homo sapiens
aauuuauugucugucuacauuuc

SEQ ID NO: 1610625 - RNA, 21 nt, Homo sapiens
aauuuauuuccaauguuucaa

SEQ ID NO: 1610626 - RNA, 19 nt, Homo sapiens
aauuuauuuccacuaaaaa

SEQ ID NO: 1610627 - RNA, 13 nt, Homo sapiens
aauuucagcuuca

SEQ ID NO: 1610628 - RNA, 14 nt, Homo sapiens
aauuucaguccuua

SEQ ID NO: 1610629 - RNA, 20 nt, Homo sapiens
aauuucauacccaugucaga

SEQ ID NO: 1610630 - RNA, 16 nt, Homo sapiens
aauuucauaccuauca

SEQ ID NO: 1610631 - RNA, 14 nt, Homo sapiens
aauuucauuuccag

SEQ ID NO: 1610632 - RNA, 22 nt, Homo sapiens
aauuuccaaagcagccugugaa

SEQ ID NO: 1610633 - RNA, 19 nt, Homo sapiens
aauuucccccuaaaccaac

SEQ ID NO: 1610634 - RNA, 21 nt, Homo sapiens
aauuuccuuuuugacacugaa

SEQ ID NO: 1610635 - RNA, 14 nt, Homo sapiens
aauuucgccuuaaa

SEQ ID NO: 1610636 - RNA, 22 nt, Homo sapiens
aauuucuaaaguaaaauugaag

SEQ ID NO: 1610637 - RNA, 21 nt, Homo sapiens
aauuucuagccugcacuuuga

SEQ ID NO: 1610638 - RNA, 24 nt, Homo sapiens
aauuucuagccugcacuuugaugu

SEQ ID NO: 1610639 - RNA, 15 nt, Homo sapiens
acauuauauugcaau

SEQ ID NO: 1610640 - RNA, 12 nt, Homo sapiens
acauuaugugga

SEQ ID NO: 1610641 - RNA, 22 nt, Homo sapiens
acauuauuuggcuuaaaccaga

SEQ ID NO: 1610642 - RNA, 13 nt, Homo sapiens
acauucacugagu

SEQ ID NO: 1610643 - RNA, 14 nt, Homo sapiens
acauucacugagug

SEQ ID NO: 1610644 - RNA, 18 nt, Homo sapiens
acauucacugagugccua

SEQ ID NO: 1610645 - RNA, 19 nt, Homo sapiens
acauucacugagugccuac

SEQ ID NO: 1610646 - RNA, 19 nt, Homo sapiens
acauucucgcuucccugaa

SEQ ID NO: 1610647 - RNA, 12 nt, Homo sapiens
acauucuuggcu

SEQ ID NO: 1610648 - RNA, 17 nt, Homo sapiens
acauucuugguuguuaa

SEQ ID NO: 1610649 - RNA, 21 nt, Homo sapiens
acauucuuugggccuccugga

SEQ ID NO: 1610650 - RNA, 20 nt, Homo sapiens
acauugaguagacacauuua

SEQ ID NO: 1610651 - RNA, 14 nt, Homo sapiens
acauugccaucacu

SEQ ID NO: 1610652 - RNA, 19 nt, Homo sapiens
acauugccuucuggagcug

SEQ ID NO: 1610653 - RNA, 13 nt, Homo sapiens
acauugcugauau

SEQ ID NO: 1610654 - RNA, 16 nt, Homo sapiens
acauugcugauaugca

SEQ ID NO: 1610655 - RNA, 19 nt, Homo sapiens
acuuguuugcugugaacaa

SEQ ID NO: 1610656 - RNA, 19 nt, Homo sapiens
acuuguuuuaaacuugccu

SEQ ID NO: 1610657 - RNA, 16 nt, Homo sapiens
acuuuaaaagacugaa

SEQ ID NO: 1610658 - RNA, 22 nt, Homo sapiens
acuuuaaaauaucuacauuaau

SEQ ID NO: 1610659 - RNA, 19 nt, Homo sapiens
acuuuaaagcguuugcaca

SEQ ID NO: 1610660 - RNA, 18 nt, Homo sapiens
acuuuaaaugacauuugu

SEQ ID NO: 1610661 - RNA, 14 nt, Homo sapiens
acuuuaaccuuaga

SEQ ID NO: 1610662 - RNA, 16 nt, Homo sapiens
acuuuaagaaguaauu

SEQ ID NO: 1610663 - RNA, 17 nt, Homo sapiens
acuuuacaaaaguauua

SEQ ID NO: 1610664 - RNA, 14 nt, Homo sapiens
acuuuacaaaccau

SEQ ID NO: 1610665 - RNA, 12 nt, Homo sapiens
acuuuaccaugc

SEQ ID NO: 1610666 - RNA, 17 nt, Homo sapiens
acuuuaccaugcucaau

SEQ ID NO: 1610667 - RNA, 22 nt, Homo sapiens
acuuuagacuucccacuguucu

SEQ ID NO: 1610668 - RNA, 19 nt, Homo sapiens
acuuuagcaacaguuauca

SEQ ID NO: 1610669 - RNA, 19 nt, Homo sapiens
acuuucauccucaagcuca

SEQ ID NO: 1610670 - RNA, 18 nt, Homo sapiens
acuuucaugcagccuaaa

SEQ ID NO: 1610671 - RNA, 20 nt, Homo sapiens
acuuucauugccagugucuu

SEQ ID NO: 1610672 - RNA, 17 nt, Homo sapiens
acuuuccaaugccacag

SEQ ID NO: 1610673 - RNA, 16 nt, Homo sapiens
acuuucuaugugacau

SEQ ID NO: 1610674 - RNA, 23 nt, Homo sapiens
acuuucuguguugaagcacuguu

SEQ ID NO: 1610675 - RNA, 21 nt, Homo sapiens
acuuucuguuggauuccaugc

SEQ ID NO: 1610676 - RNA, 22 nt, Homo sapiens
acuuucuucaccaagugcaaua

SEQ ID NO: 1610677 - RNA, 18 nt, Homo sapiens
acuuucuucucuuuccca

SEQ ID NO: 1610678 - RNA, 18 nt, Homo sapiens
acuuucuuucuguaggug

SEQ ID NO: 1610679 - RNA, 16 nt, Homo sapiens
acuuugaaacuauuaa

SEQ ID NO: 1610680 - RNA, 19 nt, Homo sapiens
acuuugcuaaagacaugaa

SEQ ID NO: 1610681 - RNA, 12 nt, Homo sapiens
acuuugcuccuc

SEQ ID NO: 1610682 - RNA, 22 nt, Homo sapiens
acuuugguggccacauaagcca

SEQ ID NO: 1610683 - RNA, 14 nt, Homo sapiens
acuuuguacauuug

SEQ ID NO: 1610684 - RNA, 23 nt, Homo sapiens
acuuuguaucuucacugccaagc

SEQ ID NO: 1610685 - RNA, 17 nt, Homo sapiens
acuuuguguucauuuca

SEQ ID NO: 1610686 - RNA, 21 nt, Homo sapiens
acuuuuaaaaugaagcuuugg

SEQ ID NO: 1610687 - RNA, 23 nt, Homo sapiens
acuuuuauuuuuugguggugaaa

SEQ ID NO: 1610688 - RNA, 12 nt, Homo sapiens
acuuuuccugcu

SEQ ID NO: 1610689 - RNA, 18 nt, Homo sapiens
acuuuugaggacgcuggg

SEQ ID NO: 1610690 - RNA, 23 nt, Homo sapiens
acuuuugguaucuacuucuacau

SEQ ID NO: 1610691 - RNA, 22 nt, Homo sapiens
acuuuuguguaucguaaccagc

SEQ ID NO: 1610692 - RNA, 13 nt, Homo sapiens
acuuuuuggugga

SEQ ID NO: 1610693 - RNA, 20 nt, Homo sapiens
acuuuuuuagaaaugcaaaa

SEQ ID NO: 1610694 - RNA, 21 nt, Homo sapiens
acuuuuuuagaaaugcaaaau

SEQ ID NO: 1610695 - RNA, 18 nt, Homo sapiens
acuuuuuuuaaacugugg

SEQ ID NO: 1610696 - RNA, 14 nt, Homo sapiens
acuuuuuuuccuug

SEQ ID NO: 1610697 - RNA, 17 nt, Homo sapiens
agaaaaaaaauguaccc

SEQ ID NO: 1610698 - RNA, 18 nt, Homo sapiens
agaaaaacacaaacauuc

SEQ ID NO: 1610699 - RNA, 12 nt, Homo sapiens
agaaaaagccac

SEQ ID NO: 1610700 - RNA, 20 nt, Homo sapiens
agaaaaauauauacuaaaca

SEQ ID NO: 1610701 - RNA, 20 nt, Homo sapiens
agaaaaaugcuguuuauuca

SEQ ID NO: 1610702 - RNA, 15 nt, Homo sapiens
agaaaaccacaacua

SEQ ID NO: 1610703 - RNA, 13 nt, Homo sapiens
agaaaaccagcuu

SEQ ID NO: 1610704 - RNA, 18 nt, Homo sapiens
agaaaacucccaauacaa

SEQ ID NO: 1610705 - RNA, 16 nt, Homo sapiens
agaaaagaaauuaguu

SEQ ID NO: 1610706 - RNA, 17 nt, Homo sapiens
agaaaagcaauacuguu

SEQ ID NO: 1610707 - RNA, 15 nt, Homo sapiens
agaaaagccucucca

SEQ ID NO: 1610708 - RNA, 19 nt, Homo sapiens
agaaaaggacuccucagaa

SEQ ID NO: 1610709 - RNA, 14 nt, Homo sapiens
agaaaaucuaccaa

SEQ ID NO: 1610710 - RNA, 16 nt, Homo sapiens
agaaaauucuccugau

SEQ ID NO: 1610711 - RNA, 19 nt, Homo sapiens
agaaacaaaauccucagga

SEQ ID NO: 1610712 - RNA, 19 nt, Homo sapiens
agaaacaguugguaacuuu

SEQ ID NO: 1610713 - RNA, 13 nt, Homo sapiens
agaaacauuucag

SEQ ID NO: 1610714 - RNA, 14 nt, Homo sapiens
agaaacauuucaga

SEQ ID NO: 1610715 - RNA, 20 nt, Homo sapiens
agaaacccuaagccaagacc

SEQ ID NO: 1610716 - RNA, 14 nt, Homo sapiens
agaaacuucccaag

SEQ ID NO: 1610717 - RNA, 15 nt, Homo sapiens
agaaagaaugcaaga

SEQ ID NO: 1610718 - RNA, 14 nt, Homo sapiens
agaaagacuauuca

SEQ ID NO: 1610719 - RNA, 23 nt, Homo sapiens
agaaagacuauucaaacagucuc

SEQ ID NO: 1610720 - RNA, 16 nt, Homo sapiens
agaaagaugacaaaag

SEQ ID NO: 1610721 - RNA, 14 nt, Homo sapiens
agaaagauuugaug

SEQ ID NO: 1610722 - RNA, 12 nt, Homo sapiens
agaaagcaaaag

SEQ ID NO: 1610723 - RNA, 20 nt, Homo sapiens
agaaagccaacauguggcuc

SEQ ID NO: 1610724 - RNA, 20 nt, Homo sapiens
agaaagcucauggcuguguc

SEQ ID NO: 1610725 - RNA, 19 nt, Homo sapiens
agaaagcuccuuccagacc

SEQ ID NO: 1610726 - RNA, 20 nt, Homo sapiens
agaaagcugcacuggugcua

SEQ ID NO: 1610727 - RNA, 14 nt, Homo sapiens
agaaaggaaguaua

SEQ ID NO: 1610728 - RNA, 12 nt, Homo sapiens
agaaaguacaaa

SEQ ID NO: 1610729 - RNA, 16 nt, Homo sapiens
agaaagugaggcucag

SEQ ID NO: 1610730 - RNA, 20 nt, Homo sapiens
agaaaguuggccaauuucac

SEQ ID NO: 1610731 - RNA, 18 nt, Homo sapiens
agaaauaaggcuaaccau

SEQ ID NO: 1610732 - RNA, 14 nt, Homo sapiens
agaaauacagucuu

SEQ ID NO: 1610733 - RNA, 16 nt, Homo sapiens
agaaauauauccugug

SEQ ID NO: 1610734 - RNA, 14 nt, Homo sapiens
agaaaucaauggua

SEQ ID NO: 1610735 - RNA, 16 nt, Homo sapiens
agaaaucugugccuga

SEQ ID NO: 1610736 - RNA, 23 nt, Homo sapiens
agaaaucuugcuucagaccauca

SEQ ID NO: 1610737 - RNA, 15 nt, Homo sapiens
agaaaugacuguggu

SEQ ID NO: 1610738 - RNA, 22 nt, Homo sapiens
agaaaugauucaaauugcugcu

SEQ ID NO: 1610739 - RNA, 23 nt, Homo sapiens
agaaaugauucaaauugcugcuu

SEQ ID NO: 1610740 - RNA, 22 nt, Homo sapiens
agaaaugcaauaacucugggag

SEQ ID NO: 1610741 - RNA, 20 nt, Homo sapiens
agaaaugcauaccaguaauu

SEQ ID NO: 1610742 - RNA, 19 nt, Homo sapiens
agaaauguuggcauuuagu

SEQ ID NO: 1610743 - RNA, 17 nt, Homo sapiens
agaacacgauaaaccau

SEQ ID NO: 1610744 - RNA, 14 nt, Homo sapiens
agaacacuccaagc

SEQ ID NO: 1610745 - RNA, 16 nt, Homo sapiens
agaacagaggcauuua

SEQ ID NO: 1610746 - RNA, 15 nt, Homo sapiens
agaacagagucucag

SEQ ID NO: 1610747 - RNA, 14 nt, Homo sapiens
agaacaguaugaau

SEQ ID NO: 1610748 - RNA, 20 nt, Homo sapiens
agaacaucauuacuuaugau

SEQ ID NO: 1610749 - RNA, 13 nt, Homo sapiens
agaacaugcaguu

SEQ ID NO: 1610750 - RNA, 12 nt, Homo sapiens
agaaccaaaggg

SEQ ID NO: 1610751 - RNA, 23 nt, Homo sapiens
agaaccaccauagugaaguguga

SEQ ID NO: 1610752 - RNA, 19 nt, Homo sapiens
agaacccaguguuuccaca

SEQ ID NO: 1610753 - RNA, 19 nt, Homo sapiens
agaaccccugaaguauuuu

SEQ ID NO: 1610754 - RNA, 14 nt, Homo sapiens
agaaccuaaugcac

SEQ ID NO: 1610755 - RNA, 13 nt, Homo sapiens
agaaccuagaagg

SEQ ID NO: 1610756 - RNA, 17 nt, Homo sapiens
agaaccuuaaagaacca

SEQ ID NO: 1610757 - RNA, 20 nt, Homo sapiens
agaaccuuaaugacaacacu

SEQ ID NO: 1610758 - RNA, 15 nt, Homo sapiens
agaaccuucaaccca

SEQ ID NO: 1610759 - RNA, 15 nt, Homo sapiens
agaacguggugaccu

SEQ ID NO: 1610760 - RNA, 20 nt, Homo sapiens
agaacguggugaccuuucac

SEQ ID NO: 1610761 - RNA, 22 nt, Homo sapiens
acaggcaaauguacuucucacc

SEQ ID NO: 1610762 - RNA, 23 nt, Homo sapiens
acaggcaaauguacuucucaccc

SEQ ID NO: 1610763 - RNA, 13 nt, Homo sapiens
acaggcagucucu

SEQ ID NO: 1610764 - RNA, 21 nt, Homo sapiens
acaggccauugugaaccaaug

SEQ ID NO: 1610765 - RNA, 15 nt, Homo sapiens
acaggcgugagccac

SEQ ID NO: 1610766 - RNA, 22 nt, Homo sapiens
acaggcgugauccaccacaccu

SEQ ID NO: 1610767 - RNA, 19 nt, Homo sapiens
acagggacaugcccugugu

SEQ ID NO: 1610768 - RNA, 14 nt, Homo sapiens
acagggauucucac

SEQ ID NO: 1610769 - RNA, 13 nt, Homo sapiens
acaggggagaaaa

SEQ ID NO: 1610770 - RNA, 15 nt, Homo sapiens
acaggggcacaagcc

SEQ ID NO: 1610771 - RNA, 21 nt, Homo sapiens
acagguauuuuuuuaaaucaa

SEQ ID NO: 1610772 - RNA, 20 nt, Homo sapiens
acaggugcaacagacuugaa

SEQ ID NO: 1610773 - RNA, 17 nt, Homo sapiens
acaggugccuucccaga

SEQ ID NO: 1610774 - RNA, 20 nt, Homo sapiens
acagguguagaccagagugu

SEQ ID NO: 1610775 - RNA, 23 nt, Homo sapiens
acagguguuuuuccacaagugcc

SEQ ID NO: 1610776 - RNA, 18 nt, Homo sapiens
acaguacccaaacugcuu

SEQ ID NO: 1610777 - RNA, 13 nt, Homo sapiens
acaguacugauac

SEQ ID NO: 1610778 - RNA, 20 nt, Homo sapiens
acacacccauguaaccacug

SEQ ID NO: 1610779 - RNA, 13 nt, Homo sapiens
acacaccuagcca

SEQ ID NO: 1610780 - RNA, 23 nt, Homo sapiens
acacacggugccuuuauuuccac

SEQ ID NO: 1610781 - RNA, 21 nt, Homo sapiens
acacacuaacaucaauggcuu

SEQ ID NO: 1610782 - RNA, 12 nt, Homo sapiens
acacacugaguu

SEQ ID NO: 1610783 - RNA, 11 nt, Homo sapiens
acacacugugc

SEQ ID NO: 1610784 - RNA, 19 nt, Homo sapiens
acacagagcaggacugcac

SEQ ID NO: 1610785 - RNA, 14 nt, Homo sapiens
acacagcaucagcu

SEQ ID NO: 1610786 - RNA, 14 nt, Homo sapiens
acacagcauuguau

SEQ ID NO: 1610787 - RNA, 20 nt, Homo sapiens
acacagcccuggaaacauac

SEQ ID NO: 1610788 - RNA, 19 nt, Homo sapiens
acacaggaggcugaggcag

SEQ ID NO: 1610789 - RNA, 14 nt, Homo sapiens
acacagguguagac

SEQ ID NO: 1610790 - RNA, 13 nt, Homo sapiens
acacagugaugaa

SEQ ID NO: 1610791 - RNA, 23 nt, Homo sapiens
acacaguguuggagguuaaggca

SEQ ID NO: 1610792 - RNA, 14 nt, Homo sapiens
acacauagauucac

SEQ ID NO: 1610793 - RNA, 22 nt, Homo sapiens
acacaugauccugcaauuccac

SEQ ID NO: 1610794 - RNA, 18 nt, Homo sapiens
acacaugcacacaugugc

SEQ ID NO: 1610795 - RNA, 19 nt, Homo sapiens
acacauugacuccuuucca

SEQ ID NO: 1610796 - RNA, 13 nt, Homo sapiens
acacauugcugau

SEQ ID NO: 1610797 - RNA, 15 nt, Homo sapiens
aggccuagacucugu

SEQ ID NO: 1610798 - RNA, 13 nt, Homo sapiens
aggccucugagaa

SEQ ID NO: 1610799 - RNA, 21 nt, Homo sapiens
aggccugaaaugacauuucac

SEQ ID NO: 1610800 - RNA, 21 nt, Homo sapiens
aggccugccucccacuucacu

SEQ ID NO: 1610801 - RNA, 18 nt, Homo sapiens
aggccuggccucaucuca

SEQ ID NO: 1610802 - RNA, 20 nt, Homo sapiens
aggccugucccuugccucug

SEQ ID NO: 1610803 - RNA, 19 nt, Homo sapiens
aggcgcaguggcucaugcc

SEQ ID NO: 1610804 - RNA, 23 nt, Homo sapiens
aggcggccucgugccaugaucug

SEQ ID NO: 1610805 - RNA, 23 nt, Homo sapiens
aggcguuuguuauauaaaaauac

SEQ ID NO: 1610806 - RNA, 14 nt, Homo sapiens
aggcuaaaugagau

SEQ ID NO: 1610807 - RNA, 16 nt, Homo sapiens
aggcucaaccuuccaa

SEQ ID NO: 1610808 - RNA, 17 nt, Homo sapiens
aggcucagagaugugca

SEQ ID NO: 1610809 - RNA, 14 nt, Homo sapiens
aggcucagauuaaa

SEQ ID NO: 1610810 - RNA, 15 nt, Homo sapiens
aggcucagauuaaau

SEQ ID NO: 1610811 - RNA, 19 nt, Homo sapiens
aggcuccucacgggcgaug

SEQ ID NO: 1610812 - RNA, 21 nt, Homo sapiens
aggcucugugggaggaugaag

SEQ ID NO: 1610813 - RNA, 15 nt, Homo sapiens
aggcugacauucacu

SEQ ID NO: 1610814 - RNA, 19 nt, Homo sapiens
aggcugacauucacugagu

SEQ ID NO: 1610815 - RNA, 17 nt, Homo sapiens
aggcugaggcaggagaa

SEQ ID NO: 1610816 - RNA, 21 nt, Homo sapiens
aggcugccccauugagaucuu

SEQ ID NO: 1610817 - RNA, 15 nt, Homo sapiens
aggcugccccucuca

SEQ ID NO: 1610818 - RNA, 19 nt, Homo sapiens
aggcugccccucucaccaa

SEQ ID NO: 1610819 - RNA, 23 nt, Homo sapiens
aggcuggaaggcagcaggcauuu

SEQ ID NO: 1610820 - RNA, 12 nt, Homo sapiens
aggcugggccau

SEQ ID NO: 1610821 - RNA, 21 nt, Homo sapiens
aggcugggccauguccaaaga

SEQ ID NO: 1610822 - RNA, 23 nt, Homo sapiens
aggcugggccauguccaaagagg

SEQ ID NO: 1610823 - RNA, 19 nt, Homo sapiens
aggcugugccaucagcucc

SEQ ID NO: 1610824 - RNA, 18 nt, Homo sapiens
aggcuguuugagaaccau

SEQ ID NO: 1610825 - RNA, 14 nt, Homo sapiens
aggcuuacugagcu

SEQ ID NO: 1610826 - RNA, 18 nt, Homo sapiens
aggcuucuauuaccuauu

SEQ ID NO: 1610827 - RNA, 17 nt, Homo sapiens
aggcuuuauguacaaac

SEQ ID NO: 1610828 - RNA, 11 nt, Homo sapiens
aggcuuucaug

SEQ ID NO: 1610829 - RNA, 23 nt, Homo sapiens
agggaaaacaaauauuucacuua

SEQ ID NO: 1610830 - RNA, 22 nt, Homo sapiens
agggaacggcgaugaacaaaug

SEQ ID NO: 1610831 - RNA, 18 nt, Homo sapiens
agggaauaauauucaaua

SEQ ID NO: 1610832 - RNA, 18 nt, Homo sapiens
agggaaugggucugcaca

SEQ ID NO: 1610833 - RNA, 15 nt, Homo sapiens
agggagaagagggaa

SEQ ID NO: 1610834 - RNA, 20 nt, Homo sapiens
agggagacagccagguggca

SEQ ID NO: 1610835 - RNA, 15 nt, Homo sapiens
agggagaccaugccu

SEQ ID NO: 1610836 - RNA, 21 nt, Homo sapiens
agggagacccccaucuuuaca

SEQ ID NO: 1610837 - RNA, 14 nt, Homo sapiens
agggagacucagcc

SEQ ID NO: 1610838 - RNA, 13 nt, Homo sapiens
agggagaugccau

SEQ ID NO: 1610839 - RNA, 12 nt, Homo sapiens
agggagugucag

SEQ ID NO: 1610840 - RNA, 16 nt, Homo sapiens
agggauaauuggugca

SEQ ID NO: 1610841 - RNA, 18 nt, Homo sapiens
agggaugauucaagccau

SEQ ID NO: 1610842 - RNA, 22 nt, Homo sapiens
agggauuuaauacguacuuuag

SEQ ID NO: 1610843 - RNA, 12 nt, Homo sapiens
agggcacaagcu

SEQ ID NO: 1610844 - RNA, 11 nt, Homo sapiens
agggcacugaa

SEQ ID NO: 1610845 - RNA, 13 nt, Homo sapiens
agggcacugugau

SEQ ID NO: 1610846 - RNA, 22 nt, Homo sapiens
agggcagaauaaauaagcaaaa

SEQ ID NO: 1610847 - RNA, 20 nt, Homo sapiens
agggcauucuuucccaguga

SEQ ID NO: 1610848 - RNA, 23 nt, Homo sapiens
agggccaggccucugcuggcuca

SEQ ID NO: 1610849 - RNA, 19 nt, Homo sapiens
agggcccacccaugucacc

SEQ ID NO: 1610850 - RNA, 14 nt, Homo sapiens
agggcccuaccuga

SEQ ID NO: 1610851 - RNA, 20 nt, Homo sapiens
agggccguugcccccagacu

SEQ ID NO: 1610852 - RNA, 20 nt, Homo sapiens
agggcggggguugcgucuca

SEQ ID NO: 1610853 - RNA, 23 nt, Homo sapiens
agggcuagaaccuggagagcuag

SEQ ID NO: 1610854 - RNA, 23 nt, Homo sapiens
agggcuagaaucuggagagcuag

SEQ ID NO: 1610855 - RNA, 16 nt, Homo sapiens
agggcucccuaaacuu

SEQ ID NO: 1610856 - RNA, 16 nt, Homo sapiens
agggcugcaggggauu

SEQ ID NO: 1610857 - RNA, 15 nt, Homo sapiens
agggcugccuuugga

SEQ ID NO: 1610858 - RNA, 23 nt, Homo sapiens
agggcugcgacgcuugcucuguu

SEQ ID NO: 1610859 - RNA, 16 nt, Homo sapiens
aggggaacacaggccc

SEQ ID NO: 1610860 - RNA, 18 nt, Homo sapiens
aggggcaaccaacugccc

SEQ ID NO: 1610861 - RNA, 13 nt, Homo sapiens
aggggcagccaca

SEQ ID NO: 1610862 - RNA, 22 nt, Homo sapiens
aggggccaauuuuggaugagca

SEQ ID NO: 1610863 - RNA, 15 nt, Homo sapiens
aggggcucucucaug

SEQ ID NO: 1610864 - RNA, 23 nt, Homo sapiens
aggggcugcagggccacuggaag

SEQ ID NO: 1610865 - RNA, 18 nt, Homo sapiens
aggggcuugggccugcac

SEQ ID NO: 1610866 - RNA, 22 nt, Homo sapiens
aggggugggauccacacugaga

SEQ ID NO: 1610867 - RNA, 23 nt, Homo sapiens
aggguaaauaaaccacugugcgu

SEQ ID NO: 1610868 - RNA, 18 nt, Homo sapiens
aggguacagaugugcugu

SEQ ID NO: 1610869 - RNA, 17 nt, Homo sapiens
aggguaccgucuucucc

SEQ ID NO: 1610870 - RNA, 14 nt, Homo sapiens
agggucacuggccu

SEQ ID NO: 1610871 - RNA, 13 nt, Homo sapiens
aggguccagugga

SEQ ID NO: 1610872 - RNA, 16 nt, Homo sapiens
agggucuaagcaccuu

SEQ ID NO: 1610873 - RNA, 16 nt, Homo sapiens
agggucuuugguguuu

SEQ ID NO: 1610874 - RNA, 19 nt, Homo sapiens
agggugacguuagcauuac

SEQ ID NO: 1610875 - RNA, 18 nt, Homo sapiens
agggugacugaugauaca

SEQ ID NO: 1610876 - RNA, 15 nt, Homo sapiens
aggguggggauauca

SEQ ID NO: 1610877 - RNA, 19 nt, Homo sapiens
aggguguaauggagcauca

SEQ ID NO: 1610878 - RNA, 23 nt, Homo sapiens
agggugucacgagcccauucuca

SEQ ID NO: 1610879 - RNA, 14 nt, Homo sapiens
aggguuccaaaggg

SEQ ID NO: 1610880 - RNA, 15 nt, Homo sapiens
aggguucuaaaugca

SEQ ID NO: 1610881 - RNA, 13 nt, Homo sapiens
aggguugccugua

SEQ ID NO: 1610882 - RNA, 22 nt, Homo sapiens
aggguuuuaaacacuaaucaca

SEQ ID NO: 1610883 - RNA, 13 nt, Homo sapiens
agguaaaccaaac

SEQ ID NO: 1610884 - RNA, 15 nt, Homo sapiens
agguaacacuacaga

SEQ ID NO: 1610885 - RNA, 15 nt, Homo sapiens
agguaacucuuugca

SEQ ID NO: 1610886 - RNA, 17 nt, Homo sapiens
agguaauucuagccuuu

SEQ ID NO: 1610887 - RNA, 18 nt, Homo sapiens
agguacugagagugaaca

SEQ ID NO: 1610888 - RNA, 16 nt, Homo sapiens
agguagcucggcacca

SEQ ID NO: 1610889 - RNA, 15 nt, Homo sapiens
aggucagaaguucaa

SEQ ID NO: 1610890 - RNA, 13 nt, Homo sapiens
aggucagcaguau

SEQ ID NO: 1610891 - RNA, 21 nt, Homo sapiens
aggucagcccagccccuccaa

SEQ ID NO: 1610892 - RNA, 20 nt, Homo sapiens
aggucagcgcgguccugacu

SEQ ID NO: 1610893 - RNA, 13 nt, Homo sapiens
aggucaggacggc

SEQ ID NO: 1610894 - RNA, 14 nt, Homo sapiens
aggucagggagcaa

SEQ ID NO: 1610895 - RNA, 19 nt, Homo sapiens
aggucauugcaccuaucuc

SEQ ID NO: 1610896 - RNA, 21 nt, Homo sapiens
agguccuuauguccugucaua

SEQ ID NO: 1610897 - RNA, 16 nt, Homo sapiens
aggucgaggcuacagu

SEQ ID NO: 1610898 - RNA, 15 nt, Homo sapiens
aggucuacagugaua

SEQ ID NO: 1610899 - RNA, 18 nt, Homo sapiens
aggucuagaaaaccagcu

SEQ ID NO: 1610900 - RNA, 17 nt, Homo sapiens
aggucuccaaaccagac

SEQ ID NO: 1610901 - RNA, 19 nt, Homo sapiens
aggucuccaccugcacauu

SEQ ID NO: 1610902 - RNA, 20 nt, Homo sapiens
aggucuguuuaaaguggcaa

SEQ ID NO: 1610903 - RNA, 14 nt, Homo sapiens
aggugacaaccauu

SEQ ID NO: 1610904 - RNA, 15 nt, Homo sapiens
aggugcagucuuuga

SEQ ID NO: 1610905 - RNA, 20 nt, Homo sapiens
aggugcuacaaaaacacagc

SEQ ID NO: 1610906 - RNA, 13 nt, Homo sapiens
aggugcucugugg

SEQ ID NO: 1610907 - RNA, 20 nt, Homo sapiens
aggugcuguccccacugccc

SEQ ID NO: 1610908 - RNA, 21 nt, Homo sapiens
agguggaaaaacagcauguac

SEQ ID NO: 1610909 - RNA, 14 nt, Homo sapiens
aggaaagugguugu

SEQ ID NO: 1610910 - RNA, 19 nt, Homo sapiens
aggaaaguuugccaggagg

SEQ ID NO: 1610911 - RNA, 23 nt, Homo sapiens
aggaaauauuaagagcuauuuua

SEQ ID NO: 1610912 - RNA, 22 nt, Homo sapiens
aggaaaucaaauaugcaaagca

SEQ ID NO: 1610913 - RNA, 13 nt, Homo sapiens
aggaaauguggaa

SEQ ID NO: 1610914 - RNA, 22 nt, Homo sapiens
aggaacaaaaagguaaauccca

SEQ ID NO: 1610915 - RNA, 17 nt, Homo sapiens
aggaacaaauaaacuca

SEQ ID NO: 1610916 - RNA, 21 nt, Homo sapiens
aggaacagcaaaugcaaaaac

SEQ ID NO: 1610917 - RNA, 14 nt, Homo sapiens
aggaacauggagcu

SEQ ID NO: 1610918 - RNA, 12 nt, Homo sapiens
aggaaccuacca

SEQ ID NO: 1610919 - RNA, 19 nt, Homo sapiens
aggaaccucgaguacugug

SEQ ID NO: 1610920 - RNA, 13 nt, Homo sapiens
aggaaccuuccuu

SEQ ID NO: 1610921 - RNA, 17 nt, Homo sapiens
aggaacuagaaagaagg

SEQ ID NO: 1610922 - RNA, 23 nt, Homo sapiens
aggaacuugcccugagcacuccu

SEQ ID NO: 1610923 - RNA, 15 nt, Homo sapiens
aggaagaaugaaacu

SEQ ID NO: 1610924 - RNA, 14 nt, Homo sapiens
aggaagacuugaag

SEQ ID NO: 1610925 - RNA, 11 nt, Homo sapiens
aggaagcaagc

SEQ ID NO: 1610926 - RNA, 18 nt, Homo sapiens
aggaagcaccccaugcca

SEQ ID NO: 1610927 - RNA, 18 nt, Homo sapiens
aggaagccgccaguacuu

SEQ ID NO: 1610928 - RNA, 15 nt, Homo sapiens
aggaagcuacccaag

SEQ ID NO: 1610929 - RNA, 12 nt, Homo sapiens
aggaaggauuuu

SEQ ID NO: 1610930 - RNA, 23 nt, Homo sapiens
aggaagggcugggccaccaggga

SEQ ID NO: 1610931 - RNA, 17 nt, Homo sapiens
aggaaguagcugucaga

SEQ ID NO: 1610932 - RNA, 17 nt, Homo sapiens
aggaaguaucagcacua

SEQ ID NO: 1610933 - RNA, 15 nt, Homo sapiens
aggaauacauugcaa

SEQ ID NO: 1610934 - RNA, 15 nt, Homo sapiens
aggaauacauuuuau

SEQ ID NO: 1610935 - RNA, 17 nt, Homo sapiens
aggaauauacauagucu

SEQ ID NO: 1610936 - RNA, 14 nt, Homo sapiens
aggaaucagcucaa

SEQ ID NO: 1610937 - RNA, 13 nt, Homo sapiens
aggaauccuggac

SEQ ID NO: 1610938 - RNA, 24 nt, Homo sapiens
aggaauccuggaccaagcacaaaa

SEQ ID NO: 1610939 - RNA, 22 nt, Homo sapiens
aggaaugacuuggguuuaacaa

SEQ ID NO: 1610940 - RNA, 18 nt, Homo sapiens
aggaauggugcguggcuu

SEQ ID NO: 1610941 - RNA, 14 nt, Homo sapiens
aggaauuaaagaca

SEQ ID NO: 1610942 - RNA, 22 nt, Homo sapiens
aggaauuacgugcucugugggu

SEQ ID NO: 1610943 - RNA, 22 nt, Homo sapiens
aggaauucuaaauaaauuuccc

SEQ ID NO: 1610944 - RNA, 17 nt, Homo sapiens
aggacaaguuuuaguua

SEQ ID NO: 1610945 - RNA, 13 nt, Homo sapiens
aggacacagugau

SEQ ID NO: 1610946 - RNA, 15 nt, Homo sapiens
aggacagaacagugu

SEQ ID NO: 1610947 - RNA, 17 nt, Homo sapiens
aggacagaauguguucu

SEQ ID NO: 1610948 - RNA, 20 nt, Homo sapiens
aggacauucuacaaaauauc

SEQ ID NO: 1610949 - RNA, 23 nt, Homo sapiens
aggaccccucgccuucaggagaa

SEQ ID NO: 1610950 - RNA, 22 nt, Homo sapiens
aggaccuuucugaggaguaaaa

SEQ ID NO: 1610951 - RNA, 23 nt, Homo sapiens
aggacgccacucauuucaucuca

SEQ ID NO: 1610952 - RNA, 13 nt, Homo sapiens
aggacucagcaca

SEQ ID NO: 1610953 - RNA, 11 nt, Homo sapiens
aggacucuucc

SEQ ID NO: 1610954 - RNA, 20 nt, Homo sapiens
aggacucuuuccgacugccc

SEQ ID NO: 1610955 - RNA, 14 nt, Homo sapiens
aggacugggccacu

SEQ ID NO: 1610956 - RNA, 21 nt, Homo sapiens
aggacuguuuuauaaacugcu

SEQ ID NO: 1610957 - RNA, 17 nt, Homo sapiens
aggacuucugcagcuau

SEQ ID NO: 1610958 - RNA, 13 nt, Homo sapiens
aggagaaacugag

SEQ ID NO: 1610959 - RNA, 21 nt, Homo sapiens
aggagaaccacuacaugcagc

SEQ ID NO: 1610960 - RNA, 14 nt, Homo sapiens
aggagacauugcuc

SEQ ID NO: 1610961 - RNA, 22 nt, Homo sapiens
aggagaccauuuguauuaccau

SEQ ID NO: 1610962 - RNA, 22 nt, Homo sapiens
aggagacgggggagcagcacga

SEQ ID NO: 1610963 - RNA, 21 nt, Homo sapiens
aggagacuuaggaaccuacca

SEQ ID NO: 1610964 - RNA, 23 nt, Homo sapiens
aggagacuuucaugcagccuaaa

SEQ ID NO: 1610965 - RNA, 14 nt, Homo sapiens
aggagagugagugc

SEQ ID NO: 1610966 - RNA, 17 nt, Homo sapiens
aggagagugagugccuu

SEQ ID NO: 1610967 - RNA, 12 nt, Homo sapiens
aggagauuacaa

SEQ ID NO: 1610968 - RNA, 22 nt, Homo sapiens
aggagauuccuucauaaaacuc

SEQ ID NO: 1610969 - RNA, 18 nt, Homo sapiens
aggagccaccaguucuca

SEQ ID NO: 1610970 - RNA, 19 nt, Homo sapiens
aggagccucacuggggcag

SEQ ID NO: 1610971 - RNA, 19 nt, Homo sapiens
aggagccuuuugcucucug

SEQ ID NO: 1610972 - RNA, 15 nt, Homo sapiens
aggagcgcuacccac

SEQ ID NO: 1610973 - RNA, 14 nt, Homo sapiens
aggagcugggccag

SEQ ID NO: 1610974 - RNA, 13 nt, Homo sapiens
aggaggaacaaag

SEQ ID NO: 1610975 - RNA, 13 nt, Homo sapiens
aggaggaauuuac

SEQ ID NO: 1610976 - RNA, 17 nt, Homo sapiens
aggaggcuggcagguau

SEQ ID NO: 1610977 - RNA, 15 nt, Homo sapiens
aggaggcuggugaca

SEQ ID NO: 1610978 - RNA, 14 nt, Homo sapiens
aggagggaggugcu

SEQ ID NO: 1610979 - RNA, 16 nt, Homo sapiens
aggagggcccuaccug

SEQ ID NO: 1610980 - RNA, 23 nt, Homo sapiens
aggaggugaccaaaucaguguga

SEQ ID NO: 1610981 - RNA, 16 nt, Homo sapiens
aggagucaaaacuaca

SEQ ID NO: 1610982 - RNA, 21 nt, Homo sapiens
aggagucccugccaucauguu

SEQ ID NO: 1610983 - RNA, 19 nt, Homo sapiens
aggaguguccucuucccuc

SEQ ID NO: 1610984 - RNA, 17 nt, Homo sapiens
aggaguguccugcccau

SEQ ID NO: 1610985 - RNA, 18 nt, Homo sapiens
aggagugugaccacugaa

SEQ ID NO: 1610986 - RNA, 22 nt, Homo sapiens
aggaguuacagggaaguggucu

SEQ ID NO: 1610987 - RNA, 15 nt, Homo sapiens
aggaguuagaaccac

SEQ ID NO: 1610988 - RNA, 18 nt, Homo sapiens
aggaguucaagaccagcc

SEQ ID NO: 1610989 - RNA, 23 nt, Homo sapiens
aggauaacuggcacccagagaaa

SEQ ID NO: 1610990 - RNA, 15 nt, Homo sapiens
aggauaagagggauu

SEQ ID NO: 1610991 - RNA, 13 nt, Homo sapiens
aggauacccagau

SEQ ID NO: 1610992 - RNA, 23 nt, Homo sapiens
aggaugaaucauauucauaugca

SEQ ID NO: 1610993 - RNA, 21 nt, Homo sapiens
aggauggaacaucaguggaug

SEQ ID NO: 1610994 - RNA, 16 nt, Homo sapiens
aggaugggggaugugg

SEQ ID NO: 1610995 - RNA, 16 nt, Homo sapiens
aggaugguucugugac

SEQ ID NO: 1610996 - RNA, 23 nt, Homo sapiens
aggauuauuuuaaauacaaaagg

SEQ ID NO: 1610997 - RNA, 22 nt, Homo sapiens
aggauuuucuuuuuaacuuuac

SEQ ID NO: 1610998 - RNA, 20 nt, Homo sapiens
aggcaagcugaaauuuuaga

SEQ ID NO: 1610999 - RNA, 15 nt, Homo sapiens
aggcaauccuaccuu

SEQ ID NO: 1611000 - RNA, 21 nt, Homo sapiens
aggcaauuccugauggaaaau

SEQ ID NO: 1611001 - RNA, 15 nt, Homo sapiens
aggcacacacugugc

SEQ ID NO: 1611002 - RNA, 13 nt, Homo sapiens
aggcaccaggaag

SEQ ID NO: 1611003 - RNA, 18 nt, Homo sapiens
aggcaccaguccagcaaa

SEQ ID NO: 1611004 - RNA, 23 nt, Homo sapiens
aggcagaucugugccccaugccu

SEQ ID NO: 1611005 - RNA, 15 nt, Homo sapiens
aggcagccacagaca

SEQ ID NO: 1611006 - RNA, 16 nt, Homo sapiens
aggcagcuaagacaua

SEQ ID NO: 1611007 - RNA, 18 nt, Homo sapiens
aggcagcugauccaggca

SEQ ID NO: 1611008 - RNA, 20 nt, Homo sapiens
aggcagcugccucugcuccc

SEQ ID NO: 1611009 - RNA, 19 nt, Homo sapiens
aggcagcuucuacuccugc

SEQ ID NO: 1611010 - RNA, 17 nt, Homo sapiens
aggcaggagaauggugu

SEQ ID NO: 1611011 - RNA, 22 nt, Homo sapiens
aggcagguacagguagugggcu

SEQ ID NO: 1611012 - RNA, 20 nt, Homo sapiens
aggcauacugccuuguuuaa

SEQ ID NO: 1611013 - RNA, 19 nt, Homo sapiens
aggcauaugcacagucaag

SEQ ID NO: 1611014 - RNA, 21 nt, Homo sapiens
aggcaucauacuaaacuucac

SEQ ID NO: 1611015 - RNA, 13 nt, Homo sapiens
aggccaacagcac

SEQ ID NO: 1611016 - RNA, 15 nt, Homo sapiens
aggccaacagcaccu

SEQ ID NO: 1611017 - RNA, 17 nt, Homo sapiens
aggccaagaacuugcaa

SEQ ID NO: 1611018 - RNA, 11 nt, Homo sapiens
aggccacagaa

SEQ ID NO: 1611019 - RNA, 20 nt, Homo sapiens
aggccacccccuauccucug

SEQ ID NO: 1611020 - RNA, 21 nt, Homo sapiens
agccugcucauguaccucuga

SEQ ID NO: 1611021 - RNA, 18 nt, Homo sapiens
agccugcuggcacccacc

SEQ ID NO: 1611022 - RNA, 17 nt, Homo sapiens
agccuggacaccucuca

SEQ ID NO: 1611023 - RNA, 13 nt, Homo sapiens
agccuggaugcca

SEQ ID NO: 1611024 - RNA, 18 nt, Homo sapiens
agccuggccaacauggug

SEQ ID NO: 1611025 - RNA, 14 nt, Homo sapiens
agccugggcaacau

SEQ ID NO: 1611026 - RNA, 17 nt, Homo sapiens
agccuggguuaaguauu

SEQ ID NO: 1611027 - RNA, 19 nt, Homo sapiens
agccuggucaacauaguga

SEQ ID NO: 1611028 - RNA, 17 nt, Homo sapiens
agccuucaagugccaaa

SEQ ID NO: 1611029 - RNA, 15 nt, Homo sapiens
agccuugcucucuuc

SEQ ID NO: 1611030 - RNA, 17 nt, Homo sapiens
agccuugcucucuucaa

SEQ ID NO: 1611031 - RNA, 17 nt, Homo sapiens
agccuuggcucuacccu

SEQ ID NO: 1611032 - RNA, 22 nt, Homo sapiens
agccuugucuucuuagcuguca

SEQ ID NO: 1611033 - RNA, 21 nt, Homo sapiens
agccuugugugaacucaccaa

SEQ ID NO: 1611034 - RNA, 19 nt, Homo sapiens
agccuuuaucuaugggaga

SEQ ID NO: 1611035 - RNA, 11 nt, Homo sapiens
agccuuuccag

SEQ ID NO: 1611036 - RNA, 14 nt, Homo sapiens
agccuuuugcucuc

SEQ ID NO: 1611037 - RNA, 12 nt, Homo sapiens
agcgacagugag

SEQ ID NO: 1611038 - RNA, 13 nt, Homo sapiens
agcgagacuccac

SEQ ID NO: 1611039 - RNA, 17 nt, Homo sapiens
agcgagacuccaucucu

SEQ ID NO: 1611040 - RNA, 16 nt, Homo sapiens
agcgcaugcuggugca

SEQ ID NO: 1611041 - RNA, 19 nt, Homo sapiens
agcgccacacacugcacau

SEQ ID NO: 1611042 - RNA, 13 nt, Homo sapiens
agcgcgaugaacg

SEQ ID NO: 1611043 - RNA, 22 nt, Homo sapiens
agcgcucgauggaccucagcaa

SEQ ID NO: 1611044 - RNA, 14 nt, Homo sapiens
agcgcuuugaauau

SEQ ID NO: 1611045 - RNA, 22 nt, Homo sapiens
agcggcccuaagggagugucua

SEQ ID NO: 1611046 - RNA, 18 nt, Homo sapiens
agcggguaaagugcaaug

SEQ ID NO: 1611047 - RNA, 19 nt, Homo sapiens
agcgguaucucuggcacca

SEQ ID NO: 1611048 - RNA, 21 nt, Homo sapiens
agcgugcaguagagagcaaag

SEQ ID NO: 1611049 - RNA, 17 nt, Homo sapiens
agcgugugagugaggga

SEQ ID NO: 1611050 - RNA, 19 nt, Homo sapiens
agcguuccuagagaagaca

SEQ ID NO: 1611051 - RNA, 14 nt, Homo sapiens
agcuaagauuaucu

SEQ ID NO: 1611052 - RNA, 18 nt, Homo sapiens
agcuaaggaggggaaaaa

SEQ ID NO: 1611053 - RNA, 17 nt, Homo sapiens
agcuaaguacacaauaa

SEQ ID NO: 1611054 - RNA, 21 nt, Homo sapiens
agcuacaagugcagcugugac

SEQ ID NO: 1611055 - RNA, 11 nt, Homo sapiens
agcuacagugu

SEQ ID NO: 1611056 - RNA, 14 nt, Homo sapiens
agcuacucucccca

SEQ ID NO: 1611057 - RNA, 12 nt, Homo sapiens
agcuacuggaau

SEQ ID NO: 1611058 - RNA, 21 nt, Homo sapiens
agcuagaagugggccaggaca

SEQ ID NO: 1611059 - RNA, 19 nt, Homo sapiens
agcuagaugugucuuacca

SEQ ID NO: 1611060 - RNA, 21 nt, Homo sapiens
agcuagcaacauuuguuuuag

SEQ ID NO: 1611061 - RNA, 15 nt, Homo sapiens
agcuaggaugguucu

SEQ ID NO: 1611062 - RNA, 19 nt, Homo sapiens
agcuaggaugguucuguga

SEQ ID NO: 1611063 - RNA, 21 nt, Homo sapiens
agcuaggaugguucugugacc

SEQ ID NO: 1611064 - RNA, 14 nt, Homo sapiens
agcuagugccuuua

SEQ ID NO: 1611065 - RNA, 14 nt, Homo sapiens
agcuauaacuaagc

SEQ ID NO: 1611066 - RNA, 16 nt, Homo sapiens
agcuauaacuaagcau

SEQ ID NO: 1611067 - RNA, 15 nt, Homo sapiens
agcuaugaaaccacu

SEQ ID NO: 1611068 - RNA, 17 nt, Homo sapiens
agcuaugaaaccacugc

SEQ ID NO: 1611069 - RNA, 17 nt, Homo sapiens
agcuaugcuguaucugu

SEQ ID NO: 1611070 - RNA, 17 nt, Homo sapiens
agcuaugggagccccag

SEQ ID NO: 1611071 - RNA, 16 nt, Homo sapiens
agcuauuucauuugcu

SEQ ID NO: 1611072 - RNA, 10 nt, Homo sapiens
agcucaccag

SEQ ID NO: 1611073 - RNA, 23 nt, Homo sapiens
agcucacuaggccgauccugcug

SEQ ID NO: 1611074 - RNA, 19 nt, Homo sapiens
agcucauccaugccucaga

SEQ ID NO: 1611075 - RNA, 16 nt, Homo sapiens
agcucaucugcaaaag

SEQ ID NO: 1611076 - RNA, 17 nt, Homo sapiens
agcuccagcgauggugc

SEQ ID NO: 1611077 - RNA, 14 nt, Homo sapiens
agcuccaucaauga

SEQ ID NO: 1611078 - RNA, 17 nt, Homo sapiens
agcuccucaaagccuca

SEQ ID NO: 1611079 - RNA, 16 nt, Homo sapiens
agcucgcauuugucaa

SEQ ID NO: 1611080 - RNA, 23 nt, Homo sapiens
agcucugccucccucuccauauc

SEQ ID NO: 1611081 - RNA, 17 nt, Homo sapiens
agcucugcgccaaucac

SEQ ID NO: 1611082 - RNA, 15 nt, Homo sapiens
agcucuguugaauca

SEQ ID NO: 1611083 - RNA, 19 nt, Homo sapiens
agcucuucucccagaugua

SEQ ID NO: 1611084 - RNA, 20 nt, Homo sapiens
agcugagauugcaccacugc

SEQ ID NO: 1611085 - RNA, 16 nt, Homo sapiens
agcugagauugcacua

SEQ ID NO: 1611086 - RNA, 20 nt, Homo sapiens
agcugagauugcacuauugc

SEQ ID NO: 1611087 - RNA, 22 nt, Homo sapiens
agcugagugacugcagcuugcc

SEQ ID NO: 1611088 - RNA, 15 nt, Homo sapiens
agcugauucacuaug

SEQ ID NO: 1611089 - RNA, 16 nt, Homo sapiens
agcugauuccagaaca

SEQ ID NO: 1611090 - RNA, 13 nt, Homo sapiens
agcugcaaagugu

SEQ ID NO: 1611091 - RNA, 19 nt, Homo sapiens
agcugccuucccuagcuuu

SEQ ID NO: 1611092 - RNA, 19 nt, Homo sapiens
agcugcuauccccaucucc

SEQ ID NO: 1611093 - RNA, 11 nt, Homo sapiens
agcugcucccc

SEQ ID NO: 1611094 - RNA, 16 nt, Homo sapiens
agcugcugaaacugua

SEQ ID NO: 1611095 - RNA, 16 nt, Homo sapiens
agcugcuggaugacuu

SEQ ID NO: 1611096 - RNA, 16 nt, Homo sapiens
agcugcugucacuaga

SEQ ID NO: 1611097 - RNA, 15 nt, Homo sapiens
agcugcuuccagugu

SEQ ID NO: 1611098 - RNA, 22 nt, Homo sapiens
agcuggagucugucaauguccu

SEQ ID NO: 1611099 - RNA, 21 nt, Homo sapiens
agcuggcagacucgggaccaa

SEQ ID NO: 1611100 - RNA, 16 nt, Homo sapiens
agcuggcgcucagcag

SEQ ID NO: 1611101 - RNA, 13 nt, Homo sapiens
agcugggagacaa

SEQ ID NO: 1611102 - RNA, 12 nt, Homo sapiens
agcugggagcac

SEQ ID NO: 1611103 - RNA, 16 nt, Homo sapiens
agcugggagcacuggu

SEQ ID NO: 1611104 - RNA, 17 nt, Homo sapiens
agcugggagcacuggug

SEQ ID NO: 1611105 - RNA, 19 nt, Homo sapiens
agcuggggaugucucucau

SEQ ID NO: 1611106 - RNA, 19 nt, Homo sapiens
agcuggggcgcgaugucaa

SEQ ID NO: 1611107 - RNA, 18 nt, Homo sapiens
agcugguucaguacuguc

SEQ ID NO: 1611108 - RNA, 21 nt, Homo sapiens
agcuguaagauaauguugcuu

SEQ ID NO: 1611109 - RNA, 22 nt, Homo sapiens
agcuguacucuucugacugccc

SEQ ID NO: 1611110 - RNA, 15 nt, Homo sapiens
agcugucaccucuca

SEQ ID NO: 1611111 - RNA, 14 nt, Homo sapiens
agcuguguucacag

SEQ ID NO: 1611112 - RNA, 15 nt, Homo sapiens
agcuguuaccauuca

SEQ ID NO: 1611113 - RNA, 22 nt, Homo sapiens
agcuguuccuccuaaaacaauc

SEQ ID NO: 1611114 - RNA, 13 nt, Homo sapiens
agcuguugaucuu

SEQ ID NO: 1611115 - RNA, 16 nt, Homo sapiens
agcuguugaucuuuca

SEQ ID NO: 1611116 - RNA, 15 nt, Homo sapiens
agcuuaagaaccauu

SEQ ID NO: 1611117 - RNA, 16 nt, Homo sapiens
agcuuacuagcacuuu

SEQ ID NO: 1611118 - RNA, 23 nt, Homo sapiens
agcuucagcaggaggcaagcgug

SEQ ID NO: 1611119 - RNA, 22 nt, Homo sapiens
agcuucaggagggaaccagcuu

SEQ ID NO: 1611120 - RNA, 21 nt, Homo sapiens
agcuucauauaccagcaauau

SEQ ID NO: 1611121 - RNA, 20 nt, Homo sapiens
agcuugccaaaucuuugugu

SEQ ID NO: 1611122 - RNA, 15 nt, Homo sapiens
agcuuggacuacaca

SEQ ID NO: 1611123 - RNA, 17 nt, Homo sapiens
agcuuggacuacacaau

SEQ ID NO: 1611124 - RNA, 15 nt, Homo sapiens
agcuuggagggaugg

SEQ ID NO: 1611125 - RNA, 20 nt, Homo sapiens
agcuuuaggcagagccauaa

SEQ ID NO: 1611126 - RNA, 20 nt, Homo sapiens
agcuuuaucugucuugacuu

SEQ ID NO: 1611127 - RNA, 14 nt, Homo sapiens
agcuuucagauuau

SEQ ID NO: 1611128 - RNA, 15 nt, Homo sapiens
agcuuuccucaaaaa

SEQ ID NO: 1611129 - RNA, 18 nt, Homo sapiens
agcuuuccuggaggaaaa

SEQ ID NO: 1611130 - RNA, 16 nt, Homo sapiens
agcuuuguauguuuau

SEQ ID NO: 1611131 - RNA, 12 nt, Homo sapiens
agcuuugucacu

SEQ ID NO: 1611132 - RNA, 23 nt, Homo sapiens
agcuuugugaaaacuacugaugu

SEQ ID NO: 1611133 - RNA, 21 nt, Homo sapiens
agcuuuucccaggagaccauu

SEQ ID NO: 1611134 - RNA, 22 nt, Homo sapiens
agcuuuuugcagauaacaaaca

SEQ ID NO: 1611135 - RNA, 17 nt, Homo sapiens
aggaaaaacaugagcau

SEQ ID NO: 1611136 - RNA, 19 nt, Homo sapiens
aggaaaacacuauuuccaa

SEQ ID NO: 1611137 - RNA, 13 nt, Homo sapiens
aggaaaaggcccc

SEQ ID NO: 1611138 - RNA, 17 nt, Homo sapiens
aggaaaagguugaauaa

SEQ ID NO: 1611139 - RNA, 16 nt, Homo sapiens
agcauuacauuauuaa

SEQ ID NO: 1611140 - RNA, 23 nt, Homo sapiens
agcauuacccuccucucucccca

SEQ ID NO: 1611141 - RNA, 13 nt, Homo sapiens
agcauugcuacug

SEQ ID NO: 1611142 - RNA, 18 nt, Homo sapiens
agcauuguaaaugugcuu

SEQ ID NO: 1611143 - RNA, 17 nt, Homo sapiens
agcauuuagacccugca

SEQ ID NO: 1611144 - RNA, 22 nt, Homo sapiens
agcauuugacccuugcugugaa

SEQ ID NO: 1611145 - RNA, 17 nt, Homo sapiens
agcauuugaguuugcaa

SEQ ID NO: 1611146 - RNA, 13 nt, Homo sapiens
agcauuuucauuc

SEQ ID NO: 1611147 - RNA, 20 nt, Homo sapiens
agcauuuucauucauuuuaa

SEQ ID NO: 1611148 - RNA, 21 nt, Homo sapiens
agccaaccuagcuagcaacau

SEQ ID NO: 1611149 - RNA, 22 nt, Homo sapiens
agccaacgagacacauugccuu

SEQ ID NO: 1611150 - RNA, 23 nt, Homo sapiens
agccaaggagggagggucuuccu

SEQ ID NO: 1611151 - RNA, 22 nt, Homo sapiens
agccaaggauagaagcugcagu

SEQ ID NO: 1611152 - RNA, 13 nt, Homo sapiens
agccaagugcaga

SEQ ID NO: 1611153 - RNA, 17 nt, Homo sapiens
agccaaguggggugcug

SEQ ID NO: 1611154 - RNA, 17 nt, Homo sapiens
agccacaagcugcacug

SEQ ID NO: 1611155 - RNA, 19 nt, Homo sapiens
agccacacaaacguuuacu

SEQ ID NO: 1611156 - RNA, 15 nt, Homo sapiens
agccaccaagaggga

SEQ ID NO: 1611157 - RNA, 14 nt, Homo sapiens
agccaccaguucuc

SEQ ID NO: 1611158 - RNA, 13 nt, Homo sapiens
agccaccugcaag

SEQ ID NO: 1611159 - RNA, 14 nt, Homo sapiens
agccacuguaugau

SEQ ID NO: 1611160 - RNA, 23 nt, Homo sapiens
agccacuguaugauucucuuaau

SEQ ID NO: 1611161 - RNA, 18 nt, Homo sapiens
agccacugucacaggcau

SEQ ID NO: 1611162 - RNA, 21 nt, Homo sapiens
agccacuuaccaauugcuaag

SEQ ID NO: 1611163 - RNA, 16 nt, Homo sapiens
agccacuugacuggca

SEQ ID NO: 1611164 - RNA, 17 nt, Homo sapiens
agccacuugacuggcac

SEQ ID NO: 1611165 - RNA, 18 nt, Homo sapiens
agccagcugugcacuuuc

SEQ ID NO: 1611166 - RNA, 15 nt, Homo sapiens
agccagcuuaaaccc

SEQ ID NO: 1611167 - RNA, 14 nt, Homo sapiens
agccaggagcagcc

SEQ ID NO: 1611168 - RNA, 16 nt, Homo sapiens
agccaggagcagcccu

SEQ ID NO: 1611169 - RNA, 18 nt, Homo sapiens
agccaggagcagcccugg

SEQ ID NO: 1611170 - RNA, 18 nt, Homo sapiens
agccaggaggccugcuag

SEQ ID NO: 1611171 - RNA, 21 nt, Homo sapiens
agccaggagugcccccgggaa

SEQ ID NO: 1611172 - RNA, 18 nt, Homo sapiens
agccaggcacacacugug

SEQ ID NO: 1611173 - RNA, 22 nt, Homo sapiens
agccaggccugggggcagccuc

SEQ ID NO: 1611174 - RNA, 16 nt, Homo sapiens
agccaggcugccaagg

SEQ ID NO: 1611175 - RNA, 20 nt, Homo sapiens
agccaguagccuaaaucucc

SEQ ID NO: 1611176 - RNA, 14 nt, Homo sapiens
agccaguuacauaa

SEQ ID NO: 1611177 - RNA, 13 nt, Homo sapiens
agccaguuuauuu

SEQ ID NO: 1611178 - RNA, 18 nt, Homo sapiens
agccauaagaaagcacua

SEQ ID NO: 1611179 - RNA, 19 nt, Homo sapiens
agccauaagaaagcacuau

SEQ ID NO: 1611180 - RNA, 22 nt, Homo sapiens
agccauaagaaagcacuauuaa

SEQ ID NO: 1611181 - RNA, 16 nt, Homo sapiens
agccauaggugcaguu

SEQ ID NO: 1611182 - RNA, 17 nt, Homo sapiens
agccauauguacauaau

SEQ ID NO: 1611183 - RNA, 19 nt, Homo sapiens
agccauauugucaccucag

SEQ ID NO: 1611184 - RNA, 16 nt, Homo sapiens
agccaugccugagguc

SEQ ID NO: 1611185 - RNA, 20 nt, Homo sapiens
agccauggucccaggcuucc

SEQ ID NO: 1611186 - RNA, 22 nt, Homo sapiens
agccauuucacucucaaacuuc

SEQ ID NO: 1611187 - RNA, 19 nt, Homo sapiens
agccauuuuucaaagcaau

SEQ ID NO: 1611188 - RNA, 17 nt, Homo sapiens
agcccaacagcacuuuu

SEQ ID NO: 1611189 - RNA, 16 nt, Homo sapiens
agcccaagaggacuga

SEQ ID NO: 1611190 - RNA, 16 nt, Homo sapiens
agcccaaggucaggga

SEQ ID NO: 1611191 - RNA, 17 nt, Homo sapiens
agcccaauuaauuccug

SEQ ID NO: 1611192 - RNA, 13 nt, Homo sapiens
agcccacaucuca

SEQ ID NO: 1611193 - RNA, 12 nt, Homo sapiens
agcccacugagg

SEQ ID NO: 1611194 - RNA, 15 nt, Homo sapiens
agcccagauggaaag

SEQ ID NO: 1611195 - RNA, 14 nt, Homo sapiens
agcccagccuggga

SEQ ID NO: 1611196 - RNA, 15 nt, Homo sapiens
agcccagccugggag

SEQ ID NO: 1611197 - RNA, 22 nt, Homo sapiens
agcccagcuuggcccuuuccuu

SEQ ID NO: 1611198 - RNA, 17 nt, Homo sapiens
agcccaggagccucacu

SEQ ID NO: 1611199 - RNA, 15 nt, Homo sapiens
agcccagugcugcca

SEQ ID NO: 1611200 - RNA, 12 nt, Homo sapiens
agcccauaucac

SEQ ID NO: 1611201 - RNA, 17 nt, Homo sapiens
agcccauaucacuaaga

SEQ ID NO: 1611202 - RNA, 20 nt, Homo sapiens
agcccauggcccccaauaaa

SEQ ID NO: 1611203 - RNA, 21 nt, Homo sapiens
agcccauggcccccaauaaag

SEQ ID NO: 1611204 - RNA, 20 nt, Homo sapiens
agcccauuucuccauacgca

SEQ ID NO: 1611205 - RNA, 12 nt, Homo sapiens
agccccaaaagg

SEQ ID NO: 1611206 - RNA, 15 nt, Homo sapiens
agccccaaaucucuc

SEQ ID NO: 1611207 - RNA, 20 nt, Homo sapiens
agcccccaccggaacugggc

SEQ ID NO: 1611208 - RNA, 16 nt, Homo sapiens
agccccggcaagccac

SEQ ID NO: 1611209 - RNA, 23 nt, Homo sapiens
agccccuccaaaggucugauguc

SEQ ID NO: 1611210 - RNA, 20 nt, Homo sapiens
agccccuccccagacucuca

SEQ ID NO: 1611211 - RNA, 16 nt, Homo sapiens
agccccuccucccuca

SEQ ID NO: 1611212 - RNA, 19 nt, Homo sapiens
agcccuaaguggcugccuu

SEQ ID NO: 1611213 - RNA, 19 nt, Homo sapiens
agcccugcagcccaccaga

SEQ ID NO: 1611214 - RNA, 21 nt, Homo sapiens
agcccuggcccccacagcgcu

SEQ ID NO: 1611215 - RNA, 20 nt, Homo sapiens
agcccugggguuugaagcug

SEQ ID NO: 1611216 - RNA, 15 nt, Homo sapiens
agcccugucugcuag

SEQ ID NO: 1611217 - RNA, 19 nt, Homo sapiens
agcccuucaccaucuaccu

SEQ ID NO: 1611218 - RNA, 21 nt, Homo sapiens
agcccuucccagggcacccag

SEQ ID NO: 1611219 - RNA, 22 nt, Homo sapiens
agcccuuccucccauuucccau

SEQ ID NO: 1611220 - RNA, 23 nt, Homo sapiens
agcccuugggcacugcacccugu

SEQ ID NO: 1611221 - RNA, 15 nt, Homo sapiens
agccgagaucaugcc

SEQ ID NO: 1611222 - RNA, 19 nt, Homo sapiens
agccgauggggaggggaug

SEQ ID NO: 1611223 - RNA, 18 nt, Homo sapiens
agccgcauuggugacuca

SEQ ID NO: 1611224 - RNA, 18 nt, Homo sapiens
agccgcgggccaggaggc

SEQ ID NO: 1611225 - RNA, 16 nt, Homo sapiens
agccggcuugauuucc

SEQ ID NO: 1611226 - RNA, 19 nt, Homo sapiens
agccgggcaugauggugca

SEQ ID NO: 1611227 - RNA, 18 nt, Homo sapiens
agccggggugggugugcu

SEQ ID NO: 1611228 - RNA, 20 nt, Homo sapiens
agccgguggugcccgugccc

SEQ ID NO: 1611229 - RNA, 15 nt, Homo sapiens
agccguauuuuacau

SEQ ID NO: 1611230 - RNA, 20 nt, Homo sapiens
agccuaaaagugggcuugau

SEQ ID NO: 1611231 - RNA, 12 nt, Homo sapiens
agccuaaaucuc

SEQ ID NO: 1611232 - RNA, 17 nt, Homo sapiens
agccuaaccccauuccu

SEQ ID NO: 1611233 - RNA, 20 nt, Homo sapiens
agccuaaccccauuccugug

SEQ ID NO: 1611234 - RNA, 21 nt, Homo sapiens
agccuaagaauaugaucaggu

SEQ ID NO: 1611235 - RNA, 13 nt, Homo sapiens
agccuaccucucc

SEQ ID NO: 1611236 - RNA, 13 nt, Homo sapiens
agccuagagaagg

SEQ ID NO: 1611237 - RNA, 18 nt, Homo sapiens
agccuagccugcauauca

SEQ ID NO: 1611238 - RNA, 16 nt, Homo sapiens
agccuagcggagccca

SEQ ID NO: 1611239 - RNA, 18 nt, Homo sapiens
agccuagcggagcccagc

SEQ ID NO: 1611240 - RNA, 12 nt, Homo sapiens
agccuauagcag

SEQ ID NO: 1611241 - RNA, 16 nt, Homo sapiens
agccucagaaggcccc

SEQ ID NO: 1611242 - RNA, 22 nt, Homo sapiens
agccucccccucagaugaucuc

SEQ ID NO: 1611243 - RNA, 17 nt, Homo sapiens
agccuccccgugccaaa

SEQ ID NO: 1611244 - RNA, 18 nt, Homo sapiens
agccucuccgacucugca

SEQ ID NO: 1611245 - RNA, 14 nt, Homo sapiens
agccucuccuccau

SEQ ID NO: 1611246 - RNA, 17 nt, Homo sapiens
agccucugccgcugcca

SEQ ID NO: 1611247 - RNA, 18 nt, Homo sapiens
agccucugccgcugccau

SEQ ID NO: 1611248 - RNA, 22 nt, Homo sapiens
agccucugcuggagaaagccac

SEQ ID NO: 1611249 - RNA, 22 nt, Homo sapiens
agccugaaguggaaugacugaa

SEQ ID NO: 1611250 - RNA, 20 nt, Homo sapiens
agccugaauuggcuaugcag

SEQ ID NO: 1611251 - RNA, 21 nt, Homo sapiens
agccugacucagcuaauguca

SEQ ID NO: 1611252 - RNA, 21 nt, Homo sapiens
agccugagcagagacaugacu

SEQ ID NO: 1611253 - RNA, 12 nt, Homo sapiens
agccugaucuuu

SEQ ID NO: 1611254 - RNA, 12 nt, Homo sapiens
agccugcauuga

SEQ ID NO: 1611255 - RNA, 20 nt, Homo sapiens
agccugcauugagcuugcau

SEQ ID NO: 1611256 - RNA, 23 nt, Homo sapiens
agccugcggggugcccucucacu

SEQ ID NO: 1611257 - RNA, 23 nt, Homo sapiens
agauguuuguuuucaaaauacuu

SEQ ID NO: 1611258 - RNA, 21 nt, Homo sapiens
agauuaaauuacagcuuuuau

SEQ ID NO: 1611259 - RNA, 17 nt, Homo sapiens
agauuacugaugugaua

SEQ ID NO: 1611260 - RNA, 13 nt, Homo sapiens
agauuaugugacu

SEQ ID NO: 1611261 - RNA, 23 nt, Homo sapiens
agauuauugugacuucacuguau

SEQ ID NO: 1611262 - RNA, 15 nt, Homo sapiens
agauucaaacccagg

SEQ ID NO: 1611263 - RNA, 19 nt, Homo sapiens
agauucagguaauacaaac

SEQ ID NO: 1611264 - RNA, 15 nt, Homo sapiens
agauuccaaaaagca

SEQ ID NO: 1611265 - RNA, 17 nt, Homo sapiens
agauuccaccuagagcu

SEQ ID NO: 1611266 - RNA, 20 nt, Homo sapiens
agauucuaguagaacucuag

SEQ ID NO: 1611267 - RNA, 13 nt, Homo sapiens
agaacucauuuga

SEQ ID NO: 1611268 - RNA, 22 nt, Homo sapiens
agaacugaacuguaacuuaaau

SEQ ID NO: 1611269 - RNA, 15 nt, Homo sapiens
agaacugaagcucuu

SEQ ID NO: 1611270 - RNA, 20 nt, Homo sapiens
agaacugaaggcauaugcac

SEQ ID NO: 1611271 - RNA, 20 nt, Homo sapiens
agaacuggaacuacguagcu

SEQ ID NO: 1611272 - RNA, 14 nt, Homo sapiens
agaacugucuguga

SEQ ID NO: 1611273 - RNA, 20 nt, Homo sapiens
agaacuuccccucccuuccc

SEQ ID NO: 1611274 - RNA, 19 nt, Homo sapiens
agaacuuucuuauuuugcu

SEQ ID NO: 1611275 - RNA, 22 nt, Homo sapiens
agaagaaaauccauucauucaa

SEQ ID NO: 1611276 - RNA, 23 nt, Homo sapiens
agaagaaauuaggagugcugaua

SEQ ID NO: 1611277 - RNA, 12 nt, Homo sapiens
agaagacauuuu

SEQ ID NO: 1611278 - RNA, 16 nt, Homo sapiens
agaagaggaaagggag

SEQ ID NO: 1611279 - RNA, 18 nt, Homo sapiens
gaagaucaauuucuccca

SEQ ID NO: 1611280 - RNA, 18 nt, Homo sapiens
gaagaugggcuucaucca

SEQ ID NO: 1611281 - RNA, 23 nt, Homo sapiens
gaagcaaaucagaaacuugugaa

SEQ ID NO: 1611282 - RNA, 19 nt, Homo sapiens
gaagcaacccaaauguuca

SEQ ID NO: 1611283 - RNA, 18 nt, Homo sapiens
gaagcaauugaaaaggaa

SEQ ID NO: 1611284 - RNA, 16 nt, Homo sapiens
gaagcaccccaugcca

SEQ ID NO: 1611285 - RNA, 13 nt, Homo sapiens
gaagcacugagca

SEQ ID NO: 1611286 - RNA, 14 nt, Homo sapiens
gaagcacuucugcu

SEQ ID NO: 1611287 - RNA, 15 nt, Homo sapiens
gaagcacuugcucaa

SEQ ID NO: 1611288 - RNA, 15 nt, Homo sapiens
gaagccaagugggau

SEQ ID NO: 1611289 - RNA, 13 nt, Homo sapiens
gaagccacagagu

SEQ ID NO: 1611290 - RNA, 18 nt, Homo sapiens
gaagccacaggccugaga

SEQ ID NO: 1611291 - RNA, 20 nt, Homo sapiens
gaagccacuauuacugggac

SEQ ID NO: 1611292 - RNA, 18 nt, Homo sapiens
gaagccauuuuccaguga

SEQ ID NO: 1611293 - RNA, 19 nt, Homo sapiens
gaagcccugauguguccuc

SEQ ID NO: 1611294 - RNA, 23 nt, Homo sapiens
gaagcccugauguguccucaggg

SEQ ID NO: 1611295 - RNA, 16 nt, Homo sapiens
gaagccggucaucacc

SEQ ID NO: 1611296 - RNA, 17 nt, Homo sapiens
gaagccuauguaugcca

SEQ ID NO: 1611297 - RNA, 17 nt, Homo sapiens
gaagcgagauguguggc

SEQ ID NO: 1611298 - RNA, 12 nt, Homo sapiens
gaagcuacccaa

SEQ ID NO: 1611299 - RNA, 20 nt, Homo sapiens
gaagcucacacauccuguca

SEQ ID NO: 1611300 - RNA, 22 nt, Homo sapiens
gaagcucucgagggaagcagug

SEQ ID NO: 1611301 - RNA, 24 nt, Homo sapiens
gaagcuggaggcacaacgcaccag

SEQ ID NO: 1611302 - RNA, 13 nt, Homo sapiens
gaagcuuauagag

SEQ ID NO: 1611303 - RNA, 22 nt, Homo sapiens
gaaggaacagcaauggugucag

SEQ ID NO: 1611304 - RNA, 23 nt, Homo sapiens
gaaggaacauggagcugucauca

SEQ ID NO: 1611305 - RNA, 16 nt, Homo sapiens
gaaggacacagugaug

SEQ ID NO: 1611306 - RNA, 18 nt, Homo sapiens
gaaggacacagugaugaa

SEQ ID NO: 1611307 - RNA, 14 nt, Homo sapiens
gaaggcaaacccau

SEQ ID NO: 1611308 - RNA, 23 nt, Homo sapiens
gaaggcaauuuuaguguauuaau

SEQ ID NO: 1611309 - RNA, 16 nt, Homo sapiens
gaaggcagccaccagc

SEQ ID NO: 1611310 - RNA, 14 nt, Homo sapiens
gaaggcauaugcac

SEQ ID NO: 1611311 - RNA, 17 nt, Homo sapiens
gaaggcugugagccaag

SEQ ID NO: 1611312 - RNA, 19 nt, Homo sapiens
gaagggggucaaaggaaga

SEQ ID NO: 1611313 - RNA, 20 nt, Homo sapiens
gaaggggguggggaagaaga

SEQ ID NO: 1611314 - RNA, 23 nt, Homo sapiens
gaagggucccuuuugcauugcca

SEQ ID NO: 1611315 - RNA, 21 nt, Homo sapiens
gaaggguuuugcuacauucua

SEQ ID NO: 1611316 - RNA, 14 nt, Homo sapiens
gaagguacacccca

SEQ ID NO: 1611317 - RNA, 14 nt, Homo sapiens
gaaggucaccagca

SEQ ID NO: 1611318 - RNA, 19 nt, Homo sapiens
gaaggugaaagugcaguuc

SEQ ID NO: 1611319 - RNA, 16 nt, Homo sapiens
gaagguucucugugcu

SEQ ID NO: 1611320 - RNA, 14 nt, Homo sapiens
gaaguaggcauaua

SEQ ID NO: 1611321 - RNA, 15 nt, Homo sapiens
gaaguaucagcacua

SEQ ID NO: 1611322 - RNA, 21 nt, Homo sapiens
gaaguauccuucagccugaaa

SEQ ID NO: 1611323 - RNA, 16 nt, Homo sapiens
gaagucaucauuccuc

SEQ ID NO: 1611324 - RNA, 13 nt, Homo sapiens
gaagucaucucau

SEQ ID NO: 1611325 - RNA, 16 nt, Homo sapiens
gaagucaucucauucc

SEQ ID NO: 1611326 - RNA, 21 nt, Homo sapiens
gaagucaucucauuccacugu

SEQ ID NO: 1611327 - RNA, 15 nt, Homo sapiens
gaaguccuccagaca

SEQ ID NO: 1611328 - RNA, 15 nt, Homo sapiens
gaaguccuucaguga

SEQ ID NO: 1611329 - RNA, 15 nt, Homo sapiens
gaagucuucuauuua

SEQ ID NO: 1611330 - RNA, 19 nt, Homo sapiens
gaaguggcugccaaagaga

SEQ ID NO: 1611331 - RNA, 22 nt, Homo sapiens
gaaguggggcuaggucuugcca

SEQ ID NO: 1611332 - RNA, 16 nt, Homo sapiens
gaaguuaugcugucau

SEQ ID NO: 1611333 - RNA, 13 nt, Homo sapiens
gaaguucugagau

SEQ ID NO: 1611334 - RNA, 20 nt, Homo sapiens
gaaguugcugcugugaaucu

SEQ ID NO: 1611335 - RNA, 14 nt, Homo sapiens
gaaguugugcuaaa

SEQ ID NO: 1611336 - RNA, 17 nt, Homo sapiens
gaaguuucuggugccau

SEQ ID NO: 1611337 - RNA, 19 nt, Homo sapiens
gaaguuuuuggugucacag

SEQ ID NO: 1611338 - RNA, 17 nt, Homo sapiens
gaaguuuuuuacuuugg

SEQ ID NO: 1611339 - RNA, 22 nt, Homo sapiens
gaauaaagccacuguaugauuc

SEQ ID NO: 1611340 - RNA, 19 nt, Homo sapiens
gaauaaagccuuuguaucu

SEQ ID NO: 1611341 - RNA, 16 nt, Homo sapiens
gaauaaauucuaccuc

SEQ ID NO: 1611342 - RNA, 19 nt, Homo sapiens
gaauaaggcuuuuucuucc

SEQ ID NO: 1611343 - RNA, 14 nt, Homo sapiens
gaauaauacauacu

SEQ ID NO: 1611344 - RNA, 15 nt, Homo sapiens
gaauaauauucaaua

SEQ ID NO: 1611345 - RNA, 17 nt, Homo sapiens
gaauacaacauugccaa

SEQ ID NO: 1611346 - RNA, 20 nt, Homo sapiens
gaauacugcauuuacagugu

SEQ ID NO: 1611347 - RNA, 22 nt, Homo sapiens
gaauagccuggccaccagccau

SEQ ID NO: 1611348 - RNA, 16 nt, Homo sapiens
gaauaguaaacuaaag

SEQ ID NO: 1611349 - RNA, 13 nt, Homo sapiens
gaauauaauuuca

SEQ ID NO: 1611350 - RNA, 21 nt, Homo sapiens
gaauaucuguucccagccccu

SEQ ID NO: 1611351 - RNA, 22 nt, Homo sapiens
gaauaugaucagguaacuuucg

SEQ ID NO: 1611352 - RNA, 16 nt, Homo sapiens
gaaucaaaugcaauuu

SEQ ID NO: 1611353 - RNA, 14 nt, Homo sapiens
gaaucaacauuucu

SEQ ID NO: 1611354 - RNA, 22 nt, Homo sapiens
gaaucagcaucucuucuucccu

SEQ ID NO: 1611355 - RNA, 19 nt, Homo sapiens
gaaucagcucaaucuucaa

SEQ ID NO: 1611356 - RNA, 22 nt, Homo sapiens
gaaucaguccuagaauguuuca

SEQ ID NO: 1611357 - RNA, 19 nt, Homo sapiens
gaauccauguaaauugcaa

SEQ ID NO: 1611358 - RNA, 22 nt, Homo sapiens
gaauccuggaccaagcacaaaa

SEQ ID NO: 1611359 - RNA, 23 nt, Homo sapiens
gaaucgguuguucuuuccucaca

SEQ ID NO: 1611360 - RNA, 19 nt, Homo sapiens
gaaucuguuucucugcugu

SEQ ID NO: 1611361 - RNA, 13 nt, Homo sapiens
gaaugaaacugau

SEQ ID NO: 1611362 - RNA, 15 nt, Homo sapiens
gaaugacauugaacu

SEQ ID NO: 1611363 - RNA, 19 nt, Homo sapiens
gaaugacugacaaagacau

SEQ ID NO: 1611364 - RNA, 19 nt, Homo sapiens
gaaugagcacccauuccaa

SEQ ID NO: 1611365 - RNA, 15 nt, Homo sapiens
gaaugagugccuuga

SEQ ID NO: 1611366 - RNA, 23 nt, Homo sapiens
gaaugaugcucaaaaucuuucca

SEQ ID NO: 1611367 - RNA, 16 nt, Homo sapiens
gaaugaugugauacaa

SEQ ID NO: 1611368 - RNA, 14 nt, Homo sapiens
gaaugauucagugu

SEQ ID NO: 1611369 - RNA, 20 nt, Homo sapiens
gaaugccgguuaaauuccau

SEQ ID NO: 1611370 - RNA, 19 nt, Homo sapiens
gaaugcggccucugagaca

SEQ ID NO: 1611371 - RNA, 17 nt, Homo sapiens
gaauggagcuggcccuc

SEQ ID NO: 1611372 - RNA, 20 nt, Homo sapiens
gaaugggcuugaaacauuau

SEQ ID NO: 1611373 - RNA, 17 nt, Homo sapiens
gaauguggcaguuuaaa

SEQ ID NO: 1611374 - RNA, 22 nt, Homo sapiens
gaauguuaauuuuuugguacaa

SEQ ID NO: 1611375 - RNA, 20 nt, Homo sapiens
gaauguuauccaacuauuaa

SEQ ID NO: 1611376 - RNA, 17 nt, Homo sapiens
gaauguucaucucucca

SEQ ID NO: 1611377 - RNA, 15 nt, Homo sapiens
gaauuaaaguacuuu

SEQ ID NO: 1611378 - RNA, 16 nt, Homo sapiens
gaauuaacacaugauc

SEQ ID NO: 1611379 - RNA, 14 nt, Homo sapiens
gaauuacagacuca

SEQ ID NO: 1611380 - RNA, 16 nt, Homo sapiens
gaauuauaacuguaaa

SEQ ID NO: 1611381 - RNA, 15 nt, Homo sapiens
gaauuaucuauuuca

SEQ ID NO: 1611382 - RNA, 20 nt, Homo sapiens
gaauuauuguagacaugccc

SEQ ID NO: 1611383 - RNA, 19 nt, Homo sapiens
gaauuccaaagcaaaacca

SEQ ID NO: 1611384 - RNA, 18 nt, Homo sapiens
gaauugaacgacuaccca

SEQ ID NO: 1611385 - RNA, 16 nt, Homo sapiens
gaauugaacgacugua

SEQ ID NO: 1611386 - RNA, 15 nt, Homo sapiens
gaauugacucaaaaa

SEQ ID NO: 1611387 - RNA, 13 nt, Homo sapiens
gaauugauuagga

SEQ ID NO: 1611388 - RNA, 15 nt, Homo sapiens
gaauugccagucuuu

SEQ ID NO: 1611389 - RNA, 13 nt, Homo sapiens
gaauuggguuucu

SEQ ID NO: 1611390 - RNA, 14 nt, Homo sapiens
gaauugguugccau

SEQ ID NO: 1611391 - RNA, 18 nt, Homo sapiens
gaauuuccucuauugaug

SEQ ID NO: 1611392 - RNA, 13 nt, Homo sapiens
gaauuucuaagaa

SEQ ID NO: 1611393 - RNA, 16 nt, Homo sapiens
gaauuuguuuuagcca

SEQ ID NO: 1611394 - RNA, 15 nt, Homo sapiens
gaauuuuauaaucug

SEQ ID NO: 1611395 - RNA, 19 nt, Homo sapiens
gaauuuuugcaauaaugca

SEQ ID NO: 1611396 - RNA, 22 nt, Homo sapiens
gaauuuuugcaauaaugcagua

SEQ ID NO: 1611397 - RNA, 14 nt, Homo sapiens
gaaagagcaaguga

SEQ ID NO: 1611398 - RNA, 13 nt, Homo sapiens
gaaagagccugaa

SEQ ID NO: 1611399 - RNA, 18 nt, Homo sapiens
gaaagaggcaccaggaag

SEQ ID NO: 1611400 - RNA, 13 nt, Homo sapiens
gaaagaucaaaga

SEQ ID NO: 1611401 - RNA, 12 nt, Homo sapiens
gaaagauuugau

SEQ ID NO: 1611402 - RNA, 15 nt, Homo sapiens
gaaagauuugaugua

SEQ ID NO: 1611403 - RNA, 19 nt, Homo sapiens
gaaagcaacaaagauugag

SEQ ID NO: 1611404 - RNA, 11 nt, Homo sapiens
gaaagcacuau

SEQ ID NO: 1611405 - RNA, 11 nt, Homo sapiens
gaaagcacuua

SEQ ID NO: 1611406 - RNA, 22 nt, Homo sapiens
gaaagcagaaaaucuaccaaga

SEQ ID NO: 1611407 - RNA, 18 nt, Homo sapiens
gaaagcauccauuaauua

SEQ ID NO: 1611408 - RNA, 13 nt, Homo sapiens
gaaagcauuauuu

SEQ ID NO: 1611409 - RNA, 14 nt, Homo sapiens
gaaagccuuaggga

SEQ ID NO: 1611410 - RNA, 17 nt, Homo sapiens
gaaagcuggugucugau

SEQ ID NO: 1611411 - RNA, 11 nt, Homo sapiens
gaaagcuuugu

SEQ ID NO: 1611412 - RNA, 21 nt, Homo sapiens
gaaaggaaauaguaccuucaa

SEQ ID NO: 1611413 - RNA, 19 nt, Homo sapiens
gaaaggauuuuaccaaagc

SEQ ID NO: 1611414 - RNA, 22 nt, Homo sapiens
gaaagggaagaucuuaugccuu

SEQ ID NO: 1611415 - RNA, 20 nt, Homo sapiens
gaaaggguuugauauggaga

SEQ ID NO: 1611416 - RNA, 14 nt, Homo sapiens
gaaaggucugagga

SEQ ID NO: 1611417 - RNA, 21 nt, Homo sapiens
gaaaggucugaggaugaugua

SEQ ID NO: 1611418 - RNA, 23 nt, Homo sapiens
gaaagguuuuauucuauauugcu

SEQ ID NO: 1611419 - RNA, 16 nt, Homo sapiens
gaaagguuuuccuuau

SEQ ID NO: 1611420 - RNA, 19 nt, Homo sapiens
gaaaguacacucugcuguu

SEQ ID NO: 1611421 - RNA, 15 nt, Homo sapiens
gaaaguguuuugccc

SEQ ID NO: 1611422 - RNA, 17 nt, Homo sapiens
gaaaguuguauucucau

SEQ ID NO: 1611423 - RNA, 22 nt, Homo sapiens
gaaaguuuaacaaaugacugua

SEQ ID NO: 1611424 - RNA, 18 nt, Homo sapiens
gaaauaaauauuguguug

SEQ ID NO: 1611425 - RNA, 13 nt, Homo sapiens
gaaauaagccaga

SEQ ID NO: 1611426 - RNA, 16 nt, Homo sapiens
gaaauaagcugugauu

SEQ ID NO: 1611427 - RNA, 16 nt, Homo sapiens
gaaauacagucuucca

SEQ ID NO: 1611428 - RNA, 18 nt, Homo sapiens
gaaauacagucuuccaca

SEQ ID NO: 1611429 - RNA, 13 nt, Homo sapiens
gaaauacuuaaca

SEQ ID NO: 1611430 - RNA, 14 nt, Homo sapiens
gaaauauauuacuu

SEQ ID NO: 1611431 - RNA, 21 nt, Homo sapiens
gaaauauuugucuucucaggc

SEQ ID NO: 1611432 - RNA, 13 nt, Homo sapiens
gaaaucuacugaa

SEQ ID NO: 1611433 - RNA, 19 nt, Homo sapiens
gaaaucuauagaacugaau

SEQ ID NO: 1611434 - RNA, 15 nt, Homo sapiens
gaaaugaaagggaaa

SEQ ID NO: 1611435 - RNA, 22 nt, Homo sapiens
gaaaugaugaaaagguugccug

SEQ ID NO: 1611436 - RNA, 9 nt, Homo sapiens
gaaaugcaa

SEQ ID NO: 1611437 - RNA, 16 nt, Homo sapiens
gaaaugcacuaagaca

SEQ ID NO: 1611438 - RNA, 14 nt, Homo sapiens
gaaaugcuuagaaa

SEQ ID NO: 1611439 - RNA, 15 nt, Homo sapiens
gaaauggaugcaaag

SEQ ID NO: 1611440 - RNA, 20 nt, Homo sapiens
gaaauggccaggauccucuc

SEQ ID NO: 1611441 - RNA, 22 nt, Homo sapiens
gaaaugggaauugcgcucaggg

SEQ ID NO: 1611442 - RNA, 23 nt, Homo sapiens
gaaaugggaauugcgcucagggg

SEQ ID NO: 1611443 - RNA, 15 nt, Homo sapiens
gaaaugggcagugaa

SEQ ID NO: 1611444 - RNA, 19 nt, Homo sapiens
gaaaugucaucaaacucca

SEQ ID NO: 1611445 - RNA, 19 nt, Homo sapiens
gaaaugugaaaagagcaau

SEQ ID NO: 1611446 - RNA, 17 nt, Homo sapiens
gaaauuaagaaggcaaa

SEQ ID NO: 1611447 - RNA, 15 nt, Homo sapiens
gaaauuaagacuuua

SEQ ID NO: 1611448 - RNA, 17 nt, Homo sapiens
gaaauuaagacuuuaug

SEQ ID NO: 1611449 - RNA, 21 nt, Homo sapiens
gaaauuaguuucaaauuuacc

SEQ ID NO: 1611450 - RNA, 21 nt, Homo sapiens
gaaauucacuuccccucuagg

SEQ ID NO: 1611451 - RNA, 18 nt, Homo sapiens
gaaauugcaguaacaaaa

SEQ ID NO: 1611452 - RNA, 21 nt, Homo sapiens
gaaauuggaagaagcacugau

SEQ ID NO: 1611453 - RNA, 17 nt, Homo sapiens
gaaauuuugcaccagcg

SEQ ID NO: 1611454 - RNA, 15 nt, Homo sapiens
gaacaaaaagguaaa

SEQ ID NO: 1611455 - RNA, 22 nt, Homo sapiens
gaacaacccaccauuucugggg

SEQ ID NO: 1611456 - RNA, 14 nt, Homo sapiens
gaacaacuaccuga

SEQ ID NO: 1611457 - RNA, 15 nt, Homo sapiens
gaacaagaaauggau

SEQ ID NO: 1611458 - RNA, 20 nt, Homo sapiens
gaacaaugacgugccuaccu

SEQ ID NO: 1611459 - RNA, 21 nt, Homo sapiens
gaacaauuguggucucucuua

SEQ ID NO: 1611460 - RNA, 23 nt, Homo sapiens
gaacaauuguggucucucuuaac

SEQ ID NO: 1611461 - RNA, 20 nt, Homo sapiens
gaacaauuuccaaaacuguc

SEQ ID NO: 1611462 - RNA, 12 nt, Homo sapiens
gaacacaggccc

SEQ ID NO: 1611463 - RNA, 22 nt, Homo sapiens
gaacagcacuggggagucuuug

SEQ ID NO: 1611464 - RNA, 23 nt, Homo sapiens
gaacaggucccacgccaggccag

SEQ ID NO: 1611465 - RNA, 17 nt, Homo sapiens
gaacagguucucuuccu

SEQ ID NO: 1611466 - RNA, 14 nt, Homo sapiens
gaacaucacauucc

SEQ ID NO: 1611467 - RNA, 20 nt, Homo sapiens
gaacaucucaugugugcuca

SEQ ID NO: 1611468 - RNA, 12 nt, Homo sapiens
gaacauggagcu

SEQ ID NO: 1611469 - RNA, 15 nt, Homo sapiens
gaacauuguacuguu

SEQ ID NO: 1611470 - RNA, 19 nt, Homo sapiens
gaaccaaggaaucauguca

SEQ ID NO: 1611471 - RNA, 22 nt, Homo sapiens
gaaccacagcagacaccauuca

SEQ ID NO: 1611472 - RNA, 20 nt, Homo sapiens
gaaccacucauugucuuuga

SEQ ID NO: 1611473 - RNA, 11 nt, Homo sapiens
gaaccacugag

SEQ ID NO: 1611474 - RNA, 23 nt, Homo sapiens
gaaccagccguauuuuacaugaa

SEQ ID NO: 1611475 - RNA, 17 nt, Homo sapiens
gaaccagggcucuucuc

SEQ ID NO: 1611476 - RNA, 21 nt, Homo sapiens
gaaccauguugguugcacuuu

SEQ ID NO: 1611477 - RNA, 16 nt, Homo sapiens
gaaccgaggcagggaa

SEQ ID NO: 1611478 - RNA, 18 nt, Homo sapiens
gaaccgcaauaugggagg

SEQ ID NO: 1611479 - RNA, 13 nt, Homo sapiens
gaaccguuuugaa

SEQ ID NO: 1611480 - RNA, 16 nt, Homo sapiens
gaaccuaauagcacca

SEQ ID NO: 1611481 - RNA, 18 nt, Homo sapiens
gaaccucucguaguccau

SEQ ID NO: 1611482 - RNA, 13 nt, Homo sapiens
gaaccuguccagu

SEQ ID NO: 1611483 - RNA, 14 nt, Homo sapiens
gaaccuuaaugaca

SEQ ID NO: 1611484 - RNA, 22 nt, Homo sapiens
gaaccuuaaugacaacacuuaa

SEQ ID NO: 1611485 - RNA, 13 nt, Homo sapiens
gaacggggagaaa

SEQ ID NO: 1611486 - RNA, 14 nt, Homo sapiens
gaacgguucuuuga

SEQ ID NO: 1611487 - RNA, 21 nt, Homo sapiens
gaacuaaaaauuaaaaccucu

SEQ ID NO: 1611488 - RNA, 18 nt, Homo sapiens
gaacuagccaaaccagga

SEQ ID NO: 1611489 - RNA, 13 nt, Homo sapiens
gaacucaaggguu

SEQ ID NO: 1611490 - RNA, 13 nt, Homo sapiens
gaacucauuugaa

SEQ ID NO: 1611491 - RNA, 22 nt, Homo sapiens
gaacuccaucagaaaaccaaag

SEQ ID NO: 1611492 - RNA, 23 nt, Homo sapiens
gaacucuucuuugcugcauuccu

SEQ ID NO: 1611493 - RNA, 20 nt, Homo sapiens
gaacugaaggcagcauguau

SEQ ID NO: 1611494 - RNA, 14 nt, Homo sapiens
gaacugacaaugaa

SEQ ID NO: 1611495 - RNA, 19 nt, Homo sapiens
gaacuggaagaaagcaaca

SEQ ID NO: 1611496 - RNA, 13 nt, Homo sapiens
gaacugucuguga

SEQ ID NO: 1611497 - RNA, 13 nt, Homo sapiens
gaacuguguuuca

SEQ ID NO: 1611498 - RNA, 19 nt, Homo sapiens
gaacuguugccuaauugga

SEQ ID NO: 1611499 - RNA, 17 nt, Homo sapiens
gaacuuaauaacugugu

SEQ ID NO: 1611500 - RNA, 12 nt, Homo sapiens
gaacuugcaaua

SEQ ID NO: 1611501 - RNA, 19 nt, Homo sapiens
gaacuuuaaaaaagcaaau

SEQ ID NO: 1611502 - RNA, 15 nt, Homo sapiens
gaacuuuauuuacac

SEQ ID NO: 1611503 - RNA, 20 nt, Homo sapiens
gaacuuuuuuagaaaugcaa

SEQ ID NO: 1611504 - RNA, 21 nt, Homo sapiens
gaacuuuuuuagaaaugcaaa

SEQ ID NO: 1611505 - RNA, 18 nt, Homo sapiens
gaagaaaagcaugcauau

SEQ ID NO: 1611506 - RNA, 17 nt, Homo sapiens
gaagaaacacacuggau

SEQ ID NO: 1611507 - RNA, 17 nt, Homo sapiens
gaagaaaccguauccau

SEQ ID NO: 1611508 - RNA, 13 nt, Homo sapiens
gaagaaagcaaca

SEQ ID NO: 1611509 - RNA, 15 nt, Homo sapiens
gaagaaaucaugaua

SEQ ID NO: 1611510 - RNA, 16 nt, Homo sapiens
gaagaaggaaacaccg

SEQ ID NO: 1611511 - RNA, 15 nt, Homo sapiens
gaagaauaaauucua

SEQ ID NO: 1611512 - RNA, 14 nt, Homo sapiens
gaagacaaacaaua

SEQ ID NO: 1611513 - RNA, 17 nt, Homo sapiens
gaagagaaaggacucag

SEQ ID NO: 1611514 - RNA, 22 nt, Homo sapiens
gaagagggaaauguacacuuuu

SEQ ID NO: 1611515 - RNA, 14 nt, Homo sapiens
gaagauaaacacaa

SEQ ID NO: 1611516 - RNA, 16 nt, Homo sapiens
cuuugcucucuggcca

SEQ ID NO: 1611517 - RNA, 17 nt, Homo sapiens
cuuugcucucuggccac

SEQ ID NO: 1611518 - RNA, 21 nt, Homo sapiens
cuuugcugucaaaacuacuga

SEQ ID NO: 1611519 - RNA, 19 nt, Homo sapiens
cuuuggaccuaauccaagc

SEQ ID NO: 1611520 - RNA, 21 nt, Homo sapiens
cuuuggccccucgacccugug

SEQ ID NO: 1611521 - RNA, 14 nt, Homo sapiens
cuuuggguacuuau

SEQ ID NO: 1611522 - RNA, 22 nt, Homo sapiens
cuuuggguuggagcuguuccau

SEQ ID NO: 1611523 - RNA, 16 nt, Homo sapiens
cuuuguaauauuuucc

SEQ ID NO: 1611524 - RNA, 19 nt, Homo sapiens
cuuuguagacuguuucaca

SEQ ID NO: 1611525 - RNA, 21 nt, Homo sapiens
cuuuguauauaggcuucucac

SEQ ID NO: 1611526 - RNA, 14 nt, Homo sapiens
cuuuguaucauuca

SEQ ID NO: 1611527 - RNA, 15 nt, Homo sapiens
cuuuguauguauuuc

SEQ ID NO: 1611528 - RNA, 16 nt, Homo sapiens
cuuugucacuugccac

SEQ ID NO: 1611529 - RNA, 14 nt, Homo sapiens
cuuugucucugaga

SEQ ID NO: 1611530 - RNA, 15 nt, Homo sapiens
cuuugugagcuguga

SEQ ID NO: 1611531 - RNA, 19 nt, Homo sapiens
cuuugugauaguucagucc

SEQ ID NO: 1611532 - RNA, 20 nt, Homo sapiens
cuuuguggggcucaaaaccu

SEQ ID NO: 1611533 - RNA, 21 nt, Homo sapiens
cuuuguggggcucaaaaccuc

SEQ ID NO: 1611534 - RNA, 17 nt, Homo sapiens
ccacucauuucaucuca

SEQ ID NO: 1611535 - RNA, 17 nt, Homo sapiens
ccacucccaaagcucag

SEQ ID NO: 1611536 - RNA, 16 nt, Homo sapiens
ccacuccucugacuca

SEQ ID NO: 1611537 - RNA, 16 nt, Homo sapiens
ccacuccuuccuucag

SEQ ID NO: 1611538 - RNA, 22 nt, Homo sapiens
ccacucuaugaguuggacuuca

SEQ ID NO: 1611539 - RNA, 14 nt, Homo sapiens
ccacucugccauuc

SEQ ID NO: 1611540 - RNA, 22 nt, Homo sapiens
ccacucuggagcauuucucauc

SEQ ID NO: 1611541 - RNA, 14 nt, Homo sapiens
ccacugauaucaug

SEQ ID NO: 1611542 - RNA, 16 nt, Homo sapiens
ccacugcacuuuccaa

SEQ ID NO: 1611543 - RNA, 14 nt, Homo sapiens
ccacugcucgugga

SEQ ID NO: 1611544 - RNA, 20 nt, Homo sapiens
ccacuggcuuuugccuguaa

SEQ ID NO: 1611545 - RNA, 12 nt, Homo sapiens
ccacugggaccc

SEQ ID NO: 1611546 - RNA, 22 nt, Homo sapiens
ccacugggacccccaacauucu

SEQ ID NO: 1611547 - RNA, 19 nt, Homo sapiens
ccacuggggaaugcuccca

SEQ ID NO: 1611548 - RNA, 13 nt, Homo sapiens
ccacugucuuuca

SEQ ID NO: 1611549 - RNA, 23 nt, Homo sapiens
ccacuguugguauuauauaauuc

SEQ ID NO: 1611550 - RNA, 11 nt, Homo sapiens
ccacuucucac

SEQ ID NO: 1611551 - RNA, 18 nt, Homo sapiens
ccacuugccugugcuaca

SEQ ID NO: 1611552 - RNA, 22 nt, Homo sapiens
ccacuugccugugcuacaauuc

SEQ ID NO: 1611553 - RNA, 22 nt, Homo sapiens
ccagaaaauguaaggcaaugcu

SEQ ID NO: 1611554 - RNA, 19 nt, Homo sapiens
ccagaaagcuucauccaca

SEQ ID NO: 1611555 - RNA, 21 nt, Homo sapiens
ccagaaauaaagaucucagga

SEQ ID NO: 1611556 - RNA, 20 nt, Homo sapiens
ccagaaccaacugcauuggu

SEQ ID NO: 1611557 - RNA, 22 nt, Homo sapiens
ccagaagaaaauucuccugaua

SEQ ID NO: 1611558 - RNA, 21 nt, Homo sapiens
ccagacaagcgccgcugugag

SEQ ID NO: 1611559 - RNA, 22 nt, Homo sapiens
ccagacacuggcguuacugcuu

SEQ ID NO: 1611560 - RNA, 11 nt, Homo sapiens
ccagacauucu

SEQ ID NO: 1611561 - RNA, 23 nt, Homo sapiens
ccagacccaguggacucuuccac

SEQ ID NO: 1611562 - RNA, 20 nt, Homo sapiens
ccagacuucccacggcuccu

SEQ ID NO: 1611563 - RNA, 18 nt, Homo sapiens
ccagagaaugcuuugaaa

SEQ ID NO: 1611564 - RNA, 15 nt, Homo sapiens
ccagagacacugagc

SEQ ID NO: 1611565 - RNA, 20 nt, Homo sapiens
ccagagauagggaugucaua

SEQ ID NO: 1611566 - RNA, 21 nt, Homo sapiens
ccagagcccaaggucagggag

SEQ ID NO: 1611567 - RNA, 19 nt, Homo sapiens
ccagaggaaguuauggcag

SEQ ID NO: 1611568 - RNA, 22 nt, Homo sapiens
ccagaggagcagaccagcacuu

SEQ ID NO: 1611569 - RNA, 21 nt, Homo sapiens
ccagaggagccaccaguucuc

SEQ ID NO: 1611570 - RNA, 14 nt, Homo sapiens
ccagaggagggcag

SEQ ID NO: 1611571 - RNA, 23 nt, Homo sapiens
ccagaggcagagguugcagugag

SEQ ID NO: 1611572 - RNA, 15 nt, Homo sapiens
ccagagggcacucug

SEQ ID NO: 1611573 - RNA, 14 nt, Homo sapiens
ccagagucccugcc

SEQ ID NO: 1611574 - RNA, 15 nt, Homo sapiens
ccagauagcugcauu

SEQ ID NO: 1611575 - RNA, 15 nt, Homo sapiens
ccagauggacuccag

SEQ ID NO: 1611576 - RNA, 18 nt, Homo sapiens
ccagauguaaauagaaca

SEQ ID NO: 1611577 - RNA, 17 nt, Homo sapiens
ccagauguuaugcuccu

SEQ ID NO: 1611578 - RNA, 19 nt, Homo sapiens
ccagauuggcucacacuga

SEQ ID NO: 1611579 - RNA, 22 nt, Homo sapiens
ccagauuggcucacacugagaa

SEQ ID NO: 1611580 - RNA, 13 nt, Homo sapiens
ccagcaaagugau

SEQ ID NO: 1611581 - RNA, 10 nt, Homo sapiens
ccagcacuuc

SEQ ID NO: 1611582 - RNA, 16 nt, Homo sapiens
ccagcacuuugggagg

SEQ ID NO: 1611583 - RNA, 13 nt, Homo sapiens
ccagcagagccag

SEQ ID NO: 1611584 - RNA, 21 nt, Homo sapiens
ccagcagcacagucacccaug

SEQ ID NO: 1611585 - RNA, 15 nt, Homo sapiens
ccagcaguacaauaa

SEQ ID NO: 1611586 - RNA, 22 nt, Homo sapiens
ccagccagaggguagggcacaa

SEQ ID NO: 1611587 - RNA, 15 nt, Homo sapiens
ccagccagauccucu

SEQ ID NO: 1611588 - RNA, 20 nt, Homo sapiens
ccagccaucaaaaugcuuuu

SEQ ID NO: 1611589 - RNA, 10 nt, Homo sapiens
ccagcccaga

SEQ ID NO: 1611590 - RNA, 17 nt, Homo sapiens
ccagcccauaaccagua

SEQ ID NO: 1611591 - RNA, 21 nt, Homo sapiens
ccagcccauggcccccaauaa

SEQ ID NO: 1611592 - RNA, 18 nt, Homo sapiens
ccagccccggcaagccac

SEQ ID NO: 1611593 - RNA, 17 nt, Homo sapiens
ccagccguauuuuacau

SEQ ID NO: 1611594 - RNA, 23 nt, Homo sapiens
ccagccuauagcagaagcacauu

SEQ ID NO: 1611595 - RNA, 21 nt, Homo sapiens
ccagccucugccgcugccaug

SEQ ID NO: 1611596 - RNA, 16 nt, Homo sapiens
ccagccugccuggcag

SEQ ID NO: 1611597 - RNA, 20 nt, Homo sapiens
ccagccugggcagccaggcu

SEQ ID NO: 1611598 - RNA, 14 nt, Homo sapiens
ccagcuaucuguca

SEQ ID NO: 1611599 - RNA, 20 nt, Homo sapiens
ccagcucauuucaguuucua

SEQ ID NO: 1611600 - RNA, 23 nt, Homo sapiens
ccagcugacacgcucaguugaaa

SEQ ID NO: 1611601 - RNA, 16 nt, Homo sapiens
ccagcugcagaagggu

SEQ ID NO: 1611602 - RNA, 18 nt, Homo sapiens
ccagcugggaagcccuuu

SEQ ID NO: 1611603 - RNA, 16 nt, Homo sapiens
ccagcugugcacuuuc

SEQ ID NO: 1611604 - RNA, 19 nt, Homo sapiens
ccagcugugcacuuucuuc

SEQ ID NO: 1611605 - RNA, 22 nt, Homo sapiens
ccagcugugcacuuucuucucu

SEQ ID NO: 1611606 - RNA, 12 nt, Homo sapiens
ccagcugugcug

SEQ ID NO: 1611607 - RNA, 14 nt, Homo sapiens
ccagcugugcugug

SEQ ID NO: 1611608 - RNA, 13 nt, Homo sapiens
ccagcuuacuagc

SEQ ID NO: 1611609 - RNA, 18 nt, Homo sapiens
ccagcuuacuagcacuuu

SEQ ID NO: 1611610 - RNA, 21 nt, Homo sapiens
ccagcuuaugagcucaaagua

SEQ ID NO: 1611611 - RNA, 21 nt, Homo sapiens
ccagcuucccgaguaccagug

SEQ ID NO: 1611612 - RNA, 14 nt, Homo sapiens
ccagcuuuccucau

SEQ ID NO: 1611613 - RNA, 17 nt, Homo sapiens
ccagcuuuccucaucag

SEQ ID NO: 1611614 - RNA, 15 nt, Homo sapiens
ccaggaccucuuaag

SEQ ID NO: 1611615 - RNA, 20 nt, Homo sapiens
ccaggagauggguccagggg

SEQ ID NO: 1611616 - RNA, 23 nt, Homo sapiens
ccaggagcaggaccuacuaggag

SEQ ID NO: 1611617 - RNA, 19 nt, Homo sapiens
ccaggaguucugaagcuga

SEQ ID NO: 1611618 - RNA, 14 nt, Homo sapiens
ccaggauucagcua

SEQ ID NO: 1611619 - RNA, 16 nt, Homo sapiens
ccaggccaagacucaa

SEQ ID NO: 1611620 - RNA, 14 nt, Homo sapiens
ccaggccaauguca

SEQ ID NO: 1611621 - RNA, 13 nt, Homo sapiens
ccaggccaggugc

SEQ ID NO: 1611622 - RNA, 20 nt, Homo sapiens
ccaggccucucucugcucca

SEQ ID NO: 1611623 - RNA, 16 nt, Homo sapiens
ccaggcuagagugcaa

SEQ ID NO: 1611624 - RNA, 13 nt, Homo sapiens
ccaggcuggagac

SEQ ID NO: 1611625 - RNA, 16 nt, Homo sapiens
ccaggcuuacugagcu

SEQ ID NO: 1611626 - RNA, 14 nt, Homo sapiens
ccaggcuuuguaca

SEQ ID NO: 1611627 - RNA, 13 nt, Homo sapiens
ccagggaaggugg

SEQ ID NO: 1611628 - RNA, 18 nt, Homo sapiens
ccagggaugauucaagcc

SEQ ID NO: 1611629 - RNA, 14 nt, Homo sapiens
ccagggaugcugcc

SEQ ID NO: 1611630 - RNA, 21 nt, Homo sapiens
ccagggcccacuagcauccac

SEQ ID NO: 1611631 - RNA, 16 nt, Homo sapiens
ccaggggcagccacac

SEQ ID NO: 1611632 - RNA, 17 nt, Homo sapiens
ccaggguuggcaugacu

SEQ ID NO: 1611633 - RNA, 15 nt, Homo sapiens
ccaggucagccacug

SEQ ID NO: 1611634 - RNA, 16 nt, Homo sapiens
ccagguggaacaaaca

SEQ ID NO: 1611635 - RNA, 15 nt, Homo sapiens
ccagguucucauuag

SEQ ID NO: 1611636 - RNA, 23 nt, Homo sapiens
ccaguaauggaaugaagguaaua

SEQ ID NO: 1611637 - RNA, 13 nt, Homo sapiens
ccaguacauuuaa

SEQ ID NO: 1611638 - RNA, 21 nt, Homo sapiens
ccaguagcugcccuuccugcc

SEQ ID NO: 1611639 - RNA, 23 nt, Homo sapiens
ccagucagaugguaguugagggu

SEQ ID NO: 1611640 - RNA, 14 nt, Homo sapiens
ccaguccaaagccg

SEQ ID NO: 1611641 - RNA, 17 nt, Homo sapiens
ccaguccaagaccccaa

SEQ ID NO: 1611642 - RNA, 18 nt, Homo sapiens
ccagucggccccaucucu

SEQ ID NO: 1611643 - RNA, 17 nt, Homo sapiens
ccagucuggaaaacaga

SEQ ID NO: 1611644 - RNA, 22 nt, Homo sapiens
ccagugacacgucucgccaagc

SEQ ID NO: 1611645 - RNA, 13 nt, Homo sapiens
ccaguggacucuu

SEQ ID NO: 1611646 - RNA, 18 nt, Homo sapiens
cucuauaagauuccaaaa

SEQ ID NO: 1611647 - RNA, 22 nt, Homo sapiens
cucuauauuguucagcaugcaa

SEQ ID NO: 1611648 - RNA, 15 nt, Homo sapiens
cucucaagcagguuu

SEQ ID NO: 1611649 - RNA, 12 nt, Homo sapiens
cucucaagucaa

SEQ ID NO: 1611650 - RNA, 21 nt, Homo sapiens
cucucagucucugagcaguga

SEQ ID NO: 1611651 - RNA, 14 nt, Homo sapiens
cucuccaagacagc

SEQ ID NO: 1611652 - RNA, 18 nt, Homo sapiens
cucuccaagucucagugg

SEQ ID NO: 1611653 - RNA, 18 nt, Homo sapiens
cucuccacugggaccuga

SEQ ID NO: 1611654 - RNA, 22 nt, Homo sapiens
cucuccauaucuccuuccccua

SEQ ID NO: 1611655 - RNA, 16 nt, Homo sapiens
cucuccaucagcuccu

SEQ ID NO: 1611656 - RNA, 13 nt, Homo sapiens
cucucccuaggcu

SEQ ID NO: 1611657 - RNA, 18 nt, Homo sapiens
cucucccuguacacagug

SEQ ID NO: 1611658 - RNA, 14 nt, Homo sapiens
cucuccugcaaaag

SEQ ID NO: 1611659 - RNA, 23 nt, Homo sapiens
cucuccugggacaaccagacucu

SEQ ID NO: 1611660 - RNA, 23 nt, Homo sapiens
cucuccuguauuuaacaaaaagu

SEQ ID NO: 1611661 - RNA, 20 nt, Homo sapiens
cucucgagggaagcagugug

SEQ ID NO: 1611662 - RNA, 23 nt, Homo sapiens
cucucgcaagggaaguccuugca

SEQ ID NO: 1611663 - RNA, 22 nt, Homo sapiens
cucucucaaaagagaaaaacaa

SEQ ID NO: 1611664 - RNA, 15 nt, Homo sapiens
cucucucauacccuc

SEQ ID NO: 1611665 - RNA, 14 nt, Homo sapiens
cucucuccugucca

SEQ ID NO: 1611666 - RNA, 22 nt, Homo sapiens
cucucucuuuucuacacacuca

SEQ ID NO: 1611667 - RNA, 22 nt, Homo sapiens
cucucuuagcauccugccuuag

SEQ ID NO: 1611668 - RNA, 15 nt, Homo sapiens
cucucuucucuccag

SEQ ID NO: 1611669 - RNA, 14 nt, Homo sapiens
cucugaaaccagug

SEQ ID NO: 1611670 - RNA, 15 nt, Homo sapiens
cucugacaguccaca

SEQ ID NO: 1611671 - RNA, 18 nt, Homo sapiens
cucugacaguccacaggg

SEQ ID NO: 1611672 - RNA, 20 nt, Homo sapiens
cucugagaacuccucauucc

SEQ ID NO: 1611673 - RNA, 15 nt, Homo sapiens
cucugagcugugcag

SEQ ID NO: 1611674 - RNA, 15 nt, Homo sapiens
cucugaggacacaga

SEQ ID NO: 1611675 - RNA, 21 nt, Homo sapiens
cucugagguuuccgaaaucag

SEQ ID NO: 1611676 - RNA, 21 nt, Homo sapiens
cucugcaauuuuacugugaaa

SEQ ID NO: 1611677 - RNA, 16 nt, Homo sapiens
cucugcagacuuccca

SEQ ID NO: 1611678 - RNA, 18 nt, Homo sapiens
cucugcaguaaaacacau

SEQ ID NO: 1611679 - RNA, 17 nt, Homo sapiens
cucugcagucaagcccu

SEQ ID NO: 1611680 - RNA, 15 nt, Homo sapiens
cucugccauguguuu

SEQ ID NO: 1611681 - RNA, 17 nt, Homo sapiens
cucugccccugcagcug

SEQ ID NO: 1611682 - RNA, 13 nt, Homo sapiens
cucugcccgggag

SEQ ID NO: 1611683 - RNA, 14 nt, Homo sapiens
cucugccgcugcca

SEQ ID NO: 1611684 - RNA, 19 nt, Homo sapiens
cucugccgcugccaugcuu

SEQ ID NO: 1611685 - RNA, 17 nt, Homo sapiens
cucugcuccccugugaa

SEQ ID NO: 1611686 - RNA, 15 nt, Homo sapiens
cucugcugcucugac

SEQ ID NO: 1611687 - RNA, 19 nt, Homo sapiens
cucugcuugauuuuugccu

SEQ ID NO: 1611688 - RNA, 17 nt, Homo sapiens
cucuggaccauauacca

SEQ ID NO: 1611689 - RNA, 15 nt, Homo sapiens
cucuggcacagugua

SEQ ID NO: 1611690 - RNA, 21 nt, Homo sapiens
cucugggaaguggucagcgca

SEQ ID NO: 1611691 - RNA, 15 nt, Homo sapiens
cucugggaguaauac

SEQ ID NO: 1611692 - RNA, 15 nt, Homo sapiens
cucuggggugcagcu

SEQ ID NO: 1611693 - RNA, 14 nt, Homo sapiens
cucuguaaaacaca

SEQ ID NO: 1611694 - RNA, 15 nt, Homo sapiens
cucuguaauugaaua

SEQ ID NO: 1611695 - RNA, 20 nt, Homo sapiens
cucuguagagcaugguucca

SEQ ID NO: 1611696 - RNA, 10 nt, Homo sapiens
cucuguccag

SEQ ID NO: 1611697 - RNA, 12 nt, Homo sapiens
cucugugaaagc

SEQ ID NO: 1611698 - RNA, 18 nt, Homo sapiens
cucugugggcuccaugua

SEQ ID NO: 1611699 - RNA, 20 nt, Homo sapiens
cucuguuuauagugacccac

SEQ ID NO: 1611700 - RNA, 15 nt, Homo sapiens
cucuguuucuucaau

SEQ ID NO: 1611701 - RNA, 21 nt, Homo sapiens
cucuguuuucucucuguuaca

SEQ ID NO: 1611702 - RNA, 16 nt, Homo sapiens
cucuuaaacuugugaa

SEQ ID NO: 1611703 - RNA, 19 nt, Homo sapiens
cucuuaaaucauuugguua

SEQ ID NO: 1611704 - RNA, 21 nt, Homo sapiens
cucuucaauaaaccacaagca

SEQ ID NO: 1611705 - RNA, 22 nt, Homo sapiens
cucuucaauaaaccacaagcau

SEQ ID NO: 1611706 - RNA, 22 nt, Homo sapiens
cucuuccccagagaggcacuca

SEQ ID NO: 1611707 - RNA, 11 nt, Homo sapiens
cucuuccucau

SEQ ID NO: 1611708 - RNA, 20 nt, Homo sapiens
cucuuccuugaccugcauug

SEQ ID NO: 1611709 - RNA, 14 nt, Homo sapiens
cucuucucauuuca

SEQ ID NO: 1611710 - RNA, 22 nt, Homo sapiens
cucuucugaauaaagcaauuag

SEQ ID NO: 1611711 - RNA, 15 nt, Homo sapiens
cucuucugacugccc

SEQ ID NO: 1611712 - RNA, 12 nt, Homo sapiens
cucuucugcaag

SEQ ID NO: 1611713 - RNA, 23 nt, Homo sapiens
cucuucuggggcaggcugggcca

SEQ ID NO: 1611714 - RNA, 22 nt, Homo sapiens
cucuucuuccccagguccuucc

SEQ ID NO: 1611715 - RNA, 16 nt, Homo sapiens
cucuucuuuaccagaa

SEQ ID NO: 1611716 - RNA, 14 nt, Homo sapiens
cucuugaccaggcu

SEQ ID NO: 1611717 - RNA, 23 nt, Homo sapiens
cucuuggacccaccuguggggcc

SEQ ID NO: 1611718 - RNA, 14 nt, Homo sapiens
cucuuggcagucac

SEQ ID NO: 1611719 - RNA, 21 nt, Homo sapiens
cucuuguccucuucugcucuu

SEQ ID NO: 1611720 - RNA, 12 nt, Homo sapiens
cucuuuaccucc

SEQ ID NO: 1611721 - RNA, 14 nt, Homo sapiens
cucuuucagugcuu

SEQ ID NO: 1611722 - RNA, 18 nt, Homo sapiens
cucuuugaucuacuugcc

SEQ ID NO: 1611723 - RNA, 19 nt, Homo sapiens
cucuuuggaggaagcccau

SEQ ID NO: 1611724 - RNA, 23 nt, Homo sapiens
cucuuuuacaguuagaaacacca

SEQ ID NO: 1611725 - RNA, 17 nt, Homo sapiens
cucuuuucuacacacuc

SEQ ID NO: 1611726 - RNA, 23 nt, Homo sapiens
cucuuuugugaugaacauauuca

SEQ ID NO: 1611727 - RNA, 18 nt, Homo sapiens
cugaaaaaaacauaucca

SEQ ID NO: 1611728 - RNA, 21 nt, Homo sapiens
cugaaaaaaacauauccaaaa

SEQ ID NO: 1611729 - RNA, 15 nt, Homo sapiens
cugaaaaaugcaaau

SEQ ID NO: 1611730 - RNA, 19 nt, Homo sapiens
cugaaaacacugugcacau

SEQ ID NO: 1611731 - RNA, 21 nt, Homo sapiens
cugaaacucauagacacugau

SEQ ID NO: 1611732 - RNA, 16 nt, Homo sapiens
cugaaagccuuaggga

SEQ ID NO: 1611733 - RNA, 18 nt, Homo sapiens
cugaaaggugauugcagc

SEQ ID NO: 1611734 - RNA, 19 nt, Homo sapiens
cugaaaggugauugcagcu

SEQ ID NO: 1611735 - RNA, 20 nt, Homo sapiens
cugaacaauauauacuuaua

SEQ ID NO: 1611736 - RNA, 21 nt, Homo sapiens
cugaacagcccucucucucac

SEQ ID NO: 1611737 - RNA, 12 nt, Homo sapiens
cugaacauauua

SEQ ID NO: 1611738 - RNA, 18 nt, Homo sapiens
cugaaccauguggauaac

SEQ ID NO: 1611739 - RNA, 14 nt, Homo sapiens
cugaaccauuccaa

SEQ ID NO: 1611740 - RNA, 19 nt, Homo sapiens
cugaacucaaacugaggaa

SEQ ID NO: 1611741 - RNA, 23 nt, Homo sapiens
cugaacucaccauagagacccau

SEQ ID NO: 1611742 - RNA, 21 nt, Homo sapiens
cugaacuuuaucuguucuguu

SEQ ID NO: 1611743 - RNA, 18 nt, Homo sapiens
cugaacuuucucccucau

SEQ ID NO: 1611744 - RNA, 11 nt, Homo sapiens
cugaagauauu

SEQ ID NO: 1611745 - RNA, 18 nt, Homo sapiens
cugaagcugacagcacua

SEQ ID NO: 1611746 - RNA, 21 nt, Homo sapiens
cugaagcugacagcacuacaa

SEQ ID NO: 1611747 - RNA, 21 nt, Homo sapiens
cugaagcuuaggacuaccagc

SEQ ID NO: 1611748 - RNA, 19 nt, Homo sapiens
cugaaggagccccauuccu

SEQ ID NO: 1611749 - RNA, 11 nt, Homo sapiens
cuugaagccaa

SEQ ID NO: 1611750 - RNA, 13 nt, Homo sapiens
cuugaaugccaua

SEQ ID NO: 1611751 - RNA, 18 nt, Homo sapiens
cuugaaugccauagucaa

SEQ ID NO: 1611752 - RNA, 11 nt, Homo sapiens
cuugacagucu

SEQ ID NO: 1611753 - RNA, 13 nt, Homo sapiens
cuugaccucguga

SEQ ID NO: 1611754 - RNA, 17 nt, Homo sapiens
cuugaccucgugaucca

SEQ ID NO: 1611755 - RNA, 18 nt, Homo sapiens
cuugaccucgugauccac

SEQ ID NO: 1611756 - RNA, 16 nt, Homo sapiens
cuugagaagcugccau

SEQ ID NO: 1611757 - RNA, 17 nt, Homo sapiens
cuugaguagacuuggac

SEQ ID NO: 1611758 - RNA, 15 nt, Homo sapiens
cuugaguauaagaua

SEQ ID NO: 1611759 - RNA, 22 nt, Homo sapiens
cuugagugagaagagcuugcac

SEQ ID NO: 1611760 - RNA, 15 nt, Homo sapiens
cuugagugugugaac

SEQ ID NO: 1611761 - RNA, 16 nt, Homo sapiens
cuugagugugugaaca

SEQ ID NO: 1611762 - RNA, 23 nt, Homo sapiens
cuugaucaacaucuuuucuugcc

SEQ ID NO: 1611763 - RNA, 23 nt, Homo sapiens
cuugaucggaaagcucuuccuaa

SEQ ID NO: 1611764 - RNA, 19 nt, Homo sapiens
cuugaucuuugagcccauu

SEQ ID NO: 1611765 - RNA, 24 nt, Homo sapiens
cuugaugcgggucaacauuuccaa

SEQ ID NO: 1611766 - RNA, 10 nt, Homo sapiens
ccaaaggggc

SEQ ID NO: 1611767 - RNA, 16 nt, Homo sapiens
ccaaaguacagaauuu

SEQ ID NO: 1611768 - RNA, 18 nt, Homo sapiens
ccaaagugcugggauuac

SEQ ID NO: 1611769 - RNA, 20 nt, Homo sapiens
ccaaaucugcauccuuuuca

SEQ ID NO: 1611770 - RNA, 22 nt, Homo sapiens
ccaaaugcagggaggggaggca

SEQ ID NO: 1611771 - RNA, 22 nt, Homo sapiens
ccaaaugcuuugggaacugugu

SEQ ID NO: 1611772 - RNA, 22 nt, Homo sapiens
ccaaauguaaaaauccuuuuga

SEQ ID NO: 1611773 - RNA, 23 nt, Homo sapiens
ccaaauuagggcaauuggaacaa

SEQ ID NO: 1611774 - RNA, 20 nt, Homo sapiens
ccaaauuguguauauaucuu

SEQ ID NO: 1611775 - RNA, 23 nt, Homo sapiens
ccaaauuuaauuaaagccuuaag

SEQ ID NO: 1611776 - RNA, 18 nt, Homo sapiens
ccaaauuuagaaagcuua

SEQ ID NO: 1611777 - RNA, 19 nt, Homo sapiens
ccaaauuuagucccagaaa

SEQ ID NO: 1611778 - RNA, 23 nt, Homo sapiens
ccaacacaaccauaagcagccag

SEQ ID NO: 1611779 - RNA, 17 nt, Homo sapiens
ccaacagagcugggcua

SEQ ID NO: 1611780 - RNA, 12 nt, Homo sapiens
ccaacagcacuu

SEQ ID NO: 1611781 - RNA, 18 nt, Homo sapiens
ccaacauggcacauguau

SEQ ID NO: 1611782 - RNA, 17 nt, Homo sapiens
ccaacaugucagaacua

SEQ ID NO: 1611783 - RNA, 21 nt, Homo sapiens
ccaacauuaaaagccaccccc

SEQ ID NO: 1611784 - RNA, 14 nt, Homo sapiens
ccaacauucuuggc

SEQ ID NO: 1611785 - RNA, 18 nt, Homo sapiens
ccaaccuggggggcagug

SEQ ID NO: 1611786 - RNA, 21 nt, Homo sapiens
ccaaccuucuugucauugaaa

SEQ ID NO: 1611787 - RNA, 23 nt, Homo sapiens
ccaacucaggacagaacaguguu

SEQ ID NO: 1611788 - RNA, 17 nt, Homo sapiens
ccaacuucaauuuacuu

SEQ ID NO: 1611789 - RNA, 19 nt, Homo sapiens
ccaacuugguuuugcuaca

SEQ ID NO: 1611790 - RNA, 13 nt, Homo sapiens
ccaagaacuugca

SEQ ID NO: 1611791 - RNA, 17 nt, Homo sapiens
ccaagaacuugcaauac

SEQ ID NO: 1611792 - RNA, 20 nt, Homo sapiens
ccaagaaguggcugccaaag

SEQ ID NO: 1611793 - RNA, 22 nt, Homo sapiens
ccaagacaaaaagccacaauga

SEQ ID NO: 1611794 - RNA, 22 nt, Homo sapiens
ccaagaccccaaaucaccacaa

SEQ ID NO: 1611795 - RNA, 10 nt, Homo sapiens
ccaagagcua

SEQ ID NO: 1611796 - RNA, 14 nt, Homo sapiens
ccaagagcuacucc

SEQ ID NO: 1611797 - RNA, 14 nt, Homo sapiens
ccaagaugagcugc

SEQ ID NO: 1611798 - RNA, 23 nt, Homo sapiens
ccaagauuaugugacuugcaaua

SEQ ID NO: 1611799 - RNA, 16 nt, Homo sapiens
ccaagcacagagccug

SEQ ID NO: 1611800 - RNA, 23 nt, Homo sapiens
ccaagccauguuccccaguucag

SEQ ID NO: 1611801 - RNA, 17 nt, Homo sapiens
ccaagccccugccucca

SEQ ID NO: 1611802 - RNA, 14 nt, Homo sapiens
ccaagcugcauggc

SEQ ID NO: 1611803 - RNA, 21 nt, Homo sapiens
ccaagcugggccccagcccac

SEQ ID NO: 1611804 - RNA, 15 nt, Homo sapiens
ccaaggacacccucc

SEQ ID NO: 1611805 - RNA, 22 nt, Homo sapiens
ccaaggaccucucucaaugcca

SEQ ID NO: 1611806 - RNA, 16 nt, Homo sapiens
ccaaggccuaccccag

SEQ ID NO: 1611807 - RNA, 22 nt, Homo sapiens
ccaaggcugagacagugaauuu

SEQ ID NO: 1611808 - RNA, 11 nt, Homo sapiens
ccaaggucucc

SEQ ID NO: 1611809 - RNA, 22 nt, Homo sapiens
ccaaggugcugaugucaaagug

SEQ ID NO: 1611810 - RNA, 17 nt, Homo sapiens
ccaagguuacucagcag

SEQ ID NO: 1611811 - RNA, 17 nt, Homo sapiens
ccaagguugcacagcaa

SEQ ID NO: 1611812 - RNA, 11 nt, Homo sapiens
ccaagugccaa

SEQ ID NO: 1611813 - RNA, 18 nt, Homo sapiens
ccaagugggaauguuuaa

SEQ ID NO: 1611814 - RNA, 16 nt, Homo sapiens
ccaagugggauuugca

SEQ ID NO: 1611815 - RNA, 20 nt, Homo sapiens
ccaauaaaauguaucugcau

SEQ ID NO: 1611816 - RNA, 18 nt, Homo sapiens
ccaauaaaccagugugaa

SEQ ID NO: 1611817 - RNA, 19 nt, Homo sapiens
ccaauaaaggcagcugccu

SEQ ID NO: 1611818 - RNA, 17 nt, Homo sapiens
ccaaucagcacucugua

SEQ ID NO: 1611819 - RNA, 17 nt, Homo sapiens
ccaaucagcgcucugua

SEQ ID NO: 1611820 - RNA, 16 nt, Homo sapiens
ccaauccccagacuca

SEQ ID NO: 1611821 - RNA, 17 nt, Homo sapiens
ccaauccuggacaugaa

SEQ ID NO: 1611822 - RNA, 17 nt, Homo sapiens
ccaaugcacugaugugu

SEQ ID NO: 1611823 - RNA, 15 nt, Homo sapiens
ccaaugcucuuuuca

SEQ ID NO: 1611824 - RNA, 20 nt, Homo sapiens
ccaaugcuguggguuuccaa

SEQ ID NO: 1611825 - RNA, 15 nt, Homo sapiens
ccaaugggacaguua

SEQ ID NO: 1611826 - RNA, 21 nt, Homo sapiens
ccaauguucuaaaguuuugca

SEQ ID NO: 1611827 - RNA, 22 nt, Homo sapiens
ccaauguuugacaaaacacagc

SEQ ID NO: 1611828 - RNA, 18 nt, Homo sapiens
ccaauugcucuuucacag

SEQ ID NO: 1611829 - RNA, 23 nt, Homo sapiens
ccaauuugguaaaaaugcugcuc

SEQ ID NO: 1611830 - RNA, 16 nt, Homo sapiens
ccacaaaaaauacuuu

SEQ ID NO: 1611831 - RNA, 21 nt, Homo sapiens
ccacaaucuggcuuagugcca

SEQ ID NO: 1611832 - RNA, 14 nt, Homo sapiens
ccacaaugccagac

SEQ ID NO: 1611833 - RNA, 14 nt, Homo sapiens
ccacacaaauucag

SEQ ID NO: 1611834 - RNA, 13 nt, Homo sapiens
ccacacacugagu

SEQ ID NO: 1611835 - RNA, 17 nt, Homo sapiens
ccacacaugaaucugca

SEQ ID NO: 1611836 - RNA, 16 nt, Homo sapiens
ccacacauuaguacuu

SEQ ID NO: 1611837 - RNA, 15 nt, Homo sapiens
ccacacccacuuugu

SEQ ID NO: 1611838 - RNA, 15 nt, Homo sapiens
ccacacccagcucag

SEQ ID NO: 1611839 - RNA, 11 nt, Homo sapiens
ccacaccucag

SEQ ID NO: 1611840 - RNA, 21 nt, Homo sapiens
ccacacuuguuccagcucuuu

SEQ ID NO: 1611841 - RNA, 17 nt, Homo sapiens
ccacagacaacauggaa

SEQ ID NO: 1611842 - RNA, 18 nt, Homo sapiens
ccacagggagcuccguca

SEQ ID NO: 1611843 - RNA, 15 nt, Homo sapiens
ccacaggucuaagag

SEQ ID NO: 1611844 - RNA, 20 nt, Homo sapiens
ccacaguucacaugccacaa

SEQ ID NO: 1611845 - RNA, 13 nt, Homo sapiens
ccacauaagcacu

SEQ ID NO: 1611846 - RNA, 23 nt, Homo sapiens
ccacauaggaaaaugccaugaaa

SEQ ID NO: 1611847 - RNA, 14 nt, Homo sapiens
ccacauauagagcu

SEQ ID NO: 1611848 - RNA, 21 nt, Homo sapiens
ccacauauuuuagacacuucc

SEQ ID NO: 1611849 - RNA, 13 nt, Homo sapiens
ccacaucagggcg

SEQ ID NO: 1611850 - RNA, 22 nt, Homo sapiens
ccacaugaggccaucucaggag

SEQ ID NO: 1611851 - RNA, 12 nt, Homo sapiens
ccacaugcaugu

SEQ ID NO: 1611852 - RNA, 18 nt, Homo sapiens
ccacaugggagcagucca

SEQ ID NO: 1611853 - RNA, 11 nt, Homo sapiens
ccacauggugu

SEQ ID NO: 1611854 - RNA, 18 nt, Homo sapiens
ccacauuuccacaccaga

SEQ ID NO: 1611855 - RNA, 16 nt, Homo sapiens
ccaccaaaugugcuuu

SEQ ID NO: 1611856 - RNA, 19 nt, Homo sapiens
ccaccaaaugugcuuugag

SEQ ID NO: 1611857 - RNA, 21 nt, Homo sapiens
ccaccaaccccccaccuccac

SEQ ID NO: 1611858 - RNA, 20 nt, Homo sapiens
ccaccaagggaucugccauu

SEQ ID NO: 1611859 - RNA, 16 nt, Homo sapiens
ccaccagcaguucccu

SEQ ID NO: 1611860 - RNA, 20 nt, Homo sapiens
ccaccaggccagcucaggaa

SEQ ID NO: 1611861 - RNA, 13 nt, Homo sapiens
ccaccagugccuc

SEQ ID NO: 1611862 - RNA, 20 nt, Homo sapiens
ccaccaucaaaggaauauaa

SEQ ID NO: 1611863 - RNA, 15 nt, Homo sapiens
ccaccauuucugggg

SEQ ID NO: 1611864 - RNA, 16 nt, Homo sapiens
ccacccaaaagucaaa

SEQ ID NO: 1611865 - RNA, 17 nt, Homo sapiens
ccacccaccuggcuuca

SEQ ID NO: 1611866 - RNA, 16 nt, Homo sapiens
ccacccaccuuugcca

SEQ ID NO: 1611867 - RNA, 13 nt, Homo sapiens
ccaccccagcuca

SEQ ID NO: 1611868 - RNA, 14 nt, Homo sapiens
ccaccccuaccucu

SEQ ID NO: 1611869 - RNA, 21 nt, Homo sapiens
ccaccuaaaaacauuuacuga

SEQ ID NO: 1611870 - RNA, 13 nt, Homo sapiens
ccaccucuaccaa

SEQ ID NO: 1611871 - RNA, 16 nt, Homo sapiens
ccaccugacacaccag

SEQ ID NO: 1611872 - RNA, 16 nt, Homo sapiens
ccaccuuugccacaaa

SEQ ID NO: 1611873 - RNA, 20 nt, Homo sapiens
ccacgacuguuguacaagcu

SEQ ID NO: 1611874 - RNA, 13 nt, Homo sapiens
ccacgcugaccau

SEQ ID NO: 1611875 - RNA, 15 nt, Homo sapiens
ccacgugguguguuu

SEQ ID NO: 1611876 - RNA, 23 nt, Homo sapiens
ccacuaaaguagggaaguuuuau

SEQ ID NO: 1611877 - RNA, 15 nt, Homo sapiens
ccacuaaccaucccc

SEQ ID NO: 1611878 - RNA, 11 nt, Homo sapiens
caugugccuuu

SEQ ID NO: 1611879 - RNA, 22 nt, Homo sapiens
caugugcuucaucugugggaug

SEQ ID NO: 1611880 - RNA, 13 nt, Homo sapiens
caugugcuugcca

SEQ ID NO: 1611881 - RNA, 23 nt, Homo sapiens
cauguggcuccucccagcccaua

SEQ ID NO: 1611882 - RNA, 14 nt, Homo sapiens
cauguuaaucacau

SEQ ID NO: 1611883 - RNA, 23 nt, Homo sapiens
cauguuuauaaaucuuaugcucu

SEQ ID NO: 1611884 - RNA, 19 nt, Homo sapiens
cauguuucccuacaccucu

SEQ ID NO: 1611885 - RNA, 22 nt, Homo sapiens
cauuaaaauauagagacaggac

SEQ ID NO: 1611886 - RNA, 18 nt, Homo sapiens
cauuaaagagccaguuua

SEQ ID NO: 1611887 - RNA, 19 nt, Homo sapiens
cauuaaagagccaguuuau

SEQ ID NO: 1611888 - RNA, 15 nt, Homo sapiens
cauuaacugcacaaa

SEQ ID NO: 1611889 - RNA, 18 nt, Homo sapiens
cauuaauaccuaaacugu

SEQ ID NO: 1611890 - RNA, 16 nt, Homo sapiens
cauuacuuguauaaau

SEQ ID NO: 1611891 - RNA, 14 nt, Homo sapiens
cauuagccaaggau

SEQ ID NO: 1611892 - RNA, 16 nt, Homo sapiens
cauuagucaauaacua

SEQ ID NO: 1611893 - RNA, 19 nt, Homo sapiens
cauuaucuaguucauugaa

SEQ ID NO: 1611894 - RNA, 13 nt, Homo sapiens
cauuaucuugcag

SEQ ID NO: 1611895 - RNA, 19 nt, Homo sapiens
cauuaucuugcagcuguaa

SEQ ID NO: 1611896 - RNA, 22 nt, Homo sapiens
cauuaucuugcagcuguaaaca

SEQ ID NO: 1611897 - RNA, 16 nt, Homo sapiens
cauuauucuucacuua

SEQ ID NO: 1611898 - RNA, 14 nt, Homo sapiens
cauuauuuggcuua

SEQ ID NO: 1611899 - RNA, 18 nt, Homo sapiens
cauucaacagagacugaa

SEQ ID NO: 1611900 - RNA, 15 nt, Homo sapiens
cauucauucauucag

SEQ ID NO: 1611901 - RNA, 21 nt, Homo sapiens
cauucccagggaccuuggaaa

SEQ ID NO: 1611902 - RNA, 20 nt, Homo sapiens
cauuccccuccccacuccuc

SEQ ID NO: 1611903 - RNA, 19 nt, Homo sapiens
cauuccugugcggacagcc

SEQ ID NO: 1611904 - RNA, 20 nt, Homo sapiens
cauuccuuuuucuucacuua

SEQ ID NO: 1611905 - RNA, 17 nt, Homo sapiens
cauucggugugaacuuu

SEQ ID NO: 1611906 - RNA, 13 nt, Homo sapiens
cauucgucaucac

SEQ ID NO: 1611907 - RNA, 17 nt, Homo sapiens
cauucuaaaacacaaca

SEQ ID NO: 1611908 - RNA, 14 nt, Homo sapiens
cauucuacugaaca

SEQ ID NO: 1611909 - RNA, 15 nt, Homo sapiens
cauucuagauccugc

SEQ ID NO: 1611910 - RNA, 22 nt, Homo sapiens
cauucuccuccuauugccucca

SEQ ID NO: 1611911 - RNA, 21 nt, Homo sapiens
cauucuccugccucagccucc

SEQ ID NO: 1611912 - RNA, 18 nt, Homo sapiens
cauucucugccuguacug

SEQ ID NO: 1611913 - RNA, 14 nt, Homo sapiens
cauucugaaucaga

SEQ ID NO: 1611914 - RNA, 15 nt, Homo sapiens
cauucugcacucaga

SEQ ID NO: 1611915 - RNA, 14 nt, Homo sapiens
cauucugcuacuuc

SEQ ID NO: 1611916 - RNA, 20 nt, Homo sapiens
cauucuucagacaucaguca

SEQ ID NO: 1611917 - RNA, 13 nt, Homo sapiens
cauucuucuacuu

SEQ ID NO: 1611918 - RNA, 18 nt, Homo sapiens
cauucuuuuucuguugaa

SEQ ID NO: 1611919 - RNA, 16 nt, Homo sapiens
cauugaacacaaacug

SEQ ID NO: 1611920 - RNA, 14 nt, Homo sapiens
cauugaucugggau

SEQ ID NO: 1611921 - RNA, 23 nt, Homo sapiens
cauugaugcugcuggcuaagcau

SEQ ID NO: 1611922 - RNA, 14 nt, Homo sapiens
cauugcagcagaua

SEQ ID NO: 1611923 - RNA, 16 nt, Homo sapiens
cauugccuuugaaugu

SEQ ID NO: 1611924 - RNA, 17 nt, Homo sapiens
cauugcuaaacugauga

SEQ ID NO: 1611925 - RNA, 20 nt, Homo sapiens
cauugcugacuguguauaua

SEQ ID NO: 1611926 - RNA, 21 nt, Homo sapiens
cauuggaccuuuccugaggaa

SEQ ID NO: 1611927 - RNA, 23 nt, Homo sapiens
cauugucacaacaauuaaauaua

SEQ ID NO: 1611928 - RNA, 16 nt, Homo sapiens
cauugugaaccaaugc

SEQ ID NO: 1611929 - RNA, 22 nt, Homo sapiens
cauuguggccgccaugagcaac

SEQ ID NO: 1611930 - RNA, 14 nt, Homo sapiens
cauuguucacuucu

SEQ ID NO: 1611931 - RNA, 22 nt, Homo sapiens
cauuguuuagaaagaauauuca

SEQ ID NO: 1611932 - RNA, 18 nt, Homo sapiens
cauuuaaaaagguuuaaa

SEQ ID NO: 1611933 - RNA, 20 nt, Homo sapiens
cauuuaaagaaagaaugcau

SEQ ID NO: 1611934 - RNA, 22 nt, Homo sapiens
cauuuaaauaucugaacauuua

SEQ ID NO: 1611935 - RNA, 20 nt, Homo sapiens
cauuuacuuagcagaaccac

SEQ ID NO: 1611936 - RNA, 14 nt, Homo sapiens
cauuuaucaccucu

SEQ ID NO: 1611937 - RNA, 21 nt, Homo sapiens
cauuuaucuuuuguauaucua

SEQ ID NO: 1611938 - RNA, 21 nt, Homo sapiens
cauuuauuuacacucuugauu

SEQ ID NO: 1611939 - RNA, 16 nt, Homo sapiens
cauuucaaaaugcuuc

SEQ ID NO: 1611940 - RNA, 13 nt, Homo sapiens
cauuucaaugugu

SEQ ID NO: 1611941 - RNA, 23 nt, Homo sapiens
cauuucuacuaugaucagaagaa

SEQ ID NO: 1611942 - RNA, 22 nt, Homo sapiens
cauuucuauuucuccuccaugg

SEQ ID NO: 1611943 - RNA, 12 nt, Homo sapiens
cauuucucaagg

SEQ ID NO: 1611944 - RNA, 16 nt, Homo sapiens
cauuucucauguugaa

SEQ ID NO: 1611945 - RNA, 23 nt, Homo sapiens
cauuucucuaacuccugccauuc

SEQ ID NO: 1611946 - RNA, 21 nt, Homo sapiens
cauuucuucucguuuucacag

SEQ ID NO: 1611947 - RNA, 23 nt, Homo sapiens
cauuucuuuucucuuuaaucucc

SEQ ID NO: 1611948 - RNA, 17 nt, Homo sapiens
cauuugaaugcuuaauu

SEQ ID NO: 1611949 - RNA, 20 nt, Homo sapiens
cauuugaaugcuuaauucaa

SEQ ID NO: 1611950 - RNA, 19 nt, Homo sapiens
cauuugacccuugcuguga

SEQ ID NO: 1611951 - RNA, 11 nt, Homo sapiens
cauuugcugaa

SEQ ID NO: 1611952 - RNA, 21 nt, Homo sapiens
cauuuguagcuuugcccauug

SEQ ID NO: 1611953 - RNA, 14 nt, Homo sapiens
cauuugugaagcuu

SEQ ID NO: 1611954 - RNA, 13 nt, Homo sapiens
cauuugugcaaga

SEQ ID NO: 1611955 - RNA, 16 nt, Homo sapiens
cauuugugcguaugca

SEQ ID NO: 1611956 - RNA, 22 nt, Homo sapiens
cauuuguguuuugaaagcccaa

SEQ ID NO: 1611957 - RNA, 21 nt, Homo sapiens
cauuuuaaauuccacugaaaa

SEQ ID NO: 1611958 - RNA, 18 nt, Homo sapiens
cauuuuaacgcugccuaa

SEQ ID NO: 1611959 - RNA, 17 nt, Homo sapiens
cauuuuauguuaaggga

SEQ ID NO: 1611960 - RNA, 12 nt, Homo sapiens
cauuuuccuuag

SEQ ID NO: 1611961 - RNA, 20 nt, Homo sapiens
cauuuuccuuaggaaaaaca

SEQ ID NO: 1611962 - RNA, 20 nt, Homo sapiens
cauuuucuugaugucacuau

SEQ ID NO: 1611963 - RNA, 21 nt, Homo sapiens
cauuuuguaaguugaagcaaa

SEQ ID NO: 1611964 - RNA, 13 nt, Homo sapiens
cauuuuguggaau

SEQ ID NO: 1611965 - RNA, 18 nt, Homo sapiens
cauuuuguuuuuacugua

SEQ ID NO: 1611966 - RNA, 14 nt, Homo sapiens
cauuuuuaaccacu

SEQ ID NO: 1611967 - RNA, 16 nt, Homo sapiens
cauuuuucaaagcaau

SEQ ID NO: 1611968 - RNA, 20 nt, Homo sapiens
cauuuuugucagagugcaca

SEQ ID NO: 1611969 - RNA, 17 nt, Homo sapiens
cauuuuuuaaugugcuc

SEQ ID NO: 1611970 - RNA, 22 nt, Homo sapiens
cauuuuuugagguaucacugca

SEQ ID NO: 1611971 - RNA, 16 nt, Homo sapiens
ccaaaaauuacuuugg

SEQ ID NO: 1611972 - RNA, 22 nt, Homo sapiens
ccaaaaauuauguguugccaaa

SEQ ID NO: 1611973 - RNA, 18 nt, Homo sapiens
ccaaaacaagccaaagag

SEQ ID NO: 1611974 - RNA, 18 nt, Homo sapiens
ccaaaacauaccauuucu

SEQ ID NO: 1611975 - RNA, 12 nt, Homo sapiens
ccaaaaccaaac

SEQ ID NO: 1611976 - RNA, 19 nt, Homo sapiens
ccaaaaccuuccucuucca

SEQ ID NO: 1611977 - RNA, 18 nt, Homo sapiens
ccaaaacguugaauugau

SEQ ID NO: 1611978 - RNA, 17 nt, Homo sapiens
ccaaaauaccagagccu

SEQ ID NO: 1611979 - RNA, 20 nt, Homo sapiens
ccaaaauauaaucagagaua

SEQ ID NO: 1611980 - RNA, 14 nt, Homo sapiens
ccaaaauauauauu

SEQ ID NO: 1611981 - RNA, 19 nt, Homo sapiens
ccaaaauauuaacauucuu

SEQ ID NO: 1611982 - RNA, 13 nt, Homo sapiens
ccaaaauccgacu

SEQ ID NO: 1611983 - RNA, 13 nt, Homo sapiens
ccaaaaugucauu

SEQ ID NO: 1611984 - RNA, 15 nt, Homo sapiens
ccaaaauucauuucu

SEQ ID NO: 1611985 - RNA, 20 nt, Homo sapiens
ccaaacaacagucuucauuu

SEQ ID NO: 1611986 - RNA, 23 nt, Homo sapiens
ccaaacaggacagcacugggaac

SEQ ID NO: 1611987 - RNA, 19 nt, Homo sapiens
ccaaacuuuagcaacaguu

SEQ ID NO: 1611988 - RNA, 20 nt, Homo sapiens
ccaaagaaaugaacauucca

SEQ ID NO: 1611989 - RNA, 13 nt, Homo sapiens
ccaaagcaucaau

SEQ ID NO: 1611990 - RNA, 18 nt, Homo sapiens
cauccugauuuuuacuau

SEQ ID NO: 1611991 - RNA, 15 nt, Homo sapiens
cauccuucuaagaca

SEQ ID NO: 1611992 - RNA, 15 nt, Homo sapiens
caucgauugauaugc

SEQ ID NO: 1611993 - RNA, 20 nt, Homo sapiens
caucgcaggaugacagcucc

SEQ ID NO: 1611994 - RNA, 17 nt, Homo sapiens
caucggaaaaauaauca

SEQ ID NO: 1611995 - RNA, 23 nt, Homo sapiens
caucguugcaaccacugcaauau

SEQ ID NO: 1611996 - RNA, 11 nt, Homo sapiens
caucuacuuag

SEQ ID NO: 1611997 - RNA, 14 nt, Homo sapiens
caucuagucacaaa

SEQ ID NO: 1611998 - RNA, 20 nt, Homo sapiens
caucuaucagauuaaguuag

SEQ ID NO: 1611999 - RNA, 14 nt, Homo sapiens
caucuaucugguga

SEQ ID NO: 1612000 - RNA, 20 nt, Homo sapiens
caucuauuuccucugugcaa

SEQ ID NO: 1612001 - RNA, 22 nt, Homo sapiens
caucuauuuugaugcagcauuu

SEQ ID NO: 1612002 - RNA, 21 nt, Homo sapiens
caucuauuuuggauuguauau

SEQ ID NO: 1612003 - RNA, 21 nt, Homo sapiens
caucucaaagaaggcauuugc

SEQ ID NO: 1612004 - RNA, 22 nt, Homo sapiens
caucucaaggggcccagccucc

SEQ ID NO: 1612005 - RNA, 16 nt, Homo sapiens
caucucagugaagaau

SEQ ID NO: 1612006 - RNA, 15 nt, Homo sapiens
caucucaucaugucu

SEQ ID NO: 1612007 - RNA, 16 nt, Homo sapiens
caucuccauguagaau

SEQ ID NO: 1612008 - RNA, 14 nt, Homo sapiens
caucuccaugugac

SEQ ID NO: 1612009 - RNA, 21 nt, Homo sapiens
caucucccagauaaugugaaa

SEQ ID NO: 1612010 - RNA, 20 nt, Homo sapiens
caucuccccucagauuccac

SEQ ID NO: 1612011 - RNA, 21 nt, Homo sapiens
caucuccccucagauuccacc

SEQ ID NO: 1612012 - RNA, 23 nt, Homo sapiens
caucucuaacauaugauacugau

SEQ ID NO: 1612013 - RNA, 16 nt, Homo sapiens
caucucuuuaccuccu

SEQ ID NO: 1612014 - RNA, 23 nt, Homo sapiens
caucucuuuaccuccuaauucca

SEQ ID NO: 1612015 - RNA, 20 nt, Homo sapiens
caucugaaagugguacuuga

SEQ ID NO: 1612016 - RNA, 20 nt, Homo sapiens
caucugcgggggugauguga

SEQ ID NO: 1612017 - RNA, 15 nt, Homo sapiens
caucuggcggaucca

SEQ ID NO: 1612018 - RNA, 22 nt, Homo sapiens
caucuggggcaccugcuuccac

SEQ ID NO: 1612019 - RNA, 22 nt, Homo sapiens
caucugugcucuccguguuccu

SEQ ID NO: 1612020 - RNA, 15 nt, Homo sapiens
caucuucuccaucug

SEQ ID NO: 1612021 - RNA, 18 nt, Homo sapiens
caucuucuuauuuuccaa

SEQ ID NO: 1612022 - RNA, 20 nt, Homo sapiens
caucuucuuauuuuccaaau

SEQ ID NO: 1612023 - RNA, 18 nt, Homo sapiens
caucuugagccacaguca

SEQ ID NO: 1612024 - RNA, 14 nt, Homo sapiens
caucuugcuaccag

SEQ ID NO: 1612025 - RNA, 16 nt, Homo sapiens
caucuugcuaccagua

SEQ ID NO: 1612026 - RNA, 21 nt, Homo sapiens
caucuuucuuccaaacaggcu

SEQ ID NO: 1612027 - RNA, 14 nt, Homo sapiens
caucuuuucuugcc

SEQ ID NO: 1612028 - RNA, 19 nt, Homo sapiens
caugaaaaagaauaccaau

SEQ ID NO: 1612029 - RNA, 18 nt, Homo sapiens
caugaaaauaaacuugaa

SEQ ID NO: 1612030 - RNA, 20 nt, Homo sapiens
caugaaagcaucugagcuaa

SEQ ID NO: 1612031 - RNA, 18 nt, Homo sapiens
caugaaaguggacaagga

SEQ ID NO: 1612032 - RNA, 19 nt, Homo sapiens
caugaaaguggacaaggag

SEQ ID NO: 1612033 - RNA, 13 nt, Homo sapiens
caugaaauguguu

SEQ ID NO: 1612034 - RNA, 14 nt, Homo sapiens
caugaacuauauga

SEQ ID NO: 1612035 - RNA, 14 nt, Homo sapiens
caugaagcacauca

SEQ ID NO: 1612036 - RNA, 13 nt, Homo sapiens
caugaagcacuga

SEQ ID NO: 1612037 - RNA, 22 nt, Homo sapiens
caugaauaacauuuaaauucca

SEQ ID NO: 1612038 - RNA, 17 nt, Homo sapiens
caugaaucucucaauua

SEQ ID NO: 1612039 - RNA, 18 nt, Homo sapiens
caugagaugagaugacca

SEQ ID NO: 1612040 - RNA, 22 nt, Homo sapiens
caugagauuuuuuagaucuucc

SEQ ID NO: 1612041 - RNA, 18 nt, Homo sapiens
caugaggcaguuccuucc

SEQ ID NO: 1612042 - RNA, 20 nt, Homo sapiens
caugaggccaccaguaaaag

SEQ ID NO: 1612043 - RNA, 15 nt, Homo sapiens
caugaggccaucuca

SEQ ID NO: 1612044 - RNA, 19 nt, Homo sapiens
caugaggccaucucaggag

SEQ ID NO: 1612045 - RNA, 13 nt, Homo sapiens
caugauacauuuu

SEQ ID NO: 1612046 - RNA, 14 nt, Homo sapiens
caugauaggauuug

SEQ ID NO: 1612047 - RNA, 15 nt, Homo sapiens
caugaugcuaaaggc

SEQ ID NO: 1612048 - RNA, 16 nt, Homo sapiens
caugauggugcaugcc

SEQ ID NO: 1612049 - RNA, 23 nt, Homo sapiens
caugaugugaagaguuucacaaa

SEQ ID NO: 1612050 - RNA, 12 nt, Homo sapiens
caugauuuccca

SEQ ID NO: 1612051 - RNA, 10 nt, Homo sapiens
caugcaaaau

SEQ ID NO: 1612052 - RNA, 15 nt, Homo sapiens
caugcaaaauauguu

SEQ ID NO: 1612053 - RNA, 23 nt, Homo sapiens
caugcaaacugcuuuauuuuccc

SEQ ID NO: 1612054 - RNA, 13 nt, Homo sapiens
caugcacugaugu

SEQ ID NO: 1612055 - RNA, 15 nt, Homo sapiens
caugcagcucuucaa

SEQ ID NO: 1612056 - RNA, 21 nt, Homo sapiens
caugcagcuguggcagaguua

SEQ ID NO: 1612057 - RNA, 18 nt, Homo sapiens
caugcauacuuacagacu

SEQ ID NO: 1612058 - RNA, 18 nt, Homo sapiens
caugcauguccuguaaag

SEQ ID NO: 1612059 - RNA, 23 nt, Homo sapiens
caugcauguucuccucuaucuua

SEQ ID NO: 1612060 - RNA, 19 nt, Homo sapiens
caugcauugagcucucuca

SEQ ID NO: 1612061 - RNA, 14 nt, Homo sapiens
caugccuugagauc

SEQ ID NO: 1612062 - RNA, 15 nt, Homo sapiens
caugcuacaguuauu

SEQ ID NO: 1612063 - RNA, 16 nt, Homo sapiens
caugcuacaguuauua

SEQ ID NO: 1612064 - RNA, 18 nt, Homo sapiens
caugcucucucaccugcu

SEQ ID NO: 1612065 - RNA, 16 nt, Homo sapiens
caugcuggcugaagag

SEQ ID NO: 1612066 - RNA, 17 nt, Homo sapiens
caugcugggauuuccaa

SEQ ID NO: 1612067 - RNA, 14 nt, Homo sapiens
caugcugugcugug

SEQ ID NO: 1612068 - RNA, 19 nt, Homo sapiens
caugcuguugcugcuacug

SEQ ID NO: 1612069 - RNA, 20 nt, Homo sapiens
caugcuuaauaaacauguca

SEQ ID NO: 1612070 - RNA, 21 nt, Homo sapiens
cauggaaauguauuuuaguua

SEQ ID NO: 1612071 - RNA, 22 nt, Homo sapiens
cauggaacaaaugggaucaauu

SEQ ID NO: 1612072 - RNA, 17 nt, Homo sapiens
cauggaaucgaaguguu

SEQ ID NO: 1612073 - RNA, 20 nt, Homo sapiens
cauggaauuucuaguaugag

SEQ ID NO: 1612074 - RNA, 13 nt, Homo sapiens
cauggacauuuag

SEQ ID NO: 1612075 - RNA, 12 nt, Homo sapiens
cauggaccacga

SEQ ID NO: 1612076 - RNA, 15 nt, Homo sapiens
cauggagaaacccug

SEQ ID NO: 1612077 - RNA, 21 nt, Homo sapiens
cauggagacguggugggacuc

SEQ ID NO: 1612078 - RNA, 17 nt, Homo sapiens
cauggaggaacaguauu

SEQ ID NO: 1612079 - RNA, 22 nt, Homo sapiens
cauggaggccaagaacuugcaa

SEQ ID NO: 1612080 - RNA, 18 nt, Homo sapiens
cauggauaacuacauuac

SEQ ID NO: 1612081 - RNA, 20 nt, Homo sapiens
cauggauuacuucucuauaa

SEQ ID NO: 1612082 - RNA, 16 nt, Homo sapiens
cauggcacauguauac

SEQ ID NO: 1612083 - RNA, 14 nt, Homo sapiens
cauggcagggccag

SEQ ID NO: 1612084 - RNA, 12 nt, Homo sapiens
cauggccucaaa

SEQ ID NO: 1612085 - RNA, 17 nt, Homo sapiens
cauggccugagcaucca

SEQ ID NO: 1612086 - RNA, 14 nt, Homo sapiens
cauggcuaccucag

SEQ ID NO: 1612087 - RNA, 21 nt, Homo sapiens
cauggcuuagagaggcuugaa

SEQ ID NO: 1612088 - RNA, 20 nt, Homo sapiens
caugggauggggaugaagua

SEQ ID NO: 1612089 - RNA, 21 nt, Homo sapiens
cauggugaaacccccaucucu

SEQ ID NO: 1612090 - RNA, 20 nt, Homo sapiens
cauggugaaaccccgucucu

SEQ ID NO: 1612091 - RNA, 13 nt, Homo sapiens
cauggugcuacuu

SEQ ID NO: 1612092 - RNA, 20 nt, Homo sapiens
caugguucugccuccuggcc

SEQ ID NO: 1612093 - RNA, 16 nt, Homo sapiens
cauguaaacugugcac

SEQ ID NO: 1612094 - RNA, 15 nt, Homo sapiens
cauguaaauugcaaa

SEQ ID NO: 1612095 - RNA, 19 nt, Homo sapiens
cauguacccaaaguguucu

SEQ ID NO: 1612096 - RNA, 18 nt, Homo sapiens
cauguaccucugauuaau

SEQ ID NO: 1612097 - RNA, 18 nt, Homo sapiens
cauguacuacagcuauau

SEQ ID NO: 1612098 - RNA, 20 nt, Homo sapiens
cauguaucucaguaccccau

SEQ ID NO: 1612099 - RNA, 12 nt, Homo sapiens
caugucaucaaa

SEQ ID NO: 1612100 - RNA, 19 nt, Homo sapiens
caugucauuucagaaguua

SEQ ID NO: 1612101 - RNA, 14 nt, Homo sapiens
cauguccauaugca

SEQ ID NO: 1612102 - RNA, 13 nt, Homo sapiens
caugucuagagaa

SEQ ID NO: 1612103 - RNA, 19 nt, Homo sapiens
cagauucuucacuggugag

SEQ ID NO: 1612104 - RNA, 12 nt, Homo sapiens
cagauugaacuu

SEQ ID NO: 1612105 - RNA, 22 nt, Homo sapiens
cagauuggguuggaaugcuuuc

SEQ ID NO: 1612106 - RNA, 16 nt, Homo sapiens
cagauuuucaugcaaa

SEQ ID NO: 1612107 - RNA, 14 nt, Homo sapiens
auccaggcuuugua

SEQ ID NO: 1612108 - RNA, 15 nt, Homo sapiens
auccagucuauucac

SEQ ID NO: 1612109 - RNA, 21 nt, Homo sapiens
auugacucaaaaaugagguac

SEQ ID NO: 1612110 - RNA, 17 nt, Homo sapiens
auugacucaaaccauau

SEQ ID NO: 1612111 - RNA, 14 nt, Homo sapiens
auuuccauagucaa

SEQ ID NO: 1612112 - RNA, 18 nt, Homo sapiens
auuuccauagucaaugau

SEQ ID NO: 1612113 - RNA, 18 nt, Homo sapiens
auuucccacugcacucca

SEQ ID NO: 1612114 - RNA, 16 nt, Homo sapiens
auuuccccagccacag

SEQ ID NO: 1612115 - RNA, 20 nt, Homo sapiens
auuuccccagccacaggcca

SEQ ID NO: 1612116 - RNA, 18 nt, Homo sapiens
auuucccugcagaccuca

SEQ ID NO: 1612117 - RNA, 17 nt, Homo sapiens
auuuccuaauacuguca

SEQ ID NO: 1612118 - RNA, 15 nt, Homo sapiens
auuuccuaugcaaau

SEQ ID NO: 1612119 - RNA, 22 nt, Homo sapiens
auuuccuuaaauguuuugccag

SEQ ID NO: 1612120 - RNA, 15 nt, Homo sapiens
auuuccuuuuugaca

SEQ ID NO: 1612121 - RNA, 22 nt, Homo sapiens
auuucgaagccacagagucucu

SEQ ID NO: 1612122 - RNA, 14 nt, Homo sapiens
auuucgugugccgc

SEQ ID NO: 1612123 - RNA, 17 nt, Homo sapiens
auuucuaauguuuacua

SEQ ID NO: 1612124 - RNA, 20 nt, Homo sapiens
auuucuaauguuuacuauau

SEQ ID NO: 1612125 - RNA, 16 nt, Homo sapiens
auuucuauagccaaaa

SEQ ID NO: 1612126 - RNA, 16 nt, Homo sapiens
auuucucaagggccau

SEQ ID NO: 1612127 - RNA, 16 nt, Homo sapiens
auuucuccuccauggg

SEQ ID NO: 1612128 - RNA, 17 nt, Homo sapiens
auuucucuacuugucau

SEQ ID NO: 1612129 - RNA, 15 nt, Homo sapiens
auuucugaacaguac

SEQ ID NO: 1612130 - RNA, 22 nt, Homo sapiens
auuucugaggagccugcaacau

SEQ ID NO: 1612131 - RNA, 19 nt, Homo sapiens
auuucugaucuauacaaau

SEQ ID NO: 1612132 - RNA, 22 nt, Homo sapiens
auuucugggccgggcauggugg

SEQ ID NO: 1612133 - RNA, 19 nt, Homo sapiens
auuucuguuccagucacau

SEQ ID NO: 1612134 - RNA, 15 nt, Homo sapiens
auuucuuaacuucuu

SEQ ID NO: 1612135 - RNA, 17 nt, Homo sapiens
auuucuucuacugcuau

SEQ ID NO: 1612136 - RNA, 21 nt, Homo sapiens
auuugaauuauuucugucaca

SEQ ID NO: 1612137 - RNA, 18 nt, Homo sapiens
auuugacaaaacuaaccu

SEQ ID NO: 1612138 - RNA, 13 nt, Homo sapiens
auuugacuauucu

SEQ ID NO: 1612139 - RNA, 21 nt, Homo sapiens
auuugacugaagaugcagcuc

SEQ ID NO: 1612140 - RNA, 14 nt, Homo sapiens
auuugaugcauguc

SEQ ID NO: 1612141 - RNA, 20 nt, Homo sapiens
auuugcaaagaaaaguuuca

SEQ ID NO: 1612142 - RNA, 22 nt, Homo sapiens
auuugcaaagaaaaguuucacc

SEQ ID NO: 1612143 - RNA, 22 nt, Homo sapiens
auuugcauauugaaaagcacag

SEQ ID NO: 1612144 - RNA, 16 nt, Homo sapiens
auuugcauuaaauuca

SEQ ID NO: 1612145 - RNA, 18 nt, Homo sapiens
auuuggagauauaccuaa

SEQ ID NO: 1612146 - RNA, 16 nt, Homo sapiens
auuuggcaaugccauc

SEQ ID NO: 1612147 - RNA, 16 nt, Homo sapiens
auuuggcuugcuguuu

SEQ ID NO: 1612148 - RNA, 20 nt, Homo sapiens
auuugggagggaaaagggaa

SEQ ID NO: 1612149 - RNA, 17 nt, Homo sapiens
auuugggcugaauguau

SEQ ID NO: 1612150 - RNA, 20 nt, Homo sapiens
auuugguaaaaaugcugcuc

SEQ ID NO: 1612151 - RNA, 17 nt, Homo sapiens
auuugguagaugacaaa

SEQ ID NO: 1612152 - RNA, 16 nt, Homo sapiens
auuuggugacugugua

SEQ ID NO: 1612153 - RNA, 17 nt, Homo sapiens
auuuggugacuguguaa

SEQ ID NO: 1612154 - RNA, 23 nt, Homo sapiens
auuuggugacuguguaacuuucu

SEQ ID NO: 1612155 - RNA, 16 nt, Homo sapiens
auuugguuagaagggu

SEQ ID NO: 1612156 - RNA, 19 nt, Homo sapiens
auuuguaaugagcaccugg

SEQ ID NO: 1612157 - RNA, 20 nt, Homo sapiens
auuugucccuaugcauauca

SEQ ID NO: 1612158 - RNA, 19 nt, Homo sapiens
auuugucugaaacauuuca

SEQ ID NO: 1612159 - RNA, 20 nt, Homo sapiens
auuugucuguaaaaaaugga

SEQ ID NO: 1612160 - RNA, 13 nt, Homo sapiens
auuugugaagcuu

SEQ ID NO: 1612161 - RNA, 23 nt, Homo sapiens
auuuguuuaaacaaucuuucaug

SEQ ID NO: 1612162 - RNA, 13 nt, Homo sapiens
auuuguuuuuacc

SEQ ID NO: 1612163 - RNA, 24 nt, Homo sapiens
auuuuaaaaacugacuuaaugcuc

SEQ ID NO: 1612164 - RNA, 15 nt, Homo sapiens
auuuuaaauacaaaa

SEQ ID NO: 1612165 - RNA, 22 nt, Homo sapiens
auuuuaacuuccuuggacucau

SEQ ID NO: 1612166 - RNA, 12 nt, Homo sapiens
auuuuaagacaa

SEQ ID NO: 1612167 - RNA, 22 nt, Homo sapiens
auuuuaaguaaaagucuaccug

SEQ ID NO: 1612168 - RNA, 16 nt, Homo sapiens
auuuuaaguaucccau

SEQ ID NO: 1612169 - RNA, 19 nt, Homo sapiens
auuuuaagucccugucacc

SEQ ID NO: 1612170 - RNA, 14 nt, Homo sapiens
auuuuaauuauaau

SEQ ID NO: 1612171 - RNA, 16 nt, Homo sapiens
auuuuacaagucaaaa

SEQ ID NO: 1612172 - RNA, 23 nt, Homo sapiens
auuuuacaauuuuuuaucaugca

SEQ ID NO: 1612173 - RNA, 18 nt, Homo sapiens
auuuuaccaaagcaucaa

SEQ ID NO: 1612174 - RNA, 16 nt, Homo sapiens
auuuuaguguguaaaa

SEQ ID NO: 1612175 - RNA, 17 nt, Homo sapiens
auuuuauaccagcuuau

SEQ ID NO: 1612176 - RNA, 22 nt, Homo sapiens
auuuuauaugcuuacugauaua

SEQ ID NO: 1612177 - RNA, 20 nt, Homo sapiens
auuuuaucuugguaguacau

SEQ ID NO: 1612178 - RNA, 15 nt, Homo sapiens
auuuuaugucuauau

SEQ ID NO: 1612179 - RNA, 17 nt, Homo sapiens
auuuuauuaggauuacc

SEQ ID NO: 1612180 - RNA, 19 nt, Homo sapiens
auuuuauucaagaaugcca

SEQ ID NO: 1612181 - RNA, 18 nt, Homo sapiens
auuuuauugaauacuguc

SEQ ID NO: 1612182 - RNA, 19 nt, Homo sapiens
auuuuauuuugacagaagc

SEQ ID NO: 1612183 - RNA, 21 nt, Homo sapiens
auuuucaauuuggagcauuaa

SEQ ID NO: 1612184 - RNA, 18 nt, Homo sapiens
auuuucaugugguacuac

SEQ ID NO: 1612185 - RNA, 20 nt, Homo sapiens
auuuucauuguaauguucau

SEQ ID NO: 1612186 - RNA, 19 nt, Homo sapiens
auuuucccuacuugcagcg

SEQ ID NO: 1612187 - RNA, 19 nt, Homo sapiens
auuuucucuggcagcauaa

SEQ ID NO: 1612188 - RNA, 19 nt, Homo sapiens
auuuucugugguuugggcu

SEQ ID NO: 1612189 - RNA, 21 nt, Homo sapiens
auuuucuuacacugugucauu

SEQ ID NO: 1612190 - RNA, 15 nt, Homo sapiens
auuuucuugauguca

SEQ ID NO: 1612191 - RNA, 16 nt, Homo sapiens
auuuugaaaaaugaga

SEQ ID NO: 1612192 - RNA, 21 nt, Homo sapiens
auuuugaaauauaguaaacac

SEQ ID NO: 1612193 - RNA, 14 nt, Homo sapiens
auuuugagcauuag

SEQ ID NO: 1612194 - RNA, 23 nt, Homo sapiens
auuuugaguaaauauuuguuacu

SEQ ID NO: 1612195 - RNA, 13 nt, Homo sapiens
auuuugauggugu

SEQ ID NO: 1612196 - RNA, 20 nt, Homo sapiens
auuuugcaaacacugugauu

SEQ ID NO: 1612197 - RNA, 16 nt, Homo sapiens
auuuugcaaagauuua

SEQ ID NO: 1612198 - RNA, 12 nt, Homo sapiens
auuuugcacuga

SEQ ID NO: 1612199 - RNA, 16 nt, Homo sapiens
auuuugccauuuagcg

SEQ ID NO: 1612200 - RNA, 15 nt, Homo sapiens
auuuuggaaacucaa

SEQ ID NO: 1612201 - RNA, 18 nt, Homo sapiens
auuuugggacuucuaccc

SEQ ID NO: 1612202 - RNA, 20 nt, Homo sapiens
auuuugggacuucuacccag

SEQ ID NO: 1612203 - RNA, 15 nt, Homo sapiens
auuuugguacuguga

SEQ ID NO: 1612204 - RNA, 17 nt, Homo sapiens
auuuugguuuguguauc

SEQ ID NO: 1612205 - RNA, 19 nt, Homo sapiens
auuuuguaaaauauuaugu

SEQ ID NO: 1612206 - RNA, 18 nt, Homo sapiens
auuuuguaaauaugcaaa

SEQ ID NO: 1612207 - RNA, 18 nt, Homo sapiens
auuuuguaccaaguaaau

SEQ ID NO: 1612208 - RNA, 21 nt, Homo sapiens
auuuuguugccuucaucuuca

SEQ ID NO: 1612209 - RNA, 16 nt, Homo sapiens
auuuuuaaccaacaga

SEQ ID NO: 1612210 - RNA, 21 nt, Homo sapiens
auuuuuaagcuaugaaaaaua

SEQ ID NO: 1612211 - RNA, 13 nt, Homo sapiens
auuuuuacuauca

SEQ ID NO: 1612212 - RNA, 14 nt, Homo sapiens
auuuuucaagagau

SEQ ID NO: 1612213 - RNA, 17 nt, Homo sapiens
auuuuucaugcuaucaa

SEQ ID NO: 1612214 - RNA, 14 nt, Homo sapiens
auuuuucuguuacc

SEQ ID NO: 1612215 - RNA, 14 nt, Homo sapiens
auuuuugugcacau

SEQ ID NO: 1612216 - RNA, 17 nt, Homo sapiens
auuuuuguuagcaaaga

SEQ ID NO: 1612217 - RNA, 23 nt, Homo sapiens
auuuuuuaaaacaagccaagaaa

SEQ ID NO: 1612218 - RNA, 16 nt, Homo sapiens
auuuuuuaaacuguag

SEQ ID NO: 1612219 - RNA, 15 nt, Homo sapiens
auuuuuuaacuuucu

SEQ ID NO: 1612220 - RNA, 11 nt, Homo sapiens
auuuuuugcca

SEQ ID NO: 1612221 - RNA, 18 nt, Homo sapiens
auuuuuugggcagcaauu

SEQ ID NO: 1612222 - RNA, 15 nt, Homo sapiens
auuuuuugguacaaa

SEQ ID NO: 1612223 - RNA, 17 nt, Homo sapiens
auuuuuuuccuaagaca

SEQ ID NO: 1612224 - RNA, 20 nt, Homo sapiens
auuuuuuucuuuacuuaucu

SEQ ID NO: 1612225 - RNA, 21 nt, Homo sapiens
auuuuuuuugcuucuggcuac

SEQ ID NO: 1612226 - RNA, 16 nt, Homo sapiens
cagaacccugccaugg

SEQ ID NO: 1612227 - RNA, 20 nt, Homo sapiens
cagaaccucuuccccagaaa

SEQ ID NO: 1612228 - RNA, 14 nt, Homo sapiens
cagaaccuuuguca

SEQ ID NO: 1612229 - RNA, 22 nt, Homo sapiens
uucuucucagaaaagaggccag

SEQ ID NO: 1612230 - RNA, 22 nt, Homo sapiens
uucuucuuuaaucacuuaacau

SEQ ID NO: 1612231 - RNA, 19 nt, Homo sapiens
uucuugaaauuuuaaccua

SEQ ID NO: 1612232 - RNA, 20 nt, Homo sapiens
uucuugaagaauaaauucua

SEQ ID NO: 1612233 - RNA, 14 nt, Homo sapiens
uucuugaagacauc

SEQ ID NO: 1612234 - RNA, 14 nt, Homo sapiens
uucuugcaugguuu

SEQ ID NO: 1612235 - RNA, 18 nt, Homo sapiens
uucuugcuuucucucuca

SEQ ID NO: 1612236 - RNA, 15 nt, Homo sapiens
uucuuuaaaggcauc

SEQ ID NO: 1612237 - RNA, 14 nt, Homo sapiens
uucuuuauggaaau

SEQ ID NO: 1612238 - RNA, 16 nt, Homo sapiens
uucuuucaaccuauac

SEQ ID NO: 1612239 - RNA, 15 nt, Homo sapiens
uucuuucaacuugca

SEQ ID NO: 1612240 - RNA, 14 nt, Homo sapiens
uucuuucauucuaa

SEQ ID NO: 1612241 - RNA, 14 nt, Homo sapiens
uucuuucuguugaa

SEQ ID NO: 1612242 - RNA, 16 nt, Homo sapiens
uucuuugaccagcaca

SEQ ID NO: 1612243 - RNA, 16 nt, Homo sapiens
uucuuugauucuccuu

SEQ ID NO: 1612244 - RNA, 16 nt, Homo sapiens
uucuuugcugcaguca

SEQ ID NO: 1612245 - RNA, 18 nt, Homo sapiens
uugaaaaacaacugcaua

SEQ ID NO: 1612246 - RNA, 14 nt, Homo sapiens
uugaaaaaggugau

SEQ ID NO: 1612247 - RNA, 20 nt, Homo sapiens
uugaaaagagguggauucau

SEQ ID NO: 1612248 - RNA, 13 nt, Homo sapiens
uugaaaaugggcu

SEQ ID NO: 1612249 - RNA, 20 nt, Homo sapiens
uugaaacagauucaggccag

SEQ ID NO: 1612250 - RNA, 17 nt, Homo sapiens
uugaaacuaucucaugc

SEQ ID NO: 1612251 - RNA, 16 nt, Homo sapiens
uugaaacugcauuugu

SEQ ID NO: 1612252 - RNA, 21 nt, Homo sapiens
uugaaauaaaugacaauguaa

SEQ ID NO: 1612253 - RNA, 16 nt, Homo sapiens
uugaaauaagaauuca

SEQ ID NO: 1612254 - RNA, 20 nt, Homo sapiens
uugaaauauaguaaacacuu

SEQ ID NO: 1612255 - RNA, 14 nt, Homo sapiens
uugaaauaucaugu

SEQ ID NO: 1612256 - RNA, 14 nt, Homo sapiens
uugaaauccaggaa

SEQ ID NO: 1612257 - RNA, 16 nt, Homo sapiens
uugaaaugaaagggaa

SEQ ID NO: 1612258 - RNA, 15 nt, Homo sapiens
uugaaaugcuguuag

SEQ ID NO: 1612259 - RNA, 12 nt, Homo sapiens
uugaaauggaaa

SEQ ID NO: 1612260 - RNA, 13 nt, Homo sapiens
uugaaauguaauu

SEQ ID NO: 1612261 - RNA, 15 nt, Homo sapiens
uugaacuggaagaaa

SEQ ID NO: 1612262 - RNA, 13 nt, Homo sapiens
uugaagccaaaga

SEQ ID NO: 1612263 - RNA, 16 nt, Homo sapiens
uugaaggaucaucuga

SEQ ID NO: 1612264 - RNA, 13 nt, Homo sapiens
uugaagggcuuua

SEQ ID NO: 1612265 - RNA, 22 nt, Homo sapiens
uugaaggguguugcacccuuuu

SEQ ID NO: 1612266 - RNA, 15 nt, Homo sapiens
uugaauaaagagaug

SEQ ID NO: 1612267 - RNA, 17 nt, Homo sapiens
uugaaucugggacugug

SEQ ID NO: 1612268 - RNA, 20 nt, Homo sapiens
uugaaugaugugauacaaau

SEQ ID NO: 1612269 - RNA, 12 nt, Homo sapiens
uugaaugcuuaa

SEQ ID NO: 1612270 - RNA, 18 nt, Homo sapiens
uugaaugcuuaauucaau

SEQ ID NO: 1612271 - RNA, 17 nt, Homo sapiens
uugaauguccuuuuaug

SEQ ID NO: 1612272 - RNA, 15 nt, Homo sapiens
uugaauuaccauaga

SEQ ID NO: 1612273 - RNA, 18 nt, Homo sapiens
uugaauuccgcagcagca

SEQ ID NO: 1612274 - RNA, 16 nt, Homo sapiens
uugaauucuugauaaa

SEQ ID NO: 1612275 - RNA, 18 nt, Homo sapiens
uugaauuuuuuaucugca

SEQ ID NO: 1612276 - RNA, 11 nt, Homo sapiens
uugacaaugau

SEQ ID NO: 1612277 - RNA, 19 nt, Homo sapiens
uugacaccacuuagauuua

SEQ ID NO: 1612278 - RNA, 15 nt, Homo sapiens
uugacagaagcuauu

SEQ ID NO: 1612279 - RNA, 19 nt, Homo sapiens
uugacagcugucauauaau

SEQ ID NO: 1612280 - RNA, 17 nt, Homo sapiens
uugacauaaucauucau

SEQ ID NO: 1612281 - RNA, 15 nt, Homo sapiens
uugaccucauuucaa

SEQ ID NO: 1612282 - RNA, 14 nt, Homo sapiens
uugacguuugcuca

SEQ ID NO: 1612283 - RNA, 20 nt, Homo sapiens
uugacuaaguuuuuauacca

SEQ ID NO: 1612284 - RNA, 19 nt, Homo sapiens
uugacuaauagagcuccau

SEQ ID NO: 1612285 - RNA, 12 nt, Homo sapiens
uugacucaaaaa

SEQ ID NO: 1612286 - RNA, 14 nt, Homo sapiens
uugacuccacuuuu

SEQ ID NO: 1612287 - RNA, 15 nt, Homo sapiens
uugacugucagcaag

SEQ ID NO: 1612288 - RNA, 21 nt, Homo sapiens
uugacuuacauagaugauaaa

SEQ ID NO: 1612289 - RNA, 16 nt, Homo sapiens
uugacuugaaggcagu

SEQ ID NO: 1612290 - RNA, 20 nt, Homo sapiens
uugagaaccagucuccucac

SEQ ID NO: 1612291 - RNA, 16 nt, Homo sapiens
uugagaaccuaaugca

SEQ ID NO: 1612292 - RNA, 12 nt, Homo sapiens
uugagaaugagu

SEQ ID NO: 1612293 - RNA, 15 nt, Homo sapiens
uugagcaacucccuc

SEQ ID NO: 1612294 - RNA, 14 nt, Homo sapiens
uugagcgacaucuc

SEQ ID NO: 1612295 - RNA, 17 nt, Homo sapiens
uugagcucuucuuaaag

SEQ ID NO: 1612296 - RNA, 18 nt, Homo sapiens
uugagcugcugacugcca

SEQ ID NO: 1612297 - RNA, 21 nt, Homo sapiens
uugagcuucauauaccagcaa

SEQ ID NO: 1612298 - RNA, 15 nt, Homo sapiens
uuauuacucuauaca

SEQ ID NO: 1612299 - RNA, 16 nt, Homo sapiens
uuauuauuucuaaucc

SEQ ID NO: 1612300 - RNA, 18 nt, Homo sapiens
uuauuccagagaagccag

SEQ ID NO: 1612301 - RNA, 13 nt, Homo sapiens
uuauugacuaaca

SEQ ID NO: 1612302 - RNA, 23 nt, Homo sapiens
uuauuuacagcucuguaaccucc

SEQ ID NO: 1612303 - RNA, 16 nt, Homo sapiens
uuauuuacaugugauu

SEQ ID NO: 1612304 - RNA, 18 nt, Homo sapiens
uuauuucuaacacuagcu

SEQ ID NO: 1612305 - RNA, 13 nt, Homo sapiens
uuauuucuaugaa

SEQ ID NO: 1612306 - RNA, 13 nt, Homo sapiens
uuauuucugcucu

SEQ ID NO: 1612307 - RNA, 17 nt, Homo sapiens
uuauuugcuucuucgaa

SEQ ID NO: 1612308 - RNA, 16 nt, Homo sapiens
uuauuuuacagcucau

SEQ ID NO: 1612309 - RNA, 19 nt, Homo sapiens
uuauuuugcaaaaguuccu

SEQ ID NO: 1612310 - RNA, 21 nt, Homo sapiens
uucaaaacaaaaugaaacaaa

SEQ ID NO: 1612311 - RNA, 22 nt, Homo sapiens
uucaaaauuuuguaaauaugca

SEQ ID NO: 1612312 - RNA, 18 nt, Homo sapiens
uucaaacauuauucucaa

SEQ ID NO: 1612313 - RNA, 19 nt, Homo sapiens
uucaaacauuauucucaac

SEQ ID NO: 1612314 - RNA, 12 nt, Homo sapiens
uucaaaguuuag

SEQ ID NO: 1612315 - RNA, 14 nt, Homo sapiens
uucaaauacuuuug

SEQ ID NO: 1612316 - RNA, 19 nt, Homo sapiens
uucaaauccauagauuucg

SEQ ID NO: 1612317 - RNA, 20 nt, Homo sapiens
uucaaauccuuauuguucag

SEQ ID NO: 1612318 - RNA, 23 nt, Homo sapiens
uucaaaucuacgguuaugaaggc

SEQ ID NO: 1612319 - RNA, 12 nt, Homo sapiens
uucaaauuugau

SEQ ID NO: 1612320 - RNA, 19 nt, Homo sapiens
uucaacaaagaaacaaaga

SEQ ID NO: 1612321 - RNA, 21 nt, Homo sapiens
uucaacuaauacaugguuuaa

SEQ ID NO: 1612322 - RNA, 13 nt, Homo sapiens
uucaacucugauc

SEQ ID NO: 1612323 - RNA, 22 nt, Homo sapiens
uucaacuuggugacacucuaua

SEQ ID NO: 1612324 - RNA, 14 nt, Homo sapiens
uucaagaaguauuu

SEQ ID NO: 1612325 - RNA, 15 nt, Homo sapiens
uucaagacucaaugu

SEQ ID NO: 1612326 - RNA, 12 nt, Homo sapiens
uucaagccauuc

SEQ ID NO: 1612327 - RNA, 15 nt, Homo sapiens
uucaagccuguuaua

SEQ ID NO: 1612328 - RNA, 14 nt, Homo sapiens
uucaaguaccaaaa

SEQ ID NO: 1612329 - RNA, 20 nt, Homo sapiens
uucaagugccuagacuguua

SEQ ID NO: 1612330 - RNA, 15 nt, Homo sapiens
uucaauaaaccacaa

SEQ ID NO: 1612331 - RNA, 20 nt, Homo sapiens
uucaauaaaccacaagcauc

SEQ ID NO: 1612332 - RNA, 14 nt, Homo sapiens
uucaauacaaacaa

SEQ ID NO: 1612333 - RNA, 21 nt, Homo sapiens
uucaauaguggcauaccaaau

SEQ ID NO: 1612334 - RNA, 23 nt, Homo sapiens
uucaauaguggcauaccaaaugg

SEQ ID NO: 1612335 - RNA, 23 nt, Homo sapiens
uucaauauaagaagcaaucuuug

SEQ ID NO: 1612336 - RNA, 14 nt, Homo sapiens
uucaaucuguaaac

SEQ ID NO: 1612337 - RNA, 20 nt, Homo sapiens
uucaauuauacuaaaccuca

SEQ ID NO: 1612338 - RNA, 22 nt, Homo sapiens
uucaauuauacuaaaccucaca

SEQ ID NO: 1612339 - RNA, 21 nt, Homo sapiens
uucacaaaaugcacuucuauu

SEQ ID NO: 1612340 - RNA, 12 nt, Homo sapiens
uucacacauuca

SEQ ID NO: 1612341 - RNA, 11 nt, Homo sapiens
uucacacugca

SEQ ID NO: 1612342 - RNA, 23 nt, Homo sapiens
uucacagccacaccuggacugac

SEQ ID NO: 1612343 - RNA, 16 nt, Homo sapiens
uucacaggcacuccug

SEQ ID NO: 1612344 - RNA, 19 nt, Homo sapiens
uucacaguaauaugguucc

SEQ ID NO: 1612345 - RNA, 21 nt, Homo sapiens
uucacauacaaaucauccauc

SEQ ID NO: 1612346 - RNA, 15 nt, Homo sapiens
uucacauaguuugau

SEQ ID NO: 1612347 - RNA, 17 nt, Homo sapiens
uucacauaguuugauaa

SEQ ID NO: 1612348 - RNA, 16 nt, Homo sapiens
uucacauugcacucau

SEQ ID NO: 1612349 - RNA, 13 nt, Homo sapiens
uucaccuuucuag

SEQ ID NO: 1612350 - RNA, 20 nt, Homo sapiens
uucacugccuaaaauuuuag

SEQ ID NO: 1612351 - RNA, 20 nt, Homo sapiens
uucacuggggcaugagauuu

SEQ ID NO: 1612352 - RNA, 20 nt, Homo sapiens
uucacuucuaccuacauauu

SEQ ID NO: 1612353 - RNA, 20 nt, Homo sapiens
uucagaaaagaugugcagau

SEQ ID NO: 1612354 - RNA, 12 nt, Homo sapiens
uuccucacauuu

SEQ ID NO: 1612355 - RNA, 14 nt, Homo sapiens
uuccucauguugcu

SEQ ID NO: 1612356 - RNA, 20 nt, Homo sapiens
uuccuccagagacacugagc

SEQ ID NO: 1612357 - RNA, 17 nt, Homo sapiens
uuccucccauuucccau

SEQ ID NO: 1612358 - RNA, 18 nt, Homo sapiens
uuccucccauuucccauu

SEQ ID NO: 1612359 - RNA, 16 nt, Homo sapiens
uuccucccccaguucc

SEQ ID NO: 1612360 - RNA, 21 nt, Homo sapiens
uuccucccccaguuccuccca

SEQ ID NO: 1612361 - RNA, 18 nt, Homo sapiens
uuccucccuggugugaac

SEQ ID NO: 1612362 - RNA, 21 nt, Homo sapiens
uuccuccgaggccaguaccuu

SEQ ID NO: 1612363 - RNA, 22 nt, Homo sapiens
uuccuccucuauuuaagauaua

SEQ ID NO: 1612364 - RNA, 18 nt, Homo sapiens
uuccuccuuuaccuuuca

SEQ ID NO: 1612365 - RNA, 17 nt, Homo sapiens
uuccucuagaagccaag

SEQ ID NO: 1612366 - RNA, 18 nt, Homo sapiens
uuccucucucucuuccuc

SEQ ID NO: 1612367 - RNA, 23 nt, Homo sapiens
uuccucucugaguggacuggccu

SEQ ID NO: 1612368 - RNA, 22 nt, Homo sapiens
uuccucugccacucccugcugu

SEQ ID NO: 1612369 - RNA, 19 nt, Homo sapiens
uuccugaaaauugcaauac

SEQ ID NO: 1612370 - RNA, 13 nt, Homo sapiens
uuccugacacuca

SEQ ID NO: 1612371 - RNA, 23 nt, Homo sapiens
uuccugccuuugauguggaugaa

SEQ ID NO: 1612372 - RNA, 19 nt, Homo sapiens
uuccuggaacuugcucuca

SEQ ID NO: 1612373 - RNA, 16 nt, Homo sapiens
uuccuggcagcugcug

SEQ ID NO: 1612374 - RNA, 22 nt, Homo sapiens
uuccuggccuucugaacuccau

SEQ ID NO: 1612375 - RNA, 19 nt, Homo sapiens
uuccuggggcacaaguguc

SEQ ID NO: 1612376 - RNA, 21 nt, Homo sapiens
uuccugguggauacuguagaa

SEQ ID NO: 1612377 - RNA, 15 nt, Homo sapiens
uuccuguucaguaau

SEQ ID NO: 1612378 - RNA, 14 nt, Homo sapiens
uuccuguuugucua

SEQ ID NO: 1612379 - RNA, 16 nt, Homo sapiens
uuccuuacacauuuua

SEQ ID NO: 1612380 - RNA, 13 nt, Homo sapiens
uuccuucaucucc

SEQ ID NO: 1612381 - RNA, 19 nt, Homo sapiens
uuccuuccagauccugggu

SEQ ID NO: 1612382 - RNA, 13 nt, Homo sapiens
uuccuucccacau

SEQ ID NO: 1612383 - RNA, 15 nt, Homo sapiens
uuccuucccagagau

SEQ ID NO: 1612384 - RNA, 14 nt, Homo sapiens
uuccuuccuuccuc

SEQ ID NO: 1612385 - RNA, 16 nt, Homo sapiens
uuccuuggccaugcag

SEQ ID NO: 1612386 - RNA, 13 nt, Homo sapiens
uuccuuguauucu

SEQ ID NO: 1612387 - RNA, 21 nt, Homo sapiens
uuccuuuaaaaauacauagca

SEQ ID NO: 1612388 - RNA, 22 nt, Homo sapiens
uuccuuuaaugauaacuaaaau

SEQ ID NO: 1612389 - RNA, 17 nt, Homo sapiens
uuccuuuaugugaauuu

SEQ ID NO: 1612390 - RNA, 23 nt, Homo sapiens
uuccuuuuauuuuuauaggaaua

SEQ ID NO: 1612391 - RNA, 20 nt, Homo sapiens
uuccuuuucccugcuuccag

SEQ ID NO: 1612392 - RNA, 15 nt, Homo sapiens
uuccuuuuuucccau

SEQ ID NO: 1612393 - RNA, 19 nt, Homo sapiens
uucgagaccagccugacca

SEQ ID NO: 1612394 - RNA, 13 nt, Homo sapiens
uucgagggguccu

SEQ ID NO: 1612395 - RNA, 11 nt, Homo sapiens
uucgcuugcuu

SEQ ID NO: 1612396 - RNA, 14 nt, Homo sapiens
uucgguuccagaca

SEQ ID NO: 1612397 - RNA, 20 nt, Homo sapiens
uucgucuaaugggggcaguc

SEQ ID NO: 1612398 - RNA, 19 nt, Homo sapiens
uucuaaaaauaaaaguauu

SEQ ID NO: 1612399 - RNA, 15 nt, Homo sapiens
uucuaaaccaaaaau

SEQ ID NO: 1612400 - RNA, 18 nt, Homo sapiens
uucuaaaguuuugcaaca

SEQ ID NO: 1612401 - RNA, 20 nt, Homo sapiens
uucuaaguuauuuuguacau

SEQ ID NO: 1612402 - RNA, 18 nt, Homo sapiens
uucuacagcuaggacuua

SEQ ID NO: 1612403 - RNA, 11 nt, Homo sapiens
uucuacccuga

SEQ ID NO: 1612404 - RNA, 20 nt, Homo sapiens
uucuaccucuuggcugccuu

SEQ ID NO: 1612405 - RNA, 16 nt, Homo sapiens
uucuacuaugaucaga

SEQ ID NO: 1612406 - RNA, 23 nt, Homo sapiens
uucuacuggaaaaaaauacaaaa

SEQ ID NO: 1612407 - RNA, 14 nt, Homo sapiens
uucuacuuguaaaa

SEQ ID NO: 1612408 - RNA, 18 nt, Homo sapiens
uucuacuuuuaacuaaua

SEQ ID NO: 1612409 - RNA, 15 nt, Homo sapiens
uucuagaacaccugc

SEQ ID NO: 1612410 - RNA, 18 nt, Homo sapiens
uucuagaacaccugccuu

SEQ ID NO: 1612411 - RNA, 12 nt, Homo sapiens
uucuagccuuuu

SEQ ID NO: 1612412 - RNA, 14 nt, Homo sapiens
uucuaggauagcua

SEQ ID NO: 1612413 - RNA, 14 nt, Homo sapiens
uucuagucacuucc

SEQ ID NO: 1612414 - RNA, 15 nt, Homo sapiens
uucuaguucugccag

SEQ ID NO: 1612415 - RNA, 15 nt, Homo sapiens
uucuaugcauuaaga

SEQ ID NO: 1612416 - RNA, 16 nt, Homo sapiens
uucuaugugucaucaa

SEQ ID NO: 1612417 - RNA, 12 nt, Homo sapiens
uucuauuuuccc

SEQ ID NO: 1612418 - RNA, 16 nt, Homo sapiens
uucucaaagucucaua

SEQ ID NO: 1612419 - RNA, 15 nt, Homo sapiens
uucucaccagcugca

SEQ ID NO: 1612420 - RNA, 15 nt, Homo sapiens
uuaguuauauucacu

SEQ ID NO: 1612421 - RNA, 13 nt, Homo sapiens
uuaguugagauuu

SEQ ID NO: 1612422 - RNA, 15 nt, Homo sapiens
uuaguugagauuuca

SEQ ID NO: 1612423 - RNA, 22 nt, Homo sapiens
uuauaaaaauauaaauuguaca

SEQ ID NO: 1612424 - RNA, 15 nt, Homo sapiens
uuauaaauagcauuu

SEQ ID NO: 1612425 - RNA, 20 nt, Homo sapiens
uuauaagaaagaucaaagac

SEQ ID NO: 1612426 - RNA, 20 nt, Homo sapiens
uuauaauuuuacucacucac

SEQ ID NO: 1612427 - RNA, 13 nt, Homo sapiens
uuauacagugaua

SEQ ID NO: 1612428 - RNA, 15 nt, Homo sapiens
uuauacagugauaaa

SEQ ID NO: 1612429 - RNA, 23 nt, Homo sapiens
uuauacauguaacagaguagcag

SEQ ID NO: 1612430 - RNA, 19 nt, Homo sapiens
uuauacuaaauaugugacu

SEQ ID NO: 1612431 - RNA, 14 nt, Homo sapiens
uuauacuguacaau

SEQ ID NO: 1612432 - RNA, 23 nt, Homo sapiens
uuauaggaaaaaaacugggauaa

SEQ ID NO: 1612433 - RNA, 23 nt, Homo sapiens
uuauaggaaaaguuauugugaua

SEQ ID NO: 1612434 - RNA, 17 nt, Homo sapiens
uuauaggggauacuuga

SEQ ID NO: 1612435 - RNA, 23 nt, Homo sapiens
uuauagugaaacauguacuuuga

SEQ ID NO: 1612436 - RNA, 15 nt, Homo sapiens
uuauaguuacugugu

SEQ ID NO: 1612437 - RNA, 22 nt, Homo sapiens
uuauauaauaaaguauuccacc

SEQ ID NO: 1612438 - RNA, 12 nt, Homo sapiens
uuauauaauuca

SEQ ID NO: 1612439 - RNA, 17 nt, Homo sapiens
uuauauaauuguugaac

SEQ ID NO: 1612440 - RNA, 13 nt, Homo sapiens
uuauaucugugaa

SEQ ID NO: 1612441 - RNA, 19 nt, Homo sapiens
uuauauguagccuuuacug

SEQ ID NO: 1612442 - RNA, 13 nt, Homo sapiens
uuauauucaucca

SEQ ID NO: 1612443 - RNA, 14 nt, Homo sapiens
uuauauucuaauag

SEQ ID NO: 1612444 - RNA, 22 nt, Homo sapiens
uuauauuuccuuuaugugaauu

SEQ ID NO: 1612445 - RNA, 22 nt, Homo sapiens
uuaucaccgugggcucccugac

SEQ ID NO: 1612446 - RNA, 20 nt, Homo sapiens
uuaucaccucugauggcuga

SEQ ID NO: 1612447 - RNA, 14 nt, Homo sapiens
uuaucagccugugc

SEQ ID NO: 1612448 - RNA, 16 nt, Homo sapiens
uuaucaugcauguccu

SEQ ID NO: 1612449 - RNA, 17 nt, Homo sapiens
uuauccaaaaugcuugg

SEQ ID NO: 1612450 - RNA, 17 nt, Homo sapiens
uuauccccguuucuugc

SEQ ID NO: 1612451 - RNA, 18 nt, Homo sapiens
uuauccccucagaacacg

SEQ ID NO: 1612452 - RNA, 13 nt, Homo sapiens
uuaucccucucuu

SEQ ID NO: 1612453 - RNA, 17 nt, Homo sapiens
uuauccuguauucuugu

SEQ ID NO: 1612454 - RNA, 17 nt, Homo sapiens
uuaucguuaagcacaag

SEQ ID NO: 1612455 - RNA, 21 nt, Homo sapiens
uuaucuauagcuaaguacaca

SEQ ID NO: 1612456 - RNA, 21 nt, Homo sapiens
uuaucuauuccugaaauuucu

SEQ ID NO: 1612457 - RNA, 13 nt, Homo sapiens
uuaucugauacuu

SEQ ID NO: 1612458 - RNA, 21 nt, Homo sapiens
uuaucuguaauuguaauucca

SEQ ID NO: 1612459 - RNA, 17 nt, Homo sapiens
uuaucugucucuucuac

SEQ ID NO: 1612460 - RNA, 17 nt, Homo sapiens
uuaucuguuuccugaca

SEQ ID NO: 1612461 - RNA, 13 nt, Homo sapiens
uuaucuuaugcca

SEQ ID NO: 1612462 - RNA, 16 nt, Homo sapiens
uuaugaaaaguacuaa

SEQ ID NO: 1612463 - RNA, 13 nt, Homo sapiens
uuaugaacuacag

SEQ ID NO: 1612464 - RNA, 11 nt, Homo sapiens
uuaugagauuu

SEQ ID NO: 1612465 - RNA, 16 nt, Homo sapiens
uuaugauauauuucag

SEQ ID NO: 1612466 - RNA, 22 nt, Homo sapiens
uuaugauuacuaucauggcaua

SEQ ID NO: 1612467 - RNA, 23 nt, Homo sapiens
uuaugccaccugaauaaagaaug

SEQ ID NO: 1612468 - RNA, 16 nt, Homo sapiens
uuaugcuccugcugau

SEQ ID NO: 1612469 - RNA, 18 nt, Homo sapiens
uuauguaccuccaugagc

SEQ ID NO: 1612470 - RNA, 19 nt, Homo sapiens
uuaugucucuucugagcua

SEQ ID NO: 1612471 - RNA, 19 nt, Homo sapiens
uuaugucucuugagcauca

SEQ ID NO: 1612472 - RNA, 17 nt, Homo sapiens
uuaugugacuugcaaua

SEQ ID NO: 1612473 - RNA, 14 nt, Homo sapiens
uuaugugugccuuu

SEQ ID NO: 1612474 - RNA, 21 nt, Homo sapiens
uuauguugaauccacccaaau

SEQ ID NO: 1612475 - RNA, 21 nt, Homo sapiens
uuauuaaaguacaaccauaga

SEQ ID NO: 1612476 - RNA, 13 nt, Homo sapiens
uuauuaacuaaga

SEQ ID NO: 1612477 - RNA, 11 nt, Homo sapiens
uuauuacauaa

SEQ ID NO: 1612478 - RNA, 14 nt, Homo sapiens
uuauuacauguaau

SEQ ID NO: 1612479 - RNA, 19 nt, Homo sapiens
uuauuacauguaauuugau

SEQ ID NO: 1612480 - RNA, 21 nt, Homo sapiens
uuaacuuuucuaacagaaagc

SEQ ID NO: 1612481 - RNA, 18 nt, Homo sapiens
uuaagaaauuuugccuuu

SEQ ID NO: 1612482 - RNA, 21 nt, Homo sapiens
uuaagaacaucaaaacuaacc

SEQ ID NO: 1612483 - RNA, 17 nt, Homo sapiens
uuaagacagagucucac

SEQ ID NO: 1612484 - RNA, 13 nt, Homo sapiens
uuaagauucuuga

SEQ ID NO: 1612485 - RNA, 23 nt, Homo sapiens
uuaaggauaaaucauaaagucag

SEQ ID NO: 1612486 - RNA, 23 nt, Homo sapiens
uuaaggaugacagagaugugcau

SEQ ID NO: 1612487 - RNA, 15 nt, Homo sapiens
uuaagucccauucag

SEQ ID NO: 1612488 - RNA, 16 nt, Homo sapiens
uuaagugcaauuaaca

SEQ ID NO: 1612489 - RNA, 22 nt, Homo sapiens
uuaaguuuguaagacagugccc

SEQ ID NO: 1612490 - RNA, 23 nt, Homo sapiens
uuaauaaaaaggaauacauugca

SEQ ID NO: 1612491 - RNA, 22 nt, Homo sapiens
uuaauaaaccauuuuuacuugg

SEQ ID NO: 1612492 - RNA, 15 nt, Homo sapiens
uuaauaaaguaguua

SEQ ID NO: 1612493 - RNA, 13 nt, Homo sapiens
uuaauaauuugcu

SEQ ID NO: 1612494 - RNA, 13 nt, Homo sapiens
uuaauaccaaagu

SEQ ID NO: 1612495 - RNA, 12 nt, Homo sapiens
uuaauacuguau

SEQ ID NO: 1612496 - RNA, 18 nt, Homo sapiens
uuaauagggaauauaucu

SEQ ID NO: 1612497 - RNA, 16 nt, Homo sapiens
uuaauaguguuuacau

SEQ ID NO: 1612498 - RNA, 14 nt, Homo sapiens
uuaauauaaaccca

SEQ ID NO: 1612499 - RNA, 13 nt, Homo sapiens
uuaauaugcugca

SEQ ID NO: 1612500 - RNA, 16 nt, Homo sapiens
uuaauauugugcaaac

SEQ ID NO: 1612501 - RNA, 20 nt, Homo sapiens
uuaauauuuuuccacuuaaa

SEQ ID NO: 1612502 - RNA, 17 nt, Homo sapiens
uuaauccaauauuuugc

SEQ ID NO: 1612503 - RNA, 22 nt, Homo sapiens
uuaaucuggacacacuguuaca

SEQ ID NO: 1612504 - RNA, 15 nt, Homo sapiens
uuaaucuuccauucc

SEQ ID NO: 1612505 - RNA, 11 nt, Homo sapiens
uuaauguaaua

SEQ ID NO: 1612506 - RNA, 18 nt, Homo sapiens
uuaauguaauaaagugaa

SEQ ID NO: 1612507 - RNA, 18 nt, Homo sapiens
uuaaugugacaguguuca

SEQ ID NO: 1612508 - RNA, 11 nt, Homo sapiens
uuaaugugcuc

SEQ ID NO: 1612509 - RNA, 17 nt, Homo sapiens
uuaauguggacuggaac

SEQ ID NO: 1612510 - RNA, 18 nt, Homo sapiens
uuaauguuaacaagacaa

SEQ ID NO: 1612511 - RNA, 13 nt, Homo sapiens
uuaauuauugcuu

SEQ ID NO: 1612512 - RNA, 22 nt, Homo sapiens
uuaauucaccccacacuagaaa

SEQ ID NO: 1612513 - RNA, 13 nt, Homo sapiens
uuaauugugcaaa

SEQ ID NO: 1612514 - RNA, 15 nt, Homo sapiens
uuaauuuugauucag

SEQ ID NO: 1612515 - RNA, 19 nt, Homo sapiens
uuaauuuuuauacugacaa

SEQ ID NO: 1612516 - RNA, 19 nt, Homo sapiens
uuaauuuuugauacuaagc

SEQ ID NO: 1612517 - RNA, 18 nt, Homo sapiens
uuaauuuuuuacuuucag

SEQ ID NO: 1612518 - RNA, 17 nt, Homo sapiens
uuaauuuuuugguacaa

SEQ ID NO: 1612519 - RNA, 14 nt, Homo sapiens
uuacaauaagcuaa

SEQ ID NO: 1612520 - RNA, 22 nt, Homo sapiens
uuacaaugaucaccgacugaaa

SEQ ID NO: 1612521 - RNA, 14 nt, Homo sapiens
uuacacaaagggaa

SEQ ID NO: 1612522 - RNA, 13 nt, Homo sapiens
uuacacagugaga

SEQ ID NO: 1612523 - RNA, 13 nt, Homo sapiens
uuacacucuugau

SEQ ID NO: 1612524 - RNA, 21 nt, Homo sapiens
uuacacuugggauugucuuac

SEQ ID NO: 1612525 - RNA, 13 nt, Homo sapiens
uuacagaaaucaa

SEQ ID NO: 1612526 - RNA, 16 nt, Homo sapiens
uuacagacugaaaggu

SEQ ID NO: 1612527 - RNA, 14 nt, Homo sapiens
uuacagagacagaa

SEQ ID NO: 1612528 - RNA, 20 nt, Homo sapiens
uuacagagagcuugcuguga

SEQ ID NO: 1612529 - RNA, 15 nt, Homo sapiens
uuacagcacuacucu

SEQ ID NO: 1612530 - RNA, 17 nt, Homo sapiens
uuacagcuccuuugaaa

SEQ ID NO: 1612531 - RNA, 21 nt, Homo sapiens
uuacagcuccuuugaaaacuc

SEQ ID NO: 1612532 - RNA, 17 nt, Homo sapiens
uuacagggugacucaca

SEQ ID NO: 1612533 - RNA, 22 nt, Homo sapiens
uuacaggugugagccaccgugc

SEQ ID NO: 1612534 - RNA, 11 nt, Homo sapiens
uuacaguucug

SEQ ID NO: 1612535 - RNA, 14 nt, Homo sapiens
uuacauaaguuccu

SEQ ID NO: 1612536 - RNA, 14 nt, Homo sapiens
uuacauacuuuauc

SEQ ID NO: 1612537 - RNA, 21 nt, Homo sapiens
uguuccacauucucucucuuu

SEQ ID NO: 1612538 - RNA, 18 nt, Homo sapiens
uguucccauuuuugcuua

SEQ ID NO: 1612539 - RNA, 16 nt, Homo sapiens
uguucccccugugcag

SEQ ID NO: 1612540 - RNA, 14 nt, Homo sapiens
uguucccugacucc

SEQ ID NO: 1612541 - RNA, 19 nt, Homo sapiens
uguuccucuuggugucaua

SEQ ID NO: 1612542 - RNA, 14 nt, Homo sapiens
uguucguucugaua

SEQ ID NO: 1612543 - RNA, 22 nt, Homo sapiens
uguucuaagucuuuccauugga

SEQ ID NO: 1612544 - RNA, 18 nt, Homo sapiens
uguucuagaaacauguaa

SEQ ID NO: 1612545 - RNA, 22 nt, Homo sapiens
uguucuaguaacaauacaugag

SEQ ID NO: 1612546 - RNA, 15 nt, Homo sapiens
uguucucaacauacu

SEQ ID NO: 1612547 - RNA, 18 nt, Homo sapiens
uguucucagaaucccuua

SEQ ID NO: 1612548 - RNA, 21 nt, Homo sapiens
uguucucuaggccuucaggac

SEQ ID NO: 1612549 - RNA, 19 nt, Homo sapiens
uguucugccuggagacaag

SEQ ID NO: 1612550 - RNA, 23 nt, Homo sapiens
uguucugggaaaauccacuauga

SEQ ID NO: 1612551 - RNA, 19 nt, Homo sapiens
uguucuguuugcuguggaa

SEQ ID NO: 1612552 - RNA, 15 nt, Homo sapiens
uguugaagcacuguu

SEQ ID NO: 1612553 - RNA, 14 nt, Homo sapiens
uguugaaguuuaca

SEQ ID NO: 1612554 - RNA, 19 nt, Homo sapiens
uguugaaucacaguaucag

SEQ ID NO: 1612555 - RNA, 14 nt, Homo sapiens
uguugcagguucau

SEQ ID NO: 1612556 - RNA, 23 nt, Homo sapiens
uguugccuaccuagcugcaucua

SEQ ID NO: 1612557 - RNA, 15 nt, Homo sapiens
uguugccuugcauuu

SEQ ID NO: 1612558 - RNA, 23 nt, Homo sapiens
uguugcugcaucuccccucagau

SEQ ID NO: 1612559 - RNA, 13 nt, Homo sapiens
uguuggcaauuau

SEQ ID NO: 1612560 - RNA, 16 nt, Homo sapiens
uguuggcauagcucug

SEQ ID NO: 1612561 - RNA, 20 nt, Homo sapiens
uguugguauuauauaauuca

SEQ ID NO: 1612562 - RNA, 22 nt, Homo sapiens
uguuggucaggcuggucucaaa

SEQ ID NO: 1612563 - RNA, 18 nt, Homo sapiens
uguugucuauuugucucu

SEQ ID NO: 1612564 - RNA, 18 nt, Homo sapiens
uguuguuugguucaggga

SEQ ID NO: 1612565 - RNA, 12 nt, Homo sapiens
uguuuacaugag

SEQ ID NO: 1612566 - RNA, 13 nt, Homo sapiens
uguuuaccaugaa

SEQ ID NO: 1612567 - RNA, 13 nt, Homo sapiens
uguuuaccuggug

SEQ ID NO: 1612568 - RNA, 22 nt, Homo sapiens
uguuuauaaauagcauuuggaa

SEQ ID NO: 1612569 - RNA, 16 nt, Homo sapiens
uguuuaucgaaguaua

SEQ ID NO: 1612570 - RNA, 16 nt, Homo sapiens
uguuuauuuuuguaca

SEQ ID NO: 1612571 - RNA, 23 nt, Homo sapiens
uguuucaaacaagaaacauuuca

SEQ ID NO: 1612572 - RNA, 20 nt, Homo sapiens
uguuucaauugcaucuccca

SEQ ID NO: 1612573 - RNA, 13 nt, Homo sapiens
uguuucuacacau

SEQ ID NO: 1612574 - RNA, 22 nt, Homo sapiens
uguuucuggaauugauauugaa

SEQ ID NO: 1612575 - RNA, 19 nt, Homo sapiens
uguuucuucaaugguucuc

SEQ ID NO: 1612576 - RNA, 18 nt, Homo sapiens
uguuugauacacauuuga

SEQ ID NO: 1612577 - RNA, 9 nt, Homo sapiens
uguuugaug

SEQ ID NO: 1612578 - RNA, 12 nt, Homo sapiens
uguuugcacuua

SEQ ID NO: 1612579 - RNA, 19 nt, Homo sapiens
uguuugcacuuggcaaaaa

SEQ ID NO: 1612580 - RNA, 12 nt, Homo sapiens
uguuugcaucug

SEQ ID NO: 1612581 - RNA, 15 nt, Homo sapiens
uguuugcgcuugacc

SEQ ID NO: 1612582 - RNA, 20 nt, Homo sapiens
uguuugguguuugucugugu

SEQ ID NO: 1612583 - RNA, 20 nt, Homo sapiens
uguuuuacccuauacaucca

SEQ ID NO: 1612584 - RNA, 23 nt, Homo sapiens
uguuuuacucagaggagcugcaa

SEQ ID NO: 1612585 - RNA, 14 nt, Homo sapiens
uguuuuaguucuug

SEQ ID NO: 1612586 - RNA, 16 nt, Homo sapiens
uguuuucucuaagaua

SEQ ID NO: 1612587 - RNA, 20 nt, Homo sapiens
uguuuucucuggaguauucu

SEQ ID NO: 1612588 - RNA, 20 nt, Homo sapiens
uguuuugccauguuggccag

SEQ ID NO: 1612589 - RNA, 15 nt, Homo sapiens
uguuuuggcuuuaug

SEQ ID NO: 1612590 - RNA, 13 nt, Homo sapiens
uguuuuucuucag

SEQ ID NO: 1612591 - RNA, 21 nt, Homo sapiens
uguccuggggaauacuggcca

SEQ ID NO: 1612592 - RNA, 17 nt, Homo sapiens
uguccuucccuguucuc

SEQ ID NO: 1612593 - RNA, 19 nt, Homo sapiens
ugucgcaugagaacauuaa

SEQ ID NO: 1612594 - RNA, 15 nt, Homo sapiens
ugucgggacaugguu

SEQ ID NO: 1612595 - RNA, 18 nt, Homo sapiens
ugucguauaggcauguaa

SEQ ID NO: 1612596 - RNA, 18 nt, Homo sapiens
ugucguuuucacauauga

SEQ ID NO: 1612597 - RNA, 18 nt, Homo sapiens
ugucuagagaacacugug

SEQ ID NO: 1612598 - RNA, 23 nt, Homo sapiens
ugucuauuauuuagaaaugaaca

SEQ ID NO: 1612599 - RNA, 15 nt, Homo sapiens
ugucucaacuacuca

SEQ ID NO: 1612600 - RNA, 12 nt, Homo sapiens
ugucucauuaua

SEQ ID NO: 1612601 - RNA, 21 nt, Homo sapiens
ugucuccacccguguccagca

SEQ ID NO: 1612602 - RNA, 19 nt, Homo sapiens
ugucuccuggacucagggu

SEQ ID NO: 1612603 - RNA, 15 nt, Homo sapiens
ugucucucaugacca

SEQ ID NO: 1612604 - RNA, 23 nt, Homo sapiens
ugucucucuaguugaacccuggg

SEQ ID NO: 1612605 - RNA, 20 nt, Homo sapiens
ugucucugggccacuuggag

SEQ ID NO: 1612606 - RNA, 16 nt, Homo sapiens
ugucucuucugagcua

SEQ ID NO: 1612607 - RNA, 21 nt, Homo sapiens
ugucugaguaagcccucagga

SEQ ID NO: 1612608 - RNA, 20 nt, Homo sapiens
ugucugcaccuuagaaaaaa

SEQ ID NO: 1612609 - RNA, 15 nt, Homo sapiens
ugucuggccaggccu

SEQ ID NO: 1612610 - RNA, 16 nt, Homo sapiens
ugucuggcguucucaa

SEQ ID NO: 1612611 - RNA, 15 nt, Homo sapiens
ugucugucaccagcu

SEQ ID NO: 1612612 - RNA, 21 nt, Homo sapiens
ugucugucuacauuucugcag

SEQ ID NO: 1612613 - RNA, 22 nt, Homo sapiens
ugucugugcaugucccccagga

SEQ ID NO: 1612614 - RNA, 17 nt, Homo sapiens
ugucuuaaccucaggga

SEQ ID NO: 1612615 - RNA, 23 nt, Homo sapiens
ugucuugaguagacuuggaccca

SEQ ID NO: 1612616 - RNA, 16 nt, Homo sapiens
ugucuuggucacugcu

SEQ ID NO: 1612617 - RNA, 20 nt, Homo sapiens
ugucuuggucacugcugaga

SEQ ID NO: 1612618 - RNA, 18 nt, Homo sapiens
ugucuuuguucugugauu

SEQ ID NO: 1612619 - RNA, 16 nt, Homo sapiens
ugugaaagaguugaag

SEQ ID NO: 1612620 - RNA, 16 nt, Homo sapiens
ugugaaauaucaucac

SEQ ID NO: 1612621 - RNA, 20 nt, Homo sapiens
ugugaaauucacaguaauau

SEQ ID NO: 1612622 - RNA, 22 nt, Homo sapiens
ugugaagccuuuaucuauggga

SEQ ID NO: 1612623 - RNA, 23 nt, Homo sapiens
ugugaagccuuuaucuaugggag

SEQ ID NO: 1612624 - RNA, 20 nt, Homo sapiens
ugugaaggcaggggaaugua

SEQ ID NO: 1612625 - RNA, 18 nt, Homo sapiens
ugugaaguuuaauugacu

SEQ ID NO: 1612626 - RNA, 18 nt, Homo sapiens
ugugaauagaacucugaa

SEQ ID NO: 1612627 - RNA, 13 nt, Homo sapiens
ugugaauauuccu

SEQ ID NO: 1612628 - RNA, 16 nt, Homo sapiens
ugugaauuauugacac

SEQ ID NO: 1612629 - RNA, 21 nt, Homo sapiens
ugugaccaaugucuugaugca

SEQ ID NO: 1612630 - RNA, 18 nt, Homo sapiens
ugugaccugucagaauaa

SEQ ID NO: 1612631 - RNA, 12 nt, Homo sapiens
ugugacuacuga

SEQ ID NO: 1612632 - RNA, 17 nt, Homo sapiens
ugugacugccaggauaa

SEQ ID NO: 1612633 - RNA, 15 nt, Homo sapiens
ugugacuucacugua

SEQ ID NO: 1612634 - RNA, 15 nt, Homo sapiens
ugugagcauggggcc

SEQ ID NO: 1612635 - RNA, 19 nt, Homo sapiens
ugugaggcggcccugacca

SEQ ID NO: 1612636 - RNA, 23 nt, Homo sapiens
ugugagggugacguuagcauuac

SEQ ID NO: 1612637 - RNA, 17 nt, Homo sapiens
ugugagguauacauauu

SEQ ID NO: 1612638 - RNA, 21 nt, Homo sapiens
ugugagugagggagacaggaa

SEQ ID NO: 1612639 - RNA, 18 nt, Homo sapiens
ugugaugaacgugccuga

SEQ ID NO: 1612640 - RNA, 15 nt, Homo sapiens
ugugauuagaucaca

SEQ ID NO: 1612641 - RNA, 22 nt, Homo sapiens
ugugauuuuucugcacuaauau

SEQ ID NO: 1612642 - RNA, 11 nt, Homo sapiens
ugcaccaaaga

SEQ ID NO: 1612643 - RNA, 13 nt, Homo sapiens
ugcaccaaagaca

SEQ ID NO: 1612644 - RNA, 18 nt, Homo sapiens
ugcaccaauuaucaucuu

SEQ ID NO: 1612645 - RNA, 14 nt, Homo sapiens
ugcaccacugcacu

SEQ ID NO: 1612646 - RNA, 14 nt, Homo sapiens
ugcaccauggagac

SEQ ID NO: 1612647 - RNA, 16 nt, Homo sapiens
ugcaccccugagccag

SEQ ID NO: 1612648 - RNA, 12 nt, Homo sapiens
ugcaccuaccuu

SEQ ID NO: 1612649 - RNA, 15 nt, Homo sapiens
ugcaccugugcauuu

SEQ ID NO: 1612650 - RNA, 16 nt, Homo sapiens
ugcacguggggcccac

SEQ ID NO: 1612651 - RNA, 13 nt, Homo sapiens
ugcacuaagacaa

SEQ ID NO: 1612652 - RNA, 15 nt, Homo sapiens
ugcacuagugcaauu

SEQ ID NO: 1612653 - RNA, 20 nt, Homo sapiens
ugcacuccagccugggcaac

SEQ ID NO: 1612654 - RNA, 22 nt, Homo sapiens
ugcacuccagccugggggacag

SEQ ID NO: 1612655 - RNA, 13 nt, Homo sapiens
ugcacugcauucc

SEQ ID NO: 1612656 - RNA, 19 nt, Homo sapiens
ugcacuguucaaaccucug

SEQ ID NO: 1612657 - RNA, 21 nt, Homo sapiens
ugcacuguucccccugugcag

SEQ ID NO: 1612658 - RNA, 15 nt, Homo sapiens
ugcacuuauucaaua

SEQ ID NO: 1612659 - RNA, 21 nt, Homo sapiens
ugcacuuuuuccuuacugugc

SEQ ID NO: 1612660 - RNA, 13 nt, Homo sapiens
ugcagaaccagca

SEQ ID NO: 1612661 - RNA, 16 nt, Homo sapiens
ugcagaauaauccugu

SEQ ID NO: 1612662 - RNA, 20 nt, Homo sapiens
ugcagaauucaaaagugauu

SEQ ID NO: 1612663 - RNA, 21 nt, Homo sapiens
ugcagacaacccuguccucag

SEQ ID NO: 1612664 - RNA, 17 nt, Homo sapiens
ugcagaccugguuccca

SEQ ID NO: 1612665 - RNA, 17 nt, Homo sapiens
ugcagacggaugcccau

SEQ ID NO: 1612666 - RNA, 22 nt, Homo sapiens
ugcagaggggaaagacuuccau

SEQ ID NO: 1612667 - RNA, 15 nt, Homo sapiens
ugcagaguguuuacc

SEQ ID NO: 1612668 - RNA, 14 nt, Homo sapiens
ugcagcccaugccc

SEQ ID NO: 1612669 - RNA, 15 nt, Homo sapiens
ugcagcccaugccca

SEQ ID NO: 1612670 - RNA, 22 nt, Homo sapiens
ugcagcccccauuguggucaca

SEQ ID NO: 1612671 - RNA, 20 nt, Homo sapiens
ugcagcggcuccugcaaaag

SEQ ID NO: 1612672 - RNA, 15 nt, Homo sapiens
ugcagcuacuggaau

SEQ ID NO: 1612673 - RNA, 16 nt, Homo sapiens
ugcaggacaacucugu

SEQ ID NO: 1612674 - RNA, 23 nt, Homo sapiens
ugcaggacaucaaaaacaaccug

SEQ ID NO: 1612675 - RNA, 22 nt, Homo sapiens
ugcaggcaggaacaaacagggc

SEQ ID NO: 1612676 - RNA, 12 nt, Homo sapiens
ugcagggagaca

SEQ ID NO: 1612677 - RNA, 17 nt, Homo sapiens
ugcagggccacuggaag

SEQ ID NO: 1612678 - RNA, 21 nt, Homo sapiens
ugcaggucuccaccugcacau

SEQ ID NO: 1612679 - RNA, 17 nt, Homo sapiens
ugcaguagagagcaaag

SEQ ID NO: 1612680 - RNA, 20 nt, Homo sapiens
ugcaguaugaacuauugccu

SEQ ID NO: 1612681 - RNA, 17 nt, Homo sapiens
ugcaguaugguacauuu

SEQ ID NO: 1612682 - RNA, 15 nt, Homo sapiens
ugcagucaagcccug

SEQ ID NO: 1612683 - RNA, 17 nt, Homo sapiens
ugcagucacaucacaau

SEQ ID NO: 1612684 - RNA, 18 nt, Homo sapiens
ugcagucacaucacaaua

SEQ ID NO: 1612685 - RNA, 14 nt, Homo sapiens
ugcaguggugccau

SEQ ID NO: 1612686 - RNA, 16 nt, Homo sapiens
ugcaguguuaguauuc

SEQ ID NO: 1612687 - RNA, 18 nt, Homo sapiens
ugcaguucagcaccaccc

SEQ ID NO: 1612688 - RNA, 17 nt, Homo sapiens
ugcaguuucuuuucaca

SEQ ID NO: 1612689 - RNA, 19 nt, Homo sapiens
ugcauauuuguuacuuuac

SEQ ID NO: 1612690 - RNA, 21 nt, Homo sapiens
ugcaucacggauggugcaugg

SEQ ID NO: 1612691 - RNA, 20 nt, Homo sapiens
ugcauccagcagcagcacuu

SEQ ID NO: 1612692 - RNA, 20 nt, Homo sapiens
ugcaucccacguucuguuaa

SEQ ID NO: 1612693 - RNA, 18 nt, Homo sapiens
ugcauccguaguucccug

SEQ ID NO: 1612694 - RNA, 21 nt, Homo sapiens
ugcaucuccccucagauucca

SEQ ID NO: 1612695 - RNA, 23 nt, Homo sapiens
ugcaucuccccucagauuccacc

SEQ ID NO: 1612696 - RNA, 18 nt, Homo sapiens
ugcaucuggagagaacag

SEQ ID NO: 1612697 - RNA, 11 nt, Homo sapiens
ugcaucuggca

SEQ ID NO: 1612698 - RNA, 14 nt, Homo sapiens
ugcaugaccuacca

SEQ ID NO: 1612699 - RNA, 19 nt, Homo sapiens
ugcaugaccuaccaggaca

SEQ ID NO: 1612700 - RNA, 11 nt, Homo sapiens
ugcaugggcuc

SEQ ID NO: 1612701 - RNA, 18 nt, Homo sapiens
ugcaugguauguggguga

SEQ ID NO: 1612702 - RNA, 13 nt, Homo sapiens
ugcauguucuccu

SEQ ID NO: 1612703 - RNA, 12 nt, Homo sapiens
ugcauuccagcc

SEQ ID NO: 1612704 - RNA, 17 nt, Homo sapiens
ugcauugagcucucuca

SEQ ID NO: 1612705 - RNA, 15 nt, Homo sapiens
ugcauugccaagugc

SEQ ID NO: 1612706 - RNA, 19 nt, Homo sapiens
ugcauugccaagugccaua

SEQ ID NO: 1612707 - RNA, 23 nt, Homo sapiens
ugcauuuaaauacagucuuccau

SEQ ID NO: 1612708 - RNA, 15 nt, Homo sapiens
ugcauuuaugaugca

SEQ ID NO: 1612709 - RNA, 20 nt, Homo sapiens
ugcauuucauauuauuuuag

SEQ ID NO: 1612710 - RNA, 16 nt, Homo sapiens
ugcauuuccauuucuc

SEQ ID NO: 1612711 - RNA, 17 nt, Homo sapiens
ugccaaaaucaauacaa

SEQ ID NO: 1612712 - RNA, 13 nt, Homo sapiens
ugccaaaaugcaa

SEQ ID NO: 1612713 - RNA, 19 nt, Homo sapiens
ugccaauacagacaaagca

SEQ ID NO: 1612714 - RNA, 17 nt, Homo sapiens
ugccaaugaccaaacag

SEQ ID NO: 1612715 - RNA, 17 nt, Homo sapiens
ugccacagccagaggag

SEQ ID NO: 1612716 - RNA, 21 nt, Homo sapiens
ugccacaggaggggaaguagg

SEQ ID NO: 1612717 - RNA, 13 nt, Homo sapiens
ugccaccaaagga

SEQ ID NO: 1612718 - RNA, 18 nt, Homo sapiens
ugccaccacgcccagcua

SEQ ID NO: 1612719 - RNA, 19 nt, Homo sapiens
ugccaccaugacuggcuaa

SEQ ID NO: 1612720 - RNA, 18 nt, Homo sapiens
ugccacccaccuuugcca

SEQ ID NO: 1612721 - RNA, 16 nt, Homo sapiens
ugccaccggaggucac

SEQ ID NO: 1612722 - RNA, 20 nt, Homo sapiens
ugccaccuuccggggcauuu

SEQ ID NO: 1612723 - RNA, 15 nt, Homo sapiens
ugccagcagagccag

SEQ ID NO: 1612724 - RNA, 11 nt, Homo sapiens
ugccagcugcc

SEQ ID NO: 1612725 - RNA, 14 nt, Homo sapiens
ugccagugcacucc

SEQ ID NO: 1612726 - RNA, 11 nt, Homo sapiens
ugccagugccu

SEQ ID NO: 1612727 - RNA, 14 nt, Homo sapiens
ugccagugccuuau

SEQ ID NO: 1612728 - RNA, 17 nt, Homo sapiens
ugccauagucaaagaga

SEQ ID NO: 1612729 - RNA, 20 nt, Homo sapiens
ugccaucaccacggcucacu

SEQ ID NO: 1612730 - RNA, 15 nt, Homo sapiens
ugccaugcucagaaa

SEQ ID NO: 1612731 - RNA, 20 nt, Homo sapiens
ugccauguggcagaucuaca

SEQ ID NO: 1612732 - RNA, 18 nt, Homo sapiens
ugccauuaaaacauuacc

SEQ ID NO: 1612733 - RNA, 19 nt, Homo sapiens
ugccauuucugaacuguua

SEQ ID NO: 1612734 - RNA, 18 nt, Homo sapiens
ugcccaacccuaucccag

SEQ ID NO: 1612735 - RNA, 18 nt, Homo sapiens
ugcccagaauaaguuauu

SEQ ID NO: 1612736 - RNA, 23 nt, Homo sapiens
ugcccagaauaaguuauugcagu

SEQ ID NO: 1612737 - RNA, 19 nt, Homo sapiens
ugcccagccuggaugccau

SEQ ID NO: 1612738 - RNA, 16 nt, Homo sapiens
ugcccaguacauuuaa

SEQ ID NO: 1612739 - RNA, 20 nt, Homo sapiens
ugccccaccccauccagcca

SEQ ID NO: 1612740 - RNA, 22 nt, Homo sapiens
ugccccagauuuacuaaaucaa

SEQ ID NO: 1612741 - RNA, 14 nt, Homo sapiens
ugccccagggggau

SEQ ID NO: 1612742 - RNA, 17 nt, Homo sapiens
ugccccaugccugucca

SEQ ID NO: 1612743 - RNA, 23 nt, Homo sapiens
ugccccauugagaucuuccugcu

SEQ ID NO: 1612744 - RNA, 17 nt, Homo sapiens
ugcccccaauccaugaa

SEQ ID NO: 1612745 - RNA, 17 nt, Homo sapiens
ugcccccuccuguguaa

SEQ ID NO: 1612746 - RNA, 14 nt, Homo sapiens
ugccccucucacca

SEQ ID NO: 1612747 - RNA, 15 nt, Homo sapiens
ugccccuugggagac

SEQ ID NO: 1612748 - RNA, 19 nt, Homo sapiens
ugcccuaguugugggcaac

SEQ ID NO: 1612749 - RNA, 23 nt, Homo sapiens
ugcccucucccuguguucugggc

SEQ ID NO: 1612750 - RNA, 20 nt, Homo sapiens
ugcccucuuguggugcauug

SEQ ID NO: 1612751 - RNA, 14 nt, Homo sapiens
ugcccuguguggcu

SEQ ID NO: 1612752 - RNA, 22 nt, Homo sapiens
ugcccuuaaguucagcaacugu

SEQ ID NO: 1612753 - RNA, 17 nt, Homo sapiens
ugcccuuguuccagcuu

SEQ ID NO: 1612754 - RNA, 14 nt, Homo sapiens
ugcccuuugggguc

SEQ ID NO: 1612755 - RNA, 12 nt, Homo sapiens
ugccgaauuugg

SEQ ID NO: 1612756 - RNA, 20 nt, Homo sapiens
ugccgcccuccacaccucua

SEQ ID NO: 1612757 - RNA, 21 nt, Homo sapiens
ugccuaauuuugaacuaguaa

SEQ ID NO: 1612758 - RNA, 13 nt, Homo sapiens
ugccuacagccag

SEQ ID NO: 1612759 - RNA, 15 nt, Homo sapiens
ugccuacagccaggu

SEQ ID NO: 1612760 - RNA, 12 nt, Homo sapiens
ugccuaccucuu

SEQ ID NO: 1612761 - RNA, 21 nt, Homo sapiens
ugaccacaucgcucuaggaua

SEQ ID NO: 1612762 - RNA, 22 nt, Homo sapiens
ugaccacucuucuuuaagccau

SEQ ID NO: 1612763 - RNA, 16 nt, Homo sapiens
ugaccauuauucacag

SEQ ID NO: 1612764 - RNA, 21 nt, Homo sapiens
ugacccacccuagaucuuccc

SEQ ID NO: 1612765 - RNA, 19 nt, Homo sapiens
ugaccccagcauuuccaga

SEQ ID NO: 1612766 - RNA, 21 nt, Homo sapiens
ugacccucaucuuucuuccaa

SEQ ID NO: 1612767 - RNA, 15 nt, Homo sapiens
ugaccuaccaggaca

SEQ ID NO: 1612768 - RNA, 18 nt, Homo sapiens
ugaccuguguuucacuua

SEQ ID NO: 1612769 - RNA, 16 nt, Homo sapiens
ugaccuuuagguauua

SEQ ID NO: 1612770 - RNA, 15 nt, Homo sapiens
ugaccuuugaccucg

SEQ ID NO: 1612771 - RNA, 20 nt, Homo sapiens
ugacgguguccaugccuucc

SEQ ID NO: 1612772 - RNA, 19 nt, Homo sapiens
ugacucaauuauuugcaua

SEQ ID NO: 1612773 - RNA, 19 nt, Homo sapiens
ugacucacucauaaagguu

SEQ ID NO: 1612774 - RNA, 23 nt, Homo sapiens
ugacucagaacuucugccucuaa

SEQ ID NO: 1612775 - RNA, 20 nt, Homo sapiens
ugacucagcuaaugucacaa

SEQ ID NO: 1612776 - RNA, 14 nt, Homo sapiens
ugacucagugacca

SEQ ID NO: 1612777 - RNA, 15 nt, Homo sapiens
ugacuccaagcugca

SEQ ID NO: 1612778 - RNA, 21 nt, Homo sapiens
ugacuccacuacuuuacuguu

SEQ ID NO: 1612779 - RNA, 12 nt, Homo sapiens
ugacucuagcaa

SEQ ID NO: 1612780 - RNA, 19 nt, Homo sapiens
ugacucuaggcuucagguu

SEQ ID NO: 1612781 - RNA, 16 nt, Homo sapiens
ugacucucagcagcua

SEQ ID NO: 1612782 - RNA, 18 nt, Homo sapiens
ugacucuuagccccagac

SEQ ID NO: 1612783 - RNA, 19 nt, Homo sapiens
ugacucuuuauugucugua

SEQ ID NO: 1612784 - RNA, 16 nt, Homo sapiens
ugacugagauggagug

SEQ ID NO: 1612785 - RNA, 19 nt, Homo sapiens
ugacugugauuagaucaca

SEQ ID NO: 1612786 - RNA, 19 nt, Homo sapiens
ugacuuagcgucaagacau

SEQ ID NO: 1612787 - RNA, 15 nt, Homo sapiens
ugacuuauaguacau

SEQ ID NO: 1612788 - RNA, 13 nt, Homo sapiens
ugacuucacugua

SEQ ID NO: 1612789 - RNA, 14 nt, Homo sapiens
ugacuucacuguau

SEQ ID NO: 1612790 - RNA, 14 nt, Homo sapiens
ugacuugcaauaaa

SEQ ID NO: 1612791 - RNA, 13 nt, Homo sapiens
ugacuugcaaucc

SEQ ID NO: 1612792 - RNA, 17 nt, Homo sapiens
ugacuuuagaaagcuga

SEQ ID NO: 1612793 - RNA, 17 nt, Homo sapiens
ugacuuugcuccucaca

SEQ ID NO: 1612794 - RNA, 21 nt, Homo sapiens
ugacuuugggaaagagggacc

SEQ ID NO: 1612795 - RNA, 19 nt, Homo sapiens
ugacuuugggcaagccaag

SEQ ID NO: 1612796 - RNA, 23 nt, Homo sapiens
ugagaaaaauagagcaaaaucaa

SEQ ID NO: 1612797 - RNA, 23 nt, Homo sapiens
ugagaaaaguuuaaagacacuua

SEQ ID NO: 1612798 - RNA, 23 nt, Homo sapiens
ugagaaaauaucuugcuuucaaa

SEQ ID NO: 1612799 - RNA, 14 nt, Homo sapiens
ugagaaacugggaa

SEQ ID NO: 1612800 - RNA, 15 nt, Homo sapiens
ugagaaauggccaaa

SEQ ID NO: 1612801 - RNA, 17 nt, Homo sapiens
ugagaaauggccaaaua

SEQ ID NO: 1612802 - RNA, 22 nt, Homo sapiens
ugagaacauuaacaaaagcaau

SEQ ID NO: 1612803 - RNA, 16 nt, Homo sapiens
ugagaaccauuuacuu

SEQ ID NO: 1612804 - RNA, 18 nt, Homo sapiens
ugagaacuccucauuccc

SEQ ID NO: 1612805 - RNA, 20 nt, Homo sapiens
ugagaagccugaugacauca

SEQ ID NO: 1612806 - RNA, 14 nt, Homo sapiens
ugagaagcugccau

SEQ ID NO: 1612807 - RNA, 20 nt, Homo sapiens
ugagaaggcagccaccagcg

SEQ ID NO: 1612808 - RNA, 17 nt, Homo sapiens
ugagaauguucaucucu

SEQ ID NO: 1612809 - RNA, 12 nt, Homo sapiens
ugagacacuguc

SEQ ID NO: 1612810 - RNA, 16 nt, Homo sapiens
ugagacagcacagcca

SEQ ID NO: 1612811 - RNA, 22 nt, Homo sapiens
ugagacagcucugcauacucau

SEQ ID NO: 1612812 - RNA, 19 nt, Homo sapiens
ugagaccaggguggccaca

SEQ ID NO: 1612813 - RNA, 17 nt, Homo sapiens
ugagacucuagggucca

SEQ ID NO: 1612814 - RNA, 23 nt, Homo sapiens
ugagacuuucuucuagugcuuuu

SEQ ID NO: 1612815 - RNA, 14 nt, Homo sapiens
ugagagacccaagg

SEQ ID NO: 1612816 - RNA, 22 nt, Homo sapiens
ugagagcaauauuuaaauucuc

SEQ ID NO: 1612817 - RNA, 19 nt, Homo sapiens
ugagaggccacagugcaau

SEQ ID NO: 1612818 - RNA, 13 nt, Homo sapiens
ugagauacuuugc

SEQ ID NO: 1612819 - RNA, 13 nt, Homo sapiens
ugagauauggacu

SEQ ID NO: 1612820 - RNA, 20 nt, Homo sapiens
ugagaugauuuccaagccuc

SEQ ID NO: 1612821 - RNA, 22 nt, Homo sapiens
ugagaugcaggugaugccauua

SEQ ID NO: 1612822 - RNA, 21 nt, Homo sapiens
ugagauucagaugucauuuag

SEQ ID NO: 1612823 - RNA, 15 nt, Homo sapiens
ugagcaagacauacu

SEQ ID NO: 1612824 - RNA, 18 nt, Homo sapiens
ugagcaagacauacuuaa

SEQ ID NO: 1612825 - RNA, 18 nt, Homo sapiens
ugagcaauaugucaguca

SEQ ID NO: 1612826 - RNA, 19 nt, Homo sapiens
ugagcacauuugacuccac

SEQ ID NO: 1612827 - RNA, 14 nt, Homo sapiens
ugagcacuacucua

SEQ ID NO: 1612828 - RNA, 17 nt, Homo sapiens
ugagcacuccuggugca

SEQ ID NO: 1612829 - RNA, 15 nt, Homo sapiens
ugagcagguguucuu

SEQ ID NO: 1612830 - RNA, 23 nt, Homo sapiens
ugagcagguguucuucauuaccu

SEQ ID NO: 1612831 - RNA, 19 nt, Homo sapiens
ugagcaguggacacgugag

SEQ ID NO: 1612832 - RNA, 16 nt, Homo sapiens
ugagcaguuagcagac

SEQ ID NO: 1612833 - RNA, 23 nt, Homo sapiens
ugagcauggggccaggaaagucu

SEQ ID NO: 1612834 - RNA, 21 nt, Homo sapiens
ugagccaagagugcacuacug

SEQ ID NO: 1612835 - RNA, 19 nt, Homo sapiens
ugagccacagucacuggau

SEQ ID NO: 1612836 - RNA, 21 nt, Homo sapiens
ugagccagucuuugaacugca

SEQ ID NO: 1612837 - RNA, 22 nt, Homo sapiens
ugagcgcccccgagcccugacu

SEQ ID NO: 1612838 - RNA, 18 nt, Homo sapiens
ugagcgggagucagggac

SEQ ID NO: 1612839 - RNA, 14 nt, Homo sapiens
ugagcuggggacuc

SEQ ID NO: 1612840 - RNA, 15 nt, Homo sapiens
ugagcuucaauauaa

SEQ ID NO: 1612841 - RNA, 20 nt, Homo sapiens
ugagcuucauauaccagcaa

SEQ ID NO: 1612842 - RNA, 18 nt, Homo sapiens
ugaggaaaaguccacaag

SEQ ID NO: 1612843 - RNA, 23 nt, Homo sapiens
ugaggaaguggcugucccugugg

SEQ ID NO: 1612844 - RNA, 18 nt, Homo sapiens
ugaggacgcuggggaaua

SEQ ID NO: 1612845 - RNA, 15 nt, Homo sapiens
ugaggaguaaaaaga

SEQ ID NO: 1612846 - RNA, 14 nt, Homo sapiens
ugaggcaauaaaaa

SEQ ID NO: 1612847 - RNA, 20 nt, Homo sapiens
ugaggcaggagaagaacaag

SEQ ID NO: 1612848 - RNA, 12 nt, Homo sapiens
ugaggcuucuaa

SEQ ID NO: 1612849 - RNA, 15 nt, Homo sapiens
ugagggagaugccau

SEQ ID NO: 1612850 - RNA, 14 nt, Homo sapiens
ugagggcagauuca

SEQ ID NO: 1612851 - RNA, 22 nt, Homo sapiens
ugagggcaguucugaguguuua

SEQ ID NO: 1612852 - RNA, 15 nt, Homo sapiens
ugaggggcucucuca

SEQ ID NO: 1612853 - RNA, 18 nt, Homo sapiens
ugaggggcucucucauga

SEQ ID NO: 1612854 - RNA, 12 nt, Homo sapiens
ugaggggucccc

SEQ ID NO: 1612855 - RNA, 12 nt, Homo sapiens
ugagggugcuga

SEQ ID NO: 1612856 - RNA, 20 nt, Homo sapiens
ugagguaauucuagccuuuu

SEQ ID NO: 1612857 - RNA, 19 nt, Homo sapiens
ugagguaucacugcaguca

SEQ ID NO: 1612858 - RNA, 18 nt, Homo sapiens
ugaguaacaggugccuuc

SEQ ID NO: 1612859 - RNA, 15 nt, Homo sapiens
ugaguaagauuuacc

SEQ ID NO: 1612860 - RNA, 18 nt, Homo sapiens
ugaguaagcccucaggag

SEQ ID NO: 1612861 - RNA, 17 nt, Homo sapiens
ugaguaauacaucaaag

SEQ ID NO: 1612862 - RNA, 15 nt, Homo sapiens
ugaguagcugggacu

SEQ ID NO: 1612863 - RNA, 20 nt, Homo sapiens
ugaguaguggccacuggggu

SEQ ID NO: 1612864 - RNA, 15 nt, Homo sapiens
ugagucaaagacuua

SEQ ID NO: 1612865 - RNA, 20 nt, Homo sapiens
ugagucaugaucucccugcc

SEQ ID NO: 1612866 - RNA, 20 nt, Homo sapiens
ugaguccacgcccaccagcc

SEQ ID NO: 1612867 - RNA, 21 nt, Homo sapiens
ugaguccgacccagacaucca

SEQ ID NO: 1612868 - RNA, 12 nt, Homo sapiens
ugagucuucacu

SEQ ID NO: 1612869 - RNA, 14 nt, Homo sapiens
ugagugugugaaca

SEQ ID NO: 1612870 - RNA, 21 nt, Homo sapiens
ugaguugugugaauaccccaa

SEQ ID NO: 1612871 - RNA, 20 nt, Homo sapiens
ugaguuguuuaaacagucaa

SEQ ID NO: 1612872 - RNA, 21 nt, Homo sapiens
ugaguuuggaugucuguagca

SEQ ID NO: 1612873 - RNA, 15 nt, Homo sapiens
ugauaaaaagaucaa

SEQ ID NO: 1612874 - RNA, 16 nt, Homo sapiens
ugauaaaagauggcca

SEQ ID NO: 1612875 - RNA, 19 nt, Homo sapiens
ugauaaaauuuuacauuug

SEQ ID NO: 1612876 - RNA, 13 nt, Homo sapiens
ugauaaagaggca

SEQ ID NO: 1612877 - RNA, 18 nt, Homo sapiens
ugauaaaugauagacaau

SEQ ID NO: 1612878 - RNA, 14 nt, Homo sapiens
ugauaaggcucuga

SEQ ID NO: 1612879 - RNA, 17 nt, Homo sapiens
ugaaagugguacuugau

SEQ ID NO: 1612880 - RNA, 20 nt, Homo sapiens
ugaaaguuaauccacuguga

SEQ ID NO: 1612881 - RNA, 17 nt, Homo sapiens
ugaaaguugcuuuuauu

SEQ ID NO: 1612882 - RNA, 20 nt, Homo sapiens
ugaaauaaaagcacacugcu

SEQ ID NO: 1612883 - RNA, 15 nt, Homo sapiens
ugaaauaaaugacaa

SEQ ID NO: 1612884 - RNA, 17 nt, Homo sapiens
ugaaauaagcugugauu

SEQ ID NO: 1612885 - RNA, 23 nt, Homo sapiens
ugaaauaccuuuucucacaaaaa

SEQ ID NO: 1612886 - RNA, 12 nt, Homo sapiens
ugaaauaucauc

SEQ ID NO: 1612887 - RNA, 19 nt, Homo sapiens
ugaaaucgcugcucaaaaa

SEQ ID NO: 1612888 - RNA, 22 nt, Homo sapiens
ugaaaucuauuggguuaauuuc

SEQ ID NO: 1612889 - RNA, 21 nt, Homo sapiens
ugaaaucuuguuuguuacugu

SEQ ID NO: 1612890 - RNA, 16 nt, Homo sapiens
ugaaaugaaagggaaa

SEQ ID NO: 1612891 - RNA, 20 nt, Homo sapiens
ugaaaugaaugauucuacag

SEQ ID NO: 1612892 - RNA, 15 nt, Homo sapiens
ugaaaugacauuuca

SEQ ID NO: 1612893 - RNA, 16 nt, Homo sapiens
ugaaaugacauuucac

SEQ ID NO: 1612894 - RNA, 21 nt, Homo sapiens
ugaaauucugaauuugcaaag

SEQ ID NO: 1612895 - RNA, 15 nt, Homo sapiens
ugaaauuguaucuca

SEQ ID NO: 1612896 - RNA, 18 nt, Homo sapiens
ugaaauuuugcaccagcg

SEQ ID NO: 1612897 - RNA, 20 nt, Homo sapiens
ugaacaaauuuucuggugcu

SEQ ID NO: 1612898 - RNA, 22 nt, Homo sapiens
ugaacaauuguggucucucuua

SEQ ID NO: 1612899 - RNA, 15 nt, Homo sapiens
ugaacacaucagcuu

SEQ ID NO: 1612900 - RNA, 22 nt, Homo sapiens
ugaacaucccuuuuucaaugaa

SEQ ID NO: 1612901 - RNA, 22 nt, Homo sapiens
ugaaccaagaccauugaauucu

SEQ ID NO: 1612902 - RNA, 19 nt, Homo sapiens
ugaaccaaugcaagacgcc

SEQ ID NO: 1612903 - RNA, 17 nt, Homo sapiens
ugaaccaugaagucaua

SEQ ID NO: 1612904 - RNA, 16 nt, Homo sapiens
ugaaccuucugcaaca

SEQ ID NO: 1612905 - RNA, 21 nt, Homo sapiens
ugaacucugguggcacaggag

SEQ ID NO: 1612906 - RNA, 18 nt, Homo sapiens
ugaacugcagcaaucaca

SEQ ID NO: 1612907 - RNA, 20 nt, Homo sapiens
ugaacugcagcaaucacaaa

SEQ ID NO: 1612908 - RNA, 12 nt, Homo sapiens
ugaagagcuaau

SEQ ID NO: 1612909 - RNA, 17 nt, Homo sapiens
ugaagagcuaauuuacu

SEQ ID NO: 1612910 - RNA, 15 nt, Homo sapiens
ugaagagcuauuaua

SEQ ID NO: 1612911 - RNA, 15 nt, Homo sapiens
ugaagaguaaaggaa

SEQ ID NO: 1612912 - RNA, 19 nt, Homo sapiens
ugaagaugggcuucaucca

SEQ ID NO: 1612913 - RNA, 19 nt, Homo sapiens
ugaagcacugagcagaagc

SEQ ID NO: 1612914 - RNA, 11 nt, Homo sapiens
ugaagcacugu

SEQ ID NO: 1612915 - RNA, 14 nt, Homo sapiens
ugaagcagcacugu

SEQ ID NO: 1612916 - RNA, 17 nt, Homo sapiens
ugaagcagucuugcucu

SEQ ID NO: 1612917 - RNA, 13 nt, Homo sapiens
ugaagccacagca

SEQ ID NO: 1612918 - RNA, 18 nt, Homo sapiens
ugaagccuauguaugcca

SEQ ID NO: 1612919 - RNA, 21 nt, Homo sapiens
ugaagcugacagcacuacaaa

SEQ ID NO: 1612920 - RNA, 17 nt, Homo sapiens
ugaagcugcacaguguu

SEQ ID NO: 1612921 - RNA, 21 nt, Homo sapiens
ugaagcuuaggacuaccagcc

SEQ ID NO: 1612922 - RNA, 21 nt, Homo sapiens
ugaagcuuuaggcagagccau

SEQ ID NO: 1612923 - RNA, 16 nt, Homo sapiens
ugaaggaaaaacacaa

SEQ ID NO: 1612924 - RNA, 19 nt, Homo sapiens
ugaaggaguccuugcauca

SEQ ID NO: 1612925 - RNA, 22 nt, Homo sapiens
ugaaggaugcggcaggugcucu

SEQ ID NO: 1612926 - RNA, 22 nt, Homo sapiens
ugaaggcaguacuuauagaccu

SEQ ID NO: 1612927 - RNA, 16 nt, Homo sapiens
ugaaggggaggucaca

SEQ ID NO: 1612928 - RNA, 21 nt, Homo sapiens
ugaaguuuaaacucugcucag

SEQ ID NO: 1612929 - RNA, 16 nt, Homo sapiens
ugaaguuuaauugacu

SEQ ID NO: 1612930 - RNA, 13 nt, Homo sapiens
ugaaguuuaguca

SEQ ID NO: 1612931 - RNA, 17 nt, Homo sapiens
ugaaguuuugauuuauu

SEQ ID NO: 1612932 - RNA, 15 nt, Homo sapiens
ugaauaaugaaugaa

SEQ ID NO: 1612933 - RNA, 12 nt, Homo sapiens
ugaauacacuua

SEQ ID NO: 1612934 - RNA, 23 nt, Homo sapiens
ugaauacgcuaauaagugacaaa

SEQ ID NO: 1612935 - RNA, 20 nt, Homo sapiens
ugaauacucugcccucuaga

SEQ ID NO: 1612936 - RNA, 18 nt, Homo sapiens
ugaauacugcauuuacag

SEQ ID NO: 1612937 - RNA, 21 nt, Homo sapiens
ugaauacugcauuuacagugu

SEQ ID NO: 1612938 - RNA, 15 nt, Homo sapiens
ugaauagaacucuga

SEQ ID NO: 1612939 - RNA, 23 nt, Homo sapiens
ugaaucaaucuggcuucugcauu

SEQ ID NO: 1612940 - RNA, 23 nt, Homo sapiens
ugaaucaguccuagaauguuuca

SEQ ID NO: 1612941 - RNA, 15 nt, Homo sapiens
ugaaucaugaaguaa

SEQ ID NO: 1612942 - RNA, 23 nt, Homo sapiens
ugaauccacccaaaucuauuguu

SEQ ID NO: 1612943 - RNA, 15 nt, Homo sapiens
ugaauccaucuugcu

SEQ ID NO: 1612944 - RNA, 19 nt, Homo sapiens
ugaaucgcaaguuaacuug

SEQ ID NO: 1612945 - RNA, 15 nt, Homo sapiens
ugaaugacauugaac

SEQ ID NO: 1612946 - RNA, 13 nt, Homo sapiens
ugaaugacuugac

SEQ ID NO: 1612947 - RNA, 19 nt, Homo sapiens
ugaaugacuugacuucaaa

SEQ ID NO: 1612948 - RNA, 16 nt, Homo sapiens
ugaaugcuauguucug

SEQ ID NO: 1612949 - RNA, 17 nt, Homo sapiens
ugaaugcuuaauucaau

SEQ ID NO: 1612950 - RNA, 16 nt, Homo sapiens
ugaauggccuucauau

SEQ ID NO: 1612951 - RNA, 16 nt, Homo sapiens
ugaauguuaaugguca

SEQ ID NO: 1612952 - RNA, 17 nt, Homo sapiens
ugaauuauugacacuga

SEQ ID NO: 1612953 - RNA, 18 nt, Homo sapiens
ugaauuauugacacugaa

SEQ ID NO: 1612954 - RNA, 14 nt, Homo sapiens
ugaauucauauaau

SEQ ID NO: 1612955 - RNA, 15 nt, Homo sapiens
ugaauucauaucgcc

SEQ ID NO: 1612956 - RNA, 19 nt, Homo sapiens
ugaauuccacuccuuccag

SEQ ID NO: 1612957 - RNA, 21 nt, Homo sapiens
ugaauuccacuccuuccagaa

SEQ ID NO: 1612958 - RNA, 14 nt, Homo sapiens
ugaauuccauggaa

SEQ ID NO: 1612959 - RNA, 20 nt, Homo sapiens
ugaauuccauggaauuucua

SEQ ID NO: 1612960 - RNA, 15 nt, Homo sapiens
ugaauuccucucaaa

SEQ ID NO: 1612961 - RNA, 19 nt, Homo sapiens
ugaauuguuacaucaugcu

SEQ ID NO: 1612962 - RNA, 13 nt, Homo sapiens
ugaauuucacugu

SEQ ID NO: 1612963 - RNA, 21 nt, Homo sapiens
ucugacuaggugucaccauac

SEQ ID NO: 1612964 - RNA, 19 nt, Homo sapiens
ucugagaaagacuauucaa

SEQ ID NO: 1612965 - RNA, 22 nt, Homo sapiens
ucugagaacuccucauucccug

SEQ ID NO: 1612966 - RNA, 15 nt, Homo sapiens
ucugagaagacacaa

SEQ ID NO: 1612967 - RNA, 15 nt, Homo sapiens
ucugagacauuccac

SEQ ID NO: 1612968 - RNA, 20 nt, Homo sapiens
ucugagcacggacucuccca

SEQ ID NO: 1612969 - RNA, 19 nt, Homo sapiens
ucugagcagugaaugauuc

SEQ ID NO: 1612970 - RNA, 23 nt, Homo sapiens
ucugagcagugaaugauucagug

SEQ ID NO: 1612971 - RNA, 15 nt, Homo sapiens
ucugagcuauuucau

SEQ ID NO: 1612972 - RNA, 14 nt, Homo sapiens
ucugagcucugcau

SEQ ID NO: 1612973 - RNA, 23 nt, Homo sapiens
ucugagcuguaauuucgccuuaa

SEQ ID NO: 1612974 - RNA, 21 nt, Homo sapiens
ucugaggaucagcacugccag

SEQ ID NO: 1612975 - RNA, 20 nt, Homo sapiens
ucugaggcccugcccaauga

SEQ ID NO: 1612976 - RNA, 17 nt, Homo sapiens
ucugauaggaaugugaa

SEQ ID NO: 1612977 - RNA, 15 nt, Homo sapiens
ucugauauguaucca

SEQ ID NO: 1612978 - RNA, 18 nt, Homo sapiens
ucugaucauguaugcauc

SEQ ID NO: 1612979 - RNA, 20 nt, Homo sapiens
ucugaucugcccccacuguc

SEQ ID NO: 1612980 - RNA, 22 nt, Homo sapiens
ucugauggaacuguguauuuau

SEQ ID NO: 1612981 - RNA, 14 nt, Homo sapiens
ucugaugucuccac

SEQ ID NO: 1612982 - RNA, 20 nt, Homo sapiens
ucugauucuuuuuucaguca

SEQ ID NO: 1612983 - RNA, 18 nt, Homo sapiens
ucugauuuguaaugagca

SEQ ID NO: 1612984 - RNA, 20 nt, Homo sapiens
ucugauuuuggccaucagga

SEQ ID NO: 1612985 - RNA, 21 nt, Homo sapiens
ucugcaaaaugggaacaauga

SEQ ID NO: 1612986 - RNA, 19 nt, Homo sapiens
ucugcacaacugacuucca

SEQ ID NO: 1612987 - RNA, 17 nt, Homo sapiens
ucugcaccacaccuggc

SEQ ID NO: 1612988 - RNA, 19 nt, Homo sapiens
ucugcacuguucaaaccuc

SEQ ID NO: 1612989 - RNA, 14 nt, Homo sapiens
ucugcagcucugac

SEQ ID NO: 1612990 - RNA, 17 nt, Homo sapiens
ucugcauccagagauuc

SEQ ID NO: 1612991 - RNA, 19 nt, Homo sapiens
ucugcauccuggcuugaaa

SEQ ID NO: 1612992 - RNA, 22 nt, Homo sapiens
ucugcauggaacagcauuaccc

SEQ ID NO: 1612993 - RNA, 16 nt, Homo sapiens
ucugcauucucuaguc

SEQ ID NO: 1612994 - RNA, 21 nt, Homo sapiens
ucugcccccgcggguucuaga

SEQ ID NO: 1612995 - RNA, 16 nt, Homo sapiens
ucugcccgcuccaugg

SEQ ID NO: 1612996 - RNA, 21 nt, Homo sapiens
ucugcccgcuccauggaaaag

SEQ ID NO: 1612997 - RNA, 18 nt, Homo sapiens
ucugcccggcuacaucag

SEQ ID NO: 1612998 - RNA, 15 nt, Homo sapiens
ucugccuaugcacug

SEQ ID NO: 1612999 - RNA, 14 nt, Homo sapiens
ucugccuguacuga

SEQ ID NO: 1613000 - RNA, 19 nt, Homo sapiens
ucugccuguuauaacucug

SEQ ID NO: 1613001 - RNA, 19 nt, Homo sapiens
ucugccuuggauuccuaga

SEQ ID NO: 1613002 - RNA, 17 nt, Homo sapiens
ucugccuuuuuacuaua

SEQ ID NO: 1613003 - RNA, 22 nt, Homo sapiens
ucugcuaauucgagucauggcu

SEQ ID NO: 1613004 - RNA, 14 nt, Homo sapiens
ucugcucaucauuc

SEQ ID NO: 1613005 - RNA, 10 nt, Homo sapiens
ucugcuccac

SEQ ID NO: 1613006 - RNA, 21 nt, Homo sapiens
ucugcugauuaucacacauca

SEQ ID NO: 1613007 - RNA, 12 nt, Homo sapiens
ucugcuguagaa

SEQ ID NO: 1613008 - RNA, 15 nt, Homo sapiens
ucugcuuuuccucug

SEQ ID NO: 1613009 - RNA, 22 nt, Homo sapiens
ucuggaaguuucuggugccauu

SEQ ID NO: 1613010 - RNA, 12 nt, Homo sapiens
ucuggagcauuu

SEQ ID NO: 1613011 - RNA, 20 nt, Homo sapiens
ucuggauuagaaugccgguu

SEQ ID NO: 1613012 - RNA, 17 nt, Homo sapiens
ucuggauucaaauuuau

SEQ ID NO: 1613013 - RNA, 12 nt, Homo sapiens
ucuggauuucau

SEQ ID NO: 1613014 - RNA, 17 nt, Homo sapiens
ucugggacaaaacugga

SEQ ID NO: 1613015 - RNA, 17 nt, Homo sapiens
ucugggacuccugucua

SEQ ID NO: 1613016 - RNA, 17 nt, Homo sapiens
ucugggagucacacagu

SEQ ID NO: 1613017 - RNA, 13 nt, Homo sapiens
ucugggcacugga

SEQ ID NO: 1613018 - RNA, 17 nt, Homo sapiens
ucuggggccacuuggua

SEQ ID NO: 1613019 - RNA, 21 nt, Homo sapiens
ucugggguccauucucugagu

SEQ ID NO: 1613020 - RNA, 22 nt, Homo sapiens
ucuggggugggaguaacagggc

SEQ ID NO: 1613021 - RNA, 19 nt, Homo sapiens
ucugggugaccucacuuua

SEQ ID NO: 1613022 - RNA, 22 nt, Homo sapiens
ucuggguggaagugugugccaa

SEQ ID NO: 1613023 - RNA, 23 nt, Homo sapiens
ucugggugugcuuuuugggacca

SEQ ID NO: 1613024 - RNA, 13 nt, Homo sapiens
ucugguguugacu

SEQ ID NO: 1613025 - RNA, 19 nt, Homo sapiens
ucuguaaaaaauggagcuc

SEQ ID NO: 1613026 - RNA, 19 nt, Homo sapiens
ucuguaaaacgcaccaauc

SEQ ID NO: 1613027 - RNA, 16 nt, Homo sapiens
ucuguaaaaugcacca

SEQ ID NO: 1613028 - RNA, 19 nt, Homo sapiens
ucuguaaaaugcaccaauc

SEQ ID NO: 1613029 - RNA, 16 nt, Homo sapiens
ucuguaaacuguguau

SEQ ID NO: 1613030 - RNA, 22 nt, Homo sapiens
ucuguaaugauacugauuauga

SEQ ID NO: 1613031 - RNA, 14 nt, Homo sapiens
ucuguacauuugca

SEQ ID NO: 1613032 - RNA, 15 nt, Homo sapiens
ucuguacuaucuuac

SEQ ID NO: 1613033 - RNA, 17 nt, Homo sapiens
ucuguaggaaacccaac

SEQ ID NO: 1613034 - RNA, 20 nt, Homo sapiens
ucuguauugggguacaggaa

SEQ ID NO: 1613035 - RNA, 21 nt, Homo sapiens
ucuguauugggguacaggaau

SEQ ID NO: 1613036 - RNA, 19 nt, Homo sapiens
ucuguauuuuauuuagaca

SEQ ID NO: 1613037 - RNA, 12 nt, Homo sapiens
ucugucaccagc

SEQ ID NO: 1613038 - RNA, 21 nt, Homo sapiens
ucugucaccagcuaucuguca

SEQ ID NO: 1613039 - RNA, 16 nt, Homo sapiens
ucugucaucucucugg

SEQ ID NO: 1613040 - RNA, 12 nt, Homo sapiens
ucugucaugaac

SEQ ID NO: 1613041 - RNA, 19 nt, Homo sapiens
ucuguccacgauucacuca

SEQ ID NO: 1613042 - RNA, 20 nt, Homo sapiens
ucuguccuggaggcacuggg

SEQ ID NO: 1613043 - RNA, 21 nt, Homo sapiens
ucuguccuggaggcacuggga

SEQ ID NO: 1613044 - RNA, 17 nt, Homo sapiens
ucugucuccaagaccuu

SEQ ID NO: 1613045 - RNA, 16 nt, Homo sapiens
ucugugcagucacugg

SEQ ID NO: 1613046 - RNA, 22 nt, Homo sapiens
ucuguggcaaaaguuuaaucag

SEQ ID NO: 1613047 - RNA, 17 nt, Homo sapiens
ucuguggcacucagaua

SEQ ID NO: 1613048 - RNA, 18 nt, Homo sapiens
ucuguggucccuuccaau

SEQ ID NO: 1613049 - RNA, 19 nt, Homo sapiens
ucuguguguguguaugugg

SEQ ID NO: 1613050 - RNA, 18 nt, Homo sapiens
ucuguguugaagcacugu

SEQ ID NO: 1613051 - RNA, 20 nt, Homo sapiens
ucuguguuuucagacugccu

SEQ ID NO: 1613052 - RNA, 22 nt, Homo sapiens
ucuguguuuugaaugguguugu

SEQ ID NO: 1613053 - RNA, 14 nt, Homo sapiens
ucuguuauauagug

SEQ ID NO: 1613054 - RNA, 18 nt, Homo sapiens
ucuguuaugcugugacac

SEQ ID NO: 1613055 - RNA, 17 nt, Homo sapiens
ucuguucaguucauucc

SEQ ID NO: 1613056 - RNA, 17 nt, Homo sapiens
ucuguugaaaagcacac

SEQ ID NO: 1613057 - RNA, 15 nt, Homo sapiens
ucuguugaaucacag

SEQ ID NO: 1613058 - RNA, 15 nt, Homo sapiens
ucuguugggaugcca

SEQ ID NO: 1613059 - RNA, 21 nt, Homo sapiens
ucuguuuccuggucagcaugu

SEQ ID NO: 1613060 - RNA, 22 nt, Homo sapiens
ucuuaaauuuucuuccuuugaa

SEQ ID NO: 1613061 - RNA, 19 nt, Homo sapiens
ucuuaacccccuagaaaga

SEQ ID NO: 1613062 - RNA, 22 nt, Homo sapiens
ucuuaaccucagggagugcaga

SEQ ID NO: 1613063 - RNA, 16 nt, Homo sapiens
ucuuaacuucuugcuu

SEQ ID NO: 1613064 - RNA, 13 nt, Homo sapiens
ucuuaacuugaag

SEQ ID NO: 1613065 - RNA, 13 nt, Homo sapiens
ucuuaagacguga

SEQ ID NO: 1613066 - RNA, 22 nt, Homo sapiens
ucuuaagauccacaaaugaagg

SEQ ID NO: 1613067 - RNA, 21 nt, Homo sapiens
ucuuacaaguuagauguuacu

SEQ ID NO: 1613068 - RNA, 14 nt, Homo sapiens
ucuuacacauagca

SEQ ID NO: 1613069 - RNA, 23 nt, Homo sapiens
ucuuaccagaucuaauauugacu

SEQ ID NO: 1613070 - RNA, 20 nt, Homo sapiens
ucuuacguuuuucuggugcu

SEQ ID NO: 1613071 - RNA, 17 nt, Homo sapiens
ucuuacuacagcuucag

SEQ ID NO: 1613072 - RNA, 20 nt, Homo sapiens
ucuuacuacagcuucaguga

SEQ ID NO: 1613073 - RNA, 15 nt, Homo sapiens
ucuuagauucuuaau

SEQ ID NO: 1613074 - RNA, 23 nt, Homo sapiens
ucuuagcuccccuccaaccuggg

SEQ ID NO: 1613075 - RNA, 20 nt, Homo sapiens
ucuuagugugccaagaguuc

SEQ ID NO: 1613076 - RNA, 12 nt, Homo sapiens
ucuuaucuuucu

SEQ ID NO: 1613077 - RNA, 20 nt, Homo sapiens
ucuuaugggauuacauguua

SEQ ID NO: 1613078 - RNA, 16 nt, Homo sapiens
ucuuaugugugccuuu

SEQ ID NO: 1613079 - RNA, 20 nt, Homo sapiens
ucuucaagucccaucauaga

SEQ ID NO: 1613080 - RNA, 13 nt, Homo sapiens
ucuucacagucac

SEQ ID NO: 1613081 - RNA, 20 nt, Homo sapiens
ucuaucuaaugacaugccua

SEQ ID NO: 1613082 - RNA, 23 nt, Homo sapiens
ucuaucuugaauuucaugcuuuc

SEQ ID NO: 1613083 - RNA, 18 nt, Homo sapiens
ucuaugaguuggacuuca

SEQ ID NO: 1613084 - RNA, 19 nt, Homo sapiens
ucuaugcuggauaagaaau

SEQ ID NO: 1613085 - RNA, 12 nt, Homo sapiens
ucuauuacauuu

SEQ ID NO: 1613086 - RNA, 13 nt, Homo sapiens
ucuauuaucucaa

SEQ ID NO: 1613087 - RNA, 16 nt, Homo sapiens
ucuauuuaagugcaau

SEQ ID NO: 1613088 - RNA, 17 nt, Homo sapiens
ucuauuuaagugcaauu

SEQ ID NO: 1613089 - RNA, 21 nt, Homo sapiens
ucuauuuacauaaaaugggug

SEQ ID NO: 1613090 - RNA, 16 nt, Homo sapiens
ucuauuuccuccccca

SEQ ID NO: 1613091 - RNA, 19 nt, Homo sapiens
ucuauuucuccuccauggg

SEQ ID NO: 1613092 - RNA, 14 nt, Homo sapiens
ucuauuuguacaau

SEQ ID NO: 1613093 - RNA, 15 nt, Homo sapiens
ucuauuuuauaucug

SEQ ID NO: 1613094 - RNA, 22 nt, Homo sapiens
ucucaaaacaauauuacuuugu

SEQ ID NO: 1613095 - RNA, 19 nt, Homo sapiens
ucucaaacucccgaccuca

SEQ ID NO: 1613096 - RNA, 20 nt, Homo sapiens
ucucaaacucccgaccucag

SEQ ID NO: 1613097 - RNA, 20 nt, Homo sapiens
ucucaaacuccugaccucag

SEQ ID NO: 1613098 - RNA, 21 nt, Homo sapiens
ucucaaagcauaaaauggaau

SEQ ID NO: 1613099 - RNA, 14 nt, Homo sapiens
ucucaacuacucag

SEQ ID NO: 1613100 - RNA, 16 nt, Homo sapiens
ucucaagcuagccaga

SEQ ID NO: 1613101 - RNA, 17 nt, Homo sapiens
ucucaauucaaauccau

SEQ ID NO: 1613102 - RNA, 20 nt, Homo sapiens
ucucaauucaaauccauaga

SEQ ID NO: 1613103 - RNA, 17 nt, Homo sapiens
ucucacaaaaaggcaaa

SEQ ID NO: 1613104 - RNA, 13 nt, Homo sapiens
ucucaccuacgaa

SEQ ID NO: 1613105 - RNA, 12 nt, Homo sapiens
ucucaccugcuc

SEQ ID NO: 1613106 - RNA, 18 nt, Homo sapiens
ucucaccugcucccaguc

SEQ ID NO: 1613107 - RNA, 22 nt, Homo sapiens
ucucacugugggaaggccagcu

SEQ ID NO: 1613108 - RNA, 12 nt, Homo sapiens
ucucacuuugua

SEQ ID NO: 1613109 - RNA, 18 nt, Homo sapiens
ucucacuuuuauugauaa

SEQ ID NO: 1613110 - RNA, 14 nt, Homo sapiens
ucucagaauucuuc

SEQ ID NO: 1613111 - RNA, 13 nt, Homo sapiens
ucucagaugcagu

SEQ ID NO: 1613112 - RNA, 23 nt, Homo sapiens
ucucagauguugaaacuuugaau

SEQ ID NO: 1613113 - RNA, 19 nt, Homo sapiens
ucucagccauaggugcagu

SEQ ID NO: 1613114 - RNA, 12 nt, Homo sapiens
ucucagccucug

SEQ ID NO: 1613115 - RNA, 18 nt, Homo sapiens
ucucagcgagguguaaag

SEQ ID NO: 1613116 - RNA, 19 nt, Homo sapiens
ucucagcguuuugaguuua

SEQ ID NO: 1613117 - RNA, 21 nt, Homo sapiens
ucucaggacagaaccacugag

SEQ ID NO: 1613118 - RNA, 14 nt, Homo sapiens
ucucaggaccaaag

SEQ ID NO: 1613119 - RNA, 20 nt, Homo sapiens
ucucaggaccaaagcuuuca

SEQ ID NO: 1613120 - RNA, 21 nt, Homo sapiens
ucucaguggcuucaucuguca

SEQ ID NO: 1613121 - RNA, 18 nt, Homo sapiens
ucucauagguugagcaau

SEQ ID NO: 1613122 - RNA, 20 nt, Homo sapiens
ucucaugagcuguguucaca

SEQ ID NO: 1613123 - RNA, 15 nt, Homo sapiens
ucucaugcuccuuaa

SEQ ID NO: 1613124 - RNA, 19 nt, Homo sapiens
ucucauggguggcacucag

SEQ ID NO: 1613125 - RNA, 21 nt, Homo sapiens
ucucaugucuccccaguucca

SEQ ID NO: 1613126 - RNA, 14 nt, Homo sapiens
ucucauucauucau

SEQ ID NO: 1613127 - RNA, 13 nt, Homo sapiens
ucucauuccagag

SEQ ID NO: 1613128 - RNA, 17 nt, Homo sapiens
ucucauuugggcaccuu

SEQ ID NO: 1613129 - RNA, 14 nt, Homo sapiens
ucuccacaagggga

SEQ ID NO: 1613130 - RNA, 20 nt, Homo sapiens
ucuccagcaauaauguuuuc

SEQ ID NO: 1613131 - RNA, 22 nt, Homo sapiens
ucuccaggcauuuagcccucac

SEQ ID NO: 1613132 - RNA, 20 nt, Homo sapiens
ucuccagucauuauguuaau

SEQ ID NO: 1613133 - RNA, 20 nt, Homo sapiens
ucuccauguguuugauuucu

SEQ ID NO: 1613134 - RNA, 15 nt, Homo sapiens
ucucccaggucccag

SEQ ID NO: 1613135 - RNA, 12 nt, Homo sapiens
ucuccccagaau

SEQ ID NO: 1613136 - RNA, 14 nt, Homo sapiens
ucucccugccaagu

SEQ ID NO: 1613137 - RNA, 19 nt, Homo sapiens
ucucccuggggcacuuuca

SEQ ID NO: 1613138 - RNA, 13 nt, Homo sapiens
ucuccgacucugc

SEQ ID NO: 1613139 - RNA, 13 nt, Homo sapiens
ucuccuacccuga

SEQ ID NO: 1613140 - RNA, 23 nt, Homo sapiens
ucuccuauuccuucacacaguuc

SEQ ID NO: 1613141 - RNA, 22 nt, Homo sapiens
ucuccucggacugugugcaggu

SEQ ID NO: 1613142 - RNA, 14 nt, Homo sapiens
ucuccucucucuau

SEQ ID NO: 1613143 - RNA, 13 nt, Homo sapiens
ucuccugccugcc

SEQ ID NO: 1613144 - RNA, 21 nt, Homo sapiens
ucuccuuaucuuuauuggcuu

SEQ ID NO: 1613145 - RNA, 23 nt, Homo sapiens
ucuccuucacucugacaguauua

SEQ ID NO: 1613146 - RNA, 14 nt, Homo sapiens
ucucgaacaguauu

SEQ ID NO: 1613147 - RNA, 17 nt, Homo sapiens
ucucgagcccagaugga

SEQ ID NO: 1613148 - RNA, 17 nt, Homo sapiens
ucucgaucucuugaccu

SEQ ID NO: 1613149 - RNA, 16 nt, Homo sapiens
ucucgggugcauuuga

SEQ ID NO: 1613150 - RNA, 18 nt, Homo sapiens
ucucgugguaggacugua

SEQ ID NO: 1613151 - RNA, 18 nt, Homo sapiens
ucucuaaaaacauagaaa

SEQ ID NO: 1613152 - RNA, 20 nt, Homo sapiens
ucucuaacauaugauacuga

SEQ ID NO: 1613153 - RNA, 16 nt, Homo sapiens
ucucuacugaauguca

SEQ ID NO: 1613154 - RNA, 14 nt, Homo sapiens
ucucuacugaucaa

SEQ ID NO: 1613155 - RNA, 21 nt, Homo sapiens
ucucuaggccuucaggacucu

SEQ ID NO: 1613156 - RNA, 22 nt, Homo sapiens
ucucuauauucggaauguaacu

SEQ ID NO: 1613157 - RNA, 15 nt, Homo sapiens
ucucuauauugcuua

SEQ ID NO: 1613158 - RNA, 19 nt, Homo sapiens
ucucucaucucuuagcucc

SEQ ID NO: 1613159 - RNA, 13 nt, Homo sapiens
ucucucaugacca

SEQ ID NO: 1613160 - RNA, 17 nt, Homo sapiens
ucucuccagcugacuaa

SEQ ID NO: 1613161 - RNA, 23 nt, Homo sapiens
ucucucccaggucccagccccuu

SEQ ID NO: 1613162 - RNA, 19 nt, Homo sapiens
ucucuccccagaugugacu

SEQ ID NO: 1613163 - RNA, 13 nt, Homo sapiens
ucucucuguuaca

SEQ ID NO: 1613164 - RNA, 16 nt, Homo sapiens
ucucucuucucuccag

SEQ ID NO: 1613165 - RNA, 13 nt, Homo sapiens
ucucugaaagugu

SEQ ID NO: 1613166 - RNA, 14 nt, Homo sapiens
ucucugagcaguga

SEQ ID NO: 1613167 - RNA, 22 nt, Homo sapiens
uagcugacggcuggguguuuca

SEQ ID NO: 1613168 - RNA, 13 nt, Homo sapiens
uagcugacuugca

SEQ ID NO: 1613169 - RNA, 20 nt, Homo sapiens
uagcugagaagcaauggguc

SEQ ID NO: 1613170 - RNA, 12 nt, Homo sapiens
uagcugucacau

SEQ ID NO: 1613171 - RNA, 17 nt, Homo sapiens
uaggaaagaugagaaau

SEQ ID NO: 1613172 - RNA, 21 nt, Homo sapiens
uaggaacugcugggcuuggca

SEQ ID NO: 1613173 - RNA, 14 nt, Homo sapiens
uaggaaggauuuuc

SEQ ID NO: 1613174 - RNA, 21 nt, Homo sapiens
uaggaaggcagcauuccauga

SEQ ID NO: 1613175 - RNA, 19 nt, Homo sapiens
uaggaaggugaaucugccc

SEQ ID NO: 1613176 - RNA, 16 nt, Homo sapiens
uaggaauaaauaaaaa

SEQ ID NO: 1613177 - RNA, 24 nt, Homo sapiens
uaggaaucccagaggugggauccu

SEQ ID NO: 1613178 - RNA, 15 nt, Homo sapiens
uaggacagcaaagca

SEQ ID NO: 1613179 - RNA, 22 nt, Homo sapiens
uaggacagcauauaaauguaau

SEQ ID NO: 1613180 - RNA, 18 nt, Homo sapiens
uaggagcagaaaugcaag

SEQ ID NO: 1613181 - RNA, 23 nt, Homo sapiens
uaggagccugcuggucacagccu

SEQ ID NO: 1613182 - RNA, 23 nt, Homo sapiens
uaggauaacuggcacccagagaa

SEQ ID NO: 1613183 - RNA, 18 nt, Homo sapiens
uaggcagaucaagguuua

SEQ ID NO: 1613184 - RNA, 19 nt, Homo sapiens
uaggcagcaagcuuugguu

SEQ ID NO: 1613185 - RNA, 12 nt, Homo sapiens
uaggcauguaaa

SEQ ID NO: 1613186 - RNA, 20 nt, Homo sapiens
uaggccaggcacaguggcuc

SEQ ID NO: 1613187 - RNA, 22 nt, Homo sapiens
uaggccugaaaugacauuucac

SEQ ID NO: 1613188 - RNA, 15 nt, Homo sapiens
uaggcuagagacaga

SEQ ID NO: 1613189 - RNA, 21 nt, Homo sapiens
uaggcucuuaugugugccuuu

SEQ ID NO: 1613190 - RNA, 20 nt, Homo sapiens
uagggacagucaaaaccaag

SEQ ID NO: 1613191 - RNA, 22 nt, Homo sapiens
uagggacaugaaauuuacaaag

SEQ ID NO: 1613192 - RNA, 21 nt, Homo sapiens
uagggacugccaggcuguuuc

SEQ ID NO: 1613193 - RNA, 17 nt, Homo sapiens
uagggcuuuugauuuau

SEQ ID NO: 1613194 - RNA, 22 nt, Homo sapiens
uagggguuaacuuggucagagc

SEQ ID NO: 1613195 - RNA, 19 nt, Homo sapiens
uagggucacuuugccauua

SEQ ID NO: 1613196 - RNA, 16 nt, Homo sapiens
uaggguggcccuugca

SEQ ID NO: 1613197 - RNA, 16 nt, Homo sapiens
uaggucuccucagggu

SEQ ID NO: 1613198 - RNA, 15 nt, Homo sapiens
uaggugcaguuugcu

SEQ ID NO: 1613199 - RNA, 16 nt, Homo sapiens
uagguuuuuaaagacu

SEQ ID NO: 1613200 - RNA, 12 nt, Homo sapiens
uaguaacaugug

SEQ ID NO: 1613201 - RNA, 17 nt, Homo sapiens
uaguaacuauaagauac

SEQ ID NO: 1613202 - RNA, 13 nt, Homo sapiens
uaguaaguaauau

SEQ ID NO: 1613203 - RNA, 20 nt, Homo sapiens
uaguaaguaauaucaaagca

SEQ ID NO: 1613204 - RNA, 21 nt, Homo sapiens
uaguaauguuuuauacuguuu

SEQ ID NO: 1613205 - RNA, 13 nt, Homo sapiens
uaguacaauagua

SEQ ID NO: 1613206 - RNA, 14 nt, Homo sapiens
uaguacuaagcuua

SEQ ID NO: 1613207 - RNA, 20 nt, Homo sapiens
uaguacuuauguugcacaau

SEQ ID NO: 1613208 - RNA, 20 nt, Homo sapiens
uaguagaaagacaucugccu

SEQ ID NO: 1613209 - RNA, 14 nt, Homo sapiens
uaguagacacacua

SEQ ID NO: 1613210 - RNA, 20 nt, Homo sapiens
uaguauggccugacagcucu

SEQ ID NO: 1613211 - RNA, 15 nt, Homo sapiens
uaguauuaacuauua

SEQ ID NO: 1613212 - RNA, 21 nt, Homo sapiens
uaguauucuugagggacaaug

SEQ ID NO: 1613213 - RNA, 20 nt, Homo sapiens
uagucaagugcguccacgag

SEQ ID NO: 1613214 - RNA, 19 nt, Homo sapiens
uagucaauaacuaaacuaa

SEQ ID NO: 1613215 - RNA, 20 nt, Homo sapiens
uagucaauuucuacuucugg

SEQ ID NO: 1613216 - RNA, 16 nt, Homo sapiens
uagucauuaacccauc

SEQ ID NO: 1613217 - RNA, 15 nt, Homo sapiens
uagucccagcuacuu

SEQ ID NO: 1613218 - RNA, 22 nt, Homo sapiens
uaguccucacuucuagaucuca

SEQ ID NO: 1613219 - RNA, 22 nt, Homo sapiens
uagucuuggaagcuguuuggaa

SEQ ID NO: 1613220 - RNA, 19 nt, Homo sapiens
uagucuuuuguaauaucaa

SEQ ID NO: 1613221 - RNA, 14 nt, Homo sapiens
uagugaaacaugua

SEQ ID NO: 1613222 - RNA, 20 nt, Homo sapiens
uagugaaacauguacuuuga

SEQ ID NO: 1613223 - RNA, 14 nt, Homo sapiens
uagugcaacuuaga

SEQ ID NO: 1613224 - RNA, 14 nt, Homo sapiens
uagugcaucagaug

SEQ ID NO: 1613225 - RNA, 22 nt, Homo sapiens
uagugccacccaccuuugccac

SEQ ID NO: 1613226 - RNA, 21 nt, Homo sapiens
uaguggcaaaugaaagcauaa

SEQ ID NO: 1613227 - RNA, 22 nt, Homo sapiens
uaguggcauaccaaauggcacu

SEQ ID NO: 1613228 - RNA, 14 nt, Homo sapiens
uagugucauccuca

SEQ ID NO: 1613229 - RNA, 20 nt, Homo sapiens
uagugucauccucacaguga

SEQ ID NO: 1613230 - RNA, 21 nt, Homo sapiens
uagugugaaauauauuacuua

SEQ ID NO: 1613231 - RNA, 12 nt, Homo sapiens
uagugugaauua

SEQ ID NO: 1613232 - RNA, 18 nt, Homo sapiens
uaguguuuggacagcuga

SEQ ID NO: 1613233 - RNA, 19 nt, Homo sapiens
uaguucaaucuggauucau

SEQ ID NO: 1613234 - RNA, 22 nt, Homo sapiens
uaguuccccaaauacaaaguua

SEQ ID NO: 1613235 - RNA, 22 nt, Homo sapiens
uaguucccugaaaacccagaga

SEQ ID NO: 1613236 - RNA, 14 nt, Homo sapiens
uaguucuacauuau

SEQ ID NO: 1613237 - RNA, 13 nt, Homo sapiens
uaguucugccagg

SEQ ID NO: 1613238 - RNA, 22 nt, Homo sapiens
uaguuucccuacugaacccugc

SEQ ID NO: 1613239 - RNA, 18 nt, Homo sapiens
uaguuucuugaggccaaa

SEQ ID NO: 1613240 - RNA, 15 nt, Homo sapiens
uaguuuuacuuuuaa

SEQ ID NO: 1613241 - RNA, 19 nt, Homo sapiens
uaguuuuagcuguagauca

SEQ ID NO: 1613242 - RNA, 15 nt, Homo sapiens
uaguuuucagccuug

SEQ ID NO: 1613243 - RNA, 14 nt, Homo sapiens
uaguuuucauuuua

SEQ ID NO: 1613244 - RNA, 20 nt, Homo sapiens
uaguuuuuccuaucauguua

SEQ ID NO: 1613245 - RNA, 14 nt, Homo sapiens
uauaaaaaacacua

SEQ ID NO: 1613246 - RNA, 20 nt, Homo sapiens
uauaaaaauauuaagacaau

SEQ ID NO: 1613247 - RNA, 16 nt, Homo sapiens
uauaaaagacugacca

SEQ ID NO: 1613248 - RNA, 20 nt, Homo sapiens
uauaaaauagacuuacugca

SEQ ID NO: 1613249 - RNA, 21 nt, Homo sapiens
uauaaacaaaagaaucuucca

SEQ ID NO: 1613250 - RNA, 20 nt, Homo sapiens
uauaaacaggagacagguca

SEQ ID NO: 1613251 - RNA, 12 nt, Homo sapiens
uauaaaccugga

SEQ ID NO: 1613252 - RNA, 12 nt, Homo sapiens
uauaaagcagua

SEQ ID NO: 1613253 - RNA, 22 nt, Homo sapiens
uauaaagcauguggucuuauag

SEQ ID NO: 1613254 - RNA, 19 nt, Homo sapiens
uacugucuucuucauguca

SEQ ID NO: 1613255 - RNA, 20 nt, Homo sapiens
uacugugucauaaacagaug

SEQ ID NO: 1613256 - RNA, 16 nt, Homo sapiens
uacuguuuacaguuua

SEQ ID NO: 1613257 - RNA, 20 nt, Homo sapiens
uacuuaaaaauagucuucca

SEQ ID NO: 1613258 - RNA, 18 nt, Homo sapiens
uacuuaacauuucauugu

SEQ ID NO: 1613259 - RNA, 14 nt, Homo sapiens
uacuuaagugcugc

SEQ ID NO: 1613260 - RNA, 14 nt, Homo sapiens
uacuuaguucaagc

SEQ ID NO: 1613261 - RNA, 18 nt, Homo sapiens
uacuuauagaauucaguc

SEQ ID NO: 1613262 - RNA, 21 nt, Homo sapiens
uacuuaucucucaaaacaaua

SEQ ID NO: 1613263 - RNA, 15 nt, Homo sapiens
uacuuaucuuaugcc

SEQ ID NO: 1613264 - RNA, 21 nt, Homo sapiens
uacuuauguugcacaaugaga

SEQ ID NO: 1613265 - RNA, 13 nt, Homo sapiens
uacuucaguauua

SEQ ID NO: 1613266 - RNA, 23 nt, Homo sapiens
uacuuccaggauggaugcaucac

SEQ ID NO: 1613267 - RNA, 20 nt, Homo sapiens
uacuuccucugugaacugug

SEQ ID NO: 1613268 - RNA, 21 nt, Homo sapiens
uacuucuucauccauagacac

SEQ ID NO: 1613269 - RNA, 22 nt, Homo sapiens
uacuugaagauuaauguaggau

SEQ ID NO: 1613270 - RNA, 12 nt, Homo sapiens
uacuugucauau

SEQ ID NO: 1613271 - RNA, 18 nt, Homo sapiens
uacuuuaauauaaaccca

SEQ ID NO: 1613272 - RNA, 14 nt, Homo sapiens
uacuuuacaaacca

SEQ ID NO: 1613273 - RNA, 20 nt, Homo sapiens
uacuuuauuucugaucuaua

SEQ ID NO: 1613274 - RNA, 17 nt, Homo sapiens
uacuuugguagcuggga

SEQ ID NO: 1613275 - RNA, 20 nt, Homo sapiens
uacuuugugaauagaacucu

SEQ ID NO: 1613276 - RNA, 18 nt, Homo sapiens
uacuuuuuccauuuggca

SEQ ID NO: 1613277 - RNA, 19 nt, Homo sapiens
uagaaaaaaaaauucacau

SEQ ID NO: 1613278 - RNA, 21 nt, Homo sapiens
uagaaaaaaaaauucacauga

SEQ ID NO: 1613279 - RNA, 20 nt, Homo sapiens
uagaaaaagaacaugcaguu

SEQ ID NO: 1613280 - RNA, 20 nt, Homo sapiens
uagaaaaggccaauauaccu

SEQ ID NO: 1613281 - RNA, 17 nt, Homo sapiens
uagaaaauauaaguaaa

SEQ ID NO: 1613282 - RNA, 18 nt, Homo sapiens
uagaaaauuagacuguga

SEQ ID NO: 1613283 - RNA, 14 nt, Homo sapiens
uagaaacacugcaa

SEQ ID NO: 1613284 - RNA, 12 nt, Homo sapiens
uagaaaccugaa

SEQ ID NO: 1613285 - RNA, 19 nt, Homo sapiens
uagaaagcugacauugcca

SEQ ID NO: 1613286 - RNA, 15 nt, Homo sapiens
uagaaagggugcugc

SEQ ID NO: 1613287 - RNA, 13 nt, Homo sapiens
uagaaaguggaaa

SEQ ID NO: 1613288 - RNA, 18 nt, Homo sapiens
uagaaauauugacucaaa

SEQ ID NO: 1613289 - RNA, 11 nt, Homo sapiens
uagaaaugcaa

SEQ ID NO: 1613290 - RNA, 13 nt, Homo sapiens
uagaaaugcaaaa

SEQ ID NO: 1613291 - RNA, 19 nt, Homo sapiens
uagaaauugggcagucuua

SEQ ID NO: 1613292 - RNA, 22 nt, Homo sapiens
uagaaccucaaacaggauggaa

SEQ ID NO: 1613293 - RNA, 11 nt, Homo sapiens
uagaaccugga

SEQ ID NO: 1613294 - RNA, 15 nt, Homo sapiens
uagaagaagcccaua

SEQ ID NO: 1613295 - RNA, 14 nt, Homo sapiens
uagaagauggcacu

SEQ ID NO: 1613296 - RNA, 20 nt, Homo sapiens
uagaagauguguaaacaggu

SEQ ID NO: 1613297 - RNA, 11 nt, Homo sapiens
uagaagccaag

SEQ ID NO: 1613298 - RNA, 14 nt, Homo sapiens
uagaagccaaggga

SEQ ID NO: 1613299 - RNA, 20 nt, Homo sapiens
uagaagccaagggaaagggg

SEQ ID NO: 1613300 - RNA, 21 nt, Homo sapiens
uagaagccacuauuacuggga

SEQ ID NO: 1613301 - RNA, 16 nt, Homo sapiens
uagaagugcauucucc

SEQ ID NO: 1613302 - RNA, 20 nt, Homo sapiens
uagaagugguuuccugauaa

SEQ ID NO: 1613303 - RNA, 17 nt, Homo sapiens
uagaauauccaugaccu

SEQ ID NO: 1613304 - RNA, 14 nt, Homo sapiens
uagaaucucuucau

SEQ ID NO: 1613305 - RNA, 14 nt, Homo sapiens
uagaaugagacuua

SEQ ID NO: 1613306 - RNA, 12 nt, Homo sapiens
uagaaugccaua

SEQ ID NO: 1613307 - RNA, 23 nt, Homo sapiens
uagaauggaggaagaacaacaaa

SEQ ID NO: 1613308 - RNA, 14 nt, Homo sapiens
uagaauucagucaa

SEQ ID NO: 1613309 - RNA, 12 nt, Homo sapiens
uagaauucugaa

SEQ ID NO: 1613310 - RNA, 23 nt, Homo sapiens
uagaauuuuuugagagaaugaga

SEQ ID NO: 1613311 - RNA, 22 nt, Homo sapiens
uagacaaaugaacaagcaauua

SEQ ID NO: 1613312 - RNA, 14 nt, Homo sapiens
uagacacaguauug

SEQ ID NO: 1613313 - RNA, 12 nt, Homo sapiens
uagacacaugaa

SEQ ID NO: 1613314 - RNA, 21 nt, Homo sapiens
uagacccugcauuuauagcau

SEQ ID NO: 1613315 - RNA, 17 nt, Homo sapiens
uagacgagacaguccau

SEQ ID NO: 1613316 - RNA, 14 nt, Homo sapiens
uagacuaaggccau

SEQ ID NO: 1613317 - RNA, 21 nt, Homo sapiens
uagacuaccggacacucguca

SEQ ID NO: 1613318 - RNA, 14 nt, Homo sapiens
uagacuagcaaucu

SEQ ID NO: 1613319 - RNA, 19 nt, Homo sapiens
uagacucacagccguccaa

SEQ ID NO: 1613320 - RNA, 20 nt, Homo sapiens
uagacuguuucacauugcac

SEQ ID NO: 1613321 - RNA, 22 nt, Homo sapiens
uagacuuggacccaaaaaauca

SEQ ID NO: 1613322 - RNA, 23 nt, Homo sapiens
uagagacaggacagaauguguuc

SEQ ID NO: 1613323 - RNA, 19 nt, Homo sapiens
uagagagucuccaagagaa

SEQ ID NO: 1613324 - RNA, 16 nt, Homo sapiens
uagagaugggguuuca

SEQ ID NO: 1613325 - RNA, 13 nt, Homo sapiens
uagagcagacagg

SEQ ID NO: 1613326 - RNA, 22 nt, Homo sapiens
uagagccaggcacacacugugc

SEQ ID NO: 1613327 - RNA, 15 nt, Homo sapiens
uagagcuagaugugu

SEQ ID NO: 1613328 - RNA, 14 nt, Homo sapiens
uagagcugccugug

SEQ ID NO: 1613329 - RNA, 20 nt, Homo sapiens
uagaggauuaguaagaucuc

SEQ ID NO: 1613330 - RNA, 18 nt, Homo sapiens
uagagucauguuugcacu

SEQ ID NO: 1613331 - RNA, 18 nt, Homo sapiens
uagagucuuaaagcauuu

SEQ ID NO: 1613332 - RNA, 13 nt, Homo sapiens
uagauaaucuugu

SEQ ID NO: 1613333 - RNA, 17 nt, Homo sapiens
uagauaaucuugugcaa

SEQ ID NO: 1613334 - RNA, 17 nt, Homo sapiens
uagauaucaauguuaau

SEQ ID NO: 1613335 - RNA, 12 nt, Homo sapiens
uagaugacaaau

SEQ ID NO: 1613336 - RNA, 21 nt, Homo sapiens
uagauggggagccucgggaaa

SEQ ID NO: 1613337 - RNA, 16 nt, Homo sapiens
uagaugguuugagccu

SEQ ID NO: 1613338 - RNA, 20 nt, Homo sapiens
uagaugugucuuaccagauc

SEQ ID NO: 1613339 - RNA, 13 nt, Homo sapiens
uagauucaccugu

SEQ ID NO: 1613340 - RNA, 19 nt, Homo sapiens
uagauucagguaauacaaa

SEQ ID NO: 1613341 - RNA, 20 nt, Homo sapiens
uagauuucgaagccacagag

SEQ ID NO: 1613342 - RNA, 21 nt, Homo sapiens
gaaaccuggucucuacauaaa

SEQ ID NO: 1613343 - RNA, 18 nt, Homo sapiens
gaaacggaggccagagag

SEQ ID NO: 1613344 - RNA, 21 nt, Homo sapiens
gaaacgucuucuaaacuuccc

SEQ ID NO: 1613345 - RNA, 17 nt, Homo sapiens
gaaacuaagagcucuca

SEQ ID NO: 1613346 - RNA, 20 nt, Homo sapiens
gaaacuaucucaugccagug

SEQ ID NO: 1613347 - RNA, 23 nt, Homo sapiens
gaaacucagauuuaaccuguuau

SEQ ID NO: 1613348 - RNA, 11 nt, Homo sapiens
gaaacugaguc

SEQ ID NO: 1613349 - RNA, 18 nt, Homo sapiens
gaaacugggaaacugggu

SEQ ID NO: 1613350 - RNA, 13 nt, Homo sapiens
gaaacuguccaaa

SEQ ID NO: 1613351 - RNA, 19 nt, Homo sapiens
gaaagaaauuuggcuauaa

SEQ ID NO: 1613352 - RNA, 23 nt, Homo sapiens
gaaagaaguguggggauuuucac

SEQ ID NO: 1613353 - RNA, 18 nt, Homo sapiens
gaaagaaguuauuuucca

SEQ ID NO: 1613354 - RNA, 13 nt, Homo sapiens
gaaagaaugcauu

SEQ ID NO: 1613355 - RNA, 20 nt, Homo sapiens
gaaagaccaggccaauguca

SEQ ID NO: 1613356 - RNA, 23 nt, Homo sapiens
gaaagacgccuucaucugggaca

SEQ ID NO: 1613357 - RNA, 15 nt, Homo sapiens
gaaagacugaagaaa

SEQ ID NO: 1613358 - RNA, 18 nt, Homo sapiens
gaaagagacuccgucuca

SEQ ID NO: 1613359 - RNA, 19 nt, Homo sapiens
gaaagagagcaccacguga

SEQ ID NO: 1613360 - RNA, 20 nt, Homo sapiens
gacaaaaugacuggcuccug

SEQ ID NO: 1613361 - RNA, 20 nt, Homo sapiens
gacaaaggccuuaacaaacg

SEQ ID NO: 1613362 - RNA, 20 nt, Homo sapiens
gacaaagucaacuuccacau

SEQ ID NO: 1613363 - RNA, 17 nt, Homo sapiens
gacaaauuuugcauauu

SEQ ID NO: 1613364 - RNA, 14 nt, Homo sapiens
gacaacaccuuccu

SEQ ID NO: 1613365 - RNA, 12 nt, Homo sapiens
gacaacacuuaa

SEQ ID NO: 1613366 - RNA, 18 nt, Homo sapiens
gacaacauuucuauagcc

SEQ ID NO: 1613367 - RNA, 14 nt, Homo sapiens
gacaaccaccaggu

SEQ ID NO: 1613368 - RNA, 15 nt, Homo sapiens
gacaaccagacucug

SEQ ID NO: 1613369 - RNA, 22 nt, Homo sapiens
gacaacccuguccucaggccug

SEQ ID NO: 1613370 - RNA, 15 nt, Homo sapiens
gacaaccucauuuua

SEQ ID NO: 1613371 - RNA, 22 nt, Homo sapiens
gacaagagaugggaaugaggug

SEQ ID NO: 1613372 - RNA, 18 nt, Homo sapiens
gacaagcgccgcugugag

SEQ ID NO: 1613373 - RNA, 20 nt, Homo sapiens
gacaaguuuuguuuccucau

SEQ ID NO: 1613374 - RNA, 16 nt, Homo sapiens
gacaauaaacccucag

SEQ ID NO: 1613375 - RNA, 17 nt, Homo sapiens
gacaauaguauuucucc

SEQ ID NO: 1613376 - RNA, 13 nt, Homo sapiens
gacaauaugugcc

SEQ ID NO: 1613377 - RNA, 13 nt, Homo sapiens
gacaaucaucucc

SEQ ID NO: 1613378 - RNA, 15 nt, Homo sapiens
gacaauccuugagaa

SEQ ID NO: 1613379 - RNA, 14 nt, Homo sapiens
gacaaugaagggaa

SEQ ID NO: 1613380 - RNA, 12 nt, Homo sapiens
gacacacuguua

SEQ ID NO: 1613381 - RNA, 17 nt, Homo sapiens
gacacagaagccuuuga

SEQ ID NO: 1613382 - RNA, 20 nt, Homo sapiens
gacacauucaggaguuaaau

SEQ ID NO: 1613383 - RNA, 12 nt, Homo sapiens
gacacauuggac

SEQ ID NO: 1613384 - RNA, 15 nt, Homo sapiens
gacaccaccaaggcu

SEQ ID NO: 1613385 - RNA, 18 nt, Homo sapiens
gacacccaugccagagag

SEQ ID NO: 1613386 - RNA, 23 nt, Homo sapiens
gacacccucccuccaggguccuc

SEQ ID NO: 1613387 - RNA, 22 nt, Homo sapiens
gacacucuauaagauuccaaaa

SEQ ID NO: 1613388 - RNA, 19 nt, Homo sapiens
gacacuggcguuacugcuu

SEQ ID NO: 1613389 - RNA, 12 nt, Homo sapiens
gacacugucucu

SEQ ID NO: 1613390 - RNA, 20 nt, Homo sapiens
gacacuuaauacuaccuuga

SEQ ID NO: 1613391 - RNA, 22 nt, Homo sapiens
gacacuuaauacuaccuugaaa

SEQ ID NO: 1613392 - RNA, 17 nt, Homo sapiens
gacacuuuaauuaccaa

SEQ ID NO: 1613393 - RNA, 15 nt, Homo sapiens
gacagaaccacugag

SEQ ID NO: 1613394 - RNA, 16 nt, Homo sapiens
gacagagggcacauga

SEQ ID NO: 1613395 - RNA, 16 nt, Homo sapiens
gacagagggcucaccu

SEQ ID NO: 1613396 - RNA, 22 nt, Homo sapiens
gacagagggcucaccucuugcc

SEQ ID NO: 1613397 - RNA, 18 nt, Homo sapiens
gacagaugccuggugagc

SEQ ID NO: 1613398 - RNA, 21 nt, Homo sapiens
gacagcacugggaaccuagcu

SEQ ID NO: 1613399 - RNA, 20 nt, Homo sapiens
gacagcauauaaauguaaua

SEQ ID NO: 1613400 - RNA, 11 nt, Homo sapiens
gacagcccuuc

SEQ ID NO: 1613401 - RNA, 20 nt, Homo sapiens
gacagcuccuggaccaggcc

SEQ ID NO: 1613402 - RNA, 13 nt, Homo sapiens
gacagcuugagaa

SEQ ID NO: 1613403 - RNA, 14 nt, Homo sapiens
gacaggagcacugc

SEQ ID NO: 1613404 - RNA, 18 nt, Homo sapiens
gacaggauaagagggauu

SEQ ID NO: 1613405 - RNA, 16 nt, Homo sapiens
gacaguaaacacucca

SEQ ID NO: 1613406 - RNA, 15 nt, Homo sapiens
gacaguauccacaau

SEQ ID NO: 1613407 - RNA, 20 nt, Homo sapiens
gacagucauaaauacuguca

SEQ ID NO: 1613408 - RNA, 16 nt, Homo sapiens
gacagucucacucugu

SEQ ID NO: 1613409 - RNA, 21 nt, Homo sapiens
gacagugaagcagcacuguga

SEQ ID NO: 1613410 - RNA, 21 nt, Homo sapiens
gacagugcccuuggugcgagg

SEQ ID NO: 1613411 - RNA, 16 nt, Homo sapiens
gacagugcugcagcuc

SEQ ID NO: 1613412 - RNA, 22 nt, Homo sapiens
gacaguuuugcuuuaguacaau

SEQ ID NO: 1613413 - RNA, 14 nt, Homo sapiens
gacauaacagugca

SEQ ID NO: 1613414 - RNA, 21 nt, Homo sapiens
gacauacuagaguugauuaua

SEQ ID NO: 1613415 - RNA, 17 nt, Homo sapiens
gacauacuuaaugcaua

SEQ ID NO: 1613416 - RNA, 20 nt, Homo sapiens
gacauagaauuaacacauga

SEQ ID NO: 1613417 - RNA, 23 nt, Homo sapiens
gacauccucugcuaccaucucau

SEQ ID NO: 1613418 - RNA, 11 nt, Homo sapiens
gacaucugccu

SEQ ID NO: 1613419 - RNA, 16 nt, Homo sapiens
gacaugauuuccuuga

SEQ ID NO: 1613420 - RNA, 18 nt, Homo sapiens
gacaugauuuccuugaau

SEQ ID NO: 1613421 - RNA, 15 nt, Homo sapiens
gacauggaaagggag

SEQ ID NO: 1613422 - RNA, 15 nt, Homo sapiens
gacauggagauguaa

SEQ ID NO: 1613423 - RNA, 14 nt, Homo sapiens
gacauggugccuua

SEQ ID NO: 1613424 - RNA, 15 nt, Homo sapiens
gacauucacugagug

SEQ ID NO: 1613425 - RNA, 18 nt, Homo sapiens
gacauucacugagugccu

SEQ ID NO: 1613426 - RNA, 13 nt, Homo sapiens
gacauugaacuga

SEQ ID NO: 1613427 - RNA, 23 nt, Homo sapiens
gacauuucuaucuugaauuucau

SEQ ID NO: 1613428 - RNA, 23 nt, Homo sapiens
gacauuucucuaacuccugccau

SEQ ID NO: 1613429 - RNA, 23 nt, Homo sapiens
gaccaaacuggauagaaccacca

SEQ ID NO: 1613430 - RNA, 17 nt, Homo sapiens
gaccaaagagcccucaa

SEQ ID NO: 1613431 - RNA, 13 nt, Homo sapiens
gaccaccggguga

SEQ ID NO: 1613432 - RNA, 22 nt, Homo sapiens
gaccacugaagcaccacaggga

SEQ ID NO: 1613433 - RNA, 18 nt, Homo sapiens
gaccacugcuggaccaag

SEQ ID NO: 1613434 - RNA, 17 nt, Homo sapiens
gaccacuuccaggggaa

SEQ ID NO: 1613435 - RNA, 23 nt, Homo sapiens
gaccacuuccaggggaaccugcc

SEQ ID NO: 1613436 - RNA, 15 nt, Homo sapiens
gaccagaagccuugg

SEQ ID NO: 1613437 - RNA, 16 nt, Homo sapiens
gaccagaaguguuuca

SEQ ID NO: 1613438 - RNA, 21 nt, Homo sapiens
gaccagaggagcagaccagca

SEQ ID NO: 1613439 - RNA, 14 nt, Homo sapiens
gaccagcacuucaa

SEQ ID NO: 1613440 - RNA, 22 nt, Homo sapiens
gaccaggccaagacucaagccu

SEQ ID NO: 1613441 - RNA, 16 nt, Homo sapiens
gaccaguaggacucaa

SEQ ID NO: 1613442 - RNA, 16 nt, Homo sapiens
gaccauaguauaauca

SEQ ID NO: 1613443 - RNA, 22 nt, Homo sapiens
gaccauuuuuacauccaugaaa

SEQ ID NO: 1613444 - RNA, 15 nt, Homo sapiens
gacccaaaaggcaga

SEQ ID NO: 1613445 - RNA, 17 nt, Homo sapiens
gacccaagggaguguca

SEQ ID NO: 1613446 - RNA, 16 nt, Homo sapiens
gacccacaaggccagg

SEQ ID NO: 1613447 - RNA, 14 nt, Homo sapiens
gacccaccccaacu

SEQ ID NO: 1613448 - RNA, 23 nt, Homo sapiens
gacccaggaaaggcaggauugaa

SEQ ID NO: 1613449 - RNA, 14 nt, Homo sapiens
gacccagggccuga

SEQ ID NO: 1613450 - RNA, 14 nt, Homo sapiens
gacccaugugcaag

SEQ ID NO: 1613451 - RNA, 19 nt, Homo sapiens
gaccccagaggauugcugc

SEQ ID NO: 1613452 - RNA, 19 nt, Homo sapiens
gacccccaucucuacaaaa

SEQ ID NO: 1613453 - RNA, 16 nt, Homo sapiens
gacccccccccaacuc

SEQ ID NO: 1613454 - RNA, 16 nt, Homo sapiens
gaccccuaaugcugca

SEQ ID NO: 1613455 - RNA, 13 nt, Homo sapiens
gaccccucuaccu

SEQ ID NO: 1613456 - RNA, 16 nt, Homo sapiens
gacccuccccuaguca

SEQ ID NO: 1613457 - RNA, 23 nt, Homo sapiens
gacccucgggccccauccucauc

SEQ ID NO: 1613458 - RNA, 22 nt, Homo sapiens
gacccuucagguguuacuagaa

SEQ ID NO: 1613459 - RNA, 18 nt, Homo sapiens
gacccuugauuuugcccc

SEQ ID NO: 1613460 - RNA, 17 nt, Homo sapiens
gaccuaugagcacauag

SEQ ID NO: 1613461 - RNA, 19 nt, Homo sapiens
aaaauguugagaaucccaa

SEQ ID NO: 1613462 - RNA, 23 nt, Homo sapiens
aaaauguuuaaauucucuuucac

SEQ ID NO: 1613463 - RNA, 19 nt, Homo sapiens
aaaauguuucuacagauau

SEQ ID NO: 1613464 - RNA, 15 nt, Homo sapiens
aaaauguuugagcac

SEQ ID NO: 1613465 - RNA, 16 nt, Homo sapiens
aaaauuaaaauggaug

SEQ ID NO: 1613466 - RNA, 17 nt, Homo sapiens
aaaauuauguguugcca

SEQ ID NO: 1613467 - RNA, 13 nt, Homo sapiens
aaaauucaaagca

SEQ ID NO: 1613468 - RNA, 13 nt, Homo sapiens
aaaauucauuucu

SEQ ID NO: 1613469 - RNA, 14 nt, Homo sapiens
aaaauucauuugcu

SEQ ID NO: 1613470 - RNA, 18 nt, Homo sapiens
aaaauucccuaaagacua

SEQ ID NO: 1613471 - RNA, 17 nt, Homo sapiens
aaaauucuuaaguaugu

SEQ ID NO: 1613472 - RNA, 15 nt, Homo sapiens
aaaauugacaaugau

SEQ ID NO: 1613473 - RNA, 21 nt, Homo sapiens
aaaauugcaguuucauguaug

SEQ ID NO: 1613474 - RNA, 11 nt, Homo sapiens
aaaauugcucu

SEQ ID NO: 1613475 - RNA, 14 nt, Homo sapiens
aaaauugucuuucc

SEQ ID NO: 1613476 - RNA, 21 nt, Homo sapiens
aaaauuuaaaguaucuugcac

SEQ ID NO: 1613477 - RNA, 21 nt, Homo sapiens
aaaauuuuguaaauaugcaaa

SEQ ID NO: 1613478 - RNA, 21 nt, Homo sapiens
aaaauuuugugacauuccuuc

SEQ ID NO: 1613479 - RNA, 11 nt, Homo sapiens
aaacaaaaaua

SEQ ID NO: 1613480 - RNA, 18 nt, Homo sapiens
aaacaaaaaucuguguaa

SEQ ID NO: 1613481 - RNA, 16 nt, Homo sapiens
aaacaaaacaaaaacc

SEQ ID NO: 1613482 - RNA, 19 nt, Homo sapiens
aaacaaaaccaacucagac

SEQ ID NO: 1613483 - RNA, 13 nt, Homo sapiens
aaacaaaccuugc

SEQ ID NO: 1613484 - RNA, 23 nt, Homo sapiens
aaacaaguauauaauuuacuuug

SEQ ID NO: 1613485 - RNA, 23 nt, Homo sapiens
aaacaaucuuucaugucuuguca

SEQ ID NO: 1613486 - RNA, 12 nt, Homo sapiens
aaacaaugcaga

SEQ ID NO: 1613487 - RNA, 23 nt, Homo sapiens
aaacacagcugcuuucuucuuac

SEQ ID NO: 1613488 - RNA, 22 nt, Homo sapiens
aaacaccagccgaggccacaga

SEQ ID NO: 1613489 - RNA, 16 nt, Homo sapiens
aaacacccaugcuauc

SEQ ID NO: 1613490 - RNA, 18 nt, Homo sapiens
aaacacccuucagcaaug

SEQ ID NO: 1613491 - RNA, 20 nt, Homo sapiens
aaacacccuuucaucucaga

SEQ ID NO: 1613492 - RNA, 12 nt, Homo sapiens
aaacacugugua

SEQ ID NO: 1613493 - RNA, 14 nt, Homo sapiens
aaacagaguauguc

SEQ ID NO: 1613494 - RNA, 19 nt, Homo sapiens
aaacagcagcagcaaacaa

SEQ ID NO: 1613495 - RNA, 22 nt, Homo sapiens
aaacagccucucucuuuucuac

SEQ ID NO: 1613496 - RNA, 16 nt, Homo sapiens
aaacagggacaaagaa

SEQ ID NO: 1613497 - RNA, 16 nt, Homo sapiens
aaacagggauuaucau

SEQ ID NO: 1613498 - RNA, 21 nt, Homo sapiens
aaacagggcugccuucuggcc

SEQ ID NO: 1613499 - RNA, 22 nt, Homo sapiens
aaacagggcugccuucuggccu

SEQ ID NO: 1613500 - RNA, 18 nt, Homo sapiens
aaacaggugcuaauuugu

SEQ ID NO: 1613501 - RNA, 16 nt, Homo sapiens
aaacagucaucuagaa

SEQ ID NO: 1613502 - RNA, 18 nt, Homo sapiens
aaacauaaucuucugccu

SEQ ID NO: 1613503 - RNA, 21 nt, Homo sapiens
aaacauauuuuuauacuuuau

SEQ ID NO: 1613504 - RNA, 22 nt, Homo sapiens
aaacaucacaccugcccuaaac

SEQ ID NO: 1613505 - RNA, 17 nt, Homo sapiens
aaacaucaccuauuuaa

SEQ ID NO: 1613506 - RNA, 15 nt, Homo sapiens
aaacauguacuuuga

SEQ ID NO: 1613507 - RNA, 14 nt, Homo sapiens
aaacauuauucuca

SEQ ID NO: 1613508 - RNA, 12 nt, Homo sapiens
aaacauugaaga

SEQ ID NO: 1613509 - RNA, 14 nt, Homo sapiens
aaacauugccuuug

SEQ ID NO: 1613510 - RNA, 21 nt, Homo sapiens
aaacauuucuaagacuacuaa

SEQ ID NO: 1613511 - RNA, 17 nt, Homo sapiens
aaaccagaaaggugauu

SEQ ID NO: 1613512 - RNA, 17 nt, Homo sapiens
aaaccagaacaguauga

SEQ ID NO: 1613513 - RNA, 23 nt, Homo sapiens
aaaccaggaaggaaaaugugaac

SEQ ID NO: 1613514 - RNA, 22 nt, Homo sapiens
aaaccauaaaacccuauacaag

SEQ ID NO: 1613515 - RNA, 22 nt, Homo sapiens
aaaccauggucucucugcuugc

SEQ ID NO: 1613516 - RNA, 22 nt, Homo sapiens
aaaccauuuuguuauugacuaa

SEQ ID NO: 1613517 - RNA, 16 nt, Homo sapiens
aaacccaguaauucua

SEQ ID NO: 1613518 - RNA, 17 nt, Homo sapiens
aaacccagucucagaca

SEQ ID NO: 1613519 - RNA, 24 nt, Homo sapiens
aaacccauacaauguauguacaau

SEQ ID NO: 1613520 - RNA, 22 nt, Homo sapiens
aaaccccagucauggcuuccuu

SEQ ID NO: 1613521 - RNA, 18 nt, Homo sapiens
aaaccccuucuuuacuuc

SEQ ID NO: 1613522 - RNA, 15 nt, Homo sapiens
aaacccuaucuguga

SEQ ID NO: 1613523 - RNA, 16 nt, Homo sapiens
aaaccugaccccugcu

SEQ ID NO: 1613524 - RNA, 21 nt, Homo sapiens
aaaccugaccccugcucagua

SEQ ID NO: 1613525 - RNA, 18 nt, Homo sapiens
aaaccugaugcuggggac

SEQ ID NO: 1613526 - RNA, 15 nt, Homo sapiens
aaaccugauuggcca

SEQ ID NO: 1613527 - RNA, 13 nt, Homo sapiens
aaaccugcaguuu

SEQ ID NO: 1613528 - RNA, 17 nt, Homo sapiens
aaaccuuccucuuccag

SEQ ID NO: 1613529 - RNA, 18 nt, Homo sapiens
aaaccuuuacaguuagca

SEQ ID NO: 1613530 - RNA, 18 nt, Homo sapiens
aaacgccaguguguuuaa

SEQ ID NO: 1613531 - RNA, 16 nt, Homo sapiens
aaacggauuccaaaga

SEQ ID NO: 1613532 - RNA, 16 nt, Homo sapiens
aaacguccuacuguau

SEQ ID NO: 1613533 - RNA, 14 nt, Homo sapiens
aaacgucuaggaaa

SEQ ID NO: 1613534 - RNA, 19 nt, Homo sapiens
aaacgucuucuaaacuucc

SEQ ID NO: 1613535 - RNA, 20 nt, Homo sapiens
aaacgucuucuaaacuuccc

SEQ ID NO: 1613536 - RNA, 13 nt, Homo sapiens
aaacuaaccaucu

SEQ ID NO: 1613537 - RNA, 23 nt, Homo sapiens
aaacuaaccuugaauaaggccca

SEQ ID NO: 1613538 - RNA, 16 nt, Homo sapiens
aaacuaagagcucuca

SEQ ID NO: 1613539 - RNA, 21 nt, Homo sapiens
aaacuaauuuaguaauagccu

SEQ ID NO: 1613540 - RNA, 16 nt, Homo sapiens
aaacuaguacuauuau

SEQ ID NO: 1613541 - RNA, 15 nt, Homo sapiens
aaacuaguggcaaua

SEQ ID NO: 1613542 - RNA, 22 nt, Homo sapiens
aaacuaguggcaauauccaaau

SEQ ID NO: 1613543 - RNA, 18 nt, Homo sapiens
aaacuauguaacauguag

SEQ ID NO: 1613544 - RNA, 16 nt, Homo sapiens
aaacuauguguucaau

SEQ ID NO: 1613545 - RNA, 12 nt, Homo sapiens
aaacucucacca

SEQ ID NO: 1613546 - RNA, 19 nt, Homo sapiens
aaacucucuucucuuucuc

SEQ ID NO: 1613547 - RNA, 20 nt, Homo sapiens
aagacaugauuuccuugaau

SEQ ID NO: 1613548 - RNA, 11 nt, Homo sapiens
aagacauuucu

SEQ ID NO: 1613549 - RNA, 20 nt, Homo sapiens
aagaccaggucuacagugau

SEQ ID NO: 1613550 - RNA, 21 nt, Homo sapiens
aagaccaggucuacagugaua

SEQ ID NO: 1613551 - RNA, 19 nt, Homo sapiens
aagacccccagcacuuggg

SEQ ID NO: 1613552 - RNA, 14 nt, Homo sapiens
aagacccugucuca

SEQ ID NO: 1613553 - RNA, 13 nt, Homo sapiens
aagacgccuucau

SEQ ID NO: 1613554 - RNA, 23 nt, Homo sapiens
aagacgugauuuugcuguagaag

SEQ ID NO: 1613555 - RNA, 14 nt, Homo sapiens
aagacguuuuccca

SEQ ID NO: 1613556 - RNA, 13 nt, Homo sapiens
aagacuaucuaca

SEQ ID NO: 1613557 - RNA, 20 nt, Homo sapiens
aagacuauucaaacagucuc

SEQ ID NO: 1613558 - RNA, 23 nt, Homo sapiens
aagacugaaucuaccugcccuaa

SEQ ID NO: 1613559 - RNA, 11 nt, Homo sapiens
aagacugacca

SEQ ID NO: 1613560 - RNA, 14 nt, Homo sapiens
aagacugagucaag

SEQ ID NO: 1613561 - RNA, 22 nt, Homo sapiens
aagacuggaagcuaauuugcau

SEQ ID NO: 1613562 - RNA, 19 nt, Homo sapiens
aagacugguuuucugccaa

SEQ ID NO: 1613563 - RNA, 19 nt, Homo sapiens
aagacuguugccacuuaac

SEQ ID NO: 1613564 - RNA, 17 nt, Homo sapiens
aagagaaaaugcgucuc

SEQ ID NO: 1613565 - RNA, 13 nt, Homo sapiens
aagagaagcauca

SEQ ID NO: 1613566 - RNA, 18 nt, Homo sapiens
aagagaccacccauauca

SEQ ID NO: 1613567 - RNA, 22 nt, Homo sapiens
aagagcaaaccuaacaggagaa

SEQ ID NO: 1613568 - RNA, 22 nt, Homo sapiens
aagagcaggacuccaggcccaa

SEQ ID NO: 1613569 - RNA, 20 nt, Homo sapiens
aagagcuauuuuagaaagcu

SEQ ID NO: 1613570 - RNA, 14 nt, Homo sapiens
aagaggaacagcac

SEQ ID NO: 1613571 - RNA, 21 nt, Homo sapiens
aagaggaaggccucuguggca

SEQ ID NO: 1613572 - RNA, 16 nt, Homo sapiens
aagaggcagcuugaaa

SEQ ID NO: 1613573 - RNA, 20 nt, Homo sapiens
aagagggugauugcuggggc

SEQ ID NO: 1613574 - RNA, 19 nt, Homo sapiens
aagaguacacucagccacu

SEQ ID NO: 1613575 - RNA, 23 nt, Homo sapiens
aagaguacacucagccacuguca

SEQ ID NO: 1613576 - RNA, 21 nt, Homo sapiens
agaaucagagaaggaacauac

SEQ ID NO: 1613577 - RNA, 15 nt, Homo sapiens
agaaucccugccugu

SEQ ID NO: 1613578 - RNA, 17 nt, Homo sapiens
agaaucguaauggguau

SEQ ID NO: 1613579 - RNA, 22 nt, Homo sapiens
agaaucuuugcaugcagaggag

SEQ ID NO: 1613580 - RNA, 13 nt, Homo sapiens
agaaugaauuuau

SEQ ID NO: 1613581 - RNA, 15 nt, Homo sapiens
agaaugagacaucca

SEQ ID NO: 1613582 - RNA, 12 nt, Homo sapiens
agaauggagcug

SEQ ID NO: 1613583 - RNA, 23 nt, Homo sapiens
agaauguagacagguauaaugau

SEQ ID NO: 1613584 - RNA, 16 nt, Homo sapiens
agaauguucaucucuc

SEQ ID NO: 1613585 - RNA, 15 nt, Homo sapiens
agaauuaacacauga

SEQ ID NO: 1613586 - RNA, 15 nt, Homo sapiens
agaauuauaacugua

SEQ ID NO: 1613587 - RNA, 15 nt, Homo sapiens
agaauugaccaaaua

SEQ ID NO: 1613588 - RNA, 19 nt, Homo sapiens
agaauuucugcuaaauauc

SEQ ID NO: 1613589 - RNA, 18 nt, Homo sapiens
agaauuugagugcucuga

SEQ ID NO: 1613590 - RNA, 17 nt, Homo sapiens
agaauuugcucgcuaca

SEQ ID NO: 1613591 - RNA, 23 nt, Homo sapiens
agacaaaaauaucaauggugcug

SEQ ID NO: 1613592 - RNA, 21 nt, Homo sapiens
agacaacaaaugggucccuca

SEQ ID NO: 1613593 - RNA, 18 nt, Homo sapiens
agacaacaccuuccuccu

SEQ ID NO: 1613594 - RNA, 18 nt, Homo sapiens
agacaacccucagauuug

SEQ ID NO: 1613595 - RNA, 17 nt, Homo sapiens
agacaagagaucuacac

SEQ ID NO: 1613596 - RNA, 22 nt, Homo sapiens
agacaagcagaguaacaggauc

SEQ ID NO: 1613597 - RNA, 14 nt, Homo sapiens
agacaagcgccgcu

SEQ ID NO: 1613598 - RNA, 21 nt, Homo sapiens
agacaagcuguauaaacagaa

SEQ ID NO: 1613599 - RNA, 22 nt, Homo sapiens
agacaagcuguauaaacagaac

SEQ ID NO: 1613600 - RNA, 13 nt, Homo sapiens
agacaaggugcua

SEQ ID NO: 1613601 - RNA, 19 nt, Homo sapiens
agacaauaaacccucagag

SEQ ID NO: 1613602 - RNA, 14 nt, Homo sapiens
agacaauuccucca

SEQ ID NO: 1613603 - RNA, 18 nt, Homo sapiens
agacaccagccuagccug

SEQ ID NO: 1613604 - RNA, 22 nt, Homo sapiens
agacacugucucuaccaaaaaa

SEQ ID NO: 1613605 - RNA, 16 nt, Homo sapiens
agacagaaaacauguu

SEQ ID NO: 1613606 - RNA, 13 nt, Homo sapiens
agacagaagcuua

SEQ ID NO: 1613607 - RNA, 21 nt, Homo sapiens
agacagcccuggcaaaugccu

SEQ ID NO: 1613608 - RNA, 21 nt, Homo sapiens
agacagcgcaugcuggugcag

SEQ ID NO: 1613609 - RNA, 14 nt, Homo sapiens
agacagugcccuug

SEQ ID NO: 1613610 - RNA, 23 nt, Homo sapiens
agacaguuuugcuuuaguacaau

SEQ ID NO: 1613611 - RNA, 23 nt, Homo sapiens
agacauagaauuaacacaugauc

SEQ ID NO: 1613612 - RNA, 15 nt, Homo sapiens
agacaucaacagaua

SEQ ID NO: 1613613 - RNA, 19 nt, Homo sapiens
agacaucuuugggccuguc

SEQ ID NO: 1613614 - RNA, 15 nt, Homo sapiens
agacauucauuuagu

SEQ ID NO: 1613615 - RNA, 23 nt, Homo sapiens
agacauuucucuaacuccugcca

SEQ ID NO: 1613616 - RNA, 13 nt, Homo sapiens
agacauuugcuga

SEQ ID NO: 1613617 - RNA, 19 nt, Homo sapiens
agacauuugcugaacucag

SEQ ID NO: 1613618 - RNA, 18 nt, Homo sapiens
agaccauuuguauuacca

SEQ ID NO: 1613619 - RNA, 16 nt, Homo sapiens
agacccacaaggccag

SEQ ID NO: 1613620 - RNA, 22 nt, Homo sapiens
agacccacgugcuaggggauga

SEQ ID NO: 1613621 - RNA, 11 nt, Homo sapiens
agacccagugg

SEQ ID NO: 1613622 - RNA, 21 nt, Homo sapiens
agacccaguggacucuuccac

SEQ ID NO: 1613623 - RNA, 13 nt, Homo sapiens
agaccccagcugg

SEQ ID NO: 1613624 - RNA, 13 nt, Homo sapiens
agaccccaugccu

SEQ ID NO: 1613625 - RNA, 17 nt, Homo sapiens
agacccccacaccucag

SEQ ID NO: 1613626 - RNA, 16 nt, Homo sapiens
agacccccagcacuug

SEQ ID NO: 1613627 - RNA, 20 nt, Homo sapiens
agaccccucucccagcuauu

SEQ ID NO: 1613628 - RNA, 22 nt, Homo sapiens
agacccuuauugcuguccugga

SEQ ID NO: 1613629 - RNA, 15 nt, Homo sapiens
agaccucaagccauc

SEQ ID NO: 1613630 - RNA, 22 nt, Homo sapiens
agaccucacacacacaaaaaau

SEQ ID NO: 1613631 - RNA, 22 nt, Homo sapiens
agaccucagugccuuccuguuu

SEQ ID NO: 1613632 - RNA, 19 nt, Homo sapiens
agaccucuaggaggagcua

SEQ ID NO: 1613633 - RNA, 16 nt, Homo sapiens
agaccucuaguagcug

SEQ ID NO: 1613634 - RNA, 19 nt, Homo sapiens
agacgugauuuugcuguag

SEQ ID NO: 1613635 - RNA, 13 nt, Homo sapiens
agacuaacauguc

SEQ ID NO: 1613636 - RNA, 14 nt, Homo sapiens
agacuaacauguca

SEQ ID NO: 1613637 - RNA, 19 nt, Homo sapiens
agacuacacuaguccauaa

SEQ ID NO: 1613638 - RNA, 11 nt, Homo sapiens
agacuacaggg

SEQ ID NO: 1613639 - RNA, 23 nt, Homo sapiens
agacuagaaaauuagacugugau

SEQ ID NO: 1613640 - RNA, 20 nt, Homo sapiens
agacuaugauauaacaugug

SEQ ID NO: 1613641 - RNA, 22 nt, Homo sapiens
agacucaugguguguuacacaa

SEQ ID NO: 1613642 - RNA, 16 nt, Homo sapiens
agacuccaucucuucu

SEQ ID NO: 1613643 - RNA, 19 nt, Homo sapiens
agacucccaugaagccuuu

SEQ ID NO: 1613644 - RNA, 17 nt, Homo sapiens
agacucgagaacuuuca

SEQ ID NO: 1613645 - RNA, 17 nt, Homo sapiens
agacugaagauggcuuu

SEQ ID NO: 1613646 - RNA, 17 nt, Homo sapiens
agacugaaucuaccugc

SEQ ID NO: 1613647 - RNA, 15 nt, Homo sapiens
agacugaugagcaca

SEQ ID NO: 1613648 - RNA, 18 nt, Homo sapiens
agacuggaauaguggcau

SEQ ID NO: 1613649 - RNA, 19 nt, Homo sapiens
agacugguuuucugccaau

SEQ ID NO: 1613650 - RNA, 18 nt, Homo sapiens
agacuguuacuuuggcaa

SEQ ID NO: 1613651 - RNA, 18 nt, Homo sapiens
agacuguugccacuuaac

SEQ ID NO: 1613652 - RNA, 14 nt, Homo sapiens
agacuucuggccua

SEQ ID NO: 1613653 - RNA, 21 nt, Homo sapiens
agacuuugcuaaagacaugaa

SEQ ID NO: 1613654 - RNA, 20 nt, Homo sapiens
agacuuuuugguggauguaa

SEQ ID NO: 1613655 - RNA, 16 nt, Homo sapiens
agagaaaaauugccuu

SEQ ID NO: 1613656 - RNA, 15 nt, Homo sapiens
agagaaaggacucag

SEQ ID NO: 1613657 - RNA, 22 nt, Homo sapiens
agagaacaaugugcuaugugaa

SEQ ID NO: 1613658 - RNA, 23 nt, Homo sapiens
agagaacaguuuuacaauagaca

SEQ ID NO: 1613659 - RNA, 23 nt, Homo sapiens
agagaauguguguguguggcagg

SEQ ID NO: 1613660 - RNA, 16 nt, Homo sapiens
agagaauguuccagac

SEQ ID NO: 1613661 - RNA, 14 nt, Homo sapiens
agagacaagcagag

SEQ ID NO: 1613662 - RNA, 12 nt, Homo sapiens
agagacacugag

SEQ ID NO: 1613663 - RNA, 13 nt, Homo sapiens
agagacacugagc

SEQ ID NO: 1613664 - RNA, 11 nt, Homo sapiens
agagacagggu

SEQ ID NO: 1613665 - RNA, 17 nt, Homo sapiens
agagaccacacauuuua

SEQ ID NO: 1613666 - RNA, 12 nt, Homo sapiens
agagaccucaaa

SEQ ID NO: 1613667 - RNA, 19 nt, Homo sapiens
agagaccucaaauuacuuu

SEQ ID NO: 1613668 - RNA, 15 nt, Homo sapiens
agagaccugcucagg

SEQ ID NO: 1613669 - RNA, 23 nt, Homo sapiens
agagaccugcucaggcgucgcug

SEQ ID NO: 1613670 - RNA, 16 nt, Homo sapiens
aaugacuuaaccauau

SEQ ID NO: 1613671 - RNA, 16 nt, Homo sapiens
aaugacuuacuuuccu

SEQ ID NO: 1613672 - RNA, 16 nt, Homo sapiens
aaugagaucauuguga

SEQ ID NO: 1613673 - RNA, 15 nt, Homo sapiens
aaugagguaaauaag

SEQ ID NO: 1613674 - RNA, 19 nt, Homo sapiens
aaugauaggaaaaauccau

SEQ ID NO: 1613675 - RNA, 14 nt, Homo sapiens
aaugaucacauucu

SEQ ID NO: 1613676 - RNA, 14 nt, Homo sapiens
aaugaugcucaaaa

SEQ ID NO: 1613677 - RNA, 20 nt, Homo sapiens
aaugaugcucaaaaucuuuc

SEQ ID NO: 1613678 - RNA, 23 nt, Homo sapiens
aaugaugcucaaaaucuuuccaa

SEQ ID NO: 1613679 - RNA, 21 nt, Homo sapiens
aaugaugguuuaauagguaaa

SEQ ID NO: 1613680 - RNA, 13 nt, Homo sapiens
aaugaugugauac

SEQ ID NO: 1613681 - RNA, 21 nt, Homo sapiens
aaugaugugugcaaguacgac

SEQ ID NO: 1613682 - RNA, 20 nt, Homo sapiens
aaugauuaaauuaugaagcu

SEQ ID NO: 1613683 - RNA, 23 nt, Homo sapiens
aaugauugguuaaaaugugauuu

SEQ ID NO: 1613684 - RNA, 17 nt, Homo sapiens
aaugauuucacagugug

SEQ ID NO: 1613685 - RNA, 15 nt, Homo sapiens
aaugcaccaaucagc

SEQ ID NO: 1613686 - RNA, 22 nt, Homo sapiens
aaugcacccaucagcacucugu

SEQ ID NO: 1613687 - RNA, 22 nt, Homo sapiens
aaugcacucugggucuggccag

SEQ ID NO: 1613688 - RNA, 20 nt, Homo sapiens
aaugcauuccagaacaaauu

SEQ ID NO: 1613689 - RNA, 19 nt, Homo sapiens
aaugccaaugaacaucuca

SEQ ID NO: 1613690 - RNA, 13 nt, Homo sapiens
aaugccagcauaa

SEQ ID NO: 1613691 - RNA, 23 nt, Homo sapiens
aaugccauccagaugugugcaau

SEQ ID NO: 1613692 - RNA, 18 nt, Homo sapiens
aaugcccauuuuugcuaa

SEQ ID NO: 1613693 - RNA, 16 nt, Homo sapiens
aaugccgcgauggguc

SEQ ID NO: 1613694 - RNA, 17 nt, Homo sapiens
aaugccuaucugaccaa

SEQ ID NO: 1613695 - RNA, 20 nt, Homo sapiens
acagagcaggggcuccagca

SEQ ID NO: 1613696 - RNA, 19 nt, Homo sapiens
acagagcuucccugacuca

SEQ ID NO: 1613697 - RNA, 11 nt, Homo sapiens
acagaggcaua

SEQ ID NO: 1613698 - RNA, 18 nt, Homo sapiens
acagagggcucaccucuu

SEQ ID NO: 1613699 - RNA, 21 nt, Homo sapiens
acagagugagacuccaucuca

SEQ ID NO: 1613700 - RNA, 20 nt, Homo sapiens
acagaguugccaggcacuuu

SEQ ID NO: 1613701 - RNA, 17 nt, Homo sapiens
acagaguugcuuaauga

SEQ ID NO: 1613702 - RNA, 15 nt, Homo sapiens
acagauaucaguguc

SEQ ID NO: 1613703 - RNA, 18 nt, Homo sapiens
acagaugugaaaauauac

SEQ ID NO: 1613704 - RNA, 15 nt, Homo sapiens
acagauuaaagaaga

SEQ ID NO: 1613705 - RNA, 21 nt, Homo sapiens
acagauuucaaaaaaaaaccc

SEQ ID NO: 1613706 - RNA, 14 nt, Homo sapiens
acagcaaacaggug

SEQ ID NO: 1613707 - RNA, 17 nt, Homo sapiens
acagcaauggugucagu

SEQ ID NO: 1613708 - RNA, 18 nt, Homo sapiens
acagcacagggaagcaaa

SEQ ID NO: 1613709 - RNA, 21 nt, Homo sapiens
acagcacuggggagucuuugu

SEQ ID NO: 1613710 - RNA, 15 nt, Homo sapiens
acagcaucagcucaa

SEQ ID NO: 1613711 - RNA, 16 nt, Homo sapiens
acagcauuaacugucu

SEQ ID NO: 1613712 - RNA, 23 nt, Homo sapiens
acagccaccaagaaguggcugcc

SEQ ID NO: 1613713 - RNA, 21 nt, Homo sapiens
acagcccaggauacuggcaca

SEQ ID NO: 1613714 - RNA, 17 nt, Homo sapiens
acagcccuuccucccau

SEQ ID NO: 1613715 - RNA, 12 nt, Homo sapiens
acagcuacucuc

SEQ ID NO: 1613716 - RNA, 21 nt, Homo sapiens
acagcuacucuccccacgagg

SEQ ID NO: 1613717 - RNA, 20 nt, Homo sapiens
acagcucgggcccucuguga

SEQ ID NO: 1613718 - RNA, 18 nt, Homo sapiens
acagcugaaaagagcuuu

SEQ ID NO: 1613719 - RNA, 21 nt, Homo sapiens
acagcuguaaucccagcacuu

SEQ ID NO: 1613720 - RNA, 22 nt, Homo sapiens
acagcuugggaggaaaccugag

SEQ ID NO: 1613721 - RNA, 15 nt, Homo sapiens
acuuuuugcauuuaa

SEQ ID NO: 1613722 - RNA, 19 nt, Homo sapiens
acuuuuuuagaaaugcaaa

SEQ ID NO: 1613723 - RNA, 18 nt, Homo sapiens
agaaaaaaaaaacacuug

SEQ ID NO: 1613724 - RNA, 19 nt, Homo sapiens
agaaaaaggaaaaccauuc

SEQ ID NO: 1613725 - RNA, 17 nt, Homo sapiens
agaaaaauauauacuaa

SEQ ID NO: 1613726 - RNA, 17 nt, Homo sapiens
agaaaaauaucuuggcc

SEQ ID NO: 1613727 - RNA, 12 nt, Homo sapiens
agaaaacaagua

SEQ ID NO: 1613728 - RNA, 17 nt, Homo sapiens
agaaaacaaguauauaa

SEQ ID NO: 1613729 - RNA, 12 nt, Homo sapiens
agaaaacauguu

SEQ ID NO: 1613730 - RNA, 22 nt, Homo sapiens
agaaaagaugugcagauaucac

SEQ ID NO: 1613731 - RNA, 19 nt, Homo sapiens
agaaaagcaauacuguuuc

SEQ ID NO: 1613732 - RNA, 16 nt, Homo sapiens
agaaaagcaguggcuc

SEQ ID NO: 1613733 - RNA, 19 nt, Homo sapiens
agaaaagcaugcauaucau

SEQ ID NO: 1613734 - RNA, 17 nt, Homo sapiens
agaaaagggaguuuaaa

SEQ ID NO: 1613735 - RNA, 19 nt, Homo sapiens
agaaaauccauucauucaa

SEQ ID NO: 1613736 - RNA, 20 nt, Homo sapiens
agaaaauccccaacuaugca

SEQ ID NO: 1613737 - RNA, 17 nt, Homo sapiens
agaaaaucuaccaagaa

SEQ ID NO: 1613738 - RNA, 18 nt, Homo sapiens
agaaaaugcgucucuccu

SEQ ID NO: 1613739 - RNA, 18 nt, Homo sapiens
agaaaauggguuuauuca

SEQ ID NO: 1613740 - RNA, 22 nt, Homo sapiens
agaaaauguucuguuugcugug

SEQ ID NO: 1613741 - RNA, 12 nt, Homo sapiens
agaaaauuuucc

SEQ ID NO: 1613742 - RNA, 11 nt, Homo sapiens
agaaacaaaug

SEQ ID NO: 1613743 - RNA, 12 nt, Homo sapiens
agaaacaagaca

SEQ ID NO: 1613744 - RNA, 15 nt, Homo sapiens
agaaacagugugcau

SEQ ID NO: 1613745 - RNA, 16 nt, Homo sapiens
agaaacagugugcaug

SEQ ID NO: 1613746 - RNA, 19 nt, Homo sapiens
agaaaccagaaaagcaaua

SEQ ID NO: 1613747 - RNA, 17 nt, Homo sapiens
agaaacuagcagauuug

SEQ ID NO: 1613748 - RNA, 12 nt, Homo sapiens
agaaacugagaa

SEQ ID NO: 1613749 - RNA, 19 nt, Homo sapiens
agaaacugggcagcccuga

SEQ ID NO: 1613750 - RNA, 19 nt, Homo sapiens
agaaagaaugcauuccaga

SEQ ID NO: 1613751 - RNA, 22 nt, Homo sapiens
agaaagaaugcauuccagaaca

SEQ ID NO: 1613752 - RNA, 14 nt, Homo sapiens
agaaagaucaaaga

SEQ ID NO: 1613753 - RNA, 12 nt, Homo sapiens
agaaagcacuua

SEQ ID NO: 1613754 - RNA, 20 nt, Homo sapiens
agaaagccaggagcagcccu

SEQ ID NO: 1613755 - RNA, 19 nt, Homo sapiens
agaaagcucauggcugugu

SEQ ID NO: 1613756 - RNA, 15 nt, Homo sapiens
agaaagcugugggac

SEQ ID NO: 1613757 - RNA, 12 nt, Homo sapiens
agaaagcuuaag

SEQ ID NO: 1613758 - RNA, 15 nt, Homo sapiens
agaaaggguuccaaa

SEQ ID NO: 1613759 - RNA, 17 nt, Homo sapiens
agaaagguuuuauucua

SEQ ID NO: 1613760 - RNA, 16 nt, Homo sapiens
agaaaguaagcauuuc

SEQ ID NO: 1613761 - RNA, 14 nt, Homo sapiens
agaaaguguauuug

SEQ ID NO: 1613762 - RNA, 16 nt, Homo sapiens
agaaauaaagaucuca

SEQ ID NO: 1613763 - RNA, 17 nt, Homo sapiens
agaaauacagucuucca

SEQ ID NO: 1613764 - RNA, 15 nt, Homo sapiens
agaaauacuugaacu

SEQ ID NO: 1613765 - RNA, 14 nt, Homo sapiens
agaaauagaauuau

SEQ ID NO: 1613766 - RNA, 14 nt, Homo sapiens
agaaauauggacac

SEQ ID NO: 1613767 - RNA, 18 nt, Homo sapiens
agaaauauggacacuuaa

SEQ ID NO: 1613768 - RNA, 22 nt, Homo sapiens
agaaauauugacucaaaccaua

SEQ ID NO: 1613769 - RNA, 19 nt, Homo sapiens
agaaaucaauaguugaauu

SEQ ID NO: 1613770 - RNA, 14 nt, Homo sapiens
agaaaucuacugaa

SEQ ID NO: 1613771 - RNA, 19 nt, Homo sapiens
agaaaucugugccugagaa

SEQ ID NO: 1613772 - RNA, 18 nt, Homo sapiens
agaaaugacagucaaaag

SEQ ID NO: 1613773 - RNA, 11 nt, Homo sapiens
agaaaugcaaa

SEQ ID NO: 1613774 - RNA, 11 nt, Homo sapiens
agaaaugccag

SEQ ID NO: 1613775 - RNA, 12 nt, Homo sapiens
agaaauggccaa

SEQ ID NO: 1613776 - RNA, 17 nt, Homo sapiens
agaaauuaccuguggau

SEQ ID NO: 1613777 - RNA, 14 nt, Homo sapiens
agaaauuaguuuca

SEQ ID NO: 1613778 - RNA, 18 nt, Homo sapiens
agaaauuuugccuuuaag

SEQ ID NO: 1613779 - RNA, 20 nt, Homo sapiens
agaacaaaagcgacccauuc

SEQ ID NO: 1613780 - RNA, 15 nt, Homo sapiens
agaacaaagccacug

SEQ ID NO: 1613781 - RNA, 15 nt, Homo sapiens
agaacaacuaccuga

SEQ ID NO: 1613782 - RNA, 18 nt, Homo sapiens
agaacaccagagaccuca

SEQ ID NO: 1613783 - RNA, 13 nt, Homo sapiens
agaacaccugccu

SEQ ID NO: 1613784 - RNA, 23 nt, Homo sapiens
agaacacgauaaaccauggccaa

SEQ ID NO: 1613785 - RNA, 12 nt, Homo sapiens
agaacacugugc

SEQ ID NO: 1613786 - RNA, 17 nt, Homo sapiens
agaacagaggcauuuaa

SEQ ID NO: 1613787 - RNA, 22 nt, Homo sapiens
agaacagagucucaggacagaa

SEQ ID NO: 1613788 - RNA, 17 nt, Homo sapiens
agaacagguucuuaaaa

SEQ ID NO: 1613789 - RNA, 16 nt, Homo sapiens
agaacauacuguucuc

SEQ ID NO: 1613790 - RNA, 18 nt, Homo sapiens
agaacaucauuacuuaug

SEQ ID NO: 1613791 - RNA, 19 nt, Homo sapiens
agaacauuauucaucucuc

SEQ ID NO: 1613792 - RNA, 17 nt, Homo sapiens
agaaccuaaugcacucu

SEQ ID NO: 1613793 - RNA, 19 nt, Homo sapiens
agaaccugaguucccggga

SEQ ID NO: 1613794 - RNA, 23 nt, Homo sapiens
agaaccuggagggcuagaaccua

SEQ ID NO: 1613795 - RNA, 19 nt, Homo sapiens
agaacgcgacuuccacaaa

SEQ ID NO: 1613796 - RNA, 13 nt, Homo sapiens
agaacuaaagcug

SEQ ID NO: 1613797 - RNA, 15 nt, Homo sapiens
agaacuaaagcugga

SEQ ID NO: 1613798 - RNA, 20 nt, Homo sapiens
agaacuagccaaaccaggac

SEQ ID NO: 1613799 - RNA, 15 nt, Homo sapiens
agaacugagggcucu

SEQ ID NO: 1613800 - RNA, 12 nt, Homo sapiens
agaacuggugcu

SEQ ID NO: 1613801 - RNA, 15 nt, Homo sapiens
agaacuguacauugu

SEQ ID NO: 1613802 - RNA, 16 nt, Homo sapiens
agaacuguuuucucaa

SEQ ID NO: 1613803 - RNA, 13 nt, Homo sapiens
agaacuuaaucug

SEQ ID NO: 1613804 - RNA, 21 nt, Homo sapiens
agaacuuagccuuuaccugug

SEQ ID NO: 1613805 - RNA, 19 nt, Homo sapiens
agaacuucauggaucagau

SEQ ID NO: 1613806 - RNA, 19 nt, Homo sapiens
agaacuucugccucuaagc

SEQ ID NO: 1613807 - RNA, 13 nt, Homo sapiens
agaacuugcaaua

SEQ ID NO: 1613808 - RNA, 15 nt, Homo sapiens
agaagaaacuuguaa

SEQ ID NO: 1613809 - RNA, 16 nt, Homo sapiens
agaagaggacauugga

SEQ ID NO: 1613810 - RNA, 20 nt, Homo sapiens
agaagagguugggcuuccau

SEQ ID NO: 1613811 - RNA, 21 nt, Homo sapiens
agaagcaguggccuuauugca

SEQ ID NO: 1613812 - RNA, 20 nt, Homo sapiens
agaagccacgcuguccucuc

SEQ ID NO: 1613813 - RNA, 16 nt, Homo sapiens
agaagcccgaggucau

SEQ ID NO: 1613814 - RNA, 15 nt, Homo sapiens
agaagccgugggaag

SEQ ID NO: 1613815 - RNA, 19 nt, Homo sapiens
agaagccuccaagcacaga

SEQ ID NO: 1613816 - RNA, 21 nt, Homo sapiens
aauuccaaagcaaaaccagaa

SEQ ID NO: 1613817 - RNA, 17 nt, Homo sapiens
aauuccacagauuauca

SEQ ID NO: 1613818 - RNA, 21 nt, Homo sapiens
aauuccuccagagacacugag

SEQ ID NO: 1613819 - RNA, 22 nt, Homo sapiens
aauuccuccagagacacugagc

SEQ ID NO: 1613820 - RNA, 13 nt, Homo sapiens
aauuccugugauu

SEQ ID NO: 1613821 - RNA, 15 nt, Homo sapiens
aauucggugugcacc

SEQ ID NO: 1613822 - RNA, 21 nt, Homo sapiens
aauucuauaggaacauaugaa

SEQ ID NO: 1613823 - RNA, 22 nt, Homo sapiens
aauucucuaaccgaauauucau

SEQ ID NO: 1613824 - RNA, 15 nt, Homo sapiens
aauucucucacuuaa

SEQ ID NO: 1613825 - RNA, 17 nt, Homo sapiens
aauucucucucuugcag

SEQ ID NO: 1613826 - RNA, 15 nt, Homo sapiens
aauucugaacuuuau

SEQ ID NO: 1613827 - RNA, 19 nt, Homo sapiens
aauucuggcaggaccucac

SEQ ID NO: 1613828 - RNA, 11 nt, Homo sapiens
aauucuugaua

SEQ ID NO: 1613829 - RNA, 21 nt, Homo sapiens
aauucuuucccagucugucga

SEQ ID NO: 1613830 - RNA, 13 nt, Homo sapiens
aauugacaaugau

SEQ ID NO: 1613831 - RNA, 14 nt, Homo sapiens
aauugacacuuaaa

SEQ ID NO: 1613832 - RNA, 19 nt, Homo sapiens
aauugauauugaaugaugu

SEQ ID NO: 1613833 - RNA, 12 nt, Homo sapiens
aauugcaauaca

SEQ ID NO: 1613834 - RNA, 14 nt, Homo sapiens
aauugcucagagaa

SEQ ID NO: 1613835 - RNA, 18 nt, Homo sapiens
aauugcucuuucacaggu

SEQ ID NO: 1613836 - RNA, 23 nt, Homo sapiens
aauuggcuaaaagacaugcauuu

SEQ ID NO: 1613837 - RNA, 19 nt, Homo sapiens
aauuguaaacuguacuagu

SEQ ID NO: 1613838 - RNA, 15 nt, Homo sapiens
aauuguaaauccugu

SEQ ID NO: 1613839 - RNA, 21 nt, Homo sapiens
aauugucuuuguucugugauu

SEQ ID NO: 1613840 - RNA, 18 nt, Homo sapiens
aauuguuuaccauagaaa

SEQ ID NO: 1613841 - RNA, 13 nt, Homo sapiens
aauuuaagacuug

SEQ ID NO: 1613842 - RNA, 17 nt, Homo sapiens
aauuuaauugcuuugaa

SEQ ID NO: 1613843 - RNA, 21 nt, Homo sapiens
aauuuagagauaggaaacuga

SEQ ID NO: 1613844 - RNA, 19 nt, Homo sapiens
aauuuagucuagacacaau

SEQ ID NO: 1613845 - RNA, 20 nt, Homo sapiens
aauuuauaccuagcacuuua

SEQ ID NO: 1613846 - RNA, 12 nt, Homo sapiens
aauuuauacuua

SEQ ID NO: 1613847 - RNA, 16 nt, Homo sapiens
aauuuauccauucaau

SEQ ID NO: 1613848 - RNA, 19 nt, Homo sapiens
aauuuaucuuuaccaaaaa

SEQ ID NO: 1613849 - RNA, 22 nt, Homo sapiens
aauuuaucuuuaccaaaaacca

SEQ ID NO: 1613850 - RNA, 19 nt, Homo sapiens
aauuuauuaacuaaucaag

SEQ ID NO: 1613851 - RNA, 15 nt, Homo sapiens
aauuucaaaccacac

SEQ ID NO: 1613852 - RNA, 15 nt, Homo sapiens
aauuucagcuucaua

SEQ ID NO: 1613853 - RNA, 13 nt, Homo sapiens
aauuucauacuaa

SEQ ID NO: 1613854 - RNA, 20 nt, Homo sapiens
aauuucauagcuguacuucu

SEQ ID NO: 1613855 - RNA, 20 nt, Homo sapiens
aauuuccaaaauaaucuaua

SEQ ID NO: 1613856 - RNA, 15 nt, Homo sapiens
aauuucccccuaaac

SEQ ID NO: 1613857 - RNA, 20 nt, Homo sapiens
aauuuccuuuuugacacuga

SEQ ID NO: 1613858 - RNA, 20 nt, Homo sapiens
aauuucggauuuuuuccaaa

SEQ ID NO: 1613859 - RNA, 21 nt, Homo sapiens
aauuucuacuucuggaaguca

SEQ ID NO: 1613860 - RNA, 15 nt, Homo sapiens
aauuucucccaguca

SEQ ID NO: 1613861 - RNA, 17 nt, Homo sapiens
aauuucucccuauguuu

SEQ ID NO: 1613862 - RNA, 15 nt, Homo sapiens
aauuugaugacuuau

SEQ ID NO: 1613863 - RNA, 21 nt, Homo sapiens
aauuugcaaagaaaaguuuca

SEQ ID NO: 1613864 - RNA, 14 nt, Homo sapiens
aauuugcugccaaa

SEQ ID NO: 1613865 - RNA, 20 nt, Homo sapiens
aauuuggccuuaagaacugu

SEQ ID NO: 1613866 - RNA, 16 nt, Homo sapiens
aauuuguaggaaaaag

SEQ ID NO: 1613867 - RNA, 22 nt, Homo sapiens
aauuuguguguuuuuagcugug

SEQ ID NO: 1613868 - RNA, 17 nt, Homo sapiens
aauuuguuuuagccauu

SEQ ID NO: 1613869 - RNA, 17 nt, Homo sapiens
aauuuuaaaaaagggag

SEQ ID NO: 1613870 - RNA, 13 nt, Homo sapiens
aauuuuaaccuau

SEQ ID NO: 1613871 - RNA, 15 nt, Homo sapiens
aauuuuacacucugu

SEQ ID NO: 1613872 - RNA, 21 nt, Homo sapiens
aauuuuacucacucacucuga

SEQ ID NO: 1613873 - RNA, 14 nt, Homo sapiens
aauuuuacugugaa

SEQ ID NO: 1613874 - RNA, 20 nt, Homo sapiens
aauuuuauaugcuuacugau

SEQ ID NO: 1613875 - RNA, 17 nt, Homo sapiens
aauuuugaauugauacc

SEQ ID NO: 1613876 - RNA, 18 nt, Homo sapiens
aauuuuguaaauaugcaa

SEQ ID NO: 1613877 - RNA, 16 nt, Homo sapiens
aauuuuguaugccaau

SEQ ID NO: 1613878 - RNA, 12 nt, Homo sapiens
aauuuuguugca

SEQ ID NO: 1613879 - RNA, 21 nt, Homo sapiens
aauuuuguugcaucauguuga

SEQ ID NO: 1613880 - RNA, 19 nt, Homo sapiens
aauuuuguuuucuguggag

SEQ ID NO: 1613881 - RNA, 13 nt, Homo sapiens
aauuuuuaggcaa

SEQ ID NO: 1613882 - RNA, 12 nt, Homo sapiens
aauuuuucauag

SEQ ID NO: 1613883 - RNA, 18 nt, Homo sapiens
aauuuuuccuaugcuauu

SEQ ID NO: 1613884 - RNA, 19 nt, Homo sapiens
aauuuuugcuaugcuguaa

SEQ ID NO: 1613885 - RNA, 17 nt, Homo sapiens
aauuuuuuaacauauug

SEQ ID NO: 1613886 - RNA, 16 nt, Homo sapiens
aauuuuuugacuugaa

SEQ ID NO: 1613887 - RNA, 17 nt, Homo sapiens
aauuuuuugacuugaag

SEQ ID NO: 1613888 - RNA, 13 nt, Homo sapiens
aauuuuuugcucu

SEQ ID NO: 1613889 - RNA, 16 nt, Homo sapiens
aauuuuuugguacaaa

SEQ ID NO: 1613890 - RNA, 19 nt, Homo sapiens
aauuuuuuuuccuugccug

SEQ ID NO: 1613891 - RNA, 13 nt, Homo sapiens
acaaaaaaauuaa

SEQ ID NO: 1613892 - RNA, 14 nt, Homo sapiens
acaaaaauguuucc

SEQ ID NO: 1613893 - RNA, 21 nt, Homo sapiens
acaaaacccucagcacuguua

SEQ ID NO: 1613894 - RNA, 11 nt, Homo sapiens
acaaaacuaca

SEQ ID NO: 1613895 - RNA, 16 nt, Homo sapiens
acaaaacuacaugaga

SEQ ID NO: 1613896 - RNA, 17 nt, Homo sapiens
acaaaaggaauguguaa

SEQ ID NO: 1613897 - RNA, 20 nt, Homo sapiens
acaaaauaaccaauccugga

SEQ ID NO: 1613898 - RNA, 19 nt, Homo sapiens
acaaaaucuuguaggucau

SEQ ID NO: 1613899 - RNA, 12 nt, Homo sapiens
acaaaaugguca

SEQ ID NO: 1613900 - RNA, 16 nt, Homo sapiens
acaaaauggucaucca

SEQ ID NO: 1613901 - RNA, 20 nt, Homo sapiens
acaaaauggucauccaaacu

SEQ ID NO: 1613902 - RNA, 22 nt, Homo sapiens
acaaaauggucauccaaacuca

SEQ ID NO: 1613903 - RNA, 22 nt, Homo sapiens
acaaacaagaaagcuauuccaa

SEQ ID NO: 1613904 - RNA, 15 nt, Homo sapiens
acaaacaaugcaaac

SEQ ID NO: 1613905 - RNA, 16 nt, Homo sapiens
acaaacaaugcaauca

SEQ ID NO: 1613906 - RNA, 14 nt, Homo sapiens
acaaacacauuaua

SEQ ID NO: 1613907 - RNA, 19 nt, Homo sapiens
acaaacagaaaugacugug

SEQ ID NO: 1613908 - RNA, 18 nt, Homo sapiens
acaaacuauauauaauca

SEQ ID NO: 1613909 - RNA, 20 nt, Homo sapiens
acaaacucucaccaugaugu

SEQ ID NO: 1613910 - RNA, 12 nt, Homo sapiens
acaaacugugaa

SEQ ID NO: 1613911 - RNA, 15 nt, Homo sapiens
acaaacuucaaagag

SEQ ID NO: 1613912 - RNA, 15 nt, Homo sapiens
acaaagaaacaaaga

SEQ ID NO: 1613913 - RNA, 15 nt, Homo sapiens
acaaagaauuaucca

SEQ ID NO: 1613914 - RNA, 18 nt, Homo sapiens
acaaagaauuucagucuc

SEQ ID NO: 1613915 - RNA, 20 nt, Homo sapiens
acaaagaugucuuaaccuca

SEQ ID NO: 1613916 - RNA, 19 nt, Homo sapiens
acaaagauugagaagccau

SEQ ID NO: 1613917 - RNA, 17 nt, Homo sapiens
acaaagauuugugguaa

SEQ ID NO: 1613918 - RNA, 18 nt, Homo sapiens
acaaagccccccagcucc

SEQ ID NO: 1613919 - RNA, 20 nt, Homo sapiens
acaaagccccccagcuccca

SEQ ID NO: 1613920 - RNA, 12 nt, Homo sapiens
acaaaggccaca

SEQ ID NO: 1613921 - RNA, 23 nt, Homo sapiens
acaaaggcugacauucacugagu

SEQ ID NO: 1613922 - RNA, 20 nt, Homo sapiens
acaaaguagaggaauccaug

SEQ ID NO: 1613923 - RNA, 15 nt, Homo sapiens
acaaauaacaucuca

SEQ ID NO: 1613924 - RNA, 17 nt, Homo sapiens
acaaauaaguaauaucu

SEQ ID NO: 1613925 - RNA, 22 nt, Homo sapiens
acaaaugaaauaaauauugugu

SEQ ID NO: 1613926 - RNA, 12 nt, Homo sapiens
acaaaugaacaa

SEQ ID NO: 1613927 - RNA, 15 nt, Homo sapiens
acaaaugacaucaaa

SEQ ID NO: 1613928 - RNA, 20 nt, Homo sapiens
acaaauuagccauuucacuc

SEQ ID NO: 1613929 - RNA, 24 nt, Homo sapiens
acaaauuagccauuucacucucaa

SEQ ID NO: 1613930 - RNA, 16 nt, Homo sapiens
acaacacuuaauagca

SEQ ID NO: 1613931 - RNA, 15 nt, Homo sapiens
acaacagauggcugc

SEQ ID NO: 1613932 - RNA, 20 nt, Homo sapiens
acaacagguaaaacagggcc

SEQ ID NO: 1613933 - RNA, 13 nt, Homo sapiens
acaacagugaaaa

SEQ ID NO: 1613934 - RNA, 15 nt, Homo sapiens
acaacauggugcuac

SEQ ID NO: 1613935 - RNA, 15 nt, Homo sapiens
aagcuccuuccagac

SEQ ID NO: 1613936 - RNA, 22 nt, Homo sapiens
aagcucuucuucccagcacuau

SEQ ID NO: 1613937 - RNA, 14 nt, Homo sapiens
aagcugcugucacu

SEQ ID NO: 1613938 - RNA, 21 nt, Homo sapiens
aagcugugggacgaaagcaca

SEQ ID NO: 1613939 - RNA, 14 nt, Homo sapiens
aagcuuaaugauuc

SEQ ID NO: 1613940 - RNA, 17 nt, Homo sapiens
aagcuuuaucuuugugu

SEQ ID NO: 1613941 - RNA, 11 nt, Homo sapiens
aagcuuuauga

SEQ ID NO: 1613942 - RNA, 21 nt, Homo sapiens
aagcuuuauuaccaguggcgu

SEQ ID NO: 1613943 - RNA, 22 nt, Homo sapiens
aagcuuucauguaaacugugca

SEQ ID NO: 1613944 - RNA, 19 nt, Homo sapiens
aaggaaaaucacaucucca

SEQ ID NO: 1613945 - RNA, 14 nt, Homo sapiens
aaggaaacauauuu

SEQ ID NO: 1613946 - RNA, 19 nt, Homo sapiens
aaggaaagauuugugaacu

SEQ ID NO: 1613947 - RNA, 16 nt, Homo sapiens
aaggaaagcacuaaga

SEQ ID NO: 1613948 - RNA, 18 nt, Homo sapiens
aaggaaaggcucauuuaa

SEQ ID NO: 1613949 - RNA, 13 nt, Homo sapiens
aaggaacauaccc

SEQ ID NO: 1613950 - RNA, 20 nt, Homo sapiens
aaggaacauaccccuuacaa

SEQ ID NO: 1613951 - RNA, 22 nt, Homo sapiens
aaggaacgcugucucuuugcaa

SEQ ID NO: 1613952 - RNA, 13 nt, Homo sapiens
aaggaagacuuga

SEQ ID NO: 1613953 - RNA, 14 nt, Homo sapiens
aaggaauacaauau

SEQ ID NO: 1613954 - RNA, 18 nt, Homo sapiens
aaggacucuuccaccucc

SEQ ID NO: 1613955 - RNA, 22 nt, Homo sapiens
aaggagaaaaagacagcgauaa

SEQ ID NO: 1613956 - RNA, 23 nt, Homo sapiens
aaggagacucaccucugccucaa

SEQ ID NO: 1613957 - RNA, 22 nt, Homo sapiens
aaggagagacucccaugaagcc

SEQ ID NO: 1613958 - RNA, 19 nt, Homo sapiens
aaggagcaucuaucagauu

SEQ ID NO: 1613959 - RNA, 15 nt, Homo sapiens
aaggagcugauacuu

SEQ ID NO: 1613960 - RNA, 15 nt, Homo sapiens
aaggaggccugggga

SEQ ID NO: 1613961 - RNA, 11 nt, Homo sapiens
aaggagucaaa

SEQ ID NO: 1613962 - RNA, 19 nt, Homo sapiens
aaggagugcgugccugcua

SEQ ID NO: 1613963 - RNA, 18 nt, Homo sapiens
aacuggaauuaaaaggau

SEQ ID NO: 1613964 - RNA, 16 nt, Homo sapiens
aacuggauagaaccac

SEQ ID NO: 1613965 - RNA, 15 nt, Homo sapiens
aacuggcacccagag

SEQ ID NO: 1613966 - RNA, 16 nt, Homo sapiens
aacuggcaugucauuu

SEQ ID NO: 1613967 - RNA, 18 nt, Homo sapiens
aacuggcaugucauuugc

SEQ ID NO: 1613968 - RNA, 16 nt, Homo sapiens
aacuggggggcaauuu

SEQ ID NO: 1613969 - RNA, 15 nt, Homo sapiens
aacuguaaaaaucau

SEQ ID NO: 1613970 - RNA, 21 nt, Homo sapiens
aacuguaaaguucaauuguga

SEQ ID NO: 1613971 - RNA, 16 nt, Homo sapiens
aacuguaaaugugaca

SEQ ID NO: 1613972 - RNA, 15 nt, Homo sapiens
aacugucuuccucaa

SEQ ID NO: 1613973 - RNA, 20 nt, Homo sapiens
aacugugaaauguacgucau

SEQ ID NO: 1613974 - RNA, 22 nt, Homo sapiens
aacuguuaguauuaacuauuag

SEQ ID NO: 1613975 - RNA, 13 nt, Homo sapiens
aacuuaccuuguu

SEQ ID NO: 1613976 - RNA, 20 nt, Homo sapiens
aacuuaccuuguuaagacaa

SEQ ID NO: 1613977 - RNA, 24 nt, Homo sapiens
aacuuagaaggauggcaucuccau

SEQ ID NO: 1613978 - RNA, 23 nt, Homo sapiens
aacuuagccauuuuucaaagcaa

SEQ ID NO: 1613979 - RNA, 19 nt, Homo sapiens
aacuuauaacccacuuuaa

SEQ ID NO: 1613980 - RNA, 16 nt, Homo sapiens
aacuuauggacuguuu

SEQ ID NO: 1613981 - RNA, 12 nt, Homo sapiens
aacuucaaagag

SEQ ID NO: 1613982 - RNA, 13 nt, Homo sapiens
aacuucaaagagg

SEQ ID NO: 1613983 - RNA, 15 nt, Homo sapiens
aacuucaaagaggaa

SEQ ID NO: 1613984 - RNA, 16 nt, Homo sapiens
aacuucaccuacauua

SEQ ID NO: 1613985 - RNA, 20 nt, Homo sapiens
aacuucaccuacauuaucuc

SEQ ID NO: 1613986 - RNA, 19 nt, Homo sapiens
aacuuccgcugaggggucu

SEQ ID NO: 1613987 - RNA, 20 nt, Homo sapiens
aacuucuccuuagacacuuu

SEQ ID NO: 1613988 - RNA, 22 nt, Homo sapiens
aacuugaaauauauaauauuca

SEQ ID NO: 1613989 - RNA, 13 nt, Homo sapiens
aacuugcaauacc

SEQ ID NO: 1613990 - RNA, 14 nt, Homo sapiens
aacuugcaauacca

SEQ ID NO: 1613991 - RNA, 16 nt, Homo sapiens
aacuugcaauaccaau

SEQ ID NO: 1613992 - RNA, 20 nt, Homo sapiens
aacuugcaauaccaauguuc

SEQ ID NO: 1613993 - RNA, 19 nt, Homo sapiens
aacuugcuucuaaaugccc

SEQ ID NO: 1613994 - RNA, 16 nt, Homo sapiens
aacuugggcuacugaa

SEQ ID NO: 1613995 - RNA, 21 nt, Homo sapiens
aacuuggucugcagaccaucc

SEQ ID NO: 1613996 - RNA, 15 nt, Homo sapiens
aacuuguauuuccaa

SEQ ID NO: 1613997 - RNA, 18 nt, Homo sapiens
aacuuguggccucaagca

SEQ ID NO: 1613998 - RNA, 23 nt, Homo sapiens
aacuuuaccaaaugaaaugccaa

SEQ ID NO: 1613999 - RNA, 22 nt, Homo sapiens
aacuuuacuguccuaacauggu

SEQ ID NO: 1614000 - RNA, 21 nt, Homo sapiens
aacuuuagcaacaguuaucac

SEQ ID NO: 1614001 - RNA, 15 nt, Homo sapiens
aacuuuaguuugccu

SEQ ID NO: 1614002 - RNA, 18 nt, Homo sapiens
aacuuucuguccuaauca

SEQ ID NO: 1614003 - RNA, 20 nt, Homo sapiens
aacuuugaauaaagaauacu

SEQ ID NO: 1614004 - RNA, 16 nt, Homo sapiens
aacuuuuauuacuggg

SEQ ID NO: 1614005 - RNA, 17 nt, Homo sapiens
aacuuuugguaucuacu

SEQ ID NO: 1614006 - RNA, 20 nt, Homo sapiens
aacuuuuuuuccuugugguu

SEQ ID NO: 1614007 - RNA, 14 nt, Homo sapiens
aagaaaaauaucuu

SEQ ID NO: 1614008 - RNA, 15 nt, Homo sapiens
aagaaaauaucacug

SEQ ID NO: 1614009 - RNA, 13 nt, Homo sapiens
aagaaaaucacuu

SEQ ID NO: 1614010 - RNA, 14 nt, Homo sapiens
aagaaaauccauua

SEQ ID NO: 1614011 - RNA, 14 nt, Homo sapiens
aagaaaauccauuc

SEQ ID NO: 1614012 - RNA, 22 nt, Homo sapiens
aagaaaauuuugggguaaaaag

SEQ ID NO: 1614013 - RNA, 17 nt, Homo sapiens
aagaaacacccuuucau

SEQ ID NO: 1614014 - RNA, 15 nt, Homo sapiens
aagaaacaguugaau

SEQ ID NO: 1614015 - RNA, 15 nt, Homo sapiens
aagaaacgucuucua

SEQ ID NO: 1614016 - RNA, 16 nt, Homo sapiens
aagaaagaucaaagac

SEQ ID NO: 1614017 - RNA, 21 nt, Homo sapiens
aagaaagucuaucuaaugaca

SEQ ID NO: 1614018 - RNA, 14 nt, Homo sapiens
aagaaaucaugaua

SEQ ID NO: 1614019 - RNA, 23 nt, Homo sapiens
aagaaauguaagggaaacugcca

SEQ ID NO: 1614020 - RNA, 20 nt, Homo sapiens
aagaacagagucucaggaca

SEQ ID NO: 1614021 - RNA, 14 nt, Homo sapiens
aagaacaugcaguu

SEQ ID NO: 1614022 - RNA, 21 nt, Homo sapiens
aagaaccaaggaaucauguca

SEQ ID NO: 1614023 - RNA, 17 nt, Homo sapiens
aagaacgcgacuuccac

SEQ ID NO: 1614024 - RNA, 12 nt, Homo sapiens
aagaagaaagca

SEQ ID NO: 1614025 - RNA, 21 nt, Homo sapiens
aagaagacuguugccacuuaa

SEQ ID NO: 1614026 - RNA, 22 nt, Homo sapiens
aagaagagcgagagaucaaaga

SEQ ID NO: 1614027 - RNA, 13 nt, Homo sapiens
aagaaggaacaau

SEQ ID NO: 1614028 - RNA, 20 nt, Homo sapiens
aagaaggauaccaaauacca

SEQ ID NO: 1614029 - RNA, 15 nt, Homo sapiens
aagaaggcaauauua

SEQ ID NO: 1614030 - RNA, 11 nt, Homo sapiens
aagaaggcauu

SEQ ID NO: 1614031 - RNA, 20 nt, Homo sapiens
aagaaggccagcaacauugg

SEQ ID NO: 1614032 - RNA, 15 nt, Homo sapiens
aagaaggcucacaga

SEQ ID NO: 1614033 - RNA, 20 nt, Homo sapiens
aagaagucggaaugucauag

SEQ ID NO: 1614034 - RNA, 20 nt, Homo sapiens
aagaagucuuggaaacagac

SEQ ID NO: 1614035 - RNA, 14 nt, Homo sapiens
aagaauaccaauau

SEQ ID NO: 1614036 - RNA, 15 nt, Homo sapiens
aagaauacuucucau

SEQ ID NO: 1614037 - RNA, 17 nt, Homo sapiens
aagaauaugacuuuuua

SEQ ID NO: 1614038 - RNA, 19 nt, Homo sapiens
aagaaucuuagauaacuuc

SEQ ID NO: 1614039 - RNA, 22 nt, Homo sapiens
aagaauguuuggcacucucuaa

SEQ ID NO: 1614040 - RNA, 15 nt, Homo sapiens
aagaauuccaaagca

SEQ ID NO: 1614041 - RNA, 17 nt, Homo sapiens
aagaauugaacccagga

SEQ ID NO: 1614042 - RNA, 21 nt, Homo sapiens
aagaauuuaagacuugugcuu

SEQ ID NO: 1614043 - RNA, 21 nt, Homo sapiens
aagacaauaauucuacauguu

SEQ ID NO: 1614044 - RNA, 18 nt, Homo sapiens
aagacacaucuuauugaa

SEQ ID NO: 1614045 - RNA, 21 nt, Homo sapiens
aagacacauugacuccuuucc

SEQ ID NO: 1614046 - RNA, 22 nt, Homo sapiens
aagacaggcaaauguacuucuc

SEQ ID NO: 1614047 - RNA, 17 nt, Homo sapiens
aagacagggcuucucuc

SEQ ID NO: 1614048 - RNA, 20 nt, Homo sapiens
aagacauacuccuuccauca

SEQ ID NO: 1614049 - RNA, 15 nt, Homo sapiens
aagacaucagucucc

SEQ ID NO: 1614050 - RNA, 13 nt, Homo sapiens
aagacaucugccu

SEQ ID NO: 1614051 - RNA, 22 nt, Homo sapiens
gccaugaguuccagaaaguaaa

SEQ ID NO: 1614052 - RNA, 21 nt, Homo sapiens
gccaugcaacgggauugaagg

SEQ ID NO: 1614053 - RNA, 18 nt, Homo sapiens
gccaugccuggagacaua

SEQ ID NO: 1614054 - RNA, 22 nt, Homo sapiens
gccaugcucaaccccccuccca

SEQ ID NO: 1614055 - RNA, 14 nt, Homo sapiens
gccaugggguccau

SEQ ID NO: 1614056 - RNA, 13 nt, Homo sapiens
gccauguccaaag

SEQ ID NO: 1614057 - RNA, 13 nt, Homo sapiens
gccaugucucaga

SEQ ID NO: 1614058 - RNA, 15 nt, Homo sapiens
gccauuacaccagaa

SEQ ID NO: 1614059 - RNA, 19 nt, Homo sapiens
gccauucugugcaggcugc

SEQ ID NO: 1614060 - RNA, 15 nt, Homo sapiens
gccauugcauuccag

SEQ ID NO: 1614061 - RNA, 14 nt, Homo sapiens
gcccaacagcacuu

SEQ ID NO: 1614062 - RNA, 16 nt, Homo sapiens
gcccaagguugcacag

SEQ ID NO: 1614063 - RNA, 17 nt, Homo sapiens
gcccaccacaacuaaca

SEQ ID NO: 1614064 - RNA, 17 nt, Homo sapiens
gcccacggcucaaguga

SEQ ID NO: 1614065 - RNA, 17 nt, Homo sapiens
gcccacugaggggccag

SEQ ID NO: 1614066 - RNA, 14 nt, Homo sapiens
gcccacuggccgcu

SEQ ID NO: 1614067 - RNA, 19 nt, Homo sapiens
gcccacuucuucucagaaa

SEQ ID NO: 1614068 - RNA, 20 nt, Homo sapiens
gcccagaagaaaauucuccu

SEQ ID NO: 1614069 - RNA, 14 nt, Homo sapiens
gcccagacccagug

SEQ ID NO: 1614070 - RNA, 15 nt, Homo sapiens
gcccagacugaugag

SEQ ID NO: 1614071 - RNA, 16 nt, Homo sapiens
gcccagaggcuccauc

SEQ ID NO: 1614072 - RNA, 16 nt, Homo sapiens
gcccagaugacauccc

SEQ ID NO: 1614073 - RNA, 22 nt, Homo sapiens
gcccagccaggccaacagcacc

SEQ ID NO: 1614074 - RNA, 15 nt, Homo sapiens
gcccagccugcucuc

SEQ ID NO: 1614075 - RNA, 21 nt, Homo sapiens
gcccagcuuucaaaggacaaa

SEQ ID NO: 1614076 - RNA, 22 nt, Homo sapiens
gcccaggagccucacuggggca

SEQ ID NO: 1614077 - RNA, 17 nt, Homo sapiens
gcccaggccacagagaa

SEQ ID NO: 1614078 - RNA, 21 nt, Homo sapiens
gcacaauuaauuaaaagugaa

SEQ ID NO: 1614079 - RNA, 22 nt, Homo sapiens
gcacaauuaauuaaaagugaaa

SEQ ID NO: 1614080 - RNA, 23 nt, Homo sapiens
gcacaauuaauuaaaagugaaac

SEQ ID NO: 1614081 - RNA, 13 nt, Homo sapiens
gcacacacugugc

SEQ ID NO: 1614082 - RNA, 22 nt, Homo sapiens
gcacacccuccagagacaacag

SEQ ID NO: 1614083 - RNA, 22 nt, Homo sapiens
gcacacugccagucucacugug

SEQ ID NO: 1614084 - RNA, 18 nt, Homo sapiens
gcacacuggcucacccag

SEQ ID NO: 1614085 - RNA, 23 nt, Homo sapiens
gcacagcaggcugccagugccug

SEQ ID NO: 1614086 - RNA, 15 nt, Homo sapiens
gcacagcuaauucua

SEQ ID NO: 1614087 - RNA, 21 nt, Homo sapiens
gcacagggcagcugggcccaa

SEQ ID NO: 1614088 - RNA, 20 nt, Homo sapiens
gcacagggcucccaggccag

SEQ ID NO: 1614089 - RNA, 19 nt, Homo sapiens
gcacagucauacaagucau

SEQ ID NO: 1614090 - RNA, 16 nt, Homo sapiens
gcacaguccagaccca

SEQ ID NO: 1614091 - RNA, 14 nt, Homo sapiens
gcacauauugagaa

SEQ ID NO: 1614092 - RNA, 21 nt, Homo sapiens
gcacaucaauuacaagcugua

SEQ ID NO: 1614093 - RNA, 13 nt, Homo sapiens
gcacauguauuga

SEQ ID NO: 1614094 - RNA, 19 nt, Homo sapiens
gcacaugugccacuguuca

SEQ ID NO: 1614095 - RNA, 20 nt, Homo sapiens
gcacaugugccacuguucag

SEQ ID NO: 1614096 - RNA, 15 nt, Homo sapiens
gcacauuaacuucug

SEQ ID NO: 1614097 - RNA, 22 nt, Homo sapiens
gcacauuuucagacugcaauau

SEQ ID NO: 1614098 - RNA, 17 nt, Homo sapiens
gcaccaaagacaucagu

SEQ ID NO: 1614099 - RNA, 19 nt, Homo sapiens
gcaccaaucagcacucugu

SEQ ID NO: 1614100 - RNA, 22 nt, Homo sapiens
gcaccaaucuuguuuauagcaa

SEQ ID NO: 1614101 - RNA, 14 nt, Homo sapiens
gcaccagacacuca

SEQ ID NO: 1614102 - RNA, 18 nt, Homo sapiens
gcaccagagggauaaaaa

SEQ ID NO: 1614103 - RNA, 23 nt, Homo sapiens
gcaccagugggacuguggugacu

SEQ ID NO: 1614104 - RNA, 20 nt, Homo sapiens
gcacccccugcuccaccagc

SEQ ID NO: 1614105 - RNA, 21 nt, Homo sapiens
gcaccuaccuuagaaaacaag

SEQ ID NO: 1614106 - RNA, 22 nt, Homo sapiens
gcacgccaacauggcacaugua

SEQ ID NO: 1614107 - RNA, 23 nt, Homo sapiens
gcacgccaacauggcacauguau

SEQ ID NO: 1614108 - RNA, 18 nt, Homo sapiens
gcucagaaggaauggugc

SEQ ID NO: 1614109 - RNA, 16 nt, Homo sapiens
gcucagacuugccagg

SEQ ID NO: 1614110 - RNA, 16 nt, Homo sapiens
gcucagagaugugcac

SEQ ID NO: 1614111 - RNA, 23 nt, Homo sapiens
gcucagcuucuucuuucauucua

SEQ ID NO: 1614112 - RNA, 18 nt, Homo sapiens
gcucaggagccaccagca

SEQ ID NO: 1614113 - RNA, 15 nt, Homo sapiens
gcucaggcacauaca

SEQ ID NO: 1614114 - RNA, 17 nt, Homo sapiens
gcucaguuggugcugcu

SEQ ID NO: 1614115 - RNA, 10 nt, Homo sapiens
gcucaugccc

SEQ ID NO: 1614116 - RNA, 18 nt, Homo sapiens
gcucauguaccucugauu

SEQ ID NO: 1614117 - RNA, 14 nt, Homo sapiens
gcuccagcaccuuc

SEQ ID NO: 1614118 - RNA, 15 nt, Homo sapiens
gcuccaucaaugagg

SEQ ID NO: 1614119 - RNA, 19 nt, Homo sapiens
gcuccaucguccauccucu

SEQ ID NO: 1614120 - RNA, 13 nt, Homo sapiens
gcuccauguagaa

SEQ ID NO: 1614121 - RNA, 20 nt, Homo sapiens
gcuccauguagaagccacua

SEQ ID NO: 1614122 - RNA, 20 nt, Homo sapiens
gcuccauugguguugacaua

SEQ ID NO: 1614123 - RNA, 22 nt, Homo sapiens
gcucccacaaugcugaugaaaa

SEQ ID NO: 1614124 - RNA, 23 nt, Homo sapiens
gcuccccacgauaagcaccagug

SEQ ID NO: 1614125 - RNA, 19 nt, Homo sapiens
gcucccccuccagccagag

SEQ ID NO: 1614126 - RNA, 20 nt, Homo sapiens
gcuccuccuugcccagacua

SEQ ID NO: 1614127 - RNA, 21 nt, Homo sapiens
gcuccugauauaacacuuucc

SEQ ID NO: 1614128 - RNA, 21 nt, Homo sapiens
gcuccugcccaggccacagag

SEQ ID NO: 1614129 - RNA, 16 nt, Homo sapiens
gcucgcuacacuacuc

SEQ ID NO: 1614130 - RNA, 19 nt, Homo sapiens
gcucgcuacacuacuccug

SEQ ID NO: 1614131 - RNA, 17 nt, Homo sapiens
gcucggaacacauucuc

SEQ ID NO: 1614132 - RNA, 22 nt, Homo sapiens
cuucuuauggaauugauuugca

SEQ ID NO: 1614133 - RNA, 14 nt, Homo sapiens
cuucuuauuaauca

SEQ ID NO: 1614134 - RNA, 17 nt, Homo sapiens
cuucuucauccauagac

SEQ ID NO: 1614135 - RNA, 18 nt, Homo sapiens
cuucuucccucccuaucu

SEQ ID NO: 1614136 - RNA, 14 nt, Homo sapiens
cuucuuccuuguag

SEQ ID NO: 1614137 - RNA, 21 nt, Homo sapiens
cuucuuggucucagugucaau

SEQ ID NO: 1614138 - RNA, 20 nt, Homo sapiens
cuucuuucauucuaauccuu

SEQ ID NO: 1614139 - RNA, 18 nt, Homo sapiens
cuugaaaaaaaacagugg

SEQ ID NO: 1614140 - RNA, 13 nt, Homo sapiens
cuugaaaugaugg

SEQ ID NO: 1614141 - RNA, 22 nt, Homo sapiens
cuugaacaagaugugggccuug

SEQ ID NO: 1614142 - RNA, 17 nt, Homo sapiens
cuugaacucuguucccc

SEQ ID NO: 1614143 - RNA, 13 nt, Homo sapiens
cuugaagcacaga

SEQ ID NO: 1614144 - RNA, 15 nt, Homo sapiens
cuugaagccaaagaa

SEQ ID NO: 1614145 - RNA, 22 nt, Homo sapiens
cuugaauacucugcccucuaga

SEQ ID NO: 1614146 - RNA, 23 nt, Homo sapiens
cuugaauacucugcccucuagag

SEQ ID NO: 1614147 - RNA, 12 nt, Homo sapiens
cuugaaugccau

SEQ ID NO: 1614148 - RNA, 21 nt, Homo sapiens
cuugaaugccauagucaaaga

SEQ ID NO: 1614149 - RNA, 16 nt, Homo sapiens
cuugaauguggcuuga

SEQ ID NO: 1614150 - RNA, 22 nt, Homo sapiens
cuugaauuccauggaauuucua

SEQ ID NO: 1614151 - RNA, 14 nt, Homo sapiens
cuugacaaucaucu

SEQ ID NO: 1614152 - RNA, 13 nt, Homo sapiens
cuugacugcauug

SEQ ID NO: 1614153 - RNA, 14 nt, Homo sapiens
cuugagaagcugcc

SEQ ID NO: 1614154 - RNA, 22 nt, Homo sapiens
cuugagaaggucacuacugcau

SEQ ID NO: 1614155 - RNA, 23 nt, Homo sapiens
cuugaguuguuuaaacagucaaa

SEQ ID NO: 1614156 - RNA, 18 nt, Homo sapiens
cuugauggaaauugacca

SEQ ID NO: 1614157 - RNA, 12 nt, Homo sapiens
cuugauucucuc

SEQ ID NO: 1614158 - RNA, 14 nt, Homo sapiens
cuugcaaucuaauc

SEQ ID NO: 1614159 - RNA, 16 nt, Homo sapiens
cuugcaauguagucaa

SEQ ID NO: 1614160 - RNA, 18 nt, Homo sapiens
cuugcaauguagucaaua

SEQ ID NO: 1614161 - RNA, 20 nt, Homo sapiens
cuugcaccacuuccguccca

SEQ ID NO: 1614162 - RNA, 23 nt, Homo sapiens
cuugccaccccacccucccugga

SEQ ID NO: 1614163 - RNA, 19 nt, Homo sapiens
cuugcccagacuacagggc

SEQ ID NO: 1614164 - RNA, 16 nt, Homo sapiens
cuugcccagcuuucaa

SEQ ID NO: 1614165 - RNA, 15 nt, Homo sapiens
cuugccuaggcgauu

SEQ ID NO: 1614166 - RNA, 18 nt, Homo sapiens
cuugcucaaaaucuguga

SEQ ID NO: 1614167 - RNA, 18 nt, Homo sapiens
cuugcuggaacacagggg

SEQ ID NO: 1614168 - RNA, 22 nt, Homo sapiens
cuugcuguuaaaaauaauuaca

SEQ ID NO: 1614169 - RNA, 13 nt, Homo sapiens
cuugcuguuuuca

SEQ ID NO: 1614170 - RNA, 19 nt, Homo sapiens
cuugcuucuaaaugcccag

SEQ ID NO: 1614171 - RNA, 15 nt, Homo sapiens
cuuggaacuguccca

SEQ ID NO: 1614172 - RNA, 15 nt, Homo sapiens
cuuggaccucaguga

SEQ ID NO: 1614173 - RNA, 15 nt, Homo sapiens
cuuggagcaaucaga

SEQ ID NO: 1614174 - RNA, 21 nt, Homo sapiens
cuuggaggaccuuggccuguu

SEQ ID NO: 1614175 - RNA, 19 nt, Homo sapiens
cuuggaguaaaacuguaua

SEQ ID NO: 1614176 - RNA, 23 nt, Homo sapiens
cuuggauagcuaauaaugagcua

SEQ ID NO: 1614177 - RNA, 13 nt, Homo sapiens
cuuggccucccaa

SEQ ID NO: 1614178 - RNA, 14 nt, Homo sapiens
cuuggcugacauga

SEQ ID NO: 1614179 - RNA, 15 nt, Homo sapiens
cuugggauugucuua

SEQ ID NO: 1614180 - RNA, 24 nt, Homo sapiens
cuugggcucccacauaagcacuag

SEQ ID NO: 1614181 - RNA, 15 nt, Homo sapiens
cuugggggucagggg

SEQ ID NO: 1614182 - RNA, 16 nt, Homo sapiens
cuugggggucaggggg

SEQ ID NO: 1614183 - RNA, 17 nt, Homo sapiens
cuuggucugcagaccau

SEQ ID NO: 1614184 - RNA, 17 nt, Homo sapiens
cuuggucuguacaaaua

SEQ ID NO: 1614185 - RNA, 18 nt, Homo sapiens
cuuggugacaaaauucau

SEQ ID NO: 1614186 - RNA, 23 nt, Homo sapiens
cuuguaaaaugcuuuucacuuuc

SEQ ID NO: 1614187 - RNA, 13 nt, Homo sapiens
cuuguaaggggaa

SEQ ID NO: 1614188 - RNA, 18 nt, Homo sapiens
cuuguagaaagugaggcu

SEQ ID NO: 1614189 - RNA, 20 nt, Homo sapiens
cuuguauaaugaacauguua

SEQ ID NO: 1614190 - RNA, 20 nt, Homo sapiens
cuuguauauauggaucagag

SEQ ID NO: 1614191 - RNA, 14 nt, Homo sapiens
cuuguauuuccaaa

SEQ ID NO: 1614192 - RNA, 19 nt, Homo sapiens
cuugucaagccugugcaaa

SEQ ID NO: 1614193 - RNA, 18 nt, Homo sapiens
cuuguccgcaagggguga

SEQ ID NO: 1614194 - RNA, 21 nt, Homo sapiens
cuugucucugggccacuugga

SEQ ID NO: 1614195 - RNA, 13 nt, Homo sapiens
cuugucugugauc

SEQ ID NO: 1614196 - RNA, 17 nt, Homo sapiens
cuugugcuuagcuuuca

SEQ ID NO: 1614197 - RNA, 20 nt, Homo sapiens
cuugugugauguuuuacaca

SEQ ID NO: 1614198 - RNA, 21 nt, Homo sapiens
cuuguguucacccgugggugu

SEQ ID NO: 1614199 - RNA, 13 nt, Homo sapiens
cuuguucuacuga

SEQ ID NO: 1614200 - RNA, 16 nt, Homo sapiens
cuuguucuacugagaa

SEQ ID NO: 1614201 - RNA, 12 nt, Homo sapiens
cuuguugcugca

SEQ ID NO: 1614202 - RNA, 16 nt, Homo sapiens
cuuguuuacagcacua

SEQ ID NO: 1614203 - RNA, 24 nt, Homo sapiens
cuuguuuacagcacuacucugugc

SEQ ID NO: 1614204 - RNA, 21 nt, Homo sapiens
cuuuaaaaaagcaaauuucau

SEQ ID NO: 1614205 - RNA, 13 nt, Homo sapiens
cuuuaaaacaaaa

SEQ ID NO: 1614206 - RNA, 20 nt, Homo sapiens
cuuuaaaauauaucuggaac

SEQ ID NO: 1614207 - RNA, 14 nt, Homo sapiens
cuuuaaaucuguga

SEQ ID NO: 1614208 - RNA, 16 nt, Homo sapiens
cuuuaaaucugugaug

SEQ ID NO: 1614209 - RNA, 18 nt, Homo sapiens
cuuuaaaugacaguaaua

SEQ ID NO: 1614210 - RNA, 16 nt, Homo sapiens
cuuuaaccuaugauaa

SEQ ID NO: 1614211 - RNA, 22 nt, Homo sapiens
cuuuaaucuccuauuccuucac

SEQ ID NO: 1614212 - RNA, 18 nt, Homo sapiens
cuuuaaugauaacuaaaa

SEQ ID NO: 1614213 - RNA, 16 nt, Homo sapiens
cuuuaauuaccaguuu

SEQ ID NO: 1614214 - RNA, 19 nt, Homo sapiens
cuuuaauucuguaucugua

SEQ ID NO: 1614215 - RNA, 22 nt, Homo sapiens
cuuuacaacuaaauaacacaga

SEQ ID NO: 1614216 - RNA, 12 nt, Homo sapiens
cuuuaccaugcu

SEQ ID NO: 1614217 - RNA, 19 nt, Homo sapiens
cuuuaccuaaauaugagcc

SEQ ID NO: 1614218 - RNA, 19 nt, Homo sapiens
cuuuacuauuuauuuacau

SEQ ID NO: 1614219 - RNA, 20 nt, Homo sapiens
cuuuacuccguaacagauuu

SEQ ID NO: 1614220 - RNA, 15 nt, Homo sapiens
cuuuagacuucccac

SEQ ID NO: 1614221 - RNA, 19 nt, Homo sapiens
cuuuagcaacaguuaucac

SEQ ID NO: 1614222 - RNA, 12 nt, Homo sapiens
gaaccacauauu

SEQ ID NO: 1614223 - RNA, 13 nt, Homo sapiens
gaaccacuaugaa

SEQ ID NO: 1614224 - RNA, 17 nt, Homo sapiens
gaaccauuauacuuuau

SEQ ID NO: 1614225 - RNA, 19 nt, Homo sapiens
gaaccauucacagugcaag

SEQ ID NO: 1614226 - RNA, 18 nt, Homo sapiens
gaaccucgccauaaggca

SEQ ID NO: 1614227 - RNA, 21 nt, Homo sapiens
gaaccugagcuauuuuccucu

SEQ ID NO: 1614228 - RNA, 18 nt, Homo sapiens
gaacgcccucaugcucag

SEQ ID NO: 1614229 - RNA, 19 nt, Homo sapiens
gaacgcgacuuccacaaac

SEQ ID NO: 1614230 - RNA, 21 nt, Homo sapiens
gaacggaggaggacaugggga

SEQ ID NO: 1614231 - RNA, 20 nt, Homo sapiens
gaacguuuuuccuguucuua

SEQ ID NO: 1614232 - RNA, 21 nt, Homo sapiens
gaacuaaagugcugcacucaa

SEQ ID NO: 1614233 - RNA, 20 nt, Homo sapiens
gaacuacggggcuuacagga

SEQ ID NO: 1614234 - RNA, 16 nt, Homo sapiens
gaacuagaaccuggag

SEQ ID NO: 1614235 - RNA, 14 nt, Homo sapiens
gaacucaccauaga

SEQ ID NO: 1614236 - RNA, 23 nt, Homo sapiens
gaacucagcacauucgggaccaa

SEQ ID NO: 1614237 - RNA, 19 nt, Homo sapiens
gaacucauuugaaugcuua

SEQ ID NO: 1614238 - RNA, 12 nt, Homo sapiens
gaacuccacugc

SEQ ID NO: 1614239 - RNA, 17 nt, Homo sapiens
gaacuccacugcaagag

SEQ ID NO: 1614240 - RNA, 14 nt, Homo sapiens
gaacuccugaccuu

SEQ ID NO: 1614241 - RNA, 15 nt, Homo sapiens
gaacucucaaaucca

SEQ ID NO: 1614242 - RNA, 14 nt, Homo sapiens
gaacucugguggca

SEQ ID NO: 1614243 - RNA, 23 nt, Homo sapiens
gaacucuuucuuugguauuccau

SEQ ID NO: 1614244 - RNA, 14 nt, Homo sapiens
gaacugagggcucu

SEQ ID NO: 1614245 - RNA, 19 nt, Homo sapiens
gaacuuacuguagccucag

SEQ ID NO: 1614246 - RNA, 18 nt, Homo sapiens
gaacuucaggugugacuc

SEQ ID NO: 1614247 - RNA, 20 nt, Homo sapiens
gaacuugcaauaccaauguu

SEQ ID NO: 1614248 - RNA, 23 nt, Homo sapiens
gaacuuuaagaagcaguguuuua

SEQ ID NO: 1614249 - RNA, 14 nt, Homo sapiens
gaacuuuuguacug

SEQ ID NO: 1614250 - RNA, 14 nt, Homo sapiens
gaagaaagcaacaa

SEQ ID NO: 1614251 - RNA, 19 nt, Homo sapiens
gaagaacaacaaagacaug

SEQ ID NO: 1614252 - RNA, 19 nt, Homo sapiens
gaagaacaagaaauggaug

SEQ ID NO: 1614253 - RNA, 16 nt, Homo sapiens
gaagaaccaaauaccu

SEQ ID NO: 1614254 - RNA, 17 nt, Homo sapiens
gaagaaccaaauaccuc

SEQ ID NO: 1614255 - RNA, 20 nt, Homo sapiens
gaagaacggggcucuucuca

SEQ ID NO: 1614256 - RNA, 21 nt, Homo sapiens
cuuagccauuuuucaaagcaa

SEQ ID NO: 1614257 - RNA, 16 nt, Homo sapiens
cuuaggauggggcucc

SEQ ID NO: 1614258 - RNA, 15 nt, Homo sapiens
cuuagggacagucaa

SEQ ID NO: 1614259 - RNA, 23 nt, Homo sapiens
cuuagggcagauuuucaugcaaa

SEQ ID NO: 1614260 - RNA, 12 nt, Homo sapiens
cuuaguaaaauu

SEQ ID NO: 1614261 - RNA, 21 nt, Homo sapiens
cuuaguaaguaauaucaaagc

SEQ ID NO: 1614262 - RNA, 18 nt, Homo sapiens
cuuaguguccuucuuaac

SEQ ID NO: 1614263 - RNA, 14 nt, Homo sapiens
cuuaguugaaauga

SEQ ID NO: 1614264 - RNA, 18 nt, Homo sapiens
cuuauaagaaagaucaaa

SEQ ID NO: 1614265 - RNA, 19 nt, Homo sapiens
cuuauaagaaagaucaaag

SEQ ID NO: 1614266 - RNA, 20 nt, Homo sapiens
cuuauaagaaagaucaaaga

SEQ ID NO: 1614267 - RNA, 18 nt, Homo sapiens
cuuauauucauccaugcc

SEQ ID NO: 1614268 - RNA, 17 nt, Homo sapiens
cuuaucaggauaccaga

SEQ ID NO: 1614269 - RNA, 15 nt, Homo sapiens
cuuauccugcauugu

SEQ ID NO: 1614270 - RNA, 15 nt, Homo sapiens
cuuaucucucaaaac

SEQ ID NO: 1614271 - RNA, 16 nt, Homo sapiens
cuuaucugauacuuau

SEQ ID NO: 1614272 - RNA, 21 nt, Homo sapiens
cuuaucuuuauuggcuugaua

SEQ ID NO: 1614273 - RNA, 20 nt, Homo sapiens
cuuaugaaaagaauuugaug

SEQ ID NO: 1614274 - RNA, 22 nt, Homo sapiens
cuuaugaaaauuauacugagaa

SEQ ID NO: 1614275 - RNA, 18 nt, Homo sapiens
cuuauggggugagaauau

SEQ ID NO: 1614276 - RNA, 14 nt, Homo sapiens
cuuauguugcacaa

SEQ ID NO: 1614277 - RNA, 18 nt, Homo sapiens
cuuauuacauauuuacac

SEQ ID NO: 1614278 - RNA, 15 nt, Homo sapiens
cuuauucauuccuca

SEQ ID NO: 1614279 - RNA, 18 nt, Homo sapiens
cuuauuuuaccuucucau

SEQ ID NO: 1614280 - RNA, 21 nt, Homo sapiens
cuuauuuugugugcuuuccca

SEQ ID NO: 1614281 - RNA, 21 nt, Homo sapiens
cuucaaaauaaaaaguaauga

SEQ ID NO: 1614282 - RNA, 15 nt, Homo sapiens
cuucaaaauauugag

SEQ ID NO: 1614283 - RNA, 21 nt, Homo sapiens
cuucaaagucucaaugaaaua

SEQ ID NO: 1614284 - RNA, 13 nt, Homo sapiens
cuucaaauucaaa

SEQ ID NO: 1614285 - RNA, 14 nt, Homo sapiens
cuucaacaugacau

SEQ ID NO: 1614286 - RNA, 18 nt, Homo sapiens
cuucaacaugacauccag

SEQ ID NO: 1614287 - RNA, 21 nt, Homo sapiens
cuucaacaugacauccagaga

SEQ ID NO: 1614288 - RNA, 14 nt, Homo sapiens
cuucaacccagugg

SEQ ID NO: 1614289 - RNA, 15 nt, Homo sapiens
cuucaagagcaucug

SEQ ID NO: 1614290 - RNA, 19 nt, Homo sapiens
cuucaagagcaucuggaac

SEQ ID NO: 1614291 - RNA, 14 nt, Homo sapiens
cuucaagugccaaa

SEQ ID NO: 1614292 - RNA, 15 nt, Homo sapiens
cuucaagugccaaac

SEQ ID NO: 1614293 - RNA, 13 nt, Homo sapiens
cuucaauacuuaa

SEQ ID NO: 1614294 - RNA, 15 nt, Homo sapiens
cuucacacaguucaa

SEQ ID NO: 1614295 - RNA, 18 nt, Homo sapiens
cuucaccaagugaucaaa

SEQ ID NO: 1614296 - RNA, 20 nt, Homo sapiens
cuucacgauuaacugugaaa

SEQ ID NO: 1614297 - RNA, 19 nt, Homo sapiens
cuucacgggcaaucaugag

SEQ ID NO: 1614298 - RNA, 13 nt, Homo sapiens
cuucacuauacaa

SEQ ID NO: 1614299 - RNA, 16 nt, Homo sapiens
cuucacucaggucuca

SEQ ID NO: 1614300 - RNA, 11 nt, Homo sapiens
cuucacuguau

SEQ ID NO: 1614301 - RNA, 22 nt, Homo sapiens
cuucagaacugcccuugcugcc

SEQ ID NO: 1614302 - RNA, 13 nt, Homo sapiens
cuucagcaaguua

SEQ ID NO: 1614303 - RNA, 18 nt, Homo sapiens
cuucagccuuaauggaag

SEQ ID NO: 1614304 - RNA, 15 nt, Homo sapiens
cuucaggacucuaga

SEQ ID NO: 1614305 - RNA, 17 nt, Homo sapiens
cuucagggaacugcaua

SEQ ID NO: 1614306 - RNA, 18 nt, Homo sapiens
cuucagggcugaguucug

SEQ ID NO: 1614307 - RNA, 14 nt, Homo sapiens
cuucagucaagaaa

SEQ ID NO: 1614308 - RNA, 17 nt, Homo sapiens
cuucagucuugguaaaa

SEQ ID NO: 1614309 - RNA, 15 nt, Homo sapiens
cuucauauaccagca

SEQ ID NO: 1614310 - RNA, 20 nt, Homo sapiens
cuucauaugaaaggugccau

SEQ ID NO: 1614311 - RNA, 15 nt, Homo sapiens
cuucauccguuguga

SEQ ID NO: 1614312 - RNA, 21 nt, Homo sapiens
cuucaucuggcaacaucuuua

SEQ ID NO: 1614313 - RNA, 19 nt, Homo sapiens
cuucaucuucacugcaauu

SEQ ID NO: 1614314 - RNA, 20 nt, Homo sapiens
cuucaugcuugacauaccua

SEQ ID NO: 1614315 - RNA, 19 nt, Homo sapiens
cuucauggaucagaucugg

SEQ ID NO: 1614316 - RNA, 16 nt, Homo sapiens
cuucauguaaauugac

SEQ ID NO: 1614317 - RNA, 23 nt, Homo sapiens
cuucaugucaucaaaaucugcac

SEQ ID NO: 1614318 - RNA, 19 nt, Homo sapiens
cuucauuuuguauaaucac

SEQ ID NO: 1614319 - RNA, 20 nt, Homo sapiens
cuucauuuuuuaaugugcuc

SEQ ID NO: 1614320 - RNA, 22 nt, Homo sapiens
cuuccagaaccaacugcauugg

SEQ ID NO: 1614321 - RNA, 20 nt, Homo sapiens
cuuccagcggcucacaaaga

SEQ ID NO: 1614322 - RNA, 20 nt, Homo sapiens
cuuccagugcccuaggccug

SEQ ID NO: 1614323 - RNA, 18 nt, Homo sapiens
cuuccaucaucacuguaa

SEQ ID NO: 1614324 - RNA, 11 nt, Homo sapiens
cuuccauuugc

SEQ ID NO: 1614325 - RNA, 17 nt, Homo sapiens
cuucccaaaaacagccc

SEQ ID NO: 1614326 - RNA, 20 nt, Homo sapiens
cuucccaaguagcugggauu

SEQ ID NO: 1614327 - RNA, 15 nt, Homo sapiens
cuucccacggcuccu

SEQ ID NO: 1614328 - RNA, 23 nt, Homo sapiens
cuucccauuguggcuccuaucug

SEQ ID NO: 1614329 - RNA, 15 nt, Homo sapiens
cuuccccagacccag

SEQ ID NO: 1614330 - RNA, 21 nt, Homo sapiens
cuuccccagguccuuccuuua

SEQ ID NO: 1614331 - RNA, 15 nt, Homo sapiens
cuuccccgugcccua

SEQ ID NO: 1614332 - RNA, 18 nt, Homo sapiens
cuuccccuggcacuggca

SEQ ID NO: 1614333 - RNA, 17 nt, Homo sapiens
cuucccucucaugacuu

SEQ ID NO: 1614334 - RNA, 21 nt, Homo sapiens
cuucccucucugcagacuucc

SEQ ID NO: 1614335 - RNA, 15 nt, Homo sapiens
cuucccuguucuccc

SEQ ID NO: 1614336 - RNA, 20 nt, Homo sapiens
cuuccgggaaaacagcuauu

SEQ ID NO: 1614337 - RNA, 23 nt, Homo sapiens
cuuccguggucagagugccacug

SEQ ID NO: 1614338 - RNA, 14 nt, Homo sapiens
cuuccuaggucaug

SEQ ID NO: 1614339 - RNA, 15 nt, Homo sapiens
cuuccuauuagugac

SEQ ID NO: 1614340 - RNA, 20 nt, Homo sapiens
cuuccucaaauacaugcaca

SEQ ID NO: 1614341 - RNA, 14 nt, Homo sapiens
cuuccucaugaauc

SEQ ID NO: 1614342 - RNA, 22 nt, Homo sapiens
cuuccucccuggugugaacucu

SEQ ID NO: 1614343 - RNA, 13 nt, Homo sapiens
cuuccucugguaa

SEQ ID NO: 1614344 - RNA, 14 nt, Homo sapiens
cuuccugcguagaa

SEQ ID NO: 1614345 - RNA, 14 nt, Homo sapiens
cuuccuggguccug

SEQ ID NO: 1614346 - RNA, 19 nt, Homo sapiens
cuuccuguggccugaagaa

SEQ ID NO: 1614347 - RNA, 19 nt, Homo sapiens
cuuccuuagccuugcucag

SEQ ID NO: 1614348 - RNA, 19 nt, Homo sapiens
cuuccuuugucguguuucu

SEQ ID NO: 1614349 - RNA, 14 nt, Homo sapiens
cuaagacauauuca

SEQ ID NO: 1614350 - RNA, 17 nt, Homo sapiens
cuaagauaauuuacuua

SEQ ID NO: 1614351 - RNA, 15 nt, Homo sapiens
cuaagcagaccacug

SEQ ID NO: 1614352 - RNA, 15 nt, Homo sapiens
cuaaggaggggaaaa

SEQ ID NO: 1614353 - RNA, 17 nt, Homo sapiens
cuaaggcucuauuuccu

SEQ ID NO: 1614354 - RNA, 18 nt, Homo sapiens
cuaaguaaaaccacagca

SEQ ID NO: 1614355 - RNA, 22 nt, Homo sapiens
cugucaagaagaggaaagggag

SEQ ID NO: 1614356 - RNA, 20 nt, Homo sapiens
cugucaauguccuacugaga

SEQ ID NO: 1614357 - RNA, 19 nt, Homo sapiens
cugucacguagaacuugga

SEQ ID NO: 1614358 - RNA, 21 nt, Homo sapiens
cugucacuagucucaccagcc

SEQ ID NO: 1614359 - RNA, 17 nt, Homo sapiens
cugucagaugucacaua

SEQ ID NO: 1614360 - RNA, 13 nt, Homo sapiens
cugucagccugac

SEQ ID NO: 1614361 - RNA, 12 nt, Homo sapiens
cugucaguucuc

SEQ ID NO: 1614362 - RNA, 18 nt, Homo sapiens
cugucauauaauuuugaa

SEQ ID NO: 1614363 - RNA, 15 nt, Homo sapiens
cugucauuacgucaa

SEQ ID NO: 1614364 - RNA, 20 nt, Homo sapiens
cuguccacccugccaagacu

SEQ ID NO: 1614365 - RNA, 22 nt, Homo sapiens
cuguccaugaagcacugagcag

SEQ ID NO: 1614366 - RNA, 14 nt, Homo sapiens
cugucccaccccua

SEQ ID NO: 1614367 - RNA, 21 nt, Homo sapiens
cugucccaccccuaccucuag

SEQ ID NO: 1614368 - RNA, 16 nt, Homo sapiens
cuguccccacugcccc

SEQ ID NO: 1614369 - RNA, 17 nt, Homo sapiens
cuguccccuucucucau

SEQ ID NO: 1614370 - RNA, 19 nt, Homo sapiens
cuguccguaguaucagaga

SEQ ID NO: 1614371 - RNA, 19 nt, Homo sapiens
cuguccuaaggaaccuucc

SEQ ID NO: 1614372 - RNA, 19 nt, Homo sapiens
cuguccuguuucugucaag

SEQ ID NO: 1614373 - RNA, 20 nt, Homo sapiens
cugucgcaugagaacauuaa

SEQ ID NO: 1614374 - RNA, 14 nt, Homo sapiens
cugucuacauuucu

SEQ ID NO: 1614375 - RNA, 17 nt, Homo sapiens
cugucuagagcaacuuu

SEQ ID NO: 1614376 - RNA, 16 nt, Homo sapiens
cugucuauacuacagu

SEQ ID NO: 1614377 - RNA, 16 nt, Homo sapiens
cugucucaacuacuca

SEQ ID NO: 1614378 - RNA, 13 nt, Homo sapiens
cugucuccauggc

SEQ ID NO: 1614379 - RNA, 18 nt, Homo sapiens
cugucugaguaguggcca

SEQ ID NO: 1614380 - RNA, 17 nt, Homo sapiens
cugucuggcccugggga

SEQ ID NO: 1614381 - RNA, 19 nt, Homo sapiens
cugucuuacuauuauagca

SEQ ID NO: 1614382 - RNA, 19 nt, Homo sapiens
cugucuucagagaacccac

SEQ ID NO: 1614383 - RNA, 13 nt, Homo sapiens
cugugaaauacca

SEQ ID NO: 1614384 - RNA, 17 nt, Homo sapiens
cugugaaauaccacaag

SEQ ID NO: 1614385 - RNA, 22 nt, Homo sapiens
cugugaaaucauaaaguccuuu

SEQ ID NO: 1614386 - RNA, 16 nt, Homo sapiens
cugugaauuaagccca

SEQ ID NO: 1614387 - RNA, 15 nt, Homo sapiens
cugugacuaccucaa

SEQ ID NO: 1614388 - RNA, 21 nt, Homo sapiens
cugugaggggcucucucauga

SEQ ID NO: 1614389 - RNA, 14 nt, Homo sapiens
cugugcacaugccu

SEQ ID NO: 1614390 - RNA, 22 nt, Homo sapiens
cugugcaggccugucccuggga

SEQ ID NO: 1614391 - RNA, 22 nt, Homo sapiens
cugugcagguggggagacuggg

SEQ ID NO: 1614392 - RNA, 20 nt, Homo sapiens
cugugcauacuuucccucau

SEQ ID NO: 1614393 - RNA, 22 nt, Homo sapiens
cugugccaauacagacaaagca

SEQ ID NO: 1614394 - RNA, 16 nt, Homo sapiens
cugugccaucagcucc

SEQ ID NO: 1614395 - RNA, 15 nt, Homo sapiens
cugugcccagcaugc

SEQ ID NO: 1614396 - RNA, 19 nt, Homo sapiens
cugugcccaguacuuccug

SEQ ID NO: 1614397 - RNA, 17 nt, Homo sapiens
cugugccuggcucccug

SEQ ID NO: 1614398 - RNA, 14 nt, Homo sapiens
cugugccuuuugcc

SEQ ID NO: 1614399 - RNA, 19 nt, Homo sapiens
cugugcuguauuuugauau

SEQ ID NO: 1614400 - RNA, 14 nt, Homo sapiens
cuguggaagcuuug

SEQ ID NO: 1614401 - RNA, 16 nt, Homo sapiens
cuguggcggugccugg

SEQ ID NO: 1614402 - RNA, 15 nt, Homo sapiens
cuguggggacugaac

SEQ ID NO: 1614403 - RNA, 18 nt, Homo sapiens
cuguguaccucacugucc

SEQ ID NO: 1614404 - RNA, 21 nt, Homo sapiens
cuguguauaucucuuggaaaa

SEQ ID NO: 1614405 - RNA, 19 nt, Homo sapiens
cugugucugccugucccca

SEQ ID NO: 1614406 - RNA, 19 nt, Homo sapiens
cuguguggacuucaucuca

SEQ ID NO: 1614407 - RNA, 17 nt, Homo sapiens
cuguguggcugugcaau

SEQ ID NO: 1614408 - RNA, 16 nt, Homo sapiens
cuguguugaagcacug

SEQ ID NO: 1614409 - RNA, 15 nt, Homo sapiens
cuguguuuccaucuc

SEQ ID NO: 1614410 - RNA, 15 nt, Homo sapiens
cuguuaaaugaacuu

SEQ ID NO: 1614411 - RNA, 15 nt, Homo sapiens
cuguuaacuuuugua

SEQ ID NO: 1614412 - RNA, 16 nt, Homo sapiens
cuguuaccaaaucuca

SEQ ID NO: 1614413 - RNA, 13 nt, Homo sapiens
cuguuaguauuaa

SEQ ID NO: 1614414 - RNA, 17 nt, Homo sapiens
cuguucagagcacucau

SEQ ID NO: 1614415 - RNA, 22 nt, Homo sapiens
cuguuccauaggaaggcuguga

SEQ ID NO: 1614416 - RNA, 19 nt, Homo sapiens
cuguucugaaaggagacau

SEQ ID NO: 1614417 - RNA, 16 nt, Homo sapiens
cuguucuuaacacuuc

SEQ ID NO: 1614418 - RNA, 16 nt, Homo sapiens
cuguucuuuuguccca

SEQ ID NO: 1614419 - RNA, 13 nt, Homo sapiens
cuguugaaucaca

SEQ ID NO: 1614420 - RNA, 13 nt, Homo sapiens
cuguugacaaaug

SEQ ID NO: 1614421 - RNA, 15 nt, Homo sapiens
cuguugacaaaugac

SEQ ID NO: 1614422 - RNA, 14 nt, Homo sapiens
cuguugcuuuacag

SEQ ID NO: 1614423 - RNA, 17 nt, Homo sapiens
cuguuggcaaggugaca

SEQ ID NO: 1614424 - RNA, 16 nt, Homo sapiens
cuguuuaaaaaaccac

SEQ ID NO: 1614425 - RNA, 15 nt, Homo sapiens
cuguuugcuguggaa

SEQ ID NO: 1614426 - RNA, 12 nt, Homo sapiens
cuguuugucaau

SEQ ID NO: 1614427 - RNA, 15 nt, Homo sapiens
cuguuugugggguga

SEQ ID NO: 1614428 - RNA, 18 nt, Homo sapiens
cuuaaaaaaauaugccuu

SEQ ID NO: 1614429 - RNA, 13 nt, Homo sapiens
cuuaaaaauuuau

SEQ ID NO: 1614430 - RNA, 11 nt, Homo sapiens
cuuaaaacacu

SEQ ID NO: 1614431 - RNA, 14 nt, Homo sapiens
cuuaaaacuauaac

SEQ ID NO: 1614432 - RNA, 13 nt, Homo sapiens
cuuaaaauaguuu

SEQ ID NO: 1614433 - RNA, 15 nt, Homo sapiens
cuuaaaaugcaauau

SEQ ID NO: 1614434 - RNA, 14 nt, Homo sapiens
cuuaaacacacauu

SEQ ID NO: 1614435 - RNA, 15 nt, Homo sapiens
cuuaaacccauacaa

SEQ ID NO: 1614436 - RNA, 15 nt, Homo sapiens
cuuaaacuugaccca

SEQ ID NO: 1614437 - RNA, 16 nt, Homo sapiens
cuuaaagcauuucagg

SEQ ID NO: 1614438 - RNA, 17 nt, Homo sapiens
cuuaaagggucuuauga

SEQ ID NO: 1614439 - RNA, 13 nt, Homo sapiens
cuuaaaguauaau

SEQ ID NO: 1614440 - RNA, 22 nt, Homo sapiens
cuuaaauauauauuucuaauau

SEQ ID NO: 1614441 - RNA, 12 nt, Homo sapiens
cuuaacacuucc

SEQ ID NO: 1614442 - RNA, 12 nt, Homo sapiens
cuuaacauucau

SEQ ID NO: 1614443 - RNA, 16 nt, Homo sapiens
cuuaacauuccuaaaa

SEQ ID NO: 1614444 - RNA, 13 nt, Homo sapiens
cuuaacauuucau

SEQ ID NO: 1614445 - RNA, 19 nt, Homo sapiens
cuuaacauuucauuguaca

SEQ ID NO: 1614446 - RNA, 14 nt, Homo sapiens
cuuaaccuuuccag

SEQ ID NO: 1614447 - RNA, 21 nt, Homo sapiens
cuuaagagauuggaucaagua

SEQ ID NO: 1614448 - RNA, 15 nt, Homo sapiens
cuuaagcacaauuaa

SEQ ID NO: 1614449 - RNA, 22 nt, Homo sapiens
cuuaauaagauauuuaguaaua

SEQ ID NO: 1614450 - RNA, 21 nt, Homo sapiens
cuuaauacuaaggaaccaaca

SEQ ID NO: 1614451 - RNA, 13 nt, Homo sapiens
cuggaaucaaaua

SEQ ID NO: 1614452 - RNA, 23 nt, Homo sapiens
cuggaauugauauugaaugaugu

SEQ ID NO: 1614453 - RNA, 21 nt, Homo sapiens
cuggacaaagaaauuccccaa

SEQ ID NO: 1614454 - RNA, 18 nt, Homo sapiens
cuggacacaauaggucuu

SEQ ID NO: 1614455 - RNA, 16 nt, Homo sapiens
cuggacauucgaggaa

SEQ ID NO: 1614456 - RNA, 14 nt, Homo sapiens
cuggaccaagcaca

SEQ ID NO: 1614457 - RNA, 22 nt, Homo sapiens
cuggacggcaggcucacugcca

SEQ ID NO: 1614458 - RNA, 18 nt, Homo sapiens
cuggagacaaggugcuaa

SEQ ID NO: 1614459 - RNA, 16 nt, Homo sapiens
cuggagagugcacaug

SEQ ID NO: 1614460 - RNA, 20 nt, Homo sapiens
cuggagauaugaaggauuac

SEQ ID NO: 1614461 - RNA, 22 nt, Homo sapiens
cuggagaugcagcuacuggaau

SEQ ID NO: 1614462 - RNA, 15 nt, Homo sapiens
cuggagcaguggacu

SEQ ID NO: 1614463 - RNA, 22 nt, Homo sapiens
cuggagccggggugggugugcu

SEQ ID NO: 1614464 - RNA, 19 nt, Homo sapiens
cuggagccugcauuaugca

SEQ ID NO: 1614465 - RNA, 20 nt, Homo sapiens
cuggagggcuagaaucugga

SEQ ID NO: 1614466 - RNA, 23 nt, Homo sapiens
cuggagggguggcccagagccau

SEQ ID NO: 1614467 - RNA, 21 nt, Homo sapiens
cuggagucccaaaugucauca

SEQ ID NO: 1614468 - RNA, 20 nt, Homo sapiens
cuggagugcaguggcgcgau

SEQ ID NO: 1614469 - RNA, 19 nt, Homo sapiens
cuaggagcugggaggaaaa

SEQ ID NO: 1614470 - RNA, 13 nt, Homo sapiens
cuaggaugugaug

SEQ ID NO: 1614471 - RNA, 22 nt, Homo sapiens
cuaggcaccucagaccaaucau

SEQ ID NO: 1614472 - RNA, 16 nt, Homo sapiens
cuaggccugaaaugac

SEQ ID NO: 1614473 - RNA, 18 nt, Homo sapiens
cuaggccugaaaugacau

SEQ ID NO: 1614474 - RNA, 22 nt, Homo sapiens
cuaggcguuuguuauauaaaaa

SEQ ID NO: 1614475 - RNA, 15 nt, Homo sapiens
cuaggguacaugucc

SEQ ID NO: 1614476 - RNA, 22 nt, Homo sapiens
cuagggucuugggggucagggg

SEQ ID NO: 1614477 - RNA, 20 nt, Homo sapiens
cccacuguucugaaaggaga

SEQ ID NO: 1614478 - RNA, 22 nt, Homo sapiens
ccuguggguuugguccuugaac

SEQ ID NO: 1614479 - RNA, 14 nt, Homo sapiens
ccuguguacaacuu

SEQ ID NO: 1614480 - RNA, 18 nt, Homo sapiens
cacaagugucugugcaug

SEQ ID NO: 1614481 - RNA, 12 nt, Homo sapiens
cacaaugccaga

SEQ ID NO: 1614482 - RNA, 15 nt, Homo sapiens
cacaaugcugaugaa

SEQ ID NO: 1614483 - RNA, 11 nt, Homo sapiens
cacacaaugcc

SEQ ID NO: 1614484 - RNA, 18 nt, Homo sapiens
cacacacaaaaacagaaa

SEQ ID NO: 1614485 - RNA, 19 nt, Homo sapiens
cacacacagccugucccug

SEQ ID NO: 1614486 - RNA, 13 nt, Homo sapiens
cacacacaugcau

SEQ ID NO: 1614487 - RNA, 14 nt, Homo sapiens
cacacacaugcaua

SEQ ID NO: 1614488 - RNA, 22 nt, Homo sapiens
cacacacccugagcuuuugcca

SEQ ID NO: 1614489 - RNA, 12 nt, Homo sapiens
cacacacugugc

SEQ ID NO: 1614490 - RNA, 15 nt, Homo sapiens
cacacaggucucauu

SEQ ID NO: 1614491 - RNA, 14 nt, Homo sapiens
cacacauccuguca

SEQ ID NO: 1614492 - RNA, 19 nt, Homo sapiens
cacacauccugucaguguc

SEQ ID NO: 1614493 - RNA, 17 nt, Homo sapiens
cacacauucugccuugg

SEQ ID NO: 1614494 - RNA, 12 nt, Homo sapiens
cacaccaaucag

SEQ ID NO: 1614495 - RNA, 13 nt, Homo sapiens
cacaccaaucagc

SEQ ID NO: 1614496 - RNA, 13 nt, Homo sapiens
cacaccagagaca

SEQ ID NO: 1614497 - RNA, 23 nt, Homo sapiens
cacaccuggcauggugcagggag

SEQ ID NO: 1614498 - RNA, 16 nt, Homo sapiens
cacacgaguuccagac

SEQ ID NO: 1614499 - RNA, 17 nt, Homo sapiens
cacacuaagagggcaga

SEQ ID NO: 1614500 - RNA, 21 nt, Homo sapiens
cacacuauuucccucuacuga

SEQ ID NO: 1614501 - RNA, 10 nt, Homo sapiens
cacacugaga

SEQ ID NO: 1614502 - RNA, 17 nt, Homo sapiens
cacacugcccugucucc

SEQ ID NO: 1614503 - RNA, 14 nt, Homo sapiens
cacacugguacuua

SEQ ID NO: 1614504 - RNA, 16 nt, Homo sapiens
cacacuuuuggaacca

SEQ ID NO: 1614505 - RNA, 16 nt, Homo sapiens
cacagaaaauaaggca

SEQ ID NO: 1614506 - RNA, 21 nt, Homo sapiens
cacagaaagcuccuuccagac

SEQ ID NO: 1614507 - RNA, 14 nt, Homo sapiens
cacagaaaucacag

SEQ ID NO: 1614508 - RNA, 22 nt, Homo sapiens
cacagaaccuuugucaacuuca

SEQ ID NO: 1614509 - RNA, 18 nt, Homo sapiens
cacagagcaaguccucac

SEQ ID NO: 1614510 - RNA, 20 nt, Homo sapiens
cacagagcaggacugcacag

SEQ ID NO: 1614511 - RNA, 12 nt, Homo sapiens
cacagauaagua

SEQ ID NO: 1614512 - RNA, 21 nt, Homo sapiens
cacagcaagucacuggccagu

SEQ ID NO: 1614513 - RNA, 18 nt, Homo sapiens
cacagcagacaccauuca

SEQ ID NO: 1614514 - RNA, 14 nt, Homo sapiens
cacagcagcauuuu

SEQ ID NO: 1614515 - RNA, 15 nt, Homo sapiens
cacagcaucagcuca

SEQ ID NO: 1614516 - RNA, 17 nt, Homo sapiens
cacagccaacgagacac

SEQ ID NO: 1614517 - RNA, 14 nt, Homo sapiens
cacagcccaagagg

SEQ ID NO: 1614518 - RNA, 15 nt, Homo sapiens
cacagcccaggccac

SEQ ID NO: 1614519 - RNA, 14 nt, Homo sapiens
cacagcguccuguc

SEQ ID NO: 1614520 - RNA, 15 nt, Homo sapiens
cacagcuaaccacuu

SEQ ID NO: 1614521 - RNA, 14 nt, Homo sapiens
cacaggcuccccau

SEQ ID NO: 1614522 - RNA, 17 nt, Homo sapiens
cacagggagugcacaua

SEQ ID NO: 1614523 - RNA, 14 nt, Homo sapiens
cacaguagaacugu

SEQ ID NO: 1614524 - RNA, 21 nt, Homo sapiens
cacaguagaacugucugugaa

SEQ ID NO: 1614525 - RNA, 20 nt, Homo sapiens
cacagucaauggauccacaa

SEQ ID NO: 1614526 - RNA, 13 nt, Homo sapiens
cacagucacuggc

SEQ ID NO: 1614527 - RNA, 11 nt, Homo sapiens
cacagugcaag

SEQ ID NO: 1614528 - RNA, 21 nt, Homo sapiens
cacaguggauggacggacaag

SEQ ID NO: 1614529 - RNA, 17 nt, Homo sapiens
cacaguucacaugccac

SEQ ID NO: 1614530 - RNA, 15 nt, Homo sapiens
cacaguuguguuccu

SEQ ID NO: 1614531 - RNA, 17 nt, Homo sapiens
cacaguuguguuccuga

SEQ ID NO: 1614532 - RNA, 16 nt, Homo sapiens
cacauacuugcagcuc

SEQ ID NO: 1614533 - RNA, 20 nt, Homo sapiens
cacauagaacugaacuguaa

SEQ ID NO: 1614534 - RNA, 18 nt, Homo sapiens
cacauaguucuguaauaa

SEQ ID NO: 1614535 - RNA, 18 nt, Homo sapiens
cacaucaagacuaucuac

SEQ ID NO: 1614536 - RNA, 21 nt, Homo sapiens
cacaucaauuacaagcuguag

SEQ ID NO: 1614537 - RNA, 21 nt, Homo sapiens
cacaucccauugggacuccau

SEQ ID NO: 1614538 - RNA, 20 nt, Homo sapiens
cacaucccuauagaccacug

SEQ ID NO: 1614539 - RNA, 16 nt, Homo sapiens
cacaucuaaagcuuua

SEQ ID NO: 1614540 - RNA, 14 nt, Homo sapiens
cacaugaggccauc

SEQ ID NO: 1614541 - RNA, 21 nt, Homo sapiens
cacaugauaccucugaucaag

SEQ ID NO: 1614542 - RNA, 15 nt, Homo sapiens
cacaugaugugcaua

SEQ ID NO: 1614543 - RNA, 16 nt, Homo sapiens
cacaugcccaugauga

SEQ ID NO: 1614544 - RNA, 12 nt, Homo sapiens
cacaugcugucu

SEQ ID NO: 1614545 - RNA, 12 nt, Homo sapiens
cacauggcuuag

SEQ ID NO: 1614546 - RNA, 12 nt, Homo sapiens
cacaugugaugu

SEQ ID NO: 1614547 - RNA, 13 nt, Homo sapiens
cacauucuucagu

SEQ ID NO: 1614548 - RNA, 20 nt, Homo sapiens
cacauugcugugaacaggaa

SEQ ID NO: 1614549 - RNA, 20 nt, Homo sapiens
cacauuuagaaaagugaauu

SEQ ID NO: 1614550 - RNA, 20 nt, Homo sapiens
cacauuugggauguuccuuu

SEQ ID NO: 1614551 - RNA, 13 nt, Homo sapiens
cacauuuuacucu

SEQ ID NO: 1614552 - RNA, 18 nt, Homo sapiens
caccaaaucuauuugaaa

SEQ ID NO: 1614553 - RNA, 18 nt, Homo sapiens
caccaagcugcucuccuu

SEQ ID NO: 1614554 - RNA, 20 nt, Homo sapiens
caccaaggaacucuacuuca

SEQ ID NO: 1614555 - RNA, 13 nt, Homo sapiens
caccaagugcaau

SEQ ID NO: 1614556 - RNA, 16 nt, Homo sapiens
caccaaugaaaacaug

SEQ ID NO: 1614557 - RNA, 21 nt, Homo sapiens
caccaaugaaaacauguacua

SEQ ID NO: 1614558 - RNA, 17 nt, Homo sapiens
caccaccccaguuuccu

SEQ ID NO: 1614559 - RNA, 14 nt, Homo sapiens
caccacugauauca

SEQ ID NO: 1614560 - RNA, 17 nt, Homo sapiens
caccagagacaagcaga

SEQ ID NO: 1614561 - RNA, 23 nt, Homo sapiens
caccagagggauaaaaacaauac

SEQ ID NO: 1614562 - RNA, 15 nt, Homo sapiens
caccagcaccaacac

SEQ ID NO: 1614563 - RNA, 21 nt, Homo sapiens
caccagccauacuuaucucuc

SEQ ID NO: 1614564 - RNA, 14 nt, Homo sapiens
caccagccaugugc

SEQ ID NO: 1614565 - RNA, 14 nt, Homo sapiens
caccagcccugaag

SEQ ID NO: 1614566 - RNA, 20 nt, Homo sapiens
caccagcccugaccccagug

SEQ ID NO: 1614567 - RNA, 19 nt, Homo sapiens
caccaggacugaaagaaga

SEQ ID NO: 1614568 - RNA, 15 nt, Homo sapiens
caccaggagauuaca

SEQ ID NO: 1614569 - RNA, 13 nt, Homo sapiens
caccagggagcag

SEQ ID NO: 1614570 - RNA, 12 nt, Homo sapiens
caccaggggugc

SEQ ID NO: 1614571 - RNA, 17 nt, Homo sapiens
caccaggggugcacaau

SEQ ID NO: 1614572 - RNA, 20 nt, Homo sapiens
caccagugguacuaagcaca

SEQ ID NO: 1614573 - RNA, 11 nt, Homo sapiens
caccaguucuc

SEQ ID NO: 1614574 - RNA, 18 nt, Homo sapiens
caccaugcuugccugaag

SEQ ID NO: 1614575 - RNA, 13 nt, Homo sapiens
caccauguuggcc

SEQ ID NO: 1614576 - RNA, 18 nt, Homo sapiens
caccauguuugagcucag

SEQ ID NO: 1614577 - RNA, 14 nt, Homo sapiens
caccauucauucca

SEQ ID NO: 1614578 - RNA, 17 nt, Homo sapiens
caccauucauuccaugu

SEQ ID NO: 1614579 - RNA, 18 nt, Homo sapiens
caccauucgucaucacuc

SEQ ID NO: 1614580 - RNA, 22 nt, Homo sapiens
caccauuuaauuucauguauau

SEQ ID NO: 1614581 - RNA, 13 nt, Homo sapiens
cacccaaagcauu

SEQ ID NO: 1614582 - RNA, 22 nt, Homo sapiens
cacccaaauguaaaaauccuuu

SEQ ID NO: 1614583 - RNA, 12 nt, Homo sapiens
cacccaccaggc

SEQ ID NO: 1614584 - RNA, 16 nt, Homo sapiens
cacccaccucaccaaa

SEQ ID NO: 1614585 - RNA, 12 nt, Homo sapiens
cacccaggcaau

SEQ ID NO: 1614586 - RNA, 15 nt, Homo sapiens
cacccaggcaggugc

SEQ ID NO: 1614587 - RNA, 18 nt, Homo sapiens
cacccaucagcacucugu

SEQ ID NO: 1614588 - RNA, 19 nt, Homo sapiens
caccccaucuuugcugcca

SEQ ID NO: 1614589 - RNA, 20 nt, Homo sapiens
cacccccuucucugcuccac

SEQ ID NO: 1614590 - RNA, 21 nt, Homo sapiens
caccccggggacccugugaca

SEQ ID NO: 1614591 - RNA, 14 nt, Homo sapiens
caccccuaccucua

SEQ ID NO: 1614592 - RNA, 17 nt, Homo sapiens
caccccuaccucuagua

SEQ ID NO: 1614593 - RNA, 18 nt, Homo sapiens
cacccucaucgggcgcua

SEQ ID NO: 1614594 - RNA, 21 nt, Homo sapiens
caguuccacagcagugucaca

SEQ ID NO: 1614595 - RNA, 19 nt, Homo sapiens
caguucccuccuucuuaca

SEQ ID NO: 1614596 - RNA, 23 nt, Homo sapiens
caguuccuagcacugccccacau

SEQ ID NO: 1614597 - RNA, 18 nt, Homo sapiens
caguucucugccacccau

SEQ ID NO: 1614598 - RNA, 13 nt, Homo sapiens
caguucugugguu

SEQ ID NO: 1614599 - RNA, 23 nt, Homo sapiens
caguugagcuucauauaccagca

SEQ ID NO: 1614600 - RNA, 22 nt, Homo sapiens
caguugcucaaaaagaaaucaa

SEQ ID NO: 1614601 - RNA, 19 nt, Homo sapiens
caguuggacucucagggau

SEQ ID NO: 1614602 - RNA, 22 nt, Homo sapiens
caguuggcacuguaaggugcuu

SEQ ID NO: 1614603 - RNA, 21 nt, Homo sapiens
caguuggcaugguaguauaca

SEQ ID NO: 1614604 - RNA, 15 nt, Homo sapiens
caguuggugcugcuu

SEQ ID NO: 1614605 - RNA, 22 nt, Homo sapiens
caguuuaaaagcacgacagugg

SEQ ID NO: 1614606 - RNA, 17 nt, Homo sapiens
caguuuaggaguacuga

SEQ ID NO: 1614607 - RNA, 17 nt, Homo sapiens
caguuuccuggggcaca

SEQ ID NO: 1614608 - RNA, 19 nt, Homo sapiens
caguuucuaggcaccucag

SEQ ID NO: 1614609 - RNA, 13 nt, Homo sapiens
caguuucucagaa

SEQ ID NO: 1614610 - RNA, 19 nt, Homo sapiens
caguuugacuucuuugaga

SEQ ID NO: 1614611 - RNA, 14 nt, Homo sapiens
caguuugcuugaua

SEQ ID NO: 1614612 - RNA, 16 nt, Homo sapiens
caguuuggagucacug

SEQ ID NO: 1614613 - RNA, 17 nt, Homo sapiens
caguuuggagucacugu

SEQ ID NO: 1614614 - RNA, 22 nt, Homo sapiens
caguuuuuauuaaucuacugua

SEQ ID NO: 1614615 - RNA, 14 nt, Homo sapiens
caguuuuucacuuc

SEQ ID NO: 1614616 - RNA, 21 nt, Homo sapiens
cauaaaaauaaaucaguucau

SEQ ID NO: 1614617 - RNA, 20 nt, Homo sapiens
cauaaaaguuggcucaggag

SEQ ID NO: 1614618 - RNA, 18 nt, Homo sapiens
cauaaauugguauaauaa

SEQ ID NO: 1614619 - RNA, 15 nt, Homo sapiens
cauaaccugucucac

SEQ ID NO: 1614620 - RNA, 21 nt, Homo sapiens
cauaacugaaaaugugcuaua

SEQ ID NO: 1614621 - RNA, 19 nt, Homo sapiens
cauaacuuauugcugauuu

SEQ ID NO: 1614622 - RNA, 15 nt, Homo sapiens
cauaagaaagcacua

SEQ ID NO: 1614623 - RNA, 18 nt, Homo sapiens
cauaagcuacugccaucc

SEQ ID NO: 1614624 - RNA, 22 nt, Homo sapiens
cauaagcucaguaacugugcau

SEQ ID NO: 1614625 - RNA, 13 nt, Homo sapiens
cauaaguagcauu

SEQ ID NO: 1614626 - RNA, 21 nt, Homo sapiens
cauaauaaaaggaguucagau

SEQ ID NO: 1614627 - RNA, 15 nt, Homo sapiens
cauaauagucaauuu

SEQ ID NO: 1614628 - RNA, 19 nt, Homo sapiens
cauaaucaauauaaucuga

SEQ ID NO: 1614629 - RNA, 21 nt, Homo sapiens
cauaaugcuuuggaaaaaugg

SEQ ID NO: 1614630 - RNA, 16 nt, Homo sapiens
cauaauuacuauguca

SEQ ID NO: 1614631 - RNA, 19 nt, Homo sapiens
cauaauucuuuugaaaaua

SEQ ID NO: 1614632 - RNA, 15 nt, Homo sapiens
cauacaaaucaucca

SEQ ID NO: 1614633 - RNA, 14 nt, Homo sapiens
cauacaaguuucau

SEQ ID NO: 1614634 - RNA, 15 nt, Homo sapiens
cauacaauggccaac

SEQ ID NO: 1614635 - RNA, 14 nt, Homo sapiens
cauacaguuuucau

SEQ ID NO: 1614636 - RNA, 16 nt, Homo sapiens
cauacaucauuccaca

SEQ ID NO: 1614637 - RNA, 13 nt, Homo sapiens
cauacauguuaca

SEQ ID NO: 1614638 - RNA, 22 nt, Homo sapiens
cauaccaaugaaaaaauguaua

SEQ ID NO: 1614639 - RNA, 19 nt, Homo sapiens
cauacgagagcagaggucu

SEQ ID NO: 1614640 - RNA, 21 nt, Homo sapiens
cauacuacauugaguagacac

SEQ ID NO: 1614641 - RNA, 17 nt, Homo sapiens
cauacuagaguucaugg

SEQ ID NO: 1614642 - RNA, 21 nt, Homo sapiens
cauacucccuauuuucauucc

SEQ ID NO: 1614643 - RNA, 13 nt, Homo sapiens
cauacuguucuca

SEQ ID NO: 1614644 - RNA, 17 nt, Homo sapiens
cauacuuaacauuucau

SEQ ID NO: 1614645 - RNA, 16 nt, Homo sapiens
cauagaaauauugacu

SEQ ID NO: 1614646 - RNA, 22 nt, Homo sapiens
cauagacaaaggccuuaacaaa

SEQ ID NO: 1614647 - RNA, 14 nt, Homo sapiens
cauagacaauuccu

SEQ ID NO: 1614648 - RNA, 22 nt, Homo sapiens
cauagagcuuuuuaauagcacu

SEQ ID NO: 1614649 - RNA, 23 nt, Homo sapiens
cauagagcuuuuuaauagcacua

SEQ ID NO: 1614650 - RNA, 15 nt, Homo sapiens
cauagauugcaaaua

SEQ ID NO: 1614651 - RNA, 20 nt, Homo sapiens
cauagcucaccaggacuguu

SEQ ID NO: 1614652 - RNA, 22 nt, Homo sapiens
cauagggcaugauuaacaaagc

SEQ ID NO: 1614653 - RNA, 18 nt, Homo sapiens
cauagguugagcaauuuc

SEQ ID NO: 1614654 - RNA, 22 nt, Homo sapiens
cauaguagguacccaauucaau

SEQ ID NO: 1614655 - RNA, 14 nt, Homo sapiens
cauagucauuuagg

SEQ ID NO: 1614656 - RNA, 18 nt, Homo sapiens
cauagucuuuguuuacau

SEQ ID NO: 1614657 - RNA, 21 nt, Homo sapiens
cauagucuuuguuuacaugag

SEQ ID NO: 1614658 - RNA, 19 nt, Homo sapiens
cauagugaccuguguuuca

SEQ ID NO: 1614659 - RNA, 19 nt, Homo sapiens
cauaguguuaacugucagu

SEQ ID NO: 1614660 - RNA, 15 nt, Homo sapiens
cauauaaauguaaua

SEQ ID NO: 1614661 - RNA, 15 nt, Homo sapiens
cauauaauuaaaaag

SEQ ID NO: 1614662 - RNA, 23 nt, Homo sapiens
cauauaccacccauagugcuuca

SEQ ID NO: 1614663 - RNA, 21 nt, Homo sapiens
cauauaccagaggaaagacca

SEQ ID NO: 1614664 - RNA, 19 nt, Homo sapiens
cauauaucaagguuucaau

SEQ ID NO: 1614665 - RNA, 12 nt, Homo sapiens
cauauaucacua

SEQ ID NO: 1614666 - RNA, 13 nt, Homo sapiens
cauauaucuauua

SEQ ID NO: 1614667 - RNA, 19 nt, Homo sapiens
cauauaugugaucugggca

SEQ ID NO: 1614668 - RNA, 21 nt, Homo sapiens
cauauauuuagccccauuaca

SEQ ID NO: 1614669 - RNA, 22 nt, Homo sapiens
cauauauuuagccccauuacac

SEQ ID NO: 1614670 - RNA, 18 nt, Homo sapiens
cauaucauuaaacaaaua

SEQ ID NO: 1614671 - RNA, 17 nt, Homo sapiens
cauaucccuuccucuca

SEQ ID NO: 1614672 - RNA, 23 nt, Homo sapiens
cauaucuaacuuuguaaccagaa

SEQ ID NO: 1614673 - RNA, 11 nt, Homo sapiens
cauaucuccau

SEQ ID NO: 1614674 - RNA, 20 nt, Homo sapiens
cauaucuccuuccccuacac

SEQ ID NO: 1614675 - RNA, 18 nt, Homo sapiens
cauaucuuaaaacuaaau

SEQ ID NO: 1614676 - RNA, 19 nt, Homo sapiens
cauaugaaaggugccaugg

SEQ ID NO: 1614677 - RNA, 14 nt, Homo sapiens
cauaugauacugau

SEQ ID NO: 1614678 - RNA, 13 nt, Homo sapiens
cauauuaucucau

SEQ ID NO: 1614679 - RNA, 21 nt, Homo sapiens
cauauugaucuuuuuaucaug

SEQ ID NO: 1614680 - RNA, 18 nt, Homo sapiens
cauauuggaauguacaug

SEQ ID NO: 1614681 - RNA, 16 nt, Homo sapiens
cauauuuaaugaugau

SEQ ID NO: 1614682 - RNA, 20 nt, Homo sapiens
caucaaacauuggauuuuuc

SEQ ID NO: 1614683 - RNA, 17 nt, Homo sapiens
caucaaagugguaaaua

SEQ ID NO: 1614684 - RNA, 13 nt, Homo sapiens
caucaagcuccac

SEQ ID NO: 1614685 - RNA, 12 nt, Homo sapiens
caucaauagugu

SEQ ID NO: 1614686 - RNA, 16 nt, Homo sapiens
caucaaugcaauaaga

SEQ ID NO: 1614687 - RNA, 17 nt, Homo sapiens
caucacccaagccacaa

SEQ ID NO: 1614688 - RNA, 23 nt, Homo sapiens
caucacccgggaacuuuuuuaga

SEQ ID NO: 1614689 - RNA, 18 nt, Homo sapiens
caucacuccucugucaua

SEQ ID NO: 1614690 - RNA, 17 nt, Homo sapiens
caucacuguaaagacaa

SEQ ID NO: 1614691 - RNA, 18 nt, Homo sapiens
caucacuguaaagacaaa

SEQ ID NO: 1614692 - RNA, 19 nt, Homo sapiens
caucagacugucaagaaga

SEQ ID NO: 1614693 - RNA, 14 nt, Homo sapiens
caucagauaugcuu

SEQ ID NO: 1614694 - RNA, 20 nt, Homo sapiens
caucagcugcugaaacaaca

SEQ ID NO: 1614695 - RNA, 18 nt, Homo sapiens
caucagugcucuguaaaa

SEQ ID NO: 1614696 - RNA, 22 nt, Homo sapiens
caucauaacucacuaacaggga

SEQ ID NO: 1614697 - RNA, 13 nt, Homo sapiens
caucauagggaua

SEQ ID NO: 1614698 - RNA, 13 nt, Homo sapiens
caucaucacugua

SEQ ID NO: 1614699 - RNA, 23 nt, Homo sapiens
caucaucccuuaauuaaauauca

SEQ ID NO: 1614700 - RNA, 17 nt, Homo sapiens
caucaucuccugccuuc

SEQ ID NO: 1614701 - RNA, 19 nt, Homo sapiens
caucaucuccugccuuccu

SEQ ID NO: 1614702 - RNA, 23 nt, Homo sapiens
caucaucuguucgauugaaauuu

SEQ ID NO: 1614703 - RNA, 21 nt, Homo sapiens
caucaugcggugggugcugcc

SEQ ID NO: 1614704 - RNA, 17 nt, Homo sapiens
caucauucucugucuca

SEQ ID NO: 1614705 - RNA, 12 nt, Homo sapiens
caucauuucagc

SEQ ID NO: 1614706 - RNA, 22 nt, Homo sapiens
cauccaaacuaaaaggaaguca

SEQ ID NO: 1614707 - RNA, 13 nt, Homo sapiens
cauccaauguaug

SEQ ID NO: 1614708 - RNA, 14 nt, Homo sapiens
cauccagacagucg

SEQ ID NO: 1614709 - RNA, 15 nt, Homo sapiens
cauccagaccugagc

SEQ ID NO: 1614710 - RNA, 16 nt, Homo sapiens
cauccagcaguacaau

SEQ ID NO: 1614711 - RNA, 16 nt, Homo sapiens
cauccagccucagaga

SEQ ID NO: 1614712 - RNA, 16 nt, Homo sapiens
cagaagggaauugcuc

SEQ ID NO: 1614713 - RNA, 15 nt, Homo sapiens
cagaagggcagugac

SEQ ID NO: 1614714 - RNA, 19 nt, Homo sapiens
cagaaguuaguuuguauau

SEQ ID NO: 1614715 - RNA, 20 nt, Homo sapiens
cagaauccugaugguaucaa

SEQ ID NO: 1614716 - RNA, 19 nt, Homo sapiens
cagaaugcggccucugaga

SEQ ID NO: 1614717 - RNA, 21 nt, Homo sapiens
cagcaguugaaaagacuccaa

SEQ ID NO: 1614718 - RNA, 12 nt, Homo sapiens
cagcaguuuuau

SEQ ID NO: 1614719 - RNA, 20 nt, Homo sapiens
cagcauagggucacuuugcc

SEQ ID NO: 1614720 - RNA, 13 nt, Homo sapiens
cagcaucagcuca

SEQ ID NO: 1614721 - RNA, 23 nt, Homo sapiens
cagcaugaaggcagccacagaca

SEQ ID NO: 1614722 - RNA, 19 nt, Homo sapiens
cagcaugagugcugagaua

SEQ ID NO: 1614723 - RNA, 15 nt, Homo sapiens
cagcaugauguguug

SEQ ID NO: 1614724 - RNA, 21 nt, Homo sapiens
cagcauuaaaaaaaaucaaaa

SEQ ID NO: 1614725 - RNA, 16 nt, Homo sapiens
cagccaaguagccucu

SEQ ID NO: 1614726 - RNA, 22 nt, Homo sapiens
cagccaaguugugacagucacu

SEQ ID NO: 1614727 - RNA, 13 nt, Homo sapiens
cagccacaccacu

SEQ ID NO: 1614728 - RNA, 14 nt, Homo sapiens
cagccaccaagaag

SEQ ID NO: 1614729 - RNA, 14 nt, Homo sapiens
cagccacccaagcc

SEQ ID NO: 1614730 - RNA, 12 nt, Homo sapiens
cagccacuguca

SEQ ID NO: 1614731 - RNA, 20 nt, Homo sapiens
cagccacuguuuguuuacaa

SEQ ID NO: 1614732 - RNA, 19 nt, Homo sapiens
cagccacuugacuggcaca

SEQ ID NO: 1614733 - RNA, 20 nt, Homo sapiens
cagccagaacuuucuuucac

SEQ ID NO: 1614734 - RNA, 16 nt, Homo sapiens
cagccaggcccugaga

SEQ ID NO: 1614735 - RNA, 14 nt, Homo sapiens
cagccaggcugcca

SEQ ID NO: 1614736 - RNA, 20 nt, Homo sapiens
cagccauaagaaagcacuau

SEQ ID NO: 1614737 - RNA, 13 nt, Homo sapiens
cagccauaugcag

SEQ ID NO: 1614738 - RNA, 19 nt, Homo sapiens
cagccaucguccugggacu

SEQ ID NO: 1614739 - RNA, 23 nt, Homo sapiens
cagccaucguccugggacucgga

SEQ ID NO: 1614740 - RNA, 14 nt, Homo sapiens
cagccaugaaguca

SEQ ID NO: 1614741 - RNA, 17 nt, Homo sapiens
cagcccaacagcacuuu

SEQ ID NO: 1614742 - RNA, 20 nt, Homo sapiens
cagcccacagagccugaauu

SEQ ID NO: 1614743 - RNA, 15 nt, Homo sapiens
cagcccagcuggugg

SEQ ID NO: 1614744 - RNA, 17 nt, Homo sapiens
cagcccagugcugccac

SEQ ID NO: 1614745 - RNA, 18 nt, Homo sapiens
cagcccauggcccccaau

SEQ ID NO: 1614746 - RNA, 21 nt, Homo sapiens
cagcccauuggccgagcuccu

SEQ ID NO: 1614747 - RNA, 17 nt, Homo sapiens
cagccccaacuccaggg

SEQ ID NO: 1614748 - RNA, 15 nt, Homo sapiens
cagccccgccuguca

SEQ ID NO: 1614749 - RNA, 12 nt, Homo sapiens
cagccccggggu

SEQ ID NO: 1614750 - RNA, 16 nt, Homo sapiens
cagccccuccaaaggu

SEQ ID NO: 1614751 - RNA, 18 nt, Homo sapiens
cagccccuccucccucaa

SEQ ID NO: 1614752 - RNA, 19 nt, Homo sapiens
cagcccugaggugaaaggg

SEQ ID NO: 1614753 - RNA, 23 nt, Homo sapiens
cagcccuugcacuccuacugagu

SEQ ID NO: 1614754 - RNA, 17 nt, Homo sapiens
cagccgaggccacagaa

SEQ ID NO: 1614755 - RNA, 23 nt, Homo sapiens
cagccgccagcugggagcacugg

SEQ ID NO: 1614756 - RNA, 21 nt, Homo sapiens
cagccucccaaaguguuggga

SEQ ID NO: 1614757 - RNA, 19 nt, Homo sapiens
cagccucccuaguagcugg

SEQ ID NO: 1614758 - RNA, 19 nt, Homo sapiens
cagccuggaaaccuacaga

SEQ ID NO: 1614759 - RNA, 19 nt, Homo sapiens
cagccugggcaacauacca

SEQ ID NO: 1614760 - RNA, 22 nt, Homo sapiens
cagcggugccucaacacccugg

SEQ ID NO: 1614761 - RNA, 23 nt, Homo sapiens
cagcguggaugucgaugacuuca

SEQ ID NO: 1614762 - RNA, 21 nt, Homo sapiens
cagcuaacccgugcagaacca

SEQ ID NO: 1614763 - RNA, 17 nt, Homo sapiens
cagcuaagacauauuca

SEQ ID NO: 1614764 - RNA, 22 nt, Homo sapiens
cagcuacucaggaggcugagac

SEQ ID NO: 1614765 - RNA, 14 nt, Homo sapiens
cagcuacugcaaau

SEQ ID NO: 1614766 - RNA, 24 nt, Homo sapiens
cagcuacuuggaaggcugaggcag

SEQ ID NO: 1614767 - RNA, 14 nt, Homo sapiens
cagcuagcuuauuc

SEQ ID NO: 1614768 - RNA, 22 nt, Homo sapiens
cagcuagcuuauucuuguguac

SEQ ID NO: 1614769 - RNA, 15 nt, Homo sapiens
cagcuagugccuuua

SEQ ID NO: 1614770 - RNA, 20 nt, Homo sapiens
cagcuaucugucaucucucu

SEQ ID NO: 1614771 - RNA, 22 nt, Homo sapiens
cagcucaaauuccgagugcaga

SEQ ID NO: 1614772 - RNA, 14 nt, Homo sapiens
cagcuccuggacca

SEQ ID NO: 1614773 - RNA, 17 nt, Homo sapiens
cagcucugccuugcacu

SEQ ID NO: 1614774 - RNA, 22 nt, Homo sapiens
cagcugaaagauugauuaauga

SEQ ID NO: 1614775 - RNA, 13 nt, Homo sapiens
cagcugacuaaac

SEQ ID NO: 1614776 - RNA, 18 nt, Homo sapiens
cagcuggagguugagcuc

SEQ ID NO: 1614777 - RNA, 20 nt, Homo sapiens
cagcuggaucgcugcacaug

SEQ ID NO: 1614778 - RNA, 16 nt, Homo sapiens
cagcuguaaacauauu

SEQ ID NO: 1614779 - RNA, 15 nt, Homo sapiens
cagcugugcacuuuc

SEQ ID NO: 1614780 - RNA, 20 nt, Homo sapiens
cagcuguuuaugcauagaua

SEQ ID NO: 1614781 - RNA, 14 nt, Homo sapiens
cagcuuaugagcuc

SEQ ID NO: 1614782 - RNA, 19 nt, Homo sapiens
cagcuucaacuuuucucuu

SEQ ID NO: 1614783 - RNA, 21 nt, Homo sapiens
cagcuucuucuuucauucuaa

SEQ ID NO: 1614784 - RNA, 16 nt, Homo sapiens
cagcuugcucuucagu

SEQ ID NO: 1614785 - RNA, 16 nt, Homo sapiens
cagcuuggcccuuucc

SEQ ID NO: 1614786 - RNA, 23 nt, Homo sapiens
cagcuuuauccccguuucuugca

SEQ ID NO: 1614787 - RNA, 20 nt, Homo sapiens
cagcuuuccucaucaggcca

SEQ ID NO: 1614788 - RNA, 18 nt, Homo sapiens
cagcuuugggguuccuuu

SEQ ID NO: 1614789 - RNA, 21 nt, Homo sapiens
cagcuuuuuuugucuuuuuaa

SEQ ID NO: 1614790 - RNA, 22 nt, Homo sapiens
caggaaaccuuggccucugcua

SEQ ID NO: 1614791 - RNA, 20 nt, Homo sapiens
caggaaagcuggugucugau

SEQ ID NO: 1614792 - RNA, 21 nt, Homo sapiens
caggaaaggacggcugagcau

SEQ ID NO: 1614793 - RNA, 19 nt, Homo sapiens
caggaaaucaaauaugcaa

SEQ ID NO: 1614794 - RNA, 13 nt, Homo sapiens
caggaacaaacag

SEQ ID NO: 1614795 - RNA, 17 nt, Homo sapiens
caggaacaaacagggcu

SEQ ID NO: 1614796 - RNA, 15 nt, Homo sapiens
caggaacuaaaggaa

SEQ ID NO: 1614797 - RNA, 17 nt, Homo sapiens
caggaagggagaacuug

SEQ ID NO: 1614798 - RNA, 15 nt, Homo sapiens
caggacuuaacauca

SEQ ID NO: 1614799 - RNA, 16 nt, Homo sapiens
caggagaagaacaaga

SEQ ID NO: 1614800 - RNA, 23 nt, Homo sapiens
caggagaaucacuugaacccagg

SEQ ID NO: 1614801 - RNA, 15 nt, Homo sapiens
caggagcacugcaug

SEQ ID NO: 1614802 - RNA, 23 nt, Homo sapiens
caggagcuugggcagugccccag

SEQ ID NO: 1614803 - RNA, 15 nt, Homo sapiens
caggaggaucacuug

SEQ ID NO: 1614804 - RNA, 18 nt, Homo sapiens
caggaggaucacuugagc

SEQ ID NO: 1614805 - RNA, 18 nt, Homo sapiens
caggaggcagacaaugac

SEQ ID NO: 1614806 - RNA, 14 nt, Homo sapiens
caggaggcugccac

SEQ ID NO: 1614807 - RNA, 16 nt, Homo sapiens
caggagggcccuaccu

SEQ ID NO: 1614808 - RNA, 17 nt, Homo sapiens
caggaguucaagaccag

SEQ ID NO: 1614809 - RNA, 17 nt, Homo sapiens
caggauaucacauugga

SEQ ID NO: 1614810 - RNA, 15 nt, Homo sapiens
caggaucugcuccaa

SEQ ID NO: 1614811 - RNA, 21 nt, Homo sapiens
caggaucugucugugcacaug

SEQ ID NO: 1614812 - RNA, 18 nt, Homo sapiens
caggaucuuugacugaaa

SEQ ID NO: 1614813 - RNA, 18 nt, Homo sapiens
caggcaaucguucugcug

SEQ ID NO: 1614814 - RNA, 17 nt, Homo sapiens
caggcacacaggucuca

SEQ ID NO: 1614815 - RNA, 14 nt, Homo sapiens
caggcacgugccac

SEQ ID NO: 1614816 - RNA, 23 nt, Homo sapiens
caggcagagacugaaaauugcag

SEQ ID NO: 1614817 - RNA, 17 nt, Homo sapiens
caggcauagaggcuucu

SEQ ID NO: 1614818 - RNA, 13 nt, Homo sapiens
caggcauugccaa

SEQ ID NO: 1614819 - RNA, 18 nt, Homo sapiens
caggcauuugacugaaga

SEQ ID NO: 1614820 - RNA, 14 nt, Homo sapiens
caggccaucaagga

SEQ ID NO: 1614821 - RNA, 18 nt, Homo sapiens
caggccauugucccugaa

SEQ ID NO: 1614822 - RNA, 20 nt, Homo sapiens
caggccauugucccugaaga

SEQ ID NO: 1614823 - RNA, 13 nt, Homo sapiens
caggcccaguggc

SEQ ID NO: 1614824 - RNA, 19 nt, Homo sapiens
caggcccaguggccgguca

SEQ ID NO: 1614825 - RNA, 13 nt, Homo sapiens
caggccccaggac

SEQ ID NO: 1614826 - RNA, 20 nt, Homo sapiens
caggccuaucuggaagccac

SEQ ID NO: 1614827 - RNA, 20 nt, Homo sapiens
caggccucucggugcuccau

SEQ ID NO: 1614828 - RNA, 23 nt, Homo sapiens
caggccucucggugcuccaucuc

SEQ ID NO: 1614829 - RNA, 19 nt, Homo sapiens
caggccuugggcuccugau

SEQ ID NO: 1614830 - RNA, 20 nt, Homo sapiens
caggcgcaguggcucaugcc

SEQ ID NO: 1614831 - RNA, 12 nt, Homo sapiens
auucaguguuaa

SEQ ID NO: 1614832 - RNA, 17 nt, Homo sapiens
auucaguuuucauuugg

SEQ ID NO: 1614833 - RNA, 13 nt, Homo sapiens
auucauaugcaga

SEQ ID NO: 1614834 - RNA, 16 nt, Homo sapiens
auucaugaaaugugga

SEQ ID NO: 1614835 - RNA, 17 nt, Homo sapiens
auucauggcuaccucag

SEQ ID NO: 1614836 - RNA, 12 nt, Homo sapiens
auucauuccuca

SEQ ID NO: 1614837 - RNA, 23 nt, Homo sapiens
auucauucuuuuugaaaugucaa

SEQ ID NO: 1614838 - RNA, 14 nt, Homo sapiens
auucauuggugaag

SEQ ID NO: 1614839 - RNA, 16 nt, Homo sapiens
auuccaaaauccaaaa

SEQ ID NO: 1614840 - RNA, 15 nt, Homo sapiens
auuccaaacuaugac

SEQ ID NO: 1614841 - RNA, 13 nt, Homo sapiens
auuccaaagcaaa

SEQ ID NO: 1614842 - RNA, 16 nt, Homo sapiens
auuccaacauuucuca

SEQ ID NO: 1614843 - RNA, 21 nt, Homo sapiens
auuccaacauuucucacugaa

SEQ ID NO: 1614844 - RNA, 14 nt, Homo sapiens
auuccaacuucaau

SEQ ID NO: 1614845 - RNA, 15 nt, Homo sapiens
auuccaccuagagcu

SEQ ID NO: 1614846 - RNA, 19 nt, Homo sapiens
auuccagaaugcuguacau

SEQ ID NO: 1614847 - RNA, 16 nt, Homo sapiens
auuccauccucaacac

SEQ ID NO: 1614848 - RNA, 20 nt, Homo sapiens
auucccaccauucuaccuga

SEQ ID NO: 1614849 - RNA, 15 nt, Homo sapiens
auucccagaagucca

SEQ ID NO: 1614850 - RNA, 21 nt, Homo sapiens
auuccccuguagcagucacug

SEQ ID NO: 1614851 - RNA, 23 nt, Homo sapiens
auuccccuguagcagucacugac

SEQ ID NO: 1614852 - RNA, 22 nt, Homo sapiens
auucccgacgacacauauacau

SEQ ID NO: 1614853 - RNA, 13 nt, Homo sapiens
auucccuccauuu

SEQ ID NO: 1614854 - RNA, 20 nt, Homo sapiens
auucccugcacacacaugca

SEQ ID NO: 1614855 - RNA, 19 nt, Homo sapiens
auucccuugaaauuuagau

SEQ ID NO: 1614856 - RNA, 18 nt, Homo sapiens
auuccgagugcagaaaag

SEQ ID NO: 1614857 - RNA, 20 nt, Homo sapiens
auuccuacagcacuacuggg

SEQ ID NO: 1614858 - RNA, 23 nt, Homo sapiens
auuccuagauuacaucugccuua

SEQ ID NO: 1614859 - RNA, 16 nt, Homo sapiens
auuccuaugcugcaau

SEQ ID NO: 1614860 - RNA, 17 nt, Homo sapiens
auuccucaccaagcuca

SEQ ID NO: 1614861 - RNA, 12 nt, Homo sapiens
auuccucauguc

SEQ ID NO: 1614862 - RNA, 16 nt, Homo sapiens
auuccugugcggacag

SEQ ID NO: 1614863 - RNA, 22 nt, Homo sapiens
auuccugugcggacagcccuuc

SEQ ID NO: 1614864 - RNA, 23 nt, Homo sapiens
auuccugugcggacagcccuucc

SEQ ID NO: 1614865 - RNA, 20 nt, Homo sapiens
auuccuguuugucuacauau

SEQ ID NO: 1614866 - RNA, 23 nt, Homo sapiens
auuccuucucccaucucuuccuu

SEQ ID NO: 1614867 - RNA, 15 nt, Homo sapiens
auuccuugaguuuca

SEQ ID NO: 1614868 - RNA, 14 nt, Homo sapiens
auuccuugcacaua

SEQ ID NO: 1614869 - RNA, 19 nt, Homo sapiens
auuccuuuuucuucacuua

SEQ ID NO: 1614870 - RNA, 18 nt, Homo sapiens
auucuaacccaagacaug

SEQ ID NO: 1614871 - RNA, 23 nt, Homo sapiens
auucuaacccaagacaugacauu

SEQ ID NO: 1614872 - RNA, 14 nt, Homo sapiens
auucuaauuaaaau

SEQ ID NO: 1614873 - RNA, 16 nt, Homo sapiens
auucuacacagagcag

SEQ ID NO: 1614874 - RNA, 14 nt, Homo sapiens
auucuacagugaug

SEQ ID NO: 1614875 - RNA, 18 nt, Homo sapiens
auucuaccugaggccagg

SEQ ID NO: 1614876 - RNA, 13 nt, Homo sapiens
auucuacuggaaa

SEQ ID NO: 1614877 - RNA, 19 nt, Homo sapiens
auucuauuuauauguacau

SEQ ID NO: 1614878 - RNA, 21 nt, Homo sapiens
auucuauuuauauguacauga

SEQ ID NO: 1614879 - RNA, 15 nt, Homo sapiens
auucucacaaggaaa

SEQ ID NO: 1614880 - RNA, 20 nt, Homo sapiens
auucucauaaguagcauuca

SEQ ID NO: 1614881 - RNA, 21 nt, Homo sapiens
auucuccucucucuaucccug

SEQ ID NO: 1614882 - RNA, 15 nt, Homo sapiens
auucucuagucaguu

SEQ ID NO: 1614883 - RNA, 16 nt, Homo sapiens
auucucuauuuuacuu

SEQ ID NO: 1614884 - RNA, 21 nt, Homo sapiens
auucucuuaauagcuauacau

SEQ ID NO: 1614885 - RNA, 22 nt, Homo sapiens
auucugagcaaaggcccugggu

SEQ ID NO: 1614886 - RNA, 23 nt, Homo sapiens
auucugagcaaaggcccugggua

SEQ ID NO: 1614887 - RNA, 21 nt, Homo sapiens
auucugauuauugaguuccag

SEQ ID NO: 1614888 - RNA, 23 nt, Homo sapiens
auucugcaguaaaucuuuuacaa

SEQ ID NO: 1614889 - RNA, 21 nt, Homo sapiens
auucuggaagcaaauggcaaa

SEQ ID NO: 1614890 - RNA, 21 nt, Homo sapiens
auucuggcauaauuuuuacag

SEQ ID NO: 1614891 - RNA, 14 nt, Homo sapiens
auucugguuuauuu

SEQ ID NO: 1614892 - RNA, 22 nt, Homo sapiens
auucuguguauuaacaugcaau

SEQ ID NO: 1614893 - RNA, 18 nt, Homo sapiens
auucuguuuuuaaugcua

SEQ ID NO: 1614894 - RNA, 21 nt, Homo sapiens
auucuucacuggugagacaau

SEQ ID NO: 1614895 - RNA, 17 nt, Homo sapiens
auucuuccaucaucacu

SEQ ID NO: 1614896 - RNA, 14 nt, Homo sapiens
auucuucuacuugu

SEQ ID NO: 1614897 - RNA, 20 nt, Homo sapiens
auucuugagggacaaugcca

SEQ ID NO: 1614898 - RNA, 17 nt, Homo sapiens
auucuugaggucuugag

SEQ ID NO: 1614899 - RNA, 21 nt, Homo sapiens
auucuugcuaugaaaaguuuc

SEQ ID NO: 1614900 - RNA, 20 nt, Homo sapiens
auucuuguaucaaauucaau

SEQ ID NO: 1614901 - RNA, 16 nt, Homo sapiens
auucuuguuggcuuuu

SEQ ID NO: 1614902 - RNA, 17 nt, Homo sapiens
auucuuucaacuugcaa

SEQ ID NO: 1614903 - RNA, 13 nt, Homo sapiens
auucuuucccaac

SEQ ID NO: 1614904 - RNA, 15 nt, Homo sapiens
auucuuuuaaugcca

SEQ ID NO: 1614905 - RNA, 20 nt, Homo sapiens
auucuuuugaauuguuacau

SEQ ID NO: 1614906 - RNA, 14 nt, Homo sapiens
auugaaaagcacag

SEQ ID NO: 1614907 - RNA, 20 nt, Homo sapiens
auugaaacuaagagcucuca

SEQ ID NO: 1614908 - RNA, 22 nt, Homo sapiens
auugaaagugggcaaaagcuua

SEQ ID NO: 1614909 - RNA, 14 nt, Homo sapiens
auugaaauuuugca

SEQ ID NO: 1614910 - RNA, 12 nt, Homo sapiens
auugaaguaaug

SEQ ID NO: 1614911 - RNA, 16 nt, Homo sapiens
auugaaguauuuugcu

SEQ ID NO: 1614912 - RNA, 16 nt, Homo sapiens
auugaaugaugugaua

SEQ ID NO: 1614913 - RNA, 13 nt, Homo sapiens
auugaaugugauu

SEQ ID NO: 1614914 - RNA, 13 nt, Homo sapiens
auugaauuaucuu

SEQ ID NO: 1614915 - RNA, 23 nt, Homo sapiens
auugaauuaugcuguguaaaaau

SEQ ID NO: 1614916 - RNA, 13 nt, Homo sapiens
auugaauucuaaa

SEQ ID NO: 1614917 - RNA, 12 nt, Homo sapiens
auugacacugaa

SEQ ID NO: 1614918 - RNA, 22 nt, Homo sapiens
auugaccgcgacuaauuucaaa

SEQ ID NO: 1614919 - RNA, 15 nt, Homo sapiens
auugaccuuuaggua

SEQ ID NO: 1614920 - RNA, 16 nt, Homo sapiens
auugacuccuuuccaa

SEQ ID NO: 1614921 - RNA, 21 nt, Homo sapiens
auugacuucauuuuauauuua

SEQ ID NO: 1614922 - RNA, 12 nt, Homo sapiens
auugacuucuuu

SEQ ID NO: 1614923 - RNA, 17 nt, Homo sapiens
auugacuucuuuuuggc

SEQ ID NO: 1614924 - RNA, 21 nt, Homo sapiens
auugacuuuuuuugagcgaca

SEQ ID NO: 1614925 - RNA, 18 nt, Homo sapiens
auugauuagauaaagauu

SEQ ID NO: 1614926 - RNA, 22 nt, Homo sapiens
auugauuguauuguugaaaaag

SEQ ID NO: 1614927 - RNA, 22 nt, Homo sapiens
auugcaaauaaaccacuuucua

SEQ ID NO: 1614928 - RNA, 17 nt, Homo sapiens
auugcaauacauuucaa

SEQ ID NO: 1614929 - RNA, 19 nt, Homo sapiens
auugcaauguucaaugcca

SEQ ID NO: 1614930 - RNA, 17 nt, Homo sapiens
auugcaguuucauguau

SEQ ID NO: 1614931 - RNA, 15 nt, Homo sapiens
auugcauuuauaugu

SEQ ID NO: 1614932 - RNA, 16 nt, Homo sapiens
auugccaagucagcau

SEQ ID NO: 1614933 - RNA, 18 nt, Homo sapiens
auugccacaaguccagcu

SEQ ID NO: 1614934 - RNA, 14 nt, Homo sapiens
auugccauguggac

SEQ ID NO: 1614935 - RNA, 17 nt, Homo sapiens
auugccuccauucuccu

SEQ ID NO: 1614936 - RNA, 21 nt, Homo sapiens
auugccuucucaccagcugca

SEQ ID NO: 1614937 - RNA, 22 nt, Homo sapiens
auugccuugcuuuuaucacuua

SEQ ID NO: 1614938 - RNA, 20 nt, Homo sapiens
auguguuuuucuccagugcu

SEQ ID NO: 1614939 - RNA, 19 nt, Homo sapiens
auguuaaguccucccugac

SEQ ID NO: 1614940 - RNA, 22 nt, Homo sapiens
auguuaauugggcaggugaaaa

SEQ ID NO: 1614941 - RNA, 22 nt, Homo sapiens
auguuaauuuuuugguacaaaa

SEQ ID NO: 1614942 - RNA, 18 nt, Homo sapiens
auguuaccuucacauguc

SEQ ID NO: 1614943 - RNA, 20 nt, Homo sapiens
auguuagaugcuuaguguga

SEQ ID NO: 1614944 - RNA, 22 nt, Homo sapiens
auguuccccaggauucagcuau

SEQ ID NO: 1614945 - RNA, 18 nt, Homo sapiens
auguucgcucgugcagua

SEQ ID NO: 1614946 - RNA, 12 nt, Homo sapiens
auguucuuggcu

SEQ ID NO: 1614947 - RNA, 13 nt, Homo sapiens
auguucuuuggaa

SEQ ID NO: 1614948 - RNA, 15 nt, Homo sapiens
auguugaucauguac

SEQ ID NO: 1614949 - RNA, 20 nt, Homo sapiens
auguugcuuucuuaucccag

SEQ ID NO: 1614950 - RNA, 23 nt, Homo sapiens
auguugcuuucuuaucccaguga

SEQ ID NO: 1614951 - RNA, 22 nt, Homo sapiens
auguuguguuuuuaacauguca

SEQ ID NO: 1614952 - RNA, 20 nt, Homo sapiens
auguuguuccaggaugugga

SEQ ID NO: 1614953 - RNA, 14 nt, Homo sapiens
auguuuacaggggu

SEQ ID NO: 1614954 - RNA, 23 nt, Homo sapiens
auguuuacuaaguggacuggugu

SEQ ID NO: 1614955 - RNA, 16 nt, Homo sapiens
auguuuaguuuuacau

SEQ ID NO: 1614956 - RNA, 19 nt, Homo sapiens
auguuuauuuuucuugucu

SEQ ID NO: 1614957 - RNA, 14 nt, Homo sapiens
auguuucacagugg

SEQ ID NO: 1614958 - RNA, 17 nt, Homo sapiens
auguuuguggccucaga

SEQ ID NO: 1614959 - RNA, 17 nt, Homo sapiens
auguuuuaauaccacaa

SEQ ID NO: 1614960 - RNA, 18 nt, Homo sapiens
auguuuucuaccagugug

SEQ ID NO: 1614961 - RNA, 13 nt, Homo sapiens
auguuuuuacuga

SEQ ID NO: 1614962 - RNA, 14 nt, Homo sapiens
auuaaaaaacuuca

SEQ ID NO: 1614963 - RNA, 14 nt, Homo sapiens
auuaaaaacuacca

SEQ ID NO: 1614964 - RNA, 12 nt, Homo sapiens
auuaaaacauua

SEQ ID NO: 1614965 - RNA, 12 nt, Homo sapiens
auuaaaauaucc

SEQ ID NO: 1614966 - RNA, 13 nt, Homo sapiens
auuaaaauuccaa

SEQ ID NO: 1614967 - RNA, 15 nt, Homo sapiens
auuaaaccuuuccau

SEQ ID NO: 1614968 - RNA, 15 nt, Homo sapiens
auuaaaguacaacca

SEQ ID NO: 1614969 - RNA, 16 nt, Homo sapiens
auuaaauagugugaug

SEQ ID NO: 1614970 - RNA, 16 nt, Homo sapiens
auuaaaugugagcaaa

SEQ ID NO: 1614971 - RNA, 17 nt, Homo sapiens
auuaaauuguuccauuu

SEQ ID NO: 1614972 - RNA, 12 nt, Homo sapiens
auuaacaauuaa

SEQ ID NO: 1614973 - RNA, 14 nt, Homo sapiens
auuaacaucaaaga

SEQ ID NO: 1614974 - RNA, 20 nt, Homo sapiens
auuaacuauuaguguuaacu

SEQ ID NO: 1614975 - RNA, 17 nt, Homo sapiens
auuaacucugcauagac

SEQ ID NO: 1614976 - RNA, 14 nt, Homo sapiens
auuaagaagcaaua

SEQ ID NO: 1614977 - RNA, 18 nt, Homo sapiens
auuaagacuuuauguagu

SEQ ID NO: 1614978 - RNA, 19 nt, Homo sapiens
auuaagcccaauuaauucc

SEQ ID NO: 1614979 - RNA, 20 nt, Homo sapiens
auuaauaaagauggcacuuu

SEQ ID NO: 1614980 - RNA, 23 nt, Homo sapiens
auuaauacucugcagugauuaga

SEQ ID NO: 1614981 - RNA, 17 nt, Homo sapiens
auuaauccauuuuaaca

SEQ ID NO: 1614982 - RNA, 22 nt, Homo sapiens
auuaaucucuaguaaaacauug

SEQ ID NO: 1614983 - RNA, 19 nt, Homo sapiens
auuaaucuuaguguaugau

SEQ ID NO: 1614984 - RNA, 13 nt, Homo sapiens
auuaauguuaaca

SEQ ID NO: 1614985 - RNA, 21 nt, Homo sapiens
auuaauuacuucacuauacaa

SEQ ID NO: 1614986 - RNA, 15 nt, Homo sapiens
auuacaaaugcaauu

SEQ ID NO: 1614987 - RNA, 15 nt, Homo sapiens
auuacaaccauauau

SEQ ID NO: 1614988 - RNA, 20 nt, Homo sapiens
auuacaaucgagacugcaau

SEQ ID NO: 1614989 - RNA, 16 nt, Homo sapiens
auuacaggcacgugcc

SEQ ID NO: 1614990 - RNA, 17 nt, Homo sapiens
auuacaggcacgugcca

SEQ ID NO: 1614991 - RNA, 17 nt, Homo sapiens
auuacaggcgugaucca

SEQ ID NO: 1614992 - RNA, 21 nt, Homo sapiens
auuacaggcgugauccaccac

SEQ ID NO: 1614993 - RNA, 15 nt, Homo sapiens
auuacaguguagcua

SEQ ID NO: 1614994 - RNA, 15 nt, Homo sapiens
auuacauauuuacac

SEQ ID NO: 1614995 - RNA, 17 nt, Homo sapiens
auuacaucugccuuaaa

SEQ ID NO: 1614996 - RNA, 11 nt, Homo sapiens
auuacaugauu

SEQ ID NO: 1614997 - RNA, 13 nt, Homo sapiens
auuaccuaaugaa

SEQ ID NO: 1614998 - RNA, 19 nt, Homo sapiens
auuaccuccuguguggaag

SEQ ID NO: 1614999 - RNA, 22 nt, Homo sapiens
auuacuaaauuacaaaugcaau

SEQ ID NO: 1615000 - RNA, 23 nt, Homo sapiens
auuacuaguacuauuacuaguac

SEQ ID NO: 1615001 - RNA, 13 nt, Homo sapiens
auuacuaucauaa

SEQ ID NO: 1615002 - RNA, 16 nt, Homo sapiens
auuacugaugugugca

SEQ ID NO: 1615003 - RNA, 21 nt, Homo sapiens
auuacuggccuuuuucauuua

SEQ ID NO: 1615004 - RNA, 15 nt, Homo sapiens
auuacugguccaaaa

SEQ ID NO: 1615005 - RNA, 23 nt, Homo sapiens
auuacuguaaacagccuacugaa

SEQ ID NO: 1615006 - RNA, 23 nt, Homo sapiens
auuacuugguuugugaauccauc

SEQ ID NO: 1615007 - RNA, 18 nt, Homo sapiens
auuagagggaugagacag

SEQ ID NO: 1615008 - RNA, 13 nt, Homo sapiens
auuagauaaucaa

SEQ ID NO: 1615009 - RNA, 22 nt, Homo sapiens
auuagauaaucaagggcacugu

SEQ ID NO: 1615010 - RNA, 23 nt, Homo sapiens
auuaguaauuuauauagauguca

SEQ ID NO: 1615011 - RNA, 23 nt, Homo sapiens
auuaguacagaaauauccaugac

SEQ ID NO: 1615012 - RNA, 14 nt, Homo sapiens
auuagugcagccaa

SEQ ID NO: 1615013 - RNA, 19 nt, Homo sapiens
auuaguuuggguucucuac

SEQ ID NO: 1615014 - RNA, 19 nt, Homo sapiens
auuauaaaugacaaccuga

SEQ ID NO: 1615015 - RNA, 14 nt, Homo sapiens
auuauaaguugacc

SEQ ID NO: 1615016 - RNA, 19 nt, Homo sapiens
auuauauaaaucauuucaa

SEQ ID NO: 1615017 - RNA, 14 nt, Homo sapiens
auuauauucacaga

SEQ ID NO: 1615018 - RNA, 18 nt, Homo sapiens
auuauauucacagacuga

SEQ ID NO: 1615019 - RNA, 13 nt, Homo sapiens
auuaucaaaaagc

SEQ ID NO: 1615020 - RNA, 13 nt, Homo sapiens
auuaucaacagca

SEQ ID NO: 1615021 - RNA, 16 nt, Homo sapiens
auuaucuauuaucuca

SEQ ID NO: 1615022 - RNA, 23 nt, Homo sapiens
auuaucucaaaacugcacuguca

SEQ ID NO: 1615023 - RNA, 20 nt, Homo sapiens
auuaugcauuauaucaaauc

SEQ ID NO: 1615024 - RNA, 21 nt, Homo sapiens
auuauggaaaacuguguugcc

SEQ ID NO: 1615025 - RNA, 19 nt, Homo sapiens
auuaugguuagcugucaca

SEQ ID NO: 1615026 - RNA, 23 nt, Homo sapiens
auuauguguugccaaaaccaaac

SEQ ID NO: 1615027 - RNA, 13 nt, Homo sapiens
auuauguuuauuu

SEQ ID NO: 1615028 - RNA, 19 nt, Homo sapiens
auuauguuuucaacacuuu

SEQ ID NO: 1615029 - RNA, 22 nt, Homo sapiens
auuauuaaaacugaacuugaag

SEQ ID NO: 1615030 - RNA, 14 nt, Homo sapiens
auuauucaucucuc

SEQ ID NO: 1615031 - RNA, 17 nt, Homo sapiens
auuauuccaagccuuau

SEQ ID NO: 1615032 - RNA, 13 nt, Homo sapiens
auuauucccauga

SEQ ID NO: 1615033 - RNA, 23 nt, Homo sapiens
auuauucugggcaccacaaaaua

SEQ ID NO: 1615034 - RNA, 13 nt, Homo sapiens
auuauugacacug

SEQ ID NO: 1615035 - RNA, 15 nt, Homo sapiens
auuauuuacugacau

SEQ ID NO: 1615036 - RNA, 23 nt, Homo sapiens
auuauuuacugacauauaucuau

SEQ ID NO: 1615037 - RNA, 11 nt, Homo sapiens
auuauuugccc

SEQ ID NO: 1615038 - RNA, 16 nt, Homo sapiens
auuauuuuacaaucaa

SEQ ID NO: 1615039 - RNA, 16 nt, Homo sapiens
auucaaaaauuaucua

SEQ ID NO: 1615040 - RNA, 17 nt, Homo sapiens
auucaaagaaguacuuu

SEQ ID NO: 1615041 - RNA, 18 nt, Homo sapiens
auucaaagaaguacuuua

SEQ ID NO: 1615042 - RNA, 15 nt, Homo sapiens
auucaaauugcugcu

SEQ ID NO: 1615043 - RNA, 16 nt, Homo sapiens
auucaaauugcugcuu

SEQ ID NO: 1615044 - RNA, 23 nt, Homo sapiens
augcucaguuuaagguacacugu

SEQ ID NO: 1615045 - RNA, 13 nt, Homo sapiens
augcucauaccuc

SEQ ID NO: 1615046 - RNA, 23 nt, Homo sapiens
augcucccuccccugcccugguc

SEQ ID NO: 1615047 - RNA, 22 nt, Homo sapiens
augcugaaaaauauagccuuua

SEQ ID NO: 1615048 - RNA, 18 nt, Homo sapiens
augcuguuuguagugaaa

SEQ ID NO: 1615049 - RNA, 19 nt, Homo sapiens
augcuguuuguagugaaau

SEQ ID NO: 1615050 - RNA, 22 nt, Homo sapiens
augcuugacauaccuaccagua

SEQ ID NO: 1615051 - RNA, 20 nt, Homo sapiens
augcuuuugcuugcaaugua

SEQ ID NO: 1615052 - RNA, 15 nt, Homo sapiens
auggaaaacuguguu

SEQ ID NO: 1615053 - RNA, 14 nt, Homo sapiens
auggaacuguuggc

SEQ ID NO: 1615054 - RNA, 21 nt, Homo sapiens
auggaacuuuauuuacacucc

SEQ ID NO: 1615055 - RNA, 22 nt, Homo sapiens
auggaagccagggcuugucaca

SEQ ID NO: 1615056 - RNA, 19 nt, Homo sapiens
auggaauaucaucugucau

SEQ ID NO: 1615057 - RNA, 16 nt, Homo sapiens
auggaauugauuugca

SEQ ID NO: 1615058 - RNA, 20 nt, Homo sapiens
auggaauuucucccagucau

SEQ ID NO: 1615059 - RNA, 19 nt, Homo sapiens
auggacaguggagaugaag

SEQ ID NO: 1615060 - RNA, 23 nt, Homo sapiens
auggacuggagcucaucugcaaa

SEQ ID NO: 1615061 - RNA, 17 nt, Homo sapiens
auggagaaacaagacag

SEQ ID NO: 1615062 - RNA, 23 nt, Homo sapiens
auggagacguggugggacuccag

SEQ ID NO: 1615063 - RNA, 15 nt, Homo sapiens
auggagccaugacaa

SEQ ID NO: 1615064 - RNA, 15 nt, Homo sapiens
auggauucacuucua

SEQ ID NO: 1615065 - RNA, 20 nt, Homo sapiens
auggauugccaagucagcau

SEQ ID NO: 1615066 - RNA, 17 nt, Homo sapiens
auggauuguggaaaaug

SEQ ID NO: 1615067 - RNA, 17 nt, Homo sapiens
auggcacuuuugaugaa

SEQ ID NO: 1615068 - RNA, 18 nt, Homo sapiens
auggcacuuuugaugaaa

SEQ ID NO: 1615069 - RNA, 18 nt, Homo sapiens
auggcauaaccugucuca

SEQ ID NO: 1615070 - RNA, 21 nt, Homo sapiens
auggcauaugguccuagacaa

SEQ ID NO: 1615071 - RNA, 23 nt, Homo sapiens
auggccucaaaaaucagggccac

SEQ ID NO: 1615072 - RNA, 22 nt, Homo sapiens
auggccugagaugcaggugaug

SEQ ID NO: 1615073 - RNA, 17 nt, Homo sapiens
auggcucuggcacagug

SEQ ID NO: 1615074 - RNA, 18 nt, Homo sapiens
auggcugaguuuauuagu

SEQ ID NO: 1615075 - RNA, 23 nt, Homo sapiens
auggcugaguuuauuaguacaug

SEQ ID NO: 1615076 - RNA, 22 nt, Homo sapiens
auggcuggaagggguccagccu

SEQ ID NO: 1615077 - RNA, 21 nt, Homo sapiens
auggcuuccgugagacacaag

SEQ ID NO: 1615078 - RNA, 18 nt, Homo sapiens
auggcuucggacaaaaua

SEQ ID NO: 1615079 - RNA, 15 nt, Homo sapiens
auggcuuugugauuc

SEQ ID NO: 1615080 - RNA, 19 nt, Homo sapiens
auggcuuugugauucaauc

SEQ ID NO: 1615081 - RNA, 23 nt, Homo sapiens
augggagggggcuugaagccaaa

SEQ ID NO: 1615082 - RNA, 14 nt, Homo sapiens
auggggcacccugg

SEQ ID NO: 1615083 - RNA, 20 nt, Homo sapiens
auggggucucgcucugucac

SEQ ID NO: 1615084 - RNA, 16 nt, Homo sapiens
augggucccucagucu

SEQ ID NO: 1615085 - RNA, 18 nt, Homo sapiens
augguaggucaaguaaua

SEQ ID NO: 1615086 - RNA, 14 nt, Homo sapiens
augguaucaaugga

SEQ ID NO: 1615087 - RNA, 19 nt, Homo sapiens
auggucaaugcuagcacaa

SEQ ID NO: 1615088 - RNA, 23 nt, Homo sapiens
auggucccaggcuucccaaaagu

SEQ ID NO: 1615089 - RNA, 16 nt, Homo sapiens
augguccuuucuggaa

SEQ ID NO: 1615090 - RNA, 14 nt, Homo sapiens
auggucucuaccua

SEQ ID NO: 1615091 - RNA, 18 nt, Homo sapiens
auggucuucguccuugac

SEQ ID NO: 1615092 - RNA, 23 nt, Homo sapiens
auggugaaaccccgucucuacua

SEQ ID NO: 1615093 - RNA, 13 nt, Homo sapiens
auggugaacucca

SEQ ID NO: 1615094 - RNA, 15 nt, Homo sapiens
auggugauugucaug

SEQ ID NO: 1615095 - RNA, 22 nt, Homo sapiens
auggugcguggcuucccugucc

SEQ ID NO: 1615096 - RNA, 21 nt, Homo sapiens
augguguaaauauuagugcag

SEQ ID NO: 1615097 - RNA, 19 nt, Homo sapiens
auggugugccuuccagauc

SEQ ID NO: 1615098 - RNA, 13 nt, Homo sapiens
augguuaauacua

SEQ ID NO: 1615099 - RNA, 18 nt, Homo sapiens
augguucccaagcgucau

SEQ ID NO: 1615100 - RNA, 14 nt, Homo sapiens
auguaaacugugca

SEQ ID NO: 1615101 - RNA, 15 nt, Homo sapiens
auguaaacugugcac

SEQ ID NO: 1615102 - RNA, 17 nt, Homo sapiens
auguaaauaaaacauca

SEQ ID NO: 1615103 - RNA, 22 nt, Homo sapiens
auguaaauguguuagcacugau

SEQ ID NO: 1615104 - RNA, 12 nt, Homo sapiens
auguaagcacuc

SEQ ID NO: 1615105 - RNA, 12 nt, Homo sapiens
auguaagccugg

SEQ ID NO: 1615106 - RNA, 12 nt, Homo sapiens
auguaagcucuu

SEQ ID NO: 1615107 - RNA, 17 nt, Homo sapiens
auguaauacauauagca

SEQ ID NO: 1615108 - RNA, 15 nt, Homo sapiens
auguacagacauauu

SEQ ID NO: 1615109 - RNA, 11 nt, Homo sapiens
auguacaugag

SEQ ID NO: 1615110 - RNA, 14 nt, Homo sapiens
auguacauuacaga

SEQ ID NO: 1615111 - RNA, 16 nt, Homo sapiens
auguacuacagcuaua

SEQ ID NO: 1615112 - RNA, 14 nt, Homo sapiens
auguacuaugucug

SEQ ID NO: 1615113 - RNA, 12 nt, Homo sapiens
auguagacauaa

SEQ ID NO: 1615114 - RNA, 20 nt, Homo sapiens
auguagagaggagucagauu

SEQ ID NO: 1615115 - RNA, 18 nt, Homo sapiens
auguaggguaaggugccu

SEQ ID NO: 1615116 - RNA, 20 nt, Homo sapiens
auguauaaaaauuaucaaaa

SEQ ID NO: 1615117 - RNA, 17 nt, Homo sapiens
auguaucaguguccuuu

SEQ ID NO: 1615118 - RNA, 17 nt, Homo sapiens
auguaucuauuuguaca

SEQ ID NO: 1615119 - RNA, 19 nt, Homo sapiens
auguaucucaguaccccau

SEQ ID NO: 1615120 - RNA, 13 nt, Homo sapiens
auguauguacaau

SEQ ID NO: 1615121 - RNA, 19 nt, Homo sapiens
auguauuuuccuaauguga

SEQ ID NO: 1615122 - RNA, 21 nt, Homo sapiens
auguauuuuccuaaugugauc

SEQ ID NO: 1615123 - RNA, 13 nt, Homo sapiens
augucaagcacca

SEQ ID NO: 1615124 - RNA, 21 nt, Homo sapiens
augucaauaaaaccacuguac

SEQ ID NO: 1615125 - RNA, 14 nt, Homo sapiens
augucacagauucc

SEQ ID NO: 1615126 - RNA, 15 nt, Homo sapiens
augucacagauuccu

SEQ ID NO: 1615127 - RNA, 17 nt, Homo sapiens
augucacgaacuugaaa

SEQ ID NO: 1615128 - RNA, 18 nt, Homo sapiens
augucagggcacauguga

SEQ ID NO: 1615129 - RNA, 21 nt, Homo sapiens
augucauagaagaaaauccau

SEQ ID NO: 1615130 - RNA, 12 nt, Homo sapiens
augucaucaaaa

SEQ ID NO: 1615131 - RNA, 20 nt, Homo sapiens
augucauugucuacuccuag

SEQ ID NO: 1615132 - RNA, 11 nt, Homo sapiens
auguccaaaga

SEQ ID NO: 1615133 - RNA, 19 nt, Homo sapiens
auguccgugagaacaucau

SEQ ID NO: 1615134 - RNA, 17 nt, Homo sapiens
auguccuuuuaugauuu

SEQ ID NO: 1615135 - RNA, 17 nt, Homo sapiens
augucgaugacuucauc

SEQ ID NO: 1615136 - RNA, 14 nt, Homo sapiens
augucuauguagcu

SEQ ID NO: 1615137 - RNA, 19 nt, Homo sapiens
augucuauguagcugaaaa

SEQ ID NO: 1615138 - RNA, 16 nt, Homo sapiens
augucuauucagcuuc

SEQ ID NO: 1615139 - RNA, 21 nt, Homo sapiens
augucuccccaguuccacagc

SEQ ID NO: 1615140 - RNA, 13 nt, Homo sapiens
augucucucauga

SEQ ID NO: 1615141 - RNA, 21 nt, Homo sapiens
augucucuuuggcgaccuccu

SEQ ID NO: 1615142 - RNA, 23 nt, Homo sapiens
augucuguauuucauucuuguug

SEQ ID NO: 1615143 - RNA, 22 nt, Homo sapiens
augucuugcuguugacauauuu

SEQ ID NO: 1615144 - RNA, 14 nt, Homo sapiens
augugaaacacuuu

SEQ ID NO: 1615145 - RNA, 13 nt, Homo sapiens
augugaacaugga

SEQ ID NO: 1615146 - RNA, 22 nt, Homo sapiens
augugaacauggaaacaacuuc

SEQ ID NO: 1615147 - RNA, 13 nt, Homo sapiens
augugaagucucu

SEQ ID NO: 1615148 - RNA, 20 nt, Homo sapiens
augugaauuauugacacuga

SEQ ID NO: 1615149 - RNA, 13 nt, Homo sapiens
augugacuacuga

SEQ ID NO: 1615150 - RNA, 15 nt, Homo sapiens
augugacucuuucca

SEQ ID NO: 1615151 - RNA, 15 nt, Homo sapiens
augugauguggugcg

SEQ ID NO: 1615152 - RNA, 22 nt, Homo sapiens
augugauuuuauggugauguca

SEQ ID NO: 1615153 - RNA, 10 nt, Homo sapiens
augugcaaua

SEQ ID NO: 1615154 - RNA, 20 nt, Homo sapiens
augugccuuucuuugccucu

SEQ ID NO: 1615155 - RNA, 12 nt, Homo sapiens
augugcuauuaa

SEQ ID NO: 1615156 - RNA, 18 nt, Homo sapiens
augugcuugccaugugua

SEQ ID NO: 1615157 - RNA, 15 nt, Homo sapiens
auguggaaugcagcc

SEQ ID NO: 1615158 - RNA, 17 nt, Homo sapiens
auguggccugcauguac

SEQ ID NO: 1615159 - RNA, 21 nt, Homo sapiens
auguggguuaucauggaagaa

SEQ ID NO: 1615160 - RNA, 12 nt, Homo sapiens
augugguacuac

SEQ ID NO: 1615161 - RNA, 13 nt, Homo sapiens
auguggucaugga

SEQ ID NO: 1615162 - RNA, 14 nt, Homo sapiens
augugguuuguaca

SEQ ID NO: 1615163 - RNA, 13 nt, Homo sapiens
augaagguaauau

SEQ ID NO: 1615164 - RNA, 12 nt, Homo sapiens
augaagugcaau

SEQ ID NO: 1615165 - RNA, 18 nt, Homo sapiens
augaaguuaugcugucau

SEQ ID NO: 1615166 - RNA, 18 nt, Homo sapiens
augaauauagaugcuggc

SEQ ID NO: 1615167 - RNA, 13 nt, Homo sapiens
augaauaugaucc

SEQ ID NO: 1615168 - RNA, 18 nt, Homo sapiens
augaauaugaucccuaau

SEQ ID NO: 1615169 - RNA, 20 nt, Homo sapiens
augaaucauauucauaugca

SEQ ID NO: 1615170 - RNA, 16 nt, Homo sapiens
augaaugcuucuagaa

SEQ ID NO: 1615171 - RNA, 17 nt, Homo sapiens
augaauuaacccaaaga

SEQ ID NO: 1615172 - RNA, 21 nt, Homo sapiens
augaauuuaucuuuaccaaaa

SEQ ID NO: 1615173 - RNA, 16 nt, Homo sapiens
augacaacaccugguu

SEQ ID NO: 1615174 - RNA, 21 nt, Homo sapiens
augacaagaugggacagcaac

SEQ ID NO: 1615175 - RNA, 15 nt, Homo sapiens
augacaaucaguuau

SEQ ID NO: 1615176 - RNA, 21 nt, Homo sapiens
augacaguauuauacgcuggc

SEQ ID NO: 1615177 - RNA, 15 nt, Homo sapiens
augacauugaacuga

SEQ ID NO: 1615178 - RNA, 20 nt, Homo sapiens
augaccagaagccuuggaac

SEQ ID NO: 1615179 - RNA, 21 nt, Homo sapiens
augaccaguuguuauuuacag

SEQ ID NO: 1615180 - RNA, 19 nt, Homo sapiens
augaccuugggguacaauu

SEQ ID NO: 1615181 - RNA, 17 nt, Homo sapiens
augagaaaggacagagc

SEQ ID NO: 1615182 - RNA, 13 nt, Homo sapiens
augagaagcagaa

SEQ ID NO: 1615183 - RNA, 21 nt, Homo sapiens
augagaaggcagccaccagcg

SEQ ID NO: 1615184 - RNA, 17 nt, Homo sapiens
augagacagacauucac

SEQ ID NO: 1615185 - RNA, 16 nt, Homo sapiens
augagacuuacugcuc

SEQ ID NO: 1615186 - RNA, 13 nt, Homo sapiens
augagacuuugaa

SEQ ID NO: 1615187 - RNA, 23 nt, Homo sapiens
augagacuuugaaacuaucucau

SEQ ID NO: 1615188 - RNA, 21 nt, Homo sapiens
augagauuuuucuauccaaau

SEQ ID NO: 1615189 - RNA, 23 nt, Homo sapiens
augagcaagccuagguacgaaga

SEQ ID NO: 1615190 - RNA, 14 nt, Homo sapiens
augagcacaucucu

SEQ ID NO: 1615191 - RNA, 17 nt, Homo sapiens
augagcacccauuccaa

SEQ ID NO: 1615192 - RNA, 18 nt, Homo sapiens
augagcacccauuccaaa

SEQ ID NO: 1615193 - RNA, 20 nt, Homo sapiens
augagcacguuuuuguaaaa

SEQ ID NO: 1615194 - RNA, 16 nt, Homo sapiens
augagcccacccugcu

SEQ ID NO: 1615195 - RNA, 15 nt, Homo sapiens
augagcccuagaaga

SEQ ID NO: 1615196 - RNA, 17 nt, Homo sapiens
augagcccuggcuccca

SEQ ID NO: 1615197 - RNA, 17 nt, Homo sapiens
augagcuauccuuucaa

SEQ ID NO: 1615198 - RNA, 11 nt, Homo sapiens
augagcucaaa

SEQ ID NO: 1615199 - RNA, 13 nt, Homo sapiens
augaggacagagg

SEQ ID NO: 1615200 - RNA, 18 nt, Homo sapiens
augaggauaaugggaaga

SEQ ID NO: 1615201 - RNA, 22 nt, Homo sapiens
augaggggaagccauuuuccag

SEQ ID NO: 1615202 - RNA, 15 nt, Homo sapiens
augaggucuguuuaa

SEQ ID NO: 1615203 - RNA, 16 nt, Homo sapiens
augaggugccacccag

SEQ ID NO: 1615204 - RNA, 17 nt, Homo sapiens
augaguaauacaucaaa

SEQ ID NO: 1615205 - RNA, 21 nt, Homo sapiens
augaguaauacaucaaagagu

SEQ ID NO: 1615206 - RNA, 16 nt, Homo sapiens
augaguuaacugugaa

SEQ ID NO: 1615207 - RNA, 17 nt, Homo sapiens
augaguucaaauacuuu

SEQ ID NO: 1615208 - RNA, 20 nt, Homo sapiens
augaguuggacuucagucuu

SEQ ID NO: 1615209 - RNA, 16 nt, Homo sapiens
augauaacuaaaaucc

SEQ ID NO: 1615210 - RNA, 16 nt, Homo sapiens
augauaaggcucugaa

SEQ ID NO: 1615211 - RNA, 17 nt, Homo sapiens
augauaauaaaggcauu

SEQ ID NO: 1615212 - RNA, 17 nt, Homo sapiens
augauaauuauuuacaa

SEQ ID NO: 1615213 - RNA, 14 nt, Homo sapiens
augauagcagacau

SEQ ID NO: 1615214 - RNA, 15 nt, Homo sapiens
augauauauucuuga

SEQ ID NO: 1615215 - RNA, 19 nt, Homo sapiens
augaucaaaaauaaugcau

SEQ ID NO: 1615216 - RNA, 20 nt, Homo sapiens
augaucacauucuuuccaaa

SEQ ID NO: 1615217 - RNA, 16 nt, Homo sapiens
augauccuugcugaua

SEQ ID NO: 1615218 - RNA, 20 nt, Homo sapiens
augaucucccucuaagcaca

SEQ ID NO: 1615219 - RNA, 22 nt, Homo sapiens
augaugagguuuucuuaacuua

SEQ ID NO: 1615220 - RNA, 15 nt, Homo sapiens
augaugauguggaag

SEQ ID NO: 1615221 - RNA, 18 nt, Homo sapiens
augaugcuagccagcaaa

SEQ ID NO: 1615222 - RNA, 13 nt, Homo sapiens
augauucaagcca

SEQ ID NO: 1615223 - RNA, 14 nt, Homo sapiens
augauucaagccau

SEQ ID NO: 1615224 - RNA, 19 nt, Homo sapiens
augauucaagccauuccaa

SEQ ID NO: 1615225 - RNA, 19 nt, Homo sapiens
augauuccaccuacaugag

SEQ ID NO: 1615226 - RNA, 19 nt, Homo sapiens
augauugaaaccaaguuga

SEQ ID NO: 1615227 - RNA, 16 nt, Homo sapiens
augauuucacagugug

SEQ ID NO: 1615228 - RNA, 20 nt, Homo sapiens
augauuugcuguuaccaaau

SEQ ID NO: 1615229 - RNA, 19 nt, Homo sapiens
augcaaaaaaugcuuuguu

SEQ ID NO: 1615230 - RNA, 15 nt, Homo sapiens
augcaaaucaauuac

SEQ ID NO: 1615231 - RNA, 16 nt, Homo sapiens
augcaacauacgggaa

SEQ ID NO: 1615232 - RNA, 12 nt, Homo sapiens
augcaagcagcu

SEQ ID NO: 1615233 - RNA, 14 nt, Homo sapiens
augcaagccagcuu

SEQ ID NO: 1615234 - RNA, 21 nt, Homo sapiens
augcaauaaaauuauuugcag

SEQ ID NO: 1615235 - RNA, 19 nt, Homo sapiens
augcaauguaagcauacuu

SEQ ID NO: 1615236 - RNA, 21 nt, Homo sapiens
augcaauuucauuuaaacuuc

SEQ ID NO: 1615237 - RNA, 19 nt, Homo sapiens
augcacaaacaugugugua

SEQ ID NO: 1615238 - RNA, 14 nt, Homo sapiens
augcacacugagaa

SEQ ID NO: 1615239 - RNA, 18 nt, Homo sapiens
augcacagucauacaagu

SEQ ID NO: 1615240 - RNA, 13 nt, Homo sapiens
augcacuaagaca

SEQ ID NO: 1615241 - RNA, 15 nt, Homo sapiens
augcacuaagacaag

SEQ ID NO: 1615242 - RNA, 17 nt, Homo sapiens
augcacuaagacaagaa

SEQ ID NO: 1615243 - RNA, 22 nt, Homo sapiens
augcacuguucccccugugcag

SEQ ID NO: 1615244 - RNA, 19 nt, Homo sapiens
augcacuugaaaugauggu

SEQ ID NO: 1615245 - RNA, 22 nt, Homo sapiens
augcacuuggccugacucagga

SEQ ID NO: 1615246 - RNA, 16 nt, Homo sapiens
augcagacaacaccuu

SEQ ID NO: 1615247 - RNA, 17 nt, Homo sapiens
augcagauuacacugau

SEQ ID NO: 1615248 - RNA, 21 nt, Homo sapiens
augcagcucacuacccuauuc

SEQ ID NO: 1615249 - RNA, 20 nt, Homo sapiens
augcagcucuucaacaugac

SEQ ID NO: 1615250 - RNA, 23 nt, Homo sapiens
augcagcuguggcagaguuacag

SEQ ID NO: 1615251 - RNA, 23 nt, Homo sapiens
augcaggaagugguggcaaaggu

SEQ ID NO: 1615252 - RNA, 23 nt, Homo sapiens
augcaggcagcacagcagacuag

SEQ ID NO: 1615253 - RNA, 18 nt, Homo sapiens
augcaggugaugccauua

SEQ ID NO: 1615254 - RNA, 16 nt, Homo sapiens
augcaguuccaaucaa

SEQ ID NO: 1615255 - RNA, 13 nt, Homo sapiens
augcaguuuucau

SEQ ID NO: 1615256 - RNA, 14 nt, Homo sapiens
augcauaaaugcga

SEQ ID NO: 1615257 - RNA, 20 nt, Homo sapiens
augcauggaaacauggagga

SEQ ID NO: 1615258 - RNA, 19 nt, Homo sapiens
augcaugucugccuaugca

SEQ ID NO: 1615259 - RNA, 12 nt, Homo sapiens
augcauuauuaa

SEQ ID NO: 1615260 - RNA, 19 nt, Homo sapiens
augccacaaauaacaucuc

SEQ ID NO: 1615261 - RNA, 20 nt, Homo sapiens
augccacaaauaacaucuca

SEQ ID NO: 1615262 - RNA, 11 nt, Homo sapiens
augccacagac

SEQ ID NO: 1615263 - RNA, 17 nt, Homo sapiens
augccaccaacuuacaa

SEQ ID NO: 1615264 - RNA, 17 nt, Homo sapiens
augccaccacacguguu

SEQ ID NO: 1615265 - RNA, 16 nt, Homo sapiens
augccaggaaccuguc

SEQ ID NO: 1615266 - RNA, 15 nt, Homo sapiens
augccagugccuuau

SEQ ID NO: 1615267 - RNA, 20 nt, Homo sapiens
augcccauuugugaagcuua

SEQ ID NO: 1615268 - RNA, 21 nt, Homo sapiens
augcccccuguggaugcugcu

SEQ ID NO: 1615269 - RNA, 13 nt, Homo sapiens
augcccugugugg

SEQ ID NO: 1615270 - RNA, 18 nt, Homo sapiens
augccgguuaaauuccau

SEQ ID NO: 1615271 - RNA, 14 nt, Homo sapiens
augccugacucagu

SEQ ID NO: 1615272 - RNA, 17 nt, Homo sapiens
augccuguaaucccagc

SEQ ID NO: 1615273 - RNA, 20 nt, Homo sapiens
augccuguggugaagugugg

SEQ ID NO: 1615274 - RNA, 20 nt, Homo sapiens
augcuaacaaagacaaaagu

SEQ ID NO: 1615275 - RNA, 18 nt, Homo sapiens
augcuacauauaugcaau

SEQ ID NO: 1615276 - RNA, 20 nt, Homo sapiens
augcucaaaaucuuuccaaa

SEQ ID NO: 1615277 - RNA, 13 nt, Homo sapiens
augcucaccaagg

SEQ ID NO: 1615278 - RNA, 14 nt, Homo sapiens
augcucaccaagga

SEQ ID NO: 1615279 - RNA, 20 nt, Homo sapiens
augcucaggagccaccagca

SEQ ID NO: 1615280 - RNA, 18 nt, Homo sapiens
augcucaggcuacuauag

SEQ ID NO: 1615281 - RNA, 22 nt, Homo sapiens
augcucaguuggugcugcuuuc

SEQ ID NO: 1615282 - RNA, 19 nt, Homo sapiens
agagacucagaugaggaca

SEQ ID NO: 1615283 - RNA, 14 nt, Homo sapiens
agagacuccgucuc

SEQ ID NO: 1615284 - RNA, 15 nt, Homo sapiens
agagacuccgucuca

SEQ ID NO: 1615285 - RNA, 20 nt, Homo sapiens
agagagaaguucauacaaag

SEQ ID NO: 1615286 - RNA, 15 nt, Homo sapiens
agagauacacagaua

SEQ ID NO: 1615287 - RNA, 12 nt, Homo sapiens
agagauacagua

SEQ ID NO: 1615288 - RNA, 15 nt, Homo sapiens
agagauagcuucucu

SEQ ID NO: 1615289 - RNA, 20 nt, Homo sapiens
agagaucagcgacccugagg

SEQ ID NO: 1615290 - RNA, 18 nt, Homo sapiens
agagaucucccuucucau

SEQ ID NO: 1615291 - RNA, 22 nt, Homo sapiens
agagaucuuucuuuccaaaaca

SEQ ID NO: 1615292 - RNA, 16 nt, Homo sapiens
agagauggauauugaa

SEQ ID NO: 1615293 - RNA, 18 nt, Homo sapiens
agagauggauauugaaau

SEQ ID NO: 1615294 - RNA, 20 nt, Homo sapiens
agagcaaaacuccgucucaa

SEQ ID NO: 1615295 - RNA, 14 nt, Homo sapiens
agagcaaucagaau

SEQ ID NO: 1615296 - RNA, 16 nt, Homo sapiens
agagcacaccuaucuu

SEQ ID NO: 1615297 - RNA, 16 nt, Homo sapiens
agagcacucauuccuu

SEQ ID NO: 1615298 - RNA, 12 nt, Homo sapiens
agagcagcagca

SEQ ID NO: 1615299 - RNA, 15 nt, Homo sapiens
agagcaugcacaugc

SEQ ID NO: 1615300 - RNA, 16 nt, Homo sapiens
agagccagcaggucaa

SEQ ID NO: 1615301 - RNA, 23 nt, Homo sapiens
agagccaggcacacacugugcuu

SEQ ID NO: 1615302 - RNA, 19 nt, Homo sapiens
agagcccuugccuccccau

SEQ ID NO: 1615303 - RNA, 17 nt, Homo sapiens
agagcgaggaaaggauu

SEQ ID NO: 1615304 - RNA, 18 nt, Homo sapiens
agagcgaggaaaggauuu

SEQ ID NO: 1615305 - RNA, 21 nt, Homo sapiens
agagcugaguugggggugugg

SEQ ID NO: 1615306 - RNA, 14 nt, Homo sapiens
auaguaaugugaug

SEQ ID NO: 1615307 - RNA, 19 nt, Homo sapiens
auaguaccuucaauacuua

SEQ ID NO: 1615308 - RNA, 13 nt, Homo sapiens
auaguacuauuaa

SEQ ID NO: 1615309 - RNA, 21 nt, Homo sapiens
auaguagaaagacaucugccu

SEQ ID NO: 1615310 - RNA, 15 nt, Homo sapiens
auaguagacacacua

SEQ ID NO: 1615311 - RNA, 22 nt, Homo sapiens
auagucccauuuuucucuugcc

SEQ ID NO: 1615312 - RNA, 23 nt, Homo sapiens
auagucuugaaaugaaagggaaa

SEQ ID NO: 1615313 - RNA, 14 nt, Homo sapiens
auagucuuugccag

SEQ ID NO: 1615314 - RNA, 14 nt, Homo sapiens
auagugcacaaaau

SEQ ID NO: 1615315 - RNA, 22 nt, Homo sapiens
auagugccagguggcucagugc

SEQ ID NO: 1615316 - RNA, 23 nt, Homo sapiens
auaguggcauaccaaauggcacu

SEQ ID NO: 1615317 - RNA, 18 nt, Homo sapiens
auaguguccuaugcaaua

SEQ ID NO: 1615318 - RNA, 16 nt, Homo sapiens
auaguguuaacuguca

SEQ ID NO: 1615319 - RNA, 13 nt, Homo sapiens
auaguuacugugu

SEQ ID NO: 1615320 - RNA, 15 nt, Homo sapiens
auaguuacuguguaa

SEQ ID NO: 1615321 - RNA, 15 nt, Homo sapiens
auaguuaugccugua

SEQ ID NO: 1615322 - RNA, 19 nt, Homo sapiens
auaguuauuaaauguuuca

SEQ ID NO: 1615323 - RNA, 23 nt, Homo sapiens
auaguuuuucagucuauggguuu

SEQ ID NO: 1615324 - RNA, 15 nt, Homo sapiens
auauaaaacagucau

SEQ ID NO: 1615325 - RNA, 14 nt, Homo sapiens
auauaacuaucucu

SEQ ID NO: 1615326 - RNA, 15 nt, Homo sapiens
auauaagacugcugc

SEQ ID NO: 1615327 - RNA, 16 nt, Homo sapiens
auauaaggaaagcaau

SEQ ID NO: 1615328 - RNA, 18 nt, Homo sapiens
auauaaggaaagcaauaa

SEQ ID NO: 1615329 - RNA, 14 nt, Homo sapiens
auauaaugaugcug

SEQ ID NO: 1615330 - RNA, 15 nt, Homo sapiens
auauaauuuaaugua

SEQ ID NO: 1615331 - RNA, 15 nt, Homo sapiens
auauacaaaacuuua

SEQ ID NO: 1615332 - RNA, 22 nt, Homo sapiens
auauacauagucuuuguuuaca

SEQ ID NO: 1615333 - RNA, 12 nt, Homo sapiens
auauaccaaauu

SEQ ID NO: 1615334 - RNA, 15 nt, Homo sapiens
auauaccuaauguua

SEQ ID NO: 1615335 - RNA, 14 nt, Homo sapiens
auauacucaugucc

SEQ ID NO: 1615336 - RNA, 13 nt, Homo sapiens
auauacuuauaga

SEQ ID NO: 1615337 - RNA, 23 nt, Homo sapiens
auauacuuauagaauucagucaa

SEQ ID NO: 1615338 - RNA, 18 nt, Homo sapiens
auauacuugacucuaaua

SEQ ID NO: 1615339 - RNA, 15 nt, Homo sapiens
auauagagacaggac

SEQ ID NO: 1615340 - RNA, 12 nt, Homo sapiens
auauaggauaau

SEQ ID NO: 1615341 - RNA, 16 nt, Homo sapiens
auauaguggaugauau

SEQ ID NO: 1615342 - RNA, 13 nt, Homo sapiens
auauauaaucauc

SEQ ID NO: 1615343 - RNA, 14 nt, Homo sapiens
auauaugcaauaua

SEQ ID NO: 1615344 - RNA, 22 nt, Homo sapiens
auauauuaauaaucuuggcaau

SEQ ID NO: 1615345 - RNA, 21 nt, Homo sapiens
auauauuguguugacuuuaua

SEQ ID NO: 1615346 - RNA, 20 nt, Homo sapiens
auauauuuucauccuauaag

SEQ ID NO: 1615347 - RNA, 18 nt, Homo sapiens
auaucaaaucuaccacug

SEQ ID NO: 1615348 - RNA, 16 nt, Homo sapiens
auaucaagguuucaau

SEQ ID NO: 1615349 - RNA, 15 nt, Homo sapiens
auaucaauggugcug

SEQ ID NO: 1615350 - RNA, 22 nt, Homo sapiens
auaucaauguuuguccuguaua

SEQ ID NO: 1615351 - RNA, 13 nt, Homo sapiens
auaucacacaaua

SEQ ID NO: 1615352 - RNA, 22 nt, Homo sapiens
auaucacacacauugcugugaa

SEQ ID NO: 1615353 - RNA, 22 nt, Homo sapiens
auaucaguauucugacauguaa

SEQ ID NO: 1615354 - RNA, 23 nt, Homo sapiens
auaucauucacccaaaacaaagu

SEQ ID NO: 1615355 - RNA, 22 nt, Homo sapiens
auaucgcuggccagcauuauaa

SEQ ID NO: 1615356 - RNA, 13 nt, Homo sapiens
auaucuaccccag

SEQ ID NO: 1615357 - RNA, 18 nt, Homo sapiens
auaucucaaugugcaaua

SEQ ID NO: 1615358 - RNA, 17 nt, Homo sapiens
auaucucaauuaccaau

SEQ ID NO: 1615359 - RNA, 20 nt, Homo sapiens
auaucugcuguccagacagc

SEQ ID NO: 1615360 - RNA, 16 nt, Homo sapiens
auaucuguaaugauac

SEQ ID NO: 1615361 - RNA, 20 nt, Homo sapiens
auaucuuggacaaaucacau

SEQ ID NO: 1615362 - RNA, 20 nt, Homo sapiens
auaucuuuaugggcucuguu

SEQ ID NO: 1615363 - RNA, 20 nt, Homo sapiens
auaucuuugcugcuuuccag

SEQ ID NO: 1615364 - RNA, 21 nt, Homo sapiens
auaugaaaaucuccaucucaa

SEQ ID NO: 1615365 - RNA, 18 nt, Homo sapiens
auaugaguaauacaucaa

SEQ ID NO: 1615366 - RNA, 21 nt, Homo sapiens
auaugaguaauacaucaaaga

SEQ ID NO: 1615367 - RNA, 14 nt, Homo sapiens
auaugauaaaacac

SEQ ID NO: 1615368 - RNA, 22 nt, Homo sapiens
auaugcaggacggcaguacuca

SEQ ID NO: 1615369 - RNA, 15 nt, Homo sapiens
auauggaauuuugca

SEQ ID NO: 1615370 - RNA, 19 nt, Homo sapiens
auauggacacuacacuggg

SEQ ID NO: 1615371 - RNA, 13 nt, Homo sapiens
auauggcugccca

SEQ ID NO: 1615372 - RNA, 18 nt, Homo sapiens
auaugggaggaacaaaga

SEQ ID NO: 1615373 - RNA, 21 nt, Homo sapiens
auaugguccuagacaaaccau

SEQ ID NO: 1615374 - RNA, 14 nt, Homo sapiens
auauguagccuuca

SEQ ID NO: 1615375 - RNA, 21 nt, Homo sapiens
auauguagccuucacacagau

SEQ ID NO: 1615376 - RNA, 18 nt, Homo sapiens
auauguauaucacauucc

SEQ ID NO: 1615377 - RNA, 19 nt, Homo sapiens
auaugugguuugguaguau

SEQ ID NO: 1615378 - RNA, 18 nt, Homo sapiens
auauguguaaagauuuau

SEQ ID NO: 1615379 - RNA, 15 nt, Homo sapiens
auauuaaaagaacuc

SEQ ID NO: 1615380 - RNA, 12 nt, Homo sapiens
auauuaacauuc

SEQ ID NO: 1615381 - RNA, 15 nt, Homo sapiens
auauuagugcagcca

SEQ ID NO: 1615382 - RNA, 14 nt, Homo sapiens
auauuauaacucau

SEQ ID NO: 1615383 - RNA, 20 nt, Homo sapiens
auauucaaacauuauucuca

SEQ ID NO: 1615384 - RNA, 16 nt, Homo sapiens
auauucaguggugaaa

SEQ ID NO: 1615385 - RNA, 13 nt, Homo sapiens
auauucccaagcu

SEQ ID NO: 1615386 - RNA, 20 nt, Homo sapiens
auauucucuauuuuacuuuu

SEQ ID NO: 1615387 - RNA, 16 nt, Homo sapiens
auauugagaugacacu

SEQ ID NO: 1615388 - RNA, 18 nt, Homo sapiens
auauugagcaauauguca

SEQ ID NO: 1615389 - RNA, 17 nt, Homo sapiens
auauugaucaccaugaa

SEQ ID NO: 1615390 - RNA, 18 nt, Homo sapiens
auauugcaguaguauuua

SEQ ID NO: 1615391 - RNA, 21 nt, Homo sapiens
auauugcucuauauguaauau

SEQ ID NO: 1615392 - RNA, 17 nt, Homo sapiens
auauuguauaggggcaa

SEQ ID NO: 1615393 - RNA, 19 nt, Homo sapiens
auauuuaaaaaauuaugga

SEQ ID NO: 1615394 - RNA, 15 nt, Homo sapiens
auauuuaaaacauca

SEQ ID NO: 1615395 - RNA, 22 nt, Homo sapiens
auauuuaacuggugcacuuugu

SEQ ID NO: 1615396 - RNA, 14 nt, Homo sapiens
auauuuacaaugua

SEQ ID NO: 1615397 - RNA, 16 nt, Homo sapiens
auauuuaggguacuau

SEQ ID NO: 1615398 - RNA, 19 nt, Homo sapiens
auauuuauacagcagagaa

SEQ ID NO: 1615399 - RNA, 18 nt, Homo sapiens
auauuucuaccugaguga

SEQ ID NO: 1615400 - RNA, 19 nt, Homo sapiens
auauuucuaccugagugaa

SEQ ID NO: 1615401 - RNA, 17 nt, Homo sapiens
auauuucuugcuuucaa

SEQ ID NO: 1615402 - RNA, 22 nt, Homo sapiens
auauuuguaucacaaaucuuaa

SEQ ID NO: 1615403 - RNA, 20 nt, Homo sapiens
auauuugugugaaaauguga

SEQ ID NO: 1615404 - RNA, 16 nt, Homo sapiens
auauuuuaaagaccaa

SEQ ID NO: 1615405 - RNA, 17 nt, Homo sapiens
auauuuuaugaacauug

SEQ ID NO: 1615406 - RNA, 17 nt, Homo sapiens
auauuuuuccacuuaaa

SEQ ID NO: 1615407 - RNA, 15 nt, Homo sapiens
auauuuuugugcaca

SEQ ID NO: 1615408 - RNA, 17 nt, Homo sapiens
auauuuuuuuaacuuua

SEQ ID NO: 1615409 - RNA, 18 nt, Homo sapiens
aucaaaaaaccuuuacag

SEQ ID NO: 1615410 - RNA, 18 nt, Homo sapiens
aucaaaaaugccacuuaa

SEQ ID NO: 1615411 - RNA, 22 nt, Homo sapiens
aucaaaacuuggacccuuggaa

SEQ ID NO: 1615412 - RNA, 13 nt, Homo sapiens
aucaaaagacuuu

SEQ ID NO: 1615413 - RNA, 14 nt, Homo sapiens
aucaaaagacuuuu

SEQ ID NO: 1615414 - RNA, 22 nt, Homo sapiens
aucaaauugugcaguacuuugu

SEQ ID NO: 1615415 - RNA, 11 nt, Homo sapiens
aucaacaugac

SEQ ID NO: 1615416 - RNA, 15 nt, Homo sapiens
aucaacauuucucaa

SEQ ID NO: 1615417 - RNA, 12 nt, Homo sapiens
aucaaccuucaa

SEQ ID NO: 1615418 - RNA, 19 nt, Homo sapiens
aucaagacuaucuacaaaa

SEQ ID NO: 1615419 - RNA, 12 nt, Homo sapiens
aucaagauauau

SEQ ID NO: 1615420 - RNA, 21 nt, Homo sapiens
aucaaggauguaguaucucau

SEQ ID NO: 1615421 - RNA, 16 nt, Homo sapiens
aucaauacaaccagcc

SEQ ID NO: 1615422 - RNA, 19 nt, Homo sapiens
aucaaucugcaguuuaaca

SEQ ID NO: 1615423 - RNA, 19 nt, Homo sapiens
aucaaucuggcuucugcau

SEQ ID NO: 1615424 - RNA, 14 nt, Homo sapiens
aucaauuucuaaug

SEQ ID NO: 1615425 - RNA, 22 nt, Homo sapiens
aucacaaaggcugacauucacu

SEQ ID NO: 1615426 - RNA, 12 nt, Homo sapiens
aucacacagugu

SEQ ID NO: 1615427 - RNA, 12 nt, Homo sapiens
aucacacugcgg

SEQ ID NO: 1615428 - RNA, 19 nt, Homo sapiens
aucacacugggugguggcc

SEQ ID NO: 1615429 - RNA, 13 nt, Homo sapiens
aucacagggucac

SEQ ID NO: 1615430 - RNA, 16 nt, Homo sapiens
aucacaguguuuuuau

SEQ ID NO: 1615431 - RNA, 17 nt, Homo sapiens
aucacaguuguguuccu

SEQ ID NO: 1615432 - RNA, 19 nt, Homo sapiens
aucacaucuaaagcuuuau

SEQ ID NO: 1615433 - RNA, 22 nt, Homo sapiens
aucacaucuuaaagcuaaaaau

SEQ ID NO: 1615434 - RNA, 18 nt, Homo sapiens
aucacauucccauuugcu

SEQ ID NO: 1615435 - RNA, 16 nt, Homo sapiens
aucaccagccaugugc

SEQ ID NO: 1615436 - RNA, 23 nt, Homo sapiens
aucaccccucugccccugcagcu

SEQ ID NO: 1615437 - RNA, 18 nt, Homo sapiens
aucacccuaccaacuuua

SEQ ID NO: 1615438 - RNA, 13 nt, Homo sapiens
aucaccuauuuaa

SEQ ID NO: 1615439 - RNA, 18 nt, Homo sapiens
aucacgaggucaggagau

SEQ ID NO: 1615440 - RNA, 22 nt, Homo sapiens
aucacuaacauuauauugcaau

SEQ ID NO: 1615441 - RNA, 17 nt, Homo sapiens
aucacucuaauucggau

SEQ ID NO: 1615442 - RNA, 23 nt, Homo sapiens
aucacucuaauucggauuugcca

SEQ ID NO: 1615443 - RNA, 14 nt, Homo sapiens
aucacugcagucac

SEQ ID NO: 1615444 - RNA, 15 nt, Homo sapiens
aucacugguccaggu

SEQ ID NO: 1615445 - RNA, 13 nt, Homo sapiens
aucacuuaucagu

SEQ ID NO: 1615446 - RNA, 23 nt, Homo sapiens
aucacuugaacccgggaggcaga

SEQ ID NO: 1615447 - RNA, 20 nt, Homo sapiens
aucacuuucucaguuuucau

SEQ ID NO: 1615448 - RNA, 11 nt, Homo sapiens
aucacuuugac

SEQ ID NO: 1615449 - RNA, 21 nt, Homo sapiens
aucagaaaacaggguccagga

SEQ ID NO: 1615450 - RNA, 15 nt, Homo sapiens
aucagaaaaccaaag

SEQ ID NO: 1615451 - RNA, 16 nt, Homo sapiens
aucagaaacuugugaa

SEQ ID NO: 1615452 - RNA, 22 nt, Homo sapiens
aucagacccaacccaugaaggc

SEQ ID NO: 1615453 - RNA, 15 nt, Homo sapiens
aucagaccugcauug

SEQ ID NO: 1615454 - RNA, 14 nt, Homo sapiens
aucagacucuguaa

SEQ ID NO: 1615455 - RNA, 16 nt, Homo sapiens
aucagagaacuuuccc

SEQ ID NO: 1615456 - RNA, 17 nt, Homo sapiens
aucagagauaaagcuua

SEQ ID NO: 1615457 - RNA, 11 nt, Homo sapiens
aucagagccuu

SEQ ID NO: 1615458 - RNA, 19 nt, Homo sapiens
aucagaggaaauucuuucc

SEQ ID NO: 1615459 - RNA, 21 nt, Homo sapiens
aucagauccgugcgugaagua

SEQ ID NO: 1615460 - RNA, 22 nt, Homo sapiens
aucagaugcuuuccugcacauu

SEQ ID NO: 1615461 - RNA, 18 nt, Homo sapiens
aucagauggugucauuua

SEQ ID NO: 1615462 - RNA, 23 nt, Homo sapiens
aucagcacucuguaaaaugcacc

SEQ ID NO: 1615463 - RNA, 23 nt, Homo sapiens
aucagcuauuuugugaagccaug

SEQ ID NO: 1615464 - RNA, 21 nt, Homo sapiens
aucaggacagguggugcaaau

SEQ ID NO: 1615465 - RNA, 15 nt, Homo sapiens
aucaggacccagagg

SEQ ID NO: 1615466 - RNA, 18 nt, Homo sapiens
aucagggucuaagcaccu

SEQ ID NO: 1615467 - RNA, 15 nt, Homo sapiens
aucagucaacaacuu

SEQ ID NO: 1615468 - RNA, 18 nt, Homo sapiens
aucagucuccaacauguu

SEQ ID NO: 1615469 - RNA, 20 nt, Homo sapiens
aucagugacucacuuccaaa

SEQ ID NO: 1615470 - RNA, 17 nt, Homo sapiens
aucauacaaacucucac

SEQ ID NO: 1615471 - RNA, 15 nt, Homo sapiens
aucauacaccagaag

SEQ ID NO: 1615472 - RNA, 18 nt, Homo sapiens
aucauagcaagaccucau

SEQ ID NO: 1615473 - RNA, 20 nt, Homo sapiens
aucauagguaagguuuucaa

SEQ ID NO: 1615474 - RNA, 15 nt, Homo sapiens
aucaucaaguaauac

SEQ ID NO: 1615475 - RNA, 14 nt, Homo sapiens
aucaugaagcacau

SEQ ID NO: 1615476 - RNA, 16 nt, Homo sapiens
aucaugguacauuuau

SEQ ID NO: 1615477 - RNA, 22 nt, Homo sapiens
aucaugguacauuuaucacuga

SEQ ID NO: 1615478 - RNA, 15 nt, Homo sapiens
aucauguguguccac

SEQ ID NO: 1615479 - RNA, 15 nt, Homo sapiens
aucauuaauucacau

SEQ ID NO: 1615480 - RNA, 17 nt, Homo sapiens
aucauucaaguguaaaa

SEQ ID NO: 1615481 - RNA, 16 nt, Homo sapiens
aucauucucauucuca

SEQ ID NO: 1615482 - RNA, 19 nt, Homo sapiens
aucauuguuuauuguauac

SEQ ID NO: 1615483 - RNA, 18 nt, Homo sapiens
aucauuuauaauacuguu

SEQ ID NO: 1615484 - RNA, 18 nt, Homo sapiens
aucauuucugcaucagcu

SEQ ID NO: 1615485 - RNA, 13 nt, Homo sapiens
auccaaccacugu

SEQ ID NO: 1615486 - RNA, 17 nt, Homo sapiens
auccaaggaaacaugca

SEQ ID NO: 1615487 - RNA, 17 nt, Homo sapiens
auccaaugaguguuaca

SEQ ID NO: 1615488 - RNA, 12 nt, Homo sapiens
auccacauggga

SEQ ID NO: 1615489 - RNA, 16 nt, Homo sapiens
auccaccccaccccau

SEQ ID NO: 1615490 - RNA, 23 nt, Homo sapiens
auccaccgccacugggccuguca

SEQ ID NO: 1615491 - RNA, 20 nt, Homo sapiens
auccacuaacacuuuaguua

SEQ ID NO: 1615492 - RNA, 13 nt, Homo sapiens
auccagacagucg

SEQ ID NO: 1615493 - RNA, 17 nt, Homo sapiens
auccagcacuggugaac

SEQ ID NO: 1615494 - RNA, 23 nt, Homo sapiens
auccagccagaccccacgcugac

SEQ ID NO: 1615495 - RNA, 19 nt, Homo sapiens
auccagccaugccugaggu

SEQ ID NO: 1615496 - RNA, 16 nt, Homo sapiens
auccaggcuuuguaca

SEQ ID NO: 1615497 - RNA, 16 nt, Homo sapiens
auccagugauccuuac

SEQ ID NO: 1615498 - RNA, 20 nt, Homo sapiens
auccauagacacaguauuga

SEQ ID NO: 1615499 - RNA, 22 nt, Homo sapiens
auccauagauuucgaagccaca

SEQ ID NO: 1615500 - RNA, 19 nt, Homo sapiens
auccauauuugcuaagaau

SEQ ID NO: 1615501 - RNA, 24 nt, Homo sapiens
auccauccuugccaauagugucau

SEQ ID NO: 1615502 - RNA, 18 nt, Homo sapiens
auccaucuugagccacag

SEQ ID NO: 1615503 - RNA, 15 nt, Homo sapiens
auccaugcugugcug

SEQ ID NO: 1615504 - RNA, 16 nt, Homo sapiens
auccaugcuucucauc

SEQ ID NO: 1615505 - RNA, 19 nt, Homo sapiens
auccauggggcugauugua

SEQ ID NO: 1615506 - RNA, 14 nt, Homo sapiens
aucccagcuacuca

SEQ ID NO: 1615507 - RNA, 11 nt, Homo sapiens
aucccaugagc

SEQ ID NO: 1615508 - RNA, 15 nt, Homo sapiens
aucccaugagcuccu

SEQ ID NO: 1615509 - RNA, 23 nt, Homo sapiens
auccccaacuaugcaugccaagg

SEQ ID NO: 1615510 - RNA, 17 nt, Homo sapiens
auccccacccagucuca

SEQ ID NO: 1615511 - RNA, 16 nt, Homo sapiens
auccccguuucuugca

SEQ ID NO: 1615512 - RNA, 12 nt, Homo sapiens
aucccuaccccc

SEQ ID NO: 1615513 - RNA, 15 nt, Homo sapiens
aucccucucuucccc

SEQ ID NO: 1615514 - RNA, 19 nt, Homo sapiens
aucccugaggaaaagucca

SEQ ID NO: 1615515 - RNA, 21 nt, Homo sapiens
aucccugaggaaaaguccaca

SEQ ID NO: 1615516 - RNA, 17 nt, Homo sapiens
aucccuuaacaguugua

SEQ ID NO: 1615517 - RNA, 16 nt, Homo sapiens
aucccuuuuuuuacau

SEQ ID NO: 1615518 - RNA, 19 nt, Homo sapiens
aucccuuuuuuuacauuuc

SEQ ID NO: 1615519 - RNA, 20 nt, Homo sapiens
aucccuuuuuuuacauuuca

SEQ ID NO: 1615520 - RNA, 19 nt, Homo sapiens
auccgauuccccuguagca

SEQ ID NO: 1615521 - RNA, 17 nt, Homo sapiens
auccgcugccagccuug

SEQ ID NO: 1615522 - RNA, 13 nt, Homo sapiens
auccgggaggaca

SEQ ID NO: 1615523 - RNA, 17 nt, Homo sapiens
auccguaguucccugaa

SEQ ID NO: 1615524 - RNA, 23 nt, Homo sapiens
auccuacccccugugccuuguca

SEQ ID NO: 1615525 - RNA, 20 nt, Homo sapiens
auccucacagugaacacuca

SEQ ID NO: 1615526 - RNA, 12 nt, Homo sapiens
auccuccauugc

SEQ ID NO: 1615527 - RNA, 14 nt, Homo sapiens
auccuccauugcuc

SEQ ID NO: 1615528 - RNA, 18 nt, Homo sapiens
auccuccauuugcuguac

SEQ ID NO: 1615529 - RNA, 15 nt, Homo sapiens
auccucccuaucaag

SEQ ID NO: 1615530 - RNA, 21 nt, Homo sapiens
auccucccuggcagacacaac

SEQ ID NO: 1615531 - RNA, 23 nt, Homo sapiens
auccucuggaaaaggcuuucaug

SEQ ID NO: 1615532 - RNA, 19 nt, Homo sapiens
auccucuucccuuauucua

SEQ ID NO: 1615533 - RNA, 23 nt, Homo sapiens
auccugaaaaggguguugcuaag

SEQ ID NO: 1615534 - RNA, 14 nt, Homo sapiens
auccugaacuuucu

SEQ ID NO: 1615535 - RNA, 19 nt, Homo sapiens
auccugagugugaugaacg

SEQ ID NO: 1615536 - RNA, 14 nt, Homo sapiens
auccugcaauucca

SEQ ID NO: 1615537 - RNA, 22 nt, Homo sapiens
auccuggaaggacacagugaug

SEQ ID NO: 1615538 - RNA, 21 nt, Homo sapiens
auccuggguacugaaagccuu

SEQ ID NO: 1615539 - RNA, 22 nt, Homo sapiens
auccuggguacugaaagccuua

SEQ ID NO: 1615540 - RNA, 15 nt, Homo sapiens
auccuguguaccuca

SEQ ID NO: 1615541 - RNA, 20 nt, Homo sapiens
auccuguuuuuagugcugac

SEQ ID NO: 1615542 - RNA, 14 nt, Homo sapiens
auccuuccauucca

SEQ ID NO: 1615543 - RNA, 13 nt, Homo sapiens
auccuugugacuu

SEQ ID NO: 1615544 - RNA, 19 nt, Homo sapiens
aucgaaucuacuaauucca

SEQ ID NO: 1615545 - RNA, 19 nt, Homo sapiens
aucggcuggggacugcuac

SEQ ID NO: 1615546 - RNA, 16 nt, Homo sapiens
aucuaauaugauagcg

SEQ ID NO: 1615547 - RNA, 22 nt, Homo sapiens
aucuaauauggccacaguaguc

SEQ ID NO: 1615548 - RNA, 14 nt, Homo sapiens
aucuacacuccagu

SEQ ID NO: 1615549 - RNA, 15 nt, Homo sapiens
aucuacaguaaugaa

SEQ ID NO: 1615550 - RNA, 17 nt, Homo sapiens
aucuacuucuacaucca

SEQ ID NO: 1615551 - RNA, 17 nt, Homo sapiens
aucuagagcaaagccau

SEQ ID NO: 1615552 - RNA, 17 nt, Homo sapiens
aucuagcacacucuucu

SEQ ID NO: 1615553 - RNA, 15 nt, Homo sapiens
aucuauaaacagaca

SEQ ID NO: 1615554 - RNA, 20 nt, Homo sapiens
aucuauaacaaaugcuuuau

SEQ ID NO: 1615555 - RNA, 15 nt, Homo sapiens
aucuauaaugucagc

SEQ ID NO: 1615556 - RNA, 16 nt, Homo sapiens
aucuauagaacaucca

SEQ ID NO: 1615557 - RNA, 18 nt, Homo sapiens
aucuauagcuaaguacac

SEQ ID NO: 1615558 - RNA, 14 nt, Homo sapiens
aucuauaguagaca

SEQ ID NO: 1615559 - RNA, 13 nt, Homo sapiens
aucuauuaucuca

SEQ ID NO: 1615560 - RNA, 18 nt, Homo sapiens
aucuauucuucugaccau

SEQ ID NO: 1615561 - RNA, 16 nt, Homo sapiens
aucuauuuguacaauu

SEQ ID NO: 1615562 - RNA, 20 nt, Homo sapiens
aucucagccauucuaacuca

SEQ ID NO: 1615563 - RNA, 22 nt, Homo sapiens
aucucauuuuacacaaagggaa

SEQ ID NO: 1615564 - RNA, 21 nt, Homo sapiens
aucuccaauccacacauauug

SEQ ID NO: 1615565 - RNA, 17 nt, Homo sapiens
aucuccccucagauucc

SEQ ID NO: 1615566 - RNA, 18 nt, Homo sapiens
aucuccccucagauucca

SEQ ID NO: 1615567 - RNA, 13 nt, Homo sapiens
aucuccgccucca

SEQ ID NO: 1615568 - RNA, 14 nt, Homo sapiens
aucuccugaccucg

SEQ ID NO: 1615569 - RNA, 15 nt, Homo sapiens
aucucugaacuggua

SEQ ID NO: 1615570 - RNA, 14 nt, Homo sapiens
aucucuuccuugac

SEQ ID NO: 1615571 - RNA, 21 nt, Homo sapiens
aucucuucuuauacagauaaa

SEQ ID NO: 1615572 - RNA, 14 nt, Homo sapiens
aucucuuuaccucc

SEQ ID NO: 1615573 - RNA, 15 nt, Homo sapiens
aucucuuuaccuccu

SEQ ID NO: 1615574 - RNA, 18 nt, Homo sapiens
aucugaaacagcuucaug

SEQ ID NO: 1615575 - RNA, 19 nt, Homo sapiens
aucugaaagugguacuuga

SEQ ID NO: 1615576 - RNA, 14 nt, Homo sapiens
aucugaaauucaaa

SEQ ID NO: 1615577 - RNA, 13 nt, Homo sapiens
aucugaacauucu

SEQ ID NO: 1615578 - RNA, 20 nt, Homo sapiens
aucugcaaggacauuucuca

SEQ ID NO: 1615579 - RNA, 15 nt, Homo sapiens
aucugccaucugcuu

SEQ ID NO: 1615580 - RNA, 16 nt, Homo sapiens
aucugccauugggacc

SEQ ID NO: 1615581 - RNA, 23 nt, Homo sapiens
aucugcugaaggcagucauauca

SEQ ID NO: 1615582 - RNA, 18 nt, Homo sapiens
aucugcuguccagacagc

SEQ ID NO: 1615583 - RNA, 17 nt, Homo sapiens
aucugcuguugccagug

SEQ ID NO: 1615584 - RNA, 23 nt, Homo sapiens
aucuggaagccaccucaccaagg

SEQ ID NO: 1615585 - RNA, 14 nt, Homo sapiens
aucugggacugugc

SEQ ID NO: 1615586 - RNA, 16 nt, Homo sapiens
aucuggguaagaagaa

SEQ ID NO: 1615587 - RNA, 22 nt, Homo sapiens
aucuggguaagaagaaagcaaa

SEQ ID NO: 1615588 - RNA, 23 nt, Homo sapiens
aucugguaaaagcaccauuguga

SEQ ID NO: 1615589 - RNA, 16 nt, Homo sapiens
aucuggucccuugcag

SEQ ID NO: 1615590 - RNA, 13 nt, Homo sapiens
aucuguacuuugu

SEQ ID NO: 1615591 - RNA, 22 nt, Homo sapiens
aucugucacauaaaagucugug

SEQ ID NO: 1615592 - RNA, 20 nt, Homo sapiens
aucugucugugcacaugccu

SEQ ID NO: 1615593 - RNA, 21 nt, Homo sapiens
aucugucugugcacaugccuc

SEQ ID NO: 1615594 - RNA, 12 nt, Homo sapiens
aucuguguaaag

SEQ ID NO: 1615595 - RNA, 14 nt, Homo sapiens
aucuguuuguuacu

SEQ ID NO: 1615596 - RNA, 18 nt, Homo sapiens
aucuguuuguuacugcau

SEQ ID NO: 1615597 - RNA, 13 nt, Homo sapiens
aucuuaaaacuaa

SEQ ID NO: 1615598 - RNA, 17 nt, Homo sapiens
aucuuaaaagcuaucuu

SEQ ID NO: 1615599 - RNA, 16 nt, Homo sapiens
aucuuaagauccacaa

SEQ ID NO: 1615600 - RNA, 14 nt, Homo sapiens
aucuuaauguauau

SEQ ID NO: 1615601 - RNA, 21 nt, Homo sapiens
aucuucaauuuauuacugaaa

SEQ ID NO: 1615602 - RNA, 23 nt, Homo sapiens
aucuuccaaccccccaguauaaa

SEQ ID NO: 1615603 - RNA, 18 nt, Homo sapiens
aucuucccuuuauuacaa

SEQ ID NO: 1615604 - RNA, 22 nt, Homo sapiens
aucuucccuuuauuacaagaag

SEQ ID NO: 1615605 - RNA, 23 nt, Homo sapiens
aucuuccguggucagagugccac

SEQ ID NO: 1615606 - RNA, 15 nt, Homo sapiens
aucuucguacaugaa

SEQ ID NO: 1615607 - RNA, 12 nt, Homo sapiens
aucuucuacuuu

SEQ ID NO: 1615608 - RNA, 18 nt, Homo sapiens
aucuucuuauaacuugua

SEQ ID NO: 1615609 - RNA, 17 nt, Homo sapiens
aucuugaguugcagcuc

SEQ ID NO: 1615610 - RNA, 15 nt, Homo sapiens
aucuugcuaccagua

SEQ ID NO: 1615611 - RNA, 18 nt, Homo sapiens
aucuuggacaaaucacau

SEQ ID NO: 1615612 - RNA, 16 nt, Homo sapiens
aucuuguuacugcuga

SEQ ID NO: 1615613 - RNA, 21 nt, Homo sapiens
aucuuuaaaauacacacucaa

SEQ ID NO: 1615614 - RNA, 21 nt, Homo sapiens
aucuuuacaaaacuacaugag

SEQ ID NO: 1615615 - RNA, 12 nt, Homo sapiens
aucuuuaccucc

SEQ ID NO: 1615616 - RNA, 22 nt, Homo sapiens
aucuuuaccuccugaguaauaa

SEQ ID NO: 1615617 - RNA, 20 nt, Homo sapiens
aucuuuaucaugaagcacau

SEQ ID NO: 1615618 - RNA, 16 nt, Homo sapiens
aucuuucaaaccagcu

SEQ ID NO: 1615619 - RNA, 17 nt, Homo sapiens
aucuuucaccuuucuag

SEQ ID NO: 1615620 - RNA, 19 nt, Homo sapiens
aucuuucaugucuugucau

SEQ ID NO: 1615621 - RNA, 21 nt, Homo sapiens
aucuuucuuccaaacaggcuc

SEQ ID NO: 1615622 - RNA, 23 nt, Homo sapiens
aucuuucuuuccaaaacauuucu

SEQ ID NO: 1615623 - RNA, 15 nt, Homo sapiens
aucuuuggauuugau

SEQ ID NO: 1615624 - RNA, 15 nt, Homo sapiens
aucuuuguaccaaaa

SEQ ID NO: 1615625 - RNA, 18 nt, Homo sapiens
aucuuuguuuaaaugcca

SEQ ID NO: 1615626 - RNA, 19 nt, Homo sapiens
aucuuuguuuaaaugccaa

SEQ ID NO: 1615627 - RNA, 18 nt, Homo sapiens
aucuuuuuuaaacuguaa

SEQ ID NO: 1615628 - RNA, 15 nt, Homo sapiens
augaaacaacaaaac

SEQ ID NO: 1615629 - RNA, 22 nt, Homo sapiens
augaaacaacagagacagugaa

SEQ ID NO: 1615630 - RNA, 15 nt, Homo sapiens
augaaagugaugaca

SEQ ID NO: 1615631 - RNA, 15 nt, Homo sapiens
augaaauccagugag

SEQ ID NO: 1615632 - RNA, 16 nt, Homo sapiens
augaacacuacagaua

SEQ ID NO: 1615633 - RNA, 17 nt, Homo sapiens
augaacauauuguugaa

SEQ ID NO: 1615634 - RNA, 14 nt, Homo sapiens
augaacgugccuga

SEQ ID NO: 1615635 - RNA, 19 nt, Homo sapiens
augaacucuugaagucaca

SEQ ID NO: 1615636 - RNA, 20 nt, Homo sapiens
augaacuuuaaaaaagcaaa

SEQ ID NO: 1615637 - RNA, 15 nt, Homo sapiens
augaagaaaauugag

SEQ ID NO: 1615638 - RNA, 20 nt, Homo sapiens
augaagaaucacgauuucau

SEQ ID NO: 1615639 - RNA, 22 nt, Homo sapiens
augaagagcuauuuaaugacac

SEQ ID NO: 1615640 - RNA, 14 nt, Homo sapiens
augaagcacaucaa

SEQ ID NO: 1615641 - RNA, 19 nt, Homo sapiens
augaagcacaucaauuaca

SEQ ID NO: 1615642 - RNA, 12 nt, Homo sapiens
augaagcuuugg

SEQ ID NO: 1615643 - RNA, 20 nt, Homo sapiens
augaaggagugcgugccugc

SEQ ID NO: 1615644 - RNA, 13 nt, Homo sapiens
augaagggaaauu

SEQ ID NO: 1615645 - RNA, 15 nt, Homo sapiens
uggucacacacugau

SEQ ID NO: 1615646 - RNA, 19 nt, Homo sapiens
uggucacagacuucuggcc

SEQ ID NO: 1615647 - RNA, 19 nt, Homo sapiens
uggucacagccaugaaguc

SEQ ID NO: 1615648 - RNA, 23 nt, Homo sapiens
uggucacaugaugugcauagaga

SEQ ID NO: 1615649 - RNA, 17 nt, Homo sapiens
uggucacccaacucaag

SEQ ID NO: 1615650 - RNA, 17 nt, Homo sapiens
uggucagagugccacug

SEQ ID NO: 1615651 - RNA, 13 nt, Homo sapiens
uggucauccaaac

SEQ ID NO: 1615652 - RNA, 19 nt, Homo sapiens
uggucauuuccuaugcaaa

SEQ ID NO: 1615653 - RNA, 15 nt, Homo sapiens
ugguccaccuccuga

SEQ ID NO: 1615654 - RNA, 14 nt, Homo sapiens
ugguccuucccuga

SEQ ID NO: 1615655 - RNA, 17 nt, Homo sapiens
uggucuugaacuccuga

SEQ ID NO: 1615656 - RNA, 21 nt, Homo sapiens
uggugaaguaaauuaggcagu

SEQ ID NO: 1615657 - RNA, 11 nt, Homo sapiens
uggugacucac

SEQ ID NO: 1615658 - RNA, 14 nt, Homo sapiens
uggugagcagggga

SEQ ID NO: 1615659 - RNA, 13 nt, Homo sapiens
uggugaggcaaua

SEQ ID NO: 1615660 - RNA, 22 nt, Homo sapiens
uggugccauuucugaacuguua

SEQ ID NO: 1615661 - RNA, 19 nt, Homo sapiens
uggugcugcuuucuuguug

SEQ ID NO: 1615662 - RNA, 21 nt, Homo sapiens
ugguggaacccccaucucuac

SEQ ID NO: 1615663 - RNA, 21 nt, Homo sapiens
ugguggcaaagguuuauucca

SEQ ID NO: 1615664 - RNA, 18 nt, Homo sapiens
ugguggcauuguuuacag

SEQ ID NO: 1615665 - RNA, 19 nt, Homo sapiens
ugguggccagccagaucaa

SEQ ID NO: 1615666 - RNA, 21 nt, Homo sapiens
ugguggcccacugacuaagaa

SEQ ID NO: 1615667 - RNA, 23 nt, Homo sapiens
ugguguaaauauuagugcaguua

SEQ ID NO: 1615668 - RNA, 13 nt, Homo sapiens
ugguguauuguca

SEQ ID NO: 1615669 - RNA, 15 nt, Homo sapiens
ugguguccagucuuu

SEQ ID NO: 1615670 - RNA, 18 nt, Homo sapiens
uggugucuauuauaguga

SEQ ID NO: 1615671 - RNA, 15 nt, Homo sapiens
uggugucugugacau

SEQ ID NO: 1615672 - RNA, 19 nt, Homo sapiens
uggugugaaaauacacuua

SEQ ID NO: 1615673 - RNA, 13 nt, Homo sapiens
uggugugaacucu

SEQ ID NO: 1615674 - RNA, 13 nt, Homo sapiens
uggugugaucucg

SEQ ID NO: 1615675 - RNA, 23 nt, Homo sapiens
uggugugaucucggcucacugca

SEQ ID NO: 1615676 - RNA, 19 nt, Homo sapiens
ugguucacauccuaccccu

SEQ ID NO: 1615677 - RNA, 15 nt, Homo sapiens
ugguuccaaagacac

SEQ ID NO: 1615678 - RNA, 19 nt, Homo sapiens
ugguucccccacugaucac

SEQ ID NO: 1615679 - RNA, 21 nt, Homo sapiens
ugguucccuccccaaggccac

SEQ ID NO: 1615680 - RNA, 15 nt, Homo sapiens
ugguuccuacauccu

SEQ ID NO: 1615681 - RNA, 19 nt, Homo sapiens
ugguucuaacugcuguuaa

SEQ ID NO: 1615682 - RNA, 16 nt, Homo sapiens
ugguugaugccaaaaa

SEQ ID NO: 1615683 - RNA, 21 nt, Homo sapiens
ugguuugccugaggcuguaac

SEQ ID NO: 1615684 - RNA, 18 nt, Homo sapiens
ugguuuuucaguuuucag

SEQ ID NO: 1615685 - RNA, 13 nt, Homo sapiens
uguaaaaauccuu

SEQ ID NO: 1615686 - RNA, 19 nt, Homo sapiens
uguaaaaaugaaaagccaa

SEQ ID NO: 1615687 - RNA, 20 nt, Homo sapiens
uguaaaacgcaccaaucagc

SEQ ID NO: 1615688 - RNA, 12 nt, Homo sapiens
uguaaaaugcac

SEQ ID NO: 1615689 - RNA, 17 nt, Homo sapiens
uguaaacaagcaauaau

SEQ ID NO: 1615690 - RNA, 22 nt, Homo sapiens
uguaaacuguacuagucugugu

SEQ ID NO: 1615691 - RNA, 16 nt, Homo sapiens
uguaaagacaaauaaa

SEQ ID NO: 1615692 - RNA, 15 nt, Homo sapiens
uguaaagacacaucu

SEQ ID NO: 1615693 - RNA, 17 nt, Homo sapiens
uguaaagacacaucuua

SEQ ID NO: 1615694 - RNA, 19 nt, Homo sapiens
uguaaagauguuuauuuca

SEQ ID NO: 1615695 - RNA, 18 nt, Homo sapiens
uguaaauacacauagcau

SEQ ID NO: 1615696 - RNA, 13 nt, Homo sapiens
uguaaaugugaca

SEQ ID NO: 1615697 - RNA, 22 nt, Homo sapiens
uguaaauugcaaauaaaccacu

SEQ ID NO: 1615698 - RNA, 15 nt, Homo sapiens
uguaaauuucucaaa

SEQ ID NO: 1615699 - RNA, 20 nt, Homo sapiens
uguaacagauaucagugucu

SEQ ID NO: 1615700 - RNA, 23 nt, Homo sapiens
uguaacagcggcaggguguccca

SEQ ID NO: 1615701 - RNA, 14 nt, Homo sapiens
uguaaccacugcac

SEQ ID NO: 1615702 - RNA, 21 nt, Homo sapiens
uguaacugagagaaagauucu

SEQ ID NO: 1615703 - RNA, 17 nt, Homo sapiens
uguaacuguuacaguaa

SEQ ID NO: 1615704 - RNA, 19 nt, Homo sapiens
uguaagaacaacuaccuga

SEQ ID NO: 1615705 - RNA, 18 nt, Homo sapiens
uguaagaaggcaauauua

SEQ ID NO: 1615706 - RNA, 17 nt, Homo sapiens
uguaagauaauguugcu

SEQ ID NO: 1615707 - RNA, 17 nt, Homo sapiens
uguaagcauaacuuauu

SEQ ID NO: 1615708 - RNA, 14 nt, Homo sapiens
uguaaggugcuaca

SEQ ID NO: 1615709 - RNA, 23 nt, Homo sapiens
uguaauaaaucuaggaugugaug

SEQ ID NO: 1615710 - RNA, 13 nt, Homo sapiens
uguaauaagcaau

SEQ ID NO: 1615711 - RNA, 16 nt, Homo sapiens
uguaauacacagugag

SEQ ID NO: 1615712 - RNA, 21 nt, Homo sapiens
uguaauaccugauugaucaca

SEQ ID NO: 1615713 - RNA, 15 nt, Homo sapiens
uguaauacuuuacaa

SEQ ID NO: 1615714 - RNA, 19 nt, Homo sapiens
uguaauauuucuucaaaua

SEQ ID NO: 1615715 - RNA, 22 nt, Homo sapiens
uguaaucaaggccagugcuaaa

SEQ ID NO: 1615716 - RNA, 19 nt, Homo sapiens
uguaaucacagcuacuugg

SEQ ID NO: 1615717 - RNA, 16 nt, Homo sapiens
uguaaucccagcacuu

SEQ ID NO: 1615718 - RNA, 20 nt, Homo sapiens
uguaauccuugcauuuugga

SEQ ID NO: 1615719 - RNA, 16 nt, Homo sapiens
uguaaucucagcacuu

SEQ ID NO: 1615720 - RNA, 17 nt, Homo sapiens
uguaaucucagcacuuu

SEQ ID NO: 1615721 - RNA, 14 nt, Homo sapiens
uguaaugcugcaca

SEQ ID NO: 1615722 - RNA, 18 nt, Homo sapiens
uguaauggaacuuagcca

SEQ ID NO: 1615723 - RNA, 17 nt, Homo sapiens
uguaaugucaccaccuu

SEQ ID NO: 1615724 - RNA, 23 nt, Homo sapiens
uguacaauaaaaacauugccuuu

SEQ ID NO: 1615725 - RNA, 15 nt, Homo sapiens
uguacacaacaaucc

SEQ ID NO: 1615726 - RNA, 14 nt, Homo sapiens
uguacacagucagc

SEQ ID NO: 1615727 - RNA, 16 nt, Homo sapiens
uguacagucuuguauu

SEQ ID NO: 1615728 - RNA, 17 nt, Homo sapiens
uguacauguaguugaau

SEQ ID NO: 1615729 - RNA, 16 nt, Homo sapiens
uguaccugacuuccac

SEQ ID NO: 1615730 - RNA, 14 nt, Homo sapiens
uguaccugugcacg

SEQ ID NO: 1615731 - RNA, 17 nt, Homo sapiens
uguacuaauacagggag

SEQ ID NO: 1615732 - RNA, 14 nt, Homo sapiens
uguacuacagcuau

SEQ ID NO: 1615733 - RNA, 18 nt, Homo sapiens
uguagaagauggcacuua

SEQ ID NO: 1615734 - RNA, 17 nt, Homo sapiens
uguagaagccacuauua

SEQ ID NO: 1615735 - RNA, 23 nt, Homo sapiens
uguagaaguccacagacaucuuu

SEQ ID NO: 1615736 - RNA, 19 nt, Homo sapiens
uguagaccaccuaauauca

SEQ ID NO: 1615737 - RNA, 15 nt, Homo sapiens
uguagacugugccag

SEQ ID NO: 1615738 - RNA, 15 nt, Homo sapiens
uguagauucagguaa

SEQ ID NO: 1615739 - RNA, 14 nt, Homo sapiens
uguagauuugaaaa

SEQ ID NO: 1615740 - RNA, 14 nt, Homo sapiens
uguagcaauggcca

SEQ ID NO: 1615741 - RNA, 15 nt, Homo sapiens
uguagcugugucaug

SEQ ID NO: 1615742 - RNA, 22 nt, Homo sapiens
uguaggaaaagaggccagcucu

SEQ ID NO: 1615743 - RNA, 19 nt, Homo sapiens
uguaggaaccaauucuuga

SEQ ID NO: 1615744 - RNA, 13 nt, Homo sapiens
uguagucucagcu

SEQ ID NO: 1615745 - RNA, 21 nt, Homo sapiens
uguagugcauuuuuaaacuug

SEQ ID NO: 1615746 - RNA, 13 nt, Homo sapiens
uguaguuucuuga

SEQ ID NO: 1615747 - RNA, 23 nt, Homo sapiens
uguaguuuucccugcacuguguc

SEQ ID NO: 1615748 - RNA, 15 nt, Homo sapiens
uguauaauacuuugu

SEQ ID NO: 1615749 - RNA, 23 nt, Homo sapiens
uguauacucuugaauuccucuca

SEQ ID NO: 1615750 - RNA, 19 nt, Homo sapiens
uguauagauccacagggag

SEQ ID NO: 1615751 - RNA, 11 nt, Homo sapiens
uguauaguguu

SEQ ID NO: 1615752 - RNA, 15 nt, Homo sapiens
uguauaguguucaca

SEQ ID NO: 1615753 - RNA, 19 nt, Homo sapiens
uguauauaaacauaucaau

SEQ ID NO: 1615754 - RNA, 15 nt, Homo sapiens
uguauauauguguau

SEQ ID NO: 1615755 - RNA, 13 nt, Homo sapiens
uguauauuacacc

SEQ ID NO: 1615756 - RNA, 19 nt, Homo sapiens
uguauauucaggacuugaa

SEQ ID NO: 1615757 - RNA, 13 nt, Homo sapiens
uguauauugcuaa

SEQ ID NO: 1615758 - RNA, 21 nt, Homo sapiens
uguauauuuuauaucaauuua

SEQ ID NO: 1615759 - RNA, 18 nt, Homo sapiens
uguaucaaaugugacauu

SEQ ID NO: 1615760 - RNA, 20 nt, Homo sapiens
uguaucuuuuauccugggag

SEQ ID NO: 1615761 - RNA, 18 nt, Homo sapiens
uguaugaaaaauugggga

SEQ ID NO: 1615762 - RNA, 19 nt, Homo sapiens
uguaugaaagagcaaguga

SEQ ID NO: 1615763 - RNA, 13 nt, Homo sapiens
uguaugacaguga

SEQ ID NO: 1615764 - RNA, 17 nt, Homo sapiens
ugccuuuggacuugucc

SEQ ID NO: 1615765 - RNA, 13 nt, Homo sapiens
ugccuuugugauc

SEQ ID NO: 1615766 - RNA, 20 nt, Homo sapiens
ugcgaagacccucuugccca

SEQ ID NO: 1615767 - RNA, 14 nt, Homo sapiens
ugcgaggacaucaa

SEQ ID NO: 1615768 - RNA, 15 nt, Homo sapiens
ugcgcaauguggcau

SEQ ID NO: 1615769 - RNA, 22 nt, Homo sapiens
ugcgccaaucccgccaugcuca

SEQ ID NO: 1615770 - RNA, 12 nt, Homo sapiens
ugcgcucagggg

SEQ ID NO: 1615771 - RNA, 13 nt, Homo sapiens
ugcgcuuaaucca

SEQ ID NO: 1615772 - RNA, 15 nt, Homo sapiens
ugcggacagcccuuc

SEQ ID NO: 1615773 - RNA, 21 nt, Homo sapiens
ugcgucaagucuaaaccaaga

SEQ ID NO: 1615774 - RNA, 13 nt, Homo sapiens
ugcgugacuguau

SEQ ID NO: 1615775 - RNA, 14 nt, Homo sapiens
ugcuaaauugucug

SEQ ID NO: 1615776 - RNA, 17 nt, Homo sapiens
ugcuaacaaagacaaaa

SEQ ID NO: 1615777 - RNA, 18 nt, Homo sapiens
ugcuaacaaagacaaaag

SEQ ID NO: 1615778 - RNA, 20 nt, Homo sapiens
ugcuaacuuaaaaaacugca

SEQ ID NO: 1615779 - RNA, 20 nt, Homo sapiens
uggcucaugccuguaauccc

SEQ ID NO: 1615780 - RNA, 15 nt, Homo sapiens
uggcucccaugacca

SEQ ID NO: 1615781 - RNA, 14 nt, Homo sapiens
uggcuccuaucugu

SEQ ID NO: 1615782 - RNA, 13 nt, Homo sapiens
uggcucugggaau

SEQ ID NO: 1615783 - RNA, 20 nt, Homo sapiens
uggcucuguggcgagccauu

SEQ ID NO: 1615784 - RNA, 17 nt, Homo sapiens
uggcugagguuccucug

SEQ ID NO: 1615785 - RNA, 13 nt, Homo sapiens
uggcugccaaaga

SEQ ID NO: 1615786 - RNA, 15 nt, Homo sapiens
uggcugccaaagaga

SEQ ID NO: 1615787 - RNA, 12 nt, Homo sapiens
uggcugccuugu

SEQ ID NO: 1615788 - RNA, 23 nt, Homo sapiens
uggcuucaggcuaagaagagauu

SEQ ID NO: 1615789 - RNA, 17 nt, Homo sapiens
uggcuuuaugugcaaaa

SEQ ID NO: 1615790 - RNA, 17 nt, Homo sapiens
uggcuuucauaaaucau

SEQ ID NO: 1615791 - RNA, 14 nt, Homo sapiens
uggcuuucccagga

SEQ ID NO: 1615792 - RNA, 19 nt, Homo sapiens
ugggaaaauccacuaugac

SEQ ID NO: 1615793 - RNA, 14 nt, Homo sapiens
ugggaauucuugcu

SEQ ID NO: 1615794 - RNA, 23 nt, Homo sapiens
ugggacagacgagacaacagcac

SEQ ID NO: 1615795 - RNA, 15 nt, Homo sapiens
ugggaccaucacuga

SEQ ID NO: 1615796 - RNA, 16 nt, Homo sapiens
ugggaccugcaggcca

SEQ ID NO: 1615797 - RNA, 23 nt, Homo sapiens
ugggacuacaggcucaugccauc

SEQ ID NO: 1615798 - RNA, 22 nt, Homo sapiens
ugggacucaguuguucugagca

SEQ ID NO: 1615799 - RNA, 22 nt, Homo sapiens
ugggacuccuccuuuauuucag

SEQ ID NO: 1615800 - RNA, 20 nt, Homo sapiens
ugggacugugccuggcuccc

SEQ ID NO: 1615801 - RNA, 17 nt, Homo sapiens
ugggagaaugucaguau

SEQ ID NO: 1615802 - RNA, 19 nt, Homo sapiens
ugggagacccugaacucag

SEQ ID NO: 1615803 - RNA, 20 nt, Homo sapiens
ugggagcaguccaugcauga

SEQ ID NO: 1615804 - RNA, 14 nt, Homo sapiens
ugggagcugccaag

SEQ ID NO: 1615805 - RNA, 15 nt, Homo sapiens
ugggaggaacaaaga

SEQ ID NO: 1615806 - RNA, 20 nt, Homo sapiens
ugggaggaacuccuugcaca

SEQ ID NO: 1615807 - RNA, 21 nt, Homo sapiens
ugggaggaugaaggagugcgu

SEQ ID NO: 1615808 - RNA, 21 nt, Homo sapiens
ugggauagagaauguuccaga

SEQ ID NO: 1615809 - RNA, 17 nt, Homo sapiens
ugggaucugucacacca

SEQ ID NO: 1615810 - RNA, 19 nt, Homo sapiens
ugggcaaacccuggugcuu

SEQ ID NO: 1615811 - RNA, 18 nt, Homo sapiens
ugggcaacagagcaagac

SEQ ID NO: 1615812 - RNA, 12 nt, Homo sapiens
ugggcacugggg

SEQ ID NO: 1615813 - RNA, 14 nt, Homo sapiens
ugggcagagcccaa

SEQ ID NO: 1615814 - RNA, 16 nt, Homo sapiens
ugggcagaucacuuga

SEQ ID NO: 1615815 - RNA, 21 nt, Homo sapiens
ugggcagcccaacagcacuuu

SEQ ID NO: 1615816 - RNA, 20 nt, Homo sapiens
ugggcagcuacaagugcagc

SEQ ID NO: 1615817 - RNA, 17 nt, Homo sapiens
ugggcagugagugccau

SEQ ID NO: 1615818 - RNA, 18 nt, Homo sapiens
ugggccauguccaaagag

SEQ ID NO: 1615819 - RNA, 16 nt, Homo sapiens
ugggccccaccaccua

SEQ ID NO: 1615820 - RNA, 17 nt, Homo sapiens
ugggccucggaccccac

SEQ ID NO: 1615821 - RNA, 15 nt, Homo sapiens
ugggccugcacccuu

SEQ ID NO: 1615822 - RNA, 20 nt, Homo sapiens
ugggccuugcaagaugggag

SEQ ID NO: 1615823 - RNA, 16 nt, Homo sapiens
ugggcgcaguggcuca

SEQ ID NO: 1615824 - RNA, 19 nt, Homo sapiens
ugggcgugaguggacgugu

SEQ ID NO: 1615825 - RNA, 14 nt, Homo sapiens
ugggcgugcuaccu

SEQ ID NO: 1615826 - RNA, 18 nt, Homo sapiens
ugggcugaccgugucucu

SEQ ID NO: 1615827 - RNA, 15 nt, Homo sapiens
ugggcugggcaguau

SEQ ID NO: 1615828 - RNA, 15 nt, Homo sapiens
ugggcugucugucac

SEQ ID NO: 1615829 - RNA, 13 nt, Homo sapiens
ugggcuucaucca

SEQ ID NO: 1615830 - RNA, 15 nt, Homo sapiens
uggggaaaacuugca

SEQ ID NO: 1615831 - RNA, 16 nt, Homo sapiens
uggggaaaacuugcag

SEQ ID NO: 1615832 - RNA, 15 nt, Homo sapiens
uggggaauauacgug

SEQ ID NO: 1615833 - RNA, 20 nt, Homo sapiens
uggggacacagcaucagcuc

SEQ ID NO: 1615834 - RNA, 23 nt, Homo sapiens
uggggaccaaaucaaaugaauga

SEQ ID NO: 1615835 - RNA, 16 nt, Homo sapiens
uggggagcccacugag

SEQ ID NO: 1615836 - RNA, 19 nt, Homo sapiens
uggggagcuccugggaccc

SEQ ID NO: 1615837 - RNA, 16 nt, Homo sapiens
uggggauaucagggca

SEQ ID NO: 1615838 - RNA, 17 nt, Homo sapiens
uggggaucgaugugcuc

SEQ ID NO: 1615839 - RNA, 16 nt, Homo sapiens
uggggaugucucucau

SEQ ID NO: 1615840 - RNA, 18 nt, Homo sapiens
uggggaugucucucauga

SEQ ID NO: 1615841 - RNA, 19 nt, Homo sapiens
uggggcacuuucauccuca

SEQ ID NO: 1615842 - RNA, 12 nt, Homo sapiens
uggggcagacaa

SEQ ID NO: 1615843 - RNA, 14 nt, Homo sapiens
uggggcagacaaua

SEQ ID NO: 1615844 - RNA, 23 nt, Homo sapiens
uggggcagcacccuauaaaucaa

SEQ ID NO: 1615845 - RNA, 15 nt, Homo sapiens
uggggcaggggugcu

SEQ ID NO: 1615846 - RNA, 17 nt, Homo sapiens
uggggccccaucuugau

SEQ ID NO: 1615847 - RNA, 15 nt, Homo sapiens
uggggcugauuguau

SEQ ID NO: 1615848 - RNA, 16 nt, Homo sapiens
uggggcugguuuugcu

SEQ ID NO: 1615849 - RNA, 22 nt, Homo sapiens
uggggggcaauuuugcacugaa

SEQ ID NO: 1615850 - RNA, 17 nt, Homo sapiens
ugggguggccaccagua

SEQ ID NO: 1615851 - RNA, 19 nt, Homo sapiens
ugggguggcgggaauccua

SEQ ID NO: 1615852 - RNA, 15 nt, Homo sapiens
ugggguuccucugua

SEQ ID NO: 1615853 - RNA, 15 nt, Homo sapiens
ugggguucgaaauca

SEQ ID NO: 1615854 - RNA, 15 nt, Homo sapiens
ugggguucucuacag

SEQ ID NO: 1615855 - RNA, 19 nt, Homo sapiens
ugggguucucuacaggccu

SEQ ID NO: 1615856 - RNA, 23 nt, Homo sapiens
uggguacugaaagccuuagggaa

SEQ ID NO: 1615857 - RNA, 17 nt, Homo sapiens
ugggucuaggacacagu

SEQ ID NO: 1615858 - RNA, 14 nt, Homo sapiens
ugggucuauguucc

SEQ ID NO: 1615859 - RNA, 22 nt, Homo sapiens
ugggucugggagucacacagug

SEQ ID NO: 1615860 - RNA, 19 nt, Homo sapiens
ugggugucauuucauucca

SEQ ID NO: 1615861 - RNA, 12 nt, Homo sapiens
uggguuggaaag

SEQ ID NO: 1615862 - RNA, 15 nt, Homo sapiens
ugguaaauacuguga

SEQ ID NO: 1615863 - RNA, 16 nt, Homo sapiens
ugguaaauacugugaa

SEQ ID NO: 1615864 - RNA, 23 nt, Homo sapiens
ugguaacugauuaccugccaauu

SEQ ID NO: 1615865 - RNA, 22 nt, Homo sapiens
ugguaacugcuuucuguuccaa

SEQ ID NO: 1615866 - RNA, 22 nt, Homo sapiens
ugguaagacugcugguugacau

SEQ ID NO: 1615867 - RNA, 20 nt, Homo sapiens
ugguaauaaaugugacucag

SEQ ID NO: 1615868 - RNA, 21 nt, Homo sapiens
ugguaauaaaugugacucagc

SEQ ID NO: 1615869 - RNA, 15 nt, Homo sapiens
ugguacacaauguga

SEQ ID NO: 1615870 - RNA, 17 nt, Homo sapiens
ugguacaucuaccuaaa

SEQ ID NO: 1615871 - RNA, 20 nt, Homo sapiens
ugguaccucucauuugggca

SEQ ID NO: 1615872 - RNA, 18 nt, Homo sapiens
ugguacuguagcagggga

SEQ ID NO: 1615873 - RNA, 11 nt, Homo sapiens
ugguacuguga

SEQ ID NO: 1615874 - RNA, 14 nt, Homo sapiens
ugguagagcaauaa

SEQ ID NO: 1615875 - RNA, 20 nt, Homo sapiens
ugguagccaucaagcacuuc

SEQ ID NO: 1615876 - RNA, 19 nt, Homo sapiens
ugguauguaauggaacuua

SEQ ID NO: 1615877 - RNA, 21 nt, Homo sapiens
ugguaugugggugacccugga

SEQ ID NO: 1615878 - RNA, 21 nt, Homo sapiens
ugauagacugcuacagguaau

SEQ ID NO: 1615879 - RNA, 15 nt, Homo sapiens
ugauauaaucuuuca

SEQ ID NO: 1615880 - RNA, 13 nt, Homo sapiens
ugauauauuucag

SEQ ID NO: 1615881 - RNA, 15 nt, Homo sapiens
ugauauauuucagcu

SEQ ID NO: 1615882 - RNA, 14 nt, Homo sapiens
ugauaucaugggga

SEQ ID NO: 1615883 - RNA, 19 nt, Homo sapiens
ugauaucuauaguagacac

SEQ ID NO: 1615884 - RNA, 21 nt, Homo sapiens
ugaucacaucuaaagcuuuau

SEQ ID NO: 1615885 - RNA, 22 nt, Homo sapiens
ugaucacaucuaaagcuuuauc

SEQ ID NO: 1615886 - RNA, 16 nt, Homo sapiens
ugaucaggucuuuacu

SEQ ID NO: 1615887 - RNA, 15 nt, Homo sapiens
ugauccagauguuau

SEQ ID NO: 1615888 - RNA, 17 nt, Homo sapiens
ugauccggggguccagg

SEQ ID NO: 1615889 - RNA, 14 nt, Homo sapiens
ugaucggaaagcuc

SEQ ID NO: 1615890 - RNA, 13 nt, Homo sapiens
ugaucuauacaaa

SEQ ID NO: 1615891 - RNA, 12 nt, Homo sapiens
ucuaaaugccca

SEQ ID NO: 1615892 - RNA, 22 nt, Homo sapiens
ucuaacagcacagggaagcaaa

SEQ ID NO: 1615893 - RNA, 20 nt, Homo sapiens
ucuaagagaacaaugugcua

SEQ ID NO: 1615894 - RNA, 15 nt, Homo sapiens
ucuaagcacauucca

SEQ ID NO: 1615895 - RNA, 16 nt, Homo sapiens
ucuaagcacauuccaa

SEQ ID NO: 1615896 - RNA, 20 nt, Homo sapiens
ucuaaggcuaagcaucuuca

SEQ ID NO: 1615897 - RNA, 21 nt, Homo sapiens
ucuaagugggacauucaaaaa

SEQ ID NO: 1615898 - RNA, 17 nt, Homo sapiens
ucuaauaugauuauaca

SEQ ID NO: 1615899 - RNA, 20 nt, Homo sapiens
ucuaaucuauaugauaugca

SEQ ID NO: 1615900 - RNA, 15 nt, Homo sapiens
ucuaaugcauguauu

SEQ ID NO: 1615901 - RNA, 22 nt, Homo sapiens
ucuacaaaaaaugcagaacuua

SEQ ID NO: 1615902 - RNA, 14 nt, Homo sapiens
ucuacaaaauaucc

SEQ ID NO: 1615903 - RNA, 20 nt, Homo sapiens
ucuacacagauggaaucucu

SEQ ID NO: 1615904 - RNA, 23 nt, Homo sapiens
ucuacaccaaugaaaacauguac

SEQ ID NO: 1615905 - RNA, 21 nt, Homo sapiens
ucuacacgcuguauuguguau

SEQ ID NO: 1615906 - RNA, 16 nt, Homo sapiens
ucuacauccaauguau

SEQ ID NO: 1615907 - RNA, 14 nt, Homo sapiens
ucuacaugaugcua

SEQ ID NO: 1615908 - RNA, 15 nt, Homo sapiens
ucuaccagcauaaau

SEQ ID NO: 1615909 - RNA, 23 nt, Homo sapiens
ucuaccuccuuguguugcacuga

SEQ ID NO: 1615910 - RNA, 15 nt, Homo sapiens
ucuaccugagcauuc

SEQ ID NO: 1615911 - RNA, 16 nt, Homo sapiens
ucuaccugccacucac

SEQ ID NO: 1615912 - RNA, 15 nt, Homo sapiens
ucuacgccaauguua

SEQ ID NO: 1615913 - RNA, 15 nt, Homo sapiens
ucuacuaaaaacaca

SEQ ID NO: 1615914 - RNA, 15 nt, Homo sapiens
ucuacuaauuccaca

SEQ ID NO: 1615915 - RNA, 11 nt, Homo sapiens
ucuacuuuuaa

SEQ ID NO: 1615916 - RNA, 21 nt, Homo sapiens
uuuagaaggacucaguauuau

SEQ ID NO: 1615917 - RNA, 20 nt, Homo sapiens
uuuaggaaaugggcagugaa

SEQ ID NO: 1615918 - RNA, 14 nt, Homo sapiens
uuuaggaguacuga

SEQ ID NO: 1615919 - RNA, 14 nt, Homo sapiens
uuuaguaaauguua

SEQ ID NO: 1615920 - RNA, 13 nt, Homo sapiens
uuuaguacuuguu

SEQ ID NO: 1615921 - RNA, 21 nt, Homo sapiens
uuuaguagagaugggguuuca

SEQ ID NO: 1615922 - RNA, 12 nt, Homo sapiens
uuuaguggcuca

SEQ ID NO: 1615923 - RNA, 16 nt, Homo sapiens
uuuaguuacguauaau

SEQ ID NO: 1615924 - RNA, 13 nt, Homo sapiens
uuuaguuacuuua

SEQ ID NO: 1615925 - RNA, 23 nt, Homo sapiens
uuuauaauaaaaagcuucaggga

SEQ ID NO: 1615926 - RNA, 15 nt, Homo sapiens
uuuauacaguugaaa

SEQ ID NO: 1615927 - RNA, 15 nt, Homo sapiens
uuuauacuguuuacu

SEQ ID NO: 1615928 - RNA, 12 nt, Homo sapiens
uuuauacuuugc

SEQ ID NO: 1615929 - RNA, 18 nt, Homo sapiens
uuuauaggccugugugua

SEQ ID NO: 1615930 - RNA, 18 nt, Homo sapiens
uuuauauaagucuguuau

SEQ ID NO: 1615931 - RNA, 21 nt, Homo sapiens
uuuauaucacugucuagcugu

SEQ ID NO: 1615932 - RNA, 14 nt, Homo sapiens
uuuauaucaugcaa

SEQ ID NO: 1615933 - RNA, 17 nt, Homo sapiens
uuuauaucaugcaaaau

SEQ ID NO: 1615934 - RNA, 18 nt, Homo sapiens
uuuauauugucauuguca

SEQ ID NO: 1615935 - RNA, 12 nt, Homo sapiens
uuuaucacugaa

SEQ ID NO: 1615936 - RNA, 23 nt, Homo sapiens
uuuaucagagucaugaugaauca

SEQ ID NO: 1615937 - RNA, 20 nt, Homo sapiens
uuuaucauucaaguguaaaa

SEQ ID NO: 1615938 - RNA, 15 nt, Homo sapiens
uuuaucgaaguauau

SEQ ID NO: 1615939 - RNA, 16 nt, Homo sapiens
uuuaucuuuauaugaa

SEQ ID NO: 1615940 - RNA, 19 nt, Homo sapiens
uuuaucuuugauucuccuu

SEQ ID NO: 1615941 - RNA, 17 nt, Homo sapiens
uuuaugagaaacuuaaa

SEQ ID NO: 1615942 - RNA, 14 nt, Homo sapiens
uuuaugauuccacc

SEQ ID NO: 1615943 - RNA, 19 nt, Homo sapiens
uuuauggagaccucuccuu

SEQ ID NO: 1615944 - RNA, 16 nt, Homo sapiens
uuuaugguuaauacua

SEQ ID NO: 1615945 - RNA, 14 nt, Homo sapiens
uuuaugugagauac

SEQ ID NO: 1615946 - RNA, 19 nt, Homo sapiens
uuuauguguugaugacuca

SEQ ID NO: 1615947 - RNA, 15 nt, Homo sapiens
uuuauuaaucuuagu

SEQ ID NO: 1615948 - RNA, 14 nt, Homo sapiens
uuuauuacauauga

SEQ ID NO: 1615949 - RNA, 15 nt, Homo sapiens
uuuauuccuuugaau

SEQ ID NO: 1615950 - RNA, 14 nt, Homo sapiens
uuuauuuacuucgu

SEQ ID NO: 1615951 - RNA, 18 nt, Homo sapiens
uuuauuuccaauguuuca

SEQ ID NO: 1615952 - RNA, 14 nt, Homo sapiens
uuuauuuccacuaa

SEQ ID NO: 1615953 - RNA, 16 nt, Homo sapiens
uuuauuuccacuaaaa

SEQ ID NO: 1615954 - RNA, 18 nt, Homo sapiens
uuuauuuucauucugcca

SEQ ID NO: 1615955 - RNA, 16 nt, Homo sapiens
uuucaaaaccuuuuga

SEQ ID NO: 1615956 - RNA, 22 nt, Homo sapiens
uuucaaagcuaaaauauauaau

SEQ ID NO: 1615957 - RNA, 17 nt, Homo sapiens
uuguaccgcaaugugac

SEQ ID NO: 1615958 - RNA, 15 nt, Homo sapiens
uuguauaaugaacau

SEQ ID NO: 1615959 - RNA, 20 nt, Homo sapiens
uuguaucaaaugugacauua

SEQ ID NO: 1615960 - RNA, 14 nt, Homo sapiens
uuguauccaaagga

SEQ ID NO: 1615961 - RNA, 20 nt, Homo sapiens
uuguaucuuucuuucucuaa

SEQ ID NO: 1615962 - RNA, 23 nt, Homo sapiens
uuguaugcuuuuauaggccugug

SEQ ID NO: 1615963 - RNA, 18 nt, Homo sapiens
uuguauuccucaugucau

SEQ ID NO: 1615964 - RNA, 16 nt, Homo sapiens
uuguauuuaccuucua

SEQ ID NO: 1615965 - RNA, 13 nt, Homo sapiens
uugucaaacugua

SEQ ID NO: 1615966 - RNA, 21 nt, Homo sapiens
uugucaauagcaugcaaaaaa

SEQ ID NO: 1615967 - RNA, 15 nt, Homo sapiens
uugucaauaguauua

SEQ ID NO: 1615968 - RNA, 15 nt, Homo sapiens
uugucagaacuagaa

SEQ ID NO: 1615969 - RNA, 15 nt, Homo sapiens
uugucagacuuccaa

SEQ ID NO: 1615970 - RNA, 18 nt, Homo sapiens
uugucccuaugcauauca

SEQ ID NO: 1615971 - RNA, 20 nt, Homo sapiens
uuguccugcccuguggaaug

SEQ ID NO: 1615972 - RNA, 23 nt, Homo sapiens
uugucuaugaauaugaucccuaa

SEQ ID NO: 1615973 - RNA, 20 nt, Homo sapiens
uugucuguaaaaaauggagc

SEQ ID NO: 1615974 - RNA, 22 nt, Homo sapiens
uugucuguuaaaugaacuugau

SEQ ID NO: 1615975 - RNA, 17 nt, Homo sapiens
uugucuuacuguugcau

SEQ ID NO: 1615976 - RNA, 23 nt, Homo sapiens
uugugaaguggaaauguucuaaa

SEQ ID NO: 1615977 - RNA, 18 nt, Homo sapiens
uugugaauuaggcuguaa

SEQ ID NO: 1615978 - RNA, 20 nt, Homo sapiens
uugugacaggaaagcccucc

SEQ ID NO: 1615979 - RNA, 22 nt, Homo sapiens
uugugacagucacugcauuugc

SEQ ID NO: 1615980 - RNA, 17 nt, Homo sapiens
uugugacuucacuguau

SEQ ID NO: 1615981 - RNA, 22 nt, Homo sapiens
uugugagucuucacuaaaauca

SEQ ID NO: 1615982 - RNA, 16 nt, Homo sapiens
uugugauccaccccgc

SEQ ID NO: 1615983 - RNA, 19 nt, Homo sapiens
uugugaucucacacacaga

SEQ ID NO: 1615984 - RNA, 15 nt, Homo sapiens
uugugaugaacauau

SEQ ID NO: 1615985 - RNA, 16 nt, Homo sapiens
uugugauguguccuga

SEQ ID NO: 1615986 - RNA, 16 nt, Homo sapiens
uugugauuucuuuaaa

SEQ ID NO: 1615987 - RNA, 10 nt, Homo sapiens
uugugcaaac

SEQ ID NO: 1615988 - RNA, 14 nt, Homo sapiens
uugugcacauguac

SEQ ID NO: 1615989 - RNA, 21 nt, Homo sapiens
uugugcugcaccuggucauac

SEQ ID NO: 1615990 - RNA, 20 nt, Homo sapiens
uugugcugugggcagcaccc

SEQ ID NO: 1615991 - RNA, 23 nt, Homo sapiens
uugugcuuaguccaauuccuugc

SEQ ID NO: 1615992 - RNA, 19 nt, Homo sapiens
uugugggcaacacaugcag

SEQ ID NO: 1615993 - RNA, 12 nt, Homo sapiens
ugucaguucucu

SEQ ID NO: 1615994 - RNA, 12 nt, Homo sapiens
ugucauaugcag

SEQ ID NO: 1615995 - RNA, 13 nt, Homo sapiens
ugucaucacucaa

SEQ ID NO: 1615996 - RNA, 17 nt, Homo sapiens
ugucauccauauuugcu

SEQ ID NO: 1615997 - RNA, 21 nt, Homo sapiens
ugucauccucaaagaaagugu

SEQ ID NO: 1615998 - RNA, 15 nt, Homo sapiens
ugucauccucacagu

SEQ ID NO: 1615999 - RNA, 13 nt, Homo sapiens
ugucaugcccuua

SEQ ID NO: 1616000 - RNA, 14 nt, Homo sapiens
ugucauuauauucu

SEQ ID NO: 1616001 - RNA, 19 nt, Homo sapiens
ugucauuccuaaaacaccc

SEQ ID NO: 1616002 - RNA, 19 nt, Homo sapiens
ugucauuucauuccauugc

SEQ ID NO: 1616003 - RNA, 12 nt, Homo sapiens
uguccaaagagg

SEQ ID NO: 1616004 - RNA, 17 nt, Homo sapiens
uguccacgauucacuca

SEQ ID NO: 1616005 - RNA, 15 nt, Homo sapiens
uguccaggagcuaau

SEQ ID NO: 1616006 - RNA, 15 nt, Homo sapiens
uguccaugccuucca

SEQ ID NO: 1616007 - RNA, 17 nt, Homo sapiens
ugucccaaccccagugg

SEQ ID NO: 1616008 - RNA, 20 nt, Homo sapiens
ugucccaccccuaccucuag

SEQ ID NO: 1616009 - RNA, 16 nt, Homo sapiens
ugucccagaaugccuc

SEQ ID NO: 1616010 - RNA, 21 nt, Homo sapiens
ugucccagaaugccuccugca

SEQ ID NO: 1616011 - RNA, 15 nt, Homo sapiens
ugucccauucuagau

SEQ ID NO: 1616012 - RNA, 15 nt, Homo sapiens
ugucccuaagagaug

SEQ ID NO: 1616013 - RNA, 16 nt, Homo sapiens
ugucccugaaaccuag

SEQ ID NO: 1616014 - RNA, 22 nt, Homo sapiens
uguccuaaucauauaccagagg

SEQ ID NO: 1616015 - RNA, 19 nt, Homo sapiens
uguccuagaaguucuuuga

SEQ ID NO: 1616016 - RNA, 13 nt, Homo sapiens
uguccucucugug

SEQ ID NO: 1616017 - RNA, 18 nt, Homo sapiens
uguccuggaggcacuggg

SEQ ID NO: 1616018 - RNA, 17 nt, Homo sapiens
ugucgauuuaugccuca

SEQ ID NO: 1616019 - RNA, 18 nt, Homo sapiens
ugucgguuaccucugcau

SEQ ID NO: 1616020 - RNA, 22 nt, Homo sapiens
ugucguuuucacauaugacaau

SEQ ID NO: 1616021 - RNA, 11 nt, Homo sapiens
ugucuaccugg

SEQ ID NO: 1616022 - RNA, 18 nt, Homo sapiens
ugucuacgggggcacuug

SEQ ID NO: 1616023 - RNA, 17 nt, Homo sapiens
ugucuagcuguuucaaa

SEQ ID NO: 1616024 - RNA, 22 nt, Homo sapiens
ugucuaugacgcaaagaucacc

SEQ ID NO: 1616025 - RNA, 17 nt, Homo sapiens
ugucuauguagcugaaa

SEQ ID NO: 1616026 - RNA, 23 nt, Homo sapiens
ugucucaauucaaauccauagau

SEQ ID NO: 1616027 - RNA, 21 nt, Homo sapiens
ugucuccagggcccccaccga

SEQ ID NO: 1616028 - RNA, 23 nt, Homo sapiens
ugucucgugguaggacuguagaa

SEQ ID NO: 1616029 - RNA, 12 nt, Homo sapiens
ugucucucauga

SEQ ID NO: 1616030 - RNA, 18 nt, Homo sapiens
ugucucuugagcaucaau

SEQ ID NO: 1616031 - RNA, 12 nt, Homo sapiens
ugucucuuuauu

SEQ ID NO: 1616032 - RNA, 16 nt, Homo sapiens
ugucugaacauagaaa

SEQ ID NO: 1616033 - RNA, 16 nt, Homo sapiens
ugucugcaccuuagaa

SEQ ID NO: 1616034 - RNA, 17 nt, Homo sapiens
ugucugccuaugcacug

SEQ ID NO: 1616035 - RNA, 18 nt, Homo sapiens
ugucugccuaugcacuga

SEQ ID NO: 1616036 - RNA, 19 nt, Homo sapiens
ugucugcuugcaucugcac

SEQ ID NO: 1616037 - RNA, 21 nt, Homo sapiens
ugucugugcccuccaaagagc

SEQ ID NO: 1616038 - RNA, 19 nt, Homo sapiens
ugucuguggcaaaaguuua

SEQ ID NO: 1616039 - RNA, 18 nt, Homo sapiens
ugucuguuaaaugaacuu

SEQ ID NO: 1616040 - RNA, 21 nt, Homo sapiens
ugucuuaauuaaaagaauauu

SEQ ID NO: 1616041 - RNA, 22 nt, Homo sapiens
ugucuuacuauuauagcaacuu

SEQ ID NO: 1616042 - RNA, 13 nt, Homo sapiens
ugucuucagagaa

SEQ ID NO: 1616043 - RNA, 14 nt, Homo sapiens
ugucuucuacagau

SEQ ID NO: 1616044 - RNA, 22 nt, Homo sapiens
ugucuugucauacaaauuuaua

SEQ ID NO: 1616045 - RNA, 17 nt, Homo sapiens
ugucuuucuuuggugcc

SEQ ID NO: 1616046 - RNA, 15 nt, Homo sapiens
ugucuuuuguucucu

SEQ ID NO: 1616047 - RNA, 15 nt, Homo sapiens
ugugaaacuuucauu

SEQ ID NO: 1616048 - RNA, 17 nt, Homo sapiens
ugugaaaugaauguaau

SEQ ID NO: 1616049 - RNA, 21 nt, Homo sapiens
ugugaaauguacgucauuugu

SEQ ID NO: 1616050 - RNA, 23 nt, Homo sapiens
ugugaaggaauuauucccaugag

SEQ ID NO: 1616051 - RNA, 20 nt, Homo sapiens
ugugaaguaaaagagggacc

SEQ ID NO: 1616052 - RNA, 18 nt, Homo sapiens
ugugaaguuugcuuugua

SEQ ID NO: 1616053 - RNA, 23 nt, Homo sapiens
ugugaauagccuggccaccagcc

SEQ ID NO: 1616054 - RNA, 21 nt, Homo sapiens
ugugaaucugaaagacuugaa

SEQ ID NO: 1616055 - RNA, 12 nt, Homo sapiens
ugugacauacau

SEQ ID NO: 1616056 - RNA, 22 nt, Homo sapiens
ugugacauuauaugcacuagca

SEQ ID NO: 1616057 - RNA, 23 nt, Homo sapiens
ugugaccacugaagcaccacagg

SEQ ID NO: 1616058 - RNA, 16 nt, Homo sapiens
ugugaccgaacacugc

SEQ ID NO: 1616059 - RNA, 18 nt, Homo sapiens
ugugacuauguuccaaua

SEQ ID NO: 1616060 - RNA, 15 nt, Homo sapiens
ugugacucagcauca

SEQ ID NO: 1616061 - RNA, 17 nt, Homo sapiens
ugugacugccaucaucu

SEQ ID NO: 1616062 - RNA, 17 nt, Homo sapiens
ugugacuuacaauuugc

SEQ ID NO: 1616063 - RNA, 14 nt, Homo sapiens
ugugacuucacugu

SEQ ID NO: 1616064 - RNA, 20 nt, Homo sapiens
ugugagaauugugcuuucac

SEQ ID NO: 1616065 - RNA, 23 nt, Homo sapiens
ugugagacucgagaacuuucauu

SEQ ID NO: 1616066 - RNA, 18 nt, Homo sapiens
ugugagaguggcuuucua

SEQ ID NO: 1616067 - RNA, 19 nt, Homo sapiens
ugugagaguggcuuucuac

SEQ ID NO: 1616068 - RNA, 12 nt, Homo sapiens
ugugagcggaag

SEQ ID NO: 1616069 - RNA, 12 nt, Homo sapiens
ugugaggcuucu

SEQ ID NO: 1616070 - RNA, 16 nt, Homo sapiens
ugugauggcaaagaag

SEQ ID NO: 1616071 - RNA, 15 nt, Homo sapiens
ugugauguauauugu

SEQ ID NO: 1616072 - RNA, 16 nt, Homo sapiens
ugugauuagaucacau

SEQ ID NO: 1616073 - RNA, 14 nt, Homo sapiens
ugugauucugccuu

SEQ ID NO: 1616074 - RNA, 14 nt, Homo sapiens
ugugauugugauuc

SEQ ID NO: 1616075 - RNA, 20 nt, Homo sapiens
ugugcaauuuguaaauauug

SEQ ID NO: 1616076 - RNA, 22 nt, Homo sapiens
ugugcaauuuguaaauauugcu

SEQ ID NO: 1616077 - RNA, 21 nt, Homo sapiens
ugugccaagagcuacucccac

SEQ ID NO: 1616078 - RNA, 16 nt, Homo sapiens
ugugccccaugccugu

SEQ ID NO: 1616079 - RNA, 20 nt, Homo sapiens
ugugcccuccaaagagccuu

SEQ ID NO: 1616080 - RNA, 23 nt, Homo sapiens
ugugccuauagucccacuacuug

SEQ ID NO: 1616081 - RNA, 18 nt, Homo sapiens
ugugccuuggugugcugu

SEQ ID NO: 1616082 - RNA, 15 nt, Homo sapiens
ugugcggacagcccu

SEQ ID NO: 1616083 - RNA, 14 nt, Homo sapiens
ugugcuacaauuca

SEQ ID NO: 1616084 - RNA, 16 nt, Homo sapiens
ugugcuggacacuguc

SEQ ID NO: 1616085 - RNA, 22 nt, Homo sapiens
ugugcuggacacuguccaugaa

SEQ ID NO: 1616086 - RNA, 19 nt, Homo sapiens
ugugcuucaucugugggau

SEQ ID NO: 1616087 - RNA, 14 nt, Homo sapiens
uguggaaaauggag

SEQ ID NO: 1616088 - RNA, 14 nt, Homo sapiens
uuugaaugcuuaau

SEQ ID NO: 1616089 - RNA, 16 nt, Homo sapiens
uuugacacgcaguugc

SEQ ID NO: 1616090 - RNA, 12 nt, Homo sapiens
uuugacacugaa

SEQ ID NO: 1616091 - RNA, 17 nt, Homo sapiens
uuugacuucagauugaa

SEQ ID NO: 1616092 - RNA, 17 nt, Homo sapiens
uuugagagaaauaugaa

SEQ ID NO: 1616093 - RNA, 20 nt, Homo sapiens
uuugagauuaagaaugccag

SEQ ID NO: 1616094 - RNA, 20 nt, Homo sapiens
uuugagcugcugacugccaa

SEQ ID NO: 1616095 - RNA, 18 nt, Homo sapiens
uuugaucuacuugccuca

SEQ ID NO: 1616096 - RNA, 17 nt, Homo sapiens
uuugauuaaagacucca

SEQ ID NO: 1616097 - RNA, 20 nt, Homo sapiens
uuugauucagcaaaaaucuc

SEQ ID NO: 1616098 - RNA, 23 nt, Homo sapiens
uuugcaaacacugugauuacucu

SEQ ID NO: 1616099 - RNA, 22 nt, Homo sapiens
uuugcaaaguacuguaagaaua

SEQ ID NO: 1616100 - RNA, 23 nt, Homo sapiens
uuugcaacaauaaaguacuuuac

SEQ ID NO: 1616101 - RNA, 20 nt, Homo sapiens
uuugcaagggaaaagucucu

SEQ ID NO: 1616102 - RNA, 14 nt, Homo sapiens
uuugcacaggagaa

SEQ ID NO: 1616103 - RNA, 16 nt, Homo sapiens
uuugcagaaaucacaa

SEQ ID NO: 1616104 - RNA, 17 nt, Homo sapiens
uuugcagaaaucacaau

SEQ ID NO: 1616105 - RNA, 22 nt, Homo sapiens
uuugcauccagcagcagcacuu

SEQ ID NO: 1616106 - RNA, 18 nt, Homo sapiens
uuugcaucugaaagagaa

SEQ ID NO: 1616107 - RNA, 15 nt, Homo sapiens
uuugcauugccaagu

SEQ ID NO: 1616108 - RNA, 19 nt, Homo sapiens
uuugccaaaauaccagagc

SEQ ID NO: 1616109 - RNA, 17 nt, Homo sapiens
uuugccaaggcucuccc

SEQ ID NO: 1616110 - RNA, 14 nt, Homo sapiens
uuugccacaucccu

SEQ ID NO: 1616111 - RNA, 16 nt, Homo sapiens
uuugcggaaugcauug

SEQ ID NO: 1616112 - RNA, 17 nt, Homo sapiens
uuugcugcagucaucua

SEQ ID NO: 1616113 - RNA, 15 nt, Homo sapiens
uuugcugcuuuccag

SEQ ID NO: 1616114 - RNA, 17 nt, Homo sapiens
uuugcuucuugccauca

SEQ ID NO: 1616115 - RNA, 14 nt, Homo sapiens
uuugcuuucaggga

SEQ ID NO: 1616116 - RNA, 16 nt, Homo sapiens
uuuggaagucaugagc

SEQ ID NO: 1616117 - RNA, 21 nt, Homo sapiens
uuuggaccaccguucagucau

SEQ ID NO: 1616118 - RNA, 19 nt, Homo sapiens
uuuggaugagcauggagcu

SEQ ID NO: 1616119 - RNA, 15 nt, Homo sapiens
uuuggaugucuguag

SEQ ID NO: 1616120 - RNA, 15 nt, Homo sapiens
uuuggccuccuccag

SEQ ID NO: 1616121 - RNA, 19 nt, Homo sapiens
uuuggcuagguaucauuca

SEQ ID NO: 1616122 - RNA, 16 nt, Homo sapiens
uuuggcuuaaaccaga

SEQ ID NO: 1616123 - RNA, 19 nt, Homo sapiens
uuuggcuuaaaccagaacc

SEQ ID NO: 1616124 - RNA, 23 nt, Homo sapiens
uuugggcccagggacaccagcca

SEQ ID NO: 1616125 - RNA, 18 nt, Homo sapiens
uuugggcuccacauugca

SEQ ID NO: 1616126 - RNA, 19 nt, Homo sapiens
aaaaauauuguuucugcau

SEQ ID NO: 1616127 - RNA, 13 nt, Homo sapiens
aaaaaucccucca

SEQ ID NO: 1616128 - RNA, 22 nt, Homo sapiens
aaaaaucuaagauucauguguu

SEQ ID NO: 1616129 - RNA, 22 nt, Homo sapiens
aaaacacugaaaaauauuccaa

SEQ ID NO: 1616130 - RNA, 12 nt, Homo sapiens
aaaacacuuuca

SEQ ID NO: 1616131 - RNA, 16 nt, Homo sapiens
aaaacaugugguuaca

SEQ ID NO: 1616132 - RNA, 15 nt, Homo sapiens
aaaacauucagucug

SEQ ID NO: 1616133 - RNA, 14 nt, Homo sapiens
aaaaccuacauauu

SEQ ID NO: 1616134 - RNA, 22 nt, Homo sapiens
aaaaccuuguggauaaguggcu

SEQ ID NO: 1616135 - RNA, 21 nt, Homo sapiens
aaaacuguuuguuaucucuug

SEQ ID NO: 1616136 - RNA, 11 nt, Homo sapiens
aaaacuuuauu

SEQ ID NO: 1616137 - RNA, 15 nt, Homo sapiens
aaaagaaugacuaua

SEQ ID NO: 1616138 - RNA, 14 nt, Homo sapiens
aaaagacugaccaa

SEQ ID NO: 1616139 - RNA, 18 nt, Homo sapiens
aaaagccuuccaguuuug

SEQ ID NO: 1616140 - RNA, 13 nt, Homo sapiens
aaaaguacauauu

SEQ ID NO: 1616141 - RNA, 15 nt, Homo sapiens
aaaaguagcuuauag

SEQ ID NO: 1616142 - RNA, 17 nt, Homo sapiens
aaaauaaaaaacauaua

SEQ ID NO: 1616143 - RNA, 23 nt, Homo sapiens
aaaauaaaauguuucauuaugca

SEQ ID NO: 1616144 - RNA, 16 nt, Homo sapiens
aaaauauagacauucu

SEQ ID NO: 1616145 - RNA, 18 nt, Homo sapiens
aaaauauugaauaaugcg

SEQ ID NO: 1616146 - RNA, 15 nt, Homo sapiens
aaaauauuguuucug

SEQ ID NO: 1616147 - RNA, 14 nt, Homo sapiens
aaaaucaacaugac

SEQ ID NO: 1616148 - RNA, 20 nt, Homo sapiens
aaaaucuagcacacucuucu

SEQ ID NO: 1616149 - RNA, 21 nt, Homo sapiens
aaaaucucuacugcuuuggau

SEQ ID NO: 1616150 - RNA, 20 nt, Homo sapiens
aaaaucuguuauagcuuuaa

SEQ ID NO: 1616151 - RNA, 15 nt, Homo sapiens
aaaaucuuguguuaa

SEQ ID NO: 1616152 - RNA, 14 nt, Homo sapiens
aaaauggagccaug

SEQ ID NO: 1616153 - RNA, 21 nt, Homo sapiens
aaaauuauuugaaaacauaua

SEQ ID NO: 1616154 - RNA, 13 nt, Homo sapiens
aaaauugcucccu

SEQ ID NO: 1616155 - RNA, 17 nt, Homo sapiens
aaacaaaauuugacuaa

SEQ ID NO: 1616156 - RNA, 22 nt, Homo sapiens
aaacaaucuguuuuggcuuuau

SEQ ID NO: 1616157 - RNA, 17 nt, Homo sapiens
aaacagcagcacuuuuu

SEQ ID NO: 1616158 - RNA, 20 nt, Homo sapiens
aaacagccaagauuuuccuc

SEQ ID NO: 1616159 - RNA, 22 nt, Homo sapiens
aaacagccucuuuuugauacug

SEQ ID NO: 1616160 - RNA, 17 nt, Homo sapiens
aaacagcugcccugugu

SEQ ID NO: 1616161 - RNA, 14 nt, Homo sapiens
aaacauugugauca

SEQ ID NO: 1616162 - RNA, 15 nt, Homo sapiens
aaaccaaugucauaa

SEQ ID NO: 1616163 - RNA, 17 nt, Homo sapiens
aaaccagaacccagugu

SEQ ID NO: 1616164 - RNA, 15 nt, Homo sapiens
aaaccaucacaugac

SEQ ID NO: 1616165 - RNA, 20 nt, Homo sapiens
aaacccagucuccucuccau

SEQ ID NO: 1616166 - RNA, 17 nt, Homo sapiens
aaacccccacuccagcu

SEQ ID NO: 1616167 - RNA, 17 nt, Homo sapiens
aaaccuuuaaucugcac

SEQ ID NO: 1616168 - RNA, 19 nt, Homo sapiens
aaacucaacaagugcuccu

SEQ ID NO: 1616169 - RNA, 12 nt, Homo sapiens
aaacuccauuga

SEQ ID NO: 1616170 - RNA, 14 nt, Homo sapiens
aaacugaaccacaa

SEQ ID NO: 1616171 - RNA, 19 nt, Homo sapiens
aaacugaggcccuugggca

SEQ ID NO: 1616172 - RNA, 22 nt, Homo sapiens
aaacugcugucccaaacaugca

SEQ ID NO: 1616173 - RNA, 22 nt, Homo sapiens
aaacuucaugguuugcauuuaa

SEQ ID NO: 1616174 - RNA, 19 nt, Homo sapiens
aaacuucugaagacugaga

SEQ ID NO: 1616175 - RNA, 17 nt, Homo sapiens
aaacuugacauguagcu

SEQ ID NO: 1616176 - RNA, 23 nt, Homo sapiens
aaagaaaaauaucuuggccuaaa

SEQ ID NO: 1616177 - RNA, 19 nt, Homo sapiens
aaagaaaaucucugugaaa

SEQ ID NO: 1616178 - RNA, 21 nt, Homo sapiens
aaagaauuuuccugagacaaa

SEQ ID NO: 1616179 - RNA, 17 nt, Homo sapiens
aaagacacaaaaaaaga

SEQ ID NO: 1616180 - RNA, 20 nt, Homo sapiens
aaagacacaggcauggcuaa

SEQ ID NO: 1616181 - RNA, 21 nt, Homo sapiens
aaagacauuuuuuaaaagccu

SEQ ID NO: 1616182 - RNA, 16 nt, Homo sapiens
aaagagagaagccagc

SEQ ID NO: 1616183 - RNA, 19 nt, Homo sapiens
aaagagagaccccagucaa

SEQ ID NO: 1616184 - RNA, 22 nt, Homo sapiens
aaagaggacaggcuaccccuuu

SEQ ID NO: 1616185 - RNA, 19 nt, Homo sapiens
aaagaggcccaagugcaaa

SEQ ID NO: 1616186 - RNA, 23 nt, Homo sapiens
aaagauguacaaaacaguuugaa

SEQ ID NO: 1616187 - RNA, 23 nt, Homo sapiens
aaagauuacccccaguccucccu

SEQ ID NO: 1616188 - RNA, 18 nt, Homo sapiens
aaagauuuuuggcacuuu

SEQ ID NO: 1616189 - RNA, 12 nt, Homo sapiens
aaagcacuaccu

SEQ ID NO: 1616190 - RNA, 15 nt, Homo sapiens
aaagcacuaccuaag

SEQ ID NO: 1616191 - RNA, 21 nt, Homo sapiens
aaagcccuuguccccaugaaa

SEQ ID NO: 1616192 - RNA, 21 nt, Homo sapiens
aaagcuacuauguacugccuu

SEQ ID NO: 1616193 - RNA, 17 nt, Homo sapiens
aaagcugcuugcuguaa

SEQ ID NO: 1616194 - RNA, 20 nt, Homo sapiens
aaagcuuuauacaguugaau

SEQ ID NO: 1616195 - RNA, 20 nt, Homo sapiens
aaaggaacaaaacaacacaa

SEQ ID NO: 1616196 - RNA, 15 nt, Homo sapiens
aaaggaacaguugca

SEQ ID NO: 1616197 - RNA, 12 nt, Homo sapiens
aaaggagccugu

SEQ ID NO: 1616198 - RNA, 22 nt, Homo sapiens
aaagguaaaucccacaucccag

SEQ ID NO: 1616199 - RNA, 13 nt, Homo sapiens
aaaguaaugacuu

SEQ ID NO: 1616200 - RNA, 15 nt, Homo sapiens
aaaguaaugaucuca

SEQ ID NO: 1616201 - RNA, 23 nt, Homo sapiens
aaaguagcagugugaaguacaau

SEQ ID NO: 1616202 - RNA, 13 nt, Homo sapiens
aaaguagccacgu

SEQ ID NO: 1616203 - RNA, 13 nt, Homo sapiens
aacuguguugcca

SEQ ID NO: 1616204 - RNA, 15 nt, Homo sapiens
aacuuauucucugua

SEQ ID NO: 1616205 - RNA, 22 nt, Homo sapiens
aacuucugccucccaugcuuac

SEQ ID NO: 1616206 - RNA, 14 nt, Homo sapiens
aacuugacauguag

SEQ ID NO: 1616207 - RNA, 20 nt, Homo sapiens
aacuuuauaaggaaauguau

SEQ ID NO: 1616208 - RNA, 18 nt, Homo sapiens
aacuuuuuugaggccuuu

SEQ ID NO: 1616209 - RNA, 15 nt, Homo sapiens
aagaaaauaucacug

SEQ ID NO: 1616210 - RNA, 12 nt, Homo sapiens
aagaaaaugccu

SEQ ID NO: 1616211 - RNA, 16 nt, Homo sapiens
aagaaagaaacuucau

SEQ ID NO: 1616212 - RNA, 14 nt, Homo sapiens
aagaaagccuaaaa

SEQ ID NO: 1616213 - RNA, 21 nt, Homo sapiens
aagaaaugggugaaugagcuu

SEQ ID NO: 1616214 - RNA, 23 nt, Homo sapiens
aagaacuggaaccccagcuuccc

SEQ ID NO: 1616215 - RNA, 14 nt, Homo sapiens
aagaagccuuuccu

SEQ ID NO: 1616216 - RNA, 11 nt, Homo sapiens
aagaagcuuua

SEQ ID NO: 1616217 - RNA, 12 nt, Homo sapiens
aagaagcuuuau

SEQ ID NO: 1616218 - RNA, 19 nt, Homo sapiens
aagaauaaacuccauuuaa

SEQ ID NO: 1616219 - RNA, 17 nt, Homo sapiens
aagaauaugacuuuuua

SEQ ID NO: 1616220 - RNA, 17 nt, Homo sapiens
aagacacaggcauggcu

SEQ ID NO: 1616221 - RNA, 21 nt, Homo sapiens
aagacacauugacuccuuucc

SEQ ID NO: 1616222 - RNA, 12 nt, Homo sapiens
aagacacuguua

SEQ ID NO: 1616223 - RNA, 13 nt, Homo sapiens
aagaccccacugc

SEQ ID NO: 1616224 - RNA, 11 nt, Homo sapiens
aagacugacca

SEQ ID NO: 1616225 - RNA, 18 nt, Homo sapiens
aagacugguuuucugcca

SEQ ID NO: 1616226 - RNA, 15 nt, Homo sapiens
aagagauaaacuaca

SEQ ID NO: 1616227 - RNA, 16 nt, Homo sapiens
aagagauaaacuacau

SEQ ID NO: 1616228 - RNA, 21 nt, Homo sapiens
aagagcaucaugccucugagg

SEQ ID NO: 1616229 - RNA, 14 nt, Homo sapiens
aagaggugacccca

SEQ ID NO: 1616230 - RNA, 12 nt, Homo sapiens
aagauacuaaua

SEQ ID NO: 1616231 - RNA, 21 nt, Homo sapiens
aagauacuaauagaguacuua

SEQ ID NO: 1616232 - RNA, 23 nt, Homo sapiens
aagauacuaauagaguacuuaau

SEQ ID NO: 1616233 - RNA, 22 nt, Homo sapiens
aagaucaaggaguacaaugccc

SEQ ID NO: 1616234 - RNA, 18 nt, Homo sapiens
aagaucaccacuucccca

SEQ ID NO: 1616235 - RNA, 19 nt, Homo sapiens
aagaucacgccacuggacu

SEQ ID NO: 1616236 - RNA, 18 nt, Homo sapiens
aagaucucgguuugccaa

SEQ ID NO: 1616237 - RNA, 17 nt, Homo sapiens
aagauuuuuggcacuuu

SEQ ID NO: 1616238 - RNA, 19 nt, Homo sapiens
aagcacagauguucuucaa

SEQ ID NO: 1616239 - RNA, 19 nt, Homo sapiens
aagcacccagcccuccugc

SEQ ID NO: 1616240 - RNA, 20 nt, Homo sapiens
aagcaccuuccccuccauuc

SEQ ID NO: 1616241 - RNA, 19 nt, Homo sapiens
aagcacuugcuuacauccu

SEQ ID NO: 1616242 - RNA, 16 nt, Homo sapiens
aagcagucaguuugca

SEQ ID NO: 1616243 - RNA, 14 nt, Homo sapiens
aagcauaaagcaau

SEQ ID NO: 1616244 - RNA, 12 nt, Homo sapiens
aagcauacuuug

SEQ ID NO: 1616245 - RNA, 17 nt, Homo sapiens
aagcauuauccuuuuau

SEQ ID NO: 1616246 - RNA, 20 nt, Homo sapiens
aagcauuuuauaaaugauau

SEQ ID NO: 1616247 - RNA, 19 nt, Homo sapiens
aagccaauucagacaggca

SEQ ID NO: 1616248 - RNA, 13 nt, Homo sapiens
aagccagcacuca

SEQ ID NO: 1616249 - RNA, 17 nt, Homo sapiens
aagccaugugcuaagaa

SEQ ID NO: 1616250 - RNA, 14 nt, Homo sapiens
aagcccaguucauc

SEQ ID NO: 1616251 - RNA, 17 nt, Homo sapiens
aagcccugcccacagaa

SEQ ID NO: 1616252 - RNA, 20 nt, Homo sapiens
aagcccuuguccccaugaaa

SEQ ID NO: 1616253 - RNA, 20 nt, Homo sapiens
aagccuaagggauccugccu

SEQ ID NO: 1616254 - RNA, 14 nt, Homo sapiens
aagcuaaauuccac

SEQ ID NO: 1616255 - RNA, 21 nt, Homo sapiens
aagcuacuauguacugccuua

SEQ ID NO: 1616256 - RNA, 22 nt, Homo sapiens
aagcuacuauguacugccuuag

SEQ ID NO: 1616257 - RNA, 22 nt, Homo sapiens
aagcuauggugagaugcagcug

SEQ ID NO: 1616258 - RNA, 18 nt, Homo sapiens
aagcuccaagaggcuccu

SEQ ID NO: 1616259 - RNA, 11 nt, Homo sapiens
aagcuccuagg

SEQ ID NO: 1616260 - RNA, 18 nt, Homo sapiens
aagcugccucaaggaauu

SEQ ID NO: 1616261 - RNA, 22 nt, Homo sapiens
aagcugcuccaggccugcagca

SEQ ID NO: 1616262 - RNA, 23 nt, Homo sapiens
aagcugguugucuuuacaugaaa

SEQ ID NO: 1616263 - RNA, 13 nt, Homo sapiens
aaggaaaacagac

SEQ ID NO: 1616264 - RNA, 16 nt, Homo sapiens
aaggaauagaagcaaa

SEQ ID NO: 1616265 - RNA, 15 nt, Homo sapiens
aaggacaggacccuc

SEQ ID NO: 1616266 - RNA, 15 nt, Homo sapiens
aaggaccuuggaaga

SEQ ID NO: 1616267 - RNA, 21 nt, Homo sapiens
aaggacugagggcagugcccu

SEQ ID NO: 1616268 - RNA, 16 nt, Homo sapiens
aaggaguaaucugugu

SEQ ID NO: 1616269 - RNA, 17 nt, Homo sapiens
aaggaguaaucugugua

SEQ ID NO: 1616270 - RNA, 18 nt, Homo sapiens
aaggaguaaucuguguac

SEQ ID NO: 1616271 - RNA, 21 nt, Homo sapiens
aaggaguaaucuguguacaaa

SEQ ID NO: 1616272 - RNA, 16 nt, Homo sapiens
aaggaguacaaugccc

SEQ ID NO: 1616273 - RNA, 22 nt, Homo sapiens
aaggaguacaaugcccagauca

SEQ ID NO: 1616274 - RNA, 21 nt, Homo sapiens
aaggaugguuuuaucuucccu

SEQ ID NO: 1616275 - RNA, 17 nt, Homo sapiens
aaggccucauccugggg

SEQ ID NO: 1616276 - RNA, 16 nt, Homo sapiens
aaggccuggucuggga

SEQ ID NO: 1616277 - RNA, 20 nt, Homo sapiens
aaggcugccagguguggaac

SEQ ID NO: 1616278 - RNA, 21 nt, Homo sapiens
aaggcugccagguguggaaca

SEQ ID NO: 1616279 - RNA, 13 nt, Homo sapiens
aaggcuguugcau

SEQ ID NO: 1616280 - RNA, 14 nt, Homo sapiens
aaggcuuucagggc

SEQ ID NO: 1616281 - RNA, 13 nt, Homo sapiens
aagggcacuccca

SEQ ID NO: 1616282 - RNA, 19 nt, Homo sapiens
aagggcacucccaacccug

SEQ ID NO: 1616283 - RNA, 14 nt, Homo sapiens
aagggcaucaucua

SEQ ID NO: 1616284 - RNA, 14 nt, Homo sapiens
aaggggacauucca

SEQ ID NO: 1616285 - RNA, 16 nt, Homo sapiens
aaggggagaccucaga

SEQ ID NO: 1616286 - RNA, 20 nt, Homo sapiens
aagguccucugucagucaca

SEQ ID NO: 1616287 - RNA, 19 nt, Homo sapiens
aagguggaacaagcacaga

SEQ ID NO: 1616288 - RNA, 15 nt, Homo sapiens
aaguaaugaucucaa

SEQ ID NO: 1616289 - RNA, 20 nt, Homo sapiens
aaguaauguaaaauccaucc

SEQ ID NO: 1616290 - RNA, 20 nt, Homo sapiens
aaguaauuuugcuccuugau

SEQ ID NO: 1616291 - RNA, 18 nt, Homo sapiens
aaguacauguuaaacuua

SEQ ID NO: 1616292 - RNA, 22 nt, Homo sapiens
aagucacccagggacacuccaa

SEQ ID NO: 1616293 - RNA, 15 nt, Homo sapiens
aagucauuccaugaa

SEQ ID NO: 1616294 - RNA, 17 nt, Homo sapiens
aaguccagaagggucau

SEQ ID NO: 1616295 - RNA, 14 nt, Homo sapiens
aagucccuuuguga

SEQ ID NO: 1616296 - RNA, 17 nt, Homo sapiens
aaguccguguccuaccu

SEQ ID NO: 1616297 - RNA, 17 nt, Homo sapiens
aaguccuucaccucacu

SEQ ID NO: 1616298 - RNA, 17 nt, Homo sapiens
aagugcucuaacuuuuc

SEQ ID NO: 1616299 - RNA, 14 nt, Homo sapiens
aaguggacucaggg

SEQ ID NO: 1616300 - RNA, 18 nt, Homo sapiens
aaguggucugaauucugg

SEQ ID NO: 1616301 - RNA, 13 nt, Homo sapiens
aaguggucuggga

SEQ ID NO: 1616302 - RNA, 21 nt, Homo sapiens
aagugucaccccucacuguga

SEQ ID NO: 1616303 - RNA, 20 nt, Homo sapiens
aaguguucacaacagugaaa

SEQ ID NO: 1616304 - RNA, 11 nt, Homo sapiens
aaguguugcau

SEQ ID NO: 1616305 - RNA, 23 nt, Homo sapiens
aaguguuggcaaacgagacuuuc

SEQ ID NO: 1616306 - RNA, 15 nt, Homo sapiens
aaguuccacuucuug

SEQ ID NO: 1616307 - RNA, 20 nt, Homo sapiens
aaguucuuggugguggauga

SEQ ID NO: 1616308 - RNA, 22 nt, Homo sapiens
aaguugcccaccaaaacacaga

SEQ ID NO: 1616309 - RNA, 14 nt, Homo sapiens
aaguuguugcauuc

SEQ ID NO: 1616310 - RNA, 22 nt, Homo sapiens
aaguuuaaauaccaguacuuga

SEQ ID NO: 1616311 - RNA, 17 nt, Homo sapiens
aaguuugcacucuuuga

SEQ ID NO: 1616312 - RNA, 16 nt, Homo sapiens
aauaaaauacauuuau

SEQ ID NO: 1616313 - RNA, 13 nt, Homo sapiens
gucaucugugcac

SEQ ID NO: 1616314 - RNA, 14 nt, Homo sapiens
gucaucugugcacu

SEQ ID NO: 1616315 - RNA, 19 nt, Homo sapiens
gucauggcuaauuuaacac

SEQ ID NO: 1616316 - RNA, 23 nt, Homo sapiens
gucauuaauggcauaugguccua

SEQ ID NO: 1616317 - RNA, 19 nt, Homo sapiens
gucauuauccuugcuauga

SEQ ID NO: 1616318 - RNA, 14 nt, Homo sapiens
gucauuauucucug

SEQ ID NO: 1616319 - RNA, 14 nt, Homo sapiens
gucauuucauucca

SEQ ID NO: 1616320 - RNA, 12 nt, Homo sapiens
guccaaauccaa

SEQ ID NO: 1616321 - RNA, 16 nt, Homo sapiens
guccaaauccaaccuc

SEQ ID NO: 1616322 - RNA, 9 nt, Homo sapiens
guccaucuu

SEQ ID NO: 1616323 - RNA, 13 nt, Homo sapiens
gucccacaggcca

SEQ ID NO: 1616324 - RNA, 17 nt, Homo sapiens
gucccacuaucugggug

SEQ ID NO: 1616325 - RNA, 17 nt, Homo sapiens
guccccacccuccacuc

SEQ ID NO: 1616326 - RNA, 21 nt, Homo sapiens
guccccacccuccacucagcu

SEQ ID NO: 1616327 - RNA, 18 nt, Homo sapiens
gucccgcgugcaaaggaa

SEQ ID NO: 1616328 - RNA, 18 nt, Homo sapiens
gucccuccucagaccucc

SEQ ID NO: 1616329 - RNA, 20 nt, Homo sapiens
guccuagccccucacuucca

SEQ ID NO: 1616330 - RNA, 13 nt, Homo sapiens
guccuccaagcuc

SEQ ID NO: 1616331 - RNA, 15 nt, Homo sapiens
guccucccuagcucu

SEQ ID NO: 1616332 - RNA, 20 nt, Homo sapiens
guccugagcacugccaggag

SEQ ID NO: 1616333 - RNA, 18 nt, Homo sapiens
guccuuucccaccauucc

SEQ ID NO: 1616334 - RNA, 19 nt, Homo sapiens
gucgaauuccuacugacaa

SEQ ID NO: 1616335 - RNA, 19 nt, Homo sapiens
gucuaauagucuuugccag

SEQ ID NO: 1616336 - RNA, 15 nt, Homo sapiens
gucuauagguuugug

SEQ ID NO: 1616337 - RNA, 22 nt, Homo sapiens
gucucaaaccuccaaaagcccu

SEQ ID NO: 1616338 - RNA, 15 nt, Homo sapiens
gucucauuugggcua

SEQ ID NO: 1616339 - RNA, 14 nt, Homo sapiens
gucucauuuugaca

SEQ ID NO: 1616340 - RNA, 18 nt, Homo sapiens
gucuccaacggcaaggga

SEQ ID NO: 1616341 - RNA, 17 nt, Homo sapiens
gucuccaggggccugca

SEQ ID NO: 1616342 - RNA, 17 nt, Homo sapiens
gucucccagcucagggc

SEQ ID NO: 1616343 - RNA, 19 nt, Homo sapiens
gucucucucuucucucuag

SEQ ID NO: 1616344 - RNA, 21 nt, Homo sapiens
gucucucucuucucucuaggu

SEQ ID NO: 1616345 - RNA, 12 nt, Homo sapiens
gucucucucuuu

SEQ ID NO: 1616346 - RNA, 16 nt, Homo sapiens
gucucuggggucagga

SEQ ID NO: 1616347 - RNA, 18 nt, Homo sapiens
gucugaauaacacuggau

SEQ ID NO: 1616348 - RNA, 16 nt, Homo sapiens
gucugaauucuggaau

SEQ ID NO: 1616349 - RNA, 23 nt, Homo sapiens
gucugauuuugagguuuagcaau

SEQ ID NO: 1616350 - RNA, 16 nt, Homo sapiens
gucugcugcugugcag

SEQ ID NO: 1616351 - RNA, 14 nt, Homo sapiens
gucugcuugucaaa

SEQ ID NO: 1616352 - RNA, 14 nt, Homo sapiens
gucugggacaggga

SEQ ID NO: 1616353 - RNA, 23 nt, Homo sapiens
gucugggaguauacggaaacaaa

SEQ ID NO: 1616354 - RNA, 13 nt, Homo sapiens
gucugguguucca

SEQ ID NO: 1616355 - RNA, 19 nt, Homo sapiens
gucugugugaaugugggca

SEQ ID NO: 1616356 - RNA, 21 nt, Homo sapiens
gucuuaccagugacgcugcug

SEQ ID NO: 1616357 - RNA, 20 nt, Homo sapiens
gucuuggcuuucauguuauu

SEQ ID NO: 1616358 - RNA, 20 nt, Homo sapiens
gucuuuccugaaccaugugg

SEQ ID NO: 1616359 - RNA, 17 nt, Homo sapiens
gucuuuucaucugggaa

SEQ ID NO: 1616360 - RNA, 18 nt, Homo sapiens
gucuuuuuuauguuaaaa

SEQ ID NO: 1616361 - RNA, 16 nt, Homo sapiens
gugaauaauggcacug

SEQ ID NO: 1616362 - RNA, 13 nt, Homo sapiens
gugaaugugggca

SEQ ID NO: 1616363 - RNA, 21 nt, Homo sapiens
gugaccccuccuugucagggu

SEQ ID NO: 1616364 - RNA, 15 nt, Homo sapiens
gugacuguugagggc

SEQ ID NO: 1616365 - RNA, 21 nt, Homo sapiens
gugagcagggucaagccucuu

SEQ ID NO: 1616366 - RNA, 14 nt, Homo sapiens
gugagcuacuuugu

SEQ ID NO: 1616367 - RNA, 15 nt, Homo sapiens
gugagggugcugacu

SEQ ID NO: 1616368 - RNA, 15 nt, Homo sapiens
gugaggugacacucc

SEQ ID NO: 1616369 - RNA, 18 nt, Homo sapiens
gugaggugcuugagucuc

SEQ ID NO: 1616370 - RNA, 13 nt, Homo sapiens
gugagugugacag

SEQ ID NO: 1616371 - RNA, 22 nt, Homo sapiens
gugauccugccuugcugugaaa

SEQ ID NO: 1616372 - RNA, 12 nt, Homo sapiens
gugaucuaccca

SEQ ID NO: 1616373 - RNA, 13 nt, Homo sapiens
gugauucaaugaa

SEQ ID NO: 1616374 - RNA, 23 nt, Homo sapiens
gugcaaaguccguguccuaccuc

SEQ ID NO: 1616375 - RNA, 14 nt, Homo sapiens
gugcacucucugcu

SEQ ID NO: 1616376 - RNA, 12 nt, Homo sapiens
gugcacuuucuc

SEQ ID NO: 1616377 - RNA, 19 nt, Homo sapiens
gugcaguggcgugaucucg

SEQ ID NO: 1616378 - RNA, 20 nt, Homo sapiens
gugcaguuguaggcauguag

SEQ ID NO: 1616379 - RNA, 17 nt, Homo sapiens
gugcaugccgggaccau

SEQ ID NO: 1616380 - RNA, 20 nt, Homo sapiens
gugccaauacagacaaagca

SEQ ID NO: 1616381 - RNA, 20 nt, Homo sapiens
gugccagaggcuggaccaca

SEQ ID NO: 1616382 - RNA, 13 nt, Homo sapiens
gugcccaugugua

SEQ ID NO: 1616383 - RNA, 12 nt, Homo sapiens
gugcuacagggg

SEQ ID NO: 1616384 - RNA, 22 nt, Homo sapiens
gugcucauucauuuaacagagc

SEQ ID NO: 1616385 - RNA, 19 nt, Homo sapiens
gugcuggaauuacaggcgu

SEQ ID NO: 1616386 - RNA, 15 nt, Homo sapiens
gugcuugagccagga

SEQ ID NO: 1616387 - RNA, 14 nt, Homo sapiens
gugcuugagucucc

SEQ ID NO: 1616388 - RNA, 20 nt, Homo sapiens
guggaacagcccaugcugag

SEQ ID NO: 1616389 - RNA, 19 nt, Homo sapiens
guggaaugugcauucucug

SEQ ID NO: 1616390 - RNA, 13 nt, Homo sapiens
guggagugcagug

SEQ ID NO: 1616391 - RNA, 15 nt, Homo sapiens
guggauagcauuguu

SEQ ID NO: 1616392 - RNA, 12 nt, Homo sapiens
guggaugacccu

SEQ ID NO: 1616393 - RNA, 19 nt, Homo sapiens
guggccuaauuuacaagca

SEQ ID NO: 1616394 - RNA, 15 nt, Homo sapiens
guggucuugaucucc

SEQ ID NO: 1616395 - RNA, 17 nt, Homo sapiens
gugguuuuugagccaug

SEQ ID NO: 1616396 - RNA, 14 nt, Homo sapiens
guguagccugugca

SEQ ID NO: 1616397 - RNA, 11 nt, Homo sapiens
gugucaccucc

SEQ ID NO: 1616398 - RNA, 19 nt, Homo sapiens
gugucaguucaacuuucag

SEQ ID NO: 1616399 - RNA, 17 nt, Homo sapiens
gugucucugcaugugua

SEQ ID NO: 1616400 - RNA, 13 nt, Homo sapiens
gugucugcacagg

SEQ ID NO: 1616401 - RNA, 20 nt, Homo sapiens
gugucuguacacguguccug

SEQ ID NO: 1616402 - RNA, 20 nt, Homo sapiens
gugugaauaaagugcugcgg

SEQ ID NO: 1616403 - RNA, 15 nt, Homo sapiens
gugugaaugugggca

SEQ ID NO: 1616404 - RNA, 18 nt, Homo sapiens
gugugacuucuuacacau

SEQ ID NO: 1616405 - RNA, 19 nt, Homo sapiens
gugugccugucuguuacac

SEQ ID NO: 1616406 - RNA, 14 nt, Homo sapiens
gugugcugugacaa

SEQ ID NO: 1616407 - RNA, 20 nt, Homo sapiens
guguguacaugugcacuccc

SEQ ID NO: 1616408 - RNA, 20 nt, Homo sapiens
gugugucucugcauguguaa

SEQ ID NO: 1616409 - RNA, 15 nt, Homo sapiens
gugugugacaauucu

SEQ ID NO: 1616410 - RNA, 14 nt, Homo sapiens
gugugugcugccag

SEQ ID NO: 1616411 - RNA, 14 nt, Homo sapiens
guguuaucuuuuga

SEQ ID NO: 1616412 - RNA, 15 nt, Homo sapiens
guguuugacgggaaa

SEQ ID NO: 1616413 - RNA, 12 nt, Homo sapiens
guguuuugccau

SEQ ID NO: 1616414 - RNA, 22 nt, Homo sapiens
guuaaaaauaaaaaacauauac

SEQ ID NO: 1616415 - RNA, 14 nt, Homo sapiens
guuaacuacauauu

SEQ ID NO: 1616416 - RNA, 13 nt, Homo sapiens
guuaacuugcaua

SEQ ID NO: 1616417 - RNA, 17 nt, Homo sapiens
guuaauaaaccuuugca

SEQ ID NO: 1616418 - RNA, 13 nt, Homo sapiens
gggagagucucac

SEQ ID NO: 1616419 - RNA, 13 nt, Homo sapiens
gggagcugccaag

SEQ ID NO: 1616420 - RNA, 11 nt, Homo sapiens
gggaggacaaa

SEQ ID NO: 1616421 - RNA, 23 nt, Homo sapiens
gggaggccgaagcuaacagggaa

SEQ ID NO: 1616422 - RNA, 13 nt, Homo sapiens
gggaucuugcaaa

SEQ ID NO: 1616423 - RNA, 20 nt, Homo sapiens
gggaugaggucaccagggga

SEQ ID NO: 1616424 - RNA, 12 nt, Homo sapiens
gggcaagcuuug

SEQ ID NO: 1616425 - RNA, 15 nt, Homo sapiens
gggcacuggcccagg

SEQ ID NO: 1616426 - RNA, 11 nt, Homo sapiens
gggcacuuuuu

SEQ ID NO: 1616427 - RNA, 22 nt, Homo sapiens
gggcagcgcccuuccucuccac

SEQ ID NO: 1616428 - RNA, 18 nt, Homo sapiens
gggcaggaguagcugagc

SEQ ID NO: 1616429 - RNA, 14 nt, Homo sapiens
gggcagugcccaug

SEQ ID NO: 1616430 - RNA, 18 nt, Homo sapiens
gggcaugggaaggugggc

SEQ ID NO: 1616431 - RNA, 18 nt, Homo sapiens
gggccauucuccacagca

SEQ ID NO: 1616432 - RNA, 23 nt, Homo sapiens
gggcccucccagcccauugcugc

SEQ ID NO: 1616433 - RNA, 15 nt, Homo sapiens
gggccugaugugugu

SEQ ID NO: 1616434 - RNA, 16 nt, Homo sapiens
gggccugcagaaggaa

SEQ ID NO: 1616435 - RNA, 14 nt, Homo sapiens
gggcucugagccaa

SEQ ID NO: 1616436 - RNA, 16 nt, Homo sapiens
gggcuuauccaugccu

SEQ ID NO: 1616437 - RNA, 21 nt, Homo sapiens
ggggacccugggcccaucucu

SEQ ID NO: 1616438 - RNA, 20 nt, Homo sapiens
ggggcaaaauggcaccuaag

SEQ ID NO: 1616439 - RNA, 17 nt, Homo sapiens
ggggucccaucagugaa

SEQ ID NO: 1616440 - RNA, 19 nt, Homo sapiens
ggggugggaguuuugcucu

SEQ ID NO: 1616441 - RNA, 16 nt, Homo sapiens
gggugacggcccucau

SEQ ID NO: 1616442 - RNA, 20 nt, Homo sapiens
ggguggagugcaguggugcg

SEQ ID NO: 1616443 - RNA, 12 nt, Homo sapiens
ggguuuugcucu

SEQ ID NO: 1616444 - RNA, 21 nt, Homo sapiens
gguaccugcccucuauuuauu

SEQ ID NO: 1616445 - RNA, 20 nt, Homo sapiens
gguacuauuuagauauaaca

SEQ ID NO: 1616446 - RNA, 17 nt, Homo sapiens
gguagagucauguuugc

SEQ ID NO: 1616447 - RNA, 11 nt, Homo sapiens
gguagccagca

SEQ ID NO: 1616448 - RNA, 14 nt, Homo sapiens
gguaggucauucuu

SEQ ID NO: 1616449 - RNA, 23 nt, Homo sapiens
gguaggugccgcuacaguuuuua

SEQ ID NO: 1616450 - RNA, 14 nt, Homo sapiens
gguaggugugacau

SEQ ID NO: 1616451 - RNA, 15 nt, Homo sapiens
ggucaagaaacagcc

SEQ ID NO: 1616452 - RNA, 15 nt, Homo sapiens
ggucaaucaguguua

SEQ ID NO: 1616453 - RNA, 15 nt, Homo sapiens
ggucauaguguauaa

SEQ ID NO: 1616454 - RNA, 17 nt, Homo sapiens
gguccacucuuguugaa

SEQ ID NO: 1616455 - RNA, 16 nt, Homo sapiens
ggucccuggagggcaa

SEQ ID NO: 1616456 - RNA, 15 nt, Homo sapiens
gguccugagcacugc

SEQ ID NO: 1616457 - RNA, 15 nt, Homo sapiens
ggucugaauucugga

SEQ ID NO: 1616458 - RNA, 23 nt, Homo sapiens
ggucugaauucuggaaucacaaa

SEQ ID NO: 1616459 - RNA, 19 nt, Homo sapiens
ggugacuguguaacuuucu

SEQ ID NO: 1616460 - RNA, 16 nt, Homo sapiens
ggugcaaccagggagc

SEQ ID NO: 1616461 - RNA, 19 nt, Homo sapiens
ggugcaguaucaugcccug

SEQ ID NO: 1616462 - RNA, 12 nt, Homo sapiens
gguggcaauaaa

SEQ ID NO: 1616463 - RNA, 13 nt, Homo sapiens
ggugucacauucc

SEQ ID NO: 1616464 - RNA, 15 nt, Homo sapiens
gguucagcugaagcu

SEQ ID NO: 1616465 - RNA, 20 nt, Homo sapiens
gguucaugcuucuacuguga

SEQ ID NO: 1616466 - RNA, 22 nt, Homo sapiens
gguucaugcuucuacugugaca

SEQ ID NO: 1616467 - RNA, 14 nt, Homo sapiens
gguugcauucuacu

SEQ ID NO: 1616468 - RNA, 15 nt, Homo sapiens
gguugggcagccaga

SEQ ID NO: 1616469 - RNA, 17 nt, Homo sapiens
gguuucucucccuccuu

SEQ ID NO: 1616470 - RNA, 14 nt, Homo sapiens
guaaaacaaucugu

SEQ ID NO: 1616471 - RNA, 21 nt, Homo sapiens
guaaaacaaucuguuuuggcu

SEQ ID NO: 1616472 - RNA, 12 nt, Homo sapiens
guaaaacagggc

SEQ ID NO: 1616473 - RNA, 16 nt, Homo sapiens
guaaaacaguuucauc

SEQ ID NO: 1616474 - RNA, 18 nt, Homo sapiens
guaaagacugguuuucug

SEQ ID NO: 1616475 - RNA, 20 nt, Homo sapiens
guaaagauccuauagcucuu

SEQ ID NO: 1616476 - RNA, 23 nt, Homo sapiens
guaaauccagauuuucacuguuc

SEQ ID NO: 1616477 - RNA, 16 nt, Homo sapiens
guaaauccaugguguu

SEQ ID NO: 1616478 - RNA, 10 nt, Homo sapiens
guaaccacug

SEQ ID NO: 1616479 - RNA, 18 nt, Homo sapiens
guaacuugccauccgcac

SEQ ID NO: 1616480 - RNA, 15 nt, Homo sapiens
guaagcgauuugaaa

SEQ ID NO: 1616481 - RNA, 18 nt, Homo sapiens
guaaucccaguacuuugg

SEQ ID NO: 1616482 - RNA, 14 nt, Homo sapiens
guaauucaguuauu

SEQ ID NO: 1616483 - RNA, 13 nt, Homo sapiens
guacaauaauuca

SEQ ID NO: 1616484 - RNA, 14 nt, Homo sapiens
guacaaucuuggga

SEQ ID NO: 1616485 - RNA, 12 nt, Homo sapiens
guacaccccagc

SEQ ID NO: 1616486 - RNA, 17 nt, Homo sapiens
guacauguuaaacuuac

SEQ ID NO: 1616487 - RNA, 13 nt, Homo sapiens
guacauucuuccu

SEQ ID NO: 1616488 - RNA, 22 nt, Homo sapiens
guaccaaagaaacaccacuuaa

SEQ ID NO: 1616489 - RNA, 20 nt, Homo sapiens
guaccuggcagcccugggcc

SEQ ID NO: 1616490 - RNA, 21 nt, Homo sapiens
guacuauucugagcauacuca

SEQ ID NO: 1616491 - RNA, 19 nt, Homo sapiens
guacuauugugaccacagg

SEQ ID NO: 1616492 - RNA, 13 nt, Homo sapiens
guacugccuuaaa

SEQ ID NO: 1616493 - RNA, 18 nt, Homo sapiens
guacugccuuagugcuga

SEQ ID NO: 1616494 - RNA, 21 nt, Homo sapiens
guagaaaauaaaacugagcua

SEQ ID NO: 1616495 - RNA, 19 nt, Homo sapiens
guagagcauaccacuugaa

SEQ ID NO: 1616496 - RNA, 12 nt, Homo sapiens
guagccagguac

SEQ ID NO: 1616497 - RNA, 16 nt, Homo sapiens
guagccugugcaugua

SEQ ID NO: 1616498 - RNA, 15 nt, Homo sapiens
guagcucaaucugca

SEQ ID NO: 1616499 - RNA, 17 nt, Homo sapiens
guaggugaaagaacaag

SEQ ID NO: 1616500 - RNA, 16 nt, Homo sapiens
guauacauacauguau

SEQ ID NO: 1616501 - RNA, 19 nt, Homo sapiens
guauauuuauuucuagcaa

SEQ ID NO: 1616502 - RNA, 19 nt, Homo sapiens
guaucacgggucacuugaa

SEQ ID NO: 1616503 - RNA, 11 nt, Homo sapiens
guaucacuggu

SEQ ID NO: 1616504 - RNA, 18 nt, Homo sapiens
guaucaugcccugugcaa

SEQ ID NO: 1616505 - RNA, 16 nt, Homo sapiens
guaucuccagccacuc

SEQ ID NO: 1616506 - RNA, 14 nt, Homo sapiens
guaugccacugcac

SEQ ID NO: 1616507 - RNA, 17 nt, Homo sapiens
guaugcuucuuuauaca

SEQ ID NO: 1616508 - RNA, 13 nt, Homo sapiens
guauggcucugca

SEQ ID NO: 1616509 - RNA, 19 nt, Homo sapiens
guaugucuuggacacugua

SEQ ID NO: 1616510 - RNA, 18 nt, Homo sapiens
guauguguaaaacaaucu

SEQ ID NO: 1616511 - RNA, 17 nt, Homo sapiens
guauuacagcuuucaca

SEQ ID NO: 1616512 - RNA, 19 nt, Homo sapiens
guauuagugacaccacaca

SEQ ID NO: 1616513 - RNA, 17 nt, Homo sapiens
guauuccaccacaggaa

SEQ ID NO: 1616514 - RNA, 18 nt, Homo sapiens
guauuccaccacaggaau

SEQ ID NO: 1616515 - RNA, 15 nt, Homo sapiens
guauuucucugugaa

SEQ ID NO: 1616516 - RNA, 13 nt, Homo sapiens
gucaagcuccuag

SEQ ID NO: 1616517 - RNA, 23 nt, Homo sapiens
gucaagugaggugacacuccagu

SEQ ID NO: 1616518 - RNA, 18 nt, Homo sapiens
gucaauaaacaacagcug

SEQ ID NO: 1616519 - RNA, 15 nt, Homo sapiens
gucaaugaccauuca

SEQ ID NO: 1616520 - RNA, 17 nt, Homo sapiens
gucacauggccuaugca

SEQ ID NO: 1616521 - RNA, 20 nt, Homo sapiens
gccaauacagacaaagcaua

SEQ ID NO: 1616522 - RNA, 20 nt, Homo sapiens
gccaauuuuuguacuuuuag

SEQ ID NO: 1616523 - RNA, 15 nt, Homo sapiens
gccacagacaacuca

SEQ ID NO: 1616524 - RNA, 16 nt, Homo sapiens
gccacagcagccacuu

SEQ ID NO: 1616525 - RNA, 23 nt, Homo sapiens
gccacaucccuauagaccacugg

SEQ ID NO: 1616526 - RNA, 14 nt, Homo sapiens
gccaccacauguau

SEQ ID NO: 1616527 - RNA, 17 nt, Homo sapiens
gccaccuuuauggacug

SEQ ID NO: 1616528 - RNA, 20 nt, Homo sapiens
gccaccuuuauggacuggcc

SEQ ID NO: 1616529 - RNA, 16 nt, Homo sapiens
gccacggccuggcugg

SEQ ID NO: 1616530 - RNA, 24 nt, Homo sapiens
gccacguaugguggcucaugucua

SEQ ID NO: 1616531 - RNA, 19 nt, Homo sapiens
gccacugacugagauggag

SEQ ID NO: 1616532 - RNA, 23 nt, Homo sapiens
gccagaacguggcucugcuggcc

SEQ ID NO: 1616533 - RNA, 18 nt, Homo sapiens
gccagacucuagguuaua

SEQ ID NO: 1616534 - RNA, 15 nt, Homo sapiens
gccagccacaggacc

SEQ ID NO: 1616535 - RNA, 17 nt, Homo sapiens
ggacugugaggccauac

SEQ ID NO: 1616536 - RNA, 11 nt, Homo sapiens
ggacuugccuc

SEQ ID NO: 1616537 - RNA, 14 nt, Homo sapiens
ggagaagcacagcu

SEQ ID NO: 1616538 - RNA, 17 nt, Homo sapiens
ggagaaggagugccaua

SEQ ID NO: 1616539 - RNA, 16 nt, Homo sapiens
ggagacaaggugcuaa

SEQ ID NO: 1616540 - RNA, 13 nt, Homo sapiens
ggagaccucagaa

SEQ ID NO: 1616541 - RNA, 20 nt, Homo sapiens
ggagcagguuccccaagggc

SEQ ID NO: 1616542 - RNA, 10 nt, Homo sapiens
ggagccacuc

SEQ ID NO: 1616543 - RNA, 19 nt, Homo sapiens
ggagccccuucugcucagc

SEQ ID NO: 1616544 - RNA, 22 nt, Homo sapiens
ggagccccuucugcucagcucu

SEQ ID NO: 1616545 - RNA, 15 nt, Homo sapiens
ggagcugaggccaca

SEQ ID NO: 1616546 - RNA, 17 nt, Homo sapiens
ggaggaaggagccuaug

SEQ ID NO: 1616547 - RNA, 15 nt, Homo sapiens
ggaggaauacauuuu

SEQ ID NO: 1616548 - RNA, 14 nt, Homo sapiens
ggaggaggugaaag

SEQ ID NO: 1616549 - RNA, 21 nt, Homo sapiens
ggaggauacugaggcacacag

SEQ ID NO: 1616550 - RNA, 22 nt, Homo sapiens
ggaggauacugaggcacacaga

SEQ ID NO: 1616551 - RNA, 23 nt, Homo sapiens
ggaggaugucccugggccagggu

SEQ ID NO: 1616552 - RNA, 15 nt, Homo sapiens
ggaggcccuccugug

SEQ ID NO: 1616553 - RNA, 19 nt, Homo sapiens
ggaggcggagguugcagua

SEQ ID NO: 1616554 - RNA, 13 nt, Homo sapiens
ggagggacaagug

SEQ ID NO: 1616555 - RNA, 21 nt, Homo sapiens
ggagggcugucaucugugcac

SEQ ID NO: 1616556 - RNA, 14 nt, Homo sapiens
ggagggucagccag

SEQ ID NO: 1616557 - RNA, 22 nt, Homo sapiens
ggaguaaucuguguacaaagaa

SEQ ID NO: 1616558 - RNA, 22 nt, Homo sapiens
ggagucuugcucugucacccag

SEQ ID NO: 1616559 - RNA, 14 nt, Homo sapiens
ggauaaagccacuu

SEQ ID NO: 1616560 - RNA, 21 nt, Homo sapiens
ggauaaguuucuauucuguca

SEQ ID NO: 1616561 - RNA, 15 nt, Homo sapiens
ggauacgacacaugc

SEQ ID NO: 1616562 - RNA, 21 nt, Homo sapiens
ggauauuuacugcucuuuauu

SEQ ID NO: 1616563 - RNA, 14 nt, Homo sapiens
ggaucccaccccau

SEQ ID NO: 1616564 - RNA, 15 nt, Homo sapiens
ggaucccuacugcca

SEQ ID NO: 1616565 - RNA, 22 nt, Homo sapiens
ggaucuugaauguggucucagg

SEQ ID NO: 1616566 - RNA, 18 nt, Homo sapiens
ggaucuuggagaauguga

SEQ ID NO: 1616567 - RNA, 14 nt, Homo sapiens
ggaugggaugcacu

SEQ ID NO: 1616568 - RNA, 15 nt, Homo sapiens
ggauuaaauuuaauu

SEQ ID NO: 1616569 - RNA, 20 nt, Homo sapiens
ggauuacaggcgccugccac

SEQ ID NO: 1616570 - RNA, 19 nt, Homo sapiens
ggauuacaggugugcacca

SEQ ID NO: 1616571 - RNA, 22 nt, Homo sapiens
ggauucccaccccacuucugca

SEQ ID NO: 1616572 - RNA, 21 nt, Homo sapiens
ggauuguucuggucuuacuca

SEQ ID NO: 1616573 - RNA, 15 nt, Homo sapiens
ggauuuucacauucu

SEQ ID NO: 1616574 - RNA, 16 nt, Homo sapiens
ggcaacgcacaaaaca

SEQ ID NO: 1616575 - RNA, 17 nt, Homo sapiens
ggcacagcuaaccacuu

SEQ ID NO: 1616576 - RNA, 17 nt, Homo sapiens
ggcacauuccccuugcc

SEQ ID NO: 1616577 - RNA, 14 nt, Homo sapiens
ggcacuguggccuu

SEQ ID NO: 1616578 - RNA, 21 nt, Homo sapiens
ggcagaaacaaaaugacugua

SEQ ID NO: 1616579 - RNA, 22 nt, Homo sapiens
ggcagagccaccugacucuugc

SEQ ID NO: 1616580 - RNA, 22 nt, Homo sapiens
ggcagagcugggggcugaggga

SEQ ID NO: 1616581 - RNA, 18 nt, Homo sapiens
ggcagccacaacugcagu

SEQ ID NO: 1616582 - RNA, 20 nt, Homo sapiens
ggcagccuggacauagagag

SEQ ID NO: 1616583 - RNA, 18 nt, Homo sapiens
ggcaggaacaaacagggc

SEQ ID NO: 1616584 - RNA, 21 nt, Homo sapiens
ggcaggaguagcugagcucac

SEQ ID NO: 1616585 - RNA, 23 nt, Homo sapiens
ggcaugcuggcucccagggccau

SEQ ID NO: 1616586 - RNA, 23 nt, Homo sapiens
ggccaaggugccaccacccugcc

SEQ ID NO: 1616587 - RNA, 21 nt, Homo sapiens
ggccacauagaugcugaugga

SEQ ID NO: 1616588 - RNA, 19 nt, Homo sapiens
ggccagggcugcccugaga

SEQ ID NO: 1616589 - RNA, 14 nt, Homo sapiens
ggccauauuuacua

SEQ ID NO: 1616590 - RNA, 14 nt, Homo sapiens
ggccccauccucau

SEQ ID NO: 1616591 - RNA, 13 nt, Homo sapiens
ggccccgggcugg

SEQ ID NO: 1616592 - RNA, 16 nt, Homo sapiens
ggccccucucauuccc

SEQ ID NO: 1616593 - RNA, 17 nt, Homo sapiens
ggccccuuugagucuga

SEQ ID NO: 1616594 - RNA, 13 nt, Homo sapiens
ggccuaugcacau

SEQ ID NO: 1616595 - RNA, 17 nt, Homo sapiens
ggccuaugcacauaugg

SEQ ID NO: 1616596 - RNA, 11 nt, Homo sapiens
ggccucagagc

SEQ ID NO: 1616597 - RNA, 19 nt, Homo sapiens
ggccucagcugaaugccuc

SEQ ID NO: 1616598 - RNA, 20 nt, Homo sapiens
ggccucccaaaugagccaug

SEQ ID NO: 1616599 - RNA, 19 nt, Homo sapiens
ggccucugagaagcucuga

SEQ ID NO: 1616600 - RNA, 15 nt, Homo sapiens
ggccuggccagucaa

SEQ ID NO: 1616601 - RNA, 18 nt, Homo sapiens
ggccuguacggacacugu

SEQ ID NO: 1616602 - RNA, 15 nt, Homo sapiens
ggccugugauguuuu

SEQ ID NO: 1616603 - RNA, 18 nt, Homo sapiens
ggccuguguagcugugac

SEQ ID NO: 1616604 - RNA, 16 nt, Homo sapiens
ggcuaaugaagaucau

SEQ ID NO: 1616605 - RNA, 17 nt, Homo sapiens
ggcuauuuucagaugaa

SEQ ID NO: 1616606 - RNA, 19 nt, Homo sapiens
ggcucagcagggcugguca

SEQ ID NO: 1616607 - RNA, 20 nt, Homo sapiens
ggcucagccucaaaugcagu

SEQ ID NO: 1616608 - RNA, 18 nt, Homo sapiens
ggcucagugcaaccucug

SEQ ID NO: 1616609 - RNA, 18 nt, Homo sapiens
ggcuccagaugcagggca

SEQ ID NO: 1616610 - RNA, 15 nt, Homo sapiens
ggcucccagggccau

SEQ ID NO: 1616611 - RNA, 16 nt, Homo sapiens
ggcucguguauuuauu

SEQ ID NO: 1616612 - RNA, 15 nt, Homo sapiens
ggcucuaacgccuga

SEQ ID NO: 1616613 - RNA, 15 nt, Homo sapiens
ggcucuccaagggaa

SEQ ID NO: 1616614 - RNA, 17 nt, Homo sapiens
ggcugauucagcauuuu

SEQ ID NO: 1616615 - RNA, 18 nt, Homo sapiens
ggcugcucggggugcaca

SEQ ID NO: 1616616 - RNA, 18 nt, Homo sapiens
ggcugcuuccugugacag

SEQ ID NO: 1616617 - RNA, 22 nt, Homo sapiens
ggcugcuuccugugacagugaa

SEQ ID NO: 1616618 - RNA, 15 nt, Homo sapiens
ggcuggagugcaaug

SEQ ID NO: 1616619 - RNA, 17 nt, Homo sapiens
ggcuggccgcaugacca

SEQ ID NO: 1616620 - RNA, 14 nt, Homo sapiens
ggcuggccucccaa

SEQ ID NO: 1616621 - RNA, 18 nt, Homo sapiens
ggcugugggcaagccuaa

SEQ ID NO: 1616622 - RNA, 23 nt, Homo sapiens
ggcuucagcccccaccaggggaa

SEQ ID NO: 1616623 - RNA, 13 nt, Homo sapiens
ggcuucuggaaua

SEQ ID NO: 1616624 - RNA, 15 nt, Homo sapiens
ggcuucuggucauga

SEQ ID NO: 1616625 - RNA, 16 nt, Homo sapiens
ggcuugaaggccagca

SEQ ID NO: 1616626 - RNA, 20 nt, Homo sapiens
ggcuuuaauagucaccuuca

SEQ ID NO: 1616627 - RNA, 12 nt, Homo sapiens
ggcuuuaugcaa

SEQ ID NO: 1616628 - RNA, 12 nt, Homo sapiens
ggcuuuugccac

SEQ ID NO: 1616629 - RNA, 20 nt, Homo sapiens
ggcuuuuugccaucugugau

SEQ ID NO: 1616630 - RNA, 14 nt, Homo sapiens
gggaaccacuccca

SEQ ID NO: 1616631 - RNA, 21 nt, Homo sapiens
gggaacuggccaagcugaggu

SEQ ID NO: 1616632 - RNA, 23 nt, Homo sapiens
gggaacuuuuuuagaaaugcaaa

SEQ ID NO: 1616633 - RNA, 21 nt, Homo sapiens
gggaagaugcccucaacucac

SEQ ID NO: 1616634 - RNA, 18 nt, Homo sapiens
gggaaggugggcgggcag

SEQ ID NO: 1616635 - RNA, 18 nt, Homo sapiens
cugaguagcugggauuac

SEQ ID NO: 1616636 - RNA, 23 nt, Homo sapiens
cugagugaccuccuucugcaaag

SEQ ID NO: 1616637 - RNA, 19 nt, Homo sapiens
cugaguucuggggugggag

SEQ ID NO: 1616638 - RNA, 17 nt, Homo sapiens
cugauaagcuuccuaga

SEQ ID NO: 1616639 - RNA, 18 nt, Homo sapiens
cugaucaagaacauguca

SEQ ID NO: 1616640 - RNA, 18 nt, Homo sapiens
cugaugccccagggauuc

SEQ ID NO: 1616641 - RNA, 12 nt, Homo sapiens
cugucucaguga

SEQ ID NO: 1616642 - RNA, 13 nt, Homo sapiens
cugucucagugau

SEQ ID NO: 1616643 - RNA, 20 nt, Homo sapiens
cugucuucccaaacccaguc

SEQ ID NO: 1616644 - RNA, 15 nt, Homo sapiens
cugucuuggggccac

SEQ ID NO: 1616645 - RNA, 17 nt, Homo sapiens
cugugaaaccccuaugu

SEQ ID NO: 1616646 - RNA, 23 nt, Homo sapiens
cugugaccugcugagcucugaga

SEQ ID NO: 1616647 - RNA, 15 nt, Homo sapiens
cugugacugauauga

SEQ ID NO: 1616648 - RNA, 19 nt, Homo sapiens
cugugagcccagcuggguc

SEQ ID NO: 1616649 - RNA, 17 nt, Homo sapiens
cugugauaugccauagg

SEQ ID NO: 1616650 - RNA, 19 nt, Homo sapiens
cugugcacaaaacccagac

SEQ ID NO: 1616651 - RNA, 18 nt, Homo sapiens
cugugcacugcccaugga

SEQ ID NO: 1616652 - RNA, 14 nt, Homo sapiens
cugugccccaccac

SEQ ID NO: 1616653 - RNA, 15 nt, Homo sapiens
cugugccccaccacg

SEQ ID NO: 1616654 - RNA, 23 nt, Homo sapiens
cugugccucgcuccccacucugc

SEQ ID NO: 1616655 - RNA, 14 nt, Homo sapiens
cuguggaaugugca

SEQ ID NO: 1616656 - RNA, 15 nt, Homo sapiens
cuguggccaaguucu

SEQ ID NO: 1616657 - RNA, 18 nt, Homo sapiens
cuguguacacgugacaga

SEQ ID NO: 1616658 - RNA, 17 nt, Homo sapiens
cuguguauucauucuca

SEQ ID NO: 1616659 - RNA, 21 nt, Homo sapiens
cuguguggucuccaugcucac

SEQ ID NO: 1616660 - RNA, 11 nt, Homo sapiens
cuguguuucaa

SEQ ID NO: 1616661 - RNA, 22 nt, Homo sapiens
cuguuccccaaggacucuucca

SEQ ID NO: 1616662 - RNA, 13 nt, Homo sapiens
cuguuccuugaaa

SEQ ID NO: 1616663 - RNA, 15 nt, Homo sapiens
cuguugacuggcugu

SEQ ID NO: 1616664 - RNA, 19 nt, Homo sapiens
cuguugccuuugcucuuau

SEQ ID NO: 1616665 - RNA, 12 nt, Homo sapiens
cuguuggaugau

SEQ ID NO: 1616666 - RNA, 16 nt, Homo sapiens
cuguuuaaagugucac

SEQ ID NO: 1616667 - RNA, 17 nt, Homo sapiens
cuguuuaucaagccaua

SEQ ID NO: 1616668 - RNA, 15 nt, Homo sapiens
cuguuucacauugca

SEQ ID NO: 1616669 - RNA, 13 nt, Homo sapiens
cuguuucagaaau

SEQ ID NO: 1616670 - RNA, 16 nt, Homo sapiens
cuguuuuguaaagucc

SEQ ID NO: 1616671 - RNA, 23 nt, Homo sapiens
cuuaaagccuuuuccugaauugg

SEQ ID NO: 1616672 - RNA, 13 nt, Homo sapiens
cuuaaauaagucu

SEQ ID NO: 1616673 - RNA, 14 nt, Homo sapiens
cuuaacacauucaa

SEQ ID NO: 1616674 - RNA, 21 nt, Homo sapiens
cuuaacacauucaauagcaua

SEQ ID NO: 1616675 - RNA, 21 nt, Homo sapiens
cuuaagccagcacucacacca

SEQ ID NO: 1616676 - RNA, 18 nt, Homo sapiens
cuuaaguuuuacuugagg

SEQ ID NO: 1616677 - RNA, 22 nt, Homo sapiens
cuuaauagguucaaaagcaauc

SEQ ID NO: 1616678 - RNA, 12 nt, Homo sapiens
cuuacaauguga

SEQ ID NO: 1616679 - RNA, 18 nt, Homo sapiens
cuuacacauaaagcacua

SEQ ID NO: 1616680 - RNA, 23 nt, Homo sapiens
cuuagggcagauuuucaugcaaa

SEQ ID NO: 1616681 - RNA, 21 nt, Homo sapiens
cuuaguaaguaauaucaaagc

SEQ ID NO: 1616682 - RNA, 15 nt, Homo sapiens
cuuagucaugguguu

SEQ ID NO: 1616683 - RNA, 18 nt, Homo sapiens
cuuaucaacuaaugauuu

SEQ ID NO: 1616684 - RNA, 17 nt, Homo sapiens
cuuauccaugccuggga

SEQ ID NO: 1616685 - RNA, 13 nt, Homo sapiens
cuuaugauucaga

SEQ ID NO: 1616686 - RNA, 14 nt, Homo sapiens
cuuauuaguuacaa

SEQ ID NO: 1616687 - RNA, 14 nt, Homo sapiens
cuuauucucuguag

SEQ ID NO: 1616688 - RNA, 13 nt, Homo sapiens
cuuauuucuauga

SEQ ID NO: 1616689 - RNA, 18 nt, Homo sapiens
cuucaacaugacauccag

SEQ ID NO: 1616690 - RNA, 17 nt, Homo sapiens
cuucaagaacuuucucu

SEQ ID NO: 1616691 - RNA, 14 nt, Homo sapiens
cuucaccucacuga

SEQ ID NO: 1616692 - RNA, 14 nt, Homo sapiens
cuucaccuuaggaa

SEQ ID NO: 1616693 - RNA, 14 nt, Homo sapiens
cuucacgcuuucag

SEQ ID NO: 1616694 - RNA, 14 nt, Homo sapiens
cuucacugcuccuc

SEQ ID NO: 1616695 - RNA, 21 nt, Homo sapiens
cuucaggaagcauaaagcaau

SEQ ID NO: 1616696 - RNA, 22 nt, Homo sapiens
cuucaggggcucccugccugag

SEQ ID NO: 1616697 - RNA, 22 nt, Homo sapiens
cuuccaagaccauuuguaguga

SEQ ID NO: 1616698 - RNA, 13 nt, Homo sapiens
cuuccaaguccuu

SEQ ID NO: 1616699 - RNA, 12 nt, Homo sapiens
cuuccaccucac

SEQ ID NO: 1616700 - RNA, 22 nt, Homo sapiens
cuucccagagggauugcuguga

SEQ ID NO: 1616701 - RNA, 13 nt, Homo sapiens
cuucccccagcaa

SEQ ID NO: 1616702 - RNA, 18 nt, Homo sapiens
cuucccucugcauugacc

SEQ ID NO: 1616703 - RNA, 22 nt, Homo sapiens
cuucccuugcuggaaaacccaa

SEQ ID NO: 1616704 - RNA, 22 nt, Homo sapiens
cuuccgcacccucccuagcucu

SEQ ID NO: 1616705 - RNA, 12 nt, Homo sapiens
cuuccuagguca

SEQ ID NO: 1616706 - RNA, 17 nt, Homo sapiens
cuuccucagcaggccaa

SEQ ID NO: 1616707 - RNA, 19 nt, Homo sapiens
cuuccugcccuaacucugc

SEQ ID NO: 1616708 - RNA, 22 nt, Homo sapiens
cuuccuggggaccaagauuuac

SEQ ID NO: 1616709 - RNA, 18 nt, Homo sapiens
cuuccuuuugagggagca

SEQ ID NO: 1616710 - RNA, 13 nt, Homo sapiens
cuucggauaugau

SEQ ID NO: 1616711 - RNA, 18 nt, Homo sapiens
cuucggcagggaggugaa

SEQ ID NO: 1616712 - RNA, 13 nt, Homo sapiens
cuucuacuccucc

SEQ ID NO: 1616713 - RNA, 20 nt, Homo sapiens
cuucucaggacacaggccug

SEQ ID NO: 1616714 - RNA, 17 nt, Homo sapiens
cuucuccaagcuuucag

SEQ ID NO: 1616715 - RNA, 15 nt, Homo sapiens
cuucuccauucccua

SEQ ID NO: 1616716 - RNA, 19 nt, Homo sapiens
cuucuccguacaccccagc

SEQ ID NO: 1616717 - RNA, 14 nt, Homo sapiens
cuucugcaacccca

SEQ ID NO: 1616718 - RNA, 15 nt, Homo sapiens
cuucugcucagcucu

SEQ ID NO: 1616719 - RNA, 17 nt, Homo sapiens
cuucugcuugucccaaa

SEQ ID NO: 1616720 - RNA, 16 nt, Homo sapiens
cuucuuauuaaucaua

SEQ ID NO: 1616721 - RNA, 16 nt, Homo sapiens
cuucuugcuucaguca

SEQ ID NO: 1616722 - RNA, 19 nt, Homo sapiens
cuucuugguggggaugaga

SEQ ID NO: 1616723 - RNA, 16 nt, Homo sapiens
cuucuuuauacaugcu

SEQ ID NO: 1616724 - RNA, 22 nt, Homo sapiens
cuugaacccccucccuguccca

SEQ ID NO: 1616725 - RNA, 20 nt, Homo sapiens
cuugaaucucugaauuugag

SEQ ID NO: 1616726 - RNA, 14 nt, Homo sapiens
cuugagggaccaau

SEQ ID NO: 1616727 - RNA, 14 nt, Homo sapiens
cuugaucaaaggca

SEQ ID NO: 1616728 - RNA, 20 nt, Homo sapiens
cuugaugagcugugcacaaa

SEQ ID NO: 1616729 - RNA, 20 nt, Homo sapiens
cuugccauuuguagcuuugc

SEQ ID NO: 1616730 - RNA, 19 nt, Homo sapiens
cuugcucccaagccccuga

SEQ ID NO: 1616731 - RNA, 18 nt, Homo sapiens
cuugcucccaauggugcu

SEQ ID NO: 1616732 - RNA, 16 nt, Homo sapiens
cuuggaaucgucccua

SEQ ID NO: 1616733 - RNA, 17 nt, Homo sapiens
cuuggcuuuaugcaaau

SEQ ID NO: 1616734 - RNA, 20 nt, Homo sapiens
cuuggggagauggaguucuu

SEQ ID NO: 1616735 - RNA, 18 nt, Homo sapiens
cuugguuuccaaaggcau

SEQ ID NO: 1616736 - RNA, 14 nt, Homo sapiens
cuugucaaugugau

SEQ ID NO: 1616737 - RNA, 23 nt, Homo sapiens
cuugucagacauaaagccauguu

SEQ ID NO: 1616738 - RNA, 16 nt, Homo sapiens
cuuguucucacugucu

SEQ ID NO: 1616739 - RNA, 22 nt, Homo sapiens
cuuguugacacggccaugacca

SEQ ID NO: 1616740 - RNA, 19 nt, Homo sapiens
cuuuaaagucagguccaau

SEQ ID NO: 1616741 - RNA, 12 nt, Homo sapiens
cuuuaaauauca

SEQ ID NO: 1616742 - RNA, 21 nt, Homo sapiens
cuuuaacacaacucuuuguuc

SEQ ID NO: 1616743 - RNA, 21 nt, Homo sapiens
cuuuaaccccaaauuuggcua

SEQ ID NO: 1616744 - RNA, 22 nt, Homo sapiens
cuuuaagaagcaguguuuuaga

SEQ ID NO: 1616745 - RNA, 19 nt, Homo sapiens
cuuuacaaacccugcaauu

SEQ ID NO: 1616746 - RNA, 18 nt, Homo sapiens
cuuuacaaacugaagaua

SEQ ID NO: 1616747 - RNA, 21 nt, Homo sapiens
cgcccugcaugucuccucacc

SEQ ID NO: 1616748 - RNA, 22 nt, Homo sapiens
cgcugagcgucacggccaagug

SEQ ID NO: 1616749 - RNA, 17 nt, Homo sapiens
cggagguccuuuggaca

SEQ ID NO: 1616750 - RNA, 15 nt, Homo sapiens
cggauguaugaucuc

SEQ ID NO: 1616751 - RNA, 16 nt, Homo sapiens
cggauguaugaucucu

SEQ ID NO: 1616752 - RNA, 18 nt, Homo sapiens
cggauguuucugugacac

SEQ ID NO: 1616753 - RNA, 17 nt, Homo sapiens
cggcaacaucaacccga

SEQ ID NO: 1616754 - RNA, 12 nt, Homo sapiens
cggcacauuccc

SEQ ID NO: 1616755 - RNA, 15 nt, Homo sapiens
cggcucagugcaacc

SEQ ID NO: 1616756 - RNA, 16 nt, Homo sapiens
cggcuuguaaauguga

SEQ ID NO: 1616757 - RNA, 20 nt, Homo sapiens
ccuccaaaagcccugaguuu

SEQ ID NO: 1616758 - RNA, 14 nt, Homo sapiens
ccuccaacaccaag

SEQ ID NO: 1616759 - RNA, 15 nt, Homo sapiens
ccuccaggcugaggg

SEQ ID NO: 1616760 - RNA, 14 nt, Homo sapiens
ccuccauuccccac

SEQ ID NO: 1616761 - RNA, 16 nt, Homo sapiens
ccucccaaaaugcugg

SEQ ID NO: 1616762 - RNA, 17 nt, Homo sapiens
ccuccuccccuagggaa

SEQ ID NO: 1616763 - RNA, 16 nt, Homo sapiens
ccucgcccuccacaaa

SEQ ID NO: 1616764 - RNA, 21 nt, Homo sapiens
ccucucgccucauuacuguga

SEQ ID NO: 1616765 - RNA, 14 nt, Homo sapiens
ccucugaagcauuu

SEQ ID NO: 1616766 - RNA, 11 nt, Homo sapiens
ccucugcauuu

SEQ ID NO: 1616767 - RNA, 23 nt, Homo sapiens
ccucuggauccagccaugccuga

SEQ ID NO: 1616768 - RNA, 17 nt, Homo sapiens
ccaacuguuucccugcu

SEQ ID NO: 1616769 - RNA, 16 nt, Homo sapiens
ccaaggacucuuccac

SEQ ID NO: 1616770 - RNA, 16 nt, Homo sapiens
ccaaguccagguccug

SEQ ID NO: 1616771 - RNA, 20 nt, Homo sapiens
ccaaguccuauccuaaauaa

SEQ ID NO: 1616772 - RNA, 15 nt, Homo sapiens
ccaagugcaaaagaa

SEQ ID NO: 1616773 - RNA, 23 nt, Homo sapiens
ccaaguucuuagggcacaugaaa

SEQ ID NO: 1616774 - RNA, 23 nt, Homo sapiens
ccaaguugagauuuuaauucugu

SEQ ID NO: 1616775 - RNA, 15 nt, Homo sapiens
ccaaucugcauuucu

SEQ ID NO: 1616776 - RNA, 21 nt, Homo sapiens
ccacaaaugggaaaaccagac

SEQ ID NO: 1616777 - RNA, 22 nt, Homo sapiens
ccacacgccucuguguacaugu

SEQ ID NO: 1616778 - RNA, 11 nt, Homo sapiens
ccacacuugaa

SEQ ID NO: 1616779 - RNA, 21 nt, Homo sapiens
ccacagagaaguuuguagcca

SEQ ID NO: 1616780 - RNA, 23 nt, Homo sapiens
ccacagagaaguuuguagccagg

SEQ ID NO: 1616781 - RNA, 20 nt, Homo sapiens
augugugguggccucagcug

SEQ ID NO: 1616782 - RNA, 15 nt, Homo sapiens
auguguguaaauucu

SEQ ID NO: 1616783 - RNA, 17 nt, Homo sapiens
auguguuucaaaaccau

SEQ ID NO: 1616784 - RNA, 18 nt, Homo sapiens
auguguuuuaucacuuca

SEQ ID NO: 1616785 - RNA, 22 nt, Homo sapiens
auguguuuuaucacuucauuca

SEQ ID NO: 1616786 - RNA, 18 nt, Homo sapiens
auguuacugacuccucag

SEQ ID NO: 1616787 - RNA, 20 nt, Homo sapiens
auguuauguaccauaugauc

SEQ ID NO: 1616788 - RNA, 20 nt, Homo sapiens
auguuccuuucgaaagcaau

SEQ ID NO: 1616789 - RNA, 15 nt, Homo sapiens
auguugaucauguac

SEQ ID NO: 1616790 - RNA, 23 nt, Homo sapiens
auguugcaaagaacuccagaguc

SEQ ID NO: 1616791 - RNA, 23 nt, Homo sapiens
auguuuaugaaggguaagggaau

SEQ ID NO: 1616792 - RNA, 24 nt, Homo sapiens
auguuugacaaaacacagccaagg

SEQ ID NO: 1616793 - RNA, 17 nt, Homo sapiens
auuaaaauacauuuuaa

SEQ ID NO: 1616794 - RNA, 19 nt, Homo sapiens
auuaaacaaguauaaaaua

SEQ ID NO: 1616795 - RNA, 17 nt, Homo sapiens
auuaaacguaugcaugu

SEQ ID NO: 1616796 - RNA, 19 nt, Homo sapiens
auuaacaacaauaacacug

SEQ ID NO: 1616797 - RNA, 20 nt, Homo sapiens
auuaacaacaauaacacugu

SEQ ID NO: 1616798 - RNA, 18 nt, Homo sapiens
auuaagacuuuauguagu

SEQ ID NO: 1616799 - RNA, 19 nt, Homo sapiens
auuaagacuuuauguaguu

SEQ ID NO: 1616800 - RNA, 24 nt, Homo sapiens
auuaaggccuuuuccacacgcauu

SEQ ID NO: 1616801 - RNA, 22 nt, Homo sapiens
auuaaucacaaauuucacuuau

SEQ ID NO: 1616802 - RNA, 18 nt, Homo sapiens
auuacauaaucuguacaa

SEQ ID NO: 1616803 - RNA, 15 nt, Homo sapiens
aauauuuagcuguaa

SEQ ID NO: 1616804 - RNA, 18 nt, Homo sapiens
aauauuuucucuguacuu

SEQ ID NO: 1616805 - RNA, 19 nt, Homo sapiens
aauauuuuguuuugugcag

SEQ ID NO: 1616806 - RNA, 21 nt, Homo sapiens
aauauuuuucuguagugugaa

SEQ ID NO: 1616807 - RNA, 12 nt, Homo sapiens
aaucaaucugca

SEQ ID NO: 1616808 - RNA, 23 nt, Homo sapiens
aaucacauucuguuuaucaagcc

SEQ ID NO: 1616809 - RNA, 15 nt, Homo sapiens
aaucaccccauuuca

SEQ ID NO: 1616810 - RNA, 18 nt, Homo sapiens
aaucagaguguacaaauu

SEQ ID NO: 1616811 - RNA, 16 nt, Homo sapiens
aaucagcccagugcaa

SEQ ID NO: 1616812 - RNA, 18 nt, Homo sapiens
aaucaguaaauaguguca

SEQ ID NO: 1616813 - RNA, 13 nt, Homo sapiens
aaucauaaaggau

SEQ ID NO: 1616814 - RNA, 15 nt, Homo sapiens
aaucauacuuaacau

SEQ ID NO: 1616815 - RNA, 20 nt, Homo sapiens
aaucaugauccuuguguuca

SEQ ID NO: 1616816 - RNA, 15 nt, Homo sapiens
aaucaugcugagaga

SEQ ID NO: 1616817 - RNA, 21 nt, Homo sapiens
aaucauguugaucauguacuu

SEQ ID NO: 1616818 - RNA, 21 nt, Homo sapiens
aaucauuuguuuacauuugau

SEQ ID NO: 1616819 - RNA, 20 nt, Homo sapiens
aaucauuuucauuccuaaag

SEQ ID NO: 1616820 - RNA, 20 nt, Homo sapiens
aauccaguuauuagagaugu

SEQ ID NO: 1616821 - RNA, 18 nt, Homo sapiens
aauccaugggucuggcua

SEQ ID NO: 1616822 - RNA, 13 nt, Homo sapiens
aauccaugguguu

SEQ ID NO: 1616823 - RNA, 17 nt, Homo sapiens
aaucccacccacaugug

SEQ ID NO: 1616824 - RNA, 20 nt, Homo sapiens
aaucccuccccgugacugca

SEQ ID NO: 1616825 - RNA, 19 nt, Homo sapiens
aauccuucuauucuagccu

SEQ ID NO: 1616826 - RNA, 21 nt, Homo sapiens
aaucuaggccaccccaaccuc

SEQ ID NO: 1616827 - RNA, 21 nt, Homo sapiens
aaucuaucgugucaaccccaa

SEQ ID NO: 1616828 - RNA, 18 nt, Homo sapiens
aaucucugaauuugagau

SEQ ID NO: 1616829 - RNA, 12 nt, Homo sapiens
aaucugaguaua

SEQ ID NO: 1616830 - RNA, 16 nt, Homo sapiens
aaucugcaaacaugcc

SEQ ID NO: 1616831 - RNA, 13 nt, Homo sapiens
aaugaaacacagc

SEQ ID NO: 1616832 - RNA, 13 nt, Homo sapiens
aaugaacaucucu

SEQ ID NO: 1616833 - RNA, 14 nt, Homo sapiens
aaugaaccacaaaa

SEQ ID NO: 1616834 - RNA, 20 nt, Homo sapiens
aaugaacccccaugauguaa

SEQ ID NO: 1616835 - RNA, 17 nt, Homo sapiens
aaugaagaucauauacg

SEQ ID NO: 1616836 - RNA, 14 nt, Homo sapiens
aaugacaaguauuu

SEQ ID NO: 1616837 - RNA, 18 nt, Homo sapiens
aaugaguuuaaugccaua

SEQ ID NO: 1616838 - RNA, 15 nt, Homo sapiens
aaugauuuuacuuaa

SEQ ID NO: 1616839 - RNA, 18 nt, Homo sapiens
aaugcaaauacccaccag

SEQ ID NO: 1616840 - RNA, 21 nt, Homo sapiens
aaugcaagccaucucuaauaa

SEQ ID NO: 1616841 - RNA, 18 nt, Homo sapiens
aaugcacguuucaaagcu

SEQ ID NO: 1616842 - RNA, 15 nt, Homo sapiens
aaugccagucucauu

SEQ ID NO: 1616843 - RNA, 18 nt, Homo sapiens
aaugcuaagaaugcauua

SEQ ID NO: 1616844 - RNA, 17 nt, Homo sapiens
aaugcugauaugaucuu

SEQ ID NO: 1616845 - RNA, 17 nt, Homo sapiens
aaugcuucauaugagga

SEQ ID NO: 1616846 - RNA, 17 nt, Homo sapiens
aaugcuucauuauucaa

SEQ ID NO: 1616847 - RNA, 18 nt, Homo sapiens
aauggagccaugacaaga

SEQ ID NO: 1616848 - RNA, 16 nt, Homo sapiens
aauggccggcuggaaa

SEQ ID NO: 1616849 - RNA, 13 nt, Homo sapiens
aauggucaaugcu

SEQ ID NO: 1616850 - RNA, 21 nt, Homo sapiens
aauggugaagaacuagcauau

SEQ ID NO: 1616851 - RNA, 14 nt, Homo sapiens
aauguaagcauacu

SEQ ID NO: 1616852 - RNA, 18 nt, Homo sapiens
aauguauuuugacacugg

SEQ ID NO: 1616853 - RNA, 19 nt, Homo sapiens
aaugugacccccaaguccu

SEQ ID NO: 1616854 - RNA, 19 nt, Homo sapiens
aauguguacagugaacaaa

SEQ ID NO: 1616855 - RNA, 19 nt, Homo sapiens
aauguguauuuuauaugau

SEQ ID NO: 1616856 - RNA, 20 nt, Homo sapiens
aauguguguagauacuuccu

SEQ ID NO: 1616857 - RNA, 18 nt, Homo sapiens
aauguguuucaaaaccau

SEQ ID NO: 1616858 - RNA, 19 nt, Homo sapiens
aauguguuucaaaaccaug

SEQ ID NO: 1616859 - RNA, 20 nt, Homo sapiens
aauguguuuuaucacuucau

SEQ ID NO: 1616860 - RNA, 16 nt, Homo sapiens
aauguuaacuacauau

SEQ ID NO: 1616861 - RNA, 16 nt, Homo sapiens
aauguuguacuugaaa

SEQ ID NO: 1616862 - RNA, 19 nt, Homo sapiens
aauguuuaauaaagcuuua

SEQ ID NO: 1616863 - RNA, 16 nt, Homo sapiens
aauuaaaaaagcauac

SEQ ID NO: 1616864 - RNA, 15 nt, Homo sapiens
aauuaaccuuacuaa

SEQ ID NO: 1616865 - RNA, 19 nt, Homo sapiens
aauuacauuucacuucaag

SEQ ID NO: 1616866 - RNA, 14 nt, Homo sapiens
aauuaccaguuuuc

SEQ ID NO: 1616867 - RNA, 17 nt, Homo sapiens
aauucaguuauuugcac

SEQ ID NO: 1616868 - RNA, 13 nt, Homo sapiens
aauucauauucuu

SEQ ID NO: 1616869 - RNA, 21 nt, Homo sapiens
aauuccuuauccuagccuuug

SEQ ID NO: 1616870 - RNA, 23 nt, Homo sapiens
aauucuaacccagguauccaaaa

SEQ ID NO: 1616871 - RNA, 14 nt, Homo sapiens
aauucuagccaaaa

SEQ ID NO: 1616872 - RNA, 14 nt, Homo sapiens
aauucucuuucaaa

SEQ ID NO: 1616873 - RNA, 21 nt, Homo sapiens
aauucuuacccuguacauaug

SEQ ID NO: 1616874 - RNA, 20 nt, Homo sapiens
aauugaagaaagucagcucu

SEQ ID NO: 1616875 - RNA, 13 nt, Homo sapiens
aauugacagauca

SEQ ID NO: 1616876 - RNA, 22 nt, Homo sapiens
aauugguaaaacucacugugau

SEQ ID NO: 1616877 - RNA, 21 nt, Homo sapiens
aauuuauaccucaaacuaucu

SEQ ID NO: 1616878 - RNA, 14 nt, Homo sapiens
aauuuauccauuca

SEQ ID NO: 1616879 - RNA, 22 nt, Homo sapiens
aaaugugaagggucaacuccaa

SEQ ID NO: 1616880 - RNA, 18 nt, Homo sapiens
aaaugugguugcuuaauu

SEQ ID NO: 1616881 - RNA, 15 nt, Homo sapiens
aaauuaacacaaagg

SEQ ID NO: 1616882 - RNA, 22 nt, Homo sapiens
aaauuauuugaaaacauauaaa

SEQ ID NO: 1616883 - RNA, 11 nt, Homo sapiens
aaauuccccaa

SEQ ID NO: 1616884 - RNA, 15 nt, Homo sapiens
aaauugacagaucaa

SEQ ID NO: 1616885 - RNA, 17 nt, Homo sapiens
aaauugcuuacugauau

SEQ ID NO: 1616886 - RNA, 18 nt, Homo sapiens
aaauugggaaaacuccau

SEQ ID NO: 1616887 - RNA, 17 nt, Homo sapiens
aaauugugauguggcua

SEQ ID NO: 1616888 - RNA, 12 nt, Homo sapiens
aaauuuacuuuu

SEQ ID NO: 1616889 - RNA, 16 nt, Homo sapiens
aaauuucauugcacuu

SEQ ID NO: 1616890 - RNA, 17 nt, Homo sapiens
aaauuucauugcacuuu

SEQ ID NO: 1616891 - RNA, 15 nt, Homo sapiens
aaauuugaaugacaa

SEQ ID NO: 1616892 - RNA, 20 nt, Homo sapiens
aaauuuuuaaaacacagaaa

SEQ ID NO: 1616893 - RNA, 19 nt, Homo sapiens
aaauuuuucuuuucuugau

SEQ ID NO: 1616894 - RNA, 22 nt, Homo sapiens
aacaaauaaauaagaucagacu

SEQ ID NO: 1616895 - RNA, 12 nt, Homo sapiens
aacaagcugugc

SEQ ID NO: 1616896 - RNA, 21 nt, Homo sapiens
aacaauucuuauugacucaua

SEQ ID NO: 1616897 - RNA, 13 nt, Homo sapiens
aacaauugguaaa

SEQ ID NO: 1616898 - RNA, 23 nt, Homo sapiens
aacaauuuggucuuagcuuuaca

SEQ ID NO: 1616899 - RNA, 19 nt, Homo sapiens
aacacagaaacuauaugca

SEQ ID NO: 1616900 - RNA, 14 nt, Homo sapiens
aacaccaagcacag

SEQ ID NO: 1616901 - RNA, 15 nt, Homo sapiens
aacaccaagcacagc

SEQ ID NO: 1616902 - RNA, 19 nt, Homo sapiens
aacaccacuuaaucuucuc

SEQ ID NO: 1616903 - RNA, 14 nt, Homo sapiens
aacacggugcucau

SEQ ID NO: 1616904 - RNA, 17 nt, Homo sapiens
aacacucagaagccugg

SEQ ID NO: 1616905 - RNA, 22 nt, Homo sapiens
aacacugugauuuaucuuucaa

SEQ ID NO: 1616906 - RNA, 18 nt, Homo sapiens
aacagaaaacaucccacu

SEQ ID NO: 1616907 - RNA, 16 nt, Homo sapiens
aacagaaccacaaaaa

SEQ ID NO: 1616908 - RNA, 16 nt, Homo sapiens
aacagagggaguuuaa

SEQ ID NO: 1616909 - RNA, 22 nt, Homo sapiens
aacagagggaguuuaauacagg

SEQ ID NO: 1616910 - RNA, 17 nt, Homo sapiens
aacagccacuacauuac

SEQ ID NO: 1616911 - RNA, 18 nt, Homo sapiens
aacagcccucagacuguc

SEQ ID NO: 1616912 - RNA, 14 nt, Homo sapiens
aacauauggcuuua

SEQ ID NO: 1616913 - RNA, 12 nt, Homo sapiens
aacaucaccagu

SEQ ID NO: 1616914 - RNA, 13 nt, Homo sapiens
aacaugaauuuca

SEQ ID NO: 1616915 - RNA, 18 nt, Homo sapiens
aacaugacauccagagau

SEQ ID NO: 1616916 - RNA, 23 nt, Homo sapiens
aacaugacauccagagaugacua

SEQ ID NO: 1616917 - RNA, 12 nt, Homo sapiens
aacauguauaaa

SEQ ID NO: 1616918 - RNA, 17 nt, Homo sapiens
aacauucagucugacaa

SEQ ID NO: 1616919 - RNA, 15 nt, Homo sapiens
aacauuucauuguac

SEQ ID NO: 1616920 - RNA, 17 nt, Homo sapiens
aaccaaacuuguucauu

SEQ ID NO: 1616921 - RNA, 14 nt, Homo sapiens
aaccacaaaccuag

SEQ ID NO: 1616922 - RNA, 12 nt, Homo sapiens
aaccacugcacu

SEQ ID NO: 1616923 - RNA, 16 nt, Homo sapiens
aaccauccacuuacau

SEQ ID NO: 1616924 - RNA, 16 nt, Homo sapiens
aaccaugguaacaaua

SEQ ID NO: 1616925 - RNA, 14 nt, Homo sapiens
aaccaugguaugaa

SEQ ID NO: 1616926 - RNA, 12 nt, Homo sapiens
aaccccagugga

SEQ ID NO: 1616927 - RNA, 15 nt, Homo sapiens
aaccccuccacugcu

SEQ ID NO: 1616928 - RNA, 13 nt, Homo sapiens
aacccuaccuguc

SEQ ID NO: 1616929 - RNA, 23 nt, Homo sapiens
aacccugacuccucuuugugcag

SEQ ID NO: 1616930 - RNA, 18 nt, Homo sapiens
aaccuaguacgacuucau

SEQ ID NO: 1616931 - RNA, 20 nt, Homo sapiens
aaccuccgccucccagguuc

SEQ ID NO: 1616932 - RNA, 16 nt, Homo sapiens
aaccucuacauauuua

SEQ ID NO: 1616933 - RNA, 16 nt, Homo sapiens
aaccucuucaugagcu

SEQ ID NO: 1616934 - RNA, 15 nt, Homo sapiens
aaccugaauggucug

SEQ ID NO: 1616935 - RNA, 19 nt, Homo sapiens
aaccuggaauggagacuuu

SEQ ID NO: 1616936 - RNA, 15 nt, Homo sapiens
aaccuggacccagau

SEQ ID NO: 1616937 - RNA, 21 nt, Homo sapiens
aaccuuaaagaaccaucagca

SEQ ID NO: 1616938 - RNA, 12 nt, Homo sapiens
aacgcacaaaac

SEQ ID NO: 1616939 - RNA, 22 nt, Homo sapiens
aacguaugugguuaucugugaa

SEQ ID NO: 1616940 - RNA, 12 nt, Homo sapiens
aacguccacaaa

SEQ ID NO: 1616941 - RNA, 14 nt, Homo sapiens
aacguggcacuggu

SEQ ID NO: 1616942 - RNA, 24 nt, Homo sapiens
aacuaaugauaaaguaaugaucuc

SEQ ID NO: 1616943 - RNA, 22 nt, Homo sapiens
aacuacccagguauuacacaag

SEQ ID NO: 1616944 - RNA, 12 nt, Homo sapiens
aacuacuauuca

SEQ ID NO: 1616945 - RNA, 16 nt, Homo sapiens
aacucacaagugcuca

SEQ ID NO: 1616946 - RNA, 18 nt, Homo sapiens
aacucacaagugcucauc

SEQ ID NO: 1616947 - RNA, 15 nt, Homo sapiens
aacucacucugggcu

SEQ ID NO: 1616948 - RNA, 19 nt, Homo sapiens
aacuccuuccauccuugac

SEQ ID NO: 1616949 - RNA, 21 nt, Homo sapiens
aacucucaccaugaugugaag

SEQ ID NO: 1616950 - RNA, 22 nt, Homo sapiens
aacucucaccaugaugugaaga

SEQ ID NO: 1616951 - RNA, 20 nt, Homo sapiens
aacucugucuucaccugauu

SEQ ID NO: 1616952 - RNA, 22 nt, Homo sapiens
aacucugucuucaccugauuca

SEQ ID NO: 1616953 - RNA, 18 nt, Homo sapiens
aacugaacagaaccacaa

SEQ ID NO: 1616954 - RNA, 22 nt, Homo sapiens
aacugccacauacaccacaaaa

SEQ ID NO: 1616955 - RNA, 17 nt, Homo sapiens
aacuggaagccuucccc

SEQ ID NO: 1616956 - RNA, 23 nt, Homo sapiens
aacuguaccaugugcuacagggg

SEQ ID NO: 1616957 - RNA, 10 nt, Homo sapiens
aacugugaac

SEQ ID NO: 1616958 - RNA, 14 nt, Homo sapiens
guuaauauggugua

SEQ ID NO: 1616959 - RNA, 17 nt, Homo sapiens
guuacagauuaucacau

SEQ ID NO: 1616960 - RNA, 13 nt, Homo sapiens
guuaccacuacuu

SEQ ID NO: 1616961 - RNA, 18 nt, Homo sapiens
guuacccugcauguuggc

SEQ ID NO: 1616962 - RNA, 17 nt, Homo sapiens
guuaccucugcauggaa

SEQ ID NO: 1616963 - RNA, 20 nt, Homo sapiens
aacaaauguggcuccaagcu

SEQ ID NO: 1616964 - RNA, 18 nt, Homo sapiens
aacaaauuucauugcacu

SEQ ID NO: 1616965 - RNA, 19 nt, Homo sapiens
aacaaauuucauugcacuu

SEQ ID NO: 1616966 - RNA, 19 nt, Homo sapiens
aacaacaauaacacugucu

SEQ ID NO: 1616967 - RNA, 20 nt, Homo sapiens
aacaacguugacaaguuuug

SEQ ID NO: 1616968 - RNA, 13 nt, Homo sapiens
aacaacuaccuga

SEQ ID NO: 1616969 - RNA, 13 nt, Homo sapiens
aacaaguacuucu

SEQ ID NO: 1616970 - RNA, 22 nt, Homo sapiens
aacaaguauauaauuuacuuug

SEQ ID NO: 1616971 - RNA, 18 nt, Homo sapiens
aacaaguuagaaaauuca

SEQ ID NO: 1616972 - RNA, 22 nt, Homo sapiens
aacaauaguucuuagcuuugaa

SEQ ID NO: 1616973 - RNA, 16 nt, Homo sapiens
aacaauuacuggcuca

SEQ ID NO: 1616974 - RNA, 16 nt, Homo sapiens
aacacaaaacuugaaa

SEQ ID NO: 1616975 - RNA, 18 nt, Homo sapiens
aacacagacaaagugcua

SEQ ID NO: 1616976 - RNA, 23 nt, Homo sapiens
aacacagcuuacaaucgcaaauc

SEQ ID NO: 1616977 - RNA, 13 nt, Homo sapiens
aacaccacuuaau

SEQ ID NO: 1616978 - RNA, 12 nt, Homo sapiens
aacacugggcug

SEQ ID NO: 1616979 - RNA, 13 nt, Homo sapiens
aacagaagccuga

SEQ ID NO: 1616980 - RNA, 23 nt, Homo sapiens
aacagaagccugaugcugacauu

SEQ ID NO: 1616981 - RNA, 22 nt, Homo sapiens
aacagcauuacccuccucucuc

SEQ ID NO: 1616982 - RNA, 20 nt, Homo sapiens
aacagccacuacauuacuuc

SEQ ID NO: 1616983 - RNA, 21 nt, Homo sapiens
aacaggcugauaccuuuguga

SEQ ID NO: 1616984 - RNA, 21 nt, Homo sapiens
aacagggcugccuucuggccu

SEQ ID NO: 1616985 - RNA, 16 nt, Homo sapiens
aacaggguaccucaag

SEQ ID NO: 1616986 - RNA, 14 nt, Homo sapiens
aacaggucacuuga

SEQ ID NO: 1616987 - RNA, 20 nt, Homo sapiens
aacauauaaagcacuauaca

SEQ ID NO: 1616988 - RNA, 12 nt, Homo sapiens
aacauauuucau

SEQ ID NO: 1616989 - RNA, 23 nt, Homo sapiens
aacaucccaucuaagcauuccac

SEQ ID NO: 1616990 - RNA, 16 nt, Homo sapiens
aacaugauacugcugc

SEQ ID NO: 1616991 - RNA, 22 nt, Homo sapiens
aacaugauacugcugcuuguca

SEQ ID NO: 1616992 - RNA, 12 nt, Homo sapiens
aacaugauuuca

SEQ ID NO: 1616993 - RNA, 17 nt, Homo sapiens
aacaugcaccuugcucc

SEQ ID NO: 1616994 - RNA, 16 nt, Homo sapiens
aacaugcauacuuuau

SEQ ID NO: 1616995 - RNA, 22 nt, Homo sapiens
aacauguuccugggaucacuga

SEQ ID NO: 1616996 - RNA, 22 nt, Homo sapiens
aacauuauguggcccucuggau

SEQ ID NO: 1616997 - RNA, 13 nt, Homo sapiens
aacauugugauca

SEQ ID NO: 1616998 - RNA, 14 nt, Homo sapiens
aacauuuaaauucc

SEQ ID NO: 1616999 - RNA, 20 nt, Homo sapiens
aaccacaccuacccagggcu

SEQ ID NO: 1617000 - RNA, 19 nt, Homo sapiens
aaccacucauaauucuuca

SEQ ID NO: 1617001 - RNA, 19 nt, Homo sapiens
aaccagaacccaguguuuc

SEQ ID NO: 1617002 - RNA, 17 nt, Homo sapiens
aaccagggcucuucuca

SEQ ID NO: 1617003 - RNA, 17 nt, Homo sapiens
aaccaguuaaagccaca

SEQ ID NO: 1617004 - RNA, 20 nt, Homo sapiens
aacccaguguuuccacacuu

SEQ ID NO: 1617005 - RNA, 22 nt, Homo sapiens
aacccuggaucaguccuuugau

SEQ ID NO: 1617006 - RNA, 11 nt, Homo sapiens
aaccuacauau

SEQ ID NO: 1617007 - RNA, 14 nt, Homo sapiens
aaccuacauauucc

SEQ ID NO: 1617008 - RNA, 15 nt, Homo sapiens
aaccuacauauucca

SEQ ID NO: 1617009 - RNA, 13 nt, Homo sapiens
aaccucuacauau

SEQ ID NO: 1617010 - RNA, 20 nt, Homo sapiens
aaccucuucaugagcuugaa

SEQ ID NO: 1617011 - RNA, 11 nt, Homo sapiens
aaccuggaccc

SEQ ID NO: 1617012 - RNA, 18 nt, Homo sapiens
aagauggcauccugugaa

SEQ ID NO: 1617013 - RNA, 11 nt, Homo sapiens
aagauuacuuu

SEQ ID NO: 1617014 - RNA, 12 nt, Homo sapiens
aagauuacuuuu

SEQ ID NO: 1617015 - RNA, 12 nt, Homo sapiens
aagauucaugug

SEQ ID NO: 1617016 - RNA, 22 nt, Homo sapiens
aagauucucuauuggcucccuu

SEQ ID NO: 1617017 - RNA, 21 nt, Homo sapiens
aagauuguuggugaauuuuca

SEQ ID NO: 1617018 - RNA, 22 nt, Homo sapiens
aagauuugaugggccacaacug

SEQ ID NO: 1617019 - RNA, 16 nt, Homo sapiens
aagauuuuccucuugu

SEQ ID NO: 1617020 - RNA, 17 nt, Homo sapiens
aagauuuuccucuugug

SEQ ID NO: 1617021 - RNA, 21 nt, Homo sapiens
aagcaaugggucacucauuaa

SEQ ID NO: 1617022 - RNA, 19 nt, Homo sapiens
aagcaauucuccugccuua

SEQ ID NO: 1617023 - RNA, 17 nt, Homo sapiens
aagcacaccuacagagc

SEQ ID NO: 1617024 - RNA, 18 nt, Homo sapiens
aagcaggacugugccucc

SEQ ID NO: 1617025 - RNA, 13 nt, Homo sapiens
aagcaugugaugu

SEQ ID NO: 1617026 - RNA, 21 nt, Homo sapiens
aagcauuauccuuuuaucuca

SEQ ID NO: 1617027 - RNA, 17 nt, Homo sapiens
aagccagccagaggcau

SEQ ID NO: 1617028 - RNA, 18 nt, Homo sapiens
aagcccugugcuccaugg

SEQ ID NO: 1617029 - RNA, 21 nt, Homo sapiens
aagccgaccuucccuccgccu

SEQ ID NO: 1617030 - RNA, 16 nt, Homo sapiens
aagccuaucaaaggaa

SEQ ID NO: 1617031 - RNA, 20 nt, Homo sapiens
aagccugaugcugacauuca

SEQ ID NO: 1617032 - RNA, 19 nt, Homo sapiens
aagcucuucccuugcucau

SEQ ID NO: 1617033 - RNA, 20 nt, Homo sapiens
aagcugcuccaggccugcag

SEQ ID NO: 1617034 - RNA, 21 nt, Homo sapiens
aagcugugagacagugggaaa

SEQ ID NO: 1617035 - RNA, 14 nt, Homo sapiens
aagcuugucaaaga

SEQ ID NO: 1617036 - RNA, 10 nt, Homo sapiens
aagcuuuauu

SEQ ID NO: 1617037 - RNA, 16 nt, Homo sapiens
aaggaacucuacuuca

SEQ ID NO: 1617038 - RNA, 14 nt, Homo sapiens
aaggacucuuccac

SEQ ID NO: 1617039 - RNA, 17 nt, Homo sapiens
aaggacuuaaggacagc

SEQ ID NO: 1617040 - RNA, 17 nt, Homo sapiens
aaggagaaggagugcca

SEQ ID NO: 1617041 - RNA, 19 nt, Homo sapiens
aaggagggagcuacucuca

SEQ ID NO: 1617042 - RNA, 23 nt, Homo sapiens
aaggaugcugucaagcaccugca

SEQ ID NO: 1617043 - RNA, 15 nt, Homo sapiens
aaggcagccaggcug

SEQ ID NO: 1617044 - RNA, 16 nt, Homo sapiens
aaggcaggcagggcuc

SEQ ID NO: 1617045 - RNA, 12 nt, Homo sapiens
aaggcuucucuc

SEQ ID NO: 1617046 - RNA, 14 nt, Homo sapiens
aagggacacuuuua

SEQ ID NO: 1617047 - RNA, 22 nt, Homo sapiens
aagggagagaacaaaagcuaua

SEQ ID NO: 1617048 - RNA, 15 nt, Homo sapiens
aaggggcaggccaga

SEQ ID NO: 1617049 - RNA, 17 nt, Homo sapiens
aagggguuggggugaca

SEQ ID NO: 1617050 - RNA, 13 nt, Homo sapiens
aagguaaauccca

SEQ ID NO: 1617051 - RNA, 18 nt, Homo sapiens
aagguccucugucaguca

SEQ ID NO: 1617052 - RNA, 14 nt, Homo sapiens
aagguucagcugaa

SEQ ID NO: 1617053 - RNA, 14 nt, Homo sapiens
aaguaauaucuuuc

SEQ ID NO: 1617054 - RNA, 15 nt, Homo sapiens
aaguaauaucuuuca

SEQ ID NO: 1617055 - RNA, 11 nt, Homo sapiens
aaguacauauu

SEQ ID NO: 1617056 - RNA, 22 nt, Homo sapiens
aaguagucucuccccuggccac

SEQ ID NO: 1617057 - RNA, 14 nt, Homo sapiens
aaguauuacaacca

SEQ ID NO: 1617058 - RNA, 12 nt, Homo sapiens
aagucacaucca

SEQ ID NO: 1617059 - RNA, 21 nt, Homo sapiens
aagucacccagggacacucca

SEQ ID NO: 1617060 - RNA, 20 nt, Homo sapiens
aagucccuuugugacuucaa

SEQ ID NO: 1617061 - RNA, 22 nt, Homo sapiens
aaguccuagccccucacuucca

SEQ ID NO: 1617062 - RNA, 21 nt, Homo sapiens
aaguccucuggauugagauac

SEQ ID NO: 1617063 - RNA, 16 nt, Homo sapiens
aaguccuucaccucac

SEQ ID NO: 1617064 - RNA, 19 nt, Homo sapiens
aaguccuucaccucacuga

SEQ ID NO: 1617065 - RNA, 14 nt, Homo sapiens
ugauuuuacuuaac

SEQ ID NO: 1617066 - RNA, 15 nt, Homo sapiens
ugauuuuuaauaguu

SEQ ID NO: 1617067 - RNA, 21 nt, Homo sapiens
ugcaaaccacuucuccaugcu

SEQ ID NO: 1617068 - RNA, 12 nt, Homo sapiens
ugcaaagccagu

SEQ ID NO: 1617069 - RNA, 14 nt, Homo sapiens
ugcaaauacaauca

SEQ ID NO: 1617070 - RNA, 19 nt, Homo sapiens
ugcaaauacaaucagccca

SEQ ID NO: 1617071 - RNA, 23 nt, Homo sapiens
ugcaaauacaaucagcccagugc

SEQ ID NO: 1617072 - RNA, 18 nt, Homo sapiens
ugcaaaucaaacauauuc

SEQ ID NO: 1617073 - RNA, 19 nt, Homo sapiens
ugcaaaucaaacauauucu

SEQ ID NO: 1617074 - RNA, 19 nt, Homo sapiens
ugcaaauccuaugugauuu

SEQ ID NO: 1617075 - RNA, 14 nt, Homo sapiens
ugcaacuucugccu

SEQ ID NO: 1617076 - RNA, 14 nt, Homo sapiens
ugcaagccaucucu

SEQ ID NO: 1617077 - RNA, 13 nt, Homo sapiens
ugcaaugugcuac

SEQ ID NO: 1617078 - RNA, 22 nt, Homo sapiens
ugcacauauggacucugcacau

SEQ ID NO: 1617079 - RNA, 13 nt, Homo sapiens
ugcacaugaaucc

SEQ ID NO: 1617080 - RNA, 23 nt, Homo sapiens
ugcacaugucuuguacaugugua

SEQ ID NO: 1617081 - RNA, 19 nt, Homo sapiens
ugcaccccucugcccucau

SEQ ID NO: 1617082 - RNA, 23 nt, Homo sapiens
ugcaccuuacaacucggggacaa

SEQ ID NO: 1617083 - RNA, 20 nt, Homo sapiens
ugcacucuagccugggugac

SEQ ID NO: 1617084 - RNA, 22 nt, Homo sapiens
ugcacuuagccaugauggcaac

SEQ ID NO: 1617085 - RNA, 16 nt, Homo sapiens
ugcagaaguacuccua

SEQ ID NO: 1617086 - RNA, 21 nt, Homo sapiens
ugcagaggggcccaugaaaga

SEQ ID NO: 1617087 - RNA, 13 nt, Homo sapiens
ugcagcagagccu

SEQ ID NO: 1617088 - RNA, 13 nt, Homo sapiens
ugcagcccaagga

SEQ ID NO: 1617089 - RNA, 20 nt, Homo sapiens
ugcagcucuucaacaugaca

SEQ ID NO: 1617090 - RNA, 18 nt, Homo sapiens
ugcaggaucccuacugcc

SEQ ID NO: 1617091 - RNA, 20 nt, Homo sapiens
ugcaggaucccuacugccaa

SEQ ID NO: 1617092 - RNA, 13 nt, Homo sapiens
ugcagguauuuca

SEQ ID NO: 1617093 - RNA, 15 nt, Homo sapiens
ugcagucugggugcu

SEQ ID NO: 1617094 - RNA, 17 nt, Homo sapiens
ugcaguggcgugaucuc

SEQ ID NO: 1617095 - RNA, 17 nt, Homo sapiens
ugcauaauaaaugcuuc

SEQ ID NO: 1617096 - RNA, 17 nt, Homo sapiens
ugcauagcaagugaaag

SEQ ID NO: 1617097 - RNA, 20 nt, Homo sapiens
ugcauccagcagcagcacuu

SEQ ID NO: 1617098 - RNA, 16 nt, Homo sapiens
ugcaugauacuaucug

SEQ ID NO: 1617099 - RNA, 15 nt, Homo sapiens
ugcaugugacucuga

SEQ ID NO: 1617100 - RNA, 19 nt, Homo sapiens
ugcauguuggcccagaccu

SEQ ID NO: 1617101 - RNA, 14 nt, Homo sapiens
ugcauuauaucaaa

SEQ ID NO: 1617102 - RNA, 18 nt, Homo sapiens
ugcauugagguuuccaca

SEQ ID NO: 1617103 - RNA, 15 nt, Homo sapiens
ugcauuuagcuucuu

SEQ ID NO: 1617104 - RNA, 21 nt, Homo sapiens
ugcauuuauuuaagacacugu

SEQ ID NO: 1617105 - RNA, 16 nt, Homo sapiens
ugccaaaaacaaaaaa

SEQ ID NO: 1617106 - RNA, 15 nt, Homo sapiens
ugccaacuauucuca

SEQ ID NO: 1617107 - RNA, 22 nt, Homo sapiens
ugccaagagggucugauggcac

SEQ ID NO: 1617108 - RNA, 17 nt, Homo sapiens
ugccaccuccuggaagg

SEQ ID NO: 1617109 - RNA, 17 nt, Homo sapiens
ugccaccuuuauggacu

SEQ ID NO: 1617110 - RNA, 19 nt, Homo sapiens
ugccacuaacuucuaaaga

SEQ ID NO: 1617111 - RNA, 12 nt, Homo sapiens
ugccacugcacu

SEQ ID NO: 1617112 - RNA, 14 nt, Homo sapiens
ugccaggcacuuug

SEQ ID NO: 1617113 - RNA, 20 nt, Homo sapiens
ugccagugcuaaacuacuga

SEQ ID NO: 1617114 - RNA, 14 nt, Homo sapiens
ugccauagaacaag

SEQ ID NO: 1617115 - RNA, 22 nt, Homo sapiens
ugccccagauuuacuaaaucaa

SEQ ID NO: 1617116 - RNA, 20 nt, Homo sapiens
ugccccucucugggccucag

SEQ ID NO: 1617117 - RNA, 20 nt, Homo sapiens
ugcccuucagcauccucagu

SEQ ID NO: 1617118 - RNA, 17 nt, Homo sapiens
ugcccuuccuccugccu

SEQ ID NO: 1617119 - RNA, 15 nt, Homo sapiens
ugccgcaccauugaa

SEQ ID NO: 1617120 - RNA, 15 nt, Homo sapiens
ugccuagaggugcuc

SEQ ID NO: 1617121 - RNA, 14 nt, Homo sapiens
ugccucacaucucc

SEQ ID NO: 1617122 - RNA, 20 nt, Homo sapiens
ugccucacaucucccuucca

SEQ ID NO: 1617123 - RNA, 22 nt, Homo sapiens
ugccucaggccucugugccgca

SEQ ID NO: 1617124 - RNA, 12 nt, Homo sapiens
ugccuccaucuu

SEQ ID NO: 1617125 - RNA, 23 nt, Homo sapiens
ugccucugaggccagccuggccu

SEQ ID NO: 1617126 - RNA, 14 nt, Homo sapiens
ugccucugucucac

SEQ ID NO: 1617127 - RNA, 14 nt, Homo sapiens
ugccugagggucac

SEQ ID NO: 1617128 - RNA, 20 nt, Homo sapiens
ugccugggggcuuuugccac

SEQ ID NO: 1617129 - RNA, 15 nt, Homo sapiens
ugccuguacuacucu

SEQ ID NO: 1617130 - RNA, 18 nt, Homo sapiens
ugccuguguacugccuua

SEQ ID NO: 1617131 - RNA, 15 nt, Homo sapiens
ugccuuaaaauggaa

SEQ ID NO: 1617132 - RNA, 14 nt, Homo sapiens
ugccuuauugcugu

SEQ ID NO: 1617133 - RNA, 14 nt, Homo sapiens
ugccuucugaaaug

SEQ ID NO: 1617134 - RNA, 14 nt, Homo sapiens
ugccuucuggccuu

SEQ ID NO: 1617135 - RNA, 16 nt, Homo sapiens
ugccuucuuauugcuu

SEQ ID NO: 1617136 - RNA, 18 nt, Homo sapiens
ugccuuggggaggacaaa

SEQ ID NO: 1617137 - RNA, 16 nt, Homo sapiens
ugccuuuaagccaaag

SEQ ID NO: 1617138 - RNA, 18 nt, Homo sapiens
ugccuuuuucauuuucca

SEQ ID NO: 1617139 - RNA, 23 nt, Homo sapiens
ugccuuuuuuuuaaggagcaaaa

SEQ ID NO: 1617140 - RNA, 21 nt, Homo sapiens
ugcgagacgcacacagcugag

SEQ ID NO: 1617141 - RNA, 16 nt, Homo sapiens
ugcgccaaucccgcca

SEQ ID NO: 1617142 - RNA, 13 nt, Homo sapiens
ugcggagcaagag

SEQ ID NO: 1617143 - RNA, 21 nt, Homo sapiens
ugcgugcgcgcgcuucuggga

SEQ ID NO: 1617144 - RNA, 16 nt, Homo sapiens
ugcguggacucugcac

SEQ ID NO: 1617145 - RNA, 17 nt, Homo sapiens
ugcguguguacaugugc

SEQ ID NO: 1617146 - RNA, 18 nt, Homo sapiens
ugcuaacaaagacaaaag

SEQ ID NO: 1617147 - RNA, 12 nt, Homo sapiens
ugcuaacaaugc

SEQ ID NO: 1617148 - RNA, 22 nt, Homo sapiens
ugcuaaugcaaauuaaaacaua

SEQ ID NO: 1617149 - RNA, 17 nt, Homo sapiens
ugcuacaggggccagaa

SEQ ID NO: 1617150 - RNA, 20 nt, Homo sapiens
ugcuauaacuaugaccaugc

SEQ ID NO: 1617151 - RNA, 20 nt, Homo sapiens
ugcuauucuagagcuuuuau

SEQ ID NO: 1617152 - RNA, 22 nt, Homo sapiens
ugcucagugggggcagagccac

SEQ ID NO: 1617153 - RNA, 16 nt, Homo sapiens
ugcucauugaacuuua

SEQ ID NO: 1617154 - RNA, 14 nt, Homo sapiens
ugcucccacagaac

SEQ ID NO: 1617155 - RNA, 16 nt, Homo sapiens
ugcuccccuacuucuc

SEQ ID NO: 1617156 - RNA, 21 nt, Homo sapiens
ugcuccuugauaaaguauuau

SEQ ID NO: 1617157 - RNA, 15 nt, Homo sapiens
ugcucuaagcccagg

SEQ ID NO: 1617158 - RNA, 17 nt, Homo sapiens
ugcugaaaaaucaucca

SEQ ID NO: 1617159 - RNA, 18 nt, Homo sapiens
ugcugaccagacagccuc

SEQ ID NO: 1617160 - RNA, 22 nt, Homo sapiens
ugcugaggagaguggaacagaa

SEQ ID NO: 1617161 - RNA, 23 nt, Homo sapiens
ugcugcuucuccaagcuuucaga

SEQ ID NO: 1617162 - RNA, 21 nt, Homo sapiens
ugcuguagaagauggcacuua

SEQ ID NO: 1617163 - RNA, 18 nt, Homo sapiens
ugcugucccaaacaugca

SEQ ID NO: 1617164 - RNA, 17 nt, Homo sapiens
ugcuuagagacuaucaa

SEQ ID NO: 1617165 - RNA, 13 nt, Homo sapiens
ugcuucaucugcu

SEQ ID NO: 1617166 - RNA, 22 nt, Homo sapiens
ugcuucccagguucaagcgauu

SEQ ID NO: 1617167 - RNA, 18 nt, Homo sapiens
ugcuucucuagcucucua

SEQ ID NO: 1617168 - RNA, 13 nt, Homo sapiens
ugcuucuguagaa

SEQ ID NO: 1617169 - RNA, 14 nt, Homo sapiens
ugcuugaacccaag

SEQ ID NO: 1617170 - RNA, 18 nt, Homo sapiens
ugcuugcucccaagcccc

SEQ ID NO: 1617171 - RNA, 18 nt, Homo sapiens
ugcuuggaagccagguac

SEQ ID NO: 1617172 - RNA, 17 nt, Homo sapiens
ugcuugggacauugcaa

SEQ ID NO: 1617173 - RNA, 22 nt, Homo sapiens
ugcuugggacauugcaauuugc

SEQ ID NO: 1617174 - RNA, 17 nt, Homo sapiens
ugcuugggcugacccag

SEQ ID NO: 1617175 - RNA, 18 nt, Homo sapiens
ucuauucuagccugcauu

SEQ ID NO: 1617176 - RNA, 13 nt, Homo sapiens
ucucaaacuauga

SEQ ID NO: 1617177 - RNA, 23 nt, Homo sapiens
ucucaccccugcuauaacuauga

SEQ ID NO: 1617178 - RNA, 11 nt, Homo sapiens
ucucacugugu

SEQ ID NO: 1617179 - RNA, 14 nt, Homo sapiens
ucucagccacugaa

SEQ ID NO: 1617180 - RNA, 14 nt, Homo sapiens
ucucauaauuccua

SEQ ID NO: 1617181 - RNA, 20 nt, Homo sapiens
ucucauuuccagcuucucag

SEQ ID NO: 1617182 - RNA, 13 nt, Homo sapiens
ucuccaauacuca

SEQ ID NO: 1617183 - RNA, 18 nt, Homo sapiens
ucuccaguuugcaccugu

SEQ ID NO: 1617184 - RNA, 16 nt, Homo sapiens
ucuccauguuggucag

SEQ ID NO: 1617185 - RNA, 16 nt, Homo sapiens
ucucccagcucagggc

SEQ ID NO: 1617186 - RNA, 17 nt, Homo sapiens
ucucccaggccucugcc

SEQ ID NO: 1617187 - RNA, 17 nt, Homo sapiens
ucucccuuccaccucac

SEQ ID NO: 1617188 - RNA, 16 nt, Homo sapiens
ucuccuuacagucacu

SEQ ID NO: 1617189 - RNA, 17 nt, Homo sapiens
ucuccuuacagucacua

SEQ ID NO: 1617190 - RNA, 19 nt, Homo sapiens
ucucgaacuccuaaccuca

SEQ ID NO: 1617191 - RNA, 19 nt, Homo sapiens
ucucgccucauuacuguga

SEQ ID NO: 1617192 - RNA, 14 nt, Homo sapiens
ucucgguuugccaa

SEQ ID NO: 1617193 - RNA, 23 nt, Homo sapiens
ucucuaaccgaauauucauggau

SEQ ID NO: 1617194 - RNA, 19 nt, Homo sapiens
ucucuacucccucuuguca

SEQ ID NO: 1617195 - RNA, 12 nt, Homo sapiens
ucucuacugcuu

SEQ ID NO: 1617196 - RNA, 17 nt, Homo sapiens
ucucuagcuuugucaua

SEQ ID NO: 1617197 - RNA, 14 nt, Homo sapiens
ucucuccagccuga

SEQ ID NO: 1617198 - RNA, 23 nt, Homo sapiens
ucucuccccauccccacccaguc

SEQ ID NO: 1617199 - RNA, 22 nt, Homo sapiens
ucucugaauuuucagagacuuu

SEQ ID NO: 1617200 - RNA, 21 nt, Homo sapiens
ucucugaguccuggcccaaag

SEQ ID NO: 1617201 - RNA, 13 nt, Homo sapiens
ucucuugccauuu

SEQ ID NO: 1617202 - RNA, 19 nt, Homo sapiens
ucucuugccauuuguagcu

SEQ ID NO: 1617203 - RNA, 14 nt, Homo sapiens
ucucuuugugcucu

SEQ ID NO: 1617204 - RNA, 13 nt, Homo sapiens
ucugaagauguca

SEQ ID NO: 1617205 - RNA, 19 nt, Homo sapiens
ucugaaguacuaacacaag

SEQ ID NO: 1617206 - RNA, 17 nt, Homo sapiens
ucugacucuaagaauuc

SEQ ID NO: 1617207 - RNA, 13 nt, Homo sapiens
ucugacuugacaa

SEQ ID NO: 1617208 - RNA, 11 nt, Homo sapiens
ucugaguauaa

SEQ ID NO: 1617209 - RNA, 21 nt, Homo sapiens
ucugagucuauguucaaagac

SEQ ID NO: 1617210 - RNA, 15 nt, Homo sapiens
ucugauauguaucca

SEQ ID NO: 1617211 - RNA, 14 nt, Homo sapiens
ucugauccauccau

SEQ ID NO: 1617212 - RNA, 16 nt, Homo sapiens
ucugcaaccccaggua

SEQ ID NO: 1617213 - RNA, 15 nt, Homo sapiens
ucugcacaugucuug

SEQ ID NO: 1617214 - RNA, 14 nt, Homo sapiens
ucugcaguuuaaca

SEQ ID NO: 1617215 - RNA, 15 nt, Homo sapiens
ucugcaugagcugau

SEQ ID NO: 1617216 - RNA, 22 nt, Homo sapiens
ucugcggaaaaacaaacaugaa

SEQ ID NO: 1617217 - RNA, 22 nt, Homo sapiens
ucugcuaauucgagucauggcu

SEQ ID NO: 1617218 - RNA, 13 nt, Homo sapiens
ucugcuugucaaa

SEQ ID NO: 1617219 - RNA, 19 nt, Homo sapiens
ucugcuuuugaaaucugua

SEQ ID NO: 1617220 - RNA, 12 nt, Homo sapiens
ucuggacacuug

SEQ ID NO: 1617221 - RNA, 23 nt, Homo sapiens
uauguauauauuuuucugauuau

SEQ ID NO: 1617222 - RNA, 19 nt, Homo sapiens
uaugucacuagaauggaua

SEQ ID NO: 1617223 - RNA, 23 nt, Homo sapiens
uaugugacgacugcaaagccagu

SEQ ID NO: 1617224 - RNA, 11 nt, Homo sapiens
uaugugcaaaa

SEQ ID NO: 1617225 - RNA, 17 nt, Homo sapiens
uauguuaaaauucucau

SEQ ID NO: 1617226 - RNA, 18 nt, Homo sapiens
uauuaaagaauaagcugu

SEQ ID NO: 1617227 - RNA, 23 nt, Homo sapiens
uauuaaauugggaaaacuccauc

SEQ ID NO: 1617228 - RNA, 15 nt, Homo sapiens
uauuaacccuaccug

SEQ ID NO: 1617229 - RNA, 20 nt, Homo sapiens
uauuaagguuuucaaccgga

SEQ ID NO: 1617230 - RNA, 12 nt, Homo sapiens
uauuacugaugu

SEQ ID NO: 1617231 - RNA, 15 nt, Homo sapiens
uauuagccaacuguu

SEQ ID NO: 1617232 - RNA, 15 nt, Homo sapiens
uauucaugaguauuc

SEQ ID NO: 1617233 - RNA, 15 nt, Homo sapiens
uauuccuaugcugca

SEQ ID NO: 1617234 - RNA, 20 nt, Homo sapiens
uauucuuuacaaacugaaga

SEQ ID NO: 1617235 - RNA, 19 nt, Homo sapiens
uauugcuguugcuuaucau

SEQ ID NO: 1617236 - RNA, 20 nt, Homo sapiens
uauugugaaucgauucccaa

SEQ ID NO: 1617237 - RNA, 19 nt, Homo sapiens
uauuguuaucuuuaccucc

SEQ ID NO: 1617238 - RNA, 14 nt, Homo sapiens
uauuguugcugaaa

SEQ ID NO: 1617239 - RNA, 19 nt, Homo sapiens
uauuuaauuaaaauauaca

SEQ ID NO: 1617240 - RNA, 20 nt, Homo sapiens
uauuuagauauaacacuaug

SEQ ID NO: 1617241 - RNA, 16 nt, Homo sapiens
uauuuauuuuuugcca

SEQ ID NO: 1617242 - RNA, 16 nt, Homo sapiens
uauuuuaaaggcaaaa

SEQ ID NO: 1617243 - RNA, 22 nt, Homo sapiens
uauuuuagcugcacggcauuac

SEQ ID NO: 1617244 - RNA, 21 nt, Homo sapiens
uauuuuaggcacuguucaaua

SEQ ID NO: 1617245 - RNA, 14 nt, Homo sapiens
uauuuucagugcau

SEQ ID NO: 1617246 - RNA, 18 nt, Homo sapiens
uauuuuuggaagcauaca

SEQ ID NO: 1617247 - RNA, 15 nt, Homo sapiens
ucaaaaauacucuug

SEQ ID NO: 1617248 - RNA, 16 nt, Homo sapiens
ucaaagacugugaaca

SEQ ID NO: 1617249 - RNA, 23 nt, Homo sapiens
ucaaagaggcugaggcuggcaca

SEQ ID NO: 1617250 - RNA, 14 nt, Homo sapiens
ucaaagcauuugca

SEQ ID NO: 1617251 - RNA, 17 nt, Homo sapiens
ucaaagcccacauacug

SEQ ID NO: 1617252 - RNA, 16 nt, Homo sapiens
ucaaaggcacacagca

SEQ ID NO: 1617253 - RNA, 18 nt, Homo sapiens
ucaaaggccagaccugca

SEQ ID NO: 1617254 - RNA, 17 nt, Homo sapiens
ucaaagugucucauucu

SEQ ID NO: 1617255 - RNA, 22 nt, Homo sapiens
ucaaauauauuucaagcuauaa

SEQ ID NO: 1617256 - RNA, 20 nt, Homo sapiens
ucaugagcuugaacaaggac

SEQ ID NO: 1617257 - RNA, 15 nt, Homo sapiens
ucaugcacacagaua

SEQ ID NO: 1617258 - RNA, 15 nt, Homo sapiens
ucaugccacugcacu

SEQ ID NO: 1617259 - RNA, 20 nt, Homo sapiens
ucaugguccgccugccucag

SEQ ID NO: 1617260 - RNA, 17 nt, Homo sapiens
ucaugucauuaugacau

SEQ ID NO: 1617261 - RNA, 23 nt, Homo sapiens
ucaugucuauaaucccagcacuu

SEQ ID NO: 1617262 - RNA, 20 nt, Homo sapiens
ucauuaacucaaauucaaug

SEQ ID NO: 1617263 - RNA, 23 nt, Homo sapiens
ucauuaaugacacuuguccccaa

SEQ ID NO: 1617264 - RNA, 14 nt, Homo sapiens
ucauuaugccacuu

SEQ ID NO: 1617265 - RNA, 17 nt, Homo sapiens
ucauucucauaauuccu

SEQ ID NO: 1617266 - RNA, 13 nt, Homo sapiens
ucauugcacuuuc

SEQ ID NO: 1617267 - RNA, 17 nt, Homo sapiens
ucauuguacaaguauua

SEQ ID NO: 1617268 - RNA, 17 nt, Homo sapiens
ucauuucagauauucca

SEQ ID NO: 1617269 - RNA, 19 nt, Homo sapiens
ucauuuguuuacauuugau

SEQ ID NO: 1617270 - RNA, 15 nt, Homo sapiens
ucauuuuugcacuua

SEQ ID NO: 1617271 - RNA, 22 nt, Homo sapiens
ucauuuuuguaggaagcauuuu

SEQ ID NO: 1617272 - RNA, 18 nt, Homo sapiens
uccaaaaauguguaagaa

SEQ ID NO: 1617273 - RNA, 14 nt, Homo sapiens
uccaaaccuucaca

SEQ ID NO: 1617274 - RNA, 18 nt, Homo sapiens
uccaaacuguucugagaa

SEQ ID NO: 1617275 - RNA, 22 nt, Homo sapiens
uccaaccugagaaauggccaaa

SEQ ID NO: 1617276 - RNA, 21 nt, Homo sapiens
uccaagccuuauuuugaguaa

SEQ ID NO: 1617277 - RNA, 15 nt, Homo sapiens
uccaaugccacagac

SEQ ID NO: 1617278 - RNA, 20 nt, Homo sapiens
uccaauguuagagacuuuuu

SEQ ID NO: 1617279 - RNA, 20 nt, Homo sapiens
uccaauugcucuuucacagg

SEQ ID NO: 1617280 - RNA, 23 nt, Homo sapiens
uccacaucuuuuuccaagcagug

SEQ ID NO: 1617281 - RNA, 14 nt, Homo sapiens
uccaccacaguaaa

SEQ ID NO: 1617282 - RNA, 14 nt, Homo sapiens
uccaccagggccag

SEQ ID NO: 1617283 - RNA, 20 nt, Homo sapiens
uccaccccaucccagacucc

SEQ ID NO: 1617284 - RNA, 22 nt, Homo sapiens
uccaccccuccccaucuggacc

SEQ ID NO: 1617285 - RNA, 12 nt, Homo sapiens
uccaccuguggg

SEQ ID NO: 1617286 - RNA, 18 nt, Homo sapiens
uccacuauuuucaaagaa

SEQ ID NO: 1617287 - RNA, 17 nt, Homo sapiens
uccagaugcagggcagu

SEQ ID NO: 1617288 - RNA, 18 nt, Homo sapiens
uccagcuucucaguuucu

SEQ ID NO: 1617289 - RNA, 16 nt, Homo sapiens
uccaggagagagccag

SEQ ID NO: 1617290 - RNA, 16 nt, Homo sapiens
uccagggcaaggccau

SEQ ID NO: 1617291 - RNA, 19 nt, Homo sapiens
uccagggcccccaucucau

SEQ ID NO: 1617292 - RNA, 16 nt, Homo sapiens
uccaggugauucuguu

SEQ ID NO: 1617293 - RNA, 14 nt, Homo sapiens
uccaguacuaugga

SEQ ID NO: 1617294 - RNA, 22 nt, Homo sapiens
uccaguacuauggagugcucac

SEQ ID NO: 1617295 - RNA, 20 nt, Homo sapiens
uccagugucugucauuucag

SEQ ID NO: 1617296 - RNA, 14 nt, Homo sapiens
uccaguuaaccaag

SEQ ID NO: 1617297 - RNA, 15 nt, Homo sapiens
uccauaaaguacaaa

SEQ ID NO: 1617298 - RNA, 19 nt, Homo sapiens
uccaucccaaccagugcca

SEQ ID NO: 1617299 - RNA, 21 nt, Homo sapiens
ucccaaauccgccaguguuuc

SEQ ID NO: 1617300 - RNA, 19 nt, Homo sapiens
ucccaaaugagccaugaga

SEQ ID NO: 1617301 - RNA, 13 nt, Homo sapiens
ucccaacucccuu

SEQ ID NO: 1617302 - RNA, 20 nt, Homo sapiens
ucccaagagcaucaugccuc

SEQ ID NO: 1617303 - RNA, 13 nt, Homo sapiens
ucccaagcucaga

SEQ ID NO: 1617304 - RNA, 19 nt, Homo sapiens
ucccacccacaugugacac

SEQ ID NO: 1617305 - RNA, 12 nt, Homo sapiens
ucccaccccagg

SEQ ID NO: 1617306 - RNA, 18 nt, Homo sapiens
ucccaccccucauaccua

SEQ ID NO: 1617307 - RNA, 20 nt, Homo sapiens
ucccacucccggccugucau

SEQ ID NO: 1617308 - RNA, 22 nt, Homo sapiens
ucccacuuggaggccuuucauc

SEQ ID NO: 1617309 - RNA, 20 nt, Homo sapiens
ucccagagggauugcuguga

SEQ ID NO: 1617310 - RNA, 21 nt, Homo sapiens
ucccagcacgaguggccaguu

SEQ ID NO: 1617311 - RNA, 13 nt, Homo sapiens
ucccagcucaggg

SEQ ID NO: 1617312 - RNA, 18 nt, Homo sapiens
ucccaggaccccauccuc

SEQ ID NO: 1617313 - RNA, 17 nt, Homo sapiens
ucccaggaggugcagug

SEQ ID NO: 1617314 - RNA, 19 nt, Homo sapiens
ucccaggccccaugaccuc

SEQ ID NO: 1617315 - RNA, 21 nt, Homo sapiens
ucccaggugagaauucaggca

SEQ ID NO: 1617316 - RNA, 21 nt, Homo sapiens
ucccaucccguaagaccaccu

SEQ ID NO: 1617317 - RNA, 20 nt, Homo sapiens
ucccauuuccugagaccaca

SEQ ID NO: 1617318 - RNA, 19 nt, Homo sapiens
uccccaacgaaaagcacau

SEQ ID NO: 1617319 - RNA, 17 nt, Homo sapiens
uccccaagaucugccag

SEQ ID NO: 1617320 - RNA, 17 nt, Homo sapiens
uccccacccagucucau

SEQ ID NO: 1617321 - RNA, 19 nt, Homo sapiens
uccccacccagucucaugu

SEQ ID NO: 1617322 - RNA, 13 nt, Homo sapiens
uccccagagcugu

SEQ ID NO: 1617323 - RNA, 21 nt, Homo sapiens
uccccagcagggucuuuucau

SEQ ID NO: 1617324 - RNA, 20 nt, Homo sapiens
uccccagcucccccaggcag

SEQ ID NO: 1617325 - RNA, 21 nt, Homo sapiens
uccccaguagagaaacauuug

SEQ ID NO: 1617326 - RNA, 19 nt, Homo sapiens
uccccauuagcuuucaauu

SEQ ID NO: 1617327 - RNA, 16 nt, Homo sapiens
gcuggcugguggaaca

SEQ ID NO: 1617328 - RNA, 16 nt, Homo sapiens
gcugucaagcaccugc

SEQ ID NO: 1617329 - RNA, 19 nt, Homo sapiens
gcugucccugcagggccau

SEQ ID NO: 1617330 - RNA, 16 nt, Homo sapiens
gcugugagacaguggg

SEQ ID NO: 1617331 - RNA, 15 nt, Homo sapiens
gcuguuccuguucag

SEQ ID NO: 1617332 - RNA, 13 nt, Homo sapiens
gcuguugcauggg

SEQ ID NO: 1617333 - RNA, 23 nt, Homo sapiens
gcuguuuaaugucugccagguga

SEQ ID NO: 1617334 - RNA, 19 nt, Homo sapiens
gcuuaccuaucuguggaaa

SEQ ID NO: 1617335 - RNA, 18 nt, Homo sapiens
gcuuacuagcacuuugag

SEQ ID NO: 1617336 - RNA, 15 nt, Homo sapiens
gcuuagagacuauca

SEQ ID NO: 1617337 - RNA, 15 nt, Homo sapiens
gcuuaucauuugaaa

SEQ ID NO: 1617338 - RNA, 12 nt, Homo sapiens
gcuuaugauuca

SEQ ID NO: 1617339 - RNA, 15 nt, Homo sapiens
gcuucauuuuacuaa

SEQ ID NO: 1617340 - RNA, 14 nt, Homo sapiens
gcuuccugugacag

SEQ ID NO: 1617341 - RNA, 18 nt, Homo sapiens
gcuucuggaauagaaaca

SEQ ID NO: 1617342 - RNA, 16 nt, Homo sapiens
gcuucuuauccuuaca

SEQ ID NO: 1617343 - RNA, 13 nt, Homo sapiens
gcuugaguuauau

SEQ ID NO: 1617344 - RNA, 17 nt, Homo sapiens
gcuuggaagccagguac

SEQ ID NO: 1617345 - RNA, 16 nt, Homo sapiens
gcuugucaaugugauu

SEQ ID NO: 1617346 - RNA, 16 nt, Homo sapiens
gcuuuaugcaaauaca

SEQ ID NO: 1617347 - RNA, 17 nt, Homo sapiens
uacaggcgccugccaca

SEQ ID NO: 1617348 - RNA, 22 nt, Homo sapiens
uacaggggccagaagaugaaca

SEQ ID NO: 1617349 - RNA, 15 nt, Homo sapiens
uacaguugaauuuua

SEQ ID NO: 1617350 - RNA, 20 nt, Homo sapiens
uacaguuuuuauugcuuguu

SEQ ID NO: 1617351 - RNA, 14 nt, Homo sapiens
uacauaaucuguac

SEQ ID NO: 1617352 - RNA, 16 nt, Homo sapiens
uacauccaaagcagac

SEQ ID NO: 1617353 - RNA, 20 nt, Homo sapiens
uacauccagucacuuugcca

SEQ ID NO: 1617354 - RNA, 14 nt, Homo sapiens
uacauccucugaua

SEQ ID NO: 1617355 - RNA, 15 nt, Homo sapiens
uacaugcaacagaag

SEQ ID NO: 1617356 - RNA, 16 nt, Homo sapiens
uacauguaauuugaug

SEQ ID NO: 1617357 - RNA, 18 nt, Homo sapiens
uacauucuuccugauuau

SEQ ID NO: 1617358 - RNA, 14 nt, Homo sapiens
uacauuucucauac

SEQ ID NO: 1617359 - RNA, 22 nt, Homo sapiens
uacauuugaugcaugucuuuua

SEQ ID NO: 1617360 - RNA, 17 nt, Homo sapiens
uaccaaccugaagacac

SEQ ID NO: 1617361 - RNA, 14 nt, Homo sapiens
uaccaguacuugag

SEQ ID NO: 1617362 - RNA, 22 nt, Homo sapiens
uaccaguauaagcaucugccau

SEQ ID NO: 1617363 - RNA, 18 nt, Homo sapiens
uaccaguuuuccagaaca

SEQ ID NO: 1617364 - RNA, 21 nt, Homo sapiens
uaccauacauuuaaaguuuug

SEQ ID NO: 1617365 - RNA, 12 nt, Homo sapiens
uaccaugcugaa

SEQ ID NO: 1617366 - RNA, 18 nt, Homo sapiens
uaccaugugcuacagggg

SEQ ID NO: 1617367 - RNA, 17 nt, Homo sapiens
uacccaguuacuuauga

SEQ ID NO: 1617368 - RNA, 23 nt, Homo sapiens
uacccauagaaaacuugacaugu

SEQ ID NO: 1617369 - RNA, 15 nt, Homo sapiens
uacccaugcuuuguu

SEQ ID NO: 1617370 - RNA, 22 nt, Homo sapiens
uacccaugcuuuguuuuucaca

SEQ ID NO: 1617371 - RNA, 13 nt, Homo sapiens
uacccccucauuu

SEQ ID NO: 1617372 - RNA, 18 nt, Homo sapiens
uaccgcuggcccugccgu

SEQ ID NO: 1617373 - RNA, 13 nt, Homo sapiens
uaccggauucucu

SEQ ID NO: 1617374 - RNA, 19 nt, Homo sapiens
uaccuagcuggcucuguga

SEQ ID NO: 1617375 - RNA, 22 nt, Homo sapiens
uaccucaguucccucuugcuca

SEQ ID NO: 1617376 - RNA, 20 nt, Homo sapiens
uaccucauaguaucuucacu

SEQ ID NO: 1617377 - RNA, 19 nt, Homo sapiens
uaccuggaggaaugauuag

SEQ ID NO: 1617378 - RNA, 14 nt, Homo sapiens
uaccugggugauua

SEQ ID NO: 1617379 - RNA, 13 nt, Homo sapiens
uaccugucucucu

SEQ ID NO: 1617380 - RNA, 16 nt, Homo sapiens
uaccuuaucacugcau

SEQ ID NO: 1617381 - RNA, 17 nt, Homo sapiens
uacgacuucauuccuuc

SEQ ID NO: 1617382 - RNA, 21 nt, Homo sapiens
uacgaugcaauucuagccaaa

SEQ ID NO: 1617383 - RNA, 12 nt, Homo sapiens
uacggacacugu

SEQ ID NO: 1617384 - RNA, 18 nt, Homo sapiens
uacguaugagauccuuua

SEQ ID NO: 1617385 - RNA, 20 nt, Homo sapiens
uacgugauccucucaccuca

SEQ ID NO: 1617386 - RNA, 18 nt, Homo sapiens
uacuaacauuuucauuga

SEQ ID NO: 1617387 - RNA, 20 nt, Homo sapiens
uacuaagggaacaauccaug

SEQ ID NO: 1617388 - RNA, 21 nt, Homo sapiens
uacuaauuuucuagauuuucu

SEQ ID NO: 1617389 - RNA, 13 nt, Homo sapiens
uacuacacuccau

SEQ ID NO: 1617390 - RNA, 14 nt, Homo sapiens
uacuagcacuuuga

SEQ ID NO: 1617391 - RNA, 20 nt, Homo sapiens
uacuagcaggcaaugcugua

SEQ ID NO: 1617392 - RNA, 14 nt, Homo sapiens
uacuauguacugcc

SEQ ID NO: 1617393 - RNA, 16 nt, Homo sapiens
uacuauucaaaaccuc

SEQ ID NO: 1617394 - RNA, 17 nt, Homo sapiens
uacuccauauucuuccc

SEQ ID NO: 1617395 - RNA, 20 nt, Homo sapiens
uacucuaggcagugacagug

SEQ ID NO: 1617396 - RNA, 14 nt, Homo sapiens
uacugaauugucag

SEQ ID NO: 1617397 - RNA, 13 nt, Homo sapiens
uacugaguuugau

SEQ ID NO: 1617398 - RNA, 16 nt, Homo sapiens
uacugcccaggccuau

SEQ ID NO: 1617399 - RNA, 20 nt, Homo sapiens
uacuggcuuucauagcuuuu

SEQ ID NO: 1617400 - RNA, 13 nt, Homo sapiens
uacuguacaugaa

SEQ ID NO: 1617401 - RNA, 13 nt, Homo sapiens
uacuuaaauuccc

SEQ ID NO: 1617402 - RNA, 14 nt, Homo sapiens
uacuuaacauuuca

SEQ ID NO: 1617403 - RNA, 16 nt, Homo sapiens
uacuuaauauacucag

SEQ ID NO: 1617404 - RNA, 13 nt, Homo sapiens
uacuuaaugcaca

SEQ ID NO: 1617405 - RNA, 14 nt, Homo sapiens
uacuuacacuguau

SEQ ID NO: 1617406 - RNA, 17 nt, Homo sapiens
uacuucggggcugggaa

SEQ ID NO: 1617407 - RNA, 18 nt, Homo sapiens
uacuucggggcugggaag

SEQ ID NO: 1617408 - RNA, 20 nt, Homo sapiens
uacuucuugauaccugggau

SEQ ID NO: 1617409 - RNA, 13 nt, Homo sapiens
uacuugcauuuau

SEQ ID NO: 1617410 - RNA, 21 nt, Homo sapiens
uacuugcuuucaauugacaaa

SEQ ID NO: 1617411 - RNA, 21 nt, Homo sapiens
uacuugucauaucacuaaaua

SEQ ID NO: 1617412 - RNA, 15 nt, Homo sapiens
uacuuugugcauucu

SEQ ID NO: 1617413 - RNA, 14 nt, Homo sapiens
uacuuuuacagguu

SEQ ID NO: 1617414 - RNA, 14 nt, Homo sapiens
uacuuuuuuacacu

SEQ ID NO: 1617415 - RNA, 16 nt, Homo sapiens
uacuuuuuuacacuga

SEQ ID NO: 1617416 - RNA, 11 nt, Homo sapiens
uagaaaacugg

SEQ ID NO: 1617417 - RNA, 23 nt, Homo sapiens
uagaaaaugacuuauuucugcuc

SEQ ID NO: 1617418 - RNA, 14 nt, Homo sapiens
uagaaacauuguaa

SEQ ID NO: 1617419 - RNA, 18 nt, Homo sapiens
uagaaagccaugugcuaa

SEQ ID NO: 1617420 - RNA, 11 nt, Homo sapiens
uagaaaugcaa

SEQ ID NO: 1617421 - RNA, 13 nt, Homo sapiens
uagaaaugcaaaa

SEQ ID NO: 1617422 - RNA, 20 nt, Homo sapiens
uagaacuuuauuaaguaaaa

SEQ ID NO: 1617423 - RNA, 14 nt, Homo sapiens
uagaagauggcacu

SEQ ID NO: 1617424 - RNA, 15 nt, Homo sapiens
uagaagugcaagaaa

SEQ ID NO: 1617425 - RNA, 23 nt, Homo sapiens
uagaauagccuguggccuuugca

SEQ ID NO: 1617426 - RNA, 14 nt, Homo sapiens
uagacacagauaau

SEQ ID NO: 1617427 - RNA, 12 nt, Homo sapiens
aaaaaagauccc

SEQ ID NO: 1617428 - RNA, 13 nt, Homo sapiens
aaaaagaaaugca

SEQ ID NO: 1617429 - RNA, 20 nt, Homo sapiens
aagaacuuucucugccauca

SEQ ID NO: 1617430 - RNA, 15 nt, Homo sapiens
aagaagcauuuugca

SEQ ID NO: 1617431 - RNA, 23 nt, Homo sapiens
aagaagccacccuccuugcagga

SEQ ID NO: 1617432 - RNA, 17 nt, Homo sapiens
aagaagguuaccaagaa

SEQ ID NO: 1617433 - RNA, 17 nt, Homo sapiens
aagaauagaaaacuggg

SEQ ID NO: 1617434 - RNA, 20 nt, Homo sapiens
aagaauucucucuucuggaa

SEQ ID NO: 1617435 - RNA, 17 nt, Homo sapiens
aagaauuuaaaauaaca

SEQ ID NO: 1617436 - RNA, 15 nt, Homo sapiens
aagacaugacauucu

SEQ ID NO: 1617437 - RNA, 19 nt, Homo sapiens
aagacugguuuucugccaa

SEQ ID NO: 1617438 - RNA, 14 nt, Homo sapiens
aagacuuguaauau

SEQ ID NO: 1617439 - RNA, 13 nt, Homo sapiens
aagacuuugugac

SEQ ID NO: 1617440 - RNA, 20 nt, Homo sapiens
aagacuuugugacugucacu

SEQ ID NO: 1617441 - RNA, 14 nt, Homo sapiens
aagagaaacuucaa

SEQ ID NO: 1617442 - RNA, 14 nt, Homo sapiens
aagagaaucacaga

SEQ ID NO: 1617443 - RNA, 19 nt, Homo sapiens
aagagagaacaguugucca

SEQ ID NO: 1617444 - RNA, 21 nt, Homo sapiens
aagagcaggaggugccugaaa

SEQ ID NO: 1617445 - RNA, 16 nt, Homo sapiens
aagagcuuaagaacca

SEQ ID NO: 1617446 - RNA, 21 nt, Homo sapiens
aagagucugugcugguugcca

SEQ ID NO: 1617447 - RNA, 18 nt, Homo sapiens
aagaucacgccacuggac

SEQ ID NO: 1617448 - RNA, 20 nt, Homo sapiens
aagauccaagaggcccugca

SEQ ID NO: 1617449 - RNA, 13 nt, Homo sapiens
aagaugagccugg

SEQ ID NO: 1617450 - RNA, 11 nt, Homo sapiens
aagaugcccuc

SEQ ID NO: 1617451 - RNA, 17 nt, Homo sapiens
aagauggacuuaccugg

SEQ ID NO: 1617452 - RNA, 18 nt, Homo sapiens
aagauuacccccaguccu

SEQ ID NO: 1617453 - RNA, 20 nt, Homo sapiens
aagauucuggggcuguguua

SEQ ID NO: 1617454 - RNA, 22 nt, Homo sapiens
aagauuguaauuaaaaugauag

SEQ ID NO: 1617455 - RNA, 20 nt, Homo sapiens
aagcaauucuccugccuuag

SEQ ID NO: 1617456 - RNA, 18 nt, Homo sapiens
aagcaccagugggacugu

SEQ ID NO: 1617457 - RNA, 19 nt, Homo sapiens
aagcaccugcaugugcugu

SEQ ID NO: 1617458 - RNA, 23 nt, Homo sapiens
aagcacgauggagagagccuuau

SEQ ID NO: 1617459 - RNA, 14 nt, Homo sapiens
aagcacuguguuua

SEQ ID NO: 1617460 - RNA, 17 nt, Homo sapiens
aagcaguggccuuuuuc

SEQ ID NO: 1617461 - RNA, 13 nt, Homo sapiens
aagcauacuucua

SEQ ID NO: 1617462 - RNA, 13 nt, Homo sapiens
aagcauacuuugu

SEQ ID NO: 1617463 - RNA, 14 nt, Homo sapiens
aagcauacuuugua

SEQ ID NO: 1617464 - RNA, 12 nt, Homo sapiens
aagcaucugcca

SEQ ID NO: 1617465 - RNA, 23 nt, Homo sapiens
aagcauuauccuuuuaucucaca

SEQ ID NO: 1617466 - RNA, 12 nt, Homo sapiens
aagcauuuacaa

SEQ ID NO: 1617467 - RNA, 21 nt, Homo sapiens
aagccaauucagacaggcaaa

SEQ ID NO: 1617468 - RNA, 12 nt, Homo sapiens
aagccagggucu

SEQ ID NO: 1617469 - RNA, 12 nt, Homo sapiens
aagcccaguuca

SEQ ID NO: 1617470 - RNA, 15 nt, Homo sapiens
aagcccugugcucca

SEQ ID NO: 1617471 - RNA, 20 nt, Homo sapiens
aagccuggcccauaauguga

SEQ ID NO: 1617472 - RNA, 16 nt, Homo sapiens
aagccuuccaguuuug

SEQ ID NO: 1617473 - RNA, 16 nt, Homo sapiens
aagccuucccccagca

SEQ ID NO: 1617474 - RNA, 14 nt, Homo sapiens
aagcgaacaucuuc

SEQ ID NO: 1617475 - RNA, 16 nt, Homo sapiens
aagcuaacagggaagg

SEQ ID NO: 1617476 - RNA, 16 nt, Homo sapiens
aagcuacuauguacug

SEQ ID NO: 1617477 - RNA, 21 nt, Homo sapiens
aagcucagaggcgcacuguga

SEQ ID NO: 1617478 - RNA, 10 nt, Homo sapiens
aagcucugcc

SEQ ID NO: 1617479 - RNA, 20 nt, Homo sapiens
aagcucugccccuuccccau

SEQ ID NO: 1617480 - RNA, 20 nt, Homo sapiens
aagcugacucuuugcucuaa

SEQ ID NO: 1617481 - RNA, 16 nt, Homo sapiens
aagcugagauugagca

SEQ ID NO: 1617482 - RNA, 14 nt, Homo sapiens
aagcugccauauau

SEQ ID NO: 1617483 - RNA, 17 nt, Homo sapiens
aagcugccgguucuuaa

SEQ ID NO: 1617484 - RNA, 14 nt, Homo sapiens
aagcuggugcuacu

SEQ ID NO: 1617485 - RNA, 22 nt, Homo sapiens
aagcuuguauuuaacugaauaa

SEQ ID NO: 1617486 - RNA, 19 nt, Homo sapiens
aagcuuuugguaauauuca

SEQ ID NO: 1617487 - RNA, 14 nt, Homo sapiens
aaggaaaagcaaga

SEQ ID NO: 1617488 - RNA, 14 nt, Homo sapiens
aaggaaaaugacuc

SEQ ID NO: 1617489 - RNA, 21 nt, Homo sapiens
aaggaacucuacuucagucaa

SEQ ID NO: 1617490 - RNA, 20 nt, Homo sapiens
aaggaauagaagcaaauuaa

SEQ ID NO: 1617491 - RNA, 17 nt, Homo sapiens
aaggacgguucuuacac

SEQ ID NO: 1617492 - RNA, 19 nt, Homo sapiens
aaggagccugugaacccag

SEQ ID NO: 1617493 - RNA, 15 nt, Homo sapiens
aaggagggggccuca

SEQ ID NO: 1617494 - RNA, 20 nt, Homo sapiens
aaggaguaaucuguguacaa

SEQ ID NO: 1617495 - RNA, 19 nt, Homo sapiens
aaggauaaagccacuucug

SEQ ID NO: 1617496 - RNA, 19 nt, Homo sapiens
aaggcagccugaacacuca

SEQ ID NO: 1617497 - RNA, 16 nt, Homo sapiens
aagggaaagauaauaa

SEQ ID NO: 1617498 - RNA, 17 nt, Homo sapiens
aagggacccaccugcua

SEQ ID NO: 1617499 - RNA, 17 nt, Homo sapiens
aagggagggcucugagg

SEQ ID NO: 1617500 - RNA, 14 nt, Homo sapiens
aagggagucucucu

SEQ ID NO: 1617501 - RNA, 15 nt, Homo sapiens
aagggagucucucuu

SEQ ID NO: 1617502 - RNA, 16 nt, Homo sapiens
aagggagucucucuuc

SEQ ID NO: 1617503 - RNA, 14 nt, Homo sapiens
aagggcuacuuaau

SEQ ID NO: 1617504 - RNA, 13 nt, Homo sapiens
aaggggcaaauuu

SEQ ID NO: 1617505 - RNA, 19 nt, Homo sapiens
aagggguuggggugacagu

SEQ ID NO: 1617506 - RNA, 14 nt, Homo sapiens
aagggucacaauac

SEQ ID NO: 1617507 - RNA, 21 nt, Homo sapiens
aaggucaugccacugcacucu

SEQ ID NO: 1617508 - RNA, 22 nt, Homo sapiens
aagguccugcuauuacuaagga

SEQ ID NO: 1617509 - RNA, 14 nt, Homo sapiens
aaggugacagagca

SEQ ID NO: 1617510 - RNA, 15 nt, Homo sapiens
aagguguucucugua

SEQ ID NO: 1617511 - RNA, 21 nt, Homo sapiens
aaguaacaugcauacuuuauu

SEQ ID NO: 1617512 - RNA, 22 nt, Homo sapiens
aaguaauguaaaauccauccaa

SEQ ID NO: 1617513 - RNA, 15 nt, Homo sapiens
aaguaauuugaauag

SEQ ID NO: 1617514 - RNA, 15 nt, Homo sapiens
aaguacaauaauuca

SEQ ID NO: 1617515 - RNA, 19 nt, Homo sapiens
aaguagaaaugggauguuu

SEQ ID NO: 1617516 - RNA, 21 nt, Homo sapiens
aaguagcagugugaaguacaa

SEQ ID NO: 1617517 - RNA, 20 nt, Homo sapiens
aaguagcuuugaacuaguuu

SEQ ID NO: 1617518 - RNA, 13 nt, Homo sapiens
aagucaaggagaa

SEQ ID NO: 1617519 - RNA, 15 nt, Homo sapiens
aagucagcucuuguc

SEQ ID NO: 1617520 - RNA, 16 nt, Homo sapiens
aagucagguccaauuu

SEQ ID NO: 1617521 - RNA, 16 nt, Homo sapiens
aagucugcuacccuca

SEQ ID NO: 1617522 - RNA, 13 nt, Homo sapiens
aagugaacuauga

SEQ ID NO: 1617523 - RNA, 18 nt, Homo sapiens
aagugaggaagaguuuau

SEQ ID NO: 1617524 - RNA, 19 nt, Homo sapiens
aagugaggugacacuccag

SEQ ID NO: 1617525 - RNA, 18 nt, Homo sapiens
aagugcgugaauguaugu

SEQ ID NO: 1617526 - RNA, 23 nt, Homo sapiens
aagugcgugccgugugaguguga

SEQ ID NO: 1617527 - RNA, 18 nt, Homo sapiens
aaguggagaccuuucuag

SEQ ID NO: 1617528 - RNA, 22 nt, Homo sapiens
aagugucaccccucacugugac

SEQ ID NO: 1617529 - RNA, 15 nt, Homo sapiens
aagugucaccuccuu

SEQ ID NO: 1617530 - RNA, 20 nt, Homo sapiens
aagugugcugugacaagcca

SEQ ID NO: 1617531 - RNA, 23 nt, Homo sapiens
aagugugugccaccaugccucac

SEQ ID NO: 1617532 - RNA, 19 nt, Homo sapiens
aaguucagugagaaucugc

SEQ ID NO: 1617533 - RNA, 20 nt, Homo sapiens
aaguuccugcugccugggua

SEQ ID NO: 1617534 - RNA, 11 nt, Homo sapiens
aaguugcucac

SEQ ID NO: 1617535 - RNA, 16 nt, Homo sapiens
aaguuguugcauuccc

SEQ ID NO: 1617536 - RNA, 14 nt, Homo sapiens
aaguuugaaaggaa

SEQ ID NO: 1617537 - RNA, 13 nt, Homo sapiens
aaguuuuacuuga

SEQ ID NO: 1617538 - RNA, 19 nt, Homo sapiens
aaguuuuggccaccacaug

SEQ ID NO: 1617539 - RNA, 18 nt, Homo sapiens
accucaccccacuuaucc

SEQ ID NO: 1617540 - RNA, 17 nt, Homo sapiens
accucacugacacaggg

SEQ ID NO: 1617541 - RNA, 18 nt, Homo sapiens
accucagaaagauuugau

SEQ ID NO: 1617542 - RNA, 18 nt, Homo sapiens
accucaguuauuacaugu

SEQ ID NO: 1617543 - RNA, 20 nt, Homo sapiens
accucaguucccucuugcuc

SEQ ID NO: 1617544 - RNA, 21 nt, Homo sapiens
accucaguucccucuugcuca

SEQ ID NO: 1617545 - RNA, 17 nt, Homo sapiens
accuccaagcauuucau

SEQ ID NO: 1617546 - RNA, 18 nt, Homo sapiens
accuccgccagauccugc

SEQ ID NO: 1617547 - RNA, 14 nt, Homo sapiens
accuccucugccag

SEQ ID NO: 1617548 - RNA, 13 nt, Homo sapiens
accucgugaucca

SEQ ID NO: 1617549 - RNA, 10 nt, Homo sapiens
accucugcau

SEQ ID NO: 1617550 - RNA, 16 nt, Homo sapiens
accucuguucauuuca

SEQ ID NO: 1617551 - RNA, 20 nt, Homo sapiens
accugaaggaauaaaaugau

SEQ ID NO: 1617552 - RNA, 17 nt, Homo sapiens
accugagaaauggccaa

SEQ ID NO: 1617553 - RNA, 18 nt, Homo sapiens
accugagaaauggccaaa

SEQ ID NO: 1617554 - RNA, 19 nt, Homo sapiens
accugaggcccccaucucc

SEQ ID NO: 1617555 - RNA, 18 nt, Homo sapiens
accugcaugugcugucac

SEQ ID NO: 1617556 - RNA, 16 nt, Homo sapiens
accugcgggagcugca

SEQ ID NO: 1617557 - RNA, 16 nt, Homo sapiens
accugggcccuggggc

SEQ ID NO: 1617558 - RNA, 16 nt, Homo sapiens
accuggggagagccug

SEQ ID NO: 1617559 - RNA, 19 nt, Homo sapiens
accuggucugguugggcag

SEQ ID NO: 1617560 - RNA, 21 nt, Homo sapiens
accugguguuaggugugcaaa

SEQ ID NO: 1617561 - RNA, 14 nt, Homo sapiens
accugucauuguau

SEQ ID NO: 1617562 - RNA, 17 nt, Homo sapiens
accuguccccacccucc

SEQ ID NO: 1617563 - RNA, 16 nt, Homo sapiens
accugucucucucuuc

SEQ ID NO: 1617564 - RNA, 15 nt, Homo sapiens
accugugagcccagc

SEQ ID NO: 1617565 - RNA, 19 nt, Homo sapiens
accuguggccaaguucuua

SEQ ID NO: 1617566 - RNA, 23 nt, Homo sapiens
accuguuaucuguguuugcugag

SEQ ID NO: 1617567 - RNA, 24 nt, Homo sapiens
accuguucuuagaguguagcugua

SEQ ID NO: 1617568 - RNA, 16 nt, Homo sapiens
accuuccccaaaggaa

SEQ ID NO: 1617569 - RNA, 19 nt, Homo sapiens
accuucccuuccucagcag

SEQ ID NO: 1617570 - RNA, 13 nt, Homo sapiens
accuugaugagcu

SEQ ID NO: 1617571 - RNA, 20 nt, Homo sapiens
accuugaugagcugugcaca

SEQ ID NO: 1617572 - RNA, 14 nt, Homo sapiens
accuugcuuuggac

SEQ ID NO: 1617573 - RNA, 16 nt, Homo sapiens
accuuguuauuucuca

SEQ ID NO: 1617574 - RNA, 15 nt, Homo sapiens
accuuuaaauaucau

SEQ ID NO: 1617575 - RNA, 21 nt, Homo sapiens
accuuucacgaacaugggcau

SEQ ID NO: 1617576 - RNA, 15 nt, Homo sapiens
accuuuugcuccuau

SEQ ID NO: 1617577 - RNA, 20 nt, Homo sapiens
acgaccuugguucacuuuuc

SEQ ID NO: 1617578 - RNA, 15 nt, Homo sapiens
acgacuaaguugaau

SEQ ID NO: 1617579 - RNA, 23 nt, Homo sapiens
acgcagaagagggggaggggaag

SEQ ID NO: 1617580 - RNA, 22 nt, Homo sapiens
acgcagguauuuagaagcagag

SEQ ID NO: 1617581 - RNA, 20 nt, Homo sapiens
acggagucuugcucugucac

SEQ ID NO: 1617582 - RNA, 13 nt, Homo sapiens
acggccccagcgc

SEQ ID NO: 1617583 - RNA, 20 nt, Homo sapiens
acggccuguacggacacugu

SEQ ID NO: 1617584 - RNA, 13 nt, Homo sapiens
acggcuuacaugu

SEQ ID NO: 1617585 - RNA, 19 nt, Homo sapiens
acgggaauucagacaagcu

SEQ ID NO: 1617586 - RNA, 17 nt, Homo sapiens
acguaugcaugugaaga

SEQ ID NO: 1617587 - RNA, 16 nt, Homo sapiens
acguaugguggcucau

SEQ ID NO: 1617588 - RNA, 13 nt, Homo sapiens
acguggcacuggu

SEQ ID NO: 1617589 - RNA, 14 nt, Homo sapiens
acguggcucagcca

SEQ ID NO: 1617590 - RNA, 18 nt, Homo sapiens
acguguauaguaucugua

SEQ ID NO: 1617591 - RNA, 18 nt, Homo sapiens
acgugucugcacaggguc

SEQ ID NO: 1617592 - RNA, 16 nt, Homo sapiens
acgugugcaguuguag

SEQ ID NO: 1617593 - RNA, 20 nt, Homo sapiens
acguuggccuaacacugggc

SEQ ID NO: 1617594 - RNA, 14 nt, Homo sapiens
acuaaaacacugaa

SEQ ID NO: 1617595 - RNA, 12 nt, Homo sapiens
acuaaaguuaac

SEQ ID NO: 1617596 - RNA, 12 nt, Homo sapiens
acuaagcacugu

SEQ ID NO: 1617597 - RNA, 20 nt, Homo sapiens
acuacuccgugaaggcuucu

SEQ ID NO: 1617598 - RNA, 13 nt, Homo sapiens
acuacucuaggga

SEQ ID NO: 1617599 - RNA, 16 nt, Homo sapiens
acuaguuuuacuuuga

SEQ ID NO: 1617600 - RNA, 17 nt, Homo sapiens
acuauaagcccacuguu

SEQ ID NO: 1617601 - RNA, 13 nt, Homo sapiens
acuaucugugcca

SEQ ID NO: 1617602 - RNA, 15 nt, Homo sapiens
acuauguacugccuu

SEQ ID NO: 1617603 - RNA, 22 nt, Homo sapiens
acuauucauggcuaccucagaa

SEQ ID NO: 1617604 - RNA, 18 nt, Homo sapiens
acuauuuagauauaacac

SEQ ID NO: 1617605 - RNA, 22 nt, Homo sapiens
acuauuuagauauaacacuaug

SEQ ID NO: 1617606 - RNA, 14 nt, Homo sapiens
acucaaaggccaga

SEQ ID NO: 1617607 - RNA, 15 nt, Homo sapiens
acucaaaucaguaua

SEQ ID NO: 1617608 - RNA, 15 nt, Homo sapiens
acucacuuguucuca

SEQ ID NO: 1617609 - RNA, 17 nt, Homo sapiens
acucagagaaacaaugg

SEQ ID NO: 1617610 - RNA, 12 nt, Homo sapiens
acucagcacaag

SEQ ID NO: 1617611 - RNA, 17 nt, Homo sapiens
acucagcuguccugcag

SEQ ID NO: 1617612 - RNA, 15 nt, Homo sapiens
acucaugaucaagau

SEQ ID NO: 1617613 - RNA, 16 nt, Homo sapiens
acucauuaaugaauca

SEQ ID NO: 1617614 - RNA, 16 nt, Homo sapiens
acuccgccagccacag

SEQ ID NO: 1617615 - RNA, 19 nt, Homo sapiens
acuccuucccuaauagcuu

SEQ ID NO: 1617616 - RNA, 23 nt, Homo sapiens
acucuacuucagucaauagccau

SEQ ID NO: 1617617 - RNA, 12 nt, Homo sapiens
acucugcacaug

SEQ ID NO: 1617618 - RNA, 23 nt, Homo sapiens
acucugggcuguaacguggcacu

SEQ ID NO: 1617619 - RNA, 18 nt, Homo sapiens
acucugucacccuagcua

SEQ ID NO: 1617620 - RNA, 18 nt, Homo sapiens
acucuguuuccuggucag

SEQ ID NO: 1617621 - RNA, 14 nt, Homo sapiens
acucuuccaccucc

SEQ ID NO: 1617622 - RNA, 17 nt, Homo sapiens
acucuucugacugcccc

SEQ ID NO: 1617623 - RNA, 17 nt, Homo sapiens
acucuugaaguacuuaa

SEQ ID NO: 1617624 - RNA, 13 nt, Homo sapiens
acucuuuguucaa

SEQ ID NO: 1617625 - RNA, 14 nt, Homo sapiens
acugaacauuccag

SEQ ID NO: 1617626 - RNA, 18 nt, Homo sapiens
acugaacuugcuauggaa

SEQ ID NO: 1617627 - RNA, 15 nt, Homo sapiens
acugaagcugcacag

SEQ ID NO: 1617628 - RNA, 16 nt, Homo sapiens
acugaagcugcacagu

SEQ ID NO: 1617629 - RNA, 23 nt, Homo sapiens
acugaaggcuuucagggccucca

SEQ ID NO: 1617630 - RNA, 18 nt, Homo sapiens
acugaagugaacuaugaa

SEQ ID NO: 1617631 - RNA, 14 nt, Homo sapiens
acugaauaauauca

SEQ ID NO: 1617632 - RNA, 15 nt, Homo sapiens
acugagauggaguga

SEQ ID NO: 1617633 - RNA, 19 nt, Homo sapiens
acugaugccccagggauuc

SEQ ID NO: 1617634 - RNA, 14 nt, Homo sapiens
acugaugugugcaa

SEQ ID NO: 1617635 - RNA, 20 nt, Homo sapiens
acugcacuuuccaaugccac

SEQ ID NO: 1617636 - RNA, 22 nt, Homo sapiens
acuggaaccccagcuucccucc

SEQ ID NO: 1617637 - RNA, 17 nt, Homo sapiens
acuggacugucuaugaa

SEQ ID NO: 1617638 - RNA, 16 nt, Homo sapiens
acuggauucauucuca

SEQ ID NO: 1617639 - RNA, 19 nt, Homo sapiens
acuggcugugugaccuuag

SEQ ID NO: 1617640 - RNA, 16 nt, Homo sapiens
acugggacgccuucag

SEQ ID NO: 1617641 - RNA, 17 nt, Homo sapiens
acugggccuuagugggc

SEQ ID NO: 1617642 - RNA, 16 nt, Homo sapiens
acugggugucauuuca

SEQ ID NO: 1617643 - RNA, 17 nt, Homo sapiens
acugguagguugggaca

SEQ ID NO: 1617644 - RNA, 19 nt, Homo sapiens
acuguagacaggaaagcca

SEQ ID NO: 1617645 - RNA, 13 nt, Homo sapiens
acugucaguucuc

SEQ ID NO: 1617646 - RNA, 16 nt, Homo sapiens
acugucuaugaacuug

SEQ ID NO: 1617647 - RNA, 16 nt, Homo sapiens
acuguguaacuuucuc

SEQ ID NO: 1617648 - RNA, 17 nt, Homo sapiens
acugugucugaaucaug

SEQ ID NO: 1617649 - RNA, 16 nt, Homo sapiens
cacaugucuuguacau

SEQ ID NO: 1617650 - RNA, 17 nt, Homo sapiens
cacaugugacacauaug

SEQ ID NO: 1617651 - RNA, 14 nt, Homo sapiens
cacauuaacauuuu

SEQ ID NO: 1617652 - RNA, 14 nt, Homo sapiens
caccaaaaccaaac

SEQ ID NO: 1617653 - RNA, 16 nt, Homo sapiens
caccaaugcaacauuu

SEQ ID NO: 1617654 - RNA, 20 nt, Homo sapiens
caccaauggauuguggaaaa

SEQ ID NO: 1617655 - RNA, 14 nt, Homo sapiens
caccacacacacac

SEQ ID NO: 1617656 - RNA, 23 nt, Homo sapiens
caccaccuggggagagccugcuu

SEQ ID NO: 1617657 - RNA, 19 nt, Homo sapiens
caccagccagaggaugcau

SEQ ID NO: 1617658 - RNA, 18 nt, Homo sapiens
caccagcccugaccccag

SEQ ID NO: 1617659 - RNA, 20 nt, Homo sapiens
caccaugaugugaagaguuu

SEQ ID NO: 1617660 - RNA, 12 nt, Homo sapiens
cacccacaugug

SEQ ID NO: 1617661 - RNA, 16 nt, Homo sapiens
cacccagggacacucc

SEQ ID NO: 1617662 - RNA, 15 nt, Homo sapiens
cacccccaugacauu

SEQ ID NO: 1617663 - RNA, 16 nt, Homo sapiens
caccccugacuuuuau

SEQ ID NO: 1617664 - RNA, 16 nt, Homo sapiens
caccgagcgggugcaa

SEQ ID NO: 1617665 - RNA, 19 nt, Homo sapiens
caccgugcccaaccucacu

SEQ ID NO: 1617666 - RNA, 21 nt, Homo sapiens
caccgugccuggcugauucag

SEQ ID NO: 1617667 - RNA, 17 nt, Homo sapiens
caccguucugugcacaa

SEQ ID NO: 1617668 - RNA, 23 nt, Homo sapiens
caccuaccuuagaaaacaaguau

SEQ ID NO: 1617669 - RNA, 23 nt, Homo sapiens
caccuaugagugagaauaugugg

SEQ ID NO: 1617670 - RNA, 13 nt, Homo sapiens
caccucugugacc

SEQ ID NO: 1617671 - RNA, 13 nt, Homo sapiens
caccuuacaacuc

SEQ ID NO: 1617672 - RNA, 22 nt, Homo sapiens
caccuuccguuccccgcuaggu

SEQ ID NO: 1617673 - RNA, 18 nt, Homo sapiens
cacggcuuguaaauguga

SEQ ID NO: 1617674 - RNA, 13 nt, Homo sapiens
cacuaccacauua

SEQ ID NO: 1617675 - RNA, 19 nt, Homo sapiens
cacuacugggugucauuuc

SEQ ID NO: 1617676 - RNA, 21 nt, Homo sapiens
cacuauguuuauuuacuaauu

SEQ ID NO: 1617677 - RNA, 17 nt, Homo sapiens
cacucaguuuaugcugu

SEQ ID NO: 1617678 - RNA, 16 nt, Homo sapiens
cacucaugcacacaga

SEQ ID NO: 1617679 - RNA, 14 nt, Homo sapiens
cacuccagcuccuu

SEQ ID NO: 1617680 - RNA, 16 nt, Homo sapiens
cacuccugcuguaaau

SEQ ID NO: 1617681 - RNA, 14 nt, Homo sapiens
cacuccuucucuca

SEQ ID NO: 1617682 - RNA, 15 nt, Homo sapiens
cacugacaguuaaua

SEQ ID NO: 1617683 - RNA, 18 nt, Homo sapiens
cacugcagacuuguccag

SEQ ID NO: 1617684 - RNA, 18 nt, Homo sapiens
cacugcauuaucuugcuc

SEQ ID NO: 1617685 - RNA, 22 nt, Homo sapiens
cacugccccacguugucccuga

SEQ ID NO: 1617686 - RNA, 20 nt, Homo sapiens
cacuggacugucuaugaacu

SEQ ID NO: 1617687 - RNA, 20 nt, Homo sapiens
cacuguacaagguaccccuu

SEQ ID NO: 1617688 - RNA, 17 nt, Homo sapiens
cacuguagcagguucua

SEQ ID NO: 1617689 - RNA, 19 nt, Homo sapiens
cacugucuccuuucucuua

SEQ ID NO: 1617690 - RNA, 16 nt, Homo sapiens
cacugugucauucugu

SEQ ID NO: 1617691 - RNA, 21 nt, Homo sapiens
cacugugucccucucucugga

SEQ ID NO: 1617692 - RNA, 15 nt, Homo sapiens
cacuguguuacugcu

SEQ ID NO: 1617693 - RNA, 19 nt, Homo sapiens
cacuguguuuauaugucuu

SEQ ID NO: 1617694 - RNA, 23 nt, Homo sapiens
cacuguguuuauaugucuugcaa

SEQ ID NO: 1617695 - RNA, 15 nt, Homo sapiens
cacuguuacagagau

SEQ ID NO: 1617696 - RNA, 17 nt, Homo sapiens
cacuguuccagucuccu

SEQ ID NO: 1617697 - RNA, 18 nt, Homo sapiens
cacuucaaugcacauggu

SEQ ID NO: 1617698 - RNA, 18 nt, Homo sapiens
cacuuccccaagaucugc

SEQ ID NO: 1617699 - RNA, 20 nt, Homo sapiens
cacuuccugcugcgaaagac

SEQ ID NO: 1617700 - RNA, 17 nt, Homo sapiens
cacuucuggcuucagcc

SEQ ID NO: 1617701 - RNA, 16 nt, Homo sapiens
cacuugacagacugua

SEQ ID NO: 1617702 - RNA, 13 nt, Homo sapiens
cacuuggaugcag

SEQ ID NO: 1617703 - RNA, 15 nt, Homo sapiens
cacuuuccuuucaau

SEQ ID NO: 1617704 - RNA, 15 nt, Homo sapiens
cagaaauggacugga

SEQ ID NO: 1617705 - RNA, 13 nt, Homo sapiens
cagaacccagugu

SEQ ID NO: 1617706 - RNA, 20 nt, Homo sapiens
cagaacguggugaccuuuca

SEQ ID NO: 1617707 - RNA, 16 nt, Homo sapiens
cagaacuugaaggguu

SEQ ID NO: 1617708 - RNA, 14 nt, Homo sapiens
cagaagaaaucaua

SEQ ID NO: 1617709 - RNA, 14 nt, Homo sapiens
cagaagccugaugc

SEQ ID NO: 1617710 - RNA, 23 nt, Homo sapiens
cagaaggaaaaaaacaugaauuu

SEQ ID NO: 1617711 - RNA, 21 nt, Homo sapiens
cagaauguuacugacuccuca

SEQ ID NO: 1617712 - RNA, 14 nt, Homo sapiens
cagaauuacauaaa

SEQ ID NO: 1617713 - RNA, 14 nt, Homo sapiens
cagaauugcacauc

SEQ ID NO: 1617714 - RNA, 16 nt, Homo sapiens
cagaauuggaaucaca

SEQ ID NO: 1617715 - RNA, 17 nt, Homo sapiens
cagaauuggaaucacau

SEQ ID NO: 1617716 - RNA, 18 nt, Homo sapiens
cagacacaugcuauguuc

SEQ ID NO: 1617717 - RNA, 12 nt, Homo sapiens
cagacacugcac

SEQ ID NO: 1617718 - RNA, 12 nt, Homo sapiens
cagacccagugg

SEQ ID NO: 1617719 - RNA, 15 nt, Homo sapiens
cagaccuaauaucau

SEQ ID NO: 1617720 - RNA, 13 nt, Homo sapiens
cagaccugcaugg

SEQ ID NO: 1617721 - RNA, 20 nt, Homo sapiens
cagacgagacaacagcacac

SEQ ID NO: 1617722 - RNA, 20 nt, Homo sapiens
cagagaacucccccaccugu

SEQ ID NO: 1617723 - RNA, 16 nt, Homo sapiens
cagagcaaaugagcuc

SEQ ID NO: 1617724 - RNA, 18 nt, Homo sapiens
cagagcacuuugcaacuc

SEQ ID NO: 1617725 - RNA, 23 nt, Homo sapiens
cagagcagcuccaccacugugca

SEQ ID NO: 1617726 - RNA, 22 nt, Homo sapiens
cagagcccugugucuguauaca

SEQ ID NO: 1617727 - RNA, 16 nt, Homo sapiens
cagagcgcacagggag

SEQ ID NO: 1617728 - RNA, 13 nt, Homo sapiens
cagagcuuccuua

SEQ ID NO: 1617729 - RNA, 22 nt, Homo sapiens
cagaggaacaaaccaggggaca

SEQ ID NO: 1617730 - RNA, 14 nt, Homo sapiens
cagaggauguggcc

SEQ ID NO: 1617731 - RNA, 15 nt, Homo sapiens
cagaggcuggaccac

SEQ ID NO: 1617732 - RNA, 15 nt, Homo sapiens
cagagggccuggcuc

SEQ ID NO: 1617733 - RNA, 16 nt, Homo sapiens
cagagugaccagcaca

SEQ ID NO: 1617734 - RNA, 16 nt, Homo sapiens
cagaguucugugacac

SEQ ID NO: 1617735 - RNA, 15 nt, Homo sapiens
cagauaaccuaauaa

SEQ ID NO: 1617736 - RNA, 23 nt, Homo sapiens
cagauaaccuaauaauuguaucu

SEQ ID NO: 1617737 - RNA, 14 nt, Homo sapiens
cagauagcugccac

SEQ ID NO: 1617738 - RNA, 17 nt, Homo sapiens
cagaugcaagacacugu

SEQ ID NO: 1617739 - RNA, 19 nt, Homo sapiens
cagaugcaagacacugugc

SEQ ID NO: 1617740 - RNA, 22 nt, Homo sapiens
cagaugcaagacacugugccac

SEQ ID NO: 1617741 - RNA, 22 nt, Homo sapiens
cagauguuuuacgucugggaga

SEQ ID NO: 1617742 - RNA, 13 nt, Homo sapiens
cagauugcaugug

SEQ ID NO: 1617743 - RNA, 15 nt, Homo sapiens
cagauuuaugaauuu

SEQ ID NO: 1617744 - RNA, 16 nt, Homo sapiens
cagauuuucaugcaaa

SEQ ID NO: 1617745 - RNA, 17 nt, Homo sapiens
cagauuuucaugcaaaa

SEQ ID NO: 1617746 - RNA, 18 nt, Homo sapiens
cagauuuuuuccucugca

SEQ ID NO: 1617747 - RNA, 18 nt, Homo sapiens
cagcaaacccugauguga

SEQ ID NO: 1617748 - RNA, 16 nt, Homo sapiens
cagcacagguauuuca

SEQ ID NO: 1617749 - RNA, 17 nt, Homo sapiens
cagcaggggggcugugc

SEQ ID NO: 1617750 - RNA, 13 nt, Homo sapiens
cagcaggugcuga

SEQ ID NO: 1617751 - RNA, 14 nt, Homo sapiens
cagcauacuucaaa

SEQ ID NO: 1617752 - RNA, 16 nt, Homo sapiens
cagcaugccugaacua

SEQ ID NO: 1617753 - RNA, 14 nt, Homo sapiens
cagccacacuucuc

SEQ ID NO: 1617754 - RNA, 17 nt, Homo sapiens
cagccacgaggugcaac

SEQ ID NO: 1617755 - RNA, 14 nt, Homo sapiens
cagccacuucugca

SEQ ID NO: 1617756 - RNA, 15 nt, Homo sapiens
cagccacuucugcag

SEQ ID NO: 1617757 - RNA, 21 nt, Homo sapiens
cagccacuuugcuaccaugac

SEQ ID NO: 1617758 - RNA, 20 nt, Homo sapiens
cagccagaacuuucuuucac

SEQ ID NO: 1617759 - RNA, 13 nt, Homo sapiens
cauauaaacucau

SEQ ID NO: 1617760 - RNA, 17 nt, Homo sapiens
cauauaaagcacuauac

SEQ ID NO: 1617761 - RNA, 20 nt, Homo sapiens
cauauaaauagaugauuuca

SEQ ID NO: 1617762 - RNA, 21 nt, Homo sapiens
cauauagaauuauuacaauuu

SEQ ID NO: 1617763 - RNA, 17 nt, Homo sapiens
cauaucagcacauauuu

SEQ ID NO: 1617764 - RNA, 19 nt, Homo sapiens
cauauccaggcaccaggac

SEQ ID NO: 1617765 - RNA, 16 nt, Homo sapiens
cauaucggcucacaaa

SEQ ID NO: 1617766 - RNA, 14 nt, Homo sapiens
cauaugaacacaga

SEQ ID NO: 1617767 - RNA, 22 nt, Homo sapiens
cauaugaggaggaugucccugg

SEQ ID NO: 1617768 - RNA, 16 nt, Homo sapiens
cauauggacucugcac

SEQ ID NO: 1617769 - RNA, 13 nt, Homo sapiens
caucacaugacca

SEQ ID NO: 1617770 - RNA, 23 nt, Homo sapiens
caucagaaccagaggcuuggucc

SEQ ID NO: 1617771 - RNA, 23 nt, Homo sapiens
caucagauggaagcuuacucucu

SEQ ID NO: 1617772 - RNA, 19 nt, Homo sapiens
caucagcuguuaaccauuu

SEQ ID NO: 1617773 - RNA, 13 nt, Homo sapiens
caucagugaaaga

SEQ ID NO: 1617774 - RNA, 12 nt, Homo sapiens
caucaucuaugg

SEQ ID NO: 1617775 - RNA, 13 nt, Homo sapiens
caucaucuauggc

SEQ ID NO: 1617776 - RNA, 20 nt, Homo sapiens
cauccagaguucugugacac

SEQ ID NO: 1617777 - RNA, 14 nt, Homo sapiens
cauccagaugugug

SEQ ID NO: 1617778 - RNA, 18 nt, Homo sapiens
cauccagaugugugcaau

SEQ ID NO: 1617779 - RNA, 15 nt, Homo sapiens
cauccauaaagaagc

SEQ ID NO: 1617780 - RNA, 16 nt, Homo sapiens
cauccccagcgauucc

SEQ ID NO: 1617781 - RNA, 17 nt, Homo sapiens
caucccuuuuucugcua

SEQ ID NO: 1617782 - RNA, 15 nt, Homo sapiens
cauccugugaagucc

SEQ ID NO: 1617783 - RNA, 15 nt, Homo sapiens
caucucccucugauu

SEQ ID NO: 1617784 - RNA, 22 nt, Homo sapiens
caucucccuuccaccucacaac

SEQ ID NO: 1617785 - RNA, 23 nt, Homo sapiens
caucucccuuggguaaaaugaag

SEQ ID NO: 1617786 - RNA, 14 nt, Homo sapiens
caucuccuccuugc

SEQ ID NO: 1617787 - RNA, 21 nt, Homo sapiens
caucucuugaaaccuguuaaa

SEQ ID NO: 1617788 - RNA, 21 nt, Homo sapiens
caucuggaaaccucuacauau

SEQ ID NO: 1617789 - RNA, 19 nt, Homo sapiens
caugaaacauuacaggaaa

SEQ ID NO: 1617790 - RNA, 12 nt, Homo sapiens
caugaacuguac

SEQ ID NO: 1617791 - RNA, 21 nt, Homo sapiens
caugacaaaaaggccaagaga

SEQ ID NO: 1617792 - RNA, 22 nt, Homo sapiens
caugaccaccccucucgccuca

SEQ ID NO: 1617793 - RNA, 15 nt, Homo sapiens
caugaccacuuuccc

SEQ ID NO: 1617794 - RNA, 19 nt, Homo sapiens
caugaggccaucucaggag

SEQ ID NO: 1617795 - RNA, 19 nt, Homo sapiens
caugauacuaucugugcca

SEQ ID NO: 1617796 - RNA, 14 nt, Homo sapiens
caugauacugcugc

SEQ ID NO: 1617797 - RNA, 16 nt, Homo sapiens
caugaucaagauauau

SEQ ID NO: 1617798 - RNA, 10 nt, Homo sapiens
caugaucucg

SEQ ID NO: 1617799 - RNA, 23 nt, Homo sapiens
caugaugcgggccagugcuccag

SEQ ID NO: 1617800 - RNA, 13 nt, Homo sapiens
caugcacacagau

SEQ ID NO: 1617801 - RNA, 18 nt, Homo sapiens
caugcacccucauacaca

SEQ ID NO: 1617802 - RNA, 14 nt, Homo sapiens
caugcaccuugcuc

SEQ ID NO: 1617803 - RNA, 16 nt, Homo sapiens
caugcaccuugcuccc

SEQ ID NO: 1617804 - RNA, 17 nt, Homo sapiens
caugcaccuugcuccca

SEQ ID NO: 1617805 - RNA, 18 nt, Homo sapiens
caugccacugcacucuag

SEQ ID NO: 1617806 - RNA, 14 nt, Homo sapiens
caugcccaugauga

SEQ ID NO: 1617807 - RNA, 14 nt, Homo sapiens
caugccccuggcug

SEQ ID NO: 1617808 - RNA, 15 nt, Homo sapiens
caugcccugugcaac

SEQ ID NO: 1617809 - RNA, 13 nt, Homo sapiens
caugcccuguuca

SEQ ID NO: 1617810 - RNA, 20 nt, Homo sapiens
caugcgguagccagcacaca

SEQ ID NO: 1617811 - RNA, 22 nt, Homo sapiens
caugcuuuguuuuucacauaua

SEQ ID NO: 1617812 - RNA, 21 nt, Homo sapiens
cauggaacagcauuacccucc

SEQ ID NO: 1617813 - RNA, 23 nt, Homo sapiens
cauggaguugccaacuauucuca

SEQ ID NO: 1617814 - RNA, 10 nt, Homo sapiens
cauggaugau

SEQ ID NO: 1617815 - RNA, 20 nt, Homo sapiens
cauggauucaaccaacugca

SEQ ID NO: 1617816 - RNA, 20 nt, Homo sapiens
cauggccuugaaacaguucc

SEQ ID NO: 1617817 - RNA, 14 nt, Homo sapiens
cauggcuaccucag

SEQ ID NO: 1617818 - RNA, 17 nt, Homo sapiens
cauggcugccaucucac

SEQ ID NO: 1617819 - RNA, 20 nt, Homo sapiens
caugguccuguggacuccuc

SEQ ID NO: 1617820 - RNA, 17 nt, Homo sapiens
caugucuacaaucugcu

SEQ ID NO: 1617821 - RNA, 22 nt, Homo sapiens
caugucuuaccagugacgcugc

SEQ ID NO: 1617822 - RNA, 13 nt, Homo sapiens
caugugaacaucc

SEQ ID NO: 1617823 - RNA, 15 nt, Homo sapiens
caugugacacauaug

SEQ ID NO: 1617824 - RNA, 17 nt, Homo sapiens
cauguguacauucugcc

SEQ ID NO: 1617825 - RNA, 16 nt, Homo sapiens
cauguugaaggugccc

SEQ ID NO: 1617826 - RNA, 20 nt, Homo sapiens
cauguuuuaacaaaaaccaa

SEQ ID NO: 1617827 - RNA, 11 nt, Homo sapiens
cauuaaauuca

SEQ ID NO: 1617828 - RNA, 18 nt, Homo sapiens
cauuaaugacacuugucc

SEQ ID NO: 1617829 - RNA, 13 nt, Homo sapiens
cauuauccuugcu

SEQ ID NO: 1617830 - RNA, 19 nt, Homo sapiens
cauucaggcaacgcacaaa

SEQ ID NO: 1617831 - RNA, 21 nt, Homo sapiens
cauucagggcuauuuuuuccc

SEQ ID NO: 1617832 - RNA, 19 nt, Homo sapiens
cauuccauugccuagcucu

SEQ ID NO: 1617833 - RNA, 21 nt, Homo sapiens
cauucccguggaacguuuuuc

SEQ ID NO: 1617834 - RNA, 14 nt, Homo sapiens
cauucuacuagcag

SEQ ID NO: 1617835 - RNA, 21 nt, Homo sapiens
cauucuguuuaucaagccaua

SEQ ID NO: 1617836 - RNA, 16 nt, Homo sapiens
cauucuuuugccacau

SEQ ID NO: 1617837 - RNA, 13 nt, Homo sapiens
cauugaacuguac

SEQ ID NO: 1617838 - RNA, 14 nt, Homo sapiens
cauugaacuuuaag

SEQ ID NO: 1617839 - RNA, 17 nt, Homo sapiens
cauugauuuaauguaau

SEQ ID NO: 1617840 - RNA, 14 nt, Homo sapiens
cauugccggcaaug

SEQ ID NO: 1617841 - RNA, 13 nt, Homo sapiens
cauugccuagcuc

SEQ ID NO: 1617842 - RNA, 14 nt, Homo sapiens
cauuggcaucugcu

SEQ ID NO: 1617843 - RNA, 13 nt, Homo sapiens
cauugucaccucu

SEQ ID NO: 1617844 - RNA, 20 nt, Homo sapiens
cauuuaaauuccacagauua

SEQ ID NO: 1617845 - RNA, 14 nt, Homo sapiens
cauuuacccaacuc

SEQ ID NO: 1617846 - RNA, 17 nt, Homo sapiens
cauuuacuuuaauuucc

SEQ ID NO: 1617847 - RNA, 20 nt, Homo sapiens
cauuuagacuuauguggaac

SEQ ID NO: 1617848 - RNA, 13 nt, Homo sapiens
cauuuauaaaaua

SEQ ID NO: 1617849 - RNA, 14 nt, Homo sapiens
cauuuauaaaggga

SEQ ID NO: 1617850 - RNA, 16 nt, Homo sapiens
cauuucaaucauugaa

SEQ ID NO: 1617851 - RNA, 15 nt, Homo sapiens
cauuucacacaguga

SEQ ID NO: 1617852 - RNA, 16 nt, Homo sapiens
cauuucacacagugaa

SEQ ID NO: 1617853 - RNA, 17 nt, Homo sapiens
cauuucagaaaugcugu

SEQ ID NO: 1617854 - RNA, 11 nt, Homo sapiens
cauuucuuaga

SEQ ID NO: 1617855 - RNA, 14 nt, Homo sapiens
cauuugauggccac

SEQ ID NO: 1617856 - RNA, 14 nt, Homo sapiens
cauuugcucuuuca

SEQ ID NO: 1617857 - RNA, 19 nt, Homo sapiens
cauuugcucuuucaucucu

SEQ ID NO: 1617858 - RNA, 21 nt, Homo sapiens
cauuuggaggaaucaccccau

SEQ ID NO: 1617859 - RNA, 21 nt, Homo sapiens
cauuuuaugagaguuuggaau

SEQ ID NO: 1617860 - RNA, 15 nt, Homo sapiens
cauuuucauugauga

SEQ ID NO: 1617861 - RNA, 18 nt, Homo sapiens
cauuuucucccuuaggaa

SEQ ID NO: 1617862 - RNA, 15 nt, Homo sapiens
cauuuugagcuauuu

SEQ ID NO: 1617863 - RNA, 13 nt, Homo sapiens
cauuuuguggaau

SEQ ID NO: 1617864 - RNA, 11 nt, Homo sapiens
ccaaaacacag

SEQ ID NO: 1617865 - RNA, 12 nt, Homo sapiens
ccaaaacacaga

SEQ ID NO: 1617866 - RNA, 22 nt, Homo sapiens
ccaaaagggccauguuucaaga

SEQ ID NO: 1617867 - RNA, 13 nt, Homo sapiens
ccaaacgcuuauu

SEQ ID NO: 1617868 - RNA, 18 nt, Homo sapiens
ccaaacgcuuauugugua

SEQ ID NO: 1617869 - RNA, 14 nt, Homo sapiens
ccaaacugccucaa

SEQ ID NO: 1617870 - RNA, 16 nt, Homo sapiens
ccuccuuggcuuuaug

SEQ ID NO: 1617871 - RNA, 19 nt, Homo sapiens
ccuccuuggcuuuaugcaa

SEQ ID NO: 1617872 - RNA, 15 nt, Homo sapiens
ccucgccccaaaguu

SEQ ID NO: 1617873 - RNA, 17 nt, Homo sapiens
ccucgggugugcuaugg

SEQ ID NO: 1617874 - RNA, 14 nt, Homo sapiens
ccucguaugcaugg

SEQ ID NO: 1617875 - RNA, 22 nt, Homo sapiens
ccucguuauuguuguugccaaa

SEQ ID NO: 1617876 - RNA, 18 nt, Homo sapiens
ccucuaaguguugugaaa

SEQ ID NO: 1617877 - RNA, 13 nt, Homo sapiens
ccucuacauauuu

SEQ ID NO: 1617878 - RNA, 20 nt, Homo sapiens
ccucucagaagguaggggaa

SEQ ID NO: 1617879 - RNA, 20 nt, Homo sapiens
ccucugacuaguagauuucu

SEQ ID NO: 1617880 - RNA, 21 nt, Homo sapiens
ccucugauuuccuucugcuau

SEQ ID NO: 1617881 - RNA, 21 nt, Homo sapiens
ccucugucggcuuuuugccau

SEQ ID NO: 1617882 - RNA, 17 nt, Homo sapiens
ccucuguucauuucaca

SEQ ID NO: 1617883 - RNA, 17 nt, Homo sapiens
ccucuucuuccuaccuu

SEQ ID NO: 1617884 - RNA, 19 nt, Homo sapiens
ccucuugaagcauagcuuu

SEQ ID NO: 1617885 - RNA, 16 nt, Homo sapiens
ccucuuguucauguca

SEQ ID NO: 1617886 - RNA, 16 nt, Homo sapiens
ccucuuguugcugagu

SEQ ID NO: 1617887 - RNA, 18 nt, Homo sapiens
ccucuuugucuaaaacaa

SEQ ID NO: 1617888 - RNA, 18 nt, Homo sapiens
ccugaaggaaaaugacuc

SEQ ID NO: 1617889 - RNA, 12 nt, Homo sapiens
ccugaaggcaca

SEQ ID NO: 1617890 - RNA, 22 nt, Homo sapiens
ccugacacuaaccagagucagc

SEQ ID NO: 1617891 - RNA, 13 nt, Homo sapiens
ccugagagucuga

SEQ ID NO: 1617892 - RNA, 15 nt, Homo sapiens
ccugagugaccuccu

SEQ ID NO: 1617893 - RNA, 17 nt, Homo sapiens
ccugaucagaggcauuu

SEQ ID NO: 1617894 - RNA, 15 nt, Homo sapiens
ccugcacucuuuaag

SEQ ID NO: 1617895 - RNA, 16 nt, Homo sapiens
ccugcaggacuugcca

SEQ ID NO: 1617896 - RNA, 13 nt, Homo sapiens
ccugcccacagaa

SEQ ID NO: 1617897 - RNA, 21 nt, Homo sapiens
ccugccccagauuuacuaaau

SEQ ID NO: 1617898 - RNA, 10 nt, Homo sapiens
ccugcccuug

SEQ ID NO: 1617899 - RNA, 16 nt, Homo sapiens
ccugccuucaaagcca

SEQ ID NO: 1617900 - RNA, 16 nt, Homo sapiens
ccugcgagacgcacac

SEQ ID NO: 1617901 - RNA, 23 nt, Homo sapiens
ccugcgggugaacaaagcagcca

SEQ ID NO: 1617902 - RNA, 12 nt, Homo sapiens
ccugcuaccugu

SEQ ID NO: 1617903 - RNA, 16 nt, Homo sapiens
ccugcucacaaaauca

SEQ ID NO: 1617904 - RNA, 14 nt, Homo sapiens
ccugcucccacaga

SEQ ID NO: 1617905 - RNA, 14 nt, Homo sapiens
ccugcugagaucug

SEQ ID NO: 1617906 - RNA, 18 nt, Homo sapiens
ccugcugcccagugcaaa

SEQ ID NO: 1617907 - RNA, 22 nt, Homo sapiens
ccugcugcgagacccggcucuc

SEQ ID NO: 1617908 - RNA, 13 nt, Homo sapiens
ccuggaaaggggg

SEQ ID NO: 1617909 - RNA, 16 nt, Homo sapiens
ccuggacagcugugcc

SEQ ID NO: 1617910 - RNA, 17 nt, Homo sapiens
ccuggagacaaggugcu

SEQ ID NO: 1617911 - RNA, 16 nt, Homo sapiens
ccuggagggcaagccc

SEQ ID NO: 1617912 - RNA, 23 nt, Homo sapiens
ccuggaucaguccuuugaucagu

SEQ ID NO: 1617913 - RNA, 15 nt, Homo sapiens
ccuggcacacaucag

SEQ ID NO: 1617914 - RNA, 22 nt, Homo sapiens
ccuggcagccacaacugcaguc

SEQ ID NO: 1617915 - RNA, 15 nt, Homo sapiens
ccuggccgaguccaa

SEQ ID NO: 1617916 - RNA, 19 nt, Homo sapiens
ccuggcuggcugagggcag

SEQ ID NO: 1617917 - RNA, 16 nt, Homo sapiens
ccugggacagggcaaa

SEQ ID NO: 1617918 - RNA, 15 nt, Homo sapiens
ccugggauucaggaa

SEQ ID NO: 1617919 - RNA, 20 nt, Homo sapiens
ccuggggcuagggggagccc

SEQ ID NO: 1617920 - RNA, 17 nt, Homo sapiens
ccugggggcuuuugcca

SEQ ID NO: 1617921 - RNA, 16 nt, Homo sapiens
ccuggggugaauacuu

SEQ ID NO: 1617922 - RNA, 17 nt, Homo sapiens
ccuggggugaauacuua

SEQ ID NO: 1617923 - RNA, 16 nt, Homo sapiens
ccuguaauaaauaugu

SEQ ID NO: 1617924 - RNA, 18 nt, Homo sapiens
ccuguaauuuuucuggga

SEQ ID NO: 1617925 - RNA, 12 nt, Homo sapiens
ccuguacauaug

SEQ ID NO: 1617926 - RNA, 17 nt, Homo sapiens
ccuguagcagucacuga

SEQ ID NO: 1617927 - RNA, 14 nt, Homo sapiens
ccugugaaauacca

SEQ ID NO: 1617928 - RNA, 16 nt, Homo sapiens
ccugugugugcugcca

SEQ ID NO: 1617929 - RNA, 22 nt, Homo sapiens
ccuguuaucuguguuugcugag

SEQ ID NO: 1617930 - RNA, 22 nt, Homo sapiens
ccuguuccccaaggacucuucc

SEQ ID NO: 1617931 - RNA, 16 nt, Homo sapiens
ccuuaacacauucaau

SEQ ID NO: 1617932 - RNA, 20 nt, Homo sapiens
ccuuacaacucggggacaaa

SEQ ID NO: 1617933 - RNA, 16 nt, Homo sapiens
ccuuacagucacuaau

SEQ ID NO: 1617934 - RNA, 22 nt, Homo sapiens
ccuucaccucacugaaaacauc

SEQ ID NO: 1617935 - RNA, 12 nt, Homo sapiens
ccuuccaagcac

SEQ ID NO: 1617936 - RNA, 19 nt, Homo sapiens
ccuuccaccucacaacucc

SEQ ID NO: 1617937 - RNA, 18 nt, Homo sapiens
ccuuccagcuagugaccc

SEQ ID NO: 1617938 - RNA, 20 nt, Homo sapiens
ccuuccagcuagugacccac

SEQ ID NO: 1617939 - RNA, 17 nt, Homo sapiens
ccuuccuauuuugcaua

SEQ ID NO: 1617940 - RNA, 15 nt, Homo sapiens
ccuuccucuuccugc

SEQ ID NO: 1617941 - RNA, 15 nt, Homo sapiens
ccuuccuggacagcu

SEQ ID NO: 1617942 - RNA, 13 nt, Homo sapiens
ccuuccuuaccuc

SEQ ID NO: 1617943 - RNA, 22 nt, Homo sapiens
ccuucucacacacaacugucca

SEQ ID NO: 1617944 - RNA, 19 nt, Homo sapiens
ccuucucuacacucuugua

SEQ ID NO: 1617945 - RNA, 23 nt, Homo sapiens
ccuucugauugauggugcuauuu

SEQ ID NO: 1617946 - RNA, 23 nt, Homo sapiens
ccuugcaguuccccgagaacuuu

SEQ ID NO: 1617947 - RNA, 23 nt, Homo sapiens
ccuugcaguuuuacuaaaacacu

SEQ ID NO: 1617948 - RNA, 18 nt, Homo sapiens
ccuugcauguaaaaaccu

SEQ ID NO: 1617949 - RNA, 13 nt, Homo sapiens
ccuugcugugaaa

SEQ ID NO: 1617950 - RNA, 18 nt, Homo sapiens
ccuugcugugaaauuucu

SEQ ID NO: 1617951 - RNA, 12 nt, Homo sapiens
ccuuggcuuuau

SEQ ID NO: 1617952 - RNA, 19 nt, Homo sapiens
ccuuggcuuuaugcaaaua

SEQ ID NO: 1617953 - RNA, 14 nt, Homo sapiens
ccuuguauucugag

SEQ ID NO: 1617954 - RNA, 13 nt, Homo sapiens
ccuuuaaucugca

SEQ ID NO: 1617955 - RNA, 22 nt, Homo sapiens
ccuuucaauaaaguuguugcau

SEQ ID NO: 1617956 - RNA, 15 nt, Homo sapiens
ccuuucccuagagaa

SEQ ID NO: 1617957 - RNA, 21 nt, Homo sapiens
ccuuugcucuuauaaaaucaa

SEQ ID NO: 1617958 - RNA, 17 nt, Homo sapiens
ccuuuggcagaguucua

SEQ ID NO: 1617959 - RNA, 16 nt, Homo sapiens
ccuuugggacuaagcu

SEQ ID NO: 1617960 - RNA, 15 nt, Homo sapiens
ccuuuguagcuacuu

SEQ ID NO: 1617961 - RNA, 18 nt, Homo sapiens
ccuuugucauuauuaguc

SEQ ID NO: 1617962 - RNA, 19 nt, Homo sapiens
ccuuuuaagcaugugaugu

SEQ ID NO: 1617963 - RNA, 20 nt, Homo sapiens
cgaaacuccauugagucauu

SEQ ID NO: 1617964 - RNA, 21 nt, Homo sapiens
cgaaucacacagacaguuucu

SEQ ID NO: 1617965 - RNA, 23 nt, Homo sapiens
cgagaguguguguauauguauua

SEQ ID NO: 1617966 - RNA, 15 nt, Homo sapiens
cgagcagcugagcag

SEQ ID NO: 1617967 - RNA, 12 nt, Homo sapiens
cgaggugguuca

SEQ ID NO: 1617968 - RNA, 19 nt, Homo sapiens
cgaguaacuccccucaggg

SEQ ID NO: 1617969 - RNA, 19 nt, Homo sapiens
cgaguacucuugaacacaa

SEQ ID NO: 1617970 - RNA, 17 nt, Homo sapiens
cgaguuguuggcugcuc

SEQ ID NO: 1617971 - RNA, 12 nt, Homo sapiens
cgaugugcccag

SEQ ID NO: 1617972 - RNA, 16 nt, Homo sapiens
cgauucccaagcuccc

SEQ ID NO: 1617973 - RNA, 12 nt, Homo sapiens
cgcacccggcuc

SEQ ID NO: 1617974 - RNA, 21 nt, Homo sapiens
cgccagauaaaauguucagug

SEQ ID NO: 1617975 - RNA, 16 nt, Homo sapiens
cgccaggcugaccaca

SEQ ID NO: 1617976 - RNA, 14 nt, Homo sapiens
cgccaucaugucuu

SEQ ID NO: 1617977 - RNA, 19 nt, Homo sapiens
cgcccaggcuggagugcag

SEQ ID NO: 1617978 - RNA, 23 nt, Homo sapiens
cgccccagcaggugcugacuuca

SEQ ID NO: 1617979 - RNA, 13 nt, Homo sapiens
cgcccuccacaaa

SEQ ID NO: 1617980 - RNA, 21 nt, Homo sapiens
cuguacugggccauguugugc

SEQ ID NO: 1617981 - RNA, 20 nt, Homo sapiens
cuguagaacuuauucucugu

SEQ ID NO: 1617982 - RNA, 17 nt, Homo sapiens
cuguagcucaaucugca

SEQ ID NO: 1617983 - RNA, 18 nt, Homo sapiens
cuguagcucaaucugcaa

SEQ ID NO: 1617984 - RNA, 21 nt, Homo sapiens
cuguaucuccagccacuccaa

SEQ ID NO: 1617985 - RNA, 22 nt, Homo sapiens
cuguaugucaauaaacaacagc

SEQ ID NO: 1617986 - RNA, 15 nt, Homo sapiens
cugucaagcuggugc

SEQ ID NO: 1617987 - RNA, 18 nt, Homo sapiens
cugucaccugagacccaa

SEQ ID NO: 1617988 - RNA, 20 nt, Homo sapiens
cugucauuucagauauucca

SEQ ID NO: 1617989 - RNA, 14 nt, Homo sapiens
cuguccaagacagg

SEQ ID NO: 1617990 - RNA, 14 nt, Homo sapiens
cuguccccacugcc

SEQ ID NO: 1617991 - RNA, 16 nt, Homo sapiens
cuguccccacugcccc

SEQ ID NO: 1617992 - RNA, 22 nt, Homo sapiens
cuguccugcagcaaacacucca

SEQ ID NO: 1617993 - RNA, 18 nt, Homo sapiens
cuguccuguuucugucaa

SEQ ID NO: 1617994 - RNA, 19 nt, Homo sapiens
cugucuaugaacuugcaaa

SEQ ID NO: 1617995 - RNA, 17 nt, Homo sapiens
cugucucugaaguacua

SEQ ID NO: 1617996 - RNA, 18 nt, Homo sapiens
cugucuguuacacuggag

SEQ ID NO: 1617997 - RNA, 17 nt, Homo sapiens
cugucuuuuauuuaaca

SEQ ID NO: 1617998 - RNA, 18 nt, Homo sapiens
cugugaacuuucauguca

SEQ ID NO: 1617999 - RNA, 16 nt, Homo sapiens
cugugacacuuaucuc

SEQ ID NO: 1618000 - RNA, 22 nt, Homo sapiens
cugugaccugcugagcucugag

SEQ ID NO: 1618001 - RNA, 20 nt, Homo sapiens
cugugauguucccaccugcu

SEQ ID NO: 1618002 - RNA, 18 nt, Homo sapiens
cugugauuuaucuuucaa

SEQ ID NO: 1618003 - RNA, 10 nt, Homo sapiens
cugugccaac

SEQ ID NO: 1618004 - RNA, 23 nt, Homo sapiens
cugugccaauacagacaaagcau

SEQ ID NO: 1618005 - RNA, 15 nt, Homo sapiens
cugugcuacguguga

SEQ ID NO: 1618006 - RNA, 14 nt, Homo sapiens
cugugcugggggaa

SEQ ID NO: 1618007 - RNA, 20 nt, Homo sapiens
cuguggaaugagugugcaug

SEQ ID NO: 1618008 - RNA, 21 nt, Homo sapiens
cuguggagaucagaaagugac

SEQ ID NO: 1618009 - RNA, 22 nt, Homo sapiens
cugugucauucuguuagauacu

SEQ ID NO: 1618010 - RNA, 15 nt, Homo sapiens
cugugucuguauaca

SEQ ID NO: 1618011 - RNA, 23 nt, Homo sapiens
cuguguuacugcuuugcaaagac

SEQ ID NO: 1618012 - RNA, 18 nt, Homo sapiens
cuguguuuauaugucuug

SEQ ID NO: 1618013 - RNA, 10 nt, Homo sapiens
cuguguuuca

SEQ ID NO: 1618014 - RNA, 16 nt, Homo sapiens
cuguguuucugcaaua

SEQ ID NO: 1618015 - RNA, 15 nt, Homo sapiens
cuguuaguguuaaaa

SEQ ID NO: 1618016 - RNA, 14 nt, Homo sapiens
cuguucauuucaca

SEQ ID NO: 1618017 - RNA, 17 nt, Homo sapiens
cuguuccagauuccuau

SEQ ID NO: 1618018 - RNA, 18 nt, Homo sapiens
cuguugaauuucccacau

SEQ ID NO: 1618019 - RNA, 22 nt, Homo sapiens
cuguugacuggcugugugaccu

SEQ ID NO: 1618020 - RNA, 17 nt, Homo sapiens
cuguuuaaugucugcca

SEQ ID NO: 1618021 - RNA, 19 nt, Homo sapiens
cuguuuugugccagugcua

SEQ ID NO: 1618022 - RNA, 20 nt, Homo sapiens
cuguuuuuacuaaguuuuca

SEQ ID NO: 1618023 - RNA, 19 nt, Homo sapiens
cuguuuuugucuacacucu

SEQ ID NO: 1618024 - RNA, 22 nt, Homo sapiens
cuguuuuuuuuuuuuagccaua

SEQ ID NO: 1618025 - RNA, 17 nt, Homo sapiens
cuuaaauauugcucuau

SEQ ID NO: 1618026 - RNA, 23 nt, Homo sapiens
cuuaaauauuguaauaugacaga

SEQ ID NO: 1618027 - RNA, 15 nt, Homo sapiens
cuuaacacauucaau

SEQ ID NO: 1618028 - RNA, 21 nt, Homo sapiens
cuuaagaacugcuucauguga

SEQ ID NO: 1618029 - RNA, 17 nt, Homo sapiens
cuuaaguuuuacuugag

SEQ ID NO: 1618030 - RNA, 12 nt, Homo sapiens
cuuaaugcacag

SEQ ID NO: 1618031 - RNA, 19 nt, Homo sapiens
cuuaaugguauccuacuga

SEQ ID NO: 1618032 - RNA, 16 nt, Homo sapiens
cuuaaugguguuguuu

SEQ ID NO: 1618033 - RNA, 18 nt, Homo sapiens
cuuaccuaucuguggaaa

SEQ ID NO: 1618034 - RNA, 13 nt, Homo sapiens
cuuacuggugcua

SEQ ID NO: 1618035 - RNA, 15 nt, Homo sapiens
cuuagaguguagcug

SEQ ID NO: 1618036 - RNA, 18 nt, Homo sapiens
cuuagaguguagcuguaa

SEQ ID NO: 1618037 - RNA, 19 nt, Homo sapiens
cuuauaaaaauaaagggaa

SEQ ID NO: 1618038 - RNA, 13 nt, Homo sapiens
cuuauaugugaca

SEQ ID NO: 1618039 - RNA, 15 nt, Homo sapiens
cuuauaugugacacu

SEQ ID NO: 1618040 - RNA, 18 nt, Homo sapiens
cuuauguggaacuguaca

SEQ ID NO: 1618041 - RNA, 16 nt, Homo sapiens
cuuauugacucauaca

SEQ ID NO: 1618042 - RNA, 16 nt, Homo sapiens
cuuauuuuuagccaua

SEQ ID NO: 1618043 - RNA, 21 nt, Homo sapiens
cuucaaaauaaaaaguaauga

SEQ ID NO: 1618044 - RNA, 13 nt, Homo sapiens
cuucaaagccacu

SEQ ID NO: 1618045 - RNA, 22 nt, Homo sapiens
cuucaauguauugagcauguga

SEQ ID NO: 1618046 - RNA, 15 nt, Homo sapiens
cuucaccucacugaa

SEQ ID NO: 1618047 - RNA, 12 nt, Homo sapiens
cuucacucucca

SEQ ID NO: 1618048 - RNA, 15 nt, Homo sapiens
cuucagauguuggua

SEQ ID NO: 1618049 - RNA, 13 nt, Homo sapiens
cuucagcaaguua

SEQ ID NO: 1618050 - RNA, 16 nt, Homo sapiens
cuucaguaacaagugu

SEQ ID NO: 1618051 - RNA, 20 nt, Homo sapiens
cuucaguucucuacucccuc

SEQ ID NO: 1618052 - RNA, 16 nt, Homo sapiens
cuucauucacauucag

SEQ ID NO: 1618053 - RNA, 18 nt, Homo sapiens
cuucauuccuuccacuaa

SEQ ID NO: 1618054 - RNA, 21 nt, Homo sapiens
cuuccaaguccuuuaucugca

SEQ ID NO: 1618055 - RNA, 23 nt, Homo sapiens
cuuccagcaagcaaagugcuuug

SEQ ID NO: 1618056 - RNA, 18 nt, Homo sapiens
cuucccccuuccaaauaa

SEQ ID NO: 1618057 - RNA, 19 nt, Homo sapiens
cuucccuacacagggccug

SEQ ID NO: 1618058 - RNA, 19 nt, Homo sapiens
cuucccuuuauuacaagaa

SEQ ID NO: 1618059 - RNA, 23 nt, Homo sapiens
cuuccgcuuugaaagaagcaaga

SEQ ID NO: 1618060 - RNA, 22 nt, Homo sapiens
cuuccuucccagaauguuacug

SEQ ID NO: 1618061 - RNA, 17 nt, Homo sapiens
cuuccuuuuaacugcca

SEQ ID NO: 1618062 - RNA, 19 nt, Homo sapiens
cuucgcacacacccaugua

SEQ ID NO: 1618063 - RNA, 16 nt, Homo sapiens
cuucuaggaauggagg

SEQ ID NO: 1618064 - RNA, 16 nt, Homo sapiens
cuucuccaugcugcaa

SEQ ID NO: 1618065 - RNA, 23 nt, Homo sapiens
cuucuccaugcugcaaaggagaa

SEQ ID NO: 1618066 - RNA, 22 nt, Homo sapiens
cuucucuacacccacccaaaag

SEQ ID NO: 1618067 - RNA, 22 nt, Homo sapiens
cuucugauuaaaguaaguagaa

SEQ ID NO: 1618068 - RNA, 21 nt, Homo sapiens
cuucuggagaaaaaggugcca

SEQ ID NO: 1618069 - RNA, 14 nt, Homo sapiens
cuucuuacuaagcu

SEQ ID NO: 1618070 - RNA, 16 nt, Homo sapiens
cuucuuacuggugcua

SEQ ID NO: 1618071 - RNA, 21 nt, Homo sapiens
cuucuucaagauuuauggaaa

SEQ ID NO: 1618072 - RNA, 21 nt, Homo sapiens
cuucuuccuuauuucacugaa

SEQ ID NO: 1618073 - RNA, 11 nt, Homo sapiens
cuucuugucag

SEQ ID NO: 1618074 - RNA, 19 nt, Homo sapiens
cuucuuucccuuagugacu

SEQ ID NO: 1618075 - RNA, 16 nt, Homo sapiens
cuugaaguacuuaaca

SEQ ID NO: 1618076 - RNA, 14 nt, Homo sapiens
cuugaauuuaauac

SEQ ID NO: 1618077 - RNA, 20 nt, Homo sapiens
cuugacuguuaguuguccac

SEQ ID NO: 1618078 - RNA, 20 nt, Homo sapiens
cuugagcuggauucacuugg

SEQ ID NO: 1618079 - RNA, 23 nt, Homo sapiens
cuugaucggaaagcucuuccuaa

SEQ ID NO: 1618080 - RNA, 20 nt, Homo sapiens
cuugaugccauaugccuugg

SEQ ID NO: 1618081 - RNA, 13 nt, Homo sapiens
cuugauuaagggc

SEQ ID NO: 1618082 - RNA, 13 nt, Homo sapiens
cuugcaaagccuu

SEQ ID NO: 1618083 - RNA, 20 nt, Homo sapiens
cuugcaugcuugcauaagag

SEQ ID NO: 1618084 - RNA, 20 nt, Homo sapiens
cuugccuaaauacaagggcu

SEQ ID NO: 1618085 - RNA, 12 nt, Homo sapiens
cuugcucagugg

SEQ ID NO: 1618086 - RNA, 13 nt, Homo sapiens
cuugcucaugagc

SEQ ID NO: 1618087 - RNA, 12 nt, Homo sapiens
cuugcugugaaa

SEQ ID NO: 1618088 - RNA, 17 nt, Homo sapiens
cuugcuuuuugcugugu

SEQ ID NO: 1618089 - RNA, 16 nt, Homo sapiens
gacucugcacaugucu

SEQ ID NO: 1618090 - RNA, 20 nt, Homo sapiens
gacucugcacaugucuugua

SEQ ID NO: 1618091 - RNA, 20 nt, Homo sapiens
gacugaagugaacuaugaag

SEQ ID NO: 1618092 - RNA, 18 nt, Homo sapiens
gacugauugauuauucaa

SEQ ID NO: 1618093 - RNA, 11 nt, Homo sapiens
gacugccacag

SEQ ID NO: 1618094 - RNA, 22 nt, Homo sapiens
gacugcuauucuagagcuuuua

SEQ ID NO: 1618095 - RNA, 15 nt, Homo sapiens
gacugucacuugcug

SEQ ID NO: 1618096 - RNA, 16 nt, Homo sapiens
gacugucuaugaacuu

SEQ ID NO: 1618097 - RNA, 14 nt, Homo sapiens
gacuuauguggaac

SEQ ID NO: 1618098 - RNA, 15 nt, Homo sapiens
gacuuauugccaaaa

SEQ ID NO: 1618099 - RNA, 20 nt, Homo sapiens
gacuucuggagaaagcucau

SEQ ID NO: 1618100 - RNA, 19 nt, Homo sapiens
gacuuggcacuccuggaca

SEQ ID NO: 1618101 - RNA, 13 nt, Homo sapiens
gacuuuguguuca

SEQ ID NO: 1618102 - RNA, 15 nt, Homo sapiens
gagaaacaauggcua

SEQ ID NO: 1618103 - RNA, 16 nt, Homo sapiens
gagaaacagccugugu

SEQ ID NO: 1618104 - RNA, 15 nt, Homo sapiens
gagaaacugccacau

SEQ ID NO: 1618105 - RNA, 14 nt, Homo sapiens
gagaaauggccaaa

SEQ ID NO: 1618106 - RNA, 23 nt, Homo sapiens
gagaaauuccuuagucauggugu

SEQ ID NO: 1618107 - RNA, 20 nt, Homo sapiens
gagaaauugaacuucaggga

SEQ ID NO: 1618108 - RNA, 14 nt, Homo sapiens
gagaagcaaugggu

SEQ ID NO: 1618109 - RNA, 16 nt, Homo sapiens
gagaagcacagcuccu

SEQ ID NO: 1618110 - RNA, 11 nt, Homo sapiens
gagaagggaca

SEQ ID NO: 1618111 - RNA, 16 nt, Homo sapiens
gagaauucaggcaaac

SEQ ID NO: 1618112 - RNA, 14 nt, Homo sapiens
gagacaacagguaa

SEQ ID NO: 1618113 - RNA, 15 nt, Homo sapiens
gagacaaggugcuaa

SEQ ID NO: 1618114 - RNA, 15 nt, Homo sapiens
gagaccacacauuuu

SEQ ID NO: 1618115 - RNA, 21 nt, Homo sapiens
gagagcccccacccaguuccu

SEQ ID NO: 1618116 - RNA, 16 nt, Homo sapiens
gagagggugacaagau

SEQ ID NO: 1618117 - RNA, 21 nt, Homo sapiens
gagaggucagccuugaccuaa

SEQ ID NO: 1618118 - RNA, 15 nt, Homo sapiens
gagauauacauugug

SEQ ID NO: 1618119 - RNA, 22 nt, Homo sapiens
gagauauuucaagcucauguca

SEQ ID NO: 1618120 - RNA, 14 nt, Homo sapiens
gagaugacagggaa

SEQ ID NO: 1618121 - RNA, 17 nt, Homo sapiens
gagaugagguuucacca

SEQ ID NO: 1618122 - RNA, 12 nt, Homo sapiens
gagaugcagcug

SEQ ID NO: 1618123 - RNA, 18 nt, Homo sapiens
gagauggagucucacucu

SEQ ID NO: 1618124 - RNA, 21 nt, Homo sapiens
gagauucaagggacccaugag

SEQ ID NO: 1618125 - RNA, 18 nt, Homo sapiens
gagcaaaaaucugagaaa

SEQ ID NO: 1618126 - RNA, 20 nt, Homo sapiens
gagcaaacucugcugucuaa

SEQ ID NO: 1618127 - RNA, 18 nt, Homo sapiens
gagcaccuugcaguuccc

SEQ ID NO: 1618128 - RNA, 21 nt, Homo sapiens
gagcagaauguuguacuugaa

SEQ ID NO: 1618129 - RNA, 14 nt, Homo sapiens
gagcagacaggcua

SEQ ID NO: 1618130 - RNA, 14 nt, Homo sapiens
gagcauuugcaccu

SEQ ID NO: 1618131 - RNA, 18 nt, Homo sapiens
gagccaaagcuuauguga

SEQ ID NO: 1618132 - RNA, 21 nt, Homo sapiens
gagccacaagcugcacuguga

SEQ ID NO: 1618133 - RNA, 20 nt, Homo sapiens
gagccaccacgccuggcugg

SEQ ID NO: 1618134 - RNA, 16 nt, Homo sapiens
gagccacucuguuccu

SEQ ID NO: 1618135 - RNA, 18 nt, Homo sapiens
gagccagccacacuugaa

SEQ ID NO: 1618136 - RNA, 21 nt, Homo sapiens
gagccccuuugccugucaagu

SEQ ID NO: 1618137 - RNA, 20 nt, Homo sapiens
gagccuggaagacacccuaa

SEQ ID NO: 1618138 - RNA, 18 nt, Homo sapiens
gagccuuauaaacagaua

SEQ ID NO: 1618139 - RNA, 16 nt, Homo sapiens
gagcgucacggccaag

SEQ ID NO: 1618140 - RNA, 14 nt, Homo sapiens
gagcgugcuuucaa

SEQ ID NO: 1618141 - RNA, 12 nt, Homo sapiens
gagcuauaacuu

SEQ ID NO: 1618142 - RNA, 23 nt, Homo sapiens
gagcuaugugacucggauggucu

SEQ ID NO: 1618143 - RNA, 15 nt, Homo sapiens
gagcucuacaggccu

SEQ ID NO: 1618144 - RNA, 23 nt, Homo sapiens
gagcugguggggaggagccugga

SEQ ID NO: 1618145 - RNA, 20 nt, Homo sapiens
gaggaaugcuggacuggagg

SEQ ID NO: 1618146 - RNA, 22 nt, Homo sapiens
gaggagucugagguccugagca

SEQ ID NO: 1618147 - RNA, 22 nt, Homo sapiens
gaggcagggacaagucuuucuc

SEQ ID NO: 1618148 - RNA, 12 nt, Homo sapiens
gaggccaucuca

SEQ ID NO: 1618149 - RNA, 15 nt, Homo sapiens
gaggcccccaucucc

SEQ ID NO: 1618150 - RNA, 19 nt, Homo sapiens
gaggccccuggagccagau

SEQ ID NO: 1618151 - RNA, 19 nt, Homo sapiens
gaggccccugucucagggu

SEQ ID NO: 1618152 - RNA, 18 nt, Homo sapiens
gaggcccuccugugcugg

SEQ ID NO: 1618153 - RNA, 13 nt, Homo sapiens
gaggccugugcua

SEQ ID NO: 1618154 - RNA, 16 nt, Homo sapiens
gaggcugauuccucuc

SEQ ID NO: 1618155 - RNA, 19 nt, Homo sapiens
gaggcuucccuacacaggg

SEQ ID NO: 1618156 - RNA, 13 nt, Homo sapiens
gagggagguguuu

SEQ ID NO: 1618157 - RNA, 21 nt, Homo sapiens
gagggcagcccccucccuaga

SEQ ID NO: 1618158 - RNA, 21 nt, Homo sapiens
gagggccuaaccgagaucagu

SEQ ID NO: 1618159 - RNA, 12 nt, Homo sapiens
gagggucucaga

SEQ ID NO: 1618160 - RNA, 19 nt, Homo sapiens
gaggucaccagcugcugug

SEQ ID NO: 1618161 - RNA, 23 nt, Homo sapiens
gaggucagggagugcuggcucac

SEQ ID NO: 1618162 - RNA, 17 nt, Homo sapiens
gaggucuccaaacugau

SEQ ID NO: 1618163 - RNA, 19 nt, Homo sapiens
gaggugaauacucuugaaa

SEQ ID NO: 1618164 - RNA, 16 nt, Homo sapiens
gaggugcaacaagguc

SEQ ID NO: 1618165 - RNA, 16 nt, Homo sapiens
gaggugccacccagua

SEQ ID NO: 1618166 - RNA, 21 nt, Homo sapiens
gaggugcccacuccgccagcc

SEQ ID NO: 1618167 - RNA, 19 nt, Homo sapiens
gaggugguucagacaagac

SEQ ID NO: 1618168 - RNA, 21 nt, Homo sapiens
gagguguuuaacggcacugug

SEQ ID NO: 1618169 - RNA, 20 nt, Homo sapiens
gaguaccuguccaagacagg

SEQ ID NO: 1618170 - RNA, 18 nt, Homo sapiens
gagucauggcuaauuuaa

SEQ ID NO: 1618171 - RNA, 22 nt, Homo sapiens
gagucauguugaaggugcccaa

SEQ ID NO: 1618172 - RNA, 14 nt, Homo sapiens
gagucucacuuugg

SEQ ID NO: 1618173 - RNA, 14 nt, Homo sapiens
gagucucucuucca

SEQ ID NO: 1618174 - RNA, 16 nt, Homo sapiens
gagucugcacgggacc

SEQ ID NO: 1618175 - RNA, 13 nt, Homo sapiens
gagugaccagcac

SEQ ID NO: 1618176 - RNA, 22 nt, Homo sapiens
gagugagguguugcagcccaaa

SEQ ID NO: 1618177 - RNA, 16 nt, Homo sapiens
gagugcaguggcacga

SEQ ID NO: 1618178 - RNA, 19 nt, Homo sapiens
gagugcaguggcgugaucu

SEQ ID NO: 1618179 - RNA, 15 nt, Homo sapiens
gagugcaguggugcg

SEQ ID NO: 1618180 - RNA, 12 nt, Homo sapiens
gagugcauuuag

SEQ ID NO: 1618181 - RNA, 20 nt, Homo sapiens
gaguugccaggcacuuugag

SEQ ID NO: 1618182 - RNA, 22 nt, Homo sapiens
gaguuuaauuuuugaaaacugg

SEQ ID NO: 1618183 - RNA, 14 nt, Homo sapiens
gaguuucaaauccc

SEQ ID NO: 1618184 - RNA, 22 nt, Homo sapiens
gauaaaagagaagccaaacagc

SEQ ID NO: 1618185 - RNA, 18 nt, Homo sapiens
gauaaaguaaugaucuca

SEQ ID NO: 1618186 - RNA, 15 nt, Homo sapiens
gauaaggaaauaaga

SEQ ID NO: 1618187 - RNA, 15 nt, Homo sapiens
gauacaaacauguuc

SEQ ID NO: 1618188 - RNA, 22 nt, Homo sapiens
gauacugcugcgucauuacagg

SEQ ID NO: 1618189 - RNA, 21 nt, Homo sapiens
gauagaacacaaaacuugaaa

SEQ ID NO: 1618190 - RNA, 15 nt, Homo sapiens
gauagauaaugccuu

SEQ ID NO: 1618191 - RNA, 18 nt, Homo sapiens
gauagauguugcucuuuc

SEQ ID NO: 1618192 - RNA, 19 nt, Homo sapiens
gauagauguugcucuuuca

SEQ ID NO: 1618193 - RNA, 21 nt, Homo sapiens
gauaggaagacgcagagcaaa

SEQ ID NO: 1618194 - RNA, 20 nt, Homo sapiens
gauauaacacuauguuuauu

SEQ ID NO: 1618195 - RNA, 22 nt, Homo sapiens
gauauauauaugcuuggcuaac

SEQ ID NO: 1618196 - RNA, 14 nt, Homo sapiens
gauauucuuuacaa

SEQ ID NO: 1618197 - RNA, 21 nt, Homo sapiens
gauauugaucaaauauagaaa

SEQ ID NO: 1618198 - RNA, 17 nt, Homo sapiens
gauauuuuuuggugugc

SEQ ID NO: 1618199 - RNA, 19 nt, Homo sapiens
uccccaccuuccuuaccuc

SEQ ID NO: 1618200 - RNA, 14 nt, Homo sapiens
uccccaggggcaug

SEQ ID NO: 1618201 - RNA, 17 nt, Homo sapiens
ucccccuaauauuaggg

SEQ ID NO: 1618202 - RNA, 15 nt, Homo sapiens
ucccccugcaacuuc

SEQ ID NO: 1618203 - RNA, 15 nt, Homo sapiens
uccccuacuucucag

SEQ ID NO: 1618204 - RNA, 16 nt, Homo sapiens
uccccucacacacaaa

SEQ ID NO: 1618205 - RNA, 20 nt, Homo sapiens
uccccucacccaugcuuuca

SEQ ID NO: 1618206 - RNA, 16 nt, Homo sapiens
uccccugaccugugag

SEQ ID NO: 1618207 - RNA, 19 nt, Homo sapiens
uccccuugccuaaauacaa

SEQ ID NO: 1618208 - RNA, 20 nt, Homo sapiens
ucccgaguagcugggauuac

SEQ ID NO: 1618209 - RNA, 20 nt, Homo sapiens
ucccuaaaauaaagaucacc

SEQ ID NO: 1618210 - RNA, 19 nt, Homo sapiens
ucccuaccugacugccaca

SEQ ID NO: 1618211 - RNA, 18 nt, Homo sapiens
ucccuauaucagggccug

SEQ ID NO: 1618212 - RNA, 15 nt, Homo sapiens
ucccugcugugccau

SEQ ID NO: 1618213 - RNA, 13 nt, Homo sapiens
ucccugggcauug

SEQ ID NO: 1618214 - RNA, 21 nt, Homo sapiens
ucccuucccagcgcugcuggu

SEQ ID NO: 1618215 - RNA, 18 nt, Homo sapiens
ucccuuccucuuccugcc

SEQ ID NO: 1618216 - RNA, 16 nt, Homo sapiens
ucccuugcccauguga

SEQ ID NO: 1618217 - RNA, 21 nt, Homo sapiens
uccgaggccccugucucaggg

SEQ ID NO: 1618218 - RNA, 16 nt, Homo sapiens
uccgccagauccugca

SEQ ID NO: 1618219 - RNA, 13 nt, Homo sapiens
uccgccugccuca

SEQ ID NO: 1618220 - RNA, 20 nt, Homo sapiens
uccguucaauaagcauuuca

SEQ ID NO: 1618221 - RNA, 23 nt, Homo sapiens
uccuaaagaaaaauaucuuggcc

SEQ ID NO: 1618222 - RNA, 16 nt, Homo sapiens
uccuaagaaugugaug

SEQ ID NO: 1618223 - RNA, 15 nt, Homo sapiens
uccuacguauccugc

SEQ ID NO: 1618224 - RNA, 23 nt, Homo sapiens
uccuagaaaguucuguguaaaca

SEQ ID NO: 1618225 - RNA, 17 nt, Homo sapiens
uccuaugcugcaauaca

SEQ ID NO: 1618226 - RNA, 15 nt, Homo sapiens
uccucaaagcauuug

SEQ ID NO: 1618227 - RNA, 21 nt, Homo sapiens
uccucacacacccugagguca

SEQ ID NO: 1618228 - RNA, 16 nt, Homo sapiens
uccuccaacaccaagc

SEQ ID NO: 1618229 - RNA, 15 nt, Homo sapiens
uccuccaagcucacg

SEQ ID NO: 1618230 - RNA, 19 nt, Homo sapiens
uccuccagcguggugugag

SEQ ID NO: 1618231 - RNA, 14 nt, Homo sapiens
uccucucucccugc

SEQ ID NO: 1618232 - RNA, 10 nt, Homo sapiens
uccucugcau

SEQ ID NO: 1618233 - RNA, 17 nt, Homo sapiens
uccucugcauuuacaca

SEQ ID NO: 1618234 - RNA, 11 nt, Homo sapiens
uccucugccag

SEQ ID NO: 1618235 - RNA, 17 nt, Homo sapiens
uccucugccagcaggaa

SEQ ID NO: 1618236 - RNA, 23 nt, Homo sapiens
uccucuggaucacagacacugca

SEQ ID NO: 1618237 - RNA, 14 nt, Homo sapiens
uccucuugugauuu

SEQ ID NO: 1618238 - RNA, 21 nt, Homo sapiens
uccugaaauuugagagacaaa

SEQ ID NO: 1618239 - RNA, 13 nt, Homo sapiens
uccugcaguuccc

SEQ ID NO: 1618240 - RNA, 12 nt, Homo sapiens
uccugcauuucu

SEQ ID NO: 1618241 - RNA, 17 nt, Homo sapiens
uccuggaaauucugcug

SEQ ID NO: 1618242 - RNA, 13 nt, Homo sapiens
uccuggccucaga

SEQ ID NO: 1618243 - RNA, 15 nt, Homo sapiens
uccuggccucagagc

SEQ ID NO: 1618244 - RNA, 15 nt, Homo sapiens
uccugggaucacuga

SEQ ID NO: 1618245 - RNA, 21 nt, Homo sapiens
uccuggggaggauacugaggc

SEQ ID NO: 1618246 - RNA, 14 nt, Homo sapiens
uccuggugugaagg

SEQ ID NO: 1618247 - RNA, 23 nt, Homo sapiens
uccuggugugaagguccugcuau

SEQ ID NO: 1618248 - RNA, 21 nt, Homo sapiens
uccuguggcauguugauuucu

SEQ ID NO: 1618249 - RNA, 15 nt, Homo sapiens
uccuguggucucuga

SEQ ID NO: 1618250 - RNA, 19 nt, Homo sapiens
uccugugguuuuauuacaa

SEQ ID NO: 1618251 - RNA, 17 nt, Homo sapiens
uccuuaacacauucaau

SEQ ID NO: 1618252 - RNA, 14 nt, Homo sapiens
uccuuaggccucug

SEQ ID NO: 1618253 - RNA, 18 nt, Homo sapiens
uccuucuauucuagccug

SEQ ID NO: 1618254 - RNA, 14 nt, Homo sapiens
uccuugacuuugaa

SEQ ID NO: 1618255 - RNA, 17 nt, Homo sapiens
uccuugauaaaguauua

SEQ ID NO: 1618256 - RNA, 10 nt, Homo sapiens
uccuuggcau

SEQ ID NO: 1618257 - RNA, 17 nt, Homo sapiens
uccuuugguccuucaaa

SEQ ID NO: 1618258 - RNA, 19 nt, Homo sapiens
uccuuuuuuaaaaaugcaa

SEQ ID NO: 1618259 - RNA, 21 nt, Homo sapiens
uccuuuuuuggggaguaccug

SEQ ID NO: 1618260 - RNA, 22 nt, Homo sapiens
uccuuuuuuggggaguaccugu

SEQ ID NO: 1618261 - RNA, 20 nt, Homo sapiens
ucgaaaccuacaagauuucc

SEQ ID NO: 1618262 - RNA, 12 nt, Homo sapiens
ucgacagacagc

SEQ ID NO: 1618263 - RNA, 20 nt, Homo sapiens
ucgauggaugggaugcacuc

SEQ ID NO: 1618264 - RNA, 18 nt, Homo sapiens
ucgauuuucuauuaugga

SEQ ID NO: 1618265 - RNA, 16 nt, Homo sapiens
ucgcagccacccugag

SEQ ID NO: 1618266 - RNA, 21 nt, Homo sapiens
ucgcccugcgguagaugggag

SEQ ID NO: 1618267 - RNA, 16 nt, Homo sapiens
ucgcuccccacucugc

SEQ ID NO: 1618268 - RNA, 19 nt, Homo sapiens
ucgcucuugaggagcucaa

SEQ ID NO: 1618269 - RNA, 21 nt, Homo sapiens
ucgcucuugucugucugucuc

SEQ ID NO: 1618270 - RNA, 22 nt, Homo sapiens
ucgcuguuggagcaaaccauua

SEQ ID NO: 1618271 - RNA, 16 nt, Homo sapiens
ucgcuuaagccagcac

SEQ ID NO: 1618272 - RNA, 12 nt, Homo sapiens
ucggauaugauu

SEQ ID NO: 1618273 - RNA, 14 nt, Homo sapiens
ucggccccaucucu

SEQ ID NO: 1618274 - RNA, 19 nt, Homo sapiens
ucggcucuggagauuaucc

SEQ ID NO: 1618275 - RNA, 15 nt, Homo sapiens
ucggcuuuuugccau

SEQ ID NO: 1618276 - RNA, 21 nt, Homo sapiens
ucggcuuuuugccaucuguga

SEQ ID NO: 1618277 - RNA, 17 nt, Homo sapiens
ucgggcgcgaccugcug

SEQ ID NO: 1618278 - RNA, 19 nt, Homo sapiens
ucgguuguucuuuccucac

SEQ ID NO: 1618279 - RNA, 19 nt, Homo sapiens
ucgugguaggacuguagaa

SEQ ID NO: 1618280 - RNA, 22 nt, Homo sapiens
ucuaaacuaggauugacauucu

SEQ ID NO: 1618281 - RNA, 18 nt, Homo sapiens
ucuaaaugauuaucuuga

SEQ ID NO: 1618282 - RNA, 19 nt, Homo sapiens
ucuaaaugauuaucuugaa

SEQ ID NO: 1618283 - RNA, 19 nt, Homo sapiens
ucuaacuuuugugugaaau

SEQ ID NO: 1618284 - RNA, 17 nt, Homo sapiens
ucuaagcuuuucauuaa

SEQ ID NO: 1618285 - RNA, 18 nt, Homo sapiens
ucuacagauggcauaccu

SEQ ID NO: 1618286 - RNA, 17 nt, Homo sapiens
ucuacuccucccucuga

SEQ ID NO: 1618287 - RNA, 23 nt, Homo sapiens
ucuacucugcuuuuuuucuacug

SEQ ID NO: 1618288 - RNA, 19 nt, Homo sapiens
ucuaggccaccccaaccuc

SEQ ID NO: 1618289 - RNA, 21 nt, Homo sapiens
ucuagggaaugggacugugag

SEQ ID NO: 1618290 - RNA, 20 nt, Homo sapiens
ucuaguggguugaccuuuaa

SEQ ID NO: 1618291 - RNA, 16 nt, Homo sapiens
ucuaguucagcugccc

SEQ ID NO: 1618292 - RNA, 18 nt, Homo sapiens
ucuauaccuuacugcaau

SEQ ID NO: 1618293 - RNA, 15 nt, Homo sapiens
ucuaucccuuaccug

SEQ ID NO: 1618294 - RNA, 20 nt, Homo sapiens
ucuaucugacucucgcugug

SEQ ID NO: 1618295 - RNA, 14 nt, Homo sapiens
ucuaugaacuugca

SEQ ID NO: 1618296 - RNA, 15 nt, Homo sapiens
ucuaugaacuugcaa

SEQ ID NO: 1618297 - RNA, 18 nt, Homo sapiens
ucuauguuuguauuugga

SEQ ID NO: 1618298 - RNA, 17 nt, Homo sapiens
ucucaaauuuguggucc

SEQ ID NO: 1618299 - RNA, 16 nt, Homo sapiens
ucucaaucuccugacu

SEQ ID NO: 1618300 - RNA, 20 nt, Homo sapiens
ucucacauaagcccaguuca

SEQ ID NO: 1618301 - RNA, 22 nt, Homo sapiens
ucucacauaagcccaguucauc

SEQ ID NO: 1618302 - RNA, 22 nt, Homo sapiens
ucucagacuuuggaaaaugcau

SEQ ID NO: 1618303 - RNA, 21 nt, Homo sapiens
ucucauaccuuccccacaucu

SEQ ID NO: 1618304 - RNA, 18 nt, Homo sapiens
ucucauguuuuccauugu

SEQ ID NO: 1618305 - RNA, 11 nt, Homo sapiens
ucucauucccu

SEQ ID NO: 1618306 - RNA, 18 nt, Homo sapiens
ucucauucccuccccaga

SEQ ID NO: 1618307 - RNA, 22 nt, Homo sapiens
ucuccaagcuuucagacaagaa

SEQ ID NO: 1618308 - RNA, 13 nt, Homo sapiens
ucuccaugcucac

SEQ ID NO: 1618309 - RNA, 17 nt, Homo sapiens
uggaacaagcacagaug

SEQ ID NO: 1618310 - RNA, 13 nt, Homo sapiens
uggaacagcccau

SEQ ID NO: 1618311 - RNA, 22 nt, Homo sapiens
uggaacuguacaaauugugaug

SEQ ID NO: 1618312 - RNA, 18 nt, Homo sapiens
uggaaggccuucuuucua

SEQ ID NO: 1618313 - RNA, 14 nt, Homo sapiens
uggaaguaguaauu

SEQ ID NO: 1618314 - RNA, 21 nt, Homo sapiens
uggaauagaaacagugguuug

SEQ ID NO: 1618315 - RNA, 14 nt, Homo sapiens
uggaaugaaugaca

SEQ ID NO: 1618316 - RNA, 21 nt, Homo sapiens
uggaauuauuguagacaugcc

SEQ ID NO: 1618317 - RNA, 14 nt, Homo sapiens
uggacacagaggaa

SEQ ID NO: 1618318 - RNA, 15 nt, Homo sapiens
uggacacgagccaca

SEQ ID NO: 1618319 - RNA, 12 nt, Homo sapiens
uggacacuugcg

SEQ ID NO: 1618320 - RNA, 14 nt, Homo sapiens
uggacucugcacau

SEQ ID NO: 1618321 - RNA, 21 nt, Homo sapiens
uggacugucuaugaacuugca

SEQ ID NO: 1618322 - RNA, 16 nt, Homo sapiens
uggagaaccagggcuc

SEQ ID NO: 1618323 - RNA, 17 nt, Homo sapiens
uggagacaaggugcuaa

SEQ ID NO: 1618324 - RNA, 18 nt, Homo sapiens
uggagacccugcaaacag

SEQ ID NO: 1618325 - RNA, 22 nt, Homo sapiens
uggagacuuuuaucuacuucuc

SEQ ID NO: 1618326 - RNA, 15 nt, Homo sapiens
uggagaucacagccc

SEQ ID NO: 1618327 - RNA, 18 nt, Homo sapiens
uggagcuggcacugugga

SEQ ID NO: 1618328 - RNA, 16 nt, Homo sapiens
uggaggaagagccacc

SEQ ID NO: 1618329 - RNA, 14 nt, Homo sapiens
uggaggagacauga

SEQ ID NO: 1618330 - RNA, 14 nt, Homo sapiens
uggaggcaguccau

SEQ ID NO: 1618331 - RNA, 23 nt, Homo sapiens
uggaggcggaauugcucucccag

SEQ ID NO: 1618332 - RNA, 12 nt, Homo sapiens
uggaggcugcuc

SEQ ID NO: 1618333 - RNA, 22 nt, Homo sapiens
uggagggaaggauaaagccacu

SEQ ID NO: 1618334 - RNA, 21 nt, Homo sapiens
uggaguauagugcaaauucau

SEQ ID NO: 1618335 - RNA, 17 nt, Homo sapiens
uggagugcaguggugcg

SEQ ID NO: 1618336 - RNA, 19 nt, Homo sapiens
uggagugcaguggugcgau

SEQ ID NO: 1618337 - RNA, 15 nt, Homo sapiens
uggagugcucacaaa

SEQ ID NO: 1618338 - RNA, 16 nt, Homo sapiens
uggaguguaguggcau

SEQ ID NO: 1618339 - RNA, 18 nt, Homo sapiens
uggaguguaguggcauga

SEQ ID NO: 1618340 - RNA, 20 nt, Homo sapiens
uggaucaguccuuugaucag

SEQ ID NO: 1618341 - RNA, 19 nt, Homo sapiens
uggauccagccaugccuga

SEQ ID NO: 1618342 - RNA, 14 nt, Homo sapiens
uggaugcaggguuu

SEQ ID NO: 1618343 - RNA, 21 nt, Homo sapiens
uggaugggguugugaccaaga

SEQ ID NO: 1618344 - RNA, 14 nt, Homo sapiens
uggauguucacugc

SEQ ID NO: 1618345 - RNA, 15 nt, Homo sapiens
uggauucucauugcc

SEQ ID NO: 1618346 - RNA, 22 nt, Homo sapiens
uggauuuucaaaaagccguuga

SEQ ID NO: 1618347 - RNA, 17 nt, Homo sapiens
uggcaaaacagcccuca

SEQ ID NO: 1618348 - RNA, 17 nt, Homo sapiens
uggcaaacauuuuucca

SEQ ID NO: 1618349 - RNA, 23 nt, Homo sapiens
uggcaaagauuuuuggcacuuug

SEQ ID NO: 1618350 - RNA, 20 nt, Homo sapiens
uggcaauauuccuuagucaa

SEQ ID NO: 1618351 - RNA, 17 nt, Homo sapiens
uggcacuuauaaccaaa

SEQ ID NO: 1618352 - RNA, 12 nt, Homo sapiens
uggcagagccag

SEQ ID NO: 1618353 - RNA, 19 nt, Homo sapiens
uggcaucccggccaggugg

SEQ ID NO: 1618354 - RNA, 19 nt, Homo sapiens
uggcauguguacaaugaaa

SEQ ID NO: 1618355 - RNA, 14 nt, Homo sapiens
uggccaaagucacu

SEQ ID NO: 1618356 - RNA, 15 nt, Homo sapiens
uggccaagccuauca

SEQ ID NO: 1618357 - RNA, 12 nt, Homo sapiens
uggccaagcuga

SEQ ID NO: 1618358 - RNA, 14 nt, Homo sapiens
uggccaaugugcau

SEQ ID NO: 1618359 - RNA, 13 nt, Homo sapiens
uggccaguucauu

SEQ ID NO: 1618360 - RNA, 13 nt, Homo sapiens
uggcccuaaagga

SEQ ID NO: 1618361 - RNA, 15 nt, Homo sapiens
uggccggcacuccau

SEQ ID NO: 1618362 - RNA, 18 nt, Homo sapiens
uggccuaugcacauaugg

SEQ ID NO: 1618363 - RNA, 20 nt, Homo sapiens
uggccucagcugaaugccuc

SEQ ID NO: 1618364 - RNA, 20 nt, Homo sapiens
uggccucccugcugugccau

SEQ ID NO: 1618365 - RNA, 18 nt, Homo sapiens
uggccuggcacacaucag

SEQ ID NO: 1618366 - RNA, 20 nt, Homo sapiens
uggccuucuaggaauggagg

SEQ ID NO: 1618367 - RNA, 15 nt, Homo sapiens
uggccuuugcaauuu

SEQ ID NO: 1618368 - RNA, 14 nt, Homo sapiens
uggcgugcugagaa

SEQ ID NO: 1618369 - RNA, 15 nt, Homo sapiens
uggcuaagauaccaa

SEQ ID NO: 1618370 - RNA, 12 nt, Homo sapiens
uggcucacuggc

SEQ ID NO: 1618371 - RNA, 14 nt, Homo sapiens
uggcucagccucaa

SEQ ID NO: 1618372 - RNA, 19 nt, Homo sapiens
uggcuuagagaggcuugaa

SEQ ID NO: 1618373 - RNA, 17 nt, Homo sapiens
uggcuuuaagccauuau

SEQ ID NO: 1618374 - RNA, 14 nt, Homo sapiens
uggcuuuaugcaaa

SEQ ID NO: 1618375 - RNA, 15 nt, Homo sapiens
uggcuuuaugcaaau

SEQ ID NO: 1618376 - RNA, 19 nt, Homo sapiens
uggcuuuaugcaaauacaa

SEQ ID NO: 1618377 - RNA, 14 nt, Homo sapiens
ugggaaaaccagac

SEQ ID NO: 1618378 - RNA, 15 nt, Homo sapiens
ugggaaaaccagacu

SEQ ID NO: 1618379 - RNA, 16 nt, Homo sapiens
ugggaaagauuacuuu

SEQ ID NO: 1618380 - RNA, 16 nt, Homo sapiens
ugggaagccgugcucg

SEQ ID NO: 1618381 - RNA, 22 nt, Homo sapiens
ugggaagucguccuuacuccug

SEQ ID NO: 1618382 - RNA, 11 nt, Homo sapiens
ugggacagggc

SEQ ID NO: 1618383 - RNA, 15 nt, Homo sapiens
ugggacguggcucag

SEQ ID NO: 1618384 - RNA, 18 nt, Homo sapiens
ugggagaguaccugugug

SEQ ID NO: 1618385 - RNA, 14 nt, Homo sapiens
ugggagagucucac

SEQ ID NO: 1618386 - RNA, 23 nt, Homo sapiens
ugggagauccugcauuucuaaca

SEQ ID NO: 1618387 - RNA, 20 nt, Homo sapiens
ugggagauucaagggaccca

SEQ ID NO: 1618388 - RNA, 15 nt, Homo sapiens
ugggaugcacucuca

SEQ ID NO: 1618389 - RNA, 17 nt, Homo sapiens
ugggcagugagugcagg

SEQ ID NO: 1618390 - RNA, 19 nt, Homo sapiens
ugggcuaaugaagaucaua

SEQ ID NO: 1618391 - RNA, 18 nt, Homo sapiens
ugggcuccuccagggugu

SEQ ID NO: 1618392 - RNA, 19 nt, Homo sapiens
ugggcugggcucgccacau

SEQ ID NO: 1618393 - RNA, 23 nt, Homo sapiens
ugggcuguaacguggcacuggua

SEQ ID NO: 1618394 - RNA, 17 nt, Homo sapiens
uggggaaaaaacugugc

SEQ ID NO: 1618395 - RNA, 23 nt, Homo sapiens
uggggaaggagaaggagugccau

SEQ ID NO: 1618396 - RNA, 14 nt, Homo sapiens
uggggaagggaguc

SEQ ID NO: 1618397 - RNA, 13 nt, Homo sapiens
uggggaggacaaa

SEQ ID NO: 1618398 - RNA, 19 nt, Homo sapiens
uggggagggagguguuuaa

SEQ ID NO: 1618399 - RNA, 13 nt, Homo sapiens
uggggauugcaga

SEQ ID NO: 1618400 - RNA, 19 nt, Homo sapiens
ugggugaucugcugcugag

SEQ ID NO: 1618401 - RNA, 21 nt, Homo sapiens
ugggugauuacauaaucugua

SEQ ID NO: 1618402 - RNA, 14 nt, Homo sapiens
ugggugcucagaau

SEQ ID NO: 1618403 - RNA, 16 nt, Homo sapiens
uggguguacaaacuca

SEQ ID NO: 1618404 - RNA, 16 nt, Homo sapiens
uggguucacaccauuc

SEQ ID NO: 1618405 - RNA, 22 nt, Homo sapiens
uggguuuggcaaaacucaggca

SEQ ID NO: 1618406 - RNA, 15 nt, Homo sapiens
ugguauugcagagaa

SEQ ID NO: 1618407 - RNA, 18 nt, Homo sapiens
uggucaggcuggucucaa

SEQ ID NO: 1618408 - RNA, 17 nt, Homo sapiens
uggucuuugcaaaaagg

SEQ ID NO: 1618409 - RNA, 16 nt, Homo sapiens
uggugaccuuucacga

SEQ ID NO: 1618410 - RNA, 16 nt, Homo sapiens
uggugccaccucagac

SEQ ID NO: 1618411 - RNA, 14 nt, Homo sapiens
ugguguacuguguu

SEQ ID NO: 1618412 - RNA, 18 nt, Homo sapiens
ugguuauccaauugcucu

SEQ ID NO: 1618413 - RNA, 12 nt, Homo sapiens
ugguucuuucag

SEQ ID NO: 1618414 - RNA, 20 nt, Homo sapiens
ugguuggaaaacacuuucau

SEQ ID NO: 1618415 - RNA, 17 nt, Homo sapiens
ugguuuuaaaaaagcau

SEQ ID NO: 1618416 - RNA, 20 nt, Homo sapiens
ugguuuuaaaaaagcauuau

SEQ ID NO: 1618417 - RNA, 12 nt, Homo sapiens
ugguuuuggaca

SEQ ID NO: 1618418 - RNA, 18 nt, Homo sapiens
ugguuuuucaguuuucag

SEQ ID NO: 1618419 - RNA, 17 nt, Homo sapiens
uguaaacaaaccacagc

SEQ ID NO: 1618420 - RNA, 22 nt, Homo sapiens
uguuuuaauccuuaacacauuc

SEQ ID NO: 1618421 - RNA, 19 nt, Homo sapiens
uguuuucaagaugguguua

SEQ ID NO: 1618422 - RNA, 20 nt, Homo sapiens
uguuuugccauguuggccag

SEQ ID NO: 1618423 - RNA, 15 nt, Homo sapiens
uguuuuggcuuuaug

SEQ ID NO: 1618424 - RNA, 20 nt, Homo sapiens
uguuuuuagcugguggcaau

SEQ ID NO: 1618425 - RNA, 17 nt, Homo sapiens
uuaaaacauugguuaua

SEQ ID NO: 1618426 - RNA, 16 nt, Homo sapiens
uuaaaagaaugaguga

SEQ ID NO: 1618427 - RNA, 15 nt, Homo sapiens
uuaaaauaacuaagc

SEQ ID NO: 1618428 - RNA, 19 nt, Homo sapiens
uuaaacaagucaauucugu

SEQ ID NO: 1618429 - RNA, 20 nt, Homo sapiens
uuaaacauugugaucauuag

SEQ ID NO: 1618430 - RNA, 22 nt, Homo sapiens
uuaaacgguaacauccaaaagc

SEQ ID NO: 1618431 - RNA, 18 nt, Homo sapiens
uuaaacguaugcauguga

SEQ ID NO: 1618432 - RNA, 15 nt, Homo sapiens
uuaaagaaccaucag

SEQ ID NO: 1618433 - RNA, 18 nt, Homo sapiens
uuaaagaagagaacugcc

SEQ ID NO: 1618434 - RNA, 15 nt, Homo sapiens
uuaaagaauaugacu

SEQ ID NO: 1618435 - RNA, 13 nt, Homo sapiens
uuaaaggacauaa

SEQ ID NO: 1618436 - RNA, 21 nt, Homo sapiens
uuaaagucagguccaauuugu

SEQ ID NO: 1618437 - RNA, 15 nt, Homo sapiens
uuaaaguuacuuugu

SEQ ID NO: 1618438 - RNA, 14 nt, Homo sapiens
uuaaaucuagacau

SEQ ID NO: 1618439 - RNA, 13 nt, Homo sapiens
uuaaaucugugaa

SEQ ID NO: 1618440 - RNA, 19 nt, Homo sapiens
uuaaauuauuuuuguucau

SEQ ID NO: 1618441 - RNA, 15 nt, Homo sapiens
uuaacaaaauccuca

SEQ ID NO: 1618442 - RNA, 15 nt, Homo sapiens
uuaacaacaauaaca

SEQ ID NO: 1618443 - RNA, 21 nt, Homo sapiens
uuaacagauaaagaaacugag

SEQ ID NO: 1618444 - RNA, 15 nt, Homo sapiens
uuaacggcacugugg

SEQ ID NO: 1618445 - RNA, 15 nt, Homo sapiens
uuaacggugcuaaaa

SEQ ID NO: 1618446 - RNA, 17 nt, Homo sapiens
uuaacggugcuaaaaau

SEQ ID NO: 1618447 - RNA, 18 nt, Homo sapiens
uuaagagucuacucucaa

SEQ ID NO: 1618448 - RNA, 16 nt, Homo sapiens
uuaagauguguagacc

SEQ ID NO: 1618449 - RNA, 15 nt, Homo sapiens
uuaagcaugugaugu

SEQ ID NO: 1618450 - RNA, 12 nt, Homo sapiens
uuaaggagccua

SEQ ID NO: 1618451 - RNA, 21 nt, Homo sapiens
uuaaggaggcugagagcccaa

SEQ ID NO: 1618452 - RNA, 19 nt, Homo sapiens
uuaaggggagcaacagagg

SEQ ID NO: 1618453 - RNA, 19 nt, Homo sapiens
uuaagguaugguacaagca

SEQ ID NO: 1618454 - RNA, 18 nt, Homo sapiens
uuaagguucaagacagau

SEQ ID NO: 1618455 - RNA, 23 nt, Homo sapiens
uuaaguaucuuuuuucaaaaaca

SEQ ID NO: 1618456 - RNA, 16 nt, Homo sapiens
uuaagugaauacauua

SEQ ID NO: 1618457 - RNA, 21 nt, Homo sapiens
uuaauaaaaacaaccuugcau

SEQ ID NO: 1618458 - RNA, 16 nt, Homo sapiens
uuaauaaaccuuugca

SEQ ID NO: 1618459 - RNA, 18 nt, Homo sapiens
uuaauacaugcaacagaa

SEQ ID NO: 1618460 - RNA, 22 nt, Homo sapiens
uuaauaccugggugauuacaua

SEQ ID NO: 1618461 - RNA, 17 nt, Homo sapiens
uuaauauaguaacacac

SEQ ID NO: 1618462 - RNA, 14 nt, Homo sapiens
uuaaucggugcauu

SEQ ID NO: 1618463 - RNA, 22 nt, Homo sapiens
uuaauggucaaugcuagcacaa

SEQ ID NO: 1618464 - RNA, 19 nt, Homo sapiens
uuaauucucuuucaaagcu

SEQ ID NO: 1618465 - RNA, 18 nt, Homo sapiens
uuacaaagggggaggcua

SEQ ID NO: 1618466 - RNA, 19 nt, Homo sapiens
uuacaacccgguucacucu

SEQ ID NO: 1618467 - RNA, 21 nt, Homo sapiens
uuacacagccuaaagcuaaaa

SEQ ID NO: 1618468 - RNA, 22 nt, Homo sapiens
uuacagacugaaaggugugaac

SEQ ID NO: 1618469 - RNA, 18 nt, Homo sapiens
uuacagggagcugggaca

SEQ ID NO: 1618470 - RNA, 18 nt, Homo sapiens
uuacauaaucuguacaau

SEQ ID NO: 1618471 - RNA, 14 nt, Homo sapiens
uuacaugaguucaa

SEQ ID NO: 1618472 - RNA, 20 nt, Homo sapiens
uuacaugaguucaaauacuu

SEQ ID NO: 1618473 - RNA, 16 nt, Homo sapiens
uuacauguaauuugau

SEQ ID NO: 1618474 - RNA, 18 nt, Homo sapiens
uuacauuuucaguaccaa

SEQ ID NO: 1618475 - RNA, 19 nt, Homo sapiens
uuacccaggguggagugca

SEQ ID NO: 1618476 - RNA, 16 nt, Homo sapiens
uuaccgugggcacuga

SEQ ID NO: 1618477 - RNA, 16 nt, Homo sapiens
uuaccuaguuugcacu

SEQ ID NO: 1618478 - RNA, 17 nt, Homo sapiens
uuaccuaguuugcacua

SEQ ID NO: 1618479 - RNA, 17 nt, Homo sapiens
uuacuaauuauacuacu

SEQ ID NO: 1618480 - RNA, 17 nt, Homo sapiens
uuacuuguaauuaugaa

SEQ ID NO: 1618481 - RNA, 16 nt, Homo sapiens
uuagaaggcuuaagaa

SEQ ID NO: 1618482 - RNA, 18 nt, Homo sapiens
uuagaaucugaguauaaa

SEQ ID NO: 1618483 - RNA, 20 nt, Homo sapiens
uuagaccugccagccacugu

SEQ ID NO: 1618484 - RNA, 16 nt, Homo sapiens
uuagacuuauguggaa

SEQ ID NO: 1618485 - RNA, 19 nt, Homo sapiens
uuagagcccauuaaucuug

SEQ ID NO: 1618486 - RNA, 12 nt, Homo sapiens
uuagaguuuaau

SEQ ID NO: 1618487 - RNA, 13 nt, Homo sapiens
uuagccaaaagaa

SEQ ID NO: 1618488 - RNA, 16 nt, Homo sapiens
uuagccagauuugucu

SEQ ID NO: 1618489 - RNA, 18 nt, Homo sapiens
uuagcuccaaaccuucac

SEQ ID NO: 1618490 - RNA, 20 nt, Homo sapiens
uuagcugguggcaauaaaua

SEQ ID NO: 1618491 - RNA, 15 nt, Homo sapiens
uuagcuguaaacuga

SEQ ID NO: 1618492 - RNA, 18 nt, Homo sapiens
uuaggauuuucacauucu

SEQ ID NO: 1618493 - RNA, 17 nt, Homo sapiens
uuaggcccggagcugcc

SEQ ID NO: 1618494 - RNA, 15 nt, Homo sapiens
uuagggacacuuuca

SEQ ID NO: 1618495 - RNA, 23 nt, Homo sapiens
uuagggcugaaucuucuggagaa

SEQ ID NO: 1618496 - RNA, 18 nt, Homo sapiens
uuagguauuauaaguaau

SEQ ID NO: 1618497 - RNA, 13 nt, Homo sapiens
uuaggugugcaaa

SEQ ID NO: 1618498 - RNA, 23 nt, Homo sapiens
uuaguguucuguuugaaacuaau

SEQ ID NO: 1618499 - RNA, 19 nt, Homo sapiens
uuaguucaauacagugaag

SEQ ID NO: 1618500 - RNA, 19 nt, Homo sapiens
uuauaaaugauaucaaaga

SEQ ID NO: 1618501 - RNA, 13 nt, Homo sapiens
uuauaaugggaua

SEQ ID NO: 1618502 - RNA, 20 nt, Homo sapiens
uuauagaaaaggaacaguug

SEQ ID NO: 1618503 - RNA, 21 nt, Homo sapiens
uuauaugggaggguucugggu

SEQ ID NO: 1618504 - RNA, 15 nt, Homo sapiens
uuauauuaaaguaaa

SEQ ID NO: 1618505 - RNA, 20 nt, Homo sapiens
uuaucacuucauucacauuc

SEQ ID NO: 1618506 - RNA, 17 nt, Homo sapiens
uuaucuguuuccugaca

SEQ ID NO: 1618507 - RNA, 13 nt, Homo sapiens
uuaucuugcucau

SEQ ID NO: 1618508 - RNA, 18 nt, Homo sapiens
uuaugauuaaucugauua

SEQ ID NO: 1618509 - RNA, 17 nt, Homo sapiens
uuaugcaaauacaauca

SEQ ID NO: 1618510 - RNA, 13 nt, Homo sapiens
uuauuaaguaaaa

SEQ ID NO: 1618511 - RNA, 13 nt, Homo sapiens
uuauuacauguaa

SEQ ID NO: 1618512 - RNA, 14 nt, Homo sapiens
uuauuagucuucaa

SEQ ID NO: 1618513 - RNA, 22 nt, Homo sapiens
uuauucauuuggugacugugua

SEQ ID NO: 1618514 - RNA, 14 nt, Homo sapiens
uuauucuacuauac

SEQ ID NO: 1618515 - RNA, 21 nt, Homo sapiens
uuauuucugguaacucacuca

SEQ ID NO: 1618516 - RNA, 17 nt, Homo sapiens
uuauuugccagagccaa

SEQ ID NO: 1618517 - RNA, 22 nt, Homo sapiens
uuauuugggagggaaaagggaa

SEQ ID NO: 1618518 - RNA, 13 nt, Homo sapiens
uucaaaagcaauc

SEQ ID NO: 1618519 - RNA, 12 nt, Homo sapiens
uucaaagcuaaa

SEQ ID NO: 1618520 - RNA, 20 nt, Homo sapiens
uucaaagugucucauucuca

SEQ ID NO: 1618521 - RNA, 21 nt, Homo sapiens
uucaaagugucucauucucag

SEQ ID NO: 1618522 - RNA, 22 nt, Homo sapiens
uucaaagugucucauucucaga

SEQ ID NO: 1618523 - RNA, 12 nt, Homo sapiens
uucaaaugaauu

SEQ ID NO: 1618524 - RNA, 18 nt, Homo sapiens
uucaacaguuuuugcuaa

SEQ ID NO: 1618525 - RNA, 21 nt, Homo sapiens
uucaacuaauacaugguuuaa

SEQ ID NO: 1618526 - RNA, 20 nt, Homo sapiens
uucaagcuuguccagguuga

SEQ ID NO: 1618527 - RNA, 18 nt, Homo sapiens
uucaaggcucaaugcuau

SEQ ID NO: 1618528 - RNA, 18 nt, Homo sapiens
uucaagguaacuguacug

SEQ ID NO: 1618529 - RNA, 21 nt, Homo sapiens
uucaagguaacuguacugggc

SEQ ID NO: 1618530 - RNA, 10 nt, Homo sapiens
agccauaaau

SEQ ID NO: 1618531 - RNA, 15 nt, Homo sapiens
agcccaccccugugc

SEQ ID NO: 1618532 - RNA, 13 nt, Homo sapiens
agcccagcacagg

SEQ ID NO: 1618533 - RNA, 13 nt, Homo sapiens
agcccagugcaaa

SEQ ID NO: 1618534 - RNA, 18 nt, Homo sapiens
agccccagcgccaaagga

SEQ ID NO: 1618535 - RNA, 13 nt, Homo sapiens
agccccgacuucc

SEQ ID NO: 1618536 - RNA, 15 nt, Homo sapiens
agcccgacagugcca

SEQ ID NO: 1618537 - RNA, 18 nt, Homo sapiens
agcccugaccccagugua

SEQ ID NO: 1618538 - RNA, 22 nt, Homo sapiens
agcccugaguuucaaguauccu

SEQ ID NO: 1618539 - RNA, 17 nt, Homo sapiens
agcccugccuccaucuc

SEQ ID NO: 1618540 - RNA, 19 nt, Homo sapiens
agcccugggacagggcaaa

SEQ ID NO: 1618541 - RNA, 16 nt, Homo sapiens
agcccugggaccgcua

SEQ ID NO: 1618542 - RNA, 19 nt, Homo sapiens
agcccugugucuguauaca

SEQ ID NO: 1618543 - RNA, 16 nt, Homo sapiens
agcccuucuguaccug

SEQ ID NO: 1618544 - RNA, 19 nt, Homo sapiens
agcccuuugcuaaaauaua

SEQ ID NO: 1618545 - RNA, 18 nt, Homo sapiens
agccggggcgaguggcac

SEQ ID NO: 1618546 - RNA, 20 nt, Homo sapiens
agccuagaaacuaacacagc

SEQ ID NO: 1618547 - RNA, 11 nt, Homo sapiens
agccuauggca

SEQ ID NO: 1618548 - RNA, 19 nt, Homo sapiens
agccucgcuuuuucauccu

SEQ ID NO: 1618549 - RNA, 20 nt, Homo sapiens
agccugaauuggcuaugcag

SEQ ID NO: 1618550 - RNA, 19 nt, Homo sapiens
agccugcucuagugggaca

SEQ ID NO: 1618551 - RNA, 20 nt, Homo sapiens
agccugugaacccaggacaa

SEQ ID NO: 1618552 - RNA, 18 nt, Homo sapiens
agccugugccacacuucg

SEQ ID NO: 1618553 - RNA, 23 nt, Homo sapiens
agccugugcgucccagcugaagg

SEQ ID NO: 1618554 - RNA, 15 nt, Homo sapiens
agccuucccucugca

SEQ ID NO: 1618555 - RNA, 21 nt, Homo sapiens
agccuuuuuuccugggccaga

SEQ ID NO: 1618556 - RNA, 20 nt, Homo sapiens
agcgauucuccugccucagc

SEQ ID NO: 1618557 - RNA, 12 nt, Homo sapiens
agcgccaaagga

SEQ ID NO: 1618558 - RNA, 20 nt, Homo sapiens
agcggacaguggcaggacag

SEQ ID NO: 1618559 - RNA, 22 nt, Homo sapiens
agcgggagccucccugccucag

SEQ ID NO: 1618560 - RNA, 14 nt, Homo sapiens
agcuaaaugugauc

SEQ ID NO: 1618561 - RNA, 15 nt, Homo sapiens
agcuaaccacuucgc

SEQ ID NO: 1618562 - RNA, 15 nt, Homo sapiens
agcuacaggacauuu

SEQ ID NO: 1618563 - RNA, 16 nt, Homo sapiens
agcuacaggacauuuu

SEQ ID NO: 1618564 - RNA, 17 nt, Homo sapiens
agcuacuauguacugcc

SEQ ID NO: 1618565 - RNA, 13 nt, Homo sapiens
agcuagacugugu

SEQ ID NO: 1618566 - RNA, 17 nt, Homo sapiens
agcuagacugugucuga

SEQ ID NO: 1618567 - RNA, 15 nt, Homo sapiens
agcuauaacuuacuu

SEQ ID NO: 1618568 - RNA, 19 nt, Homo sapiens
agcuauagucuaugcaguc

SEQ ID NO: 1618569 - RNA, 20 nt, Homo sapiens
agcuauuuaucuguaguaaa

SEQ ID NO: 1618570 - RNA, 14 nt, Homo sapiens
agcucacaaccacc

SEQ ID NO: 1618571 - RNA, 16 nt, Homo sapiens
agcucagcagacaucc

SEQ ID NO: 1618572 - RNA, 21 nt, Homo sapiens
agcuccacccuggccgagucc

SEQ ID NO: 1618573 - RNA, 18 nt, Homo sapiens
agcucccgggcacaucca

SEQ ID NO: 1618574 - RNA, 18 nt, Homo sapiens
agcuccuaguaugcccug

SEQ ID NO: 1618575 - RNA, 19 nt, Homo sapiens
agcucucaauuuuauguau

SEQ ID NO: 1618576 - RNA, 19 nt, Homo sapiens
agcucuccccaaacuugcu

SEQ ID NO: 1618577 - RNA, 22 nt, Homo sapiens
agcucugaaaucaacucucuuc

SEQ ID NO: 1618578 - RNA, 18 nt, Homo sapiens
agcucuggagaacagugg

SEQ ID NO: 1618579 - RNA, 17 nt, Homo sapiens
agcugaaggcaguggca

SEQ ID NO: 1618580 - RNA, 17 nt, Homo sapiens
agcugaauaaccugcac

SEQ ID NO: 1618581 - RNA, 15 nt, Homo sapiens
agcugagaagcaaug

SEQ ID NO: 1618582 - RNA, 13 nt, Homo sapiens
agcuggaaccaug

SEQ ID NO: 1618583 - RNA, 14 nt, Homo sapiens
agcuggcucuguga

SEQ ID NO: 1618584 - RNA, 16 nt, Homo sapiens
agcuggcucugugagg

SEQ ID NO: 1618585 - RNA, 15 nt, Homo sapiens
agcugguggcaauaa

SEQ ID NO: 1618586 - RNA, 21 nt, Homo sapiens
agcugguggcaauaaauauua

SEQ ID NO: 1618587 - RNA, 16 nt, Homo sapiens
agcuguaaacugaaua

SEQ ID NO: 1618588 - RNA, 18 nt, Homo sapiens
agcugucucaaaccucca

SEQ ID NO: 1618589 - RNA, 22 nt, Homo sapiens
agcugucucaaaccuccaaaag

SEQ ID NO: 1618590 - RNA, 20 nt, Homo sapiens
agcugugcacaaaguggcau

SEQ ID NO: 1618591 - RNA, 13 nt, Homo sapiens
agcuguuagggcu

SEQ ID NO: 1618592 - RNA, 20 nt, Homo sapiens
agcuguuuagggucuucucc

SEQ ID NO: 1618593 - RNA, 20 nt, Homo sapiens
agcuguuuaugcauagauaa

SEQ ID NO: 1618594 - RNA, 19 nt, Homo sapiens
agcuguuucaaaugugcau

SEQ ID NO: 1618595 - RNA, 14 nt, Homo sapiens
agcuuaagaaccau

SEQ ID NO: 1618596 - RNA, 18 nt, Homo sapiens
agcuuaagaaccauugau

SEQ ID NO: 1618597 - RNA, 17 nt, Homo sapiens
agcuuaaugauucugau

SEQ ID NO: 1618598 - RNA, 22 nt, Homo sapiens
agcuuagggaugagauacuuau

SEQ ID NO: 1618599 - RNA, 13 nt, Homo sapiens
agcuucaacuuuu

SEQ ID NO: 1618600 - RNA, 16 nt, Homo sapiens
agcuuccuggggacca

SEQ ID NO: 1618601 - RNA, 19 nt, Homo sapiens
agcuucucuugcucucgac

SEQ ID NO: 1618602 - RNA, 18 nt, Homo sapiens
agcuucugcccaccuacu

SEQ ID NO: 1618603 - RNA, 22 nt, Homo sapiens
agcuugccuguuucuucucuac

SEQ ID NO: 1618604 - RNA, 17 nt, Homo sapiens
agcuuguccagguugau

SEQ ID NO: 1618605 - RNA, 18 nt, Homo sapiens
agcuuuccaaggaagcag

SEQ ID NO: 1618606 - RNA, 16 nt, Homo sapiens
agcuuuguauguuuau

SEQ ID NO: 1618607 - RNA, 20 nt, Homo sapiens
aggaaaacgugaacaaacuu

SEQ ID NO: 1618608 - RNA, 20 nt, Homo sapiens
aggaaaacugaggcccuugg

SEQ ID NO: 1618609 - RNA, 19 nt, Homo sapiens
aggaaaaugcuuauugaug

SEQ ID NO: 1618610 - RNA, 17 nt, Homo sapiens
aggaaagagagacccca

SEQ ID NO: 1618611 - RNA, 13 nt, Homo sapiens
aggaaagggauug

SEQ ID NO: 1618612 - RNA, 15 nt, Homo sapiens
aggaacaaacagggc

SEQ ID NO: 1618613 - RNA, 18 nt, Homo sapiens
aggaacacccccaugaca

SEQ ID NO: 1618614 - RNA, 23 nt, Homo sapiens
aggaacacccccaugacauugca

SEQ ID NO: 1618615 - RNA, 22 nt, Homo sapiens
aggaacagauuuugcuaagaca

SEQ ID NO: 1618616 - RNA, 18 nt, Homo sapiens
aggaaccgcccagugcag

SEQ ID NO: 1618617 - RNA, 16 nt, Homo sapiens
aggaagauaugccacu

SEQ ID NO: 1618618 - RNA, 15 nt, Homo sapiens
aggaagucuaccugg

SEQ ID NO: 1618619 - RNA, 15 nt, Homo sapiens
aggaauaaagacuug

SEQ ID NO: 1618620 - RNA, 18 nt, Homo sapiens
aggaauauaagaaaagua

SEQ ID NO: 1618621 - RNA, 16 nt, Homo sapiens
aggaauauacauaguc

SEQ ID NO: 1618622 - RNA, 20 nt, Homo sapiens
aggaauauuuucuucugcac

SEQ ID NO: 1618623 - RNA, 21 nt, Homo sapiens
aggaaucuccgaggcucccca

SEQ ID NO: 1618624 - RNA, 22 nt, Homo sapiens
aggaaugacccuuuugugucua

SEQ ID NO: 1618625 - RNA, 17 nt, Homo sapiens
aggaaugacuuacuuuc

SEQ ID NO: 1618626 - RNA, 15 nt, Homo sapiens
aggaaugugggcuau

SEQ ID NO: 1618627 - RNA, 21 nt, Homo sapiens
aggaaugugggcugggggaag

SEQ ID NO: 1618628 - RNA, 16 nt, Homo sapiens
aggacaaaacuucuug

SEQ ID NO: 1618629 - RNA, 18 nt, Homo sapiens
aggacaggacccucagga

SEQ ID NO: 1618630 - RNA, 23 nt, Homo sapiens
aggacaugcgguagccagcacac

SEQ ID NO: 1618631 - RNA, 16 nt, Homo sapiens
aggaccuggcugccau

SEQ ID NO: 1618632 - RNA, 15 nt, Homo sapiens
aggacuaacacucag

SEQ ID NO: 1618633 - RNA, 22 nt, Homo sapiens
aggacuaacacucagaagccug

SEQ ID NO: 1618634 - RNA, 23 nt, Homo sapiens
aggacuagggcuuauccaugccu

SEQ ID NO: 1618635 - RNA, 11 nt, Homo sapiens
aggacucuucc

SEQ ID NO: 1618636 - RNA, 12 nt, Homo sapiens
aggacuguagaa

SEQ ID NO: 1618637 - RNA, 17 nt, Homo sapiens
aggagaaaaagcuuaau

SEQ ID NO: 1618638 - RNA, 13 nt, Homo sapiens
aggagcagcccug

SEQ ID NO: 1618639 - RNA, 19 nt, Homo sapiens
aggagcccagcggcccaag

SEQ ID NO: 1618640 - RNA, 13 nt, Homo sapiens
augccauaugccu

SEQ ID NO: 1618641 - RNA, 22 nt, Homo sapiens
augccauccagaugugugcaau

SEQ ID NO: 1618642 - RNA, 21 nt, Homo sapiens
augcccaagagaucugugcca

SEQ ID NO: 1618643 - RNA, 13 nt, Homo sapiens
augcccagcugua

SEQ ID NO: 1618644 - RNA, 15 nt, Homo sapiens
augccuagaguuuac

SEQ ID NO: 1618645 - RNA, 19 nt, Homo sapiens
augccucagccuacuuuca

SEQ ID NO: 1618646 - RNA, 19 nt, Homo sapiens
augccuguguacugccuua

SEQ ID NO: 1618647 - RNA, 16 nt, Homo sapiens
augccuuaaaauggaa

SEQ ID NO: 1618648 - RNA, 13 nt, Homo sapiens
augcgaaaguuug

SEQ ID NO: 1618649 - RNA, 18 nt, Homo sapiens
augcgggccagugcucca

SEQ ID NO: 1618650 - RNA, 20 nt, Homo sapiens
augcgguagccagcacacag

SEQ ID NO: 1618651 - RNA, 14 nt, Homo sapiens
augcuaacaaagac

SEQ ID NO: 1618652 - RNA, 21 nt, Homo sapiens
augcuaagaaugcauuauuga

SEQ ID NO: 1618653 - RNA, 21 nt, Homo sapiens
augcuacaagacgggcaaaau

SEQ ID NO: 1618654 - RNA, 12 nt, Homo sapiens
augcuagugaua

SEQ ID NO: 1618655 - RNA, 14 nt, Homo sapiens
augcucacuuuauu

SEQ ID NO: 1618656 - RNA, 16 nt, Homo sapiens
augcucauugaacuuu

SEQ ID NO: 1618657 - RNA, 23 nt, Homo sapiens
augcugagagagcuggaggcacc

SEQ ID NO: 1618658 - RNA, 17 nt, Homo sapiens
augcuggcugguggaac

SEQ ID NO: 1618659 - RNA, 18 nt, Homo sapiens
augcuggcugguggaaca

SEQ ID NO: 1618660 - RNA, 15 nt, Homo sapiens
augcuucuacuguga

SEQ ID NO: 1618661 - RNA, 17 nt, Homo sapiens
augcuuggcuaacuaua

SEQ ID NO: 1618662 - RNA, 15 nt, Homo sapiens
augcuuucaucaucc

SEQ ID NO: 1618663 - RNA, 22 nt, Homo sapiens
augcuuuguucagccugccuuc

SEQ ID NO: 1618664 - RNA, 19 nt, Homo sapiens
augcuuuuacuaagcacug

SEQ ID NO: 1618665 - RNA, 14 nt, Homo sapiens
auggaacacggcca

SEQ ID NO: 1618666 - RNA, 16 nt, Homo sapiens
auggacugcuucaucu

SEQ ID NO: 1618667 - RNA, 23 nt, Homo sapiens
auggacuggagcucaucugcaaa

SEQ ID NO: 1618668 - RNA, 21 nt, Homo sapiens
auggagacaagggcaucaucu

SEQ ID NO: 1618669 - RNA, 14 nt, Homo sapiens
auggagcaagcucu

SEQ ID NO: 1618670 - RNA, 18 nt, Homo sapiens
auggagccaugacaagaa

SEQ ID NO: 1618671 - RNA, 16 nt, Homo sapiens
auggagugcucacaaa

SEQ ID NO: 1618672 - RNA, 20 nt, Homo sapiens
auggagugcucacaaaggau

SEQ ID NO: 1618673 - RNA, 22 nt, Homo sapiens
auggauaaaauaaugcugcaaa

SEQ ID NO: 1618674 - RNA, 15 nt, Homo sapiens
auggaugaucuggga

SEQ ID NO: 1618675 - RNA, 18 nt, Homo sapiens
auggcaacagaaaccaag

SEQ ID NO: 1618676 - RNA, 17 nt, Homo sapiens
auggcaauuuagcucuc

SEQ ID NO: 1618677 - RNA, 14 nt, Homo sapiens
auggcauauggucc

SEQ ID NO: 1618678 - RNA, 13 nt, Homo sapiens
auggcaucuucaa

SEQ ID NO: 1618679 - RNA, 14 nt, Homo sapiens
auggccaacuuucu

SEQ ID NO: 1618680 - RNA, 23 nt, Homo sapiens
auggccggcuggaaaugcugggc

SEQ ID NO: 1618681 - RNA, 21 nt, Homo sapiens
auggcuaacaccucccugggc

SEQ ID NO: 1618682 - RNA, 20 nt, Homo sapiens
auggcucaagucugcacaga

SEQ ID NO: 1618683 - RNA, 17 nt, Homo sapiens
auggcuccuccauaucu

SEQ ID NO: 1618684 - RNA, 14 nt, Homo sapiens
augggacugugagg

SEQ ID NO: 1618685 - RNA, 17 nt, Homo sapiens
augggagcuuaacuuua

SEQ ID NO: 1618686 - RNA, 18 nt, Homo sapiens
augggaggguucugggug

SEQ ID NO: 1618687 - RNA, 14 nt, Homo sapiens
auggguacaaugaa

SEQ ID NO: 1618688 - RNA, 14 nt, Homo sapiens
augguaaucagaaa

SEQ ID NO: 1618689 - RNA, 23 nt, Homo sapiens
augguccgccugccucagccucc

SEQ ID NO: 1618690 - RNA, 19 nt, Homo sapiens
auggugaagaacuagcaua

SEQ ID NO: 1618691 - RNA, 16 nt, Homo sapiens
auggugagaugcagcu

SEQ ID NO: 1618692 - RNA, 22 nt, Homo sapiens
auggugagaugcagcuggaaaa

SEQ ID NO: 1618693 - RNA, 22 nt, Homo sapiens
augguguaggaaaaaugcaagc

SEQ ID NO: 1618694 - RNA, 22 nt, Homo sapiens
augguguuauuuucugagagac

SEQ ID NO: 1618695 - RNA, 16 nt, Homo sapiens
auguaaaauccaucca

SEQ ID NO: 1618696 - RNA, 12 nt, Homo sapiens
auguaagccugg

SEQ ID NO: 1618697 - RNA, 23 nt, Homo sapiens
auguacagacuuuuuucuuguca

SEQ ID NO: 1618698 - RNA, 18 nt, Homo sapiens
auguacuaggauacugcu

SEQ ID NO: 1618699 - RNA, 15 nt, Homo sapiens
auguagccagcagaa

SEQ ID NO: 1618700 - RNA, 16 nt, Homo sapiens
auguauaaaugugaua

SEQ ID NO: 1618701 - RNA, 20 nt, Homo sapiens
auguaucacgggucacuuga

SEQ ID NO: 1618702 - RNA, 23 nt, Homo sapiens
auguaucuuaaaggacauaaaau

SEQ ID NO: 1618703 - RNA, 15 nt, Homo sapiens
augucaggucagcca

SEQ ID NO: 1618704 - RNA, 11 nt, Homo sapiens
auguccauuuu

SEQ ID NO: 1618705 - RNA, 22 nt, Homo sapiens
augucuauaaucccagcacuuu

SEQ ID NO: 1618706 - RNA, 21 nt, Homo sapiens
augucucuuugugcucuaaaa

SEQ ID NO: 1618707 - RNA, 17 nt, Homo sapiens
augucuugacuguuagu

SEQ ID NO: 1618708 - RNA, 20 nt, Homo sapiens
augucuugcaaagccuuuaa

SEQ ID NO: 1618709 - RNA, 17 nt, Homo sapiens
augucuuggacacugua

SEQ ID NO: 1618710 - RNA, 20 nt, Homo sapiens
augucuuggacacuguacaa

SEQ ID NO: 1618711 - RNA, 17 nt, Homo sapiens
augucuuguacaugugu

SEQ ID NO: 1618712 - RNA, 22 nt, Homo sapiens
augucuuuuacccggcacauuc

SEQ ID NO: 1618713 - RNA, 23 nt, Homo sapiens
augugaauuauuuuaaaggcaaa

SEQ ID NO: 1618714 - RNA, 19 nt, Homo sapiens
augugacacugcagcagaa

SEQ ID NO: 1618715 - RNA, 19 nt, Homo sapiens
augugauccugccuugcug

SEQ ID NO: 1618716 - RNA, 23 nt, Homo sapiens
augugggcugggggaagaugccc

SEQ ID NO: 1618717 - RNA, 12 nt, Homo sapiens
auguggucucag

SEQ ID NO: 1618718 - RNA, 18 nt, Homo sapiens
auguguagccugugcaug

SEQ ID NO: 1618719 - RNA, 23 nt, Homo sapiens
auguguguagauacuuccugccc

SEQ ID NO: 1618720 - RNA, 17 nt, Homo sapiens
auguuaccuucacaugu

SEQ ID NO: 1618721 - RNA, 18 nt, Homo sapiens
auguuaccuucacauguc

SEQ ID NO: 1618722 - RNA, 16 nt, Homo sapiens
auguuagaaugagauc

SEQ ID NO: 1618723 - RNA, 17 nt, Homo sapiens
auguuccgagaagaaca

SEQ ID NO: 1618724 - RNA, 13 nt, Homo sapiens
auguugcaaagaa

SEQ ID NO: 1618725 - RNA, 20 nt, Homo sapiens
auguuuaaauucucuuucac

SEQ ID NO: 1618726 - RNA, 23 nt, Homo sapiens
auguuuacuaaguggacuggugu

SEQ ID NO: 1618727 - RNA, 21 nt, Homo sapiens
auguuucaagaaaauggauuu

SEQ ID NO: 1618728 - RNA, 17 nt, Homo sapiens
auguuuuugcugcuacu

SEQ ID NO: 1618729 - RNA, 22 nt, Homo sapiens
auuaaaacauauuucauuuuaa

SEQ ID NO: 1618730 - RNA, 18 nt, Homo sapiens
auuaaaauaacuaagcaa

SEQ ID NO: 1618731 - RNA, 22 nt, Homo sapiens
auuaaaauuggaugcuagagaa

SEQ ID NO: 1618732 - RNA, 15 nt, Homo sapiens
auuaaacguaugcau

SEQ ID NO: 1618733 - RNA, 17 nt, Homo sapiens
auuaacauuuugagcua

SEQ ID NO: 1618734 - RNA, 16 nt, Homo sapiens
auuaacggagugucua

SEQ ID NO: 1618735 - RNA, 18 nt, Homo sapiens
auuaacuuuaauucucuu

SEQ ID NO: 1618736 - RNA, 18 nt, Homo sapiens
auuaagagucuacucuca

SEQ ID NO: 1618737 - RNA, 19 nt, Homo sapiens
auuaauuguuuugcacuuu

SEQ ID NO: 1618738 - RNA, 16 nt, Homo sapiens
auuaauuuaauuacua

SEQ ID NO: 1618739 - RNA, 17 nt, Homo sapiens
auuacagcuuucacagu

SEQ ID NO: 1618740 - RNA, 11 nt, Homo sapiens
auuacugugag

SEQ ID NO: 1618741 - RNA, 19 nt, Homo sapiens
auuacuuuuuuaaaggcac

SEQ ID NO: 1618742 - RNA, 18 nt, Homo sapiens
auuagauacacuucuuaa

SEQ ID NO: 1618743 - RNA, 22 nt, Homo sapiens
auuagccacauguacacuacau

SEQ ID NO: 1618744 - RNA, 21 nt, Homo sapiens
auuaguauuaauacuacccau

SEQ ID NO: 1618745 - RNA, 21 nt, Homo sapiens
auuauacagaccuaauaucau

SEQ ID NO: 1618746 - RNA, 15 nt, Homo sapiens
auuauacuacaauaa

SEQ ID NO: 1618747 - RNA, 14 nt, Homo sapiens
auuaucuugcucau

SEQ ID NO: 1618748 - RNA, 18 nt, Homo sapiens
auuaugaugaaaaccuac

SEQ ID NO: 1618749 - RNA, 14 nt, Homo sapiens
caauauaaucugaa

SEQ ID NO: 1618750 - RNA, 16 nt, Homo sapiens
caauauuguacaguuu

SEQ ID NO: 1618751 - RNA, 21 nt, Homo sapiens
caaucugccuuugaaucugga

SEQ ID NO: 1618752 - RNA, 18 nt, Homo sapiens
caauggcgcgaucuuggc

SEQ ID NO: 1618753 - RNA, 22 nt, Homo sapiens
caauguacaguugaaauaacug

SEQ ID NO: 1618754 - RNA, 17 nt, Homo sapiens
caauguggcaaacugaa

SEQ ID NO: 1618755 - RNA, 21 nt, Homo sapiens
caauguucuuugucucaaaau

SEQ ID NO: 1618756 - RNA, 14 nt, Homo sapiens
caauuccaccaggg

SEQ ID NO: 1618757 - RNA, 19 nt, Homo sapiens
caauuccugugcucaaaaa

SEQ ID NO: 1618758 - RNA, 18 nt, Homo sapiens
caauuuuugucucagaag

SEQ ID NO: 1618759 - RNA, 16 nt, Homo sapiens
cacaaaaucacuuuaa

SEQ ID NO: 1618760 - RNA, 13 nt, Homo sapiens
cacaaacccaagg

SEQ ID NO: 1618761 - RNA, 13 nt, Homo sapiens
cacaacagugaaa

SEQ ID NO: 1618762 - RNA, 18 nt, Homo sapiens
cacaacucuuuguucaaa

SEQ ID NO: 1618763 - RNA, 15 nt, Homo sapiens
cacaagaaugugcag

SEQ ID NO: 1618764 - RNA, 12 nt, Homo sapiens
cacaauacuguu

SEQ ID NO: 1618765 - RNA, 13 nt, Homo sapiens
cacaauauuccua

SEQ ID NO: 1618766 - RNA, 15 nt, Homo sapiens
cacacaacuguccau

SEQ ID NO: 1618767 - RNA, 20 nt, Homo sapiens
cacacaccaaguaccaguau

SEQ ID NO: 1618768 - RNA, 17 nt, Homo sapiens
cacacagaggggaguca

SEQ ID NO: 1618769 - RNA, 20 nt, Homo sapiens
cacacagcaagucaggguug

SEQ ID NO: 1618770 - RNA, 12 nt, Homo sapiens
cacacagugaaa

SEQ ID NO: 1618771 - RNA, 18 nt, Homo sapiens
cacaccaaggcccugcau

SEQ ID NO: 1618772 - RNA, 18 nt, Homo sapiens
cacaccaaguaccaguau

SEQ ID NO: 1618773 - RNA, 14 nt, Homo sapiens
cacaccauucaggu

SEQ ID NO: 1618774 - RNA, 22 nt, Homo sapiens
cacacccaugcacacucaugca

SEQ ID NO: 1618775 - RNA, 15 nt, Homo sapiens
cacaccuacccaggg

SEQ ID NO: 1618776 - RNA, 13 nt, Homo sapiens
cacacucuucagu

SEQ ID NO: 1618777 - RNA, 13 nt, Homo sapiens
cacacuuugccau

SEQ ID NO: 1618778 - RNA, 16 nt, Homo sapiens
cacacuuuguccaaug

SEQ ID NO: 1618779 - RNA, 20 nt, Homo sapiens
cacagaggggagucaccagc

SEQ ID NO: 1618780 - RNA, 16 nt, Homo sapiens
cacagauagcugccac

SEQ ID NO: 1618781 - RNA, 14 nt, Homo sapiens
cacagccaacacgc

SEQ ID NO: 1618782 - RNA, 23 nt, Homo sapiens
cacagccuucccucugcauugac

SEQ ID NO: 1618783 - RNA, 22 nt, Homo sapiens
cacagcuucugcagcagacugu

SEQ ID NO: 1618784 - RNA, 23 nt, Homo sapiens
cacagcuucugcagcagacuguc

SEQ ID NO: 1618785 - RNA, 13 nt, Homo sapiens
cacagguauuuca

SEQ ID NO: 1618786 - RNA, 24 nt, Homo sapiens
cacagguguguuucccaucccacu

SEQ ID NO: 1618787 - RNA, 18 nt, Homo sapiens
cacaguaccggauucucu

SEQ ID NO: 1618788 - RNA, 21 nt, Homo sapiens
cacaguagaacugucugugaa

SEQ ID NO: 1618789 - RNA, 13 nt, Homo sapiens
cacagugugaaua

SEQ ID NO: 1618790 - RNA, 19 nt, Homo sapiens
cacauaagcccaguucauc

SEQ ID NO: 1618791 - RNA, 17 nt, Homo sapiens
cacauacaccacaaaaa

SEQ ID NO: 1618792 - RNA, 21 nt, Homo sapiens
cacauacauguaaaauauguc

SEQ ID NO: 1618793 - RNA, 21 nt, Homo sapiens
cacauaggaaacuuuugauaa

SEQ ID NO: 1618794 - RNA, 15 nt, Homo sapiens
cacaucaugagccuu

SEQ ID NO: 1618795 - RNA, 13 nt, Homo sapiens
cacaugcccauga

SEQ ID NO: 1618796 - RNA, 16 nt, Homo sapiens
cacaugcccaugauga

SEQ ID NO: 1618797 - RNA, 20 nt, Homo sapiens
cacaugcccuaaugucugua

SEQ ID NO: 1618798 - RNA, 18 nt, Homo sapiens
cacaugugacacauaugc

SEQ ID NO: 1618799 - RNA, 19 nt, Homo sapiens
cacaugugacacauaugca

SEQ ID NO: 1618800 - RNA, 20 nt, Homo sapiens
cacaugugacacauaugcac

SEQ ID NO: 1618801 - RNA, 23 nt, Homo sapiens
cacauucuguuuaucaagccaua

SEQ ID NO: 1618802 - RNA, 18 nt, Homo sapiens
caccaaaacaaacccaaa

SEQ ID NO: 1618803 - RNA, 15 nt, Homo sapiens
caccaaguaccagua

SEQ ID NO: 1618804 - RNA, 17 nt, Homo sapiens
caccacuaacaugcccu

SEQ ID NO: 1618805 - RNA, 14 nt, Homo sapiens
caccacuuaaucuu

SEQ ID NO: 1618806 - RNA, 15 nt, Homo sapiens
caccagccagaggau

SEQ ID NO: 1618807 - RNA, 20 nt, Homo sapiens
caccagcccugaccccagug

SEQ ID NO: 1618808 - RNA, 21 nt, Homo sapiens
caccagcccugaccccagugu

SEQ ID NO: 1618809 - RNA, 22 nt, Homo sapiens
caccaggaauccccaacaugca

SEQ ID NO: 1618810 - RNA, 21 nt, Homo sapiens
caccaugacccucuuccucau

SEQ ID NO: 1618811 - RNA, 20 nt, Homo sapiens
cacccaggcuggaguacagc

SEQ ID NO: 1618812 - RNA, 20 nt, Homo sapiens
cacccaggcuggagugcagu

SEQ ID NO: 1618813 - RNA, 14 nt, Homo sapiens
caccccaucccacg

SEQ ID NO: 1618814 - RNA, 15 nt, Homo sapiens
cacccuccuacaggu

SEQ ID NO: 1618815 - RNA, 21 nt, Homo sapiens
cacccugggcuuccugagcca

SEQ ID NO: 1618816 - RNA, 22 nt, Homo sapiens
caccuaagaucucgguuugcca

SEQ ID NO: 1618817 - RNA, 18 nt, Homo sapiens
caccuacucacacaggca

SEQ ID NO: 1618818 - RNA, 13 nt, Homo sapiens
caccucacaacuc

SEQ ID NO: 1618819 - RNA, 23 nt, Homo sapiens
caccuccgccagauccugcagaa

SEQ ID NO: 1618820 - RNA, 22 nt, Homo sapiens
caccucuaaucuggauguuaag

SEQ ID NO: 1618821 - RNA, 13 nt, Homo sapiens
caccucuguucau

SEQ ID NO: 1618822 - RNA, 15 nt, Homo sapiens
caccugacucuugca

SEQ ID NO: 1618823 - RNA, 20 nt, Homo sapiens
caccugagacaugcugaaau

SEQ ID NO: 1618824 - RNA, 13 nt, Homo sapiens
caccugugguuuu

SEQ ID NO: 1618825 - RNA, 15 nt, Homo sapiens
caccuuccguucccc

SEQ ID NO: 1618826 - RNA, 17 nt, Homo sapiens
caccuugugucuguaca

SEQ ID NO: 1618827 - RNA, 22 nt, Homo sapiens
caccuuuucagcgauguaugca

SEQ ID NO: 1618828 - RNA, 17 nt, Homo sapiens
cacgaucucaacucacu

SEQ ID NO: 1618829 - RNA, 19 nt, Homo sapiens
cacgauggagagagccuua

SEQ ID NO: 1618830 - RNA, 14 nt, Homo sapiens
cacggcauuacccc

SEQ ID NO: 1618831 - RNA, 21 nt, Homo sapiens
cacggccuguacggacacugu

SEQ ID NO: 1618832 - RNA, 20 nt, Homo sapiens
cacggucuguucuugaagca

SEQ ID NO: 1618833 - RNA, 21 nt, Homo sapiens
cacguaugguggcucaugucu

SEQ ID NO: 1618834 - RNA, 20 nt, Homo sapiens
cacuaaccaaaucucucaaa

SEQ ID NO: 1618835 - RNA, 14 nt, Homo sapiens
cacuacauuacuuc

SEQ ID NO: 1618836 - RNA, 22 nt, Homo sapiens
cacuaucugggugcaugaucuu

SEQ ID NO: 1618837 - RNA, 16 nt, Homo sapiens
cacuaugccugacuaa

SEQ ID NO: 1618838 - RNA, 17 nt, Homo sapiens
cacuaugggugagcaua

SEQ ID NO: 1618839 - RNA, 19 nt, Homo sapiens
cacuccuggacaaccugga

SEQ ID NO: 1618840 - RNA, 20 nt, Homo sapiens
cacuccuucucucacugugu

SEQ ID NO: 1618841 - RNA, 14 nt, Homo sapiens
cacucuuguaauaa

SEQ ID NO: 1618842 - RNA, 13 nt, Homo sapiens
cacugacugagau

SEQ ID NO: 1618843 - RNA, 13 nt, Homo sapiens
cacugacuguaug

SEQ ID NO: 1618844 - RNA, 20 nt, Homo sapiens
cacugagcuauaacuuacuu

SEQ ID NO: 1618845 - RNA, 22 nt, Homo sapiens
cacugcacuuuccaaugccaca

SEQ ID NO: 1618846 - RNA, 14 nt, Homo sapiens
cacugcagcagaaa

SEQ ID NO: 1618847 - RNA, 11 nt, Homo sapiens
cacuguacaag

SEQ ID NO: 1618848 - RNA, 19 nt, Homo sapiens
cacuguuaauauucuauua

SEQ ID NO: 1618849 - RNA, 10 nt, Homo sapiens
cacuguucaa

SEQ ID NO: 1618850 - RNA, 13 nt, Homo sapiens
cacuguucaauac

SEQ ID NO: 1618851 - RNA, 21 nt, Homo sapiens
cacuuaaagccuuuuccugaa

SEQ ID NO: 1618852 - RNA, 22 nt, Homo sapiens
cacuuaauuuguaaacuucuga

SEQ ID NO: 1618853 - RNA, 19 nt, Homo sapiens
cacuuauacccaugaacuu

SEQ ID NO: 1618854 - RNA, 13 nt, Homo sapiens
cacuucauucaca

SEQ ID NO: 1618855 - RNA, 17 nt, Homo sapiens
cacuucauucacauuca

SEQ ID NO: 1618856 - RNA, 14 nt, Homo sapiens
cacuuccaugagaa

SEQ ID NO: 1618857 - RNA, 23 nt, Homo sapiens
cacuuccaugagaagaagcagau

SEQ ID NO: 1618858 - RNA, 19 nt, Homo sapiens
cacuuccuuuuaccugccc

SEQ ID NO: 1618859 - RNA, 15 nt, Homo sapiens
caugacauugcauuu

SEQ ID NO: 1618860 - RNA, 16 nt, Homo sapiens
caugacauugcauuug

SEQ ID NO: 1618861 - RNA, 17 nt, Homo sapiens
caugaccacauagcaug

SEQ ID NO: 1618862 - RNA, 15 nt, Homo sapiens
caugagacugcccug

SEQ ID NO: 1618863 - RNA, 18 nt, Homo sapiens
caugaggcaguuccuucc

SEQ ID NO: 1618864 - RNA, 22 nt, Homo sapiens
caugaugcgggccagugcucca

SEQ ID NO: 1618865 - RNA, 10 nt, Homo sapiens
caugcaaaau

SEQ ID NO: 1618866 - RNA, 15 nt, Homo sapiens
caugcaaaauauguu

SEQ ID NO: 1618867 - RNA, 18 nt, Homo sapiens
caugcaccuugcucccaa

SEQ ID NO: 1618868 - RNA, 15 nt, Homo sapiens
caugcauacuuuauu

SEQ ID NO: 1618869 - RNA, 16 nt, Homo sapiens
caugcccugugcaacc

SEQ ID NO: 1618870 - RNA, 16 nt, Homo sapiens
caugcguccuggucaa

SEQ ID NO: 1618871 - RNA, 16 nt, Homo sapiens
caugcucaggagccac

SEQ ID NO: 1618872 - RNA, 21 nt, Homo sapiens
caugcuggcucccagggccau

SEQ ID NO: 1618873 - RNA, 14 nt, Homo sapiens
caugcugugcauuu

SEQ ID NO: 1618874 - RNA, 14 nt, Homo sapiens
caugcuuuucugcc

SEQ ID NO: 1618875 - RNA, 15 nt, Homo sapiens
cauggccuaugcaca

SEQ ID NO: 1618876 - RNA, 19 nt, Homo sapiens
cauggccuaugcacauaug

SEQ ID NO: 1618877 - RNA, 22 nt, Homo sapiens
cauggccuugaaacaguuccau

SEQ ID NO: 1618878 - RNA, 17 nt, Homo sapiens
cauggcuguguuugcag

SEQ ID NO: 1618879 - RNA, 19 nt, Homo sapiens
caugggcuaaugaagauca

SEQ ID NO: 1618880 - RNA, 20 nt, Homo sapiens
caugggcuaaugaagaucau

SEQ ID NO: 1618881 - RNA, 19 nt, Homo sapiens
cauggucccacaucccugg

SEQ ID NO: 1618882 - RNA, 22 nt, Homo sapiens
cauggugcaguuuuggugugua

SEQ ID NO: 1618883 - RNA, 14 nt, Homo sapiens
cauguaaccacugc

SEQ ID NO: 1618884 - RNA, 20 nt, Homo sapiens
cauguaaccacugcacuuuc

SEQ ID NO: 1618885 - RNA, 13 nt, Homo sapiens
cauguagcuucuu

SEQ ID NO: 1618886 - RNA, 18 nt, Homo sapiens
cauguagcuucuucugaa

SEQ ID NO: 1618887 - RNA, 16 nt, Homo sapiens
caugucugcuugucaa

SEQ ID NO: 1618888 - RNA, 20 nt, Homo sapiens
caugugacacauaugcaccu

SEQ ID NO: 1618889 - RNA, 14 nt, Homo sapiens
caugugacucugaa

SEQ ID NO: 1618890 - RNA, 14 nt, Homo sapiens
caugugcuacaggg

SEQ ID NO: 1618891 - RNA, 15 nt, Homo sapiens
cauguuggcccagac

SEQ ID NO: 1618892 - RNA, 11 nt, Homo sapiens
cauguuugcag

SEQ ID NO: 1618893 - RNA, 17 nt, Homo sapiens
cauguuugcagggguga

SEQ ID NO: 1618894 - RNA, 18 nt, Homo sapiens
cauuaaaaugacaaacau

SEQ ID NO: 1618895 - RNA, 16 nt, Homo sapiens
cauuaacucccuccac

SEQ ID NO: 1618896 - RNA, 13 nt, Homo sapiens
cauuaauguguaa

SEQ ID NO: 1618897 - RNA, 20 nt, Homo sapiens
cauuacagggcacaggccau

SEQ ID NO: 1618898 - RNA, 20 nt, Homo sapiens
cauuauccuuuuaucucaca

SEQ ID NO: 1618899 - RNA, 14 nt, Homo sapiens
cauuauuuggcuua

SEQ ID NO: 1618900 - RNA, 17 nt, Homo sapiens
cauucaauuagugguca

SEQ ID NO: 1618901 - RNA, 12 nt, Homo sapiens
cauucacauuca

SEQ ID NO: 1618902 - RNA, 13 nt, Homo sapiens
cauucacauucag

SEQ ID NO: 1618903 - RNA, 18 nt, Homo sapiens
cauucagagguuuuguua

SEQ ID NO: 1618904 - RNA, 15 nt, Homo sapiens
cauucaggucuuucu

SEQ ID NO: 1618905 - RNA, 12 nt, Homo sapiens
cauuccaugaag

SEQ ID NO: 1618906 - RNA, 18 nt, Homo sapiens
cauucucugaguguuguu

SEQ ID NO: 1618907 - RNA, 20 nt, Homo sapiens
cauucuguuuaucaagccau

SEQ ID NO: 1618908 - RNA, 19 nt, Homo sapiens
cauugaagccgacucuggc

SEQ ID NO: 1618909 - RNA, 17 nt, Homo sapiens
cauugagucauuauccu

SEQ ID NO: 1618910 - RNA, 17 nt, Homo sapiens
cauugauccagucauuu

SEQ ID NO: 1618911 - RNA, 23 nt, Homo sapiens
cauugaugagcaagacauacuua

SEQ ID NO: 1618912 - RNA, 14 nt, Homo sapiens
cauugcaauuugca

SEQ ID NO: 1618913 - RNA, 12 nt, Homo sapiens
cauugcacuuuc

SEQ ID NO: 1618914 - RNA, 22 nt, Homo sapiens
cauuggagagaaaaaacuuaag

SEQ ID NO: 1618915 - RNA, 14 nt, Homo sapiens
cauuguaaaccaca

SEQ ID NO: 1618916 - RNA, 22 nt, Homo sapiens
cauugucguauaggcauguaaa

SEQ ID NO: 1618917 - RNA, 21 nt, Homo sapiens
cauuuaaauuccacagauuau

SEQ ID NO: 1618918 - RNA, 18 nt, Homo sapiens
cauuuaagacacauugac

SEQ ID NO: 1618919 - RNA, 19 nt, Homo sapiens
cauuuauaaagggacacuu

SEQ ID NO: 1618920 - RNA, 19 nt, Homo sapiens
cauuuauuuaagacacugu

SEQ ID NO: 1618921 - RNA, 16 nt, Homo sapiens
cauuucagauauucca

SEQ ID NO: 1618922 - RNA, 13 nt, Homo sapiens
cauuucauuccau

SEQ ID NO: 1618923 - RNA, 23 nt, Homo sapiens
cauuucucauaccuuccccacau

SEQ ID NO: 1618924 - RNA, 15 nt, Homo sapiens
cauuugagcagcuga

SEQ ID NO: 1618925 - RNA, 22 nt, Homo sapiens
cauuuuauucacauaugucuua

SEQ ID NO: 1618926 - RNA, 20 nt, Homo sapiens
cauuuucccccacuacugca

SEQ ID NO: 1618927 - RNA, 21 nt, Homo sapiens
cauuuuuaagauagaacacaa

SEQ ID NO: 1618928 - RNA, 20 nt, Homo sapiens
ccaaaccugucuuggggcca

SEQ ID NO: 1618929 - RNA, 12 nt, Homo sapiens
ccaaagaagcag

SEQ ID NO: 1618930 - RNA, 22 nt, Homo sapiens
ccaaagagauauugauauugaa

SEQ ID NO: 1618931 - RNA, 22 nt, Homo sapiens
ccaaagcacuugcuuacauccu

SEQ ID NO: 1618932 - RNA, 17 nt, Homo sapiens
ccaaagcuuaugugaca

SEQ ID NO: 1618933 - RNA, 14 nt, Homo sapiens
ccaaagugguauag

SEQ ID NO: 1618934 - RNA, 13 nt, Homo sapiens
ccaaaguugcuca

SEQ ID NO: 1618935 - RNA, 14 nt, Homo sapiens
ccaaaguugcucac

SEQ ID NO: 1618936 - RNA, 21 nt, Homo sapiens
ccaaauccaaggaaacaugca

SEQ ID NO: 1618937 - RNA, 21 nt, Homo sapiens
ccaaauuuggcaaaacagccc

SEQ ID NO: 1618938 - RNA, 16 nt, Homo sapiens
ccaaauuuggcuaaaa

SEQ ID NO: 1618939 - RNA, 21 nt, Homo sapiens
ccaacacugucacuagucuca

SEQ ID NO: 1618940 - RNA, 21 nt, Homo sapiens
ccaacaugaaaacaauucuua

SEQ ID NO: 1618941 - RNA, 15 nt, Homo sapiens
ccaacaugcacugau

SEQ ID NO: 1618942 - RNA, 16 nt, Homo sapiens
ccaaccugaagacacc

SEQ ID NO: 1618943 - RNA, 24 nt, Homo sapiens
ccaacguaugugguuaucugugaa

SEQ ID NO: 1618944 - RNA, 16 nt, Homo sapiens
ccaacuacucagccua

SEQ ID NO: 1618945 - RNA, 12 nt, Homo sapiens
ccaacuccucac

SEQ ID NO: 1618946 - RNA, 21 nt, Homo sapiens
ccaacucuacacagcucagca

SEQ ID NO: 1618947 - RNA, 18 nt, Homo sapiens
ccaacugaacugaacuaa

SEQ ID NO: 1618948 - RNA, 16 nt, Homo sapiens
ccaagaaaauaucacu

SEQ ID NO: 1618949 - RNA, 15 nt, Homo sapiens
ccaagacaugacauu

SEQ ID NO: 1618950 - RNA, 21 nt, Homo sapiens
ccaagaucugccagaccugca

SEQ ID NO: 1618951 - RNA, 12 nt, Homo sapiens
ccaagcacccag

SEQ ID NO: 1618952 - RNA, 12 nt, Homo sapiens
ccaagcauuuca

SEQ ID NO: 1618953 - RNA, 16 nt, Homo sapiens
ccaagcuagacugugu

SEQ ID NO: 1618954 - RNA, 21 nt, Homo sapiens
ccaagcuuucagacaagaaug

SEQ ID NO: 1618955 - RNA, 15 nt, Homo sapiens
ccaaggacucuucca

SEQ ID NO: 1618956 - RNA, 18 nt, Homo sapiens
ccaaggacugagggcagu

SEQ ID NO: 1618957 - RNA, 23 nt, Homo sapiens
ccaaggcauugauugcacuugau

SEQ ID NO: 1618958 - RNA, 14 nt, Homo sapiens
ccaaguaccaguau

SEQ ID NO: 1618959 - RNA, 21 nt, Homo sapiens
ccaaguucuuaguugcuguau

SEQ ID NO: 1618960 - RNA, 14 nt, Homo sapiens
ccaauacagucuag

SEQ ID NO: 1618961 - RNA, 17 nt, Homo sapiens
ccaaucacccuguaaua

SEQ ID NO: 1618962 - RNA, 18 nt, Homo sapiens
ccaaucugcauuucuuac

SEQ ID NO: 1618963 - RNA, 22 nt, Homo sapiens
ccaauguuugacaaaacacagc

SEQ ID NO: 1618964 - RNA, 12 nt, Homo sapiens
ccacacucagca

SEQ ID NO: 1618965 - RNA, 14 nt, Homo sapiens
ccacacuuccauga

SEQ ID NO: 1618966 - RNA, 14 nt, Homo sapiens
ccacagcacagcca

SEQ ID NO: 1618967 - RNA, 14 nt, Homo sapiens
ccacaggcacaggu

SEQ ID NO: 1618968 - RNA, 11 nt, Homo sapiens
ccacaucccag

SEQ ID NO: 1618969 - RNA, 21 nt, Homo sapiens
gcuuauaaaaauaaagggaag

SEQ ID NO: 1618970 - RNA, 14 nt, Homo sapiens
gcuuauaugugaca

SEQ ID NO: 1618971 - RNA, 13 nt, Homo sapiens
gcuuccaucccaa

SEQ ID NO: 1618972 - RNA, 17 nt, Homo sapiens
gcuucccagguucaagc

SEQ ID NO: 1618973 - RNA, 23 nt, Homo sapiens
gcuuccuagaaaguucuguguaa

SEQ ID NO: 1618974 - RNA, 20 nt, Homo sapiens
gcuuccuggggaccaagauu

SEQ ID NO: 1618975 - RNA, 22 nt, Homo sapiens
gcuuccuuagguugaugcugga

SEQ ID NO: 1618976 - RNA, 14 nt, Homo sapiens
gcuucuacugugac

SEQ ID NO: 1618977 - RNA, 15 nt, Homo sapiens
gcuucuacugugaca

SEQ ID NO: 1618978 - RNA, 15 nt, Homo sapiens
gcuucuccauggcca

SEQ ID NO: 1618979 - RNA, 21 nt, Homo sapiens
gcuucuucuucaagauuuaug

SEQ ID NO: 1618980 - RNA, 15 nt, Homo sapiens
gcuugcaugcuugca

SEQ ID NO: 1618981 - RNA, 11 nt, Homo sapiens
gcuugcuccca

SEQ ID NO: 1618982 - RNA, 18 nt, Homo sapiens
gcuugucaaaagaaauaa

SEQ ID NO: 1618983 - RNA, 17 nt, Homo sapiens
gcuuucauguuauuaaa

SEQ ID NO: 1618984 - RNA, 13 nt, Homo sapiens
gcuuuccaagcuu

SEQ ID NO: 1618985 - RNA, 16 nt, Homo sapiens
gcuuucgguacuguaa

SEQ ID NO: 1618986 - RNA, 15 nt, Homo sapiens
gcuuucuccauugua

SEQ ID NO: 1618987 - RNA, 21 nt, Homo sapiens
gcuuucuccauuguaaaccac

SEQ ID NO: 1618988 - RNA, 20 nt, Homo sapiens
gcuuugaaaagucacuuacu

SEQ ID NO: 1618989 - RNA, 14 nt, Homo sapiens
gcuuugcuccuuca

SEQ ID NO: 1618990 - RNA, 22 nt, Homo sapiens
gcuuugguaaaacaguuucauc

SEQ ID NO: 1618991 - RNA, 20 nt, Homo sapiens
gcuuuuauuugguguguucg

SEQ ID NO: 1618992 - RNA, 15 nt, Homo sapiens
ggaaaaaaacaugaa

SEQ ID NO: 1618993 - RNA, 17 nt, Homo sapiens
ggaaaaacaaacaugaa

SEQ ID NO: 1618994 - RNA, 14 nt, Homo sapiens
ggaaaaaccuugug

SEQ ID NO: 1618995 - RNA, 22 nt, Homo sapiens
ggaaaacuguguugccacagua

SEQ ID NO: 1618996 - RNA, 13 nt, Homo sapiens
ggaaaagcaagaa

SEQ ID NO: 1618997 - RNA, 17 nt, Homo sapiens
ggaaaaggccuggggug

SEQ ID NO: 1618998 - RNA, 12 nt, Homo sapiens
ggaaaauggagc

SEQ ID NO: 1618999 - RNA, 21 nt, Homo sapiens
ggaaaauggagccaugacaag

SEQ ID NO: 1619000 - RNA, 17 nt, Homo sapiens
ggaaauuaagacuuuau

SEQ ID NO: 1619001 - RNA, 21 nt, Homo sapiens
ggaacaaaacuccagacucuu

SEQ ID NO: 1619002 - RNA, 13 nt, Homo sapiens
ggaacacacuugg

SEQ ID NO: 1619003 - RNA, 15 nt, Homo sapiens
ggaacaguugcauuu

SEQ ID NO: 1619004 - RNA, 21 nt, Homo sapiens
ggaagaaacacguggucauga

SEQ ID NO: 1619005 - RNA, 14 nt, Homo sapiens
ggaagauaugccac

SEQ ID NO: 1619006 - RNA, 15 nt, Homo sapiens
ggaagaugcccucaa

SEQ ID NO: 1619007 - RNA, 14 nt, Homo sapiens
ggaagcuuacucuc

SEQ ID NO: 1619008 - RNA, 22 nt, Homo sapiens
ggaaggaaaucccaucagugaa

SEQ ID NO: 1619009 - RNA, 14 nt, Homo sapiens
ggaaguccuagccc

SEQ ID NO: 1619010 - RNA, 20 nt, Homo sapiens
ggaagugugacuucuuacac

SEQ ID NO: 1619011 - RNA, 13 nt, Homo sapiens
ggaauauuugaau

SEQ ID NO: 1619012 - RNA, 12 nt, Homo sapiens
ggaauucagugc

SEQ ID NO: 1619013 - RNA, 19 nt, Homo sapiens
ggacaaagaaauuccccaa

SEQ ID NO: 1619014 - RNA, 13 nt, Homo sapiens
ggacaaccuggac

SEQ ID NO: 1619015 - RNA, 11 nt, Homo sapiens
ggacacuccaa

SEQ ID NO: 1619016 - RNA, 21 nt, Homo sapiens
ggacagccuccuucagcccuu

SEQ ID NO: 1619017 - RNA, 16 nt, Homo sapiens
ggacauacacuugcau

SEQ ID NO: 1619018 - RNA, 16 nt, Homo sapiens
ggacaugaaaaauugc

SEQ ID NO: 1619019 - RNA, 13 nt, Homo sapiens
ggacauuccagua

SEQ ID NO: 1619020 - RNA, 19 nt, Homo sapiens
ggaccaccuccucugccag

SEQ ID NO: 1619021 - RNA, 22 nt, Homo sapiens
ggacguggcucagccagcacuu

SEQ ID NO: 1619022 - RNA, 13 nt, Homo sapiens
ggacucuuccacc

SEQ ID NO: 1619023 - RNA, 19 nt, Homo sapiens
ggacugaugccccagggau

SEQ ID NO: 1619024 - RNA, 20 nt, Homo sapiens
ggacugaugccccagggauu

SEQ ID NO: 1619025 - RNA, 22 nt, Homo sapiens
ggacuugccacccccaguuccu

SEQ ID NO: 1619026 - RNA, 13 nt, Homo sapiens
ggagaguaccugu

SEQ ID NO: 1619027 - RNA, 20 nt, Homo sapiens
ggagaguaccuguguguuuc

SEQ ID NO: 1619028 - RNA, 24 nt, Homo sapiens
ggagcaagcucuucccuugcucau

SEQ ID NO: 1619029 - RNA, 16 nt, Homo sapiens
ggagcacggacuguca

SEQ ID NO: 1619030 - RNA, 13 nt, Homo sapiens
ggagccaccagca

SEQ ID NO: 1619031 - RNA, 18 nt, Homo sapiens
ggagccccgccacagccu

SEQ ID NO: 1619032 - RNA, 16 nt, Homo sapiens
ggagcugccccucucu

SEQ ID NO: 1619033 - RNA, 15 nt, Homo sapiens
ggaggcaacgccaga

SEQ ID NO: 1619034 - RNA, 14 nt, Homo sapiens
ggaggccuuucauc

SEQ ID NO: 1619035 - RNA, 19 nt, Homo sapiens
ggagguugcaguaagccaa

SEQ ID NO: 1619036 - RNA, 18 nt, Homo sapiens
ggagucccugcaggugaa

SEQ ID NO: 1619037 - RNA, 15 nt, Homo sapiens
ggagugguuccugug

SEQ ID NO: 1619038 - RNA, 16 nt, Homo sapiens
ggaguuuugcucucug

SEQ ID NO: 1619039 - RNA, 12 nt, Homo sapiens
ggaucacagaca

SEQ ID NO: 1619040 - RNA, 12 nt, Homo sapiens
ggaucagcuuug

SEQ ID NO: 1619041 - RNA, 19 nt, Homo sapiens
ggaugaggucaccagggga

SEQ ID NO: 1619042 - RNA, 22 nt, Homo sapiens
ggaugcaggguuugagaauguu

SEQ ID NO: 1619043 - RNA, 22 nt, Homo sapiens
ggaugcauagccuggacacaga

SEQ ID NO: 1619044 - RNA, 13 nt, Homo sapiens
ggaugcugugcua

SEQ ID NO: 1619045 - RNA, 23 nt, Homo sapiens
ggauggaacacggccacaucaaa

SEQ ID NO: 1619046 - RNA, 18 nt, Homo sapiens
ggauguaagccuggagcu

SEQ ID NO: 1619047 - RNA, 18 nt, Homo sapiens
ggaugucccugggccagg

SEQ ID NO: 1619048 - RNA, 22 nt, Homo sapiens
ggaugucuccgucucugucuca

SEQ ID NO: 1619049 - RNA, 13 nt, Homo sapiens
ggauucuaaggaa

SEQ ID NO: 1619050 - RNA, 17 nt, Homo sapiens
ggcaaacuugcaguuua

SEQ ID NO: 1619051 - RNA, 22 nt, Homo sapiens
ggcaaagauuuuuggcacuuug

SEQ ID NO: 1619052 - RNA, 15 nt, Homo sapiens
ggcaacaggucaugu

SEQ ID NO: 1619053 - RNA, 15 nt, Homo sapiens
ggcaagagaauugaa

SEQ ID NO: 1619054 - RNA, 17 nt, Homo sapiens
ggcaagcccugcccaca

SEQ ID NO: 1619055 - RNA, 23 nt, Homo sapiens
ggcaauaaauauuagaagccugc

SEQ ID NO: 1619056 - RNA, 21 nt, Homo sapiens
ggcacacaucaggaguucaau

SEQ ID NO: 1619057 - RNA, 18 nt, Homo sapiens
ggcacccaugccaucuca

SEQ ID NO: 1619058 - RNA, 11 nt, Homo sapiens
ggcacugaccg

SEQ ID NO: 1619059 - RNA, 13 nt, Homo sapiens
ggcacuguucaau

SEQ ID NO: 1619060 - RNA, 20 nt, Homo sapiens
ggcagaccugacucucuuaa

SEQ ID NO: 1619061 - RNA, 19 nt, Homo sapiens
ggcagacugugaacuugac

SEQ ID NO: 1619062 - RNA, 17 nt, Homo sapiens
ggcagagucuaccuuga

SEQ ID NO: 1619063 - RNA, 18 nt, Homo sapiens
ggcaggaaauacuuugua

SEQ ID NO: 1619064 - RNA, 19 nt, Homo sapiens
ggcaggaccagguggcacu

SEQ ID NO: 1619065 - RNA, 13 nt, Homo sapiens
ggcaggagaagaa

SEQ ID NO: 1619066 - RNA, 17 nt, Homo sapiens
ggcaggcugaggugaga

SEQ ID NO: 1619067 - RNA, 17 nt, Homo sapiens
ggcagggcccacgugua

SEQ ID NO: 1619068 - RNA, 14 nt, Homo sapiens
ggcagggcccagug

SEQ ID NO: 1619069 - RNA, 13 nt, Homo sapiens
ggcagggugcagu

SEQ ID NO: 1619070 - RNA, 15 nt, Homo sapiens
ggcaguggcagggga

SEQ ID NO: 1619071 - RNA, 15 nt, Homo sapiens
ggcauuuccugggug

SEQ ID NO: 1619072 - RNA, 15 nt, Homo sapiens
ggccaagcugaggug

SEQ ID NO: 1619073 - RNA, 12 nt, Homo sapiens
ggccaaguguac

SEQ ID NO: 1619074 - RNA, 17 nt, Homo sapiens
ggccacauagaugcuga

SEQ ID NO: 1619075 - RNA, 20 nt, Homo sapiens
ggccaggcacccccaaauca

SEQ ID NO: 1619076 - RNA, 23 nt, Homo sapiens
ggccagggucugugugaaugugg

SEQ ID NO: 1619077 - RNA, 18 nt, Homo sapiens
ggccauuuuggugcuuau

SEQ ID NO: 1619078 - RNA, 17 nt, Homo sapiens
ggccccauuuacccaac

SEQ ID NO: 1619079 - RNA, 13 nt, Homo sapiens
ggcccccaucucc

SEQ ID NO: 1619080 - RNA, 21 nt, Homo sapiens
ggccccgugaggcaaugggag

SEQ ID NO: 1619081 - RNA, 20 nt, Homo sapiens
ggcccucuugaaucucugaa

SEQ ID NO: 1619082 - RNA, 18 nt, Homo sapiens
ggccgggcaauccagaca

SEQ ID NO: 1619083 - RNA, 17 nt, Homo sapiens
ggccuaacacugggcug

SEQ ID NO: 1619084 - RNA, 21 nt, Homo sapiens
ggccuaguacaaucuugggaa

SEQ ID NO: 1619085 - RNA, 23 nt, Homo sapiens
ggccucgaaaaccaucacaugac

SEQ ID NO: 1619086 - RNA, 16 nt, Homo sapiens
ggccucugagaagcuc

SEQ ID NO: 1619087 - RNA, 21 nt, Homo sapiens
ggccucuucuuccuaccuuga

SEQ ID NO: 1619088 - RNA, 15 nt, Homo sapiens
ggccugagugaccuc

SEQ ID NO: 1619089 - RNA, 16 nt, Homo sapiens
ggccuggggccugaga

SEQ ID NO: 1619090 - RNA, 14 nt, Homo sapiens
ggccuguccuccaa

SEQ ID NO: 1619091 - RNA, 17 nt, Homo sapiens
ggccuuagugggccagg

SEQ ID NO: 1619092 - RNA, 13 nt, Homo sapiens
ggccuuuccugug

SEQ ID NO: 1619093 - RNA, 16 nt, Homo sapiens
ggcggagguugcagua

SEQ ID NO: 1619094 - RNA, 22 nt, Homo sapiens
ggcuagauccgagguggcagcu

SEQ ID NO: 1619095 - RNA, 14 nt, Homo sapiens
ggcuauguaaacaa

SEQ ID NO: 1619096 - RNA, 16 nt, Homo sapiens
ggcucaagucugcaca

SEQ ID NO: 1619097 - RNA, 14 nt, Homo sapiens
ggcucagccucaaa

SEQ ID NO: 1619098 - RNA, 20 nt, Homo sapiens
ggcuccagaugcagggcagu

SEQ ID NO: 1619099 - RNA, 15 nt, Homo sapiens
ggcugaaagaugacg

SEQ ID NO: 1619100 - RNA, 18 nt, Homo sapiens
ggcugacaugaagcuguu

SEQ ID NO: 1619101 - RNA, 14 nt, Homo sapiens
ggcugcuuccugug

SEQ ID NO: 1619102 - RNA, 16 nt, Homo sapiens
ggcuggagugcaaugg

SEQ ID NO: 1619103 - RNA, 20 nt, Homo sapiens
ggcuggagugcaauggcgcg

SEQ ID NO: 1619104 - RNA, 20 nt, Homo sapiens
ggcuggagugcaguggcgca

SEQ ID NO: 1619105 - RNA, 13 nt, Homo sapiens
ggcuggcaguugg

SEQ ID NO: 1619106 - RNA, 17 nt, Homo sapiens
ggcugggacguggcuca

SEQ ID NO: 1619107 - RNA, 20 nt, Homo sapiens
ggcuguauuugcuguugauu

SEQ ID NO: 1619108 - RNA, 17 nt, Homo sapiens
ggcugucaucugugcac

SEQ ID NO: 1619109 - RNA, 13 nt, Homo sapiens
ggcugugccaacc

SEQ ID NO: 1619110 - RNA, 19 nt, Homo sapiens
ggcuuccccagguggccug

SEQ ID NO: 1619111 - RNA, 21 nt, Homo sapiens
ggcuucuguugucaccuucac

SEQ ID NO: 1619112 - RNA, 18 nt, Homo sapiens
ggcuuguaaaugugacac

SEQ ID NO: 1619113 - RNA, 9 nt, Homo sapiens
ggcuuuaug

SEQ ID NO: 1619114 - RNA, 14 nt, Homo sapiens
ggcuuuaugcaaau

SEQ ID NO: 1619115 - RNA, 15 nt, Homo sapiens
ggcuuuaugcaaaua

SEQ ID NO: 1619116 - RNA, 19 nt, Homo sapiens
ggcuuucugggugugacug

SEQ ID NO: 1619117 - RNA, 16 nt, Homo sapiens
gggaagaugcccucaa

SEQ ID NO: 1619118 - RNA, 14 nt, Homo sapiens
gggaaguaacagac

SEQ ID NO: 1619119 - RNA, 16 nt, Homo sapiens
gggaaugagcccagag

SEQ ID NO: 1619120 - RNA, 17 nt, Homo sapiens
gggaaugggacugugag

SEQ ID NO: 1619121 - RNA, 18 nt, Homo sapiens
gggaccaaccugaccuaa

SEQ ID NO: 1619122 - RNA, 22 nt, Homo sapiens
gggaccaauauuaccaucuuaa

SEQ ID NO: 1619123 - RNA, 13 nt, Homo sapiens
gggagaacgggaa

SEQ ID NO: 1619124 - RNA, 19 nt, Homo sapiens
gggagaggggagugcauuu

SEQ ID NO: 1619125 - RNA, 23 nt, Homo sapiens
gggaugucuccgucucugucuca

SEQ ID NO: 1619126 - RNA, 23 nt, Homo sapiens
gggauucacaaggugaagaacug

SEQ ID NO: 1619127 - RNA, 16 nt, Homo sapiens
gggcaaacaacugaac

SEQ ID NO: 1619128 - RNA, 17 nt, Homo sapiens
gggcaagcuuugcuccu

SEQ ID NO: 1619129 - RNA, 22 nt, Homo sapiens
gggcaguucgcagccacccuga

SEQ ID NO: 1619130 - RNA, 22 nt, Homo sapiens
gggccaucugacugccaagcca

SEQ ID NO: 1619131 - RNA, 19 nt, Homo sapiens
gggccuauggagagcccug

SEQ ID NO: 1619132 - RNA, 23 nt, Homo sapiens
gggccucaggcucugcacagaca

SEQ ID NO: 1619133 - RNA, 20 nt, Homo sapiens
gggccuggcuggcugagggc

SEQ ID NO: 1619134 - RNA, 22 nt, Homo sapiens
gggcggggcguguagccagcca

SEQ ID NO: 1619135 - RNA, 23 nt, Homo sapiens
gggcuauuuuuucccccacaaac

SEQ ID NO: 1619136 - RNA, 21 nt, Homo sapiens
gggcucccguggccuguagaa

SEQ ID NO: 1619137 - RNA, 20 nt, Homo sapiens
gggcugucaucugugcacug

SEQ ID NO: 1619138 - RNA, 19 nt, Homo sapiens
ggggacgcccccagugaga

SEQ ID NO: 1619139 - RNA, 14 nt, Homo sapiens
ggggcagcacuccc

SEQ ID NO: 1619140 - RNA, 16 nt, Homo sapiens
ggggccacguggaugg

SEQ ID NO: 1619141 - RNA, 14 nt, Homo sapiens
ggggcuuuugccac

SEQ ID NO: 1619142 - RNA, 16 nt, Homo sapiens
gggggcggccuaugac

SEQ ID NO: 1619143 - RNA, 23 nt, Homo sapiens
gggggcucccguggccuguagaa

SEQ ID NO: 1619144 - RNA, 21 nt, Homo sapiens
ggggugugccugucuguuaca

SEQ ID NO: 1619145 - RNA, 20 nt, Homo sapiens
gggucccaucagugaaagaa

SEQ ID NO: 1619146 - RNA, 14 nt, Homo sapiens
gggucucagaugga

SEQ ID NO: 1619147 - RNA, 20 nt, Homo sapiens
gggugauuacauaaucugua

SEQ ID NO: 1619148 - RNA, 17 nt, Homo sapiens
gguaaaacucacuguga

SEQ ID NO: 1619149 - RNA, 19 nt, Homo sapiens
gguaaaacucacugugauc

SEQ ID NO: 1619150 - RNA, 20 nt, Homo sapiens
gguaauguuaguaaauccau

SEQ ID NO: 1619151 - RNA, 22 nt, Homo sapiens
gguagccagcacacagggcagu

SEQ ID NO: 1619152 - RNA, 23 nt, Homo sapiens
gguaggucauucuuuugccacau

SEQ ID NO: 1619153 - RNA, 21 nt, Homo sapiens
gguaucauugucuuuccugaa

SEQ ID NO: 1619154 - RNA, 13 nt, Homo sapiens
ggucagcauguac

SEQ ID NO: 1619155 - RNA, 18 nt, Homo sapiens
ggucauucuuuugccaca

SEQ ID NO: 1619156 - RNA, 23 nt, Homo sapiens
gguccaaagaguuucugcaaagu

SEQ ID NO: 1619157 - RNA, 19 nt, Homo sapiens
gguccucugucagucacag

SEQ ID NO: 1619158 - RNA, 21 nt, Homo sapiens
ggucguggagagcuaggagca

SEQ ID NO: 1619159 - RNA, 16 nt, Homo sapiens
ggucuaagguucagcc

SEQ ID NO: 1619160 - RNA, 15 nt, Homo sapiens
ggucuaggacacagu

SEQ ID NO: 1619161 - RNA, 19 nt, Homo sapiens
ggucugauuuugagguuua

SEQ ID NO: 1619162 - RNA, 14 nt, Homo sapiens
ggugagaugcagcu

SEQ ID NO: 1619163 - RNA, 15 nt, Homo sapiens
ggugagaugcagcug

SEQ ID NO: 1619164 - RNA, 15 nt, Homo sapiens
gguggaacaagcaca

SEQ ID NO: 1619165 - RNA, 20 nt, Homo sapiens
gguggagugcaguggugcga

SEQ ID NO: 1619166 - RNA, 22 nt, Homo sapiens
gguggcccuaaaggacucucca

SEQ ID NO: 1619167 - RNA, 14 nt, Homo sapiens
gguguggagugacu

SEQ ID NO: 1619168 - RNA, 17 nt, Homo sapiens
gguuaugugaguguugu

SEQ ID NO: 1619169 - RNA, 16 nt, Homo sapiens
gguucacaccauucuc

SEQ ID NO: 1619170 - RNA, 21 nt, Homo sapiens
gguucccaaaucccucucaca

SEQ ID NO: 1619171 - RNA, 14 nt, Homo sapiens
gguugccacccaag

SEQ ID NO: 1619172 - RNA, 18 nt, Homo sapiens
gguuggaagugugacuuc

SEQ ID NO: 1619173 - RNA, 14 nt, Homo sapiens
gguuuagaucaaau

SEQ ID NO: 1619174 - RNA, 22 nt, Homo sapiens
gguuugagaauguuuuuagcug

SEQ ID NO: 1619175 - RNA, 15 nt, Homo sapiens
guaaaacaaucuguu

SEQ ID NO: 1619176 - RNA, 12 nt, Homo sapiens
guaaaaugaagg

SEQ ID NO: 1619177 - RNA, 20 nt, Homo sapiens
guaaauaugugacauuccug

SEQ ID NO: 1619178 - RNA, 12 nt, Homo sapiens
guaaauucugua

SEQ ID NO: 1619179 - RNA, 19 nt, Homo sapiens
guaacaaaccugcacuuau

SEQ ID NO: 1619180 - RNA, 20 nt, Homo sapiens
guaacaaauaaauaagauca

SEQ ID NO: 1619181 - RNA, 12 nt, Homo sapiens
guaacuugccau

SEQ ID NO: 1619182 - RNA, 16 nt, Homo sapiens
guaagaccaccuuccc

SEQ ID NO: 1619183 - RNA, 21 nt, Homo sapiens
guaagccaaggucaugccacu

SEQ ID NO: 1619184 - RNA, 17 nt, Homo sapiens
guaauaauaaugggaga

SEQ ID NO: 1619185 - RNA, 20 nt, Homo sapiens
guaauguuaguaaauccaug

SEQ ID NO: 1619186 - RNA, 22 nt, Homo sapiens
guaauuuuucugggaaguccua

SEQ ID NO: 1619187 - RNA, 20 nt, Homo sapiens
guacaaugaacccccaugau

SEQ ID NO: 1619188 - RNA, 18 nt, Homo sapiens
uaauaugguguacauucu

SEQ ID NO: 1619189 - RNA, 17 nt, Homo sapiens
uaaucacaaauuucacu

SEQ ID NO: 1619190 - RNA, 21 nt, Homo sapiens
uaaucagcaagaauuugaucg

SEQ ID NO: 1619191 - RNA, 14 nt, Homo sapiens
uaaucaguucugug

SEQ ID NO: 1619192 - RNA, 14 nt, Homo sapiens
uaaugaaacacagc

SEQ ID NO: 1619193 - RNA, 13 nt, Homo sapiens
uaaugaagaauca

SEQ ID NO: 1619194 - RNA, 17 nt, Homo sapiens
uaaugauaaaauagcca

SEQ ID NO: 1619195 - RNA, 15 nt, Homo sapiens
uaaugauaaaguaau

SEQ ID NO: 1619196 - RNA, 20 nt, Homo sapiens
uaaugaucucaaacuaugac

SEQ ID NO: 1619197 - RNA, 17 nt, Homo sapiens
uaaugauuuuacuuaac

SEQ ID NO: 1619198 - RNA, 18 nt, Homo sapiens
uaaugcucaacaauuuau

SEQ ID NO: 1619199 - RNA, 15 nt, Homo sapiens
uaaugcuuuuacuaa

SEQ ID NO: 1619200 - RNA, 21 nt, Homo sapiens
uaaugcuuuuacuaagcacug

SEQ ID NO: 1619201 - RNA, 16 nt, Homo sapiens
uaauggccggcuggaa

SEQ ID NO: 1619202 - RNA, 22 nt, Homo sapiens
uaauggggugagcucacaacca

SEQ ID NO: 1619203 - RNA, 18 nt, Homo sapiens
uaauggucaaugcuagca

SEQ ID NO: 1619204 - RNA, 20 nt, Homo sapiens
uaauguaucuuaaaggacau

SEQ ID NO: 1619205 - RNA, 17 nt, Homo sapiens
uaaugucauggccuuga

SEQ ID NO: 1619206 - RNA, 14 nt, Homo sapiens
uaauguugaugaau

SEQ ID NO: 1619207 - RNA, 20 nt, Homo sapiens
uaauuaacuguaaacuugga

SEQ ID NO: 1619208 - RNA, 13 nt, Homo sapiens
uaauuacuacuag

SEQ ID NO: 1619209 - RNA, 15 nt, Homo sapiens
uaauuaugcaauuag

SEQ ID NO: 1619210 - RNA, 22 nt, Homo sapiens
uaauuauuguuauacacagcuu

SEQ ID NO: 1619211 - RNA, 14 nt, Homo sapiens
uaauucuggagaua

SEQ ID NO: 1619212 - RNA, 17 nt, Homo sapiens
uaauuuacaagcacgau

SEQ ID NO: 1619213 - RNA, 18 nt, Homo sapiens
uaauuuguaaacuucuga

SEQ ID NO: 1619214 - RNA, 15 nt, Homo sapiens
uacaaaauccagcua

SEQ ID NO: 1619215 - RNA, 13 nt, Homo sapiens
uacaaagaaauaa

SEQ ID NO: 1619216 - RNA, 20 nt, Homo sapiens
uacaacaucaccagugccac

SEQ ID NO: 1619217 - RNA, 20 nt, Homo sapiens
uacaauauuaaguccaaauc

SEQ ID NO: 1619218 - RNA, 16 nt, Homo sapiens
uacaaucagcccagug

SEQ ID NO: 1619219 - RNA, 21 nt, Homo sapiens
uacaaucagcccagugcaaac

SEQ ID NO: 1619220 - RNA, 21 nt, Homo sapiens
uacaaucuuagugaaugggaa

SEQ ID NO: 1619221 - RNA, 13 nt, Homo sapiens
uacaauguagaug

SEQ ID NO: 1619222 - RNA, 16 nt, Homo sapiens
uacacaaaccugaaaa

SEQ ID NO: 1619223 - RNA, 19 nt, Homo sapiens
uacacacacacgcacacaa

SEQ ID NO: 1619224 - RNA, 17 nt, Homo sapiens
uacacagaauuguucca

SEQ ID NO: 1619225 - RNA, 11 nt, Homo sapiens
uacacagagaa

SEQ ID NO: 1619226 - RNA, 15 nt, Homo sapiens
uacacauacauguaa

SEQ ID NO: 1619227 - RNA, 14 nt, Homo sapiens
uacaggcgugagcc

SEQ ID NO: 1619228 - RNA, 20 nt, Homo sapiens
uacaggggcccgccaccaca

SEQ ID NO: 1619229 - RNA, 20 nt, Homo sapiens
uacagguuaagacaaagggu

SEQ ID NO: 1619230 - RNA, 23 nt, Homo sapiens
uacagucacuaauauaguagauu

SEQ ID NO: 1619231 - RNA, 16 nt, Homo sapiens
uacagucuuguauuaa

SEQ ID NO: 1619232 - RNA, 21 nt, Homo sapiens
uacauagaaagccaugugcua

SEQ ID NO: 1619233 - RNA, 17 nt, Homo sapiens
uacauaggucuguaugg

SEQ ID NO: 1619234 - RNA, 12 nt, Homo sapiens
uacauaugcuga

SEQ ID NO: 1619235 - RNA, 18 nt, Homo sapiens
uacauauguaaacauaag

SEQ ID NO: 1619236 - RNA, 13 nt, Homo sapiens
uacauccaaagca

SEQ ID NO: 1619237 - RNA, 18 nt, Homo sapiens
uacauccagucacuuugc

SEQ ID NO: 1619238 - RNA, 17 nt, Homo sapiens
uacaugguuuaaaguca

SEQ ID NO: 1619239 - RNA, 21 nt, Homo sapiens
uacauguuuauaaaucuuaug

SEQ ID NO: 1619240 - RNA, 20 nt, Homo sapiens
uacauuuucaguaccaaaga

SEQ ID NO: 1619241 - RNA, 19 nt, Homo sapiens
uacauuuuguaaaauauua

SEQ ID NO: 1619242 - RNA, 18 nt, Homo sapiens
uaccacacccagggcuau

SEQ ID NO: 1619243 - RNA, 12 nt, Homo sapiens
uaccaguacuug

SEQ ID NO: 1619244 - RNA, 14 nt, Homo sapiens
uaccauacauuuaa

SEQ ID NO: 1619245 - RNA, 16 nt, Homo sapiens
uaccauucacuacuca

SEQ ID NO: 1619246 - RNA, 19 nt, Homo sapiens
uacccgagaagcacuugag

SEQ ID NO: 1619247 - RNA, 14 nt, Homo sapiens
uaccugacugccac

SEQ ID NO: 1619248 - RNA, 20 nt, Homo sapiens
uaccugcagccagcagagcu

SEQ ID NO: 1619249 - RNA, 17 nt, Homo sapiens
uaccuguccaagacagg

SEQ ID NO: 1619250 - RNA, 15 nt, Homo sapiens
uaccuuucagugcag

SEQ ID NO: 1619251 - RNA, 18 nt, Homo sapiens
uacgugagaaauagcuga

SEQ ID NO: 1619252 - RNA, 17 nt, Homo sapiens
uacuaaaacacugaaaa

SEQ ID NO: 1619253 - RNA, 19 nt, Homo sapiens
uacuaacauuuucauugau

SEQ ID NO: 1619254 - RNA, 24 nt, Homo sapiens
uacuaacauuuucauugaugagca

SEQ ID NO: 1619255 - RNA, 16 nt, Homo sapiens
uacuaagauacuccau

SEQ ID NO: 1619256 - RNA, 14 nt, Homo sapiens
uacuaagggaacaa

SEQ ID NO: 1619257 - RNA, 14 nt, Homo sapiens
uacuagcaggcaau

SEQ ID NO: 1619258 - RNA, 12 nt, Homo sapiens
uacuauggagug

SEQ ID NO: 1619259 - RNA, 10 nt, Homo sapiens
uacucagcuu

SEQ ID NO: 1619260 - RNA, 20 nt, Homo sapiens
uacucuuucuaaugcugaua

SEQ ID NO: 1619261 - RNA, 14 nt, Homo sapiens
uacugaaaauccaa

SEQ ID NO: 1619262 - RNA, 16 nt, Homo sapiens
uacugcagcaccucca

SEQ ID NO: 1619263 - RNA, 17 nt, Homo sapiens
uacugccaaccuggaau

SEQ ID NO: 1619264 - RNA, 18 nt, Homo sapiens
uacuuaacauuucauugu

SEQ ID NO: 1619265 - RNA, 17 nt, Homo sapiens
uacuuccccagaugccu

SEQ ID NO: 1619266 - RNA, 12 nt, Homo sapiens
uacuugucauau

SEQ ID NO: 1619267 - RNA, 21 nt, Homo sapiens
uacuuuaaauccuaccaaagu

SEQ ID NO: 1619268 - RNA, 22 nt, Homo sapiens
uacuuucuauucuuuagcugua

SEQ ID NO: 1619269 - RNA, 12 nt, Homo sapiens
uacuuugugcau

SEQ ID NO: 1619270 - RNA, 15 nt, Homo sapiens
uacuuuguuaggauu

SEQ ID NO: 1619271 - RNA, 15 nt, Homo sapiens
uacuuuuuaguaauu

SEQ ID NO: 1619272 - RNA, 14 nt, Homo sapiens
uagaaagaaacuaa

SEQ ID NO: 1619273 - RNA, 13 nt, Homo sapiens
uagaaaguagcca

SEQ ID NO: 1619274 - RNA, 18 nt, Homo sapiens
uagaacugucugugaaca

SEQ ID NO: 1619275 - RNA, 22 nt, Homo sapiens
uagaagcagagggacaaccaga

SEQ ID NO: 1619276 - RNA, 23 nt, Homo sapiens
uagaagccugcagaauccagcua

SEQ ID NO: 1619277 - RNA, 22 nt, Homo sapiens
uagaaguuaaugauuuuacuua

SEQ ID NO: 1619278 - RNA, 23 nt, Homo sapiens
uagaaguuaaugauuuuacuuaa

SEQ ID NO: 1619279 - RNA, 21 nt, Homo sapiens
uagaauagccuguggccuuug

SEQ ID NO: 1619280 - RNA, 22 nt, Homo sapiens
uagaauagccuguggccuuugc

SEQ ID NO: 1619281 - RNA, 15 nt, Homo sapiens
uagacaggaaagcca

SEQ ID NO: 1619282 - RNA, 13 nt, Homo sapiens
uagaccuaaaaua

SEQ ID NO: 1619283 - RNA, 21 nt, Homo sapiens
uagacuaccggacacucguca

SEQ ID NO: 1619284 - RNA, 20 nt, Homo sapiens
uagagacgggguuucacugu

SEQ ID NO: 1619285 - RNA, 22 nt, Homo sapiens
uagagaugagguuucaccauga

SEQ ID NO: 1619286 - RNA, 18 nt, Homo sapiens
uagagcauaccacuugaa

SEQ ID NO: 1619287 - RNA, 18 nt, Homo sapiens
uagagucauguuugcacu

SEQ ID NO: 1619288 - RNA, 22 nt, Homo sapiens
uagaguguagccuaaagggcag

SEQ ID NO: 1619289 - RNA, 15 nt, Homo sapiens
uagaguguagcugua

SEQ ID NO: 1619290 - RNA, 17 nt, Homo sapiens
uagauaauaaaauugcu

SEQ ID NO: 1619291 - RNA, 20 nt, Homo sapiens
uagauaaucucuccauuccc

SEQ ID NO: 1619292 - RNA, 17 nt, Homo sapiens
uagauauaacacuaugu

SEQ ID NO: 1619293 - RNA, 22 nt, Homo sapiens
uagauauaacacuauguuuauu

SEQ ID NO: 1619294 - RNA, 17 nt, Homo sapiens
uagaugauaaaagagaa

SEQ ID NO: 1619295 - RNA, 12 nt, Homo sapiens
uagaugauuuca

SEQ ID NO: 1619296 - RNA, 21 nt, Homo sapiens
uagcaaagacuugugugaugc

SEQ ID NO: 1619297 - RNA, 19 nt, Homo sapiens
uagcaagauauugaucaaa

SEQ ID NO: 1619298 - RNA, 19 nt, Homo sapiens
ucccuuagugacucuugaa

SEQ ID NO: 1619299 - RNA, 17 nt, Homo sapiens
ucccuuccaccucacaa

SEQ ID NO: 1619300 - RNA, 21 nt, Homo sapiens
ucccuugcuggaaaacccaaa

SEQ ID NO: 1619301 - RNA, 17 nt, Homo sapiens
uccgacgcugccucuca

SEQ ID NO: 1619302 - RNA, 19 nt, Homo sapiens
uccgaggccccugucucag

SEQ ID NO: 1619303 - RNA, 14 nt, Homo sapiens
uccgccagauccug

SEQ ID NO: 1619304 - RNA, 14 nt, Homo sapiens
uccgccugccucag

SEQ ID NO: 1619305 - RNA, 17 nt, Homo sapiens
uccgcuagcaguacuaa

SEQ ID NO: 1619306 - RNA, 10 nt, Homo sapiens
uccggcucua

SEQ ID NO: 1619307 - RNA, 15 nt, Homo sapiens
uccgguggaaggccu

SEQ ID NO: 1619308 - RNA, 15 nt, Homo sapiens
uccguacaccccagc

SEQ ID NO: 1619309 - RNA, 24 nt, Homo sapiens
uccuaaagaaaaauaucuuggccu

SEQ ID NO: 1619310 - RNA, 18 nt, Homo sapiens
uccuaaccucaagugauc

SEQ ID NO: 1619311 - RNA, 19 nt, Homo sapiens
uccuacagcacuacugggu

SEQ ID NO: 1619312 - RNA, 23 nt, Homo sapiens
uccuaggaugucaugucugcuug

SEQ ID NO: 1619313 - RNA, 15 nt, Homo sapiens
uccuaugcugcaaua

SEQ ID NO: 1619314 - RNA, 22 nt, Homo sapiens
uccuaugugauuuuaacucugu

SEQ ID NO: 1619315 - RNA, 13 nt, Homo sapiens
uccucacucuuca

SEQ ID NO: 1619316 - RNA, 21 nt, Homo sapiens
uccucaggugauuuguaugcu

SEQ ID NO: 1619317 - RNA, 22 nt, Homo sapiens
uccuccaacaccaagcacagca

SEQ ID NO: 1619318 - RNA, 21 nt, Homo sapiens
uccuccagcccagacccagug

SEQ ID NO: 1619319 - RNA, 20 nt, Homo sapiens
uccuccagggugugugcucg

SEQ ID NO: 1619320 - RNA, 17 nt, Homo sapiens
uccuccauuuuccuccc

SEQ ID NO: 1619321 - RNA, 19 nt, Homo sapiens
uccucuccuccagcccaga

SEQ ID NO: 1619322 - RNA, 18 nt, Homo sapiens
uccucucguccuuggaua

SEQ ID NO: 1619323 - RNA, 15 nt, Homo sapiens
uccucugcauuuaca

SEQ ID NO: 1619324 - RNA, 13 nt, Homo sapiens
uccucuggaucac

SEQ ID NO: 1619325 - RNA, 16 nt, Homo sapiens
uccucuggaucacaga

SEQ ID NO: 1619326 - RNA, 22 nt, Homo sapiens
uccugagacaaauuuuaacuuc

SEQ ID NO: 1619327 - RNA, 20 nt, Homo sapiens
uccugaucgccaaccuuucc

SEQ ID NO: 1619328 - RNA, 19 nt, Homo sapiens
uccugcagaaguacuccua

SEQ ID NO: 1619329 - RNA, 14 nt, Homo sapiens
uccugccaggguga

SEQ ID NO: 1619330 - RNA, 23 nt, Homo sapiens
uccugccagggugagcaggguca

SEQ ID NO: 1619331 - RNA, 18 nt, Homo sapiens
uccugccucuacugggaa

SEQ ID NO: 1619332 - RNA, 19 nt, Homo sapiens
uccugccucuacugggaag

SEQ ID NO: 1619333 - RNA, 16 nt, Homo sapiens
uccuggacaaccugga

SEQ ID NO: 1619334 - RNA, 22 nt, Homo sapiens
uccuggacaaccuggacccaga

SEQ ID NO: 1619335 - RNA, 15 nt, Homo sapiens
uccuggacagcugug

SEQ ID NO: 1619336 - RNA, 17 nt, Homo sapiens
uccuggugccaccucag

SEQ ID NO: 1619337 - RNA, 20 nt, Homo sapiens
uccuguaccgucgacaagaa

SEQ ID NO: 1619338 - RNA, 21 nt, Homo sapiens
uccuguccucuggaucacaga

SEQ ID NO: 1619339 - RNA, 20 nt, Homo sapiens
uccuguggucucugaccagg

SEQ ID NO: 1619340 - RNA, 20 nt, Homo sapiens
uccuguguguacucugucca

SEQ ID NO: 1619341 - RNA, 16 nt, Homo sapiens
uccuuccagcuaguga

SEQ ID NO: 1619342 - RNA, 15 nt, Homo sapiens
uccuuccaggugauu

SEQ ID NO: 1619343 - RNA, 15 nt, Homo sapiens
uccuucucacacaca

SEQ ID NO: 1619344 - RNA, 20 nt, Homo sapiens
uccuucuuucuaguucagcu

SEQ ID NO: 1619345 - RNA, 15 nt, Homo sapiens
uccuugaaaaugugu

SEQ ID NO: 1619346 - RNA, 13 nt, Homo sapiens
uccuugacccaga

SEQ ID NO: 1619347 - RNA, 14 nt, Homo sapiens
uccuugacuguaaa

SEQ ID NO: 1619348 - RNA, 15 nt, Homo sapiens
uccuuggaaauugga

SEQ ID NO: 1619349 - RNA, 15 nt, Homo sapiens
uccuuggcuuuaugc

SEQ ID NO: 1619350 - RNA, 22 nt, Homo sapiens
uccuuggcuuuaugcaaauaca

SEQ ID NO: 1619351 - RNA, 22 nt, Homo sapiens
uccuuuacaaacauacagucca

SEQ ID NO: 1619352 - RNA, 17 nt, Homo sapiens
uccuuucgaaagcaaug

SEQ ID NO: 1619353 - RNA, 23 nt, Homo sapiens
uccuuugucauuauuagucuuca

SEQ ID NO: 1619354 - RNA, 19 nt, Homo sapiens
uccuuuuaaagaagcuuua

SEQ ID NO: 1619355 - RNA, 20 nt, Homo sapiens
uccuuuuaucucacaaauaa

SEQ ID NO: 1619356 - RNA, 12 nt, Homo sapiens
ucgaaagcaaug

SEQ ID NO: 1619357 - RNA, 19 nt, Homo sapiens
ucgaagaaaggcagaagaa

SEQ ID NO: 1619358 - RNA, 16 nt, Homo sapiens
ucgggcgcgaccugcu

SEQ ID NO: 1619359 - RNA, 13 nt, Homo sapiens
ucguauccaccuu

SEQ ID NO: 1619360 - RNA, 13 nt, Homo sapiens
ucuaaaaacuuag

SEQ ID NO: 1619361 - RNA, 15 nt, Homo sapiens
ucuaaaaacuuagaa

SEQ ID NO: 1619362 - RNA, 13 nt, Homo sapiens
ucuaaacuuuccc

SEQ ID NO: 1619363 - RNA, 23 nt, Homo sapiens
ucuaaauuaaagagaaaauugag

SEQ ID NO: 1619364 - RNA, 23 nt, Homo sapiens
ucuaagauggauuaaacaaguau

SEQ ID NO: 1619365 - RNA, 18 nt, Homo sapiens
ucuaagcccaggaucucu

SEQ ID NO: 1619366 - RNA, 15 nt, Homo sapiens
ucuaagguacugugg

SEQ ID NO: 1619367 - RNA, 17 nt, Homo sapiens
ucuaaguguacuucaua

SEQ ID NO: 1619368 - RNA, 15 nt, Homo sapiens
ucuaauuacauuuca

SEQ ID NO: 1619369 - RNA, 13 nt, Homo sapiens
ucuacacauacau

SEQ ID NO: 1619370 - RNA, 19 nt, Homo sapiens
ucuacacauacauguaaaa

SEQ ID NO: 1619371 - RNA, 19 nt, Homo sapiens
ucuagaacuuaaguuugau

SEQ ID NO: 1619372 - RNA, 19 nt, Homo sapiens
ucuagaaucauacuuaaca

SEQ ID NO: 1619373 - RNA, 17 nt, Homo sapiens
ucuagaaugagcaagac

SEQ ID NO: 1619374 - RNA, 15 nt, Homo sapiens
ucuagcuuugucaua

SEQ ID NO: 1619375 - RNA, 22 nt, Homo sapiens
ucuaggcaggcaagagaauuga

SEQ ID NO: 1619376 - RNA, 18 nt, Homo sapiens
ucuaggcuaccagaagag

SEQ ID NO: 1619377 - RNA, 15 nt, Homo sapiens
ucuaguacacuuuua

SEQ ID NO: 1619378 - RNA, 19 nt, Homo sapiens
ucuauaguugucaguauua

SEQ ID NO: 1619379 - RNA, 21 nt, Homo sapiens
ucuaucaaauacuaguauuaa

SEQ ID NO: 1619380 - RNA, 24 nt, Homo sapiens
ucuaucacugcauuaucuugcuca

SEQ ID NO: 1619381 - RNA, 18 nt, Homo sapiens
ucuaucccuuaccugcuu

SEQ ID NO: 1619382 - RNA, 13 nt, Homo sapiens
ucuaugauguugc

SEQ ID NO: 1619383 - RNA, 15 nt, Homo sapiens
ucuauguucaaagac

SEQ ID NO: 1619384 - RNA, 12 nt, Homo sapiens
ucuauucuagcc

SEQ ID NO: 1619385 - RNA, 18 nt, Homo sapiens
ucuauuuuucaaucauca

SEQ ID NO: 1619386 - RNA, 14 nt, Homo sapiens
ucucaacauacugu

SEQ ID NO: 1619387 - RNA, 15 nt, Homo sapiens
ucucaacucacugca

SEQ ID NO: 1619388 - RNA, 17 nt, Homo sapiens
ucucacaaauaaguaau

SEQ ID NO: 1619389 - RNA, 19 nt, Homo sapiens
ucucacaaauaaguaauau

SEQ ID NO: 1619390 - RNA, 20 nt, Homo sapiens
ucucacggcuuguaaaugug

SEQ ID NO: 1619391 - RNA, 17 nt, Homo sapiens
ucucagaagguagggga

SEQ ID NO: 1619392 - RNA, 16 nt, Homo sapiens
ucucauccauggauuc

SEQ ID NO: 1619393 - RNA, 17 nt, Homo sapiens
ucuccaacggcaaggga

SEQ ID NO: 1619394 - RNA, 15 nt, Homo sapiens
ucuccagccacucca

SEQ ID NO: 1619395 - RNA, 21 nt, Homo sapiens
ucuccccucacacuuugccau

SEQ ID NO: 1619396 - RNA, 20 nt, Homo sapiens
ucuccccugaccugugagcc

SEQ ID NO: 1619397 - RNA, 12 nt, Homo sapiens
ucucccuuccac

SEQ ID NO: 1619398 - RNA, 22 nt, Homo sapiens
ucuccuaaaacuuuaaaacuug

SEQ ID NO: 1619399 - RNA, 14 nt, Homo sapiens
ucuccuccauuccc

SEQ ID NO: 1619400 - RNA, 12 nt, Homo sapiens
ucuccucuccau

SEQ ID NO: 1619401 - RNA, 13 nt, Homo sapiens
ucuccuguggucu

SEQ ID NO: 1619402 - RNA, 13 nt, Homo sapiens
ucuccuuacaguc

SEQ ID NO: 1619403 - RNA, 21 nt, Homo sapiens
ucucgaccggcccugcauucu

SEQ ID NO: 1619404 - RNA, 14 nt, Homo sapiens
ucucgagaggcaau

SEQ ID NO: 1619405 - RNA, 17 nt, Homo sapiens
ucucgccucauuacugu

SEQ ID NO: 1619406 - RNA, 17 nt, Homo sapiens
ucucggcucagugcaac

SEQ ID NO: 1619407 - RNA, 15 nt, Homo sapiens
ucucgguuugccaaa

SEQ ID NO: 1619408 - RNA, 21 nt, Homo sapiens
ugaaacauggcuguguuugca

SEQ ID NO: 1619409 - RNA, 20 nt, Homo sapiens
ugaaacuccaugcaaaccau

SEQ ID NO: 1619410 - RNA, 17 nt, Homo sapiens
ugaaagaaagggaccca

SEQ ID NO: 1619411 - RNA, 14 nt, Homo sapiens
ugaaauaugugaag

SEQ ID NO: 1619412 - RNA, 15 nt, Homo sapiens
ugaaauuaagcauuu

SEQ ID NO: 1619413 - RNA, 12 nt, Homo sapiens
ugaacaucucuu

SEQ ID NO: 1619414 - RNA, 22 nt, Homo sapiens
ugaaccauccacuuacauauau

SEQ ID NO: 1619415 - RNA, 17 nt, Homo sapiens
ugaaccauguguggcaa

SEQ ID NO: 1619416 - RNA, 21 nt, Homo sapiens
ugaacuaaugauaaaguaaug

SEQ ID NO: 1619417 - RNA, 19 nt, Homo sapiens
ugaacuacauaacuuccua

SEQ ID NO: 1619418 - RNA, 22 nt, Homo sapiens
ugaagaacuggaaccccagcuu

SEQ ID NO: 1619419 - RNA, 21 nt, Homo sapiens
ugaagagaagcaagacagagg

SEQ ID NO: 1619420 - RNA, 15 nt, Homo sapiens
ugaagagauugcuga

SEQ ID NO: 1619421 - RNA, 21 nt, Homo sapiens
ugaagauggcauccugugaag

SEQ ID NO: 1619422 - RNA, 17 nt, Homo sapiens
ugaagauguuuguguau

SEQ ID NO: 1619423 - RNA, 19 nt, Homo sapiens
ugaagccauguagccaccc

SEQ ID NO: 1619424 - RNA, 20 nt, Homo sapiens
ugaagcugaggcucaggggu

SEQ ID NO: 1619425 - RNA, 17 nt, Homo sapiens
ugaagcugcacaguguu

SEQ ID NO: 1619426 - RNA, 22 nt, Homo sapiens
ugaagugcuguuuuauuacugu

SEQ ID NO: 1619427 - RNA, 17 nt, Homo sapiens
ugaaguggugagcuuaa

SEQ ID NO: 1619428 - RNA, 21 nt, Homo sapiens
ugaauaacauuuaaauuccac

SEQ ID NO: 1619429 - RNA, 17 nt, Homo sapiens
ugaauccccggccucug

SEQ ID NO: 1619430 - RNA, 23 nt, Homo sapiens
ugaaucccucuaucucuaaagaa

SEQ ID NO: 1619431 - RNA, 17 nt, Homo sapiens
ugaaucuauaaguagua

SEQ ID NO: 1619432 - RNA, 17 nt, Homo sapiens
ugaaucucugaauuuga

SEQ ID NO: 1619433 - RNA, 15 nt, Homo sapiens
ugaaugacaugaccu

SEQ ID NO: 1619434 - RNA, 20 nt, Homo sapiens
ugaaugccuccuguggggaa

SEQ ID NO: 1619435 - RNA, 21 nt, Homo sapiens
ugaaugccucgcucccuucaa

SEQ ID NO: 1619436 - RNA, 16 nt, Homo sapiens
ugaauguuaaugguca

SEQ ID NO: 1619437 - RNA, 18 nt, Homo sapiens
ugaauucugucauuucaa

SEQ ID NO: 1619438 - RNA, 13 nt, Homo sapiens
ugaauuuucuuca

SEQ ID NO: 1619439 - RNA, 18 nt, Homo sapiens
ugacaagaacaaagccac

SEQ ID NO: 1619440 - RNA, 16 nt, Homo sapiens
ugacaauagagggcca

SEQ ID NO: 1619441 - RNA, 14 nt, Homo sapiens
ugacacauaugcac

SEQ ID NO: 1619442 - RNA, 18 nt, Homo sapiens
ugacacuagucagaaaau

SEQ ID NO: 1619443 - RNA, 12 nt, Homo sapiens
ugacagaacaag

SEQ ID NO: 1619444 - RNA, 19 nt, Homo sapiens
ugacagaucaagcugugag

SEQ ID NO: 1619445 - RNA, 21 nt, Homo sapiens
ugacagaucaagcugugagac

SEQ ID NO: 1619446 - RNA, 20 nt, Homo sapiens
ugacagcggaaagcccugug

SEQ ID NO: 1619447 - RNA, 17 nt, Homo sapiens
ugacaguagcucuuaga

SEQ ID NO: 1619448 - RNA, 17 nt, Homo sapiens
ugaccaaacagccaaga

SEQ ID NO: 1619449 - RNA, 18 nt, Homo sapiens
ugaccacagcacagccaa

SEQ ID NO: 1619450 - RNA, 21 nt, Homo sapiens
ugacccuugucccauguggcu

SEQ ID NO: 1619451 - RNA, 20 nt, Homo sapiens
ugaccucaggugaucugccc

SEQ ID NO: 1619452 - RNA, 22 nt, Homo sapiens
ugaccuugaugagcugugcaca

SEQ ID NO: 1619453 - RNA, 19 nt, Homo sapiens
ugacgacauacaugcuacu

SEQ ID NO: 1619454 - RNA, 20 nt, Homo sapiens
ugacgucaucaucacauuca

SEQ ID NO: 1619455 - RNA, 16 nt, Homo sapiens
ugacugagauggagug

SEQ ID NO: 1619456 - RNA, 21 nt, Homo sapiens
ugacuguagaacuuauucucu

SEQ ID NO: 1619457 - RNA, 13 nt, Homo sapiens
ugacuucuagaaa

SEQ ID NO: 1619458 - RNA, 17 nt, Homo sapiens
ugagaaauggccaaaua

SEQ ID NO: 1619459 - RNA, 21 nt, Homo sapiens
ugagaacucguucaccuccaa

SEQ ID NO: 1619460 - RNA, 21 nt, Homo sapiens
ugagaagacauggaugaucug

SEQ ID NO: 1619461 - RNA, 14 nt, Homo sapiens
ugagaagggacaag

SEQ ID NO: 1619462 - RNA, 20 nt, Homo sapiens
ugagaaucuaggccacccca

SEQ ID NO: 1619463 - RNA, 22 nt, Homo sapiens
ugagacuacaagugugugccac

SEQ ID NO: 1619464 - RNA, 22 nt, Homo sapiens
ugagagaaagagagaagccagc

SEQ ID NO: 1619465 - RNA, 19 nt, Homo sapiens
ugagauagcauugugaacu

SEQ ID NO: 1619466 - RNA, 19 nt, Homo sapiens
ugagauccggcaacaucaa

SEQ ID NO: 1619467 - RNA, 17 nt, Homo sapiens
ugagaugauacauccaa

SEQ ID NO: 1619468 - RNA, 16 nt, Homo sapiens
ugagaugcagcuggaa

SEQ ID NO: 1619469 - RNA, 17 nt, Homo sapiens
ugagauggagugagcug

SEQ ID NO: 1619470 - RNA, 16 nt, Homo sapiens
ugagcaagacauacuu

SEQ ID NO: 1619471 - RNA, 22 nt, Homo sapiens
ugagcacugccaggagggacaa

SEQ ID NO: 1619472 - RNA, 15 nt, Homo sapiens
ugagcauaccugucu

SEQ ID NO: 1619473 - RNA, 20 nt, Homo sapiens
ugagccagcccuccuugacc

SEQ ID NO: 1619474 - RNA, 16 nt, Homo sapiens
ugagccuacgcugaag

SEQ ID NO: 1619475 - RNA, 19 nt, Homo sapiens
ugagcugguaggauguaag

SEQ ID NO: 1619476 - RNA, 13 nt, Homo sapiens
ugagcugugcaca

SEQ ID NO: 1619477 - RNA, 13 nt, Homo sapiens
ugaggaucauaug

SEQ ID NO: 1619478 - RNA, 19 nt, Homo sapiens
ugaggccaucucaggagau

SEQ ID NO: 1619479 - RNA, 23 nt, Homo sapiens
ugagggaccaauauuaccaucuu

SEQ ID NO: 1619480 - RNA, 16 nt, Homo sapiens
ugagggaucugucuca

SEQ ID NO: 1619481 - RNA, 22 nt, Homo sapiens
ugagggaucugucucacuggca

SEQ ID NO: 1619482 - RNA, 21 nt, Homo sapiens
ugagguuucuuugacuucaau

SEQ ID NO: 1619483 - RNA, 19 nt, Homo sapiens
ugagucagugccaugacug

SEQ ID NO: 1619484 - RNA, 19 nt, Homo sapiens
ugagucuauguucaaagac

SEQ ID NO: 1619485 - RNA, 14 nt, Homo sapiens
ugagucuugaucua

SEQ ID NO: 1619486 - RNA, 19 nt, Homo sapiens
ugaguggcuuuaaugaaua

SEQ ID NO: 1619487 - RNA, 19 nt, Homo sapiens
ugagugggagaguaccugu

SEQ ID NO: 1619488 - RNA, 17 nt, Homo sapiens
ugaguuagaggagaaaa

SEQ ID NO: 1619489 - RNA, 14 nt, Homo sapiens
ugauaaaccugcca

SEQ ID NO: 1619490 - RNA, 14 nt, Homo sapiens
ugauaaaguauuau

SEQ ID NO: 1619491 - RNA, 22 nt, Homo sapiens
ugauacauccaaagcagacagc

SEQ ID NO: 1619492 - RNA, 13 nt, Homo sapiens
ugauacaugucag

SEQ ID NO: 1619493 - RNA, 23 nt, Homo sapiens
ugauacucuuucuaaugcugaua

SEQ ID NO: 1619494 - RNA, 12 nt, Homo sapiens
ugauacugcugc

SEQ ID NO: 1619495 - RNA, 20 nt, Homo sapiens
ugauauuuauuuuuugccau

SEQ ID NO: 1619496 - RNA, 17 nt, Homo sapiens
ugaucaagaacauguca

SEQ ID NO: 1619497 - RNA, 17 nt, Homo sapiens
ugaucagaggcauuuga

SEQ ID NO: 1619498 - RNA, 15 nt, Homo sapiens
ugauccauccaucuc

SEQ ID NO: 1619499 - RNA, 20 nt, Homo sapiens
ugauccugccuugcugugaa

SEQ ID NO: 1619500 - RNA, 14 nt, Homo sapiens
ugaugagcugugca

SEQ ID NO: 1619501 - RNA, 15 nt, Homo sapiens
ugaugccauaugccu

SEQ ID NO: 1619502 - RNA, 19 nt, Homo sapiens
ugaugccuguguacugccu

SEQ ID NO: 1619503 - RNA, 22 nt, Homo sapiens
ugaugccuguguacugccuuaa

SEQ ID NO: 1619504 - RNA, 18 nt, Homo sapiens
ugauggcaacagaaacca

SEQ ID NO: 1619505 - RNA, 16 nt, Homo sapiens
ugauggccaccagcuu

SEQ ID NO: 1619506 - RNA, 17 nt, Homo sapiens
ugauuaaaaaacugaca

SEQ ID NO: 1619507 - RNA, 13 nt, Homo sapiens
ugauuaaaguaag

SEQ ID NO: 1619508 - RNA, 15 nt, Homo sapiens
ugauucaacagggaa

SEQ ID NO: 1619509 - RNA, 16 nt, Homo sapiens
ugauugcucccaggau

SEQ ID NO: 1619510 - RNA, 15 nt, Homo sapiens
ugauuuagugaucaa

SEQ ID NO: 1619511 - RNA, 19 nt, Homo sapiens
ugauuucaauagcuuugua

SEQ ID NO: 1619512 - RNA, 20 nt, Homo sapiens
ugauuucucuacuugucaua

SEQ ID NO: 1619513 - RNA, 19 nt, Homo sapiens
ugauuuuacuuaacucauu

SEQ ID NO: 1619514 - RNA, 15 nt, Homo sapiens
ugauuuugcuuucca

SEQ ID NO: 1619515 - RNA, 16 nt, Homo sapiens
ugauuuugcuuuccaa

SEQ ID NO: 1619516 - RNA, 17 nt, Homo sapiens
ugcaaacccugguggua

SEQ ID NO: 1619517 - RNA, 16 nt, Homo sapiens
gaagggagaauugaga

SEQ ID NO: 1619518 - RNA, 11 nt, Homo sapiens
gaaggggccac

SEQ ID NO: 1619519 - RNA, 22 nt, Homo sapiens
gaaggggcuagggaggaccaaa

SEQ ID NO: 1619520 - RNA, 12 nt, Homo sapiens
gaaggugcccaa

SEQ ID NO: 1619521 - RNA, 17 nt, Homo sapiens
gaaggugcccaaccuaa

SEQ ID NO: 1619522 - RNA, 16 nt, Homo sapiens
gaaguacuccuauugc

SEQ ID NO: 1619523 - RNA, 15 nt, Homo sapiens
gaaguaugguguguu

SEQ ID NO: 1619524 - RNA, 14 nt, Homo sapiens
gaaguauugcugaa

SEQ ID NO: 1619525 - RNA, 23 nt, Homo sapiens
gaagucucucuauuacacuggag

SEQ ID NO: 1619526 - RNA, 15 nt, Homo sapiens
cagccaucaagggaa

SEQ ID NO: 1619527 - RNA, 20 nt, Homo sapiens
cagcccaccccugugcccac

SEQ ID NO: 1619528 - RNA, 13 nt, Homo sapiens
cagcccagugcaa

SEQ ID NO: 1619529 - RNA, 15 nt, Homo sapiens
cagcccagugcaaac

SEQ ID NO: 1619530 - RNA, 13 nt, Homo sapiens
cagcccauugcug

SEQ ID NO: 1619531 - RNA, 19 nt, Homo sapiens
cagcccuccuugacccaga

SEQ ID NO: 1619532 - RNA, 23 nt, Homo sapiens
cagccucccgaguagcugggauu

SEQ ID NO: 1619533 - RNA, 15 nt, Homo sapiens
cagccuccuccuccg

SEQ ID NO: 1619534 - RNA, 21 nt, Homo sapiens
cagccucgcgggugucacauu

SEQ ID NO: 1619535 - RNA, 17 nt, Homo sapiens
cagccugaggugcccac

SEQ ID NO: 1619536 - RNA, 21 nt, Homo sapiens
cagcggaaagcccugugcucc

SEQ ID NO: 1619537 - RNA, 14 nt, Homo sapiens
cagcucagccagug

SEQ ID NO: 1619538 - RNA, 18 nt, Homo sapiens
cagcuccugccaggguga

SEQ ID NO: 1619539 - RNA, 13 nt, Homo sapiens
cagcucuggagaa

SEQ ID NO: 1619540 - RNA, 17 nt, Homo sapiens
cagcugaauaaccugca

SEQ ID NO: 1619541 - RNA, 23 nt, Homo sapiens
cagcugugccagaggcuggacca

SEQ ID NO: 1619542 - RNA, 22 nt, Homo sapiens
gauuacccccaguccucccuag

SEQ ID NO: 1619543 - RNA, 21 nt, Homo sapiens
gauuaugaaauuucauggaug

SEQ ID NO: 1619544 - RNA, 15 nt, Homo sapiens
gauucacagucucau

SEQ ID NO: 1619545 - RNA, 13 nt, Homo sapiens
gauucagcauuuu

SEQ ID NO: 1619546 - RNA, 19 nt, Homo sapiens
gauucagcucccacacaca

SEQ ID NO: 1619547 - RNA, 21 nt, Homo sapiens
gauucauucucauaauuccua

SEQ ID NO: 1619548 - RNA, 22 nt, Homo sapiens
gauucucucaucuaacugauga

SEQ ID NO: 1619549 - RNA, 18 nt, Homo sapiens
gauugagaagggacaagc

SEQ ID NO: 1619550 - RNA, 12 nt, Homo sapiens
gauugauuuucu

SEQ ID NO: 1619551 - RNA, 13 nt, Homo sapiens
gauugcacuugau

SEQ ID NO: 1619552 - RNA, 19 nt, Homo sapiens
gauugcaugugacucugaa

SEQ ID NO: 1619553 - RNA, 15 nt, Homo sapiens
gauugccaaucugca

SEQ ID NO: 1619554 - RNA, 18 nt, Homo sapiens
gauugcucccaggaucuc

SEQ ID NO: 1619555 - RNA, 13 nt, Homo sapiens
gauugcugugaaa

SEQ ID NO: 1619556 - RNA, 22 nt, Homo sapiens
gauuggccccacugacguuggc

SEQ ID NO: 1619557 - RNA, 22 nt, Homo sapiens
gauuuacuaaaucaaucugcag

SEQ ID NO: 1619558 - RNA, 23 nt, Homo sapiens
gauuucaccacucaaaggccaga

SEQ ID NO: 1619559 - RNA, 14 nt, Homo sapiens
gauuucuccaggau

SEQ ID NO: 1619560 - RNA, 17 nt, Homo sapiens
gagacaggguuucacug

SEQ ID NO: 1619561 - RNA, 16 nt, Homo sapiens
gagaccccagucguga

SEQ ID NO: 1619562 - RNA, 15 nt, Homo sapiens
gagacgcacacagcu

SEQ ID NO: 1619563 - RNA, 22 nt, Homo sapiens
gagacggagucuugcucuguca

SEQ ID NO: 1619564 - RNA, 17 nt, Homo sapiens
gagacgggguuucucca

SEQ ID NO: 1619565 - RNA, 18 nt, Homo sapiens
gagacgguguuuugccau

SEQ ID NO: 1619566 - RNA, 13 nt, Homo sapiens
gagagaaaacugc

SEQ ID NO: 1619567 - RNA, 17 nt, Homo sapiens
gagagagcuggaggcac

SEQ ID NO: 1619568 - RNA, 16 nt, Homo sapiens
gagagccucgcuuuuu

SEQ ID NO: 1619569 - RNA, 17 nt, Homo sapiens
gagagcuagagggacaa

SEQ ID NO: 1619570 - RNA, 18 nt, Homo sapiens
gagagcuagagggacaaa

SEQ ID NO: 1619571 - RNA, 22 nt, Homo sapiens
uacucuacagauuuuacaaaua

SEQ ID NO: 1619572 - RNA, 13 nt, Homo sapiens
uauccugggaccu

SEQ ID NO: 1619573 - RNA, 22 nt, Homo sapiens
uauccuuuuaucucacaaauaa

SEQ ID NO: 1619574 - RNA, 16 nt, Homo sapiens
uaucggcucacaaaga

SEQ ID NO: 1619575 - RNA, 17 nt, Homo sapiens
uaucggcucacaaagag

SEQ ID NO: 1619576 - RNA, 21 nt, Homo sapiens
uaucuacauaaguccuuucaa

SEQ ID NO: 1619577 - RNA, 23 nt, Homo sapiens
uaucuacauuaaaaugacaaaca

SEQ ID NO: 1619578 - RNA, 21 nt, Homo sapiens
uaucugcaccuagaaccuccc

SEQ ID NO: 1619579 - RNA, 22 nt, Homo sapiens
uaucuguagugagauagcauug

SEQ ID NO: 1619580 - RNA, 22 nt, Homo sapiens
uaucuucccuuuauuacaagaa

SEQ ID NO: 1619581 - RNA, 18 nt, Homo sapiens
uaucuugaaaaaguauug

SEQ ID NO: 1619582 - RNA, 15 nt, Homo sapiens
uaugaacuugcaaac

SEQ ID NO: 1619583 - RNA, 19 nt, Homo sapiens
uaugaagaaagauacuaau

SEQ ID NO: 1619584 - RNA, 20 nt, Homo sapiens
uaugaagaaagauacuaaua

SEQ ID NO: 1619585 - RNA, 23 nt, Homo sapiens
uaugaccucgcccuccacaaaug

SEQ ID NO: 1619586 - RNA, 19 nt, Homo sapiens
uaugagcuugcucauuaau

SEQ ID NO: 1619587 - RNA, 21 nt, Homo sapiens
uaugagguuucuuugacuuca

SEQ ID NO: 1619588 - RNA, 14 nt, Homo sapiens
uaugaugaaaaccu

SEQ ID NO: 1619589 - RNA, 14 nt, Homo sapiens
uaugcaaaauggaa

SEQ ID NO: 1619590 - RNA, 20 nt, Homo sapiens
uaugcaaauacaaucagccc

SEQ ID NO: 1619591 - RNA, 20 nt, Homo sapiens
uaugcaauuagccucauagu

SEQ ID NO: 1619592 - RNA, 20 nt, Homo sapiens
uaugcauuugcauuugcucu

SEQ ID NO: 1619593 - RNA, 18 nt, Homo sapiens
uaugccacuaacuucuaa

SEQ ID NO: 1619594 - RNA, 17 nt, Homo sapiens
uaugcgugugacagugu

SEQ ID NO: 1619595 - RNA, 18 nt, Homo sapiens
uaugcucauugaacuuua

SEQ ID NO: 1619596 - RNA, 19 nt, Homo sapiens
uaugcucauugaacuuuaa

SEQ ID NO: 1619597 - RNA, 14 nt, Homo sapiens
uauggacucugcac

SEQ ID NO: 1619598 - RNA, 18 nt, Homo sapiens
uaugguguacauucuucc

SEQ ID NO: 1619599 - RNA, 13 nt, Homo sapiens
uauguacugccuu

SEQ ID NO: 1619600 - RNA, 14 nt, Homo sapiens
uauguacugccuua

SEQ ID NO: 1619601 - RNA, 16 nt, Homo sapiens
uauguacugccuuagu

SEQ ID NO: 1619602 - RNA, 15 nt, Homo sapiens
uaugucaaagcaaca

SEQ ID NO: 1619603 - RNA, 20 nt, Homo sapiens
uaugucaaagcaacagucca

SEQ ID NO: 1619604 - RNA, 14 nt, Homo sapiens
uauguccacuguuc

SEQ ID NO: 1619605 - RNA, 18 nt, Homo sapiens
uaugucuugcaaagccuu

SEQ ID NO: 1619606 - RNA, 18 nt, Homo sapiens
uaugucuuggacacugua

SEQ ID NO: 1619607 - RNA, 17 nt, Homo sapiens
uaugugguuaucuguga

SEQ ID NO: 1619608 - RNA, 21 nt, Homo sapiens
uauguuuaucaaagagcacuu

SEQ ID NO: 1619609 - RNA, 17 nt, Homo sapiens
uauuaacuuuaauucuc

SEQ ID NO: 1619610 - RNA, 20 nt, Homo sapiens
uauuaaggccuuuuccacac

SEQ ID NO: 1619611 - RNA, 21 nt, Homo sapiens
uauuaaucauacaaacucuca

SEQ ID NO: 1619612 - RNA, 20 nt, Homo sapiens
uauuaauuguuuugcacuuu

SEQ ID NO: 1619613 - RNA, 13 nt, Homo sapiens
uauuacaaacaag

SEQ ID NO: 1619614 - RNA, 18 nt, Homo sapiens
uauuagcagggauucucu

SEQ ID NO: 1619615 - RNA, 14 nt, Homo sapiens
uauuaugugcaaca

SEQ ID NO: 1619616 - RNA, 17 nt, Homo sapiens
uauuauucuacuauacu

SEQ ID NO: 1619617 - RNA, 18 nt, Homo sapiens
uauucauggauggcucaa

SEQ ID NO: 1619618 - RNA, 11 nt, Homo sapiens
uauucucugaa

SEQ ID NO: 1619619 - RNA, 18 nt, Homo sapiens
uauucuuccccgaaucac

SEQ ID NO: 1619620 - RNA, 13 nt, Homo sapiens
uauucuuuacuau

SEQ ID NO: 1619621 - RNA, 18 nt, Homo sapiens
uauucuuugcucuugcca

SEQ ID NO: 1619622 - RNA, 14 nt, Homo sapiens
uauugagcauguga

SEQ ID NO: 1619623 - RNA, 14 nt, Homo sapiens
uauugagugugauu

SEQ ID NO: 1619624 - RNA, 22 nt, Homo sapiens
uauugguuuuaaaaaagcauua

SEQ ID NO: 1619625 - RNA, 15 nt, Homo sapiens
uauuguuguugccaa

SEQ ID NO: 1619626 - RNA, 19 nt, Homo sapiens
uauuuauuuuuugccauuu

SEQ ID NO: 1619627 - RNA, 13 nt, Homo sapiens
uauuucaccaagc

SEQ ID NO: 1619628 - RNA, 20 nt, Homo sapiens
uauuugagacuguccugugc

SEQ ID NO: 1619629 - RNA, 22 nt, Homo sapiens
uauuugcacaaguucagugaga

SEQ ID NO: 1619630 - RNA, 15 nt, Homo sapiens
uauuugccuucugaa

SEQ ID NO: 1619631 - RNA, 20 nt, Homo sapiens
uauuuuaaacuacugauuga

SEQ ID NO: 1619632 - RNA, 14 nt, Homo sapiens
uauuuuauaugauu

SEQ ID NO: 1619633 - RNA, 20 nt, Homo sapiens
uauuuuuauaauaaacauaa

SEQ ID NO: 1619634 - RNA, 13 nt, Homo sapiens
ucaaaaaguaauu

SEQ ID NO: 1619635 - RNA, 22 nt, Homo sapiens
ucaaaacuguuuguuaucucuu

SEQ ID NO: 1619636 - RNA, 12 nt, Homo sapiens
ucaaaagcaauc

SEQ ID NO: 1619637 - RNA, 13 nt, Homo sapiens
ucaaaaggucuaa

SEQ ID NO: 1619638 - RNA, 17 nt, Homo sapiens
ucaaaauaaaaaguaau

SEQ ID NO: 1619639 - RNA, 14 nt, Homo sapiens
ucaaaauacuucuu

SEQ ID NO: 1619640 - RNA, 21 nt, Homo sapiens
ucaaacauauucuaaugccug

SEQ ID NO: 1619641 - RNA, 17 nt, Homo sapiens
ucaaacuccugaccuca

SEQ ID NO: 1619642 - RNA, 21 nt, Homo sapiens
ucaaagcuaaauuccacacua

SEQ ID NO: 1619643 - RNA, 19 nt, Homo sapiens
ucaaagugucucauucuca

SEQ ID NO: 1619644 - RNA, 21 nt, Homo sapiens
ucaaauauauuucaagcuaua

SEQ ID NO: 1619645 - RNA, 17 nt, Homo sapiens
ucaaaugugcauuuugu

SEQ ID NO: 1619646 - RNA, 19 nt, Homo sapiens
ucaacaaauuucauugcac

SEQ ID NO: 1619647 - RNA, 19 nt, Homo sapiens
ucaacaauuuauccauuca

SEQ ID NO: 1619648 - RNA, 14 nt, Homo sapiens
ucaacacauuggaa

SEQ ID NO: 1619649 - RNA, 17 nt, Homo sapiens
ucaacaggucacuugau

SEQ ID NO: 1619650 - RNA, 15 nt, Homo sapiens
ucaaccuccuggaca

SEQ ID NO: 1619651 - RNA, 20 nt, Homo sapiens
ucaaccugguguuaggugug

SEQ ID NO: 1619652 - RNA, 21 nt, Homo sapiens
ucaacuacuauucaaaaccuc

SEQ ID NO: 1619653 - RNA, 21 nt, Homo sapiens
ucaacucacccccuacacaca

SEQ ID NO: 1619654 - RNA, 19 nt, Homo sapiens
ucaacucccuucucggggu

SEQ ID NO: 1619655 - RNA, 20 nt, Homo sapiens
ucaagaaacagccagcaaga

SEQ ID NO: 1619656 - RNA, 19 nt, Homo sapiens
ucaagauauauguguauac

SEQ ID NO: 1619657 - RNA, 14 nt, Homo sapiens
ucaagcucauguca

SEQ ID NO: 1619658 - RNA, 20 nt, Homo sapiens
ucaagcucaugucauuauga

SEQ ID NO: 1619659 - RNA, 23 nt, Homo sapiens
ucaagcucaugucauuaugacau

SEQ ID NO: 1619660 - RNA, 15 nt, Homo sapiens
ucaagcuccccucac

SEQ ID NO: 1619661 - RNA, 22 nt, Homo sapiens
ucaagcuuuggauaacgaugaa

SEQ ID NO: 1619662 - RNA, 20 nt, Homo sapiens
ucaaggacaccugccuucaa

SEQ ID NO: 1619663 - RNA, 18 nt, Homo sapiens
ucaaggaggcccacugug

SEQ ID NO: 1619664 - RNA, 13 nt, Homo sapiens
ucaaggccuucag

SEQ ID NO: 1619665 - RNA, 15 nt, Homo sapiens
ucaaggcugcaguga

SEQ ID NO: 1619666 - RNA, 14 nt, Homo sapiens
ucaagguguucucu

SEQ ID NO: 1619667 - RNA, 16 nt, Homo sapiens
ucaaguguccuggaaa

SEQ ID NO: 1619668 - RNA, 21 nt, Homo sapiens
ucaauaaaguuguugcauucc

SEQ ID NO: 1619669 - RNA, 21 nt, Homo sapiens
ucaaucugcaaacaugccagg

SEQ ID NO: 1619670 - RNA, 22 nt, Homo sapiens
ucaaucugcaguuuaacaaaau

SEQ ID NO: 1619671 - RNA, 23 nt, Homo sapiens
ucaaucuguccguucacaugugu

SEQ ID NO: 1619672 - RNA, 15 nt, Homo sapiens
ucaauuccguagcca

SEQ ID NO: 1619673 - RNA, 16 nt, Homo sapiens
ucacaaauccuucaaa

SEQ ID NO: 1619674 - RNA, 14 nt, Homo sapiens
ucacaacagucacc

SEQ ID NO: 1619675 - RNA, 19 nt, Homo sapiens
ucacaacuccuuccauccu

SEQ ID NO: 1619676 - RNA, 13 nt, Homo sapiens
ucacaauacuguu

SEQ ID NO: 1619677 - RNA, 18 nt, Homo sapiens
ucacaguacagcaugugc

SEQ ID NO: 1619678 - RNA, 22 nt, Homo sapiens
ucacaguccuguccucuggauc

SEQ ID NO: 1619679 - RNA, 14 nt, Homo sapiens
ucacauaugucuua

SEQ ID NO: 1619680 - RNA, 19 nt, Homo sapiens
ucacauuuuuuuaugcucu

SEQ ID NO: 1619681 - RNA, 19 nt, Homo sapiens
ucaccaggggaggagccug

SEQ ID NO: 1619682 - RNA, 22 nt, Homo sapiens
ucaccauuaugcugguguaugu

SEQ ID NO: 1619683 - RNA, 17 nt, Homo sapiens
ucacccagggacacucc

SEQ ID NO: 1619684 - RNA, 23 nt, Homo sapiens
ucacccccuacacacacaugaga

SEQ ID NO: 1619685 - RNA, 17 nt, Homo sapiens
ucaccccucacugugac

SEQ ID NO: 1619686 - RNA, 22 nt, Homo sapiens
ucacccuguaauaaauaugugu

SEQ ID NO: 1619687 - RNA, 17 nt, Homo sapiens
ucaccucacaaaccuga

SEQ ID NO: 1619688 - RNA, 14 nt, Homo sapiens
ucaccucacugaaa

SEQ ID NO: 1619689 - RNA, 10 nt, Homo sapiens
ucaccuucac

SEQ ID NO: 1619690 - RNA, 17 nt, Homo sapiens
ucacguaguucuagcag

SEQ ID NO: 1619691 - RNA, 15 nt, Homo sapiens
ucacuaaacuuuauu

SEQ ID NO: 1619692 - RNA, 13 nt, Homo sapiens
ucacuagucucac

SEQ ID NO: 1619693 - RNA, 20 nt, Homo sapiens
ucacucauuaaugaaucaca

SEQ ID NO: 1619694 - RNA, 15 nt, Homo sapiens
ucacucuucaaggag

SEQ ID NO: 1619695 - RNA, 20 nt, Homo sapiens
ucacugaaaacaucuggaag

SEQ ID NO: 1619696 - RNA, 23 nt, Homo sapiens
ucacugaugggaaaacugccaau

SEQ ID NO: 1619697 - RNA, 18 nt, Homo sapiens
ucacugcaacuucugccu

SEQ ID NO: 1619698 - RNA, 21 nt, Homo sapiens
ucacuuccccaagaucugcca

SEQ ID NO: 1619699 - RNA, 13 nt, Homo sapiens
ucagaaaaguaau

SEQ ID NO: 1619700 - RNA, 21 nt, Homo sapiens
ucagaaagggagggcucugag

SEQ ID NO: 1619701 - RNA, 18 nt, Homo sapiens
ucagaauaggaagauaug

SEQ ID NO: 1619702 - RNA, 13 nt, Homo sapiens
ucagaauugcaca

SEQ ID NO: 1619703 - RNA, 17 nt, Homo sapiens
ucagaauugcacaucua

SEQ ID NO: 1619704 - RNA, 17 nt, Homo sapiens
ucagaauuggaaucaca

SEQ ID NO: 1619705 - RNA, 22 nt, Homo sapiens
ucagacaagaaugugcacucuc

SEQ ID NO: 1619706 - RNA, 16 nt, Homo sapiens
ucagacauaaagccau

SEQ ID NO: 1619707 - RNA, 22 nt, Homo sapiens
ucagaccaagcagcaggaauuc

SEQ ID NO: 1619708 - RNA, 22 nt, Homo sapiens
ucagacuuuggaaaaugcauug

SEQ ID NO: 1619709 - RNA, 17 nt, Homo sapiens
ucagagagggugacaag

SEQ ID NO: 1619710 - RNA, 16 nt, Homo sapiens
ucagauugcaugugac

SEQ ID NO: 1619711 - RNA, 17 nt, Homo sapiens
ucagauugcaugugacu

SEQ ID NO: 1619712 - RNA, 22 nt, Homo sapiens
ucagauuguuaucuaucaacua

SEQ ID NO: 1619713 - RNA, 21 nt, Homo sapiens
ucagauuuuuuccucugcauu

SEQ ID NO: 1619714 - RNA, 15 nt, Homo sapiens
ucagcaagacauaaa

SEQ ID NO: 1619715 - RNA, 21 nt, Homo sapiens
ucagcaaguuagaacuagcca

SEQ ID NO: 1619716 - RNA, 16 nt, Homo sapiens
ucagcaccuacagugu

SEQ ID NO: 1619717 - RNA, 19 nt, Homo sapiens
ucagcaggccaaacauggc

SEQ ID NO: 1619718 - RNA, 21 nt, Homo sapiens
ucagcaugccugaacuacaua

SEQ ID NO: 1619719 - RNA, 14 nt, Homo sapiens
ucagcccagugcaa

SEQ ID NO: 1619720 - RNA, 23 nt, Homo sapiens
ucagccuacuuucacacuaagaa

SEQ ID NO: 1619721 - RNA, 16 nt, Homo sapiens
ucagcgggagcacugc

SEQ ID NO: 1619722 - RNA, 19 nt, Homo sapiens
ucagcucuggagaacagug

SEQ ID NO: 1619723 - RNA, 16 nt, Homo sapiens
ucagcugguccugacc

SEQ ID NO: 1619724 - RNA, 18 nt, Homo sapiens
ucaggaaggggugugcug

SEQ ID NO: 1619725 - RNA, 20 nt, Homo sapiens
ucaggaauucagugccuuca

SEQ ID NO: 1619726 - RNA, 16 nt, Homo sapiens
ucaggagccaccagca

SEQ ID NO: 1619727 - RNA, 20 nt, Homo sapiens
ucaggcaaacguccacaaag

SEQ ID NO: 1619728 - RNA, 15 nt, Homo sapiens
ucaggcaacgcacaa

SEQ ID NO: 1619729 - RNA, 15 nt, Homo sapiens
ucagggccucaggca

SEQ ID NO: 1619730 - RNA, 21 nt, Homo sapiens
ucaggugccuuugaguucuag

SEQ ID NO: 1619731 - RNA, 21 nt, Homo sapiens
ucaguaacaaguguuggcaaa

SEQ ID NO: 1619732 - RNA, 13 nt, Homo sapiens
ucaguaggcuucu

SEQ ID NO: 1619733 - RNA, 15 nt, Homo sapiens
ucaguauuauucuac

SEQ ID NO: 1619734 - RNA, 14 nt, Homo sapiens
ucagucacagccac

SEQ ID NO: 1619735 - RNA, 15 nt, Homo sapiens
ucaguccuuugauca

SEQ ID NO: 1619736 - RNA, 16 nt, Homo sapiens
ucagugacuccugcug

SEQ ID NO: 1619737 - RNA, 19 nt, Homo sapiens
ucaguucugcuugcuccca

SEQ ID NO: 1619738 - RNA, 14 nt, Homo sapiens
ucauaaaaaucuag

SEQ ID NO: 1619739 - RNA, 17 nt, Homo sapiens
ucauaaaucuucuuauu

SEQ ID NO: 1619740 - RNA, 23 nt, Homo sapiens
ucauaacugggugguuugagggu

SEQ ID NO: 1619741 - RNA, 14 nt, Homo sapiens
ucaucaggugcaua

SEQ ID NO: 1619742 - RNA, 16 nt, Homo sapiens
ucaucgggaaaggcaa

SEQ ID NO: 1619743 - RNA, 20 nt, Homo sapiens
ucaucuguggagcugccaca

SEQ ID NO: 1619744 - RNA, 19 nt, Homo sapiens
ucaucuuugccaccaccug

SEQ ID NO: 1619745 - RNA, 20 nt, Homo sapiens
ucaugccccuggcugggacg

SEQ ID NO: 1619746 - RNA, 13 nt, Homo sapiens
ucaugcccugugc

SEQ ID NO: 1619747 - RNA, 23 nt, Homo sapiens
ucaugucagcuuauaugugacac

SEQ ID NO: 1619748 - RNA, 17 nt, Homo sapiens
ucauguguggaaauggg

SEQ ID NO: 1619749 - RNA, 18 nt, Homo sapiens
ucauguuauuaaacguau

SEQ ID NO: 1619750 - RNA, 18 nt, Homo sapiens
ucauguugaucauguacu

SEQ ID NO: 1619751 - RNA, 19 nt, Homo sapiens
ucauuacagggcacaggcc

SEQ ID NO: 1619752 - RNA, 13 nt, Homo sapiens
ucauuacugugag

SEQ ID NO: 1619753 - RNA, 22 nt, Homo sapiens
ucauuacuguuccagauuccua

SEQ ID NO: 1619754 - RNA, 15 nt, Homo sapiens
ucauuauccacccca

SEQ ID NO: 1619755 - RNA, 14 nt, Homo sapiens
ucauucacauucag

SEQ ID NO: 1619756 - RNA, 16 nt, Homo sapiens
ucauucauaguaguua

SEQ ID NO: 1619757 - RNA, 17 nt, Homo sapiens
ucauucuuuugccacau

SEQ ID NO: 1619758 - RNA, 18 nt, Homo sapiens
ucauugggaagauucucu

SEQ ID NO: 1619759 - RNA, 15 nt, Homo sapiens
ucauugguguacugu

SEQ ID NO: 1619760 - RNA, 17 nt, Homo sapiens
ucauugguguacugugu

SEQ ID NO: 1619761 - RNA, 16 nt, Homo sapiens
ucauuucacacaguga

SEQ ID NO: 1619762 - RNA, 14 nt, Homo sapiens
ucauuucauuccau

SEQ ID NO: 1619763 - RNA, 22 nt, Homo sapiens
ucauuuggaggaaucaccccau

SEQ ID NO: 1619764 - RNA, 13 nt, Homo sapiens
uccaagauaugga

SEQ ID NO: 1619765 - RNA, 14 nt, Homo sapiens
uccaagcauuucau

SEQ ID NO: 1619766 - RNA, 17 nt, Homo sapiens
uccaagcuuguauuuaa

SEQ ID NO: 1619767 - RNA, 17 nt, Homo sapiens
uccaaguugagauuuua

SEQ ID NO: 1619768 - RNA, 22 nt, Homo sapiens
uccaauuucucuuuacuugaaa

SEQ ID NO: 1619769 - RNA, 14 nt, Homo sapiens
uccacacacaguaa

SEQ ID NO: 1619770 - RNA, 16 nt, Homo sapiens
uccacaccauucaggu

SEQ ID NO: 1619771 - RNA, 15 nt, Homo sapiens
uccacagauuaucaa

SEQ ID NO: 1619772 - RNA, 10 nt, Homo sapiens
uccaccagcc

SEQ ID NO: 1619773 - RNA, 12 nt, Homo sapiens
uccaccuuccau

SEQ ID NO: 1619774 - RNA, 22 nt, Homo sapiens
uccacucagcuguccugcagca

SEQ ID NO: 1619775 - RNA, 14 nt, Homo sapiens
uccagaacacucuu

SEQ ID NO: 1619776 - RNA, 18 nt, Homo sapiens
uccagagacaacagguaa

SEQ ID NO: 1619777 - RNA, 16 nt, Homo sapiens
uccagaugugugcaau

SEQ ID NO: 1619778 - RNA, 20 nt, Homo sapiens
uccagcccagacccagugga

SEQ ID NO: 1619779 - RNA, 19 nt, Homo sapiens
uccagcccugggacagggc

SEQ ID NO: 1619780 - RNA, 16 nt, Homo sapiens
uccaguuguguugaca

SEQ ID NO: 1619781 - RNA, 19 nt, Homo sapiens
uccauaaaagguguguuga

SEQ ID NO: 1619782 - RNA, 22 nt, Homo sapiens
uccauagccuaaucccugggca

SEQ ID NO: 1619783 - RNA, 14 nt, Homo sapiens
uccauccaaucuau

SEQ ID NO: 1619784 - RNA, 14 nt, Homo sapiens
uccauccuggucag

SEQ ID NO: 1619785 - RNA, 23 nt, Homo sapiens
uccaucuuguuucauuugcuugc

SEQ ID NO: 1619786 - RNA, 16 nt, Homo sapiens
uccauugccuagcucu

SEQ ID NO: 1619787 - RNA, 19 nt, Homo sapiens
ucccaaaucccucucacaa

SEQ ID NO: 1619788 - RNA, 16 nt, Homo sapiens
uuucucagacuuugga

SEQ ID NO: 1619789 - RNA, 22 nt, Homo sapiens
uuucugacaggcgcaacuccuc

SEQ ID NO: 1619790 - RNA, 13 nt, Homo sapiens
uuucugcauuuca

SEQ ID NO: 1619791 - RNA, 14 nt, Homo sapiens
uuucugcauuucaa

SEQ ID NO: 1619792 - RNA, 18 nt, Homo sapiens
uuucugguaaaacuuuag

SEQ ID NO: 1619793 - RNA, 15 nt, Homo sapiens
uuucuguaacacacu

SEQ ID NO: 1619794 - RNA, 16 nt, Homo sapiens
uuucuuagugugccaa

SEQ ID NO: 1619795 - RNA, 23 nt, Homo sapiens
uuucuuaguguuguggacacugc

SEQ ID NO: 1619796 - RNA, 15 nt, Homo sapiens
uuugaaccugugcaa

SEQ ID NO: 1619797 - RNA, 12 nt, Homo sapiens
uuugaagugauu

SEQ ID NO: 1619798 - RNA, 21 nt, Homo sapiens
uuugaauaagcagaacauacu

SEQ ID NO: 1619799 - RNA, 15 nt, Homo sapiens
uuugaauucuugaua

SEQ ID NO: 1619800 - RNA, 16 nt, Homo sapiens
uuugacuccaggaaca

SEQ ID NO: 1619801 - RNA, 13 nt, Homo sapiens
uuugagaauguuu

SEQ ID NO: 1619802 - RNA, 11 nt, Homo sapiens
uuugagccaug

SEQ ID NO: 1619803 - RNA, 20 nt, Homo sapiens
uuugaggaccccuuaaucuu

SEQ ID NO: 1619804 - RNA, 23 nt, Homo sapiens
uuugaggaccccuuaaucuugcu

SEQ ID NO: 1619805 - RNA, 13 nt, Homo sapiens
uuugcaguugaug

SEQ ID NO: 1619806 - RNA, 23 nt, Homo sapiens
uucagugcaguuucuuuucacau

SEQ ID NO: 1619807 - RNA, 21 nt, Homo sapiens
uucauaagauauucuuuacaa

SEQ ID NO: 1619808 - RNA, 22 nt, Homo sapiens
uucauagauagauaaguaucag

SEQ ID NO: 1619809 - RNA, 14 nt, Homo sapiens
uucauaguaguuac

SEQ ID NO: 1619810 - RNA, 21 nt, Homo sapiens
uucaucccucgggugugcuau

SEQ ID NO: 1619811 - RNA, 20 nt, Homo sapiens
uucauggcuaccucagaaag

SEQ ID NO: 1619812 - RNA, 23 nt, Homo sapiens
uucauguguauggaauauauucu

SEQ ID NO: 1619813 - RNA, 21 nt, Homo sapiens
uucauguugcaaagaacucca

SEQ ID NO: 1619814 - RNA, 23 nt, Homo sapiens
uucauuccuaaagaaaaauaucu

SEQ ID NO: 1619815 - RNA, 21 nt, Homo sapiens
uucauuguuuuuaacuuugcu

SEQ ID NO: 1619816 - RNA, 18 nt, Homo sapiens
uuccaaaugccauccaga

SEQ ID NO: 1619817 - RNA, 15 nt, Homo sapiens
uuccacagauuauca

SEQ ID NO: 1619818 - RNA, 16 nt, Homo sapiens
uuccagcguacuauaa

SEQ ID NO: 1619819 - RNA, 17 nt, Homo sapiens
uuccagcguacuauaau

SEQ ID NO: 1619820 - RNA, 14 nt, Homo sapiens
uuccaguacuaugg

SEQ ID NO: 1619821 - RNA, 23 nt, Homo sapiens
uuccagugucacuugacucuuga

SEQ ID NO: 1619822 - RNA, 16 nt, Homo sapiens
uuccauaagaagucgu

SEQ ID NO: 1619823 - RNA, 19 nt, Homo sapiens
uuccaugagaagaagcaga

SEQ ID NO: 1619824 - RNA, 20 nt, Homo sapiens
uucccacgucuaacuggaaa

SEQ ID NO: 1619825 - RNA, 18 nt, Homo sapiens
uuccccaagaucugccag

SEQ ID NO: 1619826 - RNA, 22 nt, Homo sapiens
uuccccacccaguucuucauuu

SEQ ID NO: 1619827 - RNA, 18 nt, Homo sapiens
uucccccaauguuuaaaa

SEQ ID NO: 1619828 - RNA, 21 nt, Homo sapiens
uucccccugcuuccaccucac

SEQ ID NO: 1619829 - RNA, 16 nt, Homo sapiens
uuccccgugggccaug

SEQ ID NO: 1619830 - RNA, 21 nt, Homo sapiens
uucccgcccagccucacuucc

SEQ ID NO: 1619831 - RNA, 15 nt, Homo sapiens
uucccuaaacuuuag

SEQ ID NO: 1619832 - RNA, 20 nt, Homo sapiens
uucccuauggguucugugac

SEQ ID NO: 1619833 - RNA, 23 nt, Homo sapiens
uucccuccccagaauggaggcaa

SEQ ID NO: 1619834 - RNA, 15 nt, Homo sapiens
uucccucugcauuga

SEQ ID NO: 1619835 - RNA, 15 nt, Homo sapiens
uucccucuugcucag

SEQ ID NO: 1619836 - RNA, 13 nt, Homo sapiens
uucccuugcucau

SEQ ID NO: 1619837 - RNA, 19 nt, Homo sapiens
uuccguuuuagaaaaggaa

SEQ ID NO: 1619838 - RNA, 23 nt, Homo sapiens
uuccuaacaugcaccuugcuccc

SEQ ID NO: 1619839 - RNA, 12 nt, Homo sapiens
uuccuaggucau

SEQ ID NO: 1619840 - RNA, 18 nt, Homo sapiens
uuccuaugcugcaauaca

SEQ ID NO: 1619841 - RNA, 17 nt, Homo sapiens
uuccucaaagcauuugc

SEQ ID NO: 1619842 - RNA, 16 nt, Homo sapiens
uuccucagcaggccaa

SEQ ID NO: 1619843 - RNA, 16 nt, Homo sapiens
uuccucagcugugugg

SEQ ID NO: 1619844 - RNA, 18 nt, Homo sapiens
uuccuccuuuaccuuuca

SEQ ID NO: 1619845 - RNA, 22 nt, Homo sapiens
uuccucuugugauuucuuuaaa

SEQ ID NO: 1619846 - RNA, 14 nt, Homo sapiens
uuccugcccuugaa

SEQ ID NO: 1619847 - RNA, 14 nt, Homo sapiens
uuccuguagccuuc

SEQ ID NO: 1619848 - RNA, 15 nt, Homo sapiens
uuccuguucaguaau

SEQ ID NO: 1619849 - RNA, 14 nt, Homo sapiens
uuccuuugaaauuu

SEQ ID NO: 1619850 - RNA, 21 nt, Homo sapiens
uuccuuuguagcuacuuuugc

SEQ ID NO: 1619851 - RNA, 16 nt, Homo sapiens
uuccuuugucauuauu

SEQ ID NO: 1619852 - RNA, 16 nt, Homo sapiens
uucgaaacuccauuga

SEQ ID NO: 1619853 - RNA, 20 nt, Homo sapiens
uucgcucuugaggagcucaa

SEQ ID NO: 1619854 - RNA, 22 nt, Homo sapiens
uucggauguaugaucucucuag

SEQ ID NO: 1619855 - RNA, 21 nt, Homo sapiens
uucguaacggccuugaucccc

SEQ ID NO: 1619856 - RNA, 15 nt, Homo sapiens
uucuaauuaaccuua

SEQ ID NO: 1619857 - RNA, 16 nt, Homo sapiens
uucuacacauacaugu

SEQ ID NO: 1619858 - RNA, 14 nt, Homo sapiens
uucuaggauagcua

SEQ ID NO: 1619859 - RNA, 14 nt, Homo sapiens
uucuaggcuaccag

SEQ ID NO: 1619860 - RNA, 15 nt, Homo sapiens
uucuauuauggaaaa

SEQ ID NO: 1619861 - RNA, 22 nt, Homo sapiens
uucucacacacaacuguccaua

SEQ ID NO: 1619862 - RNA, 13 nt, Homo sapiens
uucuccugccuca

SEQ ID NO: 1619863 - RNA, 14 nt, Homo sapiens
uucuccugccucag

SEQ ID NO: 1619864 - RNA, 19 nt, Homo sapiens
uucuccuggccccugccug

SEQ ID NO: 1619865 - RNA, 13 nt, Homo sapiens
uucucuacaccca

SEQ ID NO: 1619866 - RNA, 20 nt, Homo sapiens
uucucuugccauuuguagcu

SEQ ID NO: 1619867 - RNA, 14 nt, Homo sapiens
uucucuuuacuuga

SEQ ID NO: 1619868 - RNA, 11 nt, Homo sapiens
uucucuuucac

SEQ ID NO: 1619869 - RNA, 15 nt, Homo sapiens
uucugacuuuuacag

SEQ ID NO: 1619870 - RNA, 23 nt, Homo sapiens
uucugucaagcuggugcuacugu

SEQ ID NO: 1619871 - RNA, 19 nt, Homo sapiens
uucuguuuaucaagccaua

SEQ ID NO: 1619872 - RNA, 15 nt, Homo sapiens
uucuuaccaguguga

SEQ ID NO: 1619873 - RNA, 14 nt, Homo sapiens
uucuucauacuuaa

SEQ ID NO: 1619874 - RNA, 20 nt, Homo sapiens
uucuuccgcacccucccuag

SEQ ID NO: 1619875 - RNA, 21 nt, Homo sapiens
uucuuccucaaagcauuugca

SEQ ID NO: 1619876 - RNA, 21 nt, Homo sapiens
uucuucugaagaucagaacau

SEQ ID NO: 1619877 - RNA, 17 nt, Homo sapiens
uucuuggcaugcaucuu

SEQ ID NO: 1619878 - RNA, 21 nt, Homo sapiens
uucuuuagaauuuuuacccaa

SEQ ID NO: 1619879 - RNA, 15 nt, Homo sapiens
uucuuuccacugaau

SEQ ID NO: 1619880 - RNA, 14 nt, Homo sapiens
uucuuuucuugauu

SEQ ID NO: 1619881 - RNA, 13 nt, Homo sapiens
uugaaaaauugcc

SEQ ID NO: 1619882 - RNA, 22 nt, Homo sapiens
uugaaaggccaacagcaagugu

SEQ ID NO: 1619883 - RNA, 18 nt, Homo sapiens
uugaaauaaaacauucag

SEQ ID NO: 1619884 - RNA, 20 nt, Homo sapiens
uugaaccauccacuuacaua

SEQ ID NO: 1619885 - RNA, 15 nt, Homo sapiens
uugaaccugugcaau

SEQ ID NO: 1619886 - RNA, 22 nt, Homo sapiens
uugaacuguaccaugugcuaca

SEQ ID NO: 1619887 - RNA, 19 nt, Homo sapiens
uugaaucuauuucacuuau

SEQ ID NO: 1619888 - RNA, 21 nt, Homo sapiens
uugaauggguccauuuugccc

SEQ ID NO: 1619889 - RNA, 17 nt, Homo sapiens
uugaauguggucucagg

SEQ ID NO: 1619890 - RNA, 14 nt, Homo sapiens
uugacaacacagcc

SEQ ID NO: 1619891 - RNA, 15 nt, Homo sapiens
uugacacggccauga

SEQ ID NO: 1619892 - RNA, 13 nt, Homo sapiens
uugacagcaugaa

SEQ ID NO: 1619893 - RNA, 17 nt, Homo sapiens
uugacauucuacaguug

SEQ ID NO: 1619894 - RNA, 16 nt, Homo sapiens
uugaccucucauaaau

SEQ ID NO: 1619895 - RNA, 12 nt, Homo sapiens
uugagaaugagu

SEQ ID NO: 1619896 - RNA, 19 nt, Homo sapiens
uugagcaucagugagguua

SEQ ID NO: 1619897 - RNA, 13 nt, Homo sapiens
uugaggagcucaa

SEQ ID NO: 1619898 - RNA, 19 nt, Homo sapiens
uugagucuguuuuguaaag

SEQ ID NO: 1619899 - RNA, 22 nt, Homo sapiens
uugagugugauuugaaugauuu

SEQ ID NO: 1619900 - RNA, 20 nt, Homo sapiens
uugauauuuauuuuuugcca

SEQ ID NO: 1619901 - RNA, 22 nt, Homo sapiens
uugaucauaaacugacuaucau

SEQ ID NO: 1619902 - RNA, 17 nt, Homo sapiens
uugaugagcugugcaca

SEQ ID NO: 1619903 - RNA, 11 nt, Homo sapiens
uugaugccaua

SEQ ID NO: 1619904 - RNA, 12 nt, Homo sapiens
uugaugccauau

SEQ ID NO: 1619905 - RNA, 18 nt, Homo sapiens
uugaugccauaugccuug

SEQ ID NO: 1619906 - RNA, 20 nt, Homo sapiens
uugcaccuguccccacccuc

SEQ ID NO: 1619907 - RNA, 19 nt, Homo sapiens
uugcagaaugaagccauuu

SEQ ID NO: 1619908 - RNA, 12 nt, Homo sapiens
uugcagcccaaa

SEQ ID NO: 1619909 - RNA, 15 nt, Homo sapiens
uugcauacugaaaau

SEQ ID NO: 1619910 - RNA, 14 nt, Homo sapiens
uugcaugcuugcau

SEQ ID NO: 1619911 - RNA, 12 nt, Homo sapiens
uugcaugggcua

SEQ ID NO: 1619912 - RNA, 17 nt, Homo sapiens
uugcaugugacucugaa

SEQ ID NO: 1619913 - RNA, 19 nt, Homo sapiens
uugccacccaagagagaac

SEQ ID NO: 1619914 - RNA, 20 nt, Homo sapiens
uugcccaggcuggagugcaa

SEQ ID NO: 1619915 - RNA, 19 nt, Homo sapiens
uuaacaaguuagaaaauuc

SEQ ID NO: 1619916 - RNA, 14 nt, Homo sapiens
uuaacacauucaau

SEQ ID NO: 1619917 - RNA, 21 nt, Homo sapiens
uuaacacccuuuagaaccuua

SEQ ID NO: 1619918 - RNA, 14 nt, Homo sapiens
uuaaccugggacca

SEQ ID NO: 1619919 - RNA, 13 nt, Homo sapiens
uuaacggugcuaa

SEQ ID NO: 1619920 - RNA, 18 nt, Homo sapiens
uuaacucccuccaccagc

SEQ ID NO: 1619921 - RNA, 19 nt, Homo sapiens
uuaacucccuccaccagcc

SEQ ID NO: 1619922 - RNA, 15 nt, Homo sapiens
uuaacugccaagaaa

SEQ ID NO: 1619923 - RNA, 16 nt, Homo sapiens
uuaagagaucccuuaa

SEQ ID NO: 1619924 - RNA, 21 nt, Homo sapiens
uuaagauuuuuuauuugaaaa

SEQ ID NO: 1619925 - RNA, 13 nt, Homo sapiens
uuaaggcacagug

SEQ ID NO: 1619926 - RNA, 17 nt, Homo sapiens
uuaagguucaagacaga

SEQ ID NO: 1619927 - RNA, 21 nt, Homo sapiens
uuaagguuucaacaaauuuca

SEQ ID NO: 1619928 - RNA, 16 nt, Homo sapiens
uuaaguuuuacuugag

SEQ ID NO: 1619929 - RNA, 14 nt, Homo sapiens
uuaauaaaaguaca

SEQ ID NO: 1619930 - RNA, 15 nt, Homo sapiens
uuaauaaagcuuuau

SEQ ID NO: 1619931 - RNA, 23 nt, Homo sapiens
uuaauaaucagcaagaauuugau

SEQ ID NO: 1619932 - RNA, 18 nt, Homo sapiens
uuaauccuuaacacauuc

SEQ ID NO: 1619933 - RNA, 19 nt, Homo sapiens
uuaauccuuaacacauuca

SEQ ID NO: 1619934 - RNA, 18 nt, Homo sapiens
uuaaucuucucucuugau

SEQ ID NO: 1619935 - RNA, 16 nt, Homo sapiens
uuaaucuugaucauuc

SEQ ID NO: 1619936 - RNA, 19 nt, Homo sapiens
uuaaugcacagugcauuau

SEQ ID NO: 1619937 - RNA, 12 nt, Homo sapiens
uuaauguaucuu

SEQ ID NO: 1619938 - RNA, 13 nt, Homo sapiens
uuaaugucugcca

SEQ ID NO: 1619939 - RNA, 18 nt, Homo sapiens
uuaaugucugccagguga

SEQ ID NO: 1619940 - RNA, 17 nt, Homo sapiens
uuaauguggacuggaac

SEQ ID NO: 1619941 - RNA, 17 nt, Homo sapiens
uuaauuacuacuaggua

SEQ ID NO: 1619942 - RNA, 18 nt, Homo sapiens
uuaauuguuuugcacuuu

SEQ ID NO: 1619943 - RNA, 15 nt, Homo sapiens
uuaauuuauguaucu

SEQ ID NO: 1619944 - RNA, 15 nt, Homo sapiens
uuacaaauaguucug

SEQ ID NO: 1619945 - RNA, 19 nt, Homo sapiens
uuacacugugucauucugu

SEQ ID NO: 1619946 - RNA, 18 nt, Homo sapiens
uuacagauuaucacauua

SEQ ID NO: 1619947 - RNA, 23 nt, Homo sapiens
uuacauccagaguucugugacac

SEQ ID NO: 1619948 - RNA, 14 nt, Homo sapiens
uuaccugucucucu

SEQ ID NO: 1619949 - RNA, 14 nt, Homo sapiens
uuacuaagcacugu

SEQ ID NO: 1619950 - RNA, 22 nt, Homo sapiens
uuacuaaggaguaaucugugua

SEQ ID NO: 1619951 - RNA, 12 nt, Homo sapiens
uuacuacuuuaa

SEQ ID NO: 1619952 - RNA, 17 nt, Homo sapiens
uuacuggacauaacauu

SEQ ID NO: 1619953 - RNA, 14 nt, Homo sapiens
uuacuugcauuuau

SEQ ID NO: 1619954 - RNA, 23 nt, Homo sapiens
uuacuuuucuguuuaguuuuaca

SEQ ID NO: 1619955 - RNA, 13 nt, Homo sapiens
uuagaaaauucag

SEQ ID NO: 1619956 - RNA, 12 nt, Homo sapiens
uuagaaagggaa

SEQ ID NO: 1619957 - RNA, 12 nt, Homo sapiens
uuagaaauggau

SEQ ID NO: 1619958 - RNA, 19 nt, Homo sapiens
uuagaauuaaaaaagcaua

SEQ ID NO: 1619959 - RNA, 17 nt, Homo sapiens
uuagacaagacugucua

SEQ ID NO: 1619960 - RNA, 20 nt, Homo sapiens
uuagacuaguuucuuauuaa

SEQ ID NO: 1619961 - RNA, 22 nt, Homo sapiens
uuagaggagaaaaagcuuaaug

SEQ ID NO: 1619962 - RNA, 13 nt, Homo sapiens
uuagauacacuuc

SEQ ID NO: 1619963 - RNA, 20 nt, Homo sapiens
uuagcagggauucucucauc

SEQ ID NO: 1619964 - RNA, 19 nt, Homo sapiens
uuagccuaaauguuaacua

SEQ ID NO: 1619965 - RNA, 20 nt, Homo sapiens
uuagcuccauaaaguacaaa

SEQ ID NO: 1619966 - RNA, 23 nt, Homo sapiens
uuagcucucuuggguucccaaau

SEQ ID NO: 1619967 - RNA, 16 nt, Homo sapiens
uuagcuguacuguaau

SEQ ID NO: 1619968 - RNA, 16 nt, Homo sapiens
uuagguaagacauaua

SEQ ID NO: 1619969 - RNA, 21 nt, Homo sapiens
uuagugaucaaauugugcagu

SEQ ID NO: 1619970 - RNA, 13 nt, Homo sapiens
uuaguguugugga

SEQ ID NO: 1619971 - RNA, 20 nt, Homo sapiens
uuaguuguccacaaaucuuc

SEQ ID NO: 1619972 - RNA, 14 nt, Homo sapiens
uuaguuuuucuuac

SEQ ID NO: 1619973 - RNA, 21 nt, Homo sapiens
uuaguuuuucuuacuugcauu

SEQ ID NO: 1619974 - RNA, 19 nt, Homo sapiens
uuauaaaaagaugaucgcu

SEQ ID NO: 1619975 - RNA, 22 nt, Homo sapiens
uuauaaaaauauaaauuguaca

SEQ ID NO: 1619976 - RNA, 18 nt, Homo sapiens
uuauaaugaaaauaaaca

SEQ ID NO: 1619977 - RNA, 19 nt, Homo sapiens
uuauaccaccauccuugua

SEQ ID NO: 1619978 - RNA, 15 nt, Homo sapiens
uuauacuacaauaau

SEQ ID NO: 1619979 - RNA, 14 nt, Homo sapiens
uuauacuacuuugu

SEQ ID NO: 1619980 - RNA, 13 nt, Homo sapiens
uuauaugugacac

SEQ ID NO: 1619981 - RNA, 17 nt, Homo sapiens
uuauaugugacacugca

SEQ ID NO: 1619982 - RNA, 16 nt, Homo sapiens
uuauauuuuuagccua

SEQ ID NO: 1619983 - RNA, 17 nt, Homo sapiens
uuaucacuucauucaca

SEQ ID NO: 1619984 - RNA, 23 nt, Homo sapiens
uuaucacuucauucacauucaga

SEQ ID NO: 1619985 - RNA, 19 nt, Homo sapiens
uuaucauuaaaaauuaccu

SEQ ID NO: 1619986 - RNA, 12 nt, Homo sapiens
uuauccaugccu

SEQ ID NO: 1619987 - RNA, 16 nt, Homo sapiens
uuauccuuuuaucuca

SEQ ID NO: 1619988 - RNA, 15 nt, Homo sapiens
uuaucuacuucucuc

SEQ ID NO: 1619989 - RNA, 13 nt, Homo sapiens
uuaugacagugaa

SEQ ID NO: 1619990 - RNA, 16 nt, Homo sapiens
uuaugagacacaggau

SEQ ID NO: 1619991 - RNA, 17 nt, Homo sapiens
uuaugagacacaggaug

SEQ ID NO: 1619992 - RNA, 15 nt, Homo sapiens
uuaugcaaauacaau

SEQ ID NO: 1619993 - RNA, 18 nt, Homo sapiens
uuauguguugaugacuca

SEQ ID NO: 1619994 - RNA, 14 nt, Homo sapiens
uuauuacauguaau

SEQ ID NO: 1619995 - RNA, 15 nt, Homo sapiens
uuauuauauugucga

SEQ ID NO: 1619996 - RNA, 13 nt, Homo sapiens
uuauucuuccuca

SEQ ID NO: 1619997 - RNA, 15 nt, Homo sapiens
uuauuuaacuauuca

SEQ ID NO: 1619998 - RNA, 13 nt, Homo sapiens
uuauuucuagcaa

SEQ ID NO: 1619999 - RNA, 17 nt, Homo sapiens
uuauuugaaaacauaua

SEQ ID NO: 1620000 - RNA, 17 nt, Homo sapiens
uuauuuuuguucauaua

SEQ ID NO: 1620001 - RNA, 16 nt, Homo sapiens
uuauuuuuuucuuaaa

SEQ ID NO: 1620002 - RNA, 12 nt, Homo sapiens
uucaaaauacuu

SEQ ID NO: 1620003 - RNA, 12 nt, Homo sapiens
uucaaaauugcu

SEQ ID NO: 1620004 - RNA, 13 nt, Homo sapiens
uucaaagacugug

SEQ ID NO: 1620005 - RNA, 19 nt, Homo sapiens
uucaaggccuucaguuuau

SEQ ID NO: 1620006 - RNA, 18 nt, Homo sapiens
uucaagggacccaugagu

SEQ ID NO: 1620007 - RNA, 16 nt, Homo sapiens
uucaagugcacugagc

SEQ ID NO: 1620008 - RNA, 17 nt, Homo sapiens
uucaauagcauaucaca

SEQ ID NO: 1620009 - RNA, 18 nt, Homo sapiens
uucaauagcuaagcaucu

SEQ ID NO: 1620010 - RNA, 15 nt, Homo sapiens
uucaaugaaccacaa

SEQ ID NO: 1620011 - RNA, 13 nt, Homo sapiens
uucaauguauuga

SEQ ID NO: 1620012 - RNA, 14 nt, Homo sapiens
uucaauugacaaau

SEQ ID NO: 1620013 - RNA, 16 nt, Homo sapiens
uucacaaauccuucaa

SEQ ID NO: 1620014 - RNA, 20 nt, Homo sapiens
uucacaggcuaaugggauaa

SEQ ID NO: 1620015 - RNA, 12 nt, Homo sapiens
uucaccaugaug

SEQ ID NO: 1620016 - RNA, 19 nt, Homo sapiens
uucaccuccaagcauuuca

SEQ ID NO: 1620017 - RNA, 17 nt, Homo sapiens
uucacgaacaugggcau

SEQ ID NO: 1620018 - RNA, 22 nt, Homo sapiens
uucacucccaggugagaauuca

SEQ ID NO: 1620019 - RNA, 15 nt, Homo sapiens
uucacuguggucuca

SEQ ID NO: 1620020 - RNA, 22 nt, Homo sapiens
uucacuuucccaaaacugccac

SEQ ID NO: 1620021 - RNA, 14 nt, Homo sapiens
uucagacaagacag

SEQ ID NO: 1620022 - RNA, 19 nt, Homo sapiens
uucagaggagcaacccuau

SEQ ID NO: 1620023 - RNA, 23 nt, Homo sapiens
uucagauauaaaagacugaccaa

SEQ ID NO: 1620024 - RNA, 19 nt, Homo sapiens
uucagaugcuucugggaga

SEQ ID NO: 1620025 - RNA, 23 nt, Homo sapiens
uucaggccauucuccugccucag

SEQ ID NO: 1620026 - RNA, 12 nt, Homo sapiens
uguacaaagccc

SEQ ID NO: 1620027 - RNA, 20 nt, Homo sapiens
uguacaaugaacccccauga

SEQ ID NO: 1620028 - RNA, 16 nt, Homo sapiens
uguacaugauugccaa

SEQ ID NO: 1620029 - RNA, 20 nt, Homo sapiens
uguacauguguagccugugc

SEQ ID NO: 1620030 - RNA, 22 nt, Homo sapiens
uguacauguguagccugugcau

SEQ ID NO: 1620031 - RNA, 22 nt, Homo sapiens
uguacccuccuccccacacaga

SEQ ID NO: 1620032 - RNA, 18 nt, Homo sapiens
uguagaagauggcacuua

SEQ ID NO: 1620033 - RNA, 13 nt, Homo sapiens
uguagacaggaaa

SEQ ID NO: 1620034 - RNA, 18 nt, Homo sapiens
uguagacaggaaagccag

SEQ ID NO: 1620035 - RNA, 13 nt, Homo sapiens
uguagacucuugc

SEQ ID NO: 1620036 - RNA, 13 nt, Homo sapiens
uguagccagguac

SEQ ID NO: 1620037 - RNA, 14 nt, Homo sapiens
uguagccugugcau

SEQ ID NO: 1620038 - RNA, 18 nt, Homo sapiens
uguagcuucuucugaaag

SEQ ID NO: 1620039 - RNA, 16 nt, Homo sapiens
uguaguaaacuauuua

SEQ ID NO: 1620040 - RNA, 19 nt, Homo sapiens
uguauaaaugugauaugau

SEQ ID NO: 1620041 - RNA, 17 nt, Homo sapiens
uguauauauauauacuu

SEQ ID NO: 1620042 - RNA, 14 nt, Homo sapiens
uguauauguauuau

SEQ ID NO: 1620043 - RNA, 14 nt, Homo sapiens
uguaucuacauuaa

SEQ ID NO: 1620044 - RNA, 20 nt, Homo sapiens
uguaucuuaaaggacauaaa

SEQ ID NO: 1620045 - RNA, 22 nt, Homo sapiens
uguauuuuccuaaugugaucau

SEQ ID NO: 1620046 - RNA, 14 nt, Homo sapiens
ugucaaccccaaau

SEQ ID NO: 1620047 - RNA, 16 nt, Homo sapiens
ugucaccucagcacug

SEQ ID NO: 1620048 - RNA, 23 nt, Homo sapiens
ugucaccucgcugggcucuaagg

SEQ ID NO: 1620049 - RNA, 15 nt, Homo sapiens
ugucaggagaaaguu

SEQ ID NO: 1620050 - RNA, 14 nt, Homo sapiens
ugucaggugugaua

SEQ ID NO: 1620051 - RNA, 20 nt, Homo sapiens
ugucaguuuuguacauagca

SEQ ID NO: 1620052 - RNA, 15 nt, Homo sapiens
ugucauuucaaagac

SEQ ID NO: 1620053 - RNA, 17 nt, Homo sapiens
ugucccaaacaugcacu

SEQ ID NO: 1620054 - RNA, 18 nt, Homo sapiens
ugucgguuaccucugcau

SEQ ID NO: 1620055 - RNA, 11 nt, Homo sapiens
ugucuaccugg

SEQ ID NO: 1620056 - RNA, 12 nt, Homo sapiens
ugucucagggug

SEQ ID NO: 1620057 - RNA, 11 nt, Homo sapiens
ugucucaguga

SEQ ID NO: 1620058 - RNA, 19 nt, Homo sapiens
ugucucccagcucagggcu

SEQ ID NO: 1620059 - RNA, 20 nt, Homo sapiens
ugucugaguggcuucacucc

SEQ ID NO: 1620060 - RNA, 14 nt, Homo sapiens
ugucuuggggccac

SEQ ID NO: 1620061 - RNA, 15 nt, Homo sapiens
ugugaacagcuugcu

SEQ ID NO: 1620062 - RNA, 16 nt, Homo sapiens
ugugaacaucccuuau

SEQ ID NO: 1620063 - RNA, 17 nt, Homo sapiens
ugugaagaaaggguguu

SEQ ID NO: 1620064 - RNA, 16 nt, Homo sapiens
ugugaaguacaauaau

SEQ ID NO: 1620065 - RNA, 15 nt, Homo sapiens
ugugacacauaugca

SEQ ID NO: 1620066 - RNA, 22 nt, Homo sapiens
ugugacccccaaguccuauccu

SEQ ID NO: 1620067 - RNA, 13 nt, Homo sapiens
ugugaguauuucu

SEQ ID NO: 1620068 - RNA, 23 nt, Homo sapiens
ugugauccugccuugcugugaaa

SEQ ID NO: 1620069 - RNA, 15 nt, Homo sapiens
ugugcaccuuuacac

SEQ ID NO: 1620070 - RNA, 19 nt, Homo sapiens
ugugcauacgccucuuguu

SEQ ID NO: 1620071 - RNA, 17 nt, Homo sapiens
ugugccaauacagacaa

SEQ ID NO: 1620072 - RNA, 20 nt, Homo sapiens
ugugccaccgccuucccuga

SEQ ID NO: 1620073 - RNA, 16 nt, Homo sapiens
ugugccccaccacguc

SEQ ID NO: 1620074 - RNA, 20 nt, Homo sapiens
ugugccgcaccauugaacug

SEQ ID NO: 1620075 - RNA, 23 nt, Homo sapiens
uguggcccucuggauccagccau

SEQ ID NO: 1620076 - RNA, 12 nt, Homo sapiens
uguggugcauuc

SEQ ID NO: 1620077 - RNA, 16 nt, Homo sapiens
uguguagaccuugaug

SEQ ID NO: 1620078 - RNA, 14 nt, Homo sapiens
ugugucaccccaga

SEQ ID NO: 1620079 - RNA, 22 nt, Homo sapiens
ugugucaguggggcucucugag

SEQ ID NO: 1620080 - RNA, 23 nt, Homo sapiens
uguguccacugcaauugguggua

SEQ ID NO: 1620081 - RNA, 19 nt, Homo sapiens
ugugucccugaaguauuua

SEQ ID NO: 1620082 - RNA, 15 nt, Homo sapiens
uguguccugcaguuc

SEQ ID NO: 1620083 - RNA, 12 nt, Homo sapiens
ugugucuguaca

SEQ ID NO: 1620084 - RNA, 13 nt, Homo sapiens
ugugucuguacac

SEQ ID NO: 1620085 - RNA, 22 nt, Homo sapiens
uguguggcaaacuugcaguuua

SEQ ID NO: 1620086 - RNA, 17 nt, Homo sapiens
ugugugguauucaacua

SEQ ID NO: 1620087 - RNA, 14 nt, Homo sapiens
uguguguguguaca

SEQ ID NO: 1620088 - RNA, 19 nt, Homo sapiens
uguguguuuguguguuuca

SEQ ID NO: 1620089 - RNA, 15 nt, Homo sapiens
uguuaagguucaaga

SEQ ID NO: 1620090 - RNA, 15 nt, Homo sapiens
uguuaauauggugua

SEQ ID NO: 1620091 - RNA, 21 nt, Homo sapiens
uguuaauaugguguacauucu

SEQ ID NO: 1620092 - RNA, 23 nt, Homo sapiens
uguuaauggucaaugcuagcaca

SEQ ID NO: 1620093 - RNA, 20 nt, Homo sapiens
uguuacuuuuucuuguauuc

SEQ ID NO: 1620094 - RNA, 16 nt, Homo sapiens
uguuagguuacagauu

SEQ ID NO: 1620095 - RNA, 17 nt, Homo sapiens
uguuaguauaagcuuuu

SEQ ID NO: 1620096 - RNA, 14 nt, Homo sapiens
uguuauagcuuuaa

SEQ ID NO: 1620097 - RNA, 18 nt, Homo sapiens
uguuaucuaucaacuaua

SEQ ID NO: 1620098 - RNA, 14 nt, Homo sapiens
uguuauucauuugg

SEQ ID NO: 1620099 - RNA, 14 nt, Homo sapiens
uguucaauacugua

SEQ ID NO: 1620100 - RNA, 19 nt, Homo sapiens
uguucacaacagugaaaag

SEQ ID NO: 1620101 - RNA, 12 nt, Homo sapiens
uguucauuucac

SEQ ID NO: 1620102 - RNA, 14 nt, Homo sapiens
uguucuuugucuca

SEQ ID NO: 1620103 - RNA, 17 nt, Homo sapiens
uguugaaucuauuucac

SEQ ID NO: 1620104 - RNA, 15 nt, Homo sapiens
uguugacacggccau

SEQ ID NO: 1620105 - RNA, 17 nt, Homo sapiens
uguugugaaacuguaaa

SEQ ID NO: 1620106 - RNA, 19 nt, Homo sapiens
uguuuaaugucugccaggu

SEQ ID NO: 1620107 - RNA, 19 nt, Homo sapiens
uguuuacaugaguucaaau

SEQ ID NO: 1620108 - RNA, 16 nt, Homo sapiens
uguuuaucaagccaua

SEQ ID NO: 1620109 - RNA, 21 nt, Homo sapiens
uguuuaugaagaaagauacua

SEQ ID NO: 1620110 - RNA, 14 nt, Homo sapiens
uguuuccacacuua

SEQ ID NO: 1620111 - RNA, 13 nt, Homo sapiens
uguuugaguuaaa

SEQ ID NO: 1620112 - RNA, 17 nt, Homo sapiens
uguuuguuucuguagaa

SEQ ID NO: 1620113 - RNA, 19 nt, Homo sapiens
uguuuuaaguacuacacau

SEQ ID NO: 1620114 - RNA, 13 nt, Homo sapiens
uguuuuaucacuu

SEQ ID NO: 1620115 - RNA, 14 nt, Homo sapiens
uguuuugcacuuuu

SEQ ID NO: 1620116 - RNA, 12 nt, Homo sapiens
uguuuuuacuaa

SEQ ID NO: 1620117 - RNA, 14 nt, Homo sapiens
uuaaaaaaacagac

SEQ ID NO: 1620118 - RNA, 13 nt, Homo sapiens
uuaaaaacuuaaa

SEQ ID NO: 1620119 - RNA, 17 nt, Homo sapiens
uuaaaacuugaaguagg

SEQ ID NO: 1620120 - RNA, 20 nt, Homo sapiens
uuaaaauaacacuugcccau

SEQ ID NO: 1620121 - RNA, 22 nt, Homo sapiens
uuaaaauaacuaagcaaguaua

SEQ ID NO: 1620122 - RNA, 13 nt, Homo sapiens
uuaaaauucucau

SEQ ID NO: 1620123 - RNA, 14 nt, Homo sapiens
uuaaacaagucaau

SEQ ID NO: 1620124 - RNA, 20 nt, Homo sapiens
uuaaacauaagcuaaaucau

SEQ ID NO: 1620125 - RNA, 20 nt, Homo sapiens
uuaaaccagaacccaguguu

SEQ ID NO: 1620126 - RNA, 17 nt, Homo sapiens
uuaaaccagggaugucu

SEQ ID NO: 1620127 - RNA, 15 nt, Homo sapiens
uuaaacuacugauug

SEQ ID NO: 1620128 - RNA, 14 nt, Homo sapiens
uuaaacugauucau

SEQ ID NO: 1620129 - RNA, 16 nt, Homo sapiens
uuaaaggacauaaaau

SEQ ID NO: 1620130 - RNA, 11 nt, Homo sapiens
uuaaaguauuu

SEQ ID NO: 1620131 - RNA, 15 nt, Homo sapiens
uuaaauaacagggac

SEQ ID NO: 1620132 - RNA, 14 nt, Homo sapiens
uuaaaucaaaaggg

SEQ ID NO: 1620133 - RNA, 12 nt, Homo sapiens
uuaaaucuguga

SEQ ID NO: 1620134 - RNA, 12 nt, Homo sapiens
uuaaauuccaca

SEQ ID NO: 1620135 - RNA, 15 nt, Homo sapiens
uuaaauuccacagau

SEQ ID NO: 1620136 - RNA, 17 nt, Homo sapiens
uuaaauuccacagauua

SEQ ID NO: 1620137 - RNA, 15 nt, Homo sapiens
aacgaguuguuggcu

SEQ ID NO: 1620138 - RNA, 20 nt, Homo sapiens
aacgccugagcccagggagg

SEQ ID NO: 1620139 - RNA, 14 nt, Homo sapiens
aacguaugcaugug

SEQ ID NO: 1620140 - RNA, 15 nt, Homo sapiens
aacguggcacuggua

SEQ ID NO: 1620141 - RNA, 18 nt, Homo sapiens
aacuagccaaaccaggac

SEQ ID NO: 1620142 - RNA, 14 nt, Homo sapiens
aacucaacuucuuu

SEQ ID NO: 1620143 - RNA, 21 nt, Homo sapiens
aacucauggaccacaguaaca

SEQ ID NO: 1620144 - RNA, 12 nt, Homo sapiens
aacuccuuccau

SEQ ID NO: 1620145 - RNA, 13 nt, Homo sapiens
aacucggggacaa

SEQ ID NO: 1620146 - RNA, 12 nt, Homo sapiens
aacucuguacaa

SEQ ID NO: 1620147 - RNA, 20 nt, Homo sapiens
aacucuguauuacagcuuuc

SEQ ID NO: 1620148 - RNA, 15 nt, Homo sapiens
aacugaacauuccag

SEQ ID NO: 1620149 - RNA, 17 nt, Homo sapiens
aacugcauuccuucccc

SEQ ID NO: 1620150 - RNA, 23 nt, Homo sapiens
aacugcccagcggacaguggcag

SEQ ID NO: 1620151 - RNA, 16 nt, Homo sapiens
aacuguacauuucaca

SEQ ID NO: 1620152 - RNA, 13 nt, Homo sapiens
aacuguaugcuca

SEQ ID NO: 1620153 - RNA, 21 nt, Homo sapiens
aacugugccaauacagacaaa

SEQ ID NO: 1620154 - RNA, 13 nt, Homo sapiens
aacugugccuugu

SEQ ID NO: 1620155 - RNA, 16 nt, Homo sapiens
aacuguuucccugcug

SEQ ID NO: 1620156 - RNA, 14 nt, Homo sapiens
aacuuagaaaggga

SEQ ID NO: 1620157 - RNA, 19 nt, Homo sapiens
aacuuccgcugaggggucu

SEQ ID NO: 1620158 - RNA, 12 nt, Homo sapiens
aacuucuuguca

SEQ ID NO: 1620159 - RNA, 23 nt, Homo sapiens
aacuuucaggggcugacucucca

SEQ ID NO: 1620160 - RNA, 15 nt, Homo sapiens
aagaaaaacuagaca

SEQ ID NO: 1620161 - RNA, 14 nt, Homo sapiens
aagaaaaauaucuu

SEQ ID NO: 1620162 - RNA, 16 nt, Homo sapiens
aagaaaauggauuuaa

SEQ ID NO: 1620163 - RNA, 17 nt, Homo sapiens
aagaaacagaguggccu

SEQ ID NO: 1620164 - RNA, 17 nt, Homo sapiens
aagaaaguuaacugacu

SEQ ID NO: 1620165 - RNA, 18 nt, Homo sapiens
aagaaaucucuaugcaaa

SEQ ID NO: 1620166 - RNA, 21 nt, Homo sapiens
aagaaccacucauaauucuuc

SEQ ID NO: 1620167 - RNA, 22 nt, Homo sapiens
aagaagacaccucuaaucugga

SEQ ID NO: 1620168 - RNA, 12 nt, Homo sapiens
aagaaggcauug

SEQ ID NO: 1620169 - RNA, 15 nt, Homo sapiens
aagaagguuuguguu

SEQ ID NO: 1620170 - RNA, 13 nt, Homo sapiens
aagacacauugac

SEQ ID NO: 1620171 - RNA, 11 nt, Homo sapiens
aagaccaccuu

SEQ ID NO: 1620172 - RNA, 23 nt, Homo sapiens
aagacgugauuuugcuguagaag

SEQ ID NO: 1620173 - RNA, 15 nt, Homo sapiens
aagacucauugcuua

SEQ ID NO: 1620174 - RNA, 13 nt, Homo sapiens
aagacuugugcau

SEQ ID NO: 1620175 - RNA, 16 nt, Homo sapiens
aagagaaaauugagag

SEQ ID NO: 1620176 - RNA, 15 nt, Homo sapiens
aagagagaagccagc

SEQ ID NO: 1620177 - RNA, 21 nt, Homo sapiens
aagagcaaacaaaaguucugc

SEQ ID NO: 1620178 - RNA, 12 nt, Homo sapiens
aagagcuguuau

SEQ ID NO: 1620179 - RNA, 12 nt, Homo sapiens
aagagggaacaa

SEQ ID NO: 1620180 - RNA, 19 nt, Homo sapiens
aagagggacaggcugaaga

SEQ ID NO: 1620181 - RNA, 12 nt, Homo sapiens
aagaggugaccc

SEQ ID NO: 1620182 - RNA, 22 nt, Homo sapiens
aagagucaacaggucacuugau

SEQ ID NO: 1620183 - RNA, 17 nt, Homo sapiens
aagauaaaccaguugaa

SEQ ID NO: 1620184 - RNA, 18 nt, Homo sapiens
aagauaaaccaguugaau

SEQ ID NO: 1620185 - RNA, 13 nt, Homo sapiens
aagauacuccaua

SEQ ID NO: 1620186 - RNA, 18 nt, Homo sapiens
aagauauauguguauaca

SEQ ID NO: 1620187 - RNA, 20 nt, Homo sapiens
aagauaugccacuaacuucu

SEQ ID NO: 1620188 - RNA, 16 nt, Homo sapiens
aagauauucuuuacaa

SEQ ID NO: 1620189 - RNA, 16 nt, Homo sapiens
aagauauuuacucaaa

SEQ ID NO: 1620190 - RNA, 19 nt, Homo sapiens
aagaucaacgccucacuga

SEQ ID NO: 1620191 - RNA, 15 nt, Homo sapiens
aagaucauugccauc

SEQ ID NO: 1620192 - RNA, 22 nt, Homo sapiens
aagaucauugccaucaccauuu

SEQ ID NO: 1620193 - RNA, 19 nt, Homo sapiens
aagaugacggaugccuaga

SEQ ID NO: 1620194 - RNA, 21 nt, Homo sapiens
aagaugaguuauuuaacuggu

SEQ ID NO: 1620195 - RNA, 17 nt, Homo sapiens
aagaugcccucaacuca

SEQ ID NO: 1620196 - RNA, 20 nt, Homo sapiens
aagauggagcaaaccuagcc

SEQ ID NO: 1620197 - RNA, 20 nt, Homo sapiens
aagauggcacuuauaaccaa

SEQ ID NO: 1620198 - RNA, 18 nt, Homo sapiens
aaugucucuuugugcucu

SEQ ID NO: 1620199 - RNA, 13 nt, Homo sapiens
aaugucuguauca

SEQ ID NO: 1620200 - RNA, 13 nt, Homo sapiens
aaugugcacucuc

SEQ ID NO: 1620201 - RNA, 18 nt, Homo sapiens
aauguggcuccaagcuca

SEQ ID NO: 1620202 - RNA, 20 nt, Homo sapiens
aauguggguauugaguguga

SEQ ID NO: 1620203 - RNA, 22 nt, Homo sapiens
aauguguuuuaucacuucauuc

SEQ ID NO: 1620204 - RNA, 17 nt, Homo sapiens
aauuaaaaaagcauacu

SEQ ID NO: 1620205 - RNA, 23 nt, Homo sapiens
aauuaaaggagaagauuccugaa

SEQ ID NO: 1620206 - RNA, 15 nt, Homo sapiens
aauuaaaucuagaca

SEQ ID NO: 1620207 - RNA, 14 nt, Homo sapiens
aauuaagacuuuau

SEQ ID NO: 1620208 - RNA, 16 nt, Homo sapiens
aauuagaaaguagcca

SEQ ID NO: 1620209 - RNA, 19 nt, Homo sapiens
aauuauuguuauacacagc

SEQ ID NO: 1620210 - RNA, 17 nt, Homo sapiens
aauuauuuuuguucaua

SEQ ID NO: 1620211 - RNA, 22 nt, Homo sapiens
aauucagacaagcugcauuuca

SEQ ID NO: 1620212 - RNA, 17 nt, Homo sapiens
aauuccacagauuauca

SEQ ID NO: 1620213 - RNA, 21 nt, Homo sapiens
aauuccguguuuucgcuuuuu

SEQ ID NO: 1620214 - RNA, 22 nt, Homo sapiens
aauuccuacugacaacauuaua

SEQ ID NO: 1620215 - RNA, 16 nt, Homo sapiens
aauucuccugccuuag

SEQ ID NO: 1620216 - RNA, 17 nt, Homo sapiens
aauucuccugccuuagc

SEQ ID NO: 1620217 - RNA, 20 nt, Homo sapiens
aauucugucauuucaaagac

SEQ ID NO: 1620218 - RNA, 20 nt, Homo sapiens
aauucuuauugacucauaca

SEQ ID NO: 1620219 - RNA, 21 nt, Homo sapiens
aauucuuauugacucauacac

SEQ ID NO: 1620220 - RNA, 11 nt, Homo sapiens
aauucuugaua

SEQ ID NO: 1620221 - RNA, 21 nt, Homo sapiens
aauugacagaucaagcuguga

SEQ ID NO: 1620222 - RNA, 14 nt, Homo sapiens
aauugcucuuucac

SEQ ID NO: 1620223 - RNA, 15 nt, Homo sapiens
aauugguagaaggau

SEQ ID NO: 1620224 - RNA, 18 nt, Homo sapiens
aauuggugcuauuugaag

SEQ ID NO: 1620225 - RNA, 23 nt, Homo sapiens
aauugugugugaugugaagccaa

SEQ ID NO: 1620226 - RNA, 16 nt, Homo sapiens
aauuuaaaaaaacaga

SEQ ID NO: 1620227 - RNA, 19 nt, Homo sapiens
aauuuauuuccacuaaaaa

SEQ ID NO: 1620228 - RNA, 13 nt, Homo sapiens
aauuucauugcac

SEQ ID NO: 1620229 - RNA, 23 nt, Homo sapiens
aauuucauuucagccacuucugc

SEQ ID NO: 1620230 - RNA, 16 nt, Homo sapiens
aauuugagauacaaac

SEQ ID NO: 1620231 - RNA, 17 nt, Homo sapiens
aauuuguuuuagccauu

SEQ ID NO: 1620232 - RNA, 23 nt, Homo sapiens
aauuuucuguguuuugcuguacc

SEQ ID NO: 1620233 - RNA, 21 nt, Homo sapiens
aauuuucuucauacuuaaaaa

SEQ ID NO: 1620234 - RNA, 21 nt, Homo sapiens
aauuuuuacacaaaccugaaa

SEQ ID NO: 1620235 - RNA, 22 nt, Homo sapiens
aauuuuugaaaaaaguacauau

SEQ ID NO: 1620236 - RNA, 21 nt, Homo sapiens
aauuuuuuaaaguuacuuugu

SEQ ID NO: 1620237 - RNA, 16 nt, Homo sapiens
acaaaagauuaaucuu

SEQ ID NO: 1620238 - RNA, 15 nt, Homo sapiens
acaaaagucugucuu

SEQ ID NO: 1620239 - RNA, 14 nt, Homo sapiens
acaaacaaguggau

SEQ ID NO: 1620240 - RNA, 20 nt, Homo sapiens
acaaacccccacuccagcuc

SEQ ID NO: 1620241 - RNA, 18 nt, Homo sapiens
acaaacugaagauaauga

SEQ ID NO: 1620242 - RNA, 23 nt, Homo sapiens
acaaagagaaugagaagacaugg

SEQ ID NO: 1620243 - RNA, 13 nt, Homo sapiens
acaaagaugacug

SEQ ID NO: 1620244 - RNA, 19 nt, Homo sapiens
acaaagcucaaaguaugca

SEQ ID NO: 1620245 - RNA, 19 nt, Homo sapiens
acaaaggauacuuuuacag

SEQ ID NO: 1620246 - RNA, 21 nt, Homo sapiens
acaaaggauacuuuuacaggu

SEQ ID NO: 1620247 - RNA, 19 nt, Homo sapiens
acaaaguuauauucacagu

SEQ ID NO: 1620248 - RNA, 14 nt, Homo sapiens
acaaauaaauaaga

SEQ ID NO: 1620249 - RNA, 18 nt, Homo sapiens
acaaauaaauaagaucag

SEQ ID NO: 1620250 - RNA, 17 nt, Homo sapiens
acaaauaaguaauaucu

SEQ ID NO: 1620251 - RNA, 15 nt, Homo sapiens
acaaauaguucugaa

SEQ ID NO: 1620252 - RNA, 21 nt, Homo sapiens
aaguccuuggacuguuuugaa

SEQ ID NO: 1620253 - RNA, 20 nt, Homo sapiens
aagucuaaaugaaguuauua

SEQ ID NO: 1620254 - RNA, 15 nt, Homo sapiens
aagucuaccugggcu

SEQ ID NO: 1620255 - RNA, 14 nt, Homo sapiens
aagucuagaaucau

SEQ ID NO: 1620256 - RNA, 15 nt, Homo sapiens
aagucugcuacccuc

SEQ ID NO: 1620257 - RNA, 14 nt, Homo sapiens
aagucugucuugcc

SEQ ID NO: 1620258 - RNA, 13 nt, Homo sapiens
aagugaaagcaag

SEQ ID NO: 1620259 - RNA, 17 nt, Homo sapiens
aagugccaaaugcucuc

SEQ ID NO: 1620260 - RNA, 21 nt, Homo sapiens
aagugcgugccgugugagugu

SEQ ID NO: 1620261 - RNA, 16 nt, Homo sapiens
aagugguugcauucua

SEQ ID NO: 1620262 - RNA, 19 nt, Homo sapiens
aaguguaaaaaaugucuca

SEQ ID NO: 1620263 - RNA, 22 nt, Homo sapiens
aaguguccuggaaauucugcug

SEQ ID NO: 1620264 - RNA, 15 nt, Homo sapiens
aagugucucauucuc

SEQ ID NO: 1620265 - RNA, 15 nt, Homo sapiens
aaguuagaaaauuca

SEQ ID NO: 1620266 - RNA, 11 nt, Homo sapiens
aaguucaguga

SEQ ID NO: 1620267 - RNA, 15 nt, Homo sapiens
aaguuuaaauaccag

SEQ ID NO: 1620268 - RNA, 13 nt, Homo sapiens
aaguuucuaaaaa

SEQ ID NO: 1620269 - RNA, 18 nt, Homo sapiens
aauaaaaaggaaaacaga

SEQ ID NO: 1620270 - RNA, 18 nt, Homo sapiens
aauaaaacuuaaaucuca

SEQ ID NO: 1620271 - RNA, 14 nt, Homo sapiens
aauaaaauuaacaa

SEQ ID NO: 1620272 - RNA, 13 nt, Homo sapiens
aauaaaugaguag

SEQ ID NO: 1620273 - RNA, 21 nt, Homo sapiens
aauaaauugcuuacugauauu

SEQ ID NO: 1620274 - RNA, 12 nt, Homo sapiens
aauaacacugga

SEQ ID NO: 1620275 - RNA, 12 nt, Homo sapiens
aauaacacuguc

SEQ ID NO: 1620276 - RNA, 22 nt, Homo sapiens
aauaacuaagcaaguauauuua

SEQ ID NO: 1620277 - RNA, 23 nt, Homo sapiens
aauaagacuuagauugugcuccu

SEQ ID NO: 1620278 - RNA, 16 nt, Homo sapiens
aauaagaucagacucu

SEQ ID NO: 1620279 - RNA, 17 nt, Homo sapiens
aauaagaucagacucug

SEQ ID NO: 1620280 - RNA, 22 nt, Homo sapiens
aauaagauguaguaacacugug

SEQ ID NO: 1620281 - RNA, 18 nt, Homo sapiens
aauaaugccuaguggcuu

SEQ ID NO: 1620282 - RNA, 22 nt, Homo sapiens
aauaauucauauucuucauauc

SEQ ID NO: 1620283 - RNA, 15 nt, Homo sapiens
aauacaaucagccca

SEQ ID NO: 1620284 - RNA, 23 nt, Homo sapiens
aauacaaucagcccagugcaaac

SEQ ID NO: 1620285 - RNA, 12 nt, Homo sapiens
aauacaguauac

SEQ ID NO: 1620286 - RNA, 22 nt, Homo sapiens
aauacaguauaccgcaguggcu

SEQ ID NO: 1620287 - RNA, 16 nt, Homo sapiens
aauaccaguacuugag

SEQ ID NO: 1620288 - RNA, 24 nt, Homo sapiens
aauacuuuugggauguuaccuuca

SEQ ID NO: 1620289 - RNA, 18 nt, Homo sapiens
aauagaaggauucaguca

SEQ ID NO: 1620290 - RNA, 12 nt, Homo sapiens
aauagcaauaac

SEQ ID NO: 1620291 - RNA, 19 nt, Homo sapiens
aauagcauaucacagagag

SEQ ID NO: 1620292 - RNA, 15 nt, Homo sapiens
aauagcuaagcaucu

SEQ ID NO: 1620293 - RNA, 19 nt, Homo sapiens
aauagguucaaaagcaauc

SEQ ID NO: 1620294 - RNA, 18 nt, Homo sapiens
aauaguuagaucuacccu

SEQ ID NO: 1620295 - RNA, 17 nt, Homo sapiens
aauauacaggaggaugu

SEQ ID NO: 1620296 - RNA, 22 nt, Homo sapiens
aauauagagggcuuaugauuca

SEQ ID NO: 1620297 - RNA, 16 nt, Homo sapiens
aauauauaucacucua

SEQ ID NO: 1620298 - RNA, 18 nt, Homo sapiens
aauauauuucaagcuaua

SEQ ID NO: 1620299 - RNA, 15 nt, Homo sapiens
aauauauuuuaucuu

SEQ ID NO: 1620300 - RNA, 12 nt, Homo sapiens
aauaucuuggcc

SEQ ID NO: 1620301 - RNA, 21 nt, Homo sapiens
aauaugguguacauucuuccu

SEQ ID NO: 1620302 - RNA, 13 nt, Homo sapiens
aauaugucuuucu

SEQ ID NO: 1620303 - RNA, 20 nt, Homo sapiens
aauauuuagcuguaaacuga

SEQ ID NO: 1620304 - RNA, 15 nt, Homo sapiens
aauauuuauuuaacu

SEQ ID NO: 1620305 - RNA, 23 nt, Homo sapiens
aauauuuuuauaucaugcaaaau

SEQ ID NO: 1620306 - RNA, 20 nt, Homo sapiens
aauauuuuucuguaguguga

SEQ ID NO: 1620307 - RNA, 23 nt, Homo sapiens
aaucaaaacucacaagugcucau

SEQ ID NO: 1620308 - RNA, 14 nt, Homo sapiens
aaucaaacauauuc

SEQ ID NO: 1620309 - RNA, 18 nt, Homo sapiens
acuuuuucuuguauucau

SEQ ID NO: 1620310 - RNA, 15 nt, Homo sapiens
acuuuuuuacacuga

SEQ ID NO: 1620311 - RNA, 19 nt, Homo sapiens
acuuuuuuagaaaugcaaa

SEQ ID NO: 1620312 - RNA, 15 nt, Homo sapiens
agaaaaaggugccau

SEQ ID NO: 1620313 - RNA, 12 nt, Homo sapiens
agaaaacaagua

SEQ ID NO: 1620314 - RNA, 12 nt, Homo sapiens
agaaaacauuuu

SEQ ID NO: 1620315 - RNA, 18 nt, Homo sapiens
agaaaaccuguucaggca

SEQ ID NO: 1620316 - RNA, 21 nt, Homo sapiens
agaaaacucccaauacaaaga

SEQ ID NO: 1620317 - RNA, 22 nt, Homo sapiens
agaaaaucugcauguuugauua

SEQ ID NO: 1620318 - RNA, 23 nt, Homo sapiens
agaaacaaccguuggaaacauaa

SEQ ID NO: 1620319 - RNA, 17 nt, Homo sapiens
agaaacacguggucaug

SEQ ID NO: 1620320 - RNA, 14 nt, Homo sapiens
agaaacagccugug

SEQ ID NO: 1620321 - RNA, 23 nt, Homo sapiens
agaaacauuguaaauauuuacuc

SEQ ID NO: 1620322 - RNA, 23 nt, Homo sapiens
agaaaccuggggugaauacuuau

SEQ ID NO: 1620323 - RNA, 15 nt, Homo sapiens
agaaaggguuccaaa

SEQ ID NO: 1620324 - RNA, 18 nt, Homo sapiens
agaaagugacauuugcuu

SEQ ID NO: 1620325 - RNA, 11 nt, Homo sapiens
agaaaugcaaa

SEQ ID NO: 1620326 - RNA, 20 nt, Homo sapiens
agaaauggacuggagcucau

SEQ ID NO: 1620327 - RNA, 22 nt, Homo sapiens
agaaauggccaaauauauuucc

SEQ ID NO: 1620328 - RNA, 15 nt, Homo sapiens
agaacaaagccacug

SEQ ID NO: 1620329 - RNA, 20 nt, Homo sapiens
agaacaagaccccgucucaa

SEQ ID NO: 1620330 - RNA, 17 nt, Homo sapiens
agaacagguucuuaaaa

SEQ ID NO: 1620331 - RNA, 22 nt, Homo sapiens
agaacaguuguccaggaugcug

SEQ ID NO: 1620332 - RNA, 17 nt, Homo sapiens
agaaccacaaacaauuc

SEQ ID NO: 1620333 - RNA, 14 nt, Homo sapiens
agaaccacucauaa

SEQ ID NO: 1620334 - RNA, 17 nt, Homo sapiens
agaaccacucauaauuc

SEQ ID NO: 1620335 - RNA, 16 nt, Homo sapiens
agaacgguuuuuggau

SEQ ID NO: 1620336 - RNA, 19 nt, Homo sapiens
agaacguuuuuuccucagu

SEQ ID NO: 1620337 - RNA, 20 nt, Homo sapiens
agaacuaccaugagaugguu

SEQ ID NO: 1620338 - RNA, 20 nt, Homo sapiens
agaacuagccaaaccaggac

SEQ ID NO: 1620339 - RNA, 17 nt, Homo sapiens
agaacugggcaacuauu

SEQ ID NO: 1620340 - RNA, 14 nt, Homo sapiens
agaacugucuguga

SEQ ID NO: 1620341 - RNA, 19 nt, Homo sapiens
agaagaaagaaacuucauu

SEQ ID NO: 1620342 - RNA, 17 nt, Homo sapiens
agaagcaagacacgugg

SEQ ID NO: 1620343 - RNA, 22 nt, Homo sapiens
agaaguucaaacccuguaucca

SEQ ID NO: 1620344 - RNA, 17 nt, Homo sapiens
agaauaaggcaggcauu

SEQ ID NO: 1620345 - RNA, 20 nt, Homo sapiens
agaaucauacuuaacauuuc

SEQ ID NO: 1620346 - RNA, 21 nt, Homo sapiens
agaaucccggcugucaagggg

SEQ ID NO: 1620347 - RNA, 14 nt, Homo sapiens
agaaugagaagaca

SEQ ID NO: 1620348 - RNA, 22 nt, Homo sapiens
agaauucaggcaaacguccaca

SEQ ID NO: 1620349 - RNA, 13 nt, Homo sapiens
agaauucuacccu

SEQ ID NO: 1620350 - RNA, 13 nt, Homo sapiens
agaauugcacauc

SEQ ID NO: 1620351 - RNA, 14 nt, Homo sapiens
agaauuggaaucac

SEQ ID NO: 1620352 - RNA, 16 nt, Homo sapiens
agaauuggaaucacau

SEQ ID NO: 1620353 - RNA, 20 nt, Homo sapiens
agaauuuaaaauaacacuug

SEQ ID NO: 1620354 - RNA, 19 nt, Homo sapiens
agacaaauucggauguaug

SEQ ID NO: 1620355 - RNA, 16 nt, Homo sapiens
agacaagcugcauuuc

SEQ ID NO: 1620356 - RNA, 18 nt, Homo sapiens
agacacguggccucguga

SEQ ID NO: 1620357 - RNA, 12 nt, Homo sapiens
agacaggaugag

SEQ ID NO: 1620358 - RNA, 23 nt, Homo sapiens
agacaggcaaauaaaagugaccu

SEQ ID NO: 1620359 - RNA, 19 nt, Homo sapiens
agacaggguuucacugugu

SEQ ID NO: 1620360 - RNA, 20 nt, Homo sapiens
agacaguccuuucccaccau

SEQ ID NO: 1620361 - RNA, 15 nt, Homo sapiens
agacauacauuucuc

SEQ ID NO: 1620362 - RNA, 22 nt, Homo sapiens
agacauccauaaagaagcaaua

SEQ ID NO: 1620363 - RNA, 21 nt, Homo sapiens
agacauggaugaucugggaga

SEQ ID NO: 1620364 - RNA, 23 nt, Homo sapiens
agaccagcccaccccugugccca

SEQ ID NO: 1620365 - RNA, 14 nt, Homo sapiens
agacccaucucucc

SEQ ID NO: 1620366 - RNA, 15 nt, Homo sapiens
agaccccagucguga

SEQ ID NO: 1620367 - RNA, 18 nt, Homo sapiens
agacccugaugcagguca

SEQ ID NO: 1620368 - RNA, 19 nt, Homo sapiens
agacccugaugcaggucag

SEQ ID NO: 1620369 - RNA, 13 nt, Homo sapiens
agaccuacccucc

SEQ ID NO: 1620370 - RNA, 15 nt, Homo sapiens
agaccucaucugugg

SEQ ID NO: 1620371 - RNA, 19 nt, Homo sapiens
agacgugauuuugcuguag

SEQ ID NO: 1620372 - RNA, 22 nt, Homo sapiens
agacucacuuguucucacuguc

SEQ ID NO: 1620373 - RNA, 23 nt, Homo sapiens
agacucccuugcuuuuugcugug

SEQ ID NO: 1620374 - RNA, 22 nt, Homo sapiens
agacucuugcuccugcuucucc

SEQ ID NO: 1620375 - RNA, 19 nt, Homo sapiens
agacugguuuucugccaau

SEQ ID NO: 1620376 - RNA, 12 nt, Homo sapiens
agacuugugcau

SEQ ID NO: 1620377 - RNA, 14 nt, Homo sapiens
agagaacuccccca

SEQ ID NO: 1620378 - RNA, 13 nt, Homo sapiens
agagaaggggcag

SEQ ID NO: 1620379 - RNA, 14 nt, Homo sapiens
agagacagaauuca

SEQ ID NO: 1620380 - RNA, 13 nt, Homo sapiens
agagacagaggau

SEQ ID NO: 1620381 - RNA, 18 nt, Homo sapiens
agagacgguguuuugcca

SEQ ID NO: 1620382 - RNA, 19 nt, Homo sapiens
agagagcuagagggacaaa

SEQ ID NO: 1620383 - RNA, 17 nt, Homo sapiens
agagauaaacuacauag

SEQ ID NO: 1620384 - RNA, 21 nt, Homo sapiens
agagauauugauauugaagga

SEQ ID NO: 1620385 - RNA, 20 nt, Homo sapiens
agagauauuucaagcucaug

SEQ ID NO: 1620386 - RNA, 16 nt, Homo sapiens
agagauugauggguua

SEQ ID NO: 1620387 - RNA, 17 nt, Homo sapiens
agagauuuucauuuuag

SEQ ID NO: 1620388 - RNA, 23 nt, Homo sapiens
agagcaaguccucacucuucaag

SEQ ID NO: 1620389 - RNA, 17 nt, Homo sapiens
agagcacuuugcaacuc

SEQ ID NO: 1620390 - RNA, 19 nt, Homo sapiens
agagcccauuaaucuugau

SEQ ID NO: 1620391 - RNA, 17 nt, Homo sapiens
agagcccugugucugua

SEQ ID NO: 1620392 - RNA, 16 nt, Homo sapiens
agagcgugcuuucaag

SEQ ID NO: 1620393 - RNA, 13 nt, Homo sapiens
agagcuggaggca

SEQ ID NO: 1620394 - RNA, 21 nt, Homo sapiens
agaggagcccagcggcccaag

SEQ ID NO: 1620395 - RNA, 21 nt, Homo sapiens
agaggccggucccuuccuugg

SEQ ID NO: 1620396 - RNA, 19 nt, Homo sapiens
agaggcugaggcuggcaca

SEQ ID NO: 1620397 - RNA, 18 nt, Homo sapiens
agaggggagugcauuuag

SEQ ID NO: 1620398 - RNA, 18 nt, Homo sapiens
agaggggauucacaaggu

SEQ ID NO: 1620399 - RNA, 21 nt, Homo sapiens
agagguagucucacugcuuga

SEQ ID NO: 1620400 - RNA, 15 nt, Homo sapiens
agaggucaccagcug

SEQ ID NO: 1620401 - RNA, 17 nt, Homo sapiens
agaggucagcacacauu

SEQ ID NO: 1620402 - RNA, 20 nt, Homo sapiens
agagucaacaggucacuuga

SEQ ID NO: 1620403 - RNA, 19 nt, Homo sapiens
agagugacggcuggcaugg

SEQ ID NO: 1620404 - RNA, 15 nt, Homo sapiens
agaguguagcuguaa

SEQ ID NO: 1620405 - RNA, 14 nt, Homo sapiens
agauaaacuacaua

SEQ ID NO: 1620406 - RNA, 13 nt, Homo sapiens
agauaaagaccuu

SEQ ID NO: 1620407 - RNA, 17 nt, Homo sapiens
agauaccaggcacuuaa

SEQ ID NO: 1620408 - RNA, 16 nt, Homo sapiens
agauagcuugagcugg

SEQ ID NO: 1620409 - RNA, 17 nt, Homo sapiens
agauauauguguauaca

SEQ ID NO: 1620410 - RNA, 23 nt, Homo sapiens
agauauugcgccugugugcgugu

SEQ ID NO: 1620411 - RNA, 21 nt, Homo sapiens
agauauuucaagcucauguca

SEQ ID NO: 1620412 - RNA, 18 nt, Homo sapiens
agaucagaacauucagcu

SEQ ID NO: 1620413 - RNA, 18 nt, Homo sapiens
agaucauauacgugaaaa

SEQ ID NO: 1620414 - RNA, 19 nt, Homo sapiens
agauccuuuaguccaccca

SEQ ID NO: 1620415 - RNA, 17 nt, Homo sapiens
agaugaacugacugaag

SEQ ID NO: 1620416 - RNA, 18 nt, Homo sapiens
agaugagucagugccaug

SEQ ID NO: 1620417 - RNA, 22 nt, Homo sapiens
agaugauacauccaaagcagac

SEQ ID NO: 1620418 - RNA, 21 nt, Homo sapiens
acugacaacauuauaacugua

SEQ ID NO: 1620419 - RNA, 12 nt, Homo sapiens
acugaggcaucc

SEQ ID NO: 1620420 - RNA, 19 nt, Homo sapiens
acugagguugggguguacu

SEQ ID NO: 1620421 - RNA, 12 nt, Homo sapiens
acugcaagcucc

SEQ ID NO: 1620422 - RNA, 16 nt, Homo sapiens
acugcagcaccuccag

SEQ ID NO: 1620423 - RNA, 18 nt, Homo sapiens
acugcauuaucuugcuca

SEQ ID NO: 1620424 - RNA, 16 nt, Homo sapiens
acugccacagaacugg

SEQ ID NO: 1620425 - RNA, 15 nt, Homo sapiens
acugcccauggacag

SEQ ID NO: 1620426 - RNA, 19 nt, Homo sapiens
acugcccauggacaggcug

SEQ ID NO: 1620427 - RNA, 21 nt, Homo sapiens
acugcuauucuagagcuuuua

SEQ ID NO: 1620428 - RNA, 18 nt, Homo sapiens
acugcucuguguuuacag

SEQ ID NO: 1620429 - RNA, 21 nt, Homo sapiens
acugcugcgucauuacagggc

SEQ ID NO: 1620430 - RNA, 20 nt, Homo sapiens
acugcugggggugagcugua

SEQ ID NO: 1620431 - RNA, 17 nt, Homo sapiens
acuggagcucaucugca

SEQ ID NO: 1620432 - RNA, 22 nt, Homo sapiens
acuggcaaacauuuuuccagua

SEQ ID NO: 1620433 - RNA, 22 nt, Homo sapiens
acuggcagggacgaggacaaau

SEQ ID NO: 1620434 - RNA, 17 nt, Homo sapiens
acugguuccuuccuuag

SEQ ID NO: 1620435 - RNA, 20 nt, Homo sapiens
acuguaaugagucagugaag

SEQ ID NO: 1620436 - RNA, 14 nt, Homo sapiens
acugucaguucucu

SEQ ID NO: 1620437 - RNA, 23 nt, Homo sapiens
acugugccaccgccuucccugac

SEQ ID NO: 1620438 - RNA, 17 nt, Homo sapiens
acugugugagauuguga

SEQ ID NO: 1620439 - RNA, 17 nt, Homo sapiens
acuguguugacuuugcu

SEQ ID NO: 1620440 - RNA, 21 nt, Homo sapiens
acuguuaagaauagaaaacug

SEQ ID NO: 1620441 - RNA, 16 nt, Homo sapiens
acuguuccagauuccu

SEQ ID NO: 1620442 - RNA, 21 nt, Homo sapiens
acuguucucaacauacuguaa

SEQ ID NO: 1620443 - RNA, 23 nt, Homo sapiens
acuuaaauauuguaauaugacag

SEQ ID NO: 1620444 - RNA, 18 nt, Homo sapiens
acuuaacuauuaaggccu

SEQ ID NO: 1620445 - RNA, 17 nt, Homo sapiens
acuuaauacaugcaaca

SEQ ID NO: 1620446 - RNA, 18 nt, Homo sapiens
acuuaauguucuuaugca

SEQ ID NO: 1620447 - RNA, 16 nt, Homo sapiens
acuuacuuaguguuau

SEQ ID NO: 1620448 - RNA, 16 nt, Homo sapiens
acuucaaacugagauc

SEQ ID NO: 1620449 - RNA, 23 nt, Homo sapiens
acuucaagaacccugacuccucu

SEQ ID NO: 1620450 - RNA, 13 nt, Homo sapiens
acuucacuuauua

SEQ ID NO: 1620451 - RNA, 20 nt, Homo sapiens
acuucacuuauuagucuuag

SEQ ID NO: 1620452 - RNA, 15 nt, Homo sapiens
acuuccuugcuuaag

SEQ ID NO: 1620453 - RNA, 18 nt, Homo sapiens
acuucucaggacacaggc

SEQ ID NO: 1620454 - RNA, 16 nt, Homo sapiens
acuucugcaaccccag

SEQ ID NO: 1620455 - RNA, 17 nt, Homo sapiens
acuucugcaaccccagg

SEQ ID NO: 1620456 - RNA, 11 nt, Homo sapiens
acuucuuguca

SEQ ID NO: 1620457 - RNA, 21 nt, Homo sapiens
acuugacauguagcuucuucu

SEQ ID NO: 1620458 - RNA, 18 nt, Homo sapiens
acuugaggaucauaugaa

SEQ ID NO: 1620459 - RNA, 17 nt, Homo sapiens
acuugcugauccaugag

SEQ ID NO: 1620460 - RNA, 14 nt, Homo sapiens
acuuggcacuccug

SEQ ID NO: 1620461 - RNA, 23 nt, Homo sapiens
acuuucaggggcugacucuccag

SEQ ID NO: 1620462 - RNA, 17 nt, Homo sapiens
acuuucccacccaggaa

SEQ ID NO: 1620463 - RNA, 12 nt, Homo sapiens
acuuugaacuaa

SEQ ID NO: 1620464 - RNA, 12 nt, Homo sapiens
acuuugugacug

SEQ ID NO: 1620465 - RNA, 18 nt, Homo sapiens
acuuuuaucuacuucucu

SEQ ID NO: 1620466 - RNA, 13 nt, Homo sapiens
acagcuuucacag

SEQ ID NO: 1620467 - RNA, 13 nt, Homo sapiens
acaggaaauugac

SEQ ID NO: 1620468 - RNA, 16 nt, Homo sapiens
acaggaaauugacuua

SEQ ID NO: 1620469 - RNA, 23 nt, Homo sapiens
acaggcugauaccuuugugaagu

SEQ ID NO: 1620470 - RNA, 17 nt, Homo sapiens
acagggcacaggccaug

SEQ ID NO: 1620471 - RNA, 17 nt, Homo sapiens
acagggucauguuugca

SEQ ID NO: 1620472 - RNA, 16 nt, Homo sapiens
acaggguccucagcuc

SEQ ID NO: 1620473 - RNA, 15 nt, Homo sapiens
acaggucaaccaugg

SEQ ID NO: 1620474 - RNA, 17 nt, Homo sapiens
acagguucuuaaaaagg

SEQ ID NO: 1620475 - RNA, 19 nt, Homo sapiens
acaguaaugaaauguuuac

SEQ ID NO: 1620476 - RNA, 15 nt, Homo sapiens
acaguagaacugucu

SEQ ID NO: 1620477 - RNA, 16 nt, Homo sapiens
acagucaccucacaaa

SEQ ID NO: 1620478 - RNA, 19 nt, Homo sapiens
acagucacuaauauaguag

SEQ ID NO: 1620479 - RNA, 19 nt, Homo sapiens
acaguccaaacuguucuga

SEQ ID NO: 1620480 - RNA, 21 nt, Homo sapiens
acaguccuguccucuggauca

SEQ ID NO: 1620481 - RNA, 15 nt, Homo sapiens
acagugccaacuccu

SEQ ID NO: 1620482 - RNA, 14 nt, Homo sapiens
acagugcccagggc

SEQ ID NO: 1620483 - RNA, 20 nt, Homo sapiens
acagugccgacagcucucca

SEQ ID NO: 1620484 - RNA, 19 nt, Homo sapiens
acaguggcaggacaggaaa

SEQ ID NO: 1620485 - RNA, 15 nt, Homo sapiens
acaguguuuggacag

SEQ ID NO: 1620486 - RNA, 22 nt, Homo sapiens
acaguugugauaauagcauuuu

SEQ ID NO: 1620487 - RNA, 16 nt, Homo sapiens
acaguuuuauacccuu

SEQ ID NO: 1620488 - RNA, 12 nt, Homo sapiens
acauaaagccau

SEQ ID NO: 1620489 - RNA, 20 nt, Homo sapiens
acauaaaggcuaacuaugag

SEQ ID NO: 1620490 - RNA, 16 nt, Homo sapiens
acauaaccaauuugua

SEQ ID NO: 1620491 - RNA, 15 nt, Homo sapiens
acauaaucuguacaa

SEQ ID NO: 1620492 - RNA, 16 nt, Homo sapiens
acauacauuucucaua

SEQ ID NO: 1620493 - RNA, 23 nt, Homo sapiens
acauagaaauggaaauuuugcua

SEQ ID NO: 1620494 - RNA, 14 nt, Homo sapiens
acauagcugugcua

SEQ ID NO: 1620495 - RNA, 19 nt, Homo sapiens
acauagucuuuguuuacau

SEQ ID NO: 1620496 - RNA, 14 nt, Homo sapiens
acauauauuuugca

SEQ ID NO: 1620497 - RNA, 16 nt, Homo sapiens
acauauggacucugca

SEQ ID NO: 1620498 - RNA, 23 nt, Homo sapiens
acauauuuuaaccuuuugcuccu

SEQ ID NO: 1620499 - RNA, 16 nt, Homo sapiens
acaucaguauaguguu

SEQ ID NO: 1620500 - RNA, 15 nt, Homo sapiens
acauccauguuccga

SEQ ID NO: 1620501 - RNA, 20 nt, Homo sapiens
acaucccuauagaccacugg

SEQ ID NO: 1620502 - RNA, 18 nt, Homo sapiens
acaucuguaauccuagcu

SEQ ID NO: 1620503 - RNA, 22 nt, Homo sapiens
acaugaagcuguugugugaggu

SEQ ID NO: 1620504 - RNA, 23 nt, Homo sapiens
acaugaaucccacccacauguga

SEQ ID NO: 1620505 - RNA, 21 nt, Homo sapiens
acaugacauucuuagcuguaa

SEQ ID NO: 1620506 - RNA, 16 nt, Homo sapiens
acaugaggccaucuca

SEQ ID NO: 1620507 - RNA, 13 nt, Homo sapiens
acaugauugccaa

SEQ ID NO: 1620508 - RNA, 19 nt, Homo sapiens
acaugcccaaaacuuaucc

SEQ ID NO: 1620509 - RNA, 17 nt, Homo sapiens
acauggccuaugcacau

SEQ ID NO: 1620510 - RNA, 21 nt, Homo sapiens
acauguaaaauaugucuuucu

SEQ ID NO: 1620511 - RNA, 15 nt, Homo sapiens
acauguaauuugaug

SEQ ID NO: 1620512 - RNA, 22 nt, Homo sapiens
acauguagguaggaagcacuga

SEQ ID NO: 1620513 - RNA, 15 nt, Homo sapiens
acauguccuauuacu

SEQ ID NO: 1620514 - RNA, 17 nt, Homo sapiens
acaugugacacauaugc

SEQ ID NO: 1620515 - RNA, 13 nt, Homo sapiens
acauguguauauu

SEQ ID NO: 1620516 - RNA, 21 nt, Homo sapiens
acauguuaguuuuucuuacuu

SEQ ID NO: 1620517 - RNA, 21 nt, Homo sapiens
acauguuccuuauauuuacuc

SEQ ID NO: 1620518 - RNA, 22 nt, Homo sapiens
agccagcacucacaccacuaac

SEQ ID NO: 1620519 - RNA, 16 nt, Homo sapiens
agccagccacacuuga

SEQ ID NO: 1620520 - RNA, 16 nt, Homo sapiens
agccaggagcagcccu

SEQ ID NO: 1620521 - RNA, 16 nt, Homo sapiens
agccaggccccacccc

SEQ ID NO: 1620522 - RNA, 12 nt, Homo sapiens
agccaggucucc

SEQ ID NO: 1620523 - RNA, 19 nt, Homo sapiens
agccagugcugucugggau

SEQ ID NO: 1620524 - RNA, 13 nt, Homo sapiens
agccauaaauugc

SEQ ID NO: 1620525 - RNA, 16 nt, Homo sapiens
agcccacuguuaauau

SEQ ID NO: 1620526 - RNA, 14 nt, Homo sapiens
agcccaggaucucu

SEQ ID NO: 1620527 - RNA, 15 nt, Homo sapiens
agcccaggaucucuu

SEQ ID NO: 1620528 - RNA, 18 nt, Homo sapiens
agcccccacccaguuccu

SEQ ID NO: 1620529 - RNA, 17 nt, Homo sapiens
agcccccuccuggugcc

SEQ ID NO: 1620530 - RNA, 17 nt, Homo sapiens
agccccuucugcucagc

SEQ ID NO: 1620531 - RNA, 20 nt, Homo sapiens
agcccgacagugccaucccc

SEQ ID NO: 1620532 - RNA, 20 nt, Homo sapiens
agcccucagacugucaggca

SEQ ID NO: 1620533 - RNA, 22 nt, Homo sapiens
agcccucagcugguccugacca

SEQ ID NO: 1620534 - RNA, 20 nt, Homo sapiens
agcccucgccucugcgagaa

SEQ ID NO: 1620535 - RNA, 12 nt, Homo sapiens
agcccugcccac

SEQ ID NO: 1620536 - RNA, 19 nt, Homo sapiens
agcccuggcccccugaguu

SEQ ID NO: 1620537 - RNA, 21 nt, Homo sapiens
agcccugggaaccacucccac

SEQ ID NO: 1620538 - RNA, 21 nt, Homo sapiens
agccuaauaacgugaaacuua

SEQ ID NO: 1620539 - RNA, 16 nt, Homo sapiens
agccuacgcugaagau

SEQ ID NO: 1620540 - RNA, 14 nt, Homo sapiens
agccucacuuccuu

SEQ ID NO: 1620541 - RNA, 23 nt, Homo sapiens
agccucgcgggugucacauuccu

SEQ ID NO: 1620542 - RNA, 17 nt, Homo sapiens
agccucucaaguaauau

SEQ ID NO: 1620543 - RNA, 14 nt, Homo sapiens
agccucuccuccau

SEQ ID NO: 1620544 - RNA, 13 nt, Homo sapiens
agccugcaacuca

SEQ ID NO: 1620545 - RNA, 18 nt, Homo sapiens
agccugcagaauccagcu

SEQ ID NO: 1620546 - RNA, 21 nt, Homo sapiens
agccuggcugcccaucaugug

SEQ ID NO: 1620547 - RNA, 16 nt, Homo sapiens
agccugggccuaugga

SEQ ID NO: 1620548 - RNA, 16 nt, Homo sapiens
agccuguggccuuugc

SEQ ID NO: 1620549 - RNA, 23 nt, Homo sapiens
agccugugucuuuaaaugcugcu

SEQ ID NO: 1620550 - RNA, 19 nt, Homo sapiens
agccuugaugccauaugcc

SEQ ID NO: 1620551 - RNA, 17 nt, Homo sapiens
agccuuuccuguagccu

SEQ ID NO: 1620552 - RNA, 18 nt, Homo sapiens
agcgccaggcugaccaca

SEQ ID NO: 1620553 - RNA, 18 nt, Homo sapiens
agcgcccuuccucuccac

SEQ ID NO: 1620554 - RNA, 22 nt, Homo sapiens
agcggaaagcccugugcuccau

SEQ ID NO: 1620555 - RNA, 15 nt, Homo sapiens
agcggacaguggcag

SEQ ID NO: 1620556 - RNA, 17 nt, Homo sapiens
agcgggcggaggggauc

SEQ ID NO: 1620557 - RNA, 18 nt, Homo sapiens
agcgucacggccaagugu

SEQ ID NO: 1620558 - RNA, 16 nt, Homo sapiens
agcgugggcucagcag

SEQ ID NO: 1620559 - RNA, 21 nt, Homo sapiens
agcuaaaaaauuguuaaacuu

SEQ ID NO: 1620560 - RNA, 21 nt, Homo sapiens
agcuaagggugggugcucaga

SEQ ID NO: 1620561 - RNA, 16 nt, Homo sapiens
aaaaaggaaaacagac

SEQ ID NO: 1620562 - RNA, 17 nt, Homo sapiens
aaaaaggugccaucuca

SEQ ID NO: 1620563 - RNA, 13 nt, Homo sapiens
aaaaauauuccaa

SEQ ID NO: 1620564 - RNA, 20 nt, Homo sapiens
aaaaauauuguuucugcauu

SEQ ID NO: 1620565 - RNA, 18 nt, Homo sapiens
aaaaaugucucaugucaa

SEQ ID NO: 1620566 - RNA, 10 nt, Homo sapiens
aaaacaaaga

SEQ ID NO: 1620567 - RNA, 20 nt, Homo sapiens
aaaacagcccucagacuguc

SEQ ID NO: 1620568 - RNA, 15 nt, Homo sapiens
aaaacugaaccacaa

SEQ ID NO: 1620569 - RNA, 22 nt, Homo sapiens
aaaacuggguaugcguuucaug

SEQ ID NO: 1620570 - RNA, 14 nt, Homo sapiens
aaaacuucuuguca

SEQ ID NO: 1620571 - RNA, 16 nt, Homo sapiens
aaaacuugacauguag

SEQ ID NO: 1620572 - RNA, 12 nt, Homo sapiens
aaaagaaaucca

SEQ ID NO: 1620573 - RNA, 14 nt, Homo sapiens
aaaagaaggucaaa

SEQ ID NO: 1620574 - RNA, 14 nt, Homo sapiens
aaaagcacaaucac

SEQ ID NO: 1620575 - RNA, 23 nt, Homo sapiens
aaaagcauuauccuuuuaucuca

SEQ ID NO: 1620576 - RNA, 20 nt, Homo sapiens
aaaaggucuguuaaugucau

SEQ ID NO: 1620577 - RNA, 16 nt, Homo sapiens
aaaaggugccaucuca

SEQ ID NO: 1620578 - RNA, 14 nt, Homo sapiens
aaaaguaaugacuu

SEQ ID NO: 1620579 - RNA, 14 nt, Homo sapiens
aaaauaaacaugua

SEQ ID NO: 1620580 - RNA, 17 nt, Homo sapiens
aaaauaaagcaaugugu

SEQ ID NO: 1620581 - RNA, 16 nt, Homo sapiens
aaaaucccuccaccuu

SEQ ID NO: 1620582 - RNA, 21 nt, Homo sapiens
aaaaucugcauguuugauuau

SEQ ID NO: 1620583 - RNA, 23 nt, Homo sapiens
aaaaugaaaauucuaacccaaga

SEQ ID NO: 1620584 - RNA, 13 nt, Homo sapiens
aaaaugauccuca

SEQ ID NO: 1620585 - RNA, 22 nt, Homo sapiens
aaaaugccagucucauugucac

SEQ ID NO: 1620586 - RNA, 22 nt, Homo sapiens
aaaauuagaaucugaguauaaa

SEQ ID NO: 1620587 - RNA, 13 nt, Homo sapiens
aaaauuagcaugg

SEQ ID NO: 1620588 - RNA, 21 nt, Homo sapiens
aaaauuuuuuuuguaacugga

SEQ ID NO: 1620589 - RNA, 16 nt, Homo sapiens
aaacaaaaaugauccu

SEQ ID NO: 1620590 - RNA, 23 nt, Homo sapiens
aaacaaguauauaauuuacuuug

SEQ ID NO: 1620591 - RNA, 17 nt, Homo sapiens
aaacaagucaauucugu

SEQ ID NO: 1620592 - RNA, 19 nt, Homo sapiens
aaacaauaucagacuuuuu

SEQ ID NO: 1620593 - RNA, 19 nt, Homo sapiens
aaacaauucuuauugacuc

SEQ ID NO: 1620594 - RNA, 14 nt, Homo sapiens
aaacagaagccuga

SEQ ID NO: 1620595 - RNA, 19 nt, Homo sapiens
aaacagauguuuguuuuca

SEQ ID NO: 1620596 - RNA, 20 nt, Homo sapiens
aaacaggcugauaccuuugu

SEQ ID NO: 1620597 - RNA, 22 nt, Homo sapiens
aaacagggcugccuucuggccu

SEQ ID NO: 1620598 - RNA, 16 nt, Homo sapiens
aaacaggguaccucaa

SEQ ID NO: 1620599 - RNA, 13 nt, Homo sapiens
aaacauauacaaa

SEQ ID NO: 1620600 - RNA, 19 nt, Homo sapiens
aaacauucagucugacaaa

SEQ ID NO: 1620601 - RNA, 17 nt, Homo sapiens
aaacauuuuaucauuaa

SEQ ID NO: 1620602 - RNA, 16 nt, Homo sapiens
aaaccagggaugucug

SEQ ID NO: 1620603 - RNA, 14 nt, Homo sapiens
aaaccauucuuucc

SEQ ID NO: 1620604 - RNA, 19 nt, Homo sapiens
aaacccauucccucuccag

SEQ ID NO: 1620605 - RNA, 18 nt, Homo sapiens
aaacccccacuccagcuc

SEQ ID NO: 1620606 - RNA, 17 nt, Homo sapiens
aaaccucuacauauuua

SEQ ID NO: 1620607 - RNA, 9 nt, Homo sapiens
aaaccuggg

SEQ ID NO: 1620608 - RNA, 15 nt, Homo sapiens
aaacggauaccaagu

SEQ ID NO: 1620609 - RNA, 12 nt, Homo sapiens
aaacuaaacaga

SEQ ID NO: 1620610 - RNA, 24 nt, Homo sapiens
aaacuaacacagccaucaagggaa

SEQ ID NO: 1620611 - RNA, 23 nt, Homo sapiens
aaacuagguaaaaucuacaguac

SEQ ID NO: 1620612 - RNA, 19 nt, Homo sapiens
aaacucacaagugcucauc

SEQ ID NO: 1620613 - RNA, 18 nt, Homo sapiens
aaacugaccaaacgcuua

SEQ ID NO: 1620614 - RNA, 13 nt, Homo sapiens
aaacugauuuauc

SEQ ID NO: 1620615 - RNA, 20 nt, Homo sapiens
aaacugcaaagcucggugcu

SEQ ID NO: 1620616 - RNA, 14 nt, Homo sapiens
aaacuguguugcca

SEQ ID NO: 1620617 - RNA, 23 nt, Homo sapiens
aaacuguucuuuugcauuuugcc

SEQ ID NO: 1620618 - RNA, 13 nt, Homo sapiens
aaacuuaaaucuc

SEQ ID NO: 1620619 - RNA, 20 nt, Homo sapiens
aaacuucuugucagacauaa

SEQ ID NO: 1620620 - RNA, 22 nt, Homo sapiens
aaacuuuauuuguaaaccauug

SEQ ID NO: 1620621 - RNA, 23 nt, Homo sapiens
aaacuuucuccauuuaagacaca

SEQ ID NO: 1620622 - RNA, 16 nt, Homo sapiens
aaagaaacaccacuua

SEQ ID NO: 1620623 - RNA, 16 nt, Homo sapiens
aaagaaauuccccaag

SEQ ID NO: 1620624 - RNA, 21 nt, Homo sapiens
aaagacaaauucggauguaug

SEQ ID NO: 1620625 - RNA, 17 nt, Homo sapiens
aaagacauccauaaaga

SEQ ID NO: 1620626 - RNA, 18 nt, Homo sapiens
aaagacuugugcaucccu

SEQ ID NO: 1620627 - RNA, 16 nt, Homo sapiens
aaagacuuuguuaaau

SEQ ID NO: 1620628 - RNA, 20 nt, Homo sapiens
aaagagagaccccagucaag

SEQ ID NO: 1620629 - RNA, 21 nt, Homo sapiens
aaagaggcugaggcuggcaca

SEQ ID NO: 1620630 - RNA, 16 nt, Homo sapiens
aaagagggacaggcug

SEQ ID NO: 1620631 - RNA, 23 nt, Homo sapiens
aaagaucauuuauaauacuguuu

SEQ ID NO: 1620632 - RNA, 16 nt, Homo sapiens
aaagauccuauagcuc

SEQ ID NO: 1620633 - RNA, 16 nt, Homo sapiens
aaagcagccacgaggu

SEQ ID NO: 1620634 - RNA, 16 nt, Homo sapiens
aaagcaggacugugcc

SEQ ID NO: 1620635 - RNA, 16 nt, Homo sapiens
aaagcauuugcaauca

SEQ ID NO: 1620636 - RNA, 12 nt, Homo sapiens
aaagccacuucu

SEQ ID NO: 1620637 - RNA, 17 nt, Homo sapiens
aaagcccugugcuccau

SEQ ID NO: 1620638 - RNA, 19 nt, Homo sapiens
aaagccucuuuuaguccau

SEQ ID NO: 1620639 - RNA, 23 nt, Homo sapiens
aaagccuucccuugcccauguga

SEQ ID NO: 1620640 - RNA, 15 nt, Homo sapiens
aaagcuaaauuccac

SEQ ID NO: 1620641 - RNA, 17 nt, Homo sapiens
aaagcucaaaguaugca

SEQ ID NO: 1620642 - RNA, 20 nt, Homo sapiens
aaagcuuaaugauucugaua

SEQ ID NO: 1620643 - RNA, 15 nt, Homo sapiens
aaaggaaacugcuau

SEQ ID NO: 1620644 - RNA, 16 nt, Homo sapiens
aaaggagccuaggcca

SEQ ID NO: 1620645 - RNA, 15 nt, Homo sapiens
aaaggagccugugaa

SEQ ID NO: 1620646 - RNA, 16 nt, Homo sapiens
aaaggagccugugaac

SEQ ID NO: 1620647 - RNA, 21 nt, Homo sapiens
aaaggaucucugagaccacag

SEQ ID NO: 1620648 - RNA, 13 nt, Homo sapiens
aaagggaaguagu

SEQ ID NO: 1620649 - RNA, 19 nt, Homo sapiens
aaagggaaguaguccuugg

SEQ ID NO: 1620650 - RNA, 19 nt, Homo sapiens
aaagggacccaccugcuag

SEQ ID NO: 1620651 - RNA, 16 nt, Homo sapiens
aaagggccauguuuca

SEQ ID NO: 1620652 - RNA, 14 nt, Homo sapiens
aaaggucuguuaau

SEQ ID NO: 1620653 - RNA, 16 nt, Homo sapiens
aaaggugacaguauua

SEQ ID NO: 1620654 - RNA, 19 nt, Homo sapiens
aaaguacacuaaguuugca

SEQ ID NO: 1620655 - RNA, 14 nt, Homo sapiens
aaaguaguauugca

SEQ ID NO: 1620656 - RNA, 12 nt, Homo sapiens
aaagucacuuac

SEQ ID NO: 1620657 - RNA, 18 nt, Homo sapiens
aaaguccccagagaaagc

SEQ ID NO: 1620658 - RNA, 16 nt, Homo sapiens
aaagugguaauccucu

SEQ ID NO: 1620659 - RNA, 17 nt, Homo sapiens
aaaguuauauucacagu

SEQ ID NO: 1620660 - RNA, 21 nt, Homo sapiens
aaaguuuaggcaugcucagaa

SEQ ID NO: 1620661 - RNA, 19 nt, Homo sapiens
aaauaaaaaacauauacaa

SEQ ID NO: 1620662 - RNA, 16 nt, Homo sapiens
aaauaaauaagaucag

SEQ ID NO: 1620663 - RNA, 12 nt, Homo sapiens
aaauaaauuucc

SEQ ID NO: 1620664 - RNA, 22 nt, Homo sapiens
aaauacacagugcugaccagac

SEQ ID NO: 1620665 - RNA, 23 nt, Homo sapiens
aaauacacagugcugaccagaca

SEQ ID NO: 1620666 - RNA, 17 nt, Homo sapiens
aaauacacuugugauua

SEQ ID NO: 1620667 - RNA, 20 nt, Homo sapiens
aaauacauguguauauuccu

SEQ ID NO: 1620668 - RNA, 16 nt, Homo sapiens
aaauagaauuugagca

SEQ ID NO: 1620669 - RNA, 17 nt, Homo sapiens
aaauaguugucugugcu

SEQ ID NO: 1620670 - RNA, 23 nt, Homo sapiens
aaauaguugucugugcuuccuug

SEQ ID NO: 1620671 - RNA, 14 nt, Homo sapiens
acagguccccagau

SEQ ID NO: 1620672 - RNA, 18 nt, Homo sapiens
acaguacagcaugugccu

SEQ ID NO: 1620673 - RNA, 22 nt, Homo sapiens
acaguagagcaaaucuaugaga

SEQ ID NO: 1620674 - RNA, 14 nt, Homo sapiens
acagucaccucaca

SEQ ID NO: 1620675 - RNA, 18 nt, Homo sapiens
acaguccuguccucugga

SEQ ID NO: 1620676 - RNA, 19 nt, Homo sapiens
acaguccuguccucuggau

SEQ ID NO: 1620677 - RNA, 22 nt, Homo sapiens
acagucuuguauuaaguuguua

SEQ ID NO: 1620678 - RNA, 21 nt, Homo sapiens
acagugccauccccaccuuca

SEQ ID NO: 1620679 - RNA, 19 nt, Homo sapiens
acagugccgacagcucucc

SEQ ID NO: 1620680 - RNA, 22 nt, Homo sapiens
acaguggcaggacaggaaaaac

SEQ ID NO: 1620681 - RNA, 14 nt, Homo sapiens
acagugugggaggc

SEQ ID NO: 1620682 - RNA, 18 nt, Homo sapiens
acaguugguucaucccuu

SEQ ID NO: 1620683 - RNA, 21 nt, Homo sapiens
acaguuuccaaauugcccuau

SEQ ID NO: 1620684 - RNA, 22 nt, Homo sapiens
acauaaaauuuaaaaacuuaaa

SEQ ID NO: 1620685 - RNA, 13 nt, Homo sapiens
acauaacuuccua

SEQ ID NO: 1620686 - RNA, 14 nt, Homo sapiens
acauacuguucuca

SEQ ID NO: 1620687 - RNA, 19 nt, Homo sapiens
acauagccugcaaagcugg

SEQ ID NO: 1620688 - RNA, 18 nt, Homo sapiens
acauauaaagcacuauac

SEQ ID NO: 1620689 - RNA, 22 nt, Homo sapiens
acauauaacgcagucuaauuac

SEQ ID NO: 1620690 - RNA, 17 nt, Homo sapiens
acauauggacucugcac

SEQ ID NO: 1620691 - RNA, 15 nt, Homo sapiens
acaucaggaguucaa

SEQ ID NO: 1620692 - RNA, 20 nt, Homo sapiens
acauccaaagcagacagcuc

SEQ ID NO: 1620693 - RNA, 21 nt, Homo sapiens
acauccaggaaggaccuugcu

SEQ ID NO: 1620694 - RNA, 18 nt, Homo sapiens
acauccaggcaauggccu

SEQ ID NO: 1620695 - RNA, 19 nt, Homo sapiens
acauccaggcaauggccua

SEQ ID NO: 1620696 - RNA, 18 nt, Homo sapiens
acaucugagagaugacag

SEQ ID NO: 1620697 - RNA, 18 nt, Homo sapiens
acaugaaucccacccaca

SEQ ID NO: 1620698 - RNA, 20 nt, Homo sapiens
acaugacauucuuagcugua

SEQ ID NO: 1620699 - RNA, 18 nt, Homo sapiens
acaugcaccuugcuccca

SEQ ID NO: 1620700 - RNA, 17 nt, Homo sapiens
acaugcgguagccagca

SEQ ID NO: 1620701 - RNA, 22 nt, Homo sapiens
acaugcuagugauaucuagaaa

SEQ ID NO: 1620702 - RNA, 18 nt, Homo sapiens
acaugcuauguucugucu

SEQ ID NO: 1620703 - RNA, 23 nt, Homo sapiens
acaugcuauguucugucuuccca

SEQ ID NO: 1620704 - RNA, 16 nt, Homo sapiens
acauggccuaugcaca

SEQ ID NO: 1620705 - RNA, 21 nt, Homo sapiens
acauggccuaugcacauaugg

SEQ ID NO: 1620706 - RNA, 18 nt, Homo sapiens
acauggcuguguuugcag

SEQ ID NO: 1620707 - RNA, 14 nt, Homo sapiens
acauuaacggugcu

SEQ ID NO: 1620708 - RNA, 16 nt, Homo sapiens
acauuaguauagucuc

SEQ ID NO: 1620709 - RNA, 21 nt, Homo sapiens
acauuauguggcccucuggau

SEQ ID NO: 1620710 - RNA, 15 nt, Homo sapiens
acauucaauagcaua

SEQ ID NO: 1620711 - RNA, 18 nt, Homo sapiens
acauucaauagcauauca

SEQ ID NO: 1620712 - RNA, 15 nt, Homo sapiens
acauucagaaguaau

SEQ ID NO: 1620713 - RNA, 18 nt, Homo sapiens
acauuccaguagccagua

SEQ ID NO: 1620714 - RNA, 23 nt, Homo sapiens
acauucuguuuaucaagccauaa

SEQ ID NO: 1620715 - RNA, 21 nt, Homo sapiens
acauucuuagcuguaacuuaa

SEQ ID NO: 1620716 - RNA, 15 nt, Homo sapiens
acauuuaaauuccac

SEQ ID NO: 1620717 - RNA, 17 nt, Homo sapiens
acauuuaaauuccacag

SEQ ID NO: 1620718 - RNA, 23 nt, Homo sapiens
acauuuacuuuaauuuccuugac

SEQ ID NO: 1620719 - RNA, 18 nt, Homo sapiens
acauuugacuucuagaaa

SEQ ID NO: 1620720 - RNA, 21 nt, Homo sapiens
acauuuuuucagucauauaaa

SEQ ID NO: 1620721 - RNA, 13 nt, Homo sapiens
accaaaaccacag

SEQ ID NO: 1620722 - RNA, 19 nt, Homo sapiens
accaaacaucccccaauga

SEQ ID NO: 1620723 - RNA, 14 nt, Homo sapiens
accaagcacagcag

SEQ ID NO: 1620724 - RNA, 16 nt, Homo sapiens
accaauauuaccaucu

SEQ ID NO: 1620725 - RNA, 19 nt, Homo sapiens
accaauguacccaccgggc

SEQ ID NO: 1620726 - RNA, 18 nt, Homo sapiens
accacaaaaaccaaacau

SEQ ID NO: 1620727 - RNA, 14 nt, Homo sapiens
accacaaacaauuc

SEQ ID NO: 1620728 - RNA, 18 nt, Homo sapiens
accacaaggcuguugcau

SEQ ID NO: 1620729 - RNA, 12 nt, Homo sapiens
accacuugacag

SEQ ID NO: 1620730 - RNA, 16 nt, Homo sapiens
accagacacguacaaa

SEQ ID NO: 1620731 - RNA, 18 nt, Homo sapiens
accagcccugaccccagu

SEQ ID NO: 1620732 - RNA, 19 nt, Homo sapiens
accagcucugaacuuccaa

SEQ ID NO: 1620733 - RNA, 16 nt, Homo sapiens
accaggacuagggcug

SEQ ID NO: 1620734 - RNA, 14 nt, Homo sapiens
accaggauggagca

SEQ ID NO: 1620735 - RNA, 16 nt, Homo sapiens
accagggcucuucuca

SEQ ID NO: 1620736 - RNA, 19 nt, Homo sapiens
accagguaguuuguugcau

SEQ ID NO: 1620737 - RNA, 18 nt, Homo sapiens
accauccugccauccuug

SEQ ID NO: 1620738 - RNA, 22 nt, Homo sapiens
accauggccaccccagagccau

SEQ ID NO: 1620739 - RNA, 15 nt, Homo sapiens
acccaacacauggga

SEQ ID NO: 1620740 - RNA, 16 nt, Homo sapiens
acccaagggcaggggc

SEQ ID NO: 1620741 - RNA, 12 nt, Homo sapiens
acccaaucugcc

SEQ ID NO: 1620742 - RNA, 13 nt, Homo sapiens
acccaaucugccu

SEQ ID NO: 1620743 - RNA, 23 nt, Homo sapiens
acccacaugugacacauaugcac

SEQ ID NO: 1620744 - RNA, 18 nt, Homo sapiens
acccacccaaaagucacc

SEQ ID NO: 1620745 - RNA, 22 nt, Homo sapiens
acccaccucggccucccaaaau

SEQ ID NO: 1620746 - RNA, 23 nt, Homo sapiens
acccagaugcaagacacugugcc

SEQ ID NO: 1620747 - RNA, 15 nt, Homo sapiens
acccagggacacucc

SEQ ID NO: 1620748 - RNA, 21 nt, Homo sapiens
acccagguauuacacaagcca

SEQ ID NO: 1620749 - RNA, 18 nt, Homo sapiens
accccaucaccuacucac

SEQ ID NO: 1620750 - RNA, 17 nt, Homo sapiens
accccucacugugacug

SEQ ID NO: 1620751 - RNA, 18 nt, Homo sapiens
accccucacugugacuga

SEQ ID NO: 1620752 - RNA, 20 nt, Homo sapiens
acccuauuuagaaauggauu

SEQ ID NO: 1620753 - RNA, 17 nt, Homo sapiens
acccucaggaauucagu

SEQ ID NO: 1620754 - RNA, 14 nt, Homo sapiens
acccucauacacag

SEQ ID NO: 1620755 - RNA, 16 nt, Homo sapiens
acccuccccuagucac

SEQ ID NO: 1620756 - RNA, 19 nt, Homo sapiens
acccuccccuagucacuca

SEQ ID NO: 1620757 - RNA, 21 nt, Homo sapiens
acccucgggccccauccucau

SEQ ID NO: 1620758 - RNA, 23 nt, Homo sapiens
acccugacuccucuuugugcaga

SEQ ID NO: 1620759 - RNA, 18 nt, Homo sapiens
acccugagagucugagaa

SEQ ID NO: 1620760 - RNA, 20 nt, Homo sapiens
acccuggaucaguccuuuga

SEQ ID NO: 1620761 - RNA, 16 nt, Homo sapiens
acccugggauucagga

SEQ ID NO: 1620762 - RNA, 19 nt, Homo sapiens
acccugggcuuccugagcc

SEQ ID NO: 1620763 - RNA, 22 nt, Homo sapiens
acccuuuugugucuaugauguu

SEQ ID NO: 1620764 - RNA, 15 nt, Homo sapiens
accgacucaccugcg

SEQ ID NO: 1620765 - RNA, 18 nt, Homo sapiens
accgccacgucccagcau

SEQ ID NO: 1620766 - RNA, 20 nt, Homo sapiens
accggaaggaggccaaccag

SEQ ID NO: 1620767 - RNA, 22 nt, Homo sapiens
accggaaggaggccaaccagcc

SEQ ID NO: 1620768 - RNA, 18 nt, Homo sapiens
accgucacacucuucagu

SEQ ID NO: 1620769 - RNA, 14 nt, Homo sapiens
accguucugugcac

SEQ ID NO: 1620770 - RNA, 22 nt, Homo sapiens
accuaaaaauguaggcuuucau

SEQ ID NO: 1620771 - RNA, 17 nt, Homo sapiens
accuaaagcaagccuga

SEQ ID NO: 1620772 - RNA, 15 nt, Homo sapiens
accuacagagcaccu

SEQ ID NO: 1620773 - RNA, 14 nt, Homo sapiens
accuacaguguaca

SEQ ID NO: 1620774 - RNA, 16 nt, Homo sapiens
accuacauauuccaug

SEQ ID NO: 1620775 - RNA, 16 nt, Homo sapiens
accuacucacacaggc

SEQ ID NO: 1620776 - RNA, 16 nt, Homo sapiens
accuagcagccucaaa

SEQ ID NO: 1620777 - RNA, 18 nt, Homo sapiens
accuagcagccucaaaac

SEQ ID NO: 1620778 - RNA, 15 nt, Homo sapiens
accuaucuguggaaa

SEQ ID NO: 1620779 - RNA, 13 nt, Homo sapiens
accucaccaagga

SEQ ID NO: 1620780 - RNA, 19 nt, Homo sapiens
ccaaagcagacagcuccac

SEQ ID NO: 1620781 - RNA, 19 nt, Homo sapiens
ccaaagcccaaagugguau

SEQ ID NO: 1620782 - RNA, 14 nt, Homo sapiens
ccaaaguagggaug

SEQ ID NO: 1620783 - RNA, 17 nt, Homo sapiens
ccaaauuucauuucagc

SEQ ID NO: 1620784 - RNA, 14 nt, Homo sapiens
ccaaauuuggcuaa

SEQ ID NO: 1620785 - RNA, 23 nt, Homo sapiens
ccaacacaugggaccuauaacug

SEQ ID NO: 1620786 - RNA, 11 nt, Homo sapiens
ccaacaucuuu

SEQ ID NO: 1620787 - RNA, 23 nt, Homo sapiens
ccaacuccccuccgucugugaca

SEQ ID NO: 1620788 - RNA, 17 nt, Homo sapiens
ccaagaaaauaucacug

SEQ ID NO: 1620789 - RNA, 18 nt, Homo sapiens
ccaagacaugacauucuu

SEQ ID NO: 1620790 - RNA, 13 nt, Homo sapiens
ccaagaucugcca

SEQ ID NO: 1620791 - RNA, 13 nt, Homo sapiens
ccaagcauuucau

SEQ ID NO: 1620792 - RNA, 16 nt, Homo sapiens
ccaagcuccaaaucca

SEQ ID NO: 1620793 - RNA, 22 nt, Homo sapiens
ccaaggaacucuacuucaguca

SEQ ID NO: 1620794 - RNA, 23 nt, Homo sapiens
ccaaggccucauccuggggagga

SEQ ID NO: 1620795 - RNA, 20 nt, Homo sapiens
ccaagguugucagcuuugga

SEQ ID NO: 1620796 - RNA, 21 nt, Homo sapiens
ccaaucaccuuuccuguucca

SEQ ID NO: 1620797 - RNA, 16 nt, Homo sapiens
ccaauugcucuuucac

SEQ ID NO: 1620798 - RNA, 18 nt, Homo sapiens
ccaauugcucuuucacag

SEQ ID NO: 1620799 - RNA, 14 nt, Homo sapiens
ccacaaaucuucag

SEQ ID NO: 1620800 - RNA, 19 nt, Homo sapiens
ccacaaggcuguugcaugg

SEQ ID NO: 1620801 - RNA, 15 nt, Homo sapiens
ccacacagacuccac

SEQ ID NO: 1620802 - RNA, 14 nt, Homo sapiens
ccacacucagcaca

SEQ ID NO: 1620803 - RNA, 18 nt, Homo sapiens
ccacacuuaaauucucua

SEQ ID NO: 1620804 - RNA, 23 nt, Homo sapiens
ccacagaacacagcaauuccuca

SEQ ID NO: 1620805 - RNA, 10 nt, Homo sapiens
ccacagauua

SEQ ID NO: 1620806 - RNA, 16 nt, Homo sapiens
ccacagcaaccccagg

SEQ ID NO: 1620807 - RNA, 21 nt, Homo sapiens
ccacagcaaccccaggcugaa

SEQ ID NO: 1620808 - RNA, 19 nt, Homo sapiens
ccacagcggauguuguaga

SEQ ID NO: 1620809 - RNA, 17 nt, Homo sapiens
ccacagcuucugcagca

SEQ ID NO: 1620810 - RNA, 23 nt, Homo sapiens
ccacaggccgcccugcgggugaa

SEQ ID NO: 1620811 - RNA, 16 nt, Homo sapiens
ccacaucccaguuucu

SEQ ID NO: 1620812 - RNA, 12 nt, Homo sapiens
ccacaucuccug

SEQ ID NO: 1620813 - RNA, 19 nt, Homo sapiens
ccaccauuccugccuuuaa

SEQ ID NO: 1620814 - RNA, 13 nt, Homo sapiens
ccacccacaugug

SEQ ID NO: 1620815 - RNA, 12 nt, Homo sapiens
ccacccaggaaa

SEQ ID NO: 1620816 - RNA, 15 nt, Homo sapiens
ccaccccuucccuau

SEQ ID NO: 1620817 - RNA, 17 nt, Homo sapiens
ccacccuugucccucag

SEQ ID NO: 1620818 - RNA, 22 nt, Homo sapiens
ccaccucggccucccaaaaugc

SEQ ID NO: 1620819 - RNA, 22 nt, Homo sapiens
ccaccugacacuaaccagaguc

SEQ ID NO: 1620820 - RNA, 20 nt, Homo sapiens
ccaccuugaccguaggggaa

SEQ ID NO: 1620821 - RNA, 12 nt, Homo sapiens
ccacuacugcag

SEQ ID NO: 1620822 - RNA, 17 nt, Homo sapiens
ccacuauuuucaaagaa

SEQ ID NO: 1620823 - RNA, 14 nt, Homo sapiens
ccacucugcucuga

SEQ ID NO: 1620824 - RNA, 15 nt, Homo sapiens
ccacucugcucugau

SEQ ID NO: 1620825 - RNA, 17 nt, Homo sapiens
ccacuguucuguucuca

SEQ ID NO: 1620826 - RNA, 14 nt, Homo sapiens
ccacuuaaucuucu

SEQ ID NO: 1620827 - RNA, 15 nt, Homo sapiens
ccagaaguuccucaa

SEQ ID NO: 1620828 - RNA, 12 nt, Homo sapiens
ccagacccagug

SEQ ID NO: 1620829 - RNA, 23 nt, Homo sapiens
ccagacccaguggacucuuccac

SEQ ID NO: 1620830 - RNA, 22 nt, Homo sapiens
ccagagaaacugccacauacac

SEQ ID NO: 1620831 - RNA, 19 nt, Homo sapiens
ccagagacagaggaugugg

SEQ ID NO: 1620832 - RNA, 14 nt, Homo sapiens
ccagagaugacuau

SEQ ID NO: 1620833 - RNA, 14 nt, Homo sapiens
ccagagcugugcca

SEQ ID NO: 1620834 - RNA, 15 nt, Homo sapiens
ccagagcugugccag

SEQ ID NO: 1620835 - RNA, 16 nt, Homo sapiens
ccagaggcuggaccac

SEQ ID NO: 1620836 - RNA, 23 nt, Homo sapiens
ccagauaaaauguucagugcaau

SEQ ID NO: 1620837 - RNA, 21 nt, Homo sapiens
ccagaugugugcaauguggca

SEQ ID NO: 1620838 - RNA, 14 nt, Homo sapiens
ccagcacacagggc

SEQ ID NO: 1620839 - RNA, 16 nt, Homo sapiens
ccagcacagguauuuc

SEQ ID NO: 1620840 - RNA, 22 nt, Homo sapiens
ccagcaccggccccauuuaccc

SEQ ID NO: 1620841 - RNA, 23 nt, Homo sapiens
ccagcaccggccccauuuaccca

SEQ ID NO: 1620842 - RNA, 16 nt, Homo sapiens
ccagcagcagcacuua

SEQ ID NO: 1620843 - RNA, 17 nt, Homo sapiens
ccagcagcuggguuggg

SEQ ID NO: 1620844 - RNA, 19 nt, Homo sapiens
ccagccagaggaugcauag

SEQ ID NO: 1620845 - RNA, 17 nt, Homo sapiens
ccagcccagacccagug

SEQ ID NO: 1620846 - RNA, 13 nt, Homo sapiens
ccagcccauugcu

SEQ ID NO: 1620847 - RNA, 16 nt, Homo sapiens
ccagcccugggaacca

SEQ ID NO: 1620848 - RNA, 17 nt, Homo sapiens
ccagcggacaguggcag

SEQ ID NO: 1620849 - RNA, 17 nt, Homo sapiens
ccagcuaaggacauuuc

SEQ ID NO: 1620850 - RNA, 13 nt, Homo sapiens
ccagcuagugacc

SEQ ID NO: 1620851 - RNA, 12 nt, Homo sapiens
ccagcuaugaau

SEQ ID NO: 1620852 - RNA, 23 nt, Homo sapiens
ccagcugcugugccccaccacgu

SEQ ID NO: 1620853 - RNA, 22 nt, Homo sapiens
ccaggaggcggagguugcagua

SEQ ID NO: 1620854 - RNA, 15 nt, Homo sapiens
ccaggaggugcagug

SEQ ID NO: 1620855 - RNA, 14 nt, Homo sapiens
ccaggauacuggca

SEQ ID NO: 1620856 - RNA, 14 nt, Homo sapiens
ccaggcaugcaaug

SEQ ID NO: 1620857 - RNA, 18 nt, Homo sapiens
ccaggcugaccacagcac

SEQ ID NO: 1620858 - RNA, 16 nt, Homo sapiens
ccaggcuggagugcaa

SEQ ID NO: 1620859 - RNA, 20 nt, Homo sapiens
ccaggcuggagugcaauggc

SEQ ID NO: 1620860 - RNA, 20 nt, Homo sapiens
ccaggcuggagugcaguggc

SEQ ID NO: 1620861 - RNA, 23 nt, Homo sapiens
ccaggcuggcagauuuccaaaag

SEQ ID NO: 1620862 - RNA, 20 nt, Homo sapiens
ccagggaagaagaucaacgc

SEQ ID NO: 1620863 - RNA, 14 nt, Homo sapiens
ccagggacacucca

SEQ ID NO: 1620864 - RNA, 21 nt, Homo sapiens
ccagggagcugcaggggcaug

SEQ ID NO: 1620865 - RNA, 23 nt, Homo sapiens
ccagggcucuaaugugucucuca

SEQ ID NO: 1620866 - RNA, 13 nt, Homo sapiens
ccaggguggagug

SEQ ID NO: 1620867 - RNA, 23 nt, Homo sapiens
ccaggguggagugcaguggugcg

SEQ ID NO: 1620868 - RNA, 16 nt, Homo sapiens
ccagguauuacacaag

SEQ ID NO: 1620869 - RNA, 12 nt, Homo sapiens
ccaguacuugag

SEQ ID NO: 1620870 - RNA, 18 nt, Homo sapiens
ccagucggccccaucucu

SEQ ID NO: 1620871 - RNA, 17 nt, Homo sapiens
ccagucuggaaaacaga

SEQ ID NO: 1620872 - RNA, 23 nt, Homo sapiens
ccagucuggaaaacagaaaccau

SEQ ID NO: 1620873 - RNA, 16 nt, Homo sapiens
ccagugcaaaccacuu

SEQ ID NO: 1620874 - RNA, 16 nt, Homo sapiens
ccauagaaaacuugac

SEQ ID NO: 1620875 - RNA, 17 nt, Homo sapiens
ccaucaggauccagucu

SEQ ID NO: 1620876 - RNA, 18 nt, Homo sapiens
ccaucagugaauccugaa

SEQ ID NO: 1620877 - RNA, 21 nt, Homo sapiens
ccauccagaugugugcaaugu

SEQ ID NO: 1620878 - RNA, 17 nt, Homo sapiens
ccaucuaucacugcauu

SEQ ID NO: 1620879 - RNA, 13 nt, Homo sapiens
ccaugaacacaga

SEQ ID NO: 1620880 - RNA, 21 nt, Homo sapiens
ccaugaugugaagaguuucac

SEQ ID NO: 1620881 - RNA, 20 nt, Homo sapiens
ccaugcugggccacugggga

SEQ ID NO: 1620882 - RNA, 14 nt, Homo sapiens
ccaugcugugagca

SEQ ID NO: 1620883 - RNA, 19 nt, Homo sapiens
ccauggcugccaucucacc

SEQ ID NO: 1620884 - RNA, 14 nt, Homo sapiens
ccauguaaccacug

SEQ ID NO: 1620885 - RNA, 15 nt, Homo sapiens
ccauguuacuucucu

SEQ ID NO: 1620886 - RNA, 18 nt, Homo sapiens
ccauucuccugccucagc

SEQ ID NO: 1620887 - RNA, 14 nt, Homo sapiens
ccauugaacuguac

SEQ ID NO: 1620888 - RNA, 20 nt, Homo sapiens
ccauugauuuaauguaauag

SEQ ID NO: 1620889 - RNA, 16 nt, Homo sapiens
ccauugcuccauucac

SEQ ID NO: 1620890 - RNA, 13 nt, Homo sapiens
cucuugucaaaag

SEQ ID NO: 1620891 - RNA, 21 nt, Homo sapiens
cugaaacucauagacacugau

SEQ ID NO: 1620892 - RNA, 11 nt, Homo sapiens
cugaaccacaa

SEQ ID NO: 1620893 - RNA, 20 nt, Homo sapiens
cugaacuacauaacuuccua

SEQ ID NO: 1620894 - RNA, 19 nt, Homo sapiens
cugaagcgaacaucuucau

SEQ ID NO: 1620895 - RNA, 22 nt, Homo sapiens
cugaagggaacuagagguguua

SEQ ID NO: 1620896 - RNA, 14 nt, Homo sapiens
cugaaggggaaccc

SEQ ID NO: 1620897 - RNA, 20 nt, Homo sapiens
cugaagugugcugugacaag

SEQ ID NO: 1620898 - RNA, 11 nt, Homo sapiens
cugaauucugg

SEQ ID NO: 1620899 - RNA, 17 nt, Homo sapiens
cugaauucuggaaucac

SEQ ID NO: 1620900 - RNA, 19 nt, Homo sapiens
cugaauucuggaaucacaa

SEQ ID NO: 1620901 - RNA, 20 nt, Homo sapiens
cugacaggcgcaacuccucc

SEQ ID NO: 1620902 - RNA, 19 nt, Homo sapiens
cugacaguaacagcaucuu

SEQ ID NO: 1620903 - RNA, 15 nt, Homo sapiens
cugaccaauauugua

SEQ ID NO: 1620904 - RNA, 22 nt, Homo sapiens
cugaccucgugaucuacccacc

SEQ ID NO: 1620905 - RNA, 19 nt, Homo sapiens
cugaccuuuaaaaggccau

SEQ ID NO: 1620906 - RNA, 14 nt, Homo sapiens
cugacggugcaguc

SEQ ID NO: 1620907 - RNA, 12 nt, Homo sapiens
cugacucuccag

SEQ ID NO: 1620908 - RNA, 13 nt, Homo sapiens
cugacucuugcag

SEQ ID NO: 1620909 - RNA, 13 nt, Homo sapiens
cugagagaugaca

SEQ ID NO: 1620910 - RNA, 17 nt, Homo sapiens
cugagaugcucacuuua

SEQ ID NO: 1620911 - RNA, 15 nt, Homo sapiens
cugagcauuugcacc

SEQ ID NO: 1620912 - RNA, 17 nt, Homo sapiens
cugagccagcccuccuu

SEQ ID NO: 1620913 - RNA, 23 nt, Homo sapiens
cugagcuggaaggggccacgugg

SEQ ID NO: 1620914 - RNA, 20 nt, Homo sapiens
cugagcuuuguccugaagga

SEQ ID NO: 1620915 - RNA, 20 nt, Homo sapiens
cugaggagucugagguccug

SEQ ID NO: 1620916 - RNA, 14 nt, Homo sapiens
cugagggcagugcc

SEQ ID NO: 1620917 - RNA, 15 nt, Homo sapiens
cugagggcaguucug

SEQ ID NO: 1620918 - RNA, 15 nt, Homo sapiens
cugagucugcagaug

SEQ ID NO: 1620919 - RNA, 13 nt, Homo sapiens
cugaguguuguuu

SEQ ID NO: 1620920 - RNA, 17 nt, Homo sapiens
cugaguuugauuuguua

SEQ ID NO: 1620921 - RNA, 19 nt, Homo sapiens
cugaugagucuugaucuag

SEQ ID NO: 1620922 - RNA, 21 nt, Homo sapiens
cugauuauuuucuacacauac

SEQ ID NO: 1620923 - RNA, 14 nt, Homo sapiens
cugauucacagucu

SEQ ID NO: 1620924 - RNA, 19 nt, Homo sapiens
cugcaaaguguaugugacc

SEQ ID NO: 1620925 - RNA, 14 nt, Homo sapiens
cugcaauacauuaa

SEQ ID NO: 1620926 - RNA, 18 nt, Homo sapiens
cugcacacccuccagaga

SEQ ID NO: 1620927 - RNA, 14 nt, Homo sapiens
cugcacagagcaag

SEQ ID NO: 1620928 - RNA, 11 nt, Homo sapiens
cugcacaggcu

SEQ ID NO: 1620929 - RNA, 17 nt, Homo sapiens
cugcacaugucuuguac

SEQ ID NO: 1620930 - RNA, 21 nt, Homo sapiens
cugcaccuuacaacucgggga

SEQ ID NO: 1620931 - RNA, 13 nt, Homo sapiens
cugcacugugaac

SEQ ID NO: 1620932 - RNA, 17 nt, Homo sapiens
cugcacuuauacccaug

SEQ ID NO: 1620933 - RNA, 18 nt, Homo sapiens
cugcacuuauacccauga

SEQ ID NO: 1620934 - RNA, 22 nt, Homo sapiens
cugcacuuuggaaaccaagcaa

SEQ ID NO: 1620935 - RNA, 20 nt, Homo sapiens
cugcagcauugccauaccau

SEQ ID NO: 1620936 - RNA, 23 nt, Homo sapiens
cugcagucccauccucuugucag

SEQ ID NO: 1620937 - RNA, 17 nt, Homo sapiens
cugcaucuuggggacau

SEQ ID NO: 1620938 - RNA, 21 nt, Homo sapiens
cugcauuucuaacaagcuccc

SEQ ID NO: 1620939 - RNA, 21 nt, Homo sapiens
cugcauuucuuaccaguguga

SEQ ID NO: 1620940 - RNA, 11 nt, Homo sapiens
cugccaagagu

SEQ ID NO: 1620941 - RNA, 17 nt, Homo sapiens
cugccacucugccccuu

SEQ ID NO: 1620942 - RNA, 14 nt, Homo sapiens
cugccagaccugca

SEQ ID NO: 1620943 - RNA, 16 nt, Homo sapiens
cugcccaggcaaggaa

SEQ ID NO: 1620944 - RNA, 19 nt, Homo sapiens
cugcccagugcaaaccacu

SEQ ID NO: 1620945 - RNA, 22 nt, Homo sapiens
cugcccauggacaggcuggcuc

SEQ ID NO: 1620946 - RNA, 15 nt, Homo sapiens
cugccccagauuuac

SEQ ID NO: 1620947 - RNA, 17 nt, Homo sapiens
cugcccugcucccacag

SEQ ID NO: 1620948 - RNA, 21 nt, Homo sapiens
cugccuauaaucuuauacaac

SEQ ID NO: 1620949 - RNA, 19 nt, Homo sapiens
cugccuucaaagccacuga

SEQ ID NO: 1620950 - RNA, 19 nt, Homo sapiens
cugcucggggugcacagga

SEQ ID NO: 1620951 - RNA, 22 nt, Homo sapiens
cugcugcuucuccaagcuuuca

SEQ ID NO: 1620952 - RNA, 20 nt, Homo sapiens
cugcugggcucugccuuaaa

SEQ ID NO: 1620953 - RNA, 17 nt, Homo sapiens
cugcuuuucccauugcc

SEQ ID NO: 1620954 - RNA, 16 nt, Homo sapiens
cuggaaaacccaaagu

SEQ ID NO: 1620955 - RNA, 15 nt, Homo sapiens
cuggaaauucugcug

SEQ ID NO: 1620956 - RNA, 16 nt, Homo sapiens
cuggaaauucugcugc

SEQ ID NO: 1620957 - RNA, 18 nt, Homo sapiens
cuggaacuccuaaaccuu

SEQ ID NO: 1620958 - RNA, 22 nt, Homo sapiens
cuggaagccaccucaccaagga

SEQ ID NO: 1620959 - RNA, 14 nt, Homo sapiens
cuggaaucgcuuga

SEQ ID NO: 1620960 - RNA, 23 nt, Homo sapiens
cuggaccauaauagacaccaaaa

SEQ ID NO: 1620961 - RNA, 18 nt, Homo sapiens
cuggagacaaggugcuaa

SEQ ID NO: 1620962 - RNA, 19 nt, Homo sapiens
cuggagacggggcaucucc

SEQ ID NO: 1620963 - RNA, 15 nt, Homo sapiens
cuggaggaacacuug

SEQ ID NO: 1620964 - RNA, 15 nt, Homo sapiens
cuggaucacagacac

SEQ ID NO: 1620965 - RNA, 21 nt, Homo sapiens
cuggauccagccaugccugag

SEQ ID NO: 1620966 - RNA, 21 nt, Homo sapiens
cuggauucacuuggauucuga

SEQ ID NO: 1620967 - RNA, 13 nt, Homo sapiens
cuggauucauucu

SEQ ID NO: 1620968 - RNA, 16 nt, Homo sapiens
cuggccacagccuucc

SEQ ID NO: 1620969 - RNA, 15 nt, Homo sapiens
cuggccuucuaggaa

SEQ ID NO: 1620970 - RNA, 17 nt, Homo sapiens
cuggcgccccuuccuag

SEQ ID NO: 1620971 - RNA, 14 nt, Homo sapiens
cuggcuacucccug

SEQ ID NO: 1620972 - RNA, 15 nt, Homo sapiens
cuggcucacaguaca

SEQ ID NO: 1620973 - RNA, 20 nt, Homo sapiens
cuggcuccagagauggucac

SEQ ID NO: 1620974 - RNA, 21 nt, Homo sapiens
cuggcucccagggccaugaac

SEQ ID NO: 1620975 - RNA, 14 nt, Homo sapiens
cugggaaagacauc

SEQ ID NO: 1620976 - RNA, 20 nt, Homo sapiens
cugggaccccagcugcucua

SEQ ID NO: 1620977 - RNA, 15 nt, Homo sapiens
cugggagagucucac

SEQ ID NO: 1620978 - RNA, 18 nt, Homo sapiens
cugggagauccugcauuu

SEQ ID NO: 1620979 - RNA, 14 nt, Homo sapiens
cugggaugucuccg

SEQ ID NO: 1620980 - RNA, 15 nt, Homo sapiens
cugggauuacaggcg

SEQ ID NO: 1620981 - RNA, 23 nt, Homo sapiens
cugggcuguaacguggcacuggu

SEQ ID NO: 1620982 - RNA, 17 nt, Homo sapiens
cugggcuuccugagcca

SEQ ID NO: 1620983 - RNA, 22 nt, Homo sapiens
cuggggccccuaagcuccuagg

SEQ ID NO: 1620984 - RNA, 19 nt, Homo sapiens
cuggggccuguacugccug

SEQ ID NO: 1620985 - RNA, 22 nt, Homo sapiens
cuggggucaucgggaaaggcaa

SEQ ID NO: 1620986 - RNA, 19 nt, Homo sapiens
cugggguuggaagugugac

SEQ ID NO: 1620987 - RNA, 15 nt, Homo sapiens
cugggucagacccau

SEQ ID NO: 1620988 - RNA, 19 nt, Homo sapiens
cuggguccauccuggucag

SEQ ID NO: 1620989 - RNA, 20 nt, Homo sapiens
cugggucuaccacucagaga

SEQ ID NO: 1620990 - RNA, 22 nt, Homo sapiens
cugggugucugggcucaagcuu

SEQ ID NO: 1620991 - RNA, 12 nt, Homo sapiens
cuggucaccucc

SEQ ID NO: 1620992 - RNA, 18 nt, Homo sapiens
cugguggucaugaauuca

SEQ ID NO: 1620993 - RNA, 21 nt, Homo sapiens
cugguuuaauuucauguguau

SEQ ID NO: 1620994 - RNA, 15 nt, Homo sapiens
cugguuuucugccaa

SEQ ID NO: 1620995 - RNA, 17 nt, Homo sapiens
cugguuuucugccaaug

SEQ ID NO: 1620996 - RNA, 12 nt, Homo sapiens
cuguaagggcag

SEQ ID NO: 1620997 - RNA, 22 nt, Homo sapiens
cuguaaucaaaaggaggaauuu

SEQ ID NO: 1620998 - RNA, 14 nt, Homo sapiens
cuguaaucaggcaa

SEQ ID NO: 1620999 - RNA, 14 nt, Homo sapiens
cuguacacagaauu

SEQ ID NO: 1621000 - RNA, 14 nt, Homo sapiens
gcauguugauuucu

SEQ ID NO: 1621001 - RNA, 17 nt, Homo sapiens
gcauuaauagucccauu

SEQ ID NO: 1621002 - RNA, 16 nt, Homo sapiens
gcauuaucuugcucau

SEQ ID NO: 1621003 - RNA, 20 nt, Homo sapiens
gcauuauguacacaggucaa

SEQ ID NO: 1621004 - RNA, 21 nt, Homo sapiens
gcauucuuuuggcaguucuga

SEQ ID NO: 1621005 - RNA, 19 nt, Homo sapiens
gcauuguaucgauguuaug

SEQ ID NO: 1621006 - RNA, 13 nt, Homo sapiens
gcauuuagcuucu

SEQ ID NO: 1621007 - RNA, 10 nt, Homo sapiens
gccaaacaaa

SEQ ID NO: 1621008 - RNA, 17 nt, Homo sapiens
gccaaacacccaugccc

SEQ ID NO: 1621009 - RNA, 23 nt, Homo sapiens
gccaaacagcaagaagcuguuac

SEQ ID NO: 1621010 - RNA, 13 nt, Homo sapiens
gccaaaccaggac

SEQ ID NO: 1621011 - RNA, 22 nt, Homo sapiens
gccaaccagcccgacagugcca

SEQ ID NO: 1621012 - RNA, 23 nt, Homo sapiens
gccaagcuaauuuauagcaagau

SEQ ID NO: 1621013 - RNA, 14 nt, Homo sapiens
gccaaucugcauuu

SEQ ID NO: 1621014 - RNA, 17 nt, Homo sapiens
gccacuauuaacauuuc

SEQ ID NO: 1621015 - RNA, 13 nt, Homo sapiens
gccacugcacucu

SEQ ID NO: 1621016 - RNA, 16 nt, Homo sapiens
gccagaauucuacccu

SEQ ID NO: 1621017 - RNA, 24 nt, Homo sapiens
gccagcaccugcgggagcugcacu

SEQ ID NO: 1621018 - RNA, 13 nt, Homo sapiens
gccagccacagga

SEQ ID NO: 1621019 - RNA, 15 nt, Homo sapiens
gccagcccuccuuga

SEQ ID NO: 1621020 - RNA, 19 nt, Homo sapiens
gccagcccuccuugaccca

SEQ ID NO: 1621021 - RNA, 15 nt, Homo sapiens
gccaggcacuuugag

SEQ ID NO: 1621022 - RNA, 15 nt, Homo sapiens
gccaggcugaucucg

SEQ ID NO: 1621023 - RNA, 21 nt, Homo sapiens
gccaggguggucuugaucucc

SEQ ID NO: 1621024 - RNA, 14 nt, Homo sapiens
gccauaccauuccc

SEQ ID NO: 1621025 - RNA, 16 nt, Homo sapiens
gccauaccuucuccca

SEQ ID NO: 1621026 - RNA, 22 nt, Homo sapiens
gccauccuugacuuugaacuaa

SEQ ID NO: 1621027 - RNA, 14 nt, Homo sapiens
gccaugaaccaaau

SEQ ID NO: 1621028 - RNA, 20 nt, Homo sapiens
gccauguauaaaugugauau

SEQ ID NO: 1621029 - RNA, 23 nt, Homo sapiens
gccauugaucauaaacugacuau

SEQ ID NO: 1621030 - RNA, 14 nt, Homo sapiens
gcccagacccagug

SEQ ID NO: 1621031 - RNA, 15 nt, Homo sapiens
gcccagacccagugg

SEQ ID NO: 1621032 - RNA, 18 nt, Homo sapiens
gcccaggcuggagugcaa

SEQ ID NO: 1621033 - RNA, 19 nt, Homo sapiens
gcccaggcuggagugcagu

SEQ ID NO: 1621034 - RNA, 20 nt, Homo sapiens
gcccaggggagcguguuccu

SEQ ID NO: 1621035 - RNA, 20 nt, Homo sapiens
gcccauuagagaaguauuua

SEQ ID NO: 1621036 - RNA, 17 nt, Homo sapiens
gccccaaaguugcucac

SEQ ID NO: 1621037 - RNA, 20 nt, Homo sapiens
gccccaacuccuuccagcua

SEQ ID NO: 1621038 - RNA, 19 nt, Homo sapiens
gccccaugaccuccagcuu

SEQ ID NO: 1621039 - RNA, 15 nt, Homo sapiens
gccccauuuacccaa

SEQ ID NO: 1621040 - RNA, 22 nt, Homo sapiens
gcccccagcuucaccucuggga

SEQ ID NO: 1621041 - RNA, 16 nt, Homo sapiens
gccccuacccuggacu

SEQ ID NO: 1621042 - RNA, 17 nt, Homo sapiens
gccccuuugccugucaa

SEQ ID NO: 1621043 - RNA, 15 nt, Homo sapiens
gcccucagacauuua

SEQ ID NO: 1621044 - RNA, 13 nt, Homo sapiens
gcccucuauuuau

SEQ ID NO: 1621045 - RNA, 17 nt, Homo sapiens
gcccugaggccuagacu

SEQ ID NO: 1621046 - RNA, 18 nt, Homo sapiens
gcccuggccucugcucaa

SEQ ID NO: 1621047 - RNA, 19 nt, Homo sapiens
gcccuuccuccugccuuuc

SEQ ID NO: 1621048 - RNA, 16 nt, Homo sapiens
gccgacagcucuccaa

SEQ ID NO: 1621049 - RNA, 14 nt, Homo sapiens
gccgcaccauugaa

SEQ ID NO: 1621050 - RNA, 21 nt, Homo sapiens
gccgcauuccugcacucagaa

SEQ ID NO: 1621051 - RNA, 22 nt, Homo sapiens
gccguauacaaggaauaugaca

SEQ ID NO: 1621052 - RNA, 18 nt, Homo sapiens
gccguuuccccuccuugg

SEQ ID NO: 1621053 - RNA, 19 nt, Homo sapiens
gccuaguacaaucuuggga

SEQ ID NO: 1621054 - RNA, 19 nt, Homo sapiens
gccuaugcacauauggacu

SEQ ID NO: 1621055 - RNA, 13 nt, Homo sapiens
gccuauggcaucu

SEQ ID NO: 1621056 - RNA, 23 nt, Homo sapiens
gccucagccucccaaagugcugg

SEQ ID NO: 1621057 - RNA, 17 nt, Homo sapiens
gccucaggccucugugc

SEQ ID NO: 1621058 - RNA, 16 nt, Homo sapiens
gccucccauccagggc

SEQ ID NO: 1621059 - RNA, 22 nt, Homo sapiens
gccuccucucucccugccucac

SEQ ID NO: 1621060 - RNA, 17 nt, Homo sapiens
gccucuccaguuugcac

SEQ ID NO: 1621061 - RNA, 19 nt, Homo sapiens
gccucuuauuccaggagaa

SEQ ID NO: 1621062 - RNA, 21 nt, Homo sapiens
gccugaauuggcuaugcagua

SEQ ID NO: 1621063 - RNA, 16 nt, Homo sapiens
gccugagcccagggag

SEQ ID NO: 1621064 - RNA, 13 nt, Homo sapiens
gccugaggugccc

SEQ ID NO: 1621065 - RNA, 14 nt, Homo sapiens
gccugaugcugaca

SEQ ID NO: 1621066 - RNA, 21 nt, Homo sapiens
gccugcagcaggaguggugca

SEQ ID NO: 1621067 - RNA, 14 nt, Homo sapiens
gccuggacacagag

SEQ ID NO: 1621068 - RNA, 18 nt, Homo sapiens
gccuggagcuaauggcga

SEQ ID NO: 1621069 - RNA, 18 nt, Homo sapiens
gccuggcaacaucuuacu

SEQ ID NO: 1621070 - RNA, 20 nt, Homo sapiens
gccuggggguuuuccaagcc

SEQ ID NO: 1621071 - RNA, 15 nt, Homo sapiens
gccugggugcaaaga

SEQ ID NO: 1621072 - RNA, 17 nt, Homo sapiens
gccuguucauggcagau

SEQ ID NO: 1621073 - RNA, 14 nt, Homo sapiens
gccuucaaagccac

SEQ ID NO: 1621074 - RNA, 19 nt, Homo sapiens
gccuucaguuuauuuccac

SEQ ID NO: 1621075 - RNA, 23 nt, Homo sapiens
gccuuuaaauuguuccucuuugu

SEQ ID NO: 1621076 - RNA, 16 nt, Homo sapiens
gccuuuaagccaaaga

SEQ ID NO: 1621077 - RNA, 18 nt, Homo sapiens
gccuuuuucauuuuccaa

SEQ ID NO: 1621078 - RNA, 21 nt, Homo sapiens
gcgaaaguucuugguggugga

SEQ ID NO: 1621079 - RNA, 11 nt, Homo sapiens
gcgcgcugagc

SEQ ID NO: 1621080 - RNA, 13 nt, Homo sapiens
gcgcuucugggaa

SEQ ID NO: 1621081 - RNA, 17 nt, Homo sapiens
gcggaaagcccugugcu

SEQ ID NO: 1621082 - RNA, 21 nt, Homo sapiens
gcgguagccagcacacagggc

SEQ ID NO: 1621083 - RNA, 16 nt, Homo sapiens
gcgucacggccaagug

SEQ ID NO: 1621084 - RNA, 13 nt, Homo sapiens
gcgugauucaaug

SEQ ID NO: 1621085 - RNA, 21 nt, Homo sapiens
gcuaaaucauauuaguauuaa

SEQ ID NO: 1621086 - RNA, 20 nt, Homo sapiens
gcuaaaugugaguauuucug

SEQ ID NO: 1621087 - RNA, 16 nt, Homo sapiens
gcuaaaugugauccug

SEQ ID NO: 1621088 - RNA, 17 nt, Homo sapiens
gcuaaggacauuuccca

SEQ ID NO: 1621089 - RNA, 13 nt, Homo sapiens
gcuacaagggaag

SEQ ID NO: 1621090 - RNA, 20 nt, Homo sapiens
gcuacaccacucuggcagcc

SEQ ID NO: 1621091 - RNA, 16 nt, Homo sapiens
gcuacaggggccagaa

SEQ ID NO: 1621092 - RNA, 16 nt, Homo sapiens
gcuacuauguacugcc

SEQ ID NO: 1621093 - RNA, 22 nt, Homo sapiens
gcuacucugugccagagccugg

SEQ ID NO: 1621094 - RNA, 22 nt, Homo sapiens
gcuacuuuuuuuuaguucaaua

SEQ ID NO: 1621095 - RNA, 21 nt, Homo sapiens
gcuagacuaccggacacucgu

SEQ ID NO: 1621096 - RNA, 16 nt, Homo sapiens
gcuagacugugucuga

SEQ ID NO: 1621097 - RNA, 22 nt, Homo sapiens
gcuagcaaagacuugugugaug

SEQ ID NO: 1621098 - RNA, 13 nt, Homo sapiens
gcuaggagcaaag

SEQ ID NO: 1621099 - RNA, 18 nt, Homo sapiens
gcuaggagcaaagccugu

SEQ ID NO: 1621100 - RNA, 18 nt, Homo sapiens
gcuauagucuaugcaguc

SEQ ID NO: 1621101 - RNA, 18 nt, Homo sapiens
gcuaugcaguacauugua

SEQ ID NO: 1621102 - RNA, 23 nt, Homo sapiens
gcuaugcggaggaaagcaagugu

SEQ ID NO: 1621103 - RNA, 20 nt, Homo sapiens
gcuauggugagaugcagcug

SEQ ID NO: 1621104 - RNA, 13 nt, Homo sapiens
gcucacaguacag

SEQ ID NO: 1621105 - RNA, 16 nt, Homo sapiens
gcucagaauugcacau

SEQ ID NO: 1621106 - RNA, 21 nt, Homo sapiens
gcucagaggcgcacugugacc

SEQ ID NO: 1621107 - RNA, 14 nt, Homo sapiens
gcucaugagcuccu

SEQ ID NO: 1621108 - RNA, 20 nt, Homo sapiens
gcucauucauuuaacagagc

SEQ ID NO: 1621109 - RNA, 21 nt, Homo sapiens
gcuccauggcugccaucucac

SEQ ID NO: 1621110 - RNA, 17 nt, Homo sapiens
ugcaaggggacauucca

SEQ ID NO: 1621111 - RNA, 18 nt, Homo sapiens
ugcaaucagcuaccauuc

SEQ ID NO: 1621112 - RNA, 15 nt, Homo sapiens
ugcacaaaguggcau

SEQ ID NO: 1621113 - RNA, 17 nt, Homo sapiens
ugcacaaaguggcauaa

SEQ ID NO: 1621114 - RNA, 13 nt, Homo sapiens
ugcacaccaaggc

SEQ ID NO: 1621115 - RNA, 20 nt, Homo sapiens
ugcacaggguccucagcuca

SEQ ID NO: 1621116 - RNA, 17 nt, Homo sapiens
ugcaccaaacugccuca

SEQ ID NO: 1621117 - RNA, 21 nt, Homo sapiens
ugcaccuugugucuguacacg

SEQ ID NO: 1621118 - RNA, 21 nt, Homo sapiens
ugcagacacaucagcuguuaa

SEQ ID NO: 1621119 - RNA, 21 nt, Homo sapiens
ugcagacagaagucuccucaa

SEQ ID NO: 1621120 - RNA, 15 nt, Homo sapiens
ugcagaccugucacc

SEQ ID NO: 1621121 - RNA, 13 nt, Homo sapiens
ugcagcauugcca

SEQ ID NO: 1621122 - RNA, 15 nt, Homo sapiens
ugcagggccuggcau

SEQ ID NO: 1621123 - RNA, 21 nt, Homo sapiens
ugcaggggugacggcccucau

SEQ ID NO: 1621124 - RNA, 13 nt, Homo sapiens
ugcagucugggug

SEQ ID NO: 1621125 - RNA, 21 nt, Homo sapiens
ugcaguuguaggcauguagcu

SEQ ID NO: 1621126 - RNA, 17 nt, Homo sapiens
ugcaguuucuuuucaca

SEQ ID NO: 1621127 - RNA, 17 nt, Homo sapiens
ugcauaugucacuagaa

SEQ ID NO: 1621128 - RNA, 12 nt, Homo sapiens
ugcaugugaaga

SEQ ID NO: 1621129 - RNA, 19 nt, Homo sapiens
ugcauguuugauuauagua

SEQ ID NO: 1621130 - RNA, 16 nt, Homo sapiens
ugcauuauaucaaauc

SEQ ID NO: 1621131 - RNA, 17 nt, Homo sapiens
ugcauuaucuugcucau

SEQ ID NO: 1621132 - RNA, 22 nt, Homo sapiens
ugcauucauuuuuauagcaaca

SEQ ID NO: 1621133 - RNA, 16 nt, Homo sapiens
ugcauucuacuagcag

SEQ ID NO: 1621134 - RNA, 22 nt, Homo sapiens
ugcauuucauaaacuaauagaa

SEQ ID NO: 1621135 - RNA, 20 nt, Homo sapiens
ugcauuucuaacaagcuccc

SEQ ID NO: 1621136 - RNA, 21 nt, Homo sapiens
ugccaacaauccuagugcuuu

SEQ ID NO: 1621137 - RNA, 17 nt, Homo sapiens
ugccaaccucacugaca

SEQ ID NO: 1621138 - RNA, 20 nt, Homo sapiens
ugccaaccuggaauggagac

SEQ ID NO: 1621139 - RNA, 14 nt, Homo sapiens
ugccaacuauucuc

SEQ ID NO: 1621140 - RNA, 12 nt, Homo sapiens
ugccaagccaga

SEQ ID NO: 1621141 - RNA, 15 nt, Homo sapiens
ugccaauacagacaa

SEQ ID NO: 1621142 - RNA, 18 nt, Homo sapiens
ugccacaacgcccggcua

SEQ ID NO: 1621143 - RNA, 19 nt, Homo sapiens
ugccaccgccuucccugac

SEQ ID NO: 1621144 - RNA, 12 nt, Homo sapiens
ugccaccucaga

SEQ ID NO: 1621145 - RNA, 18 nt, Homo sapiens
ugccacuggcaugcucuu

SEQ ID NO: 1621146 - RNA, 22 nt, Homo sapiens
ugccacuuccuuuuaacugcca

SEQ ID NO: 1621147 - RNA, 17 nt, Homo sapiens
ugccagaggcuggacca

SEQ ID NO: 1621148 - RNA, 17 nt, Homo sapiens
ugccagagguaauguua

SEQ ID NO: 1621149 - RNA, 16 nt, Homo sapiens
ugccaggaagggccau

SEQ ID NO: 1621150 - RNA, 19 nt, Homo sapiens
ugccagugcuaaacuacug

SEQ ID NO: 1621151 - RNA, 23 nt, Homo sapiens
ugccauaccauucccauggaguu

SEQ ID NO: 1621152 - RNA, 21 nt, Homo sapiens
ugccauagaacaagauaccag

SEQ ID NO: 1621153 - RNA, 13 nt, Homo sapiens
ugccaucaccauu

SEQ ID NO: 1621154 - RNA, 17 nt, Homo sapiens
ugccaugacugagaagg

SEQ ID NO: 1621155 - RNA, 14 nt, Homo sapiens
ugcccacuccgcca

SEQ ID NO: 1621156 - RNA, 20 nt, Homo sapiens
ugcccagcggacaguggcag

SEQ ID NO: 1621157 - RNA, 20 nt, Homo sapiens
ugcccaggcuggagugcaau

SEQ ID NO: 1621158 - RNA, 15 nt, Homo sapiens
ugccccaaugugacc

SEQ ID NO: 1621159 - RNA, 17 nt, Homo sapiens
ugcccccuccuguguaa

SEQ ID NO: 1621160 - RNA, 14 nt, Homo sapiens
ugccccucucuggg

SEQ ID NO: 1621161 - RNA, 17 nt, Homo sapiens
ugccccuggggcuucca

SEQ ID NO: 1621162 - RNA, 19 nt, Homo sapiens
ugcccuaacuguacauuuc

SEQ ID NO: 1621163 - RNA, 23 nt, Homo sapiens
ugcccucugacuaguagauuucu

SEQ ID NO: 1621164 - RNA, 17 nt, Homo sapiens
ugcccuugcugggccug

SEQ ID NO: 1621165 - RNA, 19 nt, Homo sapiens
ugccgccuccuugugcaca

SEQ ID NO: 1621166 - RNA, 18 nt, Homo sapiens
ugccgcuacaguuuuuau

SEQ ID NO: 1621167 - RNA, 21 nt, Homo sapiens
ugccguuuccccuccuuggcu

SEQ ID NO: 1621168 - RNA, 18 nt, Homo sapiens
ugccucagccucccgagu

SEQ ID NO: 1621169 - RNA, 21 nt, Homo sapiens
ugccugaaaugcuucuguuuu

SEQ ID NO: 1621170 - RNA, 21 nt, Homo sapiens
ugccugcccuuucucccaaaa

SEQ ID NO: 1621171 - RNA, 19 nt, Homo sapiens
ugccuuaaccugggaccaa

SEQ ID NO: 1621172 - RNA, 17 nt, Homo sapiens
ugccuucaacaacguga

SEQ ID NO: 1621173 - RNA, 20 nt, Homo sapiens
ugccuucuuauugcuuuuau

SEQ ID NO: 1621174 - RNA, 18 nt, Homo sapiens
ugccuuuaagccaaagaa

SEQ ID NO: 1621175 - RNA, 15 nt, Homo sapiens
ugcgaaagacccaca

SEQ ID NO: 1621176 - RNA, 16 nt, Homo sapiens
ugcgguagaugggagg

SEQ ID NO: 1621177 - RNA, 22 nt, Homo sapiens
ugcgugauucaaugaaccacaa

SEQ ID NO: 1621178 - RNA, 15 nt, Homo sapiens
ugcguggacucugca

SEQ ID NO: 1621179 - RNA, 17 nt, Homo sapiens
ugcuaacaaagacaaaa

SEQ ID NO: 1621180 - RNA, 12 nt, Homo sapiens
ugcuaucugggc

SEQ ID NO: 1621181 - RNA, 15 nt, Homo sapiens
ugcuauguucugucu

SEQ ID NO: 1621182 - RNA, 16 nt, Homo sapiens
ugcucagaauugcaca

SEQ ID NO: 1621183 - RNA, 18 nt, Homo sapiens
ugcucaggagccaccagc

SEQ ID NO: 1621184 - RNA, 19 nt, Homo sapiens
ugcucaggagccaccagca

SEQ ID NO: 1621185 - RNA, 20 nt, Homo sapiens
ugcucaugagcuccugauca

SEQ ID NO: 1621186 - RNA, 21 nt, Homo sapiens
ugcucauucauuuaacagagc

SEQ ID NO: 1621187 - RNA, 18 nt, Homo sapiens
ugcucauugaacuuuaag

SEQ ID NO: 1621188 - RNA, 13 nt, Homo sapiens
ugcucccacagaa

SEQ ID NO: 1621189 - RNA, 17 nt, Homo sapiens
ugcuccccuacuucuca

SEQ ID NO: 1621190 - RNA, 16 nt, Homo sapiens
ugcucccuccacagcu

SEQ ID NO: 1621191 - RNA, 14 nt, Homo sapiens
ugcuccguuccuca

SEQ ID NO: 1621192 - RNA, 22 nt, Homo sapiens
ugcucuuggggaaggggacaga

SEQ ID NO: 1621193 - RNA, 23 nt, Homo sapiens
ugcucuuuauuuuaaaaaacacu

SEQ ID NO: 1621194 - RNA, 23 nt, Homo sapiens
ugcugaaaaaucauccaagacag

SEQ ID NO: 1621195 - RNA, 16 nt, Homo sapiens
ugcugacuucacuuau

SEQ ID NO: 1621196 - RNA, 17 nt, Homo sapiens
ugcugccaaacacccau

SEQ ID NO: 1621197 - RNA, 13 nt, Homo sapiens
ugcugccugggua

SEQ ID NO: 1621198 - RNA, 16 nt, Homo sapiens
ugcugcggagcaagag

SEQ ID NO: 1621199 - RNA, 18 nt, Homo sapiens
ugcugggcugggcccucu

SEQ ID NO: 1621200 - RNA, 14 nt, Homo sapiens
ugcuguaugucucg

SEQ ID NO: 1621201 - RNA, 17 nt, Homo sapiens
ugcugucaagcaccugc

SEQ ID NO: 1621202 - RNA, 11 nt, Homo sapiens
ugcugugacaa

SEQ ID NO: 1621203 - RNA, 12 nt, Homo sapiens
ugcugugcauuu

SEQ ID NO: 1621204 - RNA, 14 nt, Homo sapiens
ugcuguucagugcc

SEQ ID NO: 1621205 - RNA, 21 nt, Homo sapiens
ugcuguugauucagacuuuca

SEQ ID NO: 1621206 - RNA, 22 nt, Homo sapiens
ugcuuaagguaugguacaagca

SEQ ID NO: 1621207 - RNA, 14 nt, Homo sapiens
ugcuucuacuguga

SEQ ID NO: 1621208 - RNA, 19 nt, Homo sapiens
ugcuucuccaagcuuucag

SEQ ID NO: 1621209 - RNA, 23 nt, Homo sapiens
ugcuucuuauccuuacacucccc

SEQ ID NO: 1621210 - RNA, 15 nt, Homo sapiens
ugcuugaacuaggcu

SEQ ID NO: 1621211 - RNA, 15 nt, Homo sapiens
ugcuugggacauugc

SEQ ID NO: 1621212 - RNA, 13 nt, Homo sapiens
ugcuuuagaacuu

SEQ ID NO: 1621213 - RNA, 15 nt, Homo sapiens
ugcuuuuacuaagca

SEQ ID NO: 1621214 - RNA, 18 nt, Homo sapiens
ugcuuuugaaaucuguau

SEQ ID NO: 1621215 - RNA, 14 nt, Homo sapiens
uggaaaacacuuuc

SEQ ID NO: 1621216 - RNA, 23 nt, Homo sapiens
uggaaaaugcugugugcugccau

SEQ ID NO: 1621217 - RNA, 16 nt, Homo sapiens
uggaaaccucuacaua

SEQ ID NO: 1621218 - RNA, 18 nt, Homo sapiens
uggaaagugcucagugaa

SEQ ID NO: 1621219 - RNA, 14 nt, Homo sapiens
uggaacaagcacag

SEQ ID NO: 1621220 - RNA, 21 nt, Homo sapiens
uugauauuuauuuuuugccau

SEQ ID NO: 1621221 - RNA, 14 nt, Homo sapiens
uugcaaagccuuua

SEQ ID NO: 1621222 - RNA, 20 nt, Homo sapiens
uugcauaauaaaugcuucag

SEQ ID NO: 1621223 - RNA, 24 nt, Homo sapiens
uugcaugggcuaaugaagaucaua

SEQ ID NO: 1621224 - RNA, 16 nt, Homo sapiens
uugccaaaaacaaaaa

SEQ ID NO: 1621225 - RNA, 18 nt, Homo sapiens
uugccauuuguagcuuug

SEQ ID NO: 1621226 - RNA, 21 nt, Homo sapiens
uugcccaggcuggagugcaau

SEQ ID NO: 1621227 - RNA, 14 nt, Homo sapiens
uugcccaugugaaa

SEQ ID NO: 1621228 - RNA, 13 nt, Homo sapiens
uugcguacacaga

SEQ ID NO: 1621229 - RNA, 17 nt, Homo sapiens
uugcuaacaaugcucug

SEQ ID NO: 1621230 - RNA, 15 nt, Homo sapiens
uugcuauagagccua

SEQ ID NO: 1621231 - RNA, 23 nt, Homo sapiens
uugcucagugggggcagagccac

SEQ ID NO: 1621232 - RNA, 13 nt, Homo sapiens
uugcuccugcuuc

SEQ ID NO: 1621233 - RNA, 11 nt, Homo sapiens
uugcugcaaag

SEQ ID NO: 1621234 - RNA, 12 nt, Homo sapiens
uugcuuuccacu

SEQ ID NO: 1621235 - RNA, 18 nt, Homo sapiens
uugcuuucgguacuguaa

SEQ ID NO: 1621236 - RNA, 17 nt, Homo sapiens
uugcuuuugacuccagg

SEQ ID NO: 1621237 - RNA, 18 nt, Homo sapiens
uuggaagguggguucugc

SEQ ID NO: 1621238 - RNA, 15 nt, Homo sapiens
uuggagcaaaccauu

SEQ ID NO: 1621239 - RNA, 12 nt, Homo sapiens
uuggcaaugcau

SEQ ID NO: 1621240 - RNA, 16 nt, Homo sapiens
uuggcacuccuggaca

SEQ ID NO: 1621241 - RNA, 16 nt, Homo sapiens
uuggcugaacuacaag

SEQ ID NO: 1621242 - RNA, 15 nt, Homo sapiens
uugggaacaggguua

SEQ ID NO: 1621243 - RNA, 14 nt, Homo sapiens
uugggacauugcaa

SEQ ID NO: 1621244 - RNA, 20 nt, Homo sapiens
uugggacauugcaauuugca

SEQ ID NO: 1621245 - RNA, 14 nt, Homo sapiens
uugggagcugccaa

SEQ ID NO: 1621246 - RNA, 22 nt, Homo sapiens
uuggggaggacaaaacuucuug

SEQ ID NO: 1621247 - RNA, 19 nt, Homo sapiens
uugguggccuaauuuacaa

SEQ ID NO: 1621248 - RNA, 22 nt, Homo sapiens
uugguuuccaaaggcauuuuau

SEQ ID NO: 1621249 - RNA, 15 nt, Homo sapiens
uuguaaagauccuau

SEQ ID NO: 1621250 - RNA, 15 nt, Homo sapiens
uuguaacuugccauc

SEQ ID NO: 1621251 - RNA, 19 nt, Homo sapiens
uuguacccccagguggaag

SEQ ID NO: 1621252 - RNA, 14 nt, Homo sapiens
uuguagacaugccc

SEQ ID NO: 1621253 - RNA, 12 nt, Homo sapiens
uugucucgcuug

SEQ ID NO: 1621254 - RNA, 21 nt, Homo sapiens
uugugaaggccucgcaggaag

SEQ ID NO: 1621255 - RNA, 21 nt, Homo sapiens
uugugaaguugcccaccaaaa

SEQ ID NO: 1621256 - RNA, 20 nt, Homo sapiens
uuguggaggaggugaaagaa

SEQ ID NO: 1621257 - RNA, 19 nt, Homo sapiens
uugugggacacaacacaga

SEQ ID NO: 1621258 - RNA, 16 nt, Homo sapiens
uuguguauccaugcac

SEQ ID NO: 1621259 - RNA, 22 nt, Homo sapiens
uuguguaucuguuuacauccag

SEQ ID NO: 1621260 - RNA, 14 nt, Homo sapiens
uugugucacaaaga

SEQ ID NO: 1621261 - RNA, 15 nt, Homo sapiens
uugugucuguacacg

SEQ ID NO: 1621262 - RNA, 21 nt, Homo sapiens
uugugugugaugugaagccaa

SEQ ID NO: 1621263 - RNA, 21 nt, Homo sapiens
uuguuacuuuuaguucuauaa

SEQ ID NO: 1621264 - RNA, 12 nt, Homo sapiens
uuguuccucuuu

SEQ ID NO: 1621265 - RNA, 19 nt, Homo sapiens
uuuaaaaaagcauuauccu

SEQ ID NO: 1621266 - RNA, 19 nt, Homo sapiens
uuuaaaaaauugacuaccu

SEQ ID NO: 1621267 - RNA, 12 nt, Homo sapiens
uuuaaaacucua

SEQ ID NO: 1621268 - RNA, 14 nt, Homo sapiens
uuuaaaauaacacu

SEQ ID NO: 1621269 - RNA, 15 nt, Homo sapiens
uuuaaaccacuaaaa

SEQ ID NO: 1621270 - RNA, 14 nt, Homo sapiens
uuuaaaccagggau

SEQ ID NO: 1621271 - RNA, 23 nt, Homo sapiens
uuuaacacccuuuagaaccuuaa

SEQ ID NO: 1621272 - RNA, 14 nt, Homo sapiens
uuuaacggcacugu

SEQ ID NO: 1621273 - RNA, 13 nt, Homo sapiens
uuuaacugugaac

SEQ ID NO: 1621274 - RNA, 19 nt, Homo sapiens
uuuaacuuaagggagaaaa

SEQ ID NO: 1621275 - RNA, 14 nt, Homo sapiens
uuuaaggagcaaaa

SEQ ID NO: 1621276 - RNA, 17 nt, Homo sapiens
uuuaagguuucaacaaa

SEQ ID NO: 1621277 - RNA, 12 nt, Homo sapiens
uuuaauccuuaa

SEQ ID NO: 1621278 - RNA, 19 nt, Homo sapiens
uuuaauccuuaacacauuc

SEQ ID NO: 1621279 - RNA, 17 nt, Homo sapiens
uuuaauuuuaaugcugu

SEQ ID NO: 1621280 - RNA, 14 nt, Homo sapiens
uuuacaugaguuca

SEQ ID NO: 1621281 - RNA, 18 nt, Homo sapiens
uuuacaugaguucaaaua

SEQ ID NO: 1621282 - RNA, 17 nt, Homo sapiens
uuuaccuaguuugcacu

SEQ ID NO: 1621283 - RNA, 12 nt, Homo sapiens
uuuacuuugaac

SEQ ID NO: 1621284 - RNA, 23 nt, Homo sapiens
uuuacuuuugcucccuaccugac

SEQ ID NO: 1621285 - RNA, 17 nt, Homo sapiens
uuuagacaagacugucu

SEQ ID NO: 1621286 - RNA, 21 nt, Homo sapiens
uuuagacuuauguggaacugu

SEQ ID NO: 1621287 - RNA, 21 nt, Homo sapiens
uuuagaucaaauauauuucaa

SEQ ID NO: 1621288 - RNA, 12 nt, Homo sapiens
uuuagggagaac

SEQ ID NO: 1621289 - RNA, 21 nt, Homo sapiens
uuuagucauuaauguguaaca

SEQ ID NO: 1621290 - RNA, 19 nt, Homo sapiens
uuuaguccacccaauggcu

SEQ ID NO: 1621291 - RNA, 19 nt, Homo sapiens
uuuaguucaauacagugaa

SEQ ID NO: 1621292 - RNA, 17 nt, Homo sapiens
uuuauaaagggacacuu

SEQ ID NO: 1621293 - RNA, 19 nt, Homo sapiens
uuuauaaaucuuaugcucu

SEQ ID NO: 1621294 - RNA, 16 nt, Homo sapiens
uuuauaagagcuaaag

SEQ ID NO: 1621295 - RNA, 13 nt, Homo sapiens
uuuauaauaaaca

SEQ ID NO: 1621296 - RNA, 10 nt, Homo sapiens
uuuauacaau

SEQ ID NO: 1621297 - RNA, 19 nt, Homo sapiens
uuuaucaaagagcacuuga

SEQ ID NO: 1621298 - RNA, 19 nt, Homo sapiens
uuuaucacuucauucacau

SEQ ID NO: 1621299 - RNA, 23 nt, Homo sapiens
uuuaucacuucauucacauucag

SEQ ID NO: 1621300 - RNA, 19 nt, Homo sapiens
uuuaucuauuagauaauca

SEQ ID NO: 1621301 - RNA, 14 nt, Homo sapiens
uuuaugaauaucau

SEQ ID NO: 1621302 - RNA, 12 nt, Homo sapiens
uuuaugcaaaua

SEQ ID NO: 1621303 - RNA, 19 nt, Homo sapiens
uuuaugcaaauacaaucag

SEQ ID NO: 1621304 - RNA, 21 nt, Homo sapiens
uuuauuccaaaugccauccag

SEQ ID NO: 1621305 - RNA, 12 nt, Homo sapiens
uuuauuuagcau

SEQ ID NO: 1621306 - RNA, 16 nt, Homo sapiens
uuuauuuccacuaaaa

SEQ ID NO: 1621307 - RNA, 21 nt, Homo sapiens
uuucaaagugucucauucuca

SEQ ID NO: 1621308 - RNA, 16 nt, Homo sapiens
uuucaacaaauuucau

SEQ ID NO: 1621309 - RNA, 20 nt, Homo sapiens
uuucaacaaauuucauugca

SEQ ID NO: 1621310 - RNA, 21 nt, Homo sapiens
uuucaacaaauuucauugcac

SEQ ID NO: 1621311 - RNA, 16 nt, Homo sapiens
uuucacauucuuggcu

SEQ ID NO: 1621312 - RNA, 21 nt, Homo sapiens
uuucaggaaaauguauugauu

SEQ ID NO: 1621313 - RNA, 22 nt, Homo sapiens
uuucauccggggcuuugccaga

SEQ ID NO: 1621314 - RNA, 11 nt, Homo sapiens
uuucauugcac

SEQ ID NO: 1621315 - RNA, 12 nt, Homo sapiens
uuucauugcacu

SEQ ID NO: 1621316 - RNA, 15 nt, Homo sapiens
uuucauugcacuuuc

SEQ ID NO: 1621317 - RNA, 21 nt, Homo sapiens
uuuccacacuuaaauucucua

SEQ ID NO: 1621318 - RNA, 17 nt, Homo sapiens
uuucccaaaacugccac

SEQ ID NO: 1621319 - RNA, 22 nt, Homo sapiens
uuucccuuccugggucuaccac

SEQ ID NO: 1621320 - RNA, 17 nt, Homo sapiens
uuucccuuuauuucucu

SEQ ID NO: 1621321 - RNA, 20 nt, Homo sapiens
uuuccgaggccccugucuca

SEQ ID NO: 1621322 - RNA, 12 nt, Homo sapiens
uuuccucugcau

SEQ ID NO: 1621323 - RNA, 16 nt, Homo sapiens
uuuccuggccucagag

SEQ ID NO: 1621324 - RNA, 20 nt, Homo sapiens
uuuccuuuuuuaaaaaugca

SEQ ID NO: 1621325 - RNA, 20 nt, Homo sapiens
uuucuauagaaaaaguaaaa

SEQ ID NO: 1621326 - RNA, 14 nt, Homo sapiens
uuucuauucuguca

SEQ ID NO: 1621327 - RNA, 13 nt, Homo sapiens
uuucucaaaaccc

SEQ ID NO: 1621328 - RNA, 20 nt, Homo sapiens
uuucucauguuuuccauugu

SEQ ID NO: 1621329 - RNA, 18 nt, Homo sapiens
uuucucucacacuuuugc

SEQ ID NO: 1621330 - RNA, 12 nt, Homo sapiens
aaaaaaacagac

SEQ ID NO: 1621331 - RNA, 23 nt, Homo sapiens
aaaaaccuuguagauagcuugag

SEQ ID NO: 1621332 - RNA, 13 nt, Homo sapiens
aaaaagcauacuu

SEQ ID NO: 1621333 - RNA, 13 nt, Homo sapiens
aaaaagcugcuuc

SEQ ID NO: 1621334 - RNA, 19 nt, Homo sapiens
agagcuacccgcagaguuc

SEQ ID NO: 1621335 - RNA, 22 nt, Homo sapiens
agagcugggggcugagggagac

SEQ ID NO: 1621336 - RNA, 19 nt, Homo sapiens
agaggcccaagugcaaaag

SEQ ID NO: 1621337 - RNA, 20 nt, Homo sapiens
agaggcuccugaaugugacu

SEQ ID NO: 1621338 - RNA, 15 nt, Homo sapiens
agaggcuggaccaca

SEQ ID NO: 1621339 - RNA, 12 nt, Homo sapiens
agagggcccaaa

SEQ ID NO: 1621340 - RNA, 17 nt, Homo sapiens
agaggucaccagcugcu

SEQ ID NO: 1621341 - RNA, 15 nt, Homo sapiens
agagguucugccucu

SEQ ID NO: 1621342 - RNA, 12 nt, Homo sapiens
agagucugagaa

SEQ ID NO: 1621343 - RNA, 14 nt, Homo sapiens
agaguguagcugua

SEQ ID NO: 1621344 - RNA, 16 nt, Homo sapiens
agauaaaccaguugaa

SEQ ID NO: 1621345 - RNA, 13 nt, Homo sapiens
agauaaccuuguu

SEQ ID NO: 1621346 - RNA, 19 nt, Homo sapiens
agauaaucucuccauuccc

SEQ ID NO: 1621347 - RNA, 15 nt, Homo sapiens
agauacaaacauguu

SEQ ID NO: 1621348 - RNA, 18 nt, Homo sapiens
agauacagggaugaggca

SEQ ID NO: 1621349 - RNA, 23 nt, Homo sapiens
agauagucuauguauguguaaaa

SEQ ID NO: 1621350 - RNA, 18 nt, Homo sapiens
agauauggacacacggga

SEQ ID NO: 1621351 - RNA, 14 nt, Homo sapiens
agauauucuuuaca

SEQ ID NO: 1621352 - RNA, 15 nt, Homo sapiens
agauauucuuuacaa

SEQ ID NO: 1621353 - RNA, 19 nt, Homo sapiens
agaucaaauauauuucaag

SEQ ID NO: 1621354 - RNA, 13 nt, Homo sapiens
agaucagacucug

SEQ ID NO: 1621355 - RNA, 20 nt, Homo sapiens
agaucauccagaaguuccuc

SEQ ID NO: 1621356 - RNA, 18 nt, Homo sapiens
agaucauugccaucacca

SEQ ID NO: 1621357 - RNA, 22 nt, Homo sapiens
agauccccuguguggucuccau

SEQ ID NO: 1621358 - RNA, 19 nt, Homo sapiens
agaucugccagaccugcau

SEQ ID NO: 1621359 - RNA, 17 nt, Homo sapiens
agaugacgaguaacucc

SEQ ID NO: 1621360 - RNA, 17 nt, Homo sapiens
agaugagucagugccau

SEQ ID NO: 1621361 - RNA, 19 nt, Homo sapiens
agaugauacauccaaagca

SEQ ID NO: 1621362 - RNA, 20 nt, Homo sapiens
agaugccugggugcaaagaa

SEQ ID NO: 1621363 - RNA, 15 nt, Homo sapiens
agaugcucacuuuau

SEQ ID NO: 1621364 - RNA, 15 nt, Homo sapiens
agaugcuugguugug

SEQ ID NO: 1621365 - RNA, 19 nt, Homo sapiens
agauggaaugggggugugg

SEQ ID NO: 1621366 - RNA, 21 nt, Homo sapiens
agauggaguucuugugccaua

SEQ ID NO: 1621367 - RNA, 16 nt, Homo sapiens
agauuacccccagucc

SEQ ID NO: 1621368 - RNA, 12 nt, Homo sapiens
agauucagcucc

SEQ ID NO: 1621369 - RNA, 21 nt, Homo sapiens
agauuuaagugaauacauuaa

SEQ ID NO: 1621370 - RNA, 18 nt, Homo sapiens
agcaaaaucaacaugacu

SEQ ID NO: 1621371 - RNA, 15 nt, Homo sapiens
agcaacacagaggaa

SEQ ID NO: 1621372 - RNA, 22 nt, Homo sapiens
agcaagcucuucccuugcucau

SEQ ID NO: 1621373 - RNA, 21 nt, Homo sapiens
agcaaguccucacucuucaag

SEQ ID NO: 1621374 - RNA, 14 nt, Homo sapiens
agcaaucauuuuau

SEQ ID NO: 1621375 - RNA, 21 nt, Homo sapiens
agcaaugcuucuaucaaauac

SEQ ID NO: 1621376 - RNA, 20 nt, Homo sapiens
agcaaugucucuuugugcuc

SEQ ID NO: 1621377 - RNA, 22 nt, Homo sapiens
agcaauugugaaauacaguaua

SEQ ID NO: 1621378 - RNA, 18 nt, Homo sapiens
agcacaaucacuaaacuu

SEQ ID NO: 1621379 - RNA, 11 nt, Homo sapiens
agcacagccaa

SEQ ID NO: 1621380 - RNA, 15 nt, Homo sapiens
agcacagcuccugcc

SEQ ID NO: 1621381 - RNA, 20 nt, Homo sapiens
agcacugccaggagggacaa

SEQ ID NO: 1621382 - RNA, 21 nt, Homo sapiens
agcacugccaggagggacaaa

SEQ ID NO: 1621383 - RNA, 19 nt, Homo sapiens
agcagcuccaccacugugc

SEQ ID NO: 1621384 - RNA, 12 nt, Homo sapiens
agcagcugagca

SEQ ID NO: 1621385 - RNA, 20 nt, Homo sapiens
agcaggaauaaagacuugug

SEQ ID NO: 1621386 - RNA, 16 nt, Homo sapiens
agcaggaggugccuga

SEQ ID NO: 1621387 - RNA, 19 nt, Homo sapiens
agcaggcagcgccaagugc

SEQ ID NO: 1621388 - RNA, 20 nt, Homo sapiens
agcaggcauuucugugaugu

SEQ ID NO: 1621389 - RNA, 19 nt, Homo sapiens
agcaggggggcugugccaa

SEQ ID NO: 1621390 - RNA, 17 nt, Homo sapiens
agcaggugcugacuuca

SEQ ID NO: 1621391 - RNA, 14 nt, Homo sapiens
agcauaaagcaauu

SEQ ID NO: 1621392 - RNA, 13 nt, Homo sapiens
agcauacuucaaa

SEQ ID NO: 1621393 - RNA, 13 nt, Homo sapiens
agcaucaugccuc

SEQ ID NO: 1621394 - RNA, 21 nt, Homo sapiens
agcauugccauaccauuccca

SEQ ID NO: 1621395 - RNA, 14 nt, Homo sapiens
agcauugcuuucug

SEQ ID NO: 1621396 - RNA, 17 nt, Homo sapiens
agcauugggcugggcuc

SEQ ID NO: 1621397 - RNA, 19 nt, Homo sapiens
agccaaagcuuaugugaca

SEQ ID NO: 1621398 - RNA, 18 nt, Homo sapiens
agccaauucagacaggca

SEQ ID NO: 1621399 - RNA, 15 nt, Homo sapiens
agccacaacugcagu

SEQ ID NO: 1621400 - RNA, 16 nt, Homo sapiens
agccacacuucucagg

SEQ ID NO: 1621401 - RNA, 17 nt, Homo sapiens
agccacccugaggaguc

SEQ ID NO: 1621402 - RNA, 23 nt, Homo sapiens
agccaccuagcccuaucaagcca

SEQ ID NO: 1621403 - RNA, 15 nt, Homo sapiens
agccacgucaaugca

SEQ ID NO: 1621404 - RNA, 12 nt, Homo sapiens
agccagcaagag

SEQ ID NO: 1621405 - RNA, 18 nt, Homo sapiens
agccagccacacuugaac

SEQ ID NO: 1621406 - RNA, 14 nt, Homo sapiens
agccagcccugccu

SEQ ID NO: 1621407 - RNA, 14 nt, Homo sapiens
agccaggagcagcc

SEQ ID NO: 1621408 - RNA, 18 nt, Homo sapiens
agccaggaggccugcuag

SEQ ID NO: 1621409 - RNA, 18 nt, Homo sapiens
agccaggccccaagccca

SEQ ID NO: 1621410 - RNA, 22 nt, Homo sapiens
agccaggguggucuugaucucc

SEQ ID NO: 1621411 - RNA, 18 nt, Homo sapiens
agccagugcugucuggga

SEQ ID NO: 1621412 - RNA, 19 nt, Homo sapiens
agccauauugucaccucag

SEQ ID NO: 1621413 - RNA, 13 nt, Homo sapiens
agccaucucuaau

SEQ ID NO: 1621414 - RNA, 15 nt, Homo sapiens
agccaucucuaauaa

SEQ ID NO: 1621415 - RNA, 11 nt, Homo sapiens
agccaugccug

SEQ ID NO: 1621416 - RNA, 16 nt, Homo sapiens
agccaugccugagguc

SEQ ID NO: 1621417 - RNA, 20 nt, Homo sapiens
agcccacuguuaauauucua

SEQ ID NO: 1621418 - RNA, 19 nt, Homo sapiens
agcccagcugggucaggca

SEQ ID NO: 1621419 - RNA, 19 nt, Homo sapiens
agcccaggauacuggcaca

SEQ ID NO: 1621420 - RNA, 14 nt, Homo sapiens
agcccagugcaaac

SEQ ID NO: 1621421 - RNA, 20 nt, Homo sapiens
agccccagagaaacugccac

SEQ ID NO: 1621422 - RNA, 15 nt, Homo sapiens
agccccucacacagc

SEQ ID NO: 1621423 - RNA, 17 nt, Homo sapiens
agcccugugucuguaua

SEQ ID NO: 1621424 - RNA, 13 nt, Homo sapiens
agccgacucuggc

SEQ ID NO: 1621425 - RNA, 15 nt, Homo sapiens
agccgguaacugucc

SEQ ID NO: 1621426 - RNA, 13 nt, Homo sapiens
agccuaaauguua

SEQ ID NO: 1621427 - RNA, 21 nt, Homo sapiens
agccuaacacacuccaagaua

SEQ ID NO: 1621428 - RNA, 21 nt, Homo sapiens
agccuacuuucacacuaagaa

SEQ ID NO: 1621429 - RNA, 19 nt, Homo sapiens
agccuauaggccaaugcau

SEQ ID NO: 1621430 - RNA, 15 nt, Homo sapiens
agccuauggcaucuu

SEQ ID NO: 1621431 - RNA, 16 nt, Homo sapiens
agccucaaaugcagua

SEQ ID NO: 1621432 - RNA, 13 nt, Homo sapiens
agccugaacacuc

SEQ ID NO: 1621433 - RNA, 15 nt, Homo sapiens
agccugcagaaucca

SEQ ID NO: 1621434 - RNA, 12 nt, Homo sapiens
agccugcauuga

SEQ ID NO: 1621435 - RNA, 20 nt, Homo sapiens
agccugcauugagcuugcau

SEQ ID NO: 1621436 - RNA, 17 nt, Homo sapiens
agccuggccuccugccu

SEQ ID NO: 1621437 - RNA, 22 nt, Homo sapiens
agccugugcauguaugucuugg

SEQ ID NO: 1621438 - RNA, 12 nt, Homo sapiens
agccugugccac

SEQ ID NO: 1621439 - RNA, 21 nt, Homo sapiens
agccuguucauggcagaugua

SEQ ID NO: 1621440 - RNA, 17 nt, Homo sapiens
agccuucccuugcccau

SEQ ID NO: 1621441 - RNA, 16 nt, Homo sapiens
agccuucggacagaca

SEQ ID NO: 1621442 - RNA, 12 nt, Homo sapiens
agcgaacaucuu

SEQ ID NO: 1621443 - RNA, 18 nt, Homo sapiens
agcgauguaugcagcuau

SEQ ID NO: 1621444 - RNA, 14 nt, Homo sapiens
agcuaugaauauag

SEQ ID NO: 1621445 - RNA, 23 nt, Homo sapiens
agcuaugugacucggauggucuu

SEQ ID NO: 1621446 - RNA, 22 nt, Homo sapiens
agcuauguugacaugaggcagu

SEQ ID NO: 1621447 - RNA, 14 nt, Homo sapiens
agcucaaucugcaa

SEQ ID NO: 1621448 - RNA, 23 nt, Homo sapiens
agcucacaaccaccauucaguca

SEQ ID NO: 1621449 - RNA, 14 nt, Homo sapiens
agcucacccacccc

SEQ ID NO: 1621450 - RNA, 14 nt, Homo sapiens
agcucagccagugg

SEQ ID NO: 1621451 - RNA, 23 nt, Homo sapiens
agcucaggaaggggugugcugag

SEQ ID NO: 1621452 - RNA, 16 nt, Homo sapiens
agcuccaaaccuucac

SEQ ID NO: 1621453 - RNA, 14 nt, Homo sapiens
agcuccccugccuu

SEQ ID NO: 1621454 - RNA, 17 nt, Homo sapiens
agcuccgccucccgggu

SEQ ID NO: 1621455 - RNA, 12 nt, Homo sapiens
agcucucuaggc

SEQ ID NO: 1621456 - RNA, 17 nt, Homo sapiens
agcucuuccccaucuca

SEQ ID NO: 1621457 - RNA, 22 nt, Homo sapiens
agcucuuccccaucucacucuu

SEQ ID NO: 1621458 - RNA, 17 nt, Homo sapiens
agcucuucccuugcuca

SEQ ID NO: 1621459 - RNA, 18 nt, Homo sapiens
agcucuucccuugcucau

SEQ ID NO: 1621460 - RNA, 20 nt, Homo sapiens
agcugaaaagggcacuccca

SEQ ID NO: 1621461 - RNA, 13 nt, Homo sapiens
agcugaaugccuc

SEQ ID NO: 1621462 - RNA, 13 nt, Homo sapiens
agcugcauuucag

SEQ ID NO: 1621463 - RNA, 18 nt, Homo sapiens
agcugccauaauaaugcc

SEQ ID NO: 1621464 - RNA, 16 nt, Homo sapiens
agcugccccaauguga

SEQ ID NO: 1621465 - RNA, 18 nt, Homo sapiens
agcugccccacaggugug

SEQ ID NO: 1621466 - RNA, 14 nt, Homo sapiens
agcuggcacugugg

SEQ ID NO: 1621467 - RNA, 20 nt, Homo sapiens
agcugggucaggcagggugc

SEQ ID NO: 1621468 - RNA, 20 nt, Homo sapiens
agcuguaacuuaacuauuaa

SEQ ID NO: 1621469 - RNA, 23 nt, Homo sapiens
agcuguacucuucugacugcccc

SEQ ID NO: 1621470 - RNA, 13 nt, Homo sapiens
agcuguacuguaa

SEQ ID NO: 1621471 - RNA, 16 nt, Homo sapiens
agcugugcaggcaugg

SEQ ID NO: 1621472 - RNA, 17 nt, Homo sapiens
agcuguugugugagguu

SEQ ID NO: 1621473 - RNA, 15 nt, Homo sapiens
agcuuacaaucgcaa

SEQ ID NO: 1621474 - RNA, 16 nt, Homo sapiens
agcuuacuagcacuuu

SEQ ID NO: 1621475 - RNA, 20 nt, Homo sapiens
agcuuccuagaaaguucugu

SEQ ID NO: 1621476 - RNA, 16 nt, Homo sapiens
agcuugaucaaaggca

SEQ ID NO: 1621477 - RNA, 20 nt, Homo sapiens
agcuugcugucacuucuuca

SEQ ID NO: 1621478 - RNA, 14 nt, Homo sapiens
aggaaaaagugcuu

SEQ ID NO: 1621479 - RNA, 16 nt, Homo sapiens
aggaaaaaugaguaau

SEQ ID NO: 1621480 - RNA, 17 nt, Homo sapiens
aggaaaaggccuggggu

SEQ ID NO: 1621481 - RNA, 13 nt, Homo sapiens
aggaaacaugcag

SEQ ID NO: 1621482 - RNA, 23 nt, Homo sapiens
aggaaaugaugagaaauauuaaa

SEQ ID NO: 1621483 - RNA, 22 nt, Homo sapiens
aggaacaaaaagguaaauccca

SEQ ID NO: 1621484 - RNA, 14 nt, Homo sapiens
aggaacagcccagc

SEQ ID NO: 1621485 - RNA, 21 nt, Homo sapiens
aggaagacccaacacauggga

SEQ ID NO: 1621486 - RNA, 14 nt, Homo sapiens
aggaagcacugaaa

SEQ ID NO: 1621487 - RNA, 21 nt, Homo sapiens
aggaagggccauuuuggugcu

SEQ ID NO: 1621488 - RNA, 20 nt, Homo sapiens
aggaauaaagacuugugcau

SEQ ID NO: 1621489 - RNA, 17 nt, Homo sapiens
aggaauauacauagucu

SEQ ID NO: 1621490 - RNA, 13 nt, Homo sapiens
aggaaucacccca

SEQ ID NO: 1621491 - RNA, 17 nt, Homo sapiens
aggaauccccaacaugc

SEQ ID NO: 1621492 - RNA, 21 nt, Homo sapiens
aggaaugcuuccgagacacca

SEQ ID NO: 1621493 - RNA, 13 nt, Homo sapiens
aggaauucagugc

SEQ ID NO: 1621494 - RNA, 19 nt, Homo sapiens
aggacaaaacuucuuguca

SEQ ID NO: 1621495 - RNA, 12 nt, Homo sapiens
aggacaccugcc

SEQ ID NO: 1621496 - RNA, 21 nt, Homo sapiens
aggacaugaaaaauugcuaug

SEQ ID NO: 1621497 - RNA, 11 nt, Homo sapiens
aggaccaccuc

SEQ ID NO: 1621498 - RNA, 19 nt, Homo sapiens
aggacccaggaggugugau

SEQ ID NO: 1621499 - RNA, 15 nt, Homo sapiens
aggaccugagccugc

SEQ ID NO: 1621500 - RNA, 14 nt, Homo sapiens
aggaccuugcuuug

SEQ ID NO: 1621501 - RNA, 18 nt, Homo sapiens
aggaccuuggaagagcaa

SEQ ID NO: 1621502 - RNA, 15 nt, Homo sapiens
aggagaagcacagcu

SEQ ID NO: 1621503 - RNA, 23 nt, Homo sapiens
aggagaagggggcucugccccag

SEQ ID NO: 1621504 - RNA, 15 nt, Homo sapiens
aggagccuaggccag

SEQ ID NO: 1621505 - RNA, 21 nt, Homo sapiens
aggagccuauggcaucuuccc

SEQ ID NO: 1621506 - RNA, 16 nt, Homo sapiens
aggagcuggaaccaug

SEQ ID NO: 1621507 - RNA, 13 nt, Homo sapiens
aggauauuaacaa

SEQ ID NO: 1621508 - RNA, 19 nt, Homo sapiens
aggauauuaacaacaauaa

SEQ ID NO: 1621509 - RNA, 15 nt, Homo sapiens
aggaucucugagacc

SEQ ID NO: 1621510 - RNA, 15 nt, Homo sapiens
aggauguaagccugg

SEQ ID NO: 1621511 - RNA, 21 nt, Homo sapiens
aggcaaaaccgugcucuuuau

SEQ ID NO: 1621512 - RNA, 13 nt, Homo sapiens
aggcaaugggagc

SEQ ID NO: 1621513 - RNA, 22 nt, Homo sapiens
aggcaccaguuacccugcaugu

SEQ ID NO: 1621514 - RNA, 21 nt, Homo sapiens
aggcaggaacaaacagggcug

SEQ ID NO: 1621515 - RNA, 14 nt, Homo sapiens
aggcaggcauuccu

SEQ ID NO: 1621516 - RNA, 15 nt, Homo sapiens
aggcaggcauuccug

SEQ ID NO: 1621517 - RNA, 23 nt, Homo sapiens
aggcagggugcaguaucaugccc

SEQ ID NO: 1621518 - RNA, 14 nt, Homo sapiens
aggcauccaugaaa

SEQ ID NO: 1621519 - RNA, 20 nt, Homo sapiens
auuuccuguguguguugccc

SEQ ID NO: 1621520 - RNA, 22 nt, Homo sapiens
auuucuccaggauuuccugcuu

SEQ ID NO: 1621521 - RNA, 14 nt, Homo sapiens
auuucucuacuugu

SEQ ID NO: 1621522 - RNA, 13 nt, Homo sapiens
auuugaaugauuu

SEQ ID NO: 1621523 - RNA, 14 nt, Homo sapiens
auuugcacaaguuc

SEQ ID NO: 1621524 - RNA, 15 nt, Homo sapiens
auuugcauccagcag

SEQ ID NO: 1621525 - RNA, 15 nt, Homo sapiens
auuugcuuuuugcua

SEQ ID NO: 1621526 - RNA, 22 nt, Homo sapiens
auuugggcuagacuaccggaca

SEQ ID NO: 1621527 - RNA, 17 nt, Homo sapiens
auuuggggauauuguca

SEQ ID NO: 1621528 - RNA, 16 nt, Homo sapiens
auuuggugacugugua

SEQ ID NO: 1621529 - RNA, 17 nt, Homo sapiens
auuuggugacuguguaa

SEQ ID NO: 1621530 - RNA, 20 nt, Homo sapiens
auuugguguguucguugcac

SEQ ID NO: 1621531 - RNA, 15 nt, Homo sapiens
auuugugucacaaag

SEQ ID NO: 1621532 - RNA, 14 nt, Homo sapiens
auuuuaaagacaaa

SEQ ID NO: 1621533 - RNA, 16 nt, Homo sapiens
auuuuaagaaggcauu

SEQ ID NO: 1621534 - RNA, 23 nt, Homo sapiens
auuuuagcuaaauucagggagau

SEQ ID NO: 1621535 - RNA, 22 nt, Homo sapiens
auuuuauaaaugauaucaaaga

SEQ ID NO: 1621536 - RNA, 14 nt, Homo sapiens
auuuucagcauuaa

SEQ ID NO: 1621537 - RNA, 17 nt, Homo sapiens
auuuucaguaccaaaga

SEQ ID NO: 1621538 - RNA, 19 nt, Homo sapiens
auuuucagugcaucauuac

SEQ ID NO: 1621539 - RNA, 21 nt, Homo sapiens
auuuucuagauuuucuacuuu

SEQ ID NO: 1621540 - RNA, 16 nt, Homo sapiens
ccacagaguuuuucag

SEQ ID NO: 1621541 - RNA, 14 nt, Homo sapiens
ccacagauuaucaa

SEQ ID NO: 1621542 - RNA, 19 nt, Homo sapiens
ccacaugugacacauaugc

SEQ ID NO: 1621543 - RNA, 20 nt, Homo sapiens
ccaccaucaaaggaauauaa

SEQ ID NO: 1621544 - RNA, 13 nt, Homo sapiens
ccacccagucuca

SEQ ID NO: 1621545 - RNA, 19 nt, Homo sapiens
ccaccgccuucccugacac

SEQ ID NO: 1621546 - RNA, 23 nt, Homo sapiens
ccaccgcuguggccggcacucca

SEQ ID NO: 1621547 - RNA, 15 nt, Homo sapiens
ccaccuccuguggac

SEQ ID NO: 1621548 - RNA, 22 nt, Homo sapiens
ccaccuuuauggacuggccccu

SEQ ID NO: 1621549 - RNA, 16 nt, Homo sapiens
ccacgaccuuugaaga

SEQ ID NO: 1621550 - RNA, 21 nt, Homo sapiens
ccacggcaggccccugcagga

SEQ ID NO: 1621551 - RNA, 23 nt, Homo sapiens
ccacggggaggcccccccagaag

SEQ ID NO: 1621552 - RNA, 15 nt, Homo sapiens
ccacuccagcuccuu

SEQ ID NO: 1621553 - RNA, 17 nt, Homo sapiens
ccacuggguuuggcaaa

SEQ ID NO: 1621554 - RNA, 18 nt, Homo sapiens
ccacuucuccaugcugca

SEQ ID NO: 1621555 - RNA, 19 nt, Homo sapiens
ccacuucuccaugcugcaa

SEQ ID NO: 1621556 - RNA, 23 nt, Homo sapiens
ccacuuuccccgugggccauggc

SEQ ID NO: 1621557 - RNA, 15 nt, Homo sapiens
ccacuuugcuaccau

SEQ ID NO: 1621558 - RNA, 17 nt, Homo sapiens
ccagaacuuucuuucac

SEQ ID NO: 1621559 - RNA, 13 nt, Homo sapiens
ccagagaugacua

SEQ ID NO: 1621560 - RNA, 21 nt, Homo sapiens
ccagagaugacuauuacuuuu

SEQ ID NO: 1621561 - RNA, 18 nt, Homo sapiens
ccagagauggucacauga

SEQ ID NO: 1621562 - RNA, 17 nt, Homo sapiens
ccagagcugugccagca

SEQ ID NO: 1621563 - RNA, 14 nt, Homo sapiens
ccagaggugcucca

SEQ ID NO: 1621564 - RNA, 19 nt, Homo sapiens
ccagaugagaagucugcua

SEQ ID NO: 1621565 - RNA, 19 nt, Homo sapiens
ccagauuuucacuguucca

SEQ ID NO: 1621566 - RNA, 17 nt, Homo sapiens
ccagcacacagggcagu

SEQ ID NO: 1621567 - RNA, 19 nt, Homo sapiens
ccagcacgaguggccaguu

SEQ ID NO: 1621568 - RNA, 17 nt, Homo sapiens
ccagcacucacaccacu

SEQ ID NO: 1621569 - RNA, 13 nt, Homo sapiens
ccagccacuguca

SEQ ID NO: 1621570 - RNA, 15 nt, Homo sapiens
ccagcccauugcugc

SEQ ID NO: 1621571 - RNA, 14 nt, Homo sapiens
ccagcgccaaagga

SEQ ID NO: 1621572 - RNA, 19 nt, Homo sapiens
ccagcucagggcucuuucc

SEQ ID NO: 1621573 - RNA, 18 nt, Homo sapiens
ccaggacaauuagaaaaa

SEQ ID NO: 1621574 - RNA, 12 nt, Homo sapiens
ccaggaccccau

SEQ ID NO: 1621575 - RNA, 16 nt, Homo sapiens
ccaggagagagccagg

SEQ ID NO: 1621576 - RNA, 22 nt, Homo sapiens
ccaggaugcccagaugaacuga

SEQ ID NO: 1621577 - RNA, 18 nt, Homo sapiens
ccaggauuuuaauuucag

SEQ ID NO: 1621578 - RNA, 12 nt, Homo sapiens
ccaggcaauggc

SEQ ID NO: 1621579 - RNA, 17 nt, Homo sapiens
ccaggcccuacuaccca

SEQ ID NO: 1621580 - RNA, 18 nt, Homo sapiens
ccaggccugggugaucug

SEQ ID NO: 1621581 - RNA, 18 nt, Homo sapiens
ccaggccuguugcuauag

SEQ ID NO: 1621582 - RNA, 23 nt, Homo sapiens
ccaggcugaccacagcacagcca

SEQ ID NO: 1621583 - RNA, 17 nt, Homo sapiens
ccaggcuggagugcaau

SEQ ID NO: 1621584 - RNA, 18 nt, Homo sapiens
ccaggcuggagugcagug

SEQ ID NO: 1621585 - RNA, 19 nt, Homo sapiens
ccaggcuggagugcagugg

SEQ ID NO: 1621586 - RNA, 18 nt, Homo sapiens
ccagggcucuaauguguc

SEQ ID NO: 1621587 - RNA, 16 nt, Homo sapiens
ccagggcugcccugag

SEQ ID NO: 1621588 - RNA, 21 nt, Homo sapiens
ccagguacaggagaggcagca

SEQ ID NO: 1621589 - RNA, 14 nt, Homo sapiens
ccagguguggaaca

SEQ ID NO: 1621590 - RNA, 12 nt, Homo sapiens
ccaguaguggga

SEQ ID NO: 1621591 - RNA, 23 nt, Homo sapiens
ccagucauuuuauuuuguaauau

SEQ ID NO: 1621592 - RNA, 19 nt, Homo sapiens
ccaguccucccuagcucuu

SEQ ID NO: 1621593 - RNA, 19 nt, Homo sapiens
ccagugacaaggcccugag

SEQ ID NO: 1621594 - RNA, 16 nt, Homo sapiens
ccagugcagguauuuc

SEQ ID NO: 1621595 - RNA, 16 nt, Homo sapiens
ccagugccugcacauc

SEQ ID NO: 1621596 - RNA, 13 nt, Homo sapiens
ccaguggacucuu

SEQ ID NO: 1621597 - RNA, 22 nt, Homo sapiens
ccagugucacuugacucuugaa

SEQ ID NO: 1621598 - RNA, 22 nt, Homo sapiens
ccaguuagauagaagaauuuua

SEQ ID NO: 1621599 - RNA, 12 nt, Homo sapiens
ccaguugcagac

SEQ ID NO: 1621600 - RNA, 21 nt, Homo sapiens
ccauaauagacaccaaaacaa

SEQ ID NO: 1621601 - RNA, 22 nt, Homo sapiens
ccauagggucggaggugcuguc

SEQ ID NO: 1621602 - RNA, 15 nt, Homo sapiens
ccauagucacauggc

SEQ ID NO: 1621603 - RNA, 21 nt, Homo sapiens
ccaucaauaaauguugcaaug

SEQ ID NO: 1621604 - RNA, 14 nt, Homo sapiens
ccaucaccuacuca

SEQ ID NO: 1621605 - RNA, 15 nt, Homo sapiens
ccaucaccuacucac

SEQ ID NO: 1621606 - RNA, 16 nt, Homo sapiens
ccauccccacccaguc

SEQ ID NO: 1621607 - RNA, 22 nt, Homo sapiens
ccaucgcacaccaaauuuggca

SEQ ID NO: 1621608 - RNA, 16 nt, Homo sapiens
ccaugagaaucuuaau

SEQ ID NO: 1621609 - RNA, 20 nt, Homo sapiens
ccaugagaugauacauccaa

SEQ ID NO: 1621610 - RNA, 21 nt, Homo sapiens
ccaugauguaaguuuaccuau

SEQ ID NO: 1621611 - RNA, 17 nt, Homo sapiens
ccaugcguccuggucaa

SEQ ID NO: 1621612 - RNA, 15 nt, Homo sapiens
ccaugcuaacaaaga

SEQ ID NO: 1621613 - RNA, 17 nt, Homo sapiens
ccaugcucaccaaggaa

SEQ ID NO: 1621614 - RNA, 16 nt, Homo sapiens
ccaugcugauaaacug

SEQ ID NO: 1621615 - RNA, 15 nt, Homo sapiens
ccauggaggguauac

SEQ ID NO: 1621616 - RNA, 22 nt, Homo sapiens
ccauggccaccccagagccauc

SEQ ID NO: 1621617 - RNA, 14 nt, Homo sapiens
ccaugugcuaagaa

SEQ ID NO: 1621618 - RNA, 14 nt, Homo sapiens
ccauuaaucuugau

SEQ ID NO: 1621619 - RNA, 14 nt, Homo sapiens
ccauucacuacuca

SEQ ID NO: 1621620 - RNA, 16 nt, Homo sapiens
ccauucuccugccuca

SEQ ID NO: 1621621 - RNA, 17 nt, Homo sapiens
ccauugccuagcucuuu

SEQ ID NO: 1621622 - RNA, 15 nt, Homo sapiens
ccauuuaaaaaacau

SEQ ID NO: 1621623 - RNA, 16 nt, Homo sapiens
ccauuuagagggugaa

SEQ ID NO: 1621624 - RNA, 14 nt, Homo sapiens
cccaaaacugccac

SEQ ID NO: 1621625 - RNA, 21 nt, Homo sapiens
cccaaacuugcuuuaugccuu

SEQ ID NO: 1621626 - RNA, 21 nt, Homo sapiens
cccaacucuguaucuccagcc

SEQ ID NO: 1621627 - RNA, 21 nt, Homo sapiens
cccaagacaugacauucuuag

SEQ ID NO: 1621628 - RNA, 23 nt, Homo sapiens
cccaagaggucaaggcugcagug

SEQ ID NO: 1621629 - RNA, 16 nt, Homo sapiens
cccaaggaugcuguca

SEQ ID NO: 1621630 - RNA, 13 nt, Homo sapiens
cccaauacaaaga

SEQ ID NO: 1621631 - RNA, 12 nt, Homo sapiens
cccaauggugcu

SEQ ID NO: 1621632 - RNA, 13 nt, Homo sapiens
cccaaugugaccu

SEQ ID NO: 1621633 - RNA, 16 nt, Homo sapiens
cccacacacacacccg

SEQ ID NO: 1621634 - RNA, 21 nt, Homo sapiens
cccacaggccacggaccaaug

SEQ ID NO: 1621635 - RNA, 23 nt, Homo sapiens
cccacaugugacacauaugcacc

SEQ ID NO: 1621636 - RNA, 19 nt, Homo sapiens
agucuauguauguguaaaa

SEQ ID NO: 1621637 - RNA, 19 nt, Homo sapiens
agucugauccauccaucuc

SEQ ID NO: 1621638 - RNA, 14 nt, Homo sapiens
agucugcugcugug

SEQ ID NO: 1621639 - RNA, 19 nt, Homo sapiens
agucuuccucccuguguau

SEQ ID NO: 1621640 - RNA, 12 nt, Homo sapiens
agucuugaucua

SEQ ID NO: 1621641 - RNA, 23 nt, Homo sapiens
agucuugguuucucucuacagug

SEQ ID NO: 1621642 - RNA, 21 nt, Homo sapiens
agugaaaaucuuggagacccu

SEQ ID NO: 1621643 - RNA, 16 nt, Homo sapiens
agugaaguauugcuga

SEQ ID NO: 1621644 - RNA, 14 nt, Homo sapiens
agugaauacauuaa

SEQ ID NO: 1621645 - RNA, 23 nt, Homo sapiens
agugaauacauuaacggugcuaa

SEQ ID NO: 1621646 - RNA, 17 nt, Homo sapiens
agugacaaggcccugag

SEQ ID NO: 1621647 - RNA, 16 nt, Homo sapiens
agugacccacaugcca

SEQ ID NO: 1621648 - RNA, 20 nt, Homo sapiens
agugacucuugaaguacuua

SEQ ID NO: 1621649 - RNA, 24 nt, Homo sapiens
agugacuucuggagaaagcucaug

SEQ ID NO: 1621650 - RNA, 16 nt, Homo sapiens
agugaggugacacucc

SEQ ID NO: 1621651 - RNA, 20 nt, Homo sapiens
agugagguguugcagcccaa

SEQ ID NO: 1621652 - RNA, 21 nt, Homo sapiens
agugcaaccucugcuucccag

SEQ ID NO: 1621653 - RNA, 14 nt, Homo sapiens
agugcauugaucau

SEQ ID NO: 1621654 - RNA, 16 nt, Homo sapiens
agugccaacuccucac

SEQ ID NO: 1621655 - RNA, 15 nt, Homo sapiens
agugccauaccuucu

SEQ ID NO: 1621656 - RNA, 19 nt, Homo sapiens
agugccgacagcucuccaa

SEQ ID NO: 1621657 - RNA, 14 nt, Homo sapiens
agugcuggcucaca

SEQ ID NO: 1621658 - RNA, 14 nt, Homo sapiens
aguggaaaacaaag

SEQ ID NO: 1621659 - RNA, 18 nt, Homo sapiens
aguggaaauuaagacuuu

SEQ ID NO: 1621660 - RNA, 22 nt, Homo sapiens
aguggagagaagcucuucaaua

SEQ ID NO: 1621661 - RNA, 21 nt, Homo sapiens
aguggcauaaaaaacaugugg

SEQ ID NO: 1621662 - RNA, 16 nt, Homo sapiens
aguggccucuuugucu

SEQ ID NO: 1621663 - RNA, 20 nt, Homo sapiens
aguggcgccaucucggcuca

SEQ ID NO: 1621664 - RNA, 15 nt, Homo sapiens
augaagaagacaccu

SEQ ID NO: 1621665 - RNA, 14 nt, Homo sapiens
augaaugacaugac

SEQ ID NO: 1621666 - RNA, 15 nt, Homo sapiens
augaaugacaugacc

SEQ ID NO: 1621667 - RNA, 22 nt, Homo sapiens
augacaagaacaaagccacuga

SEQ ID NO: 1621668 - RNA, 14 nt, Homo sapiens
augacacuuguccc

SEQ ID NO: 1621669 - RNA, 19 nt, Homo sapiens
augacuaaagcagggacaa

SEQ ID NO: 1621670 - RNA, 11 nt, Homo sapiens
augacugagaa

SEQ ID NO: 1621671 - RNA, 15 nt, Homo sapiens
augacuuacuuuccu

SEQ ID NO: 1621672 - RNA, 13 nt, Homo sapiens
augagaagcagaa

SEQ ID NO: 1621673 - RNA, 19 nt, Homo sapiens
augagagggugcuauccau

SEQ ID NO: 1621674 - RNA, 11 nt, Homo sapiens
augagccauga

SEQ ID NO: 1621675 - RNA, 16 nt, Homo sapiens
augagcccacccugcu

SEQ ID NO: 1621676 - RNA, 18 nt, Homo sapiens
augagcugacaucucagu

SEQ ID NO: 1621677 - RNA, 23 nt, Homo sapiens
augagcugugcacaaaguggcau

SEQ ID NO: 1621678 - RNA, 15 nt, Homo sapiens
augaggccaucucag

SEQ ID NO: 1621679 - RNA, 22 nt, Homo sapiens
augagguuucuuugacuucaau

SEQ ID NO: 1621680 - RNA, 19 nt, Homo sapiens
augauacugcugcuuguca

SEQ ID NO: 1621681 - RNA, 17 nt, Homo sapiens
augaucaagauauaugu

SEQ ID NO: 1621682 - RNA, 17 nt, Homo sapiens
augauccuuuuuuguca

SEQ ID NO: 1621683 - RNA, 23 nt, Homo sapiens
augauccuuuuuugucauuuuau

SEQ ID NO: 1621684 - RNA, 21 nt, Homo sapiens
augaugcgggccagugcucca

SEQ ID NO: 1621685 - RNA, 19 nt, Homo sapiens
augauuuagugaucaaauu

SEQ ID NO: 1621686 - RNA, 23 nt, Homo sapiens
augauuuguaguggaaacauuua

SEQ ID NO: 1621687 - RNA, 15 nt, Homo sapiens
augcaaauacaauca

SEQ ID NO: 1621688 - RNA, 23 nt, Homo sapiens
augcaaauacaaucagcccagug

SEQ ID NO: 1621689 - RNA, 12 nt, Homo sapiens
augcaacauuug

SEQ ID NO: 1621690 - RNA, 13 nt, Homo sapiens
augcacacagaua

SEQ ID NO: 1621691 - RNA, 18 nt, Homo sapiens
augcacacucaugcacac

SEQ ID NO: 1621692 - RNA, 16 nt, Homo sapiens
augcacagugcauuau

SEQ ID NO: 1621693 - RNA, 15 nt, Homo sapiens
augcacugauguugu

SEQ ID NO: 1621694 - RNA, 19 nt, Homo sapiens
augcaggucagcccaugga

SEQ ID NO: 1621695 - RNA, 17 nt, Homo sapiens
augccaccacacguguu

SEQ ID NO: 1621696 - RNA, 12 nt, Homo sapiens
augccucugagg

SEQ ID NO: 1621697 - RNA, 20 nt, Homo sapiens
augcuaacaaagacaaaagu

SEQ ID NO: 1621698 - RNA, 20 nt, Homo sapiens
augcuauguucugucuuccc

SEQ ID NO: 1621699 - RNA, 13 nt, Homo sapiens
augcucaccaagg

SEQ ID NO: 1621700 - RNA, 22 nt, Homo sapiens
augcucuauguuuguauuugga

SEQ ID NO: 1621701 - RNA, 14 nt, Homo sapiens
augcugauaugauc

SEQ ID NO: 1621702 - RNA, 13 nt, Homo sapiens
augcuggcaaagg

SEQ ID NO: 1621703 - RNA, 17 nt, Homo sapiens
augcugguacuauugug

SEQ ID NO: 1621704 - RNA, 18 nt, Homo sapiens
augcuuuuacuaagcacu

SEQ ID NO: 1621705 - RNA, 20 nt, Homo sapiens
augcuuuuacuaagcacugu

SEQ ID NO: 1621706 - RNA, 20 nt, Homo sapiens
augcuuuucugccacuccau

SEQ ID NO: 1621707 - RNA, 15 nt, Homo sapiens
auggaaaggacagug

SEQ ID NO: 1621708 - RNA, 16 nt, Homo sapiens
auggaacacggccaca

SEQ ID NO: 1621709 - RNA, 23 nt, Homo sapiens
auggaacgcuaaugaaacacagc

SEQ ID NO: 1621710 - RNA, 13 nt, Homo sapiens
auggacucugcac

SEQ ID NO: 1621711 - RNA, 16 nt, Homo sapiens
auggagcaaaccuagc

SEQ ID NO: 1621712 - RNA, 15 nt, Homo sapiens
auggaggcccuccug

SEQ ID NO: 1621713 - RNA, 18 nt, Homo sapiens
auggauguuuuagccauu

SEQ ID NO: 1621714 - RNA, 21 nt, Homo sapiens
auggauuaaacaaguauaaaa

SEQ ID NO: 1621715 - RNA, 23 nt, Homo sapiens
auggccuugaaacaguuccauuu

SEQ ID NO: 1621716 - RNA, 18 nt, Homo sapiens
augggaagcagacaauaa

SEQ ID NO: 1621717 - RNA, 22 nt, Homo sapiens
augggacggagguccuuuggac

SEQ ID NO: 1621718 - RNA, 18 nt, Homo sapiens
augggagcugaggccaca

SEQ ID NO: 1621719 - RNA, 14 nt, Homo sapiens
augggguagaaaca

SEQ ID NO: 1621720 - RNA, 13 nt, Homo sapiens
auggggugggggg

SEQ ID NO: 1621721 - RNA, 18 nt, Homo sapiens
auggguccauuuugcccu

SEQ ID NO: 1621722 - RNA, 17 nt, Homo sapiens
augggucuaggacacag

SEQ ID NO: 1621723 - RNA, 18 nt, Homo sapiens
augguuggaaaacacuuu

SEQ ID NO: 1621724 - RNA, 21 nt, Homo sapiens
auguaaaaaccuuguagauag

SEQ ID NO: 1621725 - RNA, 17 nt, Homo sapiens
auguaaacaaaccacag

SEQ ID NO: 1621726 - RNA, 13 nt, Homo sapiens
auguaaacauaag

SEQ ID NO: 1621727 - RNA, 12 nt, Homo sapiens
auguacaggaug

SEQ ID NO: 1621728 - RNA, 15 nt, Homo sapiens
auguacauuuauuca

SEQ ID NO: 1621729 - RNA, 12 nt, Homo sapiens
auguaugcagcu

SEQ ID NO: 1621730 - RNA, 13 nt, Homo sapiens
auguaugcagcua

SEQ ID NO: 1621731 - RNA, 21 nt, Homo sapiens
auguauuuuccuaaugugauc

SEQ ID NO: 1621732 - RNA, 22 nt, Homo sapiens
auguccauuuuugaagugauuu

SEQ ID NO: 1621733 - RNA, 15 nt, Homo sapiens
augucccugggccag

SEQ ID NO: 1621734 - RNA, 12 nt, Homo sapiens
auguccuauuac

SEQ ID NO: 1621735 - RNA, 18 nt, Homo sapiens
auguccucuugaagcaua

SEQ ID NO: 1621736 - RNA, 15 nt, Homo sapiens
augucuugacuguua

SEQ ID NO: 1621737 - RNA, 17 nt, Homo sapiens
augucuugcaaagccuu

SEQ ID NO: 1621738 - RNA, 11 nt, Homo sapiens
augugaagggu

SEQ ID NO: 1621739 - RNA, 17 nt, Homo sapiens
augugaauaauggcacu

SEQ ID NO: 1621740 - RNA, 17 nt, Homo sapiens
augugacaccccggggg

SEQ ID NO: 1621741 - RNA, 16 nt, Homo sapiens
augugacauuccauga

SEQ ID NO: 1621742 - RNA, 20 nt, Homo sapiens
augugacgacugcaaagcca

SEQ ID NO: 1621743 - RNA, 13 nt, Homo sapiens
augugacuacuga

SEQ ID NO: 1621744 - RNA, 14 nt, Homo sapiens
augugauccugccu

SEQ ID NO: 1621745 - RNA, 16 nt, Homo sapiens
auguggauaacuuuac

SEQ ID NO: 1621746 - RNA, 12 nt, Homo sapiens
auguggcagcug

SEQ ID NO: 1621747 - RNA, 21 nt, Homo sapiens
auguggucuaagguucagccu

SEQ ID NO: 1621748 - RNA, 16 nt, Homo sapiens
augugguugcuuaauu

SEQ ID NO: 1621749 - RNA, 22 nt, Homo sapiens
auguguaagaacaacuaccuga

SEQ ID NO: 1621750 - RNA, 18 nt, Homo sapiens
cuuuauucuuuacuauua

SEQ ID NO: 1621751 - RNA, 14 nt, Homo sapiens
cuuuauugcagaau

SEQ ID NO: 1621752 - RNA, 14 nt, Homo sapiens
cuuucacaguccug

SEQ ID NO: 1621753 - RNA, 22 nt, Homo sapiens
cuuucaugaauucugucauuuc

SEQ ID NO: 1621754 - RNA, 13 nt, Homo sapiens
cuuuccccaagga

SEQ ID NO: 1621755 - RNA, 16 nt, Homo sapiens
cuuuccucagaucauc

SEQ ID NO: 1621756 - RNA, 15 nt, Homo sapiens
cuuuccugaaccaug

SEQ ID NO: 1621757 - RNA, 16 nt, Homo sapiens
cuuuccuuucaauaaa

SEQ ID NO: 1621758 - RNA, 14 nt, Homo sapiens
cuuucuaaugcuga

SEQ ID NO: 1621759 - RNA, 17 nt, Homo sapiens
cuuucucaacuguccca

SEQ ID NO: 1621760 - RNA, 20 nt, Homo sapiens
cuuucuccauuguaaaccac

SEQ ID NO: 1621761 - RNA, 14 nt, Homo sapiens
cuuucucugccugg

SEQ ID NO: 1621762 - RNA, 22 nt, Homo sapiens
cuuucuguccuggagcuagcaa

SEQ ID NO: 1621763 - RNA, 20 nt, Homo sapiens
cuuugaaacuccaugcaaac

SEQ ID NO: 1621764 - RNA, 14 nt, Homo sapiens
cuuugaauuuacug

SEQ ID NO: 1621765 - RNA, 14 nt, Homo sapiens
cuuugaucaguaua

SEQ ID NO: 1621766 - RNA, 15 nt, Homo sapiens
cuuugauuccuggaa

SEQ ID NO: 1621767 - RNA, 21 nt, Homo sapiens
cuuugccccuggggcuuccau

SEQ ID NO: 1621768 - RNA, 12 nt, Homo sapiens
cuuugcuaaaau

SEQ ID NO: 1621769 - RNA, 16 nt, Homo sapiens
cuuuggaaauacacag

SEQ ID NO: 1621770 - RNA, 15 nt, Homo sapiens
cuuuggaauggugua

SEQ ID NO: 1621771 - RNA, 14 nt, Homo sapiens
cuuugucucaaaau

SEQ ID NO: 1621772 - RNA, 16 nt, Homo sapiens
cuuugucucaaaauaa

SEQ ID NO: 1621773 - RNA, 17 nt, Homo sapiens
cuuuguuaugacaguga

SEQ ID NO: 1621774 - RNA, 20 nt, Homo sapiens
cuuuguugaaagcagaagaa

SEQ ID NO: 1621775 - RNA, 23 nt, Homo sapiens
cuuuguuuacaugaguucaaaua

SEQ ID NO: 1621776 - RNA, 16 nt, Homo sapiens
cuuuguuuaugaagaa

SEQ ID NO: 1621777 - RNA, 22 nt, Homo sapiens
cuuuuaaaaauucaaaugauuu

SEQ ID NO: 1621778 - RNA, 21 nt, Homo sapiens
cuuuuacccggcacauucccc

SEQ ID NO: 1621779 - RNA, 15 nt, Homo sapiens
cuuuuacuaagcacu

SEQ ID NO: 1621780 - RNA, 19 nt, Homo sapiens
cuuuuaguaaagucaagga

SEQ ID NO: 1621781 - RNA, 19 nt, Homo sapiens
cuuuuaucuacuucucucu

SEQ ID NO: 1621782 - RNA, 15 nt, Homo sapiens
cuuuuauuuggugug

SEQ ID NO: 1621783 - RNA, 20 nt, Homo sapiens
cuuuucacaaacauuaguau

SEQ ID NO: 1621784 - RNA, 23 nt, Homo sapiens
cuuuucagcgauguaugcagcua

SEQ ID NO: 1621785 - RNA, 22 nt, Homo sapiens
cuuuuccaugcacccucauaca

SEQ ID NO: 1621786 - RNA, 22 nt, Homo sapiens
cuuuucugccacuccauauuaa

SEQ ID NO: 1621787 - RNA, 15 nt, Homo sapiens
cuuuucuuuccucag

SEQ ID NO: 1621788 - RNA, 21 nt, Homo sapiens
cuuuugauagagguaacuuaa

SEQ ID NO: 1621789 - RNA, 23 nt, Homo sapiens
cuuuuuauacuuuguaaagacaa

SEQ ID NO: 1621790 - RNA, 14 nt, Homo sapiens
cuuuuucucaaaau

SEQ ID NO: 1621791 - RNA, 16 nt, Homo sapiens
cuuuuuggccugugau

SEQ ID NO: 1621792 - RNA, 12 nt, Homo sapiens
cuuuuuuacacu

SEQ ID NO: 1621793 - RNA, 14 nt, Homo sapiens
cuuuuuuacacuga

SEQ ID NO: 1621794 - RNA, 23 nt, Homo sapiens
cuuuuuuuuuuuuaaaccaggga

SEQ ID NO: 1621795 - RNA, 13 nt, Homo sapiens
gaaaaaaagugag

SEQ ID NO: 1621796 - RNA, 15 nt, Homo sapiens
gaaaaagccaccuag

SEQ ID NO: 1621797 - RNA, 21 nt, Homo sapiens
gaaaaaugcaagccaucucua

SEQ ID NO: 1621798 - RNA, 14 nt, Homo sapiens
gaaaaauugccaau

SEQ ID NO: 1621799 - RNA, 13 nt, Homo sapiens
gaaaaccaucaca

SEQ ID NO: 1621800 - RNA, 15 nt, Homo sapiens
gaaaacuugacaugu

SEQ ID NO: 1621801 - RNA, 20 nt, Homo sapiens
gaaaacuugacauguagcuu

SEQ ID NO: 1621802 - RNA, 14 nt, Homo sapiens
gaaaagaaaccugg

SEQ ID NO: 1621803 - RNA, 15 nt, Homo sapiens
gaaaaguguuaggga

SEQ ID NO: 1621804 - RNA, 16 nt, Homo sapiens
gaaaaucucugugaaa

SEQ ID NO: 1621805 - RNA, 16 nt, Homo sapiens
gaaaaucugcauguuu

SEQ ID NO: 1621806 - RNA, 23 nt, Homo sapiens
gaaacaaaaaugauccucagugc

SEQ ID NO: 1621807 - RNA, 17 nt, Homo sapiens
gaaacaaggcugccagg

SEQ ID NO: 1621808 - RNA, 16 nt, Homo sapiens
gaaacaguuucuugcu

SEQ ID NO: 1621809 - RNA, 16 nt, Homo sapiens
gaaacaugucuugacu

SEQ ID NO: 1621810 - RNA, 17 nt, Homo sapiens
gaaacaugucuugacug

SEQ ID NO: 1621811 - RNA, 21 nt, Homo sapiens
gaaaccugucauuguauucag

SEQ ID NO: 1621812 - RNA, 21 nt, Homo sapiens
gaaacucaacuucuuuccucu

SEQ ID NO: 1621813 - RNA, 15 nt, Homo sapiens
gaaacuuacacuguu

SEQ ID NO: 1621814 - RNA, 16 nt, Homo sapiens
gaaagaaucuuuacaa

SEQ ID NO: 1621815 - RNA, 12 nt, Homo sapiens
gaaagacaucca

SEQ ID NO: 1621816 - RNA, 21 nt, Homo sapiens
gaaaggcuauuuucagaugaa

SEQ ID NO: 1621817 - RNA, 15 nt, Homo sapiens
gaaauaaaacauuca

SEQ ID NO: 1621818 - RNA, 21 nt, Homo sapiens
gaaauaguuauuuuaauaccu

SEQ ID NO: 1621819 - RNA, 16 nt, Homo sapiens
gaaauaugaaugcccc

SEQ ID NO: 1621820 - RNA, 22 nt, Homo sapiens
gaaaucauaaaggaucagagau

SEQ ID NO: 1621821 - RNA, 9 nt, Homo sapiens
gaaaugcaa

SEQ ID NO: 1621822 - RNA, 23 nt, Homo sapiens
gaaaugcugguuuuucaguuuuc

SEQ ID NO: 1621823 - RNA, 20 nt, Homo sapiens
gaaauggauuuaucaucacc

SEQ ID NO: 1621824 - RNA, 18 nt, Homo sapiens
gaaaugugucaccccaga

SEQ ID NO: 1621825 - RNA, 15 nt, Homo sapiens
gaacaaaaagguaaa

SEQ ID NO: 1621826 - RNA, 23 nt, Homo sapiens
gaacacucuuagcuauguugaca

SEQ ID NO: 1621827 - RNA, 21 nt, Homo sapiens
gaacaguugcauuuagcuucu

SEQ ID NO: 1621828 - RNA, 19 nt, Homo sapiens
gaacauaaguaaucacuaa

SEQ ID NO: 1621829 - RNA, 13 nt, Homo sapiens
gaaccaacaucuu

SEQ ID NO: 1621830 - RNA, 12 nt, Homo sapiens
gaaccacuccca

SEQ ID NO: 1621831 - RNA, 17 nt, Homo sapiens
gaacccagaaauagcca

SEQ ID NO: 1621832 - RNA, 16 nt, Homo sapiens
gaacccaguguuucca

SEQ ID NO: 1621833 - RNA, 21 nt, Homo sapiens
gaaccugcccugcucccacag

SEQ ID NO: 1621834 - RNA, 19 nt, Homo sapiens
gaacuccuaaccucaagug

SEQ ID NO: 1621835 - RNA, 23 nt, Homo sapiens
gaacucuccuggccuucuaggaa

SEQ ID NO: 1621836 - RNA, 12 nt, Homo sapiens
gaacucuuuaug

SEQ ID NO: 1621837 - RNA, 16 nt, Homo sapiens
gaacugaacauuccag

SEQ ID NO: 1621838 - RNA, 22 nt, Homo sapiens
gaacugacaggcagccuggaca

SEQ ID NO: 1621839 - RNA, 18 nt, Homo sapiens
gaacuuuaagaagcagug

SEQ ID NO: 1621840 - RNA, 23 nt, Homo sapiens
gaacuuuaagaagcaguguuuua

SEQ ID NO: 1621841 - RNA, 22 nt, Homo sapiens
gaacuuuguccgguggaaggcc

SEQ ID NO: 1621842 - RNA, 21 nt, Homo sapiens
gaacuuuuuuagaaaugcaaa

SEQ ID NO: 1621843 - RNA, 22 nt, Homo sapiens
gaacuuuuuuagaaaugcaaaa

SEQ ID NO: 1621844 - RNA, 21 nt, Homo sapiens
gaagaacuggaaccccagcuu

SEQ ID NO: 1621845 - RNA, 22 nt, Homo sapiens
gaagagggaaauguacacuuuu

SEQ ID NO: 1621846 - RNA, 21 nt, Homo sapiens
gaagauaacgccuucccuaag

SEQ ID NO: 1621847 - RNA, 19 nt, Homo sapiens
gaagaucauauacgugaaa

SEQ ID NO: 1621848 - RNA, 23 nt, Homo sapiens
gaagaugacgaguaacuccccuc

SEQ ID NO: 1621849 - RNA, 13 nt, Homo sapiens
gaagcaacauuuu

SEQ ID NO: 1621850 - RNA, 14 nt, Homo sapiens
gaagcagagggaca

SEQ ID NO: 1621851 - RNA, 11 nt, Homo sapiens
gaagcuuuauc

SEQ ID NO: 1621852 - RNA, 11 nt, Homo sapiens
gaagcuuuauu

SEQ ID NO: 1621853 - RNA, 17 nt, Homo sapiens
gaaggccuucuuucuag

SEQ ID NO: 1621854 - RNA, 20 nt, Homo sapiens
gggacaaaggagccugugaa

SEQ ID NO: 1621855 - RNA, 11 nt, Homo sapiens
gggacacucca

SEQ ID NO: 1621856 - RNA, 16 nt, Homo sapiens
gggacaucucuuugaa

SEQ ID NO: 1621857 - RNA, 19 nt, Homo sapiens
gggaccuccccagcccagg

SEQ ID NO: 1621858 - RNA, 20 nt, Homo sapiens
gggacucauccuugcccagg

SEQ ID NO: 1621859 - RNA, 16 nt, Homo sapiens
gggacugugaggccau

SEQ ID NO: 1621860 - RNA, 22 nt, Homo sapiens
gggacugugaggccauacuugu

SEQ ID NO: 1621861 - RNA, 23 nt, Homo sapiens
gggagagagagcuagagggacaa

SEQ ID NO: 1621862 - RNA, 19 nt, Homo sapiens
uaacauuuaaauuccacag

SEQ ID NO: 1621863 - RNA, 17 nt, Homo sapiens
uaacauuucauuguaca

SEQ ID NO: 1621864 - RNA, 16 nt, Homo sapiens
uaacauuuugagcuau

SEQ ID NO: 1621865 - RNA, 19 nt, Homo sapiens
ucuaagucgugcacuuucu

SEQ ID NO: 1621866 - RNA, 19 nt, Homo sapiens
ucuaaugugaaaaucauca

SEQ ID NO: 1621867 - RNA, 16 nt, Homo sapiens
ucuaauuaugcaauua

SEQ ID NO: 1621868 - RNA, 16 nt, Homo sapiens
ucuacauaaguccuuu

SEQ ID NO: 1621869 - RNA, 20 nt, Homo sapiens
gucaccuccuuccccagcuc

SEQ ID NO: 1621870 - RNA, 12 nt, Homo sapiens
gucagcauguac

SEQ ID NO: 1621871 - RNA, 17 nt, Homo sapiens
gucaguggggcucucug

SEQ ID NO: 1621872 - RNA, 18 nt, Homo sapiens
gucaguguagacacaggu

SEQ ID NO: 1621873 - RNA, 15 nt, Homo sapiens
gucauaaagcauugg

SEQ ID NO: 1621874 - RNA, 17 nt, Homo sapiens
gucauaguuaugugauu

SEQ ID NO: 1621875 - RNA, 17 nt, Homo sapiens
uucagaaaaggaugccu

SEQ ID NO: 1621876 - RNA, 15 nt, Homo sapiens
uucagauauuccagg

SEQ ID NO: 1621877 - RNA, 19 nt, Homo sapiens
uucagcccccaccagggga

SEQ ID NO: 1621878 - RNA, 17 nt, Homo sapiens
uucagcucccacacaca

SEQ ID NO: 1621879 - RNA, 13 nt, Homo sapiens
uucaguaccaaag

SEQ ID NO: 1621880 - RNA, 17 nt, Homo sapiens
uucaguuauuugcacaa

SEQ ID NO: 1621881 - RNA, 18 nt, Homo sapiens
uucaguucugcuugcucc

SEQ ID NO: 1621882 - RNA, 17 nt, Homo sapiens
uucaguuuauuuccacu

SEQ ID NO: 1621883 - RNA, 15 nt, Homo sapiens
uucaguuuucaggag

SEQ ID NO: 1621884 - RNA, 13 nt, Homo sapiens
uucauauaacguc

SEQ ID NO: 1621885 - RNA, 19 nt, Homo sapiens
uucauauuuauugauuaaa

SEQ ID NO: 1621886 - RNA, 19 nt, Homo sapiens
uucaucuaaaugaaagugg

SEQ ID NO: 1621887 - RNA, 15 nt, Homo sapiens
uucaugaccauccug

SEQ ID NO: 1621888 - RNA, 18 nt, Homo sapiens
uucaugagcuugaacaag

SEQ ID NO: 1621889 - RNA, 19 nt, Homo sapiens
uucauuccuuccacuaacu

SEQ ID NO: 1621890 - RNA, 12 nt, Homo sapiens
uucauugcacuu

SEQ ID NO: 1621891 - RNA, 13 nt, Homo sapiens
uucauuucacaca

SEQ ID NO: 1621892 - RNA, 14 nt, Homo sapiens
uucauuucauuuca

SEQ ID NO: 1621893 - RNA, 18 nt, Homo sapiens
uucauuuggaggaaucac

SEQ ID NO: 1621894 - RNA, 17 nt, Homo sapiens
uucauuuugagaucaag

SEQ ID NO: 1621895 - RNA, 21 nt, Homo sapiens
uuccaaauugcccuaugcugu

SEQ ID NO: 1621896 - RNA, 23 nt, Homo sapiens
uuccaagcagugccccacuucau

SEQ ID NO: 1621897 - RNA, 20 nt, Homo sapiens
uuccagugucugucauuuca

SEQ ID NO: 1621898 - RNA, 23 nt, Homo sapiens
uuccauugaagccgacucuggcc

SEQ ID NO: 1621899 - RNA, 16 nt, Homo sapiens
uucccaagagcaucau

SEQ ID NO: 1621900 - RNA, 21 nt, Homo sapiens
uucccacgucuaacuggaaac

SEQ ID NO: 1621901 - RNA, 15 nt, Homo sapiens
uucccagcgcugcug

SEQ ID NO: 1621902 - RNA, 19 nt, Homo sapiens
uucccccacuacugcagca

SEQ ID NO: 1621903 - RNA, 18 nt, Homo sapiens
uuccccgaaucacacaga

SEQ ID NO: 1621904 - RNA, 20 nt, Homo sapiens
uuccccuccuuggcuuuaug

SEQ ID NO: 1621905 - RNA, 23 nt, Homo sapiens
uuccccuccuuggcuuuaugcaa

SEQ ID NO: 1621906 - RNA, 15 nt, Homo sapiens
uuccccuugccuaaa

SEQ ID NO: 1621907 - RNA, 14 nt, Homo sapiens
uucccucugcauug

SEQ ID NO: 1621908 - RNA, 19 nt, Homo sapiens
uucccucuugcucaguggg

SEQ ID NO: 1621909 - RNA, 14 nt, Homo sapiens
uucccuugcuggaa

SEQ ID NO: 1621910 - RNA, 23 nt, Homo sapiens
uuccgaggccccugucucagggu

SEQ ID NO: 1621911 - RNA, 20 nt, Homo sapiens
uuccgcacccucccuagcuc

SEQ ID NO: 1621912 - RNA, 18 nt, Homo sapiens
uuccgcuuugaaagaagc

SEQ ID NO: 1621913 - RNA, 23 nt, Homo sapiens
uuccgggacaaguggucugggac

SEQ ID NO: 1621914 - RNA, 20 nt, Homo sapiens
uuccuaauaagugaagggaa

SEQ ID NO: 1621915 - RNA, 20 nt, Homo sapiens
uuccuacagcacuacugggu

SEQ ID NO: 1621916 - RNA, 22 nt, Homo sapiens
uuccuaugcugcaauacauuaa

SEQ ID NO: 1621917 - RNA, 11 nt, Homo sapiens
uuccucugcau

SEQ ID NO: 1621918 - RNA, 19 nt, Homo sapiens
uuccugaauuggaaaggaa

SEQ ID NO: 1621919 - RNA, 23 nt, Homo sapiens
uuccugagccagcccuccuugac

SEQ ID NO: 1621920 - RNA, 18 nt, Homo sapiens
uuccugauugauuugggu

SEQ ID NO: 1621921 - RNA, 21 nt, Homo sapiens
uuccugcccuugaacccccuc

SEQ ID NO: 1621922 - RNA, 16 nt, Homo sapiens
uuccuguuuccagggu

SEQ ID NO: 1621923 - RNA, 15 nt, Homo sapiens
uuccuucuacuccuc

SEQ ID NO: 1621924 - RNA, 15 nt, Homo sapiens
uuccuugacuguaaa

SEQ ID NO: 1621925 - RNA, 13 nt, Homo sapiens
uuccuuguauucu

SEQ ID NO: 1621926 - RNA, 16 nt, Homo sapiens
uuccuuuguagcuacu

SEQ ID NO: 1621927 - RNA, 13 nt, Homo sapiens
uucgaaagcaaug

SEQ ID NO: 1621928 - RNA, 20 nt, Homo sapiens
uucggacaugcuuuucugcc

SEQ ID NO: 1621929 - RNA, 14 nt, Homo sapiens
uucuaauaaagcca

SEQ ID NO: 1621930 - RNA, 18 nt, Homo sapiens
uucuaaugcugauaugau

SEQ ID NO: 1621931 - RNA, 21 nt, Homo sapiens
uucuaauggcacuuaucauua

SEQ ID NO: 1621932 - RNA, 20 nt, Homo sapiens
uucuaauuuauauuauccau

SEQ ID NO: 1621933 - RNA, 18 nt, Homo sapiens
uucuacuaaaccagaaau

SEQ ID NO: 1621934 - RNA, 18 nt, Homo sapiens
uucucauaccuuccccac

SEQ ID NO: 1621935 - RNA, 14 nt, Homo sapiens
uucuccugccuuag

SEQ ID NO: 1621936 - RNA, 13 nt, Homo sapiens
uucucucacugug

SEQ ID NO: 1621937 - RNA, 16 nt, Homo sapiens
uucugaagacugagaa

SEQ ID NO: 1621938 - RNA, 13 nt, Homo sapiens
uucugacuuauga

SEQ ID NO: 1621939 - RNA, 17 nt, Homo sapiens
uucugauauguauccau

SEQ ID NO: 1621940 - RNA, 19 nt, Homo sapiens
uucugccaaugaccaaaca

SEQ ID NO: 1621941 - RNA, 15 nt, Homo sapiens
uucugcuaugacaaa

SEQ ID NO: 1621942 - RNA, 23 nt, Homo sapiens
uucugggagacacccaaagggug

SEQ ID NO: 1621943 - RNA, 20 nt, Homo sapiens
uucuguccuggagcuagcaa

SEQ ID NO: 1621944 - RNA, 22 nt, Homo sapiens
uucuguuauaccccauauauua

SEQ ID NO: 1621945 - RNA, 22 nt, Homo sapiens
uucuguuuuuaaugcuauuuga

SEQ ID NO: 1621946 - RNA, 18 nt, Homo sapiens
uucuuacacugugucauu

SEQ ID NO: 1621947 - RNA, 19 nt, Homo sapiens
uucuuacccuguacauaug

SEQ ID NO: 1621948 - RNA, 16 nt, Homo sapiens
uucuuagaguguagcu

SEQ ID NO: 1621949 - RNA, 17 nt, Homo sapiens
uucuuauuaaucauaca

SEQ ID NO: 1621950 - RNA, 16 nt, Homo sapiens
uucuucaccucuucca

SEQ ID NO: 1621951 - RNA, 15 nt, Homo sapiens
uucuuggugguggau

SEQ ID NO: 1621952 - RNA, 22 nt, Homo sapiens
uucuugucagacauaaagccau

SEQ ID NO: 1621953 - RNA, 15 nt, Homo sapiens
uucuuuccuuguuca

SEQ ID NO: 1621954 - RNA, 16 nt, Homo sapiens
uucuuuccuuguucag

SEQ ID NO: 1621955 - RNA, 14 nt, Homo sapiens
uucuuuuccuaaca

SEQ ID NO: 1621956 - RNA, 16 nt, Homo sapiens
uugaaaaaaguacaua

SEQ ID NO: 1621957 - RNA, 21 nt, Homo sapiens
uugaaaauguguuguugcugu

SEQ ID NO: 1621958 - RNA, 20 nt, Homo sapiens
uugaaagcagaagaagacag

SEQ ID NO: 1621959 - RNA, 23 nt, Homo sapiens
uugaaauguuuaauaaagcuuua

SEQ ID NO: 1621960 - RNA, 19 nt, Homo sapiens
uugaagaccccacugccac

SEQ ID NO: 1621961 - RNA, 16 nt, Homo sapiens
uugaaugcuaagaaug

SEQ ID NO: 1621962 - RNA, 16 nt, Homo sapiens
uugaauucuugauaaa

SEQ ID NO: 1621963 - RNA, 19 nt, Homo sapiens
uugacagaucaagcuguga

SEQ ID NO: 1621964 - RNA, 14 nt, Homo sapiens
uugaccguagggga

SEQ ID NO: 1621965 - RNA, 20 nt, Homo sapiens
uugacuccuuuccaauagaa

SEQ ID NO: 1621966 - RNA, 14 nt, Homo sapiens
uugacucuugaaua

SEQ ID NO: 1621967 - RNA, 18 nt, Homo sapiens
uugacuguuaguugucca

SEQ ID NO: 1621968 - RNA, 13 nt, Homo sapiens
uugagaagggaca

SEQ ID NO: 1621969 - RNA, 15 nt, Homo sapiens
uugagacugauucag

SEQ ID NO: 1621970 - RNA, 22 nt, Homo sapiens
uugagauacuugaccuugcaug

SEQ ID NO: 1621971 - RNA, 14 nt, Homo sapiens
uugagguuuccaca

SEQ ID NO: 1621972 - RNA, 17 nt, Homo sapiens
uugagucuaacacacca

SEQ ID NO: 1621973 - RNA, 22 nt, Homo sapiens
uugauaggccuaguacaaucuu

SEQ ID NO: 1621974 - RNA, 14 nt, Homo sapiens
uugaucaugcugca

SEQ ID NO: 1621975 - RNA, 22 nt, Homo sapiens
uugaucuugaacuccugaccuc

SEQ ID NO: 1621976 - RNA, 15 nt, Homo sapiens
uugaugccauaugcc

SEQ ID NO: 1621977 - RNA, 13 nt, Homo sapiens
uugauucacuuca

SEQ ID NO: 1621978 - RNA, 19 nt, Homo sapiens
uugcaaugcaugauacuau

SEQ ID NO: 1621979 - RNA, 16 nt, Homo sapiens
uugcaccucuguucau

SEQ ID NO: 1621980 - RNA, 13 nt, Homo sapiens
uugcaggaaaugu

SEQ ID NO: 1621981 - RNA, 19 nt, Homo sapiens
uugcaguaagccaagguca

SEQ ID NO: 1621982 - RNA, 21 nt, Homo sapiens
uugcauggauguuuuagccau

SEQ ID NO: 1621983 - RNA, 18 nt, Homo sapiens
uugccaaagagaaacaaa

SEQ ID NO: 1621984 - RNA, 20 nt, Homo sapiens
ugcuauucuaacuaaugaca

SEQ ID NO: 1621985 - RNA, 22 nt, Homo sapiens
ugcucaacaauuuauccauuca

SEQ ID NO: 1621986 - RNA, 21 nt, Homo sapiens
ugcucacaaaggauacuuuua

SEQ ID NO: 1621987 - RNA, 13 nt, Homo sapiens
ugcucaccaagga

SEQ ID NO: 1621988 - RNA, 17 nt, Homo sapiens
ugcucagaauugcacau

SEQ ID NO: 1621989 - RNA, 21 nt, Homo sapiens
ugcucaguuuuucuguguuuc

SEQ ID NO: 1621990 - RNA, 16 nt, Homo sapiens
ugcucggggugcacag

SEQ ID NO: 1621991 - RNA, 17 nt, Homo sapiens
ugcugaaugccucgcuc

SEQ ID NO: 1621992 - RNA, 15 nt, Homo sapiens
ugcugagaaccuggc

SEQ ID NO: 1621993 - RNA, 12 nt, Homo sapiens
ugcugccaaaca

SEQ ID NO: 1621994 - RNA, 21 nt, Homo sapiens
ugcugccaaacacccaugccc

SEQ ID NO: 1621995 - RNA, 13 nt, Homo sapiens
ugcugcugugacc

SEQ ID NO: 1621996 - RNA, 19 nt, Homo sapiens
ugcugcuucuccauggcca

SEQ ID NO: 1621997 - RNA, 17 nt, Homo sapiens
ugcuggccggagcaaac

SEQ ID NO: 1621998 - RNA, 21 nt, Homo sapiens
ugcugggcugacggugcaguc

SEQ ID NO: 1621999 - RNA, 21 nt, Homo sapiens
ugcugugacaagccaauguga

SEQ ID NO: 1622000 - RNA, 19 nt, Homo sapiens
ugcugugccccaccacguc

SEQ ID NO: 1622001 - RNA, 19 nt, Homo sapiens
ugcuguggaaugugcauuc

SEQ ID NO: 1622002 - RNA, 18 nt, Homo sapiens
ugcuucaugugaacaucc

SEQ ID NO: 1622003 - RNA, 18 nt, Homo sapiens
ugcuugaacccaagaggu

SEQ ID NO: 1622004 - RNA, 21 nt, Homo sapiens
ugcuuugggaagacugaggca

SEQ ID NO: 1622005 - RNA, 15 nt, Homo sapiens
ugcuuugugccuuug

SEQ ID NO: 1622006 - RNA, 19 nt, Homo sapiens
ugcuuuucugccacuccau

SEQ ID NO: 1622007 - RNA, 17 nt, Homo sapiens
ugcuuuuuuaaauauua

SEQ ID NO: 1622008 - RNA, 14 nt, Homo sapiens
uggaaaacuguguu

SEQ ID NO: 1622009 - RNA, 18 nt, Homo sapiens
uggaaaagggucuuggga

SEQ ID NO: 1622010 - RNA, 13 nt, Homo sapiens
uggaaacaaaaca

SEQ ID NO: 1622011 - RNA, 16 nt, Homo sapiens
uggaacaagcacagau

SEQ ID NO: 1622012 - RNA, 12 nt, Homo sapiens
uggaacacggcc

SEQ ID NO: 1622013 - RNA, 21 nt, Homo sapiens
uggaacagcauuacccuccuc

SEQ ID NO: 1622014 - RNA, 14 nt, Homo sapiens
uggaaccccagcuu

SEQ ID NO: 1622015 - RNA, 16 nt, Homo sapiens
uggaacccccagaaua

SEQ ID NO: 1622016 - RNA, 21 nt, Homo sapiens
uggaagccaccucaccaagga

SEQ ID NO: 1622017 - RNA, 13 nt, Homo sapiens
uggaaggggccac

SEQ ID NO: 1622018 - RNA, 20 nt, Homo sapiens
uggaauaaaguugcagauga

SEQ ID NO: 1622019 - RNA, 22 nt, Homo sapiens
uggaaucacaaaccaagccaug

SEQ ID NO: 1622020 - RNA, 19 nt, Homo sapiens
uggaaucagaauuggaauc

SEQ ID NO: 1622021 - RNA, 13 nt, Homo sapiens
uggaauuacaggc

SEQ ID NO: 1622022 - RNA, 17 nt, Homo sapiens
uggacaaccuggaccca

SEQ ID NO: 1622023 - RNA, 21 nt, Homo sapiens
uggacugaugccccagggauu

SEQ ID NO: 1622024 - RNA, 16 nt, Homo sapiens
uggagaaagagcugcc

SEQ ID NO: 1622025 - RNA, 17 nt, Homo sapiens
uggagaucacagcccca

SEQ ID NO: 1622026 - RNA, 17 nt, Homo sapiens
uggagcuagcaaagacu

SEQ ID NO: 1622027 - RNA, 16 nt, Homo sapiens
uggagcuggcacugug

SEQ ID NO: 1622028 - RNA, 15 nt, Homo sapiens
uggaggagacaugag

SEQ ID NO: 1622029 - RNA, 19 nt, Homo sapiens
uggaggcacccaugccauc

SEQ ID NO: 1622030 - RNA, 16 nt, Homo sapiens
uggaggcagagggcaa

SEQ ID NO: 1622031 - RNA, 16 nt, Homo sapiens
uggaggcaguccaucu

SEQ ID NO: 1622032 - RNA, 14 nt, Homo sapiens
uggagggaaagggg

SEQ ID NO: 1622033 - RNA, 21 nt, Homo sapiens
uggagggaccuugucucccag

SEQ ID NO: 1622034 - RNA, 15 nt, Homo sapiens
uggagggcaagcccu

SEQ ID NO: 1622035 - RNA, 19 nt, Homo sapiens
uggagguucugaaauaccu

SEQ ID NO: 1622036 - RNA, 18 nt, Homo sapiens
uggagugcaguggugcga

SEQ ID NO: 1622037 - RNA, 14 nt, Homo sapiens
uggauaacgaugaa

SEQ ID NO: 1622038 - RNA, 23 nt, Homo sapiens
uggauccugggucaaaaaaaaga

SEQ ID NO: 1622039 - RNA, 22 nt, Homo sapiens
uggaucuuggagaaugugagaa

SEQ ID NO: 1622040 - RNA, 21 nt, Homo sapiens
uggaugcugugcuacguguga

SEQ ID NO: 1622041 - RNA, 18 nt, Homo sapiens
uggaugggaugcacucuc

SEQ ID NO: 1622042 - RNA, 19 nt, Homo sapiens
uggaugucuuuguggugau

SEQ ID NO: 1622043 - RNA, 23 nt, Homo sapiens
uggauuggaaugcagaggucucc

SEQ ID NO: 1622044 - RNA, 18 nt, Homo sapiens
uggcaaacugaagcugca

SEQ ID NO: 1622045 - RNA, 22 nt, Homo sapiens
uggcacauggguggacacggau

SEQ ID NO: 1622046 - RNA, 18 nt, Homo sapiens
uggcaggagcuacugaga

SEQ ID NO: 1622047 - RNA, 15 nt, Homo sapiens
uggcauaugguccua

SEQ ID NO: 1622048 - RNA, 18 nt, Homo sapiens
uggcauguguacaaugaa

SEQ ID NO: 1622049 - RNA, 16 nt, Homo sapiens
uggccaggcugaucuc

SEQ ID NO: 1622050 - RNA, 14 nt, Homo sapiens
uggccaggggccag

SEQ ID NO: 1622051 - RNA, 16 nt, Homo sapiens
uggcccauaaugugaa

SEQ ID NO: 1622052 - RNA, 16 nt, Homo sapiens
uggcccugcuuucuac

SEQ ID NO: 1622053 - RNA, 14 nt, Homo sapiens
uggccuaugcacau

SEQ ID NO: 1622054 - RNA, 18 nt, Homo sapiens
uggccugugauguuuuau

SEQ ID NO: 1622055 - RNA, 18 nt, Homo sapiens
uggccuugaaacaguucc

SEQ ID NO: 1622056 - RNA, 22 nt, Homo sapiens
uggcgccccuuccuaggucaug

SEQ ID NO: 1622057 - RNA, 15 nt, Homo sapiens
uggcucaagucugca

SEQ ID NO: 1622058 - RNA, 17 nt, Homo sapiens
uggcucaugucuauaau

SEQ ID NO: 1622059 - RNA, 17 nt, Homo sapiens
uggcuguguuugcagcc

SEQ ID NO: 1622060 - RNA, 10 nt, Homo sapiens
uggcuuuaug

SEQ ID NO: 1622061 - RNA, 13 nt, Homo sapiens
uggcuuuaugcaa

SEQ ID NO: 1622062 - RNA, 17 nt, Homo sapiens
uggcuuuaugcaaauac

SEQ ID NO: 1622063 - RNA, 22 nt, Homo sapiens
uggcuuuaugcaaauacaauca

SEQ ID NO: 1622064 - RNA, 15 nt, Homo sapiens
uggcuuuaugugcaa

SEQ ID NO: 1622065 - RNA, 16 nt, Homo sapiens
ugggaaauaugaaugc

SEQ ID NO: 1622066 - RNA, 21 nt, Homo sapiens
ugggaaauauuuagcaaauaa

SEQ ID NO: 1622067 - RNA, 21 nt, Homo sapiens
ugggaacaggguuacuguaua

SEQ ID NO: 1622068 - RNA, 17 nt, Homo sapiens
ugggacacaacacagau

SEQ ID NO: 1622069 - RNA, 17 nt, Homo sapiens
ugggacagggcaaacaa

SEQ ID NO: 1622070 - RNA, 15 nt, Homo sapiens
ugggacauugcaauu

SEQ ID NO: 1622071 - RNA, 16 nt, Homo sapiens
ugggacugucggagga

SEQ ID NO: 1622072 - RNA, 12 nt, Homo sapiens
ugggacugugag

SEQ ID NO: 1622073 - RNA, 14 nt, Homo sapiens
ugggagcugccaag

SEQ ID NO: 1622074 - RNA, 16 nt, Homo sapiens
ugggaggguucugggu

SEQ ID NO: 1622075 - RNA, 16 nt, Homo sapiens
ugggaguuuugcucuc

SEQ ID NO: 1622076 - RNA, 12 nt, Homo sapiens
ugggaugcacuc

SEQ ID NO: 1622077 - RNA, 21 nt, Homo sapiens
ugggauguccaccacaguaaa

SEQ ID NO: 1622078 - RNA, 21 nt, Homo sapiens
ugggauuacaggugugcacca

SEQ ID NO: 1622079 - RNA, 19 nt, Homo sapiens
ugggcaaagggaaguaaca

SEQ ID NO: 1622080 - RNA, 17 nt, Homo sapiens
ugggcaacuauucauga

SEQ ID NO: 1622081 - RNA, 24 nt, Homo sapiens
ugggcacuuuuuaacauugcugau

SEQ ID NO: 1622082 - RNA, 23 nt, Homo sapiens
uguguauccaugcaccuaccuua

SEQ ID NO: 1622083 - RNA, 17 nt, Homo sapiens
uguguauuucucuguga

SEQ ID NO: 1622084 - RNA, 22 nt, Homo sapiens
ugugucucccgugcaugcucug

SEQ ID NO: 1622085 - RNA, 19 nt, Homo sapiens
ugugucucugcauguguaa

SEQ ID NO: 1622086 - RNA, 12 nt, Homo sapiens
uguguguggcag

SEQ ID NO: 1622087 - RNA, 12 nt, Homo sapiens
uguguguuucaa

SEQ ID NO: 1622088 - RNA, 15 nt, Homo sapiens
uguguucguugcaca

SEQ ID NO: 1622089 - RNA, 15 nt, Homo sapiens
uguguugaaugaaga

SEQ ID NO: 1622090 - RNA, 18 nt, Homo sapiens
uguguuuuuaacauguca

SEQ ID NO: 1622091 - RNA, 20 nt, Homo sapiens
uguuaauaaaaguacauguu

SEQ ID NO: 1622092 - RNA, 15 nt, Homo sapiens
uguuacugccuauaa

SEQ ID NO: 1622093 - RNA, 21 nt, Homo sapiens
uguuaguaaauccaugguguu

SEQ ID NO: 1622094 - RNA, 17 nt, Homo sapiens
uguuauacacagcuuua

SEQ ID NO: 1622095 - RNA, 19 nt, Homo sapiens
gcuccagaugcagggcagu

SEQ ID NO: 1622096 - RNA, 22 nt, Homo sapiens
gcucccaacucccuucugcuug

SEQ ID NO: 1622097 - RNA, 22 nt, Homo sapiens
gcucccacggagcaucucagaa

SEQ ID NO: 1622098 - RNA, 14 nt, Homo sapiens
gcucccagggccau

SEQ ID NO: 1622099 - RNA, 14 nt, Homo sapiens
gcuccggccugucc

SEQ ID NO: 1622100 - RNA, 22 nt, Homo sapiens
gcucggacuuggcacuccugga

SEQ ID NO: 1622101 - RNA, 23 nt, Homo sapiens
gcucuccccaaacuugcuuuaug

SEQ ID NO: 1622102 - RNA, 21 nt, Homo sapiens
gcucucugucaggugugauaa

SEQ ID NO: 1622103 - RNA, 14 nt, Homo sapiens
gcucugaaggucca

SEQ ID NO: 1622104 - RNA, 12 nt, Homo sapiens
gcucugagccaa

SEQ ID NO: 1622105 - RNA, 23 nt, Homo sapiens
gcucugcaccccucugcccucau

SEQ ID NO: 1622106 - RNA, 20 nt, Homo sapiens
gcucuguucccaguaguuau

SEQ ID NO: 1622107 - RNA, 17 nt, Homo sapiens
gcucuucccuugcucau

SEQ ID NO: 1622108 - RNA, 22 nt, Homo sapiens
gcugaaugccuccuguggggaa

SEQ ID NO: 1622109 - RNA, 23 nt, Homo sapiens
gcugacaugaagcuguuguguga

SEQ ID NO: 1622110 - RNA, 14 nt, Homo sapiens
gcugagcgccagga

SEQ ID NO: 1622111 - RNA, 21 nt, Homo sapiens
gcugaggcuggcacaggacau

SEQ ID NO: 1622112 - RNA, 17 nt, Homo sapiens
gcugaggugcccaggag

SEQ ID NO: 1622113 - RNA, 16 nt, Homo sapiens
gcugagucugcagaug

SEQ ID NO: 1622114 - RNA, 20 nt, Homo sapiens
gcugcaccuucacucuccag

SEQ ID NO: 1622115 - RNA, 14 nt, Homo sapiens
gcugccuaguggga

SEQ ID NO: 1622116 - RNA, 20 nt, Homo sapiens
gcuggagugcaguggcacga

SEQ ID NO: 1622117 - RNA, 20 nt, Homo sapiens
gcuggaguguaguggcauga

SEQ ID NO: 1622118 - RNA, 19 nt, Homo sapiens
gcuggcccccaccgcugug

SEQ ID NO: 1622119 - RNA, 13 nt, Homo sapiens
gcuggcccugccg

SEQ ID NO: 1622120 - RNA, 20 nt, Homo sapiens
gcuggccggggcucugggug

SEQ ID NO: 1622121 - RNA, 15 nt, Homo sapiens
gcugggcucgccaca

SEQ ID NO: 1622122 - RNA, 22 nt, Homo sapiens
gcuggucucaaacuccugaccu

SEQ ID NO: 1622123 - RNA, 22 nt, Homo sapiens
gcuguacucuucugacugcccc

SEQ ID NO: 1622124 - RNA, 14 nt, Homo sapiens
gcuguagaagaugg

SEQ ID NO: 1622125 - RNA, 16 nt, Homo sapiens
gcugucaucugugcac

SEQ ID NO: 1622126 - RNA, 17 nt, Homo sapiens
gcuguccccacugcccc

SEQ ID NO: 1622127 - RNA, 15 nt, Homo sapiens
gcuuauaugugacac

SEQ ID NO: 1622128 - RNA, 12 nt, Homo sapiens
gcuuaugugaca

SEQ ID NO: 1622129 - RNA, 13 nt, Homo sapiens
gcuuaugugacau

SEQ ID NO: 1622130 - RNA, 18 nt, Homo sapiens
gcuucaaggacaccugcc

SEQ ID NO: 1622131 - RNA, 23 nt, Homo sapiens
gcuucaugggccuggaugcagau

SEQ ID NO: 1622132 - RNA, 23 nt, Homo sapiens
gcuuccaucccaaccagugccaa

SEQ ID NO: 1622133 - RNA, 23 nt, Homo sapiens
gcuuccgagaauagcuccacugg

SEQ ID NO: 1622134 - RNA, 22 nt, Homo sapiens
gcuuccuugguucaugcuucua

SEQ ID NO: 1622135 - RNA, 18 nt, Homo sapiens
gcuucuccaagcuuucag

SEQ ID NO: 1622136 - RNA, 14 nt, Homo sapiens
gcuucuuauccuua

SEQ ID NO: 1622137 - RNA, 20 nt, Homo sapiens
gcuucuucugaaagaauuau

SEQ ID NO: 1622138 - RNA, 12 nt, Homo sapiens
gcuucuucuuca

SEQ ID NO: 1622139 - RNA, 16 nt, Homo sapiens
gcuucuucuucaagau

SEQ ID NO: 1622140 - RNA, 15 nt, Homo sapiens
gcuucuuucccuuag

SEQ ID NO: 1622141 - RNA, 20 nt, Homo sapiens
gcuugaucaaaggcacacag

SEQ ID NO: 1622142 - RNA, 14 nt, Homo sapiens
gcuugcucauuaau

SEQ ID NO: 1622143 - RNA, 12 nt, Homo sapiens
gcuuuagcuuca

SEQ ID NO: 1622144 - RNA, 16 nt, Homo sapiens
gcuuuauacaguugaa

SEQ ID NO: 1622145 - RNA, 11 nt, Homo sapiens
gcuuuaugcaa

SEQ ID NO: 1622146 - RNA, 12 nt, Homo sapiens
gcuuuaugcaaa

SEQ ID NO: 1622147 - RNA, 14 nt, Homo sapiens
gcuuuaugcaaaua

SEQ ID NO: 1622148 - RNA, 15 nt, Homo sapiens
gcuuuccuguuucca

SEQ ID NO: 1622149 - RNA, 12 nt, Homo sapiens
gcuuugcccauu

SEQ ID NO: 1622150 - RNA, 12 nt, Homo sapiens
gcuuugucauag

SEQ ID NO: 1622151 - RNA, 17 nt, Homo sapiens
gcuuuguccugaaggaa

SEQ ID NO: 1622152 - RNA, 20 nt, Homo sapiens
gcuuuuacuaagcacugugu

SEQ ID NO: 1622153 - RNA, 21 nt, Homo sapiens
gcuuuuaugauauauauaugc

SEQ ID NO: 1622154 - RNA, 21 nt, Homo sapiens
gcuuuuccaauaaaagacaca

SEQ ID NO: 1622155 - RNA, 12 nt, Homo sapiens
ggaaaaugacuc

SEQ ID NO: 1622156 - RNA, 14 nt, Homo sapiens
ggaaacacacuguu

SEQ ID NO: 1622157 - RNA, 19 nt, Homo sapiens
ggaaacaguccaaacuguu

SEQ ID NO: 1622158 - RNA, 20 nt, Homo sapiens
ggaaagacauccauaaagaa

SEQ ID NO: 1622159 - RNA, 14 nt, Homo sapiens
ggaaagauuacuuu

SEQ ID NO: 1622160 - RNA, 20 nt, Homo sapiens
ggaaagcuuaaaacccaaua

SEQ ID NO: 1622161 - RNA, 18 nt, Homo sapiens
ggaaaggugacaguauua

SEQ ID NO: 1622162 - RNA, 13 nt, Homo sapiens
ggaaauaauauca

SEQ ID NO: 1622163 - RNA, 14 nt, Homo sapiens
ggaaauagcuaaua

SEQ ID NO: 1622164 - RNA, 13 nt, Homo sapiens
ggaaauuagccac

SEQ ID NO: 1622165 - RNA, 23 nt, Homo sapiens
ggaacaaaccaggggacacuuug

SEQ ID NO: 1622166 - RNA, 14 nt, Homo sapiens
ggaacacggccaca

SEQ ID NO: 1622167 - RNA, 23 nt, Homo sapiens
ggaacacggccacaucaaagagg

SEQ ID NO: 1622168 - RNA, 18 nt, Homo sapiens
ggaacaggguuacuguau

SEQ ID NO: 1622169 - RNA, 14 nt, Homo sapiens
ggaaccgcccagug

SEQ ID NO: 1622170 - RNA, 23 nt, Homo sapiens
ggaacuguguuucaaauggacug

SEQ ID NO: 1622171 - RNA, 14 nt, Homo sapiens
ggaagaaacuuucu

SEQ ID NO: 1622172 - RNA, 21 nt, Homo sapiens
ggaagacuuugugacugucac

SEQ ID NO: 1622173 - RNA, 13 nt, Homo sapiens
ggaagaugcccuc

SEQ ID NO: 1622174 - RNA, 23 nt, Homo sapiens
ggaagauggagcaaaccuagccc

SEQ ID NO: 1622175 - RNA, 22 nt, Homo sapiens
ggaagcaacagauagauguugc

SEQ ID NO: 1622176 - RNA, 14 nt, Homo sapiens
ggaagcauacaauu

SEQ ID NO: 1622177 - RNA, 14 nt, Homo sapiens
ggaagccaaagagu

SEQ ID NO: 1622178 - RNA, 20 nt, Homo sapiens
ggaagccaccucaccaagga

SEQ ID NO: 1622179 - RNA, 20 nt, Homo sapiens
ggaagccccugggcccagua

SEQ ID NO: 1622180 - RNA, 22 nt, Homo sapiens
ggaagucguccuuacuccugug

SEQ ID NO: 1622181 - RNA, 21 nt, Homo sapiens
ggaaucacaaaccaagccaug

SEQ ID NO: 1622182 - RNA, 18 nt, Homo sapiens
ggaaugacuuacuuuccu

SEQ ID NO: 1622183 - RNA, 11 nt, Homo sapiens
ggaaugcuacu

SEQ ID NO: 1622184 - RNA, 11 nt, Homo sapiens
ggaauggugua

SEQ ID NO: 1622185 - RNA, 15 nt, Homo sapiens
ggacaagucuuucuc

SEQ ID NO: 1622186 - RNA, 9 nt, Homo sapiens
ggacacugc

SEQ ID NO: 1622187 - RNA, 11 nt, Homo sapiens
ggacacuguac

SEQ ID NO: 1622188 - RNA, 19 nt, Homo sapiens
ggacagggcugucucugaa

SEQ ID NO: 1622189 - RNA, 12 nt, Homo sapiens
ggacaguggcag

SEQ ID NO: 1622190 - RNA, 21 nt, Homo sapiens
ggacaugagaucagggccugc

SEQ ID NO: 1622191 - RNA, 19 nt, Homo sapiens
ggacaugcuuuucugccac

SEQ ID NO: 1622192 - RNA, 22 nt, Homo sapiens
ggacauucuaaugcauauuuau

SEQ ID NO: 1622193 - RNA, 13 nt, Homo sapiens
agacuaacauguc

SEQ ID NO: 1622194 - RNA, 20 nt, Homo sapiens
agacuaccggacacucguca

SEQ ID NO: 1622195 - RNA, 20 nt, Homo sapiens
agacucccaccccagggauu

SEQ ID NO: 1622196 - RNA, 19 nt, Homo sapiens
agacucucgcaucuuccca

SEQ ID NO: 1622197 - RNA, 19 nt, Homo sapiens
agacuguuucacauugcac

SEQ ID NO: 1622198 - RNA, 20 nt, Homo sapiens
agacuuuguguucauuucau

SEQ ID NO: 1622199 - RNA, 17 nt, Homo sapiens
agagaaauuucucauca

SEQ ID NO: 1622200 - RNA, 14 nt, Homo sapiens
agagaagcaagaca

SEQ ID NO: 1622201 - RNA, 22 nt, Homo sapiens
agagaagccaaacagcaagaag

SEQ ID NO: 1622202 - RNA, 14 nt, Homo sapiens
agagaaugaugaua

SEQ ID NO: 1622203 - RNA, 16 nt, Homo sapiens
agagaauguguguaga

SEQ ID NO: 1622204 - RNA, 23 nt, Homo sapiens
agagaauguguguguguggcagg

SEQ ID NO: 1622205 - RNA, 15 nt, Homo sapiens
agagaauuggcucaa

SEQ ID NO: 1622206 - RNA, 13 nt, Homo sapiens
agagacagaauuc

SEQ ID NO: 1622207 - RNA, 19 nt, Homo sapiens
agagacgguguuuugccau

SEQ ID NO: 1622208 - RNA, 13 nt, Homo sapiens
agagagggagaag

SEQ ID NO: 1622209 - RNA, 12 nt, Homo sapiens
agagagucccag

SEQ ID NO: 1622210 - RNA, 23 nt, Homo sapiens
agagauauuucaagcucauguca

SEQ ID NO: 1622211 - RNA, 19 nt, Homo sapiens
agagaucagcgacccugag

SEQ ID NO: 1622212 - RNA, 15 nt, Homo sapiens
agagaugacagggaa

SEQ ID NO: 1622213 - RNA, 17 nt, Homo sapiens
agagcaaaucuaugaga

SEQ ID NO: 1622214 - RNA, 21 nt, Homo sapiens
agagccucgcucuguuaccca

SEQ ID NO: 1622215 - RNA, 23 nt, Homo sapiens
agagcuaagggugggugcucaga

SEQ ID NO: 1622216 - RNA, 16 nt, Homo sapiens
agagcuagagggacaa

SEQ ID NO: 1622217 - RNA, 16 nt, Homo sapiens
agagcucuacaggccu

SEQ ID NO: 1622218 - RNA, 20 nt, Homo sapiens
agagcuuuuauuuggugugu

SEQ ID NO: 1622219 - RNA, 21 nt, Homo sapiens
agaggaaauucaaaucccuuu

SEQ ID NO: 1622220 - RNA, 22 nt, Homo sapiens
agaggaaugugggcuauguagu

SEQ ID NO: 1622221 - RNA, 19 nt, Homo sapiens
agaggaauuuauaccucaa

SEQ ID NO: 1622222 - RNA, 17 nt, Homo sapiens
agaggacaggcuacccc

SEQ ID NO: 1622223 - RNA, 19 nt, Homo sapiens
agaggacccuuacgugaga

SEQ ID NO: 1622224 - RNA, 13 nt, Homo sapiens
agaggagaaaaag

SEQ ID NO: 1622225 - RNA, 17 nt, Homo sapiens
agaggagucaaguaaug

SEQ ID NO: 1622226 - RNA, 14 nt, Homo sapiens
agaggagugugaag

SEQ ID NO: 1622227 - RNA, 14 nt, Homo sapiens
agaggccugugcua

SEQ ID NO: 1622228 - RNA, 14 nt, Homo sapiens
agaggccuuguccc

SEQ ID NO: 1622229 - RNA, 20 nt, Homo sapiens
agaggcugaggcuggcacag

SEQ ID NO: 1622230 - RNA, 18 nt, Homo sapiens
agagggauugcugugaaa

SEQ ID NO: 1622231 - RNA, 17 nt, Homo sapiens
agagggccuaaccgaga

SEQ ID NO: 1622232 - RNA, 12 nt, Homo sapiens
agaggggagcag

SEQ ID NO: 1622233 - RNA, 18 nt, Homo sapiens
agagggggcgaagggauc

SEQ ID NO: 1622234 - RNA, 14 nt, Homo sapiens
agaggucaccagcu

SEQ ID NO: 1622235 - RNA, 19 nt, Homo sapiens
agaguacuuaauauacuca

SEQ ID NO: 1622236 - RNA, 20 nt, Homo sapiens
agaguacuuaauauacucag

SEQ ID NO: 1622237 - RNA, 15 nt, Homo sapiens
agagucuaccuugaa

SEQ ID NO: 1622238 - RNA, 17 nt, Homo sapiens
agagugacggcuggcau

SEQ ID NO: 1622239 - RNA, 23 nt, Homo sapiens
agaguguguguuuguguguuuca

SEQ ID NO: 1622240 - RNA, 17 nt, Homo sapiens
agauaaacaaacaagcc

SEQ ID NO: 1622241 - RNA, 23 nt, Homo sapiens
agauauaucccggaugaggcuga

SEQ ID NO: 1622242 - RNA, 20 nt, Homo sapiens
agaucaaggaguacaaugcc

SEQ ID NO: 1622243 - RNA, 13 nt, Homo sapiens
agaucaaugguuu

SEQ ID NO: 1622244 - RNA, 12 nt, Homo sapiens
agaucacgccac

SEQ ID NO: 1622245 - RNA, 19 nt, Homo sapiens
agaucagcgacccugagga

SEQ ID NO: 1622246 - RNA, 21 nt, Homo sapiens
agaucauauuguauauaguua

SEQ ID NO: 1622247 - RNA, 14 nt, Homo sapiens
agaucauggcccac

SEQ ID NO: 1622248 - RNA, 17 nt, Homo sapiens
agauccaagaggcccug

SEQ ID NO: 1622249 - RNA, 22 nt, Homo sapiens
agauccugcagaaguacuccua

SEQ ID NO: 1622250 - RNA, 17 nt, Homo sapiens
agaugacccaaucugcc

SEQ ID NO: 1622251 - RNA, 18 nt, Homo sapiens
agaugacggaugccuaga

SEQ ID NO: 1622252 - RNA, 15 nt, Homo sapiens
agaugauacauccaa

SEQ ID NO: 1622253 - RNA, 16 nt, Homo sapiens
agaugcaaugugcuac

SEQ ID NO: 1622254 - RNA, 14 nt, Homo sapiens
agaugcagggcagu

SEQ ID NO: 1622255 - RNA, 21 nt, Homo sapiens
agauguacaaaacaguuugaa

SEQ ID NO: 1622256 - RNA, 22 nt, Homo sapiens
agauguauucuuuauaauugaa

SEQ ID NO: 1622257 - RNA, 19 nt, Homo sapiens
agauuacuuuuucuuuaug

SEQ ID NO: 1622258 - RNA, 20 nt, Homo sapiens
agauuuaaccccuccacugc

SEQ ID NO: 1622259 - RNA, 16 nt, Homo sapiens
agauuuuaaagacaaa

SEQ ID NO: 1622260 - RNA, 17 nt, Homo sapiens
agauuuucaugcaaaag

SEQ ID NO: 1622261 - RNA, 18 nt, Homo sapiens
agcaaaagggaggaacac

SEQ ID NO: 1622262 - RNA, 17 nt, Homo sapiens
agcaaacucugcugucu

SEQ ID NO: 1622263 - RNA, 17 nt, Homo sapiens
agcaagaagcuguuacc

SEQ ID NO: 1622264 - RNA, 15 nt, Homo sapiens
agcaaguuagaacua

SEQ ID NO: 1622265 - RNA, 20 nt, Homo sapiens
agcaaucauuuuaugcuguu

SEQ ID NO: 1622266 - RNA, 19 nt, Homo sapiens
agcaauuugaucaguauau

SEQ ID NO: 1622267 - RNA, 15 nt, Homo sapiens
agcacacagggcagu

SEQ ID NO: 1622268 - RNA, 19 nt, Homo sapiens
agcaccuacaguguacagu

SEQ ID NO: 1622269 - RNA, 21 nt, Homo sapiens
agcaccugcgggagcugcacu

SEQ ID NO: 1622270 - RNA, 23 nt, Homo sapiens
agcacuccccagagcugugccag

SEQ ID NO: 1622271 - RNA, 15 nt, Homo sapiens
agcacugccaggagg

SEQ ID NO: 1622272 - RNA, 20 nt, Homo sapiens
agcagaauguuguacuugaa

SEQ ID NO: 1622273 - RNA, 20 nt, Homo sapiens
agcaggaacuucuagcucau

SEQ ID NO: 1622274 - RNA, 20 nt, Homo sapiens
agcaggaggcuuucugggcu

SEQ ID NO: 1622275 - RNA, 18 nt, Homo sapiens
agcaggagguuaucugug

SEQ ID NO: 1622276 - RNA, 15 nt, Homo sapiens
agcaggaguggugca

SEQ ID NO: 1622277 - RNA, 13 nt, Homo sapiens
agcaggccaaaca

SEQ ID NO: 1622278 - RNA, 17 nt, Homo sapiens
agcaggggggcugugcc

SEQ ID NO: 1622279 - RNA, 22 nt, Homo sapiens
agcagggucuuuucaucuggga

SEQ ID NO: 1622280 - RNA, 14 nt, Homo sapiens
agcaguguuuuaga

SEQ ID NO: 1622281 - RNA, 19 nt, Homo sapiens
agcauaccugucucagcug

SEQ ID NO: 1622282 - RNA, 12 nt, Homo sapiens
agcauacuuugu

SEQ ID NO: 1622283 - RNA, 17 nt, Homo sapiens
agcaucagauggaagcu

SEQ ID NO: 1622284 - RNA, 14 nt, Homo sapiens
agcauccucuuuaa

SEQ ID NO: 1622285 - RNA, 17 nt, Homo sapiens
agcaucucccagcaaga

SEQ ID NO: 1622286 - RNA, 15 nt, Homo sapiens
agcauuacccuccuc

SEQ ID NO: 1622287 - RNA, 20 nt, Homo sapiens
agcauugccauaccauuccc

SEQ ID NO: 1622288 - RNA, 16 nt, Homo sapiens
agccaaggucaugcca

SEQ ID NO: 1622289 - RNA, 19 nt, Homo sapiens
agccaaggucaugccacug

SEQ ID NO: 1622290 - RNA, 18 nt, Homo sapiens
agccaauaccagccgcca

SEQ ID NO: 1622291 - RNA, 17 nt, Homo sapiens
agccacacuucucagga

SEQ ID NO: 1622292 - RNA, 13 nt, Homo sapiens
agccacacuugaa

SEQ ID NO: 1622293 - RNA, 14 nt, Homo sapiens
agccacacuugaac

SEQ ID NO: 1622294 - RNA, 11 nt, Homo sapiens
agccacagaug

SEQ ID NO: 1622295 - RNA, 15 nt, Homo sapiens
agccacaggaccacc

SEQ ID NO: 1622296 - RNA, 17 nt, Homo sapiens
agccacaggaccaccuc

SEQ ID NO: 1622297 - RNA, 21 nt, Homo sapiens
agccaccuugaccguagggga

SEQ ID NO: 1622298 - RNA, 21 nt, Homo sapiens
agccacuacauuacuucaaac

SEQ ID NO: 1622299 - RNA, 16 nt, Homo sapiens
agccagagacagagga

SEQ ID NO: 1622300 - RNA, 23 nt, Homo sapiens
agccagcccuccuugacccagaa

SEQ ID NO: 1622301 - RNA, 20 nt, Homo sapiens
agccagcuuacuagcacuuu

SEQ ID NO: 1622302 - RNA, 22 nt, Homo sapiens
agccagcuuacuagcacuuuga

SEQ ID NO: 1622303 - RNA, 18 nt, Homo sapiens
auaaaauguucagugcaa

SEQ ID NO: 1622304 - RNA, 22 nt, Homo sapiens
auaaaauguucagugcaaucag

SEQ ID NO: 1622305 - RNA, 16 nt, Homo sapiens
auaaacaacauugucu

SEQ ID NO: 1622306 - RNA, 24 nt, Homo sapiens
auaaacacacagaucugcaucuga

SEQ ID NO: 1622307 - RNA, 16 nt, Homo sapiens
auaaacucauuuaacu

SEQ ID NO: 1622308 - RNA, 16 nt, Homo sapiens
auaaacucauuuaucu

SEQ ID NO: 1622309 - RNA, 16 nt, Homo sapiens
auaaacugauuuaucu

SEQ ID NO: 1622310 - RNA, 22 nt, Homo sapiens
auaaacugauuuaucuauuuaa

SEQ ID NO: 1622311 - RNA, 15 nt, Homo sapiens
auaaacugugccaau

SEQ ID NO: 1622312 - RNA, 12 nt, Homo sapiens
auaaagccaugu

SEQ ID NO: 1622313 - RNA, 12 nt, Homo sapiens
auaaagcuuuau

SEQ ID NO: 1622314 - RNA, 13 nt, Homo sapiens
auaaagugacaga

SEQ ID NO: 1622315 - RNA, 15 nt, Homo sapiens
auaaauaaaguuucu

SEQ ID NO: 1622316 - RNA, 20 nt, Homo sapiens
auaaauaagaucagacucug

SEQ ID NO: 1622317 - RNA, 17 nt, Homo sapiens
auaaaucucuccuauaa

SEQ ID NO: 1622318 - RNA, 14 nt, Homo sapiens
auaaaugagugauu

SEQ ID NO: 1622319 - RNA, 22 nt, Homo sapiens
auaaauugcuuacugauauuau

SEQ ID NO: 1622320 - RNA, 20 nt, Homo sapiens
auaacaaaauggacauggug

SEQ ID NO: 1622321 - RNA, 17 nt, Homo sapiens
auaacauuuaaauucca

SEQ ID NO: 1622322 - RNA, 18 nt, Homo sapiens
auaacauuuaaauuccac

SEQ ID NO: 1622323 - RNA, 14 nt, Homo sapiens
auaacauuuacuuu

SEQ ID NO: 1622324 - RNA, 19 nt, Homo sapiens
auaacgcagucuaauuaca

SEQ ID NO: 1622325 - RNA, 14 nt, Homo sapiens
auaagcccaguuca

SEQ ID NO: 1622326 - RNA, 14 nt, Homo sapiens
auaaguaauaucuu

SEQ ID NO: 1622327 - RNA, 14 nt, Homo sapiens
auaauauacuguac

SEQ ID NO: 1622328 - RNA, 17 nt, Homo sapiens
auaaucaagggcacugu

SEQ ID NO: 1622329 - RNA, 17 nt, Homo sapiens
auaaucacacugcggua

SEQ ID NO: 1622330 - RNA, 17 nt, Homo sapiens
auaauguuaaccaagga

SEQ ID NO: 1622331 - RNA, 15 nt, Homo sapiens
auaauuggugcuauu

SEQ ID NO: 1622332 - RNA, 17 nt, Homo sapiens
auaauuuacuuuguaga

SEQ ID NO: 1622333 - RNA, 13 nt, Homo sapiens
auacaaacucuca

SEQ ID NO: 1622334 - RNA, 20 nt, Homo sapiens
auacaaucagcccagugcaa

SEQ ID NO: 1622335 - RNA, 21 nt, Homo sapiens
auacaaucagcccagugcaaa

SEQ ID NO: 1622336 - RNA, 22 nt, Homo sapiens
auacacagcuuuaugauaucaa

SEQ ID NO: 1622337 - RNA, 14 nt, Homo sapiens
auacacuaaccaaa

SEQ ID NO: 1622338 - RNA, 20 nt, Homo sapiens
auacacuuuuuaaaaucuca

SEQ ID NO: 1622339 - RNA, 21 nt, Homo sapiens
auacacuuuuuaaaaucucaa

SEQ ID NO: 1622340 - RNA, 11 nt, Homo sapiens
auacagugaag

SEQ ID NO: 1622341 - RNA, 23 nt, Homo sapiens
auacauguaucugguuugucagg

SEQ ID NO: 1622342 - RNA, 18 nt, Homo sapiens
auacccugcccuugacau

SEQ ID NO: 1622343 - RNA, 20 nt, Homo sapiens
auaccucaaacuaucuggcc

SEQ ID NO: 1622344 - RNA, 23 nt, Homo sapiens
auacugcugcgucauuacagggc

SEQ ID NO: 1622345 - RNA, 12 nt, Homo sapiens
auacuguucuca

SEQ ID NO: 1622346 - RNA, 17 nt, Homo sapiens
auacuugaccuugcaug

SEQ ID NO: 1622347 - RNA, 13 nt, Homo sapiens
auagacaccaaaa

SEQ ID NO: 1622348 - RNA, 18 nt, Homo sapiens
auagacacugaucuggcu

SEQ ID NO: 1622349 - RNA, 12 nt, Homo sapiens
auagaccacugg

SEQ ID NO: 1622350 - RNA, 15 nt, Homo sapiens
auagacuuaauacau

SEQ ID NO: 1622351 - RNA, 19 nt, Homo sapiens
auagacuuauugccaaaaa

SEQ ID NO: 1622352 - RNA, 12 nt, Homo sapiens
auagauaaguca

SEQ ID NO: 1622353 - RNA, 14 nt, Homo sapiens
auagcaagugaaag

SEQ ID NO: 1622354 - RNA, 12 nt, Homo sapiens
auagcaucuccu

SEQ ID NO: 1622355 - RNA, 22 nt, Homo sapiens
auagcuaagcaucuccuuacag

SEQ ID NO: 1622356 - RNA, 22 nt, Homo sapiens
auagcugccacuggcaugcucu

SEQ ID NO: 1622357 - RNA, 15 nt, Homo sapiens
auagcuuuuacucug

SEQ ID NO: 1622358 - RNA, 18 nt, Homo sapiens
auaggaagauaugccacu

SEQ ID NO: 1622359 - RNA, 22 nt, Homo sapiens
auaggaagauaugccacuaacu

SEQ ID NO: 1622360 - RNA, 16 nt, Homo sapiens
auaggagccccaggca

SEQ ID NO: 1622361 - RNA, 18 nt, Homo sapiens
auagguucaaaagcaauc

SEQ ID NO: 1622362 - RNA, 16 nt, Homo sapiens
auaguaguuacuguca

SEQ ID NO: 1622363 - RNA, 20 nt, Homo sapiens
auagugagauuuaaguuccu

SEQ ID NO: 1622364 - RNA, 13 nt, Homo sapiens
auauaacaaauaa

SEQ ID NO: 1622365 - RNA, 19 nt, Homo sapiens
auauacugcugaucuugca

SEQ ID NO: 1622366 - RNA, 15 nt, Homo sapiens
auauagccauugauc

SEQ ID NO: 1622367 - RNA, 12 nt, Homo sapiens
auauauuuugca

SEQ ID NO: 1622368 - RNA, 14 nt, Homo sapiens
auaucaaucaagcc

SEQ ID NO: 1622369 - RNA, 11 nt, Homo sapiens
auaucacucua

SEQ ID NO: 1622370 - RNA, 14 nt, Homo sapiens
auaucagcacauau

SEQ ID NO: 1622371 - RNA, 18 nt, Homo sapiens
auaucagggccugaguga

SEQ ID NO: 1622372 - RNA, 20 nt, Homo sapiens
auaucagggguacauucuag

SEQ ID NO: 1622373 - RNA, 11 nt, Homo sapiens
auaucuuggcc

SEQ ID NO: 1622374 - RNA, 19 nt, Homo sapiens
auaugaagaagacaccucu

SEQ ID NO: 1622375 - RNA, 20 nt, Homo sapiens
auaugaucaguguuacugcc

SEQ ID NO: 1622376 - RNA, 21 nt, Homo sapiens
auaugccuuggggaggacaaa

SEQ ID NO: 1622377 - RNA, 22 nt, Homo sapiens
auaugccuuggggaggacaaaa

SEQ ID NO: 1622378 - RNA, 19 nt, Homo sapiens
auaugcugacuucacuuau

SEQ ID NO: 1622379 - RNA, 20 nt, Homo sapiens
auaugcuuggcuaacuauau

SEQ ID NO: 1622380 - RNA, 21 nt, Homo sapiens
auaugguccuagacaaaccau

SEQ ID NO: 1622381 - RNA, 19 nt, Homo sapiens
auaugguguacauucuucc

SEQ ID NO: 1622382 - RNA, 17 nt, Homo sapiens
auaugucuuacuacuuu

SEQ ID NO: 1622383 - RNA, 13 nt, Homo sapiens
auaugucuugcaa

SEQ ID NO: 1622384 - RNA, 14 nt, Homo sapiens
auauuagggaguaa

SEQ ID NO: 1622385 - RNA, 21 nt, Homo sapiens
auauucugaagcaacauuuua

SEQ ID NO: 1622386 - RNA, 21 nt, Homo sapiens
auauucuuccccgaaucacac

SEQ ID NO: 1622387 - RNA, 18 nt, Homo sapiens
auauuguaaagauccuau

SEQ ID NO: 1622388 - RNA, 22 nt, Homo sapiens
auauuuuaucuugguaguacau

SEQ ID NO: 1622389 - RNA, 18 nt, Homo sapiens
auauuuuguuuugugcag

SEQ ID NO: 1622390 - RNA, 14 nt, Homo sapiens
aucaaauacuagua

SEQ ID NO: 1622391 - RNA, 12 nt, Homo sapiens
aucaacaugacu

SEQ ID NO: 1622392 - RNA, 15 nt, Homo sapiens
aucaacuaaugauuu

SEQ ID NO: 1622393 - RNA, 12 nt, Homo sapiens
aucaagauauau

SEQ ID NO: 1622394 - RNA, 13 nt, Homo sapiens
aucaagguucagc

SEQ ID NO: 1622395 - RNA, 22 nt, Homo sapiens
aucaauaaauguugcaaugcau

SEQ ID NO: 1622396 - RNA, 23 nt, Homo sapiens
aucaauacugcacacugcacauu

SEQ ID NO: 1622397 - RNA, 22 nt, Homo sapiens
aucaauauuuuuauaucaugca

SEQ ID NO: 1622398 - RNA, 19 nt, Homo sapiens
aucaaucugcaguuuaaca

SEQ ID NO: 1622399 - RNA, 20 nt, Homo sapiens
aucacaaaccaagccaugcu

SEQ ID NO: 1622400 - RNA, 15 nt, Homo sapiens
aucacaaauuucacu

SEQ ID NO: 1622401 - RNA, 13 nt, Homo sapiens
aucacacucucca

SEQ ID NO: 1622402 - RNA, 14 nt, Homo sapiens
aucacacucuccau

SEQ ID NO: 1622403 - RNA, 16 nt, Homo sapiens
aucacagccucacccc

SEQ ID NO: 1622404 - RNA, 21 nt, Homo sapiens
aucacaugaccacauagcaug

SEQ ID NO: 1622405 - RNA, 16 nt, Homo sapiens
aucacauuaacauuuu

SEQ ID NO: 1622406 - RNA, 17 nt, Homo sapiens
aucacauuccucugccc

SEQ ID NO: 1622407 - RNA, 14 nt, Homo sapiens
aucaccagugccac

SEQ ID NO: 1622408 - RNA, 15 nt, Homo sapiens
aucaccuacucacac

SEQ ID NO: 1622409 - RNA, 18 nt, Homo sapiens
aucacgggucacuugaaa

SEQ ID NO: 1622410 - RNA, 19 nt, Homo sapiens
aucacuucauucacauuca

SEQ ID NO: 1622411 - RNA, 22 nt, Homo sapiens
aucagauugcaugugacucuga

SEQ ID NO: 1622412 - RNA, 16 nt, Homo sapiens
aucagcccagugcaaa

SEQ ID NO: 1622413 - RNA, 20 nt, Homo sapiens
auuaugauuaaucugauuau

SEQ ID NO: 1622414 - RNA, 21 nt, Homo sapiens
auuauggaaaacuguguugcc

SEQ ID NO: 1622415 - RNA, 18 nt, Homo sapiens
auuauguggcccucugga

SEQ ID NO: 1622416 - RNA, 13 nt, Homo sapiens
auuauguuuauuu

SEQ ID NO: 1622417 - RNA, 17 nt, Homo sapiens
auuauuccaagccuuau

SEQ ID NO: 1622418 - RNA, 18 nt, Homo sapiens
auuauuguagacaugccc

SEQ ID NO: 1622419 - RNA, 19 nt, Homo sapiens
auucaagggacccaugagu

SEQ ID NO: 1622420 - RNA, 14 nt, Homo sapiens
auucacagucucau

SEQ ID NO: 1622421 - RNA, 15 nt, Homo sapiens
auucagauaauuaga

SEQ ID NO: 1622422 - RNA, 17 nt, Homo sapiens
auucaggcaacgcacaa

SEQ ID NO: 1622423 - RNA, 17 nt, Homo sapiens
auucauggcuaccucag

SEQ ID NO: 1622424 - RNA, 15 nt, Homo sapiens
auucauuuaacagag

SEQ ID NO: 1622425 - RNA, 17 nt, Homo sapiens
auucauuuggugacugu

SEQ ID NO: 1622426 - RNA, 22 nt, Homo sapiens
auucauuuuuaagauagaacac

SEQ ID NO: 1622427 - RNA, 14 nt, Homo sapiens
auuccacacuacca

SEQ ID NO: 1622428 - RNA, 20 nt, Homo sapiens
auucccuuaaugguguuguu

SEQ ID NO: 1622429 - RNA, 21 nt, Homo sapiens
auuccuuccacuaacucauag

SEQ ID NO: 1622430 - RNA, 23 nt, Homo sapiens
auucuaacccaagacaugacauu

SEQ ID NO: 1622431 - RNA, 22 nt, Homo sapiens
auucuaacccagguauccaaaa

SEQ ID NO: 1622432 - RNA, 16 nt, Homo sapiens
auucuagagcuuuuau

SEQ ID NO: 1622433 - RNA, 18 nt, Homo sapiens
auucuaggaaaucagaag

SEQ ID NO: 1622434 - RNA, 13 nt, Homo sapiens
auucucaggccaa

SEQ ID NO: 1622435 - RNA, 15 nt, Homo sapiens
auucuccugccucag

SEQ ID NO: 1622436 - RNA, 16 nt, Homo sapiens
auucuccugccuuagc

SEQ ID NO: 1622437 - RNA, 21 nt, Homo sapiens
auucucucaucuaacugauga

SEQ ID NO: 1622438 - RNA, 15 nt, Homo sapiens
auucucucucuaagu

SEQ ID NO: 1622439 - RNA, 17 nt, Homo sapiens
auucugagcauacucaa

SEQ ID NO: 1622440 - RNA, 19 nt, Homo sapiens
auucugauauguauccauc

SEQ ID NO: 1622441 - RNA, 14 nt, Homo sapiens
auucugucauuuca

SEQ ID NO: 1622442 - RNA, 14 nt, Homo sapiens
auucugugacauuu

SEQ ID NO: 1622443 - RNA, 20 nt, Homo sapiens
auucuguuuaucaagccaua

SEQ ID NO: 1622444 - RNA, 21 nt, Homo sapiens
auucuuaacuuauuaccucag

SEQ ID NO: 1622445 - RNA, 18 nt, Homo sapiens
auucuuacccuguacaua

SEQ ID NO: 1622446 - RNA, 21 nt, Homo sapiens
auucuucagcguaaaauggug

SEQ ID NO: 1622447 - RNA, 18 nt, Homo sapiens
auucuuccccgaaucaca

SEQ ID NO: 1622448 - RNA, 22 nt, Homo sapiens
auucuuccucaaagcauuugca

SEQ ID NO: 1622449 - RNA, 15 nt, Homo sapiens
auucuuuuaaugcca

SEQ ID NO: 1622450 - RNA, 14 nt, Homo sapiens
auugaacuguacca

SEQ ID NO: 1622451 - RNA, 18 nt, Homo sapiens
auugaauguuaaugguca

SEQ ID NO: 1622452 - RNA, 13 nt, Homo sapiens
auugacucauaca

SEQ ID NO: 1622453 - RNA, 16 nt, Homo sapiens
auugacuccuuuccaa

SEQ ID NO: 1622454 - RNA, 22 nt, Homo sapiens
auugacuuucaguaaacauaaa

SEQ ID NO: 1622455 - RNA, 15 nt, Homo sapiens
auugagauacuugac

SEQ ID NO: 1622456 - RNA, 18 nt, Homo sapiens
auugagcagaagaucaag

SEQ ID NO: 1622457 - RNA, 21 nt, Homo sapiens
auugagcagaagaucaaggag

SEQ ID NO: 1622458 - RNA, 15 nt, Homo sapiens
auugagguuuccaca

SEQ ID NO: 1622459 - RNA, 19 nt, Homo sapiens
auugauccagucauuuuau

SEQ ID NO: 1622460 - RNA, 13 nt, Homo sapiens
auugcacucauca

SEQ ID NO: 1622461 - RNA, 15 nt, Homo sapiens
auugcaugugacucu

SEQ ID NO: 1622462 - RNA, 17 nt, Homo sapiens
auugccuagaggugcuc

SEQ ID NO: 1622463 - RNA, 18 nt, Homo sapiens
auugcucccaggaucucc

SEQ ID NO: 1622464 - RNA, 19 nt, Homo sapiens
auugcucucccagcccuug

SEQ ID NO: 1622465 - RNA, 13 nt, Homo sapiens
auugcugccaaga

SEQ ID NO: 1622466 - RNA, 17 nt, Homo sapiens
auugcugccaaggugga

SEQ ID NO: 1622467 - RNA, 22 nt, Homo sapiens
auugcuugaguuauauguucac

SEQ ID NO: 1622468 - RNA, 22 nt, Homo sapiens
auuggaaugcagaggucuccaa

SEQ ID NO: 1622469 - RNA, 19 nt, Homo sapiens
auuguacccccucauuugu

SEQ ID NO: 1622470 - RNA, 17 nt, Homo sapiens
auuguaucaggcaagau

SEQ ID NO: 1622471 - RNA, 20 nt, Homo sapiens
auugucgguuaccucugcau

SEQ ID NO: 1622472 - RNA, 15 nt, Homo sapiens
auugugcaguacuuu

SEQ ID NO: 1622473 - RNA, 18 nt, Homo sapiens
auuguuccaguacuaugg

SEQ ID NO: 1622474 - RNA, 16 nt, Homo sapiens
auuguuguugccaaag

SEQ ID NO: 1622475 - RNA, 16 nt, Homo sapiens
auuguuugaaacaaag

SEQ ID NO: 1622476 - RNA, 19 nt, Homo sapiens
auuuaaaauaacacuugcc

SEQ ID NO: 1622477 - RNA, 23 nt, Homo sapiens
auuuaaauuacaauuuuaucugu

SEQ ID NO: 1622478 - RNA, 17 nt, Homo sapiens
auuuaaauuccacagau

SEQ ID NO: 1622479 - RNA, 11 nt, Homo sapiens
auuuaacuuaa

SEQ ID NO: 1622480 - RNA, 14 nt, Homo sapiens
auuuaagacacugu

SEQ ID NO: 1622481 - RNA, 12 nt, Homo sapiens
auuuaagugaau

SEQ ID NO: 1622482 - RNA, 20 nt, Homo sapiens
auuuaagugaauacauuaac

SEQ ID NO: 1622483 - RNA, 15 nt, Homo sapiens
auuuaauuacuacua

SEQ ID NO: 1622484 - RNA, 14 nt, Homo sapiens
auuuacaagcacga

SEQ ID NO: 1622485 - RNA, 14 nt, Homo sapiens
auuuacuaaaucaa

SEQ ID NO: 1622486 - RNA, 22 nt, Homo sapiens
auuuacuaaaucaaucugcagu

SEQ ID NO: 1622487 - RNA, 17 nt, Homo sapiens
auuuagauauaacacua

SEQ ID NO: 1622488 - RNA, 19 nt, Homo sapiens
auuuaguguuuuuaccucu

SEQ ID NO: 1622489 - RNA, 12 nt, Homo sapiens
auuuaucugugu

SEQ ID NO: 1622490 - RNA, 15 nt, Homo sapiens
auuuauuugguguuu

SEQ ID NO: 1622491 - RNA, 15 nt, Homo sapiens
auuuauuuuuugcca

SEQ ID NO: 1622492 - RNA, 14 nt, Homo sapiens
auuucaagcuauaa

SEQ ID NO: 1622493 - RNA, 15 nt, Homo sapiens
auuucagauauucca

SEQ ID NO: 1622494 - RNA, 20 nt, Homo sapiens
auuucauaaauaaaggugua

SEQ ID NO: 1622495 - RNA, 15 nt, Homo sapiens
auuucauccuugaau

SEQ ID NO: 1622496 - RNA, 22 nt, Homo sapiens
auuucauccuugaauccuaugu

SEQ ID NO: 1622497 - RNA, 13 nt, Homo sapiens
auuucauugcacu

SEQ ID NO: 1622498 - RNA, 15 nt, Homo sapiens
auuuccuucugcuau

SEQ ID NO: 1622499 - RNA, 12 nt, Homo sapiens
auuucucuguga

SEQ ID NO: 1622500 - RNA, 17 nt, Homo sapiens
auuucucuuuacuugaa

SEQ ID NO: 1622501 - RNA, 18 nt, Homo sapiens
auuucuuggcaugcaucu

SEQ ID NO: 1622502 - RNA, 22 nt, Homo sapiens
auuugaauagccuguuccuuua

SEQ ID NO: 1622503 - RNA, 14 nt, Homo sapiens
auuugaugcauguc

SEQ ID NO: 1622504 - RNA, 17 nt, Homo sapiens
auuugccagagccaaau

SEQ ID NO: 1622505 - RNA, 20 nt, Homo sapiens
auuuguaguggaaacauuua

SEQ ID NO: 1622506 - RNA, 20 nt, Homo sapiens
auuuguaugcucauugaacu

SEQ ID NO: 1622507 - RNA, 16 nt, Homo sapiens
auuugugucacaaaga

SEQ ID NO: 1622508 - RNA, 18 nt, Homo sapiens
auuuguuaagguucaaga

SEQ ID NO: 1622509 - RNA, 19 nt, Homo sapiens
auuuuaaaacucuacagau

SEQ ID NO: 1622510 - RNA, 23 nt, Homo sapiens
auuuuaaugauaaaauagccaag

SEQ ID NO: 1622511 - RNA, 12 nt, Homo sapiens
auuuuaccauac

SEQ ID NO: 1622512 - RNA, 18 nt, Homo sapiens
auuuuaccuaguuugcac

SEQ ID NO: 1622513 - RNA, 13 nt, Homo sapiens
auuuuacuaaaaa

SEQ ID NO: 1622514 - RNA, 17 nt, Homo sapiens
auuuucaaaagcauuaa

SEQ ID NO: 1622515 - RNA, 22 nt, Homo sapiens
auuuucaagagucuaauagucu

SEQ ID NO: 1622516 - RNA, 22 nt, Homo sapiens
auuuucccccacuacugcagca

SEQ ID NO: 1622517 - RNA, 17 nt, Homo sapiens
auuuuccuuuguagcua

SEQ ID NO: 1622518 - RNA, 22 nt, Homo sapiens
auuuucucuuuguaugucuguu

SEQ ID NO: 1622519 - RNA, 16 nt, Homo sapiens
auuuugagguuuagca

SEQ ID NO: 1622520 - RNA, 20 nt, Homo sapiens
auuuugcuaagacauaaucu

SEQ ID NO: 1622521 - RNA, 19 nt, Homo sapiens
auuuuguaaaauauuaugu

SEQ ID NO: 1622522 - RNA, 21 nt, Homo sapiens
auuuuuaauguuuguacacaa

SEQ ID NO: 1622523 - RNA, 22 nt, Homo sapiens
caggcaagcccggguucuaccc

SEQ ID NO: 1622524 - RNA, 15 nt, Homo sapiens
caggcaaugcuguac

SEQ ID NO: 1622525 - RNA, 16 nt, Homo sapiens
caggcagcgccaagug

SEQ ID NO: 1622526 - RNA, 15 nt, Homo sapiens
caggcagggugcagu

SEQ ID NO: 1622527 - RNA, 17 nt, Homo sapiens
caggccauggauggaaa

SEQ ID NO: 1622528 - RNA, 14 nt, Homo sapiens
caggcgccugccac

SEQ ID NO: 1622529 - RNA, 16 nt, Homo sapiens
caggcuggagugcaau

SEQ ID NO: 1622530 - RNA, 19 nt, Homo sapiens
caggcuggagugcaauggc

SEQ ID NO: 1622531 - RNA, 20 nt, Homo sapiens
caggcuggagugcaguggca

SEQ ID NO: 1622532 - RNA, 20 nt, Homo sapiens
caggcuggucucaaacuccu

SEQ ID NO: 1622533 - RNA, 14 nt, Homo sapiens
cagggaacuuagua

SEQ ID NO: 1622534 - RNA, 22 nt, Homo sapiens
cagggacacuccaacucuacac

SEQ ID NO: 1622535 - RNA, 20 nt, Homo sapiens
cagggagaggucaccagcug

SEQ ID NO: 1622536 - RNA, 15 nt, Homo sapiens
cagggagaugucuag

SEQ ID NO: 1622537 - RNA, 15 nt, Homo sapiens
cagggccacauagau

SEQ ID NO: 1622538 - RNA, 14 nt, Homo sapiens
cagggcccagugac

SEQ ID NO: 1622539 - RNA, 17 nt, Homo sapiens
cagggcccccaucucau

SEQ ID NO: 1622540 - RNA, 14 nt, Homo sapiens
cagggccucaggca

SEQ ID NO: 1622541 - RNA, 20 nt, Homo sapiens
cagggcucauuuuugcacuu

SEQ ID NO: 1622542 - RNA, 22 nt, Homo sapiens
cagggcucuaaugugucucuca

SEQ ID NO: 1622543 - RNA, 20 nt, Homo sapiens
caggggugagccaccgugcc

SEQ ID NO: 1622544 - RNA, 13 nt, Homo sapiens
caggguaccucaa

SEQ ID NO: 1622545 - RNA, 20 nt, Homo sapiens
caggguaccucaagccccau

SEQ ID NO: 1622546 - RNA, 17 nt, Homo sapiens
cagggugaggugcuuga

SEQ ID NO: 1622547 - RNA, 16 nt, Homo sapiens
caggguggagugcagu

SEQ ID NO: 1622548 - RNA, 18 nt, Homo sapiens
caggguggagugcagugg

SEQ ID NO: 1622549 - RNA, 23 nt, Homo sapiens
caggguggcagaacuugaagggu

SEQ ID NO: 1622550 - RNA, 18 nt, Homo sapiens
caggguuggggugguuuu

SEQ ID NO: 1622551 - RNA, 17 nt, Homo sapiens
cagguaagucugguuuu

SEQ ID NO: 1622552 - RNA, 14 nt, Homo sapiens
caggucaccaagca

SEQ ID NO: 1622553 - RNA, 21 nt, Homo sapiens
caggugauccgcccaccucag

SEQ ID NO: 1622554 - RNA, 23 nt, Homo sapiens
caggugauuuguaugcucauuga

SEQ ID NO: 1622555 - RNA, 22 nt, Homo sapiens
caggugcugacuucaucuccca

SEQ ID NO: 1622556 - RNA, 12 nt, Homo sapiens
cagguguggaac

SEQ ID NO: 1622557 - RNA, 16 nt, Homo sapiens
cagguuaaugcugaaa

SEQ ID NO: 1622558 - RNA, 15 nt, Homo sapiens
cagguugaucuugaa

SEQ ID NO: 1622559 - RNA, 13 nt, Homo sapiens
caguaaacauaaa

SEQ ID NO: 1622560 - RNA, 12 nt, Homo sapiens
caguaagccaag

SEQ ID NO: 1622561 - RNA, 14 nt, Homo sapiens
caguagcccagagu

SEQ ID NO: 1622562 - RNA, 21 nt, Homo sapiens
caguauaccuaucugcugcac

SEQ ID NO: 1622563 - RNA, 19 nt, Homo sapiens
caguauuuucuccacuuca

SEQ ID NO: 1622564 - RNA, 13 nt, Homo sapiens
cagucacagccac

SEQ ID NO: 1622565 - RNA, 13 nt, Homo sapiens
cagucaggaugag

SEQ ID NO: 1622566 - RNA, 16 nt, Homo sapiens
caguccucccuagcuc

SEQ ID NO: 1622567 - RNA, 16 nt, Homo sapiens
cagucucauuuugaca

SEQ ID NO: 1622568 - RNA, 23 nt, Homo sapiens
cagucuuccucccuguguauuca

SEQ ID NO: 1622569 - RNA, 21 nt, Homo sapiens
cagugaaggucuuuguuauga

SEQ ID NO: 1622570 - RNA, 14 nt, Homo sapiens
cagugacuccugcu

SEQ ID NO: 1622571 - RNA, 16 nt, Homo sapiens
cagugcagguauuuca

SEQ ID NO: 1622572 - RNA, 16 nt, Homo sapiens
cagugccaacuccuca

SEQ ID NO: 1622573 - RNA, 18 nt, Homo sapiens
cagugccaugacugagaa

SEQ ID NO: 1622574 - RNA, 14 nt, Homo sapiens
caguggauucucau

SEQ ID NO: 1622575 - RNA, 17 nt, Homo sapiens
cagugggggcagagcca

SEQ ID NO: 1622576 - RNA, 14 nt, Homo sapiens
caguguacagucuu

SEQ ID NO: 1622577 - RNA, 17 nt, Homo sapiens
caguuccccgagaacuu

SEQ ID NO: 1622578 - RNA, 15 nt, Homo sapiens
caguucccucuugcu

SEQ ID NO: 1622579 - RNA, 17 nt, Homo sapiens
caguucucuacucccuc

SEQ ID NO: 1622580 - RNA, 15 nt, Homo sapiens
caguuguguugacac

SEQ ID NO: 1622581 - RNA, 20 nt, Homo sapiens
caguuuuguacauagcaaau

SEQ ID NO: 1622582 - RNA, 21 nt, Homo sapiens
cauaaaaucuuggcgagucau

SEQ ID NO: 1622583 - RNA, 13 nt, Homo sapiens
cauaaagcauugg

SEQ ID NO: 1622584 - RNA, 12 nt, Homo sapiens
cauaaagcauuu

SEQ ID NO: 1622585 - RNA, 18 nt, Homo sapiens
cauaagauauucuuuaca

SEQ ID NO: 1622586 - RNA, 14 nt, Homo sapiens
cauaaucuguacaa

SEQ ID NO: 1622587 - RNA, 15 nt, Homo sapiens
cauaaucuguacaau

SEQ ID NO: 1622588 - RNA, 19 nt, Homo sapiens
cauaaucuguacaaugaac

SEQ ID NO: 1622589 - RNA, 19 nt, Homo sapiens
cauacaccacaaaaaccaa

SEQ ID NO: 1622590 - RNA, 14 nt, Homo sapiens
cauacgguucuguu

SEQ ID NO: 1622591 - RNA, 19 nt, Homo sapiens
cauacucuguugccuccuc

SEQ ID NO: 1622592 - RNA, 16 nt, Homo sapiens
cauacuuaaugcauau

SEQ ID NO: 1622593 - RNA, 14 nt, Homo sapiens
cauagaaaacuuga

SEQ ID NO: 1622594 - RNA, 23 nt, Homo sapiens
cauagaaaaggcgugcaguacua

SEQ ID NO: 1622595 - RNA, 19 nt, Homo sapiens
cauagaaagccaugugcua

SEQ ID NO: 1622596 - RNA, 23 nt, Homo sapiens
cauagagaugagcccacccugcu

SEQ ID NO: 1622597 - RNA, 22 nt, Homo sapiens
cauagaguagguacuccauaaa

SEQ ID NO: 1622598 - RNA, 18 nt, Homo sapiens
cauagucuuuguuuacau

SEQ ID NO: 1622599 - RNA, 21 nt, Homo sapiens
cauagucuuuguuuacaugag

SEQ ID NO: 1622600 - RNA, 20 nt, Homo sapiens
cauauaacgcagucuaauua

SEQ ID NO: 1622601 - RNA, 15 nt, Homo sapiens
cauauagacuguaca

SEQ ID NO: 1622602 - RNA, 21 nt, Homo sapiens
cauauauuaccccuucauguc

SEQ ID NO: 1622603 - RNA, 20 nt, Homo sapiens
cauaucagggguacauucua

SEQ ID NO: 1622604 - RNA, 22 nt, Homo sapiens
cauaugccuuggggaggacaaa

SEQ ID NO: 1622605 - RNA, 17 nt, Homo sapiens
cauaugucuuacuacuu

SEQ ID NO: 1622606 - RNA, 18 nt, Homo sapiens
cauauuguacccccucau

SEQ ID NO: 1622607 - RNA, 16 nt, Homo sapiens
caucacgucaagcuuu

SEQ ID NO: 1622608 - RNA, 15 nt, Homo sapiens
caucaucuaagguga

SEQ ID NO: 1622609 - RNA, 17 nt, Homo sapiens
cauccagaaguuccuca

SEQ ID NO: 1622610 - RNA, 15 nt, Homo sapiens
cauccagagaugacu

SEQ ID NO: 1622611 - RNA, 24 nt, Homo sapiens
cauccauguuccgagaagaacaga

SEQ ID NO: 1622612 - RNA, 16 nt, Homo sapiens
caucccacugcucccc

SEQ ID NO: 1622613 - RNA, 15 nt, Homo sapiens
caucccuggaaggac

SEQ ID NO: 1622614 - RNA, 22 nt, Homo sapiens
cauccucugauagcuguuucaa

SEQ ID NO: 1622615 - RNA, 13 nt, Homo sapiens
cauccuucuccag

SEQ ID NO: 1622616 - RNA, 21 nt, Homo sapiens
cauccuuguuuugaaaaccua

SEQ ID NO: 1622617 - RNA, 21 nt, Homo sapiens
caucgauuuucuauuauggaa

SEQ ID NO: 1622618 - RNA, 19 nt, Homo sapiens
caucuagggaaugggacug

SEQ ID NO: 1622619 - RNA, 22 nt, Homo sapiens
caucuagggaaugggacuguga

SEQ ID NO: 1622620 - RNA, 13 nt, Homo sapiens
caucucuaauaau

SEQ ID NO: 1622621 - RNA, 22 nt, Homo sapiens
caucucuugaaaccuguuaaaa

SEQ ID NO: 1622622 - RNA, 21 nt, Homo sapiens
caucugaaaguagagguugua

SEQ ID NO: 1622623 - RNA, 20 nt, Homo sapiens
caucugacugccaagccaga

SEQ ID NO: 1622624 - RNA, 22 nt, Homo sapiens
caucugcuuuucccauugccau

SEQ ID NO: 1622625 - RNA, 15 nt, Homo sapiens
caucuggaaaccucu

SEQ ID NO: 1622626 - RNA, 22 nt, Homo sapiens
caucugugcacugcccauggac

SEQ ID NO: 1622627 - RNA, 18 nt, Homo sapiens
caucuuggggacaucucu

SEQ ID NO: 1622628 - RNA, 14 nt, Homo sapiens
caucuuuaacacaa

SEQ ID NO: 1622629 - RNA, 24 nt, Homo sapiens
caugaacguuauuauauugucgaa

SEQ ID NO: 1622630 - RNA, 22 nt, Homo sapiens
caugaauaacauuuaaauucca

SEQ ID NO: 1622631 - RNA, 11 nt, Homo sapiens
caugaauucau

SEQ ID NO: 1622632 - RNA, 21 nt, Homo sapiens
gccccauggaggguauacuga

SEQ ID NO: 1622633 - RNA, 21 nt, Homo sapiens
gcccccaccgugggcagggag

SEQ ID NO: 1622634 - RNA, 19 nt, Homo sapiens
gccccuggggcuuccaucc

SEQ ID NO: 1622635 - RNA, 17 nt, Homo sapiens
gcccucacaucuuccac

SEQ ID NO: 1622636 - RNA, 16 nt, Homo sapiens
gcccucagacauuuau

SEQ ID NO: 1622637 - RNA, 16 nt, Homo sapiens
gcccucagacugucag

SEQ ID NO: 1622638 - RNA, 19 nt, Homo sapiens
gcccucccagcccauugcu

SEQ ID NO: 1622639 - RNA, 18 nt, Homo sapiens
gcccucggguccaugugu

SEQ ID NO: 1622640 - RNA, 19 nt, Homo sapiens
gcccugagcuuuguccuga

SEQ ID NO: 1622641 - RNA, 15 nt, Homo sapiens
gcccugcccacagaa

SEQ ID NO: 1622642 - RNA, 18 nt, Homo sapiens
gcccugccuggaggaccu

SEQ ID NO: 1622643 - RNA, 16 nt, Homo sapiens
gcccugcgggugaaca

SEQ ID NO: 1622644 - RNA, 22 nt, Homo sapiens
gcccugggaccgcuacaccacu

SEQ ID NO: 1622645 - RNA, 18 nt, Homo sapiens
gcccuggggccuguacug

SEQ ID NO: 1622646 - RNA, 21 nt, Homo sapiens
gcccuguaauuuuucugggaa

SEQ ID NO: 1622647 - RNA, 18 nt, Homo sapiens
gcccuuguccccaugaaa

SEQ ID NO: 1622648 - RNA, 19 nt, Homo sapiens
gcccuuugcuaaaauauaa

SEQ ID NO: 1622649 - RNA, 15 nt, Homo sapiens
gccgaguccaagcug

SEQ ID NO: 1622650 - RNA, 12 nt, Homo sapiens
gccggcacucca

SEQ ID NO: 1622651 - RNA, 19 nt, Homo sapiens
gccgugugagugugacagg

SEQ ID NO: 1622652 - RNA, 23 nt, Homo sapiens
gccguuuccccuccuuggcuuua

SEQ ID NO: 1622653 - RNA, 20 nt, Homo sapiens
gccuaacacacuccaagaua

SEQ ID NO: 1622654 - RNA, 23 nt, Homo sapiens
gccuaauaguaacugguuaaaaa

SEQ ID NO: 1622655 - RNA, 19 nt, Homo sapiens
gccucccuuugugugcaua

SEQ ID NO: 1622656 - RNA, 20 nt, Homo sapiens
gccuccuggcuucacgccau

SEQ ID NO: 1622657 - RNA, 16 nt, Homo sapiens
gccucugcauauaugu

SEQ ID NO: 1622658 - RNA, 21 nt, Homo sapiens
gccucugugccgcaccauuga

SEQ ID NO: 1622659 - RNA, 18 nt, Homo sapiens
gccugaugcugacauuca

SEQ ID NO: 1622660 - RNA, 20 nt, Homo sapiens
gccugcccccuugggugacc

SEQ ID NO: 1622661 - RNA, 13 nt, Homo sapiens
gccugcuauugca

SEQ ID NO: 1622662 - RNA, 15 nt, Homo sapiens
gccuggaggugggca

SEQ ID NO: 1622663 - RNA, 16 nt, Homo sapiens
gccuggccuccugccu

SEQ ID NO: 1622664 - RNA, 16 nt, Homo sapiens
gccugggccccggaaa

SEQ ID NO: 1622665 - RNA, 22 nt, Homo sapiens
gccugguucaaaguaaagcaga

SEQ ID NO: 1622666 - RNA, 21 nt, Homo sapiens
gccugguucuaggcugcugca

SEQ ID NO: 1622667 - RNA, 20 nt, Homo sapiens
gccugugcauguaugucuug

SEQ ID NO: 1622668 - RNA, 17 nt, Homo sapiens
gccuguggccuuugcaa

SEQ ID NO: 1622669 - RNA, 13 nt, Homo sapiens
gccuguguagcug

SEQ ID NO: 1622670 - RNA, 19 nt, Homo sapiens
gccugugugcguguguaua

SEQ ID NO: 1622671 - RNA, 15 nt, Homo sapiens
gccuuaaugcuucau

SEQ ID NO: 1622672 - RNA, 16 nt, Homo sapiens
gccuuagggcacuggg

SEQ ID NO: 1622673 - RNA, 12 nt, Homo sapiens
gccuuagugggc

SEQ ID NO: 1622674 - RNA, 17 nt, Homo sapiens
gccuucccuaagucaca

SEQ ID NO: 1622675 - RNA, 18 nt, Homo sapiens
gccuugaaacaguuccau

SEQ ID NO: 1622676 - RNA, 19 nt, Homo sapiens
gccuugaugccauaugccu

SEQ ID NO: 1622677 - RNA, 17 nt, Homo sapiens
gccuugcacauaggaaa

SEQ ID NO: 1622678 - RNA, 14 nt, Homo sapiens
gccuugcugugaaa

SEQ ID NO: 1622679 - RNA, 22 nt, Homo sapiens
gccuuuuuuuuaaggagcaaaa

SEQ ID NO: 1622680 - RNA, 16 nt, Homo sapiens
gcgaaugacaaaauca

SEQ ID NO: 1622681 - RNA, 14 nt, Homo sapiens
gcggaaagcccugu

SEQ ID NO: 1622682 - RNA, 15 nt, Homo sapiens
gcggaaagcccugug

SEQ ID NO: 1622683 - RNA, 22 nt, Homo sapiens
gcguacauacgguucuguuaua

SEQ ID NO: 1622684 - RNA, 16 nt, Homo sapiens
gcguggacucugcaca

SEQ ID NO: 1622685 - RNA, 18 nt, Homo sapiens
gcguggacucugcacaug

SEQ ID NO: 1622686 - RNA, 20 nt, Homo sapiens
gcguggacucugcacauguc

SEQ ID NO: 1622687 - RNA, 11 nt, Homo sapiens
gcuaaccacuu

SEQ ID NO: 1622688 - RNA, 20 nt, Homo sapiens
gcuaacuauauuugcuuuuu

SEQ ID NO: 1622689 - RNA, 15 nt, Homo sapiens
gcuagaaaacauuuu

SEQ ID NO: 1622690 - RNA, 13 nt, Homo sapiens
gcuagcaguacua

SEQ ID NO: 1622691 - RNA, 15 nt, Homo sapiens
gcuagggaaggcggg

SEQ ID NO: 1622692 - RNA, 15 nt, Homo sapiens
gcuagggaggaccaa

SEQ ID NO: 1622693 - RNA, 16 nt, Homo sapiens
gcuauaccagcagaaa

SEQ ID NO: 1622694 - RNA, 14 nt, Homo sapiens
gcuauggugagaug

SEQ ID NO: 1622695 - RNA, 12 nt, Homo sapiens
gcuauguaguca

SEQ ID NO: 1622696 - RNA, 19 nt, Homo sapiens
gcuauucuaacuaaugaca

SEQ ID NO: 1622697 - RNA, 12 nt, Homo sapiens
gcucacaaagag

SEQ ID NO: 1622698 - RNA, 16 nt, Homo sapiens
gcucacaaagagauaa

SEQ ID NO: 1622699 - RNA, 22 nt, Homo sapiens
gcucagccagcacuuguccagc

SEQ ID NO: 1622700 - RNA, 21 nt, Homo sapiens
gcucaggaaggggugugcuga

SEQ ID NO: 1622701 - RNA, 18 nt, Homo sapiens
gcucaggagccaccagca

SEQ ID NO: 1622702 - RNA, 20 nt, Homo sapiens
gcuccacccuggccgagucc

SEQ ID NO: 1622703 - RNA, 17 nt, Homo sapiens
gcuccaggccugcagca

SEQ ID NO: 1622704 - RNA, 17 nt, Homo sapiens
gcuccauucacucccag

SEQ ID NO: 1622705 - RNA, 21 nt, Homo sapiens
gcucccaacucccuucugcuu

SEQ ID NO: 1622706 - RNA, 14 nt, Homo sapiens
gcucccacagaaca

SEQ ID NO: 1622707 - RNA, 19 nt, Homo sapiens
gcucccccuccagccagag

SEQ ID NO: 1622708 - RNA, 16 nt, Homo sapiens
gcuccccucacucugu

SEQ ID NO: 1622709 - RNA, 14 nt, Homo sapiens
gcucucucuagaau

SEQ ID NO: 1622710 - RNA, 14 nt, Homo sapiens
gcucucuggacacu

SEQ ID NO: 1622711 - RNA, 16 nt, Homo sapiens
gcucugagccaaccuu

SEQ ID NO: 1622712 - RNA, 14 nt, Homo sapiens
gcucugcacagaca

SEQ ID NO: 1622713 - RNA, 16 nt, Homo sapiens
gcucugcccaggcaag

SEQ ID NO: 1622714 - RNA, 23 nt, Homo sapiens
gcucuucccuugcucaugagcuc

SEQ ID NO: 1622715 - RNA, 17 nt, Homo sapiens
gcugaaaaaucauccaa

SEQ ID NO: 1622716 - RNA, 19 nt, Homo sapiens
gcugaaaaaucauccaaga

SEQ ID NO: 1622717 - RNA, 23 nt, Homo sapiens
gcugaagugguugcauucuacua

SEQ ID NO: 1622718 - RNA, 14 nt, Homo sapiens
gcugaccacagcac

SEQ ID NO: 1622719 - RNA, 20 nt, Homo sapiens
gcugaccacagcacagccaa

SEQ ID NO: 1622720 - RNA, 13 nt, Homo sapiens
gcugacucuccag

SEQ ID NO: 1622721 - RNA, 16 nt, Homo sapiens
gcugaggccacacuca

SEQ ID NO: 1622722 - RNA, 16 nt, Homo sapiens
gcugagggagaccccc

SEQ ID NO: 1622723 - RNA, 14 nt, Homo sapiens
gcugagucugcaga

SEQ ID NO: 1622724 - RNA, 14 nt, Homo sapiens
gcugauccaugaga

SEQ ID NO: 1622725 - RNA, 21 nt, Homo sapiens
gcugaugccuguguacugccu

SEQ ID NO: 1622726 - RNA, 14 nt, Homo sapiens
gcugccagcacagg

SEQ ID NO: 1622727 - RNA, 22 nt, Homo sapiens
gcugcucuaagcccaggaucuc

SEQ ID NO: 1622728 - RNA, 15 nt, Homo sapiens
gcugcugagaaccug

SEQ ID NO: 1622729 - RNA, 20 nt, Homo sapiens
gcuggaaaagggucuuggga

SEQ ID NO: 1622730 - RNA, 15 nt, Homo sapiens
gcuggcccgugacag

SEQ ID NO: 1622731 - RNA, 16 nt, Homo sapiens
gcuggcccgugacaga

SEQ ID NO: 1622732 - RNA, 23 nt, Homo sapiens
gcugggacguggcucagccagca

SEQ ID NO: 1622733 - RNA, 20 nt, Homo sapiens
gcugggauuacaggugugca

SEQ ID NO: 1622734 - RNA, 22 nt, Homo sapiens
gcugggcucuaagguacugugg

SEQ ID NO: 1622735 - RNA, 20 nt, Homo sapiens
gcuguaacguggcacuggua

SEQ ID NO: 1622736 - RNA, 12 nt, Homo sapiens
gcuguaugaccc

SEQ ID NO: 1622737 - RNA, 21 nt, Homo sapiens
gcugucaucugugcacugccc

SEQ ID NO: 1622738 - RNA, 14 nt, Homo sapiens
gcuguccugcagca

SEQ ID NO: 1622739 - RNA, 23 nt, Homo sapiens
gcugugggacagggaccgggccu

SEQ ID NO: 1622740 - RNA, 20 nt, Homo sapiens
gcuguugcaugggcuaauga

SEQ ID NO: 1622741 - RNA, 22 nt, Homo sapiens
gcuuaagaacugcuucauguga

SEQ ID NO: 1622742 - RNA, 19 nt, Homo sapiens
gugcaguggugcgaucucg

SEQ ID NO: 1622743 - RNA, 15 nt, Homo sapiens
gugcauggaggcccu

SEQ ID NO: 1622744 - RNA, 14 nt, Homo sapiens
gugccaccucagac

SEQ ID NO: 1622745 - RNA, 19 nt, Homo sapiens
gugccagugcuaaacuacu

SEQ ID NO: 1622746 - RNA, 21 nt, Homo sapiens
gugcccagggcucuaaugugu

SEQ ID NO: 1622747 - RNA, 22 nt, Homo sapiens
gugcccauguguacauucugcc

SEQ ID NO: 1622748 - RNA, 10 nt, Homo sapiens
gugcccucca

SEQ ID NO: 1622749 - RNA, 18 nt, Homo sapiens
gugccgugugagugugac

SEQ ID NO: 1622750 - RNA, 22 nt, Homo sapiens
gugcgaucucggcucagugcaa

SEQ ID NO: 1622751 - RNA, 14 nt, Homo sapiens
gugcucacaaagga

SEQ ID NO: 1622752 - RNA, 19 nt, Homo sapiens
gugcugccagcacagggcu

SEQ ID NO: 1622753 - RNA, 18 nt, Homo sapiens
gugcuguuuuuguucuac

SEQ ID NO: 1622754 - RNA, 16 nt, Homo sapiens
guggaacaaccugcug

SEQ ID NO: 1622755 - RNA, 15 nt, Homo sapiens
guggaacaagcacag

SEQ ID NO: 1622756 - RNA, 16 nt, Homo sapiens
guggacaggacuaaca

SEQ ID NO: 1622757 - RNA, 16 nt, Homo sapiens
guggauaacuuuacag

SEQ ID NO: 1622758 - RNA, 23 nt, Homo sapiens
guggcagcugucucaaaccucca

SEQ ID NO: 1622759 - RNA, 21 nt, Homo sapiens
guggccuaauuuacaagcacg

SEQ ID NO: 1622760 - RNA, 14 nt, Homo sapiens
guggcuguuucauc

SEQ ID NO: 1622761 - RNA, 22 nt, Homo sapiens
guggguauugagugugauuuga

SEQ ID NO: 1622762 - RNA, 22 nt, Homo sapiens
gugguaaaaccuguucuccaua

SEQ ID NO: 1622763 - RNA, 11 nt, Homo sapiens
guggugcauuc

SEQ ID NO: 1622764 - RNA, 19 nt, Homo sapiens
gugguucagacaagacaga

SEQ ID NO: 1622765 - RNA, 19 nt, Homo sapiens
guguacagucuuguauuaa

SEQ ID NO: 1622766 - RNA, 21 nt, Homo sapiens
guguagcugugaccugcugag

SEQ ID NO: 1622767 - RNA, 12 nt, Homo sapiens
guguaugugacc

SEQ ID NO: 1622768 - RNA, 16 nt, Homo sapiens
guguauucauucucau

SEQ ID NO: 1622769 - RNA, 23 nt, Homo sapiens
gugucaccccucacugugacuga

SEQ ID NO: 1622770 - RNA, 16 nt, Homo sapiens
gugucauaaacuuucu

SEQ ID NO: 1622771 - RNA, 13 nt, Homo sapiens
gugucucauucuc

SEQ ID NO: 1622772 - RNA, 21 nt, Homo sapiens
gugugagaagaucauugccau

SEQ ID NO: 1622773 - RNA, 18 nt, Homo sapiens
gugugccaagaguucgau

SEQ ID NO: 1622774 - RNA, 22 nt, Homo sapiens
guguggcaaacuugcaguuuaa

SEQ ID NO: 1622775 - RNA, 20 nt, Homo sapiens
gugugguauucaacuaauac

SEQ ID NO: 1622776 - RNA, 15 nt, Homo sapiens
guguguacaaauaca

SEQ ID NO: 1622777 - RNA, 12 nt, Homo sapiens
gugugugcugcc

SEQ ID NO: 1622778 - RNA, 21 nt, Homo sapiens
guguugaugacucacucauaa

SEQ ID NO: 1622779 - RNA, 23 nt, Homo sapiens
guguuggcaaacgagacuuucuc

SEQ ID NO: 1622780 - RNA, 16 nt, Homo sapiens
guguuuuuaacauguc

SEQ ID NO: 1622781 - RNA, 17 nt, Homo sapiens
guguuuuuaacauguca

SEQ ID NO: 1622782 - RNA, 22 nt, Homo sapiens
guuaaacuaaggcccucuugaa

SEQ ID NO: 1622783 - RNA, 18 nt, Homo sapiens
guuaaaugguuauccaau

SEQ ID NO: 1622784 - RNA, 19 nt, Homo sapiens
guuaacuugccuccaucuu

SEQ ID NO: 1622785 - RNA, 20 nt, Homo sapiens
guuacaaaguuauauucaca

SEQ ID NO: 1622786 - RNA, 12 nt, Homo sapiens
guuacacuggag

SEQ ID NO: 1622787 - RNA, 16 nt, Homo sapiens
guuacuccagugccaa

SEQ ID NO: 1622788 - RNA, 15 nt, Homo sapiens
guuacuguauacuga

SEQ ID NO: 1622789 - RNA, 20 nt, Homo sapiens
guuacuuuuucuuguauuca

SEQ ID NO: 1622790 - RNA, 13 nt, Homo sapiens
guuagaaaauuca

SEQ ID NO: 1622791 - RNA, 14 nt, Homo sapiens
guuagaaaauucag

SEQ ID NO: 1622792 - RNA, 14 nt, Homo sapiens
guuauacacagcuu

SEQ ID NO: 1622793 - RNA, 17 nt, Homo sapiens
guuauaccccauauauu

SEQ ID NO: 1622794 - RNA, 16 nt, Homo sapiens
guuaugugauuuuccu

SEQ ID NO: 1622795 - RNA, 19 nt, Homo sapiens
guuaugugauuuuccuuug

SEQ ID NO: 1622796 - RNA, 13 nt, Homo sapiens
guucagacaagac

SEQ ID NO: 1622797 - RNA, 14 nt, Homo sapiens
guucagcugcccca

SEQ ID NO: 1622798 - RNA, 19 nt, Homo sapiens
guucaugcuucuacuguga

SEQ ID NO: 1622799 - RNA, 14 nt, Homo sapiens
guuccaguacuaug

SEQ ID NO: 1622800 - RNA, 15 nt, Homo sapiens
guucccucugccugg

SEQ ID NO: 1622801 - RNA, 16 nt, Homo sapiens
guucccucuugcucag

SEQ ID NO: 1622802 - RNA, 13 nt, Homo sapiens
guucgcuuaucaa

SEQ ID NO: 1622803 - RNA, 18 nt, Homo sapiens
guucuaauccaagggcca

SEQ ID NO: 1622804 - RNA, 16 nt, Homo sapiens
guucuacccguuccaa

SEQ ID NO: 1622805 - RNA, 20 nt, Homo sapiens
guucucccccugaaugugua

SEQ ID NO: 1622806 - RNA, 22 nt, Homo sapiens
guucucuacucccucuugucag

SEQ ID NO: 1622807 - RNA, 19 nt, Homo sapiens
guucugggauuacaggugu

SEQ ID NO: 1622808 - RNA, 14 nt, Homo sapiens
guucugugaccacu

SEQ ID NO: 1622809 - RNA, 12 nt, Homo sapiens
guucugugcaca

SEQ ID NO: 1622810 - RNA, 15 nt, Homo sapiens
guucuucuuccugaa

SEQ ID NO: 1622811 - RNA, 12 nt, Homo sapiens
guucuuuccucc

SEQ ID NO: 1622812 - RNA, 16 nt, Homo sapiens
guugaauuucccacau

SEQ ID NO: 1622813 - RNA, 22 nt, Homo sapiens
guugacacauaugaacacagac

SEQ ID NO: 1622814 - RNA, 20 nt, Homo sapiens
guuggaauuucauuauaugu

SEQ ID NO: 1622815 - RNA, 16 nt, Homo sapiens
guuggaugaugagcag

SEQ ID NO: 1622816 - RNA, 12 nt, Homo sapiens
guugguguuccu

SEQ ID NO: 1622817 - RNA, 14 nt, Homo sapiens
guugguucaucccu

SEQ ID NO: 1622818 - RNA, 17 nt, Homo sapiens
guuuaauuucaugugua

SEQ ID NO: 1622819 - RNA, 20 nt, Homo sapiens
guuuacauccagaguucugu

SEQ ID NO: 1622820 - RNA, 16 nt, Homo sapiens
guuuaugcugugcuaa

SEQ ID NO: 1622821 - RNA, 22 nt, Homo sapiens
guuucaacaaauuucauugcac

SEQ ID NO: 1622822 - RNA, 23 nt, Homo sapiens
guuucaacaaauuucauugcacu

SEQ ID NO: 1622823 - RNA, 19 nt, Homo sapiens
guuucacuguguuagccag

SEQ ID NO: 1622824 - RNA, 21 nt, Homo sapiens
guuucuaaaaacacacacaaa

SEQ ID NO: 1622825 - RNA, 20 nt, Homo sapiens
guuucuugcuuggaagccag

SEQ ID NO: 1622826 - RNA, 16 nt, Homo sapiens
guuugggaaggugaug

SEQ ID NO: 1622827 - RNA, 23 nt, Homo sapiens
guuuuaaaaugugaggcaauaag

SEQ ID NO: 1622828 - RNA, 22 nt, Homo sapiens
guuuuauccuuacaaugugaau

SEQ ID NO: 1622829 - RNA, 19 nt, Homo sapiens
guuuucaagaugguguuau

SEQ ID NO: 1622830 - RNA, 17 nt, Homo sapiens
guuuuccaguucaucga

SEQ ID NO: 1622831 - RNA, 23 nt, Homo sapiens
guuuuccaguucaucgauuuucu

SEQ ID NO: 1622832 - RNA, 20 nt, Homo sapiens
guuuucuuuuucagauuuau

SEQ ID NO: 1622833 - RNA, 21 nt, Homo sapiens
guuuucuuuuucagauuuaug

SEQ ID NO: 1622834 - RNA, 14 nt, Homo sapiens
guuuugaaaaccua

SEQ ID NO: 1622835 - RNA, 14 nt, Homo sapiens
guuuugugugguau

SEQ ID NO: 1622836 - RNA, 21 nt, Homo sapiens
guuuuuauuuagcauggggau

SEQ ID NO: 1622837 - RNA, 16 nt, Homo sapiens
guuuuuuauuaugcau

SEQ ID NO: 1622838 - RNA, 16 nt, Homo sapiens
guuuuuucacugccug

SEQ ID NO: 1622839 - RNA, 16 nt, Homo sapiens
guuuuuuguaacuaau

SEQ ID NO: 1622840 - RNA, 18 nt, Homo sapiens
uaaaaaagcauuauccuu

SEQ ID NO: 1622841 - RNA, 19 nt, Homo sapiens
uaaaaaaugucucauguca

SEQ ID NO: 1622842 - RNA, 13 nt, Homo sapiens
uaaaaaauugacu

SEQ ID NO: 1622843 - RNA, 19 nt, Homo sapiens
uaaaaauauaaauuguaca

SEQ ID NO: 1622844 - RNA, 21 nt, Homo sapiens
uaaaaaucuagcacacucuuc

SEQ ID NO: 1622845 - RNA, 15 nt, Homo sapiens
uaaaaauguucucaa

SEQ ID NO: 1622846 - RNA, 17 nt, Homo sapiens
uaaaacggauaccaagu

SEQ ID NO: 1622847 - RNA, 22 nt, Homo sapiens
uaaaacggauaccaaguugauu

SEQ ID NO: 1622848 - RNA, 18 nt, Homo sapiens
uaaaacucacugugauca

SEQ ID NO: 1622849 - RNA, 14 nt, Homo sapiens
uaaaacuugguucu

SEQ ID NO: 1622850 - RNA, 19 nt, Homo sapiens
uaaaacuugguucugaaua

SEQ ID NO: 1622851 - RNA, 18 nt, Homo sapiens
uaaaagaggaaaagccaa

SEQ ID NO: 1622852 - RNA, 17 nt, Homo sapiens
uagcaggcaaugcugua

SEQ ID NO: 1622853 - RNA, 19 nt, Homo sapiens
uagcagggauucucucauc

SEQ ID NO: 1622854 - RNA, 15 nt, Homo sapiens
uagcaucuccuuuca

SEQ ID NO: 1622855 - RNA, 20 nt, Homo sapiens
uagccagaauucuacccugg

SEQ ID NO: 1622856 - RNA, 23 nt, Homo sapiens
uagccagccggggcgaguggcac

SEQ ID NO: 1622857 - RNA, 12 nt, Homo sapiens
uagccccagcgc

SEQ ID NO: 1622858 - RNA, 14 nt, Homo sapiens
uagcucaaucugca

SEQ ID NO: 1622859 - RNA, 16 nt, Homo sapiens
uagcucaaucugcaaa

SEQ ID NO: 1622860 - RNA, 20 nt, Homo sapiens
uagcuccaaaccuucacaca

SEQ ID NO: 1622861 - RNA, 18 nt, Homo sapiens
uagcucuuccccaucuca

SEQ ID NO: 1622862 - RNA, 21 nt, Homo sapiens
uagcugggccaacuccaguga

SEQ ID NO: 1622863 - RNA, 17 nt, Homo sapiens
uagcuguaaacugaaua

SEQ ID NO: 1622864 - RNA, 22 nt, Homo sapiens
uagcuugagcuggauucacuug

SEQ ID NO: 1622865 - RNA, 21 nt, Homo sapiens
uagcuuucaauuccguagcca

SEQ ID NO: 1622866 - RNA, 21 nt, Homo sapiens
uagcuuuccuggaagucaaau

SEQ ID NO: 1622867 - RNA, 17 nt, Homo sapiens
uaggaagacgcagagca

SEQ ID NO: 1622868 - RNA, 16 nt, Homo sapiens
uaggaagcacugaaaa

SEQ ID NO: 1622869 - RNA, 22 nt, Homo sapiens
uaggaugugcuaggucuaagau

SEQ ID NO: 1622870 - RNA, 21 nt, Homo sapiens
uaggcagaaacaaaaugacug

SEQ ID NO: 1622871 - RNA, 12 nt, Homo sapiens
uaggcauguaaa

SEQ ID NO: 1622872 - RNA, 21 nt, Homo sapiens
uaggcauguagcuacaggaca

SEQ ID NO: 1622873 - RNA, 17 nt, Homo sapiens
uaggccaccccaaccuc

SEQ ID NO: 1622874 - RNA, 15 nt, Homo sapiens
uaggcugcugcugug

SEQ ID NO: 1622875 - RNA, 16 nt, Homo sapiens
uaggcuggaauguucc

SEQ ID NO: 1622876 - RNA, 14 nt, Homo sapiens
uagggacacuuuca

SEQ ID NO: 1622877 - RNA, 20 nt, Homo sapiens
uagggacacuuucacagucc

SEQ ID NO: 1622878 - RNA, 21 nt, Homo sapiens
uagggacugccaggcuguuuc

SEQ ID NO: 1622879 - RNA, 16 nt, Homo sapiens
uagguguguccacaga

SEQ ID NO: 1622880 - RNA, 17 nt, Homo sapiens
uagguucaaaagcaauc

SEQ ID NO: 1622881 - RNA, 13 nt, Homo sapiens
uaguaaauccaug

SEQ ID NO: 1622882 - RNA, 13 nt, Homo sapiens
uaguaaguaauau

SEQ ID NO: 1622883 - RNA, 12 nt, Homo sapiens
uagucacauggc

SEQ ID NO: 1622884 - RNA, 23 nt, Homo sapiens
uagucacauggccuaugcacaua

SEQ ID NO: 1622885 - RNA, 18 nt, Homo sapiens
uagucacucauccauccc

SEQ ID NO: 1622886 - RNA, 18 nt, Homo sapiens
uagucauucuaacugcac

SEQ ID NO: 1622887 - RNA, 15 nt, Homo sapiens
uaguccuuuacaaac

SEQ ID NO: 1622888 - RNA, 16 nt, Homo sapiens
uagugauaucuagaaa

SEQ ID NO: 1622889 - RNA, 23 nt, Homo sapiens
uagugccugaauuuguucucuuu

SEQ ID NO: 1622890 - RNA, 23 nt, Homo sapiens
uagugcugaugccuguguacugc

SEQ ID NO: 1622891 - RNA, 17 nt, Homo sapiens
uaguucaauacagugaa

SEQ ID NO: 1622892 - RNA, 20 nt, Homo sapiens
uaguugcguggacucugcac

SEQ ID NO: 1622893 - RNA, 13 nt, Homo sapiens
uaguuguucuccc

SEQ ID NO: 1622894 - RNA, 13 nt, Homo sapiens
uaguuugcacuau

SEQ ID NO: 1622895 - RNA, 18 nt, Homo sapiens
uauaaaaagaugaucgcu

SEQ ID NO: 1622896 - RNA, 15 nt, Homo sapiens
uauaaagcacuauac

SEQ ID NO: 1622897 - RNA, 22 nt, Homo sapiens
uauaaaguugguucacuucaaa

SEQ ID NO: 1622898 - RNA, 21 nt, Homo sapiens
uauaaccuuguucucugcuug

SEQ ID NO: 1622899 - RNA, 15 nt, Homo sapiens
uauaacgcagucuaa

SEQ ID NO: 1622900 - RNA, 14 nt, Homo sapiens
uauaacgucaugug

SEQ ID NO: 1622901 - RNA, 22 nt, Homo sapiens
uauaagaaaugcauaugucacu

SEQ ID NO: 1622902 - RNA, 16 nt, Homo sapiens
uauaagcaucugccau

SEQ ID NO: 1622903 - RNA, 15 nt, Homo sapiens
uauaagcugccauau

SEQ ID NO: 1622904 - RNA, 17 nt, Homo sapiens
uauaauaauauacugua

SEQ ID NO: 1622905 - RNA, 22 nt, Homo sapiens
uauaauguacagaagagcaaaa

SEQ ID NO: 1622906 - RNA, 17 nt, Homo sapiens
uauacaaaaaauuuuua

SEQ ID NO: 1622907 - RNA, 12 nt, Homo sapiens
uauacagaggaa

SEQ ID NO: 1622908 - RNA, 15 nt, Homo sapiens
uauacauacauguau

SEQ ID NO: 1622909 - RNA, 16 nt, Homo sapiens
uauacauugugauaua

SEQ ID NO: 1622910 - RNA, 16 nt, Homo sapiens
uauagaaaugcugguu

SEQ ID NO: 1622911 - RNA, 18 nt, Homo sapiens
uauaugaucaguguuacu

SEQ ID NO: 1622912 - RNA, 18 nt, Homo sapiens
uauauguguauacauaca

SEQ ID NO: 1622913 - RNA, 20 nt, Homo sapiens
uauauugcaaggugugaugg

SEQ ID NO: 1622914 - RNA, 18 nt, Homo sapiens
uauauuguaaagauccua

SEQ ID NO: 1622915 - RNA, 15 nt, Homo sapiens
uauauuuuaccauac

SEQ ID NO: 1622916 - RNA, 14 nt, Homo sapiens
uaucaagccaaaga

SEQ ID NO: 1622917 - RNA, 11 nt, Homo sapiens
uaucacauuaa

SEQ ID NO: 1622918 - RNA, 21 nt, Homo sapiens
uaucaccuagcagccucaaaa

SEQ ID NO: 1622919 - RNA, 22 nt, Homo sapiens
uaucaccuagcagccucaaaac

SEQ ID NO: 1622920 - RNA, 19 nt, Homo sapiens
uaucauucuuuguaucuua

SEQ ID NO: 1622921 - RNA, 21 nt, Homo sapiens
uaucauuuuaaaaacuuuauu

SEQ ID NO: 1622922 - RNA, 17 nt, Homo sapiens
uauccaauugcucuuuc

SEQ ID NO: 1622923 - RNA, 18 nt, Homo sapiens
uauccaauugcucuuuca

SEQ ID NO: 1622924 - RNA, 20 nt, Homo sapiens
uauccacuacuccgugaagg

SEQ ID NO: 1622925 - RNA, 11 nt, Homo sapiens
uauccaugccu

SEQ ID NO: 1622926 - RNA, 12 nt, Homo sapiens
uauccugggacc

SEQ ID NO: 1622927 - RNA, 22 nt, Homo sapiens
uaucgggagaggggauucacaa

SEQ ID NO: 1622928 - RNA, 15 nt, Homo sapiens
uaucguuuaauuuua

SEQ ID NO: 1622929 - RNA, 21 nt, Homo sapiens
uaucucgaauuugaagagauu

SEQ ID NO: 1622930 - RNA, 12 nt, Homo sapiens
uaucugcugcac

SEQ ID NO: 1622931 - RNA, 18 nt, Homo sapiens
uaucuggucaaccuccug

SEQ ID NO: 1622932 - RNA, 17 nt, Homo sapiens
uaucuguguuugcugag

SEQ ID NO: 1622933 - RNA, 16 nt, Homo sapiens
uaucuguuuacaucca

SEQ ID NO: 1622934 - RNA, 16 nt, Homo sapiens
uaucuuaaaucuguga

SEQ ID NO: 1622935 - RNA, 13 nt, Homo sapiens
uaugaaaacucau

SEQ ID NO: 1622936 - RNA, 18 nt, Homo sapiens
uaugacagaaaaguaaug

SEQ ID NO: 1622937 - RNA, 18 nt, Homo sapiens
uaugacauuucuuaaaac

SEQ ID NO: 1622938 - RNA, 18 nt, Homo sapiens
uaugauucagauuguuau

SEQ ID NO: 1622939 - RNA, 17 nt, Homo sapiens
uaugcaaauacaaucag

SEQ ID NO: 1622940 - RNA, 21 nt, Homo sapiens
uaugcaccuugugucuguaca

SEQ ID NO: 1622941 - RNA, 15 nt, Homo sapiens
uaugcauuugcauuu

SEQ ID NO: 1622942 - RNA, 19 nt, Homo sapiens
uaugccugacuaauuuugu

SEQ ID NO: 1622943 - RNA, 15 nt, Homo sapiens
uaugcucauugaacu

SEQ ID NO: 1622944 - RNA, 20 nt, Homo sapiens
uaugcucauugaacuuuaag

SEQ ID NO: 1622945 - RNA, 19 nt, Homo sapiens
uaugcuuggcuaacuauau

SEQ ID NO: 1622946 - RNA, 17 nt, Homo sapiens
uaugcuuuagaacuuuu

SEQ ID NO: 1622947 - RNA, 15 nt, Homo sapiens
uauggacucugcaca

SEQ ID NO: 1622948 - RNA, 14 nt, Homo sapiens
uauggcuccuccau

SEQ ID NO: 1622949 - RNA, 16 nt, Homo sapiens
uauggcuccuccauau

SEQ ID NO: 1622950 - RNA, 18 nt, Homo sapiens
uaugucuuacuacuuuaa

SEQ ID NO: 1622951 - RNA, 14 nt, Homo sapiens
uaugucuuggacac

SEQ ID NO: 1622952 - RNA, 21 nt, Homo sapiens
uaugugacgacugcaaagcca

SEQ ID NO: 1622953 - RNA, 14 nt, Homo sapiens
uauguucaaagacu

SEQ ID NO: 1622954 - RNA, 17 nt, Homo sapiens
uauguucugucuuccca

SEQ ID NO: 1622955 - RNA, 15 nt, Homo sapiens
uauuaaucauacaaa

SEQ ID NO: 1622956 - RNA, 16 nt, Homo sapiens
uauuacugaugugugc

SEQ ID NO: 1622957 - RNA, 19 nt, Homo sapiens
uauuauaaacuguaugcuc

SEQ ID NO: 1622958 - RNA, 14 nt, Homo sapiens
uauucaaaaccuca

SEQ ID NO: 1622959 - RNA, 13 nt, Homo sapiens
uauucaacuaaua

SEQ ID NO: 1622960 - RNA, 18 nt, Homo sapiens
uauucaagugaaugggga

SEQ ID NO: 1622961 - RNA, 11 nt, Homo sapiens
uauucaugagu

SEQ ID NO: 1622962 - RNA, 18 nt, Homo sapiens
ucucuaaagaaaaucucu

SEQ ID NO: 1622963 - RNA, 18 nt, Homo sapiens
ucucuacuuccccagaug

SEQ ID NO: 1622964 - RNA, 16 nt, Homo sapiens
ucucuaggccucucca

SEQ ID NO: 1622965 - RNA, 17 nt, Homo sapiens
ucucucacggcuuguaa

SEQ ID NO: 1622966 - RNA, 15 nt, Homo sapiens
ucucuccagccugac

SEQ ID NO: 1622967 - RNA, 18 nt, Homo sapiens
ucucucccccucugucuc

SEQ ID NO: 1622968 - RNA, 16 nt, Homo sapiens
ucucucuaggugucag

SEQ ID NO: 1622969 - RNA, 21 nt, Homo sapiens
ucucucugaagaugucaaauc

SEQ ID NO: 1622970 - RNA, 16 nt, Homo sapiens
ucucugaacaauacaa

SEQ ID NO: 1622971 - RNA, 21 nt, Homo sapiens
ucucugaguuuuaguuggucu

SEQ ID NO: 1622972 - RNA, 19 nt, Homo sapiens
ucucugugcccuccagcaa

SEQ ID NO: 1622973 - RNA, 16 nt, Homo sapiens
ucucuuugugcucuaa

SEQ ID NO: 1622974 - RNA, 14 nt, Homo sapiens
ucugaaagcuuuau

SEQ ID NO: 1622975 - RNA, 13 nt, Homo sapiens
ucugaacuuccaa

SEQ ID NO: 1622976 - RNA, 18 nt, Homo sapiens
ucugacugccaagccaga

SEQ ID NO: 1622977 - RNA, 23 nt, Homo sapiens
ucugacuuaagcugccucaagga

SEQ ID NO: 1622978 - RNA, 22 nt, Homo sapiens
ucugaggcgccccaacccgugg

SEQ ID NO: 1622979 - RNA, 19 nt, Homo sapiens
ucugaucaagaacauguca

SEQ ID NO: 1622980 - RNA, 17 nt, Homo sapiens
ucugaucguuuauucuc

SEQ ID NO: 1622981 - RNA, 15 nt, Homo sapiens
ucugaugcaucagaa

SEQ ID NO: 1622982 - RNA, 18 nt, Homo sapiens
ucugauucacagucucau

SEQ ID NO: 1622983 - RNA, 15 nt, Homo sapiens
ucugcaaacaugcca

SEQ ID NO: 1622984 - RNA, 14 nt, Homo sapiens
ucugcaucuugggg

SEQ ID NO: 1622985 - RNA, 19 nt, Homo sapiens
ucugcauggaacagcauua

SEQ ID NO: 1622986 - RNA, 16 nt, Homo sapiens
ucugcauguguaaaag

SEQ ID NO: 1622987 - RNA, 19 nt, Homo sapiens
ucugcauuucuuaccagug

SEQ ID NO: 1622988 - RNA, 17 nt, Homo sapiens
ucugccagaccugcaug

SEQ ID NO: 1622989 - RNA, 17 nt, Homo sapiens
ucugccaucaacuacua

SEQ ID NO: 1622990 - RNA, 13 nt, Homo sapiens
ucugcccaccuac

SEQ ID NO: 1622991 - RNA, 15 nt, Homo sapiens
ucugcccucauuacu

SEQ ID NO: 1622992 - RNA, 21 nt, Homo sapiens
ucugccuagaguguagccuaa

SEQ ID NO: 1622993 - RNA, 17 nt, Homo sapiens
ucugccuggcaacaucu

SEQ ID NO: 1622994 - RNA, 18 nt, Homo sapiens
ucugcucugaugcaucag

SEQ ID NO: 1622995 - RNA, 20 nt, Homo sapiens
ucugcugucuaaccugugac

SEQ ID NO: 1622996 - RNA, 17 nt, Homo sapiens
ucugcuuuucccauugc

SEQ ID NO: 1622997 - RNA, 20 nt, Homo sapiens
ucugcuuuucccauugccau

SEQ ID NO: 1622998 - RNA, 18 nt, Homo sapiens
ucuggauccagccaugcc

SEQ ID NO: 1622999 - RNA, 15 nt, Homo sapiens
ucuggcuacucccug

SEQ ID NO: 1623000 - RNA, 19 nt, Homo sapiens
ucuggcuuccuaaacccau

SEQ ID NO: 1623001 - RNA, 16 nt, Homo sapiens
ucugggcuaauauacu

SEQ ID NO: 1623002 - RNA, 18 nt, Homo sapiens
ucugggcucaagcuuucc

SEQ ID NO: 1623003 - RNA, 21 nt, Homo sapiens
ucuggggaggcaggcauuccu

SEQ ID NO: 1623004 - RNA, 16 nt, Homo sapiens
ucugggucagacccau

SEQ ID NO: 1623005 - RNA, 23 nt, Homo sapiens
ucuguacaaugaacccccaugau

SEQ ID NO: 1623006 - RNA, 12 nt, Homo sapiens
ucuguaccuuca

SEQ ID NO: 1623007 - RNA, 21 nt, Homo sapiens
ucuguagcucaaucugcaaac

SEQ ID NO: 1623008 - RNA, 15 nt, Homo sapiens
ucuguaguaaacuau

SEQ ID NO: 1623009 - RNA, 20 nt, Homo sapiens
ucuguauauauauauacuua

SEQ ID NO: 1623010 - RNA, 20 nt, Homo sapiens
ucuguauuacagcuuucaca

SEQ ID NO: 1623011 - RNA, 17 nt, Homo sapiens
ucugucagucacagcca

SEQ ID NO: 1623012 - RNA, 14 nt, Homo sapiens
ucugucuuguucau

SEQ ID NO: 1623013 - RNA, 14 nt, Homo sapiens
ucugugaagcauuc

SEQ ID NO: 1623014 - RNA, 21 nt, Homo sapiens
ucuguggaaguagcuuugaac

SEQ ID NO: 1623015 - RNA, 16 nt, Homo sapiens
ucuguguggugcauuc

SEQ ID NO: 1623016 - RNA, 22 nt, Homo sapiens
ucuguucauuucacacagugaa

SEQ ID NO: 1623017 - RNA, 16 nt, Homo sapiens
ucuguucuugaagcag

SEQ ID NO: 1623018 - RNA, 14 nt, Homo sapiens
ucuuaaaucuguga

SEQ ID NO: 1623019 - RNA, 13 nt, Homo sapiens
ucuuaagacguga

SEQ ID NO: 1623020 - RNA, 20 nt, Homo sapiens
ucuuacacaggcuucaucaa

SEQ ID NO: 1623021 - RNA, 19 nt, Homo sapiens
ucuuaccagugacgcugcu

SEQ ID NO: 1623022 - RNA, 22 nt, Homo sapiens
ucuuaccagugacgcugcugac

SEQ ID NO: 1623023 - RNA, 19 nt, Homo sapiens
ucuuacccuguacauaugu

SEQ ID NO: 1623024 - RNA, 20 nt, Homo sapiens
ucuuagugugccaagaguuc

SEQ ID NO: 1623025 - RNA, 18 nt, Homo sapiens
ucuuaguuaugugacgac

SEQ ID NO: 1623026 - RNA, 14 nt, Homo sapiens
ucuuaguugcugua

SEQ ID NO: 1623027 - RNA, 14 nt, Homo sapiens
ucuuauuaaucaua

SEQ ID NO: 1623028 - RNA, 22 nt, Homo sapiens
ucuucaaggaggcccacugugu

SEQ ID NO: 1623029 - RNA, 15 nt, Homo sapiens
ucuucaccucuucca

SEQ ID NO: 1623030 - RNA, 18 nt, Homo sapiens
ucuucaccugauucaacu

SEQ ID NO: 1623031 - RNA, 13 nt, Homo sapiens
ucuucaugagcuu

SEQ ID NO: 1623032 - RNA, 14 nt, Homo sapiens
ucuuccaccugcug

SEQ ID NO: 1623033 - RNA, 20 nt, Homo sapiens
ucuucuaaaauagcaauaac

SEQ ID NO: 1623034 - RNA, 20 nt, Homo sapiens
ucuucuccuaaaacuuuaaa

SEQ ID NO: 1623035 - RNA, 14 nt, Homo sapiens
ucuucucucuugau

SEQ ID NO: 1623036 - RNA, 13 nt, Homo sapiens
ucuucuuccugaa

SEQ ID NO: 1623037 - RNA, 16 nt, Homo sapiens
ucuugaaguacuuaac

SEQ ID NO: 1623038 - RNA, 20 nt, Homo sapiens
ucuugaaucucugaauuuga

SEQ ID NO: 1623039 - RNA, 12 nt, Homo sapiens
ucuugacuguua

SEQ ID NO: 1623040 - RNA, 14 nt, Homo sapiens
ucuugauaaaugac

SEQ ID NO: 1623041 - RNA, 11 nt, Homo sapiens
ucuugaucucc

SEQ ID NO: 1623042 - RNA, 13 nt, Homo sapiens
ucuugcaugucua

SEQ ID NO: 1623043 - RNA, 16 nt, Homo sapiens
ucuuggccuaaaccuc

SEQ ID NO: 1623044 - RNA, 17 nt, Homo sapiens
ucuuggccuaaaccuca

SEQ ID NO: 1623045 - RNA, 16 nt, Homo sapiens
ucuuggguucccaaau

SEQ ID NO: 1623046 - RNA, 14 nt, Homo sapiens
ucuugguuuccaaa

SEQ ID NO: 1623047 - RNA, 21 nt, Homo sapiens
ucuuguguauuucucugugaa

SEQ ID NO: 1623048 - RNA, 17 nt, Homo sapiens
ucuuuagagguaugauu

SEQ ID NO: 1623049 - RNA, 20 nt, Homo sapiens
ucuuuauauuuuuagccuaa

SEQ ID NO: 1623050 - RNA, 16 nt, Homo sapiens
ucuuucacacggcaca

SEQ ID NO: 1623051 - RNA, 22 nt, Homo sapiens
ucuuucacacggcacauuugga

SEQ ID NO: 1623052 - RNA, 16 nt, Homo sapiens
ucuuucaucucugcuu

SEQ ID NO: 1623053 - RNA, 20 nt, Homo sapiens
ucuuuccugaaccaugugga

SEQ ID NO: 1623054 - RNA, 21 nt, Homo sapiens
ucuuucuaaugcugauaugau

SEQ ID NO: 1623055 - RNA, 24 nt, Homo sapiens
ucuuugcggggccugucucaguga

SEQ ID NO: 1623056 - RNA, 19 nt, Homo sapiens
ucuuugcucuaauuuugga

SEQ ID NO: 1623057 - RNA, 19 nt, Homo sapiens
ucuuuguuaugacagugaa

SEQ ID NO: 1623058 - RNA, 16 nt, Homo sapiens
ucuuuuaaaaucauga

SEQ ID NO: 1623059 - RNA, 16 nt, Homo sapiens
ucuuuucaucugggaa

SEQ ID NO: 1623060 - RNA, 13 nt, Homo sapiens
ucuuuuguucucu

SEQ ID NO: 1623061 - RNA, 18 nt, Homo sapiens
ucuuuuucagauuuauga

SEQ ID NO: 1623062 - RNA, 21 nt, Homo sapiens
ugaaaacauauaaagcacuau

SEQ ID NO: 1623063 - RNA, 20 nt, Homo sapiens
ugaaaacaucuggaagggga

SEQ ID NO: 1623064 - RNA, 21 nt, Homo sapiens
ugaaaacaucuggaaggggau

SEQ ID NO: 1623065 - RNA, 12 nt, Homo sapiens
ugaaaaccuaaa

SEQ ID NO: 1623066 - RNA, 19 nt, Homo sapiens
ugaaaaccuacauauucca

SEQ ID NO: 1623067 - RNA, 15 nt, Homo sapiens
ugaaaagucacuuac

SEQ ID NO: 1623068 - RNA, 19 nt, Homo sapiens
ugaaaauauagacauucuc

SEQ ID NO: 1623069 - RNA, 17 nt, Homo sapiens
ugaaaaucaucacucaa

SEQ ID NO: 1623070 - RNA, 21 nt, Homo sapiens
ugaaaauguguuguugcugug

SEQ ID NO: 1623071 - RNA, 19 nt, Homo sapiens
ugaaacagcugcccugugu

SEQ ID NO: 1623072 - RNA, 16 nt, Homo sapiens
uguacaaaacaguuug

SEQ ID NO: 1623073 - RNA, 14 nt, Homo sapiens
uguacaaagaaaua

SEQ ID NO: 1623074 - RNA, 21 nt, Homo sapiens
uguacaaauugugauguggcu

SEQ ID NO: 1623075 - RNA, 15 nt, Homo sapiens
uguacacaacaaucc

SEQ ID NO: 1623076 - RNA, 19 nt, Homo sapiens
uguacacagaauuguucca

SEQ ID NO: 1623077 - RNA, 16 nt, Homo sapiens
uguacagucuuguauu

SEQ ID NO: 1623078 - RNA, 14 nt, Homo sapiens
uguaccauaugauc

SEQ ID NO: 1623079 - RNA, 20 nt, Homo sapiens
uguaccaugugcuacagggg

SEQ ID NO: 1623080 - RNA, 17 nt, Homo sapiens
uguaccuauggcaauuu

SEQ ID NO: 1623081 - RNA, 14 nt, Homo sapiens
uguacggacacugu

SEQ ID NO: 1623082 - RNA, 13 nt, Homo sapiens
uguacugccuuag

SEQ ID NO: 1623083 - RNA, 14 nt, Homo sapiens
uguacugccuuagu

SEQ ID NO: 1623084 - RNA, 16 nt, Homo sapiens
uguacugccuuagugc

SEQ ID NO: 1623085 - RNA, 20 nt, Homo sapiens
uguagaaaauaaaacugagc

SEQ ID NO: 1623086 - RNA, 14 nt, Homo sapiens
uguagaccuugaug

SEQ ID NO: 1623087 - RNA, 22 nt, Homo sapiens
uguagagacgguguuuugccau

SEQ ID NO: 1623088 - RNA, 15 nt, Homo sapiens
uguagcagucacuga

SEQ ID NO: 1623089 - RNA, 13 nt, Homo sapiens
uguagccagcaga

SEQ ID NO: 1623090 - RNA, 17 nt, Homo sapiens
uguagcuguaagggcag

SEQ ID NO: 1623091 - RNA, 19 nt, Homo sapiens
uguaguuucugcauuucaa

SEQ ID NO: 1623092 - RNA, 12 nt, Homo sapiens
uguauaaaaugg

SEQ ID NO: 1623093 - RNA, 21 nt, Homo sapiens
uguauaauacauccauucuac

SEQ ID NO: 1623094 - RNA, 15 nt, Homo sapiens
uguauagaccuaaaa

SEQ ID NO: 1623095 - RNA, 15 nt, Homo sapiens
uguauaguaucugua

SEQ ID NO: 1623096 - RNA, 13 nt, Homo sapiens
uguauccaugcac

SEQ ID NO: 1623097 - RNA, 18 nt, Homo sapiens
uguauuacagcuuucaca

SEQ ID NO: 1623098 - RNA, 13 nt, Homo sapiens
uguauugauucaa

SEQ ID NO: 1623099 - RNA, 16 nt, Homo sapiens
uguauuucaagaccuc

SEQ ID NO: 1623100 - RNA, 15 nt, Homo sapiens
ugucaaggcaguugc

SEQ ID NO: 1623101 - RNA, 18 nt, Homo sapiens
ugucaccccucacuguga

SEQ ID NO: 1623102 - RNA, 12 nt, Homo sapiens
ugucaccuucac

SEQ ID NO: 1623103 - RNA, 22 nt, Homo sapiens
ugucacuucuucaccucuucca

SEQ ID NO: 1623104 - RNA, 15 nt, Homo sapiens
ugucagcaauuuaac

SEQ ID NO: 1623105 - RNA, 15 nt, Homo sapiens
ugucagccuugcuac

SEQ ID NO: 1623106 - RNA, 21 nt, Homo sapiens
ugucaguauuauucuacuaua

SEQ ID NO: 1623107 - RNA, 16 nt, Homo sapiens
ugucagucacagccac

SEQ ID NO: 1623108 - RNA, 10 nt, Homo sapiens
uguccaucuu

SEQ ID NO: 1623109 - RNA, 21 nt, Homo sapiens
ugucccacuaucugggugcau

SEQ ID NO: 1623110 - RNA, 16 nt, Homo sapiens
uguccugcaguuccca

SEQ ID NO: 1623111 - RNA, 21 nt, Homo sapiens
uguccuuuuacucagcuuuau

SEQ ID NO: 1623112 - RNA, 17 nt, Homo sapiens
ugucgaauuccuacuga

SEQ ID NO: 1623113 - RNA, 14 nt, Homo sapiens
ugucgugaaauugu

SEQ ID NO: 1623114 - RNA, 20 nt, Homo sapiens
ugucuaggcaggcaagagaa

SEQ ID NO: 1623115 - RNA, 13 nt, Homo sapiens
ugucucaguuuac

SEQ ID NO: 1623116 - RNA, 23 nt, Homo sapiens
ugucucgugguaggacuguagaa

SEQ ID NO: 1623117 - RNA, 14 nt, Homo sapiens
ugucugcucugcau

SEQ ID NO: 1623118 - RNA, 20 nt, Homo sapiens
ugucuguugaaauaaaacau

SEQ ID NO: 1623119 - RNA, 22 nt, Homo sapiens
ugucuucccaaacccagucucc

SEQ ID NO: 1623120 - RNA, 13 nt, Homo sapiens
ugucuucuuuaug

SEQ ID NO: 1623121 - RNA, 19 nt, Homo sapiens
ugucuugcaaagccuuuaa

SEQ ID NO: 1623122 - RNA, 15 nt, Homo sapiens
ugucuuuuguucucu

SEQ ID NO: 1623123 - RNA, 21 nt, Homo sapiens
ugugaaacuguaaauuucaua

SEQ ID NO: 1623124 - RNA, 19 nt, Homo sapiens
ugugaaauaccaaccugaa

SEQ ID NO: 1623125 - RNA, 21 nt, Homo sapiens
ugugaacagcuugcugucacu

SEQ ID NO: 1623126 - RNA, 14 nt, Homo sapiens
ugugaagaaagggu

SEQ ID NO: 1623127 - RNA, 22 nt, Homo sapiens
ugugaaggccucgcaggaagac

SEQ ID NO: 1623128 - RNA, 18 nt, Homo sapiens
ugugaaguuuaauugacu

SEQ ID NO: 1623129 - RNA, 15 nt, Homo sapiens
ugugacacugcagca

SEQ ID NO: 1623130 - RNA, 13 nt, Homo sapiens
ugugacauuccug

SEQ ID NO: 1623131 - RNA, 20 nt, Homo sapiens
ugugaccagucugacccuua

SEQ ID NO: 1623132 - RNA, 23 nt, Homo sapiens
ugugacuauucauggcuaccuca

SEQ ID NO: 1623133 - RNA, 19 nt, Homo sapiens
ugugagguucgcuuaucaa

SEQ ID NO: 1623134 - RNA, 23 nt, Homo sapiens
ugugauauauuagggacacuuuc

SEQ ID NO: 1623135 - RNA, 12 nt, Homo sapiens
ugugauaugauu

SEQ ID NO: 1623136 - RNA, 22 nt, Homo sapiens
ugugcacacccaugcacacuca

SEQ ID NO: 1623137 - RNA, 17 nt, Homo sapiens
ugugcauguaugucuug

SEQ ID NO: 1623138 - RNA, 13 nt, Homo sapiens
ugugccaaccugu

SEQ ID NO: 1623139 - RNA, 17 nt, Homo sapiens
ugugcuacgugugaaau

SEQ ID NO: 1623140 - RNA, 20 nt, Homo sapiens
ugugcuccauggcugccauc

SEQ ID NO: 1623141 - RNA, 13 nt, Homo sapiens
ugugcugugacaa

SEQ ID NO: 1623142 - RNA, 14 nt, Homo sapiens
uguggaaaauggag

SEQ ID NO: 1623143 - RNA, 16 nt, Homo sapiens
uguggaaaugcuuaaa

SEQ ID NO: 1623144 - RNA, 24 nt, Homo sapiens
uguggacaggacuaacacucagaa

SEQ ID NO: 1623145 - RNA, 19 nt, Homo sapiens
uguggagaucagaaaguga

SEQ ID NO: 1623146 - RNA, 20 nt, Homo sapiens
uguggagaugagucagugcc

SEQ ID NO: 1623147 - RNA, 20 nt, Homo sapiens
uguggcaaacuugcaguuua

SEQ ID NO: 1623148 - RNA, 13 nt, Homo sapiens
uguggcagagcca

SEQ ID NO: 1623149 - RNA, 14 nt, Homo sapiens
uguggcagcugucu

SEQ ID NO: 1623150 - RNA, 16 nt, Homo sapiens
uguggccuuggucuaa

SEQ ID NO: 1623151 - RNA, 18 nt, Homo sapiens
uguggguguacauuuugu

SEQ ID NO: 1623152 - RNA, 19 nt, Homo sapiens
ugugguuacacagugugaa

SEQ ID NO: 1623153 - RNA, 20 nt, Homo sapiens
uguguaaacagaagccuguu

SEQ ID NO: 1623154 - RNA, 13 nt, Homo sapiens
uguguacugccuu

SEQ ID NO: 1623155 - RNA, 16 nt, Homo sapiens
ugugucuguacacgug

SEQ ID NO: 1623156 - RNA, 18 nt, Homo sapiens
uguguggcaaacuugcag

SEQ ID NO: 1623157 - RNA, 21 nt, Homo sapiens
uguguuacugcuuugcaaaga

SEQ ID NO: 1623158 - RNA, 21 nt, Homo sapiens
uguguucacguaguucuagca

SEQ ID NO: 1623159 - RNA, 13 nt, Homo sapiens
uguguugccacag

SEQ ID NO: 1623160 - RNA, 13 nt, Homo sapiens
uguguuugcugag

SEQ ID NO: 1623161 - RNA, 16 nt, Homo sapiens
uguguuuuuucggaca

SEQ ID NO: 1623162 - RNA, 15 nt, Homo sapiens
uguuaaccauuugca

SEQ ID NO: 1623163 - RNA, 15 nt, Homo sapiens
uguuaauagacuuaa

SEQ ID NO: 1623164 - RNA, 13 nt, Homo sapiens
uguuaccuucaca

SEQ ID NO: 1623165 - RNA, 14 nt, Homo sapiens
uguuaccuucacau

SEQ ID NO: 1623166 - RNA, 20 nt, Homo sapiens
uguuacugcuuugcaaagac

SEQ ID NO: 1623167 - RNA, 18 nt, Homo sapiens
uguuacuuuuaguucuau

SEQ ID NO: 1623168 - RNA, 23 nt, Homo sapiens
uguuaguaaauaaaauuaacaaa

SEQ ID NO: 1623169 - RNA, 22 nt, Homo sapiens
uguuaguuuuucuuacuugcau

SEQ ID NO: 1623170 - RNA, 15 nt, Homo sapiens
uguuaugacagugaa

SEQ ID NO: 1623171 - RNA, 18 nt, Homo sapiens
uguucauauuuauugauu

SEQ ID NO: 1623172 - RNA, 15 nt, Homo sapiens
uguucaucugugcac

SEQ ID NO: 1623173 - RNA, 16 nt, Homo sapiens
uguucaugucagcuua

SEQ ID NO: 1623174 - RNA, 16 nt, Homo sapiens
uguucccagagcacuu

SEQ ID NO: 1623175 - RNA, 19 nt, Homo sapiens
uguucuacccguuccaaaa

SEQ ID NO: 1623176 - RNA, 15 nt, Homo sapiens
uguucucaacauacu

SEQ ID NO: 1623177 - RNA, 22 nt, Homo sapiens
uguucucauagaggaaauucaa

SEQ ID NO: 1623178 - RNA, 11 nt, Homo sapiens
uguucugagaa

SEQ ID NO: 1623179 - RNA, 15 nt, Homo sapiens
uguucugucaccaau

SEQ ID NO: 1623180 - RNA, 15 nt, Homo sapiens
uguucugucuuccca

SEQ ID NO: 1623181 - RNA, 20 nt, Homo sapiens
uguucuuaugcaaaauggaa

SEQ ID NO: 1623182 - RNA, 13 nt, Homo sapiens
aaaaaaacagacu

SEQ ID NO: 1623183 - RNA, 11 nt, Homo sapiens
aaaaacaacca

SEQ ID NO: 1623184 - RNA, 14 nt, Homo sapiens
aaaaacaaccuugc

SEQ ID NO: 1623185 - RNA, 10 nt, Homo sapiens
aaaaacagac

SEQ ID NO: 1623186 - RNA, 12 nt, Homo sapiens
aaaaacaugugg

SEQ ID NO: 1623187 - RNA, 22 nt, Homo sapiens
aaaaagugcuuauuaugugcaa

SEQ ID NO: 1623188 - RNA, 14 nt, Homo sapiens
aaaaauaaagggaa

SEQ ID NO: 1623189 - RNA, 20 nt, Homo sapiens
aaaaauagcuuucaaaagaa

SEQ ID NO: 1623190 - RNA, 23 nt, Homo sapiens
aaaaauauuguuucugcauucau

SEQ ID NO: 1623191 - RNA, 14 nt, Homo sapiens
aaaaaucugagaaa

SEQ ID NO: 1623192 - RNA, 21 nt, Homo sapiens
aaaaaugcaagccaucucuaa

SEQ ID NO: 1623193 - RNA, 19 nt, Homo sapiens
aaaacaaacccaaagguag

SEQ ID NO: 1623194 - RNA, 22 nt, Homo sapiens
aaaacacacacaaagcacauug

SEQ ID NO: 1623195 - RNA, 12 nt, Homo sapiens
aaaaccucaaac

SEQ ID NO: 1623196 - RNA, 14 nt, Homo sapiens
aaaacucacuguga

SEQ ID NO: 1623197 - RNA, 21 nt, Homo sapiens
aaaagauguugugucuugugu

SEQ ID NO: 1623198 - RNA, 18 nt, Homo sapiens
aaaagccuucccuugccc

SEQ ID NO: 1623199 - RNA, 16 nt, Homo sapiens
aaaagggaacugaaca

SEQ ID NO: 1623200 - RNA, 22 nt, Homo sapiens
aaaagggucuugggaaauauga

SEQ ID NO: 1623201 - RNA, 14 nt, Homo sapiens
aaaaguguuaggga

SEQ ID NO: 1623202 - RNA, 21 nt, Homo sapiens
aaaauaaaaaggaaaacagac

SEQ ID NO: 1623203 - RNA, 15 nt, Homo sapiens
aaaaucacuggggau

SEQ ID NO: 1623204 - RNA, 16 nt, Homo sapiens
aaaauccaauaaucag

SEQ ID NO: 1623205 - RNA, 15 nt, Homo sapiens
aaaauccauccaauc

SEQ ID NO: 1623206 - RNA, 23 nt, Homo sapiens
aaaaugaagguggaacaagcaca

SEQ ID NO: 1623207 - RNA, 14 nt, Homo sapiens
aaaaugacuguaga

SEQ ID NO: 1623208 - RNA, 15 nt, Homo sapiens
aaaaugacuguagaa

SEQ ID NO: 1623209 - RNA, 19 nt, Homo sapiens
aaaaugcaagccaucucua

SEQ ID NO: 1623210 - RNA, 20 nt, Homo sapiens
aaaaugcaagccaucucuaa

SEQ ID NO: 1623211 - RNA, 22 nt, Homo sapiens
aaaauguuaccacuacuuuaau

SEQ ID NO: 1623212 - RNA, 23 nt, Homo sapiens
aaaauguuuaaauucucuuucac

SEQ ID NO: 1623213 - RNA, 18 nt, Homo sapiens
aaaauucucauuacucuu

SEQ ID NO: 1623214 - RNA, 19 nt, Homo sapiens
aaaauuuuuaaaacacaga

SEQ ID NO: 1623215 - RNA, 22 nt, Homo sapiens
aaaauuuuuuuuguaacuggag

SEQ ID NO: 1623216 - RNA, 14 nt, Homo sapiens
aaacacccaugccc

SEQ ID NO: 1623217 - RNA, 21 nt, Homo sapiens
aaacagggcugccuucuggcc

SEQ ID NO: 1623218 - RNA, 19 nt, Homo sapiens
aaacaguccaaacuguucu

SEQ ID NO: 1623219 - RNA, 15 nt, Homo sapiens
aaacauacaguccau

SEQ ID NO: 1623220 - RNA, 23 nt, Homo sapiens
aaacaucacaaaauguaauuuaa

SEQ ID NO: 1623221 - RNA, 14 nt, Homo sapiens
aaacaucccccaau

SEQ ID NO: 1623222 - RNA, 13 nt, Homo sapiens
aaacaucuggaag

SEQ ID NO: 1623223 - RNA, 14 nt, Homo sapiens
aaacauucagucug

SEQ ID NO: 1623224 - RNA, 17 nt, Homo sapiens
aaacauuuuuguggcuu

SEQ ID NO: 1623225 - RNA, 13 nt, Homo sapiens
aaaccaagccaug

SEQ ID NO: 1623226 - RNA, 11 nt, Homo sapiens
aaaccacuucu

SEQ ID NO: 1623227 - RNA, 14 nt, Homo sapiens
aaacccccacucca

SEQ ID NO: 1623228 - RNA, 16 nt, Homo sapiens
aaaccuacauauucca

SEQ ID NO: 1623229 - RNA, 15 nt, Homo sapiens
aaaccuuguucuauu

SEQ ID NO: 1623230 - RNA, 13 nt, Homo sapiens
aaaccuuugcaaa

SEQ ID NO: 1623231 - RNA, 13 nt, Homo sapiens
aaacgagacuuuc

SEQ ID NO: 1623232 - RNA, 16 nt, Homo sapiens
aaacgcuuauugugua

SEQ ID NO: 1623233 - RNA, 14 nt, Homo sapiens
aaacguccacaaag

SEQ ID NO: 1623234 - RNA, 20 nt, Homo sapiens
aaacugaagcugcacagugu

SEQ ID NO: 1623235 - RNA, 15 nt, Homo sapiens
aaacuuaauguucuu

SEQ ID NO: 1623236 - RNA, 23 nt, Homo sapiens
aaacuuuaggcccugccccagau

SEQ ID NO: 1623237 - RNA, 19 nt, Homo sapiens
aaagaaaaauaucuuggcc

SEQ ID NO: 1623238 - RNA, 16 nt, Homo sapiens
aaagaaaacacaccuc

SEQ ID NO: 1623239 - RNA, 21 nt, Homo sapiens
aaagaaagggacccaccugcu

SEQ ID NO: 1623240 - RNA, 22 nt, Homo sapiens
aaagaaauuuaaguucuaugag

SEQ ID NO: 1623241 - RNA, 12 nt, Homo sapiens
aaagaagcuuua

SEQ ID NO: 1623242 - RNA, 14 nt, Homo sapiens
aaagaagcuuuauc

SEQ ID NO: 1623243 - RNA, 23 nt, Homo sapiens
aaagaaucccaauguuugacaaa

SEQ ID NO: 1623244 - RNA, 17 nt, Homo sapiens
aaagaauuauuugccuu

SEQ ID NO: 1623245 - RNA, 11 nt, Homo sapiens
aaagacaaauu

SEQ ID NO: 1623246 - RNA, 14 nt, Homo sapiens
aaagacagcuguuu

SEQ ID NO: 1623247 - RNA, 21 nt, Homo sapiens
aaagacccugaugcaggucag

SEQ ID NO: 1623248 - RNA, 22 nt, Homo sapiens
aaagaccuuuuccaugcacccu

SEQ ID NO: 1623249 - RNA, 18 nt, Homo sapiens
aaagacugugaacagcuu

SEQ ID NO: 1623250 - RNA, 13 nt, Homo sapiens
aaagagaagccaa

SEQ ID NO: 1623251 - RNA, 16 nt, Homo sapiens
aaagagauauugauau

SEQ ID NO: 1623252 - RNA, 16 nt, Homo sapiens
aaagaggacaggcuac

SEQ ID NO: 1623253 - RNA, 20 nt, Homo sapiens
aaagagguaaaaaacuguca

SEQ ID NO: 1623254 - RNA, 11 nt, Homo sapiens
aaagcauuauc

SEQ ID NO: 1623255 - RNA, 21 nt, Homo sapiens
aaagccagugcugucugggau

SEQ ID NO: 1623256 - RNA, 14 nt, Homo sapiens
aaagccaugugcua

SEQ ID NO: 1623257 - RNA, 19 nt, Homo sapiens
aaagcuacuauguacugcc

SEQ ID NO: 1623258 - RNA, 23 nt, Homo sapiens
aaagcuacuauguacugccuuag

SEQ ID NO: 1623259 - RNA, 16 nt, Homo sapiens
aaaggaaaacgugaac

SEQ ID NO: 1623260 - RNA, 16 nt, Homo sapiens
aaaggacucuccagcc

SEQ ID NO: 1623261 - RNA, 18 nt, Homo sapiens
aaaggagccuaggccagg

SEQ ID NO: 1623262 - RNA, 15 nt, Homo sapiens
aaaggccucuuguaa

SEQ ID NO: 1623263 - RNA, 17 nt, Homo sapiens
aaaggcuaaacauaugg

SEQ ID NO: 1623264 - RNA, 19 nt, Homo sapiens
aaaggcugcagcauugcca

SEQ ID NO: 1623265 - RNA, 14 nt, Homo sapiens
aaagggacacuuuu

SEQ ID NO: 1623266 - RNA, 15 nt, Homo sapiens
aaagggugucuauca

SEQ ID NO: 1623267 - RNA, 15 nt, Homo sapiens
aaaggugccaucuca

SEQ ID NO: 1623268 - RNA, 13 nt, Homo sapiens
aaagguguguuga

SEQ ID NO: 1623269 - RNA, 12 nt, Homo sapiens
aaaguagggaug

SEQ ID NO: 1623270 - RNA, 22 nt, Homo sapiens
aaagucacccagggacacucca

SEQ ID NO: 1623271 - RNA, 19 nt, Homo sapiens
aaaguccguguccuaccuc

SEQ ID NO: 1623272 - RNA, 21 nt, Homo sapiens
aaaguccucuggauugagaua

SEQ ID NO: 1623273 - RNA, 15 nt, Homo sapiens
aaaguccuuggacug

SEQ ID NO: 1623274 - RNA, 19 nt, Homo sapiens
aaagucugucuuuccugaa

SEQ ID NO: 1623275 - RNA, 17 nt, Homo sapiens
aaagugcuggaauuaca

SEQ ID NO: 1623276 - RNA, 21 nt, Homo sapiens
aaagugcuggaauuacaggcg

SEQ ID NO: 1623277 - RNA, 20 nt, Homo sapiens
aaaguggcagggaccggcag

SEQ ID NO: 1623278 - RNA, 22 nt, Homo sapiens
aaagugucaccccucacuguga

SEQ ID NO: 1623279 - RNA, 21 nt, Homo sapiens
aaaguuauauucacaguuuuu

SEQ ID NO: 1623280 - RNA, 18 nt, Homo sapiens
aaaguucuugguggugga

SEQ ID NO: 1623281 - RNA, 12 nt, Homo sapiens
aaaguugcucac

SEQ ID NO: 1623282 - RNA, 13 nt, Homo sapiens
aaaguugcucacc

SEQ ID NO: 1623283 - RNA, 12 nt, Homo sapiens
aaaguuguugca

SEQ ID NO: 1623284 - RNA, 16 nt, Homo sapiens
aaaguuuccuaggaug

SEQ ID NO: 1623285 - RNA, 21 nt, Homo sapiens
aaaguuuuuuauuaugcauua

SEQ ID NO: 1623286 - RNA, 16 nt, Homo sapiens
aaauaaaaaaagacaa

SEQ ID NO: 1623287 - RNA, 20 nt, Homo sapiens
aaauaaaaaucucuuuucca

SEQ ID NO: 1623288 - RNA, 13 nt, Homo sapiens
aaauaaaacugag

SEQ ID NO: 1623289 - RNA, 17 nt, Homo sapiens
aaauaaaaggaagccaa

SEQ ID NO: 1623290 - RNA, 16 nt, Homo sapiens
aaauaaacauguauaa

SEQ ID NO: 1623291 - RNA, 17 nt, Homo sapiens
aaauaaagauauuguuc

SEQ ID NO: 1623292 - RNA, 23 nt, Homo sapiens
aaauaaguaauaucuuucaguua

SEQ ID NO: 1623293 - RNA, 14 nt, Homo sapiens
aaauaauaucauuu

SEQ ID NO: 1623294 - RNA, 12 nt, Homo sapiens
aaauacaaucag

SEQ ID NO: 1623295 - RNA, 14 nt, Homo sapiens
aaauacaaucagcc

SEQ ID NO: 1623296 - RNA, 22 nt, Homo sapiens
aaauacaaucagcccagugcaa

SEQ ID NO: 1623297 - RNA, 15 nt, Homo sapiens
aaauacuuaaauucc

SEQ ID NO: 1623298 - RNA, 20 nt, Homo sapiens
aaauagcugaaaagggcacu

SEQ ID NO: 1623299 - RNA, 23 nt, Homo sapiens
aaauaguguucccagagcacuuu

SEQ ID NO: 1623300 - RNA, 19 nt, Homo sapiens
aaauauagacauucucaca

SEQ ID NO: 1623301 - RNA, 22 nt, Homo sapiens
aaaucacgcaucucuacuccuc

SEQ ID NO: 1623302 - RNA, 20 nt, Homo sapiens
aaaucauccaagacaguuau

SEQ ID NO: 1623303 - RNA, 15 nt, Homo sapiens
aaaucaucuuuguga

SEQ ID NO: 1623304 - RNA, 15 nt, Homo sapiens
aaaucguuuauuuca

SEQ ID NO: 1623305 - RNA, 20 nt, Homo sapiens
aaaugaggugccacccagua

SEQ ID NO: 1623306 - RNA, 18 nt, Homo sapiens
aaaugaguagacauugug

SEQ ID NO: 1623307 - RNA, 16 nt, Homo sapiens
aaaugauccucagugc

SEQ ID NO: 1623308 - RNA, 17 nt, Homo sapiens
aaaugcaagccaucucu

SEQ ID NO: 1623309 - RNA, 23 nt, Homo sapiens
aaaugcaagccaucucuaauaau

SEQ ID NO: 1623310 - RNA, 23 nt, Homo sapiens
aaaugccagucucauugucaccu

SEQ ID NO: 1623311 - RNA, 14 nt, Homo sapiens
aaaugccauccaga

SEQ ID NO: 1623312 - RNA, 17 nt, Homo sapiens
aaaugcucucucaaauu

SEQ ID NO: 1623313 - RNA, 17 nt, Homo sapiens
aaaugggaaaaccagac

SEQ ID NO: 1623314 - RNA, 18 nt, Homo sapiens
aaaugggaaaaccagacu

SEQ ID NO: 1623315 - RNA, 19 nt, Homo sapiens
aaauguauuuugacacugg

SEQ ID NO: 1623316 - RNA, 19 nt, Homo sapiens
aaaugugauccugccuugc

SEQ ID NO: 1623317 - RNA, 16 nt, Homo sapiens
aaauguguaagaacaa

SEQ ID NO: 1623318 - RNA, 12 nt, Homo sapiens
aaauuaagcauu

SEQ ID NO: 1623319 - RNA, 17 nt, Homo sapiens
aaauuagaaucugagua

SEQ ID NO: 1623320 - RNA, 21 nt, Homo sapiens
aaauuaucuauaaucucagaa

SEQ ID NO: 1623321 - RNA, 17 nt, Homo sapiens
aaauuauuucucucaca

SEQ ID NO: 1623322 - RNA, 21 nt, Homo sapiens
aaauuauuugaaaacauauaa

SEQ ID NO: 1623323 - RNA, 20 nt, Homo sapiens
aaauuccacacuaccacauu

SEQ ID NO: 1623324 - RNA, 19 nt, Homo sapiens
aaauuggaugcuagagaau

SEQ ID NO: 1623325 - RNA, 17 nt, Homo sapiens
aaauugggaaaacucca

SEQ ID NO: 1623326 - RNA, 14 nt, Homo sapiens
aaauugugaugugg

SEQ ID NO: 1623327 - RNA, 19 nt, Homo sapiens
aaauuuaaaaaaacagacu

SEQ ID NO: 1623328 - RNA, 23 nt, Homo sapiens
aaauuuaagaaaacaaguauaua

SEQ ID NO: 1623329 - RNA, 16 nt, Homo sapiens
aaauuugagagacaaa

SEQ ID NO: 1623330 - RNA, 22 nt, Homo sapiens
aaauuugugguccacugagcua

SEQ ID NO: 1623331 - RNA, 20 nt, Homo sapiens
aaauuuuucuuuucuugauu

SEQ ID NO: 1623332 - RNA, 12 nt, Homo sapiens
aacaaacagggc

SEQ ID NO: 1623333 - RNA, 13 nt, Homo sapiens
aacaaacagggcu

SEQ ID NO: 1623334 - RNA, 23 nt, Homo sapiens
aacaagguccucugucagucaca

SEQ ID NO: 1623335 - RNA, 12 nt, Homo sapiens
aacaaguauaaa

SEQ ID NO: 1623336 - RNA, 15 nt, Homo sapiens
aacaaguauuggaaa

SEQ ID NO: 1623337 - RNA, 15 nt, Homo sapiens
aacaagugaaauaac

SEQ ID NO: 1623338 - RNA, 15 nt, Homo sapiens
aacaauccaugugau

SEQ ID NO: 1623339 - RNA, 20 nt, Homo sapiens
aacaaucuauggcuuauuuc

SEQ ID NO: 1623340 - RNA, 24 nt, Homo sapiens
aacaauugguaaaacucacuguga

SEQ ID NO: 1623341 - RNA, 15 nt, Homo sapiens
aacaauuuggucuua

SEQ ID NO: 1623342 - RNA, 22 nt, Homo sapiens
aacacacuuggaugcaggguuu

SEQ ID NO: 1623343 - RNA, 13 nt, Homo sapiens
aacacauucaaua

SEQ ID NO: 1623344 - RNA, 13 nt, Homo sapiens
aacacccaugccc

SEQ ID NO: 1623345 - RNA, 19 nt, Homo sapiens
aacacugucacuagucuca

SEQ ID NO: 1623346 - RNA, 14 nt, Homo sapiens
aacacuuucauccg

SEQ ID NO: 1623347 - RNA, 15 nt, Homo sapiens
aacagcuugcuguca

SEQ ID NO: 1623348 - RNA, 20 nt, Homo sapiens
aacaguccaaacuguucuga

SEQ ID NO: 1623349 - RNA, 15 nt, Homo sapiens
aacaguugcauuuag

SEQ ID NO: 1623350 - RNA, 16 nt, Homo sapiens
aacaguuuuugcuaau

SEQ ID NO: 1623351 - RNA, 14 nt, Homo sapiens
aacauacuguucuc

SEQ ID NO: 1623352 - RNA, 20 nt, Homo sapiens
aacauagauuuaagugaaua

SEQ ID NO: 1623353 - RNA, 20 nt, Homo sapiens
aacaucccuuauuaguuaca

SEQ ID NO: 1623354 - RNA, 20 nt, Homo sapiens
aacaugccaggccucaggga

SEQ ID NO: 1623355 - RNA, 20 nt, Homo sapiens
aacauuguaaauauuuacuc

SEQ ID NO: 1623356 - RNA, 15 nt, Homo sapiens
aacauuuaaauucca

SEQ ID NO: 1623357 - RNA, 16 nt, Homo sapiens
aacauuuaaauuccac

SEQ ID NO: 1623358 - RNA, 19 nt, Homo sapiens
aacauuuaaauuccacaga

SEQ ID NO: 1623359 - RNA, 21 nt, Homo sapiens
aacauuuacuuuugcucccua

SEQ ID NO: 1623360 - RNA, 18 nt, Homo sapiens
aacauuuuucacaucucu

SEQ ID NO: 1623361 - RNA, 20 nt, Homo sapiens
aaccaacagaaaacauccca

SEQ ID NO: 1623362 - RNA, 14 nt, Homo sapiens
aaccagcucugaac

SEQ ID NO: 1623363 - RNA, 14 nt, Homo sapiens
aaccaguugaauca

SEQ ID NO: 1623364 - RNA, 14 nt, Homo sapiens
aaccaucagcauca

SEQ ID NO: 1623365 - RNA, 18 nt, Homo sapiens
aaccauuguaacuauuaa

SEQ ID NO: 1623366 - RNA, 11 nt, Homo sapiens
aacccaaagug

SEQ ID NO: 1623367 - RNA, 22 nt, Homo sapiens
aacccaauacagucuaguuucc

SEQ ID NO: 1623368 - RNA, 13 nt, Homo sapiens
aacccaggacaag

SEQ ID NO: 1623369 - RNA, 13 nt, Homo sapiens
aaccccaguggau

SEQ ID NO: 1623370 - RNA, 18 nt, Homo sapiens
aaccccaguggauucuca

SEQ ID NO: 1623371 - RNA, 19 nt, Homo sapiens
aacccgugccaaguccagg

SEQ ID NO: 1623372 - RNA, 21 nt, Homo sapiens
aacccugacuccucuuugugc

SEQ ID NO: 1623373 - RNA, 21 nt, Homo sapiens
aaccucaguuauuacauguaa

SEQ ID NO: 1623374 - RNA, 20 nt, Homo sapiens
aaccucauaaaaaucuagca

SEQ ID NO: 1623375 - RNA, 21 nt, Homo sapiens
aaccugguguuaggugugcaa

SEQ ID NO: 1623376 - RNA, 18 nt, Homo sapiens
aaccuguuaaaacaacca

SEQ ID NO: 1623377 - RNA, 16 nt, Homo sapiens
aaccuuuaaucugcac

SEQ ID NO: 1623378 - RNA, 13 nt, Homo sapiens
aacggcaagggaa

SEQ ID NO: 1623379 - RNA, 13 nt, Homo sapiens
aacggcacugugg

SEQ ID NO: 1623380 - RNA, 18 nt, Homo sapiens
aacgguuuaauucugucu

SEQ ID NO: 1623381 - RNA, 13 nt, Homo sapiens
aacuaacacagcc

SEQ ID NO: 1623382 - RNA, 23 nt, Homo sapiens
aacuaauccuucuggcagauuca

SEQ ID NO: 1623383 - RNA, 23 nt, Homo sapiens
aacuacccagguauuacacaagc

SEQ ID NO: 1623384 - RNA, 23 nt, Homo sapiens
aacuacucagccuagcacaggcu

SEQ ID NO: 1623385 - RNA, 12 nt, Homo sapiens
aacuagccaaac

SEQ ID NO: 1623386 - RNA, 17 nt, Homo sapiens
aacuaguaaacauaugu

SEQ ID NO: 1623387 - RNA, 18 nt, Homo sapiens
aacuauaagcccacuguu

SEQ ID NO: 1623388 - RNA, 22 nt, Homo sapiens
aacuaugagcuugcucauuaau

SEQ ID NO: 1623389 - RNA, 15 nt, Homo sapiens
aacuauuaaggccuu

SEQ ID NO: 1623390 - RNA, 10 nt, Homo sapiens
aacuauuuau

SEQ ID NO: 1623391 - RNA, 22 nt, Homo sapiens
aacucacaagugcucaucuguu

SEQ ID NO: 1623392 - RNA, 19 nt, Homo sapiens
aacucacccccuacacaca

SEQ ID NO: 1623393 - RNA, 12 nt, Homo sapiens
aacucacuguga

SEQ ID NO: 1623394 - RNA, 24 nt, Homo sapiens
aacucaugaucaagauauaugugu

SEQ ID NO: 1623395 - RNA, 22 nt, Homo sapiens
aacuccccucagggauacgaca

SEQ ID NO: 1623396 - RNA, 14 nt, Homo sapiens
aacuccuacaugau

SEQ ID NO: 1623397 - RNA, 19 nt, Homo sapiens
aacuccugaccucagguga

SEQ ID NO: 1623398 - RNA, 13 nt, Homo sapiens
aacugaaccacaa

SEQ ID NO: 1623399 - RNA, 22 nt, Homo sapiens
aacugacaggcagccuggacau

SEQ ID NO: 1623400 - RNA, 22 nt, Homo sapiens
aacugacugaaggaaaagcaag

SEQ ID NO: 1623401 - RNA, 21 nt, Homo sapiens
aacugaugaguaaacugaggc

SEQ ID NO: 1623402 - RNA, 14 nt, Homo sapiens
aacugcaaauggaa

SEQ ID NO: 1623403 - RNA, 17 nt, Homo sapiens
aacugccacagauagcu

SEQ ID NO: 1623404 - RNA, 17 nt, Homo sapiens
aacugcccaaggcaugu

SEQ ID NO: 1623405 - RNA, 20 nt, Homo sapiens
aacugccuuuggcagaguuc

SEQ ID NO: 1623406 - RNA, 13 nt, Homo sapiens
aacugcuaaugca

SEQ ID NO: 1623407 - RNA, 19 nt, Homo sapiens
aacuguacaaauugugaug

SEQ ID NO: 1623408 - RNA, 14 nt, Homo sapiens
aacuguacauuuca

SEQ ID NO: 1623409 - RNA, 16 nt, Homo sapiens
aacuguaccaugugcu

SEQ ID NO: 1623410 - RNA, 15 nt, Homo sapiens
aacuguacugggcca

SEQ ID NO: 1623411 - RNA, 12 nt, Homo sapiens
aacuguguuuca

SEQ ID NO: 1623412 - RNA, 22 nt, Homo sapiens
aacuuauucucuguaggccaaa

SEQ ID NO: 1623413 - RNA, 14 nt, Homo sapiens
aacuucuugucaga

SEQ ID NO: 1623414 - RNA, 18 nt, Homo sapiens
aacuucuuuccucuggag

SEQ ID NO: 1623415 - RNA, 14 nt, Homo sapiens
aacuugcugaucca

SEQ ID NO: 1623416 - RNA, 13 nt, Homo sapiens
aacuuucuuucac

SEQ ID NO: 1623417 - RNA, 15 nt, Homo sapiens
aagaaacaccacuua

SEQ ID NO: 1623418 - RNA, 12 nt, Homo sapiens
aagaaaugcaaa

SEQ ID NO: 1623419 - RNA, 16 nt, Homo sapiens
aagaagccacccuccu

SEQ ID NO: 1623420 - RNA, 13 nt, Homo sapiens
aagaaggaacaau

SEQ ID NO: 1623421 - RNA, 22 nt, Homo sapiens
aagaauacccaggaagacuuug

SEQ ID NO: 1623422 - RNA, 23 nt, Homo sapiens
aagaaucaguaggaccaggccac

SEQ ID NO: 1623423 - RNA, 14 nt, Homo sapiens
aagaaucuuuacaa

SEQ ID NO: 1623424 - RNA, 23 nt, Homo sapiens
aagaaugugaugggccacaagga

SEQ ID NO: 1623425 - RNA, 15 nt, Homo sapiens
aagaauuacuuugug

SEQ ID NO: 1623426 - RNA, 13 nt, Homo sapiens
aagaauuuugcuu

SEQ ID NO: 1623427 - RNA, 17 nt, Homo sapiens
aagacaccguucauuca

SEQ ID NO: 1623428 - RNA, 14 nt, Homo sapiens
aagacacuguuaca

SEQ ID NO: 1623429 - RNA, 21 nt, Homo sapiens
aagacauauaacgcagucuaa

SEQ ID NO: 1623430 - RNA, 20 nt, Homo sapiens
aagacucucgcaucuuccca

SEQ ID NO: 1623431 - RNA, 23 nt, Homo sapiens
aagacugauuuuaauagggaaua

SEQ ID NO: 1623432 - RNA, 14 nt, Homo sapiens
aagacuugugcauc

SEQ ID NO: 1623433 - RNA, 15 nt, Homo sapiens
aagacuugugcaucc

SEQ ID NO: 1623434 - RNA, 16 nt, Homo sapiens
aagacuuuauguaguu

SEQ ID NO: 1623435 - RNA, 13 nt, Homo sapiens
aagagaagcaaga

SEQ ID NO: 1623436 - RNA, 18 nt, Homo sapiens
aagagaaucacagaguca

SEQ ID NO: 1623437 - RNA, 18 nt, Homo sapiens
aagagagggacaggcacu

SEQ ID NO: 1623438 - RNA, 21 nt, Homo sapiens
aagagcugccuggaugagaaa

SEQ ID NO: 1623439 - RNA, 17 nt, Homo sapiens
aagagguaaaaaacugu

SEQ ID NO: 1623440 - RNA, 20 nt, Homo sapiens
aagagucaacauugauccag

SEQ ID NO: 1623441 - RNA, 19 nt, Homo sapiens
aagaguuucacaaauccuu

SEQ ID NO: 1623442 - RNA, 13 nt, Homo sapiens
aagauaaauuuca

SEQ ID NO: 1623443 - RNA, 19 nt, Homo sapiens
aagauaccaaaaccacagu

SEQ ID NO: 1623444 - RNA, 15 nt, Homo sapiens
aagauauauguguau

SEQ ID NO: 1623445 - RNA, 13 nt, Homo sapiens
aagauauggacac

SEQ ID NO: 1623446 - RNA, 21 nt, Homo sapiens
aagaugacgaguaacuccccu

SEQ ID NO: 1623447 - RNA, 19 nt, Homo sapiens
aagauggcauccugugaag

SEQ ID NO: 1623448 - RNA, 14 nt, Homo sapiens
aagauguacuucuc

SEQ ID NO: 1623449 - RNA, 19 nt, Homo sapiens
aagcaaguguucacaacag

SEQ ID NO: 1623450 - RNA, 23 nt, Homo sapiens
aagcacaaucacuaaacuuuauu

SEQ ID NO: 1623451 - RNA, 21 nt, Homo sapiens
aagcagccacgaggugcaaca

SEQ ID NO: 1623452 - RNA, 21 nt, Homo sapiens
aagcagguucccaagcucaga

SEQ ID NO: 1623453 - RNA, 19 nt, Homo sapiens
aagcauggugucaguuuug

SEQ ID NO: 1623454 - RNA, 11 nt, Homo sapiens
aagccaaagaa

SEQ ID NO: 1623455 - RNA, 16 nt, Homo sapiens
aagccaaggucaugcc

SEQ ID NO: 1623456 - RNA, 14 nt, Homo sapiens
aagccaccucacca

SEQ ID NO: 1623457 - RNA, 20 nt, Homo sapiens
aagccagcacucacaccacu

SEQ ID NO: 1623458 - RNA, 21 nt, Homo sapiens
aagccauguauaaaugugaua

SEQ ID NO: 1623459 - RNA, 16 nt, Homo sapiens
aagccauguuuccucu

SEQ ID NO: 1623460 - RNA, 17 nt, Homo sapiens
aagcccaggaucucuuu

SEQ ID NO: 1623461 - RNA, 18 nt, Homo sapiens
aagccccauuuccucaca

SEQ ID NO: 1623462 - RNA, 17 nt, Homo sapiens
aagccccugacccgcuc

SEQ ID NO: 1623463 - RNA, 14 nt, Homo sapiens
aagccuucccccag

SEQ ID NO: 1623464 - RNA, 15 nt, Homo sapiens
aagcgaacaucuuca

SEQ ID NO: 1623465 - RNA, 15 nt, Homo sapiens
aagcgauucuccugc

SEQ ID NO: 1623466 - RNA, 12 nt, Homo sapiens
aagcuaaaucau

SEQ ID NO: 1623467 - RNA, 13 nt, Homo sapiens
aagcucaugucau

SEQ ID NO: 1623468 - RNA, 21 nt, Homo sapiens
aagcugaggugcccaggagaa

SEQ ID NO: 1623469 - RNA, 12 nt, Homo sapiens
aagcugccucaa

SEQ ID NO: 1623470 - RNA, 12 nt, Homo sapiens
aagcugcuccag

SEQ ID NO: 1623471 - RNA, 23 nt, Homo sapiens
aagcugcuugcuguaacugugug

SEQ ID NO: 1623472 - RNA, 14 nt, Homo sapiens
aagcuuaaugauuc

SEQ ID NO: 1623473 - RNA, 12 nt, Homo sapiens
aaggaagcagaa

SEQ ID NO: 1623474 - RNA, 17 nt, Homo sapiens
aaggacucuuccaccuc

SEQ ID NO: 1623475 - RNA, 18 nt, Homo sapiens
aaggacucuuccaccucc

SEQ ID NO: 1623476 - RNA, 15 nt, Homo sapiens
aaggagccuauggca

SEQ ID NO: 1623477 - RNA, 20 nt, Homo sapiens
aaggaggcugaucccugaga

SEQ ID NO: 1623478 - RNA, 20 nt, Homo sapiens
aaggaguacaaugcccagau

SEQ ID NO: 1623479 - RNA, 15 nt, Homo sapiens
aaggaucucugagac

SEQ ID NO: 1623480 - RNA, 22 nt, Homo sapiens
aaggcacacagcaagucagggu

SEQ ID NO: 1623481 - RNA, 15 nt, Homo sapiens
aaggcauccaugaaa

SEQ ID NO: 1623482 - RNA, 17 nt, Homo sapiens
aaggccuggggugaccc

SEQ ID NO: 1623483 - RNA, 21 nt, Homo sapiens
aaggcuauguaaacaaaccac

SEQ ID NO: 1623484 - RNA, 18 nt, Homo sapiens
aaggcuuauuaaagugga

SEQ ID NO: 1623485 - RNA, 21 nt, Homo sapiens
aagggcacgugaagucauuga

SEQ ID NO: 1623486 - RNA, 16 nt, Homo sapiens
aaggggauauuuacug

SEQ ID NO: 1623487 - RNA, 16 nt, Homo sapiens
aagggugggugcucag

SEQ ID NO: 1623488 - RNA, 19 nt, Homo sapiens
aagggugggugcucagaau

SEQ ID NO: 1623489 - RNA, 22 nt, Homo sapiens
aagguuuuguugcuagcccuuc

SEQ ID NO: 1623490 - RNA, 13 nt, Homo sapiens
aaguaaauuaaac

SEQ ID NO: 1623491 - RNA, 14 nt, Homo sapiens
aaguaaugaucuca

SEQ ID NO: 1623492 - RNA, 16 nt, Homo sapiens
aaguacaauaauucau

SEQ ID NO: 1623493 - RNA, 23 nt, Homo sapiens
aaguacuccuauugccgccagaa

SEQ ID NO: 1623494 - RNA, 13 nt, Homo sapiens
aagucaagcucca

SEQ ID NO: 1623495 - RNA, 17 nt, Homo sapiens
aagucaggguuggagca

SEQ ID NO: 1623496 - RNA, 17 nt, Homo sapiens
aagucccuuugugacuu

SEQ ID NO: 1623497 - RNA, 14 nt, Homo sapiens
aagucgaugaacua

SEQ ID NO: 1623498 - RNA, 15 nt, Homo sapiens
aagucuagaaucaua

SEQ ID NO: 1623499 - RNA, 21 nt, Homo sapiens
aagucucucuauuacacugga

SEQ ID NO: 1623500 - RNA, 21 nt, Homo sapiens
aagucugcagcggugccucac

SEQ ID NO: 1623501 - RNA, 14 nt, Homo sapiens
aagugaacuaugaa

SEQ ID NO: 1623502 - RNA, 24 nt, Homo sapiens
aagugacuucuggagaaagcucau

SEQ ID NO: 1623503 - RNA, 13 nt, Homo sapiens
aagugaggaugag

SEQ ID NO: 1623504 - RNA, 20 nt, Homo sapiens
aagugaggaugagacccagc

SEQ ID NO: 1623505 - RNA, 17 nt, Homo sapiens
aagugaggugacacucc

SEQ ID NO: 1623506 - RNA, 21 nt, Homo sapiens
aagugccaaaugcucucucaa

SEQ ID NO: 1623507 - RNA, 14 nt, Homo sapiens
aagugcgugaaugu

SEQ ID NO: 1623508 - RNA, 14 nt, Homo sapiens
aagugcuccugaaa

SEQ ID NO: 1623509 - RNA, 18 nt, Homo sapiens
aaguucuuaguugcugua

SEQ ID NO: 1623510 - RNA, 13 nt, Homo sapiens
aaguugugcuuga

SEQ ID NO: 1623511 - RNA, 12 nt, Homo sapiens
aaguuguugcau

SEQ ID NO: 1623512 - RNA, 15 nt, Homo sapiens
aaguuguugcauucc

SEQ ID NO: 1623513 - RNA, 16 nt, Homo sapiens
aaguuuaauugacuua

SEQ ID NO: 1623514 - RNA, 14 nt, Homo sapiens
aaguuuuacuugag

SEQ ID NO: 1623515 - RNA, 20 nt, Homo sapiens
aaguuuuuuauuaugcauua

SEQ ID NO: 1623516 - RNA, 23 nt, Homo sapiens
aauaaaaauuaucuauaaucuca

SEQ ID NO: 1623517 - RNA, 14 nt, Homo sapiens
aauaaaacauucag

SEQ ID NO: 1623518 - RNA, 14 nt, Homo sapiens
aauaaaauaucaua

SEQ ID NO: 1623519 - RNA, 22 nt, Homo sapiens
aauaaaauuuuuuuucauguuu

SEQ ID NO: 1623520 - RNA, 20 nt, Homo sapiens
aauaaauaagaucagacucu

SEQ ID NO: 1623521 - RNA, 15 nt, Homo sapiens
aauaaauaugcucag

SEQ ID NO: 1623522 - RNA, 18 nt, Homo sapiens
aauaacauuuaaauucca

SEQ ID NO: 1623523 - RNA, 23 nt, Homo sapiens
aauaacauuuaaauuccacagau

SEQ ID NO: 1623524 - RNA, 15 nt, Homo sapiens
aauaagaucagacuc

SEQ ID NO: 1623525 - RNA, 13 nt, Homo sapiens
aauaaguaauauc

SEQ ID NO: 1623526 - RNA, 20 nt, Homo sapiens
aauaaugcugcaaacuuaau

SEQ ID NO: 1623527 - RNA, 14 nt, Homo sapiens
aauaauucauauuc

SEQ ID NO: 1623528 - RNA, 17 nt, Homo sapiens
aauaauucauauucuuc

SEQ ID NO: 1623529 - RNA, 22 nt, Homo sapiens
aauacaagaguggagagaagcu

SEQ ID NO: 1623530 - RNA, 18 nt, Homo sapiens
aauacagacaaagcauaa

SEQ ID NO: 1623531 - RNA, 15 nt, Homo sapiens
aauacagacaucuaa

SEQ ID NO: 1623532 - RNA, 23 nt, Homo sapiens
aauacauuaaaauaacuaagcaa

SEQ ID NO: 1623533 - RNA, 14 nt, Homo sapiens
aauacccaugcuuu

SEQ ID NO: 1623534 - RNA, 15 nt, Homo sapiens
aauaccuuggucuca

SEQ ID NO: 1623535 - RNA, 18 nt, Homo sapiens
aauaccuuggucucaccu

SEQ ID NO: 1623536 - RNA, 16 nt, Homo sapiens
aauagaaacauuugua

SEQ ID NO: 1623537 - RNA, 22 nt, Homo sapiens
aauagaauuugagcaucaguga

SEQ ID NO: 1623538 - RNA, 19 nt, Homo sapiens
aauagacuuaauacaugca

SEQ ID NO: 1623539 - RNA, 15 nt, Homo sapiens
aauagucuuugccag

SEQ ID NO: 1623540 - RNA, 14 nt, Homo sapiens
aauauaaagcuuaa

SEQ ID NO: 1623541 - RNA, 14 nt, Homo sapiens
aauauaaauuguac

SEQ ID NO: 1623542 - RNA, 12 nt, Homo sapiens
aauauacucagg

SEQ ID NO: 1623543 - RNA, 16 nt, Homo sapiens
aauauagaaaguugau

SEQ ID NO: 1623544 - RNA, 23 nt, Homo sapiens
aauauauauuaagugugccaaau

SEQ ID NO: 1623545 - RNA, 18 nt, Homo sapiens
aauauauuuuaccauaca

SEQ ID NO: 1623546 - RNA, 20 nt, Homo sapiens
aauaucaaauaaaauaucau

SEQ ID NO: 1623547 - RNA, 18 nt, Homo sapiens
aauaucacuguaaugagu

SEQ ID NO: 1623548 - RNA, 17 nt, Homo sapiens
aauaucauaaagcauuu

SEQ ID NO: 1623549 - RNA, 12 nt, Homo sapiens
aauaucuaaaaa

SEQ ID NO: 1623550 - RNA, 12 nt, Homo sapiens
aauaucuuucag

SEQ ID NO: 1623551 - RNA, 12 nt, Homo sapiens
aauaugacagau

SEQ ID NO: 1623552 - RNA, 17 nt, Homo sapiens
aauaugguguacauucu

SEQ ID NO: 1623553 - RNA, 18 nt, Homo sapiens
aauauuagaagccugcag

SEQ ID NO: 1623554 - RNA, 17 nt, Homo sapiens
aauauuagggaguaaaa

SEQ ID NO: 1623555 - RNA, 21 nt, Homo sapiens
aauauuccuaugcugcaauac

SEQ ID NO: 1623556 - RNA, 21 nt, Homo sapiens
aauauuuauuuaacuauucau

SEQ ID NO: 1623557 - RNA, 22 nt, Homo sapiens
aauauuuuaaacuacugauuga

SEQ ID NO: 1623558 - RNA, 17 nt, Homo sapiens
aauauuuuguauauuau

SEQ ID NO: 1623559 - RNA, 16 nt, Homo sapiens
aauauuuuuuacagau

SEQ ID NO: 1623560 - RNA, 18 nt, Homo sapiens
aaucacaaaccaagccau

SEQ ID NO: 1623561 - RNA, 17 nt, Homo sapiens
aaucagcccagugcaaa

SEQ ID NO: 1623562 - RNA, 18 nt, Homo sapiens
aaucagcccagugcaaac

SEQ ID NO: 1623563 - RNA, 18 nt, Homo sapiens
aaucagucauuucuucau

SEQ ID NO: 1623564 - RNA, 20 nt, Homo sapiens
aaucauaaaggaucagagau

SEQ ID NO: 1623565 - RNA, 19 nt, Homo sapiens
aaucauacaaacucucacc

SEQ ID NO: 1623566 - RNA, 18 nt, Homo sapiens
aauccccaacaugcacug

SEQ ID NO: 1623567 - RNA, 15 nt, Homo sapiens
aaucccucucacaag

SEQ ID NO: 1623568 - RNA, 18 nt, Homo sapiens
aaucccuguaauauuuag

SEQ ID NO: 1623569 - RNA, 18 nt, Homo sapiens
aauccuagcuacuuggca

SEQ ID NO: 1623570 - RNA, 21 nt, Homo sapiens
aauccugcucacaaaaucacu

SEQ ID NO: 1623571 - RNA, 19 nt, Homo sapiens
aauccuucuggcagauuca

SEQ ID NO: 1623572 - RNA, 19 nt, Homo sapiens
aaucgauucccaagcuccc

SEQ ID NO: 1623573 - RNA, 16 nt, Homo sapiens
aaucguuuauuucaca

SEQ ID NO: 1623574 - RNA, 15 nt, Homo sapiens
aaucuccugacuuca

SEQ ID NO: 1623575 - RNA, 16 nt, Homo sapiens
aaucucugaauuugag

SEQ ID NO: 1623576 - RNA, 18 nt, Homo sapiens
aaucuuagugaaugggaa

SEQ ID NO: 1623577 - RNA, 14 nt, Homo sapiens
aaucuuaugcucuc

SEQ ID NO: 1623578 - RNA, 19 nt, Homo sapiens
aaucuuuuaaaaauucaaa

SEQ ID NO: 1623579 - RNA, 15 nt, Homo sapiens
aaucuuuuacauuuu

SEQ ID NO: 1623580 - RNA, 16 nt, Homo sapiens
aaugaaaauucuaacc

SEQ ID NO: 1623581 - RNA, 13 nt, Homo sapiens
aaugaaauaguua

SEQ ID NO: 1623582 - RNA, 12 nt, Homo sapiens
aaugaaugacau

SEQ ID NO: 1623583 - RNA, 15 nt, Homo sapiens
aaugacaaacaugau

SEQ ID NO: 1623584 - RNA, 17 nt, Homo sapiens
aaugacuguagaacuua

SEQ ID NO: 1623585 - RNA, 14 nt, Homo sapiens
aaugagccaugaga

SEQ ID NO: 1623586 - RNA, 14 nt, Homo sapiens
aaugcaacaguuuu

SEQ ID NO: 1623587 - RNA, 18 nt, Homo sapiens
aaugcaagccaucucuaa

SEQ ID NO: 1623588 - RNA, 20 nt, Homo sapiens
aaugcauauuugccacaaaa

SEQ ID NO: 1623589 - RNA, 12 nt, Homo sapiens
aaugccauccag

SEQ ID NO: 1623590 - RNA, 21 nt, Homo sapiens
aaugcuagcacaauauuccua

SEQ ID NO: 1623591 - RNA, 14 nt, Homo sapiens
aaugcuggacugga

SEQ ID NO: 1623592 - RNA, 20 nt, Homo sapiens
aaugcuuacggccaucucuu

SEQ ID NO: 1623593 - RNA, 20 nt, Homo sapiens
aauggcauaugguccuagac

SEQ ID NO: 1623594 - RNA, 20 nt, Homo sapiens
aauggcgcgaucuuggcuca

SEQ ID NO: 1623595 - RNA, 15 nt, Homo sapiens
aaugggaaaaccaga

SEQ ID NO: 1623596 - RNA, 15 nt, Homo sapiens
aauguacauuuauuc

SEQ ID NO: 1623597 - RNA, 15 nt, Homo sapiens
aauguauugauucaa

SEQ ID NO: 1623598 - RNA, 14 nt, Homo sapiens
aaugucauggccuu

SEQ ID NO: 1623599 - RNA, 14 nt, Homo sapiens
aaugucugccaggu

SEQ ID NO: 1623600 - RNA, 20 nt, Homo sapiens
aaugucuuguguauuucucu

SEQ ID NO: 1623601 - RNA, 17 nt, Homo sapiens
aaugugaccuggggcag

SEQ ID NO: 1623602 - RNA, 12 nt, Homo sapiens
aaugugcacucu

SEQ ID NO: 1623603 - RNA, 19 nt, Homo sapiens
aaugugggcuauguaguca

SEQ ID NO: 1623604 - RNA, 18 nt, Homo sapiens
aauguuaauggucaaugc

SEQ ID NO: 1623605 - RNA, 21 nt, Homo sapiens
aauguuuaaauucucuuucac

SEQ ID NO: 1623606 - RNA, 21 nt, Homo sapiens
aauguuuucauuauguucaug

SEQ ID NO: 1623607 - RNA, 12 nt, Homo sapiens
aauuaagcauuu

SEQ ID NO: 1623608 - RNA, 19 nt, Homo sapiens
aauuagccacauguacacu

SEQ ID NO: 1623609 - RNA, 22 nt, Homo sapiens
aauuagccacauguacacuaca

SEQ ID NO: 1623610 - RNA, 14 nt, Homo sapiens
aauuagggcccaau

SEQ ID NO: 1623611 - RNA, 22 nt, Homo sapiens
aauuaugaaaacucaugaucaa

SEQ ID NO: 1623612 - RNA, 15 nt, Homo sapiens
aauuauuucucucac

SEQ ID NO: 1623613 - RNA, 17 nt, Homo sapiens
aauucagacaagcugca

SEQ ID NO: 1623614 - RNA, 22 nt, Homo sapiens
aauucagcuuuguccaaaggaa

SEQ ID NO: 1623615 - RNA, 22 nt, Homo sapiens
aauucucuaaccgaauauucau

SEQ ID NO: 1623616 - RNA, 13 nt, Homo sapiens
aauucucuuucac

SEQ ID NO: 1623617 - RNA, 21 nt, Homo sapiens
aauucuguuuuuaaugcuauu

SEQ ID NO: 1623618 - RNA, 15 nt, Homo sapiens
aauugacaacacagc

SEQ ID NO: 1623619 - RNA, 18 nt, Homo sapiens
aauugcucuuucacaggu

SEQ ID NO: 1623620 - RNA, 15 nt, Homo sapiens
aauugcuucuucuuc

SEQ ID NO: 1623621 - RNA, 22 nt, Homo sapiens
aauugcuucuucuucaagauuu

SEQ ID NO: 1623622 - RNA, 19 nt, Homo sapiens
aauuguaaauccuguguuu

SEQ ID NO: 1623623 - RNA, 17 nt, Homo sapiens
aauugucguuuuuauuc

SEQ ID NO: 1623624 - RNA, 12 nt, Homo sapiens
aauuuagcucuc

SEQ ID NO: 1623625 - RNA, 16 nt, Homo sapiens
aauuuauccauucaau

SEQ ID NO: 1623626 - RNA, 15 nt, Homo sapiens
aauuucauugcacuu

SEQ ID NO: 1623627 - RNA, 17 nt, Homo sapiens
aauuucucuuuacuuga

SEQ ID NO: 1623628 - RNA, 19 nt, Homo sapiens
aauuucucuuuacuugaaa

SEQ ID NO: 1623629 - RNA, 16 nt, Homo sapiens
aauuugauuuacauau

SEQ ID NO: 1623630 - RNA, 19 nt, Homo sapiens
aauuuggcuucuguuguca

SEQ ID NO: 1623631 - RNA, 20 nt, Homo sapiens
aauuuuagugucauuuccau

SEQ ID NO: 1623632 - RNA, 20 nt, Homo sapiens
aauuuucuugguucuuucag

SEQ ID NO: 1623633 - RNA, 18 nt, Homo sapiens
acaaaaaauagcuuucaa

SEQ ID NO: 1623634 - RNA, 17 nt, Homo sapiens
acaaaacacagccaagg

SEQ ID NO: 1623635 - RNA, 14 nt, Homo sapiens
acaaaacaguuuga

SEQ ID NO: 1623636 - RNA, 11 nt, Homo sapiens
acaaacagggc

SEQ ID NO: 1623637 - RNA, 22 nt, Homo sapiens
acaaacaugauacugcugcuug

SEQ ID NO: 1623638 - RNA, 14 nt, Homo sapiens
acaaaccaagccau

SEQ ID NO: 1623639 - RNA, 16 nt, Homo sapiens
acaaaccaagccaugc

SEQ ID NO: 1623640 - RNA, 14 nt, Homo sapiens
acaaaccacaccac

SEQ ID NO: 1623641 - RNA, 14 nt, Homo sapiens
acaaacccaagggc

SEQ ID NO: 1623642 - RNA, 13 nt, Homo sapiens
acaaacucucacc

SEQ ID NO: 1623643 - RNA, 16 nt, Homo sapiens
acaaagagaaugagaa

SEQ ID NO: 1623644 - RNA, 15 nt, Homo sapiens
acaaaggagccugug

SEQ ID NO: 1623645 - RNA, 18 nt, Homo sapiens
acaaauaaacucauuuaa

SEQ ID NO: 1623646 - RNA, 21 nt, Homo sapiens
acaaaucuucaguauuuucuc

SEQ ID NO: 1623647 - RNA, 18 nt, Homo sapiens
acaaauguggccaagccu

SEQ ID NO: 1623648 - RNA, 16 nt, Homo sapiens
acaaauuucauugcac

SEQ ID NO: 1623649 - RNA, 16 nt, Homo sapiens
acaaauuuuaacuucu

SEQ ID NO: 1623650 - RNA, 13 nt, Homo sapiens
acaacagcacaca

SEQ ID NO: 1623651 - RNA, 20 nt, Homo sapiens
acaacagguaaaacagggcc

SEQ ID NO: 1623652 - RNA, 16 nt, Homo sapiens
acaacuccuacaugau

SEQ ID NO: 1623653 - RNA, 16 nt, Homo sapiens
acaacucggggacaaa

SEQ ID NO: 1623654 - RNA, 17 nt, Homo sapiens
acaacucggggacaaau

SEQ ID NO: 1623655 - RNA, 17 nt, Homo sapiens
acaacuuaguguaauau

SEQ ID NO: 1623656 - RNA, 22 nt, Homo sapiens
acaagaacucuuuauguagcau

SEQ ID NO: 1623657 - RNA, 18 nt, Homo sapiens
acaagaccccgucucaaa

SEQ ID NO: 1623658 - RNA, 12 nt, Homo sapiens
acaaggccaucu

SEQ ID NO: 1623659 - RNA, 17 nt, Homo sapiens
acaaggcccugagcuuu

SEQ ID NO: 1623660 - RNA, 14 nt, Homo sapiens
acaaggcucugcua

SEQ ID NO: 1623661 - RNA, 19 nt, Homo sapiens
acaagggucacaauacugu

SEQ ID NO: 1623662 - RNA, 16 nt, Homo sapiens
acaaguggucugggac

SEQ ID NO: 1623663 - RNA, 21 nt, Homo sapiens
acaaguuagaaaauucagcuc

SEQ ID NO: 1623664 - RNA, 16 nt, Homo sapiens
acaaguuccugauaac

SEQ ID NO: 1623665 - RNA, 15 nt, Homo sapiens
acaauaacacugucu

SEQ ID NO: 1623666 - RNA, 16 nt, Homo sapiens
acaauauuaaguccaa

SEQ ID NO: 1623667 - RNA, 18 nt, Homo sapiens
acaaucagcccagugcaa

SEQ ID NO: 1623668 - RNA, 20 nt, Homo sapiens
acaaucagcccagugcaaac

SEQ ID NO: 1623669 - RNA, 19 nt, Homo sapiens
acaaugaacccccaugaug

SEQ ID NO: 1623670 - RNA, 22 nt, Homo sapiens
acaauuuggucuuagcuuuaca

SEQ ID NO: 1623671 - RNA, 23 nt, Homo sapiens
acaauuuggucuuagcuuuacau

SEQ ID NO: 1623672 - RNA, 17 nt, Homo sapiens
acacaaaccacaccaca

SEQ ID NO: 1623673 - RNA, 15 nt, Homo sapiens
acacaaguuccugau

SEQ ID NO: 1623674 - RNA, 18 nt, Homo sapiens
acacacuucggcucucug

SEQ ID NO: 1623675 - RNA, 21 nt, Homo sapiens
acacagaggggagucaccagc

SEQ ID NO: 1623676 - RNA, 23 nt, Homo sapiens
acacaguaauggggugagcucac

SEQ ID NO: 1623677 - RNA, 19 nt, Homo sapiens
acacauuggaauugauguc

SEQ ID NO: 1623678 - RNA, 17 nt, Homo sapiens
acacccaugcacacuca

SEQ ID NO: 1623679 - RNA, 23 nt, Homo sapiens
acacccccaugacauugcauuug

SEQ ID NO: 1623680 - RNA, 20 nt, Homo sapiens
acaccucaagguguucucug

SEQ ID NO: 1623681 - RNA, 19 nt, Homo sapiens
acaccucccugggccucuu

SEQ ID NO: 1623682 - RNA, 14 nt, Homo sapiens
acaccuggccuuaa

SEQ ID NO: 1623683 - RNA, 18 nt, Homo sapiens
acacguacaaaauccagc

SEQ ID NO: 1623684 - RNA, 12 nt, Homo sapiens
acacgugacaga

SEQ ID NO: 1623685 - RNA, 15 nt, Homo sapiens
acacguguccuguag

SEQ ID NO: 1623686 - RNA, 12 nt, Homo sapiens
acacuaccacau

SEQ ID NO: 1623687 - RNA, 18 nt, Homo sapiens
acacuccaacucuacaca

SEQ ID NO: 1623688 - RNA, 14 nt, Homo sapiens
acacucuucaguga

SEQ ID NO: 1623689 - RNA, 21 nt, Homo sapiens
acacugugauuuaucuuucaa

SEQ ID NO: 1623690 - RNA, 13 nt, Homo sapiens
acacugugucauu

SEQ ID NO: 1623691 - RNA, 18 nt, Homo sapiens
acacuucucaggacacag

SEQ ID NO: 1623692 - RNA, 16 nt, Homo sapiens
acacuuggaugcaggg

SEQ ID NO: 1623693 - RNA, 12 nt, Homo sapiens
acacuuugccau

SEQ ID NO: 1623694 - RNA, 18 nt, Homo sapiens
acagaaaacaucccacug

SEQ ID NO: 1623695 - RNA, 23 nt, Homo sapiens
acagaaaaguaauguaaaaucca

SEQ ID NO: 1623696 - RNA, 23 nt, Homo sapiens
acagaacagggucauguuugcag

SEQ ID NO: 1623697 - RNA, 21 nt, Homo sapiens
acagaaggaaaaaaacaugaa

SEQ ID NO: 1623698 - RNA, 13 nt, Homo sapiens
acagaagugacuu

SEQ ID NO: 1623699 - RNA, 15 nt, Homo sapiens
acagaauuguuccag

SEQ ID NO: 1623700 - RNA, 16 nt, Homo sapiens
acagaccuaauaucau

SEQ ID NO: 1623701 - RNA, 15 nt, Homo sapiens
acagauagcugccac

SEQ ID NO: 1623702 - RNA, 19 nt, Homo sapiens
acagaucaagcugugagac

SEQ ID NO: 1623703 - RNA, 15 nt, Homo sapiens
acagauggcauaccu

SEQ ID NO: 1623704 - RNA, 23 nt, Homo sapiens
acagauguuuguuuucaaaauac

SEQ ID NO: 1623705 - RNA, 22 nt, Homo sapiens
acagcaaccucuucaugagcuu

SEQ ID NO: 1623706 - RNA, 14 nt, Homo sapiens
acagcacagccaac

SEQ ID NO: 1623707 - RNA, 15 nt, Homo sapiens
acagcagccuggggc

SEQ ID NO: 1623708 - RNA, 12 nt, Homo sapiens
acagcauugcuu

SEQ ID NO: 1623709 - RNA, 17 nt, Homo sapiens
acagccauagugugugu

SEQ ID NO: 1623710 - RNA, 14 nt, Homo sapiens
acagcuaaccacuu

SEQ ID NO: 1623711 - RNA, 15 nt, Homo sapiens
acagcuuuucuugau

SEQ ID NO: 1623712 - RNA, 14 nt, Homo sapiens
acaggaccaccucc

SEQ ID NO: 1623713 - RNA, 23 nt, Homo sapiens
acaggaggcccccaucuaugagc

SEQ ID NO: 1623714 - RNA, 12 nt, Homo sapiens
acaggcacucca

SEQ ID NO: 1623715 - RNA, 17 nt, Homo sapiens
acaggcgcaacuccucc

SEQ ID NO: 1623716 - RNA, 15 nt, Homo sapiens
acaggcgugagccac

SEQ ID NO: 1623717 - RNA, 18 nt, Homo sapiens
acagggaagaaacuuucu

SEQ ID NO: 1623718 - RNA, 15 nt, Homo sapiens
acagggagugcacau

SEQ ID NO: 1623719 - RNA, 23 nt, Homo sapiens
acagggccaguggggccugugga

SEQ ID NO: 1623720 - RNA, 17 nt, Homo sapiens
acaggguccucagcuca

SEQ ID NO: 1623721 - RNA, 14 nt, Homo sapiens
acaggugugcacca

SEQ ID NO: 1623722 - RNA, 16 nt, Homo sapiens
acaguccuguccucug

SEQ ID NO: 1623723 - RNA, 14 nt, Homo sapiens
acagugggaaauau

SEQ ID NO: 1623724 - RNA, 20 nt, Homo sapiens
acaguugcauuuagcuucuu

SEQ ID NO: 1623725 - RNA, 20 nt, Homo sapiens
acaguugugauaauagcauu

SEQ ID NO: 1623726 - RNA, 17 nt, Homo sapiens
acauaaagcacuaccua

SEQ ID NO: 1623727 - RNA, 14 nt, Homo sapiens
acauaaagccaugu

SEQ ID NO: 1623728 - RNA, 21 nt, Homo sapiens
acauaaucuguacaaugaacc

SEQ ID NO: 1623729 - RNA, 15 nt, Homo sapiens
acauacuuaaugcau

SEQ ID NO: 1623730 - RNA, 21 nt, Homo sapiens
acauagaaagccaugugcuaa

SEQ ID NO: 1623731 - RNA, 21 nt, Homo sapiens
acauagucuuuguuuacauga

SEQ ID NO: 1623732 - RNA, 12 nt, Homo sapiens
acauaugcaccu

SEQ ID NO: 1623733 - RNA, 17 nt, Homo sapiens
acauauguaaacauaag

SEQ ID NO: 1623734 - RNA, 21 nt, Homo sapiens
acauaugucuuacuacuuuaa

SEQ ID NO: 1623735 - RNA, 20 nt, Homo sapiens
acauccaaaagcaaccacaa

SEQ ID NO: 1623736 - RNA, 15 nt, Homo sapiens
acauccagucacuuu

SEQ ID NO: 1623737 - RNA, 15 nt, Homo sapiens
acaucucccuuccac

SEQ ID NO: 1623738 - RNA, 18 nt, Homo sapiens
acaucucccuuccaccuc

SEQ ID NO: 1623739 - RNA, 13 nt, Homo sapiens
acaucuuccacca

SEQ ID NO: 1623740 - RNA, 17 nt, Homo sapiens
acaugaauccugugaua

SEQ ID NO: 1623741 - RNA, 19 nt, Homo sapiens
acaugaauuucauugaacu

SEQ ID NO: 1623742 - RNA, 16 nt, Homo sapiens
acaugaccacauagca

SEQ ID NO: 1623743 - RNA, 19 nt, Homo sapiens
acaugaguucaaauacuuu

SEQ ID NO: 1623744 - RNA, 21 nt, Homo sapiens
acaugccaggccucagggauc

SEQ ID NO: 1623745 - RNA, 22 nt, Homo sapiens
acaugcuuuucugccacuccau

SEQ ID NO: 1623746 - RNA, 17 nt, Homo sapiens
acauggacugcuucauc

SEQ ID NO: 1623747 - RNA, 14 nt, Homo sapiens
acauggccuaugca

SEQ ID NO: 1623748 - RNA, 19 nt, Homo sapiens
acauggccuaugcacauau

SEQ ID NO: 1623749 - RNA, 19 nt, Homo sapiens
acaugggaccuauaacugc

SEQ ID NO: 1623750 - RNA, 22 nt, Homo sapiens
acauguagggcaagaggaugaa

SEQ ID NO: 1623751 - RNA, 14 nt, Homo sapiens
acaugucuugacug

SEQ ID NO: 1623752 - RNA, 19 nt, Homo sapiens
acauguguagccugugcau

SEQ ID NO: 1623753 - RNA, 20 nt, Homo sapiens
acauguguagccugugcaug

SEQ ID NO: 1623754 - RNA, 21 nt, Homo sapiens
acauguuuguuucuguagaaa

SEQ ID NO: 1623755 - RNA, 16 nt, Homo sapiens
acauuaacggugcuaa

SEQ ID NO: 1623756 - RNA, 22 nt, Homo sapiens
acauuaacucccuccaccagcc

SEQ ID NO: 1623757 - RNA, 21 nt, Homo sapiens
acauuauccauccucugagau

SEQ ID NO: 1623758 - RNA, 22 nt, Homo sapiens
acauuauuuggcuuaaaccaga

SEQ ID NO: 1623759 - RNA, 20 nt, Homo sapiens
acauucaauagcauaucaca

SEQ ID NO: 1623760 - RNA, 14 nt, Homo sapiens
acauucagggcuau

SEQ ID NO: 1623761 - RNA, 21 nt, Homo sapiens
acauucuuccugauuauuuuc

SEQ ID NO: 1623762 - RNA, 19 nt, Homo sapiens
acauugcagcuucaacuuu

SEQ ID NO: 1623763 - RNA, 14 nt, Homo sapiens
acauuuucauugau

SEQ ID NO: 1623764 - RNA, 15 nt, Homo sapiens
acauuuuuccaguaa

SEQ ID NO: 1623765 - RNA, 20 nt, Homo sapiens
acauuuuuguggcuuaugac

SEQ ID NO: 1623766 - RNA, 16 nt, Homo sapiens
accaaaaccacagugc

SEQ ID NO: 1623767 - RNA, 17 nt, Homo sapiens
accaaacugccucaauc

SEQ ID NO: 1623768 - RNA, 22 nt, Homo sapiens
accaaagggaugguauugagaa

SEQ ID NO: 1623769 - RNA, 16 nt, Homo sapiens
accaaagucacaucca

SEQ ID NO: 1623770 - RNA, 14 nt, Homo sapiens
accaaguugugcuu

SEQ ID NO: 1623771 - RNA, 17 nt, Homo sapiens
accaauauuaccaucuu

SEQ ID NO: 1623772 - RNA, 15 nt, Homo sapiens
accaaugucauaaca

SEQ ID NO: 1623773 - RNA, 20 nt, Homo sapiens
accacaaaaaagaaacuugc

SEQ ID NO: 1623774 - RNA, 13 nt, Homo sapiens
accaccuucccuu

SEQ ID NO: 1623775 - RNA, 22 nt, Homo sapiens
accacuuuccccgugggccaug

SEQ ID NO: 1623776 - RNA, 14 nt, Homo sapiens
accagaacccagug

SEQ ID NO: 1623777 - RNA, 20 nt, Homo sapiens
accagcccugaccccagugu

SEQ ID NO: 1623778 - RNA, 21 nt, Homo sapiens
accagggagcugcaggggcau

SEQ ID NO: 1623779 - RNA, 13 nt, Homo sapiens
accagggaugcug

SEQ ID NO: 1623780 - RNA, 20 nt, Homo sapiens
accagggaugucuguugaaa

SEQ ID NO: 1623781 - RNA, 22 nt, Homo sapiens
accagggaugucuguugaaaua

SEQ ID NO: 1623782 - RNA, 14 nt, Homo sapiens
accagggcugcucu

SEQ ID NO: 1623783 - RNA, 13 nt, Homo sapiens
accaguacuugag

SEQ ID NO: 1623784 - RNA, 17 nt, Homo sapiens
accagucugacccuuac

SEQ ID NO: 1623785 - RNA, 22 nt, Homo sapiens
accagugcaucacaucugcaca

SEQ ID NO: 1623786 - RNA, 22 nt, Homo sapiens
accaguuucuaucccuuaccug

SEQ ID NO: 1623787 - RNA, 13 nt, Homo sapiens
accauacauuuaa

SEQ ID NO: 1623788 - RNA, 17 nt, Homo sapiens
accauauguccacuguu

SEQ ID NO: 1623789 - RNA, 21 nt, Homo sapiens
accauccugccauccuugacu

SEQ ID NO: 1623790 - RNA, 22 nt, Homo sapiens
accauccuuguagacucagaaa

SEQ ID NO: 1623791 - RNA, 15 nt, Homo sapiens
accaugagaugguuu

SEQ ID NO: 1623792 - RNA, 22 nt, Homo sapiens
accaugcugugagcagcagggc

SEQ ID NO: 1623793 - RNA, 22 nt, Homo sapiens
accauuccugccuuuaagccaa

SEQ ID NO: 1623794 - RNA, 19 nt, Homo sapiens
acccaccccacaauuccuc

SEQ ID NO: 1623795 - RNA, 19 nt, Homo sapiens
acccacgcagagaagcccc

SEQ ID NO: 1623796 - RNA, 16 nt, Homo sapiens
acccaggaagacuuug

SEQ ID NO: 1623797 - RNA, 15 nt, Homo sapiens
acccaggcaugcaau

SEQ ID NO: 1623798 - RNA, 17 nt, Homo sapiens
acccagggacacuccaa

SEQ ID NO: 1623799 - RNA, 19 nt, Homo sapiens
acccagggacacuccaacu

SEQ ID NO: 1623800 - RNA, 19 nt, Homo sapiens
acccaggguggagugcagu

SEQ ID NO: 1623801 - RNA, 19 nt, Homo sapiens
acccaguggacucuuccac

SEQ ID NO: 1623802 - RNA, 18 nt, Homo sapiens
acccagugguccccagag

SEQ ID NO: 1623803 - RNA, 17 nt, Homo sapiens
accccaguggauucuca

SEQ ID NO: 1623804 - RNA, 18 nt, Homo sapiens
accccaguggauucucau

SEQ ID NO: 1623805 - RNA, 14 nt, Homo sapiens
acccccagccuggg

SEQ ID NO: 1623806 - RNA, 20 nt, Homo sapiens
acccccagguggaaggcaga

SEQ ID NO: 1623807 - RNA, 14 nt, Homo sapiens
acccccucauuugu

SEQ ID NO: 1623808 - RNA, 21 nt, Homo sapiens
accccggggugcccacaggcc

SEQ ID NO: 1623809 - RNA, 14 nt, Homo sapiens
accccucacuguga

SEQ ID NO: 1623810 - RNA, 14 nt, Homo sapiens
accccugucccaac

SEQ ID NO: 1623811 - RNA, 23 nt, Homo sapiens
accccugucccaaccccagugga

SEQ ID NO: 1623812 - RNA, 17 nt, Homo sapiens
accccuguuucuggcac

SEQ ID NO: 1623813 - RNA, 15 nt, Homo sapiens
acccgagaagcacuu

SEQ ID NO: 1623814 - RNA, 16 nt, Homo sapiens
acccgcagaguucuca

SEQ ID NO: 1623815 - RNA, 15 nt, Homo sapiens
acccuaauguggcag

SEQ ID NO: 1623816 - RNA, 15 nt, Homo sapiens
acccuccacucagcu

SEQ ID NO: 1623817 - RNA, 19 nt, Homo sapiens
acccuccacucagcugucc

SEQ ID NO: 1623818 - RNA, 21 nt, Homo sapiens
acccuccacucagcuguccug

SEQ ID NO: 1623819 - RNA, 15 nt, Homo sapiens
acccuccccuaguca

SEQ ID NO: 1623820 - RNA, 20 nt, Homo sapiens
acccuccuugggacugaagg

SEQ ID NO: 1623821 - RNA, 19 nt, Homo sapiens
acccuuuuuugaaccaaca

SEQ ID NO: 1623822 - RNA, 17 nt, Homo sapiens
accgccugaaggcacag

SEQ ID NO: 1623823 - RNA, 21 nt, Homo sapiens
accgcuguggccggcacucca

SEQ ID NO: 1623824 - RNA, 21 nt, Homo sapiens
accgguucccacaagccugcc

SEQ ID NO: 1623825 - RNA, 20 nt, Homo sapiens
accgucacacucuucaguga

SEQ ID NO: 1623826 - RNA, 17 nt, Homo sapiens
accguggcccuuccugg

SEQ ID NO: 1623827 - RNA, 17 nt, Homo sapiens
accucaagguguucucu

SEQ ID NO: 1623828 - RNA, 20 nt, Homo sapiens
accucaagguguucucugua

SEQ ID NO: 1623829 - RNA, 21 nt, Homo sapiens
accucaucuguggagcugcca

SEQ ID NO: 1623830 - RNA, 17 nt, Homo sapiens
accuccaaaagcccuga

SEQ ID NO: 1623831 - RNA, 20 nt, Homo sapiens
accuccaagcauuucaugaa

SEQ ID NO: 1623832 - RNA, 20 nt, Homo sapiens
accuccgccagauccugcag

SEQ ID NO: 1623833 - RNA, 13 nt, Homo sapiens
accuccuguggac

SEQ ID NO: 1623834 - RNA, 13 nt, Homo sapiens
accucgugaucua

SEQ ID NO: 1623835 - RNA, 22 nt, Homo sapiens
accucuucaugagcuugaacaa

SEQ ID NO: 1623836 - RNA, 11 nt, Homo sapiens
accucuuccac

SEQ ID NO: 1623837 - RNA, 13 nt, Homo sapiens
accugacucuugc

SEQ ID NO: 1623838 - RNA, 15 nt, Homo sapiens
accugacucuugcag

SEQ ID NO: 1623839 - RNA, 13 nt, Homo sapiens
accugacugccac

SEQ ID NO: 1623840 - RNA, 14 nt, Homo sapiens
accugcagccagca

SEQ ID NO: 1623841 - RNA, 17 nt, Homo sapiens
accugcaugugcuguca

SEQ ID NO: 1623842 - RNA, 22 nt, Homo sapiens
accugccaagagucaacagguc

SEQ ID NO: 1623843 - RNA, 22 nt, Homo sapiens
accugcccaaggaugcugucaa

SEQ ID NO: 1623844 - RNA, 18 nt, Homo sapiens
accugcugagcucugaga

SEQ ID NO: 1623845 - RNA, 20 nt, Homo sapiens
accuggcagacuugcccagg

SEQ ID NO: 1623846 - RNA, 19 nt, Homo sapiens
accuggcagccacaacugc

SEQ ID NO: 1623847 - RNA, 17 nt, Homo sapiens
accuggcagcccugggc

SEQ ID NO: 1623848 - RNA, 20 nt, Homo sapiens
accugggcuuaaguuuuacu

SEQ ID NO: 1623849 - RNA, 20 nt, Homo sapiens
accuguguggacaggacuaa

SEQ ID NO: 1623850 - RNA, 16 nt, Homo sapiens
accuguuagcagacag

SEQ ID NO: 1623851 - RNA, 19 nt, Homo sapiens
accuguuagcagacaggcc

SEQ ID NO: 1623852 - RNA, 20 nt, Homo sapiens
accuuaaagaaccaucagca

SEQ ID NO: 1623853 - RNA, 14 nt, Homo sapiens
accuucacucucca

SEQ ID NO: 1623854 - RNA, 14 nt, Homo sapiens
accuuccuuaccuc

SEQ ID NO: 1623855 - RNA, 21 nt, Homo sapiens
accuugaugguaggugugaca

SEQ ID NO: 1623856 - RNA, 22 nt, Homo sapiens
accuugucucccagcucagggc

SEQ ID NO: 1623857 - RNA, 15 nt, Homo sapiens
accuugugucuguac

SEQ ID NO: 1623858 - RNA, 14 nt, Homo sapiens
accuuuuacucuuc

SEQ ID NO: 1623859 - RNA, 14 nt, Homo sapiens
acgacauacaugcu

SEQ ID NO: 1623860 - RNA, 19 nt, Homo sapiens
acgaugcaauucuagccaa

SEQ ID NO: 1623861 - RNA, 20 nt, Homo sapiens
acgcaccgccugaaggcaca

SEQ ID NO: 1623862 - RNA, 21 nt, Homo sapiens
acgcaccgccugaaggcacag

SEQ ID NO: 1623863 - RNA, 14 nt, Homo sapiens
acgcaccugccuca

SEQ ID NO: 1623864 - RNA, 20 nt, Homo sapiens
acgcuuguagaacucacucu

SEQ ID NO: 1623865 - RNA, 16 nt, Homo sapiens
acggacugucaguucu

SEQ ID NO: 1623866 - RNA, 18 nt, Homo sapiens
acggagucuugcucuguc

SEQ ID NO: 1623867 - RNA, 21 nt, Homo sapiens
acggaucugcugggcucugcc

SEQ ID NO: 1623868 - RNA, 12 nt, Homo sapiens
acggcacugugg

SEQ ID NO: 1623869 - RNA, 21 nt, Homo sapiens
acggcccucaucuaugaggaa

SEQ ID NO: 1623870 - RNA, 18 nt, Homo sapiens
acggcuuguaaaugugac

SEQ ID NO: 1623871 - RNA, 11 nt, Homo sapiens
acggugcaguc

SEQ ID NO: 1623872 - RNA, 19 nt, Homo sapiens
acggugcagucugggugcu

SEQ ID NO: 1623873 - RNA, 17 nt, Homo sapiens
acgguuuaauucugucu

SEQ ID NO: 1623874 - RNA, 21 nt, Homo sapiens
acguacaaaauccagcuauga

SEQ ID NO: 1623875 - RNA, 14 nt, Homo sapiens
acgucuaacuggaa

SEQ ID NO: 1623876 - RNA, 22 nt, Homo sapiens
acgucuggacugcuauucuaga

SEQ ID NO: 1623877 - RNA, 20 nt, Homo sapiens
acgugauccucucaccucag

SEQ ID NO: 1623878 - RNA, 16 nt, Homo sapiens
acguggcucagccagc

SEQ ID NO: 1623879 - RNA, 17 nt, Homo sapiens
acguugucccugagauu

SEQ ID NO: 1623880 - RNA, 15 nt, Homo sapiens
acuaaaacacugaaa

SEQ ID NO: 1623881 - RNA, 23 nt, Homo sapiens
acuaaaucaaucugcaguuuaac

SEQ ID NO: 1623882 - RNA, 19 nt, Homo sapiens
acuaaccagagucagcaca

SEQ ID NO: 1623883 - RNA, 22 nt, Homo sapiens
acuaaggaguaaucuguguaca

SEQ ID NO: 1623884 - RNA, 20 nt, Homo sapiens
acuaaugauaaaguaaugau

SEQ ID NO: 1623885 - RNA, 15 nt, Homo sapiens
acuaauuuuacaugu

SEQ ID NO: 1623886 - RNA, 23 nt, Homo sapiens
acuacucagccuagcacaggcug

SEQ ID NO: 1623887 - RNA, 19 nt, Homo sapiens
acuagcaggcaaugcugua

SEQ ID NO: 1623888 - RNA, 13 nt, Homo sapiens
acuaggauacugc

SEQ ID NO: 1623889 - RNA, 11 nt, Homo sapiens
acuagugcaau

SEQ ID NO: 1623890 - RNA, 21 nt, Homo sapiens
acuauaaugaaaacauccuug

SEQ ID NO: 1623891 - RNA, 18 nt, Homo sapiens
acuauacuguacaugaaa

SEQ ID NO: 1623892 - RNA, 20 nt, Homo sapiens
acuaucugugccagagguaa

SEQ ID NO: 1623893 - RNA, 15 nt, Homo sapiens
acuauggagugcuca

SEQ ID NO: 1623894 - RNA, 17 nt, Homo sapiens
acuauggagugcucaca

SEQ ID NO: 1623895 - RNA, 14 nt, Homo sapiens
acuauguacugccu

SEQ ID NO: 1623896 - RNA, 14 nt, Homo sapiens
acuauucauaagau

SEQ ID NO: 1623897 - RNA, 20 nt, Homo sapiens
acuauugcagaccugucacc

SEQ ID NO: 1623898 - RNA, 19 nt, Homo sapiens
acuauugugaccacaggcu

SEQ ID NO: 1623899 - RNA, 20 nt, Homo sapiens
acuauugugaccacaggcug

SEQ ID NO: 1623900 - RNA, 22 nt, Homo sapiens
acucaacuucuuuccucuggag

SEQ ID NO: 1623901 - RNA, 13 nt, Homo sapiens
acucacugugauc

SEQ ID NO: 1623902 - RNA, 19 nt, Homo sapiens
acucagccggcagccagau

SEQ ID NO: 1623903 - RNA, 16 nt, Homo sapiens
acucagggauuccuuc

SEQ ID NO: 1623904 - RNA, 15 nt, Homo sapiens
acucauuuaucuccu

SEQ ID NO: 1623905 - RNA, 19 nt, Homo sapiens
acuccagagucaguaguua

SEQ ID NO: 1623906 - RNA, 19 nt, Homo sapiens
acucccaccacaggcauaa

SEQ ID NO: 1623907 - RNA, 14 nt, Homo sapiens
acuccugaccucag

SEQ ID NO: 1623908 - RNA, 15 nt, Homo sapiens
acucuacacagcuca

SEQ ID NO: 1623909 - RNA, 17 nt, Homo sapiens
acucucgcaucuuccca

SEQ ID NO: 1623910 - RNA, 23 nt, Homo sapiens
acucugacaagcuggccaaaguc

SEQ ID NO: 1623911 - RNA, 14 nt, Homo sapiens
acucugcacaugaa

SEQ ID NO: 1623912 - RNA, 14 nt, Homo sapiens
acucugcacauguc

SEQ ID NO: 1623913 - RNA, 19 nt, Homo sapiens
acucugcacaugucuugua

SEQ ID NO: 1623914 - RNA, 14 nt, Homo sapiens
acucugcugucuaa

SEQ ID NO: 1623915 - RNA, 21 nt, Homo sapiens
acucugcuuuuuuucuacugu

SEQ ID NO: 1623916 - RNA, 15 nt, Homo sapiens
acucugucuaccugg

SEQ ID NO: 1623917 - RNA, 22 nt, Homo sapiens
acucugugccagagccuggggc

SEQ ID NO: 1623918 - RNA, 22 nt, Homo sapiens
acucuucaaggaggcccacugu

SEQ ID NO: 1623919 - RNA, 22 nt, Homo sapiens
acucuugaaguacuuaacauac

SEQ ID NO: 1623920 - RNA, 18 nt, Homo sapiens
acugaagcugcacagugu

SEQ ID NO: 1623921 - RNA, 18 nt, Homo sapiens
acugaccggugcuuuuau

SEQ ID NO: 1623922 - RNA, 18 nt, Homo sapiens
acugaugccccagggauu

SEQ ID NO: 1623923 - RNA, 20 nt, Homo sapiens
acugauugcucccaggaucu

SEQ ID NO: 1623924 - RNA, 16 nt, Homo sapiens
acugcacaguagagca

SEQ ID NO: 1623925 - RNA, 23 nt, Homo sapiens
acugcacuuuggaaaccaagcaa

SEQ ID NO: 1623926 - RNA, 12 nt, Homo sapiens
acugccaagaaa

SEQ ID NO: 1623927 - RNA, 19 nt, Homo sapiens
acugccaggagggacaaag

SEQ ID NO: 1623928 - RNA, 17 nt, Homo sapiens
acugccaggcuguuuca

SEQ ID NO: 1623929 - RNA, 21 nt, Homo sapiens
acugcccaggccuaucuggaa

SEQ ID NO: 1623930 - RNA, 20 nt, Homo sapiens
acugcuagcuuucuccuuac

SEQ ID NO: 1623931 - RNA, 24 nt, Homo sapiens
acugcuagcuuucuccuuaccguc

SEQ ID NO: 1623932 - RNA, 15 nt, Homo sapiens
acugcugcuugucaa

SEQ ID NO: 1623933 - RNA, 14 nt, Homo sapiens
acugcuucauguga

SEQ ID NO: 1623934 - RNA, 19 nt, Homo sapiens
acugcuuuuuugauucuga

SEQ ID NO: 1623935 - RNA, 17 nt, Homo sapiens
acuggauucauucucau

SEQ ID NO: 1623936 - RNA, 15 nt, Homo sapiens
acuggcaugcuaaag

SEQ ID NO: 1623937 - RNA, 24 nt, Homo sapiens
acugguuaaaaaacaaauguucau

SEQ ID NO: 1623938 - RNA, 15 nt, Homo sapiens
acugguuuucugcca

SEQ ID NO: 1623939 - RNA, 21 nt, Homo sapiens
acuguacacagaauuguucca

SEQ ID NO: 1623940 - RNA, 22 nt, Homo sapiens
acuguacacagaauuguuccag

SEQ ID NO: 1623941 - RNA, 19 nt, Homo sapiens
acuguccuguccugcucau

SEQ ID NO: 1623942 - RNA, 19 nt, Homo sapiens
acugucuccuuucucuuau

SEQ ID NO: 1623943 - RNA, 21 nt, Homo sapiens
acugucugugaacagagagac

SEQ ID NO: 1623944 - RNA, 20 nt, Homo sapiens
acugugacacuuaucucacu

SEQ ID NO: 1623945 - RNA, 17 nt, Homo sapiens
acugugauacaguuuug

SEQ ID NO: 1623946 - RNA, 15 nt, Homo sapiens
acuguguaacuuucu

SEQ ID NO: 1623947 - RNA, 23 nt, Homo sapiens
acugugucauucuguuagauacu

SEQ ID NO: 1623948 - RNA, 22 nt, Homo sapiens
acuguucaauacuguaugccuu

SEQ ID NO: 1623949 - RNA, 16 nt, Homo sapiens
acuguuugauuuggau

SEQ ID NO: 1623950 - RNA, 22 nt, Homo sapiens
acuuaaaaaauacuugcaugaa

SEQ ID NO: 1623951 - RNA, 17 nt, Homo sapiens
acuuaaggaaguuugau

SEQ ID NO: 1623952 - RNA, 13 nt, Homo sapiens
acuuacacuguau

SEQ ID NO: 1623953 - RNA, 22 nt, Homo sapiens
acuuaguaaguaauaucaaagc

SEQ ID NO: 1623954 - RNA, 15 nt, Homo sapiens
acuuauugccaaaaa

SEQ ID NO: 1623955 - RNA, 14 nt, Homo sapiens
acuucacgcuuuca

SEQ ID NO: 1623956 - RNA, 15 nt, Homo sapiens
acuucacuaggcauu

SEQ ID NO: 1623957 - RNA, 18 nt, Homo sapiens
acuucauucacauucaga

SEQ ID NO: 1623958 - RNA, 22 nt, Homo sapiens
acuuccccaagaucugccagac

SEQ ID NO: 1623959 - RNA, 16 nt, Homo sapiens
acuucgcacacaccca

SEQ ID NO: 1623960 - RNA, 18 nt, Homo sapiens
acuucuucaccucuucca

SEQ ID NO: 1623961 - RNA, 17 nt, Homo sapiens
acuucuugcuucaguca

SEQ ID NO: 1623962 - RNA, 15 nt, Homo sapiens
acuucuugucagaca

SEQ ID NO: 1623963 - RNA, 16 nt, Homo sapiens
acuugaaauucuuuca

SEQ ID NO: 1623964 - RNA, 21 nt, Homo sapiens
acuugaaauucuuucagcuau

SEQ ID NO: 1623965 - RNA, 17 nt, Homo sapiens
acuugaagaaggaaaga

SEQ ID NO: 1623966 - RNA, 19 nt, Homo sapiens
acuugaggaucauaugaau

SEQ ID NO: 1623967 - RNA, 16 nt, Homo sapiens
acuugagggaccaaua

SEQ ID NO: 1623968 - RNA, 22 nt, Homo sapiens
acuugcauauuguuggcacaga

SEQ ID NO: 1623969 - RNA, 12 nt, Homo sapiens
acuugcauuuau

SEQ ID NO: 1623970 - RNA, 20 nt, Homo sapiens
acuugcauuuauuuaagaca

SEQ ID NO: 1623971 - RNA, 15 nt, Homo sapiens
acuugguucugaaua

SEQ ID NO: 1623972 - RNA, 19 nt, Homo sapiens
acuuuaaauccuaccaaag

SEQ ID NO: 1623973 - RNA, 20 nt, Homo sapiens
acuuuaaauccuaccaaagu

SEQ ID NO: 1623974 - RNA, 17 nt, Homo sapiens
acuuuaauuuccuugac

SEQ ID NO: 1623975 - RNA, 22 nt, Homo sapiens
acuuuauguaguuuuuauaugu

SEQ ID NO: 1623976 - RNA, 16 nt, Homo sapiens
acuuucacacuaagaa

SEQ ID NO: 1623977 - RNA, 17 nt, Homo sapiens
acuuuggcugaacuaca

SEQ ID NO: 1623978 - RNA, 15 nt, Homo sapiens
acuuugugagccaaa

SEQ ID NO: 1623979 - RNA, 23 nt, Homo sapiens
acuuuguuuucaagaugguguua

SEQ ID NO: 1623980 - RNA, 17 nt, Homo sapiens
acuuuuaucuacuucuc

SEQ ID NO: 1623981 - RNA, 14 nt, Homo sapiens
acuuuuauuaaaga

SEQ ID NO: 1623982 - RNA, 23 nt, Homo sapiens
acuuuucuuuuuuucaaaugaau

SEQ ID NO: 1623983 - RNA, 13 nt, Homo sapiens
acuuuugcuugaa

SEQ ID NO: 1623984 - RNA, 17 nt, Homo sapiens
acuuuuucuuguauuca

SEQ ID NO: 1623985 - RNA, 22 nt, Homo sapiens
acuuuuuucuaguacacuuuua

SEQ ID NO: 1623986 - RNA, 15 nt, Homo sapiens
agaaaaaaagggauc

SEQ ID NO: 1623987 - RNA, 17 nt, Homo sapiens
agaaaaauaucuuggcc

SEQ ID NO: 1623988 - RNA, 18 nt, Homo sapiens
agaaaacaagagauauac

SEQ ID NO: 1623989 - RNA, 17 nt, Homo sapiens
agaaaaggaacaguugc

SEQ ID NO: 1623990 - RNA, 17 nt, Homo sapiens
agaaaauguaguuagcu

SEQ ID NO: 1623991 - RNA, 14 nt, Homo sapiens
agaaacaagcugug

SEQ ID NO: 1623992 - RNA, 14 nt, Homo sapiens
agaaacuauaugca

SEQ ID NO: 1623993 - RNA, 17 nt, Homo sapiens
agaaacuugcugaucca

SEQ ID NO: 1623994 - RNA, 21 nt, Homo sapiens
agaaacuuucuggugcugucu

SEQ ID NO: 1623995 - RNA, 14 nt, Homo sapiens
agaaagauacuaau

SEQ ID NO: 1623996 - RNA, 19 nt, Homo sapiens
agaaagcucauggcugugu

SEQ ID NO: 1623997 - RNA, 12 nt, Homo sapiens
agaaagggaccc

SEQ ID NO: 1623998 - RNA, 21 nt, Homo sapiens
agaaauaaucccuguaauauu

SEQ ID NO: 1623999 - RNA, 13 nt, Homo sapiens
agaaaugcaaaac

SEQ ID NO: 1624000 - RNA, 15 nt, Homo sapiens
agaacaacuaccuga

SEQ ID NO: 1624001 - RNA, 21 nt, Homo sapiens
agaacagggucauguuugcag

SEQ ID NO: 1624002 - RNA, 19 nt, Homo sapiens
agaaccaugguaugaaggu

SEQ ID NO: 1624003 - RNA, 18 nt, Homo sapiens
agaacccaccaaccagaa

SEQ ID NO: 1624004 - RNA, 20 nt, Homo sapiens
agaacucccccaccuguggu

SEQ ID NO: 1624005 - RNA, 15 nt, Homo sapiens
agaacuuauucucug

SEQ ID NO: 1624006 - RNA, 17 nt, Homo sapiens
agaacuuucugauucac

SEQ ID NO: 1624007 - RNA, 22 nt, Homo sapiens
agaagacauggaugaucuggga

SEQ ID NO: 1624008 - RNA, 12 nt, Homo sapiens
agaagagcaaaa

SEQ ID NO: 1624009 - RNA, 18 nt, Homo sapiens
agaagagugccacauuua

SEQ ID NO: 1624010 - RNA, 13 nt, Homo sapiens
agaagcaagacac

SEQ ID NO: 1624011 - RNA, 19 nt, Homo sapiens
agaagcaaugggucacuca

SEQ ID NO: 1624012 - RNA, 12 nt, Homo sapiens
agaagcagcccu

SEQ ID NO: 1624013 - RNA, 14 nt, Homo sapiens
agaagcauuuugca

SEQ ID NO: 1624014 - RNA, 22 nt, Homo sapiens
agaagccccuuauuuuuagcca

SEQ ID NO: 1624015 - RNA, 15 nt, Homo sapiens
agaagguuaccaaga

SEQ ID NO: 1624016 - RNA, 12 nt, Homo sapiens
agaaguauuuau

SEQ ID NO: 1624017 - RNA, 18 nt, Homo sapiens
agaaguuuguagccaggu

SEQ ID NO: 1624018 - RNA, 18 nt, Homo sapiens
agaauaaggaacaacguu

SEQ ID NO: 1624019 - RNA, 21 nt, Homo sapiens
agaauacccaggaagacuuug

SEQ ID NO: 1624020 - RNA, 12 nt, Homo sapiens
agaauauuuacu

SEQ ID NO: 1624021 - RNA, 21 nt, Homo sapiens
agaauccagcuacgaauauag

SEQ ID NO: 1624022 - RNA, 18 nt, Homo sapiens
agaaucuaggccacccca

SEQ ID NO: 1624023 - RNA, 14 nt, Homo sapiens
agaauguuguacuu

SEQ ID NO: 1624024 - RNA, 18 nt, Homo sapiens
agaauuauacagaccuaa

SEQ ID NO: 1624025 - RNA, 21 nt, Homo sapiens
agaauucaaguggguauucug

SEQ ID NO: 1624026 - RNA, 17 nt, Homo sapiens
agacaaauucggaugua

SEQ ID NO: 1624027 - RNA, 13 nt, Homo sapiens
agacaaggugcua

SEQ ID NO: 1624028 - RNA, 17 nt, Homo sapiens
agacagaaccuuguuau

SEQ ID NO: 1624029 - RNA, 17 nt, Homo sapiens
agacagagggucucaga

SEQ ID NO: 1624030 - RNA, 23 nt, Homo sapiens
agacagcaggcagcgccaagugc

SEQ ID NO: 1624031 - RNA, 18 nt, Homo sapiens
agacaggaugaggucucg

SEQ ID NO: 1624032 - RNA, 19 nt, Homo sapiens
agacaggccccgugaggca

SEQ ID NO: 1624033 - RNA, 16 nt, Homo sapiens
agacaguuauugcaag

SEQ ID NO: 1624034 - RNA, 15 nt, Homo sapiens
agacauaaagccaug

SEQ ID NO: 1624035 - RNA, 21 nt, Homo sapiens
agacauauaacgcagucuaau

SEQ ID NO: 1624036 - RNA, 15 nt, Homo sapiens
agaccccacugccac

SEQ ID NO: 1624037 - RNA, 14 nt, Homo sapiens
agaccccagucaag

SEQ ID NO: 1624038 - RNA, 15 nt, Homo sapiens
agaccuccagcccug

SEQ ID NO: 1624039 - RNA, 15 nt, Homo sapiens
agaccugcaugguca

SEQ ID NO: 1624040 - RNA, 16 nt, Homo sapiens
agaccugccagccacu

SEQ ID NO: 1624041 - RNA, 12 nt, Homo sapiens
agaccugucacc

SEQ ID NO: 1624042 - RNA, 18 nt, Homo sapiens
agacgggguuucacugug

SEQ ID NO: 1624043 - RNA, 18 nt, Homo sapiens
cgagacaacagcacacag

SEQ ID NO: 1624044 - RNA, 14 nt, Homo sapiens
cgaguacucuugaa

SEQ ID NO: 1624045 - RNA, 15 nt, Homo sapiens
cgagucauggcuaau

SEQ ID NO: 1624046 - RNA, 23 nt, Homo sapiens
cgaucgauggaugggaugcacuc

SEQ ID NO: 1624047 - RNA, 22 nt, Homo sapiens
cgauggaugggaugcacucuca

SEQ ID NO: 1624048 - RNA, 12 nt, Homo sapiens
cgauguaugcag

SEQ ID NO: 1624049 - RNA, 13 nt, Homo sapiens
cgauguaugcagc

SEQ ID NO: 1624050 - RNA, 18 nt, Homo sapiens
cgcacaccaaauuuggca

SEQ ID NO: 1624051 - RNA, 17 nt, Homo sapiens
cgcacccucccuagcuc

SEQ ID NO: 1624052 - RNA, 21 nt, Homo sapiens
cgccagccacaggaccaccuc

SEQ ID NO: 1624053 - RNA, 17 nt, Homo sapiens
cgccaggcugaccacag

SEQ ID NO: 1624054 - RNA, 21 nt, Homo sapiens
cgcccacuugucccacuaucu

SEQ ID NO: 1624055 - RNA, 20 nt, Homo sapiens
cgcccaggcuggagugcagu

SEQ ID NO: 1624056 - RNA, 12 nt, Homo sapiens
cgcccagugcag

SEQ ID NO: 1624057 - RNA, 18 nt, Homo sapiens
cgccucacugaaacaugg

SEQ ID NO: 1624058 - RNA, 16 nt, Homo sapiens
cgcuacaccacucugg

SEQ ID NO: 1624059 - RNA, 12 nt, Homo sapiens
cgcuucugggaa

SEQ ID NO: 1624060 - RNA, 14 nt, Homo sapiens
cggacaguggcagg

SEQ ID NO: 1624061 - RNA, 13 nt, Homo sapiens
cggagcaucucag

SEQ ID NO: 1624062 - RNA, 21 nt, Homo sapiens
cggagcucccgggcacaucca

SEQ ID NO: 1624063 - RNA, 14 nt, Homo sapiens
cggauaaguuugaa

SEQ ID NO: 1624064 - RNA, 12 nt, Homo sapiens
cggauccugcug

SEQ ID NO: 1624065 - RNA, 21 nt, Homo sapiens
cggcagcgggcggaggggauc

SEQ ID NO: 1624066 - RNA, 16 nt, Homo sapiens
cggccccaucucucau

SEQ ID NO: 1624067 - RNA, 14 nt, Homo sapiens
cggccucccaaagu

SEQ ID NO: 1624068 - RNA, 13 nt, Homo sapiens
cgggagcacugcg

SEQ ID NO: 1624069 - RNA, 14 nt, Homo sapiens
cgggagcugcacua

SEQ ID NO: 1624070 - RNA, 21 nt, Homo sapiens
cgggcaaaauaaagugacaga

SEQ ID NO: 1624071 - RNA, 21 nt, Homo sapiens
cgggcuuggcggcucuagccc

SEQ ID NO: 1624072 - RNA, 22 nt, Homo sapiens
cggggugagggggggcucccug

SEQ ID NO: 1624073 - RNA, 16 nt, Homo sapiens
cgggguuucuccaugu

SEQ ID NO: 1624074 - RNA, 14 nt, Homo sapiens
cgguguuuugccau

SEQ ID NO: 1624075 - RNA, 11 nt, Homo sapiens
cgguucacucu

SEQ ID NO: 1624076 - RNA, 15 nt, Homo sapiens
cguacaccccagcuc

SEQ ID NO: 1624077 - RNA, 20 nt, Homo sapiens
cguaugagauccuuuagucc

SEQ ID NO: 1624078 - RNA, 23 nt, Homo sapiens
cgucagggagaggucaccagcug

SEQ ID NO: 1624079 - RNA, 14 nt, Homo sapiens
cgucauuacagggc

SEQ ID NO: 1624080 - RNA, 22 nt, Homo sapiens
cguccacaaaggucacaggcag

SEQ ID NO: 1624081 - RNA, 13 nt, Homo sapiens
cgucuaacuggaa

SEQ ID NO: 1624082 - RNA, 14 nt, Homo sapiens
cgugauacauuugg

SEQ ID NO: 1624083 - RNA, 13 nt, Homo sapiens
cguggaaaggggc

SEQ ID NO: 1624084 - RNA, 19 nt, Homo sapiens
cgugguaggacuguagaaa

SEQ ID NO: 1624085 - RNA, 17 nt, Homo sapiens
cguuccccgcuagguca

SEQ ID NO: 1624086 - RNA, 14 nt, Homo sapiens
cguuucuuuccacc

SEQ ID NO: 1624087 - RNA, 21 nt, Homo sapiens
cuaaaauuguauagaccuaaa

SEQ ID NO: 1624088 - RNA, 17 nt, Homo sapiens
cuaaacacaacaauaac

SEQ ID NO: 1624089 - RNA, 16 nt, Homo sapiens
cuaaacucagaggcag

SEQ ID NO: 1624090 - RNA, 14 nt, Homo sapiens
cuaaacugguguuu

SEQ ID NO: 1624091 - RNA, 21 nt, Homo sapiens
cuaaagaaaaauaucuuggcc

SEQ ID NO: 1624092 - RNA, 16 nt, Homo sapiens
cuaaaggacucuccag

SEQ ID NO: 1624093 - RNA, 18 nt, Homo sapiens
cuaaaggacucuccagcc

SEQ ID NO: 1624094 - RNA, 22 nt, Homo sapiens
cuaaaggggacuagacaguuag

SEQ ID NO: 1624095 - RNA, 23 nt, Homo sapiens
cuaaauaaaaauauguaauuuca

SEQ ID NO: 1624096 - RNA, 20 nt, Homo sapiens
cuaaaucauauuaguauuaa

SEQ ID NO: 1624097 - RNA, 21 nt, Homo sapiens
cuaacacagccaucaagggaa

SEQ ID NO: 1624098 - RNA, 14 nt, Homo sapiens
cuaacauagauuua

SEQ ID NO: 1624099 - RNA, 22 nt, Homo sapiens
cuaacccaagacaugacauucu

SEQ ID NO: 1624100 - RNA, 15 nt, Homo sapiens
cuaacuauauuugcu

SEQ ID NO: 1624101 - RNA, 19 nt, Homo sapiens
cuaacuauauuugcuuuuu

SEQ ID NO: 1624102 - RNA, 17 nt, Homo sapiens
cuaacuuuucuuaaggu

SEQ ID NO: 1624103 - RNA, 16 nt, Homo sapiens
cuaagaauaaacucca

SEQ ID NO: 1624104 - RNA, 17 nt, Homo sapiens
cuaagcaaguauauuua

SEQ ID NO: 1624105 - RNA, 21 nt, Homo sapiens
cuaaguguugugaaacuguaa

SEQ ID NO: 1624106 - RNA, 19 nt, Homo sapiens
cuaaucaaagccagggucu

SEQ ID NO: 1624107 - RNA, 14 nt, Homo sapiens
cuaauggcacuuau

SEQ ID NO: 1624108 - RNA, 17 nt, Homo sapiens
cuaaugugaucauauga

SEQ ID NO: 1624109 - RNA, 15 nt, Homo sapiens
cuaauuacauuucac

SEQ ID NO: 1624110 - RNA, 15 nt, Homo sapiens
cuaauuuacaagcac

SEQ ID NO: 1624111 - RNA, 22 nt, Homo sapiens
cuaauuuuuucccagacuacua

SEQ ID NO: 1624112 - RNA, 15 nt, Homo sapiens
cuacacagcucagca

SEQ ID NO: 1624113 - RNA, 15 nt, Homo sapiens
cuacacauacaugua

SEQ ID NO: 1624114 - RNA, 22 nt, Homo sapiens
cuacaccacucuggcagccaca

SEQ ID NO: 1624115 - RNA, 22 nt, Homo sapiens
cuacaguuuuuauuuagcaugg

SEQ ID NO: 1624116 - RNA, 18 nt, Homo sapiens
cuaccauucaaaauugcu

SEQ ID NO: 1624117 - RNA, 20 nt, Homo sapiens
cuaccucagcgucucuucca

SEQ ID NO: 1624118 - RNA, 16 nt, Homo sapiens
cuaccugagcuaaaua

SEQ ID NO: 1624119 - RNA, 23 nt, Homo sapiens
cuacucuaggcagugacagugcc

SEQ ID NO: 1624120 - RNA, 17 nt, Homo sapiens
cuacugagcauuugcac

SEQ ID NO: 1624121 - RNA, 14 nt, Homo sapiens
cuacugcucugugu

SEQ ID NO: 1624122 - RNA, 15 nt, Homo sapiens
cuacuuuaaauccua

SEQ ID NO: 1624123 - RNA, 22 nt, Homo sapiens
cuacuuuuuuuuaguucaauac

SEQ ID NO: 1624124 - RNA, 23 nt, Homo sapiens
cuagaaagggcuaauuaggucuc

SEQ ID NO: 1624125 - RNA, 22 nt, Homo sapiens
cuagaaucauacuuaacauuuc

SEQ ID NO: 1624126 - RNA, 14 nt, Homo sapiens
cuagagcuuuuauu

SEQ ID NO: 1624127 - RNA, 18 nt, Homo sapiens
cuagauuuucuacuuuau

SEQ ID NO: 1624128 - RNA, 21 nt, Homo sapiens
cuagcaaagacuugugugaug

SEQ ID NO: 1624129 - RNA, 13 nt, Homo sapiens
cuagcacacucuu

SEQ ID NO: 1624130 - RNA, 14 nt, Homo sapiens
cuagccaggucucc

SEQ ID NO: 1624131 - RNA, 13 nt, Homo sapiens
cuaggaauggagg

SEQ ID NO: 1624132 - RNA, 17 nt, Homo sapiens
cuaggauacugcugcgu

SEQ ID NO: 1624133 - RNA, 21 nt, Homo sapiens
cuaggccucuccaguuugcac

SEQ ID NO: 1624134 - RNA, 15 nt, Homo sapiens
cuaggguacaugucc

SEQ ID NO: 1624135 - RNA, 19 nt, Homo sapiens
cuaggucaaccccacugua

SEQ ID NO: 1624136 - RNA, 13 nt, Homo sapiens
cuagugggaguua

SEQ ID NO: 1624137 - RNA, 17 nt, Homo sapiens
cuaguugagagcaccuu

SEQ ID NO: 1624138 - RNA, 15 nt, Homo sapiens
cuaguuuuacuuuga

SEQ ID NO: 1624139 - RNA, 19 nt, Homo sapiens
cuauaaucccagcacuuug

SEQ ID NO: 1624140 - RNA, 14 nt, Homo sapiens
cuauaucuuaggua

SEQ ID NO: 1624141 - RNA, 12 nt, Homo sapiens
cuauauuugcuu

SEQ ID NO: 1624142 - RNA, 21 nt, Homo sapiens
cuaucaaaggaaaugagaaug

SEQ ID NO: 1624143 - RNA, 14 nt, Homo sapiens
cuaucccuuaccug

SEQ ID NO: 1624144 - RNA, 15 nt, Homo sapiens
cuaucuggaagccac

SEQ ID NO: 1624145 - RNA, 21 nt, Homo sapiens
cuaugauguugcuguucacag

SEQ ID NO: 1624146 - RNA, 23 nt, Homo sapiens
cuaugcacauauggacucugcac

SEQ ID NO: 1624147 - RNA, 18 nt, Homo sapiens
cuauggugagaugcagcu

SEQ ID NO: 1624148 - RNA, 14 nt, Homo sapiens
cuauguacugccuu

SEQ ID NO: 1624149 - RNA, 22 nt, Homo sapiens
cuauguacugccuuagugcuga

SEQ ID NO: 1624150 - RNA, 15 nt, Homo sapiens
cuauguucaaagacu

SEQ ID NO: 1624151 - RNA, 14 nt, Homo sapiens
cuauguuuauuuac

SEQ ID NO: 1624152 - RNA, 19 nt, Homo sapiens
cuauuauggaaaacugugu

SEQ ID NO: 1624153 - RNA, 14 nt, Homo sapiens
cuauucaaaaccuc

SEQ ID NO: 1624154 - RNA, 21 nt, Homo sapiens
cuauugcagaaugaagccauu

SEQ ID NO: 1624155 - RNA, 15 nt, Homo sapiens
cuauugugaccacag

SEQ ID NO: 1624156 - RNA, 19 nt, Homo sapiens
cuauuuccuuccagccuuu

SEQ ID NO: 1624157 - RNA, 14 nt, Homo sapiens
cucaaaugcaguau

SEQ ID NO: 1624158 - RNA, 12 nt, Homo sapiens
cucaacuucuuu

SEQ ID NO: 1624159 - RNA, 20 nt, Homo sapiens
cucaagccccauuuccucac

SEQ ID NO: 1624160 - RNA, 18 nt, Homo sapiens
cucaauagaucugggaga

SEQ ID NO: 1624161 - RNA, 21 nt, Homo sapiens
cucaaucugcaaacaugccag

SEQ ID NO: 1624162 - RNA, 18 nt, Homo sapiens
cucacaacagucaccuca

SEQ ID NO: 1624163 - RNA, 14 nt, Homo sapiens
cucacauaagccca

SEQ ID NO: 1624164 - RNA, 20 nt, Homo sapiens
cucacauaagcccaguucau

SEQ ID NO: 1624165 - RNA, 17 nt, Homo sapiens
cucaccaugaugugaag

SEQ ID NO: 1624166 - RNA, 14 nt, Homo sapiens
cucacuugcuucuu

SEQ ID NO: 1624167 - RNA, 20 nt, Homo sapiens
cucacuuuggaaucagaauu

SEQ ID NO: 1624168 - RNA, 21 nt, Homo sapiens
cucagaagugaaaaucuugga

SEQ ID NO: 1624169 - RNA, 20 nt, Homo sapiens
cucagaauaaggcaggcauu

SEQ ID NO: 1624170 - RNA, 18 nt, Homo sapiens
cucagaauugcacaucua

SEQ ID NO: 1624171 - RNA, 18 nt, Homo sapiens
cucagaccuccagcccug

SEQ ID NO: 1624172 - RNA, 15 nt, Homo sapiens
cucagcagacaucca

SEQ ID NO: 1624173 - RNA, 20 nt, Homo sapiens
cucagccuccugaguagcug

SEQ ID NO: 1624174 - RNA, 15 nt, Homo sapiens
cucagcuguccugca

SEQ ID NO: 1624175 - RNA, 19 nt, Homo sapiens
cucagcuguccugcagcaa

SEQ ID NO: 1624176 - RNA, 16 nt, Homo sapiens
cucaguuccugcagca

SEQ ID NO: 1624177 - RNA, 20 nt, Homo sapiens
cucauaaaaaucuagcacac

SEQ ID NO: 1624178 - RNA, 21 nt, Homo sapiens
cucauaacugggugguuugag

SEQ ID NO: 1624179 - RNA, 22 nt, Homo sapiens
cucauagccacuuuuauguuac

SEQ ID NO: 1624180 - RNA, 18 nt, Homo sapiens
cucaugagcuccugauca

SEQ ID NO: 1624181 - RNA, 19 nt, Homo sapiens
cucaugucauuaugacauu

SEQ ID NO: 1624182 - RNA, 16 nt, Homo sapiens
cucauuaaugacacuu

SEQ ID NO: 1624183 - RNA, 13 nt, Homo sapiens
cucauuacuguga

SEQ ID NO: 1624184 - RNA, 21 nt, Homo sapiens
cucauucuaugaacagugaca

SEQ ID NO: 1624185 - RNA, 16 nt, Homo sapiens
cucauugcuuaauucu

SEQ ID NO: 1624186 - RNA, 20 nt, Homo sapiens
cucauuuguuuaucugauuu

SEQ ID NO: 1624187 - RNA, 23 nt, Homo sapiens
cuccaaauccaaggaaacaugca

SEQ ID NO: 1624188 - RNA, 14 nt, Homo sapiens
cuccaagcauuuca

SEQ ID NO: 1624189 - RNA, 17 nt, Homo sapiens
cuccaccacugugcacu

SEQ ID NO: 1624190 - RNA, 21 nt, Homo sapiens
cuccagcccugggacagggca

SEQ ID NO: 1624191 - RNA, 21 nt, Homo sapiens
cuccagccugacuuggggaga

SEQ ID NO: 1624192 - RNA, 20 nt, Homo sapiens
cucccaaaugagccaugaga

SEQ ID NO: 1624193 - RNA, 12 nt, Homo sapiens
cucccacacaca

SEQ ID NO: 1624194 - RNA, 13 nt, Homo sapiens
cucccagggccau

SEQ ID NO: 1624195 - RNA, 19 nt, Homo sapiens
cucccccagccccagagaa

SEQ ID NO: 1624196 - RNA, 14 nt, Homo sapiens
cuccccugccccuc

SEQ ID NO: 1624197 - RNA, 18 nt, Homo sapiens
cuccccugggacuuuccc

SEQ ID NO: 1624198 - RNA, 18 nt, Homo sapiens
cucccuccucacucccua

SEQ ID NO: 1624199 - RNA, 14 nt, Homo sapiens
cucccucugacucu

SEQ ID NO: 1624200 - RNA, 18 nt, Homo sapiens
cucccugccucacaucuc

SEQ ID NO: 1624201 - RNA, 22 nt, Homo sapiens
cucccugggaggcgggcgcacu

SEQ ID NO: 1624202 - RNA, 15 nt, Homo sapiens
cuccgccagccacag

SEQ ID NO: 1624203 - RNA, 23 nt, Homo sapiens
cuccguacaccccagcuccuagg

SEQ ID NO: 1624204 - RNA, 16 nt, Homo sapiens
cuccucugaagcauuu

SEQ ID NO: 1624205 - RNA, 17 nt, Homo sapiens
cuccucugaagcauuug

SEQ ID NO: 1624206 - RNA, 18 nt, Homo sapiens
cuccucugugaagcauuc

SEQ ID NO: 1624207 - RNA, 15 nt, Homo sapiens
cuccugccaggguga

SEQ ID NO: 1624208 - RNA, 12 nt, Homo sapiens
cuccugcuccaa

SEQ ID NO: 1624209 - RNA, 21 nt, Homo sapiens
cuccuguggucucugaccagg

SEQ ID NO: 1624210 - RNA, 22 nt, Homo sapiens
cuccuuccuucccagaauguua

SEQ ID NO: 1624211 - RNA, 20 nt, Homo sapiens
cuccuuggcuuuaugcaaau

SEQ ID NO: 1624212 - RNA, 17 nt, Homo sapiens
cuccuugucccccguga

SEQ ID NO: 1624213 - RNA, 17 nt, Homo sapiens
cucgaacuaaaagccuu

SEQ ID NO: 1624214 - RNA, 19 nt, Homo sapiens
cucgccucauuacugugag

SEQ ID NO: 1624215 - RNA, 20 nt, Homo sapiens
cucggacuuacugccugacc

SEQ ID NO: 1624216 - RNA, 21 nt, Homo sapiens
cucggagggauggagaaagaa

SEQ ID NO: 1624217 - RNA, 14 nt, Homo sapiens
cucggggucccugg

SEQ ID NO: 1624218 - RNA, 15 nt, Homo sapiens
cucggggugcacagg

SEQ ID NO: 1624219 - RNA, 20 nt, Homo sapiens
cucgugguaggacuguagaa

SEQ ID NO: 1624220 - RNA, 15 nt, Homo sapiens
cucuaagcccaggau

SEQ ID NO: 1624221 - RNA, 17 nt, Homo sapiens
cucuaagcccaggaucu

SEQ ID NO: 1624222 - RNA, 18 nt, Homo sapiens
cucuacacagcucagcag

SEQ ID NO: 1624223 - RNA, 20 nt, Homo sapiens
cucuacacccacccaaaagu

SEQ ID NO: 1624224 - RNA, 23 nt, Homo sapiens
cucuacacccacccaaaagucac

SEQ ID NO: 1624225 - RNA, 19 nt, Homo sapiens
cucuacuugucauaucacu

SEQ ID NO: 1624226 - RNA, 21 nt, Homo sapiens
cucuagaaugagcaagacugg

SEQ ID NO: 1624227 - RNA, 20 nt, Homo sapiens
cucuagcagagcaauuugau

SEQ ID NO: 1624228 - RNA, 20 nt, Homo sapiens
cucuagcuuugucauaguua

SEQ ID NO: 1624229 - RNA, 23 nt, Homo sapiens
cucuaggccucuccaguuugcac

SEQ ID NO: 1624230 - RNA, 15 nt, Homo sapiens
cucuauuacacugga

SEQ ID NO: 1624231 - RNA, 17 nt, Homo sapiens
cucuauugauacucuuu

SEQ ID NO: 1624232 - RNA, 20 nt, Homo sapiens
cucucaugguacuuccucug

SEQ ID NO: 1624233 - RNA, 20 nt, Homo sapiens
cucuccuuccaacaaaagaa

SEQ ID NO: 1624234 - RNA, 15 nt, Homo sapiens
cucucuacagugcca

SEQ ID NO: 1624235 - RNA, 20 nt, Homo sapiens
cucucucuagaaugagcaag

SEQ ID NO: 1624236 - RNA, 13 nt, Homo sapiens
cucucucucugaa

SEQ ID NO: 1624237 - RNA, 14 nt, Homo sapiens
cucucuucuggaau

SEQ ID NO: 1624238 - RNA, 15 nt, Homo sapiens
cucucuucuggaauc

SEQ ID NO: 1624239 - RNA, 18 nt, Homo sapiens
cucugaagguccaaagag

SEQ ID NO: 1624240 - RNA, 19 nt, Homo sapiens
cucugaauuugagauacaa

SEQ ID NO: 1624241 - RNA, 22 nt, Homo sapiens
cucugacaagcuggccaaaguc

SEQ ID NO: 1624242 - RNA, 21 nt, Homo sapiens
cucugccuuaaacacacauug

SEQ ID NO: 1624243 - RNA, 22 nt, Homo sapiens
cucugccuuaaacacacauugc

SEQ ID NO: 1624244 - RNA, 13 nt, Homo sapiens
cucuggacuccac

SEQ ID NO: 1624245 - RNA, 22 nt, Homo sapiens
cucugguguaguuucugcauuu

SEQ ID NO: 1624246 - RNA, 17 nt, Homo sapiens
cucuguaucuccagcca

SEQ ID NO: 1624247 - RNA, 19 nt, Homo sapiens
cucugucaccugagaccca

SEQ ID NO: 1624248 - RNA, 23 nt, Homo sapiens
cucugugagggugcugacuggcu

SEQ ID NO: 1624249 - RNA, 17 nt, Homo sapiens
cucugugcccuccagca

SEQ ID NO: 1624250 - RNA, 14 nt, Homo sapiens
cucuucucagccac

SEQ ID NO: 1624251 - RNA, 14 nt, Homo sapiens
cucuuguugcugag

SEQ ID NO: 1624252 - RNA, 13 nt, Homo sapiens
cucuuuacuugaa

SEQ ID NO: 1624253 - RNA, 14 nt, Homo sapiens
cucuuuaguguucu

SEQ ID NO: 1624254 - RNA, 15 nt, Homo sapiens
cucuuucaaagcuaa

SEQ ID NO: 1624255 - RNA, 17 nt, Homo sapiens
cucuuuuaguccauuga

SEQ ID NO: 1624256 - RNA, 21 nt, Homo sapiens
cugaaaagauguugugucuug

SEQ ID NO: 1624257 - RNA, 16 nt, Homo sapiens
cugaaagggcacuuaa

SEQ ID NO: 1624258 - RNA, 21 nt, Homo sapiens
cugaagauggcauccugugaa

SEQ ID NO: 1624259 - RNA, 13 nt, Homo sapiens
cugaagaugucaa

SEQ ID NO: 1624260 - RNA, 13 nt, Homo sapiens
cugaagcagguuc

SEQ ID NO: 1624261 - RNA, 21 nt, Homo sapiens
cugaagcccaaagccugagga

SEQ ID NO: 1624262 - RNA, 21 nt, Homo sapiens
cugaaggcacagcuaaccacu

SEQ ID NO: 1624263 - RNA, 19 nt, Homo sapiens
cugaaggcugaaagacagg

SEQ ID NO: 1624264 - RNA, 13 nt, Homo sapiens
cugaaggcuuuca

SEQ ID NO: 1624265 - RNA, 20 nt, Homo sapiens
cugaaguacuaacacaagga

SEQ ID NO: 1624266 - RNA, 19 nt, Homo sapiens
cugaagugguugcauucua

SEQ ID NO: 1624267 - RNA, 14 nt, Homo sapiens
cugaauaacacugg

SEQ ID NO: 1624268 - RNA, 17 nt, Homo sapiens
cugaauauaaagcuuaa

SEQ ID NO: 1624269 - RNA, 20 nt, Homo sapiens
cugaccaauauuguacaguu

SEQ ID NO: 1624270 - RNA, 21 nt, Homo sapiens
cugaccaauauuguacaguuu

SEQ ID NO: 1624271 - RNA, 17 nt, Homo sapiens
cugaccacagcacagcc

SEQ ID NO: 1624272 - RNA, 15 nt, Homo sapiens
cugacucuaagaauu

SEQ ID NO: 1624273 - RNA, 16 nt, Homo sapiens
cugacuguugccuuug

SEQ ID NO: 1624274 - RNA, 21 nt, Homo sapiens
cugagaacauaaaaucuuggc

SEQ ID NO: 1624275 - RNA, 17 nt, Homo sapiens
cugagccugccgagcaa

SEQ ID NO: 1624276 - RNA, 13 nt, Homo sapiens
cugagcucugaga

SEQ ID NO: 1624277 - RNA, 22 nt, Homo sapiens
cugaggccacacucagcacaag

SEQ ID NO: 1624278 - RNA, 18 nt, Homo sapiens
cugagggcagugcccuuu

SEQ ID NO: 1624279 - RNA, 21 nt, Homo sapiens
cugagggucacaguaccuuga

SEQ ID NO: 1624280 - RNA, 17 nt, Homo sapiens
cugaguguuuaauuuca

SEQ ID NO: 1624281 - RNA, 16 nt, Homo sapiens
cugauccauccaucuc

SEQ ID NO: 1624282 - RNA, 16 nt, Homo sapiens
cugaugccccagggau

SEQ ID NO: 1624283 - RNA, 17 nt, Homo sapiens
cugaugccccagggauu

SEQ ID NO: 1624284 - RNA, 15 nt, Homo sapiens
cugaugggaaaacug

SEQ ID NO: 1624285 - RNA, 13 nt, Homo sapiens
cugauucauaaua

SEQ ID NO: 1624286 - RNA, 12 nt, Homo sapiens
cugcaaagccag

SEQ ID NO: 1624287 - RNA, 16 nt, Homo sapiens
cugcaaguaaguauga

SEQ ID NO: 1624288 - RNA, 15 nt, Homo sapiens
cugcacacugcacau

SEQ ID NO: 1624289 - RNA, 14 nt, Homo sapiens
cugcacaggcuugc

SEQ ID NO: 1624290 - RNA, 18 nt, Homo sapiens
cugcacaugucuuguaca

SEQ ID NO: 1624291 - RNA, 20 nt, Homo sapiens
cugcaccccucugcccucau

SEQ ID NO: 1624292 - RNA, 16 nt, Homo sapiens
cugcacuuauacccau

SEQ ID NO: 1624293 - RNA, 13 nt, Homo sapiens
cugcacuuuggaa

SEQ ID NO: 1624294 - RNA, 13 nt, Homo sapiens
cugcagaauccag

SEQ ID NO: 1624295 - RNA, 18 nt, Homo sapiens
cugcagcagagccuggaa

SEQ ID NO: 1624296 - RNA, 16 nt, Homo sapiens
cugcaggauaaaaugg

SEQ ID NO: 1624297 - RNA, 16 nt, Homo sapiens
cugcauuuacacacac

SEQ ID NO: 1624298 - RNA, 22 nt, Homo sapiens
cugcauuucaagaagacuggca

SEQ ID NO: 1624299 - RNA, 19 nt, Homo sapiens
cugccaugguaaucagaaa

SEQ ID NO: 1624300 - RNA, 15 nt, Homo sapiens
cugcccaggccuucc

SEQ ID NO: 1624301 - RNA, 15 nt, Homo sapiens
cugccccuuccccau

SEQ ID NO: 1624302 - RNA, 22 nt, Homo sapiens
cugcccugcucugcccaggcaa

SEQ ID NO: 1624303 - RNA, 19 nt, Homo sapiens
cugccuaauaguaacuggu

SEQ ID NO: 1624304 - RNA, 19 nt, Homo sapiens
cugccucugucucacugaa

SEQ ID NO: 1624305 - RNA, 24 nt, Homo sapiens
cugccuggguaggccccacaaggc

SEQ ID NO: 1624306 - RNA, 22 nt, Homo sapiens
cugccuuagugcugaugccugu

SEQ ID NO: 1624307 - RNA, 21 nt, Homo sapiens
cugcgcccugccgcacccgcg

SEQ ID NO: 1624308 - RNA, 12 nt, Homo sapiens
cugcuauaacua

SEQ ID NO: 1624309 - RNA, 16 nt, Homo sapiens
cugcuauaacuaugac

SEQ ID NO: 1624310 - RNA, 13 nt, Homo sapiens
cugcuccaagagg

SEQ ID NO: 1624311 - RNA, 21 nt, Homo sapiens
cugcucuagugggacagccca

SEQ ID NO: 1624312 - RNA, 13 nt, Homo sapiens
cugcugcugagaa

SEQ ID NO: 1624313 - RNA, 20 nt, Homo sapiens
cugcugcuucuccaagcuuu

SEQ ID NO: 1624314 - RNA, 14 nt, Homo sapiens
cugcugggugccuc

SEQ ID NO: 1624315 - RNA, 15 nt, Homo sapiens
cugcugguaccugcc

SEQ ID NO: 1624316 - RNA, 22 nt, Homo sapiens
cugcuucaugggccuggaugca

SEQ ID NO: 1624317 - RNA, 16 nt, Homo sapiens
cugcuucaugugaaca

SEQ ID NO: 1624318 - RNA, 23 nt, Homo sapiens
cuggaaaagggucuugggaaaua

SEQ ID NO: 1624319 - RNA, 15 nt, Homo sapiens
cuggaaaaugaaucc

SEQ ID NO: 1624320 - RNA, 21 nt, Homo sapiens
cuggaacuuuuuagauuauuc

SEQ ID NO: 1624321 - RNA, 19 nt, Homo sapiens
cuggaaggggccacgugga

SEQ ID NO: 1624322 - RNA, 23 nt, Homo sapiens
cuggaaucacaaaccaagccaug

SEQ ID NO: 1624323 - RNA, 12 nt, Homo sapiens
cuggacacagag

SEQ ID NO: 1624324 - RNA, 16 nt, Homo sapiens
cuggacugucuaugaa

SEQ ID NO: 1624325 - RNA, 20 nt, Homo sapiens
cuggagugcaauggcgcgau

SEQ ID NO: 1624326 - RNA, 20 nt, Homo sapiens
cuggagugcaguggcacgau

SEQ ID NO: 1624327 - RNA, 22 nt, Homo sapiens
cuggagugcaguggcacgaucu

SEQ ID NO: 1624328 - RNA, 20 nt, Homo sapiens
cuggagugcaguggcgcaau

SEQ ID NO: 1624329 - RNA, 20 nt, Homo sapiens
cuggagugcaguggcgccau

SEQ ID NO: 1624330 - RNA, 15 nt, Homo sapiens
cuggauucuaaggaa

SEQ ID NO: 1624331 - RNA, 14 nt, Homo sapiens
cuggauucuaucua

SEQ ID NO: 1624332 - RNA, 20 nt, Homo sapiens
cuggauuuguuucugugauc

SEQ ID NO: 1624333 - RNA, 20 nt, Homo sapiens
cuggcacuguggagaccaca

SEQ ID NO: 1624334 - RNA, 19 nt, Homo sapiens
cuggcagggacgaggacaa

SEQ ID NO: 1624335 - RNA, 17 nt, Homo sapiens
cuggcagggcccaguga

SEQ ID NO: 1624336 - RNA, 21 nt, Homo sapiens
cuggcagggcccagugacaag

SEQ ID NO: 1624337 - RNA, 14 nt, Homo sapiens
cuggcauuaagggc

SEQ ID NO: 1624338 - RNA, 15 nt, Homo sapiens
cuggcauugaaaugc

SEQ ID NO: 1624339 - RNA, 15 nt, Homo sapiens
cuggccacagccuuc

SEQ ID NO: 1624340 - RNA, 22 nt, Homo sapiens
cuggcccccaucagcccugcua

SEQ ID NO: 1624341 - RNA, 21 nt, Homo sapiens
cuggccuauuuaucugaucaa

SEQ ID NO: 1624342 - RNA, 15 nt, Homo sapiens
cuggcugguggaaca

SEQ ID NO: 1624343 - RNA, 23 nt, Homo sapiens
cuggcuuggggucaagaaacagc

SEQ ID NO: 1624344 - RNA, 15 nt, Homo sapiens
cugggaaacaguccc

SEQ ID NO: 1624345 - RNA, 16 nt, Homo sapiens
cugggaaccacuccca

SEQ ID NO: 1624346 - RNA, 16 nt, Homo sapiens
cugggauuacaggugu

SEQ ID NO: 1624347 - RNA, 19 nt, Homo sapiens
cugggauuacaggugugca

SEQ ID NO: 1624348 - RNA, 20 nt, Homo sapiens
cugggauuacaggugugcac

SEQ ID NO: 1624349 - RNA, 14 nt, Homo sapiens
cugggccagggucu

SEQ ID NO: 1624350 - RNA, 22 nt, Homo sapiens
cugggccauucuccacagcaac

SEQ ID NO: 1624351 - RNA, 23 nt, Homo sapiens
cugggcccaguaccuagcuggcu

SEQ ID NO: 1624352 - RNA, 20 nt, Homo sapiens
cugggcuaauauacuuguaa

SEQ ID NO: 1624353 - RNA, 15 nt, Homo sapiens
cuggggacucaggga

SEQ ID NO: 1624354 - RNA, 14 nt, Homo sapiens
cuggggaggugaac

SEQ ID NO: 1624355 - RNA, 16 nt, Homo sapiens
cuggggaggugaacug

SEQ ID NO: 1624356 - RNA, 23 nt, Homo sapiens
cuggguggcuacucugugccaga

SEQ ID NO: 1624357 - RNA, 16 nt, Homo sapiens
cuggguucacaccauu

SEQ ID NO: 1624358 - RNA, 20 nt, Homo sapiens
cugguacuauugugaccaca

SEQ ID NO: 1624359 - RNA, 17 nt, Homo sapiens
cugguagguugggacac

SEQ ID NO: 1624360 - RNA, 16 nt, Homo sapiens
cuggugccaccucaga

SEQ ID NO: 1624361 - RNA, 23 nt, Homo sapiens
cuggugugaggaccaugcuguga

SEQ ID NO: 1624362 - RNA, 15 nt, Homo sapiens
cuguaaacuuggaau

SEQ ID NO: 1624363 - RNA, 20 nt, Homo sapiens
cuguaauauuuagcuguaaa

SEQ ID NO: 1624364 - RNA, 17 nt, Homo sapiens
cuguaaucccaguacuu

SEQ ID NO: 1624365 - RNA, 21 nt, Homo sapiens
cuguacaaugaacccccauga

SEQ ID NO: 1624366 - RNA, 14 nt, Homo sapiens
cuguacauuucaca

SEQ ID NO: 1624367 - RNA, 13 nt, Homo sapiens
cuguaccaugugc

SEQ ID NO: 1624368 - RNA, 15 nt, Homo sapiens
cuguacggacacugu

SEQ ID NO: 1624369 - RNA, 22 nt, Homo sapiens
cuguagaaaagggaacugaaca

SEQ ID NO: 1624370 - RNA, 19 nt, Homo sapiens
cuguagcuucucuugcucu

SEQ ID NO: 1624371 - RNA, 21 nt, Homo sapiens
cuguagugagauagcauugug

SEQ ID NO: 1624372 - RNA, 23 nt, Homo sapiens
cuguaguugcguggacucugcac

SEQ ID NO: 1624373 - RNA, 13 nt, Homo sapiens
cuguaucuccagc

SEQ ID NO: 1624374 - RNA, 18 nt, Homo sapiens
cugucacuagucucacca

SEQ ID NO: 1624375 - RNA, 21 nt, Homo sapiens
cugucacuagucucaccagcc

SEQ ID NO: 1624376 - RNA, 16 nt, Homo sapiens
cugucaggugugauaa

SEQ ID NO: 1624377 - RNA, 15 nt, Homo sapiens
cugucagucacagcc

SEQ ID NO: 1624378 - RNA, 12 nt, Homo sapiens
cugucaguucuc

SEQ ID NO: 1624379 - RNA, 22 nt, Homo sapiens
cuguccguucacauguguggua

SEQ ID NO: 1624380 - RNA, 19 nt, Homo sapiens
cuguccuguuucugucaag

SEQ ID NO: 1624381 - RNA, 16 nt, Homo sapiens
cuguccuuucagucug

SEQ ID NO: 1624382 - RNA, 14 nt, Homo sapiens
cugucucacuggca

SEQ ID NO: 1624383 - RNA, 16 nt, Homo sapiens
cugugaaccugggcac

SEQ ID NO: 1624384 - RNA, 20 nt, Homo sapiens
cugugaggccauacuuguga

SEQ ID NO: 1624385 - RNA, 20 nt, Homo sapiens
cugugcccaccaugacccuc

SEQ ID NO: 1624386 - RNA, 14 nt, Homo sapiens
cuguguacugccuu

SEQ ID NO: 1624387 - RNA, 15 nt, Homo sapiens
cuguguagcugugac

SEQ ID NO: 1624388 - RNA, 16 nt, Homo sapiens
cuguguagcugugacc

SEQ ID NO: 1624389 - RNA, 20 nt, Homo sapiens
cugugugaaugugggcacug

SEQ ID NO: 1624390 - RNA, 15 nt, Homo sapiens
cugugugagacccac

SEQ ID NO: 1624391 - RNA, 16 nt, Homo sapiens
cugugugagauuguga

SEQ ID NO: 1624392 - RNA, 15 nt, Homo sapiens
cuguguggugcauuc

SEQ ID NO: 1624393 - RNA, 17 nt, Homo sapiens
cugugugucuguccuga

SEQ ID NO: 1624394 - RNA, 16 nt, Homo sapiens
cugugugugcugccag

SEQ ID NO: 1624395 - RNA, 19 nt, Homo sapiens
cuguguguuuuaguuucau

SEQ ID NO: 1624396 - RNA, 13 nt, Homo sapiens
cuguucauuucac

SEQ ID NO: 1624397 - RNA, 23 nt, Homo sapiens
cuguuccccaaggacucuuccac

SEQ ID NO: 1624398 - RNA, 22 nt, Homo sapiens
cuguucuuagaguguagcugua

SEQ ID NO: 1624399 - RNA, 15 nt, Homo sapiens
cuguugaaacuuaca

SEQ ID NO: 1624400 - RNA, 18 nt, Homo sapiens
cuguuguaacugcccaag

SEQ ID NO: 1624401 - RNA, 15 nt, Homo sapiens
cuguuuaaaguguca

SEQ ID NO: 1624402 - RNA, 19 nt, Homo sapiens
cuguuucaucucagcuuuu

SEQ ID NO: 1624403 - RNA, 16 nt, Homo sapiens
cuguuuuauauucaac

SEQ ID NO: 1624404 - RNA, 14 nt, Homo sapiens
cuuaaacacacauu

SEQ ID NO: 1624405 - RNA, 24 nt, Homo sapiens
cuuaaaccagaacccaguguuucc

SEQ ID NO: 1624406 - RNA, 16 nt, Homo sapiens
cuuaaauacaaucaca

SEQ ID NO: 1624407 - RNA, 17 nt, Homo sapiens
cuuaaaucucacucuag

SEQ ID NO: 1624408 - RNA, 17 nt, Homo sapiens
cuuaaaucugugaagua

SEQ ID NO: 1624409 - RNA, 21 nt, Homo sapiens
cuuaaauuugauuuacauaua

SEQ ID NO: 1624410 - RNA, 13 nt, Homo sapiens
cuuaacacauuca

SEQ ID NO: 1624411 - RNA, 19 nt, Homo sapiens
cuuaacauuucauuguaca

SEQ ID NO: 1624412 - RNA, 22 nt, Homo sapiens
cuuaagaacugcuucaugugaa

SEQ ID NO: 1624413 - RNA, 17 nt, Homo sapiens
cuuaaguagauaaggaa

SEQ ID NO: 1624414 - RNA, 22 nt, Homo sapiens
cuuaaguauuauauaaacugug

SEQ ID NO: 1624415 - RNA, 22 nt, Homo sapiens
cuuacacauaaagcacuaccua

SEQ ID NO: 1624416 - RNA, 17 nt, Homo sapiens
cuuacagucacuaauau

SEQ ID NO: 1624417 - RNA, 15 nt, Homo sapiens
cuuacuuaguguuau

SEQ ID NO: 1624418 - RNA, 18 nt, Homo sapiens
cuuagaaaacaaguauug

SEQ ID NO: 1624419 - RNA, 18 nt, Homo sapiens
cuuagggcagauuuucau

SEQ ID NO: 1624420 - RNA, 18 nt, Homo sapiens
cuuaguaaguaauaucaa

SEQ ID NO: 1624421 - RNA, 12 nt, Homo sapiens
cuuagugaaugg

SEQ ID NO: 1624422 - RNA, 20 nt, Homo sapiens
cuuaguguuguggacacugc

SEQ ID NO: 1624423 - RNA, 15 nt, Homo sapiens
cuuaucaacuaauga

SEQ ID NO: 1624424 - RNA, 14 nt, Homo sapiens
cuuaugugacaugg

SEQ ID NO: 1624425 - RNA, 20 nt, Homo sapiens
cuuauucucuguaggccaaa

SEQ ID NO: 1624426 - RNA, 12 nt, Homo sapiens
cuuauucuuaac

SEQ ID NO: 1624427 - RNA, 17 nt, Homo sapiens
cuuauugcuguugcuua

SEQ ID NO: 1624428 - RNA, 21 nt, Homo sapiens
cuucaagaacccugacuccuc

SEQ ID NO: 1624429 - RNA, 14 nt, Homo sapiens
cuucaccucuucca

SEQ ID NO: 1624430 - RNA, 17 nt, Homo sapiens
cuucagcccccaccagg

SEQ ID NO: 1624431 - RNA, 23 nt, Homo sapiens
cuucagcuauacuuacacuguau

SEQ ID NO: 1624432 - RNA, 21 nt, Homo sapiens
cuucauaagauauucuuuaca

SEQ ID NO: 1624433 - RNA, 21 nt, Homo sapiens
cuucaugguccgccugccuca

SEQ ID NO: 1624434 - RNA, 15 nt, Homo sapiens
cuucauuucaaucau

SEQ ID NO: 1624435 - RNA, 19 nt, Homo sapiens
cuucauuuuauuaauauuu

SEQ ID NO: 1624436 - RNA, 23 nt, Homo sapiens
cuuccaauaguuagaucuacccu

SEQ ID NO: 1624437 - RNA, 15 nt, Homo sapiens
cuuccagcuagugac

SEQ ID NO: 1624438 - RNA, 18 nt, Homo sapiens
cuuccagugucugucauu

SEQ ID NO: 1624439 - RNA, 22 nt, Homo sapiens
cuuccaucccaaccagugccaa

SEQ ID NO: 1624440 - RNA, 22 nt, Homo sapiens
cuuccauuuucccccacuacug

SEQ ID NO: 1624441 - RNA, 16 nt, Homo sapiens
cuuccccaagaucugc

SEQ ID NO: 1624442 - RNA, 13 nt, Homo sapiens
cuuccccaucuca

SEQ ID NO: 1624443 - RNA, 16 nt, Homo sapiens
cuuccccgaaucacac

SEQ ID NO: 1624444 - RNA, 18 nt, Homo sapiens
cuucccuacacagggccu

SEQ ID NO: 1624445 - RNA, 23 nt, Homo sapiens
cuucccuugcucaugagcuccug

SEQ ID NO: 1624446 - RNA, 12 nt, Homo sapiens
cuuccucuccac

SEQ ID NO: 1624447 - RNA, 18 nt, Homo sapiens
cuuccuggacagcugugc

SEQ ID NO: 1624448 - RNA, 17 nt, Homo sapiens
cuuccuggggaccaaga

SEQ ID NO: 1624449 - RNA, 13 nt, Homo sapiens
cuucuaaccacac

SEQ ID NO: 1624450 - RNA, 18 nt, Homo sapiens
cuucuaaguguacuucau

SEQ ID NO: 1624451 - RNA, 14 nt, Homo sapiens
cuucuacugugaca

SEQ ID NO: 1624452 - RNA, 14 nt, Homo sapiens
cuucuagaaaacau

SEQ ID NO: 1624453 - RNA, 22 nt, Homo sapiens
cuucuaggauagcuaacuguaa

SEQ ID NO: 1624454 - RNA, 17 nt, Homo sapiens
cuucucuugagcaguua

SEQ ID NO: 1624455 - RNA, 21 nt, Homo sapiens
cuucugcaaaguggcagggac

SEQ ID NO: 1624456 - RNA, 18 nt, Homo sapiens
cuucuggagaaagcucau

SEQ ID NO: 1624457 - RNA, 10 nt, Homo sapiens
cuucugggaa

SEQ ID NO: 1624458 - RNA, 14 nt, Homo sapiens
cuucuuauuaauca

SEQ ID NO: 1624459 - RNA, 17 nt, Homo sapiens
cuucuugucagacauaa

SEQ ID NO: 1624460 - RNA, 23 nt, Homo sapiens
cuucuugucagacauaaagccau

SEQ ID NO: 1624461 - RNA, 16 nt, Homo sapiens
cuucuuuccucuggag

SEQ ID NO: 1624462 - RNA, 23 nt, Homo sapiens
cuugaaauuuggcuaauaacaaa

SEQ ID NO: 1624463 - RNA, 23 nt, Homo sapiens
cuugaccucucauaaauuuacuu

SEQ ID NO: 1624464 - RNA, 23 nt, Homo sapiens
cuugacuguaaagagaaguaauu

SEQ ID NO: 1624465 - RNA, 20 nt, Homo sapiens
cuugaggaucauaugaauua

SEQ ID NO: 1624466 - RNA, 13 nt, Homo sapiens
cuugagggaccaa

SEQ ID NO: 1624467 - RNA, 22 nt, Homo sapiens
cuugaugagcugugcacaaagu

SEQ ID NO: 1624468 - RNA, 18 nt, Homo sapiens
cuugcacccgcaagucaa

SEQ ID NO: 1624469 - RNA, 22 nt, Homo sapiens
cuugccugaggggaaagagaga

SEQ ID NO: 1624470 - RNA, 19 nt, Homo sapiens
cuugcucaugagcuccuga

SEQ ID NO: 1624471 - RNA, 21 nt, Homo sapiens
cuugcucccaagccccugacc

SEQ ID NO: 1624472 - RNA, 23 nt, Homo sapiens
cuugcugauuuucagacagggaa

SEQ ID NO: 1624473 - RNA, 17 nt, Homo sapiens
cuugcuuccaagaccau

SEQ ID NO: 1624474 - RNA, 19 nt, Homo sapiens
cuugcuucucuagcucucu

SEQ ID NO: 1624475 - RNA, 16 nt, Homo sapiens
cuuggcggcucuagcc

SEQ ID NO: 1624476 - RNA, 14 nt, Homo sapiens
cuuggcugacauga

SEQ ID NO: 1624477 - RNA, 12 nt, Homo sapiens
cuuggcuuuaug

SEQ ID NO: 1624478 - RNA, 13 nt, Homo sapiens
cuuggugagaugg

SEQ ID NO: 1624479 - RNA, 20 nt, Homo sapiens
cuuguacccccagguggaag

SEQ ID NO: 1624480 - RNA, 17 nt, Homo sapiens
cuuguagccagccgggg

SEQ ID NO: 1624481 - RNA, 10 nt, Homo sapiens
cuuguauuca

SEQ ID NO: 1624482 - RNA, 19 nt, Homo sapiens
cuuguauuuaacugaauaa

SEQ ID NO: 1624483 - RNA, 18 nt, Homo sapiens
cuuguccagguugaucuu

SEQ ID NO: 1624484 - RNA, 13 nt, Homo sapiens
cuuguccccauga

SEQ ID NO: 1624485 - RNA, 17 nt, Homo sapiens
cuugugaaacgucugga

SEQ ID NO: 1624486 - RNA, 11 nt, Homo sapiens
cuugugccaua

SEQ ID NO: 1624487 - RNA, 16 nt, Homo sapiens
cuugugccauagucac

SEQ ID NO: 1624488 - RNA, 18 nt, Homo sapiens
cuuguggguccaugcuaa

SEQ ID NO: 1624489 - RNA, 22 nt, Homo sapiens
cuugugucugcggggaucagag

SEQ ID NO: 1624490 - RNA, 22 nt, Homo sapiens
cuuguuuguuugagcuuaggga

SEQ ID NO: 1624491 - RNA, 14 nt, Homo sapiens
cuuuaaauaucauu

SEQ ID NO: 1624492 - RNA, 18 nt, Homo sapiens
cuuuaaauccuaccaaag

SEQ ID NO: 1624493 - RNA, 15 nt, Homo sapiens
cuuuaagccaaagaa

SEQ ID NO: 1624494 - RNA, 21 nt, Homo sapiens
cuuuacaaaccuuuguuucaa

SEQ ID NO: 1624495 - RNA, 20 nt, Homo sapiens
cuuuacauuuucaguaccaa

SEQ ID NO: 1624496 - RNA, 22 nt, Homo sapiens
cuuuacauuuucaguaccaaag

SEQ ID NO: 1624497 - RNA, 16 nt, Homo sapiens
cuuuaugcaaauacaa

SEQ ID NO: 1624498 - RNA, 14 nt, Homo sapiens
cuuuaugugcaaaa

SEQ ID NO: 1624499 - RNA, 12 nt, Homo sapiens
cuuuauuucucu

SEQ ID NO: 1624500 - RNA, 18 nt, Homo sapiens
cuuucaaagcuaaauucc

SEQ ID NO: 1624501 - RNA, 16 nt, Homo sapiens
cuuucacgcugaaaca

SEQ ID NO: 1624502 - RNA, 23 nt, Homo sapiens
cuuucaucccucgggugugcuau

SEQ ID NO: 1624503 - RNA, 11 nt, Homo sapiens
cuuuccaagcu

SEQ ID NO: 1624504 - RNA, 17 nt, Homo sapiens
cuuuccaaggaagcaga

SEQ ID NO: 1624505 - RNA, 18 nt, Homo sapiens
cuuuccaaugccacagac

SEQ ID NO: 1624506 - RNA, 16 nt, Homo sapiens
cuuuccaucuaucacu

SEQ ID NO: 1624507 - RNA, 14 nt, Homo sapiens
cuuucgaaagcaau

SEQ ID NO: 1624508 - RNA, 20 nt, Homo sapiens
cuuucuaaugcugauaugau

SEQ ID NO: 1624509 - RNA, 18 nt, Homo sapiens
cuuucugaaauuagggcc

SEQ ID NO: 1624510 - RNA, 22 nt, Homo sapiens
cuuucuuuagaauuuuuaccca

SEQ ID NO: 1624511 - RNA, 22 nt, Homo sapiens
cuuucuuuuuuaaauaggguug

SEQ ID NO: 1624512 - RNA, 21 nt, Homo sapiens
cuuugaaugcuaagaaugcau

SEQ ID NO: 1624513 - RNA, 13 nt, Homo sapiens
cuuugcaaacccu

SEQ ID NO: 1624514 - RNA, 14 nt, Homo sapiens
cuuugccugucaag

SEQ ID NO: 1624515 - RNA, 15 nt, Homo sapiens
cuuugugacuucaag

SEQ ID NO: 1624516 - RNA, 12 nt, Homo sapiens
cuuugugugcau

SEQ ID NO: 1624517 - RNA, 14 nt, Homo sapiens
cuuuguuaggauuu

SEQ ID NO: 1624518 - RNA, 18 nt, Homo sapiens
cuuuguuaugacagugaa

SEQ ID NO: 1624519 - RNA, 14 nt, Homo sapiens
cuuuguuuacauga

SEQ ID NO: 1624520 - RNA, 15 nt, Homo sapiens
cuuuguuuacaugag

SEQ ID NO: 1624521 - RNA, 14 nt, Homo sapiens
cuuuuaauccuggc

SEQ ID NO: 1624522 - RNA, 18 nt, Homo sapiens
cuuuuacagguuaagaca

SEQ ID NO: 1624523 - RNA, 18 nt, Homo sapiens
cuuuuagagucagacucc

SEQ ID NO: 1624524 - RNA, 12 nt, Homo sapiens
cuuuucacaaac

SEQ ID NO: 1624525 - RNA, 22 nt, Homo sapiens
cuuuucagcgauguaugcagcu

SEQ ID NO: 1624526 - RNA, 16 nt, Homo sapiens
cuuuuccacuccauug

SEQ ID NO: 1624527 - RNA, 17 nt, Homo sapiens
cuuuucccauugccaug

SEQ ID NO: 1624528 - RNA, 17 nt, Homo sapiens
cuuuucugccacuccau

SEQ ID NO: 1624529 - RNA, 10 nt, Homo sapiens
cuuuugccac

SEQ ID NO: 1624530 - RNA, 16 nt, Homo sapiens
cuuuugcuugaauuua

SEQ ID NO: 1624531 - RNA, 22 nt, Homo sapiens
cuuuugggauguuaccuucaca

SEQ ID NO: 1624532 - RNA, 18 nt, Homo sapiens
cuuuuucauuuuccaaua

SEQ ID NO: 1624533 - RNA, 19 nt, Homo sapiens
cuuuuugcguacacagaga

SEQ ID NO: 1624534 - RNA, 15 nt, Homo sapiens
cuuuuuuaaaggcac

SEQ ID NO: 1624535 - RNA, 14 nt, Homo sapiens
cuuuuuuauacuca

SEQ ID NO: 1624536 - RNA, 18 nt, Homo sapiens
cuuuuuuauacucaauca

SEQ ID NO: 1624537 - RNA, 19 nt, Homo sapiens
cuuuuuuccugggccagaa

SEQ ID NO: 1624538 - RNA, 22 nt, Homo sapiens
cuuuuuugaggccuuuuuugcc

SEQ ID NO: 1624539 - RNA, 12 nt, Homo sapiens
cuuuuuugccag

SEQ ID NO: 1624540 - RNA, 13 nt, Homo sapiens
cuuuuuugccaga

SEQ ID NO: 1624541 - RNA, 17 nt, Homo sapiens
gaaaaauaccaacucag

SEQ ID NO: 1624542 - RNA, 22 nt, Homo sapiens
gaaaaauauaauguugauaaua

SEQ ID NO: 1624543 - RNA, 12 nt, Homo sapiens
gaaaacaauucu

SEQ ID NO: 1624544 - RNA, 14 nt, Homo sapiens
gaaaacacuuucau

SEQ ID NO: 1624545 - RNA, 12 nt, Homo sapiens
gaaaaccaucac

SEQ ID NO: 1624546 - RNA, 21 nt, Homo sapiens
gaaaacucaugaucaagauau

SEQ ID NO: 1624547 - RNA, 16 nt, Homo sapiens
gaaaacucccaauaca

SEQ ID NO: 1624548 - RNA, 13 nt, Homo sapiens
gaaaacuugacau

SEQ ID NO: 1624549 - RNA, 22 nt, Homo sapiens
gaaaacuugacauguagcuucu

SEQ ID NO: 1624550 - RNA, 14 nt, Homo sapiens
gaaaauaaacaugu

SEQ ID NO: 1624551 - RNA, 18 nt, Homo sapiens
gaaaauauagacauucuc

SEQ ID NO: 1624552 - RNA, 15 nt, Homo sapiens
gaaaaucucugugaa

SEQ ID NO: 1624553 - RNA, 19 nt, Homo sapiens
gaaaauuggauucccuuaa

SEQ ID NO: 1624554 - RNA, 20 nt, Homo sapiens
gaaacaaggcugccaggugu

SEQ ID NO: 1624555 - RNA, 22 nt, Homo sapiens
gaaacaauggcuaagauaccaa

SEQ ID NO: 1624556 - RNA, 13 nt, Homo sapiens
gaaacagccugug

SEQ ID NO: 1624557 - RNA, 17 nt, Homo sapiens
gaaacagcugcccugug

SEQ ID NO: 1624558 - RNA, 17 nt, Homo sapiens
gaaaccucuacauauuu

SEQ ID NO: 1624559 - RNA, 20 nt, Homo sapiens
gaaaccuguuaaaacaacca

SEQ ID NO: 1624560 - RNA, 14 nt, Homo sapiens
gaaacuaacacagc

SEQ ID NO: 1624561 - RNA, 19 nt, Homo sapiens
gaaacuaacacagccauca

SEQ ID NO: 1624562 - RNA, 15 nt, Homo sapiens
gaaagacauccauaa

SEQ ID NO: 1624563 - RNA, 21 nt, Homo sapiens
gaaagagagaagccagccaca

SEQ ID NO: 1624564 - RNA, 12 nt, Homo sapiens
gaaagauuacuu

SEQ ID NO: 1624565 - RNA, 13 nt, Homo sapiens
gaaagauuacuuu

SEQ ID NO: 1624566 - RNA, 21 nt, Homo sapiens
gaaagcaaguguucacaacag

SEQ ID NO: 1624567 - RNA, 20 nt, Homo sapiens
gaaagcuuuauacaguugaa

SEQ ID NO: 1624568 - RNA, 19 nt, Homo sapiens
gaaaggaggaaggagccua

SEQ ID NO: 1624569 - RNA, 19 nt, Homo sapiens
gaaaguucuugguggugga

SEQ ID NO: 1624570 - RNA, 18 nt, Homo sapiens
gaaauaaaaggaagccaa

SEQ ID NO: 1624571 - RNA, 19 nt, Homo sapiens
gaaauaacaagucgaugaa

SEQ ID NO: 1624572 - RNA, 22 nt, Homo sapiens
gaaauacaguauaccgcagugg

SEQ ID NO: 1624573 - RNA, 13 nt, Homo sapiens
gaaauacuuugua

SEQ ID NO: 1624574 - RNA, 17 nt, Homo sapiens
gaaaucaauacugcaca

SEQ ID NO: 1624575 - RNA, 11 nt, Homo sapiens
gaaaugcaaaa

SEQ ID NO: 1624576 - RNA, 23 nt, Homo sapiens
gaaauguuuaauaaagcuuuaua

SEQ ID NO: 1624577 - RNA, 16 nt, Homo sapiens
gaaauugacagaucaa

SEQ ID NO: 1624578 - RNA, 16 nt, Homo sapiens
gaacaauuuggucuua

SEQ ID NO: 1624579 - RNA, 13 nt, Homo sapiens
gaacagaagugag

SEQ ID NO: 1624580 - RNA, 14 nt, Homo sapiens
gaacagacugaccu

SEQ ID NO: 1624581 - RNA, 20 nt, Homo sapiens
gaacagggucauguuugcag

SEQ ID NO: 1624582 - RNA, 15 nt, Homo sapiens
gaacaguuguccagg

SEQ ID NO: 1624583 - RNA, 15 nt, Homo sapiens
gaacauacuguucuc

SEQ ID NO: 1624584 - RNA, 16 nt, Homo sapiens
gaacauacuguucuca

SEQ ID NO: 1624585 - RNA, 15 nt, Homo sapiens
gaacauuauuuaaua

SEQ ID NO: 1624586 - RNA, 21 nt, Homo sapiens
gaaccacucauaauucuucac

SEQ ID NO: 1624587 - RNA, 20 nt, Homo sapiens
gaacguuuuuccuguucuua

SEQ ID NO: 1624588 - RNA, 19 nt, Homo sapiens
gaacuuaguaaguaauauc

SEQ ID NO: 1624589 - RNA, 19 nt, Homo sapiens
gaacuucuuugaauuuacu

SEQ ID NO: 1624590 - RNA, 20 nt, Homo sapiens
gaacuuuuuuagaaaugcaa

SEQ ID NO: 1624591 - RNA, 19 nt, Homo sapiens
gaagaacaagaaauggaug

SEQ ID NO: 1624592 - RNA, 13 nt, Homo sapiens
gaagcauuuugca

SEQ ID NO: 1624593 - RNA, 17 nt, Homo sapiens
gaagccagccacagacc

SEQ ID NO: 1624594 - RNA, 16 nt, Homo sapiens
gaagcuggugcgcccu

SEQ ID NO: 1624595 - RNA, 15 nt, Homo sapiens
gaaggaaaagcaaga

SEQ ID NO: 1624596 - RNA, 18 nt, Homo sapiens
gaaggacaggacccucag

SEQ ID NO: 1624597 - RNA, 16 nt, Homo sapiens
gaaggauaaagccacu

SEQ ID NO: 1624598 - RNA, 18 nt, Homo sapiens
gaaggcaguggcagggga

SEQ ID NO: 1624599 - RNA, 12 nt, Homo sapiens
gaaggcuaugua

SEQ ID NO: 1624600 - RNA, 23 nt, Homo sapiens
gaaggcuuaagaacugcuucaug

SEQ ID NO: 1624601 - RNA, 17 nt, Homo sapiens
gaagggagucucucuuc

SEQ ID NO: 1624602 - RNA, 20 nt, Homo sapiens
gaagggggcggccuaugacu

SEQ ID NO: 1624603 - RNA, 14 nt, Homo sapiens
gaaguauggugugu

SEQ ID NO: 1624604 - RNA, 20 nt, Homo sapiens
gaagucagagagggugacaa

SEQ ID NO: 1624605 - RNA, 16 nt, Homo sapiens
gaaguuuaauugacuu

SEQ ID NO: 1624606 - RNA, 21 nt, Homo sapiens
gaaguuuuaugcgugugacag

SEQ ID NO: 1624607 - RNA, 13 nt, Homo sapiens
gaauaaagacuug

SEQ ID NO: 1624608 - RNA, 17 nt, Homo sapiens
gaauaaucuccuguuaa

SEQ ID NO: 1624609 - RNA, 20 nt, Homo sapiens
gaauacauuaacggugcuaa

SEQ ID NO: 1624610 - RNA, 19 nt, Homo sapiens
gaauaccuuggucucaccu

SEQ ID NO: 1624611 - RNA, 21 nt, Homo sapiens
gaaucauacuuaacauuucau

SEQ ID NO: 1624612 - RNA, 18 nt, Homo sapiens
gaaucauuuuuguaggaa

SEQ ID NO: 1624613 - RNA, 16 nt, Homo sapiens
gaaucccaauguuuga

SEQ ID NO: 1624614 - RNA, 15 nt, Homo sapiens
gaaugacuuacuuuc

SEQ ID NO: 1624615 - RNA, 18 nt, Homo sapiens
gaaugcagaggucuccaa

SEQ ID NO: 1624616 - RNA, 20 nt, Homo sapiens
gaaugccucgcucccuucaa

SEQ ID NO: 1624617 - RNA, 15 nt, Homo sapiens
gaaugcuggcaaagg

SEQ ID NO: 1624618 - RNA, 14 nt, Homo sapiens
gaaugggcugagaa

SEQ ID NO: 1624619 - RNA, 22 nt, Homo sapiens
gaauuauuguagacaugcccaa

SEQ ID NO: 1624620 - RNA, 20 nt, Homo sapiens
gaauucucucuucuggaauc

SEQ ID NO: 1624621 - RNA, 14 nt, Homo sapiens
gaauuggaaucaca

SEQ ID NO: 1624622 - RNA, 18 nt, Homo sapiens
gaauuggaaucacauucu

SEQ ID NO: 1624623 - RNA, 17 nt, Homo sapiens
gaauuguuccaguacua

SEQ ID NO: 1624624 - RNA, 13 nt, Homo sapiens
gaauuucccacau

SEQ ID NO: 1624625 - RNA, 16 nt, Homo sapiens
gaauuuguuuuagcca

SEQ ID NO: 1624626 - RNA, 15 nt, Homo sapiens
gacaaaaaggccaag

SEQ ID NO: 1624627 - RNA, 13 nt, Homo sapiens
gacaaaacacagc

SEQ ID NO: 1624628 - RNA, 17 nt, Homo sapiens
gacaaccagaaggcccu

SEQ ID NO: 1624629 - RNA, 18 nt, Homo sapiens
gacaagaaugugcacucu

SEQ ID NO: 1624630 - RNA, 15 nt, Homo sapiens
gacaagcaugguccc

SEQ ID NO: 1624631 - RNA, 12 nt, Homo sapiens
gacacaggcaug

SEQ ID NO: 1624632 - RNA, 16 nt, Homo sapiens
gacaccaaaacaaacc

SEQ ID NO: 1624633 - RNA, 18 nt, Homo sapiens
gacaccacaaggcagccu

SEQ ID NO: 1624634 - RNA, 10 nt, Homo sapiens
gacagaauuc

SEQ ID NO: 1624635 - RNA, 17 nt, Homo sapiens
gacagagcagugcugga

SEQ ID NO: 1624636 - RNA, 20 nt, Homo sapiens
gacagcaugaaauguccucu

SEQ ID NO: 1624637 - RNA, 22 nt, Homo sapiens
gacagugaaauacauccuucaa

SEQ ID NO: 1624638 - RNA, 18 nt, Homo sapiens
gacagugaggcaggagaa

SEQ ID NO: 1624639 - RNA, 14 nt, Homo sapiens
gacaguuucugaca

SEQ ID NO: 1624640 - RNA, 19 nt, Homo sapiens
gacauaaagccauguuucc

SEQ ID NO: 1624641 - RNA, 14 nt, Homo sapiens
gacaugacauucuu

SEQ ID NO: 1624642 - RNA, 22 nt, Homo sapiens
gacaugcugaaauuauuucucu

SEQ ID NO: 1624643 - RNA, 23 nt, Homo sapiens
gacauguagguaggaagcacuga

SEQ ID NO: 1624644 - RNA, 14 nt, Homo sapiens
gacauugcauuugg

SEQ ID NO: 1624645 - RNA, 16 nt, Homo sapiens
gacauuuucucuuaga

SEQ ID NO: 1624646 - RNA, 18 nt, Homo sapiens
gacauuuuuucagucaua

SEQ ID NO: 1624647 - RNA, 21 nt, Homo sapiens
gacauuuuuucagucauauaa

SEQ ID NO: 1624648 - RNA, 14 nt, Homo sapiens
gaccacgaggcuga

SEQ ID NO: 1624649 - RNA, 22 nt, Homo sapiens
gaccacuuuccccgugggccau

SEQ ID NO: 1624650 - RNA, 23 nt, Homo sapiens
gaccauggccaccccagagccau

SEQ ID NO: 1624651 - RNA, 14 nt, Homo sapiens
gacccaaucugccu

SEQ ID NO: 1624652 - RNA, 15 nt, Homo sapiens
gacccacacuuccau

SEQ ID NO: 1624653 - RNA, 20 nt, Homo sapiens
gacccacacuuccaugagaa

SEQ ID NO: 1624654 - RNA, 17 nt, Homo sapiens
gaccccgcccagcauug

SEQ ID NO: 1624655 - RNA, 16 nt, Homo sapiens
gacccuccccuaguca

SEQ ID NO: 1624656 - RNA, 19 nt, Homo sapiens
gacccugggcccaucucuc

SEQ ID NO: 1624657 - RNA, 21 nt, Homo sapiens
gaccuaaaaaggucuguuaau

SEQ ID NO: 1624658 - RNA, 19 nt, Homo sapiens
gaccuccagcuuuccugua

SEQ ID NO: 1624659 - RNA, 22 nt, Homo sapiens
gaccuccucuucccccuuccaa

SEQ ID NO: 1624660 - RNA, 19 nt, Homo sapiens
gaccucucauaaauuuacu

SEQ ID NO: 1624661 - RNA, 22 nt, Homo sapiens
gaccuuucuagacaucauuguc

SEQ ID NO: 1624662 - RNA, 18 nt, Homo sapiens
gacgacauacaugcuacu

SEQ ID NO: 1624663 - RNA, 22 nt, Homo sapiens
gacgaguacucuugaacacaag

SEQ ID NO: 1624664 - RNA, 13 nt, Homo sapiens
gacgcugcugaca

SEQ ID NO: 1624665 - RNA, 21 nt, Homo sapiens
gacggcccucaucuaugagga

SEQ ID NO: 1624666 - RNA, 22 nt, Homo sapiens
gacgggcaaaauaaagugacag

SEQ ID NO: 1624667 - RNA, 23 nt, Homo sapiens
gacgggcaaaauaaagugacaga

SEQ ID NO: 1624668 - RNA, 17 nt, Homo sapiens
gacgugauuuugcugua

SEQ ID NO: 1624669 - RNA, 21 nt, Homo sapiens
gacguuggccuaacacugggc

SEQ ID NO: 1624670 - RNA, 16 nt, Homo sapiens
gacuaguuucuuauua

SEQ ID NO: 1624671 - RNA, 15 nt, Homo sapiens
gacucaauguggaaa

SEQ ID NO: 1624672 - RNA, 18 nt, Homo sapiens
gacucauacaccagguca

SEQ ID NO: 1624673 - RNA, 13 nt, Homo sapiens
gacucuccaggga

SEQ ID NO: 1624674 - RNA, 10 nt, Homo sapiens
gacucugcac

SEQ ID NO: 1624675 - RNA, 11 nt, Homo sapiens
gacucuuccac

SEQ ID NO: 1624676 - RNA, 22 nt, Homo sapiens
gacucuuuaauaaauugcuuac

SEQ ID NO: 1624677 - RNA, 14 nt, Homo sapiens
gacugagauggagu

SEQ ID NO: 1624678 - RNA, 16 nt, Homo sapiens
gacugguuuucugcca

SEQ ID NO: 1624679 - RNA, 21 nt, Homo sapiens
gacugucaguucucugggaag

SEQ ID NO: 1624680 - RNA, 15 nt, Homo sapiens
gacuguggugacuuc

SEQ ID NO: 1624681 - RNA, 19 nt, Homo sapiens
gacuuaaggacagcauguc

SEQ ID NO: 1624682 - RNA, 13 nt, Homo sapiens
gacuuauugccaa

SEQ ID NO: 1624683 - RNA, 17 nt, Homo sapiens
gacuuguccagugcucc

SEQ ID NO: 1624684 - RNA, 16 nt, Homo sapiens
gacuuuacaaaccuuu

SEQ ID NO: 1624685 - RNA, 18 nt, Homo sapiens
gacuuucaguaaacauaa

SEQ ID NO: 1624686 - RNA, 13 nt, Homo sapiens
gagaaauggccaa

SEQ ID NO: 1624687 - RNA, 19 nt, Homo sapiens
gagaacaguuguccaggau

SEQ ID NO: 1624688 - RNA, 22 nt, Homo sapiens
gagaacugccuuuggcagaguu

SEQ ID NO: 1624689 - RNA, 14 nt, Homo sapiens
gagaagcacuugag

SEQ ID NO: 1624690 - RNA, 22 nt, Homo sapiens
gagaaggacaugagaucagggc

SEQ ID NO: 1624691 - RNA, 20 nt, Homo sapiens
gagaauguguuucaaaacca

SEQ ID NO: 1624692 - RNA, 21 nt, Homo sapiens
gagaauguguuucaaaaccau

SEQ ID NO: 1624693 - RNA, 22 nt, Homo sapiens
gagaauguguuucaaaaccaug

SEQ ID NO: 1624694 - RNA, 19 nt, Homo sapiens
gagacaagggcaucaucua

SEQ ID NO: 1624695 - RNA, 21 nt, Homo sapiens
gagaccuccccauguacauaa

SEQ ID NO: 1624696 - RNA, 11 nt, Homo sapiens
gagagaccucu

SEQ ID NO: 1624697 - RNA, 16 nt, Homo sapiens
gagagaugggccaggc

SEQ ID NO: 1624698 - RNA, 18 nt, Homo sapiens
gagaggggagugcauuua

SEQ ID NO: 1624699 - RNA, 13 nt, Homo sapiens
gagagggugacaa

SEQ ID NO: 1624700 - RNA, 15 nt, Homo sapiens
gagaguagagggcac

SEQ ID NO: 1624701 - RNA, 14 nt, Homo sapiens
gagauaaacuacau

SEQ ID NO: 1624702 - RNA, 17 nt, Homo sapiens
gagauagcauugugaac

SEQ ID NO: 1624703 - RNA, 19 nt, Homo sapiens
gagauauggcauugcacug

SEQ ID NO: 1624704 - RNA, 15 nt, Homo sapiens
gagaucugugccaua

SEQ ID NO: 1624705 - RNA, 18 nt, Homo sapiens
gagaugacccaaucugcc

SEQ ID NO: 1624706 - RNA, 13 nt, Homo sapiens
gagauggaguucu

SEQ ID NO: 1624707 - RNA, 12 nt, Homo sapiens
gagauggucaca

SEQ ID NO: 1624708 - RNA, 11 nt, Homo sapiens
gagaugugauc

SEQ ID NO: 1624709 - RNA, 17 nt, Homo sapiens
gagauuuuaauucugug

SEQ ID NO: 1624710 - RNA, 15 nt, Homo sapiens
gagcaaguccucacu

SEQ ID NO: 1624711 - RNA, 16 nt, Homo sapiens
gagcaccgccugugaa

SEQ ID NO: 1624712 - RNA, 14 nt, Homo sapiens
gagcagcugaauaa

SEQ ID NO: 1624713 - RNA, 19 nt, Homo sapiens
gagccaccugacucuugca

SEQ ID NO: 1624714 - RNA, 18 nt, Homo sapiens
gagccagcccuccuugac

SEQ ID NO: 1624715 - RNA, 19 nt, Homo sapiens
gagcuaggagcaaagccug

SEQ ID NO: 1624716 - RNA, 16 nt, Homo sapiens
gagcucacaaggcagc

SEQ ID NO: 1624717 - RNA, 15 nt, Homo sapiens
gagcugcaggggcau

SEQ ID NO: 1624718 - RNA, 22 nt, Homo sapiens
gagcugccaagagugaagggaa

SEQ ID NO: 1624719 - RNA, 23 nt, Homo sapiens
gaggaaugugggcuauguaguca

SEQ ID NO: 1624720 - RNA, 21 nt, Homo sapiens
gaggacaaaacuucuugucag

SEQ ID NO: 1624721 - RNA, 20 nt, Homo sapiens
gaggagcaccuccgccagau

SEQ ID NO: 1624722 - RNA, 16 nt, Homo sapiens
gaggagcuggaaccau

SEQ ID NO: 1624723 - RNA, 13 nt, Homo sapiens
gaggaucauauga

SEQ ID NO: 1624724 - RNA, 13 nt, Homo sapiens
gaggcagugacag

SEQ ID NO: 1624725 - RNA, 14 nt, Homo sapiens
gaggccugugcuag

SEQ ID NO: 1624726 - RNA, 14 nt, Homo sapiens
gaggcugauuccuc

SEQ ID NO: 1624727 - RNA, 19 nt, Homo sapiens
gaggcuggaccacacagga

SEQ ID NO: 1624728 - RNA, 16 nt, Homo sapiens
gagggaaaucuguaaa

SEQ ID NO: 1624729 - RNA, 19 nt, Homo sapiens
gagggacaaaggagccugu

SEQ ID NO: 1624730 - RNA, 22 nt, Homo sapiens
gaggggaggauguauaaaaugg

SEQ ID NO: 1624731 - RNA, 12 nt, Homo sapiens
gagggugacuga

SEQ ID NO: 1624732 - RNA, 14 nt, Homo sapiens
gaggugacacucca

SEQ ID NO: 1624733 - RNA, 22 nt, Homo sapiens
gaggugcuguccccacugcccc

SEQ ID NO: 1624734 - RNA, 14 nt, Homo sapiens
gaggugugccagaa

SEQ ID NO: 1624735 - RNA, 14 nt, Homo sapiens
gaguaaucugugua

SEQ ID NO: 1624736 - RNA, 17 nt, Homo sapiens
gaguagguacuccauaa

SEQ ID NO: 1624737 - RNA, 12 nt, Homo sapiens
gagucuauguuc

SEQ ID NO: 1624738 - RNA, 17 nt, Homo sapiens
gagucucauuugggcua

SEQ ID NO: 1624739 - RNA, 22 nt, Homo sapiens
gagucuccaacggcaagggaac

SEQ ID NO: 1624740 - RNA, 22 nt, Homo sapiens
gagugauaauaguccuuuacaa

SEQ ID NO: 1624741 - RNA, 22 nt, Homo sapiens
gagugggccccgggcuggagaa

SEQ ID NO: 1624742 - RNA, 18 nt, Homo sapiens
gagugugacagggccagu

SEQ ID NO: 1624743 - RNA, 17 nt, Homo sapiens
gaguuauauguucacug

SEQ ID NO: 1624744 - RNA, 15 nt, Homo sapiens
gaguucuagaccucu

SEQ ID NO: 1624745 - RNA, 19 nt, Homo sapiens
gaguuucacaaauccuuca

SEQ ID NO: 1624746 - RNA, 24 nt, Homo sapiens
gauaaaaugccagucucauuguca

SEQ ID NO: 1624747 - RNA, 14 nt, Homo sapiens
gauaaaugacuguu

SEQ ID NO: 1624748 - RNA, 21 nt, Homo sapiens
gauaaguagggcuaagccagu

SEQ ID NO: 1624749 - RNA, 14 nt, Homo sapiens
gauaauaauggguu

SEQ ID NO: 1624750 - RNA, 14 nt, Homo sapiens
gauaaucacacugc

SEQ ID NO: 1624751 - RNA, 15 nt, Homo sapiens
gauacauuuggauaa

SEQ ID NO: 1624752 - RNA, 21 nt, Homo sapiens
gauacauuuggauaaacaaca

SEQ ID NO: 1624753 - RNA, 19 nt, Homo sapiens
gauacuaauagaguacuua

SEQ ID NO: 1624754 - RNA, 19 nt, Homo sapiens
gauacugaggcacacagag

SEQ ID NO: 1624755 - RNA, 14 nt, Homo sapiens
gauagaagauuguu

SEQ ID NO: 1624756 - RNA, 14 nt, Homo sapiens
gauagauaaugccu

SEQ ID NO: 1624757 - RNA, 15 nt, Homo sapiens
gauagcauugugaac

SEQ ID NO: 1624758 - RNA, 18 nt, Homo sapiens
gauauuaacaacaauaac

SEQ ID NO: 1624759 - RNA, 18 nt, Homo sapiens
gauauuuauuuuuugcca

SEQ ID NO: 1624760 - RNA, 16 nt, Homo sapiens
gaucacagacacugca

SEQ ID NO: 1624761 - RNA, 17 nt, Homo sapiens
gaucacgccacuggacu

SEQ ID NO: 1624762 - RNA, 15 nt, Homo sapiens
gaucagcgacccuga

SEQ ID NO: 1624763 - RNA, 15 nt, Homo sapiens
gaucagguguggcca

SEQ ID NO: 1624764 - RNA, 15 nt, Homo sapiens
gaucaucuuugccac

SEQ ID NO: 1624765 - RNA, 22 nt, Homo sapiens
gauccugcaaggggacauucca

SEQ ID NO: 1624766 - RNA, 18 nt, Homo sapiens
gaucucggcucacugcaa

SEQ ID NO: 1624767 - RNA, 15 nt, Homo sapiens
gaucucggcucagug

SEQ ID NO: 1624768 - RNA, 16 nt, Homo sapiens
gaucucgguuugccaa

SEQ ID NO: 1624769 - RNA, 18 nt, Homo sapiens
gaucucucuagcuuuguc

SEQ ID NO: 1624770 - RNA, 18 nt, Homo sapiens
gaucugggagauccugca

SEQ ID NO: 1624771 - RNA, 22 nt, Homo sapiens
gaucuggggaggcaggcauucc

SEQ ID NO: 1624772 - RNA, 18 nt, Homo sapiens
gaucuugaacuccugacc

SEQ ID NO: 1624773 - RNA, 12 nt, Homo sapiens
gaugaaaaccua

SEQ ID NO: 1624774 - RNA, 15 nt, Homo sapiens
gaugacacuagucag

SEQ ID NO: 1624775 - RNA, 16 nt, Homo sapiens
gaugacuauuacuuuu

SEQ ID NO: 1624776 - RNA, 18 nt, Homo sapiens
gaugagcaagacauacuu

SEQ ID NO: 1624777 - RNA, 21 nt, Homo sapiens
gaugagucagugccaugacug

SEQ ID NO: 1624778 - RNA, 18 nt, Homo sapiens
gaugauuuaauauggauu

SEQ ID NO: 1624779 - RNA, 20 nt, Homo sapiens
gaugauuucaauagcuuugu

SEQ ID NO: 1624780 - RNA, 15 nt, Homo sapiens
gaugcccucaacuca

SEQ ID NO: 1624781 - RNA, 13 nt, Homo sapiens
gauggcauaccug

SEQ ID NO: 1624782 - RNA, 20 nt, Homo sapiens
gauggcauaccugugccugc

SEQ ID NO: 1624783 - RNA, 16 nt, Homo sapiens
gauggcauccugugaa

SEQ ID NO: 1624784 - RNA, 19 nt, Homo sapiens
gaugggaugcacucucaga

SEQ ID NO: 1624785 - RNA, 12 nt, Homo sapiens
gaugggcaaagc

SEQ ID NO: 1624786 - RNA, 21 nt, Homo sapiens
gaugggcauaugugucagugg

SEQ ID NO: 1624787 - RNA, 14 nt, Homo sapiens
gauguaugcagcua

SEQ ID NO: 1624788 - RNA, 13 nt, Homo sapiens
gaugugaagccaa

SEQ ID NO: 1624789 - RNA, 23 nt, Homo sapiens
gauuaaauaaaacuuaaaucuca

SEQ ID NO: 1624790 - RNA, 13 nt, Homo sapiens
gauuaauuugaaa

SEQ ID NO: 1624791 - RNA, 12 nt, Homo sapiens
gauuacuuguaa

SEQ ID NO: 1624792 - RNA, 18 nt, Homo sapiens
gauucgaaacuccauuga

SEQ ID NO: 1624793 - RNA, 20 nt, Homo sapiens
gauugcaugugacucugaag

SEQ ID NO: 1624794 - RNA, 14 nt, Homo sapiens
gauugcccgugaag

SEQ ID NO: 1624795 - RNA, 15 nt, Homo sapiens
gauuucagcagggau

SEQ ID NO: 1624796 - RNA, 20 nt, Homo sapiens
gauuuccaaaagacuugaag

SEQ ID NO: 1624797 - RNA, 23 nt, Homo sapiens
gauuucucuacuugucauaucac

SEQ ID NO: 1624798 - RNA, 18 nt, Homo sapiens
gauuuguaugcucauuga

SEQ ID NO: 1624799 - RNA, 12 nt, Homo sapiens
gauuuguggaaa

SEQ ID NO: 1624800 - RNA, 23 nt, Homo sapiens
gauuuucaaccagauaacauacc

SEQ ID NO: 1624801 - RNA, 16 nt, Homo sapiens
gauuuugcuguagaag

SEQ ID NO: 1624802 - RNA, 15 nt, Homo sapiens
gcaaaguguauguga

SEQ ID NO: 1624803 - RNA, 20 nt, Homo sapiens
gcaaauaaaauaaaugaaau

SEQ ID NO: 1624804 - RNA, 14 nt, Homo sapiens
gcaaauacaaucag

SEQ ID NO: 1624805 - RNA, 19 nt, Homo sapiens
gcaaaucuaugagauuuug

SEQ ID NO: 1624806 - RNA, 18 nt, Homo sapiens
gcaaaugcagaaccacaa

SEQ ID NO: 1624807 - RNA, 20 nt, Homo sapiens
gcaaauuaaaacauauuuca

SEQ ID NO: 1624808 - RNA, 16 nt, Homo sapiens
gcaacagaaaccaaga

SEQ ID NO: 1624809 - RNA, 23 nt, Homo sapiens
gcaacagauagauguugcucuuu

SEQ ID NO: 1624810 - RNA, 19 nt, Homo sapiens
gcaacagccacuacauuac

SEQ ID NO: 1624811 - RNA, 20 nt, Homo sapiens
gcaacaucuuacuuguccuu

SEQ ID NO: 1624812 - RNA, 17 nt, Homo sapiens
gcaacauuaugauuaau

SEQ ID NO: 1624813 - RNA, 20 nt, Homo sapiens
gcaaccagggagcugcaggg

SEQ ID NO: 1624814 - RNA, 11 nt, Homo sapiens
gcaaccccagg

SEQ ID NO: 1624815 - RNA, 20 nt, Homo sapiens
gcaaggcccgagcagcugag

SEQ ID NO: 1624816 - RNA, 17 nt, Homo sapiens
gcaauaaacauaugugu

SEQ ID NO: 1624817 - RNA, 18 nt, Homo sapiens
gcaauagcuagcuauaua

SEQ ID NO: 1624818 - RNA, 18 nt, Homo sapiens
gcaaucagaguguacaaa

SEQ ID NO: 1624819 - RNA, 20 nt, Homo sapiens
gcaaucagcuaccauucaaa

SEQ ID NO: 1624820 - RNA, 14 nt, Homo sapiens
gcaauuuagcucuc

SEQ ID NO: 1624821 - RNA, 18 nt, Homo sapiens
gcacaaggccaucugggc

SEQ ID NO: 1624822 - RNA, 16 nt, Homo sapiens
gcacaagggcacguga

SEQ ID NO: 1624823 - RNA, 14 nt, Homo sapiens
gcacacagggcagu

SEQ ID NO: 1624824 - RNA, 19 nt, Homo sapiens
gcacacccaugcacacuca

SEQ ID NO: 1624825 - RNA, 19 nt, Homo sapiens
gcacaguagagcaaaucua

SEQ ID NO: 1624826 - RNA, 21 nt, Homo sapiens
gcacauauccaggcaccagga

SEQ ID NO: 1624827 - RNA, 15 nt, Homo sapiens
gcacauccaggcaau

SEQ ID NO: 1624828 - RNA, 20 nt, Homo sapiens
gcacauuccccuugccuaaa

SEQ ID NO: 1624829 - RNA, 23 nt, Homo sapiens
gcaccagugggacuguggugacu

SEQ ID NO: 1624830 - RNA, 16 nt, Homo sapiens
gcacccccugcagcuu

SEQ ID NO: 1624831 - RNA, 15 nt, Homo sapiens
gcacccucccuagcu

SEQ ID NO: 1624832 - RNA, 18 nt, Homo sapiens
gcaccguucugugcacaa

SEQ ID NO: 1624833 - RNA, 21 nt, Homo sapiens
gcaccuaccuuagaaaacaag

SEQ ID NO: 1624834 - RNA, 17 nt, Homo sapiens
gcaccugcaugugcugu

SEQ ID NO: 1624835 - RNA, 19 nt, Homo sapiens
gcaccugcaugugcuguca

SEQ ID NO: 1624836 - RNA, 13 nt, Homo sapiens
gcacuccuggaca

SEQ ID NO: 1624837 - RNA, 22 nt, Homo sapiens
gcacugcccaggucccuccuca

SEQ ID NO: 1624838 - RNA, 16 nt, Homo sapiens
gcacuuccaccuccag

SEQ ID NO: 1624839 - RNA, 17 nt, Homo sapiens
gcacuuuccuuucaaua

SEQ ID NO: 1624840 - RNA, 18 nt, Homo sapiens
gcagaaacaaaaugacug

SEQ ID NO: 1624841 - RNA, 23 nt, Homo sapiens
gcagaagaucaaggaguacaaug

SEQ ID NO: 1624842 - RNA, 12 nt, Homo sapiens
gcagacauccac

SEQ ID NO: 1624843 - RNA, 19 nt, Homo sapiens
gcagaccugacucucuuaa

SEQ ID NO: 1624844 - RNA, 23 nt, Homo sapiens
gcagagaccagcccaccccugug

SEQ ID NO: 1624845 - RNA, 24 nt, Homo sapiens
gcagagcgaucucggcucacugca

SEQ ID NO: 1624846 - RNA, 22 nt, Homo sapiens
gcagaucuuggaaugaaugaca

SEQ ID NO: 1624847 - RNA, 19 nt, Homo sapiens
gcagcaccguucugugcac

SEQ ID NO: 1624848 - RNA, 14 nt, Homo sapiens
gcagcccaaggaca

SEQ ID NO: 1624849 - RNA, 22 nt, Homo sapiens
gcagcuuaggauggcuauguga

SEQ ID NO: 1624850 - RNA, 13 nt, Homo sapiens
gcagcuuguagcc

SEQ ID NO: 1624851 - RNA, 18 nt, Homo sapiens
gcaggaaauacuuuguaa

SEQ ID NO: 1624852 - RNA, 23 nt, Homo sapiens
gcaggaauaaagacuugugcauc

SEQ ID NO: 1624853 - RNA, 14 nt, Homo sapiens
gcaggacuugccac

SEQ ID NO: 1624854 - RNA, 16 nt, Homo sapiens
gcaggagaagaacaag

SEQ ID NO: 1624855 - RNA, 14 nt, Homo sapiens
gcaggaguagcuga

SEQ ID NO: 1624856 - RNA, 14 nt, Homo sapiens
gcaggaguggugca

SEQ ID NO: 1624857 - RNA, 20 nt, Homo sapiens
gcaggaguggugcagacaga

SEQ ID NO: 1624858 - RNA, 17 nt, Homo sapiens
gcaggaucccuacugcc

SEQ ID NO: 1624859 - RNA, 23 nt, Homo sapiens
gcaggcuuucugggugugacuga

SEQ ID NO: 1624860 - RNA, 22 nt, Homo sapiens
gcaggugcugacuucaucuccc

SEQ ID NO: 1624861 - RNA, 24 nt, Homo sapiens
gcaguagccuaacacacuccaaga

SEQ ID NO: 1624862 - RNA, 22 nt, Homo sapiens
gcaguggagggggcaagcuuug

SEQ ID NO: 1624863 - RNA, 16 nt, Homo sapiens
gcauaaaaaacaugug

SEQ ID NO: 1624864 - RNA, 14 nt, Homo sapiens
gcauaccacuugaa

SEQ ID NO: 1624865 - RNA, 18 nt, Homo sapiens
gcauaugguccuagacaa

SEQ ID NO: 1624866 - RNA, 22 nt, Homo sapiens
gcauaugucacuagaauggaua

SEQ ID NO: 1624867 - RNA, 13 nt, Homo sapiens
gcaucaucuaugg

SEQ ID NO: 1624868 - RNA, 22 nt, Homo sapiens
gcaucaugccucugaggccagc

SEQ ID NO: 1624869 - RNA, 13 nt, Homo sapiens
gcaucauuacugu

SEQ ID NO: 1624870 - RNA, 20 nt, Homo sapiens
gcaucuuccccaacgaaaag

SEQ ID NO: 1624871 - RNA, 18 nt, Homo sapiens
gcaugagucuguuuccca

SEQ ID NO: 1624872 - RNA, 22 nt, Homo sapiens
gcaugcuggcucccagggccau

SEQ ID NO: 1624873 - RNA, 16 nt, Homo sapiens
gcauuacuugcuuuca

SEQ ID NO: 1624874 - RNA, 18 nt, Homo sapiens
gcauugauugcacuugau

SEQ ID NO: 1624875 - RNA, 14 nt, Homo sapiens
gcauugcuuuccac

SEQ ID NO: 1624876 - RNA, 23 nt, Homo sapiens
gcauuuauuuaagacacuguuac

SEQ ID NO: 1624877 - RNA, 14 nt, Homo sapiens
gccaaccuggaaug

SEQ ID NO: 1624878 - RNA, 13 nt, Homo sapiens
gccaacuccucac

SEQ ID NO: 1624879 - RNA, 17 nt, Homo sapiens
gccaagaauacuugaag

SEQ ID NO: 1624880 - RNA, 21 nt, Homo sapiens
gccaagauuuuccucuuguga

SEQ ID NO: 1624881 - RNA, 16 nt, Homo sapiens
gccaauguuaugccag

SEQ ID NO: 1624882 - RNA, 16 nt, Homo sapiens
gccacagauagcugcc

SEQ ID NO: 1624883 - RNA, 19 nt, Homo sapiens
gccacauacaccacaaaaa

SEQ ID NO: 1624884 - RNA, 21 nt, Homo sapiens
gccacaucuccuguggucucu

SEQ ID NO: 1624885 - RNA, 22 nt, Homo sapiens
gccacccugugggccgggcaau

SEQ ID NO: 1624886 - RNA, 13 nt, Homo sapiens
gccaccucaccaa

SEQ ID NO: 1624887 - RNA, 16 nt, Homo sapiens
gccaccucaccaagga

SEQ ID NO: 1624888 - RNA, 15 nt, Homo sapiens
gccacuaacuucuaa

SEQ ID NO: 1624889 - RNA, 17 nt, Homo sapiens
gccacuaugccugacua

SEQ ID NO: 1624890 - RNA, 16 nt, Homo sapiens
gccacucuuagcuaaa

SEQ ID NO: 1624891 - RNA, 21 nt, Homo sapiens
gccacuggacugucuaugaac

SEQ ID NO: 1624892 - RNA, 21 nt, Homo sapiens
gccagaagaugaacagacuga

SEQ ID NO: 1624893 - RNA, 18 nt, Homo sapiens
gccagagcgugcuuucaa

SEQ ID NO: 1624894 - RNA, 22 nt, Homo sapiens
gccagagguaauguuaguaaau

SEQ ID NO: 1624895 - RNA, 20 nt, Homo sapiens
gccagcaagagggaacaaaa

SEQ ID NO: 1624896 - RNA, 16 nt, Homo sapiens
gccagcagaacugaag

SEQ ID NO: 1624897 - RNA, 16 nt, Homo sapiens
gccagccacacuugaa

SEQ ID NO: 1624898 - RNA, 22 nt, Homo sapiens
gccagcccuccuugacccagaa

SEQ ID NO: 1624899 - RNA, 17 nt, Homo sapiens
gccaggaggccugcuag

SEQ ID NO: 1624900 - RNA, 11 nt, Homo sapiens
gccaggccagg

SEQ ID NO: 1624901 - RNA, 22 nt, Homo sapiens
gccagucucauugucaccucug

SEQ ID NO: 1624902 - RNA, 13 nt, Homo sapiens
gccauaccauucc

SEQ ID NO: 1624903 - RNA, 13 nt, Homo sapiens
gccauagaacaag

SEQ ID NO: 1624904 - RNA, 16 nt, Homo sapiens
gccauccccaccuuca

SEQ ID NO: 1624905 - RNA, 23 nt, Homo sapiens
gccaugacaagaacaaagccacu

SEQ ID NO: 1624906 - RNA, 20 nt, Homo sapiens
gccaugcucaggagccacca

SEQ ID NO: 1624907 - RNA, 20 nt, Homo sapiens
gccauggggaagauggagca

SEQ ID NO: 1624908 - RNA, 23 nt, Homo sapiens
gccauguuucaagaaaauggauu

SEQ ID NO: 1624909 - RNA, 20 nt, Homo sapiens
gcccaagugcaaaagaaaaa

SEQ ID NO: 1624910 - RNA, 18 nt, Homo sapiens
gcccacgguuucagcuag

SEQ ID NO: 1624911 - RNA, 22 nt, Homo sapiens
gcccaggccuucccaccaggaa

SEQ ID NO: 1624912 - RNA, 19 nt, Homo sapiens
gcccaggcuggagugcaau

SEQ ID NO: 1624913 - RNA, 14 nt, Homo sapiens
gcccagggcugaua

SEQ ID NO: 1624914 - RNA, 12 nt, Homo sapiens
gcccagugcaaa

SEQ ID NO: 1624915 - RNA, 13 nt, Homo sapiens
gcccagugcaaac

SEQ ID NO: 1624916 - RNA, 23 nt, Homo sapiens
gccccaacucaagugucaccucc

SEQ ID NO: 1624917 - RNA, 16 nt, Homo sapiens
gccccacauggcuuag

SEQ ID NO: 1624918 - RNA, 15 nt, Homo sapiens
gccccacgugcuccc

SEQ ID NO: 1624919 - RNA, 21 nt, Homo sapiens
gccccaugaccuccagcuuuc

SEQ ID NO: 1624920 - RNA, 15 nt, Homo sapiens
uguucuugaagcagu

SEQ ID NO: 1624921 - RNA, 21 nt, Homo sapiens
uguugagacugauucagagga

SEQ ID NO: 1624922 - RNA, 11 nt, Homo sapiens
uguugcaaugc

SEQ ID NO: 1624923 - RNA, 18 nt, Homo sapiens
uguugcaaugcaugauac

SEQ ID NO: 1624924 - RNA, 11 nt, Homo sapiens
uguugcaugga

SEQ ID NO: 1624925 - RNA, 12 nt, Homo sapiens
uguugcauuccc

SEQ ID NO: 1624926 - RNA, 20 nt, Homo sapiens
uguugcccaggcuggagugc

SEQ ID NO: 1624927 - RNA, 15 nt, Homo sapiens
uguuggcaaacgaga

SEQ ID NO: 1624928 - RNA, 21 nt, Homo sapiens
uguuggcuuucccuuaucaaa

SEQ ID NO: 1624929 - RNA, 19 nt, Homo sapiens
uguuuaaauucucuuucac

SEQ ID NO: 1624930 - RNA, 18 nt, Homo sapiens
uguuuacaacaucaccag

SEQ ID NO: 1624931 - RNA, 22 nt, Homo sapiens
uguuuauuugugucacaaagaa

SEQ ID NO: 1624932 - RNA, 22 nt, Homo sapiens
uguuucccaagcuagacugugu

SEQ ID NO: 1624933 - RNA, 18 nt, Homo sapiens
uguuucugucaagcuggu

SEQ ID NO: 1624934 - RNA, 19 nt, Homo sapiens
uguuugcacuuggcaaaaa

SEQ ID NO: 1624935 - RNA, 23 nt, Homo sapiens
uguuuugaaaaccuaaaagacag

SEQ ID NO: 1624936 - RNA, 17 nt, Homo sapiens
uguuuugcccaccagau

SEQ ID NO: 1624937 - RNA, 17 nt, Homo sapiens
uguuuuucacauauaaa

SEQ ID NO: 1624938 - RNA, 23 nt, Homo sapiens
uuaaaaauaaaaaacauauacaa

SEQ ID NO: 1624939 - RNA, 13 nt, Homo sapiens
uuaaaacagaagc

SEQ ID NO: 1624940 - RNA, 15 nt, Homo sapiens
uuaaacaaguauaaa

SEQ ID NO: 1624941 - RNA, 21 nt, Homo sapiens
uuaaacaagucaauucugugu

SEQ ID NO: 1624942 - RNA, 19 nt, Homo sapiens
uuaaacacacauugcagcu

SEQ ID NO: 1624943 - RNA, 23 nt, Homo sapiens
uuaaacacacauugcagcuucaa

SEQ ID NO: 1624944 - RNA, 14 nt, Homo sapiens
uuaaagaagcuuua

SEQ ID NO: 1624945 - RNA, 15 nt, Homo sapiens
uuaaagaagcuuuau

SEQ ID NO: 1624946 - RNA, 17 nt, Homo sapiens
uuaaagagggacaggcu

SEQ ID NO: 1624947 - RNA, 19 nt, Homo sapiens
uuaaagcaagcaacacaga

SEQ ID NO: 1624948 - RNA, 18 nt, Homo sapiens
uuaaaguggacuuauuaa

SEQ ID NO: 1624949 - RNA, 22 nt, Homo sapiens
uuaaauaaaacuuaaaucucac

SEQ ID NO: 1624950 - RNA, 19 nt, Homo sapiens
uuaaauaccaguacuugag

SEQ ID NO: 1624951 - RNA, 22 nt, Homo sapiens
uuaaauauuguaauaugacaga

SEQ ID NO: 1624952 - RNA, 14 nt, Homo sapiens
uuaaauuacaauuu

SEQ ID NO: 1624953 - RNA, 14 nt, Homo sapiens
uuaaauuccacaga

SEQ ID NO: 1624954 - RNA, 21 nt, Homo sapiens
uuaacauacacguuaacugca

SEQ ID NO: 1624955 - RNA, 13 nt, Homo sapiens
uuaaccugggacc

SEQ ID NO: 1624956 - RNA, 11 nt, Homo sapiens
uuaacugccaa

SEQ ID NO: 1624957 - RNA, 19 nt, Homo sapiens
uuaagagaucccuuaagaa

SEQ ID NO: 1624958 - RNA, 16 nt, Homo sapiens
uuaagauagaacacaa

SEQ ID NO: 1624959 - RNA, 13 nt, Homo sapiens
uuaagauguguag

SEQ ID NO: 1624960 - RNA, 18 nt, Homo sapiens
uuaagcauuuugaaacaa

SEQ ID NO: 1624961 - RNA, 15 nt, Homo sapiens
uuaagccagcacuca

SEQ ID NO: 1624962 - RNA, 22 nt, Homo sapiens
uuaaguuacacauuuuucagau

SEQ ID NO: 1624963 - RNA, 14 nt, Homo sapiens
uuaauacaugcaac

SEQ ID NO: 1624964 - RNA, 14 nt, Homo sapiens
uuaaucugcaccuu

SEQ ID NO: 1624965 - RNA, 11 nt, Homo sapiens
uuaauguaucu

SEQ ID NO: 1624966 - RNA, 12 nt, Homo sapiens
uuaauucuuaag

SEQ ID NO: 1624967 - RNA, 17 nt, Homo sapiens
uuacacugugucauucu

SEQ ID NO: 1624968 - RNA, 18 nt, Homo sapiens
uuacacuguuucaucuca

SEQ ID NO: 1624969 - RNA, 20 nt, Homo sapiens
uuacacuguuucaucucagc

SEQ ID NO: 1624970 - RNA, 20 nt, Homo sapiens
uuacagacuagcaggcuacu

SEQ ID NO: 1624971 - RNA, 14 nt, Homo sapiens
uuacagcuuucaca

SEQ ID NO: 1624972 - RNA, 16 nt, Homo sapiens
uuacaguguuuggaca

SEQ ID NO: 1624973 - RNA, 21 nt, Homo sapiens
uuaccaaagagauauugauau

SEQ ID NO: 1624974 - RNA, 19 nt, Homo sapiens
uuaccaguuuuccagaaca

SEQ ID NO: 1624975 - RNA, 15 nt, Homo sapiens
uuaccauguauguau

SEQ ID NO: 1624976 - RNA, 19 nt, Homo sapiens
uuacccaacucuguacaaa

SEQ ID NO: 1624977 - RNA, 16 nt, Homo sapiens
uuaccuauguaacaaa

SEQ ID NO: 1624978 - RNA, 21 nt, Homo sapiens
uuacuaacuaaauaccauuca

SEQ ID NO: 1624979 - RNA, 23 nt, Homo sapiens
uuacuaaguggacuggugucaua

SEQ ID NO: 1624980 - RNA, 13 nt, Homo sapiens
uuacugauauuau

SEQ ID NO: 1624981 - RNA, 16 nt, Homo sapiens
uuacugaugugugcaa

SEQ ID NO: 1624982 - RNA, 18 nt, Homo sapiens
uuacuguuccagauuccu

SEQ ID NO: 1624983 - RNA, 13 nt, Homo sapiens
uuacuuaacucau

SEQ ID NO: 1624984 - RNA, 20 nt, Homo sapiens
uuacuugaggaucauaugaa

SEQ ID NO: 1624985 - RNA, 17 nt, Homo sapiens
uuacuuuuucuuguauu

SEQ ID NO: 1624986 - RNA, 14 nt, Homo sapiens
uuagaaaugcaaaa

SEQ ID NO: 1624987 - RNA, 15 nt, Homo sapiens
uuagaucuacccugc

SEQ ID NO: 1624988 - RNA, 21 nt, Homo sapiens
uuagcauaaaauuuucuacuc

SEQ ID NO: 1624989 - RNA, 22 nt, Homo sapiens
uuagcauaaaauuuucuacucu

SEQ ID NO: 1624990 - RNA, 16 nt, Homo sapiens
uuagcuauguugacau

SEQ ID NO: 1624991 - RNA, 12 nt, Homo sapiens
uuagcuguaaac

SEQ ID NO: 1624992 - RNA, 21 nt, Homo sapiens
uuaggaauaaucuccuguuaa

SEQ ID NO: 1624993 - RNA, 23 nt, Homo sapiens
uuaggauuuucacauucuuggcu

SEQ ID NO: 1624994 - RNA, 12 nt, Homo sapiens
uuagggcacugg

SEQ ID NO: 1624995 - RNA, 14 nt, Homo sapiens
uuaguucaauacag

SEQ ID NO: 1624996 - RNA, 13 nt, Homo sapiens
uuauacccaugaa

SEQ ID NO: 1624997 - RNA, 15 nt, Homo sapiens
uuauauuuuuagccu

SEQ ID NO: 1624998 - RNA, 21 nt, Homo sapiens
uuaucacuucauucacauuca

SEQ ID NO: 1624999 - RNA, 15 nt, Homo sapiens
uuaucaucaccucaa

SEQ ID NO: 1625000 - RNA, 18 nt, Homo sapiens
uuauccauccucugagau

SEQ ID NO: 1625001 - RNA, 13 nt, Homo sapiens
uuaucccaaucau

SEQ ID NO: 1625002 - RNA, 13 nt, Homo sapiens
uuaucugcaccua

SEQ ID NO: 1625003 - RNA, 22 nt, Homo sapiens
uuaucugcaccuagaaccuccc

SEQ ID NO: 1625004 - RNA, 19 nt, Homo sapiens
uuaucuggaaauaauauca

SEQ ID NO: 1625005 - RNA, 22 nt, Homo sapiens
uuaugaggguccucuacuucag

SEQ ID NO: 1625006 - RNA, 16 nt, Homo sapiens
uuaugaguggcuuuaa

SEQ ID NO: 1625007 - RNA, 15 nt, Homo sapiens
uuaugaugaaaaccu

SEQ ID NO: 1625008 - RNA, 16 nt, Homo sapiens
uuauggaaaacugugu

SEQ ID NO: 1625009 - RNA, 22 nt, Homo sapiens
uuauggaauggggcaaaguaaa

SEQ ID NO: 1625010 - RNA, 13 nt, Homo sapiens
uuauggcaaagau

SEQ ID NO: 1625011 - RNA, 16 nt, Homo sapiens
uuauguaucugguuaa

SEQ ID NO: 1625012 - RNA, 21 nt, Homo sapiens
uuaugugcaaaaucuguuaua

SEQ ID NO: 1625013 - RNA, 19 nt, Homo sapiens
uuauuaauuuuuauuauga

SEQ ID NO: 1625014 - RNA, 19 nt, Homo sapiens
uuauuacauguaauuugau

SEQ ID NO: 1625015 - RNA, 19 nt, Homo sapiens
uuauuguuguugccaaaga

SEQ ID NO: 1625016 - RNA, 21 nt, Homo sapiens
uuauuugcuaaucaaagccag

SEQ ID NO: 1625017 - RNA, 20 nt, Homo sapiens
uuauuuuugguuuccaaaga

SEQ ID NO: 1625018 - RNA, 13 nt, Homo sapiens
uuauuuuuugcca

SEQ ID NO: 1625019 - RNA, 22 nt, Homo sapiens
uucaaaauugcuucuucuucaa

SEQ ID NO: 1625020 - RNA, 14 nt, Homo sapiens
uucaaauacuuuug

SEQ ID NO: 1625021 - RNA, 12 nt, Homo sapiens
uucaagacagau

SEQ ID NO: 1625022 - RNA, 15 nt, Homo sapiens
uucaagacucaaugu

SEQ ID NO: 1625023 - RNA, 22 nt, Homo sapiens
uucaaggaggcccacugugucu

SEQ ID NO: 1625024 - RNA, 16 nt, Homo sapiens
uucaaguuccacuucu

SEQ ID NO: 1625025 - RNA, 14 nt, Homo sapiens
uucaauacagugaa

SEQ ID NO: 1625026 - RNA, 14 nt, Homo sapiens
uucaaugaaccaca

SEQ ID NO: 1625027 - RNA, 17 nt, Homo sapiens
uucaaugaaccacaaaa

SEQ ID NO: 1625028 - RNA, 23 nt, Homo sapiens
uucacacagugaaacgcaauuuu

SEQ ID NO: 1625029 - RNA, 14 nt, Homo sapiens
uucacacuaagaaa

SEQ ID NO: 1625030 - RNA, 16 nt, Homo sapiens
uucacauugcacucau

SEQ ID NO: 1625031 - RNA, 15 nt, Homo sapiens
uucaccucacugaaa

SEQ ID NO: 1625032 - RNA, 19 nt, Homo sapiens
uucacgaaguguugcaugg

SEQ ID NO: 1625033 - RNA, 13 nt, Homo sapiens
uucacgccauucu

SEQ ID NO: 1625034 - RNA, 15 nt, Homo sapiens
uucacgccauucucc

SEQ ID NO: 1625035 - RNA, 15 nt, Homo sapiens
uucacucuccagggu

SEQ ID NO: 1625036 - RNA, 18 nt, Homo sapiens
uucagacaagaaugugca

SEQ ID NO: 1625037 - RNA, 16 nt, Homo sapiens
uucagacaagacagag

SEQ ID NO: 1625038 - RNA, 19 nt, Homo sapiens
uucaggaaaauguauugau

SEQ ID NO: 1625039 - RNA, 17 nt, Homo sapiens
uucaggagacuuuacaa

SEQ ID NO: 1625040 - RNA, 21 nt, Homo sapiens
uucaguauuuucuccacuuca

SEQ ID NO: 1625041 - RNA, 13 nt, Homo sapiens
uucagucugacaa

SEQ ID NO: 1625042 - RNA, 15 nt, Homo sapiens
uucagugagaaucug

SEQ ID NO: 1625043 - RNA, 14 nt, Homo sapiens
uucagugcaguuuc

SEQ ID NO: 1625044 - RNA, 20 nt, Homo sapiens
uucauaguaguuacugucag

SEQ ID NO: 1625045 - RNA, 17 nt, Homo sapiens
uucaugagcuugaacaa

SEQ ID NO: 1625046 - RNA, 15 nt, Homo sapiens
uucaugaguauucau

SEQ ID NO: 1625047 - RNA, 16 nt, Homo sapiens
uucauggcuaccucag

SEQ ID NO: 1625048 - RNA, 20 nt, Homo sapiens
uucaugguccgccugccuca

SEQ ID NO: 1625049 - RNA, 12 nt, Homo sapiens
uucauucaaaag

SEQ ID NO: 1625050 - RNA, 13 nt, Homo sapiens
uucauucacauuc

SEQ ID NO: 1625051 - RNA, 14 nt, Homo sapiens
uucauucacauuca

SEQ ID NO: 1625052 - RNA, 21 nt, Homo sapiens
uucauucaggcaacgcacaaa

SEQ ID NO: 1625053 - RNA, 13 nt, Homo sapiens
uucauugcacuuu

SEQ ID NO: 1625054 - RNA, 15 nt, Homo sapiens
uucauuucauuucag

SEQ ID NO: 1625055 - RNA, 23 nt, Homo sapiens
uuccaagaaaauaucacuguaau

SEQ ID NO: 1625056 - RNA, 15 nt, Homo sapiens
uuccaauaguuagau

SEQ ID NO: 1625057 - RNA, 19 nt, Homo sapiens
uuccaaugccacagacaac

SEQ ID NO: 1625058 - RNA, 16 nt, Homo sapiens
uuccacagauuaucaa

SEQ ID NO: 1625059 - RNA, 18 nt, Homo sapiens
uuccaugacgacauacau

SEQ ID NO: 1625060 - RNA, 22 nt, Homo sapiens
uuccauugaagccgacucuggc

SEQ ID NO: 1625061 - RNA, 21 nt, Homo sapiens
uuccauuuugcuaauauuuac

SEQ ID NO: 1625062 - RNA, 17 nt, Homo sapiens
uucccaaaucccucuca

SEQ ID NO: 1625063 - RNA, 21 nt, Homo sapiens
uuccccgcccguuuuacaaag

SEQ ID NO: 1625064 - RNA, 15 nt, Homo sapiens
uuccccuccuuggcu

SEQ ID NO: 1625065 - RNA, 12 nt, Homo sapiens
uucccucugcau

SEQ ID NO: 1625066 - RNA, 16 nt, Homo sapiens
uucccuuagugacucu

SEQ ID NO: 1625067 - RNA, 21 nt, Homo sapiens
uuccgaggccccugucucagg

SEQ ID NO: 1625068 - RNA, 22 nt, Homo sapiens
uuccgcacccucccuagcucug

SEQ ID NO: 1625069 - RNA, 16 nt, Homo sapiens
uuccucaaagcauuug

SEQ ID NO: 1625070 - RNA, 18 nt, Homo sapiens
uuccucaaagcauuugca

SEQ ID NO: 1625071 - RNA, 16 nt, Homo sapiens
uuccucagaucaucca

SEQ ID NO: 1625072 - RNA, 13 nt, Homo sapiens
uuccucuggagac

SEQ ID NO: 1625073 - RNA, 13 nt, Homo sapiens
uuccugaagggaa

SEQ ID NO: 1625074 - RNA, 16 nt, Homo sapiens
uuccugauaacuuuaa

SEQ ID NO: 1625075 - RNA, 13 nt, Homo sapiens
uuccugggaacau

SEQ ID NO: 1625076 - RNA, 15 nt, Homo sapiens
uuccuuaaguauuau

SEQ ID NO: 1625077 - RNA, 12 nt, Homo sapiens
uuccuuaccucc

SEQ ID NO: 1625078 - RNA, 19 nt, Homo sapiens
uuccuuaguuucaaagugu

SEQ ID NO: 1625079 - RNA, 20 nt, Homo sapiens
uuccuucccagaauguuacu

SEQ ID NO: 1625080 - RNA, 22 nt, Homo sapiens
uucgaaacuccauugagucauu

SEQ ID NO: 1625081 - RNA, 13 nt, Homo sapiens
uucgaaaggccuu

SEQ ID NO: 1625082 - RNA, 11 nt, Homo sapiens
uucgcacacac

SEQ ID NO: 1625083 - RNA, 16 nt, Homo sapiens
uucuaacgccagcaca

SEQ ID NO: 1625084 - RNA, 17 nt, Homo sapiens
uucuaggaaaucagaag

SEQ ID NO: 1625085 - RNA, 16 nt, Homo sapiens
uucuaucccuuaccug

SEQ ID NO: 1625086 - RNA, 18 nt, Homo sapiens
uucuauucuagccugcau

SEQ ID NO: 1625087 - RNA, 23 nt, Homo sapiens
uucucaaaacccuuaaaagaagg

SEQ ID NO: 1625088 - RNA, 15 nt, Homo sapiens
uucucaacuguccca

SEQ ID NO: 1625089 - RNA, 22 nt, Homo sapiens
uucucagacuuuggaaaaugca

SEQ ID NO: 1625090 - RNA, 20 nt, Homo sapiens
uucucagaguaaaauaggca

SEQ ID NO: 1625091 - RNA, 23 nt, Homo sapiens
uucucauaauuccuacagcacua

SEQ ID NO: 1625092 - RNA, 19 nt, Homo sapiens
uucucaucuuuuuacuaaa

SEQ ID NO: 1625093 - RNA, 23 nt, Homo sapiens
uucucccacaugaggccaucuca

SEQ ID NO: 1625094 - RNA, 19 nt, Homo sapiens
uucucggggugggacagac

SEQ ID NO: 1625095 - RNA, 22 nt, Homo sapiens
uucucucacuguguuacugcuu

SEQ ID NO: 1625096 - RNA, 21 nt, Homo sapiens
uucucugccaucaacuacuau

SEQ ID NO: 1625097 - RNA, 20 nt, Homo sapiens
uucucuuuuccuuugguccu

SEQ ID NO: 1625098 - RNA, 18 nt, Homo sapiens
uucugagcauacucaaca

SEQ ID NO: 1625099 - RNA, 23 nt, Homo sapiens
uucugcaaaguguaugugaccau

SEQ ID NO: 1625100 - RNA, 17 nt, Homo sapiens
uucugcaaccccaggua

SEQ ID NO: 1625101 - RNA, 12 nt, Homo sapiens
uucugcauuuca

SEQ ID NO: 1625102 - RNA, 20 nt, Homo sapiens
uucuggcuucagcccccacc

SEQ ID NO: 1625103 - RNA, 21 nt, Homo sapiens
uucugucuucccaaacccagu

SEQ ID NO: 1625104 - RNA, 20 nt, Homo sapiens
uucuguggaaguagcuuuga

SEQ ID NO: 1625105 - RNA, 22 nt, Homo sapiens
uucuguguggugcauuccugaa

SEQ ID NO: 1625106 - RNA, 14 nt, Homo sapiens
uucuuauccuuaca

SEQ ID NO: 1625107 - RNA, 22 nt, Homo sapiens
uucuucaccucuuccacuccuu

SEQ ID NO: 1625108 - RNA, 15 nt, Homo sapiens
uucuucauguacaga

SEQ ID NO: 1625109 - RNA, 10 nt, Homo sapiens
uucuugucag

SEQ ID NO: 1625110 - RNA, 23 nt, Homo sapiens
uucuugucagacauaaagccaug

SEQ ID NO: 1625111 - RNA, 18 nt, Homo sapiens
uucuuuagcuguacugua

SEQ ID NO: 1625112 - RNA, 11 nt, Homo sapiens
uucuuuccacc

SEQ ID NO: 1625113 - RNA, 16 nt, Homo sapiens
uucuuugaaauauaau

SEQ ID NO: 1625114 - RNA, 17 nt, Homo sapiens
uucuuuuccuaacaugc

SEQ ID NO: 1625115 - RNA, 15 nt, Homo sapiens
uugaaacaaagaagg

SEQ ID NO: 1625116 - RNA, 18 nt, Homo sapiens
uugaaaugccucuugacc

SEQ ID NO: 1625117 - RNA, 18 nt, Homo sapiens
uugacaauugggagcugc

SEQ ID NO: 1625118 - RNA, 17 nt, Homo sapiens
uugacacauaugaacac

SEQ ID NO: 1625119 - RNA, 20 nt, Homo sapiens
uugacacauaugaacacaga

SEQ ID NO: 1625120 - RNA, 14 nt, Homo sapiens
uugacacggccaug

SEQ ID NO: 1625121 - RNA, 17 nt, Homo sapiens
uugacacggccaugacc

SEQ ID NO: 1625122 - RNA, 16 nt, Homo sapiens
uugacuggcuguguga

SEQ ID NO: 1625123 - RNA, 11 nt, Homo sapiens
uugagacagag

SEQ ID NO: 1625124 - RNA, 19 nt, Homo sapiens
uugagcagaagaucaagga

SEQ ID NO: 1625125 - RNA, 13 nt, Homo sapiens
uugagcaugugau

SEQ ID NO: 1625126 - RNA, 19 nt, Homo sapiens
uugaggccuuuuuugccag

SEQ ID NO: 1625127 - RNA, 19 nt, Homo sapiens
uugauauuuauuuuuugcc

SEQ ID NO: 1625128 - RNA, 12 nt, Homo sapiens
uugaucaguaua

SEQ ID NO: 1625129 - RNA, 14 nt, Homo sapiens
uugauugcacuuga

SEQ ID NO: 1625130 - RNA, 12 nt, Homo sapiens
uugauugggaug

SEQ ID NO: 1625131 - RNA, 15 nt, Homo sapiens
uugauuuacauauau

SEQ ID NO: 1625132 - RNA, 14 nt, Homo sapiens
uugcaaggugugau

SEQ ID NO: 1625133 - RNA, 20 nt, Homo sapiens
uugcacaaguucagugagaa

SEQ ID NO: 1625134 - RNA, 22 nt, Homo sapiens
uugcaccucuguucauuucaca

SEQ ID NO: 1625135 - RNA, 14 nt, Homo sapiens
uugcacucaucaua

SEQ ID NO: 1625136 - RNA, 17 nt, Homo sapiens
uugcagaaugaagccau

SEQ ID NO: 1625137 - RNA, 15 nt, Homo sapiens
uugcagcccaaaggc

SEQ ID NO: 1625138 - RNA, 21 nt, Homo sapiens
uugcaguaagccaaggucaug

SEQ ID NO: 1625139 - RNA, 13 nt, Homo sapiens
uugcauugcagag

SEQ ID NO: 1625140 - RNA, 21 nt, Homo sapiens
uugcauuuauuuaagacacug

SEQ ID NO: 1625141 - RNA, 14 nt, Homo sapiens
uugccaaaaacaaa

SEQ ID NO: 1625142 - RNA, 16 nt, Homo sapiens
uugccaaucugcauuu

SEQ ID NO: 1625143 - RNA, 14 nt, Homo sapiens
uugccagagccaaa

SEQ ID NO: 1625144 - RNA, 14 nt, Homo sapiens
uugcccaccccacc

SEQ ID NO: 1625145 - RNA, 23 nt, Homo sapiens
uugcccaggcuggagugcaaugg

SEQ ID NO: 1625146 - RNA, 21 nt, Homo sapiens
uugccuguuucuucucuacac

SEQ ID NO: 1625147 - RNA, 15 nt, Homo sapiens
uugcgugauucaaug

SEQ ID NO: 1625148 - RNA, 22 nt, Homo sapiens
uugcuaauacccaguuacuuau

SEQ ID NO: 1625149 - RNA, 20 nt, Homo sapiens
uugcucaccgacucaccugc

SEQ ID NO: 1625150 - RNA, 20 nt, Homo sapiens
uugcugaagugguugcauuc

SEQ ID NO: 1625151 - RNA, 23 nt, Homo sapiens
uugcuggcaucccggccaggugg

SEQ ID NO: 1625152 - RNA, 11 nt, Homo sapiens
uugcuguagaa

SEQ ID NO: 1625153 - RNA, 14 nt, Homo sapiens
uugcugugaaauuu

SEQ ID NO: 1625154 - RNA, 18 nt, Homo sapiens
uugcuuccaagaccauuu

SEQ ID NO: 1625155 - RNA, 14 nt, Homo sapiens
uugcuucuauuauu

SEQ ID NO: 1625156 - RNA, 12 nt, Homo sapiens
uugcuugaauuu

SEQ ID NO: 1625157 - RNA, 19 nt, Homo sapiens
uugcuuggaagccagguac

SEQ ID NO: 1625158 - RNA, 17 nt, Homo sapiens
uugcuugggacauugca

SEQ ID NO: 1625159 - RNA, 18 nt, Homo sapiens
uugcuugggacauugcaa

SEQ ID NO: 1625160 - RNA, 10 nt, Homo sapiens
uugcuuuaug

SEQ ID NO: 1625161 - RNA, 20 nt, Homo sapiens
uugcuuuugacuccaggaac

SEQ ID NO: 1625162 - RNA, 15 nt, Homo sapiens
uuggaaucacauucu

SEQ ID NO: 1625163 - RNA, 15 nt, Homo sapiens
uuggaaucagaauug

SEQ ID NO: 1625164 - RNA, 15 nt, Homo sapiens
uuggaaugaaugaca

SEQ ID NO: 1625165 - RNA, 12 nt, Homo sapiens
uuggagcaaacc

SEQ ID NO: 1625166 - RNA, 18 nt, Homo sapiens
uuggauaaguuucuauuc

SEQ ID NO: 1625167 - RNA, 17 nt, Homo sapiens
uuggauugcuggggcca

SEQ ID NO: 1625168 - RNA, 15 nt, Homo sapiens
uuggcggcucuagcc

SEQ ID NO: 1625169 - RNA, 16 nt, Homo sapiens
uuggcucaccauaacc

SEQ ID NO: 1625170 - RNA, 23 nt, Homo sapiens
uuggcuucuguugucaccuucac

SEQ ID NO: 1625171 - RNA, 14 nt, Homo sapiens
uuggcuuuaugcaa

SEQ ID NO: 1625172 - RNA, 16 nt, Homo sapiens
uuggcuuuaugcaaau

SEQ ID NO: 1625173 - RNA, 18 nt, Homo sapiens
uuggcuuuaugcaaauac

SEQ ID NO: 1625174 - RNA, 20 nt, Homo sapiens
uuggcuuuaugcaaauacaa

SEQ ID NO: 1625175 - RNA, 21 nt, Homo sapiens
uugggcaccucgacuugugaa

SEQ ID NO: 1625176 - RNA, 20 nt, Homo sapiens
uugguaaaacucacugugau

SEQ ID NO: 1625177 - RNA, 18 nt, Homo sapiens
uuggucuuagcuuuacau

SEQ ID NO: 1625178 - RNA, 19 nt, Homo sapiens
uuggugugugugacaauuc

SEQ ID NO: 1625179 - RNA, 14 nt, Homo sapiens
uuguaaaacaaaga

SEQ ID NO: 1625180 - RNA, 15 nt, Homo sapiens
uuguaaauaggauuu

SEQ ID NO: 1625181 - RNA, 19 nt, Homo sapiens
uuguaaauaugugacauuc

SEQ ID NO: 1625182 - RNA, 15 nt, Homo sapiens
uuguaaaugugacac

SEQ ID NO: 1625183 - RNA, 22 nt, Homo sapiens
uuguacaggaacugcauugacu

SEQ ID NO: 1625184 - RNA, 14 nt, Homo sapiens
uuguacugacccca

SEQ ID NO: 1625185 - RNA, 18 nt, Homo sapiens
uuguagccagguacugca

SEQ ID NO: 1625186 - RNA, 20 nt, Homo sapiens
uuguaguuuuggcuaguccu

SEQ ID NO: 1625187 - RNA, 22 nt, Homo sapiens
uuguauccguucaauaagcauu

SEQ ID NO: 1625188 - RNA, 15 nt, Homo sapiens
uugucaccucuguga

SEQ ID NO: 1625189 - RNA, 17 nt, Homo sapiens
uugucaccucugugacc

SEQ ID NO: 1625190 - RNA, 17 nt, Homo sapiens
uugucagcaauuuaacu

SEQ ID NO: 1625191 - RNA, 20 nt, Homo sapiens
uugucagccuugcuacuuga

SEQ ID NO: 1625192 - RNA, 16 nt, Homo sapiens
uugucgguuaccucug

SEQ ID NO: 1625193 - RNA, 13 nt, Homo sapiens
uugucuacacucu

SEQ ID NO: 1625194 - RNA, 19 nt, Homo sapiens
uugucuuuucaaaauauua

SEQ ID NO: 1625195 - RNA, 12 nt, Homo sapiens
uugugacuucaa

SEQ ID NO: 1625196 - RNA, 20 nt, Homo sapiens
uugugauauauuagggacac

SEQ ID NO: 1625197 - RNA, 13 nt, Homo sapiens
uuguggagaucac

SEQ ID NO: 1625198 - RNA, 21 nt, Homo sapiens
uugugggacacaacacagaua

SEQ ID NO: 1625199 - RNA, 17 nt, Homo sapiens
uuguggguccaugcuaa

SEQ ID NO: 1625200 - RNA, 23 nt, Homo sapiens
uuguuaaguauugugcacuguau

SEQ ID NO: 1625201 - RNA, 14 nt, Homo sapiens
uuguuagaaagugc

SEQ ID NO: 1625202 - RNA, 12 nt, Homo sapiens
uuguucuacucu

SEQ ID NO: 1625203 - RNA, 21 nt, Homo sapiens
uuguucuuuaaagucaggucc

SEQ ID NO: 1625204 - RNA, 17 nt, Homo sapiens
uuguuuugaaaaccuaa

SEQ ID NO: 1625205 - RNA, 19 nt, Homo sapiens
uuuaaaaaauauuuucucu

SEQ ID NO: 1625206 - RNA, 17 nt, Homo sapiens
uuuaaacaaaugugaua

SEQ ID NO: 1625207 - RNA, 14 nt, Homo sapiens
uuuaaaguuuaaau

SEQ ID NO: 1625208 - RNA, 16 nt, Homo sapiens
uuuaaauagcauaaaa

SEQ ID NO: 1625209 - RNA, 13 nt, Homo sapiens
uuuaaauuccaca

SEQ ID NO: 1625210 - RNA, 14 nt, Homo sapiens
uuuaaauuccacag

SEQ ID NO: 1625211 - RNA, 22 nt, Homo sapiens
uuuaagaaaacaaguauauaau

SEQ ID NO: 1625212 - RNA, 21 nt, Homo sapiens
uuuaagaagucuaaaugaagu

SEQ ID NO: 1625213 - RNA, 13 nt, Homo sapiens
uuuaagacacugu

SEQ ID NO: 1625214 - RNA, 23 nt, Homo sapiens
uuuaagacucucgcaucuuccca

SEQ ID NO: 1625215 - RNA, 12 nt, Homo sapiens
uuuaagccuuuu

SEQ ID NO: 1625216 - RNA, 15 nt, Homo sapiens
uuuaaguacuacaca

SEQ ID NO: 1625217 - RNA, 19 nt, Homo sapiens
uuuaauguaauagggaaaa

SEQ ID NO: 1625218 - RNA, 15 nt, Homo sapiens
uuuaaugugaacucu

SEQ ID NO: 1625219 - RNA, 16 nt, Homo sapiens
uuuaauucugucuugu

SEQ ID NO: 1625220 - RNA, 12 nt, Homo sapiens
uuuacauuugau

SEQ ID NO: 1625221 - RNA, 20 nt, Homo sapiens
uuuaccaaagagauauugau

SEQ ID NO: 1625222 - RNA, 17 nt, Homo sapiens
uuuaccuuauguuuaau

SEQ ID NO: 1625223 - RNA, 22 nt, Homo sapiens
uuuaccuuucagugcaguuucu

SEQ ID NO: 1625224 - RNA, 16 nt, Homo sapiens
uuuagaaaugcaaaau

SEQ ID NO: 1625225 - RNA, 13 nt, Homo sapiens
uuuaggcacuguu

SEQ ID NO: 1625226 - RNA, 21 nt, Homo sapiens
uuuaggugaauuaauuaaaca

SEQ ID NO: 1625227 - RNA, 14 nt, Homo sapiens
uuuauauauuggaa

SEQ ID NO: 1625228 - RNA, 17 nt, Homo sapiens
uuuauaucaugcaaaau

SEQ ID NO: 1625229 - RNA, 14 nt, Homo sapiens
uuuauauucaacuc

SEQ ID NO: 1625230 - RNA, 14 nt, Homo sapiens
uuuaucaagccaua

SEQ ID NO: 1625231 - RNA, 18 nt, Homo sapiens
uuuaucacuucauucaca

SEQ ID NO: 1625232 - RNA, 15 nt, Homo sapiens
uuuauguacaggaug

SEQ ID NO: 1625233 - RNA, 19 nt, Homo sapiens
uuuauguguugaugacuca

SEQ ID NO: 1625234 - RNA, 21 nt, Homo sapiens
uuuauguugguugauauaaca

SEQ ID NO: 1625235 - RNA, 16 nt, Homo sapiens
uuuauuuaacuauuca

SEQ ID NO: 1625236 - RNA, 19 nt, Homo sapiens
uuuauuuuacauagaucau

SEQ ID NO: 1625237 - RNA, 17 nt, Homo sapiens
uuuauuuuugagacaga

SEQ ID NO: 1625238 - RNA, 18 nt, Homo sapiens
uuuauuuuugagacagag

SEQ ID NO: 1625239 - RNA, 15 nt, Homo sapiens
uuucaauuaauauua

SEQ ID NO: 1625240 - RNA, 14 nt, Homo sapiens
uuucacacagugaa

SEQ ID NO: 1625241 - RNA, 16 nt, Homo sapiens
uuucacacagugaaac

SEQ ID NO: 1625242 - RNA, 13 nt, Homo sapiens
uuucaugcaaaag

SEQ ID NO: 1625243 - RNA, 13 nt, Homo sapiens
uuucauguugcaa

SEQ ID NO: 1625244 - RNA, 11 nt, Homo sapiens
uuucauuccau

SEQ ID NO: 1625245 - RNA, 13 nt, Homo sapiens
uuucauugcacuu

SEQ ID NO: 1625246 - RNA, 23 nt, Homo sapiens
uuuccaccuggagggaaaggggg

SEQ ID NO: 1625247 - RNA, 15 nt, Homo sapiens
uuuccacuccauugu

SEQ ID NO: 1625248 - RNA, 20 nt, Homo sapiens
uuuccagaacuaccaugaga

SEQ ID NO: 1625249 - RNA, 17 nt, Homo sapiens
uuuccaucuaucacugc

SEQ ID NO: 1625250 - RNA, 13 nt, Homo sapiens
uuuccccuaucau

SEQ ID NO: 1625251 - RNA, 23 nt, Homo sapiens
uuucccgcccagccucacuuccu

SEQ ID NO: 1625252 - RNA, 23 nt, Homo sapiens
uuuccuaacaugcaccuugcucc

SEQ ID NO: 1625253 - RNA, 16 nt, Homo sapiens
uuuccucagugcauuu

SEQ ID NO: 1625254 - RNA, 20 nt, Homo sapiens
uuuccuggucagcauguacu

SEQ ID NO: 1625255 - RNA, 18 nt, Homo sapiens
uuuccuuugguccuucaa

SEQ ID NO: 1625256 - RNA, 17 nt, Homo sapiens
uuuccuuuucugucucu

SEQ ID NO: 1625257 - RNA, 14 nt, Homo sapiens
uuucuaaaaacaca

SEQ ID NO: 1625258 - RNA, 21 nt, Homo sapiens
uuucuaaacuaggauugacau

SEQ ID NO: 1625259 - RNA, 19 nt, Homo sapiens
uuucuaacgccagcacacu

SEQ ID NO: 1625260 - RNA, 13 nt, Homo sapiens
uuucuagcaaaca

SEQ ID NO: 1625261 - RNA, 19 nt, Homo sapiens
uuucuagcucugacagccu

SEQ ID NO: 1625262 - RNA, 15 nt, Homo sapiens
uuucuauuauggaaa

SEQ ID NO: 1625263 - RNA, 23 nt, Homo sapiens
uuucucagacuuuggaaaaugca

SEQ ID NO: 1625264 - RNA, 12 nt, Homo sapiens
uuucuccauugu

SEQ ID NO: 1625265 - RNA, 21 nt, Homo sapiens
uuucucgacagaugauuuucu

SEQ ID NO: 1625266 - RNA, 14 nt, Homo sapiens
uuucucuuaugcuu

SEQ ID NO: 1625267 - RNA, 15 nt, Homo sapiens
uuucuggcucuccca

SEQ ID NO: 1625268 - RNA, 15 nt, Homo sapiens
uuucuguagugugaa

SEQ ID NO: 1625269 - RNA, 22 nt, Homo sapiens
uuucuugcuggauuauugcuua

SEQ ID NO: 1625270 - RNA, 13 nt, Homo sapiens
uuucuuuccucag

SEQ ID NO: 1625271 - RNA, 17 nt, Homo sapiens
uuucuuuuuuauacuca

SEQ ID NO: 1625272 - RNA, 17 nt, Homo sapiens
uuugaaaagucacuuac

SEQ ID NO: 1625273 - RNA, 16 nt, Homo sapiens
uuugaaccaacaucuu

SEQ ID NO: 1625274 - RNA, 22 nt, Homo sapiens
uuugcauccagcagcagcacuu

SEQ ID NO: 1625275 - RNA, 14 nt, Homo sapiens
uuugcguacacaga

SEQ ID NO: 1625276 - RNA, 15 nt, Homo sapiens
uuugcuaucugggcu

SEQ ID NO: 1625277 - RNA, 19 nt, Homo sapiens
uuugcucagaauugcacau

SEQ ID NO: 1625278 - RNA, 17 nt, Homo sapiens
uuuggaacuguguuuca

SEQ ID NO: 1625279 - RNA, 16 nt, Homo sapiens
uuuggcuuaaaccaga

SEQ ID NO: 1625280 - RNA, 21 nt, Homo sapiens
uuugggagcacggacugucag

SEQ ID NO: 1625281 - RNA, 22 nt, Homo sapiens
uuuggugacuguguaacuuucu

SEQ ID NO: 1625282 - RNA, 18 nt, Homo sapiens
uuugguuuugugugguau

SEQ ID NO: 1625283 - RNA, 16 nt, Homo sapiens
uuuguaaaguuagccu

SEQ ID NO: 1625284 - RNA, 15 nt, Homo sapiens
uuuguaacuugccau

SEQ ID NO: 1625285 - RNA, 22 nt, Homo sapiens
uuuguaaugauuuuggaacugu

SEQ ID NO: 1625286 - RNA, 17 nt, Homo sapiens
uuuguacauagcaaaua

SEQ ID NO: 1625287 - RNA, 16 nt, Homo sapiens
uuuguagccagguacu

SEQ ID NO: 1625288 - RNA, 13 nt, Homo sapiens
uuugucucagaag

SEQ ID NO: 1625289 - RNA, 14 nt, Homo sapiens
uuugugucccugaa

SEQ ID NO: 1625290 - RNA, 13 nt, Homo sapiens
uuuguguguuuca

SEQ ID NO: 1625291 - RNA, 22 nt, Homo sapiens
uuuguuacagccaagugccaaa

SEQ ID NO: 1625292 - RNA, 16 nt, Homo sapiens
uuuguuuaagcugacu

SEQ ID NO: 1625293 - RNA, 13 nt, Homo sapiens
uuuguuuuaaucc

SEQ ID NO: 1625294 - RNA, 14 nt, Homo sapiens
uuuuaaacuacuga

SEQ ID NO: 1625295 - RNA, 13 nt, Homo sapiens
uuuuaaagacaaa

SEQ ID NO: 1625296 - RNA, 18 nt, Homo sapiens
uuuuaauuuauacuggca

SEQ ID NO: 1625297 - RNA, 21 nt, Homo sapiens
uuuuacauagaucauauugua

SEQ ID NO: 1625298 - RNA, 22 nt, Homo sapiens
uuuuagaauuaaaaaagcauac

SEQ ID NO: 1625299 - RNA, 22 nt, Homo sapiens
uuuuagauuauuccaagccuua

SEQ ID NO: 1625300 - RNA, 18 nt, Homo sapiens
uuuuagccauaaauugcu

SEQ ID NO: 1625301 - RNA, 15 nt, Homo sapiens
uuuuaggacaucuua

SEQ ID NO: 1625302 - RNA, 18 nt, Homo sapiens
uuuuagggagaacgggaa

SEQ ID NO: 1625303 - RNA, 16 nt, Homo sapiens
uuuuauaucaugcaaa

SEQ ID NO: 1625304 - RNA, 12 nt, Homo sapiens
uuuuauaugauu

SEQ ID NO: 1625305 - RNA, 21 nt, Homo sapiens
uuuucaaaauauuacucaguu

SEQ ID NO: 1625306 - RNA, 22 nt, Homo sapiens
uuuucaaucaucaaaaaguaau

SEQ ID NO: 1625307 - RNA, 13 nt, Homo sapiens
uuuucacaucucu

SEQ ID NO: 1625308 - RNA, 18 nt, Homo sapiens
uuuucaggggucguccca

SEQ ID NO: 1625309 - RNA, 13 nt, Homo sapiens
uuuucugccaaga

SEQ ID NO: 1625310 - RNA, 12 nt, Homo sapiens
uuuucugccacu

SEQ ID NO: 1625311 - RNA, 15 nt, Homo sapiens
uuuugaaaaccuaaa

SEQ ID NO: 1625312 - RNA, 14 nt, Homo sapiens
uuuugagggagcaa

SEQ ID NO: 1625313 - RNA, 18 nt, Homo sapiens
uuuugcuuuugacuccag

SEQ ID NO: 1625314 - RNA, 12 nt, Homo sapiens
uuuugucucaga

SEQ ID NO: 1625315 - RNA, 14 nt, Homo sapiens
uuuuuaaaguaugu

SEQ ID NO: 1625316 - RNA, 16 nt, Homo sapiens
uuuuuaaggagcaaaa

SEQ ID NO: 1625317 - RNA, 20 nt, Homo sapiens
uuuuuagcugguggcaauaa

SEQ ID NO: 1625318 - RNA, 17 nt, Homo sapiens
uuuuucccagacuacua

SEQ ID NO: 1625319 - RNA, 14 nt, Homo sapiens
uuuuuccuagucuu

SEQ ID NO: 1625320 - RNA, 11 nt, Homo sapiens
uuuuugccauu

SEQ ID NO: 1625321 - RNA, 12 nt, Homo sapiens
uuuuuuguccau

SEQ ID NO: 1625322 - RNA, 22 nt, Homo sapiens
acaguccaaacuguucugagaa

SEQ ID NO: 1625323 - RNA, 21 nt, Homo sapiens
acagugaaauacauccuucaa

SEQ ID NO: 1625324 - RNA, 12 nt, Homo sapiens
acagugaacaaa

SEQ ID NO: 1625325 - RNA, 17 nt, Homo sapiens
acagugccaacuccuca

SEQ ID NO: 1625326 - RNA, 17 nt, Homo sapiens
acagugccgacagcucu

SEQ ID NO: 1625327 - RNA, 18 nt, Homo sapiens
acagugccgacagcucuc

SEQ ID NO: 1625328 - RNA, 21 nt, Homo sapiens
acaguuauugcaagaguuuaa

SEQ ID NO: 1625329 - RNA, 18 nt, Homo sapiens
acaguugcauuuagcuuc

SEQ ID NO: 1625330 - RNA, 18 nt, Homo sapiens
acaguuucuugcuuggaa

SEQ ID NO: 1625331 - RNA, 13 nt, Homo sapiens
acauaaagccaug

SEQ ID NO: 1625332 - RNA, 15 nt, Homo sapiens
acauagaaagccaug

SEQ ID NO: 1625333 - RNA, 12 nt, Homo sapiens
acauagcugugc

SEQ ID NO: 1625334 - RNA, 14 nt, Homo sapiens
acauauaaagcacu

SEQ ID NO: 1625335 - RNA, 20 nt, Homo sapiens
acauauggacucugcacaug

SEQ ID NO: 1625336 - RNA, 12 nt, Homo sapiens
acaucaccagug

SEQ ID NO: 1625337 - RNA, 17 nt, Homo sapiens
acaucaccagugccacg

SEQ ID NO: 1625338 - RNA, 19 nt, Homo sapiens
acauccaaagcagacagcu

SEQ ID NO: 1625339 - RNA, 16 nt, Homo sapiens
acauccagaguucugu

SEQ ID NO: 1625340 - RNA, 21 nt, Homo sapiens
acaucuccuguggucucugac

SEQ ID NO: 1625341 - RNA, 20 nt, Homo sapiens
acaucugagagaugacaggg

SEQ ID NO: 1625342 - RNA, 20 nt, Homo sapiens
acaugacccaggccuggcca

SEQ ID NO: 1625343 - RNA, 13 nt, Homo sapiens
acaugacuggugg

SEQ ID NO: 1625344 - RNA, 15 nt, Homo sapiens
acaugagacuuuccg

SEQ ID NO: 1625345 - RNA, 21 nt, Homo sapiens
acaugaggcaguuccuuccag

SEQ ID NO: 1625346 - RNA, 16 nt, Homo sapiens
acaugaguucaaauac

SEQ ID NO: 1625347 - RNA, 18 nt, Homo sapiens
acaugcaacagaagugac

SEQ ID NO: 1625348 - RNA, 22 nt, Homo sapiens
acaugccccccagauugcugca

SEQ ID NO: 1625349 - RNA, 18 nt, Homo sapiens
acaugcccuaaugucugu

SEQ ID NO: 1625350 - RNA, 18 nt, Homo sapiens
acaugcccuguucagcua

SEQ ID NO: 1625351 - RNA, 14 nt, Homo sapiens
acauguagcuucuu

SEQ ID NO: 1625352 - RNA, 23 nt, Homo sapiens
acauguagguaggaagcacugaa

SEQ ID NO: 1625353 - RNA, 23 nt, Homo sapiens
acauguaucacgggucacuugaa

SEQ ID NO: 1625354 - RNA, 16 nt, Homo sapiens
acaugucaaucugucc

SEQ ID NO: 1625355 - RNA, 14 nt, Homo sapiens
acauguccuauuac

SEQ ID NO: 1625356 - RNA, 17 nt, Homo sapiens
acaugucuugacuguua

SEQ ID NO: 1625357 - RNA, 19 nt, Homo sapiens
acaugucuuguacaugugu

SEQ ID NO: 1625358 - RNA, 15 nt, Homo sapiens
acaugugacacauau

SEQ ID NO: 1625359 - RNA, 18 nt, Homo sapiens
acaugugacacauaugca

SEQ ID NO: 1625360 - RNA, 14 nt, Homo sapiens
acaugugcacuccc

SEQ ID NO: 1625361 - RNA, 22 nt, Homo sapiens
acauguguagccugugcaugua

SEQ ID NO: 1625362 - RNA, 20 nt, Homo sapiens
acauuaaaauaacuaagcaa

SEQ ID NO: 1625363 - RNA, 21 nt, Homo sapiens
acauuacuucaaacugagauc

SEQ ID NO: 1625364 - RNA, 22 nt, Homo sapiens
acauucuagcugagaagcaaug

SEQ ID NO: 1625365 - RNA, 22 nt, Homo sapiens
acauucuguuuaucaagccaua

SEQ ID NO: 1625366 - RNA, 12 nt, Homo sapiens
acauucuuggcu

SEQ ID NO: 1625367 - RNA, 14 nt, Homo sapiens
acauuuaaauucca

SEQ ID NO: 1625368 - RNA, 16 nt, Homo sapiens
acauuuaaauuccaca

SEQ ID NO: 1625369 - RNA, 24 nt, Homo sapiens
acauuucauuguacaaguauuaca

SEQ ID NO: 1625370 - RNA, 14 nt, Homo sapiens
acauuugugcagaa

SEQ ID NO: 1625371 - RNA, 16 nt, Homo sapiens
acauuuuaucauuaaa

SEQ ID NO: 1625372 - RNA, 16 nt, Homo sapiens
accaagcagcaggaau

SEQ ID NO: 1625373 - RNA, 13 nt, Homo sapiens
accaauauuguac

SEQ ID NO: 1625374 - RNA, 16 nt, Homo sapiens
accaauauuguacagu

SEQ ID NO: 1625375 - RNA, 16 nt, Homo sapiens
accacacaggagaagc

SEQ ID NO: 1625376 - RNA, 18 nt, Homo sapiens
accacacuguuacgaugc

SEQ ID NO: 1625377 - RNA, 16 nt, Homo sapiens
accacagcacagccaa

SEQ ID NO: 1625378 - RNA, 16 nt, Homo sapiens
accacagcggauguug

SEQ ID NO: 1625379 - RNA, 22 nt, Homo sapiens
accaccuggggagagccugcuu

SEQ ID NO: 1625380 - RNA, 16 nt, Homo sapiens
accacucccaccacag

SEQ ID NO: 1625381 - RNA, 15 nt, Homo sapiens
accacuucuccaugc

SEQ ID NO: 1625382 - RNA, 16 nt, Homo sapiens
accacuugacagacug

SEQ ID NO: 1625383 - RNA, 18 nt, Homo sapiens
accacuugacagacugua

SEQ ID NO: 1625384 - RNA, 21 nt, Homo sapiens
accacuuuccccgugggccau

SEQ ID NO: 1625385 - RNA, 13 nt, Homo sapiens
accagcccacccc

SEQ ID NO: 1625386 - RNA, 15 nt, Homo sapiens
accaggaaucuccga

SEQ ID NO: 1625387 - RNA, 22 nt, Homo sapiens
accagugugaccacacuguuac

SEQ ID NO: 1625388 - RNA, 12 nt, Homo sapiens
accaucuuaauc

SEQ ID NO: 1625389 - RNA, 19 nt, Homo sapiens
accaugacaaaaaggccaa

SEQ ID NO: 1625390 - RNA, 9 nt, Homo sapiens
accaugcug

SEQ ID NO: 1625391 - RNA, 17 nt, Homo sapiens
accauggcaaaguggau

SEQ ID NO: 1625392 - RNA, 17 nt, Homo sapiens
acccaacucuguacaaa

SEQ ID NO: 1625393 - RNA, 16 nt, Homo sapiens
acccacaagugucuaa

SEQ ID NO: 1625394 - RNA, 21 nt, Homo sapiens
acccacaugugacacauaugc

SEQ ID NO: 1625395 - RNA, 11 nt, Homo sapiens
acccaccugcu

SEQ ID NO: 1625396 - RNA, 15 nt, Homo sapiens
acccagcaucuccca

SEQ ID NO: 1625397 - RNA, 20 nt, Homo sapiens
acccaggcuggagugcagug

SEQ ID NO: 1625398 - RNA, 16 nt, Homo sapiens
acccagggacacucca

SEQ ID NO: 1625399 - RNA, 16 nt, Homo sapiens
acccagggcuaugagg

SEQ ID NO: 1625400 - RNA, 18 nt, Homo sapiens
acccaguucuucauuugg

SEQ ID NO: 1625401 - RNA, 20 nt, Homo sapiens
acccauauguuaaaauucuc

SEQ ID NO: 1625402 - RNA, 17 nt, Homo sapiens
acccaugcccagcugua

SEQ ID NO: 1625403 - RNA, 17 nt, Homo sapiens
acccauguaaccacugc

SEQ ID NO: 1625404 - RNA, 12 nt, Homo sapiens
accccagcuccu

SEQ ID NO: 1625405 - RNA, 14 nt, Homo sapiens
accccagcuccuag

SEQ ID NO: 1625406 - RNA, 22 nt, Homo sapiens
accccagcuccuaggucucaga

SEQ ID NO: 1625407 - RNA, 11 nt, Homo sapiens
accccagcugc

SEQ ID NO: 1625408 - RNA, 18 nt, Homo sapiens
accccagguauccuucau

SEQ ID NO: 1625409 - RNA, 22 nt, Homo sapiens
acccccaguccucccuagcucu

SEQ ID NO: 1625410 - RNA, 12 nt, Homo sapiens
acccccaugaug

SEQ ID NO: 1625411 - RNA, 17 nt, Homo sapiens
accccuccccagucucu

SEQ ID NO: 1625412 - RNA, 19 nt, Homo sapiens
accccuguaaucaggcaag

SEQ ID NO: 1625413 - RNA, 21 nt, Homo sapiens
acccuauuuagaaauggauuu

SEQ ID NO: 1625414 - RNA, 22 nt, Homo sapiens
acccuccagagacaacagguaa

SEQ ID NO: 1625415 - RNA, 15 nt, Homo sapiens
acccucccuagcucu

SEQ ID NO: 1625416 - RNA, 23 nt, Homo sapiens
acccuccuccccacacagacucc

SEQ ID NO: 1625417 - RNA, 17 nt, Homo sapiens
acccugcaggacuugcc

SEQ ID NO: 1625418 - RNA, 18 nt, Homo sapiens
acccugcaggacuugcca

SEQ ID NO: 1625419 - RNA, 16 nt, Homo sapiens
acccugcauguuggcc

SEQ ID NO: 1625420 - RNA, 20 nt, Homo sapiens
accgugccuggcugauucag

SEQ ID NO: 1625421 - RNA, 18 nt, Homo sapiens
accguguaccucaguucc

SEQ ID NO: 1625422 - RNA, 23 nt, Homo sapiens
accguucauucaggcaacgcaca

SEQ ID NO: 1625423 - RNA, 15 nt, Homo sapiens
accguucugugcaca

SEQ ID NO: 1625424 - RNA, 14 nt, Homo sapiens
accuaauaucauuu

SEQ ID NO: 1625425 - RNA, 15 nt, Homo sapiens
accuacaagauuucc

SEQ ID NO: 1625426 - RNA, 12 nt, Homo sapiens
accuacauauuc

SEQ ID NO: 1625427 - RNA, 14 nt, Homo sapiens
accuacauauucca

SEQ ID NO: 1625428 - RNA, 17 nt, Homo sapiens
accuacccuccacaggc

SEQ ID NO: 1625429 - RNA, 12 nt, Homo sapiens
accuauguaaca

SEQ ID NO: 1625430 - RNA, 13 nt, Homo sapiens
accucaagugauc

SEQ ID NO: 1625431 - RNA, 19 nt, Homo sapiens
accuccccagcccaggaaa

SEQ ID NO: 1625432 - RNA, 14 nt, Homo sapiens
acuuauuuauauaa

SEQ ID NO: 1625433 - RNA, 17 nt, Homo sapiens
acuuauuuucagugcau

SEQ ID NO: 1625434 - RNA, 18 nt, Homo sapiens
acuucaaugcacauggug

SEQ ID NO: 1625435 - RNA, 23 nt, Homo sapiens
acuucaauguauugagcauguga

SEQ ID NO: 1625436 - RNA, 19 nt, Homo sapiens
acuucacgaaguguugcau

SEQ ID NO: 1625437 - RNA, 16 nt, Homo sapiens
acuuccagcuugccug

SEQ ID NO: 1625438 - RNA, 21 nt, Homo sapiens
acuuccuuuuaacugccaaga

SEQ ID NO: 1625439 - RNA, 17 nt, Homo sapiens
acuucggcucucuggac

SEQ ID NO: 1625440 - RNA, 18 nt, Homo sapiens
acuucuaaagaaguucaa

SEQ ID NO: 1625441 - RNA, 21 nt, Homo sapiens
acuucuaauuuauauuaucca

SEQ ID NO: 1625442 - RNA, 13 nt, Homo sapiens
acuucuagcucau

SEQ ID NO: 1625443 - RNA, 19 nt, Homo sapiens
acuucuggagaaagcucau

SEQ ID NO: 1625444 - RNA, 19 nt, Homo sapiens
acuucuucaccucuuccac

SEQ ID NO: 1625445 - RNA, 11 nt, Homo sapiens
acuucuugucu

SEQ ID NO: 1625446 - RNA, 15 nt, Homo sapiens
acuucuugucuauag

SEQ ID NO: 1625447 - RNA, 21 nt, Homo sapiens
acuugaaauuuggcuaauaac

SEQ ID NO: 1625448 - RNA, 14 nt, Homo sapiens
acuugaaccuaaua

SEQ ID NO: 1625449 - RNA, 16 nt, Homo sapiens
acuugacaagccuucu

SEQ ID NO: 1625450 - RNA, 15 nt, Homo sapiens
acuugacagacugua

SEQ ID NO: 1625451 - RNA, 15 nt, Homo sapiens
acuugacauguagcu

SEQ ID NO: 1625452 - RNA, 22 nt, Homo sapiens
acuugacugggugagacccaaa

SEQ ID NO: 1625453 - RNA, 16 nt, Homo sapiens
acuugccucugcacac

SEQ ID NO: 1625454 - RNA, 16 nt, Homo sapiens
acuugcuucucuagcu

SEQ ID NO: 1625455 - RNA, 16 nt, Homo sapiens
acuugcuuuaugccuu

SEQ ID NO: 1625456 - RNA, 21 nt, Homo sapiens
acuugcuuuaugccuucuuau

SEQ ID NO: 1625457 - RNA, 13 nt, Homo sapiens
acuuggcaaaaag

SEQ ID NO: 1625458 - RNA, 19 nt, Homo sapiens
acuuggcacuccuggacaa

SEQ ID NO: 1625459 - RNA, 23 nt, Homo sapiens
acuuggggagauggaguucuugu

SEQ ID NO: 1625460 - RNA, 14 nt, Homo sapiens
acuugucauaucac

SEQ ID NO: 1625461 - RNA, 19 nt, Homo sapiens
acuugucuucccuucugau

SEQ ID NO: 1625462 - RNA, 12 nt, Homo sapiens
acuugugugaug

SEQ ID NO: 1625463 - RNA, 21 nt, Homo sapiens
acuuuaaauccuaccaaagua

SEQ ID NO: 1625464 - RNA, 20 nt, Homo sapiens
acuuuaauuauuguuauaca

SEQ ID NO: 1625465 - RNA, 18 nt, Homo sapiens
acuuuaucuaauaccucu

SEQ ID NO: 1625466 - RNA, 12 nt, Homo sapiens
acuuucauguca

SEQ ID NO: 1625467 - RNA, 17 nt, Homo sapiens
acuuuccaaugccacag

SEQ ID NO: 1625468 - RNA, 22 nt, Homo sapiens
acuuuccccgugggccauggca

SEQ ID NO: 1625469 - RNA, 14 nt, Homo sapiens
acuuucucugccau

SEQ ID NO: 1625470 - RNA, 20 nt, Homo sapiens
acuuuguauaugaaucaaaa

SEQ ID NO: 1625471 - RNA, 16 nt, Homo sapiens
acuuuguccgguggaa

SEQ ID NO: 1625472 - RNA, 17 nt, Homo sapiens
acuuugugacugucacu

SEQ ID NO: 1625473 - RNA, 18 nt, Homo sapiens
acuuugugagccaaagcu

SEQ ID NO: 1625474 - RNA, 17 nt, Homo sapiens
acuuuguguucauuuca

SEQ ID NO: 1625475 - RNA, 22 nt, Homo sapiens
acuuuguuaaaugguuauccaa

SEQ ID NO: 1625476 - RNA, 21 nt, Homo sapiens
acuuuucuuuccucagaucau

SEQ ID NO: 1625477 - RNA, 16 nt, Homo sapiens
acuuuugauaaguauc

SEQ ID NO: 1625478 - RNA, 21 nt, Homo sapiens
acuuuuucuuguauucaugaa

SEQ ID NO: 1625479 - RNA, 12 nt, Homo sapiens
acuuuuuuacac

SEQ ID NO: 1625480 - RNA, 17 nt, Homo sapiens
acuuuuuuacacugaua

SEQ ID NO: 1625481 - RNA, 21 nt, Homo sapiens
acuuuuuuagaaaugcaaaau

SEQ ID NO: 1625482 - RNA, 12 nt, Homo sapiens
agaaaaagccac

SEQ ID NO: 1625483 - RNA, 17 nt, Homo sapiens
agaaaacaaguauauaa

SEQ ID NO: 1625484 - RNA, 21 nt, Homo sapiens
agaaaacuugacauguagcuu

SEQ ID NO: 1625485 - RNA, 23 nt, Homo sapiens
agaaaauacgagaaaaucugcau

SEQ ID NO: 1625486 - RNA, 23 nt, Homo sapiens
agaaaaugacuuauuucugcucu

SEQ ID NO: 1625487 - RNA, 19 nt, Homo sapiens
agaaacaccacuuaaucuu

SEQ ID NO: 1625488 - RNA, 20 nt, Homo sapiens
agaaagccaggagcagcccu

SEQ ID NO: 1625489 - RNA, 20 nt, Homo sapiens
agaaagcucauggcuguguc

SEQ ID NO: 1625490 - RNA, 22 nt, Homo sapiens
agaaaggcucugaagguccaaa

SEQ ID NO: 1625491 - RNA, 22 nt, Homo sapiens
agaaaguugauauucaaccuca

SEQ ID NO: 1625492 - RNA, 17 nt, Homo sapiens
agaaaugcuaucagaaa

SEQ ID NO: 1625493 - RNA, 12 nt, Homo sapiens
agaaauggccaa

SEQ ID NO: 1625494 - RNA, 13 nt, Homo sapiens
agaaauuccccaa

SEQ ID NO: 1625495 - RNA, 16 nt, Homo sapiens
agaacauacuguucuc

SEQ ID NO: 1625496 - RNA, 16 nt, Homo sapiens
agaaccagggcucuuc

SEQ ID NO: 1625497 - RNA, 16 nt, Homo sapiens
agaaccaguaccucag

SEQ ID NO: 1625498 - RNA, 23 nt, Homo sapiens
agaacguggugaccuuucacgaa

SEQ ID NO: 1625499 - RNA, 15 nt, Homo sapiens
agaacucacucuggg

SEQ ID NO: 1625500 - RNA, 22 nt, Homo sapiens
agaacugggcaacuauucauga

SEQ ID NO: 1625501 - RNA, 20 nt, Homo sapiens
agaacuuucugauucacagu

SEQ ID NO: 1625502 - RNA, 16 nt, Homo sapiens
agaagaucauugccau

SEQ ID NO: 1625503 - RNA, 19 nt, Homo sapiens
agaagauccaagaggcccu

SEQ ID NO: 1625504 - RNA, 22 nt, Homo sapiens
agaagauggcacuuauaaccaa

SEQ ID NO: 1625505 - RNA, 21 nt, Homo sapiens
agaagauggcagauacaggag

SEQ ID NO: 1625506 - RNA, 19 nt, Homo sapiens
agaagccaaacagcaagaa

SEQ ID NO: 1625507 - RNA, 14 nt, Homo sapiens
agaagccagccaca

SEQ ID NO: 1625508 - RNA, 22 nt, Homo sapiens
agaagcuccauggacgugucug

SEQ ID NO: 1625509 - RNA, 17 nt, Homo sapiens
agaagcucggacuuggc

SEQ ID NO: 1625510 - RNA, 14 nt, Homo sapiens
agaaggaacaauaa

SEQ ID NO: 1625511 - RNA, 23 nt, Homo sapiens
agaaggcuauguaaacaaaccac

SEQ ID NO: 1625512 - RNA, 16 nt, Homo sapiens
agaaggugaacuguua

SEQ ID NO: 1625513 - RNA, 20 nt, Homo sapiens
agaagguuaccaagaagccu

SEQ ID NO: 1625514 - RNA, 14 nt, Homo sapiens
agaagucuccucaa

SEQ ID NO: 1625515 - RNA, 13 nt, Homo sapiens
agaaguuccucaa

SEQ ID NO: 1625516 - RNA, 14 nt, Homo sapiens
agaauagaaaacug

SEQ ID NO: 1625517 - RNA, 20 nt, Homo sapiens
agaauagcuuuuacucuggu

SEQ ID NO: 1625518 - RNA, 13 nt, Homo sapiens
agaauaugacuuu

SEQ ID NO: 1625519 - RNA, 16 nt, Homo sapiens
agaaucacgauuucau

SEQ ID NO: 1625520 - RNA, 21 nt, Homo sapiens
agaaugagaccuggagucaug

SEQ ID NO: 1625521 - RNA, 15 nt, Homo sapiens
agaaugugcacucuc

SEQ ID NO: 1625522 - RNA, 17 nt, Homo sapiens
agaauguguuucaaaac

SEQ ID NO: 1625523 - RNA, 21 nt, Homo sapiens
agaauguuacugacuccucag

SEQ ID NO: 1625524 - RNA, 18 nt, Homo sapiens
agaauuaaaaaagcauac

SEQ ID NO: 1625525 - RNA, 23 nt, Homo sapiens
agaauuauacagaccuaauauca

SEQ ID NO: 1625526 - RNA, 14 nt, Homo sapiens
agaauucuacccug

SEQ ID NO: 1625527 - RNA, 19 nt, Homo sapiens
agaauucucucuucuggaa

SEQ ID NO: 1625528 - RNA, 21 nt, Homo sapiens
agaauuguuccaguacuaugg

SEQ ID NO: 1625529 - RNA, 19 nt, Homo sapiens
agacaagaaugugcacucu

SEQ ID NO: 1625530 - RNA, 22 nt, Homo sapiens
agacaagaaugugcacucucug

SEQ ID NO: 1625531 - RNA, 16 nt, Homo sapiens
agacaaguauggcucc

SEQ ID NO: 1625532 - RNA, 13 nt, Homo sapiens
agacagugggaaa

SEQ ID NO: 1625533 - RNA, 15 nt, Homo sapiens
agacagugggaaaua

SEQ ID NO: 1625534 - RNA, 13 nt, Homo sapiens
agacauaaagcca

SEQ ID NO: 1625535 - RNA, 22 nt, Homo sapiens
agacauaaagccuuuugcuuua

SEQ ID NO: 1625536 - RNA, 13 nt, Homo sapiens
agacauacauuuc

SEQ ID NO: 1625537 - RNA, 16 nt, Homo sapiens
agacauacauuucuca

SEQ ID NO: 1625538 - RNA, 20 nt, Homo sapiens
agaccaccuucccuuccuca

SEQ ID NO: 1625539 - RNA, 17 nt, Homo sapiens
agaccaucgcacaccaa

SEQ ID NO: 1625540 - RNA, 11 nt, Homo sapiens
agacccagugg

SEQ ID NO: 1625541 - RNA, 16 nt, Homo sapiens
accuccucuuccccca

SEQ ID NO: 1625542 - RNA, 15 nt, Homo sapiens
accucggagggaugg

SEQ ID NO: 1625543 - RNA, 19 nt, Homo sapiens
accucggccucccaaagug

SEQ ID NO: 1625544 - RNA, 13 nt, Homo sapiens
accugagccugcc

SEQ ID NO: 1625545 - RNA, 21 nt, Homo sapiens
accugcacuuauacccaugaa

SEQ ID NO: 1625546 - RNA, 17 nt, Homo sapiens
accugcccaaggaugcu

SEQ ID NO: 1625547 - RNA, 19 nt, Homo sapiens
accugcccaaggaugcugu

SEQ ID NO: 1625548 - RNA, 21 nt, Homo sapiens
accugcuagucgccccucaga

SEQ ID NO: 1625549 - RNA, 18 nt, Homo sapiens
accugggcuuaaguuuua

SEQ ID NO: 1625550 - RNA, 18 nt, Homo sapiens
accuggggugaauacuua

SEQ ID NO: 1625551 - RNA, 23 nt, Homo sapiens
accugucucucucuucucucuag

SEQ ID NO: 1625552 - RNA, 20 nt, Homo sapiens
accuguugagacugauucag

SEQ ID NO: 1625553 - RNA, 22 nt, Homo sapiens
accuugaccgacaugaacugua

SEQ ID NO: 1625554 - RNA, 13 nt, Homo sapiens
accuugcauguaa

SEQ ID NO: 1625555 - RNA, 21 nt, Homo sapiens
accuugcucccaauggugcuu

SEQ ID NO: 1625556 - RNA, 12 nt, Homo sapiens
accuuguucuau

SEQ ID NO: 1625557 - RNA, 22 nt, Homo sapiens
accuuuuauguguugaugacuc

SEQ ID NO: 1625558 - RNA, 23 nt, Homo sapiens
accuuuucucgcugaaagcacua

SEQ ID NO: 1625559 - RNA, 20 nt, Homo sapiens
accuuuugcuccuaucccau

SEQ ID NO: 1625560 - RNA, 22 nt, Homo sapiens
acgaauauagaggguuuugcuc

SEQ ID NO: 1625561 - RNA, 16 nt, Homo sapiens
acgacauacaugcuac

SEQ ID NO: 1625562 - RNA, 17 nt, Homo sapiens
acgagcaggcauuucug

SEQ ID NO: 1625563 - RNA, 22 nt, Homo sapiens
acgaugcaauucuagccaaaaa

SEQ ID NO: 1625564 - RNA, 22 nt, Homo sapiens
acgcaauuuuaccuaguuugca

SEQ ID NO: 1625565 - RNA, 13 nt, Homo sapiens
acggagcaucuca

SEQ ID NO: 1625566 - RNA, 14 nt, Homo sapiens
acggccacaucaaa

SEQ ID NO: 1625567 - RNA, 21 nt, Homo sapiens
acggugcagucugggugcucg

SEQ ID NO: 1625568 - RNA, 20 nt, Homo sapiens
acggugcuaaaaaugaaaau

SEQ ID NO: 1625569 - RNA, 23 nt, Homo sapiens
acguacaaaauccagcuaugaau

SEQ ID NO: 1625570 - RNA, 22 nt, Homo sapiens
acgucugggagaaauugacaga

SEQ ID NO: 1625571 - RNA, 15 nt, Homo sapiens
acgugauacauuugg

SEQ ID NO: 1625572 - RNA, 22 nt, Homo sapiens
acuaaaaauauagcaaaugcag

SEQ ID NO: 1625573 - RNA, 20 nt, Homo sapiens
acuaaacagaaaacucccaa

SEQ ID NO: 1625574 - RNA, 12 nt, Homo sapiens
acuaacacagcc

SEQ ID NO: 1625575 - RNA, 15 nt, Homo sapiens
acuaagauacuccau

SEQ ID NO: 1625576 - RNA, 21 nt, Homo sapiens
acuaaggaguaaucuguguac

SEQ ID NO: 1625577 - RNA, 19 nt, Homo sapiens
acuaauuauacuacuuugu

SEQ ID NO: 1625578 - RNA, 16 nt, Homo sapiens
acuacauaacuuccua

SEQ ID NO: 1625579 - RNA, 22 nt, Homo sapiens
acuacuccgugaaggcuucucu

SEQ ID NO: 1625580 - RNA, 18 nt, Homo sapiens
acuagccaaaccaggacc

SEQ ID NO: 1625581 - RNA, 20 nt, Homo sapiens
acuagggcuuauccaugccu

SEQ ID NO: 1625582 - RNA, 14 nt, Homo sapiens
acuaguagauuucu

SEQ ID NO: 1625583 - RNA, 18 nt, Homo sapiens
acuauucauggcuaccuc

SEQ ID NO: 1625584 - RNA, 21 nt, Homo sapiens
acucaagaagcacaccuacag

SEQ ID NO: 1625585 - RNA, 14 nt, Homo sapiens
acucaaucauuucu

SEQ ID NO: 1625586 - RNA, 11 nt, Homo sapiens
acucaccugcg

SEQ ID NO: 1625587 - RNA, 12 nt, Homo sapiens
acucacugugau

SEQ ID NO: 1625588 - RNA, 15 nt, Homo sapiens
acuccaacuguggag

SEQ ID NO: 1625589 - RNA, 23 nt, Homo sapiens
acuccacccuccaccuuccauuu

SEQ ID NO: 1625590 - RNA, 21 nt, Homo sapiens
acuccaggaacaaaaagguaa

SEQ ID NO: 1625591 - RNA, 17 nt, Homo sapiens
acuccauuuaaaaaaca

SEQ ID NO: 1625592 - RNA, 18 nt, Homo sapiens
acucccaccacaggcaua

SEQ ID NO: 1625593 - RNA, 17 nt, Homo sapiens
acuccccagagcugugc

SEQ ID NO: 1625594 - RNA, 20 nt, Homo sapiens
acuccccagagcugugccag

SEQ ID NO: 1625595 - RNA, 16 nt, Homo sapiens
acucccuaggcccaag

SEQ ID NO: 1625596 - RNA, 16 nt, Homo sapiens
acucccuccaccagcc

SEQ ID NO: 1625597 - RNA, 23 nt, Homo sapiens
acucccuucucggggugggacag

SEQ ID NO: 1625598 - RNA, 19 nt, Homo sapiens
acuccuaaaccuuugcccc

SEQ ID NO: 1625599 - RNA, 18 nt, Homo sapiens
acuccuaaccucaaguga

SEQ ID NO: 1625600 - RNA, 13 nt, Homo sapiens
acuccuggacaac

SEQ ID NO: 1625601 - RNA, 11 nt, Homo sapiens
acuccuuccau

SEQ ID NO: 1625602 - RNA, 15 nt, Homo sapiens
acucugcacaugucu

SEQ ID NO: 1625603 - RNA, 20 nt, Homo sapiens
acucugcacaugucuuguac

SEQ ID NO: 1625604 - RNA, 15 nt, Homo sapiens
acucuguaucuccag

SEQ ID NO: 1625605 - RNA, 20 nt, Homo sapiens
acucuguaucuccagccacu

SEQ ID NO: 1625606 - RNA, 22 nt, Homo sapiens
acucuguauuacagcuuucaca

SEQ ID NO: 1625607 - RNA, 20 nt, Homo sapiens
acucuuagcuaaaucccucc

SEQ ID NO: 1625608 - RNA, 17 nt, Homo sapiens
acucuuccaccucccaa

SEQ ID NO: 1625609 - RNA, 18 nt, Homo sapiens
acucuuccaccucccaac

SEQ ID NO: 1625610 - RNA, 20 nt, Homo sapiens
acucuucuuacuggugcuau

SEQ ID NO: 1625611 - RNA, 21 nt, Homo sapiens
acucuugaaguacuuaacaua

SEQ ID NO: 1625612 - RNA, 12 nt, Homo sapiens
acucuugcaggg

SEQ ID NO: 1625613 - RNA, 23 nt, Homo sapiens
acucuuugguuuuaucauuccau

SEQ ID NO: 1625614 - RNA, 16 nt, Homo sapiens
acugaacagaaccaca

SEQ ID NO: 1625615 - RNA, 19 nt, Homo sapiens
acugaagcgaacaucuuca

SEQ ID NO: 1625616 - RNA, 14 nt, Homo sapiens
acugacaacauuau

SEQ ID NO: 1625617 - RNA, 22 nt, Homo sapiens
acugaccccaucaccuacucac

SEQ ID NO: 1625618 - RNA, 22 nt, Homo sapiens
acugaccuugaugagcugugca

SEQ ID NO: 1625619 - RNA, 16 nt, Homo sapiens
acugacuccucagucc

SEQ ID NO: 1625620 - RNA, 21 nt, Homo sapiens
acugacuggauucauucucau

SEQ ID NO: 1625621 - RNA, 14 nt, Homo sapiens
acugagcauuugca

SEQ ID NO: 1625622 - RNA, 16 nt, Homo sapiens
acugagcauuugcacc

SEQ ID NO: 1625623 - RNA, 16 nt, Homo sapiens
acugagcuauaacuua

SEQ ID NO: 1625624 - RNA, 20 nt, Homo sapiens
acugaugagucuugaucuag

SEQ ID NO: 1625625 - RNA, 14 nt, Homo sapiens
acugauuuaucuau

SEQ ID NO: 1625626 - RNA, 19 nt, Homo sapiens
acugcaaagcucggugcuc

SEQ ID NO: 1625627 - RNA, 20 nt, Homo sapiens
acugcaaagcucggugcucc

SEQ ID NO: 1625628 - RNA, 20 nt, Homo sapiens
acugcacucuagccugggug

SEQ ID NO: 1625629 - RNA, 21 nt, Homo sapiens
acugcacuuuccaaugccaca

SEQ ID NO: 1625630 - RNA, 22 nt, Homo sapiens
acugcacuuuccaaugccacag

SEQ ID NO: 1625631 - RNA, 21 nt, Homo sapiens
acugcagauggccuuguugcu

SEQ ID NO: 1625632 - RNA, 18 nt, Homo sapiens
acugcccuggccuuugca

SEQ ID NO: 1625633 - RNA, 21 nt, Homo sapiens
acuggcacagagguagucuca

SEQ ID NO: 1625634 - RNA, 18 nt, Homo sapiens
acuggccuauuuaucuga

SEQ ID NO: 1625635 - RNA, 23 nt, Homo sapiens
acuggccucccuuugugugcaua

SEQ ID NO: 1625636 - RNA, 20 nt, Homo sapiens
acugggccccacauggcuua

SEQ ID NO: 1625637 - RNA, 20 nt, Homo sapiens
acugggccuuagugggccag

SEQ ID NO: 1625638 - RNA, 15 nt, Homo sapiens
acuguacauuucaca

SEQ ID NO: 1625639 - RNA, 15 nt, Homo sapiens
acugucuagaacuua

SEQ ID NO: 1625640 - RNA, 14 nt, Homo sapiens
acugugacugauau

SEQ ID NO: 1625641 - RNA, 23 nt, Homo sapiens
acugugccuuguuucaacaguuu

SEQ ID NO: 1625642 - RNA, 22 nt, Homo sapiens
acuguggaggcuguaaauccag

SEQ ID NO: 1625643 - RNA, 21 nt, Homo sapiens
acugugucccucucucuggaa

SEQ ID NO: 1625644 - RNA, 15 nt, Homo sapiens
acuguuuuuaaucuc

SEQ ID NO: 1625645 - RNA, 19 nt, Homo sapiens
acuuaccgagucagacuuu

SEQ ID NO: 1625646 - RNA, 17 nt, Homo sapiens
acuuagauugugcuccu

SEQ ID NO: 1625647 - RNA, 13 nt, Homo sapiens
acuuauguggaac

SEQ ID NO: 1625648 - RNA, 13 nt, Homo sapiens
acuuauugccaaa

SEQ ID NO: 1625649 - RNA, 18 nt, Homo sapiens
gauuucugggcacuuuuu

SEQ ID NO: 1625650 - RNA, 19 nt, Homo sapiens
gauuuucaaaagcauuaau

SEQ ID NO: 1625651 - RNA, 14 nt, Homo sapiens
gauuuuccuuugua

SEQ ID NO: 1625652 - RNA, 18 nt, Homo sapiens
gauuuuuuccucugcauu

SEQ ID NO: 1625653 - RNA, 21 nt, Homo sapiens
gcaaaacagcccucagacugu

SEQ ID NO: 1625654 - RNA, 17 nt, Homo sapiens
gcaaaaucaacaugacu

SEQ ID NO: 1625655 - RNA, 16 nt, Homo sapiens
gcaaagccagugcugu

SEQ ID NO: 1625656 - RNA, 12 nt, Homo sapiens
gcaaagugcuuu

SEQ ID NO: 1625657 - RNA, 17 nt, Homo sapiens
gcaaaguguaugugacc

SEQ ID NO: 1625658 - RNA, 22 nt, Homo sapiens
gcaaauaaaauaaaugaaaucu

SEQ ID NO: 1625659 - RNA, 21 nt, Homo sapiens
gcaaauacaaucagcccagug

SEQ ID NO: 1625660 - RNA, 22 nt, Homo sapiens
gcaaauacaaucagcccagugc

SEQ ID NO: 1625661 - RNA, 15 nt, Homo sapiens
gcaaauccuauguga

SEQ ID NO: 1625662 - RNA, 20 nt, Homo sapiens
gcaaauuucuauaaauuuaa

SEQ ID NO: 1625663 - RNA, 18 nt, Homo sapiens
gcaacagauagauguugc

SEQ ID NO: 1625664 - RNA, 21 nt, Homo sapiens
gcaacuccuccauuuuccucc

SEQ ID NO: 1625665 - RNA, 16 nt, Homo sapiens
gcaagacauaaagccu

SEQ ID NO: 1625666 - RNA, 15 nt, Homo sapiens
gcaagcuuugcuccu

SEQ ID NO: 1625667 - RNA, 14 nt, Homo sapiens
gcaaggugugaugg

SEQ ID NO: 1625668 - RNA, 20 nt, Homo sapiens
gcaaguuagaacuagccaaa

SEQ ID NO: 1625669 - RNA, 12 nt, Homo sapiens
gcaaguuugcac

SEQ ID NO: 1625670 - RNA, 17 nt, Homo sapiens
gcaauaaauaccagaca

SEQ ID NO: 1625671 - RNA, 14 nt, Homo sapiens
gcaauaaauauuag

SEQ ID NO: 1625672 - RNA, 15 nt, Homo sapiens
gcaaucugacccuau

SEQ ID NO: 1625673 - RNA, 22 nt, Homo sapiens
gcaaugcaugauacuaucugug

SEQ ID NO: 1625674 - RNA, 21 nt, Homo sapiens
gcaaugucucuuugugcucua

SEQ ID NO: 1625675 - RNA, 18 nt, Homo sapiens
gcaauucuccugccuuag

SEQ ID NO: 1625676 - RNA, 22 nt, Homo sapiens
gcacaagggcacgugaagucau

SEQ ID NO: 1625677 - RNA, 19 nt, Homo sapiens
gcacacagcugagcacuua

SEQ ID NO: 1625678 - RNA, 16 nt, Homo sapiens
gcacaggagcuaccug

SEQ ID NO: 1625679 - RNA, 13 nt, Homo sapiens
gcacaggccaugg

SEQ ID NO: 1625680 - RNA, 14 nt, Homo sapiens
gcacagguauuuca

SEQ ID NO: 1625681 - RNA, 22 nt, Homo sapiens
gcacauauccaggcaccaggac

SEQ ID NO: 1625682 - RNA, 23 nt, Homo sapiens
gcacauauccaggcaccaggacu

SEQ ID NO: 1625683 - RNA, 20 nt, Homo sapiens
gcacaugucuuguacaugug

SEQ ID NO: 1625684 - RNA, 17 nt, Homo sapiens
gcacauuuggacauuuc

SEQ ID NO: 1625685 - RNA, 21 nt, Homo sapiens
gcacccggcucguguauuuau

SEQ ID NO: 1625686 - RNA, 13 nt, Homo sapiens
gcacccucccuag

SEQ ID NO: 1625687 - RNA, 16 nt, Homo sapiens
gcacccuggacaaaga

SEQ ID NO: 1625688 - RNA, 16 nt, Homo sapiens
gcaccguucugugcac

SEQ ID NO: 1625689 - RNA, 15 nt, Homo sapiens
gcaccuacaguguac

SEQ ID NO: 1625690 - RNA, 17 nt, Homo sapiens
gcaccuucacucuccag

SEQ ID NO: 1625691 - RNA, 14 nt, Homo sapiens
gcaccuugcuccca

SEQ ID NO: 1625692 - RNA, 22 nt, Homo sapiens
gcacugaaggcuuucagggccu

SEQ ID NO: 1625693 - RNA, 10 nt, Homo sapiens
gcacugaccg

SEQ ID NO: 1625694 - RNA, 16 nt, Homo sapiens
gcacuuauacccauga

SEQ ID NO: 1625695 - RNA, 21 nt, Homo sapiens
gcacuuuccaaugccacagac

SEQ ID NO: 1625696 - RNA, 23 nt, Homo sapiens
gcagaaacaaaaugacuguagaa

SEQ ID NO: 1625697 - RNA, 17 nt, Homo sapiens
gcagaaaggguuccaaa

SEQ ID NO: 1625698 - RNA, 19 nt, Homo sapiens
gcagaacauacuguucuca

SEQ ID NO: 1625699 - RNA, 12 nt, Homo sapiens
gcagaaccacaa

SEQ ID NO: 1625700 - RNA, 13 nt, Homo sapiens
gcagaacuugaag

SEQ ID NO: 1625701 - RNA, 15 nt, Homo sapiens
gcagaaugaagccau

SEQ ID NO: 1625702 - RNA, 21 nt, Homo sapiens
gcagacagcuccacccuggcc

SEQ ID NO: 1625703 - RNA, 14 nt, Homo sapiens
gcagaccaucgcac

SEQ ID NO: 1625704 - RNA, 15 nt, Homo sapiens
gcagaccucuggauu

SEQ ID NO: 1625705 - RNA, 22 nt, Homo sapiens
gcagagaccccggacccaggcc

SEQ ID NO: 1625706 - RNA, 15 nt, Homo sapiens
gcagcaaauuuucag

SEQ ID NO: 1625707 - RNA, 20 nt, Homo sapiens
gcagcaccguucugugcaca

SEQ ID NO: 1625708 - RNA, 21 nt, Homo sapiens
gcagccuaacacggugcucau

SEQ ID NO: 1625709 - RNA, 13 nt, Homo sapiens
gcagccucaaaac

SEQ ID NO: 1625710 - RNA, 17 nt, Homo sapiens
gcagcgccaggcugacc

SEQ ID NO: 1625711 - RNA, 20 nt, Homo sapiens
gcagcgcccuuccucuccac

SEQ ID NO: 1625712 - RNA, 20 nt, Homo sapiens
gcagcucauccaagcuugua

SEQ ID NO: 1625713 - RNA, 17 nt, Homo sapiens
gcagcuuaggauggcua

SEQ ID NO: 1625714 - RNA, 18 nt, Homo sapiens
gcaggaacuucuagcuca

SEQ ID NO: 1625715 - RNA, 15 nt, Homo sapiens
gcaggaguagcugag

SEQ ID NO: 1625716 - RNA, 18 nt, Homo sapiens
gcaggaguagcugagcuc

SEQ ID NO: 1625717 - RNA, 18 nt, Homo sapiens
gcagggaaggacaggacc

SEQ ID NO: 1625718 - RNA, 18 nt, Homo sapiens
gcagggacaauuugcugc

SEQ ID NO: 1625719 - RNA, 15 nt, Homo sapiens
gcagggucuuuucau

SEQ ID NO: 1625720 - RNA, 21 nt, Homo sapiens
gcagggugcaguaucaugccc

SEQ ID NO: 1625721 - RNA, 19 nt, Homo sapiens
gcaguaucaugcccugugc

SEQ ID NO: 1625722 - RNA, 15 nt, Homo sapiens
gcagucuaauuacau

SEQ ID NO: 1625723 - RNA, 12 nt, Homo sapiens
gcagugcccuuu

SEQ ID NO: 1625724 - RNA, 17 nt, Homo sapiens
gcaguggcgugaucucg

SEQ ID NO: 1625725 - RNA, 23 nt, Homo sapiens
gcaguucugaguguuuaauuuca

SEQ ID NO: 1625726 - RNA, 21 nt, Homo sapiens
gcaguuuugcuaucugggcug

SEQ ID NO: 1625727 - RNA, 20 nt, Homo sapiens
gcauaagagcuuaagaacca

SEQ ID NO: 1625728 - RNA, 19 nt, Homo sapiens
gcauagaguagguacucca

SEQ ID NO: 1625729 - RNA, 14 nt, Homo sapiens
gcauaucacagaga

SEQ ID NO: 1625730 - RNA, 20 nt, Homo sapiens
gcauccagcagcagcacuua

SEQ ID NO: 1625731 - RNA, 12 nt, Homo sapiens
gcauccugugaa

SEQ ID NO: 1625732 - RNA, 23 nt, Homo sapiens
gcauggggauugcagagugacca

SEQ ID NO: 1625733 - RNA, 20 nt, Homo sapiens
gcauguuggcccagaccuca

SEQ ID NO: 1625734 - RNA, 14 nt, Homo sapiens
gcauuccugaaggg

SEQ ID NO: 1625735 - RNA, 24 nt, Homo sapiens
gccaaaaacaaaaaauagcuuuca

SEQ ID NO: 1625736 - RNA, 23 nt, Homo sapiens
gccaaaccucuguucaguguaaa

SEQ ID NO: 1625737 - RNA, 18 nt, Homo sapiens
gccaagagugaagggaag

SEQ ID NO: 1625738 - RNA, 20 nt, Homo sapiens
gccaaggucaugccacugca

SEQ ID NO: 1625739 - RNA, 21 nt, Homo sapiens
gccaaggucaugccacugcac

SEQ ID NO: 1625740 - RNA, 22 nt, Homo sapiens
gagaggcccugggguucucccc

SEQ ID NO: 1625741 - RNA, 17 nt, Homo sapiens
gagagggugcuauccau

SEQ ID NO: 1625742 - RNA, 17 nt, Homo sapiens
gagaguaccuguguguu

SEQ ID NO: 1625743 - RNA, 16 nt, Homo sapiens
gagaguggaacagaag

SEQ ID NO: 1625744 - RNA, 19 nt, Homo sapiens
gagauagcauugugaacug

SEQ ID NO: 1625745 - RNA, 22 nt, Homo sapiens
gagaugacccaaucugccuuug

SEQ ID NO: 1625746 - RNA, 15 nt, Homo sapiens
gagaugcagcuggaa

SEQ ID NO: 1625747 - RNA, 19 nt, Homo sapiens
gagauggucacaugaccca

SEQ ID NO: 1625748 - RNA, 18 nt, Homo sapiens
gagcaaaaucaacaugac

SEQ ID NO: 1625749 - RNA, 18 nt, Homo sapiens
gagcaaguccucacucuu

SEQ ID NO: 1625750 - RNA, 15 nt, Homo sapiens
gagcaccuugcaguu

SEQ ID NO: 1625751 - RNA, 23 nt, Homo sapiens
gagcacugccaggagggacaaag

SEQ ID NO: 1625752 - RNA, 17 nt, Homo sapiens
gagcagaagaucaagga

SEQ ID NO: 1625753 - RNA, 13 nt, Homo sapiens
gagcaucaugccu

SEQ ID NO: 1625754 - RNA, 16 nt, Homo sapiens
gagccaggacccagga

SEQ ID NO: 1625755 - RNA, 17 nt, Homo sapiens
gagccuaggccaggugc

SEQ ID NO: 1625756 - RNA, 15 nt, Homo sapiens
gagccuggaagacac

SEQ ID NO: 1625757 - RNA, 19 nt, Homo sapiens
gagcucccgggcacaucca

SEQ ID NO: 1625758 - RNA, 14 nt, Homo sapiens
gagcugagcuggaa

SEQ ID NO: 1625759 - RNA, 13 nt, Homo sapiens
gagcuggaggcac

SEQ ID NO: 1625760 - RNA, 21 nt, Homo sapiens
gagcuguguccugcaguuccc

SEQ ID NO: 1625761 - RNA, 19 nt, Homo sapiens
gaggaggccguugauucac

SEQ ID NO: 1625762 - RNA, 15 nt, Homo sapiens
gaggcagacuccuga

SEQ ID NO: 1625763 - RNA, 16 nt, Homo sapiens
gaggccuuuuuugcca

SEQ ID NO: 1625764 - RNA, 17 nt, Homo sapiens
gaggccuuuuuugccag

SEQ ID NO: 1625765 - RNA, 21 nt, Homo sapiens
gaggcuccugaaugugacugg

SEQ ID NO: 1625766 - RNA, 17 nt, Homo sapiens
gagggacaggcacucca

SEQ ID NO: 1625767 - RNA, 22 nt, Homo sapiens
gagggagaagaaagaaacuuca

SEQ ID NO: 1625768 - RNA, 17 nt, Homo sapiens
gagggaggcucaggucc

SEQ ID NO: 1625769 - RNA, 16 nt, Homo sapiens
gagggauugcugugaa

SEQ ID NO: 1625770 - RNA, 23 nt, Homo sapiens
gagggcaagcccugcccacagaa

SEQ ID NO: 1625771 - RNA, 16 nt, Homo sapiens
gagggcagcagccagc

SEQ ID NO: 1625772 - RNA, 13 nt, Homo sapiens
gaggucaccagcu

SEQ ID NO: 1625773 - RNA, 17 nt, Homo sapiens
gaggucagcacacauua

SEQ ID NO: 1625774 - RNA, 16 nt, Homo sapiens
gagguccugagcacug

SEQ ID NO: 1625775 - RNA, 12 nt, Homo sapiens
gaggugcuccau

SEQ ID NO: 1625776 - RNA, 12 nt, Homo sapiens
gaguaagggaag

SEQ ID NO: 1625777 - RNA, 14 nt, Homo sapiens
gaguaauaagcaug

SEQ ID NO: 1625778 - RNA, 17 nt, Homo sapiens
gaguaaucuguguacaa

SEQ ID NO: 1625779 - RNA, 19 nt, Homo sapiens
gaguacucuugaacacaag

SEQ ID NO: 1625780 - RNA, 18 nt, Homo sapiens
gaguagagggcacugggu

SEQ ID NO: 1625781 - RNA, 16 nt, Homo sapiens
gaguauaaauuuacuu

SEQ ID NO: 1625782 - RNA, 21 nt, Homo sapiens
gagucauggcuaauuuaacac

SEQ ID NO: 1625783 - RNA, 19 nt, Homo sapiens
gagucucauuugggcuaga

SEQ ID NO: 1625784 - RNA, 23 nt, Homo sapiens
gagucugagaacccccagaccaa

SEQ ID NO: 1625785 - RNA, 19 nt, Homo sapiens
gagucugugcugguugcca

SEQ ID NO: 1625786 - RNA, 15 nt, Homo sapiens
gagugaccuccuucu

SEQ ID NO: 1625787 - RNA, 13 nt, Homo sapiens
gagugauucuguc

SEQ ID NO: 1625788 - RNA, 23 nt, Homo sapiens
gaguggcuucacuccugcuguaa

SEQ ID NO: 1625789 - RNA, 22 nt, Homo sapiens
gaguguguguuuguguguuuca

SEQ ID NO: 1625790 - RNA, 22 nt, Homo sapiens
gaguucuugugccauagucaca

SEQ ID NO: 1625791 - RNA, 13 nt, Homo sapiens
gauaaacaaacaa

SEQ ID NO: 1625792 - RNA, 14 nt, Homo sapiens
gauaaacaaacaag

SEQ ID NO: 1625793 - RNA, 15 nt, Homo sapiens
gauaaacaacauuga

SEQ ID NO: 1625794 - RNA, 19 nt, Homo sapiens
gauaaaccaaugucauaac

SEQ ID NO: 1625795 - RNA, 14 nt, Homo sapiens
gauaaaccaguuga

SEQ ID NO: 1625796 - RNA, 23 nt, Homo sapiens
gauaaacugauuuaucuauuuaa

SEQ ID NO: 1625797 - RNA, 21 nt, Homo sapiens
gauaaaugagugauucugucc

SEQ ID NO: 1625798 - RNA, 16 nt, Homo sapiens
gauaagagaauaccuu

SEQ ID NO: 1625799 - RNA, 14 nt, Homo sapiens
gauaauagcauuuu

SEQ ID NO: 1625800 - RNA, 11 nt, Homo sapiens
gauaaugccuu

SEQ ID NO: 1625801 - RNA, 16 nt, Homo sapiens
gauacuuuuacagguu

SEQ ID NO: 1625802 - RNA, 20 nt, Homo sapiens
gauagaagauuguuggugaa

SEQ ID NO: 1625803 - RNA, 13 nt, Homo sapiens
gauagauguuugg

SEQ ID NO: 1625804 - RNA, 20 nt, Homo sapiens
gauauauguguauacauaca

SEQ ID NO: 1625805 - RNA, 22 nt, Homo sapiens
gauaucauuuuaaaaacuuuau

SEQ ID NO: 1625806 - RNA, 16 nt, Homo sapiens
gauaugccacuaacuu

SEQ ID NO: 1625807 - RNA, 20 nt, Homo sapiens
gauaugccacuaacuucuaa

SEQ ID NO: 1625808 - RNA, 19 nt, Homo sapiens
gauauuuauuuuuugccau

SEQ ID NO: 1625809 - RNA, 23 nt, Homo sapiens
gaucaaauauauuucaagcuaua

SEQ ID NO: 1625810 - RNA, 17 nt, Homo sapiens
gaucaaauugugcagua

SEQ ID NO: 1625811 - RNA, 22 nt, Homo sapiens
gaucaaauugugcaguacuuug

SEQ ID NO: 1625812 - RNA, 17 nt, Homo sapiens
gaucagauugcauguga

SEQ ID NO: 1625813 - RNA, 19 nt, Homo sapiens
gaucagauugcaugugacu

SEQ ID NO: 1625814 - RNA, 17 nt, Homo sapiens
gaucaguguuacugccu

SEQ ID NO: 1625815 - RNA, 13 nt, Homo sapiens
gaucauugccauc

SEQ ID NO: 1625816 - RNA, 15 nt, Homo sapiens
gaucccuacugccaa

SEQ ID NO: 1625817 - RNA, 19 nt, Homo sapiens
gauccugccuugcugugaa

SEQ ID NO: 1625818 - RNA, 23 nt, Homo sapiens
gaucuccccucacacuuugccau

SEQ ID NO: 1625819 - RNA, 20 nt, Homo sapiens
gaucucgaacuccuaaccuc

SEQ ID NO: 1625820 - RNA, 14 nt, Homo sapiens
gaucugcugcugag

SEQ ID NO: 1625821 - RNA, 15 nt, Homo sapiens
gaucugcugcugaga

SEQ ID NO: 1625822 - RNA, 18 nt, Homo sapiens
gaugaggucaccagggga

SEQ ID NO: 1625823 - RNA, 18 nt, Homo sapiens
gaugcacucucagaccaa

SEQ ID NO: 1625824 - RNA, 16 nt, Homo sapiens
gaugccauaugccuug

SEQ ID NO: 1625825 - RNA, 14 nt, Homo sapiens
gaugccccagggau

SEQ ID NO: 1625826 - RNA, 19 nt, Homo sapiens
gaugccuguguacugccuu

SEQ ID NO: 1625827 - RNA, 14 nt, Homo sapiens
gauggccacuguga

SEQ ID NO: 1625828 - RNA, 18 nt, Homo sapiens
gaugggaggugugccaga

SEQ ID NO: 1625829 - RNA, 15 nt, Homo sapiens
gaugggaugcacucu

SEQ ID NO: 1625830 - RNA, 19 nt, Homo sapiens
gauguacaaaacaguuuga

SEQ ID NO: 1625831 - RNA, 13 nt, Homo sapiens
gauguaugaucuc

SEQ ID NO: 1625832 - RNA, 20 nt, Homo sapiens
gaugucaggauguugcucca

SEQ ID NO: 1625833 - RNA, 17 nt, Homo sapiens
gaugucaugucugcuug

SEQ ID NO: 1625834 - RNA, 17 nt, Homo sapiens
gaugucccugggccagg

SEQ ID NO: 1625835 - RNA, 15 nt, Homo sapiens
gaugugacauuccau

SEQ ID NO: 1625836 - RNA, 17 nt, Homo sapiens
gauguugguaucugcag

SEQ ID NO: 1625837 - RNA, 15 nt, Homo sapiens
gauguuuguuuucaa

SEQ ID NO: 1625838 - RNA, 18 nt, Homo sapiens
gauuacaggugugcacca

SEQ ID NO: 1625839 - RNA, 17 nt, Homo sapiens
cagcuuauaugugacac

SEQ ID NO: 1625840 - RNA, 16 nt, Homo sapiens
cagcuucaacuuuucu

SEQ ID NO: 1625841 - RNA, 19 nt, Homo sapiens
caggaaaauguauugauuc

SEQ ID NO: 1625842 - RNA, 17 nt, Homo sapiens
caggaacaaacagggcu

SEQ ID NO: 1625843 - RNA, 18 nt, Homo sapiens
caggaauccccaacaugc

SEQ ID NO: 1625844 - RNA, 19 nt, Homo sapiens
caggaauccccaacaugca

SEQ ID NO: 1625845 - RNA, 20 nt, Homo sapiens
caggacacaggccuguguag

SEQ ID NO: 1625846 - RNA, 14 nt, Homo sapiens
caggagaagaacaa

SEQ ID NO: 1625847 - RNA, 21 nt, Homo sapiens
caggaggugugauuccugaag

SEQ ID NO: 1625848 - RNA, 22 nt, Homo sapiens
caggaugcuggcugguggaaca

SEQ ID NO: 1625849 - RNA, 16 nt, Homo sapiens
caggauguugcuccau

SEQ ID NO: 1625850 - RNA, 20 nt, Homo sapiens
caggcaacgcacaaaacaga

SEQ ID NO: 1625851 - RNA, 19 nt, Homo sapiens
caggcacuccaaaccuguc

SEQ ID NO: 1625852 - RNA, 13 nt, Homo sapiens
caggccccaugac

SEQ ID NO: 1625853 - RNA, 15 nt, Homo sapiens
caggccuaaccugcu

SEQ ID NO: 1625854 - RNA, 20 nt, Homo sapiens
caggccuaucuggaagccac

SEQ ID NO: 1625855 - RNA, 22 nt, Homo sapiens
caggccuguguagcugugaccu

SEQ ID NO: 1625856 - RNA, 18 nt, Homo sapiens
caggccuucccaccagga

SEQ ID NO: 1625857 - RNA, 19 nt, Homo sapiens
caggccuucccaccaggaa

SEQ ID NO: 1625858 - RNA, 20 nt, Homo sapiens
caggcgugagccaccgcgcc

SEQ ID NO: 1625859 - RNA, 17 nt, Homo sapiens
caggcuggagugcaaug

SEQ ID NO: 1625860 - RNA, 13 nt, Homo sapiens
cagggaaaacugc

SEQ ID NO: 1625861 - RNA, 16 nt, Homo sapiens
cagggaaaacugcaaa

SEQ ID NO: 1625862 - RNA, 14 nt, Homo sapiens
cagggacacuccaa

SEQ ID NO: 1625863 - RNA, 19 nt, Homo sapiens
cagggagaggucaccagcu

SEQ ID NO: 1625864 - RNA, 14 nt, Homo sapiens
cagggaucuugcaa

SEQ ID NO: 1625865 - RNA, 24 nt, Homo sapiens
cagggauuccuucuaaguguacuu

SEQ ID NO: 1625866 - RNA, 16 nt, Homo sapiens
cagggccagagcagcu

SEQ ID NO: 1625867 - RNA, 16 nt, Homo sapiens
cagggcccccaucuca

SEQ ID NO: 1625868 - RNA, 18 nt, Homo sapiens
cagggccugcuauugcag

SEQ ID NO: 1625869 - RNA, 15 nt, Homo sapiens
cagggccuggcauag

SEQ ID NO: 1625870 - RNA, 18 nt, Homo sapiens
cagggcucauuuuugcac

SEQ ID NO: 1625871 - RNA, 20 nt, Homo sapiens
cagggcucuaaugugucucu

SEQ ID NO: 1625872 - RNA, 15 nt, Homo sapiens
caggggcaugacugu

SEQ ID NO: 1625873 - RNA, 14 nt, Homo sapiens
caggggccugcaga

SEQ ID NO: 1625874 - RNA, 23 nt, Homo sapiens
caggggggcugugccaaccuguu

SEQ ID NO: 1625875 - RNA, 11 nt, Homo sapiens
caggggugacg

SEQ ID NO: 1625876 - RNA, 17 nt, Homo sapiens
cagggucugugugaaug

SEQ ID NO: 1625877 - RNA, 15 nt, Homo sapiens
cagggugcaguauca

SEQ ID NO: 1625878 - RNA, 15 nt, Homo sapiens
cagguagaccugucu

SEQ ID NO: 1625879 - RNA, 20 nt, Homo sapiens
cagguauuacacaagccaaa

SEQ ID NO: 1625880 - RNA, 22 nt, Homo sapiens
caggucacuugaucaugcugca

SEQ ID NO: 1625881 - RNA, 14 nt, Homo sapiens
caggucccuccuca

SEQ ID NO: 1625882 - RNA, 22 nt, Homo sapiens
caggugaggguuacacugaaga

SEQ ID NO: 1625883 - RNA, 20 nt, Homo sapiens
cagguggcacuuccaccucc

SEQ ID NO: 1625884 - RNA, 20 nt, Homo sapiens
caggugugagccaccgcgcc

SEQ ID NO: 1625885 - RNA, 20 nt, Homo sapiens
caguacagcaugugccuuaa

SEQ ID NO: 1625886 - RNA, 19 nt, Homo sapiens
caguacuaaucaugugagg

SEQ ID NO: 1625887 - RNA, 18 nt, Homo sapiens
caguagaacugucuguga

SEQ ID NO: 1625888 - RNA, 23 nt, Homo sapiens
caguagagcaaaucuaugagauu

SEQ ID NO: 1625889 - RNA, 22 nt, Homo sapiens
caguauaagcaucugccaucug

SEQ ID NO: 1625890 - RNA, 17 nt, Homo sapiens
caguauuuucuccacuu

SEQ ID NO: 1625891 - RNA, 16 nt, Homo sapiens
cagucacugacaguua

SEQ ID NO: 1625892 - RNA, 22 nt, Homo sapiens
cagucaguuugcacaacaagau

SEQ ID NO: 1625893 - RNA, 17 nt, Homo sapiens
cagucggccccaucucu

SEQ ID NO: 1625894 - RNA, 18 nt, Homo sapiens
cagucuaauuacauuuca

SEQ ID NO: 1625895 - RNA, 16 nt, Homo sapiens
cagucucauugucacc

SEQ ID NO: 1625896 - RNA, 16 nt, Homo sapiens
cagugacaaggcccug

SEQ ID NO: 1625897 - RNA, 16 nt, Homo sapiens
cagugacgcugcugac

SEQ ID NO: 1625898 - RNA, 15 nt, Homo sapiens
cagugagccauguuc

SEQ ID NO: 1625899 - RNA, 13 nt, Homo sapiens
cagugcaguuucu

SEQ ID NO: 1625900 - RNA, 18 nt, Homo sapiens
cagugcaucacaucugca

SEQ ID NO: 1625901 - RNA, 20 nt, Homo sapiens
cagugcaucacaucugcaca

SEQ ID NO: 1625902 - RNA, 17 nt, Homo sapiens
cagugcaucauuacugu

SEQ ID NO: 1625903 - RNA, 16 nt, Homo sapiens
caguggacucuuccac

SEQ ID NO: 1625904 - RNA, 13 nt, Homo sapiens
caguggcgccauc

SEQ ID NO: 1625905 - RNA, 13 nt, Homo sapiens
caguguacagucu

SEQ ID NO: 1625906 - RNA, 14 nt, Homo sapiens
caguguacccuccu

SEQ ID NO: 1625907 - RNA, 16 nt, Homo sapiens
caguguuuccacacuu

SEQ ID NO: 1625908 - RNA, 13 nt, Homo sapiens
caguguuuggaca

SEQ ID NO: 1625909 - RNA, 13 nt, Homo sapiens
caguuaaggggag

SEQ ID NO: 1625910 - RNA, 22 nt, Homo sapiens
caguuaaggggagcaacagagg

SEQ ID NO: 1625911 - RNA, 20 nt, Homo sapiens
caguuauuugcacaaguuca

SEQ ID NO: 1625912 - RNA, 16 nt, Homo sapiens
caguucugcuugcucc

SEQ ID NO: 1625913 - RNA, 19 nt, Homo sapiens
caguucugcuugcucccaa

SEQ ID NO: 1625914 - RNA, 14 nt, Homo sapiens
caguugcauuuagc

SEQ ID NO: 1625915 - RNA, 19 nt, Homo sapiens
caguuguccuuaaauuugu

SEQ ID NO: 1625916 - RNA, 23 nt, Homo sapiens
caguuucuaucccuuaccugcuu

SEQ ID NO: 1625917 - RNA, 12 nt, Homo sapiens
caguuucugaca

SEQ ID NO: 1625918 - RNA, 15 nt, Homo sapiens
caguuugcaccuguc

SEQ ID NO: 1625919 - RNA, 20 nt, Homo sapiens
caguuuuccagaacacucuu

SEQ ID NO: 1625920 - RNA, 21 nt, Homo sapiens
cauaaagagguaaaaaacugu

SEQ ID NO: 1625921 - RNA, 11 nt, Homo sapiens
cauaaagccau

SEQ ID NO: 1625922 - RNA, 16 nt, Homo sapiens
cauaaauaaaggugua

SEQ ID NO: 1625923 - RNA, 16 nt, Homo sapiens
cauaagcccaguucau

SEQ ID NO: 1625924 - RNA, 18 nt, Homo sapiens
cauaaucaauauaaucug

SEQ ID NO: 1625925 - RNA, 19 nt, Homo sapiens
cauaauuccuacagcacua

SEQ ID NO: 1625926 - RNA, 13 nt, Homo sapiens
cauacacuugcau

SEQ ID NO: 1625927 - RNA, 13 nt, Homo sapiens
cauacuguucuca

SEQ ID NO: 1625928 - RNA, 21 nt, Homo sapiens
cauagcugugcuaugagguuu

SEQ ID NO: 1625929 - RNA, 14 nt, Homo sapiens
cauaggucuguaug

SEQ ID NO: 1625930 - RNA, 15 nt, Homo sapiens
cauaguguguguuua

SEQ ID NO: 1625931 - RNA, 19 nt, Homo sapiens
cauauaaaagcuaugguga

SEQ ID NO: 1625932 - RNA, 13 nt, Homo sapiens
cauauagacugua

SEQ ID NO: 1625933 - RNA, 15 nt, Homo sapiens
caccuugugucugua

SEQ ID NO: 1625934 - RNA, 13 nt, Homo sapiens
caccuuuuacucu

SEQ ID NO: 1625935 - RNA, 15 nt, Homo sapiens
cacgggucacuugaa

SEQ ID NO: 1625936 - RNA, 19 nt, Homo sapiens
cacgucaagcuuuggauaa

SEQ ID NO: 1625937 - RNA, 15 nt, Homo sapiens
cacgucuaacuggaa

SEQ ID NO: 1625938 - RNA, 13 nt, Homo sapiens
cacguguccugua

SEQ ID NO: 1625939 - RNA, 22 nt, Homo sapiens
cacguuugcaguugaugugucu

SEQ ID NO: 1625940 - RNA, 14 nt, Homo sapiens
cacuaccuaaguaa

SEQ ID NO: 1625941 - RNA, 21 nt, Homo sapiens
cacuacugggugucauuucau

SEQ ID NO: 1625942 - RNA, 17 nt, Homo sapiens
cacuagucucaccagcc

SEQ ID NO: 1625943 - RNA, 15 nt, Homo sapiens
cacuauaugaucagu

SEQ ID NO: 1625944 - RNA, 18 nt, Homo sapiens
cacuaucugggugcauga

SEQ ID NO: 1625945 - RNA, 12 nt, Homo sapiens
cacuaugccuga

SEQ ID NO: 1625946 - RNA, 16 nt, Homo sapiens
cacuauuuucaaagaa

SEQ ID NO: 1625947 - RNA, 22 nt, Homo sapiens
cacuccaacucuacacagcuca

SEQ ID NO: 1625948 - RNA, 23 nt, Homo sapiens
cacuccaguugcagaccaucgca

SEQ ID NO: 1625949 - RNA, 20 nt, Homo sapiens
cacucucagaccaagcagca

SEQ ID NO: 1625950 - RNA, 13 nt, Homo sapiens
cacucuguuccug

SEQ ID NO: 1625951 - RNA, 14 nt, Homo sapiens
cacucuuagcuaug

SEQ ID NO: 1625952 - RNA, 21 nt, Homo sapiens
cacugaaaaauauuccaagcu

SEQ ID NO: 1625953 - RNA, 22 nt, Homo sapiens
cacugauaaaaguuuugauauu

SEQ ID NO: 1625954 - RNA, 17 nt, Homo sapiens
cacuguggagaccacac

SEQ ID NO: 1625955 - RNA, 17 nt, Homo sapiens
cacuguucaauacugua

SEQ ID NO: 1625956 - RNA, 16 nt, Homo sapiens
cacuguucuguucuca

SEQ ID NO: 1625957 - RNA, 12 nt, Homo sapiens
cacuuacuauug

SEQ ID NO: 1625958 - RNA, 22 nt, Homo sapiens
cacuuagaccugccagccacug

SEQ ID NO: 1625959 - RNA, 21 nt, Homo sapiens
cacuucaaggcucaaugcuau

SEQ ID NO: 1625960 - RNA, 18 nt, Homo sapiens
cacuucauucacauucag

SEQ ID NO: 1625961 - RNA, 12 nt, Homo sapiens
cacuuccagugu

SEQ ID NO: 1625962 - RNA, 17 nt, Homo sapiens
cacuucgcacacaccca

SEQ ID NO: 1625963 - RNA, 18 nt, Homo sapiens
cacuucggcucucuggac

SEQ ID NO: 1625964 - RNA, 12 nt, Homo sapiens
cacuucucagga

SEQ ID NO: 1625965 - RNA, 16 nt, Homo sapiens
cacuuggaugcagggu

SEQ ID NO: 1625966 - RNA, 22 nt, Homo sapiens
cagaaaaaaauaaauguucuaa

SEQ ID NO: 1625967 - RNA, 15 nt, Homo sapiens
cagaaaaccuguuca

SEQ ID NO: 1625968 - RNA, 15 nt, Homo sapiens
cagaaaccaagagac

SEQ ID NO: 1625969 - RNA, 22 nt, Homo sapiens
cagaaaguccccccucgcccca

SEQ ID NO: 1625970 - RNA, 16 nt, Homo sapiens
cagaaauaguugucug

SEQ ID NO: 1625971 - RNA, 17 nt, Homo sapiens
cagaaauaguugucugu

SEQ ID NO: 1625972 - RNA, 20 nt, Homo sapiens
cagaacaagaccccgucuca

SEQ ID NO: 1625973 - RNA, 11 nt, Homo sapiens
cagaaccacaa

SEQ ID NO: 1625974 - RNA, 12 nt, Homo sapiens
cagaaccacaaa

SEQ ID NO: 1625975 - RNA, 19 nt, Homo sapiens
cagaaccuuguuauuucuc

SEQ ID NO: 1625976 - RNA, 15 nt, Homo sapiens
cagaagaugaacaga

SEQ ID NO: 1625977 - RNA, 12 nt, Homo sapiens
cagaaggggugg

SEQ ID NO: 1625978 - RNA, 17 nt, Homo sapiens
cagaauaaauaugcuca

SEQ ID NO: 1625979 - RNA, 12 nt, Homo sapiens
cagaauccagcu

SEQ ID NO: 1625980 - RNA, 23 nt, Homo sapiens
cagaauguggguauugaguguga

SEQ ID NO: 1625981 - RNA, 19 nt, Homo sapiens
cagacaaagcauaaucaau

SEQ ID NO: 1625982 - RNA, 19 nt, Homo sapiens
cagacaagaaugugcacuc

SEQ ID NO: 1625983 - RNA, 21 nt, Homo sapiens
cagacaagaaugugcacucuc

SEQ ID NO: 1625984 - RNA, 19 nt, Homo sapiens
cagacagaagucuccucaa

SEQ ID NO: 1625985 - RNA, 15 nt, Homo sapiens
cagacauaaagccau

SEQ ID NO: 1625986 - RNA, 17 nt, Homo sapiens
cagacauaaagccaugu

SEQ ID NO: 1625987 - RNA, 11 nt, Homo sapiens
cagacccagug

SEQ ID NO: 1625988 - RNA, 15 nt, Homo sapiens
cagacccaucucucc

SEQ ID NO: 1625989 - RNA, 16 nt, Homo sapiens
cagaccucaggugcua

SEQ ID NO: 1625990 - RNA, 14 nt, Homo sapiens
cagaccucuggauu

SEQ ID NO: 1625991 - RNA, 19 nt, Homo sapiens
cagacuaucguaaccuggu

SEQ ID NO: 1625992 - RNA, 18 nt, Homo sapiens
cagacuccugagugaggu

SEQ ID NO: 1625993 - RNA, 18 nt, Homo sapiens
cagacuuuggaaaaugca

SEQ ID NO: 1625994 - RNA, 23 nt, Homo sapiens
cagacuuuggaaaaugcauugua

SEQ ID NO: 1625995 - RNA, 14 nt, Homo sapiens
cagagacagcuuga

SEQ ID NO: 1625996 - RNA, 23 nt, Homo sapiens
cagagaccagcccaccccugugc

SEQ ID NO: 1625997 - RNA, 18 nt, Homo sapiens
cagagaucaggaucagcu

SEQ ID NO: 1625998 - RNA, 16 nt, Homo sapiens
cagagcaaguccucac

SEQ ID NO: 1625999 - RNA, 20 nt, Homo sapiens
cagaggaugcaacaaaugug

SEQ ID NO: 1626000 - RNA, 22 nt, Homo sapiens
cagaggcucagacucacuguua

SEQ ID NO: 1626001 - RNA, 18 nt, Homo sapiens
cagagggauugcugugaa

SEQ ID NO: 1626002 - RNA, 18 nt, Homo sapiens
cagaggggcagauggaaa

SEQ ID NO: 1626003 - RNA, 23 nt, Homo sapiens
cagagguuuuguuagguuacaga

SEQ ID NO: 1626004 - RNA, 16 nt, Homo sapiens
cagaucaagcugugag

SEQ ID NO: 1626005 - RNA, 17 nt, Homo sapiens
cagaucaagcugugaga

SEQ ID NO: 1626006 - RNA, 11 nt, Homo sapiens
cagauccugca

SEQ ID NO: 1626007 - RNA, 20 nt, Homo sapiens
cagaugauuuucuucuccau

SEQ ID NO: 1626008 - RNA, 20 nt, Homo sapiens
cagaugggcauaugugucag

SEQ ID NO: 1626009 - RNA, 23 nt, Homo sapiens
cagauguggaguauuagugacac

SEQ ID NO: 1626010 - RNA, 15 nt, Homo sapiens
cagcaauauuuugua

SEQ ID NO: 1626011 - RNA, 14 nt, Homo sapiens
cagcacacuggacu

SEQ ID NO: 1626012 - RNA, 12 nt, Homo sapiens
cagcacauauuu

SEQ ID NO: 1626013 - RNA, 18 nt, Homo sapiens
cagcacgaguggccaguu

SEQ ID NO: 1626014 - RNA, 21 nt, Homo sapiens
cagcacuccccagagcugugc

SEQ ID NO: 1626015 - RNA, 20 nt, Homo sapiens
cagcagagccuggaagacac

SEQ ID NO: 1626016 - RNA, 17 nt, Homo sapiens
cagcagcaaauuuucag

SEQ ID NO: 1626017 - RNA, 20 nt, Homo sapiens
cagcagggcuggucaccucc

SEQ ID NO: 1626018 - RNA, 11 nt, Homo sapiens
cagcauugcuu

SEQ ID NO: 1626019 - RNA, 14 nt, Homo sapiens
cagccacaacugca

SEQ ID NO: 1626020 - RNA, 15 nt, Homo sapiens
cagccacaggaccac

SEQ ID NO: 1626021 - RNA, 16 nt, Homo sapiens
cagccaccccugagau

SEQ ID NO: 1626022 - RNA, 15 nt, Homo sapiens
cagccagauggcccc

SEQ ID NO: 1626023 - RNA, 13 nt, Homo sapiens
cagccaggugcau

SEQ ID NO: 1626024 - RNA, 21 nt, Homo sapiens
cagccauaguguguguuuaga

SEQ ID NO: 1626025 - RNA, 13 nt, Homo sapiens
cagccaucaaggg

SEQ ID NO: 1626026 - RNA, 16 nt, Homo sapiens
caagcugaggugccca

SEQ ID NO: 1626027 - RNA, 11 nt, Homo sapiens
caagcuuucag

SEQ ID NO: 1626028 - RNA, 15 nt, Homo sapiens
caagcuuugcuccuu

SEQ ID NO: 1626029 - RNA, 23 nt, Homo sapiens
caaggaaauauauuuuaccauac

SEQ ID NO: 1626030 - RNA, 14 nt, Homo sapiens
caaggaacagaagu

SEQ ID NO: 1626031 - RNA, 19 nt, Homo sapiens
caaggacguggaugacccu

SEQ ID NO: 1626032 - RNA, 22 nt, Homo sapiens
caaggagggggccucauugugu

SEQ ID NO: 1626033 - RNA, 21 nt, Homo sapiens
caaggaugcugucaagcaccu

SEQ ID NO: 1626034 - RNA, 20 nt, Homo sapiens
caaggcagccugaacacuca

SEQ ID NO: 1626035 - RNA, 17 nt, Homo sapiens
caaggccagaugcacau

SEQ ID NO: 1626036 - RNA, 22 nt, Homo sapiens
caaggcugccagguguggaaca

SEQ ID NO: 1626037 - RNA, 13 nt, Homo sapiens
caagggagaguga

SEQ ID NO: 1626038 - RNA, 20 nt, Homo sapiens
caagggaggggugguauuaa

SEQ ID NO: 1626039 - RNA, 18 nt, Homo sapiens
caagggccaguugguguu

SEQ ID NO: 1626040 - RNA, 14 nt, Homo sapiens
caaggggacauucc

SEQ ID NO: 1626041 - RNA, 21 nt, Homo sapiens
caaggucaugccacugcacuc

SEQ ID NO: 1626042 - RNA, 14 nt, Homo sapiens
caaggugugauggu

SEQ ID NO: 1626043 - RNA, 16 nt, Homo sapiens
caaguauauaauuuac

SEQ ID NO: 1626044 - RNA, 17 nt, Homo sapiens
caaguauuacaaccaua

SEQ ID NO: 1626045 - RNA, 16 nt, Homo sapiens
caagucccuuugugac

SEQ ID NO: 1626046 - RNA, 17 nt, Homo sapiens
caagugcgugccgugug

SEQ ID NO: 1626047 - RNA, 15 nt, Homo sapiens
caagugucaccuccu

SEQ ID NO: 1626048 - RNA, 18 nt, Homo sapiens
caaguguuugugggacac

SEQ ID NO: 1626049 - RNA, 20 nt, Homo sapiens
caaguucuuaguugcuguau

SEQ ID NO: 1626050 - RNA, 11 nt, Homo sapiens
caaguuugcac

SEQ ID NO: 1626051 - RNA, 21 nt, Homo sapiens
caauaaaguuguugcauuccc

SEQ ID NO: 1626052 - RNA, 16 nt, Homo sapiens
caauaacacugucucc

SEQ ID NO: 1626053 - RNA, 15 nt, Homo sapiens
caauaauauauugua

SEQ ID NO: 1626054 - RNA, 12 nt, Homo sapiens
caauacagugaa

SEQ ID NO: 1626055 - RNA, 13 nt, Homo sapiens
caauacagugaag

SEQ ID NO: 1626056 - RNA, 15 nt, Homo sapiens
caauauuaccaucuu

SEQ ID NO: 1626057 - RNA, 14 nt, Homo sapiens
caaucagcccagug

SEQ ID NO: 1626058 - RNA, 16 nt, Homo sapiens
caaucagcccagugca

SEQ ID NO: 1626059 - RNA, 18 nt, Homo sapiens
caaucagcccagugcaaa

SEQ ID NO: 1626060 - RNA, 18 nt, Homo sapiens
caaucugcaguuuaacaa

SEQ ID NO: 1626061 - RNA, 20 nt, Homo sapiens
caaucuguccguucacaugu

SEQ ID NO: 1626062 - RNA, 17 nt, Homo sapiens
caaugaacccccaugau

SEQ ID NO: 1626063 - RNA, 13 nt, Homo sapiens
caaugaccaaaca

SEQ ID NO: 1626064 - RNA, 19 nt, Homo sapiens
caaugccacagacaacuca

SEQ ID NO: 1626065 - RNA, 21 nt, Homo sapiens
caaugcuucuaucaaauacua

SEQ ID NO: 1626066 - RNA, 21 nt, Homo sapiens
caaugggaagcagacaauaac

SEQ ID NO: 1626067 - RNA, 13 nt, Homo sapiens
caaugggagcuga

SEQ ID NO: 1626068 - RNA, 19 nt, Homo sapiens
caaugggagcugaggccac

SEQ ID NO: 1626069 - RNA, 15 nt, Homo sapiens
caauuaguggucaua

SEQ ID NO: 1626070 - RNA, 16 nt, Homo sapiens
caauucuccugccuua

SEQ ID NO: 1626071 - RNA, 19 nt, Homo sapiens
caauuuaacuagacacaga

SEQ ID NO: 1626072 - RNA, 13 nt, Homo sapiens
caauuugcugcca

SEQ ID NO: 1626073 - RNA, 21 nt, Homo sapiens
caauuuguagacucuugcucc

SEQ ID NO: 1626074 - RNA, 22 nt, Homo sapiens
caauuuuaccuaguuugcacua

SEQ ID NO: 1626075 - RNA, 12 nt, Homo sapiens
cacaaaacagaa

SEQ ID NO: 1626076 - RNA, 17 nt, Homo sapiens
cacaaacccccacucca

SEQ ID NO: 1626077 - RNA, 22 nt, Homo sapiens
cacaaaggaaguccaaccugag

SEQ ID NO: 1626078 - RNA, 17 nt, Homo sapiens
cacaaaggauacuuuua

SEQ ID NO: 1626079 - RNA, 14 nt, Homo sapiens
cacaaaguggcaua

SEQ ID NO: 1626080 - RNA, 21 nt, Homo sapiens
cacaaaucagaccuggcugcu

SEQ ID NO: 1626081 - RNA, 13 nt, Homo sapiens
cacaacacagaua

SEQ ID NO: 1626082 - RNA, 14 nt, Homo sapiens
cacaacagugaaaa

SEQ ID NO: 1626083 - RNA, 14 nt, Homo sapiens
cacaacuccuucca

SEQ ID NO: 1626084 - RNA, 13 nt, Homo sapiens
cacaacugcaguc

SEQ ID NO: 1626085 - RNA, 20 nt, Homo sapiens
cacaacugucuuagacugcu

SEQ ID NO: 1626086 - RNA, 14 nt, Homo sapiens
cacaagguuuuaua

SEQ ID NO: 1626087 - RNA, 17 nt, Homo sapiens
cacaauauuccuaugcu

SEQ ID NO: 1626088 - RNA, 15 nt, Homo sapiens
cacaaugaugaugau

SEQ ID NO: 1626089 - RNA, 22 nt, Homo sapiens
cacacacagacuguugucccug

SEQ ID NO: 1626090 - RNA, 16 nt, Homo sapiens
cacacagaggggaguc

SEQ ID NO: 1626091 - RNA, 19 nt, Homo sapiens
cacacaggagaagcucgga

SEQ ID NO: 1626092 - RNA, 11 nt, Homo sapiens
cacacagugaa

SEQ ID NO: 1626093 - RNA, 14 nt, Homo sapiens
cacacauugcagcu

SEQ ID NO: 1626094 - RNA, 17 nt, Homo sapiens
cacaccuccugccuuua

SEQ ID NO: 1626095 - RNA, 17 nt, Homo sapiens
cacacuaagagggcaga

SEQ ID NO: 1626096 - RNA, 22 nt, Homo sapiens
cacacucuucucuugagcaguu

SEQ ID NO: 1626097 - RNA, 14 nt, Homo sapiens
cacacuucucagga

SEQ ID NO: 1626098 - RNA, 15 nt, Homo sapiens
cacagaaacuauaug

SEQ ID NO: 1626099 - RNA, 22 nt, Homo sapiens
cacagaauuguuccaguacuau

SEQ ID NO: 1626100 - RNA, 15 nt, Homo sapiens
cacagacaacucaca

SEQ ID NO: 1626101 - RNA, 18 nt, Homo sapiens
cacagagaaggcuaugua

SEQ ID NO: 1626102 - RNA, 13 nt, Homo sapiens
cacagcacagcca

SEQ ID NO: 1626103 - RNA, 15 nt, Homo sapiens
cacagccaucaaggg

SEQ ID NO: 1626104 - RNA, 18 nt, Homo sapiens
cacagccuucccucugca

SEQ ID NO: 1626105 - RNA, 21 nt, Homo sapiens
cacagcucagcagacauccac

SEQ ID NO: 1626106 - RNA, 20 nt, Homo sapiens
cacagcuccugccaggguga

SEQ ID NO: 1626107 - RNA, 12 nt, Homo sapiens
cacagcuuuaug

SEQ ID NO: 1626108 - RNA, 18 nt, Homo sapiens
cacagcuuuaugauauca

SEQ ID NO: 1626109 - RNA, 23 nt, Homo sapiens
cacaggaccaccuccucugccag

SEQ ID NO: 1626110 - RNA, 23 nt, Homo sapiens
cacaggccuguguagcugugacc

SEQ ID NO: 1626111 - RNA, 23 nt, Homo sapiens
cacaguaauggggugagcucaca

SEQ ID NO: 1626112 - RNA, 11 nt, Homo sapiens
cacagucucau

SEQ ID NO: 1626113 - RNA, 16 nt, Homo sapiens
cacaguuaucaaaaag

SEQ ID NO: 1626114 - RNA, 22 nt, Homo sapiens
cacauacgggcuuuaauaguca

SEQ ID NO: 1626115 - RNA, 13 nt, Homo sapiens
cacauaugcaccu

SEQ ID NO: 1626116 - RNA, 22 nt, Homo sapiens
cacauauggacucugcacauga

SEQ ID NO: 1626117 - RNA, 23 nt, Homo sapiens
cacaucccuggaaggacauccau

SEQ ID NO: 1626118 - RNA, 22 nt, Homo sapiens
cacaucuccuguggucucugac

SEQ ID NO: 1626119 - RNA, 21 nt, Homo sapiens
cacaucuuuuuccaagcagug

SEQ ID NO: 1626120 - RNA, 17 nt, Homo sapiens
cacaugaggccaucuca

SEQ ID NO: 1626121 - RNA, 17 nt, Homo sapiens
cacaugcccuaaugucu

SEQ ID NO: 1626122 - RNA, 13 nt, Homo sapiens
cacaugcuauguu

SEQ ID NO: 1626123 - RNA, 19 nt, Homo sapiens
cacauggccuaugcacaua

SEQ ID NO: 1626124 - RNA, 21 nt, Homo sapiens
cacauggccuaugcacauaug

SEQ ID NO: 1626125 - RNA, 12 nt, Homo sapiens
cacauggcuuag

SEQ ID NO: 1626126 - RNA, 19 nt, Homo sapiens
cacauucaauagcauauca

SEQ ID NO: 1626127 - RNA, 23 nt, Homo sapiens
cacauugacuccuuuccaauaga

SEQ ID NO: 1626128 - RNA, 20 nt, Homo sapiens
cacauuuauuuuuauaucua

SEQ ID NO: 1626129 - RNA, 17 nt, Homo sapiens
cacauuuuucagauaua

SEQ ID NO: 1626130 - RNA, 22 nt, Homo sapiens
cacauuuuuuuaugcucuugaa

SEQ ID NO: 1626131 - RNA, 18 nt, Homo sapiens
caccaagccaauaccagc

SEQ ID NO: 1626132 - RNA, 18 nt, Homo sapiens
caccaagggcgcaagagu

SEQ ID NO: 1626133 - RNA, 21 nt, Homo sapiens
caccaauguacccaccgggcc

SEQ ID NO: 1626134 - RNA, 15 nt, Homo sapiens
caccacacccggcua

SEQ ID NO: 1626135 - RNA, 23 nt, Homo sapiens
caccacuaacaugcccuguucag

SEQ ID NO: 1626136 - RNA, 15 nt, Homo sapiens
aauuuggcuaauaac

SEQ ID NO: 1626137 - RNA, 15 nt, Homo sapiens
aauuuguaaugauuu

SEQ ID NO: 1626138 - RNA, 22 nt, Homo sapiens
aauuuuaaugauaaaauagcca

SEQ ID NO: 1626139 - RNA, 15 nt, Homo sapiens
aauuuucagcauuaa

SEQ ID NO: 1626140 - RNA, 15 nt, Homo sapiens
aauuuuugucucaga

SEQ ID NO: 1626141 - RNA, 21 nt, Homo sapiens
aauuuuuucccagacuacuau

SEQ ID NO: 1626142 - RNA, 13 nt, Homo sapiens
acaaaaaccaaac

SEQ ID NO: 1626143 - RNA, 16 nt, Homo sapiens
acaaaacuucuuguca

SEQ ID NO: 1626144 - RNA, 17 nt, Homo sapiens
acaaaacuucuugucag

SEQ ID NO: 1626145 - RNA, 11 nt, Homo sapiens
acaaaagcuau

SEQ ID NO: 1626146 - RNA, 14 nt, Homo sapiens
acaaacauuaguau

SEQ ID NO: 1626147 - RNA, 20 nt, Homo sapiens
acaaacucucaccaugaugu

SEQ ID NO: 1626148 - RNA, 22 nt, Homo sapiens
acaaauaaauaagaucagacuc

SEQ ID NO: 1626149 - RNA, 18 nt, Homo sapiens
acaaaugggaaaaccaga

SEQ ID NO: 1626150 - RNA, 21 nt, Homo sapiens
acaaauucggauguaugaucu

SEQ ID NO: 1626151 - RNA, 15 nt, Homo sapiens
acaaauuucacuuau

SEQ ID NO: 1626152 - RNA, 19 nt, Homo sapiens
acaaauuucauugcacuuu

SEQ ID NO: 1626153 - RNA, 21 nt, Homo sapiens
acaaauuucauugcacuuucc

SEQ ID NO: 1626154 - RNA, 17 nt, Homo sapiens
acaaauuuuaacuucuu

SEQ ID NO: 1626155 - RNA, 12 nt, Homo sapiens
acaacaacaaaa

SEQ ID NO: 1626156 - RNA, 13 nt, Homo sapiens
acaacagugaaaa

SEQ ID NO: 1626157 - RNA, 12 nt, Homo sapiens
acaacuaccuga

SEQ ID NO: 1626158 - RNA, 14 nt, Homo sapiens
acaacuccuuccau

SEQ ID NO: 1626159 - RNA, 21 nt, Homo sapiens
acaacuccuuccauccuugac

SEQ ID NO: 1626160 - RNA, 21 nt, Homo sapiens
acaagaaaauguauccaagga

SEQ ID NO: 1626161 - RNA, 16 nt, Homo sapiens
acaagaacaaagccac

SEQ ID NO: 1626162 - RNA, 16 nt, Homo sapiens
acaagaaugugcacuc

SEQ ID NO: 1626163 - RNA, 19 nt, Homo sapiens
acaagaaugugcacucucu

SEQ ID NO: 1626164 - RNA, 16 nt, Homo sapiens
acaagcugcacuguga

SEQ ID NO: 1626165 - RNA, 18 nt, Homo sapiens
acaagucauuccaugaag

SEQ ID NO: 1626166 - RNA, 12 nt, Homo sapiens
acaagugucagg

SEQ ID NO: 1626167 - RNA, 12 nt, Homo sapiens
acaagugucuaa

SEQ ID NO: 1626168 - RNA, 21 nt, Homo sapiens
uacucugugccagagccuggg

SEQ ID NO: 1626169 - RNA, 19 nt, Homo sapiens
uacugcacacugcacauuu

SEQ ID NO: 1626170 - RNA, 17 nt, Homo sapiens
uacugggugucauuuca

SEQ ID NO: 1626171 - RNA, 15 nt, Homo sapiens
uacuuaacauuucau

SEQ ID NO: 1626172 - RNA, 14 nt, Homo sapiens
uacuuaaugcauau

SEQ ID NO: 1626173 - RNA, 13 nt, Homo sapiens
uacuuaugcaaga

SEQ ID NO: 1626174 - RNA, 16 nt, Homo sapiens
uacuucaaacugagau

SEQ ID NO: 1626175 - RNA, 20 nt, Homo sapiens
uacuuccucugugaacugug

SEQ ID NO: 1626176 - RNA, 22 nt, Homo sapiens
uacuucuguggaaguagcuuug

SEQ ID NO: 1626177 - RNA, 13 nt, Homo sapiens
uacuugaauguag

SEQ ID NO: 1626178 - RNA, 22 nt, Homo sapiens
uacuuggcugcuuccugugaca

SEQ ID NO: 1626179 - RNA, 18 nt, Homo sapiens
uacuuuguaaauaggauu

SEQ ID NO: 1626180 - RNA, 21 nt, Homo sapiens
uacuuuuaguagagacagugu

SEQ ID NO: 1626181 - RNA, 17 nt, Homo sapiens
uacuuuucuuuccucag

SEQ ID NO: 1626182 - RNA, 20 nt, Homo sapiens
uacuuuuuuuuaguucaaua

SEQ ID NO: 1626183 - RNA, 21 nt, Homo sapiens
uagaaaacuugacauguagcu

SEQ ID NO: 1626184 - RNA, 15 nt, Homo sapiens
uagaaacauuguaaa

SEQ ID NO: 1626185 - RNA, 22 nt, Homo sapiens
uagaaaguauguuuguguuggu

SEQ ID NO: 1626186 - RNA, 12 nt, Homo sapiens
uagaaauggauu

SEQ ID NO: 1626187 - RNA, 13 nt, Homo sapiens
uagaaauggauuu

SEQ ID NO: 1626188 - RNA, 19 nt, Homo sapiens
uagaaccuuaaagaaccau

SEQ ID NO: 1626189 - RNA, 16 nt, Homo sapiens
uagaacugucugugaa

SEQ ID NO: 1626190 - RNA, 18 nt, Homo sapiens
uagaagaaaugcuaucag

SEQ ID NO: 1626191 - RNA, 20 nt, Homo sapiens
uagaagcagagggacaacca

SEQ ID NO: 1626192 - RNA, 17 nt, Homo sapiens
uagaaucugaguauaaa

SEQ ID NO: 1626193 - RNA, 20 nt, Homo sapiens
uagaauuugagcaucaguga

SEQ ID NO: 1626194 - RNA, 17 nt, Homo sapiens
uagacaaaccaucuccu

SEQ ID NO: 1626195 - RNA, 20 nt, Homo sapiens
uagacaaaccaucuccuccu

SEQ ID NO: 1626196 - RNA, 13 nt, Homo sapiens
uagacacagguca

SEQ ID NO: 1626197 - RNA, 17 nt, Homo sapiens
uagacaggaaagccagg

SEQ ID NO: 1626198 - RNA, 18 nt, Homo sapiens
uagaccugccagccacug

SEQ ID NO: 1626199 - RNA, 16 nt, Homo sapiens
uagagacaguguuucg

SEQ ID NO: 1626200 - RNA, 21 nt, Homo sapiens
uagagauguacugaguuugau

SEQ ID NO: 1626201 - RNA, 18 nt, Homo sapiens
uagaggauagggagaaua

SEQ ID NO: 1626202 - RNA, 20 nt, Homo sapiens
uagaggugcucauucauuua

SEQ ID NO: 1626203 - RNA, 20 nt, Homo sapiens
uagaguagguacuccauaaa

SEQ ID NO: 1626204 - RNA, 20 nt, Homo sapiens
uagauccugguuaccacucu

SEQ ID NO: 1626205 - RNA, 21 nt, Homo sapiens
uagauuauuccaagccuuauu

SEQ ID NO: 1626206 - RNA, 21 nt, Homo sapiens
uagauucagcucccacacaca

SEQ ID NO: 1626207 - RNA, 15 nt, Homo sapiens
uagauuuaagugaau

SEQ ID NO: 1626208 - RNA, 20 nt, Homo sapiens
uagcaagauauugaucaaau

SEQ ID NO: 1626209 - RNA, 22 nt, Homo sapiens
uagcagauacagggaugaggca

SEQ ID NO: 1626210 - RNA, 20 nt, Homo sapiens
uagcaggaacuucuagcuca

SEQ ID NO: 1626211 - RNA, 13 nt, Homo sapiens
uagcagucacuga

SEQ ID NO: 1626212 - RNA, 20 nt, Homo sapiens
uagccaaaccaggacccugu

SEQ ID NO: 1626213 - RNA, 21 nt, Homo sapiens
uagccaacugcuaaugcaaau

SEQ ID NO: 1626214 - RNA, 18 nt, Homo sapiens
uagccagcacacagggca

SEQ ID NO: 1626215 - RNA, 23 nt, Homo sapiens
uagccaggguggucuugaucucc

SEQ ID NO: 1626216 - RNA, 15 nt, Homo sapiens
uagccauugaucaua

SEQ ID NO: 1626217 - RNA, 16 nt, Homo sapiens
uagccccucacuucca

SEQ ID NO: 1626218 - RNA, 17 nt, Homo sapiens
uagcuccaaaccuucac

SEQ ID NO: 1626219 - RNA, 15 nt, Homo sapiens
uagcuccacuggaga

SEQ ID NO: 1626220 - RNA, 19 nt, Homo sapiens
uagcuccauaaaguacaaa

SEQ ID NO: 1626221 - RNA, 23 nt, Homo sapiens
uagcugagaagcaaugggucacu

SEQ ID NO: 1626222 - RNA, 14 nt, Homo sapiens
uagcugagcucaca

SEQ ID NO: 1626223 - RNA, 16 nt, Homo sapiens
uagcugugaccugcug

SEQ ID NO: 1626224 - RNA, 22 nt, Homo sapiens
uagcuguuucaaaugugcauuu

SEQ ID NO: 1626225 - RNA, 13 nt, Homo sapiens
uaggaagcacuga

SEQ ID NO: 1626226 - RNA, 13 nt, Homo sapiens
uaggaccaggcca

SEQ ID NO: 1626227 - RNA, 15 nt, Homo sapiens
uaggagcaaagccug

SEQ ID NO: 1626228 - RNA, 16 nt, Homo sapiens
uaggauacugcugcgu

SEQ ID NO: 1626229 - RNA, 16 nt, Homo sapiens
uaggauggcuauguga

SEQ ID NO: 1626230 - RNA, 13 nt, Homo sapiens
uaggccaggugca

SEQ ID NO: 1626231 - RNA, 10 nt, Homo sapiens
uaggcccaag

SEQ ID NO: 1626232 - RNA, 14 nt, Homo sapiens
uaggccccacaagg

SEQ ID NO: 1626233 - RNA, 16 nt, Homo sapiens
uaggcuuucauguugc

SEQ ID NO: 1626234 - RNA, 23 nt, Homo sapiens
uagggggagccccuucugcucag

SEQ ID NO: 1626235 - RNA, 21 nt, Homo sapiens
uagguauuucuaacgccagca

SEQ ID NO: 1626236 - RNA, 22 nt, Homo sapiens
uagguguaagagaaauggaaau

SEQ ID NO: 1626237 - RNA, 22 nt, Homo sapiens
uagguuacagauuaucacauua

SEQ ID NO: 1626238 - RNA, 18 nt, Homo sapiens
uaguaaauccaugguguu

SEQ ID NO: 1626239 - RNA, 17 nt, Homo sapiens
uaguaguuacugucagc

SEQ ID NO: 1626240 - RNA, 12 nt, Homo sapiens
uaguaucuguau

SEQ ID NO: 1626241 - RNA, 19 nt, Homo sapiens
uagucacauggccuaugca

SEQ ID NO: 1626242 - RNA, 20 nt, Homo sapiens
uagucacauggccuaugcac

SEQ ID NO: 1626243 - RNA, 20 nt, Homo sapiens
uagucauugucauaaguaaa

SEQ ID NO: 1626244 - RNA, 13 nt, Homo sapiens
uagucuuugccag

SEQ ID NO: 1626245 - RNA, 22 nt, Homo sapiens
uagugcuuguggagaucacagc

SEQ ID NO: 1626246 - RNA, 21 nt, Homo sapiens
uaguggcuuccccucugucaa

SEQ ID NO: 1626247 - RNA, 23 nt, Homo sapiens
uagugggccagggcugcccugag

SEQ ID NO: 1626248 - RNA, 13 nt, Homo sapiens
uaguuacugucag

SEQ ID NO: 1626249 - RNA, 13 nt, Homo sapiens
uaguuaugugauu

SEQ ID NO: 1626250 - RNA, 19 nt, Homo sapiens
uaguugcguggacucugca

SEQ ID NO: 1626251 - RNA, 18 nt, Homo sapiens
uauaaauacguauuacaa

SEQ ID NO: 1626252 - RNA, 15 nt, Homo sapiens
uauacaccauauacu

SEQ ID NO: 1626253 - RNA, 12 nt, Homo sapiens
uauacauuguga

SEQ ID NO: 1626254 - RNA, 13 nt, Homo sapiens
uauaccaaaaggg

SEQ ID NO: 1626255 - RNA, 22 nt, Homo sapiens
uauagaaaaggaacaguugcau

SEQ ID NO: 1626256 - RNA, 17 nt, Homo sapiens
uauagagccuaccugua

SEQ ID NO: 1626257 - RNA, 19 nt, Homo sapiens
uauaguaacacacuuccag

SEQ ID NO: 1626258 - RNA, 20 nt, Homo sapiens
uauaguugucaguauuauuc

SEQ ID NO: 1626259 - RNA, 13 nt, Homo sapiens
uauauaaguugcu

SEQ ID NO: 1626260 - RNA, 15 nt, Homo sapiens
uauaucacucuagaa

SEQ ID NO: 1626261 - RNA, 19 nt, Homo sapiens
uauaucuuagguaagacau

SEQ ID NO: 1626262 - RNA, 14 nt, Homo sapiens
uauaugcaaagaaa

SEQ ID NO: 1626263 - RNA, 15 nt, Homo sapiens
uauaugcagaauuac

SEQ ID NO: 1626264 - RNA, 12 nt, Homo sapiens
uauaugucuugc

SEQ ID NO: 1626265 - RNA, 21 nt, Homo sapiens
uauauuagggacacuuucaca

SEQ ID NO: 1626266 - RNA, 15 nt, Homo sapiens
uauauucaacucaua

SEQ ID NO: 1626267 - RNA, 16 nt, Homo sapiens
uaucaaaaaguauuau

SEQ ID NO: 1626268 - RNA, 20 nt, Homo sapiens
uaucacuucauucacauuca

SEQ ID NO: 1626269 - RNA, 17 nt, Homo sapiens
uaucaugcccugugcaa

SEQ ID NO: 1626270 - RNA, 19 nt, Homo sapiens
uaucaugcccugugcaacc

SEQ ID NO: 1626271 - RNA, 17 nt, Homo sapiens
uauccauccucugagau

SEQ ID NO: 1626272 - RNA, 13 nt, Homo sapiens
uauccaugcaccu

SEQ ID NO: 1626273 - RNA, 13 nt, Homo sapiens
uaucccuuaccug

SEQ ID NO: 1626274 - RNA, 23 nt, Homo sapiens
uauccuaaauaaaaaaagacaaa

SEQ ID NO: 1626275 - RNA, 18 nt, Homo sapiens
uauccuacugagcauuug

SEQ ID NO: 1626276 - RNA, 17 nt, Homo sapiens
acaauaauucauauucu

SEQ ID NO: 1626277 - RNA, 23 nt, Homo sapiens
acaauccuucuauucuagccugc

SEQ ID NO: 1626278 - RNA, 21 nt, Homo sapiens
acaaucuguuuuggcuuuaug

SEQ ID NO: 1626279 - RNA, 15 nt, Homo sapiens
acacacaaagcacau

SEQ ID NO: 1626280 - RNA, 20 nt, Homo sapiens
acacacgcacacaaaccaca

SEQ ID NO: 1626281 - RNA, 21 nt, Homo sapiens
acacacuaacaaaagcaugaa

SEQ ID NO: 1626282 - RNA, 22 nt, Homo sapiens
acacacuaacaaaagcaugaaa

SEQ ID NO: 1626283 - RNA, 16 nt, Homo sapiens
acacagacaaagugcu

SEQ ID NO: 1626284 - RNA, 15 nt, Homo sapiens
acacagacaguuucu

SEQ ID NO: 1626285 - RNA, 19 nt, Homo sapiens
acacagacaguuucugaca

SEQ ID NO: 1626286 - RNA, 16 nt, Homo sapiens
acacagcuuuaugaua

SEQ ID NO: 1626287 - RNA, 13 nt, Homo sapiens
acacaggcuucau

SEQ ID NO: 1626288 - RNA, 13 nt, Homo sapiens
acacauaugcacc

SEQ ID NO: 1626289 - RNA, 19 nt, Homo sapiens
acaccaaguaccaguauaa

SEQ ID NO: 1626290 - RNA, 13 nt, Homo sapiens
acaccacaaaaac

SEQ ID NO: 1626291 - RNA, 19 nt, Homo sapiens
acaccacuuucugcuuucc

SEQ ID NO: 1626292 - RNA, 19 nt, Homo sapiens
acaccauucuccugccuca

SEQ ID NO: 1626293 - RNA, 22 nt, Homo sapiens
acacccccaugacauugcauuu

SEQ ID NO: 1626294 - RNA, 22 nt, Homo sapiens
acacccuggccugaacugagga

SEQ ID NO: 1626295 - RNA, 21 nt, Homo sapiens
acacccuuugggaaagcucuu

SEQ ID NO: 1626296 - RNA, 16 nt, Homo sapiens
acaccgcugcacucaa

SEQ ID NO: 1626297 - RNA, 16 nt, Homo sapiens
acaccucccugugaag

SEQ ID NO: 1626298 - RNA, 16 nt, Homo sapiens
acaccuuggacuguua

SEQ ID NO: 1626299 - RNA, 20 nt, Homo sapiens
acacucccccagccccagag

SEQ ID NO: 1626300 - RNA, 14 nt, Homo sapiens
acacucuuagcuau

SEQ ID NO: 1626301 - RNA, 19 nt, Homo sapiens
acacugaaaaauauuccaa

SEQ ID NO: 1626302 - RNA, 14 nt, Homo sapiens
acacugaucuggcu

SEQ ID NO: 1626303 - RNA, 23 nt, Homo sapiens
acacugcagcagaaaggcucuga

SEQ ID NO: 1626304 - RNA, 22 nt, Homo sapiens
acacugggcugcagagacugga

SEQ ID NO: 1626305 - RNA, 14 nt, Homo sapiens
acacuuaacagaug

SEQ ID NO: 1626306 - RNA, 15 nt, Homo sapiens
acacuugaaccuaau

SEQ ID NO: 1626307 - RNA, 18 nt, Homo sapiens
acacuuuuaugagcuucc

SEQ ID NO: 1626308 - RNA, 15 nt, Homo sapiens
acacuuuugcuugaa

SEQ ID NO: 1626309 - RNA, 15 nt, Homo sapiens
acagaaaacucccaa

SEQ ID NO: 1626310 - RNA, 13 nt, Homo sapiens
acagaaaccaaga

SEQ ID NO: 1626311 - RNA, 21 nt, Homo sapiens
acagaaccuuguuauuucuca

SEQ ID NO: 1626312 - RNA, 21 nt, Homo sapiens
acagaacuggaggcaguccau

SEQ ID NO: 1626313 - RNA, 17 nt, Homo sapiens
acagaagaggagucaag

SEQ ID NO: 1626314 - RNA, 21 nt, Homo sapiens
acagaagccugaugcugacau

SEQ ID NO: 1626315 - RNA, 13 nt, Homo sapiens
acagaaggggugg

SEQ ID NO: 1626316 - RNA, 14 nt, Homo sapiens
acagacaguuucug

SEQ ID NO: 1626317 - RNA, 12 nt, Homo sapiens
acagaccuaaua

SEQ ID NO: 1626318 - RNA, 12 nt, Homo sapiens
acagacgugugc

SEQ ID NO: 1626319 - RNA, 17 nt, Homo sapiens
acagacuccacccuccu

SEQ ID NO: 1626320 - RNA, 14 nt, Homo sapiens
acagacuccugagg

SEQ ID NO: 1626321 - RNA, 16 nt, Homo sapiens
acagagcaaguccuca

SEQ ID NO: 1626322 - RNA, 20 nt, Homo sapiens
acagagcgagacuccaucuc

SEQ ID NO: 1626323 - RNA, 22 nt, Homo sapiens
acagagggucucagauggacga

SEQ ID NO: 1626324 - RNA, 20 nt, Homo sapiens
acagaguugccaggcacuuu

SEQ ID NO: 1626325 - RNA, 18 nt, Homo sapiens
acagaucaagcugugaga

SEQ ID NO: 1626326 - RNA, 19 nt, Homo sapiens
acagaugcaaugugcuacu

SEQ ID NO: 1626327 - RNA, 20 nt, Homo sapiens
acagcaaacccugaugugac

SEQ ID NO: 1626328 - RNA, 18 nt, Homo sapiens
acagcaaccccaggcuga

SEQ ID NO: 1626329 - RNA, 21 nt, Homo sapiens
acagcaaccucuucaugagcu

SEQ ID NO: 1626330 - RNA, 11 nt, Homo sapiens
acagcacacag

SEQ ID NO: 1626331 - RNA, 16 nt, Homo sapiens
acagcagccacuuugc

SEQ ID NO: 1626332 - RNA, 17 nt, Homo sapiens
acagcaugaaauguccu

SEQ ID NO: 1626333 - RNA, 14 nt, Homo sapiens
acagccguuugaau

SEQ ID NO: 1626334 - RNA, 20 nt, Homo sapiens
acagcuaaccacuucgcaca

SEQ ID NO: 1626335 - RNA, 22 nt, Homo sapiens
acagcuucggccuccacaucgu

SEQ ID NO: 1626336 - RNA, 16 nt, Homo sapiens
acagcuugcugucacu

SEQ ID NO: 1626337 - RNA, 14 nt, Homo sapiens
acagcuuucacagu

SEQ ID NO: 1626338 - RNA, 22 nt, Homo sapiens
acaggaccaccuccucugccag

SEQ ID NO: 1626339 - RNA, 18 nt, Homo sapiens
acaggacuaacacucaga

SEQ ID NO: 1626340 - RNA, 18 nt, Homo sapiens
acaggccauggauggaaa

SEQ ID NO: 1626341 - RNA, 20 nt, Homo sapiens
acaggcugagaacucguuca

SEQ ID NO: 1626342 - RNA, 22 nt, Homo sapiens
acaggcuggcaguugguacuga

SEQ ID NO: 1626343 - RNA, 20 nt, Homo sapiens
acagggaaaacugcaaagcu

SEQ ID NO: 1626344 - RNA, 14 nt, Homo sapiens
acagggccugcuau

SEQ ID NO: 1626345 - RNA, 21 nt, Homo sapiens
acagggccugcuauugcagaa

SEQ ID NO: 1626346 - RNA, 21 nt, Homo sapiens
acagggcucauuuuugcacuu

SEQ ID NO: 1626347 - RNA, 10 nt, Homo sapiens
acagggguga

SEQ ID NO: 1626348 - RNA, 18 nt, Homo sapiens
acagggucauguuugcag

SEQ ID NO: 1626349 - RNA, 16 nt, Homo sapiens
acagguaaaacagggc

SEQ ID NO: 1626350 - RNA, 14 nt, Homo sapiens
acaguacagcaugu

SEQ ID NO: 1626351 - RNA, 18 nt, Homo sapiens
acaguaccggauucucuc

SEQ ID NO: 1626352 - RNA, 20 nt, Homo sapiens
acaguagaacugucugugaa

SEQ ID NO: 1626353 - RNA, 13 nt, Homo sapiens
acaguauuuccac

SEQ ID NO: 1626354 - RNA, 22 nt, Homo sapiens
uaaccaaagcccaaagugguau

SEQ ID NO: 1626355 - RNA, 18 nt, Homo sapiens
uaaccugggaccaaccug

SEQ ID NO: 1626356 - RNA, 17 nt, Homo sapiens
uaaccuuuugcuccuau

SEQ ID NO: 1626357 - RNA, 13 nt, Homo sapiens
uaacggcacugug

SEQ ID NO: 1626358 - RNA, 14 nt, Homo sapiens
uaacggcacugugg

SEQ ID NO: 1626359 - RNA, 14 nt, Homo sapiens
uaacuauauuugcu

SEQ ID NO: 1626360 - RNA, 18 nt, Homo sapiens
uaacuaugaccaugcuga

SEQ ID NO: 1626361 - RNA, 12 nt, Homo sapiens
uaacuaugcuuu

SEQ ID NO: 1626362 - RNA, 22 nt, Homo sapiens
uaacucaaauucaaugcuucua

SEQ ID NO: 1626363 - RNA, 15 nt, Homo sapiens
uaacugggugguuug

SEQ ID NO: 1626364 - RNA, 13 nt, Homo sapiens
uaagacacauuga

SEQ ID NO: 1626365 - RNA, 19 nt, Homo sapiens
uaagaccaccuucccuucc

SEQ ID NO: 1626366 - RNA, 18 nt, Homo sapiens
uaagagcuuaagaaccau

SEQ ID NO: 1626367 - RNA, 21 nt, Homo sapiens
uaagaggauugcuugagccca

SEQ ID NO: 1626368 - RNA, 15 nt, Homo sapiens
uaagagucugugcug

SEQ ID NO: 1626369 - RNA, 15 nt, Homo sapiens
uaagaucagacucug

SEQ ID NO: 1626370 - RNA, 22 nt, Homo sapiens
uaagauguguagaccuugaugg

SEQ ID NO: 1626371 - RNA, 20 nt, Homo sapiens
uaagcccggauagacuuauu

SEQ ID NO: 1626372 - RNA, 14 nt, Homo sapiens
uaaggacauuuccc

SEQ ID NO: 1626373 - RNA, 22 nt, Homo sapiens
uaagggcagugcccauguguac

SEQ ID NO: 1626374 - RNA, 12 nt, Homo sapiens
uaagguucaaga

SEQ ID NO: 1626375 - RNA, 19 nt, Homo sapiens
uaaguaaaagcuacuaugu

SEQ ID NO: 1626376 - RNA, 23 nt, Homo sapiens
uaaguaaaagcuacuauguacug

SEQ ID NO: 1626377 - RNA, 20 nt, Homo sapiens
uaaguaaucacuaaugcuca

SEQ ID NO: 1626378 - RNA, 15 nt, Homo sapiens
uaagucacauaucag

SEQ ID NO: 1626379 - RNA, 17 nt, Homo sapiens
uaagugaauacauuaac

SEQ ID NO: 1626380 - RNA, 14 nt, Homo sapiens
uaagugugccaaau

SEQ ID NO: 1626381 - RNA, 21 nt, Homo sapiens
uaaguuaagugcauugaucau

SEQ ID NO: 1626382 - RNA, 19 nt, Homo sapiens
uaaguuacacauuuuucag

SEQ ID NO: 1626383 - RNA, 18 nt, Homo sapiens
uaaguuugaucugucagc

SEQ ID NO: 1626384 - RNA, 15 nt, Homo sapiens
uaaguuuuacuugag

SEQ ID NO: 1626385 - RNA, 13 nt, Homo sapiens
uaauaaagcuuua

SEQ ID NO: 1626386 - RNA, 15 nt, Homo sapiens
uaauaaagcuuuaua

SEQ ID NO: 1626387 - RNA, 16 nt, Homo sapiens
uaauaaagucuaugga

SEQ ID NO: 1626388 - RNA, 21 nt, Homo sapiens
uaauaaauugcuuacugauau

SEQ ID NO: 1626389 - RNA, 19 nt, Homo sapiens
uaauaauaagucaguguua

SEQ ID NO: 1626390 - RNA, 21 nt, Homo sapiens
uaauaauuguaucuacauuaa

SEQ ID NO: 1626391 - RNA, 19 nt, Homo sapiens
uaauagacuuaauacaugc

SEQ ID NO: 1626392 - RNA, 13 nt, Homo sapiens
uaauagaguacuu

SEQ ID NO: 1626393 - RNA, 16 nt, Homo sapiens
uaauagucuuugccag

SEQ ID NO: 1626394 - RNA, 22 nt, Homo sapiens
uaauauaccagcuuguaugcaa

SEQ ID NO: 1626395 - RNA, 16 nt, Homo sapiens
uaauaucuuucaguua

SEQ ID NO: 1626396 - RNA, 18 nt, Homo sapiens
uaaucaagggcacuguga

SEQ ID NO: 1626397 - RNA, 16 nt, Homo sapiens
uaaucaauauaaucug

SEQ ID NO: 1626398 - RNA, 16 nt, Homo sapiens
uaaucacaaauuucac

SEQ ID NO: 1626399 - RNA, 12 nt, Homo sapiens
uaaucauacaaa

SEQ ID NO: 1626400 - RNA, 14 nt, Homo sapiens
uaaucgcuaaucag

SEQ ID NO: 1626401 - RNA, 14 nt, Homo sapiens
uaaucuaguuuuau

SEQ ID NO: 1626402 - RNA, 16 nt, Homo sapiens
uaaucuuugagucuaa

SEQ ID NO: 1626403 - RNA, 22 nt, Homo sapiens
uaaugcuuuuacuaagcacugu

SEQ ID NO: 1626404 - RNA, 20 nt, Homo sapiens
uaauguacagaagagcaaaa

SEQ ID NO: 1626405 - RNA, 20 nt, Homo sapiens
uaauguggcagcugucucaa

SEQ ID NO: 1626406 - RNA, 15 nt, Homo sapiens
uaauguuauucauuu

SEQ ID NO: 1626407 - RNA, 15 nt, Homo sapiens
uaauuaaaaugauag

SEQ ID NO: 1626408 - RNA, 17 nt, Homo sapiens
uaauuauacuacuuugu

SEQ ID NO: 1626409 - RNA, 18 nt, Homo sapiens
uaauuaugaaaagaaaua

SEQ ID NO: 1626410 - RNA, 22 nt, Homo sapiens
uaauuuaacccaggcaugcaau

SEQ ID NO: 1626411 - RNA, 15 nt, Homo sapiens
uaauuucauguguau

SEQ ID NO: 1626412 - RNA, 14 nt, Homo sapiens
uaauuuugauuucu

SEQ ID NO: 1626413 - RNA, 17 nt, Homo sapiens
uaauuuuugaaaacugg

SEQ ID NO: 1626414 - RNA, 12 nt, Homo sapiens
uacaaacauguu

SEQ ID NO: 1626415 - RNA, 22 nt, Homo sapiens
uacaaagcccuuguccccauga

SEQ ID NO: 1626416 - RNA, 18 nt, Homo sapiens
uacaacccgguucacucu

SEQ ID NO: 1626417 - RNA, 21 nt, Homo sapiens
uacaaggguaaaauguuacca

SEQ ID NO: 1626418 - RNA, 14 nt, Homo sapiens
uacaaguauuacaa

SEQ ID NO: 1626419 - RNA, 18 nt, Homo sapiens
uacaauauuaaguccaaa

SEQ ID NO: 1626420 - RNA, 17 nt, Homo sapiens
uacaaucagcccagugc

SEQ ID NO: 1626421 - RNA, 20 nt, Homo sapiens
uacaaucagcccagugcaaa

SEQ ID NO: 1626422 - RNA, 20 nt, Homo sapiens
uacacagcuuuaugauauca

SEQ ID NO: 1626423 - RNA, 23 nt, Homo sapiens
uacacauacauguaaaauauguc

SEQ ID NO: 1626424 - RNA, 21 nt, Homo sapiens
uacacuacauuuuuucuaaua

SEQ ID NO: 1626425 - RNA, 18 nt, Homo sapiens
uacacuaggaaacguguu

SEQ ID NO: 1626426 - RNA, 18 nt, Homo sapiens
uacagacaaagcauaauc

SEQ ID NO: 1626427 - RNA, 21 nt, Homo sapiens
uacagacaucuaauguucucc

SEQ ID NO: 1626428 - RNA, 13 nt, Homo sapiens
uacagacuagcag

SEQ ID NO: 1626429 - RNA, 22 nt, Homo sapiens
uacaggcgugcgccacuaugcc

SEQ ID NO: 1626430 - RNA, 15 nt, Homo sapiens
uacagguuaagacaa

SEQ ID NO: 1626431 - RNA, 19 nt, Homo sapiens
uacagugccaacuccucac

SEQ ID NO: 1626432 - RNA, 13 nt, Homo sapiens
uacauagucuuug

SEQ ID NO: 1626433 - RNA, 15 nt, Homo sapiens
uacauauauuuugca

SEQ ID NO: 1626434 - RNA, 22 nt, Homo sapiens
uacauccaaagcagacagcucc

SEQ ID NO: 1626435 - RNA, 16 nt, Homo sapiens
uacauguguagccugu

SEQ ID NO: 1626436 - RNA, 24 nt, Homo sapiens
uacauuaaaauaacuaagcaagua

SEQ ID NO: 1626437 - RNA, 17 nt, Homo sapiens
uacauuaacggugcuaa

SEQ ID NO: 1626438 - RNA, 23 nt, Homo sapiens
uacauuuauaaaauaaaaaggaa

SEQ ID NO: 1626439 - RNA, 15 nt, Homo sapiens
uaccaaaagggccau

SEQ ID NO: 1626440 - RNA, 16 nt, Homo sapiens
uaccaauucacccacu

SEQ ID NO: 1626441 - RNA, 11 nt, Homo sapiens
uaccacuugaa

SEQ ID NO: 1626442 - RNA, 13 nt, Homo sapiens
uaccauacauuua

SEQ ID NO: 1626443 - RNA, 17 nt, Homo sapiens
uaccaucuuaaucuuua

SEQ ID NO: 1626444 - RNA, 18 nt, Homo sapiens
uacccagggcugccgcau

SEQ ID NO: 1626445 - RNA, 20 nt, Homo sapiens
uacccaggguggagugcagu

SEQ ID NO: 1626446 - RNA, 15 nt, Homo sapiens
uaccccuuuacaaau

SEQ ID NO: 1626447 - RNA, 18 nt, Homo sapiens
uaccgcgucuacccuggg

SEQ ID NO: 1626448 - RNA, 14 nt, Homo sapiens
uaccgcuggcccug

SEQ ID NO: 1626449 - RNA, 18 nt, Homo sapiens
uaccggacacucgucacc

SEQ ID NO: 1626450 - RNA, 18 nt, Homo sapiens
uaccucagaaagauuuga

SEQ ID NO: 1626451 - RNA, 17 nt, Homo sapiens
uaccuggaggaaugauu

SEQ ID NO: 1626452 - RNA, 17 nt, Homo sapiens
uaccugucucucucuuc

SEQ ID NO: 1626453 - RNA, 17 nt, Homo sapiens
uaccuucucccaggccu

SEQ ID NO: 1626454 - RNA, 22 nt, Homo sapiens
uaccuuugacuuuuuggcuuua

SEQ ID NO: 1626455 - RNA, 20 nt, Homo sapiens
uacuaacuaaauaccauuca

SEQ ID NO: 1626456 - RNA, 13 nt, Homo sapiens
uacuagcacuuug

SEQ ID NO: 1626457 - RNA, 13 nt, Homo sapiens
uacuauguacugc

SEQ ID NO: 1626458 - RNA, 17 nt, Homo sapiens
uacuauguacugccuua

SEQ ID NO: 1626459 - RNA, 13 nt, Homo sapiens
uacuccagugcca

SEQ ID NO: 1626460 - RNA, 17 nt, Homo sapiens
uacucccauuaaauuca

SEQ ID NO: 1626461 - RNA, 14 nt, Homo sapiens
ucccaacacuguca

SEQ ID NO: 1626462 - RNA, 21 nt, Homo sapiens
ucccaagcguuucuuuccacc

SEQ ID NO: 1626463 - RNA, 21 nt, Homo sapiens
cauauagagaugaaguuugua

SEQ ID NO: 1626464 - RNA, 17 nt, Homo sapiens
cauaucggcucacaaag

SEQ ID NO: 1626465 - RNA, 18 nt, Homo sapiens
cauaucggcucacaaaga

SEQ ID NO: 1626466 - RNA, 21 nt, Homo sapiens
cauaugaggaggaugucccug

SEQ ID NO: 1626467 - RNA, 18 nt, Homo sapiens
cauaugaucuguuuugua

SEQ ID NO: 1626468 - RNA, 23 nt, Homo sapiens
cauaugccuuggggaggacaaaa

SEQ ID NO: 1626469 - RNA, 15 nt, Homo sapiens
cauauggacucugca

SEQ ID NO: 1626470 - RNA, 19 nt, Homo sapiens
cauauggacucugcacaug

SEQ ID NO: 1626471 - RNA, 20 nt, Homo sapiens
cauaugucuuacuacuuuaa

SEQ ID NO: 1626472 - RNA, 19 nt, Homo sapiens
cauauuaguauuaauacua

SEQ ID NO: 1626473 - RNA, 22 nt, Homo sapiens
cauauucuuccccgaaucacac

SEQ ID NO: 1626474 - RNA, 15 nt, Homo sapiens
cauauugucuggaaa

SEQ ID NO: 1626475 - RNA, 21 nt, Homo sapiens
caucaauaaauguugcaaugc

SEQ ID NO: 1626476 - RNA, 15 nt, Homo sapiens
caucacaugaccaca

SEQ ID NO: 1626477 - RNA, 22 nt, Homo sapiens
caucagugaauccugaaacugg

SEQ ID NO: 1626478 - RNA, 20 nt, Homo sapiens
caucauauuuuguugugcac

SEQ ID NO: 1626479 - RNA, 22 nt, Homo sapiens
caucauuacuguuccagauucc

SEQ ID NO: 1626480 - RNA, 16 nt, Homo sapiens
cauccacacacaguaa

SEQ ID NO: 1626481 - RNA, 19 nt, Homo sapiens
caucccuuuuucugcuaau

SEQ ID NO: 1626482 - RNA, 13 nt, Homo sapiens
cauccuugcccag

SEQ ID NO: 1626483 - RNA, 23 nt, Homo sapiens
caucuagggaaugggacugugag

SEQ ID NO: 1626484 - RNA, 13 nt, Homo sapiens
caucugggaaaga

SEQ ID NO: 1626485 - RNA, 20 nt, Homo sapiens
caucugggaaagacauccau

SEQ ID NO: 1626486 - RNA, 21 nt, Homo sapiens
caucugugcacugcccaugga

SEQ ID NO: 1626487 - RNA, 13 nt, Homo sapiens
caucuuuaacaca

SEQ ID NO: 1626488 - RNA, 17 nt, Homo sapiens
caugaaagauaagcuuu

SEQ ID NO: 1626489 - RNA, 16 nt, Homo sapiens
caugaauaacauuuaa

SEQ ID NO: 1626490 - RNA, 23 nt, Homo sapiens
caugaaucccacccacaugugac

SEQ ID NO: 1626491 - RNA, 14 nt, Homo sapiens
caugacaagaacaa

SEQ ID NO: 1626492 - RNA, 17 nt, Homo sapiens
caugaccauccugccau

SEQ ID NO: 1626493 - RNA, 11 nt, Homo sapiens
caugagaucag

SEQ ID NO: 1626494 - RNA, 15 nt, Homo sapiens
caugaggccaucuca

SEQ ID NO: 1626495 - RNA, 21 nt, Homo sapiens
caugaugcgggccagugcucc

SEQ ID NO: 1626496 - RNA, 13 nt, Homo sapiens
caugcacugaugu

SEQ ID NO: 1626497 - RNA, 21 nt, Homo sapiens
caugcagcucuucaacaugac

SEQ ID NO: 1626498 - RNA, 13 nt, Homo sapiens
caugccucugagg

SEQ ID NO: 1626499 - RNA, 22 nt, Homo sapiens
caugccucugaggccagccugg

SEQ ID NO: 1626500 - RNA, 20 nt, Homo sapiens
caugccugaggucuaccccu

SEQ ID NO: 1626501 - RNA, 15 nt, Homo sapiens
caugccugggaaaug

SEQ ID NO: 1626502 - RNA, 18 nt, Homo sapiens
caugcgguagccagcaca

SEQ ID NO: 1626503 - RNA, 18 nt, Homo sapiens
caugcucccaacucccuu

SEQ ID NO: 1626504 - RNA, 22 nt, Homo sapiens
caugcuggcucccagggccaug

SEQ ID NO: 1626505 - RNA, 21 nt, Homo sapiens
caugcuuuucugccacuccau

SEQ ID NO: 1626506 - RNA, 24 nt, Homo sapiens
cauggauucaaccaacugcaaaug

SEQ ID NO: 1626507 - RNA, 19 nt, Homo sapiens
cauggcaauuuuuacacaa

SEQ ID NO: 1626508 - RNA, 14 nt, Homo sapiens
cauggccuaugcac

SEQ ID NO: 1626509 - RNA, 16 nt, Homo sapiens
cauggccuaugcacau

SEQ ID NO: 1626510 - RNA, 16 nt, Homo sapiens
cauggcugccaucuca

SEQ ID NO: 1626511 - RNA, 12 nt, Homo sapiens
caugucagcaau

SEQ ID NO: 1626512 - RNA, 16 nt, Homo sapiens
caugucauuaugacau

SEQ ID NO: 1626513 - RNA, 16 nt, Homo sapiens
cauguccuauuacuga

SEQ ID NO: 1626514 - RNA, 14 nt, Homo sapiens
cauguuuaauguga

SEQ ID NO: 1626515 - RNA, 23 nt, Homo sapiens
cauguuuauaaaucuuaugcucu

SEQ ID NO: 1626516 - RNA, 20 nt, Homo sapiens
cauguuugauuauaguauua

SEQ ID NO: 1626517 - RNA, 17 nt, Homo sapiens
cauguuugcacuuggca

SEQ ID NO: 1626518 - RNA, 20 nt, Homo sapiens
cauguuuguuucuguagaaa

SEQ ID NO: 1626519 - RNA, 22 nt, Homo sapiens
cauuaaaaaaauuagaaaguag

SEQ ID NO: 1626520 - RNA, 14 nt, Homo sapiens
cauuaauuuaauua

SEQ ID NO: 1626521 - RNA, 20 nt, Homo sapiens
cauuaauuuaauuacuacua

SEQ ID NO: 1626522 - RNA, 19 nt, Homo sapiens
cauuacuguuccagauucc

SEQ ID NO: 1626523 - RNA, 14 nt, Homo sapiens
cauuauaacuguau

SEQ ID NO: 1626524 - RNA, 20 nt, Homo sapiens
cauuauccuugcuaugauga

SEQ ID NO: 1626525 - RNA, 22 nt, Homo sapiens
cauuauccuuuuaucucacaaa

SEQ ID NO: 1626526 - RNA, 17 nt, Homo sapiens
cauuauucaagaaugaa

SEQ ID NO: 1626527 - RNA, 18 nt, Homo sapiens
cauucagucaagugaggu

SEQ ID NO: 1626528 - RNA, 14 nt, Homo sapiens
cauuccaguagaag

SEQ ID NO: 1626529 - RNA, 20 nt, Homo sapiens
cauucuagcugagaagcaau

SEQ ID NO: 1626530 - RNA, 13 nt, Homo sapiens
cauucucacauaa

SEQ ID NO: 1626531 - RNA, 21 nt, Homo sapiens
cauucuccugccucagccucc

SEQ ID NO: 1626532 - RNA, 16 nt, Homo sapiens
cauucugcaugagcug

SEQ ID NO: 1626533 - RNA, 16 nt, Homo sapiens
cauucuucaguucucu

SEQ ID NO: 1626534 - RNA, 15 nt, Homo sapiens
cauugaacuguacca

SEQ ID NO: 1626535 - RNA, 22 nt, Homo sapiens
cauugaacuguaccaugugcua

SEQ ID NO: 1626536 - RNA, 14 nt, Homo sapiens
cauugagucccugc

SEQ ID NO: 1626537 - RNA, 15 nt, Homo sapiens
cauugcaauuugcag

SEQ ID NO: 1626538 - RNA, 17 nt, Homo sapiens
cauugcgugauucaaug

SEQ ID NO: 1626539 - RNA, 15 nt, Homo sapiens
cauugcuuuccacug

SEQ ID NO: 1626540 - RNA, 14 nt, Homo sapiens
cauugggauauucu

SEQ ID NO: 1626541 - RNA, 14 nt, Homo sapiens
cauuguauucuguu

SEQ ID NO: 1626542 - RNA, 17 nt, Homo sapiens
cauugucaccucuguga

SEQ ID NO: 1626543 - RNA, 19 nt, Homo sapiens
cauuguuuucuuuuacaga

SEQ ID NO: 1626544 - RNA, 14 nt, Homo sapiens
cauuuaaauuccac

SEQ ID NO: 1626545 - RNA, 16 nt, Homo sapiens
cauuuaaauuccacag

SEQ ID NO: 1626546 - RNA, 17 nt, Homo sapiens
cauuuauuuaagacacu

SEQ ID NO: 1626547 - RNA, 20 nt, Homo sapiens
cauuuauuuaagacacuguu

SEQ ID NO: 1626548 - RNA, 23 nt, Homo sapiens
cauuuauuuaagacacuguuaca

SEQ ID NO: 1626549 - RNA, 17 nt, Homo sapiens
cauuuauuuuuauaucu

SEQ ID NO: 1626550 - RNA, 22 nt, Homo sapiens
cauuucacaggcuaaugggaua

SEQ ID NO: 1626551 - RNA, 14 nt, Homo sapiens
cauuugcauuugcu

SEQ ID NO: 1626552 - RNA, 15 nt, Homo sapiens
cauuuguacugaccc

SEQ ID NO: 1626553 - RNA, 12 nt, Homo sapiens
cauuuguagcuu

SEQ ID NO: 1626554 - RNA, 19 nt, Homo sapiens
cauuuuauucacauauguc

SEQ ID NO: 1626555 - RNA, 19 nt, Homo sapiens
cauuuuauuuuguaauauu

SEQ ID NO: 1626556 - RNA, 16 nt, Homo sapiens
cauuuuucacaucucu

SEQ ID NO: 1626557 - RNA, 19 nt, Homo sapiens
cauuuuugcacuuaucucg

SEQ ID NO: 1626558 - RNA, 18 nt, Homo sapiens
cauuuuuguaacuugcca

SEQ ID NO: 1626559 - RNA, 15 nt, Homo sapiens
ccaaaauucauuucu

SEQ ID NO: 1626560 - RNA, 22 nt, Homo sapiens
ccaaacaaaacugaaccacaaa

SEQ ID NO: 1626561 - RNA, 13 nt, Homo sapiens
ccaaacaugcacu

SEQ ID NO: 1626562 - RNA, 22 nt, Homo sapiens
ccaaacauggccagacucccuu

SEQ ID NO: 1626563 - RNA, 22 nt, Homo sapiens
ccaaaggaauuugcauccagca

SEQ ID NO: 1626564 - RNA, 21 nt, Homo sapiens
ccaaagggugaagcuauuuau

SEQ ID NO: 1626565 - RNA, 20 nt, Homo sapiens
ccaaaugccauccagaugug

SEQ ID NO: 1626566 - RNA, 15 nt, Homo sapiens
ccaaauuuggcuaaa

SEQ ID NO: 1626567 - RNA, 18 nt, Homo sapiens
ccaaauuuuaucuggaag

SEQ ID NO: 1626568 - RNA, 20 nt, Homo sapiens
ccaaccccaguggauucuca

SEQ ID NO: 1626569 - RNA, 15 nt, Homo sapiens
ccaaccucacugaca

SEQ ID NO: 1626570 - RNA, 23 nt, Homo sapiens
ccaacgaaaagcacauccaggca

SEQ ID NO: 1626571 - RNA, 14 nt, Homo sapiens
ccaacuccagugaa

SEQ ID NO: 1626572 - RNA, 19 nt, Homo sapiens
caccacuugacagacugua

SEQ ID NO: 1626573 - RNA, 20 nt, Homo sapiens
caccagcugcugugccccac

SEQ ID NO: 1626574 - RNA, 23 nt, Homo sapiens
caccaggaauccccaacaugcac

SEQ ID NO: 1626575 - RNA, 20 nt, Homo sapiens
caccaggggaggagccugug

SEQ ID NO: 1626576 - RNA, 19 nt, Homo sapiens
caccaugauggccaggcug

SEQ ID NO: 1626577 - RNA, 16 nt, Homo sapiens
caccauucaggucuuu

SEQ ID NO: 1626578 - RNA, 21 nt, Homo sapiens
cacccaaaagucacccaggga

SEQ ID NO: 1626579 - RNA, 15 nt, Homo sapiens
cacccaacuuuguca

SEQ ID NO: 1626580 - RNA, 13 nt, Homo sapiens
cacccacauguga

SEQ ID NO: 1626581 - RNA, 20 nt, Homo sapiens
cacccggcucguguauuuau

SEQ ID NO: 1626582 - RNA, 15 nt, Homo sapiens
cacccgggaacuuuu

SEQ ID NO: 1626583 - RNA, 20 nt, Homo sapiens
cacccugaggagucugaggu

SEQ ID NO: 1626584 - RNA, 16 nt, Homo sapiens
cacccuggacaaagaa

SEQ ID NO: 1626585 - RNA, 12 nt, Homo sapiens
caccguucugug

SEQ ID NO: 1626586 - RNA, 18 nt, Homo sapiens
caccucaagguguucucu

SEQ ID NO: 1626587 - RNA, 14 nt, Homo sapiens
caccucuguucauu

SEQ ID NO: 1626588 - RNA, 15 nt, Homo sapiens
caccugcaugugcug

SEQ ID NO: 1626589 - RNA, 15 nt, Homo sapiens
gaagugcgugaaugu

SEQ ID NO: 1626590 - RNA, 12 nt, Homo sapiens
gaagugcucuaa

SEQ ID NO: 1626591 - RNA, 22 nt, Homo sapiens
gaagugugcugugacaagccaa

SEQ ID NO: 1626592 - RNA, 22 nt, Homo sapiens
gaaguucaaacccuguauccaa

SEQ ID NO: 1626593 - RNA, 16 nt, Homo sapiens
gaauaaacuccauuua

SEQ ID NO: 1626594 - RNA, 16 nt, Homo sapiens
gaauaaagacuugugc

SEQ ID NO: 1626595 - RNA, 22 nt, Homo sapiens
gaauaaauaugcucagccaccc

SEQ ID NO: 1626596 - RNA, 14 nt, Homo sapiens
gaauaacauuuaaa

SEQ ID NO: 1626597 - RNA, 19 nt, Homo sapiens
gaauaacauuuaaauucca

SEQ ID NO: 1626598 - RNA, 15 nt, Homo sapiens
gaauaaccugcacag

SEQ ID NO: 1626599 - RNA, 19 nt, Homo sapiens
gaauacccaggaagacuuu

SEQ ID NO: 1626600 - RNA, 14 nt, Homo sapiens
gaauagugccugaa

SEQ ID NO: 1626601 - RNA, 17 nt, Homo sapiens
gaauaucauugauuuua

SEQ ID NO: 1626602 - RNA, 14 nt, Homo sapiens
gaaucacaaaccaa

SEQ ID NO: 1626603 - RNA, 17 nt, Homo sapiens
gaaucccggcugucaag

SEQ ID NO: 1626604 - RNA, 18 nt, Homo sapiens
gaaucgcuugaacccagg

SEQ ID NO: 1626605 - RNA, 19 nt, Homo sapiens
gaaucuauuguuucuccuc

SEQ ID NO: 1626606 - RNA, 15 nt, Homo sapiens
gaaugaaugacauga

SEQ ID NO: 1626607 - RNA, 17 nt, Homo sapiens
gaaugcagaggucucca

SEQ ID NO: 1626608 - RNA, 14 nt, Homo sapiens
gaaugggacuguga

SEQ ID NO: 1626609 - RNA, 19 nt, Homo sapiens
gaauguuugugucuguggu

SEQ ID NO: 1626610 - RNA, 17 nt, Homo sapiens
gaauuaaaaaagcauac

SEQ ID NO: 1626611 - RNA, 22 nt, Homo sapiens
gaauuauuugccuucugaaaug

SEQ ID NO: 1626612 - RNA, 21 nt, Homo sapiens
gaauucaaguggguauucugg

SEQ ID NO: 1626613 - RNA, 20 nt, Homo sapiens
gaauucauacucuguugccu

SEQ ID NO: 1626614 - RNA, 22 nt, Homo sapiens
gaauucauacucuguugccucc

SEQ ID NO: 1626615 - RNA, 17 nt, Homo sapiens
gaauucugucauuucaa

SEQ ID NO: 1626616 - RNA, 20 nt, Homo sapiens
gaauuuuuacccaauuggau

SEQ ID NO: 1626617 - RNA, 17 nt, Homo sapiens
gacaaaacuucuuguca

SEQ ID NO: 1626618 - RNA, 21 nt, Homo sapiens
gacaaaacuucuugucagaca

SEQ ID NO: 1626619 - RNA, 17 nt, Homo sapiens
gacaaagagaaugagaa

SEQ ID NO: 1626620 - RNA, 18 nt, Homo sapiens
gacaaaggagccugugaa

SEQ ID NO: 1626621 - RNA, 18 nt, Homo sapiens
gacaaguggacucagggc

SEQ ID NO: 1626622 - RNA, 19 nt, Homo sapiens
gacaauguuguccuccugu

SEQ ID NO: 1626623 - RNA, 20 nt, Homo sapiens
gacaccugccuucaaagcca

SEQ ID NO: 1626624 - RNA, 20 nt, Homo sapiens
gacagaucaagcugugagac

SEQ ID NO: 1626625 - RNA, 12 nt, Homo sapiens
gacagcaugaaa

SEQ ID NO: 1626626 - RNA, 13 nt, Homo sapiens
gacagcucuccaa

SEQ ID NO: 1626627 - RNA, 18 nt, Homo sapiens
gacaggcagccuggacau

SEQ ID NO: 1626628 - RNA, 10 nt, Homo sapiens
gacagucauc

SEQ ID NO: 1626629 - RNA, 10 nt, Homo sapiens
gacagugaau

SEQ ID NO: 1626630 - RNA, 16 nt, Homo sapiens
gacagugggaaauauu

SEQ ID NO: 1626631 - RNA, 21 nt, Homo sapiens
gacauaaaauuuaaaaacuua

SEQ ID NO: 1626632 - RNA, 22 nt, Homo sapiens
gacauaaaauuuaaaaacuuaa

SEQ ID NO: 1626633 - RNA, 16 nt, Homo sapiens
gacauaaagccauguu

SEQ ID NO: 1626634 - RNA, 13 nt, Homo sapiens
gacauacaugcua

SEQ ID NO: 1626635 - RNA, 14 nt, Homo sapiens
gacauacauuucuc

SEQ ID NO: 1626636 - RNA, 21 nt, Homo sapiens
gacauagcugugcuaugaggu

SEQ ID NO: 1626637 - RNA, 15 nt, Homo sapiens
gacaugcccaaaacu

SEQ ID NO: 1626638 - RNA, 15 nt, Homo sapiens
gacauguagcuucuu

SEQ ID NO: 1626639 - RNA, 21 nt, Homo sapiens
gaccaauauuguacaguuuuu

SEQ ID NO: 1626640 - RNA, 13 nt, Homo sapiens
gaccacacuguua

SEQ ID NO: 1626641 - RNA, 18 nt, Homo sapiens
gaccacugcuggaccaag

SEQ ID NO: 1626642 - RNA, 17 nt, Homo sapiens
gaccagcccaccccugu

SEQ ID NO: 1626643 - RNA, 15 nt, Homo sapiens
gaccagucugacccu

SEQ ID NO: 1626644 - RNA, 14 nt, Homo sapiens
gacccaccugcuag

SEQ ID NO: 1626645 - RNA, 11 nt, Homo sapiens
gaccccagugu

SEQ ID NO: 1626646 - RNA, 19 nt, Homo sapiens
gacccccgcaaguuugcac

SEQ ID NO: 1626647 - RNA, 13 nt, Homo sapiens
gaccuaaaauaaa

SEQ ID NO: 1626648 - RNA, 18 nt, Homo sapiens
gaccuaaagcaagccuga

SEQ ID NO: 1626649 - RNA, 18 nt, Homo sapiens
gaccuauuagaguauuuu

SEQ ID NO: 1626650 - RNA, 10 nt, Homo sapiens
gaccucuugu

SEQ ID NO: 1626651 - RNA, 23 nt, Homo sapiens
gaccuuaaaauguguacagugaa

SEQ ID NO: 1626652 - RNA, 20 nt, Homo sapiens
gacgcaccgccugaaggcac

SEQ ID NO: 1626653 - RNA, 21 nt, Homo sapiens
gacuagccagaauucuacccu

SEQ ID NO: 1626654 - RNA, 15 nt, Homo sapiens
gacuaguagauuucu

SEQ ID NO: 1626655 - RNA, 22 nt, Homo sapiens
gacucacuuguucucacugucu

SEQ ID NO: 1626656 - RNA, 16 nt, Homo sapiens
gacucauccuugccca

SEQ ID NO: 1626657 - RNA, 19 nt, Homo sapiens
gacucccaccccagggauu

SEQ ID NO: 1626658 - RNA, 18 nt, Homo sapiens
gacuccugaggacagcug

SEQ ID NO: 1626659 - RNA, 14 nt, Homo sapiens
gacucugcacaugu

SEQ ID NO: 1626660 - RNA, 15 nt, Homo sapiens
gacucugcacauguc

SEQ ID NO: 1626661 - RNA, 18 nt, Homo sapiens
gacucugcacaugucuug

SEQ ID NO: 1626662 - RNA, 21 nt, Homo sapiens
gacucuggggaggugaacugg

SEQ ID NO: 1626663 - RNA, 16 nt, Homo sapiens
gacucuucgaugugcc

SEQ ID NO: 1626664 - RNA, 20 nt, Homo sapiens
gacugaagcgaacaucuuca

SEQ ID NO: 1626665 - RNA, 12 nt, Homo sapiens
gacugcuuuuag

SEQ ID NO: 1626666 - RNA, 13 nt, Homo sapiens
gacuggagcucau

SEQ ID NO: 1626667 - RNA, 17 nt, Homo sapiens
gacuggagcucaucugc

SEQ ID NO: 1626668 - RNA, 16 nt, Homo sapiens
gacuggcgugcugaga

SEQ ID NO: 1626669 - RNA, 14 nt, Homo sapiens
gacugucaguucuc

SEQ ID NO: 1626670 - RNA, 21 nt, Homo sapiens
gacugugaggccauacuugug

SEQ ID NO: 1626671 - RNA, 19 nt, Homo sapiens
gacuuaccuggcagacuug

SEQ ID NO: 1626672 - RNA, 23 nt, Homo sapiens
gacuuacuuuccugugguuuuau

SEQ ID NO: 1626673 - RNA, 12 nt, Homo sapiens
gacuucacuuau

SEQ ID NO: 1626674 - RNA, 14 nt, Homo sapiens
gagaaacugccaca

SEQ ID NO: 1626675 - RNA, 19 nt, Homo sapiens
gagaaagagagaagccagc

SEQ ID NO: 1626676 - RNA, 15 nt, Homo sapiens
gagaaauugacagau

SEQ ID NO: 1626677 - RNA, 22 nt, Homo sapiens
gagaaauugacagaucaagcug

SEQ ID NO: 1626678 - RNA, 23 nt, Homo sapiens
gagaacuuucugauucacagucu

SEQ ID NO: 1626679 - RNA, 14 nt, Homo sapiens
gagaagcacagcuc

SEQ ID NO: 1626680 - RNA, 17 nt, Homo sapiens
gagaagccaaacagcaa

SEQ ID NO: 1626681 - RNA, 20 nt, Homo sapiens
gagaagcucugaagaacucu

SEQ ID NO: 1626682 - RNA, 23 nt, Homo sapiens
gagaaggcuauguaaacaaacca

SEQ ID NO: 1626683 - RNA, 17 nt, Homo sapiens
gagaagggggcucugcc

SEQ ID NO: 1626684 - RNA, 21 nt, Homo sapiens
gagaaguuuguagccagguac

SEQ ID NO: 1626685 - RNA, 14 nt, Homo sapiens
gagaauguguguag

SEQ ID NO: 1626686 - RNA, 23 nt, Homo sapiens
gagaauugaaaugaggugccacc

SEQ ID NO: 1626687 - RNA, 12 nt, Homo sapiens
gagaauugagaa

SEQ ID NO: 1626688 - RNA, 14 nt, Homo sapiens
gagaauuggcucaa

SEQ ID NO: 1626689 - RNA, 22 nt, Homo sapiens
gagacagcuugaucaaaggcac

SEQ ID NO: 1626690 - RNA, 16 nt, Homo sapiens
uugcccaccagaucau

SEQ ID NO: 1626691 - RNA, 23 nt, Homo sapiens
uugccuccaucuuuuucuugggu

SEQ ID NO: 1626692 - RNA, 19 nt, Homo sapiens
uugccugaggggaaagaga

SEQ ID NO: 1626693 - RNA, 15 nt, Homo sapiens
uugcggauacuuugc

SEQ ID NO: 1626694 - RNA, 16 nt, Homo sapiens
uugcuaaaauauaauu

SEQ ID NO: 1626695 - RNA, 17 nt, Homo sapiens
uugcucccaggaucucc

SEQ ID NO: 1626696 - RNA, 15 nt, Homo sapiens
uugcucccuaccuga

SEQ ID NO: 1626697 - RNA, 11 nt, Homo sapiens
uugcucccuau

SEQ ID NO: 1626698 - RNA, 16 nt, Homo sapiens
uugcucuuucaucucu

SEQ ID NO: 1626699 - RNA, 16 nt, Homo sapiens
uugcugauccaugaga

SEQ ID NO: 1626700 - RNA, 22 nt, Homo sapiens
uugcugccaaacacccaugccc

SEQ ID NO: 1626701 - RNA, 17 nt, Homo sapiens
uugcugugugucugucc

SEQ ID NO: 1626702 - RNA, 16 nt, Homo sapiens
uuggaaaacacuuuca

SEQ ID NO: 1626703 - RNA, 20 nt, Homo sapiens
uuggaaaacacuuucauccg

SEQ ID NO: 1626704 - RNA, 22 nt, Homo sapiens
uuggaagccagguacaggagag

SEQ ID NO: 1626705 - RNA, 13 nt, Homo sapiens
uuggaauggugua

SEQ ID NO: 1626706 - RNA, 22 nt, Homo sapiens
uuggagaaccagggcucuucuc

SEQ ID NO: 1626707 - RNA, 18 nt, Homo sapiens
uuggaugauugugugacu

SEQ ID NO: 1626708 - RNA, 19 nt, Homo sapiens
uuggauggccuccauccag

SEQ ID NO: 1626709 - RNA, 15 nt, Homo sapiens
uuggauucccuuaaa

SEQ ID NO: 1626710 - RNA, 21 nt, Homo sapiens
uuggcaggcugaggugagaag

SEQ ID NO: 1626711 - RNA, 15 nt, Homo sapiens
uuggccaaugugcau

SEQ ID NO: 1626712 - RNA, 14 nt, Homo sapiens
uuggcucaccauaa

SEQ ID NO: 1626713 - RNA, 17 nt, Homo sapiens
uugggaaagcucuuguc

SEQ ID NO: 1626714 - RNA, 21 nt, Homo sapiens
uugggagcaccgccugugaaa

SEQ ID NO: 1626715 - RNA, 15 nt, Homo sapiens
uugguggccuaauuu

SEQ ID NO: 1626716 - RNA, 20 nt, Homo sapiens
uuguaaaacaaaauuugacu

SEQ ID NO: 1626717 - RNA, 22 nt, Homo sapiens
uuguaaaguguuagauggaaaa

SEQ ID NO: 1626718 - RNA, 17 nt, Homo sapiens
uuguaaaguuagccuuu

SEQ ID NO: 1626719 - RNA, 14 nt, Homo sapiens
uuguacaauguaga

SEQ ID NO: 1626720 - RNA, 15 nt, Homo sapiens
uuguacuaugcuguu

SEQ ID NO: 1626721 - RNA, 14 nt, Homo sapiens
uuguagccagguac

SEQ ID NO: 1626722 - RNA, 19 nt, Homo sapiens
uuguauauaguuaguaucu

SEQ ID NO: 1626723 - RNA, 20 nt, Homo sapiens
uugucaccucagcacugugg

SEQ ID NO: 1626724 - RNA, 21 nt, Homo sapiens
uugucaccucugugaccccuc

SEQ ID NO: 1626725 - RNA, 18 nt, Homo sapiens
uugucaguuccaaacaga

SEQ ID NO: 1626726 - RNA, 18 nt, Homo sapiens
uuguccagguugaucuug

SEQ ID NO: 1626727 - RNA, 20 nt, Homo sapiens
uuguccagguugaucuugaa

SEQ ID NO: 1626728 - RNA, 17 nt, Homo sapiens
uugucucccagcucagg

SEQ ID NO: 1626729 - RNA, 14 nt, Homo sapiens
uugucuuggaacca

SEQ ID NO: 1626730 - RNA, 16 nt, Homo sapiens
uugugauuucuuuaaa

SEQ ID NO: 1626731 - RNA, 21 nt, Homo sapiens
uugugcuccuucggauaugau

SEQ ID NO: 1626732 - RNA, 17 nt, Homo sapiens
uuguuccaguacuaugg

SEQ ID NO: 1626733 - RNA, 13 nt, Homo sapiens
uuguucuggucuu

SEQ ID NO: 1626734 - RNA, 20 nt, Homo sapiens
uuguucuuuggaaauacaca

SEQ ID NO: 1626735 - RNA, 12 nt, Homo sapiens
uuguugcauucc

SEQ ID NO: 1626736 - RNA, 20 nt, Homo sapiens
uuguugcuacauuuacuuua

SEQ ID NO: 1626737 - RNA, 13 nt, Homo sapiens
uuguuguugccaa

SEQ ID NO: 1626738 - RNA, 16 nt, Homo sapiens
uuguuucugcauucau

SEQ ID NO: 1626739 - RNA, 14 nt, Homo sapiens
uuguuucuguagaa

SEQ ID NO: 1626740 - RNA, 12 nt, Homo sapiens
uuuaaagucaca

SEQ ID NO: 1626741 - RNA, 20 nt, Homo sapiens
uuuaaauaccaguacuugag

SEQ ID NO: 1626742 - RNA, 22 nt, Homo sapiens
uuuaaauuacaauuuuaucugu

SEQ ID NO: 1626743 - RNA, 14 nt, Homo sapiens
uuuaacguuuucau

SEQ ID NO: 1626744 - RNA, 23 nt, Homo sapiens
uuuaagaaaggaagcaacagaua

SEQ ID NO: 1626745 - RNA, 20 nt, Homo sapiens
uuuaagaucacgccacugga

SEQ ID NO: 1626746 - RNA, 15 nt, Homo sapiens
uuuaagcaugugaug

SEQ ID NO: 1626747 - RNA, 21 nt, Homo sapiens
uuuaauaaauugcuuacugau

SEQ ID NO: 1626748 - RNA, 21 nt, Homo sapiens
uuuaauagggaauauaucucu

SEQ ID NO: 1626749 - RNA, 22 nt, Homo sapiens
uuuaaucauuauuugagacugu

SEQ ID NO: 1626750 - RNA, 20 nt, Homo sapiens
uuuaauccuuaacacauuca

SEQ ID NO: 1626751 - RNA, 21 nt, Homo sapiens
uuuaauccuuaacacauucaa

SEQ ID NO: 1626752 - RNA, 12 nt, Homo sapiens
uuuaaucugcac

SEQ ID NO: 1626753 - RNA, 19 nt, Homo sapiens
uuuaauuuugugaaucuau

SEQ ID NO: 1626754 - RNA, 13 nt, Homo sapiens
uuuacaaaggggg

SEQ ID NO: 1626755 - RNA, 22 nt, Homo sapiens
uuuacauccagaguucugugac

SEQ ID NO: 1626756 - RNA, 19 nt, Homo sapiens
uuuacauuuucaguaccaa

SEQ ID NO: 1626757 - RNA, 16 nt, Homo sapiens
uuuaggacaucuuaaa

SEQ ID NO: 1626758 - RNA, 17 nt, Homo sapiens
uuuaguguuuuuaccuc

SEQ ID NO: 1626759 - RNA, 15 nt, Homo sapiens
uuuauacaauguucu

SEQ ID NO: 1626760 - RNA, 14 nt, Homo sapiens
uuuauaucaugcaa

SEQ ID NO: 1626761 - RNA, 22 nt, Homo sapiens
uuuaucacuucauucacauuca

SEQ ID NO: 1626762 - RNA, 22 nt, Homo sapiens
uuuaucucacaaauaaguaaua

SEQ ID NO: 1626763 - RNA, 18 nt, Homo sapiens
uuuaucuguuuccugaca

SEQ ID NO: 1626764 - RNA, 15 nt, Homo sapiens
uuuauuuaacuauuc

SEQ ID NO: 1626765 - RNA, 14 nt, Homo sapiens
uuuauuuccacuaa

SEQ ID NO: 1626766 - RNA, 22 nt, Homo sapiens
uuuauuucugguaacucacuca

SEQ ID NO: 1626767 - RNA, 20 nt, Homo sapiens
uuucaaagaaaauagauuag

SEQ ID NO: 1626768 - RNA, 12 nt, Homo sapiens
uuucaaccauaa

SEQ ID NO: 1626769 - RNA, 20 nt, Homo sapiens
uuucaagaaaauagcuauaa

SEQ ID NO: 1626770 - RNA, 12 nt, Homo sapiens
uuucaaggccuu

SEQ ID NO: 1626771 - RNA, 14 nt, Homo sapiens
uuucagccacuucu

SEQ ID NO: 1626772 - RNA, 14 nt, Homo sapiens
uuucagucugaucc

SEQ ID NO: 1626773 - RNA, 16 nt, Homo sapiens
uuucauacauuugacu

SEQ ID NO: 1626774 - RNA, 20 nt, Homo sapiens
uuucaucugggaaagacauc

SEQ ID NO: 1626775 - RNA, 18 nt, Homo sapiens
uuuccagugucacuugac

SEQ ID NO: 1626776 - RNA, 22 nt, Homo sapiens
uuuccaugcacccucauacaca

SEQ ID NO: 1626777 - RNA, 18 nt, Homo sapiens
uuuccccaccuuccuuac

SEQ ID NO: 1626778 - RNA, 19 nt, Homo sapiens
uuuccccuccuuggcuuua

SEQ ID NO: 1626779 - RNA, 20 nt, Homo sapiens
uuuccccuccuuggcuuuau

SEQ ID NO: 1626780 - RNA, 17 nt, Homo sapiens
uuucccgcccagccuca

SEQ ID NO: 1626781 - RNA, 16 nt, Homo sapiens
uuuccugauaacauua

SEQ ID NO: 1626782 - RNA, 14 nt, Homo sapiens
uuugccacaucccu

SEQ ID NO: 1626783 - RNA, 23 nt, Homo sapiens
uuugcucucugucaggugugaua

SEQ ID NO: 1626784 - RNA, 20 nt, Homo sapiens
uuugcugccaaacacccaug

SEQ ID NO: 1626785 - RNA, 11 nt, Homo sapiens
uuugcuguaga

SEQ ID NO: 1626786 - RNA, 12 nt, Homo sapiens
uuuggaaacaca

SEQ ID NO: 1626787 - RNA, 14 nt, Homo sapiens
uuuggaaaccaagc

SEQ ID NO: 1626788 - RNA, 20 nt, Homo sapiens
uuuggauauuuuuuggugug

SEQ ID NO: 1626789 - RNA, 12 nt, Homo sapiens
uuuggcuaaaau

SEQ ID NO: 1626790 - RNA, 22 nt, Homo sapiens
uuugggagcccaugggggagcu

SEQ ID NO: 1626791 - RNA, 19 nt, Homo sapiens
uuuggucuuagcuuuacau

SEQ ID NO: 1626792 - RNA, 14 nt, Homo sapiens
uuugguuuuggaca

SEQ ID NO: 1626793 - RNA, 22 nt, Homo sapiens
uuugugcagagauaaagaccuu

SEQ ID NO: 1626794 - RNA, 23 nt, Homo sapiens
uuugugccagugcuaaacuacug

SEQ ID NO: 1626795 - RNA, 22 nt, Homo sapiens
uuuguggccuuggcugacauga

SEQ ID NO: 1626796 - RNA, 15 nt, Homo sapiens
uuugugucacaaaga

SEQ ID NO: 1626797 - RNA, 13 nt, Homo sapiens
uuuguuuaacaaa

SEQ ID NO: 1626798 - RNA, 14 nt, Homo sapiens
uuuguuuaugaaga

SEQ ID NO: 1626799 - RNA, 12 nt, Homo sapiens
uuuuaaaacaca

SEQ ID NO: 1626800 - RNA, 12 nt, Homo sapiens
uuuuaacucugu

SEQ ID NO: 1626801 - RNA, 15 nt, Homo sapiens
uuuuaacugccaaga

SEQ ID NO: 1626802 - RNA, 21 nt, Homo sapiens
uuuuaauccuuaacacauuca

SEQ ID NO: 1626803 - RNA, 17 nt, Homo sapiens
uuuuaaugcuauuugaa

SEQ ID NO: 1626804 - RNA, 15 nt, Homo sapiens
uuuuacacugauaaa

SEQ ID NO: 1626805 - RNA, 20 nt, Homo sapiens
uuuuaguucaauacagugaa

SEQ ID NO: 1626806 - RNA, 13 nt, Homo sapiens
uuuuauaauuaau

SEQ ID NO: 1626807 - RNA, 19 nt, Homo sapiens
uuuuauguguugaugacuc

SEQ ID NO: 1626808 - RNA, 23 nt, Homo sapiens
uuuuccauuguuugaaacaaaga

SEQ ID NO: 1626809 - RNA, 15 nt, Homo sapiens
uuuucuguaguguga

SEQ ID NO: 1626810 - RNA, 15 nt, Homo sapiens
uuuugacacugguau

SEQ ID NO: 1626811 - RNA, 13 nt, Homo sapiens
uuuugcuuuccaa

SEQ ID NO: 1626812 - RNA, 21 nt, Homo sapiens
uuuuuaaaauauauugcugca

SEQ ID NO: 1626813 - RNA, 16 nt, Homo sapiens
uuuuuagugcauccag

SEQ ID NO: 1626814 - RNA, 11 nt, Homo sapiens
uuuuugagaug

SEQ ID NO: 1626815 - RNA, 16 nt, Homo sapiens
uuuuugagauggaauc

SEQ ID NO: 1626816 - RNA, 22 nt, Homo sapiens
uuuuuggacuagccagaauucu

SEQ ID NO: 1626817 - RNA, 21 nt, Homo sapiens
uuuuuucacucauagccacuu

SEQ ID NO: 1626818 - RNA, 17 nt, Homo sapiens
uuuuuucugccuaauag

SEQ ID NO: 1626819 - RNA, 22 nt, Homo sapiens
agcuaauggcgaucaucuuugc

SEQ ID NO: 1626820 - RNA, 13 nt, Homo sapiens
agcuacaggacau

SEQ ID NO: 1626821 - RNA, 21 nt, Homo sapiens
agcuacuauguacugccuuag

SEQ ID NO: 1626822 - RNA, 22 nt, Homo sapiens
agcuacuuugugagccaaagcu

SEQ ID NO: 1626823 - RNA, 23 nt, Homo sapiens
agcuagcaaagacuugugugaug

SEQ ID NO: 1626824 - RNA, 16 nt, Homo sapiens
agcuaucuauaccuua

SEQ ID NO: 1626825 - RNA, 21 nt, Homo sapiens
agcuauggugagaugcagcug

SEQ ID NO: 1626826 - RNA, 13 nt, Homo sapiens
agcucaggugccu

SEQ ID NO: 1626827 - RNA, 19 nt, Homo sapiens
agcuccaagaggcuccuga

SEQ ID NO: 1626828 - RNA, 17 nt, Homo sapiens
agcuccccucacucugu

SEQ ID NO: 1626829 - RNA, 17 nt, Homo sapiens
agcucuucaacaugaca

SEQ ID NO: 1626830 - RNA, 18 nt, Homo sapiens
agcucuuccccaucucac

SEQ ID NO: 1626831 - RNA, 20 nt, Homo sapiens
agcugaaugccuccuguggg

SEQ ID NO: 1626832 - RNA, 17 nt, Homo sapiens
agcugagaagcaauggg

SEQ ID NO: 1626833 - RNA, 14 nt, Homo sapiens
agcugcacuacagc

SEQ ID NO: 1626834 - RNA, 14 nt, Homo sapiens
agcugcaggggcau

SEQ ID NO: 1626835 - RNA, 18 nt, Homo sapiens
agcugcgccugcgcugca

SEQ ID NO: 1626836 - RNA, 17 nt, Homo sapiens
agcugggacuacagggg

SEQ ID NO: 1626837 - RNA, 17 nt, Homo sapiens
agcugggauuacaggcg

SEQ ID NO: 1626838 - RNA, 19 nt, Homo sapiens
agcugggauuacaggcgug

SEQ ID NO: 1626839 - RNA, 21 nt, Homo sapiens
agcugggauuacaggugugca

SEQ ID NO: 1626840 - RNA, 16 nt, Homo sapiens
agcugggggcugaggg

SEQ ID NO: 1626841 - RNA, 21 nt, Homo sapiens
agcugguaggauguaagccug

SEQ ID NO: 1626842 - RNA, 16 nt, Homo sapiens
agcugguggcaauaaa

SEQ ID NO: 1626843 - RNA, 22 nt, Homo sapiens
agcuguacucuucugacugccc

SEQ ID NO: 1626844 - RNA, 17 nt, Homo sapiens
agcugugaccugcugag

SEQ ID NO: 1626845 - RNA, 17 nt, Homo sapiens
agcuguuccuguucagu

SEQ ID NO: 1626846 - RNA, 18 nt, Homo sapiens
agcuguuugaaauguuua

SEQ ID NO: 1626847 - RNA, 14 nt, Homo sapiens
agcuuacucucugc

SEQ ID NO: 1626848 - RNA, 21 nt, Homo sapiens
agcuuauaaaaauaaagggaa

SEQ ID NO: 1626849 - RNA, 21 nt, Homo sapiens
agcuucuucugaaagaauuau

SEQ ID NO: 1626850 - RNA, 14 nt, Homo sapiens
agcuugcugucacu

SEQ ID NO: 1626851 - RNA, 20 nt, Homo sapiens
agcuuguccagguugaucuu

SEQ ID NO: 1626852 - RNA, 14 nt, Homo sapiens
agcuuuccaaggaa

SEQ ID NO: 1626853 - RNA, 22 nt, Homo sapiens
agcuuuucuugauaggccuagu

SEQ ID NO: 1626854 - RNA, 13 nt, Homo sapiens
aggaaaacagacu

SEQ ID NO: 1626855 - RNA, 14 nt, Homo sapiens
aggaaaagcaagaa

SEQ ID NO: 1626856 - RNA, 20 nt, Homo sapiens
aggaaauacuuuguaacuuu

SEQ ID NO: 1626857 - RNA, 18 nt, Homo sapiens
aggaacaaauaaacucau

SEQ ID NO: 1626858 - RNA, 14 nt, Homo sapiens
aggaagcuuggcuu

SEQ ID NO: 1626859 - RNA, 15 nt, Homo sapiens
aggaauacauuuuau

SEQ ID NO: 1626860 - RNA, 18 nt, Homo sapiens
aggaauccccaacaugca

SEQ ID NO: 1626861 - RNA, 23 nt, Homo sapiens
aggaauuuuuuuaacuuaaggga

SEQ ID NO: 1626862 - RNA, 12 nt, Homo sapiens
aggacaagcaug

SEQ ID NO: 1626863 - RNA, 15 nt, Homo sapiens
aggacacccaggaau

SEQ ID NO: 1626864 - RNA, 11 nt, Homo sapiens
aggacaucuua

SEQ ID NO: 1626865 - RNA, 13 nt, Homo sapiens
aggaccaccaaug

SEQ ID NO: 1626866 - RNA, 11 nt, Homo sapiens
aggaccaugcu

SEQ ID NO: 1626867 - RNA, 22 nt, Homo sapiens
aggacuuuaucuaauaccucug

SEQ ID NO: 1626868 - RNA, 18 nt, Homo sapiens
aggagaagcacagcuccu

SEQ ID NO: 1626869 - RNA, 22 nt, Homo sapiens
aggagaccuacccuccacaggc

SEQ ID NO: 1626870 - RNA, 15 nt, Homo sapiens
aggagagaaaacugc

SEQ ID NO: 1626871 - RNA, 15 nt, Homo sapiens
aggagagagucccag

SEQ ID NO: 1626872 - RNA, 14 nt, Homo sapiens
aggaggagcaccuc

SEQ ID NO: 1626873 - RNA, 23 nt, Homo sapiens
aggaggagcaccuccgccagauc

SEQ ID NO: 1626874 - RNA, 21 nt, Homo sapiens
aggaggccguugauucacuuc

SEQ ID NO: 1626875 - RNA, 22 nt, Homo sapiens
aggagggggucguggagagcua

SEQ ID NO: 1626876 - RNA, 20 nt, Homo sapiens
aggaggguauggugcugcuc

SEQ ID NO: 1626877 - RNA, 11 nt, Homo sapiens
aggaguacaau

SEQ ID NO: 1626878 - RNA, 13 nt, Homo sapiens
aggagugccauac

SEQ ID NO: 1626879 - RNA, 20 nt, Homo sapiens
aggauacugaggcacacaga

SEQ ID NO: 1626880 - RNA, 16 nt, Homo sapiens
aggaucccuacugcca

SEQ ID NO: 1626881 - RNA, 23 nt, Homo sapiens
aggaucucugagaccacagaggc

SEQ ID NO: 1626882 - RNA, 22 nt, Homo sapiens
aggaugucaugucugcuuguca

SEQ ID NO: 1626883 - RNA, 22 nt, Homo sapiens
aggcacacagcaagucaggguu

SEQ ID NO: 1626884 - RNA, 14 nt, Homo sapiens
aggcacuguucaau

SEQ ID NO: 1626885 - RNA, 20 nt, Homo sapiens
aggcacuguucaauacugua

SEQ ID NO: 1626886 - RNA, 18 nt, Homo sapiens
aggcagaaaagucaucau

SEQ ID NO: 1626887 - RNA, 14 nt, Homo sapiens
aggcagccagccgu

SEQ ID NO: 1626888 - RNA, 23 nt, Homo sapiens
aggcaggcuuucugggugugacu

SEQ ID NO: 1626889 - RNA, 22 nt, Homo sapiens
aggcauggucccuuaaggcaca

SEQ ID NO: 1626890 - RNA, 17 nt, Homo sapiens
aggcauuuccugcugaa

SEQ ID NO: 1626891 - RNA, 17 nt, Homo sapiens
aggccaacagcaagugu

SEQ ID NO: 1626892 - RNA, 21 nt, Homo sapiens
aggccauugggauauucugaa

SEQ ID NO: 1626893 - RNA, 16 nt, Homo sapiens
aggccccaugaccucc

SEQ ID NO: 1626894 - RNA, 20 nt, Homo sapiens
aggcccugcaccuuccccaa

SEQ ID NO: 1626895 - RNA, 16 nt, Homo sapiens
aggcccuugggcaccu

SEQ ID NO: 1626896 - RNA, 13 nt, Homo sapiens
aggccucugagaa

SEQ ID NO: 1626897 - RNA, 20 nt, Homo sapiens
aggccuguuucuuuuccccu

SEQ ID NO: 1626898 - RNA, 23 nt, Homo sapiens
aggccuucaguuuauuuccacua

SEQ ID NO: 1626899 - RNA, 17 nt, Homo sapiens
aggcgccgcacuuccuu

SEQ ID NO: 1626900 - RNA, 16 nt, Homo sapiens
aggcuacaaagcagag

SEQ ID NO: 1626901 - RNA, 21 nt, Homo sapiens
aggcucugcacagacaagcag

SEQ ID NO: 1626902 - RNA, 15 nt, Homo sapiens
aggcugaaagacagg

SEQ ID NO: 1626903 - RNA, 17 nt, Homo sapiens
aggcugaccacagcaca

SEQ ID NO: 1626904 - RNA, 18 nt, Homo sapiens
aggcugagaacucguuca

SEQ ID NO: 1626905 - RNA, 12 nt, Homo sapiens
aggcugcugcug

SEQ ID NO: 1626906 - RNA, 20 nt, Homo sapiens
aggcuggagugcaguggcac

SEQ ID NO: 1626907 - RNA, 20 nt, Homo sapiens
aggcuggagugcaguggcau

SEQ ID NO: 1626908 - RNA, 20 nt, Homo sapiens
aggcuggaguguaguggcau

SEQ ID NO: 1626909 - RNA, 20 nt, Homo sapiens
aggcuggcuccagaugcagg

SEQ ID NO: 1626910 - RNA, 22 nt, Homo sapiens
aggcuggggccccuaagcuccu

SEQ ID NO: 1626911 - RNA, 18 nt, Homo sapiens
agggaacaaguacuucuu

SEQ ID NO: 1626912 - RNA, 18 nt, Homo sapiens
agggaacuagagguguua

SEQ ID NO: 1626913 - RNA, 20 nt, Homo sapiens
agggaaguaguccuuggcau

SEQ ID NO: 1626914 - RNA, 17 nt, Homo sapiens
agggaauucucuuggcu

SEQ ID NO: 1626915 - RNA, 15 nt, Homo sapiens
agggacccaccugcu

SEQ ID NO: 1626916 - RNA, 14 nt, Homo sapiens
agggacccaugagu

SEQ ID NO: 1626917 - RNA, 21 nt, Homo sapiens
agggaccucaagcaccacgcc

SEQ ID NO: 1626918 - RNA, 14 nt, Homo sapiens
agggagaugggauu

SEQ ID NO: 1626919 - RNA, 12 nt, Homo sapiens
agggaggcucag

SEQ ID NO: 1626920 - RNA, 15 nt, Homo sapiens
agggaggggugguau

SEQ ID NO: 1626921 - RNA, 14 nt, Homo sapiens
agggaucuugcaaa

SEQ ID NO: 1626922 - RNA, 16 nt, Homo sapiens
agggauggagaaagaa

SEQ ID NO: 1626923 - RNA, 22 nt, Homo sapiens
agggauggagaaagaaguggag

SEQ ID NO: 1626924 - RNA, 15 nt, Homo sapiens
agggcacaggagcua

SEQ ID NO: 1626925 - RNA, 14 nt, Homo sapiens
agggcacugggcug

SEQ ID NO: 1626926 - RNA, 21 nt, Homo sapiens
agggcagagucuaccuugaaa

SEQ ID NO: 1626927 - RNA, 17 nt, Homo sapiens
agggcaguucugagugu

SEQ ID NO: 1626928 - RNA, 21 nt, Homo sapiens
aaaacuuuaggcccugcccca

SEQ ID NO: 1626929 - RNA, 13 nt, Homo sapiens
aaaagacugacca

SEQ ID NO: 1626930 - RNA, 16 nt, Homo sapiens
aaaagcccuuugcuaa

SEQ ID NO: 1626931 - RNA, 15 nt, Homo sapiens
aaaagggcacuccca

SEQ ID NO: 1626932 - RNA, 23 nt, Homo sapiens
aaaagucacccagggacacucca

SEQ ID NO: 1626933 - RNA, 14 nt, Homo sapiens
aaaagucacuuacu

SEQ ID NO: 1626934 - RNA, 23 nt, Homo sapiens
aaaaguccucuggauugagauac

SEQ ID NO: 1626935 - RNA, 13 nt, Homo sapiens
aaaauacucugac

SEQ ID NO: 1626936 - RNA, 11 nt, Homo sapiens
aaaauagccaa

SEQ ID NO: 1626937 - RNA, 19 nt, Homo sapiens
aaaauaguacacacauaua

SEQ ID NO: 1626938 - RNA, 17 nt, Homo sapiens
aaaauauguaauuucaa

SEQ ID NO: 1626939 - RNA, 14 nt, Homo sapiens
aaaaucuagcacac

SEQ ID NO: 1626940 - RNA, 15 nt, Homo sapiens
aaaaugaaaauucua

SEQ ID NO: 1626941 - RNA, 16 nt, Homo sapiens
aaaaugacaaacauga

SEQ ID NO: 1626942 - RNA, 20 nt, Homo sapiens
aaaaugcaauguaagcauac

SEQ ID NO: 1626943 - RNA, 15 nt, Homo sapiens
aaaaugccagucuca

SEQ ID NO: 1626944 - RNA, 14 nt, Homo sapiens
aaaauggcaccuaa

SEQ ID NO: 1626945 - RNA, 13 nt, Homo sapiens
aaaauuacauaua

SEQ ID NO: 1626946 - RNA, 13 nt, Homo sapiens
aaaauuauuugcu

SEQ ID NO: 1626947 - RNA, 18 nt, Homo sapiens
aaaauucauuucuaauua

SEQ ID NO: 1626948 - RNA, 19 nt, Homo sapiens
aaaauuuaaaaaaacagac

SEQ ID NO: 1626949 - RNA, 22 nt, Homo sapiens
aaacaaaaaugauccucagugc

SEQ ID NO: 1626950 - RNA, 16 nt, Homo sapiens
aaacaaaugugauaca

SEQ ID NO: 1626951 - RNA, 19 nt, Homo sapiens
aaacacacauugcagcuuc

SEQ ID NO: 1626952 - RNA, 12 nt, Homo sapiens
aaacacuccacc

SEQ ID NO: 1626953 - RNA, 16 nt, Homo sapiens
aaacagaacaggguca

SEQ ID NO: 1626954 - RNA, 20 nt, Homo sapiens
aaacagcucagccagugggg

SEQ ID NO: 1626955 - RNA, 22 nt, Homo sapiens
aaacagucccgcgugcaaagga

SEQ ID NO: 1626956 - RNA, 16 nt, Homo sapiens
aaacaugcacuuccuu

SEQ ID NO: 1626957 - RNA, 23 nt, Homo sapiens
aaacauguuccuuauauuuacuc

SEQ ID NO: 1626958 - RNA, 19 nt, Homo sapiens
aaacauuaguauagucucc

SEQ ID NO: 1626959 - RNA, 19 nt, Homo sapiens
aaacauuuuucacaucucu

SEQ ID NO: 1626960 - RNA, 21 nt, Homo sapiens
aaaccacuucuccaugcugca

SEQ ID NO: 1626961 - RNA, 11 nt, Homo sapiens
aaaccaucaca

SEQ ID NO: 1626962 - RNA, 12 nt, Homo sapiens
aaaccauucuag

SEQ ID NO: 1626963 - RNA, 20 nt, Homo sapiens
aaaccauucuagguguuuca

SEQ ID NO: 1626964 - RNA, 22 nt, Homo sapiens
aaaccauucuuuccccucagga

SEQ ID NO: 1626965 - RNA, 14 nt, Homo sapiens
aaacccagucuccu

SEQ ID NO: 1626966 - RNA, 18 nt, Homo sapiens
aaaccugccaagagucaa

SEQ ID NO: 1626967 - RNA, 19 nt, Homo sapiens
aaaccuggggugaauacuu

SEQ ID NO: 1626968 - RNA, 14 nt, Homo sapiens
aaaccuuguagaua

SEQ ID NO: 1626969 - RNA, 14 nt, Homo sapiens
aaacuccaugcaaa

SEQ ID NO: 1626970 - RNA, 12 nt, Homo sapiens
aaacucucacca

SEQ ID NO: 1626971 - RNA, 20 nt, Homo sapiens
aaacugauuuaucuauuuaa

SEQ ID NO: 1626972 - RNA, 21 nt, Homo sapiens
aaacugcugucccaaacaugc

SEQ ID NO: 1626973 - RNA, 22 nt, Homo sapiens
aaacuuacacuguuucaucuca

SEQ ID NO: 1626974 - RNA, 16 nt, Homo sapiens
aaacuuagaaagggaa

SEQ ID NO: 1626975 - RNA, 23 nt, Homo sapiens
aaacuugaaguagguagcaacgu

SEQ ID NO: 1626976 - RNA, 21 nt, Homo sapiens
aaagaaauaaagggugucuau

SEQ ID NO: 1626977 - RNA, 13 nt, Homo sapiens
aaagaagcuuuau

SEQ ID NO: 1626978 - RNA, 15 nt, Homo sapiens
aaagaauuauuugcc

SEQ ID NO: 1626979 - RNA, 14 nt, Homo sapiens
aaagagaaugagaa

SEQ ID NO: 1626980 - RNA, 18 nt, Homo sapiens
aaagauaaaaauaucauc

SEQ ID NO: 1626981 - RNA, 21 nt, Homo sapiens
aaagaucauuuauaauacugu

SEQ ID NO: 1626982 - RNA, 14 nt, Homo sapiens
aaagcaaguguuca

SEQ ID NO: 1626983 - RNA, 15 nt, Homo sapiens
aaagcaauugugaaa

SEQ ID NO: 1626984 - RNA, 18 nt, Homo sapiens
aaagcagaagaagacaga

SEQ ID NO: 1626985 - RNA, 22 nt, Homo sapiens
aaagcagacagcuccacccugg

SEQ ID NO: 1626986 - RNA, 19 nt, Homo sapiens
aaagcagacuuuugugaac

SEQ ID NO: 1626987 - RNA, 12 nt, Homo sapiens
aaagcagccacg

SEQ ID NO: 1626988 - RNA, 22 nt, Homo sapiens
aaagcagccacgaggugcaaca

SEQ ID NO: 1626989 - RNA, 19 nt, Homo sapiens
aaagccagggucucucccu

SEQ ID NO: 1626990 - RNA, 13 nt, Homo sapiens
aaagcuacuaugu

SEQ ID NO: 1626991 - RNA, 11 nt, Homo sapiens
aaagcuuaaug

SEQ ID NO: 1626992 - RNA, 18 nt, Homo sapiens
aaagcuuuauacaguuga

SEQ ID NO: 1626993 - RNA, 13 nt, Homo sapiens
aaaggaacaaaua

SEQ ID NO: 1626994 - RNA, 19 nt, Homo sapiens
aaaggaaccgcccagugca

SEQ ID NO: 1626995 - RNA, 23 nt, Homo sapiens
aaaggaauuugcauccagcagca

SEQ ID NO: 1626996 - RNA, 22 nt, Homo sapiens
aaaggagccugugaacccagga

SEQ ID NO: 1626997 - RNA, 16 nt, Homo sapiens
aaaggaucagagauuc

SEQ ID NO: 1626998 - RNA, 11 nt, Homo sapiens
aaaggccagac

SEQ ID NO: 1626999 - RNA, 10 nt, Homo sapiens
aaagggaccc

SEQ ID NO: 1627000 - RNA, 12 nt, Homo sapiens
aaagggcacuua

SEQ ID NO: 1627001 - RNA, 16 nt, Homo sapiens
aaagggugucuaucau

SEQ ID NO: 1627002 - RNA, 23 nt, Homo sapiens
aaagguacgauuauacuugagau

SEQ ID NO: 1627003 - RNA, 19 nt, Homo sapiens
aaagguuuuggaucuugaa

SEQ ID NO: 1627004 - RNA, 14 nt, Homo sapiens
aaaguaauuuuguc

SEQ ID NO: 1627005 - RNA, 18 nt, Homo sapiens
aaaguacauauauuuugc

SEQ ID NO: 1627006 - RNA, 21 nt, Homo sapiens
aaagucacccagggacacucc

SEQ ID NO: 1627007 - RNA, 16 nt, Homo sapiens
aaagucacuuccccaa

SEQ ID NO: 1627008 - RNA, 17 nt, Homo sapiens
aaaguuuaaauaccagu

SEQ ID NO: 1627009 - RNA, 18 nt, Homo sapiens
aaauaagcucuccccaaa

SEQ ID NO: 1627010 - RNA, 20 nt, Homo sapiens
aaauacaaucagcccagugc

SEQ ID NO: 1627011 - RNA, 12 nt, Homo sapiens
aaauacaugugu

SEQ ID NO: 1627012 - RNA, 11 nt, Homo sapiens
aaauacuucuu

SEQ ID NO: 1627013 - RNA, 13 nt, Homo sapiens
aaauacuugcaug

SEQ ID NO: 1627014 - RNA, 17 nt, Homo sapiens
aaauaucauaaagcauu

SEQ ID NO: 1627015 - RNA, 18 nt, Homo sapiens
aaauaucuuggccuaaac

SEQ ID NO: 1627016 - RNA, 22 nt, Homo sapiens
aaauaugcucagccacccugug

SEQ ID NO: 1627017 - RNA, 18 nt, Homo sapiens
aaauauuccaagcuucau

SEQ ID NO: 1627018 - RNA, 22 nt, Homo sapiens
aaauauugcucuauguuaguau

SEQ ID NO: 1627019 - RNA, 18 nt, Homo sapiens
aaauauuuuaaacuacug

SEQ ID NO: 1627020 - RNA, 13 nt, Homo sapiens
aaaucaacaugac

SEQ ID NO: 1627021 - RNA, 13 nt, Homo sapiens
aaaucaguauuug

SEQ ID NO: 1627022 - RNA, 21 nt, Homo sapiens
aaauccgaaccuccucuguga

SEQ ID NO: 1627023 - RNA, 14 nt, Homo sapiens
aaauccgccagugu

SEQ ID NO: 1627024 - RNA, 22 nt, Homo sapiens
aaaucuaaaugauuaucuugaa

SEQ ID NO: 1627025 - RNA, 23 nt, Homo sapiens
aaaucucuacugcuuuggauccu

SEQ ID NO: 1627026 - RNA, 23 nt, Homo sapiens
aaaucuguaucuguagugagaua

SEQ ID NO: 1627027 - RNA, 22 nt, Homo sapiens
aaauguauugauucaacaggga

SEQ ID NO: 1627028 - RNA, 21 nt, Homo sapiens
aaauguuuaauaaagcuuuau

SEQ ID NO: 1627029 - RNA, 23 nt, Homo sapiens
aaauuaaacgguaacauccaaaa

SEQ ID NO: 1627030 - RNA, 14 nt, Homo sapiens
aaauuaagacuuua

SEQ ID NO: 1627031 - RNA, 20 nt, Homo sapiens
aaauuagccacauguacacu

SEQ ID NO: 1627032 - RNA, 21 nt, Homo sapiens
aaauuauuuuuguucauauaa

SEQ ID NO: 1627033 - RNA, 19 nt, Homo sapiens
aaauuccacacuaccacau

SEQ ID NO: 1627034 - RNA, 19 nt, Homo sapiens
aaauuccacagauuaucaa

SEQ ID NO: 1627035 - RNA, 17 nt, Homo sapiens
aaauugaacuucaggga

SEQ ID NO: 1627036 - RNA, 18 nt, Homo sapiens
aaauuucuucugguagug

SEQ ID NO: 1627037 - RNA, 15 nt, Homo sapiens
aacaaacccaaaggu

SEQ ID NO: 1627038 - RNA, 19 nt, Homo sapiens
auagacuuaauacaugcaa

SEQ ID NO: 1627039 - RNA, 21 nt, Homo sapiens
auagagcaaaaucaacaugac

SEQ ID NO: 1627040 - RNA, 18 nt, Homo sapiens
auagagggccacggggag

SEQ ID NO: 1627041 - RNA, 16 nt, Homo sapiens
auagccauugaucaua

SEQ ID NO: 1627042 - RNA, 23 nt, Homo sapiens
auagccuguggccuuugcaauuu

SEQ ID NO: 1627043 - RNA, 20 nt, Homo sapiens
auaguagauuuuaaagacaa

SEQ ID NO: 1627044 - RNA, 23 nt, Homo sapiens
auagugcugcaauaaacauaugu

SEQ ID NO: 1627045 - RNA, 13 nt, Homo sapiens
auaguuaugugau

SEQ ID NO: 1627046 - RNA, 18 nt, Homo sapiens
auaguuaugugauuuucc

SEQ ID NO: 1627047 - RNA, 14 nt, Homo sapiens
auaguuauuaucca

SEQ ID NO: 1627048 - RNA, 18 nt, Homo sapiens
auaguuggucaucuagca

SEQ ID NO: 1627049 - RNA, 15 nt, Homo sapiens
auauauauauacuua

SEQ ID NO: 1627050 - RNA, 13 nt, Homo sapiens
auauaugucucuu

SEQ ID NO: 1627051 - RNA, 19 nt, Homo sapiens
auauauguguauacauaca

SEQ ID NO: 1627052 - RNA, 18 nt, Homo sapiens
auaucaaaucuaccacug

SEQ ID NO: 1627053 - RNA, 21 nt, Homo sapiens
auaucauucuuuguaucuuaa

SEQ ID NO: 1627054 - RNA, 21 nt, Homo sapiens
auaucauuuuaaaaacuuuau

SEQ ID NO: 1627055 - RNA, 22 nt, Homo sapiens
auaucauuuuaaaaacuuuauu

SEQ ID NO: 1627056 - RNA, 12 nt, Homo sapiens
auaucuaaaaac

SEQ ID NO: 1627057 - RNA, 13 nt, Homo sapiens
auaucuaaaaacu

SEQ ID NO: 1627058 - RNA, 18 nt, Homo sapiens
auaucuggguuaaguguu

SEQ ID NO: 1627059 - RNA, 16 nt, Homo sapiens
auauggacucugcaca

SEQ ID NO: 1627060 - RNA, 20 nt, Homo sapiens
auauggggaaaaaacugugc

SEQ ID NO: 1627061 - RNA, 22 nt, Homo sapiens
auauguaauuucaaaauacauu

SEQ ID NO: 1627062 - RNA, 15 nt, Homo sapiens
auauguacuugucaa

SEQ ID NO: 1627063 - RNA, 15 nt, Homo sapiens
auauguccacuguuc

SEQ ID NO: 1627064 - RNA, 23 nt, Homo sapiens
auauguccacuguucuguucuca

SEQ ID NO: 1627065 - RNA, 12 nt, Homo sapiens
auaugugucagu

SEQ ID NO: 1627066 - RNA, 14 nt, Homo sapiens
auauguucaggaaa

SEQ ID NO: 1627067 - RNA, 21 nt, Homo sapiens
auauuaacaacaauaacacug

SEQ ID NO: 1627068 - RNA, 13 nt, Homo sapiens
auauuaguauuaa

SEQ ID NO: 1627069 - RNA, 18 nt, Homo sapiens
auauucuauuaacuuuaa

SEQ ID NO: 1627070 - RNA, 13 nt, Homo sapiens
auauuuacuaccu

SEQ ID NO: 1627071 - RNA, 20 nt, Homo sapiens
auauuuauuuaacuauucau

SEQ ID NO: 1627072 - RNA, 20 nt, Homo sapiens
auauuuuaccauacauuuaa

SEQ ID NO: 1627073 - RNA, 16 nt, Homo sapiens
auauuuuuagccuaaa

SEQ ID NO: 1627074 - RNA, 22 nt, Homo sapiens
auauuuuuaguagagacagggu

SEQ ID NO: 1627075 - RNA, 14 nt, Homo sapiens
aucaaaaaguaauu

SEQ ID NO: 1627076 - RNA, 14 nt, Homo sapiens
aucaaaaaguauua

SEQ ID NO: 1627077 - RNA, 15 nt, Homo sapiens
aucaaaggcacacag

SEQ ID NO: 1627078 - RNA, 13 nt, Homo sapiens
aucaacaugacug

SEQ ID NO: 1627079 - RNA, 20 nt, Homo sapiens
aucaacgccucacugaaaca

SEQ ID NO: 1627080 - RNA, 15 nt, Homo sapiens
aucaagaacauguca

SEQ ID NO: 1627081 - RNA, 20 nt, Homo sapiens
aucaagaacaugucagcaau

SEQ ID NO: 1627082 - RNA, 16 nt, Homo sapiens
aucaagagaaacuuca

SEQ ID NO: 1627083 - RNA, 21 nt, Homo sapiens
aucaauaaauguugcaaugca

SEQ ID NO: 1627084 - RNA, 19 nt, Homo sapiens
aucaauacugcacacugca

SEQ ID NO: 1627085 - RNA, 22 nt, Homo sapiens
aucaauacugcacacugcacau

SEQ ID NO: 1627086 - RNA, 21 nt, Homo sapiens
aucacauucuguuuaucaagc

SEQ ID NO: 1627087 - RNA, 15 nt, Homo sapiens
aucaccauauuguaa

SEQ ID NO: 1627088 - RNA, 17 nt, Homo sapiens
aucacgggucacuugaa

SEQ ID NO: 1627089 - RNA, 23 nt, Homo sapiens
aucacucaagaugccuccuguca

SEQ ID NO: 1627090 - RNA, 19 nt, Homo sapiens
aucacucauucuaugaaca

SEQ ID NO: 1627091 - RNA, 22 nt, Homo sapiens
aucacucugugucugaguggcu

SEQ ID NO: 1627092 - RNA, 15 nt, Homo sapiens
aucagaaaaguaauu

SEQ ID NO: 1627093 - RNA, 14 nt, Homo sapiens
aucagaauaggaag

SEQ ID NO: 1627094 - RNA, 14 nt, Homo sapiens
aucagcacauauuu

SEQ ID NO: 1627095 - RNA, 15 nt, Homo sapiens
aucagccagcaagag

SEQ ID NO: 1627096 - RNA, 22 nt, Homo sapiens
aucaggauccagucuggaaaac

SEQ ID NO: 1627097 - RNA, 23 nt, Homo sapiens
aucagucauuucuucauguacag

SEQ ID NO: 1627098 - RNA, 19 nt, Homo sapiens
aucauaaacugacuaucau

SEQ ID NO: 1627099 - RNA, 17 nt, Homo sapiens
aucauauguauauguca

SEQ ID NO: 1627100 - RNA, 21 nt, Homo sapiens
aucauauuaguauuaauacua

SEQ ID NO: 1627101 - RNA, 16 nt, Homo sapiens
aucauuccauuuugcu

SEQ ID NO: 1627102 - RNA, 23 nt, Homo sapiens
auccaaaaauguguaagaacaac

SEQ ID NO: 1627103 - RNA, 20 nt, Homo sapiens
auccauaaagaagcaauaaa

SEQ ID NO: 1627104 - RNA, 22 nt, Homo sapiens
auccaugccugggaaaugccac

SEQ ID NO: 1627105 - RNA, 12 nt, Homo sapiens
aucccaaccagu

SEQ ID NO: 1627106 - RNA, 12 nt, Homo sapiens
aucccagcacuu

SEQ ID NO: 1627107 - RNA, 14 nt, Homo sapiens
auccccacccaguc

SEQ ID NO: 1627108 - RNA, 17 nt, Homo sapiens
auccccacccagucuca

SEQ ID NO: 1627109 - RNA, 17 nt, Homo sapiens
auccccuggcuccagag

SEQ ID NO: 1627110 - RNA, 20 nt, Homo sapiens
auccccuguguggucuccau

SEQ ID NO: 1627111 - RNA, 21 nt, Homo sapiens
aucccggcugucaaggggugu

SEQ ID NO: 1627112 - RNA, 12 nt, Homo sapiens
aucccugagauc

SEQ ID NO: 1627113 - RNA, 15 nt, Homo sapiens
aucccuggaaggaca

SEQ ID NO: 1627114 - RNA, 18 nt, Homo sapiens
aucccuguaauauuuagc

SEQ ID NO: 1627115 - RNA, 19 nt, Homo sapiens
auccgaaccuccucuguga

SEQ ID NO: 1627116 - RNA, 20 nt, Homo sapiens
auccgaaccuccucugugaa

SEQ ID NO: 1627117 - RNA, 16 nt, Homo sapiens
auccgcccaccucagc

SEQ ID NO: 1627118 - RNA, 22 nt, Homo sapiens
auccuaaauaaaaaaagacaaa

SEQ ID NO: 1627119 - RNA, 21 nt, Homo sapiens
auccucucccauggagacaag

SEQ ID NO: 1627120 - RNA, 21 nt, Homo sapiens
auccugcaaggggacauucca

SEQ ID NO: 1627121 - RNA, 18 nt, Homo sapiens
auccugcagggcuucucc

SEQ ID NO: 1627122 - RNA, 23 nt, Homo sapiens
auccugccauccuugacuuugaa

SEQ ID NO: 1627123 - RNA, 11 nt, Homo sapiens
auccugugaag

SEQ ID NO: 1627124 - RNA, 20 nt, Homo sapiens
auccuuaacacauucaauag

SEQ ID NO: 1627125 - RNA, 22 nt, Homo sapiens
auccuuguuuugaaaaccuaaa

SEQ ID NO: 1627126 - RNA, 13 nt, Homo sapiens
auccuuuuaucuc

SEQ ID NO: 1627127 - RNA, 15 nt, Homo sapiens
aucgaugacgggcug

SEQ ID NO: 1627128 - RNA, 23 nt, Homo sapiens
aucgauggaugggaugcacucuc

SEQ ID NO: 1627129 - RNA, 14 nt, Homo sapiens
aucuaaaaacuuag

SEQ ID NO: 1627130 - RNA, 17 nt, Homo sapiens
aucuaaaaacuuagaaa

SEQ ID NO: 1627131 - RNA, 18 nt, Homo sapiens
aucuacauuaaaaugaca

SEQ ID NO: 1627132 - RNA, 15 nt, Homo sapiens
aucuaucaacuauaa

SEQ ID NO: 1627133 - RNA, 18 nt, Homo sapiens
aucucaacucacugcaag

SEQ ID NO: 1627134 - RNA, 13 nt, Homo sapiens
aucucacaaauaa

SEQ ID NO: 1627135 - RNA, 22 nt, Homo sapiens
aucucaugccccuggcugggac

SEQ ID NO: 1627136 - RNA, 20 nt, Homo sapiens
aucucggcucacugcaagcu

SEQ ID NO: 1627137 - RNA, 19 nt, Homo sapiens
aucucggcucagugcaacc

SEQ ID NO: 1627138 - RNA, 18 nt, Homo sapiens
aucucugaauuugagaua

SEQ ID NO: 1627139 - RNA, 17 nt, Homo sapiens
aucucugugaaaccccu

SEQ ID NO: 1627140 - RNA, 18 nt, Homo sapiens
aucugcaaacaugccagg

SEQ ID NO: 1627141 - RNA, 15 nt, Homo sapiens
aucugcaccuagaac

SEQ ID NO: 1627142 - RNA, 17 nt, Homo sapiens
aucugccagaccugcau

SEQ ID NO: 1627143 - RNA, 23 nt, Homo sapiens
aucuggaagccaccucaccaagg

SEQ ID NO: 1627144 - RNA, 22 nt, Homo sapiens
aucuggucugaauaacacugga

SEQ ID NO: 1627145 - RNA, 18 nt, Homo sapiens
aucugguuaaugacauac

SEQ ID NO: 1627146 - RNA, 19 nt, Homo sapiens
aucugucugcucugcauau

SEQ ID NO: 1627147 - RNA, 15 nt, Homo sapiens
aucuguuuuuggaca

SEQ ID NO: 1627148 - RNA, 22 nt, Homo sapiens
aucuucccuuuauuacaagaag

SEQ ID NO: 1627149 - RNA, 17 nt, Homo sapiens
ugcuuucaugaccaucc

SEQ ID NO: 1627150 - RNA, 15 nt, Homo sapiens
ugcuuugcaaagacc

SEQ ID NO: 1627151 - RNA, 18 nt, Homo sapiens
ugcuuuguaggugucuca

SEQ ID NO: 1627152 - RNA, 18 nt, Homo sapiens
ugcuuuuugcguacacag

SEQ ID NO: 1627153 - RNA, 16 nt, Homo sapiens
ugcuuuuuuucuacug

SEQ ID NO: 1627154 - RNA, 15 nt, Homo sapiens
uggaaaacuguguug

SEQ ID NO: 1627155 - RNA, 12 nt, Homo sapiens
uggaaaaugcau

SEQ ID NO: 1627156 - RNA, 13 nt, Homo sapiens
uggaaacuucugu

SEQ ID NO: 1627157 - RNA, 23 nt, Homo sapiens
uggaaagauuuuguccagaagaa

SEQ ID NO: 1627158 - RNA, 19 nt, Homo sapiens
uggaaaucaauacugcaca

SEQ ID NO: 1627159 - RNA, 19 nt, Homo sapiens
uggaaaucuuuuacauuuu

SEQ ID NO: 1627160 - RNA, 19 nt, Homo sapiens
uggaacacggccacaucaa

SEQ ID NO: 1627161 - RNA, 23 nt, Homo sapiens
uggaacgcuaaugaaacacagcu

SEQ ID NO: 1627162 - RNA, 16 nt, Homo sapiens
uggaagagcacaagag

SEQ ID NO: 1627163 - RNA, 15 nt, Homo sapiens
uggaaggcagacagc

SEQ ID NO: 1627164 - RNA, 19 nt, Homo sapiens
uggaaguaguaauugcaag

SEQ ID NO: 1627165 - RNA, 21 nt, Homo sapiens
uggaaucacaaaccaagccau

SEQ ID NO: 1627166 - RNA, 17 nt, Homo sapiens
uggaauccuauauagaa

SEQ ID NO: 1627167 - RNA, 22 nt, Homo sapiens
uggaaugggggugugggggucc

SEQ ID NO: 1627168 - RNA, 18 nt, Homo sapiens
uggacagaaaaugcaaug

SEQ ID NO: 1627169 - RNA, 22 nt, Homo sapiens
uggacaggaggcccccaucuau

SEQ ID NO: 1627170 - RNA, 15 nt, Homo sapiens
uggacauaacauuuu

SEQ ID NO: 1627171 - RNA, 16 nt, Homo sapiens
uggacauagagaggga

SEQ ID NO: 1627172 - RNA, 18 nt, Homo sapiens
uggacauuuuuucaguca

SEQ ID NO: 1627173 - RNA, 17 nt, Homo sapiens
uggacucugcacauguc

SEQ ID NO: 1627174 - RNA, 13 nt, Homo sapiens
uggacucuuccac

SEQ ID NO: 1627175 - RNA, 19 nt, Homo sapiens
uggacugccuuauugcugu

SEQ ID NO: 1627176 - RNA, 14 nt, Homo sapiens
uggagaaagagcug

SEQ ID NO: 1627177 - RNA, 22 nt, Homo sapiens
uggagacaagggcaucaucuau

SEQ ID NO: 1627178 - RNA, 20 nt, Homo sapiens
uggagacaaggugcuaacau

SEQ ID NO: 1627179 - RNA, 18 nt, Homo sapiens
uggagagaagcucuucaa

SEQ ID NO: 1627180 - RNA, 21 nt, Homo sapiens
uggagagccccucacacagcc

SEQ ID NO: 1627181 - RNA, 21 nt, Homo sapiens
uggagaucagaaagugacauu

SEQ ID NO: 1627182 - RNA, 14 nt, Homo sapiens
uggagcaaaccauu

SEQ ID NO: 1627183 - RNA, 19 nt, Homo sapiens
uggagcaggagccccgcca

SEQ ID NO: 1627184 - RNA, 13 nt, Homo sapiens
uggaggaccugag

SEQ ID NO: 1627185 - RNA, 20 nt, Homo sapiens
uggaggguguucggggccca

SEQ ID NO: 1627186 - RNA, 19 nt, Homo sapiens
uggaguagagguacuagaa

SEQ ID NO: 1627187 - RNA, 22 nt, Homo sapiens
uggaguagccuggacuguuuca

SEQ ID NO: 1627188 - RNA, 17 nt, Homo sapiens
uggaguucuugugccau

SEQ ID NO: 1627189 - RNA, 14 nt, Homo sapiens
uggauagcauuguu

SEQ ID NO: 1627190 - RNA, 16 nt, Homo sapiens
uggauccugggucaaa

SEQ ID NO: 1627191 - RNA, 14 nt, Homo sapiens
uggcacuaauauaa

SEQ ID NO: 1627192 - RNA, 16 nt, Homo sapiens
uggcacucuguaguca

SEQ ID NO: 1627193 - RNA, 12 nt, Homo sapiens
uggcaugaucuc

SEQ ID NO: 1627194 - RNA, 18 nt, Homo sapiens
uggcauguugauuucuau

SEQ ID NO: 1627195 - RNA, 20 nt, Homo sapiens
uggccacaguaauuggucau

SEQ ID NO: 1627196 - RNA, 19 nt, Homo sapiens
uggccaggccuaguaacca

SEQ ID NO: 1627197 - RNA, 15 nt, Homo sapiens
uggcccauaauguga

SEQ ID NO: 1627198 - RNA, 18 nt, Homo sapiens
uggcccccaccgcugugg

SEQ ID NO: 1627199 - RNA, 13 nt, Homo sapiens
uggccuaugcaca

SEQ ID NO: 1627200 - RNA, 16 nt, Homo sapiens
uggccuaugcacauau

SEQ ID NO: 1627201 - RNA, 22 nt, Homo sapiens
uggccuaugcacauauggacuc

SEQ ID NO: 1627202 - RNA, 20 nt, Homo sapiens
uggccucccuuugugugcau

SEQ ID NO: 1627203 - RNA, 13 nt, Homo sapiens
uggccuggcacac

SEQ ID NO: 1627204 - RNA, 18 nt, Homo sapiens
uggcucaagucugcacag

SEQ ID NO: 1627205 - RNA, 21 nt, Homo sapiens
uggcugacaguaacagcaucu

SEQ ID NO: 1627206 - RNA, 14 nt, Homo sapiens
uggcugacuguugc

SEQ ID NO: 1627207 - RNA, 20 nt, Homo sapiens
uggcuucagcccccaccagg

SEQ ID NO: 1627208 - RNA, 11 nt, Homo sapiens
uggcuuucaua

SEQ ID NO: 1627209 - RNA, 19 nt, Homo sapiens
ugggaaugaaauuaacaca

SEQ ID NO: 1627210 - RNA, 19 nt, Homo sapiens
ugggacacaacacagauaa

SEQ ID NO: 1627211 - RNA, 13 nt, Homo sapiens
ugggacagggcaa

SEQ ID NO: 1627212 - RNA, 23 nt, Homo sapiens
ugggacccaaggaucggggggcc

SEQ ID NO: 1627213 - RNA, 16 nt, Homo sapiens
ugggaccccagcugcu

SEQ ID NO: 1627214 - RNA, 18 nt, Homo sapiens
ugggaccccagcugcucu

SEQ ID NO: 1627215 - RNA, 15 nt, Homo sapiens
ugggagcaccgccug

SEQ ID NO: 1627216 - RNA, 17 nt, Homo sapiens
ugggagggaaaagggaa

SEQ ID NO: 1627217 - RNA, 17 nt, Homo sapiens
ugggaguuuugcucucu

SEQ ID NO: 1627218 - RNA, 14 nt, Homo sapiens
ugggauauucccaa

SEQ ID NO: 1627219 - RNA, 18 nt, Homo sapiens
ugggauguccaccacagu

SEQ ID NO: 1627220 - RNA, 13 nt, Homo sapiens
ugggcacuggccc

SEQ ID NO: 1627221 - RNA, 15 nt, Homo sapiens
ugggccacaacuguc

SEQ ID NO: 1627222 - RNA, 17 nt, Homo sapiens
ugggccccucucauucc

SEQ ID NO: 1627223 - RNA, 21 nt, Homo sapiens
ugggcucgccacaucccauga

SEQ ID NO: 1627224 - RNA, 23 nt, Homo sapiens
ugggcucugccuuaaacacacau

SEQ ID NO: 1627225 - RNA, 20 nt, Homo sapiens
ugggcuuaaguuuuacuuga

SEQ ID NO: 1627226 - RNA, 18 nt, Homo sapiens
uggggacauacacuugca

SEQ ID NO: 1627227 - RNA, 23 nt, Homo sapiens
uggggagaggggagugcauuuag

SEQ ID NO: 1627228 - RNA, 12 nt, Homo sapiens
uggggaggacaa

SEQ ID NO: 1627229 - RNA, 18 nt, Homo sapiens
uggggagggagguguuua

SEQ ID NO: 1627230 - RNA, 20 nt, Homo sapiens
uggggccccuaagcuccuag

SEQ ID NO: 1627231 - RNA, 11 nt, Homo sapiens
uggggccugua

SEQ ID NO: 1627232 - RNA, 16 nt, Homo sapiens
uggggccuguggaaug

SEQ ID NO: 1627233 - RNA, 15 nt, Homo sapiens
uggggucuuuuuaug

SEQ ID NO: 1627234 - RNA, 22 nt, Homo sapiens
uggguaaccagucccaggugaa

SEQ ID NO: 1627235 - RNA, 11 nt, Homo sapiens
uggguauuucu

SEQ ID NO: 1627236 - RNA, 19 nt, Homo sapiens
uggguauuucuuggcaugc

SEQ ID NO: 1627237 - RNA, 17 nt, Homo sapiens
ugggucuaggacacagu

SEQ ID NO: 1627238 - RNA, 14 nt, Homo sapiens
uggguggaaagugc

SEQ ID NO: 1627239 - RNA, 20 nt, Homo sapiens
ugguaaaacucacugugauc

SEQ ID NO: 1627240 - RNA, 12 nt, Homo sapiens
ugguaugaaggu

SEQ ID NO: 1627241 - RNA, 23 nt, Homo sapiens
ugguauucaacuaauacaugguu

SEQ ID NO: 1627242 - RNA, 16 nt, Homo sapiens
uggucaaucaguguua

SEQ ID NO: 1627243 - RNA, 15 nt, Homo sapiens
uggucauuuggcagc

SEQ ID NO: 1627244 - RNA, 23 nt, Homo sapiens
uggucugaagaaggaaggccuga

SEQ ID NO: 1627245 - RNA, 19 nt, Homo sapiens
uggucuuuccaucuaucac

SEQ ID NO: 1627246 - RNA, 19 nt, Homo sapiens
uggugagaugcagcuggaa

SEQ ID NO: 1627247 - RNA, 21 nt, Homo sapiens
uggugagcuuaacccuggaaa

SEQ ID NO: 1627248 - RNA, 15 nt, Homo sapiens
uggugcugcucugug

SEQ ID NO: 1627249 - RNA, 18 nt, Homo sapiens
ugguggaacaaccugcug

SEQ ID NO: 1627250 - RNA, 18 nt, Homo sapiens
ugguggccuaauuuacaa

SEQ ID NO: 1627251 - RNA, 14 nt, Homo sapiens
ugguucaucccuuu

SEQ ID NO: 1627252 - RNA, 14 nt, Homo sapiens
ugguuuuugagcca

SEQ ID NO: 1627253 - RNA, 14 nt, Homo sapiens
uguaaacaaaccac

SEQ ID NO: 1627254 - RNA, 22 nt, Homo sapiens
uguaaacugaauauaaagcuua

SEQ ID NO: 1627255 - RNA, 13 nt, Homo sapiens
uguaaccacugca

SEQ ID NO: 1627256 - RNA, 17 nt, Homo sapiens
uguaacuuaacuauuaa

SEQ ID NO: 1627257 - RNA, 22 nt, Homo sapiens
uguaaggggaagagggaaaugu

SEQ ID NO: 1627258 - RNA, 14 nt, Homo sapiens
uguaaguuuaccua

SEQ ID NO: 1627259 - RNA, 12 nt, Homo sapiens
uaaaaaagcauu

SEQ ID NO: 1627260 - RNA, 18 nt, Homo sapiens
uaaaaaccuuguagauag

SEQ ID NO: 1627261 - RNA, 13 nt, Homo sapiens
uaaaaacuuuauu

SEQ ID NO: 1627262 - RNA, 17 nt, Homo sapiens
uaaaaaggaaaacagac

SEQ ID NO: 1627263 - RNA, 15 nt, Homo sapiens
uaaaaauaaagggaa

SEQ ID NO: 1627264 - RNA, 19 nt, Homo sapiens
uaaaaauauagcaaaugca

SEQ ID NO: 1627265 - RNA, 12 nt, Homo sapiens
uaaaaaugcaaa

SEQ ID NO: 1627266 - RNA, 11 nt, Homo sapiens
uaaaacaaaga

SEQ ID NO: 1627267 - RNA, 20 nt, Homo sapiens
uaaaacagaagccugaugcu

SEQ ID NO: 1627268 - RNA, 20 nt, Homo sapiens
uaaaacauugguuauauuac

SEQ ID NO: 1627269 - RNA, 16 nt, Homo sapiens
uaaaacucacugugau

SEQ ID NO: 1627270 - RNA, 15 nt, Homo sapiens
uaaaacucuacagau

SEQ ID NO: 1627271 - RNA, 18 nt, Homo sapiens
uaaaacuuaaaucucacu

SEQ ID NO: 1627272 - RNA, 14 nt, Homo sapiens
uaaaacuuuauuaa

SEQ ID NO: 1627273 - RNA, 15 nt, Homo sapiens
uaaaagaaugacuau

SEQ ID NO: 1627274 - RNA, 23 nt, Homo sapiens
uaaaagcuacuauguacugccuu

SEQ ID NO: 1627275 - RNA, 19 nt, Homo sapiens
uaaaagcuauggugagaug

SEQ ID NO: 1627276 - RNA, 22 nt, Homo sapiens
uaaaaguuuuuuauuaugcauu

SEQ ID NO: 1627277 - RNA, 22 nt, Homo sapiens
uaaaauaaaaaggaaaacagac

SEQ ID NO: 1627278 - RNA, 13 nt, Homo sapiens
uaaaauaacacuu

SEQ ID NO: 1627279 - RNA, 18 nt, Homo sapiens
uaaaauaacuaagcaagu

SEQ ID NO: 1627280 - RNA, 21 nt, Homo sapiens
uaaaauauaauuuucaaaaag

SEQ ID NO: 1627281 - RNA, 19 nt, Homo sapiens
uaaaauauuuaaugugaca

SEQ ID NO: 1627282 - RNA, 18 nt, Homo sapiens
uaaaaugaacaucucuug

SEQ ID NO: 1627283 - RNA, 20 nt, Homo sapiens
uaaaaugaaggguguggggu

SEQ ID NO: 1627284 - RNA, 17 nt, Homo sapiens
uaaaauucucauuacuc

SEQ ID NO: 1627285 - RNA, 16 nt, Homo sapiens
uaaaauugaguuugua

SEQ ID NO: 1627286 - RNA, 22 nt, Homo sapiens
uaaacaaaugugauacauuuaa

SEQ ID NO: 1627287 - RNA, 20 nt, Homo sapiens
uaaacaagucaauucugugu

SEQ ID NO: 1627288 - RNA, 20 nt, Homo sapiens
uaaacauuuuucacaucucu

SEQ ID NO: 1627289 - RNA, 23 nt, Homo sapiens
uaaaccaaugucauaacaggcau

SEQ ID NO: 1627290 - RNA, 13 nt, Homo sapiens
uaaaccacuaaaa

SEQ ID NO: 1627291 - RNA, 22 nt, Homo sapiens
uaaaccagggaugucuguugaa

SEQ ID NO: 1627292 - RNA, 22 nt, Homo sapiens
uaaacuaggauugacauucuac

SEQ ID NO: 1627293 - RNA, 14 nt, Homo sapiens
uaaacuccauuuaa

SEQ ID NO: 1627294 - RNA, 20 nt, Homo sapiens
uaaagaaaaucucugugaaa

SEQ ID NO: 1627295 - RNA, 20 nt, Homo sapiens
uaaagacugguuuucugcca

SEQ ID NO: 1627296 - RNA, 14 nt, Homo sapiens
uaaagcacuaccua

SEQ ID NO: 1627297 - RNA, 15 nt, Homo sapiens
uaaagcacuaccuaa

SEQ ID NO: 1627298 - RNA, 16 nt, Homo sapiens
uaaagggacacuuuua

SEQ ID NO: 1627299 - RNA, 12 nt, Homo sapiens
uaaagugcugcg

SEQ ID NO: 1627300 - RNA, 23 nt, Homo sapiens
uaaaguuuaaauaccaguacuug

SEQ ID NO: 1627301 - RNA, 17 nt, Homo sapiens
uaaauaccagacacgua

SEQ ID NO: 1627302 - RNA, 18 nt, Homo sapiens
uaaauaccaguacuugag

SEQ ID NO: 1627303 - RNA, 23 nt, Homo sapiens
uaaauagugucauauaaacucau

SEQ ID NO: 1627304 - RNA, 22 nt, Homo sapiens
uaaauaguuacuccagugccaa

SEQ ID NO: 1627305 - RNA, 21 nt, Homo sapiens
uaaauauuagaagccugcaga

SEQ ID NO: 1627306 - RNA, 22 nt, Homo sapiens
uaaauauuuauuuaacuauuca

SEQ ID NO: 1627307 - RNA, 17 nt, Homo sapiens
uaaaucauauuaguauu

SEQ ID NO: 1627308 - RNA, 17 nt, Homo sapiens
uaaauccaugguguuau

SEQ ID NO: 1627309 - RNA, 16 nt, Homo sapiens
uaaauccuaccaaagu

SEQ ID NO: 1627310 - RNA, 18 nt, Homo sapiens
uaaauguugcaaugcaug

SEQ ID NO: 1627311 - RNA, 15 nt, Homo sapiens
uaaauuccacagauu

SEQ ID NO: 1627312 - RNA, 16 nt, Homo sapiens
uaaauuccacagauua

SEQ ID NO: 1627313 - RNA, 23 nt, Homo sapiens
uaaauugggaaaacuccaucaau

SEQ ID NO: 1627314 - RNA, 20 nt, Homo sapiens
uaaauuuggcuucuguuguc

SEQ ID NO: 1627315 - RNA, 15 nt, Homo sapiens
uaacaaacuagucag

SEQ ID NO: 1627316 - RNA, 14 nt, Homo sapiens
uaacacauucaaua

SEQ ID NO: 1627317 - RNA, 23 nt, Homo sapiens
uaacacuggauuuguuucuguga

SEQ ID NO: 1627318 - RNA, 10 nt, Homo sapiens
uaacagagag

SEQ ID NO: 1627319 - RNA, 20 nt, Homo sapiens
uaacagaugcaaugugcuac

SEQ ID NO: 1627320 - RNA, 14 nt, Homo sapiens
uaacagcaucuuua

SEQ ID NO: 1627321 - RNA, 13 nt, Homo sapiens
uaacaugcaccuu

SEQ ID NO: 1627322 - RNA, 24 nt, Homo sapiens
uaaccaaggaaauauauuuuacca

SEQ ID NO: 1627323 - RNA, 19 nt, Homo sapiens
uaacccaagacaugacauu

SEQ ID NO: 1627324 - RNA, 13 nt, Homo sapiens
uaacccucucuug

SEQ ID NO: 1627325 - RNA, 16 nt, Homo sapiens
uaacgcagucuaauua

SEQ ID NO: 1627326 - RNA, 18 nt, Homo sapiens
uaacgccagcacacuauu

SEQ ID NO: 1627327 - RNA, 14 nt, Homo sapiens
uaacguggcacugg

SEQ ID NO: 1627328 - RNA, 20 nt, Homo sapiens
uaacuaugagcuugcucauu

SEQ ID NO: 1627329 - RNA, 20 nt, Homo sapiens
uaacucccuccaccagccug

SEQ ID NO: 1627330 - RNA, 15 nt, Homo sapiens
uaacucugcccaccc

SEQ ID NO: 1627331 - RNA, 22 nt, Homo sapiens
uaacucugcccacccuccugua

SEQ ID NO: 1627332 - RNA, 18 nt, Homo sapiens
uaacucuguauuacagcu

SEQ ID NO: 1627333 - RNA, 16 nt, Homo sapiens
uaacuguacauuucac

SEQ ID NO: 1627334 - RNA, 20 nt, Homo sapiens
uaacuguaugggagcuuaac

SEQ ID NO: 1627335 - RNA, 14 nt, Homo sapiens
uaacugugugagau

SEQ ID NO: 1627336 - RNA, 22 nt, Homo sapiens
uaagaaccacucauaauucuuc

SEQ ID NO: 1627337 - RNA, 14 nt, Homo sapiens
uaagacacauugac

SEQ ID NO: 1627338 - RNA, 23 nt, Homo sapiens
uaagaccaccuucccuuccucag

SEQ ID NO: 1627339 - RNA, 20 nt, Homo sapiens
uaagacucucgcaucuuccc

SEQ ID NO: 1627340 - RNA, 14 nt, Homo sapiens
uaagaucagacucu

SEQ ID NO: 1627341 - RNA, 16 nt, Homo sapiens
uaagauuaauuuucuc

SEQ ID NO: 1627342 - RNA, 14 nt, Homo sapiens
uaagcauacuuugu

SEQ ID NO: 1627343 - RNA, 21 nt, Homo sapiens
uaagcaucugccaucugcuuu

SEQ ID NO: 1627344 - RNA, 14 nt, Homo sapiens
uaagcccacuguua

SEQ ID NO: 1627345 - RNA, 14 nt, Homo sapiens
uaagcuuuucauua

SEQ ID NO: 1627346 - RNA, 12 nt, Homo sapiens
uaaggagcaaaa

SEQ ID NO: 1627347 - RNA, 19 nt, Homo sapiens
uaaggcccucuugaaucuc

SEQ ID NO: 1627348 - RNA, 15 nt, Homo sapiens
uaagggcuacuuaau

SEQ ID NO: 1627349 - RNA, 16 nt, Homo sapiens
uaagguuucaacaaau

SEQ ID NO: 1627350 - RNA, 15 nt, Homo sapiens
uaaguggacuggugu

SEQ ID NO: 1627351 - RNA, 20 nt, Homo sapiens
uaaguggacuggugucauaa

SEQ ID NO: 1627352 - RNA, 15 nt, Homo sapiens
uaaguuugaaaggaa

SEQ ID NO: 1627353 - RNA, 13 nt, Homo sapiens
uaauaauggaaug

SEQ ID NO: 1627354 - RNA, 15 nt, Homo sapiens
uaauaaugggagacu

SEQ ID NO: 1627355 - RNA, 15 nt, Homo sapiens
uaauacagacaucua

SEQ ID NO: 1627356 - RNA, 17 nt, Homo sapiens
uaauauaagcugccaua

SEQ ID NO: 1627357 - RNA, 14 nt, Homo sapiens
uaauauaguagauu

SEQ ID NO: 1627358 - RNA, 23 nt, Homo sapiens
uaauauguuuaguuuuacauuuu

SEQ ID NO: 1627359 - RNA, 19 nt, Homo sapiens
uaaucaaaaagaagacauu

SEQ ID NO: 1627360 - RNA, 17 nt, Homo sapiens
uaaucagucauuucuuc

SEQ ID NO: 1627361 - RNA, 13 nt, Homo sapiens
uaaucccagcacu

SEQ ID NO: 1627362 - RNA, 11 nt, Homo sapiens
uaauccuuaac

SEQ ID NO: 1627363 - RNA, 18 nt, Homo sapiens
uaauccuuaacacauuca

SEQ ID NO: 1627364 - RNA, 20 nt, Homo sapiens
uaauccuucuggcagauuca

SEQ ID NO: 1627365 - RNA, 16 nt, Homo sapiens
uaaucuucucucuuga

SEQ ID NO: 1627366 - RNA, 22 nt, Homo sapiens
uaaugaagaaucacgauuucau

SEQ ID NO: 1627367 - RNA, 19 nt, Homo sapiens
uaaugcucaacaauuuauc

SEQ ID NO: 1627368 - RNA, 16 nt, Homo sapiens
uaaugcucgucugugu

SEQ ID NO: 1627369 - RNA, 14 nt, Homo sapiens
gugaagagaagcaa

SEQ ID NO: 1627370 - RNA, 22 nt, Homo sapiens
gugaauacauuaacggugcuaa

SEQ ID NO: 1627371 - RNA, 22 nt, Homo sapiens
gugaauccaugggucuggcuag

SEQ ID NO: 1627372 - RNA, 12 nt, Homo sapiens
gugacacauaug

SEQ ID NO: 1627373 - RNA, 20 nt, Homo sapiens
gugacagacuccugaggaca

SEQ ID NO: 1627374 - RNA, 23 nt, Homo sapiens
gugagagaaagagagaagccagc

SEQ ID NO: 1627375 - RNA, 22 nt, Homo sapiens
gugagccaaagcuuaugugaca

SEQ ID NO: 1627376 - RNA, 14 nt, Homo sapiens
gugaggggcaagcu

SEQ ID NO: 1627377 - RNA, 19 nt, Homo sapiens
gugagugggagaguaccug

SEQ ID NO: 1627378 - RNA, 16 nt, Homo sapiens
gugauaauagcauuuu

SEQ ID NO: 1627379 - RNA, 13 nt, Homo sapiens
gugaucuacccac

SEQ ID NO: 1627380 - RNA, 23 nt, Homo sapiens
gugauuuuccuuuguagcuacuu

SEQ ID NO: 1627381 - RNA, 14 nt, Homo sapiens
gugcaaaaucuguu

SEQ ID NO: 1627382 - RNA, 12 nt, Homo sapiens
gugcacaaauac

SEQ ID NO: 1627383 - RNA, 22 nt, Homo sapiens
gugcaguacuuugugcauucug

SEQ ID NO: 1627384 - RNA, 19 nt, Homo sapiens
gugcaucacaucugcacac

SEQ ID NO: 1627385 - RNA, 10 nt, Homo sapiens
gugcauuuag

SEQ ID NO: 1627386 - RNA, 20 nt, Homo sapiens
gugccgugugagugugacag

SEQ ID NO: 1627387 - RNA, 18 nt, Homo sapiens
gugccuggccuggcacac

SEQ ID NO: 1627388 - RNA, 20 nt, Homo sapiens
gugcuccuccuuggugccug

SEQ ID NO: 1627389 - RNA, 17 nt, Homo sapiens
guggaacaaccugcugg

SEQ ID NO: 1627390 - RNA, 15 nt, Homo sapiens
guggacugaugcccc

SEQ ID NO: 1627391 - RNA, 19 nt, Homo sapiens
guggagugcaguggugcga

SEQ ID NO: 1627392 - RNA, 14 nt, Homo sapiens
guggcccucuggau

SEQ ID NO: 1627393 - RNA, 15 nt, Homo sapiens
guggccggcacucca

SEQ ID NO: 1627394 - RNA, 15 nt, Homo sapiens
guggcucagccagca

SEQ ID NO: 1627395 - RNA, 17 nt, Homo sapiens
gugggacacaacacaga

SEQ ID NO: 1627396 - RNA, 23 nt, Homo sapiens
gugggccagggcugcccugagaa

SEQ ID NO: 1627397 - RNA, 18 nt, Homo sapiens
gugggccaugaaccaaau

SEQ ID NO: 1627398 - RNA, 11 nt, Homo sapiens
gugggccaugg

SEQ ID NO: 1627399 - RNA, 15 nt, Homo sapiens
guggguguacauuuu

SEQ ID NO: 1627400 - RNA, 16 nt, Homo sapiens
gugguuugaagacccc

SEQ ID NO: 1627401 - RNA, 20 nt, Homo sapiens
guguaagaacaacuaccuga

SEQ ID NO: 1627402 - RNA, 20 nt, Homo sapiens
guguacaaauacauguguau

SEQ ID NO: 1627403 - RNA, 16 nt, Homo sapiens
guguacacgugacaga

SEQ ID NO: 1627404 - RNA, 17 nt, Homo sapiens
guguacacgugacagag

SEQ ID NO: 1627405 - RNA, 23 nt, Homo sapiens
guguaccucaguucccucuugcu

SEQ ID NO: 1627406 - RNA, 12 nt, Homo sapiens
guguacugccuu

SEQ ID NO: 1627407 - RNA, 13 nt, Homo sapiens
guguauccaugca

SEQ ID NO: 1627408 - RNA, 14 nt, Homo sapiens
gugucugggcucaa

SEQ ID NO: 1627409 - RNA, 17 nt, Homo sapiens
guguuacugcuuugcaa

SEQ ID NO: 1627410 - RNA, 18 nt, Homo sapiens
guguucacaacagugaaa

SEQ ID NO: 1627411 - RNA, 18 nt, Homo sapiens
guguugugaaacuguaaa

SEQ ID NO: 1627412 - RNA, 13 nt, Homo sapiens
guguuugcugagg

SEQ ID NO: 1627413 - RNA, 18 nt, Homo sapiens
guuaaacagcagcacuuu

SEQ ID NO: 1627414 - RNA, 19 nt, Homo sapiens
guuaaggggagcaacagag

SEQ ID NO: 1627415 - RNA, 20 nt, Homo sapiens
guuaauaaaccuuugcaaac

SEQ ID NO: 1627416 - RNA, 15 nt, Homo sapiens
guuacagagauacug

SEQ ID NO: 1627417 - RNA, 16 nt, Homo sapiens
guuaccucugcaugga

SEQ ID NO: 1627418 - RNA, 19 nt, Homo sapiens
guuacuuuuuuacacugau

SEQ ID NO: 1627419 - RNA, 16 nt, Homo sapiens
guuagaacuagccaaa

SEQ ID NO: 1627420 - RNA, 20 nt, Homo sapiens
guuaggcauuuccugcugaa

SEQ ID NO: 1627421 - RNA, 14 nt, Homo sapiens
guuauaaaguccuu

SEQ ID NO: 1627422 - RNA, 16 nt, Homo sapiens
guucaaagacugugaa

SEQ ID NO: 1627423 - RNA, 22 nt, Homo sapiens
guucaaagacugugaacagcuu

SEQ ID NO: 1627424 - RNA, 15 nt, Homo sapiens
guucaauacagugaa

SEQ ID NO: 1627425 - RNA, 15 nt, Homo sapiens
guucacaacagugaa

SEQ ID NO: 1627426 - RNA, 14 nt, Homo sapiens
guucacaccauucu

SEQ ID NO: 1627427 - RNA, 20 nt, Homo sapiens
guucacagcuuuucuugaua

SEQ ID NO: 1627428 - RNA, 21 nt, Homo sapiens
guucauuuagauaauuugaaa

SEQ ID NO: 1627429 - RNA, 17 nt, Homo sapiens
guucauuuugaguauuu

SEQ ID NO: 1627430 - RNA, 19 nt, Homo sapiens
guuccucccccugcucccc

SEQ ID NO: 1627431 - RNA, 22 nt, Homo sapiens
guuccuuccaggugauucuguu

SEQ ID NO: 1627432 - RNA, 23 nt, Homo sapiens
guucuaaggauggaaaggugaca

SEQ ID NO: 1627433 - RNA, 13 nt, Homo sapiens
guucuaccccuaa

SEQ ID NO: 1627434 - RNA, 12 nt, Homo sapiens
guucuaugagaa

SEQ ID NO: 1627435 - RNA, 17 nt, Homo sapiens
guucuguuauaccccau

SEQ ID NO: 1627436 - RNA, 13 nt, Homo sapiens
guucuuagagugu

SEQ ID NO: 1627437 - RNA, 13 nt, Homo sapiens
guucuucauuugg

SEQ ID NO: 1627438 - RNA, 17 nt, Homo sapiens
guucuuugucucaaaau

SEQ ID NO: 1627439 - RNA, 18 nt, Homo sapiens
guugacaaggcucugcua

SEQ ID NO: 1627440 - RNA, 23 nt, Homo sapiens
guugauuucagcaccuacagugu

SEQ ID NO: 1627441 - RNA, 20 nt, Homo sapiens
guugccacaguagaacuguc

SEQ ID NO: 1627442 - RNA, 20 nt, Homo sapiens
guugcccaccaaaacacaga

SEQ ID NO: 1627443 - RNA, 19 nt, Homo sapiens
guugccuuugcucuuauaa

SEQ ID NO: 1627444 - RNA, 20 nt, Homo sapiens
guugcucaccgacucaccug

SEQ ID NO: 1627445 - RNA, 16 nt, Homo sapiens
guugcuuaucauuuga

SEQ ID NO: 1627446 - RNA, 18 nt, Homo sapiens
guuggaaaacacuuucau

SEQ ID NO: 1627447 - RNA, 18 nt, Homo sapiens
guuggcaaacgagacuuu

SEQ ID NO: 1627448 - RNA, 13 nt, Homo sapiens
guuggcuuucccu

SEQ ID NO: 1627449 - RNA, 14 nt, Homo sapiens
guugucagcuuugg

SEQ ID NO: 1627450 - RNA, 14 nt, Homo sapiens
guuguguguguucu

SEQ ID NO: 1627451 - RNA, 14 nt, Homo sapiens
guuguguugacaca

SEQ ID NO: 1627452 - RNA, 15 nt, Homo sapiens
guuuaaaacagaagc

SEQ ID NO: 1627453 - RNA, 20 nt, Homo sapiens
guuuaaugucugccagguga

SEQ ID NO: 1627454 - RNA, 18 nt, Homo sapiens
guuuauuauaaacuguau

SEQ ID NO: 1627455 - RNA, 14 nt, Homo sapiens
guuucaaaaccaug

SEQ ID NO: 1627456 - RNA, 15 nt, Homo sapiens
guuucaaaaccaugc

SEQ ID NO: 1627457 - RNA, 22 nt, Homo sapiens
guuuccccuccuuggcuuuaug

SEQ ID NO: 1627458 - RNA, 12 nt, Homo sapiens
guuuccugguca

SEQ ID NO: 1627459 - RNA, 13 nt, Homo sapiens
guuuccuggucag

SEQ ID NO: 1627460 - RNA, 16 nt, Homo sapiens
guuucuccauguuggu

SEQ ID NO: 1627461 - RNA, 21 nt, Homo sapiens
guuucugucaagcuggugcua

SEQ ID NO: 1627462 - RNA, 16 nt, Homo sapiens
guuucuucucuacacc

SEQ ID NO: 1627463 - RNA, 20 nt, Homo sapiens
guuugaaaggaaacugcuau

SEQ ID NO: 1627464 - RNA, 19 nt, Homo sapiens
guuugcacuuggcaaaaag

SEQ ID NO: 1627465 - RNA, 19 nt, Homo sapiens
guuugccuuuguaccauau

SEQ ID NO: 1627466 - RNA, 22 nt, Homo sapiens
guuugcgggggucugagucuau

SEQ ID NO: 1627467 - RNA, 18 nt, Homo sapiens
guuugucagaggaacaaa

SEQ ID NO: 1627468 - RNA, 17 nt, Homo sapiens
guuuuaaguacuacaca

SEQ ID NO: 1627469 - RNA, 23 nt, Homo sapiens
guuuuaauccuuaacacauucaa

SEQ ID NO: 1627470 - RNA, 14 nt, Homo sapiens
guuuuacaaagggg

SEQ ID NO: 1627471 - RNA, 18 nt, Homo sapiens
guuuuacgucugggagaa

SEQ ID NO: 1627472 - RNA, 15 nt, Homo sapiens
guuuuaucacuucau

SEQ ID NO: 1627473 - RNA, 18 nt, Homo sapiens
guuuucauuauguucaug

SEQ ID NO: 1627474 - RNA, 14 nt, Homo sapiens
guuuuuagcuggug

SEQ ID NO: 1627475 - RNA, 21 nt, Homo sapiens
guuuuucuuacuugcauuuau

SEQ ID NO: 1627476 - RNA, 13 nt, Homo sapiens
guuuuugagccau

SEQ ID NO: 1627477 - RNA, 19 nt, Homo sapiens
guuuuuuauuaugcauuau

SEQ ID NO: 1627478 - RNA, 13 nt, Homo sapiens
uaaaaaaacagac

SEQ ID NO: 1627479 - RNA, 20 nt, Homo sapiens
gguuggggugacagucauca

SEQ ID NO: 1627480 - RNA, 22 nt, Homo sapiens
gguuucaaacuccugaccucag

SEQ ID NO: 1627481 - RNA, 23 nt, Homo sapiens
gguuucacuguggucucaaucuc

SEQ ID NO: 1627482 - RNA, 19 nt, Homo sapiens
gguuuccaaaggcauuuua

SEQ ID NO: 1627483 - RNA, 22 nt, Homo sapiens
gguuucucucuacagugccaac

SEQ ID NO: 1627484 - RNA, 21 nt, Homo sapiens
gguuugccaaaauucauuucu

SEQ ID NO: 1627485 - RNA, 12 nt, Homo sapiens
guaaaaaacugu

SEQ ID NO: 1627486 - RNA, 12 nt, Homo sapiens
guaaaacaaaga

SEQ ID NO: 1627487 - RNA, 16 nt, Homo sapiens
guaaaaggccaaaccu

SEQ ID NO: 1627488 - RNA, 17 nt, Homo sapiens
guaaacagaagccuguu

SEQ ID NO: 1627489 - RNA, 14 nt, Homo sapiens
guaaagcagaggau

SEQ ID NO: 1627490 - RNA, 21 nt, Homo sapiens
guaaaucauauuuuagcugca

SEQ ID NO: 1627491 - RNA, 21 nt, Homo sapiens
guaacaaauaaauaagaucag

SEQ ID NO: 1627492 - RNA, 14 nt, Homo sapiens
guaagcagccuuug

SEQ ID NO: 1627493 - RNA, 13 nt, Homo sapiens
guaauauuuagcu

SEQ ID NO: 1627494 - RNA, 15 nt, Homo sapiens
guaauccucaagaaa

SEQ ID NO: 1627495 - RNA, 21 nt, Homo sapiens
guaauuaaaaugauaguugau

SEQ ID NO: 1627496 - RNA, 15 nt, Homo sapiens
guaauuuugauuucu

SEQ ID NO: 1627497 - RNA, 16 nt, Homo sapiens
guaauuuuucugggaa

SEQ ID NO: 1627498 - RNA, 17 nt, Homo sapiens
guacacguguccuguag

SEQ ID NO: 1627499 - RNA, 15 nt, Homo sapiens
guacaggaacugcau

SEQ ID NO: 1627500 - RNA, 18 nt, Homo sapiens
guacauauguaaacauaa

SEQ ID NO: 1627501 - RNA, 14 nt, Homo sapiens
guacccaccgggcc

SEQ ID NO: 1627502 - RNA, 16 nt, Homo sapiens
guaccgcgucuacccu

SEQ ID NO: 1627503 - RNA, 15 nt, Homo sapiens
guacuacucuaggga

SEQ ID NO: 1627504 - RNA, 17 nt, Homo sapiens
guacuaugucaaagcaa

SEQ ID NO: 1627505 - RNA, 19 nt, Homo sapiens
guacucuucugacugcccc

SEQ ID NO: 1627506 - RNA, 17 nt, Homo sapiens
guacucuuuaacauaca

SEQ ID NO: 1627507 - RNA, 23 nt, Homo sapiens
guacugccuuaaauguaccuaug

SEQ ID NO: 1627508 - RNA, 14 nt, Homo sapiens
guacuuaacauaca

SEQ ID NO: 1627509 - RNA, 13 nt, Homo sapiens
guagacucuugcu

SEQ ID NO: 1627510 - RNA, 12 nt, Homo sapiens
guagaugggagg

SEQ ID NO: 1627511 - RNA, 16 nt, Homo sapiens
guagcaaguacuuugg

SEQ ID NO: 1627512 - RNA, 16 nt, Homo sapiens
guagcauccucuuuaa

SEQ ID NO: 1627513 - RNA, 18 nt, Homo sapiens
guagccuaacacacucca

SEQ ID NO: 1627514 - RNA, 17 nt, Homo sapiens
guagccugugcauguau

SEQ ID NO: 1627515 - RNA, 17 nt, Homo sapiens
guagcugggacuacagg

SEQ ID NO: 1627516 - RNA, 20 nt, Homo sapiens
guagcugggauuacaggcgu

SEQ ID NO: 1627517 - RNA, 19 nt, Homo sapiens
guagguaggaagcacugaa

SEQ ID NO: 1627518 - RNA, 13 nt, Homo sapiens
guaggugucucau

SEQ ID NO: 1627519 - RNA, 14 nt, Homo sapiens
guagucaugcugug

SEQ ID NO: 1627520 - RNA, 21 nt, Homo sapiens
guagucucuccccuggccaca

SEQ ID NO: 1627521 - RNA, 17 nt, Homo sapiens
guaguuaaggagccuaa

SEQ ID NO: 1627522 - RNA, 14 nt, Homo sapiens
guaguugcucuuuc

SEQ ID NO: 1627523 - RNA, 19 nt, Homo sapiens
guaguuucugcauuucaag

SEQ ID NO: 1627524 - RNA, 14 nt, Homo sapiens
guauaaauggaccu

SEQ ID NO: 1627525 - RNA, 18 nt, Homo sapiens
guauaaaugugauaugau

SEQ ID NO: 1627526 - RNA, 14 nt, Homo sapiens
guauaagcaucugc

SEQ ID NO: 1627527 - RNA, 11 nt, Homo sapiens
guauacaguau

SEQ ID NO: 1627528 - RNA, 17 nt, Homo sapiens
guauaugucuuuuaccc

SEQ ID NO: 1627529 - RNA, 20 nt, Homo sapiens
guaucaugcccugugcaacc

SEQ ID NO: 1627530 - RNA, 14 nt, Homo sapiens
guauccaccuugca

SEQ ID NO: 1627531 - RNA, 20 nt, Homo sapiens
guauccagucugaagauguu

SEQ ID NO: 1627532 - RNA, 23 nt, Homo sapiens
guauccuacugagcauuugcacc

SEQ ID NO: 1627533 - RNA, 16 nt, Homo sapiens
guaugcuuaagagaaa

SEQ ID NO: 1627534 - RNA, 14 nt, Homo sapiens
guaugguguguuca

SEQ ID NO: 1627535 - RNA, 21 nt, Homo sapiens
guauugucgguuaccucugca

SEQ ID NO: 1627536 - RNA, 20 nt, Homo sapiens
guauuguuuuccagugucac

SEQ ID NO: 1627537 - RNA, 16 nt, Homo sapiens
guauuuucaaccauaa

SEQ ID NO: 1627538 - RNA, 19 nt, Homo sapiens
gucaacaucaccccagugg

SEQ ID NO: 1627539 - RNA, 23 nt, Homo sapiens
gucaaccccacuguagacaggaa

SEQ ID NO: 1627540 - RNA, 15 nt, Homo sapiens
gucaagcuggugcua

SEQ ID NO: 1627541 - RNA, 17 nt, Homo sapiens
gucaccaauguacccac

SEQ ID NO: 1627542 - RNA, 23 nt, Homo sapiens
gucacgcuuucaugaauucuguc

SEQ ID NO: 1627543 - RNA, 15 nt, Homo sapiens
gucacuagucucacc

SEQ ID NO: 1627544 - RNA, 22 nt, Homo sapiens
gucacuuccccaagaucugcca

SEQ ID NO: 1627545 - RNA, 17 nt, Homo sapiens
gucagacauaaagccau

SEQ ID NO: 1627546 - RNA, 18 nt, Homo sapiens
gucagacuccuagacuca

SEQ ID NO: 1627547 - RNA, 16 nt, Homo sapiens
gucagggagaggucac

SEQ ID NO: 1627548 - RNA, 16 nt, Homo sapiens
gucagugccaugacug

SEQ ID NO: 1627549 - RNA, 19 nt, Homo sapiens
gucagugccaugacugaga

SEQ ID NO: 1627550 - RNA, 20 nt, Homo sapiens
gucauaaugguuuuuaacac

SEQ ID NO: 1627551 - RNA, 17 nt, Homo sapiens
gucaucacacucuccau

SEQ ID NO: 1627552 - RNA, 13 nt, Homo sapiens
gucauguuugcag

SEQ ID NO: 1627553 - RNA, 21 nt, Homo sapiens
gucauucuuuauucuuuacua

SEQ ID NO: 1627554 - RNA, 13 nt, Homo sapiens
gucauuguauuca

SEQ ID NO: 1627555 - RNA, 21 nt, Homo sapiens
gucauuucauuccauugccua

SEQ ID NO: 1627556 - RNA, 21 nt, Homo sapiens
guccacggucuguucuugaag

SEQ ID NO: 1627557 - RNA, 17 nt, Homo sapiens
guccauguguucuuauu

SEQ ID NO: 1627558 - RNA, 14 nt, Homo sapiens
guccauuuugcccu

SEQ ID NO: 1627559 - RNA, 19 nt, Homo sapiens
guccauuuugcccuuccau

SEQ ID NO: 1627560 - RNA, 20 nt, Homo sapiens
gucccuucccagcgcugcug

SEQ ID NO: 1627561 - RNA, 15 nt, Homo sapiens
guccuagacaaacca

SEQ ID NO: 1627562 - RNA, 17 nt, Homo sapiens
guccucuucugcaucuu

SEQ ID NO: 1627563 - RNA, 16 nt, Homo sapiens
guccuguuucugucaa

SEQ ID NO: 1627564 - RNA, 14 nt, Homo sapiens
guccuucaccucac

SEQ ID NO: 1627565 - RNA, 19 nt, Homo sapiens
guccuucaccucacugaaa

SEQ ID NO: 1627566 - RNA, 17 nt, Homo sapiens
gucuaguuucucaaaac

SEQ ID NO: 1627567 - RNA, 15 nt, Homo sapiens
gucuauggcacuaau

SEQ ID NO: 1627568 - RNA, 22 nt, Homo sapiens
gucuauguucaaagacugugaa

SEQ ID NO: 1627569 - RNA, 23 nt, Homo sapiens
gucuccucaauuuuugucucaga

SEQ ID NO: 1627570 - RNA, 14 nt, Homo sapiens
gucucugcucuuuc

SEQ ID NO: 1627571 - RNA, 22 nt, Homo sapiens
gucucuucggcagggaggugaa

SEQ ID NO: 1627572 - RNA, 17 nt, Homo sapiens
gucugaagcccaaagcc

SEQ ID NO: 1627573 - RNA, 13 nt, Homo sapiens
gucuggacugcua

SEQ ID NO: 1627574 - RNA, 20 nt, Homo sapiens
gucugggagaaauugacaga

SEQ ID NO: 1627575 - RNA, 22 nt, Homo sapiens
gucugggaguauacggaaacaa

SEQ ID NO: 1627576 - RNA, 15 nt, Homo sapiens
gucuguuacacugga

SEQ ID NO: 1627577 - RNA, 16 nt, Homo sapiens
gucuguuuuaauuuaa

SEQ ID NO: 1627578 - RNA, 18 nt, Homo sapiens
gucuuagacugcuagcuu

SEQ ID NO: 1627579 - RNA, 12 nt, Homo sapiens
gucuuagcuuua

SEQ ID NO: 1627580 - RNA, 15 nt, Homo sapiens
gucuuccacuucaau

SEQ ID NO: 1627581 - RNA, 20 nt, Homo sapiens
gucuucccuucugauugaug

SEQ ID NO: 1627582 - RNA, 18 nt, Homo sapiens
gucuuggacacuguacaa

SEQ ID NO: 1627583 - RNA, 18 nt, Homo sapiens
gucuuggggccacuuuca

SEQ ID NO: 1627584 - RNA, 18 nt, Homo sapiens
gucuuuauaaugggauau

SEQ ID NO: 1627585 - RNA, 21 nt, Homo sapiens
gucuuuucaaaauauuacuca

SEQ ID NO: 1627586 - RNA, 17 nt, Homo sapiens
gugaaauuaagcauuuu

SEQ ID NO: 1627587 - RNA, 19 nt, Homo sapiens
gugaacaaagcagccacga

SEQ ID NO: 1627588 - RNA, 20 nt, Homo sapiens
gugaacagcuugcugucacu

SEQ ID NO: 1627589 - RNA, 22 nt, Homo sapiens
ggccaguggggccuguggaaug

SEQ ID NO: 1627590 - RNA, 23 nt, Homo sapiens
ggccaucugacugccaagccaga

SEQ ID NO: 1627591 - RNA, 13 nt, Homo sapiens
ggcccagugacaa

SEQ ID NO: 1627592 - RNA, 20 nt, Homo sapiens
ggcccuaaaggacucuccag

SEQ ID NO: 1627593 - RNA, 18 nt, Homo sapiens
ggcccuguuccccaagga

SEQ ID NO: 1627594 - RNA, 17 nt, Homo sapiens
ggccgcccugcggguga

SEQ ID NO: 1627595 - RNA, 15 nt, Homo sapiens
ggccuaacacugggc

SEQ ID NO: 1627596 - RNA, 23 nt, Homo sapiens
ggccuaacacugggcugcagaga

SEQ ID NO: 1627597 - RNA, 14 nt, Homo sapiens
ggccuccugccucu

SEQ ID NO: 1627598 - RNA, 22 nt, Homo sapiens
ggccuccugccucuacugggaa

SEQ ID NO: 1627599 - RNA, 18 nt, Homo sapiens
ggccucgaaaaccaucac

SEQ ID NO: 1627600 - RNA, 16 nt, Homo sapiens
ggccucugucaccuga

SEQ ID NO: 1627601 - RNA, 17 nt, Homo sapiens
ggccugcugcugagaac

SEQ ID NO: 1627602 - RNA, 22 nt, Homo sapiens
ggccuucaguuuauuuccacua

SEQ ID NO: 1627603 - RNA, 13 nt, Homo sapiens
ggccuuguaagac

SEQ ID NO: 1627604 - RNA, 13 nt, Homo sapiens
ggcgaguggcacg

SEQ ID NO: 1627605 - RNA, 19 nt, Homo sapiens
ggcgguacacuacgcacug

SEQ ID NO: 1627606 - RNA, 21 nt, Homo sapiens
ggcuaccucagaaagauuuga

SEQ ID NO: 1627607 - RNA, 12 nt, Homo sapiens
ggcucacaaaga

SEQ ID NO: 1627608 - RNA, 13 nt, Homo sapiens
ggcucagccagca

SEQ ID NO: 1627609 - RNA, 21 nt, Homo sapiens
ggcucagccucaaaugcagua

SEQ ID NO: 1627610 - RNA, 13 nt, Homo sapiens
ggcucauuuuugc

SEQ ID NO: 1627611 - RNA, 20 nt, Homo sapiens
ggcucccagggccaugaacu

SEQ ID NO: 1627612 - RNA, 21 nt, Homo sapiens
ggcucccugccugagggucac

SEQ ID NO: 1627613 - RNA, 19 nt, Homo sapiens
ggcugccagguguggaaca

SEQ ID NO: 1627614 - RNA, 20 nt, Homo sapiens
ggcugcuuggagcagccuaa

SEQ ID NO: 1627615 - RNA, 20 nt, Homo sapiens
ggcuggagugcaguggcgcc

SEQ ID NO: 1627616 - RNA, 20 nt, Homo sapiens
ggcuggaguguaguggcaug

SEQ ID NO: 1627617 - RNA, 13 nt, Homo sapiens
ggcugguggaaca

SEQ ID NO: 1627618 - RNA, 15 nt, Homo sapiens
ggcuuaauaccuggg

SEQ ID NO: 1627619 - RNA, 13 nt, Homo sapiens
ggcuuuaugcaaa

SEQ ID NO: 1627620 - RNA, 23 nt, Homo sapiens
ggcuuuaugcaaauacaaucagc

SEQ ID NO: 1627621 - RNA, 19 nt, Homo sapiens
ggcuuuuugccaucuguga

SEQ ID NO: 1627622 - RNA, 13 nt, Homo sapiens
gggaaaaccagac

SEQ ID NO: 1627623 - RNA, 18 nt, Homo sapiens
gggaagagacagcccagg

SEQ ID NO: 1627624 - RNA, 23 nt, Homo sapiens
gggaagaugcccucaacucaccc

SEQ ID NO: 1627625 - RNA, 21 nt, Homo sapiens
gggacaaaggagccugugaac

SEQ ID NO: 1627626 - RNA, 16 nt, Homo sapiens
gggacacaacacagau

SEQ ID NO: 1627627 - RNA, 13 nt, Homo sapiens
gggacacuuucac

SEQ ID NO: 1627628 - RNA, 19 nt, Homo sapiens
gggacauugcaauuugcag

SEQ ID NO: 1627629 - RNA, 21 nt, Homo sapiens
gggaccuugucucccagcuca

SEQ ID NO: 1627630 - RNA, 22 nt, Homo sapiens
gggacugucggaggaaagggau

SEQ ID NO: 1627631 - RNA, 19 nt, Homo sapiens
gggagaaaaaaagggaucu

SEQ ID NO: 1627632 - RNA, 19 nt, Homo sapiens
gggagaagaagucagagag

SEQ ID NO: 1627633 - RNA, 16 nt, Homo sapiens
gggagauccugcauuu

SEQ ID NO: 1627634 - RNA, 15 nt, Homo sapiens
gggagcaguggccau

SEQ ID NO: 1627635 - RNA, 12 nt, Homo sapiens
gggaggacaaaa

SEQ ID NO: 1627636 - RNA, 22 nt, Homo sapiens
gggaggacaaaacuucuuguca

SEQ ID NO: 1627637 - RNA, 13 nt, Homo sapiens
gggauuacaggcg

SEQ ID NO: 1627638 - RNA, 15 nt, Homo sapiens
gggauugcugugaaa

SEQ ID NO: 1627639 - RNA, 13 nt, Homo sapiens
gggauuggaagaa

SEQ ID NO: 1627640 - RNA, 21 nt, Homo sapiens
gggauuuauuuucaauuaaua

SEQ ID NO: 1627641 - RNA, 16 nt, Homo sapiens
gggcaacuauucauga

SEQ ID NO: 1627642 - RNA, 15 nt, Homo sapiens
gggcaauccagacag

SEQ ID NO: 1627643 - RNA, 14 nt, Homo sapiens
gggcagcacucccc

SEQ ID NO: 1627644 - RNA, 17 nt, Homo sapiens
gggcagcgccaggcuga

SEQ ID NO: 1627645 - RNA, 16 nt, Homo sapiens
gggcagggcccacgug

SEQ ID NO: 1627646 - RNA, 14 nt, Homo sapiens
gggccacuggggac

SEQ ID NO: 1627647 - RNA, 18 nt, Homo sapiens
gggccagggucuguguga

SEQ ID NO: 1627648 - RNA, 14 nt, Homo sapiens
gggccccauccuca

SEQ ID NO: 1627649 - RNA, 22 nt, Homo sapiens
gggccccgccagggcuggggac

SEQ ID NO: 1627650 - RNA, 14 nt, Homo sapiens
gggccugcugcuga

SEQ ID NO: 1627651 - RNA, 15 nt, Homo sapiens
gggccugcugcugag

SEQ ID NO: 1627652 - RNA, 16 nt, Homo sapiens
gggccuggcuggcuga

SEQ ID NO: 1627653 - RNA, 15 nt, Homo sapiens
gggcgggauucucuc

SEQ ID NO: 1627654 - RNA, 18 nt, Homo sapiens
gggcucauuuuugcacuu

SEQ ID NO: 1627655 - RNA, 13 nt, Homo sapiens
gggcuuuugccac

SEQ ID NO: 1627656 - RNA, 18 nt, Homo sapiens
ggggagaagacaaaugaa

SEQ ID NO: 1627657 - RNA, 10 nt, Homo sapiens
ggggcuucca

SEQ ID NO: 1627658 - RNA, 14 nt, Homo sapiens
gggggcugugccaa

SEQ ID NO: 1627659 - RNA, 20 nt, Homo sapiens
gggguuucacuguggucuca

SEQ ID NO: 1627660 - RNA, 18 nt, Homo sapiens
gggucugugugaaugugg

SEQ ID NO: 1627661 - RNA, 19 nt, Homo sapiens
gggugagccaccgugccca

SEQ ID NO: 1627662 - RNA, 21 nt, Homo sapiens
ggguggaaagugcucagugaa

SEQ ID NO: 1627663 - RNA, 18 nt, Homo sapiens
gggugguuuuugagccau

SEQ ID NO: 1627664 - RNA, 11 nt, Homo sapiens
gggugugcuau

SEQ ID NO: 1627665 - RNA, 21 nt, Homo sapiens
ggguuuggcaaaacucaggca

SEQ ID NO: 1627666 - RNA, 13 nt, Homo sapiens
gguaaaacagggc

SEQ ID NO: 1627667 - RNA, 16 nt, Homo sapiens
gguaauauucauuuua

SEQ ID NO: 1627668 - RNA, 23 nt, Homo sapiens
gguacauucuagcugagaagcaa

SEQ ID NO: 1627669 - RNA, 15 nt, Homo sapiens
gguagguugggacac

SEQ ID NO: 1627670 - RNA, 20 nt, Homo sapiens
gguagucaugcugugcauuu

SEQ ID NO: 1627671 - RNA, 23 nt, Homo sapiens
gguauccuucauuauccacccca

SEQ ID NO: 1627672 - RNA, 21 nt, Homo sapiens
gguauuuguuuguagcuuucc

SEQ ID NO: 1627673 - RNA, 19 nt, Homo sapiens
ggucauaaagcauuggagu

SEQ ID NO: 1627674 - RNA, 14 nt, Homo sapiens
ggucauucuuuauu

SEQ ID NO: 1627675 - RNA, 21 nt, Homo sapiens
ggucauuucuuagauggagaa

SEQ ID NO: 1627676 - RNA, 20 nt, Homo sapiens
gguccaagccugcaacucau

SEQ ID NO: 1627677 - RNA, 22 nt, Homo sapiens
ggucccuggagggcaagcccug

SEQ ID NO: 1627678 - RNA, 12 nt, Homo sapiens
gguccugucuaa

SEQ ID NO: 1627679 - RNA, 14 nt, Homo sapiens
gguccuuuggacag

SEQ ID NO: 1627680 - RNA, 23 nt, Homo sapiens
ggucugagucuauguucaaagac

SEQ ID NO: 1627681 - RNA, 18 nt, Homo sapiens
ggucugugugaauguggg

SEQ ID NO: 1627682 - RNA, 19 nt, Homo sapiens
ggucuucuccccucaccca

SEQ ID NO: 1627683 - RNA, 12 nt, Homo sapiens
ggugaauaugca

SEQ ID NO: 1627684 - RNA, 23 nt, Homo sapiens
ggugacagagcagugcuggaaua

SEQ ID NO: 1627685 - RNA, 17 nt, Homo sapiens
ggugaccccagggcaca

SEQ ID NO: 1627686 - RNA, 13 nt, Homo sapiens
ggugcaagcacuc

SEQ ID NO: 1627687 - RNA, 21 nt, Homo sapiens
ggugcaagcacucgggguccc

SEQ ID NO: 1627688 - RNA, 13 nt, Homo sapiens
ggugcccacaggc

SEQ ID NO: 1627689 - RNA, 15 nt, Homo sapiens
ggugcuauccauuuc

SEQ ID NO: 1627690 - RNA, 23 nt, Homo sapiens
ggugcucauucauuuaacagagc

SEQ ID NO: 1627691 - RNA, 12 nt, Homo sapiens
gguggaaggccu

SEQ ID NO: 1627692 - RNA, 22 nt, Homo sapiens
ggugguuuuugagccaugcgug

SEQ ID NO: 1627693 - RNA, 20 nt, Homo sapiens
gguguuauuuucugagagac

SEQ ID NO: 1627694 - RNA, 13 nt, Homo sapiens
gguguuuugccau

SEQ ID NO: 1627695 - RNA, 13 nt, Homo sapiens
gguuaucuuguua

SEQ ID NO: 1627696 - RNA, 16 nt, Homo sapiens
gguucaagcuugucca

SEQ ID NO: 1627697 - RNA, 20 nt, Homo sapiens
gguucuaggcugcugcacac

SEQ ID NO: 1627698 - RNA, 18 nt, Homo sapiens
gguuggggugacagucau

SEQ ID NO: 1627699 - RNA, 14 nt, Homo sapiens
cuacguauccugca

SEQ ID NO: 1627700 - RNA, 14 nt, Homo sapiens
cuacuacccauugu

SEQ ID NO: 1627701 - RNA, 19 nt, Homo sapiens
cuacucccuggaccacgag

SEQ ID NO: 1627702 - RNA, 10 nt, Homo sapiens
cuacuccucc

SEQ ID NO: 1627703 - RNA, 19 nt, Homo sapiens
cuacugagggcaguucuga

SEQ ID NO: 1627704 - RNA, 16 nt, Homo sapiens
cuacugauuguuucau

SEQ ID NO: 1627705 - RNA, 17 nt, Homo sapiens
cuacugcagcaccucca

SEQ ID NO: 1627706 - RNA, 19 nt, Homo sapiens
cuacugggugucauuucau

SEQ ID NO: 1627707 - RNA, 23 nt, Homo sapiens
cuacugggugucauuucauucca

SEQ ID NO: 1627708 - RNA, 12 nt, Homo sapiens
cuagaaugagca

SEQ ID NO: 1627709 - RNA, 16 nt, Homo sapiens
cuagauuuucuacuuu

SEQ ID NO: 1627710 - RNA, 13 nt, Homo sapiens
cuagcagcaccgu

SEQ ID NO: 1627711 - RNA, 24 nt, Homo sapiens
cuagcaggaacuucuagcucauuu

SEQ ID NO: 1627712 - RNA, 20 nt, Homo sapiens
cuagccccagcgccaaagga

SEQ ID NO: 1627713 - RNA, 17 nt, Homo sapiens
cuagccccucacuucca

SEQ ID NO: 1627714 - RNA, 18 nt, Homo sapiens
cuagccccucacuuccag

SEQ ID NO: 1627715 - RNA, 17 nt, Homo sapiens
cuagccuuugggcacaa

SEQ ID NO: 1627716 - RNA, 14 nt, Homo sapiens
cuaggcugagcaau

SEQ ID NO: 1627717 - RNA, 23 nt, Homo sapiens
cuaggggcuugguccuagggugg

SEQ ID NO: 1627718 - RNA, 17 nt, Homo sapiens
cuagguaacgagggcaa

SEQ ID NO: 1627719 - RNA, 14 nt, Homo sapiens
cuaguaaccaaggc

SEQ ID NO: 1627720 - RNA, 22 nt, Homo sapiens
cuagucuuauggaaagcaaaua

SEQ ID NO: 1627721 - RNA, 12 nt, Homo sapiens
cuaguuacacau

SEQ ID NO: 1627722 - RNA, 13 nt, Homo sapiens
cuauaacugccca

SEQ ID NO: 1627723 - RNA, 16 nt, Homo sapiens
cuauaacuuacuucug

SEQ ID NO: 1627724 - RNA, 17 nt, Homo sapiens
cuauaagcccacuguua

SEQ ID NO: 1627725 - RNA, 18 nt, Homo sapiens
cuauaggccaaugcauga

SEQ ID NO: 1627726 - RNA, 20 nt, Homo sapiens
cuauaggugacaaacaucuc

SEQ ID NO: 1627727 - RNA, 23 nt, Homo sapiens
cuaucacugcauuaucuugcuca

SEQ ID NO: 1627728 - RNA, 13 nt, Homo sapiens
cuauccugggacc

SEQ ID NO: 1627729 - RNA, 13 nt, Homo sapiens
cuaucgugucaac

SEQ ID NO: 1627730 - RNA, 14 nt, Homo sapiens
cuaugcacauaugg

SEQ ID NO: 1627731 - RNA, 14 nt, Homo sapiens
cuauggacagggcu

SEQ ID NO: 1627732 - RNA, 18 nt, Homo sapiens
cuauggagugcucacaaa

SEQ ID NO: 1627733 - RNA, 14 nt, Homo sapiens
cuaugggugagcau

SEQ ID NO: 1627734 - RNA, 19 nt, Homo sapiens
cuauggugagaugcagcug

SEQ ID NO: 1627735 - RNA, 19 nt, Homo sapiens
cuauguaaacaaaccacag

SEQ ID NO: 1627736 - RNA, 14 nt, Homo sapiens
cuauguucaaagac

SEQ ID NO: 1627737 - RNA, 14 nt, Homo sapiens
cuauuaauucuuaa

SEQ ID NO: 1627738 - RNA, 18 nt, Homo sapiens
cuauucauggcuaccuca

SEQ ID NO: 1627739 - RNA, 16 nt, Homo sapiens
cuauucuagagcuuuu

SEQ ID NO: 1627740 - RNA, 18 nt, Homo sapiens
cuauucugagcauacuca

SEQ ID NO: 1627741 - RNA, 12 nt, Homo sapiens
cuauuggucucc

SEQ ID NO: 1627742 - RNA, 21 nt, Homo sapiens
cuauuuagaaauggauuuauc

SEQ ID NO: 1627743 - RNA, 13 nt, Homo sapiens
cuauuuaucugau

SEQ ID NO: 1627744 - RNA, 18 nt, Homo sapiens
cuauuuaucugaucaaga

SEQ ID NO: 1627745 - RNA, 23 nt, Homo sapiens
cuauuuuuguuggggggugggag

SEQ ID NO: 1627746 - RNA, 20 nt, Homo sapiens
cucaaaccuccaaaagcccu

SEQ ID NO: 1627747 - RNA, 21 nt, Homo sapiens
cucaaaggccagaccugcaga

SEQ ID NO: 1627748 - RNA, 20 nt, Homo sapiens
cucaacaaaacccaugcauu

SEQ ID NO: 1627749 - RNA, 23 nt, Homo sapiens
cucaacuucuuuccucuggagac

SEQ ID NO: 1627750 - RNA, 23 nt, Homo sapiens
cucaagaaauaaaaggaagccaa

SEQ ID NO: 1627751 - RNA, 21 nt, Homo sapiens
cucaagucugcacagagcaag

SEQ ID NO: 1627752 - RNA, 18 nt, Homo sapiens
cucaagugucaccuccuu

SEQ ID NO: 1627753 - RNA, 11 nt, Homo sapiens
cucaaucugca

SEQ ID NO: 1627754 - RNA, 17 nt, Homo sapiens
cucacaucucccuucca

SEQ ID NO: 1627755 - RNA, 17 nt, Homo sapiens
cucacccccuacacaca

SEQ ID NO: 1627756 - RNA, 15 nt, Homo sapiens
cucacucuguuuccu

SEQ ID NO: 1627757 - RNA, 12 nt, Homo sapiens
cucacucuucaa

SEQ ID NO: 1627758 - RNA, 20 nt, Homo sapiens
cucacugaaaacaucuggaa

SEQ ID NO: 1627759 - RNA, 15 nt, Homo sapiens
cucacugaaacaugg

SEQ ID NO: 1627760 - RNA, 17 nt, Homo sapiens
cucacugcaaucucugc

SEQ ID NO: 1627761 - RNA, 22 nt, Homo sapiens
cucagaagguaggggaagggcg

SEQ ID NO: 1627762 - RNA, 14 nt, Homo sapiens
cucagaagucugca

SEQ ID NO: 1627763 - RNA, 16 nt, Homo sapiens
cucagaauugcacauc

SEQ ID NO: 1627764 - RNA, 16 nt, Homo sapiens
cucagcagacauccac

SEQ ID NO: 1627765 - RNA, 15 nt, Homo sapiens
cucagccacccugug

SEQ ID NO: 1627766 - RNA, 14 nt, Homo sapiens
cucagcugguccug

SEQ ID NO: 1627767 - RNA, 18 nt, Homo sapiens
cucagcuguccugcagca

SEQ ID NO: 1627768 - RNA, 17 nt, Homo sapiens
cucagcuuuauaacaaa

SEQ ID NO: 1627769 - RNA, 16 nt, Homo sapiens
cucaggaauucagugc

SEQ ID NO: 1627770 - RNA, 16 nt, Homo sapiens
cucagggccucaggca

SEQ ID NO: 1627771 - RNA, 23 nt, Homo sapiens
cucaguuauuacauguaauuuga

SEQ ID NO: 1627772 - RNA, 17 nt, Homo sapiens
cucaguucccucuugcu

SEQ ID NO: 1627773 - RNA, 20 nt, Homo sapiens
cucauuacucuuaaggaaua

SEQ ID NO: 1627774 - RNA, 18 nt, Homo sapiens
cucauucccuccccagaa

SEQ ID NO: 1627775 - RNA, 16 nt, Homo sapiens
cuccaaaccugucuug

SEQ ID NO: 1627776 - RNA, 22 nt, Homo sapiens
cuccaacaccaagcacagcagc

SEQ ID NO: 1627777 - RNA, 22 nt, Homo sapiens
cuccaagcuuucagacaagaau

SEQ ID NO: 1627778 - RNA, 19 nt, Homo sapiens
cuccaccagccugcugaca

SEQ ID NO: 1627779 - RNA, 19 nt, Homo sapiens
cuccagcccagacccagug

SEQ ID NO: 1627780 - RNA, 14 nt, Homo sapiens
cuccaggauuuccu

SEQ ID NO: 1627781 - RNA, 17 nt, Homo sapiens
cuccaguugcagaccau

SEQ ID NO: 1627782 - RNA, 18 nt, Homo sapiens
cuccauaaaguacaaaug

SEQ ID NO: 1627783 - RNA, 21 nt, Homo sapiens
cuccaucaauaaauguugcaa

SEQ ID NO: 1627784 - RNA, 12 nt, Homo sapiens
cuccaugcugca

SEQ ID NO: 1627785 - RNA, 14 nt, Homo sapiens
cuccauuuuagccc

SEQ ID NO: 1627786 - RNA, 18 nt, Homo sapiens
cucccaaagugcuggaau

SEQ ID NO: 1627787 - RNA, 20 nt, Homo sapiens
cucccaaagugcugggauua

SEQ ID NO: 1627788 - RNA, 14 nt, Homo sapiens
cucccaacucccuu

SEQ ID NO: 1627789 - RNA, 21 nt, Homo sapiens
cucccaagccccugacccgcu

SEQ ID NO: 1627790 - RNA, 21 nt, Homo sapiens
cucccacaugaggccaucuca

SEQ ID NO: 1627791 - RNA, 17 nt, Homo sapiens
cucccaccccagggauu

SEQ ID NO: 1627792 - RNA, 16 nt, Homo sapiens
cucccagggccaugaa

SEQ ID NO: 1627793 - RNA, 20 nt, Homo sapiens
cucccaggugagaauucagg

SEQ ID NO: 1627794 - RNA, 16 nt, Homo sapiens
cuccccauuagcuuuc

SEQ ID NO: 1627795 - RNA, 12 nt, Homo sapiens
cucccuaccuga

SEQ ID NO: 1627796 - RNA, 15 nt, Homo sapiens
cucccuccaccagcc

SEQ ID NO: 1627797 - RNA, 21 nt, Homo sapiens
cucccuugcuuuuugcugugu

SEQ ID NO: 1627798 - RNA, 14 nt, Homo sapiens
cuccuacaugaugu

SEQ ID NO: 1627799 - RNA, 16 nt, Homo sapiens
cuccugcuucaugggc

SEQ ID NO: 1627800 - RNA, 13 nt, Homo sapiens
cuccuucugcaaa

SEQ ID NO: 1627801 - RNA, 15 nt, Homo sapiens
cuccuuuaccuuuca

SEQ ID NO: 1627802 - RNA, 13 nt, Homo sapiens
cucggacuuggca

SEQ ID NO: 1627803 - RNA, 12 nt, Homo sapiens
cucggaugacac

SEQ ID NO: 1627804 - RNA, 21 nt, Homo sapiens
cucggccucccaaaaugcugg

SEQ ID NO: 1627805 - RNA, 16 nt, Homo sapiens
cucggcucagugcaac

SEQ ID NO: 1627806 - RNA, 17 nt, Homo sapiens
cucuaaugugucucuca

SEQ ID NO: 1627807 - RNA, 18 nt, Homo sapiens
cucuaaugugucucucac

SEQ ID NO: 1627808 - RNA, 14 nt, Homo sapiens
cucuacagugccaa

SEQ ID NO: 1627809 - RNA, 14 nt, Homo sapiens
cucuagaaugagca

SEQ ID NO: 1627810 - RNA, 21 nt, Homo sapiens
cucuagcuuugucauaguuau

SEQ ID NO: 1627811 - RNA, 14 nt, Homo sapiens
cucuagugggacag

SEQ ID NO: 1627812 - RNA, 24 nt, Homo sapiens
cucuaugaccucgcccuccacaaa

SEQ ID NO: 1627813 - RNA, 19 nt, Homo sapiens
cucucacacuuuugcuuga

SEQ ID NO: 1627814 - RNA, 22 nt, Homo sapiens
cucucacggcuuguaaauguga

SEQ ID NO: 1627815 - RNA, 22 nt, Homo sapiens
cucucagaccaagcagcaggaa

SEQ ID NO: 1627816 - RNA, 11 nt, Homo sapiens
cucuccaggga

SEQ ID NO: 1627817 - RNA, 18 nt, Homo sapiens
cucucuaggugucaggag

SEQ ID NO: 1627818 - RNA, 13 nt, Homo sapiens
cucugaacuucca

SEQ ID NO: 1627819 - RNA, 14 nt, Homo sapiens
cucugcacaugucu

SEQ ID NO: 1627820 - RNA, 24 nt, Homo sapiens
cucugccuuaaacacacauugcag

SEQ ID NO: 1627821 - RNA, 13 nt, Homo sapiens
cucuggauugaga

SEQ ID NO: 1627822 - RNA, 21 nt, Homo sapiens
cucuguagcucaaucugcaaa

SEQ ID NO: 1627823 - RNA, 15 nt, Homo sapiens
cucuguucauuucac

SEQ ID NO: 1627824 - RNA, 18 nt, Homo sapiens
cucuguucccaguaguua

SEQ ID NO: 1627825 - RNA, 15 nt, Homo sapiens
cucuuauaaaaucaa

SEQ ID NO: 1627826 - RNA, 21 nt, Homo sapiens
cucuuauaaaaucaauaagag

SEQ ID NO: 1627827 - RNA, 14 nt, Homo sapiens
cucuucaacaugac

SEQ ID NO: 1627828 - RNA, 19 nt, Homo sapiens
cucuucaacaugacaucca

SEQ ID NO: 1627829 - RNA, 15 nt, Homo sapiens
cucuuccaaguccuu

SEQ ID NO: 1627830 - RNA, 16 nt, Homo sapiens
cucuuccccaucucac

SEQ ID NO: 1627831 - RNA, 20 nt, Homo sapiens
cucuucucuugagcaguuag

SEQ ID NO: 1627832 - RNA, 15 nt, Homo sapiens
cucuucugacugccc

SEQ ID NO: 1627833 - RNA, 13 nt, Homo sapiens
cucuugaagcaua

SEQ ID NO: 1627834 - RNA, 18 nt, Homo sapiens
cucuugaaguacuuaaca

SEQ ID NO: 1627835 - RNA, 21 nt, Homo sapiens
cucuugaaguacuuaacauac

SEQ ID NO: 1627836 - RNA, 15 nt, Homo sapiens
cucuuggccugauca

SEQ ID NO: 1627837 - RNA, 20 nt, Homo sapiens
cucuuuacuugaaauuuggc

SEQ ID NO: 1627838 - RNA, 23 nt, Homo sapiens
cugaaaaauggagcaguaaugca

SEQ ID NO: 1627839 - RNA, 12 nt, Homo sapiens
cugaaaugugac

SEQ ID NO: 1627840 - RNA, 17 nt, Homo sapiens
cugaagauaaugaaaua

SEQ ID NO: 1627841 - RNA, 14 nt, Homo sapiens
cugaagauggcauc

SEQ ID NO: 1627842 - RNA, 22 nt, Homo sapiens
cugaaggcacagcuaaccacuu

SEQ ID NO: 1627843 - RNA, 23 nt, Homo sapiens
cugaaggcaguggcaggggagca

SEQ ID NO: 1627844 - RNA, 13 nt, Homo sapiens
cugaauaauauca

SEQ ID NO: 1627845 - RNA, 20 nt, Homo sapiens
cugaauauaaagcuuaauaa

SEQ ID NO: 1627846 - RNA, 15 nt, Homo sapiens
cugaaucaugucugu

SEQ ID NO: 1627847 - RNA, 22 nt, Homo sapiens
cugaauccccggccucugucac

SEQ ID NO: 1627848 - RNA, 14 nt, Homo sapiens
cugaauucuggaau

SEQ ID NO: 1627849 - RNA, 17 nt, Homo sapiens
cugacaagcuggccaaa

SEQ ID NO: 1627850 - RNA, 15 nt, Homo sapiens
cugacggcgccuuuu

SEQ ID NO: 1627851 - RNA, 21 nt, Homo sapiens
cugacugaaggaaaagcaaga

SEQ ID NO: 1627852 - RNA, 15 nt, Homo sapiens
cugacugaaugcaga

SEQ ID NO: 1627853 - RNA, 17 nt, Homo sapiens
cugacugccaagccaga

SEQ ID NO: 1627854 - RNA, 16 nt, Homo sapiens
cugagaaucuaggcca

SEQ ID NO: 1627855 - RNA, 19 nt, Homo sapiens
cugagacaaauuuuaacuu

SEQ ID NO: 1627856 - RNA, 15 nt, Homo sapiens
cugagagucugagaa

SEQ ID NO: 1627857 - RNA, 15 nt, Homo sapiens
cugaggcacacagag

SEQ ID NO: 1627858 - RNA, 17 nt, Homo sapiens
cugagggcagugcccuu

SEQ ID NO: 1627859 - RNA, 15 nt, Homo sapiens
cugaguauaaauuua

SEQ ID NO: 1627860 - RNA, 18 nt, Homo sapiens
cugaguauaaauuuacuu

SEQ ID NO: 1627861 - RNA, 17 nt, Homo sapiens
cugaguggcuucacucc

SEQ ID NO: 1627862 - RNA, 19 nt, Homo sapiens
cugaguuguugagucuguu

SEQ ID NO: 1627863 - RNA, 23 nt, Homo sapiens
cugauccugcaaggggacauucc

SEQ ID NO: 1627864 - RNA, 22 nt, Homo sapiens
cugaucuugcaugucuacaauc

SEQ ID NO: 1627865 - RNA, 12 nt, Homo sapiens
cugaugcugaca

SEQ ID NO: 1627866 - RNA, 17 nt, Homo sapiens
cugauguaguaugcuua

SEQ ID NO: 1627867 - RNA, 16 nt, Homo sapiens
cugaugugacauucca

SEQ ID NO: 1627868 - RNA, 15 nt, Homo sapiens
cugauucagcauuuu

SEQ ID NO: 1627869 - RNA, 18 nt, Homo sapiens
cugauuuccuucugcuau

SEQ ID NO: 1627870 - RNA, 17 nt, Homo sapiens
cugcaaggggacauucc

SEQ ID NO: 1627871 - RNA, 14 nt, Homo sapiens
cugcacaccaaggc

SEQ ID NO: 1627872 - RNA, 23 nt, Homo sapiens
cugcacaugucuuguacaugugu

SEQ ID NO: 1627873 - RNA, 20 nt, Homo sapiens
cugcacuccagccuggggga

SEQ ID NO: 1627874 - RNA, 13 nt, Homo sapiens
cugcagcaaacac

SEQ ID NO: 1627875 - RNA, 17 nt, Homo sapiens
cugcagcaggaguggug

SEQ ID NO: 1627876 - RNA, 21 nt, Homo sapiens
cugcaggaucccuacugccaa

SEQ ID NO: 1627877 - RNA, 14 nt, Homo sapiens
cugcaugucuccuc

SEQ ID NO: 1627878 - RNA, 17 nt, Homo sapiens
cugcauuaucuugcuca

SEQ ID NO: 1627879 - RNA, 18 nt, Homo sapiens
cugcauuaucuugcucau

SEQ ID NO: 1627880 - RNA, 10 nt, Homo sapiens
cugcauuuca

SEQ ID NO: 1627881 - RNA, 12 nt, Homo sapiens
cugccaaggugg

SEQ ID NO: 1627882 - RNA, 17 nt, Homo sapiens
cugccacauacaccaca

SEQ ID NO: 1627883 - RNA, 12 nt, Homo sapiens
cugccacuccau

SEQ ID NO: 1627884 - RNA, 15 nt, Homo sapiens
cugccagaccugcau

SEQ ID NO: 1627885 - RNA, 20 nt, Homo sapiens
cugccaggcuguuucagcca

SEQ ID NO: 1627886 - RNA, 18 nt, Homo sapiens
cugcccacuccacuccuc

SEQ ID NO: 1627887 - RNA, 13 nt, Homo sapiens
cugcccagugcaa

SEQ ID NO: 1627888 - RNA, 21 nt, Homo sapiens
cugcccccuugggugaccucu

SEQ ID NO: 1627889 - RNA, 18 nt, Homo sapiens
cugccccuuccccaugaa

SEQ ID NO: 1627890 - RNA, 17 nt, Homo sapiens
cugcccucuauuuauua

SEQ ID NO: 1627891 - RNA, 16 nt, Homo sapiens
cugcccuucagcaucc

SEQ ID NO: 1627892 - RNA, 15 nt, Homo sapiens
cugccucacaucucc

SEQ ID NO: 1627893 - RNA, 15 nt, Homo sapiens
cugccucuggcuucc

SEQ ID NO: 1627894 - RNA, 22 nt, Homo sapiens
cugccuuaaauguaccuauggc

SEQ ID NO: 1627895 - RNA, 20 nt, Homo sapiens
cugccuuaaccugggaccaa

SEQ ID NO: 1627896 - RNA, 16 nt, Homo sapiens
cugccuucaaagccac

SEQ ID NO: 1627897 - RNA, 18 nt, Homo sapiens
cugccuuuaagccaaaga

SEQ ID NO: 1627898 - RNA, 18 nt, Homo sapiens
cugcgcauauagacugua

SEQ ID NO: 1627899 - RNA, 20 nt, Homo sapiens
cugcuaugacaaaaccuuua

SEQ ID NO: 1627900 - RNA, 20 nt, Homo sapiens
cugcucacaaaaucacuuua

SEQ ID NO: 1627901 - RNA, 14 nt, Homo sapiens
cugcucccacagaa

SEQ ID NO: 1627902 - RNA, 14 nt, Homo sapiens
cugcucgcucccug

SEQ ID NO: 1627903 - RNA, 19 nt, Homo sapiens
cugcucugaugcaucagaa

SEQ ID NO: 1627904 - RNA, 17 nt, Homo sapiens
cugcucugcccaggcaa

SEQ ID NO: 1627905 - RNA, 15 nt, Homo sapiens
cugcugcccagugca

SEQ ID NO: 1627906 - RNA, 21 nt, Homo sapiens
cugcugcccagugcaaaccac

SEQ ID NO: 1627907 - RNA, 20 nt, Homo sapiens
cugcugggugccuccuugcc

SEQ ID NO: 1627908 - RNA, 23 nt, Homo sapiens
cugcuguaaauuuggcuucuguu

SEQ ID NO: 1627909 - RNA, 18 nt, Homo sapiens
cugcuucccagguucaag

SEQ ID NO: 1627910 - RNA, 11 nt, Homo sapiens
cugcuuucuac

SEQ ID NO: 1627911 - RNA, 19 nt, Homo sapiens
cugcuuuugaaaucuguau

SEQ ID NO: 1627912 - RNA, 22 nt, Homo sapiens
cuggaaaagggucuugggaaau

SEQ ID NO: 1627913 - RNA, 19 nt, Homo sapiens
cuggaaaccucuacauauu

SEQ ID NO: 1627914 - RNA, 16 nt, Homo sapiens
cuggaaauaauaucau

SEQ ID NO: 1627915 - RNA, 14 nt, Homo sapiens
cuggaaggggccac

SEQ ID NO: 1627916 - RNA, 15 nt, Homo sapiens
cuggaaggggccacg

SEQ ID NO: 1627917 - RNA, 15 nt, Homo sapiens
cuggaauuacaggcg

SEQ ID NO: 1627918 - RNA, 20 nt, Homo sapiens
cuggacauuuuuucagucau

SEQ ID NO: 1627919 - RNA, 13 nt, Homo sapiens
cccucuauuuauu

SEQ ID NO: 1627920 - RNA, 13 nt, Homo sapiens
cccucuccuucca

SEQ ID NO: 1627921 - RNA, 21 nt, Homo sapiens
cccucugacuugacaagccuu

SEQ ID NO: 1627922 - RNA, 23 nt, Homo sapiens
cccugagcuuuguccugaaggaa

SEQ ID NO: 1627923 - RNA, 15 nt, Homo sapiens
cccugaugugacauu

SEQ ID NO: 1627924 - RNA, 17 nt, Homo sapiens
cccugcaggaaaacuga

SEQ ID NO: 1627925 - RNA, 21 nt, Homo sapiens
cccuuaaaggggagaccucag

SEQ ID NO: 1627926 - RNA, 21 nt, Homo sapiens
cccuuacagccucugacuuaa

SEQ ID NO: 1627927 - RNA, 15 nt, Homo sapiens
cccuuugagucugaa

SEQ ID NO: 1627928 - RNA, 13 nt, Homo sapiens
cccuuugugacuu

SEQ ID NO: 1627929 - RNA, 20 nt, Homo sapiens
cccuuuuaagcaugugaugu

SEQ ID NO: 1627930 - RNA, 11 nt, Homo sapiens
ccgagaacuuu

SEQ ID NO: 1627931 - RNA, 16 nt, Homo sapiens
ccgagaagcacuugag

SEQ ID NO: 1627932 - RNA, 19 nt, Homo sapiens
ccgcacugcccaggucccu

SEQ ID NO: 1627933 - RNA, 14 nt, Homo sapiens
ccgcgugcaaagga

SEQ ID NO: 1627934 - RNA, 18 nt, Homo sapiens
ccgcuuugaaagaagcaa

SEQ ID NO: 1627935 - RNA, 18 nt, Homo sapiens
ccggccaggugggcgggg

SEQ ID NO: 1627936 - RNA, 14 nt, Homo sapiens
ccgggcuggagaaa

SEQ ID NO: 1627937 - RNA, 15 nt, Homo sapiens
ccgggcuggagaaag

SEQ ID NO: 1627938 - RNA, 17 nt, Homo sapiens
ccgguucuuaaauccau

SEQ ID NO: 1627939 - RNA, 18 nt, Homo sapiens
ccguccuggcacagaaga

SEQ ID NO: 1627940 - RNA, 12 nt, Homo sapiens
ccgugggccaug

SEQ ID NO: 1627941 - RNA, 12 nt, Homo sapiens
ccuaacaugcac

SEQ ID NO: 1627942 - RNA, 18 nt, Homo sapiens
ccuaacaugcaccuugcu

SEQ ID NO: 1627943 - RNA, 17 nt, Homo sapiens
ccuaauaauuguaucua

SEQ ID NO: 1627944 - RNA, 19 nt, Homo sapiens
ccuaaugucuguaucacuc

SEQ ID NO: 1627945 - RNA, 18 nt, Homo sapiens
ccuaaugugaucauauga

SEQ ID NO: 1627946 - RNA, 20 nt, Homo sapiens
ccuaccccuccccagucucu

SEQ ID NO: 1627947 - RNA, 16 nt, Homo sapiens
ccuacguauccugcag

SEQ ID NO: 1627948 - RNA, 15 nt, Homo sapiens
ccuacugagcauuug

SEQ ID NO: 1627949 - RNA, 19 nt, Homo sapiens
ccuacugagcauuugcacc

SEQ ID NO: 1627950 - RNA, 20 nt, Homo sapiens
ccuagacucugucuaccugg

SEQ ID NO: 1627951 - RNA, 23 nt, Homo sapiens
ccuagcugggccaacuccaguga

SEQ ID NO: 1627952 - RNA, 21 nt, Homo sapiens
ccuagguuuuccuuccaagca

SEQ ID NO: 1627953 - RNA, 12 nt, Homo sapiens
ccuauagcucuu

SEQ ID NO: 1627954 - RNA, 15 nt, Homo sapiens
ccuauaucuuaggua

SEQ ID NO: 1627955 - RNA, 16 nt, Homo sapiens
ccuaugcccagggaau

SEQ ID NO: 1627956 - RNA, 20 nt, Homo sapiens
ccuaugcugcaauacauuaa

SEQ ID NO: 1627957 - RNA, 18 nt, Homo sapiens
ccucaagguguucucugu

SEQ ID NO: 1627958 - RNA, 16 nt, Homo sapiens
ccucaagugauccucc

SEQ ID NO: 1627959 - RNA, 23 nt, Homo sapiens
ccucacaaaccugaauggucuga

SEQ ID NO: 1627960 - RNA, 22 nt, Homo sapiens
ccucaccuagccugaugagauu

SEQ ID NO: 1627961 - RNA, 16 nt, Homo sapiens
ccucacugaaaacauc

SEQ ID NO: 1627962 - RNA, 22 nt, Homo sapiens
ccucacuugcuucuuauccuua

SEQ ID NO: 1627963 - RNA, 17 nt, Homo sapiens
ccucagggauccucugc

SEQ ID NO: 1627964 - RNA, 11 nt, Homo sapiens
ccucauugugu

SEQ ID NO: 1627965 - RNA, 13 nt, Homo sapiens
ccuccaagcauuu

SEQ ID NO: 1627966 - RNA, 13 nt, Homo sapiens
ccuccauccagaa

SEQ ID NO: 1627967 - RNA, 17 nt, Homo sapiens
ccuccccagcccaggaa

SEQ ID NO: 1627968 - RNA, 16 nt, Homo sapiens
ccuccccguccaggcc

SEQ ID NO: 1627969 - RNA, 22 nt, Homo sapiens
ccucccuccuuuccuuugcccu

SEQ ID NO: 1627970 - RNA, 18 nt, Homo sapiens
ccuccgccagauccugca

SEQ ID NO: 1627971 - RNA, 20 nt, Homo sapiens
ccuccuuggcuuuaugcaaa

SEQ ID NO: 1627972 - RNA, 21 nt, Homo sapiens
ccuccuuggcuuuaugcaaau

SEQ ID NO: 1627973 - RNA, 15 nt, Homo sapiens
ccuccuuggugccug

SEQ ID NO: 1627974 - RNA, 20 nt, Homo sapiens
ccucgaaaaccaucacauga

SEQ ID NO: 1627975 - RNA, 15 nt, Homo sapiens
ccucgcccuccacaa

SEQ ID NO: 1627976 - RNA, 17 nt, Homo sapiens
ccucggccucccaaaau

SEQ ID NO: 1627977 - RNA, 20 nt, Homo sapiens
ccucuccuuccaacaaaaga

SEQ ID NO: 1627978 - RNA, 12 nt, Homo sapiens
ccucucuacuuc

SEQ ID NO: 1627979 - RNA, 21 nt, Homo sapiens
ccucugacuuaagcugccuca

SEQ ID NO: 1627980 - RNA, 14 nt, Homo sapiens
ccucugcauuuaca

SEQ ID NO: 1627981 - RNA, 9 nt, Homo sapiens
ccucuggag

SEQ ID NO: 1627982 - RNA, 21 nt, Homo sapiens
ccucuggcuuccuaaacccau

SEQ ID NO: 1627983 - RNA, 20 nt, Homo sapiens
ccucugucagucacagccac

SEQ ID NO: 1627984 - RNA, 21 nt, Homo sapiens
ccucuucccccuuccaaauaa

SEQ ID NO: 1627985 - RNA, 19 nt, Homo sapiens
ccucuuugucuaaaacaau

SEQ ID NO: 1627986 - RNA, 17 nt, Homo sapiens
ccugacacccugggcuu

SEQ ID NO: 1627987 - RNA, 14 nt, Homo sapiens
ccugacuggccaaa

SEQ ID NO: 1627988 - RNA, 21 nt, Homo sapiens
ccugagauccggcaacaucaa

SEQ ID NO: 1627989 - RNA, 12 nt, Homo sapiens
ccugaggugccc

SEQ ID NO: 1627990 - RNA, 22 nt, Homo sapiens
ccugaguaauaagcaugguguc

SEQ ID NO: 1627991 - RNA, 19 nt, Homo sapiens
ccugaguuucaaguauccu

SEQ ID NO: 1627992 - RNA, 18 nt, Homo sapiens
ccugaucgccaaccuuuc

SEQ ID NO: 1627993 - RNA, 18 nt, Homo sapiens
ccugcagcaaacacucca

SEQ ID NO: 1627994 - RNA, 17 nt, Homo sapiens
ccugcaggacuugccac

SEQ ID NO: 1627995 - RNA, 16 nt, Homo sapiens
ccugcaugugcuguca

SEQ ID NO: 1627996 - RNA, 23 nt, Homo sapiens
ccugcauguuggcccagaccuca

SEQ ID NO: 1627997 - RNA, 15 nt, Homo sapiens
ccugccaagagucaa

SEQ ID NO: 1627998 - RNA, 22 nt, Homo sapiens
ccugccauucugcaugagcuga

SEQ ID NO: 1627999 - RNA, 17 nt, Homo sapiens
ccugcccccuuggguga

SEQ ID NO: 1628000 - RNA, 18 nt, Homo sapiens
ccugcccuugaacccccu

SEQ ID NO: 1628001 - RNA, 22 nt, Homo sapiens
ccugcuagucgccccucagagc

SEQ ID NO: 1628002 - RNA, 19 nt, Homo sapiens
ccugcuccccuacuucuca

SEQ ID NO: 1628003 - RNA, 13 nt, Homo sapiens
ccugcugagcucu

SEQ ID NO: 1628004 - RNA, 17 nt, Homo sapiens
ccuggaaauucugcugc

SEQ ID NO: 1628005 - RNA, 21 nt, Homo sapiens
ccuggacaaccuggacccaga

SEQ ID NO: 1628006 - RNA, 15 nt, Homo sapiens
ccuggaggaaugauu

SEQ ID NO: 1628007 - RNA, 17 nt, Homo sapiens
ccuggcagggcccagug

SEQ ID NO: 1628008 - RNA, 15 nt, Homo sapiens
ccuggccgaugguac

SEQ ID NO: 1628009 - RNA, 13 nt, Homo sapiens
ccugggaacauca

SEQ ID NO: 1628010 - RNA, 14 nt, Homo sapiens
ccugggccuaugga

SEQ ID NO: 1628011 - RNA, 19 nt, Homo sapiens
ccuggggauucacccagug

SEQ ID NO: 1628012 - RNA, 21 nt, Homo sapiens
ccuggggguuuaagcucugcc

SEQ ID NO: 1628013 - RNA, 18 nt, Homo sapiens
ccuggguaggccccacaa

SEQ ID NO: 1628014 - RNA, 21 nt, Homo sapiens
ccugggugaucugcugcugag

SEQ ID NO: 1628015 - RNA, 19 nt, Homo sapiens
ccugggugucugggcucaa

SEQ ID NO: 1628016 - RNA, 20 nt, Homo sapiens
ccugguauuuucaaccauaa

SEQ ID NO: 1628017 - RNA, 17 nt, Homo sapiens
ccuguaauauuuagcug

SEQ ID NO: 1628018 - RNA, 20 nt, Homo sapiens
ccuguaauauuuagcuguaa

SEQ ID NO: 1628019 - RNA, 16 nt, Homo sapiens
ccugucauuguauuca

SEQ ID NO: 1628020 - RNA, 16 nt, Homo sapiens
ccuguccccacccucc

SEQ ID NO: 1628021 - RNA, 17 nt, Homo sapiens
ccuguccuccaacacca

SEQ ID NO: 1628022 - RNA, 13 nt, Homo sapiens
ccuguccuuucag

SEQ ID NO: 1628023 - RNA, 21 nt, Homo sapiens
ccugucuuggggccacuuuca

SEQ ID NO: 1628024 - RNA, 14 nt, Homo sapiens
ccugugcucaaaaa

SEQ ID NO: 1628025 - RNA, 17 nt, Homo sapiens
ccuguguacugccuuaa

SEQ ID NO: 1628026 - RNA, 22 nt, Homo sapiens
ccugugugggacugaguggcaa

SEQ ID NO: 1628027 - RNA, 17 nt, Homo sapiens
ccugugugugcugccag

SEQ ID NO: 1628028 - RNA, 12 nt, Homo sapiens
ccuguuccccaa

SEQ ID NO: 1628029 - RNA, 19 nt, Homo sapiens
ccuguuccuuuaaccccaa

SEQ ID NO: 1628030 - RNA, 15 nt, Homo sapiens
ccuguuuucugcugu

SEQ ID NO: 1628031 - RNA, 21 nt, Homo sapiens
ccuuaaaggggagaccucaga

SEQ ID NO: 1628032 - RNA, 17 nt, Homo sapiens
ccuuaaguauaucaugu

SEQ ID NO: 1628033 - RNA, 19 nt, Homo sapiens
ccuuagaaaacaaguauug

SEQ ID NO: 1628034 - RNA, 23 nt, Homo sapiens
ccuuaggucgcgcucuugcacac

SEQ ID NO: 1628035 - RNA, 18 nt, Homo sapiens
ccuucaagguggcagcug

SEQ ID NO: 1628036 - RNA, 20 nt, Homo sapiens
ccuucaauuuguagacucuu

SEQ ID NO: 1628037 - RNA, 20 nt, Homo sapiens
ccuucaguucugcuugcucc

SEQ ID NO: 1628038 - RNA, 21 nt, Homo sapiens
ccuuccauagccuaaucccug

SEQ ID NO: 1628039 - RNA, 13 nt, Homo sapiens
ccuucuggugucu

SEQ ID NO: 1628040 - RNA, 17 nt, Homo sapiens
ccuugaugagcugugca

SEQ ID NO: 1628041 - RNA, 19 nt, Homo sapiens
ccuugaugagcugugcaca

SEQ ID NO: 1628042 - RNA, 17 nt, Homo sapiens
ccuugccccuaccucag

SEQ ID NO: 1628043 - RNA, 14 nt, Homo sapiens
ccuuggcuuuaugc

SEQ ID NO: 1628044 - RNA, 11 nt, Homo sapiens
ccuugucuccc

SEQ ID NO: 1628045 - RNA, 22 nt, Homo sapiens
ccuuguucuauuuuucaaucau

SEQ ID NO: 1628046 - RNA, 19 nt, Homo sapiens
ccuuguugacacggccaug

SEQ ID NO: 1628047 - RNA, 17 nt, Homo sapiens
ccuuuaaauaucauucu

SEQ ID NO: 1628048 - RNA, 17 nt, Homo sapiens
ccuuucagugcaguuuc

SEQ ID NO: 1628049 - RNA, 13 nt, Homo sapiens
ccuuuccaauaga

SEQ ID NO: 1628050 - RNA, 17 nt, Homo sapiens
ccuuucucaacuguccc

SEQ ID NO: 1628051 - RNA, 13 nt, Homo sapiens
ccuuugcaauuug

SEQ ID NO: 1628052 - RNA, 15 nt, Homo sapiens
ccuuuggaauggugu

SEQ ID NO: 1628053 - RNA, 15 nt, Homo sapiens
ccuuuuaacugccaa

SEQ ID NO: 1628054 - RNA, 15 nt, Homo sapiens
ccuuuuacucagcuu

SEQ ID NO: 1628055 - RNA, 14 nt, Homo sapiens
ccuuuuauguguug

SEQ ID NO: 1628056 - RNA, 18 nt, Homo sapiens
ccuuuuuuaaaaaugcaa

SEQ ID NO: 1628057 - RNA, 17 nt, Homo sapiens
ccuuuuuuauuccauaa

SEQ ID NO: 1628058 - RNA, 21 nt, Homo sapiens
cgaaaccgguggggcugguuc

SEQ ID NO: 1628059 - RNA, 19 nt, Homo sapiens
cgaaacuccauugagucau

SEQ ID NO: 1628060 - RNA, 22 nt, Homo sapiens
cgaaagcaaugcuucuaucaaa

SEQ ID NO: 1628061 - RNA, 16 nt, Homo sapiens
cgaaucacacagacag

SEQ ID NO: 1628062 - RNA, 16 nt, Homo sapiens
cgaccugcgccaaucc

SEQ ID NO: 1628063 - RNA, 17 nt, Homo sapiens
cgagcaccugugcccau

SEQ ID NO: 1628064 - RNA, 20 nt, Homo sapiens
cgaggccccugucucagggu

SEQ ID NO: 1628065 - RNA, 18 nt, Homo sapiens
cgaguggaugcugugcua

SEQ ID NO: 1628066 - RNA, 22 nt, Homo sapiens
cgauauucuuugcucuugccau

SEQ ID NO: 1628067 - RNA, 22 nt, Homo sapiens
cgaucgauggaugggaugcacu

SEQ ID NO: 1628068 - RNA, 20 nt, Homo sapiens
cgaucucaacucacugcaag

SEQ ID NO: 1628069 - RNA, 23 nt, Homo sapiens
cgcaauuuuaccuaguuugcacu

SEQ ID NO: 1628070 - RNA, 22 nt, Homo sapiens
cgcacacacccauguaaccacu

SEQ ID NO: 1628071 - RNA, 13 nt, Homo sapiens
cgcaccugccuca

SEQ ID NO: 1628072 - RNA, 15 nt, Homo sapiens
cgcacugcccagguc

SEQ ID NO: 1628073 - RNA, 19 nt, Homo sapiens
cgcaggaagacccaacaca

SEQ ID NO: 1628074 - RNA, 15 nt, Homo sapiens
cgcauauagacugua

SEQ ID NO: 1628075 - RNA, 19 nt, Homo sapiens
cgccaaucccgccaugcuc

SEQ ID NO: 1628076 - RNA, 16 nt, Homo sapiens
cgccacuggacugucu

SEQ ID NO: 1628077 - RNA, 18 nt, Homo sapiens
cgccccaaaguugcucac

SEQ ID NO: 1628078 - RNA, 22 nt, Homo sapiens
cgccggauguuucugugacaca

SEQ ID NO: 1628079 - RNA, 20 nt, Homo sapiens
cgccgucccaccagcuucac

SEQ ID NO: 1628080 - RNA, 14 nt, Homo sapiens
cgcuagcaguacua

SEQ ID NO: 1628081 - RNA, 16 nt, Homo sapiens
cgcuagcaguacuaau

SEQ ID NO: 1628082 - RNA, 16 nt, Homo sapiens
cggaaagcccugugcu

SEQ ID NO: 1628083 - RNA, 15 nt, Homo sapiens
cggaauugcucuccc

SEQ ID NO: 1628084 - RNA, 13 nt, Homo sapiens
cggcucacaaaga

SEQ ID NO: 1628085 - RNA, 14 nt, Homo sapiens
cggcucagugcaac

SEQ ID NO: 1628086 - RNA, 13 nt, Homo sapiens
cggcucuagcccc

SEQ ID NO: 1628087 - RNA, 22 nt, Homo sapiens
cgggcaugagucuguuucccaa

SEQ ID NO: 1628088 - RNA, 18 nt, Homo sapiens
cggggacuaacaaagaca

SEQ ID NO: 1628089 - RNA, 16 nt, Homo sapiens
cguaagaccaccuucc

SEQ ID NO: 1628090 - RNA, 17 nt, Homo sapiens
cgucaucaucacauuca

SEQ ID NO: 1628091 - RNA, 21 nt, Homo sapiens
cguccauugccggcaauggau

SEQ ID NO: 1628092 - RNA, 13 nt, Homo sapiens
cgucccaccagcu

SEQ ID NO: 1628093 - RNA, 14 nt, Homo sapiens
cgucuggacugcua

SEQ ID NO: 1628094 - RNA, 16 nt, Homo sapiens
cgucuguuuuugcaac

SEQ ID NO: 1628095 - RNA, 20 nt, Homo sapiens
cgugauucaaugaaccacaa

SEQ ID NO: 1628096 - RNA, 16 nt, Homo sapiens
cgugauuuugcuguag

SEQ ID NO: 1628097 - RNA, 22 nt, Homo sapiens
cgugcaugcucugcagcauuga

SEQ ID NO: 1628098 - RNA, 21 nt, Homo sapiens
cguggacucugcacaugucuu

SEQ ID NO: 1628099 - RNA, 19 nt, Homo sapiens
cguggugugagaagaucau

SEQ ID NO: 1628100 - RNA, 15 nt, Homo sapiens
cguucaauaagcauu

SEQ ID NO: 1628101 - RNA, 19 nt, Homo sapiens
cguuggccuaacacugggc

SEQ ID NO: 1628102 - RNA, 12 nt, Homo sapiens
cguugucccuga

SEQ ID NO: 1628103 - RNA, 13 nt, Homo sapiens
cguuuauuucaca

SEQ ID NO: 1628104 - RNA, 22 nt, Homo sapiens
cuaaaaaggucuguuaauguca

SEQ ID NO: 1628105 - RNA, 19 nt, Homo sapiens
cuaaaauagcaauaacuga

SEQ ID NO: 1628106 - RNA, 13 nt, Homo sapiens
cuaaagcaagccu

SEQ ID NO: 1628107 - RNA, 11 nt, Homo sapiens
cuaaagggcag

SEQ ID NO: 1628108 - RNA, 22 nt, Homo sapiens
cuaaaguuaaauaggauauuaa

SEQ ID NO: 1628109 - RNA, 15 nt, Homo sapiens
cuaacacagccauca

SEQ ID NO: 1628110 - RNA, 14 nt, Homo sapiens
cuaacacggugcuc

SEQ ID NO: 1628111 - RNA, 18 nt, Homo sapiens
cuaacuguacauuucaca

SEQ ID NO: 1628112 - RNA, 22 nt, Homo sapiens
cuaacuuuguauccguucaaua

SEQ ID NO: 1628113 - RNA, 20 nt, Homo sapiens
cuaagaauaaacuccauuua

SEQ ID NO: 1628114 - RNA, 21 nt, Homo sapiens
cuaagaauaaacuccauuuaa

SEQ ID NO: 1628115 - RNA, 14 nt, Homo sapiens
cuaagaauucucuc

SEQ ID NO: 1628116 - RNA, 17 nt, Homo sapiens
cuaagagacacauacag

SEQ ID NO: 1628117 - RNA, 20 nt, Homo sapiens
cuaagaucucgguuugccaa

SEQ ID NO: 1628118 - RNA, 13 nt, Homo sapiens
cuaaggaguaauc

SEQ ID NO: 1628119 - RNA, 17 nt, Homo sapiens
cuaagggaacaauccau

SEQ ID NO: 1628120 - RNA, 11 nt, Homo sapiens
cuaagucacau

SEQ ID NO: 1628121 - RNA, 16 nt, Homo sapiens
cuaagucacauaucag

SEQ ID NO: 1628122 - RNA, 18 nt, Homo sapiens
cuaauaauguuaaccaag

SEQ ID NO: 1628123 - RNA, 23 nt, Homo sapiens
cuaauaauuguaucuacauuaaa

SEQ ID NO: 1628124 - RNA, 15 nt, Homo sapiens
cuaauaccucugugu

SEQ ID NO: 1628125 - RNA, 16 nt, Homo sapiens
cuaauagucuuugcca

SEQ ID NO: 1628126 - RNA, 17 nt, Homo sapiens
cuaauagucuuugccag

SEQ ID NO: 1628127 - RNA, 15 nt, Homo sapiens
cuaauauacuuguaa

SEQ ID NO: 1628128 - RNA, 23 nt, Homo sapiens
cuaaugacaaguauuuucuacua

SEQ ID NO: 1628129 - RNA, 12 nt, Homo sapiens
cuaaugcucaac

SEQ ID NO: 1628130 - RNA, 17 nt, Homo sapiens
cuaaugugaaaaucauc

SEQ ID NO: 1628131 - RNA, 23 nt, Homo sapiens
cuaauguuugaacaaagcucaaa

SEQ ID NO: 1628132 - RNA, 16 nt, Homo sapiens
cuaauuguaagugaaa

SEQ ID NO: 1628133 - RNA, 19 nt, Homo sapiens
cuacaaaaccucaaaccag

SEQ ID NO: 1628134 - RNA, 15 nt, Homo sapiens
cuacauaacuuccua

SEQ ID NO: 1628135 - RNA, 12 nt, Homo sapiens
cuaccacuguau

SEQ ID NO: 1628136 - RNA, 16 nt, Homo sapiens
cuacccauuguucccu

SEQ ID NO: 1628137 - RNA, 16 nt, Homo sapiens
cuaccugggcuucugg

SEQ ID NO: 1628138 - RNA, 20 nt, Homo sapiens
cuaccuuagaaaacaaguau

SEQ ID NO: 1628139 - RNA, 16 nt, Homo sapiens
agagauaaacuacaua

SEQ ID NO: 1628140 - RNA, 20 nt, Homo sapiens
agagaugacacuagucagaa

SEQ ID NO: 1628141 - RNA, 20 nt, Homo sapiens
agagaugacuauuacuuuuc

SEQ ID NO: 1628142 - RNA, 17 nt, Homo sapiens
agagccaggaugcccag

SEQ ID NO: 1628143 - RNA, 22 nt, Homo sapiens
agagcgugcuuucaaguguccu

SEQ ID NO: 1628144 - RNA, 23 nt, Homo sapiens
agagcuuuuauuugguguguucg

SEQ ID NO: 1628145 - RNA, 14 nt, Homo sapiens
agaggcagugacag

SEQ ID NO: 1628146 - RNA, 21 nt, Homo sapiens
agaggcucagacucacuguua

SEQ ID NO: 1628147 - RNA, 20 nt, Homo sapiens
agaggucaaggcugcaguga

SEQ ID NO: 1628148 - RNA, 18 nt, Homo sapiens
agaggugcuccauggagg

SEQ ID NO: 1628149 - RNA, 21 nt, Homo sapiens
agagguuugguuuccuguguc

SEQ ID NO: 1628150 - RNA, 13 nt, Homo sapiens
agaguaccugugu

SEQ ID NO: 1628151 - RNA, 16 nt, Homo sapiens
agaguagagggcacug

SEQ ID NO: 1628152 - RNA, 19 nt, Homo sapiens
agaguagagggcacugggu

SEQ ID NO: 1628153 - RNA, 19 nt, Homo sapiens
agaguagguacuccauaaa

SEQ ID NO: 1628154 - RNA, 22 nt, Homo sapiens
agagucuaauagucuuugccag

SEQ ID NO: 1628155 - RNA, 13 nt, Homo sapiens
agagucugugcug

SEQ ID NO: 1628156 - RNA, 14 nt, Homo sapiens
agagucugugcugg

SEQ ID NO: 1628157 - RNA, 21 nt, Homo sapiens
agaguuuggaauuauuguaga

SEQ ID NO: 1628158 - RNA, 15 nt, Homo sapiens
agauaaacuacauag

SEQ ID NO: 1628159 - RNA, 21 nt, Homo sapiens
agauagaacacaaaacuugaa

SEQ ID NO: 1628160 - RNA, 13 nt, Homo sapiens
agauagcugccac

SEQ ID NO: 1628161 - RNA, 20 nt, Homo sapiens
agauauauguguauacauac

SEQ ID NO: 1628162 - RNA, 16 nt, Homo sapiens
agauauggcauugcac

SEQ ID NO: 1628163 - RNA, 16 nt, Homo sapiens
agauccuauagcucuu

SEQ ID NO: 1628164 - RNA, 13 nt, Homo sapiens
agauccugcauuu

SEQ ID NO: 1628165 - RNA, 17 nt, Homo sapiens
agaucucgguuugccaa

SEQ ID NO: 1628166 - RNA, 20 nt, Homo sapiens
agaucuggggaggcaggcau

SEQ ID NO: 1628167 - RNA, 15 nt, Homo sapiens
agaugacagggaaaa

SEQ ID NO: 1628168 - RNA, 19 nt, Homo sapiens
agaugacagggaaaacugc

SEQ ID NO: 1628169 - RNA, 22 nt, Homo sapiens
agaugacagggaaaacugcaaa

SEQ ID NO: 1628170 - RNA, 22 nt, Homo sapiens
agaugauuucaauagcuuugua

SEQ ID NO: 1628171 - RNA, 18 nt, Homo sapiens
agaugcccccuccaggag

SEQ ID NO: 1628172 - RNA, 16 nt, Homo sapiens
agaugcccucaacuca

SEQ ID NO: 1628173 - RNA, 22 nt, Homo sapiens
agauggacacgagccacaagcu

SEQ ID NO: 1628174 - RNA, 17 nt, Homo sapiens
agauggagucucacucu

SEQ ID NO: 1628175 - RNA, 12 nt, Homo sapiens
agauggaguucu

SEQ ID NO: 1628176 - RNA, 20 nt, Homo sapiens
agauggaguucuugugccau

SEQ ID NO: 1628177 - RNA, 21 nt, Homo sapiens
agauguuuguuuucaaaauac

SEQ ID NO: 1628178 - RNA, 22 nt, Homo sapiens
agauguuuuacgucugggagaa

SEQ ID NO: 1628179 - RNA, 22 nt, Homo sapiens
agauuaugaugaaaaccuacau

SEQ ID NO: 1628180 - RNA, 16 nt, Homo sapiens
agauuccuaugaugga

SEQ ID NO: 1628181 - RNA, 12 nt, Homo sapiens
agauugugcucc

SEQ ID NO: 1628182 - RNA, 18 nt, Homo sapiens
agauuuccaaaagacuug

SEQ ID NO: 1628183 - RNA, 17 nt, Homo sapiens
agauuugaugggccaca

SEQ ID NO: 1628184 - RNA, 15 nt, Homo sapiens
agauuuuuuccucug

SEQ ID NO: 1628185 - RNA, 20 nt, Homo sapiens
agcaaauaauuuccuggugu

SEQ ID NO: 1628186 - RNA, 16 nt, Homo sapiens
agcaaauuuucagcau

SEQ ID NO: 1628187 - RNA, 12 nt, Homo sapiens
agcaacagucca

SEQ ID NO: 1628188 - RNA, 17 nt, Homo sapiens
agcaagacauacuuaau

SEQ ID NO: 1628189 - RNA, 17 nt, Homo sapiens
agcaagggacagugagg

SEQ ID NO: 1628190 - RNA, 15 nt, Homo sapiens
agcaaguguucacaa

SEQ ID NO: 1628191 - RNA, 22 nt, Homo sapiens
agcaaguguucacaacagugaa

SEQ ID NO: 1628192 - RNA, 21 nt, Homo sapiens
agcaauugugaaauacaguau

SEQ ID NO: 1628193 - RNA, 20 nt, Homo sapiens
agcacaaggccaucugggcu

SEQ ID NO: 1628194 - RNA, 22 nt, Homo sapiens
agcacaaucacuaaacuuuauu

SEQ ID NO: 1628195 - RNA, 16 nt, Homo sapiens
agcacagcuccugcca

SEQ ID NO: 1628196 - RNA, 14 nt, Homo sapiens
agcacggacuguca

SEQ ID NO: 1628197 - RNA, 18 nt, Homo sapiens
agcacugaaaauaguguu

SEQ ID NO: 1628198 - RNA, 17 nt, Homo sapiens
agcagacuuuugugaac

SEQ ID NO: 1628199 - RNA, 23 nt, Homo sapiens
agcagagcuuagcuucaaggaca

SEQ ID NO: 1628200 - RNA, 23 nt, Homo sapiens
agcagcacuuuuuaguucccuaa

SEQ ID NO: 1628201 - RNA, 23 nt, Homo sapiens
agcaggcagcgccaagugcgugc

SEQ ID NO: 1628202 - RNA, 14 nt, Homo sapiens
agcaggcuagacag

SEQ ID NO: 1628203 - RNA, 20 nt, Homo sapiens
agcagguucccaagcucaga

SEQ ID NO: 1628204 - RNA, 22 nt, Homo sapiens
agcagucacugacaguuaauaa

SEQ ID NO: 1628205 - RNA, 15 nt, Homo sapiens
agcauaccacuugaa

SEQ ID NO: 1628206 - RNA, 16 nt, Homo sapiens
agcauccucaguuccu

SEQ ID NO: 1628207 - RNA, 21 nt, Homo sapiens
agcaucuccuuacagucacua

SEQ ID NO: 1628208 - RNA, 17 nt, Homo sapiens
agcaucuuuaacacaac

SEQ ID NO: 1628209 - RNA, 21 nt, Homo sapiens
agcaugaaauguccucuugaa

SEQ ID NO: 1628210 - RNA, 22 nt, Homo sapiens
agcaugaaauguccucuugaag

SEQ ID NO: 1628211 - RNA, 15 nt, Homo sapiens
agcaugccugaacua

SEQ ID NO: 1628212 - RNA, 23 nt, Homo sapiens
agcauuacccuccucucucccca

SEQ ID NO: 1628213 - RNA, 15 nt, Homo sapiens
agcauuccacacugc

SEQ ID NO: 1628214 - RNA, 12 nt, Homo sapiens
agcauuugcacc

SEQ ID NO: 1628215 - RNA, 14 nt, Homo sapiens
agcauuugcaccuc

SEQ ID NO: 1628216 - RNA, 13 nt, Homo sapiens
agccaaacaaaac

SEQ ID NO: 1628217 - RNA, 20 nt, Homo sapiens
agccaacuguuucccugcug

SEQ ID NO: 1628218 - RNA, 20 nt, Homo sapiens
agccaaggucaugccacugc

SEQ ID NO: 1628219 - RNA, 17 nt, Homo sapiens
agccacaagcugcacug

SEQ ID NO: 1628220 - RNA, 18 nt, Homo sapiens
agccacauguacacuaca

SEQ ID NO: 1628221 - RNA, 14 nt, Homo sapiens
agccaccucaccaa

SEQ ID NO: 1628222 - RNA, 17 nt, Homo sapiens
agccacgaggugcaaca

SEQ ID NO: 1628223 - RNA, 18 nt, Homo sapiens
agccacuauuaacauuuc

SEQ ID NO: 1628224 - RNA, 19 nt, Homo sapiens
agccacuuugcuaccauga

SEQ ID NO: 1628225 - RNA, 20 nt, Homo sapiens
agccacuuugcuaccaugac

SEQ ID NO: 1628226 - RNA, 22 nt, Homo sapiens
agccagaauucuacccuggaaa

SEQ ID NO: 1628227 - RNA, 14 nt, Homo sapiens
agccagaggcaucu

SEQ ID NO: 1628228 - RNA, 16 nt, Homo sapiens
agccagaggcaucuga

SEQ ID NO: 1628229 - RNA, 22 nt, Homo sapiens
agccagcaagagggaacaaaac

SEQ ID NO: 1628230 - RNA, 12 nt, Homo sapiens
agccaggagcag

SEQ ID NO: 1628231 - RNA, 18 nt, Homo sapiens
agccaggagcagcccugg

SEQ ID NO: 1628232 - RNA, 21 nt, Homo sapiens
agccaggguggucuugaucuc

SEQ ID NO: 1628233 - RNA, 17 nt, Homo sapiens
agccaguggggaugagg

SEQ ID NO: 1628234 - RNA, 21 nt, Homo sapiens
agccaguggggaugaggucac

SEQ ID NO: 1628235 - RNA, 23 nt, Homo sapiens
agccaugacaagaacaaagccac

SEQ ID NO: 1628236 - RNA, 17 nt, Homo sapiens
agccauugaucauaaac

SEQ ID NO: 1628237 - RNA, 16 nt, Homo sapiens
agcccacauacuggau

SEQ ID NO: 1628238 - RNA, 21 nt, Homo sapiens
agcccagcacagguauuucag

SEQ ID NO: 1628239 - RNA, 18 nt, Homo sapiens
agcccauugcugccaagg

SEQ ID NO: 1628240 - RNA, 19 nt, Homo sapiens
agccccauugcuccauuca

SEQ ID NO: 1628241 - RNA, 22 nt, Homo sapiens
agccccugggcccaguaccuag

SEQ ID NO: 1628242 - RNA, 17 nt, Homo sapiens
agcccgacagugccauc

SEQ ID NO: 1628243 - RNA, 15 nt, Homo sapiens
agcccucucacugug

SEQ ID NO: 1628244 - RNA, 16 nt, Homo sapiens
agcccucucacugugu

SEQ ID NO: 1628245 - RNA, 20 nt, Homo sapiens
agcccuggccucugcucaac

SEQ ID NO: 1628246 - RNA, 12 nt, Homo sapiens
agccuaacacgg

SEQ ID NO: 1628247 - RNA, 17 nt, Homo sapiens
agccuaauaacgugaaa

SEQ ID NO: 1628248 - RNA, 12 nt, Homo sapiens
agggacaagcca

SEQ ID NO: 1628249 - RNA, 12 nt, Homo sapiens
agggacacucca

SEQ ID NO: 1628250 - RNA, 13 nt, Homo sapiens
agggacacuccaa

SEQ ID NO: 1628251 - RNA, 21 nt, Homo sapiens
agggacacuccaacucuacac

SEQ ID NO: 1628252 - RNA, 17 nt, Homo sapiens
agggacacuuucacagu

SEQ ID NO: 1628253 - RNA, 17 nt, Homo sapiens
agggacaggcacuccaa

SEQ ID NO: 1628254 - RNA, 16 nt, Homo sapiens
agggaccucaagcacc

SEQ ID NO: 1628255 - RNA, 14 nt, Homo sapiens
agggaccuugucuc

SEQ ID NO: 1628256 - RNA, 14 nt, Homo sapiens
agggagaacgggaa

SEQ ID NO: 1628257 - RNA, 15 nt, Homo sapiens
agggagggcucugag

SEQ ID NO: 1628258 - RNA, 16 nt, Homo sapiens
agggagggcugucauc

SEQ ID NO: 1628259 - RNA, 18 nt, Homo sapiens
agggaugcggauccugcu

SEQ ID NO: 1628260 - RNA, 22 nt, Homo sapiens
agggcaagggaggggugguauu

SEQ ID NO: 1628261 - RNA, 19 nt, Homo sapiens
agggcugucaucugugcac

SEQ ID NO: 1628262 - RNA, 14 nt, Homo sapiens
aggggaaagagaga

SEQ ID NO: 1628263 - RNA, 20 nt, Homo sapiens
aggggagcaacagaggacau

SEQ ID NO: 1628264 - RNA, 18 nt, Homo sapiens
aggggcaugacugucgcc

SEQ ID NO: 1628265 - RNA, 11 nt, Homo sapiens
aggggccagaa

SEQ ID NO: 1628266 - RNA, 17 nt, Homo sapiens
aggggccucccugugac

SEQ ID NO: 1628267 - RNA, 22 nt, Homo sapiens
agggggagccccuucugcucag

SEQ ID NO: 1628268 - RNA, 21 nt, Homo sapiens
agggggcgaagggaucagccc

SEQ ID NO: 1628269 - RNA, 13 nt, Homo sapiens
agggguacauucu

SEQ ID NO: 1628270 - RNA, 14 nt, Homo sapiens
agggucaagccucu

SEQ ID NO: 1628271 - RNA, 17 nt, Homo sapiens
agggucugugugaaugu

SEQ ID NO: 1628272 - RNA, 20 nt, Homo sapiens
agggucuuuucaucugggaa

SEQ ID NO: 1628273 - RNA, 21 nt, Homo sapiens
agggugaggugcuugagucuc

SEQ ID NO: 1628274 - RNA, 19 nt, Homo sapiens
agggugcaguaucaugccc

SEQ ID NO: 1628275 - RNA, 16 nt, Homo sapiens
agguaggaagcacuga

SEQ ID NO: 1628276 - RNA, 20 nt, Homo sapiens
agguauuacacaagccaaaa

SEQ ID NO: 1628277 - RNA, 19 nt, Homo sapiens
aggucaugccacugcacuc

SEQ ID NO: 1628278 - RNA, 21 nt, Homo sapiens
aggucaugccacugcacucua

SEQ ID NO: 1628279 - RNA, 18 nt, Homo sapiens
agguccugagcacugcca

SEQ ID NO: 1628280 - RNA, 14 nt, Homo sapiens
aggucuaccccugg

SEQ ID NO: 1628281 - RNA, 19 nt, Homo sapiens
aggucuccaaacugauuaa

SEQ ID NO: 1628282 - RNA, 21 nt, Homo sapiens
aggugaauaaacacacagauc

SEQ ID NO: 1628283 - RNA, 13 nt, Homo sapiens
aggugacacucca

SEQ ID NO: 1628284 - RNA, 15 nt, Homo sapiens
aggugagaacccugu

SEQ ID NO: 1628285 - RNA, 23 nt, Homo sapiens
aggugauuuguaugcucauugaa

SEQ ID NO: 1628286 - RNA, 23 nt, Homo sapiens
aggugcccacuccgccagccaca

SEQ ID NO: 1628287 - RNA, 15 nt, Homo sapiens
aggugcccaggagaa

SEQ ID NO: 1628288 - RNA, 18 nt, Homo sapiens
aggugcuguccccacugc

SEQ ID NO: 1628289 - RNA, 20 nt, Homo sapiens
aggugcuguccccacugccc

SEQ ID NO: 1628290 - RNA, 17 nt, Homo sapiens
aggugcuugagucucca

SEQ ID NO: 1628291 - RNA, 22 nt, Homo sapiens
aggugugcaaaguccguguccu

SEQ ID NO: 1628292 - RNA, 20 nt, Homo sapiens
agguguugcagcccaaaggc

SEQ ID NO: 1628293 - RNA, 14 nt, Homo sapiens
agguucagccugaa

SEQ ID NO: 1628294 - RNA, 19 nt, Homo sapiens
agguuucaacaaauuucau

SEQ ID NO: 1628295 - RNA, 18 nt, Homo sapiens
agguuucuuugacuucaa

SEQ ID NO: 1628296 - RNA, 23 nt, Homo sapiens
agguuugguuugguuuuggacau

SEQ ID NO: 1628297 - RNA, 22 nt, Homo sapiens
aguaaaagaucagguuauacuu

SEQ ID NO: 1628298 - RNA, 20 nt, Homo sapiens
aguaaagcagaggaugcaac

SEQ ID NO: 1628299 - RNA, 12 nt, Homo sapiens
aguaaauccaug

SEQ ID NO: 1628300 - RNA, 15 nt, Homo sapiens
aguaacuccccucag

SEQ ID NO: 1628301 - RNA, 23 nt, Homo sapiens
aguaacugguuaaaaaacaaaug

SEQ ID NO: 1628302 - RNA, 14 nt, Homo sapiens
aguaaguaauauca

SEQ ID NO: 1628303 - RNA, 19 nt, Homo sapiens
aguaauauagcugagacua

SEQ ID NO: 1628304 - RNA, 16 nt, Homo sapiens
aguaaugaucucaaac

SEQ ID NO: 1628305 - RNA, 14 nt, Homo sapiens
aguacaaugcccag

SEQ ID NO: 1628306 - RNA, 22 nt, Homo sapiens
aguacacuuuuaugagcuucca

SEQ ID NO: 1628307 - RNA, 21 nt, Homo sapiens
aguagauuuuaaagacaaaau

SEQ ID NO: 1628308 - RNA, 10 nt, Homo sapiens
aguagcugag

SEQ ID NO: 1628309 - RNA, 20 nt, Homo sapiens
aguaguccuuggcauagaca

SEQ ID NO: 1628310 - RNA, 23 nt, Homo sapiens
aguaucaggucugaccccagugg

SEQ ID NO: 1628311 - RNA, 20 nt, Homo sapiens
aguauggcuccuccauaucu

SEQ ID NO: 1628312 - RNA, 15 nt, Homo sapiens
aguauuaauacuacc

SEQ ID NO: 1628313 - RNA, 20 nt, Homo sapiens
aguauuauauaaacugugcc

SEQ ID NO: 1628314 - RNA, 22 nt, Homo sapiens
aguauuaucauugcuccccuga

SEQ ID NO: 1628315 - RNA, 20 nt, Homo sapiens
aguauugucgguuaccucug

SEQ ID NO: 1628316 - RNA, 17 nt, Homo sapiens
agucaagcuccaagagg

SEQ ID NO: 1628317 - RNA, 14 nt, Homo sapiens
agucaauauuguau

SEQ ID NO: 1628318 - RNA, 10 nt, Homo sapiens
agucaaucca

SEQ ID NO: 1628319 - RNA, 19 nt, Homo sapiens
agucacauggccuaugcac

SEQ ID NO: 1628320 - RNA, 20 nt, Homo sapiens
agucacccagggacacucca

SEQ ID NO: 1628321 - RNA, 11 nt, Homo sapiens
agucaccucac

SEQ ID NO: 1628322 - RNA, 17 nt, Homo sapiens
agucaucagaaauucca

SEQ ID NO: 1628323 - RNA, 13 nt, Homo sapiens
agucaugcugugc

SEQ ID NO: 1628324 - RNA, 17 nt, Homo sapiens
agucauggcuaauuuaa

SEQ ID NO: 1628325 - RNA, 12 nt, Homo sapiens
agucaugguguu

SEQ ID NO: 1628326 - RNA, 19 nt, Homo sapiens
agucauuccaugaagcccc

SEQ ID NO: 1628327 - RNA, 23 nt, Homo sapiens
agucauuccaugaagccccagag

SEQ ID NO: 1628328 - RNA, 20 nt, Homo sapiens
agucccauccucuugucagg

SEQ ID NO: 1628329 - RNA, 18 nt, Homo sapiens
agucccuuugugacuuca

SEQ ID NO: 1628330 - RNA, 19 nt, Homo sapiens
aguccguguccuaccuccg

SEQ ID NO: 1628331 - RNA, 17 nt, Homo sapiens
aguccuucccuuucauu

SEQ ID NO: 1628332 - RNA, 19 nt, Homo sapiens
agucggccccaucucucau

SEQ ID NO: 1628333 - RNA, 15 nt, Homo sapiens
agucuaaacagaguc

SEQ ID NO: 1628334 - RNA, 17 nt, Homo sapiens
agucuauguauguguaa

SEQ ID NO: 1628335 - RNA, 13 nt, Homo sapiens
agucucaccagcc

SEQ ID NO: 1628336 - RNA, 14 nt, Homo sapiens
agucucucuuccaa

SEQ ID NO: 1628337 - RNA, 21 nt, Homo sapiens
agucugacccuuacagccucu

SEQ ID NO: 1628338 - RNA, 21 nt, Homo sapiens
agucugcuacccucauuucuc

SEQ ID NO: 1628339 - RNA, 21 nt, Homo sapiens
agucuggaaaacagaaaccau

SEQ ID NO: 1628340 - RNA, 16 nt, Homo sapiens
agucuuguauuaaguu

SEQ ID NO: 1628341 - RNA, 18 nt, Homo sapiens
agucuuuguuuacaugag

SEQ ID NO: 1628342 - RNA, 14 nt, Homo sapiens
agugaacuaugaag

SEQ ID NO: 1628343 - RNA, 22 nt, Homo sapiens
agugaauacauuaacggugcua

SEQ ID NO: 1628344 - RNA, 18 nt, Homo sapiens
agugaccagcacacugga

SEQ ID NO: 1628345 - RNA, 13 nt, Homo sapiens
agugacgcugcug

SEQ ID NO: 1628346 - RNA, 17 nt, Homo sapiens
agugaggugacacucca

SEQ ID NO: 1628347 - RNA, 18 nt, Homo sapiens
agugaguucguuuuggag

SEQ ID NO: 1628348 - RNA, 14 nt, Homo sapiens
agugauccucccac

SEQ ID NO: 1628349 - RNA, 19 nt, Homo sapiens
agugcaguggcgugaucuc

SEQ ID NO: 1628350 - RNA, 14 nt, Homo sapiens
agugcaguggugcg

SEQ ID NO: 1628351 - RNA, 11 nt, Homo sapiens
agugcauuuag

SEQ ID NO: 1628352 - RNA, 16 nt, Homo sapiens
agugcauuugugcuag

SEQ ID NO: 1628353 - RNA, 14 nt, Homo sapiens
agugcugucuggga

SEQ ID NO: 1628354 - RNA, 17 nt, Homo sapiens
aguggagaccuuucuag

SEQ ID NO: 1628355 - RNA, 16 nt, Homo sapiens
aguggaguuggugaau

SEQ ID NO: 1628356 - RNA, 12 nt, Homo sapiens
aguggccaguuc

SEQ ID NO: 1628357 - RNA, 20 nt, Homo sapiens
aguggcgugaucucggcuca

SEQ ID NO: 1628358 - RNA, 16 nt, Homo sapiens
auauugagggagacag

SEQ ID NO: 1628359 - RNA, 19 nt, Homo sapiens
auauuuauuuaacuauuca

SEQ ID NO: 1628360 - RNA, 15 nt, Homo sapiens
auauuucaagcuaua

SEQ ID NO: 1628361 - RNA, 18 nt, Homo sapiens
aucaaaaggaggaauuuc

SEQ ID NO: 1628362 - RNA, 20 nt, Homo sapiens
aucaaaagggagagaacaaa

SEQ ID NO: 1628363 - RNA, 11 nt, Homo sapiens
aucaacaugac

SEQ ID NO: 1628364 - RNA, 18 nt, Homo sapiens
aucaaccuauuaaaauac

SEQ ID NO: 1628365 - RNA, 11 nt, Homo sapiens
aucaagccaua

SEQ ID NO: 1628366 - RNA, 22 nt, Homo sapiens
aucaagcugugagacaguggga

SEQ ID NO: 1628367 - RNA, 15 nt, Homo sapiens
aucaauacugcacac

SEQ ID NO: 1628368 - RNA, 24 nt, Homo sapiens
aucaauauuuuuauaucaugcaaa

SEQ ID NO: 1628369 - RNA, 15 nt, Homo sapiens
aucacaaaccaagcc

SEQ ID NO: 1628370 - RNA, 18 nt, Homo sapiens
aucacaaaccaagccaug

SEQ ID NO: 1628371 - RNA, 17 nt, Homo sapiens
aucacacagacaguuuc

SEQ ID NO: 1628372 - RNA, 16 nt, Homo sapiens
aucacagacacugcac

SEQ ID NO: 1628373 - RNA, 23 nt, Homo sapiens
aucacauucuguuuaucaagcca

SEQ ID NO: 1628374 - RNA, 19 nt, Homo sapiens
aucacuaaauaaacacgau

SEQ ID NO: 1628375 - RNA, 17 nt, Homo sapiens
aucacucauucuaugaa

SEQ ID NO: 1628376 - RNA, 21 nt, Homo sapiens
aucacugcauuaucuugcuca

SEQ ID NO: 1628377 - RNA, 14 nt, Homo sapiens
aucagaaauuccag

SEQ ID NO: 1628378 - RNA, 15 nt, Homo sapiens
aucagaacauucagc

SEQ ID NO: 1628379 - RNA, 18 nt, Homo sapiens
aucagcacacggcuccca

SEQ ID NO: 1628380 - RNA, 22 nt, Homo sapiens
aucagcaucacccgggaacuuu

SEQ ID NO: 1628381 - RNA, 15 nt, Homo sapiens
aucagggccugcccc

SEQ ID NO: 1628382 - RNA, 13 nt, Homo sapiens
aucauauuaguau

SEQ ID NO: 1628383 - RNA, 19 nt, Homo sapiens
aucauccagaaguuccuca

SEQ ID NO: 1628384 - RNA, 15 nt, Homo sapiens
auccacuuacauaua

SEQ ID NO: 1628385 - RNA, 21 nt, Homo sapiens
auccagaggacccaacugaac

SEQ ID NO: 1628386 - RNA, 16 nt, Homo sapiens
auccagcuaugaauau

SEQ ID NO: 1628387 - RNA, 17 nt, Homo sapiens
auccaggcaccaggacu

SEQ ID NO: 1628388 - RNA, 14 nt, Homo sapiens
auccaguuauuaga

SEQ ID NO: 1628389 - RNA, 15 nt, Homo sapiens
auccaucucucucuu

SEQ ID NO: 1628390 - RNA, 17 nt, Homo sapiens
auccaugcaccuaccuu

SEQ ID NO: 1628391 - RNA, 20 nt, Homo sapiens
auccaugcaccuaccuuaga

SEQ ID NO: 1628392 - RNA, 18 nt, Homo sapiens
aucccacaucccaguuuc

SEQ ID NO: 1628393 - RNA, 13 nt, Homo sapiens
aucccuguaauau

SEQ ID NO: 1628394 - RNA, 19 nt, Homo sapiens
aucccuguaauauuuagcu

SEQ ID NO: 1628395 - RNA, 17 nt, Homo sapiens
aucccuuaagaaguuag

SEQ ID NO: 1628396 - RNA, 15 nt, Homo sapiens
aucccuuaccugcuu

SEQ ID NO: 1628397 - RNA, 13 nt, Homo sapiens
auccuagugcuuu

SEQ ID NO: 1628398 - RNA, 11 nt, Homo sapiens
auccugcauuu

SEQ ID NO: 1628399 - RNA, 22 nt, Homo sapiens
auccugcccucacaucuuccac

SEQ ID NO: 1628400 - RNA, 20 nt, Homo sapiens
auccugccuugcugugaaau

SEQ ID NO: 1628401 - RNA, 18 nt, Homo sapiens
auccuucuggcagauuca

SEQ ID NO: 1628402 - RNA, 18 nt, Homo sapiens
auccuucuuucuaguuca

SEQ ID NO: 1628403 - RNA, 13 nt, Homo sapiens
aucgcaaaucaaa

SEQ ID NO: 1628404 - RNA, 21 nt, Homo sapiens
aucuacauuaaaaugacaaac

SEQ ID NO: 1628405 - RNA, 13 nt, Homo sapiens
aucuacccaccuc

SEQ ID NO: 1628406 - RNA, 14 nt, Homo sapiens
aucuaggccacccc

SEQ ID NO: 1628407 - RNA, 19 nt, Homo sapiens
aucuauaccuuacugcaau

SEQ ID NO: 1628408 - RNA, 15 nt, Homo sapiens
aucucaaacuaugac

SEQ ID NO: 1628409 - RNA, 15 nt, Homo sapiens
aucucacuguuuuau

SEQ ID NO: 1628410 - RNA, 16 nt, Homo sapiens
aucucccuuccaccuc

SEQ ID NO: 1628411 - RNA, 12 nt, Homo sapiens
aucucugugaaa

SEQ ID NO: 1628412 - RNA, 19 nt, Homo sapiens
aucugacugccaagccaga

SEQ ID NO: 1628413 - RNA, 23 nt, Homo sapiens
aucugcugcaccuucacucucca

SEQ ID NO: 1628414 - RNA, 20 nt, Homo sapiens
aucuggaaaccucuacauau

SEQ ID NO: 1628415 - RNA, 22 nt, Homo sapiens
aucuggaaaccucuacauauuu

SEQ ID NO: 1628416 - RNA, 18 nt, Homo sapiens
aucugggcugugggcaag

SEQ ID NO: 1628417 - RNA, 22 nt, Homo sapiens
aucuggucaaccuccuggacau

SEQ ID NO: 1628418 - RNA, 20 nt, Homo sapiens
aucuguccguucacaugugu

SEQ ID NO: 1628419 - RNA, 15 nt, Homo sapiens
aucuguguacaaaga

SEQ ID NO: 1628420 - RNA, 22 nt, Homo sapiens
aucuuaccuugugcagucauca

SEQ ID NO: 1628421 - RNA, 15 nt, Homo sapiens
aucuuagguaagaca

SEQ ID NO: 1628422 - RNA, 19 nt, Homo sapiens
aucuuagguaagacauaua

SEQ ID NO: 1628423 - RNA, 13 nt, Homo sapiens
aucuucaacagac

SEQ ID NO: 1628424 - RNA, 22 nt, Homo sapiens
aucuucaguauuuucuccacuu

SEQ ID NO: 1628425 - RNA, 16 nt, Homo sapiens
aucuucuuacuaagcu

SEQ ID NO: 1628426 - RNA, 19 nt, Homo sapiens
aucuugaacuccugaccuc

SEQ ID NO: 1628427 - RNA, 22 nt, Homo sapiens
aucuuuaccuccugaguaauaa

SEQ ID NO: 1628428 - RNA, 19 nt, Homo sapiens
aucuuuauuuuauuauuca

SEQ ID NO: 1628429 - RNA, 22 nt, Homo sapiens
aucuuuguugaaagcagaagaa

SEQ ID NO: 1628430 - RNA, 11 nt, Homo sapiens
aucuuuuacau

SEQ ID NO: 1628431 - RNA, 13 nt, Homo sapiens
augaaaacaauuc

SEQ ID NO: 1628432 - RNA, 19 nt, Homo sapiens
augaaacuuuccuuuguca

SEQ ID NO: 1628433 - RNA, 14 nt, Homo sapiens
augaaauuaacaca

SEQ ID NO: 1628434 - RNA, 15 nt, Homo sapiens
augaacccccaugau

SEQ ID NO: 1628435 - RNA, 23 nt, Homo sapiens
augaaccugcccugcucccacag

SEQ ID NO: 1628436 - RNA, 20 nt, Homo sapiens
augaagaaguuucuaaaaac

SEQ ID NO: 1628437 - RNA, 18 nt, Homo sapiens
augaaugguuucaacaaa

SEQ ID NO: 1628438 - RNA, 22 nt, Homo sapiens
augaauucauacucuguugccu

SEQ ID NO: 1628439 - RNA, 12 nt, Homo sapiens
augacagugaau

SEQ ID NO: 1628440 - RNA, 14 nt, Homo sapiens
augacauugcauuu

SEQ ID NO: 1628441 - RNA, 23 nt, Homo sapiens
augacccccgcaaguuugcacuc

SEQ ID NO: 1628442 - RNA, 19 nt, Homo sapiens
augacuugggcacccccag

SEQ ID NO: 1628443 - RNA, 17 nt, Homo sapiens
augagcaagacugggcc

SEQ ID NO: 1628444 - RNA, 24 nt, Homo sapiens
augaggccacugcugcuucuccau

SEQ ID NO: 1628445 - RNA, 16 nt, Homo sapiens
augagguggagagugg

SEQ ID NO: 1628446 - RNA, 21 nt, Homo sapiens
augagguuucuuugacuucaa

SEQ ID NO: 1628447 - RNA, 15 nt, Homo sapiens
augauaaaauagcca

SEQ ID NO: 1628448 - RNA, 14 nt, Homo sapiens
augauaaaguaaug

SEQ ID NO: 1628449 - RNA, 14 nt, Homo sapiens
augauccucagugc

SEQ ID NO: 1628450 - RNA, 16 nt, Homo sapiens
augauccuuguguuca

SEQ ID NO: 1628451 - RNA, 20 nt, Homo sapiens
augauggaaauuagccacau

SEQ ID NO: 1628452 - RNA, 17 nt, Homo sapiens
augauggccaggcugau

SEQ ID NO: 1628453 - RNA, 13 nt, Homo sapiens
augcaaauaccca

SEQ ID NO: 1628454 - RNA, 17 nt, Homo sapiens
augcaaauccuauguga

SEQ ID NO: 1628455 - RNA, 16 nt, Homo sapiens
augcaacagaagugac

SEQ ID NO: 1628456 - RNA, 18 nt, Homo sapiens
augcaagacacugugcca

SEQ ID NO: 1628457 - RNA, 19 nt, Homo sapiens
augcaauguaagcauacuu

SEQ ID NO: 1628458 - RNA, 20 nt, Homo sapiens
augcacauauggacucugca

SEQ ID NO: 1628459 - RNA, 20 nt, Homo sapiens
augcagcucuucaacaugac

SEQ ID NO: 1628460 - RNA, 20 nt, Homo sapiens
augcauagccuggacacaga

SEQ ID NO: 1628461 - RNA, 16 nt, Homo sapiens
augcauauuuauaaga

SEQ ID NO: 1628462 - RNA, 18 nt, Homo sapiens
augcaucuuuaauuccuu

SEQ ID NO: 1628463 - RNA, 14 nt, Homo sapiens
augcaugauacuau

SEQ ID NO: 1628464 - RNA, 17 nt, Homo sapiens
augcaugauacuaucug

SEQ ID NO: 1628465 - RNA, 15 nt, Homo sapiens
augcauuucauaaac

SEQ ID NO: 1628466 - RNA, 13 nt, Homo sapiens
augccacuuccuu

SEQ ID NO: 1628467 - RNA, 19 nt, Homo sapiens
augcccugugcaaccucuu

SEQ ID NO: 1628468 - RNA, 22 nt, Homo sapiens
augccuggagccacagcagcca

SEQ ID NO: 1628469 - RNA, 14 nt, Homo sapiens
augccuugaugauu

SEQ ID NO: 1628470 - RNA, 15 nt, Homo sapiens
augcggauccugcug

SEQ ID NO: 1628471 - RNA, 14 nt, Homo sapiens
augcucaccaagga

SEQ ID NO: 1628472 - RNA, 12 nt, Homo sapiens
augcucacuuua

SEQ ID NO: 1628473 - RNA, 22 nt, Homo sapiens
augcugaaaaaucauccaagac

SEQ ID NO: 1628474 - RNA, 17 nt, Homo sapiens
augcugauaaacugauu

SEQ ID NO: 1628475 - RNA, 21 nt, Homo sapiens
augcugggauuacagggguga

SEQ ID NO: 1628476 - RNA, 20 nt, Homo sapiens
augcugucaagcaccugcau

SEQ ID NO: 1628477 - RNA, 22 nt, Homo sapiens
augcuucuacugugacacuuau

SEQ ID NO: 1628478 - RNA, 17 nt, Homo sapiens
augcuuuuacuaagcac

SEQ ID NO: 1628479 - RNA, 20 nt, Homo sapiens
auggaacagcauuacccucc

SEQ ID NO: 1628480 - RNA, 22 nt, Homo sapiens
auggacuggagcucaucugcaa

SEQ ID NO: 1628481 - RNA, 22 nt, Homo sapiens
auggagacuuuuaucuacuucu

SEQ ID NO: 1628482 - RNA, 17 nt, Homo sapiens
auggagagagccuuaua

SEQ ID NO: 1628483 - RNA, 12 nt, Homo sapiens
auggaguugcca

SEQ ID NO: 1628484 - RNA, 18 nt, Homo sapiens
auggcaauuuagcucucu

SEQ ID NO: 1628485 - RNA, 12 nt, Homo sapiens
auggcagacucu

SEQ ID NO: 1628486 - RNA, 19 nt, Homo sapiens
auggcaggagcuacugaga

SEQ ID NO: 1628487 - RNA, 21 nt, Homo sapiens
auggcauaugguccuagacaa

SEQ ID NO: 1628488 - RNA, 19 nt, Homo sapiens
auggcuucuggucaugaaa

SEQ ID NO: 1628489 - RNA, 19 nt, Homo sapiens
augggacugugaggccaua

SEQ ID NO: 1628490 - RNA, 16 nt, Homo sapiens
auggggaaaaaacugu

SEQ ID NO: 1628491 - RNA, 14 nt, Homo sapiens
auggggcacccugg

SEQ ID NO: 1628492 - RNA, 14 nt, Homo sapiens
augggucuaggaca

SEQ ID NO: 1628493 - RNA, 23 nt, Homo sapiens
augguacuuccucugugaacugu

SEQ ID NO: 1628494 - RNA, 16 nt, Homo sapiens
auggucaaugcuagca

SEQ ID NO: 1628495 - RNA, 20 nt, Homo sapiens
auggucaaugcuagcacaau

SEQ ID NO: 1628496 - RNA, 19 nt, Homo sapiens
auggucccuuaaggcacag

SEQ ID NO: 1628497 - RNA, 18 nt, Homo sapiens
augguccgccugccucag

SEQ ID NO: 1628498 - RNA, 21 nt, Homo sapiens
augguuggaaaacacuuucau

SEQ ID NO: 1628499 - RNA, 17 nt, Homo sapiens
augguuuaaagucacag

SEQ ID NO: 1628500 - RNA, 17 nt, Homo sapiens
auguaaaauccauccaa

SEQ ID NO: 1628501 - RNA, 18 nt, Homo sapiens
auguacagaagagcaaaa

SEQ ID NO: 1628502 - RNA, 15 nt, Homo sapiens
auguacugccuuagu

SEQ ID NO: 1628503 - RNA, 20 nt, Homo sapiens
auguaguuuuuauauguugu

SEQ ID NO: 1628504 - RNA, 19 nt, Homo sapiens
auguauuuuccuaauguga

SEQ ID NO: 1628505 - RNA, 21 nt, Homo sapiens
auguccacuguucuguucuca

SEQ ID NO: 1628506 - RNA, 19 nt, Homo sapiens
auguccucuuguugcugag

SEQ ID NO: 1628507 - RNA, 17 nt, Homo sapiens
augucuauaaucccagc

SEQ ID NO: 1628508 - RNA, 23 nt, Homo sapiens
augucugcuugucaaaagaaaua

SEQ ID NO: 1628509 - RNA, 18 nt, Homo sapiens
augucuugcaaagccuuu

SEQ ID NO: 1628510 - RNA, 20 nt, Homo sapiens
augugaagaguuucacaaau

SEQ ID NO: 1628511 - RNA, 12 nt, Homo sapiens
augugaagccaa

SEQ ID NO: 1628512 - RNA, 21 nt, Homo sapiens
augugaucauaugaggaccuu

SEQ ID NO: 1628513 - RNA, 14 nt, Homo sapiens
augugcuacagggg

SEQ ID NO: 1628514 - RNA, 18 nt, Homo sapiens
auguggcagcugucucaa

SEQ ID NO: 1628515 - RNA, 15 nt, Homo sapiens
auguggcccucugga

SEQ ID NO: 1628516 - RNA, 19 nt, Homo sapiens
auguggcccucuggaucca

SEQ ID NO: 1628517 - RNA, 16 nt, Homo sapiens
auguguagaccuugau

SEQ ID NO: 1628518 - RNA, 18 nt, Homo sapiens
auguguuucaaaaccaug

SEQ ID NO: 1628519 - RNA, 22 nt, Homo sapiens
auguuaaaauucucauuacucu

SEQ ID NO: 1628520 - RNA, 14 nt, Homo sapiens
auguuaccuucaca

SEQ ID NO: 1628521 - RNA, 16 nt, Homo sapiens
auguuacugacuccuc

SEQ ID NO: 1628522 - RNA, 12 nt, Homo sapiens
auguuacuucuc

SEQ ID NO: 1628523 - RNA, 12 nt, Homo sapiens
auguugcaaugc

SEQ ID NO: 1628524 - RNA, 21 nt, Homo sapiens
auguuuauaaaucuuaugcuc

SEQ ID NO: 1628525 - RNA, 17 nt, Homo sapiens
auguuuauuuacuaauu

SEQ ID NO: 1628526 - RNA, 21 nt, Homo sapiens
auguuuuagccauuguuggcu

SEQ ID NO: 1628527 - RNA, 13 nt, Homo sapiens
auguuuugcccac

SEQ ID NO: 1628528 - RNA, 16 nt, Homo sapiens
auuaaacaaguauaaa

SEQ ID NO: 1628529 - RNA, 19 nt, Homo sapiens
auuaaacgguaacauccaa

SEQ ID NO: 1628530 - RNA, 13 nt, Homo sapiens
auuaaguuaucuu

SEQ ID NO: 1628531 - RNA, 23 nt, Homo sapiens
auuaauuuucuugguucuuucag

SEQ ID NO: 1628532 - RNA, 17 nt, Homo sapiens
auuacauggaacuuuuc

SEQ ID NO: 1628533 - RNA, 17 nt, Homo sapiens
auuacauuucacuucaa

SEQ ID NO: 1628534 - RNA, 20 nt, Homo sapiens
auuaccuagaagugcaagaa

SEQ ID NO: 1628535 - RNA, 18 nt, Homo sapiens
auuacuuguaauuaugaa

SEQ ID NO: 1628536 - RNA, 22 nt, Homo sapiens
auuagaagccugcagaauccag

SEQ ID NO: 1628537 - RNA, 22 nt, Homo sapiens
auuagauaaucaagggcacugu

SEQ ID NO: 1628538 - RNA, 17 nt, Homo sapiens
auuagggacacuuucac

SEQ ID NO: 1628539 - RNA, 17 nt, Homo sapiens
auuauacagaccuaaua

SEQ ID NO: 1628540 - RNA, 20 nt, Homo sapiens
auuauauugucgaauuccua

SEQ ID NO: 1628541 - RNA, 22 nt, Homo sapiens
auuaugaugaaaaccuacauau

SEQ ID NO: 1628542 - RNA, 13 nt, Homo sapiens
auuauuaauugca

SEQ ID NO: 1628543 - RNA, 14 nt, Homo sapiens
auuauucaaaaaca

SEQ ID NO: 1628544 - RNA, 23 nt, Homo sapiens
auucaacagggaagaaacuuucu

SEQ ID NO: 1628545 - RNA, 17 nt, Homo sapiens
auucaauuaguggucau

SEQ ID NO: 1628546 - RNA, 21 nt, Homo sapiens
auucaauuaguggucauaaaa

SEQ ID NO: 1628547 - RNA, 13 nt, Homo sapiens
auucacauucaga

SEQ ID NO: 1628548 - RNA, 20 nt, Homo sapiens
auucagaaauucuccaggau

SEQ ID NO: 1628549 - RNA, 15 nt, Homo sapiens
auucagaauuauaca

SEQ ID NO: 1628550 - RNA, 18 nt, Homo sapiens
auucagcgggagcacugc

SEQ ID NO: 1628551 - RNA, 16 nt, Homo sapiens
auucauuuaacagagc

SEQ ID NO: 1628552 - RNA, 18 nt, Homo sapiens
auuccacacuaccacauu

SEQ ID NO: 1628553 - RNA, 14 nt, Homo sapiens
auuccacagauuau

SEQ ID NO: 1628554 - RNA, 22 nt, Homo sapiens
auuccaugaagccccagaggua

SEQ ID NO: 1628555 - RNA, 18 nt, Homo sapiens
auuccaugacgacauaca

SEQ ID NO: 1628556 - RNA, 12 nt, Homo sapiens
auuccauugccu

SEQ ID NO: 1628557 - RNA, 17 nt, Homo sapiens
auucccagccuguggca

SEQ ID NO: 1628558 - RNA, 22 nt, Homo sapiens
auuccugccuuuaagccaaaga

SEQ ID NO: 1628559 - RNA, 21 nt, Homo sapiens
auuccuucgaaaggccuucag

SEQ ID NO: 1628560 - RNA, 17 nt, Homo sapiens
auuccuucuaaguguac

SEQ ID NO: 1628561 - RNA, 17 nt, Homo sapiens
auucggauguaugaucu

SEQ ID NO: 1628562 - RNA, 16 nt, Homo sapiens
auucuaacuaaugaca

SEQ ID NO: 1628563 - RNA, 18 nt, Homo sapiens
auucuaugaacagugaca

SEQ ID NO: 1628564 - RNA, 18 nt, Homo sapiens
auucuauuauacuacaau

SEQ ID NO: 1628565 - RNA, 12 nt, Homo sapiens
auucuccacagc

SEQ ID NO: 1628566 - RNA, 12 nt, Homo sapiens
auucucuuucac

SEQ ID NO: 1628567 - RNA, 17 nt, Homo sapiens
auucucuuuuaucuguu

SEQ ID NO: 1628568 - RNA, 16 nt, Homo sapiens
auucugauauguaucc

SEQ ID NO: 1628569 - RNA, 17 nt, Homo sapiens
auucugccuagagugua

SEQ ID NO: 1628570 - RNA, 21 nt, Homo sapiens
auucuggcauaauuuuuacag

SEQ ID NO: 1628571 - RNA, 19 nt, Homo sapiens
auucuguuuaucaagccau

SEQ ID NO: 1628572 - RNA, 23 nt, Homo sapiens
auucuucaguucucuacucccuc

SEQ ID NO: 1628573 - RNA, 19 nt, Homo sapiens
auucuuuacaaacugaaga

SEQ ID NO: 1628574 - RNA, 18 nt, Homo sapiens
auucuuuauucuuuacua

SEQ ID NO: 1628575 - RNA, 16 nt, Homo sapiens
auucuuucagcuauca

SEQ ID NO: 1628576 - RNA, 19 nt, Homo sapiens
auucuuucagcuaucagua

SEQ ID NO: 1628577 - RNA, 16 nt, Homo sapiens
gcuccauucacuccca

SEQ ID NO: 1628578 - RNA, 21 nt, Homo sapiens
gcuccauucacucccagguga

SEQ ID NO: 1628579 - RNA, 19 nt, Homo sapiens
gcucccacggagcaucuca

SEQ ID NO: 1628580 - RNA, 23 nt, Homo sapiens
gcuccccacgauaagcaccagug

SEQ ID NO: 1628581 - RNA, 14 nt, Homo sapiens
gcuccccacucugc

SEQ ID NO: 1628582 - RNA, 19 nt, Homo sapiens
gcuccuaggucucagagaa

SEQ ID NO: 1628583 - RNA, 13 nt, Homo sapiens
gcuccuccagggu

SEQ ID NO: 1628584 - RNA, 19 nt, Homo sapiens
gcuccuucaguucugcuug

SEQ ID NO: 1628585 - RNA, 15 nt, Homo sapiens
gcucggggugcacag

SEQ ID NO: 1628586 - RNA, 21 nt, Homo sapiens
gcucuccccaaacuugcuuua

SEQ ID NO: 1628587 - RNA, 23 nt, Homo sapiens
gcucugacagccuagaaguccaa

SEQ ID NO: 1628588 - RNA, 20 nt, Homo sapiens
gcucugagaggcccuggauc

SEQ ID NO: 1628589 - RNA, 13 nt, Homo sapiens
gcucuguauauau

SEQ ID NO: 1628590 - RNA, 22 nt, Homo sapiens
gcucuuagacucgccuaucuua

SEQ ID NO: 1628591 - RNA, 18 nt, Homo sapiens
gcucuuauaaaaucaaua

SEQ ID NO: 1628592 - RNA, 14 nt, Homo sapiens
gcugaaaagggcac

SEQ ID NO: 1628593 - RNA, 14 nt, Homo sapiens
gcugaagauggcau

SEQ ID NO: 1628594 - RNA, 14 nt, Homo sapiens
gcugaagcagguuc

SEQ ID NO: 1628595 - RNA, 21 nt, Homo sapiens
gcugaaggcaguggcagggga

SEQ ID NO: 1628596 - RNA, 21 nt, Homo sapiens
gcugaagugguugcauucuac

SEQ ID NO: 1628597 - RNA, 22 nt, Homo sapiens
gcugagauugagcagaagauca

SEQ ID NO: 1628598 - RNA, 16 nt, Homo sapiens
gcugagcaaucugacc

SEQ ID NO: 1628599 - RNA, 20 nt, Homo sapiens
gcugagcaaucugacccuau

SEQ ID NO: 1628600 - RNA, 13 nt, Homo sapiens
gcugagcucugag

SEQ ID NO: 1628601 - RNA, 15 nt, Homo sapiens
gcugaggcuggcaca

SEQ ID NO: 1628602 - RNA, 17 nt, Homo sapiens
gcugagggagacccccc

SEQ ID NO: 1628603 - RNA, 23 nt, Homo sapiens
gcugagggccucucuacuucccc

SEQ ID NO: 1628604 - RNA, 22 nt, Homo sapiens
gcugcaaaauuaaaucuagaca

SEQ ID NO: 1628605 - RNA, 15 nt, Homo sapiens
gcugcgagacccggc

SEQ ID NO: 1628606 - RNA, 19 nt, Homo sapiens
gcugcugcacaccaaggcc

SEQ ID NO: 1628607 - RNA, 16 nt, Homo sapiens
gcuggaaacuucugua

SEQ ID NO: 1628608 - RNA, 13 nt, Homo sapiens
gcuggaccacaca

SEQ ID NO: 1628609 - RNA, 14 nt, Homo sapiens
gcuggccgcaugac

SEQ ID NO: 1628610 - RNA, 17 nt, Homo sapiens
gcuggcucacaguacag

SEQ ID NO: 1628611 - RNA, 16 nt, Homo sapiens
gcugggacguggcuca

SEQ ID NO: 1628612 - RNA, 23 nt, Homo sapiens
gcugggucaggcagggugcagua

SEQ ID NO: 1628613 - RNA, 14 nt, Homo sapiens
gcugguggcaauaa

SEQ ID NO: 1628614 - RNA, 18 nt, Homo sapiens
gcugucaucugugcacug

SEQ ID NO: 1628615 - RNA, 16 nt, Homo sapiens
gcuguccccacugccc

SEQ ID NO: 1628616 - RNA, 20 nt, Homo sapiens
gcugucgagaaacagccugu

SEQ ID NO: 1628617 - RNA, 18 nt, Homo sapiens
gcuguggccggcacucca

SEQ ID NO: 1628618 - RNA, 22 nt, Homo sapiens
gcugugggcaagccuaagggau

SEQ ID NO: 1628619 - RNA, 13 nt, Homo sapiens
gcuguguuugcag

SEQ ID NO: 1628620 - RNA, 23 nt, Homo sapiens
gcuguguuugcagccugcucuag

SEQ ID NO: 1628621 - RNA, 15 nt, Homo sapiens
gcuguuguuccauug

SEQ ID NO: 1628622 - RNA, 11 nt, Homo sapiens
gcuguuucauc

SEQ ID NO: 1628623 - RNA, 15 nt, Homo sapiens
gcuuaacccuggaaa

SEQ ID NO: 1628624 - RNA, 18 nt, Homo sapiens
gcuuauccaugccuggga

SEQ ID NO: 1628625 - RNA, 21 nt, Homo sapiens
gcuuaugacagagguuuugaa

SEQ ID NO: 1628626 - RNA, 21 nt, Homo sapiens
gcuucagcccccaccagggga

SEQ ID NO: 1628627 - RNA, 13 nt, Homo sapiens
gcuuccaccucac

SEQ ID NO: 1628628 - RNA, 20 nt, Homo sapiens
gcuuccuaguaagucaggac

SEQ ID NO: 1628629 - RNA, 19 nt, Homo sapiens
gcuucuccugauccugcaa

SEQ ID NO: 1628630 - RNA, 20 nt, Homo sapiens
gcuugauuguuuuggucuca

SEQ ID NO: 1628631 - RNA, 14 nt, Homo sapiens
gcuuggaagccagg

SEQ ID NO: 1628632 - RNA, 20 nt, Homo sapiens
gcuugggaaacucaacuucu

SEQ ID NO: 1628633 - RNA, 13 nt, Homo sapiens
gcuugucaggggg

SEQ ID NO: 1628634 - RNA, 18 nt, Homo sapiens
gcuuguggagaucacagc

SEQ ID NO: 1628635 - RNA, 16 nt, Homo sapiens
gcuuuacuccaggaaa

SEQ ID NO: 1628636 - RNA, 13 nt, Homo sapiens
gcuuuaugcaaau

SEQ ID NO: 1628637 - RNA, 15 nt, Homo sapiens
gcuuuaugcaaauac

SEQ ID NO: 1628638 - RNA, 20 nt, Homo sapiens
gcuuuaugcaaauacaauca

SEQ ID NO: 1628639 - RNA, 22 nt, Homo sapiens
gcuuuaugcaaauacaaucagc

SEQ ID NO: 1628640 - RNA, 23 nt, Homo sapiens
gcuuugccagagcgugcuuucaa

SEQ ID NO: 1628641 - RNA, 15 nt, Homo sapiens
gcuuuugguaauauu

SEQ ID NO: 1628642 - RNA, 15 nt, Homo sapiens
gcuuuuugcugugua

SEQ ID NO: 1628643 - RNA, 12 nt, Homo sapiens
ggaaaaugcauu

SEQ ID NO: 1628644 - RNA, 15 nt, Homo sapiens
ggaaagcaugcauug

SEQ ID NO: 1628645 - RNA, 17 nt, Homo sapiens
ggaaaggacaguguggg

SEQ ID NO: 1628646 - RNA, 17 nt, Homo sapiens
ggaaaggggcaggccag

SEQ ID NO: 1628647 - RNA, 15 nt, Homo sapiens
ggaaauuaagacuuu

SEQ ID NO: 1628648 - RNA, 19 nt, Homo sapiens
ggaaauuagccacauguac

SEQ ID NO: 1628649 - RNA, 15 nt, Homo sapiens
ggaacacccccauga

SEQ ID NO: 1628650 - RNA, 19 nt, Homo sapiens
ggaacaggguuacuguaua

SEQ ID NO: 1628651 - RNA, 11 nt, Homo sapiens
ggaacccggcg

SEQ ID NO: 1628652 - RNA, 14 nt, Homo sapiens
ggaagagcaaggga

SEQ ID NO: 1628653 - RNA, 11 nt, Homo sapiens
ggaagcauuuu

SEQ ID NO: 1628654 - RNA, 10 nt, Homo sapiens
ggaagccagg

SEQ ID NO: 1628655 - RNA, 13 nt, Homo sapiens
ggaagccagguac

SEQ ID NO: 1628656 - RNA, 20 nt, Homo sapiens
ggaaggagaaggagugccau

SEQ ID NO: 1628657 - RNA, 17 nt, Homo sapiens
ggaaggaggaauguggg

SEQ ID NO: 1628658 - RNA, 14 nt, Homo sapiens
ggaagggggggaca

SEQ ID NO: 1628659 - RNA, 19 nt, Homo sapiens
ggaauccugcucacaaaau

SEQ ID NO: 1628660 - RNA, 20 nt, Homo sapiens
ggaauggggcaaaguaaauu

SEQ ID NO: 1628661 - RNA, 19 nt, Homo sapiens
ggaaugugcauucucugag

SEQ ID NO: 1628662 - RNA, 20 nt, Homo sapiens
ggacaaaggagccugugaac

SEQ ID NO: 1628663 - RNA, 14 nt, Homo sapiens
ggacacaacacaga

SEQ ID NO: 1628664 - RNA, 17 nt, Homo sapiens
ggacaggacuaacacuc

SEQ ID NO: 1628665 - RNA, 15 nt, Homo sapiens
ggacaggcacuccaa

SEQ ID NO: 1628666 - RNA, 18 nt, Homo sapiens
ggacauagccugcaaagc

SEQ ID NO: 1628667 - RNA, 14 nt, Homo sapiens
ggaccacaguaaca

SEQ ID NO: 1628668 - RNA, 18 nt, Homo sapiens
ggaccaccuccucugcca

SEQ ID NO: 1628669 - RNA, 18 nt, Homo sapiens
ggacucauccuugcccag

SEQ ID NO: 1628670 - RNA, 13 nt, Homo sapiens
ggacucugcacau

SEQ ID NO: 1628671 - RNA, 12 nt, Homo sapiens
ggacucuuccac

SEQ ID NO: 1628672 - RNA, 15 nt, Homo sapiens
ggacugugaggccau

SEQ ID NO: 1628673 - RNA, 15 nt, Homo sapiens
ggagaaaaagcuuaa

SEQ ID NO: 1628674 - RNA, 18 nt, Homo sapiens
ggagaagaaagaggugac

SEQ ID NO: 1628675 - RNA, 18 nt, Homo sapiens
ggagaagaagucagagag

SEQ ID NO: 1628676 - RNA, 13 nt, Homo sapiens
ggagaauugagaa

SEQ ID NO: 1628677 - RNA, 17 nt, Homo sapiens
ggagacuuuuaucuacu

SEQ ID NO: 1628678 - RNA, 22 nt, Homo sapiens
ggagagaagcucuucaauagcu

SEQ ID NO: 1628679 - RNA, 18 nt, Homo sapiens
ggagagucucacuuugga

SEQ ID NO: 1628680 - RNA, 13 nt, Homo sapiens
ggagcaacagagg

SEQ ID NO: 1628681 - RNA, 19 nt, Homo sapiens
ggagccacagcagccacuu

SEQ ID NO: 1628682 - RNA, 18 nt, Homo sapiens
ggagcccagcggcccaag

SEQ ID NO: 1628683 - RNA, 12 nt, Homo sapiens
ggagcugccaca

SEQ ID NO: 1628684 - RNA, 17 nt, Homo sapiens
ggaggcacccaugccau

SEQ ID NO: 1628685 - RNA, 13 nt, Homo sapiens
ggaggcaguccau

SEQ ID NO: 1628686 - RNA, 15 nt, Homo sapiens
ggagguaaugaauua

SEQ ID NO: 1628687 - RNA, 22 nt, Homo sapiens
ggaggugaaagaaagggaccca

SEQ ID NO: 1628688 - RNA, 13 nt, Homo sapiens
gggguagccugag

SEQ ID NO: 1628689 - RNA, 20 nt, Homo sapiens
ggggugguuuuugagccaug

SEQ ID NO: 1628690 - RNA, 18 nt, Homo sapiens
gggugaucugcugcugag

SEQ ID NO: 1628691 - RNA, 14 nt, Homo sapiens
gggugcaagcacuc

SEQ ID NO: 1628692 - RNA, 21 nt, Homo sapiens
gguacuauuuagauauaacac

SEQ ID NO: 1628693 - RNA, 20 nt, Homo sapiens
gguagccagcacacagggca

SEQ ID NO: 1628694 - RNA, 19 nt, Homo sapiens
gguauuaaacaagucaauu

SEQ ID NO: 1628695 - RNA, 15 nt, Homo sapiens
gguauuucuuggcau

SEQ ID NO: 1628696 - RNA, 17 nt, Homo sapiens
ggucaaccuccuggaca

SEQ ID NO: 1628697 - RNA, 18 nt, Homo sapiens
ggucacaguaccuugaau

SEQ ID NO: 1628698 - RNA, 14 nt, Homo sapiens
ggucaccagcugcu

SEQ ID NO: 1628699 - RNA, 15 nt, Homo sapiens
ggucaggcagggugc

SEQ ID NO: 1628700 - RNA, 18 nt, Homo sapiens
ggucaggcagggugcagu

SEQ ID NO: 1628701 - RNA, 13 nt, Homo sapiens
gguccuuuggaca

SEQ ID NO: 1628702 - RNA, 18 nt, Homo sapiens
ggucugaauaacacugga

SEQ ID NO: 1628703 - RNA, 21 nt, Homo sapiens
ggucugagucuauguucaaag

SEQ ID NO: 1628704 - RNA, 23 nt, Homo sapiens
ggucuugugguuguguguguucu

SEQ ID NO: 1628705 - RNA, 20 nt, Homo sapiens
ggugaacaaagcagccacga

SEQ ID NO: 1628706 - RNA, 18 nt, Homo sapiens
ggugagagggccgggcag

SEQ ID NO: 1628707 - RNA, 22 nt, Homo sapiens
ggugauuacauaaucuguacaa

SEQ ID NO: 1628708 - RNA, 17 nt, Homo sapiens
ggugcaguaucaugccc

SEQ ID NO: 1628709 - RNA, 19 nt, Homo sapiens
ggugcauagcaagugaaag

SEQ ID NO: 1628710 - RNA, 19 nt, Homo sapiens
ggugcgcccugucucugug

SEQ ID NO: 1628711 - RNA, 16 nt, Homo sapiens
gguggaaggcagacag

SEQ ID NO: 1628712 - RNA, 19 nt, Homo sapiens
gguggaaggcagacagcag

SEQ ID NO: 1628713 - RNA, 23 nt, Homo sapiens
gguggagggaaggauaaagccac

SEQ ID NO: 1628714 - RNA, 21 nt, Homo sapiens
gguggcaccugccacucugcc

SEQ ID NO: 1628715 - RNA, 12 nt, Homo sapiens
gguguacugugu

SEQ ID NO: 1628716 - RNA, 20 nt, Homo sapiens
gguguagccagguauggcuc

SEQ ID NO: 1628717 - RNA, 18 nt, Homo sapiens
gguguuauuuucugagag

SEQ ID NO: 1628718 - RNA, 21 nt, Homo sapiens
gguuaaacagcagcacuuuuu

SEQ ID NO: 1628719 - RNA, 15 nt, Homo sapiens
gguuaagacaaaggg

SEQ ID NO: 1628720 - RNA, 15 nt, Homo sapiens
gguucaaaagcaauc

SEQ ID NO: 1628721 - RNA, 20 nt, Homo sapiens
gguucuuaaaaaggaacaaa

SEQ ID NO: 1628722 - RNA, 20 nt, Homo sapiens
gguucuucuuccugaagcug

SEQ ID NO: 1628723 - RNA, 17 nt, Homo sapiens
gguuguacuaugcuguu

SEQ ID NO: 1628724 - RNA, 14 nt, Homo sapiens
guaaacaaaccaca

SEQ ID NO: 1628725 - RNA, 20 nt, Homo sapiens
guaaacugaggcccaaagca

SEQ ID NO: 1628726 - RNA, 20 nt, Homo sapiens
guaaacuucugaagacugag

SEQ ID NO: 1628727 - RNA, 21 nt, Homo sapiens
guaaauauuuguuacuuuuag

SEQ ID NO: 1628728 - RNA, 21 nt, Homo sapiens
guaaaucauguugaucaugua

SEQ ID NO: 1628729 - RNA, 17 nt, Homo sapiens
guaacuccccucaggga

SEQ ID NO: 1628730 - RNA, 19 nt, Homo sapiens
guaacuccccucagggaua

SEQ ID NO: 1628731 - RNA, 21 nt, Homo sapiens
guaagacccuuauugcugucc

SEQ ID NO: 1628732 - RNA, 22 nt, Homo sapiens
guaagccaaggucaugccacug

SEQ ID NO: 1628733 - RNA, 18 nt, Homo sapiens
guaaguuuaccuauguaa

SEQ ID NO: 1628734 - RNA, 13 nt, Homo sapiens
guaaucauuuuaa

SEQ ID NO: 1628735 - RNA, 13 nt, Homo sapiens
guaaucuguguac

SEQ ID NO: 1628736 - RNA, 18 nt, Homo sapiens
guaaucuguguacaaaga

SEQ ID NO: 1628737 - RNA, 19 nt, Homo sapiens
guaaucuguguacaaagaa

SEQ ID NO: 1628738 - RNA, 15 nt, Homo sapiens
guaauuuuucuggga

SEQ ID NO: 1628739 - RNA, 12 nt, Homo sapiens
guacacaacaau

SEQ ID NO: 1628740 - RNA, 22 nt, Homo sapiens
guacacuuuuaugagcuuccaa

SEQ ID NO: 1628741 - RNA, 17 nt, Homo sapiens
guacaugguguuugugg

SEQ ID NO: 1628742 - RNA, 16 nt, Homo sapiens
guacaugugcacuccc

SEQ ID NO: 1628743 - RNA, 17 nt, Homo sapiens
guacauuguauucuguu

SEQ ID NO: 1628744 - RNA, 17 nt, Homo sapiens
guaccaugugcuacagg

SEQ ID NO: 1628745 - RNA, 16 nt, Homo sapiens
guacccccucauuugu

SEQ ID NO: 1628746 - RNA, 15 nt, Homo sapiens
guaccugcugggugu

SEQ ID NO: 1628747 - RNA, 17 nt, Homo sapiens
guaccugcuggguguuu

SEQ ID NO: 1628748 - RNA, 21 nt, Homo sapiens
guacucccauuaaauucagug

SEQ ID NO: 1628749 - RNA, 18 nt, Homo sapiens
guacucuguccaguuccu

SEQ ID NO: 1628750 - RNA, 14 nt, Homo sapiens
guacugggccaugu

SEQ ID NO: 1628751 - RNA, 19 nt, Homo sapiens
guacuguuuuccaguucau

SEQ ID NO: 1628752 - RNA, 22 nt, Homo sapiens
guagaacucacucugggcugua

SEQ ID NO: 1628753 - RNA, 16 nt, Homo sapiens
guagacucuugcuccu

SEQ ID NO: 1628754 - RNA, 20 nt, Homo sapiens
guagagacgguguuuugcca

SEQ ID NO: 1628755 - RNA, 13 nt, Homo sapiens
guagagccuugac

SEQ ID NO: 1628756 - RNA, 16 nt, Homo sapiens
guagagggcacugggu

SEQ ID NO: 1628757 - RNA, 16 nt, Homo sapiens
guagcuacaggacauu

SEQ ID NO: 1628758 - RNA, 17 nt, Homo sapiens
guagcuugcucccugug

SEQ ID NO: 1628759 - RNA, 16 nt, Homo sapiens
guaggugaaagaacaa

SEQ ID NO: 1628760 - RNA, 16 nt, Homo sapiens
guagguguaagagaaa

SEQ ID NO: 1628761 - RNA, 20 nt, Homo sapiens
guauaauacauccauucuac

SEQ ID NO: 1628762 - RNA, 17 nt, Homo sapiens
guaucaugcccugugca

SEQ ID NO: 1628763 - RNA, 17 nt, Homo sapiens
guaugaucucucuagcu

SEQ ID NO: 1628764 - RNA, 13 nt, Homo sapiens
guaugcaugugaa

SEQ ID NO: 1628765 - RNA, 14 nt, Homo sapiens
guaugucuguuacc

SEQ ID NO: 1628766 - RNA, 17 nt, Homo sapiens
guauuaauuuauguauc

SEQ ID NO: 1628767 - RNA, 14 nt, Homo sapiens
guauuuaggggcaa

SEQ ID NO: 1628768 - RNA, 23 nt, Homo sapiens
guauuuucuuacacugugucauu

SEQ ID NO: 1628769 - RNA, 17 nt, Homo sapiens
gucaaaagaaauaaucc

SEQ ID NO: 1628770 - RNA, 22 nt, Homo sapiens
gucaaaauaaaggauaacucug

SEQ ID NO: 1628771 - RNA, 13 nt, Homo sapiens
gucaagcaccugc

SEQ ID NO: 1628772 - RNA, 21 nt, Homo sapiens
gucaagcaccugcaugugcug

SEQ ID NO: 1628773 - RNA, 15 nt, Homo sapiens
gucaagcuccuagua

SEQ ID NO: 1628774 - RNA, 13 nt, Homo sapiens
gucacaugaccca

SEQ ID NO: 1628775 - RNA, 18 nt, Homo sapiens
gucacauggccuaugcac

SEQ ID NO: 1628776 - RNA, 21 nt, Homo sapiens
gucaccccucacugugacuga

SEQ ID NO: 1628777 - RNA, 16 nt, Homo sapiens
gucacggccaagugua

SEQ ID NO: 1628778 - RNA, 16 nt, Homo sapiens
gucacugacaguuaau

SEQ ID NO: 1628779 - RNA, 22 nt, Homo sapiens
gucacuucuucaccucuuccac

SEQ ID NO: 1628780 - RNA, 18 nt, Homo sapiens
gucagaaauauucuuauu

SEQ ID NO: 1628781 - RNA, 17 nt, Homo sapiens
gucagaugaggcccugc

SEQ ID NO: 1628782 - RNA, 19 nt, Homo sapiens
gucagcccauggaggcaga

SEQ ID NO: 1628783 - RNA, 15 nt, Homo sapiens
gucagucacagccac

SEQ ID NO: 1628784 - RNA, 20 nt, Homo sapiens
gucauaauaaauuaggacac

SEQ ID NO: 1628785 - RNA, 17 nt, Homo sapiens
gucaucaggugcauagc

SEQ ID NO: 1628786 - RNA, 14 nt, Homo sapiens
gucaucaucacauu

SEQ ID NO: 1628787 - RNA, 18 nt, Homo sapiens
gucaugccacugcacucu

SEQ ID NO: 1628788 - RNA, 17 nt, Homo sapiens
gucaugcugugcauuuu

SEQ ID NO: 1628789 - RNA, 21 nt, Homo sapiens
gucauguuugcaggggugacg

SEQ ID NO: 1628790 - RNA, 23 nt, Homo sapiens
gucauuauucucugaacaauaca

SEQ ID NO: 1628791 - RNA, 14 nt, Homo sapiens
gucauuguauucag

SEQ ID NO: 1628792 - RNA, 14 nt, Homo sapiens
gucauuucaaagac

SEQ ID NO: 1628793 - RNA, 16 nt, Homo sapiens
guccagguugaucuug

SEQ ID NO: 1628794 - RNA, 18 nt, Homo sapiens
gucccacaucccugggcc

SEQ ID NO: 1628795 - RNA, 20 nt, Homo sapiens
gucccauuuuucucuugcca

SEQ ID NO: 1628796 - RNA, 16 nt, Homo sapiens
gucccucucucuggaa

SEQ ID NO: 1628797 - RNA, 17 nt, Homo sapiens
guugcauuuagcuucuu

SEQ ID NO: 1628798 - RNA, 21 nt, Homo sapiens
guugccaaagagaaacaaaaa

SEQ ID NO: 1628799 - RNA, 22 nt, Homo sapiens
guugccugggggcuuuugccac

SEQ ID NO: 1628800 - RNA, 21 nt, Homo sapiens
guugccuuuuucauuuuccaa

SEQ ID NO: 1628801 - RNA, 13 nt, Homo sapiens
guugcuguucaca

SEQ ID NO: 1628802 - RNA, 13 nt, Homo sapiens
guuggaacauccu

SEQ ID NO: 1628803 - RNA, 18 nt, Homo sapiens
guuggccuaacacugggc

SEQ ID NO: 1628804 - RNA, 16 nt, Homo sapiens
guugugaaacuguaaa

SEQ ID NO: 1628805 - RNA, 13 nt, Homo sapiens
guugugcgcacau

SEQ ID NO: 1628806 - RNA, 19 nt, Homo sapiens
guuguuaauaaaaguacau

SEQ ID NO: 1628807 - RNA, 21 nt, Homo sapiens
guuguuaauaaaaguacaugu

SEQ ID NO: 1628808 - RNA, 13 nt, Homo sapiens
guuuacaacauca

SEQ ID NO: 1628809 - RNA, 23 nt, Homo sapiens
guuuacaacaucaccagugccac

SEQ ID NO: 1628810 - RNA, 16 nt, Homo sapiens
guuuacaugagacuuu

SEQ ID NO: 1628811 - RNA, 17 nt, Homo sapiens
guuuaguuuuacauuuu

SEQ ID NO: 1628812 - RNA, 11 nt, Homo sapiens
guuuauuccaa

SEQ ID NO: 1628813 - RNA, 18 nt, Homo sapiens
guuucauuugcuugcccc

SEQ ID NO: 1628814 - RNA, 23 nt, Homo sapiens
guuucccaagcuagacugugucu

SEQ ID NO: 1628815 - RNA, 15 nt, Homo sapiens
guuucugccugggca

SEQ ID NO: 1628816 - RNA, 13 nt, Homo sapiens
guuucugucaagc

SEQ ID NO: 1628817 - RNA, 20 nt, Homo sapiens
guuuguuuucaaaauacuuc

SEQ ID NO: 1628818 - RNA, 22 nt, Homo sapiens
guuuuaauccuuaacacauuca

SEQ ID NO: 1628819 - RNA, 16 nt, Homo sapiens
guuuuauccuuacaau

SEQ ID NO: 1628820 - RNA, 18 nt, Homo sapiens
guuuugugugguauucaa

SEQ ID NO: 1628821 - RNA, 13 nt, Homo sapiens
uaaaaaagcauac

SEQ ID NO: 1628822 - RNA, 18 nt, Homo sapiens
uaaaaauaaaaaacauau

SEQ ID NO: 1628823 - RNA, 22 nt, Homo sapiens
uaaaaauauaaauuguacauuu

SEQ ID NO: 1628824 - RNA, 16 nt, Homo sapiens
uaaaaaucuagcacac

SEQ ID NO: 1628825 - RNA, 20 nt, Homo sapiens
uaaaaaucuagcacacucuu

SEQ ID NO: 1628826 - RNA, 16 nt, Homo sapiens
uaaaaaugaaaauucu

SEQ ID NO: 1628827 - RNA, 12 nt, Homo sapiens
uaaaaauucuug

SEQ ID NO: 1628828 - RNA, 22 nt, Homo sapiens
uaaaacaaaauuugacuaauuu

SEQ ID NO: 1628829 - RNA, 18 nt, Homo sapiens
uaaaacccacaagugucu

SEQ ID NO: 1628830 - RNA, 14 nt, Homo sapiens
uaaaagagaagcca

SEQ ID NO: 1628831 - RNA, 16 nt, Homo sapiens
uaaaagcaugucaaca

SEQ ID NO: 1628832 - RNA, 14 nt, Homo sapiens
uaaaagcuauggug

SEQ ID NO: 1628833 - RNA, 12 nt, Homo sapiens
uaaaaucucuaa

SEQ ID NO: 1628834 - RNA, 14 nt, Homo sapiens
uaaaaugacaaaca

SEQ ID NO: 1628835 - RNA, 23 nt, Homo sapiens
uaaaauuaaucacaaauuucacu

SEQ ID NO: 1628836 - RNA, 14 nt, Homo sapiens
uaaaauucucauua

SEQ ID NO: 1628837 - RNA, 13 nt, Homo sapiens
uaaacaaguauaa

SEQ ID NO: 1628838 - RNA, 14 nt, Homo sapiens
uaaacugauuuauc

SEQ ID NO: 1628839 - RNA, 20 nt, Homo sapiens
uaaacuuggaaucaagguaa

SEQ ID NO: 1628840 - RNA, 22 nt, Homo sapiens
uaaacuuuauuuguaaaccauu

SEQ ID NO: 1628841 - RNA, 22 nt, Homo sapiens
uaaagaaccaucagcaucaccc

SEQ ID NO: 1628842 - RNA, 14 nt, Homo sapiens
uaaagaagcuuuau

SEQ ID NO: 1628843 - RNA, 20 nt, Homo sapiens
uaaagaauguucuauuucug

SEQ ID NO: 1628844 - RNA, 12 nt, Homo sapiens
uaaagcuuuaua

SEQ ID NO: 1628845 - RNA, 19 nt, Homo sapiens
uaaaggggagaccucagaa

SEQ ID NO: 1628846 - RNA, 24 nt, Homo sapiens
uaaagguacgauuauacuugagau

SEQ ID NO: 1628847 - RNA, 23 nt, Homo sapiens
uaaaguccuuggacuguuuugaa

SEQ ID NO: 1628848 - RNA, 14 nt, Homo sapiens
uaaagugacagaug

SEQ ID NO: 1628849 - RNA, 23 nt, Homo sapiens
uaaagugucaccccucacuguga

SEQ ID NO: 1628850 - RNA, 17 nt, Homo sapiens
uaaaguuguugcauucc

SEQ ID NO: 1628851 - RNA, 22 nt, Homo sapiens
uaaaguuuaaauaccaguacuu

SEQ ID NO: 1628852 - RNA, 16 nt, Homo sapiens
uaaauaaaaaaagaca

SEQ ID NO: 1628853 - RNA, 21 nt, Homo sapiens
uaaauaaaacuuaaaucucac

SEQ ID NO: 1628854 - RNA, 19 nt, Homo sapiens
uaaauaagaucagacucug

SEQ ID NO: 1628855 - RNA, 21 nt, Homo sapiens
uaaauaaguaaaagcuacuau

SEQ ID NO: 1628856 - RNA, 20 nt, Homo sapiens
uaaauacagcauacuucaaa

SEQ ID NO: 1628857 - RNA, 16 nt, Homo sapiens
uaaauaccauucacua

SEQ ID NO: 1628858 - RNA, 14 nt, Homo sapiens
uaaauaucauucuu

SEQ ID NO: 1628859 - RNA, 23 nt, Homo sapiens
uaaauaucuuuuuccuucuacuc

SEQ ID NO: 1628860 - RNA, 17 nt, Homo sapiens
uaaauauuagaagccug

SEQ ID NO: 1628861 - RNA, 19 nt, Homo sapiens
uaaaucauauuaguauuaa

SEQ ID NO: 1628862 - RNA, 17 nt, Homo sapiens
uaaaucccacaucccag

SEQ ID NO: 1628863 - RNA, 18 nt, Homo sapiens
uaaaucccacaucccagu

SEQ ID NO: 1628864 - RNA, 19 nt, Homo sapiens
uaaaugacugucuuaucac

SEQ ID NO: 1628865 - RNA, 22 nt, Homo sapiens
uaaauuauuuuuguucauauaa

SEQ ID NO: 1628866 - RNA, 15 nt, Homo sapiens
uaacaaaauccucag

SEQ ID NO: 1628867 - RNA, 18 nt, Homo sapiens
uaacaacaauaacacugu

SEQ ID NO: 1628868 - RNA, 17 nt, Homo sapiens
uaacaagcucccaggua

SEQ ID NO: 1628869 - RNA, 12 nt, Homo sapiens
uaacacacucca

SEQ ID NO: 1628870 - RNA, 24 nt, Homo sapiens
uaacacauucaauagcauaucaca

SEQ ID NO: 1628871 - RNA, 22 nt, Homo sapiens
uaacagauaaagaaacugaggc

SEQ ID NO: 1628872 - RNA, 14 nt, Homo sapiens
uaacauagauuuaa

SEQ ID NO: 1628873 - RNA, 21 nt, Homo sapiens
uaacaugcaccuugcucccaa

SEQ ID NO: 1628874 - RNA, 20 nt, Homo sapiens
uaacaugcccuguucagcua

SEQ ID NO: 1628875 - RNA, 20 nt, Homo sapiens
uaacauuuaaauuccacaga

SEQ ID NO: 1628876 - RNA, 22 nt, Homo sapiens
uaacauuuaaauuccacagauu

SEQ ID NO: 1628877 - RNA, 20 nt, Homo sapiens
uaacauuuacuuuugcuccc

SEQ ID NO: 1628878 - RNA, 18 nt, Homo sapiens
uaacccaagacaugacau

SEQ ID NO: 1628879 - RNA, 20 nt, Homo sapiens
uaaccugggcuuaaguuuua

SEQ ID NO: 1628880 - RNA, 22 nt, Homo sapiens
uaaccuuguucucugcuugaca

SEQ ID NO: 1628881 - RNA, 14 nt, Homo sapiens
uaacgucaugugca

SEQ ID NO: 1628882 - RNA, 15 nt, Homo sapiens
uaacuauauuugcuu

SEQ ID NO: 1628883 - RNA, 14 nt, Homo sapiens
uaacucacucaguu

SEQ ID NO: 1628884 - RNA, 17 nt, Homo sapiens
uaacugcagaguaaauu

SEQ ID NO: 1628885 - RNA, 18 nt, Homo sapiens
uaagaaaaaaacuugucu

SEQ ID NO: 1628886 - RNA, 24 nt, Homo sapiens
uaagaaugugaugggccacaagga

SEQ ID NO: 1628887 - RNA, 13 nt, Homo sapiens
uaagaauucucuc

SEQ ID NO: 1628888 - RNA, 16 nt, Homo sapiens
uaagagucugugcugg

SEQ ID NO: 1628889 - RNA, 19 nt, Homo sapiens
uaagaucucgguuugccaa

SEQ ID NO: 1628890 - RNA, 14 nt, Homo sapiens
uaagcaucugccau

SEQ ID NO: 1628891 - RNA, 23 nt, Homo sapiens
uaagccaaagaaacaagcugugc

SEQ ID NO: 1628892 - RNA, 16 nt, Homo sapiens
uaagcccaggaucucu

SEQ ID NO: 1628893 - RNA, 20 nt, Homo sapiens
uaaggaguaaucuguguaca

SEQ ID NO: 1628894 - RNA, 17 nt, Homo sapiens
uaagggugggugcucag

SEQ ID NO: 1628895 - RNA, 21 nt, Homo sapiens
uaagguuucaacaaauuucau

SEQ ID NO: 1628896 - RNA, 23 nt, Homo sapiens
uaaguauuauauaaacugugcca

SEQ ID NO: 1628897 - RNA, 14 nt, Homo sapiens
uaagucaguguuaa

SEQ ID NO: 1628898 - RNA, 21 nt, Homo sapiens
uaagugcuugguugggguggu

SEQ ID NO: 1628899 - RNA, 12 nt, Homo sapiens
uaaguguacuuc

SEQ ID NO: 1628900 - RNA, 16 nt, Homo sapiens
uaauaaaaguacaugu

SEQ ID NO: 1628901 - RNA, 14 nt, Homo sapiens
uaauaaagcuuuau

SEQ ID NO: 1628902 - RNA, 18 nt, Homo sapiens
uaauacagcuucuaacuc

SEQ ID NO: 1628903 - RNA, 19 nt, Homo sapiens
uaauaccuuuaaauaucau

SEQ ID NO: 1628904 - RNA, 15 nt, Homo sapiens
uaauacuuuuccaca

SEQ ID NO: 1628905 - RNA, 14 nt, Homo sapiens
uaauagaguacuua

SEQ ID NO: 1628906 - RNA, 14 nt, Homo sapiens
uagagaaguauuua

SEQ ID NO: 1628907 - RNA, 22 nt, Homo sapiens
uagagacaggguuucacugugu

SEQ ID NO: 1628908 - RNA, 20 nt, Homo sapiens
uagagacgguguuuugccau

SEQ ID NO: 1628909 - RNA, 19 nt, Homo sapiens
uagagcccauuaaucuuga

SEQ ID NO: 1628910 - RNA, 14 nt, Homo sapiens
uagagccuugacaa

SEQ ID NO: 1628911 - RNA, 12 nt, Homo sapiens
uagagggacaaa

SEQ ID NO: 1628912 - RNA, 23 nt, Homo sapiens
uagaggugcucauucauuuaaca

SEQ ID NO: 1628913 - RNA, 20 nt, Homo sapiens
uagaucugggagauccugca

SEQ ID NO: 1628914 - RNA, 11 nt, Homo sapiens
uagauguugcu

SEQ ID NO: 1628915 - RNA, 18 nt, Homo sapiens
uagauuaacggagugucu

SEQ ID NO: 1628916 - RNA, 16 nt, Homo sapiens
uagauuuuaaagacaa

SEQ ID NO: 1628917 - RNA, 18 nt, Homo sapiens
uagcaauagcuagcuaua

SEQ ID NO: 1628918 - RNA, 14 nt, Homo sapiens
uagcagacaggccc

SEQ ID NO: 1628919 - RNA, 22 nt, Homo sapiens
uagcagcaccguucugugcaca

SEQ ID NO: 1628920 - RNA, 16 nt, Homo sapiens
uagcaguacuaaucau

SEQ ID NO: 1628921 - RNA, 19 nt, Homo sapiens
uagcaucuccuuucacuuu

SEQ ID NO: 1628922 - RNA, 20 nt, Homo sapiens
uagcauguuccuccuuuucu

SEQ ID NO: 1628923 - RNA, 18 nt, Homo sapiens
uagccacccaacuuuguc

SEQ ID NO: 1628924 - RNA, 18 nt, Homo sapiens
uagccagaauucuacccu

SEQ ID NO: 1628925 - RNA, 21 nt, Homo sapiens
uagccagauuugucuuuuugu

SEQ ID NO: 1628926 - RNA, 20 nt, Homo sapiens
uagccagcacacagggcagu

SEQ ID NO: 1628927 - RNA, 15 nt, Homo sapiens
uagccauaauuuugc

SEQ ID NO: 1628928 - RNA, 19 nt, Homo sapiens
uagccccagcgccaaagga

SEQ ID NO: 1628929 - RNA, 19 nt, Homo sapiens
uagccccauugcuccauuc

SEQ ID NO: 1628930 - RNA, 16 nt, Homo sapiens
uagcccccaagccggu

SEQ ID NO: 1628931 - RNA, 17 nt, Homo sapiens
uagcccuucaagugcac

SEQ ID NO: 1628932 - RNA, 21 nt, Homo sapiens
uagccuguggccuuugcaauu

SEQ ID NO: 1628933 - RNA, 22 nt, Homo sapiens
uagccuguggccuuugcaauuu

SEQ ID NO: 1628934 - RNA, 22 nt, Homo sapiens
uagcuccauaaaguacaaauga

SEQ ID NO: 1628935 - RNA, 22 nt, Homo sapiens
uagcucucucuagaaugagcaa

SEQ ID NO: 1628936 - RNA, 21 nt, Homo sapiens
uagcuguuucaaaugugcauu

SEQ ID NO: 1628937 - RNA, 22 nt, Homo sapiens
uagcuucuuucccuuagugacu

SEQ ID NO: 1628938 - RNA, 12 nt, Homo sapiens
uagcuugcuccc

SEQ ID NO: 1628939 - RNA, 24 nt, Homo sapiens
uagcuuuacauuuucaguaccaaa

SEQ ID NO: 1628940 - RNA, 22 nt, Homo sapiens
uagcuuugaaacuccaugcaaa

SEQ ID NO: 1628941 - RNA, 17 nt, Homo sapiens
uaggcauguagcuacag

SEQ ID NO: 1628942 - RNA, 16 nt, Homo sapiens
uaggccaggugcaacc

SEQ ID NO: 1628943 - RNA, 22 nt, Homo sapiens
uaggccuaguacaaucuuggga

SEQ ID NO: 1628944 - RNA, 13 nt, Homo sapiens
uaggcugcugcug

SEQ ID NO: 1628945 - RNA, 18 nt, Homo sapiens
uagggcuuauccaugccu

SEQ ID NO: 1628946 - RNA, 22 nt, Homo sapiens
uagguagucaugcugugcauuu

SEQ ID NO: 1628947 - RNA, 21 nt, Homo sapiens
uaggucauucuuuugccacau

SEQ ID NO: 1628948 - RNA, 14 nt, Homo sapiens
uaggugucucauag

SEQ ID NO: 1628949 - RNA, 21 nt, Homo sapiens
uagguuuuccuuccaagcacc

SEQ ID NO: 1628950 - RNA, 17 nt, Homo sapiens
uagguuuugcuugggaa

SEQ ID NO: 1628951 - RNA, 12 nt, Homo sapiens
uaguaaccaagg

SEQ ID NO: 1628952 - RNA, 20 nt, Homo sapiens
uaguaaguaauaucaaagca

SEQ ID NO: 1628953 - RNA, 16 nt, Homo sapiens
uaguaauggcagagca

SEQ ID NO: 1628954 - RNA, 22 nt, Homo sapiens
uagucacauggccuaugcacau

SEQ ID NO: 1628955 - RNA, 23 nt, Homo sapiens
uagucccauuuuucucuugccau

SEQ ID NO: 1628956 - RNA, 14 nt, Homo sapiens
uagucucaccagcc

SEQ ID NO: 1628957 - RNA, 15 nt, Homo sapiens
uagucucuccccugg

SEQ ID NO: 1628958 - RNA, 17 nt, Homo sapiens
uagugaaucacguaaag

SEQ ID NO: 1628959 - RNA, 22 nt, Homo sapiens
uagugaaucacguaaagcuaga

SEQ ID NO: 1628960 - RNA, 21 nt, Homo sapiens
uagugacucuugaaguacuua

SEQ ID NO: 1628961 - RNA, 17 nt, Homo sapiens
uagugcaauuccaagaa

SEQ ID NO: 1628962 - RNA, 13 nt, Homo sapiens
uagugcauccagu

SEQ ID NO: 1628963 - RNA, 20 nt, Homo sapiens
uagugccugaauuuguucuc

SEQ ID NO: 1628964 - RNA, 21 nt, Homo sapiens
uaguggcgaugcgcccugcau

SEQ ID NO: 1628965 - RNA, 21 nt, Homo sapiens
uaguggucagaaaaauacuua

SEQ ID NO: 1628966 - RNA, 22 nt, Homo sapiens
uaguuggucuuuccaucuauca

SEQ ID NO: 1628967 - RNA, 16 nt, Homo sapiens
uauaaaagacugacca

SEQ ID NO: 1628968 - RNA, 17 nt, Homo sapiens
uauaaacuguaugcuca

SEQ ID NO: 1628969 - RNA, 21 nt, Homo sapiens
uauaaauacagcauacuucaa

SEQ ID NO: 1628970 - RNA, 22 nt, Homo sapiens
uauaaauacagcauacuucaaa

SEQ ID NO: 1628971 - RNA, 19 nt, Homo sapiens
uauaaauacguauuacaaa

SEQ ID NO: 1628972 - RNA, 14 nt, Homo sapiens
uauaagaguaauau

SEQ ID NO: 1628973 - RNA, 17 nt, Homo sapiens
uauacaauaacccaguu

SEQ ID NO: 1628974 - RNA, 23 nt, Homo sapiens
uauacauuuuuuaggacaucuua

SEQ ID NO: 1628975 - RNA, 12 nt, Homo sapiens
uauaccagcaga

SEQ ID NO: 1628976 - RNA, 13 nt, Homo sapiens
uauaccuuacugc

SEQ ID NO: 1628977 - RNA, 23 nt, Homo sapiens
uauacggaaacaaaaaugauccu

SEQ ID NO: 1628978 - RNA, 17 nt, Homo sapiens
uauagacauucucacau

SEQ ID NO: 1628979 - RNA, 19 nt, Homo sapiens
uauauaauuuauuuccacu

SEQ ID NO: 1628980 - RNA, 19 nt, Homo sapiens
uauauaguuaguaucuuua

SEQ ID NO: 1628981 - RNA, 22 nt, Homo sapiens
uauauaugcuuggcuaacuaua

SEQ ID NO: 1628982 - RNA, 20 nt, Homo sapiens
uauaucuuagguaagacaua

SEQ ID NO: 1628983 - RNA, 20 nt, Homo sapiens
uauauuggaaauaucacccc

SEQ ID NO: 1628984 - RNA, 16 nt, Homo sapiens
uauauuggaagcugcu

SEQ ID NO: 1628985 - RNA, 23 nt, Homo sapiens
uauauuuuaucuugguaguacau

SEQ ID NO: 1628986 - RNA, 17 nt, Homo sapiens
uaucaaauacuaguauu

SEQ ID NO: 1628987 - RNA, 19 nt, Homo sapiens
uaucaaauacuaguauuaa

SEQ ID NO: 1628988 - RNA, 18 nt, Homo sapiens
uaucacgggucacuugaa

SEQ ID NO: 1628989 - RNA, 16 nt, Homo sapiens
uauccaccccauccca

SEQ ID NO: 1628990 - RNA, 16 nt, Homo sapiens
uaucccuuaccugcuu

SEQ ID NO: 1628991 - RNA, 16 nt, Homo sapiens
uauccuuacaauguga

SEQ ID NO: 1628992 - RNA, 16 nt, Homo sapiens
uauccuuacacucccc

SEQ ID NO: 1628993 - RNA, 22 nt, Homo sapiens
uaucgaugauggaaauuagcca

SEQ ID NO: 1628994 - RNA, 22 nt, Homo sapiens
uaucuacauuaaaaugacaaac

SEQ ID NO: 1628995 - RNA, 20 nt, Homo sapiens
uaucuuuugaauucuugaua

SEQ ID NO: 1628996 - RNA, 20 nt, Homo sapiens
uaugaaaauauagacauucu

SEQ ID NO: 1628997 - RNA, 23 nt, Homo sapiens
uaugaaaauauagacauucucac

SEQ ID NO: 1628998 - RNA, 12 nt, Homo sapiens
uaugaacacaga

SEQ ID NO: 1628999 - RNA, 13 nt, Homo sapiens
uaugaauaucauu

SEQ ID NO: 1629000 - RNA, 17 nt, Homo sapiens
uaugacagaaaaguaau

SEQ ID NO: 1629001 - RNA, 15 nt, Homo sapiens
uaugaggaccuuuau

SEQ ID NO: 1629002 - RNA, 19 nt, Homo sapiens
uaugaucucucuagcuuug

SEQ ID NO: 1629003 - RNA, 17 nt, Homo sapiens
uaugauuguuucucaaa

SEQ ID NO: 1629004 - RNA, 18 nt, Homo sapiens
uaugcaaauacaaucagc

SEQ ID NO: 1629005 - RNA, 19 nt, Homo sapiens
uaugcagcuaucuggucaa

SEQ ID NO: 1629006 - RNA, 23 nt, Homo sapiens
uaugccacaccuggccuuaaaga

SEQ ID NO: 1629007 - RNA, 14 nt, Homo sapiens
uaugccacugcacu

SEQ ID NO: 1629008 - RNA, 21 nt, Homo sapiens
uaugcggaggaaagcaagugu

SEQ ID NO: 1629009 - RNA, 21 nt, Homo sapiens
uaugcugaucuuuuaaaauca

SEQ ID NO: 1629010 - RNA, 12 nt, Homo sapiens
uauggacucugc

SEQ ID NO: 1629011 - RNA, 15 nt, Homo sapiens
uauggagagcccugg

SEQ ID NO: 1629012 - RNA, 19 nt, Homo sapiens
uaugggagcuuaacuuuau

SEQ ID NO: 1629013 - RNA, 18 nt, Homo sapiens
uauguaacaaaccugcac

SEQ ID NO: 1629014 - RNA, 15 nt, Homo sapiens
agguuucaacaaauu

SEQ ID NO: 1629015 - RNA, 15 nt, Homo sapiens
agguuucaccaugau

SEQ ID NO: 1629016 - RNA, 18 nt, Homo sapiens
agguuuguauaaguaauu

SEQ ID NO: 1629017 - RNA, 22 nt, Homo sapiens
agguuuugcuugggaaacucaa

SEQ ID NO: 1629018 - RNA, 13 nt, Homo sapiens
agguuuuguugcu

SEQ ID NO: 1629019 - RNA, 15 nt, Homo sapiens
aguaaaaagacauuu

SEQ ID NO: 1629020 - RNA, 16 nt, Homo sapiens
aguaaaaggcuuauua

SEQ ID NO: 1629021 - RNA, 16 nt, Homo sapiens
aguaacaaauaaauaa

SEQ ID NO: 1629022 - RNA, 14 nt, Homo sapiens
aguaacacacuucc

SEQ ID NO: 1629023 - RNA, 20 nt, Homo sapiens
aguaacaugcauacuuuauu

SEQ ID NO: 1629024 - RNA, 13 nt, Homo sapiens
aguaauaagcaug

SEQ ID NO: 1629025 - RNA, 15 nt, Homo sapiens
aguaauaucuuucag

SEQ ID NO: 1629026 - RNA, 13 nt, Homo sapiens
aguaauggcagag

SEQ ID NO: 1629027 - RNA, 21 nt, Homo sapiens
aguaauguaaaauccauccaa

SEQ ID NO: 1629028 - RNA, 19 nt, Homo sapiens
aguaauuuugcuccuugau

SEQ ID NO: 1629029 - RNA, 20 nt, Homo sapiens
aguacagcaugugccuuaau

SEQ ID NO: 1629030 - RNA, 20 nt, Homo sapiens
aguacuauggagugcucaca

SEQ ID NO: 1629031 - RNA, 13 nt, Homo sapiens
aguagaacugucu

SEQ ID NO: 1629032 - RNA, 18 nt, Homo sapiens
aguagagggcacuggguc

SEQ ID NO: 1629033 - RNA, 21 nt, Homo sapiens
aguagcagcagaggccagugg

SEQ ID NO: 1629034 - RNA, 20 nt, Homo sapiens
aguagcccagagugagcuuu

SEQ ID NO: 1629035 - RNA, 22 nt, Homo sapiens
aguagccuaacacacuccaaga

SEQ ID NO: 1629036 - RNA, 17 nt, Homo sapiens
aguaguccuuggcauag

SEQ ID NO: 1629037 - RNA, 17 nt, Homo sapiens
aguauugucgguuaccu

SEQ ID NO: 1629038 - RNA, 12 nt, Homo sapiens
agucaagcuccu

SEQ ID NO: 1629039 - RNA, 16 nt, Homo sapiens
agucaaguaauggagg

SEQ ID NO: 1629040 - RNA, 21 nt, Homo sapiens
agucacauggccuaugcacau

SEQ ID NO: 1629041 - RNA, 21 nt, Homo sapiens
agucacccagggacacuccaa

SEQ ID NO: 1629042 - RNA, 22 nt, Homo sapiens
agucagacuuuguguucauuuc

SEQ ID NO: 1629043 - RNA, 21 nt, Homo sapiens
agucaggacagcuuguaugua

SEQ ID NO: 1629044 - RNA, 19 nt, Homo sapiens
agucauggcuaauuuaaca

SEQ ID NO: 1629045 - RNA, 18 nt, Homo sapiens
agucauugaggcccugcu

SEQ ID NO: 1629046 - RNA, 22 nt, Homo sapiens
aguccccccucgccccaaaguu

SEQ ID NO: 1629047 - RNA, 13 nt, Homo sapiens
aguccgaaugaga

SEQ ID NO: 1629048 - RNA, 22 nt, Homo sapiens
aguccucuggauugagauacuu

SEQ ID NO: 1629049 - RNA, 17 nt, Homo sapiens
aguccuguccucuggau

SEQ ID NO: 1629050 - RNA, 13 nt, Homo sapiens
agucucacuuugg

SEQ ID NO: 1629051 - RNA, 14 nt, Homo sapiens
agucucagucugau

SEQ ID NO: 1629052 - RNA, 20 nt, Homo sapiens
agucugauccauccaucucu

SEQ ID NO: 1629053 - RNA, 13 nt, Homo sapiens
agucuuugccagu

SEQ ID NO: 1629054 - RNA, 17 nt, Homo sapiens
agucuuuguuuacauga

SEQ ID NO: 1629055 - RNA, 14 nt, Homo sapiens
agugacuccugcug

SEQ ID NO: 1629056 - RNA, 18 nt, Homo sapiens
agugaggcaggagaagaa

SEQ ID NO: 1629057 - RNA, 15 nt, Homo sapiens
agugaggugacacuc

SEQ ID NO: 1629058 - RNA, 18 nt, Homo sapiens
agugaggugacacuccag

SEQ ID NO: 1629059 - RNA, 20 nt, Homo sapiens
agugcaguggcacgaucuca

SEQ ID NO: 1629060 - RNA, 20 nt, Homo sapiens
agugcaucacaucugcacac

SEQ ID NO: 1629061 - RNA, 16 nt, Homo sapiens
agugcauuauguacac

SEQ ID NO: 1629062 - RNA, 17 nt, Homo sapiens
agugccaaggaccuccu

SEQ ID NO: 1629063 - RNA, 21 nt, Homo sapiens
agugcguguguacaugugcac

SEQ ID NO: 1629064 - RNA, 15 nt, Homo sapiens
agugcugaccagaca

SEQ ID NO: 1629065 - RNA, 15 nt, Homo sapiens
agugcugaugccugu

SEQ ID NO: 1629066 - RNA, 20 nt, Homo sapiens
agugcuggaauagcaucucc

SEQ ID NO: 1629067 - RNA, 21 nt, Homo sapiens
aguggaaaacaaagccaaaca

SEQ ID NO: 1629068 - RNA, 14 nt, Homo sapiens
aguggcaugaucuc

SEQ ID NO: 1629069 - RNA, 15 nt, Homo sapiens
aguggcaugaucucg

SEQ ID NO: 1629070 - RNA, 21 nt, Homo sapiens
agugggagaguaccugugugu

SEQ ID NO: 1629071 - RNA, 11 nt, Homo sapiens
agugggccagg

SEQ ID NO: 1629072 - RNA, 21 nt, Homo sapiens
aguggggacauacacuugcau

SEQ ID NO: 1629073 - RNA, 17 nt, Homo sapiens
aguggucugaauucugg

SEQ ID NO: 1629074 - RNA, 22 nt, Homo sapiens
aguggugcgaucucggcucagu

SEQ ID NO: 1629075 - RNA, 20 nt, Homo sapiens
aguguaguuaaggagccuaa

SEQ ID NO: 1629076 - RNA, 12 nt, Homo sapiens
agugucaccucc

SEQ ID NO: 1629077 - RNA, 19 nt, Homo sapiens
aguguccuggaaauucugc

SEQ ID NO: 1629078 - RNA, 23 nt, Homo sapiens
agugugaaacagcugcccugugu

SEQ ID NO: 1629079 - RNA, 21 nt, Homo sapiens
agugugaauaaagugcugcgg

SEQ ID NO: 1629080 - RNA, 13 nt, Homo sapiens
agugugacagggc

SEQ ID NO: 1629081 - RNA, 14 nt, Homo sapiens
agugugacagggcc

SEQ ID NO: 1629082 - RNA, 22 nt, Homo sapiens
aguguuggcaaacgagacuuuc

SEQ ID NO: 1629083 - RNA, 17 nt, Homo sapiens
aguguugugaaacugua

SEQ ID NO: 1629084 - RNA, 15 nt, Homo sapiens
aguuaaggagccuaa

SEQ ID NO: 1629085 - RNA, 23 nt, Homo sapiens
aguuacccugcauguuggcccag

SEQ ID NO: 1629086 - RNA, 19 nt, Homo sapiens
aguuacuuuuuuacacuga

SEQ ID NO: 1629087 - RNA, 19 nt, Homo sapiens
aguuauuuuaauaccuuua

SEQ ID NO: 1629088 - RNA, 19 nt, Homo sapiens
aguucaauaaaugucuguu

SEQ ID NO: 1629089 - RNA, 16 nt, Homo sapiens
aguucaauacagugaa

SEQ ID NO: 1629090 - RNA, 17 nt, Homo sapiens
aguucaucaccauuucc

SEQ ID NO: 1629091 - RNA, 19 nt, Homo sapiens
aguuccccgagaacuuucu

SEQ ID NO: 1629092 - RNA, 20 nt, Homo sapiens
aguuccuaugacacaguuau

SEQ ID NO: 1629093 - RNA, 22 nt, Homo sapiens
aguuccuuccaggugauucugu

SEQ ID NO: 1629094 - RNA, 21 nt, Homo sapiens
aguucuguucacguccauugc

SEQ ID NO: 1629095 - RNA, 17 nt, Homo sapiens
aguugagauuuuaauuc

SEQ ID NO: 1629096 - RNA, 19 nt, Homo sapiens
aguugcauuuagcuucuuu

SEQ ID NO: 1629097 - RNA, 18 nt, Homo sapiens
aguugcguggacucugca

SEQ ID NO: 1629098 - RNA, 19 nt, Homo sapiens
aguugcguggacucugcac

SEQ ID NO: 1629099 - RNA, 13 nt, Homo sapiens
aguugcuguaugu

SEQ ID NO: 1629100 - RNA, 15 nt, Homo sapiens
aguugucaguauuau

SEQ ID NO: 1629101 - RNA, 23 nt, Homo sapiens
aguugucaguauuauucuacuau

SEQ ID NO: 1629102 - RNA, 15 nt, Homo sapiens
aguuguuaauaaaag

SEQ ID NO: 1629103 - RNA, 17 nt, Homo sapiens
aguuguuuuuauucuuc

SEQ ID NO: 1629104 - RNA, 21 nt, Homo sapiens
aguuuaugcugugcuaaauau

SEQ ID NO: 1629105 - RNA, 18 nt, Homo sapiens
aguuuauguuguacaaug

SEQ ID NO: 1629106 - RNA, 20 nt, Homo sapiens
aguuuccuaggaugucaugu

SEQ ID NO: 1629107 - RNA, 21 nt, Homo sapiens
aguuucuaucccuuaccugcu

SEQ ID NO: 1629108 - RNA, 17 nt, Homo sapiens
aguuucuauucugucag

SEQ ID NO: 1629109 - RNA, 21 nt, Homo sapiens
aguuuggaauuauuguagaca

SEQ ID NO: 1629110 - RNA, 15 nt, Homo sapiens
aguuuguagccaggu

SEQ ID NO: 1629111 - RNA, 21 nt, Homo sapiens
aguuuguagccagguacugca

SEQ ID NO: 1629112 - RNA, 15 nt, Homo sapiens
aguuuuaaauaagcu

SEQ ID NO: 1629113 - RNA, 15 nt, Homo sapiens
aguuuuacauuuuaa

SEQ ID NO: 1629114 - RNA, 20 nt, Homo sapiens
aguuuuacuaaaacacugaa

SEQ ID NO: 1629115 - RNA, 23 nt, Homo sapiens
aguuuuacuaaaacacugaaaaa

SEQ ID NO: 1629116 - RNA, 21 nt, Homo sapiens
aguuuuguacauagcaaauaa

SEQ ID NO: 1629117 - RNA, 21 nt, Homo sapiens
auaaaacauucagucugacaa

SEQ ID NO: 1629118 - RNA, 16 nt, Homo sapiens
auaaaagagaagccaa

SEQ ID NO: 1629119 - RNA, 17 nt, Homo sapiens
auaaaauagaaacauuu

SEQ ID NO: 1629120 - RNA, 15 nt, Homo sapiens
auaaaauccagcuca

SEQ ID NO: 1629121 - RNA, 17 nt, Homo sapiens
auaaaaugaacaucucu

SEQ ID NO: 1629122 - RNA, 14 nt, Homo sapiens
auaaaauggucaug

SEQ ID NO: 1629123 - RNA, 21 nt, Homo sapiens
aucagcuguuaaccauuugca

SEQ ID NO: 1629124 - RNA, 21 nt, Homo sapiens
aucaggugcauagcaagugaa

SEQ ID NO: 1629125 - RNA, 22 nt, Homo sapiens
aucaguucuguguggugcauuc

SEQ ID NO: 1629126 - RNA, 14 nt, Homo sapiens
aucauaaaaucaaa

SEQ ID NO: 1629127 - RNA, 18 nt, Homo sapiens
aucauaaaggaucagaga

SEQ ID NO: 1629128 - RNA, 17 nt, Homo sapiens
aucauacaaacucucac

SEQ ID NO: 1629129 - RNA, 14 nt, Homo sapiens
aucauccaagacag

SEQ ID NO: 1629130 - RNA, 14 nt, Homo sapiens
aucaugcugagaga

SEQ ID NO: 1629131 - RNA, 15 nt, Homo sapiens
aucaugugaggaaau

SEQ ID NO: 1629132 - RNA, 16 nt, Homo sapiens
aucauuagaaucuuac

SEQ ID NO: 1629133 - RNA, 21 nt, Homo sapiens
aucauuauuucaccaagccaa

SEQ ID NO: 1629134 - RNA, 15 nt, Homo sapiens
aucauuuuauucaca

SEQ ID NO: 1629135 - RNA, 16 nt, Homo sapiens
auccaaccuccuguca

SEQ ID NO: 1629136 - RNA, 18 nt, Homo sapiens
auccaccccaucccagac

SEQ ID NO: 1629137 - RNA, 16 nt, Homo sapiens
auccacuuacauauau

SEQ ID NO: 1629138 - RNA, 18 nt, Homo sapiens
auccagaguucugugaca

SEQ ID NO: 1629139 - RNA, 19 nt, Homo sapiens
auccagccaugccugaggu

SEQ ID NO: 1629140 - RNA, 20 nt, Homo sapiens
auccagggcccccaucucau

SEQ ID NO: 1629141 - RNA, 17 nt, Homo sapiens
auccaugaaacauuaca

SEQ ID NO: 1629142 - RNA, 18 nt, Homo sapiens
auccaugcaccuaccuua

SEQ ID NO: 1629143 - RNA, 22 nt, Homo sapiens
auccaugcggccuggguguccu

SEQ ID NO: 1629144 - RNA, 18 nt, Homo sapiens
aucccaaccagugccaag

SEQ ID NO: 1629145 - RNA, 19 nt, Homo sapiens
aucccaaccagugccaagg

SEQ ID NO: 1629146 - RNA, 13 nt, Homo sapiens
aucccacauccca

SEQ ID NO: 1629147 - RNA, 18 nt, Homo sapiens
auccccacccagucucau

SEQ ID NO: 1629148 - RNA, 18 nt, Homo sapiens
auccccagcgauucccuc

SEQ ID NO: 1629149 - RNA, 16 nt, Homo sapiens
aucccccaaugaccuu

SEQ ID NO: 1629150 - RNA, 18 nt, Homo sapiens
aucccuaacuaaagggga

SEQ ID NO: 1629151 - RNA, 19 nt, Homo sapiens
aucccuacugccaaccugg

SEQ ID NO: 1629152 - RNA, 16 nt, Homo sapiens
aucccuauagaccacu

SEQ ID NO: 1629153 - RNA, 18 nt, Homo sapiens
aucccuauagaccacugg

SEQ ID NO: 1629154 - RNA, 18 nt, Homo sapiens
aucccucgggugugcuau

SEQ ID NO: 1629155 - RNA, 19 nt, Homo sapiens
auccgauuccccuguagca

SEQ ID NO: 1629156 - RNA, 20 nt, Homo sapiens
auccuacugagcauuugcac

SEQ ID NO: 1629157 - RNA, 17 nt, Homo sapiens
auccuagcuacuuggca

SEQ ID NO: 1629158 - RNA, 16 nt, Homo sapiens
auccuuaacacauuca

SEQ ID NO: 1629159 - RNA, 15 nt, Homo sapiens
auccuuacaauguga

SEQ ID NO: 1629160 - RNA, 14 nt, Homo sapiens
auccuuccauucca

SEQ ID NO: 1629161 - RNA, 24 nt, Homo sapiens
auccuuggaaauuggaagagcaca

SEQ ID NO: 1629162 - RNA, 21 nt, Homo sapiens
auccuuguuuugaaaaccuaa

SEQ ID NO: 1629163 - RNA, 16 nt, Homo sapiens
aucgauauuagaagcu

SEQ ID NO: 1629164 - RNA, 19 nt, Homo sapiens
aucgauggaugggaugcac

SEQ ID NO: 1629165 - RNA, 16 nt, Homo sapiens
aucggcucacaaagag

SEQ ID NO: 1629166 - RNA, 20 nt, Homo sapiens
aucguuccaguucccacuug

SEQ ID NO: 1629167 - RNA, 20 nt, Homo sapiens
aucuaagcauuccacacugc

SEQ ID NO: 1629168 - RNA, 18 nt, Homo sapiens
aucuaccacuguaugagu

SEQ ID NO: 1629169 - RNA, 14 nt, Homo sapiens
aucuaucaacuaua

SEQ ID NO: 1629170 - RNA, 15 nt, Homo sapiens
aucuauuucacuuau

SEQ ID NO: 1629171 - RNA, 14 nt, Homo sapiens
aucucaaacuauga

SEQ ID NO: 1629172 - RNA, 22 nt, Homo sapiens
aucuccuuacagucacuaauau

SEQ ID NO: 1629173 - RNA, 20 nt, Homo sapiens
aucucgaacuccuaaccuca

SEQ ID NO: 1629174 - RNA, 22 nt, Homo sapiens
aucucugagaccacagaggcuc

SEQ ID NO: 1629175 - RNA, 19 nt, Homo sapiens
aucucugguugucuaguca

SEQ ID NO: 1629176 - RNA, 19 nt, Homo sapiens
aucugagaaaaaaagugag

SEQ ID NO: 1629177 - RNA, 13 nt, Homo sapiens
aucugcaguuuaa

SEQ ID NO: 1629178 - RNA, 15 nt, Homo sapiens
aucugcaguuuaaca

SEQ ID NO: 1629179 - RNA, 15 nt, Homo sapiens
aucugccaucugcuu

SEQ ID NO: 1629180 - RNA, 12 nt, Homo sapiens
aucugcugucuu

SEQ ID NO: 1629181 - RNA, 16 nt, Homo sapiens
aucugggagagucuca

SEQ ID NO: 1629182 - RNA, 13 nt, Homo sapiens
aucugggugcaug

SEQ ID NO: 1629183 - RNA, 19 nt, Homo sapiens
aucugucuuuuauuuaaca

SEQ ID NO: 1629184 - RNA, 10 nt, Homo sapiens
aucugugcac

SEQ ID NO: 1629185 - RNA, 18 nt, Homo sapiens
aucugugccagagguaau

SEQ ID NO: 1629186 - RNA, 14 nt, Homo sapiens
aucuuaaaggacau

SEQ ID NO: 1629187 - RNA, 15 nt, Homo sapiens
aucuuccaccagcac

SEQ ID NO: 1629188 - RNA, 18 nt, Homo sapiens
aucuuccccaacgaaaag

SEQ ID NO: 1629189 - RNA, 23 nt, Homo sapiens
aucuuccccaacgaaaagcacau

SEQ ID NO: 1629190 - RNA, 18 nt, Homo sapiens
aucuucccuuuauuacaa

SEQ ID NO: 1629191 - RNA, 16 nt, Homo sapiens
aucuucucucuugauu

SEQ ID NO: 1629192 - RNA, 18 nt, Homo sapiens
aucuuggagaaugugaga

SEQ ID NO: 1629193 - RNA, 15 nt, Homo sapiens
aucuuuaacacaacu

SEQ ID NO: 1629194 - RNA, 12 nt, Homo sapiens
aucuuuaccucc

SEQ ID NO: 1629195 - RNA, 18 nt, Homo sapiens
augaaaacucaugaucaa

SEQ ID NO: 1629196 - RNA, 16 nt, Homo sapiens
augaaaggaucucuga

SEQ ID NO: 1629197 - RNA, 18 nt, Homo sapiens
augaaauguccucuugaa

SEQ ID NO: 1629198 - RNA, 12 nt, Homo sapiens
augaacaucucu

SEQ ID NO: 1629199 - RNA, 15 nt, Homo sapiens
augaacccugcccug

SEQ ID NO: 1629200 - RNA, 20 nt, Homo sapiens
augaaccugcccugcuccca

SEQ ID NO: 1629201 - RNA, 17 nt, Homo sapiens
augaacuuaaaaugaaa

SEQ ID NO: 1629202 - RNA, 17 nt, Homo sapiens
augaagaaagauacuaa

SEQ ID NO: 1629203 - RNA, 20 nt, Homo sapiens
augaagaaucacgauuucau

SEQ ID NO: 1629204 - RNA, 21 nt, Homo sapiens
augaagguggaacaagcacag

SEQ ID NO: 1629205 - RNA, 13 nt, Homo sapiens
augaaguuauuaa

SEQ ID NO: 1629206 - RNA, 17 nt, Homo sapiens
augacagaaaaguaaug

SEQ ID NO: 1629207 - RNA, 22 nt, Homo sapiens
augacagugaauauugcuuuua

SEQ ID NO: 1629208 - RNA, 15 nt, Homo sapiens
augaccauccugcca

SEQ ID NO: 1629209 - RNA, 15 nt, Homo sapiens
augaccaugcugaua

SEQ ID NO: 1629210 - RNA, 19 nt, Homo sapiens
augacccaggccuggccag

SEQ ID NO: 1629211 - RNA, 18 nt, Homo sapiens
augacgacauacaugcua

SEQ ID NO: 1629212 - RNA, 15 nt, Homo sapiens
augacgucaucauca

SEQ ID NO: 1629213 - RNA, 13 nt, Homo sapiens
augagaagacaug

SEQ ID NO: 1629214 - RNA, 20 nt, Homo sapiens
augagaguagagggcacugg

SEQ ID NO: 1629215 - RNA, 18 nt, Homo sapiens
augagaugauacauccaa

SEQ ID NO: 1629216 - RNA, 13 nt, Homo sapiens
augagccaugaga

SEQ ID NO: 1629217 - RNA, 16 nt, Homo sapiens
augagcugacaucuca

SEQ ID NO: 1629218 - RNA, 17 nt, Homo sapiens
augagcugacaucucag

SEQ ID NO: 1629219 - RNA, 16 nt, Homo sapiens
augaggugccacccag

SEQ ID NO: 1629220 - RNA, 16 nt, Homo sapiens
augaguggcuuuaaug

SEQ ID NO: 1629221 - RNA, 17 nt, Homo sapiens
augaguucaaauacuuu

SEQ ID NO: 1629222 - RNA, 13 nt, Homo sapiens
augauacauccaa

SEQ ID NO: 1629223 - RNA, 20 nt, Homo sapiens
augaucaguguuacugccua

SEQ ID NO: 1629224 - RNA, 21 nt, Homo sapiens
augaucucucuagcuuuguca

SEQ ID NO: 1629225 - RNA, 16 nt, Homo sapiens
augcaaauacaaucag

SEQ ID NO: 1629226 - RNA, 19 nt, Homo sapiens
augcaaauacaaucagccc

SEQ ID NO: 1629227 - RNA, 19 nt, Homo sapiens
augcaaauccuaugugauu

SEQ ID NO: 1629228 - RNA, 14 nt, Homo sapiens
augcaaugugcuac

SEQ ID NO: 1629229 - RNA, 21 nt, Homo sapiens
augcacauauggacucugcac

SEQ ID NO: 1629230 - RNA, 17 nt, Homo sapiens
augcagaaccacaaaca

SEQ ID NO: 1629231 - RNA, 11 nt, Homo sapiens
augccacagac

SEQ ID NO: 1629232 - RNA, 23 nt, Homo sapiens
augccacuuccuuuuaacugcca

SEQ ID NO: 1629233 - RNA, 20 nt, Homo sapiens
cacuucucaggacacaggcc

SEQ ID NO: 1629234 - RNA, 21 nt, Homo sapiens
cacuucucucuccccaucccc

SEQ ID NO: 1629235 - RNA, 20 nt, Homo sapiens
cacuuucccaaaacugccac

SEQ ID NO: 1629236 - RNA, 14 nt, Homo sapiens
cacuuuccuuucaa

SEQ ID NO: 1629237 - RNA, 16 nt, Homo sapiens
cacuuuccuuucaaua

SEQ ID NO: 1629238 - RNA, 15 nt, Homo sapiens
cacuuuggaaucaga

SEQ ID NO: 1629239 - RNA, 18 nt, Homo sapiens
cacuuuugcuugaauuua

SEQ ID NO: 1629240 - RNA, 18 nt, Homo sapiens
cacuuuuuaaaaucucaa

SEQ ID NO: 1629241 - RNA, 18 nt, Homo sapiens
cagaaacaugucuugacu

SEQ ID NO: 1629242 - RNA, 14 nt, Homo sapiens
cagaaagauuugau

SEQ ID NO: 1629243 - RNA, 18 nt, Homo sapiens
cagaacauacuguucuca

SEQ ID NO: 1629244 - RNA, 16 nt, Homo sapiens
cagaacuaccaugaga

SEQ ID NO: 1629245 - RNA, 13 nt, Homo sapiens
cagaagaagacag

SEQ ID NO: 1629246 - RNA, 23 nt, Homo sapiens
cagaagacuucuauggaccacaa

SEQ ID NO: 1629247 - RNA, 21 nt, Homo sapiens
cagaagauccaagaggcccug

SEQ ID NO: 1629248 - RNA, 20 nt, Homo sapiens
cagaaggaaaaaaacaugaa

SEQ ID NO: 1629249 - RNA, 15 nt, Homo sapiens
cagaaguaauuugaa

SEQ ID NO: 1629250 - RNA, 14 nt, Homo sapiens
cagaaguacuccua

SEQ ID NO: 1629251 - RNA, 14 nt, Homo sapiens
cagaaguuccucaa

SEQ ID NO: 1629252 - RNA, 13 nt, Homo sapiens
cagaauaauacaa

SEQ ID NO: 1629253 - RNA, 14 nt, Homo sapiens
cagaaucccggcug

SEQ ID NO: 1629254 - RNA, 22 nt, Homo sapiens
cagaaucccggcugucaagggg

SEQ ID NO: 1629255 - RNA, 11 nt, Homo sapiens
cagaauggagg

SEQ ID NO: 1629256 - RNA, 13 nt, Homo sapiens
cagaauggaggca

SEQ ID NO: 1629257 - RNA, 16 nt, Homo sapiens
cagaauguuacugacu

SEQ ID NO: 1629258 - RNA, 13 nt, Homo sapiens
cagaauugcacau

SEQ ID NO: 1629259 - RNA, 19 nt, Homo sapiens
cagaauuguuccaguacua

SEQ ID NO: 1629260 - RNA, 23 nt, Homo sapiens
cagacacaugcuauguucugucu

SEQ ID NO: 1629261 - RNA, 18 nt, Homo sapiens
cagacagaagucuccuca

SEQ ID NO: 1629262 - RNA, 14 nt, Homo sapiens
cagaccaucgcaca

SEQ ID NO: 1629263 - RNA, 22 nt, Homo sapiens
cagacccaguggacucuuccac

SEQ ID NO: 1629264 - RNA, 23 nt, Homo sapiens
cagaccuaauaucauuuuauuca

SEQ ID NO: 1629265 - RNA, 16 nt, Homo sapiens
cagaccugccucuucc

SEQ ID NO: 1629266 - RNA, 20 nt, Homo sapiens
cagacucccaccccagggau

SEQ ID NO: 1629267 - RNA, 22 nt, Homo sapiens
cagacucccaccccagggauug

SEQ ID NO: 1629268 - RNA, 18 nt, Homo sapiens
cagacuccuagacucacu

SEQ ID NO: 1629269 - RNA, 22 nt, Homo sapiens
cagacucuugggccguccccau

SEQ ID NO: 1629270 - RNA, 21 nt, Homo sapiens
cagacugaccuugaugagcug

SEQ ID NO: 1629271 - RNA, 21 nt, Homo sapiens
cagacuuuguguucauuucau

SEQ ID NO: 1629272 - RNA, 16 nt, Homo sapiens
cagacuuuugugaaca

SEQ ID NO: 1629273 - RNA, 17 nt, Homo sapiens
cagagaaguuuguagcc

SEQ ID NO: 1629274 - RNA, 22 nt, Homo sapiens
cagagagaggggagaagccugg

SEQ ID NO: 1629275 - RNA, 16 nt, Homo sapiens
cagagauaaagaccuu

SEQ ID NO: 1629276 - RNA, 21 nt, Homo sapiens
cagagauggucacaugaccca

SEQ ID NO: 1629277 - RNA, 17 nt, Homo sapiens
cagagccucgcucuguu

SEQ ID NO: 1629278 - RNA, 17 nt, Homo sapiens
cagagcgagacuccauc

SEQ ID NO: 1629279 - RNA, 20 nt, Homo sapiens
cagagcuuccuggggaccaa

SEQ ID NO: 1629280 - RNA, 12 nt, Homo sapiens
cagaggaacaaa

SEQ ID NO: 1629281 - RNA, 13 nt, Homo sapiens
cagaggauguggc

SEQ ID NO: 1629282 - RNA, 20 nt, Homo sapiens
cagagguaauguuaguaaau

SEQ ID NO: 1629283 - RNA, 14 nt, Homo sapiens
cagaggugcuccau

SEQ ID NO: 1629284 - RNA, 17 nt, Homo sapiens
cagaggugcuccaugga

SEQ ID NO: 1629285 - RNA, 23 nt, Homo sapiens
cagagugaccagcacacuggacu

SEQ ID NO: 1629286 - RNA, 19 nt, Homo sapiens
cagauaaaaugccagucuc

SEQ ID NO: 1629287 - RNA, 11 nt, Homo sapiens
cagauaacaua

SEQ ID NO: 1629288 - RNA, 18 nt, Homo sapiens
cagauagcugccacuggc

SEQ ID NO: 1629289 - RNA, 21 nt, Homo sapiens
cagaucgcuuuacuccaggaa

SEQ ID NO: 1629290 - RNA, 15 nt, Homo sapiens
cagaugcagggcagu

SEQ ID NO: 1629291 - RNA, 21 nt, Homo sapiens
cagaugccucagccuacuuuc

SEQ ID NO: 1629292 - RNA, 23 nt, Homo sapiens
cagauguuuguuuucaaaauacu

SEQ ID NO: 1629293 - RNA, 12 nt, Homo sapiens
cagauugcugca

SEQ ID NO: 1629294 - RNA, 13 nt, Homo sapiens
cagauugcugcaa

SEQ ID NO: 1629295 - RNA, 16 nt, Homo sapiens
cagauuuacuaaauca

SEQ ID NO: 1629296 - RNA, 19 nt, Homo sapiens
cagcaaacccugaugugac

SEQ ID NO: 1629297 - RNA, 16 nt, Homo sapiens
cagcaagucaggguug

SEQ ID NO: 1629298 - RNA, 16 nt, Homo sapiens
cagcacacagggcagu

SEQ ID NO: 1629299 - RNA, 13 nt, Homo sapiens
cagcacacuggac

SEQ ID NO: 1629300 - RNA, 12 nt, Homo sapiens
cagcacagccaa

SEQ ID NO: 1629301 - RNA, 15 nt, Homo sapiens
cagcaccuacagugu

SEQ ID NO: 1629302 - RNA, 14 nt, Homo sapiens
cagcagcagcacuu

SEQ ID NO: 1629303 - RNA, 22 nt, Homo sapiens
cagcaggaauaaagacuugugc

SEQ ID NO: 1629304 - RNA, 13 nt, Homo sapiens
cagcaugccugaa

SEQ ID NO: 1629305 - RNA, 13 nt, Homo sapiens
cagccacccugcc

SEQ ID NO: 1629306 - RNA, 12 nt, Homo sapiens
cagcccaaaggc

SEQ ID NO: 1629307 - RNA, 16 nt, Homo sapiens
cagcccaccccugugc

SEQ ID NO: 1629308 - RNA, 14 nt, Homo sapiens
cagcccagugcaaa

SEQ ID NO: 1629309 - RNA, 18 nt, Homo sapiens
cagccccgggcacccgcc

SEQ ID NO: 1629310 - RNA, 17 nt, Homo sapiens
cagcccucagacuguca

SEQ ID NO: 1629311 - RNA, 15 nt, Homo sapiens
cagccucccauccag

SEQ ID NO: 1629312 - RNA, 15 nt, Homo sapiens
cagccugggggacag

SEQ ID NO: 1629313 - RNA, 16 nt, Homo sapiens
cagcgcccuuccucuc

SEQ ID NO: 1629314 - RNA, 14 nt, Homo sapiens
cagcggauguugua

SEQ ID NO: 1629315 - RNA, 22 nt, Homo sapiens
cagcuacgaauauagaggguuu

SEQ ID NO: 1629316 - RNA, 11 nt, Homo sapiens
cagcucagggc

SEQ ID NO: 1629317 - RNA, 14 nt, Homo sapiens
cagcucugggccau

SEQ ID NO: 1629318 - RNA, 20 nt, Homo sapiens
cagcugguccugaccaggau

SEQ ID NO: 1629319 - RNA, 13 nt, Homo sapiens
cagcuguuuaugc

SEQ ID NO: 1629320 - RNA, 23 nt, Homo sapiens
cagcuguuuggccaaugugcaua

SEQ ID NO: 1629321 - RNA, 19 nt, Homo sapiens
cagcuucaacuuuucucuu

SEQ ID NO: 1629322 - RNA, 12 nt, Homo sapiens
cagcuucuaacu

SEQ ID NO: 1629323 - RNA, 16 nt, Homo sapiens
caggaaaaacccguca

SEQ ID NO: 1629324 - RNA, 17 nt, Homo sapiens
caggaaauacuuuguaa

SEQ ID NO: 1629325 - RNA, 22 nt, Homo sapiens
caggaagacuuugugacuguca

SEQ ID NO: 1629326 - RNA, 16 nt, Homo sapiens
caggaaggggugugcu

SEQ ID NO: 1629327 - RNA, 15 nt, Homo sapiens
caggacaggaaaaac

SEQ ID NO: 1629328 - RNA, 12 nt, Homo sapiens
caggaccaccuc

SEQ ID NO: 1629329 - RNA, 22 nt, Homo sapiens
caggaccagguggcacuuccac

SEQ ID NO: 1629330 - RNA, 13 nt, Homo sapiens
caggacggggcac

SEQ ID NO: 1629331 - RNA, 21 nt, Homo sapiens
caggagcuaccuguguggaca

SEQ ID NO: 1629332 - RNA, 20 nt, Homo sapiens
caggaggcccccaucuauga

SEQ ID NO: 1629333 - RNA, 21 nt, Homo sapiens
caggaggguauggugcugcuc

SEQ ID NO: 1629334 - RNA, 16 nt, Homo sapiens
caggaggugccugaaa

SEQ ID NO: 1629335 - RNA, 20 nt, Homo sapiens
caggaggugugaaugcacgu

SEQ ID NO: 1629336 - RNA, 18 nt, Homo sapiens
caggaguagcugagcuca

SEQ ID NO: 1629337 - RNA, 19 nt, Homo sapiens
caggaguagcugagcucac

SEQ ID NO: 1629338 - RNA, 22 nt, Homo sapiens
caggauacuggcacagagguag

SEQ ID NO: 1629339 - RNA, 15 nt, Homo sapiens
caggaugaggucucg

SEQ ID NO: 1629340 - RNA, 15 nt, Homo sapiens
caggauguugcucca

SEQ ID NO: 1629341 - RNA, 14 nt, Homo sapiens
caggcaacgcacaa

SEQ ID NO: 1629342 - RNA, 18 nt, Homo sapiens
caggcaacgcacaaaaca

SEQ ID NO: 1629343 - RNA, 16 nt, Homo sapiens
cccacggagcaucuca

SEQ ID NO: 1629344 - RNA, 15 nt, Homo sapiens
cccagacuacuauuu

SEQ ID NO: 1629345 - RNA, 19 nt, Homo sapiens
cccagacuacuauuuucuu

SEQ ID NO: 1629346 - RNA, 18 nt, Homo sapiens
cccagacucccaccccag

SEQ ID NO: 1629347 - RNA, 18 nt, Homo sapiens
cccagagcugugccagca

SEQ ID NO: 1629348 - RNA, 13 nt, Homo sapiens
cccagagugagcu

SEQ ID NO: 1629349 - RNA, 20 nt, Homo sapiens
cccagaugccugggugcaaa

SEQ ID NO: 1629350 - RNA, 21 nt, Homo sapiens
cccagcaggugcugacuucau

SEQ ID NO: 1629351 - RNA, 21 nt, Homo sapiens
cccagcuccggccuguccucc

SEQ ID NO: 1629352 - RNA, 16 nt, Homo sapiens
cccaggacggggcaca

SEQ ID NO: 1629353 - RNA, 15 nt, Homo sapiens
cccaggauacuggca

SEQ ID NO: 1629354 - RNA, 12 nt, Homo sapiens
cccaggaucucc

SEQ ID NO: 1629355 - RNA, 15 nt, Homo sapiens
cccaggcaugcaaug

SEQ ID NO: 1629356 - RNA, 16 nt, Homo sapiens
cccaggcaugcaaugc

SEQ ID NO: 1629357 - RNA, 23 nt, Homo sapiens
cccaggccuaucuggaagccacc

SEQ ID NO: 1629358 - RNA, 17 nt, Homo sapiens
cccaggcuggagugcaa

SEQ ID NO: 1629359 - RNA, 18 nt, Homo sapiens
cccaggcuggagugcaau

SEQ ID NO: 1629360 - RNA, 18 nt, Homo sapiens
cccaggguggagugcagu

SEQ ID NO: 1629361 - RNA, 19 nt, Homo sapiens
cccaggguggagugcagug

SEQ ID NO: 1629362 - RNA, 15 nt, Homo sapiens
cccaguucuucauuu

SEQ ID NO: 1629363 - RNA, 19 nt, Homo sapiens
cccauagaaaacuugacau

SEQ ID NO: 1629364 - RNA, 15 nt, Homo sapiens
cccaucaccuacuca

SEQ ID NO: 1629365 - RNA, 23 nt, Homo sapiens
cccauccauuaggccagcaacgc

SEQ ID NO: 1629366 - RNA, 12 nt, Homo sapiens
cccaucuaugag

SEQ ID NO: 1629367 - RNA, 21 nt, Homo sapiens
cccaugagaguagagggcacu

SEQ ID NO: 1629368 - RNA, 22 nt, Homo sapiens
cccaugcuuuguaggugucuca

SEQ ID NO: 1629369 - RNA, 15 nt, Homo sapiens
cccauguaaccacug

SEQ ID NO: 1629370 - RNA, 12 nt, Homo sapiens
cccaugugaaaa

SEQ ID NO: 1629371 - RNA, 19 nt, Homo sapiens
cccauugcugccaaggugg

SEQ ID NO: 1629372 - RNA, 17 nt, Homo sapiens
ccccaaauuuggcuaaa

SEQ ID NO: 1629373 - RNA, 16 nt, Homo sapiens
ccccaagaucugccag

SEQ ID NO: 1629374 - RNA, 11 nt, Homo sapiens
ccccacacccc

SEQ ID NO: 1629375 - RNA, 13 nt, Homo sapiens
ccccaccuucaau

SEQ ID NO: 1629376 - RNA, 20 nt, Homo sapiens
ccccagaggugcuccaugga

SEQ ID NO: 1629377 - RNA, 19 nt, Homo sapiens
ccccagcucccccaggcag

SEQ ID NO: 1629378 - RNA, 16 nt, Homo sapiens
ccccaguggauucuca

SEQ ID NO: 1629379 - RNA, 17 nt, Homo sapiens
ccccaugacauugcauu

SEQ ID NO: 1629380 - RNA, 16 nt, Homo sapiens
cccccaaaucaagcag

SEQ ID NO: 1629381 - RNA, 11 nt, Homo sapiens
cccccaucucc

SEQ ID NO: 1629382 - RNA, 15 nt, Homo sapiens
cccccugaguuuccu

SEQ ID NO: 1629383 - RNA, 18 nt, Homo sapiens
ccccucacucuguuuccu

SEQ ID NO: 1629384 - RNA, 15 nt, Homo sapiens
ccccuggccacagua

SEQ ID NO: 1629385 - RNA, 14 nt, Homo sapiens
ccccugucucaggg

SEQ ID NO: 1629386 - RNA, 23 nt, Homo sapiens
ccccuucacguuugcaguugaug

SEQ ID NO: 1629387 - RNA, 19 nt, Homo sapiens
cccggcucguguauuuauu

SEQ ID NO: 1629388 - RNA, 17 nt, Homo sapiens
cccggcugucaaggggu

SEQ ID NO: 1629389 - RNA, 21 nt, Homo sapiens
cccuacacagggccugcuauu

SEQ ID NO: 1629390 - RNA, 21 nt, Homo sapiens
cccuagcucuuccccaucuca

SEQ ID NO: 1629391 - RNA, 15 nt, Homo sapiens
cccuccaccuuccau

SEQ ID NO: 1629392 - RNA, 19 nt, Homo sapiens
cccuccugugcugggggaa

SEQ ID NO: 1629393 - RNA, 16 nt, Homo sapiens
cccucggguccauaga

SEQ ID NO: 1629394 - RNA, 21 nt, Homo sapiens
cccucugucggcuuuuugcca

SEQ ID NO: 1629395 - RNA, 22 nt, Homo sapiens
cccugaccugugagcccagcug

SEQ ID NO: 1629396 - RNA, 20 nt, Homo sapiens
cccugcaaacagaacagggu

SEQ ID NO: 1629397 - RNA, 14 nt, Homo sapiens
cccugcaauuacuu

SEQ ID NO: 1629398 - RNA, 11 nt, Homo sapiens
cccugcauguu

SEQ ID NO: 1629399 - RNA, 13 nt, Homo sapiens
cccugcccacaga

SEQ ID NO: 1629400 - RNA, 20 nt, Homo sapiens
cccugccccugugggacuca

SEQ ID NO: 1629401 - RNA, 14 nt, Homo sapiens
cccugccugagggu

SEQ ID NO: 1629402 - RNA, 13 nt, Homo sapiens
cccugcucccaca

SEQ ID NO: 1629403 - RNA, 20 nt, Homo sapiens
cccugcucugcccaggcaag

SEQ ID NO: 1629404 - RNA, 13 nt, Homo sapiens
cccuggagggcaa

SEQ ID NO: 1629405 - RNA, 14 nt, Homo sapiens
cccugggccagggu

SEQ ID NO: 1629406 - RNA, 15 nt, Homo sapiens
cccuguuagcuuucc

SEQ ID NO: 1629407 - RNA, 20 nt, Homo sapiens
cccuuaggucgcgcucuugc

SEQ ID NO: 1629408 - RNA, 15 nt, Homo sapiens
cccuuagugacucuu

SEQ ID NO: 1629409 - RNA, 15 nt, Homo sapiens
cccuuccccugggaa

SEQ ID NO: 1629410 - RNA, 15 nt, Homo sapiens
cccuucugcucagcu

SEQ ID NO: 1629411 - RNA, 22 nt, Homo sapiens
cccuucuugguuuccaaaggca

SEQ ID NO: 1629412 - RNA, 15 nt, Homo sapiens
cccuugcccacccca

SEQ ID NO: 1629413 - RNA, 22 nt, Homo sapiens
cccuuuauuacaagaaggaaca

SEQ ID NO: 1629414 - RNA, 12 nt, Homo sapiens
cccuuugcuaaa

SEQ ID NO: 1629415 - RNA, 11 nt, Homo sapiens
ccgacucuggc

SEQ ID NO: 1629416 - RNA, 12 nt, Homo sapiens
ccgcacuuccuu

SEQ ID NO: 1629417 - RNA, 17 nt, Homo sapiens
ccggacucucggcucuu

SEQ ID NO: 1629418 - RNA, 19 nt, Homo sapiens
ccgggcagaggggcagaug

SEQ ID NO: 1629419 - RNA, 15 nt, Homo sapiens
ccgggccacuccuuc

SEQ ID NO: 1629420 - RNA, 15 nt, Homo sapiens
ccggggaacuggcca

SEQ ID NO: 1629421 - RNA, 19 nt, Homo sapiens
ccggugcagggccuggcau

SEQ ID NO: 1629422 - RNA, 22 nt, Homo sapiens
ccgguggaaaacuggacugugg

SEQ ID NO: 1629423 - RNA, 14 nt, Homo sapiens
ccgucuugaucgga

SEQ ID NO: 1629424 - RNA, 20 nt, Homo sapiens
ccgugugagugugacagggc

SEQ ID NO: 1629425 - RNA, 18 nt, Homo sapiens
ccguucugugcacaaaac

SEQ ID NO: 1629426 - RNA, 14 nt, Homo sapiens
ccuaaauguuaacu

SEQ ID NO: 1629427 - RNA, 16 nt, Homo sapiens
ccuaacacggugcuca

SEQ ID NO: 1629428 - RNA, 21 nt, Homo sapiens
ccuaacacugggcugcagaga

SEQ ID NO: 1629429 - RNA, 20 nt, Homo sapiens
ccuaacugaauacagucuca

SEQ ID NO: 1629430 - RNA, 22 nt, Homo sapiens
ccuaauguggcagcugucucaa

SEQ ID NO: 1629431 - RNA, 15 nt, Homo sapiens
ccuacaagauuuccu

SEQ ID NO: 1629432 - RNA, 19 nt, Homo sapiens
ccuacagcacuacugggug

SEQ ID NO: 1629433 - RNA, 21 nt, Homo sapiens
ccuaccuuagaaaacaaguau

SEQ ID NO: 1629434 - RNA, 15 nt, Homo sapiens
ccuagccaggucucc

SEQ ID NO: 1629435 - RNA, 20 nt, Homo sapiens
ccuagccuuugggcacaauu

SEQ ID NO: 1629436 - RNA, 21 nt, Homo sapiens
ccuagcucuuccccaucucac

SEQ ID NO: 1629437 - RNA, 14 nt, Homo sapiens
ccuaggauguucug

SEQ ID NO: 1629438 - RNA, 20 nt, Homo sapiens
ccuaggcugcugcugugacc

SEQ ID NO: 1629439 - RNA, 12 nt, Homo sapiens
ccuaucuggaag

SEQ ID NO: 1629440 - RNA, 16 nt, Homo sapiens
ccuaugcacauaugga

SEQ ID NO: 1629441 - RNA, 14 nt, Homo sapiens
ccuaugcugcaaua

SEQ ID NO: 1629442 - RNA, 20 nt, Homo sapiens
ccuaugggucuaggacacag

SEQ ID NO: 1629443 - RNA, 16 nt, Homo sapiens
ccuaugugauuuuaac

SEQ ID NO: 1629444 - RNA, 19 nt, Homo sapiens
ccuauuuagaaauggauuu

SEQ ID NO: 1629445 - RNA, 18 nt, Homo sapiens
ccucaaaccagucacuuu

SEQ ID NO: 1629446 - RNA, 16 nt, Homo sapiens
ccucaaagcauuugca

SEQ ID NO: 1629447 - RNA, 17 nt, Homo sapiens
ccucaaagcauuugcaa

SEQ ID NO: 1629448 - RNA, 17 nt, Homo sapiens
ccucaaaugcaguauuu

SEQ ID NO: 1629449 - RNA, 23 nt, Homo sapiens
ccucaagaaauaaaaggaagcca

SEQ ID NO: 1629450 - RNA, 14 nt, Homo sapiens
ccucaagcaccacg

SEQ ID NO: 1629451 - RNA, 18 nt, Homo sapiens
ccucaagggccaggacuu

SEQ ID NO: 1629452 - RNA, 20 nt, Homo sapiens
ccucaagguguucucuguag

SEQ ID NO: 1629453 - RNA, 17 nt, Homo sapiens
guacaccacaaggguca

SEQ ID NO: 1629454 - RNA, 18 nt, Homo sapiens
guacaccacaagggucac

SEQ ID NO: 1629455 - RNA, 20 nt, Homo sapiens
guacauaauauccaauggaa

SEQ ID NO: 1629456 - RNA, 12 nt, Homo sapiens
guacaugugcac

SEQ ID NO: 1629457 - RNA, 18 nt, Homo sapiens
guacauucuagcugagaa

SEQ ID NO: 1629458 - RNA, 20 nt, Homo sapiens
guaccugguggauaucuagc

SEQ ID NO: 1629459 - RNA, 14 nt, Homo sapiens
guacuauugcagac

SEQ ID NO: 1629460 - RNA, 18 nt, Homo sapiens
guacuguguuugauuugu

SEQ ID NO: 1629461 - RNA, 15 nt, Homo sapiens
guacuugucaaagaa

SEQ ID NO: 1629462 - RNA, 19 nt, Homo sapiens
guagaaaagggaacugaac

SEQ ID NO: 1629463 - RNA, 15 nt, Homo sapiens
guagagacaguguuu

SEQ ID NO: 1629464 - RNA, 21 nt, Homo sapiens
guagagacgguguuuugccau

SEQ ID NO: 1629465 - RNA, 13 nt, Homo sapiens
guagauaaggaaa

SEQ ID NO: 1629466 - RNA, 18 nt, Homo sapiens
guagauuuuaaagacaaa

SEQ ID NO: 1629467 - RNA, 14 nt, Homo sapiens
guagcuacaggaca

SEQ ID NO: 1629468 - RNA, 16 nt, Homo sapiens
guagcucaaucugcaa

SEQ ID NO: 1629469 - RNA, 14 nt, Homo sapiens
guagcuugcucccu

SEQ ID NO: 1629470 - RNA, 21 nt, Homo sapiens
guagguaggaagcacugaaaa

SEQ ID NO: 1629471 - RNA, 17 nt, Homo sapiens
guaggugugacauguua

SEQ ID NO: 1629472 - RNA, 23 nt, Homo sapiens
guaguucuagcaguccccagcug

SEQ ID NO: 1629473 - RNA, 19 nt, Homo sapiens
guauaaaauaaaauacauu

SEQ ID NO: 1629474 - RNA, 16 nt, Homo sapiens
guauaaauuuacuuuu

SEQ ID NO: 1629475 - RNA, 23 nt, Homo sapiens
guauccaugcaccuaccuuagaa

SEQ ID NO: 1629476 - RNA, 22 nt, Homo sapiens
guauccguucaauaagcauuuc

SEQ ID NO: 1629477 - RNA, 13 nt, Homo sapiens
guauccugcagcg

SEQ ID NO: 1629478 - RNA, 22 nt, Homo sapiens
guauccuuguugacacggccau

SEQ ID NO: 1629479 - RNA, 14 nt, Homo sapiens
guaucgauguuaug

SEQ ID NO: 1629480 - RNA, 20 nt, Homo sapiens
guaucuauuagcagccauau

SEQ ID NO: 1629481 - RNA, 21 nt, Homo sapiens
guaucuguuuacauccagagu

SEQ ID NO: 1629482 - RNA, 14 nt, Homo sapiens
guaugcaauggauu

SEQ ID NO: 1629483 - RNA, 15 nt, Homo sapiens
guauuaaguuguuaa

SEQ ID NO: 1629484 - RNA, 19 nt, Homo sapiens
guauucaacuaauacaugg

SEQ ID NO: 1629485 - RNA, 17 nt, Homo sapiens
guauucauauguuuaug

SEQ ID NO: 1629486 - RNA, 21 nt, Homo sapiens
guauuccccuuuauguacagg

SEQ ID NO: 1629487 - RNA, 16 nt, Homo sapiens
guauugugcacuguau

SEQ ID NO: 1629488 - RNA, 17 nt, Homo sapiens
guauuuucuccacuuca

SEQ ID NO: 1629489 - RNA, 15 nt, Homo sapiens
guauuuugacacugg

SEQ ID NO: 1629490 - RNA, 22 nt, Homo sapiens
gucaacuccaacguaugugguu

SEQ ID NO: 1629491 - RNA, 18 nt, Homo sapiens
gucaagaaacagccagca

SEQ ID NO: 1629492 - RNA, 21 nt, Homo sapiens
gucaagugaggugacacucca

SEQ ID NO: 1629493 - RNA, 11 nt, Homo sapiens
gucacaaagaa

SEQ ID NO: 1629494 - RNA, 17 nt, Homo sapiens
gucacacucuucaguga

SEQ ID NO: 1629495 - RNA, 13 nt, Homo sapiens
gucacagccaccc

SEQ ID NO: 1629496 - RNA, 23 nt, Homo sapiens
gucacauggccuaugcacauaug

SEQ ID NO: 1629497 - RNA, 16 nt, Homo sapiens
gucaccccucacugug

SEQ ID NO: 1629498 - RNA, 21 nt, Homo sapiens
gucacgcacaagggcacguga

SEQ ID NO: 1629499 - RNA, 22 nt, Homo sapiens
gucacgcuuucaugaauucugu

SEQ ID NO: 1629500 - RNA, 14 nt, Homo sapiens
gucacuagucucac

SEQ ID NO: 1629501 - RNA, 12 nt, Homo sapiens
gucagacauaaa

SEQ ID NO: 1629502 - RNA, 13 nt, Homo sapiens
gucagacauaaag

SEQ ID NO: 1629503 - RNA, 23 nt, Homo sapiens
gucagacuuuguguucauuucau

SEQ ID NO: 1629504 - RNA, 18 nt, Homo sapiens
gucagcauguacuccccu

SEQ ID NO: 1629505 - RNA, 17 nt, Homo sapiens
gucaggcagggugcagu

SEQ ID NO: 1629506 - RNA, 21 nt, Homo sapiens
gucagggagaggucaccagcu

SEQ ID NO: 1629507 - RNA, 20 nt, Homo sapiens
gucagugccaugacugagaa

SEQ ID NO: 1629508 - RNA, 17 nt, Homo sapiens
gucaucaucacauucag

SEQ ID NO: 1629509 - RNA, 16 nt, Homo sapiens
gucaugaauagaaaaa

SEQ ID NO: 1629510 - RNA, 15 nt, Homo sapiens
gucaugccacugcac

SEQ ID NO: 1629511 - RNA, 13 nt, Homo sapiens
gucauuacagggc

SEQ ID NO: 1629512 - RNA, 20 nt, Homo sapiens
gucauucagcgggagcacug

SEQ ID NO: 1629513 - RNA, 17 nt, Homo sapiens
gucauucuaacugcacu

SEQ ID NO: 1629514 - RNA, 19 nt, Homo sapiens
gucauuucaaagacucuca

SEQ ID NO: 1629515 - RNA, 18 nt, Homo sapiens
guccacuguucuguucuc

SEQ ID NO: 1629516 - RNA, 19 nt, Homo sapiens
guccacuguucuguucuca

SEQ ID NO: 1629517 - RNA, 21 nt, Homo sapiens
guccacuguucuguucucaua

SEQ ID NO: 1629518 - RNA, 15 nt, Homo sapiens
guccagguugaucuu

SEQ ID NO: 1629519 - RNA, 14 nt, Homo sapiens
gucccaaccccagu

SEQ ID NO: 1629520 - RNA, 16 nt, Homo sapiens
gucccaaccccagugg

SEQ ID NO: 1629521 - RNA, 20 nt, Homo sapiens
guccuccaacaccaagcaca

SEQ ID NO: 1629522 - RNA, 21 nt, Homo sapiens
guccucuggaucacagacacu

SEQ ID NO: 1629523 - RNA, 22 nt, Homo sapiens
guccucugucagucacagccac

SEQ ID NO: 1629524 - RNA, 21 nt, Homo sapiens
guccucuucugcaucuugggg

SEQ ID NO: 1629525 - RNA, 16 nt, Homo sapiens
guccucuugaagcaua

SEQ ID NO: 1629526 - RNA, 20 nt, Homo sapiens
guccugaaggaaaaugacuc

SEQ ID NO: 1629527 - RNA, 14 nt, Homo sapiens
guccugggcaaagg

SEQ ID NO: 1629528 - RNA, 22 nt, Homo sapiens
guccugguggggcagcuccucu

SEQ ID NO: 1629529 - RNA, 16 nt, Homo sapiens
guccuguccugcucau

SEQ ID NO: 1629530 - RNA, 18 nt, Homo sapiens
guccuuuacaaacauaca

SEQ ID NO: 1629531 - RNA, 15 nt, Homo sapiens
gucgccccucagagc

SEQ ID NO: 1629532 - RNA, 17 nt, Homo sapiens
gucucaaucuccugacu

SEQ ID NO: 1629533 - RNA, 21 nt, Homo sapiens
gucucauugucaccucuguga

SEQ ID NO: 1629534 - RNA, 14 nt, Homo sapiens
gucuccaugcucac

SEQ ID NO: 1629535 - RNA, 17 nt, Homo sapiens
gucuccaugcucaccaa

SEQ ID NO: 1629536 - RNA, 20 nt, Homo sapiens
gucuccaugcucaccaagga

SEQ ID NO: 1629537 - RNA, 21 nt, Homo sapiens
gucuccucggccacuuucagu

SEQ ID NO: 1629538 - RNA, 19 nt, Homo sapiens
gucucucuauuacacugga

SEQ ID NO: 1629539 - RNA, 17 nt, Homo sapiens
gucugaauucuggaauc

SEQ ID NO: 1629540 - RNA, 12 nt, Homo sapiens
gucugagguccu

SEQ ID NO: 1629541 - RNA, 21 nt, Homo sapiens
gucugagguccugagcacugc

SEQ ID NO: 1629542 - RNA, 15 nt, Homo sapiens
gucuguacacguguc

SEQ ID NO: 1629543 - RNA, 15 nt, Homo sapiens
gucuuagcuuuacau

SEQ ID NO: 1629544 - RNA, 19 nt, Homo sapiens
gucuucuccccucacccau

SEQ ID NO: 1629545 - RNA, 16 nt, Homo sapiens
gucuucuuacuuggaa

SEQ ID NO: 1629546 - RNA, 13 nt, Homo sapiens
gucuuguguuucu

SEQ ID NO: 1629547 - RNA, 19 nt, Homo sapiens
gucuuugccagucauucag

SEQ ID NO: 1629548 - RNA, 17 nt, Homo sapiens
gucuuuuuuauguuaaa

SEQ ID NO: 1629549 - RNA, 14 nt, Homo sapiens
gugaacaaagcagc

SEQ ID NO: 1629550 - RNA, 18 nt, Homo sapiens
gugaacccaggacaagca

SEQ ID NO: 1629551 - RNA, 19 nt, Homo sapiens
gugaagaguuucacaaauc

SEQ ID NO: 1629552 - RNA, 14 nt, Homo sapiens
gugaauucacccau

SEQ ID NO: 1629553 - RNA, 13 nt, Homo sapiens
gugacacauaugc

SEQ ID NO: 1629554 - RNA, 15 nt, Homo sapiens
gugaggagucugggu

SEQ ID NO: 1629555 - RNA, 12 nt, Homo sapiens
gugauacauuug

SEQ ID NO: 1629556 - RNA, 18 nt, Homo sapiens
gugauccgcccaccucag

SEQ ID NO: 1629557 - RNA, 20 nt, Homo sapiens
gugauuuuccuuuguagcua

SEQ ID NO: 1629558 - RNA, 16 nt, Homo sapiens
gugcaaaaucuguuau

SEQ ID NO: 1629559 - RNA, 17 nt, Homo sapiens
gugcacucucugcuuag

SEQ ID NO: 1629560 - RNA, 19 nt, Homo sapiens
gugcagaaauuugaaugac

SEQ ID NO: 1629561 - RNA, 23 nt, Homo sapiens
gugcaguaucaugcccugugcaa

SEQ ID NO: 1629562 - RNA, 19 nt, Homo sapiens
gugcaguggcgcauucuag

SEQ ID NO: 1629563 - RNA, 17 nt, Homo sapiens
uauucauggauggcuca

SEQ ID NO: 1629564 - RNA, 20 nt, Homo sapiens
uauuccaaaugccauccaga

SEQ ID NO: 1629565 - RNA, 14 nt, Homo sapiens
uauuccuaugcugc

SEQ ID NO: 1629566 - RNA, 15 nt, Homo sapiens
uauucuagccugcau

SEQ ID NO: 1629567 - RNA, 17 nt, Homo sapiens
uauugcaaggugugaug

SEQ ID NO: 1629568 - RNA, 15 nt, Homo sapiens
uauugggauaucauu

SEQ ID NO: 1629569 - RNA, 23 nt, Homo sapiens
uauugguuuuaaaaaagcauuau

SEQ ID NO: 1629570 - RNA, 17 nt, Homo sapiens
uauuguaaagauccuau

SEQ ID NO: 1629571 - RNA, 15 nt, Homo sapiens
uauuguuggcacaga

SEQ ID NO: 1629572 - RNA, 18 nt, Homo sapiens
uauuuagauauaacacua

SEQ ID NO: 1629573 - RNA, 20 nt, Homo sapiens
uauuucuucgugaacauaga

SEQ ID NO: 1629574 - RNA, 15 nt, Homo sapiens
uauuucuuggcaugc

SEQ ID NO: 1629575 - RNA, 20 nt, Homo sapiens
uauuugcacaaguucaguga

SEQ ID NO: 1629576 - RNA, 16 nt, Homo sapiens
uauuugcuuuuugcua

SEQ ID NO: 1629577 - RNA, 24 nt, Homo sapiens
uauuugcuuuuugcuaacaaugcu

SEQ ID NO: 1629578 - RNA, 12 nt, Homo sapiens
uauuuggcuuaa

SEQ ID NO: 1629579 - RNA, 17 nt, Homo sapiens
uauuugugucacaaaga

SEQ ID NO: 1629580 - RNA, 14 nt, Homo sapiens
uauuuuacauagau

SEQ ID NO: 1629581 - RNA, 16 nt, Homo sapiens
uauuuuaggcacuguu

SEQ ID NO: 1629582 - RNA, 17 nt, Homo sapiens
uauuuuauuauucagaa

SEQ ID NO: 1629583 - RNA, 13 nt, Homo sapiens
uauuuucuacaca

SEQ ID NO: 1629584 - RNA, 18 nt, Homo sapiens
ucaaaaccucaaauccac

SEQ ID NO: 1629585 - RNA, 22 nt, Homo sapiens
ucaaaagaaauuuaaguucuau

SEQ ID NO: 1629586 - RNA, 23 nt, Homo sapiens
ucaaaauaaaaaguaaugacuua

SEQ ID NO: 1629587 - RNA, 12 nt, Homo sapiens
ucaaaauacuuc

SEQ ID NO: 1629588 - RNA, 15 nt, Homo sapiens
ucaaacccauucccu

SEQ ID NO: 1629589 - RNA, 18 nt, Homo sapiens
ucaaaccuccaaaagccc

SEQ ID NO: 1629590 - RNA, 17 nt, Homo sapiens
ucaacaaauuucauugc

SEQ ID NO: 1629591 - RNA, 23 nt, Homo sapiens
ucaacaaauuucauugcacuuuc

SEQ ID NO: 1629592 - RNA, 21 nt, Homo sapiens
ucaacaugacauccagagaug

SEQ ID NO: 1629593 - RNA, 17 nt, Homo sapiens
ucaaccagauaacauac

SEQ ID NO: 1629594 - RNA, 20 nt, Homo sapiens
ucaacuuucagaagugccac

SEQ ID NO: 1629595 - RNA, 14 nt, Homo sapiens
ucaagaaaauggau

SEQ ID NO: 1629596 - RNA, 18 nt, Homo sapiens
ucaagcaccugcaugugc

SEQ ID NO: 1629597 - RNA, 22 nt, Homo sapiens
ucaagcgauucuccugccucag

SEQ ID NO: 1629598 - RNA, 15 nt, Homo sapiens
ucaagcugugagaca

SEQ ID NO: 1629599 - RNA, 15 nt, Homo sapiens
ucaaggaguacaaug

SEQ ID NO: 1629600 - RNA, 20 nt, Homo sapiens
ucaaggaguacaaugcccag

SEQ ID NO: 1629601 - RNA, 15 nt, Homo sapiens
ucaagguguucucug

SEQ ID NO: 1629602 - RNA, 19 nt, Homo sapiens
ucaagugaggugacacucc

SEQ ID NO: 1629603 - RNA, 20 nt, Homo sapiens
ucaagugaggugacacucca

SEQ ID NO: 1629604 - RNA, 19 nt, Homo sapiens
ucaagugucaccuccuucc

SEQ ID NO: 1629605 - RNA, 22 nt, Homo sapiens
ucaauaaacaacagcugaagca

SEQ ID NO: 1629606 - RNA, 21 nt, Homo sapiens
ucaauccuaaaagcaugucaa

SEQ ID NO: 1629607 - RNA, 15 nt, Homo sapiens
ucaaugcuagcacaa

SEQ ID NO: 1629608 - RNA, 18 nt, Homo sapiens
ucacaaaaucacuuuaag

SEQ ID NO: 1629609 - RNA, 17 nt, Homo sapiens
ucacaaauuucacuuau

SEQ ID NO: 1629610 - RNA, 13 nt, Homo sapiens
ucacaacagugaa

SEQ ID NO: 1629611 - RNA, 12 nt, Homo sapiens
ucacacagugaa

SEQ ID NO: 1629612 - RNA, 20 nt, Homo sapiens
ucacagccaccccugagauc

SEQ ID NO: 1629613 - RNA, 22 nt, Homo sapiens
ucacaucuuccaccagcaccuu

SEQ ID NO: 1629614 - RNA, 12 nt, Homo sapiens
ucacauguccua

SEQ ID NO: 1629615 - RNA, 18 nt, Homo sapiens
ucacauuccucugcccuu

SEQ ID NO: 1629616 - RNA, 23 nt, Homo sapiens
ucacauucuguuuaucaagccau

SEQ ID NO: 1629617 - RNA, 17 nt, Homo sapiens
ucaccagugccacguca

SEQ ID NO: 1629618 - RNA, 23 nt, Homo sapiens
ucaccaugaugugaagaguuuca

SEQ ID NO: 1629619 - RNA, 14 nt, Homo sapiens
ucacccacucccuu

SEQ ID NO: 1629620 - RNA, 16 nt, Homo sapiens
ucacguaaagcuagaa

SEQ ID NO: 1629621 - RNA, 23 nt, Homo sapiens
ucacuaaauaaacacgauuuuau

SEQ ID NO: 1629622 - RNA, 14 nt, Homo sapiens
ucacuaauauagua

SEQ ID NO: 1629623 - RNA, 14 nt, Homo sapiens
ucacuaaugcucaa

SEQ ID NO: 1629624 - RNA, 16 nt, Homo sapiens
ucacucauagccacuu

SEQ ID NO: 1629625 - RNA, 21 nt, Homo sapiens
ucacucccaggugagaauuca

SEQ ID NO: 1629626 - RNA, 18 nt, Homo sapiens
ucacucccuaggcccaag

SEQ ID NO: 1629627 - RNA, 20 nt, Homo sapiens
ucacucuuaguuaugugacg

SEQ ID NO: 1629628 - RNA, 18 nt, Homo sapiens
ucacugaaaacaucugga

SEQ ID NO: 1629629 - RNA, 19 nt, Homo sapiens
ucacugaaaacaucuggaa

SEQ ID NO: 1629630 - RNA, 18 nt, Homo sapiens
ucacuuccuuugcccuuc

SEQ ID NO: 1629631 - RNA, 17 nt, Homo sapiens
ucacuugaucaugcugc

SEQ ID NO: 1629632 - RNA, 14 nt, Homo sapiens
ucagaaaaguaauu

SEQ ID NO: 1629633 - RNA, 14 nt, Homo sapiens
ucagaaagauuuga

SEQ ID NO: 1629634 - RNA, 23 nt, Homo sapiens
ucagaaagggagggcucugaggc

SEQ ID NO: 1629635 - RNA, 14 nt, Homo sapiens
ucagaacccagaaa

SEQ ID NO: 1629636 - RNA, 14 nt, Homo sapiens
ucagaauugcacau

SEQ ID NO: 1629637 - RNA, 15 nt, Homo sapiens
ucagacaagcugcau

SEQ ID NO: 1629638 - RNA, 13 nt, Homo sapiens
ucagacaggcaaa

SEQ ID NO: 1629639 - RNA, 18 nt, Homo sapiens
ucagacuuucacaccauu

SEQ ID NO: 1629640 - RNA, 22 nt, Homo sapiens
ucagacuuuguguucauuucau

SEQ ID NO: 1629641 - RNA, 17 nt, Homo sapiens
ucagaggcgcacuguga

SEQ ID NO: 1629642 - RNA, 23 nt, Homo sapiens
ucagauauaaaagacugaccaau

SEQ ID NO: 1629643 - RNA, 18 nt, Homo sapiens
ucagcaacaucccaucua

SEQ ID NO: 1629644 - RNA, 19 nt, Homo sapiens
ucagcaagacauaaagccu

SEQ ID NO: 1629645 - RNA, 16 nt, Homo sapiens
ucagcagacauccaca

SEQ ID NO: 1629646 - RNA, 22 nt, Homo sapiens
ucagccaacugcccuaacugua

SEQ ID NO: 1629647 - RNA, 21 nt, Homo sapiens
ucagccagcaagagggaacaa

SEQ ID NO: 1629648 - RNA, 16 nt, Homo sapiens
ucagcccagugcaaac

SEQ ID NO: 1629649 - RNA, 23 nt, Homo sapiens
ucagcccugcccuucagcauccu

SEQ ID NO: 1629650 - RNA, 23 nt, Homo sapiens
ucagcuagacaaugauuuggcca

SEQ ID NO: 1629651 - RNA, 13 nt, Homo sapiens
ucagcucugggcc

SEQ ID NO: 1629652 - RNA, 20 nt, Homo sapiens
ucaggaacacccccaugaca

SEQ ID NO: 1629653 - RNA, 16 nt, Homo sapiens
ucaggcuacaagguag

SEQ ID NO: 1629654 - RNA, 21 nt, Homo sapiens
ucagggagaggucaccagcug

SEQ ID NO: 1629655 - RNA, 16 nt, Homo sapiens
ucagggccucaggcac

SEQ ID NO: 1629656 - RNA, 21 nt, Homo sapiens
ucaggggucgucccaacucug

SEQ ID NO: 1629657 - RNA, 14 nt, Homo sapiens
ucagguccaauuug

SEQ ID NO: 1629658 - RNA, 13 nt, Homo sapiens
ucaggugccaacc

SEQ ID NO: 1629659 - RNA, 18 nt, Homo sapiens
ucaguaaucacuuuucag

SEQ ID NO: 1629660 - RNA, 12 nt, Homo sapiens
ucaguaccaaag

SEQ ID NO: 1629661 - RNA, 17 nt, Homo sapiens
ucaguaggcuaauguca

SEQ ID NO: 1629662 - RNA, 15 nt, Homo sapiens
ucaguaggcuucugg

SEQ ID NO: 1629663 - RNA, 15 nt, Homo sapiens
ucagucaauagccau

SEQ ID NO: 1629664 - RNA, 22 nt, Homo sapiens
ucagucacagccaccccugaga

SEQ ID NO: 1629665 - RNA, 22 nt, Homo sapiens
ucagucauuucuucauguacag

SEQ ID NO: 1629666 - RNA, 17 nt, Homo sapiens
ucagugaaguacaccug

SEQ ID NO: 1629667 - RNA, 14 nt, Homo sapiens
ucagugcaguuucu

SEQ ID NO: 1629668 - RNA, 20 nt, Homo sapiens
ucagugcaguuucuuuucac

SEQ ID NO: 1629669 - RNA, 14 nt, Homo sapiens
ucagugccaugacu

SEQ ID NO: 1629670 - RNA, 20 nt, Homo sapiens
ucagugccuucaacaacgug

SEQ ID NO: 1629671 - RNA, 13 nt, Homo sapiens
ucaguuauuugca

SEQ ID NO: 1629672 - RNA, 16 nt, Homo sapiens
ugcaaaggagaagcac

SEQ ID NO: 1629673 - RNA, 16 nt, Homo sapiens
ugcaaauacaaucagc

SEQ ID NO: 1629674 - RNA, 17 nt, Homo sapiens
ugcaaauccuaugugau

SEQ ID NO: 1629675 - RNA, 18 nt, Homo sapiens
ugcaaauccuaugugauu

SEQ ID NO: 1629676 - RNA, 18 nt, Homo sapiens
ugcaaccagggagcugca

SEQ ID NO: 1629677 - RNA, 14 nt, Homo sapiens
ugcaaccccaggua

SEQ ID NO: 1629678 - RNA, 21 nt, Homo sapiens
ugcaaccucuuggccugauca

SEQ ID NO: 1629679 - RNA, 11 nt, Homo sapiens
ugcaagcacuc

SEQ ID NO: 1629680 - RNA, 19 nt, Homo sapiens
ugcaagccaucucuaauaa

SEQ ID NO: 1629681 - RNA, 15 nt, Homo sapiens
ugcaaggugugaugg

SEQ ID NO: 1629682 - RNA, 19 nt, Homo sapiens
ugcaaucagcuaccauuca

SEQ ID NO: 1629683 - RNA, 16 nt, Homo sapiens
ugcaauguaagcauac

SEQ ID NO: 1629684 - RNA, 13 nt, Homo sapiens
ugcaauuccaaga

SEQ ID NO: 1629685 - RNA, 14 nt, Homo sapiens
ugcaauuccaagaa

SEQ ID NO: 1629686 - RNA, 22 nt, Homo sapiens
ugcacaaucccuaaaauaaaga

SEQ ID NO: 1629687 - RNA, 21 nt, Homo sapiens
ugcacacucaugcacacagau

SEQ ID NO: 1629688 - RNA, 16 nt, Homo sapiens
ugcacaggcuugcugu

SEQ ID NO: 1629689 - RNA, 17 nt, Homo sapiens
ugcaccaccacacccgg

SEQ ID NO: 1629690 - RNA, 21 nt, Homo sapiens
ugcaccuguccccacccucca

SEQ ID NO: 1629691 - RNA, 14 nt, Homo sapiens
ugcaccuugcuccc

SEQ ID NO: 1629692 - RNA, 18 nt, Homo sapiens
ugcacuuauacccaugaa

SEQ ID NO: 1629693 - RNA, 17 nt, Homo sapiens
ugcagacacaucagcug

SEQ ID NO: 1629694 - RNA, 14 nt, Homo sapiens
ugcagcaccuccag

SEQ ID NO: 1629695 - RNA, 23 nt, Homo sapiens
ugcagcauugccauaccauuccc

SEQ ID NO: 1629696 - RNA, 14 nt, Homo sapiens
ugcaggaaaacuga

SEQ ID NO: 1629697 - RNA, 14 nt, Homo sapiens
ugcaugcuugcaua

SEQ ID NO: 1629698 - RNA, 17 nt, Homo sapiens
ugcauggaggcccuccu

SEQ ID NO: 1629699 - RNA, 21 nt, Homo sapiens
ugcauggauguuuuagccauu

SEQ ID NO: 1629700 - RNA, 19 nt, Homo sapiens
ugcauucuuccgcacccuc

SEQ ID NO: 1629701 - RNA, 12 nt, Homo sapiens
ugcauuuagcuu

SEQ ID NO: 1629702 - RNA, 17 nt, Homo sapiens
ugccaaccuguucuuag

SEQ ID NO: 1629703 - RNA, 14 nt, Homo sapiens
ugccaacuccucac

SEQ ID NO: 1629704 - RNA, 19 nt, Homo sapiens
ugccaauacagacaaagca

SEQ ID NO: 1629705 - RNA, 21 nt, Homo sapiens
ugccagaggcuggaccacaca

SEQ ID NO: 1629706 - RNA, 20 nt, Homo sapiens
ugccagcacagggcuguaaa

SEQ ID NO: 1629707 - RNA, 15 nt, Homo sapiens
ugccagguguggaac

SEQ ID NO: 1629708 - RNA, 14 nt, Homo sapiens
ugccauaugccuug

SEQ ID NO: 1629709 - RNA, 17 nt, Homo sapiens
ugccaucaacuacuauu

SEQ ID NO: 1629710 - RNA, 20 nt, Homo sapiens
ugccaucugugauaugccau

SEQ ID NO: 1629711 - RNA, 14 nt, Homo sapiens
ugcccaaccucacu

SEQ ID NO: 1629712 - RNA, 13 nt, Homo sapiens
ugcccacaggccg

SEQ ID NO: 1629713 - RNA, 20 nt, Homo sapiens
ugcccacuccgccagccaca

SEQ ID NO: 1629714 - RNA, 21 nt, Homo sapiens
ugcccacuccgccagccacag

SEQ ID NO: 1629715 - RNA, 13 nt, Homo sapiens
ugcccagaucaac

SEQ ID NO: 1629716 - RNA, 15 nt, Homo sapiens
ugcccagaucaacag

SEQ ID NO: 1629717 - RNA, 21 nt, Homo sapiens
ugcccaggcuggagugcaaug

SEQ ID NO: 1629718 - RNA, 18 nt, Homo sapiens
ugcccaggucccuccuca

SEQ ID NO: 1629719 - RNA, 15 nt, Homo sapiens
ugcccauugucuuau

SEQ ID NO: 1629720 - RNA, 13 nt, Homo sapiens
ugccccaauguga

SEQ ID NO: 1629721 - RNA, 17 nt, Homo sapiens
ugcccccuccaggagag

SEQ ID NO: 1629722 - RNA, 19 nt, Homo sapiens
ugcccucauuacugggccu

SEQ ID NO: 1629723 - RNA, 20 nt, Homo sapiens
ugcccugagaagcugcucca

SEQ ID NO: 1629724 - RNA, 15 nt, Homo sapiens
ugcccuggcauuaag

SEQ ID NO: 1629725 - RNA, 22 nt, Homo sapiens
ugcccuguaauuuuucugggaa

SEQ ID NO: 1629726 - RNA, 16 nt, Homo sapiens
ugcccuguuagcuuuc

SEQ ID NO: 1629727 - RNA, 19 nt, Homo sapiens
ugcccuguuagcuuuccaa

SEQ ID NO: 1629728 - RNA, 18 nt, Homo sapiens
ugcccuuccuccugccuu

SEQ ID NO: 1629729 - RNA, 15 nt, Homo sapiens
ugccgcauuccugca

SEQ ID NO: 1629730 - RNA, 20 nt, Homo sapiens
ugccgccuccuugugcacaa

SEQ ID NO: 1629731 - RNA, 19 nt, Homo sapiens
ugccguccugcaguccuua

SEQ ID NO: 1629732 - RNA, 17 nt, Homo sapiens
ugccuagaggugcucau

SEQ ID NO: 1629733 - RNA, 10 nt, Homo sapiens
ugccuggcaa

SEQ ID NO: 1629734 - RNA, 15 nt, Homo sapiens
ugccuggccuggcac

SEQ ID NO: 1629735 - RNA, 19 nt, Homo sapiens
ugccugucuguuacacugg

SEQ ID NO: 1629736 - RNA, 21 nt, Homo sapiens
ugccuguguacugccuuaaau

SEQ ID NO: 1629737 - RNA, 21 nt, Homo sapiens
ugccuuaaacacacauugcag

SEQ ID NO: 1629738 - RNA, 15 nt, Homo sapiens
ugccuugcugugaaa

SEQ ID NO: 1629739 - RNA, 17 nt, Homo sapiens
ugccuuggggaggacaa

SEQ ID NO: 1629740 - RNA, 22 nt, Homo sapiens
ugcgaucucggcucagugcaac

SEQ ID NO: 1629741 - RNA, 22 nt, Homo sapiens
ugcgccaaucccgccaugcuca

SEQ ID NO: 1629742 - RNA, 20 nt, Homo sapiens
ugcggaaaaacaaacaugaa

SEQ ID NO: 1629743 - RNA, 18 nt, Homo sapiens
ugcgggugaacaaagcag

SEQ ID NO: 1629744 - RNA, 13 nt, Homo sapiens
ugcguacacagag

SEQ ID NO: 1629745 - RNA, 22 nt, Homo sapiens
ugcgugcgcgcgcuucugggaa

SEQ ID NO: 1629746 - RNA, 14 nt, Homo sapiens
ugcguggacucugc

SEQ ID NO: 1629747 - RNA, 20 nt, Homo sapiens
ugcguguguacaugugcacu

SEQ ID NO: 1629748 - RNA, 16 nt, Homo sapiens
ugcuaacauagauuua

SEQ ID NO: 1629749 - RNA, 24 nt, Homo sapiens
ugcuacugauuguuucauugcgaa

SEQ ID NO: 1629750 - RNA, 20 nt, Homo sapiens
ugcuagauaauaaaauugcu

SEQ ID NO: 1629751 - RNA, 16 nt, Homo sapiens
ugcuaucccacuguau

SEQ ID NO: 1629752 - RNA, 16 nt, Homo sapiens
ugcucacaaaggauac

SEQ ID NO: 1629753 - RNA, 21 nt, Homo sapiens
ugcucagaauugcacaucuaa

SEQ ID NO: 1629754 - RNA, 17 nt, Homo sapiens
ugcucauugaacuuuaa

SEQ ID NO: 1629755 - RNA, 21 nt, Homo sapiens
ugcucauuuuuucuucuccua

SEQ ID NO: 1629756 - RNA, 21 nt, Homo sapiens
ugcuccauggcugccaucuca

SEQ ID NO: 1629757 - RNA, 13 nt, Homo sapiens
ugcucucugucag

SEQ ID NO: 1629758 - RNA, 14 nt, Homo sapiens
ugcucuugccauag

SEQ ID NO: 1629759 - RNA, 18 nt, Homo sapiens
ugcucuuucaucucugcu

SEQ ID NO: 1629760 - RNA, 19 nt, Homo sapiens
ugcugcaaaggagaagcac

SEQ ID NO: 1629761 - RNA, 20 nt, Homo sapiens
ugcugcccagugcaaaccac

SEQ ID NO: 1629762 - RNA, 14 nt, Homo sapiens
ugcugcuucuccau

SEQ ID NO: 1629763 - RNA, 15 nt, Homo sapiens
ugcugcuugucaaau

SEQ ID NO: 1629764 - RNA, 19 nt, Homo sapiens
ugcuggaauuacaggcgug

SEQ ID NO: 1629765 - RNA, 21 nt, Homo sapiens
ugcuggagaucagcaugccug

SEQ ID NO: 1629766 - RNA, 19 nt, Homo sapiens
ugcuggcucccagggccau

SEQ ID NO: 1629767 - RNA, 19 nt, Homo sapiens
ugcugggugccuccuugcc

SEQ ID NO: 1629768 - RNA, 22 nt, Homo sapiens
ugcugucccaaacaugcacuuc

SEQ ID NO: 1629769 - RNA, 20 nt, Homo sapiens
ugcuguccuguuucugucaa

SEQ ID NO: 1629770 - RNA, 17 nt, Homo sapiens
ugcugugccccaccacg

SEQ ID NO: 1629771 - RNA, 22 nt, Homo sapiens
ugcuguuuuuguucuacucuag

SEQ ID NO: 1629772 - RNA, 19 nt, Homo sapiens
ugcuuaagguaugguacaa

SEQ ID NO: 1629773 - RNA, 19 nt, Homo sapiens
ugcuuccaccucaccccac

SEQ ID NO: 1629774 - RNA, 18 nt, Homo sapiens
ugcuucccagguucaagc

SEQ ID NO: 1629775 - RNA, 11 nt, Homo sapiens
ugcuugcuccc

SEQ ID NO: 1629776 - RNA, 23 nt, Homo sapiens
ugcuuuccuuuuuuaaaaaugca

SEQ ID NO: 1629777 - RNA, 16 nt, Homo sapiens
ugcuuuucccauugcc

SEQ ID NO: 1629778 - RNA, 18 nt, Homo sapiens
ugcuuuuccucugccuuc

SEQ ID NO: 1629779 - RNA, 17 nt, Homo sapiens
ugcuuuugaaaucugua

SEQ ID NO: 1629780 - RNA, 18 nt, Homo sapiens
ugcuuuugaggaacauua

SEQ ID NO: 1629781 - RNA, 17 nt, Homo sapiens
aauaaacaacauugucu

SEQ ID NO: 1629782 - RNA, 18 nt, Homo sapiens
aauaaacauuuguagcau

SEQ ID NO: 1629783 - RNA, 11 nt, Homo sapiens
aauaaagcaau

SEQ ID NO: 1629784 - RNA, 20 nt, Homo sapiens
aauaaaguuguugcauuccc

SEQ ID NO: 1629785 - RNA, 14 nt, Homo sapiens
aauaaauaucugua

SEQ ID NO: 1629786 - RNA, 22 nt, Homo sapiens
aauaaauguugcaaugcaugau

SEQ ID NO: 1629787 - RNA, 16 nt, Homo sapiens
aauaacaaacuaguca

SEQ ID NO: 1629788 - RNA, 12 nt, Homo sapiens
aauaacagagag

SEQ ID NO: 1629789 - RNA, 19 nt, Homo sapiens
aauaacagccauagugugu

SEQ ID NO: 1629790 - RNA, 19 nt, Homo sapiens
aauaacauuuaaauuccac

SEQ ID NO: 1629791 - RNA, 14 nt, Homo sapiens
aauaaccugcacag

SEQ ID NO: 1629792 - RNA, 23 nt, Homo sapiens
aauacaagaguggagagaagcuc

SEQ ID NO: 1629793 - RNA, 21 nt, Homo sapiens
aauacaaucagcccagugcaa

SEQ ID NO: 1629794 - RNA, 23 nt, Homo sapiens
aauacuacccauagaaaacuuga

SEQ ID NO: 1629795 - RNA, 14 nt, Homo sapiens
aauacuaguauuaa

SEQ ID NO: 1629796 - RNA, 20 nt, Homo sapiens
aauacuuauuuucagugcau

SEQ ID NO: 1629797 - RNA, 20 nt, Homo sapiens
aauacuugcaugaaugauuu

SEQ ID NO: 1629798 - RNA, 19 nt, Homo sapiens
aauagaccuaacugaauac

SEQ ID NO: 1629799 - RNA, 13 nt, Homo sapiens
aauagaguacuua

SEQ ID NO: 1629800 - RNA, 16 nt, Homo sapiens
aauagcuaagcaucuc

SEQ ID NO: 1629801 - RNA, 21 nt, Homo sapiens
aauagcuuucaaaagaaauuu

SEQ ID NO: 1629802 - RNA, 18 nt, Homo sapiens
aauaggaagauaugccac

SEQ ID NO: 1629803 - RNA, 18 nt, Homo sapiens
aauaggcaccauugcuua

SEQ ID NO: 1629804 - RNA, 19 nt, Homo sapiens
aauaguuagaucuacccug

SEQ ID NO: 1629805 - RNA, 16 nt, Homo sapiens
aauauaaaaugaguag

SEQ ID NO: 1629806 - RNA, 20 nt, Homo sapiens
aauauauauuaagugugcca

SEQ ID NO: 1629807 - RNA, 13 nt, Homo sapiens
aauauaucuggaa

SEQ ID NO: 1629808 - RNA, 18 nt, Homo sapiens
aauaugacagauaaccua

SEQ ID NO: 1629809 - RNA, 21 nt, Homo sapiens
aauauggggauagucuggguc

SEQ ID NO: 1629810 - RNA, 22 nt, Homo sapiens
aauauguaauuucaaaauacau

SEQ ID NO: 1629811 - RNA, 17 nt, Homo sapiens
aauauuaguuaauggau

SEQ ID NO: 1629812 - RNA, 18 nt, Homo sapiens
aauauuccuaugcugcaa

SEQ ID NO: 1629813 - RNA, 23 nt, Homo sapiens
aauauuuacuaacuaaauaccau

SEQ ID NO: 1629814 - RNA, 22 nt, Homo sapiens
aaaguagucucuccccuggcca

SEQ ID NO: 1629815 - RNA, 15 nt, Homo sapiens
aaaguauucuagugu

SEQ ID NO: 1629816 - RNA, 22 nt, Homo sapiens
aaagugcugggauuacaggcgu

SEQ ID NO: 1629817 - RNA, 16 nt, Homo sapiens
aaaguugagcgucauu

SEQ ID NO: 1629818 - RNA, 16 nt, Homo sapiens
aaaguuuaaauaccag

SEQ ID NO: 1629819 - RNA, 20 nt, Homo sapiens
aaaguuuccuaggaugucau

SEQ ID NO: 1629820 - RNA, 17 nt, Homo sapiens
aaauaaaaaaagacaaa

SEQ ID NO: 1629821 - RNA, 16 nt, Homo sapiens
aaauaaaaaucucuuu

SEQ ID NO: 1629822 - RNA, 14 nt, Homo sapiens
aaauaaaacuuaaa

SEQ ID NO: 1629823 - RNA, 19 nt, Homo sapiens
aaauaaauucugacuuaug

SEQ ID NO: 1629824 - RNA, 17 nt, Homo sapiens
aaauaagaucagacucu

SEQ ID NO: 1629825 - RNA, 16 nt, Homo sapiens
aaauacaaucagccca

SEQ ID NO: 1629826 - RNA, 19 nt, Homo sapiens
aaauacuucuuuuucauua

SEQ ID NO: 1629827 - RNA, 15 nt, Homo sapiens
aaauagccacuauua

SEQ ID NO: 1629828 - RNA, 19 nt, Homo sapiens
aaauauauaucacucuaga

SEQ ID NO: 1629829 - RNA, 19 nt, Homo sapiens
aaauauuuacucuuugcaa

SEQ ID NO: 1629830 - RNA, 13 nt, Homo sapiens
aaauccacccaua

SEQ ID NO: 1629831 - RNA, 13 nt, Homo sapiens
aaauccucaggug

SEQ ID NO: 1629832 - RNA, 15 nt, Homo sapiens
aaaucuaccacugua

SEQ ID NO: 1629833 - RNA, 16 nt, Homo sapiens
aaaucuaccacuguau

SEQ ID NO: 1629834 - RNA, 14 nt, Homo sapiens
aaaucucacucuag

SEQ ID NO: 1629835 - RNA, 19 nt, Homo sapiens
aaaucuuuuaaaaauucaa

SEQ ID NO: 1629836 - RNA, 20 nt, Homo sapiens
aaaugacucuggggagguga

SEQ ID NO: 1629837 - RNA, 15 nt, Homo sapiens
aaaugagaaugacag

SEQ ID NO: 1629838 - RNA, 15 nt, Homo sapiens
aaaugagccaugaga

SEQ ID NO: 1629839 - RNA, 13 nt, Homo sapiens
aaaugaguagaca

SEQ ID NO: 1629840 - RNA, 23 nt, Homo sapiens
aaaugcagauauugcgccugugu

SEQ ID NO: 1629841 - RNA, 16 nt, Homo sapiens
aaaugcugguuuuuca

SEQ ID NO: 1629842 - RNA, 15 nt, Homo sapiens
aaauguacacuuuuu

SEQ ID NO: 1629843 - RNA, 14 nt, Homo sapiens
aaauguccucuuga

SEQ ID NO: 1629844 - RNA, 20 nt, Homo sapiens
aaauguccucuugaagcaua

SEQ ID NO: 1629845 - RNA, 21 nt, Homo sapiens
agacccaguggacucuuccac

SEQ ID NO: 1629846 - RNA, 22 nt, Homo sapiens
agacccuuauugcuguccugga

SEQ ID NO: 1629847 - RNA, 14 nt, Homo sapiens
agacccuuucccca

SEQ ID NO: 1629848 - RNA, 21 nt, Homo sapiens
agaccuccagcccugggacag

SEQ ID NO: 1629849 - RNA, 16 nt, Homo sapiens
agaccucugugcacuu

SEQ ID NO: 1629850 - RNA, 21 nt, Homo sapiens
agacgggaauucaugcaaaug

SEQ ID NO: 1629851 - RNA, 23 nt, Homo sapiens
agacgggcaaaauaaagugacag

SEQ ID NO: 1629852 - RNA, 17 nt, Homo sapiens
agacgguguuuugccau

SEQ ID NO: 1629853 - RNA, 21 nt, Homo sapiens
agacgugauuuugcuguagaa

SEQ ID NO: 1629854 - RNA, 18 nt, Homo sapiens
agacguuaggcauuuccu

SEQ ID NO: 1629855 - RNA, 13 nt, Homo sapiens
agacuagcaggcu

SEQ ID NO: 1629856 - RNA, 14 nt, Homo sapiens
agacucccuugcuu

SEQ ID NO: 1629857 - RNA, 20 nt, Homo sapiens
agacucucgcaucuucccaa

SEQ ID NO: 1629858 - RNA, 23 nt, Homo sapiens
agacugcuagcuuucuccuuacc

SEQ ID NO: 1629859 - RNA, 22 nt, Homo sapiens
agacugggcccaugaacacaga

SEQ ID NO: 1629860 - RNA, 17 nt, Homo sapiens
agacugguuuucugcca

SEQ ID NO: 1629861 - RNA, 16 nt, Homo sapiens
agacuguagcuucucu

SEQ ID NO: 1629862 - RNA, 21 nt, Homo sapiens
agacuuaaaaaauacuugcau

SEQ ID NO: 1629863 - RNA, 14 nt, Homo sapiens
agacuugugugaug

SEQ ID NO: 1629864 - RNA, 14 nt, Homo sapiens
agacuuugggauag

SEQ ID NO: 1629865 - RNA, 17 nt, Homo sapiens
agacuuugugacuguca

SEQ ID NO: 1629866 - RNA, 15 nt, Homo sapiens
agagaauccaaacuc

SEQ ID NO: 1629867 - RNA, 21 nt, Homo sapiens
agagacagcuugaucaaaggc

SEQ ID NO: 1629868 - RNA, 21 nt, Homo sapiens
agagacaggguuucacugugu

SEQ ID NO: 1629869 - RNA, 17 nt, Homo sapiens
agagaccacacauuuua

SEQ ID NO: 1629870 - RNA, 21 nt, Homo sapiens
agagacgggguuucuccaugu

SEQ ID NO: 1629871 - RNA, 16 nt, Homo sapiens
agagaggccuuguccc

SEQ ID NO: 1629872 - RNA, 20 nt, Homo sapiens
agagaucagcgacccugagg

SEQ ID NO: 1629873 - RNA, 19 nt, Homo sapiens
agagaucgacagacagcca

SEQ ID NO: 1629874 - RNA, 14 nt, Homo sapiens
agagcaucaugccu

SEQ ID NO: 1629875 - RNA, 22 nt, Homo sapiens
agagccaccaaagucacaucca

SEQ ID NO: 1629876 - RNA, 12 nt, Homo sapiens
agagccuggaag

SEQ ID NO: 1629877 - RNA, 13 nt, Homo sapiens
agagccuugacaa

SEQ ID NO: 1629878 - RNA, 22 nt, Homo sapiens
agagcgaucucggcucacugca

SEQ ID NO: 1629879 - RNA, 21 nt, Homo sapiens
agggaggugaauacucuugaa

SEQ ID NO: 1629880 - RNA, 18 nt, Homo sapiens
agggagugcacauaucca

SEQ ID NO: 1629881 - RNA, 17 nt, Homo sapiens
agggagugcuggcucac

SEQ ID NO: 1629882 - RNA, 16 nt, Homo sapiens
agggaugucuguugaa

SEQ ID NO: 1629883 - RNA, 11 nt, Homo sapiens
agggcacauua

SEQ ID NO: 1629884 - RNA, 17 nt, Homo sapiens
agggcacuuaauuugua

SEQ ID NO: 1629885 - RNA, 15 nt, Homo sapiens
agggcagugcccuuu

SEQ ID NO: 1629886 - RNA, 16 nt, Homo sapiens
agggcauaucggcuca

SEQ ID NO: 1629887 - RNA, 14 nt, Homo sapiens
agggcaucaucuau

SEQ ID NO: 1629888 - RNA, 19 nt, Homo sapiens
agggccaguugguguuccu

SEQ ID NO: 1629889 - RNA, 23 nt, Homo sapiens
agggcccucccagcccauugcug

SEQ ID NO: 1629890 - RNA, 14 nt, Homo sapiens
agggcugcccugag

SEQ ID NO: 1629891 - RNA, 14 nt, Homo sapiens
aggggacauuccag

SEQ ID NO: 1629892 - RNA, 19 nt, Homo sapiens
aggggagucaccagccaga

SEQ ID NO: 1629893 - RNA, 16 nt, Homo sapiens
aggggauccagccacu

SEQ ID NO: 1629894 - RNA, 17 nt, Homo sapiens
aggggaucccaccccau

SEQ ID NO: 1629895 - RNA, 20 nt, Homo sapiens
aggggccagaagaugaacag

SEQ ID NO: 1629896 - RNA, 22 nt, Homo sapiens
aggggcgacaguagugagcgcc

SEQ ID NO: 1629897 - RNA, 16 nt, Homo sapiens
aggggcugacucucca

SEQ ID NO: 1629898 - RNA, 19 nt, Homo sapiens
agggguggaguuuuguaua

SEQ ID NO: 1629899 - RNA, 19 nt, Homo sapiens
agggucacaguaccuugaa

SEQ ID NO: 1629900 - RNA, 14 nt, Homo sapiens
agggucaucugccc

SEQ ID NO: 1629901 - RNA, 17 nt, Homo sapiens
aggguggucuugaucuc

SEQ ID NO: 1629902 - RNA, 18 nt, Homo sapiens
aggguuacugacguguaa

SEQ ID NO: 1629903 - RNA, 18 nt, Homo sapiens
agguagcuauaguugcag

SEQ ID NO: 1629904 - RNA, 16 nt, Homo sapiens
agguauggcucugcac

SEQ ID NO: 1629905 - RNA, 16 nt, Homo sapiens
aggucaaggcugcagu

SEQ ID NO: 1629906 - RNA, 19 nt, Homo sapiens
aggucaccaagcaguggcc

SEQ ID NO: 1629907 - RNA, 12 nt, Homo sapiens
aggucaccagcu

SEQ ID NO: 1629908 - RNA, 22 nt, Homo sapiens
agguccacggucuguucuugaa

SEQ ID NO: 1629909 - RNA, 14 nt, Homo sapiens
aggucccagcccug

SEQ ID NO: 1629910 - RNA, 14 nt, Homo sapiens
agguccuuuggaca

SEQ ID NO: 1629911 - RNA, 24 nt, Homo sapiens
aggucugacaguagcucuuagacu

SEQ ID NO: 1629912 - RNA, 14 nt, Homo sapiens
aggugacacuccag

SEQ ID NO: 1629913 - RNA, 18 nt, Homo sapiens
agguggaacaagcacaga

SEQ ID NO: 1629914 - RNA, 15 nt, Homo sapiens
aggugugacauguua

SEQ ID NO: 1629915 - RNA, 13 nt, Homo sapiens
aggugugccagaa

SEQ ID NO: 1629916 - RNA, 22 nt, Homo sapiens
aggugugugggccaccgugccu

SEQ ID NO: 1629917 - RNA, 13 nt, Homo sapiens
agguuaucugugc

SEQ ID NO: 1629918 - RNA, 15 nt, Homo sapiens
agguucaaaagcaau

SEQ ID NO: 1629919 - RNA, 19 nt, Homo sapiens
aguaaaacggauaccaagu

SEQ ID NO: 1629920 - RNA, 17 nt, Homo sapiens
aguaaaagcuacuaugu

SEQ ID NO: 1629921 - RNA, 21 nt, Homo sapiens
aguaaagguacgauuauacuu

SEQ ID NO: 1629922 - RNA, 17 nt, Homo sapiens
aguaaaguuagauuaaa

SEQ ID NO: 1629923 - RNA, 16 nt, Homo sapiens
aguaaauugcucuguu

SEQ ID NO: 1629924 - RNA, 19 nt, Homo sapiens
aguaacacacuuccagugu

SEQ ID NO: 1629925 - RNA, 20 nt, Homo sapiens
aguaagcccggauagacuua

SEQ ID NO: 1629926 - RNA, 21 nt, Homo sapiens
aguaauaucuuucaguuauua

SEQ ID NO: 1629927 - RNA, 18 nt, Homo sapiens
aguaaucuguguacaaag

SEQ ID NO: 1629928 - RNA, 23 nt, Homo sapiens
aguaauuggucaugugaugcaag

SEQ ID NO: 1629929 - RNA, 11 nt, Homo sapiens
aguaauuuugc

SEQ ID NO: 1629930 - RNA, 24 nt, Homo sapiens
aguaccaguauaagcaucugccau

SEQ ID NO: 1629931 - RNA, 12 nt, Homo sapiens
aguacuaaucau

SEQ ID NO: 1629932 - RNA, 18 nt, Homo sapiens
aguacuaugucaaagcaa

SEQ ID NO: 1629933 - RNA, 15 nt, Homo sapiens
aguagagcauaccac

SEQ ID NO: 1629934 - RNA, 17 nt, Homo sapiens
aguagagggcacugggu

SEQ ID NO: 1629935 - RNA, 12 nt, Homo sapiens
aguagauaagga

SEQ ID NO: 1629936 - RNA, 19 nt, Homo sapiens
aguagauuuuaaagacaaa

SEQ ID NO: 1629937 - RNA, 19 nt, Homo sapiens
aguagcucaaaaauacucu

SEQ ID NO: 1629938 - RNA, 21 nt, Homo sapiens
aguagcugggauuacaggugu

SEQ ID NO: 1629939 - RNA, 18 nt, Homo sapiens
aguauaagcaucugccau

SEQ ID NO: 1629940 - RNA, 21 nt, Homo sapiens
aguaucaugcccugugcaacc

SEQ ID NO: 1629941 - RNA, 18 nt, Homo sapiens
aguaugccacugcacucc

SEQ ID NO: 1629942 - RNA, 18 nt, Homo sapiens
aguauggcuccuccauau

SEQ ID NO: 1629943 - RNA, 16 nt, Homo sapiens
aguaugguguguucac

SEQ ID NO: 1629944 - RNA, 23 nt, Homo sapiens
aguauuccaugguguauaugugc

SEQ ID NO: 1629945 - RNA, 22 nt, Homo sapiens
agucaagugaggugacacucca

SEQ ID NO: 1629946 - RNA, 20 nt, Homo sapiens
agucaauucugugugguaua

SEQ ID NO: 1629947 - RNA, 13 nt, Homo sapiens
agucacagccacc

SEQ ID NO: 1629948 - RNA, 22 nt, Homo sapiens
agucacauggccuaugcacaua

SEQ ID NO: 1629949 - RNA, 17 nt, Homo sapiens
agucacugacaguuaau

SEQ ID NO: 1629950 - RNA, 21 nt, Homo sapiens
agucacuuugccagagccuga

SEQ ID NO: 1629951 - RNA, 21 nt, Homo sapiens
agucagacuccuagacucacu

SEQ ID NO: 1629952 - RNA, 13 nt, Homo sapiens
agucaguguuaaa

SEQ ID NO: 1629953 - RNA, 17 nt, Homo sapiens
agucaucaucagggccu

SEQ ID NO: 1629954 - RNA, 23 nt, Homo sapiens
agucauucagcagcaaauuuuca

SEQ ID NO: 1629955 - RNA, 17 nt, Homo sapiens
aguccacacuuugucca

SEQ ID NO: 1629956 - RNA, 15 nt, Homo sapiens
agucccuuugugacu

SEQ ID NO: 1629957 - RNA, 13 nt, Homo sapiens
agucgaugaacua

SEQ ID NO: 1629958 - RNA, 19 nt, Homo sapiens
auauaguaacacacuucca

SEQ ID NO: 1629959 - RNA, 20 nt, Homo sapiens
auauauguguauacauacau

SEQ ID NO: 1629960 - RNA, 12 nt, Homo sapiens
auaucaucauag

SEQ ID NO: 1629961 - RNA, 14 nt, Homo sapiens
auaucaugcaaaau

SEQ ID NO: 1629962 - RNA, 12 nt, Homo sapiens
auaucauuuuaa

SEQ ID NO: 1629963 - RNA, 17 nt, Homo sapiens
auaucauuuuauucaca

SEQ ID NO: 1629964 - RNA, 18 nt, Homo sapiens
auauccaggcaccaggac

SEQ ID NO: 1629965 - RNA, 23 nt, Homo sapiens
auaugaucuguuuuguaucuuaa

SEQ ID NO: 1629966 - RNA, 18 nt, Homo sapiens
auaugcaccuugugucug

SEQ ID NO: 1629967 - RNA, 21 nt, Homo sapiens
auauguauuauaggaggagcu

SEQ ID NO: 1629968 - RNA, 19 nt, Homo sapiens
auauuaacaacaauaacac

SEQ ID NO: 1629969 - RNA, 13 nt, Homo sapiens
auauuccuaugcu

SEQ ID NO: 1629970 - RNA, 22 nt, Homo sapiens
auauugucaccucagcacugug

SEQ ID NO: 1629971 - RNA, 19 nt, Homo sapiens
auauuuagcuguaaacuga

SEQ ID NO: 1629972 - RNA, 18 nt, Homo sapiens
auauuuauuuuuugccau

SEQ ID NO: 1629973 - RNA, 19 nt, Homo sapiens
auauuucaagcucauguca

SEQ ID NO: 1629974 - RNA, 18 nt, Homo sapiens
aucaaagacucauugcuu

SEQ ID NO: 1629975 - RNA, 16 nt, Homo sapiens
aucaaaggcacacagc

SEQ ID NO: 1629976 - RNA, 22 nt, Homo sapiens
aucaaauugugcaguacuuugu

SEQ ID NO: 1629977 - RNA, 23 nt, Homo sapiens
aucaagaacaugucagcaauguc

SEQ ID NO: 1629978 - RNA, 18 nt, Homo sapiens
aucaagauauauguguau

SEQ ID NO: 1629979 - RNA, 14 nt, Homo sapiens
aucaagcugugaga

SEQ ID NO: 1629980 - RNA, 15 nt, Homo sapiens
aucaagcugugagac

SEQ ID NO: 1629981 - RNA, 22 nt, Homo sapiens
aucaaggaguacaaugcccaga

SEQ ID NO: 1629982 - RNA, 15 nt, Homo sapiens
aucaauaaauguugc

SEQ ID NO: 1629983 - RNA, 17 nt, Homo sapiens
aucaauaaauguugcaa

SEQ ID NO: 1629984 - RNA, 20 nt, Homo sapiens
aucaauaaauguugcaaugc

SEQ ID NO: 1629985 - RNA, 16 nt, Homo sapiens
aucaaucugcaguuua

SEQ ID NO: 1629986 - RNA, 18 nt, Homo sapiens
aucacaaauuucacuuau

SEQ ID NO: 1629987 - RNA, 12 nt, Homo sapiens
aucacacugcgg

SEQ ID NO: 1629988 - RNA, 23 nt, Homo sapiens
aucaccuacucacacaggcauuu

SEQ ID NO: 1629989 - RNA, 16 nt, Homo sapiens
aucacgccacuggacu

SEQ ID NO: 1629990 - RNA, 15 nt, Homo sapiens
aucacuaaugcucaa

SEQ ID NO: 1629991 - RNA, 19 nt, Homo sapiens
aucacugcauuauucucuu

SEQ ID NO: 1629992 - RNA, 17 nt, Homo sapiens
aucacuguaaugaguca

SEQ ID NO: 1629993 - RNA, 15 nt, Homo sapiens
aucacuucauucaca

SEQ ID NO: 1629994 - RNA, 19 nt, Homo sapiens
aucacuuuucagaagacuu

SEQ ID NO: 1629995 - RNA, 16 nt, Homo sapiens
aucagagauguacaug

SEQ ID NO: 1629996 - RNA, 15 nt, Homo sapiens
aucagcaucacccgg

SEQ ID NO: 1629997 - RNA, 15 nt, Homo sapiens
aucaggccccacccc

SEQ ID NO: 1629998 - RNA, 17 nt, Homo sapiens
aucagggccugagugac

SEQ ID NO: 1629999 - RNA, 18 nt, Homo sapiens
aucaguaaucacuuuuca

SEQ ID NO: 1630000 - RNA, 19 nt, Homo sapiens
aucaguucuguguggugca

SEQ ID NO: 1630001 - RNA, 13 nt, Homo sapiens
aucauccaagaca

SEQ ID NO: 1630002 - RNA, 22 nt, Homo sapiens
aucauccugcagacagacaaua

SEQ ID NO: 1630003 - RNA, 20 nt, Homo sapiens
aucaugauccuuguguucag

SEQ ID NO: 1630004 - RNA, 18 nt, Homo sapiens
aucaugcccugugcaacc

SEQ ID NO: 1630005 - RNA, 13 nt, Homo sapiens
aucaugucuguau

SEQ ID NO: 1630006 - RNA, 13 nt, Homo sapiens
aucauuccauuuu

SEQ ID NO: 1630007 - RNA, 18 nt, Homo sapiens
aucauugccaucaccauu

SEQ ID NO: 1630008 - RNA, 16 nt, Homo sapiens
aucauugucagccuug

SEQ ID NO: 1630009 - RNA, 18 nt, Homo sapiens
aucauuuauaauacuguu

SEQ ID NO: 1630010 - RNA, 21 nt, Homo sapiens
aucauuuguuuacauuugaug

SEQ ID NO: 1630011 - RNA, 23 nt, Homo sapiens
aucauuuuuguaggaagcauuuu

SEQ ID NO: 1630012 - RNA, 17 nt, Homo sapiens
auccaaggaaacaugca

SEQ ID NO: 1630013 - RNA, 18 nt, Homo sapiens
auccagaugugugcaaug

SEQ ID NO: 1630014 - RNA, 17 nt, Homo sapiens
auccagcagcagcacuu

SEQ ID NO: 1630015 - RNA, 14 nt, Homo sapiens
auccagcuaugaau

SEQ ID NO: 1630016 - RNA, 19 nt, Homo sapiens
auccaugcaccuaccuuag

SEQ ID NO: 1630017 - RNA, 23 nt, Homo sapiens
auccaugugauuaauguuuucau

SEQ ID NO: 1630018 - RNA, 17 nt, Homo sapiens
aucccacccacauguga

SEQ ID NO: 1630019 - RNA, 21 nt, Homo sapiens
aucccauuuuuaaagaauuag

SEQ ID NO: 1630020 - RNA, 24 nt, Homo sapiens
aucccucucacaagaaugugcaga

SEQ ID NO: 1630021 - RNA, 12 nt, Homo sapiens
aucccugccucu

SEQ ID NO: 1630022 - RNA, 14 nt, Homo sapiens
auccuaugugauuu

SEQ ID NO: 1630023 - RNA, 20 nt, Homo sapiens
auccugcagaaguacuccua

SEQ ID NO: 1630024 - RNA, 19 nt, Homo sapiens
auccugccuugcugugaaa

SEQ ID NO: 1630025 - RNA, 19 nt, Homo sapiens
auccuggggcagcacuccc

SEQ ID NO: 1630026 - RNA, 18 nt, Homo sapiens
auccuuaacacauucaau

SEQ ID NO: 1630027 - RNA, 19 nt, Homo sapiens
auccuuaacacauucaaua

SEQ ID NO: 1630028 - RNA, 20 nt, Homo sapiens
auccuuccuuuugagggagc

SEQ ID NO: 1630029 - RNA, 22 nt, Homo sapiens
auccuucuuucuaguucagcug

SEQ ID NO: 1630030 - RNA, 14 nt, Homo sapiens
auccuugacuuuga

SEQ ID NO: 1630031 - RNA, 21 nt, Homo sapiens
auccuuguugacacggccaug

SEQ ID NO: 1630032 - RNA, 22 nt, Homo sapiens
aucgauggaugggaugcacucu

SEQ ID NO: 1630033 - RNA, 15 nt, Homo sapiens
aucuacaguaaugaa

SEQ ID NO: 1630034 - RNA, 14 nt, Homo sapiens
aucuaccacuguau

SEQ ID NO: 1630035 - RNA, 17 nt, Homo sapiens
aucuagcacacucuucu

SEQ ID NO: 1630036 - RNA, 22 nt, Homo sapiens
aucuauauguacuugucaaaga

SEQ ID NO: 1630037 - RNA, 14 nt, Homo sapiens
aucuaucacugcau

SEQ ID NO: 1630038 - RNA, 19 nt, Homo sapiens
aucuaugagcugacaucuc

SEQ ID NO: 1630039 - RNA, 14 nt, Homo sapiens
aucucaccuccugc

SEQ ID NO: 1630040 - RNA, 15 nt, Homo sapiens
aucucccagcaagac

SEQ ID NO: 1630041 - RNA, 15 nt, Homo sapiens
aguggcgugaucucg

SEQ ID NO: 1630042 - RNA, 19 nt, Homo sapiens
agugggaaauauuuagcaa

SEQ ID NO: 1630043 - RNA, 20 nt, Homo sapiens
agugggagcugagcuggaag

SEQ ID NO: 1630044 - RNA, 17 nt, Homo sapiens
agugguccccagaggug

SEQ ID NO: 1630045 - RNA, 22 nt, Homo sapiens
aguguaccgcgucuacccuggg

SEQ ID NO: 1630046 - RNA, 19 nt, Homo sapiens
aguguaguggcaugaucuc

SEQ ID NO: 1630047 - RNA, 23 nt, Homo sapiens
agugucaccccucacugugacug

SEQ ID NO: 1630048 - RNA, 16 nt, Homo sapiens
agugucugucauuuca

SEQ ID NO: 1630049 - RNA, 22 nt, Homo sapiens
agugugacagggccaguggggc

SEQ ID NO: 1630050 - RNA, 21 nt, Homo sapiens
aguguguguuuguguguuuca

SEQ ID NO: 1630051 - RNA, 20 nt, Homo sapiens
aguguuaauuuuaccuuguu

SEQ ID NO: 1630052 - RNA, 18 nt, Homo sapiens
aguuaaagccacagaugg

SEQ ID NO: 1630053 - RNA, 15 nt, Homo sapiens
aguuacaaccugaag

SEQ ID NO: 1630054 - RNA, 23 nt, Homo sapiens
aguuauaaaguccuuggacuguu

SEQ ID NO: 1630055 - RNA, 20 nt, Homo sapiens
aguucaaacccuguauccaa

SEQ ID NO: 1630056 - RNA, 12 nt, Homo sapiens
aguucaaauacu

SEQ ID NO: 1630057 - RNA, 17 nt, Homo sapiens
aguucaauacagugaag

SEQ ID NO: 1630058 - RNA, 23 nt, Homo sapiens
aguucagcugccccacaggugug

SEQ ID NO: 1630059 - RNA, 14 nt, Homo sapiens
aguucaucaccauu

SEQ ID NO: 1630060 - RNA, 14 nt, Homo sapiens
aguucccucuugcu

SEQ ID NO: 1630061 - RNA, 15 nt, Homo sapiens
aguucugaacauuuu

SEQ ID NO: 1630062 - RNA, 15 nt, Homo sapiens
aguucugcaaaauac

SEQ ID NO: 1630063 - RNA, 15 nt, Homo sapiens
aguucuugugccaua

SEQ ID NO: 1630064 - RNA, 18 nt, Homo sapiens
aguugagagcaccuugca

SEQ ID NO: 1630065 - RNA, 21 nt, Homo sapiens
aguugcccaccaaaacacaga

SEQ ID NO: 1630066 - RNA, 17 nt, Homo sapiens
aguugguucacuucaaa

SEQ ID NO: 1630067 - RNA, 14 nt, Homo sapiens
aguugucaguauua

SEQ ID NO: 1630068 - RNA, 13 nt, Homo sapiens
aguuguguugaca

SEQ ID NO: 1630069 - RNA, 14 nt, Homo sapiens
aguuguugcauucc

SEQ ID NO: 1630070 - RNA, 20 nt, Homo sapiens
aguuuaaaacagaagccuga

SEQ ID NO: 1630071 - RNA, 19 nt, Homo sapiens
aguuuaccuauguaacaaa

SEQ ID NO: 1630072 - RNA, 15 nt, Homo sapiens
aguuucucaaaaccc

SEQ ID NO: 1630073 - RNA, 23 nt, Homo sapiens
aguuucuugcuuggaagccaggu

SEQ ID NO: 1630074 - RNA, 14 nt, Homo sapiens
aguuugaucuguca

SEQ ID NO: 1630075 - RNA, 22 nt, Homo sapiens
aguuugauuuguuaauccuuuc

SEQ ID NO: 1630076 - RNA, 23 nt, Homo sapiens
aguuugcuuuuugcguacacaga

SEQ ID NO: 1630077 - RNA, 17 nt, Homo sapiens
aguuuuacuaaaacacu

SEQ ID NO: 1630078 - RNA, 21 nt, Homo sapiens
aguuuuuuauuaugcauuaua

SEQ ID NO: 1630079 - RNA, 14 nt, Homo sapiens
auaaaaaaagacaa

SEQ ID NO: 1630080 - RNA, 17 nt, Homo sapiens
auaaaaaacauauacaa

SEQ ID NO: 1630081 - RNA, 20 nt, Homo sapiens
auaaaagcuauggugagaug

SEQ ID NO: 1630082 - RNA, 15 nt, Homo sapiens
auaaaaggaagccaa

SEQ ID NO: 1630083 - RNA, 14 nt, Homo sapiens
auaaaauguuucau

SEQ ID NO: 1630084 - RNA, 20 nt, Homo sapiens
auaaaauguuucauuaugca

SEQ ID NO: 1630085 - RNA, 16 nt, Homo sapiens
auaaacagauaaugcu

SEQ ID NO: 1630086 - RNA, 21 nt, Homo sapiens
auaaaccaguugaaucauuga

SEQ ID NO: 1630087 - RNA, 20 nt, Homo sapiens
auaaacugugccaauacaga

SEQ ID NO: 1630088 - RNA, 17 nt, Homo sapiens
auaaagacuugugcauc

SEQ ID NO: 1630089 - RNA, 20 nt, Homo sapiens
auaaagaucauuuauaauac

SEQ ID NO: 1630090 - RNA, 11 nt, Homo sapiens
auaaagcuuua

SEQ ID NO: 1630091 - RNA, 19 nt, Homo sapiens
auaaaggaucagagauucu

SEQ ID NO: 1630092 - RNA, 23 nt, Homo sapiens
auaaagggugucuaucauaugaa

SEQ ID NO: 1630093 - RNA, 18 nt, Homo sapiens
auaaaguaaugaucucaa

SEQ ID NO: 1630094 - RNA, 18 nt, Homo sapiens
auaaaguuguugcauucc

SEQ ID NO: 1630095 - RNA, 13 nt, Homo sapiens
auaaaugacuguu

SEQ ID NO: 1630096 - RNA, 16 nt, Homo sapiens
auaaauguugcaaugc

SEQ ID NO: 1630097 - RNA, 19 nt, Homo sapiens
auaacacuugcccaugcua

SEQ ID NO: 1630098 - RNA, 23 nt, Homo sapiens
auaacauuuaaauuccacagauu

SEQ ID NO: 1630099 - RNA, 15 nt, Homo sapiens
auaacauuuacuuuu

SEQ ID NO: 1630100 - RNA, 22 nt, Homo sapiens
auaacugcccagcggacagugg

SEQ ID NO: 1630101 - RNA, 20 nt, Homo sapiens
auaacuuaaauauugcucua

SEQ ID NO: 1630102 - RNA, 15 nt, Homo sapiens
auaagaucagacucu

SEQ ID NO: 1630103 - RNA, 14 nt, Homo sapiens
auaagaucuguuuu

SEQ ID NO: 1630104 - RNA, 18 nt, Homo sapiens
auaagcccaguucaucac

SEQ ID NO: 1630105 - RNA, 19 nt, Homo sapiens
auaauaaacaacauugucu

SEQ ID NO: 1630106 - RNA, 17 nt, Homo sapiens
auaauaaugccuagugg

SEQ ID NO: 1630107 - RNA, 23 nt, Homo sapiens
auaauaggggauuuuaaaacucu

SEQ ID NO: 1630108 - RNA, 21 nt, Homo sapiens
auaaucacucauucuaugaac

SEQ ID NO: 1630109 - RNA, 16 nt, Homo sapiens
auaaucccagcacuuu

SEQ ID NO: 1630110 - RNA, 16 nt, Homo sapiens
auaaucuguacaauga

SEQ ID NO: 1630111 - RNA, 16 nt, Homo sapiens
auaaugaaauaguuau

SEQ ID NO: 1630112 - RNA, 20 nt, Homo sapiens
auaaugguuuuuaacaccuu

SEQ ID NO: 1630113 - RNA, 20 nt, Homo sapiens
auaauucuggagauacuggu

SEQ ID NO: 1630114 - RNA, 13 nt, Homo sapiens
auaauuugaucuu

SEQ ID NO: 1630115 - RNA, 11 nt, Homo sapiens
auaauuuugca

SEQ ID NO: 1630116 - RNA, 18 nt, Homo sapiens
auaauuuuguugcuacau

SEQ ID NO: 1630117 - RNA, 18 nt, Homo sapiens
auacaccacaaaaaccaa

SEQ ID NO: 1630118 - RNA, 11 nt, Homo sapiens
auacaguauuu

SEQ ID NO: 1630119 - RNA, 20 nt, Homo sapiens
auacauagacugauugauua

SEQ ID NO: 1630120 - RNA, 22 nt, Homo sapiens
auacauuuuuuaggacaucuua

SEQ ID NO: 1630121 - RNA, 17 nt, Homo sapiens
auaccauucacuacuca

SEQ ID NO: 1630122 - RNA, 16 nt, Homo sapiens
cuuuagagaaugccac

SEQ ID NO: 1630123 - RNA, 23 nt, Homo sapiens
cuuuauaaaauauuuaaugugac

SEQ ID NO: 1630124 - RNA, 19 nt, Homo sapiens
cuuuauauuuauccacuac

SEQ ID NO: 1630125 - RNA, 15 nt, Homo sapiens
cuuuaugcaaauaca

SEQ ID NO: 1630126 - RNA, 22 nt, Homo sapiens
cuuuaugcaaauacaaucagcc

SEQ ID NO: 1630127 - RNA, 23 nt, Homo sapiens
gccagcccugccuggaggaccug

SEQ ID NO: 1630128 - RNA, 14 nt, Homo sapiens
gccaggcacuuuga

SEQ ID NO: 1630129 - RNA, 19 nt, Homo sapiens
gccagggucugugugaaug

SEQ ID NO: 1630130 - RNA, 14 nt, Homo sapiens
gccagguguggaac

SEQ ID NO: 1630131 - RNA, 15 nt, Homo sapiens
gccagguguggaaca

SEQ ID NO: 1630132 - RNA, 10 nt, Homo sapiens
gccagucuca

SEQ ID NO: 1630133 - RNA, 17 nt, Homo sapiens
gccagucucauugucac

SEQ ID NO: 1630134 - RNA, 21 nt, Homo sapiens
gccagucucauugucaccucu

SEQ ID NO: 1630135 - RNA, 21 nt, Homo sapiens
gccaguggggccuguggaaug

SEQ ID NO: 1630136 - RNA, 21 nt, Homo sapiens
gccauaccauucccauggagu

SEQ ID NO: 1630137 - RNA, 11 nt, Homo sapiens
gccauaugccu

SEQ ID NO: 1630138 - RNA, 14 nt, Homo sapiens
gccaucaacuacua

SEQ ID NO: 1630139 - RNA, 22 nt, Homo sapiens
gccaucauccucccgccaggag

SEQ ID NO: 1630140 - RNA, 16 nt, Homo sapiens
gccauccaauuucucu

SEQ ID NO: 1630141 - RNA, 17 nt, Homo sapiens
gccaugacaagaacaaa

SEQ ID NO: 1630142 - RNA, 16 nt, Homo sapiens
gccaugagaugauaca

SEQ ID NO: 1630143 - RNA, 22 nt, Homo sapiens
gccaugagaugauacauccaaa

SEQ ID NO: 1630144 - RNA, 15 nt, Homo sapiens
gccauguuuccucuu

SEQ ID NO: 1630145 - RNA, 13 nt, Homo sapiens
gccauuuguacug

SEQ ID NO: 1630146 - RNA, 23 nt, Homo sapiens
gcccagagugagcuuuagcucuc

SEQ ID NO: 1630147 - RNA, 21 nt, Homo sapiens
gcccaggaucguuuuuuccca

SEQ ID NO: 1630148 - RNA, 14 nt, Homo sapiens
gcccaggaucucuu

SEQ ID NO: 1630149 - RNA, 20 nt, Homo sapiens
gcccaggcuggagugcaaug

SEQ ID NO: 1630150 - RNA, 21 nt, Homo sapiens
gcccaggcuggagugcaaugg

SEQ ID NO: 1630151 - RNA, 20 nt, Homo sapiens
gcccaggcuggagugcagug

SEQ ID NO: 1630152 - RNA, 20 nt, Homo sapiens
gcccaggcuggaguguagug

SEQ ID NO: 1630153 - RNA, 15 nt, Homo sapiens
gcccauugcugccaa

SEQ ID NO: 1630154 - RNA, 22 nt, Homo sapiens
gcccauugucuuauuggcacau

SEQ ID NO: 1630155 - RNA, 18 nt, Homo sapiens
gcccccuugggugaccuc

SEQ ID NO: 1630156 - RNA, 14 nt, Homo sapiens
gccccgccacagcc

SEQ ID NO: 1630157 - RNA, 15 nt, Homo sapiens
gccccucacuuccag

SEQ ID NO: 1630158 - RNA, 16 nt, Homo sapiens
gccccugcccccagag

SEQ ID NO: 1630159 - RNA, 19 nt, Homo sapiens
gcccuaacuguacauuuca

SEQ ID NO: 1630160 - RNA, 13 nt, Homo sapiens
gcccucagacugu

SEQ ID NO: 1630161 - RNA, 23 nt, Homo sapiens
gcccucuggauccagccaugccu

SEQ ID NO: 1630162 - RNA, 16 nt, Homo sapiens
gcccuggggccuguac

SEQ ID NO: 1630163 - RNA, 13 nt, Homo sapiens
gcccugugcaacc

SEQ ID NO: 1630164 - RNA, 16 nt, Homo sapiens
gcccuguucagcuacu

SEQ ID NO: 1630165 - RNA, 22 nt, Homo sapiens
gcccuuacuugcuucucuagcu

SEQ ID NO: 1630166 - RNA, 21 nt, Homo sapiens
gccggggcucugggugcugcc

SEQ ID NO: 1630167 - RNA, 15 nt, Homo sapiens
gccuaauaguaacug

SEQ ID NO: 1630168 - RNA, 15 nt, Homo sapiens
gccuaucaaaggaaa

SEQ ID NO: 1630169 - RNA, 18 nt, Homo sapiens
gccuaucuggaagccacc

SEQ ID NO: 1630170 - RNA, 16 nt, Homo sapiens
gccuaugcacauaugg

SEQ ID NO: 1630171 - RNA, 16 nt, Homo sapiens
gccuauggagagcccu

SEQ ID NO: 1630172 - RNA, 13 nt, Homo sapiens
gccucacaucucc

SEQ ID NO: 1630173 - RNA, 19 nt, Homo sapiens
gccucacugaaacauggcu

SEQ ID NO: 1630174 - RNA, 21 nt, Homo sapiens
gccuccaucuuuuucuugggu

SEQ ID NO: 1630175 - RNA, 23 nt, Homo sapiens
gccuccaucuuuuucuuggguga

SEQ ID NO: 1630176 - RNA, 17 nt, Homo sapiens
gccucccaaagugcugg

SEQ ID NO: 1630177 - RNA, 16 nt, Homo sapiens
gccucccgaguagcug

SEQ ID NO: 1630178 - RNA, 15 nt, Homo sapiens
gccucgaaaaccauc

SEQ ID NO: 1630179 - RNA, 14 nt, Homo sapiens
gccucuuguucaug

SEQ ID NO: 1630180 - RNA, 13 nt, Homo sapiens
gccugaacacuca

SEQ ID NO: 1630181 - RNA, 22 nt, Homo sapiens
gccugagugaccuccuucugca

SEQ ID NO: 1630182 - RNA, 13 nt, Homo sapiens
gccugcugcugag

SEQ ID NO: 1630183 - RNA, 18 nt, Homo sapiens
gccugcugcugagaaccu

SEQ ID NO: 1630184 - RNA, 22 nt, Homo sapiens
gccugcuuggggggugaugagg

SEQ ID NO: 1630185 - RNA, 20 nt, Homo sapiens
gccuggagacaaggugcuaa

SEQ ID NO: 1630186 - RNA, 20 nt, Homo sapiens
gccuggccuccugccucuac

SEQ ID NO: 1630187 - RNA, 19 nt, Homo sapiens
gccugggggcuuuugccac

SEQ ID NO: 1630188 - RNA, 18 nt, Homo sapiens
gccugucuguuacacugg

SEQ ID NO: 1630189 - RNA, 13 nt, Homo sapiens
gccugugcaugua

SEQ ID NO: 1630190 - RNA, 12 nt, Homo sapiens
gccuguggaaug

SEQ ID NO: 1630191 - RNA, 21 nt, Homo sapiens
gccuguuuuguuggcucuuuc

SEQ ID NO: 1630192 - RNA, 19 nt, Homo sapiens
gccuuaaacacacauugca

SEQ ID NO: 1630193 - RNA, 16 nt, Homo sapiens
gccuuaaugcuucaua

SEQ ID NO: 1630194 - RNA, 15 nt, Homo sapiens
gccuucaguguaccg

SEQ ID NO: 1630195 - RNA, 21 nt, Homo sapiens
gccuucccaaguugugcuuga

SEQ ID NO: 1630196 - RNA, 18 nt, Homo sapiens
gccuucuuauugcuuuua

SEQ ID NO: 1630197 - RNA, 18 nt, Homo sapiens
gccuugaugccauaugcc

SEQ ID NO: 1630198 - RNA, 18 nt, Homo sapiens
gccuuguaagacccuuau

SEQ ID NO: 1630199 - RNA, 20 nt, Homo sapiens
gccuuuuuuccugggccaga

SEQ ID NO: 1630200 - RNA, 13 nt, Homo sapiens
gccuuuuuugcca

SEQ ID NO: 1630201 - RNA, 14 nt, Homo sapiens
gccuuuuuugccag

SEQ ID NO: 1630202 - RNA, 14 nt, Homo sapiens
gcgaacaucuucau

SEQ ID NO: 1630203 - RNA, 13 nt, Homo sapiens
gcgagacuccauc

SEQ ID NO: 1630204 - RNA, 23 nt, Homo sapiens
gcgagaggugagcuacuuuguga

SEQ ID NO: 1630205 - RNA, 21 nt, Homo sapiens
gcgccaggauggaacacggcc

SEQ ID NO: 1630206 - RNA, 20 nt, Homo sapiens
gcgcccagccaggcuccagu

SEQ ID NO: 1630207 - RNA, 22 nt, Homo sapiens
gcggaccccucgucaucaggug

SEQ ID NO: 1630208 - RNA, 22 nt, Homo sapiens
gcgggagccucccugccucagg

SEQ ID NO: 1630209 - RNA, 23 nt, Homo sapiens
gcgguaggucauucuuuugccac

SEQ ID NO: 1630210 - RNA, 12 nt, Homo sapiens
gcguccugguca

SEQ ID NO: 1630211 - RNA, 23 nt, Homo sapiens
gcgucucccucgcagagcccuuc

SEQ ID NO: 1630212 - RNA, 20 nt, Homo sapiens
gcgugcgcgcgcuucuggga

SEQ ID NO: 1630213 - RNA, 12 nt, Homo sapiens
gcuaaauuccac

SEQ ID NO: 1630214 - RNA, 20 nt, Homo sapiens
gcuaagaauaaacuccauuu

SEQ ID NO: 1630215 - RNA, 23 nt, Homo sapiens
gcuaaggaugguuuuaucuuccc

SEQ ID NO: 1630216 - RNA, 15 nt, Homo sapiens
gcuaagggugggugc

SEQ ID NO: 1630217 - RNA, 17 nt, Homo sapiens
gcuaagggugggugcuc

SEQ ID NO: 1630218 - RNA, 15 nt, Homo sapiens
gcuaauauacuugua

SEQ ID NO: 1630219 - RNA, 20 nt, Homo sapiens
gcuaaucagucauuucuuca

SEQ ID NO: 1630220 - RNA, 19 nt, Homo sapiens
gcuaaugaagaucauauac

SEQ ID NO: 1630221 - RNA, 21 nt, Homo sapiens
gcuaccuguucuugggccuca

SEQ ID NO: 1630222 - RNA, 14 nt, Homo sapiens
cucacaaaaucacu

SEQ ID NO: 1630223 - RNA, 15 nt, Homo sapiens
cucacaaacuugauu

SEQ ID NO: 1630224 - RNA, 14 nt, Homo sapiens
cucacaaagagaua

SEQ ID NO: 1630225 - RNA, 19 nt, Homo sapiens
cucacauaagcccaguuca

SEQ ID NO: 1630226 - RNA, 11 nt, Homo sapiens
cucacucccua

SEQ ID NO: 1630227 - RNA, 22 nt, Homo sapiens
cucacucugggcuguaacgugg

SEQ ID NO: 1630228 - RNA, 15 nt, Homo sapiens
cucacucuucaagga

SEQ ID NO: 1630229 - RNA, 19 nt, Homo sapiens
cucacuguguuacugcuuu

SEQ ID NO: 1630230 - RNA, 18 nt, Homo sapiens
cugaugccuguguacugc

SEQ ID NO: 1630231 - RNA, 23 nt, Homo sapiens
cugaugccuguguacugccuuaa

SEQ ID NO: 1630232 - RNA, 18 nt, Homo sapiens
cugauguaguaugcuuaa

SEQ ID NO: 1630233 - RNA, 20 nt, Homo sapiens
cugauuacuuguaauuauga

SEQ ID NO: 1630234 - RNA, 22 nt, Homo sapiens
cugauucacagucucauuuuga

SEQ ID NO: 1630235 - RNA, 20 nt, Homo sapiens
cugauucauaauaaauaucu

SEQ ID NO: 1630236 - RNA, 17 nt, Homo sapiens
cugauuuccuucugcua

SEQ ID NO: 1630237 - RNA, 15 nt, Homo sapiens
cugcaagauggacac

SEQ ID NO: 1630238 - RNA, 18 nt, Homo sapiens
cugcaaggggacauucca

SEQ ID NO: 1630239 - RNA, 22 nt, Homo sapiens
cugcaauacauuaaaauaacua

SEQ ID NO: 1630240 - RNA, 19 nt, Homo sapiens
cugcacaugucuuguacau

SEQ ID NO: 1630241 - RNA, 19 nt, Homo sapiens
cugcaccccucugcccuca

SEQ ID NO: 1630242 - RNA, 22 nt, Homo sapiens
cugcaccuuacaacucggggac

SEQ ID NO: 1630243 - RNA, 17 nt, Homo sapiens
cugcagaaguacuccua

SEQ ID NO: 1630244 - RNA, 16 nt, Homo sapiens
cugcagaauccagcua

SEQ ID NO: 1630245 - RNA, 23 nt, Homo sapiens
cugcagcauugccauaccauucc

SEQ ID NO: 1630246 - RNA, 18 nt, Homo sapiens
cugcauggucaagccucu

SEQ ID NO: 1630247 - RNA, 15 nt, Homo sapiens
cugcaugugcuguca

SEQ ID NO: 1630248 - RNA, 18 nt, Homo sapiens
cugccacauacaccacaa

SEQ ID NO: 1630249 - RNA, 21 nt, Homo sapiens
cugccaguugucuuaugugaa

SEQ ID NO: 1630250 - RNA, 20 nt, Homo sapiens
cugccauccuugacuuugaa

SEQ ID NO: 1630251 - RNA, 19 nt, Homo sapiens
cugcccaaggaugcuguca

SEQ ID NO: 1630252 - RNA, 19 nt, Homo sapiens
cugcccaggccuaucugga

SEQ ID NO: 1630253 - RNA, 14 nt, Homo sapiens
cugcccagugcaaa

SEQ ID NO: 1630254 - RNA, 16 nt, Homo sapiens
cugccccuacccugga

SEQ ID NO: 1630255 - RNA, 17 nt, Homo sapiens
cugcccgcagaccucug

SEQ ID NO: 1630256 - RNA, 16 nt, Homo sapiens
cugcccuaacuguaca

SEQ ID NO: 1630257 - RNA, 19 nt, Homo sapiens
cugcccucacaucuuccac

SEQ ID NO: 1630258 - RNA, 15 nt, Homo sapiens
cugcccucuauuuau

SEQ ID NO: 1630259 - RNA, 17 nt, Homo sapiens
cugccucagccucccaa

SEQ ID NO: 1630260 - RNA, 14 nt, Homo sapiens
cugccuuaaacaca

SEQ ID NO: 1630261 - RNA, 14 nt, Homo sapiens
cugccuugcuguga

SEQ ID NO: 1630262 - RNA, 15 nt, Homo sapiens
cugccuugcugugaa

SEQ ID NO: 1630263 - RNA, 19 nt, Homo sapiens
cugccuugcugugaaauuu

SEQ ID NO: 1630264 - RNA, 18 nt, Homo sapiens
cugcggaccccucgucau

SEQ ID NO: 1630265 - RNA, 18 nt, Homo sapiens
cugcgucauuacagggca

SEQ ID NO: 1630266 - RNA, 17 nt, Homo sapiens
cugcuaucccacuguau

SEQ ID NO: 1630267 - RNA, 18 nt, Homo sapiens
cugcucacaaaaucacuu

SEQ ID NO: 1630268 - RNA, 18 nt, Homo sapiens
cugcuccccuacuucuca

SEQ ID NO: 1630269 - RNA, 14 nt, Homo sapiens
cugcucuuccucag

SEQ ID NO: 1630270 - RNA, 18 nt, Homo sapiens
cugcugagacgccacgga

SEQ ID NO: 1630271 - RNA, 20 nt, Homo sapiens
cugcugcgucauuacagggc

SEQ ID NO: 1630272 - RNA, 13 nt, Homo sapiens
cugcuggugugag

SEQ ID NO: 1630273 - RNA, 18 nt, Homo sapiens
cugcuucuccaagcuuuc

SEQ ID NO: 1630274 - RNA, 17 nt, Homo sapiens
cugcuuugggaagccgu

SEQ ID NO: 1630275 - RNA, 17 nt, Homo sapiens
cuggaaaacagaaacca

SEQ ID NO: 1630276 - RNA, 22 nt, Homo sapiens
cuggaaaacagaaaccauucua

SEQ ID NO: 1630277 - RNA, 23 nt, Homo sapiens
cuggaaaacagaaaccauucuag

SEQ ID NO: 1630278 - RNA, 20 nt, Homo sapiens
cuggaaaggaggaaggagcc

SEQ ID NO: 1630279 - RNA, 18 nt, Homo sapiens
cuggaauagaaacagugg

SEQ ID NO: 1630280 - RNA, 21 nt, Homo sapiens
cuggacaaagaaauuccccaa

SEQ ID NO: 1630281 - RNA, 18 nt, Homo sapiens
cuggagcucaucugcaaa

SEQ ID NO: 1630282 - RNA, 23 nt, Homo sapiens
cuggaggggagaggucagccuug

SEQ ID NO: 1630283 - RNA, 14 nt, Homo sapiens
cuggagugcaaugg

SEQ ID NO: 1630284 - RNA, 19 nt, Homo sapiens
cuggagugcaguggcgcau

SEQ ID NO: 1630285 - RNA, 20 nt, Homo sapiens
cuggagugcaguggcgugau

SEQ ID NO: 1630286 - RNA, 19 nt, Homo sapiens
cuggaucacagacacugca

SEQ ID NO: 1630287 - RNA, 13 nt, Homo sapiens
cuggaugagaaac

SEQ ID NO: 1630288 - RNA, 21 nt, Homo sapiens
cuggccccuaggcugcugcug

SEQ ID NO: 1630289 - RNA, 17 nt, Homo sapiens
cuggccucagagcuucc

SEQ ID NO: 1630290 - RNA, 17 nt, Homo sapiens
cuggccuugggcccucu

SEQ ID NO: 1630291 - RNA, 12 nt, Homo sapiens
cuggcuacuccc

SEQ ID NO: 1630292 - RNA, 16 nt, Homo sapiens
cuggcucacaguacag

SEQ ID NO: 1630293 - RNA, 16 nt, Homo sapiens
cuggcucagccucaaa

SEQ ID NO: 1630294 - RNA, 18 nt, Homo sapiens
cuggcucccagggccaug

SEQ ID NO: 1630295 - RNA, 20 nt, Homo sapiens
cuggcucccagggccaugaa

SEQ ID NO: 1630296 - RNA, 19 nt, Homo sapiens
cuggcuuccuaaacccauc

SEQ ID NO: 1630297 - RNA, 14 nt, Homo sapiens
cugggaaacagucc

SEQ ID NO: 1630298 - RNA, 19 nt, Homo sapiens
cugggaaagggagauguca

SEQ ID NO: 1630299 - RNA, 18 nt, Homo sapiens
cugggacacuuaacagau

SEQ ID NO: 1630300 - RNA, 21 nt, Homo sapiens
cugggcagggggcaugaugcg

SEQ ID NO: 1630301 - RNA, 15 nt, Homo sapiens
cugggccaacuccag

SEQ ID NO: 1630302 - RNA, 15 nt, Homo sapiens
cugggccacugggga

SEQ ID NO: 1630303 - RNA, 20 nt, Homo sapiens
cugggccauucuccacagca

SEQ ID NO: 1630304 - RNA, 17 nt, Homo sapiens
cugggccugcugcugag

SEQ ID NO: 1630305 - RNA, 16 nt, Homo sapiens
cugggcucaagcuuuc

SEQ ID NO: 1630306 - RNA, 23 nt, Homo sapiens
cugggcucgccacaucccaugag

SEQ ID NO: 1630307 - RNA, 19 nt, Homo sapiens
cugggcugcagagacugga

SEQ ID NO: 1630308 - RNA, 13 nt, Homo sapiens
cugggcuguaacg

SEQ ID NO: 1630309 - RNA, 15 nt, Homo sapiens
cuggggagcucagga

SEQ ID NO: 1630310 - RNA, 23 nt, Homo sapiens
cuggggaggcaggcauuccugaa

SEQ ID NO: 1630311 - RNA, 18 nt, Homo sapiens
cuggggcucuaacgccug

SEQ ID NO: 1630312 - RNA, 18 nt, Homo sapiens
cuggggcuuccaucccaa

SEQ ID NO: 1630313 - RNA, 13 nt, Homo sapiens
cugggugaucugc

SEQ ID NO: 1630314 - RNA, 21 nt, Homo sapiens
cuggucagcauguacuccccu

SEQ ID NO: 1630315 - RNA, 23 nt, Homo sapiens
cugguccuaccaauggauucaug

SEQ ID NO: 1630316 - RNA, 12 nt, Homo sapiens
cugguccugacc

SEQ ID NO: 1630317 - RNA, 20 nt, Homo sapiens
cuggucucaaacuccugacc

SEQ ID NO: 1630318 - RNA, 18 nt, Homo sapiens
cugguggggcagcuccuc

SEQ ID NO: 1630319 - RNA, 16 nt, Homo sapiens
cuggugugaagguccu

SEQ ID NO: 1630320 - RNA, 13 nt, Homo sapiens
cugguguucacca

SEQ ID NO: 1630321 - RNA, 16 nt, Homo sapiens
cugguuuucugccaau

SEQ ID NO: 1630322 - RNA, 14 nt, Homo sapiens
cuguaaacugaaua

SEQ ID NO: 1630323 - RNA, 18 nt, Homo sapiens
cuguaauauuuagcugua

SEQ ID NO: 1630324 - RNA, 15 nt, Homo sapiens
cuguacacagaauug

SEQ ID NO: 1630325 - RNA, 20 nt, Homo sapiens
cuguacacagaauuguucca

SEQ ID NO: 1630326 - RNA, 19 nt, Homo sapiens
cuguagacaggaaagccag

SEQ ID NO: 1630327 - RNA, 18 nt, Homo sapiens
cuguagugagauagcauu

SEQ ID NO: 1630328 - RNA, 22 nt, Homo sapiens
cuguaguugcguggacucugca

SEQ ID NO: 1630329 - RNA, 15 nt, Homo sapiens
cuguaucuccagcca

SEQ ID NO: 1630330 - RNA, 17 nt, Homo sapiens
cuguaugucucguggua

SEQ ID NO: 1630331 - RNA, 19 nt, Homo sapiens
cuguauuacagcuuucaca

SEQ ID NO: 1630332 - RNA, 17 nt, Homo sapiens
cugucaaaucuaguuuc

SEQ ID NO: 1630333 - RNA, 21 nt, Homo sapiens
aucuccccucacacuuugcca

SEQ ID NO: 1630334 - RNA, 15 nt, Homo sapiens
aucucggcucagugc

SEQ ID NO: 1630335 - RNA, 18 nt, Homo sapiens
aucucggcucagugcaac

SEQ ID NO: 1630336 - RNA, 13 nt, Homo sapiens
aucucuacugcuu

SEQ ID NO: 1630337 - RNA, 16 nt, Homo sapiens
aucucucaaaucuguu

SEQ ID NO: 1630338 - RNA, 16 nt, Homo sapiens
aucucuugaaaccugu

SEQ ID NO: 1630339 - RNA, 15 nt, Homo sapiens
aucugacucucgcug

SEQ ID NO: 1630340 - RNA, 19 nt, Homo sapiens
aucugagagaugacaggga

SEQ ID NO: 1630341 - RNA, 15 nt, Homo sapiens
aucugcugucuuuau

SEQ ID NO: 1630342 - RNA, 19 nt, Homo sapiens
aucuggaaaccucuacaua

SEQ ID NO: 1630343 - RNA, 13 nt, Homo sapiens
aucuggaaguuga

SEQ ID NO: 1630344 - RNA, 18 nt, Homo sapiens
aucugggaaagacaucca

SEQ ID NO: 1630345 - RNA, 17 nt, Homo sapiens
aucugguccaacaugaa

SEQ ID NO: 1630346 - RNA, 20 nt, Homo sapiens
aucugugcaccacuugacag

SEQ ID NO: 1630347 - RNA, 23 nt, Homo sapiens
aucugugcacugcccauggacag

SEQ ID NO: 1630348 - RNA, 10 nt, Homo sapiens
aucuguguuc

SEQ ID NO: 1630349 - RNA, 20 nt, Homo sapiens
aucuuagguaagacauauaa

SEQ ID NO: 1630350 - RNA, 23 nt, Homo sapiens
aucuucccuuuauuacaagaagg

SEQ ID NO: 1630351 - RNA, 19 nt, Homo sapiens
aucuuggagaaugugagaa

SEQ ID NO: 1630352 - RNA, 16 nt, Homo sapiens
aucuuggggacaucuc

SEQ ID NO: 1630353 - RNA, 12 nt, Homo sapiens
aucuuuacaaac

SEQ ID NO: 1630354 - RNA, 16 nt, Homo sapiens
aucuuuuuuagcauaa

SEQ ID NO: 1630355 - RNA, 16 nt, Homo sapiens
augaacagacugaccu

SEQ ID NO: 1630356 - RNA, 17 nt, Homo sapiens
augaacuugcaaacagg

SEQ ID NO: 1630357 - RNA, 20 nt, Homo sapiens
cgggaggaggaggagcaccu

SEQ ID NO: 1630358 - RNA, 23 nt, Homo sapiens
cgggaggauugagaagggacaag

SEQ ID NO: 1630359 - RNA, 16 nt, Homo sapiens
cgggccccauccucau

SEQ ID NO: 1630360 - RNA, 18 nt, Homo sapiens
cggggccugucucaguga

SEQ ID NO: 1630361 - RNA, 12 nt, Homo sapiens
cgggugugcuau

SEQ ID NO: 1630362 - RNA, 21 nt, Homo sapiens
cgguccaagccugcaacucau

SEQ ID NO: 1630363 - RNA, 16 nt, Homo sapiens
cggucccugucccucu

SEQ ID NO: 1630364 - RNA, 14 nt, Homo sapiens
cgguuaccucugca

SEQ ID NO: 1630365 - RNA, 15 nt, Homo sapiens
cgguuaccucugcau

SEQ ID NO: 1630366 - RNA, 17 nt, Homo sapiens
cgguuaccucugcaugg

SEQ ID NO: 1630367 - RNA, 14 nt, Homo sapiens
cgguuuaauucugu

SEQ ID NO: 1630368 - RNA, 22 nt, Homo sapiens
cgucagggagaggucaccagcu

SEQ ID NO: 1630369 - RNA, 19 nt, Homo sapiens
cgucccuauaucagggccu

SEQ ID NO: 1630370 - RNA, 14 nt, Homo sapiens
cgucuaacuggaaa

SEQ ID NO: 1630371 - RNA, 12 nt, Homo sapiens
cgucugugacau

SEQ ID NO: 1630372 - RNA, 16 nt, Homo sapiens
cgugaggcagggacaa

SEQ ID NO: 1630373 - RNA, 19 nt, Homo sapiens
cgugauuuugcuguagaag

SEQ ID NO: 1630374 - RNA, 19 nt, Homo sapiens
cgugcgcgcgcuucuggga

SEQ ID NO: 1630375 - RNA, 14 nt, Homo sapiens
cguggacucugcac

SEQ ID NO: 1630376 - RNA, 17 nt, Homo sapiens
cguggacucugcacaug

SEQ ID NO: 1630377 - RNA, 22 nt, Homo sapiens
cguggacucugcacaugucuug

SEQ ID NO: 1630378 - RNA, 21 nt, Homo sapiens
cguggucccaacuacucagcc

SEQ ID NO: 1630379 - RNA, 18 nt, Homo sapiens
cguggugaccuuucacga

SEQ ID NO: 1630380 - RNA, 15 nt, Homo sapiens
cguucugugcacaaa

SEQ ID NO: 1630381 - RNA, 22 nt, Homo sapiens
cguugacaaguuuuguggggcu

SEQ ID NO: 1630382 - RNA, 14 nt, Homo sapiens
cuaaaaacuuagaa

SEQ ID NO: 1630383 - RNA, 15 nt, Homo sapiens
cuaaaauagcaauaa

SEQ ID NO: 1630384 - RNA, 12 nt, Homo sapiens
cuaaacuacuga

SEQ ID NO: 1630385 - RNA, 23 nt, Homo sapiens
cuaaagccuuccuauuuugcaua

SEQ ID NO: 1630386 - RNA, 15 nt, Homo sapiens
cuaaaucaaucugca

SEQ ID NO: 1630387 - RNA, 18 nt, Homo sapiens
cuaaaugugauccugccu

SEQ ID NO: 1630388 - RNA, 18 nt, Homo sapiens
cuaaccaaaucucucaaa

SEQ ID NO: 1630389 - RNA, 16 nt, Homo sapiens
cuaacuguacauuuca

SEQ ID NO: 1630390 - RNA, 14 nt, Homo sapiens
cuaaggacauuucc

SEQ ID NO: 1630391 - RNA, 12 nt, Homo sapiens
cuaauaaagcca

SEQ ID NO: 1630392 - RNA, 22 nt, Homo sapiens
cuaauaauuguaucuacauuaa

SEQ ID NO: 1630393 - RNA, 22 nt, Homo sapiens
cuaaugugaaaaucaucacuca

SEQ ID NO: 1630394 - RNA, 17 nt, Homo sapiens
cuaauuuacaagcacga

SEQ ID NO: 1630395 - RNA, 18 nt, Homo sapiens
cuaauuuacaagcacgau

SEQ ID NO: 1630396 - RNA, 20 nt, Homo sapiens
cuaauuuucuagauuuucua

SEQ ID NO: 1630397 - RNA, 18 nt, Homo sapiens
cuacacagggccugcuau

SEQ ID NO: 1630398 - RNA, 16 nt, Homo sapiens
cuacaguaaugaaaug

SEQ ID NO: 1630399 - RNA, 18 nt, Homo sapiens
cuacauauugucuggaaa

SEQ ID NO: 1630400 - RNA, 16 nt, Homo sapiens
cuacauuaaaaugaca

SEQ ID NO: 1630401 - RNA, 22 nt, Homo sapiens
cuaccauucaaaauugcuucuu

SEQ ID NO: 1630402 - RNA, 15 nt, Homo sapiens
cuaccccuuuacaaa

SEQ ID NO: 1630403 - RNA, 15 nt, Homo sapiens
cuaccugacugccac

SEQ ID NO: 1630404 - RNA, 17 nt, Homo sapiens
cuacgaauauagagggu

SEQ ID NO: 1630405 - RNA, 14 nt, Homo sapiens
cuacgcacuggaca

SEQ ID NO: 1630406 - RNA, 20 nt, Homo sapiens
cuacgccaauguuaugccag

SEQ ID NO: 1630407 - RNA, 16 nt, Homo sapiens
cuacuaagauacucca

SEQ ID NO: 1630408 - RNA, 14 nt, Homo sapiens
cuacuauguacugc

SEQ ID NO: 1630409 - RNA, 19 nt, Homo sapiens
cuacuauguacugccuuag

SEQ ID NO: 1630410 - RNA, 21 nt, Homo sapiens
cuacucacacaggcauuuccu

SEQ ID NO: 1630411 - RNA, 20 nt, Homo sapiens
cuacucccuggaccacgagg

SEQ ID NO: 1630412 - RNA, 21 nt, Homo sapiens
cuacucugugccagagccugg

SEQ ID NO: 1630413 - RNA, 19 nt, Homo sapiens
cuacugagcauuugcaccu

SEQ ID NO: 1630414 - RNA, 18 nt, Homo sapiens
cuacugcagcaccuccag

SEQ ID NO: 1630415 - RNA, 18 nt, Homo sapiens
cuacugcucuguguuuac

SEQ ID NO: 1630416 - RNA, 16 nt, Homo sapiens
cuacuucucagucccc

SEQ ID NO: 1630417 - RNA, 14 nt, Homo sapiens
cuacuugggagcac

SEQ ID NO: 1630418 - RNA, 15 nt, Homo sapiens
cuacuugucauauca

SEQ ID NO: 1630419 - RNA, 18 nt, Homo sapiens
cuacuuuucuuuccucag

SEQ ID NO: 1630420 - RNA, 23 nt, Homo sapiens
cuagaaucauacuuaacauuuca

SEQ ID NO: 1630421 - RNA, 17 nt, Homo sapiens
cuagacuuagauucauu

SEQ ID NO: 1630422 - RNA, 18 nt, Homo sapiens
cuagauaauaaaauugcu

SEQ ID NO: 1630423 - RNA, 19 nt, Homo sapiens
cuagauuuucuacuuuauu

SEQ ID NO: 1630424 - RNA, 22 nt, Homo sapiens
cuagcacaugcccuaaugucug

SEQ ID NO: 1630425 - RNA, 12 nt, Homo sapiens
cuaggccccaga

SEQ ID NO: 1630426 - RNA, 22 nt, Homo sapiens
cuagggaggaccaaagggaugg

SEQ ID NO: 1630427 - RNA, 13 nt, Homo sapiens
cuaguaaccaagg

SEQ ID NO: 1630428 - RNA, 15 nt, Homo sapiens
cuaguacaaucuugg

SEQ ID NO: 1630429 - RNA, 17 nt, Homo sapiens
cuaguacuaugucaaag

SEQ ID NO: 1630430 - RNA, 20 nt, Homo sapiens
cuaguacuaugucaaagcaa

SEQ ID NO: 1630431 - RNA, 15 nt, Homo sapiens
cuaguaugcccugua

SEQ ID NO: 1630432 - RNA, 22 nt, Homo sapiens
cuagucacucauccauccccug

SEQ ID NO: 1630433 - RNA, 15 nt, Homo sapiens
cuagucucaccagcc

SEQ ID NO: 1630434 - RNA, 14 nt, Homo sapiens
cuaguugagagcac

SEQ ID NO: 1630435 - RNA, 21 nt, Homo sapiens
cuaguuugcacuauaugauca

SEQ ID NO: 1630436 - RNA, 11 nt, Homo sapiens
cuauagcucuu

SEQ ID NO: 1630437 - RNA, 24 nt, Homo sapiens
cuaucuuagguagucaugcugugc

SEQ ID NO: 1630438 - RNA, 18 nt, Homo sapiens
cuaucuuagguggagcua

SEQ ID NO: 1630439 - RNA, 15 nt, Homo sapiens
cuaugacuugggcac

SEQ ID NO: 1630440 - RNA, 17 nt, Homo sapiens
cuaugcugcaauacauu

SEQ ID NO: 1630441 - RNA, 14 nt, Homo sapiens
cuaugcugugcucc

SEQ ID NO: 1630442 - RNA, 16 nt, Homo sapiens
cuauguacugccuuag

SEQ ID NO: 1630443 - RNA, 20 nt, Homo sapiens
cuauguucaaagacugugaa

SEQ ID NO: 1630444 - RNA, 16 nt, Homo sapiens
cuauuaaacuauuuua

SEQ ID NO: 1630445 - RNA, 23 nt, Homo sapiens
cuauuaacuuuaauucucuuuca

SEQ ID NO: 1630446 - RNA, 16 nt, Homo sapiens
cuauucauggcuaccu

SEQ ID NO: 1630447 - RNA, 19 nt, Homo sapiens
cuauucauggcuaccucag

SEQ ID NO: 1630448 - RNA, 23 nt, Homo sapiens
cuauucugagcauacucaacaaa

SEQ ID NO: 1630449 - RNA, 22 nt, Homo sapiens
cuauuguuucuccucugaagca

SEQ ID NO: 1630450 - RNA, 15 nt, Homo sapiens
cuauuugaacaagug

SEQ ID NO: 1630451 - RNA, 13 nt, Homo sapiens
cucaaacuaucug

SEQ ID NO: 1630452 - RNA, 19 nt, Homo sapiens
cucaacaagugcuccugaa

SEQ ID NO: 1630453 - RNA, 16 nt, Homo sapiens
cucaacucacugcaag

SEQ ID NO: 1630454 - RNA, 15 nt, Homo sapiens
cucaagucugcacag

SEQ ID NO: 1630455 - RNA, 13 nt, Homo sapiens
cucaaucuccuga

SEQ ID NO: 1630456 - RNA, 16 nt, Homo sapiens
cucaauuuuugucuca

SEQ ID NO: 1630457 - RNA, 16 nt, Homo sapiens
uucaacaaauuucauu

SEQ ID NO: 1630458 - RNA, 21 nt, Homo sapiens
uucaacaaauuucauugcacu

SEQ ID NO: 1630459 - RNA, 16 nt, Homo sapiens
uucaacagggaagaaa

SEQ ID NO: 1630460 - RNA, 19 nt, Homo sapiens
uucaacaguuuuugcuaau

SEQ ID NO: 1630461 - RNA, 12 nt, Homo sapiens
uucaacaugaca

SEQ ID NO: 1630462 - RNA, 18 nt, Homo sapiens
uucaacaugacauccaga

SEQ ID NO: 1630463 - RNA, 12 nt, Homo sapiens
uucaagauccuc

SEQ ID NO: 1630464 - RNA, 15 nt, Homo sapiens
uucaagcuuguccag

SEQ ID NO: 1630465 - RNA, 19 nt, Homo sapiens
uucaauagcauaucacaga

SEQ ID NO: 1630466 - RNA, 19 nt, Homo sapiens
uucacaccgcugcacucaa

SEQ ID NO: 1630467 - RNA, 22 nt, Homo sapiens
uucacauaugucuuacuacuuu

SEQ ID NO: 1630468 - RNA, 19 nt, Homo sapiens
uucacauucagaaguaauu

SEQ ID NO: 1630469 - RNA, 13 nt, Homo sapiens
uucacauugcacu

SEQ ID NO: 1630470 - RNA, 13 nt, Homo sapiens
uucaccaagccaa

SEQ ID NO: 1630471 - RNA, 15 nt, Homo sapiens
uucacucccagguga

SEQ ID NO: 1630472 - RNA, 15 nt, Homo sapiens
ugaucugcugcugag

SEQ ID NO: 1630473 - RNA, 12 nt, Homo sapiens
ugaucugucagc

SEQ ID NO: 1630474 - RNA, 12 nt, Homo sapiens
ugaucuugagca

SEQ ID NO: 1630475 - RNA, 16 nt, Homo sapiens
ugaugcaagccagcuu

SEQ ID NO: 1630476 - RNA, 16 nt, Homo sapiens
ugaugccccagggauu

SEQ ID NO: 1630477 - RNA, 20 nt, Homo sapiens
ugaugggaggugugccagaa

SEQ ID NO: 1630478 - RNA, 20 nt, Homo sapiens
ugauguugucuuagcauggu

SEQ ID NO: 1630479 - RNA, 18 nt, Homo sapiens
ugauuaaucugauuauac

SEQ ID NO: 1630480 - RNA, 13 nt, Homo sapiens
ugauuauucaaca

SEQ ID NO: 1630481 - RNA, 16 nt, Homo sapiens
ugauugagggugugau

SEQ ID NO: 1630482 - RNA, 14 nt, Homo sapiens
ugauugcacuugau

SEQ ID NO: 1630483 - RNA, 19 nt, Homo sapiens
ugauugugugacuauucau

SEQ ID NO: 1630484 - RNA, 14 nt, Homo sapiens
ugauuuaccucaua

SEQ ID NO: 1630485 - RNA, 13 nt, Homo sapiens
ugauuuuacuuaa

SEQ ID NO: 1630486 - RNA, 13 nt, Homo sapiens
ugcaaaacuuuag

SEQ ID NO: 1630487 - RNA, 14 nt, Homo sapiens
ugcaaaaguucuca

SEQ ID NO: 1630488 - RNA, 15 nt, Homo sapiens
ugcaaauacaaucag

SEQ ID NO: 1630489 - RNA, 22 nt, Homo sapiens
ugcaaauacaaucagcccagug

SEQ ID NO: 1630490 - RNA, 17 nt, Homo sapiens
ugcaaaucaaacauauu

SEQ ID NO: 1630491 - RNA, 20 nt, Homo sapiens
ugcaacagccacuacauuac

SEQ ID NO: 1630492 - RNA, 18 nt, Homo sapiens
ugcaaccucugcuuccca

SEQ ID NO: 1630493 - RNA, 12 nt, Homo sapiens
ugcaagcacucg

SEQ ID NO: 1630494 - RNA, 15 nt, Homo sapiens
ugcaagccaucucua

SEQ ID NO: 1630495 - RNA, 14 nt, Homo sapiens
ugcaaugcaugaua

SEQ ID NO: 1630496 - RNA, 15 nt, Homo sapiens
ugcaauguaagcaua

SEQ ID NO: 1630497 - RNA, 14 nt, Homo sapiens
ugcaauucuagcca

SEQ ID NO: 1630498 - RNA, 14 nt, Homo sapiens
ugcacacugcacau

SEQ ID NO: 1630499 - RNA, 20 nt, Homo sapiens
ugcacagagcaaguccucac

SEQ ID NO: 1630500 - RNA, 19 nt, Homo sapiens
ugcacaggguccucagcuc

SEQ ID NO: 1630501 - RNA, 16 nt, Homo sapiens
ugcacaguagagcaaa

SEQ ID NO: 1630502 - RNA, 20 nt, Homo sapiens
ugcacaugucuuguacaugu

SEQ ID NO: 1630503 - RNA, 15 nt, Homo sapiens
ugcaccacuugacag

SEQ ID NO: 1630504 - RNA, 12 nt, Homo sapiens
ugcaccuaccuu

SEQ ID NO: 1630505 - RNA, 17 nt, Homo sapiens
ugcaccuucacucucca

SEQ ID NO: 1630506 - RNA, 22 nt, Homo sapiens
ugcaccuugugucuguacacgu

SEQ ID NO: 1630507 - RNA, 19 nt, Homo sapiens
ugcacuacagcccuggccu

SEQ ID NO: 1630508 - RNA, 14 nt, Homo sapiens
ugcacuagugcaau

SEQ ID NO: 1630509 - RNA, 15 nt, Homo sapiens
ugcacuagugcaauu

SEQ ID NO: 1630510 - RNA, 20 nt, Homo sapiens
ugcacuuuccaaugccacag

SEQ ID NO: 1630511 - RNA, 11 nt, Homo sapiens
ugcacuuuccu

SEQ ID NO: 1630512 - RNA, 21 nt, Homo sapiens
ugcacuuuuagaaaugcauau

SEQ ID NO: 1630513 - RNA, 20 nt, Homo sapiens
ugcacuuuuuuauaagagcu

SEQ ID NO: 1630514 - RNA, 16 nt, Homo sapiens
ugcagaaauuugaaug

SEQ ID NO: 1630515 - RNA, 19 nt, Homo sapiens
ugcagaaauuugaaugaca

SEQ ID NO: 1630516 - RNA, 18 nt, Homo sapiens
ugcagaaccacaaacaau

SEQ ID NO: 1630517 - RNA, 16 nt, Homo sapiens
ugcagaagaaaucaua

SEQ ID NO: 1630518 - RNA, 17 nt, Homo sapiens
ugcagaaggaaagaagg

SEQ ID NO: 1630519 - RNA, 22 nt, Homo sapiens
ugcagaccaucgcacaccaaau

SEQ ID NO: 1630520 - RNA, 15 nt, Homo sapiens
ugcagagcagacagg

SEQ ID NO: 1630521 - RNA, 15 nt, Homo sapiens
ugcagaugaggacua

SEQ ID NO: 1630522 - RNA, 16 nt, Homo sapiens
ugcagcaaacacucca

SEQ ID NO: 1630523 - RNA, 21 nt, Homo sapiens
ugcagcaaacacuccacccuc

SEQ ID NO: 1630524 - RNA, 14 nt, Homo sapiens
ugcagcagagccug

SEQ ID NO: 1630525 - RNA, 13 nt, Homo sapiens
ugcagcuaucugg

SEQ ID NO: 1630526 - RNA, 20 nt, Homo sapiens
ugcagcuggaaaagggucuu

SEQ ID NO: 1630527 - RNA, 22 nt, Homo sapiens
ugcaggcaggaacaaacagggc

SEQ ID NO: 1630528 - RNA, 12 nt, Homo sapiens
ugcagggccauc

SEQ ID NO: 1630529 - RNA, 13 nt, Homo sapiens
ugcaguaagccaa

SEQ ID NO: 1630530 - RNA, 22 nt, Homo sapiens
ugcaguaagccaaggucaugcc

SEQ ID NO: 1630531 - RNA, 20 nt, Homo sapiens
ugcagucaucagaaauucca

SEQ ID NO: 1630532 - RNA, 17 nt, Homo sapiens
ugcaguggcacgaucuc

SEQ ID NO: 1630533 - RNA, 18 nt, Homo sapiens
ugcaguggcgugaucucg

SEQ ID NO: 1630534 - RNA, 20 nt, Homo sapiens
ugcaguuccccgagaacuuu

SEQ ID NO: 1630535 - RNA, 20 nt, Homo sapiens
ugcaguuucuuuucacauua

SEQ ID NO: 1630536 - RNA, 14 nt, Homo sapiens
ugcaguuuuacuaa

SEQ ID NO: 1630537 - RNA, 13 nt, Homo sapiens
ugcauacuuuauu

SEQ ID NO: 1630538 - RNA, 14 nt, Homo sapiens
ugcaucuuauucga

SEQ ID NO: 1630539 - RNA, 20 nt, Homo sapiens
ugcauggaacccccagaaua

SEQ ID NO: 1630540 - RNA, 18 nt, Homo sapiens
ugcaugggcuaaugaaga

SEQ ID NO: 1630541 - RNA, 22 nt, Homo sapiens
ugcauguccucuuguugcugag

SEQ ID NO: 1630542 - RNA, 16 nt, Homo sapiens
ugcaugugacucugaa

SEQ ID NO: 1630543 - RNA, 14 nt, Homo sapiens
ugcauucucuccca

SEQ ID NO: 1630544 - RNA, 13 nt, Homo sapiens
ugcauuuagcuuc

SEQ ID NO: 1630545 - RNA, 14 nt, Homo sapiens
ugcauuuagcuucu

SEQ ID NO: 1630546 - RNA, 14 nt, Homo sapiens
ugcauuucuuacca

SEQ ID NO: 1630547 - RNA, 18 nt, Homo sapiens
ugcauuuuauagaauagu

SEQ ID NO: 1630548 - RNA, 21 nt, Homo sapiens
ugccaacuauucucaggccaa

SEQ ID NO: 1630549 - RNA, 17 nt, Homo sapiens
ugccaaucugcauuucu

SEQ ID NO: 1630550 - RNA, 17 nt, Homo sapiens
ugccaaugaccaaacag

SEQ ID NO: 1630551 - RNA, 15 nt, Homo sapiens
ugccacugcacucua

SEQ ID NO: 1630552 - RNA, 15 nt, Homo sapiens
ugccagccacuguca

SEQ ID NO: 1630553 - RNA, 18 nt, Homo sapiens
ugccauacuuuccuguau

SEQ ID NO: 1630554 - RNA, 12 nt, Homo sapiens
ugccauaugccu

SEQ ID NO: 1630555 - RNA, 17 nt, Homo sapiens
ugccauccagccagaac

SEQ ID NO: 1630556 - RNA, 21 nt, Homo sapiens
ugcccaagagaucugugccau

SEQ ID NO: 1630557 - RNA, 13 nt, Homo sapiens
ugcccaccagauc

SEQ ID NO: 1630558 - RNA, 12 nt, Homo sapiens
ugcccagaucaa

SEQ ID NO: 1630559 - RNA, 19 nt, Homo sapiens
ugcccaggucccuccucag

SEQ ID NO: 1630560 - RNA, 12 nt, Homo sapiens
ugcccaugugaa

SEQ ID NO: 1630561 - RNA, 19 nt, Homo sapiens
ugccccaacuccuuccagc

SEQ ID NO: 1630562 - RNA, 19 nt, Homo sapiens
ugccccacuucauggauuu

SEQ ID NO: 1630563 - RNA, 20 nt, Homo sapiens
ugccccccagauugcugcaa

SEQ ID NO: 1630564 - RNA, 20 nt, Homo sapiens
ugcccccuggggaucacagc

SEQ ID NO: 1630565 - RNA, 11 nt, Homo sapiens
ugcccuuugag

SEQ ID NO: 1630566 - RNA, 20 nt, Homo sapiens
ugccgugugagugugacagg

SEQ ID NO: 1630567 - RNA, 20 nt, Homo sapiens
ugccuagaguguagccuaaa

SEQ ID NO: 1630568 - RNA, 20 nt, Homo sapiens
ugccucgcuccccacucugc

SEQ ID NO: 1630569 - RNA, 16 nt, Homo sapiens
ugccuggccuggcaca

SEQ ID NO: 1630570 - RNA, 21 nt, Homo sapiens
ugccuucuuauugcuuuuaug

SEQ ID NO: 1630571 - RNA, 16 nt, Homo sapiens
ugccuugcugugaaau

SEQ ID NO: 1630572 - RNA, 16 nt, Homo sapiens
ugccuuugcucuuaua

SEQ ID NO: 1630573 - RNA, 19 nt, Homo sapiens
ugggccugcugcugagaac

SEQ ID NO: 1630574 - RNA, 19 nt, Homo sapiens
ugggcugugggcaagccua

SEQ ID NO: 1630575 - RNA, 12 nt, Homo sapiens
ugggcuuccuga

SEQ ID NO: 1630576 - RNA, 20 nt, Homo sapiens
uggggaaacagaugccucag

SEQ ID NO: 1630577 - RNA, 17 nt, Homo sapiens
uggggaaaccauggcaa

SEQ ID NO: 1630578 - RNA, 12 nt, Homo sapiens
uggggaccaaga

SEQ ID NO: 1630579 - RNA, 21 nt, Homo sapiens
uggggaccgguucccacaagc

SEQ ID NO: 1630580 - RNA, 20 nt, Homo sapiens
uggggagaggggagugcauu

SEQ ID NO: 1630581 - RNA, 22 nt, Homo sapiens
uggggaggacaaaacuucuugu

SEQ ID NO: 1630582 - RNA, 22 nt, Homo sapiens
uggggcuggccucccaaaugag

SEQ ID NO: 1630583 - RNA, 12 nt, Homo sapiens
uggggcuuccau

SEQ ID NO: 1630584 - RNA, 22 nt, Homo sapiens
ugaaaauuauuugaaaacauau

SEQ ID NO: 1630585 - RNA, 16 nt, Homo sapiens
ugaaacauggcugugu

SEQ ID NO: 1630586 - RNA, 15 nt, Homo sapiens
ugaaacuuauaguua

SEQ ID NO: 1630587 - RNA, 16 nt, Homo sapiens
ugaaagcaaguguuca

SEQ ID NO: 1630588 - RNA, 21 nt, Homo sapiens
ugaaagcguuuacaugagacu

SEQ ID NO: 1630589 - RNA, 21 nt, Homo sapiens
ugaaagcuuuauacaguugaa

SEQ ID NO: 1630590 - RNA, 19 nt, Homo sapiens
ugaaaguagcagugugaag

SEQ ID NO: 1630591 - RNA, 15 nt, Homo sapiens
ugaaauaaaacauuc

SEQ ID NO: 1630592 - RNA, 13 nt, Homo sapiens
ugaaaucuuuuaa

SEQ ID NO: 1630593 - RNA, 23 nt, Homo sapiens
ugaaauucuuucagcuaucagua

SEQ ID NO: 1630594 - RNA, 11 nt, Homo sapiens
ugaacaaagca

SEQ ID NO: 1630595 - RNA, 14 nt, Homo sapiens
ugaaccaacaucuu

SEQ ID NO: 1630596 - RNA, 10 nt, Homo sapiens
ugaaccuaau

SEQ ID NO: 1630597 - RNA, 10 nt, Homo sapiens
ugaaccugug

SEQ ID NO: 1630598 - RNA, 14 nt, Homo sapiens
ugaacuaguuuuac

SEQ ID NO: 1630599 - RNA, 15 nt, Homo sapiens
ugaacugaacuaauc

SEQ ID NO: 1630600 - RNA, 21 nt, Homo sapiens
ugaacuguaccaugugcuaca

SEQ ID NO: 1630601 - RNA, 20 nt, Homo sapiens
ugaagaaagauacuaauaga

SEQ ID NO: 1630602 - RNA, 23 nt, Homo sapiens
ugaagaaagucagcucuugucaa

SEQ ID NO: 1630603 - RNA, 19 nt, Homo sapiens
ugaagaucauauacgugaa

SEQ ID NO: 1630604 - RNA, 15 nt, Homo sapiens
ugaagcagguuccca

SEQ ID NO: 1630605 - RNA, 21 nt, Homo sapiens
ugaagccaauucagacaggca

SEQ ID NO: 1630606 - RNA, 24 nt, Homo sapiens
ugaaggggaaccccggggugccca

SEQ ID NO: 1630607 - RNA, 13 nt, Homo sapiens
ugaaguaagcaac

SEQ ID NO: 1630608 - RNA, 18 nt, Homo sapiens
ugaaguacaauaauucau

SEQ ID NO: 1630609 - RNA, 14 nt, Homo sapiens
ugaaguauugcuga

SEQ ID NO: 1630610 - RNA, 18 nt, Homo sapiens
ugaagugcccuucccuug

SEQ ID NO: 1630611 - RNA, 15 nt, Homo sapiens
ugaagugugcuguga

SEQ ID NO: 1630612 - RNA, 18 nt, Homo sapiens
ugaaguuuaauugacuua

SEQ ID NO: 1630613 - RNA, 14 nt, Homo sapiens
ugaauaacauuuaa

SEQ ID NO: 1630614 - RNA, 20 nt, Homo sapiens
ugaauaacauuuaaauucca

SEQ ID NO: 1630615 - RNA, 11 nt, Homo sapiens
ugaauaucauu

SEQ ID NO: 1630616 - RNA, 22 nt, Homo sapiens
ugaauauuuuucuguaguguga

SEQ ID NO: 1630617 - RNA, 14 nt, Homo sapiens
ugaauccugugaua

SEQ ID NO: 1630618 - RNA, 22 nt, Homo sapiens
ugaaugagcuugucaaugugau

SEQ ID NO: 1630619 - RNA, 15 nt, Homo sapiens
ugaaugggcugagaa

SEQ ID NO: 1630620 - RNA, 19 nt, Homo sapiens
ugaauguguagaaccuucc

SEQ ID NO: 1630621 - RNA, 14 nt, Homo sapiens
ugaauuauuguuau

SEQ ID NO: 1630622 - RNA, 17 nt, Homo sapiens
ugaauucuggaaucaca

SEQ ID NO: 1630623 - RNA, 15 nt, Homo sapiens
ugaauuggaaaggaa

SEQ ID NO: 1630624 - RNA, 14 nt, Homo sapiens
ugaauuggcuaugc

SEQ ID NO: 1630625 - RNA, 13 nt, Homo sapiens
ugaauuuaauaca

SEQ ID NO: 1630626 - RNA, 19 nt, Homo sapiens
ugacaaaaaggccaagaga

SEQ ID NO: 1630627 - RNA, 22 nt, Homo sapiens
ugacaaaaccuuuaaucugcac

SEQ ID NO: 1630628 - RNA, 17 nt, Homo sapiens
ugacaagccaaugugaa

SEQ ID NO: 1630629 - RNA, 18 nt, Homo sapiens
ugacaagccaaugugaau

SEQ ID NO: 1630630 - RNA, 20 nt, Homo sapiens
ugacaaguauuuucuacuaa

SEQ ID NO: 1630631 - RNA, 19 nt, Homo sapiens
ugacaauugggagcugcca

SEQ ID NO: 1630632 - RNA, 15 nt, Homo sapiens
ugacacauaugcacc

SEQ ID NO: 1630633 - RNA, 19 nt, Homo sapiens
ugacaccccugacuuuuau

SEQ ID NO: 1630634 - RNA, 20 nt, Homo sapiens
ugacacggccaugaccacuu

SEQ ID NO: 1630635 - RNA, 13 nt, Homo sapiens
ugacagagugccu

SEQ ID NO: 1630636 - RNA, 18 nt, Homo sapiens
ugacagaucaagcuguga

SEQ ID NO: 1630637 - RNA, 20 nt, Homo sapiens
ugacagaucaagcugugaga

SEQ ID NO: 1630638 - RNA, 20 nt, Homo sapiens
ugacagauggugaaguaaca

SEQ ID NO: 1630639 - RNA, 16 nt, Homo sapiens
ugacagggaaaacugc

SEQ ID NO: 1630640 - RNA, 15 nt, Homo sapiens
ugacauguagcuucu

SEQ ID NO: 1630641 - RNA, 14 nt, Homo sapiens
ugacauucuacagu

SEQ ID NO: 1630642 - RNA, 17 nt, Homo sapiens
ugacauucuuagcugua

SEQ ID NO: 1630643 - RNA, 19 nt, Homo sapiens
ugacauucuuagcuguaac

SEQ ID NO: 1630644 - RNA, 14 nt, Homo sapiens
ugaccaagcaucuu

SEQ ID NO: 1630645 - RNA, 17 nt, Homo sapiens
ugacccagcaucuccca

SEQ ID NO: 1630646 - RNA, 12 nt, Homo sapiens
ugaccccagugu

SEQ ID NO: 1630647 - RNA, 14 nt, Homo sapiens
ugacccccagcucc

SEQ ID NO: 1630648 - RNA, 14 nt, Homo sapiens
ugaccgacaugaac

SEQ ID NO: 1630649 - RNA, 20 nt, Homo sapiens
ugaccugcugagcucugaga

SEQ ID NO: 1630650 - RNA, 21 nt, Homo sapiens
ugacggcccucaucuaugagg

SEQ ID NO: 1630651 - RNA, 18 nt, Homo sapiens
ugacuaaagcagggacaa

SEQ ID NO: 1630652 - RNA, 16 nt, Homo sapiens
ugacugccaagccaga

SEQ ID NO: 1630653 - RNA, 17 nt, Homo sapiens
ugacugccaagccagau

SEQ ID NO: 1630654 - RNA, 15 nt, Homo sapiens
ugacuuaagcugccu

SEQ ID NO: 1630655 - RNA, 16 nt, Homo sapiens
ugacuuugaacuaaug

SEQ ID NO: 1630656 - RNA, 23 nt, Homo sapiens
ugagaaaaauagagcaaaaucaa

SEQ ID NO: 1630657 - RNA, 16 nt, Homo sapiens
ugagacacaggaugaa

SEQ ID NO: 1630658 - RNA, 15 nt, Homo sapiens
ugagacagucuugcu

SEQ ID NO: 1630659 - RNA, 16 nt, Homo sapiens
ugagagcgacacagac

SEQ ID NO: 1630660 - RNA, 13 nt, Homo sapiens
ugagagggugcua

SEQ ID NO: 1630661 - RNA, 21 nt, Homo sapiens
ugagauuaugaugaaaaccua

SEQ ID NO: 1630662 - RNA, 23 nt, Homo sapiens
ugagauuaugaugaaaaccuaca

SEQ ID NO: 1630663 - RNA, 14 nt, Homo sapiens
ugagauugugaagu

SEQ ID NO: 1630664 - RNA, 14 nt, Homo sapiens
ugagcacugccagg

SEQ ID NO: 1630665 - RNA, 15 nt, Homo sapiens
ugagcagaagaucaa

SEQ ID NO: 1630666 - RNA, 20 nt, Homo sapiens
ugagcgucacggccaagugu

SEQ ID NO: 1630667 - RNA, 16 nt, Homo sapiens
ugagcuauaacuuacu

SEQ ID NO: 1630668 - RNA, 14 nt, Homo sapiens
ugagcuggggacuc

SEQ ID NO: 1630669 - RNA, 16 nt, Homo sapiens
ugaggaggaugucccu

SEQ ID NO: 1630670 - RNA, 17 nt, Homo sapiens
ugaggccaucucaggag

SEQ ID NO: 1630671 - RNA, 18 nt, Homo sapiens
ugaggcuggcacaggaca

SEQ ID NO: 1630672 - RNA, 12 nt, Homo sapiens
ugagggugcuga

SEQ ID NO: 1630673 - RNA, 21 nt, Homo sapiens
ugaggugacacuccaguugca

SEQ ID NO: 1630674 - RNA, 19 nt, Homo sapiens
ugaggugcccacuccgcca

SEQ ID NO: 1630675 - RNA, 16 nt, Homo sapiens
ugaguaaugguuacua

SEQ ID NO: 1630676 - RNA, 14 nt, Homo sapiens
ugaguagacauugu

SEQ ID NO: 1630677 - RNA, 16 nt, Homo sapiens
ugaguauaaauuuacu

SEQ ID NO: 1630678 - RNA, 18 nt, Homo sapiens
ugaguauuccaccacagg

SEQ ID NO: 1630679 - RNA, 14 nt, Homo sapiens
ugagucagugccau

SEQ ID NO: 1630680 - RNA, 16 nt, Homo sapiens
ugagucagugccauga

SEQ ID NO: 1630681 - RNA, 16 nt, Homo sapiens
ugagugaccuccuucu

SEQ ID NO: 1630682 - RNA, 14 nt, Homo sapiens
ugaguucaaauacu

SEQ ID NO: 1630683 - RNA, 17 nt, Homo sapiens
ugaguucuauaauauaa

SEQ ID NO: 1630684 - RNA, 15 nt, Homo sapiens
ugauaaaauagccaa

SEQ ID NO: 1630685 - RNA, 12 nt, Homo sapiens
ugauacauccaa

SEQ ID NO: 1630686 - RNA, 23 nt, Homo sapiens
ugauacauuuaagguauauugcu

SEQ ID NO: 1630687 - RNA, 22 nt, Homo sapiens
ucuacugcuuuggauccugggu

SEQ ID NO: 1630688 - RNA, 19 nt, Homo sapiens
ucuacuucucucucucuga

SEQ ID NO: 1630689 - RNA, 14 nt, Homo sapiens
ucuacuugucauau

SEQ ID NO: 1630690 - RNA, 17 nt, Homo sapiens
ucuagacaucauuguca

SEQ ID NO: 1630691 - RNA, 14 nt, Homo sapiens
ucuagagcuuuuau

SEQ ID NO: 1630692 - RNA, 18 nt, Homo sapiens
ucuagauuuucuacuuua

SEQ ID NO: 1630693 - RNA, 12 nt, Homo sapiens
ucuagcaguugu

SEQ ID NO: 1630694 - RNA, 18 nt, Homo sapiens
ucuagcuaguaauauauu

SEQ ID NO: 1630695 - RNA, 20 nt, Homo sapiens
ucuagggaaugggacuguga

SEQ ID NO: 1630696 - RNA, 23 nt, Homo sapiens
ucuaugaccucgcccuccacaaa

SEQ ID NO: 1630697 - RNA, 21 nt, Homo sapiens
ucuauguucaaagacugugaa

SEQ ID NO: 1630698 - RNA, 14 nt, Homo sapiens
ucuauuacacugga

SEQ ID NO: 1630699 - RNA, 21 nt, Homo sapiens
ucuauuuuaagacugauuuua

SEQ ID NO: 1630700 - RNA, 17 nt, Homo sapiens
ucucaaaccuccaaaag

SEQ ID NO: 1630701 - RNA, 20 nt, Homo sapiens
ucucaaacuccugaccucag

SEQ ID NO: 1630702 - RNA, 15 nt, Homo sapiens
ucucacuguguuacu

SEQ ID NO: 1630703 - RNA, 14 nt, Homo sapiens
ucucaugauuauua

SEQ ID NO: 1630704 - RNA, 10 nt, Homo sapiens
ucucauguca

SEQ ID NO: 1630705 - RNA, 20 nt, Homo sapiens
ucucauugucaccucuguga

SEQ ID NO: 1630706 - RNA, 14 nt, Homo sapiens
ucuccaggggccug

SEQ ID NO: 1630707 - RNA, 22 nt, Homo sapiens
ucucccuuggguaaaaugaagg

SEQ ID NO: 1630708 - RNA, 23 nt, Homo sapiens
ucuccuccagcccagacccagug

SEQ ID NO: 1630709 - RNA, 15 nt, Homo sapiens
ucuccuggcuuccca

SEQ ID NO: 1630710 - RNA, 21 nt, Homo sapiens
ucuccuuucucuuaugcuuaa

SEQ ID NO: 1630711 - RNA, 23 nt, Homo sapiens
ucucuacagugccaacuccucac

SEQ ID NO: 1630712 - RNA, 19 nt, Homo sapiens
ucucuccccagaugugacu

SEQ ID NO: 1630713 - RNA, 16 nt, Homo sapiens
ucucucuuuguaaaac

SEQ ID NO: 1630714 - RNA, 20 nt, Homo sapiens
ucucugugugcacacccaug

SEQ ID NO: 1630715 - RNA, 18 nt, Homo sapiens
ucucuuuacuugaaauuu

SEQ ID NO: 1630716 - RNA, 20 nt, Homo sapiens
ucugaaucaugucuguaucc

SEQ ID NO: 1630717 - RNA, 21 nt, Homo sapiens
ucugacaagcuggccaaaguc

SEQ ID NO: 1630718 - RNA, 19 nt, Homo sapiens
ucugagagaugacagggaa

SEQ ID NO: 1630719 - RNA, 19 nt, Homo sapiens
ucugauuauacaccauuuu

SEQ ID NO: 1630720 - RNA, 17 nt, Homo sapiens
ucugauucacagucuca

SEQ ID NO: 1630721 - RNA, 17 nt, Homo sapiens
ucugcaaccccagguau

SEQ ID NO: 1630722 - RNA, 16 nt, Homo sapiens
ucugcacagacaagca

SEQ ID NO: 1630723 - RNA, 16 nt, Homo sapiens
ucugcagcauugaagu

SEQ ID NO: 1630724 - RNA, 13 nt, Homo sapiens
ucugcaugagcug

SEQ ID NO: 1630725 - RNA, 11 nt, Homo sapiens
ucugcauuuac

SEQ ID NO: 1630726 - RNA, 22 nt, Homo sapiens
ucugcauuucuuaccaguguga

SEQ ID NO: 1630727 - RNA, 18 nt, Homo sapiens
ucugccuacaaaaccuca

SEQ ID NO: 1630728 - RNA, 22 nt, Homo sapiens
ucugccuagaguguagccuaaa

SEQ ID NO: 1630729 - RNA, 23 nt, Homo sapiens
ucugccuuaaacacacauugcag

SEQ ID NO: 1630730 - RNA, 15 nt, Homo sapiens
ucugcugcuucucca

SEQ ID NO: 1630731 - RNA, 16 nt, Homo sapiens
ucugcugggcucugcc

SEQ ID NO: 1630732 - RNA, 12 nt, Homo sapiens
ucugcugucuaa

SEQ ID NO: 1630733 - RNA, 19 nt, Homo sapiens
ucugcuguuuacaacauca

SEQ ID NO: 1630734 - RNA, 21 nt, Homo sapiens
ucugcuugcucccaagccccu

SEQ ID NO: 1630735 - RNA, 14 nt, Homo sapiens
ucugggaaguccua

SEQ ID NO: 1630736 - RNA, 15 nt, Homo sapiens
ucugggauguauuca

SEQ ID NO: 1630737 - RNA, 17 nt, Homo sapiens
ucuggggagcucaggaa

SEQ ID NO: 1630738 - RNA, 23 nt, Homo sapiens
ucuggggaggcaggcauuccuga

SEQ ID NO: 1630739 - RNA, 15 nt, Homo sapiens
ucuguagugagauag

SEQ ID NO: 1630740 - RNA, 22 nt, Homo sapiens
ucuguaucuccagccacuccaa

SEQ ID NO: 1630741 - RNA, 23 nt, Homo sapiens
ucuguauuaaaauuagaaucuga

SEQ ID NO: 1630742 - RNA, 23 nt, Homo sapiens
ucuguauuuuaauggaguggaua

SEQ ID NO: 1630743 - RNA, 18 nt, Homo sapiens
ucuguccugauuucuaca

SEQ ID NO: 1630744 - RNA, 20 nt, Homo sapiens
ucugugaccccuccuuguca

SEQ ID NO: 1630745 - RNA, 21 nt, Homo sapiens
ucugugccgcaccauugaacu

SEQ ID NO: 1630746 - RNA, 12 nt, Homo sapiens
ucuguguacaaa

SEQ ID NO: 1630747 - RNA, 14 nt, Homo sapiens
ucugugugguauau

SEQ ID NO: 1630748 - RNA, 13 nt, Homo sapiens
ucuguuaauguca

SEQ ID NO: 1630749 - RNA, 18 nt, Homo sapiens
ucuguuuaucaagccaua

SEQ ID NO: 1630750 - RNA, 15 nt, Homo sapiens
ucuguuucccaagcu

SEQ ID NO: 1630751 - RNA, 19 nt, Homo sapiens
ucuguuugggggaauuugu

SEQ ID NO: 1630752 - RNA, 15 nt, Homo sapiens
ucuuaaaucugugaa

SEQ ID NO: 1630753 - RNA, 14 nt, Homo sapiens
ucuuaccaguguga

SEQ ID NO: 1630754 - RNA, 20 nt, Homo sapiens
ucuuaccagugugaccacac

SEQ ID NO: 1630755 - RNA, 20 nt, Homo sapiens
ucuuacuacuuuaaauccua

SEQ ID NO: 1630756 - RNA, 14 nt, Homo sapiens
ucuuagugugccaa

SEQ ID NO: 1630757 - RNA, 16 nt, Homo sapiens
ucuuauaaaaucaaua

SEQ ID NO: 1630758 - RNA, 14 nt, Homo sapiens
ucuucaauagcuaa

SEQ ID NO: 1630759 - RNA, 14 nt, Homo sapiens
ucuucauacuuaaa

SEQ ID NO: 1630760 - RNA, 22 nt, Homo sapiens
ucuuccgcacccucccuagcuc

SEQ ID NO: 1630761 - RNA, 22 nt, Homo sapiens
ucuuccuaccuugauugagggu

SEQ ID NO: 1630762 - RNA, 14 nt, Homo sapiens
ucuuccugcccuug

SEQ ID NO: 1630763 - RNA, 17 nt, Homo sapiens
ucuucuccccucaccca

SEQ ID NO: 1630764 - RNA, 19 nt, Homo sapiens
ucuucuccccucacccaug

SEQ ID NO: 1630765 - RNA, 17 nt, Homo sapiens
ucuucuuacuggugcua

SEQ ID NO: 1630766 - RNA, 13 nt, Homo sapiens
ucuugaagcagua

SEQ ID NO: 1630767 - RNA, 15 nt, Homo sapiens
ucuugaaguacuuaa

SEQ ID NO: 1630768 - RNA, 15 nt, Homo sapiens
ucuugaauguggucu

SEQ ID NO: 1630769 - RNA, 21 nt, Homo sapiens
ucuugacuguuaguuguccac

SEQ ID NO: 1630770 - RNA, 13 nt, Homo sapiens
ucuugaggagcuc

SEQ ID NO: 1630771 - RNA, 13 nt, Homo sapiens
ucuugaucauucc

SEQ ID NO: 1630772 - RNA, 21 nt, Homo sapiens
ucuugaucggaaagcucuucc

SEQ ID NO: 1630773 - RNA, 13 nt, Homo sapiens
ucuugcaaaagau

SEQ ID NO: 1630774 - RNA, 18 nt, Homo sapiens
ucuugcuuccaagaccau

SEQ ID NO: 1630775 - RNA, 23 nt, Homo sapiens
ucuuggaaagacacaaaaaaaga

SEQ ID NO: 1630776 - RNA, 13 nt, Homo sapiens
ucuuggacacugu

SEQ ID NO: 1630777 - RNA, 20 nt, Homo sapiens
ucuuggcucaccauaaccuc

SEQ ID NO: 1630778 - RNA, 19 nt, Homo sapiens
ucuuguguuuuugucuuau

SEQ ID NO: 1630779 - RNA, 18 nt, Homo sapiens
ucuuuaauaaauugcuua

SEQ ID NO: 1630780 - RNA, 23 nt, Homo sapiens
ucuuuccaucuaucacugcauua

SEQ ID NO: 1630781 - RNA, 23 nt, Homo sapiens
ucuuucuccucuuugagacccca

SEQ ID NO: 1630782 - RNA, 21 nt, Homo sapiens
ucuuuguuaugacagugaaua

SEQ ID NO: 1630783 - RNA, 18 nt, Homo sapiens
ucuuuguucaaauguacu

SEQ ID NO: 1630784 - RNA, 19 nt, Homo sapiens
ucuuuguuuacaugaguuc

SEQ ID NO: 1630785 - RNA, 15 nt, Homo sapiens
ucuuuuaaaguauuu

SEQ ID NO: 1630786 - RNA, 23 nt, Homo sapiens
ucuuuuggcaguucugauaagcu

SEQ ID NO: 1630787 - RNA, 14 nt, Homo sapiens
ugaaaaaguauugu

SEQ ID NO: 1630788 - RNA, 17 nt, Homo sapiens
ugaaaacaucuggaagg

SEQ ID NO: 1630789 - RNA, 10 nt, Homo sapiens
ugaaaaccua

SEQ ID NO: 1630790 - RNA, 16 nt, Homo sapiens
ugaaaaccuacauauu

SEQ ID NO: 1630791 - RNA, 18 nt, Homo sapiens
ucccaagcuagacugugu

SEQ ID NO: 1630792 - RNA, 20 nt, Homo sapiens
ucccaagcuagacugugucu

SEQ ID NO: 1630793 - RNA, 14 nt, Homo sapiens
ucccaccacaggca

SEQ ID NO: 1630794 - RNA, 17 nt, Homo sapiens
ucccagaauguuacuga

SEQ ID NO: 1630795 - RNA, 20 nt, Homo sapiens
ucccagacucccaccccagg

SEQ ID NO: 1630796 - RNA, 19 nt, Homo sapiens
ucccagagggauugcugug

SEQ ID NO: 1630797 - RNA, 21 nt, Homo sapiens
ucccagagggauugcugugaa

SEQ ID NO: 1630798 - RNA, 20 nt, Homo sapiens
ucccagcccuugcauugcag

SEQ ID NO: 1630799 - RNA, 17 nt, Homo sapiens
ucccagcugaaggcagu

SEQ ID NO: 1630800 - RNA, 16 nt, Homo sapiens
ucccaggaggugcagu

SEQ ID NO: 1630801 - RNA, 22 nt, Homo sapiens
ucccaggccucugccccaagag

SEQ ID NO: 1630802 - RNA, 13 nt, Homo sapiens
ucccagggccaug

SEQ ID NO: 1630803 - RNA, 13 nt, Homo sapiens
ucccauugccaug

SEQ ID NO: 1630804 - RNA, 13 nt, Homo sapiens
uccccaagcaccu

SEQ ID NO: 1630805 - RNA, 15 nt, Homo sapiens
uccccaagggcccug

SEQ ID NO: 1630806 - RNA, 20 nt, Homo sapiens
uccccacuucucucucccca

SEQ ID NO: 1630807 - RNA, 16 nt, Homo sapiens
uccccagcccaggaaa

SEQ ID NO: 1630808 - RNA, 23 nt, Homo sapiens
uccccauccccacccagucucau

SEQ ID NO: 1630809 - RNA, 16 nt, Homo sapiens
uccccccuccauuccc

SEQ ID NO: 1630810 - RNA, 22 nt, Homo sapiens
uccccgaaucacacagacaguu

SEQ ID NO: 1630811 - RNA, 17 nt, Homo sapiens
uccccuccgucugugac

SEQ ID NO: 1630812 - RNA, 23 nt, Homo sapiens
uccccuccgucugugacauggag

SEQ ID NO: 1630813 - RNA, 19 nt, Homo sapiens
uccccuccuuggcuuuaug

SEQ ID NO: 1630814 - RNA, 15 nt, Homo sapiens
ucccgggcccagaaa

SEQ ID NO: 1630815 - RNA, 23 nt, Homo sapiens
ucccuacacagggccugcuauug

SEQ ID NO: 1630816 - RNA, 20 nt, Homo sapiens
ucccuauuagauacacuucu

SEQ ID NO: 1630817 - RNA, 17 nt, Homo sapiens
ucccuccucacucccua

SEQ ID NO: 1630818 - RNA, 17 nt, Homo sapiens
ucccucgggugugcuau

SEQ ID NO: 1630819 - RNA, 12 nt, Homo sapiens
ucccucugaugu

SEQ ID NO: 1630820 - RNA, 22 nt, Homo sapiens
ucccucugauuuccuucugcua

SEQ ID NO: 1630821 - RNA, 14 nt, Homo sapiens
ucccucuugucagu

SEQ ID NO: 1630822 - RNA, 13 nt, Homo sapiens
ucccugaaguauu

SEQ ID NO: 1630823 - RNA, 16 nt, Homo sapiens
ucccugacacccuggg

SEQ ID NO: 1630824 - RNA, 15 nt, Homo sapiens
ucccugccccuuaac

SEQ ID NO: 1630825 - RNA, 14 nt, Homo sapiens
ucccuggagggcaa

SEQ ID NO: 1630826 - RNA, 20 nt, Homo sapiens
ucccugggccugcugcugag

SEQ ID NO: 1630827 - RNA, 18 nt, Homo sapiens
ucccuguaauauuuagcu

SEQ ID NO: 1630828 - RNA, 20 nt, Homo sapiens
ucccuguaauauuuagcugu

SEQ ID NO: 1630829 - RNA, 22 nt, Homo sapiens
ucccuuaggaauauacauaguc

SEQ ID NO: 1630830 - RNA, 19 nt, Homo sapiens
ucccuuccugggucuacca

SEQ ID NO: 1630831 - RNA, 23 nt, Homo sapiens
ucccuuuggagauuuuuuaaucc

SEQ ID NO: 1630832 - RNA, 22 nt, Homo sapiens
uccgagaugacccaaucugccu

SEQ ID NO: 1630833 - RNA, 18 nt, Homo sapiens
uccgauuccccuguagca

SEQ ID NO: 1630834 - RNA, 18 nt, Homo sapiens
uccgcuagcaguacuaau

SEQ ID NO: 1630835 - RNA, 19 nt, Homo sapiens
uccguauugaacauguaca

SEQ ID NO: 1630836 - RNA, 15 nt, Homo sapiens
uccguucaauaagca

SEQ ID NO: 1630837 - RNA, 16 nt, Homo sapiens
uccguuccucauccac

SEQ ID NO: 1630838 - RNA, 20 nt, Homo sapiens
uccuaaauaaaaaaagacaa

SEQ ID NO: 1630839 - RNA, 14 nt, Homo sapiens
uccuaagaauguga

SEQ ID NO: 1630840 - RNA, 20 nt, Homo sapiens
uccuagacucacuuguucuc

SEQ ID NO: 1630841 - RNA, 16 nt, Homo sapiens
uccuaggaugucaugu

SEQ ID NO: 1630842 - RNA, 15 nt, Homo sapiens
uccuaggucaugccu

SEQ ID NO: 1630843 - RNA, 17 nt, Homo sapiens
uccuagucuuauggaaa

SEQ ID NO: 1630844 - RNA, 12 nt, Homo sapiens
uccuaugcugca

SEQ ID NO: 1630845 - RNA, 12 nt, Homo sapiens
uccuaugugauu

SEQ ID NO: 1630846 - RNA, 14 nt, Homo sapiens
uccuauuacugaug

SEQ ID NO: 1630847 - RNA, 18 nt, Homo sapiens
uccuauuacugaugugug

SEQ ID NO: 1630848 - RNA, 19 nt, Homo sapiens
uccucaagggccaggacuu

SEQ ID NO: 1630849 - RNA, 20 nt, Homo sapiens
uccucaauuuuugucucaga

SEQ ID NO: 1630850 - RNA, 22 nt, Homo sapiens
uccucacacacccugaggucag

SEQ ID NO: 1630851 - RNA, 15 nt, Homo sapiens
uccucaguuccugca

SEQ ID NO: 1630852 - RNA, 22 nt, Homo sapiens
uccuccagcccagacccagugg

SEQ ID NO: 1630853 - RNA, 13 nt, Homo sapiens
uccucccugacuc

SEQ ID NO: 1630854 - RNA, 22 nt, Homo sapiens
uccuccuuuaccuuucagugca

SEQ ID NO: 1630855 - RNA, 16 nt, Homo sapiens
uccucgcccagaucuc

SEQ ID NO: 1630856 - RNA, 20 nt, Homo sapiens
uccucuggaucacagacacu

SEQ ID NO: 1630857 - RNA, 16 nt, Homo sapiens
uccucuuguugcugag

SEQ ID NO: 1630858 - RNA, 21 nt, Homo sapiens
uccugaccucgugaucuaccc

SEQ ID NO: 1630859 - RNA, 20 nt, Homo sapiens
uccugaguagcugggauuac

SEQ ID NO: 1630860 - RNA, 19 nt, Homo sapiens
uccugcagcaaacacucca

SEQ ID NO: 1630861 - RNA, 15 nt, Homo sapiens
uccugccucuacugg

SEQ ID NO: 1630862 - RNA, 17 nt, Homo sapiens
uccugccuugcugugaa

SEQ ID NO: 1630863 - RNA, 20 nt, Homo sapiens
uccugcgcauauagacugua

SEQ ID NO: 1630864 - RNA, 17 nt, Homo sapiens
uccugcuauuacuaagg

SEQ ID NO: 1630865 - RNA, 19 nt, Homo sapiens
uccugcugaacguuucccc

SEQ ID NO: 1630866 - RNA, 17 nt, Homo sapiens
uccuggacaaccuggac

SEQ ID NO: 1630867 - RNA, 22 nt, Homo sapiens
uccuggggaccaagauuuacca

SEQ ID NO: 1630868 - RNA, 18 nt, Homo sapiens
uccuggggcagcacuccc

SEQ ID NO: 1630869 - RNA, 18 nt, Homo sapiens
uccugggucuaccacuca

SEQ ID NO: 1630870 - RNA, 18 nt, Homo sapiens
uccuggugccaccucaga

SEQ ID NO: 1630871 - RNA, 16 nt, Homo sapiens
uccugucagaugacac

SEQ ID NO: 1630872 - RNA, 18 nt, Homo sapiens
uccuguggucucugacca

SEQ ID NO: 1630873 - RNA, 16 nt, Homo sapiens
uccuuaacacauucaa

SEQ ID NO: 1630874 - RNA, 12 nt, Homo sapiens
uccuuaaguaua

SEQ ID NO: 1630875 - RNA, 13 nt, Homo sapiens
uccuuacacuccc

SEQ ID NO: 1630876 - RNA, 23 nt, Homo sapiens
uccuuaccgucuugaucggaaag

SEQ ID NO: 1630877 - RNA, 17 nt, Homo sapiens
uccuucaccucacugaa

SEQ ID NO: 1630878 - RNA, 17 nt, Homo sapiens
uccuucaguucugcuug

SEQ ID NO: 1630879 - RNA, 18 nt, Homo sapiens
uccuuccaagcacccagc

SEQ ID NO: 1630880 - RNA, 19 nt, Homo sapiens
uccuucucucacuguguua

SEQ ID NO: 1630881 - RNA, 15 nt, Homo sapiens
uccuuguauucugag

SEQ ID NO: 1630882 - RNA, 16 nt, Homo sapiens
uccuuuuaacugccaa

SEQ ID NO: 1630883 - RNA, 20 nt, Homo sapiens
ucgaaccuugaccgacauga

SEQ ID NO: 1630884 - RNA, 21 nt, Homo sapiens
ucgaacuaaaagccuucccuu

SEQ ID NO: 1630885 - RNA, 14 nt, Homo sapiens
ucgacagacagcca

SEQ ID NO: 1630886 - RNA, 22 nt, Homo sapiens
ucggaucucacaggcugagaac

SEQ ID NO: 1630887 - RNA, 15 nt, Homo sapiens
ucggcucagugcaac

SEQ ID NO: 1630888 - RNA, 14 nt, Homo sapiens
ucggguccaugugu

SEQ ID NO: 1630889 - RNA, 18 nt, Homo sapiens
ucguuauuguuguugcca

SEQ ID NO: 1630890 - RNA, 12 nt, Homo sapiens
ucuaaaugaagc

SEQ ID NO: 1630891 - RNA, 12 nt, Homo sapiens
ucuaaaugaagu

SEQ ID NO: 1630892 - RNA, 18 nt, Homo sapiens
ucuaaauguacaaauucu

SEQ ID NO: 1630893 - RNA, 16 nt, Homo sapiens
ucuaacaaaaacuaca

SEQ ID NO: 1630894 - RNA, 20 nt, Homo sapiens
ucuaaccgaauauucaugga

SEQ ID NO: 1630895 - RNA, 18 nt, Homo sapiens
ucuaagauggauuaaaca

SEQ ID NO: 1630896 - RNA, 15 nt, Homo sapiens
gcuagcaguacuaau

SEQ ID NO: 1630897 - RNA, 16 nt, Homo sapiens
gcuagcuuucuccuua

SEQ ID NO: 1630898 - RNA, 18 nt, Homo sapiens
gcuagucgccccucagag

SEQ ID NO: 1630899 - RNA, 19 nt, Homo sapiens
gcuauguucugucuuccca

SEQ ID NO: 1630900 - RNA, 23 nt, Homo sapiens
gcucacaaccaccauucagucaa

SEQ ID NO: 1630901 - RNA, 20 nt, Homo sapiens
gcucagaauugcacaucuaa

SEQ ID NO: 1630902 - RNA, 12 nt, Homo sapiens
gcucagugcaac

SEQ ID NO: 1630903 - RNA, 15 nt, Homo sapiens
gcucaucugcaaaag

SEQ ID NO: 1630904 - RNA, 20 nt, Homo sapiens
gcucauucuucaguucucua

SEQ ID NO: 1630905 - RNA, 15 nt, Homo sapiens
gcucauugaacuuua

SEQ ID NO: 1630906 - RNA, 13 nt, Homo sapiens
gcuccaaauccaa

SEQ ID NO: 1630907 - RNA, 16 nt, Homo sapiens
gcuccagaugcagggc

SEQ ID NO: 1630908 - RNA, 17 nt, Homo sapiens
guuacugcuuugcaaag

SEQ ID NO: 1630909 - RNA, 21 nt, Homo sapiens
guuacuuuuucuuguauucau

SEQ ID NO: 1630910 - RNA, 21 nt, Homo sapiens
guuagaguuuaauuuugugaa

SEQ ID NO: 1630911 - RNA, 18 nt, Homo sapiens
guuaucaaaaaguauuau

SEQ ID NO: 1630912 - RNA, 11 nt, Homo sapiens
guuaucuguga

SEQ ID NO: 1630913 - RNA, 13 nt, Homo sapiens
guuaugacaguga

SEQ ID NO: 1630914 - RNA, 14 nt, Homo sapiens
guuaugacagugaa

SEQ ID NO: 1630915 - RNA, 21 nt, Homo sapiens
guuauucauuuggugacugug

SEQ ID NO: 1630916 - RNA, 14 nt, Homo sapiens
guucaaaagcaauc

SEQ ID NO: 1630917 - RNA, 14 nt, Homo sapiens
guucaaagacugug

SEQ ID NO: 1630918 - RNA, 14 nt, Homo sapiens
guucaauacaguga

SEQ ID NO: 1630919 - RNA, 19 nt, Homo sapiens
guucacucuucucagccac

SEQ ID NO: 1630920 - RNA, 19 nt, Homo sapiens
guucauuucacacagugaa

SEQ ID NO: 1630921 - RNA, 15 nt, Homo sapiens
guuccgagaagaaca

SEQ ID NO: 1630922 - RNA, 16 nt, Homo sapiens
guuccucuuuguuuau

SEQ ID NO: 1630923 - RNA, 21 nt, Homo sapiens
guuccugcagcagagccugga

SEQ ID NO: 1630924 - RNA, 19 nt, Homo sapiens
guuccuggcucagccucaa

SEQ ID NO: 1630925 - RNA, 19 nt, Homo sapiens
guuccuuucgaaagcaaug

SEQ ID NO: 1630926 - RNA, 21 nt, Homo sapiens
guucuuacacaggcuucauca

SEQ ID NO: 1630927 - RNA, 13 nt, Homo sapiens
guugaaauggcau

SEQ ID NO: 1630928 - RNA, 20 nt, Homo sapiens
guugcguggacucugcacau

SEQ ID NO: 1630929 - RNA, 15 nt, Homo sapiens
guugcuguaugucuc

SEQ ID NO: 1630930 - RNA, 23 nt, Homo sapiens
guuggcccagaccucaggugcua

SEQ ID NO: 1630931 - RNA, 14 nt, Homo sapiens
guuggggugacagu

SEQ ID NO: 1630932 - RNA, 13 nt, Homo sapiens
guugguaucugca

SEQ ID NO: 1630933 - RNA, 15 nt, Homo sapiens
guuuaucaagccaua

SEQ ID NO: 1630934 - RNA, 20 nt, Homo sapiens
guuuaugcauagauaaucuc

SEQ ID NO: 1630935 - RNA, 22 nt, Homo sapiens
guuuaugcauagauaaucucuc

SEQ ID NO: 1630936 - RNA, 22 nt, Homo sapiens
guuuauuccaaaugccauccag

SEQ ID NO: 1630937 - RNA, 13 nt, Homo sapiens
guuucaacaaaga

SEQ ID NO: 1630938 - RNA, 12 nt, Homo sapiens
guuucaacagag

SEQ ID NO: 1630939 - RNA, 14 nt, Homo sapiens
guuucaccaugaug

SEQ ID NO: 1630940 - RNA, 22 nt, Homo sapiens
guuucauauugaugugugucua

SEQ ID NO: 1630941 - RNA, 21 nt, Homo sapiens
guuucccaagcuagacugugu

SEQ ID NO: 1630942 - RNA, 23 nt, Homo sapiens
guuuccccuuuuaagguuucaac

SEQ ID NO: 1630943 - RNA, 18 nt, Homo sapiens
guuuccuggccucagagc

SEQ ID NO: 1630944 - RNA, 20 nt, Homo sapiens
guuucuuugacuucaaugua

SEQ ID NO: 1630945 - RNA, 15 nt, Homo sapiens
guuugauuugucuca

SEQ ID NO: 1630946 - RNA, 21 nt, Homo sapiens
guuugauuugucucauauauu

SEQ ID NO: 1630947 - RNA, 19 nt, Homo sapiens
guuuggcaaaacucaggca

SEQ ID NO: 1630948 - RNA, 23 nt, Homo sapiens
guuuugauauuuauuuuuugcca

SEQ ID NO: 1630949 - RNA, 15 nt, Homo sapiens
guuuuuaacauguca

SEQ ID NO: 1630950 - RNA, 14 nt, Homo sapiens
uaaaaaaacagacu

SEQ ID NO: 1630951 - RNA, 16 nt, Homo sapiens
uaaaaaggaacaaaua

SEQ ID NO: 1630952 - RNA, 12 nt, Homo sapiens
uaaaaaguaaug

SEQ ID NO: 1630953 - RNA, 19 nt, Homo sapiens
uaaaaauaaaaaacauaua

SEQ ID NO: 1630954 - RNA, 22 nt, Homo sapiens
uaaaaauaaaaaacauauacaa

SEQ ID NO: 1630955 - RNA, 13 nt, Homo sapiens
uaaaaaugcaaau

SEQ ID NO: 1630956 - RNA, 16 nt, Homo sapiens
uaaaacaaaauuugac

SEQ ID NO: 1630957 - RNA, 17 nt, Homo sapiens
uaaaacaaaauuugacu

SEQ ID NO: 1630958 - RNA, 13 nt, Homo sapiens
uaaaacacagaaa

SEQ ID NO: 1630959 - RNA, 14 nt, Homo sapiens
uaaaacagaagccu

SEQ ID NO: 1630960 - RNA, 18 nt, Homo sapiens
uaaaacuaaggcuuuuau

SEQ ID NO: 1630961 - RNA, 20 nt, Homo sapiens
uaaaacucacugugaucaau

SEQ ID NO: 1630962 - RNA, 13 nt, Homo sapiens
uaaaagacacagg

SEQ ID NO: 1630963 - RNA, 21 nt, Homo sapiens
uaaaagcaggagguuaucugu

SEQ ID NO: 1630964 - RNA, 20 nt, Homo sapiens
uaaaagcuacuauguacugc

SEQ ID NO: 1630965 - RNA, 22 nt, Homo sapiens
uaaaagcuacuauguacugccu

SEQ ID NO: 1630966 - RNA, 21 nt, Homo sapiens
uaaaaguuuuuuauuaugcau

SEQ ID NO: 1630967 - RNA, 23 nt, Homo sapiens
uaaaaguuuuuuauuaugcauua

SEQ ID NO: 1630968 - RNA, 15 nt, Homo sapiens
uaaaauaacuaagca

SEQ ID NO: 1630969 - RNA, 17 nt, Homo sapiens
uaaaauaacuaagcaag

SEQ ID NO: 1630970 - RNA, 15 nt, Homo sapiens
uaaaaucaauaagag

SEQ ID NO: 1630971 - RNA, 15 nt, Homo sapiens
uaaaauccauccaau

SEQ ID NO: 1630972 - RNA, 12 nt, Homo sapiens
uaaaaucucaaa

SEQ ID NO: 1630973 - RNA, 15 nt, Homo sapiens
uaaaaugaacaucuc

SEQ ID NO: 1630974 - RNA, 22 nt, Homo sapiens
uaaaaugaaguggugagcuuaa

SEQ ID NO: 1630975 - RNA, 23 nt, Homo sapiens
uaaaauuagaaucugaguauaaa

SEQ ID NO: 1630976 - RNA, 15 nt, Homo sapiens
uaaaauucuauuaua

SEQ ID NO: 1630977 - RNA, 20 nt, Homo sapiens
uaaaauucuauuauacuaca

SEQ ID NO: 1630978 - RNA, 19 nt, Homo sapiens
uaaaauucucauuacucuu

SEQ ID NO: 1630979 - RNA, 20 nt, Homo sapiens
uaaacacacagaucugcauc

SEQ ID NO: 1630980 - RNA, 16 nt, Homo sapiens
uaaacauugugaucau

SEQ ID NO: 1630981 - RNA, 13 nt, Homo sapiens
uaaaccuccauac

SEQ ID NO: 1630982 - RNA, 13 nt, Homo sapiens
uaaacuacugauu

SEQ ID NO: 1630983 - RNA, 21 nt, Homo sapiens
uaaacuaggauugacauucua

SEQ ID NO: 1630984 - RNA, 20 nt, Homo sapiens
uaaacugaauauaaagcuua

SEQ ID NO: 1630985 - RNA, 20 nt, Homo sapiens
uaaacuuacuuaguguuaug

SEQ ID NO: 1630986 - RNA, 13 nt, Homo sapiens
uaaagcagaggau

SEQ ID NO: 1630987 - RNA, 15 nt, Homo sapiens
uaaagccauguuucc

SEQ ID NO: 1630988 - RNA, 18 nt, Homo sapiens
uaaaggggagaccucaga

SEQ ID NO: 1630989 - RNA, 16 nt, Homo sapiens
uaaaguaaugaucuca

SEQ ID NO: 1630990 - RNA, 20 nt, Homo sapiens
uaaaguugguucacuucaaa

SEQ ID NO: 1630991 - RNA, 16 nt, Homo sapiens
uaaauaaaaauaugua

SEQ ID NO: 1630992 - RNA, 13 nt, Homo sapiens
uaaauaagaucag

SEQ ID NO: 1630993 - RNA, 17 nt, Homo sapiens
uaaauaagaucagacuc

SEQ ID NO: 1630994 - RNA, 18 nt, Homo sapiens
uaaauaagaucagacucu

SEQ ID NO: 1630995 - RNA, 17 nt, Homo sapiens
uaaauaccaguacuuga

SEQ ID NO: 1630996 - RNA, 13 nt, Homo sapiens
uaaauauugcucu

SEQ ID NO: 1630997 - RNA, 15 nt, Homo sapiens
uaaauccaugguguu

SEQ ID NO: 1630998 - RNA, 15 nt, Homo sapiens
uaaauguucuaauaa

SEQ ID NO: 1630999 - RNA, 13 nt, Homo sapiens
uaaauuccacacu

SEQ ID NO: 1631000 - RNA, 19 nt, Homo sapiens
uaaauuccacagauuauca

SEQ ID NO: 1631001 - RNA, 13 nt, Homo sapiens
uaacaaauaaaua

SEQ ID NO: 1631002 - RNA, 14 nt, Homo sapiens
uaacaaauguggcu

SEQ ID NO: 1631003 - RNA, 20 nt, Homo sapiens
uaacaacaauaacacugucu

SEQ ID NO: 1631004 - RNA, 20 nt, Homo sapiens
uaacaagucgaugaacuauu

SEQ ID NO: 1631005 - RNA, 21 nt, Homo sapiens
uaacacccuuuagaaccuuaa

SEQ ID NO: 1631006 - RNA, 14 nt, Homo sapiens
uaacacggugcuca

SEQ ID NO: 1631007 - RNA, 18 nt, Homo sapiens
uaacacucagaagccugg

SEQ ID NO: 1631008 - RNA, 15 nt, Homo sapiens
uaacagaugcaaugu

SEQ ID NO: 1631009 - RNA, 19 nt, Homo sapiens
uaacaugcccuguucagcu

SEQ ID NO: 1631010 - RNA, 19 nt, Homo sapiens
uaacauggacugcuucauc

SEQ ID NO: 1631011 - RNA, 15 nt, Homo sapiens
uaacauuuaaauucc

SEQ ID NO: 1631012 - RNA, 16 nt, Homo sapiens
uaacauuuaaauucca

SEQ ID NO: 1631013 - RNA, 22 nt, Homo sapiens
aaauaucauucuuuguaucuua

SEQ ID NO: 1631014 - RNA, 18 nt, Homo sapiens
aaauauuacucaguuuau

SEQ ID NO: 1631015 - RNA, 19 nt, Homo sapiens
aaauauuagaagccugcag

SEQ ID NO: 1631016 - RNA, 18 nt, Homo sapiens
aaaucagaccuggcugcu

SEQ ID NO: 1631017 - RNA, 18 nt, Homo sapiens
aaaucauauuaguauuaa

SEQ ID NO: 1631018 - RNA, 18 nt, Homo sapiens
aaauccaaggaaacaugc

SEQ ID NO: 1631019 - RNA, 14 nt, Homo sapiens
aaaucccucucaca

SEQ ID NO: 1631020 - RNA, 15 nt, Homo sapiens
aaauccuaccaaagu

SEQ ID NO: 1631021 - RNA, 13 nt, Homo sapiens
aaauccuauguga

SEQ ID NO: 1631022 - RNA, 16 nt, Homo sapiens
aaauccucaggugauu

SEQ ID NO: 1631023 - RNA, 19 nt, Homo sapiens
aaaucucuacugcuuugga

SEQ ID NO: 1631024 - RNA, 22 nt, Homo sapiens
aaaugcaauguaagcauacuuu

SEQ ID NO: 1631025 - RNA, 16 nt, Homo sapiens
aaaugcagaaccacaa

SEQ ID NO: 1631026 - RNA, 23 nt, Homo sapiens
aaaugcugguuuuucaguuuuca

SEQ ID NO: 1631027 - RNA, 15 nt, Homo sapiens
aaauggccaaauaua

SEQ ID NO: 1631028 - RNA, 21 nt, Homo sapiens
aaauggugggauuacaggugu

SEQ ID NO: 1631029 - RNA, 13 nt, Homo sapiens
aaauguacacuuu

SEQ ID NO: 1631030 - RNA, 23 nt, Homo sapiens
aaauguaggcuuucauguugcaa

SEQ ID NO: 1631031 - RNA, 16 nt, Homo sapiens
aaauguauccagucug

SEQ ID NO: 1631032 - RNA, 15 nt, Homo sapiens
aaaugucucauguca

SEQ ID NO: 1631033 - RNA, 14 nt, Homo sapiens
aaaugugauacauu

SEQ ID NO: 1631034 - RNA, 15 nt, Homo sapiens
aaauguguacaguga

SEQ ID NO: 1631035 - RNA, 18 nt, Homo sapiens
aaaugugucaccccagag

SEQ ID NO: 1631036 - RNA, 15 nt, Homo sapiens
aaauguuaacuacau

SEQ ID NO: 1631037 - RNA, 20 nt, Homo sapiens
aaauuagaaaguagccacgu

SEQ ID NO: 1631038 - RNA, 15 nt, Homo sapiens
aaauuauuucucuca

SEQ ID NO: 1631039 - RNA, 20 nt, Homo sapiens
aaauuauuugaaaacauaua

SEQ ID NO: 1631040 - RNA, 13 nt, Homo sapiens
aaauuccacagau

SEQ ID NO: 1631041 - RNA, 15 nt, Homo sapiens
aaauuccacagauua

SEQ ID NO: 1631042 - RNA, 16 nt, Homo sapiens
aaauuccacagauuau

SEQ ID NO: 1631043 - RNA, 22 nt, Homo sapiens
aaauuccccaagcaccuucccc

SEQ ID NO: 1631044 - RNA, 13 nt, Homo sapiens
aaauugcucccua

SEQ ID NO: 1631045 - RNA, 20 nt, Homo sapiens
aaauuucucaucacagggau

SEQ ID NO: 1631046 - RNA, 23 nt, Homo sapiens
aaauuucuuaaucggugcauuga

SEQ ID NO: 1631047 - RNA, 14 nt, Homo sapiens
aaauuugaaugaca

SEQ ID NO: 1631048 - RNA, 21 nt, Homo sapiens
aaauuuggcuucuguugucac

SEQ ID NO: 1631049 - RNA, 13 nt, Homo sapiens
aacaaaaagguaa

SEQ ID NO: 1631050 - RNA, 16 nt, Homo sapiens
aacaaagcagccacga

SEQ ID NO: 1631051 - RNA, 17 nt, Homo sapiens
aacaaauuucauugcac

SEQ ID NO: 1631052 - RNA, 13 nt, Homo sapiens
aacaacacaaaag

SEQ ID NO: 1631053 - RNA, 21 nt, Homo sapiens
aacaaccguuggaaacauaac

SEQ ID NO: 1631054 - RNA, 12 nt, Homo sapiens
aacaaccugcug

SEQ ID NO: 1631055 - RNA, 14 nt, Homo sapiens
aacaccacuuaauc

SEQ ID NO: 1631056 - RNA, 20 nt, Homo sapiens
aacacugucacuagucucac

SEQ ID NO: 1631057 - RNA, 12 nt, Homo sapiens
aacagaaaccau

SEQ ID NO: 1631058 - RNA, 13 nt, Homo sapiens
aacagacugaccu

SEQ ID NO: 1631059 - RNA, 13 nt, Homo sapiens
aacagauaauccc

SEQ ID NO: 1631060 - RNA, 22 nt, Homo sapiens
aacagauaaucccuguauuuca

SEQ ID NO: 1631061 - RNA, 17 nt, Homo sapiens
aacagcuugcugucacu

SEQ ID NO: 1631062 - RNA, 17 nt, Homo sapiens
aacagguaaaacagggc

SEQ ID NO: 1631063 - RNA, 18 nt, Homo sapiens
aacagguaaaacagggcc

SEQ ID NO: 1631064 - RNA, 13 nt, Homo sapiens
aacaguccaaacu

SEQ ID NO: 1631065 - RNA, 12 nt, Homo sapiens
aacaguugcauu

SEQ ID NO: 1631066 - RNA, 19 nt, Homo sapiens
aacaguugcauuuagcuuc

SEQ ID NO: 1631067 - RNA, 21 nt, Homo sapiens
aacauccaaaagcaaccacaa

SEQ ID NO: 1631068 - RNA, 15 nt, Homo sapiens
aacaugaaaacaauu

SEQ ID NO: 1631069 - RNA, 15 nt, Homo sapiens
aacaugcaccuugcu

SEQ ID NO: 1631070 - RNA, 22 nt, Homo sapiens
aacauguuccuuauauuuacuc

SEQ ID NO: 1631071 - RNA, 21 nt, Homo sapiens
aacauuuaaauuccacagauu

SEQ ID NO: 1631072 - RNA, 17 nt, Homo sapiens
aaccaggacccugucca

SEQ ID NO: 1631073 - RNA, 12 nt, Homo sapiens
aaccagugccaa

SEQ ID NO: 1631074 - RNA, 13 nt, Homo sapiens
aaccagugccaag

SEQ ID NO: 1631075 - RNA, 23 nt, Homo sapiens
aaccaguuucuaucccuuaccug

SEQ ID NO: 1631076 - RNA, 13 nt, Homo sapiens
aaccaucacauga

SEQ ID NO: 1631077 - RNA, 13 nt, Homo sapiens
aaccaugccuuuu

SEQ ID NO: 1631078 - RNA, 20 nt, Homo sapiens
aacccaggaggcggagguug

SEQ ID NO: 1631079 - RNA, 17 nt, Homo sapiens
aacccauucccucucca

SEQ ID NO: 1631080 - RNA, 11 nt, Homo sapiens
aaccccagugg

SEQ ID NO: 1631081 - RNA, 18 nt, Homo sapiens
aacccucuggggagcuca

SEQ ID NO: 1631082 - RNA, 20 nt, Homo sapiens
aaccucaagugauccuccca

SEQ ID NO: 1631083 - RNA, 15 nt, Homo sapiens
aaccucuguucccca

SEQ ID NO: 1631084 - RNA, 12 nt, Homo sapiens
aaccuggaccca

SEQ ID NO: 1631085 - RNA, 19 nt, Homo sapiens
aaccuggggugaauacuua

SEQ ID NO: 1631086 - RNA, 22 nt, Homo sapiens
aaccuuaaagaaccaucagcau

SEQ ID NO: 1631087 - RNA, 22 nt, Homo sapiens
aaccuuacuaauuauacuacuu

SEQ ID NO: 1631088 - RNA, 18 nt, Homo sapiens
aaccuugaccgacaugaa

SEQ ID NO: 1631089 - RNA, 16 nt, Homo sapiens
aaccuuuugcuccuau

SEQ ID NO: 1631090 - RNA, 19 nt, Homo sapiens
aacgccuucccuaagucac

SEQ ID NO: 1631091 - RNA, 15 nt, Homo sapiens
aacguugacaaguuu

SEQ ID NO: 1631092 - RNA, 23 nt, Homo sapiens
aacuaagcaaguauauuuauuuc

SEQ ID NO: 1631093 - RNA, 16 nt, Homo sapiens
aacuaaucaccauauu

SEQ ID NO: 1631094 - RNA, 12 nt, Homo sapiens
aacuaaugauaa

SEQ ID NO: 1631095 - RNA, 19 nt, Homo sapiens
aacuacccagguauuacac

SEQ ID NO: 1631096 - RNA, 17 nt, Homo sapiens
aacuaugagcuugcuca

SEQ ID NO: 1631097 - RNA, 18 nt, Homo sapiens
aacuaugcuuuagaacuu

SEQ ID NO: 1631098 - RNA, 16 nt, Homo sapiens
aacucacucugggcug

SEQ ID NO: 1631099 - RNA, 14 nt, Homo sapiens
aacucacugugauc

SEQ ID NO: 1631100 - RNA, 19 nt, Homo sapiens
aacuccaugcaaaccaugc

SEQ ID NO: 1631101 - RNA, 14 nt, Homo sapiens
aacucggggacaaa

SEQ ID NO: 1631102 - RNA, 21 nt, Homo sapiens
aacugaacagaaccacaaaaa

SEQ ID NO: 1631103 - RNA, 13 nt, Homo sapiens
aacugaaggcaga

SEQ ID NO: 1631104 - RNA, 20 nt, Homo sapiens
aacugaagugugcugugaca

SEQ ID NO: 1631105 - RNA, 14 nt, Homo sapiens
aacugauuuaucua

SEQ ID NO: 1631106 - RNA, 14 nt, Homo sapiens
aacugccacagaua

SEQ ID NO: 1631107 - RNA, 18 nt, Homo sapiens
aacuggccaagcugaggu

SEQ ID NO: 1631108 - RNA, 17 nt, Homo sapiens
aacuguaccaugugcua

SEQ ID NO: 1631109 - RNA, 19 nt, Homo sapiens
aacuguaccaugugcuaca

SEQ ID NO: 1631110 - RNA, 18 nt, Homo sapiens
aacuguaugggagcuuaa

SEQ ID NO: 1631111 - RNA, 16 nt, Homo sapiens
aacuuacuuaguguua

SEQ ID NO: 1631112 - RNA, 20 nt, Homo sapiens
aacuuccuacguauccugca

SEQ ID NO: 1631113 - RNA, 13 nt, Homo sapiens
aacuucuugucag

SEQ ID NO: 1631114 - RNA, 19 nt, Homo sapiens
aacuucuugucagacauaa

SEQ ID NO: 1631115 - RNA, 19 nt, Homo sapiens
aacuucuuuccucuggaga

SEQ ID NO: 1631116 - RNA, 16 nt, Homo sapiens
aacuugguucugaaua

SEQ ID NO: 1631117 - RNA, 13 nt, Homo sapiens
aagaaaauggauu

SEQ ID NO: 1631118 - RNA, 17 nt, Homo sapiens
aagaaacuaaacagaaa

SEQ ID NO: 1631119 - RNA, 23 nt, Homo sapiens
aagaaacuaaacagaaaacuccc

SEQ ID NO: 1631120 - RNA, 19 nt, Homo sapiens
aagaaauccaguuuguguu

SEQ ID NO: 1631121 - RNA, 11 nt, Homo sapiens
aagaaaugcaa

SEQ ID NO: 1631122 - RNA, 15 nt, Homo sapiens
aagaaccauugauuu

SEQ ID NO: 1631123 - RNA, 14 nt, Homo sapiens
aagaacucucugga

SEQ ID NO: 1631124 - RNA, 20 nt, Homo sapiens
aauucuuacccuguacauau

SEQ ID NO: 1631125 - RNA, 21 nt, Homo sapiens
aauucuugaaagaauuuuccu

SEQ ID NO: 1631126 - RNA, 22 nt, Homo sapiens
aauugaagaaagucagcucuug

SEQ ID NO: 1631127 - RNA, 23 nt, Homo sapiens
aauugacagaucaagcugugaga

SEQ ID NO: 1631128 - RNA, 15 nt, Homo sapiens
aauuguaaauccugu

SEQ ID NO: 1631129 - RNA, 16 nt, Homo sapiens
aauugugcaguacuuu

SEQ ID NO: 1631130 - RNA, 17 nt, Homo sapiens
aauuguuaaacuugcag

SEQ ID NO: 1631131 - RNA, 15 nt, Homo sapiens
aauuguuuugcacuu

SEQ ID NO: 1631132 - RNA, 20 nt, Homo sapiens
aauuuaauacagacaucuaa

SEQ ID NO: 1631133 - RNA, 14 nt, Homo sapiens
aauuucauguguau

SEQ ID NO: 1631134 - RNA, 15 nt, Homo sapiens
aauuucauugaacua

SEQ ID NO: 1631135 - RNA, 12 nt, Homo sapiens
aauuuccuugac

SEQ ID NO: 1631136 - RNA, 24 nt, Homo sapiens
aauuugugguccacugagcuauaa

SEQ ID NO: 1631137 - RNA, 14 nt, Homo sapiens
aauuuucuacaaau

SEQ ID NO: 1631138 - RNA, 21 nt, Homo sapiens
aauuuucuagauuuucuacuu

SEQ ID NO: 1631139 - RNA, 13 nt, Homo sapiens
aauuuugcuccuu

SEQ ID NO: 1631140 - RNA, 16 nt, Homo sapiens
aauuuuguugcuacau

SEQ ID NO: 1631141 - RNA, 21 nt, Homo sapiens
aauuuuugaaaaaaguacaua

SEQ ID NO: 1631142 - RNA, 16 nt, Homo sapiens
aauuuuugaaaacugg

SEQ ID NO: 1631143 - RNA, 22 nt, Homo sapiens
acaaaaccuuuaaucugcaccu

SEQ ID NO: 1631144 - RNA, 21 nt, Homo sapiens
acaaaagaaggucaaacugug

SEQ ID NO: 1631145 - RNA, 12 nt, Homo sapiens
acaaaagucugu

SEQ ID NO: 1631146 - RNA, 16 nt, Homo sapiens
acaaaauggacauggu

SEQ ID NO: 1631147 - RNA, 20 nt, Homo sapiens
acaaacaugauacugcugcu

SEQ ID NO: 1631148 - RNA, 15 nt, Homo sapiens
acaaaccaagccaug

SEQ ID NO: 1631149 - RNA, 18 nt, Homo sapiens
acaaaccugcacuuauac

SEQ ID NO: 1631150 - RNA, 21 nt, Homo sapiens
acaaagaagguuaccaagaag

SEQ ID NO: 1631151 - RNA, 21 nt, Homo sapiens
acaaagaauuuaaaauaacac

SEQ ID NO: 1631152 - RNA, 21 nt, Homo sapiens
acaaagagaaugagaagacau

SEQ ID NO: 1631153 - RNA, 14 nt, Homo sapiens
acaaauaauuuuag

SEQ ID NO: 1631154 - RNA, 14 nt, Homo sapiens
acaaauacaugugu

SEQ ID NO: 1631155 - RNA, 13 nt, Homo sapiens
acaaauauacauu

SEQ ID NO: 1631156 - RNA, 22 nt, Homo sapiens
acaaauauggggaaaaaacugu

SEQ ID NO: 1631157 - RNA, 23 nt, Homo sapiens
acaaauggggacaggaaggauca

SEQ ID NO: 1631158 - RNA, 19 nt, Homo sapiens
acaacaucaccagugccac

SEQ ID NO: 1631159 - RNA, 17 nt, Homo sapiens
acaacauuauaacugua

SEQ ID NO: 1631160 - RNA, 15 nt, Homo sapiens
acaagcugcauuuca

SEQ ID NO: 1631161 - RNA, 20 nt, Homo sapiens
acaagguccucugucaguca

SEQ ID NO: 1631162 - RNA, 18 nt, Homo sapiens
acaaguauggcuccucca

SEQ ID NO: 1631163 - RNA, 17 nt, Homo sapiens
acaagucgaugaacuau

SEQ ID NO: 1631164 - RNA, 15 nt, Homo sapiens
acaaucagcccagug

SEQ ID NO: 1631165 - RNA, 16 nt, Homo sapiens
acaaucagcccagugc

SEQ ID NO: 1631166 - RNA, 19 nt, Homo sapiens
acaaucagcccagugcaaa

SEQ ID NO: 1631167 - RNA, 19 nt, Homo sapiens
acaauuccuccucuggcca

SEQ ID NO: 1631168 - RNA, 23 nt, Homo sapiens
acaauugguaaaacucacuguga

SEQ ID NO: 1631169 - RNA, 13 nt, Homo sapiens
acacaaagcacau

SEQ ID NO: 1631170 - RNA, 17 nt, Homo sapiens
acacaaaggaaguccaa

SEQ ID NO: 1631171 - RNA, 23 nt, Homo sapiens
acacaaaggaaguccaaccugag

SEQ ID NO: 1631172 - RNA, 12 nt, Homo sapiens
acacaacacaga

SEQ ID NO: 1631173 - RNA, 19 nt, Homo sapiens
acacaauuguuuuaccugu

SEQ ID NO: 1631174 - RNA, 16 nt, Homo sapiens
acacacauugcagcuu

SEQ ID NO: 1631175 - RNA, 20 nt, Homo sapiens
acacacccauguaaccacug

SEQ ID NO: 1631176 - RNA, 16 nt, Homo sapiens
acacacccugagguca

SEQ ID NO: 1631177 - RNA, 21 nt, Homo sapiens
acacacuucggcucucuggac

SEQ ID NO: 1631178 - RNA, 22 nt, Homo sapiens
acacacuucggcucucuggaca

SEQ ID NO: 1631179 - RNA, 22 nt, Homo sapiens
acacagcccuggccucugcuca

SEQ ID NO: 1631180 - RNA, 15 nt, Homo sapiens
acacaggcauggcua

SEQ ID NO: 1631181 - RNA, 17 nt, Homo sapiens
acacaggcuucaucaag

SEQ ID NO: 1631182 - RNA, 11 nt, Homo sapiens
acacagugaaa

SEQ ID NO: 1631183 - RNA, 17 nt, Homo sapiens
acacauacagagugggc

SEQ ID NO: 1631184 - RNA, 17 nt, Homo sapiens
acacaucaggaguucaa

SEQ ID NO: 1631185 - RNA, 18 nt, Homo sapiens
acacaugcacacaugugc

SEQ ID NO: 1631186 - RNA, 16 nt, Homo sapiens
acacaugcccaugaug

SEQ ID NO: 1631187 - RNA, 20 nt, Homo sapiens
acacaugcuauguucugucu

SEQ ID NO: 1631188 - RNA, 19 nt, Homo sapiens
acaccauucaggucuuucu

SEQ ID NO: 1631189 - RNA, 19 nt, Homo sapiens
acacccccaugacauugca

SEQ ID NO: 1631190 - RNA, 13 nt, Homo sapiens
acaccugagacau

SEQ ID NO: 1631191 - RNA, 14 nt, Homo sapiens
acaccugccuucaa

SEQ ID NO: 1631192 - RNA, 19 nt, Homo sapiens
acacgcaccugccucagga

SEQ ID NO: 1631193 - RNA, 13 nt, Homo sapiens
acacggcacauuu

SEQ ID NO: 1631194 - RNA, 19 nt, Homo sapiens
acacuagucagaaaauugg

SEQ ID NO: 1631195 - RNA, 21 nt, Homo sapiens
acacugcacagaccuuaggga

SEQ ID NO: 1631196 - RNA, 23 nt, Homo sapiens
acacuggauuuguuucugugauc

SEQ ID NO: 1631197 - RNA, 12 nt, Homo sapiens
acacuguacaag

SEQ ID NO: 1631198 - RNA, 18 nt, Homo sapiens
acacugucacuagucuca

SEQ ID NO: 1631199 - RNA, 19 nt, Homo sapiens
acacugucacuagucucac

SEQ ID NO: 1631200 - RNA, 16 nt, Homo sapiens
acacuguuacgaugca

SEQ ID NO: 1631201 - RNA, 15 nt, Homo sapiens
acacuguuucaucuc

SEQ ID NO: 1631202 - RNA, 22 nt, Homo sapiens
acacuucgcucuugaggagcuc

SEQ ID NO: 1631203 - RNA, 14 nt, Homo sapiens
acacuuggaugcag

SEQ ID NO: 1631204 - RNA, 12 nt, Homo sapiens
acacuuuugcuu

SEQ ID NO: 1631205 - RNA, 18 nt, Homo sapiens
acagaaaauacgagaaaa

SEQ ID NO: 1631206 - RNA, 22 nt, Homo sapiens
acagaacuuuuccucuguauca

SEQ ID NO: 1631207 - RNA, 14 nt, Homo sapiens
acagaagcuguuuu

SEQ ID NO: 1631208 - RNA, 15 nt, Homo sapiens
acagaagucuccuca

SEQ ID NO: 1631209 - RNA, 14 nt, Homo sapiens
acagacaaagcaua

SEQ ID NO: 1631210 - RNA, 13 nt, Homo sapiens
acagacacugcac

SEQ ID NO: 1631211 - RNA, 16 nt, Homo sapiens
acagacacugcacaga

SEQ ID NO: 1631212 - RNA, 19 nt, Homo sapiens
acagagaaguuuguagcca

SEQ ID NO: 1631213 - RNA, 22 nt, Homo sapiens
acagaggaauuuauaccucaaa

SEQ ID NO: 1631214 - RNA, 22 nt, Homo sapiens
acagaguugccaggcacuuuga

SEQ ID NO: 1631215 - RNA, 23 nt, Homo sapiens
acagauaaugcuuuuacuaagca

SEQ ID NO: 1631216 - RNA, 17 nt, Homo sapiens
acagauagauguugcuc

SEQ ID NO: 1631217 - RNA, 17 nt, Homo sapiens
acagcaaccucuucaug

SEQ ID NO: 1631218 - RNA, 23 nt, Homo sapiens
acagcaaccucuucaugagcuug

SEQ ID NO: 1631219 - RNA, 13 nt, Homo sapiens
acagcacagccaa

SEQ ID NO: 1631220 - RNA, 15 nt, Homo sapiens
acagcagucagggac

SEQ ID NO: 1631221 - RNA, 14 nt, Homo sapiens
acagcauacuucaa

SEQ ID NO: 1631222 - RNA, 16 nt, Homo sapiens
acagcaugugccuuaa

SEQ ID NO: 1631223 - RNA, 15 nt, Homo sapiens
acagcccagagccug

SEQ ID NO: 1631224 - RNA, 17 nt, Homo sapiens
acagcgcuaaggauggu

SEQ ID NO: 1631225 - RNA, 23 nt, Homo sapiens
acagcggaaagcccugugcucca

SEQ ID NO: 1631226 - RNA, 17 nt, Homo sapiens
acaggaaagccaggcca

SEQ ID NO: 1631227 - RNA, 20 nt, Homo sapiens
acaggaauggaacacacuug

SEQ ID NO: 1631228 - RNA, 15 nt, Homo sapiens
acaggaccaccuccu

SEQ ID NO: 1631229 - RNA, 20 nt, Homo sapiens
acaggaccaccuccucugcc

SEQ ID NO: 1631230 - RNA, 13 nt, Homo sapiens
acaggcacuauaa

SEQ ID NO: 1631231 - RNA, 13 nt, Homo sapiens
acaggcacuccaa

SEQ ID NO: 1631232 - RNA, 22 nt, Homo sapiens
acaggcagccagccguggccag

SEQ ID NO: 1631233 - RNA, 20 nt, Homo sapiens
acaggccauggauggaaaac

SEQ ID NO: 1631234 - RNA, 16 nt, Homo sapiens
caaaugcucucucaaa

SEQ ID NO: 1631235 - RNA, 17 nt, Homo sapiens
caaaugugauacauuua

SEQ ID NO: 1631236 - RNA, 21 nt, Homo sapiens
caaauucggauguaugaucuc

SEQ ID NO: 1631237 - RNA, 22 nt, Homo sapiens
caaauucggauguaugaucucu

SEQ ID NO: 1631238 - RNA, 15 nt, Homo sapiens
caaauuucauugcac

SEQ ID NO: 1631239 - RNA, 13 nt, Homo sapiens
caacacagaggaa

SEQ ID NO: 1631240 - RNA, 15 nt, Homo sapiens
caacagucaccucac

SEQ ID NO: 1631241 - RNA, 23 nt, Homo sapiens
caacccgagucauucguucugug

SEQ ID NO: 1631242 - RNA, 14 nt, Homo sapiens
caaccgccucaaaa

SEQ ID NO: 1631243 - RNA, 15 nt, Homo sapiens
caaccuggacccaga

SEQ ID NO: 1631244 - RNA, 13 nt, Homo sapiens
caacgaaaagcac

SEQ ID NO: 1631245 - RNA, 12 nt, Homo sapiens
caacgccagaau

SEQ ID NO: 1631246 - RNA, 14 nt, Homo sapiens
caacuaauacaugg

SEQ ID NO: 1631247 - RNA, 15 nt, Homo sapiens
caacuaauacauggu

SEQ ID NO: 1631248 - RNA, 12 nt, Homo sapiens
caacuaccugag

SEQ ID NO: 1631249 - RNA, 21 nt, Homo sapiens
caacuacuauucaaaaccuca

SEQ ID NO: 1631250 - RNA, 15 nt, Homo sapiens
caacucuguacaaag

SEQ ID NO: 1631251 - RNA, 17 nt, Homo sapiens
caacucuguaucuccag

SEQ ID NO: 1631252 - RNA, 23 nt, Homo sapiens
caacugucuuagacugcuagcuu

SEQ ID NO: 1631253 - RNA, 15 nt, Homo sapiens
caagaggcuccugaa

SEQ ID NO: 1631254 - RNA, 20 nt, Homo sapiens
caagauggacacgagccaca

SEQ ID NO: 1631255 - RNA, 19 nt, Homo sapiens
caagcaccugcaugugcug

SEQ ID NO: 1631256 - RNA, 21 nt, Homo sapiens
caagcauggucccacaucccu

SEQ ID NO: 1631257 - RNA, 21 nt, Homo sapiens
caagcauuucaugaaaaagcu

SEQ ID NO: 1631258 - RNA, 14 nt, Homo sapiens
caaggaaacaugca

SEQ ID NO: 1631259 - RNA, 15 nt, Homo sapiens
caaggacucuuccac

SEQ ID NO: 1631260 - RNA, 16 nt, Homo sapiens
caagggacccaugagu

SEQ ID NO: 1631261 - RNA, 13 nt, Homo sapiens
caagguaacugua

SEQ ID NO: 1631262 - RNA, 20 nt, Homo sapiens
caaggucaugccacugcacu

SEQ ID NO: 1631263 - RNA, 22 nt, Homo sapiens
caaguauauuuauuucuagcaa

SEQ ID NO: 1631264 - RNA, 16 nt, Homo sapiens
caaguauuuucuacua

SEQ ID NO: 1631265 - RNA, 22 nt, Homo sapiens
caagucccuuugugacuucaag

SEQ ID NO: 1631266 - RNA, 16 nt, Homo sapiens
caaguccucacucuuc

SEQ ID NO: 1631267 - RNA, 18 nt, Homo sapiens
caaguccucacucuucaa

SEQ ID NO: 1631268 - RNA, 15 nt, Homo sapiens
caagucgaugaacua

SEQ ID NO: 1631269 - RNA, 15 nt, Homo sapiens
caagugauccuccca

SEQ ID NO: 1631270 - RNA, 14 nt, Homo sapiens
caagugcacugagc

SEQ ID NO: 1631271 - RNA, 15 nt, Homo sapiens
caaguggucugggac

SEQ ID NO: 1631272 - RNA, 14 nt, Homo sapiens
caagugucaccucc

SEQ ID NO: 1631273 - RNA, 13 nt, Homo sapiens
caaguuccugaua

SEQ ID NO: 1631274 - RNA, 20 nt, Homo sapiens
caaguucuuagggcacauga

SEQ ID NO: 1631275 - RNA, 17 nt, Homo sapiens
caauaaaguuguugcau

SEQ ID NO: 1631276 - RNA, 19 nt, Homo sapiens
caauaaaguuguugcauuc

SEQ ID NO: 1631277 - RNA, 19 nt, Homo sapiens
caauaaauaccagacacgu

SEQ ID NO: 1631278 - RNA, 18 nt, Homo sapiens
caauaaauguugcaaugc

SEQ ID NO: 1631279 - RNA, 14 nt, Homo sapiens
caauaacacugucu

SEQ ID NO: 1631280 - RNA, 15 nt, Homo sapiens
caauaacacugucuc

SEQ ID NO: 1631281 - RNA, 16 nt, Homo sapiens
caauacaaagaugacu

SEQ ID NO: 1631282 - RNA, 15 nt, Homo sapiens
caauagcauaucaca

SEQ ID NO: 1631283 - RNA, 19 nt, Homo sapiens
caauagcauaucacagaga

SEQ ID NO: 1631284 - RNA, 19 nt, Homo sapiens
caauaguuagaucuacccu

SEQ ID NO: 1631285 - RNA, 16 nt, Homo sapiens
caauauuaaguccaaa

SEQ ID NO: 1631286 - RNA, 21 nt, Homo sapiens
caauauuaaguccaaauccaa

SEQ ID NO: 1631287 - RNA, 17 nt, Homo sapiens
caauauuccuaugcugc

SEQ ID NO: 1631288 - RNA, 21 nt, Homo sapiens
caauauuuuuauaucaugcaa

SEQ ID NO: 1631289 - RNA, 22 nt, Homo sapiens
caauauuuuuauaucaugcaaa

SEQ ID NO: 1631290 - RNA, 17 nt, Homo sapiens
caaucauuuauucauug

SEQ ID NO: 1631291 - RNA, 15 nt, Homo sapiens
caauccuagugcuuu

SEQ ID NO: 1631292 - RNA, 19 nt, Homo sapiens
caaucucagcucacugcaa

SEQ ID NO: 1631293 - RNA, 14 nt, Homo sapiens
caaucuuugacaau

SEQ ID NO: 1631294 - RNA, 15 nt, Homo sapiens
caaugcccagaucaa

SEQ ID NO: 1631295 - RNA, 14 nt, Homo sapiens
caauguaagcauac

SEQ ID NO: 1631296 - RNA, 19 nt, Homo sapiens
caauguauugagcauguga

SEQ ID NO: 1631297 - RNA, 18 nt, Homo sapiens
caaugucucuuugugcuc

SEQ ID NO: 1631298 - RNA, 15 nt, Homo sapiens
caauuaagcagcuug

SEQ ID NO: 1631299 - RNA, 19 nt, Homo sapiens
caauuacuggcucacuggc

SEQ ID NO: 1631300 - RNA, 18 nt, Homo sapiens
caauucacccacucccuu

SEQ ID NO: 1631301 - RNA, 16 nt, Homo sapiens
caauucagacaggcaa

SEQ ID NO: 1631302 - RNA, 17 nt, Homo sapiens
caauuccugugcucaaa

SEQ ID NO: 1631303 - RNA, 23 nt, Homo sapiens
caauugguaaaacucacugugau

SEQ ID NO: 1631304 - RNA, 19 nt, Homo sapiens
caauuuguuaagguucaag

SEQ ID NO: 1631305 - RNA, 23 nt, Homo sapiens
caauuuucuuuuuuauacucaau

SEQ ID NO: 1631306 - RNA, 13 nt, Homo sapiens
cacaaaacccaga

SEQ ID NO: 1631307 - RNA, 16 nt, Homo sapiens
cacaaaccaagccaug

SEQ ID NO: 1631308 - RNA, 20 nt, Homo sapiens
cacaaacuugauugugcaua

SEQ ID NO: 1631309 - RNA, 14 nt, Homo sapiens
cacaaaggucacag

SEQ ID NO: 1631310 - RNA, 16 nt, Homo sapiens
cacaacucuuuguuca

SEQ ID NO: 1631311 - RNA, 22 nt, Homo sapiens
cacaaggcagccugaacacuca

SEQ ID NO: 1631312 - RNA, 14 nt, Homo sapiens
cacacacagacugu

SEQ ID NO: 1631313 - RNA, 14 nt, Homo sapiens
cacacagacuccac

SEQ ID NO: 1631314 - RNA, 16 nt, Homo sapiens
cacacaggguggcaga

SEQ ID NO: 1631315 - RNA, 21 nt, Homo sapiens
cacacagugaaacgcaauuuu

SEQ ID NO: 1631316 - RNA, 23 nt, Homo sapiens
cacacaugagagagagcccccac

SEQ ID NO: 1631317 - RNA, 17 nt, Homo sapiens
cacacauuuuaugagag

SEQ ID NO: 1631318 - RNA, 15 nt, Homo sapiens
cacacccaugcacac

SEQ ID NO: 1631319 - RNA, 15 nt, Homo sapiens
cacaccuggccuuaa

SEQ ID NO: 1631320 - RNA, 13 nt, Homo sapiens
cacacgcauuaau

SEQ ID NO: 1631321 - RNA, 15 nt, Homo sapiens
cacacucuucaguga

SEQ ID NO: 1631322 - RNA, 20 nt, Homo sapiens
cacacuuggaugcaggguuu

SEQ ID NO: 1631323 - RNA, 20 nt, Homo sapiens
cacagaacacagcaauuccu

SEQ ID NO: 1631324 - RNA, 18 nt, Homo sapiens
cacagagcaaguccucac

SEQ ID NO: 1631325 - RNA, 19 nt, Homo sapiens
cacagccaccccugagauc

SEQ ID NO: 1631326 - RNA, 14 nt, Homo sapiens
cacagcuaaccacu

SEQ ID NO: 1631327 - RNA, 15 nt, Homo sapiens
cacagcuaaccacuu

SEQ ID NO: 1631328 - RNA, 13 nt, Homo sapiens
cacagcuuuauga

SEQ ID NO: 1631329 - RNA, 17 nt, Homo sapiens
cacagcuuuucuugaua

SEQ ID NO: 1631330 - RNA, 23 nt, Homo sapiens
cacaggccauggauggaaaacgc

SEQ ID NO: 1631331 - RNA, 15 nt, Homo sapiens
cacagguauuucagg

SEQ ID NO: 1631332 - RNA, 14 nt, Homo sapiens
cacaguagaacugu

SEQ ID NO: 1631333 - RNA, 17 nt, Homo sapiens
cacagugcugaccagac

SEQ ID NO: 1631334 - RNA, 15 nt, Homo sapiens
cacauacaccacaaa

SEQ ID NO: 1631335 - RNA, 13 nt, Homo sapiens
cacauacauguaa

SEQ ID NO: 1631336 - RNA, 17 nt, Homo sapiens
cacauauggacucugca

SEQ ID NO: 1631337 - RNA, 15 nt, Homo sapiens
cacauaugucuuacu

SEQ ID NO: 1631338 - RNA, 23 nt, Homo sapiens
cacaugaaucccacccacaugug

SEQ ID NO: 1631339 - RNA, 17 nt, Homo sapiens
cacaugaccacauagca

SEQ ID NO: 1631340 - RNA, 19 nt, Homo sapiens
cacaugaccacauagcaug

SEQ ID NO: 1631341 - RNA, 17 nt, Homo sapiens
cacaugcccaugaugag

SEQ ID NO: 1631342 - RNA, 15 nt, Homo sapiens
cacauggccuaugca

SEQ ID NO: 1631343 - RNA, 16 nt, Homo sapiens
cacauggccuaugcac

SEQ ID NO: 1631344 - RNA, 12 nt, Homo sapiens
ccauugcugcca

SEQ ID NO: 1631345 - RNA, 17 nt, Homo sapiens
cccaaacaugcacuucc

SEQ ID NO: 1631346 - RNA, 22 nt, Homo sapiens
cccaacacaaacccccacucca

SEQ ID NO: 1631347 - RNA, 22 nt, Homo sapiens
cccaagaucugccagaccugca

SEQ ID NO: 1631348 - RNA, 15 nt, Homo sapiens
cccaaucaccuuucc

SEQ ID NO: 1631349 - RNA, 14 nt, Homo sapiens
cccacccacaugug

SEQ ID NO: 1631350 - RNA, 16 nt, Homo sapiens
cccacccuugcccacc

SEQ ID NO: 1631351 - RNA, 17 nt, Homo sapiens
cccaccucccaccaaca

SEQ ID NO: 1631352 - RNA, 17 nt, Homo sapiens
cccacuggggugugugg

SEQ ID NO: 1631353 - RNA, 13 nt, Homo sapiens
cccagaauggagg

SEQ ID NO: 1631354 - RNA, 21 nt, Homo sapiens
cccagaccuguuagcagacag

SEQ ID NO: 1631355 - RNA, 12 nt, Homo sapiens
cccagagcacuu

SEQ ID NO: 1631356 - RNA, 16 nt, Homo sapiens
cccagagcacuuugca

SEQ ID NO: 1631357 - RNA, 15 nt, Homo sapiens
cccagaggugcucca

SEQ ID NO: 1631358 - RNA, 18 nt, Homo sapiens
cccagcccuccugcucca

SEQ ID NO: 1631359 - RNA, 22 nt, Homo sapiens
cccagcccucggguccauagag

SEQ ID NO: 1631360 - RNA, 20 nt, Homo sapiens
cccagcccugggaaccacuc

SEQ ID NO: 1631361 - RNA, 17 nt, Homo sapiens
cccagcugaaggcagug

SEQ ID NO: 1631362 - RNA, 23 nt, Homo sapiens
cccaggagaagaaagaggugacc

SEQ ID NO: 1631363 - RNA, 21 nt, Homo sapiens
cccaggaggcggagguugcag

SEQ ID NO: 1631364 - RNA, 13 nt, Homo sapiens
cccaggaggugca

SEQ ID NO: 1631365 - RNA, 16 nt, Homo sapiens
cccaggaggugcagug

SEQ ID NO: 1631366 - RNA, 21 nt, Homo sapiens
cccaggaggugugauuccuga

SEQ ID NO: 1631367 - RNA, 12 nt, Homo sapiens
cccaggaucucu

SEQ ID NO: 1631368 - RNA, 19 nt, Homo sapiens
cccaggcuggagugcagug

SEQ ID NO: 1631369 - RNA, 20 nt, Homo sapiens
cccaggcuggagugcagugg

SEQ ID NO: 1631370 - RNA, 16 nt, Homo sapiens
cccagggacacuccaa

SEQ ID NO: 1631371 - RNA, 14 nt, Homo sapiens
cccaggguggagug

SEQ ID NO: 1631372 - RNA, 22 nt, Homo sapiens
cccaggucccuccucagaccuc

SEQ ID NO: 1631373 - RNA, 23 nt, Homo sapiens
cccagguggcccuaaaggacucu

SEQ ID NO: 1631374 - RNA, 22 nt, Homo sapiens
cccagucucuggggucaggaag

SEQ ID NO: 1631375 - RNA, 19 nt, Homo sapiens
cccaguuacuuuuuuacac

SEQ ID NO: 1631376 - RNA, 16 nt, Homo sapiens
cccauagaaacauucu

SEQ ID NO: 1631377 - RNA, 16 nt, Homo sapiens
cccauguuacuucucu

SEQ ID NO: 1631378 - RNA, 13 nt, Homo sapiens
cccauugcugcca

SEQ ID NO: 1631379 - RNA, 16 nt, Homo sapiens
ccccaacaugcacuga

SEQ ID NO: 1631380 - RNA, 20 nt, Homo sapiens
ccccaaggacugagggcagu

SEQ ID NO: 1631381 - RNA, 12 nt, Homo sapiens
ccccacccaguu

SEQ ID NO: 1631382 - RNA, 16 nt, Homo sapiens
ccccaccuccugugga

SEQ ID NO: 1631383 - RNA, 22 nt, Homo sapiens
ccccaccugugguuuuaccugc

SEQ ID NO: 1631384 - RNA, 20 nt, Homo sapiens
ccccagagggccuggcucuc

SEQ ID NO: 1631385 - RNA, 12 nt, Homo sapiens
ccccgacuuccu

SEQ ID NO: 1631386 - RNA, 23 nt, Homo sapiens
ccccgcuucuccguacaccccag

SEQ ID NO: 1631387 - RNA, 17 nt, Homo sapiens
ccccggggugcccacag

SEQ ID NO: 1631388 - RNA, 19 nt, Homo sapiens
ccccgugggccauggcaau

SEQ ID NO: 1631389 - RNA, 17 nt, Homo sapiens
ccccucacacuuugcca

SEQ ID NO: 1631390 - RNA, 14 nt, Homo sapiens
ccccugcuuccacc

SEQ ID NO: 1631391 - RNA, 17 nt, Homo sapiens
ccccugucucaggguga

SEQ ID NO: 1631392 - RNA, 22 nt, Homo sapiens
ccccuuaggucgcgcucuugca

SEQ ID NO: 1631393 - RNA, 17 nt, Homo sapiens
cccgagaagcacuugag

SEQ ID NO: 1631394 - RNA, 17 nt, Homo sapiens
cccgccaugcucaggag

SEQ ID NO: 1631395 - RNA, 11 nt, Homo sapiens
cccgugacugc

SEQ ID NO: 1631396 - RNA, 23 nt, Homo sapiens
cccucacacuuugccauuugcuu

SEQ ID NO: 1631397 - RNA, 19 nt, Homo sapiens
cccucagacugucaggcaa

SEQ ID NO: 1631398 - RNA, 14 nt, Homo sapiens
cccucccagcccau

SEQ ID NO: 1631399 - RNA, 21 nt, Homo sapiens
cccuccuuggcuuuaugcaaa

SEQ ID NO: 1631400 - RNA, 19 nt, Homo sapiens
cccucgggccccauccuca

SEQ ID NO: 1631401 - RNA, 14 nt, Homo sapiens
cccucucacugugu

SEQ ID NO: 1631402 - RNA, 23 nt, Homo sapiens
cccucugacucuaagaauucucu

SEQ ID NO: 1631403 - RNA, 19 nt, Homo sapiens
cccucuugaaucucugaau

SEQ ID NO: 1631404 - RNA, 17 nt, Homo sapiens
cccugccucacaucucc

SEQ ID NO: 1631405 - RNA, 17 nt, Homo sapiens
cccuggcccccaucagc

SEQ ID NO: 1631406 - RNA, 16 nt, Homo sapiens
cccuggccgaguccaa

SEQ ID NO: 1631407 - RNA, 17 nt, Homo sapiens
cccuguaaucaggcaag

SEQ ID NO: 1631408 - RNA, 12 nt, Homo sapiens
cccugugcaacc

SEQ ID NO: 1631409 - RNA, 20 nt, Homo sapiens
cccuguguccaccugugggu

SEQ ID NO: 1631410 - RNA, 18 nt, Homo sapiens
cccuuugggaaagcucuu

SEQ ID NO: 1631411 - RNA, 12 nt, Homo sapiens
ccgagaagaaca

SEQ ID NO: 1631412 - RNA, 22 nt, Homo sapiens
ccgagagaugacacuagucaga

SEQ ID NO: 1631413 - RNA, 21 nt, Homo sapiens
ccgagcgggugcaagcacucg

SEQ ID NO: 1631414 - RNA, 21 nt, Homo sapiens
ccgagucagacuuuguguuca

SEQ ID NO: 1631415 - RNA, 22 nt, Homo sapiens
ccgcuagcaguacuaaucaugu

SEQ ID NO: 1631416 - RNA, 21 nt, Homo sapiens
ccggaaggaggccaaccagcc

SEQ ID NO: 1631417 - RNA, 17 nt, Homo sapiens
ccgggcaauccagacag

SEQ ID NO: 1631418 - RNA, 16 nt, Homo sapiens
ccggggcgaguggcac

SEQ ID NO: 1631419 - RNA, 20 nt, Homo sapiens
ccguccacguccuccaagcu

SEQ ID NO: 1631420 - RNA, 17 nt, Homo sapiens
ccgucucugucgcucuu

SEQ ID NO: 1631421 - RNA, 15 nt, Homo sapiens
ccgucugugacaugg

SEQ ID NO: 1631422 - RNA, 18 nt, Homo sapiens
ccgugaggcaaugggagc

SEQ ID NO: 1631423 - RNA, 15 nt, Homo sapiens
ccuaaaacuggcaaa

SEQ ID NO: 1631424 - RNA, 13 nt, Homo sapiens
ccuaaaggacucu

SEQ ID NO: 1631425 - RNA, 19 nt, Homo sapiens
ccuaaccuaggagggcucu

SEQ ID NO: 1631426 - RNA, 20 nt, Homo sapiens
ccuaagugcaaacacagcau

SEQ ID NO: 1631427 - RNA, 12 nt, Homo sapiens
ccuaauaucauu

SEQ ID NO: 1631428 - RNA, 22 nt, Homo sapiens
ccuacaggugcuguucagugcc

SEQ ID NO: 1631429 - RNA, 19 nt, Homo sapiens
ccuacuuuucuuuccucag

SEQ ID NO: 1631430 - RNA, 20 nt, Homo sapiens
ccuacuuuucuuuccucaga

SEQ ID NO: 1631431 - RNA, 15 nt, Homo sapiens
ccuagacaaaccauc

SEQ ID NO: 1631432 - RNA, 13 nt, Homo sapiens
ccuagaggugcuc

SEQ ID NO: 1631433 - RNA, 23 nt, Homo sapiens
ccuagcagcaccguucugugcac

SEQ ID NO: 1631434 - RNA, 22 nt, Homo sapiens
ccuagcugggccaacuccagug

SEQ ID NO: 1631435 - RNA, 18 nt, Homo sapiens
ccuaggaugucaugucug

SEQ ID NO: 1631436 - RNA, 23 nt, Homo sapiens
ccuagggaauggucccagcacga

SEQ ID NO: 1631437 - RNA, 14 nt, Homo sapiens
ccuaguuugcacua

SEQ ID NO: 1631438 - RNA, 17 nt, Homo sapiens
ccuauaaucuuauacaa

SEQ ID NO: 1631439 - RNA, 21 nt, Homo sapiens
ccuauggagagcccugggacc

SEQ ID NO: 1631440 - RNA, 20 nt, Homo sapiens
ccuauuagaguauuuuccac

SEQ ID NO: 1631441 - RNA, 19 nt, Homo sapiens
ccuauuuaucugaucaaga

SEQ ID NO: 1631442 - RNA, 22 nt, Homo sapiens
ccucaaaacgggucaguauuaa

SEQ ID NO: 1631443 - RNA, 16 nt, Homo sapiens
ccucaaaugcaguauu

SEQ ID NO: 1631444 - RNA, 19 nt, Homo sapiens
ccucaagguguucucugua

SEQ ID NO: 1631445 - RNA, 14 nt, Homo sapiens
ccucaagugauccu

SEQ ID NO: 1631446 - RNA, 19 nt, Homo sapiens
ccucaauuuuugucucaga

SEQ ID NO: 1631447 - RNA, 14 nt, Homo sapiens
ccucagccuccuga

SEQ ID NO: 1631448 - RNA, 14 nt, Homo sapiens
ccucagcgucucuu

SEQ ID NO: 1631449 - RNA, 12 nt, Homo sapiens
ccucaggugcua

SEQ ID NO: 1631450 - RNA, 21 nt, Homo sapiens
ccucauuacugggccuuagug

SEQ ID NO: 1631451 - RNA, 13 nt, Homo sapiens
ccuccaaaagccc

SEQ ID NO: 1631452 - RNA, 12 nt, Homo sapiens
ccuccaccagcc

SEQ ID NO: 1631453 - RNA, 12 nt, Homo sapiens
cucacacacaaa

SEQ ID NO: 1631454 - RNA, 13 nt, Homo sapiens
cucacaccacuaa

SEQ ID NO: 1631455 - RNA, 15 nt, Homo sapiens
cucacacuuugccau

SEQ ID NO: 1631456 - RNA, 23 nt, Homo sapiens
cucaccagcccugaccccagugu

SEQ ID NO: 1631457 - RNA, 19 nt, Homo sapiens
cucaccuagccugaugaga

SEQ ID NO: 1631458 - RNA, 23 nt, Homo sapiens
cucacucuucaaggaggcccacu

SEQ ID NO: 1631459 - RNA, 13 nt, Homo sapiens
cucacuguagcag

SEQ ID NO: 1631460 - RNA, 10 nt, Homo sapiens
cucacugugu

SEQ ID NO: 1631461 - RNA, 23 nt, Homo sapiens
cucacuuguucucacugucuguu

SEQ ID NO: 1631462 - RNA, 16 nt, Homo sapiens
cucagaggcgcacugu

SEQ ID NO: 1631463 - RNA, 22 nt, Homo sapiens
cucagaggcgcacugugacccc

SEQ ID NO: 1631464 - RNA, 18 nt, Homo sapiens
cucagaguaaaauaggca

SEQ ID NO: 1631465 - RNA, 18 nt, Homo sapiens
cucagcagggcuggucac

SEQ ID NO: 1631466 - RNA, 19 nt, Homo sapiens
cucagccucaaaugcagua

SEQ ID NO: 1631467 - RNA, 18 nt, Homo sapiens
cucagccucccaaagugc

SEQ ID NO: 1631468 - RNA, 20 nt, Homo sapiens
cucagccucccaaaguucug

SEQ ID NO: 1631469 - RNA, 20 nt, Homo sapiens
cucagggcagcgccaggcug

SEQ ID NO: 1631470 - RNA, 11 nt, Homo sapiens
cucagugcaac

SEQ ID NO: 1631471 - RNA, 20 nt, Homo sapiens
cucagugggggcagagccac

SEQ ID NO: 1631472 - RNA, 17 nt, Homo sapiens
cucaguuccugcagcag

SEQ ID NO: 1631473 - RNA, 20 nt, Homo sapiens
cucauccucuuuuaauggca

SEQ ID NO: 1631474 - RNA, 12 nt, Homo sapiens
cucaucugcaaa

SEQ ID NO: 1631475 - RNA, 21 nt, Homo sapiens
cucauggcuguguccacugca

SEQ ID NO: 1631476 - RNA, 15 nt, Homo sapiens
cuccaaauccaagga

SEQ ID NO: 1631477 - RNA, 13 nt, Homo sapiens
cuccaacaccaag

SEQ ID NO: 1631478 - RNA, 13 nt, Homo sapiens
cuccaacugugga

SEQ ID NO: 1631479 - RNA, 18 nt, Homo sapiens
cuccaagaggcuccugaa

SEQ ID NO: 1631480 - RNA, 15 nt, Homo sapiens
cuccagagaugguca

SEQ ID NO: 1631481 - RNA, 18 nt, Homo sapiens
cuccagaugcagggcagu

SEQ ID NO: 1631482 - RNA, 22 nt, Homo sapiens
cuccagcccagacccaguggac

SEQ ID NO: 1631483 - RNA, 19 nt, Homo sapiens
cuccauacucaagcugucu

SEQ ID NO: 1631484 - RNA, 14 nt, Homo sapiens
cuccaugcugcaaa

SEQ ID NO: 1631485 - RNA, 19 nt, Homo sapiens
cuccauggcugccaucuca

SEQ ID NO: 1631486 - RNA, 16 nt, Homo sapiens
cucccaacacugucac

SEQ ID NO: 1631487 - RNA, 23 nt, Homo sapiens
cucccaggugagaauucaggcaa

SEQ ID NO: 1631488 - RNA, 23 nt, Homo sapiens
cucccaucccguaagaccaccuu

SEQ ID NO: 1631489 - RNA, 17 nt, Homo sapiens
cucccaugagacugccc

SEQ ID NO: 1631490 - RNA, 21 nt, Homo sapiens
cuccccagaugugacuacuga

SEQ ID NO: 1631491 - RNA, 21 nt, Homo sapiens
cuccccaguagagaaacauuu

SEQ ID NO: 1631492 - RNA, 20 nt, Homo sapiens
cucccccuccagccagagac

SEQ ID NO: 1631493 - RNA, 16 nt, Homo sapiens
cucccguggccuguag

SEQ ID NO: 1631494 - RNA, 23 nt, Homo sapiens
cucccuaccugacugccacagaa

SEQ ID NO: 1631495 - RNA, 17 nt, Homo sapiens
cucccugcugugccaug

SEQ ID NO: 1631496 - RNA, 17 nt, Homo sapiens
cucccuggggggaggca

SEQ ID NO: 1631497 - RNA, 15 nt, Homo sapiens
cucccuucucggggu

SEQ ID NO: 1631498 - RNA, 22 nt, Homo sapiens
cuccuaaccucaagugauccuc

SEQ ID NO: 1631499 - RNA, 22 nt, Homo sapiens
cuccuagacucacuuguucuca

SEQ ID NO: 1631500 - RNA, 20 nt, Homo sapiens
cuccucuuuuuuuaaaaaua

SEQ ID NO: 1631501 - RNA, 16 nt, Homo sapiens
cuccugaccucaggug

SEQ ID NO: 1631502 - RNA, 21 nt, Homo sapiens
cuccugagugagguguugcag

SEQ ID NO: 1631503 - RNA, 18 nt, Homo sapiens
cuccuggccuucuaggaa

SEQ ID NO: 1631504 - RNA, 11 nt, Homo sapiens
cuccuggugcc

SEQ ID NO: 1631505 - RNA, 12 nt, Homo sapiens
cuccuugauaaa

SEQ ID NO: 1631506 - RNA, 14 nt, Homo sapiens
cuccuuggcuuuau

SEQ ID NO: 1631507 - RNA, 18 nt, Homo sapiens
cuccuuggcuuuaugcaa

SEQ ID NO: 1631508 - RNA, 21 nt, Homo sapiens
cuccuuuaccuuucagugcag

SEQ ID NO: 1631509 - RNA, 15 nt, Homo sapiens
cuccuuuccaauaga

SEQ ID NO: 1631510 - RNA, 14 nt, Homo sapiens
cuccuuucucuuau

SEQ ID NO: 1631511 - RNA, 18 nt, Homo sapiens
cuccuuuggaauggugua

SEQ ID NO: 1631512 - RNA, 16 nt, Homo sapiens
cucgcugaaagcacua

SEQ ID NO: 1631513 - RNA, 12 nt, Homo sapiens
cucggggacaaa

SEQ ID NO: 1631514 - RNA, 19 nt, Homo sapiens
cucgugguaggacuguaga

SEQ ID NO: 1631515 - RNA, 17 nt, Homo sapiens
cucuaacgccugagccc

SEQ ID NO: 1631516 - RNA, 18 nt, Homo sapiens
cucuaacgccugagccca

SEQ ID NO: 1631517 - RNA, 17 nt, Homo sapiens
cucuacacccacccaaa

SEQ ID NO: 1631518 - RNA, 19 nt, Homo sapiens
cucuacagauggcauaccu

SEQ ID NO: 1631519 - RNA, 19 nt, Homo sapiens
cucuagccccagcgccaaa

SEQ ID NO: 1631520 - RNA, 23 nt, Homo sapiens
cucuagccccagcgccaaaggag

SEQ ID NO: 1631521 - RNA, 12 nt, Homo sapiens
cucuagcucucu

SEQ ID NO: 1631522 - RNA, 17 nt, Homo sapiens
cucuccaauacucaggu

SEQ ID NO: 1631523 - RNA, 14 nt, Homo sapiens
cucucuagguguca

SEQ ID NO: 1631524 - RNA, 20 nt, Homo sapiens
cucugaguucugggguggga

SEQ ID NO: 1631525 - RNA, 14 nt, Homo sapiens
cucugauagcuguu

SEQ ID NO: 1631526 - RNA, 20 nt, Homo sapiens
cucugauuuccuucugcuau

SEQ ID NO: 1631527 - RNA, 18 nt, Homo sapiens
cucugcacaugucuugua

SEQ ID NO: 1631528 - RNA, 18 nt, Homo sapiens
cucugcauggaacagcau

SEQ ID NO: 1631529 - RNA, 14 nt, Homo sapiens
cucugcauguguaa

SEQ ID NO: 1631530 - RNA, 18 nt, Homo sapiens
cucugcccaggcaaggaa

SEQ ID NO: 1631531 - RNA, 15 nt, Homo sapiens
cucugccuuaaacac

SEQ ID NO: 1631532 - RNA, 20 nt, Homo sapiens
cucugcugucuaaccuguga

SEQ ID NO: 1631533 - RNA, 20 nt, Homo sapiens
cucuggauugagauacuuga

SEQ ID NO: 1631534 - RNA, 21 nt, Homo sapiens
cucugggaaguggucagcgca

SEQ ID NO: 1631535 - RNA, 17 nt, Homo sapiens
cucuggggucuuuuuau

SEQ ID NO: 1631536 - RNA, 22 nt, Homo sapiens
cucuggggucuuuuuaugcauu

SEQ ID NO: 1631537 - RNA, 15 nt, Homo sapiens
cucuguacuuuucau

SEQ ID NO: 1631538 - RNA, 14 nt, Homo sapiens
cucuguaggccaaa

SEQ ID NO: 1631539 - RNA, 22 nt, Homo sapiens
cucuguauuacagcuuucacag

SEQ ID NO: 1631540 - RNA, 15 nt, Homo sapiens
cucugucagguguga

SEQ ID NO: 1631541 - RNA, 12 nt, Homo sapiens
cucugucaguca

SEQ ID NO: 1631542 - RNA, 22 nt, Homo sapiens
cucugugaccccuccuugucag

SEQ ID NO: 1631543 - RNA, 13 nt, Homo sapiens
cucuguguagcaa

SEQ ID NO: 1631544 - RNA, 14 nt, Homo sapiens
cucugugugcacac

SEQ ID NO: 1631545 - RNA, 21 nt, Homo sapiens
cucuguuaauguggacuggaa

SEQ ID NO: 1631546 - RNA, 16 nt, Homo sapiens
cucuguuuugugccag

SEQ ID NO: 1631547 - RNA, 17 nt, Homo sapiens
cucuuauaaaaucaaua

SEQ ID NO: 1631548 - RNA, 15 nt, Homo sapiens
cucuucaacaugaca

SEQ ID NO: 1631549 - RNA, 20 nt, Homo sapiens
cucuucaauagcuaagcauc

SEQ ID NO: 1631550 - RNA, 15 nt, Homo sapiens
cucuucagugacucc

SEQ ID NO: 1631551 - RNA, 24 nt, Homo sapiens
cucuuccaaguccuuuaucugcac

SEQ ID NO: 1631552 - RNA, 21 nt, Homo sapiens
cucuuccccaucucacucuua

SEQ ID NO: 1631553 - RNA, 16 nt, Homo sapiens
cucuucccccuuccaa

SEQ ID NO: 1631554 - RNA, 18 nt, Homo sapiens
cucuucggucguauccac

SEQ ID NO: 1631555 - RNA, 17 nt, Homo sapiens
cucuucuaaaauagcaa

SEQ ID NO: 1631556 - RNA, 13 nt, Homo sapiens
cucuucuacccuu

SEQ ID NO: 1631557 - RNA, 15 nt, Homo sapiens
cucuucuacccuuuu

SEQ ID NO: 1631558 - RNA, 14 nt, Homo sapiens
cucuucuuacuggu

SEQ ID NO: 1631559 - RNA, 13 nt, Homo sapiens
cucuugaaucucu

SEQ ID NO: 1631560 - RNA, 15 nt, Homo sapiens
cucuugaggagcuca

SEQ ID NO: 1631561 - RNA, 16 nt, Homo sapiens
cucuugaggagcucaa

SEQ ID NO: 1631562 - RNA, 19 nt, Homo sapiens
cucuuguaauaaaaugucu

SEQ ID NO: 1631563 - RNA, 15 nt, Homo sapiens
gaucaagaacauguc

SEQ ID NO: 1631564 - RNA, 14 nt, Homo sapiens
gaucaagcugugag

SEQ ID NO: 1631565 - RNA, 17 nt, Homo sapiens
gaucaaggaguacaaug

SEQ ID NO: 1631566 - RNA, 23 nt, Homo sapiens
gaucaucuuugccaccaccuggg

SEQ ID NO: 1631567 - RNA, 15 nt, Homo sapiens
gauccagccaugccu

SEQ ID NO: 1631568 - RNA, 22 nt, Homo sapiens
gauccagucuggaaaacagaaa

SEQ ID NO: 1631569 - RNA, 19 nt, Homo sapiens
gaucccuacugccaaccug

SEQ ID NO: 1631570 - RNA, 18 nt, Homo sapiens
gaucgccaaccuuucccc

SEQ ID NO: 1631571 - RNA, 22 nt, Homo sapiens
gaucguuuuuucccagggcaag

SEQ ID NO: 1631572 - RNA, 20 nt, Homo sapiens
gaucucggcucagugcaacc

SEQ ID NO: 1631573 - RNA, 19 nt, Homo sapiens
gaugaaaaccuacauauuc

SEQ ID NO: 1631574 - RNA, 23 nt, Homo sapiens
gaugaaagaauuggagugauaau

SEQ ID NO: 1631575 - RNA, 15 nt, Homo sapiens
gaugaagcauuuaca

SEQ ID NO: 1631576 - RNA, 22 nt, Homo sapiens
gaugacuuuuuauacuuuguaa

SEQ ID NO: 1631577 - RNA, 15 nt, Homo sapiens
gaugagucagugcca

SEQ ID NO: 1631578 - RNA, 13 nt, Homo sapiens
gaugauacaucca

SEQ ID NO: 1631579 - RNA, 14 nt, Homo sapiens
gaugauacauccaa

SEQ ID NO: 1631580 - RNA, 15 nt, Homo sapiens
gaugcaaugugcuac

SEQ ID NO: 1631581 - RNA, 21 nt, Homo sapiens
gaugcacucucagaccaagca

SEQ ID NO: 1631582 - RNA, 13 nt, Homo sapiens
gaugccauaugcc

SEQ ID NO: 1631583 - RNA, 20 nt, Homo sapiens
gauggaacacggccacauca

SEQ ID NO: 1631584 - RNA, 17 nt, Homo sapiens
gauggcauccugugaag

SEQ ID NO: 1631585 - RNA, 21 nt, Homo sapiens
gauggcauccugugaaguccu

SEQ ID NO: 1631586 - RNA, 22 nt, Homo sapiens
gauggccacugugaauaacugu

SEQ ID NO: 1631587 - RNA, 20 nt, Homo sapiens
gaugggcauaugugucagug

SEQ ID NO: 1631588 - RNA, 16 nt, Homo sapiens
gaugucuagaggcaga

SEQ ID NO: 1631589 - RNA, 19 nt, Homo sapiens
gauuacaggcgugagccac

SEQ ID NO: 1631590 - RNA, 23 nt, Homo sapiens
gauuauaugggaggguucugggu

SEQ ID NO: 1631591 - RNA, 20 nt, Homo sapiens
gauuaugaugaaaaccuaca

SEQ ID NO: 1631592 - RNA, 18 nt, Homo sapiens
gauuccuggaagcaaacg

SEQ ID NO: 1631593 - RNA, 22 nt, Homo sapiens
gauucgaaacuccauugaguca

SEQ ID NO: 1631594 - RNA, 15 nt, Homo sapiens
gauucuccugccuca

SEQ ID NO: 1631595 - RNA, 18 nt, Homo sapiens
gauugcagagugaccagc

SEQ ID NO: 1631596 - RNA, 14 nt, Homo sapiens
gauugcugcaaaga

SEQ ID NO: 1631597 - RNA, 12 nt, Homo sapiens
gauugcugugaa

SEQ ID NO: 1631598 - RNA, 15 nt, Homo sapiens
gauuggccccacuga

SEQ ID NO: 1631599 - RNA, 17 nt, Homo sapiens
gauuguggaaaauggag

SEQ ID NO: 1631600 - RNA, 12 nt, Homo sapiens
gauuuacauaua

SEQ ID NO: 1631601 - RNA, 15 nt, Homo sapiens
gauuuuaaagacaaa

SEQ ID NO: 1631602 - RNA, 17 nt, Homo sapiens
gauuuuuuccucugcau

SEQ ID NO: 1631603 - RNA, 19 nt, Homo sapiens
gcaaaaucucuacugcuuu

SEQ ID NO: 1631604 - RNA, 16 nt, Homo sapiens
gcaaagauuuuuggca

SEQ ID NO: 1631605 - RNA, 11 nt, Homo sapiens
gcaaagccugu

SEQ ID NO: 1631606 - RNA, 19 nt, Homo sapiens
gcaaagguauuaguacaau

SEQ ID NO: 1631607 - RNA, 15 nt, Homo sapiens
gcaaauacaaucagc

SEQ ID NO: 1631608 - RNA, 15 nt, Homo sapiens
gcaaauauacaauga

SEQ ID NO: 1631609 - RNA, 22 nt, Homo sapiens
gcaacagccacuacauuacuuc

SEQ ID NO: 1631610 - RNA, 19 nt, Homo sapiens
gcaaccucuucaugagcuu

SEQ ID NO: 1631611 - RNA, 13 nt, Homo sapiens
gcaagaggaugaa

SEQ ID NO: 1631612 - RNA, 12 nt, Homo sapiens
gcaagccagcuu

SEQ ID NO: 1631613 - RNA, 17 nt, Homo sapiens
gcaaggggacauuccag

SEQ ID NO: 1631614 - RNA, 18 nt, Homo sapiens
gcaaguaaguaugaagga

SEQ ID NO: 1631615 - RNA, 14 nt, Homo sapiens
gcaaguuagaacua

SEQ ID NO: 1631616 - RNA, 14 nt, Homo sapiens
gcaauaaauaccag

SEQ ID NO: 1631617 - RNA, 17 nt, Homo sapiens
gcaauaagaauuacuuu

SEQ ID NO: 1631618 - RNA, 15 nt, Homo sapiens
gcaaucuggucugaa

SEQ ID NO: 1631619 - RNA, 16 nt, Homo sapiens
gcaaugcaugauacua

SEQ ID NO: 1631620 - RNA, 20 nt, Homo sapiens
gcaaugcauuugauggccac

SEQ ID NO: 1631621 - RNA, 12 nt, Homo sapiens
gcaaugugcuac

SEQ ID NO: 1631622 - RNA, 23 nt, Homo sapiens
gcaauuuuaccuaguuugcacua

SEQ ID NO: 1631623 - RNA, 15 nt, Homo sapiens
gcacaaguucaguga

SEQ ID NO: 1631624 - RNA, 22 nt, Homo sapiens
gcacaauauuccuaugcugcaa

SEQ ID NO: 1631625 - RNA, 20 nt, Homo sapiens
gcacacauuauuuggcuuaa

SEQ ID NO: 1631626 - RNA, 15 nt, Homo sapiens
gcacaccaaggcccu

SEQ ID NO: 1631627 - RNA, 17 nt, Homo sapiens
gcacagcuccugccagg

SEQ ID NO: 1631628 - RNA, 12 nt, Homo sapiens
gcacagcuguuu

SEQ ID NO: 1631629 - RNA, 23 nt, Homo sapiens
gcacaggacaugcgguagccagc

SEQ ID NO: 1631630 - RNA, 21 nt, Homo sapiens
gcacagggagugcacauaucc

SEQ ID NO: 1631631 - RNA, 14 nt, Homo sapiens
gcacagggcuguaa

SEQ ID NO: 1631632 - RNA, 17 nt, Homo sapiens
gcacccucccuagcucu

SEQ ID NO: 1631633 - RNA, 14 nt, Homo sapiens
gcaccucuguucau

SEQ ID NO: 1631634 - RNA, 15 nt, Homo sapiens
gcaccucuguucauu

SEQ ID NO: 1631635 - RNA, 20 nt, Homo sapiens
gcaccuucacucuccagggu

SEQ ID NO: 1631636 - RNA, 24 nt, Homo sapiens
gcaccuugugucuguacacguguc

SEQ ID NO: 1631637 - RNA, 22 nt, Homo sapiens
gcacuacugggugucauuucau

SEQ ID NO: 1631638 - RNA, 23 nt, Homo sapiens
gcacucacaccacuaacaugccc

SEQ ID NO: 1631639 - RNA, 19 nt, Homo sapiens
gcacugaccggugcuuuua

SEQ ID NO: 1631640 - RNA, 13 nt, Homo sapiens
gcacuguguuuau

SEQ ID NO: 1631641 - RNA, 13 nt, Homo sapiens
gcacuguucaaua

SEQ ID NO: 1631642 - RNA, 15 nt, Homo sapiens
gcagaaacagcauau

SEQ ID NO: 1631643 - RNA, 20 nt, Homo sapiens
gcagaacugaagugugcugu

SEQ ID NO: 1631644 - RNA, 14 nt, Homo sapiens
gcagaauccagcua

SEQ ID NO: 1631645 - RNA, 13 nt, Homo sapiens
gcagacugucccu

SEQ ID NO: 1631646 - RNA, 17 nt, Homo sapiens
gcagagucuaccuugaa

SEQ ID NO: 1631647 - RNA, 15 nt, Homo sapiens
gcagaucuuggaaug

SEQ ID NO: 1631648 - RNA, 22 nt, Homo sapiens
gcagcaggucuagaagaacaac

SEQ ID NO: 1631649 - RNA, 22 nt, Homo sapiens
gcagcaugcuugggcugaccca

SEQ ID NO: 1631650 - RNA, 19 nt, Homo sapiens
gcagccccuaagugcaaac

SEQ ID NO: 1631651 - RNA, 14 nt, Homo sapiens
gcaggaggugccug

SEQ ID NO: 1631652 - RNA, 15 nt, Homo sapiens
gcaggaggugccuga

SEQ ID NO: 1631653 - RNA, 20 nt, Homo sapiens
gcagggcagcagggaacaaa

SEQ ID NO: 1631654 - RNA, 17 nt, Homo sapiens
gcagggcccagugacaa

SEQ ID NO: 1631655 - RNA, 18 nt, Homo sapiens
gcaggucuagaagaacaa

SEQ ID NO: 1631656 - RNA, 19 nt, Homo sapiens
gcaggucuagaagaacaac

SEQ ID NO: 1631657 - RNA, 20 nt, Homo sapiens
gcaggugagaacccugugga

SEQ ID NO: 1631658 - RNA, 13 nt, Homo sapiens
gcaguacuuugug

SEQ ID NO: 1631659 - RNA, 13 nt, Homo sapiens
gcagucagggaca

SEQ ID NO: 1631660 - RNA, 17 nt, Homo sapiens
gcauaagcuaucaccua

SEQ ID NO: 1631661 - RNA, 18 nt, Homo sapiens
gcauaaucaauauaaucu

SEQ ID NO: 1631662 - RNA, 15 nt, Homo sapiens
gcauaccacuugaag

SEQ ID NO: 1631663 - RNA, 15 nt, Homo sapiens
gcauauagacuguac

SEQ ID NO: 1631664 - RNA, 15 nt, Homo sapiens
gcaucccggccaggu

SEQ ID NO: 1631665 - RNA, 17 nt, Homo sapiens
gcaucccggccaggugg

SEQ ID NO: 1631666 - RNA, 16 nt, Homo sapiens
gcaucucccagcaaga

SEQ ID NO: 1631667 - RNA, 17 nt, Homo sapiens
gcaucucccagcaagac

SEQ ID NO: 1631668 - RNA, 22 nt, Homo sapiens
gcaucuuccccaacgaaaagca

SEQ ID NO: 1631669 - RNA, 22 nt, Homo sapiens
gcaugaucuugagcaaguuccu

SEQ ID NO: 1631670 - RNA, 16 nt, Homo sapiens
gcaugccuguccuuuc

SEQ ID NO: 1631671 - RNA, 14 nt, Homo sapiens
gcauggaacagcau

SEQ ID NO: 1631672 - RNA, 24 nt, Homo sapiens
gcauguaugucuuggacacuguac

SEQ ID NO: 1631673 - RNA, 20 nt, Homo sapiens
ugaaggcaguggcaggggag

SEQ ID NO: 1631674 - RNA, 20 nt, Homo sapiens
ugaaggcauccccaggcccu

SEQ ID NO: 1631675 - RNA, 18 nt, Homo sapiens
ugaagggggcggccuaug

SEQ ID NO: 1631676 - RNA, 19 nt, Homo sapiens
ugaagguggaacaagcaca

SEQ ID NO: 1631677 - RNA, 17 nt, Homo sapiens
ugaaguacaauaauuca

SEQ ID NO: 1631678 - RNA, 22 nt, Homo sapiens
ugaaguccuucaccucacugaa

SEQ ID NO: 1631679 - RNA, 22 nt, Homo sapiens
ugaaguggucugaauucuggaa

SEQ ID NO: 1631680 - RNA, 23 nt, Homo sapiens
ugaaguggucugaauucuggaau

SEQ ID NO: 1631681 - RNA, 17 nt, Homo sapiens
ugaagugugcugugaca

SEQ ID NO: 1631682 - RNA, 16 nt, Homo sapiens
ugaaguuuaauugacu

SEQ ID NO: 1631683 - RNA, 16 nt, Homo sapiens
ugaauaaagugcugcg

SEQ ID NO: 1631684 - RNA, 17 nt, Homo sapiens
ugaauaaagugcugcgg

SEQ ID NO: 1631685 - RNA, 22 nt, Homo sapiens
ugaauaacauuuaaauuccaca

SEQ ID NO: 1631686 - RNA, 23 nt, Homo sapiens
ugaauaagcagaacauacuguuc

SEQ ID NO: 1631687 - RNA, 21 nt, Homo sapiens
ugaauacauuaacggugcuaa

SEQ ID NO: 1631688 - RNA, 23 nt, Homo sapiens
ugaaucacauuuuuuuaugcucu

SEQ ID NO: 1631689 - RNA, 15 nt, Homo sapiens
ugaaucaugucugua

SEQ ID NO: 1631690 - RNA, 16 nt, Homo sapiens
ugaaugagcuugucaa

SEQ ID NO: 1631691 - RNA, 23 nt, Homo sapiens
ugaauggggaagggagucucucu

SEQ ID NO: 1631692 - RNA, 16 nt, Homo sapiens
ugaauuucccacauac

SEQ ID NO: 1631693 - RNA, 23 nt, Homo sapiens
ugaauuugagauacaaacauguu

SEQ ID NO: 1631694 - RNA, 13 nt, Homo sapiens
ugacaagaacaaa

SEQ ID NO: 1631695 - RNA, 23 nt, Homo sapiens
ugacacaguuaucaaaaaguauu

SEQ ID NO: 1631696 - RNA, 15 nt, Homo sapiens
ugacacauaugaaca

SEQ ID NO: 1631697 - RNA, 13 nt, Homo sapiens
ugacacauaugca

SEQ ID NO: 1631698 - RNA, 14 nt, Homo sapiens
ugacacggccauga

SEQ ID NO: 1631699 - RNA, 11 nt, Homo sapiens
ugacacuccag

SEQ ID NO: 1631700 - RNA, 14 nt, Homo sapiens
ugacacuuaucuca

SEQ ID NO: 1631701 - RNA, 16 nt, Homo sapiens
ugacagaaaaguaaug

SEQ ID NO: 1631702 - RNA, 18 nt, Homo sapiens
ugacagaagcuucugccc

SEQ ID NO: 1631703 - RNA, 17 nt, Homo sapiens
ugacagggaaaacugca

SEQ ID NO: 1631704 - RNA, 18 nt, Homo sapiens
ugacaucucaguucacug

SEQ ID NO: 1631705 - RNA, 16 nt, Homo sapiens
ugaccaagcaucuuug

SEQ ID NO: 1631706 - RNA, 18 nt, Homo sapiens
ugaccaccccucucgccu

SEQ ID NO: 1631707 - RNA, 16 nt, Homo sapiens
ugacccacacuuccau

SEQ ID NO: 1631708 - RNA, 21 nt, Homo sapiens
ugacccuaugggucuaggaca

SEQ ID NO: 1631709 - RNA, 17 nt, Homo sapiens
ugacccuccccuaguca

SEQ ID NO: 1631710 - RNA, 20 nt, Homo sapiens
ugacccuuuugugucuauga

SEQ ID NO: 1631711 - RNA, 16 nt, Homo sapiens
ugaccggugcuuuuau

SEQ ID NO: 1631712 - RNA, 22 nt, Homo sapiens
ugaccuaaauaaggaucaauug

SEQ ID NO: 1631713 - RNA, 15 nt, Homo sapiens
ugaccucgugaucua

SEQ ID NO: 1631714 - RNA, 18 nt, Homo sapiens
ugacgacugcaaagccag

SEQ ID NO: 1631715 - RNA, 20 nt, Homo sapiens
ugacguguaaaugcugguau

SEQ ID NO: 1631716 - RNA, 15 nt, Homo sapiens
ugacuucacuaggca

SEQ ID NO: 1631717 - RNA, 20 nt, Homo sapiens
ugacuuucaguaaacauaaa

SEQ ID NO: 1631718 - RNA, 22 nt, Homo sapiens
ugacuuuuuggcuuuaagccau

SEQ ID NO: 1631719 - RNA, 23 nt, Homo sapiens
ugagaagggacaagccaccuuga

SEQ ID NO: 1631720 - RNA, 23 nt, Homo sapiens
ugagaauguaaauaaaugugucu

SEQ ID NO: 1631721 - RNA, 18 nt, Homo sapiens
ugagaccuggcagccaca

SEQ ID NO: 1631722 - RNA, 15 nt, Homo sapiens
ugagagagagagugu

SEQ ID NO: 1631723 - RNA, 19 nt, Homo sapiens
ugagauaaaugagugauuc

SEQ ID NO: 1631724 - RNA, 17 nt, Homo sapiens
ugagauagcauugugaa

SEQ ID NO: 1631725 - RNA, 22 nt, Homo sapiens
ugagaugauacauccaaagcag

SEQ ID NO: 1631726 - RNA, 15 nt, Homo sapiens
ugagaugaugauuag

SEQ ID NO: 1631727 - RNA, 17 nt, Homo sapiens
ugagaugcagcuggaaa

SEQ ID NO: 1631728 - RNA, 14 nt, Homo sapiens
ugagauuguacugu

SEQ ID NO: 1631729 - RNA, 16 nt, Homo sapiens
ugagauuguacuguuc

SEQ ID NO: 1631730 - RNA, 22 nt, Homo sapiens
ugagauuuugaaaaucuaccaa

SEQ ID NO: 1631731 - RNA, 13 nt, Homo sapiens
ugagcaugugaug

SEQ ID NO: 1631732 - RNA, 15 nt, Homo sapiens
ugagcauuugcaccu

SEQ ID NO: 1631733 - RNA, 21 nt, Homo sapiens
ugagccaaagcuuaugugaca

SEQ ID NO: 1631734 - RNA, 14 nt, Homo sapiens
ugagccaugagaug

SEQ ID NO: 1631735 - RNA, 17 nt, Homo sapiens
ugagcccagaacuucaa

SEQ ID NO: 1631736 - RNA, 15 nt, Homo sapiens
ugagcugacaucuca

SEQ ID NO: 1631737 - RNA, 15 nt, Homo sapiens
ugaggacagcugucc

SEQ ID NO: 1631738 - RNA, 15 nt, Homo sapiens
ugaggauaaugggaa

SEQ ID NO: 1631739 - RNA, 20 nt, Homo sapiens
ugaggcaggagaagaacaag

SEQ ID NO: 1631740 - RNA, 16 nt, Homo sapiens
ugaggccaucucagga

SEQ ID NO: 1631741 - RNA, 17 nt, Homo sapiens
ugaggccuagacucugu

SEQ ID NO: 1631742 - RNA, 18 nt, Homo sapiens
ugaggccuagacucuguc

SEQ ID NO: 1631743 - RNA, 16 nt, Homo sapiens
ugaggcuguuccuuga

SEQ ID NO: 1631744 - RNA, 15 nt, Homo sapiens
ugagggcaguucuga

SEQ ID NO: 1631745 - RNA, 22 nt, Homo sapiens
ugagggcaguucugaguguuua

SEQ ID NO: 1631746 - RNA, 12 nt, Homo sapiens
ugaggucaggga

SEQ ID NO: 1631747 - RNA, 14 nt, Homo sapiens
ugagguccugucua

SEQ ID NO: 1631748 - RNA, 14 nt, Homo sapiens
ugaggugacacucc

SEQ ID NO: 1631749 - RNA, 17 nt, Homo sapiens
ugaggugcccaggagaa

SEQ ID NO: 1631750 - RNA, 14 nt, Homo sapiens
ugaguaugccacug

SEQ ID NO: 1631751 - RNA, 20 nt, Homo sapiens
ugaguauuccaccacaggaa

SEQ ID NO: 1631752 - RNA, 20 nt, Homo sapiens
ugagucagugccaugacuga

SEQ ID NO: 1631753 - RNA, 18 nt, Homo sapiens
ugagucugcagaugagga

SEQ ID NO: 1631754 - RNA, 22 nt, Homo sapiens
ugaguguuguuuuaaucagaga

SEQ ID NO: 1631755 - RNA, 15 nt, Homo sapiens
ugauaauagcauuuu

SEQ ID NO: 1631756 - RNA, 19 nt, Homo sapiens
ugauaauaguccuuuacaa

SEQ ID NO: 1631757 - RNA, 20 nt, Homo sapiens
ugauacuggaggaacacuug

SEQ ID NO: 1631758 - RNA, 18 nt, Homo sapiens
ugaucaaaggcacacagc

SEQ ID NO: 1631759 - RNA, 13 nt, Homo sapiens
ugaucaggugugg

SEQ ID NO: 1631760 - RNA, 17 nt, Homo sapiens
ugauccauccaucucuc

SEQ ID NO: 1631761 - RNA, 13 nt, Homo sapiens
ugauccucagugc

SEQ ID NO: 1631762 - RNA, 17 nt, Homo sapiens
ugaucggaaagcucuuc

SEQ ID NO: 1631763 - RNA, 17 nt, Homo sapiens
ugaucucucuagcuuug

SEQ ID NO: 1631764 - RNA, 19 nt, Homo sapiens
ugaucugggagagucucac

SEQ ID NO: 1631765 - RNA, 14 nt, Homo sapiens
ugaugccauaugcc

SEQ ID NO: 1631766 - RNA, 17 nt, Homo sapiens
ugaugccuguguacugc

SEQ ID NO: 1631767 - RNA, 20 nt, Homo sapiens
ugaugccuguguacugccuu

SEQ ID NO: 1631768 - RNA, 21 nt, Homo sapiens
ugaugcgggccagugcuccag

SEQ ID NO: 1631769 - RNA, 21 nt, Homo sapiens
ugauggcaacagaaaccaaga

SEQ ID NO: 1631770 - RNA, 15 nt, Homo sapiens
ugauggccaccagcu

SEQ ID NO: 1631771 - RNA, 21 nt, Homo sapiens
ugauuaggaaucuaaaugaag

SEQ ID NO: 1631772 - RNA, 16 nt, Homo sapiens
ugauucacagucucau

SEQ ID NO: 1631773 - RNA, 17 nt, Homo sapiens
ugauugccaaucugcau

SEQ ID NO: 1631774 - RNA, 18 nt, Homo sapiens
ugauuggccccacugacg

SEQ ID NO: 1631775 - RNA, 15 nt, Homo sapiens
ugauuuaucuuucaa

SEQ ID NO: 1631776 - RNA, 18 nt, Homo sapiens
ugauuucuacaacuggag

SEQ ID NO: 1631777 - RNA, 21 nt, Homo sapiens
ugcaaaaugucuuguguauuu

SEQ ID NO: 1631778 - RNA, 20 nt, Homo sapiens
ugcaaaggagaagcacagcu

SEQ ID NO: 1631779 - RNA, 18 nt, Homo sapiens
ugcaaaguguaugugacc

SEQ ID NO: 1631780 - RNA, 16 nt, Homo sapiens
ugcaaauuaaaacaua

SEQ ID NO: 1631781 - RNA, 16 nt, Homo sapiens
ugcaagcacucggggu

SEQ ID NO: 1631782 - RNA, 23 nt, Homo sapiens
uucaaguguccuggaaauucugc

SEQ ID NO: 1631783 - RNA, 21 nt, Homo sapiens
uucaauagcauaucacagaga

SEQ ID NO: 1631784 - RNA, 17 nt, Homo sapiens
uucaaucauuuauucau

SEQ ID NO: 1631785 - RNA, 22 nt, Homo sapiens
uucaaugcuucuaucagacuca

SEQ ID NO: 1631786 - RNA, 13 nt, Homo sapiens
uucacacagugaa

SEQ ID NO: 1631787 - RNA, 22 nt, Homo sapiens
uucacaccauucuccugccuca

SEQ ID NO: 1631788 - RNA, 20 nt, Homo sapiens
uucacgaaguguugcaugga

SEQ ID NO: 1631789 - RNA, 24 nt, Homo sapiens
uucagaaguaauuugaauagccug

SEQ ID NO: 1631790 - RNA, 15 nt, Homo sapiens
uucagacaagcugca

SEQ ID NO: 1631791 - RNA, 21 nt, Homo sapiens
uucagaguuaucaagagacac

SEQ ID NO: 1631792 - RNA, 19 nt, Homo sapiens
uucagcaggcuagacagaa

SEQ ID NO: 1631793 - RNA, 11 nt, Homo sapiens
uucagcauuuu

SEQ ID NO: 1631794 - RNA, 17 nt, Homo sapiens
uucagccacuucugcag

SEQ ID NO: 1631795 - RNA, 21 nt, Homo sapiens
uucaggaacacccccaugaca

SEQ ID NO: 1631796 - RNA, 21 nt, Homo sapiens
uucaggaagcauaaagcaauu

SEQ ID NO: 1631797 - RNA, 18 nt, Homo sapiens
uucaggcaacgcacaaaa

SEQ ID NO: 1631798 - RNA, 13 nt, Homo sapiens
uucaggggcuccc

SEQ ID NO: 1631799 - RNA, 15 nt, Homo sapiens
uucagucauaaagag

SEQ ID NO: 1631800 - RNA, 14 nt, Homo sapiens
uucagucugaucca

SEQ ID NO: 1631801 - RNA, 17 nt, Homo sapiens
uucagugagaaucugcu

SEQ ID NO: 1631802 - RNA, 13 nt, Homo sapiens
uucagugcaucau

SEQ ID NO: 1631803 - RNA, 21 nt, Homo sapiens
uucaguucugcuugcucccaa

SEQ ID NO: 1631804 - RNA, 15 nt, Homo sapiens
uucaguuuauuucca

SEQ ID NO: 1631805 - RNA, 15 nt, Homo sapiens
uucauacacuaacca

SEQ ID NO: 1631806 - RNA, 18 nt, Homo sapiens
uucauauuuauugauuaa

SEQ ID NO: 1631807 - RNA, 21 nt, Homo sapiens
uucaucugggaaagacaucca

SEQ ID NO: 1631808 - RNA, 18 nt, Homo sapiens
uucaugcuucuacuguga

SEQ ID NO: 1631809 - RNA, 18 nt, Homo sapiens
uucauguccuaaagaaga

SEQ ID NO: 1631810 - RNA, 17 nt, Homo sapiens
uucauguguggaaaugg

SEQ ID NO: 1631811 - RNA, 17 nt, Homo sapiens
uucauuauugguuuuaa

SEQ ID NO: 1631812 - RNA, 15 nt, Homo sapiens
uucauucacauucag

SEQ ID NO: 1631813 - RNA, 17 nt, Homo sapiens
uucauugcacuuuccuu

SEQ ID NO: 1631814 - RNA, 21 nt, Homo sapiens
uucauugcacuuuccuuucaa

SEQ ID NO: 1631815 - RNA, 19 nt, Homo sapiens
uuccaaggaagcagaagac

SEQ ID NO: 1631816 - RNA, 16 nt, Homo sapiens
uuccaccagggccaga

SEQ ID NO: 1631817 - RNA, 22 nt, Homo sapiens
uuccaccagggccagagcagcu

SEQ ID NO: 1631818 - RNA, 12 nt, Homo sapiens
uuccaccucacc

SEQ ID NO: 1631819 - RNA, 17 nt, Homo sapiens
uuccacuaacucauagu

SEQ ID NO: 1631820 - RNA, 17 nt, Homo sapiens
uuccagcuagugaccca

SEQ ID NO: 1631821 - RNA, 20 nt, Homo sapiens
uuccagcuagugacccacau

SEQ ID NO: 1631822 - RNA, 22 nt, Homo sapiens
uuccaguacuauggagugcuca

SEQ ID NO: 1631823 - RNA, 14 nt, Homo sapiens
uuccagugucuguc

SEQ ID NO: 1631824 - RNA, 20 nt, Homo sapiens
uuccaucccaaccagugcca

SEQ ID NO: 1631825 - RNA, 16 nt, Homo sapiens
uuccauugccuagcuc

SEQ ID NO: 1631826 - RNA, 21 nt, Homo sapiens
uucccagagcacuuugcaacu

SEQ ID NO: 1631827 - RNA, 12 nt, Homo sapiens
uuccccaagauc

SEQ ID NO: 1631828 - RNA, 20 nt, Homo sapiens
uuccccaaggacucuuccac

SEQ ID NO: 1631829 - RNA, 17 nt, Homo sapiens
uuccccaccuuccuuac

SEQ ID NO: 1631830 - RNA, 13 nt, Homo sapiens
uucccccacccuc

SEQ ID NO: 1631831 - RNA, 19 nt, Homo sapiens
uuccccgugggccauggca

SEQ ID NO: 1631832 - RNA, 21 nt, Homo sapiens
uuccccuccuuggcuuuaugc

SEQ ID NO: 1631833 - RNA, 19 nt, Homo sapiens
uucccuuaaacaaaagugu

SEQ ID NO: 1631834 - RNA, 16 nt, Homo sapiens
uuccuaaugugaucau

SEQ ID NO: 1631835 - RNA, 12 nt, Homo sapiens
uuccucacauuu

SEQ ID NO: 1631836 - RNA, 13 nt, Homo sapiens
uuccucagaucau

SEQ ID NO: 1631837 - RNA, 16 nt, Homo sapiens
uuccugagaccacaga

SEQ ID NO: 1631838 - RNA, 16 nt, Homo sapiens
uuccugauaacauuau

SEQ ID NO: 1631839 - RNA, 21 nt, Homo sapiens
uuccugcgcauauagacugua

SEQ ID NO: 1631840 - RNA, 13 nt, Homo sapiens
uuccuucugcuau

SEQ ID NO: 1631841 - RNA, 18 nt, Homo sapiens
uucggauguaugaucucu

SEQ ID NO: 1631842 - RNA, 17 nt, Homo sapiens
uucuaaaaacacacaca

SEQ ID NO: 1631843 - RNA, 13 nt, Homo sapiens
uucuaaaaugugu

SEQ ID NO: 1631844 - RNA, 23 nt, Homo sapiens
uucuaacccaagacaugacauuc

SEQ ID NO: 1631845 - RNA, 16 nt, Homo sapiens
uucuaggcucacugca

SEQ ID NO: 1631846 - RNA, 19 nt, Homo sapiens
uucuaguucagcugcccca

SEQ ID NO: 1631847 - RNA, 18 nt, Homo sapiens
uucuaucaaauacuagua

SEQ ID NO: 1631848 - RNA, 14 nt, Homo sapiens
uucuauuaacuuua

SEQ ID NO: 1631849 - RNA, 18 nt, Homo sapiens
uucucaacauacuguaau

SEQ ID NO: 1631850 - RNA, 19 nt, Homo sapiens
uucucaacauacuguaauc

SEQ ID NO: 1631851 - RNA, 22 nt, Homo sapiens
uucucaagcugagauugagcag

SEQ ID NO: 1631852 - RNA, 18 nt, Homo sapiens
uucucaggacacaggccu

SEQ ID NO: 1631853 - RNA, 19 nt, Homo sapiens
uucuccaagcuuucagaca

SEQ ID NO: 1631854 - RNA, 18 nt, Homo sapiens
uucuccuuaccgucuuga

SEQ ID NO: 1631855 - RNA, 15 nt, Homo sapiens
uucugcaucuugggg

SEQ ID NO: 1631856 - RNA, 14 nt, Homo sapiens
uucugccacuccau

SEQ ID NO: 1631857 - RNA, 13 nt, Homo sapiens
uucugcucuggaa

SEQ ID NO: 1631858 - RNA, 15 nt, Homo sapiens
uucuggggccaucca

SEQ ID NO: 1631859 - RNA, 12 nt, Homo sapiens
uucugucuuccc

SEQ ID NO: 1631860 - RNA, 14 nt, Homo sapiens
uucugucuucccaa

SEQ ID NO: 1631861 - RNA, 17 nt, Homo sapiens
uucuguugucaccuuca

SEQ ID NO: 1631862 - RNA, 12 nt, Homo sapiens
uucuuacacugu

SEQ ID NO: 1631863 - RNA, 20 nt, Homo sapiens
uucuucaagauuuauggaaa

SEQ ID NO: 1631864 - RNA, 15 nt, Homo sapiens
uucuucauauccuuc

SEQ ID NO: 1631865 - RNA, 18 nt, Homo sapiens
uucuuccccgaaucacac

SEQ ID NO: 1631866 - RNA, 12 nt, Homo sapiens
uucuuccuuauu

SEQ ID NO: 1631867 - RNA, 15 nt, Homo sapiens
uucuucuccauuaau

SEQ ID NO: 1631868 - RNA, 19 nt, Homo sapiens
uucuugaagcaguagccua

SEQ ID NO: 1631869 - RNA, 18 nt, Homo sapiens
uucuuggugguggaugac

SEQ ID NO: 1631870 - RNA, 13 nt, Homo sapiens
uucuuguauucau

SEQ ID NO: 1631871 - RNA, 22 nt, Homo sapiens
uucuuuagaauuuuuacccaau

SEQ ID NO: 1631872 - RNA, 13 nt, Homo sapiens
uucuuuccucaca

SEQ ID NO: 1631873 - RNA, 16 nt, Homo sapiens
uucuuucuuaguccag

SEQ ID NO: 1631874 - RNA, 22 nt, Homo sapiens
uugaaagcagaagaagacagac

SEQ ID NO: 1631875 - RNA, 13 nt, Homo sapiens
uugaaauauucag

SEQ ID NO: 1631876 - RNA, 23 nt, Homo sapiens
uugaaauauucagaaauucucca

SEQ ID NO: 1631877 - RNA, 16 nt, Homo sapiens
uugaaauggcauuuaa

SEQ ID NO: 1631878 - RNA, 14 nt, Homo sapiens
uugaacacaaguuc

SEQ ID NO: 1631879 - RNA, 18 nt, Homo sapiens
uugaacuaggcugagcaa

SEQ ID NO: 1631880 - RNA, 19 nt, Homo sapiens
uugaacuuuaagaagcagu

SEQ ID NO: 1631881 - RNA, 15 nt, Homo sapiens
uugaaguacuuaaca

SEQ ID NO: 1631882 - RNA, 16 nt, Homo sapiens
uugaaguacuuaacau

SEQ ID NO: 1631883 - RNA, 18 nt, Homo sapiens
uugacaaggcucugcuau

SEQ ID NO: 1631884 - RNA, 12 nt, Homo sapiens
uugacucuugaa

SEQ ID NO: 1631885 - RNA, 21 nt, Homo sapiens
uugacuuacauagaugauaaa

SEQ ID NO: 1631886 - RNA, 19 nt, Homo sapiens
uugagaagggacaagccac

SEQ ID NO: 1631887 - RNA, 13 nt, Homo sapiens
uugagauggaguu

SEQ ID NO: 1631888 - RNA, 11 nt, Homo sapiens
uugagccaugc

SEQ ID NO: 1631889 - RNA, 18 nt, Homo sapiens
uugaggccuuuuuugcca

SEQ ID NO: 1631890 - RNA, 13 nt, Homo sapiens
uugagggaccaau

SEQ ID NO: 1631891 - RNA, 12 nt, Homo sapiens
uugagguuucca

SEQ ID NO: 1631892 - RNA, 23 nt, Homo sapiens
auguuaguuuuucuuacuugcau

SEQ ID NO: 1631893 - RNA, 21 nt, Homo sapiens
auguuccuuucgaaagcaaug

SEQ ID NO: 1631894 - RNA, 21 nt, Homo sapiens
auguuguguuuuuaacauguc

SEQ ID NO: 1631895 - RNA, 22 nt, Homo sapiens
auguuguguuuuuaacauguca

SEQ ID NO: 1631896 - RNA, 18 nt, Homo sapiens
auguuuaauaaagcuuua

SEQ ID NO: 1631897 - RNA, 16 nt, Homo sapiens
auguuuaguuuuacau

SEQ ID NO: 1631898 - RNA, 21 nt, Homo sapiens
auguuuaugaaggguaaggga

SEQ ID NO: 1631899 - RNA, 20 nt, Homo sapiens
auguuuuuuuaaaccucaua

SEQ ID NO: 1631900 - RNA, 13 nt, Homo sapiens
auuaaaagaauga

SEQ ID NO: 1631901 - RNA, 18 nt, Homo sapiens
auuaaauucaguguaguu

SEQ ID NO: 1631902 - RNA, 22 nt, Homo sapiens
auuaaccuuacuaauuauacua

SEQ ID NO: 1631903 - RNA, 22 nt, Homo sapiens
auuaaggcagcucauccaagcu

SEQ ID NO: 1631904 - RNA, 17 nt, Homo sapiens
auuaaucauacaaacuc

SEQ ID NO: 1631905 - RNA, 13 nt, Homo sapiens
auuaaucuugauc

SEQ ID NO: 1631906 - RNA, 13 nt, Homo sapiens
auuacaaaugcaa

SEQ ID NO: 1631907 - RNA, 15 nt, Homo sapiens
auuacaaccauauau

SEQ ID NO: 1631908 - RNA, 11 nt, Homo sapiens
auuacacugga

SEQ ID NO: 1631909 - RNA, 15 nt, Homo sapiens
auuacaggugugcac

SEQ ID NO: 1631910 - RNA, 17 nt, Homo sapiens
auuacaggugugcacca

SEQ ID NO: 1631911 - RNA, 12 nt, Homo sapiens
auuaccuucuau

SEQ ID NO: 1631912 - RNA, 18 nt, Homo sapiens
auuacugaugugugcaac

SEQ ID NO: 1631913 - RNA, 18 nt, Homo sapiens
auuacuguuccagauucc

SEQ ID NO: 1631914 - RNA, 15 nt, Homo sapiens
auuagaaucugagua

SEQ ID NO: 1631915 - RNA, 16 nt, Homo sapiens
auuagaaucugaguau

SEQ ID NO: 1631916 - RNA, 16 nt, Homo sapiens
auuagaguauuuucca

SEQ ID NO: 1631917 - RNA, 23 nt, Homo sapiens
auuagccacauguacacuacauu

SEQ ID NO: 1631918 - RNA, 13 nt, Homo sapiens
auuagggacacuu

SEQ ID NO: 1631919 - RNA, 16 nt, Homo sapiens
auuagggacacuuuca

SEQ ID NO: 1631920 - RNA, 17 nt, Homo sapiens
auuagugggggacugag

SEQ ID NO: 1631921 - RNA, 12 nt, Homo sapiens
auuauacuugag

SEQ ID NO: 1631922 - RNA, 13 nt, Homo sapiens
auuaucuugcuca

SEQ ID NO: 1631923 - RNA, 18 nt, Homo sapiens
auuaugagacacaggaug

SEQ ID NO: 1631924 - RNA, 14 nt, Homo sapiens
auuaugugcaacau

SEQ ID NO: 1631925 - RNA, 15 nt, Homo sapiens
auuauuauucaaaaa

SEQ ID NO: 1631926 - RNA, 22 nt, Homo sapiens
auuauuugcuauggcaggauaa

SEQ ID NO: 1631927 - RNA, 20 nt, Homo sapiens
auucaauagcauaucacaga

SEQ ID NO: 1631928 - RNA, 16 nt, Homo sapiens
auucacucccagguga

SEQ ID NO: 1631929 - RNA, 12 nt, Homo sapiens
auucagcauuuu

SEQ ID NO: 1631930 - RNA, 23 nt, Homo sapiens
auucaugaaaacuguuuuuacua

SEQ ID NO: 1631931 - RNA, 18 nt, Homo sapiens
auucauggcuaccucaga

SEQ ID NO: 1631932 - RNA, 12 nt, Homo sapiens
auucauucucau

SEQ ID NO: 1631933 - RNA, 13 nt, Homo sapiens
auuccaaaugcca

SEQ ID NO: 1631934 - RNA, 13 nt, Homo sapiens
auuccauuuugcu

SEQ ID NO: 1631935 - RNA, 19 nt, Homo sapiens
auucccaccccacuucugc

SEQ ID NO: 1631936 - RNA, 20 nt, Homo sapiens
auucccaccccucauaccua

SEQ ID NO: 1631937 - RNA, 23 nt, Homo sapiens
auuccccuguagcagucacugac

SEQ ID NO: 1631938 - RNA, 20 nt, Homo sapiens
auuccuacugacaacauuau

SEQ ID NO: 1631939 - RNA, 14 nt, Homo sapiens
auuccugaagggaa

SEQ ID NO: 1631940 - RNA, 18 nt, Homo sapiens
auucuaacccaagacaug

SEQ ID NO: 1631941 - RNA, 18 nt, Homo sapiens
auucuacuagcaggcaau

SEQ ID NO: 1631942 - RNA, 12 nt, Homo sapiens
auucuacuauac

SEQ ID NO: 1631943 - RNA, 17 nt, Homo sapiens
auucuacuauacuguac

SEQ ID NO: 1631944 - RNA, 19 nt, Homo sapiens
auucuagcugagaagcaau

SEQ ID NO: 1631945 - RNA, 19 nt, Homo sapiens
auucucucaucuaacugau

SEQ ID NO: 1631946 - RNA, 18 nt, Homo sapiens
auucuguuuuuaaugcua

SEQ ID NO: 1631947 - RNA, 12 nt, Homo sapiens
auucuuccucaa

SEQ ID NO: 1631948 - RNA, 16 nt, Homo sapiens
auucuuuagcuguacu

SEQ ID NO: 1631949 - RNA, 17 nt, Homo sapiens
auucuuuauucuuuacu

SEQ ID NO: 1631950 - RNA, 16 nt, Homo sapiens
auucuuuuaaugccac

SEQ ID NO: 1631951 - RNA, 19 nt, Homo sapiens
auucuuuuggcaguucuga

SEQ ID NO: 1631952 - RNA, 14 nt, Homo sapiens
auugacaacacagc

SEQ ID NO: 1631953 - RNA, 16 nt, Homo sapiens
auugagaagggacaag

SEQ ID NO: 1631954 - RNA, 24 nt, Homo sapiens
auugagaguaaaugacugucuuau

SEQ ID NO: 1631955 - RNA, 20 nt, Homo sapiens
auugagcagaagaucaagga

SEQ ID NO: 1631956 - RNA, 15 nt, Homo sapiens
auugagggucauucu

SEQ ID NO: 1631957 - RNA, 24 nt, Homo sapiens
auugaucauaaacugacuaucaua

SEQ ID NO: 1631958 - RNA, 16 nt, Homo sapiens
auugcaagaguuuaau

SEQ ID NO: 1631959 - RNA, 19 nt, Homo sapiens
auugcagaggggcccauga

SEQ ID NO: 1631960 - RNA, 18 nt, Homo sapiens
auugcaugugacucugaa

SEQ ID NO: 1631961 - RNA, 16 nt, Homo sapiens
auugccuagcucuuuu

SEQ ID NO: 1631962 - RNA, 21 nt, Homo sapiens
auugcucucccagcccuugca

SEQ ID NO: 1631963 - RNA, 21 nt, Homo sapiens
auugcuguccuggaggggcug

SEQ ID NO: 1631964 - RNA, 12 nt, Homo sapiens
auugcugugaaa

SEQ ID NO: 1631965 - RNA, 15 nt, Homo sapiens
auugcuuuuaugaua

SEQ ID NO: 1631966 - RNA, 15 nt, Homo sapiens
auugggaaaacucca

SEQ ID NO: 1631967 - RNA, 23 nt, Homo sapiens
auuguaaagauccuauagcucuu

SEQ ID NO: 1631968 - RNA, 17 nt, Homo sapiens
auugucgguuaccucug

SEQ ID NO: 1631969 - RNA, 22 nt, Homo sapiens
auugugcuccuucggauaugau

SEQ ID NO: 1631970 - RNA, 17 nt, Homo sapiens
auuguuaucuuuaccuc

SEQ ID NO: 1631971 - RNA, 21 nt, Homo sapiens
auuguuccucuuuguuuauga

SEQ ID NO: 1631972 - RNA, 13 nt, Homo sapiens
auuguuguugcca

SEQ ID NO: 1631973 - RNA, 18 nt, Homo sapiens
auuguuguugccaaagag

SEQ ID NO: 1631974 - RNA, 17 nt, Homo sapiens
auuguuuucuuuuacag

SEQ ID NO: 1631975 - RNA, 22 nt, Homo sapiens
auuuaaaaaaacagacucccau

SEQ ID NO: 1631976 - RNA, 16 nt, Homo sapiens
auuuaaauuccacaga

SEQ ID NO: 1631977 - RNA, 13 nt, Homo sapiens
auuuaacagagcu

SEQ ID NO: 1631978 - RNA, 16 nt, Homo sapiens
auuuaacuaaaguuaa

SEQ ID NO: 1631979 - RNA, 20 nt, Homo sapiens
auuuagcuccaaaccuucac

SEQ ID NO: 1631980 - RNA, 12 nt, Homo sapiens
auuuaggggcaa

SEQ ID NO: 1631981 - RNA, 14 nt, Homo sapiens
auuuauagcaagau

SEQ ID NO: 1631982 - RNA, 15 nt, Homo sapiens
auuuaucugaucaag

SEQ ID NO: 1631983 - RNA, 18 nt, Homo sapiens
auuuauuuaacuauucau

SEQ ID NO: 1631984 - RNA, 16 nt, Homo sapiens
auuuauuuaagacacu

SEQ ID NO: 1631985 - RNA, 15 nt, Homo sapiens
auuuauuucuagcaa

SEQ ID NO: 1631986 - RNA, 16 nt, Homo sapiens
auuuauuuuuugccau

SEQ ID NO: 1631987 - RNA, 13 nt, Homo sapiens
auuucaagaccuc

SEQ ID NO: 1631988 - RNA, 15 nt, Homo sapiens
auuucaccaagccaa

SEQ ID NO: 1631989 - RNA, 22 nt, Homo sapiens
auuucaccacucaaaggccaga

SEQ ID NO: 1631990 - RNA, 23 nt, Homo sapiens
auuucaccacucaaaggccagac

SEQ ID NO: 1631991 - RNA, 15 nt, Homo sapiens
auuucagcagggaug

SEQ ID NO: 1631992 - RNA, 12 nt, Homo sapiens
auuucauugcac

SEQ ID NO: 1631993 - RNA, 14 nt, Homo sapiens
auuucauugcacuu

SEQ ID NO: 1631994 - RNA, 16 nt, Homo sapiens
auuucauugcacuuuc

SEQ ID NO: 1631995 - RNA, 22 nt, Homo sapiens
auuucauuucagccacuucugc

SEQ ID NO: 1631996 - RNA, 13 nt, Homo sapiens
auuuccacuauuu

SEQ ID NO: 1631997 - RNA, 16 nt, Homo sapiens
auuuccagaacuacca

SEQ ID NO: 1631998 - RNA, 22 nt, Homo sapiens
auuucucuacuugucauaucac

SEQ ID NO: 1631999 - RNA, 12 nt, Homo sapiens
auuucuguaccu

SEQ ID NO: 1632000 - RNA, 15 nt, Homo sapiens
auuucuguaccuuca

SEQ ID NO: 1632001 - RNA, 17 nt, Homo sapiens
auuucuuaccaguguga

SEQ ID NO: 1632002 - RNA, 14 nt, Homo sapiens
auuucuucaaauaa

SEQ ID NO: 1632003 - RNA, 16 nt, Homo sapiens
auuugaaugacaagau

SEQ ID NO: 1632004 - RNA, 23 nt, Homo sapiens
cagucaagugaggugacacucca

SEQ ID NO: 1632005 - RNA, 12 nt, Homo sapiens
cagucacagcca

SEQ ID NO: 1632006 - RNA, 15 nt, Homo sapiens
cagucucauugucac

SEQ ID NO: 1632007 - RNA, 19 nt, Homo sapiens
cagucucauugucaccucu

SEQ ID NO: 1632008 - RNA, 20 nt, Homo sapiens
cagucucauuuugacagcau

SEQ ID NO: 1632009 - RNA, 20 nt, Homo sapiens
cagucugacccuuacagccu

SEQ ID NO: 1632010 - RNA, 20 nt, Homo sapiens
cagucugauccauccaucuc

SEQ ID NO: 1632011 - RNA, 15 nt, Homo sapiens
cagugaaguacaccu

SEQ ID NO: 1632012 - RNA, 17 nt, Homo sapiens
cagugacaaggcccuga

SEQ ID NO: 1632013 - RNA, 18 nt, Homo sapiens
cagugagguuaaacuaag

SEQ ID NO: 1632014 - RNA, 18 nt, Homo sapiens
cagugcaaaccacuucuc

SEQ ID NO: 1632015 - RNA, 14 nt, Homo sapiens
cagugcaguuucuu

SEQ ID NO: 1632016 - RNA, 16 nt, Homo sapiens
cagugcuaaacuacug

SEQ ID NO: 1632017 - RNA, 14 nt, Homo sapiens
caguggacucuucc

SEQ ID NO: 1632018 - RNA, 12 nt, Homo sapiens
caguggggcucu

SEQ ID NO: 1632019 - RNA, 19 nt, Homo sapiens
caguguagacacaggucac

SEQ ID NO: 1632020 - RNA, 18 nt, Homo sapiens
caguuagagacucuguca

SEQ ID NO: 1632021 - RNA, 19 nt, Homo sapiens
caguuauguuuuauacucu

SEQ ID NO: 1632022 - RNA, 12 nt, Homo sapiens
caguucaucacc

SEQ ID NO: 1632023 - RNA, 16 nt, Homo sapiens
caguugcauuuagcuu

SEQ ID NO: 1632024 - RNA, 21 nt, Homo sapiens
caguugugauaauagcauuuu

SEQ ID NO: 1632025 - RNA, 16 nt, Homo sapiens
caguuuauuuccacua

SEQ ID NO: 1632026 - RNA, 13 nt, Homo sapiens
caguuucucagaa

SEQ ID NO: 1632027 - RNA, 22 nt, Homo sapiens
caguuuuccagaacacucuuag

SEQ ID NO: 1632028 - RNA, 23 nt, Homo sapiens
caguuuuguacauagcaaauaaa

SEQ ID NO: 1632029 - RNA, 21 nt, Homo sapiens
caguuuuuuaaaaauguguca

SEQ ID NO: 1632030 - RNA, 16 nt, Homo sapiens
cauaaagaagcaauaa

SEQ ID NO: 1632031 - RNA, 23 nt, Homo sapiens
cauaaagagguaaaaaacuguca

SEQ ID NO: 1632032 - RNA, 13 nt, Homo sapiens
cauaaagccaugu

SEQ ID NO: 1632033 - RNA, 18 nt, Homo sapiens
cauaauaaauaucuguac

SEQ ID NO: 1632034 - RNA, 12 nt, Homo sapiens
cauaaucuguac

SEQ ID NO: 1632035 - RNA, 24 nt, Homo sapiens
cauaauuaugaaaacucaugauca

SEQ ID NO: 1632036 - RNA, 17 nt, Homo sapiens
cauaccguguaccucag

SEQ ID NO: 1632037 - RNA, 16 nt, Homo sapiens
cauagcugugcuauga

SEQ ID NO: 1632038 - RNA, 22 nt, Homo sapiens
cauagucacauggccuaugcac

SEQ ID NO: 1632039 - RNA, 18 nt, Homo sapiens
cauauaaagcacuauaca

SEQ ID NO: 1632040 - RNA, 19 nt, Homo sapiens
cauauaaagcacuauacag

SEQ ID NO: 1632041 - RNA, 18 nt, Homo sapiens
cauauaacgucaugugca

SEQ ID NO: 1632042 - RNA, 12 nt, Homo sapiens
cauaugccuugg

SEQ ID NO: 1632043 - RNA, 20 nt, Homo sapiens
cauauggacucugcacauga

SEQ ID NO: 1632044 - RNA, 18 nt, Homo sapiens
cauauugaugugugucua

SEQ ID NO: 1632045 - RNA, 22 nt, Homo sapiens
cauauugucaccucagcacugu

SEQ ID NO: 1632046 - RNA, 23 nt, Homo sapiens
cauauuuugguuuguguauccau

SEQ ID NO: 1632047 - RNA, 12 nt, Homo sapiens
caucaacuacua

SEQ ID NO: 1632048 - RNA, 14 nt, Homo sapiens
caucacacucucca

SEQ ID NO: 1632049 - RNA, 15 nt, Homo sapiens
caucacaucugcaca

SEQ ID NO: 1632050 - RNA, 23 nt, Homo sapiens
caucacccgggaacuuuuuuaga

SEQ ID NO: 1632051 - RNA, 12 nt, Homo sapiens
cauccaaagcag

SEQ ID NO: 1632052 - RNA, 19 nt, Homo sapiens
cauccaaucuauuauuucu

SEQ ID NO: 1632053 - RNA, 18 nt, Homo sapiens
caucccaaccagugccaa

SEQ ID NO: 1632054 - RNA, 17 nt, Homo sapiens
caucccacugacuguau

SEQ ID NO: 1632055 - RNA, 15 nt, Homo sapiens
cauccccacccaguc

SEQ ID NO: 1632056 - RNA, 19 nt, Homo sapiens
caucccucgggugugcuau

SEQ ID NO: 1632057 - RNA, 21 nt, Homo sapiens
caucccugggccugcugcuga

SEQ ID NO: 1632058 - RNA, 19 nt, Homo sapiens
caucccuuauuaguuacaa

SEQ ID NO: 1632059 - RNA, 18 nt, Homo sapiens
caucccuuuuucugcuaa

SEQ ID NO: 1632060 - RNA, 20 nt, Homo sapiens
cauccuucuuucuaguucag

SEQ ID NO: 1632061 - RNA, 24 nt, Homo sapiens
cauccuuggaaauuggaagagcac

SEQ ID NO: 1632062 - RNA, 21 nt, Homo sapiens
caucuagcaaccgccucaaaa

SEQ ID NO: 1632063 - RNA, 18 nt, Homo sapiens
caucuagggaaugggacu

SEQ ID NO: 1632064 - RNA, 13 nt, Homo sapiens
caucuauacaaaa

SEQ ID NO: 1632065 - RNA, 12 nt, Homo sapiens
caucucaugccc

SEQ ID NO: 1632066 - RNA, 12 nt, Homo sapiens
caucugcaaaag

SEQ ID NO: 1632067 - RNA, 17 nt, Homo sapiens
caucugggaaagacauc

SEQ ID NO: 1632068 - RNA, 14 nt, Homo sapiens
caucugucugcucu

SEQ ID NO: 1632069 - RNA, 11 nt, Homo sapiens
caucuguggag

SEQ ID NO: 1632070 - RNA, 21 nt, Homo sapiens
caugaaaaauugcuaugacua

SEQ ID NO: 1632071 - RNA, 12 nt, Homo sapiens
caugaacccugc

SEQ ID NO: 1632072 - RNA, 16 nt, Homo sapiens
caugaacccugcccug

SEQ ID NO: 1632073 - RNA, 21 nt, Homo sapiens
caugaauaacauuuaaauucc

SEQ ID NO: 1632074 - RNA, 22 nt, Homo sapiens
caugaaucccacccacauguga

SEQ ID NO: 1632075 - RNA, 14 nt, Homo sapiens
caugaauucuguca

SEQ ID NO: 1632076 - RNA, 19 nt, Homo sapiens
caugacaagaacaaagcca

SEQ ID NO: 1632077 - RNA, 21 nt, Homo sapiens
caugacauccagagaugacua

SEQ ID NO: 1632078 - RNA, 19 nt, Homo sapiens
caugacauucuuagcugua

SEQ ID NO: 1632079 - RNA, 23 nt, Homo sapiens
caugaccaccccucucgccucau

SEQ ID NO: 1632080 - RNA, 19 nt, Homo sapiens
caugagaugauacauccaa

SEQ ID NO: 1632081 - RNA, 16 nt, Homo sapiens
caugaggccaucucag

SEQ ID NO: 1632082 - RNA, 14 nt, Homo sapiens
caugaguucaaaua

SEQ ID NO: 1632083 - RNA, 18 nt, Homo sapiens
caugaguucaaauacuuu

SEQ ID NO: 1632084 - RNA, 13 nt, Homo sapiens
caugauacauuuu

SEQ ID NO: 1632085 - RNA, 18 nt, Homo sapiens
caugauacuaucugugcc

SEQ ID NO: 1632086 - RNA, 23 nt, Homo sapiens
caugaugugaagaguuucacaaa

SEQ ID NO: 1632087 - RNA, 15 nt, Homo sapiens
caugcagcucuucaa

SEQ ID NO: 1632088 - RNA, 17 nt, Homo sapiens
caugccauuuguacuga

SEQ ID NO: 1632089 - RNA, 14 nt, Homo sapiens
caugcccugugcaa

SEQ ID NO: 1632090 - RNA, 14 nt, Homo sapiens
caugccucugaggc

SEQ ID NO: 1632091 - RNA, 21 nt, Homo sapiens
caugcuacuuuuuuuuaguuc

SEQ ID NO: 1632092 - RNA, 23 nt, Homo sapiens
caugcuacuuuuuuuuaguucaa

SEQ ID NO: 1632093 - RNA, 15 nt, Homo sapiens
caugcucaccaagga

SEQ ID NO: 1632094 - RNA, 21 nt, Homo sapiens
caugcucaggagccaccagca

SEQ ID NO: 1632095 - RNA, 16 nt, Homo sapiens
caugcucugcagcauu

SEQ ID NO: 1632096 - RNA, 16 nt, Homo sapiens
caugcucuuaaaacuu

SEQ ID NO: 1632097 - RNA, 13 nt, Homo sapiens
caugcugcaaagg

SEQ ID NO: 1632098 - RNA, 23 nt, Homo sapiens
caugcugcaguggguaguucuaa

SEQ ID NO: 1632099 - RNA, 13 nt, Homo sapiens
caugcugugagca

SEQ ID NO: 1632100 - RNA, 16 nt, Homo sapiens
caugcuucuacuguga

SEQ ID NO: 1632101 - RNA, 17 nt, Homo sapiens
caugcuucuacugugac

SEQ ID NO: 1632102 - RNA, 22 nt, Homo sapiens
caugcuucuacugugacacuua

SEQ ID NO: 1632103 - RNA, 23 nt, Homo sapiens
caugcuugcauaagagcuuaaga

SEQ ID NO: 1632104 - RNA, 17 nt, Homo sapiens
cauggaguauagugcaa

SEQ ID NO: 1632105 - RNA, 24 nt, Homo sapiens
cauggcaucuucaauaugaaucua

SEQ ID NO: 1632106 - RNA, 17 nt, Homo sapiens
cauggccuaugcacaua

SEQ ID NO: 1632107 - RNA, 21 nt, Homo sapiens
cauggcuuagagaggcuugaa

SEQ ID NO: 1632108 - RNA, 17 nt, Homo sapiens
cauggguggaaagugcu

SEQ ID NO: 1632109 - RNA, 20 nt, Homo sapiens
caugguacuuccucugugaa

SEQ ID NO: 1632110 - RNA, 17 nt, Homo sapiens
caugguuuaaagucaca

SEQ ID NO: 1632111 - RNA, 20 nt, Homo sapiens
cauguaaaauaugucuuucu

SEQ ID NO: 1632112 - RNA, 13 nt, Homo sapiens
cauguaaccacug

SEQ ID NO: 1632113 - RNA, 11 nt, Homo sapiens
cacaacaaucc

SEQ ID NO: 1632114 - RNA, 11 nt, Homo sapiens
cacaacacaga

SEQ ID NO: 1632115 - RNA, 21 nt, Homo sapiens
cacaacuccuacaugauguua

SEQ ID NO: 1632116 - RNA, 14 nt, Homo sapiens
cacaaucccuaaaa

SEQ ID NO: 1632117 - RNA, 16 nt, Homo sapiens
cacacagacaguuucu

SEQ ID NO: 1632118 - RNA, 20 nt, Homo sapiens
cacacagacaguuucugaca

SEQ ID NO: 1632119 - RNA, 14 nt, Homo sapiens
cacacccaugcaca

SEQ ID NO: 1632120 - RNA, 21 nt, Homo sapiens
cacacccauguaaccacugca

SEQ ID NO: 1632121 - RNA, 14 nt, Homo sapiens
cacacucagcacaa

SEQ ID NO: 1632122 - RNA, 16 nt, Homo sapiens
cacacuccaagauaug

SEQ ID NO: 1632123 - RNA, 21 nt, Homo sapiens
cacacuucggcucucuggaca

SEQ ID NO: 1632124 - RNA, 14 nt, Homo sapiens
cacacuuggaugca

SEQ ID NO: 1632125 - RNA, 18 nt, Homo sapiens
cacagaaacuauaugcaa

SEQ ID NO: 1632126 - RNA, 15 nt, Homo sapiens
cacagacaaagugcu

SEQ ID NO: 1632127 - RNA, 14 nt, Homo sapiens
cacagacaguuucu

SEQ ID NO: 1632128 - RNA, 13 nt, Homo sapiens
cacagauuaucaa

SEQ ID NO: 1632129 - RNA, 14 nt, Homo sapiens
cacaggaccaccuc

SEQ ID NO: 1632130 - RNA, 19 nt, Homo sapiens
cacaggccacggaccaaug

SEQ ID NO: 1632131 - RNA, 23 nt, Homo sapiens
cacaggcccuggcugaggucucu

SEQ ID NO: 1632132 - RNA, 17 nt, Homo sapiens
cacagggagugcacaua

SEQ ID NO: 1632133 - RNA, 18 nt, Homo sapiens
cacagucucauuuugaca

SEQ ID NO: 1632134 - RNA, 18 nt, Homo sapiens
cacauaaagcacuaccua

SEQ ID NO: 1632135 - RNA, 13 nt, Homo sapiens
cacauauggacuc

SEQ ID NO: 1632136 - RNA, 18 nt, Homo sapiens
cacauauggacucugcac

SEQ ID NO: 1632137 - RNA, 21 nt, Homo sapiens
cacauaugucuuacuacuuua

SEQ ID NO: 1632138 - RNA, 19 nt, Homo sapiens
cacauccaggaaggaccuu

SEQ ID NO: 1632139 - RNA, 20 nt, Homo sapiens
cacaucccuauagaccacug

SEQ ID NO: 1632140 - RNA, 14 nt, Homo sapiens
cacaugaggccauc

SEQ ID NO: 1632141 - RNA, 15 nt, Homo sapiens
cacaugcuacaagac

SEQ ID NO: 1632142 - RNA, 18 nt, Homo sapiens
cacauggccuaugcacau

SEQ ID NO: 1632143 - RNA, 21 nt, Homo sapiens
cacauguccuauuacugaugu

SEQ ID NO: 1632144 - RNA, 19 nt, Homo sapiens
cacaugucuuguacaugug

SEQ ID NO: 1632145 - RNA, 20 nt, Homo sapiens
cacaugucuuguacaugugu

SEQ ID NO: 1632146 - RNA, 22 nt, Homo sapiens
cacaugucuuguacauguguag

SEQ ID NO: 1632147 - RNA, 15 nt, Homo sapiens
cacaugugacacaua

SEQ ID NO: 1632148 - RNA, 15 nt, Homo sapiens
cacauuaacucccuc

SEQ ID NO: 1632149 - RNA, 23 nt, Homo sapiens
cacauuaacucccuccaccagcc

SEQ ID NO: 1632150 - RNA, 20 nt, Homo sapiens
caccaaggaacucuacuuca

SEQ ID NO: 1632151 - RNA, 22 nt, Homo sapiens
caccaaguaccaguauaagcau

SEQ ID NO: 1632152 - RNA, 16 nt, Homo sapiens
caccacaccuggcuaa

SEQ ID NO: 1632153 - RNA, 22 nt, Homo sapiens
caccauugaacuguaccaugug

SEQ ID NO: 1632154 - RNA, 17 nt, Homo sapiens
cacccagggacacucca

SEQ ID NO: 1632155 - RNA, 13 nt, Homo sapiens
cacccagucucau

SEQ ID NO: 1632156 - RNA, 16 nt, Homo sapiens
cacccaugcccagcug

SEQ ID NO: 1632157 - RNA, 17 nt, Homo sapiens
cacccaugcccagcugu

SEQ ID NO: 1632158 - RNA, 14 nt, Homo sapiens
caccccagagccau

SEQ ID NO: 1632159 - RNA, 22 nt, Homo sapiens
cacccggcucguguauuuauua

SEQ ID NO: 1632160 - RNA, 17 nt, Homo sapiens
cacccuccuugcaggau

SEQ ID NO: 1632161 - RNA, 19 nt, Homo sapiens
cacccugcaggacuugcca

SEQ ID NO: 1632162 - RNA, 22 nt, Homo sapiens
caccgagcgggugcaagcacuc

SEQ ID NO: 1632163 - RNA, 20 nt, Homo sapiens
caccuacccagggcugccgc

SEQ ID NO: 1632164 - RNA, 12 nt, Homo sapiens
caccucacugaa

SEQ ID NO: 1632165 - RNA, 18 nt, Homo sapiens
caccugagacaugcugaa

SEQ ID NO: 1632166 - RNA, 22 nt, Homo sapiens
caccugagacaugcugaaauua

SEQ ID NO: 1632167 - RNA, 13 nt, Homo sapiens
caccuucaccucg

SEQ ID NO: 1632168 - RNA, 19 nt, Homo sapiens
caccuucacucuccagggu

SEQ ID NO: 1632169 - RNA, 13 nt, Homo sapiens
caccuugcuccca

SEQ ID NO: 1632170 - RNA, 22 nt, Homo sapiens
cacgaucucaacucacugcaag

SEQ ID NO: 1632171 - RNA, 20 nt, Homo sapiens
cacggccacaucaaagaggc

SEQ ID NO: 1632172 - RNA, 15 nt, Homo sapiens
cacguggccucguga

SEQ ID NO: 1632173 - RNA, 14 nt, Homo sapiens
cacuaaacuuuauu

SEQ ID NO: 1632174 - RNA, 14 nt, Homo sapiens
cacuagucagaaaa

SEQ ID NO: 1632175 - RNA, 12 nt, Homo sapiens
cacuagucucac

SEQ ID NO: 1632176 - RNA, 16 nt, Homo sapiens
cacuagugcaauucca

SEQ ID NO: 1632177 - RNA, 13 nt, Homo sapiens
cacucagcugucc

SEQ ID NO: 1632178 - RNA, 22 nt, Homo sapiens
cacucaguuuaugcugugcuaa

SEQ ID NO: 1632179 - RNA, 21 nt, Homo sapiens
cacuccccagagcugugccag

SEQ ID NO: 1632180 - RNA, 20 nt, Homo sapiens
cacuccgcgccgaugccacc

SEQ ID NO: 1632181 - RNA, 21 nt, Homo sapiens
cacuccuucucucacuguguu

SEQ ID NO: 1632182 - RNA, 16 nt, Homo sapiens
cacucggggucccugg

SEQ ID NO: 1632183 - RNA, 14 nt, Homo sapiens
cacucugcucugau

SEQ ID NO: 1632184 - RNA, 17 nt, Homo sapiens
cacucugggcuguaacg

SEQ ID NO: 1632185 - RNA, 18 nt, Homo sapiens
cacugaaaacaucuggaa

SEQ ID NO: 1632186 - RNA, 15 nt, Homo sapiens
cacugauaaucacac

SEQ ID NO: 1632187 - RNA, 17 nt, Homo sapiens
cacugauaaucacacug

SEQ ID NO: 1632188 - RNA, 14 nt, Homo sapiens
cacuggacugucua

SEQ ID NO: 1632189 - RNA, 21 nt, Homo sapiens
cacugggcugcagagacugga

SEQ ID NO: 1632190 - RNA, 12 nt, Homo sapiens
cacuguucaaua

SEQ ID NO: 1632191 - RNA, 14 nt, Homo sapiens
cacuguuccagucu

SEQ ID NO: 1632192 - RNA, 15 nt, Homo sapiens
cacuguuucaucuca

SEQ ID NO: 1632193 - RNA, 16 nt, Homo sapiens
cacuguuucaucucag

SEQ ID NO: 1632194 - RNA, 20 nt, Homo sapiens
cacuuaaucuucucucuuga

SEQ ID NO: 1632195 - RNA, 17 nt, Homo sapiens
cacuuauacccaugaac

SEQ ID NO: 1632196 - RNA, 20 nt, Homo sapiens
cacuuauacccaugaacuua

SEQ ID NO: 1632197 - RNA, 14 nt, Homo sapiens
cacuuccccaaaga

SEQ ID NO: 1632198 - RNA, 13 nt, Homo sapiens
cacuuucccaaaa

SEQ ID NO: 1632199 - RNA, 21 nt, Homo sapiens
cacuuuccccgugggccaugg

SEQ ID NO: 1632200 - RNA, 21 nt, Homo sapiens
caaaaaauauauaucacucua

SEQ ID NO: 1632201 - RNA, 15 nt, Homo sapiens
caaaaacuacacaua

SEQ ID NO: 1632202 - RNA, 16 nt, Homo sapiens
caaaaaggccaagaga

SEQ ID NO: 1632203 - RNA, 15 nt, Homo sapiens
caaaaaugauccuca

SEQ ID NO: 1632204 - RNA, 19 nt, Homo sapiens
caaaacccaugcauuucau

SEQ ID NO: 1632205 - RNA, 16 nt, Homo sapiens
caaaauauguuuaaaa

SEQ ID NO: 1632206 - RNA, 15 nt, Homo sapiens
caaaaucaacaugac

SEQ ID NO: 1632207 - RNA, 12 nt, Homo sapiens
caaaaucucuac

SEQ ID NO: 1632208 - RNA, 20 nt, Homo sapiens
caaaauugcuucuucuucaa

SEQ ID NO: 1632209 - RNA, 12 nt, Homo sapiens
caaacacccaug

SEQ ID NO: 1632210 - RNA, 17 nt, Homo sapiens
caaacacccaugcccag

SEQ ID NO: 1632211 - RNA, 17 nt, Homo sapiens
caaacacuccacccucc

SEQ ID NO: 1632212 - RNA, 13 nt, Homo sapiens
caaaccaagccau

SEQ ID NO: 1632213 - RNA, 13 nt, Homo sapiens
caaacgagacuuu

SEQ ID NO: 1632214 - RNA, 16 nt, Homo sapiens
caaacuugcaguuuaa

SEQ ID NO: 1632215 - RNA, 14 nt, Homo sapiens
caaacuugcuuuau

SEQ ID NO: 1632216 - RNA, 14 nt, Homo sapiens
caaagaaaaugccu

SEQ ID NO: 1632217 - RNA, 14 nt, Homo sapiens
caaagaaacaccac

SEQ ID NO: 1632218 - RNA, 16 nt, Homo sapiens
caaagaaacaccacuu

SEQ ID NO: 1632219 - RNA, 21 nt, Homo sapiens
caaagagaaugagaagacaug

SEQ ID NO: 1632220 - RNA, 20 nt, Homo sapiens
caaagaugcccccuccagga

SEQ ID NO: 1632221 - RNA, 22 nt, Homo sapiens
caaagcaacaguccacacuuug

SEQ ID NO: 1632222 - RNA, 21 nt, Homo sapiens
caaagcacuugcuuacauccu

SEQ ID NO: 1632223 - RNA, 22 nt, Homo sapiens
caaagcccuuguccccaugaaa

SEQ ID NO: 1632224 - RNA, 17 nt, Homo sapiens
caaagcuuaugugacau

SEQ ID NO: 1632225 - RNA, 18 nt, Homo sapiens
caaaggagaagcacagcu

SEQ ID NO: 1632226 - RNA, 18 nt, Homo sapiens
caaagguauuaguacaau

SEQ ID NO: 1632227 - RNA, 22 nt, Homo sapiens
caaaguagggaugcggauccug

SEQ ID NO: 1632228 - RNA, 20 nt, Homo sapiens
caaaguccguguccuaccuc

SEQ ID NO: 1632229 - RNA, 17 nt, Homo sapiens
caaagugcuggaauuac

SEQ ID NO: 1632230 - RNA, 17 nt, Homo sapiens
caaaguguaugugacca

SEQ ID NO: 1632231 - RNA, 14 nt, Homo sapiens
caaaguugcucacc

SEQ ID NO: 1632232 - RNA, 21 nt, Homo sapiens
caaauacaaucagcccagugc

SEQ ID NO: 1632233 - RNA, 18 nt, Homo sapiens
caaauagaauuugagcau

SEQ ID NO: 1632234 - RNA, 20 nt, Homo sapiens
caaauagaauuugagcauca

SEQ ID NO: 1632235 - RNA, 17 nt, Homo sapiens
caaauauuauucuuaau

SEQ ID NO: 1632236 - RNA, 17 nt, Homo sapiens
caaaucaaaacucacaa

SEQ ID NO: 1632237 - RNA, 19 nt, Homo sapiens
caaauccaaggaaacaugc

SEQ ID NO: 1632238 - RNA, 16 nt, Homo sapiens
caaaucuaccacugua

SEQ ID NO: 1632239 - RNA, 14 nt, Homo sapiens
caaaugagccauga

SEQ ID NO: 1632240 - RNA, 16 nt, Homo sapiens
caaaugagccaugaga

SEQ ID NO: 1632241 - RNA, 14 nt, Homo sapiens
caaauggcauauga

SEQ ID NO: 1632242 - RNA, 18 nt, Homo sapiens
caaaugggaaaaccagac

SEQ ID NO: 1632243 - RNA, 20 nt, Homo sapiens
caaauuaaaacaaauauaca

SEQ ID NO: 1632244 - RNA, 17 nt, Homo sapiens
caaauuucauugcacuu

SEQ ID NO: 1632245 - RNA, 22 nt, Homo sapiens
caacaaauuucauugcacuuuc

SEQ ID NO: 1632246 - RNA, 18 nt, Homo sapiens
caacaauuuauccauuca

SEQ ID NO: 1632247 - RNA, 15 nt, Homo sapiens
caacaccaagcacag

SEQ ID NO: 1632248 - RNA, 13 nt, Homo sapiens
caacagcacacag

SEQ ID NO: 1632249 - RNA, 21 nt, Homo sapiens
caacagggaagaaacuuucug

SEQ ID NO: 1632250 - RNA, 16 nt, Homo sapiens
caacaugcacugaugu

SEQ ID NO: 1632251 - RNA, 13 nt, Homo sapiens
caaccccaggcug

SEQ ID NO: 1632252 - RNA, 12 nt, Homo sapiens
caaccccagugg

SEQ ID NO: 1632253 - RNA, 13 nt, Homo sapiens
caaccccuagcug

SEQ ID NO: 1632254 - RNA, 21 nt, Homo sapiens
caacccgugccaaguccaggu

SEQ ID NO: 1632255 - RNA, 18 nt, Homo sapiens
caacgccucacugaaaca

SEQ ID NO: 1632256 - RNA, 20 nt, Homo sapiens
caacuaauacaugguuuaaa

SEQ ID NO: 1632257 - RNA, 21 nt, Homo sapiens
caacuaaugagggaaaucugu

SEQ ID NO: 1632258 - RNA, 22 nt, Homo sapiens
caacucuccccugaccugugag

SEQ ID NO: 1632259 - RNA, 17 nt, Homo sapiens
caacugaacugaacuaa

SEQ ID NO: 1632260 - RNA, 20 nt, Homo sapiens
caacugaacuugcuauggaa

SEQ ID NO: 1632261 - RNA, 20 nt, Homo sapiens
caacuguuucccugcugaau

SEQ ID NO: 1632262 - RNA, 15 nt, Homo sapiens
caagaagccuuuccu

SEQ ID NO: 1632263 - RNA, 17 nt, Homo sapiens
caagaaggaacaauaaa

SEQ ID NO: 1632264 - RNA, 14 nt, Homo sapiens
caagaaugugcacu

SEQ ID NO: 1632265 - RNA, 16 nt, Homo sapiens
caagaccucugugcac

SEQ ID NO: 1632266 - RNA, 18 nt, Homo sapiens
caagaccucugugcacuu

SEQ ID NO: 1632267 - RNA, 20 nt, Homo sapiens
caagagcaggaggugccuga

SEQ ID NO: 1632268 - RNA, 14 nt, Homo sapiens
caagaucugccaga

SEQ ID NO: 1632269 - RNA, 20 nt, Homo sapiens
caagauuuaccaauucaccc

SEQ ID NO: 1632270 - RNA, 15 nt, Homo sapiens
caagcaaagugcuuu

SEQ ID NO: 1632271 - RNA, 17 nt, Homo sapiens
caagccccauuuccuca

SEQ ID NO: 1632272 - RNA, 13 nt, Homo sapiens
caagcgauucucc

SEQ ID NO: 1632273 - RNA, 15 nt, Homo sapiens
caagcuagacugugu

SEQ ID NO: 1632274 - RNA, 16 nt, Homo sapiens
caagcuccaaauccaa

SEQ ID NO: 1632275 - RNA, 22 nt, Homo sapiens
caaggacguggaugacccuccc

SEQ ID NO: 1632276 - RNA, 13 nt, Homo sapiens
caaggacucuucc

SEQ ID NO: 1632277 - RNA, 14 nt, Homo sapiens
caaggaguacaaug

SEQ ID NO: 1632278 - RNA, 20 nt, Homo sapiens
caaggcaguugcuuguguuu

SEQ ID NO: 1632279 - RNA, 23 nt, Homo sapiens
caaggcucugcuauacagucuau

SEQ ID NO: 1632280 - RNA, 13 nt, Homo sapiens
caagggacaguga

SEQ ID NO: 1632281 - RNA, 15 nt, Homo sapiens
caagggacccaugag

SEQ ID NO: 1632282 - RNA, 14 nt, Homo sapiens
caagggaggggugg

SEQ ID NO: 1632283 - RNA, 18 nt, Homo sapiens
caagggcacgugaaguca

SEQ ID NO: 1632284 - RNA, 14 nt, Homo sapiens
caaggucaugccac

SEQ ID NO: 1632285 - RNA, 18 nt, Homo sapiens
gagcuuuguccugaagga

SEQ ID NO: 1632286 - RNA, 23 nt, Homo sapiens
gaggagccuggagagaaggggca

SEQ ID NO: 1632287 - RNA, 14 nt, Homo sapiens
gaggcaaugggagc

SEQ ID NO: 1632288 - RNA, 15 nt, Homo sapiens
gaggcaggcauuccu

SEQ ID NO: 1632289 - RNA, 11 nt, Homo sapiens
gaggcaucuga

SEQ ID NO: 1632290 - RNA, 16 nt, Homo sapiens
gaggccacacucagca

SEQ ID NO: 1632291 - RNA, 19 nt, Homo sapiens
gagggaccaauauuaccau

SEQ ID NO: 1632292 - RNA, 22 nt, Homo sapiens
gagggacgacaccucugguuuu

SEQ ID NO: 1632293 - RNA, 17 nt, Homo sapiens
gagggauugcugugaaa

SEQ ID NO: 1632294 - RNA, 14 nt, Homo sapiens
gagggcaagcccug

SEQ ID NO: 1632295 - RNA, 19 nt, Homo sapiens
gaggggucuauagguuugu

SEQ ID NO: 1632296 - RNA, 15 nt, Homo sapiens
gaggguuuugcucuu

SEQ ID NO: 1632297 - RNA, 15 nt, Homo sapiens
gagguaaaaaacugu

SEQ ID NO: 1632298 - RNA, 17 nt, Homo sapiens
gagguccugagcacugc

SEQ ID NO: 1632299 - RNA, 20 nt, Homo sapiens
gaggugggaggauugcuuga

SEQ ID NO: 1632300 - RNA, 22 nt, Homo sapiens
gaguaauaagcauggugucagu

SEQ ID NO: 1632301 - RNA, 20 nt, Homo sapiens
gagucaacaggucacuugau

SEQ ID NO: 1632302 - RNA, 14 nt, Homo sapiens
gagucccagagcuc

SEQ ID NO: 1632303 - RNA, 18 nt, Homo sapiens
gagucuauguucaaagac

SEQ ID NO: 1632304 - RNA, 23 nt, Homo sapiens
gagugccuuuucgagacuggcag

SEQ ID NO: 1632305 - RNA, 19 nt, Homo sapiens
gaguggaacagaaggggug

SEQ ID NO: 1632306 - RNA, 14 nt, Homo sapiens
gaguggcacguuua

SEQ ID NO: 1632307 - RNA, 12 nt, Homo sapiens
gaguguagccua

SEQ ID NO: 1632308 - RNA, 13 nt, Homo sapiens
gaguguagcugua

SEQ ID NO: 1632309 - RNA, 12 nt, Homo sapiens
gagugugacagg

SEQ ID NO: 1632310 - RNA, 22 nt, Homo sapiens
gaguguuguuuugugguaucau

SEQ ID NO: 1632311 - RNA, 18 nt, Homo sapiens
gaguuaaugauggcagag

SEQ ID NO: 1632312 - RNA, 21 nt, Homo sapiens
gaguuaggaccaccaauggau

SEQ ID NO: 1632313 - RNA, 22 nt, Homo sapiens
gaguuaucaagagacacucccc

SEQ ID NO: 1632314 - RNA, 21 nt, Homo sapiens
gaguuuugcuuuugacuccag

SEQ ID NO: 1632315 - RNA, 12 nt, Homo sapiens
gauaaaccaguu

SEQ ID NO: 1632316 - RNA, 11 nt, Homo sapiens
gauaaagccac

SEQ ID NO: 1632317 - RNA, 20 nt, Homo sapiens
gauaagacacccccucaaac

SEQ ID NO: 1632318 - RNA, 15 nt, Homo sapiens
gauaagagaauaccu

SEQ ID NO: 1632319 - RNA, 18 nt, Homo sapiens
gauaaucucuccauuccc

SEQ ID NO: 1632320 - RNA, 23 nt, Homo sapiens
gauacaguuuugaguaaaaagac

SEQ ID NO: 1632321 - RNA, 20 nt, Homo sapiens
gauacuaacauuuucauuga

SEQ ID NO: 1632322 - RNA, 15 nt, Homo sapiens
gauacuuuuacaggu

SEQ ID NO: 1632323 - RNA, 22 nt, Homo sapiens
gauagacuuauugccaaaaaca

SEQ ID NO: 1632324 - RNA, 12 nt, Homo sapiens
gauagauguuug

SEQ ID NO: 1632325 - RNA, 16 nt, Homo sapiens
gauaguugauuuucaa

SEQ ID NO: 1632326 - RNA, 15 nt, Homo sapiens
gauauaaaagacuga

SEQ ID NO: 1632327 - RNA, 21 nt, Homo sapiens
gauauauguguauacauacau

SEQ ID NO: 1632328 - RNA, 22 nt, Homo sapiens
gauauauuagggacacuuucac

SEQ ID NO: 1632329 - RNA, 14 nt, Homo sapiens
gauauugucauauc

SEQ ID NO: 1632330 - RNA, 15 nt, Homo sapiens
gauauuucaagcuca

SEQ ID NO: 1632331 - RNA, 18 nt, Homo sapiens
gaucaacgccucacugaa

SEQ ID NO: 1632332 - RNA, 22 nt, Homo sapiens
gaucaagcugugagacaguggg

SEQ ID NO: 1632333 - RNA, 14 nt, Homo sapiens
gaucagaaagugac

SEQ ID NO: 1632334 - RNA, 18 nt, Homo sapiens
gaucagagcgcacaggga

SEQ ID NO: 1632335 - RNA, 20 nt, Homo sapiens
gaucagcuuugaaggcugga

SEQ ID NO: 1632336 - RNA, 20 nt, Homo sapiens
gauccugccuugcugugaaa

SEQ ID NO: 1632337 - RNA, 22 nt, Homo sapiens
gaucucggcucagugcaaccuc

SEQ ID NO: 1632338 - RNA, 18 nt, Homo sapiens
gaucucugagaccacaga

SEQ ID NO: 1632339 - RNA, 18 nt, Homo sapiens
gaucugcaucugauagaa

SEQ ID NO: 1632340 - RNA, 20 nt, Homo sapiens
gaucugugccauagaacaag

SEQ ID NO: 1632341 - RNA, 17 nt, Homo sapiens
gaugagcaagacauacu

SEQ ID NO: 1632342 - RNA, 15 nt, Homo sapiens
gaugauauucucacc

SEQ ID NO: 1632343 - RNA, 19 nt, Homo sapiens
gaugcaacaaauguggcca

SEQ ID NO: 1632344 - RNA, 11 nt, Homo sapiens
gaugcacucuc

SEQ ID NO: 1632345 - RNA, 22 nt, Homo sapiens
gaugcauagccuggacacagag

SEQ ID NO: 1632346 - RNA, 17 nt, Homo sapiens
gaugccuguguacugcc

SEQ ID NO: 1632347 - RNA, 21 nt, Homo sapiens
gaugccuguguacugccuuaa

SEQ ID NO: 1632348 - RNA, 18 nt, Homo sapiens
gauggaaaggagccuagg

SEQ ID NO: 1632349 - RNA, 18 nt, Homo sapiens
gauggaugggaugcacuc

SEQ ID NO: 1632350 - RNA, 19 nt, Homo sapiens
gaugguuuuaucuucccuu

SEQ ID NO: 1632351 - RNA, 18 nt, Homo sapiens
gauguacaugauugccaa

SEQ ID NO: 1632352 - RNA, 20 nt, Homo sapiens
gauguauaaaauggucaugg

SEQ ID NO: 1632353 - RNA, 18 nt, Homo sapiens
gauguaugaucucucuag

SEQ ID NO: 1632354 - RNA, 19 nt, Homo sapiens
gaugucaucacacucucca

SEQ ID NO: 1632355 - RNA, 20 nt, Homo sapiens
gaugucaucacacucuccau

SEQ ID NO: 1632356 - RNA, 20 nt, Homo sapiens
gauguuuuacgucugggaga

SEQ ID NO: 1632357 - RNA, 23 nt, Homo sapiens
gauguuuuauccuuacaauguga

SEQ ID NO: 1632358 - RNA, 14 nt, Homo sapiens
gauuaaacaaguau

SEQ ID NO: 1632359 - RNA, 14 nt, Homo sapiens
gauuaauguuuuca

SEQ ID NO: 1632360 - RNA, 15 nt, Homo sapiens
gauuauaagaguaau

SEQ ID NO: 1632361 - RNA, 18 nt, Homo sapiens
gauuauaagaguaauaua

SEQ ID NO: 1632362 - RNA, 19 nt, Homo sapiens
gauuaugagacacaggaug

SEQ ID NO: 1632363 - RNA, 21 nt, Homo sapiens
gauucaagacucaauguggaa

SEQ ID NO: 1632364 - RNA, 12 nt, Homo sapiens
gauuccuggaag

SEQ ID NO: 1632365 - RNA, 14 nt, Homo sapiens
gauucgaaacucca

SEQ ID NO: 1632366 - RNA, 14 nt, Homo sapiens
gauugcuggggcca

SEQ ID NO: 1632367 - RNA, 17 nt, Homo sapiens
gauugugugacuauuca

SEQ ID NO: 1632368 - RNA, 18 nt, Homo sapiens
gauuuauuuucaauuaau

SEQ ID NO: 1632369 - RNA, 18 nt, Homo sapiens
gauuucaauagcuuugua

SEQ ID NO: 1632370 - RNA, 16 nt, Homo sapiens
gauuuccuucugcuau

SEQ ID NO: 1632371 - RNA, 17 nt, Homo sapiens
gauuugaugggccacaa

SEQ ID NO: 1632372 - RNA, 16 nt, Homo sapiens
gcaaaaggccucuugu

SEQ ID NO: 1632373 - RNA, 13 nt, Homo sapiens
gcaaacaugccag

SEQ ID NO: 1632374 - RNA, 15 nt, Homo sapiens
gcaaacgagacuuuc

SEQ ID NO: 1632375 - RNA, 22 nt, Homo sapiens
gcaaagauuuuuggcacuuugu

SEQ ID NO: 1632376 - RNA, 17 nt, Homo sapiens
gcaaaguccguguccua

SEQ ID NO: 1632377 - RNA, 13 nt, Homo sapiens
gcaaagugcugaa

SEQ ID NO: 1632378 - RNA, 13 nt, Homo sapiens
gcaaauacaauca

SEQ ID NO: 1632379 - RNA, 19 nt, Homo sapiens
gcaaauuuucagcauuaag

SEQ ID NO: 1632380 - RNA, 16 nt, Homo sapiens
gcaacagauagauguu

SEQ ID NO: 1632381 - RNA, 20 nt, Homo sapiens
gaauuauuguagacaugccc

SEQ ID NO: 1632382 - RNA, 13 nt, Homo sapiens
gaauuauuugccu

SEQ ID NO: 1632383 - RNA, 11 nt, Homo sapiens
gaauucagugc

SEQ ID NO: 1632384 - RNA, 17 nt, Homo sapiens
gaauucagugccuucaa

SEQ ID NO: 1632385 - RNA, 18 nt, Homo sapiens
gaauuggaaaggaaaaga

SEQ ID NO: 1632386 - RNA, 20 nt, Homo sapiens
gaauuuaauacagacaucua

SEQ ID NO: 1632387 - RNA, 19 nt, Homo sapiens
gaauuugaagagauugcug

SEQ ID NO: 1632388 - RNA, 15 nt, Homo sapiens
gacaaaggagccugu

SEQ ID NO: 1632389 - RNA, 18 nt, Homo sapiens
gacaaccuggacccagau

SEQ ID NO: 1632390 - RNA, 14 nt, Homo sapiens
gacaagaacaaagc

SEQ ID NO: 1632391 - RNA, 17 nt, Homo sapiens
gacaagcugcauuucag

SEQ ID NO: 1632392 - RNA, 14 nt, Homo sapiens
gacaaggugcuaac

SEQ ID NO: 1632393 - RNA, 15 nt, Homo sapiens
gacaaguauggcucc

SEQ ID NO: 1632394 - RNA, 23 nt, Homo sapiens
gacaagucuuucuccucuuugag

SEQ ID NO: 1632395 - RNA, 13 nt, Homo sapiens
gacacauaugcac

SEQ ID NO: 1632396 - RNA, 15 nt, Homo sapiens
gacacauaugcaccu

SEQ ID NO: 1632397 - RNA, 19 nt, Homo sapiens
gacacauaugcaccuugug

SEQ ID NO: 1632398 - RNA, 20 nt, Homo sapiens
gacaccucaagguguucucu

SEQ ID NO: 1632399 - RNA, 20 nt, Homo sapiens
gacaccugagacaugcugaa

SEQ ID NO: 1632400 - RNA, 20 nt, Homo sapiens
gacaccuuuacuaacucugg

SEQ ID NO: 1632401 - RNA, 15 nt, Homo sapiens
gacacggccaugacc

SEQ ID NO: 1632402 - RNA, 18 nt, Homo sapiens
gacacuaaccagagucag

SEQ ID NO: 1632403 - RNA, 14 nt, Homo sapiens
gacagaaccuuguu

SEQ ID NO: 1632404 - RNA, 19 nt, Homo sapiens
gacagaucaagcugugaga

SEQ ID NO: 1632405 - RNA, 16 nt, Homo sapiens
gacagcuuccuuuccu

SEQ ID NO: 1632406 - RNA, 16 nt, Homo sapiens
gacaggacuaacacuc

SEQ ID NO: 1632407 - RNA, 18 nt, Homo sapiens
gacaggacuaacacucag

SEQ ID NO: 1632408 - RNA, 17 nt, Homo sapiens
gacaggcgcaacuccuc

SEQ ID NO: 1632409 - RNA, 19 nt, Homo sapiens
gacagggcaaacaacugaa

SEQ ID NO: 1632410 - RNA, 11 nt, Homo sapiens
gacagggccag

SEQ ID NO: 1632411 - RNA, 14 nt, Homo sapiens
gacauaaagccaug

SEQ ID NO: 1632412 - RNA, 13 nt, Homo sapiens
gacauaacauuuu

SEQ ID NO: 1632413 - RNA, 17 nt, Homo sapiens
gacauaaucuaguuuua

SEQ ID NO: 1632414 - RNA, 17 nt, Homo sapiens
gacauacuuaaugcaua

SEQ ID NO: 1632415 - RNA, 14 nt, Homo sapiens
gacauguagcuucu

SEQ ID NO: 1632416 - RNA, 17 nt, Homo sapiens
gaccacagcacagccaa

SEQ ID NO: 1632417 - RNA, 24 nt, Homo sapiens
gaccaccuccucugccagcaggaa

SEQ ID NO: 1632418 - RNA, 23 nt, Homo sapiens
gacccagccccuuccccugggaa

SEQ ID NO: 1632419 - RNA, 20 nt, Homo sapiens
gacccaggccuggccaguca

SEQ ID NO: 1632420 - RNA, 20 nt, Homo sapiens
gacccaguggacucuuccac

SEQ ID NO: 1632421 - RNA, 18 nt, Homo sapiens
gaccccgcacccggcucg

SEQ ID NO: 1632422 - RNA, 23 nt, Homo sapiens
gacccucgggccccauccucauc

SEQ ID NO: 1632423 - RNA, 24 nt, Homo sapiens
gacccuuguggguccaugcuaaca

SEQ ID NO: 1632424 - RNA, 17 nt, Homo sapiens
gaccucaggugcuaggg

SEQ ID NO: 1632425 - RNA, 18 nt, Homo sapiens
gaccucgugaucuaccca

SEQ ID NO: 1632426 - RNA, 14 nt, Homo sapiens
gaccuugcauguaa

SEQ ID NO: 1632427 - RNA, 22 nt, Homo sapiens
gaccuuuauaucugucuuuuau

SEQ ID NO: 1632428 - RNA, 16 nt, Homo sapiens
gacgaguaacuccccu

SEQ ID NO: 1632429 - RNA, 19 nt, Homo sapiens
gacgugauuuugcuguaga

SEQ ID NO: 1632430 - RNA, 21 nt, Homo sapiens
gacuacaggcgccugccacaa

SEQ ID NO: 1632431 - RNA, 22 nt, Homo sapiens
gacucaauguggaaaaaauauu

SEQ ID NO: 1632432 - RNA, 16 nt, Homo sapiens
gacucacuuguucuca

SEQ ID NO: 1632433 - RNA, 16 nt, Homo sapiens
gacuccaggaacaaaa

SEQ ID NO: 1632434 - RNA, 16 nt, Homo sapiens
gacucucggcucuuca

SEQ ID NO: 1632435 - RNA, 16 nt, Homo sapiens
gacucugucuaccugg

SEQ ID NO: 1632436 - RNA, 21 nt, Homo sapiens
gacucuugaaguacuuaacau

SEQ ID NO: 1632437 - RNA, 18 nt, Homo sapiens
gacucuugaauaaaaaua

SEQ ID NO: 1632438 - RNA, 17 nt, Homo sapiens
gacucuugcagggguag

SEQ ID NO: 1632439 - RNA, 21 nt, Homo sapiens
gacugaagcgaacaucuucau

SEQ ID NO: 1632440 - RNA, 15 nt, Homo sapiens
gacugccaagccaga

SEQ ID NO: 1632441 - RNA, 19 nt, Homo sapiens
gacugcuucaucugcugua

SEQ ID NO: 1632442 - RNA, 19 nt, Homo sapiens
gacuggaccccgcccagca

SEQ ID NO: 1632443 - RNA, 17 nt, Homo sapiens
gacuggcgugcugagaa

SEQ ID NO: 1632444 - RNA, 21 nt, Homo sapiens
gacugggugagacccaaagcg

SEQ ID NO: 1632445 - RNA, 19 nt, Homo sapiens
gacuguagcuucucuugcu

SEQ ID NO: 1632446 - RNA, 15 nt, Homo sapiens
gacuuacugccugac

SEQ ID NO: 1632447 - RNA, 14 nt, Homo sapiens
gacuucacuaggca

SEQ ID NO: 1632448 - RNA, 18 nt, Homo sapiens
gacuuuguguucauuuca

SEQ ID NO: 1632449 - RNA, 19 nt, Homo sapiens
gacuuuguguucauuucau

SEQ ID NO: 1632450 - RNA, 21 nt, Homo sapiens
gagaaaaaggugccaucucag

SEQ ID NO: 1632451 - RNA, 16 nt, Homo sapiens
gagaaaauguuguaua

SEQ ID NO: 1632452 - RNA, 23 nt, Homo sapiens
gagaaaccauucuuuccccucag

SEQ ID NO: 1632453 - RNA, 21 nt, Homo sapiens
gagaaccuggccuucagugua

SEQ ID NO: 1632454 - RNA, 17 nt, Homo sapiens
gagaagaaagaggugac

SEQ ID NO: 1632455 - RNA, 12 nt, Homo sapiens
gagaagaagcag

SEQ ID NO: 1632456 - RNA, 16 nt, Homo sapiens
gagaagcaauggguca

SEQ ID NO: 1632457 - RNA, 16 nt, Homo sapiens
gagaaggagugccaua

SEQ ID NO: 1632458 - RNA, 18 nt, Homo sapiens
gagaauaaaccaggccug

SEQ ID NO: 1632459 - RNA, 19 nt, Homo sapiens
gagaauaaggaugaaauaa

SEQ ID NO: 1632460 - RNA, 18 nt, Homo sapiens
gagaauaccuuggucuca

SEQ ID NO: 1632461 - RNA, 15 nt, Homo sapiens
gagaaugcuggcaaa

SEQ ID NO: 1632462 - RNA, 19 nt, Homo sapiens
gagaaugugagaagccagc

SEQ ID NO: 1632463 - RNA, 18 nt, Homo sapiens
gagacaccacaaggcagc

SEQ ID NO: 1632464 - RNA, 18 nt, Homo sapiens
gagacagcgcuaaggaug

SEQ ID NO: 1632465 - RNA, 17 nt, Homo sapiens
gagacccggcucucagc

SEQ ID NO: 1632466 - RNA, 18 nt, Homo sapiens
gagacuuaaaaaauacuu

SEQ ID NO: 1632467 - RNA, 23 nt, Homo sapiens
gagagagcccccacccaguuccu

SEQ ID NO: 1632468 - RNA, 21 nt, Homo sapiens
gagagagcuagagggacaaag

SEQ ID NO: 1632469 - RNA, 17 nt, Homo sapiens
gagagcuaggagcaaag

SEQ ID NO: 1632470 - RNA, 14 nt, Homo sapiens
gagagggugacaag

SEQ ID NO: 1632471 - RNA, 18 nt, Homo sapiens
gagagucccagagcucau

SEQ ID NO: 1632472 - RNA, 13 nt, Homo sapiens
gagauaaacuaca

SEQ ID NO: 1632473 - RNA, 16 nt, Homo sapiens
gagaucuaaugugaaa

SEQ ID NO: 1632474 - RNA, 15 nt, Homo sapiens
gagaugaccagggau

SEQ ID NO: 1632475 - RNA, 19 nt, Homo sapiens
gagaugagucagugccaug

SEQ ID NO: 1632476 - RNA, 16 nt, Homo sapiens
gagaugauacauccaa

SEQ ID NO: 1632477 - RNA, 20 nt, Homo sapiens
gagauugagcagaagaucaa

SEQ ID NO: 1632478 - RNA, 15 nt, Homo sapiens
gagcaacagaggaca

SEQ ID NO: 1632479 - RNA, 14 nt, Homo sapiens
gagcaaguccuucc

SEQ ID NO: 1632480 - RNA, 17 nt, Homo sapiens
cuuauuaaucauacaaa

SEQ ID NO: 1632481 - RNA, 17 nt, Homo sapiens
cuuauuaugugcaacau

SEQ ID NO: 1632482 - RNA, 19 nt, Homo sapiens
cuucaaaguuaaugggaug

SEQ ID NO: 1632483 - RNA, 14 nt, Homo sapiens
cuucaacaugacau

SEQ ID NO: 1632484 - RNA, 21 nt, Homo sapiens
cuucaacaugacauccagaga

SEQ ID NO: 1632485 - RNA, 22 nt, Homo sapiens
cuuuuugggugauuaaaaaacu

SEQ ID NO: 1632486 - RNA, 20 nt, Homo sapiens
cuuuuuuagaaaugcaaaau

SEQ ID NO: 1632487 - RNA, 18 nt, Homo sapiens
cuuuuuuucuuguaugca

SEQ ID NO: 1632488 - RNA, 18 nt, Homo sapiens
cuuuuuuuuaaguuacac

SEQ ID NO: 1632489 - RNA, 18 nt, Homo sapiens
cuuuuuuuuaguucaaua

SEQ ID NO: 1632490 - RNA, 13 nt, Homo sapiens
gaaaaaauggaug

SEQ ID NO: 1632491 - RNA, 11 nt, Homo sapiens
gaaaaaccuug

SEQ ID NO: 1632492 - RNA, 21 nt, Homo sapiens
gaaaaagcaggacugugccuc

SEQ ID NO: 1632493 - RNA, 22 nt, Homo sapiens
gaaaaagcuuaaugauucugau

SEQ ID NO: 1632494 - RNA, 16 nt, Homo sapiens
gaaaaagugcuuauua

SEQ ID NO: 1632495 - RNA, 18 nt, Homo sapiens
gaaaaauauuccaagcuu

SEQ ID NO: 1632496 - RNA, 19 nt, Homo sapiens
gaaaaauugccaauucuuu

SEQ ID NO: 1632497 - RNA, 13 nt, Homo sapiens
gaaaacacuuuca

SEQ ID NO: 1632498 - RNA, 11 nt, Homo sapiens
gaaaacauuuu

SEQ ID NO: 1632499 - RNA, 16 nt, Homo sapiens
gaaaaccuacauauuc

SEQ ID NO: 1632500 - RNA, 20 nt, Homo sapiens
gaaaacucccaauacaaaga

SEQ ID NO: 1632501 - RNA, 21 nt, Homo sapiens
gaaaagaggcccaagugcaaa

SEQ ID NO: 1632502 - RNA, 13 nt, Homo sapiens
gaaaagagggaga

SEQ ID NO: 1632503 - RNA, 15 nt, Homo sapiens
gaaaaugacucuggg

SEQ ID NO: 1632504 - RNA, 14 nt, Homo sapiens
gaaaaugcauugua

SEQ ID NO: 1632505 - RNA, 19 nt, Homo sapiens
gaaaauuauugacagcaau

SEQ ID NO: 1632506 - RNA, 13 nt, Homo sapiens
gaaacaccacuua

SEQ ID NO: 1632507 - RNA, 21 nt, Homo sapiens
gaaacagucccgcgugcaaag

SEQ ID NO: 1632508 - RNA, 17 nt, Homo sapiens
gaaacauuguaaauauu

SEQ ID NO: 1632509 - RNA, 10 nt, Homo sapiens
gaaacauuua

SEQ ID NO: 1632510 - RNA, 16 nt, Homo sapiens
gaaacccugagagucu

SEQ ID NO: 1632511 - RNA, 15 nt, Homo sapiens
gaaaccuacaagauu

SEQ ID NO: 1632512 - RNA, 18 nt, Homo sapiens
gaaaccuacaagauuucc

SEQ ID NO: 1632513 - RNA, 16 nt, Homo sapiens
gaaaccucuacauauu

SEQ ID NO: 1632514 - RNA, 18 nt, Homo sapiens
gaaacgcuagaagccuaa

SEQ ID NO: 1632515 - RNA, 17 nt, Homo sapiens
gaaacuaacacagccau

SEQ ID NO: 1632516 - RNA, 13 nt, Homo sapiens
gaaacuccauuga

SEQ ID NO: 1632517 - RNA, 14 nt, Homo sapiens
gaaagaaagggacc

SEQ ID NO: 1632518 - RNA, 17 nt, Homo sapiens
gaaagagagaagccagc

SEQ ID NO: 1632519 - RNA, 20 nt, Homo sapiens
gaaagauuugaugggccaca

SEQ ID NO: 1632520 - RNA, 15 nt, Homo sapiens
gaaagccaugugcua

SEQ ID NO: 1632521 - RNA, 17 nt, Homo sapiens
gaaagcccugugcucca

SEQ ID NO: 1632522 - RNA, 19 nt, Homo sapiens
gaaaggagccuaggccagg

SEQ ID NO: 1632523 - RNA, 13 nt, Homo sapiens
gaaaggccuucag

SEQ ID NO: 1632524 - RNA, 19 nt, Homo sapiens
gaaagggguuggggugaca

SEQ ID NO: 1632525 - RNA, 22 nt, Homo sapiens
gaaauaaauucugacuuaugaa

SEQ ID NO: 1632526 - RNA, 23 nt, Homo sapiens
gaaauacacagugcugaccagac

SEQ ID NO: 1632527 - RNA, 23 nt, Homo sapiens
gaaauacccauguuacuucucug

SEQ ID NO: 1632528 - RNA, 22 nt, Homo sapiens
gaaauaguuauuuuaauaccuu

SEQ ID NO: 1632529 - RNA, 16 nt, Homo sapiens
gaaaucaacucucuuc

SEQ ID NO: 1632530 - RNA, 16 nt, Homo sapiens
gaaaugaaugguuuca

SEQ ID NO: 1632531 - RNA, 12 nt, Homo sapiens
gaaaugcaaaac

SEQ ID NO: 1632532 - RNA, 12 nt, Homo sapiens
gaaaugcaaaau

SEQ ID NO: 1632533 - RNA, 11 nt, Homo sapiens
gaaauuaacac

SEQ ID NO: 1632534 - RNA, 15 nt, Homo sapiens
gaaauuaagacuuua

SEQ ID NO: 1632535 - RNA, 16 nt, Homo sapiens
gaaauuauuucucuca

SEQ ID NO: 1632536 - RNA, 18 nt, Homo sapiens
gaaauuuuuaaaaauaca

SEQ ID NO: 1632537 - RNA, 18 nt, Homo sapiens
gaacaaagccacugacug

SEQ ID NO: 1632538 - RNA, 14 nt, Homo sapiens
gaacaacuaccuga

SEQ ID NO: 1632539 - RNA, 13 nt, Homo sapiens
gaacagguucuua

SEQ ID NO: 1632540 - RNA, 22 nt, Homo sapiens
gaacaguugcauuuagcuucuu

SEQ ID NO: 1632541 - RNA, 14 nt, Homo sapiens
gaacaucacauucc

SEQ ID NO: 1632542 - RNA, 14 nt, Homo sapiens
gaaccacaaaaagu

SEQ ID NO: 1632543 - RNA, 21 nt, Homo sapiens
gaaccauguggauaacuuuac

SEQ ID NO: 1632544 - RNA, 17 nt, Homo sapiens
gaaccauguguggcaaa

SEQ ID NO: 1632545 - RNA, 18 nt, Homo sapiens
gaacccaguguuuccaca

SEQ ID NO: 1632546 - RNA, 21 nt, Homo sapiens
gaacccccucccugucccagg

SEQ ID NO: 1632547 - RNA, 17 nt, Homo sapiens
gaaccuccucugugaag

SEQ ID NO: 1632548 - RNA, 18 nt, Homo sapiens
gaaccugcccugcuccca

SEQ ID NO: 1632549 - RNA, 23 nt, Homo sapiens
gaacgaguuguuggcugcucccu

SEQ ID NO: 1632550 - RNA, 18 nt, Homo sapiens
gaacuagccaaaccagga

SEQ ID NO: 1632551 - RNA, 15 nt, Homo sapiens
gaacuccagagucag

SEQ ID NO: 1632552 - RNA, 15 nt, Homo sapiens
gaacugaacauucca

SEQ ID NO: 1632553 - RNA, 15 nt, Homo sapiens
gaacugcauugacuu

SEQ ID NO: 1632554 - RNA, 18 nt, Homo sapiens
gaacuguacacagaauug

SEQ ID NO: 1632555 - RNA, 13 nt, Homo sapiens
gaacuguguuuca

SEQ ID NO: 1632556 - RNA, 21 nt, Homo sapiens
gaacuugcuauggaaaggaca

SEQ ID NO: 1632557 - RNA, 21 nt, Homo sapiens
gaacuuuaagaagcaguguuu

SEQ ID NO: 1632558 - RNA, 22 nt, Homo sapiens
gaagaacagauaaucccuguau

SEQ ID NO: 1632559 - RNA, 19 nt, Homo sapiens
gaagaagaucaacgccuca

SEQ ID NO: 1632560 - RNA, 21 nt, Homo sapiens
gaagacaaagcacaccauaug

SEQ ID NO: 1632561 - RNA, 20 nt, Homo sapiens
gaagauggcauccugugaag

SEQ ID NO: 1632562 - RNA, 23 nt, Homo sapiens
gaagauuguuggugaauuuucaa

SEQ ID NO: 1632563 - RNA, 14 nt, Homo sapiens
gaagcacagcuccu

SEQ ID NO: 1632564 - RNA, 16 nt, Homo sapiens
gaagcauaaagcaauu

SEQ ID NO: 1632565 - RNA, 20 nt, Homo sapiens
gaagcaugaauaacauuuaa

SEQ ID NO: 1632566 - RNA, 17 nt, Homo sapiens
gaagccugaugcugaca

SEQ ID NO: 1632567 - RNA, 19 nt, Homo sapiens
gaaggagcagucacuggga

SEQ ID NO: 1632568 - RNA, 12 nt, Homo sapiens
gaaggcuuucag

SEQ ID NO: 1632569 - RNA, 14 nt, Homo sapiens
gaaggggcuaggga

SEQ ID NO: 1632570 - RNA, 14 nt, Homo sapiens
gaagguacacccca

SEQ ID NO: 1632571 - RNA, 17 nt, Homo sapiens
gaaguccuucaccucac

SEQ ID NO: 1632572 - RNA, 15 nt, Homo sapiens
gaagucuaaaugaag

SEQ ID NO: 1632573 - RNA, 16 nt, Homo sapiens
gaagucuaaaugaagu

SEQ ID NO: 1632574 - RNA, 10 nt, Homo sapiens
gaagugcucu

SEQ ID NO: 1632575 - RNA, 23 nt, Homo sapiens
gaagugcuguuuuauuacuguuu

SEQ ID NO: 1632576 - RNA, 17 nt, Homo sapiens
gaagugguugcauucua

SEQ ID NO: 1632577 - RNA, 13 nt, Homo sapiens
gaaguguugcaug

SEQ ID NO: 1632578 - RNA, 22 nt, Homo sapiens
gaaguugcccaccaaaacacag

SEQ ID NO: 1632579 - RNA, 20 nt, Homo sapiens
gaaguuuaacaaguauuuau

SEQ ID NO: 1632580 - RNA, 20 nt, Homo sapiens
gaauaacauuuaaauuccac

SEQ ID NO: 1632581 - RNA, 20 nt, Homo sapiens
gaauaacuguguuuccuacc

SEQ ID NO: 1632582 - RNA, 22 nt, Homo sapiens
gaauaguucaggagacuuuaca

SEQ ID NO: 1632583 - RNA, 14 nt, Homo sapiens
gaauauacauaguc

SEQ ID NO: 1632584 - RNA, 23 nt, Homo sapiens
gaaucaagguaagcucaggauau

SEQ ID NO: 1632585 - RNA, 20 nt, Homo sapiens
gaaucacaaaccaagccaug

SEQ ID NO: 1632586 - RNA, 20 nt, Homo sapiens
gaaucccacccacaugugac

SEQ ID NO: 1632587 - RNA, 16 nt, Homo sapiens
gaauccccaacaugca

SEQ ID NO: 1632588 - RNA, 21 nt, Homo sapiens
cuggaggcagaaucccggcug

SEQ ID NO: 1632589 - RNA, 17 nt, Homo sapiens
cuggaucagcguggccu

SEQ ID NO: 1632590 - RNA, 18 nt, Homo sapiens
cuggauuaggucucuguu

SEQ ID NO: 1632591 - RNA, 16 nt, Homo sapiens
cuggauuauugcuuag

SEQ ID NO: 1632592 - RNA, 14 nt, Homo sapiens
cuggcaacaucuua

SEQ ID NO: 1632593 - RNA, 14 nt, Homo sapiens
cuggcacagaggua

SEQ ID NO: 1632594 - RNA, 21 nt, Homo sapiens
cuggccacaguaauuggucau

SEQ ID NO: 1632595 - RNA, 16 nt, Homo sapiens
cuggccauauuuacua

SEQ ID NO: 1632596 - RNA, 15 nt, Homo sapiens
cuggcccugccguuu

SEQ ID NO: 1632597 - RNA, 16 nt, Homo sapiens
cuggccgcaugaccac

SEQ ID NO: 1632598 - RNA, 18 nt, Homo sapiens
cuggccuauguggucuaa

SEQ ID NO: 1632599 - RNA, 17 nt, Homo sapiens
cuggccugaacugagga

SEQ ID NO: 1632600 - RNA, 14 nt, Homo sapiens
cuggcucagccuca

SEQ ID NO: 1632601 - RNA, 23 nt, Homo sapiens
cuggcugaaccaaagaaacaauu

SEQ ID NO: 1632602 - RNA, 13 nt, Homo sapiens
cuggcugugugac

SEQ ID NO: 1632603 - RNA, 23 nt, Homo sapiens
cugggauuacaggcgugagccac

SEQ ID NO: 1632604 - RNA, 13 nt, Homo sapiens
cugggcauugcuu

SEQ ID NO: 1632605 - RNA, 17 nt, Homo sapiens
cugggcuccuccagggu

SEQ ID NO: 1632606 - RNA, 19 nt, Homo sapiens
cuggggccccuaagcuccu

SEQ ID NO: 1632607 - RNA, 16 nt, Homo sapiens
cuggucagcauguacu

SEQ ID NO: 1632608 - RNA, 18 nt, Homo sapiens
cugguguauguuuaucaa

SEQ ID NO: 1632609 - RNA, 21 nt, Homo sapiens
cugguguuuuacuacacucca

SEQ ID NO: 1632610 - RNA, 13 nt, Homo sapiens
cuguaaauuuggc

SEQ ID NO: 1632611 - RNA, 16 nt, Homo sapiens
cuguaacacacuaaca

SEQ ID NO: 1632612 - RNA, 15 nt, Homo sapiens
cuguaaucaggcaag

SEQ ID NO: 1632613 - RNA, 15 nt, Homo sapiens
cuguaccaugugcua

SEQ ID NO: 1632614 - RNA, 16 nt, Homo sapiens
cuguacuguaauuucu

SEQ ID NO: 1632615 - RNA, 14 nt, Homo sapiens
cuguaggugaaaga

SEQ ID NO: 1632616 - RNA, 15 nt, Homo sapiens
cuguaugcucacaac

SEQ ID NO: 1632617 - RNA, 17 nt, Homo sapiens
cuguauuucaagaccuc

SEQ ID NO: 1632618 - RNA, 14 nt, Homo sapiens
cugucaggugugau

SEQ ID NO: 1632619 - RNA, 14 nt, Homo sapiens
cuguccuucuuaga

SEQ ID NO: 1632620 - RNA, 22 nt, Homo sapiens
cuguccuuucagucugauccau

SEQ ID NO: 1632621 - RNA, 22 nt, Homo sapiens
cugucgcugcuucgugggauac

SEQ ID NO: 1632622 - RNA, 22 nt, Homo sapiens
cugucuagaacuuaaguuugau

SEQ ID NO: 1632623 - RNA, 13 nt, Homo sapiens
cugucucagggug

SEQ ID NO: 1632624 - RNA, 14 nt, Homo sapiens
cugucucaggguga

SEQ ID NO: 1632625 - RNA, 14 nt, Homo sapiens
cugucugggaugua

SEQ ID NO: 1632626 - RNA, 22 nt, Homo sapiens
cugucuguuuuaauuuaaccca

SEQ ID NO: 1632627 - RNA, 22 nt, Homo sapiens
cugucuucaccugauucaacua

SEQ ID NO: 1632628 - RNA, 14 nt, Homo sapiens
cugugaacagcuug

SEQ ID NO: 1632629 - RNA, 15 nt, Homo sapiens
cugugaccugcugag

SEQ ID NO: 1632630 - RNA, 19 nt, Homo sapiens
cugugaccugcugagcucu

SEQ ID NO: 1632631 - RNA, 15 nt, Homo sapiens
cugugacuaccucaa

SEQ ID NO: 1632632 - RNA, 19 nt, Homo sapiens
cugugagacagugggaaau

SEQ ID NO: 1632633 - RNA, 22 nt, Homo sapiens
cugugcaaccucuuggccugau

SEQ ID NO: 1632634 - RNA, 18 nt, Homo sapiens
cugugcacaaaguggcau

SEQ ID NO: 1632635 - RNA, 21 nt, Homo sapiens
cugugcaggcauggucccuua

SEQ ID NO: 1632636 - RNA, 22 nt, Homo sapiens
cugugccaauacagacaaagca

SEQ ID NO: 1632637 - RNA, 19 nt, Homo sapiens
cugugcugggggaaugagc

SEQ ID NO: 1632638 - RNA, 13 nt, Homo sapiens
cuguggaaugagu

SEQ ID NO: 1632639 - RNA, 16 nt, Homo sapiens
cugugggcaagccuaa

SEQ ID NO: 1632640 - RNA, 19 nt, Homo sapiens
cugugggucguagagccuu

SEQ ID NO: 1632641 - RNA, 15 nt, Homo sapiens
cuguguaacuuucuc

SEQ ID NO: 1632642 - RNA, 19 nt, Homo sapiens
cugugucuaggcaggcaag

SEQ ID NO: 1632643 - RNA, 14 nt, Homo sapiens
cuguguugccacag

SEQ ID NO: 1632644 - RNA, 15 nt, Homo sapiens
cuguguuugcugagg

SEQ ID NO: 1632645 - RNA, 15 nt, Homo sapiens
cuguuaauauucuau

SEQ ID NO: 1632646 - RNA, 20 nt, Homo sapiens
cuguuaauguggacuggaac

SEQ ID NO: 1632647 - RNA, 23 nt, Homo sapiens
cuguuacgaugcaauucuagcca

SEQ ID NO: 1632648 - RNA, 19 nt, Homo sapiens
cuguuagggcugaaucuuc

SEQ ID NO: 1632649 - RNA, 15 nt, Homo sapiens
cuguuaguuguccac

SEQ ID NO: 1632650 - RNA, 15 nt, Homo sapiens
cuguucacagcuuuu

SEQ ID NO: 1632651 - RNA, 23 nt, Homo sapiens
cuguucaguguaaauaguuacuc

SEQ ID NO: 1632652 - RNA, 19 nt, Homo sapiens
cuguucauuucacacagug

SEQ ID NO: 1632653 - RNA, 21 nt, Homo sapiens
cuguucauuucacacagugaa

SEQ ID NO: 1632654 - RNA, 19 nt, Homo sapiens
cuguugagacugauucaga

SEQ ID NO: 1632655 - RNA, 22 nt, Homo sapiens
cuguuuacauccagaguucugu

SEQ ID NO: 1632656 - RNA, 17 nt, Homo sapiens
cuguuuaguuuuacacu

SEQ ID NO: 1632657 - RNA, 19 nt, Homo sapiens
cuguuuggccaaugugcau

SEQ ID NO: 1632658 - RNA, 15 nt, Homo sapiens
cuguuuuugcaacua

SEQ ID NO: 1632659 - RNA, 20 nt, Homo sapiens
cuuaaaaaagcccuuugcua

SEQ ID NO: 1632660 - RNA, 23 nt, Homo sapiens
cuuaaaaaagcccuuugcuaaaa

SEQ ID NO: 1632661 - RNA, 18 nt, Homo sapiens
cuuaaaaaauacuugcau

SEQ ID NO: 1632662 - RNA, 19 nt, Homo sapiens
cuuaaaaacggauaaguuu

SEQ ID NO: 1632663 - RNA, 13 nt, Homo sapiens
cuuaaaaugaaag

SEQ ID NO: 1632664 - RNA, 15 nt, Homo sapiens
cuuaaaggacauaaa

SEQ ID NO: 1632665 - RNA, 20 nt, Homo sapiens
cuuaaaggggagaccucaga

SEQ ID NO: 1632666 - RNA, 20 nt, Homo sapiens
cuuaaauauuguaauaugac

SEQ ID NO: 1632667 - RNA, 14 nt, Homo sapiens
cuuaaauccauccu

SEQ ID NO: 1632668 - RNA, 16 nt, Homo sapiens
cuuaacacauucaaua

SEQ ID NO: 1632669 - RNA, 17 nt, Homo sapiens
cuuaacagaugcaaugu

SEQ ID NO: 1632670 - RNA, 13 nt, Homo sapiens
cuuaacauuucau

SEQ ID NO: 1632671 - RNA, 22 nt, Homo sapiens
cuuaagaaguuagaaggcuuaa

SEQ ID NO: 1632672 - RNA, 23 nt, Homo sapiens
cuuaagaauaugcugacuucacu

SEQ ID NO: 1632673 - RNA, 22 nt, Homo sapiens
cuuaagacgugauuuugcugua

SEQ ID NO: 1632674 - RNA, 20 nt, Homo sapiens
cuuaauucuaagacuuuuga

SEQ ID NO: 1632675 - RNA, 21 nt, Homo sapiens
cuuacacauaaagcacuaccu

SEQ ID NO: 1632676 - RNA, 23 nt, Homo sapiens
cuuacauguuuguuucuguagaa

SEQ ID NO: 1632677 - RNA, 17 nt, Homo sapiens
cuuaccgugggcacuga

SEQ ID NO: 1632678 - RNA, 14 nt, Homo sapiens
cuuacuacuuuaaa

SEQ ID NO: 1632679 - RNA, 14 nt, Homo sapiens
cuuacuauuacaua

SEQ ID NO: 1632680 - RNA, 13 nt, Homo sapiens
cuuacuuccagca

SEQ ID NO: 1632681 - RNA, 13 nt, Homo sapiens
cuuagaaagggaa

SEQ ID NO: 1632682 - RNA, 18 nt, Homo sapiens
cuuagaccugccagccac

SEQ ID NO: 1632683 - RNA, 15 nt, Homo sapiens
cuuagagacuaucaa

SEQ ID NO: 1632684 - RNA, 17 nt, Homo sapiens
cuuagaguguagcugua

SEQ ID NO: 1632685 - RNA, 19 nt, Homo sapiens
cuuagguaagacauauaac

SEQ ID NO: 1632686 - RNA, 13 nt, Homo sapiens
cuuaggucuuccu

SEQ ID NO: 1632687 - RNA, 16 nt, Homo sapiens
cuuagguuuugcuugg

SEQ ID NO: 1632688 - RNA, 13 nt, Homo sapiens
cuuaguugcugua

SEQ ID NO: 1632689 - RNA, 14 nt, Homo sapiens
cuuauacccaugaa

SEQ ID NO: 1632690 - RNA, 22 nt, Homo sapiens
cuuaucauuagaaucuuaccuu

SEQ ID NO: 1632691 - RNA, 15 nt, Homo sapiens
cuuaucccucuccau

SEQ ID NO: 1632692 - RNA, 16 nt, Homo sapiens
cuuauccuagccuuug

SEQ ID NO: 1632693 - RNA, 19 nt, Homo sapiens
cuuauggggguguuucuau

SEQ ID NO: 1632694 - RNA, 12 nt, Homo sapiens
cuuaugugacau

SEQ ID NO: 1632695 - RNA, 21 nt, Homo sapiens
ccccuccuuggcuuuaugcaa

SEQ ID NO: 1632696 - RNA, 22 nt, Homo sapiens
ccccuccuuggcuuuaugcaaa

SEQ ID NO: 1632697 - RNA, 15 nt, Homo sapiens
ccccuggccacagcc

SEQ ID NO: 1632698 - RNA, 14 nt, Homo sapiens
ccccuugggugacc

SEQ ID NO: 1632699 - RNA, 16 nt, Homo sapiens
cccgacagugccaucc

SEQ ID NO: 1632700 - RNA, 14 nt, Homo sapiens
cccgacuuccugac

SEQ ID NO: 1632701 - RNA, 17 nt, Homo sapiens
cccgugccaaguccagg

SEQ ID NO: 1632702 - RNA, 17 nt, Homo sapiens
cccuaagucacauauca

SEQ ID NO: 1632703 - RNA, 14 nt, Homo sapiens
cccuaccugucaac

SEQ ID NO: 1632704 - RNA, 23 nt, Homo sapiens
cccuaucauuauuucaccaagcc

SEQ ID NO: 1632705 - RNA, 15 nt, Homo sapiens
cccuccagccagaga

SEQ ID NO: 1632706 - RNA, 21 nt, Homo sapiens
cccucgucaucaggugcauag

SEQ ID NO: 1632707 - RNA, 18 nt, Homo sapiens
cagacucccaccccaggg

SEQ ID NO: 1632708 - RNA, 19 nt, Homo sapiens
cagacuuuggaaaaugcau

SEQ ID NO: 1632709 - RNA, 20 nt, Homo sapiens
cagacuuuggaaaaugcauu

SEQ ID NO: 1632710 - RNA, 19 nt, Homo sapiens
cagacuuuguguucauuuc

SEQ ID NO: 1632711 - RNA, 21 nt, Homo sapiens
cagagccaccugacucuugca

SEQ ID NO: 1632712 - RNA, 17 nt, Homo sapiens
cagagcccugugucugu

SEQ ID NO: 1632713 - RNA, 15 nt, Homo sapiens
cagagcgugcuuuca

SEQ ID NO: 1632714 - RNA, 20 nt, Homo sapiens
cagagcugggggcugaggga

SEQ ID NO: 1632715 - RNA, 20 nt, Homo sapiens
cagaggaauuuauaccucaa

SEQ ID NO: 1632716 - RNA, 22 nt, Homo sapiens
cagaggaugcaacaaauguggc

SEQ ID NO: 1632717 - RNA, 23 nt, Homo sapiens
cagaggaugcaacaaauguggcc

SEQ ID NO: 1632718 - RNA, 14 nt, Homo sapiens
cagaggcauuugag

SEQ ID NO: 1632719 - RNA, 19 nt, Homo sapiens
cagaggcauuugagcagcu

SEQ ID NO: 1632720 - RNA, 23 nt, Homo sapiens
cagaggcccuggaggucuccagg

SEQ ID NO: 1632721 - RNA, 21 nt, Homo sapiens
cagaguucuauaauguaaaca

SEQ ID NO: 1632722 - RNA, 15 nt, Homo sapiens
cagaguucugugaca

SEQ ID NO: 1632723 - RNA, 21 nt, Homo sapiens
cagauaaaauguucagugcaa

SEQ ID NO: 1632724 - RNA, 23 nt, Homo sapiens
cagauaaugcuuuuacuaagcac

SEQ ID NO: 1632725 - RNA, 19 nt, Homo sapiens
cagaucaacagcaaccucu

SEQ ID NO: 1632726 - RNA, 18 nt, Homo sapiens
cagaucaagcugugagac

SEQ ID NO: 1632727 - RNA, 19 nt, Homo sapiens
cagaugggcauauguguca

SEQ ID NO: 1632728 - RNA, 22 nt, Homo sapiens
cagaugggcauaugugucagug

SEQ ID NO: 1632729 - RNA, 19 nt, Homo sapiens
cagaugugugcaauguggc

SEQ ID NO: 1632730 - RNA, 17 nt, Homo sapiens
cagauguuuguuuucaa

SEQ ID NO: 1632731 - RNA, 13 nt, Homo sapiens
cagauuaucacau

SEQ ID NO: 1632732 - RNA, 17 nt, Homo sapiens
cagauuguuaucuauca

SEQ ID NO: 1632733 - RNA, 19 nt, Homo sapiens
cagauuuuuuccucugcau

SEQ ID NO: 1632734 - RNA, 18 nt, Homo sapiens
cagcaaccucuucaugag

SEQ ID NO: 1632735 - RNA, 23 nt, Homo sapiens
cagcaaggccagaugcacauccc

SEQ ID NO: 1632736 - RNA, 14 nt, Homo sapiens
cagcacaaggccau

SEQ ID NO: 1632737 - RNA, 20 nt, Homo sapiens
cagcaccugcgggagcugca

SEQ ID NO: 1632738 - RNA, 20 nt, Homo sapiens
cagcacgaguggccaguuca

SEQ ID NO: 1632739 - RNA, 14 nt, Homo sapiens
cagcagacauccac

SEQ ID NO: 1632740 - RNA, 21 nt, Homo sapiens
cagcagagccuggaagacacc

SEQ ID NO: 1632741 - RNA, 23 nt, Homo sapiens
cagcaggcauaaggcaccaguua

SEQ ID NO: 1632742 - RNA, 18 nt, Homo sapiens
cagcauccucaguuccug

SEQ ID NO: 1632743 - RNA, 20 nt, Homo sapiens
cagcauugccauaccauucc

SEQ ID NO: 1632744 - RNA, 16 nt, Homo sapiens
cagccacgaggugcaa

SEQ ID NO: 1632745 - RNA, 13 nt, Homo sapiens
cagccacuucugc

SEQ ID NO: 1632746 - RNA, 18 nt, Homo sapiens
cagccagagacagaggau

SEQ ID NO: 1632747 - RNA, 12 nt, Homo sapiens
cagccagcacuu

SEQ ID NO: 1632748 - RNA, 12 nt, Homo sapiens
cagccagggccu

SEQ ID NO: 1632749 - RNA, 19 nt, Homo sapiens
cagccagggccugcgaggg

SEQ ID NO: 1632750 - RNA, 19 nt, Homo sapiens
cagcccagacccaguggac

SEQ ID NO: 1632751 - RNA, 13 nt, Homo sapiens
cagccccacccuu

SEQ ID NO: 1632752 - RNA, 20 nt, Homo sapiens
cagcccugaccccaguguac

SEQ ID NO: 1632753 - RNA, 20 nt, Homo sapiens
cagccuacuuucacacuaag

SEQ ID NO: 1632754 - RNA, 18 nt, Homo sapiens
cagccucccaaaguucug

SEQ ID NO: 1632755 - RNA, 19 nt, Homo sapiens
cagccucgcgggugucaca

SEQ ID NO: 1632756 - RNA, 20 nt, Homo sapiens
cagccugcucuagugggaca

SEQ ID NO: 1632757 - RNA, 15 nt, Homo sapiens
cagccuggacauaga

SEQ ID NO: 1632758 - RNA, 19 nt, Homo sapiens
cagccugggggacagagca

SEQ ID NO: 1632759 - RNA, 17 nt, Homo sapiens
cagcgauguaugcagcu

SEQ ID NO: 1632760 - RNA, 21 nt, Homo sapiens
cagcgccaggcugaccacagc

SEQ ID NO: 1632761 - RNA, 15 nt, Homo sapiens
cagcgccauccugag

SEQ ID NO: 1632762 - RNA, 23 nt, Homo sapiens
cagcggaaagcccugugcuccau

SEQ ID NO: 1632763 - RNA, 15 nt, Homo sapiens
cagcggacaguggca

SEQ ID NO: 1632764 - RNA, 15 nt, Homo sapiens
cagcgggagcacugc

SEQ ID NO: 1632765 - RNA, 13 nt, Homo sapiens
cagcuaaauguga

SEQ ID NO: 1632766 - RNA, 13 nt, Homo sapiens
cagcuaaccacuu

SEQ ID NO: 1632767 - RNA, 16 nt, Homo sapiens
cagcuaaccacuucgc

SEQ ID NO: 1632768 - RNA, 21 nt, Homo sapiens
cagcuagugacccacaugcca

SEQ ID NO: 1632769 - RNA, 16 nt, Homo sapiens
cagcuguccugcagca

SEQ ID NO: 1632770 - RNA, 16 nt, Homo sapiens
caggaaauacuuugua

SEQ ID NO: 1632771 - RNA, 14 nt, Homo sapiens
caggacacaggccu

SEQ ID NO: 1632772 - RNA, 19 nt, Homo sapiens
caggacugugccuccauaa

SEQ ID NO: 1632773 - RNA, 16 nt, Homo sapiens
caggagaagaacaaga

SEQ ID NO: 1632774 - RNA, 15 nt, Homo sapiens
caggagccaccagca

SEQ ID NO: 1632775 - RNA, 19 nt, Homo sapiens
caggaguucaauaaauguc

SEQ ID NO: 1632776 - RNA, 23 nt, Homo sapiens
caggauauggcuuaggaaugacu

SEQ ID NO: 1632777 - RNA, 13 nt, Homo sapiens
caggaucaccucc

SEQ ID NO: 1632778 - RNA, 18 nt, Homo sapiens
caggaucccuacugccaa

SEQ ID NO: 1632779 - RNA, 17 nt, Homo sapiens
caggcaaacguccacaa

SEQ ID NO: 1632780 - RNA, 17 nt, Homo sapiens
caggcaagagaauugaa

SEQ ID NO: 1632781 - RNA, 14 nt, Homo sapiens
caggcaaugcugua

SEQ ID NO: 1632782 - RNA, 14 nt, Homo sapiens
caggcauugaggaa

SEQ ID NO: 1632783 - RNA, 23 nt, Homo sapiens
caggcugagaacucguucaccuc

SEQ ID NO: 1632784 - RNA, 18 nt, Homo sapiens
caggcuggucuugaacuc

SEQ ID NO: 1632785 - RNA, 13 nt, Homo sapiens
caggcuucaucaa

SEQ ID NO: 1632786 - RNA, 12 nt, Homo sapiens
cagggagcaccu

SEQ ID NO: 1632787 - RNA, 13 nt, Homo sapiens
cagggaucuugca

SEQ ID NO: 1632788 - RNA, 22 nt, Homo sapiens
cagggauuuagacuuacuauua

SEQ ID NO: 1632789 - RNA, 16 nt, Homo sapiens
cagggcagacugcaga

SEQ ID NO: 1632790 - RNA, 18 nt, Homo sapiens
cagggcagcgccaggcug

SEQ ID NO: 1632791 - RNA, 22 nt, Homo sapiens
cagggcagucauuggcugucuc

SEQ ID NO: 1632792 - RNA, 21 nt, Homo sapiens
cagggcccucccagcccauug

SEQ ID NO: 1632793 - RNA, 15 nt, Homo sapiens
cagggccuccagccc

SEQ ID NO: 1632794 - RNA, 17 nt, Homo sapiens
cagggcuggucaccucc

SEQ ID NO: 1632795 - RNA, 15 nt, Homo sapiens
caggggcaugggaag

SEQ ID NO: 1632796 - RNA, 16 nt, Homo sapiens
caggggccugcagaag

SEQ ID NO: 1632797 - RNA, 21 nt, Homo sapiens
caggggcugacucuccaggga

SEQ ID NO: 1632798 - RNA, 16 nt, Homo sapiens
cagggguacauucuag

SEQ ID NO: 1632799 - RNA, 16 nt, Homo sapiens
cagggucugugugaau

SEQ ID NO: 1632800 - RNA, 17 nt, Homo sapiens
caggguggagugcagug

SEQ ID NO: 1632801 - RNA, 15 nt, Homo sapiens
cagguaaaacagggc

SEQ ID NO: 1632802 - RNA, 16 nt, Homo sapiens
cagguccaauuuguaa

SEQ ID NO: 1632803 - RNA, 20 nt, Homo sapiens
caggugcuguuuuuguucua

SEQ ID NO: 1632804 - RNA, 22 nt, Homo sapiens
caggugugauaaaauguugaac

SEQ ID NO: 1632805 - RNA, 21 nt, Homo sapiens
caggugugugggccaccgugc

SEQ ID NO: 1632806 - RNA, 22 nt, Homo sapiens
caggugugugggccaccgugcc

SEQ ID NO: 1632807 - RNA, 18 nt, Homo sapiens
cagguuaagacaaagggu

SEQ ID NO: 1632808 - RNA, 17 nt, Homo sapiens
caguaaauagugucaua

SEQ ID NO: 1632809 - RNA, 16 nt, Homo sapiens
caguaccuagcuggcu

SEQ ID NO: 1632810 - RNA, 16 nt, Homo sapiens
caguaccucaguauuc

SEQ ID NO: 1632811 - RNA, 15 nt, Homo sapiens
caguacuauggagug

SEQ ID NO: 1632812 - RNA, 19 nt, Homo sapiens
caguagagcaaaucuauga

SEQ ID NO: 1632813 - RNA, 19 nt, Homo sapiens
caguaguuauaaaguccuu

SEQ ID NO: 1632814 - RNA, 20 nt, Homo sapiens
caguauaccuaucugcugca

SEQ ID NO: 1632815 - RNA, 13 nt, Homo sapiens
cagucaagcuccu

SEQ ID NO: 1632816 - RNA, 20 nt, Homo sapiens
uuugaagaccccacugccac

SEQ ID NO: 1632817 - RNA, 22 nt, Homo sapiens
uuugaauagccuguuccuuuaa

SEQ ID NO: 1632818 - RNA, 15 nt, Homo sapiens
uuugagcgcgcugag

SEQ ID NO: 1632819 - RNA, 19 nt, Homo sapiens
uuugaggccuuuuuugcca

SEQ ID NO: 1632820 - RNA, 20 nt, Homo sapiens
uuugaggccuuuuuugccag

SEQ ID NO: 1632821 - RNA, 14 nt, Homo sapiens
uuugauuauaguau

SEQ ID NO: 1632822 - RNA, 14 nt, Homo sapiens
uuugauuuacauau

SEQ ID NO: 1632823 - RNA, 13 nt, Homo sapiens
uuugcaaacguuc

SEQ ID NO: 1632824 - RNA, 19 nt, Homo sapiens
uuugcaacucccuggguaa

SEQ ID NO: 1632825 - RNA, 15 nt, Homo sapiens
uuugcacuuggcaaa

SEQ ID NO: 1632826 - RNA, 23 nt, Homo sapiens
uuugcauuugcucuuucaucucu

SEQ ID NO: 1632827 - RNA, 21 nt, Homo sapiens
uuugccagagcgugcuuucaa

SEQ ID NO: 1632828 - RNA, 16 nt, Homo sapiens
uuugcccaccagauca

SEQ ID NO: 1632829 - RNA, 18 nt, Homo sapiens
uuugccuuuguaccauau

SEQ ID NO: 1632830 - RNA, 14 nt, Homo sapiens
uuugcugccaaaca

SEQ ID NO: 1632831 - RNA, 12 nt, Homo sapiens
uuugcuguagaa

SEQ ID NO: 1632832 - RNA, 15 nt, Homo sapiens
uuuggauaaacaaca

SEQ ID NO: 1632833 - RNA, 16 nt, Homo sapiens
uuuggaugauugucau

SEQ ID NO: 1632834 - RNA, 19 nt, Homo sapiens
uuuggcaaaacucaggcag

SEQ ID NO: 1632835 - RNA, 19 nt, Homo sapiens
uuuggcuuaaaccagaacc

SEQ ID NO: 1632836 - RNA, 18 nt, Homo sapiens
uuuggcuuuaugugcaaa

SEQ ID NO: 1632837 - RNA, 23 nt, Homo sapiens
uuuggggaagugaggaagccagg

SEQ ID NO: 1632838 - RNA, 18 nt, Homo sapiens
uuuggggcaggaaauacu

SEQ ID NO: 1632839 - RNA, 23 nt, Homo sapiens
uuuguaaacuucugaagacugag

SEQ ID NO: 1632840 - RNA, 21 nt, Homo sapiens
uuuguaucuuaaaucugugaa

SEQ ID NO: 1632841 - RNA, 17 nt, Homo sapiens
uuuguuaugacagugaa

SEQ ID NO: 1632842 - RNA, 18 nt, Homo sapiens
uuuguuaugacagugaau

SEQ ID NO: 1632843 - RNA, 17 nt, Homo sapiens
uuuuaaacaaaugugau

SEQ ID NO: 1632844 - RNA, 13 nt, Homo sapiens
uuuuaaacauaag

SEQ ID NO: 1632845 - RNA, 23 nt, Homo sapiens
uuuuaaauaggguuguacuaugc

SEQ ID NO: 1632846 - RNA, 17 nt, Homo sapiens
uuuuaaaucaaguauuu

SEQ ID NO: 1632847 - RNA, 22 nt, Homo sapiens
uuuuaacuucuugucuauaguu

SEQ ID NO: 1632848 - RNA, 12 nt, Homo sapiens
uuuuacacugau

SEQ ID NO: 1632849 - RNA, 17 nt, Homo sapiens
uuuuacauaguugagau

SEQ ID NO: 1632850 - RNA, 16 nt, Homo sapiens
uuuuacuaagcacugu

SEQ ID NO: 1632851 - RNA, 12 nt, Homo sapiens
uuuuagcccagu

SEQ ID NO: 1632852 - RNA, 22 nt, Homo sapiens
uuuuaucacuucauucacauuc

SEQ ID NO: 1632853 - RNA, 13 nt, Homo sapiens
uuuuaugucuuaa

SEQ ID NO: 1632854 - RNA, 15 nt, Homo sapiens
uuuuauuaugcauua

SEQ ID NO: 1632855 - RNA, 12 nt, Homo sapiens
uuuuauucacau

SEQ ID NO: 1632856 - RNA, 23 nt, Homo sapiens
uuuuauuguuguuguuugauccc

SEQ ID NO: 1632857 - RNA, 14 nt, Homo sapiens
uuuucaguaggcuu

SEQ ID NO: 1632858 - RNA, 13 nt, Homo sapiens
uuuucaugcaaaa

SEQ ID NO: 1632859 - RNA, 16 nt, Homo sapiens
uuuucauuuuccaaua

SEQ ID NO: 1632860 - RNA, 15 nt, Homo sapiens
uuuuccuguucuuaa

SEQ ID NO: 1632861 - RNA, 16 nt, Homo sapiens
uuuucuauuauggaaa

SEQ ID NO: 1632862 - RNA, 11 nt, Homo sapiens
uuuucugcuaa

SEQ ID NO: 1632863 - RNA, 22 nt, Homo sapiens
uuuugacagcaugaaauguccu

SEQ ID NO: 1632864 - RNA, 21 nt, Homo sapiens
uuuugaggccuuuuuugccag

SEQ ID NO: 1632865 - RNA, 16 nt, Homo sapiens
uuuugcaacuagguau

SEQ ID NO: 1632866 - RNA, 13 nt, Homo sapiens
uuuugcuguagaa

SEQ ID NO: 1632867 - RNA, 21 nt, Homo sapiens
uuuuggggaguaccuguccaa

SEQ ID NO: 1632868 - RNA, 15 nt, Homo sapiens
uuuugguaauauuca

SEQ ID NO: 1632869 - RNA, 19 nt, Homo sapiens
uuuuguauaggagccccag

SEQ ID NO: 1632870 - RNA, 19 nt, Homo sapiens
uuuugugucuaugauguug

SEQ ID NO: 1632871 - RNA, 16 nt, Homo sapiens
uuuuuaacauugcuga

SEQ ID NO: 1632872 - RNA, 22 nt, Homo sapiens
uuuuuacuaaacucagaggcag

SEQ ID NO: 1632873 - RNA, 18 nt, Homo sapiens
uuuuuauuaugcauuaua

SEQ ID NO: 1632874 - RNA, 17 nt, Homo sapiens
uuuuucugggaaguccu

SEQ ID NO: 1632875 - RNA, 15 nt, Homo sapiens
uuuuugccagacucu

SEQ ID NO: 1632876 - RNA, 14 nt, Homo sapiens
uuuuuguaacugga

SEQ ID NO: 1632877 - RNA, 20 nt, Homo sapiens
uuuuuuauaaucaagccuaa

SEQ ID NO: 1632878 - RNA, 13 nt, Homo sapiens
uuuuuuuguccau

SEQ ID NO: 1632879 - RNA, 22 nt, Homo sapiens
uugcccaggugagggaaggaga

SEQ ID NO: 1632880 - RNA, 20 nt, Homo sapiens
uugccugggggcuuuugcca

SEQ ID NO: 1632881 - RNA, 21 nt, Homo sapiens
uugccugggggcuuuugccac

SEQ ID NO: 1632882 - RNA, 20 nt, Homo sapiens
uugccugucaaguuguacau

SEQ ID NO: 1632883 - RNA, 15 nt, Homo sapiens
uugccuucuuucaua

SEQ ID NO: 1632884 - RNA, 16 nt, Homo sapiens
uugccuuugcucuuau

SEQ ID NO: 1632885 - RNA, 19 nt, Homo sapiens
uugcgacaccucaaggugu

SEQ ID NO: 1632886 - RNA, 21 nt, Homo sapiens
uugcggaagcuguuggaugau

SEQ ID NO: 1632887 - RNA, 17 nt, Homo sapiens
uugcguggacucugcac

SEQ ID NO: 1632888 - RNA, 21 nt, Homo sapiens
uugcuauggaaaggacagugu

SEQ ID NO: 1632889 - RNA, 14 nt, Homo sapiens
uugcuccuauccca

SEQ ID NO: 1632890 - RNA, 14 nt, Homo sapiens
uugcucucugucag

SEQ ID NO: 1632891 - RNA, 11 nt, Homo sapiens
uugcugugaaa

SEQ ID NO: 1632892 - RNA, 13 nt, Homo sapiens
uugcugugaaauu

SEQ ID NO: 1632893 - RNA, 17 nt, Homo sapiens
uugcuuaaaagaaaguu

SEQ ID NO: 1632894 - RNA, 14 nt, Homo sapiens
uugcuucucuagcu

SEQ ID NO: 1632895 - RNA, 21 nt, Homo sapiens
uugcuucuuauccuuacacuc

SEQ ID NO: 1632896 - RNA, 17 nt, Homo sapiens
uuggaaaacacuuucau

SEQ ID NO: 1632897 - RNA, 15 nt, Homo sapiens
uuggaaucaaaagag

SEQ ID NO: 1632898 - RNA, 20 nt, Homo sapiens
uuggacagaaaaugcaauga

SEQ ID NO: 1632899 - RNA, 19 nt, Homo sapiens
uuggacuagccagaauucu

SEQ ID NO: 1632900 - RNA, 14 nt, Homo sapiens
uuggagcaaaccau

SEQ ID NO: 1632901 - RNA, 16 nt, Homo sapiens
uuggaucuggcauuga

SEQ ID NO: 1632902 - RNA, 12 nt, Homo sapiens
uuggaucuugaa

SEQ ID NO: 1632903 - RNA, 15 nt, Homo sapiens
uuggcaguucugaua

SEQ ID NO: 1632904 - RNA, 17 nt, Homo sapiens
uuggcuuaaaccagaac

SEQ ID NO: 1632905 - RNA, 21 nt, Homo sapiens
uuggcuuuaugcaaauacaau

SEQ ID NO: 1632906 - RNA, 16 nt, Homo sapiens
uuggcuuucauguuau

SEQ ID NO: 1632907 - RNA, 16 nt, Homo sapiens
uugggauauucugaaa

SEQ ID NO: 1632908 - RNA, 21 nt, Homo sapiens
uugggauauucugaaacuuga

SEQ ID NO: 1632909 - RNA, 21 nt, Homo sapiens
uuggggaggggccucccugug

SEQ ID NO: 1632910 - RNA, 13 nt, Homo sapiens
uugggggggcucc

SEQ ID NO: 1632911 - RNA, 16 nt, Homo sapiens
uuggucccacaggcca

SEQ ID NO: 1632912 - RNA, 23 nt, Homo sapiens
uuggugaaucgguuguucuuucc

SEQ ID NO: 1632913 - RNA, 17 nt, Homo sapiens
uugguggccuaauuuac

SEQ ID NO: 1632914 - RNA, 13 nt, Homo sapiens
uugguguacugug

SEQ ID NO: 1632915 - RNA, 12 nt, Homo sapiens
uugguucacuuu

SEQ ID NO: 1632916 - RNA, 18 nt, Homo sapiens
uugguuuccaaaggcauu

SEQ ID NO: 1632917 - RNA, 12 nt, Homo sapiens
uugguuuuggac

SEQ ID NO: 1632918 - RNA, 14 nt, Homo sapiens
uuguacaaguauua

SEQ ID NO: 1632919 - RNA, 23 nt, Homo sapiens
uuguagaaaaaucccuccaccuu

SEQ ID NO: 1632920 - RNA, 17 nt, Homo sapiens
uuguagaguuuuuggaa

SEQ ID NO: 1632921 - RNA, 23 nt, Homo sapiens
uuguaucuuaaaucugugaagua

SEQ ID NO: 1632922 - RNA, 13 nt, Homo sapiens
uugucaaagaagg

SEQ ID NO: 1632923 - RNA, 20 nt, Homo sapiens
uugucagacauaaagccaug

SEQ ID NO: 1632924 - RNA, 18 nt, Homo sapiens
uugucagggucuccuucc

SEQ ID NO: 1632925 - RNA, 15 nt, Homo sapiens
uugugaaauacagua

SEQ ID NO: 1632926 - RNA, 15 nt, Homo sapiens
uugugaccacaggcu

SEQ ID NO: 1632927 - RNA, 13 nt, Homo sapiens
uugugacugucac

SEQ ID NO: 1632928 - RNA, 22 nt, Homo sapiens
uuguguugacacauaugaacac

SEQ ID NO: 1632929 - RNA, 23 nt, Homo sapiens
uuguucaacucccuucucggggu

SEQ ID NO: 1632930 - RNA, 16 nt, Homo sapiens
uuguugacacggccau

SEQ ID NO: 1632931 - RNA, 14 nt, Homo sapiens
uuguuguugccaaa

SEQ ID NO: 1632932 - RNA, 17 nt, Homo sapiens
uuuaaaaauaauuuugu

SEQ ID NO: 1632933 - RNA, 23 nt, Homo sapiens
uuuaaaccagggaugucuguuga

SEQ ID NO: 1632934 - RNA, 21 nt, Homo sapiens
uuuaaacuacugauugaaugu

SEQ ID NO: 1632935 - RNA, 16 nt, Homo sapiens
uuuaaauuccacagau

SEQ ID NO: 1632936 - RNA, 19 nt, Homo sapiens
uuuaaauuccacagauuau

SEQ ID NO: 1632937 - RNA, 21 nt, Homo sapiens
uuuaacauugcugauguagua

SEQ ID NO: 1632938 - RNA, 16 nt, Homo sapiens
uuuaacuagacacaga

SEQ ID NO: 1632939 - RNA, 18 nt, Homo sapiens
uuuaacuauucauaagau

SEQ ID NO: 1632940 - RNA, 19 nt, Homo sapiens
uuuaagaaggcauuggcau

SEQ ID NO: 1632941 - RNA, 21 nt, Homo sapiens
uuuaagccaaagaaacaagcu

SEQ ID NO: 1632942 - RNA, 21 nt, Homo sapiens
uuuaagcuaucuauaccuuac

SEQ ID NO: 1632943 - RNA, 21 nt, Homo sapiens
uuuaauaccuuuaaauaucau

SEQ ID NO: 1632944 - RNA, 17 nt, Homo sapiens
uuuaaucaguucugugu

SEQ ID NO: 1632945 - RNA, 12 nt, Homo sapiens
uuuaauuccuua

SEQ ID NO: 1632946 - RNA, 13 nt, Homo sapiens
uuuaauucugucu

SEQ ID NO: 1632947 - RNA, 14 nt, Homo sapiens
uuuaauuuauacug

SEQ ID NO: 1632948 - RNA, 23 nt, Homo sapiens
uuuacuaagcacuguguuuauau

SEQ ID NO: 1632949 - RNA, 13 nt, Homo sapiens
uuuacuaccuuau

SEQ ID NO: 1632950 - RNA, 20 nt, Homo sapiens
uuuacuugaggaucauauga

SEQ ID NO: 1632951 - RNA, 18 nt, Homo sapiens
uuuagccauuuucuuuaa

SEQ ID NO: 1632952 - RNA, 16 nt, Homo sapiens
uuuaggcacuguucaa

SEQ ID NO: 1632953 - RNA, 19 nt, Homo sapiens
uuuaguuuuacacuaggaa

SEQ ID NO: 1632954 - RNA, 16 nt, Homo sapiens
uuuauaaaugauauca

SEQ ID NO: 1632955 - RNA, 21 nt, Homo sapiens
uuuauagcuauagucuaugca

SEQ ID NO: 1632956 - RNA, 19 nt, Homo sapiens
uuuaugugcaaaaucuguu

SEQ ID NO: 1632957 - RNA, 23 nt, Homo sapiens
uuuauguguuugacgggaaacaa

SEQ ID NO: 1632958 - RNA, 15 nt, Homo sapiens
uuuauucuuccucaa

SEQ ID NO: 1632959 - RNA, 14 nt, Homo sapiens
uuuauugcuuguug

SEQ ID NO: 1632960 - RNA, 17 nt, Homo sapiens
uuuauuuguaaaccauu

SEQ ID NO: 1632961 - RNA, 13 nt, Homo sapiens
uuucaaagcuaaa

SEQ ID NO: 1632962 - RNA, 17 nt, Homo sapiens
uuucaagaagacuggca

SEQ ID NO: 1632963 - RNA, 15 nt, Homo sapiens
uuucacacagugaaa

SEQ ID NO: 1632964 - RNA, 17 nt, Homo sapiens
uuucagcgauguaugca

SEQ ID NO: 1632965 - RNA, 13 nt, Homo sapiens
uuucaguaccaaa

SEQ ID NO: 1632966 - RNA, 14 nt, Homo sapiens
uuucauacauuuga

SEQ ID NO: 1632967 - RNA, 11 nt, Homo sapiens
uuucauaccaa

SEQ ID NO: 1632968 - RNA, 13 nt, Homo sapiens
uuucaucaucccc

SEQ ID NO: 1632969 - RNA, 13 nt, Homo sapiens
uuucauguaaucc

SEQ ID NO: 1632970 - RNA, 18 nt, Homo sapiens
uuucauugaugagcaaga

SEQ ID NO: 1632971 - RNA, 23 nt, Homo sapiens
uuuccaaugccacagacaacuca

SEQ ID NO: 1632972 - RNA, 20 nt, Homo sapiens
uuuccacuauuuucaaagaa

SEQ ID NO: 1632973 - RNA, 16 nt, Homo sapiens
uuucccacccaggaaa

SEQ ID NO: 1632974 - RNA, 13 nt, Homo sapiens
uuucccauugcca

SEQ ID NO: 1632975 - RNA, 22 nt, Homo sapiens
uuuccucagugcauuugugcua

SEQ ID NO: 1632976 - RNA, 21 nt, Homo sapiens
uuuccuguguacacgugacag

SEQ ID NO: 1632977 - RNA, 20 nt, Homo sapiens
uuucguaacggccuugaucc

SEQ ID NO: 1632978 - RNA, 20 nt, Homo sapiens
uuucuaaaaacacacacaaa

SEQ ID NO: 1632979 - RNA, 21 nt, Homo sapiens
uuucuauuauggaaaacugug

SEQ ID NO: 1632980 - RNA, 23 nt, Homo sapiens
uuucucuuuacuugaaauuuggc

SEQ ID NO: 1632981 - RNA, 17 nt, Homo sapiens
uuucugagaugcucacu

SEQ ID NO: 1632982 - RNA, 19 nt, Homo sapiens
uuucuugcuuggaagccag

SEQ ID NO: 1632983 - RNA, 16 nt, Homo sapiens
uuucuuguagcuaaaa

SEQ ID NO: 1632984 - RNA, 18 nt, Homo sapiens
uuugaaaaaaguacauau

SEQ ID NO: 1632985 - RNA, 20 nt, Homo sapiens
uuugaaauaaauuuuaauuc

SEQ ID NO: 1632986 - RNA, 21 nt, Homo sapiens
uuugaaauaaauuuuaauucg

SEQ ID NO: 1632987 - RNA, 23 nt, Homo sapiens
uuugaaccauccacuuacauaua

SEQ ID NO: 1632988 - RNA, 18 nt, Homo sapiens
ugaccuuuaaaugcaaca

SEQ ID NO: 1632989 - RNA, 17 nt, Homo sapiens
ugacgaacuuccauggc

SEQ ID NO: 1632990 - RNA, 15 nt, Homo sapiens
ugacggcuggcaugg

SEQ ID NO: 1632991 - RNA, 22 nt, Homo sapiens
ugacguuggccuaacacugggc

SEQ ID NO: 1632992 - RNA, 16 nt, Homo sapiens
ugacuaguagauuucu

SEQ ID NO: 1632993 - RNA, 19 nt, Homo sapiens
ugacucacucauaaagguu

SEQ ID NO: 1632994 - RNA, 19 nt, Homo sapiens
ugacugaagugaacuauga

SEQ ID NO: 1632995 - RNA, 22 nt, Homo sapiens
ugacuggccuauuuaucugauc

SEQ ID NO: 1632996 - RNA, 22 nt, Homo sapiens
ugacugucacuugcugcuuuuu

SEQ ID NO: 1632997 - RNA, 20 nt, Homo sapiens
ugacuuucuaacugugcaga

SEQ ID NO: 1632998 - RNA, 13 nt, Homo sapiens
ugagaaacagcuc

SEQ ID NO: 1632999 - RNA, 15 nt, Homo sapiens
ugagaaauggccaaa

SEQ ID NO: 1633000 - RNA, 16 nt, Homo sapiens
ugagaaauuccuuagu

SEQ ID NO: 1633001 - RNA, 13 nt, Homo sapiens
ugagaccuggcag

SEQ ID NO: 1633002 - RNA, 14 nt, Homo sapiens
ugagagucugagaa

SEQ ID NO: 1633003 - RNA, 12 nt, Homo sapiens
ugagauggaguu

SEQ ID NO: 1633004 - RNA, 22 nt, Homo sapiens
ugagauggguguacaaacucau

SEQ ID NO: 1633005 - RNA, 15 nt, Homo sapiens
ugagcaagacauacu

SEQ ID NO: 1633006 - RNA, 18 nt, Homo sapiens
ugagcaagacauacuuaa

SEQ ID NO: 1633007 - RNA, 23 nt, Homo sapiens
ugagcacuuagcaggcaccgcca

SEQ ID NO: 1633008 - RNA, 16 nt, Homo sapiens
ugagcagaagaucaag

SEQ ID NO: 1633009 - RNA, 16 nt, Homo sapiens
ugagcaguuagcagac

SEQ ID NO: 1633010 - RNA, 12 nt, Homo sapiens
ugagcaugugau

SEQ ID NO: 1633011 - RNA, 22 nt, Homo sapiens
ugagccaaagcuuaugugacau

SEQ ID NO: 1633012 - RNA, 22 nt, Homo sapiens
ugagcccagcugggucaggcag

SEQ ID NO: 1633013 - RNA, 22 nt, Homo sapiens
ugagcgucaaagaaaaugccua

SEQ ID NO: 1633014 - RNA, 21 nt, Homo sapiens
ugagcugagacagauaagaga

SEQ ID NO: 1633015 - RNA, 18 nt, Homo sapiens
ugagcuggaaggggccac

SEQ ID NO: 1633016 - RNA, 20 nt, Homo sapiens
ugagcuggggacucagggac

SEQ ID NO: 1633017 - RNA, 14 nt, Homo sapiens
ugagcuugcucauu

SEQ ID NO: 1633018 - RNA, 20 nt, Homo sapiens
ugaggaagaguuuauggcaa

SEQ ID NO: 1633019 - RNA, 23 nt, Homo sapiens
ugaggccacugcugcuucuccau

SEQ ID NO: 1633020 - RNA, 16 nt, Homo sapiens
ugaggcccccaucucc

SEQ ID NO: 1633021 - RNA, 14 nt, Homo sapiens
ugaggggucucgga

SEQ ID NO: 1633022 - RNA, 14 nt, Homo sapiens
ugagggucacagua

SEQ ID NO: 1633023 - RNA, 18 nt, Homo sapiens
ugagggugcugacuggcu

SEQ ID NO: 1633024 - RNA, 15 nt, Homo sapiens
ugaggugacacucca

SEQ ID NO: 1633025 - RNA, 17 nt, Homo sapiens
ugaggugccacccagua

SEQ ID NO: 1633026 - RNA, 20 nt, Homo sapiens
ugagguguugcagcccaaag

SEQ ID NO: 1633027 - RNA, 22 nt, Homo sapiens
ugagguugggguguacuaguua

SEQ ID NO: 1633028 - RNA, 23 nt, Homo sapiens
ugaguaaacugaggcccaaagca

SEQ ID NO: 1633029 - RNA, 19 nt, Homo sapiens
ugaguaaugguuacuaggc

SEQ ID NO: 1633030 - RNA, 21 nt, Homo sapiens
ugaguagcugggauuacaggc

SEQ ID NO: 1633031 - RNA, 18 nt, Homo sapiens
ugauaaaagagaagccaa

SEQ ID NO: 1633032 - RNA, 17 nt, Homo sapiens
ugauaacuuuaagauca

SEQ ID NO: 1633033 - RNA, 14 nt, Homo sapiens
ugauacuaucugug

SEQ ID NO: 1633034 - RNA, 19 nt, Homo sapiens
ugauauguauccaucagga

SEQ ID NO: 1633035 - RNA, 15 nt, Homo sapiens
ugauauucaaccuca

SEQ ID NO: 1633036 - RNA, 21 nt, Homo sapiens
ugauauugggcucuucaggaa

SEQ ID NO: 1633037 - RNA, 21 nt, Homo sapiens
ugaucaauauuuuuauaucau

SEQ ID NO: 1633038 - RNA, 23 nt, Homo sapiens
ugauccugcaaggggacauucca

SEQ ID NO: 1633039 - RNA, 20 nt, Homo sapiens
ugaugaaaaccuacauauuc

SEQ ID NO: 1633040 - RNA, 15 nt, Homo sapiens
ugaugauccuucaga

SEQ ID NO: 1633041 - RNA, 20 nt, Homo sapiens
ugaugggccacaacugucuu

SEQ ID NO: 1633042 - RNA, 21 nt, Homo sapiens
ugaugggccacaacugucuua

SEQ ID NO: 1633043 - RNA, 15 nt, Homo sapiens
ugauuaagcuuuugu

SEQ ID NO: 1633044 - RNA, 20 nt, Homo sapiens
ugauuaccuagaagugcaag

SEQ ID NO: 1633045 - RNA, 20 nt, Homo sapiens
ugauucccagccuguggcag

SEQ ID NO: 1633046 - RNA, 16 nt, Homo sapiens
ugauuuagugaucaaa

SEQ ID NO: 1633047 - RNA, 22 nt, Homo sapiens
ugauuucagcaccuacagugua

SEQ ID NO: 1633048 - RNA, 16 nt, Homo sapiens
ugauuuuaacucuguc

SEQ ID NO: 1633049 - RNA, 16 nt, Homo sapiens
gcaacaucuuacuugu

SEQ ID NO: 1633050 - RNA, 14 nt, Homo sapiens
gcaagaaacaguuu

SEQ ID NO: 1633051 - RNA, 15 nt, Homo sapiens
gcaagaagcuguuac

SEQ ID NO: 1633052 - RNA, 16 nt, Homo sapiens
gcaagcccugcccaca

SEQ ID NO: 1633053 - RNA, 13 nt, Homo sapiens
gcaagcuccugca

SEQ ID NO: 1633054 - RNA, 20 nt, Homo sapiens
gcaagcucuucccuugcuca

SEQ ID NO: 1633055 - RNA, 21 nt, Homo sapiens
gcaagcucuucccuugcucau

SEQ ID NO: 1633056 - RNA, 16 nt, Homo sapiens
gcaaggggacauucca

SEQ ID NO: 1633057 - RNA, 16 nt, Homo sapiens
gcaagucccuuuguga

SEQ ID NO: 1633058 - RNA, 15 nt, Homo sapiens
gcaagugaaagcaag

SEQ ID NO: 1633059 - RNA, 12 nt, Homo sapiens
gcaagugccugg

SEQ ID NO: 1633060 - RNA, 13 nt, Homo sapiens
gcaauagaacccu

SEQ ID NO: 1633061 - RNA, 18 nt, Homo sapiens
gcaaucagcuaccauuca

SEQ ID NO: 1633062 - RNA, 16 nt, Homo sapiens
gcaauuugaucaguau

SEQ ID NO: 1633063 - RNA, 17 nt, Homo sapiens
gcacacccuccagagac

SEQ ID NO: 1633064 - RNA, 22 nt, Homo sapiens
gcacacccuccagagacaacag

SEQ ID NO: 1633065 - RNA, 23 nt, Homo sapiens
ucccccaccagcuaaggacauuu

SEQ ID NO: 1633066 - RNA, 21 nt, Homo sapiens
uccccccugcugcccagugca

SEQ ID NO: 1633067 - RNA, 22 nt, Homo sapiens
ucccccgacacagacucucaau

SEQ ID NO: 1633068 - RNA, 16 nt, Homo sapiens
ucccccuuucucugcc

SEQ ID NO: 1633069 - RNA, 13 nt, Homo sapiens
uccccgagaacuu

SEQ ID NO: 1633070 - RNA, 15 nt, Homo sapiens
uccccgugggccaug

SEQ ID NO: 1633071 - RNA, 21 nt, Homo sapiens
uccccucacacacaaauugac

SEQ ID NO: 1633072 - RNA, 18 nt, Homo sapiens
uccccuccccaucugugu

SEQ ID NO: 1633073 - RNA, 21 nt, Homo sapiens
uccccuguagcagucacugac

SEQ ID NO: 1633074 - RNA, 16 nt, Homo sapiens
ucccguggccuguaga

SEQ ID NO: 1633075 - RNA, 13 nt, Homo sapiens
ucccuaccugacu

SEQ ID NO: 1633076 - RNA, 14 nt, Homo sapiens
ucccuaggcccaag

SEQ ID NO: 1633077 - RNA, 17 nt, Homo sapiens
ucccuauagaccacugg

SEQ ID NO: 1633078 - RNA, 19 nt, Homo sapiens
ucccuauggagaggcuucc

SEQ ID NO: 1633079 - RNA, 13 nt, Homo sapiens
ucccuauuagaua

SEQ ID NO: 1633080 - RNA, 13 nt, Homo sapiens
ucccuccaccagc

SEQ ID NO: 1633081 - RNA, 21 nt, Homo sapiens
ucccuccuuuccuuugcccuu

SEQ ID NO: 1633082 - RNA, 17 nt, Homo sapiens
ucccucucucuggaaag

SEQ ID NO: 1633083 - RNA, 16 nt, Homo sapiens
ucccugaaguauuuaa

SEQ ID NO: 1633084 - RNA, 14 nt, Homo sapiens
ucccuuaggaauau

SEQ ID NO: 1633085 - RNA, 22 nt, Homo sapiens
uccgaaugagaauuuauuguga

SEQ ID NO: 1633086 - RNA, 22 nt, Homo sapiens
uccgaggccccugucucagggu

SEQ ID NO: 1633087 - RNA, 16 nt, Homo sapiens
uccguucaauaagcau

SEQ ID NO: 1633088 - RNA, 20 nt, Homo sapiens
uccguucacaugugugguac

SEQ ID NO: 1633089 - RNA, 19 nt, Homo sapiens
uccuaccaauggauucaug

SEQ ID NO: 1633090 - RNA, 16 nt, Homo sapiens
uccuacguauccugca

SEQ ID NO: 1633091 - RNA, 21 nt, Homo sapiens
uccuacugagcauuugcaccu

SEQ ID NO: 1633092 - RNA, 11 nt, Homo sapiens
uccuacugugu

SEQ ID NO: 1633093 - RNA, 17 nt, Homo sapiens
uccuagccccucacuuc

SEQ ID NO: 1633094 - RNA, 11 nt, Homo sapiens
uccuaggucuc

SEQ ID NO: 1633095 - RNA, 14 nt, Homo sapiens
uccuaggucucaga

SEQ ID NO: 1633096 - RNA, 14 nt, Homo sapiens
uccucucauuucca

SEQ ID NO: 1633097 - RNA, 17 nt, Homo sapiens
uccucuggauugagaua

SEQ ID NO: 1633098 - RNA, 21 nt, Homo sapiens
uccucugucagucacagccac

SEQ ID NO: 1633099 - RNA, 17 nt, Homo sapiens
uccucuucuuguugacc

SEQ ID NO: 1633100 - RNA, 18 nt, Homo sapiens
uccugaccucgugaucua

SEQ ID NO: 1633101 - RNA, 13 nt, Homo sapiens
uccugagcacugc

SEQ ID NO: 1633102 - RNA, 20 nt, Homo sapiens
uccugcaaggggacauucca

SEQ ID NO: 1633103 - RNA, 15 nt, Homo sapiens
uccugccagcccagc

SEQ ID NO: 1633104 - RNA, 20 nt, Homo sapiens
uccugcccucacaucuucca

SEQ ID NO: 1633105 - RNA, 11 nt, Homo sapiens
uccugcccuug

SEQ ID NO: 1633106 - RNA, 19 nt, Homo sapiens
uccugccuugcugugaaau

SEQ ID NO: 1633107 - RNA, 18 nt, Homo sapiens
ucuggagcuggcacugug

SEQ ID NO: 1633108 - RNA, 23 nt, Homo sapiens
ucuggccauauuuacuaccuuau

SEQ ID NO: 1633109 - RNA, 16 nt, Homo sapiens
ucugggauguauucaa

SEQ ID NO: 1633110 - RNA, 17 nt, Homo sapiens
ucugggcucaagcuuuc

SEQ ID NO: 1633111 - RNA, 17 nt, Homo sapiens
ucugguaggaaugcuuc

SEQ ID NO: 1633112 - RNA, 19 nt, Homo sapiens
ucuguagcucaaucugcaa

SEQ ID NO: 1633113 - RNA, 15 nt, Homo sapiens
ucuguagugugaaac

SEQ ID NO: 1633114 - RNA, 18 nt, Homo sapiens
ucuguccccaaaugucca

SEQ ID NO: 1633115 - RNA, 13 nt, Homo sapiens
ucugucuaccugg

SEQ ID NO: 1633116 - RNA, 21 nt, Homo sapiens
ucugugauguucccaccugcu

SEQ ID NO: 1633117 - RNA, 15 nt, Homo sapiens
ucugugcacugccca

SEQ ID NO: 1633118 - RNA, 22 nt, Homo sapiens
ucugugcugguugccacccaag

SEQ ID NO: 1633119 - RNA, 19 nt, Homo sapiens
ucugugguugcagucuuuc

SEQ ID NO: 1633120 - RNA, 14 nt, Homo sapiens
ucuguucacgucca

SEQ ID NO: 1633121 - RNA, 13 nt, Homo sapiens
ucuguucauuuca

SEQ ID NO: 1633122 - RNA, 21 nt, Homo sapiens
ucuguuuccuggucagcaugu

SEQ ID NO: 1633123 - RNA, 12 nt, Homo sapiens
ucuguuugaaac

SEQ ID NO: 1633124 - RNA, 14 nt, Homo sapiens
ucuuaaaacuuuau

SEQ ID NO: 1633125 - RNA, 23 nt, Homo sapiens
ucuuaaauuugauuuacauauau

SEQ ID NO: 1633126 - RNA, 20 nt, Homo sapiens
ucuuaaccaguuucuauccc

SEQ ID NO: 1633127 - RNA, 22 nt, Homo sapiens
ucuuacacauaaagcacuaccu

SEQ ID NO: 1633128 - RNA, 16 nt, Homo sapiens
ucuuacccuguacaua

SEQ ID NO: 1633129 - RNA, 15 nt, Homo sapiens
ucuuacuggugcuau

SEQ ID NO: 1633130 - RNA, 16 nt, Homo sapiens
ucuuacuugcauuuau

SEQ ID NO: 1633131 - RNA, 21 nt, Homo sapiens
ucuuaguguuguggacacugc

SEQ ID NO: 1633132 - RNA, 13 nt, Homo sapiens
ucuuauacaacag

SEQ ID NO: 1633133 - RNA, 16 nt, Homo sapiens
ucuuauggaaagcaaa

SEQ ID NO: 1633134 - RNA, 15 nt, Homo sapiens
ucuuauuccaggaga

SEQ ID NO: 1633135 - RNA, 13 nt, Homo sapiens
ucuucaacaugac

SEQ ID NO: 1633136 - RNA, 19 nt, Homo sapiens
ucuucaauaugaaucuaua

SEQ ID NO: 1633137 - RNA, 16 nt, Homo sapiens
ucuucccccuuccaaa

SEQ ID NO: 1633138 - RNA, 18 nt, Homo sapiens
ucuucccccuuccaaaua

SEQ ID NO: 1633139 - RNA, 15 nt, Homo sapiens
ucuucccuugcucau

SEQ ID NO: 1633140 - RNA, 23 nt, Homo sapiens
ucuuccuccagcaguuacuugau

SEQ ID NO: 1633141 - RNA, 19 nt, Homo sapiens
ucuuccucuagacuuggag

SEQ ID NO: 1633142 - RNA, 21 nt, Homo sapiens
ucuuccuugaggggcaguuug

SEQ ID NO: 1633143 - RNA, 19 nt, Homo sapiens
ucuucuauuaaucaagaga

SEQ ID NO: 1633144 - RNA, 21 nt, Homo sapiens
ucuugaauguggucucaggau

SEQ ID NO: 1633145 - RNA, 17 nt, Homo sapiens
ucuugauaccugggaua

SEQ ID NO: 1633146 - RNA, 17 nt, Homo sapiens
ucuuggcuuaaucauuu

SEQ ID NO: 1633147 - RNA, 17 nt, Homo sapiens
ucuuguauucaugaaaa

SEQ ID NO: 1633148 - RNA, 20 nt, Homo sapiens
ucuugucauuauucucugaa

SEQ ID NO: 1633149 - RNA, 21 nt, Homo sapiens
ucuuuaaaccacuaaaauaca

SEQ ID NO: 1633150 - RNA, 23 nt, Homo sapiens
ucuuuaauaaauugcuuacugau

SEQ ID NO: 1633151 - RNA, 16 nt, Homo sapiens
ucuuuauaaugggaua

SEQ ID NO: 1633152 - RNA, 15 nt, Homo sapiens
ucuuuccuuguucag

SEQ ID NO: 1633153 - RNA, 19 nt, Homo sapiens
ucuuuguaugucuguuacc

SEQ ID NO: 1633154 - RNA, 18 nt, Homo sapiens
ucuuuguuuacaugaguu

SEQ ID NO: 1633155 - RNA, 18 nt, Homo sapiens
ucuuuuaagcuaucuaua

SEQ ID NO: 1633156 - RNA, 22 nt, Homo sapiens
ucuuuuacccggcacauucccc

SEQ ID NO: 1633157 - RNA, 19 nt, Homo sapiens
ugaaacucauagacacuga

SEQ ID NO: 1633158 - RNA, 12 nt, Homo sapiens
ugaaagaacaag

SEQ ID NO: 1633159 - RNA, 23 nt, Homo sapiens
ugaaaggaaacugcuauugaacu

SEQ ID NO: 1633160 - RNA, 18 nt, Homo sapiens
ugaaauaacaaaauggac

SEQ ID NO: 1633161 - RNA, 23 nt, Homo sapiens
ugaaauaccaaccugaagacacc

SEQ ID NO: 1633162 - RNA, 16 nt, Homo sapiens
ugaaaucuguaucugu

SEQ ID NO: 1633163 - RNA, 21 nt, Homo sapiens
ugaacaaacuuagaaagggaa

SEQ ID NO: 1633164 - RNA, 19 nt, Homo sapiens
ugaacagcuugcugucacu

SEQ ID NO: 1633165 - RNA, 14 nt, Homo sapiens
ugaacaucccuuau

SEQ ID NO: 1633166 - RNA, 12 nt, Homo sapiens
ugaacauuccag

SEQ ID NO: 1633167 - RNA, 13 nt, Homo sapiens
ugaaccacaccau

SEQ ID NO: 1633168 - RNA, 14 nt, Homo sapiens
ugaacuaaugauaa

SEQ ID NO: 1633169 - RNA, 23 nt, Homo sapiens
ugaacucuccccuccccaucugu

SEQ ID NO: 1633170 - RNA, 23 nt, Homo sapiens
ugaagagagggacaggcacucca

SEQ ID NO: 1633171 - RNA, 16 nt, Homo sapiens
uagacagaaacauguc

SEQ ID NO: 1633172 - RNA, 23 nt, Homo sapiens
uagaccagggcugcucuuuccac

SEQ ID NO: 1633173 - RNA, 12 nt, Homo sapiens
uagacuaguuuc

SEQ ID NO: 1633174 - RNA, 14 nt, Homo sapiens
uagacuguuucaca

SEQ ID NO: 1633175 - RNA, 20 nt, Homo sapiens
uagacuguuucacauugcac

SEQ ID NO: 1633176 - RNA, 21 nt, Homo sapiens
uagacuguuucacauugcacu

SEQ ID NO: 1633177 - RNA, 15 nt, Homo sapiens
uagacuuauugccaa

SEQ ID NO: 1633178 - RNA, 16 nt, Homo sapiens
uagacuuauugccaaa

SEQ ID NO: 1633179 - RNA, 15 nt, Homo sapiens
uagagaauaaaccag

SEQ ID NO: 1633180 - RNA, 22 nt, Homo sapiens
uagagaauaaaccaggccuguu

SEQ ID NO: 1633181 - RNA, 14 nt, Homo sapiens
uagagaugagccca

SEQ ID NO: 1633182 - RNA, 13 nt, Homo sapiens
uagagggcccaaa

SEQ ID NO: 1633183 - RNA, 17 nt, Homo sapiens
uagagguucugccucua

SEQ ID NO: 1633184 - RNA, 14 nt, Homo sapiens
uagaguguagccua

SEQ ID NO: 1633185 - RNA, 15 nt, Homo sapiens
uagauaagucaauau

SEQ ID NO: 1633186 - RNA, 20 nt, Homo sapiens
uagauaauaaaauugcuccc

SEQ ID NO: 1633187 - RNA, 20 nt, Homo sapiens
uagauuaaauaaaacuuaaa

SEQ ID NO: 1633188 - RNA, 20 nt, Homo sapiens
uagcaaagacuugugugaug

SEQ ID NO: 1633189 - RNA, 21 nt, Homo sapiens
uagcacaugcccuaaugucug

SEQ ID NO: 1633190 - RNA, 18 nt, Homo sapiens
uagcaggcaaugcuguac

SEQ ID NO: 1633191 - RNA, 13 nt, Homo sapiens
uagcaugaggcca

SEQ ID NO: 1633192 - RNA, 19 nt, Homo sapiens
uagcaugaggccacugcug

SEQ ID NO: 1633193 - RNA, 14 nt, Homo sapiens
uagcauguuccucc

SEQ ID NO: 1633194 - RNA, 19 nt, Homo sapiens
uagccauaucagggguaca

SEQ ID NO: 1633195 - RNA, 21 nt, Homo sapiens
uagccccagcgccaaaggaga

SEQ ID NO: 1633196 - RNA, 20 nt, Homo sapiens
uagccuauuaaacuauuuua

SEQ ID NO: 1633197 - RNA, 21 nt, Homo sapiens
uagccucauaguuauuaucca

SEQ ID NO: 1633198 - RNA, 16 nt, Homo sapiens
uagcuaagcaucuccu

SEQ ID NO: 1633199 - RNA, 15 nt, Homo sapiens
uagcugagaagcaau

SEQ ID NO: 1633200 - RNA, 20 nt, Homo sapiens
uagcugagaagcaauggguc

SEQ ID NO: 1633201 - RNA, 12 nt, Homo sapiens
uagcugagcuca

SEQ ID NO: 1633202 - RNA, 18 nt, Homo sapiens
uagcugggacuacagggg

SEQ ID NO: 1633203 - RNA, 18 nt, Homo sapiens
uagcugggauuacaggcg

SEQ ID NO: 1633204 - RNA, 15 nt, Homo sapiens
ucaaaucgugguuua

SEQ ID NO: 1633205 - RNA, 15 nt, Homo sapiens
ucaaauggacuguua

SEQ ID NO: 1633206 - RNA, 13 nt, Homo sapiens
ucaaaugugcauu

SEQ ID NO: 1633207 - RNA, 17 nt, Homo sapiens
ucaaauuuguaaaguua

SEQ ID NO: 1633208 - RNA, 21 nt, Homo sapiens
ucaaauuuguaaaguuagccu

SEQ ID NO: 1633209 - RNA, 17 nt, Homo sapiens
ucaacaaagaucauuua

SEQ ID NO: 1633210 - RNA, 21 nt, Homo sapiens
ucaacaaauuucauugcacuu

SEQ ID NO: 1633211 - RNA, 15 nt, Homo sapiens
ucaacaauuuaucca

SEQ ID NO: 1633212 - RNA, 22 nt, Homo sapiens
ucaacagagggaguuuaauaca

SEQ ID NO: 1633213 - RNA, 14 nt, Homo sapiens
ucaaccaacugcaa

SEQ ID NO: 1633214 - RNA, 19 nt, Homo sapiens
ucaacuguuuuugucuaca

SEQ ID NO: 1633215 - RNA, 20 nt, Homo sapiens
ucaagaugagccugggcuca

SEQ ID NO: 1633216 - RNA, 20 nt, Homo sapiens
ucaagaugccuccugucaga

SEQ ID NO: 1633217 - RNA, 22 nt, Homo sapiens
ucaagcaauucuccugccuuag

SEQ ID NO: 1633218 - RNA, 20 nt, Homo sapiens
ucaagccccacgaugacugc

SEQ ID NO: 1633219 - RNA, 15 nt, Homo sapiens
ucaagcuccaagagg

SEQ ID NO: 1633220 - RNA, 18 nt, Homo sapiens
ucaagcugagauugagca

SEQ ID NO: 1633221 - RNA, 23 nt, Homo sapiens
ucaagcuggugcuacuguuugau

SEQ ID NO: 1633222 - RNA, 20 nt, Homo sapiens
ucaaggaggcccacuguguc

SEQ ID NO: 1633223 - RNA, 17 nt, Homo sapiens
ucaaggccuucaguuua

SEQ ID NO: 1633224 - RNA, 18 nt, Homo sapiens
ucaaggccuucaguuuau

SEQ ID NO: 1633225 - RNA, 18 nt, Homo sapiens
ucaaggcugcagugagcc

SEQ ID NO: 1633226 - RNA, 15 nt, Homo sapiens
ucaagggcacuguga

SEQ ID NO: 1633227 - RNA, 18 nt, Homo sapiens
ucaagggcacugugauac

SEQ ID NO: 1633228 - RNA, 18 nt, Homo sapiens
ucaagggguguucaguua

SEQ ID NO: 1633229 - RNA, 15 nt, Homo sapiens
ucaagguaacuguac

SEQ ID NO: 1633230 - RNA, 14 nt, Homo sapiens
ucaaguaauggagg

SEQ ID NO: 1633231 - RNA, 15 nt, Homo sapiens
ucaagucugcacaga

SEQ ID NO: 1633232 - RNA, 15 nt, Homo sapiens
ucaaguggguauucu

SEQ ID NO: 1633233 - RNA, 22 nt, Homo sapiens
ucaauacugcacacugcacauu

SEQ ID NO: 1633234 - RNA, 21 nt, Homo sapiens
ucaaucugcaguuuaacaaaa

SEQ ID NO: 1633235 - RNA, 19 nt, Homo sapiens
ucaaugaaccacaaaaaag

SEQ ID NO: 1633236 - RNA, 16 nt, Homo sapiens
ucaaugcuagcacaau

SEQ ID NO: 1633237 - RNA, 13 nt, Homo sapiens
ucaaugcuauucu

SEQ ID NO: 1633238 - RNA, 19 nt, Homo sapiens
ucaauucugugugguauau

SEQ ID NO: 1633239 - RNA, 23 nt, Homo sapiens
ucacaaagaauuuaaaauaacac

SEQ ID NO: 1633240 - RNA, 23 nt, Homo sapiens
ucacaaauaaguaauaucuuuca

SEQ ID NO: 1633241 - RNA, 15 nt, Homo sapiens
ucacaacagugaaaa

SEQ ID NO: 1633242 - RNA, 16 nt, Homo sapiens
ucacaaccaccauuca

SEQ ID NO: 1633243 - RNA, 16 nt, Homo sapiens
ucacaagggcucucaa

SEQ ID NO: 1633244 - RNA, 21 nt, Homo sapiens
ucacacccacccccugccugg

SEQ ID NO: 1633245 - RNA, 14 nt, Homo sapiens
ucacacuuugccau

SEQ ID NO: 1633246 - RNA, 22 nt, Homo sapiens
ucacagacacugcacagaccuu

SEQ ID NO: 1633247 - RNA, 14 nt, Homo sapiens
ucacaguccugucc

SEQ ID NO: 1633248 - RNA, 17 nt, Homo sapiens
ucacauggccuaugcac

SEQ ID NO: 1633249 - RNA, 20 nt, Homo sapiens
ucacauggccuaugcacaua

SEQ ID NO: 1633250 - RNA, 23 nt, Homo sapiens
ucacauggccuaugcacauaugg

SEQ ID NO: 1633251 - RNA, 19 nt, Homo sapiens
ucacauugcacucaucaua

SEQ ID NO: 1633252 - RNA, 18 nt, Homo sapiens
ucacccagggacacucca

SEQ ID NO: 1633253 - RNA, 18 nt, Homo sapiens
ucaccccugcuauaacua

SEQ ID NO: 1633254 - RNA, 17 nt, Homo sapiens
ucaccgacucaccugcg

SEQ ID NO: 1633255 - RNA, 17 nt, Homo sapiens
ucaccgagcgggugcaa

SEQ ID NO: 1633256 - RNA, 20 nt, Homo sapiens
ucaccuagcagccucaaaac

SEQ ID NO: 1633257 - RNA, 19 nt, Homo sapiens
ucaccuccaagcauuucau

SEQ ID NO: 1633258 - RNA, 19 nt, Homo sapiens
ucaccuuaggaauaaucuc

SEQ ID NO: 1633259 - RNA, 14 nt, Homo sapiens
ucacggccaagugu

SEQ ID NO: 1633260 - RNA, 16 nt, Homo sapiens
ucacgggucacuugaa

SEQ ID NO: 1633261 - RNA, 15 nt, Homo sapiens
ucacuaauauaguag

SEQ ID NO: 1633262 - RNA, 15 nt, Homo sapiens
ucacucauagccacu

SEQ ID NO: 1633263 - RNA, 14 nt, Homo sapiens
ucacucauccaucc

SEQ ID NO: 1633264 - RNA, 15 nt, Homo sapiens
ucacucauccauccc

SEQ ID NO: 1633265 - RNA, 17 nt, Homo sapiens
ucacuguuccagucucc

SEQ ID NO: 1633266 - RNA, 14 nt, Homo sapiens
ucacuucauucaca

SEQ ID NO: 1633267 - RNA, 18 nt, Homo sapiens
ucacuuguucucacuguc

SEQ ID NO: 1633268 - RNA, 20 nt, Homo sapiens
ucacuuguucucacugucug

SEQ ID NO: 1633269 - RNA, 16 nt, Homo sapiens
ucacuuuauuaucccu

SEQ ID NO: 1633270 - RNA, 15 nt, Homo sapiens
ucagaaagauuugau

SEQ ID NO: 1633271 - RNA, 19 nt, Homo sapiens
ucagaaauaauaaccuguu

SEQ ID NO: 1633272 - RNA, 22 nt, Homo sapiens
ucagaaguaaaggaauuugaug

SEQ ID NO: 1633273 - RNA, 15 nt, Homo sapiens
ucagaauaaggcagg

SEQ ID NO: 1633274 - RNA, 20 nt, Homo sapiens
ucagacauuuauauauugga

SEQ ID NO: 1633275 - RNA, 16 nt, Homo sapiens
ucagaccuggcugcuu

SEQ ID NO: 1633276 - RNA, 17 nt, Homo sapiens
ucagacuccuagacuca

SEQ ID NO: 1633277 - RNA, 21 nt, Homo sapiens
ucagacuuuguguucauuuca

SEQ ID NO: 1633278 - RNA, 20 nt, Homo sapiens
aggcauugauugcacuugau

SEQ ID NO: 1633279 - RNA, 19 nt, Homo sapiens
aggccacacucagcacaag

SEQ ID NO: 1633280 - RNA, 15 nt, Homo sapiens
aggccagaugcacau

SEQ ID NO: 1633281 - RNA, 17 nt, Homo sapiens
aggccauggauggaaaa

SEQ ID NO: 1633282 - RNA, 18 nt, Homo sapiens
aggccauuaggguugccu

SEQ ID NO: 1633283 - RNA, 15 nt, Homo sapiens
aggcccaaagcacuu

SEQ ID NO: 1633284 - RNA, 15 nt, Homo sapiens
aggcccccaucuccu

SEQ ID NO: 1633285 - RNA, 16 nt, Homo sapiens
aggcccuggaggucuc

SEQ ID NO: 1633286 - RNA, 22 nt, Homo sapiens
aggccucuccaguuugcaccug

SEQ ID NO: 1633287 - RNA, 21 nt, Homo sapiens
aggccuucaguuuauuuccac

SEQ ID NO: 1633288 - RNA, 22 nt, Homo sapiens
aggccuuuuuugccagacucua

SEQ ID NO: 1633289 - RNA, 19 nt, Homo sapiens
aggcucacugcaacuucug

SEQ ID NO: 1633290 - RNA, 14 nt, Homo sapiens
aggcuccccagggc

SEQ ID NO: 1633291 - RNA, 23 nt, Homo sapiens
aggcugaggcuggcacaggacau

SEQ ID NO: 1633292 - RNA, 22 nt, Homo sapiens
aggcugaucucgaacuccuaac

SEQ ID NO: 1633293 - RNA, 17 nt, Homo sapiens
aggcugauuccucucau

SEQ ID NO: 1633294 - RNA, 17 nt, Homo sapiens
aggcuggagugcaaugg

SEQ ID NO: 1633295 - RNA, 23 nt, Homo sapiens
aggcuggaguguaguggcaugau

SEQ ID NO: 1633296 - RNA, 17 nt, Homo sapiens
aggcuggcacaggacau

SEQ ID NO: 1633297 - RNA, 21 nt, Homo sapiens
aggcuuaauaccugggugauu

SEQ ID NO: 1633298 - RNA, 14 nt, Homo sapiens
agggaacaguauuu

SEQ ID NO: 1633299 - RNA, 21 nt, Homo sapiens
agggaaccugguacauccagu

SEQ ID NO: 1633300 - RNA, 16 nt, Homo sapiens
agggacaggcacucca

SEQ ID NO: 1633301 - RNA, 18 nt, Homo sapiens
agggacugucgcugcuuc

SEQ ID NO: 1633302 - RNA, 23 nt, Homo sapiens
agggacuucacgaaguguugcau

SEQ ID NO: 1633303 - RNA, 18 nt, Homo sapiens
agggagcugcaggggcau

SEQ ID NO: 1633304 - RNA, 13 nt, Homo sapiens
agggaggaccaaa

SEQ ID NO: 1633305 - RNA, 16 nt, Homo sapiens
agggaggccgaagcua

SEQ ID NO: 1633306 - RNA, 16 nt, Homo sapiens
agggagggcucugagg

SEQ ID NO: 1633307 - RNA, 15 nt, Homo sapiens
agggagggcugucau

SEQ ID NO: 1633308 - RNA, 13 nt, Homo sapiens
cccacccagucuc

SEQ ID NO: 1633309 - RNA, 14 nt, Homo sapiens
cccacccagucuca

SEQ ID NO: 1633310 - RNA, 16 nt, Homo sapiens
cccacugacuguaugg

SEQ ID NO: 1633311 - RNA, 19 nt, Homo sapiens
cccagaaguccagaagggu

SEQ ID NO: 1633312 - RNA, 23 nt, Homo sapiens
cccagagugagcuuuagcucucu

SEQ ID NO: 1633313 - RNA, 16 nt, Homo sapiens
cccaggaaaaacugga

SEQ ID NO: 1633314 - RNA, 15 nt, Homo sapiens
cccaggaccuggcug

SEQ ID NO: 1633315 - RNA, 17 nt, Homo sapiens
cccaggaggugcagugg

SEQ ID NO: 1633316 - RNA, 17 nt, Homo sapiens
cccaggauacuggcaca

SEQ ID NO: 1633317 - RNA, 19 nt, Homo sapiens
cccaggcuggagugcaaug

SEQ ID NO: 1633318 - RNA, 20 nt, Homo sapiens
cccaggcuggagugcaaugg

SEQ ID NO: 1633319 - RNA, 11 nt, Homo sapiens
cccagugcaaa

SEQ ID NO: 1633320 - RNA, 20 nt, Homo sapiens
cccagugcagguauuucaga

SEQ ID NO: 1633321 - RNA, 14 nt, Homo sapiens
cccaguucaucacc

SEQ ID NO: 1633322 - RNA, 21 nt, Homo sapiens
cccaguucaucaccauuuccu

SEQ ID NO: 1633323 - RNA, 14 nt, Homo sapiens
cccauguacauaau

SEQ ID NO: 1633324 - RNA, 12 nt, Homo sapiens
cccauuaaauuc

SEQ ID NO: 1633325 - RNA, 11 nt, Homo sapiens
cccauuucaga

SEQ ID NO: 1633326 - RNA, 23 nt, Homo sapiens
ccccaagagcaggaggugccuga

SEQ ID NO: 1633327 - RNA, 12 nt, Homo sapiens
ccccacugccac

SEQ ID NO: 1633328 - RNA, 22 nt, Homo sapiens
ccccagucucuggggucaggaa

SEQ ID NO: 1633329 - RNA, 18 nt, Homo sapiens
ccccaugaccuccagcuu

SEQ ID NO: 1633330 - RNA, 23 nt, Homo sapiens
cccccaucuccuuaaagagugug

SEQ ID NO: 1633331 - RNA, 16 nt, Homo sapiens
cccccugcagcuugua

SEQ ID NO: 1633332 - RNA, 15 nt, Homo sapiens
ccccgugacugcaau

SEQ ID NO: 1633333 - RNA, 22 nt, Homo sapiens
ccccuagcugggccaacuccag

SEQ ID NO: 1633334 - RNA, 23 nt, Homo sapiens
ccccuggcuccagagauggucac

SEQ ID NO: 1633335 - RNA, 16 nt, Homo sapiens
ccccuguagcagucac

SEQ ID NO: 1633336 - RNA, 14 nt, Homo sapiens
cccgagaagcacuu

SEQ ID NO: 1633337 - RNA, 19 nt, Homo sapiens
cccggcugucaaggggugu

SEQ ID NO: 1633338 - RNA, 22 nt, Homo sapiens
cccgggcauccacguagggggc

SEQ ID NO: 1633339 - RNA, 13 nt, Homo sapiens
cccuacacacaca

SEQ ID NO: 1633340 - RNA, 17 nt, Homo sapiens
cccucaucuaugaggaa

SEQ ID NO: 1633341 - RNA, 22 nt, Homo sapiens
cccucccagcccauugcugcca

SEQ ID NO: 1633342 - RNA, 15 nt, Homo sapiens
cccuccuuggcuuua

SEQ ID NO: 1633343 - RNA, 19 nt, Homo sapiens
cccucuagaaauuuuucag

SEQ ID NO: 1633344 - RNA, 14 nt, Homo sapiens
cccucuccuuccaa

SEQ ID NO: 1633345 - RNA, 22 nt, Homo sapiens
cccucugauuuccuucugcuau

SEQ ID NO: 1633346 - RNA, 20 nt, Homo sapiens
cccucugcauugaccuggag

SEQ ID NO: 1633347 - RNA, 15 nt, Homo sapiens
cccugaauguguaga

SEQ ID NO: 1633348 - RNA, 17 nt, Homo sapiens
cccugacuggccaaacc

SEQ ID NO: 1633349 - RNA, 19 nt, Homo sapiens
cccugaugugacauuccau

SEQ ID NO: 1633350 - RNA, 17 nt, Homo sapiens
cccugcaaacagaacag

SEQ ID NO: 1633351 - RNA, 16 nt, Homo sapiens
cccugccucacaucuc

SEQ ID NO: 1633352 - RNA, 19 nt, Homo sapiens
cccugcgggugaacaaagc

SEQ ID NO: 1633353 - RNA, 21 nt, Homo sapiens
cccugcgggugaacaaagcag

SEQ ID NO: 1633354 - RNA, 20 nt, Homo sapiens
cccugcuccccuacuucuca

SEQ ID NO: 1633355 - RNA, 16 nt, Homo sapiens
cccugcugagaucugc

SEQ ID NO: 1633356 - RNA, 21 nt, Homo sapiens
cccugcuuccaccucacccca

SEQ ID NO: 1633357 - RNA, 13 nt, Homo sapiens
cccugcuuucuac

SEQ ID NO: 1633358 - RNA, 18 nt, Homo sapiens
cccuggaaggacauccau

SEQ ID NO: 1633359 - RNA, 14 nt, Homo sapiens
cccugggaaccacu

SEQ ID NO: 1633360 - RNA, 12 nt, Homo sapiens
cccugugcucca

SEQ ID NO: 1633361 - RNA, 23 nt, Homo sapiens
cccuguguggucuccaugcucac

SEQ ID NO: 1633362 - RNA, 18 nt, Homo sapiens
cccuuacagccucugacu

SEQ ID NO: 1633363 - RNA, 18 nt, Homo sapiens
cccuuaggaauauacaua

SEQ ID NO: 1633364 - RNA, 14 nt, Homo sapiens
cccuuagugacucu

SEQ ID NO: 1633365 - RNA, 17 nt, Homo sapiens
cccuuagugacucuuga

SEQ ID NO: 1633366 - RNA, 15 nt, Homo sapiens
cccuucagcauccuc

SEQ ID NO: 1633367 - RNA, 14 nt, Homo sapiens
cccuucguguuucc

SEQ ID NO: 1633368 - RNA, 15 nt, Homo sapiens
cccuuuacaaauaga

SEQ ID NO: 1633369 - RNA, 17 nt, Homo sapiens
cccuuuauguacaggau

SEQ ID NO: 1633370 - RNA, 19 nt, Homo sapiens
cccuuugugacuucaagaa

SEQ ID NO: 1633371 - RNA, 21 nt, Homo sapiens
cccuuuuucauuuaacuuuau

SEQ ID NO: 1633372 - RNA, 19 nt, Homo sapiens
ccgagcgggugcaagcacu

SEQ ID NO: 1633373 - RNA, 20 nt, Homo sapiens
ccgagcgggugcaagcacuc

SEQ ID NO: 1633374 - RNA, 15 nt, Homo sapiens
ccgaugguacuauuu

SEQ ID NO: 1633375 - RNA, 19 nt, Homo sapiens
ccgcaccauugaacuguac

SEQ ID NO: 1633376 - RNA, 22 nt, Homo sapiens
ccgccagccacaggaccaccuc

SEQ ID NO: 1633377 - RNA, 22 nt, Homo sapiens
ccgcucggacuuacugccugac

SEQ ID NO: 1633378 - RNA, 22 nt, Homo sapiens
ccgcuggggaccgguucccaca

SEQ ID NO: 1633379 - RNA, 13 nt, Homo sapiens
ccggaaaaaucua

SEQ ID NO: 1633380 - RNA, 19 nt, Homo sapiens
ccgggcaauccagacagca

SEQ ID NO: 1633381 - RNA, 15 nt, Homo sapiens
ccgguggaaggccuu

SEQ ID NO: 1633382 - RNA, 13 nt, Homo sapiens
ccgugacugcaau

SEQ ID NO: 1633383 - RNA, 23 nt, Homo sapiens
ccuaaagggcagggcccacgugu

SEQ ID NO: 1633384 - RNA, 22 nt, Homo sapiens
ccuaaauguuaacuacauauug

SEQ ID NO: 1633385 - RNA, 17 nt, Homo sapiens
ccuaacacacuccaaga

SEQ ID NO: 1633386 - RNA, 19 nt, Homo sapiens
ccuaacacggugcucauuu

SEQ ID NO: 1633387 - RNA, 22 nt, Homo sapiens
ccuaacaugcaccuugcuccca

SEQ ID NO: 1633388 - RNA, 21 nt, Homo sapiens
ccuaagaucucgguuugccaa

SEQ ID NO: 1633389 - RNA, 15 nt, Homo sapiens
ccuaauaacgugaaa

SEQ ID NO: 1633390 - RNA, 16 nt, Homo sapiens
ccuaauaacgugaaac

SEQ ID NO: 1633391 - RNA, 15 nt, Homo sapiens
ccuaauguggcagcu

SEQ ID NO: 1633392 - RNA, 18 nt, Homo sapiens
ccuacagcacuacugggu

SEQ ID NO: 1633393 - RNA, 21 nt, Homo sapiens
ccuaccgcuggcccugccguu

SEQ ID NO: 1633394 - RNA, 13 nt, Homo sapiens
ccuaccugacugc

SEQ ID NO: 1633395 - RNA, 15 nt, Homo sapiens
ccuacguauccugca

SEQ ID NO: 1633396 - RNA, 18 nt, Homo sapiens
ccuacugagcauuugcac

SEQ ID NO: 1633397 - RNA, 17 nt, Homo sapiens
ccuacugccaaccugga

SEQ ID NO: 1633398 - RNA, 12 nt, Homo sapiens
ccuagagcucua

SEQ ID NO: 1633399 - RNA, 17 nt, Homo sapiens
ccuagcagccucaaaac

SEQ ID NO: 1633400 - RNA, 22 nt, Homo sapiens
ccuagcaggaacuucuagcuca

SEQ ID NO: 1633401 - RNA, 21 nt, Homo sapiens
ccuagcuggcucugugagggu

SEQ ID NO: 1633402 - RNA, 12 nt, Homo sapiens
ccuaggcccaag

SEQ ID NO: 1633403 - RNA, 22 nt, Homo sapiens
ccuaugauggauggcagacucu

SEQ ID NO: 1633404 - RNA, 14 nt, Homo sapiens
ccuaugcacauaug

SEQ ID NO: 1633405 - RNA, 12 nt, Homo sapiens
ccuauuaauucu

SEQ ID NO: 1633406 - RNA, 11 nt, Homo sapiens
ccucaagcacc

SEQ ID NO: 1633407 - RNA, 17 nt, Homo sapiens
ccucaagccccauuucc

SEQ ID NO: 1633408 - RNA, 20 nt, Homo sapiens
ccucaagccccauuuccuca

SEQ ID NO: 1633409 - RNA, 21 nt, Homo sapiens
ccucaagccccauuuccucac

SEQ ID NO: 1633410 - RNA, 14 nt, Homo sapiens
ccucacacagcccu

SEQ ID NO: 1633411 - RNA, 17 nt, Homo sapiens
ccucacauucucuaugu

SEQ ID NO: 1633412 - RNA, 22 nt, Homo sapiens
ccucacucuguuuccuggucag

SEQ ID NO: 1633413 - RNA, 16 nt, Homo sapiens
ccucaggugcuaggga

SEQ ID NO: 1633414 - RNA, 14 nt, Homo sapiens
ccucagucccucuu

SEQ ID NO: 1633415 - RNA, 14 nt, Homo sapiens
ccucaguuccugca

SEQ ID NO: 1633416 - RNA, 14 nt, Homo sapiens
ccucauacacagaa

SEQ ID NO: 1633417 - RNA, 14 nt, Homo sapiens
ccuccaaaagcccu

SEQ ID NO: 1633418 - RNA, 17 nt, Homo sapiens
auaccugggauacugug

SEQ ID NO: 1633419 - RNA, 21 nt, Homo sapiens
auaccuguugagacugauuca

SEQ ID NO: 1633420 - RNA, 15 nt, Homo sapiens
auaccuuccccacau

SEQ ID NO: 1633421 - RNA, 19 nt, Homo sapiens
auaccuuccccacaucuga

SEQ ID NO: 1633422 - RNA, 14 nt, Homo sapiens
auacucaacaaaac

SEQ ID NO: 1633423 - RNA, 17 nt, Homo sapiens
auacugaggcacacaga

SEQ ID NO: 1633424 - RNA, 15 nt, Homo sapiens
auacugaggggucua

SEQ ID NO: 1633425 - RNA, 18 nt, Homo sapiens
auacugcacacugcacau

SEQ ID NO: 1633426 - RNA, 14 nt, Homo sapiens
auagaagcaaauua

SEQ ID NO: 1633427 - RNA, 18 nt, Homo sapiens
auagaauaaaauauaauu

SEQ ID NO: 1633428 - RNA, 15 nt, Homo sapiens
auagacauucucaca

SEQ ID NO: 1633429 - RNA, 15 nt, Homo sapiens
auagaccacuggguu

SEQ ID NO: 1633430 - RNA, 17 nt, Homo sapiens
auagacuuauugccaaa

SEQ ID NO: 1633431 - RNA, 15 nt, Homo sapiens
auagauaagucaaua

SEQ ID NO: 1633432 - RNA, 15 nt, Homo sapiens
auagcaagugaaagc

SEQ ID NO: 1633433 - RNA, 13 nt, Homo sapiens
auagccacuuuua

SEQ ID NO: 1633434 - RNA, 19 nt, Homo sapiens
auagccuguggccuuugca

SEQ ID NO: 1633435 - RNA, 15 nt, Homo sapiens
auagucacauggccu

SEQ ID NO: 1633436 - RNA, 14 nt, Homo sapiens
auaguccuuuacaa

SEQ ID NO: 1633437 - RNA, 14 nt, Homo sapiens
auagucuuugccag

SEQ ID NO: 1633438 - RNA, 18 nt, Homo sapiens
auaguuguugaguauucc

SEQ ID NO: 1633439 - RNA, 16 nt, Homo sapiens
auauaagcugccauau

SEQ ID NO: 1633440 - RNA, 16 nt, Homo sapiens
auauaauuuauuucca

SEQ ID NO: 1633441 - RNA, 10 nt, Homo sapiens
auauacaaau

SEQ ID NO: 1633442 - RNA, 13 nt, Homo sapiens
auauacagaggaa

SEQ ID NO: 1633443 - RNA, 16 nt, Homo sapiens
auauagaauuauuaca

SEQ ID NO: 1633444 - RNA, 23 nt, Homo sapiens
auauagcaaaugcagaaccacaa

SEQ ID NO: 1633445 - RNA, 22 nt, Homo sapiens
auuacauaaucuguacaaugaa

SEQ ID NO: 1633446 - RNA, 17 nt, Homo sapiens
auuaccaucuuaaucuu

SEQ ID NO: 1633447 - RNA, 14 nt, Homo sapiens
auuacucaguuuau

SEQ ID NO: 1633448 - RNA, 16 nt, Homo sapiens
auuacugaugugugca

SEQ ID NO: 1633449 - RNA, 13 nt, Homo sapiens
auuagauaaucaa

SEQ ID NO: 1633450 - RNA, 17 nt, Homo sapiens
auuaggucucuguugac

SEQ ID NO: 1633451 - RNA, 17 nt, Homo sapiens
auuauaaacuguaugcu

SEQ ID NO: 1633452 - RNA, 14 nt, Homo sapiens
auuauccuugcuau

SEQ ID NO: 1633453 - RNA, 22 nt, Homo sapiens
auuaugaagaauacccaggaag

SEQ ID NO: 1633454 - RNA, 17 nt, Homo sapiens
auuaugaugaaaaccua

SEQ ID NO: 1633455 - RNA, 19 nt, Homo sapiens
auuaugaugaaaaccuaca

SEQ ID NO: 1633456 - RNA, 21 nt, Homo sapiens
auuaugaugaaaaccuacaua

SEQ ID NO: 1633457 - RNA, 20 nt, Homo sapiens
auuaugcauuauaucaaauc

SEQ ID NO: 1633458 - RNA, 15 nt, Homo sapiens
auuaugccacuuccu

SEQ ID NO: 1633459 - RNA, 15 nt, Homo sapiens
auuauucaaaaacau

SEQ ID NO: 1633460 - RNA, 18 nt, Homo sapiens
auuauucagaauuauaca

SEQ ID NO: 1633461 - RNA, 17 nt, Homo sapiens
auuauuguagacaugcc

SEQ ID NO: 1633462 - RNA, 18 nt, Homo sapiens
auuauuucaccaagccaa

SEQ ID NO: 1633463 - RNA, 16 nt, Homo sapiens
auuauuucucuaauua

SEQ ID NO: 1633464 - RNA, 23 nt, Homo sapiens
auuauuugggagggaaaagggaa

SEQ ID NO: 1633465 - RNA, 16 nt, Homo sapiens
auuauuuuccuuccau

SEQ ID NO: 1633466 - RNA, 22 nt, Homo sapiens
auuauuuuccuuccaugcuccc

SEQ ID NO: 1633467 - RNA, 19 nt, Homo sapiens
auucaaaaacauaacugag

SEQ ID NO: 1633468 - RNA, 13 nt, Homo sapiens
auucaaagcugcu

SEQ ID NO: 1633469 - RNA, 14 nt, Homo sapiens
auucaacacauugg

SEQ ID NO: 1633470 - RNA, 22 nt, Homo sapiens
auucagcucuggagaacagugg

SEQ ID NO: 1633471 - RNA, 16 nt, Homo sapiens
auucauggcuaccuca

SEQ ID NO: 1633472 - RNA, 17 nt, Homo sapiens
auuccagcguacuauaa

SEQ ID NO: 1633473 - RNA, 15 nt, Homo sapiens
auucccaccccucau

SEQ ID NO: 1633474 - RNA, 21 nt, Homo sapiens
auuccccuguagcagucacug

SEQ ID NO: 1633475 - RNA, 20 nt, Homo sapiens
auuccuacagcacuacuggg

SEQ ID NO: 1633476 - RNA, 15 nt, Homo sapiens
auuccuaugauggau

SEQ ID NO: 1633477 - RNA, 16 nt, Homo sapiens
auuccuaugcugcaau

SEQ ID NO: 1633478 - RNA, 22 nt, Homo sapiens
auuccuaugcugcaauacauua

SEQ ID NO: 1633479 - RNA, 16 nt, Homo sapiens
auucuacuagcaggca

SEQ ID NO: 1633480 - RNA, 17 nt, Homo sapiens
auucuauuauacuacaa

SEQ ID NO: 1633481 - RNA, 21 nt, Homo sapiens
auucucagaguaaaauaggca

SEQ ID NO: 1633482 - RNA, 15 nt, Homo sapiens
auucuccugccuuag

SEQ ID NO: 1633483 - RNA, 15 nt, Homo sapiens
auucucguuuaaaca

SEQ ID NO: 1633484 - RNA, 20 nt, Homo sapiens
auucucuaaccgaauauuca

SEQ ID NO: 1633485 - RNA, 18 nt, Homo sapiens
auucugaagcaacauuuu

SEQ ID NO: 1633486 - RNA, 16 nt, Homo sapiens
auucugccuagagugu

SEQ ID NO: 1633487 - RNA, 15 nt, Homo sapiens
auucuggaaucacaa

SEQ ID NO: 1633488 - RNA, 16 nt, Homo sapiens
auucuggaaucacaaa

SEQ ID NO: 1633489 - RNA, 21 nt, Homo sapiens
auucuguccccaaauguccau

SEQ ID NO: 1633490 - RNA, 15 nt, Homo sapiens
auucuguuuccuuaa

SEQ ID NO: 1633491 - RNA, 18 nt, Homo sapiens
auucuuaauagguucaaa

SEQ ID NO: 1633492 - RNA, 19 nt, Homo sapiens
auucuuccucaaagcauuu

SEQ ID NO: 1633493 - RNA, 23 nt, Homo sapiens
auugaacuguaccaugugcuaca

SEQ ID NO: 1633494 - RNA, 15 nt, Homo sapiens
auugaggcccugcug

SEQ ID NO: 1633495 - RNA, 17 nt, Homo sapiens
auugauggguuaauuaa

SEQ ID NO: 1633496 - RNA, 17 nt, Homo sapiens
auugcagaccugucacc

SEQ ID NO: 1633497 - RNA, 13 nt, Homo sapiens
auugcuuuuauua

SEQ ID NO: 1633498 - RNA, 19 nt, Homo sapiens
auugcuuuuuuaaauauua

SEQ ID NO: 1633499 - RNA, 14 nt, Homo sapiens
auuggaagagcaca

SEQ ID NO: 1633500 - RNA, 16 nt, Homo sapiens
auugguagaaggauuu

SEQ ID NO: 1633501 - RNA, 15 nt, Homo sapiens
auugguguacugugu

SEQ ID NO: 1633502 - RNA, 13 nt, Homo sapiens
auugucaccucug

SEQ ID NO: 1633503 - RNA, 17 nt, Homo sapiens
auugucauaucagcaca

SEQ ID NO: 1633504 - RNA, 22 nt, Homo sapiens
auugucauaucagcacauauuu

SEQ ID NO: 1633505 - RNA, 14 nt, Homo sapiens
auugugcacuguau

SEQ ID NO: 1633506 - RNA, 17 nt, Homo sapiens
auugugugacuauucau

SEQ ID NO: 1633507 - RNA, 16 nt, Homo sapiens
auuguuaucuaucaac

SEQ ID NO: 1633508 - RNA, 13 nt, Homo sapiens
auuguuguuacuu

SEQ ID NO: 1633509 - RNA, 15 nt, Homo sapiens
auuguuguugccaaa

SEQ ID NO: 1633510 - RNA, 20 nt, Homo sapiens
auuguuucuccucugaagca

SEQ ID NO: 1633511 - RNA, 23 nt, Homo sapiens
auuguuucuccucugaagcauuu

SEQ ID NO: 1633512 - RNA, 14 nt, Homo sapiens
auuuaaauuccaca

SEQ ID NO: 1633513 - RNA, 14 nt, Homo sapiens
auuuaacuauucau

SEQ ID NO: 1633514 - RNA, 18 nt, Homo sapiens
auuuaagacacuguuaca

SEQ ID NO: 1633515 - RNA, 19 nt, Homo sapiens
auuuaauacagacaucuaa

SEQ ID NO: 1633516 - RNA, 22 nt, Homo sapiens
auuuacaacccgguucacucuu

SEQ ID NO: 1633517 - RNA, 15 nt, Homo sapiens
auuuacaagcacgau

SEQ ID NO: 1633518 - RNA, 21 nt, Homo sapiens
auuuagacuuacuauuacaua

SEQ ID NO: 1633519 - RNA, 22 nt, Homo sapiens
auuuagugaucaaauugugcag

SEQ ID NO: 1633520 - RNA, 13 nt, Homo sapiens
auuuaucuuucaa

SEQ ID NO: 1633521 - RNA, 20 nt, Homo sapiens
auuuauggaaaauacucuga

SEQ ID NO: 1633522 - RNA, 14 nt, Homo sapiens
auuuauuucuagca

SEQ ID NO: 1633523 - RNA, 12 nt, Homo sapiens
auuucacacagu

SEQ ID NO: 1633524 - RNA, 15 nt, Homo sapiens
auuucacacagugaa

SEQ ID NO: 1633525 - RNA, 17 nt, Homo sapiens
auuucacauuucuacuc

SEQ ID NO: 1633526 - RNA, 14 nt, Homo sapiens
auuucaccacucaa

SEQ ID NO: 1633527 - RNA, 18 nt, Homo sapiens
auuucagauauuccaggu

SEQ ID NO: 1633528 - RNA, 22 nt, Homo sapiens
auuucagggucuuggcugccug

SEQ ID NO: 1633529 - RNA, 15 nt, Homo sapiens
auuucauugcacuuu

SEQ ID NO: 1633530 - RNA, 16 nt, Homo sapiens
auuuccagcuucucag

SEQ ID NO: 1633531 - RNA, 18 nt, Homo sapiens
auuuccugauaacauuau

SEQ ID NO: 1633532 - RNA, 23 nt, Homo sapiens
cugucaagcaccugcaugugcug

SEQ ID NO: 1633533 - RNA, 15 nt, Homo sapiens
cugucaguggagcag

SEQ ID NO: 1633534 - RNA, 16 nt, Homo sapiens
cuguccguucacaugu

SEQ ID NO: 1633535 - RNA, 20 nt, Homo sapiens
cugucucaaaccuccaaaag

SEQ ID NO: 1633536 - RNA, 19 nt, Homo sapiens
ccucugucagucacagcca

SEQ ID NO: 1633537 - RNA, 22 nt, Homo sapiens
ccucugugaacugugugugaau

SEQ ID NO: 1633538 - RNA, 13 nt, Homo sapiens
ccucugugaagca

SEQ ID NO: 1633539 - RNA, 13 nt, Homo sapiens
ccucugugccgca

SEQ ID NO: 1633540 - RNA, 19 nt, Homo sapiens
ccucuuauugggauaucau

SEQ ID NO: 1633541 - RNA, 21 nt, Homo sapiens
ccugaacuacauaacuuccua

SEQ ID NO: 1633542 - RNA, 23 nt, Homo sapiens
ccugaaggcacagcuaaccacuu

SEQ ID NO: 1633543 - RNA, 11 nt, Homo sapiens
ccugaagggaa

SEQ ID NO: 1633544 - RNA, 12 nt, Homo sapiens
ccugaccccagu

SEQ ID NO: 1633545 - RNA, 18 nt, Homo sapiens
ccugacucuugcaggggu

SEQ ID NO: 1633546 - RNA, 12 nt, Homo sapiens
ccugaguuucaa

SEQ ID NO: 1633547 - RNA, 20 nt, Homo sapiens
ccugcaaggggacauuccag

SEQ ID NO: 1633548 - RNA, 12 nt, Homo sapiens
ccugcacaggcu

SEQ ID NO: 1633549 - RNA, 16 nt, Homo sapiens
ccugcagaauccagcu

SEQ ID NO: 1633550 - RNA, 20 nt, Homo sapiens
ccugcagccccuaagugcaa

SEQ ID NO: 1633551 - RNA, 17 nt, Homo sapiens
ccugcaggcaggaacaa

SEQ ID NO: 1633552 - RNA, 17 nt, Homo sapiens
ccugccagccacuguca

SEQ ID NO: 1633553 - RNA, 19 nt, Homo sapiens
ccugccccagauuuacuaa

SEQ ID NO: 1633554 - RNA, 16 nt, Homo sapiens
ccugcccugcucugcc

SEQ ID NO: 1633555 - RNA, 17 nt, Homo sapiens
ccugccuugcugugaaa

SEQ ID NO: 1633556 - RNA, 13 nt, Homo sapiens
ccugcgagggcag

SEQ ID NO: 1633557 - RNA, 22 nt, Homo sapiens
ccugcucacaaaaucacuuuaa

SEQ ID NO: 1633558 - RNA, 16 nt, Homo sapiens
ccugcuuugggaagcc

SEQ ID NO: 1633559 - RNA, 20 nt, Homo sapiens
ccuggaaggcagccaggcug

SEQ ID NO: 1633560 - RNA, 18 nt, Homo sapiens
ccuggagacaaggugcua

SEQ ID NO: 1633561 - RNA, 20 nt, Homo sapiens
ccuggagccacagcagccac

SEQ ID NO: 1633562 - RNA, 20 nt, Homo sapiens
ccuggcacccccacaagcug

SEQ ID NO: 1633563 - RNA, 20 nt, Homo sapiens
ccuggccccuccaauccucc

SEQ ID NO: 1633564 - RNA, 16 nt, Homo sapiens
ccuggcucagccucaa

SEQ ID NO: 1633565 - RNA, 16 nt, Homo sapiens
ccuggcuggcugaggg

SEQ ID NO: 1633566 - RNA, 18 nt, Homo sapiens
ccugggaggaaauuugaa

SEQ ID NO: 1633567 - RNA, 21 nt, Homo sapiens
ccugggaggaaauuugaaugg

SEQ ID NO: 1633568 - RNA, 14 nt, Homo sapiens
ccuggggaucacag

SEQ ID NO: 1633569 - RNA, 16 nt, Homo sapiens
ccuggugccaccucag

SEQ ID NO: 1633570 - RNA, 23 nt, Homo sapiens
ccuguccuccaacaccaagcaca

SEQ ID NO: 1633571 - RNA, 13 nt, Homo sapiens
ccugucucaguga

SEQ ID NO: 1633572 - RNA, 18 nt, Homo sapiens
ccugucucucucuucucu

SEQ ID NO: 1633573 - RNA, 18 nt, Homo sapiens
ccugucuguuacacugga

SEQ ID NO: 1633574 - RNA, 17 nt, Homo sapiens
ccugugcgucccagcug

SEQ ID NO: 1633575 - RNA, 19 nt, Homo sapiens
ccuguguggucuccaugcu

SEQ ID NO: 1633576 - RNA, 15 nt, Homo sapiens
ccugugugugcugcc

SEQ ID NO: 1633577 - RNA, 20 nt, Homo sapiens
ccuguguuucauuacuugaa

SEQ ID NO: 1633578 - RNA, 18 nt, Homo sapiens
ccuguuguaacugcccaa

SEQ ID NO: 1633579 - RNA, 14 nt, Homo sapiens
ccuguuuccagggu

SEQ ID NO: 1633580 - RNA, 21 nt, Homo sapiens
ccuuaaagaguguggcaaaau

SEQ ID NO: 1633581 - RNA, 15 nt, Homo sapiens
ccuuaacacauucaa

SEQ ID NO: 1633582 - RNA, 15 nt, Homo sapiens
ccuuaaccugggacc

SEQ ID NO: 1633583 - RNA, 13 nt, Homo sapiens
ccuuaaguauuau

SEQ ID NO: 1633584 - RNA, 13 nt, Homo sapiens
ccuuaguuucaaa

SEQ ID NO: 1633585 - RNA, 15 nt, Homo sapiens
ccuuauuaguuacaa

SEQ ID NO: 1633586 - RNA, 22 nt, Homo sapiens
ccuuauuaguuacaaaguuaua

SEQ ID NO: 1633587 - RNA, 13 nt, Homo sapiens
ccuucaaagccac

SEQ ID NO: 1633588 - RNA, 14 nt, Homo sapiens
ccuucaaagccacu

SEQ ID NO: 1633589 - RNA, 18 nt, Homo sapiens
ccuucaguuuauuuccac

SEQ ID NO: 1633590 - RNA, 21 nt, Homo sapiens
ccuuccaaauaauaaagucua

SEQ ID NO: 1633591 - RNA, 13 nt, Homo sapiens
ccuuccaagcacc

SEQ ID NO: 1633592 - RNA, 20 nt, Homo sapiens
ccuuccaauaguuagaucua

SEQ ID NO: 1633593 - RNA, 13 nt, Homo sapiens
ccuuccucagcag

SEQ ID NO: 1633594 - RNA, 15 nt, Homo sapiens
ccuucgaaaggccuu

SEQ ID NO: 1633595 - RNA, 23 nt, Homo sapiens
ccuucugcucagcucugggccau

SEQ ID NO: 1633596 - RNA, 23 nt, Homo sapiens
ccuucuugguuuccaaaggcauu

SEQ ID NO: 1633597 - RNA, 15 nt, Homo sapiens
ccuugaaacaguucc

SEQ ID NO: 1633598 - RNA, 23 nt, Homo sapiens
ccuugacugaagcgaacaucuuc

SEQ ID NO: 1633599 - RNA, 18 nt, Homo sapiens
ccuugcuuucggagcucc

SEQ ID NO: 1633600 - RNA, 20 nt, Homo sapiens
ccuuggauagauucagcucc

SEQ ID NO: 1633601 - RNA, 11 nt, Homo sapiens
ccuuggcuuua

SEQ ID NO: 1633602 - RNA, 16 nt, Homo sapiens
ccuuggggaggacaaa

SEQ ID NO: 1633603 - RNA, 19 nt, Homo sapiens
ccuuggggaggacaaaacu

SEQ ID NO: 1633604 - RNA, 14 nt, Homo sapiens
ccuuguccccauga

SEQ ID NO: 1633605 - RNA, 14 nt, Homo sapiens
ccuugugucuguac

SEQ ID NO: 1633606 - RNA, 23 nt, Homo sapiens
ccuuguuauuucucagacuuugg

SEQ ID NO: 1633607 - RNA, 21 nt, Homo sapiens
ccuuguuuggggcaggaguag

SEQ ID NO: 1633608 - RNA, 16 nt, Homo sapiens
ccuuuagaaccuuaaa

SEQ ID NO: 1633609 - RNA, 16 nt, Homo sapiens
ccuuuaggccaucuca

SEQ ID NO: 1633610 - RNA, 19 nt, Homo sapiens
ccuuuaggccaucucagcu

SEQ ID NO: 1633611 - RNA, 19 nt, Homo sapiens
ccuuucaagguaacuguac

SEQ ID NO: 1633612 - RNA, 16 nt, Homo sapiens
ccuuucacuuucccaa

SEQ ID NO: 1633613 - RNA, 14 nt, Homo sapiens
ccuuucagucugau

SEQ ID NO: 1633614 - RNA, 16 nt, Homo sapiens
ccuuucccaccauucc

SEQ ID NO: 1633615 - RNA, 20 nt, Homo sapiens
ccuuuccccaccucuuacag

SEQ ID NO: 1633616 - RNA, 21 nt, Homo sapiens
ccuuucucuccagccugacuu

SEQ ID NO: 1633617 - RNA, 14 nt, Homo sapiens
ccuuugaaauuucu

SEQ ID NO: 1633618 - RNA, 14 nt, Homo sapiens
ccuuuguaccauau

SEQ ID NO: 1633619 - RNA, 18 nt, Homo sapiens
ccuuuuaaagaagcuuua

SEQ ID NO: 1633620 - RNA, 16 nt, Homo sapiens
ccuuuuaccugcccaa

SEQ ID NO: 1633621 - RNA, 14 nt, Homo sapiens
ccuuuuuugccaga

SEQ ID NO: 1633622 - RNA, 14 nt, Homo sapiens
cgaaaaccaucaca

SEQ ID NO: 1633623 - RNA, 15 nt, Homo sapiens
cgaagggaucagccc

SEQ ID NO: 1633624 - RNA, 14 nt, Homo sapiens
cgaaguagcuugcu

SEQ ID NO: 1633625 - RNA, 15 nt, Homo sapiens
cgagacaacagcaca

SEQ ID NO: 1633626 - RNA, 14 nt, Homo sapiens
cgagacaccacaag

SEQ ID NO: 1633627 - RNA, 16 nt, Homo sapiens
cgagaggcaauucagu

SEQ ID NO: 1633628 - RNA, 14 nt, Homo sapiens
cgaguaacuccccu

SEQ ID NO: 1633629 - RNA, 20 nt, Homo sapiens
cgauucccaagcucccuucc

SEQ ID NO: 1633630 - RNA, 23 nt, Homo sapiens
cgcacacacccauguaaccacug

SEQ ID NO: 1633631 - RNA, 16 nt, Homo sapiens
cgcaccauugaacugu

SEQ ID NO: 1633632 - RNA, 22 nt, Homo sapiens
cgcauacugagaaucuaggcca

SEQ ID NO: 1633633 - RNA, 16 nt, Homo sapiens
cgccacggccuggcug

SEQ ID NO: 1633634 - RNA, 16 nt, Homo sapiens
cgccccuuccuagguc

SEQ ID NO: 1633635 - RNA, 21 nt, Homo sapiens
auuuucuuacacugugucauu

SEQ ID NO: 1633636 - RNA, 23 nt, Homo sapiens
auuuugaguaaauauuuguuacu

SEQ ID NO: 1633637 - RNA, 20 nt, Homo sapiens
auuuuguccagaagaauuca

SEQ ID NO: 1633638 - RNA, 13 nt, Homo sapiens
auuuuuagccuaa

SEQ ID NO: 1633639 - RNA, 22 nt, Homo sapiens
auuuuucugggaaguccuagcc

SEQ ID NO: 1633640 - RNA, 21 nt, Homo sapiens
auuuuuguuuuuguaaugcac

SEQ ID NO: 1633641 - RNA, 23 nt, Homo sapiens
auuuuuguuuuuguaaugcacug

SEQ ID NO: 1633642 - RNA, 14 nt, Homo sapiens
auuuuuucccccac

SEQ ID NO: 1633643 - RNA, 19 nt, Homo sapiens
caaaaaugauccucagugc

SEQ ID NO: 1633644 - RNA, 22 nt, Homo sapiens
caaaaauuauaacauuuacuuu

SEQ ID NO: 1633645 - RNA, 16 nt, Homo sapiens
caaaaccucaaaccag

SEQ ID NO: 1633646 - RNA, 14 nt, Homo sapiens
caaaaccuguauua

SEQ ID NO: 1633647 - RNA, 19 nt, Homo sapiens
caaaaccuuuaaucugcac

SEQ ID NO: 1633648 - RNA, 13 nt, Homo sapiens
caaaacucaggca

SEQ ID NO: 1633649 - RNA, 16 nt, Homo sapiens
caaaacuucuugucag

SEQ ID NO: 1633650 - RNA, 14 nt, Homo sapiens
caaaagaugucuga

SEQ ID NO: 1633651 - RNA, 17 nt, Homo sapiens
caaaagggccauguuuc

SEQ ID NO: 1633652 - RNA, 13 nt, Homo sapiens
caaaagucaccca

SEQ ID NO: 1633653 - RNA, 13 nt, Homo sapiens
caaaauacuucuu

SEQ ID NO: 1633654 - RNA, 16 nt, Homo sapiens
caaaaucaacaugacu

SEQ ID NO: 1633655 - RNA, 18 nt, Homo sapiens
caaaaucaacaugacugg

SEQ ID NO: 1633656 - RNA, 19 nt, Homo sapiens
caaaaucaacaugacuggu

SEQ ID NO: 1633657 - RNA, 20 nt, Homo sapiens
caaaaugacuguagaacuua

SEQ ID NO: 1633658 - RNA, 13 nt, Homo sapiens
caaacagcaagaa

SEQ ID NO: 1633659 - RNA, 20 nt, Homo sapiens
caaacaugaauccugugaua

SEQ ID NO: 1633660 - RNA, 12 nt, Homo sapiens
caaacaugccag

SEQ ID NO: 1633661 - RNA, 16 nt, Homo sapiens
caaaccccugcagaua

SEQ ID NO: 1633662 - RNA, 17 nt, Homo sapiens
caaacccuggugguauu

SEQ ID NO: 1633663 - RNA, 17 nt, Homo sapiens
caaaccuccaaaagccc

SEQ ID NO: 1633664 - RNA, 14 nt, Homo sapiens
caaaccuucacaca

SEQ ID NO: 1633665 - RNA, 18 nt, Homo sapiens
caaacucaacaagugcuc

SEQ ID NO: 1633666 - RNA, 18 nt, Homo sapiens
caaacucauccucuuuua

SEQ ID NO: 1633667 - RNA, 13 nt, Homo sapiens
caaacugagaucc

SEQ ID NO: 1633668 - RNA, 15 nt, Homo sapiens
caaacuugcuuuaug

SEQ ID NO: 1633669 - RNA, 20 nt, Homo sapiens
caaagaaauuccccaagcac

SEQ ID NO: 1633670 - RNA, 20 nt, Homo sapiens
caaagaagguuaccaagaag

SEQ ID NO: 1633671 - RNA, 14 nt, Homo sapiens
caaagagaaugaga

SEQ ID NO: 1633672 - RNA, 14 nt, Homo sapiens
caaagcacauuggg

SEQ ID NO: 1633673 - RNA, 16 nt, Homo sapiens
caaagggggaggcuaa

SEQ ID NO: 1633674 - RNA, 21 nt, Homo sapiens
caaaguccguguccuaccucc

SEQ ID NO: 1633675 - RNA, 13 nt, Homo sapiens
caaaguugcucac

SEQ ID NO: 1633676 - RNA, 17 nt, Homo sapiens
caaauaaaauaaaugaa

SEQ ID NO: 1633677 - RNA, 14 nt, Homo sapiens
caaauaaaauauca

SEQ ID NO: 1633678 - RNA, 18 nt, Homo sapiens
caaauaaauaagaucaga

SEQ ID NO: 1633679 - RNA, 22 nt, Homo sapiens
caaauaaauaagaucagacucu

SEQ ID NO: 1633680 - RNA, 12 nt, Homo sapiens
caaauacaauca

SEQ ID NO: 1633681 - RNA, 23 nt, Homo sapiens
caaauacaaucagcccagugcaa

SEQ ID NO: 1633682 - RNA, 20 nt, Homo sapiens
caaauaguucugaacauuuu

SEQ ID NO: 1633683 - RNA, 20 nt, Homo sapiens
caaauauauuucaagcuaua

SEQ ID NO: 1633684 - RNA, 21 nt, Homo sapiens
caaauauggggaaaaaacugu

SEQ ID NO: 1633685 - RNA, 12 nt, Homo sapiens
caaauccaagga

SEQ ID NO: 1633686 - RNA, 16 nt, Homo sapiens
caaauccuaugugauu

SEQ ID NO: 1633687 - RNA, 18 nt, Homo sapiens
caaaucuaccacuguaug

SEQ ID NO: 1633688 - RNA, 18 nt, Homo sapiens
caaaucucuugcuuucuu

SEQ ID NO: 1633689 - RNA, 15 nt, Homo sapiens
caaaucuucaguauu

SEQ ID NO: 1633690 - RNA, 16 nt, Homo sapiens
caaauggggacaggaa

SEQ ID NO: 1633691 - RNA, 19 nt, Homo sapiens
caaauuugugguccacuga

SEQ ID NO: 1633692 - RNA, 23 nt, Homo sapiens
caacaauccuucuauucuagccu

SEQ ID NO: 1633693 - RNA, 15 nt, Homo sapiens
caacaauugguaaaa

SEQ ID NO: 1633694 - RNA, 21 nt, Homo sapiens
caacacugucacuagucucac

SEQ ID NO: 1633695 - RNA, 18 nt, Homo sapiens
caacagguaaaacagggc

SEQ ID NO: 1633696 - RNA, 22 nt, Homo sapiens
caacauauacauuuuguugcag

SEQ ID NO: 1633697 - RNA, 15 nt, Homo sapiens
caacaucuuacuugu

SEQ ID NO: 1633698 - RNA, 18 nt, Homo sapiens
caacaugacauccagaga

SEQ ID NO: 1633699 - RNA, 15 nt, Homo sapiens
caaccagugccaagg

SEQ ID NO: 1633700 - RNA, 14 nt, Homo sapiens
caacccgagucauu

SEQ ID NO: 1633701 - RNA, 14 nt, Homo sapiens
caaccugaagacac

SEQ ID NO: 1633702 - RNA, 22 nt, Homo sapiens
caaccugguguuaggugugcaa

SEQ ID NO: 1633703 - RNA, 15 nt, Homo sapiens
caaccuuuuaugugu

SEQ ID NO: 1633704 - RNA, 14 nt, Homo sapiens
caacgaaaagcaca

SEQ ID NO: 1633705 - RNA, 15 nt, Homo sapiens
caacgaaaagcacau

SEQ ID NO: 1633706 - RNA, 18 nt, Homo sapiens
caacuauucucaggccaa

SEQ ID NO: 1633707 - RNA, 22 nt, Homo sapiens
caacucaagugucaccuccuuc

SEQ ID NO: 1633708 - RNA, 22 nt, Homo sapiens
caacucacccccuacacacaca

SEQ ID NO: 1633709 - RNA, 21 nt, Homo sapiens
caacucuccccugaccuguga

SEQ ID NO: 1633710 - RNA, 22 nt, Homo sapiens
caacugucuuagacugcuagcu

SEQ ID NO: 1633711 - RNA, 16 nt, Homo sapiens
caacuuccgcugaggg

SEQ ID NO: 1633712 - RNA, 13 nt, Homo sapiens
caagaaaauauca

SEQ ID NO: 1633713 - RNA, 12 nt, Homo sapiens
caagaaauggau

SEQ ID NO: 1633714 - RNA, 13 nt, Homo sapiens
caagaaugugcag

SEQ ID NO: 1633715 - RNA, 20 nt, Homo sapiens
caagagcaucaugccucuga

SEQ ID NO: 1633716 - RNA, 23 nt, Homo sapiens
caagagucaacaggucacuugau

SEQ ID NO: 1633717 - RNA, 13 nt, Homo sapiens
caagcaacacaga

SEQ ID NO: 1633718 - RNA, 21 nt, Homo sapiens
caagcaccacgcccuccaggg

SEQ ID NO: 1633719 - RNA, 12 nt, Homo sapiens
caagcaccugca

SEQ ID NO: 1633720 - RNA, 12 nt, Homo sapiens
caagcauuucau

SEQ ID NO: 1633721 - RNA, 22 nt, Homo sapiens
caagccagcuuacuagcacuuu

SEQ ID NO: 1633722 - RNA, 13 nt, Homo sapiens
caagcccugccca

SEQ ID NO: 1633723 - RNA, 20 nt, Homo sapiens
caagcucuucccuugcucau

SEQ ID NO: 1633724 - RNA, 18 nt, Homo sapiens
uguucuaauggcacuuau

SEQ ID NO: 1633725 - RNA, 18 nt, Homo sapiens
uguucucugcuugacaga

SEQ ID NO: 1633726 - RNA, 20 nt, Homo sapiens
uguugcaaugcaugauacua

SEQ ID NO: 1633727 - RNA, 21 nt, Homo sapiens
uguugcaugggcuaaugaaga

SEQ ID NO: 1633728 - RNA, 23 nt, Homo sapiens
uguugcuauagagccuaccugua

SEQ ID NO: 1633729 - RNA, 16 nt, Homo sapiens
uguugcuuaucauuug

SEQ ID NO: 1633730 - RNA, 21 nt, Homo sapiens
uguuguguuuuuaacauguca

SEQ ID NO: 1633731 - RNA, 13 nt, Homo sapiens
uguuguugccaaa

SEQ ID NO: 1633732 - RNA, 18 nt, Homo sapiens
uguuuacagacgugugca

SEQ ID NO: 1633733 - RNA, 12 nt, Homo sapiens
uguuuacaugag

SEQ ID NO: 1633734 - RNA, 17 nt, Homo sapiens
uguuuacaugaguucaa

SEQ ID NO: 1633735 - RNA, 23 nt, Homo sapiens
uguuuauuccaaaugccauccag

SEQ ID NO: 1633736 - RNA, 16 nt, Homo sapiens
uguuucaaauggacug

SEQ ID NO: 1633737 - RNA, 15 nt, Homo sapiens
uguuucacauugcac

SEQ ID NO: 1633738 - RNA, 16 nt, Homo sapiens
uguuucuucucuacac

SEQ ID NO: 1633739 - RNA, 12 nt, Homo sapiens
uguuucuuuaua

SEQ ID NO: 1633740 - RNA, 12 nt, Homo sapiens
uguuugacaaaa

SEQ ID NO: 1633741 - RNA, 17 nt, Homo sapiens
uguuugacgggaaacaa

SEQ ID NO: 1633742 - RNA, 18 nt, Homo sapiens
uguuugcacuuggcaaaa

SEQ ID NO: 1633743 - RNA, 23 nt, Homo sapiens
uguuuuaauccuuaacacauuca

SEQ ID NO: 1633744 - RNA, 12 nt, Homo sapiens
uguuuuagccau

SEQ ID NO: 1633745 - RNA, 16 nt, Homo sapiens
uguuuuagucauuaau

SEQ ID NO: 1633746 - RNA, 14 nt, Homo sapiens
uguuuugaaaaccu

SEQ ID NO: 1633747 - RNA, 16 nt, Homo sapiens
uguuuugugguaucau

SEQ ID NO: 1633748 - RNA, 14 nt, Homo sapiens
uuaaaaucaguauu

SEQ ID NO: 1633749 - RNA, 16 nt, Homo sapiens
uuaaaaucaugauccu

SEQ ID NO: 1633750 - RNA, 15 nt, Homo sapiens
uuaaaaugacaaaca

SEQ ID NO: 1633751 - RNA, 14 nt, Homo sapiens
uuaaacuuacuuag

SEQ ID NO: 1633752 - RNA, 21 nt, Homo sapiens
uuaaagcaaacuaugauuuau

SEQ ID NO: 1633753 - RNA, 22 nt, Homo sapiens
uuaaauaaguaaaagcuacuau

SEQ ID NO: 1633754 - RNA, 18 nt, Homo sapiens
uuaaauaccaguacuuga

SEQ ID NO: 1633755 - RNA, 21 nt, Homo sapiens
uuaaauauuguaauaugacag

SEQ ID NO: 1633756 - RNA, 16 nt, Homo sapiens
uuaaaucaaaagggag

SEQ ID NO: 1633757 - RNA, 16 nt, Homo sapiens
uuaaauccuaccaaag

SEQ ID NO: 1633758 - RNA, 17 nt, Homo sapiens
uuaaauuacaauuuuau

SEQ ID NO: 1633759 - RNA, 20 nt, Homo sapiens
uuaaauuccacagauuauca

SEQ ID NO: 1633760 - RNA, 16 nt, Homo sapiens
uuaaauucucuuucac

SEQ ID NO: 1633761 - RNA, 13 nt, Homo sapiens
uuaacacauucaa

SEQ ID NO: 1633762 - RNA, 21 nt, Homo sapiens
uuaacagaugcaaugugcuac

SEQ ID NO: 1633763 - RNA, 14 nt, Homo sapiens
uuaacauuuugagc

SEQ ID NO: 1633764 - RNA, 14 nt, Homo sapiens
uuaacggugcuaaa

SEQ ID NO: 1633765 - RNA, 14 nt, Homo sapiens
uuaaggcagcucau

SEQ ID NO: 1633766 - RNA, 13 nt, Homo sapiens
uuaauaaauugcu

SEQ ID NO: 1633767 - RNA, 18 nt, Homo sapiens
uuaauagggaauauaucu

SEQ ID NO: 1633768 - RNA, 22 nt, Homo sapiens
uuaauauaguaacacacuucca

SEQ ID NO: 1633769 - RNA, 13 nt, Homo sapiens
uuaauuacuacua

SEQ ID NO: 1633770 - RNA, 13 nt, Homo sapiens
uuaauuucaggaa

SEQ ID NO: 1633771 - RNA, 16 nt, Homo sapiens
uuacagacugaaaggu

SEQ ID NO: 1633772 - RNA, 20 nt, Homo sapiens
uuacagagauacuguugucc

SEQ ID NO: 1633773 - RNA, 17 nt, Homo sapiens
uuacagaggacccuuac

SEQ ID NO: 1633774 - RNA, 23 nt, Homo sapiens
uuacauagaugauaaaagagaag

SEQ ID NO: 1633775 - RNA, 15 nt, Homo sapiens
uuacauccucugaua

SEQ ID NO: 1633776 - RNA, 23 nt, Homo sapiens
uuacccccaguccucccuagcuc

SEQ ID NO: 1633777 - RNA, 17 nt, Homo sapiens
uuacgacccaggacaau

SEQ ID NO: 1633778 - RNA, 15 nt, Homo sapiens
uuacuccagugccaa

SEQ ID NO: 1633779 - RNA, 13 nt, Homo sapiens
uuacugacuccuc

SEQ ID NO: 1633780 - RNA, 17 nt, Homo sapiens
uuacuuuuuuacacuga

SEQ ID NO: 1633781 - RNA, 17 nt, Homo sapiens
uuagaaaauucagcucc

SEQ ID NO: 1633782 - RNA, 13 nt, Homo sapiens
uuagaaaugcaaa

SEQ ID NO: 1633783 - RNA, 21 nt, Homo sapiens
uuagagccagccacacuugaa

SEQ ID NO: 1633784 - RNA, 16 nt, Homo sapiens
uuagaguguagcugua

SEQ ID NO: 1633785 - RNA, 21 nt, Homo sapiens
uuagauaaucaagggcacugu

SEQ ID NO: 1633786 - RNA, 21 nt, Homo sapiens
uuagauuaaauaaaacuuaaa

SEQ ID NO: 1633787 - RNA, 12 nt, Homo sapiens
uuagcagacagg

SEQ ID NO: 1633788 - RNA, 16 nt, Homo sapiens
uuagccauaaauugcu

SEQ ID NO: 1633789 - RNA, 23 nt, Homo sapiens
uuagccauaauuuugcauacuga

SEQ ID NO: 1633790 - RNA, 21 nt, Homo sapiens
uuagcuccaaaccuucacaca

SEQ ID NO: 1633791 - RNA, 16 nt, Homo sapiens
uuagggacacuuucac

SEQ ID NO: 1633792 - RNA, 17 nt, Homo sapiens
uuagggcagauuuuggu

SEQ ID NO: 1633793 - RNA, 13 nt, Homo sapiens
uuaggguauuuag

SEQ ID NO: 1633794 - RNA, 16 nt, Homo sapiens
uuaguagagacagggu

SEQ ID NO: 1633795 - RNA, 21 nt, Homo sapiens
uuaguauuaauacuacccaua

SEQ ID NO: 1633796 - RNA, 15 nt, Homo sapiens
uuaguuacaaaguua

SEQ ID NO: 1633797 - RNA, 22 nt, Homo sapiens
uuauaaaugauaucaaagaaga

SEQ ID NO: 1633798 - RNA, 14 nt, Homo sapiens
uuauaauacuguuu

SEQ ID NO: 1633799 - RNA, 19 nt, Homo sapiens
uuauacaauaacccaguua

SEQ ID NO: 1633800 - RNA, 18 nt, Homo sapiens
uuauagcaacaacaauug

SEQ ID NO: 1633801 - RNA, 22 nt, Homo sapiens
uuauagcaacaacaauugguaa

SEQ ID NO: 1633802 - RNA, 13 nt, Homo sapiens
uuauaucaugcaa

SEQ ID NO: 1633803 - RNA, 17 nt, Homo sapiens
uuauauucagaguaugu

SEQ ID NO: 1633804 - RNA, 14 nt, Homo sapiens
uuaucaagccauaa

SEQ ID NO: 1633805 - RNA, 18 nt, Homo sapiens
uuaucacuucauucacau

SEQ ID NO: 1633806 - RNA, 16 nt, Homo sapiens
uuaucuaucaacuaua

SEQ ID NO: 1633807 - RNA, 21 nt, Homo sapiens
uuaugaaaauauagacauucu

SEQ ID NO: 1633808 - RNA, 21 nt, Homo sapiens
uuaugaugaaaaccuacauau

SEQ ID NO: 1633809 - RNA, 22 nt, Homo sapiens
uuaugaugaaaaccuacauauu

SEQ ID NO: 1633810 - RNA, 16 nt, Homo sapiens
uuaugcaaauacaauc

SEQ ID NO: 1633811 - RNA, 18 nt, Homo sapiens
uuaugcaaauacaaucag

SEQ ID NO: 1633812 - RNA, 14 nt, Homo sapiens
uuauguacaggaug

SEQ ID NO: 1633813 - RNA, 17 nt, Homo sapiens
uuauguuaaaaagaaau

SEQ ID NO: 1633814 - RNA, 16 nt, Homo sapiens
uuauuaaacguaugca

SEQ ID NO: 1633815 - RNA, 23 nt, Homo sapiens
uuauuaaucauacaaacucucac

SEQ ID NO: 1633816 - RNA, 16 nt, Homo sapiens
uuauugacucauacac

SEQ ID NO: 1633817 - RNA, 13 nt, Homo sapiens
uuauuucugcucu

SEQ ID NO: 1633818 - RNA, 18 nt, Homo sapiens
uucaaagcugcuugcugu

SEQ ID NO: 1633819 - RNA, 12 nt, Homo sapiens
cucacuuuggaa

SEQ ID NO: 1633820 - RNA, 12 nt, Homo sapiens
cucagaccucca

SEQ ID NO: 1633821 - RNA, 16 nt, Homo sapiens
cucagccacugaagua

SEQ ID NO: 1633822 - RNA, 14 nt, Homo sapiens
cucagccagcacuu

SEQ ID NO: 1633823 - RNA, 23 nt, Homo sapiens
cucagccuacuuucacacuaaga

SEQ ID NO: 1633824 - RNA, 20 nt, Homo sapiens
cucagccucccgaguagcug

SEQ ID NO: 1633825 - RNA, 15 nt, Homo sapiens
cucagcugguccuga

SEQ ID NO: 1633826 - RNA, 17 nt, Homo sapiens
cucagggccucaggcac

SEQ ID NO: 1633827 - RNA, 16 nt, Homo sapiens
cucaggugaucugccc

SEQ ID NO: 1633828 - RNA, 13 nt, Homo sapiens
cucauacacagaa

SEQ ID NO: 1633829 - RNA, 14 nt, Homo sapiens
cucauacacagaaa

SEQ ID NO: 1633830 - RNA, 21 nt, Homo sapiens
cucaucuguggagcugccaca

SEQ ID NO: 1633831 - RNA, 14 nt, Homo sapiens
cucauuacugugag

SEQ ID NO: 1633832 - RNA, 15 nt, Homo sapiens
cucauugugucuccc

SEQ ID NO: 1633833 - RNA, 18 nt, Homo sapiens
cuccaagcucacgaccuu

SEQ ID NO: 1633834 - RNA, 20 nt, Homo sapiens
cuccacaaaugggaaaacca

SEQ ID NO: 1633835 - RNA, 16 nt, Homo sapiens
cuccacaggcacaggu

SEQ ID NO: 1633836 - RNA, 19 nt, Homo sapiens
cuccaccacugugcacuua

SEQ ID NO: 1633837 - RNA, 12 nt, Homo sapiens
cuccagccagag

SEQ ID NO: 1633838 - RNA, 20 nt, Homo sapiens
cuccagcccagacccagugg

SEQ ID NO: 1633839 - RNA, 15 nt, Homo sapiens
cuccaggcugagggc

SEQ ID NO: 1633840 - RNA, 12 nt, Homo sapiens
cucccacagaac

SEQ ID NO: 1633841 - RNA, 15 nt, Homo sapiens
cucccagggccauga

SEQ ID NO: 1633842 - RNA, 19 nt, Homo sapiens
cuccccacacagacuccac

SEQ ID NO: 1633843 - RNA, 15 nt, Homo sapiens
cucccccaacacaaa

SEQ ID NO: 1633844 - RNA, 15 nt, Homo sapiens
cuccccuacuucuca

SEQ ID NO: 1633845 - RNA, 18 nt, Homo sapiens
cuccccuuaaaggggaga

SEQ ID NO: 1633846 - RNA, 12 nt, Homo sapiens
cuccgaggcucc

SEQ ID NO: 1633847 - RNA, 19 nt, Homo sapiens
cuccgaggugguucagaca

SEQ ID NO: 1633848 - RNA, 20 nt, Homo sapiens
cuccuacaggugcuguucag

SEQ ID NO: 1633849 - RNA, 15 nt, Homo sapiens
cuccuccauucccua

SEQ ID NO: 1633850 - RNA, 19 nt, Homo sapiens
cuccucccucugacucuaa

SEQ ID NO: 1633851 - RNA, 17 nt, Homo sapiens
cuccucguaugcaugga

SEQ ID NO: 1633852 - RNA, 22 nt, Homo sapiens
cuccugaguagcugggacuaca

SEQ ID NO: 1633853 - RNA, 20 nt, Homo sapiens
cuccugaguagcugggauua

SEQ ID NO: 1633854 - RNA, 12 nt, Homo sapiens
cuccugccuuag

SEQ ID NO: 1633855 - RNA, 13 nt, Homo sapiens
cuccuucgcuuaa

SEQ ID NO: 1633856 - RNA, 13 nt, Homo sapiens
cuccuuggcuuua

SEQ ID NO: 1633857 - RNA, 19 nt, Homo sapiens
cuccuuggcuuuaugcaaa

SEQ ID NO: 1633858 - RNA, 14 nt, Homo sapiens
cuccuuggugccug

SEQ ID NO: 1633859 - RNA, 14 nt, Homo sapiens
cuccuuucacuuuc

SEQ ID NO: 1633860 - RNA, 17 nt, Homo sapiens
cucgaaaaccaucacau

SEQ ID NO: 1633861 - RNA, 15 nt, Homo sapiens
cucgacccacgcaga

SEQ ID NO: 1633862 - RNA, 23 nt, Homo sapiens
cucgaggagguaaugaauuaaag

SEQ ID NO: 1633863 - RNA, 14 nt, Homo sapiens
cucgccccaaaguu

SEQ ID NO: 1633864 - RNA, 16 nt, Homo sapiens
cucgcucuguuaccca

SEQ ID NO: 1633865 - RNA, 17 nt, Homo sapiens
cucggcucagugcaacc

SEQ ID NO: 1633866 - RNA, 14 nt, Homo sapiens
cucggggugggggu

SEQ ID NO: 1633867 - RNA, 17 nt, Homo sapiens
cucuaagaauucucucu

SEQ ID NO: 1633868 - RNA, 22 nt, Homo sapiens
cucuagauggcaacauuggaca

SEQ ID NO: 1633869 - RNA, 15 nt, Homo sapiens
cucuagccccagcgc

SEQ ID NO: 1633870 - RNA, 22 nt, Homo sapiens
cucuagccugggugacagagcg

SEQ ID NO: 1633871 - RNA, 15 nt, Homo sapiens
cucuauuugagaaua

SEQ ID NO: 1633872 - RNA, 23 nt, Homo sapiens
cucucaccuguacuauugcagac

SEQ ID NO: 1633873 - RNA, 22 nt, Homo sapiens
cucuccccauccccacccaguc

SEQ ID NO: 1633874 - RNA, 20 nt, Homo sapiens
cucucgccucauuacuguga

SEQ ID NO: 1633875 - RNA, 14 nt, Homo sapiens
cucucuggacacuu

SEQ ID NO: 1633876 - RNA, 16 nt, Homo sapiens
cucucuuccaaguccu

SEQ ID NO: 1633877 - RNA, 14 nt, Homo sapiens
cucucuuuaacccu

SEQ ID NO: 1633878 - RNA, 23 nt, Homo sapiens
cucugacgaguacucuugaacac

SEQ ID NO: 1633879 - RNA, 18 nt, Homo sapiens
cucugacuuaagcugccu

SEQ ID NO: 1633880 - RNA, 14 nt, Homo sapiens
cucugcacagacaa

SEQ ID NO: 1633881 - RNA, 12 nt, Homo sapiens
cucugcacaugu

SEQ ID NO: 1633882 - RNA, 13 nt, Homo sapiens
cucugcacauguc

SEQ ID NO: 1633883 - RNA, 20 nt, Homo sapiens
cucugcacaugucuuguaca

SEQ ID NO: 1633884 - RNA, 17 nt, Homo sapiens
cucugccccaggcccua

SEQ ID NO: 1633885 - RNA, 21 nt, Homo sapiens
cucugccccaggcccuacuac

SEQ ID NO: 1633886 - RNA, 16 nt, Homo sapiens
cucuggaucacagaca

SEQ ID NO: 1633887 - RNA, 21 nt, Homo sapiens
cucuggaucacagacacugca

SEQ ID NO: 1633888 - RNA, 21 nt, Homo sapiens
cucuggggucuuuuuaugcau

SEQ ID NO: 1633889 - RNA, 15 nt, Homo sapiens
cucuucccuugcuca

SEQ ID NO: 1633890 - RNA, 13 nt, Homo sapiens
cucuugaacacaa

SEQ ID NO: 1633891 - RNA, 19 nt, Homo sapiens
cucuugaaguacuuaacau

SEQ ID NO: 1633892 - RNA, 14 nt, Homo sapiens
cucuugucaaaagg

SEQ ID NO: 1633893 - RNA, 19 nt, Homo sapiens
cucuuuaagggaguguacu

SEQ ID NO: 1633894 - RNA, 19 nt, Homo sapiens
cucuuuuugggugauuaaa

SEQ ID NO: 1633895 - RNA, 23 nt, Homo sapiens
cugaaagcuuuauacaguugaau

SEQ ID NO: 1633896 - RNA, 18 nt, Homo sapiens
cugaaccauguggauaac

SEQ ID NO: 1633897 - RNA, 21 nt, Homo sapiens
cugaacuggcugaaguucaag

SEQ ID NO: 1633898 - RNA, 17 nt, Homo sapiens
cugaagugaacuaugaa

SEQ ID NO: 1633899 - RNA, 17 nt, Homo sapiens
cugaagugguugcauuc

SEQ ID NO: 1633900 - RNA, 19 nt, Homo sapiens
cugaauuggcuaugcagua

SEQ ID NO: 1633901 - RNA, 23 nt, Homo sapiens
cugacaguuaauaaaccuuugca

SEQ ID NO: 1633902 - RNA, 19 nt, Homo sapiens
cugaccacagcacagccaa

SEQ ID NO: 1633903 - RNA, 13 nt, Homo sapiens
cugaccccagugu

SEQ ID NO: 1633904 - RNA, 13 nt, Homo sapiens
cugaccucaggug

SEQ ID NO: 1633905 - RNA, 17 nt, Homo sapiens
cugaccucgugauccac

SEQ ID NO: 1633906 - RNA, 22 nt, Homo sapiens
cugacuaauuuuguaguuuuag

SEQ ID NO: 1633907 - RNA, 19 nt, Homo sapiens
cugacucuaagaauucucu

SEQ ID NO: 1633908 - RNA, 20 nt, Homo sapiens
cugacugaagugaacuauga

SEQ ID NO: 1633909 - RNA, 20 nt, Homo sapiens
cugacuggauucauucucau

SEQ ID NO: 1633910 - RNA, 19 nt, Homo sapiens
cugacuucacuaggcauug

SEQ ID NO: 1633911 - RNA, 20 nt, Homo sapiens
cugacuugguucugaagcca

SEQ ID NO: 1633912 - RNA, 23 nt, Homo sapiens
cugagaaaaaaagugagagaccu

SEQ ID NO: 1633913 - RNA, 16 nt, Homo sapiens
cugagaaauggccaaa

SEQ ID NO: 1633914 - RNA, 17 nt, Homo sapiens
cugagagaauuggcuca

SEQ ID NO: 1633915 - RNA, 15 nt, Homo sapiens
cugagagacagaauu

SEQ ID NO: 1633916 - RNA, 15 nt, Homo sapiens
cugaggccacacuca

SEQ ID NO: 1633917 - RNA, 20 nt, Homo sapiens
cugaggccacacucagcaca

SEQ ID NO: 1633918 - RNA, 17 nt, Homo sapiens
cugaggcccccaucucc

SEQ ID NO: 1633919 - RNA, 15 nt, Homo sapiens
cugagguccugagca

SEQ ID NO: 1633920 - RNA, 19 nt, Homo sapiens
cugaguagcugggacuaca

SEQ ID NO: 1633921 - RNA, 23 nt, Homo sapiens
uggggugggaguuuugcucucug

SEQ ID NO: 1633922 - RNA, 14 nt, Homo sapiens
uggguaggccccac

SEQ ID NO: 1633923 - RNA, 15 nt, Homo sapiens
uggguccaugcuaac

SEQ ID NO: 1633924 - RNA, 19 nt, Homo sapiens
ugggucuaccacucagaga

SEQ ID NO: 1633925 - RNA, 10 nt, Homo sapiens
ugggugcugc

SEQ ID NO: 1633926 - RNA, 23 nt, Homo sapiens
uggguguagccagguauggcucu

SEQ ID NO: 1633927 - RNA, 19 nt, Homo sapiens
ugggugucauuucauucca

SEQ ID NO: 1633928 - RNA, 14 nt, Homo sapiens
uggguuuggcaaaa

SEQ ID NO: 1633929 - RNA, 16 nt, Homo sapiens
ugguacuauugugacc

SEQ ID NO: 1633930 - RNA, 15 nt, Homo sapiens
ugguacuuaagcucc

SEQ ID NO: 1633931 - RNA, 16 nt, Homo sapiens
ugguaggugugacaug

SEQ ID NO: 1633932 - RNA, 24 nt, Homo sapiens
ugguauccuacugagcauuugcac

SEQ ID NO: 1633933 - RNA, 18 nt, Homo sapiens
ugguauuuucaaccauaa

SEQ ID NO: 1633934 - RNA, 21 nt, Homo sapiens
uggucagcugccccaauguga

SEQ ID NO: 1633935 - RNA, 20 nt, Homo sapiens
uggucuaagguucagccuga

SEQ ID NO: 1633936 - RNA, 22 nt, Homo sapiens
uggucuaagguucagccugaaa

SEQ ID NO: 1633937 - RNA, 15 nt, Homo sapiens
uggucuccaugcuca

SEQ ID NO: 1633938 - RNA, 17 nt, Homo sapiens
uggucuugaucuccuga

SEQ ID NO: 1633939 - RNA, 12 nt, Homo sapiens
uggugcagacag

SEQ ID NO: 1633940 - RNA, 20 nt, Homo sapiens
uggugcgcccugucucugug

SEQ ID NO: 1633941 - RNA, 21 nt, Homo sapiens
ugguguucaccaaaaccaaac

SEQ ID NO: 1633942 - RNA, 19 nt, Homo sapiens
ugguuaaacagcagcacuu

SEQ ID NO: 1633943 - RNA, 18 nt, Homo sapiens
ugguucagacaagacaga

SEQ ID NO: 1633944 - RNA, 14 nt, Homo sapiens
ugguuuaaagucac

SEQ ID NO: 1633945 - RNA, 16 nt, Homo sapiens
ugguuucucucuacag

SEQ ID NO: 1633946 - RNA, 21 nt, Homo sapiens
ugguuugccugaggcuguaac

SEQ ID NO: 1633947 - RNA, 22 nt, Homo sapiens
ugguuuuuuuuugauccucuga

SEQ ID NO: 1633948 - RNA, 15 nt, Homo sapiens
uguaaacaaaccaca

SEQ ID NO: 1633949 - RNA, 18 nt, Homo sapiens
uguaaacaaaccacagca

SEQ ID NO: 1633950 - RNA, 21 nt, Homo sapiens
uguaaauaguuacuccagugc

SEQ ID NO: 1633951 - RNA, 14 nt, Homo sapiens
uguaaccacugcac

SEQ ID NO: 1633952 - RNA, 17 nt, Homo sapiens
uguaacugugugagauu

SEQ ID NO: 1633953 - RNA, 22 nt, Homo sapiens
uguaagcaggagagaaauuucu

SEQ ID NO: 1633954 - RNA, 19 nt, Homo sapiens
uguaauauuucuucaaaua

SEQ ID NO: 1633955 - RNA, 19 nt, Homo sapiens
uguaauccuagcuacuugg

SEQ ID NO: 1633956 - RNA, 17 nt, Homo sapiens
uguacaaaacaguuuga

SEQ ID NO: 1633957 - RNA, 21 nt, Homo sapiens
uguacaaguauuacaaccaua

SEQ ID NO: 1633958 - RNA, 15 nt, Homo sapiens
uguacacagaauugu

SEQ ID NO: 1633959 - RNA, 18 nt, Homo sapiens
uguacauuaugaagaaua

SEQ ID NO: 1633960 - RNA, 17 nt, Homo sapiens
uguacuaauacagggag

SEQ ID NO: 1633961 - RNA, 19 nt, Homo sapiens
uguacugccuuaaauguac

SEQ ID NO: 1633962 - RNA, 15 nt, Homo sapiens
uguagcuucucuugc

SEQ ID NO: 1633963 - RNA, 22 nt, Homo sapiens
uguagcuucucuugcucucgac

SEQ ID NO: 1633964 - RNA, 16 nt, Homo sapiens
uguagcuucuucugaa

SEQ ID NO: 1633965 - RNA, 18 nt, Homo sapiens
uguauaagucaagcucca

SEQ ID NO: 1633966 - RNA, 15 nt, Homo sapiens
uguaucuacaguaau

SEQ ID NO: 1633967 - RNA, 20 nt, Homo sapiens
uguauuauaugcagaauuac

SEQ ID NO: 1633968 - RNA, 14 nt, Homo sapiens
uguauuuguuccca

SEQ ID NO: 1633969 - RNA, 22 nt, Homo sapiens
uguauuuucuuacacuguguca

SEQ ID NO: 1633970 - RNA, 16 nt, Homo sapiens
uguauuuugacacugg

SEQ ID NO: 1633971 - RNA, 14 nt, Homo sapiens
ugucaaugugauuu

SEQ ID NO: 1633972 - RNA, 22 nt, Homo sapiens
ugucacccugcaggacuugcca

SEQ ID NO: 1633973 - RNA, 15 nt, Homo sapiens
ugucacuagucucac

SEQ ID NO: 1633974 - RNA, 17 nt, Homo sapiens
ugucacuagucucacca

SEQ ID NO: 1633975 - RNA, 12 nt, Homo sapiens
ugucagacauaa

SEQ ID NO: 1633976 - RNA, 16 nt, Homo sapiens
ugucaggcuacaaggu

SEQ ID NO: 1633977 - RNA, 23 nt, Homo sapiens
ugucaggugugauaaaauguuga

SEQ ID NO: 1633978 - RNA, 23 nt, Homo sapiens
ugucaguauuauucuacuauacu

SEQ ID NO: 1633979 - RNA, 21 nt, Homo sapiens
ugucaguuccaaacagacaaa

SEQ ID NO: 1633980 - RNA, 12 nt, Homo sapiens
ugucaguucucu

SEQ ID NO: 1633981 - RNA, 21 nt, Homo sapiens
ugucauucuguuagauacuaa

SEQ ID NO: 1633982 - RNA, 13 nt, Homo sapiens
ugucauuguauuc

SEQ ID NO: 1633983 - RNA, 16 nt, Homo sapiens
ugucauuucauuccau

SEQ ID NO: 1633984 - RNA, 18 nt, Homo sapiens
ugucccaaacaugcacuu

SEQ ID NO: 1633985 - RNA, 17 nt, Homo sapiens
ugucccaaccccagugg

SEQ ID NO: 1633986 - RNA, 17 nt, Homo sapiens
ugucccacuaucugggu

SEQ ID NO: 1633987 - RNA, 17 nt, Homo sapiens
uguccccacugccccac

SEQ ID NO: 1633988 - RNA, 15 nt, Homo sapiens
ugucccuucccagcg

SEQ ID NO: 1633989 - RNA, 14 nt, Homo sapiens
uguccuguccugcu

SEQ ID NO: 1633990 - RNA, 17 nt, Homo sapiens
ugucggcuuuuugccau

SEQ ID NO: 1633991 - RNA, 15 nt, Homo sapiens
ugucuaucauaugaa

SEQ ID NO: 1633992 - RNA, 22 nt, Homo sapiens
ugucucaaaccuccaaaagccc

SEQ ID NO: 1633993 - RNA, 15 nt, Homo sapiens
ugucucagaagugaa

SEQ ID NO: 1633994 - RNA, 18 nt, Homo sapiens
ugucuccuuucucuuaug

SEQ ID NO: 1633995 - RNA, 19 nt, Homo sapiens
ugucucuuugugcucuaaa

SEQ ID NO: 1633996 - RNA, 16 nt, Homo sapiens
ugucugcuuucuccau

SEQ ID NO: 1633997 - RNA, 20 nt, Homo sapiens
ugucuguccugauuucuaca

SEQ ID NO: 1633998 - RNA, 22 nt, Homo sapiens
ugucuuaaugguauccuacuga

SEQ ID NO: 1633999 - RNA, 13 nt, Homo sapiens
ugucuucaccuga

SEQ ID NO: 1634000 - RNA, 18 nt, Homo sapiens
ugucuuuguggugaugau

SEQ ID NO: 1634001 - RNA, 16 nt, Homo sapiens
ugugaagcaaggagcu

SEQ ID NO: 1634002 - RNA, 20 nt, Homo sapiens
ugugaaguugcccaccaaaa

SEQ ID NO: 1634003 - RNA, 17 nt, Homo sapiens
ugugaauaauggcacug

SEQ ID NO: 1634004 - RNA, 19 nt, Homo sapiens
ugugaauaauggcacugac

SEQ ID NO: 1634005 - RNA, 13 nt, Homo sapiens
ugugacacauaug

SEQ ID NO: 1634006 - RNA, 13 nt, Homo sapiens
ugugagaagauca

SEQ ID NO: 1634007 - RNA, 15 nt, Homo sapiens
ugugcagaaaggcag

SEQ ID NO: 1634008 - RNA, 14 nt, Homo sapiens
ugugccaauacaga

SEQ ID NO: 1634009 - RNA, 23 nt, Homo sapiens
ugugccugucuguuacacuggag

SEQ ID NO: 1634010 - RNA, 14 nt, Homo sapiens
ugugggacugagug

SEQ ID NO: 1634011 - RNA, 20 nt, Homo sapiens
ugugguccacugagcuauaa

SEQ ID NO: 1634012 - RNA, 12 nt, Homo sapiens
uguggucucagg

SEQ ID NO: 1634013 - RNA, 13 nt, Homo sapiens
uguggucucagga

SEQ ID NO: 1634014 - RNA, 18 nt, Homo sapiens
ugugguggccucagcuga

SEQ ID NO: 1634015 - RNA, 21 nt, Homo sapiens
uguguacaguugguucauccc

SEQ ID NO: 1634016 - RNA, 14 nt, Homo sapiens
uguguacugccuua

SEQ ID NO: 1634017 - RNA, 14 nt, Homo sapiens
uguguauacauaca

SEQ ID NO: 1634018 - RNA, 16 nt, Homo sapiens
ugccuuuguaccauau

SEQ ID NO: 1634019 - RNA, 20 nt, Homo sapiens
ugcgaucucggcucagugca

SEQ ID NO: 1634020 - RNA, 19 nt, Homo sapiens
ugcggaggaaagcaagugu

SEQ ID NO: 1634021 - RNA, 15 nt, Homo sapiens
ugcggauacuuugcu

SEQ ID NO: 1634022 - RNA, 20 nt, Homo sapiens
ugcuacuaagauacuccaua

SEQ ID NO: 1634023 - RNA, 22 nt, Homo sapiens
ugcuacuuuuuuuuaguucaau

SEQ ID NO: 1634024 - RNA, 14 nt, Homo sapiens
ugcuauacagucua

SEQ ID NO: 1634025 - RNA, 19 nt, Homo sapiens
ugcuauagagccuaccugu

SEQ ID NO: 1634026 - RNA, 13 nt, Homo sapiens
ugcuaucagaaau

SEQ ID NO: 1634027 - RNA, 15 nt, Homo sapiens
ugcuaugaugauggu

SEQ ID NO: 1634028 - RNA, 11 nt, Homo sapiens
ugauacauuuu

SEQ ID NO: 1634029 - RNA, 18 nt, Homo sapiens
ugauacugcugcuuguca

SEQ ID NO: 1634030 - RNA, 12 nt, Homo sapiens
ugauagaagauu

SEQ ID NO: 1634031 - RNA, 14 nt, Homo sapiens
ugauauauauaugc

SEQ ID NO: 1634032 - RNA, 23 nt, Homo sapiens
ugauauauuagggacacuuucac

SEQ ID NO: 1634033 - RNA, 14 nt, Homo sapiens
ugaucggaaagcuc

SEQ ID NO: 1634034 - RNA, 16 nt, Homo sapiens
ugaucuagauacagga

SEQ ID NO: 1634035 - RNA, 22 nt, Homo sapiens
ugaucucgaacuccuaaccuca

SEQ ID NO: 1634036 - RNA, 18 nt, Homo sapiens
ggacauuuuuucagucau

SEQ ID NO: 1634037 - RNA, 14 nt, Homo sapiens
ggaccaccaaugga

SEQ ID NO: 1634038 - RNA, 16 nt, Homo sapiens
ggaccaccaauggauu

SEQ ID NO: 1634039 - RNA, 10 nt, Homo sapiens
ggaccaccuc

SEQ ID NO: 1634040 - RNA, 14 nt, Homo sapiens
ggacccuguccaau

SEQ ID NO: 1634041 - RNA, 15 nt, Homo sapiens
ggaccgcuacaccac

SEQ ID NO: 1634042 - RNA, 22 nt, Homo sapiens
ggaccuaaaaaggucuguuaau

SEQ ID NO: 1634043 - RNA, 15 nt, Homo sapiens
ggacuaacaaagaca

SEQ ID NO: 1634044 - RNA, 16 nt, Homo sapiens
ggacuguccuagccag

SEQ ID NO: 1634045 - RNA, 21 nt, Homo sapiens
ggacugucggaggaaagggau

SEQ ID NO: 1634046 - RNA, 13 nt, Homo sapiens
ugaaaaguuuccu

SEQ ID NO: 1634047 - RNA, 23 nt, Homo sapiens
ugaaaaguuuccuaggaugucau

SEQ ID NO: 1634048 - RNA, 17 nt, Homo sapiens
ugaaaauaaacauguau

SEQ ID NO: 1634049 - RNA, 18 nt, Homo sapiens
ugaaaauauagacauucu

SEQ ID NO: 1634050 - RNA, 21 nt, Homo sapiens
ugaaaauauagacauucucac

SEQ ID NO: 1634051 - RNA, 19 nt, Homo sapiens
acauuauuuaauauaguaa

SEQ ID NO: 1634052 - RNA, 12 nt, Homo sapiens
acauucagucug

SEQ ID NO: 1634053 - RNA, 21 nt, Homo sapiens
acauucuagcugagaagcaau

SEQ ID NO: 1634054 - RNA, 18 nt, Homo sapiens
acauuucucauaccuucc

SEQ ID NO: 1634055 - RNA, 22 nt, Homo sapiens
acauuucucauaccuuccccac

SEQ ID NO: 1634056 - RNA, 19 nt, Homo sapiens
acauuucuuaaaacuuuau

SEQ ID NO: 1634057 - RNA, 20 nt, Homo sapiens
acauuuggaaaagacagaaa

SEQ ID NO: 1634058 - RNA, 17 nt, Homo sapiens
acauuuggacauuucca

SEQ ID NO: 1634059 - RNA, 19 nt, Homo sapiens
acauuuucaguaccaaaga

SEQ ID NO: 1634060 - RNA, 16 nt, Homo sapiens
acauuuucauugauga

SEQ ID NO: 1634061 - RNA, 13 nt, Homo sapiens
accaaaacacaga

SEQ ID NO: 1634062 - RNA, 23 nt, Homo sapiens
accaagccaauaccagccgccau

SEQ ID NO: 1634063 - RNA, 17 nt, Homo sapiens
accaaguaccaguauaa

SEQ ID NO: 1634064 - RNA, 14 nt, Homo sapiens
accaauauuaccau

SEQ ID NO: 1634065 - RNA, 20 nt, Homo sapiens
accaauauuaccaucuuaau

SEQ ID NO: 1634066 - RNA, 20 nt, Homo sapiens
accaauauuguacaguuuuu

SEQ ID NO: 1634067 - RNA, 21 nt, Homo sapiens
accaaugcaacauuugugcag

SEQ ID NO: 1634068 - RNA, 19 nt, Homo sapiens
accaauggauuguggaaaa

SEQ ID NO: 1634069 - RNA, 14 nt, Homo sapiens
accaaugucauaac

SEQ ID NO: 1634070 - RNA, 16 nt, Homo sapiens
accaauuaagcagcuu

SEQ ID NO: 1634071 - RNA, 15 nt, Homo sapiens
accacaccaaugcaa

SEQ ID NO: 1634072 - RNA, 18 nt, Homo sapiens
accacaccuacccagggc

SEQ ID NO: 1634073 - RNA, 16 nt, Homo sapiens
accacauagcaugagg

SEQ ID NO: 1634074 - RNA, 13 nt, Homo sapiens
accaccagucuag

SEQ ID NO: 1634075 - RNA, 17 nt, Homo sapiens
accacucaaaggccaga

SEQ ID NO: 1634076 - RNA, 15 nt, Homo sapiens
accacucccaccaca

SEQ ID NO: 1634077 - RNA, 20 nt, Homo sapiens
accagcagaaaaccuguuca

SEQ ID NO: 1634078 - RNA, 18 nt, Homo sapiens
accagcucugaacuucca

SEQ ID NO: 1634079 - RNA, 23 nt, Homo sapiens
accagggaugucuguugaaauaa

SEQ ID NO: 1634080 - RNA, 15 nt, Homo sapiens
accagggcugcucuu

SEQ ID NO: 1634081 - RNA, 15 nt, Homo sapiens
accaguauaagcauc

SEQ ID NO: 1634082 - RNA, 13 nt, Homo sapiens
accagugccaagg

SEQ ID NO: 1634083 - RNA, 22 nt, Homo sapiens
accauauauugagguucauugg

SEQ ID NO: 1634084 - RNA, 17 nt, Homo sapiens
accaucacaugaccaca

SEQ ID NO: 1634085 - RNA, 15 nt, Homo sapiens
accauccugccaucc

SEQ ID NO: 1634086 - RNA, 16 nt, Homo sapiens
accaucuuaaucuuua

SEQ ID NO: 1634087 - RNA, 20 nt, Homo sapiens
accauguggauaacuuuaca

SEQ ID NO: 1634088 - RNA, 20 nt, Homo sapiens
accauucaggucuuucuuuc

SEQ ID NO: 1634089 - RNA, 15 nt, Homo sapiens
accauugaacuguac

SEQ ID NO: 1634090 - RNA, 13 nt, Homo sapiens
acccaacucugua

SEQ ID NO: 1634091 - RNA, 16 nt, Homo sapiens
acccagccccuucccc

SEQ ID NO: 1634092 - RNA, 20 nt, Homo sapiens
acccaggguggagugcagug

SEQ ID NO: 1634093 - RNA, 12 nt, Homo sapiens
acccagucucau

SEQ ID NO: 1634094 - RNA, 17 nt, Homo sapiens
acccaguggacucuucc

SEQ ID NO: 1634095 - RNA, 20 nt, Homo sapiens
acccaguucuucauuuggag

SEQ ID NO: 1634096 - RNA, 14 nt, Homo sapiens
acccaugcuuucau

SEQ ID NO: 1634097 - RNA, 15 nt, Homo sapiens
accccagcuccuagg

SEQ ID NO: 1634098 - RNA, 17 nt, Homo sapiens
accccagucaagcuccu

SEQ ID NO: 1634099 - RNA, 17 nt, Homo sapiens
accccagucgugaugug

SEQ ID NO: 1634100 - RNA, 15 nt, Homo sapiens
acccccaguuccuau

SEQ ID NO: 1634101 - RNA, 18 nt, Homo sapiens
acccccgcaaguuugcac

SEQ ID NO: 1634102 - RNA, 23 nt, Homo sapiens
accccuaguugagagcaccuugc

SEQ ID NO: 1634103 - RNA, 16 nt, Homo sapiens
accccucacugugacu

SEQ ID NO: 1634104 - RNA, 20 nt, Homo sapiens
accccugagauccggcaaca

SEQ ID NO: 1634105 - RNA, 23 nt, Homo sapiens
acccuaauguggcagcugucuca

SEQ ID NO: 1634106 - RNA, 17 nt, Homo sapiens
acccucauuucucaucu

SEQ ID NO: 1634107 - RNA, 20 nt, Homo sapiens
acccuccccuagucacucau

SEQ ID NO: 1634108 - RNA, 18 nt, Homo sapiens
acccugcccugcucugcc

SEQ ID NO: 1634109 - RNA, 14 nt, Homo sapiens
acccuucacaucac

SEQ ID NO: 1634110 - RNA, 23 nt, Homo sapiens
acccuuuuuugaaccaacaucuu

SEQ ID NO: 1634111 - RNA, 21 nt, Homo sapiens
accgagcgggugcaagcacuc

SEQ ID NO: 1634112 - RNA, 19 nt, Homo sapiens
accgcggggaccacaucaa

SEQ ID NO: 1634113 - RNA, 21 nt, Homo sapiens
accgggccacuccuuccugcc

SEQ ID NO: 1634114 - RNA, 21 nt, Homo sapiens
accgguggggcugguucugua

SEQ ID NO: 1634115 - RNA, 14 nt, Homo sapiens
accgugggcacuga

SEQ ID NO: 1634116 - RNA, 13 nt, Homo sapiens
accuacaguguac

SEQ ID NO: 1634117 - RNA, 21 nt, Homo sapiens
accuacccuccacaggcacag

SEQ ID NO: 1634118 - RNA, 19 nt, Homo sapiens
accuacuuuucuuuccuca

SEQ ID NO: 1634119 - RNA, 20 nt, Homo sapiens
accuacuuuucuuuccucag

SEQ ID NO: 1634120 - RNA, 23 nt, Homo sapiens
accuaguacgacuucauuccuuc

SEQ ID NO: 1634121 - RNA, 13 nt, Homo sapiens
accuaguuugcac

SEQ ID NO: 1634122 - RNA, 14 nt, Homo sapiens
accuaguuugcacu

SEQ ID NO: 1634123 - RNA, 15 nt, Homo sapiens
accuaguuugcacua

SEQ ID NO: 1634124 - RNA, 19 nt, Homo sapiens
accuauggcaauuuagcuc

SEQ ID NO: 1634125 - RNA, 12 nt, Homo sapiens
accucaagcacc

SEQ ID NO: 1634126 - RNA, 14 nt, Homo sapiens
accucaccaaggac

SEQ ID NO: 1634127 - RNA, 16 nt, Homo sapiens
accucagcacugugga

SEQ ID NO: 1634128 - RNA, 20 nt, Homo sapiens
accucauaaaaaucuagcac

SEQ ID NO: 1634129 - RNA, 18 nt, Homo sapiens
accuccagcuuuccugua

SEQ ID NO: 1634130 - RNA, 18 nt, Homo sapiens
accuccccagcccaggaa

SEQ ID NO: 1634131 - RNA, 19 nt, Homo sapiens
accuccgccagauccugca

SEQ ID NO: 1634132 - RNA, 18 nt, Homo sapiens
accuccugaguaauaagc

SEQ ID NO: 1634133 - RNA, 16 nt, Homo sapiens
accuccuggaaggcag

SEQ ID NO: 1634134 - RNA, 13 nt, Homo sapiens
accuccuucccca

SEQ ID NO: 1634135 - RNA, 22 nt, Homo sapiens
accuccuuucaagguaacugua

SEQ ID NO: 1634136 - RNA, 13 nt, Homo sapiens
accucucauaaau

SEQ ID NO: 1634137 - RNA, 19 nt, Homo sapiens
accucuguucauuucacac

SEQ ID NO: 1634138 - RNA, 19 nt, Homo sapiens
accucuucaugagcuugaa

SEQ ID NO: 1634139 - RNA, 13 nt, Homo sapiens
accugaagacacc

SEQ ID NO: 1634140 - RNA, 14 nt, Homo sapiens
accugacucuugca

SEQ ID NO: 1634141 - RNA, 20 nt, Homo sapiens
accugaggcccccaucuccu

SEQ ID NO: 1634142 - RNA, 13 nt, Homo sapiens
accugcaugugcu

SEQ ID NO: 1634143 - RNA, 15 nt, Homo sapiens
accugccacucugcc

SEQ ID NO: 1634144 - RNA, 21 nt, Homo sapiens
accugcccaaggaugcuguca

SEQ ID NO: 1634145 - RNA, 13 nt, Homo sapiens
accuggacccaga

SEQ ID NO: 1634146 - RNA, 16 nt, Homo sapiens
accuggccuucagugu

SEQ ID NO: 1634147 - RNA, 18 nt, Homo sapiens
accugggaccaaccugac

SEQ ID NO: 1634148 - RNA, 15 nt, Homo sapiens
accuguccaagacag

SEQ ID NO: 1634149 - RNA, 14 nt, Homo sapiens
accugucucagcug

SEQ ID NO: 1634150 - RNA, 12 nt, Homo sapiens
accugucucucu

SEQ ID NO: 1634151 - RNA, 13 nt, Homo sapiens
accugucucucuc

SEQ ID NO: 1634152 - RNA, 22 nt, Homo sapiens
accugugagcccagcuggguca

SEQ ID NO: 1634153 - RNA, 15 nt, Homo sapiens
accugugcaauauga

SEQ ID NO: 1634154 - RNA, 17 nt, Homo sapiens
accuuacaacucgggga

SEQ ID NO: 1634155 - RNA, 20 nt, Homo sapiens
accuuacaacucggggacaa

SEQ ID NO: 1634156 - RNA, 15 nt, Homo sapiens
accuucacucuccag

SEQ ID NO: 1634157 - RNA, 17 nt, Homo sapiens
accuugaccgacaugaa

SEQ ID NO: 1634158 - RNA, 19 nt, Homo sapiens
accuugcagcuaaauguga

SEQ ID NO: 1634159 - RNA, 22 nt, Homo sapiens
accuugucccuugucaguucca

SEQ ID NO: 1634160 - RNA, 17 nt, Homo sapiens
accuugugucuguacac

SEQ ID NO: 1634161 - RNA, 14 nt, Homo sapiens
aaucaaagccaggg

SEQ ID NO: 1634162 - RNA, 16 nt, Homo sapiens
aaucaauacugcacac

SEQ ID NO: 1634163 - RNA, 19 nt, Homo sapiens
aaucacaaaccaagccaug

SEQ ID NO: 1634164 - RNA, 14 nt, Homo sapiens
aaucagaauuggaa

SEQ ID NO: 1634165 - RNA, 20 nt, Homo sapiens
aaucagaauuggaaucacau

SEQ ID NO: 1634166 - RNA, 24 nt, Homo sapiens
aaucagagauguacaugauugcca

SEQ ID NO: 1634167 - RNA, 18 nt, Homo sapiens
aaucauccaagacaguua

SEQ ID NO: 1634168 - RNA, 20 nt, Homo sapiens
aaucaugugaggaaaugaug

SEQ ID NO: 1634169 - RNA, 18 nt, Homo sapiens
aaucauuuucauuccuaa

SEQ ID NO: 1634170 - RNA, 22 nt, Homo sapiens
aaucauuuuucuuuuguagcua

SEQ ID NO: 1634171 - RNA, 22 nt, Homo sapiens
aauccagauuuucacuguucca

SEQ ID NO: 1634172 - RNA, 19 nt, Homo sapiens
aauccauccaaucuauuau

SEQ ID NO: 1634173 - RNA, 22 nt, Homo sapiens
aauccaugguguuauuuucuga

SEQ ID NO: 1634174 - RNA, 14 nt, Homo sapiens
aaucccggcuguca

SEQ ID NO: 1634175 - RNA, 19 nt, Homo sapiens
aauccuuuuccuguucaua

SEQ ID NO: 1634176 - RNA, 15 nt, Homo sapiens
aaucuaccacuguau

SEQ ID NO: 1634177 - RNA, 22 nt, Homo sapiens
aaucucuaauagaggcauuacu

SEQ ID NO: 1634178 - RNA, 19 nt, Homo sapiens
aaucucuacugcuuuggau

SEQ ID NO: 1634179 - RNA, 16 nt, Homo sapiens
aaucucuccauucccg

SEQ ID NO: 1634180 - RNA, 23 nt, Homo sapiens
aaucuggucugaauaacacugga

SEQ ID NO: 1634181 - RNA, 13 nt, Homo sapiens
aaucuguacaaug

SEQ ID NO: 1634182 - RNA, 14 nt, Homo sapiens
aaucuguaucugua

SEQ ID NO: 1634183 - RNA, 20 nt, Homo sapiens
aaucuguccguucacaugug

SEQ ID NO: 1634184 - RNA, 21 nt, Homo sapiens
aaucuguccguucacaugugu

SEQ ID NO: 1634185 - RNA, 14 nt, Homo sapiens
aaucuguguacaaa

SEQ ID NO: 1634186 - RNA, 16 nt, Homo sapiens
aaucuuauacaacagc

SEQ ID NO: 1634187 - RNA, 13 nt, Homo sapiens
aaucuuaugcucu

SEQ ID NO: 1634188 - RNA, 14 nt, Homo sapiens
aaucuugaucauuc

SEQ ID NO: 1634189 - RNA, 22 nt, Homo sapiens
aaugaauuuucuucauacuuaa

SEQ ID NO: 1634190 - RNA, 18 nt, Homo sapiens
aaugacuauauaauuuau

SEQ ID NO: 1634191 - RNA, 16 nt, Homo sapiens
aaugacuuacuuuccu

SEQ ID NO: 1634192 - RNA, 17 nt, Homo sapiens
aaugacuucuaauuuau

SEQ ID NO: 1634193 - RNA, 15 nt, Homo sapiens
aaugaguagacauug

SEQ ID NO: 1634194 - RNA, 11 nt, Homo sapiens
aaugagugugc

SEQ ID NO: 1634195 - RNA, 21 nt, Homo sapiens
aaugauaaaguaaugaucuca

SEQ ID NO: 1634196 - RNA, 15 nt, Homo sapiens
aaugauccucagugc

SEQ ID NO: 1634197 - RNA, 15 nt, Homo sapiens
aaugcaaaacuuuag

SEQ ID NO: 1634198 - RNA, 22 nt, Homo sapiens
aaugcacguuucaaagcuuucc

SEQ ID NO: 1634199 - RNA, 21 nt, Homo sapiens
aaugcauuguaucgauguuau

SEQ ID NO: 1634200 - RNA, 23 nt, Homo sapiens
aaugccauccagaugugugcaau

SEQ ID NO: 1634201 - RNA, 21 nt, Homo sapiens
aaugcugguuuuucaguuuuc

SEQ ID NO: 1634202 - RNA, 12 nt, Homo sapiens
aauggacuggag

SEQ ID NO: 1634203 - RNA, 14 nt, Homo sapiens
aauggacuguuaca

SEQ ID NO: 1634204 - RNA, 20 nt, Homo sapiens
aauggcuaagauaccaaaac

SEQ ID NO: 1634205 - RNA, 14 nt, Homo sapiens
aaugggacugugag

SEQ ID NO: 1634206 - RNA, 22 nt, Homo sapiens
aaugggauggucggaucucaca

SEQ ID NO: 1634207 - RNA, 11 nt, Homo sapiens
aauggggacag

SEQ ID NO: 1634208 - RNA, 17 nt, Homo sapiens
aaugguuucaacaaaga

SEQ ID NO: 1634209 - RNA, 22 nt, Homo sapiens
aaugguuucccgggcccagaaa

SEQ ID NO: 1634210 - RNA, 14 nt, Homo sapiens
aauguaaaauccau

SEQ ID NO: 1634211 - RNA, 15 nt, Homo sapiens
aauguaaacaauauc

SEQ ID NO: 1634212 - RNA, 16 nt, Homo sapiens
aauguaggcuuucaug

SEQ ID NO: 1634213 - RNA, 18 nt, Homo sapiens
aauguauugagcauguga

SEQ ID NO: 1634214 - RNA, 14 nt, Homo sapiens
aaugucucauguca

SEQ ID NO: 1634215 - RNA, 15 nt, Homo sapiens
aaugucucaugucaa

SEQ ID NO: 1634216 - RNA, 22 nt, Homo sapiens
cacuuuuuaguucccuaaacuu

SEQ ID NO: 1634217 - RNA, 13 nt, Homo sapiens
cagaaaaccuguu

SEQ ID NO: 1634218 - RNA, 14 nt, Homo sapiens
cagaaacaugucuu

SEQ ID NO: 1634219 - RNA, 22 nt, Homo sapiens
cagaaacaugucuugacuguua

SEQ ID NO: 1634220 - RNA, 14 nt, Homo sapiens
cagaaacucuggaa

SEQ ID NO: 1634221 - RNA, 17 nt, Homo sapiens
cagaaagacccugaugc

SEQ ID NO: 1634222 - RNA, 20 nt, Homo sapiens
cagaaauaguugucugugcu

SEQ ID NO: 1634223 - RNA, 21 nt, Homo sapiens
cagaacacagcaauuccucag

SEQ ID NO: 1634224 - RNA, 22 nt, Homo sapiens
cagaacagggucauguuugcag

SEQ ID NO: 1634225 - RNA, 23 nt, Homo sapiens
cagaacugaagugugcugugaca

SEQ ID NO: 1634226 - RNA, 23 nt, Homo sapiens
cagaacuggaggcaguccaucua

SEQ ID NO: 1634227 - RNA, 15 nt, Homo sapiens
cagaacuugaagggu

SEQ ID NO: 1634228 - RNA, 16 nt, Homo sapiens
cagaacuuucuuucac

SEQ ID NO: 1634229 - RNA, 18 nt, Homo sapiens
cagaagccugaugcugac

SEQ ID NO: 1634230 - RNA, 23 nt, Homo sapiens
cagaaggaaagaagggggcccug

SEQ ID NO: 1634231 - RNA, 18 nt, Homo sapiens
cagaaucccggcugucaa

SEQ ID NO: 1634232 - RNA, 19 nt, Homo sapiens
cagaauguuguacuugaaa

SEQ ID NO: 1634233 - RNA, 20 nt, Homo sapiens
cagaauucuacccuggaaaa

SEQ ID NO: 1634234 - RNA, 17 nt, Homo sapiens
cagacaagaaugugcac

SEQ ID NO: 1634235 - RNA, 20 nt, Homo sapiens
cagacauacauuucucauac

SEQ ID NO: 1634236 - RNA, 16 nt, Homo sapiens
cagacauccacacaca

SEQ ID NO: 1634237 - RNA, 16 nt, Homo sapiens
cagaccacggcucgau

SEQ ID NO: 1634238 - RNA, 19 nt, Homo sapiens
caaggucaugccacugcac

SEQ ID NO: 1634239 - RNA, 14 nt, Homo sapiens
caaguaaguaugaa

SEQ ID NO: 1634240 - RNA, 16 nt, Homo sapiens
caagucauuccaugaa

SEQ ID NO: 1634241 - RNA, 20 nt, Homo sapiens
caagugaggugacacuccag

SEQ ID NO: 1634242 - RNA, 19 nt, Homo sapiens
caagugcucaucuguugua

SEQ ID NO: 1634243 - RNA, 19 nt, Homo sapiens
caagugucaccuccuuccc

SEQ ID NO: 1634244 - RNA, 16 nt, Homo sapiens
caaguuccacuucuug

SEQ ID NO: 1634245 - RNA, 17 nt, Homo sapiens
caaguuguagagagaaa

SEQ ID NO: 1634246 - RNA, 17 nt, Homo sapiens
caaguuuuguggggcuu

SEQ ID NO: 1634247 - RNA, 14 nt, Homo sapiens
caauacgacacuga

SEQ ID NO: 1634248 - RNA, 17 nt, Homo sapiens
caauagcuaagcaucuc

SEQ ID NO: 1634249 - RNA, 18 nt, Homo sapiens
caauauuuuuauaucaug

SEQ ID NO: 1634250 - RNA, 18 nt, Homo sapiens
caaucaagccauguauaa

SEQ ID NO: 1634251 - RNA, 21 nt, Homo sapiens
caaucacauuaacauuuugag

SEQ ID NO: 1634252 - RNA, 17 nt, Homo sapiens
caaucagcccagugcaa

SEQ ID NO: 1634253 - RNA, 15 nt, Homo sapiens
caaugaaccacaaaa

SEQ ID NO: 1634254 - RNA, 16 nt, Homo sapiens
caaugaagaaguuucu

SEQ ID NO: 1634255 - RNA, 20 nt, Homo sapiens
caauguauugagcaugugau

SEQ ID NO: 1634256 - RNA, 13 nt, Homo sapiens
caauucaguccug

SEQ ID NO: 1634257 - RNA, 16 nt, Homo sapiens
caauuccaacuuucag

SEQ ID NO: 1634258 - RNA, 18 nt, Homo sapiens
caauuccaccagggccag

SEQ ID NO: 1634259 - RNA, 16 nt, Homo sapiens
caauugggagcugcca

SEQ ID NO: 1634260 - RNA, 16 nt, Homo sapiens
caauuugcugccaaac

SEQ ID NO: 1634261 - RNA, 23 nt, Homo sapiens
caauuuuaaugauaaaauagcca

SEQ ID NO: 1634262 - RNA, 14 nt, Homo sapiens
cacaaaacuugaaa

SEQ ID NO: 1634263 - RNA, 16 nt, Homo sapiens
augauuucaaaaucag

SEQ ID NO: 1634264 - RNA, 17 nt, Homo sapiens
augauuucagcagggau

SEQ ID NO: 1634265 - RNA, 14 nt, Homo sapiens
augauuuguggaaa

SEQ ID NO: 1634266 - RNA, 17 nt, Homo sapiens
augauuuugcuuuccaa

SEQ ID NO: 1634267 - RNA, 9 nt, Homo sapiens
augcaaaac

SEQ ID NO: 1634268 - RNA, 17 nt, Homo sapiens
augcaaauacaaucagc

SEQ ID NO: 1634269 - RNA, 14 nt, Homo sapiens
augcaagccagcuu

SEQ ID NO: 1634270 - RNA, 14 nt, Homo sapiens
augcacauauggac

SEQ ID NO: 1634271 - RNA, 18 nt, Homo sapiens
augcaccuugugucugua

SEQ ID NO: 1634272 - RNA, 18 nt, Homo sapiens
augcacucucagaccaag

SEQ ID NO: 1634273 - RNA, 21 nt, Homo sapiens
augcaggcaugcuggcuccca

SEQ ID NO: 1634274 - RNA, 22 nt, Homo sapiens
augcaugugaagaaaggguguu

SEQ ID NO: 1634275 - RNA, 17 nt, Homo sapiens
augcauuauaucaaauc

SEQ ID NO: 1634276 - RNA, 22 nt, Homo sapiens
augcauuugauggccaccagcu

SEQ ID NO: 1634277 - RNA, 17 nt, Homo sapiens
augccaccuccuggaag

SEQ ID NO: 1634278 - RNA, 14 nt, Homo sapiens
augccauaugccuu

SEQ ID NO: 1634279 - RNA, 16 nt, Homo sapiens
augccauaugccuugg

SEQ ID NO: 1634280 - RNA, 23 nt, Homo sapiens
augccucgcucccuucaagacga

SEQ ID NO: 1634281 - RNA, 16 nt, Homo sapiens
augccugguauuuuca

SEQ ID NO: 1634282 - RNA, 18 nt, Homo sapiens
augccuguguacugccuu

SEQ ID NO: 1634283 - RNA, 18 nt, Homo sapiens
augccuuggggaggacaa

SEQ ID NO: 1634284 - RNA, 23 nt, Homo sapiens
augcuacuuuuuuuuaguucaau

SEQ ID NO: 1634285 - RNA, 20 nt, Homo sapiens
augcucaggagccaccagca

SEQ ID NO: 1634286 - RNA, 19 nt, Homo sapiens
augcugaaaaaucauccaa

SEQ ID NO: 1634287 - RNA, 14 nt, Homo sapiens
augcugacauucac

SEQ ID NO: 1634288 - RNA, 16 nt, Homo sapiens
augcugacuucacuua

SEQ ID NO: 1634289 - RNA, 16 nt, Homo sapiens
augcugcaaaggagaa

SEQ ID NO: 1634290 - RNA, 16 nt, Homo sapiens
augcugcaauacauua

SEQ ID NO: 1634291 - RNA, 20 nt, Homo sapiens
augcuggcucccagggccau

SEQ ID NO: 1634292 - RNA, 22 nt, Homo sapiens
augcuguuaugaguggcuuuaa

SEQ ID NO: 1634293 - RNA, 23 nt, Homo sapiens
augcuuauugaugagguuuauuc

SEQ ID NO: 1634294 - RNA, 15 nt, Homo sapiens
auggaaaacuguguu

SEQ ID NO: 1634295 - RNA, 20 nt, Homo sapiens
auggaacacacuuggaugca

SEQ ID NO: 1634296 - RNA, 15 nt, Homo sapiens
auggaacagcauuac

SEQ ID NO: 1634297 - RNA, 12 nt, Homo sapiens
auggacucugca

SEQ ID NO: 1634298 - RNA, 15 nt, Homo sapiens
auggagccaugacaa

SEQ ID NO: 1634299 - RNA, 14 nt, Homo sapiens
auggaggcccuccu

SEQ ID NO: 1634300 - RNA, 18 nt, Homo sapiens
auggaguucuugugccau

SEQ ID NO: 1634301 - RNA, 19 nt, Homo sapiens
auggauaaaauaaugcugc

SEQ ID NO: 1634302 - RNA, 12 nt, Homo sapiens
auggaugggaug

SEQ ID NO: 1634303 - RNA, 17 nt, Homo sapiens
auggauuguggaaaaug

SEQ ID NO: 1634304 - RNA, 17 nt, Homo sapiens
auggcaaaguggaucca

SEQ ID NO: 1634305 - RNA, 11 nt, Homo sapiens
auggcacugac

SEQ ID NO: 1634306 - RNA, 15 nt, Homo sapiens
auggcauccugugaa

SEQ ID NO: 1634307 - RNA, 13 nt, Homo sapiens
auggccacuguga

SEQ ID NO: 1634308 - RNA, 18 nt, Homo sapiens
auggccuccauccagaaa

SEQ ID NO: 1634309 - RNA, 11 nt, Homo sapiens
auggcugccau

SEQ ID NO: 1634310 - RNA, 15 nt, Homo sapiens
auggcugccaucuca

SEQ ID NO: 1634311 - RNA, 16 nt, Homo sapiens
auggcugccaucucac

SEQ ID NO: 1634312 - RNA, 16 nt, Homo sapiens
auggcuguguuugcag

SEQ ID NO: 1634313 - RNA, 19 nt, Homo sapiens
auggcuuaggaaugacuua

SEQ ID NO: 1634314 - RNA, 22 nt, Homo sapiens
auggcuuauuucuaugacaaau

SEQ ID NO: 1634315 - RNA, 16 nt, Homo sapiens
augggaccuauaacug

SEQ ID NO: 1634316 - RNA, 19 nt, Homo sapiens
augggagcuuaacuuuaua

SEQ ID NO: 1634317 - RNA, 13 nt, Homo sapiens
augggaugcacuc

SEQ ID NO: 1634318 - RNA, 15 nt, Homo sapiens
augggaugcacucuc

SEQ ID NO: 1634319 - RNA, 24 nt, Homo sapiens
augguaauucaguuauuugcacaa

SEQ ID NO: 1634320 - RNA, 19 nt, Homo sapiens
auggucaaugcuagcacaa

SEQ ID NO: 1634321 - RNA, 15 nt, Homo sapiens
auggugcugcucugu

SEQ ID NO: 1634322 - RNA, 22 nt, Homo sapiens
augguuacuaggcuuaauaccu

SEQ ID NO: 1634323 - RNA, 13 nt, Homo sapiens
auguaaccacugc

SEQ ID NO: 1634324 - RNA, 14 nt, Homo sapiens
auguaaccacugca

SEQ ID NO: 1634325 - RNA, 15 nt, Homo sapiens
auguaaccacugcac

SEQ ID NO: 1634326 - RNA, 14 nt, Homo sapiens
auguacacuacauu

SEQ ID NO: 1634327 - RNA, 21 nt, Homo sapiens
auguaguuuuuauauguugua

SEQ ID NO: 1634328 - RNA, 12 nt, Homo sapiens
auguauauguca

SEQ ID NO: 1634329 - RNA, 22 nt, Homo sapiens
auguaugucuuggacacuguac

SEQ ID NO: 1634330 - RNA, 23 nt, Homo sapiens
auguauguguaaaacaaucuguu

SEQ ID NO: 1634331 - RNA, 17 nt, Homo sapiens
auguauuuugacacugg

SEQ ID NO: 1634332 - RNA, 13 nt, Homo sapiens
augucucauguca

SEQ ID NO: 1634333 - RNA, 17 nt, Homo sapiens
augucuguaucacucug

SEQ ID NO: 1634334 - RNA, 21 nt, Homo sapiens
augucuguuaccuuguuaaua

SEQ ID NO: 1634335 - RNA, 15 nt, Homo sapiens
augucuuacuacuuu

SEQ ID NO: 1634336 - RNA, 21 nt, Homo sapiens
augugaagccaauucagacag

SEQ ID NO: 1634337 - RNA, 17 nt, Homo sapiens
augugaggaaaugauga

SEQ ID NO: 1634338 - RNA, 16 nt, Homo sapiens
augugaugcaagccag

SEQ ID NO: 1634339 - RNA, 22 nt, Homo sapiens
augugauuuuccuuuguagcua

SEQ ID NO: 1634340 - RNA, 13 nt, Homo sapiens
augugcugucacg

SEQ ID NO: 1634341 - RNA, 13 nt, Homo sapiens
auguggucucagg

SEQ ID NO: 1634342 - RNA, 16 nt, Homo sapiens
augugguuaucuguga

SEQ ID NO: 1634343 - RNA, 21 nt, Homo sapiens
auuugccuucugaaaugugac

SEQ ID NO: 1634344 - RNA, 22 nt, Homo sapiens
auuugcuaaucaaagccagggu

SEQ ID NO: 1634345 - RNA, 20 nt, Homo sapiens
auuugcucagaauugcacau

SEQ ID NO: 1634346 - RNA, 23 nt, Homo sapiens
auuuggugacuguguaacuuucu

SEQ ID NO: 1634347 - RNA, 19 nt, Homo sapiens
auuugguggccuaauuuac

SEQ ID NO: 1634348 - RNA, 21 nt, Homo sapiens
auuuguauaacgguuuaauuc

SEQ ID NO: 1634349 - RNA, 21 nt, Homo sapiens
auuugugguccacugagcuau

SEQ ID NO: 1634350 - RNA, 16 nt, Homo sapiens
auuuguugagccccag

SEQ ID NO: 1634351 - RNA, 20 nt, Homo sapiens
auuuuaaaacucuacagaug

SEQ ID NO: 1634352 - RNA, 13 nt, Homo sapiens
auuuuaaagacaa

SEQ ID NO: 1634353 - RNA, 23 nt, Homo sapiens
auuuuaauagggaauauaucucu

SEQ ID NO: 1634354 - RNA, 22 nt, Homo sapiens
auuuuaaugauaaaauagccaa

SEQ ID NO: 1634355 - RNA, 15 nt, Homo sapiens
auuuuaauucuguga

SEQ ID NO: 1634356 - RNA, 20 nt, Homo sapiens
auuuuaccuaguuugcacua

SEQ ID NO: 1634357 - RNA, 20 nt, Homo sapiens
auuuuagcuaaauucaggga

SEQ ID NO: 1634358 - RNA, 15 nt, Homo sapiens
auuuuaggcacuguu

SEQ ID NO: 1634359 - RNA, 18 nt, Homo sapiens
auuuuaucuugaaacuga

SEQ ID NO: 1634360 - RNA, 15 nt, Homo sapiens
auuuuauucacauau

SEQ ID NO: 1634361 - RNA, 14 nt, Homo sapiens
auuuucaaggccuu

SEQ ID NO: 1634362 - RNA, 22 nt, Homo sapiens
auuuucaaggccuucaguuuau

SEQ ID NO: 1634363 - RNA, 19 nt, Homo sapiens
auuuucuacacauacaugu

SEQ ID NO: 1634364 - RNA, 19 nt, Homo sapiens
auuuucuuguaugcuucuu

SEQ ID NO: 1634365 - RNA, 13 nt, Homo sapiens
auuuugacacugg

SEQ ID NO: 1634366 - RNA, 19 nt, Homo sapiens
auuuuguaauauugaggga

SEQ ID NO: 1634367 - RNA, 21 nt, Homo sapiens
auuuuguagaauaaggaacaa

SEQ ID NO: 1634368 - RNA, 15 nt, Homo sapiens
auuuuuccaguaacu

SEQ ID NO: 1634369 - RNA, 15 nt, Homo sapiens
auuuuuuagugcauc

SEQ ID NO: 1634370 - RNA, 14 nt, Homo sapiens
auuuuuugccauuu

SEQ ID NO: 1634371 - RNA, 18 nt, Homo sapiens
agaugcagggcagucauu

SEQ ID NO: 1634372 - RNA, 15 nt, Homo sapiens
agaugcuaggaagcu

SEQ ID NO: 1634373 - RNA, 14 nt, Homo sapiens
agauggaguucuug

SEQ ID NO: 1634374 - RNA, 18 nt, Homo sapiens
agauguacaaaacaguuu

SEQ ID NO: 1634375 - RNA, 22 nt, Homo sapiens
agauguacuucucugugugcac

SEQ ID NO: 1634376 - RNA, 23 nt, Homo sapiens
agauguuuguuuucaaaauacuu

SEQ ID NO: 1634377 - RNA, 16 nt, Homo sapiens
agauuuacuaaaucaa

SEQ ID NO: 1634378 - RNA, 21 nt, Homo sapiens
agauuuauggaaaauacucug

SEQ ID NO: 1634379 - RNA, 18 nt, Homo sapiens
agauuugaugggccacaa

SEQ ID NO: 1634380 - RNA, 14 nt, Homo sapiens
agauuuuaaagaca

SEQ ID NO: 1634381 - RNA, 22 nt, Homo sapiens
agauuuuuuccucugcauuuac

SEQ ID NO: 1634382 - RNA, 12 nt, Homo sapiens
agcaaaccauua

SEQ ID NO: 1634383 - RNA, 15 nt, Homo sapiens
agcaaaccuagcccc

SEQ ID NO: 1634384 - RNA, 14 nt, Homo sapiens
agcaaaucuaugag

SEQ ID NO: 1634385 - RNA, 22 nt, Homo sapiens
agcaaccguggcccuuccugga

SEQ ID NO: 1634386 - RNA, 20 nt, Homo sapiens
agcaagacauacuuaaugca

SEQ ID NO: 1634387 - RNA, 20 nt, Homo sapiens
agcaaguauauuuauuucua

SEQ ID NO: 1634388 - RNA, 19 nt, Homo sapiens
agcaaguccucacucuuca

SEQ ID NO: 1634389 - RNA, 14 nt, Homo sapiens
agcaauucuccugc

SEQ ID NO: 1634390 - RNA, 19 nt, Homo sapiens
agcaauucuccugccuuag

SEQ ID NO: 1634391 - RNA, 20 nt, Homo sapiens
agcaauucuccugccuuagc

SEQ ID NO: 1634392 - RNA, 21 nt, Homo sapiens
agcacaccuacagagcaccug

SEQ ID NO: 1634393 - RNA, 11 nt, Homo sapiens
agcacacucuu

SEQ ID NO: 1634394 - RNA, 13 nt, Homo sapiens
agcacacucuucu

SEQ ID NO: 1634395 - RNA, 17 nt, Homo sapiens
agcaccguucugugcac

SEQ ID NO: 1634396 - RNA, 18 nt, Homo sapiens
agcaccguucugugcaca

SEQ ID NO: 1634397 - RNA, 21 nt, Homo sapiens
agcaccguucugugcacaaaa

SEQ ID NO: 1634398 - RNA, 21 nt, Homo sapiens
agcaccuccgccagauccugc

SEQ ID NO: 1634399 - RNA, 20 nt, Homo sapiens
agcacggacugucaguucuc

SEQ ID NO: 1634400 - RNA, 21 nt, Homo sapiens
agcacggacugucaguucucu

SEQ ID NO: 1634401 - RNA, 22 nt, Homo sapiens
agcacuaccuaaguaauucucu

SEQ ID NO: 1634402 - RNA, 22 nt, Homo sapiens
agcacuacugggugucauuuca

SEQ ID NO: 1634403 - RNA, 21 nt, Homo sapiens
agcacuccccagagcugugcc

SEQ ID NO: 1634404 - RNA, 20 nt, Homo sapiens
agcacuuagcaggcaccgcc

SEQ ID NO: 1634405 - RNA, 13 nt, Homo sapiens
agcacuuugcaac

SEQ ID NO: 1634406 - RNA, 17 nt, Homo sapiens
agcagaaacagcauauu

SEQ ID NO: 1634407 - RNA, 20 nt, Homo sapiens
agcagaagagaaaauguugu

SEQ ID NO: 1634408 - RNA, 20 nt, Homo sapiens
agcagacaggccccgugagg

SEQ ID NO: 1634409 - RNA, 13 nt, Homo sapiens
agcagacauccac

SEQ ID NO: 1634410 - RNA, 21 nt, Homo sapiens
agcagcaccguucugugcaca

SEQ ID NO: 1634411 - RNA, 22 nt, Homo sapiens
agcagcagcacuuagaccugcc

SEQ ID NO: 1634412 - RNA, 13 nt, Homo sapiens
agcagccacgagg

SEQ ID NO: 1634413 - RNA, 18 nt, Homo sapiens
agcagccuaacacggugc

SEQ ID NO: 1634414 - RNA, 14 nt, Homo sapiens
agcaggaguggugc

SEQ ID NO: 1634415 - RNA, 21 nt, Homo sapiens
agcaggcagcgccaagugcgu

SEQ ID NO: 1634416 - RNA, 19 nt, Homo sapiens
agcagggcuggucaccucc

SEQ ID NO: 1634417 - RNA, 22 nt, Homo sapiens
agcaggugcugacuucaucucc

SEQ ID NO: 1634418 - RNA, 18 nt, Homo sapiens
agcaucucccagcaagac

SEQ ID NO: 1634419 - RNA, 23 nt, Homo sapiens
agcaugaauaacauuuaaauucc

SEQ ID NO: 1634420 - RNA, 15 nt, Homo sapiens
agcauguacuccccu

SEQ ID NO: 1634421 - RNA, 21 nt, Homo sapiens
agcaugugaugggcuguuuaa

SEQ ID NO: 1634422 - RNA, 12 nt, Homo sapiens
agcaugugaugu

SEQ ID NO: 1634423 - RNA, 20 nt, Homo sapiens
agcaugugccuuaaugcuuc

SEQ ID NO: 1634424 - RNA, 22 nt, Homo sapiens
agcauugccauaccauucccau

SEQ ID NO: 1634425 - RNA, 19 nt, Homo sapiens
agcauuuacauuuauuagg

SEQ ID NO: 1634426 - RNA, 23 nt, Homo sapiens
agcauuuugaaacaaaguacucu

SEQ ID NO: 1634427 - RNA, 16 nt, Homo sapiens
agccaaccuugcucuu

SEQ ID NO: 1634428 - RNA, 21 nt, Homo sapiens
agccaaggucaugccacugca

SEQ ID NO: 1634429 - RNA, 17 nt, Homo sapiens
agccaauaccagccgcc

SEQ ID NO: 1634430 - RNA, 16 nt, Homo sapiens
agccacagcagccacu

SEQ ID NO: 1634431 - RNA, 10 nt, Homo sapiens
agccacagga

SEQ ID NO: 1634432 - RNA, 22 nt, Homo sapiens
agccacccugaggagucugagg

SEQ ID NO: 1634433 - RNA, 13 nt, Homo sapiens
agccaccgugccc

SEQ ID NO: 1634434 - RNA, 13 nt, Homo sapiens
agccaccugcaag

SEQ ID NO: 1634435 - RNA, 17 nt, Homo sapiens
agccacuauuaacauuu

SEQ ID NO: 1634436 - RNA, 21 nt, Homo sapiens
agccacuuugcuaccaugaca

SEQ ID NO: 1634437 - RNA, 22 nt, Homo sapiens
acaaauauggaugagguggaga

SEQ ID NO: 1634438 - RNA, 14 nt, Homo sapiens
acaaauuucauugc

SEQ ID NO: 1634439 - RNA, 17 nt, Homo sapiens
acaaauuucauugcacu

SEQ ID NO: 1634440 - RNA, 22 nt, Homo sapiens
acaaauuucauugcacuuuccu

SEQ ID NO: 1634441 - RNA, 16 nt, Homo sapiens
acaacaauccuucuau

SEQ ID NO: 1634442 - RNA, 22 nt, Homo sapiens
acaaccaacagaaaacauccca

SEQ ID NO: 1634443 - RNA, 11 nt, Homo sapiens
acaaccugcug

SEQ ID NO: 1634444 - RNA, 12 nt, Homo sapiens
acaacucuuugu

SEQ ID NO: 1634445 - RNA, 16 nt, Homo sapiens
acaacuuaguguaaua

SEQ ID NO: 1634446 - RNA, 17 nt, Homo sapiens
acaagaccccgucucaa

SEQ ID NO: 1634447 - RNA, 22 nt, Homo sapiens
acaagaguggagagaagcucuu

SEQ ID NO: 1634448 - RNA, 16 nt, Homo sapiens
acaaggaugacaagaa

SEQ ID NO: 1634449 - RNA, 16 nt, Homo sapiens
acaaggcccugagcuu

SEQ ID NO: 1634450 - RNA, 17 nt, Homo sapiens
acaaucagcccagugca

SEQ ID NO: 1634451 - RNA, 20 nt, Homo sapiens
acaaugaacccccaugaugu

SEQ ID NO: 1634452 - RNA, 21 nt, Homo sapiens
acaaugaacccccaugaugua

SEQ ID NO: 1634453 - RNA, 20 nt, Homo sapiens
acacaauuguuuuaccuguu

SEQ ID NO: 1634454 - RNA, 13 nt, Homo sapiens
acacacacaccaa

SEQ ID NO: 1634455 - RNA, 15 nt, Homo sapiens
acacacuuccagugu

SEQ ID NO: 1634456 - RNA, 23 nt, Homo sapiens
acacagaauuguuccaguacuau

SEQ ID NO: 1634457 - RNA, 18 nt, Homo sapiens
acacagacuccacccucc

SEQ ID NO: 1634458 - RNA, 15 nt, Homo sapiens
acacagacuguuguc

SEQ ID NO: 1634459 - RNA, 17 nt, Homo sapiens
acacagaggggagucac

SEQ ID NO: 1634460 - RNA, 13 nt, Homo sapiens
acacaggccugug

SEQ ID NO: 1634461 - RNA, 19 nt, Homo sapiens
acacauugacuccuuucca

SEQ ID NO: 1634462 - RNA, 22 nt, Homo sapiens
acaccaaggcccugcaucuguc

SEQ ID NO: 1634463 - RNA, 14 nt, Homo sapiens
acaccauauacugu

SEQ ID NO: 1634464 - RNA, 16 nt, Homo sapiens
acaccccagcuccuag

SEQ ID NO: 1634465 - RNA, 16 nt, Homo sapiens
acacccgcacugccca

SEQ ID NO: 1634466 - RNA, 14 nt, Homo sapiens
acaccguucauuca

SEQ ID NO: 1634467 - RNA, 19 nt, Homo sapiens
acaccugagacaugcugaa

SEQ ID NO: 1634468 - RNA, 21 nt, Homo sapiens
acaccugccuucaaagccacu

SEQ ID NO: 1634469 - RNA, 12 nt, Homo sapiens
acacgcauuaau

SEQ ID NO: 1634470 - RNA, 20 nt, Homo sapiens
acacuaacaaaagcaugaaa

SEQ ID NO: 1634471 - RNA, 16 nt, Homo sapiens
acacuaccacauuaaa

SEQ ID NO: 1634472 - RNA, 16 nt, Homo sapiens
acacuacgcacuggac

SEQ ID NO: 1634473 - RNA, 13 nt, Homo sapiens
acacuauuuacaa

SEQ ID NO: 1634474 - RNA, 17 nt, Homo sapiens
acacucagaagccuggg

SEQ ID NO: 1634475 - RNA, 21 nt, Homo sapiens
acacuggaggagagaagaaug

SEQ ID NO: 1634476 - RNA, 17 nt, Homo sapiens
acacuguuucaucucag

SEQ ID NO: 1634477 - RNA, 18 nt, Homo sapiens
acacuuaaauucucuaac

SEQ ID NO: 1634478 - RNA, 16 nt, Homo sapiens
acacuucggcucucug

SEQ ID NO: 1634479 - RNA, 14 nt, Homo sapiens
acacuugucuuuac

SEQ ID NO: 1634480 - RNA, 23 nt, Homo sapiens
acagaagcuucugcccaccuacu

SEQ ID NO: 1634481 - RNA, 16 nt, Homo sapiens
acagaagucuccucaa

SEQ ID NO: 1634482 - RNA, 12 nt, Homo sapiens
acagacacugca

SEQ ID NO: 1634483 - RNA, 16 nt, Homo sapiens
acagacauacauuucu

SEQ ID NO: 1634484 - RNA, 18 nt, Homo sapiens
acagacaucuaauguucu

SEQ ID NO: 1634485 - RNA, 20 nt, Homo sapiens
acagacgagacaacagcaca

SEQ ID NO: 1634486 - RNA, 17 nt, Homo sapiens
acagagcgagacuccau

SEQ ID NO: 1634487 - RNA, 20 nt, Homo sapiens
acagaggggagucaccagcc

SEQ ID NO: 1634488 - RNA, 13 nt, Homo sapiens
acagagucuugcu

SEQ ID NO: 1634489 - RNA, 16 nt, Homo sapiens
acagcaagucaggguu

SEQ ID NO: 1634490 - RNA, 16 nt, Homo sapiens
acagcacuacugggug

SEQ ID NO: 1634491 - RNA, 22 nt, Homo sapiens
acagcagccacuuugcuaccau

SEQ ID NO: 1634492 - RNA, 12 nt, Homo sapiens
acagccaagggg

SEQ ID NO: 1634493 - RNA, 15 nt, Homo sapiens
acagccaucaaggga

SEQ ID NO: 1634494 - RNA, 21 nt, Homo sapiens
acagcccaggauacuggcaca

SEQ ID NO: 1634495 - RNA, 13 nt, Homo sapiens
accuuguuuauua

SEQ ID NO: 1634496 - RNA, 18 nt, Homo sapiens
accuuguuugaguuauca

SEQ ID NO: 1634497 - RNA, 21 nt, Homo sapiens
accuuuaaauaucauucuuug

SEQ ID NO: 1634498 - RNA, 21 nt, Homo sapiens
accuuuaggccaucucagcuu

SEQ ID NO: 1634499 - RNA, 17 nt, Homo sapiens
accuuugggacuaagcu

SEQ ID NO: 1634500 - RNA, 20 nt, Homo sapiens
acgaaguguugcauggaugu

SEQ ID NO: 1634501 - RNA, 17 nt, Homo sapiens
acgacugcaaagccagu

SEQ ID NO: 1634502 - RNA, 13 nt, Homo sapiens
acgaggugcaaca

SEQ ID NO: 1634503 - RNA, 22 nt, Homo sapiens
acgaguggccaguucauugugg

SEQ ID NO: 1634504 - RNA, 18 nt, Homo sapiens
acgccaauguuaugccag

SEQ ID NO: 1634505 - RNA, 21 nt, Homo sapiens
acgccucacugaaacauggcu

SEQ ID NO: 1634506 - RNA, 14 nt, Homo sapiens
acgcuuucaugaau

SEQ ID NO: 1634507 - RNA, 19 nt, Homo sapiens
acggagguccuuuggacag

SEQ ID NO: 1634508 - RNA, 14 nt, Homo sapiens
acgguaacauccaa

SEQ ID NO: 1634509 - RNA, 15 nt, Homo sapiens
acgguguuuugccau

SEQ ID NO: 1634510 - RNA, 17 nt, Homo sapiens
acgucuggacugcuauu

SEQ ID NO: 1634511 - RNA, 16 nt, Homo sapiens
acgucuggcucccugc

SEQ ID NO: 1634512 - RNA, 18 nt, Homo sapiens
acgugauuuugcuguaga

SEQ ID NO: 1634513 - RNA, 17 nt, Homo sapiens
acguggcucagccagca

SEQ ID NO: 1634514 - RNA, 21 nt, Homo sapiens
acgugugaaaucugucuuugc

SEQ ID NO: 1634515 - RNA, 16 nt, Homo sapiens
acuaaaucaaucugca

SEQ ID NO: 1634516 - RNA, 16 nt, Homo sapiens
acuaacaaagacagcu

SEQ ID NO: 1634517 - RNA, 19 nt, Homo sapiens
acuaauuauaccaguuuuu

SEQ ID NO: 1634518 - RNA, 20 nt, Homo sapiens
acuaauuauacuacuuuguu

SEQ ID NO: 1634519 - RNA, 19 nt, Homo sapiens
acuacaggcgccugccaca

SEQ ID NO: 1634520 - RNA, 16 nt, Homo sapiens
acuaccucaaaggcca

SEQ ID NO: 1634521 - RNA, 21 nt, Homo sapiens
acuaggauacugcugcgucau

SEQ ID NO: 1634522 - RNA, 16 nt, Homo sapiens
acuagucucaccagcc

SEQ ID NO: 1634523 - RNA, 16 nt, Homo sapiens
acuagugcaauuccaa

SEQ ID NO: 1634524 - RNA, 13 nt, Homo sapiens
acuauaugaucag

SEQ ID NO: 1634525 - RNA, 19 nt, Homo sapiens
acuaugaaguaagcaacaa

SEQ ID NO: 1634526 - RNA, 14 nt, Homo sapiens
acuaugcuuuagaa

SEQ ID NO: 1634527 - RNA, 15 nt, Homo sapiens
acuauuuucaaagaa

SEQ ID NO: 1634528 - RNA, 16 nt, Homo sapiens
acucacaagugcucau

SEQ ID NO: 1634529 - RNA, 15 nt, Homo sapiens
acucacucaguuuau

SEQ ID NO: 1634530 - RNA, 18 nt, Homo sapiens
acucagaggcagugacag

SEQ ID NO: 1634531 - RNA, 12 nt, Homo sapiens
acucauaauucu

SEQ ID NO: 1634532 - RNA, 17 nt, Homo sapiens
acucauagccacuuuua

SEQ ID NO: 1634533 - RNA, 17 nt, Homo sapiens
acucauccauccccugg

SEQ ID NO: 1634534 - RNA, 19 nt, Homo sapiens
acucauuaaugaaucacau

SEQ ID NO: 1634535 - RNA, 19 nt, Homo sapiens
acuccacccuccuacaggu

SEQ ID NO: 1634536 - RNA, 13 nt, Homo sapiens
acuccaugcaaac

SEQ ID NO: 1634537 - RNA, 15 nt, Homo sapiens
acucccaacccuggc

SEQ ID NO: 1634538 - RNA, 18 nt, Homo sapiens
acucccaccccagggauu

SEQ ID NO: 1634539 - RNA, 19 nt, Homo sapiens
acucccggccugucauuca

SEQ ID NO: 1634540 - RNA, 20 nt, Homo sapiens
acuccugaggacagcugucc

SEQ ID NO: 1634541 - RNA, 14 nt, Homo sapiens
acuccuuccagcua

SEQ ID NO: 1634542 - RNA, 23 nt, Homo sapiens
acuccuuccagcuagugacccac

SEQ ID NO: 1634543 - RNA, 21 nt, Homo sapiens
acucuacagauggcauaccug

SEQ ID NO: 1634544 - RNA, 17 nt, Homo sapiens
acucuaggcagugacag

SEQ ID NO: 1634545 - RNA, 18 nt, Homo sapiens
acucuaggcagugacagu

SEQ ID NO: 1634546 - RNA, 19 nt, Homo sapiens
acucucauccaaauggcau

SEQ ID NO: 1634547 - RNA, 13 nt, Homo sapiens
acucucgcugugg

SEQ ID NO: 1634548 - RNA, 20 nt, Homo sapiens
acucucuguuuuaguguuua

SEQ ID NO: 1634549 - RNA, 18 nt, Homo sapiens
acucugcacaugucuugu

SEQ ID NO: 1634550 - RNA, 13 nt, Homo sapiens
acucugcucugau

SEQ ID NO: 1634551 - RNA, 19 nt, Homo sapiens
acucugugucugaguggcu

SEQ ID NO: 1634552 - RNA, 15 nt, Homo sapiens
acucuguuccuggcu

SEQ ID NO: 1634553 - RNA, 14 nt, Homo sapiens
acucuugaacacaa

SEQ ID NO: 1634554 - RNA, 23 nt, Homo sapiens
acucuuguuuucugguaaaacuu

SEQ ID NO: 1634555 - RNA, 14 nt, Homo sapiens
acugaaggcuuuca

SEQ ID NO: 1634556 - RNA, 16 nt, Homo sapiens
acugaauacagucuca

SEQ ID NO: 1634557 - RNA, 22 nt, Homo sapiens
ucagagaacucccccaccugug

SEQ ID NO: 1634558 - RNA, 18 nt, Homo sapiens
ucagauuguuaucuauca

SEQ ID NO: 1634559 - RNA, 20 nt, Homo sapiens
ucagauuguuaucuaucaac

SEQ ID NO: 1634560 - RNA, 14 nt, Homo sapiens
ucagccagcaagag

SEQ ID NO: 1634561 - RNA, 11 nt, Homo sapiens
ucagcccagug

SEQ ID NO: 1634562 - RNA, 18 nt, Homo sapiens
ucagcccccaccagggga

SEQ ID NO: 1634563 - RNA, 14 nt, Homo sapiens
ucagccucccaaag

SEQ ID NO: 1634564 - RNA, 20 nt, Homo sapiens
ucagcgaaugacaaaaucau

SEQ ID NO: 1634565 - RNA, 14 nt, Homo sapiens
ucagcucuugucaa

SEQ ID NO: 1634566 - RNA, 18 nt, Homo sapiens
ucagcugccccaauguga

SEQ ID NO: 1634567 - RNA, 17 nt, Homo sapiens
ucaggcaaacguccaca

SEQ ID NO: 1634568 - RNA, 13 nt, Homo sapiens
ucaggcagggugc

SEQ ID NO: 1634569 - RNA, 16 nt, Homo sapiens
ucagggagaggucacc

SEQ ID NO: 1634570 - RNA, 19 nt, Homo sapiens
ucagggagaggucaccagc

SEQ ID NO: 1634571 - RNA, 19 nt, Homo sapiens
ucagggccuggggccugag

SEQ ID NO: 1634572 - RNA, 20 nt, Homo sapiens
ucagggggauaacuaccaga

SEQ ID NO: 1634573 - RNA, 21 nt, Homo sapiens
ucagguuuucgaaccuugacc

SEQ ID NO: 1634574 - RNA, 19 nt, Homo sapiens
ucaguaaauagugucauau

SEQ ID NO: 1634575 - RNA, 20 nt, Homo sapiens
ucagucaagugaggugacac

SEQ ID NO: 1634576 - RNA, 19 nt, Homo sapiens
ucagucaauagccauauca

SEQ ID NO: 1634577 - RNA, 15 nt, Homo sapiens
ucagucacagccacc

SEQ ID NO: 1634578 - RNA, 19 nt, Homo sapiens
ucagugaagucuagaauca

SEQ ID NO: 1634579 - RNA, 13 nt, Homo sapiens
ucagugcaguuuc

SEQ ID NO: 1634580 - RNA, 20 nt, Homo sapiens
ucagugccgaccugcgccaa

SEQ ID NO: 1634581 - RNA, 15 nt, Homo sapiens
ucaguucucuacucc

SEQ ID NO: 1634582 - RNA, 21 nt, Homo sapiens
ucauaccaauuccaacuuuca

SEQ ID NO: 1634583 - RNA, 19 nt, Homo sapiens
ucauaguguauaauaauau

SEQ ID NO: 1634584 - RNA, 22 nt, Homo sapiens
ucauaugaauuagccaaaagaa

SEQ ID NO: 1634585 - RNA, 10 nt, Homo sapiens
ucauauugau

SEQ ID NO: 1634586 - RNA, 20 nt, Homo sapiens
ucauauugaugugugucuag

SEQ ID NO: 1634587 - RNA, 20 nt, Homo sapiens
ucaucacagggauuuagacu

SEQ ID NO: 1634588 - RNA, 20 nt, Homo sapiens
ucaucaccuguuaucugugu

SEQ ID NO: 1634589 - RNA, 17 nt, Homo sapiens
ucauccaagcuuguauu

SEQ ID NO: 1634590 - RNA, 18 nt, Homo sapiens
ucaucccuuuuucugcua

SEQ ID NO: 1634591 - RNA, 18 nt, Homo sapiens
ucaucucccaccuagcag

SEQ ID NO: 1634592 - RNA, 13 nt, Homo sapiens
ucaucugugcacu

SEQ ID NO: 1634593 - RNA, 18 nt, Homo sapiens
ucaucuguggagcugcca

SEQ ID NO: 1634594 - RNA, 16 nt, Homo sapiens
ucaucuguuguagauu

SEQ ID NO: 1634595 - RNA, 18 nt, Homo sapiens
uccugccuuuaagccaaa

SEQ ID NO: 1634596 - RNA, 21 nt, Homo sapiens
uccugcuccguuccucaucca

SEQ ID NO: 1634597 - RNA, 13 nt, Homo sapiens
uccugcuguaaau

SEQ ID NO: 1634598 - RNA, 23 nt, Homo sapiens
uccuggcacagaagaggagucaa

SEQ ID NO: 1634599 - RNA, 19 nt, Homo sapiens
uccuggcuggccgcaugac

SEQ ID NO: 1634600 - RNA, 14 nt, Homo sapiens
uccugggucuacca

SEQ ID NO: 1634601 - RNA, 10 nt, Homo sapiens
uccugucagu

SEQ ID NO: 1634602 - RNA, 17 nt, Homo sapiens
uccuguguguacucugu

SEQ ID NO: 1634603 - RNA, 15 nt, Homo sapiens
uccuuaacacauuca

SEQ ID NO: 1634604 - RNA, 12 nt, Homo sapiens
uccuuaaguauu

SEQ ID NO: 1634605 - RNA, 14 nt, Homo sapiens
uccuuacaauguga

SEQ ID NO: 1634606 - RNA, 16 nt, Homo sapiens
uccuuaccgugggcac

SEQ ID NO: 1634607 - RNA, 19 nt, Homo sapiens
uccuuaccgugggcacuga

SEQ ID NO: 1634608 - RNA, 20 nt, Homo sapiens
uccuuaccgugggcacugaa

SEQ ID NO: 1634609 - RNA, 17 nt, Homo sapiens
uccuuaggccucugaga

SEQ ID NO: 1634610 - RNA, 18 nt, Homo sapiens
uccuuauugggacuuuuc

SEQ ID NO: 1634611 - RNA, 16 nt, Homo sapiens
uccuuauuucacugaa

SEQ ID NO: 1634612 - RNA, 16 nt, Homo sapiens
uccuuccacuaacuca

SEQ ID NO: 1634613 - RNA, 19 nt, Homo sapiens
uccuucgaaaggccuucag

SEQ ID NO: 1634614 - RNA, 18 nt, Homo sapiens
uccuucuggugucugcuu

SEQ ID NO: 1634615 - RNA, 13 nt, Homo sapiens
uccuugacuuuga

SEQ ID NO: 1634616 - RNA, 18 nt, Homo sapiens
uccuugauaaaguauuau

SEQ ID NO: 1634617 - RNA, 13 nt, Homo sapiens
uccuuggcuuuau

SEQ ID NO: 1634618 - RNA, 14 nt, Homo sapiens
uccuuggcuuuaug

SEQ ID NO: 1634619 - RNA, 20 nt, Homo sapiens
uccuuuaccuuucagugcag

SEQ ID NO: 1634620 - RNA, 22 nt, Homo sapiens
uccuuucaagguaacuguacug

SEQ ID NO: 1634621 - RNA, 14 nt, Homo sapiens
uccuuuucugucuc

SEQ ID NO: 1634622 - RNA, 14 nt, Homo sapiens
uccuuuucuucacc

SEQ ID NO: 1634623 - RNA, 14 nt, Homo sapiens
uccuuuuuuauucc

SEQ ID NO: 1634624 - RNA, 14 nt, Homo sapiens
ucgaagcuguuaau

SEQ ID NO: 1634625 - RNA, 19 nt, Homo sapiens
ucgauauuagaagcuauau

SEQ ID NO: 1634626 - RNA, 18 nt, Homo sapiens
ucgaugagaaauugaacu

SEQ ID NO: 1634627 - RNA, 23 nt, Homo sapiens
ucgaugauggaaauuagccacau

SEQ ID NO: 1634628 - RNA, 22 nt, Homo sapiens
ucgauggaugggaugcacucuc

SEQ ID NO: 1634629 - RNA, 17 nt, Homo sapiens
ucgccucauuacuguga

SEQ ID NO: 1634630 - RNA, 17 nt, Homo sapiens
ucggaggaaagggauug

SEQ ID NO: 1634631 - RNA, 18 nt, Homo sapiens
ucggcccuguuccccaag

SEQ ID NO: 1634632 - RNA, 17 nt, Homo sapiens
ucggcucacaaagagau

SEQ ID NO: 1634633 - RNA, 12 nt, Homo sapiens
ucggcuuuuugc

SEQ ID NO: 1634634 - RNA, 17 nt, Homo sapiens
ucgggccccauccucau

SEQ ID NO: 1634635 - RNA, 13 nt, Homo sapiens
ucggggucccugg

SEQ ID NO: 1634636 - RNA, 17 nt, Homo sapiens
ucguagagccuugacaa

SEQ ID NO: 1634637 - RNA, 18 nt, Homo sapiens
ucgucaucaggugcauag

SEQ ID NO: 1634638 - RNA, 14 nt, Homo sapiens
ucgugaaauugugc

SEQ ID NO: 1634639 - RNA, 19 nt, Homo sapiens
ucuaaaauguguuuuauca

SEQ ID NO: 1634640 - RNA, 16 nt, Homo sapiens
ucuaaaauucuauuau

SEQ ID NO: 1634641 - RNA, 22 nt, Homo sapiens
ucuaacaggaaaagagggagaa

SEQ ID NO: 1634642 - RNA, 22 nt, Homo sapiens
ucuaacugugcagaaaggcaga

SEQ ID NO: 1634643 - RNA, 16 nt, Homo sapiens
ucuaaguguacuucau

SEQ ID NO: 1634644 - RNA, 23 nt, Homo sapiens
ucuaaguguugugaaacuguaaa

SEQ ID NO: 1634645 - RNA, 16 nt, Homo sapiens
ucuaauaauaagucag

SEQ ID NO: 1634646 - RNA, 14 nt, Homo sapiens
ucuaaugugucucu

SEQ ID NO: 1634647 - RNA, 13 nt, Homo sapiens
ucuacagugccaa

SEQ ID NO: 1634648 - RNA, 20 nt, Homo sapiens
ucuacagugccaacuccuca

SEQ ID NO: 1634649 - RNA, 22 nt, Homo sapiens
ucuacauuaaaaugacaaacau

SEQ ID NO: 1634650 - RNA, 19 nt, Homo sapiens
ucuaccccuaaugcaaaua

SEQ ID NO: 1634651 - RNA, 18 nt, Homo sapiens
ucuacccguuccaaaagc

SEQ ID NO: 1634652 - RNA, 19 nt, Homo sapiens
ucuacccugccuguacuac

SEQ ID NO: 1634653 - RNA, 15 nt, Homo sapiens
ucuacgccaauguua

SEQ ID NO: 1634654 - RNA, 12 nt, Homo sapiens
ucuacugugaca

SEQ ID NO: 1634655 - RNA, 17 nt, Homo sapiens
ucuagcacacucuucuc

SEQ ID NO: 1634656 - RNA, 22 nt, Homo sapiens
ucuaggcugcugcacaccaagg

SEQ ID NO: 1634657 - RNA, 15 nt, Homo sapiens
ucuagguuauacaau

SEQ ID NO: 1634658 - RNA, 19 nt, Homo sapiens
ucuaguggguugaccuuua

SEQ ID NO: 1634659 - RNA, 17 nt, Homo sapiens
ucuauaccuuacugcaa

SEQ ID NO: 1634660 - RNA, 16 nt, Homo sapiens
ucuauaguugucagua

SEQ ID NO: 1634661 - RNA, 18 nt, Homo sapiens
ucuauauguacuugucaa

SEQ ID NO: 1634662 - RNA, 12 nt, Homo sapiens
ucuauuaaucaa

SEQ ID NO: 1634663 - RNA, 19 nt, Homo sapiens
uaauggcagagcagucuaa

SEQ ID NO: 1634664 - RNA, 18 nt, Homo sapiens
uaaugguuuuuaacaccu

SEQ ID NO: 1634665 - RNA, 19 nt, Homo sapiens
uaauguaaaauccauccaa

SEQ ID NO: 1634666 - RNA, 18 nt, Homo sapiens
uaauuaaaggagaagauu

SEQ ID NO: 1634667 - RNA, 17 nt, Homo sapiens
uaauuaccaguuuucca

SEQ ID NO: 1634668 - RNA, 20 nt, Homo sapiens
uaauucaguuauuugcacaa

SEQ ID NO: 1634669 - RNA, 17 nt, Homo sapiens
uaauuccuacagcacua

SEQ ID NO: 1634670 - RNA, 15 nt, Homo sapiens
uaauuggucauguga

SEQ ID NO: 1634671 - RNA, 16 nt, Homo sapiens
uaauuuaacacccuuu

SEQ ID NO: 1634672 - RNA, 13 nt, Homo sapiens
uaauuuauuucca

SEQ ID NO: 1634673 - RNA, 14 nt, Homo sapiens
uaauuuuacauguu

SEQ ID NO: 1634674 - RNA, 19 nt, Homo sapiens
uaauuuucuagauuuucua

SEQ ID NO: 1634675 - RNA, 15 nt, Homo sapiens
uacaaauacaugugu

SEQ ID NO: 1634676 - RNA, 16 nt, Homo sapiens
uacaaauagaauuuga

SEQ ID NO: 1634677 - RNA, 14 nt, Homo sapiens
uacaaauugugaug

SEQ ID NO: 1634678 - RNA, 17 nt, Homo sapiens
uacaacucggggacaaa

SEQ ID NO: 1634679 - RNA, 15 nt, Homo sapiens
uacaaucagcccagu

SEQ ID NO: 1634680 - RNA, 16 nt, Homo sapiens
uacaaucuuagugaau

SEQ ID NO: 1634681 - RNA, 22 nt, Homo sapiens
uacacagcucagcagacaucca

SEQ ID NO: 1634682 - RNA, 13 nt, Homo sapiens
uacacauacaugu

SEQ ID NO: 1634683 - RNA, 12 nt, Homo sapiens
uacaccacaaaa

SEQ ID NO: 1634684 - RNA, 15 nt, Homo sapiens
uacaccccagcuccu

SEQ ID NO: 1634685 - RNA, 12 nt, Homo sapiens
uacacuugcauc

SEQ ID NO: 1634686 - RNA, 13 nt, Homo sapiens
uacacuugugauu

SEQ ID NO: 1634687 - RNA, 13 nt, Homo sapiens
uacagacaucuaa

SEQ ID NO: 1634688 - RNA, 15 nt, Homo sapiens
uacagacaucuaaug

SEQ ID NO: 1634689 - RNA, 21 nt, Homo sapiens
uacagacuuuuuucuugucau

SEQ ID NO: 1634690 - RNA, 16 nt, Homo sapiens
uacagagcaccuguag

SEQ ID NO: 1634691 - RNA, 23 nt, Homo sapiens
uacagcaugugccuuaaugcuuc

SEQ ID NO: 1634692 - RNA, 15 nt, Homo sapiens
uacagcuuucacagu

SEQ ID NO: 1634693 - RNA, 15 nt, Homo sapiens
uacaggaggaugugu

SEQ ID NO: 1634694 - RNA, 15 nt, Homo sapiens
uagcuguacuguaau

SEQ ID NO: 1634695 - RNA, 12 nt, Homo sapiens
uagcuguuucaa

SEQ ID NO: 1634696 - RNA, 13 nt, Homo sapiens
uagcuuucaauuc

SEQ ID NO: 1634697 - RNA, 13 nt, Homo sapiens
uaggaacagccca

SEQ ID NO: 1634698 - RNA, 14 nt, Homo sapiens
uaggcacuguucaa

SEQ ID NO: 1634699 - RNA, 16 nt, Homo sapiens
uaggccaucucagcuu

SEQ ID NO: 1634700 - RNA, 13 nt, Homo sapiens
uaggucucagaga

SEQ ID NO: 1634701 - RNA, 16 nt, Homo sapiens
uaguagagcauaccac

SEQ ID NO: 1634702 - RNA, 18 nt, Homo sapiens
uaguagauuuuaaagaca

SEQ ID NO: 1634703 - RNA, 20 nt, Homo sapiens
uaguauuaauuuauguaucu

SEQ ID NO: 1634704 - RNA, 21 nt, Homo sapiens
uagucacauggccuaugcaca

SEQ ID NO: 1634705 - RNA, 15 nt, Homo sapiens
uagucaccuucauga

SEQ ID NO: 1634706 - RNA, 15 nt, Homo sapiens
uagucagaaaauugg

SEQ ID NO: 1634707 - RNA, 17 nt, Homo sapiens
uagucauuaauguguaa

SEQ ID NO: 1634708 - RNA, 16 nt, Homo sapiens
uagucgccccucagag

SEQ ID NO: 1634709 - RNA, 14 nt, Homo sapiens
uagugcaauuccaa

SEQ ID NO: 1634710 - RNA, 22 nt, Homo sapiens
uagugcugaugccuguguacug

SEQ ID NO: 1634711 - RNA, 18 nt, Homo sapiens
uaguguuguggacacugc

SEQ ID NO: 1634712 - RNA, 13 nt, Homo sapiens
uaguuaauggauu

SEQ ID NO: 1634713 - RNA, 22 nt, Homo sapiens
uaguuacaaaguuauauucaca

SEQ ID NO: 1634714 - RNA, 17 nt, Homo sapiens
uaguuacuccagugcca

SEQ ID NO: 1634715 - RNA, 14 nt, Homo sapiens
uaguuacugucagc

SEQ ID NO: 1634716 - RNA, 14 nt, Homo sapiens
uaguucagcugccc

SEQ ID NO: 1634717 - RNA, 22 nt, Homo sapiens
uaguugcguggacucugcacau

SEQ ID NO: 1634718 - RNA, 12 nt, Homo sapiens
uaguugcuguau

SEQ ID NO: 1634719 - RNA, 16 nt, Homo sapiens
uaguuggucuuuccau

SEQ ID NO: 1634720 - RNA, 19 nt, Homo sapiens
uaguuuuucuuacuugcau

SEQ ID NO: 1634721 - RNA, 23 nt, Homo sapiens
uauaaaacccuaggaugugcuag

SEQ ID NO: 1634722 - RNA, 15 nt, Homo sapiens
uauaaaauuaaucac

SEQ ID NO: 1634723 - RNA, 19 nt, Homo sapiens
uauaaauuguacauuuugu

SEQ ID NO: 1634724 - RNA, 22 nt, Homo sapiens
uauaagcccacuguuaauauuc

SEQ ID NO: 1634725 - RNA, 16 nt, Homo sapiens
uauaauacauccauuc

SEQ ID NO: 1634726 - RNA, 17 nt, Homo sapiens
uauaaucccagcacuuu

SEQ ID NO: 1634727 - RNA, 19 nt, Homo sapiens
uauaaugggauauaguuua

SEQ ID NO: 1634728 - RNA, 19 nt, Homo sapiens
uauacagaccuaauaucau

SEQ ID NO: 1634729 - RNA, 20 nt, Homo sapiens
uauacagauucgaaacucca

SEQ ID NO: 1634730 - RNA, 21 nt, Homo sapiens
uauacauagucuuuguuuaca

SEQ ID NO: 1634731 - RNA, 19 nt, Homo sapiens
uauaccagcuuguaugcaa

SEQ ID NO: 1634732 - RNA, 21 nt, Homo sapiens
uauagagggcuuaugauucag

SEQ ID NO: 1634733 - RNA, 14 nt, Homo sapiens
uauauaaacugugc

SEQ ID NO: 1634734 - RNA, 17 nt, Homo sapiens
uauauaauuuacuuugu

SEQ ID NO: 1634735 - RNA, 15 nt, Homo sapiens
uauaucuauauguac

SEQ ID NO: 1634736 - RNA, 13 nt, Homo sapiens
uauauguacuugu

SEQ ID NO: 1634737 - RNA, 13 nt, Homo sapiens
uauauugcaaggu

SEQ ID NO: 1634738 - RNA, 13 nt, Homo sapiens
uaucaagccauaa

SEQ ID NO: 1634739 - RNA, 20 nt, Homo sapiens
uaucacgggucacuugaaau

SEQ ID NO: 1634740 - RNA, 23 nt, Homo sapiens
uaucacugcauuaucuugcucau

SEQ ID NO: 1634741 - RNA, 21 nt, Homo sapiens
uaucacuucauucacauucag

SEQ ID NO: 1634742 - RNA, 18 nt, Homo sapiens
uaucagaaauagauuucc

SEQ ID NO: 1634743 - RNA, 11 nt, Homo sapiens
uaucaugcaaa

SEQ ID NO: 1634744 - RNA, 15 nt, Homo sapiens
uauccaauugcucuu

SEQ ID NO: 1634745 - RNA, 13 nt, Homo sapiens
uauccacuacucc

SEQ ID NO: 1634746 - RNA, 21 nt, Homo sapiens
uaucccucuccauaaccccac

SEQ ID NO: 1634747 - RNA, 20 nt, Homo sapiens
uaucucacaaauaaguaaua

SEQ ID NO: 1634748 - RNA, 17 nt, Homo sapiens
uaucugacagagcauca

SEQ ID NO: 1634749 - RNA, 21 nt, Homo sapiens
uaucugggugcaugaucuuga

SEQ ID NO: 1634750 - RNA, 17 nt, Homo sapiens
uaucugguuaaugacau

SEQ ID NO: 1634751 - RNA, 17 nt, Homo sapiens
uaucuuaaaggacauaa

SEQ ID NO: 1634752 - RNA, 19 nt, Homo sapiens
uaucuuagguagucaugcu

SEQ ID NO: 1634753 - RNA, 14 nt, Homo sapiens
uaucuuuaccuccu

SEQ ID NO: 1634754 - RNA, 20 nt, Homo sapiens
uaugaagaauacccaggaag

SEQ ID NO: 1634755 - RNA, 23 nt, Homo sapiens
uaugacagugaauauugcuuuua

SEQ ID NO: 1634756 - RNA, 21 nt, Homo sapiens
uaugagaguuuggaauuauug

SEQ ID NO: 1634757 - RNA, 17 nt, Homo sapiens
uaugaugaaaaccuaca

SEQ ID NO: 1634758 - RNA, 19 nt, Homo sapiens
uaugauuguuucucaaauc

SEQ ID NO: 1634759 - RNA, 16 nt, Homo sapiens
uaugcaaauacaauca

SEQ ID NO: 1634760 - RNA, 21 nt, Homo sapiens
uaugcaaaucaaacauauucu

SEQ ID NO: 1634761 - RNA, 14 nt, Homo sapiens
uaugcacauaugga

SEQ ID NO: 1634762 - RNA, 15 nt, Homo sapiens
uaugcauuauaucaa

SEQ ID NO: 1634763 - RNA, 18 nt, Homo sapiens
uaugcauuugcauuugcu

SEQ ID NO: 1634764 - RNA, 13 nt, Homo sapiens
uaugccuucuuau

SEQ ID NO: 1634765 - RNA, 14 nt, Homo sapiens
uaugcugugcuaaa

SEQ ID NO: 1634766 - RNA, 20 nt, Homo sapiens
uaugguacaagcaaugccug

SEQ ID NO: 1634767 - RNA, 16 nt, Homo sapiens
uauggugagaugcagc

SEQ ID NO: 1634768 - RNA, 12 nt, Homo sapiens
uauguaccauau

SEQ ID NO: 1634769 - RNA, 15 nt, Homo sapiens
uauguaccauaugau

SEQ ID NO: 1634770 - RNA, 15 nt, Homo sapiens
uauguacugccuuag

SEQ ID NO: 1634771 - RNA, 16 nt, Homo sapiens
gccccagucggcccca

SEQ ID NO: 1634772 - RNA, 14 nt, Homo sapiens
gccccauuuaccca

SEQ ID NO: 1634773 - RNA, 16 nt, Homo sapiens
gcccccagcccuggga

SEQ ID NO: 1634774 - RNA, 20 nt, Homo sapiens
gcccccauacuuggcugcuu

SEQ ID NO: 1634775 - RNA, 22 nt, Homo sapiens
gcccccuccaggagagagccag

SEQ ID NO: 1634776 - RNA, 19 nt, Homo sapiens
gccccguaguugcucuuuc

SEQ ID NO: 1634777 - RNA, 16 nt, Homo sapiens
gccccuuugccuguca

SEQ ID NO: 1634778 - RNA, 20 nt, Homo sapiens
gcccucauuacugggccuua

SEQ ID NO: 1634779 - RNA, 17 nt, Homo sapiens
gcccugcucuuccucag

SEQ ID NO: 1634780 - RNA, 19 nt, Homo sapiens
gcccugggaaccacuccca

SEQ ID NO: 1634781 - RNA, 18 nt, Homo sapiens
gcccugggacagggcaaa

SEQ ID NO: 1634782 - RNA, 20 nt, Homo sapiens
gcccugggacagggcaaaca

SEQ ID NO: 1634783 - RNA, 15 nt, Homo sapiens
gcccuguuagcuuuc

SEQ ID NO: 1634784 - RNA, 13 nt, Homo sapiens
gcccuuaccuguc

SEQ ID NO: 1634785 - RNA, 16 nt, Homo sapiens
gcccuucaagugcacu

SEQ ID NO: 1634786 - RNA, 20 nt, Homo sapiens
gccgggcagaggggcagaug

SEQ ID NO: 1634787 - RNA, 15 nt, Homo sapiens
gccuaacacacucca

SEQ ID NO: 1634788 - RNA, 13 nt, Homo sapiens
gccuaacacuggg

SEQ ID NO: 1634789 - RNA, 22 nt, Homo sapiens
gccuaccgcuggcccugccguu

SEQ ID NO: 1634790 - RNA, 21 nt, Homo sapiens
gccuacuuucacacuaagaaa

SEQ ID NO: 1634791 - RNA, 21 nt, Homo sapiens
gccucacuuccuuugcccuuc

SEQ ID NO: 1634792 - RNA, 15 nt, Homo sapiens
gccucauuacuguga

SEQ ID NO: 1634793 - RNA, 16 nt, Homo sapiens
gccucauuacugugag

SEQ ID NO: 1634794 - RNA, 17 nt, Homo sapiens
gccucauuacugugagg

SEQ ID NO: 1634795 - RNA, 16 nt, Homo sapiens
gccuccagcccucuca

SEQ ID NO: 1634796 - RNA, 16 nt, Homo sapiens
gccuccccguccaggc

SEQ ID NO: 1634797 - RNA, 23 nt, Homo sapiens
gccuccuggguucacaccauucu

SEQ ID NO: 1634798 - RNA, 14 nt, Homo sapiens
gccucuacugggaa

SEQ ID NO: 1634799 - RNA, 22 nt, Homo sapiens
gccugacuuggggagauggagu

SEQ ID NO: 1634800 - RNA, 14 nt, Homo sapiens
gccugaggcuguaa

SEQ ID NO: 1634801 - RNA, 21 nt, Homo sapiens
gccuggagccacagcagccac

SEQ ID NO: 1634802 - RNA, 19 nt, Homo sapiens
gccuggcauagaguaggua

SEQ ID NO: 1634803 - RNA, 13 nt, Homo sapiens
gccugggugcaaa

SEQ ID NO: 1634804 - RNA, 14 nt, Homo sapiens
gccugucucaguga

SEQ ID NO: 1634805 - RNA, 20 nt, Homo sapiens
gccuguggaaugagugugca

SEQ ID NO: 1634806 - RNA, 14 nt, Homo sapiens
gccuguguacugcc

SEQ ID NO: 1634807 - RNA, 18 nt, Homo sapiens
gccuguguacugccuuaa

SEQ ID NO: 1634808 - RNA, 17 nt, Homo sapiens
gccuguguagcugugac

SEQ ID NO: 1634809 - RNA, 20 nt, Homo sapiens
gccuuaaacacacauugcag

SEQ ID NO: 1634810 - RNA, 15 nt, Homo sapiens
gccuuagugggccag

SEQ ID NO: 1634811 - RNA, 16 nt, Homo sapiens
gccuuagugggccagg

SEQ ID NO: 1634812 - RNA, 17 nt, Homo sapiens
gccuucagcaugccuga

SEQ ID NO: 1634813 - RNA, 13 nt, Homo sapiens
gccuucaguuuau

SEQ ID NO: 1634814 - RNA, 22 nt, Homo sapiens
gccuucccugacacccugggcu

SEQ ID NO: 1634815 - RNA, 21 nt, Homo sapiens
gccuucccuugcccaugugaa

SEQ ID NO: 1634816 - RNA, 13 nt, Homo sapiens
gccuugcugugaa

SEQ ID NO: 1634817 - RNA, 18 nt, Homo sapiens
gccuuggggaggacaaaa

SEQ ID NO: 1634818 - RNA, 21 nt, Homo sapiens
gccuuuccugugugagaccca

SEQ ID NO: 1634819 - RNA, 20 nt, Homo sapiens
gccuuuuccacacgcauuaa

SEQ ID NO: 1634820 - RNA, 21 nt, Homo sapiens
gccuuuuuuccugggccagaa

SEQ ID NO: 1634821 - RNA, 15 nt, Homo sapiens
gcgauguaugcagcu

SEQ ID NO: 1634822 - RNA, 18 nt, Homo sapiens
gcgauucuccugccucag

SEQ ID NO: 1634823 - RNA, 20 nt, Homo sapiens
gcgccaggcugaccacagca

SEQ ID NO: 1634824 - RNA, 19 nt, Homo sapiens
gcgcccugcagacccugcc

SEQ ID NO: 1634825 - RNA, 14 nt, Homo sapiens
gcggacaguggcag

SEQ ID NO: 1634826 - RNA, 12 nt, Homo sapiens
gcguacacagag

SEQ ID NO: 1634827 - RNA, 15 nt, Homo sapiens
gcgucauuacagggc

SEQ ID NO: 1634828 - RNA, 20 nt, Homo sapiens
gcguccuuugaaccugugca

SEQ ID NO: 1634829 - RNA, 20 nt, Homo sapiens
gcgugcgccacuaugccuga

SEQ ID NO: 1634830 - RNA, 11 nt, Homo sapiens
gcgugugacag

SEQ ID NO: 1634831 - RNA, 23 nt, Homo sapiens
gcguuucauguagccagcagaac

SEQ ID NO: 1634832 - RNA, 13 nt, Homo sapiens
gcuaaaugugauc

SEQ ID NO: 1634833 - RNA, 17 nt, Homo sapiens
gcuaagauaccaaaacc

SEQ ID NO: 1634834 - RNA, 20 nt, Homo sapiens
gcuaauacccaguuacuuau

SEQ ID NO: 1634835 - RNA, 21 nt, Homo sapiens
gcuaaucaaagccagggucuc

SEQ ID NO: 1634836 - RNA, 15 nt, Homo sapiens
gcuacaccacucugg

SEQ ID NO: 1634837 - RNA, 22 nt, Homo sapiens
gcuaccaugacaaaaaggccaa

SEQ ID NO: 1634838 - RNA, 15 nt, Homo sapiens
gcuacccgcagaguu

SEQ ID NO: 1634839 - RNA, 22 nt, Homo sapiens
gcuacccgcagaguucucagaa

SEQ ID NO: 1634840 - RNA, 17 nt, Homo sapiens
gcuacuauguacugccu

SEQ ID NO: 1634841 - RNA, 18 nt, Homo sapiens
gcuacuauguacugccuu

SEQ ID NO: 1634842 - RNA, 23 nt, Homo sapiens
gcuacuuuugcaggauaauaauu

SEQ ID NO: 1634843 - RNA, 22 nt, Homo sapiens
gcuagacuaccggacacucguc

SEQ ID NO: 1634844 - RNA, 14 nt, Homo sapiens
gcuagagggacaaa

SEQ ID NO: 1634845 - RNA, 17 nt, Homo sapiens
gcuauaacuuacuucug

SEQ ID NO: 1634846 - RNA, 15 nt, Homo sapiens
gcuaucccacuguau

SEQ ID NO: 1634847 - RNA, 18 nt, Homo sapiens
gcuauguaaacaaaccac

SEQ ID NO: 1634848 - RNA, 16 nt, Homo sapiens
gcucaacuagcagaua

SEQ ID NO: 1634849 - RNA, 18 nt, Homo sapiens
gcucacaaccaccauuca

SEQ ID NO: 1634850 - RNA, 15 nt, Homo sapiens
gcucagaauaaggca

SEQ ID NO: 1634851 - RNA, 14 nt, Homo sapiens
gcucagaauugcac

SEQ ID NO: 1634852 - RNA, 16 nt, Homo sapiens
gcucagcagacaucca

SEQ ID NO: 1634853 - RNA, 17 nt, Homo sapiens
gcucaggccacugccca

SEQ ID NO: 1634854 - RNA, 12 nt, Homo sapiens
gcucaggugccu

SEQ ID NO: 1634855 - RNA, 20 nt, Homo sapiens
gcucaugucuauaaucccag

SEQ ID NO: 1634856 - RNA, 22 nt, Homo sapiens
gcucauuuuuucuucuccuaaa

SEQ ID NO: 1634857 - RNA, 16 nt, Homo sapiens
gcuccaaaccuucaca

SEQ ID NO: 1634858 - RNA, 14 nt, Homo sapiens
gcuccaggccugca

SEQ ID NO: 1634859 - RNA, 20 nt, Homo sapiens
gcuccauggcugccaucuca

SEQ ID NO: 1634860 - RNA, 19 nt, Homo sapiens
gcucccaggaucuccugcc

SEQ ID NO: 1634861 - RNA, 17 nt, Homo sapiens
gcucccagggccaugaa

SEQ ID NO: 1634862 - RNA, 15 nt, Homo sapiens
gcuccuccagggugu

SEQ ID NO: 1634863 - RNA, 22 nt, Homo sapiens
gcucgccccagcaggugcugac

SEQ ID NO: 1634864 - RNA, 23 nt, Homo sapiens
gcucuagccccagcgccaaagga

SEQ ID NO: 1634865 - RNA, 15 nt, Homo sapiens
gcucucugaguccug

SEQ ID NO: 1634866 - RNA, 20 nt, Homo sapiens
gcucucugucaggugugaua

SEQ ID NO: 1634867 - RNA, 22 nt, Homo sapiens
gcucuguauauauauauacuua

SEQ ID NO: 1634868 - RNA, 21 nt, Homo sapiens
gcucuuucaucucugcuugga

SEQ ID NO: 1634869 - RNA, 16 nt, Homo sapiens
gcugaagcuggugcgc

SEQ ID NO: 1634870 - RNA, 22 nt, Homo sapiens
gcugaugccuguguacugccuu

SEQ ID NO: 1634871 - RNA, 15 nt, Homo sapiens
gcugcaauacauuaa

SEQ ID NO: 1634872 - RNA, 21 nt, Homo sapiens
gcugcacucaagcuuggguga

SEQ ID NO: 1634873 - RNA, 18 nt, Homo sapiens
gcugcaggggcaugggaa

SEQ ID NO: 1634874 - RNA, 18 nt, Homo sapiens
gcugccaaacacccaugc

SEQ ID NO: 1634875 - RNA, 22 nt, Homo sapiens
gcugcuucuuauuaaucauaca

SEQ ID NO: 1634876 - RNA, 20 nt, Homo sapiens
gcuggaaaucaauacugcac

SEQ ID NO: 1634877 - RNA, 15 nt, Homo sapiens
gcuggaggcacccau

SEQ ID NO: 1634878 - RNA, 15 nt, Homo sapiens
gcuggagugcaaugg

SEQ ID NO: 1634879 - RNA, 20 nt, Homo sapiens
gcuggagugcaauggcgcga

SEQ ID NO: 1634880 - RNA, 21 nt, Homo sapiens
gagcacggacugucaguucuc

SEQ ID NO: 1634881 - RNA, 14 nt, Homo sapiens
gagcaguagcugga

SEQ ID NO: 1634882 - RNA, 21 nt, Homo sapiens
gagcaguggccaucauccucc

SEQ ID NO: 1634883 - RNA, 16 nt, Homo sapiens
gagcauaccacuugaa

SEQ ID NO: 1634884 - RNA, 21 nt, Homo sapiens
gagccaaagcuuaugugacau

SEQ ID NO: 1634885 - RNA, 18 nt, Homo sapiens
gagccaccagcaaagcgc

SEQ ID NO: 1634886 - RNA, 15 nt, Homo sapiens
gagccaccgugccca

SEQ ID NO: 1634887 - RNA, 18 nt, Homo sapiens
gagccaugacaagaacaa

SEQ ID NO: 1634888 - RNA, 19 nt, Homo sapiens
gagccucgcaacccgugcc

SEQ ID NO: 1634889 - RNA, 22 nt, Homo sapiens
gagccucgcuuuuucauccuuc

SEQ ID NO: 1634890 - RNA, 13 nt, Homo sapiens
gagcgcacaggga

SEQ ID NO: 1634891 - RNA, 22 nt, Homo sapiens
gagcugaucagccugugccaca

SEQ ID NO: 1634892 - RNA, 19 nt, Homo sapiens
gagcuugcaugcuugcaua

SEQ ID NO: 1634893 - RNA, 17 nt, Homo sapiens
gcacacucuucucuuga

SEQ ID NO: 1634894 - RNA, 19 nt, Homo sapiens
gcacagggcuguaaaugca

SEQ ID NO: 1634895 - RNA, 21 nt, Homo sapiens
gcacauauggacucugcacau

SEQ ID NO: 1634896 - RNA, 16 nt, Homo sapiens
gcacauccaggcaaug

SEQ ID NO: 1634897 - RNA, 15 nt, Homo sapiens
gcacaugucuuguac

SEQ ID NO: 1634898 - RNA, 19 nt, Homo sapiens
gcaccacuugacagacugu

SEQ ID NO: 1634899 - RNA, 17 nt, Homo sapiens
gcaccauugaacuguac

SEQ ID NO: 1634900 - RNA, 19 nt, Homo sapiens
gcaccauugaacuguacca

SEQ ID NO: 1634901 - RNA, 16 nt, Homo sapiens
gcaccuucacucucca

SEQ ID NO: 1634902 - RNA, 14 nt, Homo sapiens
gcacuacaguuuua

SEQ ID NO: 1634903 - RNA, 18 nt, Homo sapiens
gcacuacugggugucauu

SEQ ID NO: 1634904 - RNA, 17 nt, Homo sapiens
gcacugcccauggacag

SEQ ID NO: 1634905 - RNA, 19 nt, Homo sapiens
gcacugugacccccagcuc

SEQ ID NO: 1634906 - RNA, 12 nt, Homo sapiens
gcacuguucaau

SEQ ID NO: 1634907 - RNA, 22 nt, Homo sapiens
gcagaaucccggcugucaaggg

SEQ ID NO: 1634908 - RNA, 20 nt, Homo sapiens
gcagaauguuguacuugaaa

SEQ ID NO: 1634909 - RNA, 14 nt, Homo sapiens
gcagaccugacucu

SEQ ID NO: 1634910 - RNA, 19 nt, Homo sapiens
gcagagcagacaggcuaca

SEQ ID NO: 1634911 - RNA, 16 nt, Homo sapiens
gcagaguucuauaaug

SEQ ID NO: 1634912 - RNA, 23 nt, Homo sapiens
gcagauggccuuguugcuggcau

SEQ ID NO: 1634913 - RNA, 11 nt, Homo sapiens
gcagcacuccc

SEQ ID NO: 1634914 - RNA, 12 nt, Homo sapiens
gcagcacucccc

SEQ ID NO: 1634915 - RNA, 20 nt, Homo sapiens
gcagcauugccauaccauuc

SEQ ID NO: 1634916 - RNA, 19 nt, Homo sapiens
gcagccacgaggugcaaca

SEQ ID NO: 1634917 - RNA, 19 nt, Homo sapiens
gcagcccucggguccaugu

SEQ ID NO: 1634918 - RNA, 19 nt, Homo sapiens
gcagccucaaaacggguca

SEQ ID NO: 1634919 - RNA, 20 nt, Homo sapiens
gcaggaguagcugagcucac

SEQ ID NO: 1634920 - RNA, 16 nt, Homo sapiens
gcaggaguggugcaga

SEQ ID NO: 1634921 - RNA, 15 nt, Homo sapiens
gcagggcagacugca

SEQ ID NO: 1634922 - RNA, 18 nt, Homo sapiens
gcagggcccagugacaag

SEQ ID NO: 1634923 - RNA, 16 nt, Homo sapiens
gcagguucccaagcuc

SEQ ID NO: 1634924 - RNA, 20 nt, Homo sapiens
gcagguuccccaagggcccu

SEQ ID NO: 1634925 - RNA, 21 nt, Homo sapiens
gcaguaucaugcccugugcaa

SEQ ID NO: 1634926 - RNA, 12 nt, Homo sapiens
gcaguccaucua

SEQ ID NO: 1634927 - RNA, 14 nt, Homo sapiens
gcagucuaauuaca

SEQ ID NO: 1634928 - RNA, 21 nt, Homo sapiens
gcagucuaauuacauuucacu

SEQ ID NO: 1634929 - RNA, 22 nt, Homo sapiens
gcaguucgcagccacccugagg

SEQ ID NO: 1634930 - RNA, 22 nt, Homo sapiens
gcaguuuuacuaaaacacugaa

SEQ ID NO: 1634931 - RNA, 17 nt, Homo sapiens
gcauaaaaaucacuggg

SEQ ID NO: 1634932 - RNA, 13 nt, Homo sapiens
gcauaaagcaauu

SEQ ID NO: 1634933 - RNA, 20 nt, Homo sapiens
gcauaccugucucagcuguu

SEQ ID NO: 1634934 - RNA, 20 nt, Homo sapiens
gcauaguauuccauggugua

SEQ ID NO: 1634935 - RNA, 14 nt, Homo sapiens
gcauauagacugua

SEQ ID NO: 1634936 - RNA, 23 nt, Homo sapiens
gcauauuguacccccucauuugu

SEQ ID NO: 1634937 - RNA, 16 nt, Homo sapiens
gcaucagauggaagcu

SEQ ID NO: 1634938 - RNA, 15 nt, Homo sapiens
gcaucugucugcucu

SEQ ID NO: 1634939 - RNA, 23 nt, Homo sapiens
gcaugagucuguuucccaagcua

SEQ ID NO: 1634940 - RNA, 23 nt, Homo sapiens
gcaugaugcgggccagugcucca

SEQ ID NO: 1634941 - RNA, 17 nt, Homo sapiens
gcauggaacagcauuac

SEQ ID NO: 1634942 - RNA, 18 nt, Homo sapiens
gcauggucaagccucuua

SEQ ID NO: 1634943 - RNA, 18 nt, Homo sapiens
gcauguaaaaaccuugua

SEQ ID NO: 1634944 - RNA, 21 nt, Homo sapiens
gcaugugaagaaaggguguuu

SEQ ID NO: 1634945 - RNA, 22 nt, Homo sapiens
gcauguuuugcccaccagauca

SEQ ID NO: 1634946 - RNA, 19 nt, Homo sapiens
gcauucauuuuuauagcaa

SEQ ID NO: 1634947 - RNA, 17 nt, Homo sapiens
gcauuguaucgauguua

SEQ ID NO: 1634948 - RNA, 22 nt, Homo sapiens
gcauuuauuuaagacacuguua

SEQ ID NO: 1634949 - RNA, 22 nt, Homo sapiens
gccaaacaaaacugaaccacaa

SEQ ID NO: 1634950 - RNA, 19 nt, Homo sapiens
gccaaccuggaauggagac

SEQ ID NO: 1634951 - RNA, 19 nt, Homo sapiens
gccaaucccgccaugcuca

SEQ ID NO: 1634952 - RNA, 22 nt, Homo sapiens
gccacacucagcacaaggccau

SEQ ID NO: 1634953 - RNA, 15 nt, Homo sapiens
gccacagagaaguuu

SEQ ID NO: 1634954 - RNA, 17 nt, Homo sapiens
gccacaguagaacuguc

SEQ ID NO: 1634955 - RNA, 19 nt, Homo sapiens
gccacauuuucuuaaucca

SEQ ID NO: 1634956 - RNA, 11 nt, Homo sapiens
gccacccaaga

SEQ ID NO: 1634957 - RNA, 16 nt, Homo sapiens
gccacgaggugcaaca

SEQ ID NO: 1634958 - RNA, 21 nt, Homo sapiens
gccacucuuagcuaaaucccu

SEQ ID NO: 1634959 - RNA, 23 nt, Homo sapiens
gccagaccagcaggcuggccuau

SEQ ID NO: 1634960 - RNA, 18 nt, Homo sapiens
gccagcacacagggcagu

SEQ ID NO: 1634961 - RNA, 19 nt, Homo sapiens
gccagcagagcuuagcuuc

SEQ ID NO: 1634962 - RNA, 14 nt, Homo sapiens
gccagccacaggac

SEQ ID NO: 1634963 - RNA, 21 nt, Homo sapiens
gccagcccucgguaucugcag

SEQ ID NO: 1634964 - RNA, 22 nt, Homo sapiens
gccagcuuacuagcacuuugag

SEQ ID NO: 1634965 - RNA, 13 nt, Homo sapiens
gccaggcacuuug

SEQ ID NO: 1634966 - RNA, 21 nt, Homo sapiens
gccaggccuaguaaccaaggc

SEQ ID NO: 1634967 - RNA, 16 nt, Homo sapiens
gccagggcugcccuga

SEQ ID NO: 1634968 - RNA, 14 nt, Homo sapiens
gccauaugccuugg

SEQ ID NO: 1634969 - RNA, 14 nt, Homo sapiens
gccaucaagggaau

SEQ ID NO: 1634970 - RNA, 19 nt, Homo sapiens
gccauccagaugugugcaa

SEQ ID NO: 1634971 - RNA, 21 nt, Homo sapiens
gccauccccaccuucaccucg

SEQ ID NO: 1634972 - RNA, 22 nt, Homo sapiens
gccaucugacugccaagccaga

SEQ ID NO: 1634973 - RNA, 15 nt, Homo sapiens
gccaugcugggccac

SEQ ID NO: 1634974 - RNA, 19 nt, Homo sapiens
gccauggauggaaaacgcu

SEQ ID NO: 1634975 - RNA, 23 nt, Homo sapiens
gccauguugugccucccugguga

SEQ ID NO: 1634976 - RNA, 17 nt, Homo sapiens
gccauucucccccucag

SEQ ID NO: 1634977 - RNA, 23 nt, Homo sapiens
gcccacguggaggcccaccugcc

SEQ ID NO: 1634978 - RNA, 22 nt, Homo sapiens
gcccacuccgccagccacagga

SEQ ID NO: 1634979 - RNA, 19 nt, Homo sapiens
gcccacuguuaauauucua

SEQ ID NO: 1634980 - RNA, 15 nt, Homo sapiens
gcccagagccuggcu

SEQ ID NO: 1634981 - RNA, 18 nt, Homo sapiens
gcccagcucgucccggcc

SEQ ID NO: 1634982 - RNA, 20 nt, Homo sapiens
gcccaggaucagauugcaug

SEQ ID NO: 1634983 - RNA, 24 nt, Homo sapiens
gcccaggucccuccucagaccucc

SEQ ID NO: 1634984 - RNA, 19 nt, Homo sapiens
gcccaugaugagaagcaga

SEQ ID NO: 1634985 - RNA, 21 nt, Homo sapiens
gcccauggaggcagaugcccu

SEQ ID NO: 1634986 - RNA, 19 nt, Homo sapiens
gaaucccgucggcuucucg

SEQ ID NO: 1634987 - RNA, 14 nt, Homo sapiens
gaaucuaaaugaag

SEQ ID NO: 1634988 - RNA, 14 nt, Homo sapiens
gaaucuauuucacu

SEQ ID NO: 1634989 - RNA, 12 nt, Homo sapiens
gaaucuuuacaa

SEQ ID NO: 1634990 - RNA, 19 nt, Homo sapiens
gaaugagagcgacacagac

SEQ ID NO: 1634991 - RNA, 14 nt, Homo sapiens
gaaugguguaggaa

SEQ ID NO: 1634992 - RNA, 21 nt, Homo sapiens
gaaugugcacucucugcuuag

SEQ ID NO: 1634993 - RNA, 15 nt, Homo sapiens
gaauguggucucagg

SEQ ID NO: 1634994 - RNA, 23 nt, Homo sapiens
gaauguuccuuucgaaagcaaug

SEQ ID NO: 1634995 - RNA, 14 nt, Homo sapiens
gaauuauuacaauu

SEQ ID NO: 1634996 - RNA, 22 nt, Homo sapiens
cuuuuccugaauuggaaaggaa

SEQ ID NO: 1634997 - RNA, 18 nt, Homo sapiens
cuuuucuugauaggccua

SEQ ID NO: 1634998 - RNA, 18 nt, Homo sapiens
cuuuugcaggauaauaau

SEQ ID NO: 1634999 - RNA, 20 nt, Homo sapiens
cuuuugccacaucccuauag

SEQ ID NO: 1635000 - RNA, 12 nt, Homo sapiens
cuuuuguugccc

SEQ ID NO: 1635001 - RNA, 13 nt, Homo sapiens
cuuuuuaugcauu

SEQ ID NO: 1635002 - RNA, 16 nt, Homo sapiens
cuuuuucuuguauuca

SEQ ID NO: 1635003 - RNA, 15 nt, Homo sapiens
cuggacuguuucaua

SEQ ID NO: 1635004 - RNA, 16 nt, Homo sapiens
cuggagaucagcaugc

SEQ ID NO: 1635005 - RNA, 17 nt, Homo sapiens
cuggagcucaucugcaa

SEQ ID NO: 1635006 - RNA, 22 nt, Homo sapiens
cuucaggaagcauaaagcaauu

SEQ ID NO: 1635007 - RNA, 21 nt, Homo sapiens
cuucaguucugcuugcuccca

SEQ ID NO: 1635008 - RNA, 20 nt, Homo sapiens
cuucauaagauauucuuuac

SEQ ID NO: 1635009 - RNA, 22 nt, Homo sapiens
cuucauaagauauucuuuacaa

SEQ ID NO: 1635010 - RNA, 17 nt, Homo sapiens
cuucauucacauucaga

SEQ ID NO: 1635011 - RNA, 22 nt, Homo sapiens
cuucauuccuuccacuaacuca

SEQ ID NO: 1635012 - RNA, 20 nt, Homo sapiens
cuuccaauaguuagaucuac

SEQ ID NO: 1635013 - RNA, 23 nt, Homo sapiens
cuucccagagggauugcugugaa

SEQ ID NO: 1635014 - RNA, 14 nt, Homo sapiens
cuuccccaaaggaa

SEQ ID NO: 1635015 - RNA, 16 nt, Homo sapiens
cuuccccaacgaaaag

SEQ ID NO: 1635016 - RNA, 14 nt, Homo sapiens
cuucccuauaggaa

SEQ ID NO: 1635017 - RNA, 14 nt, Homo sapiens
cuucccuugcucau

SEQ ID NO: 1635018 - RNA, 22 nt, Homo sapiens
cuuccgcugaggggucucggau

SEQ ID NO: 1635019 - RNA, 23 nt, Homo sapiens
cuuccuuaccgugggcacugaag

SEQ ID NO: 1635020 - RNA, 18 nt, Homo sapiens
cuuccuuuuaacugccaa

SEQ ID NO: 1635021 - RNA, 12 nt, Homo sapiens
cuucgcacacac

SEQ ID NO: 1635022 - RNA, 13 nt, Homo sapiens
cuucuauuaauca

SEQ ID NO: 1635023 - RNA, 14 nt, Homo sapiens
cuucuauuaaucaa

SEQ ID NO: 1635024 - RNA, 17 nt, Homo sapiens
cuucuccguacacccca

SEQ ID NO: 1635025 - RNA, 17 nt, Homo sapiens
cuucucucacuguguua

SEQ ID NO: 1635026 - RNA, 23 nt, Homo sapiens
cuucugcaggaucccuacugcca

SEQ ID NO: 1635027 - RNA, 15 nt, Homo sapiens
cuucuuacuggugcu

SEQ ID NO: 1635028 - RNA, 17 nt, Homo sapiens
cuucuuuccuuguucag

SEQ ID NO: 1635029 - RNA, 13 nt, Homo sapiens
cuugaacccaaga

SEQ ID NO: 1635030 - RNA, 13 nt, Homo sapiens
cuugaaguacuua

SEQ ID NO: 1635031 - RNA, 13 nt, Homo sapiens
cuugaaugugguc

SEQ ID NO: 1635032 - RNA, 15 nt, Homo sapiens
cuugacauguagcuu

SEQ ID NO: 1635033 - RNA, 22 nt, Homo sapiens
cuugaccuaaugagguagcuau

SEQ ID NO: 1635034 - RNA, 23 nt, Homo sapiens
cuugacugaagcgaacaucuuca

SEQ ID NO: 1635035 - RNA, 14 nt, Homo sapiens
cuugaggaucauau

SEQ ID NO: 1635036 - RNA, 17 nt, Homo sapiens
cuugaggaucauaugaa

SEQ ID NO: 1635037 - RNA, 19 nt, Homo sapiens
cuugagucuccaacggcaa

SEQ ID NO: 1635038 - RNA, 16 nt, Homo sapiens
cuugaugccauaugcc

SEQ ID NO: 1635039 - RNA, 21 nt, Homo sapiens
cuugauuuuuuuaaacauaag

SEQ ID NO: 1635040 - RNA, 14 nt, Homo sapiens
cuugcaaagccuuu

SEQ ID NO: 1635041 - RNA, 15 nt, Homo sapiens
cuugcaaagccuuua

SEQ ID NO: 1635042 - RNA, 11 nt, Homo sapiens
cuugcauuuau

SEQ ID NO: 1635043 - RNA, 21 nt, Homo sapiens
cuugccuugggaccauggcca

SEQ ID NO: 1635044 - RNA, 20 nt, Homo sapiens
cuugcuggaaaacccaaagu

SEQ ID NO: 1635045 - RNA, 23 nt, Homo sapiens
cuugcuuuccugggccuuugcaa

SEQ ID NO: 1635046 - RNA, 21 nt, Homo sapiens
cuuggaaauuggaagagcaca

SEQ ID NO: 1635047 - RNA, 13 nt, Homo sapiens
cuuggaagccagg

SEQ ID NO: 1635048 - RNA, 14 nt, Homo sapiens
cuuggcuuuaugca

SEQ ID NO: 1635049 - RNA, 15 nt, Homo sapiens
cuuggcuuuaugcaa

SEQ ID NO: 1635050 - RNA, 16 nt, Homo sapiens
cuuggcuuuaugcaaa

SEQ ID NO: 1635051 - RNA, 19 nt, Homo sapiens
cuuggcuuuaugcaaauac

SEQ ID NO: 1635052 - RNA, 20 nt, Homo sapiens
cuuggcuuuaugcaaauaca

SEQ ID NO: 1635053 - RNA, 21 nt, Homo sapiens
cuuggcuuuaugcaaauacaa

SEQ ID NO: 1635054 - RNA, 18 nt, Homo sapiens
cuuggucccacaggccac

SEQ ID NO: 1635055 - RNA, 15 nt, Homo sapiens
cuuguagacucagaa

SEQ ID NO: 1635056 - RNA, 12 nt, Homo sapiens
cuuguaugcuuc

SEQ ID NO: 1635057 - RNA, 14 nt, Homo sapiens
cuugucagacauaa

SEQ ID NO: 1635058 - RNA, 21 nt, Homo sapiens
cuugucagacauaaagccaug

SEQ ID NO: 1635059 - RNA, 14 nt, Homo sapiens
cuuguggguccaug

SEQ ID NO: 1635060 - RNA, 22 nt, Homo sapiens
cuuguucagcaggcuagacaga

SEQ ID NO: 1635061 - RNA, 20 nt, Homo sapiens
cuuguucuauuuuucaauca

SEQ ID NO: 1635062 - RNA, 18 nt, Homo sapiens
cuuguucucacugucugu

SEQ ID NO: 1635063 - RNA, 22 nt, Homo sapiens
cuuguucugucaccaauguacc

SEQ ID NO: 1635064 - RNA, 19 nt, Homo sapiens
cuuuaaaaaaaaaucuugu

SEQ ID NO: 1635065 - RNA, 20 nt, Homo sapiens
cuuuaaaauauaucuggaac

SEQ ID NO: 1635066 - RNA, 22 nt, Homo sapiens
cuuuaaccccaaauuuggcuaa

SEQ ID NO: 1635067 - RNA, 20 nt, Homo sapiens
cuuuaaguuaagugcauuga

SEQ ID NO: 1635068 - RNA, 22 nt, Homo sapiens
cuuuaaugaauaaacauuugua

SEQ ID NO: 1635069 - RNA, 18 nt, Homo sapiens
cuuuaucuaauaccucug

SEQ ID NO: 1635070 - RNA, 20 nt, Homo sapiens
cuuuaucuuuuaagcuaucu

SEQ ID NO: 1635071 - RNA, 12 nt, Homo sapiens
cuuuaugcaaau

SEQ ID NO: 1635072 - RNA, 19 nt, Homo sapiens
cuuuaugcaaauacaauca

SEQ ID NO: 1635073 - RNA, 20 nt, Homo sapiens
cuuuaugcaaauacaaucag

SEQ ID NO: 1635074 - RNA, 14 nt, Homo sapiens
cuuuauuaaguaaa

SEQ ID NO: 1635075 - RNA, 17 nt, Homo sapiens
cuuuauuuguaaaccau

SEQ ID NO: 1635076 - RNA, 23 nt, Homo sapiens
cuuuauuuuaaaaaacacugaua

SEQ ID NO: 1635077 - RNA, 15 nt, Homo sapiens
cuuucaaguguccug

SEQ ID NO: 1635078 - RNA, 18 nt, Homo sapiens
cuuucagcgaaugacaaa

SEQ ID NO: 1635079 - RNA, 21 nt, Homo sapiens
cuuucaggggcugacucucca

SEQ ID NO: 1635080 - RNA, 19 nt, Homo sapiens
cuuuccaaugccacagaca

SEQ ID NO: 1635081 - RNA, 23 nt, Homo sapiens
cuuucccgcccagccucacuucc

SEQ ID NO: 1635082 - RNA, 21 nt, Homo sapiens
cuuuccgaggccccugucuca

SEQ ID NO: 1635083 - RNA, 14 nt, Homo sapiens
cuuuccugcucugg

SEQ ID NO: 1635084 - RNA, 13 nt, Homo sapiens
cuuuccuguucca

SEQ ID NO: 1635085 - RNA, 22 nt, Homo sapiens
cuuuccuguuucuaucuuucau

SEQ ID NO: 1635086 - RNA, 12 nt, Homo sapiens
cuuuccuuucaa

SEQ ID NO: 1635087 - RNA, 15 nt, Homo sapiens
cuuucgaaagcaaug

SEQ ID NO: 1635088 - RNA, 15 nt, Homo sapiens
cuuucgguacuguaa

SEQ ID NO: 1635089 - RNA, 13 nt, Homo sapiens
cuuucuguuuccu

SEQ ID NO: 1635090 - RNA, 16 nt, Homo sapiens
cuuucuuaucuggaaa

SEQ ID NO: 1635091 - RNA, 12 nt, Homo sapiens
cuuugcaaagac

SEQ ID NO: 1635092 - RNA, 13 nt, Homo sapiens
cuuugcaaagacc

SEQ ID NO: 1635093 - RNA, 17 nt, Homo sapiens
cuuuggaaaccaagcaa

SEQ ID NO: 1635094 - RNA, 20 nt, Homo sapiens
cuuuggauccugggucaaaa

SEQ ID NO: 1635095 - RNA, 22 nt, Homo sapiens
cuuugggcacggcccuccuucu

SEQ ID NO: 1635096 - RNA, 20 nt, Homo sapiens
cuuuguaauaucuaaaaacu

SEQ ID NO: 1635097 - RNA, 19 nt, Homo sapiens
cuuuguucaaauguacuau

SEQ ID NO: 1635098 - RNA, 19 nt, Homo sapiens
cuuuguuuacaugaguuca

SEQ ID NO: 1635099 - RNA, 19 nt, Homo sapiens
cuuuuaaaaugcaauguaa

SEQ ID NO: 1635100 - RNA, 16 nt, Homo sapiens
cuuuuaacugccaaga

SEQ ID NO: 1635101 - RNA, 19 nt, Homo sapiens
cuuuuaagguuucaacaaa

SEQ ID NO: 1635102 - RNA, 16 nt, Homo sapiens
cuuuuacuaagcacug

SEQ ID NO: 1635103 - RNA, 14 nt, Homo sapiens
cuuuuaucucacaa

SEQ ID NO: 1635104 - RNA, 15 nt, Homo sapiens
cuuuuaucucacaaa

SEQ ID NO: 1635105 - RNA, 21 nt, Homo sapiens
cuuuuaugauauauauaugcu

SEQ ID NO: 1635106 - RNA, 21 nt, Homo sapiens
cuuuuauguguugaugacuca

SEQ ID NO: 1635107 - RNA, 19 nt, Homo sapiens
cuuuucaaaauauuacuca

SEQ ID NO: 1635108 - RNA, 19 nt, Homo sapiens
cuuuucauuaagaaaacaa

SEQ ID NO: 1635109 - RNA, 19 nt, Homo sapiens
cuuuuccacacgcauuaau

SEQ ID NO: 1635110 - RNA, 18 nt, Homo sapiens
ccagaugagaagucugcu

SEQ ID NO: 1635111 - RNA, 16 nt, Homo sapiens
ccagcacuuugggagg

SEQ ID NO: 1635112 - RNA, 13 nt, Homo sapiens
ccagcaucuccca

SEQ ID NO: 1635113 - RNA, 14 nt, Homo sapiens
ccagccacacuuga

SEQ ID NO: 1635114 - RNA, 21 nt, Homo sapiens
ccagccagaggcaucugaggg

SEQ ID NO: 1635115 - RNA, 23 nt, Homo sapiens
ccagcccauugcugccaaggugg

SEQ ID NO: 1635116 - RNA, 23 nt, Homo sapiens
ccagcugcgccugcgcugcagga

SEQ ID NO: 1635117 - RNA, 18 nt, Homo sapiens
ccagcuuacuagcacuuu

SEQ ID NO: 1635118 - RNA, 22 nt, Homo sapiens
ccaggacggggcacaaguguca

SEQ ID NO: 1635119 - RNA, 23 nt, Homo sapiens
ccaggagaagaaagaggugaccc

SEQ ID NO: 1635120 - RNA, 13 nt, Homo sapiens
ccaggcaugcaau

SEQ ID NO: 1635121 - RNA, 16 nt, Homo sapiens
ccaggccccaccccuu

SEQ ID NO: 1635122 - RNA, 17 nt, Homo sapiens
ccaggccugggugaucu

SEQ ID NO: 1635123 - RNA, 19 nt, Homo sapiens
ccaggcugaccacagcaca

SEQ ID NO: 1635124 - RNA, 19 nt, Homo sapiens
ccaggcuggagugcaaugg

SEQ ID NO: 1635125 - RNA, 23 nt, Homo sapiens
ccagggauggccccuagccacag

SEQ ID NO: 1635126 - RNA, 21 nt, Homo sapiens
ccagggccagagcagcuccac

SEQ ID NO: 1635127 - RNA, 20 nt, Homo sapiens
ccagggcccucccagcccau

SEQ ID NO: 1635128 - RNA, 17 nt, Homo sapiens
ccaggguggagugcagu

SEQ ID NO: 1635129 - RNA, 18 nt, Homo sapiens
ccagguguggaacagccc

SEQ ID NO: 1635130 - RNA, 17 nt, Homo sapiens
ccagucacuuugccaga

SEQ ID NO: 1635131 - RNA, 11 nt, Homo sapiens
ccagucuuccu

SEQ ID NO: 1635132 - RNA, 17 nt, Homo sapiens
ccagugacgcugcugac

SEQ ID NO: 1635133 - RNA, 11 nt, Homo sapiens
ccagugcucca

SEQ ID NO: 1635134 - RNA, 14 nt, Homo sapiens
ccagugucacuuga

SEQ ID NO: 1635135 - RNA, 11 nt, Homo sapiens
ccagugucugu

SEQ ID NO: 1635136 - RNA, 15 nt, Homo sapiens
ccauaaaaggugugu

SEQ ID NO: 1635137 - RNA, 16 nt, Homo sapiens
ccauagucacauggcc

SEQ ID NO: 1635138 - RNA, 16 nt, Homo sapiens
ccaucaccauuuggug

SEQ ID NO: 1635139 - RNA, 20 nt, Homo sapiens
ccaucagcaaauauuauucu

SEQ ID NO: 1635140 - RNA, 16 nt, Homo sapiens
ccauccuggggcagca

SEQ ID NO: 1635141 - RNA, 21 nt, Homo sapiens
ccauccuugacuuugaacuaa

SEQ ID NO: 1635142 - RNA, 23 nt, Homo sapiens
ccaucugggcuccuccagggugu

SEQ ID NO: 1635143 - RNA, 15 nt, Homo sapiens
ccaugaacuuaaaau

SEQ ID NO: 1635144 - RNA, 22 nt, Homo sapiens
ccaugacaagaacaaagccacu

SEQ ID NO: 1635145 - RNA, 19 nt, Homo sapiens
ccaugacgacauacaugcu

SEQ ID NO: 1635146 - RNA, 13 nt, Homo sapiens
ccaugacugagaa

SEQ ID NO: 1635147 - RNA, 23 nt, Homo sapiens
ccaugcacccucauacacagaaa

SEQ ID NO: 1635148 - RNA, 14 nt, Homo sapiens
ccauggacaggcug

SEQ ID NO: 1635149 - RNA, 22 nt, Homo sapiens
ccauggagacaagggcaucauc

SEQ ID NO: 1635150 - RNA, 14 nt, Homo sapiens
ccauggaguugcca

SEQ ID NO: 1635151 - RNA, 16 nt, Homo sapiens
ccauggccaccccaga

SEQ ID NO: 1635152 - RNA, 13 nt, Homo sapiens
ccauguaaccacu

SEQ ID NO: 1635153 - RNA, 20 nt, Homo sapiens
ccaugugcuacaggggccag

SEQ ID NO: 1635154 - RNA, 18 nt, Homo sapiens
ccauuagagaaguauuua

SEQ ID NO: 1635155 - RNA, 20 nt, Homo sapiens
ccauucaggucuuucuuucc

SEQ ID NO: 1635156 - RNA, 18 nt, Homo sapiens
ccauugcuccauucacuc

SEQ ID NO: 1635157 - RNA, 21 nt, Homo sapiens
ccauuggaauggaccuuucag

SEQ ID NO: 1635158 - RNA, 16 nt, Homo sapiens
ccauuguuugaaacaa

SEQ ID NO: 1635159 - RNA, 20 nt, Homo sapiens
ccauuguuugaaacaaagaa

SEQ ID NO: 1635160 - RNA, 22 nt, Homo sapiens
ccauuuccuccuuuaccuuuca

SEQ ID NO: 1635161 - RNA, 15 nt, Homo sapiens
ccauuuuggugcuua

SEQ ID NO: 1635162 - RNA, 15 nt, Homo sapiens
cccaaagcacuugcu

SEQ ID NO: 1635163 - RNA, 14 nt, Homo sapiens
cccaacgaaaagca

SEQ ID NO: 1635164 - RNA, 22 nt, Homo sapiens
cccaacuccccuccgucuguga

SEQ ID NO: 1635165 - RNA, 18 nt, Homo sapiens
cccaacuccuuccagcua

SEQ ID NO: 1635166 - RNA, 23 nt, Homo sapiens
cccaagaucugccagaccugcau

SEQ ID NO: 1635167 - RNA, 17 nt, Homo sapiens
cccaaggacucuuccac

SEQ ID NO: 1635168 - RNA, 18 nt, Homo sapiens
cccaaucaccuuuccugu

SEQ ID NO: 1635169 - RNA, 18 nt, Homo sapiens
cccaaucugccuuugaau

SEQ ID NO: 1635170 - RNA, 17 nt, Homo sapiens
cccacagguguguuucc

SEQ ID NO: 1635171 - RNA, 18 nt, Homo sapiens
cccaccagggagaugucu

SEQ ID NO: 1635172 - RNA, 19 nt, Homo sapiens
cccacuaucugggugcaug

SEQ ID NO: 1635173 - RNA, 19 nt, Homo sapiens
cccacuccgccagccacag

SEQ ID NO: 1635174 - RNA, 21 nt, Homo sapiens
cccagagggauugcugugaaa

SEQ ID NO: 1635175 - RNA, 22 nt, Homo sapiens
cccagagggauugcugugaaau

SEQ ID NO: 1635176 - RNA, 23 nt, Homo sapiens
cccagaugcaagacacugugcca

SEQ ID NO: 1635177 - RNA, 23 nt, Homo sapiens
cccagauguuuuacgucugggag

SEQ ID NO: 1635178 - RNA, 15 nt, Homo sapiens
cccagauugcugcaa

SEQ ID NO: 1635179 - RNA, 19 nt, Homo sapiens
cccagcaucccuggagcag

SEQ ID NO: 1635180 - RNA, 23 nt, Homo sapiens
cccagcccugggaaccacuccca

SEQ ID NO: 1635181 - RNA, 19 nt, Homo sapiens
cccaggaucagauugcaug

SEQ ID NO: 1635182 - RNA, 21 nt, Homo sapiens
cccaggcccugcucuuccuca

SEQ ID NO: 1635183 - RNA, 23 nt, Homo sapiens
cccaggccucugccccaagagca

SEQ ID NO: 1635184 - RNA, 20 nt, Homo sapiens
cccagguggaaggcagacag

SEQ ID NO: 1635185 - RNA, 12 nt, Homo sapiens
cccagugcaaac

SEQ ID NO: 1635186 - RNA, 18 nt, Homo sapiens
cccaguggacucuuccac

SEQ ID NO: 1635187 - RNA, 18 nt, Homo sapiens
cccaguucuucauuugga

SEQ ID NO: 1635188 - RNA, 14 nt, Homo sapiens
cccaugaacacaga

SEQ ID NO: 1635189 - RNA, 14 nt, Homo sapiens
cccaugcccagcug

SEQ ID NO: 1635190 - RNA, 16 nt, Homo sapiens
cccauguaaccacugc

SEQ ID NO: 1635191 - RNA, 15 nt, Homo sapiens
cccauuaaucuugau

SEQ ID NO: 1635192 - RNA, 21 nt, Homo sapiens
cccauugcugccaagguggag

SEQ ID NO: 1635193 - RNA, 17 nt, Homo sapiens
ccccaacaugcacugau

SEQ ID NO: 1635194 - RNA, 12 nt, Homo sapiens
ccccaaguccua

SEQ ID NO: 1635195 - RNA, 21 nt, Homo sapiens
ccccaaugaccuuagccccau

SEQ ID NO: 1635196 - RNA, 23 nt, Homo sapiens
ccccaccuugcagcuaaauguga

SEQ ID NO: 1635197 - RNA, 16 nt, Homo sapiens
ccccacuccagcuccu

SEQ ID NO: 1635198 - RNA, 22 nt, Homo sapiens
ccccagccccagagaaacugcc

SEQ ID NO: 1635199 - RNA, 15 nt, Homo sapiens
ccccagcgauucccu

SEQ ID NO: 1635200 - RNA, 18 nt, Homo sapiens
ccccagcuccuaggucuc

SEQ ID NO: 1635201 - RNA, 20 nt, Homo sapiens
ccccaguagagaaacauuug

SEQ ID NO: 1635202 - RNA, 17 nt, Homo sapiens
ccccagucaagcuccua

SEQ ID NO: 1635203 - RNA, 22 nt, Homo sapiens
ccccgaaucacacagacaguuu

SEQ ID NO: 1635204 - RNA, 19 nt, Homo sapiens
ccccgaggagcccgaaguc

SEQ ID NO: 1635205 - RNA, 23 nt, Homo sapiens
ccccucauccgauuccccuguag

SEQ ID NO: 1635206 - RNA, 19 nt, Homo sapiens
cauguagguaggaagcacu

SEQ ID NO: 1635207 - RNA, 23 nt, Homo sapiens
cauguagguaggaagcacugaaa

SEQ ID NO: 1635208 - RNA, 13 nt, Homo sapiens
cauguaugucuug

SEQ ID NO: 1635209 - RNA, 17 nt, Homo sapiens
cauguaugucuuggaca

SEQ ID NO: 1635210 - RNA, 22 nt, Homo sapiens
cauguaugucuuggacacugua

SEQ ID NO: 1635211 - RNA, 20 nt, Homo sapiens
cauguccacaaugcacaugu

SEQ ID NO: 1635212 - RNA, 16 nt, Homo sapiens
caugucuugacuguua

SEQ ID NO: 1635213 - RNA, 18 nt, Homo sapiens
caugucuuguacaugugu

SEQ ID NO: 1635214 - RNA, 18 nt, Homo sapiens
caugugacacauaugcac

SEQ ID NO: 1635215 - RNA, 19 nt, Homo sapiens
caugugacacauaugcacc

SEQ ID NO: 1635216 - RNA, 22 nt, Homo sapiens
caugugacacauaugcaccuug

SEQ ID NO: 1635217 - RNA, 18 nt, Homo sapiens
caugugacucugaagcug

SEQ ID NO: 1635218 - RNA, 18 nt, Homo sapiens
cauguguagccugugcau

SEQ ID NO: 1635219 - RNA, 22 nt, Homo sapiens
cauguuauuaaacguaugcaug

SEQ ID NO: 1635220 - RNA, 15 nt, Homo sapiens
cauguucucccaaau

SEQ ID NO: 1635221 - RNA, 23 nt, Homo sapiens
cauguugcaaagaacuccagagu

SEQ ID NO: 1635222 - RNA, 22 nt, Homo sapiens
cauguuucaagaaaauggauuu

SEQ ID NO: 1635223 - RNA, 13 nt, Homo sapiens
cauguuuccucuu

SEQ ID NO: 1635224 - RNA, 19 nt, Homo sapiens
cauguuuuaacaaaaacca

SEQ ID NO: 1635225 - RNA, 13 nt, Homo sapiens
cauguuuuaggga

SEQ ID NO: 1635226 - RNA, 14 nt, Homo sapiens
cauuaaucuugauc

SEQ ID NO: 1635227 - RNA, 21 nt, Homo sapiens
cauuaaugguuggaaaacacu

SEQ ID NO: 1635228 - RNA, 15 nt, Homo sapiens
cauuaucuugcucau

SEQ ID NO: 1635229 - RNA, 16 nt, Homo sapiens
cauuaugccacuuccu

SEQ ID NO: 1635230 - RNA, 16 nt, Homo sapiens
cauuauuugagacugu

SEQ ID NO: 1635231 - RNA, 22 nt, Homo sapiens
cauuauuuggcuuaaaccagaa

SEQ ID NO: 1635232 - RNA, 17 nt, Homo sapiens
cauucaauagcauauca

SEQ ID NO: 1635233 - RNA, 19 nt, Homo sapiens
cauucaauagcauaucaca

SEQ ID NO: 1635234 - RNA, 22 nt, Homo sapiens
cauucagucaagugaggugaca

SEQ ID NO: 1635235 - RNA, 17 nt, Homo sapiens
cauucauuuaacagagc

SEQ ID NO: 1635236 - RNA, 19 nt, Homo sapiens
cauuccaguagccaguauc

SEQ ID NO: 1635237 - RNA, 16 nt, Homo sapiens
cauucccaccccucau

SEQ ID NO: 1635238 - RNA, 19 nt, Homo sapiens
cauucccauggaguugcca

SEQ ID NO: 1635239 - RNA, 23 nt, Homo sapiens
cauucccauggaguugccaacua

SEQ ID NO: 1635240 - RNA, 15 nt, Homo sapiens
cauuccugaagggaa

SEQ ID NO: 1635241 - RNA, 15 nt, Homo sapiens
cauucuccugccuca

SEQ ID NO: 1635242 - RNA, 17 nt, Homo sapiens
cauucuguuagauacua

SEQ ID NO: 1635243 - RNA, 14 nt, Homo sapiens
cauugcacuuuccu

SEQ ID NO: 1635244 - RNA, 19 nt, Homo sapiens
cauugccauaccauuccca

SEQ ID NO: 1635245 - RNA, 12 nt, Homo sapiens
cauugcugccaa

SEQ ID NO: 1635246 - RNA, 13 nt, Homo sapiens
cauugcugccaag

SEQ ID NO: 1635247 - RNA, 17 nt, Homo sapiens
cauugcuuuccacugag

SEQ ID NO: 1635248 - RNA, 20 nt, Homo sapiens
cauugucaccucugugaccc

SEQ ID NO: 1635249 - RNA, 18 nt, Homo sapiens
cauugucuuuccugaaug

SEQ ID NO: 1635250 - RNA, 14 nt, Homo sapiens
cauuuaaaaaacau

SEQ ID NO: 1635251 - RNA, 15 nt, Homo sapiens
cauuuaaauuccaca

SEQ ID NO: 1635252 - RNA, 13 nt, Homo sapiens
cauuuagcuucuu

SEQ ID NO: 1635253 - RNA, 19 nt, Homo sapiens
cauuucucauaccuucccc

SEQ ID NO: 1635254 - RNA, 20 nt, Homo sapiens
cauuugauggccaccagcuu

SEQ ID NO: 1635255 - RNA, 15 nt, Homo sapiens
cauuugcauuugcuc

SEQ ID NO: 1635256 - RNA, 15 nt, Homo sapiens
cauuuggugacugug

SEQ ID NO: 1635257 - RNA, 16 nt, Homo sapiens
cauuuggugacugugu

SEQ ID NO: 1635258 - RNA, 21 nt, Homo sapiens
cauuuguacugaccccaucac

SEQ ID NO: 1635259 - RNA, 14 nt, Homo sapiens
cauuuguagcuuug

SEQ ID NO: 1635260 - RNA, 21 nt, Homo sapiens
cauuuguagcuuugcccauug

SEQ ID NO: 1635261 - RNA, 23 nt, Homo sapiens
cauuuuauaaaugauaucaaaga

SEQ ID NO: 1635262 - RNA, 18 nt, Homo sapiens
cauuuugcccuuccauag

SEQ ID NO: 1635263 - RNA, 18 nt, Homo sapiens
cauuuuucucuugccauu

SEQ ID NO: 1635264 - RNA, 21 nt, Homo sapiens
cauuuuuguaggaagcauuuu

SEQ ID NO: 1635265 - RNA, 19 nt, Homo sapiens
cauuuuuucagucauauaa

SEQ ID NO: 1635266 - RNA, 14 nt, Homo sapiens
ccaaaacaaaccca

SEQ ID NO: 1635267 - RNA, 15 nt, Homo sapiens
ccaaaauggugggau

SEQ ID NO: 1635268 - RNA, 15 nt, Homo sapiens
ccaaacuuguucauu

SEQ ID NO: 1635269 - RNA, 17 nt, Homo sapiens
ccaaaggcugcagcauu

SEQ ID NO: 1635270 - RNA, 13 nt, Homo sapiens
ccaaccccagugg

SEQ ID NO: 1635271 - RNA, 16 nt, Homo sapiens
ccaacgaaaagcacau

SEQ ID NO: 1635272 - RNA, 16 nt, Homo sapiens
ccaacugcuaaugcaa

SEQ ID NO: 1635273 - RNA, 21 nt, Homo sapiens
ccaagagcaggaggugccuga

SEQ ID NO: 1635274 - RNA, 15 nt, Homo sapiens
ccaagagugaaggga

SEQ ID NO: 1635275 - RNA, 20 nt, Homo sapiens
ccaagcuagacugugucuga

SEQ ID NO: 1635276 - RNA, 15 nt, Homo sapiens
ccaaggaugcuguca

SEQ ID NO: 1635277 - RNA, 19 nt, Homo sapiens
ccaagguggagggaaggau

SEQ ID NO: 1635278 - RNA, 17 nt, Homo sapiens
ccaagguugggacccaa

SEQ ID NO: 1635279 - RNA, 22 nt, Homo sapiens
ccaaguaaacaggguaccucaa

SEQ ID NO: 1635280 - RNA, 21 nt, Homo sapiens
ccaaguugagauuuuaauucu

SEQ ID NO: 1635281 - RNA, 19 nt, Homo sapiens
ccaauacaaagaugacugg

SEQ ID NO: 1635282 - RNA, 13 nt, Homo sapiens
ccaaucugcauuu

SEQ ID NO: 1635283 - RNA, 14 nt, Homo sapiens
ccaauggauucaug

SEQ ID NO: 1635284 - RNA, 19 nt, Homo sapiens
ccaauuucucuuuacuuga

SEQ ID NO: 1635285 - RNA, 20 nt, Homo sapiens
ccacaagcugcacugugaac

SEQ ID NO: 1635286 - RNA, 22 nt, Homo sapiens
ccacaauuccuccucuggccac

SEQ ID NO: 1635287 - RNA, 20 nt, Homo sapiens
ccacaccaaugcaacauuug

SEQ ID NO: 1635288 - RNA, 22 nt, Homo sapiens
ccacacuucucaggacacaggc

SEQ ID NO: 1635289 - RNA, 18 nt, Homo sapiens
ccacagagagaggggaga

SEQ ID NO: 1635290 - RNA, 19 nt, Homo sapiens
ccacagcaaccccaggcug

SEQ ID NO: 1635291 - RNA, 14 nt, Homo sapiens
ccacagcagccacu

SEQ ID NO: 1635292 - RNA, 23 nt, Homo sapiens
ccacagcagccacuuugcuacca

SEQ ID NO: 1635293 - RNA, 23 nt, Homo sapiens
ccacagccuucggacagacauau

SEQ ID NO: 1635294 - RNA, 16 nt, Homo sapiens
ccacaguaauugguca

SEQ ID NO: 1635295 - RNA, 22 nt, Homo sapiens
ccacaugaggccaucucaggag

SEQ ID NO: 1635296 - RNA, 20 nt, Homo sapiens
ccacaugugacacauaugca

SEQ ID NO: 1635297 - RNA, 11 nt, Homo sapiens
ccacccaguuc

SEQ ID NO: 1635298 - RNA, 13 nt, Homo sapiens
ccacccaguuccu

SEQ ID NO: 1635299 - RNA, 18 nt, Homo sapiens
ccaccucacaacuccuuc

SEQ ID NO: 1635300 - RNA, 16 nt, Homo sapiens
ccaccuuccuuaccuc

SEQ ID NO: 1635301 - RNA, 17 nt, Homo sapiens
ccacuaaaaauauuguu

SEQ ID NO: 1635302 - RNA, 15 nt, Homo sapiens
ccacuaaaauacaua

SEQ ID NO: 1635303 - RNA, 16 nt, Homo sapiens
ccacugcacuuuccaa

SEQ ID NO: 1635304 - RNA, 22 nt, Homo sapiens
ccacugcugggggugagcugua

SEQ ID NO: 1635305 - RNA, 21 nt, Homo sapiens
ccacuuccuuuuaacugccaa

SEQ ID NO: 1635306 - RNA, 15 nt, Homo sapiens
ccacuucgcacacac

SEQ ID NO: 1635307 - RNA, 17 nt, Homo sapiens
ccacuucuccaugcugc

SEQ ID NO: 1635308 - RNA, 13 nt, Homo sapiens
ccacuugacagac

SEQ ID NO: 1635309 - RNA, 21 nt, Homo sapiens
ccacuuuccccgugggccaug

SEQ ID NO: 1635310 - RNA, 21 nt, Homo sapiens
ccacuuuggcugaacuacaag

SEQ ID NO: 1635311 - RNA, 12 nt, Homo sapiens
ccagaacacucu

SEQ ID NO: 1635312 - RNA, 22 nt, Homo sapiens
ccagaagcaagauucaaaucuc

SEQ ID NO: 1635313 - RNA, 17 nt, Homo sapiens
ccagaccucaggugcua

SEQ ID NO: 1635314 - RNA, 18 nt, Homo sapiens
ccagagcguguagugaau

SEQ ID NO: 1635315 - RNA, 21 nt, Homo sapiens
gcuuucccgcccagccucacu

SEQ ID NO: 1635316 - RNA, 18 nt, Homo sapiens
gcuuugaaagaagcaaga

SEQ ID NO: 1635317 - RNA, 11 nt, Homo sapiens
gcuuugcuccu

SEQ ID NO: 1635318 - RNA, 14 nt, Homo sapiens
gcuuugugccuuug

SEQ ID NO: 1635319 - RNA, 18 nt, Homo sapiens
gcuuuuugccaucuguga

SEQ ID NO: 1635320 - RNA, 12 nt, Homo sapiens
ggaaaacgugaa

SEQ ID NO: 1635321 - RNA, 17 nt, Homo sapiens
ggaaaagaaaccugggg

SEQ ID NO: 1635322 - RNA, 19 nt, Homo sapiens
ggaaaagggucuugggaaa

SEQ ID NO: 1635323 - RNA, 14 nt, Homo sapiens
ggaaaaugacucug

SEQ ID NO: 1635324 - RNA, 19 nt, Homo sapiens
ggaaaauggagccaugaca

SEQ ID NO: 1635325 - RNA, 14 nt, Homo sapiens
ggaaacaguccaaa

SEQ ID NO: 1635326 - RNA, 15 nt, Homo sapiens
ggaaagaaccgaaga

SEQ ID NO: 1635327 - RNA, 21 nt, Homo sapiens
ggaaauguauuuugacacugg

SEQ ID NO: 1635328 - RNA, 15 nt, Homo sapiens
ggaaauuagccacau

SEQ ID NO: 1635329 - RNA, 16 nt, Homo sapiens
ggaacaucacauuccu

SEQ ID NO: 1635330 - RNA, 21 nt, Homo sapiens
ggaaccacaccaaugcaacau

SEQ ID NO: 1635331 - RNA, 22 nt, Homo sapiens
ggaacccccagaauaaauaugc

SEQ ID NO: 1635332 - RNA, 15 nt, Homo sapiens
ggaagauaugccacu

SEQ ID NO: 1635333 - RNA, 17 nt, Homo sapiens
ggaaggacauccauguu

SEQ ID NO: 1635334 - RNA, 21 nt, Homo sapiens
ggaaggagacaggaugagguc

SEQ ID NO: 1635335 - RNA, 13 nt, Homo sapiens
ggaaggagggcac

SEQ ID NO: 1635336 - RNA, 17 nt, Homo sapiens
ggaagugaggaagccag

SEQ ID NO: 1635337 - RNA, 11 nt, Homo sapiens
ggaauaaucuc

SEQ ID NO: 1635338 - RNA, 12 nt, Homo sapiens
ggaauaaucucc

SEQ ID NO: 1635339 - RNA, 19 nt, Homo sapiens
ggaaugcagaggucuccaa

SEQ ID NO: 1635340 - RNA, 18 nt, Homo sapiens
ggacaaaacuucuuguca

SEQ ID NO: 1635341 - RNA, 19 nt, Homo sapiens
ggacaaaacuucuugucag

SEQ ID NO: 1635342 - RNA, 14 nt, Homo sapiens
ggacagaaaaugca

SEQ ID NO: 1635343 - RNA, 17 nt, Homo sapiens
ggacagaaaaugcaaug

SEQ ID NO: 1635344 - RNA, 17 nt, Homo sapiens
ggacagaauaauacaau

SEQ ID NO: 1635345 - RNA, 19 nt, Homo sapiens
ggacauuuuuucagucaua

SEQ ID NO: 1635346 - RNA, 22 nt, Homo sapiens
ggacuagccagaauucuacccu

SEQ ID NO: 1635347 - RNA, 19 nt, Homo sapiens
ggacucuuccaccucccaa

SEQ ID NO: 1635348 - RNA, 22 nt, Homo sapiens
ggacuggugucauaaacuuucu

SEQ ID NO: 1635349 - RNA, 18 nt, Homo sapiens
ggagaaagcucauggcug

SEQ ID NO: 1635350 - RNA, 18 nt, Homo sapiens
ggagaaggacaugagauc

SEQ ID NO: 1635351 - RNA, 14 nt, Homo sapiens
ggagaccucagaag

SEQ ID NO: 1635352 - RNA, 16 nt, Homo sapiens
ggagaggucaccagcu

SEQ ID NO: 1635353 - RNA, 16 nt, Homo sapiens
ggagaggucagccuug

SEQ ID NO: 1635354 - RNA, 17 nt, Homo sapiens
ggagagguuacccgaga

SEQ ID NO: 1635355 - RNA, 15 nt, Homo sapiens
ggagaguaccugugu

SEQ ID NO: 1635356 - RNA, 21 nt, Homo sapiens
ggagaguaccuguguguuucg

SEQ ID NO: 1635357 - RNA, 12 nt, Homo sapiens
ggagccagugaa

SEQ ID NO: 1635358 - RNA, 18 nt, Homo sapiens
ggagcucaucugcaaaag

SEQ ID NO: 1635359 - RNA, 11 nt, Homo sapiens
ggaggacaaaa

SEQ ID NO: 1635360 - RNA, 16 nt, Homo sapiens
ggaggaccugagccug

SEQ ID NO: 1635361 - RNA, 16 nt, Homo sapiens
ggaggcaguccaucua

SEQ ID NO: 1635362 - RNA, 15 nt, Homo sapiens
ggaggccaaccagcc

SEQ ID NO: 1635363 - RNA, 22 nt, Homo sapiens
ggaggccgaagcuaacagggaa

SEQ ID NO: 1635364 - RNA, 16 nt, Homo sapiens
ggaggcugcagugagc

SEQ ID NO: 1635365 - RNA, 21 nt, Homo sapiens
ggaggcugcucggggugcaca

SEQ ID NO: 1635366 - RNA, 17 nt, Homo sapiens
ggaggggcugggccaag

SEQ ID NO: 1635367 - RNA, 11 nt, Homo sapiens
ggagggggccc

SEQ ID NO: 1635368 - RNA, 21 nt, Homo sapiens
ggaguacaaugcccagaucaa

SEQ ID NO: 1635369 - RNA, 19 nt, Homo sapiens
ggagucucacucuugucac

SEQ ID NO: 1635370 - RNA, 13 nt, Homo sapiens
ggagugcauuuag

SEQ ID NO: 1635371 - RNA, 13 nt, Homo sapiens
ggauacuggcaca

SEQ ID NO: 1635372 - RNA, 20 nt, Homo sapiens
ggauauuaacaacaauaaca

SEQ ID NO: 1635373 - RNA, 15 nt, Homo sapiens
ggauccugggucaaa

SEQ ID NO: 1635374 - RNA, 15 nt, Homo sapiens
ggaucuugaaugugg

SEQ ID NO: 1635375 - RNA, 24 nt, Homo sapiens
ggaucuugcaaaagaugucugauc

SEQ ID NO: 1635376 - RNA, 16 nt, Homo sapiens
ggaugggaugcacucu

SEQ ID NO: 1635377 - RNA, 20 nt, Homo sapiens
ggauggggugggcuuagggg

SEQ ID NO: 1635378 - RNA, 17 nt, Homo sapiens
ggaugucccugggccag

SEQ ID NO: 1635379 - RNA, 15 nt, Homo sapiens
ggauguguguaaauu

SEQ ID NO: 1635380 - RNA, 14 nt, Homo sapiens
ggauucaggaaaag

SEQ ID NO: 1635381 - RNA, 15 nt, Homo sapiens
ggauugacauucuac

SEQ ID NO: 1635382 - RNA, 14 nt, Homo sapiens
ggauugcugugaaa

SEQ ID NO: 1635383 - RNA, 22 nt, Homo sapiens
ggauuuuuuuccuccccaccuu

SEQ ID NO: 1635384 - RNA, 23 nt, Homo sapiens
ggcaagauaaaccaaugucauaa

SEQ ID NO: 1635385 - RNA, 23 nt, Homo sapiens
ggcaauuuuuacacaaaccugaa

SEQ ID NO: 1635386 - RNA, 13 nt, Homo sapiens
ggcacaauuccug

SEQ ID NO: 1635387 - RNA, 19 nt, Homo sapiens
ggcacgaucucaacucacu

SEQ ID NO: 1635388 - RNA, 22 nt, Homo sapiens
ggcacugaccggugcuuuuauu

SEQ ID NO: 1635389 - RNA, 11 nt, Homo sapiens
ggcacuggguc

SEQ ID NO: 1635390 - RNA, 23 nt, Homo sapiens
ggcagaaacaaaaugacuguaga

SEQ ID NO: 1635391 - RNA, 22 nt, Homo sapiens
ggcagauaaaaugccagucuca

SEQ ID NO: 1635392 - RNA, 18 nt, Homo sapiens
ggcagccaggcuggcaga

SEQ ID NO: 1635393 - RNA, 23 nt, Homo sapiens
ggcagccugaacacucaguugca

SEQ ID NO: 1635394 - RNA, 21 nt, Homo sapiens
ggcagcgcccuuccucuccac

SEQ ID NO: 1635395 - RNA, 19 nt, Homo sapiens
ggcagcuuuuucauaccaa

SEQ ID NO: 1635396 - RNA, 16 nt, Homo sapiens
ggcaggaccagguggc

SEQ ID NO: 1635397 - RNA, 17 nt, Homo sapiens
ggcaggaccuguggcca

SEQ ID NO: 1635398 - RNA, 17 nt, Homo sapiens
ggcagggcccagugaca

SEQ ID NO: 1635399 - RNA, 13 nt, Homo sapiens
ggcaguggcagag

SEQ ID NO: 1635400 - RNA, 15 nt, Homo sapiens
ggcauaccugugccu

SEQ ID NO: 1635401 - RNA, 21 nt, Homo sapiens
ggcauaucggcucacaaagag

SEQ ID NO: 1635402 - RNA, 18 nt, Homo sapiens
ggcauaugguccuagaca

SEQ ID NO: 1635403 - RNA, 19 nt, Homo sapiens
ggccaagccuaucaaagga

SEQ ID NO: 1635404 - RNA, 17 nt, Homo sapiens
ggccagaugcacauccc

SEQ ID NO: 1635405 - RNA, 20 nt, Homo sapiens
ugaagauggcauccugugaa

SEQ ID NO: 1635406 - RNA, 14 nt, Homo sapiens
ugaagccaauucag

SEQ ID NO: 1635407 - RNA, 19 nt, Homo sapiens
ugaagccaauucagacagg

SEQ ID NO: 1635408 - RNA, 16 nt, Homo sapiens
ugaagccauguagcca

SEQ ID NO: 1635409 - RNA, 18 nt, Homo sapiens
ugaagcgaacaucuucau

SEQ ID NO: 1635410 - RNA, 17 nt, Homo sapiens
ugaagcuuuaaguuaag

SEQ ID NO: 1635411 - RNA, 18 nt, Homo sapiens
ugaaguaugguguguuca

SEQ ID NO: 1635412 - RNA, 16 nt, Homo sapiens
ugaaguccuucaccuc

SEQ ID NO: 1635413 - RNA, 15 nt, Homo sapiens
ugaagucucuaaugu

SEQ ID NO: 1635414 - RNA, 15 nt, Homo sapiens
ugaagugcgugaaug

SEQ ID NO: 1635415 - RNA, 20 nt, Homo sapiens
ugaaguggucugaauucugg

SEQ ID NO: 1635416 - RNA, 16 nt, Homo sapiens
ugaagugguugcauuc

SEQ ID NO: 1635417 - RNA, 13 nt, Homo sapiens
ugaagugugcugu

SEQ ID NO: 1635418 - RNA, 15 nt, Homo sapiens
ugaauaacacuggau

SEQ ID NO: 1635419 - RNA, 21 nt, Homo sapiens
ugaauaagcagaacauacugu

SEQ ID NO: 1635420 - RNA, 18 nt, Homo sapiens
ugaauacagucucaucuu

SEQ ID NO: 1635421 - RNA, 17 nt, Homo sapiens
ugaauauaaagcuuaau

SEQ ID NO: 1635422 - RNA, 22 nt, Homo sapiens
ugaaucccucuaucucuaaaga

SEQ ID NO: 1635423 - RNA, 15 nt, Homo sapiens
ugaaucuauuucacu

SEQ ID NO: 1635424 - RNA, 19 nt, Homo sapiens
ugaaucugcuuuuccucug

SEQ ID NO: 1635425 - RNA, 11 nt, Homo sapiens
ugaaucuggag

SEQ ID NO: 1635426 - RNA, 19 nt, Homo sapiens
ugaaugguuucaacaaaga

SEQ ID NO: 1635427 - RNA, 21 nt, Homo sapiens
ugaauguauguaauguguggu

SEQ ID NO: 1635428 - RNA, 21 nt, Homo sapiens
ugaauguguagaaccuuccuu

SEQ ID NO: 1635429 - RNA, 14 nt, Homo sapiens
ugaauucuggaauc

SEQ ID NO: 1635430 - RNA, 18 nt, Homo sapiens
ugaauucuggaaucacaa

SEQ ID NO: 1635431 - RNA, 14 nt, Homo sapiens
ugaauuuucagaga

SEQ ID NO: 1635432 - RNA, 14 nt, Homo sapiens
ugacaaaacacagc

SEQ ID NO: 1635433 - RNA, 16 nt, Homo sapiens
ugacacauaugcaccu

SEQ ID NO: 1635434 - RNA, 22 nt, Homo sapiens
ugacacccuggccugaacugag

SEQ ID NO: 1635435 - RNA, 15 nt, Homo sapiens
ugacagagcagugcu

SEQ ID NO: 1635436 - RNA, 20 nt, Homo sapiens
ugacagagcgagacuccauc

SEQ ID NO: 1635437 - RNA, 19 nt, Homo sapiens
ugacagagguuuugaaaug

SEQ ID NO: 1635438 - RNA, 18 nt, Homo sapiens
ugacaggcagccuggaca

SEQ ID NO: 1635439 - RNA, 22 nt, Homo sapiens
ugacaguuaauaaaccuuugca

SEQ ID NO: 1635440 - RNA, 13 nt, Homo sapiens
ugacauguagcuu

SEQ ID NO: 1635441 - RNA, 13 nt, Homo sapiens
ugacauuccauga

SEQ ID NO: 1635442 - RNA, 15 nt, Homo sapiens
ugacauugcauuugg

SEQ ID NO: 1635443 - RNA, 19 nt, Homo sapiens
ugaccaauauuguacaguu

SEQ ID NO: 1635444 - RNA, 12 nt, Homo sapiens
ugaccacagcac

SEQ ID NO: 1635445 - RNA, 15 nt, Homo sapiens
ugaccacagcacagc

SEQ ID NO: 1635446 - RNA, 17 nt, Homo sapiens
ugaccacagcacagcca

SEQ ID NO: 1635447 - RNA, 21 nt, Homo sapiens
ugacccaggccuggccaguca

SEQ ID NO: 1635448 - RNA, 20 nt, Homo sapiens
ugaccccaucaccuacucac

SEQ ID NO: 1635449 - RNA, 20 nt, Homo sapiens
ugacccccgcaaguuugcac

SEQ ID NO: 1635450 - RNA, 20 nt, Homo sapiens
ugaccucgcccuccacaaau

SEQ ID NO: 1635451 - RNA, 21 nt, Homo sapiens
ugaccucgugaucuacccacc

SEQ ID NO: 1635452 - RNA, 20 nt, Homo sapiens
ugaccucucauaaauuuacu

SEQ ID NO: 1635453 - RNA, 16 nt, Homo sapiens
aauaaaaaaagacaaa

SEQ ID NO: 1635454 - RNA, 13 nt, Homo sapiens
aauaaaacauuca

SEQ ID NO: 1635455 - RNA, 21 nt, Homo sapiens
aauaaaacccacaagugucua

SEQ ID NO: 1635456 - RNA, 14 nt, Homo sapiens
aauaaaacugagcu

SEQ ID NO: 1635457 - RNA, 22 nt, Homo sapiens
aauaaaaugaaguggugagcuu

SEQ ID NO: 1635458 - RNA, 20 nt, Homo sapiens
aauaaaaugauuuguggaaa

SEQ ID NO: 1635459 - RNA, 12 nt, Homo sapiens
aauaaacauaau

SEQ ID NO: 1635460 - RNA, 17 nt, Homo sapiens
aauaaagacuugugcau

SEQ ID NO: 1635461 - RNA, 13 nt, Homo sapiens
aauaaagcuuuau

SEQ ID NO: 1635462 - RNA, 22 nt, Homo sapiens
aauaacauuuaaauuccacaga

SEQ ID NO: 1635463 - RNA, 14 nt, Homo sapiens
aauaacuaugcuuu

SEQ ID NO: 1635464 - RNA, 18 nt, Homo sapiens
aauaauggguuucuuuca

SEQ ID NO: 1635465 - RNA, 19 nt, Homo sapiens
aauacaauauuaaguccaa

SEQ ID NO: 1635466 - RNA, 17 nt, Homo sapiens
aauacaaucagcccagu

SEQ ID NO: 1635467 - RNA, 22 nt, Homo sapiens
aauacaaucagcccagugcaaa

SEQ ID NO: 1635468 - RNA, 23 nt, Homo sapiens
aauacagacaaagcauaaucaau

SEQ ID NO: 1635469 - RNA, 11 nt, Homo sapiens
aauacagugaa

SEQ ID NO: 1635470 - RNA, 14 nt, Homo sapiens
aauacaugguuuaa

SEQ ID NO: 1635471 - RNA, 23 nt, Homo sapiens
aauacccugcccuugacaucugg

SEQ ID NO: 1635472 - RNA, 18 nt, Homo sapiens
aauaccuuuaaauaucau

SEQ ID NO: 1635473 - RNA, 20 nt, Homo sapiens
aauaccuuuaaauaucauuc

SEQ ID NO: 1635474 - RNA, 13 nt, Homo sapiens
aauacuaguauua

SEQ ID NO: 1635475 - RNA, 21 nt, Homo sapiens
aauacuuaccgagucagacuu

SEQ ID NO: 1635476 - RNA, 12 nt, Homo sapiens
aauagaaaaagu

SEQ ID NO: 1635477 - RNA, 23 nt, Homo sapiens
aauagcuuuuuaaaaaaaucucc

SEQ ID NO: 1635478 - RNA, 19 nt, Homo sapiens
aauaguuguugaguauucc

SEQ ID NO: 1635479 - RNA, 20 nt, Homo sapiens
aauauaaaguugguucacuu

SEQ ID NO: 1635480 - RNA, 20 nt, Homo sapiens
aauauaagaaaaguaaugaa

SEQ ID NO: 1635481 - RNA, 18 nt, Homo sapiens
aauauaagcugccauaua

SEQ ID NO: 1635482 - RNA, 16 nt, Homo sapiens
aauauaauuugaucuu

SEQ ID NO: 1635483 - RNA, 17 nt, Homo sapiens
aauauaauuuucaaaaa

SEQ ID NO: 1635484 - RNA, 14 nt, Homo sapiens
aauaugaguacaaa

SEQ ID NO: 1635485 - RNA, 20 nt, Homo sapiens
aauaugaguacaaaugccuu

SEQ ID NO: 1635486 - RNA, 20 nt, Homo sapiens
aauauucauuuuaaagugga

SEQ ID NO: 1635487 - RNA, 19 nt, Homo sapiens
aauauuuuaaacuacugau

SEQ ID NO: 1635488 - RNA, 23 nt, Homo sapiens
aauauuuuuguauuucucuauuu

SEQ ID NO: 1635489 - RNA, 15 nt, Homo sapiens
aaucaaaacucacaa

SEQ ID NO: 1635490 - RNA, 20 nt, Homo sapiens
aaucaagguaagcucaggau

SEQ ID NO: 1635491 - RNA, 22 nt, Homo sapiens
aaucaauaagagaacucuccuc

SEQ ID NO: 1635492 - RNA, 13 nt, Homo sapiens
aaucaaucugcag

SEQ ID NO: 1635493 - RNA, 16 nt, Homo sapiens
aaucaccccauuucag

SEQ ID NO: 1635494 - RNA, 16 nt, Homo sapiens
aaucacuaaacuuuau

SEQ ID NO: 1635495 - RNA, 18 nt, Homo sapiens
aaucacuuuaagaucuuu

SEQ ID NO: 1635496 - RNA, 12 nt, Homo sapiens
aaucaguucugu

SEQ ID NO: 1635497 - RNA, 15 nt, Homo sapiens
aaucaugugaggaaa

SEQ ID NO: 1635498 - RNA, 19 nt, Homo sapiens
aaucaugugaggaaaugau

SEQ ID NO: 1635499 - RNA, 19 nt, Homo sapiens
aauccaaggaaacaugcag

SEQ ID NO: 1635500 - RNA, 23 nt, Homo sapiens
aauccagauuuucacuguuccag

SEQ ID NO: 1635501 - RNA, 19 nt, Homo sapiens
aauccagcuacgaauauag

SEQ ID NO: 1635502 - RNA, 13 nt, Homo sapiens
aauccaguuauua

SEQ ID NO: 1635503 - RNA, 15 nt, Homo sapiens
aaucccacaucccag

SEQ ID NO: 1635504 - RNA, 19 nt, Homo sapiens
aauccugaaagggcacuua

SEQ ID NO: 1635505 - RNA, 17 nt, Homo sapiens
aauccuuaacacauuca

SEQ ID NO: 1635506 - RNA, 20 nt, Homo sapiens
aauccuuaacacauucaaua

SEQ ID NO: 1635507 - RNA, 19 nt, Homo sapiens
aaucuagacauucuuuuaa

SEQ ID NO: 1635508 - RNA, 16 nt, Homo sapiens
aaucucagaacccaga

SEQ ID NO: 1635509 - RNA, 17 nt, Homo sapiens
aaucucugaauuugaga

SEQ ID NO: 1635510 - RNA, 22 nt, Homo sapiens
aaucugcauuucuuaccagugu

SEQ ID NO: 1635511 - RNA, 16 nt, Homo sapiens
aaucugccugcaacuu

SEQ ID NO: 1635512 - RNA, 19 nt, Homo sapiens
aaugaaaauaaacauguau

SEQ ID NO: 1635513 - RNA, 14 nt, Homo sapiens
aaugaaaauuguau

SEQ ID NO: 1635514 - RNA, 12 nt, Homo sapiens
aaugaacaucuc

SEQ ID NO: 1635515 - RNA, 18 nt, Homo sapiens
aaugaacaucucuugaaa

SEQ ID NO: 1635516 - RNA, 13 nt, Homo sapiens
aaugacagccuuu

SEQ ID NO: 1635517 - RNA, 14 nt, Homo sapiens
aaugacuuacuuuc

SEQ ID NO: 1635518 - RNA, 14 nt, Homo sapiens
aaugagaagacaug

SEQ ID NO: 1635519 - RNA, 21 nt, Homo sapiens
aaugagguagcuauaguugca

SEQ ID NO: 1635520 - RNA, 20 nt, Homo sapiens
aaugaguuuaaugccauaaa

SEQ ID NO: 1635521 - RNA, 17 nt, Homo sapiens
aaugauaaaauagccaa

SEQ ID NO: 1635522 - RNA, 18 nt, Homo sapiens
aaugauaaaauagccaag

SEQ ID NO: 1635523 - RNA, 9 nt, Homo sapiens
aaugcaaaa

SEQ ID NO: 1635524 - RNA, 20 nt, Homo sapiens
aaugcaaauuaaaacauauu

SEQ ID NO: 1635525 - RNA, 17 nt, Homo sapiens
aaugcaaauuucuauaa

SEQ ID NO: 1635526 - RNA, 18 nt, Homo sapiens
aaugcauuugauggccac

SEQ ID NO: 1635527 - RNA, 10 nt, Homo sapiens
aaugccacag

SEQ ID NO: 1635528 - RNA, 12 nt, Homo sapiens
aaugccacagac

SEQ ID NO: 1635529 - RNA, 17 nt, Homo sapiens
aaugcuagcacaauauu

SEQ ID NO: 1635530 - RNA, 13 nt, Homo sapiens
aaugcuuuuacua

SEQ ID NO: 1635531 - RNA, 16 nt, Homo sapiens
aauggaggcaacgcca

SEQ ID NO: 1635532 - RNA, 18 nt, Homo sapiens
aauggaggcaacgccaga

SEQ ID NO: 1635533 - RNA, 19 nt, Homo sapiens
aauggaggucccagcccug

SEQ ID NO: 1635534 - RNA, 20 nt, Homo sapiens
aauggccuaaacuucagagg

SEQ ID NO: 1635535 - RNA, 20 nt, Homo sapiens
aauguaguuagcuccauaaa

SEQ ID NO: 1635536 - RNA, 9 nt, Homo sapiens
aauguaucu

SEQ ID NO: 1635537 - RNA, 19 nt, Homo sapiens
aauguaucuuaaaggacau

SEQ ID NO: 1635538 - RNA, 21 nt, Homo sapiens
aauguccccggacgguucugg

SEQ ID NO: 1635539 - RNA, 16 nt, Homo sapiens
aauguccccuuagguc

SEQ ID NO: 1635540 - RNA, 22 nt, Homo sapiens
aaugucucaugucaaugaccau

SEQ ID NO: 1635541 - RNA, 14 nt, Homo sapiens
aaugucuguaucac

SEQ ID NO: 1635542 - RNA, 21 nt, Homo sapiens
aaugucuguaucacucugugu

SEQ ID NO: 1635543 - RNA, 20 nt, Homo sapiens
aaugugaauaauggcacuga

SEQ ID NO: 1635544 - RNA, 16 nt, Homo sapiens
aaugugaggcaauaag

SEQ ID NO: 1635545 - RNA, 16 nt, Homo sapiens
aaugugaucauaugag

SEQ ID NO: 1635546 - RNA, 23 nt, Homo sapiens
aaugugauccugccuugcuguga

SEQ ID NO: 1635547 - RNA, 17 nt, Homo sapiens
aauguggccaagccuau

SEQ ID NO: 1635548 - RNA, 19 nt, Homo sapiens
aauguuaccacuacuuuaa

SEQ ID NO: 1635549 - RNA, 22 nt, Homo sapiens
aauguuccuuucgaaagcaaug

SEQ ID NO: 1635550 - RNA, 20 nt, Homo sapiens
aauguucuuugucucaaaau

SEQ ID NO: 1635551 - RNA, 19 nt, Homo sapiens
aauguuugugucugugguu

SEQ ID NO: 1635552 - RNA, 16 nt, Homo sapiens
aauguuuuuaagauuu

SEQ ID NO: 1635553 - RNA, 19 nt, Homo sapiens
aauuaaacgguaacaucca

SEQ ID NO: 1635554 - RNA, 13 nt, Homo sapiens
aauuaaucacaaa

SEQ ID NO: 1635555 - RNA, 19 nt, Homo sapiens
aauuauacagaccuaauau

SEQ ID NO: 1635556 - RNA, 22 nt, Homo sapiens
aauuauacagaccuaauaucau

SEQ ID NO: 1635557 - RNA, 16 nt, Homo sapiens
aauuauacuacuuugu

SEQ ID NO: 1635558 - RNA, 19 nt, Homo sapiens
aauuauuguagacaugccc

SEQ ID NO: 1635559 - RNA, 21 nt, Homo sapiens
aauucagcuccuuucuguccu

SEQ ID NO: 1635560 - RNA, 18 nt, Homo sapiens
aauucggauguaugaucu

SEQ ID NO: 1635561 - RNA, 19 nt, Homo sapiens
aauucgguuggguaccaug

SEQ ID NO: 1635562 - RNA, 17 nt, Homo sapiens
aauucuuaagaugugua

SEQ ID NO: 1635563 - RNA, 17 nt, Homo sapiens
cagcccagacccagugg

SEQ ID NO: 1635564 - RNA, 16 nt, Homo sapiens
cagcccauugcugcca

SEQ ID NO: 1635565 - RNA, 18 nt, Homo sapiens
cagccucccauccagggc

SEQ ID NO: 1635566 - RNA, 18 nt, Homo sapiens
cagccuccugaguagcug

SEQ ID NO: 1635567 - RNA, 20 nt, Homo sapiens
cagccucgcgggugucacau

SEQ ID NO: 1635568 - RNA, 17 nt, Homo sapiens
cagccugcucuaguggg

SEQ ID NO: 1635569 - RNA, 23 nt, Homo sapiens
cagccuugaugccauaugccuug

SEQ ID NO: 1635570 - RNA, 22 nt, Homo sapiens
cagcggaaagcccugugcucca

SEQ ID NO: 1635571 - RNA, 19 nt, Homo sapiens
cagcuaaggacauuuccca

SEQ ID NO: 1635572 - RNA, 18 nt, Homo sapiens
cagcucagcagacaucca

SEQ ID NO: 1635573 - RNA, 15 nt, Homo sapiens
cagcuccugccaggg

SEQ ID NO: 1635574 - RNA, 14 nt, Homo sapiens
cagcucuccaauac

SEQ ID NO: 1635575 - RNA, 16 nt, Homo sapiens
cagcucuucaacauga

SEQ ID NO: 1635576 - RNA, 17 nt, Homo sapiens
cagcugccccaauguga

SEQ ID NO: 1635577 - RNA, 14 nt, Homo sapiens
cagcugcccugugu

SEQ ID NO: 1635578 - RNA, 20 nt, Homo sapiens
cagcuggaggaauacauuuu

SEQ ID NO: 1635579 - RNA, 23 nt, Homo sapiens
cagcugugugggucauaccgugu

SEQ ID NO: 1635580 - RNA, 20 nt, Homo sapiens
cagcuguuuaugcauagaua

SEQ ID NO: 1635581 - RNA, 16 nt, Homo sapiens
cagcuuauaugugaca

SEQ ID NO: 1635582 - RNA, 13 nt, Homo sapiens
cagcuuguaugca

SEQ ID NO: 1635583 - RNA, 23 nt, Homo sapiens
cagcuuuauaacaaauguggcuc

SEQ ID NO: 1635584 - RNA, 13 nt, Homo sapiens
caggaacaaacag

SEQ ID NO: 1635585 - RNA, 18 nt, Homo sapiens
caggaagacuuugugacu

SEQ ID NO: 1635586 - RNA, 22 nt, Homo sapiens
caggaauaaagacuugugcauc

SEQ ID NO: 1635587 - RNA, 13 nt, Homo sapiens
caggaauguauca

SEQ ID NO: 1635588 - RNA, 14 nt, Homo sapiens
caggacccucagga

SEQ ID NO: 1635589 - RNA, 21 nt, Homo sapiens
caggagaaggugguggcauuu

SEQ ID NO: 1635590 - RNA, 22 nt, Homo sapiens
caggaggacauagccugcaaag

SEQ ID NO: 1635591 - RNA, 20 nt, Homo sapiens
caggaggcggagguugcagu

SEQ ID NO: 1635592 - RNA, 17 nt, Homo sapiens
caggauauccuuaucag

SEQ ID NO: 1635593 - RNA, 15 nt, Homo sapiens
caggcaacgcacaaa

SEQ ID NO: 1635594 - RNA, 19 nt, Homo sapiens
caggcacagguccccagau

SEQ ID NO: 1635595 - RNA, 17 nt, Homo sapiens
caggcacuauaauuucu

SEQ ID NO: 1635596 - RNA, 12 nt, Homo sapiens
caggcacuccaa

SEQ ID NO: 1635597 - RNA, 21 nt, Homo sapiens
caggcagagaacagaacugga

SEQ ID NO: 1635598 - RNA, 19 nt, Homo sapiens
caggccaaacauggccaga

SEQ ID NO: 1635599 - RNA, 17 nt, Homo sapiens
caggccccgugaggcaa

SEQ ID NO: 1635600 - RNA, 22 nt, Homo sapiens
caggcccuacuacccauuguuc

SEQ ID NO: 1635601 - RNA, 22 nt, Homo sapiens
caggccgcccugcgggugaaca

SEQ ID NO: 1635602 - RNA, 19 nt, Homo sapiens
caggccuaguaaccaaggc

SEQ ID NO: 1635603 - RNA, 14 nt, Homo sapiens
caggccuucuaacc

SEQ ID NO: 1635604 - RNA, 18 nt, Homo sapiens
caggcuggagugcaaugg

SEQ ID NO: 1635605 - RNA, 20 nt, Homo sapiens
caggcuggagugcaauggcg

SEQ ID NO: 1635606 - RNA, 19 nt, Homo sapiens
cagggagugcacauaucca

SEQ ID NO: 1635607 - RNA, 13 nt, Homo sapiens
cagggauggcccc

SEQ ID NO: 1635608 - RNA, 18 nt, Homo sapiens
cagggccuggagccccau

SEQ ID NO: 1635609 - RNA, 18 nt, Homo sapiens
cagggccuggggccugag

SEQ ID NO: 1635610 - RNA, 18 nt, Homo sapiens
caggggagggucagccag

SEQ ID NO: 1635611 - RNA, 14 nt, Homo sapiens
cagggguacauucu

SEQ ID NO: 1635612 - RNA, 18 nt, Homo sapiens
cagggucauguuugcagg

SEQ ID NO: 1635613 - RNA, 16 nt, Homo sapiens
cagggucucucccuca

SEQ ID NO: 1635614 - RNA, 19 nt, Homo sapiens
caggguggucuugaucucc

SEQ ID NO: 1635615 - RNA, 16 nt, Homo sapiens
cagguaaaacagggcc

SEQ ID NO: 1635616 - RNA, 23 nt, Homo sapiens
caggucacuugaucaugcugcag

SEQ ID NO: 1635617 - RNA, 13 nt, Homo sapiens
caggugaucugcc

SEQ ID NO: 1635618 - RNA, 14 nt, Homo sapiens
caggugauucuguu

SEQ ID NO: 1635619 - RNA, 14 nt, Homo sapiens
caggugcauagcaa

SEQ ID NO: 1635620 - RNA, 13 nt, Homo sapiens
caggugugcacca

SEQ ID NO: 1635621 - RNA, 15 nt, Homo sapiens
cagguuaaugcugaa

SEQ ID NO: 1635622 - RNA, 19 nt, Homo sapiens
caguacauuguauucuguu

SEQ ID NO: 1635623 - RNA, 23 nt, Homo sapiens
caguacuauggagugcucacaaa

SEQ ID NO: 1635624 - RNA, 20 nt, Homo sapiens
caguauuuucuccacuucau

SEQ ID NO: 1635625 - RNA, 18 nt, Homo sapiens
cagucaccucacaaaccu

SEQ ID NO: 1635626 - RNA, 19 nt, Homo sapiens
cagucacugacaguuaaua

SEQ ID NO: 1635627 - RNA, 17 nt, Homo sapiens
caguccacacuuugucc

SEQ ID NO: 1635628 - RNA, 17 nt, Homo sapiens
caguccucccuagcucu

SEQ ID NO: 1635629 - RNA, 16 nt, Homo sapiens
caguccuuaucugcuc

SEQ ID NO: 1635630 - RNA, 18 nt, Homo sapiens
cagugaaggucuuuguua

SEQ ID NO: 1635631 - RNA, 19 nt, Homo sapiens
cagugaagucuagaaucau

SEQ ID NO: 1635632 - RNA, 16 nt, Homo sapiens
cagugacagugcccag

SEQ ID NO: 1635633 - RNA, 13 nt, Homo sapiens
cagugagccauga

SEQ ID NO: 1635634 - RNA, 22 nt, Homo sapiens
cagugagccaugaguaugccac

SEQ ID NO: 1635635 - RNA, 13 nt, Homo sapiens
cagugcaaaccac

SEQ ID NO: 1635636 - RNA, 15 nt, Homo sapiens
cagugcaaaccacuu

SEQ ID NO: 1635637 - RNA, 22 nt, Homo sapiens
cagugcaguuucuuuucacauu

SEQ ID NO: 1635638 - RNA, 17 nt, Homo sapiens
cagugcauuauguacac

SEQ ID NO: 1635639 - RNA, 16 nt, Homo sapiens
cagugcugucugggau

SEQ ID NO: 1635640 - RNA, 15 nt, Homo sapiens
caguggacucuucca

SEQ ID NO: 1635641 - RNA, 13 nt, Homo sapiens
caguggauucuca

SEQ ID NO: 1635642 - RNA, 21 nt, Homo sapiens
caguggcacgaucucaacuca

SEQ ID NO: 1635643 - RNA, 16 nt, Homo sapiens
caguggcgugaucucg

SEQ ID NO: 1635644 - RNA, 19 nt, Homo sapiens
caguggggccuguggaaug

SEQ ID NO: 1635645 - RNA, 21 nt, Homo sapiens
cagugguagagucauguuugc

SEQ ID NO: 1635646 - RNA, 18 nt, Homo sapiens
caguguuuccacacuuaa

SEQ ID NO: 1635647 - RNA, 20 nt, Homo sapiens
caguuaauaaaccuuugcaa

SEQ ID NO: 1635648 - RNA, 20 nt, Homo sapiens
caguuacuuuuuuacacuga

SEQ ID NO: 1635649 - RNA, 19 nt, Homo sapiens
caguucgcagccacccuga

SEQ ID NO: 1635650 - RNA, 15 nt, Homo sapiens
caguucucuacuccc

SEQ ID NO: 1635651 - RNA, 15 nt, Homo sapiens
caguucugcuugcuc

SEQ ID NO: 1635652 - RNA, 20 nt, Homo sapiens
caguucuguguggugcauuc

SEQ ID NO: 1635653 - RNA, 14 nt, Homo sapiens
caguugcugugaac

SEQ ID NO: 1635654 - RNA, 19 nt, Homo sapiens
caguuuaaaggggucccau

SEQ ID NO: 1635655 - RNA, 18 nt, Homo sapiens
cauaaagaagcaauaaag

SEQ ID NO: 1635656 - RNA, 12 nt, Homo sapiens
cauaaagcaauu

SEQ ID NO: 1635657 - RNA, 16 nt, Homo sapiens
cauaaagcacuaccua

SEQ ID NO: 1635658 - RNA, 13 nt, Homo sapiens
cauaaagcauuuu

SEQ ID NO: 1635659 - RNA, 17 nt, Homo sapiens
cauaaagccauguuucc

SEQ ID NO: 1635660 - RNA, 18 nt, Homo sapiens
cauaaccccacccuugcc

SEQ ID NO: 1635661 - RNA, 20 nt, Homo sapiens
cauaagagcuuaagaaccau

SEQ ID NO: 1635662 - RNA, 23 nt, Homo sapiens
cauaaguaaucacuaaugcucaa

SEQ ID NO: 1635663 - RNA, 16 nt, Homo sapiens
cauaauaaauaucugu

SEQ ID NO: 1635664 - RNA, 19 nt, Homo sapiens
cauaaucaauauaaucuga

SEQ ID NO: 1635665 - RNA, 15 nt, Homo sapiens
cauacacagaaacca

SEQ ID NO: 1635666 - RNA, 13 nt, Homo sapiens
cauaccacuugaa

SEQ ID NO: 1635667 - RNA, 13 nt, Homo sapiens
cauaccauuccca

SEQ ID NO: 1635668 - RNA, 16 nt, Homo sapiens
cauaccauucccaugg

SEQ ID NO: 1635669 - RNA, 14 nt, Homo sapiens
cauaccugugccug

SEQ ID NO: 1635670 - RNA, 15 nt, Homo sapiens
cauacuuaacauuuc

SEQ ID NO: 1635671 - RNA, 17 nt, Homo sapiens
cauacuuaacauuucau

SEQ ID NO: 1635672 - RNA, 20 nt, Homo sapiens
cauagcccucagacauuuau

SEQ ID NO: 1635673 - RNA, 15 nt, Homo sapiens
cgccuucucccacau

SEQ ID NO: 1635674 - RNA, 19 nt, Homo sapiens
cgccuuuuuggccugugau

SEQ ID NO: 1635675 - RNA, 19 nt, Homo sapiens
cgcggcccgcgcagcugcc

SEQ ID NO: 1635676 - RNA, 12 nt, Homo sapiens
cgcuaggucaac

SEQ ID NO: 1635677 - RNA, 16 nt, Homo sapiens
cgcugaagauggcauc

SEQ ID NO: 1635678 - RNA, 17 nt, Homo sapiens
cgcuuaucaacuaauga

SEQ ID NO: 1635679 - RNA, 17 nt, Homo sapiens
cggacugucaguucucu

SEQ ID NO: 1635680 - RNA, 16 nt, Homo sapiens
cggagcaucucagaag

SEQ ID NO: 1635681 - RNA, 20 nt, Homo sapiens
cggagggaggggagggguga

SEQ ID NO: 1635682 - RNA, 15 nt, Homo sapiens
cggccuugggaaauc

SEQ ID NO: 1635683 - RNA, 14 nt, Homo sapiens
cggcucacugcaac

SEQ ID NO: 1635684 - RNA, 16 nt, Homo sapiens
cggcucgauuucucca

SEQ ID NO: 1635685 - RNA, 21 nt, Homo sapiens
cggggaagugcucuaacuuuu

SEQ ID NO: 1635686 - RNA, 16 nt, Homo sapiens
cgggugcaagcacucg

SEQ ID NO: 1635687 - RNA, 17 nt, Homo sapiens
cgguucacucuucucag

SEQ ID NO: 1635688 - RNA, 19 nt, Homo sapiens
cgguucuguuauaccccau

SEQ ID NO: 1635689 - RNA, 20 nt, Homo sapiens
cguaugguggcucaugucua

SEQ ID NO: 1635690 - RNA, 12 nt, Homo sapiens
cguccuggucaa

SEQ ID NO: 1635691 - RNA, 21 nt, Homo sapiens
cgugcuuuuccugugugugcu

SEQ ID NO: 1635692 - RNA, 13 nt, Homo sapiens
cguggacucugca

SEQ ID NO: 1635693 - RNA, 17 nt, Homo sapiens
cguguauaguaucugua

SEQ ID NO: 1635694 - RNA, 15 nt, Homo sapiens
cguguguacaugugc

SEQ ID NO: 1635695 - RNA, 18 nt, Homo sapiens
cguguguacaugugcacu

SEQ ID NO: 1635696 - RNA, 20 nt, Homo sapiens
cguucaccuccaagcauuuc

SEQ ID NO: 1635697 - RNA, 21 nt, Homo sapiens
cguuugaauauauuuuaucuu

SEQ ID NO: 1635698 - RNA, 17 nt, Homo sapiens
cuaaaaaggucuguuaa

SEQ ID NO: 1635699 - RNA, 18 nt, Homo sapiens
cuaaaaaugaaaauucua

SEQ ID NO: 1635700 - RNA, 14 nt, Homo sapiens
cuaaaacacugaaa

SEQ ID NO: 1635701 - RNA, 14 nt, Homo sapiens
cuaaaacuggcaaa

SEQ ID NO: 1635702 - RNA, 17 nt, Homo sapiens
cuaaauaaaaauaugua

SEQ ID NO: 1635703 - RNA, 17 nt, Homo sapiens
cuaaaugauuaucuuga

SEQ ID NO: 1635704 - RNA, 20 nt, Homo sapiens
cuaacacagccaucaaggga

SEQ ID NO: 1635705 - RNA, 21 nt, Homo sapiens
cuaacaugcaccuugcuccca

SEQ ID NO: 1635706 - RNA, 21 nt, Homo sapiens
cuaaccgaauauucauggaug

SEQ ID NO: 1635707 - RNA, 13 nt, Homo sapiens
cuaaccugugacc

SEQ ID NO: 1635708 - RNA, 18 nt, Homo sapiens
cuaacuaaauaccauuca

SEQ ID NO: 1635709 - RNA, 19 nt, Homo sapiens
cuaacuuuucuuaagguuu

SEQ ID NO: 1635710 - RNA, 23 nt, Homo sapiens
cuaagaacuguggucugguguuc

SEQ ID NO: 1635711 - RNA, 15 nt, Homo sapiens
cuaagauacuccaua

SEQ ID NO: 1635712 - RNA, 12 nt, Homo sapiens
cuaagcuccuag

SEQ ID NO: 1635713 - RNA, 20 nt, Homo sapiens
cuaagcugccgguucuuaaa

SEQ ID NO: 1635714 - RNA, 19 nt, Homo sapiens
cuaaggaguaaucugugua

SEQ ID NO: 1635715 - RNA, 21 nt, Homo sapiens
cuaaggaugguuuuaucuucc

SEQ ID NO: 1635716 - RNA, 18 nt, Homo sapiens
cuaagggugggugcucag

SEQ ID NO: 1635717 - RNA, 17 nt, Homo sapiens
cuaagguucagccugaa

SEQ ID NO: 1635718 - RNA, 21 nt, Homo sapiens
cuaaguguacuucauaagaua

SEQ ID NO: 1635719 - RNA, 22 nt, Homo sapiens
cuaaguguugugaaacuguaaa

SEQ ID NO: 1635720 - RNA, 20 nt, Homo sapiens
cuaauacccaguuacuuaug

SEQ ID NO: 1635721 - RNA, 19 nt, Homo sapiens
cuaauauuagggaguaaaa

SEQ ID NO: 1635722 - RNA, 13 nt, Homo sapiens
cuaauauuuacua

SEQ ID NO: 1635723 - RNA, 22 nt, Homo sapiens
cuaaugauuuagugaucaaauu

SEQ ID NO: 1635724 - RNA, 18 nt, Homo sapiens
cuaauguggcagcugucu

SEQ ID NO: 1635725 - RNA, 20 nt, Homo sapiens
cuaauguggcagcugucuca

SEQ ID NO: 1635726 - RNA, 18 nt, Homo sapiens
cuaauuauacuacuuugu

SEQ ID NO: 1635727 - RNA, 22 nt, Homo sapiens
cuacacagcucagcagacaucc

SEQ ID NO: 1635728 - RNA, 17 nt, Homo sapiens
cuacagcacuacugggu

SEQ ID NO: 1635729 - RNA, 20 nt, Homo sapiens
cuacagugccaacuccucac

SEQ ID NO: 1635730 - RNA, 15 nt, Homo sapiens
cuacauuuacuuuaa

SEQ ID NO: 1635731 - RNA, 14 nt, Homo sapiens
cuacccagguauua

SEQ ID NO: 1635732 - RNA, 21 nt, Homo sapiens
cuaccucagaaagauuugaug

SEQ ID NO: 1635733 - RNA, 14 nt, Homo sapiens
cuaccugacugcca

SEQ ID NO: 1635734 - RNA, 21 nt, Homo sapiens
cuacucagccuagcacaggcu

SEQ ID NO: 1635735 - RNA, 15 nt, Homo sapiens
cuacuuaaugcacag

SEQ ID NO: 1635736 - RNA, 16 nt, Homo sapiens
cuacuugucauaucac

SEQ ID NO: 1635737 - RNA, 21 nt, Homo sapiens
cuagacauucuuuuaaugcca

SEQ ID NO: 1635738 - RNA, 16 nt, Homo sapiens
cuagacugugucugaa

SEQ ID NO: 1635739 - RNA, 13 nt, Homo sapiens
cuagagggacaaa

SEQ ID NO: 1635740 - RNA, 12 nt, Homo sapiens
cuagaggugcuc

SEQ ID NO: 1635741 - RNA, 14 nt, Homo sapiens
cuagaguguagccu

SEQ ID NO: 1635742 - RNA, 12 nt, Homo sapiens
cuagcaguacua

SEQ ID NO: 1635743 - RNA, 19 nt, Homo sapiens
cuagcucuuccccaucuca

SEQ ID NO: 1635744 - RNA, 15 nt, Homo sapiens
cuagcugggccaacu

SEQ ID NO: 1635745 - RNA, 15 nt, Homo sapiens
cuaggaagaaucagu

SEQ ID NO: 1635746 - RNA, 18 nt, Homo sapiens
cuaggaggcuguggguuu

SEQ ID NO: 1635747 - RNA, 16 nt, Homo sapiens
cuaggcagugacagug

SEQ ID NO: 1635748 - RNA, 19 nt, Homo sapiens
cuagggaaugggacuguga

SEQ ID NO: 1635749 - RNA, 15 nt, Homo sapiens
cuagggacuguccua

SEQ ID NO: 1635750 - RNA, 12 nt, Homo sapiens
cuaguucagcug

SEQ ID NO: 1635751 - RNA, 12 nt, Homo sapiens
cuaguuugcacu

SEQ ID NO: 1635752 - RNA, 13 nt, Homo sapiens
cuaguuugcacua

SEQ ID NO: 1635753 - RNA, 19 nt, Homo sapiens
cuauaacuaugaccaugcu

SEQ ID NO: 1635754 - RNA, 16 nt, Homo sapiens
cuauaagcccacuguu

SEQ ID NO: 1635755 - RNA, 14 nt, Homo sapiens
cuauaaucucagaa

SEQ ID NO: 1635756 - RNA, 17 nt, Homo sapiens
cuauaauuucuguaaca

SEQ ID NO: 1635757 - RNA, 17 nt, Homo sapiens
cuauaccuuacugcaau

SEQ ID NO: 1635758 - RNA, 16 nt, Homo sapiens
cuauauagaaugcugc

SEQ ID NO: 1635759 - RNA, 20 nt, Homo sapiens
cuauaucagggccugaguga

SEQ ID NO: 1635760 - RNA, 21 nt, Homo sapiens
cuauauuugcuuuuugcuaac

SEQ ID NO: 1635761 - RNA, 18 nt, Homo sapiens
cuaucauaugaagauaac

SEQ ID NO: 1635762 - RNA, 17 nt, Homo sapiens
cuauccugggcauccuu

SEQ ID NO: 1635763 - RNA, 21 nt, Homo sapiens
cuaucuauaccuuacugcaau

SEQ ID NO: 1635764 - RNA, 19 nt, Homo sapiens
cuaucugggcugugggcaa

SEQ ID NO: 1635765 - RNA, 14 nt, Homo sapiens
cuaugcugcaauac

SEQ ID NO: 1635766 - RNA, 20 nt, Homo sapiens
cuauggagagcccugggacc

SEQ ID NO: 1635767 - RNA, 16 nt, Homo sapiens
cuauggagugcucaca

SEQ ID NO: 1635768 - RNA, 15 nt, Homo sapiens
cuauggcaucuuccc

SEQ ID NO: 1635769 - RNA, 18 nt, Homo sapiens
cuauguaaacaaaccaca

SEQ ID NO: 1635770 - RNA, 14 nt, Homo sapiens
cuauguagucauaa

SEQ ID NO: 1635771 - RNA, 17 nt, Homo sapiens
cuauguagucauaauaa

SEQ ID NO: 1635772 - RNA, 16 nt, Homo sapiens
cuauguauguguaaaa

SEQ ID NO: 1635773 - RNA, 19 nt, Homo sapiens
cuauuacugaugugugcaa

SEQ ID NO: 1635774 - RNA, 20 nt, Homo sapiens
cuauucuaacuaaugacaag

SEQ ID NO: 1635775 - RNA, 14 nt, Homo sapiens
cuauuuaucuguag

SEQ ID NO: 1635776 - RNA, 19 nt, Homo sapiens
cucaaaccuccaaaagccc

SEQ ID NO: 1635777 - RNA, 22 nt, Homo sapiens
cucaaacuccugaccucaggug

SEQ ID NO: 1635778 - RNA, 23 nt, Homo sapiens
cucaaauugucagcaauuuaacu

SEQ ID NO: 1635779 - RNA, 20 nt, Homo sapiens
cucaagcaccacgcccucca

SEQ ID NO: 1635780 - RNA, 12 nt, Homo sapiens
cucaagcuuucc

SEQ ID NO: 1635781 - RNA, 12 nt, Homo sapiens
cucaaucaugaa

SEQ ID NO: 1635782 - RNA, 17 nt, Homo sapiens
cucaauuuuauguauuc

SEQ ID NO: 1635783 - RNA, 18 nt, Homo sapiens
cuugcuuuuugcugugua

SEQ ID NO: 1635784 - RNA, 21 nt, Homo sapiens
cuuggagaaugugagaagcca

SEQ ID NO: 1635785 - RNA, 16 nt, Homo sapiens
cuuggccuaggucucc

SEQ ID NO: 1635786 - RNA, 17 nt, Homo sapiens
cuuggccuccugcuuca

SEQ ID NO: 1635787 - RNA, 22 nt, Homo sapiens
cuuggcuuuaugcaaauacaau

SEQ ID NO: 1635788 - RNA, 21 nt, Homo sapiens
cuugggaacaggguuacugua

SEQ ID NO: 1635789 - RNA, 17 nt, Homo sapiens
cuugggacauugcaauu

SEQ ID NO: 1635790 - RNA, 17 nt, Homo sapiens
cuugggagcaccgccug

SEQ ID NO: 1635791 - RNA, 21 nt, Homo sapiens
cuuggggggugaugagggcag

SEQ ID NO: 1635792 - RNA, 14 nt, Homo sapiens
cuuggugguggaug

SEQ ID NO: 1635793 - RNA, 14 nt, Homo sapiens
cuugguucuuucag

SEQ ID NO: 1635794 - RNA, 19 nt, Homo sapiens
cuugguuuccaaaggcauu

SEQ ID NO: 1635795 - RNA, 16 nt, Homo sapiens
cuuguaaagacugguu

SEQ ID NO: 1635796 - RNA, 14 nt, Homo sapiens
cuuguaaaugugac

SEQ ID NO: 1635797 - RNA, 13 nt, Homo sapiens
cuugucagacaua

SEQ ID NO: 1635798 - RNA, 20 nt, Homo sapiens
cuugucagacauaaagccau

SEQ ID NO: 1635799 - RNA, 16 nt, Homo sapiens
cuuguggagaucacag

SEQ ID NO: 1635800 - RNA, 13 nt, Homo sapiens
cuuguugcugagu

SEQ ID NO: 1635801 - RNA, 16 nt, Homo sapiens
cuuuaaaccacuaaaa

SEQ ID NO: 1635802 - RNA, 13 nt, Homo sapiens
cuuuaaauaucau

SEQ ID NO: 1635803 - RNA, 13 nt, Homo sapiens
cuuuaaaugcaac

SEQ ID NO: 1635804 - RNA, 12 nt, Homo sapiens
cuuuaaucugca

SEQ ID NO: 1635805 - RNA, 14 nt, Homo sapiens
cuuuaaugaauaaa

SEQ ID NO: 1635806 - RNA, 14 nt, Homo sapiens
cuuuaauggguaaa

SEQ ID NO: 1635807 - RNA, 16 nt, Homo sapiens
cuuuaauuaccaguuu

SEQ ID NO: 1635808 - RNA, 19 nt, Homo sapiens
cuuuaauuaccaguuuucc

SEQ ID NO: 1635809 - RNA, 22 nt, Homo sapiens
cuuuaauuuccuugacuguaaa

SEQ ID NO: 1635810 - RNA, 17 nt, Homo sapiens
cuuuacaaacugaagau

SEQ ID NO: 1635811 - RNA, 20 nt, Homo sapiens
cuuuacaaauagaauuugag

SEQ ID NO: 1635812 - RNA, 18 nt, Homo sapiens
cuuuagcuguacuguaau

SEQ ID NO: 1635813 - RNA, 22 nt, Homo sapiens
cuuuaguuuuugugaaguuuaa

SEQ ID NO: 1635814 - RNA, 14 nt, Homo sapiens
cuuuauaucugucu

SEQ ID NO: 1635815 - RNA, 21 nt, Homo sapiens
cuuuaugauaucaaagacuca

SEQ ID NO: 1635816 - RNA, 17 nt, Homo sapiens
cuuuaugcaaauacaau

SEQ ID NO: 1635817 - RNA, 21 nt, Homo sapiens
cuuuaugcaaauacaaucagc

SEQ ID NO: 1635818 - RNA, 15 nt, Homo sapiens
cuuuaugugcaaaau

SEQ ID NO: 1635819 - RNA, 18 nt, Homo sapiens
cuuuauguggaacaucua

SEQ ID NO: 1635820 - RNA, 12 nt, Homo sapiens
cuuuauuguggg

SEQ ID NO: 1635821 - RNA, 22 nt, Homo sapiens
cuuuauuuguaaaccauuguaa

SEQ ID NO: 1635822 - RNA, 18 nt, Homo sapiens
cuuucaagguaacuguac

SEQ ID NO: 1635823 - RNA, 13 nt, Homo sapiens
cuuucacaguccu

SEQ ID NO: 1635824 - RNA, 20 nt, Homo sapiens
cuuucagacaagaaugugca

SEQ ID NO: 1635825 - RNA, 11 nt, Homo sapiens
cuuucauguca

SEQ ID NO: 1635826 - RNA, 18 nt, Homo sapiens
cuuucccaaaacugccac

SEQ ID NO: 1635827 - RNA, 16 nt, Homo sapiens
cuuuccccaggggcau

SEQ ID NO: 1635828 - RNA, 17 nt, Homo sapiens
cuuuccccgugggccau

SEQ ID NO: 1635829 - RNA, 19 nt, Homo sapiens
cuuuccucagaucauccag

SEQ ID NO: 1635830 - RNA, 23 nt, Homo sapiens
cuuuccuguuucuaucuuucauu

SEQ ID NO: 1635831 - RNA, 20 nt, Homo sapiens
cuuucugauucacagucuca

SEQ ID NO: 1635832 - RNA, 13 nt, Homo sapiens
cuuucugccuuua

SEQ ID NO: 1635833 - RNA, 23 nt, Homo sapiens
cuuugaaacuccaugcaaaccau

SEQ ID NO: 1635834 - RNA, 17 nt, Homo sapiens
cuuugaaccugugcaau

SEQ ID NO: 1635835 - RNA, 22 nt, Homo sapiens
cuuugccagagcgugcuuucaa

SEQ ID NO: 1635836 - RNA, 19 nt, Homo sapiens
cuuuguagacuguuucaca

SEQ ID NO: 1635837 - RNA, 14 nt, Homo sapiens
cuuuguagcuacuu

SEQ ID NO: 1635838 - RNA, 14 nt, Homo sapiens
cuuuguaggugucu

SEQ ID NO: 1635839 - RNA, 21 nt, Homo sapiens
cuuugucauuauuagucuuca

SEQ ID NO: 1635840 - RNA, 17 nt, Homo sapiens
cuuuuacagacuagcag

SEQ ID NO: 1635841 - RNA, 21 nt, Homo sapiens
cuuuuaucucacaaauaagua

SEQ ID NO: 1635842 - RNA, 17 nt, Homo sapiens
cuuuucacaaacauuag

SEQ ID NO: 1635843 - RNA, 18 nt, Homo sapiens
cuuuucccauugccaugc

SEQ ID NO: 1635844 - RNA, 11 nt, Homo sapiens
cuuuuccucug

SEQ ID NO: 1635845 - RNA, 13 nt, Homo sapiens
cuuuugacuccag

SEQ ID NO: 1635846 - RNA, 14 nt, Homo sapiens
cuuuugcucccuac

SEQ ID NO: 1635847 - RNA, 14 nt, Homo sapiens
cuuuugcuccuauc

SEQ ID NO: 1635848 - RNA, 16 nt, Homo sapiens
cuuuuggcaguucuga

SEQ ID NO: 1635849 - RNA, 23 nt, Homo sapiens
cuuuugggauguuaccuucacau

SEQ ID NO: 1635850 - RNA, 13 nt, Homo sapiens
cuuuugugaacaa

SEQ ID NO: 1635851 - RNA, 22 nt, Homo sapiens
cuuuuucugcgcuucaguaaca

SEQ ID NO: 1635852 - RNA, 15 nt, Homo sapiens
cuuuuuggccuguga

SEQ ID NO: 1635853 - RNA, 20 nt, Homo sapiens
cuuuuuggcuuuaagccauu

SEQ ID NO: 1635854 - RNA, 15 nt, Homo sapiens
cuuuuuucuaguaca

SEQ ID NO: 1635855 - RNA, 14 nt, Homo sapiens
cuuuuuuuuaagga

SEQ ID NO: 1635856 - RNA, 21 nt, Homo sapiens
gaaaaaaaaaagaaaugcaaa

SEQ ID NO: 1635857 - RNA, 17 nt, Homo sapiens
gaaaaaaauguacauuu

SEQ ID NO: 1635858 - RNA, 14 nt, Homo sapiens
gaaaaaacauuuua

SEQ ID NO: 1635859 - RNA, 22 nt, Homo sapiens
gaaaaaacugugccuuguuuca

SEQ ID NO: 1635860 - RNA, 17 nt, Homo sapiens
gaaaaauaucuuggccu

SEQ ID NO: 1635861 - RNA, 18 nt, Homo sapiens
gaaaaaucauccaagaca

SEQ ID NO: 1635862 - RNA, 15 nt, Homo sapiens
gaaaacagaaaccau

SEQ ID NO: 1635863 - RNA, 11 nt, Homo sapiens
gaaaacagacu

SEQ ID NO: 1635864 - RNA, 14 nt, Homo sapiens
gaaaacaucuggaa

SEQ ID NO: 1635865 - RNA, 11 nt, Homo sapiens
gaaaaccuaaa

SEQ ID NO: 1635866 - RNA, 17 nt, Homo sapiens
gaaaagggaacugaaca

SEQ ID NO: 1635867 - RNA, 16 nt, Homo sapiens
gaaaagggucuuggga

SEQ ID NO: 1635868 - RNA, 23 nt, Homo sapiens
gaaaaguuuccuaggaugucaug

SEQ ID NO: 1635869 - RNA, 18 nt, Homo sapiens
gaaaauggagccaugaca

SEQ ID NO: 1635870 - RNA, 17 nt, Homo sapiens
gaaaauguauugauuca

SEQ ID NO: 1635871 - RNA, 12 nt, Homo sapiens
gaaaauugagag

SEQ ID NO: 1635872 - RNA, 23 nt, Homo sapiens
gaaacaaaacuagguaaaaucua

SEQ ID NO: 1635873 - RNA, 22 nt, Homo sapiens
gaaacaaagaagguuaccaaga

SEQ ID NO: 1635874 - RNA, 15 nt, Homo sapiens
gaaacaaggcugcca

SEQ ID NO: 1635875 - RNA, 15 nt, Homo sapiens
gaaacaauggcuaag

SEQ ID NO: 1635876 - RNA, 21 nt, Homo sapiens
gaaacaccacuuaaucuucuc

SEQ ID NO: 1635877 - RNA, 19 nt, Homo sapiens
gaaacaugucuugacuguu

SEQ ID NO: 1635878 - RNA, 14 nt, Homo sapiens
gaaaccaagagaca

SEQ ID NO: 1635879 - RNA, 19 nt, Homo sapiens
gaaaccucuacauauuuau

SEQ ID NO: 1635880 - RNA, 19 nt, Homo sapiens
gaaacgucuggacugcuau

SEQ ID NO: 1635881 - RNA, 16 nt, Homo sapiens
gaaacuuacacuguuu

SEQ ID NO: 1635882 - RNA, 23 nt, Homo sapiens
gaaacuuuccuuugucauuauua

SEQ ID NO: 1635883 - RNA, 18 nt, Homo sapiens
gaaagcaaguguucacaa

SEQ ID NO: 1635884 - RNA, 12 nt, Homo sapiens
gaaaggccuuca

SEQ ID NO: 1635885 - RNA, 17 nt, Homo sapiens
gaaagggguugggguga

SEQ ID NO: 1635886 - RNA, 21 nt, Homo sapiens
gaaagggguuggggugacagu

SEQ ID NO: 1635887 - RNA, 15 nt, Homo sapiens
gaaaucgaugagaaa

SEQ ID NO: 1635888 - RNA, 18 nt, Homo sapiens
gaaaucuguaaagccagu

SEQ ID NO: 1635889 - RNA, 14 nt, Homo sapiens
gaaaugaugagaaa

SEQ ID NO: 1635890 - RNA, 17 nt, Homo sapiens
gaaauuaagacuuuaug

SEQ ID NO: 1635891 - RNA, 19 nt, Homo sapiens
gaaauuccagcguacuaua

SEQ ID NO: 1635892 - RNA, 13 nt, Homo sapiens
gaacaaacagggc

SEQ ID NO: 1635893 - RNA, 17 nt, Homo sapiens
gaacaaagcagccacga

SEQ ID NO: 1635894 - RNA, 15 nt, Homo sapiens
gaacaagaaauggau

SEQ ID NO: 1635895 - RNA, 16 nt, Homo sapiens
gaacacaaaacuugaa

SEQ ID NO: 1635896 - RNA, 22 nt, Homo sapiens
gaacacaaguuccugauaacuu

SEQ ID NO: 1635897 - RNA, 12 nt, Homo sapiens
gaacacacuugg

SEQ ID NO: 1635898 - RNA, 21 nt, Homo sapiens
gaacagcauuacccuccucuc

SEQ ID NO: 1635899 - RNA, 21 nt, Homo sapiens
gaaccacucccaccacaggca

SEQ ID NO: 1635900 - RNA, 17 nt, Homo sapiens
gaaccagggcucuucuc

SEQ ID NO: 1635901 - RNA, 17 nt, Homo sapiens
gaaccaugguaugaagg

SEQ ID NO: 1635902 - RNA, 12 nt, Homo sapiens
gaacccaggaca

SEQ ID NO: 1635903 - RNA, 21 nt, Homo sapiens
gaaccccagcuucccuccagc

SEQ ID NO: 1635904 - RNA, 22 nt, Homo sapiens
gaacccuccccaccaccacuuu

SEQ ID NO: 1635905 - RNA, 16 nt, Homo sapiens
gaaccucccuccuuuc

SEQ ID NO: 1635906 - RNA, 15 nt, Homo sapiens
gaacgaguuguuggc

SEQ ID NO: 1635907 - RNA, 16 nt, Homo sapiens
gaacuagcauauagcc

SEQ ID NO: 1635908 - RNA, 18 nt, Homo sapiens
gaacucuacuucagucaa

SEQ ID NO: 1635909 - RNA, 13 nt, Homo sapiens
gaacugucuguga

SEQ ID NO: 1635910 - RNA, 17 nt, Homo sapiens
gaacuuauucucuguag

SEQ ID NO: 1635911 - RNA, 16 nt, Homo sapiens
gaagaaaaacuagaca

SEQ ID NO: 1635912 - RNA, 22 nt, Homo sapiens
gaagaauacccaggaagacuuu

SEQ ID NO: 1635913 - RNA, 15 nt, Homo sapiens
gaagacuucuaugga

SEQ ID NO: 1635914 - RNA, 21 nt, Homo sapiens
gaagagauccuuccauuccau

SEQ ID NO: 1635915 - RNA, 15 nt, Homo sapiens
gaagagcaagggaca

SEQ ID NO: 1635916 - RNA, 23 nt, Homo sapiens
gaagaggagucaaguaauggagg

SEQ ID NO: 1635917 - RNA, 21 nt, Homo sapiens
gaagaucaacgccucacugaa

SEQ ID NO: 1635918 - RNA, 21 nt, Homo sapiens
gaagaucauauacgugaaaau

SEQ ID NO: 1635919 - RNA, 21 nt, Homo sapiens
gaagaucauugccaucaccau

SEQ ID NO: 1635920 - RNA, 19 nt, Homo sapiens
gaagauggcauccugugaa

SEQ ID NO: 1635921 - RNA, 18 nt, Homo sapiens
gaagcacagcuccugcca

SEQ ID NO: 1635922 - RNA, 15 nt, Homo sapiens
gaagcauaaagcaau

SEQ ID NO: 1635923 - RNA, 16 nt, Homo sapiens
gaaggagccagugaac

SEQ ID NO: 1635924 - RNA, 23 nt, Homo sapiens
gaaggcacagcuaaccacuucgc

SEQ ID NO: 1635925 - RNA, 15 nt, Homo sapiens
gaagggagucucucu

SEQ ID NO: 1635926 - RNA, 16 nt, Homo sapiens
gaaggucuuuguuaug

SEQ ID NO: 1635927 - RNA, 14 nt, Homo sapiens
gaagguuaccaaga

SEQ ID NO: 1635928 - RNA, 13 nt, Homo sapiens
gaaguauugcuga

SEQ ID NO: 1635929 - RNA, 13 nt, Homo sapiens
gaagucuccucaa

SEQ ID NO: 1635930 - RNA, 17 nt, Homo sapiens
gaagugugcugugacaa

SEQ ID NO: 1635931 - RNA, 12 nt, Homo sapiens
gaaguuccucaa

SEQ ID NO: 1635932 - RNA, 21 nt, Homo sapiens
gaauaacauuuaaauuccaca

SEQ ID NO: 1635933 - RNA, 20 nt, Homo sapiens
gaauacccaggaagacuuug

SEQ ID NO: 1635934 - RNA, 13 nt, Homo sapiens
gaauauagagggu

SEQ ID NO: 1635935 - RNA, 13 nt, Homo sapiens
gaauaugacauac

SEQ ID NO: 1635936 - RNA, 14 nt, Homo sapiens
gaaucacacagaca

SEQ ID NO: 1635937 - RNA, 20 nt, Homo sapiens
gaaucauacuuaacauuuca

SEQ ID NO: 1635938 - RNA, 18 nt, Homo sapiens
gaaucccucuaucucuaa

SEQ ID NO: 1635939 - RNA, 23 nt, Homo sapiens
gaaucgguuguucuuuccucaca

SEQ ID NO: 1635940 - RNA, 15 nt, Homo sapiens
gaaucuaaaugaagc

SEQ ID NO: 1635941 - RNA, 17 nt, Homo sapiens
gaaucuauuucacuuau

SEQ ID NO: 1635942 - RNA, 23 nt, Homo sapiens
gaaugagccguauacaaggaaua

SEQ ID NO: 1635943 - RNA, 19 nt, Homo sapiens
gaaugagccuacgcugaag

SEQ ID NO: 1635944 - RNA, 16 nt, Homo sapiens
gaaugccuccuguggg

SEQ ID NO: 1635945 - RNA, 15 nt, Homo sapiens
gaaugcugcacuaau

SEQ ID NO: 1635946 - RNA, 21 nt, Homo sapiens
gaauggcagguucaaguucca

SEQ ID NO: 1635947 - RNA, 14 nt, Homo sapiens
gaaugggguagaaa

SEQ ID NO: 1635948 - RNA, 18 nt, Homo sapiens
gaaugguuucaacaaaga

SEQ ID NO: 1635949 - RNA, 17 nt, Homo sapiens
gaauguauguaaugugu

SEQ ID NO: 1635950 - RNA, 20 nt, Homo sapiens
gaaugugacuggcgugcuga

SEQ ID NO: 1635951 - RNA, 13 nt, Homo sapiens
gaaugugcacucu

SEQ ID NO: 1635952 - RNA, 20 nt, Homo sapiens
gaaugugggcuauguaguca

SEQ ID NO: 1635953 - RNA, 16 nt, Homo sapiens
gaauguggucucagga

SEQ ID NO: 1635954 - RNA, 19 nt, Homo sapiens
gaauguguuuacgcuguuu

SEQ ID NO: 1635955 - RNA, 22 nt, Homo sapiens
gaauguuccuuucgaaagcaau

SEQ ID NO: 1635956 - RNA, 16 nt, Homo sapiens
gaauucuggaaucaca

SEQ ID NO: 1635957 - RNA, 16 nt, Homo sapiens
gaauuggagugauaau

SEQ ID NO: 1635958 - RNA, 17 nt, Homo sapiens
gaauuuguuuuagccau

SEQ ID NO: 1635959 - RNA, 19 nt, Homo sapiens
gacaacauuauaacuguau

SEQ ID NO: 1635960 - RNA, 13 nt, Homo sapiens
gacaaggcccuga

SEQ ID NO: 1635961 - RNA, 13 nt, Homo sapiens
gacaaggugcuaa

SEQ ID NO: 1635962 - RNA, 17 nt, Homo sapiens
gacaaguggucugggac

SEQ ID NO: 1635963 - RNA, 20 nt, Homo sapiens
gacaauuugcugccaaacac

SEQ ID NO: 1635964 - RNA, 23 nt, Homo sapiens
gacaccugccuucaaagccacug

SEQ ID NO: 1635965 - RNA, 15 nt, Homo sapiens
gacacugcagacuug

SEQ ID NO: 1635966 - RNA, 14 nt, Homo sapiens
gacagacauacauu

SEQ ID NO: 1635967 - RNA, 20 nt, Homo sapiens
gacagagccucgcucuguua

SEQ ID NO: 1635968 - RNA, 17 nt, Homo sapiens
gacagaugggcauaugu

SEQ ID NO: 1635969 - RNA, 24 nt, Homo sapiens
gacagaugggcauaugugucagug

SEQ ID NO: 1635970 - RNA, 19 nt, Homo sapiens
gacagccuccuucagcccu

SEQ ID NO: 1635971 - RNA, 19 nt, Homo sapiens
gacagcuugaucaaaggca

SEQ ID NO: 1635972 - RNA, 21 nt, Homo sapiens
gacagcuugaucaaaggcaca

SEQ ID NO: 1635973 - RNA, 15 nt, Homo sapiens
gacaggaaaaacccg

SEQ ID NO: 1635974 - RNA, 13 nt, Homo sapiens
gacaggcacucca

SEQ ID NO: 1635975 - RNA, 12 nt, Homo sapiens
gacauacaugcu

SEQ ID NO: 1635976 - RNA, 15 nt, Homo sapiens
gacauacuuaaugca

SEQ ID NO: 1635977 - RNA, 19 nt, Homo sapiens
gacauacuuggagagcaaa

SEQ ID NO: 1635978 - RNA, 22 nt, Homo sapiens
gacauguagguaggaagcacug

SEQ ID NO: 1635979 - RNA, 17 nt, Homo sapiens
gacauucuuagcuguaa

SEQ ID NO: 1635980 - RNA, 19 nt, Homo sapiens
gacauuucuuaaaacuuua

SEQ ID NO: 1635981 - RNA, 19 nt, Homo sapiens
gaccacagcacagccaaca

SEQ ID NO: 1635982 - RNA, 19 nt, Homo sapiens
gaccaccccucucgccuca

SEQ ID NO: 1635983 - RNA, 23 nt, Homo sapiens
gaccacuuuccccgugggccaug

SEQ ID NO: 1635984 - RNA, 18 nt, Homo sapiens
gaccaucgcacaccaaau

SEQ ID NO: 1635985 - RNA, 14 nt, Homo sapiens
gaccaugcugugag

SEQ ID NO: 1635986 - RNA, 21 nt, Homo sapiens
gacccaaccccuagcugggcc

SEQ ID NO: 1635987 - RNA, 24 nt, Homo sapiens
gaccccagggcacaggagcuaccu

SEQ ID NO: 1635988 - RNA, 22 nt, Homo sapiens
gacccuuuuaagcaugugaugu

SEQ ID NO: 1635989 - RNA, 16 nt, Homo sapiens
gaccuaauaucauuuu

SEQ ID NO: 1635990 - RNA, 15 nt, Homo sapiens
gaccuccagcuuucc

SEQ ID NO: 1635991 - RNA, 20 nt, Homo sapiens
gaccucucauaaauuuacuu

SEQ ID NO: 1635992 - RNA, 18 nt, Homo sapiens
gaccuugaugagcugugc

SEQ ID NO: 1635993 - RNA, 12 nt, Homo sapiens
gacgcugcugac

SEQ ID NO: 1635994 - RNA, 18 nt, Homo sapiens
gacgugauuuugcuguag

SEQ ID NO: 1635995 - RNA, 20 nt, Homo sapiens
gacgugauuuugcuguagaa

SEQ ID NO: 1635996 - RNA, 15 nt, Homo sapiens
gacuacuauuuucuu

SEQ ID NO: 1635997 - RNA, 19 nt, Homo sapiens
gacuagggcuuauccaugc

SEQ ID NO: 1635998 - RNA, 18 nt, Homo sapiens
gacuccucuuugugcaga

SEQ ID NO: 1635999 - RNA, 14 nt, Homo sapiens
gacuccugaggaca

SEQ ID NO: 1636000 - RNA, 18 nt, Homo sapiens
gacuccuuuccaauagaa

SEQ ID NO: 1636001 - RNA, 16 nt, Homo sapiens
gacucuccagccaccc

SEQ ID NO: 1636002 - RNA, 13 nt, Homo sapiens
gacucucgcugug

SEQ ID NO: 1636003 - RNA, 16 nt, Homo sapiens
ucagacugucaggcaa

SEQ ID NO: 1636004 - RNA, 20 nt, Homo sapiens
ucagauggaagcuuacucuc

SEQ ID NO: 1636005 - RNA, 17 nt, Homo sapiens
ucagcaagaauuugauc

SEQ ID NO: 1636006 - RNA, 22 nt, Homo sapiens
ucagcaauacauagaacugaaa

SEQ ID NO: 1636007 - RNA, 22 nt, Homo sapiens
ucagcaccuacaguguacaguc

SEQ ID NO: 1636008 - RNA, 16 nt, Homo sapiens
ucagcaggcuagacag

SEQ ID NO: 1636009 - RNA, 22 nt, Homo sapiens
ucagcaucacccgggaacuuuu

SEQ ID NO: 1636010 - RNA, 15 nt, Homo sapiens
ucagcccagugcaaa

SEQ ID NO: 1636011 - RNA, 16 nt, Homo sapiens
ucagccugugccacac

SEQ ID NO: 1636012 - RNA, 21 nt, Homo sapiens
ucagcgucucuuccaccugcu

SEQ ID NO: 1636013 - RNA, 15 nt, Homo sapiens
ucagcuaccauucaa

SEQ ID NO: 1636014 - RNA, 15 nt, Homo sapiens
ucagcugaaugccuc

SEQ ID NO: 1636015 - RNA, 17 nt, Homo sapiens
ucagcuuauaugugaca

SEQ ID NO: 1636016 - RNA, 11 nt, Homo sapiens
ucaggaaaaug

SEQ ID NO: 1636017 - RNA, 13 nt, Homo sapiens
ucaggaacacccc

SEQ ID NO: 1636018 - RNA, 20 nt, Homo sapiens
ucaggaagcauaaagcaauu

SEQ ID NO: 1636019 - RNA, 16 nt, Homo sapiens
ucaggcagggugcagu

SEQ ID NO: 1636020 - RNA, 17 nt, Homo sapiens
ucaggcagggugcagua

SEQ ID NO: 1636021 - RNA, 15 nt, Homo sapiens
ucaggccacugccca

SEQ ID NO: 1636022 - RNA, 18 nt, Homo sapiens
ucaggccucugugccgca

SEQ ID NO: 1636023 - RNA, 20 nt, Homo sapiens
ucagggagaggucaccagcu

SEQ ID NO: 1636024 - RNA, 12 nt, Homo sapiens
ucaggugugaua

SEQ ID NO: 1636025 - RNA, 19 nt, Homo sapiens
ucaguaauaaaaccgguca

SEQ ID NO: 1636026 - RNA, 16 nt, Homo sapiens
ucagucugauccaucc

SEQ ID NO: 1636027 - RNA, 17 nt, Homo sapiens
ucagugaagucuagaau

SEQ ID NO: 1636028 - RNA, 21 nt, Homo sapiens
ucagugaauccugaaacuggu

SEQ ID NO: 1636029 - RNA, 23 nt, Homo sapiens
ucaguguaccgcgucuacccugg

SEQ ID NO: 1636030 - RNA, 16 nt, Homo sapiens
ucaguguagacacagg

SEQ ID NO: 1636031 - RNA, 15 nt, Homo sapiens
ucaguuauuacaugu

SEQ ID NO: 1636032 - RNA, 21 nt, Homo sapiens
ucaguucuguguggugcauuc

SEQ ID NO: 1636033 - RNA, 16 nt, Homo sapiens
ucaguuugacuacucu

SEQ ID NO: 1636034 - RNA, 23 nt, Homo sapiens
ucauaaagagguaaaaaacuguc

SEQ ID NO: 1636035 - RNA, 13 nt, Homo sapiens
ucauaaauuuacu

SEQ ID NO: 1636036 - RNA, 15 nt, Homo sapiens
ucauaaguaaaccua

SEQ ID NO: 1636037 - RNA, 20 nt, Homo sapiens
ucauaauuccuacagcacua

SEQ ID NO: 1636038 - RNA, 11 nt, Homo sapiens
ucauaccuuau

SEQ ID NO: 1636039 - RNA, 23 nt, Homo sapiens
ucauacuuaacauuucauuguac

SEQ ID NO: 1636040 - RNA, 18 nt, Homo sapiens
ucauauguuuaugguaau

SEQ ID NO: 1636041 - RNA, 20 nt, Homo sapiens
ucauauucuucauauccuuc

SEQ ID NO: 1636042 - RNA, 15 nt, Homo sapiens
ucaucacacucucca

SEQ ID NO: 1636043 - RNA, 15 nt, Homo sapiens
ucaucaggugcauag

SEQ ID NO: 1636044 - RNA, 18 nt, Homo sapiens
ucaucaggugcauagcaa

SEQ ID NO: 1636045 - RNA, 23 nt, Homo sapiens
ucaucaggugcauagcaagugaa

SEQ ID NO: 1636046 - RNA, 17 nt, Homo sapiens
ucaucauauguauaugu

SEQ ID NO: 1636047 - RNA, 15 nt, Homo sapiens
ucaucuaacugauga

SEQ ID NO: 1636048 - RNA, 17 nt, Homo sapiens
ucaucuguggagcugcc

SEQ ID NO: 1636049 - RNA, 15 nt, Homo sapiens
ucaugagcuugaaca

SEQ ID NO: 1636050 - RNA, 14 nt, Homo sapiens
ucaugccacugcac

SEQ ID NO: 1636051 - RNA, 13 nt, Homo sapiens
ucaugccucugag

SEQ ID NO: 1636052 - RNA, 17 nt, Homo sapiens
ucauggcuaauuuaaca

SEQ ID NO: 1636053 - RNA, 14 nt, Homo sapiens
ucauguugcaaaga

SEQ ID NO: 1636054 - RNA, 12 nt, Homo sapiens
ucauuacagggc

SEQ ID NO: 1636055 - RNA, 18 nt, Homo sapiens
ucauuacagggcacaggc

SEQ ID NO: 1636056 - RNA, 16 nt, Homo sapiens
ucauuauuagucuuca

SEQ ID NO: 1636057 - RNA, 13 nt, Homo sapiens
ucauucacauuca

SEQ ID NO: 1636058 - RNA, 19 nt, Homo sapiens
ucauucauuuaacagagcu

SEQ ID NO: 1636059 - RNA, 15 nt, Homo sapiens
ucauuccauugccua

SEQ ID NO: 1636060 - RNA, 17 nt, Homo sapiens
ucauucuucaguucucu

SEQ ID NO: 1636061 - RNA, 23 nt, Homo sapiens
ucauucuucaguucucuacuccc

SEQ ID NO: 1636062 - RNA, 12 nt, Homo sapiens
ucauucuuuauu

SEQ ID NO: 1636063 - RNA, 23 nt, Homo sapiens
ucauugaugagcaagacauacuu

SEQ ID NO: 1636064 - RNA, 11 nt, Homo sapiens
ucauugcacuu

SEQ ID NO: 1636065 - RNA, 12 nt, Homo sapiens
ucauugcacuuu

SEQ ID NO: 1636066 - RNA, 13 nt, Homo sapiens
ucauuguauucag

SEQ ID NO: 1636067 - RNA, 18 nt, Homo sapiens
ucauugucaccucuguga

SEQ ID NO: 1636068 - RNA, 14 nt, Homo sapiens
ucauuucauuucag

SEQ ID NO: 1636069 - RNA, 17 nt, Homo sapiens
uccaacaccaagcacag

SEQ ID NO: 1636070 - RNA, 23 nt, Homo sapiens
uccaacaugaaaacaauucuuau

SEQ ID NO: 1636071 - RNA, 23 nt, Homo sapiens
uccaacggcaagggaacaaguac

SEQ ID NO: 1636072 - RNA, 12 nt, Homo sapiens
uccaagcaccca

SEQ ID NO: 1636073 - RNA, 18 nt, Homo sapiens
uccaagcauuucaugaaa

SEQ ID NO: 1636074 - RNA, 18 nt, Homo sapiens
uccaagccugcaacucau

SEQ ID NO: 1636075 - RNA, 12 nt, Homo sapiens
uccaauacucag

SEQ ID NO: 1636076 - RNA, 22 nt, Homo sapiens
uccacaaugaugaugauuucag

SEQ ID NO: 1636077 - RNA, 20 nt, Homo sapiens
uccaccucccaacacuguca

SEQ ID NO: 1636078 - RNA, 18 nt, Homo sapiens
uccacuguucuguucuca

SEQ ID NO: 1636079 - RNA, 15 nt, Homo sapiens
uccacuuacauauau

SEQ ID NO: 1636080 - RNA, 13 nt, Homo sapiens
uccagaacacucu

SEQ ID NO: 1636081 - RNA, 14 nt, Homo sapiens
uccagagaugguca

SEQ ID NO: 1636082 - RNA, 15 nt, Homo sapiens
uccagagauggucac

SEQ ID NO: 1636083 - RNA, 19 nt, Homo sapiens
uccaggauuuuaauuucag

SEQ ID NO: 1636084 - RNA, 16 nt, Homo sapiens
uccaggguaccuuuga

SEQ ID NO: 1636085 - RNA, 14 nt, Homo sapiens
uccagguugaucuu

SEQ ID NO: 1636086 - RNA, 12 nt, Homo sapiens
uccagucuuccu

SEQ ID NO: 1636087 - RNA, 16 nt, Homo sapiens
uccaguuugcaccugu

SEQ ID NO: 1636088 - RNA, 13 nt, Homo sapiens
uccaucaauaaau

SEQ ID NO: 1636089 - RNA, 13 nt, Homo sapiens
uccauccuugacu

SEQ ID NO: 1636090 - RNA, 15 nt, Homo sapiens
uccaugcaaaccaug

SEQ ID NO: 1636091 - RNA, 20 nt, Homo sapiens
uccaugcaccuaccuuagaa

SEQ ID NO: 1636092 - RNA, 14 nt, Homo sapiens
uccaugccugggaa

SEQ ID NO: 1636093 - RNA, 12 nt, Homo sapiens
uccaugcugcaa

SEQ ID NO: 1636094 - RNA, 19 nt, Homo sapiens
uccaugcugcaaaggagaa

SEQ ID NO: 1636095 - RNA, 22 nt, Homo sapiens
uccaugcugcaaaggagaagca

SEQ ID NO: 1636096 - RNA, 13 nt, Homo sapiens
uccauucacuccc

SEQ ID NO: 1636097 - RNA, 14 nt, Homo sapiens
uccauucacuccca

SEQ ID NO: 1636098 - RNA, 18 nt, Homo sapiens
uccauuccccacuucucu

SEQ ID NO: 1636099 - RNA, 22 nt, Homo sapiens
ucccaaccccaguggauucuca

SEQ ID NO: 1636100 - RNA, 20 nt, Homo sapiens
ucccacaugaggccaucuca

SEQ ID NO: 1636101 - RNA, 16 nt, Homo sapiens
ucccaccauuccugcc

SEQ ID NO: 1636102 - RNA, 17 nt, Homo sapiens
ucccacccacaugugac

SEQ ID NO: 1636103 - RNA, 20 nt, Homo sapiens
ucccacccacaugugacaca

SEQ ID NO: 1636104 - RNA, 13 nt, Homo sapiens
ucccacuaucugg

SEQ ID NO: 1636105 - RNA, 17 nt, Homo sapiens
ucccacugacuguaugg

SEQ ID NO: 1636106 - RNA, 20 nt, Homo sapiens
ucccacugcucccccaacac

SEQ ID NO: 1636107 - RNA, 13 nt, Homo sapiens
ucccagcacuuug

SEQ ID NO: 1636108 - RNA, 19 nt, Homo sapiens
ucccaguaguuauaaaguc

SEQ ID NO: 1636109 - RNA, 23 nt, Homo sapiens
ucccauccuggggcagcacuccc

SEQ ID NO: 1636110 - RNA, 21 nt, Homo sapiens
ucccauuuuucucuugccauu

SEQ ID NO: 1636111 - RNA, 15 nt, Homo sapiens
uccccaacaugcacu

SEQ ID NO: 1636112 - RNA, 13 nt, Homo sapiens
uccccaacgaaaa

SEQ ID NO: 1636113 - RNA, 16 nt, Homo sapiens
uccccaacgaaaagca

SEQ ID NO: 1636114 - RNA, 12 nt, Homo sapiens
ucuccaugcugc

SEQ ID NO: 1636115 - RNA, 20 nt, Homo sapiens
ucuccccucacccaugcuuu

SEQ ID NO: 1636116 - RNA, 20 nt, Homo sapiens
ucuccucuucauggcaucuu

SEQ ID NO: 1636117 - RNA, 13 nt, Homo sapiens
ucuccugccucag

SEQ ID NO: 1636118 - RNA, 20 nt, Homo sapiens
ucucgaacuccuaaccucaa

SEQ ID NO: 1636119 - RNA, 18 nt, Homo sapiens
ucucgugguaggacugua

SEQ ID NO: 1636120 - RNA, 13 nt, Homo sapiens
ucucuacucccuc

SEQ ID NO: 1636121 - RNA, 16 nt, Homo sapiens
ucucuagcuuugucau

SEQ ID NO: 1636122 - RNA, 21 nt, Homo sapiens
ucucucccugccucacaucuc

SEQ ID NO: 1636123 - RNA, 23 nt, Homo sapiens
ucucuccgucuguuuuugcaacu

SEQ ID NO: 1636124 - RNA, 14 nt, Homo sapiens
ucucucucuugccu

SEQ ID NO: 1636125 - RNA, 15 nt, Homo sapiens
ucucucucuugccug

SEQ ID NO: 1636126 - RNA, 17 nt, Homo sapiens
ucucugaauuugagaua

SEQ ID NO: 1636127 - RNA, 18 nt, Homo sapiens
ucucugcauguguaaaag

SEQ ID NO: 1636128 - RNA, 14 nt, Homo sapiens
ucucuuuguaaaac

SEQ ID NO: 1636129 - RNA, 19 nt, Homo sapiens
ucugaaaucaacucucuuc

SEQ ID NO: 1636130 - RNA, 12 nt, Homo sapiens
ucugaacuucca

SEQ ID NO: 1636131 - RNA, 18 nt, Homo sapiens
ucugaauuugagauacaa

SEQ ID NO: 1636132 - RNA, 14 nt, Homo sapiens
ucugagagacagaa

SEQ ID NO: 1636133 - RNA, 16 nt, Homo sapiens
ucugagagacagaauu

SEQ ID NO: 1636134 - RNA, 17 nt, Homo sapiens
ucugagagacagaauuc

SEQ ID NO: 1636135 - RNA, 20 nt, Homo sapiens
ucugagucuauguucaaaga

SEQ ID NO: 1636136 - RNA, 18 nt, Homo sapiens
ucugaguggcuucacucc

SEQ ID NO: 1636137 - RNA, 21 nt, Homo sapiens
ucugauaagcuuccuagaaag

SEQ ID NO: 1636138 - RNA, 20 nt, Homo sapiens
ucugcaaaaggccucuugua

SEQ ID NO: 1636139 - RNA, 20 nt, Homo sapiens
ucugcaaaguguaugugacc

SEQ ID NO: 1636140 - RNA, 11 nt, Homo sapiens
ucugcacggga

SEQ ID NO: 1636141 - RNA, 22 nt, Homo sapiens
ucugcauggaacagcauuaccc

SEQ ID NO: 1636142 - RNA, 16 nt, Homo sapiens
ucugccaggugagggu

SEQ ID NO: 1636143 - RNA, 20 nt, Homo sapiens
ucugccuggcaacaucuuac

SEQ ID NO: 1636144 - RNA, 12 nt, Homo sapiens
ucugcugcugag

SEQ ID NO: 1636145 - RNA, 23 nt, Homo sapiens
ucugcuggggauggccacuguga

SEQ ID NO: 1636146 - RNA, 22 nt, Homo sapiens
ucugcugucuuuauaaugggau

SEQ ID NO: 1636147 - RNA, 12 nt, Homo sapiens
ucugcuugucaa

SEQ ID NO: 1636148 - RNA, 19 nt, Homo sapiens
ucugcuuuucccauugcca

SEQ ID NO: 1636149 - RNA, 15 nt, Homo sapiens
ucugcuuuuccucug

SEQ ID NO: 1636150 - RNA, 20 nt, Homo sapiens
ucuggaaaccucuacauauu

SEQ ID NO: 1636151 - RNA, 23 nt, Homo sapiens
ucuggaucacagacacugcacag

SEQ ID NO: 1636152 - RNA, 22 nt, Homo sapiens
ucuggauuguuuuuaaaccucc

SEQ ID NO: 1636153 - RNA, 22 nt, Homo sapiens
ucuggcagccacacuucucagg

SEQ ID NO: 1636154 - RNA, 20 nt, Homo sapiens
ucuggcagccucccauccag

SEQ ID NO: 1636155 - RNA, 12 nt, Homo sapiens
ucugggugcaug

SEQ ID NO: 1636156 - RNA, 16 nt, Homo sapiens
ucugguaaaacuuuag

SEQ ID NO: 1636157 - RNA, 18 nt, Homo sapiens
ucuguagugagauagcau

SEQ ID NO: 1636158 - RNA, 16 nt, Homo sapiens
ucugucaggugugaua

SEQ ID NO: 1636159 - RNA, 20 nt, Homo sapiens
ucuguccugauuucuacaac

SEQ ID NO: 1636160 - RNA, 21 nt, Homo sapiens
ucugugaccccuccuugucag

SEQ ID NO: 1636161 - RNA, 13 nt, Homo sapiens
ucuguguuuacag

SEQ ID NO: 1636162 - RNA, 20 nt, Homo sapiens
ucuguguuuuugaaauauua

SEQ ID NO: 1636163 - RNA, 19 nt, Homo sapiens
ucuuaaauuugauuuacau

SEQ ID NO: 1636164 - RNA, 22 nt, Homo sapiens
ucuuaacaaguuagaaaauuca

SEQ ID NO: 1636165 - RNA, 23 nt, Homo sapiens
ucuuaagacgugauuuugcugua

SEQ ID NO: 1636166 - RNA, 18 nt, Homo sapiens
ucuuacaguguuuggaca

SEQ ID NO: 1636167 - RNA, 21 nt, Homo sapiens
ucuuacuaauguaaaaugauu

SEQ ID NO: 1636168 - RNA, 13 nt, Homo sapiens
ucuuagcuauguu

SEQ ID NO: 1636169 - RNA, 18 nt, Homo sapiens
ucuuauuaaucauacaaa

SEQ ID NO: 1636170 - RNA, 16 nt, Homo sapiens
ucuuauugacucauac

SEQ ID NO: 1636171 - RNA, 15 nt, Homo sapiens
ucuucaacaugacau

SEQ ID NO: 1636172 - RNA, 13 nt, Homo sapiens
ucuucaagauuua

SEQ ID NO: 1636173 - RNA, 22 nt, Homo sapiens
ucuucaccuuaggaauaaucuc

SEQ ID NO: 1636174 - RNA, 16 nt, Homo sapiens
ucuucccaaacccagu

SEQ ID NO: 1636175 - RNA, 15 nt, Homo sapiens
ucuucccccuuccaa

SEQ ID NO: 1636176 - RNA, 14 nt, Homo sapiens
ucuucuuguugacc

SEQ ID NO: 1636177 - RNA, 16 nt, Homo sapiens
ucuugaacuccugacc

SEQ ID NO: 1636178 - RNA, 14 nt, Homo sapiens
ucuugaaguacuua

SEQ ID NO: 1636179 - RNA, 14 nt, Homo sapiens
ucuugaaucucuga

SEQ ID NO: 1636180 - RNA, 23 nt, Homo sapiens
ucuugaguauaagaaaugcauau

SEQ ID NO: 1636181 - RNA, 18 nt, Homo sapiens
ucuugaucggaaagcucu

SEQ ID NO: 1636182 - RNA, 16 nt, Homo sapiens
ucuuggaaugaaugac

SEQ ID NO: 1636183 - RNA, 13 nt, Homo sapiens
ucuuggggccacu

SEQ ID NO: 1636184 - RNA, 22 nt, Homo sapiens
ucuugucagacauaaagccaug

SEQ ID NO: 1636185 - RNA, 17 nt, Homo sapiens
ucuuuaauaaauugcuu

SEQ ID NO: 1636186 - RNA, 21 nt, Homo sapiens
ucuuuauaaugggauauaguu

SEQ ID NO: 1636187 - RNA, 16 nt, Homo sapiens
ucuuuccugaaccaug

SEQ ID NO: 1636188 - RNA, 17 nt, Homo sapiens
ucuuugccagucauuca

SEQ ID NO: 1636189 - RNA, 20 nt, Homo sapiens
ucuuugguuuuaucauucca

SEQ ID NO: 1636190 - RNA, 17 nt, Homo sapiens
ucuuuguaaaacaaaga

SEQ ID NO: 1636191 - RNA, 11 nt, Homo sapiens
ucuuuguucaa

SEQ ID NO: 1636192 - RNA, 16 nt, Homo sapiens
ucuuuuaagcuaucua

SEQ ID NO: 1636193 - RNA, 15 nt, Homo sapiens
ucuuuucaucuggga

SEQ ID NO: 1636194 - RNA, 19 nt, Homo sapiens
ucuuuuuccuucuacuccu

SEQ ID NO: 1636195 - RNA, 15 nt, Homo sapiens
ugaaaaaucauccaa

SEQ ID NO: 1636196 - RNA, 24 nt, Homo sapiens
ugaaaacaauucuuauugacucau

SEQ ID NO: 1636197 - RNA, 14 nt, Homo sapiens
ugaaaaccuacaua

SEQ ID NO: 1636198 - RNA, 17 nt, Homo sapiens
ugaaaagaaaaagccac

SEQ ID NO: 1636199 - RNA, 16 nt, Homo sapiens
ugaaaagggcacuccc

SEQ ID NO: 1636200 - RNA, 20 nt, Homo sapiens
ugaaaauaaacauguauaaa

SEQ ID NO: 1636201 - RNA, 15 nt, Homo sapiens
ugaaaaugaaagugu

SEQ ID NO: 1636202 - RNA, 21 nt, Homo sapiens
ugaaacucauagacacugauc

SEQ ID NO: 1636203 - RNA, 15 nt, Homo sapiens
ugaaagaagcaagac

SEQ ID NO: 1636204 - RNA, 18 nt, Homo sapiens
ugaaaggaucucugagac

SEQ ID NO: 1636205 - RNA, 17 nt, Homo sapiens
ugaaaucaacucucuuc

SEQ ID NO: 1636206 - RNA, 16 nt, Homo sapiens
ugaaauuagggcccaa

SEQ ID NO: 1636207 - RNA, 18 nt, Homo sapiens
ugaaauuauuucucucac

SEQ ID NO: 1636208 - RNA, 18 nt, Homo sapiens
ugaaauuugagagacaaa

SEQ ID NO: 1636209 - RNA, 19 nt, Homo sapiens
ugaaauuuggcuaauaaca

SEQ ID NO: 1636210 - RNA, 17 nt, Homo sapiens
ugaacaaagcagccacg

SEQ ID NO: 1636211 - RNA, 19 nt, Homo sapiens
ugaacacaaguuccugaua

SEQ ID NO: 1636212 - RNA, 18 nt, Homo sapiens
ugaacauaaguaaucacu

SEQ ID NO: 1636213 - RNA, 11 nt, Homo sapiens
ugaacaucucu

SEQ ID NO: 1636214 - RNA, 11 nt, Homo sapiens
ugaacauucca

SEQ ID NO: 1636215 - RNA, 19 nt, Homo sapiens
ugaacccaggacaagcaug

SEQ ID NO: 1636216 - RNA, 17 nt, Homo sapiens
ugaacuaggcugagcaa

SEQ ID NO: 1636217 - RNA, 19 nt, Homo sapiens
ugaacuguaccaugugcua

SEQ ID NO: 1636218 - RNA, 14 nt, Homo sapiens
ugaacuucagggag

SEQ ID NO: 1636219 - RNA, 20 nt, Homo sapiens
ugaacuucuuugaauuuacu

SEQ ID NO: 1636220 - RNA, 18 nt, Homo sapiens
ugaagaccccacugccac

SEQ ID NO: 1636221 - RNA, 14 nt, Homo sapiens
ugaagagcuucauu

SEQ ID NO: 1636222 - RNA, 14 nt, Homo sapiens
ugaagaguuucaca

SEQ ID NO: 1636223 - RNA, 14 nt, Homo sapiens
ugaagcugaggcuc

SEQ ID NO: 1636224 - RNA, 16 nt, Homo sapiens
uguaacguggcacugg

SEQ ID NO: 1636225 - RNA, 21 nt, Homo sapiens
uguaacugagagaaagauucu

SEQ ID NO: 1636226 - RNA, 19 nt, Homo sapiens
uguaagaacaacuaccuga

SEQ ID NO: 1636227 - RNA, 16 nt, Homo sapiens
uguaagagaaauggaa

SEQ ID NO: 1636228 - RNA, 15 nt, Homo sapiens
uguaaggacagaaua

SEQ ID NO: 1636229 - RNA, 19 nt, Homo sapiens
uguaagggcagugcccaug

SEQ ID NO: 1636230 - RNA, 22 nt, Homo sapiens
uguaaguuuaccuauguaacaa

SEQ ID NO: 1636231 - RNA, 15 nt, Homo sapiens
uguaauauuuagcug

SEQ ID NO: 1636232 - RNA, 14 nt, Homo sapiens
uguacaaauucuua

SEQ ID NO: 1636233 - RNA, 13 nt, Homo sapiens
uguacacagaauu

SEQ ID NO: 1636234 - RNA, 23 nt, Homo sapiens
uguacagaggucagcacacauua

SEQ ID NO: 1636235 - RNA, 11 nt, Homo sapiens
uguacaggaug

SEQ ID NO: 1636236 - RNA, 14 nt, Homo sapiens
uguacagucuugua

SEQ ID NO: 1636237 - RNA, 22 nt, Homo sapiens
uguacagugaacaaaugucuua

SEQ ID NO: 1636238 - RNA, 22 nt, Homo sapiens
uguacaguuuuuauugcuuguu

SEQ ID NO: 1636239 - RNA, 17 nt, Homo sapiens
uguacaugugcacuccc

SEQ ID NO: 1636240 - RNA, 19 nt, Homo sapiens
uguacaugugcacucccca

SEQ ID NO: 1636241 - RNA, 17 nt, Homo sapiens
uguacccccagguggaa

SEQ ID NO: 1636242 - RNA, 16 nt, Homo sapiens
uguacuauggucucuu

SEQ ID NO: 1636243 - RNA, 13 nt, Homo sapiens
uguacugccuuaa

SEQ ID NO: 1636244 - RNA, 15 nt, Homo sapiens
uguagacacagguca

SEQ ID NO: 1636245 - RNA, 19 nt, Homo sapiens
uguagacaggaaagccagg

SEQ ID NO: 1636246 - RNA, 15 nt, Homo sapiens
uguauaaguaauuca

SEQ ID NO: 1636247 - RNA, 19 nt, Homo sapiens
uguauagauccacagggag

SEQ ID NO: 1636248 - RNA, 14 nt, Homo sapiens
uguauccagucuga

SEQ ID NO: 1636249 - RNA, 22 nt, Homo sapiens
uguaugcaaaucaaacauauuc

SEQ ID NO: 1636250 - RNA, 22 nt, Homo sapiens
uguauuauuauuauugcugcca

SEQ ID NO: 1636251 - RNA, 13 nt, Homo sapiens
uguauugccaucc

SEQ ID NO: 1636252 - RNA, 14 nt, Homo sapiens
ugucaccucuguga

SEQ ID NO: 1636253 - RNA, 20 nt, Homo sapiens
ugucaccucugugaccccuc

SEQ ID NO: 1636254 - RNA, 18 nt, Homo sapiens
ugucacuugacucuugaa

SEQ ID NO: 1636255 - RNA, 19 nt, Homo sapiens
ugucagauagucuauguau

SEQ ID NO: 1636256 - RNA, 11 nt, Homo sapiens
ugucaguucuc

SEQ ID NO: 1636257 - RNA, 21 nt, Homo sapiens
ugucaguuuuguacauagcaa

SEQ ID NO: 1636258 - RNA, 15 nt, Homo sapiens
ugucaucugugcacu

SEQ ID NO: 1636259 - RNA, 19 nt, Homo sapiens
ugucauuucauuccauugc

SEQ ID NO: 1636260 - RNA, 20 nt, Homo sapiens
uguccacuguucuguucuca

SEQ ID NO: 1636261 - RNA, 23 nt, Homo sapiens
ugucccacuaucugggugcauga

SEQ ID NO: 1636262 - RNA, 13 nt, Homo sapiens
uguccuccaacac

SEQ ID NO: 1636263 - RNA, 15 nt, Homo sapiens
uguccucuucugcau

SEQ ID NO: 1636264 - RNA, 21 nt, Homo sapiens
ugucgccacacgccucugcau

SEQ ID NO: 1636265 - RNA, 18 nt, Homo sapiens
ugucguauaggcauguaa

SEQ ID NO: 1636266 - RNA, 14 nt, Homo sapiens
ugucuaucauauga

SEQ ID NO: 1636267 - RNA, 16 nt, Homo sapiens
ugucucaaaccuccaa

SEQ ID NO: 1636268 - RNA, 23 nt, Homo sapiens
ugucucaugucaaugaccauuca

SEQ ID NO: 1636269 - RNA, 18 nt, Homo sapiens
ugucucccagcucagggc

SEQ ID NO: 1636270 - RNA, 21 nt, Homo sapiens
ugucugcuugucaaaagaaau

SEQ ID NO: 1636271 - RNA, 19 nt, Homo sapiens
ugucugcuuucuccauugu

SEQ ID NO: 1636272 - RNA, 14 nt, Homo sapiens
ugucuuaccaguga

SEQ ID NO: 1636273 - RNA, 16 nt, Homo sapiens
ugucuuacuacuuuaa

SEQ ID NO: 1636274 - RNA, 18 nt, Homo sapiens
ugucuuggacacuguaca

SEQ ID NO: 1636275 - RNA, 19 nt, Homo sapiens
ugucuuggacacuguacaa

SEQ ID NO: 1636276 - RNA, 22 nt, Homo sapiens
ugucuuguucauuuugaguauu

SEQ ID NO: 1636277 - RNA, 18 nt, Homo sapiens
ugucuuuucaaaauauua

SEQ ID NO: 1636278 - RNA, 17 nt, Homo sapiens
ugugaaacaguugcugu

SEQ ID NO: 1636279 - RNA, 21 nt, Homo sapiens
ugugaaacgucuggacugcua

SEQ ID NO: 1636280 - RNA, 15 nt, Homo sapiens
ugugaacaucccuua

SEQ ID NO: 1636281 - RNA, 16 nt, Homo sapiens
ugugaacccaggacaa

SEQ ID NO: 1636282 - RNA, 20 nt, Homo sapiens
ugugaaggccucgcaggaag

SEQ ID NO: 1636283 - RNA, 16 nt, Homo sapiens
ugugaauaaagugcug

SEQ ID NO: 1636284 - RNA, 14 nt, Homo sapiens
ugugacacauaugc

SEQ ID NO: 1636285 - RNA, 12 nt, Homo sapiens
ugugacuacuga

SEQ ID NO: 1636286 - RNA, 14 nt, Homo sapiens
ugugacugucacuu

SEQ ID NO: 1636287 - RNA, 20 nt, Homo sapiens
ugugauauauuagggacacu

SEQ ID NO: 1636288 - RNA, 17 nt, Homo sapiens
ugugaugggcuguuuaa

SEQ ID NO: 1636289 - RNA, 17 nt, Homo sapiens
ugugauuuuaacucugu

SEQ ID NO: 1636290 - RNA, 17 nt, Homo sapiens
ugugcacaaaguggcau

SEQ ID NO: 1636291 - RNA, 20 nt, Homo sapiens
ugugcagagcagacaggcua

SEQ ID NO: 1636292 - RNA, 22 nt, Homo sapiens
ugugcauggaggcccuccugug

SEQ ID NO: 1636293 - RNA, 18 nt, Homo sapiens
ugugcucuaaaauucuau

SEQ ID NO: 1636294 - RNA, 12 nt, Homo sapiens
uguggacacugc

SEQ ID NO: 1636295 - RNA, 17 nt, Homo sapiens
uguggaccucacaagau

SEQ ID NO: 1636296 - RNA, 21 nt, Homo sapiens
uguggagugacucaaaucagu

SEQ ID NO: 1636297 - RNA, 17 nt, Homo sapiens
ugugguuuuaccugcag

SEQ ID NO: 1636298 - RNA, 15 nt, Homo sapiens
uguguagccugugca

SEQ ID NO: 1636299 - RNA, 13 nt, Homo sapiens
uguguagcuguga

SEQ ID NO: 1636300 - RNA, 15 nt, Homo sapiens
ugugucacaaagaau

SEQ ID NO: 1636301 - RNA, 15 nt, Homo sapiens
uguguccacagaguu

SEQ ID NO: 1636302 - RNA, 16 nt, Homo sapiens
uguguggcagagccag

SEQ ID NO: 1636303 - RNA, 13 nt, Homo sapiens
uguguguacucug

SEQ ID NO: 1636304 - RNA, 15 nt, Homo sapiens
uguguguguguacaa

SEQ ID NO: 1636305 - RNA, 22 nt, Homo sapiens
uguguuacugcuuugcaaagac

SEQ ID NO: 1636306 - RNA, 14 nt, Homo sapiens
uguguugaaugaag

SEQ ID NO: 1636307 - RNA, 13 nt, Homo sapiens
uguguuucuuuag

SEQ ID NO: 1636308 - RNA, 20 nt, Homo sapiens
uguguuuuuaacaugucaau

SEQ ID NO: 1636309 - RNA, 20 nt, Homo sapiens
uguuaaaacaaccaguuaaa

SEQ ID NO: 1636310 - RNA, 21 nt, Homo sapiens
uguuacccaggguggagugca

SEQ ID NO: 1636311 - RNA, 23 nt, Homo sapiens
uguuacgaugcaauucuagccaa

SEQ ID NO: 1636312 - RNA, 20 nt, Homo sapiens
uguuacugacuccucagucc

SEQ ID NO: 1636313 - RNA, 15 nt, Homo sapiens
uguuagcuuccuuaa

SEQ ID NO: 1636314 - RNA, 12 nt, Homo sapiens
uguuagcuuucc

SEQ ID NO: 1636315 - RNA, 15 nt, Homo sapiens
uguuaggugugcaaa

SEQ ID NO: 1636316 - RNA, 15 nt, Homo sapiens
uguuaguuguccaca

SEQ ID NO: 1636317 - RNA, 18 nt, Homo sapiens
uguuauguaaaaggccaa

SEQ ID NO: 1636318 - RNA, 11 nt, Homo sapiens
uguucaaagac

SEQ ID NO: 1636319 - RNA, 21 nt, Homo sapiens
uguuccaguacuauggagugc

SEQ ID NO: 1636320 - RNA, 18 nt, Homo sapiens
uguuccuuauauuuacuc

SEQ ID NO: 1636321 - RNA, 22 nt, Homo sapiens
uguucuccuuuggaauggugua

SEQ ID NO: 1636322 - RNA, 19 nt, Homo sapiens
uguucugccuggagacaag

SEQ ID NO: 1636323 - RNA, 15 nt, Homo sapiens
uguucuuagagugua

SEQ ID NO: 1636324 - RNA, 21 nt, Homo sapiens
uguugaaucuauuucacuuau

SEQ ID NO: 1636325 - RNA, 22 nt, Homo sapiens
uguugcugagucugcagaugag

SEQ ID NO: 1636326 - RNA, 15 nt, Homo sapiens
uguuguacuugaaaa

SEQ ID NO: 1636327 - RNA, 14 nt, Homo sapiens
uguuuaacugugaa

SEQ ID NO: 1636328 - RNA, 17 nt, Homo sapiens
uguuucgucauguuggc

SEQ ID NO: 1636329 - RNA, 16 nt, Homo sapiens
uguuucuaaacuagga

SEQ ID NO: 1636330 - RNA, 22 nt, Homo sapiens
uguuucuaaacuaggauugaca

SEQ ID NO: 1636331 - RNA, 22 nt, Homo sapiens
uguuucugucaagcuggugcua

SEQ ID NO: 1636332 - RNA, 23 nt, Homo sapiens
uguuuuaaagaauaugacuuuuu

SEQ ID NO: 1636333 - RNA, 14 nt, Homo sapiens
uguuuuaaguacua

SEQ ID NO: 1636334 - RNA, 12 nt, Homo sapiens
uuucucugugaa

SEQ ID NO: 1636335 - RNA, 14 nt, Homo sapiens
uuucuguaguguga

SEQ ID NO: 1636336 - RNA, 16 nt, Homo sapiens
uuucuuuuacagacua

SEQ ID NO: 1636337 - RNA, 18 nt, Homo sapiens
uuucuuuuuuauacucaa

SEQ ID NO: 1636338 - RNA, 22 nt, Homo sapiens
uuugaaaacauauaaagcacua

SEQ ID NO: 1636339 - RNA, 18 nt, Homo sapiens
uuugaaacaaaguacucu

SEQ ID NO: 1636340 - RNA, 16 nt, Homo sapiens
uuugaacaaagcucaa

SEQ ID NO: 1636341 - RNA, 22 nt, Homo sapiens
uuugaaccauccacuuacauau

SEQ ID NO: 1636342 - RNA, 20 nt, Homo sapiens
uuugaagugaaaaaguacau

SEQ ID NO: 1636343 - RNA, 18 nt, Homo sapiens
uuugaaugacaagauuag

SEQ ID NO: 1636344 - RNA, 20 nt, Homo sapiens
uuugaggaacauuauuuaau

SEQ ID NO: 1636345 - RNA, 15 nt, Homo sapiens
uuugauuuacauaua

SEQ ID NO: 1636346 - RNA, 17 nt, Homo sapiens
uuugccaaaauucauuu

SEQ ID NO: 1636347 - RNA, 22 nt, Homo sapiens
uuugcguacacagagaaggcua

SEQ ID NO: 1636348 - RNA, 22 nt, Homo sapiens
uuugcucccuaccugacugcca

SEQ ID NO: 1636349 - RNA, 12 nt, Homo sapiens
uuugcuccuuca

SEQ ID NO: 1636350 - RNA, 14 nt, Homo sapiens
uuuggaauuugaca

SEQ ID NO: 1636351 - RNA, 19 nt, Homo sapiens
uuugggagggaaaagggaa

SEQ ID NO: 1636352 - RNA, 20 nt, Homo sapiens
uuugggauguuaccuucaca

SEQ ID NO: 1636353 - RNA, 21 nt, Homo sapiens
uuugggcacggcccuccuucu

SEQ ID NO: 1636354 - RNA, 15 nt, Homo sapiens
uuuggggcaggagua

SEQ ID NO: 1636355 - RNA, 15 nt, Homo sapiens
uuuguaaacuucuga

SEQ ID NO: 1636356 - RNA, 23 nt, Homo sapiens
uuugucagaggcacaaaaggguu

SEQ ID NO: 1636357 - RNA, 15 nt, Homo sapiens
uuuguuggagccacu

SEQ ID NO: 1636358 - RNA, 14 nt, Homo sapiens
uuuuaacaugucaa

SEQ ID NO: 1636359 - RNA, 17 nt, Homo sapiens
uuuuaacucugucuuca

SEQ ID NO: 1636360 - RNA, 20 nt, Homo sapiens
uuuuaauccuuaacacauuc

SEQ ID NO: 1636361 - RNA, 12 nt, Homo sapiens
uuuuacauaguu

SEQ ID NO: 1636362 - RNA, 11 nt, Homo sapiens
uuuuaccauac

SEQ ID NO: 1636363 - RNA, 18 nt, Homo sapiens
uuuuaccugcccaaggau

SEQ ID NO: 1636364 - RNA, 15 nt, Homo sapiens
uuuuacguaugagau

SEQ ID NO: 1636365 - RNA, 18 nt, Homo sapiens
uuuuacuaaaacacugaa

SEQ ID NO: 1636366 - RNA, 19 nt, Homo sapiens
uuuuaguucaauacaguga

SEQ ID NO: 1636367 - RNA, 12 nt, Homo sapiens
uuuuaucucaca

SEQ ID NO: 1636368 - RNA, 16 nt, Homo sapiens
uuuuaucucacaaaua

SEQ ID NO: 1636369 - RNA, 18 nt, Homo sapiens
uuuucaagaugguguuau

SEQ ID NO: 1636370 - RNA, 16 nt, Homo sapiens
uuuucaaggccuucag

SEQ ID NO: 1636371 - RNA, 21 nt, Homo sapiens
uuuucacugccugaccuuuaa

SEQ ID NO: 1636372 - RNA, 14 nt, Homo sapiens
uuuucaguaccaaa

SEQ ID NO: 1636373 - RNA, 15 nt, Homo sapiens
uuuucauuauugguu

SEQ ID NO: 1636374 - RNA, 17 nt, Homo sapiens
uuuucauuuaacuuuau

SEQ ID NO: 1636375 - RNA, 11 nt, Homo sapiens
uuuuccagaac

SEQ ID NO: 1636376 - RNA, 13 nt, Homo sapiens
uuuucuacaaaua

SEQ ID NO: 1636377 - RNA, 20 nt, Homo sapiens
uuuucuauagaaaaaguaaa

SEQ ID NO: 1636378 - RNA, 12 nt, Homo sapiens
uuuucucuugcc

SEQ ID NO: 1636379 - RNA, 20 nt, Homo sapiens
uuuugaggccuuuuuugcca

SEQ ID NO: 1636380 - RNA, 15 nt, Homo sapiens
uuuugauaaguaucu

SEQ ID NO: 1636381 - RNA, 19 nt, Homo sapiens
uuuugcuugggaaacucaa

SEQ ID NO: 1636382 - RNA, 12 nt, Homo sapiens
uuuuggcuuuau

SEQ ID NO: 1636383 - RNA, 11 nt, Homo sapiens
uuuugugaauc

SEQ ID NO: 1636384 - RNA, 20 nt, Homo sapiens
uuuuuauaucaugcaaaaua

SEQ ID NO: 1636385 - RNA, 21 nt, Homo sapiens
uuuuuaugaagugcgugaaug

SEQ ID NO: 1636386 - RNA, 14 nt, Homo sapiens
uuuuuccucugcau

SEQ ID NO: 1636387 - RNA, 21 nt, Homo sapiens
uuuuugaaaaaaguacauauu

SEQ ID NO: 1636388 - RNA, 13 nt, Homo sapiens
uuuuuucccccac

SEQ ID NO: 1636389 - RNA, 11 nt, Homo sapiens
aggagcucaac

SEQ ID NO: 1636390 - RNA, 17 nt, Homo sapiens
aggaggcccacuguguc

SEQ ID NO: 1636391 - RNA, 23 nt, Homo sapiens
aggaggugaaagaaagggaccca

SEQ ID NO: 1636392 - RNA, 17 nt, Homo sapiens
aggaguacaaugcccag

SEQ ID NO: 1636393 - RNA, 20 nt, Homo sapiens
aggaguacaaugcccagauc

SEQ ID NO: 1636394 - RNA, 14 nt, Homo sapiens
aggauaaagccacu

SEQ ID NO: 1636395 - RNA, 15 nt, Homo sapiens
aggauauuaacaaca

SEQ ID NO: 1636396 - RNA, 13 nt, Homo sapiens
aggaugcugucaa

SEQ ID NO: 1636397 - RNA, 19 nt, Homo sapiens
aggaugcugucaagcaccu

SEQ ID NO: 1636398 - RNA, 14 nt, Homo sapiens
aggauguaagccug

SEQ ID NO: 1636399 - RNA, 17 nt, Homo sapiens
aggauguauaaaauggu

SEQ ID NO: 1636400 - RNA, 18 nt, Homo sapiens
aggauugagaagggacaa

SEQ ID NO: 1636401 - RNA, 21 nt, Homo sapiens
aggauuuucacauucuuggcu

SEQ ID NO: 1636402 - RNA, 15 nt, Homo sapiens
aggcaauggccuaaa

SEQ ID NO: 1636403 - RNA, 18 nt, Homo sapiens
aggcacagcuaaccacuu

SEQ ID NO: 1636404 - RNA, 23 nt, Homo sapiens
aggcacagugggagcugagcugg

SEQ ID NO: 1636405 - RNA, 16 nt, Homo sapiens
aggcacuuaaagccuu

SEQ ID NO: 1636406 - RNA, 14 nt, Homo sapiens
aggcaguccaucua

SEQ ID NO: 1636407 - RNA, 16 nt, Homo sapiens
aggccaaaccucuguu

SEQ ID NO: 1636408 - RNA, 19 nt, Homo sapiens
aggccacugcccacccugg

SEQ ID NO: 1636409 - RNA, 19 nt, Homo sapiens
aggcccacgguuucagcua

SEQ ID NO: 1636410 - RNA, 14 nt, Homo sapiens
aggcccccaucucc

SEQ ID NO: 1636411 - RNA, 16 nt, Homo sapiens
aggccccugucucagg

SEQ ID NO: 1636412 - RNA, 21 nt, Homo sapiens
aggcccugagcuuuguccuga

SEQ ID NO: 1636413 - RNA, 18 nt, Homo sapiens
aggcccugucucuggcua

SEQ ID NO: 1636414 - RNA, 18 nt, Homo sapiens
aggcccuuaacuaucacc

SEQ ID NO: 1636415 - RNA, 23 nt, Homo sapiens
aggccucgaaaaccaucacauga

SEQ ID NO: 1636416 - RNA, 19 nt, Homo sapiens
aggccucuccaguuugcac

SEQ ID NO: 1636417 - RNA, 12 nt, Homo sapiens
aggccucugugc

SEQ ID NO: 1636418 - RNA, 16 nt, Homo sapiens
aggccuuuuuugccag

SEQ ID NO: 1636419 - RNA, 20 nt, Homo sapiens
aggcuauguaaacaaaccac

SEQ ID NO: 1636420 - RNA, 19 nt, Homo sapiens
aggcucaggucccuggggc

SEQ ID NO: 1636421 - RNA, 20 nt, Homo sapiens
aggcuccugaaugugacugg

SEQ ID NO: 1636422 - RNA, 18 nt, Homo sapiens
aggcugaccacagcacag

SEQ ID NO: 1636423 - RNA, 11 nt, Homo sapiens
aggcugagggc

SEQ ID NO: 1636424 - RNA, 15 nt, Homo sapiens
aggcugauaccuuug

SEQ ID NO: 1636425 - RNA, 15 nt, Homo sapiens
aggcugaucccugag

SEQ ID NO: 1636426 - RNA, 23 nt, Homo sapiens
aggcugauuccucucauuuccag

SEQ ID NO: 1636427 - RNA, 22 nt, Homo sapiens
aggcugcagugagccaugagua

SEQ ID NO: 1636428 - RNA, 14 nt, Homo sapiens
aggcugcugcacac

SEQ ID NO: 1636429 - RNA, 15 nt, Homo sapiens
aggcuggagugcaau

SEQ ID NO: 1636430 - RNA, 16 nt, Homo sapiens
aggcuggagugcaaug

SEQ ID NO: 1636431 - RNA, 18 nt, Homo sapiens
aggcuggcuccagaugca

SEQ ID NO: 1636432 - RNA, 15 nt, Homo sapiens
aggcuucaucaaggu

SEQ ID NO: 1636433 - RNA, 15 nt, Homo sapiens
aggcuucccuacaca

SEQ ID NO: 1636434 - RNA, 19 nt, Homo sapiens
agggaaguaguccuuggca

SEQ ID NO: 1636435 - RNA, 19 nt, Homo sapiens
agggaaugccuggggauuc

SEQ ID NO: 1636436 - RNA, 14 nt, Homo sapiens
agggacacuuucac

SEQ ID NO: 1636437 - RNA, 17 nt, Homo sapiens
agggaccuugucuccca

SEQ ID NO: 1636438 - RNA, 18 nt, Homo sapiens
agggagaggucaccagcu

SEQ ID NO: 1636439 - RNA, 15 nt, Homo sapiens
agggauaaccugcac

SEQ ID NO: 1636440 - RNA, 18 nt, Homo sapiens
agggaugagauacuuaug

SEQ ID NO: 1636441 - RNA, 16 nt, Homo sapiens
agggauucccacccca

SEQ ID NO: 1636442 - RNA, 15 nt, Homo sapiens
agggauugcugugaa

SEQ ID NO: 1636443 - RNA, 22 nt, Homo sapiens
agggcaagcccugcccacagaa

SEQ ID NO: 1636444 - RNA, 18 nt, Homo sapiens
agggcaagggaggggugg

SEQ ID NO: 1636445 - RNA, 12 nt, Homo sapiens
agggcacugggu

SEQ ID NO: 1636446 - RNA, 13 nt, Homo sapiens
agggcacugugau

SEQ ID NO: 1636447 - RNA, 19 nt, Homo sapiens
agggcagugcccuuugaga

SEQ ID NO: 1636448 - RNA, 20 nt, Homo sapiens
agggcaguucugaguguuua

SEQ ID NO: 1636449 - RNA, 23 nt, Homo sapiens
agggccacauagaugcugaugga

SEQ ID NO: 1636450 - RNA, 13 nt, Homo sapiens
agggccucaggca

SEQ ID NO: 1636451 - RNA, 12 nt, Homo sapiens
agggcucugagg

SEQ ID NO: 1636452 - RNA, 22 nt, Homo sapiens
agggcucuuuccuccacaccau

SEQ ID NO: 1636453 - RNA, 16 nt, Homo sapiens
agggcugaaucuucug

SEQ ID NO: 1636454 - RNA, 15 nt, Homo sapiens
agggcuggggacaga

SEQ ID NO: 1636455 - RNA, 13 nt, Homo sapiens
aggggaaagagag

SEQ ID NO: 1636456 - RNA, 13 nt, Homo sapiens
aggggacauucca

SEQ ID NO: 1636457 - RNA, 16 nt, Homo sapiens
aggggcagauggaaag

SEQ ID NO: 1636458 - RNA, 20 nt, Homo sapiens
aggggccuuagggcacuggg

SEQ ID NO: 1636459 - RNA, 21 nt, Homo sapiens
aggggccuuagggcacugggc

SEQ ID NO: 1636460 - RNA, 21 nt, Homo sapiens
agggggaggcuaaagcccaga

SEQ ID NO: 1636461 - RNA, 12 nt, Homo sapiens
agggggccucau

SEQ ID NO: 1636462 - RNA, 22 nt, Homo sapiens
aggguaagggaauuuaauacuu

SEQ ID NO: 1636463 - RNA, 11 nt, Homo sapiens
agggugacuga

SEQ ID NO: 1636464 - RNA, 14 nt, Homo sapiens
agggugacugaagu

SEQ ID NO: 1636465 - RNA, 22 nt, Homo sapiens
agggugacugaagucgugcuuu

SEQ ID NO: 1636466 - RNA, 16 nt, Homo sapiens
aggguggcagaacuug

SEQ ID NO: 1636467 - RNA, 14 nt, Homo sapiens
aggguuccaaaggg

SEQ ID NO: 1636468 - RNA, 15 nt, Homo sapiens
aggguuccaaagggc

SEQ ID NO: 1636469 - RNA, 14 nt, Homo sapiens
agguaaaacagggc

SEQ ID NO: 1636470 - RNA, 12 nt, Homo sapiens
agguaacuguac

SEQ ID NO: 1636471 - RNA, 22 nt, Homo sapiens
agguaauguuaguaaauccaug

SEQ ID NO: 1636472 - RNA, 20 nt, Homo sapiens
agguacgauuauacuugaga

SEQ ID NO: 1636473 - RNA, 23 nt, Homo sapiens
agguagaagggaccucaagcacc

SEQ ID NO: 1636474 - RNA, 12 nt, Homo sapiens
agguaggggaag

SEQ ID NO: 1636475 - RNA, 21 nt, Homo sapiens
agguauaccuguugagacuga

SEQ ID NO: 1636476 - RNA, 15 nt, Homo sapiens
aggucaaacuguggg

SEQ ID NO: 1636477 - RNA, 19 nt, Homo sapiens
aggucaaccccacuguaga

SEQ ID NO: 1636478 - RNA, 22 nt, Homo sapiens
aggucagggagugcuggcucac

SEQ ID NO: 1636479 - RNA, 11 nt, Homo sapiens
aggucaugccu

SEQ ID NO: 1636480 - RNA, 17 nt, Homo sapiens
aggucccuccucagacc

SEQ ID NO: 1636481 - RNA, 19 nt, Homo sapiens
agguccucugucagucaca

SEQ ID NO: 1636482 - RNA, 21 nt, Homo sapiens
agguccuuaggccucugagaa

SEQ ID NO: 1636483 - RNA, 19 nt, Homo sapiens
aggucuuuccaagguuggg

SEQ ID NO: 1636484 - RNA, 15 nt, Homo sapiens
aggugaccccagggc

SEQ ID NO: 1636485 - RNA, 20 nt, Homo sapiens
aggugauccgcccaccucag

SEQ ID NO: 1636486 - RNA, 19 nt, Homo sapiens
aggugcauagcaagugaaa

SEQ ID NO: 1636487 - RNA, 19 nt, Homo sapiens
aggugcugacuucaucucc

SEQ ID NO: 1636488 - RNA, 20 nt, Homo sapiens
aggugcugacuucaucuccc

SEQ ID NO: 1636489 - RNA, 18 nt, Homo sapiens
agguggcccuucccggca

SEQ ID NO: 1636490 - RNA, 23 nt, Homo sapiens
aggugggaggaggccugcacagg

SEQ ID NO: 1636491 - RNA, 22 nt, Homo sapiens
aggugguucagacaagacagag

SEQ ID NO: 1636492 - RNA, 11 nt, Homo sapiens
aggugugaugg

SEQ ID NO: 1636493 - RNA, 15 nt, Homo sapiens
agguguguugaauug

SEQ ID NO: 1636494 - RNA, 14 nt, Homo sapiens
agguucaagcgauu

SEQ ID NO: 1636495 - RNA, 15 nt, Homo sapiens
agguucagccugaaa

SEQ ID NO: 1636496 - RNA, 16 nt, Homo sapiens
agguucagcugaagcu

SEQ ID NO: 1636497 - RNA, 19 nt, Homo sapiens
agguucuaggcuaccagaa

SEQ ID NO: 1636498 - RNA, 18 nt, Homo sapiens
agguugcaguaagccaag

SEQ ID NO: 1636499 - RNA, 15 nt, Homo sapiens
auuuuuagaauuaaa

SEQ ID NO: 1636500 - RNA, 20 nt, Homo sapiens
auuuuuauaauaaacauaau

SEQ ID NO: 1636501 - RNA, 18 nt, Homo sapiens
auuuuucagauauaaaag

SEQ ID NO: 1636502 - RNA, 19 nt, Homo sapiens
auuuuuccaguaacuuuuc

SEQ ID NO: 1636503 - RNA, 14 nt, Homo sapiens
auuuuucuuaacaa

SEQ ID NO: 1636504 - RNA, 23 nt, Homo sapiens
auuuuugaaaaaaguacauauuu

SEQ ID NO: 1636505 - RNA, 15 nt, Homo sapiens
auuuuugaaaacugg

SEQ ID NO: 1636506 - RNA, 23 nt, Homo sapiens
auuuuuguaaauaaauuucccaa

SEQ ID NO: 1636507 - RNA, 21 nt, Homo sapiens
auuuuuuagugcauccaguua

SEQ ID NO: 1636508 - RNA, 17 nt, Homo sapiens
auuuuuucaugaaagau

SEQ ID NO: 1636509 - RNA, 18 nt, Homo sapiens
auuuuuuccagucuuccu

SEQ ID NO: 1636510 - RNA, 11 nt, Homo sapiens
auuuuuugcca

SEQ ID NO: 1636511 - RNA, 20 nt, Homo sapiens
caaaaauguguaagaacaac

SEQ ID NO: 1636512 - RNA, 23 nt, Homo sapiens
caaaacagcccucagacugucag

SEQ ID NO: 1636513 - RNA, 11 nt, Homo sapiens
caaaaccaaac

SEQ ID NO: 1636514 - RNA, 14 nt, Homo sapiens
caaaacccuuaaaa

SEQ ID NO: 1636515 - RNA, 18 nt, Homo sapiens
caaaaccuuuaaucugca

SEQ ID NO: 1636516 - RNA, 14 nt, Homo sapiens
caaaacucaggcag

SEQ ID NO: 1636517 - RNA, 21 nt, Homo sapiens
caaaacuguucuuuugcauuu

SEQ ID NO: 1636518 - RNA, 14 nt, Homo sapiens
caaaagaaggucaa

SEQ ID NO: 1636519 - RNA, 13 nt, Homo sapiens
caaaagcaugaaa

SEQ ID NO: 1636520 - RNA, 16 nt, Homo sapiens
caaaagucacccaggg

SEQ ID NO: 1636521 - RNA, 17 nt, Homo sapiens
caaaauaaagugacaga

SEQ ID NO: 1636522 - RNA, 11 nt, Homo sapiens
caaaauacuuc

SEQ ID NO: 1636523 - RNA, 14 nt, Homo sapiens
caaacaggcugaua

SEQ ID NO: 1636524 - RNA, 22 nt, Homo sapiens
caaacaucccccaaugaccuua

SEQ ID NO: 1636525 - RNA, 15 nt, Homo sapiens
caaaccaucuccucc

SEQ ID NO: 1636526 - RNA, 13 nt, Homo sapiens
caaacccauuccc

SEQ ID NO: 1636527 - RNA, 14 nt, Homo sapiens
caaacccugcaauu

SEQ ID NO: 1636528 - RNA, 18 nt, Homo sapiens
caaacuccugaccucagg

SEQ ID NO: 1636529 - RNA, 19 nt, Homo sapiens
caaacuugggcccuucccu

SEQ ID NO: 1636530 - RNA, 13 nt, Homo sapiens
caaagacugugaa

SEQ ID NO: 1636531 - RNA, 17 nt, Homo sapiens
caaagacuugugugaug

SEQ ID NO: 1636532 - RNA, 23 nt, Homo sapiens
caaagcagccacgaggugcaaca

SEQ ID NO: 1636533 - RNA, 13 nt, Homo sapiens
caaagccacugag

SEQ ID NO: 1636534 - RNA, 17 nt, Homo sapiens
caaagcuugucaaagau

SEQ ID NO: 1636535 - RNA, 23 nt, Homo sapiens
caaagcuuuccuguuuccagggu

SEQ ID NO: 1636536 - RNA, 21 nt, Homo sapiens
caaaggagacccgccccaggg

SEQ ID NO: 1636537 - RNA, 22 nt, Homo sapiens
caaagggggaggcuaaagccca

SEQ ID NO: 1636538 - RNA, 17 nt, Homo sapiens
caaagucacauccacaa

SEQ ID NO: 1636539 - RNA, 16 nt, Homo sapiens
caaagucacuucccca

SEQ ID NO: 1636540 - RNA, 17 nt, Homo sapiens
caaaguggcagggaccg

SEQ ID NO: 1636541 - RNA, 12 nt, Homo sapiens
caaauaaacuca

SEQ ID NO: 1636542 - RNA, 17 nt, Homo sapiens
caaaucaaacauauucu

SEQ ID NO: 1636543 - RNA, 18 nt, Homo sapiens
caaaucaaacauauucua

SEQ ID NO: 1636544 - RNA, 20 nt, Homo sapiens
caaaucagaccuggcugcuu

SEQ ID NO: 1636545 - RNA, 17 nt, Homo sapiens
caaaucccucucacaag

SEQ ID NO: 1636546 - RNA, 17 nt, Homo sapiens
caaauccuaugugauuu

SEQ ID NO: 1636547 - RNA, 17 nt, Homo sapiens
caaaugcagaaccacaa

SEQ ID NO: 1636548 - RNA, 13 nt, Homo sapiens
caaauggacuguu

SEQ ID NO: 1636549 - RNA, 16 nt, Homo sapiens
caaauuucauugcacu

SEQ ID NO: 1636550 - RNA, 12 nt, Homo sapiens
caacaaauuuca

SEQ ID NO: 1636551 - RNA, 19 nt, Homo sapiens
caacaaauuucauugcacu

SEQ ID NO: 1636552 - RNA, 20 nt, Homo sapiens
caacaaauuucauugcacuu

SEQ ID NO: 1636553 - RNA, 19 nt, Homo sapiens
caacaagucauuccaugaa

SEQ ID NO: 1636554 - RNA, 16 nt, Homo sapiens
caacaggucacuugau

SEQ ID NO: 1636555 - RNA, 15 nt, Homo sapiens
caacaugcacugaug

SEQ ID NO: 1636556 - RNA, 14 nt, Homo sapiens
caaccaacugcaaa

SEQ ID NO: 1636557 - RNA, 19 nt, Homo sapiens
caaccacaaaccuaguacg

SEQ ID NO: 1636558 - RNA, 13 nt, Homo sapiens
caaccaccauuca

SEQ ID NO: 1636559 - RNA, 19 nt, Homo sapiens
caaccaccauucagucaag

SEQ ID NO: 1636560 - RNA, 22 nt, Homo sapiens
caaccaguuaaagccacagaug

SEQ ID NO: 1636561 - RNA, 16 nt, Homo sapiens
caacccgguucacucu

SEQ ID NO: 1636562 - RNA, 11 nt, Homo sapiens
caacuaccuga

SEQ ID NO: 1636563 - RNA, 21 nt, Homo sapiens
caacuccuccauuuuccuccc

SEQ ID NO: 1636564 - RNA, 19 nt, Homo sapiens
caacucuguacaaagcccu

SEQ ID NO: 1636565 - RNA, 16 nt, Homo sapiens
caacuucuuuccucug

SEQ ID NO: 1636566 - RNA, 20 nt, Homo sapiens
caagaacuuucucugccauc

SEQ ID NO: 1636567 - RNA, 17 nt, Homo sapiens
caagaaugugcacucuc

SEQ ID NO: 1636568 - RNA, 21 nt, Homo sapiens
caagacagaggggagcagugg

SEQ ID NO: 1636569 - RNA, 23 nt, Homo sapiens
caagacagggcucauuuuugcac

SEQ ID NO: 1636570 - RNA, 12 nt, Homo sapiens
caagaggcuccu

SEQ ID NO: 1636571 - RNA, 14 nt, Homo sapiens
caagauauggacac

SEQ ID NO: 1636572 - RNA, 15 nt, Homo sapiens
caagaucugccagac

SEQ ID NO: 1636573 - RNA, 14 nt, Homo sapiens
caagauuuauggaa

SEQ ID NO: 1636574 - RNA, 16 nt, Homo sapiens
caagcaauucuccugc

SEQ ID NO: 1636575 - RNA, 22 nt, Homo sapiens
caagcacccagcccuccugcuc

SEQ ID NO: 1636576 - RNA, 14 nt, Homo sapiens
caagcacucggggu

SEQ ID NO: 1636577 - RNA, 17 nt, Homo sapiens
caagcagucaguuugca

SEQ ID NO: 1636578 - RNA, 22 nt, Homo sapiens
caagccaugcuggugggccauu

SEQ ID NO: 1636579 - RNA, 20 nt, Homo sapiens
caagccuaaaauuguauaga

SEQ ID NO: 1636580 - RNA, 24 nt, Homo sapiens
caagccugccucgccuuguguuac

SEQ ID NO: 1636581 - RNA, 21 nt, Homo sapiens
caagccuucuguucugcccag

SEQ ID NO: 1636582 - RNA, 18 nt, Homo sapiens
caagcuauaaaagcagga

SEQ ID NO: 1636583 - RNA, 14 nt, Homo sapiens
caagcuccaagagg

SEQ ID NO: 1636584 - RNA, 12 nt, Homo sapiens
caagcugcauuu

SEQ ID NO: 1636585 - RNA, 15 nt, Homo sapiens
caagcugucccugca

SEQ ID NO: 1636586 - RNA, 15 nt, Homo sapiens
caagcugugcaggca

SEQ ID NO: 1636587 - RNA, 19 nt, Homo sapiens
caaggaguacaaugcccag

SEQ ID NO: 1636588 - RNA, 18 nt, Homo sapiens
caaggaugcugucaagca

SEQ ID NO: 1636589 - RNA, 16 nt, Homo sapiens
caaggcauccaugaaa

SEQ ID NO: 1636590 - RNA, 24 nt, Homo sapiens
caaggcccugagcuuuguccugaa

SEQ ID NO: 1636591 - RNA, 15 nt, Homo sapiens
caaggccuccaggga

SEQ ID NO: 1636592 - RNA, 11 nt, Homo sapiens
caaggccuuca

SEQ ID NO: 1636593 - RNA, 14 nt, Homo sapiens
caaggcugcaguga

SEQ ID NO: 1636594 - RNA, 19 nt, Homo sapiens
caaggcugcagugagccau

SEQ ID NO: 1636595 - RNA, 14 nt, Homo sapiens
caagguaacuguac

SEQ ID NO: 1636596 - RNA, 23 nt, Homo sapiens
caagguaacuguacugggccaug

SEQ ID NO: 1636597 - RNA, 18 nt, Homo sapiens
caagguccucugucaguc

SEQ ID NO: 1636598 - RNA, 21 nt, Homo sapiens
caagguccucugucagucaca

SEQ ID NO: 1636599 - RNA, 13 nt, Homo sapiens
caaggugugaugg

SEQ ID NO: 1636600 - RNA, 20 nt, Homo sapiens
caaguauuacaaccauauau

SEQ ID NO: 1636601 - RNA, 21 nt, Homo sapiens
caaguauugucgguuaccucu

SEQ ID NO: 1636602 - RNA, 21 nt, Homo sapiens
caaguguccuggaaauucugc

SEQ ID NO: 1636603 - RNA, 21 nt, Homo sapiens
caaguucuuaguugcuguaug

SEQ ID NO: 1636604 - RNA, 21 nt, Homo sapiens
caaguuuuuuaauuaagcaga

SEQ ID NO: 1636605 - RNA, 18 nt, Homo sapiens
caauaaaguuguugcauu

SEQ ID NO: 1636606 - RNA, 13 nt, Homo sapiens
caauacagucuag

SEQ ID NO: 1636607 - RNA, 21 nt, Homo sapiens
caauacugcacacugcacauu

SEQ ID NO: 1636608 - RNA, 18 nt, Homo sapiens
caauaguuagaucuaccc

SEQ ID NO: 1636609 - RNA, 22 nt, Homo sapiens
ccacaugugacacauaugcacc

SEQ ID NO: 1636610 - RNA, 15 nt, Homo sapiens
ccacccaagagagaa

SEQ ID NO: 1636611 - RNA, 21 nt, Homo sapiens
ccacccugaggagucugaggu

SEQ ID NO: 1636612 - RNA, 21 nt, Homo sapiens
ccaccuacuuuucuuuccuca

SEQ ID NO: 1636613 - RNA, 16 nt, Homo sapiens
ccaccugacucuugca

SEQ ID NO: 1636614 - RNA, 14 nt, Homo sapiens
ccaccugcuucugu

SEQ ID NO: 1636615 - RNA, 20 nt, Homo sapiens
ccacgaccuuugaagagcuu

SEQ ID NO: 1636616 - RNA, 15 nt, Homo sapiens
ccacgaggugcaaca

SEQ ID NO: 1636617 - RNA, 23 nt, Homo sapiens
ccacggccuguacggacacugug

SEQ ID NO: 1636618 - RNA, 14 nt, Homo sapiens
ccacuacugcagca

SEQ ID NO: 1636619 - RNA, 18 nt, Homo sapiens
ccacuaucugggugcaug

SEQ ID NO: 1636620 - RNA, 13 nt, Homo sapiens
ccacuaugccuga

SEQ ID NO: 1636621 - RNA, 13 nt, Homo sapiens
ccacugcacucua

SEQ ID NO: 1636622 - RNA, 19 nt, Homo sapiens
ccacuggacugucuaugaa

SEQ ID NO: 1636623 - RNA, 13 nt, Homo sapiens
ccacuggggacuu

SEQ ID NO: 1636624 - RNA, 21 nt, Homo sapiens
ccacuguagacaggaaagcca

SEQ ID NO: 1636625 - RNA, 14 nt, Homo sapiens
ccacuguaugagug

SEQ ID NO: 1636626 - RNA, 22 nt, Homo sapiens
ccacuuaaucuucucucuugau

SEQ ID NO: 1636627 - RNA, 13 nt, Homo sapiens
ccacuuacauaua

SEQ ID NO: 1636628 - RNA, 16 nt, Homo sapiens
ccacuuccccaaagaa

SEQ ID NO: 1636629 - RNA, 20 nt, Homo sapiens
ccagaaauagccacuauuaa

SEQ ID NO: 1636630 - RNA, 15 nt, Homo sapiens
ccagagccaccaaag

SEQ ID NO: 1636631 - RNA, 20 nt, Homo sapiens
ccagagccuggggcucuaac

SEQ ID NO: 1636632 - RNA, 12 nt, Homo sapiens
ccagaggcaucu

SEQ ID NO: 1636633 - RNA, 19 nt, Homo sapiens
ccagaggcuggaccacaca

SEQ ID NO: 1636634 - RNA, 21 nt, Homo sapiens
ccagagguaauguuaguaaau

SEQ ID NO: 1636635 - RNA, 19 nt, Homo sapiens
ccagaggugcuccauggag

SEQ ID NO: 1636636 - RNA, 21 nt, Homo sapiens
ccagaugaacugacugaagga

SEQ ID NO: 1636637 - RNA, 16 nt, Homo sapiens
ccagaugcagggcagu

SEQ ID NO: 1636638 - RNA, 12 nt, Homo sapiens
ccagcacagggc

SEQ ID NO: 1636639 - RNA, 13 nt, Homo sapiens
ccagcccagcugg

SEQ ID NO: 1636640 - RNA, 12 nt, Homo sapiens
ccagcccauugc

SEQ ID NO: 1636641 - RNA, 20 nt, Homo sapiens
ccagccugggggacagagca

SEQ ID NO: 1636642 - RNA, 13 nt, Homo sapiens
ccagcggcccaag

SEQ ID NO: 1636643 - RNA, 17 nt, Homo sapiens
ccagcucagggcucuuu

SEQ ID NO: 1636644 - RNA, 22 nt, Homo sapiens
ccagcuccuaggucucagagaa

SEQ ID NO: 1636645 - RNA, 17 nt, Homo sapiens
ccagcugggucaggcag

SEQ ID NO: 1636646 - RNA, 23 nt, Homo sapiens
ccagcugggucaggcagggugca

SEQ ID NO: 1636647 - RNA, 13 nt, Homo sapiens
ccagcuuacuagc

SEQ ID NO: 1636648 - RNA, 17 nt, Homo sapiens
ccagcuucucaguuucu

SEQ ID NO: 1636649 - RNA, 22 nt, Homo sapiens
ccagcuugccuguuucuucucu

SEQ ID NO: 1636650 - RNA, 13 nt, Homo sapiens
ccaggaagacuuu

SEQ ID NO: 1636651 - RNA, 14 nt, Homo sapiens
ccaggagaaggggg

SEQ ID NO: 1636652 - RNA, 23 nt, Homo sapiens
ccaggaugcuggcugguggaaca

SEQ ID NO: 1636653 - RNA, 15 nt, Homo sapiens
ccaggcaugcaaugc

SEQ ID NO: 1636654 - RNA, 23 nt, Homo sapiens
ccaggcccuacuacccauuguuc

SEQ ID NO: 1636655 - RNA, 21 nt, Homo sapiens
ccaggcccugcucuuccucag

SEQ ID NO: 1636656 - RNA, 18 nt, Homo sapiens
ccaggcuggagugcaaug

SEQ ID NO: 1636657 - RNA, 19 nt, Homo sapiens
ccagggaugucuguugaaa

SEQ ID NO: 1636658 - RNA, 19 nt, Homo sapiens
ccagggauugcccgugaag

SEQ ID NO: 1636659 - RNA, 11 nt, Homo sapiens
ccagggccaug

SEQ ID NO: 1636660 - RNA, 23 nt, Homo sapiens
ccaggggaaggaaggagggcaca

SEQ ID NO: 1636661 - RNA, 18 nt, Homo sapiens
ccagguacaggagaggca

SEQ ID NO: 1636662 - RNA, 16 nt, Homo sapiens
ccaggucccuccucag

SEQ ID NO: 1636663 - RNA, 15 nt, Homo sapiens
ccaggugauucuguu

SEQ ID NO: 1636664 - RNA, 16 nt, Homo sapiens
ccagguugaucuugaa

SEQ ID NO: 1636665 - RNA, 14 nt, Homo sapiens
ccaguaacuuuucu

SEQ ID NO: 1636666 - RNA, 13 nt, Homo sapiens
ccagugccaagga

SEQ ID NO: 1636667 - RNA, 12 nt, Homo sapiens
ccagugcuccag

SEQ ID NO: 1636668 - RNA, 20 nt, Homo sapiens
ccaguugcagaccaucgcac

SEQ ID NO: 1636669 - RNA, 11 nt, Homo sapiens
ccaguuugcac

SEQ ID NO: 1636670 - RNA, 20 nt, Homo sapiens
ccaguuugcaccugucccca

SEQ ID NO: 1636671 - RNA, 14 nt, Homo sapiens
ccauaaaguacaaa

SEQ ID NO: 1636672 - RNA, 19 nt, Homo sapiens
ccauaauuaugaaaacuca

SEQ ID NO: 1636673 - RNA, 17 nt, Homo sapiens
ccauauguccacuguuc

SEQ ID NO: 1636674 - RNA, 23 nt, Homo sapiens
ccauauucuuccccgaaucacac

SEQ ID NO: 1636675 - RNA, 22 nt, Homo sapiens
ccaucaggauccagucuggaaa

SEQ ID NO: 1636676 - RNA, 23 nt, Homo sapiens
ccaucagugaauccugaaacugg

SEQ ID NO: 1636677 - RNA, 20 nt, Homo sapiens
ccauccagaugugugcaaug

SEQ ID NO: 1636678 - RNA, 12 nt, Homo sapiens
ccauccaucucu

SEQ ID NO: 1636679 - RNA, 17 nt, Homo sapiens
ccaucccaguccugugg

SEQ ID NO: 1636680 - RNA, 21 nt, Homo sapiens
ccaucccguaagaccaccuuc

SEQ ID NO: 1636681 - RNA, 13 nt, Homo sapiens
ccauccugccauc

SEQ ID NO: 1636682 - RNA, 16 nt, Homo sapiens
ccauccuugacuuuga

SEQ ID NO: 1636683 - RNA, 14 nt, Homo sapiens
ccaucuaugagcug

SEQ ID NO: 1636684 - RNA, 13 nt, Homo sapiens
ccaucuuaaucuu

SEQ ID NO: 1636685 - RNA, 16 nt, Homo sapiens
ccaucuuaaucuuuau

SEQ ID NO: 1636686 - RNA, 20 nt, Homo sapiens
ccaugaaacauuacaggaaa

SEQ ID NO: 1636687 - RNA, 14 nt, Homo sapiens
ccaugacauugcau

SEQ ID NO: 1636688 - RNA, 20 nt, Homo sapiens
ccaugacgacauacaugcua

SEQ ID NO: 1636689 - RNA, 23 nt, Homo sapiens
ccaugacgacauacaugcuacuu

SEQ ID NO: 1636690 - RNA, 23 nt, Homo sapiens
ccaugagaguagagggcacuggg

SEQ ID NO: 1636691 - RNA, 22 nt, Homo sapiens
ccaugauggccaggcugaucuc

SEQ ID NO: 1636692 - RNA, 21 nt, Homo sapiens
ccaugccaucucaaccucuuc

SEQ ID NO: 1636693 - RNA, 11 nt, Homo sapiens
ccaugcuauuu

SEQ ID NO: 1636694 - RNA, 13 nt, Homo sapiens
ccaugcugugagc

SEQ ID NO: 1636695 - RNA, 18 nt, Homo sapiens
ccaugcuuuguagguguc

SEQ ID NO: 1636696 - RNA, 20 nt, Homo sapiens
ccauggcaaaguggauccag

SEQ ID NO: 1636697 - RNA, 17 nt, Homo sapiens
ccauggcugccaucuca

SEQ ID NO: 1636698 - RNA, 17 nt, Homo sapiens
ccaugguaaucagaaau

SEQ ID NO: 1636699 - RNA, 19 nt, Homo sapiens
ccaugguaugaaggugauu

SEQ ID NO: 1636700 - RNA, 20 nt, Homo sapiens
ccauguaaccacugcacuuu

SEQ ID NO: 1636701 - RNA, 16 nt, Homo sapiens
ccaugugcuacagggg

SEQ ID NO: 1636702 - RNA, 20 nt, Homo sapiens
ccauguucacaccgcugcac

SEQ ID NO: 1636703 - RNA, 21 nt, Homo sapiens
ccauucaggucuuucuuuccg

SEQ ID NO: 1636704 - RNA, 16 nt, Homo sapiens
ccauucagucaaguga

SEQ ID NO: 1636705 - RNA, 22 nt, Homo sapiens
ccauucccauggaguugccaac

SEQ ID NO: 1636706 - RNA, 12 nt, Homo sapiens
ccauugcuuaaa

SEQ ID NO: 1636707 - RNA, 14 nt, Homo sapiens
ccauuuaaaaaaca

SEQ ID NO: 1636708 - RNA, 13 nt, Homo sapiens
ccauuuccugaga

SEQ ID NO: 1636709 - RNA, 14 nt, Homo sapiens
cccaacaugcacug

SEQ ID NO: 1636710 - RNA, 16 nt, Homo sapiens
cccaaccccaguggau

SEQ ID NO: 1636711 - RNA, 13 nt, Homo sapiens
cccaacccuggcu

SEQ ID NO: 1636712 - RNA, 18 nt, Homo sapiens
cccaacgaaaagcacauc

SEQ ID NO: 1636713 - RNA, 11 nt, Homo sapiens
cccaaucugcc

SEQ ID NO: 1636714 - RNA, 19 nt, Homo sapiens
cccacaugugacacauaug

SEQ ID NO: 1636715 - RNA, 22 nt, Homo sapiens
cccaccagcuaaggacauuucc

SEQ ID NO: 1636716 - RNA, 20 nt, Homo sapiens
cccaccagggagaugucuag

SEQ ID NO: 1636717 - RNA, 17 nt, Homo sapiens
cccacccacaugugaca

SEQ ID NO: 1636718 - RNA, 16 nt, Homo sapiens
cccaccccacaauucc

SEQ ID NO: 1636719 - RNA, 22 nt, Homo sapiens
ccucacaaaccugaauggucug

SEQ ID NO: 1636720 - RNA, 20 nt, Homo sapiens
ccucacaacuccuuccaucc

SEQ ID NO: 1636721 - RNA, 23 nt, Homo sapiens
ccucacauuuggaugauugucau

SEQ ID NO: 1636722 - RNA, 21 nt, Homo sapiens
ccucaccccuccccugggacu

SEQ ID NO: 1636723 - RNA, 14 nt, Homo sapiens
ccucagacugucag

SEQ ID NO: 1636724 - RNA, 12 nt, Homo sapiens
ccucagugcauu

SEQ ID NO: 1636725 - RNA, 20 nt, Homo sapiens
ccucaguucccucuugcuca

SEQ ID NO: 1636726 - RNA, 22 nt, Homo sapiens
ccucauaaaaaucuagcacacu

SEQ ID NO: 1636727 - RNA, 20 nt, Homo sapiens
ccuccagcccucucacugug

SEQ ID NO: 1636728 - RNA, 14 nt, Homo sapiens
ccuccagcuuuccu

SEQ ID NO: 1636729 - RNA, 18 nt, Homo sapiens
ccucccaaaugagccaug

SEQ ID NO: 1636730 - RNA, 15 nt, Homo sapiens
ccucccuagcucuga

SEQ ID NO: 1636731 - RNA, 13 nt, Homo sapiens
ccuccucugccag

SEQ ID NO: 1636732 - RNA, 19 nt, Homo sapiens
ccuccugaguaauaagcau

SEQ ID NO: 1636733 - RNA, 21 nt, Homo sapiens
ccuccugucaguggagcaguu

SEQ ID NO: 1636734 - RNA, 13 nt, Homo sapiens
ccuccugugggga

SEQ ID NO: 1636735 - RNA, 19 nt, Homo sapiens
ccuccuguucaucugugca

SEQ ID NO: 1636736 - RNA, 17 nt, Homo sapiens
ccuccuugccuugggac

SEQ ID NO: 1636737 - RNA, 14 nt, Homo sapiens
ccucgaaaaccauc

SEQ ID NO: 1636738 - RNA, 20 nt, Homo sapiens
ccucgccccaaaguugcuca

SEQ ID NO: 1636739 - RNA, 19 nt, Homo sapiens
ccucgggccccauccucau

SEQ ID NO: 1636740 - RNA, 13 nt, Homo sapiens
ccucuacugggaa

SEQ ID NO: 1636741 - RNA, 16 nt, Homo sapiens
ccucuccaguuugcac

SEQ ID NO: 1636742 - RNA, 24 nt, Homo sapiens
ccucucucccugccucacaucucc

SEQ ID NO: 1636743 - RNA, 13 nt, Homo sapiens
ccucugaagcauu

SEQ ID NO: 1636744 - RNA, 22 nt, Homo sapiens
ccucugcauggaacagcauuac

SEQ ID NO: 1636745 - RNA, 18 nt, Homo sapiens
ccucuguucauuucacac

SEQ ID NO: 1636746 - RNA, 20 nt, Homo sapiens
ccucuuauugggauaucauu

SEQ ID NO: 1636747 - RNA, 22 nt, Homo sapiens
ccucuuggccugaucagaccac

SEQ ID NO: 1636748 - RNA, 15 nt, Homo sapiens
ccugaauguguagaa

SEQ ID NO: 1636749 - RNA, 17 nt, Homo sapiens
ccugaccucgugaucua

SEQ ID NO: 1636750 - RNA, 13 nt, Homo sapiens
ccugagcuaaaua

SEQ ID NO: 1636751 - RNA, 15 nt, Homo sapiens
ccugaggaagaugac

SEQ ID NO: 1636752 - RNA, 18 nt, Homo sapiens
ccugaggcccccaucucc

SEQ ID NO: 1636753 - RNA, 16 nt, Homo sapiens
ccugaggucagggagu

SEQ ID NO: 1636754 - RNA, 19 nt, Homo sapiens
ccugaucgccaaccuuucc

SEQ ID NO: 1636755 - RNA, 13 nt, Homo sapiens
ccugaugagauuu

SEQ ID NO: 1636756 - RNA, 17 nt, Homo sapiens
ccugaugugacauucca

SEQ ID NO: 1636757 - RNA, 15 nt, Homo sapiens
ccugauuauuuucua

SEQ ID NO: 1636758 - RNA, 13 nt, Homo sapiens
ccugcacaggcug

SEQ ID NO: 1636759 - RNA, 18 nt, Homo sapiens
ccugcagaaguacuccua

SEQ ID NO: 1636760 - RNA, 17 nt, Homo sapiens
ccugcagaauccagcua

SEQ ID NO: 1636761 - RNA, 18 nt, Homo sapiens
ccugcaucugucugcucu

SEQ ID NO: 1636762 - RNA, 11 nt, Homo sapiens
ccugcauuucu

SEQ ID NO: 1636763 - RNA, 14 nt, Homo sapiens
ccugccagggugag

SEQ ID NO: 1636764 - RNA, 18 nt, Homo sapiens
ccugcucacaaaaucacu

SEQ ID NO: 1636765 - RNA, 14 nt, Homo sapiens
ccugcuccaagagg

SEQ ID NO: 1636766 - RNA, 15 nt, Homo sapiens
ccugcugagcucuga

SEQ ID NO: 1636767 - RNA, 16 nt, Homo sapiens
ccugcugagcucugag

SEQ ID NO: 1636768 - RNA, 14 nt, Homo sapiens
ccuggaaauucugc

SEQ ID NO: 1636769 - RNA, 13 nt, Homo sapiens
ccuggaugagaaa

SEQ ID NO: 1636770 - RNA, 18 nt, Homo sapiens
ccuggcccauaaugugaa

SEQ ID NO: 1636771 - RNA, 18 nt, Homo sapiens
ccuggccuggcacacauc

SEQ ID NO: 1636772 - RNA, 18 nt, Homo sapiens
ccugggggcuuuugccac

SEQ ID NO: 1636773 - RNA, 13 nt, Homo sapiens
ccuggggugaccc

SEQ ID NO: 1636774 - RNA, 16 nt, Homo sapiens
ccuggguggcuacucu

SEQ ID NO: 1636775 - RNA, 19 nt, Homo sapiens
ccuguaauuuuucugggaa

SEQ ID NO: 1636776 - RNA, 16 nt, Homo sapiens
ccuguacggacacugu

SEQ ID NO: 1636777 - RNA, 22 nt, Homo sapiens
ccuguagccuucuguaggaauu

SEQ ID NO: 1636778 - RNA, 21 nt, Homo sapiens
ccuguccaagacagggcucau

SEQ ID NO: 1636779 - RNA, 17 nt, Homo sapiens
ccugucccaaccccagu

SEQ ID NO: 1636780 - RNA, 13 nt, Homo sapiens
ccugucucagggu

SEQ ID NO: 1636781 - RNA, 21 nt, Homo sapiens
ccugugaaguccuucaccuca

SEQ ID NO: 1636782 - RNA, 11 nt, Homo sapiens
ccugugccaca

SEQ ID NO: 1636783 - RNA, 15 nt, Homo sapiens
ccugugcuccauggc

SEQ ID NO: 1636784 - RNA, 23 nt, Homo sapiens
ccuguggagaugagucagugcca

SEQ ID NO: 1636785 - RNA, 17 nt, Homo sapiens
ccuguggccuuugcaau

SEQ ID NO: 1636786 - RNA, 18 nt, Homo sapiens
ccuguggucucugaccag

SEQ ID NO: 1636787 - RNA, 14 nt, Homo sapiens
ccuguguacugccu

SEQ ID NO: 1636788 - RNA, 15 nt, Homo sapiens
ccuguguacugccuu

SEQ ID NO: 1636789 - RNA, 18 nt, Homo sapiens
ccuguguauucauucuca

SEQ ID NO: 1636790 - RNA, 21 nt, Homo sapiens
ccuguguccaccugugggugu

SEQ ID NO: 1636791 - RNA, 18 nt, Homo sapiens
ccuguguucuuuccccag

SEQ ID NO: 1636792 - RNA, 16 nt, Homo sapiens
ccuguucagcuacucc

SEQ ID NO: 1636793 - RNA, 12 nt, Homo sapiens
ccuguuccagaa

SEQ ID NO: 1636794 - RNA, 19 nt, Homo sapiens
ccuguuccccaaggacucu

SEQ ID NO: 1636795 - RNA, 20 nt, Homo sapiens
ccuguuccccaaggacucuu

SEQ ID NO: 1636796 - RNA, 21 nt, Homo sapiens
ccuuaagcccuggcccccuga

SEQ ID NO: 1636797 - RNA, 20 nt, Homo sapiens
ccuuacccaucuugcuucca

SEQ ID NO: 1636798 - RNA, 21 nt, Homo sapiens
ccuuauaaacagauaaugcuu

SEQ ID NO: 1636799 - RNA, 20 nt, Homo sapiens
ccuucaaaauaaaaaguaau

SEQ ID NO: 1636800 - RNA, 21 nt, Homo sapiens
ccuucagcaugccugaacuac

SEQ ID NO: 1636801 - RNA, 17 nt, Homo sapiens
ccuucaguuuauuucca

SEQ ID NO: 1636802 - RNA, 18 nt, Homo sapiens
ccuuccaggugauucugu

SEQ ID NO: 1636803 - RNA, 23 nt, Homo sapiens
ccuucccagaauguuacugacuc

SEQ ID NO: 1636804 - RNA, 15 nt, Homo sapiens
ccuucccucugcauu

SEQ ID NO: 1636805 - RNA, 22 nt, Homo sapiens
ccuucgcuuaagccagcacuca

SEQ ID NO: 1636806 - RNA, 16 nt, Homo sapiens
ccuucucucacugugu

SEQ ID NO: 1636807 - RNA, 13 nt, Homo sapiens
ccuucucuccuuc

SEQ ID NO: 1636808 - RNA, 21 nt, Homo sapiens
ccuucugcuaugacaaaaccu

SEQ ID NO: 1636809 - RNA, 23 nt, Homo sapiens
ccuucugcuaugacaaaaccuuu

SEQ ID NO: 1636810 - RNA, 14 nt, Homo sapiens
ccuugaaugggcug

SEQ ID NO: 1636811 - RNA, 16 nt, Homo sapiens
ccuugcccaugugaaa

SEQ ID NO: 1636812 - RNA, 15 nt, Homo sapiens
ccuugcugugaaauu

SEQ ID NO: 1636813 - RNA, 16 nt, Homo sapiens
ccuuggcugacaugaa

SEQ ID NO: 1636814 - RNA, 17 nt, Homo sapiens
ccuuggcuuuaugcaaa

SEQ ID NO: 1636815 - RNA, 21 nt, Homo sapiens
ccuuggcuuuaugcaaauaca

SEQ ID NO: 1636816 - RNA, 20 nt, Homo sapiens
ccuugucccccgugaucucc

SEQ ID NO: 1636817 - RNA, 23 nt, Homo sapiens
ccuuucucaacugucccaaggag

SEQ ID NO: 1636818 - RNA, 16 nt, Homo sapiens
ccuuugaucaguauaa

SEQ ID NO: 1636819 - RNA, 23 nt, Homo sapiens
ccuuugcuaaaauauaauuuuca

SEQ ID NO: 1636820 - RNA, 12 nt, Homo sapiens
ccuuuguuucaa

SEQ ID NO: 1636821 - RNA, 14 nt, Homo sapiens
ccuuuuaacugcca

SEQ ID NO: 1636822 - RNA, 14 nt, Homo sapiens
ccuuuuacucagcu

SEQ ID NO: 1636823 - RNA, 12 nt, Homo sapiens
ccuuuuuugcca

SEQ ID NO: 1636824 - RNA, 13 nt, Homo sapiens
ccuuuuuugccag

SEQ ID NO: 1636825 - RNA, 18 nt, Homo sapiens
cgaaaucuuagugcccac

SEQ ID NO: 1636826 - RNA, 14 nt, Homo sapiens
cgaaguguugcaug

SEQ ID NO: 1636827 - RNA, 13 nt, Homo sapiens
cgacucaccugcg

SEQ ID NO: 1636828 - RNA, 14 nt, Homo sapiens
cgacugcaaagcca

SEQ ID NO: 1636829 - RNA, 15 nt, Homo sapiens
uaaaagcuacuaugu

SEQ ID NO: 1636830 - RNA, 16 nt, Homo sapiens
uaaaagcuacuaugua

SEQ ID NO: 1636831 - RNA, 23 nt, Homo sapiens
uaaaaguacauguuaaacuuacu

SEQ ID NO: 1636832 - RNA, 14 nt, Homo sapiens
uaaaauaaaugaaa

SEQ ID NO: 1636833 - RNA, 13 nt, Homo sapiens
uaaaauagaaaca

SEQ ID NO: 1636834 - RNA, 22 nt, Homo sapiens
uaaaauagaaacauuuguaugg

SEQ ID NO: 1636835 - RNA, 11 nt, Homo sapiens
uaaaaugaagg

SEQ ID NO: 1636836 - RNA, 18 nt, Homo sapiens
uaaaaugacaaacaugau

SEQ ID NO: 1636837 - RNA, 22 nt, Homo sapiens
uaaaauguguuuuaucacuuca

SEQ ID NO: 1636838 - RNA, 19 nt, Homo sapiens
uaaaauguuaccacuacuu

SEQ ID NO: 1636839 - RNA, 21 nt, Homo sapiens
uaaaauucuauuauacuacaa

SEQ ID NO: 1636840 - RNA, 22 nt, Homo sapiens
uaaaauuguauagaccuaaaau

SEQ ID NO: 1636841 - RNA, 12 nt, Homo sapiens
uaaacaaaccac

SEQ ID NO: 1636842 - RNA, 19 nt, Homo sapiens
uaaacaagucaauucugug

SEQ ID NO: 1636843 - RNA, 18 nt, Homo sapiens
uaaacaauaucagacuuu

SEQ ID NO: 1636844 - RNA, 18 nt, Homo sapiens
uaaacagccucuuuuuga

SEQ ID NO: 1636845 - RNA, 22 nt, Homo sapiens
uaaaccucaguuauuacaugua

SEQ ID NO: 1636846 - RNA, 19 nt, Homo sapiens
uaaacuaggauugacauuc

SEQ ID NO: 1636847 - RNA, 20 nt, Homo sapiens
uaaacucauuuaacuaaagu

SEQ ID NO: 1636848 - RNA, 17 nt, Homo sapiens
uaaacuguaugcucaca

SEQ ID NO: 1636849 - RNA, 17 nt, Homo sapiens
uaaacuuuauuuguaaa

SEQ ID NO: 1636850 - RNA, 21 nt, Homo sapiens
uaaagacugguuuucugccaa

SEQ ID NO: 1636851 - RNA, 13 nt, Homo sapiens
uaaagacuugugc

SEQ ID NO: 1636852 - RNA, 15 nt, Homo sapiens
uaaagacuugugcau

SEQ ID NO: 1636853 - RNA, 16 nt, Homo sapiens
uaaagacuugugcauc

SEQ ID NO: 1636854 - RNA, 18 nt, Homo sapiens
uaaagaucaccacuuccc

SEQ ID NO: 1636855 - RNA, 21 nt, Homo sapiens
uaaagcuuaauaaaaacaacc

SEQ ID NO: 1636856 - RNA, 20 nt, Homo sapiens
uaaagggcagggcccacgug

SEQ ID NO: 1636857 - RNA, 17 nt, Homo sapiens
uaaaggggagaccucag

SEQ ID NO: 1636858 - RNA, 13 nt, Homo sapiens
uaaaguuguugca

SEQ ID NO: 1636859 - RNA, 17 nt, Homo sapiens
uaaaguuuaaauaccag

SEQ ID NO: 1636860 - RNA, 20 nt, Homo sapiens
uaaauaaaacuuaaaucuca

SEQ ID NO: 1636861 - RNA, 15 nt, Homo sapiens
uaaauaaauuuccca

SEQ ID NO: 1636862 - RNA, 18 nt, Homo sapiens
uaaauacaaucacauuaa

SEQ ID NO: 1636863 - RNA, 21 nt, Homo sapiens
uaaauauguguugaaugaaga

SEQ ID NO: 1636864 - RNA, 14 nt, Homo sapiens
uaaauauugcucua

SEQ ID NO: 1636865 - RNA, 17 nt, Homo sapiens
uaaauauugcucuaugu

SEQ ID NO: 1636866 - RNA, 13 nt, Homo sapiens
uaaaucauauuag

SEQ ID NO: 1636867 - RNA, 18 nt, Homo sapiens
uaaaucauauuaguauua

SEQ ID NO: 1636868 - RNA, 23 nt, Homo sapiens
uaaaucauguugaucauguacuu

SEQ ID NO: 1636869 - RNA, 20 nt, Homo sapiens
uaaauggcauggaguauagu

SEQ ID NO: 1636870 - RNA, 12 nt, Homo sapiens
uaaaugugauau

SEQ ID NO: 1636871 - RNA, 18 nt, Homo sapiens
uaaaugugauccugccuu

SEQ ID NO: 1636872 - RNA, 15 nt, Homo sapiens
uaaauguugcaaugc

SEQ ID NO: 1636873 - RNA, 15 nt, Homo sapiens
uaaauuaaagagaaa

SEQ ID NO: 1636874 - RNA, 22 nt, Homo sapiens
uaaauuaaagagaaaauugaga

SEQ ID NO: 1636875 - RNA, 22 nt, Homo sapiens
uaaauuccacacuaccacauua

SEQ ID NO: 1636876 - RNA, 20 nt, Homo sapiens
uaaauuccacagauuaucaa

SEQ ID NO: 1636877 - RNA, 13 nt, Homo sapiens
uaaauugcucugu

SEQ ID NO: 1636878 - RNA, 18 nt, Homo sapiens
uaaauugggaaaacucca

SEQ ID NO: 1636879 - RNA, 19 nt, Homo sapiens
uaacaacaauaacacuguc

SEQ ID NO: 1636880 - RNA, 18 nt, Homo sapiens
uaacaagucgaugaacua

SEQ ID NO: 1636881 - RNA, 13 nt, Homo sapiens
uaacacaaagaga

SEQ ID NO: 1636882 - RNA, 12 nt, Homo sapiens
uaacacauucaa

SEQ ID NO: 1636883 - RNA, 17 nt, Homo sapiens
uaacaccucccugggcc

SEQ ID NO: 1636884 - RNA, 15 nt, Homo sapiens
uaacacggugcucau

SEQ ID NO: 1636885 - RNA, 16 nt, Homo sapiens
uaacacggugcucauu

SEQ ID NO: 1636886 - RNA, 17 nt, Homo sapiens
uaacacucagaagccug

SEQ ID NO: 1636887 - RNA, 21 nt, Homo sapiens
uaacauagauuuaagugaaua

SEQ ID NO: 1636888 - RNA, 14 nt, Homo sapiens
uaacaugauuucaa

SEQ ID NO: 1636889 - RNA, 17 nt, Homo sapiens
uaacauuuaaauuccac

SEQ ID NO: 1636890 - RNA, 18 nt, Homo sapiens
uaacauuuaaauuccaca

SEQ ID NO: 1636891 - RNA, 21 nt, Homo sapiens
uaacauuuaaauuccacagau

SEQ ID NO: 1636892 - RNA, 19 nt, Homo sapiens
uaaccacugcacuuuccaa

SEQ ID NO: 1636893 - RNA, 21 nt, Homo sapiens
uaacccaagacaugacauucu

SEQ ID NO: 1636894 - RNA, 21 nt, Homo sapiens
uaaccucaagugauccuccca

SEQ ID NO: 1636895 - RNA, 23 nt, Homo sapiens
uaacgcagucuaauuacauuuca

SEQ ID NO: 1636896 - RNA, 12 nt, Homo sapiens
uaacggcacugu

SEQ ID NO: 1636897 - RNA, 16 nt, Homo sapiens
uaacgugauacauuug

SEQ ID NO: 1636898 - RNA, 18 nt, Homo sapiens
uaacuauauuugcuuuuu

SEQ ID NO: 1636899 - RNA, 18 nt, Homo sapiens
uaacuaucaccagugcau

SEQ ID NO: 1636900 - RNA, 11 nt, Homo sapiens
uaacuauucau

SEQ ID NO: 1636901 - RNA, 13 nt, Homo sapiens
uaacuauucauaa

SEQ ID NO: 1636902 - RNA, 14 nt, Homo sapiens
uaacucaaauucaa

SEQ ID NO: 1636903 - RNA, 15 nt, Homo sapiens
uaacucccuccacca

SEQ ID NO: 1636904 - RNA, 19 nt, Homo sapiens
uaacugaaaaugaaagugu

SEQ ID NO: 1636905 - RNA, 14 nt, Homo sapiens
uaacugccaagaaa

SEQ ID NO: 1636906 - RNA, 17 nt, Homo sapiens
uaacuguaaacuuggaa

SEQ ID NO: 1636907 - RNA, 14 nt, Homo sapiens
uaacuguacauuuc

SEQ ID NO: 1636908 - RNA, 12 nt, Homo sapiens
uaacugugaaca

SEQ ID NO: 1636909 - RNA, 14 nt, Homo sapiens
uaacuucuaaagaa

SEQ ID NO: 1636910 - RNA, 23 nt, Homo sapiens
uaagaaccacucauaauucuuca

SEQ ID NO: 1636911 - RNA, 21 nt, Homo sapiens
uaagaaugaaguucugcuaca

SEQ ID NO: 1636912 - RNA, 23 nt, Homo sapiens
uaagaauucucucuucuggaauc

SEQ ID NO: 1636913 - RNA, 15 nt, Homo sapiens
uaagacacucaaaua

SEQ ID NO: 1636914 - RNA, 19 nt, Homo sapiens
uaagacucucgcaucuucc

SEQ ID NO: 1636915 - RNA, 18 nt, Homo sapiens
uaagagaacucuccucuu

SEQ ID NO: 1636916 - RNA, 15 nt, Homo sapiens
uaagagaucccuuaa

SEQ ID NO: 1636917 - RNA, 16 nt, Homo sapiens
uaagauagaacacaaa

SEQ ID NO: 1636918 - RNA, 14 nt, Homo sapiens
uaagcaugugaugu

SEQ ID NO: 1636919 - RNA, 12 nt, Homo sapiens
uaagcccaggau

SEQ ID NO: 1636920 - RNA, 22 nt, Homo sapiens
uaagcccggauagacuuauugc

SEQ ID NO: 1636921 - RNA, 16 nt, Homo sapiens
uaagcugacucuuugc

SEQ ID NO: 1636922 - RNA, 13 nt, Homo sapiens
uaaggaacaacgu

SEQ ID NO: 1636923 - RNA, 15 nt, Homo sapiens
uaaggacauuuccca

SEQ ID NO: 1636924 - RNA, 19 nt, Homo sapiens
uaaggaguaaucuguguac

SEQ ID NO: 1636925 - RNA, 11 nt, Homo sapiens
uaagggaacaa

SEQ ID NO: 1636926 - RNA, 14 nt, Homo sapiens
uaagggcagugccc

SEQ ID NO: 1636927 - RNA, 20 nt, Homo sapiens
uaaguaaaagcuacuaugua

SEQ ID NO: 1636928 - RNA, 22 nt, Homo sapiens
uaaguaaaauccccuucgcuga

SEQ ID NO: 1636929 - RNA, 15 nt, Homo sapiens
uaaguccaaauccaa

SEQ ID NO: 1636930 - RNA, 18 nt, Homo sapiens
uaagugcaaacacagcau

SEQ ID NO: 1636931 - RNA, 21 nt, Homo sapiens
uaauaaaaccggucacugaug

SEQ ID NO: 1636932 - RNA, 20 nt, Homo sapiens
uaauaaauugcuuacugaua

SEQ ID NO: 1636933 - RNA, 23 nt, Homo sapiens
uaauaaugauggucaacaauaag

SEQ ID NO: 1636934 - RNA, 20 nt, Homo sapiens
uaauacauccauucuacauc

SEQ ID NO: 1636935 - RNA, 23 nt, Homo sapiens
uaauacuacccauagaaaacuug

SEQ ID NO: 1636936 - RNA, 17 nt, Homo sapiens
uaauagucuuugccagu

SEQ ID NO: 1636937 - RNA, 13 nt, Homo sapiens
uaauauaguagau

SEQ ID NO: 1636938 - RNA, 15 nt, Homo sapiens
uaauaugguguacau

SEQ ID NO: 1636939 - RNA, 16 nt, Homo sapiens
ucaguuccaaacagac

SEQ ID NO: 1636940 - RNA, 23 nt, Homo sapiens
ucaguuccaaacagacaaaacag

SEQ ID NO: 1636941 - RNA, 15 nt, Homo sapiens
ucaguuucugccugg

SEQ ID NO: 1636942 - RNA, 13 nt, Homo sapiens
ucauaaagcauug

SEQ ID NO: 1636943 - RNA, 19 nt, Homo sapiens
ucauaagacuuugggauag

SEQ ID NO: 1636944 - RNA, 24 nt, Homo sapiens
ucauaccguguaccucaguucccu

SEQ ID NO: 1636945 - RNA, 17 nt, Homo sapiens
ucauagcccucagacau

SEQ ID NO: 1636946 - RNA, 13 nt, Homo sapiens
ucauagugagaac

SEQ ID NO: 1636947 - RNA, 19 nt, Homo sapiens
ucauaugaauuagccaaaa

SEQ ID NO: 1636948 - RNA, 14 nt, Homo sapiens
ucauauuaguauua

SEQ ID NO: 1636949 - RNA, 19 nt, Homo sapiens
ucaucacagggauuuagac

SEQ ID NO: 1636950 - RNA, 15 nt, Homo sapiens
ucaucacauucaggg

SEQ ID NO: 1636951 - RNA, 16 nt, Homo sapiens
ucauccccccugcugc

SEQ ID NO: 1636952 - RNA, 12 nt, Homo sapiens
ucaucugggaaa

SEQ ID NO: 1636953 - RNA, 13 nt, Homo sapiens
ucaugaauucaua

SEQ ID NO: 1636954 - RNA, 13 nt, Homo sapiens
ucaugagcuugaa

SEQ ID NO: 1636955 - RNA, 16 nt, Homo sapiens
ucaugaucaagauaua

SEQ ID NO: 1636956 - RNA, 18 nt, Homo sapiens
ucaugccacugcacucua

SEQ ID NO: 1636957 - RNA, 14 nt, Homo sapiens
ucaugccucugagg

SEQ ID NO: 1636958 - RNA, 15 nt, Homo sapiens
ucaugcugugcauuu

SEQ ID NO: 1636959 - RNA, 16 nt, Homo sapiens
ucauggcuaccucaga

SEQ ID NO: 1636960 - RNA, 12 nt, Homo sapiens
ucauuacuguga

SEQ ID NO: 1636961 - RNA, 18 nt, Homo sapiens
ucauucuaacugcacuuu

SEQ ID NO: 1636962 - RNA, 18 nt, Homo sapiens
ucauucuguuagauacua

SEQ ID NO: 1636963 - RNA, 15 nt, Homo sapiens
ucauugcacuuuccu

SEQ ID NO: 1636964 - RNA, 20 nt, Homo sapiens
ucauugcgugauucaaugaa

SEQ ID NO: 1636965 - RNA, 17 nt, Homo sapiens
ucauugucuuuccugaa

SEQ ID NO: 1636966 - RNA, 12 nt, Homo sapiens
ucauuucauucc

SEQ ID NO: 1636967 - RNA, 17 nt, Homo sapiens
ucauuuuugaagugaaa

SEQ ID NO: 1636968 - RNA, 19 nt, Homo sapiens
ucauuuuuuccagucuucc

SEQ ID NO: 1636969 - RNA, 14 nt, Homo sapiens
uccaaacagacaaa

SEQ ID NO: 1636970 - RNA, 22 nt, Homo sapiens
uccaaaccugucuuggggccac

SEQ ID NO: 1636971 - RNA, 22 nt, Homo sapiens
uccaaaccuucacacacagacu

SEQ ID NO: 1636972 - RNA, 20 nt, Homo sapiens
uccaaagaguuucugcaaag

SEQ ID NO: 1636973 - RNA, 22 nt, Homo sapiens
uccaaaugccauccagaugugu

SEQ ID NO: 1636974 - RNA, 21 nt, Homo sapiens
uccaacaccaagcacagcagc

SEQ ID NO: 1636975 - RNA, 19 nt, Homo sapiens
uccaacggcaagggaacaa

SEQ ID NO: 1636976 - RNA, 22 nt, Homo sapiens
uccaauagaaagaaacuaaaca

SEQ ID NO: 1636977 - RNA, 14 nt, Homo sapiens
uccacacgcauuaa

SEQ ID NO: 1636978 - RNA, 14 nt, Homo sapiens
uccacacuaccaca

SEQ ID NO: 1636979 - RNA, 14 nt, Homo sapiens
uccacagauuauca

SEQ ID NO: 1636980 - RNA, 10 nt, Homo sapiens
uccacagcaa

SEQ ID NO: 1636981 - RNA, 17 nt, Homo sapiens
uccaccagccugcugac

SEQ ID NO: 1636982 - RNA, 23 nt, Homo sapiens
uccaccuguggguguagccaggu

SEQ ID NO: 1636983 - RNA, 17 nt, Homo sapiens
uccacuauuuucaaaga

SEQ ID NO: 1636984 - RNA, 14 nt, Homo sapiens
uccagaagggucau

SEQ ID NO: 1636985 - RNA, 15 nt, Homo sapiens
uccagagaugacuau

SEQ ID NO: 1636986 - RNA, 17 nt, Homo sapiens
uccagaguucugugaca

SEQ ID NO: 1636987 - RNA, 18 nt, Homo sapiens
uccagaguucugugacac

SEQ ID NO: 1636988 - RNA, 16 nt, Homo sapiens
uccagcagcagcacuu

SEQ ID NO: 1636989 - RNA, 19 nt, Homo sapiens
uccagccacuccaacugug

SEQ ID NO: 1636990 - RNA, 14 nt, Homo sapiens
uccagccacuuccc

SEQ ID NO: 1636991 - RNA, 19 nt, Homo sapiens
uccagcccucucacugugu

SEQ ID NO: 1636992 - RNA, 22 nt, Homo sapiens
uccagcccugggacagggcaaa

SEQ ID NO: 1636993 - RNA, 17 nt, Homo sapiens
uccagccucuccuccau

SEQ ID NO: 1636994 - RNA, 16 nt, Homo sapiens
uccaggccugcagcag

SEQ ID NO: 1636995 - RNA, 19 nt, Homo sapiens
uccagggucugagugcaag

SEQ ID NO: 1636996 - RNA, 20 nt, Homo sapiens
uccaguagugggaucaucca

SEQ ID NO: 1636997 - RNA, 15 nt, Homo sapiens
uccauaaaaggugug

SEQ ID NO: 1636998 - RNA, 13 nt, Homo sapiens
uccauacuguaga

SEQ ID NO: 1636999 - RNA, 16 nt, Homo sapiens
uccauccaaucuauua

SEQ ID NO: 1637000 - RNA, 18 nt, Homo sapiens
uccaucucucucuugccu

SEQ ID NO: 1637001 - RNA, 17 nt, Homo sapiens
uccaugcucaccaagga

SEQ ID NO: 1637002 - RNA, 18 nt, Homo sapiens
uccauggcugccaucuca

SEQ ID NO: 1637003 - RNA, 20 nt, Homo sapiens
uccauuuaagacacauugac

SEQ ID NO: 1637004 - RNA, 14 nt, Homo sapiens
ucccaaaacugcca

SEQ ID NO: 1637005 - RNA, 16 nt, Homo sapiens
ucccaaccccagugga

SEQ ID NO: 1637006 - RNA, 22 nt, Homo sapiens
ucccaagagcaucaugccucug

SEQ ID NO: 1637007 - RNA, 22 nt, Homo sapiens
ucccaagcuagacugugucuga

SEQ ID NO: 1637008 - RNA, 13 nt, Homo sapiens
ucccaauguuuga

SEQ ID NO: 1637009 - RNA, 16 nt, Homo sapiens
ucccacaugaggccau

SEQ ID NO: 1637010 - RNA, 17 nt, Homo sapiens
ucccaccaggaaucucc

SEQ ID NO: 1637011 - RNA, 21 nt, Homo sapiens
ucccaccauuccugccuuuaa

SEQ ID NO: 1637012 - RNA, 16 nt, Homo sapiens
ucccacccacauguga

SEQ ID NO: 1637013 - RNA, 21 nt, Homo sapiens
ucccacccacaugugacacau

SEQ ID NO: 1637014 - RNA, 16 nt, Homo sapiens
ucccaccccagggauu

SEQ ID NO: 1637015 - RNA, 23 nt, Homo sapiens
ucccagagggauugcugugaaau

SEQ ID NO: 1637016 - RNA, 17 nt, Homo sapiens
ucccagcaagaccucau

SEQ ID NO: 1637017 - RNA, 13 nt, Homo sapiens
ucccaggaucucc

SEQ ID NO: 1637018 - RNA, 20 nt, Homo sapiens
ucccaguaguuauaaagucc

SEQ ID NO: 1637019 - RNA, 15 nt, Homo sapiens
ucccaguuucucaga

SEQ ID NO: 1637020 - RNA, 15 nt, Homo sapiens
ucccaucccacugcu

SEQ ID NO: 1637021 - RNA, 23 nt, Homo sapiens
ucccaugcuuuguaggugucuca

SEQ ID NO: 1637022 - RNA, 12 nt, Homo sapiens
ucccauugccau

SEQ ID NO: 1637023 - RNA, 17 nt, Homo sapiens
uccccaagcaccuuccc

SEQ ID NO: 1637024 - RNA, 14 nt, Homo sapiens
uccccaaggacucu

SEQ ID NO: 1637025 - RNA, 19 nt, Homo sapiens
uccccaaggacucuuccac

SEQ ID NO: 1637026 - RNA, 16 nt, Homo sapiens
uccccacccagucuca

SEQ ID NO: 1637027 - RNA, 14 nt, Homo sapiens
uccccagagcugug

SEQ ID NO: 1637028 - RNA, 16 nt, Homo sapiens
uccccagaugugacua

SEQ ID NO: 1637029 - RNA, 16 nt, Homo sapiens
uccccagcagggucuu

SEQ ID NO: 1637030 - RNA, 22 nt, Homo sapiens
uccccagcucccccaggcagaa

SEQ ID NO: 1637031 - RNA, 12 nt, Homo sapiens
uccccagucucu

SEQ ID NO: 1637032 - RNA, 16 nt, Homo sapiens
ucccccgugaucuccc

SEQ ID NO: 1637033 - RNA, 19 nt, Homo sapiens
ucccccugcuuccaccuca

SEQ ID NO: 1637034 - RNA, 17 nt, Homo sapiens
uccccgagaacuuucug

SEQ ID NO: 1637035 - RNA, 19 nt, Homo sapiens
uccccgcccguuuuacaaa

SEQ ID NO: 1637036 - RNA, 19 nt, Homo sapiens
uccccgugggccauggcaa

SEQ ID NO: 1637037 - RNA, 16 nt, Homo sapiens
uccccuagucacucau

SEQ ID NO: 1637038 - RNA, 22 nt, Homo sapiens
uccccucagggauacgacacau

SEQ ID NO: 1637039 - RNA, 17 nt, Homo sapiens
uccccuccuuggcuuua

SEQ ID NO: 1637040 - RNA, 23 nt, Homo sapiens
uccccuccuuggcuuuaugcaaa

SEQ ID NO: 1637041 - RNA, 15 nt, Homo sapiens
uccccugaccuguga

SEQ ID NO: 1637042 - RNA, 14 nt, Homo sapiens
ucccgccaugcuca

SEQ ID NO: 1637043 - RNA, 17 nt, Homo sapiens
ucccuacacagggccug

SEQ ID NO: 1637044 - RNA, 12 nt, Homo sapiens
ucccuacugcca

SEQ ID NO: 1637045 - RNA, 12 nt, Homo sapiens
ucccugccucac

SEQ ID NO: 1637046 - RNA, 17 nt, Homo sapiens
ucccuggaccacgaggc

SEQ ID NO: 1637047 - RNA, 22 nt, Homo sapiens
ucccugggaggcuggggccccu

SEQ ID NO: 1637048 - RNA, 20 nt, Homo sapiens
ucccugucccucuagugccu

SEQ ID NO: 1637049 - RNA, 17 nt, Homo sapiens
ugcuuuuucugcgcuuc

SEQ ID NO: 1637050 - RNA, 15 nt, Homo sapiens
uggaaaacacuuuca

SEQ ID NO: 1637051 - RNA, 17 nt, Homo sapiens
uggaaaaguguuaggga

SEQ ID NO: 1637052 - RNA, 14 nt, Homo sapiens
uggaaaccaagcaa

SEQ ID NO: 1637053 - RNA, 18 nt, Homo sapiens
uggaaagaaucuuuacaa

SEQ ID NO: 1637054 - RNA, 20 nt, Homo sapiens
uggaaauucugcugcuucuc

SEQ ID NO: 1637055 - RNA, 13 nt, Homo sapiens
uggaacaagcaca

SEQ ID NO: 1637056 - RNA, 15 nt, Homo sapiens
uggaacacggccaca

SEQ ID NO: 1637057 - RNA, 17 nt, Homo sapiens
uggaacugauugcuccc

SEQ ID NO: 1637058 - RNA, 15 nt, Homo sapiens
uggaacuguguuuca

SEQ ID NO: 1637059 - RNA, 22 nt, Homo sapiens
uggacacggaucugcugggcuc

SEQ ID NO: 1637060 - RNA, 21 nt, Homo sapiens
uggacagaaaaugcaaugaca

SEQ ID NO: 1637061 - RNA, 15 nt, Homo sapiens
uggacucugcacaug

SEQ ID NO: 1637062 - RNA, 13 nt, Homo sapiens
uggagaaagcuca

SEQ ID NO: 1637063 - RNA, 22 nt, Homo sapiens
uggagaaccagggcucuucuca

SEQ ID NO: 1637064 - RNA, 23 nt, Homo sapiens
uggagaaccagggcucuucucag

SEQ ID NO: 1637065 - RNA, 23 nt, Homo sapiens
uggagacccugcaaacagaacag

SEQ ID NO: 1637066 - RNA, 15 nt, Homo sapiens
uggagaccuuucuag

SEQ ID NO: 1637067 - RNA, 15 nt, Homo sapiens
uggagagaagcucuu

SEQ ID NO: 1637068 - RNA, 15 nt, Homo sapiens
uggagagagccuuau

SEQ ID NO: 1637069 - RNA, 17 nt, Homo sapiens
uggagcaguaaugcagc

SEQ ID NO: 1637070 - RNA, 15 nt, Homo sapiens
uggagccacagcagc

SEQ ID NO: 1637071 - RNA, 19 nt, Homo sapiens
uggagccgugggcgggacc

SEQ ID NO: 1637072 - RNA, 21 nt, Homo sapiens
uggagcuaauggcgaucaucu

SEQ ID NO: 1637073 - RNA, 18 nt, Homo sapiens
uggaggagagaagaauga

SEQ ID NO: 1637074 - RNA, 20 nt, Homo sapiens
uggaggugggcaaagggaag

SEQ ID NO: 1637075 - RNA, 14 nt, Homo sapiens
uggauaacuuuaca

SEQ ID NO: 1637076 - RNA, 15 nt, Homo sapiens
uggauaacuuuacag

SEQ ID NO: 1637077 - RNA, 18 nt, Homo sapiens
uggaucacagacacugca

SEQ ID NO: 1637078 - RNA, 20 nt, Homo sapiens
uggaucacagacacugcaca

SEQ ID NO: 1637079 - RNA, 21 nt, Homo sapiens
uggaugacccuccccuaguca

SEQ ID NO: 1637080 - RNA, 15 nt, Homo sapiens
uggaugggaugcacu

SEQ ID NO: 1637081 - RNA, 13 nt, Homo sapiens
uggauuauugcuu

SEQ ID NO: 1637082 - RNA, 17 nt, Homo sapiens
uggauucauucucauaa

SEQ ID NO: 1637083 - RNA, 16 nt, Homo sapiens
uggcaaacgagacuuu

SEQ ID NO: 1637084 - RNA, 15 nt, Homo sapiens
uggcagcugucucaa

SEQ ID NO: 1637085 - RNA, 19 nt, Homo sapiens
uggcauaugguccuagaca

SEQ ID NO: 1637086 - RNA, 13 nt, Homo sapiens
uggcaugaucucg

SEQ ID NO: 1637087 - RNA, 18 nt, Homo sapiens
uggcaugcuaaagccuuc

SEQ ID NO: 1637088 - RNA, 12 nt, Homo sapiens
uggccaagccua

SEQ ID NO: 1637089 - RNA, 23 nt, Homo sapiens
uggccacagccuucccucugcau

SEQ ID NO: 1637090 - RNA, 17 nt, Homo sapiens
uggccaggcugguuuca

SEQ ID NO: 1637091 - RNA, 16 nt, Homo sapiens
uggccaggggccagga

SEQ ID NO: 1637092 - RNA, 18 nt, Homo sapiens
uggcccugccguuucccc

SEQ ID NO: 1637093 - RNA, 14 nt, Homo sapiens
uggccggcuggaaa

SEQ ID NO: 1637094 - RNA, 20 nt, Homo sapiens
uggccuauuuaucugaucaa

SEQ ID NO: 1637095 - RNA, 12 nt, Homo sapiens
uggccuggcaca

SEQ ID NO: 1637096 - RNA, 12 nt, Homo sapiens
uggccugugaug

SEQ ID NO: 1637097 - RNA, 15 nt, Homo sapiens
uggccuucaguguac

SEQ ID NO: 1637098 - RNA, 14 nt, Homo sapiens
uggccuuguaagac

SEQ ID NO: 1637099 - RNA, 22 nt, Homo sapiens
uggcuaacuauauuugcuuuuu

SEQ ID NO: 1637100 - RNA, 19 nt, Homo sapiens
uggcuaccucagaaagauu

SEQ ID NO: 1637101 - RNA, 17 nt, Homo sapiens
uggcuagagggcccaaa

SEQ ID NO: 1637102 - RNA, 21 nt, Homo sapiens
uggcuaugcaguacauuguau

SEQ ID NO: 1637103 - RNA, 22 nt, Homo sapiens
uggcucaagucugcacagagca

SEQ ID NO: 1637104 - RNA, 17 nt, Homo sapiens
uggcucagccagcacuu

SEQ ID NO: 1637105 - RNA, 17 nt, Homo sapiens
uggcugaaccaaagaaa

SEQ ID NO: 1637106 - RNA, 15 nt, Homo sapiens
uggcugaacuacaag

SEQ ID NO: 1637107 - RNA, 16 nt, Homo sapiens
uggcugagcccauuuu

SEQ ID NO: 1637108 - RNA, 22 nt, Homo sapiens
uggcugguggaacaaccugcug

SEQ ID NO: 1637109 - RNA, 12 nt, Homo sapiens
uggcuguuucau

SEQ ID NO: 1637110 - RNA, 17 nt, Homo sapiens
uggcuuaaaccagaacc

SEQ ID NO: 1637111 - RNA, 24 nt, Homo sapiens
uggcuuauuucuaugacaaauuca

SEQ ID NO: 1637112 - RNA, 14 nt, Homo sapiens
uggcuucacuccug

SEQ ID NO: 1637113 - RNA, 17 nt, Homo sapiens
uggcuuuaugugcaaaa

SEQ ID NO: 1637114 - RNA, 19 nt, Homo sapiens
ugggaacaggguuacugua

SEQ ID NO: 1637115 - RNA, 15 nt, Homo sapiens
ugggaaccacuccca

SEQ ID NO: 1637116 - RNA, 17 nt, Homo sapiens
ugggaagcaggagccca

SEQ ID NO: 1637117 - RNA, 23 nt, Homo sapiens
ugggacagacgagacaacagcac

SEQ ID NO: 1637118 - RNA, 21 nt, Homo sapiens
ugggagaaauugacagaucaa

SEQ ID NO: 1637119 - RNA, 20 nt, Homo sapiens
ugggagagucucacuuugga

SEQ ID NO: 1637120 - RNA, 19 nt, Homo sapiens
ugggagcacggacugucag

SEQ ID NO: 1637121 - RNA, 20 nt, Homo sapiens
ugggauguuauauuugagaa

SEQ ID NO: 1637122 - RNA, 14 nt, Homo sapiens
ugggauuacaggug

SEQ ID NO: 1637123 - RNA, 13 nt, Homo sapiens
ugggccagggucu

SEQ ID NO: 1637124 - RNA, 21 nt, Homo sapiens
ugggccgggcaauccagacag

SEQ ID NO: 1637125 - RNA, 15 nt, Homo sapiens
ugggcuauguaguca

SEQ ID NO: 1637126 - RNA, 15 nt, Homo sapiens
uggggaaaaaacugu

SEQ ID NO: 1637127 - RNA, 15 nt, Homo sapiens
uggggaagauggagc

SEQ ID NO: 1637128 - RNA, 19 nt, Homo sapiens
uggggaagggagucucucu

SEQ ID NO: 1637129 - RNA, 19 nt, Homo sapiens
uggggacaucucuuugaau

SEQ ID NO: 1637130 - RNA, 15 nt, Homo sapiens
uggggagauggaguu

SEQ ID NO: 1637131 - RNA, 14 nt, Homo sapiens
uggggaguaccugu

SEQ ID NO: 1637132 - RNA, 18 nt, Homo sapiens
uggggaguaccuguccaa

SEQ ID NO: 1637133 - RNA, 22 nt, Homo sapiens
uggggcaggaaagcaugcauug

SEQ ID NO: 1637134 - RNA, 23 nt, Homo sapiens
ugggggggcucccguggccugua

SEQ ID NO: 1637135 - RNA, 19 nt, Homo sapiens
uggggguuuuccaagcccu

SEQ ID NO: 1637136 - RNA, 21 nt, Homo sapiens
uggggucuuuuuaugcauuug

SEQ ID NO: 1637137 - RNA, 14 nt, Homo sapiens
uggguaaaaugaag

SEQ ID NO: 1637138 - RNA, 19 nt, Homo sapiens
ugggucacucauuaaugaa

SEQ ID NO: 1637139 - RNA, 17 nt, Homo sapiens
ugggugcaugaucuuga

SEQ ID NO: 1637140 - RNA, 14 nt, Homo sapiens
uggguguacauuuu

SEQ ID NO: 1637141 - RNA, 14 nt, Homo sapiens
ugguaaaaccuguu

SEQ ID NO: 1637142 - RNA, 18 nt, Homo sapiens
ugguaaaacucacuguga

SEQ ID NO: 1637143 - RNA, 14 nt, Homo sapiens
ugguacuuccucug

SEQ ID NO: 1637144 - RNA, 23 nt, Homo sapiens
ugguauccuacugagcauuugca

SEQ ID NO: 1637145 - RNA, 19 nt, Homo sapiens
uggucauaaaauagaauaa

SEQ ID NO: 1637146 - RNA, 22 nt, Homo sapiens
uggucucaaucuccugacuuca

SEQ ID NO: 1637147 - RNA, 17 nt, Homo sapiens
uggugcgcccugucucu

SEQ ID NO: 1637148 - RNA, 21 nt, Homo sapiens
ugguguaguuucugcauuuca

SEQ ID NO: 1637149 - RNA, 18 nt, Homo sapiens
ugguuaagagaucccuua

SEQ ID NO: 1637150 - RNA, 15 nt, Homo sapiens
ugguuucaacaaaga

SEQ ID NO: 1637151 - RNA, 11 nt, Homo sapiens
uguaaccacug

SEQ ID NO: 1637152 - RNA, 12 nt, Homo sapiens
uguaaccacugc

SEQ ID NO: 1637153 - RNA, 12 nt, Homo sapiens
uguaagaacaac

SEQ ID NO: 1637154 - RNA, 19 nt, Homo sapiens
uguaagauaaaccaguuga

SEQ ID NO: 1637155 - RNA, 16 nt, Homo sapiens
uguaagcauacuuugu

SEQ ID NO: 1637156 - RNA, 17 nt, Homo sapiens
uguaauaaaacauguuc

SEQ ID NO: 1637157 - RNA, 16 nt, Homo sapiens
uguaauaugacagaua

SEQ ID NO: 1637158 - RNA, 20 nt, Homo sapiens
uguaaugugugguggccuca

SEQ ID NO: 1637159 - RNA, 12 nt, Homo sapiens
aaaaaacauaua

SEQ ID NO: 1637160 - RNA, 12 nt, Homo sapiens
aaaaagauguac

SEQ ID NO: 1637161 - RNA, 17 nt, Homo sapiens
aaaaagcccuuugcuaa

SEQ ID NO: 1637162 - RNA, 19 nt, Homo sapiens
aaaaaucccuccaccuucc

SEQ ID NO: 1637163 - RNA, 12 nt, Homo sapiens
aaaaaugaguaa

SEQ ID NO: 1637164 - RNA, 20 nt, Homo sapiens
aaaaaugcaagccaucucua

SEQ ID NO: 1637165 - RNA, 12 nt, Homo sapiens
aaaaauuagcau

SEQ ID NO: 1637166 - RNA, 13 nt, Homo sapiens
aaaacaaccaaca

SEQ ID NO: 1637167 - RNA, 20 nt, Homo sapiens
aaaacauaugaccauugagu

SEQ ID NO: 1637168 - RNA, 13 nt, Homo sapiens
aaaacaugaauuu

SEQ ID NO: 1637169 - RNA, 15 nt, Homo sapiens
aaaacucacugugau

SEQ ID NO: 1637170 - RNA, 18 nt, Homo sapiens
aaaacuggcuacugcucu

SEQ ID NO: 1637171 - RNA, 15 nt, Homo sapiens
aaaacugugccuugu

SEQ ID NO: 1637172 - RNA, 17 nt, Homo sapiens
aaaacuguguugccaca

SEQ ID NO: 1637173 - RNA, 15 nt, Homo sapiens
aaaacuucuugucag

SEQ ID NO: 1637174 - RNA, 22 nt, Homo sapiens
agggcccagugacaaggcccug

SEQ ID NO: 1637175 - RNA, 16 nt, Homo sapiens
agggcccccaucucau

SEQ ID NO: 1637176 - RNA, 20 nt, Homo sapiens
agggcccccaucucaugccc

SEQ ID NO: 1637177 - RNA, 20 nt, Homo sapiens
agggcgagagugcccagggc

SEQ ID NO: 1637178 - RNA, 23 nt, Homo sapiens
agggcgaggggccuagagcucua

SEQ ID NO: 1637179 - RNA, 18 nt, Homo sapiens
agggcucuccaagggaau

SEQ ID NO: 1637180 - RNA, 22 nt, Homo sapiens
agggcugcucuuuccacuugcc

SEQ ID NO: 1637181 - RNA, 17 nt, Homo sapiens
agggcuuauccaugccu

SEQ ID NO: 1637182 - RNA, 16 nt, Homo sapiens
aggggaaccccggggu

SEQ ID NO: 1637183 - RNA, 19 nt, Homo sapiens
aggggagcaguggccauca

SEQ ID NO: 1637184 - RNA, 21 nt, Homo sapiens
aggggaggggugaaauccaua

SEQ ID NO: 1637185 - RNA, 12 nt, Homo sapiens
aggggagugcau

SEQ ID NO: 1637186 - RNA, 16 nt, Homo sapiens
aggggagugcauuuag

SEQ ID NO: 1637187 - RNA, 13 nt, Homo sapiens
aggggauccagcc

SEQ ID NO: 1637188 - RNA, 23 nt, Homo sapiens
aggggcuagggaggaccaaaggg

SEQ ID NO: 1637189 - RNA, 23 nt, Homo sapiens
aggggcuguugaauuucccacau

SEQ ID NO: 1637190 - RNA, 21 nt, Homo sapiens
agggggcaagcuuugcuccuu

SEQ ID NO: 1637191 - RNA, 14 nt, Homo sapiens
aggggugugcugag

SEQ ID NO: 1637192 - RNA, 23 nt, Homo sapiens
agggucugugugaaugugggcac

SEQ ID NO: 1637193 - RNA, 22 nt, Homo sapiens
agggucuugggaaauaugaaug

SEQ ID NO: 1637194 - RNA, 19 nt, Homo sapiens
agggucuuuucaucuggga

SEQ ID NO: 1637195 - RNA, 22 nt, Homo sapiens
agggugaagcuauuuaucugua

SEQ ID NO: 1637196 - RNA, 20 nt, Homo sapiens
agguaacuguacugggccau

SEQ ID NO: 1637197 - RNA, 11 nt, Homo sapiens
agguacaggag

SEQ ID NO: 1637198 - RNA, 23 nt, Homo sapiens
agguauccaaaaauguguaagaa

SEQ ID NO: 1637199 - RNA, 22 nt, Homo sapiens
aggucaaggcugcagugagcca

SEQ ID NO: 1637200 - RNA, 18 nt, Homo sapiens
aggucauaaagcauugga

SEQ ID NO: 1637201 - RNA, 20 nt, Homo sapiens
agguccuuaggccucugaga

SEQ ID NO: 1637202 - RNA, 19 nt, Homo sapiens
aggugaggguuacacugaa

SEQ ID NO: 1637203 - RNA, 16 nt, Homo sapiens
aggugauggguauuag

SEQ ID NO: 1637204 - RNA, 18 nt, Homo sapiens
aggugcauagcaagugaa

SEQ ID NO: 1637205 - RNA, 19 nt, Homo sapiens
aggugccaucucaggagaa

SEQ ID NO: 1637206 - RNA, 16 nt, Homo sapiens
agguggcccuaaagga

SEQ ID NO: 1637207 - RNA, 21 nt, Homo sapiens
aggugguucagacaagacaga

SEQ ID NO: 1637208 - RNA, 13 nt, Homo sapiens
aggugugacaugu

SEQ ID NO: 1637209 - RNA, 23 nt, Homo sapiens
agguuacccgagaagcacuugag

SEQ ID NO: 1637210 - RNA, 11 nt, Homo sapiens
agguucaagac

SEQ ID NO: 1637211 - RNA, 22 nt, Homo sapiens
agguucauugcgugauucaaug

SEQ ID NO: 1637212 - RNA, 22 nt, Homo sapiens
agguuugguuugguuuuggaca

SEQ ID NO: 1637213 - RNA, 20 nt, Homo sapiens
agguuuuccuuccaagcacc

SEQ ID NO: 1637214 - RNA, 16 nt, Homo sapiens
aguaaaagcuacuaug

SEQ ID NO: 1637215 - RNA, 15 nt, Homo sapiens
aguaaauagugucau

SEQ ID NO: 1637216 - RNA, 12 nt, Homo sapiens
aguaacaaauaa

SEQ ID NO: 1637217 - RNA, 15 nt, Homo sapiens
aguaaccaaggcccu

SEQ ID NO: 1637218 - RNA, 18 nt, Homo sapiens
aguaauaucaaagcauuu

SEQ ID NO: 1637219 - RNA, 21 nt, Homo sapiens
aguaauaucaaagcauuuuau

SEQ ID NO: 1637220 - RNA, 16 nt, Homo sapiens
aguaaucuguguacaa

SEQ ID NO: 1637221 - RNA, 14 nt, Homo sapiens
aguaaugaucucaa

SEQ ID NO: 1637222 - RNA, 16 nt, Homo sapiens
aguaauggagguccca

SEQ ID NO: 1637223 - RNA, 14 nt, Homo sapiens
aguaauugcaagag

SEQ ID NO: 1637224 - RNA, 21 nt, Homo sapiens
aguaccuagcuggcucuguga

SEQ ID NO: 1637225 - RNA, 16 nt, Homo sapiens
aguacuaagggaacaa

SEQ ID NO: 1637226 - RNA, 18 nt, Homo sapiens
aguacuaagggaacaauc

SEQ ID NO: 1637227 - RNA, 15 nt, Homo sapiens
aguacuuaacauaca

SEQ ID NO: 1637228 - RNA, 17 nt, Homo sapiens
aguacuugagggaccaa

SEQ ID NO: 1637229 - RNA, 15 nt, Homo sapiens
aguacuuugugcauu

SEQ ID NO: 1637230 - RNA, 18 nt, Homo sapiens
aguagagcaaaucuauga

SEQ ID NO: 1637231 - RNA, 13 nt, Homo sapiens
aguagcugagcuc

SEQ ID NO: 1637232 - RNA, 14 nt, Homo sapiens
aguagcugagcuca

SEQ ID NO: 1637233 - RNA, 9 nt, Homo sapiens
aguaguccu

SEQ ID NO: 1637234 - RNA, 15 nt, Homo sapiens
aguauaaauuuacuu

SEQ ID NO: 1637235 - RNA, 18 nt, Homo sapiens
agucaccagccagaggau

SEQ ID NO: 1637236 - RNA, 21 nt, Homo sapiens
agucagagagggugacaagau

SEQ ID NO: 1637237 - RNA, 17 nt, Homo sapiens
agucagaugaggcccug

SEQ ID NO: 1637238 - RNA, 13 nt, Homo sapiens
agucaugguguug

SEQ ID NO: 1637239 - RNA, 15 nt, Homo sapiens
agucauugaggcccu

SEQ ID NO: 1637240 - RNA, 18 nt, Homo sapiens
agucccgcgugcaaagga

SEQ ID NO: 1637241 - RNA, 12 nt, Homo sapiens
aguccuagcccc

SEQ ID NO: 1637242 - RNA, 15 nt, Homo sapiens
aguccucacucuuca

SEQ ID NO: 1637243 - RNA, 17 nt, Homo sapiens
aguccucccuagcucuu

SEQ ID NO: 1637244 - RNA, 21 nt, Homo sapiens
aguccuucaccucacugaaaa

SEQ ID NO: 1637245 - RNA, 15 nt, Homo sapiens
aguccuucccuuuca

SEQ ID NO: 1637246 - RNA, 16 nt, Homo sapiens
agucggccccaucucu

SEQ ID NO: 1637247 - RNA, 17 nt, Homo sapiens
agucuauguucaaagac

SEQ ID NO: 1637248 - RNA, 22 nt, Homo sapiens
agucucauugucaccucuguga

SEQ ID NO: 1637249 - RNA, 18 nt, Homo sapiens
agucugagguccugagca

SEQ ID NO: 1637250 - RNA, 22 nt, Homo sapiens
agucugcuacccucauuucuca

SEQ ID NO: 1637251 - RNA, 12 nt, Homo sapiens
agucugcugcug

SEQ ID NO: 1637252 - RNA, 20 nt, Homo sapiens
agucuuccacuucaaugcac

SEQ ID NO: 1637253 - RNA, 15 nt, Homo sapiens
agucuugcucuguca

SEQ ID NO: 1637254 - RNA, 19 nt, Homo sapiens
agugaauccugaaacuggu

SEQ ID NO: 1637255 - RNA, 14 nt, Homo sapiens
agugacaaggcccu

SEQ ID NO: 1637256 - RNA, 18 nt, Homo sapiens
agugacagcagucaggga

SEQ ID NO: 1637257 - RNA, 12 nt, Homo sapiens
agugacauguag

SEQ ID NO: 1637258 - RNA, 19 nt, Homo sapiens
agugacccacaugccauuu

SEQ ID NO: 1637259 - RNA, 12 nt, Homo sapiens
agugcacugagc

SEQ ID NO: 1637260 - RNA, 13 nt, Homo sapiens
agugcaggggaug

SEQ ID NO: 1637261 - RNA, 20 nt, Homo sapiens
agugcaguggcgugaucucg

SEQ ID NO: 1637262 - RNA, 14 nt, Homo sapiens
agugcauuuagacu

SEQ ID NO: 1637263 - RNA, 20 nt, Homo sapiens
agugccaacaauccuagugc

SEQ ID NO: 1637264 - RNA, 14 nt, Homo sapiens
agugccaacuccuc

SEQ ID NO: 1637265 - RNA, 16 nt, Homo sapiens
agugcucacaaaggau

SEQ ID NO: 1637266 - RNA, 16 nt, Homo sapiens
agugcugaacuggcug

SEQ ID NO: 1637267 - RNA, 19 nt, Homo sapiens
agugcuggcucacaguaca

SEQ ID NO: 1637268 - RNA, 15 nt, Homo sapiens
agugcuuaaaaauac

SEQ ID NO: 1637269 - RNA, 15 nt, Homo sapiens
aguggagacaguccu

SEQ ID NO: 1637270 - RNA, 16 nt, Homo sapiens
aguggagagaagcucu

SEQ ID NO: 1637271 - RNA, 23 nt, Homo sapiens
aguggagggggcaagcuuugcuc

SEQ ID NO: 1637272 - RNA, 17 nt, Homo sapiens
aguggaugcugugcuac

SEQ ID NO: 1637273 - RNA, 14 nt, Homo sapiens
aguggcagggaccg

SEQ ID NO: 1637274 - RNA, 14 nt, Homo sapiens
aguggcuucacucc

SEQ ID NO: 1637275 - RNA, 22 nt, Homo sapiens
agugggccccgggcuggagaaa

SEQ ID NO: 1637276 - RNA, 15 nt, Homo sapiens
agugguugcauucua

SEQ ID NO: 1637277 - RNA, 23 nt, Homo sapiens
agugguuugaagaccccacugcc

SEQ ID NO: 1637278 - RNA, 23 nt, Homo sapiens
agugucaggcgccgcacuuccuu

SEQ ID NO: 1637279 - RNA, 17 nt, Homo sapiens
agugugacagggccagu

SEQ ID NO: 1637280 - RNA, 20 nt, Homo sapiens
agugugacuucuuacacaua

SEQ ID NO: 1637281 - RNA, 19 nt, Homo sapiens
aguguucccagagcacuuu

SEQ ID NO: 1637282 - RNA, 17 nt, Homo sapiens
aguguuguggacacugc

SEQ ID NO: 1637283 - RNA, 20 nt, Homo sapiens
aguuaaggggagcaacagag

SEQ ID NO: 1637284 - RNA, 19 nt, Homo sapiens
aguuaaugauuuuacuuaa

SEQ ID NO: 1637285 - RNA, 15 nt, Homo sapiens
aguuaugugauuuuc

SEQ ID NO: 1637286 - RNA, 16 nt, Homo sapiens
aguuauuuuaauaccu

SEQ ID NO: 1637287 - RNA, 15 nt, Homo sapiens
aguucaauacaguga

SEQ ID NO: 1637288 - RNA, 12 nt, Homo sapiens
aguucauugugg

SEQ ID NO: 1637289 - RNA, 19 nt, Homo sapiens
aguucccuaaacuuuagaa

SEQ ID NO: 1637290 - RNA, 18 nt, Homo sapiens
aguuccugcugccugggu

SEQ ID NO: 1637291 - RNA, 21 nt, Homo sapiens
aguuccuucuggugucugcuu

SEQ ID NO: 1637292 - RNA, 19 nt, Homo sapiens
aguucgcagccacccugag

SEQ ID NO: 1637293 - RNA, 17 nt, Homo sapiens
aguucuguguggugcau

SEQ ID NO: 1637294 - RNA, 14 nt, Homo sapiens
aguucuucauuugg

SEQ ID NO: 1637295 - RNA, 14 nt, Homo sapiens
aguugagacuuaaa

SEQ ID NO: 1637296 - RNA, 16 nt, Homo sapiens
aguugccaacuauucu

SEQ ID NO: 1637297 - RNA, 16 nt, Homo sapiens
aguugccaggcacuuu

SEQ ID NO: 1637298 - RNA, 20 nt, Homo sapiens
aguugcguggacucugcaca

SEQ ID NO: 1637299 - RNA, 21 nt, Homo sapiens
aguugcguggacucugcacau

SEQ ID NO: 1637300 - RNA, 11 nt, Homo sapiens
aguugcuguau

SEQ ID NO: 1637301 - RNA, 21 nt, Homo sapiens
aguuuaauuuuugaaaacugg

SEQ ID NO: 1637302 - RNA, 23 nt, Homo sapiens
aguuuaauuuuugaaaacuggcu

SEQ ID NO: 1637303 - RNA, 14 nt, Homo sapiens
aguuuaccuaugua

SEQ ID NO: 1637304 - RNA, 22 nt, Homo sapiens
aguuuaugcugugcuaaauauc

SEQ ID NO: 1637305 - RNA, 16 nt, Homo sapiens
aguuucuaaaaacaca

SEQ ID NO: 1637306 - RNA, 13 nt, Homo sapiens
aguuugcacuaua

SEQ ID NO: 1637307 - RNA, 22 nt, Homo sapiens
aguuugccuuuguaccauauaa

SEQ ID NO: 1637308 - RNA, 20 nt, Homo sapiens
aguuuuaaacaaaugugaua

SEQ ID NO: 1637309 - RNA, 22 nt, Homo sapiens
aguuuuaaacaaaugugauaca

SEQ ID NO: 1637310 - RNA, 22 nt, Homo sapiens
aguuuuucuuacuugcauuuau

SEQ ID NO: 1637311 - RNA, 16 nt, Homo sapiens
auaaaaaacauauaca

SEQ ID NO: 1637312 - RNA, 12 nt, Homo sapiens
auaaaacauuca

SEQ ID NO: 1637313 - RNA, 14 nt, Homo sapiens
auaaaauacauuua

SEQ ID NO: 1637314 - RNA, 12 nt, Homo sapiens
auaaaauagcca

SEQ ID NO: 1637315 - RNA, 23 nt, Homo sapiens
auaaacaacauugagauuaugau

SEQ ID NO: 1637316 - RNA, 15 nt, Homo sapiens
auaaacauguauaaa

SEQ ID NO: 1637317 - RNA, 13 nt, Homo sapiens
auaaaccaguuga

SEQ ID NO: 1637318 - RNA, 21 nt, Homo sapiens
auaaacgcagaagagggggag

SEQ ID NO: 1637319 - RNA, 20 nt, Homo sapiens
auaaacuguaugcucacaac

SEQ ID NO: 1637320 - RNA, 17 nt, Homo sapiens
auaaagauuucaagauc

SEQ ID NO: 1637321 - RNA, 17 nt, Homo sapiens
auaaaggaaaaugacuu

SEQ ID NO: 1637322 - RNA, 17 nt, Homo sapiens
auaaagggacacuuuua

SEQ ID NO: 1637323 - RNA, 19 nt, Homo sapiens
auaaaguccuuggacuguu

SEQ ID NO: 1637324 - RNA, 15 nt, Homo sapiens
auaaauaagaucaga

SEQ ID NO: 1637325 - RNA, 19 nt, Homo sapiens
auaaauguugcaaugcaug

SEQ ID NO: 1637326 - RNA, 16 nt, Homo sapiens
auaacauuuaaauucc

SEQ ID NO: 1637327 - RNA, 19 nt, Homo sapiens
auaacauuuaaauuccaca

SEQ ID NO: 1637328 - RNA, 21 nt, Homo sapiens
auaacauuuaaauuccacaga

SEQ ID NO: 1637329 - RNA, 22 nt, Homo sapiens
auaacauuuacuuuugcucccu

SEQ ID NO: 1637330 - RNA, 21 nt, Homo sapiens
auaacuuuuuuuuaaguuaca

SEQ ID NO: 1637331 - RNA, 14 nt, Homo sapiens
auaagaauuacuuu

SEQ ID NO: 1637332 - RNA, 14 nt, Homo sapiens
auaagacacucaaa

SEQ ID NO: 1637333 - RNA, 19 nt, Homo sapiens
auaagaucuguuuuuggac

SEQ ID NO: 1637334 - RNA, 23 nt, Homo sapiens
auaagcagaacauacuguucuca

SEQ ID NO: 1637335 - RNA, 22 nt, Homo sapiens
auaagcucuccccaaacuugcu

SEQ ID NO: 1637336 - RNA, 21 nt, Homo sapiens
auaauaaaucugccugcaacu

SEQ ID NO: 1637337 - RNA, 16 nt, Homo sapiens
auaaugaaaacauccu

SEQ ID NO: 1637338 - RNA, 18 nt, Homo sapiens
auaaugcuuuuacuaagc

SEQ ID NO: 1637339 - RNA, 20 nt, Homo sapiens
auaauuugaaaaaguuccau

SEQ ID NO: 1637340 - RNA, 13 nt, Homo sapiens
auaauuuggucau

SEQ ID NO: 1637341 - RNA, 15 nt, Homo sapiens
auacacagugcugac

SEQ ID NO: 1637342 - RNA, 23 nt, Homo sapiens
auacaugcaacagaagugacuuc

SEQ ID NO: 1637343 - RNA, 13 nt, Homo sapiens
auacaugcuacuu

SEQ ID NO: 1637344 - RNA, 22 nt, Homo sapiens
auaccaaccugaagacaccguu

SEQ ID NO: 1637345 - RNA, 15 nt, Homo sapiens
auaccaacucaguga

SEQ ID NO: 1637346 - RNA, 17 nt, Homo sapiens
auacccaggaagacuuu

SEQ ID NO: 1637347 - RNA, 21 nt, Homo sapiens
auacccuccuuccaccaaguu

SEQ ID NO: 1637348 - RNA, 19 nt, Homo sapiens
auacuaacauuuucauuga

SEQ ID NO: 1637349 - RNA, 13 nt, Homo sapiens
auacucagguuaa

SEQ ID NO: 1637350 - RNA, 17 nt, Homo sapiens
auacugcugcuugucaa

SEQ ID NO: 1637351 - RNA, 14 nt, Homo sapiens
auacuguacaugaa

SEQ ID NO: 1637352 - RNA, 20 nt, Homo sapiens
auacuguagacacucugaca

SEQ ID NO: 1637353 - RNA, 16 nt, Homo sapiens
auacuuaacauuucau

SEQ ID NO: 1637354 - RNA, 15 nt, Homo sapiens
auacuuaaugcauau

SEQ ID NO: 1637355 - RNA, 19 nt, Homo sapiens
auacuucuuuuucauuauu

SEQ ID NO: 1637356 - RNA, 15 nt, Homo sapiens
auacuuuauuguggg

SEQ ID NO: 1637357 - RNA, 12 nt, Homo sapiens
aucuugaucauu

SEQ ID NO: 1637358 - RNA, 20 nt, Homo sapiens
aucuuggagacccugcaaac

SEQ ID NO: 1637359 - RNA, 22 nt, Homo sapiens
aucuuguguuaacuugccucca

SEQ ID NO: 1637360 - RNA, 17 nt, Homo sapiens
aucuuuuaagcuaucua

SEQ ID NO: 1637361 - RNA, 15 nt, Homo sapiens
augaaaaccuacaua

SEQ ID NO: 1637362 - RNA, 11 nt, Homo sapiens
augaacacaga

SEQ ID NO: 1637363 - RNA, 11 nt, Homo sapiens
augaacaucuc

SEQ ID NO: 1637364 - RNA, 23 nt, Homo sapiens
augaacuugcaaacaggcugaua

SEQ ID NO: 1637365 - RNA, 15 nt, Homo sapiens
augaagaucauauac

SEQ ID NO: 1637366 - RNA, 18 nt, Homo sapiens
augaagguggaacaagca

SEQ ID NO: 1637367 - RNA, 21 nt, Homo sapiens
augaauaacauuuaaauucca

SEQ ID NO: 1637368 - RNA, 22 nt, Homo sapiens
augaauagaaaaaaaacaaacc

SEQ ID NO: 1637369 - RNA, 21 nt, Homo sapiens
augaaucccacccacauguga

SEQ ID NO: 1637370 - RNA, 14 nt, Homo sapiens
augaauuagccaaa

SEQ ID NO: 1637371 - RNA, 19 nt, Homo sapiens
augaauucugucauuucaa

SEQ ID NO: 1637372 - RNA, 13 nt, Homo sapiens
augaccaccccuc

SEQ ID NO: 1637373 - RNA, 21 nt, Homo sapiens
augacccccgcaaguuugcac

SEQ ID NO: 1637374 - RNA, 21 nt, Homo sapiens
augacgucaucaucacauuca

SEQ ID NO: 1637375 - RNA, 11 nt, Homo sapiens
augacuggugg

SEQ ID NO: 1637376 - RNA, 13 nt, Homo sapiens
augacuuacuuuc

SEQ ID NO: 1637377 - RNA, 17 nt, Homo sapiens
augacuuuuuauacuuu

SEQ ID NO: 1637378 - RNA, 14 nt, Homo sapiens
augagacugcccug

SEQ ID NO: 1637379 - RNA, 18 nt, Homo sapiens
augaggauaaugggaaga

SEQ ID NO: 1637380 - RNA, 14 nt, Homo sapiens
augaggccaucuca

SEQ ID NO: 1637381 - RNA, 15 nt, Homo sapiens
augaguagacauugu

SEQ ID NO: 1637382 - RNA, 19 nt, Homo sapiens
augauaaaccugccaagag

SEQ ID NO: 1637383 - RNA, 21 nt, Homo sapiens
augauaaaccugccaagaguc

SEQ ID NO: 1637384 - RNA, 20 nt, Homo sapiens
augauacugcugcuugucaa

SEQ ID NO: 1637385 - RNA, 19 nt, Homo sapiens
augaugaaaaccuacauau

SEQ ID NO: 1637386 - RNA, 16 nt, Homo sapiens
augaugagaagcagaa

SEQ ID NO: 1637387 - RNA, 22 nt, Homo sapiens
augaugcgggccagugcuccag

SEQ ID NO: 1637388 - RNA, 21 nt, Homo sapiens
augaugggaggugugccagaa

SEQ ID NO: 1637389 - RNA, 16 nt, Homo sapiens
augauugugugacuau

SEQ ID NO: 1637390 - RNA, 18 nt, Homo sapiens
acugugugugaaucugcu

SEQ ID NO: 1637391 - RNA, 13 nt, Homo sapiens
acuuaacuauuaa

SEQ ID NO: 1637392 - RNA, 13 nt, Homo sapiens
acuuaaugcacag

SEQ ID NO: 1637393 - RNA, 16 nt, Homo sapiens
acuuaaugcacagugc

SEQ ID NO: 1637394 - RNA, 13 nt, Homo sapiens
acuuacauuccag

SEQ ID NO: 1637395 - RNA, 15 nt, Homo sapiens
acuuagauucauuaa

SEQ ID NO: 1637396 - RNA, 19 nt, Homo sapiens
acuuaguaaguaauaucaa

SEQ ID NO: 1637397 - RNA, 18 nt, Homo sapiens
acuuauaccugcuaucag

SEQ ID NO: 1637398 - RNA, 16 nt, Homo sapiens
acuuaucccucuccau

SEQ ID NO: 1637399 - RNA, 17 nt, Homo sapiens
acuuauuaccucaggug

SEQ ID NO: 1637400 - RNA, 21 nt, Homo sapiens
acuuauucucuguaggccaaa

SEQ ID NO: 1637401 - RNA, 14 nt, Homo sapiens
acuucaaaguuaau

SEQ ID NO: 1637402 - RNA, 19 nt, Homo sapiens
acuucaaggcucaaugcua

SEQ ID NO: 1637403 - RNA, 13 nt, Homo sapiens
acuucacuaggca

SEQ ID NO: 1637404 - RNA, 16 nt, Homo sapiens
acuucauucacauuca

SEQ ID NO: 1637405 - RNA, 17 nt, Homo sapiens
acuucauucacauucag

SEQ ID NO: 1637406 - RNA, 22 nt, Homo sapiens
acuuccaugagaagaagcagau

SEQ ID NO: 1637407 - RNA, 19 nt, Homo sapiens
acuuccccaagaucugcca

SEQ ID NO: 1637408 - RNA, 18 nt, Homo sapiens
acuuccuacguauccugc

SEQ ID NO: 1637409 - RNA, 22 nt, Homo sapiens
acuucgcucuugaggagcucaa

SEQ ID NO: 1637410 - RNA, 18 nt, Homo sapiens
acuucucugugugcacac

SEQ ID NO: 1637411 - RNA, 15 nt, Homo sapiens
acuucugaagacuga

SEQ ID NO: 1637412 - RNA, 15 nt, Homo sapiens
acuucugcaggaucc

SEQ ID NO: 1637413 - RNA, 14 nt, Homo sapiens
acuucuugucagac

SEQ ID NO: 1637414 - RNA, 17 nt, Homo sapiens
acuugacauguagcuuc

SEQ ID NO: 1637415 - RNA, 17 nt, Homo sapiens
acuugagggaccaauau

SEQ ID NO: 1637416 - RNA, 23 nt, Homo sapiens
acuugcauuuauuuaagacacug

SEQ ID NO: 1637417 - RNA, 15 nt, Homo sapiens
acuugccuccaucuu

SEQ ID NO: 1637418 - RNA, 14 nt, Homo sapiens
acuugccucugcac

SEQ ID NO: 1637419 - RNA, 16 nt, Homo sapiens
acuugcugauccauga

SEQ ID NO: 1637420 - RNA, 21 nt, Homo sapiens
acuugucccacuaucugggug

SEQ ID NO: 1637421 - RNA, 18 nt, Homo sapiens
acuugucugccuccugcu

SEQ ID NO: 1637422 - RNA, 20 nt, Homo sapiens
acuuuaaacuugucuuuuca

SEQ ID NO: 1637423 - RNA, 23 nt, Homo sapiens
acuuuaauuuccuugacuguaaa

SEQ ID NO: 1637424 - RNA, 18 nt, Homo sapiens
acuuucaguaaacauaaa

SEQ ID NO: 1637425 - RNA, 13 nt, Homo sapiens
acuuugugcauuc

SEQ ID NO: 1637426 - RNA, 20 nt, Homo sapiens
acuuuuuuagaaaugcaaaa

SEQ ID NO: 1637427 - RNA, 18 nt, Homo sapiens
agaaaacucccaauacaa

SEQ ID NO: 1637428 - RNA, 18 nt, Homo sapiens
agaaaaguaauuuuguca

SEQ ID NO: 1637429 - RNA, 16 nt, Homo sapiens
agaaacaagcugugca

SEQ ID NO: 1637430 - RNA, 17 nt, Homo sapiens
agaaacagccugugucu

SEQ ID NO: 1637431 - RNA, 20 nt, Homo sapiens
agaaaccuggggugaauacu

SEQ ID NO: 1637432 - RNA, 20 nt, Homo sapiens
agaaagggagggcucugagg

SEQ ID NO: 1637433 - RNA, 12 nt, Homo sapiens
agaaaguacaag

SEQ ID NO: 1637434 - RNA, 19 nt, Homo sapiens
agaaauggauguaagccug

SEQ ID NO: 1637435 - RNA, 20 nt, Homo sapiens
agaaauggauguaagccugg

SEQ ID NO: 1637436 - RNA, 17 nt, Homo sapiens
agaaaugugucacccca

SEQ ID NO: 1637437 - RNA, 17 nt, Homo sapiens
agaaauugacagaucaa

SEQ ID NO: 1637438 - RNA, 12 nt, Homo sapiens
agaacaggguca

SEQ ID NO: 1637439 - RNA, 13 nt, Homo sapiens
agaacagggucau

SEQ ID NO: 1637440 - RNA, 18 nt, Homo sapiens
agaaccacucauaauucu

SEQ ID NO: 1637441 - RNA, 19 nt, Homo sapiens
agaaccagggcucuucuca

SEQ ID NO: 1637442 - RNA, 19 nt, Homo sapiens
agaacccaguguuuccaca

SEQ ID NO: 1637443 - RNA, 17 nt, Homo sapiens
agaaccuuaaagaacca

SEQ ID NO: 1637444 - RNA, 16 nt, Homo sapiens
agaacguggcucugcu

SEQ ID NO: 1637445 - RNA, 15 nt, Homo sapiens
agaacguggugaccu

SEQ ID NO: 1637446 - RNA, 20 nt, Homo sapiens
agaacguggugaccuuucac

SEQ ID NO: 1637447 - RNA, 23 nt, Homo sapiens
agaacguuuuuuccucagugcau

SEQ ID NO: 1637448 - RNA, 22 nt, Homo sapiens
agaacuggaggcaguccaucua

SEQ ID NO: 1637449 - RNA, 22 nt, Homo sapiens
agaagauccaagaggcccugca

SEQ ID NO: 1637450 - RNA, 12 nt, Homo sapiens
agaagcacuuga

SEQ ID NO: 1637451 - RNA, 20 nt, Homo sapiens
agaagccugaugcugacauu

SEQ ID NO: 1637452 - RNA, 23 nt, Homo sapiens
agaagccugaugcugacauucac

SEQ ID NO: 1637453 - RNA, 18 nt, Homo sapiens
agaagccugggggccugg

SEQ ID NO: 1637454 - RNA, 13 nt, Homo sapiens
agaagguagggga

SEQ ID NO: 1637455 - RNA, 14 nt, Homo sapiens
agaaguaauuugaa

SEQ ID NO: 1637456 - RNA, 14 nt, Homo sapiens
agaaguacuccuau

SEQ ID NO: 1637457 - RNA, 21 nt, Homo sapiens
agaauaggaagauaugccacu

SEQ ID NO: 1637458 - RNA, 16 nt, Homo sapiens
agaaugagaagacaug

SEQ ID NO: 1637459 - RNA, 16 nt, Homo sapiens
agaauguguguagaua

SEQ ID NO: 1637460 - RNA, 20 nt, Homo sapiens
agaauguguuucaaaaccau

SEQ ID NO: 1637461 - RNA, 13 nt, Homo sapiens
agaauuacauaaa

SEQ ID NO: 1637462 - RNA, 12 nt, Homo sapiens
agaauugcacau

SEQ ID NO: 1637463 - RNA, 15 nt, Homo sapiens
agaauuggaaucaca

SEQ ID NO: 1637464 - RNA, 19 nt, Homo sapiens
agaauuuaaaauaacacuu

SEQ ID NO: 1637465 - RNA, 21 nt, Homo sapiens
agacaaguauggcuccuccau

SEQ ID NO: 1637466 - RNA, 13 nt, Homo sapiens
agacacaggucac

SEQ ID NO: 1637467 - RNA, 17 nt, Homo sapiens
agacacauacagagugg

SEQ ID NO: 1637468 - RNA, 22 nt, Homo sapiens
agacacuccccccuccauuccc

SEQ ID NO: 1637469 - RNA, 15 nt, Homo sapiens
agacacugaucuggc

SEQ ID NO: 1637470 - RNA, 22 nt, Homo sapiens
agacacuguuacagagauacug

SEQ ID NO: 1637471 - RNA, 20 nt, Homo sapiens
agacagcaggcauaaggcac

SEQ ID NO: 1637472 - RNA, 14 nt, Homo sapiens
agacaggaaagcca

SEQ ID NO: 1637473 - RNA, 16 nt, Homo sapiens
agacaggaaagccagg

SEQ ID NO: 1637474 - RNA, 13 nt, Homo sapiens
agacauucucaca

SEQ ID NO: 1637475 - RNA, 15 nt, Homo sapiens
agaccaccuucccuu

SEQ ID NO: 1637476 - RNA, 14 nt, Homo sapiens
agacccaguggacu

SEQ ID NO: 1637477 - RNA, 19 nt, Homo sapiens
agacccaguggacucuucc

SEQ ID NO: 1637478 - RNA, 12 nt, Homo sapiens
agaccuacccuc

SEQ ID NO: 1637479 - RNA, 17 nt, Homo sapiens
agaccuccccauguaca

SEQ ID NO: 1637480 - RNA, 18 nt, Homo sapiens
agacgcagagcaaaugag

SEQ ID NO: 1637481 - RNA, 22 nt, Homo sapiens
agacgggaggggaggcauugac

SEQ ID NO: 1637482 - RNA, 14 nt, Homo sapiens
agacuaacauguca

SEQ ID NO: 1637483 - RNA, 22 nt, Homo sapiens
agacuaccggacacucgucacc

SEQ ID NO: 1637484 - RNA, 19 nt, Homo sapiens
agacucccaccccagggau

SEQ ID NO: 1637485 - RNA, 21 nt, Homo sapiens
agacucccaccccagggauug

SEQ ID NO: 1637486 - RNA, 20 nt, Homo sapiens
agacuccuagacucacuugu

SEQ ID NO: 1637487 - RNA, 17 nt, Homo sapiens
agacucugucuaccugg

SEQ ID NO: 1637488 - RNA, 18 nt, Homo sapiens
agacucugucuaccuggu

SEQ ID NO: 1637489 - RNA, 19 nt, Homo sapiens
agacugaaaggugugaaca

SEQ ID NO: 1637490 - RNA, 22 nt, Homo sapiens
agacuggcagggacgaggacaa

SEQ ID NO: 1637491 - RNA, 18 nt, Homo sapiens
agacuuaaaaaauacuug

SEQ ID NO: 1637492 - RNA, 21 nt, Homo sapiens
agacuuauguggaacuguaca

SEQ ID NO: 1637493 - RNA, 15 nt, Homo sapiens
agacuuauugccaaa

SEQ ID NO: 1637494 - RNA, 21 nt, Homo sapiens
agacuucuuccucuagacuug

SEQ ID NO: 1637495 - RNA, 19 nt, Homo sapiens
agagaaugagaagacaugg

SEQ ID NO: 1637496 - RNA, 14 nt, Homo sapiens
agagagaagccagc

SEQ ID NO: 1637497 - RNA, 20 nt, Homo sapiens
agagagcuagagggacaaag

SEQ ID NO: 1637498 - RNA, 16 nt, Homo sapiens
agagaggccugugcua

SEQ ID NO: 1637499 - RNA, 17 nt, Homo sapiens
agagaggccuuguccca

SEQ ID NO: 1637500 - RNA, 22 nt, Homo sapiens
agccuacuuucacacuaagaaa

SEQ ID NO: 1637501 - RNA, 15 nt, Homo sapiens
agccuaucaaaggaa

SEQ ID NO: 1637502 - RNA, 17 nt, Homo sapiens
agccucaccccauccca

SEQ ID NO: 1637503 - RNA, 19 nt, Homo sapiens
agccucgcaacccgugcca

SEQ ID NO: 1637504 - RNA, 21 nt, Homo sapiens
agccucugacuuaagcugccu

SEQ ID NO: 1637505 - RNA, 23 nt, Homo sapiens
agccugaaacucauagacacuga

SEQ ID NO: 1637506 - RNA, 21 nt, Homo sapiens
agccugaauuggcuaugcagu

SEQ ID NO: 1637507 - RNA, 20 nt, Homo sapiens
agccugaugcugacauucac

SEQ ID NO: 1637508 - RNA, 20 nt, Homo sapiens
agccugcucuagugggacag

SEQ ID NO: 1637509 - RNA, 16 nt, Homo sapiens
agccuggccuccugcc

SEQ ID NO: 1637510 - RNA, 23 nt, Homo sapiens
agccuguucauggcagauguagg

SEQ ID NO: 1637511 - RNA, 13 nt, Homo sapiens
agcgaacaucuuc

SEQ ID NO: 1637512 - RNA, 18 nt, Homo sapiens
agcgauucuccugccuca

SEQ ID NO: 1637513 - RNA, 13 nt, Homo sapiens
agcgcacagggag

SEQ ID NO: 1637514 - RNA, 21 nt, Homo sapiens
agcggaaacuucucgagcucc

SEQ ID NO: 1637515 - RNA, 14 nt, Homo sapiens
agcggacaguggca

SEQ ID NO: 1637516 - RNA, 19 nt, Homo sapiens
agcuaauuuauagcaagau

SEQ ID NO: 1637517 - RNA, 20 nt, Homo sapiens
agcuacuauguacugccuua

SEQ ID NO: 1637518 - RNA, 13 nt, Homo sapiens
agcuacuuggcag

SEQ ID NO: 1637519 - RNA, 16 nt, Homo sapiens
agcuagaaaacauuuu

SEQ ID NO: 1637520 - RNA, 19 nt, Homo sapiens
agcuauaacuuacuucugu

SEQ ID NO: 1637521 - RNA, 18 nt, Homo sapiens
agcuauacuuacacugua

SEQ ID NO: 1637522 - RNA, 13 nt, Homo sapiens
agcuaucaccuag

SEQ ID NO: 1637523 - RNA, 19 nt, Homo sapiens
agcuaucuuagguggagcu

SEQ ID NO: 1637524 - RNA, 16 nt, Homo sapiens
agcuauuuaucuguag

SEQ ID NO: 1637525 - RNA, 22 nt, Homo sapiens
agcucaaucugcaaacaugcca

SEQ ID NO: 1637526 - RNA, 16 nt, Homo sapiens
agcucagccagugggg

SEQ ID NO: 1637527 - RNA, 16 nt, Homo sapiens
agcucaucugcaaaag

SEQ ID NO: 1637528 - RNA, 16 nt, Homo sapiens
agcucccgggcacauc

SEQ ID NO: 1637529 - RNA, 15 nt, Homo sapiens
agcuccggccugucc

SEQ ID NO: 1637530 - RNA, 17 nt, Homo sapiens
agcucugccccuucccc

SEQ ID NO: 1637531 - RNA, 21 nt, Homo sapiens
agcucugguguaguuucugca

SEQ ID NO: 1637532 - RNA, 15 nt, Homo sapiens
agcugaagcuggugc

SEQ ID NO: 1637533 - RNA, 14 nt, Homo sapiens
agcugacaucucag

SEQ ID NO: 1637534 - RNA, 22 nt, Homo sapiens
agcugagacuacaagugugugc

SEQ ID NO: 1637535 - RNA, 24 nt, Homo sapiens
agcugccuaggauguucugggcua

SEQ ID NO: 1637536 - RNA, 17 nt, Homo sapiens
agcuggaaaagggucuu

SEQ ID NO: 1637537 - RNA, 13 nt, Homo sapiens
agcuggagggacc

SEQ ID NO: 1637538 - RNA, 19 nt, Homo sapiens
agcuggagggaccuugucu

SEQ ID NO: 1637539 - RNA, 20 nt, Homo sapiens
agcuggagggaccuugucuc

SEQ ID NO: 1637540 - RNA, 15 nt, Homo sapiens
agcuggauucacuug

SEQ ID NO: 1637541 - RNA, 23 nt, Homo sapiens
agcuguccugcagcaaacacucc

SEQ ID NO: 1637542 - RNA, 20 nt, Homo sapiens
agcugugaccugcugagcuc

SEQ ID NO: 1637543 - RNA, 15 nt, Homo sapiens
agcugugcaggcaug

SEQ ID NO: 1637544 - RNA, 20 nt, Homo sapiens
agcuguguccugcaguuccc

SEQ ID NO: 1637545 - RNA, 18 nt, Homo sapiens
agcuguuauuuuuaggca

SEQ ID NO: 1637546 - RNA, 19 nt, Homo sapiens
agcuguuuggccaaugugc

SEQ ID NO: 1637547 - RNA, 14 nt, Homo sapiens
agcuguuuuaguca

SEQ ID NO: 1637548 - RNA, 15 nt, Homo sapiens
agcuuaagaaccauu

SEQ ID NO: 1637549 - RNA, 20 nt, Homo sapiens
agcuucauuuuacuaaaaag

SEQ ID NO: 1637550 - RNA, 20 nt, Homo sapiens
agcuuccuuaaguauaucau

SEQ ID NO: 1637551 - RNA, 14 nt, Homo sapiens
agcuugucaaagau

SEQ ID NO: 1637552 - RNA, 14 nt, Homo sapiens
agcuuuagcuucau

SEQ ID NO: 1637553 - RNA, 12 nt, Homo sapiens
agcuuugucaua

SEQ ID NO: 1637554 - RNA, 14 nt, Homo sapiens
agcuuuucuugaua

SEQ ID NO: 1637555 - RNA, 21 nt, Homo sapiens
aggaaagagagaccccaguca

SEQ ID NO: 1637556 - RNA, 17 nt, Homo sapiens
aggaacaaauaaacuca

SEQ ID NO: 1637557 - RNA, 20 nt, Homo sapiens
aggaacaguugcauuuagcu

SEQ ID NO: 1637558 - RNA, 18 nt, Homo sapiens
aggaaccaaauuuaagac

SEQ ID NO: 1637559 - RNA, 15 nt, Homo sapiens
aggaacuucuagcuc

SEQ ID NO: 1637560 - RNA, 14 nt, Homo sapiens
aggaagauaugcca

SEQ ID NO: 1637561 - RNA, 18 nt, Homo sapiens
aggaagcauaaagcaauu

SEQ ID NO: 1637562 - RNA, 19 nt, Homo sapiens
aggaagggagaauugagaa

SEQ ID NO: 1637563 - RNA, 20 nt, Homo sapiens
aggaauagaagcaaauuaaa

SEQ ID NO: 1637564 - RNA, 22 nt, Homo sapiens
aggacaccugccuucaaagcca

SEQ ID NO: 1637565 - RNA, 17 nt, Homo sapiens
aggacgccgcuggugcu

SEQ ID NO: 1637566 - RNA, 13 nt, Homo sapiens
aggacucuuccac

SEQ ID NO: 1637567 - RNA, 13 nt, Homo sapiens
aggacuguagaaa

SEQ ID NO: 1637568 - RNA, 15 nt, Homo sapiens
aggagagagccagga

SEQ ID NO: 1637569 - RNA, 22 nt, Homo sapiens
aggagcccgaagucugcugcug

SEQ ID NO: 1637570 - RNA, 23 nt, Homo sapiens
aggaggaaggagccuauggcauc

SEQ ID NO: 1637571 - RNA, 23 nt, Homo sapiens
aggagguccuuaggccucugaga

SEQ ID NO: 1637572 - RNA, 14 nt, Homo sapiens
aggaggugaaagaa

SEQ ID NO: 1637573 - RNA, 17 nt, Homo sapiens
aggaguguccugcccau

SEQ ID NO: 1637574 - RNA, 22 nt, Homo sapiens
aggaucccuacugccaaccugg

SEQ ID NO: 1637575 - RNA, 21 nt, Homo sapiens
aggaugucccugggccagggu

SEQ ID NO: 1637576 - RNA, 18 nt, Homo sapiens
aggcaagauaaaccaaug

SEQ ID NO: 1637577 - RNA, 15 nt, Homo sapiens
aggcacagcuaacca

SEQ ID NO: 1637578 - RNA, 15 nt, Homo sapiens
aggcagcucauccaa

SEQ ID NO: 1637579 - RNA, 22 nt, Homo sapiens
aggcagugacagcagucaggga

SEQ ID NO: 1637580 - RNA, 21 nt, Homo sapiens
aggcauguagcuacaggacau

SEQ ID NO: 1637581 - RNA, 17 nt, Homo sapiens
aggccacggaccaaugg

SEQ ID NO: 1637582 - RNA, 11 nt, Homo sapiens
aggccacugcc

SEQ ID NO: 1637583 - RNA, 15 nt, Homo sapiens
aggccauacuuguga

SEQ ID NO: 1637584 - RNA, 9 nt, Homo sapiens
aggcccaag

SEQ ID NO: 1637585 - RNA, 14 nt, Homo sapiens
aggccccaugaccu

SEQ ID NO: 1637586 - RNA, 18 nt, Homo sapiens
aggccccugucucagggu

SEQ ID NO: 1637587 - RNA, 17 nt, Homo sapiens
aggcccgagcagcugag

SEQ ID NO: 1637588 - RNA, 15 nt, Homo sapiens
aggcccuacuaccca

SEQ ID NO: 1637589 - RNA, 20 nt, Homo sapiens
aggccguugauucacuucac

SEQ ID NO: 1637590 - RNA, 15 nt, Homo sapiens
aggccuagacucugu

SEQ ID NO: 1637591 - RNA, 23 nt, Homo sapiens
aggccuagacucugucuaccugg

SEQ ID NO: 1637592 - RNA, 15 nt, Homo sapiens
aggccucugccccaa

SEQ ID NO: 1637593 - RNA, 15 nt, Homo sapiens
aggccuguguagcug

SEQ ID NO: 1637594 - RNA, 17 nt, Homo sapiens
aggccuguguagcugug

SEQ ID NO: 1637595 - RNA, 15 nt, Homo sapiens
aggcgccugccacaa

SEQ ID NO: 1637596 - RNA, 19 nt, Homo sapiens
aggcgggcgcacugccucu

SEQ ID NO: 1637597 - RNA, 21 nt, Homo sapiens
aggcuauguaaacaaaccaca

SEQ ID NO: 1637598 - RNA, 19 nt, Homo sapiens
aggcugaccacagcacagc

SEQ ID NO: 1637599 - RNA, 18 nt, Homo sapiens
aggcugaucccugagauc

SEQ ID NO: 1637600 - RNA, 17 nt, Homo sapiens
aggcugcugcacaccaa

SEQ ID NO: 1637601 - RNA, 14 nt, Homo sapiens
aggcuggcagauuu

SEQ ID NO: 1637602 - RNA, 21 nt, Homo sapiens
aggcuggcagauuuccaaaag

SEQ ID NO: 1637603 - RNA, 15 nt, Homo sapiens
aggcuguuccuugaa

SEQ ID NO: 1637604 - RNA, 20 nt, Homo sapiens
aggcuuucugggcucuggac

SEQ ID NO: 1637605 - RNA, 12 nt, Homo sapiens
agggaaaacugc

SEQ ID NO: 1637606 - RNA, 13 nt, Homo sapiens
agggaaaacugca

SEQ ID NO: 1637607 - RNA, 20 nt, Homo sapiens
agggaaauguacacuuuuua

SEQ ID NO: 1637608 - RNA, 19 nt, Homo sapiens
agggaacugaacauuccag

SEQ ID NO: 1637609 - RNA, 14 nt, Homo sapiens
agggaaugacuugg

SEQ ID NO: 1637610 - RNA, 15 nt, Homo sapiens
agugggacuguggug

SEQ ID NO: 1637611 - RNA, 23 nt, Homo sapiens
aguguaaaaaaugucucauguca

SEQ ID NO: 1637612 - RNA, 18 nt, Homo sapiens
aguguucacaacagugaa

SEQ ID NO: 1637613 - RNA, 18 nt, Homo sapiens
aguguuguggacacugca

SEQ ID NO: 1637614 - RNA, 15 nt, Homo sapiens
aguguuuuuuauuca

SEQ ID NO: 1637615 - RNA, 22 nt, Homo sapiens
aguuaaaaauaaaaaacauaua

SEQ ID NO: 1637616 - RNA, 21 nt, Homo sapiens
aguuaaggggagcaacagagg

SEQ ID NO: 1637617 - RNA, 20 nt, Homo sapiens
aguuacuuuuuuacacugau

SEQ ID NO: 1637618 - RNA, 17 nt, Homo sapiens
aguuagaacuagccaaa

SEQ ID NO: 1637619 - RNA, 17 nt, Homo sapiens
aguuagaggagaaaaag

SEQ ID NO: 1637620 - RNA, 15 nt, Homo sapiens
aguuagaucuacccu

SEQ ID NO: 1637621 - RNA, 17 nt, Homo sapiens
aguuaguaucuuuauua

SEQ ID NO: 1637622 - RNA, 15 nt, Homo sapiens
aguuauaaaguccuu

SEQ ID NO: 1637623 - RNA, 14 nt, Homo sapiens
aguuaucagggaac

SEQ ID NO: 1637624 - RNA, 12 nt, Homo sapiens
aguuaugugauu

SEQ ID NO: 1637625 - RNA, 20 nt, Homo sapiens
aguuauuacauguaauuuga

SEQ ID NO: 1637626 - RNA, 22 nt, Homo sapiens
aguucucuacucccucuuguca

SEQ ID NO: 1637627 - RNA, 15 nt, Homo sapiens
aguucugcuugcucc

SEQ ID NO: 1637628 - RNA, 20 nt, Homo sapiens
aguucuguguggugcauucc

SEQ ID NO: 1637629 - RNA, 19 nt, Homo sapiens
aguugaagcucuucauuca

SEQ ID NO: 1637630 - RNA, 22 nt, Homo sapiens
aguugcagaccaucgcacacca

SEQ ID NO: 1637631 - RNA, 14 nt, Homo sapiens
aguugcauuuagcu

SEQ ID NO: 1637632 - RNA, 18 nt, Homo sapiens
aguugccaacuauucuca

SEQ ID NO: 1637633 - RNA, 20 nt, Homo sapiens
aguugcucuuucgguagugg

SEQ ID NO: 1637634 - RNA, 23 nt, Homo sapiens
aguugcugugaacuuucauguca

SEQ ID NO: 1637635 - RNA, 12 nt, Homo sapiens
aguugugaaaga

SEQ ID NO: 1637636 - RNA, 19 nt, Homo sapiens
aguuuccuaggaugucaug

SEQ ID NO: 1637637 - RNA, 19 nt, Homo sapiens
aguuucuaucccuuaccug

SEQ ID NO: 1637638 - RNA, 22 nt, Homo sapiens
aguuucuaucccuuaccugcuu

SEQ ID NO: 1637639 - RNA, 19 nt, Homo sapiens
aguuucugcauuucaagaa

SEQ ID NO: 1637640 - RNA, 14 nt, Homo sapiens
aguuucuuuucaca

SEQ ID NO: 1637641 - RNA, 15 nt, Homo sapiens
aguuugcacaacaag

SEQ ID NO: 1637642 - RNA, 18 nt, Homo sapiens
aguuuugcucucugucag

SEQ ID NO: 1637643 - RNA, 17 nt, Homo sapiens
auaaaaaaagacaaauu

SEQ ID NO: 1637644 - RNA, 13 nt, Homo sapiens
auaaaaugaacau

SEQ ID NO: 1637645 - RNA, 13 nt, Homo sapiens
auaaaauguugaa

SEQ ID NO: 1637646 - RNA, 16 nt, Homo sapiens
auaaacauguauaaaa

SEQ ID NO: 1637647 - RNA, 15 nt, Homo sapiens
auaaaccaguugaau

SEQ ID NO: 1637648 - RNA, 18 nt, Homo sapiens
auaaaccaguugaaucau

SEQ ID NO: 1637649 - RNA, 15 nt, Homo sapiens
auaaagccacuucug

SEQ ID NO: 1637650 - RNA, 11 nt, Homo sapiens
auaaagccaug

SEQ ID NO: 1637651 - RNA, 13 nt, Homo sapiens
auaaagcuuuaua

SEQ ID NO: 1637652 - RNA, 21 nt, Homo sapiens
auaaagucuauggacagggcu

SEQ ID NO: 1637653 - RNA, 15 nt, Homo sapiens
auaaaguuguugcau

SEQ ID NO: 1637654 - RNA, 19 nt, Homo sapiens
auaaaguuguugcauuccc

SEQ ID NO: 1637655 - RNA, 14 nt, Homo sapiens
auaaauaugcucag

SEQ ID NO: 1637656 - RNA, 15 nt, Homo sapiens
auaaauauucuagca

SEQ ID NO: 1637657 - RNA, 13 nt, Homo sapiens
auaaauuuaucag

SEQ ID NO: 1637658 - RNA, 12 nt, Homo sapiens
auaacacugucu

SEQ ID NO: 1637659 - RNA, 22 nt, Homo sapiens
auaacauuuaaauuccacagau

SEQ ID NO: 1637660 - RNA, 20 nt, Homo sapiens
auaacuggguuggcucucaa

SEQ ID NO: 1637661 - RNA, 16 nt, Homo sapiens
auaacuuuacagaaau

SEQ ID NO: 1637662 - RNA, 17 nt, Homo sapiens
auaagaagcauuuugca

SEQ ID NO: 1637663 - RNA, 19 nt, Homo sapiens
auaagcagaacauacuguu

SEQ ID NO: 1637664 - RNA, 14 nt, Homo sapiens
auaagcaugguguc

SEQ ID NO: 1637665 - RNA, 23 nt, Homo sapiens
auaagcuuccuagaaaguucugu

SEQ ID NO: 1637666 - RNA, 16 nt, Homo sapiens
auaagucaguguuaaa

SEQ ID NO: 1637667 - RNA, 14 nt, Homo sapiens
auaauaaacauaau

SEQ ID NO: 1637668 - RNA, 18 nt, Homo sapiens
auaauuccuacagcacua

SEQ ID NO: 1637669 - RNA, 21 nt, Homo sapiens
auaauuuaaaauccauuuuag

SEQ ID NO: 1637670 - RNA, 21 nt, Homo sapiens
auacaaacauguuccugggau

SEQ ID NO: 1637671 - RNA, 12 nt, Homo sapiens
auacaaucagcc

SEQ ID NO: 1637672 - RNA, 16 nt, Homo sapiens
auacaaucagcccagu

SEQ ID NO: 1637673 - RNA, 18 nt, Homo sapiens
auacaaucagcccagugc

SEQ ID NO: 1637674 - RNA, 14 nt, Homo sapiens
auacagacaucuaa

SEQ ID NO: 1637675 - RNA, 12 nt, Homo sapiens
auacaugcucuu

SEQ ID NO: 1637676 - RNA, 22 nt, Homo sapiens
auaccaauuacauggaacuuuu

SEQ ID NO: 1637677 - RNA, 16 nt, Homo sapiens
auaccaguacuugagg

SEQ ID NO: 1637678 - RNA, 14 nt, Homo sapiens
auacccaugaacuu

SEQ ID NO: 1637679 - RNA, 16 nt, Homo sapiens
auacccaugcuuuguu

SEQ ID NO: 1637680 - RNA, 16 nt, Homo sapiens
auaccugggauacugu

SEQ ID NO: 1637681 - RNA, 19 nt, Homo sapiens
auacuaauagaguacuuaa

SEQ ID NO: 1637682 - RNA, 13 nt, Homo sapiens
auacuccauauuc

SEQ ID NO: 1637683 - RNA, 17 nt, Homo sapiens
auacucuguugccuccu

SEQ ID NO: 1637684 - RNA, 16 nt, Homo sapiens
auacugcugcuuguca

SEQ ID NO: 1637685 - RNA, 20 nt, Homo sapiens
auacuucuuuuucauuauug

SEQ ID NO: 1637686 - RNA, 16 nt, Homo sapiens
auacuugaccuugcau

SEQ ID NO: 1637687 - RNA, 15 nt, Homo sapiens
auagaaaacuugaca

SEQ ID NO: 1637688 - RNA, 22 nt, Homo sapiens
auagaaaacuugacauguagcu

SEQ ID NO: 1637689 - RNA, 13 nt, Homo sapiens
auagacauucuca

SEQ ID NO: 1637690 - RNA, 24 nt, Homo sapiens
auagacugauugauuauucaacac

SEQ ID NO: 1637691 - RNA, 17 nt, Homo sapiens
auagaugauacauguca

SEQ ID NO: 1637692 - RNA, 19 nt, Homo sapiens
auagauguugcucuuucac

SEQ ID NO: 1637693 - RNA, 21 nt, Homo sapiens
auagcaaaugcagaaccacaa

SEQ ID NO: 1637694 - RNA, 14 nt, Homo sapiens
auagccacuauuaa

SEQ ID NO: 1637695 - RNA, 18 nt, Homo sapiens
auagcccucagacauuua

SEQ ID NO: 1637696 - RNA, 16 nt, Homo sapiens
auaggaagauaugcca

SEQ ID NO: 1637697 - RNA, 23 nt, Homo sapiens
auaggccuaguacaaucuuggga

SEQ ID NO: 1637698 - RNA, 20 nt, Homo sapiens
auagggucggaggugcuguc

SEQ ID NO: 1637699 - RNA, 23 nt, Homo sapiens
auagucacauggccuaugcacau

SEQ ID NO: 1637700 - RNA, 22 nt, Homo sapiens
auagucccauuuuucucuugcc

SEQ ID NO: 1637701 - RNA, 18 nt, Homo sapiens
auagucuuugccagucau

SEQ ID NO: 1637702 - RNA, 13 nt, Homo sapiens
auaguugucugug

SEQ ID NO: 1637703 - RNA, 17 nt, Homo sapiens
auaguuuguuauauccu

SEQ ID NO: 1637704 - RNA, 22 nt, Homo sapiens
auauacauagucuuuguuuaca

SEQ ID NO: 1637705 - RNA, 16 nt, Homo sapiens
auauagacauucucac

SEQ ID NO: 1637706 - RNA, 22 nt, Homo sapiens
auauagagggcuuaugauucag

SEQ ID NO: 1637707 - RNA, 18 nt, Homo sapiens
auauccuagacuagacau

SEQ ID NO: 1637708 - RNA, 21 nt, Homo sapiens
auaucuuagguaagacauaua

SEQ ID NO: 1637709 - RNA, 17 nt, Homo sapiens
auaugacagauaaccua

SEQ ID NO: 1637710 - RNA, 17 nt, Homo sapiens
auaugauuguuucucaa

SEQ ID NO: 1637711 - RNA, 19 nt, Homo sapiens
auaugccaagcuaauuuau

SEQ ID NO: 1637712 - RNA, 17 nt, Homo sapiens
auauggacucugcacau

SEQ ID NO: 1637713 - RNA, 21 nt, Homo sapiens
auauggacucugcacaugaau

SEQ ID NO: 1637714 - RNA, 18 nt, Homo sapiens
auauggggaaaaaacugu

SEQ ID NO: 1637715 - RNA, 22 nt, Homo sapiens
auauguccacuguucuguucuc

SEQ ID NO: 1637716 - RNA, 14 nt, Homo sapiens
auauuaaguccaaa

SEQ ID NO: 1637717 - RNA, 19 nt, Homo sapiens
auauuaaguccaaauccaa

SEQ ID NO: 1637718 - RNA, 15 nt, Homo sapiens
auauucaacucauaa

SEQ ID NO: 1637719 - RNA, 16 nt, Homo sapiens
auauucuucauauccu

SEQ ID NO: 1637720 - RNA, 15 nt, Homo sapiens
auucuuuugccacau

SEQ ID NO: 1637721 - RNA, 12 nt, Homo sapiens
auugaacuguac

SEQ ID NO: 1637722 - RNA, 15 nt, Homo sapiens
auugacuccuuucca

SEQ ID NO: 1637723 - RNA, 16 nt, Homo sapiens
auugauauugaaggaa

SEQ ID NO: 1637724 - RNA, 15 nt, Homo sapiens
auugaugagcaagac

SEQ ID NO: 1637725 - RNA, 19 nt, Homo sapiens
auugauuuuuaaaguuuaa

SEQ ID NO: 1637726 - RNA, 13 nt, Homo sapiens
auugcacuuuccu

SEQ ID NO: 1637727 - RNA, 18 nt, Homo sapiens
auugcacuuuccuuucaa

SEQ ID NO: 1637728 - RNA, 16 nt, Homo sapiens
auugcgugauucaaug

SEQ ID NO: 1637729 - RNA, 14 nt, Homo sapiens
auugcugcaaagau

SEQ ID NO: 1637730 - RNA, 14 nt, Homo sapiens
auugcugugaaauu

SEQ ID NO: 1637731 - RNA, 22 nt, Homo sapiens
auugcuucuucuucaagauuua

SEQ ID NO: 1637732 - RNA, 18 nt, Homo sapiens
auuguacaaguauuacaa

SEQ ID NO: 1637733 - RNA, 17 nt, Homo sapiens
auugugcaguacuuugu

SEQ ID NO: 1637734 - RNA, 20 nt, Homo sapiens
auuguuauacacagcuuuau

SEQ ID NO: 1637735 - RNA, 20 nt, Homo sapiens
auuguuccaguacuauggag

SEQ ID NO: 1637736 - RNA, 13 nt, Homo sapiens
auuuaaauuccac

SEQ ID NO: 1637737 - RNA, 15 nt, Homo sapiens
auuuaaauuccacag

SEQ ID NO: 1637738 - RNA, 22 nt, Homo sapiens
auuuaacacccuuuagaaccuu

SEQ ID NO: 1637739 - RNA, 18 nt, Homo sapiens
auuuaauuacuacuaggu

SEQ ID NO: 1637740 - RNA, 13 nt, Homo sapiens
auuuaauucuuaa

SEQ ID NO: 1637741 - RNA, 21 nt, Homo sapiens
auuuacccaacucuguacaaa

SEQ ID NO: 1637742 - RNA, 20 nt, Homo sapiens
auuuagaguucuagaccucu

SEQ ID NO: 1637743 - RNA, 18 nt, Homo sapiens
auuuagauauaacacuau

SEQ ID NO: 1637744 - RNA, 13 nt, Homo sapiens
auuuagcuguaaa

SEQ ID NO: 1637745 - RNA, 20 nt, Homo sapiens
auuuauaaaauaaaaaggaa

SEQ ID NO: 1637746 - RNA, 22 nt, Homo sapiens
auuuauugugaaucgauuccca

SEQ ID NO: 1637747 - RNA, 23 nt, Homo sapiens
auuuauugugaaucgauucccaa

SEQ ID NO: 1637748 - RNA, 15 nt, Homo sapiens
auuuauuuucaauua

SEQ ID NO: 1637749 - RNA, 16 nt, Homo sapiens
auuuauuuucaauuaa

SEQ ID NO: 1637750 - RNA, 13 nt, Homo sapiens
auuucaagcucau

SEQ ID NO: 1637751 - RNA, 14 nt, Homo sapiens
auuucacugaagau

SEQ ID NO: 1637752 - RNA, 18 nt, Homo sapiens
auuucauuccauugccua

SEQ ID NO: 1637753 - RNA, 15 nt, Homo sapiens
auuucauuucagcca

SEQ ID NO: 1637754 - RNA, 21 nt, Homo sapiens
auuuccacuauuuucaaagaa

SEQ ID NO: 1637755 - RNA, 16 nt, Homo sapiens
auuucucuacuuguca

SEQ ID NO: 1637756 - RNA, 17 nt, Homo sapiens
auuucucuacuugucau

SEQ ID NO: 1637757 - RNA, 22 nt, Homo sapiens
auuucucugugaauccaugggu

SEQ ID NO: 1637758 - RNA, 17 nt, Homo sapiens
auuucugggcacuuuuu

SEQ ID NO: 1637759 - RNA, 13 nt, Homo sapiens
auuugaaaacaua

SEQ ID NO: 1637760 - RNA, 20 nt, Homo sapiens
auuugaugggccacaacugu

SEQ ID NO: 1637761 - RNA, 23 nt, Homo sapiens
auuugcauuugcucuuucaucuc

SEQ ID NO: 1637762 - RNA, 18 nt, Homo sapiens
auuugcucuuucaucucu

SEQ ID NO: 1637763 - RNA, 20 nt, Homo sapiens
auuuggaggaaucaccccau

SEQ ID NO: 1637764 - RNA, 17 nt, Homo sapiens
auuuggcaaaacagccc

SEQ ID NO: 1637765 - RNA, 20 nt, Homo sapiens
auuugggagggaaaagggaa

SEQ ID NO: 1637766 - RNA, 20 nt, Homo sapiens
auuugugcuagaaauuuuca

SEQ ID NO: 1637767 - RNA, 20 nt, Homo sapiens
auuugugguccacugagcua

SEQ ID NO: 1637768 - RNA, 15 nt, Homo sapiens
auuuuaaacuacuga

SEQ ID NO: 1637769 - RNA, 15 nt, Homo sapiens
auuuuaaagacaaaa

SEQ ID NO: 1637770 - RNA, 18 nt, Homo sapiens
auuuuaaaucauuaggaa

SEQ ID NO: 1637771 - RNA, 14 nt, Homo sapiens
auuuuaacucuguc

SEQ ID NO: 1637772 - RNA, 14 nt, Homo sapiens
auuuuacuuaacuc

SEQ ID NO: 1637773 - RNA, 20 nt, Homo sapiens
auuuuaucuugguaguacau

SEQ ID NO: 1637774 - RNA, 17 nt, Homo sapiens
auuuucaauuaauauua

SEQ ID NO: 1637775 - RNA, 16 nt, Homo sapiens
auuuucaguaccaaag

SEQ ID NO: 1637776 - RNA, 17 nt, Homo sapiens
auuuugguuuguguauc

SEQ ID NO: 1637777 - RNA, 19 nt, Homo sapiens
auuuuguuuuaauccuuaa

SEQ ID NO: 1637778 - RNA, 20 nt, Homo sapiens
auuuuucuuagugugccaag

SEQ ID NO: 1637779 - RNA, 15 nt, Homo sapiens
auuuuuuuaaacaua

SEQ ID NO: 1637780 - RNA, 23 nt, Homo sapiens
caaaaaauguaauuaacuguaaa

SEQ ID NO: 1637781 - RNA, 14 nt, Homo sapiens
caaaaacuacacau

SEQ ID NO: 1637782 - RNA, 15 nt, Homo sapiens
caaaaagaagacauu

SEQ ID NO: 1637783 - RNA, 16 nt, Homo sapiens
caaaaagaagacauua

SEQ ID NO: 1637784 - RNA, 17 nt, Homo sapiens
caaaacagaaaaugaag

SEQ ID NO: 1637785 - RNA, 15 nt, Homo sapiens
caaaacaguuugaaa

SEQ ID NO: 1637786 - RNA, 21 nt, Homo sapiens
caaaaccaaacuuguucauuu

SEQ ID NO: 1637787 - RNA, 16 nt, Homo sapiens
caaaacugaaccacaa

SEQ ID NO: 1637788 - RNA, 22 nt, Homo sapiens
caaaacuucuugucagacauaa

SEQ ID NO: 1637789 - RNA, 18 nt, Homo sapiens
caaaaggccucuuguaaa

SEQ ID NO: 1637790 - RNA, 20 nt, Homo sapiens
caaaaucaugugacaauaau

SEQ ID NO: 1637791 - RNA, 17 nt, Homo sapiens
caaaaugucuuguguau

SEQ ID NO: 1637792 - RNA, 12 nt, Homo sapiens
caaaauguguaa

SEQ ID NO: 1637793 - RNA, 15 nt, Homo sapiens
caaacacccaugccc

SEQ ID NO: 1637794 - RNA, 17 nt, Homo sapiens
caaacagaacaggguca

SEQ ID NO: 1637795 - RNA, 21 nt, Homo sapiens
caaacagauguuuguuuucaa

SEQ ID NO: 1637796 - RNA, 14 nt, Homo sapiens
caaacaucacaaaa

SEQ ID NO: 1637797 - RNA, 18 nt, Homo sapiens
caaacaugaauccuguga

SEQ ID NO: 1637798 - RNA, 20 nt, Homo sapiens
caaacauguuccugggauca

SEQ ID NO: 1637799 - RNA, 22 nt, Homo sapiens
caaaccacuucuccaugcugca

SEQ ID NO: 1637800 - RNA, 12 nt, Homo sapiens
caaacgcuuauu

SEQ ID NO: 1637801 - RNA, 15 nt, Homo sapiens
caaacuccugaccuc

SEQ ID NO: 1637802 - RNA, 22 nt, Homo sapiens
caaacugcugucccaaacaugc

SEQ ID NO: 1637803 - RNA, 17 nt, Homo sapiens
caaacuugauugugcau

SEQ ID NO: 1637804 - RNA, 20 nt, Homo sapiens
caaagaacuccagagucagu

SEQ ID NO: 1637805 - RNA, 18 nt, Homo sapiens
caaagaagguuaccaaga

SEQ ID NO: 1637806 - RNA, 14 nt, Homo sapiens
caaagaugacuggu

SEQ ID NO: 1637807 - RNA, 21 nt, Homo sapiens
caaagauuuuuggcacuuugu

SEQ ID NO: 1637808 - RNA, 14 nt, Homo sapiens
caaagcauuugcaa

SEQ ID NO: 1637809 - RNA, 18 nt, Homo sapiens
caaagccacugacugaga

SEQ ID NO: 1637810 - RNA, 22 nt, Homo sapiens
caaagccagugcugucugggau

SEQ ID NO: 1637811 - RNA, 21 nt, Homo sapiens
caaagcccuuguccccaugaa

SEQ ID NO: 1637812 - RNA, 22 nt, Homo sapiens
caaagcggucccugucccucua

SEQ ID NO: 1637813 - RNA, 16 nt, Homo sapiens
caaagcuuaugugaca

SEQ ID NO: 1637814 - RNA, 21 nt, Homo sapiens
caaaggaaccgcccagugcag

SEQ ID NO: 1637815 - RNA, 20 nt, Homo sapiens
caaaggaaguccaaccugag

SEQ ID NO: 1637816 - RNA, 23 nt, Homo sapiens
caaaggcugcagcauugccauac

SEQ ID NO: 1637817 - RNA, 14 nt, Homo sapiens
caaaguacucuuua

SEQ ID NO: 1637818 - RNA, 19 nt, Homo sapiens
caaagugcuggaauuacag

SEQ ID NO: 1637819 - RNA, 18 nt, Homo sapiens
caaagugucucauucuca

SEQ ID NO: 1637820 - RNA, 23 nt, Homo sapiens
caaaguugcucaccgacucaccu

SEQ ID NO: 1637821 - RNA, 17 nt, Homo sapiens
caaauaaguaauaucuu

SEQ ID NO: 1637822 - RNA, 18 nt, Homo sapiens
caaauacaaucagcccag

SEQ ID NO: 1637823 - RNA, 21 nt, Homo sapiens
caaaucacgcaucucuacucc

SEQ ID NO: 1637824 - RNA, 22 nt, Homo sapiens
caaauccuucaaaauaaaaagu

SEQ ID NO: 1637825 - RNA, 18 nt, Homo sapiens
caaaucguuuauuucaca

SEQ ID NO: 1637826 - RNA, 19 nt, Homo sapiens
caaaucuaccacuguauga

SEQ ID NO: 1637827 - RNA, 21 nt, Homo sapiens
caaaucuaguuuccuauggaa

SEQ ID NO: 1637828 - RNA, 14 nt, Homo sapiens
caaaugccauccag

SEQ ID NO: 1637829 - RNA, 13 nt, Homo sapiens
ggaguaaucugug

SEQ ID NO: 1637830 - RNA, 17 nt, Homo sapiens
ggaguaaucuguguaca

SEQ ID NO: 1637831 - RNA, 12 nt, Homo sapiens
ggagugcaaugg

SEQ ID NO: 1637832 - RNA, 22 nt, Homo sapiens
ggagugcaguggcgugaucucg

SEQ ID NO: 1637833 - RNA, 23 nt, Homo sapiens
ggauacagucuucuuacuuggaa

SEQ ID NO: 1637834 - RNA, 14 nt, Homo sapiens
ggauacugcugcgu

SEQ ID NO: 1637835 - RNA, 21 nt, Homo sapiens
ggauauccuuaucagagcuaa

SEQ ID NO: 1637836 - RNA, 11 nt, Homo sapiens
ggaucagagau

SEQ ID NO: 1637837 - RNA, 13 nt, Homo sapiens
ggauccagccacu

SEQ ID NO: 1637838 - RNA, 16 nt, Homo sapiens
ggaugagagggugcua

SEQ ID NO: 1637839 - RNA, 18 nt, Homo sapiens
ggaugguuuuaucuuccc

SEQ ID NO: 1637840 - RNA, 22 nt, Homo sapiens
ggaugguuuuaucuucccuuua

SEQ ID NO: 1637841 - RNA, 14 nt, Homo sapiens
ggauguaagccugg

SEQ ID NO: 1637842 - RNA, 22 nt, Homo sapiens
ggaugucaugucugcuugucaa

SEQ ID NO: 1637843 - RNA, 13 nt, Homo sapiens
ggauuaaaccuuu

SEQ ID NO: 1637844 - RNA, 17 nt, Homo sapiens
ggcaaaauaaagugaca

SEQ ID NO: 1637845 - RNA, 20 nt, Homo sapiens
ggcaacaggucauguucaau

SEQ ID NO: 1637846 - RNA, 12 nt, Homo sapiens
ggcaacaucaac

SEQ ID NO: 1637847 - RNA, 17 nt, Homo sapiens
ggcaagagaauugaaau

SEQ ID NO: 1637848 - RNA, 22 nt, Homo sapiens
ggcaagagaauugaaaugaggu

SEQ ID NO: 1637849 - RNA, 20 nt, Homo sapiens
ggcaagcccugcccacagaa

SEQ ID NO: 1637850 - RNA, 18 nt, Homo sapiens
ggcaauccagacagcagg

SEQ ID NO: 1637851 - RNA, 14 nt, Homo sapiens
ggcacaagugucag

SEQ ID NO: 1637852 - RNA, 11 nt, Homo sapiens
ggcacauuccc

SEQ ID NO: 1637853 - RNA, 20 nt, Homo sapiens
ggcacugugauacaguuuug

SEQ ID NO: 1637854 - RNA, 19 nt, Homo sapiens
ggcagaguucuauaaugua

SEQ ID NO: 1637855 - RNA, 17 nt, Homo sapiens
ggcagauuuucaugcaa

SEQ ID NO: 1637856 - RNA, 20 nt, Homo sapiens
ggcagauuuucaugcaaaag

SEQ ID NO: 1637857 - RNA, 16 nt, Homo sapiens
ggcagccacaacugca

SEQ ID NO: 1637858 - RNA, 22 nt, Homo sapiens
ggcagccacacuucucaggaca

SEQ ID NO: 1637859 - RNA, 14 nt, Homo sapiens
ggcagcgccaagug

SEQ ID NO: 1637860 - RNA, 21 nt, Homo sapiens
ggcagcugucucaaaccucca

SEQ ID NO: 1637861 - RNA, 14 nt, Homo sapiens
ggcagggugcagua

SEQ ID NO: 1637862 - RNA, 21 nt, Homo sapiens
ggcauccgugaggcagggaca

SEQ ID NO: 1637863 - RNA, 23 nt, Homo sapiens
ggcauguuuugcccaccagauca

SEQ ID NO: 1637864 - RNA, 15 nt, Homo sapiens
ggccaaaccucuguu

SEQ ID NO: 1637865 - RNA, 15 nt, Homo sapiens
ggccaagccuaucaa

SEQ ID NO: 1637866 - RNA, 22 nt, Homo sapiens
ggccaagccuaucaaaggaaau

SEQ ID NO: 1637867 - RNA, 18 nt, Homo sapiens
ggccaaugaaauugaaga

SEQ ID NO: 1637868 - RNA, 23 nt, Homo sapiens
ggccacugcugcuucuccauggc

SEQ ID NO: 1637869 - RNA, 20 nt, Homo sapiens
ggccaggcuggucuugaacu

SEQ ID NO: 1637870 - RNA, 20 nt, Homo sapiens
ggccagggucugugugaaug

SEQ ID NO: 1637871 - RNA, 13 nt, Homo sapiens
ggccauggcaauu

SEQ ID NO: 1637872 - RNA, 11 nt, Homo sapiens
ggcccagaccu

SEQ ID NO: 1637873 - RNA, 15 nt, Homo sapiens
ggcccagaccucagg

SEQ ID NO: 1637874 - RNA, 19 nt, Homo sapiens
ggcccaugaacacagagag

SEQ ID NO: 1637875 - RNA, 12 nt, Homo sapiens
ggccccaucucu

SEQ ID NO: 1637876 - RNA, 23 nt, Homo sapiens
ggcccccgucagggagaggucac

SEQ ID NO: 1637877 - RNA, 18 nt, Homo sapiens
ggcccugccguuuccccu

SEQ ID NO: 1637878 - RNA, 23 nt, Homo sapiens
ggccuaaccgagaucaguauuua

SEQ ID NO: 1637879 - RNA, 14 nt, Homo sapiens
ggccuaguacaauc

SEQ ID NO: 1637880 - RNA, 10 nt, Homo sapiens
ggccucagag

SEQ ID NO: 1637881 - RNA, 19 nt, Homo sapiens
ggccuccagcccucucacu

SEQ ID NO: 1637882 - RNA, 22 nt, Homo sapiens
ggccuccuuggcaaugcauuug

SEQ ID NO: 1637883 - RNA, 18 nt, Homo sapiens
ggccucuccaguuugcac

SEQ ID NO: 1637884 - RNA, 18 nt, Homo sapiens
ggccuggcccugcuuucu

SEQ ID NO: 1637885 - RNA, 19 nt, Homo sapiens
ggccuggggugacccggca

SEQ ID NO: 1637886 - RNA, 11 nt, Homo sapiens
ggccuggucug

SEQ ID NO: 1637887 - RNA, 16 nt, Homo sapiens
ggccuuguucugucac

SEQ ID NO: 1637888 - RNA, 14 nt, Homo sapiens
ggccuuuuuugcca

SEQ ID NO: 1637889 - RNA, 15 nt, Homo sapiens
ggccuuuuuugccag

SEQ ID NO: 1637890 - RNA, 21 nt, Homo sapiens
ggcuaacuauauuugcuuuuu

SEQ ID NO: 1637891 - RNA, 16 nt, Homo sapiens
ggcuaauauacuugua

SEQ ID NO: 1637892 - RNA, 13 nt, Homo sapiens
ggcuacucugugc

SEQ ID NO: 1637893 - RNA, 19 nt, Homo sapiens
ggcuaugaggauaauggga

SEQ ID NO: 1637894 - RNA, 20 nt, Homo sapiens
ggcucagugcaaccucugcu

SEQ ID NO: 1637895 - RNA, 17 nt, Homo sapiens
ggcucccagggccauga

SEQ ID NO: 1637896 - RNA, 23 nt, Homo sapiens
ggcucccccuccagccagagaca

SEQ ID NO: 1637897 - RNA, 15 nt, Homo sapiens
ggcuccugaauguga

SEQ ID NO: 1637898 - RNA, 22 nt, Homo sapiens
ggcugacggugcagucugggug

SEQ ID NO: 1637899 - RNA, 14 nt, Homo sapiens
ggcugacucuccag

SEQ ID NO: 1637900 - RNA, 16 nt, Homo sapiens
ggcugaggcuggcaca

SEQ ID NO: 1637901 - RNA, 18 nt, Homo sapiens
ggcugccgcauuccugca

SEQ ID NO: 1637902 - RNA, 22 nt, Homo sapiens
ggcugccgcauuccugcacuca

SEQ ID NO: 1637903 - RNA, 20 nt, Homo sapiens
ggcuggaaaucaauacugca

SEQ ID NO: 1637904 - RNA, 19 nt, Homo sapiens
ggcuggagugcaauggcgc

SEQ ID NO: 1637905 - RNA, 19 nt, Homo sapiens
ggcuggagugcaguggcgu

SEQ ID NO: 1637906 - RNA, 13 nt, Homo sapiens
ggcuggauccuau

SEQ ID NO: 1637907 - RNA, 21 nt, Homo sapiens
ggcuggauucuaucuacauaa

SEQ ID NO: 1637908 - RNA, 12 nt, Homo sapiens
ggcuggcuuccu

SEQ ID NO: 1637909 - RNA, 17 nt, Homo sapiens
ggcuguguuaugaaaau

SEQ ID NO: 1637910 - RNA, 19 nt, Homo sapiens
ggcuuaaguuuuacuugag

SEQ ID NO: 1637911 - RNA, 17 nt, Homo sapiens
ggcuuaauaccugggug

SEQ ID NO: 1637912 - RNA, 18 nt, Homo sapiens
ggcuuccccucugucaaa

SEQ ID NO: 1637913 - RNA, 22 nt, Homo sapiens
ggcuuuaugcaaauacaaucag

SEQ ID NO: 1637914 - RNA, 20 nt, Homo sapiens
gggaaagagagaugggccag

SEQ ID NO: 1637915 - RNA, 13 nt, Homo sapiens
gggaaguccuagc

SEQ ID NO: 1637916 - RNA, 16 nt, Homo sapiens
gggacaaaggagccug

SEQ ID NO: 1637917 - RNA, 21 nt, Homo sapiens
gggaccgggccuggaaagggg

SEQ ID NO: 1637918 - RNA, 21 nt, Homo sapiens
gggagauucaagggacccaug

SEQ ID NO: 1637919 - RNA, 14 nt, Homo sapiens
gggagcugcagggg

SEQ ID NO: 1637920 - RNA, 23 nt, Homo sapiens
gggaggauugcuugaacccaaga

SEQ ID NO: 1637921 - RNA, 20 nt, Homo sapiens
gggagucucucuuccaaguc

SEQ ID NO: 1637922 - RNA, 20 nt, Homo sapiens
gggaugcugggcugggcccu

SEQ ID NO: 1637923 - RNA, 17 nt, Homo sapiens
gggcagggaucuugcaa

SEQ ID NO: 1637924 - RNA, 22 nt, Homo sapiens
gggcaucucccucugauuuccu

SEQ ID NO: 1637925 - RNA, 14 nt, Homo sapiens
gggcccacguguau

SEQ ID NO: 1637926 - RNA, 15 nt, Homo sapiens
gggcccccaucucau

SEQ ID NO: 1637927 - RNA, 22 nt, Homo sapiens
gggcccucuuucccugcgagac

SEQ ID NO: 1637928 - RNA, 20 nt, Homo sapiens
gggccugagagaauuggcuc

SEQ ID NO: 1637929 - RNA, 18 nt, Homo sapiens
gggccuggggccugagag

SEQ ID NO: 1637930 - RNA, 17 nt, Homo sapiens
gggcuccuccagggugu

SEQ ID NO: 1637931 - RNA, 18 nt, Homo sapiens
gggcucuaaugugucucu

SEQ ID NO: 1637932 - RNA, 18 nt, Homo sapiens
gggcucuagggacugcca

SEQ ID NO: 1637933 - RNA, 22 nt, Homo sapiens
gggcucugccccaccuggagaa

SEQ ID NO: 1637934 - RNA, 15 nt, Homo sapiens
gggcuggucaccucc

SEQ ID NO: 1637935 - RNA, 19 nt, Homo sapiens
ggggacauagcugugcuau

SEQ ID NO: 1637936 - RNA, 17 nt, Homo sapiens
ggggacucagggaccgg

SEQ ID NO: 1637937 - RNA, 13 nt, Homo sapiens
ggggccacuuuca

SEQ ID NO: 1637938 - RNA, 18 nt, Homo sapiens
gucccuguuguaacugcc

SEQ ID NO: 1637939 - RNA, 23 nt, Homo sapiens
gucccuguuuauuccaaaugcca

SEQ ID NO: 1637940 - RNA, 15 nt, Homo sapiens
guccucacucuucaa

SEQ ID NO: 1637941 - RNA, 14 nt, Homo sapiens
guccugagcacugc

SEQ ID NO: 1637942 - RNA, 20 nt, Homo sapiens
guccugcagcaaacacucca

SEQ ID NO: 1637943 - RNA, 14 nt, Homo sapiens
guccuggaaauucu

SEQ ID NO: 1637944 - RNA, 17 nt, Homo sapiens
guccuggaaauucugcu

SEQ ID NO: 1637945 - RNA, 12 nt, Homo sapiens
guccuggucaag

SEQ ID NO: 1637946 - RNA, 18 nt, Homo sapiens
guccuucaccucacugaa

SEQ ID NO: 1637947 - RNA, 22 nt, Homo sapiens
guccuuggauagauucagcucc

SEQ ID NO: 1637948 - RNA, 11 nt, Homo sapiens
guccuuuacaa

SEQ ID NO: 1637949 - RNA, 21 nt, Homo sapiens
guccuuucaauuccaccaggg

SEQ ID NO: 1637950 - RNA, 15 nt, Homo sapiens
guccuuucagucuga

SEQ ID NO: 1637951 - RNA, 22 nt, Homo sapiens
guccuuucccaccauuccugcc

SEQ ID NO: 1637952 - RNA, 18 nt, Homo sapiens
gucguauccaccuugcac

SEQ ID NO: 1637953 - RNA, 17 nt, Homo sapiens
gucgugcuuuuccugug

SEQ ID NO: 1637954 - RNA, 19 nt, Homo sapiens
gucuaagguucagccugaa

SEQ ID NO: 1637955 - RNA, 14 nt, Homo sapiens
gucuaucauaugaa

SEQ ID NO: 1637956 - RNA, 12 nt, Homo sapiens
gucucaccagcc

SEQ ID NO: 1637957 - RNA, 18 nt, Homo sapiens
gucucacugaacuagaag

SEQ ID NO: 1637958 - RNA, 13 nt, Homo sapiens
gucucccagcuca

SEQ ID NO: 1637959 - RNA, 13 nt, Homo sapiens
gucuccucuccau

SEQ ID NO: 1637960 - RNA, 23 nt, Homo sapiens
gucucgugguaggacuguagaaa

SEQ ID NO: 1637961 - RNA, 13 nt, Homo sapiens
gucucucccucag

SEQ ID NO: 1637962 - RNA, 18 nt, Homo sapiens
gucucuguugacuggcug

SEQ ID NO: 1637963 - RNA, 23 nt, Homo sapiens
gucuggaaaacagaaaccauucu

SEQ ID NO: 1637964 - RNA, 15 nt, Homo sapiens
gucugggauguauuc

SEQ ID NO: 1637965 - RNA, 19 nt, Homo sapiens
gucugguugggcagccaga

SEQ ID NO: 1637966 - RNA, 20 nt, Homo sapiens
gucuguauccccagugcccg

SEQ ID NO: 1637967 - RNA, 16 nt, Homo sapiens
gucuguuacacuggag

SEQ ID NO: 1637968 - RNA, 15 nt, Homo sapiens
gucuuggacacugua

SEQ ID NO: 1637969 - RNA, 14 nt, Homo sapiens
gucuuggcuuucau

SEQ ID NO: 1637970 - RNA, 20 nt, Homo sapiens
gucuuugcggggccugucuc

SEQ ID NO: 1637971 - RNA, 12 nt, Homo sapiens
gucuuuuacccg

SEQ ID NO: 1637972 - RNA, 16 nt, Homo sapiens
gugaaauacaguauac

SEQ ID NO: 1637973 - RNA, 23 nt, Homo sapiens
gugaacaaacuuagaaagggaag

SEQ ID NO: 1637974 - RNA, 23 nt, Homo sapiens
gugaagcauucgagacagaaccu

SEQ ID NO: 1637975 - RNA, 15 nt, Homo sapiens
gugaaguauugcuga

SEQ ID NO: 1637976 - RNA, 17 nt, Homo sapiens
gugacaagccaauguga

SEQ ID NO: 1637977 - RNA, 15 nt, Homo sapiens
gugacagggccagug

SEQ ID NO: 1637978 - RNA, 14 nt, Homo sapiens
gugacgcugcugac

SEQ ID NO: 1637979 - RNA, 12 nt, Homo sapiens
gugacugcaaua

SEQ ID NO: 1637980 - RNA, 15 nt, Homo sapiens
gugagaaauagcuga

SEQ ID NO: 1637981 - RNA, 14 nt, Homo sapiens
gugagaccuggcag

SEQ ID NO: 1637982 - RNA, 13 nt, Homo sapiens
gugagaugcagcu

SEQ ID NO: 1637983 - RNA, 14 nt, Homo sapiens
gugagaugcagcug

SEQ ID NO: 1637984 - RNA, 12 nt, Homo sapiens
gugauacauuua

SEQ ID NO: 1637985 - RNA, 20 nt, Homo sapiens
gugauuacauaaucuguaca

SEQ ID NO: 1637986 - RNA, 13 nt, Homo sapiens
gugcaaaccacuu

SEQ ID NO: 1637987 - RNA, 18 nt, Homo sapiens
gugcaauaugaggccaaa

SEQ ID NO: 1637988 - RNA, 16 nt, Homo sapiens
gugcacaaaguggcau

SEQ ID NO: 1637989 - RNA, 19 nt, Homo sapiens
gugcaguggcacgaucuca

SEQ ID NO: 1637990 - RNA, 18 nt, Homo sapiens
gugccauccccaccuuca

SEQ ID NO: 1637991 - RNA, 14 nt, Homo sapiens
gugcccaaccucac

SEQ ID NO: 1637992 - RNA, 21 nt, Homo sapiens
gugcucauucauuuaacagag

SEQ ID NO: 1637993 - RNA, 22 nt, Homo sapiens
gugcuccauggcugccaucuca

SEQ ID NO: 1637994 - RNA, 15 nt, Homo sapiens
gugcuccugaaagaa

SEQ ID NO: 1637995 - RNA, 15 nt, Homo sapiens
gugcugagaaugugu

SEQ ID NO: 1637996 - RNA, 18 nt, Homo sapiens
gugcuggaauuacaggcg

SEQ ID NO: 1637997 - RNA, 16 nt, Homo sapiens
gugcugggggaaugag

SEQ ID NO: 1637998 - RNA, 12 nt, Homo sapiens
gugcugugacaa

SEQ ID NO: 1637999 - RNA, 13 nt, Homo sapiens
guggaacuguaca

SEQ ID NO: 1638000 - RNA, 12 nt, Homo sapiens
guggaaugagug

SEQ ID NO: 1638001 - RNA, 16 nt, Homo sapiens
guggaaugagugugca

SEQ ID NO: 1638002 - RNA, 14 nt, Homo sapiens
guggagacaguccu

SEQ ID NO: 1638003 - RNA, 20 nt, Homo sapiens
guggaggcggaauugcucuc

SEQ ID NO: 1638004 - RNA, 18 nt, Homo sapiens
guggagugcaguggugcg

SEQ ID NO: 1638005 - RNA, 18 nt, Homo sapiens
guggagugggggcuucca

SEQ ID NO: 1638006 - RNA, 13 nt, Homo sapiens
guggcacuuccac

SEQ ID NO: 1638007 - RNA, 22 nt, Homo sapiens
gugggaucauccagaggagcug

SEQ ID NO: 1638008 - RNA, 19 nt, Homo sapiens
guggggccuguggaaugag

SEQ ID NO: 1638009 - RNA, 14 nt, Homo sapiens
gugguccacugagc

SEQ ID NO: 1638010 - RNA, 22 nt, Homo sapiens
guggucuaagguucagccugaa

SEQ ID NO: 1638011 - RNA, 23 nt, Homo sapiens
guguacaaauacauguguauauu

SEQ ID NO: 1638012 - RNA, 14 nt, Homo sapiens
guguacauucuucc

SEQ ID NO: 1638013 - RNA, 19 nt, Homo sapiens
guguaggaaaaaugcaagc

SEQ ID NO: 1638014 - RNA, 22 nt, Homo sapiens
guguauccaugcaccuaccuua

SEQ ID NO: 1638015 - RNA, 15 nt, Homo sapiens
gugucaaccccaaau

SEQ ID NO: 1638016 - RNA, 12 nt, Homo sapiens
gugucacaaaga

SEQ ID NO: 1638017 - RNA, 19 nt, Homo sapiens
gugucacuugacucuugaa

SEQ ID NO: 1638018 - RNA, 15 nt, Homo sapiens
gugucauuucauucc

SEQ ID NO: 1638019 - RNA, 16 nt, Homo sapiens
gugucucccgugcaug

SEQ ID NO: 1638020 - RNA, 15 nt, Homo sapiens
gugugaaugcacguu

SEQ ID NO: 1638021 - RNA, 18 nt, Homo sapiens
guguucccagagcacuuu

SEQ ID NO: 1638022 - RNA, 16 nt, Homo sapiens
guguuguggacacugc

SEQ ID NO: 1638023 - RNA, 21 nt, Homo sapiens
guuaaguauugugcacuguau

SEQ ID NO: 1638024 - RNA, 15 nt, Homo sapiens
guuaauggucaaugc

SEQ ID NO: 1638025 - RNA, 17 nt, Homo sapiens
guuaauggucaaugcua

SEQ ID NO: 1638026 - RNA, 23 nt, Homo sapiens
guuaauggucaaugcuagcacaa

SEQ ID NO: 1638027 - RNA, 15 nt, Homo sapiens
guuacacagugugaa

SEQ ID NO: 1638028 - RNA, 12 nt, Homo sapiens
guuaccaagaag

SEQ ID NO: 1638029 - RNA, 14 nt, Homo sapiens
guuaccucugcaug

SEQ ID NO: 1638030 - RNA, 15 nt, Homo sapiens
guuacuuuuuuacac

SEQ ID NO: 1638031 - RNA, 20 nt, Homo sapiens
guuaguuuuucuuacuugca

SEQ ID NO: 1638032 - RNA, 16 nt, Homo sapiens
guuauaaaaggcuuua

SEQ ID NO: 1638033 - RNA, 19 nt, Homo sapiens
guuauuguuguugccaaag

SEQ ID NO: 1638034 - RNA, 20 nt, Homo sapiens
guucaagacagaugggcaua

SEQ ID NO: 1638035 - RNA, 21 nt, Homo sapiens
guucaccuccaagcauuucau

SEQ ID NO: 1638036 - RNA, 14 nt, Homo sapiens
guucagacauguga

SEQ ID NO: 1638037 - RNA, 16 nt, Homo sapiens
guucagacaugugaag

SEQ ID NO: 1638038 - RNA, 18 nt, Homo sapiens
guucauuucacacaguga

SEQ ID NO: 1638039 - RNA, 19 nt, Homo sapiens
guucgauguuagcguuuac

SEQ ID NO: 1638040 - RNA, 16 nt, Homo sapiens
guucguugcacagcug

SEQ ID NO: 1638041 - RNA, 17 nt, Homo sapiens
guucuaauggcacuuau

SEQ ID NO: 1638042 - RNA, 15 nt, Homo sapiens
guucugucuucccaa

SEQ ID NO: 1638043 - RNA, 14 nt, Homo sapiens
guucugugcacaaa

SEQ ID NO: 1638044 - RNA, 16 nt, Homo sapiens
guucuguuauacccca

SEQ ID NO: 1638045 - RNA, 12 nt, Homo sapiens
guucuguucuca

SEQ ID NO: 1638046 - RNA, 23 nt, Homo sapiens
guugaauuucccacauacccucc

SEQ ID NO: 1638047 - RNA, 15 nt, Homo sapiens
guugcaguaagccaa

SEQ ID NO: 1638048 - RNA, 21 nt, Homo sapiens
guugcagugucuaguuucuca

SEQ ID NO: 1638049 - RNA, 19 nt, Homo sapiens
uaauaguuguugaguauuc

SEQ ID NO: 1638050 - RNA, 20 nt, Homo sapiens
uaauaugguguacauucuuc

SEQ ID NO: 1638051 - RNA, 15 nt, Homo sapiens
uaauauuuagcugua

SEQ ID NO: 1638052 - RNA, 20 nt, Homo sapiens
uaauauuuuuguauuucucu

SEQ ID NO: 1638053 - RNA, 20 nt, Homo sapiens
uaaucaagagaaacuucaaa

SEQ ID NO: 1638054 - RNA, 21 nt, Homo sapiens
uaaucagaaaaguaauuuugu

SEQ ID NO: 1638055 - RNA, 15 nt, Homo sapiens
uaaucagucauuucu

SEQ ID NO: 1638056 - RNA, 15 nt, Homo sapiens
uaaucaguucugugu

SEQ ID NO: 1638057 - RNA, 23 nt, Homo sapiens
uaaucauuuguuuacauuugaug

SEQ ID NO: 1638058 - RNA, 19 nt, Homo sapiens
uaaucugauuauacaccau

SEQ ID NO: 1638059 - RNA, 16 nt, Homo sapiens
uaaucuguacaaugaa

SEQ ID NO: 1638060 - RNA, 21 nt, Homo sapiens
uaaugaaaauaaacauguaua

SEQ ID NO: 1638061 - RNA, 23 nt, Homo sapiens
uaaugaauaaacauuuguagcau

SEQ ID NO: 1638062 - RNA, 13 nt, Homo sapiens
uaaugacauacuu

SEQ ID NO: 1638063 - RNA, 19 nt, Homo sapiens
uaaugauucugauauguau

SEQ ID NO: 1638064 - RNA, 21 nt, Homo sapiens
uaauggaggucccagcccugg

SEQ ID NO: 1638065 - RNA, 17 nt, Homo sapiens
uaauggccggcuggaaa

SEQ ID NO: 1638066 - RNA, 17 nt, Homo sapiens
uaaugucugccagguga

SEQ ID NO: 1638067 - RNA, 19 nt, Homo sapiens
uaaugugugguggccucag

SEQ ID NO: 1638068 - RNA, 15 nt, Homo sapiens
uaauuaccaguuuuc

SEQ ID NO: 1638069 - RNA, 19 nt, Homo sapiens
uaauuaccaguuuuccaga

SEQ ID NO: 1638070 - RNA, 17 nt, Homo sapiens
uaauucuaagacuuuug

SEQ ID NO: 1638071 - RNA, 14 nt, Homo sapiens
uaauucucuuucaa

SEQ ID NO: 1638072 - RNA, 12 nt, Homo sapiens
uaauucuucacc

SEQ ID NO: 1638073 - RNA, 16 nt, Homo sapiens
uaauugacaacacagc

SEQ ID NO: 1638074 - RNA, 15 nt, Homo sapiens
uaauuuauaaauaca

SEQ ID NO: 1638075 - RNA, 17 nt, Homo sapiens
uaauuuccuggugugaa

SEQ ID NO: 1638076 - RNA, 15 nt, Homo sapiens
uaauuuuucugggaa

SEQ ID NO: 1638077 - RNA, 22 nt, Homo sapiens
uaauuuuuucccagacuacuau

SEQ ID NO: 1638078 - RNA, 20 nt, Homo sapiens
uacaaaauccagcuaugaau

SEQ ID NO: 1638079 - RNA, 11 nt, Homo sapiens
uacaaacucau

SEQ ID NO: 1638080 - RNA, 13 nt, Homo sapiens
uacaaacugaaga

SEQ ID NO: 1638081 - RNA, 16 nt, Homo sapiens
uacaaagaacaugaac

SEQ ID NO: 1638082 - RNA, 20 nt, Homo sapiens
uacaaaguuauauucacagu

SEQ ID NO: 1638083 - RNA, 23 nt, Homo sapiens
uacaacccgguucacucuucuca

SEQ ID NO: 1638084 - RNA, 23 nt, Homo sapiens
uacaagaguggagagaagcucuu

SEQ ID NO: 1638085 - RNA, 14 nt, Homo sapiens
uacaagcaaugccu

SEQ ID NO: 1638086 - RNA, 16 nt, Homo sapiens
uacaaggaauaugaca

SEQ ID NO: 1638087 - RNA, 19 nt, Homo sapiens
uacaaucagcccagugcaa

SEQ ID NO: 1638088 - RNA, 14 nt, Homo sapiens
uacacagcuuuaug

SEQ ID NO: 1638089 - RNA, 16 nt, Homo sapiens
uacacauaaagcacua

SEQ ID NO: 1638090 - RNA, 20 nt, Homo sapiens
uacacauuuuucagauauaa

SEQ ID NO: 1638091 - RNA, 13 nt, Homo sapiens
uacaccacucugg

SEQ ID NO: 1638092 - RNA, 18 nt, Homo sapiens
uacaccauuaucuuggaa

SEQ ID NO: 1638093 - RNA, 13 nt, Homo sapiens
uacacgugacaga

SEQ ID NO: 1638094 - RNA, 15 nt, Homo sapiens
uacacgugacagagu

SEQ ID NO: 1638095 - RNA, 15 nt, Homo sapiens
uacacguguccugua

SEQ ID NO: 1638096 - RNA, 15 nt, Homo sapiens
uacacuaaccaaauc

SEQ ID NO: 1638097 - RNA, 17 nt, Homo sapiens
uacagaggucagcacac

SEQ ID NO: 1638098 - RNA, 15 nt, Homo sapiens
uacagauuaucacau

SEQ ID NO: 1638099 - RNA, 17 nt, Homo sapiens
uacaggaaauugacuua

SEQ ID NO: 1638100 - RNA, 18 nt, Homo sapiens
uacaggcgccugccacca

SEQ ID NO: 1638101 - RNA, 18 nt, Homo sapiens
uacaggugugcaccacca

SEQ ID NO: 1638102 - RNA, 15 nt, Homo sapiens
uacauaguugagauu

SEQ ID NO: 1638103 - RNA, 15 nt, Homo sapiens
uacaugugcacuccc

SEQ ID NO: 1638104 - RNA, 16 nt, Homo sapiens
uacauuaaaaugacaa

SEQ ID NO: 1638105 - RNA, 13 nt, Homo sapiens
uacauuguauucu

SEQ ID NO: 1638106 - RNA, 13 nt, Homo sapiens
uacauuuacuuua

SEQ ID NO: 1638107 - RNA, 18 nt, Homo sapiens
uaccaaagaaacaccacu

SEQ ID NO: 1638108 - RNA, 21 nt, Homo sapiens
uaccaauucacccacucccuu

SEQ ID NO: 1638109 - RNA, 15 nt, Homo sapiens
uaccacucagagaaa

SEQ ID NO: 1638110 - RNA, 18 nt, Homo sapiens
uaccagaaccaguaccuc

SEQ ID NO: 1638111 - RNA, 17 nt, Homo sapiens
uaccaguauaagcaucu

SEQ ID NO: 1638112 - RNA, 19 nt, Homo sapiens
uaccagugacgcugcugac

SEQ ID NO: 1638113 - RNA, 15 nt, Homo sapiens
uaccaguuuuccaga

SEQ ID NO: 1638114 - RNA, 14 nt, Homo sapiens
uacccaacucugua

SEQ ID NO: 1638115 - RNA, 21 nt, Homo sapiens
uacccccaguccucccuagcu

SEQ ID NO: 1638116 - RNA, 20 nt, Homo sapiens
uaccuacacccaagguuguc

SEQ ID NO: 1638117 - RNA, 14 nt, Homo sapiens
uaccuaguuugcac

SEQ ID NO: 1638118 - RNA, 16 nt, Homo sapiens
uaccuaguuugcacua

SEQ ID NO: 1638119 - RNA, 14 nt, Homo sapiens
uaccuuacugcaau

SEQ ID NO: 1638120 - RNA, 17 nt, Homo sapiens
uaccuuacugcaauuug

SEQ ID NO: 1638121 - RNA, 22 nt, Homo sapiens
uaccuuccccacaucugagaga

SEQ ID NO: 1638122 - RNA, 17 nt, Homo sapiens
uacgagaaaaucugcau

SEQ ID NO: 1638123 - RNA, 12 nt, Homo sapiens
uacgucugggag

SEQ ID NO: 1638124 - RNA, 16 nt, Homo sapiens
uacuaaaacacugaaa

SEQ ID NO: 1638125 - RNA, 20 nt, Homo sapiens
uacuaaggaguaaucugugu

SEQ ID NO: 1638126 - RNA, 23 nt, Homo sapiens
uacuaaggaguaaucuguguaca

SEQ ID NO: 1638127 - RNA, 14 nt, Homo sapiens
uacuaaucauguga

SEQ ID NO: 1638128 - RNA, 20 nt, Homo sapiens
uacuagcuuuauaaauuaca

SEQ ID NO: 1638129 - RNA, 18 nt, Homo sapiens
uacuauauaauauaucau

SEQ ID NO: 1638130 - RNA, 19 nt, Homo sapiens
uacuauggagugcucacaa

SEQ ID NO: 1638131 - RNA, 16 nt, Homo sapiens
uacuauguacugccuu

SEQ ID NO: 1638132 - RNA, 15 nt, Homo sapiens
uacuauucaaaaccu

SEQ ID NO: 1638133 - RNA, 21 nt, Homo sapiens
uacucagguuaaugcugaaaa

SEQ ID NO: 1638134 - RNA, 19 nt, Homo sapiens
uacucuucuuacuggugcu

SEQ ID NO: 1638135 - RNA, 23 nt, Homo sapiens
uacugacaacauuauaacuguau

SEQ ID NO: 1638136 - RNA, 19 nt, Homo sapiens
uacugagcauuugcaccuc

SEQ ID NO: 1638137 - RNA, 22 nt, Homo sapiens
uacugaugugugcaaccuuuua

SEQ ID NO: 1638138 - RNA, 11 nt, Homo sapiens
uacugccuuaa

SEQ ID NO: 1638139 - RNA, 23 nt, Homo sapiens
uacugggugucauuucauuccau

SEQ ID NO: 1638140 - RNA, 14 nt, Homo sapiens
uacuguaugccuuc

SEQ ID NO: 1638141 - RNA, 14 nt, Homo sapiens
uacuuaacauacac

SEQ ID NO: 1638142 - RNA, 16 nt, Homo sapiens
uacuucuuuuucauua

SEQ ID NO: 1638143 - RNA, 22 nt, Homo sapiens
uacuugaaauuuggcuaauaac

SEQ ID NO: 1638144 - RNA, 15 nt, Homo sapiens
uacuugcuucucuag

SEQ ID NO: 1638145 - RNA, 14 nt, Homo sapiens
uacuugucauauca

SEQ ID NO: 1638146 - RNA, 14 nt, Homo sapiens
uacuuucacacuaa

SEQ ID NO: 1638147 - RNA, 14 nt, Homo sapiens
uacuuuguaaagac

SEQ ID NO: 1638148 - RNA, 15 nt, Homo sapiens
uacuuuugcucccua

SEQ ID NO: 1638149 - RNA, 12 nt, Homo sapiens
uagaaaacuggg

SEQ ID NO: 1638150 - RNA, 16 nt, Homo sapiens
uagaaaagggaacuga

SEQ ID NO: 1638151 - RNA, 20 nt, Homo sapiens
uagaaaauaaaacugagcua

SEQ ID NO: 1638152 - RNA, 16 nt, Homo sapiens
uagaaagccaugugcu

SEQ ID NO: 1638153 - RNA, 18 nt, Homo sapiens
uagaacuagccaaaccag

SEQ ID NO: 1638154 - RNA, 17 nt, Homo sapiens
uagaacugucugugaac

SEQ ID NO: 1638155 - RNA, 18 nt, Homo sapiens
uagaccagggcugcucuu

SEQ ID NO: 1638156 - RNA, 11 nt, Homo sapiens
uagacuaguuu

SEQ ID NO: 1638157 - RNA, 22 nt, Homo sapiens
uagacugugucugaaucauguc

SEQ ID NO: 1638158 - RNA, 19 nt, Homo sapiens
uagacuguuucacauugca

SEQ ID NO: 1638159 - RNA, 22 nt, Homo sapiens
uauguaacaaaccugcacuuau

SEQ ID NO: 1638160 - RNA, 21 nt, Homo sapiens
uauguacugccuuagugcuga

SEQ ID NO: 1638161 - RNA, 21 nt, Homo sapiens
uauguccacuguucuguucuc

SEQ ID NO: 1638162 - RNA, 19 nt, Homo sapiens
uaugucuuggacacuguac

SEQ ID NO: 1638163 - RNA, 20 nt, Homo sapiens
uaugucuuggacacuguaca

SEQ ID NO: 1638164 - RNA, 15 nt, Homo sapiens
uauguggaacuguac

SEQ ID NO: 1638165 - RNA, 17 nt, Homo sapiens
uaugugucaguggggcu

SEQ ID NO: 1638166 - RNA, 18 nt, Homo sapiens
uauguucaaagacuguga

SEQ ID NO: 1638167 - RNA, 19 nt, Homo sapiens
uauguucaggaaaugaaag

SEQ ID NO: 1638168 - RNA, 18 nt, Homo sapiens
uauuaaaaauguucucaa

SEQ ID NO: 1638169 - RNA, 16 nt, Homo sapiens
uauuaacccuaccugu

SEQ ID NO: 1638170 - RNA, 23 nt, Homo sapiens
uauuaaucaagagaaacuucaaa

SEQ ID NO: 1638171 - RNA, 15 nt, Homo sapiens
uauuacuaaggagua

SEQ ID NO: 1638172 - RNA, 17 nt, Homo sapiens
uauuagcauggcauauu

SEQ ID NO: 1638173 - RNA, 13 nt, Homo sapiens
uauuaguauuaau

SEQ ID NO: 1638174 - RNA, 22 nt, Homo sapiens
uauuauaaacuguaugcucaca

SEQ ID NO: 1638175 - RNA, 14 nt, Homo sapiens
uauuauaaagccaa

SEQ ID NO: 1638176 - RNA, 22 nt, Homo sapiens
uauuaugugcaacauuaugauu

SEQ ID NO: 1638177 - RNA, 15 nt, Homo sapiens
uauuauugcugccaa

SEQ ID NO: 1638178 - RNA, 20 nt, Homo sapiens
uauucaaaaacauaacugag

SEQ ID NO: 1638179 - RNA, 14 nt, Homo sapiens
uauucacauauguc

SEQ ID NO: 1638180 - RNA, 14 nt, Homo sapiens
uauucauauguuua

SEQ ID NO: 1638181 - RNA, 14 nt, Homo sapiens
uauuccaaaugcca

SEQ ID NO: 1638182 - RNA, 16 nt, Homo sapiens
uauugcaagaguuuaa

SEQ ID NO: 1638183 - RNA, 21 nt, Homo sapiens
uauugccgccagaagauccaa

SEQ ID NO: 1638184 - RNA, 16 nt, Homo sapiens
uauugcuugaguuaua

SEQ ID NO: 1638185 - RNA, 17 nt, Homo sapiens
uauugcuugaguuauau

SEQ ID NO: 1638186 - RNA, 21 nt, Homo sapiens
uauugucgguuaccucugcau

SEQ ID NO: 1638187 - RNA, 16 nt, Homo sapiens
uauuguuguugccaaa

SEQ ID NO: 1638188 - RNA, 14 nt, Homo sapiens
uauuguuucugcau

SEQ ID NO: 1638189 - RNA, 22 nt, Homo sapiens
uauuuaauauaguaacacacuu

SEQ ID NO: 1638190 - RNA, 16 nt, Homo sapiens
uauuuauccacuacuc

SEQ ID NO: 1638191 - RNA, 14 nt, Homo sapiens
uauuuauuagccaa

SEQ ID NO: 1638192 - RNA, 17 nt, Homo sapiens
uauuucaccaagccaau

SEQ ID NO: 1638193 - RNA, 15 nt, Homo sapiens
uauuucagaaggaga

SEQ ID NO: 1638194 - RNA, 15 nt, Homo sapiens
uauuucucuucuacc

SEQ ID NO: 1638195 - RNA, 23 nt, Homo sapiens
uauuucuucaaauaaaucucucc

SEQ ID NO: 1638196 - RNA, 16 nt, Homo sapiens
uauuugaaaaauugcc

SEQ ID NO: 1638197 - RNA, 16 nt, Homo sapiens
uauuugaaaacauaua

SEQ ID NO: 1638198 - RNA, 14 nt, Homo sapiens
uauuugcacaaguu

SEQ ID NO: 1638199 - RNA, 21 nt, Homo sapiens
uauuugggagggaaaagggaa

SEQ ID NO: 1638200 - RNA, 18 nt, Homo sapiens
uauuuuaaaaaacacuga

SEQ ID NO: 1638201 - RNA, 17 nt, Homo sapiens
uauuuuaauaccuuuaa

SEQ ID NO: 1638202 - RNA, 14 nt, Homo sapiens
uauuuuauguauau

SEQ ID NO: 1638203 - RNA, 19 nt, Homo sapiens
uauuuuuauaucaugcaaa

SEQ ID NO: 1638204 - RNA, 22 nt, Homo sapiens
uauuuuuggaagcauacaauuu

SEQ ID NO: 1638205 - RNA, 21 nt, Homo sapiens
uauuuuuuaagaaaaaaagcu

SEQ ID NO: 1638206 - RNA, 13 nt, Homo sapiens
uauuuuuugccau

SEQ ID NO: 1638207 - RNA, 13 nt, Homo sapiens
ucaaaagaaauaa

SEQ ID NO: 1638208 - RNA, 17 nt, Homo sapiens
ucaaaauuuaaagccau

SEQ ID NO: 1638209 - RNA, 12 nt, Homo sapiens
ucaaagccacug

SEQ ID NO: 1638210 - RNA, 19 nt, Homo sapiens
ucaaagcccacauacugga

SEQ ID NO: 1638211 - RNA, 19 nt, Homo sapiens
ucaaaucucuugcuuucuu

SEQ ID NO: 1638212 - RNA, 23 nt, Homo sapiens
ucaaauuauuuccaagagagauu

SEQ ID NO: 1638213 - RNA, 16 nt, Homo sapiens
ucaacaugacuggugg

SEQ ID NO: 1638214 - RNA, 22 nt, Homo sapiens
ucaaccauaaaagaaguuucag

SEQ ID NO: 1638215 - RNA, 21 nt, Homo sapiens
ucaaccccaaauuuuuacgua

SEQ ID NO: 1638216 - RNA, 19 nt, Homo sapiens
ucaacuagcagauacaggg

SEQ ID NO: 1638217 - RNA, 23 nt, Homo sapiens
ucaagaaauaaaaggaagccaaa

SEQ ID NO: 1638218 - RNA, 18 nt, Homo sapiens
ucaagccauaauguaagg

SEQ ID NO: 1638219 - RNA, 15 nt, Homo sapiens
ucaagccccauuucc

SEQ ID NO: 1638220 - RNA, 16 nt, Homo sapiens
ucaagcuggugcuacu

SEQ ID NO: 1638221 - RNA, 21 nt, Homo sapiens
ucaagugaggugacacuccag

SEQ ID NO: 1638222 - RNA, 15 nt, Homo sapiens
ucaagugauccuccc

SEQ ID NO: 1638223 - RNA, 17 nt, Homo sapiens
ucaauaaacaacagcug

SEQ ID NO: 1638224 - RNA, 19 nt, Homo sapiens
ucaauaaagauuucaagau

SEQ ID NO: 1638225 - RNA, 19 nt, Homo sapiens
ucaauaaaguuguugcauu

SEQ ID NO: 1638226 - RNA, 13 nt, Homo sapiens
ucaauacagugaa

SEQ ID NO: 1638227 - RNA, 19 nt, Homo sapiens
ucaauaccaauuacaugga

SEQ ID NO: 1638228 - RNA, 21 nt, Homo sapiens
ucaauauuuuuauaucaugca

SEQ ID NO: 1638229 - RNA, 16 nt, Homo sapiens
ucaaucugcaguuuaa

SEQ ID NO: 1638230 - RNA, 17 nt, Homo sapiens
ucacaaaccaagccaug

SEQ ID NO: 1638231 - RNA, 22 nt, Homo sapiens
ucacaaauaaguaauaucuuuc

SEQ ID NO: 1638232 - RNA, 18 nt, Homo sapiens
ucacaacagucaccucac

SEQ ID NO: 1638233 - RNA, 15 nt, Homo sapiens
ucacaacuccuucca

SEQ ID NO: 1638234 - RNA, 16 nt, Homo sapiens
ucacaagaaugugcag

SEQ ID NO: 1638235 - RNA, 22 nt, Homo sapiens
ucacaucucccuuccaccucac

SEQ ID NO: 1638236 - RNA, 11 nt, Homo sapiens
ucacaugacca

SEQ ID NO: 1638237 - RNA, 18 nt, Homo sapiens
ucacauggccuaugcaca

SEQ ID NO: 1638238 - RNA, 22 nt, Homo sapiens
ucacauggccuaugcacauaug

SEQ ID NO: 1638239 - RNA, 22 nt, Homo sapiens
ucacauguccuauuacugaugu

SEQ ID NO: 1638240 - RNA, 14 nt, Homo sapiens
ucacauucuuggcu

SEQ ID NO: 1638241 - RNA, 12 nt, Homo sapiens
ucaccaggggag

SEQ ID NO: 1638242 - RNA, 14 nt, Homo sapiens
ucaccaggggagga

SEQ ID NO: 1638243 - RNA, 19 nt, Homo sapiens
ucacccaggcuggaguaca

SEQ ID NO: 1638244 - RNA, 19 nt, Homo sapiens
ucacccaggcuggagugca

SEQ ID NO: 1638245 - RNA, 13 nt, Homo sapiens
ucaccccauuuca

SEQ ID NO: 1638246 - RNA, 19 nt, Homo sapiens
ucaccccuccccugggacu

SEQ ID NO: 1638247 - RNA, 22 nt, Homo sapiens
ucaccucacugaaaacaucugg

SEQ ID NO: 1638248 - RNA, 18 nt, Homo sapiens
ucaccuccaagcauuuca

SEQ ID NO: 1638249 - RNA, 15 nt, Homo sapiens
ucaccucuuccacuc

SEQ ID NO: 1638250 - RNA, 20 nt, Homo sapiens
ucacgcaucucuacuccucu

SEQ ID NO: 1638251 - RNA, 23 nt, Homo sapiens
ucacgggucacuugaaauucuuu

SEQ ID NO: 1638252 - RNA, 21 nt, Homo sapiens
ucacucauuaaugaaucacau

SEQ ID NO: 1638253 - RNA, 14 nt, Homo sapiens
ucacugacaguuaa

SEQ ID NO: 1638254 - RNA, 17 nt, Homo sapiens
ucacuguguuacugcuu

SEQ ID NO: 1638255 - RNA, 19 nt, Homo sapiens
ucacuucauucacauucag

SEQ ID NO: 1638256 - RNA, 15 nt, Homo sapiens
ucacuugacucuuga

SEQ ID NO: 1638257 - RNA, 16 nt, Homo sapiens
ucacuugacucuugaa

SEQ ID NO: 1638258 - RNA, 19 nt, Homo sapiens
ucacuuguucucacugucu

SEQ ID NO: 1638259 - RNA, 14 nt, Homo sapiens
ucacuuuucagaag

SEQ ID NO: 1638260 - RNA, 23 nt, Homo sapiens
ucagaaagauuugaugggccaca

SEQ ID NO: 1638261 - RNA, 21 nt, Homo sapiens
ucagaaaguaacaaucuaugg

SEQ ID NO: 1638262 - RNA, 18 nt, Homo sapiens
ucagaaaugcugucauaa

SEQ ID NO: 1638263 - RNA, 13 nt, Homo sapiens
ucagaaggccuuu

SEQ ID NO: 1638264 - RNA, 21 nt, Homo sapiens
ucagaauaaggcaggcauuga

SEQ ID NO: 1638265 - RNA, 22 nt, Homo sapiens
ucagaauaggaagauaugccac

SEQ ID NO: 1638266 - RNA, 18 nt, Homo sapiens
ucagacacaugcuauguu

SEQ ID NO: 1638267 - RNA, 18 nt, Homo sapiens
ucagacauaaagccaugu

SEQ ID NO: 1638268 - RNA, 22 nt, Homo sapiens
agaaguugacaggcagugccau

SEQ ID NO: 1638269 - RNA, 19 nt, Homo sapiens
agaaguuggucuuacuuug

SEQ ID NO: 1638270 - RNA, 18 nt, Homo sapiens
agaaguuugggcuaacau

SEQ ID NO: 1638271 - RNA, 22 nt, Homo sapiens
agaauacauuguacuuauacac

SEQ ID NO: 1638272 - RNA, 13 nt, Homo sapiens
agaauauauuucc

SEQ ID NO: 1638273 - RNA, 16 nt, Homo sapiens
agaauccccuccaucu

SEQ ID NO: 1638274 - RNA, 22 nt, Homo sapiens
agaauggaaagcuucagugcug

SEQ ID NO: 1638275 - RNA, 15 nt, Homo sapiens
agaaugugacaggca

SEQ ID NO: 1638276 - RNA, 14 nt, Homo sapiens
agacacagugacca

SEQ ID NO: 1638277 - RNA, 22 nt, Homo sapiens
agacagaguuuucacucuuauu

SEQ ID NO: 1638278 - RNA, 19 nt, Homo sapiens
agacaggguuuugccaugu

SEQ ID NO: 1638279 - RNA, 16 nt, Homo sapiens
agacauaaauguucac

SEQ ID NO: 1638280 - RNA, 16 nt, Homo sapiens
agacaucagcccuugg

SEQ ID NO: 1638281 - RNA, 15 nt, Homo sapiens
agacaugagugcgug

SEQ ID NO: 1638282 - RNA, 18 nt, Homo sapiens
agacaugagugcgugcuc

SEQ ID NO: 1638283 - RNA, 15 nt, Homo sapiens
agacaugugcacuug

SEQ ID NO: 1638284 - RNA, 16 nt, Homo sapiens
agacaugugcacuuga

SEQ ID NO: 1638285 - RNA, 14 nt, Homo sapiens
agaccacugauaaa

SEQ ID NO: 1638286 - RNA, 20 nt, Homo sapiens
agaccccucucccagcuauu

SEQ ID NO: 1638287 - RNA, 20 nt, Homo sapiens
agaccuguguuacuaaaaaa

SEQ ID NO: 1638288 - RNA, 15 nt, Homo sapiens
agaccuucugaucuc

SEQ ID NO: 1638289 - RNA, 18 nt, Homo sapiens
agacgggguuucacugug

SEQ ID NO: 1638290 - RNA, 13 nt, Homo sapiens
agacuaaugcuca

SEQ ID NO: 1638291 - RNA, 17 nt, Homo sapiens
agacuauugugccuuag

SEQ ID NO: 1638292 - RNA, 17 nt, Homo sapiens
agacucgagaacuuuca

SEQ ID NO: 1638293 - RNA, 21 nt, Homo sapiens
agacugcccagcuaaagcaau

SEQ ID NO: 1638294 - RNA, 14 nt, Homo sapiens
agacuggaaggugg

SEQ ID NO: 1638295 - RNA, 22 nt, Homo sapiens
agagaacaaugugcuaugugaa

SEQ ID NO: 1638296 - RNA, 21 nt, Homo sapiens
agagacaggguuuugccaugu

SEQ ID NO: 1638297 - RNA, 16 nt, Homo sapiens
agagacgcagacaugu

SEQ ID NO: 1638298 - RNA, 18 nt, Homo sapiens
agagacgcagacaugugc

SEQ ID NO: 1638299 - RNA, 20 nt, Homo sapiens
agagacuugggacauugccu

SEQ ID NO: 1638300 - RNA, 19 nt, Homo sapiens
agagacuuugacucuccag

SEQ ID NO: 1638301 - RNA, 15 nt, Homo sapiens
agagagagcuucugu

SEQ ID NO: 1638302 - RNA, 15 nt, Homo sapiens
agagagcacagugau

SEQ ID NO: 1638303 - RNA, 20 nt, Homo sapiens
agagagcacagugaucacca

SEQ ID NO: 1638304 - RNA, 20 nt, Homo sapiens
agagagccauuuugugaaug

SEQ ID NO: 1638305 - RNA, 17 nt, Homo sapiens
agagaggguggugaccu

SEQ ID NO: 1638306 - RNA, 23 nt, Homo sapiens
agagauuggaaugggcagcucau

SEQ ID NO: 1638307 - RNA, 18 nt, Homo sapiens
agagcagaacccuagucu

SEQ ID NO: 1638308 - RNA, 14 nt, Homo sapiens
agagcagaugcaga

SEQ ID NO: 1638309 - RNA, 15 nt, Homo sapiens
agagccucacaguua

SEQ ID NO: 1638310 - RNA, 12 nt, Homo sapiens
agagccuuccag

SEQ ID NO: 1638311 - RNA, 19 nt, Homo sapiens
agagcuagaaccuagaagg

SEQ ID NO: 1638312 - RNA, 16 nt, Homo sapiens
agagcugacacaggau

SEQ ID NO: 1638313 - RNA, 21 nt, Homo sapiens
agagcuuggacuggaugcaug

SEQ ID NO: 1638314 - RNA, 22 nt, Homo sapiens
agagcuuguaauaaauacugca

SEQ ID NO: 1638315 - RNA, 15 nt, Homo sapiens
agaggagaaggaggg

SEQ ID NO: 1638316 - RNA, 21 nt, Homo sapiens
agaggagagagacuccagcug

SEQ ID NO: 1638317 - RNA, 19 nt, Homo sapiens
agagggaagccaggauugg

SEQ ID NO: 1638318 - RNA, 19 nt, Homo sapiens
agagggcacacacugugua

SEQ ID NO: 1638319 - RNA, 20 nt, Homo sapiens
agaggggaacagacuggaag

SEQ ID NO: 1638320 - RNA, 20 nt, Homo sapiens
agaggggccugccaccugga

SEQ ID NO: 1638321 - RNA, 19 nt, Homo sapiens
agaguacaccccaacagca

SEQ ID NO: 1638322 - RNA, 21 nt, Homo sapiens
agaguacaccccaacagcacc

SEQ ID NO: 1638323 - RNA, 17 nt, Homo sapiens
agaguaggaagacuuug

SEQ ID NO: 1638324 - RNA, 20 nt, Homo sapiens
agaguauuggucuccucuca

SEQ ID NO: 1638325 - RNA, 15 nt, Homo sapiens
agagucuccaguuua

SEQ ID NO: 1638326 - RNA, 19 nt, Homo sapiens
agagugagacuccaccuca

SEQ ID NO: 1638327 - RNA, 20 nt, Homo sapiens
agagugagacuccaccucaa

SEQ ID NO: 1638328 - RNA, 20 nt, Homo sapiens
agagugagacucugucucaa

SEQ ID NO: 1638329 - RNA, 22 nt, Homo sapiens
agagugcuaauuuaguucucag

SEQ ID NO: 1638330 - RNA, 13 nt, Homo sapiens
agagugucuuucc

SEQ ID NO: 1638331 - RNA, 18 nt, Homo sapiens
agaguucgugaagaggga

SEQ ID NO: 1638332 - RNA, 17 nt, Homo sapiens
agauaauucuagcuuug

SEQ ID NO: 1638333 - RNA, 13 nt, Homo sapiens
agauacugaggaa

SEQ ID NO: 1638334 - RNA, 15 nt, Homo sapiens
agaucacgccacugc

SEQ ID NO: 1638335 - RNA, 14 nt, Homo sapiens
agaucauucacuca

SEQ ID NO: 1638336 - RNA, 19 nt, Homo sapiens
agaucgugccauugcacuc

SEQ ID NO: 1638337 - RNA, 18 nt, Homo sapiens
agaugaaaccgucccuga

SEQ ID NO: 1638338 - RNA, 16 nt, Homo sapiens
agaugagaguacaccc

SEQ ID NO: 1638339 - RNA, 13 nt, Homo sapiens
agaugcaggugag

SEQ ID NO: 1638340 - RNA, 19 nt, Homo sapiens
agaugcauuaucuaugaua

SEQ ID NO: 1638341 - RNA, 16 nt, Homo sapiens
agaugccaugugcagg

SEQ ID NO: 1638342 - RNA, 21 nt, Homo sapiens
agauggagucuggcucugucu

SEQ ID NO: 1638343 - RNA, 22 nt, Homo sapiens
agaugugugauucacaguguga

SEQ ID NO: 1638344 - RNA, 19 nt, Homo sapiens
agauguucuaagucuuucc

SEQ ID NO: 1638345 - RNA, 14 nt, Homo sapiens
agauguuuauuuca

SEQ ID NO: 1638346 - RNA, 15 nt, Homo sapiens
agauuaacacucauu

SEQ ID NO: 1638347 - RNA, 23 nt, Homo sapiens
agauuaacacucauuuccaauca

SEQ ID NO: 1638348 - RNA, 21 nt, Homo sapiens
agauuauuucuguauuuggcu

SEQ ID NO: 1638349 - RNA, 22 nt, Homo sapiens
agauucaaacucaaugaugcua

SEQ ID NO: 1638350 - RNA, 22 nt, Homo sapiens
agauucuaauggcuuuauugca

SEQ ID NO: 1638351 - RNA, 16 nt, Homo sapiens
agauuucucauuugcc

SEQ ID NO: 1638352 - RNA, 20 nt, Homo sapiens
agauuugagcucagcccugg

SEQ ID NO: 1638353 - RNA, 14 nt, Homo sapiens
agcaacaccaaaaa

SEQ ID NO: 1638354 - RNA, 23 nt, Homo sapiens
agcaacccugugauacuauuacc

SEQ ID NO: 1638355 - RNA, 16 nt, Homo sapiens
agcaaccuucuugccu

SEQ ID NO: 1638356 - RNA, 14 nt, Homo sapiens
agcacagcugccaa

SEQ ID NO: 1638357 - RNA, 23 nt, Homo sapiens
agcacaggugggcuucccagugg

SEQ ID NO: 1638358 - RNA, 19 nt, Homo sapiens
agcacccucuccagaugag

SEQ ID NO: 1638359 - RNA, 20 nt, Homo sapiens
agcacccucuccagaugcag

SEQ ID NO: 1638360 - RNA, 19 nt, Homo sapiens
agcacuaaggugugcucug

SEQ ID NO: 1638361 - RNA, 21 nt, Homo sapiens
agcacuaauucaacauauacc

SEQ ID NO: 1638362 - RNA, 23 nt, Homo sapiens
agcacuaauucaacauauaccuu

SEQ ID NO: 1638363 - RNA, 23 nt, Homo sapiens
agcacucucgcacacacagugau

SEQ ID NO: 1638364 - RNA, 11 nt, Homo sapiens
agcacugacua

SEQ ID NO: 1638365 - RNA, 16 nt, Homo sapiens
agcacuguuucucuca

SEQ ID NO: 1638366 - RNA, 12 nt, Homo sapiens
agcacuucccac

SEQ ID NO: 1638367 - RNA, 12 nt, Homo sapiens
agcacuuugcaa

SEQ ID NO: 1638368 - RNA, 14 nt, Homo sapiens
agcagaacuuucac

SEQ ID NO: 1638369 - RNA, 17 nt, Homo sapiens
agcagacuuuugugaac

SEQ ID NO: 1638370 - RNA, 15 nt, Homo sapiens
agcagccaagggaug

SEQ ID NO: 1638371 - RNA, 16 nt, Homo sapiens
agcagccaagggauga

SEQ ID NO: 1638372 - RNA, 18 nt, Homo sapiens
agcauacgguaugauauu

SEQ ID NO: 1638373 - RNA, 20 nt, Homo sapiens
agcauaggaggggucuggac

SEQ ID NO: 1638374 - RNA, 20 nt, Homo sapiens
agcauaguaccucugcuauu

SEQ ID NO: 1638375 - RNA, 17 nt, Homo sapiens
agcaucuuuaacacaac

SEQ ID NO: 1638376 - RNA, 12 nt, Homo sapiens
agcaugaugaaa

SEQ ID NO: 1638377 - RNA, 18 nt, Homo sapiens
aggcugagaacacuguga

SEQ ID NO: 1638378 - RNA, 19 nt, Homo sapiens
aggcugagaacacugugaa

SEQ ID NO: 1638379 - RNA, 22 nt, Homo sapiens
aggcugcuggaaggcagcuugu

SEQ ID NO: 1638380 - RNA, 16 nt, Homo sapiens
aggcuggagugcagug

SEQ ID NO: 1638381 - RNA, 13 nt, Homo sapiens
aggcuggucucaa

SEQ ID NO: 1638382 - RNA, 21 nt, Homo sapiens
aggcuucuaugaaagacucaa

SEQ ID NO: 1638383 - RNA, 18 nt, Homo sapiens
aggcuucugauacgugua

SEQ ID NO: 1638384 - RNA, 15 nt, Homo sapiens
aggcuucuggggcuu

SEQ ID NO: 1638385 - RNA, 19 nt, Homo sapiens
agggaacugaacauuccag

SEQ ID NO: 1638386 - RNA, 21 nt, Homo sapiens
agggaaguucaggcucugaga

SEQ ID NO: 1638387 - RNA, 23 nt, Homo sapiens
agggaaguucaggcucugagaca

SEQ ID NO: 1638388 - RNA, 15 nt, Homo sapiens
agggaauaauccaga

SEQ ID NO: 1638389 - RNA, 21 nt, Homo sapiens
agggaggaaaguuucuuugaa

SEQ ID NO: 1638390 - RNA, 18 nt, Homo sapiens
agggaugaguacccaaaa

SEQ ID NO: 1638391 - RNA, 18 nt, Homo sapiens
agggaugggaccugauga

SEQ ID NO: 1638392 - RNA, 19 nt, Homo sapiens
agggaugggaccugaugac

SEQ ID NO: 1638393 - RNA, 21 nt, Homo sapiens
agggauuuuagucacacgugg

SEQ ID NO: 1638394 - RNA, 16 nt, Homo sapiens
agggcaccaccaagaa

SEQ ID NO: 1638395 - RNA, 14 nt, Homo sapiens
agggccacauggga

SEQ ID NO: 1638396 - RNA, 16 nt, Homo sapiens
agggccacaugggagg

SEQ ID NO: 1638397 - RNA, 19 nt, Homo sapiens
agggccaccacaccugacu

SEQ ID NO: 1638398 - RNA, 14 nt, Homo sapiens
agggcgcaaagggc

SEQ ID NO: 1638399 - RNA, 17 nt, Homo sapiens
agggcgcaaagggcaug

SEQ ID NO: 1638400 - RNA, 17 nt, Homo sapiens
agggcuagaaccuggaa

SEQ ID NO: 1638401 - RNA, 23 nt, Homo sapiens
agggcuagaaucuggagagcuag

SEQ ID NO: 1638402 - RNA, 19 nt, Homo sapiens
agggcuuggacucaagcaa

SEQ ID NO: 1638403 - RNA, 14 nt, Homo sapiens
aggggcauuucaca

SEQ ID NO: 1638404 - RNA, 15 nt, Homo sapiens
aggggccaagcagug

SEQ ID NO: 1638405 - RNA, 20 nt, Homo sapiens
agggugagacacugcacaga

SEQ ID NO: 1638406 - RNA, 13 nt, Homo sapiens
aggguggugaccu

SEQ ID NO: 1638407 - RNA, 14 nt, Homo sapiens
agguacaaccuguu

SEQ ID NO: 1638408 - RNA, 21 nt, Homo sapiens
agguaucugguaucugcaugu

SEQ ID NO: 1638409 - RNA, 17 nt, Homo sapiens
aggucauagcagugcuu

SEQ ID NO: 1638410 - RNA, 22 nt, Homo sapiens
aggucucgcugaugcugggcug

SEQ ID NO: 1638411 - RNA, 20 nt, Homo sapiens
aggucuuuuacauacaguga

SEQ ID NO: 1638412 - RNA, 19 nt, Homo sapiens
aggugaagcaccaagcuca

SEQ ID NO: 1638413 - RNA, 12 nt, Homo sapiens
aggugaaucuag

SEQ ID NO: 1638414 - RNA, 16 nt, Homo sapiens
agguggggacagggau

SEQ ID NO: 1638415 - RNA, 15 nt, Homo sapiens
agguguuggugacaa

SEQ ID NO: 1638416 - RNA, 17 nt, Homo sapiens
agguuaauucucuaggg

SEQ ID NO: 1638417 - RNA, 17 nt, Homo sapiens
agguuucucaaagaaau

SEQ ID NO: 1638418 - RNA, 16 nt, Homo sapiens
agguuugccagcauuu

SEQ ID NO: 1638419 - RNA, 22 nt, Homo sapiens
agguuuucuguguuuagcuauu

SEQ ID NO: 1638420 - RNA, 21 nt, Homo sapiens
aguaaaaagcuuacuaaagca

SEQ ID NO: 1638421 - RNA, 22 nt, Homo sapiens
aguaaacccagcugugagacaa

SEQ ID NO: 1638422 - RNA, 16 nt, Homo sapiens
aguaaaggcaaacuua

SEQ ID NO: 1638423 - RNA, 19 nt, Homo sapiens
aguaaauuuugugaugaau

SEQ ID NO: 1638424 - RNA, 11 nt, Homo sapiens
aguaacaugug

SEQ ID NO: 1638425 - RNA, 15 nt, Homo sapiens
aguaacauguguuaa

SEQ ID NO: 1638426 - RNA, 16 nt, Homo sapiens
aguacaccccaacagc

SEQ ID NO: 1638427 - RNA, 17 nt, Homo sapiens
aguacaccccaacagca

SEQ ID NO: 1638428 - RNA, 21 nt, Homo sapiens
aguacaccccaacagcacccu

SEQ ID NO: 1638429 - RNA, 13 nt, Homo sapiens
aguacaggugaag

SEQ ID NO: 1638430 - RNA, 12 nt, Homo sapiens
aguacagucuua

SEQ ID NO: 1638431 - RNA, 17 nt, Homo sapiens
aguacgaaccuacaguu

SEQ ID NO: 1638432 - RNA, 13 nt, Homo sapiens
aguagacaagcaa

SEQ ID NO: 1638433 - RNA, 21 nt, Homo sapiens
aguagagcuuguaauaaauac

SEQ ID NO: 1638434 - RNA, 14 nt, Homo sapiens
aguagcugggacua

SEQ ID NO: 1638435 - RNA, 20 nt, Homo sapiens
aguagcugggacuacaggca

SEQ ID NO: 1638436 - RNA, 18 nt, Homo sapiens
aguaggcuuuuaccauua

SEQ ID NO: 1638437 - RNA, 14 nt, Homo sapiens
aguaguuagcuuuc

SEQ ID NO: 1638438 - RNA, 17 nt, Homo sapiens
aguauauugauaaccuu

SEQ ID NO: 1638439 - RNA, 21 nt, Homo sapiens
agucacacgggggcagcugau

SEQ ID NO: 1638440 - RNA, 20 nt, Homo sapiens
agucacagagauaauucuag

SEQ ID NO: 1638441 - RNA, 23 nt, Homo sapiens
aguccaaggaaaccacagcugcu

SEQ ID NO: 1638442 - RNA, 14 nt, Homo sapiens
aguccaggacaccc

SEQ ID NO: 1638443 - RNA, 15 nt, Homo sapiens
agucgaacaauucau

SEQ ID NO: 1638444 - RNA, 22 nt, Homo sapiens
agucucgcuauugucaccaggg

SEQ ID NO: 1638445 - RNA, 16 nt, Homo sapiens
agucugagucagagau

SEQ ID NO: 1638446 - RNA, 17 nt, Homo sapiens
agucuggcaaacaugug

SEQ ID NO: 1638447 - RNA, 18 nt, Homo sapiens
agucuggcaaacaugugc

SEQ ID NO: 1638448 - RNA, 17 nt, Homo sapiens
agucuggguccaggccu

SEQ ID NO: 1638449 - RNA, 19 nt, Homo sapiens
agucuugcagcaggaucua

SEQ ID NO: 1638450 - RNA, 19 nt, Homo sapiens
agucuugcauugaauuuag

SEQ ID NO: 1638451 - RNA, 16 nt, Homo sapiens
agugacgcaucuccaa

SEQ ID NO: 1638452 - RNA, 21 nt, Homo sapiens
agugacuguucaagagcacac

SEQ ID NO: 1638453 - RNA, 17 nt, Homo sapiens
agugacuucacagagac

SEQ ID NO: 1638454 - RNA, 13 nt, Homo sapiens
agugagacuccac

SEQ ID NO: 1638455 - RNA, 19 nt, Homo sapiens
agugagucgaggacaggga

SEQ ID NO: 1638456 - RNA, 13 nt, Homo sapiens
agugagugaucac

SEQ ID NO: 1638457 - RNA, 19 nt, Homo sapiens
agugagugaucacugguau

SEQ ID NO: 1638458 - RNA, 12 nt, Homo sapiens
agugauguaauc

SEQ ID NO: 1638459 - RNA, 16 nt, Homo sapiens
agugauuggcucugug

SEQ ID NO: 1638460 - RNA, 15 nt, Homo sapiens
agugcaguggcacca

SEQ ID NO: 1638461 - RNA, 20 nt, Homo sapiens
agugcaguggcacgaucuca

SEQ ID NO: 1638462 - RNA, 15 nt, Homo sapiens
agugcguguguagag

SEQ ID NO: 1638463 - RNA, 19 nt, Homo sapiens
agugcuaauuuaguucuca

SEQ ID NO: 1638464 - RNA, 15 nt, Homo sapiens
agugcugaccagaca

SEQ ID NO: 1638465 - RNA, 15 nt, Homo sapiens
aguggacaccaauga

SEQ ID NO: 1638466 - RNA, 22 nt, Homo sapiens
aguggcauguggguugugauau

SEQ ID NO: 1638467 - RNA, 18 nt, Homo sapiens
agugggcccaaugcacuu

SEQ ID NO: 1638468 - RNA, 16 nt, Homo sapiens
agugggucccacuucc

SEQ ID NO: 1638469 - RNA, 21 nt, Homo sapiens
aguggugcgaucuggguucac

SEQ ID NO: 1638470 - RNA, 13 nt, Homo sapiens
agugguggagcug

SEQ ID NO: 1638471 - RNA, 15 nt, Homo sapiens
aguguaccagagaag

SEQ ID NO: 1638472 - RNA, 20 nt, Homo sapiens
aguguguuacuaucuacaaa

SEQ ID NO: 1638473 - RNA, 17 nt, Homo sapiens
aguguucacaaccugga

SEQ ID NO: 1638474 - RNA, 16 nt, Homo sapiens
aguguuccccuuccac

SEQ ID NO: 1638475 - RNA, 20 nt, Homo sapiens
aguguuggaaaaugugcaau

SEQ ID NO: 1638476 - RNA, 16 nt, Homo sapiens
aguuaucuuugaauau

SEQ ID NO: 1638477 - RNA, 16 nt, Homo sapiens
aguucaggcucugaga

SEQ ID NO: 1638478 - RNA, 17 nt, Homo sapiens
aguucggugagcuacaa

SEQ ID NO: 1638479 - RNA, 22 nt, Homo sapiens
aguugaaacugcuauagccuaa

SEQ ID NO: 1638480 - RNA, 17 nt, Homo sapiens
aguugauggugaugaaa

SEQ ID NO: 1638481 - RNA, 21 nt, Homo sapiens
aguugauucauauugcaucau

SEQ ID NO: 1638482 - RNA, 15 nt, Homo sapiens
aguugggugauaugu

SEQ ID NO: 1638483 - RNA, 18 nt, Homo sapiens
aguuggucccccuuccau

SEQ ID NO: 1638484 - RNA, 15 nt, Homo sapiens
aguuguuaauaaaag

SEQ ID NO: 1638485 - RNA, 21 nt, Homo sapiens
aguuguuucuacuacauggaa

SEQ ID NO: 1638486 - RNA, 16 nt, Homo sapiens
aguuuaaccugaugca

SEQ ID NO: 1638487 - RNA, 12 nt, Homo sapiens
auccaauacugc

SEQ ID NO: 1638488 - RNA, 12 nt, Homo sapiens
auccaauucauc

SEQ ID NO: 1638489 - RNA, 14 nt, Homo sapiens
auccacaugggagc

SEQ ID NO: 1638490 - RNA, 16 nt, Homo sapiens
auccacccaccucagc

SEQ ID NO: 1638491 - RNA, 18 nt, Homo sapiens
auccaccuccuucucugu

SEQ ID NO: 1638492 - RNA, 15 nt, Homo sapiens
auccaggaagacccc

SEQ ID NO: 1638493 - RNA, 15 nt, Homo sapiens
auccauucuaccugu

SEQ ID NO: 1638494 - RNA, 20 nt, Homo sapiens
auccauuugcguuccaugau

SEQ ID NO: 1638495 - RNA, 12 nt, Homo sapiens
aucccagcacuu

SEQ ID NO: 1638496 - RNA, 15 nt, Homo sapiens
aucccaugagccuca

SEQ ID NO: 1638497 - RNA, 16 nt, Homo sapiens
auccccaagccuggca

SEQ ID NO: 1638498 - RNA, 15 nt, Homo sapiens
auccgggaucaaagu

SEQ ID NO: 1638499 - RNA, 15 nt, Homo sapiens
auccuacaagacaca

SEQ ID NO: 1638500 - RNA, 17 nt, Homo sapiens
auccuacaagacacagu

SEQ ID NO: 1638501 - RNA, 18 nt, Homo sapiens
auccuggagggguguugu

SEQ ID NO: 1638502 - RNA, 20 nt, Homo sapiens
auccuguuaacacuguaaua

SEQ ID NO: 1638503 - RNA, 18 nt, Homo sapiens
auccuguuuuuaaaccau

SEQ ID NO: 1638504 - RNA, 14 nt, Homo sapiens
auccuuccaccuca

SEQ ID NO: 1638505 - RNA, 22 nt, Homo sapiens
aucuaaaauauuuucuacaucu

SEQ ID NO: 1638506 - RNA, 14 nt, Homo sapiens
aucuaauacacuuu

SEQ ID NO: 1638507 - RNA, 16 nt, Homo sapiens
aucuaaugacauucaa

SEQ ID NO: 1638508 - RNA, 14 nt, Homo sapiens
aucuaccaacgaaa

SEQ ID NO: 1638509 - RNA, 22 nt, Homo sapiens
aucuaugaaauaucaugcucca

SEQ ID NO: 1638510 - RNA, 21 nt, Homo sapiens
aucucaaacuacuggcaauuu

SEQ ID NO: 1638511 - RNA, 18 nt, Homo sapiens
aucucaacucacugcaag

SEQ ID NO: 1638512 - RNA, 23 nt, Homo sapiens
aucucagcuccugaaaaaugccu

SEQ ID NO: 1638513 - RNA, 19 nt, Homo sapiens
aucucagcuggaucuccau

SEQ ID NO: 1638514 - RNA, 20 nt, Homo sapiens
aucucauuggacccuuccau

SEQ ID NO: 1638515 - RNA, 23 nt, Homo sapiens
aucucauuggacccuuccauggu

SEQ ID NO: 1638516 - RNA, 20 nt, Homo sapiens
aucucggcucacugcaagcu

SEQ ID NO: 1638517 - RNA, 15 nt, Homo sapiens
aucucuaaagagcau

SEQ ID NO: 1638518 - RNA, 19 nt, Homo sapiens
aucucuacugaaaauacaa

SEQ ID NO: 1638519 - RNA, 22 nt, Homo sapiens
aucucugauucugucaaugucu

SEQ ID NO: 1638520 - RNA, 22 nt, Homo sapiens
aucucugcuuuggaaaucacac

SEQ ID NO: 1638521 - RNA, 13 nt, Homo sapiens
aucugacauauua

SEQ ID NO: 1638522 - RNA, 12 nt, Homo sapiens
aucugacuucau

SEQ ID NO: 1638523 - RNA, 20 nt, Homo sapiens
aucugcaauguuuuugugua

SEQ ID NO: 1638524 - RNA, 15 nt, Homo sapiens
aucugccacguguau

SEQ ID NO: 1638525 - RNA, 15 nt, Homo sapiens
aucugcgugacaaua

SEQ ID NO: 1638526 - RNA, 18 nt, Homo sapiens
aucugcuacugugucagg

SEQ ID NO: 1638527 - RNA, 14 nt, Homo sapiens
aucugcuaugcuau

SEQ ID NO: 1638528 - RNA, 15 nt, Homo sapiens
aucugcugucuuuau

SEQ ID NO: 1638529 - RNA, 23 nt, Homo sapiens
aucugggcauagaugcaggugag

SEQ ID NO: 1638530 - RNA, 23 nt, Homo sapiens
aucuuaaacauaauaaaucacac

SEQ ID NO: 1638531 - RNA, 15 nt, Homo sapiens
aucuuacagucagca

SEQ ID NO: 1638532 - RNA, 19 nt, Homo sapiens
aucuuacagucagcacaga

SEQ ID NO: 1638533 - RNA, 15 nt, Homo sapiens
aucuuuacucaggca

SEQ ID NO: 1638534 - RNA, 21 nt, Homo sapiens
aucuuucaaagugucuugaau

SEQ ID NO: 1638535 - RNA, 12 nt, Homo sapiens
aucuuugcagac

SEQ ID NO: 1638536 - RNA, 20 nt, Homo sapiens
aucuuuggacagaagcagcu

SEQ ID NO: 1638537 - RNA, 24 nt, Homo sapiens
aucuuuuauacauuuuagaaucag

SEQ ID NO: 1638538 - RNA, 15 nt, Homo sapiens
aucuuuucacaaaua

SEQ ID NO: 1638539 - RNA, 16 nt, Homo sapiens
aucuuuucacaaauaa

SEQ ID NO: 1638540 - RNA, 20 nt, Homo sapiens
augaaaaauaagucacuuau

SEQ ID NO: 1638541 - RNA, 16 nt, Homo sapiens
augaaauaucaugcuc

SEQ ID NO: 1638542 - RNA, 17 nt, Homo sapiens
augaaauaucaugcucc

SEQ ID NO: 1638543 - RNA, 14 nt, Homo sapiens
augaacacaauaca

SEQ ID NO: 1638544 - RNA, 20 nt, Homo sapiens
augaaccugcccugcuccca

SEQ ID NO: 1638545 - RNA, 23 nt, Homo sapiens
augaaccugcccugcucccacag

SEQ ID NO: 1638546 - RNA, 17 nt, Homo sapiens
augaaccuugcuaucaa

SEQ ID NO: 1638547 - RNA, 21 nt, Homo sapiens
augaaccuugcuaucaagaaa

SEQ ID NO: 1638548 - RNA, 18 nt, Homo sapiens
augaagguggaacaagca

SEQ ID NO: 1638549 - RNA, 21 nt, Homo sapiens
augaagguggaacaagcacag

SEQ ID NO: 1638550 - RNA, 22 nt, Homo sapiens
augaaguugauucauauugcau

SEQ ID NO: 1638551 - RNA, 17 nt, Homo sapiens
augacaauaagccacga

SEQ ID NO: 1638552 - RNA, 13 nt, Homo sapiens
augacauucaugc

SEQ ID NO: 1638553 - RNA, 13 nt, Homo sapiens
augagagcauaau

SEQ ID NO: 1638554 - RNA, 20 nt, Homo sapiens
augagcaucccaggaucgca

SEQ ID NO: 1638555 - RNA, 16 nt, Homo sapiens
augagcucaaauugau

SEQ ID NO: 1638556 - RNA, 21 nt, Homo sapiens
augaggguucaucaucccucc

SEQ ID NO: 1638557 - RNA, 19 nt, Homo sapiens
augauaaaaaaguguccua

SEQ ID NO: 1638558 - RNA, 16 nt, Homo sapiens
augauuucacagugug

SEQ ID NO: 1638559 - RNA, 15 nt, Homo sapiens
augcaacaacaugua

SEQ ID NO: 1638560 - RNA, 16 nt, Homo sapiens
augcaacaacauguau

SEQ ID NO: 1638561 - RNA, 12 nt, Homo sapiens
augcacaguggg

SEQ ID NO: 1638562 - RNA, 13 nt, Homo sapiens
augcagacaugag

SEQ ID NO: 1638563 - RNA, 13 nt, Homo sapiens
augcagcgugaag

SEQ ID NO: 1638564 - RNA, 14 nt, Homo sapiens
augcagcucugcag

SEQ ID NO: 1638565 - RNA, 14 nt, Homo sapiens
augcauaaaugcga

SEQ ID NO: 1638566 - RNA, 20 nt, Homo sapiens
augcaucugcuacuguguca

SEQ ID NO: 1638567 - RNA, 16 nt, Homo sapiens
augccaagcacugugc

SEQ ID NO: 1638568 - RNA, 21 nt, Homo sapiens
augccaagcacugugcucagg

SEQ ID NO: 1638569 - RNA, 18 nt, Homo sapiens
augcccacguaugugaaa

SEQ ID NO: 1638570 - RNA, 19 nt, Homo sapiens
augcccuguaccugugcac

SEQ ID NO: 1638571 - RNA, 15 nt, Homo sapiens
augcguuuaaucaca

SEQ ID NO: 1638572 - RNA, 17 nt, Homo sapiens
augcucuccaaaccacu

SEQ ID NO: 1638573 - RNA, 18 nt, Homo sapiens
augcugugcaaacagugu

SEQ ID NO: 1638574 - RNA, 15 nt, Homo sapiens
augcuuuuauagcug

SEQ ID NO: 1638575 - RNA, 13 nt, Homo sapiens
auggaaacacuga

SEQ ID NO: 1638576 - RNA, 23 nt, Homo sapiens
auggaaccuccuuucucuucucu

SEQ ID NO: 1638577 - RNA, 13 nt, Homo sapiens
auggaaugcuucu

SEQ ID NO: 1638578 - RNA, 13 nt, Homo sapiens
auggacaauggac

SEQ ID NO: 1638579 - RNA, 23 nt, Homo sapiens
auggacaugugucccagccacag

SEQ ID NO: 1638580 - RNA, 16 nt, Homo sapiens
auggacuuucuugcaa

SEQ ID NO: 1638581 - RNA, 16 nt, Homo sapiens
auggaguguuugacga

SEQ ID NO: 1638582 - RNA, 14 nt, Homo sapiens
auggcaaacugcca

SEQ ID NO: 1638583 - RNA, 22 nt, Homo sapiens
auggcacagcccaaagaaggaa

SEQ ID NO: 1638584 - RNA, 16 nt, Homo sapiens
auggcacccaugcacc

SEQ ID NO: 1638585 - RNA, 15 nt, Homo sapiens
auggcagaagacacc

SEQ ID NO: 1638586 - RNA, 19 nt, Homo sapiens
auggccccugccuucccag

SEQ ID NO: 1638587 - RNA, 16 nt, Homo sapiens
auggcucuacuuucag

SEQ ID NO: 1638588 - RNA, 15 nt, Homo sapiens
augggagacacugau

SEQ ID NO: 1638589 - RNA, 15 nt, Homo sapiens
augggcagcucaucu

SEQ ID NO: 1638590 - RNA, 22 nt, Homo sapiens
auggggaaguaggaauguggaa

SEQ ID NO: 1638591 - RNA, 23 nt, Homo sapiens
auggguuagggaaaacauuccau

SEQ ID NO: 1638592 - RNA, 18 nt, Homo sapiens
augguccgccugccucag

SEQ ID NO: 1638593 - RNA, 23 nt, Homo sapiens
augguccgccugccucagccucc

SEQ ID NO: 1638594 - RNA, 18 nt, Homo sapiens
augguguaauaagacaua

SEQ ID NO: 1638595 - RNA, 23 nt, Homo sapiens
augguucuggacggcccagcagc

SEQ ID NO: 1638596 - RNA, 14 nt, Homo sapiens
augguuugugucaa

SEQ ID NO: 1638597 - RNA, 15 nt, Homo sapiens
auuucagugcugcug

SEQ ID NO: 1638598 - RNA, 13 nt, Homo sapiens
auuucauacugua

SEQ ID NO: 1638599 - RNA, 14 nt, Homo sapiens
auuucauacuguaa

SEQ ID NO: 1638600 - RNA, 15 nt, Homo sapiens
auuucauacuguaac

SEQ ID NO: 1638601 - RNA, 13 nt, Homo sapiens
auuucauaugaca

SEQ ID NO: 1638602 - RNA, 23 nt, Homo sapiens
auuuccugugucuuuuuucacua

SEQ ID NO: 1638603 - RNA, 17 nt, Homo sapiens
auuucucuacugucuca

SEQ ID NO: 1638604 - RNA, 17 nt, Homo sapiens
auuugaaaccaggacau

SEQ ID NO: 1638605 - RNA, 21 nt, Homo sapiens
auuugaaaccaggacauuaaa

SEQ ID NO: 1638606 - RNA, 16 nt, Homo sapiens
auuugccuugacaaac

SEQ ID NO: 1638607 - RNA, 23 nt, Homo sapiens
auuugguuuguugagccuaauau

SEQ ID NO: 1638608 - RNA, 21 nt, Homo sapiens
auuuguauuuccccaaugacu

SEQ ID NO: 1638609 - RNA, 21 nt, Homo sapiens
auuugucaacaaagucaccca

SEQ ID NO: 1638610 - RNA, 15 nt, Homo sapiens
auuugugaauuugca

SEQ ID NO: 1638611 - RNA, 14 nt, Homo sapiens
auuuguuugugcau

SEQ ID NO: 1638612 - RNA, 21 nt, Homo sapiens
auuuuauaccaaagccaauaa

SEQ ID NO: 1638613 - RNA, 22 nt, Homo sapiens
auuuuauagaugggcaacuggc

SEQ ID NO: 1638614 - RNA, 16 nt, Homo sapiens
auuuuauuccaaaaua

SEQ ID NO: 1638615 - RNA, 14 nt, Homo sapiens
auuuucuugucaau

SEQ ID NO: 1638616 - RNA, 23 nt, Homo sapiens
auuuuuccccaaaaagaauggga

SEQ ID NO: 1638617 - RNA, 14 nt, Homo sapiens
auuuuucuaaagaa

SEQ ID NO: 1638618 - RNA, 17 nt, Homo sapiens
caaaaauugucccuuaa

SEQ ID NO: 1638619 - RNA, 11 nt, Homo sapiens
caaaaccaaau

SEQ ID NO: 1638620 - RNA, 20 nt, Homo sapiens
caaaacuuggaauucucuca

SEQ ID NO: 1638621 - RNA, 19 nt, Homo sapiens
caaaagcacuuugugcugu

SEQ ID NO: 1638622 - RNA, 15 nt, Homo sapiens
caaaagcccauucau

SEQ ID NO: 1638623 - RNA, 20 nt, Homo sapiens
caaaagcccauucauuccau

SEQ ID NO: 1638624 - RNA, 22 nt, Homo sapiens
caaaagcccauucauuccauuc

SEQ ID NO: 1638625 - RNA, 16 nt, Homo sapiens
caaaaugaaccuugcu

SEQ ID NO: 1638626 - RNA, 20 nt, Homo sapiens
caaaauggacucaagagaga

SEQ ID NO: 1638627 - RNA, 14 nt, Homo sapiens
caaacaccuggacu

SEQ ID NO: 1638628 - RNA, 17 nt, Homo sapiens
caaacagaacuauggaa

SEQ ID NO: 1638629 - RNA, 11 nt, Homo sapiens
caaacagugaa

SEQ ID NO: 1638630 - RNA, 23 nt, Homo sapiens
caaacuaccuuccaguuccucau

SEQ ID NO: 1638631 - RNA, 22 nt, Homo sapiens
caaacuccuagguucacuuugg

SEQ ID NO: 1638632 - RNA, 16 nt, Homo sapiens
caaacuguaguuguuu

SEQ ID NO: 1638633 - RNA, 19 nt, Homo sapiens
caaagaaacagagugcuaa

SEQ ID NO: 1638634 - RNA, 13 nt, Homo sapiens
caaagaaauccuc

SEQ ID NO: 1638635 - RNA, 13 nt, Homo sapiens
caaagaaauuucc

SEQ ID NO: 1638636 - RNA, 16 nt, Homo sapiens
caaagacaaaggugag

SEQ ID NO: 1638637 - RNA, 13 nt, Homo sapiens
caaagacuuuccu

SEQ ID NO: 1638638 - RNA, 23 nt, Homo sapiens
caaagauguuaugguguuuagau

SEQ ID NO: 1638639 - RNA, 23 nt, Homo sapiens
caaagcaaggaaacuauguaaca

SEQ ID NO: 1638640 - RNA, 23 nt, Homo sapiens
caaagcagggucugggcaggacu

SEQ ID NO: 1638641 - RNA, 14 nt, Homo sapiens
caaagcauuugcaa

SEQ ID NO: 1638642 - RNA, 22 nt, Homo sapiens
caaagcuuucauguaaacugug

SEQ ID NO: 1638643 - RNA, 16 nt, Homo sapiens
caaaggaauccaugua

SEQ ID NO: 1638644 - RNA, 13 nt, Homo sapiens
caaaggcugagaa

SEQ ID NO: 1638645 - RNA, 21 nt, Homo sapiens
caaaggcugagaacacuguga

SEQ ID NO: 1638646 - RNA, 20 nt, Homo sapiens
caaagggcaugggucgggag

SEQ ID NO: 1638647 - RNA, 18 nt, Homo sapiens
caaauacuauccaaauaa

SEQ ID NO: 1638648 - RNA, 17 nt, Homo sapiens
caaauauuauucuuaau

SEQ ID NO: 1638649 - RNA, 15 nt, Homo sapiens
caaauauuccagaga

SEQ ID NO: 1638650 - RNA, 14 nt, Homo sapiens
caaaucaucucuca

SEQ ID NO: 1638651 - RNA, 13 nt, Homo sapiens
caaaucucuauua

SEQ ID NO: 1638652 - RNA, 20 nt, Homo sapiens
caaaugcauacaaguuucau

SEQ ID NO: 1638653 - RNA, 14 nt, Homo sapiens
caaaugcugugcaa

SEQ ID NO: 1638654 - RNA, 20 nt, Homo sapiens
caaauggaagacacauugaa

SEQ ID NO: 1638655 - RNA, 14 nt, Homo sapiens
caaauugcagacug

SEQ ID NO: 1638656 - RNA, 16 nt, Homo sapiens
caaauuggauacugcu

SEQ ID NO: 1638657 - RNA, 12 nt, Homo sapiens
caacaacaugua

SEQ ID NO: 1638658 - RNA, 22 nt, Homo sapiens
caacaagcaagcucccaaggga

SEQ ID NO: 1638659 - RNA, 14 nt, Homo sapiens
caacaauuuaccuu

SEQ ID NO: 1638660 - RNA, 13 nt, Homo sapiens
caacagacuugaa

SEQ ID NO: 1638661 - RNA, 14 nt, Homo sapiens
caacagcacccucu

SEQ ID NO: 1638662 - RNA, 12 nt, Homo sapiens
caacaucuucaa

SEQ ID NO: 1638663 - RNA, 19 nt, Homo sapiens
caacaugccagccacugug

SEQ ID NO: 1638664 - RNA, 22 nt, Homo sapiens
caacccugugauacuauuacca

SEQ ID NO: 1638665 - RNA, 15 nt, Homo sapiens
caaccuguucugcuu

SEQ ID NO: 1638666 - RNA, 15 nt, Homo sapiens
caacucuguacaaag

SEQ ID NO: 1638667 - RNA, 22 nt, Homo sapiens
caacuggugauuguuucagaga

SEQ ID NO: 1638668 - RNA, 22 nt, Homo sapiens
caacuuccaaauuggauacugc

SEQ ID NO: 1638669 - RNA, 18 nt, Homo sapiens
caagaaagauaucuauga

SEQ ID NO: 1638670 - RNA, 13 nt, Homo sapiens
caagaagggcuag

SEQ ID NO: 1638671 - RNA, 10 nt, Homo sapiens
caagacauag

SEQ ID NO: 1638672 - RNA, 22 nt, Homo sapiens
caagaccugauuucugagcauu

SEQ ID NO: 1638673 - RNA, 16 nt, Homo sapiens
caagagcuuccagagc

SEQ ID NO: 1638674 - RNA, 21 nt, Homo sapiens
caagauccaaaugcugugcaa

SEQ ID NO: 1638675 - RNA, 14 nt, Homo sapiens
caagcaaauggcca

SEQ ID NO: 1638676 - RNA, 19 nt, Homo sapiens
caagcaagcucccaaggga

SEQ ID NO: 1638677 - RNA, 21 nt, Homo sapiens
caagcaagcucccaagggaug

SEQ ID NO: 1638678 - RNA, 14 nt, Homo sapiens
caagcaguagacaa

SEQ ID NO: 1638679 - RNA, 15 nt, Homo sapiens
caagcauuuaaugua

SEQ ID NO: 1638680 - RNA, 21 nt, Homo sapiens
caagcauuuaauguagccaug

SEQ ID NO: 1638681 - RNA, 13 nt, Homo sapiens
caagcucccaagg

SEQ ID NO: 1638682 - RNA, 11 nt, Homo sapiens
caagcucugcu

SEQ ID NO: 1638683 - RNA, 16 nt, Homo sapiens
caagcuucuucacuca

SEQ ID NO: 1638684 - RNA, 14 nt, Homo sapiens
caaggaaauaugag

SEQ ID NO: 1638685 - RNA, 19 nt, Homo sapiens
caaggacaaaaaaccucag

SEQ ID NO: 1638686 - RNA, 15 nt, Homo sapiens
caaggacacagauga

SEQ ID NO: 1638687 - RNA, 14 nt, Homo sapiens
caaggcacugccug

SEQ ID NO: 1638688 - RNA, 17 nt, Homo sapiens
caaggccagaugcacau

SEQ ID NO: 1638689 - RNA, 16 nt, Homo sapiens
caaggcugugcucccu

SEQ ID NO: 1638690 - RNA, 21 nt, Homo sapiens
caagggaauucggugugcacc

SEQ ID NO: 1638691 - RNA, 23 nt, Homo sapiens
caagggcugagauucuucgugua

SEQ ID NO: 1638692 - RNA, 15 nt, Homo sapiens
caaggucauuugcua

SEQ ID NO: 1638693 - RNA, 17 nt, Homo sapiens
caaggugacauuuccau

SEQ ID NO: 1638694 - RNA, 17 nt, Homo sapiens
caaguacuguaacugug

SEQ ID NO: 1638695 - RNA, 12 nt, Homo sapiens
caagucauucuc

SEQ ID NO: 1638696 - RNA, 14 nt, Homo sapiens
caagugauucucau

SEQ ID NO: 1638697 - RNA, 16 nt, Homo sapiens
caagugauucucaugc

SEQ ID NO: 1638698 - RNA, 23 nt, Homo sapiens
caaguggcugugacaucuacgua

SEQ ID NO: 1638699 - RNA, 13 nt, Homo sapiens
caaguguucacaa

SEQ ID NO: 1638700 - RNA, 15 nt, Homo sapiens
caaguuaguucaauc

SEQ ID NO: 1638701 - RNA, 13 nt, Homo sapiens
caaguuccagugc

SEQ ID NO: 1638702 - RNA, 18 nt, Homo sapiens
caaguuccagugcagaga

SEQ ID NO: 1638703 - RNA, 20 nt, Homo sapiens
caaguuggcuucuaaucaaa

SEQ ID NO: 1638704 - RNA, 14 nt, Homo sapiens
caauaaauguuugu

SEQ ID NO: 1638705 - RNA, 18 nt, Homo sapiens
caauaacacacagcuaac

SEQ ID NO: 1638706 - RNA, 19 nt, Homo sapiens
caauaauuuuccugugaca

SEQ ID NO: 1638707 - RNA, 23 nt, Homo sapiens
ucagagugacuacacacaguacg

SEQ ID NO: 1638708 - RNA, 19 nt, Homo sapiens
ucagaguuccgacugccau

SEQ ID NO: 1638709 - RNA, 18 nt, Homo sapiens
ucagauuccgcaccaaua

SEQ ID NO: 1638710 - RNA, 22 nt, Homo sapiens
ucagcaagcauuuucguuacau

SEQ ID NO: 1638711 - RNA, 16 nt, Homo sapiens
ucagcaccuacagugu

SEQ ID NO: 1638712 - RNA, 20 nt, Homo sapiens
ucagccaggugcugugacac

SEQ ID NO: 1638713 - RNA, 13 nt, Homo sapiens
ucagcuauauacu

SEQ ID NO: 1638714 - RNA, 19 nt, Homo sapiens
ucagcucucaguugcagcc

SEQ ID NO: 1638715 - RNA, 21 nt, Homo sapiens
ucagcuggaucuccauucucu

SEQ ID NO: 1638716 - RNA, 18 nt, Homo sapiens
ucagcuucugcugggcug

SEQ ID NO: 1638717 - RNA, 21 nt, Homo sapiens
ucaggacacuaauacaccagg

SEQ ID NO: 1638718 - RNA, 16 nt, Homo sapiens
ucaggagaaaaagccu

SEQ ID NO: 1638719 - RNA, 15 nt, Homo sapiens
ucaggagcagccuca

SEQ ID NO: 1638720 - RNA, 21 nt, Homo sapiens
ucaggagcagccucagaacaa

SEQ ID NO: 1638721 - RNA, 16 nt, Homo sapiens
ucaggaguuccagugc

SEQ ID NO: 1638722 - RNA, 14 nt, Homo sapiens
ucaggccaucauca

SEQ ID NO: 1638723 - RNA, 12 nt, Homo sapiens
ucaggugacaug

SEQ ID NO: 1638724 - RNA, 22 nt, Homo sapiens
ucaggugucccugcacuugcag

SEQ ID NO: 1638725 - RNA, 18 nt, Homo sapiens
ucaguaagacgacaagga

SEQ ID NO: 1638726 - RNA, 20 nt, Homo sapiens
ucaguaagacgacaaggaaa

SEQ ID NO: 1638727 - RNA, 10 nt, Homo sapiens
ucagugucca

SEQ ID NO: 1638728 - RNA, 18 nt, Homo sapiens
ucaguuauuauauuuaca

SEQ ID NO: 1638729 - RNA, 13 nt, Homo sapiens
ucaguuauuugca

SEQ ID NO: 1638730 - RNA, 23 nt, Homo sapiens
ucaguuuuuuuuuauacacugua

SEQ ID NO: 1638731 - RNA, 23 nt, Homo sapiens
ucauaaagucuuugaagugacuu

SEQ ID NO: 1638732 - RNA, 15 nt, Homo sapiens
ucauaagaauucugu

SEQ ID NO: 1638733 - RNA, 21 nt, Homo sapiens
ucauaccugugaauauagaua

SEQ ID NO: 1638734 - RNA, 19 nt, Homo sapiens
ucauagaauacucagggaa

SEQ ID NO: 1638735 - RNA, 22 nt, Homo sapiens
ucauagggaggccuuuagcuua

SEQ ID NO: 1638736 - RNA, 18 nt, Homo sapiens
ucauauguuuaugguaau

SEQ ID NO: 1638737 - RNA, 12 nt, Homo sapiens
ucauauugcauc

SEQ ID NO: 1638738 - RNA, 18 nt, Homo sapiens
ucauauugcaucauaguu

SEQ ID NO: 1638739 - RNA, 16 nt, Homo sapiens
ucaucacacaacucag

SEQ ID NO: 1638740 - RNA, 13 nt, Homo sapiens
ucaucacuuugac

SEQ ID NO: 1638741 - RNA, 16 nt, Homo sapiens
ucaucaggaguuccag

SEQ ID NO: 1638742 - RNA, 16 nt, Homo sapiens
ucauccacugugccau

SEQ ID NO: 1638743 - RNA, 13 nt, Homo sapiens
ucaucucaaggaa

SEQ ID NO: 1638744 - RNA, 17 nt, Homo sapiens
ucaucucccaaagugcu

SEQ ID NO: 1638745 - RNA, 12 nt, Homo sapiens
ucaucuugccac

SEQ ID NO: 1638746 - RNA, 18 nt, Homo sapiens
ucaugaaucugcaaugug

SEQ ID NO: 1638747 - RNA, 20 nt, Homo sapiens
ucaugacugagucuggcaaa

SEQ ID NO: 1638748 - RNA, 14 nt, Homo sapiens
ucaugaucaucaca

SEQ ID NO: 1638749 - RNA, 14 nt, Homo sapiens
ucaugcauuugcac

SEQ ID NO: 1638750 - RNA, 16 nt, Homo sapiens
ucauggugcuguugcc

SEQ ID NO: 1638751 - RNA, 13 nt, Homo sapiens
ucauuagcaguug

SEQ ID NO: 1638752 - RNA, 20 nt, Homo sapiens
ucauuagcaguugcucacau

SEQ ID NO: 1638753 - RNA, 14 nt, Homo sapiens
ucauuccccggggc

SEQ ID NO: 1638754 - RNA, 23 nt, Homo sapiens
ucauucuguaaagucuagcacag

SEQ ID NO: 1638755 - RNA, 13 nt, Homo sapiens
ucauucugugacc

SEQ ID NO: 1638756 - RNA, 20 nt, Homo sapiens
ucauugaccugaggcccuuc

SEQ ID NO: 1638757 - RNA, 13 nt, Homo sapiens
ucauuuacugugg

SEQ ID NO: 1638758 - RNA, 12 nt, Homo sapiens
uccaaaagcaaa

SEQ ID NO: 1638759 - RNA, 14 nt, Homo sapiens
uccaaaggccaugg

SEQ ID NO: 1638760 - RNA, 20 nt, Homo sapiens
uccaaauaaaaauaacauca

SEQ ID NO: 1638761 - RNA, 20 nt, Homo sapiens
uccaacaugugcucagggaa

SEQ ID NO: 1638762 - RNA, 19 nt, Homo sapiens
uccaaccccccagcacuga

SEQ ID NO: 1638763 - RNA, 14 nt, Homo sapiens
uccaaucauacaaa

SEQ ID NO: 1638764 - RNA, 14 nt, Homo sapiens
uccaauuaaugaag

SEQ ID NO: 1638765 - RNA, 20 nt, Homo sapiens
uccacacucaguagaaggag

SEQ ID NO: 1638766 - RNA, 13 nt, Homo sapiens
uccacagugacuc

SEQ ID NO: 1638767 - RNA, 15 nt, Homo sapiens
uccacagugacucca

SEQ ID NO: 1638768 - RNA, 20 nt, Homo sapiens
uccaccuaguggcuguccag

SEQ ID NO: 1638769 - RNA, 23 nt, Homo sapiens
uccacgcggccaccucacccucu

SEQ ID NO: 1638770 - RNA, 20 nt, Homo sapiens
uccacuaagaacaccugcau

SEQ ID NO: 1638771 - RNA, 11 nt, Homo sapiens
uccacucccag

SEQ ID NO: 1638772 - RNA, 14 nt, Homo sapiens
uccacugugccaug

SEQ ID NO: 1638773 - RNA, 17 nt, Homo sapiens
uccacuuguucauucug

SEQ ID NO: 1638774 - RNA, 12 nt, Homo sapiens
uccagacacaug

SEQ ID NO: 1638775 - RNA, 14 nt, Homo sapiens
uccagacccggcug

SEQ ID NO: 1638776 - RNA, 17 nt, Homo sapiens
uccagaugagaguacac

SEQ ID NO: 1638777 - RNA, 13 nt, Homo sapiens
uccagccccugga

SEQ ID NO: 1638778 - RNA, 17 nt, Homo sapiens
uccagccugacaacagc

SEQ ID NO: 1638779 - RNA, 14 nt, Homo sapiens
uaucucacuugugc

SEQ ID NO: 1638780 - RNA, 14 nt, Homo sapiens
uaucugaguugacu

SEQ ID NO: 1638781 - RNA, 17 nt, Homo sapiens
uaucuuucuaaaacugc

SEQ ID NO: 1638782 - RNA, 12 nt, Homo sapiens
uaugacauauga

SEQ ID NO: 1638783 - RNA, 19 nt, Homo sapiens
uaugcaccaaaucaucucu

SEQ ID NO: 1638784 - RNA, 21 nt, Homo sapiens
uaugcagagguccacaacaca

SEQ ID NO: 1638785 - RNA, 12 nt, Homo sapiens
uaugcagugaua

SEQ ID NO: 1638786 - RNA, 15 nt, Homo sapiens
uaugcaucugcuacu

SEQ ID NO: 1638787 - RNA, 21 nt, Homo sapiens
uaugccauggaggcacuaaca

SEQ ID NO: 1638788 - RNA, 16 nt, Homo sapiens
uaugcuaccuacugau

SEQ ID NO: 1638789 - RNA, 16 nt, Homo sapiens
uaugcucccucugugu

SEQ ID NO: 1638790 - RNA, 21 nt, Homo sapiens
uauguagaauauauuuccuua

SEQ ID NO: 1638791 - RNA, 23 nt, Homo sapiens
uauguauaaauuaauacagagua

SEQ ID NO: 1638792 - RNA, 18 nt, Homo sapiens
uaugucucagaccacuau

SEQ ID NO: 1638793 - RNA, 15 nt, Homo sapiens
uaugugcacaucugu

SEQ ID NO: 1638794 - RNA, 17 nt, Homo sapiens
uauguugcccagugugu

SEQ ID NO: 1638795 - RNA, 23 nt, Homo sapiens
uauguuuggaauauuccacuauu

SEQ ID NO: 1638796 - RNA, 13 nt, Homo sapiens
uauuaaaagacuc

SEQ ID NO: 1638797 - RNA, 21 nt, Homo sapiens
uauuaaaaucacugucaauau

SEQ ID NO: 1638798 - RNA, 16 nt, Homo sapiens
uauuauaaaaguacua

SEQ ID NO: 1638799 - RNA, 18 nt, Homo sapiens
uauuauagaauugcacau

SEQ ID NO: 1638800 - RNA, 18 nt, Homo sapiens
uauuaugccugaaugacu

SEQ ID NO: 1638801 - RNA, 12 nt, Homo sapiens
uauucagaugua

SEQ ID NO: 1638802 - RNA, 23 nt, Homo sapiens
uauucaugaagcggucacagauc

SEQ ID NO: 1638803 - RNA, 12 nt, Homo sapiens
uauuccagagac

SEQ ID NO: 1638804 - RNA, 18 nt, Homo sapiens
uauuccuuugcauauuau

SEQ ID NO: 1638805 - RNA, 15 nt, Homo sapiens
uauugcagcuuauau

SEQ ID NO: 1638806 - RNA, 13 nt, Homo sapiens
uauugugcauaga

SEQ ID NO: 1638807 - RNA, 14 nt, Homo sapiens
uauuuaacaacugg

SEQ ID NO: 1638808 - RNA, 12 nt, Homo sapiens
uauuuauagucg

SEQ ID NO: 1638809 - RNA, 13 nt, Homo sapiens
uauuucacuuuag

SEQ ID NO: 1638810 - RNA, 16 nt, Homo sapiens
uauuucuaguuauuac

SEQ ID NO: 1638811 - RNA, 20 nt, Homo sapiens
uauuucuaguuauuacccag

SEQ ID NO: 1638812 - RNA, 14 nt, Homo sapiens
uauuugaaagcagg

SEQ ID NO: 1638813 - RNA, 20 nt, Homo sapiens
uauuugcacaaguucaguga

SEQ ID NO: 1638814 - RNA, 22 nt, Homo sapiens
uauuugcacaaguucagugaga

SEQ ID NO: 1638815 - RNA, 14 nt, Homo sapiens
uauuugugaugaca

SEQ ID NO: 1638816 - RNA, 19 nt, Homo sapiens
uauuuuauaaguaucuuca

SEQ ID NO: 1638817 - RNA, 16 nt, Homo sapiens
uauuuugguugcugau

SEQ ID NO: 1638818 - RNA, 15 nt, Homo sapiens
uauuuugguuuagug

SEQ ID NO: 1638819 - RNA, 23 nt, Homo sapiens
uauuuugguuuagugcaaaguau

SEQ ID NO: 1638820 - RNA, 23 nt, Homo sapiens
ucaaaaaaaaaaaaaagaaucca

SEQ ID NO: 1638821 - RNA, 20 nt, Homo sapiens
ucaaaaaaaaaaaaauguga

SEQ ID NO: 1638822 - RNA, 20 nt, Homo sapiens
ucaaaaauacucacauggcu

SEQ ID NO: 1638823 - RNA, 21 nt, Homo sapiens
ucaaaacccaacaugacuguu

SEQ ID NO: 1638824 - RNA, 14 nt, Homo sapiens
ucaaaaccuacaca

SEQ ID NO: 1638825 - RNA, 15 nt, Homo sapiens
ucaaaaccuacacag

SEQ ID NO: 1638826 - RNA, 20 nt, Homo sapiens
ucaaaauagucuaaggccau

SEQ ID NO: 1638827 - RNA, 20 nt, Homo sapiens
ucaaagcacuguuucucuca

SEQ ID NO: 1638828 - RNA, 10 nt, Homo sapiens
ucaaagccag

SEQ ID NO: 1638829 - RNA, 22 nt, Homo sapiens
ucaaagugagcuccuaagccau

SEQ ID NO: 1638830 - RNA, 23 nt, Homo sapiens
ucaaaugagaaaaugucuuuauu

SEQ ID NO: 1638831 - RNA, 14 nt, Homo sapiens
ucaacaaagucacc

SEQ ID NO: 1638832 - RNA, 16 nt, Homo sapiens
ucaacaaagucaccca

SEQ ID NO: 1638833 - RNA, 15 nt, Homo sapiens
ucaacugguuguaua

SEQ ID NO: 1638834 - RNA, 19 nt, Homo sapiens
ucaacuguuuuugucuaca

SEQ ID NO: 1638835 - RNA, 17 nt, Homo sapiens
ucaagagauagagacca

SEQ ID NO: 1638836 - RNA, 20 nt, Homo sapiens
ucaaggacugguaaaauaca

SEQ ID NO: 1638837 - RNA, 19 nt, Homo sapiens
ucaaggccucccacaguga

SEQ ID NO: 1638838 - RNA, 23 nt, Homo sapiens
ucaaggguagggugggccuucag

SEQ ID NO: 1638839 - RNA, 23 nt, Homo sapiens
ucaaguacuguaacugugucaug

SEQ ID NO: 1638840 - RNA, 14 nt, Homo sapiens
ucaaguuccagugc

SEQ ID NO: 1638841 - RNA, 18 nt, Homo sapiens
ucaauacuuacauaucug

SEQ ID NO: 1638842 - RNA, 18 nt, Homo sapiens
ucaauauuaagucauugu

SEQ ID NO: 1638843 - RNA, 13 nt, Homo sapiens
ucaauauuuacua

SEQ ID NO: 1638844 - RNA, 21 nt, Homo sapiens
ucaauauuuacuauuucaaua

SEQ ID NO: 1638845 - RNA, 13 nt, Homo sapiens
ucaauccaagagu

SEQ ID NO: 1638846 - RNA, 16 nt, Homo sapiens
ucaaucucugauucug

SEQ ID NO: 1638847 - RNA, 12 nt, Homo sapiens
ucaaugcuauaa

SEQ ID NO: 1638848 - RNA, 21 nt, Homo sapiens
ucaauucuauuacgugcaaua

SEQ ID NO: 1638849 - RNA, 14 nt, Homo sapiens
ucaauuucucccca

SEQ ID NO: 1638850 - RNA, 22 nt, Homo sapiens
ucacacaugccacuaugagcuu

SEQ ID NO: 1638851 - RNA, 17 nt, Homo sapiens
ucacacauuacaaaguu

SEQ ID NO: 1638852 - RNA, 18 nt, Homo sapiens
ucacacauuugccuugac

SEQ ID NO: 1638853 - RNA, 13 nt, Homo sapiens
ucacaccacugua

SEQ ID NO: 1638854 - RNA, 16 nt, Homo sapiens
cuuuggaaauacacag

SEQ ID NO: 1638855 - RNA, 21 nt, Homo sapiens
cuuuggacagaagcagcucuu

SEQ ID NO: 1638856 - RNA, 12 nt, Homo sapiens
cuuuggucuauc

SEQ ID NO: 1638857 - RNA, 15 nt, Homo sapiens
cuuuguaaacuucca

SEQ ID NO: 1638858 - RNA, 22 nt, Homo sapiens
cuuuguacacgaagaccaucca

SEQ ID NO: 1638859 - RNA, 24 nt, Homo sapiens
cuuuguauccucugaccuacauac

SEQ ID NO: 1638860 - RNA, 15 nt, Homo sapiens
cuuuuaaacuuugau

SEQ ID NO: 1638861 - RNA, 18 nt, Homo sapiens
cuuuuaacagaacagaca

SEQ ID NO: 1638862 - RNA, 14 nt, Homo sapiens
cuuuuaacauaaua

SEQ ID NO: 1638863 - RNA, 14 nt, Homo sapiens
cuuuuacaccaguu

SEQ ID NO: 1638864 - RNA, 16 nt, Homo sapiens
cuuuuauaaaccucua

SEQ ID NO: 1638865 - RNA, 15 nt, Homo sapiens
cuuuuauacauuuua

SEQ ID NO: 1638866 - RNA, 16 nt, Homo sapiens
cuuuuauacauuuuag

SEQ ID NO: 1638867 - RNA, 23 nt, Homo sapiens
cuuuuauauugauaacagcacug

SEQ ID NO: 1638868 - RNA, 23 nt, Homo sapiens
cuuuucauuagcaguugcucaca

SEQ ID NO: 1638869 - RNA, 17 nt, Homo sapiens
cuuuuccucucaugucu

SEQ ID NO: 1638870 - RNA, 20 nt, Homo sapiens
cuuuucugacccauguucac

SEQ ID NO: 1638871 - RNA, 18 nt, Homo sapiens
cuuuucuugccucugucc

SEQ ID NO: 1638872 - RNA, 21 nt, Homo sapiens
cuuuugaccuguggugcaaaa

SEQ ID NO: 1638873 - RNA, 22 nt, Homo sapiens
cuuuugaccuguggugcaaaag

SEQ ID NO: 1638874 - RNA, 19 nt, Homo sapiens
cuuuugguuacagcacaaa

SEQ ID NO: 1638875 - RNA, 13 nt, Homo sapiens
cuuuugugaacaa

SEQ ID NO: 1638876 - RNA, 15 nt, Homo sapiens
cuuuuuaaacagugu

SEQ ID NO: 1638877 - RNA, 14 nt, Homo sapiens
cuuuuuuauacuca

SEQ ID NO: 1638878 - RNA, 16 nt, Homo sapiens
gaaaaauaagucacuu

SEQ ID NO: 1638879 - RNA, 17 nt, Homo sapiens
gaaaacacuguucucug

SEQ ID NO: 1638880 - RNA, 13 nt, Homo sapiens
gaaaacaggcaaa

SEQ ID NO: 1638881 - RNA, 17 nt, Homo sapiens
gaaaacaguauuuucca

SEQ ID NO: 1638882 - RNA, 12 nt, Homo sapiens
gaaaacauguua

SEQ ID NO: 1638883 - RNA, 13 nt, Homo sapiens
gaaaacauuccau

SEQ ID NO: 1638884 - RNA, 15 nt, Homo sapiens
gaaaacugcaacuug

SEQ ID NO: 1638885 - RNA, 23 nt, Homo sapiens
gaaaaggaaggcucuucucccca

SEQ ID NO: 1638886 - RNA, 17 nt, Homo sapiens
gaaaagggaacugaaca

SEQ ID NO: 1638887 - RNA, 20 nt, Homo sapiens
gaaaauaauugcaaauaucc

SEQ ID NO: 1638888 - RNA, 20 nt, Homo sapiens
gaaaauaguuuggauuacuu

SEQ ID NO: 1638889 - RNA, 22 nt, Homo sapiens
gaaaaucgugacaacacuugug

SEQ ID NO: 1638890 - RNA, 15 nt, Homo sapiens
gaaaauuaacacugc

SEQ ID NO: 1638891 - RNA, 21 nt, Homo sapiens
gaaacacagcugaugaacugu

SEQ ID NO: 1638892 - RNA, 23 nt, Homo sapiens
gaaacguauucaaacaauuugaa

SEQ ID NO: 1638893 - RNA, 16 nt, Homo sapiens
gaaacguggcaggacu

SEQ ID NO: 1638894 - RNA, 21 nt, Homo sapiens
gaaacucuuaucucagucaug

SEQ ID NO: 1638895 - RNA, 18 nt, Homo sapiens
gaaacugccaaacuauuu

SEQ ID NO: 1638896 - RNA, 18 nt, Homo sapiens
gaaacuggaugaggucau

SEQ ID NO: 1638897 - RNA, 23 nt, Homo sapiens
gaaagaaaguugcacggcugcug

SEQ ID NO: 1638898 - RNA, 19 nt, Homo sapiens
gaaagaacuuaagucucga

SEQ ID NO: 1638899 - RNA, 22 nt, Homo sapiens
gaaagacaagcucaaguguuca

SEQ ID NO: 1638900 - RNA, 22 nt, Homo sapiens
gaaagcacaggugggcuuccca

SEQ ID NO: 1638901 - RNA, 17 nt, Homo sapiens
gaaaguuuuguucugua

SEQ ID NO: 1638902 - RNA, 19 nt, Homo sapiens
gaaaguuuuuaauauuuau

SEQ ID NO: 1638903 - RNA, 23 nt, Homo sapiens
gaaauacacagugcugaccagac

SEQ ID NO: 1638904 - RNA, 22 nt, Homo sapiens
gaaauagugauuuccacaguga

SEQ ID NO: 1638905 - RNA, 14 nt, Homo sapiens
gaaauauuuggaaa

SEQ ID NO: 1638906 - RNA, 12 nt, Homo sapiens
gaaaucaagggc

SEQ ID NO: 1638907 - RNA, 16 nt, Homo sapiens
gaaaucauuuggguua

SEQ ID NO: 1638908 - RNA, 16 nt, Homo sapiens
gaaaucuuaaaccuua

SEQ ID NO: 1638909 - RNA, 18 nt, Homo sapiens
gaaaugagcucaaauuga

SEQ ID NO: 1638910 - RNA, 17 nt, Homo sapiens
gaaaugcauauuugcaa

SEQ ID NO: 1638911 - RNA, 18 nt, Homo sapiens
gaaauggacugacuguaa

SEQ ID NO: 1638912 - RNA, 15 nt, Homo sapiens
gaaauggggaacuac

SEQ ID NO: 1638913 - RNA, 16 nt, Homo sapiens
gaaauuuagagucaau

SEQ ID NO: 1638914 - RNA, 20 nt, Homo sapiens
gaacaaagugagacagucca

SEQ ID NO: 1638915 - RNA, 15 nt, Homo sapiens
gaacacaaggucauu

SEQ ID NO: 1638916 - RNA, 19 nt, Homo sapiens
gaacacacugagacuugaa

SEQ ID NO: 1638917 - RNA, 22 nt, Homo sapiens
gaacacacugagacuugaauca

SEQ ID NO: 1638918 - RNA, 20 nt, Homo sapiens
gaacaccauccuacauaaua

SEQ ID NO: 1638919 - RNA, 14 nt, Homo sapiens
gaacacuccuucac

SEQ ID NO: 1638920 - RNA, 18 nt, Homo sapiens
gaacaucucgaauacaau

SEQ ID NO: 1638921 - RNA, 16 nt, Homo sapiens
gaaccaggcaacuugg

SEQ ID NO: 1638922 - RNA, 10 nt, Homo sapiens
gaaccaugaa

SEQ ID NO: 1638923 - RNA, 18 nt, Homo sapiens
gaaccaugaaaaugggga

SEQ ID NO: 1638924 - RNA, 17 nt, Homo sapiens
gaaccuagaagggcuag

SEQ ID NO: 1638925 - RNA, 23 nt, Homo sapiens
gaacguguauguaccuaggauau

SEQ ID NO: 1638926 - RNA, 13 nt, Homo sapiens
gaacuagaaccug

SEQ ID NO: 1638927 - RNA, 21 nt, Homo sapiens
gaacucaugagaaguugauau

SEQ ID NO: 1638928 - RNA, 23 nt, Homo sapiens
gaacuccaucauucauccaggac

SEQ ID NO: 1638929 - RNA, 16 nt, Homo sapiens
gaacucugcaacugaa

SEQ ID NO: 1638930 - RNA, 16 nt, Homo sapiens
gaacugagcaucucca

SEQ ID NO: 1638931 - RNA, 16 nt, Homo sapiens
gaacuuucaccuucau

SEQ ID NO: 1638932 - RNA, 22 nt, Homo sapiens
gaagaacagauaaucccuguau

SEQ ID NO: 1638933 - RNA, 17 nt, Homo sapiens
gaagaaggggacaaugg

SEQ ID NO: 1638934 - RNA, 14 nt, Homo sapiens
gaagaaucuguuuc

SEQ ID NO: 1638935 - RNA, 19 nt, Homo sapiens
gaagaaugucuguaccuug

SEQ ID NO: 1638936 - RNA, 17 nt, Homo sapiens
gaagaauuggccaucuu

SEQ ID NO: 1638937 - RNA, 23 nt, Homo sapiens
gaagacaauggcuuacuccagga

SEQ ID NO: 1638938 - RNA, 19 nt, Homo sapiens
gaagaccauccauccuccc

SEQ ID NO: 1638939 - RNA, 17 nt, Homo sapiens
gaagagaaugugacagg

SEQ ID NO: 1638940 - RNA, 18 nt, Homo sapiens
gaagauauaacuauugcc

SEQ ID NO: 1638941 - RNA, 12 nt, Homo sapiens
gaagcacagcuu

SEQ ID NO: 1638942 - RNA, 16 nt, Homo sapiens
gaagcagcucaaggga

SEQ ID NO: 1638943 - RNA, 12 nt, Homo sapiens
gaagcauuuacu

SEQ ID NO: 1638944 - RNA, 14 nt, Homo sapiens
gaagccaaagccaa

SEQ ID NO: 1638945 - RNA, 14 nt, Homo sapiens
gaagccuucugacc

SEQ ID NO: 1638946 - RNA, 18 nt, Homo sapiens
gaagcggucacagaucac

SEQ ID NO: 1638947 - RNA, 22 nt, Homo sapiens
gaagcucccugaaguaagcaaa

SEQ ID NO: 1638948 - RNA, 16 nt, Homo sapiens
gaagcuuucaguauua

SEQ ID NO: 1638949 - RNA, 12 nt, Homo sapiens
gaaggacuguga

SEQ ID NO: 1638950 - RNA, 20 nt, Homo sapiens
gaaggagguucuaauauuca

SEQ ID NO: 1638951 - RNA, 14 nt, Homo sapiens
gaaggcaaacccau

SEQ ID NO: 1638952 - RNA, 15 nt, Homo sapiens
gaaggcagcuugugg

SEQ ID NO: 1638953 - RNA, 13 nt, Homo sapiens
cucuauuaucuca

SEQ ID NO: 1638954 - RNA, 20 nt, Homo sapiens
cucucaguugcagcccugcu

SEQ ID NO: 1638955 - RNA, 13 nt, Homo sapiens
cucucuaauucca

SEQ ID NO: 1638956 - RNA, 17 nt, Homo sapiens
cucugaaaccaguguua

SEQ ID NO: 1638957 - RNA, 23 nt, Homo sapiens
cucugacgaguacucuugaacac

SEQ ID NO: 1638958 - RNA, 18 nt, Homo sapiens
cucugacucagggcuccu

SEQ ID NO: 1638959 - RNA, 15 nt, Homo sapiens
cucugagcugugcag

SEQ ID NO: 1638960 - RNA, 13 nt, Homo sapiens
cucugagggugau

SEQ ID NO: 1638961 - RNA, 19 nt, Homo sapiens
cucugagucccagagccaa

SEQ ID NO: 1638962 - RNA, 13 nt, Homo sapiens
cucugaucccucu

SEQ ID NO: 1638963 - RNA, 22 nt, Homo sapiens
cucugccugaagucacacagug

SEQ ID NO: 1638964 - RNA, 17 nt, Homo sapiens
cucugcucucaggagau

SEQ ID NO: 1638965 - RNA, 24 nt, Homo sapiens
cucugcugccgccccacccagaug

SEQ ID NO: 1638966 - RNA, 13 nt, Homo sapiens
cucuguccugacu

SEQ ID NO: 1638967 - RNA, 16 nt, Homo sapiens
cucuuaguucuuaccu

SEQ ID NO: 1638968 - RNA, 14 nt, Homo sapiens
cucuucucauuuca

SEQ ID NO: 1638969 - RNA, 13 nt, Homo sapiens
cucuugaacacaa

SEQ ID NO: 1638970 - RNA, 14 nt, Homo sapiens
cugaacauugcacu

SEQ ID NO: 1638971 - RNA, 13 nt, Homo sapiens
cugaacucugcaa

SEQ ID NO: 1638972 - RNA, 16 nt, Homo sapiens
cugaaggacugugaca

SEQ ID NO: 1638973 - RNA, 19 nt, Homo sapiens
cugaaggagccccauuccu

SEQ ID NO: 1638974 - RNA, 17 nt, Homo sapiens
cugaaguaagcaaagac

SEQ ID NO: 1638975 - RNA, 20 nt, Homo sapiens
cugaagucaguuucuaucau

SEQ ID NO: 1638976 - RNA, 23 nt, Homo sapiens
cugaauagcagaagguugcaccu

SEQ ID NO: 1638977 - RNA, 13 nt, Homo sapiens
cugacagcacucc

SEQ ID NO: 1638978 - RNA, 19 nt, Homo sapiens
cugacagcacuccucggca

SEQ ID NO: 1638979 - RNA, 19 nt, Homo sapiens
cugacaguaacagcaucuu

SEQ ID NO: 1638980 - RNA, 15 nt, Homo sapiens
cugacauaugcuaac

SEQ ID NO: 1638981 - RNA, 16 nt, Homo sapiens
cugacauaugcuaacc

SEQ ID NO: 1638982 - RNA, 23 nt, Homo sapiens
cugacauaugcuaacccccaaau

SEQ ID NO: 1638983 - RNA, 19 nt, Homo sapiens
cugacccuguaaaauggag

SEQ ID NO: 1638984 - RNA, 23 nt, Homo sapiens
cugaccucgugauccaccugccu

SEQ ID NO: 1638985 - RNA, 13 nt, Homo sapiens
cugacuaacuuuu

SEQ ID NO: 1638986 - RNA, 14 nt, Homo sapiens
cugacuucaggggc

SEQ ID NO: 1638987 - RNA, 19 nt, Homo sapiens
cugacuuuaaaaggauuaa

SEQ ID NO: 1638988 - RNA, 14 nt, Homo sapiens
cugagaaaugaugg

SEQ ID NO: 1638989 - RNA, 17 nt, Homo sapiens
cugagaacacugugaaa

SEQ ID NO: 1638990 - RNA, 20 nt, Homo sapiens
cugagagcauguuuuaucau

SEQ ID NO: 1638991 - RNA, 15 nt, Homo sapiens
cugagaggucacaaa

SEQ ID NO: 1638992 - RNA, 14 nt, Homo sapiens
cugagauaccagcg

SEQ ID NO: 1638993 - RNA, 18 nt, Homo sapiens
cugagauucuucguguau

SEQ ID NO: 1638994 - RNA, 20 nt, Homo sapiens
cugagcuguuaucuugugua

SEQ ID NO: 1638995 - RNA, 23 nt, Homo sapiens
cugaggcaagccauggagugaga

SEQ ID NO: 1638996 - RNA, 15 nt, Homo sapiens
cugaggcacacagag

SEQ ID NO: 1638997 - RNA, 19 nt, Homo sapiens
cugaguagcugggacuaca

SEQ ID NO: 1638998 - RNA, 18 nt, Homo sapiens
cugaguagcugggauuac

SEQ ID NO: 1638999 - RNA, 16 nt, Homo sapiens
cugauaauguauugca

SEQ ID NO: 1639000 - RNA, 21 nt, Homo sapiens
cugauaauuauuuuaaagggg

SEQ ID NO: 1639001 - RNA, 21 nt, Homo sapiens
cugauacaaauugcagacugu

SEQ ID NO: 1639002 - RNA, 19 nt, Homo sapiens
cugauacuuugacaguguu

SEQ ID NO: 1639003 - RNA, 18 nt, Homo sapiens
cugauauuggacaguaaa

SEQ ID NO: 1639004 - RNA, 13 nt, Homo sapiens
cugaugcaagcaa

SEQ ID NO: 1639005 - RNA, 14 nt, Homo sapiens
cugaugcagucacg

SEQ ID NO: 1639006 - RNA, 18 nt, Homo sapiens
cugauguccucaccacau

SEQ ID NO: 1639007 - RNA, 22 nt, Homo sapiens
cugauuaaaaaaucucccaaag

SEQ ID NO: 1639008 - RNA, 23 nt, Homo sapiens
cugauuaaaaaaucucccaaagc

SEQ ID NO: 1639009 - RNA, 22 nt, Homo sapiens
cugauucugucaaugucuugaa

SEQ ID NO: 1639010 - RNA, 21 nt, Homo sapiens
cugauuuguauuaaaauugua

SEQ ID NO: 1639011 - RNA, 22 nt, Homo sapiens
cugauuuguauuaaaauuguaa

SEQ ID NO: 1639012 - RNA, 16 nt, Homo sapiens
cugcaaagcccagcuu

SEQ ID NO: 1639013 - RNA, 17 nt, Homo sapiens
cugcaaaucugccugau

SEQ ID NO: 1639014 - RNA, 23 nt, Homo sapiens
cugcaacaugccagccacuguga

SEQ ID NO: 1639015 - RNA, 23 nt, Homo sapiens
cugcagcgucagaaucguguuga

SEQ ID NO: 1639016 - RNA, 12 nt, Homo sapiens
cugcauguuccu

SEQ ID NO: 1639017 - RNA, 18 nt, Homo sapiens
cugcauguuccuggacac

SEQ ID NO: 1639018 - RNA, 16 nt, Homo sapiens
cugccacccuggggag

SEQ ID NO: 1639019 - RNA, 15 nt, Homo sapiens
cugcccagcucugag

SEQ ID NO: 1639020 - RNA, 16 nt, Homo sapiens
cugcccccaauccaug

SEQ ID NO: 1639021 - RNA, 20 nt, Homo sapiens
cugccucagguguccgcuau

SEQ ID NO: 1639022 - RNA, 12 nt, Homo sapiens
cugccuucucag

SEQ ID NO: 1639023 - RNA, 15 nt, Homo sapiens
cugcuaauaauaaau

SEQ ID NO: 1639024 - RNA, 14 nt, Homo sapiens
cugcucccacagaa

SEQ ID NO: 1639025 - RNA, 12 nt, Homo sapiens
cugcucuaagaa

SEQ ID NO: 1639026 - RNA, 18 nt, Homo sapiens
cugcucuccgaccagaca

SEQ ID NO: 1639027 - RNA, 13 nt, Homo sapiens
cugcugacagugu

SEQ ID NO: 1639028 - RNA, 22 nt, Homo sapiens
cugcuugaggaaaacaagcauu

SEQ ID NO: 1639029 - RNA, 17 nt, Homo sapiens
cugcuuuggaaaucaca

SEQ ID NO: 1639030 - RNA, 16 nt, Homo sapiens
cuggaacuacaaggaa

SEQ ID NO: 1639031 - RNA, 22 nt, Homo sapiens
cuggaacucagugugacuccuc

SEQ ID NO: 1639032 - RNA, 12 nt, Homo sapiens
cuggacacagag

SEQ ID NO: 1639033 - RNA, 16 nt, Homo sapiens
cuggacugucuaugaa

SEQ ID NO: 1639034 - RNA, 22 nt, Homo sapiens
cuggacuuuuccucucaugucu

SEQ ID NO: 1639035 - RNA, 12 nt, Homo sapiens
cuggagggcuag

SEQ ID NO: 1639036 - RNA, 20 nt, Homo sapiens
cuggagggcuagaaucugga

SEQ ID NO: 1639037 - RNA, 20 nt, Homo sapiens
cuggagggcuggaaucugga

SEQ ID NO: 1639038 - RNA, 12 nt, Homo sapiens
cuggagugcagu

SEQ ID NO: 1639039 - RNA, 20 nt, Homo sapiens
cuggagugcaguggcacgau

SEQ ID NO: 1639040 - RNA, 13 nt, Homo sapiens
cuggaugccugau

SEQ ID NO: 1639041 - RNA, 20 nt, Homo sapiens
cuggcaccaaaguccaggac

SEQ ID NO: 1639042 - RNA, 19 nt, Homo sapiens
cuggcacugcuuccaguga

SEQ ID NO: 1639043 - RNA, 23 nt, Homo sapiens
cuggccagggccuggaagacaga

SEQ ID NO: 1639044 - RNA, 14 nt, Homo sapiens
cuggccuccaaguc

SEQ ID NO: 1639045 - RNA, 17 nt, Homo sapiens
cuggccuccaaguccac

SEQ ID NO: 1639046 - RNA, 22 nt, Homo sapiens
cuggcgagucugcuuucuucua

SEQ ID NO: 1639047 - RNA, 23 nt, Homo sapiens
cuggcguccucucccuccuggcc

SEQ ID NO: 1639048 - RNA, 13 nt, Homo sapiens
cuggcgugcagug

SEQ ID NO: 1639049 - RNA, 18 nt, Homo sapiens
cuggcugaaggacuguga

SEQ ID NO: 1639050 - RNA, 14 nt, Homo sapiens
cuggcugugacaau

SEQ ID NO: 1639051 - RNA, 19 nt, Homo sapiens
cugggacuaaguguaccag

SEQ ID NO: 1639052 - RNA, 17 nt, Homo sapiens
cugggagagccuuccag

SEQ ID NO: 1639053 - RNA, 20 nt, Homo sapiens
cugggauccgggaucaaagu

SEQ ID NO: 1639054 - RNA, 18 nt, Homo sapiens
cugggauuacagguguga

SEQ ID NO: 1639055 - RNA, 18 nt, Homo sapiens
cugggcaagggaccugcu

SEQ ID NO: 1639056 - RNA, 23 nt, Homo sapiens
cugggguuggagguuucacuugc

SEQ ID NO: 1639057 - RNA, 19 nt, Homo sapiens
cuaauacagacuaugucac

SEQ ID NO: 1639058 - RNA, 17 nt, Homo sapiens
cuaauauguaacaagcc

SEQ ID NO: 1639059 - RNA, 15 nt, Homo sapiens
cuaauccaaauauca

SEQ ID NO: 1639060 - RNA, 17 nt, Homo sapiens
cuaaugacguugagcau

SEQ ID NO: 1639061 - RNA, 14 nt, Homo sapiens
cuaauucaacauau

SEQ ID NO: 1639062 - RNA, 23 nt, Homo sapiens
cuaauuccacuuguucauucugu

SEQ ID NO: 1639063 - RNA, 13 nt, Homo sapiens
cuaauucuuuaau

SEQ ID NO: 1639064 - RNA, 15 nt, Homo sapiens
cuaauuugugccuca

SEQ ID NO: 1639065 - RNA, 21 nt, Homo sapiens
cuacaagacacagugaccaua

SEQ ID NO: 1639066 - RNA, 16 nt, Homo sapiens
cuacacugacacuggu

SEQ ID NO: 1639067 - RNA, 13 nt, Homo sapiens
cuacagugcugug

SEQ ID NO: 1639068 - RNA, 12 nt, Homo sapiens
cuacaugcaauu

SEQ ID NO: 1639069 - RNA, 22 nt, Homo sapiens
cuacaugcaauuuagaacuaga

SEQ ID NO: 1639070 - RNA, 20 nt, Homo sapiens
cuaccaacgaaagacgugau

SEQ ID NO: 1639071 - RNA, 12 nt, Homo sapiens
cuaccacaugcc

SEQ ID NO: 1639072 - RNA, 19 nt, Homo sapiens
cuaccauaagugacaccaa

SEQ ID NO: 1639073 - RNA, 23 nt, Homo sapiens
cuaccccucccagcugacagucc

SEQ ID NO: 1639074 - RNA, 15 nt, Homo sapiens
cuaccugacugccac

SEQ ID NO: 1639075 - RNA, 19 nt, Homo sapiens
cuaccuuacagugagggcu

SEQ ID NO: 1639076 - RNA, 16 nt, Homo sapiens
cuacuacccccacaga

SEQ ID NO: 1639077 - RNA, 18 nt, Homo sapiens
cuacucauuccccggggc

SEQ ID NO: 1639078 - RNA, 20 nt, Homo sapiens
cuacuuaacuugguagccuc

SEQ ID NO: 1639079 - RNA, 14 nt, Homo sapiens
cuacuugggagcac

SEQ ID NO: 1639080 - RNA, 19 nt, Homo sapiens
cuagaaaacaggcaaauuc

SEQ ID NO: 1639081 - RNA, 18 nt, Homo sapiens
cuagaaccuggagggcua

SEQ ID NO: 1639082 - RNA, 19 nt, Homo sapiens
cuagaaccuggagggcuag

SEQ ID NO: 1639083 - RNA, 18 nt, Homo sapiens
cuagauaauaaaauugcu

SEQ ID NO: 1639084 - RNA, 13 nt, Homo sapiens
cuagauaccacuu

SEQ ID NO: 1639085 - RNA, 12 nt, Homo sapiens
cuagcauuguaa

SEQ ID NO: 1639086 - RNA, 13 nt, Homo sapiens
cuagcugugucag

SEQ ID NO: 1639087 - RNA, 17 nt, Homo sapiens
cuaguagaacaauguac

SEQ ID NO: 1639088 - RNA, 14 nt, Homo sapiens
cuaguagaacugga

SEQ ID NO: 1639089 - RNA, 20 nt, Homo sapiens
cuaguagaacuggaucccaa

SEQ ID NO: 1639090 - RNA, 14 nt, Homo sapiens
cuagucuguaacuc

SEQ ID NO: 1639091 - RNA, 16 nt, Homo sapiens
cuaguuaaaagccuuu

SEQ ID NO: 1639092 - RNA, 16 nt, Homo sapiens
cuaguuuuuuugaaau

SEQ ID NO: 1639093 - RNA, 16 nt, Homo sapiens
cuauauggcagugucu

SEQ ID NO: 1639094 - RNA, 17 nt, Homo sapiens
cuauauuguacacaccu

SEQ ID NO: 1639095 - RNA, 15 nt, Homo sapiens
cuaucauucugcucu

SEQ ID NO: 1639096 - RNA, 11 nt, Homo sapiens
cuauccagcua

SEQ ID NO: 1639097 - RNA, 13 nt, Homo sapiens
cuaugaagacagg

SEQ ID NO: 1639098 - RNA, 17 nt, Homo sapiens
cuauggcucuacuuuca

SEQ ID NO: 1639099 - RNA, 18 nt, Homo sapiens
cuauggcucuacuuucag

SEQ ID NO: 1639100 - RNA, 20 nt, Homo sapiens
cuaugucacccaaugcauau

SEQ ID NO: 1639101 - RNA, 19 nt, Homo sapiens
cuauguugcccaggcaggu

SEQ ID NO: 1639102 - RNA, 22 nt, Homo sapiens
cuauguuuuuguucaaagccag

SEQ ID NO: 1639103 - RNA, 14 nt, Homo sapiens
cuauuaaaauugcc

SEQ ID NO: 1639104 - RNA, 20 nt, Homo sapiens
cuauuaccaccaccugcuca

SEQ ID NO: 1639105 - RNA, 16 nt, Homo sapiens
cuauuacgugcaauac

SEQ ID NO: 1639106 - RNA, 13 nt, Homo sapiens
cuauuauauucau

SEQ ID NO: 1639107 - RNA, 12 nt, Homo sapiens
cuauucaucuca

SEQ ID NO: 1639108 - RNA, 13 nt, Homo sapiens
cuauuuauauaca

SEQ ID NO: 1639109 - RNA, 18 nt, Homo sapiens
cuauuucaauacuuacau

SEQ ID NO: 1639110 - RNA, 20 nt, Homo sapiens
cucaaacucuugaccucagg

SEQ ID NO: 1639111 - RNA, 13 nt, Homo sapiens
cucaaaguuaaaa

SEQ ID NO: 1639112 - RNA, 22 nt, Homo sapiens
cucaagugauucuccugccuca

SEQ ID NO: 1639113 - RNA, 23 nt, Homo sapiens
cucaauaaaguacaagagcuuaa

SEQ ID NO: 1639114 - RNA, 19 nt, Homo sapiens
cucaauauuuacuauuuca

SEQ ID NO: 1639115 - RNA, 12 nt, Homo sapiens
cucaaucucuga

SEQ ID NO: 1639116 - RNA, 12 nt, Homo sapiens
cucaauucuucc

SEQ ID NO: 1639117 - RNA, 16 nt, Homo sapiens
cucacguccaucacug

SEQ ID NO: 1639118 - RNA, 23 nt, Homo sapiens
cucacugcugcaaauacuguaua

SEQ ID NO: 1639119 - RNA, 21 nt, Homo sapiens
cucacuuugaagagugugagg

SEQ ID NO: 1639120 - RNA, 18 nt, Homo sapiens
cucagccucccaaagugc

SEQ ID NO: 1639121 - RNA, 17 nt, Homo sapiens
cucagcuggaucuccau

SEQ ID NO: 1639122 - RNA, 22 nt, Homo sapiens
cucaggacacuaauacaccagg

SEQ ID NO: 1639123 - RNA, 23 nt, Homo sapiens
cucaggcaaagaaaaugaaaugc

SEQ ID NO: 1639124 - RNA, 22 nt, Homo sapiens
cucaggcaaggggcauuucaca

SEQ ID NO: 1639125 - RNA, 22 nt, Homo sapiens
cucaguaagaagagcuuggaaa

SEQ ID NO: 1639126 - RNA, 18 nt, Homo sapiens
cucagucucugagcagug

SEQ ID NO: 1639127 - RNA, 15 nt, Homo sapiens
cucaguucagaauca

SEQ ID NO: 1639128 - RNA, 14 nt, Homo sapiens
cucaucauuuccau

SEQ ID NO: 1639129 - RNA, 17 nt, Homo sapiens
cucaucccgagcaccuc

SEQ ID NO: 1639130 - RNA, 14 nt, Homo sapiens
cucaucuaugucau

SEQ ID NO: 1639131 - RNA, 19 nt, Homo sapiens
cucaugagaaguugauaua

SEQ ID NO: 1639132 - RNA, 19 nt, Homo sapiens
cucaugcugugugacucaa

SEQ ID NO: 1639133 - RNA, 20 nt, Homo sapiens
cucaugcugugugacucaaa

SEQ ID NO: 1639134 - RNA, 18 nt, Homo sapiens
cucauguuuuuaaagggc

SEQ ID NO: 1639135 - RNA, 12 nt, Homo sapiens
cucauuaauuca

SEQ ID NO: 1639136 - RNA, 17 nt, Homo sapiens
cucauuaauucaaugaa

SEQ ID NO: 1639137 - RNA, 18 nt, Homo sapiens
cucauuaauucaaugaaa

SEQ ID NO: 1639138 - RNA, 19 nt, Homo sapiens
cucauuagugguacugggg

SEQ ID NO: 1639139 - RNA, 15 nt, Homo sapiens
cucauuucaggagca

SEQ ID NO: 1639140 - RNA, 19 nt, Homo sapiens
cucauuuuagaaccaccaa

SEQ ID NO: 1639141 - RNA, 21 nt, Homo sapiens
cuccaaaacuggaccaccaga

SEQ ID NO: 1639142 - RNA, 18 nt, Homo sapiens
cuccaagaccuucuccuu

SEQ ID NO: 1639143 - RNA, 16 nt, Homo sapiens
cuccacauaaguccau

SEQ ID NO: 1639144 - RNA, 20 nt, Homo sapiens
cuccaccccacaacccaaaa

SEQ ID NO: 1639145 - RNA, 19 nt, Homo sapiens
cuccagaaagcucaucuca

SEQ ID NO: 1639146 - RNA, 15 nt, Homo sapiens
cuccagaugagagua

SEQ ID NO: 1639147 - RNA, 21 nt, Homo sapiens
cuccagggacagcaacuauca

SEQ ID NO: 1639148 - RNA, 21 nt, Homo sapiens
cuccaucaguuagagcugaca

SEQ ID NO: 1639149 - RNA, 19 nt, Homo sapiens
cuccauccaauucuuugaa

SEQ ID NO: 1639150 - RNA, 17 nt, Homo sapiens
cuccaugucuaugcucc

SEQ ID NO: 1639151 - RNA, 20 nt, Homo sapiens
cuccauuguucagaugcuuc

SEQ ID NO: 1639152 - RNA, 22 nt, Homo sapiens
cuccauuuucuugucaauggaa

SEQ ID NO: 1639153 - RNA, 19 nt, Homo sapiens
cucccaaagugcugggauu

SEQ ID NO: 1639154 - RNA, 20 nt, Homo sapiens
cucccagcuaauugagacca

SEQ ID NO: 1639155 - RNA, 19 nt, Homo sapiens
cucccagcugacaguccuc

SEQ ID NO: 1639156 - RNA, 16 nt, Homo sapiens
cucccaggcauucccc

SEQ ID NO: 1639157 - RNA, 20 nt, Homo sapiens
cucccgaguagcugagauua

SEQ ID NO: 1639158 - RNA, 17 nt, Homo sapiens
cucccugaaguaagcaa

SEQ ID NO: 1639159 - RNA, 20 nt, Homo sapiens
cucccugcuucaauacccaa

SEQ ID NO: 1639160 - RNA, 22 nt, Homo sapiens
cuccuagacucacuuguucuca

SEQ ID NO: 1639161 - RNA, 13 nt, Homo sapiens
cuccucaggguug

SEQ ID NO: 1639162 - RNA, 12 nt, Homo sapiens
cuccucugugaa

SEQ ID NO: 1639163 - RNA, 13 nt, Homo sapiens
cuccucugugaaa

SEQ ID NO: 1639164 - RNA, 19 nt, Homo sapiens
cuccugaguagcugggauu

SEQ ID NO: 1639165 - RNA, 23 nt, Homo sapiens
uaaugaugucguuugaaucacag

SEQ ID NO: 1639166 - RNA, 18 nt, Homo sapiens
uaaugcuugccaagaaau

SEQ ID NO: 1639167 - RNA, 19 nt, Homo sapiens
uaauggaagcaucuagcau

SEQ ID NO: 1639168 - RNA, 19 nt, Homo sapiens
uaauuagaucaauuacuua

SEQ ID NO: 1639169 - RNA, 14 nt, Homo sapiens
uaauucaaaagcac

SEQ ID NO: 1639170 - RNA, 23 nt, Homo sapiens
uaauuccacuuguucauucugug

SEQ ID NO: 1639171 - RNA, 15 nt, Homo sapiens
uaauuguguggauuc

SEQ ID NO: 1639172 - RNA, 22 nt, Homo sapiens
uaauuuaacccaggcaugcaau

SEQ ID NO: 1639173 - RNA, 18 nt, Homo sapiens
uaauuuaguucucagcuc

SEQ ID NO: 1639174 - RNA, 20 nt, Homo sapiens
uaauuuuuuugagacagagu

SEQ ID NO: 1639175 - RNA, 22 nt, Homo sapiens
uacaaagcccuuguccccauga

SEQ ID NO: 1639176 - RNA, 11 nt, Homo sapiens
uacacaauggg

SEQ ID NO: 1639177 - RNA, 21 nt, Homo sapiens
uacacaauggguaucuaauaa

SEQ ID NO: 1639178 - RNA, 12 nt, Homo sapiens
uacacauuccau

SEQ ID NO: 1639179 - RNA, 13 nt, Homo sapiens
uacaccaguuuga

SEQ ID NO: 1639180 - RNA, 18 nt, Homo sapiens
uacacuaaauccccucac

SEQ ID NO: 1639181 - RNA, 13 nt, Homo sapiens
uacacuggucuaa

SEQ ID NO: 1639182 - RNA, 20 nt, Homo sapiens
uacacuguuaucuucacuuu

SEQ ID NO: 1639183 - RNA, 21 nt, Homo sapiens
uacacuuggaguuugcauucu

SEQ ID NO: 1639184 - RNA, 19 nt, Homo sapiens
uacagaaucaaaugcaauu

SEQ ID NO: 1639185 - RNA, 20 nt, Homo sapiens
uacagagaaaaugaauuugg

SEQ ID NO: 1639186 - RNA, 15 nt, Homo sapiens
uacaggagugagcac

SEQ ID NO: 1639187 - RNA, 20 nt, Homo sapiens
uacaggcauagaguucagac

SEQ ID NO: 1639188 - RNA, 16 nt, Homo sapiens
uacaggugaagcacca

SEQ ID NO: 1639189 - RNA, 17 nt, Homo sapiens
uacaggugugagucacc

SEQ ID NO: 1639190 - RNA, 10 nt, Homo sapiens
uacaguauua

SEQ ID NO: 1639191 - RNA, 16 nt, Homo sapiens
uacagucuuguauuaa

SEQ ID NO: 1639192 - RNA, 20 nt, Homo sapiens
uacaguuuuuauugcuuguu

SEQ ID NO: 1639193 - RNA, 15 nt, Homo sapiens
uacauacagugauau

SEQ ID NO: 1639194 - RNA, 17 nt, Homo sapiens
uacauauaaagauuaac

SEQ ID NO: 1639195 - RNA, 13 nt, Homo sapiens
uacaugacauuua

SEQ ID NO: 1639196 - RNA, 21 nt, Homo sapiens
uacauugaaacccuccaaauc

SEQ ID NO: 1639197 - RNA, 22 nt, Homo sapiens
uaccaaagccaauaaaugaacu

SEQ ID NO: 1639198 - RNA, 17 nt, Homo sapiens
uaccaaccugaagacac

SEQ ID NO: 1639199 - RNA, 20 nt, Homo sapiens
uaccacaugccaagcacugu

SEQ ID NO: 1639200 - RNA, 21 nt, Homo sapiens
uaccacugucuucuucagggu

SEQ ID NO: 1639201 - RNA, 14 nt, Homo sapiens
uaccagaagccaga

SEQ ID NO: 1639202 - RNA, 16 nt, Homo sapiens
uaccaugaugcaugga

SEQ ID NO: 1639203 - RNA, 15 nt, Homo sapiens
uaccaugccucucca

SEQ ID NO: 1639204 - RNA, 21 nt, Homo sapiens
uaccauuucuugagguaaaag

SEQ ID NO: 1639205 - RNA, 14 nt, Homo sapiens
uacccaacucugua

SEQ ID NO: 1639206 - RNA, 22 nt, Homo sapiens
uacccaggauucccccaacaca

SEQ ID NO: 1639207 - RNA, 21 nt, Homo sapiens
uaccuagcaaagcuccugccu

SEQ ID NO: 1639208 - RNA, 14 nt, Homo sapiens
uaccuccugagaaa

SEQ ID NO: 1639209 - RNA, 17 nt, Homo sapiens
uaccuccugucucuggc

SEQ ID NO: 1639210 - RNA, 14 nt, Homo sapiens
uaccugacugccac

SEQ ID NO: 1639211 - RNA, 21 nt, Homo sapiens
uaccuuugaaauauuaaaauc

SEQ ID NO: 1639212 - RNA, 14 nt, Homo sapiens
uacgacaacuugca

SEQ ID NO: 1639213 - RNA, 15 nt, Homo sapiens
uacguuaccaggcag

SEQ ID NO: 1639214 - RNA, 19 nt, Homo sapiens
uacuaauuuuccauaagcu

SEQ ID NO: 1639215 - RNA, 22 nt, Homo sapiens
uacuauuaccaccaccugcuca

SEQ ID NO: 1639216 - RNA, 18 nt, Homo sapiens
uacuauuucaauacuuac

SEQ ID NO: 1639217 - RNA, 17 nt, Homo sapiens
uacucaggcaaggggca

SEQ ID NO: 1639218 - RNA, 19 nt, Homo sapiens
uacucagggaaagcauuua

SEQ ID NO: 1639219 - RNA, 14 nt, Homo sapiens
uacugagacaaugu

SEQ ID NO: 1639220 - RNA, 14 nt, Homo sapiens
uacugagagcaugu

SEQ ID NO: 1639221 - RNA, 22 nt, Homo sapiens
uacugcuggcaguggaacuaag

SEQ ID NO: 1639222 - RNA, 15 nt, Homo sapiens
uacugcuuuucauua

SEQ ID NO: 1639223 - RNA, 12 nt, Homo sapiens
uacuggacucag

SEQ ID NO: 1639224 - RNA, 14 nt, Homo sapiens
uacuguggcuucuu

SEQ ID NO: 1639225 - RNA, 21 nt, Homo sapiens
uacugugucagggaacauauu

SEQ ID NO: 1639226 - RNA, 18 nt, Homo sapiens
uacuguugcacguguguu

SEQ ID NO: 1639227 - RNA, 19 nt, Homo sapiens
uacuuacauaucugacuuc

SEQ ID NO: 1639228 - RNA, 16 nt, Homo sapiens
uacuugccuaucugac

SEQ ID NO: 1639229 - RNA, 16 nt, Homo sapiens
uacuugggccauagcu

SEQ ID NO: 1639230 - RNA, 17 nt, Homo sapiens
uacuuuguauccucuga

SEQ ID NO: 1639231 - RNA, 21 nt, Homo sapiens
uacuuuugcccuuugauuaaa

SEQ ID NO: 1639232 - RNA, 15 nt, Homo sapiens
uacuuuugcucccua

SEQ ID NO: 1639233 - RNA, 20 nt, Homo sapiens
uagaaaacaggcaaauuccu

SEQ ID NO: 1639234 - RNA, 20 nt, Homo sapiens
uagaaaagcaaagggugcua

SEQ ID NO: 1639235 - RNA, 19 nt, Homo sapiens
uagaaagcugaguguuuca

SEQ ID NO: 1639236 - RNA, 20 nt, Homo sapiens
uagaacaugugucuaucugc

SEQ ID NO: 1639237 - RNA, 11 nt, Homo sapiens
uagaaccugga

SEQ ID NO: 1639238 - RNA, 14 nt, Homo sapiens
uagaagauggcacu

SEQ ID NO: 1639239 - RNA, 12 nt, Homo sapiens
uagaagucacac

SEQ ID NO: 1639240 - RNA, 22 nt, Homo sapiens
uagaauacucagggaaagcauu

SEQ ID NO: 1639241 - RNA, 20 nt, Homo sapiens
uagaauauccuacuucucca

SEQ ID NO: 1639242 - RNA, 12 nt, Homo sapiens
uagaaucuggag

SEQ ID NO: 1639243 - RNA, 17 nt, Homo sapiens
uagaccuaggccucagc

SEQ ID NO: 1639244 - RNA, 15 nt, Homo sapiens
uagagaauuuccuua

SEQ ID NO: 1639245 - RNA, 16 nt, Homo sapiens
uagagaauuuccuuac

SEQ ID NO: 1639246 - RNA, 21 nt, Homo sapiens
uagaggacagcaacuggugau

SEQ ID NO: 1639247 - RNA, 15 nt, Homo sapiens
uagagguacuuucca

SEQ ID NO: 1639248 - RNA, 16 nt, Homo sapiens
uagagucaauuugcug

SEQ ID NO: 1639249 - RNA, 16 nt, Homo sapiens
uagaguucagacuuuu

SEQ ID NO: 1639250 - RNA, 18 nt, Homo sapiens
uagauguuauuaugcuaa

SEQ ID NO: 1639251 - RNA, 17 nt, Homo sapiens
uagcaacccugugauac

SEQ ID NO: 1639252 - RNA, 22 nt, Homo sapiens
uagcaugaaauaaaauauaucu

SEQ ID NO: 1639253 - RNA, 17 nt, Homo sapiens
uagcauuugucaacaaa

SEQ ID NO: 1639254 - RNA, 18 nt, Homo sapiens
uagccuuagaagucacac

SEQ ID NO: 1639255 - RNA, 14 nt, Homo sapiens
uagcuacaucuaaa

SEQ ID NO: 1639256 - RNA, 15 nt, Homo sapiens
uagcuagcuauuucu

SEQ ID NO: 1639257 - RNA, 20 nt, Homo sapiens
uagcucuaggguauauaucc

SEQ ID NO: 1639258 - RNA, 16 nt, Homo sapiens
uagcugggacuacagg

SEQ ID NO: 1639259 - RNA, 19 nt, Homo sapiens
uaggaaagaagagaaccau

SEQ ID NO: 1639260 - RNA, 22 nt, Homo sapiens
uaggaagaauuuuuauauccac

SEQ ID NO: 1639261 - RNA, 15 nt, Homo sapiens
uaggauuacuuagau

SEQ ID NO: 1639262 - RNA, 16 nt, Homo sapiens
uaggcaccuaccacca

SEQ ID NO: 1639263 - RNA, 14 nt, Homo sapiens
uagggaucccucau

SEQ ID NO: 1639264 - RNA, 12 nt, Homo sapiens
uagguagccuug

SEQ ID NO: 1639265 - RNA, 16 nt, Homo sapiens
uagguugaaauucaua

SEQ ID NO: 1639266 - RNA, 13 nt, Homo sapiens
uaguagaacugga

SEQ ID NO: 1639267 - RNA, 21 nt, Homo sapiens
uaguagauauccucugcuuaa

SEQ ID NO: 1639268 - RNA, 15 nt, Homo sapiens
uagucaauguaaaaa

SEQ ID NO: 1639269 - RNA, 19 nt, Homo sapiens
uagugauuuccacagugac

SEQ ID NO: 1639270 - RNA, 15 nt, Homo sapiens
uagugcccucaucca

SEQ ID NO: 1639271 - RNA, 21 nt, Homo sapiens
uagugcuguaauauuguaaau

SEQ ID NO: 1639272 - RNA, 11 nt, Homo sapiens
uagugcuucuu

SEQ ID NO: 1639273 - RNA, 22 nt, Homo sapiens
uaguggcuguccagugcccauu

SEQ ID NO: 1639274 - RNA, 21 nt, Homo sapiens
uaguguuggaaaaugugcaau

SEQ ID NO: 1639275 - RNA, 23 nt, Homo sapiens
uaguguuggaaaaugugcaauau

SEQ ID NO: 1639276 - RNA, 22 nt, Homo sapiens
uauaaacugagaggucacaaag

SEQ ID NO: 1639277 - RNA, 23 nt, Homo sapiens
uauaaagauacagaacucuuuca

SEQ ID NO: 1639278 - RNA, 12 nt, Homo sapiens
uauaaagcaaau

SEQ ID NO: 1639279 - RNA, 19 nt, Homo sapiens
uauaaagcaaauuacucca

SEQ ID NO: 1639280 - RNA, 13 nt, Homo sapiens
uauaaaggauaaa

SEQ ID NO: 1639281 - RNA, 18 nt, Homo sapiens
uauaaaggauuaauguca

SEQ ID NO: 1639282 - RNA, 17 nt, Homo sapiens
uauaaauguaccagaga

SEQ ID NO: 1639283 - RNA, 13 nt, Homo sapiens
uauaaaugugauu

SEQ ID NO: 1639284 - RNA, 21 nt, Homo sapiens
uauaaaugugauugcagcuuu

SEQ ID NO: 1639285 - RNA, 12 nt, Homo sapiens
uauaacaguguu

SEQ ID NO: 1639286 - RNA, 19 nt, Homo sapiens
uauaacccagugaguucag

SEQ ID NO: 1639287 - RNA, 12 nt, Homo sapiens
uauaacuguaaa

SEQ ID NO: 1639288 - RNA, 18 nt, Homo sapiens
uauaaguaauacaggauu

SEQ ID NO: 1639289 - RNA, 21 nt, Homo sapiens
uauaauuuaaaauaugcucua

SEQ ID NO: 1639290 - RNA, 20 nt, Homo sapiens
uauacacuuggaguuugcau

SEQ ID NO: 1639291 - RNA, 13 nt, Homo sapiens
uauacuauauuac

SEQ ID NO: 1639292 - RNA, 21 nt, Homo sapiens
uauagcugugugaacguguau

SEQ ID NO: 1639293 - RNA, 17 nt, Homo sapiens
uauaguauaagcagugu

SEQ ID NO: 1639294 - RNA, 22 nt, Homo sapiens
uauagucgaacaauucauauau

SEQ ID NO: 1639295 - RNA, 13 nt, Homo sapiens
uauauacaaguga

SEQ ID NO: 1639296 - RNA, 20 nt, Homo sapiens
uauauagcucuacacaacau

SEQ ID NO: 1639297 - RNA, 12 nt, Homo sapiens
uauaugcaauau

SEQ ID NO: 1639298 - RNA, 22 nt, Homo sapiens
uauauggacuuucuugcaagca

SEQ ID NO: 1639299 - RNA, 19 nt, Homo sapiens
uauauuacuugccuaucug

SEQ ID NO: 1639300 - RNA, 14 nt, Homo sapiens
uauauucacuuuca

SEQ ID NO: 1639301 - RNA, 13 nt, Homo sapiens
uauauuuccuuau

SEQ ID NO: 1639302 - RNA, 19 nt, Homo sapiens
uauauuugaaguggagcca

SEQ ID NO: 1639303 - RNA, 15 nt, Homo sapiens
uauauuuuugugcac

SEQ ID NO: 1639304 - RNA, 12 nt, Homo sapiens
uaucaaagucau

SEQ ID NO: 1639305 - RNA, 14 nt, Homo sapiens
uaucaacagcauuu

SEQ ID NO: 1639306 - RNA, 12 nt, Homo sapiens
uaucaggagaaa

SEQ ID NO: 1639307 - RNA, 14 nt, Homo sapiens
uauccaacaugugc

SEQ ID NO: 1639308 - RNA, 18 nt, Homo sapiens
uauccccaccuacuccug

SEQ ID NO: 1639309 - RNA, 18 nt, Homo sapiens
uaucccugcucuggauuu

SEQ ID NO: 1639310 - RNA, 16 nt, Homo sapiens
uaucugacuucauaca

SEQ ID NO: 1639311 - RNA, 15 nt, Homo sapiens
uaucuucacuuuuau

SEQ ID NO: 1639312 - RNA, 15 nt, Homo sapiens
uaucuucuacaugca

SEQ ID NO: 1639313 - RNA, 15 nt, Homo sapiens
uaucuuguguaugga

SEQ ID NO: 1639314 - RNA, 16 nt, Homo sapiens
uaucuuucuaaaacug

SEQ ID NO: 1639315 - RNA, 18 nt, Homo sapiens
uaucuuugccacccucau

SEQ ID NO: 1639316 - RNA, 14 nt, Homo sapiens
uaugaaagacucaa

SEQ ID NO: 1639317 - RNA, 23 nt, Homo sapiens
uaugaaagacucaaaaagcugcc

SEQ ID NO: 1639318 - RNA, 18 nt, Homo sapiens
uaugaacauuagaaaaau

SEQ ID NO: 1639319 - RNA, 17 nt, Homo sapiens
uaugaucacggcucacu

SEQ ID NO: 1639320 - RNA, 16 nt, Homo sapiens
uaugcaucugcuacug

SEQ ID NO: 1639321 - RNA, 18 nt, Homo sapiens
uaugcaucugcuacugug

SEQ ID NO: 1639322 - RNA, 22 nt, Homo sapiens
uaugcaucugcuacugugucag

SEQ ID NO: 1639323 - RNA, 22 nt, Homo sapiens
uaugcaugcccuuccuuucuau

SEQ ID NO: 1639324 - RNA, 21 nt, Homo sapiens
uaugccauugggguaguugug

SEQ ID NO: 1639325 - RNA, 21 nt, Homo sapiens
uauggacuuucuugcaagcaa

SEQ ID NO: 1639326 - RNA, 16 nt, Homo sapiens
uauggcacccaugcac

SEQ ID NO: 1639327 - RNA, 17 nt, Homo sapiens
uauggcucuacuuucag

SEQ ID NO: 1639328 - RNA, 17 nt, Homo sapiens
uaugguuucuccaucca

SEQ ID NO: 1639329 - RNA, 22 nt, Homo sapiens
uauguagcaaaauacaugacau

SEQ ID NO: 1639330 - RNA, 19 nt, Homo sapiens
uaugucacccaaugcauau

SEQ ID NO: 1639331 - RNA, 18 nt, Homo sapiens
uaugucauauuuugccac

SEQ ID NO: 1639332 - RNA, 20 nt, Homo sapiens
uauuaauuuuccaaugcaca

SEQ ID NO: 1639333 - RNA, 20 nt, Homo sapiens
uauuacaguuuaucuauggc

SEQ ID NO: 1639334 - RNA, 22 nt, Homo sapiens
uauuacaguuuaucuauggcac

SEQ ID NO: 1639335 - RNA, 23 nt, Homo sapiens
uauuacccccuuuccucuugggc

SEQ ID NO: 1639336 - RNA, 16 nt, Homo sapiens
uauuacgugcaauacu

SEQ ID NO: 1639337 - RNA, 20 nt, Homo sapiens
uauuaguguuuuaugcaugu

SEQ ID NO: 1639338 - RNA, 13 nt, Homo sapiens
uauuauguccauu

SEQ ID NO: 1639339 - RNA, 16 nt, Homo sapiens
uauucacauguucuaa

SEQ ID NO: 1639340 - RNA, 11 nt, Homo sapiens
uauucaugagu

SEQ ID NO: 1639341 - RNA, 16 nt, Homo sapiens
uauuccacuauuugca

SEQ ID NO: 1639342 - RNA, 17 nt, Homo sapiens
uauucccacagcacuaa

SEQ ID NO: 1639343 - RNA, 22 nt, Homo sapiens
uauugaaaugauuucacagugu

SEQ ID NO: 1639344 - RNA, 17 nt, Homo sapiens
uauugauaacagcacug

SEQ ID NO: 1639345 - RNA, 15 nt, Homo sapiens
uauuguaaauacugg

SEQ ID NO: 1639346 - RNA, 12 nt, Homo sapiens
uauuguaucugu

SEQ ID NO: 1639347 - RNA, 14 nt, Homo sapiens
uauuguggugccac

SEQ ID NO: 1639348 - RNA, 18 nt, Homo sapiens
uauuuaaaagacaaacac

SEQ ID NO: 1639349 - RNA, 21 nt, Homo sapiens
uauuuauagucgaacaauuca

SEQ ID NO: 1639350 - RNA, 14 nt, Homo sapiens
uauuucaauacuua

SEQ ID NO: 1639351 - RNA, 23 nt, Homo sapiens
uauuuccaagaaauauuccuuaa

SEQ ID NO: 1639352 - RNA, 21 nt, Homo sapiens
uauuucuaguuauuacccaga

SEQ ID NO: 1639353 - RNA, 16 nt, Homo sapiens
uauuugaaaaauugcc

SEQ ID NO: 1639354 - RNA, 17 nt, Homo sapiens
uauuugcaagacauaga

SEQ ID NO: 1639355 - RNA, 20 nt, Homo sapiens
uauuuuauaccaaagccaau

SEQ ID NO: 1639356 - RNA, 16 nt, Homo sapiens
uauuuuauagcuacua

SEQ ID NO: 1639357 - RNA, 16 nt, Homo sapiens
uauuuuaucugcuaug

SEQ ID NO: 1639358 - RNA, 22 nt, Homo sapiens
uauuuuauguuauuuauagcug

SEQ ID NO: 1639359 - RNA, 22 nt, Homo sapiens
uauuuugccagugggaacuccu

SEQ ID NO: 1639360 - RNA, 21 nt, Homo sapiens
uauuuuuagacagagucucac

SEQ ID NO: 1639361 - RNA, 15 nt, Homo sapiens
uauuuuuaugugcaa

SEQ ID NO: 1639362 - RNA, 16 nt, Homo sapiens
ucaaaaauacucacau

SEQ ID NO: 1639363 - RNA, 23 nt, Homo sapiens
ucaaaaauagggaaguaacagua

SEQ ID NO: 1639364 - RNA, 17 nt, Homo sapiens
ucaaaaccuacacagcu

SEQ ID NO: 1639365 - RNA, 13 nt, Homo sapiens
ucaaaacuuggaa

SEQ ID NO: 1639366 - RNA, 14 nt, Homo sapiens
ucaaaauugcaauc

SEQ ID NO: 1639367 - RNA, 20 nt, Homo sapiens
ucaaacaugaaaacauugau

SEQ ID NO: 1639368 - RNA, 23 nt, Homo sapiens
ucaaacuccuagguucacuuugg

SEQ ID NO: 1639369 - RNA, 14 nt, Homo sapiens
ucaaagcauuugca

SEQ ID NO: 1639370 - RNA, 16 nt, Homo sapiens
ucaaagucauuaaaga

SEQ ID NO: 1639371 - RNA, 13 nt, Homo sapiens
ucaaagugagcuc

SEQ ID NO: 1639372 - RNA, 20 nt, Homo sapiens
ucaaaguuuugaaaagcuau

SEQ ID NO: 1639373 - RNA, 20 nt, Homo sapiens
ucaaauggaagacacauuga

SEQ ID NO: 1639374 - RNA, 16 nt, Homo sapiens
ucaaauuggagcuuca

SEQ ID NO: 1639375 - RNA, 22 nt, Homo sapiens
ucaacagcauuuucaagcaguu

SEQ ID NO: 1639376 - RNA, 20 nt, Homo sapiens
ucaagcagccaagggaugaa

SEQ ID NO: 1639377 - RNA, 23 nt, Homo sapiens
ucaagucagcaacagagcaaaau

SEQ ID NO: 1639378 - RNA, 15 nt, Homo sapiens
ucaaguuccagugca

SEQ ID NO: 1639379 - RNA, 23 nt, Homo sapiens
ucaauaaaauaauuauuggcaaa

SEQ ID NO: 1639380 - RNA, 17 nt, Homo sapiens
ucaauaaaggacaggcu

SEQ ID NO: 1639381 - RNA, 13 nt, Homo sapiens
ucaauacuuacau

SEQ ID NO: 1639382 - RNA, 13 nt, Homo sapiens
ucacaaggucaag

SEQ ID NO: 1639383 - RNA, 18 nt, Homo sapiens
ucacacagacacuaacga

SEQ ID NO: 1639384 - RNA, 14 nt, Homo sapiens
ucacacaugccacu

SEQ ID NO: 1639385 - RNA, 15 nt, Homo sapiens
ucacacaugccacua

SEQ ID NO: 1639386 - RNA, 16 nt, Homo sapiens
ucacacauuacaaagu

SEQ ID NO: 1639387 - RNA, 18 nt, Homo sapiens
ucacagccacuugggaua

SEQ ID NO: 1639388 - RNA, 21 nt, Homo sapiens
ucacagcuuguauuuugugaa

SEQ ID NO: 1639389 - RNA, 21 nt, Homo sapiens
ucacaggcagguccaggguuu

SEQ ID NO: 1639390 - RNA, 18 nt, Homo sapiens
ucacauucgaguguuuca

SEQ ID NO: 1639391 - RNA, 19 nt, Homo sapiens
ucaccaacgucugugccau

SEQ ID NO: 1639392 - RNA, 17 nt, Homo sapiens
ucaccacaugugcacau

SEQ ID NO: 1639393 - RNA, 17 nt, Homo sapiens
ucaccaccucaugucau

SEQ ID NO: 1639394 - RNA, 16 nt, Homo sapiens
ucaccagggcuggaau

SEQ ID NO: 1639395 - RNA, 21 nt, Homo sapiens
ucaccaggggcaggcacagca

SEQ ID NO: 1639396 - RNA, 22 nt, Homo sapiens
ucaccaggggcaggcacagcac

SEQ ID NO: 1639397 - RNA, 19 nt, Homo sapiens
ucaccauuuggcaaugcca

SEQ ID NO: 1639398 - RNA, 19 nt, Homo sapiens
ucaccuaaacccucuguga

SEQ ID NO: 1639399 - RNA, 16 nt, Homo sapiens
ucacguaaagcuagaa

SEQ ID NO: 1639400 - RNA, 22 nt, Homo sapiens
ucacuaaaaauuuuuacaaaac

SEQ ID NO: 1639401 - RNA, 16 nt, Homo sapiens
ucacucagaagacaca

SEQ ID NO: 1639402 - RNA, 17 nt, Homo sapiens
ucacucuuauugcccac

SEQ ID NO: 1639403 - RNA, 16 nt, Homo sapiens
ucacugaaaagacuau

SEQ ID NO: 1639404 - RNA, 14 nt, Homo sapiens
ucacugcaaccucc

SEQ ID NO: 1639405 - RNA, 15 nt, Homo sapiens
ucacugcagccucaa

SEQ ID NO: 1639406 - RNA, 21 nt, Homo sapiens
ucacugcugcaaauacuguau

SEQ ID NO: 1639407 - RNA, 13 nt, Homo sapiens
ucacuggaacuca

SEQ ID NO: 1639408 - RNA, 19 nt, Homo sapiens
ucacuggaacucaguguga

SEQ ID NO: 1639409 - RNA, 14 nt, Homo sapiens
ucacuggcuguuaa

SEQ ID NO: 1639410 - RNA, 18 nt, Homo sapiens
ucacuuccaagagccuuu

SEQ ID NO: 1639411 - RNA, 13 nt, Homo sapiens
ucacuugcacauc

SEQ ID NO: 1639412 - RNA, 19 nt, Homo sapiens
ucacuuguucucacugucu

SEQ ID NO: 1639413 - RNA, 20 nt, Homo sapiens
ucacuuguucucacugucug

SEQ ID NO: 1639414 - RNA, 17 nt, Homo sapiens
ucacuuuggccucccaa

SEQ ID NO: 1639415 - RNA, 21 nt, Homo sapiens
ucagaaacacccucacacugg

SEQ ID NO: 1639416 - RNA, 13 nt, Homo sapiens
ucagaauaugauu

SEQ ID NO: 1639417 - RNA, 20 nt, Homo sapiens
ucagaaucacuucugagaac

SEQ ID NO: 1639418 - RNA, 19 nt, Homo sapiens
ucagacagcugccugggau

SEQ ID NO: 1639419 - RNA, 18 nt, Homo sapiens
ucagacuccagcugugaa

SEQ ID NO: 1639420 - RNA, 17 nt, Homo sapiens
ucagacuccuagacuca

SEQ ID NO: 1639421 - RNA, 15 nt, Homo sapiens
ucagagcuacuuggg

SEQ ID NO: 1639422 - RNA, 23 nt, Homo sapiens
ucagauauaaaagacugaccaau

SEQ ID NO: 1639423 - RNA, 19 nt, Homo sapiens
ucagauucacacaugccac

SEQ ID NO: 1639424 - RNA, 22 nt, Homo sapiens
ucagauucacacaugccacuau

SEQ ID NO: 1639425 - RNA, 17 nt, Homo sapiens
ucagcaacaaccagcau

SEQ ID NO: 1639426 - RNA, 13 nt, Homo sapiens
ucagcaagcauuu

SEQ ID NO: 1639427 - RNA, 17 nt, Homo sapiens
ucagcagagaaguuuuc

SEQ ID NO: 1639428 - RNA, 14 nt, Homo sapiens
ucagccucccaaag

SEQ ID NO: 1639429 - RNA, 19 nt, Homo sapiens
ucagccucccgaauagcug

SEQ ID NO: 1639430 - RNA, 18 nt, Homo sapiens
ucagccuggcugauuauc

SEQ ID NO: 1639431 - RNA, 18 nt, Homo sapiens
ucagcgcugucaggauug

SEQ ID NO: 1639432 - RNA, 15 nt, Homo sapiens
ucagcuacuuuccau

SEQ ID NO: 1639433 - RNA, 16 nt, Homo sapiens
ucagcucacuguucua

SEQ ID NO: 1639434 - RNA, 15 nt, Homo sapiens
ucagcuggaucucca

SEQ ID NO: 1639435 - RNA, 18 nt, Homo sapiens
ucagcuggaucuccauuc

SEQ ID NO: 1639436 - RNA, 19 nt, Homo sapiens
ucagcuuguaaauagcuca

SEQ ID NO: 1639437 - RNA, 16 nt, Homo sapiens
ucaggaagcucagggc

SEQ ID NO: 1639438 - RNA, 18 nt, Homo sapiens
ucaggaccaggcaaugug

SEQ ID NO: 1639439 - RNA, 20 nt, Homo sapiens
ucaggagaucuggcugugag

SEQ ID NO: 1639440 - RNA, 15 nt, Homo sapiens
ucaggcaacgcacaa

SEQ ID NO: 1639441 - RNA, 20 nt, Homo sapiens
ucaggccaucaucaguggag

SEQ ID NO: 1639442 - RNA, 13 nt, Homo sapiens
ucaggcucugaga

SEQ ID NO: 1639443 - RNA, 20 nt, Homo sapiens
ucagggagaguuugggaacu

SEQ ID NO: 1639444 - RNA, 15 nt, Homo sapiens
ucagggcagggauac

SEQ ID NO: 1639445 - RNA, 13 nt, Homo sapiens
ucagggucccugg

SEQ ID NO: 1639446 - RNA, 21 nt, Homo sapiens
ucagguaaucgaccugccucg

SEQ ID NO: 1639447 - RNA, 16 nt, Homo sapiens
ucagguggggcagcuu

SEQ ID NO: 1639448 - RNA, 18 nt, Homo sapiens
ucaguauucccagccuug

SEQ ID NO: 1639449 - RNA, 13 nt, Homo sapiens
ucagugaauuugu

SEQ ID NO: 1639450 - RNA, 21 nt, Homo sapiens
ucagugcuucgcagauguccu

SEQ ID NO: 1639451 - RNA, 20 nt, Homo sapiens
ucaguucuuacacauuccau

SEQ ID NO: 1639452 - RNA, 21 nt, Homo sapiens
ucaguucuuacacauuccauc

SEQ ID NO: 1639453 - RNA, 14 nt, Homo sapiens
ucauaccagucagu

SEQ ID NO: 1639454 - RNA, 13 nt, Homo sapiens
ucauacugccuug

SEQ ID NO: 1639455 - RNA, 22 nt, Homo sapiens
ucauaguggcuuaaaacaacac

SEQ ID NO: 1639456 - RNA, 13 nt, Homo sapiens
ucauauugcauca

SEQ ID NO: 1639457 - RNA, 13 nt, Homo sapiens
ucauauuuugcca

SEQ ID NO: 1639458 - RNA, 19 nt, Homo sapiens
ucaucaaauggaagacaca

SEQ ID NO: 1639459 - RNA, 21 nt, Homo sapiens
ucaucaagaaauacuuucgaa

SEQ ID NO: 1639460 - RNA, 23 nt, Homo sapiens
ucaucaaggcacugccugaugga

SEQ ID NO: 1639461 - RNA, 21 nt, Homo sapiens
ucauccaggacugagaugcaa

SEQ ID NO: 1639462 - RNA, 21 nt, Homo sapiens
ucaucccgagcaccuccacau

SEQ ID NO: 1639463 - RNA, 20 nt, Homo sapiens
ucaugaacacaauacauguu

SEQ ID NO: 1639464 - RNA, 19 nt, Homo sapiens
ucaugcauggaaauucccu

SEQ ID NO: 1639465 - RNA, 19 nt, Homo sapiens
ucaugcuggccugugugau

SEQ ID NO: 1639466 - RNA, 14 nt, Homo sapiens
ucauguaaacauac

SEQ ID NO: 1639467 - RNA, 17 nt, Homo sapiens
ucauguaaacugugcac

SEQ ID NO: 1639468 - RNA, 15 nt, Homo sapiens
ucauguaacacgaca

SEQ ID NO: 1639469 - RNA, 21 nt, Homo sapiens
ucauucucugucucauccauc

SEQ ID NO: 1639470 - RNA, 14 nt, Homo sapiens
ucauuuacuguggc

SEQ ID NO: 1639471 - RNA, 15 nt, Homo sapiens
uccaaaagcaaacaa

SEQ ID NO: 1639472 - RNA, 19 nt, Homo sapiens
uccaaacuaccuuccaguu

SEQ ID NO: 1639473 - RNA, 22 nt, Homo sapiens
uccaaauaaaaauaacaucauu

SEQ ID NO: 1639474 - RNA, 16 nt, Homo sapiens
uccaacaugugcucag

SEQ ID NO: 1639475 - RNA, 23 nt, Homo sapiens
uccaaccccccagcacugaggaa

SEQ ID NO: 1639476 - RNA, 14 nt, Homo sapiens
uccaacucuucacg

SEQ ID NO: 1639477 - RNA, 18 nt, Homo sapiens
uccaaggaaaccacagcu

SEQ ID NO: 1639478 - RNA, 23 nt, Homo sapiens
uccaagucuaggaacucccucag

SEQ ID NO: 1639479 - RNA, 12 nt, Homo sapiens
uccaaucagaac

SEQ ID NO: 1639480 - RNA, 17 nt, Homo sapiens
uccacaccuccaaugcu

SEQ ID NO: 1639481 - RNA, 16 nt, Homo sapiens
uccacaccuggucuga

SEQ ID NO: 1639482 - RNA, 23 nt, Homo sapiens
uccacggagccacuccucugacu

SEQ ID NO: 1639483 - RNA, 12 nt, Homo sapiens
uccacucccacu

SEQ ID NO: 1639484 - RNA, 15 nt, Homo sapiens
uccacucgccuucau

SEQ ID NO: 1639485 - RNA, 21 nt, Homo sapiens
uccacucgccuucaucuccca

SEQ ID NO: 1639486 - RNA, 18 nt, Homo sapiens
uccacuuguucauucugu

SEQ ID NO: 1639487 - RNA, 20 nt, Homo sapiens
uccagaugagaguacacccc

SEQ ID NO: 1639488 - RNA, 20 nt, Homo sapiens
uccagcaauucuccugccuc

SEQ ID NO: 1639489 - RNA, 16 nt, Homo sapiens
uccaggaagaaggugu

SEQ ID NO: 1639490 - RNA, 21 nt, Homo sapiens
uccaggaagaccccagcacag

SEQ ID NO: 1639491 - RNA, 14 nt, Homo sapiens
uccaggaugucaac

SEQ ID NO: 1639492 - RNA, 23 nt, Homo sapiens
uccaggggccacaagaccaucua

SEQ ID NO: 1639493 - RNA, 19 nt, Homo sapiens
uccaguggaacagucuucc

SEQ ID NO: 1639494 - RNA, 20 nt, Homo sapiens
uccaguggaacagucuuccc

SEQ ID NO: 1639495 - RNA, 17 nt, Homo sapiens
uccaucuuuccugaugg

SEQ ID NO: 1639496 - RNA, 19 nt, Homo sapiens
uccaugauguuuuccauga

SEQ ID NO: 1639497 - RNA, 20 nt, Homo sapiens
uccaugggccauaugaaaag

SEQ ID NO: 1639498 - RNA, 14 nt, Homo sapiens
uccaugucucugag

SEQ ID NO: 1639499 - RNA, 23 nt, Homo sapiens
ucccaaaagcccauucauuccau

SEQ ID NO: 1639500 - RNA, 13 nt, Homo sapiens
ucccaacauuucu

SEQ ID NO: 1639501 - RNA, 15 nt, Homo sapiens
ucccaacucacccca

SEQ ID NO: 1639502 - RNA, 13 nt, Homo sapiens
ucccaagcuccca

SEQ ID NO: 1639503 - RNA, 15 nt, Homo sapiens
ucccacucaguccau

SEQ ID NO: 1639504 - RNA, 12 nt, Homo sapiens
ucccacugccaa

SEQ ID NO: 1639505 - RNA, 19 nt, Homo sapiens
ucccagaacacggcagcug

SEQ ID NO: 1639506 - RNA, 22 nt, Homo sapiens
ucccagagaccuucugaucucc

SEQ ID NO: 1639507 - RNA, 13 nt, Homo sapiens
ucccagagcugca

SEQ ID NO: 1639508 - RNA, 14 nt, Homo sapiens
ucccagagcugcac

SEQ ID NO: 1639509 - RNA, 20 nt, Homo sapiens
ucccagaggggccugccacc

SEQ ID NO: 1639510 - RNA, 23 nt, Homo sapiens
ucccaggcugagccucagucucc

SEQ ID NO: 1639511 - RNA, 19 nt, Homo sapiens
ucccaggcuggagugcagu

SEQ ID NO: 1639512 - RNA, 20 nt, Homo sapiens
ucccaguggcugcugcccag

SEQ ID NO: 1639513 - RNA, 19 nt, Homo sapiens
ucccauaccacccaaugcu

SEQ ID NO: 1639514 - RNA, 21 nt, Homo sapiens
ucccaucacuguauccauucu

SEQ ID NO: 1639515 - RNA, 16 nt, Homo sapiens
ucccaucucacacaug

SEQ ID NO: 1639516 - RNA, 20 nt, Homo sapiens
ucccaucuugauaagaccac

SEQ ID NO: 1639517 - RNA, 18 nt, Homo sapiens
ucccauuugggcaguaua

SEQ ID NO: 1639518 - RNA, 19 nt, Homo sapiens
ucccauuugggcaguauag

SEQ ID NO: 1639519 - RNA, 21 nt, Homo sapiens
uccccaggguucaguccucaa

SEQ ID NO: 1639520 - RNA, 18 nt, Homo sapiens
ucccccugacaacacuca

SEQ ID NO: 1639521 - RNA, 14 nt, Homo sapiens
ucccccuuccaugg

SEQ ID NO: 1639522 - RNA, 19 nt, Homo sapiens
uccccucgcccaucagugc

SEQ ID NO: 1639523 - RNA, 20 nt, Homo sapiens
uccccucucagagcuacuug

SEQ ID NO: 1639524 - RNA, 21 nt, Homo sapiens
uccccuggggagucugggcac

SEQ ID NO: 1639525 - RNA, 22 nt, Homo sapiens
uccccuggggagucugggcaca

SEQ ID NO: 1639526 - RNA, 14 nt, Homo sapiens
uccccuucacuccc

SEQ ID NO: 1639527 - RNA, 14 nt, Homo sapiens
uccccuucucucau

SEQ ID NO: 1639528 - RNA, 15 nt, Homo sapiens
uccccuucucucauc

SEQ ID NO: 1639529 - RNA, 17 nt, Homo sapiens
ucccgaguagcugagau

SEQ ID NO: 1639530 - RNA, 19 nt, Homo sapiens
ucccuaccugacugccaca

SEQ ID NO: 1639531 - RNA, 11 nt, Homo sapiens
ucccucucuug

SEQ ID NO: 1639532 - RNA, 16 nt, Homo sapiens
ucccugaccuucugag

SEQ ID NO: 1639533 - RNA, 21 nt, Homo sapiens
ucccuucacuccccuauccca

SEQ ID NO: 1639534 - RNA, 17 nt, Homo sapiens
ucccuucaugcauggaa

SEQ ID NO: 1639535 - RNA, 21 nt, Homo sapiens
ucccuucggcgccagcagcuc

SEQ ID NO: 1639536 - RNA, 19 nt, Homo sapiens
ucccuuggggccuaugcag

SEQ ID NO: 1639537 - RNA, 15 nt, Homo sapiens
ucccuuucacuaaaa

SEQ ID NO: 1639538 - RNA, 15 nt, Homo sapiens
uccgaagucuuccau

SEQ ID NO: 1639539 - RNA, 22 nt, Homo sapiens
uccuaaauuguuguaauugcau

SEQ ID NO: 1639540 - RNA, 19 nt, Homo sapiens
uccuaagccaugggagaca

SEQ ID NO: 1639541 - RNA, 13 nt, Homo sapiens
uccuacaagacac

SEQ ID NO: 1639542 - RNA, 21 nt, Homo sapiens
uccuacaagacacagugacca

SEQ ID NO: 1639543 - RNA, 15 nt, Homo sapiens
uccuagggccacuga

SEQ ID NO: 1639544 - RNA, 17 nt, Homo sapiens
uccuauaauucuauuga

SEQ ID NO: 1639545 - RNA, 20 nt, Homo sapiens
uccuauuucuggaauggaaa

SEQ ID NO: 1639546 - RNA, 14 nt, Homo sapiens
uccucaaacacugc

SEQ ID NO: 1639547 - RNA, 15 nt, Homo sapiens
uccucaaacacugca

SEQ ID NO: 1639548 - RNA, 13 nt, Homo sapiens
uccucacuuugaa

SEQ ID NO: 1639549 - RNA, 17 nt, Homo sapiens
uccucaggugaccaaaa

SEQ ID NO: 1639550 - RNA, 14 nt, Homo sapiens
uccuccaugggaga

SEQ ID NO: 1639551 - RNA, 15 nt, Homo sapiens
uccucccaccucagc

SEQ ID NO: 1639552 - RNA, 15 nt, Homo sapiens
uccuccguggcacau

SEQ ID NO: 1639553 - RNA, 19 nt, Homo sapiens
uccuccuccagggacagca

SEQ ID NO: 1639554 - RNA, 14 nt, Homo sapiens
uccuccucugugaa

SEQ ID NO: 1639555 - RNA, 16 nt, Homo sapiens
uccuccucugugaaac

SEQ ID NO: 1639556 - RNA, 13 nt, Homo sapiens
uccucugacucag

SEQ ID NO: 1639557 - RNA, 18 nt, Homo sapiens
uccucugugaaacuggga

SEQ ID NO: 1639558 - RNA, 19 nt, Homo sapiens
uccucugugaccaaugucu

SEQ ID NO: 1639559 - RNA, 16 nt, Homo sapiens
uccucuuucaaccuca

SEQ ID NO: 1639560 - RNA, 19 nt, Homo sapiens
uccugaccucgugauccac

SEQ ID NO: 1639561 - RNA, 14 nt, Homo sapiens
uccugccaccacgc

SEQ ID NO: 1639562 - RNA, 22 nt, Homo sapiens
uccugccccagauggcuuugug

SEQ ID NO: 1639563 - RNA, 21 nt, Homo sapiens
uccuggaaccaggcuugccug

SEQ ID NO: 1639564 - RNA, 15 nt, Homo sapiens
uccuggauuccucac

SEQ ID NO: 1639565 - RNA, 17 nt, Homo sapiens
uccuggccagaugucgc

SEQ ID NO: 1639566 - RNA, 13 nt, Homo sapiens
uccugggcccucu

SEQ ID NO: 1639567 - RNA, 17 nt, Homo sapiens
uccugugacacuuauaa

SEQ ID NO: 1639568 - RNA, 20 nt, Homo sapiens
uccuguuaacacuguaauau

SEQ ID NO: 1639569 - RNA, 22 nt, Homo sapiens
uccuuauauuuggcccaaacuc

SEQ ID NO: 1639570 - RNA, 17 nt, Homo sapiens
uccuuaucaaaggacac

SEQ ID NO: 1639571 - RNA, 18 nt, Homo sapiens
uccuuccuuuucuuugag

SEQ ID NO: 1639572 - RNA, 15 nt, Homo sapiens
uccuuucauuuacug

SEQ ID NO: 1639573 - RNA, 19 nt, Homo sapiens
ucgagacuuggguguuugu

SEQ ID NO: 1639574 - RNA, 21 nt, Homo sapiens
ucgauguccuccucugugaaa

SEQ ID NO: 1639575 - RNA, 22 nt, Homo sapiens
ucgcuccugugucuugcaaugg

SEQ ID NO: 1639576 - RNA, 20 nt, Homo sapiens
ucgcuggguccucugcagug

SEQ ID NO: 1639577 - RNA, 19 nt, Homo sapiens
ucgggaagaaggggacaau

SEQ ID NO: 1639578 - RNA, 18 nt, Homo sapiens
ucgggcuccugugcccuu

SEQ ID NO: 1639579 - RNA, 14 nt, Homo sapiens
ucgucauacaguaa

SEQ ID NO: 1639580 - RNA, 15 nt, Homo sapiens
ucgugacaacacuug

SEQ ID NO: 1639581 - RNA, 15 nt, Homo sapiens
ucgugcuaaacgcac

SEQ ID NO: 1639582 - RNA, 22 nt, Homo sapiens
ucuaaaaauucuuaacuuuuaa

SEQ ID NO: 1639583 - RNA, 15 nt, Homo sapiens
ucuaaaaugauacug

SEQ ID NO: 1639584 - RNA, 18 nt, Homo sapiens
ucuaaaaugauacugugu

SEQ ID NO: 1639585 - RNA, 14 nt, Homo sapiens
ucuaaaugccaaug

SEQ ID NO: 1639586 - RNA, 20 nt, Homo sapiens
ucuaaauggugcugcagauu

SEQ ID NO: 1639587 - RNA, 14 nt, Homo sapiens
ucuaaccauguauc

SEQ ID NO: 1639588 - RNA, 14 nt, Homo sapiens
ucuacacaacaugu

SEQ ID NO: 1639589 - RNA, 19 nt, Homo sapiens
ucuacagagcuucccugac

SEQ ID NO: 1639590 - RNA, 19 nt, Homo sapiens
ucuagaucacugugcuuau

SEQ ID NO: 1639591 - RNA, 20 nt, Homo sapiens
ucuaggcuggggaaguccuc

SEQ ID NO: 1639592 - RNA, 13 nt, Homo sapiens
ucuaguauuucca

SEQ ID NO: 1639593 - RNA, 15 nt, Homo sapiens
ucuaguauuuccaca

SEQ ID NO: 1639594 - RNA, 16 nt, Homo sapiens
ucuauauccuugacac

SEQ ID NO: 1639595 - RNA, 16 nt, Homo sapiens
ucuaucuuugagcgcc

SEQ ID NO: 1639596 - RNA, 17 nt, Homo sapiens
ucuaugagggcuaauau

SEQ ID NO: 1639597 - RNA, 16 nt, Homo sapiens
ucuauuuaacaacugg

SEQ ID NO: 1639598 - RNA, 18 nt, Homo sapiens
ucucaauauuaagucauu

SEQ ID NO: 1639599 - RNA, 16 nt, Homo sapiens
ucucaaucuccugacu

SEQ ID NO: 1639600 - RNA, 21 nt, Homo sapiens
ucucaccuaaacccucuguga

SEQ ID NO: 1639601 - RNA, 15 nt, Homo sapiens
ucucacuauaccagu

SEQ ID NO: 1639602 - RNA, 14 nt, Homo sapiens
ucucacugacuauu

SEQ ID NO: 1639603 - RNA, 18 nt, Homo sapiens
ucucacuguugcccaggc

SEQ ID NO: 1639604 - RNA, 17 nt, Homo sapiens
ugaaugugacuacuuag

SEQ ID NO: 1639605 - RNA, 18 nt, Homo sapiens
ugaauuagauuauuucug

SEQ ID NO: 1639606 - RNA, 13 nt, Homo sapiens
ugaauuagcucac

SEQ ID NO: 1639607 - RNA, 22 nt, Homo sapiens
ugacaaacuucuuucacucaca

SEQ ID NO: 1639608 - RNA, 12 nt, Homo sapiens
ugacacacagcu

SEQ ID NO: 1639609 - RNA, 13 nt, Homo sapiens
ugacacacagcuc

SEQ ID NO: 1639610 - RNA, 22 nt, Homo sapiens
ugacacaggaugaaggcaaugc

SEQ ID NO: 1639611 - RNA, 19 nt, Homo sapiens
ugacaccauuuuccugccu

SEQ ID NO: 1639612 - RNA, 22 nt, Homo sapiens
ugacaccccccuucugaaugaa

SEQ ID NO: 1639613 - RNA, 19 nt, Homo sapiens
ugacacugguauuccugcc

SEQ ID NO: 1639614 - RNA, 16 nt, Homo sapiens
ugacaguccucuccac

SEQ ID NO: 1639615 - RNA, 12 nt, Homo sapiens
ugacaugugcuu

SEQ ID NO: 1639616 - RNA, 14 nt, Homo sapiens
ugacaugugcuuug

SEQ ID NO: 1639617 - RNA, 15 nt, Homo sapiens
ugacauuauaugcac

SEQ ID NO: 1639618 - RNA, 21 nt, Homo sapiens
ugaccaaaauccccuucucau

SEQ ID NO: 1639619 - RNA, 20 nt, Homo sapiens
ugaccucgcccuccacaaau

SEQ ID NO: 1639620 - RNA, 14 nt, Homo sapiens
ugacucuuggcaca

SEQ ID NO: 1639621 - RNA, 18 nt, Homo sapiens
ugacuguaacgauugaca

SEQ ID NO: 1639622 - RNA, 16 nt, Homo sapiens
ugacuuaagugugcaa

SEQ ID NO: 1639623 - RNA, 12 nt, Homo sapiens
ugacuucagugu

SEQ ID NO: 1639624 - RNA, 13 nt, Homo sapiens
ugacuuugcauca

SEQ ID NO: 1639625 - RNA, 14 nt, Homo sapiens
ugagaacacuguga

SEQ ID NO: 1639626 - RNA, 16 nt, Homo sapiens
ugagacuaugcaaaag

SEQ ID NO: 1639627 - RNA, 12 nt, Homo sapiens
ugagacuugaau

SEQ ID NO: 1639628 - RNA, 15 nt, Homo sapiens
ugagaucauugugaa

SEQ ID NO: 1639629 - RNA, 21 nt, Homo sapiens
ugagcaaaaccaaauauucca

SEQ ID NO: 1639630 - RNA, 15 nt, Homo sapiens
ugagcagaauacugg

SEQ ID NO: 1639631 - RNA, 17 nt, Homo sapiens
ugagcagaauacugguc

SEQ ID NO: 1639632 - RNA, 14 nt, Homo sapiens
ugagcauggagcug

SEQ ID NO: 1639633 - RNA, 13 nt, Homo sapiens
ugagccacugcac

SEQ ID NO: 1639634 - RNA, 15 nt, Homo sapiens
ugagccuaauauuug

SEQ ID NO: 1639635 - RNA, 19 nt, Homo sapiens
ugagcucacugaaaagacu

SEQ ID NO: 1639636 - RNA, 21 nt, Homo sapiens
ugagcuuaagaauuuugagca

SEQ ID NO: 1639637 - RNA, 13 nt, Homo sapiens
ugaggagucuugu

SEQ ID NO: 1639638 - RNA, 20 nt, Homo sapiens
ugaggagucuugugugcauu

SEQ ID NO: 1639639 - RNA, 11 nt, Homo sapiens
ugaggcucacg

SEQ ID NO: 1639640 - RNA, 12 nt, Homo sapiens
ugaggguguaua

SEQ ID NO: 1639641 - RNA, 23 nt, Homo sapiens
ugagguugcgccacuacacucca

SEQ ID NO: 1639642 - RNA, 21 nt, Homo sapiens
ugaguagcugggauuacaggc

SEQ ID NO: 1639643 - RNA, 16 nt, Homo sapiens
ugagucccagagccaa

SEQ ID NO: 1639644 - RNA, 14 nt, Homo sapiens
ugagucgaggacag

SEQ ID NO: 1639645 - RNA, 15 nt, Homo sapiens
ugagugcgugcucag

SEQ ID NO: 1639646 - RNA, 20 nt, Homo sapiens
ugagugguggaggaggacac

SEQ ID NO: 1639647 - RNA, 21 nt, Homo sapiens
ugaguugguguugacaugugc

SEQ ID NO: 1639648 - RNA, 22 nt, Homo sapiens
ugauaagagggcacacacugug

SEQ ID NO: 1639649 - RNA, 15 nt, Homo sapiens
ugauacaagagucag

SEQ ID NO: 1639650 - RNA, 17 nt, Homo sapiens
ugauacgauaguuacau

SEQ ID NO: 1639651 - RNA, 17 nt, Homo sapiens
ugauacuuugacagugu

SEQ ID NO: 1639652 - RNA, 18 nt, Homo sapiens
ugauacuuugacaguguu

SEQ ID NO: 1639653 - RNA, 22 nt, Homo sapiens
ugauagguauaaguggugugug

SEQ ID NO: 1639654 - RNA, 17 nt, Homo sapiens
ugauauauaaaugugau

SEQ ID NO: 1639655 - RNA, 21 nt, Homo sapiens
ugauauauaaaugugauugca

SEQ ID NO: 1639656 - RNA, 20 nt, Homo sapiens
ugauauguugguagauucua

SEQ ID NO: 1639657 - RNA, 12 nt, Homo sapiens
ugauauugcagc

SEQ ID NO: 1639658 - RNA, 13 nt, Homo sapiens
ugauauugcagcu

SEQ ID NO: 1639659 - RNA, 19 nt, Homo sapiens
ugaucacggcucacugcag

SEQ ID NO: 1639660 - RNA, 12 nt, Homo sapiens
ugaucugaugca

SEQ ID NO: 1639661 - RNA, 18 nt, Homo sapiens
ugaugaaauguaaauacu

SEQ ID NO: 1639662 - RNA, 20 nt, Homo sapiens
ugaugaacuguggugccaca

SEQ ID NO: 1639663 - RNA, 21 nt, Homo sapiens
ugauggaaauacacuguuauc

SEQ ID NO: 1639664 - RNA, 17 nt, Homo sapiens
ugaugucguuugaauca

SEQ ID NO: 1639665 - RNA, 19 nt, Homo sapiens
ugauucauacauuaucuca

SEQ ID NO: 1639666 - RNA, 21 nt, Homo sapiens
ugauuccuauaaaucuaauga

SEQ ID NO: 1639667 - RNA, 16 nt, Homo sapiens
ugauucugucaauguc

SEQ ID NO: 1639668 - RNA, 22 nt, Homo sapiens
ugauuucagcaccuacagugua

SEQ ID NO: 1639669 - RNA, 22 nt, Homo sapiens
ugauuugaccauucuuuugcca

SEQ ID NO: 1639670 - RNA, 13 nt, Homo sapiens
ugauuuguauuaa

SEQ ID NO: 1639671 - RNA, 14 nt, Homo sapiens
ugcaaaaacagagg

SEQ ID NO: 1639672 - RNA, 22 nt, Homo sapiens
ugcaaaagcaggcuugugcuuu

SEQ ID NO: 1639673 - RNA, 12 nt, Homo sapiens
ugcaaacagugu

SEQ ID NO: 1639674 - RNA, 19 nt, Homo sapiens
ugcaaauacuguauauuca

SEQ ID NO: 1639675 - RNA, 15 nt, Homo sapiens
ugcaacagacuugaa

SEQ ID NO: 1639676 - RNA, 13 nt, Homo sapiens
ugcaacuuguaaa

SEQ ID NO: 1639677 - RNA, 16 nt, Homo sapiens
ugcaagauuguuuuca

SEQ ID NO: 1639678 - RNA, 18 nt, Homo sapiens
ugcaaucagcuaccauuc

SEQ ID NO: 1639679 - RNA, 12 nt, Homo sapiens
ugcaauuuagaa

SEQ ID NO: 1639680 - RNA, 19 nt, Homo sapiens
ugcacaacauuacagggaa

SEQ ID NO: 1639681 - RNA, 14 nt, Homo sapiens
ugcacacuuugcca

SEQ ID NO: 1639682 - RNA, 13 nt, Homo sapiens
ugcaccaaaucau

SEQ ID NO: 1639683 - RNA, 17 nt, Homo sapiens
ugcaccaaaucaucucu

SEQ ID NO: 1639684 - RNA, 14 nt, Homo sapiens
ugcaccacuuuuaa

SEQ ID NO: 1639685 - RNA, 23 nt, Homo sapiens
ugcaccauucuuucuuggugcau

SEQ ID NO: 1639686 - RNA, 14 nt, Homo sapiens
ugcacgugugugca

SEQ ID NO: 1639687 - RNA, 15 nt, Homo sapiens
ugcagagguccacaa

SEQ ID NO: 1639688 - RNA, 15 nt, Homo sapiens
ugcagccacuguuaa

SEQ ID NO: 1639689 - RNA, 20 nt, Homo sapiens
ugcagccacuguuaagccau

SEQ ID NO: 1639690 - RNA, 16 nt, Homo sapiens
ugcagccucaaccucc

SEQ ID NO: 1639691 - RNA, 16 nt, Homo sapiens
ugcagcuaacuuauca

SEQ ID NO: 1639692 - RNA, 13 nt, Homo sapiens
ugcaggcacagua

SEQ ID NO: 1639693 - RNA, 18 nt, Homo sapiens
ugcagugguaugaucacg

SEQ ID NO: 1639694 - RNA, 19 nt, Homo sapiens
ugcauaaauaugcagugau

SEQ ID NO: 1639695 - RNA, 22 nt, Homo sapiens
ugcauaaaugcgauccacagaa

SEQ ID NO: 1639696 - RNA, 16 nt, Homo sapiens
ugcauaagugcaugac

SEQ ID NO: 1639697 - RNA, 21 nt, Homo sapiens
ugcauauccaacaugugcuca

SEQ ID NO: 1639698 - RNA, 14 nt, Homo sapiens
ugcauauuugcaaa

SEQ ID NO: 1639699 - RNA, 17 nt, Homo sapiens
ugcauccuccgccuccc

SEQ ID NO: 1639700 - RNA, 17 nt, Homo sapiens
ugcaucugcuacugugu

SEQ ID NO: 1639701 - RNA, 18 nt, Homo sapiens
ugcaucugcuacuguguc

SEQ ID NO: 1639702 - RNA, 21 nt, Homo sapiens
ugcaucugcuacugugucagg

SEQ ID NO: 1639703 - RNA, 21 nt, Homo sapiens
ugcaugcgagugcucauuuca

SEQ ID NO: 1639704 - RNA, 15 nt, Homo sapiens
ugcauggaaauuccc

SEQ ID NO: 1639705 - RNA, 22 nt, Homo sapiens
ugcauucuuauucaucagggag

SEQ ID NO: 1639706 - RNA, 19 nt, Homo sapiens
ugccaacuucuucagagcu

SEQ ID NO: 1639707 - RNA, 19 nt, Homo sapiens
ugccaagcacugugcucag

SEQ ID NO: 1639708 - RNA, 18 nt, Homo sapiens
ugccaccacgcccggcua

SEQ ID NO: 1639709 - RNA, 18 nt, Homo sapiens
ugccaccuccugccucag

SEQ ID NO: 1639710 - RNA, 16 nt, Homo sapiens
ugccagccacugugau

SEQ ID NO: 1639711 - RNA, 19 nt, Homo sapiens
ugccagccccgccacgcuu

SEQ ID NO: 1639712 - RNA, 21 nt, Homo sapiens
ugccaguaggcucaacuaggg

SEQ ID NO: 1639713 - RNA, 21 nt, Homo sapiens
ugccauagaggacagcaacug

SEQ ID NO: 1639714 - RNA, 22 nt, Homo sapiens
ugagacuuugaggguguauauu

SEQ ID NO: 1639715 - RNA, 15 nt, Homo sapiens
ugagagaccaggcaa

SEQ ID NO: 1639716 - RNA, 11 nt, Homo sapiens
ugagaguacac

SEQ ID NO: 1639717 - RNA, 16 nt, Homo sapiens
ugagaguacaccccaa

SEQ ID NO: 1639718 - RNA, 13 nt, Homo sapiens
ugagaucauucac

SEQ ID NO: 1639719 - RNA, 16 nt, Homo sapiens
ugagaucauucacuca

SEQ ID NO: 1639720 - RNA, 15 nt, Homo sapiens
ugagauguuuuacca

SEQ ID NO: 1639721 - RNA, 21 nt, Homo sapiens
ugagauuauaggcaccuacca

SEQ ID NO: 1639722 - RNA, 14 nt, Homo sapiens
ugagcaaaaccaaa

SEQ ID NO: 1639723 - RNA, 22 nt, Homo sapiens
ugagcagaauacuggucucagg

SEQ ID NO: 1639724 - RNA, 15 nt, Homo sapiens
ugagcaucuccagca

SEQ ID NO: 1639725 - RNA, 19 nt, Homo sapiens
ugagcugcccccaaaucaa

SEQ ID NO: 1639726 - RNA, 15 nt, Homo sapiens
ugagcugggcagcug

SEQ ID NO: 1639727 - RNA, 12 nt, Homo sapiens
ugagcugugcag

SEQ ID NO: 1639728 - RNA, 15 nt, Homo sapiens
ugaggaacccuuaca

SEQ ID NO: 1639729 - RNA, 17 nt, Homo sapiens
ugaggaauauuugcaag

SEQ ID NO: 1639730 - RNA, 17 nt, Homo sapiens
ugaggaaugucuuucag

SEQ ID NO: 1639731 - RNA, 15 nt, Homo sapiens
ugaggacugauuuca

SEQ ID NO: 1639732 - RNA, 20 nt, Homo sapiens
ugaggagcuguuacugaaua

SEQ ID NO: 1639733 - RNA, 20 nt, Homo sapiens
ugaggauuuugauccaagcu

SEQ ID NO: 1639734 - RNA, 17 nt, Homo sapiens
ugaggcuuagcuuugcu

SEQ ID NO: 1639735 - RNA, 19 nt, Homo sapiens
ugagggagccuggccccau

SEQ ID NO: 1639736 - RNA, 19 nt, Homo sapiens
ugaggucuuuuacauacag

SEQ ID NO: 1639737 - RNA, 19 nt, Homo sapiens
ugaguacuacaguccuccc

SEQ ID NO: 1639738 - RNA, 20 nt, Homo sapiens
ugaguauugauaaacuuuga

SEQ ID NO: 1639739 - RNA, 19 nt, Homo sapiens
ugagucaaaaaaucucaau

SEQ ID NO: 1639740 - RNA, 19 nt, Homo sapiens
ugagucccagagccaauca

SEQ ID NO: 1639741 - RNA, 12 nt, Homo sapiens
ugagugguggag

SEQ ID NO: 1639742 - RNA, 19 nt, Homo sapiens
ugaguuacuaucaugucaa

SEQ ID NO: 1639743 - RNA, 14 nt, Homo sapiens
ugaguuuucagugg

SEQ ID NO: 1639744 - RNA, 21 nt, Homo sapiens
ugauacaaauugcagacugug

SEQ ID NO: 1639745 - RNA, 13 nt, Homo sapiens
ugauacguguaug

SEQ ID NO: 1639746 - RNA, 21 nt, Homo sapiens
ugauauagaacagugcuugcc

SEQ ID NO: 1639747 - RNA, 15 nt, Homo sapiens
ugauauugcagcuua

SEQ ID NO: 1639748 - RNA, 23 nt, Homo sapiens
ugauauuucccuccccuggggac

SEQ ID NO: 1639749 - RNA, 21 nt, Homo sapiens
ugauauuuccuucaccaccuc

SEQ ID NO: 1639750 - RNA, 14 nt, Homo sapiens
ugauccugugaagu

SEQ ID NO: 1639751 - RNA, 15 nt, Homo sapiens
ugauccuuccaccuc

SEQ ID NO: 1639752 - RNA, 16 nt, Homo sapiens
ugauccuuccaccuca

SEQ ID NO: 1639753 - RNA, 17 nt, Homo sapiens
ugaucuuugucuuuauu

SEQ ID NO: 1639754 - RNA, 13 nt, Homo sapiens
ugaugaucuuugc

SEQ ID NO: 1639755 - RNA, 20 nt, Homo sapiens
ugaugcaagcaagaaacacu

SEQ ID NO: 1639756 - RNA, 16 nt, Homo sapiens
ugaugcucacauauga

SEQ ID NO: 1639757 - RNA, 13 nt, Homo sapiens
ugaugcugggauu

SEQ ID NO: 1639758 - RNA, 24 nt, Homo sapiens
ugauuagaaauuaccuguggauau

SEQ ID NO: 1639759 - RNA, 15 nt, Homo sapiens
ugauucauauugcau

SEQ ID NO: 1639760 - RNA, 17 nt, Homo sapiens
ugauucauauugcauca

SEQ ID NO: 1639761 - RNA, 19 nt, Homo sapiens
ugauuccaucaaagagaag

SEQ ID NO: 1639762 - RNA, 13 nt, Homo sapiens
ugauuuacaugcu

SEQ ID NO: 1639763 - RNA, 15 nt, Homo sapiens
ucugcuacuguguca

SEQ ID NO: 1639764 - RNA, 18 nt, Homo sapiens
ucugcuauuugcuguuau

SEQ ID NO: 1639765 - RNA, 14 nt, Homo sapiens
ucugcucaucauuc

SEQ ID NO: 1639766 - RNA, 19 nt, Homo sapiens
ucugcuccaccuugugacc

SEQ ID NO: 1639767 - RNA, 16 nt, Homo sapiens
ucugcucucauauaag

SEQ ID NO: 1639768 - RNA, 17 nt, Homo sapiens
ucugcuuaaucugagaa

SEQ ID NO: 1639769 - RNA, 17 nt, Homo sapiens
ucuggcaccaaagucca

SEQ ID NO: 1639770 - RNA, 15 nt, Homo sapiens
ucuggcucuuccagg

SEQ ID NO: 1639771 - RNA, 15 nt, Homo sapiens
ucugucccacuuggc

SEQ ID NO: 1639772 - RNA, 17 nt, Homo sapiens
ucuguccuacucugugu

SEQ ID NO: 1639773 - RNA, 19 nt, Homo sapiens
ucugucuccuuaacacuga

SEQ ID NO: 1639774 - RNA, 15 nt, Homo sapiens
ucugugaaacuggga

SEQ ID NO: 1639775 - RNA, 20 nt, Homo sapiens
ucugugugguucagcuacuu

SEQ ID NO: 1639776 - RNA, 15 nt, Homo sapiens
ucuguucuuccauca

SEQ ID NO: 1639777 - RNA, 21 nt, Homo sapiens
ucuuaaacauaauaaaucaca

SEQ ID NO: 1639778 - RNA, 11 nt, Homo sapiens
ucuuaacucac

SEQ ID NO: 1639779 - RNA, 20 nt, Homo sapiens
ucuuaagcagauagcacaua

SEQ ID NO: 1639780 - RNA, 12 nt, Homo sapiens
ucuuaaucuuuu

SEQ ID NO: 1639781 - RNA, 18 nt, Homo sapiens
ucuuaaucuuuucacaaa

SEQ ID NO: 1639782 - RNA, 18 nt, Homo sapiens
ucuuacaaaagauuguca

SEQ ID NO: 1639783 - RNA, 18 nt, Homo sapiens
ucuuacagucagcacaga

SEQ ID NO: 1639784 - RNA, 19 nt, Homo sapiens
ucuuacauuagugauucca

SEQ ID NO: 1639785 - RNA, 21 nt, Homo sapiens
ucuuaccuuuugugguucuca

SEQ ID NO: 1639786 - RNA, 16 nt, Homo sapiens
ucuuacuuugugcaaa

SEQ ID NO: 1639787 - RNA, 14 nt, Homo sapiens
ucuuagaaaauuca

SEQ ID NO: 1639788 - RNA, 16 nt, Homo sapiens
ucuuagucgagccaag

SEQ ID NO: 1639789 - RNA, 14 nt, Homo sapiens
ucuuaguugcugua

SEQ ID NO: 1639790 - RNA, 14 nt, Homo sapiens
ucuucaccauuugg

SEQ ID NO: 1639791 - RNA, 12 nt, Homo sapiens
ucuucaccucag

SEQ ID NO: 1639792 - RNA, 20 nt, Homo sapiens
ucuucacggaaagugccugc

SEQ ID NO: 1639793 - RNA, 13 nt, Homo sapiens
ucuuccaucaccu

SEQ ID NO: 1639794 - RNA, 20 nt, Homo sapiens
ucuucccuaucuuugccacc

SEQ ID NO: 1639795 - RNA, 16 nt, Homo sapiens
ucuucuacuaccccca

SEQ ID NO: 1639796 - RNA, 18 nt, Homo sapiens
ucuugcaagcaacaagcu

SEQ ID NO: 1639797 - RNA, 15 nt, Homo sapiens
ucuugccagccacau

SEQ ID NO: 1639798 - RNA, 20 nt, Homo sapiens
ucuugggaauuuucuuccaa

SEQ ID NO: 1639799 - RNA, 22 nt, Homo sapiens
ucuugguugaggaaacaaacau

SEQ ID NO: 1639800 - RNA, 19 nt, Homo sapiens
ucuuuaacagcuuacacug

SEQ ID NO: 1639801 - RNA, 16 nt, Homo sapiens
ucuuuaaugauuccua

SEQ ID NO: 1639802 - RNA, 21 nt, Homo sapiens
ucuuuauaaugggauauaguu

SEQ ID NO: 1639803 - RNA, 20 nt, Homo sapiens
ucuuugauucaaagcacugu

SEQ ID NO: 1639804 - RNA, 18 nt, Homo sapiens
ucuuuggacagaagcagc

SEQ ID NO: 1639805 - RNA, 11 nt, Homo sapiens
ucuuuguucaa

SEQ ID NO: 1639806 - RNA, 18 nt, Homo sapiens
ucuuuuaagcuaucuaua

SEQ ID NO: 1639807 - RNA, 17 nt, Homo sapiens
ucuuuugccaaugucau

SEQ ID NO: 1639808 - RNA, 21 nt, Homo sapiens
ucuuuuuagagaaauuugcca

SEQ ID NO: 1639809 - RNA, 16 nt, Homo sapiens
ugaaaaaaaacagugg

SEQ ID NO: 1639810 - RNA, 17 nt, Homo sapiens
ugaaaaauaagucacuu

SEQ ID NO: 1639811 - RNA, 13 nt, Homo sapiens
ugaaaaaugccuc

SEQ ID NO: 1639812 - RNA, 18 nt, Homo sapiens
ugaaaacaaguuccaaau

SEQ ID NO: 1639813 - RNA, 15 nt, Homo sapiens
gaucccucucuggau

SEQ ID NO: 1639814 - RNA, 20 nt, Homo sapiens
gaucgugccauugcacucca

SEQ ID NO: 1639815 - RNA, 14 nt, Homo sapiens
gaucuccacuguug

SEQ ID NO: 1639816 - RNA, 22 nt, Homo sapiens
gaucuggcugugaggcccucag

SEQ ID NO: 1639817 - RNA, 21 nt, Homo sapiens
gaugaucuaggaagacuuugg

SEQ ID NO: 1639818 - RNA, 16 nt, Homo sapiens
gaugcauggaguguuu

SEQ ID NO: 1639819 - RNA, 17 nt, Homo sapiens
gaugcucacauaugaua

SEQ ID NO: 1639820 - RNA, 9 nt, Homo sapiens
gauggagcu

SEQ ID NO: 1639821 - RNA, 14 nt, Homo sapiens
gauguuacugagau

SEQ ID NO: 1639822 - RNA, 22 nt, Homo sapiens
gauuaaugaaucguaaugaagu

SEQ ID NO: 1639823 - RNA, 22 nt, Homo sapiens
gauuacaagcgugagccacugc

SEQ ID NO: 1639824 - RNA, 19 nt, Homo sapiens
gauuacaggcgugagccac

SEQ ID NO: 1639825 - RNA, 13 nt, Homo sapiens
gauuaucuaccca

SEQ ID NO: 1639826 - RNA, 22 nt, Homo sapiens
gauuauuuaauaacauuaccuu

SEQ ID NO: 1639827 - RNA, 17 nt, Homo sapiens
gauucaauucaacacuc

SEQ ID NO: 1639828 - RNA, 14 nt, Homo sapiens
gauucacaguguga

SEQ ID NO: 1639829 - RNA, 23 nt, Homo sapiens
gauucacccccaaacagugacau

SEQ ID NO: 1639830 - RNA, 15 nt, Homo sapiens
gauuccaucaaagag

SEQ ID NO: 1639831 - RNA, 16 nt, Homo sapiens
gauuccucacuuugaa

SEQ ID NO: 1639832 - RNA, 16 nt, Homo sapiens
gauucucaugccucag

SEQ ID NO: 1639833 - RNA, 11 nt, Homo sapiens
gauuguguuaa

SEQ ID NO: 1639834 - RNA, 23 nt, Homo sapiens
gauuuauuguuauauuacuugcc

SEQ ID NO: 1639835 - RNA, 16 nt, Homo sapiens
gauuuugcuguagaag

SEQ ID NO: 1639836 - RNA, 22 nt, Homo sapiens
gauuuuuuuuaauuaccaugcu

SEQ ID NO: 1639837 - RNA, 20 nt, Homo sapiens
gcaaaggcugagaacacugu

SEQ ID NO: 1639838 - RNA, 13 nt, Homo sapiens
gcaaauacuguau

SEQ ID NO: 1639839 - RNA, 17 nt, Homo sapiens
gcaaaugaauggcucac

SEQ ID NO: 1639840 - RNA, 16 nt, Homo sapiens
gcaaauggccaaugag

SEQ ID NO: 1639841 - RNA, 18 nt, Homo sapiens
gcaacagcaaacaggugc

SEQ ID NO: 1639842 - RNA, 19 nt, Homo sapiens
gcaaccuuuggaugcacuu

SEQ ID NO: 1639843 - RNA, 21 nt, Homo sapiens
gcaagcaagaaacacugggcu

SEQ ID NO: 1639844 - RNA, 20 nt, Homo sapiens
gcaagcucuaucaccaagga

SEQ ID NO: 1639845 - RNA, 16 nt, Homo sapiens
gcaaggaaacuaugua

SEQ ID NO: 1639846 - RNA, 16 nt, Homo sapiens
gcaauagaaauccaau

SEQ ID NO: 1639847 - RNA, 16 nt, Homo sapiens
gcaaugguuuguguca

SEQ ID NO: 1639848 - RNA, 18 nt, Homo sapiens
gcaaugguuugugucaaa

SEQ ID NO: 1639849 - RNA, 23 nt, Homo sapiens
gcaaugguuugugucaaaacugg

SEQ ID NO: 1639850 - RNA, 17 nt, Homo sapiens
gcaauucuccugccuca

SEQ ID NO: 1639851 - RNA, 21 nt, Homo sapiens
gcaauuuagaacuagauuuug

SEQ ID NO: 1639852 - RNA, 18 nt, Homo sapiens
gcacaauaguaaccuggg

SEQ ID NO: 1639853 - RNA, 15 nt, Homo sapiens
gcacacacacauaca

SEQ ID NO: 1639854 - RNA, 14 nt, Homo sapiens
gcacacacagugau

SEQ ID NO: 1639855 - RNA, 13 nt, Homo sapiens
gcacacacugugu

SEQ ID NO: 1639856 - RNA, 10 nt, Homo sapiens
gcacaccucu

SEQ ID NO: 1639857 - RNA, 12 nt, Homo sapiens
gcacagacucac

SEQ ID NO: 1639858 - RNA, 17 nt, Homo sapiens
gcacagaugcccacgua

SEQ ID NO: 1639859 - RNA, 17 nt, Homo sapiens
gcacagguuagggcaug

SEQ ID NO: 1639860 - RNA, 14 nt, Homo sapiens
gcacagugaucacc

SEQ ID NO: 1639861 - RNA, 22 nt, Homo sapiens
gcacauuagccuaugugcaugc

SEQ ID NO: 1639862 - RNA, 21 nt, Homo sapiens
gcacauuuaagagacagucac

SEQ ID NO: 1639863 - RNA, 20 nt, Homo sapiens
gcaccacuuuuaacagaaca

SEQ ID NO: 1639864 - RNA, 18 nt, Homo sapiens
gcacccagccucuaggga

SEQ ID NO: 1639865 - RNA, 19 nt, Homo sapiens
gcaccuacacucaccugca

SEQ ID NO: 1639866 - RNA, 15 nt, Homo sapiens
gcaccuacaguguac

SEQ ID NO: 1639867 - RNA, 21 nt, Homo sapiens
gcacugcugggggugaggaca

SEQ ID NO: 1639868 - RNA, 22 nt, Homo sapiens
gcacuguccugcuccacagugu

SEQ ID NO: 1639869 - RNA, 16 nt, Homo sapiens
gcacuguuucucucac

SEQ ID NO: 1639870 - RNA, 15 nt, Homo sapiens
gcacuuauugaauau

SEQ ID NO: 1639871 - RNA, 19 nt, Homo sapiens
gcagacuccacacucagua

SEQ ID NO: 1639872 - RNA, 21 nt, Homo sapiens
gcagaucuaccccuuacuuau

SEQ ID NO: 1639873 - RNA, 16 nt, Homo sapiens
gaccuguggugcaaaa

SEQ ID NO: 1639874 - RNA, 22 nt, Homo sapiens
gaccuucuaggaagcuccaguu

SEQ ID NO: 1639875 - RNA, 14 nt, Homo sapiens
gacgcagccugaga

SEQ ID NO: 1639876 - RNA, 22 nt, Homo sapiens
gacgccaucccagccccaauga

SEQ ID NO: 1639877 - RNA, 18 nt, Homo sapiens
gacgcggcaggcuucuca

SEQ ID NO: 1639878 - RNA, 22 nt, Homo sapiens
gacgggguuucaccauguuggc

SEQ ID NO: 1639879 - RNA, 17 nt, Homo sapiens
gacgugauuuugcugua

SEQ ID NO: 1639880 - RNA, 21 nt, Homo sapiens
gacuacaggcgccugccacaa

SEQ ID NO: 1639881 - RNA, 23 nt, Homo sapiens
gacuacauuuagccccucucuua

SEQ ID NO: 1639882 - RNA, 20 nt, Homo sapiens
gacuauuauagaauggaacu

SEQ ID NO: 1639883 - RNA, 16 nt, Homo sapiens
gacucaaaacccaucu

SEQ ID NO: 1639884 - RNA, 17 nt, Homo sapiens
gacucaaugcacugaca

SEQ ID NO: 1639885 - RNA, 22 nt, Homo sapiens
gacucacuuguucucacugucu

SEQ ID NO: 1639886 - RNA, 17 nt, Homo sapiens
gacucuacagaggccau

SEQ ID NO: 1639887 - RNA, 12 nt, Homo sapiens
gacugauuucag

SEQ ID NO: 1639888 - RNA, 14 nt, Homo sapiens
gacugcugagucaa

SEQ ID NO: 1639889 - RNA, 15 nt, Homo sapiens
gacugguuguucaaa

SEQ ID NO: 1639890 - RNA, 17 nt, Homo sapiens
gacuucugcaucuuaca

SEQ ID NO: 1639891 - RNA, 16 nt, Homo sapiens
gacuugaaucaaguca

SEQ ID NO: 1639892 - RNA, 18 nt, Homo sapiens
gacuugacagaacacugu

SEQ ID NO: 1639893 - RNA, 19 nt, Homo sapiens
gacuuuugaagaacaaaag

SEQ ID NO: 1639894 - RNA, 16 nt, Homo sapiens
gagaaaaugaauuugg

SEQ ID NO: 1639895 - RNA, 14 nt, Homo sapiens
gagaacacugugaa

SEQ ID NO: 1639896 - RNA, 20 nt, Homo sapiens
gagaagccacaggccugaga

SEQ ID NO: 1639897 - RNA, 21 nt, Homo sapiens
gagaaguaagcagaguucuuu

SEQ ID NO: 1639898 - RNA, 12 nt, Homo sapiens
gagaaugaccug

SEQ ID NO: 1639899 - RNA, 23 nt, Homo sapiens
gagaauguuagaggaucccucuc

SEQ ID NO: 1639900 - RNA, 17 nt, Homo sapiens
gagacaggguuucacca

SEQ ID NO: 1639901 - RNA, 16 nt, Homo sapiens
gagacgggguuucacc

SEQ ID NO: 1639902 - RNA, 15 nt, Homo sapiens
gagacuccaccucaa

SEQ ID NO: 1639903 - RNA, 19 nt, Homo sapiens
gagacuccuaggcaggaca

SEQ ID NO: 1639904 - RNA, 13 nt, Homo sapiens
gagacucugucuc

SEQ ID NO: 1639905 - RNA, 19 nt, Homo sapiens
gagagaacugagcaucucc

SEQ ID NO: 1639906 - RNA, 13 nt, Homo sapiens
gagagacuuggau

SEQ ID NO: 1639907 - RNA, 15 nt, Homo sapiens
gagagagcuuggaau

SEQ ID NO: 1639908 - RNA, 13 nt, Homo sapiens
gagagcacaguga

SEQ ID NO: 1639909 - RNA, 20 nt, Homo sapiens
gagagcacagugaucaccag

SEQ ID NO: 1639910 - RNA, 13 nt, Homo sapiens
gagagccuuccag

SEQ ID NO: 1639911 - RNA, 11 nt, Homo sapiens
gagaucucuau

SEQ ID NO: 1639912 - RNA, 16 nt, Homo sapiens
gagcaaaggcugagaa

SEQ ID NO: 1639913 - RNA, 21 nt, Homo sapiens
gagcaaaggcugagaacacug

SEQ ID NO: 1639914 - RNA, 16 nt, Homo sapiens
gagcagcuucugccac

SEQ ID NO: 1639915 - RNA, 19 nt, Homo sapiens
gagcauuuauaaauggaca

SEQ ID NO: 1639916 - RNA, 23 nt, Homo sapiens
gagccaauugauuucaacagaau

SEQ ID NO: 1639917 - RNA, 13 nt, Homo sapiens
gagccauaugaau

SEQ ID NO: 1639918 - RNA, 17 nt, Homo sapiens
gagccauuuugugaaug

SEQ ID NO: 1639919 - RNA, 15 nt, Homo sapiens
gagccccucagacag

SEQ ID NO: 1639920 - RNA, 21 nt, Homo sapiens
gagccgagaucacaccacugu

SEQ ID NO: 1639921 - RNA, 17 nt, Homo sapiens
gagccgggucugccucu

SEQ ID NO: 1639922 - RNA, 16 nt, Homo sapiens
gagccuggcuccaaac

SEQ ID NO: 1639923 - RNA, 13 nt, Homo sapiens
gagcuagaaccua

SEQ ID NO: 1639924 - RNA, 20 nt, Homo sapiens
gagcuccccuccccaacuga

SEQ ID NO: 1639925 - RNA, 15 nt, Homo sapiens
gagcuccuaagccau

SEQ ID NO: 1639926 - RNA, 13 nt, Homo sapiens
gagcucugaccca

SEQ ID NO: 1639927 - RNA, 18 nt, Homo sapiens
gagcugacacaaaccugc

SEQ ID NO: 1639928 - RNA, 12 nt, Homo sapiens
gagcugucaugu

SEQ ID NO: 1639929 - RNA, 14 nt, Homo sapiens
gagcuguuacugaa

SEQ ID NO: 1639930 - RNA, 18 nt, Homo sapiens
gaggacacuaaccacgcu

SEQ ID NO: 1639931 - RNA, 22 nt, Homo sapiens
gaggcagccccauucugccugc

SEQ ID NO: 1639932 - RNA, 17 nt, Homo sapiens
gaggcauagucaccuag

SEQ ID NO: 1639933 - RNA, 22 nt, Homo sapiens
gaggccgagucuguccuggaac

SEQ ID NO: 1639934 - RNA, 16 nt, Homo sapiens
gaggcugaggcaagag

SEQ ID NO: 1639935 - RNA, 22 nt, Homo sapiens
cuuuauuacaguuuaucuaugg

SEQ ID NO: 1639936 - RNA, 15 nt, Homo sapiens
cuuucaaaagcaaga

SEQ ID NO: 1639937 - RNA, 16 nt, Homo sapiens
cuuucaaaagcaagaa

SEQ ID NO: 1639938 - RNA, 22 nt, Homo sapiens
cuuucaaaagcaagaacaccau

SEQ ID NO: 1639939 - RNA, 16 nt, Homo sapiens
cuuucaaccucaguga

SEQ ID NO: 1639940 - RNA, 18 nt, Homo sapiens
cuuucacaguuucuucca

SEQ ID NO: 1639941 - RNA, 16 nt, Homo sapiens
cuuucagccaagccaa

SEQ ID NO: 1639942 - RNA, 21 nt, Homo sapiens
cuuucaggccacauggcuaaa

SEQ ID NO: 1639943 - RNA, 22 nt, Homo sapiens
cuuuccauccccuagaaauccu

SEQ ID NO: 1639944 - RNA, 14 nt, Homo sapiens
cuuucuacccagcg

SEQ ID NO: 1639945 - RNA, 23 nt, Homo sapiens
cuuucuguuacugauguucaaua

SEQ ID NO: 1639946 - RNA, 22 nt, Homo sapiens
cuuugauacagucaacaagccu

SEQ ID NO: 1639947 - RNA, 17 nt, Homo sapiens
cuuugcugcagaacuga

SEQ ID NO: 1639948 - RNA, 19 nt, Homo sapiens
cuuuggaccacuccccuca

SEQ ID NO: 1639949 - RNA, 14 nt, Homo sapiens
cuuuggcaacagaa

SEQ ID NO: 1639950 - RNA, 14 nt, Homo sapiens
cuuuggcuuugcaa

SEQ ID NO: 1639951 - RNA, 17 nt, Homo sapiens
cuuugggacucacuuga

SEQ ID NO: 1639952 - RNA, 18 nt, Homo sapiens
cuuuguaagaguguagaa

SEQ ID NO: 1639953 - RNA, 20 nt, Homo sapiens
cuuugugugcgucacuguga

SEQ ID NO: 1639954 - RNA, 14 nt, Homo sapiens
cuuuguucuuguca

SEQ ID NO: 1639955 - RNA, 15 nt, Homo sapiens
cuuuguuuauuguaa

SEQ ID NO: 1639956 - RNA, 16 nt, Homo sapiens
cuuuuaacagaacaga

SEQ ID NO: 1639957 - RNA, 12 nt, Homo sapiens
cuuuuaagccag

SEQ ID NO: 1639958 - RNA, 12 nt, Homo sapiens
cuuuucacaaau

SEQ ID NO: 1639959 - RNA, 22 nt, Homo sapiens
cuuuuccaugcacccucauaca

SEQ ID NO: 1639960 - RNA, 21 nt, Homo sapiens
cuuuucccagagaccuucuga

SEQ ID NO: 1639961 - RNA, 19 nt, Homo sapiens
cuuuucugacccauguuca

SEQ ID NO: 1639962 - RNA, 15 nt, Homo sapiens
cuuuucuggaaugga

SEQ ID NO: 1639963 - RNA, 21 nt, Homo sapiens
cuuuugaaaagguaaggugaa

SEQ ID NO: 1639964 - RNA, 17 nt, Homo sapiens
cuuuugacaaaggcaag

SEQ ID NO: 1639965 - RNA, 16 nt, Homo sapiens
cuuuugcauuaaucua

SEQ ID NO: 1639966 - RNA, 18 nt, Homo sapiens
cuuuuuaaacaguguuua

SEQ ID NO: 1639967 - RNA, 18 nt, Homo sapiens
cuuuuuuauacucaauca

SEQ ID NO: 1639968 - RNA, 16 nt, Homo sapiens
gaaaaaaaaauggaag

SEQ ID NO: 1639969 - RNA, 17 nt, Homo sapiens
gaaaaaaaaauggaagc

SEQ ID NO: 1639970 - RNA, 20 nt, Homo sapiens
gaaaaauuaauuuacuagaa

SEQ ID NO: 1639971 - RNA, 19 nt, Homo sapiens
gaaaaauugccaauucuuu

SEQ ID NO: 1639972 - RNA, 16 nt, Homo sapiens
gaaaacacugugcaca

SEQ ID NO: 1639973 - RNA, 14 nt, Homo sapiens
gaaaagaagcaagg

SEQ ID NO: 1639974 - RNA, 17 nt, Homo sapiens
gaaaagcuauuagccag

SEQ ID NO: 1639975 - RNA, 23 nt, Homo sapiens
gaaaagcuauuagccaggaucau

SEQ ID NO: 1639976 - RNA, 23 nt, Homo sapiens
gaaaagcuccauuuuuagugaaa

SEQ ID NO: 1639977 - RNA, 15 nt, Homo sapiens
gaaaagcugcugaca

SEQ ID NO: 1639978 - RNA, 19 nt, Homo sapiens
gaaaaggaaggcucuucuc

SEQ ID NO: 1639979 - RNA, 17 nt, Homo sapiens
auguugggaagcuauuu

SEQ ID NO: 1639980 - RNA, 17 nt, Homo sapiens
auguuuggaauauucca

SEQ ID NO: 1639981 - RNA, 20 nt, Homo sapiens
auguuuguuauuuacacugg

SEQ ID NO: 1639982 - RNA, 17 nt, Homo sapiens
auguuuuagccagugau

SEQ ID NO: 1639983 - RNA, 15 nt, Homo sapiens
auuaaaagacucauc

SEQ ID NO: 1639984 - RNA, 20 nt, Homo sapiens
auuaaaaucacugucaauau

SEQ ID NO: 1639985 - RNA, 22 nt, Homo sapiens
auuaaauguagaaagugaucca

SEQ ID NO: 1639986 - RNA, 11 nt, Homo sapiens
auuaauggaaa

SEQ ID NO: 1639987 - RNA, 14 nt, Homo sapiens
auuaauucaaugaa

SEQ ID NO: 1639988 - RNA, 23 nt, Homo sapiens
auuacaagcgugagccacugcac

SEQ ID NO: 1639989 - RNA, 22 nt, Homo sapiens
auuacagacaugaacugccagg

SEQ ID NO: 1639990 - RNA, 17 nt, Homo sapiens
auuacaggcuccugcca

SEQ ID NO: 1639991 - RNA, 14 nt, Homo sapiens
auuaccuugugcua

SEQ ID NO: 1639992 - RNA, 19 nt, Homo sapiens
auuagaaaaauagcaacuu

SEQ ID NO: 1639993 - RNA, 18 nt, Homo sapiens
auuagaucaauuacuuau

SEQ ID NO: 1639994 - RNA, 21 nt, Homo sapiens
auuagcauaauuuuguguugu

SEQ ID NO: 1639995 - RNA, 20 nt, Homo sapiens
auuaguaaauaugugaagaa

SEQ ID NO: 1639996 - RNA, 19 nt, Homo sapiens
auuauaaaugacaaccuga

SEQ ID NO: 1639997 - RNA, 16 nt, Homo sapiens
auuauagaauugcaca

SEQ ID NO: 1639998 - RNA, 23 nt, Homo sapiens
auuauaguuuaaauucaauuaca

SEQ ID NO: 1639999 - RNA, 16 nt, Homo sapiens
auuauaugcacuagca

SEQ ID NO: 1640000 - RNA, 14 nt, Homo sapiens
auuauauuucuaca

SEQ ID NO: 1640001 - RNA, 18 nt, Homo sapiens
auuaucuaugauaugcua

SEQ ID NO: 1640002 - RNA, 16 nt, Homo sapiens
auuaugcaucugcuac

SEQ ID NO: 1640003 - RNA, 18 nt, Homo sapiens
auuaugcaucugcuacug

SEQ ID NO: 1640004 - RNA, 14 nt, Homo sapiens
auuaugcuaccuac

SEQ ID NO: 1640005 - RNA, 17 nt, Homo sapiens
auuauguacucuacuga

SEQ ID NO: 1640006 - RNA, 22 nt, Homo sapiens
auuaugugcacuaccauagcua

SEQ ID NO: 1640007 - RNA, 12 nt, Homo sapiens
auuauuacuguu

SEQ ID NO: 1640008 - RNA, 15 nt, Homo sapiens
auuauuuaauuugua

SEQ ID NO: 1640009 - RNA, 15 nt, Homo sapiens
auucaaugaaaugga

SEQ ID NO: 1640010 - RNA, 21 nt, Homo sapiens
auucaauuacauaguccagug

SEQ ID NO: 1640011 - RNA, 17 nt, Homo sapiens
auucagggagugggcua

SEQ ID NO: 1640012 - RNA, 12 nt, Homo sapiens
auucaguguuaa

SEQ ID NO: 1640013 - RNA, 17 nt, Homo sapiens
auucauacauuaucuca

SEQ ID NO: 1640014 - RNA, 23 nt, Homo sapiens
auucaugaagcggucacagauca

SEQ ID NO: 1640015 - RNA, 12 nt, Homo sapiens
auuccaucuuac

SEQ ID NO: 1640016 - RNA, 20 nt, Homo sapiens
auuccucccaccccaagcaa

SEQ ID NO: 1640017 - RNA, 18 nt, Homo sapiens
auucuaagucaauccaag

SEQ ID NO: 1640018 - RNA, 18 nt, Homo sapiens
auucuacguaucugcuac

SEQ ID NO: 1640019 - RNA, 13 nt, Homo sapiens
auucucaugccuc

SEQ ID NO: 1640020 - RNA, 19 nt, Homo sapiens
auucucauuugucacacac

SEQ ID NO: 1640021 - RNA, 21 nt, Homo sapiens
auucuccauguacuggcaaga

SEQ ID NO: 1640022 - RNA, 15 nt, Homo sapiens
auucuccugccucag

SEQ ID NO: 1640023 - RNA, 17 nt, Homo sapiens
auucucugucucaucca

SEQ ID NO: 1640024 - RNA, 18 nt, Homo sapiens
auucugagccacacugaa

SEQ ID NO: 1640025 - RNA, 19 nt, Homo sapiens
auucugauguuacugagau

SEQ ID NO: 1640026 - RNA, 11 nt, Homo sapiens
auucugugacc

SEQ ID NO: 1640027 - RNA, 22 nt, Homo sapiens
auucuuccagauaauguccuug

SEQ ID NO: 1640028 - RNA, 13 nt, Homo sapiens
auucuucugcuuc

SEQ ID NO: 1640029 - RNA, 20 nt, Homo sapiens
auucuuucccaauucacauc

SEQ ID NO: 1640030 - RNA, 13 nt, Homo sapiens
auucuuuuaguuu

SEQ ID NO: 1640031 - RNA, 18 nt, Homo sapiens
auucuuuugccaauguca

SEQ ID NO: 1640032 - RNA, 19 nt, Homo sapiens
auucuuuuugaaaugucaa

SEQ ID NO: 1640033 - RNA, 13 nt, Homo sapiens
auugaagaugaac

SEQ ID NO: 1640034 - RNA, 20 nt, Homo sapiens
auugacuaacaggccaaaga

SEQ ID NO: 1640035 - RNA, 19 nt, Homo sapiens
auugauaacagcacugacu

SEQ ID NO: 1640036 - RNA, 21 nt, Homo sapiens
auugauaacagcacugacuag

SEQ ID NO: 1640037 - RNA, 22 nt, Homo sapiens
auugaugaaugaggaacaauca

SEQ ID NO: 1640038 - RNA, 22 nt, Homo sapiens
auugcacauaguucugcccaaa

SEQ ID NO: 1640039 - RNA, 20 nt, Homo sapiens
auugcagcgauuaauaacag

SEQ ID NO: 1640040 - RNA, 21 nt, Homo sapiens
auugcuccauuuucuugucaa

SEQ ID NO: 1640041 - RNA, 22 nt, Homo sapiens
auugcugccccaucagugcucc

SEQ ID NO: 1640042 - RNA, 22 nt, Homo sapiens
auugcuucuucuucaagauuua

SEQ ID NO: 1640043 - RNA, 12 nt, Homo sapiens
auugcuuucuaa

SEQ ID NO: 1640044 - RNA, 12 nt, Homo sapiens
auuggaacugga

SEQ ID NO: 1640045 - RNA, 22 nt, Homo sapiens
auuggaacuggaggcagggaac

SEQ ID NO: 1640046 - RNA, 15 nt, Homo sapiens
auuggucuccucuca

SEQ ID NO: 1640047 - RNA, 14 nt, Homo sapiens
auuguaaauacugg

SEQ ID NO: 1640048 - RNA, 15 nt, Homo sapiens
auuguacaguuuaaa

SEQ ID NO: 1640049 - RNA, 19 nt, Homo sapiens
auuguaucaaaugugacau

SEQ ID NO: 1640050 - RNA, 20 nt, Homo sapiens
auuguaucaaaugugacauu

SEQ ID NO: 1640051 - RNA, 21 nt, Homo sapiens
auuguauuaacgcaaauauua

SEQ ID NO: 1640052 - RNA, 19 nt, Homo sapiens
auugucaccagggcuggaa

SEQ ID NO: 1640053 - RNA, 23 nt, Homo sapiens
caagcaguuaguuccuucaugau

SEQ ID NO: 1640054 - RNA, 19 nt, Homo sapiens
caagcucuaucaccaagga

SEQ ID NO: 1640055 - RNA, 21 nt, Homo sapiens
caagcuggucccacucagucc

SEQ ID NO: 1640056 - RNA, 16 nt, Homo sapiens
caaggaaaccacagcu

SEQ ID NO: 1640057 - RNA, 15 nt, Homo sapiens
caaggaagguggugg

SEQ ID NO: 1640058 - RNA, 13 nt, Homo sapiens
caaggaagucaaa

SEQ ID NO: 1640059 - RNA, 21 nt, Homo sapiens
caagggcuuuguuuugcacac

SEQ ID NO: 1640060 - RNA, 14 nt, Homo sapiens
caaggucaagagau

SEQ ID NO: 1640061 - RNA, 16 nt, Homo sapiens
caaguguucacaaccu

SEQ ID NO: 1640062 - RNA, 13 nt, Homo sapiens
caaguuccugaua

SEQ ID NO: 1640063 - RNA, 23 nt, Homo sapiens
caauaaaggacaggcuggugcua

SEQ ID NO: 1640064 - RNA, 15 nt, Homo sapiens
caauaaaugaacugc

SEQ ID NO: 1640065 - RNA, 19 nt, Homo sapiens
caauaacacugcuuauaaa

SEQ ID NO: 1640066 - RNA, 21 nt, Homo sapiens
caauaagccacgaggugcagu

SEQ ID NO: 1640067 - RNA, 15 nt, Homo sapiens
caauacauguuuuca

SEQ ID NO: 1640068 - RNA, 14 nt, Homo sapiens
caauacugagccau

SEQ ID NO: 1640069 - RNA, 14 nt, Homo sapiens
caauacugcccaag

SEQ ID NO: 1640070 - RNA, 24 nt, Homo sapiens
caauauuaagucauuguuucccau

SEQ ID NO: 1640071 - RNA, 16 nt, Homo sapiens
caauauuguacaguuu

SEQ ID NO: 1640072 - RNA, 21 nt, Homo sapiens
caauauuuacuauuucaauac

SEQ ID NO: 1640073 - RNA, 19 nt, Homo sapiens
caauccaagagucugauga

SEQ ID NO: 1640074 - RNA, 15 nt, Homo sapiens
caaucccucaaaccu

SEQ ID NO: 1640075 - RNA, 18 nt, Homo sapiens
caaucucugauucuguca

SEQ ID NO: 1640076 - RNA, 13 nt, Homo sapiens
caaugaaauggau

SEQ ID NO: 1640077 - RNA, 22 nt, Homo sapiens
caaugcuauaacuauguugaua

SEQ ID NO: 1640078 - RNA, 23 nt, Homo sapiens
caaugcugccugggagccagggu

SEQ ID NO: 1640079 - RNA, 15 nt, Homo sapiens
caaugguugaugaua

SEQ ID NO: 1640080 - RNA, 14 nt, Homo sapiens
caauuaaagcaaaa

SEQ ID NO: 1640081 - RNA, 17 nt, Homo sapiens
caauuacauaguccagu

SEQ ID NO: 1640082 - RNA, 13 nt, Homo sapiens
caauuauaacuua

SEQ ID NO: 1640083 - RNA, 14 nt, Homo sapiens
caauuccaguggaa

SEQ ID NO: 1640084 - RNA, 21 nt, Homo sapiens
caauucuauuacgugcaauac

SEQ ID NO: 1640085 - RNA, 19 nt, Homo sapiens
caauucuuacaaacaugug

SEQ ID NO: 1640086 - RNA, 20 nt, Homo sapiens
caauuguuucagugccauuu

SEQ ID NO: 1640087 - RNA, 12 nt, Homo sapiens
caauuuacuuuu

SEQ ID NO: 1640088 - RNA, 16 nt, Homo sapiens
caauuugaauauaaau

SEQ ID NO: 1640089 - RNA, 15 nt, Homo sapiens
acuuacaucaugugu

SEQ ID NO: 1640090 - RNA, 14 nt, Homo sapiens
acuuaccuaccaca

SEQ ID NO: 1640091 - RNA, 16 nt, Homo sapiens
acuuacuuaguguuau

SEQ ID NO: 1640092 - RNA, 22 nt, Homo sapiens
acuuauaauuaugcuaccuacu

SEQ ID NO: 1640093 - RNA, 20 nt, Homo sapiens
acuuauuauuccagaucugc

SEQ ID NO: 1640094 - RNA, 13 nt, Homo sapiens
acuucaaggguuu

SEQ ID NO: 1640095 - RNA, 22 nt, Homo sapiens
acuucaaggguuuguugaacaa

SEQ ID NO: 1640096 - RNA, 20 nt, Homo sapiens
acuucaguacucaaauucaa

SEQ ID NO: 1640097 - RNA, 23 nt, Homo sapiens
acuucuaggauuuauuguuauau

SEQ ID NO: 1640098 - RNA, 17 nt, Homo sapiens
acuucucuauuaucuca

SEQ ID NO: 1640099 - RNA, 19 nt, Homo sapiens
acuucuuucacucacaucu

SEQ ID NO: 1640100 - RNA, 16 nt, Homo sapiens
acuugcuggcugugaa

SEQ ID NO: 1640101 - RNA, 19 nt, Homo sapiens
acuuggcuacacagggaug

SEQ ID NO: 1640102 - RNA, 22 nt, Homo sapiens
acuuguuuuugaguuuucuuau

SEQ ID NO: 1640103 - RNA, 16 nt, Homo sapiens
acuuuaaaaggauuaa

SEQ ID NO: 1640104 - RNA, 21 nt, Homo sapiens
acuuucuugaaaagaagcaag

SEQ ID NO: 1640105 - RNA, 14 nt, Homo sapiens
acuuugacaguguu

SEQ ID NO: 1640106 - RNA, 13 nt, Homo sapiens
acuuugaccuaaa

SEQ ID NO: 1640107 - RNA, 20 nt, Homo sapiens
acuuuguauccucugaccua

SEQ ID NO: 1640108 - RNA, 16 nt, Homo sapiens
acuuuguuuauuguaa

SEQ ID NO: 1640109 - RNA, 17 nt, Homo sapiens
acuuuugaagaacaaaa

SEQ ID NO: 1640110 - RNA, 13 nt, Homo sapiens
acuuuuugcagcu

SEQ ID NO: 1640111 - RNA, 15 nt, Homo sapiens
agaaaaacaaugaaa

SEQ ID NO: 1640112 - RNA, 13 nt, Homo sapiens
agaaaaauuaauu

SEQ ID NO: 1640113 - RNA, 16 nt, Homo sapiens
agaaaauaacaauaaa

SEQ ID NO: 1640114 - RNA, 21 nt, Homo sapiens
agaaaauaguuuggauuacuu

SEQ ID NO: 1640115 - RNA, 20 nt, Homo sapiens
agaaaaugugucugcaacau

SEQ ID NO: 1640116 - RNA, 12 nt, Homo sapiens
agaaagugaucc

SEQ ID NO: 1640117 - RNA, 22 nt, Homo sapiens
agaaauauucuacacauaucuu

SEQ ID NO: 1640118 - RNA, 17 nt, Homo sapiens
agaaauuaccuguggau

SEQ ID NO: 1640119 - RNA, 18 nt, Homo sapiens
agaacacacugagacuug

SEQ ID NO: 1640120 - RNA, 12 nt, Homo sapiens
agaacacuguga

SEQ ID NO: 1640121 - RNA, 17 nt, Homo sapiens
agaacagaaagaaccuu

SEQ ID NO: 1640122 - RNA, 22 nt, Homo sapiens
agaacauggugugugucucuga

SEQ ID NO: 1640123 - RNA, 23 nt, Homo sapiens
agaaccuggagagcuagaaccua

SEQ ID NO: 1640124 - RNA, 23 nt, Homo sapiens
agaaccuggagggcuagaaccua

SEQ ID NO: 1640125 - RNA, 23 nt, Homo sapiens
agaaccuggcagguuagaaccua

SEQ ID NO: 1640126 - RNA, 16 nt, Homo sapiens
agaacuagcauaacac

SEQ ID NO: 1640127 - RNA, 21 nt, Homo sapiens
agaacuauugugcucagagac

SEQ ID NO: 1640128 - RNA, 12 nt, Homo sapiens
agaacuuuagua

SEQ ID NO: 1640129 - RNA, 11 nt, Homo sapiens
agaagaugaau

SEQ ID NO: 1640130 - RNA, 13 nt, Homo sapiens
agaagcagcucuu

SEQ ID NO: 1640131 - RNA, 21 nt, Homo sapiens
agaagccugugcccugaucca

SEQ ID NO: 1640132 - RNA, 13 nt, Homo sapiens
agaaggagggaga

SEQ ID NO: 1640133 - RNA, 18 nt, Homo sapiens
agaaggagggagacauga

SEQ ID NO: 1640134 - RNA, 22 nt, Homo sapiens
agaagggcucagagaggacaaa

SEQ ID NO: 1640135 - RNA, 12 nt, Homo sapiens
agaaggggacaa

SEQ ID NO: 1640136 - RNA, 23 nt, Homo sapiens
agaaggggacaauggcagaacag

SEQ ID NO: 1640137 - RNA, 19 nt, Homo sapiens
agaagugaaaaggcugccu

SEQ ID NO: 1640138 - RNA, 11 nt, Homo sapiens
agaaguggaag

SEQ ID NO: 1640139 - RNA, 18 nt, Homo sapiens
agaaguugacaggcagug

SEQ ID NO: 1640140 - RNA, 20 nt, Homo sapiens
agaauauacuaaauuaacuu

SEQ ID NO: 1640141 - RNA, 16 nt, Homo sapiens
agaaucaguguguuac

SEQ ID NO: 1640142 - RNA, 18 nt, Homo sapiens
agaauccuacaacuucca

SEQ ID NO: 1640143 - RNA, 21 nt, Homo sapiens
agaaucuguuucccagcagug

SEQ ID NO: 1640144 - RNA, 12 nt, Homo sapiens
agaauggagcug

SEQ ID NO: 1640145 - RNA, 13 nt, Homo sapiens
agaauguuuucaa

SEQ ID NO: 1640146 - RNA, 21 nt, Homo sapiens
agaauguuuucaaauguucuc

SEQ ID NO: 1640147 - RNA, 23 nt, Homo sapiens
agaauucauucacucaacaaaca

SEQ ID NO: 1640148 - RNA, 17 nt, Homo sapiens
agaauuggccaucuuaa

SEQ ID NO: 1640149 - RNA, 19 nt, Homo sapiens
agaauuggccaucuuaaaa

SEQ ID NO: 1640150 - RNA, 19 nt, Homo sapiens
agacaagaacuuggaggca

SEQ ID NO: 1640151 - RNA, 19 nt, Homo sapiens
agacaagagggacaagugg

SEQ ID NO: 1640152 - RNA, 20 nt, Homo sapiens
agacacaccccaacaugccu

SEQ ID NO: 1640153 - RNA, 13 nt, Homo sapiens
agacacugcacag

SEQ ID NO: 1640154 - RNA, 19 nt, Homo sapiens
agacagaaucucgcucugu

SEQ ID NO: 1640155 - RNA, 20 nt, Homo sapiens
agacaggguuucaccauguu

SEQ ID NO: 1640156 - RNA, 10 nt, Homo sapiens
agacagugaa

SEQ ID NO: 1640157 - RNA, 13 nt, Homo sapiens
agacagugaaaga

SEQ ID NO: 1640158 - RNA, 11 nt, Homo sapiens
agacaugaacu

SEQ ID NO: 1640159 - RNA, 18 nt, Homo sapiens
agacaugagcauggcuga

SEQ ID NO: 1640160 - RNA, 21 nt, Homo sapiens
agacaugagugcgugcucagu

SEQ ID NO: 1640161 - RNA, 17 nt, Homo sapiens
agaccaucccugaaggc

SEQ ID NO: 1640162 - RNA, 18 nt, Homo sapiens
agaccaucuacauacaca

SEQ ID NO: 1640163 - RNA, 16 nt, Homo sapiens
agacccacuggacuca

SEQ ID NO: 1640164 - RNA, 23 nt, Homo sapiens
agacccaggagccggacacuucu

SEQ ID NO: 1640165 - RNA, 14 nt, Homo sapiens
agacccucucaggc

SEQ ID NO: 1640166 - RNA, 18 nt, Homo sapiens
agaccuguguuacuaaaa

SEQ ID NO: 1640167 - RNA, 20 nt, Homo sapiens
agacgcagacaugugcacuu

SEQ ID NO: 1640168 - RNA, 20 nt, Homo sapiens
agacuaacaggagaaugcac

SEQ ID NO: 1640169 - RNA, 23 nt, Homo sapiens
agacuaagggcgcuugucccauc

SEQ ID NO: 1640170 - RNA, 16 nt, Homo sapiens
agacuuucaagggaau

SEQ ID NO: 1640171 - RNA, 12 nt, Homo sapiens
agacuuugacuc

SEQ ID NO: 1640172 - RNA, 13 nt, Homo sapiens
agagaaaauaauu

SEQ ID NO: 1640173 - RNA, 14 nt, Homo sapiens
agagaaauuugcca

SEQ ID NO: 1640174 - RNA, 23 nt, Homo sapiens
agagaccaggcaaagcaagugau

SEQ ID NO: 1640175 - RNA, 16 nt, Homo sapiens
agagagcacagugauc

SEQ ID NO: 1640176 - RNA, 15 nt, Homo sapiens
agagaguuugccacu

SEQ ID NO: 1640177 - RNA, 19 nt, Homo sapiens
agagcaguuucuguccugc

SEQ ID NO: 1640178 - RNA, 17 nt, Homo sapiens
agagcuggagccuggug

SEQ ID NO: 1640179 - RNA, 16 nt, Homo sapiens
agagcugggugucaag

SEQ ID NO: 1640180 - RNA, 14 nt, Homo sapiens
agagcuucccugac

SEQ ID NO: 1640181 - RNA, 19 nt, Homo sapiens
agaggcagggucucacucu

SEQ ID NO: 1640182 - RNA, 23 nt, Homo sapiens
agaggcuuauucaguucuuacac

SEQ ID NO: 1640183 - RNA, 16 nt, Homo sapiens
agagugcuaugaagac

SEQ ID NO: 1640184 - RNA, 20 nt, Homo sapiens
agauaacaaucuguauauaa

SEQ ID NO: 1640185 - RNA, 19 nt, Homo sapiens
agauaaucucuccauuccc

SEQ ID NO: 1640186 - RNA, 21 nt, Homo sapiens
agauaauguccuugcuuuaca

SEQ ID NO: 1640187 - RNA, 16 nt, Homo sapiens
agauccccaagccugg

SEQ ID NO: 1640188 - RNA, 20 nt, Homo sapiens
agaugaaaccaggucacugg

SEQ ID NO: 1640189 - RNA, 13 nt, Homo sapiens
agaugaaugucag

SEQ ID NO: 1640190 - RNA, 15 nt, Homo sapiens
agaugagaguacacc

SEQ ID NO: 1640191 - RNA, 16 nt, Homo sapiens
agaugcagccccaucu

SEQ ID NO: 1640192 - RNA, 14 nt, Homo sapiens
agaugcagguuuga

SEQ ID NO: 1640193 - RNA, 21 nt, Homo sapiens
agaugucccugaagucuugca

SEQ ID NO: 1640194 - RNA, 21 nt, Homo sapiens
agauguguguugauacuguug

SEQ ID NO: 1640195 - RNA, 17 nt, Homo sapiens
agauucaaacucaauga

SEQ ID NO: 1640196 - RNA, 16 nt, Homo sapiens
agauuuuuaacuauuu

SEQ ID NO: 1640197 - RNA, 20 nt, Homo sapiens
agcaaaauacaugacauuua

SEQ ID NO: 1640198 - RNA, 17 nt, Homo sapiens
agcaaacaaaauggacu

SEQ ID NO: 1640199 - RNA, 22 nt, Homo sapiens
auauuuguaugauccuaaugaa

SEQ ID NO: 1640200 - RNA, 15 nt, Homo sapiens
auauuuuugugcaca

SEQ ID NO: 1640201 - RNA, 13 nt, Homo sapiens
aucaagaaauacu

SEQ ID NO: 1640202 - RNA, 14 nt, Homo sapiens
aucaagucagcaac

SEQ ID NO: 1640203 - RNA, 14 nt, Homo sapiens
aucacacugaauua

SEQ ID NO: 1640204 - RNA, 21 nt, Homo sapiens
aucacagcuaacaauugugaa

SEQ ID NO: 1640205 - RNA, 22 nt, Homo sapiens
aucacagcuuucaaaagcaaga

SEQ ID NO: 1640206 - RNA, 19 nt, Homo sapiens
aucacauucgaguguuuca

SEQ ID NO: 1640207 - RNA, 20 nt, Homo sapiens
aucaccgugggcucccugac

SEQ ID NO: 1640208 - RNA, 20 nt, Homo sapiens
aucaccucccaccauaaucc

SEQ ID NO: 1640209 - RNA, 16 nt, Homo sapiens
aucaccuccuguguug

SEQ ID NO: 1640210 - RNA, 15 nt, Homo sapiens
aucacgccacugcac

SEQ ID NO: 1640211 - RNA, 16 nt, Homo sapiens
aucacgccacuggacu

SEQ ID NO: 1640212 - RNA, 22 nt, Homo sapiens
aucacggcucacugcagccuca

SEQ ID NO: 1640213 - RNA, 19 nt, Homo sapiens
aucacuucugagaacucau

SEQ ID NO: 1640214 - RNA, 11 nt, Homo sapiens
aucacuuugac

SEQ ID NO: 1640215 - RNA, 16 nt, Homo sapiens
aucagaacuguuggca

SEQ ID NO: 1640216 - RNA, 17 nt, Homo sapiens
aucaggaguuccagugc

SEQ ID NO: 1640217 - RNA, 14 nt, Homo sapiens
aucaguagccagca

SEQ ID NO: 1640218 - RNA, 10 nt, Homo sapiens
aucagugcca

SEQ ID NO: 1640219 - RNA, 12 nt, Homo sapiens
aucauacaaaua

SEQ ID NO: 1640220 - RNA, 13 nt, Homo sapiens
aucauacaaauac

SEQ ID NO: 1640221 - RNA, 17 nt, Homo sapiens
aucaucaguggagccau

SEQ ID NO: 1640222 - RNA, 12 nt, Homo sapiens
aucaucucucau

SEQ ID NO: 1640223 - RNA, 23 nt, Homo sapiens
aucaucuuugcugaaugucauua

SEQ ID NO: 1640224 - RNA, 15 nt, Homo sapiens
aucauuaugaaguca

SEQ ID NO: 1640225 - RNA, 23 nt, Homo sapiens
aucauuuccugggagaaagacca

SEQ ID NO: 1640226 - RNA, 20 nt, Homo sapiens
auccaaagaauuaugcaucu

SEQ ID NO: 1640227 - RNA, 21 nt, Homo sapiens
auccaaauaaaaauaacauca

SEQ ID NO: 1640228 - RNA, 19 nt, Homo sapiens
auccaaaugcugugcaaac

SEQ ID NO: 1640229 - RNA, 20 nt, Homo sapiens
auccaacaugugcucaggga

SEQ ID NO: 1640230 - RNA, 15 nt, Homo sapiens
auccacccaccucag

SEQ ID NO: 1640231 - RNA, 16 nt, Homo sapiens
auccacuaaaaucaaa

SEQ ID NO: 1640232 - RNA, 13 nt, Homo sapiens
auccacugugcca

SEQ ID NO: 1640233 - RNA, 16 nt, Homo sapiens
auccagaaauaaugaa

SEQ ID NO: 1640234 - RNA, 23 nt, Homo sapiens
auccaggaagaccccagcacaga

SEQ ID NO: 1640235 - RNA, 16 nt, Homo sapiens
auccauuuaugucuca

SEQ ID NO: 1640236 - RNA, 21 nt, Homo sapiens
aucccaacaccaaacucuuaa

SEQ ID NO: 1640237 - RNA, 20 nt, Homo sapiens
aucccagcaagcgagcuuua

SEQ ID NO: 1640238 - RNA, 13 nt, Homo sapiens
aucccauguagaa

SEQ ID NO: 1640239 - RNA, 22 nt, Homo sapiens
auccccuaagcagaccacugau

SEQ ID NO: 1640240 - RNA, 15 nt, Homo sapiens
aucccuggaaggaca

SEQ ID NO: 1640241 - RNA, 22 nt, Homo sapiens
auccuacaagacacagugacca

SEQ ID NO: 1640242 - RNA, 11 nt, Homo sapiens
auccuacccca

SEQ ID NO: 1640243 - RNA, 22 nt, Homo sapiens
auccuaugguuucuccauccaa

SEQ ID NO: 1640244 - RNA, 14 nt, Homo sapiens
auccucccaccuca

SEQ ID NO: 1640245 - RNA, 15 nt, Homo sapiens
auccucccaccucag

SEQ ID NO: 1640246 - RNA, 19 nt, Homo sapiens
auccuggagggguguugua

SEQ ID NO: 1640247 - RNA, 12 nt, Homo sapiens
auccuggcccau

SEQ ID NO: 1640248 - RNA, 17 nt, Homo sapiens
auccuggggaacauaga

SEQ ID NO: 1640249 - RNA, 15 nt, Homo sapiens
auccuuccaccucag

SEQ ID NO: 1640250 - RNA, 24 nt, Homo sapiens
auccuuggaaauuggaagagcaca

SEQ ID NO: 1640251 - RNA, 16 nt, Homo sapiens
aucgcugucaucucag

SEQ ID NO: 1640252 - RNA, 22 nt, Homo sapiens
aucgcugucaucucagcuggau

SEQ ID NO: 1640253 - RNA, 18 nt, Homo sapiens
aucggccaucaagggaag

SEQ ID NO: 1640254 - RNA, 23 nt, Homo sapiens
aucgggaccagaaaccugggaga

SEQ ID NO: 1640255 - RNA, 15 nt, Homo sapiens
aucuacauacacagu

SEQ ID NO: 1640256 - RNA, 19 nt, Homo sapiens
aucuaggaagacuuuggaa

SEQ ID NO: 1640257 - RNA, 19 nt, Homo sapiens
aucuauaccuuacugcaau

SEQ ID NO: 1640258 - RNA, 16 nt, Homo sapiens
aucuaugauaugcuaa

SEQ ID NO: 1640259 - RNA, 22 nt, Homo sapiens
aucucaaacuacuggcaauuug

SEQ ID NO: 1640260 - RNA, 14 nt, Homo sapiens
aucucaauucuucc

SEQ ID NO: 1640261 - RNA, 22 nt, Homo sapiens
aucucauuggacccuuccaugg

SEQ ID NO: 1640262 - RNA, 13 nt, Homo sapiens
aucuccacuguug

SEQ ID NO: 1640263 - RNA, 20 nt, Homo sapiens
aucuccugugauccuuugau

SEQ ID NO: 1640264 - RNA, 22 nt, Homo sapiens
aucucggcucacugcauccucc

SEQ ID NO: 1640265 - RNA, 19 nt, Homo sapiens
aucucuauuauaucuugua

SEQ ID NO: 1640266 - RNA, 13 nt, Homo sapiens
aucucucaucacu

SEQ ID NO: 1640267 - RNA, 17 nt, Homo sapiens
aucucuggaugccugau

SEQ ID NO: 1640268 - RNA, 13 nt, Homo sapiens
aucugacuucaua

SEQ ID NO: 1640269 - RNA, 16 nt, Homo sapiens
aucugacuucauacau

SEQ ID NO: 1640270 - RNA, 22 nt, Homo sapiens
aucugacuucauacaucccuca

SEQ ID NO: 1640271 - RNA, 13 nt, Homo sapiens
aucugcaaugugg

SEQ ID NO: 1640272 - RNA, 12 nt, Homo sapiens
aucugcugucuu

SEQ ID NO: 1640273 - RNA, 17 nt, Homo sapiens
aucuggguucacugcaa

SEQ ID NO: 1640274 - RNA, 13 nt, Homo sapiens
aucuucaccucag

SEQ ID NO: 1640275 - RNA, 19 nt, Homo sapiens
aucuuccaaaccccacuuu

SEQ ID NO: 1640276 - RNA, 16 nt, Homo sapiens
aucuucuucaccauuu

SEQ ID NO: 1640277 - RNA, 17 nt, Homo sapiens
aucuugcucugcugaca

SEQ ID NO: 1640278 - RNA, 15 nt, Homo sapiens
aucuuuaacacaacu

SEQ ID NO: 1640279 - RNA, 14 nt, Homo sapiens
aucuuucuguuacu

SEQ ID NO: 1640280 - RNA, 21 nt, Homo sapiens
aucuuuggacagaagcagcuc

SEQ ID NO: 1640281 - RNA, 16 nt, Homo sapiens
augaaagggcaaagac

SEQ ID NO: 1640282 - RNA, 14 nt, Homo sapiens
augaaaugcauauu

SEQ ID NO: 1640283 - RNA, 23 nt, Homo sapiens
augaacuugcaaacaggcugaua

SEQ ID NO: 1640284 - RNA, 22 nt, Homo sapiens
augaacuuguaaaggaauuuaa

SEQ ID NO: 1640285 - RNA, 15 nt, Homo sapiens
augaauccuacauac

SEQ ID NO: 1640286 - RNA, 17 nt, Homo sapiens
augaaugggagugaggg

SEQ ID NO: 1640287 - RNA, 23 nt, Homo sapiens
augaauuugggauacuaaaguag

SEQ ID NO: 1640288 - RNA, 14 nt, Homo sapiens
augacaacuggaau

SEQ ID NO: 1640289 - RNA, 16 nt, Homo sapiens
augacacucuucugaa

SEQ ID NO: 1640290 - RNA, 21 nt, Homo sapiens
augaccugggaggacucucuu

SEQ ID NO: 1640291 - RNA, 10 nt, Homo sapiens
augacuaugc

SEQ ID NO: 1640292 - RNA, 14 nt, Homo sapiens
augagaaguacuuu

SEQ ID NO: 1640293 - RNA, 15 nt, Homo sapiens
augagcaaaaccaaa

SEQ ID NO: 1640294 - RNA, 22 nt, Homo sapiens
augaggucauagcagugcuuga

SEQ ID NO: 1640295 - RNA, 13 nt, Homo sapiens
augaguacccaaa

SEQ ID NO: 1640296 - RNA, 20 nt, Homo sapiens
augagucauccgcuaucaca

SEQ ID NO: 1640297 - RNA, 22 nt, Homo sapiens
augauccuaaugaaugcauaaa

SEQ ID NO: 1640298 - RNA, 20 nt, Homo sapiens
augaucuuugcagacaggca

SEQ ID NO: 1640299 - RNA, 18 nt, Homo sapiens
augaugcuaccaugccuc

SEQ ID NO: 1640300 - RNA, 19 nt, Homo sapiens
augaugucguuugaaucac

SEQ ID NO: 1640301 - RNA, 18 nt, Homo sapiens
augaugugggucaaggaa

SEQ ID NO: 1640302 - RNA, 17 nt, Homo sapiens
augauuuugaugcacaa

SEQ ID NO: 1640303 - RNA, 15 nt, Homo sapiens
augauuuuggccuca

SEQ ID NO: 1640304 - RNA, 18 nt, Homo sapiens
augauuuuuguguaucca

SEQ ID NO: 1640305 - RNA, 18 nt, Homo sapiens
augcaacaacauguauaa

SEQ ID NO: 1640306 - RNA, 18 nt, Homo sapiens
augcaaccuuuggaugca

SEQ ID NO: 1640307 - RNA, 24 nt, Homo sapiens
augcaaccuuuggaugcacuuuau

SEQ ID NO: 1640308 - RNA, 18 nt, Homo sapiens
augcaagauuguuuucag

SEQ ID NO: 1640309 - RNA, 17 nt, Homo sapiens
caaaauguucuauuuaa

SEQ ID NO: 1640310 - RNA, 20 nt, Homo sapiens
caaaauguucuauuuaacaa

SEQ ID NO: 1640311 - RNA, 14 nt, Homo sapiens
caaacaggcugaua

SEQ ID NO: 1640312 - RNA, 11 nt, Homo sapiens
caaacagugac

SEQ ID NO: 1640313 - RNA, 17 nt, Homo sapiens
caaacaugaaaacauug

SEQ ID NO: 1640314 - RNA, 11 nt, Homo sapiens
caaacaugugc

SEQ ID NO: 1640315 - RNA, 14 nt, Homo sapiens
caaacuaccuucca

SEQ ID NO: 1640316 - RNA, 21 nt, Homo sapiens
caaacuacuggcaauuuguaa

SEQ ID NO: 1640317 - RNA, 17 nt, Homo sapiens
caaacuucuuucacuca

SEQ ID NO: 1640318 - RNA, 19 nt, Homo sapiens
caaagaaauccuccaauca

SEQ ID NO: 1640319 - RNA, 22 nt, Homo sapiens
caaagaacuuggaaauagugau

SEQ ID NO: 1640320 - RNA, 17 nt, Homo sapiens
caaagaaucuaucacua

SEQ ID NO: 1640321 - RNA, 14 nt, Homo sapiens
caaagagugaagga

SEQ ID NO: 1640322 - RNA, 20 nt, Homo sapiens
caaagcacuguuucucucac

SEQ ID NO: 1640323 - RNA, 21 nt, Homo sapiens
caaagcccuuguccccaugaa

SEQ ID NO: 1640324 - RNA, 13 nt, Homo sapiens
caaagcguggaca

SEQ ID NO: 1640325 - RNA, 18 nt, Homo sapiens
caaaggcugagaacacug

SEQ ID NO: 1640326 - RNA, 17 nt, Homo sapiens
caaagugcugggauuac

SEQ ID NO: 1640327 - RNA, 18 nt, Homo sapiens
caaauaaugucucuguga

SEQ ID NO: 1640328 - RNA, 14 nt, Homo sapiens
caaauacuauccaa

SEQ ID NO: 1640329 - RNA, 18 nt, Homo sapiens
caaauagguauguagcag

SEQ ID NO: 1640330 - RNA, 16 nt, Homo sapiens
caaaucugacauauua

SEQ ID NO: 1640331 - RNA, 13 nt, Homo sapiens
caaaugcaauuuu

SEQ ID NO: 1640332 - RNA, 22 nt, Homo sapiens
caaaugcugugcaaacagugua

SEQ ID NO: 1640333 - RNA, 13 nt, Homo sapiens
caaauguauuuca

SEQ ID NO: 1640334 - RNA, 13 nt, Homo sapiens
caaaugugacauu

SEQ ID NO: 1640335 - RNA, 17 nt, Homo sapiens
caaauuucgagcauaag

SEQ ID NO: 1640336 - RNA, 14 nt, Homo sapiens
caacaagaaaagaa

SEQ ID NO: 1640337 - RNA, 18 nt, Homo sapiens
caacaugugcucagggaa

SEQ ID NO: 1640338 - RNA, 22 nt, Homo sapiens
caacauuacagggaaugccuga

SEQ ID NO: 1640339 - RNA, 20 nt, Homo sapiens
caacauuucucuucagugug

SEQ ID NO: 1640340 - RNA, 19 nt, Homo sapiens
caaccccccagcacugagg

SEQ ID NO: 1640341 - RNA, 18 nt, Homo sapiens
caaccugccugacauuug

SEQ ID NO: 1640342 - RNA, 18 nt, Homo sapiens
caaccuucgccaccuggg

SEQ ID NO: 1640343 - RNA, 12 nt, Homo sapiens
caacgccagaau

SEQ ID NO: 1640344 - RNA, 21 nt, Homo sapiens
caacuagggagugagugcaaa

SEQ ID NO: 1640345 - RNA, 15 nt, Homo sapiens
caacucuuugagaaa

SEQ ID NO: 1640346 - RNA, 15 nt, Homo sapiens
caacuuucauuugaa

SEQ ID NO: 1640347 - RNA, 20 nt, Homo sapiens
caagaaacuucggggcugca

SEQ ID NO: 1640348 - RNA, 11 nt, Homo sapiens
caagaaugaga

SEQ ID NO: 1640349 - RNA, 15 nt, Homo sapiens
caagacacagugacc

SEQ ID NO: 1640350 - RNA, 18 nt, Homo sapiens
caagaccaucuacauaca

SEQ ID NO: 1640351 - RNA, 20 nt, Homo sapiens
caagacgcugugcugcccug

SEQ ID NO: 1640352 - RNA, 14 nt, Homo sapiens
caagagcacacuug

SEQ ID NO: 1640353 - RNA, 16 nt, Homo sapiens
caagagcacacuuggc

SEQ ID NO: 1640354 - RNA, 23 nt, Homo sapiens
caagagcagcuaaaaccuacuca

SEQ ID NO: 1640355 - RNA, 17 nt, Homo sapiens
caagagugagacuccac

SEQ ID NO: 1640356 - RNA, 14 nt, Homo sapiens
caagauuguuuuca

SEQ ID NO: 1640357 - RNA, 19 nt, Homo sapiens
caagcaaaucccaacauuu

SEQ ID NO: 1640358 - RNA, 23 nt, Homo sapiens
caagcucaaagcguggacaggug

SEQ ID NO: 1640359 - RNA, 16 nt, Homo sapiens
caagcuggacuauggc

SEQ ID NO: 1640360 - RNA, 20 nt, Homo sapiens
caaggaagucugugucuacc

SEQ ID NO: 1640361 - RNA, 19 nt, Homo sapiens
caaggacugguaaaauaca

SEQ ID NO: 1640362 - RNA, 14 nt, Homo sapiens
caaggagacacaac

SEQ ID NO: 1640363 - RNA, 13 nt, Homo sapiens
caaggcacugccu

SEQ ID NO: 1640364 - RNA, 18 nt, Homo sapiens
caaggccucccacaguga

SEQ ID NO: 1640365 - RNA, 21 nt, Homo sapiens
caagggccagcuggaggugaa

SEQ ID NO: 1640366 - RNA, 16 nt, Homo sapiens
caaggguuuguugaac

SEQ ID NO: 1640367 - RNA, 20 nt, Homo sapiens
caagguauguacaguucaua

SEQ ID NO: 1640368 - RNA, 13 nt, Homo sapiens
caaggucacaaua

SEQ ID NO: 1640369 - RNA, 21 nt, Homo sapiens
caagucauuugaggaucucac

SEQ ID NO: 1640370 - RNA, 22 nt, Homo sapiens
caagugauaauacagauuugua

SEQ ID NO: 1640371 - RNA, 19 nt, Homo sapiens
caagugauccuuccaccuc

SEQ ID NO: 1640372 - RNA, 21 nt, Homo sapiens
caagugauccuuccaccucag

SEQ ID NO: 1640373 - RNA, 22 nt, Homo sapiens
caagugauucucaugccucagc

SEQ ID NO: 1640374 - RNA, 15 nt, Homo sapiens
caaguuccagugcag

SEQ ID NO: 1640375 - RNA, 20 nt, Homo sapiens
caaguucuuaguugcuguau

SEQ ID NO: 1640376 - RNA, 21 nt, Homo sapiens
caaguucuuaguugcuguaug

SEQ ID NO: 1640377 - RNA, 13 nt, Homo sapiens
caauaaagccuuc

SEQ ID NO: 1640378 - RNA, 14 nt, Homo sapiens
caauaaaugaacug

SEQ ID NO: 1640379 - RNA, 12 nt, Homo sapiens
caauacugagcc

SEQ ID NO: 1640380 - RNA, 14 nt, Homo sapiens
caauagaacagaga

SEQ ID NO: 1640381 - RNA, 15 nt, Homo sapiens
caauaguuguugauu

SEQ ID NO: 1640382 - RNA, 16 nt, Homo sapiens
caauauggauuucuua

SEQ ID NO: 1640383 - RNA, 19 nt, Homo sapiens
caaucaguagccagcaucu

SEQ ID NO: 1640384 - RNA, 12 nt, Homo sapiens
caauccaagagu

SEQ ID NO: 1640385 - RNA, 10 nt, Homo sapiens
caaucccuca

SEQ ID NO: 1640386 - RNA, 17 nt, Homo sapiens
caaugagaucauuguga

SEQ ID NO: 1640387 - RNA, 15 nt, Homo sapiens
caaugcagcauguug

SEQ ID NO: 1640388 - RNA, 23 nt, Homo sapiens
caaugcuauaacuauguugauaa

SEQ ID NO: 1640389 - RNA, 20 nt, Homo sapiens
caaugugggcagagauugga

SEQ ID NO: 1640390 - RNA, 20 nt, Homo sapiens
caauguuuuaaacauucuuc

SEQ ID NO: 1640391 - RNA, 22 nt, Homo sapiens
caauuauuuauuaaaugcccag

SEQ ID NO: 1640392 - RNA, 22 nt, Homo sapiens
caauucauauauuugaagugga

SEQ ID NO: 1640393 - RNA, 20 nt, Homo sapiens
caauucuaacuuuuuugcua

SEQ ID NO: 1640394 - RNA, 17 nt, Homo sapiens
caauucuccugccucag

SEQ ID NO: 1640395 - RNA, 18 nt, Homo sapiens
caauucuccugccucagc

SEQ ID NO: 1640396 - RNA, 18 nt, Homo sapiens
caauucuuugaauuuccc

SEQ ID NO: 1640397 - RNA, 23 nt, Homo sapiens
cacaaauuugggagggugagaca

SEQ ID NO: 1640398 - RNA, 18 nt, Homo sapiens
cacaacucuuuguucaaa

SEQ ID NO: 1640399 - RNA, 14 nt, Homo sapiens
cacaauaaccuuau

SEQ ID NO: 1640400 - RNA, 12 nt, Homo sapiens
cacaauggguau

SEQ ID NO: 1640401 - RNA, 16 nt, Homo sapiens
cacaauguuauuaccu

SEQ ID NO: 1640402 - RNA, 17 nt, Homo sapiens
cacacagaggggaguca

SEQ ID NO: 1640403 - RNA, 20 nt, Homo sapiens
cacacaugcuuuucuuccua

SEQ ID NO: 1640404 - RNA, 22 nt, Homo sapiens
cacacccagcccacuucugcca

SEQ ID NO: 1640405 - RNA, 19 nt, Homo sapiens
cacaccuggaaagcauaua

SEQ ID NO: 1640406 - RNA, 22 nt, Homo sapiens
cacaccuuauauuuacguauga

SEQ ID NO: 1640407 - RNA, 14 nt, Homo sapiens
cacacgcgugcaca

SEQ ID NO: 1640408 - RNA, 16 nt, Homo sapiens
cacacgcgugcacaca

SEQ ID NO: 1640409 - RNA, 15 nt, Homo sapiens
cacagacacuaacga

SEQ ID NO: 1640410 - RNA, 16 nt, Homo sapiens
cacagacccugcccug

SEQ ID NO: 1640411 - RNA, 19 nt, Homo sapiens
cacagaccugcucuggaca

SEQ ID NO: 1640412 - RNA, 22 nt, Homo sapiens
cacagcugccaagucauuugag

SEQ ID NO: 1640413 - RNA, 19 nt, Homo sapiens
cacagcuuauggcaucuca

SEQ ID NO: 1640414 - RNA, 22 nt, Homo sapiens
cacagcuuauggcaucucauug

SEQ ID NO: 1640415 - RNA, 13 nt, Homo sapiens
cacagcuuucaaa

SEQ ID NO: 1640416 - RNA, 22 nt, Homo sapiens
cacaggaugaaggcaaugccau

SEQ ID NO: 1640417 - RNA, 23 nt, Homo sapiens
cacaggaugaaggcaaugccauc

SEQ ID NO: 1640418 - RNA, 18 nt, Homo sapiens
cacaggcagguccagggu

SEQ ID NO: 1640419 - RNA, 22 nt, Homo sapiens
ccuaaauuguuguaauugcauu

SEQ ID NO: 1640420 - RNA, 23 nt, Homo sapiens
ccuaacccccagccccuccaugu

SEQ ID NO: 1640421 - RNA, 16 nt, Homo sapiens
ccuaauguguuuagau

SEQ ID NO: 1640422 - RNA, 20 nt, Homo sapiens
ccuaccacugucuucuucag

SEQ ID NO: 1640423 - RNA, 19 nt, Homo sapiens
ccuacuucucugagucagc

SEQ ID NO: 1640424 - RNA, 23 nt, Homo sapiens
ccuagaagggcuagaaccuggag

SEQ ID NO: 1640425 - RNA, 16 nt, Homo sapiens
ccuagguucacuuugg

SEQ ID NO: 1640426 - RNA, 14 nt, Homo sapiens
ccuaucuuugccac

SEQ ID NO: 1640427 - RNA, 15 nt, Homo sapiens
ccucaaagaaauccu

SEQ ID NO: 1640428 - RNA, 22 nt, Homo sapiens
ccucaaaugagaaaaugucuuu

SEQ ID NO: 1640429 - RNA, 18 nt, Homo sapiens
ccucaaccuccugggcua

SEQ ID NO: 1640430 - RNA, 16 nt, Homo sapiens
ccucaaguuccagugc

SEQ ID NO: 1640431 - RNA, 15 nt, Homo sapiens
ccucaauauuuacua

SEQ ID NO: 1640432 - RNA, 20 nt, Homo sapiens
ccucaauauuuacuauuuca

SEQ ID NO: 1640433 - RNA, 19 nt, Homo sapiens
ccucacacugggacuugca

SEQ ID NO: 1640434 - RNA, 15 nt, Homo sapiens
ccucacguccaucac

SEQ ID NO: 1640435 - RNA, 18 nt, Homo sapiens
ccucacguccaucacugg

SEQ ID NO: 1640436 - RNA, 18 nt, Homo sapiens
ccucacugggacuuugua

SEQ ID NO: 1640437 - RNA, 22 nt, Homo sapiens
ccucagccucccaaagugcugg

SEQ ID NO: 1640438 - RNA, 16 nt, Homo sapiens
ccucagggcagggaua

SEQ ID NO: 1640439 - RNA, 19 nt, Homo sapiens
ccucagggcagggauacaa

SEQ ID NO: 1640440 - RNA, 21 nt, Homo sapiens
ccucaucaggaguuccagugc

SEQ ID NO: 1640441 - RNA, 20 nt, Homo sapiens
ccucaugcugugugacucaa

SEQ ID NO: 1640442 - RNA, 13 nt, Homo sapiens
ccuccaaguccac

SEQ ID NO: 1640443 - RNA, 20 nt, Homo sapiens
ccucccaaagugcugggauu

SEQ ID NO: 1640444 - RNA, 19 nt, Homo sapiens
ccuccccccaaucccucaa

SEQ ID NO: 1640445 - RNA, 19 nt, Homo sapiens
ccuccuuauauuuggccca

SEQ ID NO: 1640446 - RNA, 15 nt, Homo sapiens
ccucgcccuccacaa

SEQ ID NO: 1640447 - RNA, 22 nt, Homo sapiens
ccucuaaaccauggcacuugau

SEQ ID NO: 1640448 - RNA, 19 nt, Homo sapiens
ccucuaacccaggucuuga

SEQ ID NO: 1640449 - RNA, 16 nt, Homo sapiens
ccucucagagcuacuu

SEQ ID NO: 1640450 - RNA, 20 nt, Homo sapiens
ccucucauuucccuuugaua

SEQ ID NO: 1640451 - RNA, 23 nt, Homo sapiens
ccugaaauuucucauuaguggua

SEQ ID NO: 1640452 - RNA, 14 nt, Homo sapiens
ccugaacucugcaa

SEQ ID NO: 1640453 - RNA, 20 nt, Homo sapiens
ccugaagucacacagugagu

SEQ ID NO: 1640454 - RNA, 18 nt, Homo sapiens
ccugacaacagccugaga

SEQ ID NO: 1640455 - RNA, 20 nt, Homo sapiens
ccugacaacagccugagaaa

SEQ ID NO: 1640456 - RNA, 15 nt, Homo sapiens
ccugacagcacuccu

SEQ ID NO: 1640457 - RNA, 21 nt, Homo sapiens
ccugagaaugaccugcccugg

SEQ ID NO: 1640458 - RNA, 17 nt, Homo sapiens
ccugagauuucaucugc

SEQ ID NO: 1640459 - RNA, 19 nt, Homo sapiens
ccugaguagcugggauuac

SEQ ID NO: 1640460 - RNA, 21 nt, Homo sapiens
ccugaguuuagggucaaggac

SEQ ID NO: 1640461 - RNA, 20 nt, Homo sapiens
ccugauaacaaccuggagac

SEQ ID NO: 1640462 - RNA, 14 nt, Homo sapiens
ccugaucaccugcc

SEQ ID NO: 1640463 - RNA, 17 nt, Homo sapiens
ccugauggagagugaga

SEQ ID NO: 1640464 - RNA, 17 nt, Homo sapiens
ccugcaaaaggacucuc

SEQ ID NO: 1640465 - RNA, 16 nt, Homo sapiens
ccugcacuguccugcu

SEQ ID NO: 1640466 - RNA, 16 nt, Homo sapiens
ccugcauuggaacugg

SEQ ID NO: 1640467 - RNA, 16 nt, Homo sapiens
ccugccucacuucuuc

SEQ ID NO: 1640468 - RNA, 17 nt, Homo sapiens
ccugcgccccagacucc

SEQ ID NO: 1640469 - RNA, 23 nt, Homo sapiens
ccugcugcagucacguguaaaca

SEQ ID NO: 1640470 - RNA, 19 nt, Homo sapiens
ccugcuucaauacccaaau

SEQ ID NO: 1640471 - RNA, 13 nt, Homo sapiens
ccuggaaccaggc

SEQ ID NO: 1640472 - RNA, 22 nt, Homo sapiens
ccuggaugcagccucacagucc

SEQ ID NO: 1640473 - RNA, 14 nt, Homo sapiens
ccuggccucaagug

SEQ ID NO: 1640474 - RNA, 19 nt, Homo sapiens
ccuggcugaaggacuguga

SEQ ID NO: 1640475 - RNA, 20 nt, Homo sapiens
ccuggcugaaggacugugac

SEQ ID NO: 1640476 - RNA, 23 nt, Homo sapiens
ccugggagaaagaccaugcauuu

SEQ ID NO: 1640477 - RNA, 14 nt, Homo sapiens
ccugggcaaagccu

SEQ ID NO: 1640478 - RNA, 13 nt, Homo sapiens
ccugggugacaaa

SEQ ID NO: 1640479 - RNA, 15 nt, Homo sapiens
ccuguaaagucugag

SEQ ID NO: 1640480 - RNA, 17 nt, Homo sapiens
ccuguaacauaucugua

SEQ ID NO: 1640481 - RNA, 18 nt, Homo sapiens
ccuguaaucccagcauuu

SEQ ID NO: 1640482 - RNA, 16 nt, Homo sapiens
ccugucuaaaaauuca

SEQ ID NO: 1640483 - RNA, 14 nt, Homo sapiens
ccugugaaauacca

SEQ ID NO: 1640484 - RNA, 22 nt, Homo sapiens
ccugugacacuuauaaauaucc

SEQ ID NO: 1640485 - RNA, 19 nt, Homo sapiens
ccugugaugucccaguuuc

SEQ ID NO: 1640486 - RNA, 15 nt, Homo sapiens
ccuguggugcaaaag

SEQ ID NO: 1640487 - RNA, 16 nt, Homo sapiens
ccuguuacacaugaca

SEQ ID NO: 1640488 - RNA, 11 nt, Homo sapiens
ccuguucucua

SEQ ID NO: 1640489 - RNA, 23 nt, Homo sapiens
ccuuaaacucagggagcauuuau

SEQ ID NO: 1640490 - RNA, 14 nt, Homo sapiens
ccuuaaacuuucaa

SEQ ID NO: 1640491 - RNA, 22 nt, Homo sapiens
ccuuaaagucaguaacuuaccc

SEQ ID NO: 1640492 - RNA, 15 nt, Homo sapiens
ccuuaaaucacacau

SEQ ID NO: 1640493 - RNA, 20 nt, Homo sapiens
ccuuaacacugagcugucau

SEQ ID NO: 1640494 - RNA, 15 nt, Homo sapiens
ccuuagaagucacac

SEQ ID NO: 1640495 - RNA, 20 nt, Homo sapiens
ccuuagcagggaaacagcua

SEQ ID NO: 1640496 - RNA, 19 nt, Homo sapiens
ccuuauuaaugaucagcua

SEQ ID NO: 1640497 - RNA, 18 nt, Homo sapiens
ccuuauucagaauuucua

SEQ ID NO: 1640498 - RNA, 18 nt, Homo sapiens
ccuuauucuauacuuucu

SEQ ID NO: 1640499 - RNA, 19 nt, Homo sapiens
ccuuauuuauauucaucaa

SEQ ID NO: 1640500 - RNA, 21 nt, Homo sapiens
ccuuauuucucaucacaucau

SEQ ID NO: 1640501 - RNA, 23 nt, Homo sapiens
ccuucaaaauguucuauuuaaca

SEQ ID NO: 1640502 - RNA, 23 nt, Homo sapiens
ccuucacagcuaagaugccaugu

SEQ ID NO: 1640503 - RNA, 20 nt, Homo sapiens
ccuucacuccccuaucccau

SEQ ID NO: 1640504 - RNA, 14 nt, Homo sapiens
ccuucaucuggaac

SEQ ID NO: 1640505 - RNA, 13 nt, Homo sapiens
ccuuccaccucag

SEQ ID NO: 1640506 - RNA, 15 nt, Homo sapiens
ccuucccaaauagca

SEQ ID NO: 1640507 - RNA, 12 nt, Homo sapiens
ccuucugaucuc

SEQ ID NO: 1640508 - RNA, 20 nt, Homo sapiens
ccuucuucuuagcaccacaa

SEQ ID NO: 1640509 - RNA, 20 nt, Homo sapiens
ccuucuuugauaauguuaaa

SEQ ID NO: 1640510 - RNA, 19 nt, Homo sapiens
ccuugaaaacacuguucuc

SEQ ID NO: 1640511 - RNA, 22 nt, Homo sapiens
ccuugaaaacacuguucucugc

SEQ ID NO: 1640512 - RNA, 14 nt, Homo sapiens
ccuugaggagucuu

SEQ ID NO: 1640513 - RNA, 22 nt, Homo sapiens
ccuugauacgauaguuacauaa

SEQ ID NO: 1640514 - RNA, 10 nt, Homo sapiens
ccuugcuaau

SEQ ID NO: 1640515 - RNA, 22 nt, Homo sapiens
ccuugcuuuacaaaccaaccau

SEQ ID NO: 1640516 - RNA, 22 nt, Homo sapiens
ccuuggaaguugcauggcauca

SEQ ID NO: 1640517 - RNA, 22 nt, Homo sapiens
ccuuggggccacugccugaggc

SEQ ID NO: 1640518 - RNA, 22 nt, Homo sapiens
ccuugucaauacugagccauuu

SEQ ID NO: 1640519 - RNA, 12 nt, Homo sapiens
ccuugugaccca

SEQ ID NO: 1640520 - RNA, 22 nt, Homo sapiens
ccuuuaaaaaugcaccacuuuu

SEQ ID NO: 1640521 - RNA, 16 nt, Homo sapiens
ccuuuaguggcuucau

SEQ ID NO: 1640522 - RNA, 15 nt, Homo sapiens
ccuuucauuuacugu

SEQ ID NO: 1640523 - RNA, 17 nt, Homo sapiens
ccuuuccuauuucccca

SEQ ID NO: 1640524 - RNA, 15 nt, Homo sapiens
ccuuugcagauauga

SEQ ID NO: 1640525 - RNA, 22 nt, Homo sapiens
ccuuuuuuaagauuuuucucaa

SEQ ID NO: 1640526 - RNA, 14 nt, Homo sapiens
ccuuuuuuaaggaa

SEQ ID NO: 1640527 - RNA, 23 nt, Homo sapiens
ccuuuuuuugaaaaaaagcuuuu

SEQ ID NO: 1640528 - RNA, 12 nt, Homo sapiens
guguugauacug

SEQ ID NO: 1640529 - RNA, 17 nt, Homo sapiens
guguuuuuaguugcuca

SEQ ID NO: 1640530 - RNA, 13 nt, Homo sapiens
guuaaaagcaaaa

SEQ ID NO: 1640531 - RNA, 20 nt, Homo sapiens
guuaauaaucuaugaugaag

SEQ ID NO: 1640532 - RNA, 14 nt, Homo sapiens
guuaaugguuugaa

SEQ ID NO: 1640533 - RNA, 14 nt, Homo sapiens
guuacagcacaaaa

SEQ ID NO: 1640534 - RNA, 15 nt, Homo sapiens
guuaccaccaugcuc

SEQ ID NO: 1640535 - RNA, 14 nt, Homo sapiens
guuacuaguacagg

SEQ ID NO: 1640536 - RNA, 15 nt, Homo sapiens
guuagugauggagcu

SEQ ID NO: 1640537 - RNA, 18 nt, Homo sapiens
guuaucuaauauguaaca

SEQ ID NO: 1640538 - RNA, 19 nt, Homo sapiens
guuaucuuguguauggaua

SEQ ID NO: 1640539 - RNA, 15 nt, Homo sapiens
guuauuuacacuggu

SEQ ID NO: 1640540 - RNA, 21 nt, Homo sapiens
guucaagugauucucaugccu

SEQ ID NO: 1640541 - RNA, 20 nt, Homo sapiens
guucaccuguguacugagua

SEQ ID NO: 1640542 - RNA, 16 nt, Homo sapiens
guucagguaacaggca

SEQ ID NO: 1640543 - RNA, 20 nt, Homo sapiens
guuccagcaaacaaaaugga

SEQ ID NO: 1640544 - RNA, 18 nt, Homo sapiens
guucccacugaaauggac

SEQ ID NO: 1640545 - RNA, 14 nt, Homo sapiens
guucccccugugca

SEQ ID NO: 1640546 - RNA, 16 nt, Homo sapiens
guucccuauuuugcca

SEQ ID NO: 1640547 - RNA, 15 nt, Homo sapiens
guuccgagaagaaca

SEQ ID NO: 1640548 - RNA, 20 nt, Homo sapiens
guuccuuccucugagccuug

SEQ ID NO: 1640549 - RNA, 15 nt, Homo sapiens
guucugggacacagu

SEQ ID NO: 1640550 - RNA, 14 nt, Homo sapiens
guugagccuaauau

SEQ ID NO: 1640551 - RNA, 14 nt, Homo sapiens
guugaugccagaca

SEQ ID NO: 1640552 - RNA, 18 nt, Homo sapiens
guugauguuggcugggaa

SEQ ID NO: 1640553 - RNA, 15 nt, Homo sapiens
guugcauuuuggcaa

SEQ ID NO: 1640554 - RNA, 15 nt, Homo sapiens
guugcugauguuuau

SEQ ID NO: 1640555 - RNA, 21 nt, Homo sapiens
guuggagagcuagaaccugga

SEQ ID NO: 1640556 - RNA, 19 nt, Homo sapiens
guuggaugcggaacccaaa

SEQ ID NO: 1640557 - RNA, 23 nt, Homo sapiens
guugggauaaggaaacacuucua

SEQ ID NO: 1640558 - RNA, 16 nt, Homo sapiens
guugguuuacuguguu

SEQ ID NO: 1640559 - RNA, 14 nt, Homo sapiens
guuguaauugcauu

SEQ ID NO: 1640560 - RNA, 18 nt, Homo sapiens
guuguagacguuguguaa

SEQ ID NO: 1640561 - RNA, 14 nt, Homo sapiens
guuguauugcauau

SEQ ID NO: 1640562 - RNA, 15 nt, Homo sapiens
guugugaagguugua

SEQ ID NO: 1640563 - RNA, 19 nt, Homo sapiens
guuguuaauaaaaguacau

SEQ ID NO: 1640564 - RNA, 23 nt, Homo sapiens
guuguucuuuaacccucacuggg

SEQ ID NO: 1640565 - RNA, 16 nt, Homo sapiens
guuuaggauuacuuag

SEQ ID NO: 1640566 - RNA, 18 nt, Homo sapiens
guuuauaaaagaugcauu

SEQ ID NO: 1640567 - RNA, 23 nt, Homo sapiens
guuuaucguauuugaugcuacag

SEQ ID NO: 1640568 - RNA, 22 nt, Homo sapiens
guuuaugcauagauaaucucuc

SEQ ID NO: 1640569 - RNA, 16 nt, Homo sapiens
guuucaaguacuguaa

SEQ ID NO: 1640570 - RNA, 19 nt, Homo sapiens
guuucaccauguuagccag

SEQ ID NO: 1640571 - RNA, 16 nt, Homo sapiens
guuucaguucugugua

SEQ ID NO: 1640572 - RNA, 22 nt, Homo sapiens
guuucauauugaugugugucua

SEQ ID NO: 1640573 - RNA, 19 nt, Homo sapiens
guuuccuagcugugugaau

SEQ ID NO: 1640574 - RNA, 17 nt, Homo sapiens
guuuccuggcacugcuu

SEQ ID NO: 1640575 - RNA, 21 nt, Homo sapiens
guuucguaacacagcauugua

SEQ ID NO: 1640576 - RNA, 12 nt, Homo sapiens
guuucuuucuag

SEQ ID NO: 1640577 - RNA, 18 nt, Homo sapiens
guuuuaaagcuugcucac

SEQ ID NO: 1640578 - RNA, 19 nt, Homo sapiens
guuuucaucaagacuggaa

SEQ ID NO: 1640579 - RNA, 15 nt, Homo sapiens
guuuucuaauaucuu

SEQ ID NO: 1640580 - RNA, 15 nt, Homo sapiens
guuuucuucugugau

SEQ ID NO: 1640581 - RNA, 16 nt, Homo sapiens
guuuucuucugugauu

SEQ ID NO: 1640582 - RNA, 23 nt, Homo sapiens
guuuuguuugguaguuuugccaa

SEQ ID NO: 1640583 - RNA, 22 nt, Homo sapiens
guuuuucuauuaaaagacucau

SEQ ID NO: 1640584 - RNA, 20 nt, Homo sapiens
uaaaaaggaauccacuccca

SEQ ID NO: 1640585 - RNA, 12 nt, Homo sapiens
uaaaaaugcacc

SEQ ID NO: 1640586 - RNA, 19 nt, Homo sapiens
uaaaacaaaagcucaucca

SEQ ID NO: 1640587 - RNA, 20 nt, Homo sapiens
uaaaacaacacucacauuua

SEQ ID NO: 1640588 - RNA, 20 nt, Homo sapiens
uaaaacauugguuauauuac

SEQ ID NO: 1640589 - RNA, 13 nt, Homo sapiens
uaaaagacaagga

SEQ ID NO: 1640590 - RNA, 15 nt, Homo sapiens
uaaaagacagugaaa

SEQ ID NO: 1640591 - RNA, 11 nt, Homo sapiens
uaaaagacuca

SEQ ID NO: 1640592 - RNA, 22 nt, Homo sapiens
uaaaauauuuuuaugugcaaua

SEQ ID NO: 1640593 - RNA, 24 nt, Homo sapiens
uaaaauccaauauuguaauccuag

SEQ ID NO: 1640594 - RNA, 23 nt, Homo sapiens
uaaaauuauuacuaaugaugcuu

SEQ ID NO: 1640595 - RNA, 16 nt, Homo sapiens
uaaaauuucuuagaaa

SEQ ID NO: 1640596 - RNA, 23 nt, Homo sapiens
uaaacaaauguaugauuacauca

SEQ ID NO: 1640597 - RNA, 15 nt, Homo sapiens
uaaacccucugugaa

SEQ ID NO: 1640598 - RNA, 15 nt, Homo sapiens
uaaaccugacaaugg

SEQ ID NO: 1640599 - RNA, 15 nt, Homo sapiens
uaaacucuggaugau

SEQ ID NO: 1640600 - RNA, 17 nt, Homo sapiens
uaaacucuggaugauuc

SEQ ID NO: 1640601 - RNA, 22 nt, Homo sapiens
uaaacucuggaugauucuucca

SEQ ID NO: 1640602 - RNA, 20 nt, Homo sapiens
uaaacuuacuuaguguuaug

SEQ ID NO: 1640603 - RNA, 20 nt, Homo sapiens
uaaagaaauauauaugauau

SEQ ID NO: 1640604 - RNA, 18 nt, Homo sapiens
uaaagcaauaugcauuua

SEQ ID NO: 1640605 - RNA, 13 nt, Homo sapiens
uaaaguacaagag

SEQ ID NO: 1640606 - RNA, 17 nt, Homo sapiens
uaaaguacaagagcuua

SEQ ID NO: 1640607 - RNA, 14 nt, Homo sapiens
uaaagucaguaacu

SEQ ID NO: 1640608 - RNA, 18 nt, Homo sapiens
uaaaguguuugaaagcuu

SEQ ID NO: 1640609 - RNA, 15 nt, Homo sapiens
uaaauacaugcauau

SEQ ID NO: 1640610 - RNA, 19 nt, Homo sapiens
uaaaucauucuuacuaaaa

SEQ ID NO: 1640611 - RNA, 13 nt, Homo sapiens
uaaauccccucac

SEQ ID NO: 1640612 - RNA, 18 nt, Homo sapiens
uaaauggugcugcagauu

SEQ ID NO: 1640613 - RNA, 13 nt, Homo sapiens
uaaauguagaaag

SEQ ID NO: 1640614 - RNA, 21 nt, Homo sapiens
uaaauguagaaagugauccau

SEQ ID NO: 1640615 - RNA, 22 nt, Homo sapiens
uaaauguuaugacuccuugaua

SEQ ID NO: 1640616 - RNA, 22 nt, Homo sapiens
uaaauucucucuaacauaacaa

SEQ ID NO: 1640617 - RNA, 13 nt, Homo sapiens
uaaauuguuguaa

SEQ ID NO: 1640618 - RNA, 20 nt, Homo sapiens
uaaauuucucuacugucuca

SEQ ID NO: 1640619 - RNA, 17 nt, Homo sapiens
uaaauuuugugaugaau

SEQ ID NO: 1640620 - RNA, 14 nt, Homo sapiens
uaacaaacucugag

SEQ ID NO: 1640621 - RNA, 16 nt, Homo sapiens
uaacacucauuuccaa

SEQ ID NO: 1640622 - RNA, 14 nt, Homo sapiens
uaacagaacagaca

SEQ ID NO: 1640623 - RNA, 16 nt, Homo sapiens
uaacaggcagauacag

SEQ ID NO: 1640624 - RNA, 22 nt, Homo sapiens
uaaccaaagcccaaagugguau

SEQ ID NO: 1640625 - RNA, 13 nt, Homo sapiens
uaaccaaauuauu

SEQ ID NO: 1640626 - RNA, 20 nt, Homo sapiens
uaaccguuuccuuucauuua

SEQ ID NO: 1640627 - RNA, 23 nt, Homo sapiens
uaaccguuuccuuucauuuacug

SEQ ID NO: 1640628 - RNA, 20 nt, Homo sapiens
uaaccuauuuccacauucuc

SEQ ID NO: 1640629 - RNA, 22 nt, Homo sapiens
uaaccuugaaaaaaaacagugg

SEQ ID NO: 1640630 - RNA, 14 nt, Homo sapiens
uaacuaugacagau

SEQ ID NO: 1640631 - RNA, 15 nt, Homo sapiens
uaacuaugacagaua

SEQ ID NO: 1640632 - RNA, 14 nt, Homo sapiens
uaacuauguugaua

SEQ ID NO: 1640633 - RNA, 18 nt, Homo sapiens
uaacucuaccugcacacu

SEQ ID NO: 1640634 - RNA, 20 nt, Homo sapiens
uaacuuuauacacuuggauu

SEQ ID NO: 1640635 - RNA, 18 nt, Homo sapiens
uaagaacaccugcauucu

SEQ ID NO: 1640636 - RNA, 21 nt, Homo sapiens
uaagacuaaugcucaaccuaa

SEQ ID NO: 1640637 - RNA, 19 nt, Homo sapiens
uaagagggcacacacugug

SEQ ID NO: 1640638 - RNA, 20 nt, Homo sapiens
uccaauaauuuuccugugac

SEQ ID NO: 1640639 - RNA, 21 nt, Homo sapiens
uccaauaauuuuccugugaca

SEQ ID NO: 1640640 - RNA, 11 nt, Homo sapiens
uccaauacugc

SEQ ID NO: 1640641 - RNA, 15 nt, Homo sapiens
uccaaugacauaucc

SEQ ID NO: 1640642 - RNA, 23 nt, Homo sapiens
uccacagcuuuuacguaguaaaa

SEQ ID NO: 1640643 - RNA, 16 nt, Homo sapiens
uccacaucuuuacuca

SEQ ID NO: 1640644 - RNA, 14 nt, Homo sapiens
uccaccaccaccug

SEQ ID NO: 1640645 - RNA, 19 nt, Homo sapiens
uccacguucugcucaucau

SEQ ID NO: 1640646 - RNA, 21 nt, Homo sapiens
uccacucaggucuguuuuccg

SEQ ID NO: 1640647 - RNA, 16 nt, Homo sapiens
uccacucccacuuccc

SEQ ID NO: 1640648 - RNA, 16 nt, Homo sapiens
uccacuugguucaggu

SEQ ID NO: 1640649 - RNA, 12 nt, Homo sapiens
uccagagcugcu

SEQ ID NO: 1640650 - RNA, 15 nt, Homo sapiens
uccagcucaccagcc

SEQ ID NO: 1640651 - RNA, 16 nt, Homo sapiens
uccaggagaaggccaa

SEQ ID NO: 1640652 - RNA, 20 nt, Homo sapiens
uccaggauuuauaaagcaaa

SEQ ID NO: 1640653 - RNA, 21 nt, Homo sapiens
uccaucaguuagagcugacac

SEQ ID NO: 1640654 - RNA, 19 nt, Homo sapiens
uccaucauucauccaggac

SEQ ID NO: 1640655 - RNA, 23 nt, Homo sapiens
uccauccccuagaaauccuggga

SEQ ID NO: 1640656 - RNA, 18 nt, Homo sapiens
uccaucgcugucaucuca

SEQ ID NO: 1640657 - RNA, 18 nt, Homo sapiens
uccauguucuauuucagu

SEQ ID NO: 1640658 - RNA, 19 nt, Homo sapiens
uccauuuacccuucuuuuc

SEQ ID NO: 1640659 - RNA, 17 nt, Homo sapiens
uccauuuuuagugaaau

SEQ ID NO: 1640660 - RNA, 22 nt, Homo sapiens
ucccaaaagcccauucauucca

SEQ ID NO: 1640661 - RNA, 18 nt, Homo sapiens
ucccaagcucccaagagc

SEQ ID NO: 1640662 - RNA, 13 nt, Homo sapiens
ucccacaggacau

SEQ ID NO: 1640663 - RNA, 16 nt, Homo sapiens
ucccaccccaagcaaa

SEQ ID NO: 1640664 - RNA, 23 nt, Homo sapiens
ucccacugcacccccuccugcug

SEQ ID NO: 1640665 - RNA, 17 nt, Homo sapiens
ucccagccacaguguua

SEQ ID NO: 1640666 - RNA, 17 nt, Homo sapiens
ucccaggaguacacccc

SEQ ID NO: 1640667 - RNA, 18 nt, Homo sapiens
ucccagguuaucugggca

SEQ ID NO: 1640668 - RNA, 18 nt, Homo sapiens
ucccaucacuguauccau

SEQ ID NO: 1640669 - RNA, 18 nt, Homo sapiens
uccccauacaaauaagca

SEQ ID NO: 1640670 - RNA, 20 nt, Homo sapiens
uccccugcccccugcaggaa

SEQ ID NO: 1640671 - RNA, 20 nt, Homo sapiens
uccccuggggagucugggca

SEQ ID NO: 1640672 - RNA, 18 nt, Homo sapiens
uccccuucucucaucucu

SEQ ID NO: 1640673 - RNA, 20 nt, Homo sapiens
ucccgaguagcugagauuau

SEQ ID NO: 1640674 - RNA, 13 nt, Homo sapiens
ucccuaccugacu

SEQ ID NO: 1640675 - RNA, 18 nt, Homo sapiens
ucccucagaucccaguuc

SEQ ID NO: 1640676 - RNA, 23 nt, Homo sapiens
ucccugaaguaagcaaagacuuu

SEQ ID NO: 1640677 - RNA, 14 nt, Homo sapiens
ucccugcaaccuga

SEQ ID NO: 1640678 - RNA, 22 nt, Homo sapiens
ucccugccuaaggaagcuaaaa

SEQ ID NO: 1640679 - RNA, 15 nt, Homo sapiens
ucccuucaucuggaa

SEQ ID NO: 1640680 - RNA, 21 nt, Homo sapiens
ucccuucaucuggaaccauca

SEQ ID NO: 1640681 - RNA, 16 nt, Homo sapiens
uccuaaaacaaaagcu

SEQ ID NO: 1640682 - RNA, 19 nt, Homo sapiens
uccuaauauuuugauucau

SEQ ID NO: 1640683 - RNA, 19 nt, Homo sapiens
uccuaaugaaugcauaaaa

SEQ ID NO: 1640684 - RNA, 17 nt, Homo sapiens
uccuacaagacacagug

SEQ ID NO: 1640685 - RNA, 18 nt, Homo sapiens
uccuacuguaugugggaa

SEQ ID NO: 1640686 - RNA, 17 nt, Homo sapiens
uccuagggccacugaag

SEQ ID NO: 1640687 - RNA, 17 nt, Homo sapiens
uccuaguuccaccauca

SEQ ID NO: 1640688 - RNA, 16 nt, Homo sapiens
uccucacguccaucac

SEQ ID NO: 1640689 - RNA, 20 nt, Homo sapiens
uccucaguuuuugugaaaag

SEQ ID NO: 1640690 - RNA, 23 nt, Homo sapiens
uccuccagggacagcaacuauca

SEQ ID NO: 1640691 - RNA, 12 nt, Homo sapiens
uccuccaggugc

SEQ ID NO: 1640692 - RNA, 14 nt, Homo sapiens
uccucccaccucag

SEQ ID NO: 1640693 - RNA, 14 nt, Homo sapiens
uccuccguggcaca

SEQ ID NO: 1640694 - RNA, 13 nt, Homo sapiens
uccuccucuguga

SEQ ID NO: 1640695 - RNA, 21 nt, Homo sapiens
uccucucaugucuuugcugca

SEQ ID NO: 1640696 - RNA, 17 nt, Homo sapiens
uccugaagagcauuugg

SEQ ID NO: 1640697 - RNA, 16 nt, Homo sapiens
uccugacuucaguguc

SEQ ID NO: 1640698 - RNA, 20 nt, Homo sapiens
uccugagggauuucuaacca

SEQ ID NO: 1640699 - RNA, 20 nt, Homo sapiens
uccugaguaguugggauuac

SEQ ID NO: 1640700 - RNA, 13 nt, Homo sapiens
uccugccaccacg

SEQ ID NO: 1640701 - RNA, 23 nt, Homo sapiens
uccugcccuugcuccagccugac

SEQ ID NO: 1640702 - RNA, 19 nt, Homo sapiens
uccuggacuuuuccucuca

SEQ ID NO: 1640703 - RNA, 21 nt, Homo sapiens
uccuggauuccucacuuugaa

SEQ ID NO: 1640704 - RNA, 17 nt, Homo sapiens
uccugggcuaagugauc

SEQ ID NO: 1640705 - RNA, 16 nt, Homo sapiens
uccugugauccuuuga

SEQ ID NO: 1640706 - RNA, 13 nt, Homo sapiens
uccugugaugucc

SEQ ID NO: 1640707 - RNA, 13 nt, Homo sapiens
uccuuaacacuga

SEQ ID NO: 1640708 - RNA, 14 nt, Homo sapiens
uccuuacucuugau

SEQ ID NO: 1640709 - RNA, 19 nt, Homo sapiens
uccuucacagaugggugcu

SEQ ID NO: 1640710 - RNA, 14 nt, Homo sapiens
uccuuccaccucag

SEQ ID NO: 1640711 - RNA, 16 nt, Homo sapiens
uccuuccagcacugac

SEQ ID NO: 1640712 - RNA, 21 nt, Homo sapiens
uccuucuuugauaauguuaaa

SEQ ID NO: 1640713 - RNA, 19 nt, Homo sapiens
uccuugagagaccaggcaa

SEQ ID NO: 1640714 - RNA, 16 nt, Homo sapiens
uccuuucauuuacugu

SEQ ID NO: 1640715 - RNA, 13 nt, Homo sapiens
uccuuucuauauc

SEQ ID NO: 1640716 - RNA, 13 nt, Homo sapiens
ucgaaaugagcuc

SEQ ID NO: 1640717 - RNA, 21 nt, Homo sapiens
ucgcccaggcuggagugcaau

SEQ ID NO: 1640718 - RNA, 13 nt, Homo sapiens
ucggcuccugcug

SEQ ID NO: 1640719 - RNA, 16 nt, Homo sapiens
ucuaaacuuuaauuca

SEQ ID NO: 1640720 - RNA, 16 nt, Homo sapiens
ucuaaagugagcucua

SEQ ID NO: 1640721 - RNA, 17 nt, Homo sapiens
ucuaaguaaugaugucg

SEQ ID NO: 1640722 - RNA, 13 nt, Homo sapiens
ucuaauacuuugu

SEQ ID NO: 1640723 - RNA, 18 nt, Homo sapiens
ucuaauggcuguggcauu

SEQ ID NO: 1640724 - RNA, 20 nt, Homo sapiens
ucuaauucuuuaaugauucc

SEQ ID NO: 1640725 - RNA, 13 nt, Homo sapiens
ucuacaguauuau

SEQ ID NO: 1640726 - RNA, 15 nt, Homo sapiens
ucuacuaacaaucag

SEQ ID NO: 1640727 - RNA, 21 nt, Homo sapiens
ucuacuaacaaucagcuccuu

SEQ ID NO: 1640728 - RNA, 20 nt, Homo sapiens
ucuacuacccccacagaccu

SEQ ID NO: 1640729 - RNA, 24 nt, Homo sapiens
ucuagagcuugaugccaguaggcu

SEQ ID NO: 1640730 - RNA, 18 nt, Homo sapiens
ucuauaccuuacugcaau

SEQ ID NO: 1640731 - RNA, 19 nt, Homo sapiens
ucuaucaccaaggagccaa

SEQ ID NO: 1640732 - RNA, 20 nt, Homo sapiens
ucuaucaccaaggagccaaa

SEQ ID NO: 1640733 - RNA, 19 nt, Homo sapiens
ucuaugaaauaucaugcuc

SEQ ID NO: 1640734 - RNA, 20 nt, Homo sapiens
ucuauggcacccaugcaccu

SEQ ID NO: 1640735 - RNA, 21 nt, Homo sapiens
ucuaugggcagaucuaccccu

SEQ ID NO: 1640736 - RNA, 16 nt, Homo sapiens
ucuauuacgugcaaua

SEQ ID NO: 1640737 - RNA, 19 nt, Homo sapiens
ucuauuucuccuccauggg

SEQ ID NO: 1640738 - RNA, 20 nt, Homo sapiens
ucucaaacucuugaccucag

SEQ ID NO: 1640739 - RNA, 20 nt, Homo sapiens
ucucaacccaggagcaucca

SEQ ID NO: 1640740 - RNA, 15 nt, Homo sapiens
ucucaacucacugca

SEQ ID NO: 1640741 - RNA, 14 nt, Homo sapiens
ucucaauucuuccc

SEQ ID NO: 1640742 - RNA, 22 nt, Homo sapiens
ucucaccuaaacccucugugaa

SEQ ID NO: 1640743 - RNA, 23 nt, Homo sapiens
ucucagccccugauccugugaag

SEQ ID NO: 1640744 - RNA, 21 nt, Homo sapiens
ucucagcuggaucuccauucu

SEQ ID NO: 1640745 - RNA, 23 nt, Homo sapiens
ucucaggcugucccaagcuccca

SEQ ID NO: 1640746 - RNA, 14 nt, Homo sapiens
ucucaguugcagcc

SEQ ID NO: 1640747 - RNA, 17 nt, Homo sapiens
ugggccccucucauucc

SEQ ID NO: 1640748 - RNA, 18 nt, Homo sapiens
ugggcucugugggcugca

SEQ ID NO: 1640749 - RNA, 11 nt, Homo sapiens
ugggcuucuag

SEQ ID NO: 1640750 - RNA, 21 nt, Homo sapiens
uggggcuaggaaauccagggu

SEQ ID NO: 1640751 - RNA, 14 nt, Homo sapiens
ugggggugcagaug

SEQ ID NO: 1640752 - RNA, 17 nt, Homo sapiens
uggggguuaccaaaaau

SEQ ID NO: 1640753 - RNA, 15 nt, Homo sapiens
ugggguaauacuucc

SEQ ID NO: 1640754 - RNA, 16 nt, Homo sapiens
uggggugggcacauug

SEQ ID NO: 1640755 - RNA, 16 nt, Homo sapiens
ugggguucggccugug

SEQ ID NO: 1640756 - RNA, 17 nt, Homo sapiens
ugggguuggagguuuca

SEQ ID NO: 1640757 - RNA, 17 nt, Homo sapiens
ugggucuccauccucca

SEQ ID NO: 1640758 - RNA, 19 nt, Homo sapiens
uggguuggaaaacaguauu

SEQ ID NO: 1640759 - RNA, 23 nt, Homo sapiens
uggguuucccuugcccuuuccau

SEQ ID NO: 1640760 - RNA, 13 nt, Homo sapiens
uggguuugagaag

SEQ ID NO: 1640761 - RNA, 22 nt, Homo sapiens
ugguaaagauggcauuucacca

SEQ ID NO: 1640762 - RNA, 16 nt, Homo sapiens
ugguacuaaggagaau

SEQ ID NO: 1640763 - RNA, 13 nt, Homo sapiens
ugguaucugcaug

SEQ ID NO: 1640764 - RNA, 12 nt, Homo sapiens
uggucacuggaa

SEQ ID NO: 1640765 - RNA, 15 nt, Homo sapiens
uggucccccuuccau

SEQ ID NO: 1640766 - RNA, 18 nt, Homo sapiens
ugguccgaagucuuccau

SEQ ID NO: 1640767 - RNA, 20 nt, Homo sapiens
ugguccugcugcuggcugcc

SEQ ID NO: 1640768 - RNA, 12 nt, Homo sapiens
ugguccuguaaa

SEQ ID NO: 1640769 - RNA, 20 nt, Homo sapiens
ugguccuuagccccaucugc

SEQ ID NO: 1640770 - RNA, 22 nt, Homo sapiens
uggucucaaucuccugacuuca

SEQ ID NO: 1640771 - RNA, 22 nt, Homo sapiens
uggucucugauagguagcauuu

SEQ ID NO: 1640772 - RNA, 22 nt, Homo sapiens
uggucugucaaugagagcauaa

SEQ ID NO: 1640773 - RNA, 14 nt, Homo sapiens
uggugacuuuugaa

SEQ ID NO: 1640774 - RNA, 18 nt, Homo sapiens
uggugcccuguucucuac

SEQ ID NO: 1640775 - RNA, 20 nt, Homo sapiens
uggugccugaagaccccaga

SEQ ID NO: 1640776 - RNA, 20 nt, Homo sapiens
ugguguuccauugccucuuu

SEQ ID NO: 1640777 - RNA, 21 nt, Homo sapiens
ugguucucacugccuccuaca

SEQ ID NO: 1640778 - RNA, 14 nt, Homo sapiens
ugguucugugccaa

SEQ ID NO: 1640779 - RNA, 17 nt, Homo sapiens
ugguuuauuucccagua

SEQ ID NO: 1640780 - RNA, 15 nt, Homo sapiens
uguaaaauuauuuca

SEQ ID NO: 1640781 - RNA, 22 nt, Homo sapiens
uguaaaguugccuuuauuugcu

SEQ ID NO: 1640782 - RNA, 22 nt, Homo sapiens
uguaacuuuguugcauuuuggc

SEQ ID NO: 1640783 - RNA, 17 nt, Homo sapiens
uguaagguggucacugu

SEQ ID NO: 1640784 - RNA, 20 nt, Homo sapiens
uguaauauuguaaauacugg

SEQ ID NO: 1640785 - RNA, 20 nt, Homo sapiens
uguaaucccagcacuuggag

SEQ ID NO: 1640786 - RNA, 16 nt, Homo sapiens
uguaauggacuaugca

SEQ ID NO: 1640787 - RNA, 12 nt, Homo sapiens
uguacaaagccc

SEQ ID NO: 1640788 - RNA, 12 nt, Homo sapiens
uguaccagagaa

SEQ ID NO: 1640789 - RNA, 14 nt, Homo sapiens
uguaccugugcacg

SEQ ID NO: 1640790 - RNA, 12 nt, Homo sapiens
uguaccuugaua

SEQ ID NO: 1640791 - RNA, 16 nt, Homo sapiens
uguacuauggucucuu

SEQ ID NO: 1640792 - RNA, 18 nt, Homo sapiens
uguacugaguauugauaa

SEQ ID NO: 1640793 - RNA, 15 nt, Homo sapiens
uguacuguuacugug

SEQ ID NO: 1640794 - RNA, 16 nt, Homo sapiens
uguacuguuacugugu

SEQ ID NO: 1640795 - RNA, 19 nt, Homo sapiens
uguacuguuacugugucag

SEQ ID NO: 1640796 - RNA, 18 nt, Homo sapiens
uguacuugccuuauuaga

SEQ ID NO: 1640797 - RNA, 12 nt, Homo sapiens
uguagaaaguga

SEQ ID NO: 1640798 - RNA, 14 nt, Homo sapiens
uguagaaagugauc

SEQ ID NO: 1640799 - RNA, 19 nt, Homo sapiens
uguagaauauauuuccuua

SEQ ID NO: 1640800 - RNA, 16 nt, Homo sapiens
uguagcaguaucucau

SEQ ID NO: 1640801 - RNA, 20 nt, Homo sapiens
uguagcucuaggguauauau

SEQ ID NO: 1640802 - RNA, 16 nt, Homo sapiens
uguaguguuuugugga

SEQ ID NO: 1640803 - RNA, 16 nt, Homo sapiens
uguauaccaugaugca

SEQ ID NO: 1640804 - RNA, 13 nt, Homo sapiens
uguauccacuuuc

SEQ ID NO: 1640805 - RNA, 14 nt, Homo sapiens
uguauccauucuac

SEQ ID NO: 1640806 - RNA, 16 nt, Homo sapiens
uguaucugugggucuc

SEQ ID NO: 1640807 - RNA, 15 nt, Homo sapiens
uguauucuauuuugc

SEQ ID NO: 1640808 - RNA, 21 nt, Homo sapiens
uguauuuaaaugaaagugaga

SEQ ID NO: 1640809 - RNA, 11 nt, Homo sapiens
ugucaucucag

SEQ ID NO: 1640810 - RNA, 17 nt, Homo sapiens
ugucaucugucacuaua

SEQ ID NO: 1640811 - RNA, 20 nt, Homo sapiens
uguccccuucucucaucucu

SEQ ID NO: 1640812 - RNA, 16 nt, Homo sapiens
ugucccugcacuugca

SEQ ID NO: 1640813 - RNA, 19 nt, Homo sapiens
uguccguggcuacaauuca

SEQ ID NO: 1640814 - RNA, 15 nt, Homo sapiens
uguccuccucuguga

SEQ ID NO: 1640815 - RNA, 14 nt, Homo sapiens
uguccugcaauuua

SEQ ID NO: 1640816 - RNA, 16 nt, Homo sapiens
ugucuaguagaacaau

SEQ ID NO: 1640817 - RNA, 17 nt, Homo sapiens
ugucucagaccacuauu

SEQ ID NO: 1640818 - RNA, 23 nt, Homo sapiens
ugucucgugguaggacuguagaa

SEQ ID NO: 1640819 - RNA, 21 nt, Homo sapiens
ugucucucacagagaaaaagu

SEQ ID NO: 1640820 - RNA, 18 nt, Homo sapiens
ugucucuuuaaugucaca

SEQ ID NO: 1640821 - RNA, 15 nt, Homo sapiens
ugucugcaacaugga

SEQ ID NO: 1640822 - RNA, 19 nt, Homo sapiens
ugucuggauucccaggaug

SEQ ID NO: 1640823 - RNA, 13 nt, Homo sapiens
ugucuucuuucca

SEQ ID NO: 1640824 - RNA, 19 nt, Homo sapiens
ugucuuucagccaagccaa

SEQ ID NO: 1640825 - RNA, 14 nt, Homo sapiens
ugucuuugccaagu

SEQ ID NO: 1640826 - RNA, 18 nt, Homo sapiens
ugucuuuuuucacuacau

SEQ ID NO: 1640827 - RNA, 15 nt, Homo sapiens
ugugaaccaccacac

SEQ ID NO: 1640828 - RNA, 20 nt, Homo sapiens
ugugaaguugcccaccaaaa

SEQ ID NO: 1640829 - RNA, 20 nt, Homo sapiens
ugugacaccccccuucugaa

SEQ ID NO: 1640830 - RNA, 22 nt, Homo sapiens
ugugacauuauaugcacuagca

SEQ ID NO: 1640831 - RNA, 20 nt, Homo sapiens
ugugaccaaugucuugaugc

SEQ ID NO: 1640832 - RNA, 19 nt, Homo sapiens
ugugacuccucaggguuga

SEQ ID NO: 1640833 - RNA, 23 nt, Homo sapiens
ugugagacucgagaacuuucauu

SEQ ID NO: 1640834 - RNA, 9 nt, Homo sapiens
ugugcaaua

SEQ ID NO: 1640835 - RNA, 15 nt, Homo sapiens
ugugcaucuggugua

SEQ ID NO: 1640836 - RNA, 21 nt, Homo sapiens
ugugccauacuuguucuguau

SEQ ID NO: 1640837 - RNA, 23 nt, Homo sapiens
ugugcccccugaaacagcugcca

SEQ ID NO: 1640838 - RNA, 13 nt, Homo sapiens
ugugcccucagau

SEQ ID NO: 1640839 - RNA, 22 nt, Homo sapiens
ugugccuuaggaaaagcauuug

SEQ ID NO: 1640840 - RNA, 18 nt, Homo sapiens
ugugcgagucugagucag

SEQ ID NO: 1640841 - RNA, 18 nt, Homo sapiens
ugugcucagagaccccuc

SEQ ID NO: 1640842 - RNA, 21 nt, Homo sapiens
uguggcaggagggcaguggug

SEQ ID NO: 1640843 - RNA, 17 nt, Homo sapiens
uguggccacagcagcuu

SEQ ID NO: 1640844 - RNA, 22 nt, Homo sapiens
uguggcuucuuaaucuuuucac

SEQ ID NO: 1640845 - RNA, 19 nt, Homo sapiens
ugugguuacuaguacaggu

SEQ ID NO: 1640846 - RNA, 12 nt, Homo sapiens
uguguacccugg

SEQ ID NO: 1640847 - RNA, 20 nt, Homo sapiens
uguguagcaaauuucgagca

SEQ ID NO: 1640848 - RNA, 15 nt, Homo sapiens
ugugucaggaaacau

SEQ ID NO: 1640849 - RNA, 19 nt, Homo sapiens
ugugucaggaaacauauuu

SEQ ID NO: 1640850 - RNA, 12 nt, Homo sapiens
ugugucugcaac

SEQ ID NO: 1640851 - RNA, 13 nt, Homo sapiens
ugugucugcaaca

SEQ ID NO: 1640852 - RNA, 14 nt, Homo sapiens
ugugugaacgugua

SEQ ID NO: 1640853 - RNA, 15 nt, Homo sapiens
ugugugaacguguau

SEQ ID NO: 1640854 - RNA, 18 nt, Homo sapiens
ugugugaucugugggcac

SEQ ID NO: 1640855 - RNA, 16 nt, Homo sapiens
ugugugcacguacaca

SEQ ID NO: 1640856 - RNA, 17 nt, Homo sapiens
uguguggggugggcaca

SEQ ID NO: 1640857 - RNA, 12 nt, Homo sapiens
aaaaaacuauuu

SEQ ID NO: 1640858 - RNA, 17 nt, Homo sapiens
aaaaacagagguggaua

SEQ ID NO: 1640859 - RNA, 18 nt, Homo sapiens
aaaaacucaggcaaagaa

SEQ ID NO: 1640860 - RNA, 17 nt, Homo sapiens
aaaaauaaagcacuuau

SEQ ID NO: 1640861 - RNA, 15 nt, Homo sapiens
aaaaaugucaucuca

SEQ ID NO: 1640862 - RNA, 14 nt, Homo sapiens
aaaaaugugacuca

SEQ ID NO: 1640863 - RNA, 14 nt, Homo sapiens
aaaacacugugcac

SEQ ID NO: 1640864 - RNA, 13 nt, Homo sapiens
aaaacaugaauuu

SEQ ID NO: 1640865 - RNA, 12 nt, Homo sapiens
aaaacauuccau

SEQ ID NO: 1640866 - RNA, 18 nt, Homo sapiens
aaaaccugagcagcaacu

SEQ ID NO: 1640867 - RNA, 21 nt, Homo sapiens
aaaaccuugaaaccuuugaca

SEQ ID NO: 1640868 - RNA, 13 nt, Homo sapiens
aaaacugccaaaa

SEQ ID NO: 1640869 - RNA, 22 nt, Homo sapiens
aaaacuguggguagagacuuug

SEQ ID NO: 1640870 - RNA, 11 nt, Homo sapiens
aaaagacauaa

SEQ ID NO: 1640871 - RNA, 14 nt, Homo sapiens
aaaagacugaccaa

SEQ ID NO: 1640872 - RNA, 20 nt, Homo sapiens
aaaagcagaaaauacagcug

SEQ ID NO: 1640873 - RNA, 15 nt, Homo sapiens
aaaaguaaacaacau

SEQ ID NO: 1640874 - RNA, 12 nt, Homo sapiens
aaaauacauaua

SEQ ID NO: 1640875 - RNA, 13 nt, Homo sapiens
aaaauacaugaca

SEQ ID NO: 1640876 - RNA, 18 nt, Homo sapiens
aaaauacaugacauuuau

SEQ ID NO: 1640877 - RNA, 13 nt, Homo sapiens
aaaauauuuuaca

SEQ ID NO: 1640878 - RNA, 19 nt, Homo sapiens
aaaauauuuucuacaucuu

SEQ ID NO: 1640879 - RNA, 16 nt, Homo sapiens
aaaaucuucagcuggu

SEQ ID NO: 1640880 - RNA, 22 nt, Homo sapiens
aaaaucuucagcugguggaugg

SEQ ID NO: 1640881 - RNA, 20 nt, Homo sapiens
aaaaugaaccuugcuaucaa

SEQ ID NO: 1640882 - RNA, 23 nt, Homo sapiens
aaaaugaagguggaacaagcaca

SEQ ID NO: 1640883 - RNA, 18 nt, Homo sapiens
aaaaugaauuugggauac

SEQ ID NO: 1640884 - RNA, 18 nt, Homo sapiens
aaaaugcaacaacaugua

SEQ ID NO: 1640885 - RNA, 20 nt, Homo sapiens
aaaaugugucugcaacaugg

SEQ ID NO: 1640886 - RNA, 17 nt, Homo sapiens
aaaaugugugugugcuu

SEQ ID NO: 1640887 - RNA, 15 nt, Homo sapiens
aaaauguuggugcaa

SEQ ID NO: 1640888 - RNA, 18 nt, Homo sapiens
aaaauuuaaaaaacugug

SEQ ID NO: 1640889 - RNA, 17 nt, Homo sapiens
aaacaaauguauuucaa

SEQ ID NO: 1640890 - RNA, 19 nt, Homo sapiens
aaacacccucacacuggga

SEQ ID NO: 1640891 - RNA, 19 nt, Homo sapiens
aaacagccuuugggaaaug

SEQ ID NO: 1640892 - RNA, 14 nt, Homo sapiens
aaacagugacauuu

SEQ ID NO: 1640893 - RNA, 21 nt, Homo sapiens
aaacauaccaacauguuuaaa

SEQ ID NO: 1640894 - RNA, 15 nt, Homo sapiens
aaacaugaguuauuc

SEQ ID NO: 1640895 - RNA, 22 nt, Homo sapiens
aaacauuuucaugcacaguaga

SEQ ID NO: 1640896 - RNA, 18 nt, Homo sapiens
aaacauuuuuguuuuuaa

SEQ ID NO: 1640897 - RNA, 22 nt, Homo sapiens
aaacccaguaguggugacugug

SEQ ID NO: 1640898 - RNA, 20 nt, Homo sapiens
aaacccccacccuucugccu

SEQ ID NO: 1640899 - RNA, 13 nt, Homo sapiens
aaacccucgaggc

SEQ ID NO: 1640900 - RNA, 14 nt, Homo sapiens
aaacccucugugaa

SEQ ID NO: 1640901 - RNA, 21 nt, Homo sapiens
aaacccuuccacguguaugca

SEQ ID NO: 1640902 - RNA, 21 nt, Homo sapiens
aaaccugagcagcaacugugu

SEQ ID NO: 1640903 - RNA, 17 nt, Homo sapiens
aaacuaccuuccaguuc

SEQ ID NO: 1640904 - RNA, 18 nt, Homo sapiens
aaacucaagcuucuucac

SEQ ID NO: 1640905 - RNA, 23 nt, Homo sapiens
aaacucaagcuucuucacucaca

SEQ ID NO: 1640906 - RNA, 20 nt, Homo sapiens
aaacuccuagguucacuuug

SEQ ID NO: 1640907 - RNA, 17 nt, Homo sapiens
aaacugcccccucugcc

SEQ ID NO: 1640908 - RNA, 12 nt, Homo sapiens
aaacugugcacc

SEQ ID NO: 1640909 - RNA, 13 nt, Homo sapiens
aaacuucaagggu

SEQ ID NO: 1640910 - RNA, 22 nt, Homo sapiens
aaacuuccaagucauucucacc

SEQ ID NO: 1640911 - RNA, 18 nt, Homo sapiens
aaacuucuuucacucaca

SEQ ID NO: 1640912 - RNA, 15 nt, Homo sapiens
aaguacuguaacugu

SEQ ID NO: 1640913 - RNA, 18 nt, Homo sapiens
aaguacuucuccacccug

SEQ ID NO: 1640914 - RNA, 23 nt, Homo sapiens
aaguaguaaauuuugugaugaau

SEQ ID NO: 1640915 - RNA, 22 nt, Homo sapiens
aaguccaggacacccagugggg

SEQ ID NO: 1640916 - RNA, 15 nt, Homo sapiens
aagucuagcacaguu

SEQ ID NO: 1640917 - RNA, 14 nt, Homo sapiens
aagucuuccauaga

SEQ ID NO: 1640918 - RNA, 18 nt, Homo sapiens
aagucuuugaagugacuu

SEQ ID NO: 1640919 - RNA, 13 nt, Homo sapiens
aagugauucucau

SEQ ID NO: 1640920 - RNA, 17 nt, Homo sapiens
aagugcacaccuuuauu

SEQ ID NO: 1640921 - RNA, 19 nt, Homo sapiens
aagugccugcaaaaacaga

SEQ ID NO: 1640922 - RNA, 20 nt, Homo sapiens
aagugcugcgauuacaggca

SEQ ID NO: 1640923 - RNA, 12 nt, Homo sapiens
aagugugugauc

SEQ ID NO: 1640924 - RNA, 15 nt, Homo sapiens
aagugugugaucugu

SEQ ID NO: 1640925 - RNA, 18 nt, Homo sapiens
aaguucaggcucugagac

SEQ ID NO: 1640926 - RNA, 11 nt, Homo sapiens
aaguucaguga

SEQ ID NO: 1640927 - RNA, 19 nt, Homo sapiens
aaguucagugagaaucugc

SEQ ID NO: 1640928 - RNA, 18 nt, Homo sapiens
aaguucuuaguugcugua

SEQ ID NO: 1640929 - RNA, 14 nt, Homo sapiens
aaguugacaccuuu

SEQ ID NO: 1640930 - RNA, 21 nt, Homo sapiens
aaguugauauagaacagugcu

SEQ ID NO: 1640931 - RNA, 18 nt, Homo sapiens
aaguugauucauauugca

SEQ ID NO: 1640932 - RNA, 22 nt, Homo sapiens
aaguuggucuuacuuugugcaa

SEQ ID NO: 1640933 - RNA, 22 nt, Homo sapiens
aaguuuccguggguucugucau

SEQ ID NO: 1640934 - RNA, 17 nt, Homo sapiens
aaguuucuuaaagcaac

SEQ ID NO: 1640935 - RNA, 14 nt, Homo sapiens
aauaaagcauuaua

SEQ ID NO: 1640936 - RNA, 22 nt, Homo sapiens
aauaaagguuagauaaguccuu

SEQ ID NO: 1640937 - RNA, 16 nt, Homo sapiens
aauaaccuuauucuau

SEQ ID NO: 1640938 - RNA, 23 nt, Homo sapiens
aauaacgauaaaagacagugaaa

SEQ ID NO: 1640939 - RNA, 20 nt, Homo sapiens
aauaagauccaauucaucuu

SEQ ID NO: 1640940 - RNA, 15 nt, Homo sapiens
aauaauucucuauua

SEQ ID NO: 1640941 - RNA, 17 nt, Homo sapiens
aauaauuuuccugugac

SEQ ID NO: 1640942 - RNA, 14 nt, Homo sapiens
aauacaauacauuu

SEQ ID NO: 1640943 - RNA, 14 nt, Homo sapiens
aauacauguuuuca

SEQ ID NO: 1640944 - RNA, 17 nt, Homo sapiens
aauacauuuucauuuau

SEQ ID NO: 1640945 - RNA, 20 nt, Homo sapiens
aauacgguggggguaggggg

SEQ ID NO: 1640946 - RNA, 21 nt, Homo sapiens
aauagcugggacuacaggugu

SEQ ID NO: 1640947 - RNA, 15 nt, Homo sapiens
aauagugauuuccac

SEQ ID NO: 1640948 - RNA, 19 nt, Homo sapiens
aauagugauuuccacagug

SEQ ID NO: 1640949 - RNA, 13 nt, Homo sapiens
aauauauugcuaa

SEQ ID NO: 1640950 - RNA, 12 nt, Homo sapiens
aauaugacauau

SEQ ID NO: 1640951 - RNA, 13 nt, Homo sapiens
aauaugcagugau

SEQ ID NO: 1640952 - RNA, 16 nt, Homo sapiens
aauauucauugguuaa

SEQ ID NO: 1640953 - RNA, 21 nt, Homo sapiens
aauauuccacuauuugcagag

SEQ ID NO: 1640954 - RNA, 23 nt, Homo sapiens
aauauuguccauuguccaauccu

SEQ ID NO: 1640955 - RNA, 15 nt, Homo sapiens
aauauuuuccaugaa

SEQ ID NO: 1640956 - RNA, 23 nt, Homo sapiens
aauauuuuccaugaaaaugcaac

SEQ ID NO: 1640957 - RNA, 13 nt, Homo sapiens
aauauuuucuaca

SEQ ID NO: 1640958 - RNA, 17 nt, Homo sapiens
aaucaaaaucaaugcag

SEQ ID NO: 1640959 - RNA, 14 nt, Homo sapiens
aaucaaaugcaauu

SEQ ID NO: 1640960 - RNA, 18 nt, Homo sapiens
aaucaaguuggcuucuaa

SEQ ID NO: 1640961 - RNA, 20 nt, Homo sapiens
aaucacacgucuggcuucac

SEQ ID NO: 1640962 - RNA, 23 nt, Homo sapiens
aaucacacgucuggcuucacaga

SEQ ID NO: 1640963 - RNA, 15 nt, Homo sapiens
aaucaccuccugugu

SEQ ID NO: 1640964 - RNA, 16 nt, Homo sapiens
aaucacuucugagaac

SEQ ID NO: 1640965 - RNA, 17 nt, Homo sapiens
aaucagaacuguuggca

SEQ ID NO: 1640966 - RNA, 19 nt, Homo sapiens
aaucauaaauauaaucuaa

SEQ ID NO: 1640967 - RNA, 13 nt, Homo sapiens
aauccaauacugc

SEQ ID NO: 1640968 - RNA, 12 nt, Homo sapiens
aauccaaugaca

SEQ ID NO: 1640969 - RNA, 21 nt, Homo sapiens
aauccauucuuaaaguacuug

SEQ ID NO: 1640970 - RNA, 14 nt, Homo sapiens
aaucccagcacuug

SEQ ID NO: 1640971 - RNA, 23 nt, Homo sapiens
aauccugaauaaaccaguaucgu

SEQ ID NO: 1640972 - RNA, 21 nt, Homo sapiens
aaucuaucgugucaaccccaa

SEQ ID NO: 1640973 - RNA, 16 nt, Homo sapiens
aaucucggcucacugc

SEQ ID NO: 1640974 - RNA, 18 nt, Homo sapiens
aaucucggcucacugcaa

SEQ ID NO: 1640975 - RNA, 22 nt, Homo sapiens
aaucucggcucacugcauccuc

SEQ ID NO: 1640976 - RNA, 22 nt, Homo sapiens
aaucucugacuaaaaauacuua

SEQ ID NO: 1640977 - RNA, 13 nt, Homo sapiens
aaucugacauauu

SEQ ID NO: 1640978 - RNA, 22 nt, Homo sapiens
aaucugggcagacauuauguaa

SEQ ID NO: 1640979 - RNA, 21 nt, Homo sapiens
aaucuuacaaaagauugucau

SEQ ID NO: 1640980 - RNA, 16 nt, Homo sapiens
aaucuugcucacagcu

SEQ ID NO: 1640981 - RNA, 18 nt, Homo sapiens
aaugaaauggauugguaa

SEQ ID NO: 1640982 - RNA, 16 nt, Homo sapiens
aaugaaccuugcuauc

SEQ ID NO: 1640983 - RNA, 17 nt, Homo sapiens
aaugaaccuugcuauca

SEQ ID NO: 1640984 - RNA, 19 nt, Homo sapiens
aaugaagccuucugaccug

SEQ ID NO: 1640985 - RNA, 16 nt, Homo sapiens
aaugaagggucauuuc

SEQ ID NO: 1640986 - RNA, 21 nt, Homo sapiens
aaugagaauuuaagccucaaa

SEQ ID NO: 1640987 - RNA, 16 nt, Homo sapiens
aaugagaucauuguga

SEQ ID NO: 1640988 - RNA, 16 nt, Homo sapiens
aaugcaacaacaugua

SEQ ID NO: 1640989 - RNA, 15 nt, Homo sapiens
aaugcaccacuuuuu

SEQ ID NO: 1640990 - RNA, 19 nt, Homo sapiens
aaugcagcgugaagggauu

SEQ ID NO: 1640991 - RNA, 23 nt, Homo sapiens
aaugcauauccaacaugugcuca

SEQ ID NO: 1640992 - RNA, 17 nt, Homo sapiens
aaugcauuauggguggu

SEQ ID NO: 1640993 - RNA, 21 nt, Homo sapiens
aaugcccagccccuucugacc

SEQ ID NO: 1640994 - RNA, 16 nt, Homo sapiens
aaugcugauguccuca

SEQ ID NO: 1640995 - RNA, 16 nt, Homo sapiens
aauggacugacuguaa

SEQ ID NO: 1640996 - RNA, 16 nt, Homo sapiens
aauggaggcaacgcca

SEQ ID NO: 1640997 - RNA, 18 nt, Homo sapiens
aauggaggcaacgccaga

SEQ ID NO: 1640998 - RNA, 23 nt, Homo sapiens
aauggcucacuauggugccaaug

SEQ ID NO: 1640999 - RNA, 20 nt, Homo sapiens
aaugguaguuuuacaguguu

SEQ ID NO: 1641000 - RNA, 13 nt, Homo sapiens
aauggugcugcag

SEQ ID NO: 1641001 - RNA, 15 nt, Homo sapiens
aauggugcugcagau

SEQ ID NO: 1641002 - RNA, 14 nt, Homo sapiens
aaugguuugaauau

SEQ ID NO: 1641003 - RNA, 20 nt, Homo sapiens
aaugguuuucuaauaucuua

SEQ ID NO: 1641004 - RNA, 15 nt, Homo sapiens
aauguagaaagugau

SEQ ID NO: 1641005 - RNA, 14 nt, Homo sapiens
aauguaugugcaca

SEQ ID NO: 1641006 - RNA, 18 nt, Homo sapiens
aaugucacaguaaugcaa

SEQ ID NO: 1641007 - RNA, 18 nt, Homo sapiens
aauguccuugcuuuacaa

SEQ ID NO: 1641008 - RNA, 19 nt, Homo sapiens
aaugucuugaugcaugcac

SEQ ID NO: 1641009 - RNA, 15 nt, Homo sapiens
aaugugacucaagac

SEQ ID NO: 1641010 - RNA, 12 nt, Homo sapiens
aaugugauugca

SEQ ID NO: 1641011 - RNA, 19 nt, Homo sapiens
aauguguuuuguacaugaa

SEQ ID NO: 1641012 - RNA, 21 nt, Homo sapiens
aauguucuauuuaacaacugg

SEQ ID NO: 1641013 - RNA, 22 nt, Homo sapiens
aauguuuguuauuuacacuggu

SEQ ID NO: 1641014 - RNA, 18 nt, Homo sapiens
aauguuuuaaacauucuu

SEQ ID NO: 1641015 - RNA, 22 nt, Homo sapiens
aauuaaggguaugauuaacucu

SEQ ID NO: 1641016 - RNA, 16 nt, Homo sapiens
aauuaauuuacuagaa

SEQ ID NO: 1641017 - RNA, 23 nt, Homo sapiens
aauuaauuugugaauuugcaaca

SEQ ID NO: 1641018 - RNA, 21 nt, Homo sapiens
aauuacauaugaaaaacccuc

SEQ ID NO: 1641019 - RNA, 15 nt, Homo sapiens
aauuaguaacaugug

SEQ ID NO: 1641020 - RNA, 19 nt, Homo sapiens
aauuauaaucaaaaucaau

SEQ ID NO: 1641021 - RNA, 16 nt, Homo sapiens
caauacuuacauaucu

SEQ ID NO: 1641022 - RNA, 19 nt, Homo sapiens
caauacuuacauaucugac

SEQ ID NO: 1641023 - RNA, 19 nt, Homo sapiens
caauaguaauucucaggcc

SEQ ID NO: 1641024 - RNA, 17 nt, Homo sapiens
caauaucuuuauugcau

SEQ ID NO: 1641025 - RNA, 12 nt, Homo sapiens
caauaugcauuu

SEQ ID NO: 1641026 - RNA, 22 nt, Homo sapiens
caauauuuccauguuucauuaa

SEQ ID NO: 1641027 - RNA, 14 nt, Homo sapiens
caaucacaguguua

SEQ ID NO: 1641028 - RNA, 16 nt, Homo sapiens
caauccagcuauguua

SEQ ID NO: 1641029 - RNA, 18 nt, Homo sapiens
caauccagcuauguuaua

SEQ ID NO: 1641030 - RNA, 22 nt, Homo sapiens
caaucccugaggacugauuuca

SEQ ID NO: 1641031 - RNA, 16 nt, Homo sapiens
caaugagaucauugug

SEQ ID NO: 1641032 - RNA, 22 nt, Homo sapiens
caaugauuaggaaucauucugu

SEQ ID NO: 1641033 - RNA, 16 nt, Homo sapiens
caauggcuuacuccag

SEQ ID NO: 1641034 - RNA, 19 nt, Homo sapiens
caaugguugaugauacuuc

SEQ ID NO: 1641035 - RNA, 22 nt, Homo sapiens
caaugguuugcaaggaagccac

SEQ ID NO: 1641036 - RNA, 23 nt, Homo sapiens
caaugguuugugucaaaacuggu

SEQ ID NO: 1641037 - RNA, 19 nt, Homo sapiens
caauguuuuaaacauucuu

SEQ ID NO: 1641038 - RNA, 21 nt, Homo sapiens
caauucugauguuacugagau

SEQ ID NO: 1641039 - RNA, 15 nt, Homo sapiens
caauugggagagaaa

SEQ ID NO: 1641040 - RNA, 18 nt, Homo sapiens
cacaaaauaaccaauccu

SEQ ID NO: 1641041 - RNA, 17 nt, Homo sapiens
cacaacauuacagggaa

SEQ ID NO: 1641042 - RNA, 17 nt, Homo sapiens
cacaagaccaucuacau

SEQ ID NO: 1641043 - RNA, 13 nt, Homo sapiens
cacacacagugau

SEQ ID NO: 1641044 - RNA, 13 nt, Homo sapiens
cacacacauacac

SEQ ID NO: 1641045 - RNA, 16 nt, Homo sapiens
cacacagaggggaguc

SEQ ID NO: 1641046 - RNA, 19 nt, Homo sapiens
cacacagauuugagcucag

SEQ ID NO: 1641047 - RNA, 20 nt, Homo sapiens
cacacagauuugagcucagc

SEQ ID NO: 1641048 - RNA, 20 nt, Homo sapiens
cacacaguauuacuucugcu

SEQ ID NO: 1641049 - RNA, 16 nt, Homo sapiens
cacaccacaaauggga

SEQ ID NO: 1641050 - RNA, 17 nt, Homo sapiens
cacaccugcggcccaau

SEQ ID NO: 1641051 - RNA, 20 nt, Homo sapiens
cacagaacacagcaauuccu

SEQ ID NO: 1641052 - RNA, 16 nt, Homo sapiens
cacagaugcuguguaa

SEQ ID NO: 1641053 - RNA, 19 nt, Homo sapiens
cacagauuugagcucagcc

SEQ ID NO: 1641054 - RNA, 18 nt, Homo sapiens
cacagcuaagaugccaug

SEQ ID NO: 1641055 - RNA, 20 nt, Homo sapiens
cacagcucccauaaccgcug

SEQ ID NO: 1641056 - RNA, 20 nt, Homo sapiens
cacagcuucauuuccugugu

SEQ ID NO: 1641057 - RNA, 22 nt, Homo sapiens
cacagcuuguauuuugugaaga

SEQ ID NO: 1641058 - RNA, 14 nt, Homo sapiens
cacaggccugagau

SEQ ID NO: 1641059 - RNA, 21 nt, Homo sapiens
cacagugcccaagaguggggu

SEQ ID NO: 1641060 - RNA, 14 nt, Homo sapiens
cacaucuugcucug

SEQ ID NO: 1641061 - RNA, 18 nt, Homo sapiens
cacaugccaagcacugug

SEQ ID NO: 1641062 - RNA, 19 nt, Homo sapiens
cacaugccacuaugagcuu

SEQ ID NO: 1641063 - RNA, 17 nt, Homo sapiens
cacaugcuuuucuuccu

SEQ ID NO: 1641064 - RNA, 14 nt, Homo sapiens
cacauggacaugug

SEQ ID NO: 1641065 - RNA, 17 nt, Homo sapiens
cacaugucaguaccuuc

SEQ ID NO: 1641066 - RNA, 16 nt, Homo sapiens
cacaugugcacaugca

SEQ ID NO: 1641067 - RNA, 18 nt, Homo sapiens
cacauugccccaugagac

SEQ ID NO: 1641068 - RNA, 19 nt, Homo sapiens
cacauuuauucugcucaca

SEQ ID NO: 1641069 - RNA, 14 nt, Homo sapiens
caccaaacucuuaa

SEQ ID NO: 1641070 - RNA, 15 nt, Homo sapiens
caccaaaucaucucu

SEQ ID NO: 1641071 - RNA, 20 nt, Homo sapiens
caccaaaucaucucucauca

SEQ ID NO: 1641072 - RNA, 14 nt, Homo sapiens
caccaagcccaguu

SEQ ID NO: 1641073 - RNA, 19 nt, Homo sapiens
caccaaugaaccccaguca

SEQ ID NO: 1641074 - RNA, 23 nt, Homo sapiens
caccacagcuuauggcaucucau

SEQ ID NO: 1641075 - RNA, 15 nt, Homo sapiens
caccacaugugcaca

SEQ ID NO: 1641076 - RNA, 15 nt, Homo sapiens
caccagccagaggau

SEQ ID NO: 1641077 - RNA, 19 nt, Homo sapiens
caccagccagaggaugcau

SEQ ID NO: 1641078 - RNA, 15 nt, Homo sapiens
caccaggucagggag

SEQ ID NO: 1641079 - RNA, 16 nt, Homo sapiens
caccaguuccuuucaa

SEQ ID NO: 1641080 - RNA, 13 nt, Homo sapiens
cacccaugcaccu

SEQ ID NO: 1641081 - RNA, 22 nt, Homo sapiens
caccccuugcucucaacccagg

SEQ ID NO: 1641082 - RNA, 14 nt, Homo sapiens
cacccucuccagau

SEQ ID NO: 1641083 - RNA, 20 nt, Homo sapiens
caccuaaacccucugugaaa

SEQ ID NO: 1641084 - RNA, 22 nt, Homo sapiens
caccuaguggcuguccagugcc

SEQ ID NO: 1641085 - RNA, 12 nt, Homo sapiens
caccucaauauu

SEQ ID NO: 1641086 - RNA, 16 nt, Homo sapiens
caccucaugucauuuc

SEQ ID NO: 1641087 - RNA, 16 nt, Homo sapiens
caccugcucacugguc

SEQ ID NO: 1641088 - RNA, 23 nt, Homo sapiens
caccuggaaagcauauacuauau

SEQ ID NO: 1641089 - RNA, 19 nt, Homo sapiens
caccuuaucuauguagaau

SEQ ID NO: 1641090 - RNA, 23 nt, Homo sapiens
caccuucugacgcagccugagaa

SEQ ID NO: 1641091 - RNA, 13 nt, Homo sapiens
cacgcgugcacac

SEQ ID NO: 1641092 - RNA, 23 nt, Homo sapiens
cacggcagcugcuggcugugaca

SEQ ID NO: 1641093 - RNA, 11 nt, Homo sapiens
cacggcugcug

SEQ ID NO: 1641094 - RNA, 18 nt, Homo sapiens
cacguacacacacauaca

SEQ ID NO: 1641095 - RNA, 18 nt, Homo sapiens
cacgucuggcuucacaga

SEQ ID NO: 1641096 - RNA, 15 nt, Homo sapiens
cacuaaauccccuca

SEQ ID NO: 1641097 - RNA, 16 nt, Homo sapiens
cacuaaccacgcugga

SEQ ID NO: 1641098 - RNA, 15 nt, Homo sapiens
cacuauggugccaau

SEQ ID NO: 1641099 - RNA, 13 nt, Homo sapiens
cacuccucggcag

SEQ ID NO: 1641100 - RNA, 16 nt, Homo sapiens
cacucugaagauccca

SEQ ID NO: 1641101 - RNA, 19 nt, Homo sapiens
cacucugcucucaggagau

SEQ ID NO: 1641102 - RNA, 23 nt, Homo sapiens
cacucugcucucaggagaucugg

SEQ ID NO: 1641103 - RNA, 14 nt, Homo sapiens
cacucugugcccau

SEQ ID NO: 1641104 - RNA, 21 nt, Homo sapiens
cacugaaauggacugacugua

SEQ ID NO: 1641105 - RNA, 22 nt, Homo sapiens
cacugagacuugaaucaaguca

SEQ ID NO: 1641106 - RNA, 21 nt, Homo sapiens
cacugcaccgggccacagaga

SEQ ID NO: 1641107 - RNA, 19 nt, Homo sapiens
cacugcacuauagccuagg

SEQ ID NO: 1641108 - RNA, 23 nt, Homo sapiens
cacugcuugaggaaaacaagcau

SEQ ID NO: 1641109 - RNA, 15 nt, Homo sapiens
cacuggcugccucca

SEQ ID NO: 1641110 - RNA, 17 nt, Homo sapiens
cacugggacuugcaaaa

SEQ ID NO: 1641111 - RNA, 16 nt, Homo sapiens
cacugguauuaacuuu

SEQ ID NO: 1641112 - RNA, 24 nt, Homo sapiens
cacuggucaaaaccuacacagcug

SEQ ID NO: 1641113 - RNA, 23 nt, Homo sapiens
cacuguuaagccauguguuccaa

SEQ ID NO: 1641114 - RNA, 15 nt, Homo sapiens
cacuguuucucucac

SEQ ID NO: 1641115 - RNA, 16 nt, Homo sapiens
cacuuccguuuaccuu

SEQ ID NO: 1641116 - RNA, 22 nt, Homo sapiens
cacuugcucaugcccugccaag

SEQ ID NO: 1641117 - RNA, 18 nt, Homo sapiens
cacuugcuggcugugaaa

SEQ ID NO: 1641118 - RNA, 19 nt, Homo sapiens
cacuugcuggcugugaaac

SEQ ID NO: 1641119 - RNA, 20 nt, Homo sapiens
cacuuguucauucugugacc

SEQ ID NO: 1641120 - RNA, 19 nt, Homo sapiens
cacuuuaaagcaauugcau

SEQ ID NO: 1641121 - RNA, 23 nt, Homo sapiens
cacuuuuaauuuugucagauuca

SEQ ID NO: 1641122 - RNA, 14 nt, Homo sapiens
cagaaaaacugugg

SEQ ID NO: 1641123 - RNA, 16 nt, Homo sapiens
cagaaaauucccauga

SEQ ID NO: 1641124 - RNA, 16 nt, Homo sapiens
cagaaagcucaucuca

SEQ ID NO: 1641125 - RNA, 12 nt, Homo sapiens
cagaacugaaga

SEQ ID NO: 1641126 - RNA, 17 nt, Homo sapiens
cagaacuuuaguauuaa

SEQ ID NO: 1641127 - RNA, 16 nt, Homo sapiens
cagaaggcaaacccau

SEQ ID NO: 1641128 - RNA, 15 nt, Homo sapiens
cagaagugauuuagu

SEQ ID NO: 1641129 - RNA, 14 nt, Homo sapiens
cagaauauacuaaa

SEQ ID NO: 1641130 - RNA, 14 nt, Homo sapiens
cccagcacugagga

SEQ ID NO: 1641131 - RNA, 20 nt, Homo sapiens
cccagcagcuccuguggcca

SEQ ID NO: 1641132 - RNA, 21 nt, Homo sapiens
cccagccccuucugacccaug

SEQ ID NO: 1641133 - RNA, 23 nt, Homo sapiens
cccagcccuccuuaucaaaggac

SEQ ID NO: 1641134 - RNA, 14 nt, Homo sapiens
cccagccucuaggg

SEQ ID NO: 1641135 - RNA, 20 nt, Homo sapiens
cccagcucugguccauagag

SEQ ID NO: 1641136 - RNA, 22 nt, Homo sapiens
cccaggagccggacacuucuca

SEQ ID NO: 1641137 - RNA, 15 nt, Homo sapiens
cccaggcaugcaaug

SEQ ID NO: 1641138 - RNA, 19 nt, Homo sapiens
cccaggccaggacucugca

SEQ ID NO: 1641139 - RNA, 20 nt, Homo sapiens
cccaggcuggagugcagugg

SEQ ID NO: 1641140 - RNA, 17 nt, Homo sapiens
cccagggcagccaggga

SEQ ID NO: 1641141 - RNA, 23 nt, Homo sapiens
cccagguuucuggucucuaggcu

SEQ ID NO: 1641142 - RNA, 19 nt, Homo sapiens
cccagucuggaaugcagug

SEQ ID NO: 1641143 - RNA, 10 nt, Homo sapiens
cccagugugu

SEQ ID NO: 1641144 - RNA, 14 nt, Homo sapiens
cccaguguguuucu

SEQ ID NO: 1641145 - RNA, 12 nt, Homo sapiens
cccaucuugaua

SEQ ID NO: 1641146 - RNA, 14 nt, Homo sapiens
cccauugucuuuac

SEQ ID NO: 1641147 - RNA, 14 nt, Homo sapiens
ccccaauccaugaa

SEQ ID NO: 1641148 - RNA, 14 nt, Homo sapiens
ccccaaucccucaa

SEQ ID NO: 1641149 - RNA, 15 nt, Homo sapiens
ccccaggcauugcca

SEQ ID NO: 1641150 - RNA, 23 nt, Homo sapiens
cccccauaaaagauauguugaag

SEQ ID NO: 1641151 - RNA, 20 nt, Homo sapiens
cccccugacauuaucuugga

SEQ ID NO: 1641152 - RNA, 18 nt, Homo sapiens
ccccgcccaggcuggcca

SEQ ID NO: 1641153 - RNA, 13 nt, Homo sapiens
ccccuaacaaaga

SEQ ID NO: 1641154 - RNA, 16 nt, Homo sapiens
ccccucccugcuucaa

SEQ ID NO: 1641155 - RNA, 16 nt, Homo sapiens
ccccuccuccacucuc

SEQ ID NO: 1641156 - RNA, 16 nt, Homo sapiens
ccccuucucucaucuc

SEQ ID NO: 1641157 - RNA, 20 nt, Homo sapiens
cccggagggaaacugugaau

SEQ ID NO: 1641158 - RNA, 15 nt, Homo sapiens
cccuacucuguguaa

SEQ ID NO: 1641159 - RNA, 16 nt, Homo sapiens
cccuacucuguguaau

SEQ ID NO: 1641160 - RNA, 17 nt, Homo sapiens
cccuagucuuuuaaaca

SEQ ID NO: 1641161 - RNA, 19 nt, Homo sapiens
cccuauugguaaagaaugg

SEQ ID NO: 1641162 - RNA, 24 nt, Homo sapiens
cccucaaggccucccacagugacu

SEQ ID NO: 1641163 - RNA, 20 nt, Homo sapiens
cccucacugggacuuuguaa

SEQ ID NO: 1641164 - RNA, 13 nt, Homo sapiens
cccucaucaggag

SEQ ID NO: 1641165 - RNA, 16 nt, Homo sapiens
cccugaagucuugcau

SEQ ID NO: 1641166 - RNA, 18 nt, Homo sapiens
cccugacauuaucuugga

SEQ ID NO: 1641167 - RNA, 14 nt, Homo sapiens
cccugcaaagccca

SEQ ID NO: 1641168 - RNA, 21 nt, Homo sapiens
cccugcaaagcccagcuugaa

SEQ ID NO: 1641169 - RNA, 13 nt, Homo sapiens
cccugcccggcug

SEQ ID NO: 1641170 - RNA, 14 nt, Homo sapiens
cccugccuaaggaa

SEQ ID NO: 1641171 - RNA, 17 nt, Homo sapiens
cccugucuaaaaauuca

SEQ ID NO: 1641172 - RNA, 22 nt, Homo sapiens
cccuuaucccugcucuggauuu

SEQ ID NO: 1641173 - RNA, 16 nt, Homo sapiens
cccuucaugcauggaa

SEQ ID NO: 1641174 - RNA, 21 nt, Homo sapiens
cccuucuucacacagacacua

SEQ ID NO: 1641175 - RNA, 16 nt, Homo sapiens
cccuucuuuucugacu

SEQ ID NO: 1641176 - RNA, 19 nt, Homo sapiens
cccuuggggccuaugcaga

SEQ ID NO: 1641177 - RNA, 12 nt, Homo sapiens
ccgagaagaaca

SEQ ID NO: 1641178 - RNA, 17 nt, Homo sapiens
ccgagccuggcuccaaa

SEQ ID NO: 1641179 - RNA, 12 nt, Homo sapiens
ccgauaccaugc

SEQ ID NO: 1641180 - RNA, 16 nt, Homo sapiens
ccgaucuccacuguug

SEQ ID NO: 1641181 - RNA, 12 nt, Homo sapiens
ccgcacaccucu

SEQ ID NO: 1641182 - RNA, 19 nt, Homo sapiens
ccgcaccaauaaagccuuc

SEQ ID NO: 1641183 - RNA, 14 nt, Homo sapiens
ccggacacuucuca

SEQ ID NO: 1641184 - RNA, 18 nt, Homo sapiens
ccggccaggugggcgggc

SEQ ID NO: 1641185 - RNA, 12 nt, Homo sapiens
ccggcugcgugg

SEQ ID NO: 1641186 - RNA, 20 nt, Homo sapiens
ccgggaagagggugauugcu

SEQ ID NO: 1641187 - RNA, 14 nt, Homo sapiens
ccgggcucagggac

SEQ ID NO: 1641188 - RNA, 22 nt, Homo sapiens
ccuaaaucaaguuggcuucuaa

SEQ ID NO: 1641189 - RNA, 18 nt, Homo sapiens
ccuaagcagaccacugau

SEQ ID NO: 1641190 - RNA, 23 nt, Homo sapiens
ccuaagccaugggagacacugau

SEQ ID NO: 1641191 - RNA, 18 nt, Homo sapiens
ccuaaugaaugcauaaaa

SEQ ID NO: 1641192 - RNA, 16 nt, Homo sapiens
ccuaaugcugcagauu

SEQ ID NO: 1641193 - RNA, 18 nt, Homo sapiens
ccuaauuccacagcugcu

SEQ ID NO: 1641194 - RNA, 21 nt, Homo sapiens
ccuaauuccacagcugcucaa

SEQ ID NO: 1641195 - RNA, 22 nt, Homo sapiens
ccuacagugcuguguacccugg

SEQ ID NO: 1641196 - RNA, 19 nt, Homo sapiens
ccuacauacgucuuucaca

SEQ ID NO: 1641197 - RNA, 13 nt, Homo sapiens
ccuaccugacugc

SEQ ID NO: 1641198 - RNA, 17 nt, Homo sapiens
ccuacgugacaacacaa

SEQ ID NO: 1641199 - RNA, 18 nt, Homo sapiens
ccuacucuuccaucuuuc

SEQ ID NO: 1641200 - RNA, 18 nt, Homo sapiens
ccuacugcuuccucugaa

SEQ ID NO: 1641201 - RNA, 21 nt, Homo sapiens
ccuagccuuagaagucacaca

SEQ ID NO: 1641202 - RNA, 18 nt, Homo sapiens
ccuagcggaguuccagca

SEQ ID NO: 1641203 - RNA, 14 nt, Homo sapiens
ccuagcugugucag

SEQ ID NO: 1641204 - RNA, 19 nt, Homo sapiens
ccuagggccacugaagaua

SEQ ID NO: 1641205 - RNA, 17 nt, Homo sapiens
ccuaucugacuucauac

SEQ ID NO: 1641206 - RNA, 13 nt, Homo sapiens
ccucaaacacugc

SEQ ID NO: 1641207 - RNA, 17 nt, Homo sapiens
ccucaaagcauuugcaa

SEQ ID NO: 1641208 - RNA, 23 nt, Homo sapiens
ccucacacugggacuugcaaaaa

SEQ ID NO: 1641209 - RNA, 12 nt, Homo sapiens
ccucagauuccg

SEQ ID NO: 1641210 - RNA, 10 nt, Homo sapiens
ccucagggcu

SEQ ID NO: 1641211 - RNA, 23 nt, Homo sapiens
ccucagggucccugguggcagcu

SEQ ID NO: 1641212 - RNA, 21 nt, Homo sapiens
ccucaguaagacgacaaggaa

SEQ ID NO: 1641213 - RNA, 17 nt, Homo sapiens
ccucagucucccagcua

SEQ ID NO: 1641214 - RNA, 17 nt, Homo sapiens
ccucauaugcaugcccu

SEQ ID NO: 1641215 - RNA, 18 nt, Homo sapiens
ccucaucccgagcaccuc

SEQ ID NO: 1641216 - RNA, 13 nt, Homo sapiens
ccucaugucauuu

SEQ ID NO: 1641217 - RNA, 15 nt, Homo sapiens
ccuccaggugcacaa

SEQ ID NO: 1641218 - RNA, 19 nt, Homo sapiens
ccuccaugucuaugcuccc

SEQ ID NO: 1641219 - RNA, 18 nt, Homo sapiens
ccucccacugccaaagaa

SEQ ID NO: 1641220 - RNA, 23 nt, Homo sapiens
ccuccccaaggagacacaacaac

SEQ ID NO: 1641221 - RNA, 23 nt, Homo sapiens
ccuccccggagccggcacugcau

SEQ ID NO: 1641222 - RNA, 20 nt, Homo sapiens
ccuccccuggggacagcaag

SEQ ID NO: 1641223 - RNA, 13 nt, Homo sapiens
ccucccugcuuca

SEQ ID NO: 1641224 - RNA, 21 nt, Homo sapiens
ccuccugaguagcugggauua

SEQ ID NO: 1641225 - RNA, 12 nt, Homo sapiens
ccucgauguccu

SEQ ID NO: 1641226 - RNA, 13 nt, Homo sapiens
ccucuccagcuau

SEQ ID NO: 1641227 - RNA, 14 nt, Homo sapiens
ccucugcuuaaaaa

SEQ ID NO: 1641228 - RNA, 17 nt, Homo sapiens
ccucuggguaggaauca

SEQ ID NO: 1641229 - RNA, 16 nt, Homo sapiens
ccucuuuuccccauga

SEQ ID NO: 1641230 - RNA, 15 nt, Homo sapiens
ccugaacucugcaac

SEQ ID NO: 1641231 - RNA, 17 nt, Homo sapiens
ccugacuccuucugcca

SEQ ID NO: 1641232 - RNA, 14 nt, Homo sapiens
ccugagauuuacac

SEQ ID NO: 1641233 - RNA, 18 nt, Homo sapiens
ccugaggacugauuucag

SEQ ID NO: 1641234 - RNA, 19 nt, Homo sapiens
ccugaggcaagccauggag

SEQ ID NO: 1641235 - RNA, 20 nt, Homo sapiens
ccugaggcaagccauggagu

SEQ ID NO: 1641236 - RNA, 12 nt, Homo sapiens
ccugaucaccug

SEQ ID NO: 1641237 - RNA, 21 nt, Homo sapiens
ccugaucagagccgugguccu

SEQ ID NO: 1641238 - RNA, 20 nt, Homo sapiens
ccugauccaaguuuacucaa

SEQ ID NO: 1641239 - RNA, 18 nt, Homo sapiens
ccugcaaaaacagaggug

SEQ ID NO: 1641240 - RNA, 13 nt, Homo sapiens
cugucacccaggc

SEQ ID NO: 1641241 - RNA, 15 nt, Homo sapiens
cuguccagugcccau

SEQ ID NO: 1641242 - RNA, 19 nt, Homo sapiens
cugucuaugaacuugcaaa

SEQ ID NO: 1641243 - RNA, 19 nt, Homo sapiens
cugucucaugugugcucuu

SEQ ID NO: 1641244 - RNA, 17 nt, Homo sapiens
cugugauucgguggaga

SEQ ID NO: 1641245 - RNA, 18 nt, Homo sapiens
cugugcccucagauuccg

SEQ ID NO: 1641246 - RNA, 15 nt, Homo sapiens
cuguggccaaguucu

SEQ ID NO: 1641247 - RNA, 20 nt, Homo sapiens
cugugggggaagagcacagc

SEQ ID NO: 1641248 - RNA, 23 nt, Homo sapiens
cuguggugugucccccucugucc

SEQ ID NO: 1641249 - RNA, 20 nt, Homo sapiens
cugugucuugcaauggcagc

SEQ ID NO: 1641250 - RNA, 20 nt, Homo sapiens
cugugucuuuuuucacuaca

SEQ ID NO: 1641251 - RNA, 15 nt, Homo sapiens
cugugugaacgugua

SEQ ID NO: 1641252 - RNA, 19 nt, Homo sapiens
cugugugaacguguaugua

SEQ ID NO: 1641253 - RNA, 15 nt, Homo sapiens
cuguuaacuaugaca

SEQ ID NO: 1641254 - RNA, 16 nt, Homo sapiens
cuguuaucuucacuuu

SEQ ID NO: 1641255 - RNA, 22 nt, Homo sapiens
cuguucuauucaucucaaggaa

SEQ ID NO: 1641256 - RNA, 17 nt, Homo sapiens
cuguucucugcccucca

SEQ ID NO: 1641257 - RNA, 14 nt, Homo sapiens
cuguugcugccuca

SEQ ID NO: 1641258 - RNA, 14 nt, Homo sapiens
cuguuugcuugugu

SEQ ID NO: 1641259 - RNA, 15 nt, Homo sapiens
cuguuugucuucucc

SEQ ID NO: 1641260 - RNA, 21 nt, Homo sapiens
cuguuuuucucuaaugcuuga

SEQ ID NO: 1641261 - RNA, 13 nt, Homo sapiens
cuuaaacuuucaa

SEQ ID NO: 1641262 - RNA, 13 nt, Homo sapiens
cuuaacacugagc

SEQ ID NO: 1641263 - RNA, 15 nt, Homo sapiens
cuuaacucaccauaa

SEQ ID NO: 1641264 - RNA, 16 nt, Homo sapiens
cuuaagcuaagacuga

SEQ ID NO: 1641265 - RNA, 14 nt, Homo sapiens
cuuacacauuccau

SEQ ID NO: 1641266 - RNA, 14 nt, Homo sapiens
cuuacauaucugac

SEQ ID NO: 1641267 - RNA, 15 nt, Homo sapiens
cuuacauaucugacu

SEQ ID NO: 1641268 - RNA, 23 nt, Homo sapiens
cuuaccagcagagcaccuuagac

SEQ ID NO: 1641269 - RNA, 19 nt, Homo sapiens
cuuaccagggucuuugcag

SEQ ID NO: 1641270 - RNA, 21 nt, Homo sapiens
cuuacuaaaaaguauaaaaua

SEQ ID NO: 1641271 - RNA, 12 nt, Homo sapiens
cuuacuuuccca

SEQ ID NO: 1641272 - RNA, 21 nt, Homo sapiens
cuuagaccaagggaugggacc

SEQ ID NO: 1641273 - RNA, 20 nt, Homo sapiens
cuuauaauuuaaaauaugcu

SEQ ID NO: 1641274 - RNA, 14 nt, Homo sapiens
cuuauacaccuuau

SEQ ID NO: 1641275 - RNA, 18 nt, Homo sapiens
cuuauauucauccaugcc

SEQ ID NO: 1641276 - RNA, 19 nt, Homo sapiens
cuuaucuuucuaaaacugc

SEQ ID NO: 1641277 - RNA, 15 nt, Homo sapiens
cuuaugaaacuaaga

SEQ ID NO: 1641278 - RNA, 13 nt, Homo sapiens
cuuauguguugca

SEQ ID NO: 1641279 - RNA, 20 nt, Homo sapiens
cuuauucaguucuuacacau

SEQ ID NO: 1641280 - RNA, 14 nt, Homo sapiens
cuuauugacuauua

SEQ ID NO: 1641281 - RNA, 22 nt, Homo sapiens
cuucacagcuaagaugccaugu

SEQ ID NO: 1641282 - RNA, 17 nt, Homo sapiens
cuucacaguacccaaac

SEQ ID NO: 1641283 - RNA, 11 nt, Homo sapiens
cuucaccucag

SEQ ID NO: 1641284 - RNA, 17 nt, Homo sapiens
cuucacucaaucucuga

SEQ ID NO: 1641285 - RNA, 19 nt, Homo sapiens
cuucacuccccuaucccau

SEQ ID NO: 1641286 - RNA, 23 nt, Homo sapiens
cuucacuccccuaucccauucuc

SEQ ID NO: 1641287 - RNA, 20 nt, Homo sapiens
cuucacucugcucucaggag

SEQ ID NO: 1641288 - RNA, 16 nt, Homo sapiens
cuucagaauaucuuaa

SEQ ID NO: 1641289 - RNA, 18 nt, Homo sapiens
cuucaguacucaaauuca

SEQ ID NO: 1641290 - RNA, 22 nt, Homo sapiens
cuucauagaauacucagggaaa

SEQ ID NO: 1641291 - RNA, 21 nt, Homo sapiens
cuucaugguccgccugccuca

SEQ ID NO: 1641292 - RNA, 19 nt, Homo sapiens
cuuccaccucagucuccca

SEQ ID NO: 1641293 - RNA, 15 nt, Homo sapiens
cuuccacuccaagug

SEQ ID NO: 1641294 - RNA, 15 nt, Homo sapiens
cuuccagcacugacu

SEQ ID NO: 1641295 - RNA, 23 nt, Homo sapiens
cuuccagguggggugaggcagug

SEQ ID NO: 1641296 - RNA, 18 nt, Homo sapiens
cuuccauuugcaagggaa

SEQ ID NO: 1641297 - RNA, 21 nt, Homo sapiens
cuucccaaauagcagcacagc

SEQ ID NO: 1641298 - RNA, 21 nt, Homo sapiens
cuucccaguggcugcugccca

SEQ ID NO: 1641299 - RNA, 13 nt, Homo sapiens
cuucccugacacu

SEQ ID NO: 1641300 - RNA, 15 nt, Homo sapiens
cuucccuuaccucaa

SEQ ID NO: 1641301 - RNA, 16 nt, Homo sapiens
cuucccuuaccucaaa

SEQ ID NO: 1641302 - RNA, 16 nt, Homo sapiens
cuuccuauaauuuuag

SEQ ID NO: 1641303 - RNA, 21 nt, Homo sapiens
cuucgggaagaaggggacaau

SEQ ID NO: 1641304 - RNA, 14 nt, Homo sapiens
cuucuaaucaaagc

SEQ ID NO: 1641305 - RNA, 21 nt, Homo sapiens
cuucuacuacccccacagacc

SEQ ID NO: 1641306 - RNA, 12 nt, Homo sapiens
cuucucauuucu

SEQ ID NO: 1641307 - RNA, 17 nt, Homo sapiens
cuucucccccccggggc

SEQ ID NO: 1641308 - RNA, 19 nt, Homo sapiens
cuucucugagucagcugac

SEQ ID NO: 1641309 - RNA, 15 nt, Homo sapiens
cuucugacgcagccu

SEQ ID NO: 1641310 - RNA, 20 nt, Homo sapiens
cuucugacgcagccugagaa

SEQ ID NO: 1641311 - RNA, 22 nt, Homo sapiens
cuucugacuuaagugugcaaaa

SEQ ID NO: 1641312 - RNA, 15 nt, Homo sapiens
cuucugauacgugua

SEQ ID NO: 1641313 - RNA, 16 nt, Homo sapiens
cuucugauacguguau

SEQ ID NO: 1641314 - RNA, 14 nt, Homo sapiens
cuucugaucuccaa

SEQ ID NO: 1641315 - RNA, 15 nt, Homo sapiens
cuucugaucuccaaa

SEQ ID NO: 1641316 - RNA, 19 nt, Homo sapiens
cuucugcaucuuacaguca

SEQ ID NO: 1641317 - RNA, 19 nt, Homo sapiens
cuucugcuuaaucugagaa

SEQ ID NO: 1641318 - RNA, 15 nt, Homo sapiens
cuucuguccuacucu

SEQ ID NO: 1641319 - RNA, 19 nt, Homo sapiens
cuucuuaaucuuuucacaa

SEQ ID NO: 1641320 - RNA, 21 nt, Homo sapiens
cuucuuaaucuuuucacaaau

SEQ ID NO: 1641321 - RNA, 21 nt, Homo sapiens
cuucuucaagauuuauggaaa

SEQ ID NO: 1641322 - RNA, 13 nt, Homo sapiens
cuucuuucacuca

SEQ ID NO: 1641323 - RNA, 18 nt, Homo sapiens
cuucuuucuacaguauua

SEQ ID NO: 1641324 - RNA, 19 nt, Homo sapiens
cuucuuugauaauguuaaa

SEQ ID NO: 1641325 - RNA, 13 nt, Homo sapiens
cuugaauuguagg

SEQ ID NO: 1641326 - RNA, 17 nt, Homo sapiens
cuugacagaacacuguc

SEQ ID NO: 1641327 - RNA, 14 nt, Homo sapiens
cuugacagggcaca

SEQ ID NO: 1641328 - RNA, 20 nt, Homo sapiens
cuugaccucaggugauccac

SEQ ID NO: 1641329 - RNA, 19 nt, Homo sapiens
cuugauaaaaaauuuauua

SEQ ID NO: 1641330 - RNA, 21 nt, Homo sapiens
cuugauaagaccaccaccuca

SEQ ID NO: 1641331 - RNA, 23 nt, Homo sapiens
cuugaucaacaucuuuucuugcc

SEQ ID NO: 1641332 - RNA, 20 nt, Homo sapiens
cuugaugccaguaggcucaa

SEQ ID NO: 1641333 - RNA, 21 nt, Homo sapiens
cuugauugugggauacuauuu

SEQ ID NO: 1641334 - RNA, 18 nt, Homo sapiens
cuugccaaauauaaauaa

SEQ ID NO: 1641335 - RNA, 16 nt, Homo sapiens
cuugccgucuaccuga

SEQ ID NO: 1641336 - RNA, 14 nt, Homo sapiens
cuugccuaucugac

SEQ ID NO: 1641337 - RNA, 15 nt, Homo sapiens
cuugcuggcugugaa

SEQ ID NO: 1641338 - RNA, 23 nt, Homo sapiens
cuuggaauccuggggaacauaga

SEQ ID NO: 1641339 - RNA, 17 nt, Homo sapiens
cuuggcuacacagggau

SEQ ID NO: 1641340 - RNA, 15 nt, Homo sapiens
cuuggggcaugaccc

SEQ ID NO: 1641341 - RNA, 23 nt, Homo sapiens
cuuguaaaugugguaaagaguua

SEQ ID NO: 1641342 - RNA, 21 nt, Homo sapiens
cuugugucuuuagugcuccaa

SEQ ID NO: 1641343 - RNA, 13 nt, Homo sapiens
cuuguucauucug

SEQ ID NO: 1641344 - RNA, 16 nt, Homo sapiens
cuuguucauucuguga

SEQ ID NO: 1641345 - RNA, 24 nt, Homo sapiens
cuuguuccccaucaucuguggaac

SEQ ID NO: 1641346 - RNA, 20 nt, Homo sapiens
cuuuaaaaauaugcaccaaa

SEQ ID NO: 1641347 - RNA, 21 nt, Homo sapiens
cuuuaagugcacaacauuaca

SEQ ID NO: 1641348 - RNA, 15 nt, Homo sapiens
cuuuauaaaauuuac

SEQ ID NO: 1641349 - RNA, 20 nt, Homo sapiens
gcauacgguaugauauugca

SEQ ID NO: 1641350 - RNA, 22 nt, Homo sapiens
gcaucauaguuugcuuuguuua

SEQ ID NO: 1641351 - RNA, 18 nt, Homo sapiens
gcauccuggcacccggcc

SEQ ID NO: 1641352 - RNA, 21 nt, Homo sapiens
gcaucucauugaggacaaaga

SEQ ID NO: 1641353 - RNA, 15 nt, Homo sapiens
gcaucuccagcauuc

SEQ ID NO: 1641354 - RNA, 16 nt, Homo sapiens
gcaucugcuacugugu

SEQ ID NO: 1641355 - RNA, 14 nt, Homo sapiens
gcauggaguguuug

SEQ ID NO: 1641356 - RNA, 17 nt, Homo sapiens
gcaugugugaaacauac

SEQ ID NO: 1641357 - RNA, 16 nt, Homo sapiens
gcauguuuuccagcuc

SEQ ID NO: 1641358 - RNA, 22 nt, Homo sapiens
gcauuaucuaugauaugcuaau

SEQ ID NO: 1641359 - RNA, 20 nt, Homo sapiens
gcauugccuuuagugaucac

SEQ ID NO: 1641360 - RNA, 20 nt, Homo sapiens
gcauuuagacccugcauuua

SEQ ID NO: 1641361 - RNA, 15 nt, Homo sapiens
gcauuuggcauuuau

SEQ ID NO: 1641362 - RNA, 16 nt, Homo sapiens
gcauuugucaacaaag

SEQ ID NO: 1641363 - RNA, 21 nt, Homo sapiens
gcauuuuccagcacuuugcaa

SEQ ID NO: 1641364 - RNA, 23 nt, Homo sapiens
gccaaaauaaugcaccacuuuua

SEQ ID NO: 1641365 - RNA, 15 nt, Homo sapiens
gccaagcagugccca

SEQ ID NO: 1641366 - RNA, 20 nt, Homo sapiens
gccaagcccaauacagccau

SEQ ID NO: 1641367 - RNA, 23 nt, Homo sapiens
gccaaggaagucugugucuacca

SEQ ID NO: 1641368 - RNA, 12 nt, Homo sapiens
gccaagggauga

SEQ ID NO: 1641369 - RNA, 15 nt, Homo sapiens
gccaagucauuugag

SEQ ID NO: 1641370 - RNA, 18 nt, Homo sapiens
gccaauaacacacagcua

SEQ ID NO: 1641371 - RNA, 12 nt, Homo sapiens
gccacagcagcu

SEQ ID NO: 1641372 - RNA, 16 nt, Homo sapiens
gccacagcagcuuugu

SEQ ID NO: 1641373 - RNA, 19 nt, Homo sapiens
gccacccucccacugccaa

SEQ ID NO: 1641374 - RNA, 21 nt, Homo sapiens
gccacuggacugucuaugaac

SEQ ID NO: 1641375 - RNA, 14 nt, Homo sapiens
gccagcaucugccu

SEQ ID NO: 1641376 - RNA, 22 nt, Homo sapiens
gccaggaaucacuggcuguuaa

SEQ ID NO: 1641377 - RNA, 17 nt, Homo sapiens
gccaggauuggggaccu

SEQ ID NO: 1641378 - RNA, 21 nt, Homo sapiens
gccaguuggucccccuuccau

SEQ ID NO: 1641379 - RNA, 18 nt, Homo sapiens
gccauccucaaacacugc

SEQ ID NO: 1641380 - RNA, 18 nt, Homo sapiens
gccaugggccuccugugu

SEQ ID NO: 1641381 - RNA, 18 nt, Homo sapiens
gccaugggggcaacagcc

SEQ ID NO: 1641382 - RNA, 22 nt, Homo sapiens
gcccagacccuucuccuuagaa

SEQ ID NO: 1641383 - RNA, 18 nt, Homo sapiens
gcccaggcuggagugcaa

SEQ ID NO: 1641384 - RNA, 13 nt, Homo sapiens
gccccagacucca

SEQ ID NO: 1641385 - RNA, 21 nt, Homo sapiens
gccccucuccuccguggcaca

SEQ ID NO: 1641386 - RNA, 11 nt, Homo sapiens
gcccuaaugcg

SEQ ID NO: 1641387 - RNA, 21 nt, Homo sapiens
gcccucaccccugguucucau

SEQ ID NO: 1641388 - RNA, 16 nt, Homo sapiens
gcccuccaguguauga

SEQ ID NO: 1641389 - RNA, 16 nt, Homo sapiens
gcccugccaugcucuc

SEQ ID NO: 1641390 - RNA, 12 nt, Homo sapiens
gcccugcugagu

SEQ ID NO: 1641391 - RNA, 13 nt, Homo sapiens
gcccuggcaccug

SEQ ID NO: 1641392 - RNA, 23 nt, Homo sapiens
gcccugugcccccugaaacagcu

SEQ ID NO: 1641393 - RNA, 23 nt, Homo sapiens
gcccugugggcccccaaauggaa

SEQ ID NO: 1641394 - RNA, 15 nt, Homo sapiens
gcccuucaugcauuu

SEQ ID NO: 1641395 - RNA, 16 nt, Homo sapiens
gcccuugcuccagccu

SEQ ID NO: 1641396 - RNA, 19 nt, Homo sapiens
gcccuugcuccagccugac

SEQ ID NO: 1641397 - RNA, 14 nt, Homo sapiens
gccgcagacaugaa

SEQ ID NO: 1641398 - RNA, 22 nt, Homo sapiens
gccggggaaggaggccguccau

SEQ ID NO: 1641399 - RNA, 15 nt, Homo sapiens
gccuaagcggcuguu

SEQ ID NO: 1641400 - RNA, 20 nt, Homo sapiens
gccuccaaguccacagugga

SEQ ID NO: 1641401 - RNA, 19 nt, Homo sapiens
gccuccacucccacuuccc

SEQ ID NO: 1641402 - RNA, 16 nt, Homo sapiens
gccuccucacaacaug

SEQ ID NO: 1641403 - RNA, 20 nt, Homo sapiens
gccuccuccagaauggagcu

SEQ ID NO: 1641404 - RNA, 13 nt, Homo sapiens
gccucucugacau

SEQ ID NO: 1641405 - RNA, 20 nt, Homo sapiens
gccucucugcuccaccuugu

SEQ ID NO: 1641406 - RNA, 14 nt, Homo sapiens
gccucugaagccua

SEQ ID NO: 1641407 - RNA, 15 nt, Homo sapiens
gccugaagucacaca

SEQ ID NO: 1641408 - RNA, 18 nt, Homo sapiens
gccugauaggacccauau

SEQ ID NO: 1641409 - RNA, 16 nt, Homo sapiens
gccugccuucucaggg

SEQ ID NO: 1641410 - RNA, 21 nt, Homo sapiens
gccuucccuaaaaucagggaa

SEQ ID NO: 1641411 - RNA, 12 nt, Homo sapiens
gccuucucaggg

SEQ ID NO: 1641412 - RNA, 19 nt, Homo sapiens
gccuucucccccccggggc

SEQ ID NO: 1641413 - RNA, 22 nt, Homo sapiens
gccuuuaaaaaugcaccacuuu

SEQ ID NO: 1641414 - RNA, 14 nt, Homo sapiens
gcgccccagacucc

SEQ ID NO: 1641415 - RNA, 17 nt, Homo sapiens
gcgucugugugugccug

SEQ ID NO: 1641416 - RNA, 12 nt, Homo sapiens
gcgugcacacac

SEQ ID NO: 1641417 - RNA, 15 nt, Homo sapiens
gcuaacccccaaaua

SEQ ID NO: 1641418 - RNA, 14 nt, Homo sapiens
gcuaagacugaugu

SEQ ID NO: 1641419 - RNA, 14 nt, Homo sapiens
gcuacacugacacu

SEQ ID NO: 1641420 - RNA, 16 nt, Homo sapiens
gcuaccucuccagccu

SEQ ID NO: 1641421 - RNA, 11 nt, Homo sapiens
gcuagaaccua

SEQ ID NO: 1641422 - RNA, 23 nt, Homo sapiens
gcuaggaaauccagggugguggu

SEQ ID NO: 1641423 - RNA, 18 nt, Homo sapiens
gcuaggaacacuccuuca

SEQ ID NO: 1641424 - RNA, 13 nt, Homo sapiens
gcuaugcuauuga

SEQ ID NO: 1641425 - RNA, 22 nt, Homo sapiens
gcuaugugaagaguaagucaac

SEQ ID NO: 1641426 - RNA, 15 nt, Homo sapiens
gcuauucuccaugua

SEQ ID NO: 1641427 - RNA, 17 nt, Homo sapiens
gcucacguguauucuau

SEQ ID NO: 1641428 - RNA, 13 nt, Homo sapiens
gcucacuguucua

SEQ ID NO: 1641429 - RNA, 20 nt, Homo sapiens
gcucaggugucccugcacuu

SEQ ID NO: 1641430 - RNA, 18 nt, Homo sapiens
gcucauauuguucccuau

SEQ ID NO: 1641431 - RNA, 13 nt, Homo sapiens
gcucaucauucuc

SEQ ID NO: 1641432 - RNA, 22 nt, Homo sapiens
gcuccaaaacuggaccaccaga

SEQ ID NO: 1641433 - RNA, 22 nt, Homo sapiens
gcuccacaccuccaaugcugcc

SEQ ID NO: 1641434 - RNA, 22 nt, Homo sapiens
gcuccacuuucagugaaagcau

SEQ ID NO: 1641435 - RNA, 20 nt, Homo sapiens
gcuccaucgcugucaucuca

SEQ ID NO: 1641436 - RNA, 17 nt, Homo sapiens
gcuccauucaaagugag

SEQ ID NO: 1641437 - RNA, 18 nt, Homo sapiens
gcucccuuuuaagccagg

SEQ ID NO: 1641438 - RNA, 14 nt, Homo sapiens
gcuccuaagccaug

SEQ ID NO: 1641439 - RNA, 13 nt, Homo sapiens
gcuccugcuccac

SEQ ID NO: 1641440 - RNA, 13 nt, Homo sapiens
gcucgucauacag

SEQ ID NO: 1641441 - RNA, 14 nt, Homo sapiens
gcucucaacccagg

SEQ ID NO: 1641442 - RNA, 14 nt, Homo sapiens
gcucugagcuguca

SEQ ID NO: 1641443 - RNA, 14 nt, Homo sapiens
gcucugccucccau

SEQ ID NO: 1641444 - RNA, 14 nt, Homo sapiens
gcucuggacaggca

SEQ ID NO: 1641445 - RNA, 16 nt, Homo sapiens
gcucugggguccucac

SEQ ID NO: 1641446 - RNA, 20 nt, Homo sapiens
gcugaaaacugcaacuugua

SEQ ID NO: 1641447 - RNA, 14 nt, Homo sapiens
gcugagaacacugu

SEQ ID NO: 1641448 - RNA, 16 nt, Homo sapiens
gcugagccucagucuc

SEQ ID NO: 1641449 - RNA, 18 nt, Homo sapiens
gcugaguugguguugaca

SEQ ID NO: 1641450 - RNA, 18 nt, Homo sapiens
gcugccagcucuguauca

SEQ ID NO: 1641451 - RNA, 22 nt, Homo sapiens
gcugccuccacucccacuuccc

SEQ ID NO: 1641452 - RNA, 14 nt, Homo sapiens
gcugcucugugguc

SEQ ID NO: 1641453 - RNA, 16 nt, Homo sapiens
gcugcuggcugugaca

SEQ ID NO: 1641454 - RNA, 15 nt, Homo sapiens
gcuggaauuaugcug

SEQ ID NO: 1641455 - RNA, 15 nt, Homo sapiens
gcuggagugcaguga

SEQ ID NO: 1641456 - RNA, 14 nt, Homo sapiens
gcuggcgugcagug

SEQ ID NO: 1641457 - RNA, 20 nt, Homo sapiens
gcuggcgugcaguggugcga

SEQ ID NO: 1641458 - RNA, 15 nt, Homo sapiens
gcugggcuucagugg

SEQ ID NO: 1641459 - RNA, 11 nt, Homo sapiens
ugggugacaaa

SEQ ID NO: 1641460 - RNA, 20 nt, Homo sapiens
ugggugucaagagggucuga

SEQ ID NO: 1641461 - RNA, 21 nt, Homo sapiens
uggguuagggaaaacauucca

SEQ ID NO: 1641462 - RNA, 16 nt, Homo sapiens
uggguucacaccauuc

SEQ ID NO: 1641463 - RNA, 17 nt, Homo sapiens
ugguaaaauacauauaa

SEQ ID NO: 1641464 - RNA, 21 nt, Homo sapiens
ugguaguuuuacaguguuucu

SEQ ID NO: 1641465 - RNA, 19 nt, Homo sapiens
ugguaucuaauucuuuaau

SEQ ID NO: 1641466 - RNA, 16 nt, Homo sapiens
uggucaaaaccuacac

SEQ ID NO: 1641467 - RNA, 20 nt, Homo sapiens
ugguccaugggccauaugaa

SEQ ID NO: 1641468 - RNA, 13 nt, Homo sapiens
uggucugacccac

SEQ ID NO: 1641469 - RNA, 14 nt, Homo sapiens
uggugcuaauauga

SEQ ID NO: 1641470 - RNA, 22 nt, Homo sapiens
ugguggagccaguaaacagagg

SEQ ID NO: 1641471 - RNA, 21 nt, Homo sapiens
ugguguaguuucugcauuuca

SEQ ID NO: 1641472 - RNA, 17 nt, Homo sapiens
ugguguugacaugugcu

SEQ ID NO: 1641473 - RNA, 19 nt, Homo sapiens
ugguucccccacugaucac

SEQ ID NO: 1641474 - RNA, 20 nt, Homo sapiens
ugguucugaugaugugccug

SEQ ID NO: 1641475 - RNA, 19 nt, Homo sapiens
ugguuucaauaaaccuaau

SEQ ID NO: 1641476 - RNA, 15 nt, Homo sapiens
ugguuuccuauuucc

SEQ ID NO: 1641477 - RNA, 15 nt, Homo sapiens
ugguuugugucaaaa

SEQ ID NO: 1641478 - RNA, 12 nt, Homo sapiens
uguaaaauggag

SEQ ID NO: 1641479 - RNA, 15 nt, Homo sapiens
uguaaagcaggugcc

SEQ ID NO: 1641480 - RNA, 13 nt, Homo sapiens
uguaaauguuaug

SEQ ID NO: 1641481 - RNA, 16 nt, Homo sapiens
uguaagaaacugccaa

SEQ ID NO: 1641482 - RNA, 23 nt, Homo sapiens
uguaauuggaaucuucaccucag

SEQ ID NO: 1641483 - RNA, 21 nt, Homo sapiens
uguacacauguauccuuucac

SEQ ID NO: 1641484 - RNA, 15 nt, Homo sapiens
uguacaggcagauga

SEQ ID NO: 1641485 - RNA, 14 nt, Homo sapiens
uguacagucuugua

SEQ ID NO: 1641486 - RNA, 16 nt, Homo sapiens
uguacagucuuguauu

SEQ ID NO: 1641487 - RNA, 19 nt, Homo sapiens
uguaccuaggauauguuaa

SEQ ID NO: 1641488 - RNA, 18 nt, Homo sapiens
uguacucugaaaguuuug

SEQ ID NO: 1641489 - RNA, 19 nt, Homo sapiens
uguacuggagaguggcaaa

SEQ ID NO: 1641490 - RNA, 15 nt, Homo sapiens
uguacuugccuuauu

SEQ ID NO: 1641491 - RNA, 18 nt, Homo sapiens
uguagaagauggcacuua

SEQ ID NO: 1641492 - RNA, 17 nt, Homo sapiens
uguagaagccacuauua

SEQ ID NO: 1641493 - RNA, 24 nt, Homo sapiens
uguagcaaauuucgagcauaagaa

SEQ ID NO: 1641494 - RNA, 15 nt, Homo sapiens
uguagcaguaucuca

SEQ ID NO: 1641495 - RNA, 23 nt, Homo sapiens
uguauagcugugugaacguguau

SEQ ID NO: 1641496 - RNA, 15 nt, Homo sapiens
uguaucaaaugugac

SEQ ID NO: 1641497 - RNA, 17 nt, Homo sapiens
uguaugagacuaugcaa

SEQ ID NO: 1641498 - RNA, 20 nt, Homo sapiens
uguaugagagggcccugccu

SEQ ID NO: 1641499 - RNA, 20 nt, Homo sapiens
uguaugauuacaucaaggcu

SEQ ID NO: 1641500 - RNA, 17 nt, Homo sapiens
uguauuagucacagaga

SEQ ID NO: 1641501 - RNA, 21 nt, Homo sapiens
uguauucucugagcugugcag

SEQ ID NO: 1641502 - RNA, 16 nt, Homo sapiens
uguauuucaagaccuc

SEQ ID NO: 1641503 - RNA, 14 nt, Homo sapiens
ugucaagaggcaaa

SEQ ID NO: 1641504 - RNA, 15 nt, Homo sapiens
ugucacccaaugcau

SEQ ID NO: 1641505 - RNA, 20 nt, Homo sapiens
ugucacuugcuggcugugaa

SEQ ID NO: 1641506 - RNA, 21 nt, Homo sapiens
ugucacuugcuggcugugaaa

SEQ ID NO: 1641507 - RNA, 16 nt, Homo sapiens
ugucacuuugcuacag

SEQ ID NO: 1641508 - RNA, 21 nt, Homo sapiens
ugucaucucagcuggaucucc

SEQ ID NO: 1641509 - RNA, 17 nt, Homo sapiens
uguccgcuauccaccaa

SEQ ID NO: 1641510 - RNA, 17 nt, Homo sapiens
uguccuacucuguguca

SEQ ID NO: 1641511 - RNA, 16 nt, Homo sapiens
uguccuccucugugaa

SEQ ID NO: 1641512 - RNA, 23 nt, Homo sapiens
uguccuggaaccaggcuugccug

SEQ ID NO: 1641513 - RNA, 16 nt, Homo sapiens
ugucuccuuaacacug

SEQ ID NO: 1641514 - RNA, 10 nt, Homo sapiens
ugucuuuauu

SEQ ID NO: 1641515 - RNA, 14 nt, Homo sapiens
ugucuuucagccaa

SEQ ID NO: 1641516 - RNA, 20 nt, Homo sapiens
ugugaaaaugugugugugcu

SEQ ID NO: 1641517 - RNA, 17 nt, Homo sapiens
ugugaacguguauguac

SEQ ID NO: 1641518 - RNA, 20 nt, Homo sapiens
ugugaaggcaggggaaugua

SEQ ID NO: 1641519 - RNA, 21 nt, Homo sapiens
ugugaccaaugucuugaugca

SEQ ID NO: 1641520 - RNA, 21 nt, Homo sapiens
ugugaccauuagcauuuguca

SEQ ID NO: 1641521 - RNA, 13 nt, Homo sapiens
ugugacuuuccua

SEQ ID NO: 1641522 - RNA, 17 nt, Homo sapiens
ugugagggcaccaccaa

SEQ ID NO: 1641523 - RNA, 11 nt, Homo sapiens
ugugcacauuu

SEQ ID NO: 1641524 - RNA, 15 nt, Homo sapiens
ugugcgccuacagga

SEQ ID NO: 1641525 - RNA, 17 nt, Homo sapiens
ugugcuggccucucuga

SEQ ID NO: 1641526 - RNA, 13 nt, Homo sapiens
uguggacacagcu

SEQ ID NO: 1641527 - RNA, 19 nt, Homo sapiens
uguggauacagucauuauu

SEQ ID NO: 1641528 - RNA, 20 nt, Homo sapiens
uguggccugggccuccucac

SEQ ID NO: 1641529 - RNA, 16 nt, Homo sapiens
uguggcuguauccacu

SEQ ID NO: 1641530 - RNA, 19 nt, Homo sapiens
ugugguuaaugccauggac

SEQ ID NO: 1641531 - RNA, 19 nt, Homo sapiens
uguguaaauguuaugacuc

SEQ ID NO: 1641532 - RNA, 19 nt, Homo sapiens
uguguaggggagccacauu

SEQ ID NO: 1641533 - RNA, 18 nt, Homo sapiens
ugugucagggaacauauu

SEQ ID NO: 1641534 - RNA, 16 nt, Homo sapiens
ugugucaguggaugcu

SEQ ID NO: 1641535 - RNA, 18 nt, Homo sapiens
ugugucccccucugucca

SEQ ID NO: 1641536 - RNA, 19 nt, Homo sapiens
ugugucccccucuguccag

SEQ ID NO: 1641537 - RNA, 18 nt, Homo sapiens
ugugugaggacuucugca

SEQ ID NO: 1641538 - RNA, 12 nt, Homo sapiens
ugugugaucugu

SEQ ID NO: 1641539 - RNA, 21 nt, Homo sapiens
ugugugaucugugggcacauu

SEQ ID NO: 1641540 - RNA, 21 nt, Homo sapiens
ugugugcgagucugagucaga

SEQ ID NO: 1641541 - RNA, 15 nt, Homo sapiens
ugugugcgucacugu

SEQ ID NO: 1641542 - RNA, 13 nt, Homo sapiens
ugugugucucuga

SEQ ID NO: 1641543 - RNA, 13 nt, Homo sapiens
uguguuucuuuag

SEQ ID NO: 1641544 - RNA, 19 nt, Homo sapiens
uguuaacacuguaauaucu

SEQ ID NO: 1641545 - RNA, 20 nt, Homo sapiens
uguuaauaaaaguacauguu

SEQ ID NO: 1641546 - RNA, 20 nt, Homo sapiens
uguuaccugaaaacacugug

SEQ ID NO: 1641547 - RNA, 15 nt, Homo sapiens
uguuacugugucagg

SEQ ID NO: 1641548 - RNA, 19 nt, Homo sapiens
uguuagagaauuuccuuac

SEQ ID NO: 1641549 - RNA, 20 nt, Homo sapiens
uguuaggccuggcacagugu

SEQ ID NO: 1641550 - RNA, 14 nt, Homo sapiens
uguuagucaaggac

SEQ ID NO: 1641551 - RNA, 18 nt, Homo sapiens
uguuaucuucacuuuuau

SEQ ID NO: 1641552 - RNA, 14 nt, Homo sapiens
uguuaugacuccuu

SEQ ID NO: 1641553 - RNA, 12 nt, Homo sapiens
uguuauuuacac

SEQ ID NO: 1641554 - RNA, 18 nt, Homo sapiens
uguuauuuuaucugcuau

SEQ ID NO: 1641555 - RNA, 12 nt, Homo sapiens
uguucaagagca

SEQ ID NO: 1641556 - RNA, 15 nt, Homo sapiens
uguucaccuucaaaa

SEQ ID NO: 1641557 - RNA, 17 nt, Homo sapiens
uguucagcuccagcuca

SEQ ID NO: 1641558 - RNA, 15 nt, Homo sapiens
uguuccccaucaucu

SEQ ID NO: 1641559 - RNA, 16 nt, Homo sapiens
uguucccccugugcag

SEQ ID NO: 1641560 - RNA, 22 nt, Homo sapiens
uguucuaagucuuuccauugga

SEQ ID NO: 1641561 - RNA, 16 nt, Homo sapiens
uguucuauucaucuca

SEQ ID NO: 1641562 - RNA, 20 nt, Homo sapiens
uguucuauucaucucaagga

SEQ ID NO: 1641563 - RNA, 22 nt, Homo sapiens
uguucuauuuuuguuuacaaac

SEQ ID NO: 1641564 - RNA, 24 nt, Homo sapiens
uguugcccuggcaccuguggccag

SEQ ID NO: 1641565 - RNA, 19 nt, Homo sapiens
uguuggaaaaugugcaaua

SEQ ID NO: 1641566 - RNA, 13 nt, Homo sapiens
uguuggugacaau

SEQ ID NO: 1641567 - RNA, 18 nt, Homo sapiens
uguuuacagauccccaag

SEQ ID NO: 1641568 - RNA, 22 nt, Homo sapiens
uguuuggaauauuccacuauuu

SEQ ID NO: 1641569 - RNA, 15 nt, Homo sapiens
uuuucuagucuucau

SEQ ID NO: 1641570 - RNA, 13 nt, Homo sapiens
uuuucuccaaaua

SEQ ID NO: 1641571 - RNA, 17 nt, Homo sapiens
uuuucucuaaugcuuga

SEQ ID NO: 1641572 - RNA, 23 nt, Homo sapiens
uuuucuggaagggcagcauauaa

SEQ ID NO: 1641573 - RNA, 21 nt, Homo sapiens
uuuucuguugccccauccacc

SEQ ID NO: 1641574 - RNA, 17 nt, Homo sapiens
uuuugaaauuaaccucu

SEQ ID NO: 1641575 - RNA, 17 nt, Homo sapiens
uuuugacagggucucac

SEQ ID NO: 1641576 - RNA, 13 nt, Homo sapiens
uuuugcacauucu

SEQ ID NO: 1641577 - RNA, 19 nt, Homo sapiens
uuuuguaaaguugccuuua

SEQ ID NO: 1641578 - RNA, 18 nt, Homo sapiens
uuuugugaagacugggaa

SEQ ID NO: 1641579 - RNA, 13 nt, Homo sapiens
uuuugugguucuc

SEQ ID NO: 1641580 - RNA, 16 nt, Homo sapiens
uuuuuaacaguguucu

SEQ ID NO: 1641581 - RNA, 16 nt, Homo sapiens
uuuuuaugugcaauaa

SEQ ID NO: 1641582 - RNA, 16 nt, Homo sapiens
uuuuucuccucuccau

SEQ ID NO: 1641583 - RNA, 22 nt, Homo sapiens
uuuuugggaaaagaaaagucaa

SEQ ID NO: 1641584 - RNA, 21 nt, Homo sapiens
uuuuuguuuacaaacauggaa

SEQ ID NO: 1641585 - RNA, 21 nt, Homo sapiens
ggacuauggcucuacuuucag

SEQ ID NO: 1641586 - RNA, 12 nt, Homo sapiens
ggacucaaugca

SEQ ID NO: 1641587 - RNA, 14 nt, Homo sapiens
ggacuuucuugcaa

SEQ ID NO: 1641588 - RNA, 20 nt, Homo sapiens
ggagaaguaauccuagggaa

SEQ ID NO: 1641589 - RNA, 21 nt, Homo sapiens
ggagagaaguuaauccacauc

SEQ ID NO: 1641590 - RNA, 14 nt, Homo sapiens
ggagaugcugggaa

SEQ ID NO: 1641591 - RNA, 13 nt, Homo sapiens
ggagcaggacuga

SEQ ID NO: 1641592 - RNA, 20 nt, Homo sapiens
ggaggauguucugggacaca

SEQ ID NO: 1641593 - RNA, 20 nt, Homo sapiens
ggaggcagagguugcaguga

SEQ ID NO: 1641594 - RNA, 21 nt, Homo sapiens
ggaggcuccagagggcacucu

SEQ ID NO: 1641595 - RNA, 18 nt, Homo sapiens
ggagucugcuucauuucc

SEQ ID NO: 1641596 - RNA, 21 nt, Homo sapiens
ggagugagugaucacugguau

SEQ ID NO: 1641597 - RNA, 17 nt, Homo sapiens
ggagugcccccaacagc

SEQ ID NO: 1641598 - RNA, 20 nt, Homo sapiens
ggagugcccccaacagcacc

SEQ ID NO: 1641599 - RNA, 21 nt, Homo sapiens
ggagugcccccaacagcaccc

SEQ ID NO: 1641600 - RNA, 22 nt, Homo sapiens
ggagugggcccaaugcacuuug

SEQ ID NO: 1641601 - RNA, 12 nt, Homo sapiens
ggauacagucau

SEQ ID NO: 1641602 - RNA, 18 nt, Homo sapiens
ggauacgacaacuugcac

SEQ ID NO: 1641603 - RNA, 22 nt, Homo sapiens
ggauauguuaaauguauagcug

SEQ ID NO: 1641604 - RNA, 24 nt, Homo sapiens
ggauccuccaggugcacaagcucc

SEQ ID NO: 1641605 - RNA, 19 nt, Homo sapiens
ggaugcagccucacagucc

SEQ ID NO: 1641606 - RNA, 16 nt, Homo sapiens
ggauuaccaguagaug

SEQ ID NO: 1641607 - RNA, 16 nt, Homo sapiens
ggauuauuuaauaaca

SEQ ID NO: 1641608 - RNA, 18 nt, Homo sapiens
ggauuucauuuguaacuu

SEQ ID NO: 1641609 - RNA, 15 nt, Homo sapiens
ggcaaagccuaguga

SEQ ID NO: 1641610 - RNA, 16 nt, Homo sapiens
ggcaacgcacaaaaca

SEQ ID NO: 1641611 - RNA, 15 nt, Homo sapiens
ggcacuauuuuuauu

SEQ ID NO: 1641612 - RNA, 18 nt, Homo sapiens
ggcacucagaagacacug

SEQ ID NO: 1641613 - RNA, 22 nt, Homo sapiens
ggcacugcugggggugaggaca

SEQ ID NO: 1641614 - RNA, 20 nt, Homo sapiens
ggcacugcuggguggcccau

SEQ ID NO: 1641615 - RNA, 19 nt, Homo sapiens
ggcagcuauagucuggcac

SEQ ID NO: 1641616 - RNA, 21 nt, Homo sapiens
ggcagcuauagucuggcacca

SEQ ID NO: 1641617 - RNA, 17 nt, Homo sapiens
ggcaggaccuguggcca

SEQ ID NO: 1641618 - RNA, 15 nt, Homo sapiens
ggcagggaacauggg

SEQ ID NO: 1641619 - RNA, 14 nt, Homo sapiens
ggcagggucucacu

SEQ ID NO: 1641620 - RNA, 10 nt, Homo sapiens
ggcaguuuuu

SEQ ID NO: 1641621 - RNA, 13 nt, Homo sapiens
ggcauaccaaaau

SEQ ID NO: 1641622 - RNA, 14 nt, Homo sapiens
ggcauagaugcagg

SEQ ID NO: 1641623 - RNA, 16 nt, Homo sapiens
ggcaugggucgggaga

SEQ ID NO: 1641624 - RNA, 15 nt, Homo sapiens
ggcauuucacaaaac

SEQ ID NO: 1641625 - RNA, 22 nt, Homo sapiens
ggcauuucacaaaacagccuuu

SEQ ID NO: 1641626 - RNA, 17 nt, Homo sapiens
ggccaccacaccugacu

SEQ ID NO: 1641627 - RNA, 22 nt, Homo sapiens
ggccagguaugcauggaaaaug

SEQ ID NO: 1641628 - RNA, 11 nt, Homo sapiens
ggccaguguga

SEQ ID NO: 1641629 - RNA, 20 nt, Homo sapiens
ggccaucucuggaugccuga

SEQ ID NO: 1641630 - RNA, 16 nt, Homo sapiens
ggcccaaugcacuuug

SEQ ID NO: 1641631 - RNA, 16 nt, Homo sapiens
ggccccugcccggcug

SEQ ID NO: 1641632 - RNA, 16 nt, Homo sapiens
ggcccugccuccuuug

SEQ ID NO: 1641633 - RNA, 17 nt, Homo sapiens
ggccuggcacagugucu

SEQ ID NO: 1641634 - RNA, 16 nt, Homo sapiens
ggccuggccagaugca

SEQ ID NO: 1641635 - RNA, 22 nt, Homo sapiens
ggccugugucccccgaacgcuc

SEQ ID NO: 1641636 - RNA, 21 nt, Homo sapiens
ggcgacaagagugagacucca

SEQ ID NO: 1641637 - RNA, 20 nt, Homo sapiens
ggcggguggaucacaagguc

SEQ ID NO: 1641638 - RNA, 15 nt, Homo sapiens
ggcguggagcugccu

SEQ ID NO: 1641639 - RNA, 22 nt, Homo sapiens
ggcuaagcacgggccauaugaa

SEQ ID NO: 1641640 - RNA, 12 nt, Homo sapiens
ggcuaagugauc

SEQ ID NO: 1641641 - RNA, 13 nt, Homo sapiens
ggcuacacaggga

SEQ ID NO: 1641642 - RNA, 16 nt, Homo sapiens
ggcuacacagggaugu

SEQ ID NO: 1641643 - RNA, 17 nt, Homo sapiens
ggcuacacugacacugg

SEQ ID NO: 1641644 - RNA, 17 nt, Homo sapiens
ggcuagaaccuggagag

SEQ ID NO: 1641645 - RNA, 16 nt, Homo sapiens
ggcuagaacuggagag

SEQ ID NO: 1641646 - RNA, 17 nt, Homo sapiens
ggcuagaaucuggagag

SEQ ID NO: 1641647 - RNA, 17 nt, Homo sapiens
ggcuaguagaacuggau

SEQ ID NO: 1641648 - RNA, 12 nt, Homo sapiens
ggcucuucucau

SEQ ID NO: 1641649 - RNA, 16 nt, Homo sapiens
ggcucuucucauuuca

SEQ ID NO: 1641650 - RNA, 17 nt, Homo sapiens
ggcugagagaguggcau

SEQ ID NO: 1641651 - RNA, 23 nt, Homo sapiens
ggcugccuccacucccacuuccc

SEQ ID NO: 1641652 - RNA, 17 nt, Homo sapiens
ggcuggaaucuggagag

SEQ ID NO: 1641653 - RNA, 15 nt, Homo sapiens
ggcuggagugcaaug

SEQ ID NO: 1641654 - RNA, 19 nt, Homo sapiens
ggcuggagugcaguggcgu

SEQ ID NO: 1641655 - RNA, 15 nt, Homo sapiens
ggcuguaucccauga

SEQ ID NO: 1641656 - RNA, 15 nt, Homo sapiens
ggcuucacuguauaa

SEQ ID NO: 1641657 - RNA, 22 nt, Homo sapiens
ggcuucuuaaucuuuucacaaa

SEQ ID NO: 1641658 - RNA, 23 nt, Homo sapiens
ggcuugcuuucuucuccugugau

SEQ ID NO: 1641659 - RNA, 14 nt, Homo sapiens
ggcuuuuccaggaa

SEQ ID NO: 1641660 - RNA, 13 nt, Homo sapiens
ggcuuuugaacug

SEQ ID NO: 1641661 - RNA, 20 nt, Homo sapiens
gggaacauauuuaaggaaca

SEQ ID NO: 1641662 - RNA, 13 nt, Homo sapiens
gggaacucaccug

SEQ ID NO: 1641663 - RNA, 13 nt, Homo sapiens
gggaaguucaggc

SEQ ID NO: 1641664 - RNA, 12 nt, Homo sapiens
gggaaugccuga

SEQ ID NO: 1641665 - RNA, 12 nt, Homo sapiens
gggacuugcaaa

SEQ ID NO: 1641666 - RNA, 13 nt, Homo sapiens
gggagacacugau

SEQ ID NO: 1641667 - RNA, 19 nt, Homo sapiens
gggagacugggcugaggga

SEQ ID NO: 1641668 - RNA, 20 nt, Homo sapiens
gggaggcagagguugcagug

SEQ ID NO: 1641669 - RNA, 15 nt, Homo sapiens
gggaggcaggaucca

SEQ ID NO: 1641670 - RNA, 12 nt, Homo sapiens
gggagucugggc

SEQ ID NO: 1641671 - RNA, 20 nt, Homo sapiens
gggauauuugguuuggccau

SEQ ID NO: 1641672 - RNA, 19 nt, Homo sapiens
gggcauagaugcaggugag

SEQ ID NO: 1641673 - RNA, 14 nt, Homo sapiens
gggccauacuggcc

SEQ ID NO: 1641674 - RNA, 13 nt, Homo sapiens
gggccuaugcaga

SEQ ID NO: 1641675 - RNA, 12 nt, Homo sapiens
gggcucagagag

SEQ ID NO: 1641676 - RNA, 20 nt, Homo sapiens
gggcucccuucccaccucuc

SEQ ID NO: 1641677 - RNA, 22 nt, Homo sapiens
gggcugcccgcucccagugucu

SEQ ID NO: 1641678 - RNA, 19 nt, Homo sapiens
gggcuggcccagggcugca

SEQ ID NO: 1641679 - RNA, 23 nt, Homo sapiens
gggcuggcccagggcugcaaugc

SEQ ID NO: 1641680 - RNA, 19 nt, Homo sapiens
gggcuucuagaaccaggca

SEQ ID NO: 1641681 - RNA, 22 nt, Homo sapiens
gggcuuggcugugcccucagau

SEQ ID NO: 1641682 - RNA, 20 nt, Homo sapiens
gggcuuuuccaaaagcaaac

SEQ ID NO: 1641683 - RNA, 22 nt, Homo sapiens
ggggaccucauuccugggacua

SEQ ID NO: 1641684 - RNA, 21 nt, Homo sapiens
ggggcucagccaggugcugug

SEQ ID NO: 1641685 - RNA, 13 nt, Homo sapiens
ggggcucuucuca

SEQ ID NO: 1641686 - RNA, 20 nt, Homo sapiens
ggggcuggguaagagcacag

SEQ ID NO: 1641687 - RNA, 16 nt, Homo sapiens
gggggaagagcacagc

SEQ ID NO: 1641688 - RNA, 20 nt, Homo sapiens
ggguucaccaggucagggag

SEQ ID NO: 1641689 - RNA, 13 nt, Homo sapiens
ggguucacugcaa

SEQ ID NO: 1641690 - RNA, 19 nt, Homo sapiens
gguaaaagcaucacaugaa

SEQ ID NO: 1641691 - RNA, 16 nt, Homo sapiens
gguacgaugacagugu

SEQ ID NO: 1641692 - RNA, 19 nt, Homo sapiens
gguagagacuuugacucuc

SEQ ID NO: 1641693 - RNA, 12 nt, Homo sapiens
gguaugauuaac

SEQ ID NO: 1641694 - RNA, 22 nt, Homo sapiens
ggucaggaggaaaagacuaaca

SEQ ID NO: 1641695 - RNA, 12 nt, Homo sapiens
ggucaugugcau

SEQ ID NO: 1641696 - RNA, 11 nt, Homo sapiens
ggucauuugcu

SEQ ID NO: 1641697 - RNA, 21 nt, Homo sapiens
ggucuuuuacauacagugaua

SEQ ID NO: 1641698 - RNA, 17 nt, Homo sapiens
ggugauggggcugagca

SEQ ID NO: 1641699 - RNA, 19 nt, Homo sapiens
ggugcaugaagguuucuga

SEQ ID NO: 1641700 - RNA, 13 nt, Homo sapiens
gguggagggccac

SEQ ID NO: 1641701 - RNA, 20 nt, Homo sapiens
ggugugaaccaccacaccca

SEQ ID NO: 1641702 - RNA, 18 nt, Homo sapiens
gguguguguucaccuuca

SEQ ID NO: 1641703 - RNA, 17 nt, Homo sapiens
gguuauaacaguguuua

SEQ ID NO: 1641704 - RNA, 15 nt, Homo sapiens
gguuaucugggcaua

SEQ ID NO: 1641705 - RNA, 21 nt, Homo sapiens
gguuccucaggugaccaaaac

SEQ ID NO: 1641706 - RNA, 12 nt, Homo sapiens
gguucgcauuau

SEQ ID NO: 1641707 - RNA, 13 nt, Homo sapiens
gguucucacuguu

SEQ ID NO: 1641708 - RNA, 14 nt, Homo sapiens
gguucucacuguug

SEQ ID NO: 1641709 - RNA, 23 nt, Homo sapiens
gguuucacuguggucucaaucuc

SEQ ID NO: 1641710 - RNA, 13 nt, Homo sapiens
gguuucacuugca

SEQ ID NO: 1641711 - RNA, 16 nt, Homo sapiens
gguuuuauccuuccuu

SEQ ID NO: 1641712 - RNA, 19 nt, Homo sapiens
guaaaacuuagcaacuugg

SEQ ID NO: 1641713 - RNA, 12 nt, Homo sapiens
guaaaauggagg

SEQ ID NO: 1641714 - RNA, 21 nt, Homo sapiens
guaaagaaauauauaugauau

SEQ ID NO: 1641715 - RNA, 15 nt, Homo sapiens
guaaaguugccuuua

SEQ ID NO: 1641716 - RNA, 17 nt, Homo sapiens
guaaauagcucaggugu

SEQ ID NO: 1641717 - RNA, 21 nt, Homo sapiens
guaaccaguagucaccucugg

SEQ ID NO: 1641718 - RNA, 19 nt, Homo sapiens
guaagcagaguucuuugca

SEQ ID NO: 1641719 - RNA, 22 nt, Homo sapiens
guaaguagcaacccugugauac

SEQ ID NO: 1641720 - RNA, 19 nt, Homo sapiens
guaaguuucaggugacaug

SEQ ID NO: 1641721 - RNA, 13 nt, Homo sapiens
guaauauucucug

SEQ ID NO: 1641722 - RNA, 19 nt, Homo sapiens
guacaccccaacagcaccc

SEQ ID NO: 1641723 - RNA, 15 nt, Homo sapiens
guacagucuuaucaa

SEQ ID NO: 1641724 - RNA, 13 nt, Homo sapiens
guacagucuugca

SEQ ID NO: 1641725 - RNA, 21 nt, Homo sapiens
guaccaaaucugacauauuau

SEQ ID NO: 1641726 - RNA, 20 nt, Homo sapiens
guacuaacuagcauuguaaa

SEQ ID NO: 1641727 - RNA, 13 nt, Homo sapiens
guacuacaguccu

SEQ ID NO: 1641728 - RNA, 21 nt, Homo sapiens
guacuccagcccggcacucca

SEQ ID NO: 1641729 - RNA, 21 nt, Homo sapiens
guacugaguauugauaaacuu

SEQ ID NO: 1641730 - RNA, 16 nt, Homo sapiens
guacuguuacuguguc

SEQ ID NO: 1641731 - RNA, 14 nt, Homo sapiens
guacuuugugcuga

SEQ ID NO: 1641732 - RNA, 15 nt, Homo sapiens
guagaaagugaucca

SEQ ID NO: 1641733 - RNA, 17 nt, Homo sapiens
guagaacaauguacaag

SEQ ID NO: 1641734 - RNA, 18 nt, Homo sapiens
guagagacaggguuucac

SEQ ID NO: 1641735 - RNA, 22 nt, Homo sapiens
guagagacaggguuuugccaug

SEQ ID NO: 1641736 - RNA, 18 nt, Homo sapiens
guagagacgggguuucac

SEQ ID NO: 1641737 - RNA, 18 nt, Homo sapiens
guagauaacugcauuuug

SEQ ID NO: 1641738 - RNA, 16 nt, Homo sapiens
guagcauuuuccagca

SEQ ID NO: 1641739 - RNA, 19 nt, Homo sapiens
guagcugggacuacaggca

SEQ ID NO: 1641740 - RNA, 12 nt, Homo sapiens
guaguuuugcca

SEQ ID NO: 1641741 - RNA, 19 nt, Homo sapiens
guauaagugguguguguau

SEQ ID NO: 1641742 - RNA, 17 nt, Homo sapiens
guauagcuggcaccuua

SEQ ID NO: 1641743 - RNA, 13 nt, Homo sapiens
guauaucuucuac

SEQ ID NO: 1641744 - RNA, 12 nt, Homo sapiens
guauauguauaa

SEQ ID NO: 1641745 - RNA, 15 nt, Homo sapiens
guaucaaaugugaca

SEQ ID NO: 1641746 - RNA, 21 nt, Homo sapiens
guaucaaaugugacauuauau

SEQ ID NO: 1641747 - RNA, 19 nt, Homo sapiens
guaugaucaauaaaggaca

SEQ ID NO: 1641748 - RNA, 17 nt, Homo sapiens
guauggcaaacugccau

SEQ ID NO: 1641749 - RNA, 22 nt, Homo sapiens
guaugugaaacacacauggaca

SEQ ID NO: 1641750 - RNA, 23 nt, Homo sapiens
guauguuugggagacugcugagu

SEQ ID NO: 1641751 - RNA, 20 nt, Homo sapiens
guauuuuauaaguaucuuca

SEQ ID NO: 1641752 - RNA, 16 nt, Homo sapiens
guauuuuuaguagaga

SEQ ID NO: 1641753 - RNA, 20 nt, Homo sapiens
gucaacaaagucacccacuu

SEQ ID NO: 1641754 - RNA, 22 nt, Homo sapiens
gucaaccccaaguuaguucaau

SEQ ID NO: 1641755 - RNA, 20 nt, Homo sapiens
gucaagcaguagacaagcaa

SEQ ID NO: 1641756 - RNA, 21 nt, Homo sapiens
gucaauccaagagucugauga

SEQ ID NO: 1641757 - RNA, 21 nt, Homo sapiens
gucacaguaaugcaagcaaag

SEQ ID NO: 1641758 - RNA, 11 nt, Homo sapiens
gucacuugcug

SEQ ID NO: 1641759 - RNA, 20 nt, Homo sapiens
gucagaguuccgacugccau

SEQ ID NO: 1641760 - RNA, 16 nt, Homo sapiens
gucagcacagaacaca

SEQ ID NO: 1641761 - RNA, 16 nt, Homo sapiens
gucagggaacauauuu

SEQ ID NO: 1641762 - RNA, 16 nt, Homo sapiens
gucauaagugacaguu

SEQ ID NO: 1641763 - RNA, 12 nt, Homo sapiens
gucauacaguaa

SEQ ID NO: 1641764 - RNA, 15 nt, Homo sapiens
gucauauuuugccac

SEQ ID NO: 1641765 - RNA, 14 nt, Homo sapiens
gucaucacuuugac

SEQ ID NO: 1641766 - RNA, 14 nt, Homo sapiens
gucaugcaaaggcu

SEQ ID NO: 1641767 - RNA, 20 nt, Homo sapiens
gucaugcauaaauaugcagu

SEQ ID NO: 1641768 - RNA, 19 nt, Homo sapiens
gucaugccaagcauuuaau

SEQ ID NO: 1641769 - RNA, 18 nt, Homo sapiens
gucaugcguuuaaucaca

SEQ ID NO: 1641770 - RNA, 14 nt, Homo sapiens
gucauuauguuaau

SEQ ID NO: 1641771 - RNA, 21 nt, Homo sapiens
gucauuguaaccucgugucua

SEQ ID NO: 1641772 - RNA, 18 nt, Homo sapiens
guccaaguggcugugaca

SEQ ID NO: 1641773 - RNA, 16 nt, Homo sapiens
guccaggcacugagau

SEQ ID NO: 1641774 - RNA, 14 nt, Homo sapiens
guccaucacuggcu

SEQ ID NO: 1641775 - RNA, 22 nt, Homo sapiens
guccauuaagcugagagugcua

SEQ ID NO: 1641776 - RNA, 12 nt, Homo sapiens
guccauuauuca

SEQ ID NO: 1641777 - RNA, 20 nt, Homo sapiens
gucccagaacacggcagcug

SEQ ID NO: 1641778 - RNA, 20 nt, Homo sapiens
gucccaggucuucuccaagg

SEQ ID NO: 1641779 - RNA, 14 nt, Homo sapiens
gucccauccuggac

SEQ ID NO: 1641780 - RNA, 17 nt, Homo sapiens
gucccugaagucuugca

SEQ ID NO: 1641781 - RNA, 12 nt, Homo sapiens
gucccuugcccc

SEQ ID NO: 1641782 - RNA, 16 nt, Homo sapiens
guccuauuauauucau

SEQ ID NO: 1641783 - RNA, 16 nt, Homo sapiens
ucuauggcacccaugc

SEQ ID NO: 1641784 - RNA, 17 nt, Homo sapiens
ucuauuucagugccaau

SEQ ID NO: 1641785 - RNA, 14 nt, Homo sapiens
ucucaaaguuaaaa

SEQ ID NO: 1641786 - RNA, 15 nt, Homo sapiens
ucucaauaaaacaga

SEQ ID NO: 1641787 - RNA, 18 nt, Homo sapiens
ucucacacaugagcauca

SEQ ID NO: 1641788 - RNA, 18 nt, Homo sapiens
ucucacuauguugcccag

SEQ ID NO: 1641789 - RNA, 20 nt, Homo sapiens
ucucacuauguugcccaggc

SEQ ID NO: 1641790 - RNA, 20 nt, Homo sapiens
ucucacucugucgcccaguc

SEQ ID NO: 1641791 - RNA, 15 nt, Homo sapiens
ucucagccacaacca

SEQ ID NO: 1641792 - RNA, 14 nt, Homo sapiens
ucucaggaccaaag

SEQ ID NO: 1641793 - RNA, 18 nt, Homo sapiens
ucucauauaagacaaaua

SEQ ID NO: 1641794 - RNA, 14 nt, Homo sapiens
ucucaucacuuuuc

SEQ ID NO: 1641795 - RNA, 18 nt, Homo sapiens
ucucaugucuuugcugca

SEQ ID NO: 1641796 - RNA, 16 nt, Homo sapiens
ucucauuaaaauccag

SEQ ID NO: 1641797 - RNA, 11 nt, Homo sapiens
ucucauucccu

SEQ ID NO: 1641798 - RNA, 18 nt, Homo sapiens
ucucauucccuccccaga

SEQ ID NO: 1641799 - RNA, 15 nt, Homo sapiens
ucucauugaggacaa

SEQ ID NO: 1641800 - RNA, 22 nt, Homo sapiens
ucucauuuguauuuucaguuug

SEQ ID NO: 1641801 - RNA, 15 nt, Homo sapiens
ucucauuugucacac

SEQ ID NO: 1641802 - RNA, 23 nt, Homo sapiens
ucuccaaaccacuuuuugcagcu

SEQ ID NO: 1641803 - RNA, 23 nt, Homo sapiens
ucuccaaccccccagcacugagg

SEQ ID NO: 1641804 - RNA, 20 nt, Homo sapiens
ucuccagaaagcucaucuca

SEQ ID NO: 1641805 - RNA, 22 nt, Homo sapiens
ucuccaggggccacaagaccau

SEQ ID NO: 1641806 - RNA, 14 nt, Homo sapiens
ucuccaucccugaa

SEQ ID NO: 1641807 - RNA, 12 nt, Homo sapiens
ucuccuccgugg

SEQ ID NO: 1641808 - RNA, 19 nt, Homo sapiens
ucucgcacacacagugauu

SEQ ID NO: 1641809 - RNA, 20 nt, Homo sapiens
ucucggcucacugcauccuc

SEQ ID NO: 1641810 - RNA, 22 nt, Homo sapiens
ucucuagggcuaguagaacugg

SEQ ID NO: 1641811 - RNA, 13 nt, Homo sapiens
ucucucaccucua

SEQ ID NO: 1641812 - RNA, 15 nt, Homo sapiens
ucucucucugccaug

SEQ ID NO: 1641813 - RNA, 18 nt, Homo sapiens
ucucucugccauggccuu

SEQ ID NO: 1641814 - RNA, 23 nt, Homo sapiens
ucucugauagguagcauuuucca

SEQ ID NO: 1641815 - RNA, 15 nt, Homo sapiens
ucucuggguuuacaa

SEQ ID NO: 1641816 - RNA, 19 nt, Homo sapiens
ucugaaaauuaacacugcu

SEQ ID NO: 1641817 - RNA, 21 nt, Homo sapiens
ucugaaggagccccauuccug

SEQ ID NO: 1641818 - RNA, 13 nt, Homo sapiens
ucugacacacagc

SEQ ID NO: 1641819 - RNA, 15 nt, Homo sapiens
ucugacccacagccu

SEQ ID NO: 1641820 - RNA, 15 nt, Homo sapiens
ucugacccacugcuu

SEQ ID NO: 1641821 - RNA, 17 nt, Homo sapiens
ucugacccauguucacg

SEQ ID NO: 1641822 - RNA, 18 nt, Homo sapiens
ucugacgcagccugagaa

SEQ ID NO: 1641823 - RNA, 17 nt, Homo sapiens
ucugacuaaaaauacuu

SEQ ID NO: 1641824 - RNA, 20 nt, Homo sapiens
ucugacucuuggcacagcau

SEQ ID NO: 1641825 - RNA, 19 nt, Homo sapiens
ucugacuuaagugugcaaa

SEQ ID NO: 1641826 - RNA, 21 nt, Homo sapiens
guccucccaucucacacauga

SEQ ID NO: 1641827 - RNA, 22 nt, Homo sapiens
guccuccucugugaaacuggga

SEQ ID NO: 1641828 - RNA, 15 nt, Homo sapiens
guccugacuucaggg

SEQ ID NO: 1641829 - RNA, 14 nt, Homo sapiens
gucggugccuucaa

SEQ ID NO: 1641830 - RNA, 13 nt, Homo sapiens
gucuaaaaccuua

SEQ ID NO: 1641831 - RNA, 23 nt, Homo sapiens
gucucaguuuacauuuuguauau

SEQ ID NO: 1641832 - RNA, 16 nt, Homo sapiens
gucuccuuaacacuga

SEQ ID NO: 1641833 - RNA, 23 nt, Homo sapiens
gucucgugguaggacuguagaaa

SEQ ID NO: 1641834 - RNA, 22 nt, Homo sapiens
gucucuuguaauccgaaucucu

SEQ ID NO: 1641835 - RNA, 12 nt, Homo sapiens
gucugacaggca

SEQ ID NO: 1641836 - RNA, 16 nt, Homo sapiens
gucuuacuuugugcaa

SEQ ID NO: 1641837 - RNA, 22 nt, Homo sapiens
gucuucauaauuucuucacuca

SEQ ID NO: 1641838 - RNA, 13 nt, Homo sapiens
gucuuguguuucu

SEQ ID NO: 1641839 - RNA, 15 nt, Homo sapiens
gucuuuacagaauca

SEQ ID NO: 1641840 - RNA, 17 nt, Homo sapiens
gucuuucuuacaaggaa

SEQ ID NO: 1641841 - RNA, 21 nt, Homo sapiens
gucuuuggugaacauugcaau

SEQ ID NO: 1641842 - RNA, 18 nt, Homo sapiens
gugaaauauaugcuauau

SEQ ID NO: 1641843 - RNA, 15 nt, Homo sapiens
gugaagcaccaagcu

SEQ ID NO: 1641844 - RNA, 16 nt, Homo sapiens
gugaauaaaccaucau

SEQ ID NO: 1641845 - RNA, 16 nt, Homo sapiens
gugaaugauucagugu

SEQ ID NO: 1641846 - RNA, 18 nt, Homo sapiens
gugacaaugguuucacca

SEQ ID NO: 1641847 - RNA, 16 nt, Homo sapiens
gugacauuuccaugca

SEQ ID NO: 1641848 - RNA, 22 nt, Homo sapiens
gugagacaguccagccuggaga

SEQ ID NO: 1641849 - RNA, 23 nt, Homo sapiens
gugagacuuugaggguguauauu

SEQ ID NO: 1641850 - RNA, 15 nt, Homo sapiens
gugagcacuaaggug

SEQ ID NO: 1641851 - RNA, 13 nt, Homo sapiens
gugaggauuaaau

SEQ ID NO: 1641852 - RNA, 17 nt, Homo sapiens
gugagggguagugggau

SEQ ID NO: 1641853 - RNA, 21 nt, Homo sapiens
gugaugaugaaaugaggucag

SEQ ID NO: 1641854 - RNA, 23 nt, Homo sapiens
uaaaauauuuuuaugugcaauaa

SEQ ID NO: 1641855 - RNA, 14 nt, Homo sapiens
uaaaaucacuguca

SEQ ID NO: 1641856 - RNA, 18 nt, Homo sapiens
uaaaauuauuacuaauga

SEQ ID NO: 1641857 - RNA, 13 nt, Homo sapiens
uaaaauuauuuca

SEQ ID NO: 1641858 - RNA, 14 nt, Homo sapiens
uaaacaaauguaug

SEQ ID NO: 1641859 - RNA, 13 nt, Homo sapiens
uaaacaguucuug

SEQ ID NO: 1641860 - RNA, 17 nt, Homo sapiens
uaaaccaucaucuugcc

SEQ ID NO: 1641861 - RNA, 22 nt, Homo sapiens
uaaacguccauuaagcugagag

SEQ ID NO: 1641862 - RNA, 16 nt, Homo sapiens
uaaacuauaaccucuc

SEQ ID NO: 1641863 - RNA, 15 nt, Homo sapiens
uaaacuuccaaguca

SEQ ID NO: 1641864 - RNA, 18 nt, Homo sapiens
uaaagacuuguauagcau

SEQ ID NO: 1641865 - RNA, 16 nt, Homo sapiens
uaaagagaguuugcca

SEQ ID NO: 1641866 - RNA, 17 nt, Homo sapiens
uaaagagaguuugccac

SEQ ID NO: 1641867 - RNA, 16 nt, Homo sapiens
uaaagcugaaaacugc

SEQ ID NO: 1641868 - RNA, 14 nt, Homo sapiens
uaaaggacaaacag

SEQ ID NO: 1641869 - RNA, 22 nt, Homo sapiens
uaaagggagauaacaaucugua

SEQ ID NO: 1641870 - RNA, 18 nt, Homo sapiens
uaaagggcgcaaagggca

SEQ ID NO: 1641871 - RNA, 20 nt, Homo sapiens
uaaagggcgcaaagggcaug

SEQ ID NO: 1641872 - RNA, 14 nt, Homo sapiens
uaaaguauucucca

SEQ ID NO: 1641873 - RNA, 14 nt, Homo sapiens
uaaaguugccuuua

SEQ ID NO: 1641874 - RNA, 12 nt, Homo sapiens
uaaauacuguuu

SEQ ID NO: 1641875 - RNA, 13 nt, Homo sapiens
uaaauaugcagug

SEQ ID NO: 1641876 - RNA, 17 nt, Homo sapiens
uaaauaugcagugauau

SEQ ID NO: 1641877 - RNA, 15 nt, Homo sapiens
uaaaucaaugcuaua

SEQ ID NO: 1641878 - RNA, 16 nt, Homo sapiens
uaaaucacacauucag

SEQ ID NO: 1641879 - RNA, 14 nt, Homo sapiens
uaaauccaaugaca

SEQ ID NO: 1641880 - RNA, 20 nt, Homo sapiens
uaaauggacaaaugcuuaug

SEQ ID NO: 1641881 - RNA, 16 nt, Homo sapiens
uaaauguuaugacucc

SEQ ID NO: 1641882 - RNA, 22 nt, Homo sapiens
uaaauuucucuacugucucagu

SEQ ID NO: 1641883 - RNA, 18 nt, Homo sapiens
uaaauuuuauuccaaaau

SEQ ID NO: 1641884 - RNA, 12 nt, Homo sapiens
uaacaaccugga

SEQ ID NO: 1641885 - RNA, 16 nt, Homo sapiens
uaacaauaaaagacaa

SEQ ID NO: 1641886 - RNA, 14 nt, Homo sapiens
uaacaauguuaagg

SEQ ID NO: 1641887 - RNA, 15 nt, Homo sapiens
uaacacuaauuauca

SEQ ID NO: 1641888 - RNA, 14 nt, Homo sapiens
uaacagcaucuuua

SEQ ID NO: 1641889 - RNA, 14 nt, Homo sapiens
uaacaguguucuca

SEQ ID NO: 1641890 - RNA, 20 nt, Homo sapiens
uaacaguuuuagaauacauu

SEQ ID NO: 1641891 - RNA, 17 nt, Homo sapiens
uaacaucauuguauuaa

SEQ ID NO: 1641892 - RNA, 13 nt, Homo sapiens
uaacauuaccuua

SEQ ID NO: 1641893 - RNA, 22 nt, Homo sapiens
uaacauuaccuuacuguggagg

SEQ ID NO: 1641894 - RNA, 16 nt, Homo sapiens
uaaccauguaucuaau

SEQ ID NO: 1641895 - RNA, 16 nt, Homo sapiens
uaacgagaaauagaaa

SEQ ID NO: 1641896 - RNA, 19 nt, Homo sapiens
uaagaacuaaaauguucua

SEQ ID NO: 1641897 - RNA, 18 nt, Homo sapiens
uaagaagcuuucaguauu

SEQ ID NO: 1641898 - RNA, 14 nt, Homo sapiens
uaagaauaguagau

SEQ ID NO: 1641899 - RNA, 22 nt, Homo sapiens
uaagacaaauauuccuuugcau

SEQ ID NO: 1641900 - RNA, 13 nt, Homo sapiens
uaagacuacugaa

SEQ ID NO: 1641901 - RNA, 21 nt, Homo sapiens
uaagagggagggagggcucca

SEQ ID NO: 1641902 - RNA, 19 nt, Homo sapiens
uaagauauuaacugagaag

SEQ ID NO: 1641903 - RNA, 15 nt, Homo sapiens
uaagauuaauagcau

SEQ ID NO: 1641904 - RNA, 16 nt, Homo sapiens
uaagcaaagacuauga

SEQ ID NO: 1641905 - RNA, 21 nt, Homo sapiens
uaagcacgggccauaugaaua

SEQ ID NO: 1641906 - RNA, 19 nt, Homo sapiens
uaagccacgaggugcagua

SEQ ID NO: 1641907 - RNA, 16 nt, Homo sapiens
uaagccauguguucca

SEQ ID NO: 1641908 - RNA, 15 nt, Homo sapiens
uaaguaaugaugucg

SEQ ID NO: 1641909 - RNA, 22 nt, Homo sapiens
uaagucaaccugccugacauuu

SEQ ID NO: 1641910 - RNA, 19 nt, Homo sapiens
uaaguuacacauuuuucag

SEQ ID NO: 1641911 - RNA, 16 nt, Homo sapiens
uaaguuaucuuugaau

SEQ ID NO: 1641912 - RNA, 19 nt, Homo sapiens
uaaguuugugaaugugacu

SEQ ID NO: 1641913 - RNA, 16 nt, Homo sapiens
uaauaaaaguacaugu

SEQ ID NO: 1641914 - RNA, 14 nt, Homo sapiens
uaauaaauacuuaa

SEQ ID NO: 1641915 - RNA, 22 nt, Homo sapiens
uaauaaugccuaccuugugagg

SEQ ID NO: 1641916 - RNA, 22 nt, Homo sapiens
uaauacaggauuauuuugauua

SEQ ID NO: 1641917 - RNA, 19 nt, Homo sapiens
uaauauggggaugcagcau

SEQ ID NO: 1641918 - RNA, 18 nt, Homo sapiens
uaauauuguaaauacugg

SEQ ID NO: 1641919 - RNA, 21 nt, Homo sapiens
uaaucaaaacccaacaugacu

SEQ ID NO: 1641920 - RNA, 23 nt, Homo sapiens
uaauccacaucuuuacucaggca

SEQ ID NO: 1641921 - RNA, 12 nt, Homo sapiens
uaauccuaaaca

SEQ ID NO: 1641922 - RNA, 18 nt, Homo sapiens
uaauccuaaacauaugaa

SEQ ID NO: 1641923 - RNA, 19 nt, Homo sapiens
uaauccucuuuuucuaguc

SEQ ID NO: 1641924 - RNA, 15 nt, Homo sapiens
uaaugauagcuacug

SEQ ID NO: 1641925 - RNA, 21 nt, Homo sapiens
uaaugguaguuuuacaguguu

SEQ ID NO: 1641926 - RNA, 15 nt, Homo sapiens
uaaugucaauucuug

SEQ ID NO: 1641927 - RNA, 16 nt, Homo sapiens
uaauuaguaacaugug

SEQ ID NO: 1641928 - RNA, 20 nt, Homo sapiens
uaauuccacagcugcucaau

SEQ ID NO: 1641929 - RNA, 13 nt, Homo sapiens
uaauucucuaggg

SEQ ID NO: 1641930 - RNA, 14 nt, Homo sapiens
uaauucugcaucug

SEQ ID NO: 1641931 - RNA, 21 nt, Homo sapiens
uaauuggaaucuucaccucag

SEQ ID NO: 1641932 - RNA, 14 nt, Homo sapiens
uaauuuguauuucc

SEQ ID NO: 1641933 - RNA, 16 nt, Homo sapiens
uaauuugugaauuugc

SEQ ID NO: 1641934 - RNA, 22 nt, Homo sapiens
ugcauauuauaaaggauaaaga

SEQ ID NO: 1641935 - RNA, 16 nt, Homo sapiens
ugcaucugcuacugug

SEQ ID NO: 1641936 - RNA, 21 nt, Homo sapiens
ugcauguaauggacuaugcac

SEQ ID NO: 1641937 - RNA, 14 nt, Homo sapiens
ugcauuaucuauga

SEQ ID NO: 1641938 - RNA, 23 nt, Homo sapiens
ugcauuuaaauacagucuuccau

SEQ ID NO: 1641939 - RNA, 13 nt, Homo sapiens
ugcauuugcacua

SEQ ID NO: 1641940 - RNA, 12 nt, Homo sapiens
ugccaaugaguu

SEQ ID NO: 1641941 - RNA, 19 nt, Homo sapiens
ugccacauuagccuuugca

SEQ ID NO: 1641942 - RNA, 20 nt, Homo sapiens
ugccauccucaaacacugca

SEQ ID NO: 1641943 - RNA, 18 nt, Homo sapiens
ugcccaagagugggguuu

SEQ ID NO: 1641944 - RNA, 23 nt, Homo sapiens
ugcccaccuccuuccagcacuga

SEQ ID NO: 1641945 - RNA, 12 nt, Homo sapiens
ugcccagugugu

SEQ ID NO: 1641946 - RNA, 21 nt, Homo sapiens
ugccccagauggcuuugugau

SEQ ID NO: 1641947 - RNA, 14 nt, Homo sapiens
ugcccccaacagca

SEQ ID NO: 1641948 - RNA, 17 nt, Homo sapiens
ugcccccaauccaugaa

SEQ ID NO: 1641949 - RNA, 24 nt, Homo sapiens
ugcccggcgcccucuguccugacu

SEQ ID NO: 1641950 - RNA, 15 nt, Homo sapiens
ugcccucagauuccg

SEQ ID NO: 1641951 - RNA, 18 nt, Homo sapiens
ugcccuugcuccagccug

SEQ ID NO: 1641952 - RNA, 19 nt, Homo sapiens
ugcccuugcuccagccuga

SEQ ID NO: 1641953 - RNA, 23 nt, Homo sapiens
ugccuaucugacuucauacaucc

SEQ ID NO: 1641954 - RNA, 14 nt, Homo sapiens
ugccucagccuccc

SEQ ID NO: 1641955 - RNA, 22 nt, Homo sapiens
ugccucagccucccaaagugcu

SEQ ID NO: 1641956 - RNA, 22 nt, Homo sapiens
ugccucagccuccugaguaguu

SEQ ID NO: 1641957 - RNA, 21 nt, Homo sapiens
ugccuccacucccacuucccu

SEQ ID NO: 1641958 - RNA, 19 nt, Homo sapiens
ugccucccuucaugcaugg

SEQ ID NO: 1641959 - RNA, 14 nt, Homo sapiens
ugccucggccuccc

SEQ ID NO: 1641960 - RNA, 22 nt, Homo sapiens
ugccucucugcuccaccuugug

SEQ ID NO: 1641961 - RNA, 20 nt, Homo sapiens
ugccucugacacacagcucu

SEQ ID NO: 1641962 - RNA, 22 nt, Homo sapiens
ugccugaagaccccagauguga

SEQ ID NO: 1641963 - RNA, 13 nt, Homo sapiens
ugccugacauuug

SEQ ID NO: 1641964 - RNA, 13 nt, Homo sapiens
ugccuucucaggg

SEQ ID NO: 1641965 - RNA, 22 nt, Homo sapiens
ugccuuuuuuucucugcauuua

SEQ ID NO: 1641966 - RNA, 17 nt, Homo sapiens
ugcggcauuaaagccau

SEQ ID NO: 1641967 - RNA, 11 nt, Homo sapiens
ugcgucacugu

SEQ ID NO: 1641968 - RNA, 12 nt, Homo sapiens
ugcgucugugug

SEQ ID NO: 1641969 - RNA, 17 nt, Homo sapiens
ugcgugugucuguguug

SEQ ID NO: 1641970 - RNA, 20 nt, Homo sapiens
ugcuaacauaaaauccaaua

SEQ ID NO: 1641971 - RNA, 22 nt, Homo sapiens
ugcuaacuagcuuggaaacugg

SEQ ID NO: 1641972 - RNA, 13 nt, Homo sapiens
ugcuaauaugaca

SEQ ID NO: 1641973 - RNA, 22 nt, Homo sapiens
ugcuaauaugacauaugacaau

SEQ ID NO: 1641974 - RNA, 21 nt, Homo sapiens
ugcuauaacuauguugauaaa

SEQ ID NO: 1641975 - RNA, 18 nt, Homo sapiens
ugcucaaucccugaggac

SEQ ID NO: 1641976 - RNA, 19 nt, Homo sapiens
ugcucacauaucugucauu

SEQ ID NO: 1641977 - RNA, 17 nt, Homo sapiens
ugcucauugcuuucuaa

SEQ ID NO: 1641978 - RNA, 21 nt, Homo sapiens
ugcuccaagucuaggaacucc

SEQ ID NO: 1641979 - RNA, 14 nt, Homo sapiens
ugcucccucugugu

SEQ ID NO: 1641980 - RNA, 19 nt, Homo sapiens
ugcuccuugggcccuuuga

SEQ ID NO: 1641981 - RNA, 18 nt, Homo sapiens
uuuaucuauggcacccau

SEQ ID NO: 1641982 - RNA, 18 nt, Homo sapiens
uuuaugggaacccucuuu

SEQ ID NO: 1641983 - RNA, 17 nt, Homo sapiens
uuuauuaaaauauuuca

SEQ ID NO: 1641984 - RNA, 19 nt, Homo sapiens
uuuauuuuauagagcagaa

SEQ ID NO: 1641985 - RNA, 23 nt, Homo sapiens
uuucaaaagcaagaacaccaucc

SEQ ID NO: 1641986 - RNA, 18 nt, Homo sapiens
uuucaacuucaguacuca

SEQ ID NO: 1641987 - RNA, 18 nt, Homo sapiens
uuucaauaaaccuaauaa

SEQ ID NO: 1641988 - RNA, 19 nt, Homo sapiens
uuucaaucucugacuaaaa

SEQ ID NO: 1641989 - RNA, 12 nt, Homo sapiens
uuucaauugcau

SEQ ID NO: 1641990 - RNA, 12 nt, Homo sapiens
uuucacacauuu

SEQ ID NO: 1641991 - RNA, 14 nt, Homo sapiens
uuucacauaugugu

SEQ ID NO: 1641992 - RNA, 20 nt, Homo sapiens
uuucacuugcacaucaugga

SEQ ID NO: 1641993 - RNA, 14 nt, Homo sapiens
uuucagaacacaag

SEQ ID NO: 1641994 - RNA, 14 nt, Homo sapiens
uuucagaauguuga

SEQ ID NO: 1641995 - RNA, 23 nt, Homo sapiens
uuucagagugacuacacacagua

SEQ ID NO: 1641996 - RNA, 18 nt, Homo sapiens
uuucagguuccaaucaga

SEQ ID NO: 1641997 - RNA, 18 nt, Homo sapiens
uuucauaaccuagccuua

SEQ ID NO: 1641998 - RNA, 15 nt, Homo sapiens
uuucaucugcucucc

SEQ ID NO: 1641999 - RNA, 15 nt, Homo sapiens
uuucauuuacugugg

SEQ ID NO: 1642000 - RNA, 17 nt, Homo sapiens
uuucauuuacuguggcu

SEQ ID NO: 1642001 - RNA, 16 nt, Homo sapiens
uuuccaaucauacaaa

SEQ ID NO: 1642002 - RNA, 17 nt, Homo sapiens
uuucccugcuagggguu

SEQ ID NO: 1642003 - RNA, 20 nt, Homo sapiens
uuuccugcgccccagacucc

SEQ ID NO: 1642004 - RNA, 24 nt, Homo sapiens
uuuccuggcacugcuuccagugag

SEQ ID NO: 1642005 - RNA, 12 nt, Homo sapiens
uuucuaucauuc

SEQ ID NO: 1642006 - RNA, 20 nt, Homo sapiens
uuucuauuaaaagacucauc

SEQ ID NO: 1642007 - RNA, 15 nt, Homo sapiens
uuucuccuucacagc

SEQ ID NO: 1642008 - RNA, 22 nt, Homo sapiens
uuucugucacaucagcuccacu

SEQ ID NO: 1642009 - RNA, 17 nt, Homo sapiens
uuucuuaauuuguaacu

SEQ ID NO: 1642010 - RNA, 17 nt, Homo sapiens
uuucuuuugcugaucuu

SEQ ID NO: 1642011 - RNA, 12 nt, Homo sapiens
uuugaaauccaa

SEQ ID NO: 1642012 - RNA, 14 nt, Homo sapiens
uuugaaauccaaag

SEQ ID NO: 1642013 - RNA, 16 nt, Homo sapiens
uuugaaucacaguaua

SEQ ID NO: 1642014 - RNA, 19 nt, Homo sapiens
uuugaccuguggugcaaaa

SEQ ID NO: 1642015 - RNA, 13 nt, Homo sapiens
uuugauauuugca

SEQ ID NO: 1642016 - RNA, 15 nt, Homo sapiens
uuugauuauucagug

SEQ ID NO: 1642017 - RNA, 14 nt, Homo sapiens
uuugcagacaggca

SEQ ID NO: 1642018 - RNA, 19 nt, Homo sapiens
uuugcauaagugcaugaca

SEQ ID NO: 1642019 - RNA, 22 nt, Homo sapiens
uuugcaucagcaacaaccagca

SEQ ID NO: 1642020 - RNA, 19 nt, Homo sapiens
uuugccacccucaugcugu

SEQ ID NO: 1642021 - RNA, 23 nt, Homo sapiens
uuugcugacuuuaaaaggauuaa

SEQ ID NO: 1642022 - RNA, 15 nt, Homo sapiens
uuuggaauauuccac

SEQ ID NO: 1642023 - RNA, 12 nt, Homo sapiens
uuuggagacaga

SEQ ID NO: 1642024 - RNA, 21 nt, Homo sapiens
uuuggcccaaacucaucuuga

SEQ ID NO: 1642025 - RNA, 15 nt, Homo sapiens
uuuggccuccuccag

SEQ ID NO: 1642026 - RNA, 20 nt, Homo sapiens
uuugggaacugcaauaaccu

SEQ ID NO: 1642027 - RNA, 16 nt, Homo sapiens
uuugggcagacccuga

SEQ ID NO: 1642028 - RNA, 22 nt, Homo sapiens
uuugggggggaauaagauuaua

SEQ ID NO: 1642029 - RNA, 18 nt, Homo sapiens
uuugggguaauacuucca

SEQ ID NO: 1642030 - RNA, 22 nt, Homo sapiens
uuugguuuguugagccuaauau

SEQ ID NO: 1642031 - RNA, 21 nt, Homo sapiens
uuuguagagccagggucucac

SEQ ID NO: 1642032 - RNA, 17 nt, Homo sapiens
uuuguauaaaaguguga

SEQ ID NO: 1642033 - RNA, 19 nt, Homo sapiens
uuuguauaccaugaugcau

SEQ ID NO: 1642034 - RNA, 20 nt, Homo sapiens
uuugugcaaaagcaggcuug

SEQ ID NO: 1642035 - RNA, 17 nt, Homo sapiens
uuugugugcgucacugu

SEQ ID NO: 1642036 - RNA, 20 nt, Homo sapiens
uuuguuuuguaucauuauga

SEQ ID NO: 1642037 - RNA, 18 nt, Homo sapiens
agaaguuaauccacaucu

SEQ ID NO: 1642038 - RNA, 20 nt, Homo sapiens
agaaguuggucuuacuuugu

SEQ ID NO: 1642039 - RNA, 15 nt, Homo sapiens
agaauauauuuccuu

SEQ ID NO: 1642040 - RNA, 21 nt, Homo sapiens
agaauauuccuacuugcagua

SEQ ID NO: 1642041 - RNA, 14 nt, Homo sapiens
agaaucacagaaca

SEQ ID NO: 1642042 - RNA, 22 nt, Homo sapiens
agaaucaguguguuacuaucua

SEQ ID NO: 1642043 - RNA, 15 nt, Homo sapiens
agaaucguguugaca

SEQ ID NO: 1642044 - RNA, 22 nt, Homo sapiens
agaaucuguuucccagcagugg

SEQ ID NO: 1642045 - RNA, 13 nt, Homo sapiens
agaauggaacuca

SEQ ID NO: 1642046 - RNA, 15 nt, Homo sapiens
agaauggaaggugga

SEQ ID NO: 1642047 - RNA, 18 nt, Homo sapiens
agaauuugagugcucuga

SEQ ID NO: 1642048 - RNA, 21 nt, Homo sapiens
agacaagcucaaguguucaca

SEQ ID NO: 1642049 - RNA, 19 nt, Homo sapiens
agacacaacaacuccuagg

SEQ ID NO: 1642050 - RNA, 17 nt, Homo sapiens
agacaccuugacagggc

SEQ ID NO: 1642051 - RNA, 18 nt, Homo sapiens
agacaccuugacagggca

SEQ ID NO: 1642052 - RNA, 20 nt, Homo sapiens
agacagaguuuucacucuua

SEQ ID NO: 1642053 - RNA, 16 nt, Homo sapiens
agacagcccuccaucu

SEQ ID NO: 1642054 - RNA, 18 nt, Homo sapiens
agacaggguuuugccaug

SEQ ID NO: 1642055 - RNA, 22 nt, Homo sapiens
agacaugaaauaaaagcuuugc

SEQ ID NO: 1642056 - RNA, 12 nt, Homo sapiens
agacaugaacug

SEQ ID NO: 1642057 - RNA, 22 nt, Homo sapiens
agaccucuagacugguucauuc

SEQ ID NO: 1642058 - RNA, 22 nt, Homo sapiens
agaccugcucuggacacuugcu

SEQ ID NO: 1642059 - RNA, 15 nt, Homo sapiens
agaccuucuccuuca

SEQ ID NO: 1642060 - RNA, 20 nt, Homo sapiens
agacgggguuucaccauguu

SEQ ID NO: 1642061 - RNA, 13 nt, Homo sapiens
agacuaaggccau

SEQ ID NO: 1642062 - RNA, 22 nt, Homo sapiens
agacuaugaggaauauuugcaa

SEQ ID NO: 1642063 - RNA, 15 nt, Homo sapiens
agacuaugucaccca

SEQ ID NO: 1642064 - RNA, 18 nt, Homo sapiens
agacuccacacucaguag

SEQ ID NO: 1642065 - RNA, 13 nt, Homo sapiens
agcucacguguau

SEQ ID NO: 1642066 - RNA, 12 nt, Homo sapiens
agcucagguguc

SEQ ID NO: 1642067 - RNA, 22 nt, Homo sapiens
agcucaggugucccugcacuug

SEQ ID NO: 1642068 - RNA, 18 nt, Homo sapiens
agcuccuguggccacagc

SEQ ID NO: 1642069 - RNA, 16 nt, Homo sapiens
agcucuaguauuucca

SEQ ID NO: 1642070 - RNA, 18 nt, Homo sapiens
agcucuaucaccaaggag

SEQ ID NO: 1642071 - RNA, 23 nt, Homo sapiens
agcucugaaaccaguguuaggga

SEQ ID NO: 1642072 - RNA, 19 nt, Homo sapiens
agcucugcuccucucccca

SEQ ID NO: 1642073 - RNA, 14 nt, Homo sapiens
agcucuugugaaua

SEQ ID NO: 1642074 - RNA, 19 nt, Homo sapiens
agcugacaguccucuccac

SEQ ID NO: 1642075 - RNA, 23 nt, Homo sapiens
agcugauacaaauugcagacugu

SEQ ID NO: 1642076 - RNA, 20 nt, Homo sapiens
agcugauggggcaaacucaa

SEQ ID NO: 1642077 - RNA, 22 nt, Homo sapiens
agcugauuucagugcugcugaa

SEQ ID NO: 1642078 - RNA, 15 nt, Homo sapiens
agcugccaccaucac

SEQ ID NO: 1642079 - RNA, 15 nt, Homo sapiens
agcugcccccagugg

SEQ ID NO: 1642080 - RNA, 19 nt, Homo sapiens
agcugccugggaggcagau

SEQ ID NO: 1642081 - RNA, 16 nt, Homo sapiens
agcugcuggcugugac

SEQ ID NO: 1642082 - RNA, 17 nt, Homo sapiens
agcuggaacuacaagga

SEQ ID NO: 1642083 - RNA, 23 nt, Homo sapiens
agcuggauuggguuaugaauauu

SEQ ID NO: 1642084 - RNA, 18 nt, Homo sapiens
agcugggacuacaggcac

SEQ ID NO: 1642085 - RNA, 16 nt, Homo sapiens
agcugggcagcuggaa

SEQ ID NO: 1642086 - RNA, 13 nt, Homo sapiens
agcugggggucaa

SEQ ID NO: 1642087 - RNA, 20 nt, Homo sapiens
agcuggugguaucugaguug

SEQ ID NO: 1642088 - RNA, 17 nt, Homo sapiens
agcuguucugucccuug

SEQ ID NO: 1642089 - RNA, 22 nt, Homo sapiens
agcuguuguacauuuaugauuu

SEQ ID NO: 1642090 - RNA, 13 nt, Homo sapiens
agcuuaagaauuu

SEQ ID NO: 1642091 - RNA, 16 nt, Homo sapiens
agcuuauggcaucuca

SEQ ID NO: 1642092 - RNA, 20 nt, Homo sapiens
agcuuauggcaucucauuga

SEQ ID NO: 1642093 - RNA, 20 nt, Homo sapiens
agcuuccagagcucugaccc

SEQ ID NO: 1642094 - RNA, 18 nt, Homo sapiens
agcuucugccacuuccca

SEQ ID NO: 1642095 - RNA, 23 nt, Homo sapiens
agcuucuguugcugccucaugcu

SEQ ID NO: 1642096 - RNA, 20 nt, Homo sapiens
agcuuggggaagacccauuc

SEQ ID NO: 1642097 - RNA, 22 nt, Homo sapiens
agcuuucauguaaacugugcac

SEQ ID NO: 1642098 - RNA, 19 nt, Homo sapiens
aggaaacuaauacaauaca

SEQ ID NO: 1642099 - RNA, 15 nt, Homo sapiens
aggaaagauuuuguu

SEQ ID NO: 1642100 - RNA, 14 nt, Homo sapiens
aggaaaggcuccag

SEQ ID NO: 1642101 - RNA, 13 nt, Homo sapiens
aggaacacuccuu

SEQ ID NO: 1642102 - RNA, 13 nt, Homo sapiens
aggaacauacaga

SEQ ID NO: 1642103 - RNA, 22 nt, Homo sapiens
aggaagaacggggcucuucuca

SEQ ID NO: 1642104 - RNA, 22 nt, Homo sapiens
aggaagaccccagcacagacuc

SEQ ID NO: 1642105 - RNA, 23 nt, Homo sapiens
aggaaggguaagggaaaggaugg

SEQ ID NO: 1642106 - RNA, 19 nt, Homo sapiens
aggacaagacccucucagg

SEQ ID NO: 1642107 - RNA, 15 nt, Homo sapiens
aggacacagaugaaa

SEQ ID NO: 1642108 - RNA, 18 nt, Homo sapiens
aggacagggaggugaccc

SEQ ID NO: 1642109 - RNA, 21 nt, Homo sapiens
aggacagggaggugaccccag

SEQ ID NO: 1642110 - RNA, 11 nt, Homo sapiens
aggacugguaa

SEQ ID NO: 1642111 - RNA, 19 nt, Homo sapiens
aggagccggacacuucuca

SEQ ID NO: 1642112 - RNA, 20 nt, Homo sapiens
aggagccggacacuucucag

SEQ ID NO: 1642113 - RNA, 23 nt, Homo sapiens
aggagcugauacuuugacagugu

SEQ ID NO: 1642114 - RNA, 14 nt, Homo sapiens
aggauaucuucucc

SEQ ID NO: 1642115 - RNA, 24 nt, Homo sapiens
aggauauguucacaccuagcguca

SEQ ID NO: 1642116 - RNA, 21 nt, Homo sapiens
aggauauugggucagugucca

SEQ ID NO: 1642117 - RNA, 20 nt, Homo sapiens
aggaucucacggaccauccg

SEQ ID NO: 1642118 - RNA, 22 nt, Homo sapiens
aggaugaucuaggaagacuuug

SEQ ID NO: 1642119 - RNA, 17 nt, Homo sapiens
aggauucccccaacaca

SEQ ID NO: 1642120 - RNA, 20 nt, Homo sapiens
aggauugggaaaaaguaauu

SEQ ID NO: 1642121 - RNA, 19 nt, Homo sapiens
aggcaaaugcccaagggaa

SEQ ID NO: 1642122 - RNA, 17 nt, Homo sapiens
aggcaaggggcauuuca

SEQ ID NO: 1642123 - RNA, 17 nt, Homo sapiens
aggcacaagccaaggaa

SEQ ID NO: 1642124 - RNA, 13 nt, Homo sapiens
aggcacagaugaa

SEQ ID NO: 1642125 - RNA, 17 nt, Homo sapiens
aggcacugccugaugga

SEQ ID NO: 1642126 - RNA, 18 nt, Homo sapiens
aggcauuuggcauuuauu

SEQ ID NO: 1642127 - RNA, 21 nt, Homo sapiens
aggccauugggauauucugaa

SEQ ID NO: 1642128 - RNA, 22 nt, Homo sapiens
aggccccucuccuccguggcac

SEQ ID NO: 1642129 - RNA, 23 nt, Homo sapiens
aggcccggccaaaauaaugcacc

SEQ ID NO: 1642130 - RNA, 12 nt, Homo sapiens
aggcccucgcug

SEQ ID NO: 1642131 - RNA, 16 nt, Homo sapiens
aggcccuucucuccag

SEQ ID NO: 1642132 - RNA, 16 nt, Homo sapiens
aggccucccacaguga

SEQ ID NO: 1642133 - RNA, 15 nt, Homo sapiens
aggccucuguggcac

SEQ ID NO: 1642134 - RNA, 18 nt, Homo sapiens
aggccugccuucucaggg

SEQ ID NO: 1642135 - RNA, 22 nt, Homo sapiens
aggcggaucuuuggacagaagc

SEQ ID NO: 1642136 - RNA, 22 nt, Homo sapiens
aggcuccagagggcacucugcu

SEQ ID NO: 1642137 - RNA, 15 nt, Homo sapiens
aggcugaaagacagg

SEQ ID NO: 1642138 - RNA, 16 nt, Homo sapiens
aggcuggagugcaaug

SEQ ID NO: 1642139 - RNA, 14 nt, Homo sapiens
aggcuggcccugcc

SEQ ID NO: 1642140 - RNA, 18 nt, Homo sapiens
aggcuggggaaguccucu

SEQ ID NO: 1642141 - RNA, 16 nt, Homo sapiens
agggaaaacauuccau

SEQ ID NO: 1642142 - RNA, 18 nt, Homo sapiens
agggaaaacauuccaucc

SEQ ID NO: 1642143 - RNA, 18 nt, Homo sapiens
agggaaaauuauuugcau

SEQ ID NO: 1642144 - RNA, 20 nt, Homo sapiens
aaugccugagugccuggcca

SEQ ID NO: 1642145 - RNA, 20 nt, Homo sapiens
aaugccuuugagacaguuuc

SEQ ID NO: 1642146 - RNA, 13 nt, Homo sapiens
aaugccuuuuugu

SEQ ID NO: 1642147 - RNA, 23 nt, Homo sapiens
aaugcguggcacaucuaaauuga

SEQ ID NO: 1642148 - RNA, 16 nt, Homo sapiens
aaugcuaaccuuguag

SEQ ID NO: 1642149 - RNA, 17 nt, Homo sapiens
aaugcuauaacuauguu

SEQ ID NO: 1642150 - RNA, 17 nt, Homo sapiens
aaugcucaaccuaacca

SEQ ID NO: 1642151 - RNA, 15 nt, Homo sapiens
aaugggaaaaccaga

SEQ ID NO: 1642152 - RNA, 23 nt, Homo sapiens
aauggggccuguuacacaugaca

SEQ ID NO: 1642153 - RNA, 17 nt, Homo sapiens
aauggggugcaugaagg

SEQ ID NO: 1642154 - RNA, 23 nt, Homo sapiens
aauggguaucuaauaaauacuua

SEQ ID NO: 1642155 - RNA, 20 nt, Homo sapiens
aaugguuugugucaaaacug

SEQ ID NO: 1642156 - RNA, 15 nt, Homo sapiens
aauguaugugcacau

SEQ ID NO: 1642157 - RNA, 19 nt, Homo sapiens
aaugucaauucuugccaaa

SEQ ID NO: 1642158 - RNA, 18 nt, Homo sapiens
aaugucauacugccuuga

SEQ ID NO: 1642159 - RNA, 12 nt, Homo sapiens
aaugucuuuauu

SEQ ID NO: 1642160 - RNA, 14 nt, Homo sapiens
aaugugacuacuua

SEQ ID NO: 1642161 - RNA, 22 nt, Homo sapiens
aaugugauaauauauugcuaaa

SEQ ID NO: 1642162 - RNA, 21 nt, Homo sapiens
aauguggaaaacauccugacu

SEQ ID NO: 1642163 - RNA, 14 nt, Homo sapiens
aaugugucugcaac

SEQ ID NO: 1642164 - RNA, 17 nt, Homo sapiens
aauguguggcugaagac

SEQ ID NO: 1642165 - RNA, 19 nt, Homo sapiens
aauguuaaggaaacucuua

SEQ ID NO: 1642166 - RNA, 23 nt, Homo sapiens
aauguuaguauuuuaauccugua

SEQ ID NO: 1642167 - RNA, 23 nt, Homo sapiens
acagcugcucaauaaaguacaag

SEQ ID NO: 1642168 - RNA, 20 nt, Homo sapiens
acagcugcuggagacuccua

SEQ ID NO: 1642169 - RNA, 22 nt, Homo sapiens
acagcugcuggagacuccuagg

SEQ ID NO: 1642170 - RNA, 23 nt, Homo sapiens
acaggaccuaggauaucuucucc

SEQ ID NO: 1642171 - RNA, 19 nt, Homo sapiens
acaggagaaugcacagugg

SEQ ID NO: 1642172 - RNA, 14 nt, Homo sapiens
acaggcaagcaccu

SEQ ID NO: 1642173 - RNA, 13 nt, Homo sapiens
acaggcacccacc

SEQ ID NO: 1642174 - RNA, 13 nt, Homo sapiens
acaggcaccugcc

SEQ ID NO: 1642175 - RNA, 17 nt, Homo sapiens
acaggcaccugccaaca

SEQ ID NO: 1642176 - RNA, 19 nt, Homo sapiens
acaggcccggcuccaggcu

SEQ ID NO: 1642177 - RNA, 23 nt, Homo sapiens
acaggcugauaccuuugugaagu

SEQ ID NO: 1642178 - RNA, 20 nt, Homo sapiens
acaggcuuguuaccaccaug

SEQ ID NO: 1642179 - RNA, 22 nt, Homo sapiens
acagggaaugccugagugccug

SEQ ID NO: 1642180 - RNA, 17 nt, Homo sapiens
acagguguuggugacaa

SEQ ID NO: 1642181 - RNA, 18 nt, Homo sapiens
acaguacccaaacugcuu

SEQ ID NO: 1642182 - RNA, 15 nt, Homo sapiens
acaguaugucccaua

SEQ ID NO: 1642183 - RNA, 19 nt, Homo sapiens
acagucaccccaggacuca

SEQ ID NO: 1642184 - RNA, 18 nt, Homo sapiens
acagucuuccauuugcaa

SEQ ID NO: 1642185 - RNA, 20 nt, Homo sapiens
acagucuugcagcaggaucu

SEQ ID NO: 1642186 - RNA, 16 nt, Homo sapiens
acagugccuauugaua

SEQ ID NO: 1642187 - RNA, 20 nt, Homo sapiens
acaguucggugagcuacaaa

SEQ ID NO: 1642188 - RNA, 18 nt, Homo sapiens
acaguucuugugugguuu

SEQ ID NO: 1642189 - RNA, 17 nt, Homo sapiens
acaguuuuagaauacau

SEQ ID NO: 1642190 - RNA, 13 nt, Homo sapiens
acauaaaauccaa

SEQ ID NO: 1642191 - RNA, 23 nt, Homo sapiens
acauaacucugcugaauguaaaa

SEQ ID NO: 1642192 - RNA, 12 nt, Homo sapiens
acauacagugau

SEQ ID NO: 1642193 - RNA, 15 nt, Homo sapiens
acauacguacuuuuc

SEQ ID NO: 1642194 - RNA, 14 nt, Homo sapiens
acauacucccaucu

SEQ ID NO: 1642195 - RNA, 12 nt, Homo sapiens
acauaguccagu

SEQ ID NO: 1642196 - RNA, 13 nt, Homo sapiens
acauaucugucau

SEQ ID NO: 1642197 - RNA, 14 nt, Homo sapiens
acauauuaagaaua

SEQ ID NO: 1642198 - RNA, 12 nt, Homo sapiens
acauauuuagcg

SEQ ID NO: 1642199 - RNA, 23 nt, Homo sapiens
acaucauggaggguuuagugcuu

SEQ ID NO: 1642200 - RNA, 15 nt, Homo sapiens
acauccauguuccga

SEQ ID NO: 1642201 - RNA, 11 nt, Homo sapiens
acaucccucag

SEQ ID NO: 1642202 - RNA, 18 nt, Homo sapiens
acaucuugcucugcugac

SEQ ID NO: 1642203 - RNA, 16 nt, Homo sapiens
acaucuuggcacauuu

SEQ ID NO: 1642204 - RNA, 14 nt, Homo sapiens
acaugaacugccag

SEQ ID NO: 1642205 - RNA, 19 nt, Homo sapiens
acaugaauuucauugaacu

SEQ ID NO: 1642206 - RNA, 15 nt, Homo sapiens
acaugcacgugugug

SEQ ID NO: 1642207 - RNA, 16 nt, Homo sapiens
acaugcagcucugcag

SEQ ID NO: 1642208 - RNA, 14 nt, Homo sapiens
acaugccaagcacu

SEQ ID NO: 1642209 - RNA, 18 nt, Homo sapiens
acaugcugaagccaaagc

SEQ ID NO: 1642210 - RNA, 21 nt, Homo sapiens
acaugcugaagccaaagccaa

SEQ ID NO: 1642211 - RNA, 10 nt, Homo sapiens
acaugggagc

SEQ ID NO: 1642212 - RNA, 14 nt, Homo sapiens
acaugguccuagca

SEQ ID NO: 1642213 - RNA, 17 nt, Homo sapiens
acauggugaaacuccau

SEQ ID NO: 1642214 - RNA, 19 nt, Homo sapiens
acauguacuguuacugugu

SEQ ID NO: 1642215 - RNA, 22 nt, Homo sapiens
acauguauguggauacagucau

SEQ ID NO: 1642216 - RNA, 12 nt, Homo sapiens
acaugugcacau

SEQ ID NO: 1642217 - RNA, 16 nt, Homo sapiens
acaugugcacaugcac

SEQ ID NO: 1642218 - RNA, 15 nt, Homo sapiens
acaugugcacuugaa

SEQ ID NO: 1642219 - RNA, 21 nt, Homo sapiens
acaugugucccagccacagug

SEQ ID NO: 1642220 - RNA, 23 nt, Homo sapiens
acauguuagucaaggacugguaa

SEQ ID NO: 1642221 - RNA, 21 nt, Homo sapiens
acauuacagggaaugccugag

SEQ ID NO: 1642222 - RNA, 13 nt, Homo sapiens
acauuaucucacu

SEQ ID NO: 1642223 - RNA, 20 nt, Homo sapiens
acauucuacacacagugccu

SEQ ID NO: 1642224 - RNA, 19 nt, Homo sapiens
acauugaaacuacacuaaa

SEQ ID NO: 1642225 - RNA, 23 nt, Homo sapiens
acauuguacuuauacaccuuauu

SEQ ID NO: 1642226 - RNA, 15 nt, Homo sapiens
acauuuaguccugua

SEQ ID NO: 1642227 - RNA, 18 nt, Homo sapiens
acauuuauucugcucaca

SEQ ID NO: 1642228 - RNA, 23 nt, Homo sapiens
acauuugguuuguugagccuaau

SEQ ID NO: 1642229 - RNA, 14 nt, Homo sapiens
acauuuuguauauu

SEQ ID NO: 1642230 - RNA, 16 nt, Homo sapiens
acauuuuuguacuaac

SEQ ID NO: 1642231 - RNA, 19 nt, Homo sapiens
accaaaauccccuucucau

SEQ ID NO: 1642232 - RNA, 12 nt, Homo sapiens
accaaaguccag

SEQ ID NO: 1642233 - RNA, 14 nt, Homo sapiens
accaaaucacugaa

SEQ ID NO: 1642234 - RNA, 11 nt, Homo sapiens
accaaaucauc

SEQ ID NO: 1642235 - RNA, 14 nt, Homo sapiens
accaaaucaucucu

SEQ ID NO: 1642236 - RNA, 18 nt, Homo sapiens
accaaggagccaaacauc

SEQ ID NO: 1642237 - RNA, 12 nt, Homo sapiens
accaagggcaga

SEQ ID NO: 1642238 - RNA, 16 nt, Homo sapiens
accaauauuguacagu

SEQ ID NO: 1642239 - RNA, 20 nt, Homo sapiens
accacagcaaggcaccugca

SEQ ID NO: 1642240 - RNA, 11 nt, Homo sapiens
accacaugcca

SEQ ID NO: 1642241 - RNA, 13 nt, Homo sapiens
accacaugccaag

SEQ ID NO: 1642242 - RNA, 15 nt, Homo sapiens
accacaugugcacau

SEQ ID NO: 1642243 - RNA, 14 nt, Homo sapiens
accacuauucuuaa

SEQ ID NO: 1642244 - RNA, 15 nt, Homo sapiens
accacuguacuccag

SEQ ID NO: 1642245 - RNA, 20 nt, Homo sapiens
accacuguggaagucccuca

SEQ ID NO: 1642246 - RNA, 14 nt, Homo sapiens
accacuuuuaacag

SEQ ID NO: 1642247 - RNA, 17 nt, Homo sapiens
accacuuuuugcagcuu

SEQ ID NO: 1642248 - RNA, 18 nt, Homo sapiens
accagagaauggacacca

SEQ ID NO: 1642249 - RNA, 18 nt, Homo sapiens
accagccuggcccacccc

SEQ ID NO: 1642250 - RNA, 18 nt, Homo sapiens
accaggcaaagcaaguga

SEQ ID NO: 1642251 - RNA, 22 nt, Homo sapiens
accagguagaacacaaggucau

SEQ ID NO: 1642252 - RNA, 13 nt, Homo sapiens
acuccaucucuac

SEQ ID NO: 1642253 - RNA, 12 nt, Homo sapiens
acucccacuucc

SEQ ID NO: 1642254 - RNA, 16 nt, Homo sapiens
acuccuaggcaggaca

SEQ ID NO: 1642255 - RNA, 23 nt, Homo sapiens
acucgccuucaucucccaaagug

SEQ ID NO: 1642256 - RNA, 17 nt, Homo sapiens
acucucgcacacacagu

SEQ ID NO: 1642257 - RNA, 12 nt, Homo sapiens
acucugaaccac

SEQ ID NO: 1642258 - RNA, 15 nt, Homo sapiens
acucugcucucagga

SEQ ID NO: 1642259 - RNA, 13 nt, Homo sapiens
acucuucacggaa

SEQ ID NO: 1642260 - RNA, 15 nt, Homo sapiens
acucuucugaauuga

SEQ ID NO: 1642261 - RNA, 13 nt, Homo sapiens
acugaaauggacu

SEQ ID NO: 1642262 - RNA, 14 nt, Homo sapiens
acugaacauuccag

SEQ ID NO: 1642263 - RNA, 22 nt, Homo sapiens
acugaauagauaugaaagcuga

SEQ ID NO: 1642264 - RNA, 16 nt, Homo sapiens
acugacauuguuggcc

SEQ ID NO: 1642265 - RNA, 13 nt, Homo sapiens
acugagacuugaa

SEQ ID NO: 1642266 - RNA, 12 nt, Homo sapiens
acugagccagca

SEQ ID NO: 1642267 - RNA, 18 nt, Homo sapiens
acugagucuggcaaacau

SEQ ID NO: 1642268 - RNA, 20 nt, Homo sapiens
acugauccaguauaagacua

SEQ ID NO: 1642269 - RNA, 14 nt, Homo sapiens
acugcaaaucugcc

SEQ ID NO: 1642270 - RNA, 12 nt, Homo sapiens
acugcaagcucc

SEQ ID NO: 1642271 - RNA, 21 nt, Homo sapiens
acugcacagaagacagcagca

SEQ ID NO: 1642272 - RNA, 20 nt, Homo sapiens
acugcacuauagccuaggug

SEQ ID NO: 1642273 - RNA, 18 nt, Homo sapiens
acugcagcuaacuuauca

SEQ ID NO: 1642274 - RNA, 22 nt, Homo sapiens
acugcagggaaaauuauuugca

SEQ ID NO: 1642275 - RNA, 23 nt, Homo sapiens
acugcagggaaaauuauuugcau

SEQ ID NO: 1642276 - RNA, 18 nt, Homo sapiens
acugccaaagaacuugga

SEQ ID NO: 1642277 - RNA, 16 nt, Homo sapiens
acugccacagaacugg

SEQ ID NO: 1642278 - RNA, 21 nt, Homo sapiens
acugccaucuuggacuuguca

SEQ ID NO: 1642279 - RNA, 13 nt, Homo sapiens
aguaaugaugucg

SEQ ID NO: 1642280 - RNA, 22 nt, Homo sapiens
aguaaugcaagcaaaguaucaa

SEQ ID NO: 1642281 - RNA, 17 nt, Homo sapiens
aguacaagagcuuaaca

SEQ ID NO: 1642282 - RNA, 12 nt, Homo sapiens
aguacaggugaa

SEQ ID NO: 1642283 - RNA, 20 nt, Homo sapiens
aguacccuuggccuuuacag

SEQ ID NO: 1642284 - RNA, 14 nt, Homo sapiens
aguaccucugcuau

SEQ ID NO: 1642285 - RNA, 18 nt, Homo sapiens
aguagcaacccugugaua

SEQ ID NO: 1642286 - RNA, 18 nt, Homo sapiens
aguaggaagacuuuggaa

SEQ ID NO: 1642287 - RNA, 18 nt, Homo sapiens
aguauuuuaauccuguac

SEQ ID NO: 1642288 - RNA, 21 nt, Homo sapiens
agucaaccugccugacauuug

SEQ ID NO: 1642289 - RNA, 13 nt, Homo sapiens
agucacagagaua

SEQ ID NO: 1642290 - RNA, 18 nt, Homo sapiens
agucaccagccagaggau

SEQ ID NO: 1642291 - RNA, 21 nt, Homo sapiens
agucagacuccuagacucacu

SEQ ID NO: 1642292 - RNA, 23 nt, Homo sapiens
agucaggugggguggagucccag

SEQ ID NO: 1642293 - RNA, 22 nt, Homo sapiens
agucaguuucuaucauucugcu

SEQ ID NO: 1642294 - RNA, 17 nt, Homo sapiens
agucauucucaccuaaa

SEQ ID NO: 1642295 - RNA, 20 nt, Homo sapiens
aguccaaggaaaccacagcu

SEQ ID NO: 1642296 - RNA, 20 nt, Homo sapiens
aguccagccuggagaugaaa

SEQ ID NO: 1642297 - RNA, 13 nt, Homo sapiens
agucggagccacu

SEQ ID NO: 1642298 - RNA, 15 nt, Homo sapiens
agucucucucugcca

SEQ ID NO: 1642299 - RNA, 14 nt, Homo sapiens
agucugaagcacuc

SEQ ID NO: 1642300 - RNA, 17 nt, Homo sapiens
agucugauucccaagcu

SEQ ID NO: 1642301 - RNA, 20 nt, Homo sapiens
agucuucagcagagaaguuu

SEQ ID NO: 1642302 - RNA, 22 nt, Homo sapiens
agucuucauaauuucuucacuc

SEQ ID NO: 1642303 - RNA, 14 nt, Homo sapiens
agucuucuauuuau

SEQ ID NO: 1642304 - RNA, 16 nt, Homo sapiens
agugaaaaggcugccu

SEQ ID NO: 1642305 - RNA, 16 nt, Homo sapiens
agugaaauauaugcua

SEQ ID NO: 1642306 - RNA, 19 nt, Homo sapiens
agugaauaaaccaucaucu

SEQ ID NO: 1642307 - RNA, 15 nt, Homo sapiens
agugaauuguugaca

SEQ ID NO: 1642308 - RNA, 20 nt, Homo sapiens
agugacuguucaagagcaca

SEQ ID NO: 1642309 - RNA, 18 nt, Homo sapiens
agugagacuccaccucaa

SEQ ID NO: 1642310 - RNA, 24 nt, Homo sapiens
agugagacuuugaggguguauauu

SEQ ID NO: 1642311 - RNA, 15 nt, Homo sapiens
agugagugaucacug

SEQ ID NO: 1642312 - RNA, 17 nt, Homo sapiens
agugauggguuagugga

SEQ ID NO: 1642313 - RNA, 15 nt, Homo sapiens
agugauuccaucaaa

SEQ ID NO: 1642314 - RNA, 19 nt, Homo sapiens
agugauucucaugccucag

SEQ ID NO: 1642315 - RNA, 21 nt, Homo sapiens
agugcacaacauuacagggaa

SEQ ID NO: 1642316 - RNA, 21 nt, Homo sapiens
agugcacuaauucugcaucug

SEQ ID NO: 1642317 - RNA, 16 nt, Homo sapiens
agugcaggcacaguau

SEQ ID NO: 1642318 - RNA, 21 nt, Homo sapiens
agugcagugagccgagaucac

SEQ ID NO: 1642319 - RNA, 17 nt, Homo sapiens
agugccuggccaaaggg

SEQ ID NO: 1642320 - RNA, 21 nt, Homo sapiens
agugcugggauuacaggugug

SEQ ID NO: 1642321 - RNA, 21 nt, Homo sapiens
agugcuugauugcguggaauu

SEQ ID NO: 1642322 - RNA, 18 nt, Homo sapiens
aguggcaccaccauggcu

SEQ ID NO: 1642323 - RNA, 19 nt, Homo sapiens
agugggggugggggguccc

SEQ ID NO: 1642324 - RNA, 17 nt, Homo sapiens
agugggucccacuuccc

SEQ ID NO: 1642325 - RNA, 18 nt, Homo sapiens
agugggucccacuucccc

SEQ ID NO: 1642326 - RNA, 14 nt, Homo sapiens
aguguggccugagu

SEQ ID NO: 1642327 - RNA, 15 nt, Homo sapiens
aguguguugacuucu

SEQ ID NO: 1642328 - RNA, 20 nt, Homo sapiens
aguguuccccuuccacugag

SEQ ID NO: 1642329 - RNA, 17 nt, Homo sapiens
aguguuugaaagcuuua

SEQ ID NO: 1642330 - RNA, 13 nt, Homo sapiens
aguuaaaaguaaa

SEQ ID NO: 1642331 - RNA, 18 nt, Homo sapiens
aguuaagaagcuguugua

SEQ ID NO: 1642332 - RNA, 19 nt, Homo sapiens
aguuaauccacaucuuuac

SEQ ID NO: 1642333 - RNA, 16 nt, Homo sapiens
aguuagagcugacaca

SEQ ID NO: 1642334 - RNA, 22 nt, Homo sapiens
aguucagaaucacuucugagaa

SEQ ID NO: 1642335 - RNA, 15 nt, Homo sapiens
aguuccgacugccau

SEQ ID NO: 1642336 - RNA, 22 nt, Homo sapiens
aguuccgacugccaucuuggac

SEQ ID NO: 1642337 - RNA, 16 nt, Homo sapiens
aguuccuuucaauggu

SEQ ID NO: 1642338 - RNA, 14 nt, Homo sapiens
aguucucaauuuca

SEQ ID NO: 1642339 - RNA, 18 nt, Homo sapiens
aguugauucauauugcau

SEQ ID NO: 1642340 - RNA, 13 nt, Homo sapiens
aguugcaccauuc

SEQ ID NO: 1642341 - RNA, 12 nt, Homo sapiens
aguugccuuuau

SEQ ID NO: 1642342 - RNA, 22 nt, Homo sapiens
aguuguuuuaauaacuuaucua

SEQ ID NO: 1642343 - RNA, 17 nt, Homo sapiens
aguuguuuuuauucuuc

SEQ ID NO: 1642344 - RNA, 16 nt, Homo sapiens
aguuuagggucaagga

SEQ ID NO: 1642345 - RNA, 14 nt, Homo sapiens
aguuucaggugaca

SEQ ID NO: 1642346 - RNA, 18 nt, Homo sapiens
aguuucuaucauucugcu

SEQ ID NO: 1642347 - RNA, 18 nt, Homo sapiens
aguuucuuccauucccau

SEQ ID NO: 1642348 - RNA, 14 nt, Homo sapiens
aguuugacugugcu

SEQ ID NO: 1642349 - RNA, 21 nt, Homo sapiens
aguuugugaaugugacuacuu

SEQ ID NO: 1642350 - RNA, 23 nt, Homo sapiens
aguuuuuuuuuauacacuguaau

SEQ ID NO: 1642351 - RNA, 19 nt, Homo sapiens
auaaaaaaguguccuauaa

SEQ ID NO: 1642352 - RNA, 21 nt, Homo sapiens
auaaaaagauguucagucauu

SEQ ID NO: 1642353 - RNA, 17 nt, Homo sapiens
auaaaaauaacaucauu

SEQ ID NO: 1642354 - RNA, 20 nt, Homo sapiens
auaaaagaauuacauaugaa

SEQ ID NO: 1642355 - RNA, 15 nt, Homo sapiens
auaaaagacagugaa

SEQ ID NO: 1642356 - RNA, 14 nt, Homo sapiens
auaaagcagcucag

SEQ ID NO: 1642357 - RNA, 12 nt, Homo sapiens
aaaaaacagugg

SEQ ID NO: 1642358 - RNA, 11 nt, Homo sapiens
aaaaaugcacc

SEQ ID NO: 1642359 - RNA, 17 nt, Homo sapiens
aaaaaugugacucaaga

SEQ ID NO: 1642360 - RNA, 14 nt, Homo sapiens
aaucuuuucacaaa

SEQ ID NO: 1642361 - RNA, 17 nt, Homo sapiens
aaucuuuucacaaauaa

SEQ ID NO: 1642362 - RNA, 16 nt, Homo sapiens
aaugacauuuugccaa

SEQ ID NO: 1642363 - RNA, 16 nt, Homo sapiens
aaugaguauuugguaa

SEQ ID NO: 1642364 - RNA, 19 nt, Homo sapiens
aaugaugucguuugaauca

SEQ ID NO: 1642365 - RNA, 17 nt, Homo sapiens
aaugauuucacagugug

SEQ ID NO: 1642366 - RNA, 13 nt, Homo sapiens
aaugcaccacuuu

SEQ ID NO: 1642367 - RNA, 22 nt, Homo sapiens
aaugcacugacauuguuggcca

SEQ ID NO: 1642368 - RNA, 13 nt, Homo sapiens
aaugcacuuuguu

SEQ ID NO: 1642369 - RNA, 20 nt, Homo sapiens
aaugcauauccaacaugugc

SEQ ID NO: 1642370 - RNA, 22 nt, Homo sapiens
aaugcauauuugcaaaguguau

SEQ ID NO: 1642371 - RNA, 23 nt, Homo sapiens
aaugcauuagauuaucaaaaagu

SEQ ID NO: 1642372 - RNA, 13 nt, Homo sapiens
aaugccauccuca

SEQ ID NO: 1642373 - RNA, 22 nt, Homo sapiens
aaugcccuuacacuuacuguug

SEQ ID NO: 1642374 - RNA, 21 nt, Homo sapiens
aaugcugguuuuucaguuuuc

SEQ ID NO: 1642375 - RNA, 19 nt, Homo sapiens
aaugcugugcaaacagugu

SEQ ID NO: 1642376 - RNA, 20 nt, Homo sapiens
aauggcacaaucucggcuca

SEQ ID NO: 1642377 - RNA, 19 nt, Homo sapiens
aaugggaauuuauaaccca

SEQ ID NO: 1642378 - RNA, 14 nt, Homo sapiens
aauggggccuguua

SEQ ID NO: 1642379 - RNA, 15 nt, Homo sapiens
aauggggugcaugaa

SEQ ID NO: 1642380 - RNA, 13 nt, Homo sapiens
aauguaaacauuu

SEQ ID NO: 1642381 - RNA, 18 nt, Homo sapiens
aauguagaaagugaucca

SEQ ID NO: 1642382 - RNA, 15 nt, Homo sapiens
aauguaucacauuga

SEQ ID NO: 1642383 - RNA, 13 nt, Homo sapiens
aaugucucuguga

SEQ ID NO: 1642384 - RNA, 22 nt, Homo sapiens
aaugugaaaaugguccaggaga

SEQ ID NO: 1642385 - RNA, 20 nt, Homo sapiens
aaugugacauuauaugcacu

SEQ ID NO: 1642386 - RNA, 15 nt, Homo sapiens
aaugugauugcagcu

SEQ ID NO: 1642387 - RNA, 23 nt, Homo sapiens
aauguuaaguugauggugaugaa

SEQ ID NO: 1642388 - RNA, 14 nt, Homo sapiens
aauguuauuaccua

SEQ ID NO: 1642389 - RNA, 22 nt, Homo sapiens
aauguucuauuuaacaacuggg

SEQ ID NO: 1642390 - RNA, 22 nt, Homo sapiens
aauuaaagugaauuguugacaa

SEQ ID NO: 1642391 - RNA, 16 nt, Homo sapiens
aauuaaguuacaauua

SEQ ID NO: 1642392 - RNA, 14 nt, Homo sapiens
aauuaauacagagu

SEQ ID NO: 1642393 - RNA, 15 nt, Homo sapiens
aauuaauuugugaau

SEQ ID NO: 1642394 - RNA, 16 nt, Homo sapiens
aauuacauaguccagu

SEQ ID NO: 1642395 - RNA, 14 nt, Homo sapiens
aauuaccuguggau

SEQ ID NO: 1642396 - RNA, 15 nt, Homo sapiens
acaguaaugcaagca

SEQ ID NO: 1642397 - RNA, 23 nt, Homo sapiens
acaguagggaugaguacccaaaa

SEQ ID NO: 1642398 - RNA, 15 nt, Homo sapiens
acaguauuacuucug

SEQ ID NO: 1642399 - RNA, 23 nt, Homo sapiens
acaguucaauucucauuugucac

SEQ ID NO: 1642400 - RNA, 20 nt, Homo sapiens
acaguuuggauguccucaaa

SEQ ID NO: 1642401 - RNA, 15 nt, Homo sapiens
acauaauacccagga

SEQ ID NO: 1642402 - RNA, 14 nt, Homo sapiens
acauagaacaugug

SEQ ID NO: 1642403 - RNA, 14 nt, Homo sapiens
acauaugacaauaa

SEQ ID NO: 1642404 - RNA, 12 nt, Homo sapiens
acaucuuguuaa

SEQ ID NO: 1642405 - RNA, 13 nt, Homo sapiens
acaucuuuacuca

SEQ ID NO: 1642406 - RNA, 13 nt, Homo sapiens
acaugaacugcca

SEQ ID NO: 1642407 - RNA, 12 nt, Homo sapiens
acaugacuguuu

SEQ ID NO: 1642408 - RNA, 18 nt, Homo sapiens
acaugccaagcacugugc

SEQ ID NO: 1642409 - RNA, 15 nt, Homo sapiens
acaugccacuaugag

SEQ ID NO: 1642410 - RNA, 18 nt, Homo sapiens
acaugccagccacuguga

SEQ ID NO: 1642411 - RNA, 21 nt, Homo sapiens
acauggaaaacagaguauuuc

SEQ ID NO: 1642412 - RNA, 10 nt, Homo sapiens
acaugugcuu

SEQ ID NO: 1642413 - RNA, 17 nt, Homo sapiens
acauuaaggcaguauga

SEQ ID NO: 1642414 - RNA, 15 nt, Homo sapiens
acauuagccuaugug

SEQ ID NO: 1642415 - RNA, 13 nt, Homo sapiens
acauucaugccug

SEQ ID NO: 1642416 - RNA, 17 nt, Homo sapiens
acauuccugaugcuucu

SEQ ID NO: 1642417 - RNA, 16 nt, Homo sapiens
acauucgaguguuuca

SEQ ID NO: 1642418 - RNA, 13 nt, Homo sapiens
acauuuccaugca

SEQ ID NO: 1642419 - RNA, 13 nt, Homo sapiens
accaaaacacaga

SEQ ID NO: 1642420 - RNA, 16 nt, Homo sapiens
accaaauuauugucca

SEQ ID NO: 1642421 - RNA, 22 nt, Homo sapiens
accaagggaugggaccugauga

SEQ ID NO: 1642422 - RNA, 23 nt, Homo sapiens
accaagggcagaggggugcucau

SEQ ID NO: 1642423 - RNA, 14 nt, Homo sapiens
accaauaaagccuu

SEQ ID NO: 1642424 - RNA, 15 nt, Homo sapiens
accaauaaagccuuc

SEQ ID NO: 1642425 - RNA, 13 nt, Homo sapiens
accaauauuguac

SEQ ID NO: 1642426 - RNA, 18 nt, Homo sapiens
accacaucuugcucugcu

SEQ ID NO: 1642427 - RNA, 14 nt, Homo sapiens
accacgcccggcua

SEQ ID NO: 1642428 - RNA, 20 nt, Homo sapiens
accacgugagaucauucacu

SEQ ID NO: 1642429 - RNA, 19 nt, Homo sapiens
accacuuuuaacagaacag

SEQ ID NO: 1642430 - RNA, 19 nt, Homo sapiens
accagcaucccuugaccag

SEQ ID NO: 1642431 - RNA, 20 nt, Homo sapiens
accaggguugaccccagagg

SEQ ID NO: 1642432 - RNA, 14 nt, Homo sapiens
accaggucagggag

SEQ ID NO: 1642433 - RNA, 21 nt, Homo sapiens
accauccaggaagaccccagc

SEQ ID NO: 1642434 - RNA, 23 nt, Homo sapiens
accaugcagugccccuagcuuag

SEQ ID NO: 1642435 - RNA, 9 nt, Homo sapiens
accaugcug

SEQ ID NO: 1642436 - RNA, 23 nt, Homo sapiens
accaugugauuauggacaucgau

SEQ ID NO: 1642437 - RNA, 17 nt, Homo sapiens
accauguuagccaggau

SEQ ID NO: 1642438 - RNA, 23 nt, Homo sapiens
accauguuggccaggcuggucuc

SEQ ID NO: 1642439 - RNA, 22 nt, Homo sapiens
accauucuccaccugccaggga

SEQ ID NO: 1642440 - RNA, 19 nt, Homo sapiens
accauuuugggguacccac

SEQ ID NO: 1642441 - RNA, 18 nt, Homo sapiens
acccaauaguuguugauu

SEQ ID NO: 1642442 - RNA, 14 nt, Homo sapiens
acccaccucagccu

SEQ ID NO: 1642443 - RNA, 15 nt, Homo sapiens
acccaggcaugcaau

SEQ ID NO: 1642444 - RNA, 21 nt, Homo sapiens
accccaacaugccugcaccug

SEQ ID NO: 1642445 - RNA, 20 nt, Homo sapiens
acccccaccccuugcucuca

SEQ ID NO: 1642446 - RNA, 18 nt, Homo sapiens
accccccagcacugagga

SEQ ID NO: 1642447 - RNA, 17 nt, Homo sapiens
accccucccuuucuccc

SEQ ID NO: 1642448 - RNA, 21 nt, Homo sapiens
accccucucuacuaaaaauac

SEQ ID NO: 1642449 - RNA, 12 nt, Homo sapiens
accccugcauug

SEQ ID NO: 1642450 - RNA, 15 nt, Homo sapiens
acccuagcuguguca

SEQ ID NO: 1642451 - RNA, 17 nt, Homo sapiens
acccuagucuuuuaaac

SEQ ID NO: 1642452 - RNA, 14 nt, Homo sapiens
acccucauacacag

SEQ ID NO: 1642453 - RNA, 11 nt, Homo sapiens
acccugugaua

SEQ ID NO: 1642454 - RNA, 23 nt, Homo sapiens
acccuucuccuuagaaguggaag

SEQ ID NO: 1642455 - RNA, 17 nt, Homo sapiens
accgugggcucccugac

SEQ ID NO: 1642456 - RNA, 17 nt, Homo sapiens
accuaaacccucuguga

SEQ ID NO: 1642457 - RNA, 14 nt, Homo sapiens
accuacagugcugu

SEQ ID NO: 1642458 - RNA, 13 nt, Homo sapiens
accuacaguguac

SEQ ID NO: 1642459 - RNA, 14 nt, Homo sapiens
accuacaguguaca

SEQ ID NO: 1642460 - RNA, 22 nt, Homo sapiens
accuacugauaaccacuccuaa

SEQ ID NO: 1642461 - RNA, 21 nt, Homo sapiens
accuaggccucagcugcacug

SEQ ID NO: 1642462 - RNA, 13 nt, Homo sapiens
accucaaaggcuc

SEQ ID NO: 1642463 - RNA, 11 nt, Homo sapiens
accucaauauu

SEQ ID NO: 1642464 - RNA, 19 nt, Homo sapiens
accucagccucccaaagug

SEQ ID NO: 1642465 - RNA, 12 nt, Homo sapiens
accuccugccuc

SEQ ID NO: 1642466 - RNA, 14 nt, Homo sapiens
accucuccagccuc

SEQ ID NO: 1642467 - RNA, 13 nt, Homo sapiens
accucucucacuc

SEQ ID NO: 1642468 - RNA, 16 nt, Homo sapiens
accucucucacugacu

SEQ ID NO: 1642469 - RNA, 17 nt, Homo sapiens
accucugccugaaguca

SEQ ID NO: 1642470 - RNA, 14 nt, Homo sapiens
accugaacucugca

SEQ ID NO: 1642471 - RNA, 19 nt, Homo sapiens
accugaacucugcaacuga

SEQ ID NO: 1642472 - RNA, 13 nt, Homo sapiens
accugacugccac

SEQ ID NO: 1642473 - RNA, 19 nt, Homo sapiens
accugccucccuucaugca

SEQ ID NO: 1642474 - RNA, 20 nt, Homo sapiens
accugccucccuucaugcau

SEQ ID NO: 1642475 - RNA, 19 nt, Homo sapiens
agaaccucgagguuucuca

SEQ ID NO: 1642476 - RNA, 23 nt, Homo sapiens
agaacggggcucuucucauuuca

SEQ ID NO: 1642477 - RNA, 18 nt, Homo sapiens
agaacugucauguaaaca

SEQ ID NO: 1642478 - RNA, 19 nt, Homo sapiens
agaagacacugaugggcaa

SEQ ID NO: 1642479 - RNA, 13 nt, Homo sapiens
agaagaugaauga

SEQ ID NO: 1642480 - RNA, 22 nt, Homo sapiens
agaagauggcacuuauaaccaa

SEQ ID NO: 1642481 - RNA, 16 nt, Homo sapiens
agaagcaagaaacuuc

SEQ ID NO: 1642482 - RNA, 14 nt, Homo sapiens
agaagggcucagag

SEQ ID NO: 1642483 - RNA, 16 nt, Homo sapiens
agaaggugacaugaca

SEQ ID NO: 1642484 - RNA, 23 nt, Homo sapiens
agaauaaaagaauuacauaugaa

SEQ ID NO: 1642485 - RNA, 17 nt, Homo sapiens
agaauacuggucucagg

SEQ ID NO: 1642486 - RNA, 18 nt, Homo sapiens
agaauauaaaaauaaagc

SEQ ID NO: 1642487 - RNA, 13 nt, Homo sapiens
agaauauacuaaa

SEQ ID NO: 1642488 - RNA, 13 nt, Homo sapiens
agaaucaaaugca

SEQ ID NO: 1642489 - RNA, 11 nt, Homo sapiens
agaauggagcu

SEQ ID NO: 1642490 - RNA, 23 nt, Homo sapiens
agaauguucuuauguugcccagu

SEQ ID NO: 1642491 - RNA, 15 nt, Homo sapiens
agaauuauaacugua

SEQ ID NO: 1642492 - RNA, 16 nt, Homo sapiens
agaauuggccaucuua

SEQ ID NO: 1642493 - RNA, 21 nt, Homo sapiens
agacaauggcuuacuccagga

SEQ ID NO: 1642494 - RNA, 19 nt, Homo sapiens
agacacaccccaacaugcc

SEQ ID NO: 1642495 - RNA, 17 nt, Homo sapiens
agacacaggcccggcuc

SEQ ID NO: 1642496 - RNA, 19 nt, Homo sapiens
agacacagugaccauacua

SEQ ID NO: 1642497 - RNA, 17 nt, Homo sapiens
agacacauuuacacuag

SEQ ID NO: 1642498 - RNA, 22 nt, Homo sapiens
agacaccagagcagaugcagag

SEQ ID NO: 1642499 - RNA, 12 nt, Homo sapiens
agacacugcaca

SEQ ID NO: 1642500 - RNA, 17 nt, Homo sapiens
agacagagaccuccugc

SEQ ID NO: 1642501 - RNA, 19 nt, Homo sapiens
agacaggguuucaccaugu

SEQ ID NO: 1642502 - RNA, 23 nt, Homo sapiens
agacagucccugccaauggacua

SEQ ID NO: 1642503 - RNA, 22 nt, Homo sapiens
caggcuuguuaccaccaugcuc

SEQ ID NO: 1642504 - RNA, 15 nt, Homo sapiens
cagggcagccaggga

SEQ ID NO: 1642505 - RNA, 14 nt, Homo sapiens
caggggcaggcaca

SEQ ID NO: 1642506 - RNA, 23 nt, Homo sapiens
caggggcuggcccagggcugcaa

SEQ ID NO: 1642507 - RNA, 20 nt, Homo sapiens
cagguaaaugguaugaucaa

SEQ ID NO: 1642508 - RNA, 22 nt, Homo sapiens
cagguaaaugguaugaucaaua

SEQ ID NO: 1642509 - RNA, 21 nt, Homo sapiens
cagguagaacacaaggucauu

SEQ ID NO: 1642510 - RNA, 19 nt, Homo sapiens
caggugcaacagacuugaa

SEQ ID NO: 1642511 - RNA, 15 nt, Homo sapiens
cagguguuggugaca

SEQ ID NO: 1642512 - RNA, 17 nt, Homo sapiens
cagguuauaacaguguu

SEQ ID NO: 1642513 - RNA, 21 nt, Homo sapiens
caguaaauggcuuauccagcu

SEQ ID NO: 1642514 - RNA, 20 nt, Homo sapiens
caguaacuuacccuuaggga

SEQ ID NO: 1642515 - RNA, 18 nt, Homo sapiens
caguaagacgacaaggaa

SEQ ID NO: 1642516 - RNA, 17 nt, Homo sapiens
caguagucaccucuggg

SEQ ID NO: 1642517 - RNA, 13 nt, Homo sapiens
cagucaaccuggg

SEQ ID NO: 1642518 - RNA, 12 nt, Homo sapiens
caguccaaggaa

SEQ ID NO: 1642519 - RNA, 20 nt, Homo sapiens
cagucucaauuuuguauuua

SEQ ID NO: 1642520 - RNA, 14 nt, Homo sapiens
cagucuuccauuug

SEQ ID NO: 1642521 - RNA, 14 nt, Homo sapiens
cagugaacaguuug

SEQ ID NO: 1642522 - RNA, 17 nt, Homo sapiens
cagugaagaugcagguu

SEQ ID NO: 1642523 - RNA, 18 nt, Homo sapiens
cagugagggcuauacaug

SEQ ID NO: 1642524 - RNA, 19 nt, Homo sapiens
cagugaguucagccuuuaa

SEQ ID NO: 1642525 - RNA, 14 nt, Homo sapiens
cagugauucaguaa

SEQ ID NO: 1642526 - RNA, 14 nt, Homo sapiens
cagugguggagcug

SEQ ID NO: 1642527 - RNA, 14 nt, Homo sapiens
caguguacagucuu

SEQ ID NO: 1642528 - RNA, 21 nt, Homo sapiens
caguguggcaagcaagagcuc

SEQ ID NO: 1642529 - RNA, 19 nt, Homo sapiens
caguguuuguauaccauga

SEQ ID NO: 1642530 - RNA, 16 nt, Homo sapiens
caguucagaaucacuu

SEQ ID NO: 1642531 - RNA, 14 nt, Homo sapiens
caguucuuacacau

SEQ ID NO: 1642532 - RNA, 18 nt, Homo sapiens
caguucuuacacauucca

SEQ ID NO: 1642533 - RNA, 13 nt, Homo sapiens
caguugaauuuau

SEQ ID NO: 1642534 - RNA, 23 nt, Homo sapiens
caguuuuguuuugagggcuauua

SEQ ID NO: 1642535 - RNA, 14 nt, Homo sapiens
cauaaaauguuaag

SEQ ID NO: 1642536 - RNA, 20 nt, Homo sapiens
cauaaagagaaaaugaugag

SEQ ID NO: 1642537 - RNA, 13 nt, Homo sapiens
cauaacaauuccu

SEQ ID NO: 1642538 - RNA, 18 nt, Homo sapiens
cauaagcaaagacuauga

SEQ ID NO: 1642539 - RNA, 20 nt, Homo sapiens
cauaauaaaucacacauuca

SEQ ID NO: 1642540 - RNA, 23 nt, Homo sapiens
cauaauuucuucacucaaucucu

SEQ ID NO: 1642541 - RNA, 22 nt, Homo sapiens
cauacgguaugauauugcagcu

SEQ ID NO: 1642542 - RNA, 11 nt, Homo sapiens
cauacugaaau

SEQ ID NO: 1642543 - RNA, 18 nt, Homo sapiens
cauagaauacucagggaa

SEQ ID NO: 1642544 - RNA, 22 nt, Homo sapiens
cauagagaauauaaaaauaaag

SEQ ID NO: 1642545 - RNA, 15 nt, Homo sapiens
cauagcagugcuuga

SEQ ID NO: 1642546 - RNA, 18 nt, Homo sapiens
cauagcgggcgcugccag

SEQ ID NO: 1642547 - RNA, 19 nt, Homo sapiens
cauaguaccucugcuauuu

SEQ ID NO: 1642548 - RNA, 21 nt, Homo sapiens
cauaguaugguggcuggguug

SEQ ID NO: 1642549 - RNA, 18 nt, Homo sapiens
cauaucucuagucccugu

SEQ ID NO: 1642550 - RNA, 14 nt, Homo sapiens
cauaugaauaacau

SEQ ID NO: 1642551 - RNA, 18 nt, Homo sapiens
cauaugacaauaagccac

SEQ ID NO: 1642552 - RNA, 15 nt, Homo sapiens
cauauucccacagca

SEQ ID NO: 1642553 - RNA, 16 nt, Homo sapiens
cauauucuguuggcca

SEQ ID NO: 1642554 - RNA, 24 nt, Homo sapiens
caucaaauggaagacacauugaaa

SEQ ID NO: 1642555 - RNA, 14 nt, Homo sapiens
caucaacauuccug

SEQ ID NO: 1642556 - RNA, 21 nt, Homo sapiens
caucaagucuuucacauuuaa

SEQ ID NO: 1642557 - RNA, 16 nt, Homo sapiens
caucacacaacucagc

SEQ ID NO: 1642558 - RNA, 23 nt, Homo sapiens
caucacuggcucucuaauuccac

SEQ ID NO: 1642559 - RNA, 15 nt, Homo sapiens
caucacuguauccau

SEQ ID NO: 1642560 - RNA, 12 nt, Homo sapiens
caucacuuugac

SEQ ID NO: 1642561 - RNA, 15 nt, Homo sapiens
caucagaaauaguca

SEQ ID NO: 1642562 - RNA, 16 nt, Homo sapiens
cauccacugugccaug

SEQ ID NO: 1642563 - RNA, 16 nt, Homo sapiens
cauccaggacugagau

SEQ ID NO: 1642564 - RNA, 20 nt, Homo sapiens
caucccagccuuggcaucua

SEQ ID NO: 1642565 - RNA, 23 nt, Homo sapiens
caucccaggaucgcaagagccau

SEQ ID NO: 1642566 - RNA, 14 nt, Homo sapiens
caucccugaaggcc

SEQ ID NO: 1642567 - RNA, 15 nt, Homo sapiens
caucccuggaaggac

SEQ ID NO: 1642568 - RNA, 23 nt, Homo sapiens
cauccuaaaugaguaaacccagc

SEQ ID NO: 1642569 - RNA, 15 nt, Homo sapiens
cauccucaaacacug

SEQ ID NO: 1642570 - RNA, 16 nt, Homo sapiens
cauccucacaccuucu

SEQ ID NO: 1642571 - RNA, 18 nt, Homo sapiens
cauccuccagauagugua

SEQ ID NO: 1642572 - RNA, 19 nt, Homo sapiens
cauccuugagucaaaaaau

SEQ ID NO: 1642573 - RNA, 14 nt, Homo sapiens
caucuauuuuacca

SEQ ID NO: 1642574 - RNA, 13 nt, Homo sapiens
caucucaaggaau

SEQ ID NO: 1642575 - RNA, 16 nt, Homo sapiens
caucugacuugaacuc

SEQ ID NO: 1642576 - RNA, 19 nt, Homo sapiens
caucugcaguacagucuua

SEQ ID NO: 1642577 - RNA, 21 nt, Homo sapiens
caucuuugcugaaugucauua

SEQ ID NO: 1642578 - RNA, 14 nt, Homo sapiens
caucuuuucuugcc

SEQ ID NO: 1642579 - RNA, 14 nt, Homo sapiens
caugaaauaaaaua

SEQ ID NO: 1642580 - RNA, 16 nt, Homo sapiens
caugaagggucccuga

SEQ ID NO: 1642581 - RNA, 20 nt, Homo sapiens
caugacauauuuuugcuuua

SEQ ID NO: 1642582 - RNA, 14 nt, Homo sapiens
caugacccagugaa

SEQ ID NO: 1642583 - RNA, 17 nt, Homo sapiens
caugagaaguugauaua

SEQ ID NO: 1642584 - RNA, 20 nt, Homo sapiens
caugagugcgugcucaguuc

SEQ ID NO: 1642585 - RNA, 17 nt, Homo sapiens
caugaucaucacaauca

SEQ ID NO: 1642586 - RNA, 17 nt, Homo sapiens
caugauguuuuccauga

SEQ ID NO: 1642587 - RNA, 16 nt, Homo sapiens
caugcauaaaugcgau

SEQ ID NO: 1642588 - RNA, 15 nt, Homo sapiens
caugccaagcacugu

SEQ ID NO: 1642589 - RNA, 17 nt, Homo sapiens
caugccuggauggggcu

SEQ ID NO: 1642590 - RNA, 12 nt, Homo sapiens
caugcucuccaa

SEQ ID NO: 1642591 - RNA, 15 nt, Homo sapiens
caugcugcccuguga

SEQ ID NO: 1642592 - RNA, 17 nt, Homo sapiens
cauggaaaacagaguau

SEQ ID NO: 1642593 - RNA, 19 nt, Homo sapiens
cauggaaaacagaguauuu

SEQ ID NO: 1642594 - RNA, 12 nt, Homo sapiens
cauggaaauucc

SEQ ID NO: 1642595 - RNA, 17 nt, Homo sapiens
cauggaggguuuagugc

SEQ ID NO: 1642596 - RNA, 15 nt, Homo sapiens
cauggcaucaccucc

SEQ ID NO: 1642597 - RNA, 14 nt, Homo sapiens
cauggcccugccau

SEQ ID NO: 1642598 - RNA, 22 nt, Homo sapiens
cauggcuuuggcuuugcaaaau

SEQ ID NO: 1642599 - RNA, 19 nt, Homo sapiens
caugggucgggagagggga

SEQ ID NO: 1642600 - RNA, 14 nt, Homo sapiens
cauguaaaaucuuc

SEQ ID NO: 1642601 - RNA, 16 nt, Homo sapiens
cauguaaacugugcac

SEQ ID NO: 1642602 - RNA, 14 nt, Homo sapiens
cauguaacacgaca

SEQ ID NO: 1642603 - RNA, 19 nt, Homo sapiens
cauguauagcuagcuauuu

SEQ ID NO: 1642604 - RNA, 15 nt, Homo sapiens
cauguaucccuguua

SEQ ID NO: 1642605 - RNA, 17 nt, Homo sapiens
cauguauccuuucacac

SEQ ID NO: 1642606 - RNA, 20 nt, Homo sapiens
cauguauccuuucacacauu

SEQ ID NO: 1642607 - RNA, 23 nt, Homo sapiens
cauguauccuuucacacauuugc

SEQ ID NO: 1642608 - RNA, 22 nt, Homo sapiens
cauguauuagccagucauugua

SEQ ID NO: 1642609 - RNA, 17 nt, Homo sapiens
caugugcacaugcacgu

SEQ ID NO: 1642610 - RNA, 22 nt, Homo sapiens
caugugccagguuuuuggucug

SEQ ID NO: 1642611 - RNA, 17 nt, Homo sapiens
cauuaaaauccaguauu

SEQ ID NO: 1642612 - RNA, 19 nt, Homo sapiens
cauuaaaauccaguauuau

SEQ ID NO: 1642613 - RNA, 13 nt, Homo sapiens
auuucuucacuca

SEQ ID NO: 1642614 - RNA, 14 nt, Homo sapiens
auuugaccauucuu

SEQ ID NO: 1642615 - RNA, 13 nt, Homo sapiens
auuugagugcucu

SEQ ID NO: 1642616 - RNA, 15 nt, Homo sapiens
auuugauaguauugu

SEQ ID NO: 1642617 - RNA, 21 nt, Homo sapiens
auuugcaagggaaaagucucu

SEQ ID NO: 1642618 - RNA, 19 nt, Homo sapiens
auuugcauaacaauuccuc

SEQ ID NO: 1642619 - RNA, 21 nt, Homo sapiens
auuugcauugaggaaauauua

SEQ ID NO: 1642620 - RNA, 19 nt, Homo sapiens
auuuguagauuaggauuaa

SEQ ID NO: 1642621 - RNA, 13 nt, Homo sapiens
auuugucaacaaa

SEQ ID NO: 1642622 - RNA, 20 nt, Homo sapiens
auuuguuaaugguuugaaua

SEQ ID NO: 1642623 - RNA, 14 nt, Homo sapiens
auuuuaauuugaua

SEQ ID NO: 1642624 - RNA, 21 nt, Homo sapiens
auuuuagauguuauuaugcua

SEQ ID NO: 1642625 - RNA, 15 nt, Homo sapiens
auuuuauagcuacua

SEQ ID NO: 1642626 - RNA, 14 nt, Homo sapiens
auuuuaucugcuau

SEQ ID NO: 1642627 - RNA, 15 nt, Homo sapiens
auuuuaucugcuaug

SEQ ID NO: 1642628 - RNA, 13 nt, Homo sapiens
auuuuccaaugca

SEQ ID NO: 1642629 - RNA, 20 nt, Homo sapiens
auuuucuacaucuuuuauac

SEQ ID NO: 1642630 - RNA, 19 nt, Homo sapiens
auuuucugcccaacuuuca

SEQ ID NO: 1642631 - RNA, 16 nt, Homo sapiens
auuuugacacaugugu

SEQ ID NO: 1642632 - RNA, 17 nt, Homo sapiens
auuuugauuauauacuu

SEQ ID NO: 1642633 - RNA, 21 nt, Homo sapiens
auuuugcggcauuaaagccau

SEQ ID NO: 1642634 - RNA, 17 nt, Homo sapiens
auuuuguagccucucuu

SEQ ID NO: 1642635 - RNA, 15 nt, Homo sapiens
auuuugucagauuca

SEQ ID NO: 1642636 - RNA, 17 nt, Homo sapiens
auuuuuaaaggacaaac

SEQ ID NO: 1642637 - RNA, 19 nt, Homo sapiens
auuuuugaauacaggcaua

SEQ ID NO: 1642638 - RNA, 14 nt, Homo sapiens
auuuuugugcacau

SEQ ID NO: 1642639 - RNA, 22 nt, Homo sapiens
auuuuuguguauccaguaugca

SEQ ID NO: 1642640 - RNA, 22 nt, Homo sapiens
caaaaauuauaacauuuacuuu

SEQ ID NO: 1642641 - RNA, 18 nt, Homo sapiens
caaaagcccauucauucc

SEQ ID NO: 1642642 - RNA, 18 nt, Homo sapiens
caaaaggauaaugaauac

SEQ ID NO: 1642643 - RNA, 20 nt, Homo sapiens
caaaauaaugcaccacuuuu

SEQ ID NO: 1642644 - RNA, 21 nt, Homo sapiens
caaaauaaugcaccacuuuua

SEQ ID NO: 1642645 - RNA, 21 nt, Homo sapiens
caaaauauauuuuguuuacaa

SEQ ID NO: 1642646 - RNA, 19 nt, Homo sapiens
caaaauccagaaguuuaaa

SEQ ID NO: 1642647 - RNA, 20 nt, Homo sapiens
caaaauugcuucuucuucaa

SEQ ID NO: 1642648 - RNA, 15 nt, Homo sapiens
caaacaccuuauuug

SEQ ID NO: 1642649 - RNA, 15 nt, Homo sapiens
caaacacugcaggca

SEQ ID NO: 1642650 - RNA, 20 nt, Homo sapiens
caaacacugcaggcaucaca

SEQ ID NO: 1642651 - RNA, 20 nt, Homo sapiens
caaacauccuacaagacaca

SEQ ID NO: 1642652 - RNA, 23 nt, Homo sapiens
caaacauccuacaagacacagug

SEQ ID NO: 1642653 - RNA, 17 nt, Homo sapiens
caaaccucuaacccagg

SEQ ID NO: 1642654 - RNA, 18 nt, Homo sapiens
caaacucaagcuucuuca

SEQ ID NO: 1642655 - RNA, 18 nt, Homo sapiens
caaacucuaaaauuauaa

SEQ ID NO: 1642656 - RNA, 21 nt, Homo sapiens
caaacugcuuuuuccaacuca

SEQ ID NO: 1642657 - RNA, 23 nt, Homo sapiens
caaacugcuuuuuccaacucaga

SEQ ID NO: 1642658 - RNA, 22 nt, Homo sapiens
caaagaauuaugcaucugcuac

SEQ ID NO: 1642659 - RNA, 12 nt, Homo sapiens
caaagagacagc

SEQ ID NO: 1642660 - RNA, 22 nt, Homo sapiens
caaagagacagcucuucuacua

SEQ ID NO: 1642661 - RNA, 18 nt, Homo sapiens
caaagagccucacaguua

SEQ ID NO: 1642662 - RNA, 19 nt, Homo sapiens
caaagcacuguuucucuca

SEQ ID NO: 1642663 - RNA, 21 nt, Homo sapiens
caaagccaauaacacacagcu

SEQ ID NO: 1642664 - RNA, 22 nt, Homo sapiens
caaaggcugagaacacugugaa

SEQ ID NO: 1642665 - RNA, 14 nt, Homo sapiens
caaagggcaugggu

SEQ ID NO: 1642666 - RNA, 18 nt, Homo sapiens
caaagugagacaguccag

SEQ ID NO: 1642667 - RNA, 17 nt, Homo sapiens
caaagugcugcgauuac

SEQ ID NO: 1642668 - RNA, 15 nt, Homo sapiens
caaauaaaaauaaca

SEQ ID NO: 1642669 - RNA, 21 nt, Homo sapiens
caaauacuguauauucaggac

SEQ ID NO: 1642670 - RNA, 16 nt, Homo sapiens
caaauauuccagagac

SEQ ID NO: 1642671 - RNA, 12 nt, Homo sapiens
caaaucaucucu

SEQ ID NO: 1642672 - RNA, 20 nt, Homo sapiens
caaaucaucucucaucacuu

SEQ ID NO: 1642673 - RNA, 19 nt, Homo sapiens
caaaugaacacacccauca

SEQ ID NO: 1642674 - RNA, 14 nt, Homo sapiens
caaaugauuaguua

SEQ ID NO: 1642675 - RNA, 22 nt, Homo sapiens
caaaugcauuucuaaagccauu

SEQ ID NO: 1642676 - RNA, 15 nt, Homo sapiens
caaauggaagacaca

SEQ ID NO: 1642677 - RNA, 21 nt, Homo sapiens
caaauguggcuguauccacuu

SEQ ID NO: 1642678 - RNA, 18 nt, Homo sapiens
caaaugugucccagugaa

SEQ ID NO: 1642679 - RNA, 22 nt, Homo sapiens
caaauuacuccaagguuuauaa

SEQ ID NO: 1642680 - RNA, 16 nt, Homo sapiens
caaauugcagacugug

SEQ ID NO: 1642681 - RNA, 19 nt, Homo sapiens
caacaaacuucaaggguuu

SEQ ID NO: 1642682 - RNA, 17 nt, Homo sapiens
caacaaagucacccacu

SEQ ID NO: 1642683 - RNA, 17 nt, Homo sapiens
caacaagcaagcuccca

SEQ ID NO: 1642684 - RNA, 12 nt, Homo sapiens
caacaccaaaaa

SEQ ID NO: 1642685 - RNA, 24 nt, Homo sapiens
caacacucacauuuauucugcuca

SEQ ID NO: 1642686 - RNA, 18 nt, Homo sapiens
caacagaaucagaucuga

SEQ ID NO: 1642687 - RNA, 13 nt, Homo sapiens
caacagagcaaaa

SEQ ID NO: 1642688 - RNA, 15 nt, Homo sapiens
caacagcauuuucaa

SEQ ID NO: 1642689 - RNA, 20 nt, Homo sapiens
caacauggcgaaaccccucu

SEQ ID NO: 1642690 - RNA, 17 nt, Homo sapiens
caacaugugcucaggga

SEQ ID NO: 1642691 - RNA, 20 nt, Homo sapiens
caacccaauaguuguugauu

SEQ ID NO: 1642692 - RNA, 17 nt, Homo sapiens
caaccccccagcacuga

SEQ ID NO: 1642693 - RNA, 20 nt, Homo sapiens
caaccccuucgcuccugugu

SEQ ID NO: 1642694 - RNA, 18 nt, Homo sapiens
caacccucucaggugacc

SEQ ID NO: 1642695 - RNA, 12 nt, Homo sapiens
caaccucaguga

SEQ ID NO: 1642696 - RNA, 14 nt, Homo sapiens
caacgaguacuuca

SEQ ID NO: 1642697 - RNA, 19 nt, Homo sapiens
caacuggcugaaagguuaa

SEQ ID NO: 1642698 - RNA, 17 nt, Homo sapiens
caacuugggaacuagac

SEQ ID NO: 1642699 - RNA, 20 nt, Homo sapiens
caacuugggaacuagacucc

SEQ ID NO: 1642700 - RNA, 16 nt, Homo sapiens
caagacccucucaggc

SEQ ID NO: 1642701 - RNA, 18 nt, Homo sapiens
caagaccucugugcacuu

SEQ ID NO: 1642702 - RNA, 23 nt, Homo sapiens
caagagauagagaccaucuuugc

SEQ ID NO: 1642703 - RNA, 16 nt, Homo sapiens
caagagccauguagaa

SEQ ID NO: 1642704 - RNA, 18 nt, Homo sapiens
caagagcuuaacagugug

SEQ ID NO: 1642705 - RNA, 14 nt, Homo sapiens
caagauuuauggaa

SEQ ID NO: 1642706 - RNA, 17 nt, Homo sapiens
caagcaacaagcuauuu

SEQ ID NO: 1642707 - RNA, 15 nt, Homo sapiens
caagcagccaaggga

SEQ ID NO: 1642708 - RNA, 17 nt, Homo sapiens
caagcagccaagggaug

SEQ ID NO: 1642709 - RNA, 18 nt, Homo sapiens
caagcccaauacagccau

SEQ ID NO: 1642710 - RNA, 15 nt, Homo sapiens
caagcucccaaggga

SEQ ID NO: 1642711 - RNA, 20 nt, Homo sapiens
cacugacagauguguuugca

SEQ ID NO: 1642712 - RNA, 15 nt, Homo sapiens
cacugauaaaaccau

SEQ ID NO: 1642713 - RNA, 22 nt, Homo sapiens
cacugaucugcuagugcuguaa

SEQ ID NO: 1642714 - RNA, 18 nt, Homo sapiens
cacugaugggcaaccccc

SEQ ID NO: 1642715 - RNA, 15 nt, Homo sapiens
cacugcaacuuguga

SEQ ID NO: 1642716 - RNA, 12 nt, Homo sapiens
cacugccaaaga

SEQ ID NO: 1642717 - RNA, 17 nt, Homo sapiens
cacugcccgaaaagcau

SEQ ID NO: 1642718 - RNA, 22 nt, Homo sapiens
cacugcugggggugaggacaca

SEQ ID NO: 1642719 - RNA, 21 nt, Homo sapiens
cacuggcuguuaaucuuucaa

SEQ ID NO: 1642720 - RNA, 18 nt, Homo sapiens
cacugggccuccaaccau

SEQ ID NO: 1642721 - RNA, 19 nt, Homo sapiens
cacugguauuaacuuuaua

SEQ ID NO: 1642722 - RNA, 14 nt, Homo sapiens
uuaaucuuuucaca

SEQ ID NO: 1642723 - RNA, 22 nt, Homo sapiens
uuaaugaucagcuauauacuau

SEQ ID NO: 1642724 - RNA, 14 nt, Homo sapiens
uuaauuucuaugaa

SEQ ID NO: 1642725 - RNA, 17 nt, Homo sapiens
uuaauuuuccaaugcac

SEQ ID NO: 1642726 - RNA, 19 nt, Homo sapiens
uuaauuuuuguacuuugcu

SEQ ID NO: 1642727 - RNA, 19 nt, Homo sapiens
uuacaacaaacacugugau

SEQ ID NO: 1642728 - RNA, 22 nt, Homo sapiens
uuacaccaguuugacugugcua

SEQ ID NO: 1642729 - RNA, 19 nt, Homo sapiens
uuacagacaugaacugcca

SEQ ID NO: 1642730 - RNA, 15 nt, Homo sapiens
uuacauacagugaua

SEQ ID NO: 1642731 - RNA, 14 nt, Homo sapiens
uuacauaucugacu

SEQ ID NO: 1642732 - RNA, 19 nt, Homo sapiens
uuacccaacucuguacaaa

SEQ ID NO: 1642733 - RNA, 13 nt, Homo sapiens
uuacccuuaggga

SEQ ID NO: 1642734 - RNA, 14 nt, Homo sapiens
uuacuaucauguca

SEQ ID NO: 1642735 - RNA, 15 nt, Homo sapiens
uuacuaucaugucaa

SEQ ID NO: 1642736 - RNA, 23 nt, Homo sapiens
uuacuauuuauugcugaaugacu

SEQ ID NO: 1642737 - RNA, 16 nt, Homo sapiens
uuacucauuaauucaa

SEQ ID NO: 1642738 - RNA, 23 nt, Homo sapiens
uuacucuauacauucaacagaga

SEQ ID NO: 1642739 - RNA, 21 nt, Homo sapiens
uuacugaagaaaucuuuccag

SEQ ID NO: 1642740 - RNA, 16 nt, Homo sapiens
uuagaagucacacagu

SEQ ID NO: 1642741 - RNA, 15 nt, Homo sapiens
uuagacccugcauuu

SEQ ID NO: 1642742 - RNA, 15 nt, Homo sapiens
uuagacucaaagaau

SEQ ID NO: 1642743 - RNA, 14 nt, Homo sapiens
uuagaggcaaagaa

SEQ ID NO: 1642744 - RNA, 17 nt, Homo sapiens
uuagagucaauuugcug

SEQ ID NO: 1642745 - RNA, 23 nt, Homo sapiens
uuagauguucuaagucuuuccau

SEQ ID NO: 1642746 - RNA, 21 nt, Homo sapiens
uuagcaugaauccuacauaca

SEQ ID NO: 1642747 - RNA, 15 nt, Homo sapiens
uuagccagugaugcu

SEQ ID NO: 1642748 - RNA, 18 nt, Homo sapiens
uuaggaagguacugucau

SEQ ID NO: 1642749 - RNA, 21 nt, Homo sapiens
uuaggaguaccauaauucugg

SEQ ID NO: 1642750 - RNA, 13 nt, Homo sapiens
uuaggauuacuua

SEQ ID NO: 1642751 - RNA, 18 nt, Homo sapiens
uuagggaaaacauuccau

SEQ ID NO: 1642752 - RNA, 14 nt, Homo sapiens
uuaguacacacuug

SEQ ID NO: 1642753 - RNA, 13 nt, Homo sapiens
uuagugauuccau

SEQ ID NO: 1642754 - RNA, 13 nt, Homo sapiens
uuaguugcaugac

SEQ ID NO: 1642755 - RNA, 23 nt, Homo sapiens
uuauaaaauauuguuaaugccua

SEQ ID NO: 1642756 - RNA, 12 nt, Homo sapiens
uuauaaucaaaa

SEQ ID NO: 1642757 - RNA, 16 nt, Homo sapiens
uuauaccccauuugau

SEQ ID NO: 1642758 - RNA, 23 nt, Homo sapiens
uuauauuacuugccuaucugacu

SEQ ID NO: 1642759 - RNA, 22 nt, Homo sapiens
uuaucaccgugggcucccugac

SEQ ID NO: 1642760 - RNA, 12 nt, Homo sapiens
uuaucugcuaug

SEQ ID NO: 1642761 - RNA, 23 nt, Homo sapiens
uuaugcauguaauggacuaugca

SEQ ID NO: 1642762 - RNA, 20 nt, Homo sapiens
uuauuaaauguagaaaguga

SEQ ID NO: 1642763 - RNA, 13 nt, Homo sapiens
uuauuaauuugaa

SEQ ID NO: 1642764 - RNA, 13 nt, Homo sapiens
uuauucuuccuca

SEQ ID NO: 1642765 - RNA, 20 nt, Homo sapiens
uuauuuaaaaagaacucuga

SEQ ID NO: 1642766 - RNA, 12 nt, Homo sapiens
uuauuucacuuu

SEQ ID NO: 1642767 - RNA, 21 nt, Homo sapiens
uucaaaaauacucacauggcu

SEQ ID NO: 1642768 - RNA, 21 nt, Homo sapiens
uucaaaagcacuuugugcugu

SEQ ID NO: 1642769 - RNA, 19 nt, Homo sapiens
uucaacaaagaaacaaaga

SEQ ID NO: 1642770 - RNA, 14 nt, Homo sapiens
uucaacauauaccu

SEQ ID NO: 1642771 - RNA, 21 nt, Homo sapiens
uucaacauuaaggcaguauga

SEQ ID NO: 1642772 - RNA, 16 nt, Homo sapiens
uucaagagcacacuug

SEQ ID NO: 1642773 - RNA, 17 nt, Homo sapiens
uucaauugcaucuccca

SEQ ID NO: 1642774 - RNA, 22 nt, Homo sapiens
uucacaccauucuccugccuca

SEQ ID NO: 1642775 - RNA, 21 nt, Homo sapiens
uucacaccuagcgucaguauu

SEQ ID NO: 1642776 - RNA, 16 nt, Homo sapiens
uucacaucuaaccuca

SEQ ID NO: 1642777 - RNA, 22 nt, Homo sapiens
uucacggaaagugccugcaaaa

SEQ ID NO: 1642778 - RNA, 14 nt, Homo sapiens
uucacucaaucucu

SEQ ID NO: 1642779 - RNA, 17 nt, Homo sapiens
uucacucugcucucagg

SEQ ID NO: 1642780 - RNA, 14 nt, Homo sapiens
uucacuuauugacu

SEQ ID NO: 1642781 - RNA, 23 nt, Homo sapiens
uguacaagguauguacaguucau

SEQ ID NO: 1642782 - RNA, 22 nt, Homo sapiens
uguacaguuuuuauugcuuguu

SEQ ID NO: 1642783 - RNA, 17 nt, Homo sapiens
uguaccuaauccaaaua

SEQ ID NO: 1642784 - RNA, 18 nt, Homo sapiens
uguacgucugacaggcaa

SEQ ID NO: 1642785 - RNA, 15 nt, Homo sapiens
uguacucuacugaua

SEQ ID NO: 1642786 - RNA, 18 nt, Homo sapiens
uguacuguuacuguguca

SEQ ID NO: 1642787 - RNA, 23 nt, Homo sapiens
uguaguguuaaagugaaucucaa

SEQ ID NO: 1642788 - RNA, 23 nt, Homo sapiens
uguauauuuucugugcagccacu

SEQ ID NO: 1642789 - RNA, 18 nt, Homo sapiens
uguaucauuaugaaguca

SEQ ID NO: 1642790 - RNA, 21 nt, Homo sapiens
uguauccucugaccuacauac

SEQ ID NO: 1642791 - RNA, 18 nt, Homo sapiens
uguauuuccccaaugacu

SEQ ID NO: 1642792 - RNA, 12 nt, Homo sapiens
ugucaaugucuu

SEQ ID NO: 1642793 - RNA, 18 nt, Homo sapiens
ugucacaugaaacauuug

SEQ ID NO: 1642794 - RNA, 21 nt, Homo sapiens
ugucacuauaggucauacaau

SEQ ID NO: 1642795 - RNA, 22 nt, Homo sapiens
ugucacuugcuggcugugaaac

SEQ ID NO: 1642796 - RNA, 18 nt, Homo sapiens
ugucagauucacacaugc

SEQ ID NO: 1642797 - RNA, 16 nt, Homo sapiens
uguccaccaccaccug

SEQ ID NO: 1642798 - RNA, 17 nt, Homo sapiens
uguccuacccacccucc

SEQ ID NO: 1642799 - RNA, 17 nt, Homo sapiens
uguccuaugggagucaa

SEQ ID NO: 1642800 - RNA, 16 nt, Homo sapiens
uguccucaccacaugc

SEQ ID NO: 1642801 - RNA, 18 nt, Homo sapiens
uguccuccucugugaaac

SEQ ID NO: 1642802 - RNA, 16 nt, Homo sapiens
ugucgcuggguccucu

SEQ ID NO: 1642803 - RNA, 16 nt, Homo sapiens
ugucucagaccacuau

SEQ ID NO: 1642804 - RNA, 24 nt, Homo sapiens
ugucucugacaaugcguggcacau

SEQ ID NO: 1642805 - RNA, 21 nt, Homo sapiens
ugucuguaauaauagacugua

SEQ ID NO: 1642806 - RNA, 22 nt, Homo sapiens
ugucuuacagagaaaagacaua

SEQ ID NO: 1642807 - RNA, 22 nt, Homo sapiens
ugucuugggaauuuucuuccaa

SEQ ID NO: 1642808 - RNA, 16 nt, Homo sapiens
ugucuuuacuccauga

SEQ ID NO: 1642809 - RNA, 15 nt, Homo sapiens
ugucuuuagugcucc

SEQ ID NO: 1642810 - RNA, 20 nt, Homo sapiens
ugucuuuggugaacauugca

SEQ ID NO: 1642811 - RNA, 13 nt, Homo sapiens
ugugaaacuggga

SEQ ID NO: 1642812 - RNA, 19 nt, Homo sapiens
ugugaaauaccaaccugaa

SEQ ID NO: 1642813 - RNA, 17 nt, Homo sapiens
ugugaacuccaucauuc

SEQ ID NO: 1642814 - RNA, 14 nt, Homo sapiens
ugugaagagacucu

SEQ ID NO: 1642815 - RNA, 16 nt, Homo sapiens
ugugaagcaaacucua

SEQ ID NO: 1642816 - RNA, 13 nt, Homo sapiens
ugugaauggauug

SEQ ID NO: 1642817 - RNA, 18 nt, Homo sapiens
ugugaaugugacuacuua

SEQ ID NO: 1642818 - RNA, 22 nt, Homo sapiens
ugugauaauauauugcuaaaau

SEQ ID NO: 1642819 - RNA, 14 nt, Homo sapiens
ugugccaugugcca

SEQ ID NO: 1642820 - RNA, 14 nt, Homo sapiens
ugugcccucagauu

SEQ ID NO: 1642821 - RNA, 24 nt, Homo sapiens
ugugcucugaucauccacugugcc

SEQ ID NO: 1642822 - RNA, 18 nt, Homo sapiens
ugugcugaucgccuuauu

SEQ ID NO: 1642823 - RNA, 21 nt, Homo sapiens
ugugcuucuuaaaauagccau

SEQ ID NO: 1642824 - RNA, 17 nt, Homo sapiens
uguggauacagucauua

SEQ ID NO: 1642825 - RNA, 18 nt, Homo sapiens
uguggcccuccaguguau

SEQ ID NO: 1642826 - RNA, 14 nt, Homo sapiens
uguggcgcagcaua

SEQ ID NO: 1642827 - RNA, 19 nt, Homo sapiens
uguggcuucuuaaucuuuu

SEQ ID NO: 1642828 - RNA, 15 nt, Homo sapiens
ugugggcuccauuca

SEQ ID NO: 1642829 - RNA, 18 nt, Homo sapiens
uguggggugggcacauug

SEQ ID NO: 1642830 - RNA, 21 nt, Homo sapiens
ugugguccgaagucuuccaua

SEQ ID NO: 1642831 - RNA, 12 nt, Homo sapiens
uguggugcaaaa

SEQ ID NO: 1642832 - RNA, 21 nt, Homo sapiens
ugugugaggacuucugcaucu

SEQ ID NO: 1642833 - RNA, 21 nt, Homo sapiens
ugugugcacguacacacacau

SEQ ID NO: 1642834 - RNA, 18 nt, Homo sapiens
uguguuaguaaacugugc

SEQ ID NO: 1642835 - RNA, 15 nt, Homo sapiens
uguguucaccuucaa

SEQ ID NO: 1642836 - RNA, 19 nt, Homo sapiens
uguguuuuguuuuguauca

SEQ ID NO: 1642837 - RNA, 14 nt, Homo sapiens
uguuaacuauugua

SEQ ID NO: 1642838 - RNA, 14 nt, Homo sapiens
uguuacacaugaca

SEQ ID NO: 1642839 - RNA, 16 nt, Homo sapiens
uguuacuuaaacauca

SEQ ID NO: 1642840 - RNA, 21 nt, Homo sapiens
uguuaguauuuuaauccugua

SEQ ID NO: 1642841 - RNA, 16 nt, Homo sapiens
caggcagguccagggu

SEQ ID NO: 1642842 - RNA, 17 nt, Homo sapiens
caggccaggacucugca

SEQ ID NO: 1642843 - RNA, 14 nt, Homo sapiens
caggccugccuucu

SEQ ID NO: 1642844 - RNA, 23 nt, Homo sapiens
caggcgugaccugccaggcacac

SEQ ID NO: 1642845 - RNA, 13 nt, Homo sapiens
caggcuacacuga

SEQ ID NO: 1642846 - RNA, 12 nt, Homo sapiens
caggcucugaga

SEQ ID NO: 1642847 - RNA, 16 nt, Homo sapiens
caggcucugagacaca

SEQ ID NO: 1642848 - RNA, 17 nt, Homo sapiens
caggcuggagugcaaug

SEQ ID NO: 1642849 - RNA, 23 nt, Homo sapiens
caggcugucccaagcucccaaga

SEQ ID NO: 1642850 - RNA, 23 nt, Homo sapiens
ugaaaaggguguuagcuaaagga

SEQ ID NO: 1642851 - RNA, 23 nt, Homo sapiens
ugaaaauuauuuuggaaauugag

SEQ ID NO: 1642852 - RNA, 16 nt, Homo sapiens
ugaaagguuaauucuc

SEQ ID NO: 1642853 - RNA, 16 nt, Homo sapiens
ugaaauaucaugcucc

SEQ ID NO: 1642854 - RNA, 12 nt, Homo sapiens
ugaaaugcauau

SEQ ID NO: 1642855 - RNA, 16 nt, Homo sapiens
ugaaaugcuuaugcuu

SEQ ID NO: 1642856 - RNA, 15 nt, Homo sapiens
ugaaauuaauuugug

SEQ ID NO: 1642857 - RNA, 20 nt, Homo sapiens
ugaaauuaauuugugaauuu

SEQ ID NO: 1642858 - RNA, 22 nt, Homo sapiens
ugaaauuaauuugugaauuugc

SEQ ID NO: 1642859 - RNA, 19 nt, Homo sapiens
ugaaauuugugauggaauc

SEQ ID NO: 1642860 - RNA, 19 nt, Homo sapiens
ugaacacaaguuccugaua

SEQ ID NO: 1642861 - RNA, 22 nt, Homo sapiens
ugaaccaagaccauugaauucu

SEQ ID NO: 1642862 - RNA, 21 nt, Homo sapiens
ugaacuccuggccucaaguga

SEQ ID NO: 1642863 - RNA, 18 nt, Homo sapiens
ugaacuguggugccacau

SEQ ID NO: 1642864 - RNA, 22 nt, Homo sapiens
ugaagaauuauucagugaauuu

SEQ ID NO: 1642865 - RNA, 22 nt, Homo sapiens
ugaagaccuggacuauugaaug

SEQ ID NO: 1642866 - RNA, 13 nt, Homo sapiens
ugaagccacagca

SEQ ID NO: 1642867 - RNA, 15 nt, Homo sapiens
ugaagccuucugacc

SEQ ID NO: 1642868 - RNA, 23 nt, Homo sapiens
ugaaggguucaccaggucaggga

SEQ ID NO: 1642869 - RNA, 15 nt, Homo sapiens
ugaagucacacagug

SEQ ID NO: 1642870 - RNA, 18 nt, Homo sapiens
ugaaguuuaauugacuua

SEQ ID NO: 1642871 - RNA, 19 nt, Homo sapiens
ugaauaagauccaauucau

SEQ ID NO: 1642872 - RNA, 13 nt, Homo sapiens
ugaauauguagua

SEQ ID NO: 1642873 - RNA, 12 nt, Homo sapiens
ugaaucacagua

SEQ ID NO: 1642874 - RNA, 22 nt, Homo sapiens
ugaauuuaagcaugaguggccu

SEQ ID NO: 1642875 - RNA, 16 nt, Homo sapiens
ugaauuuagucauuau

SEQ ID NO: 1642876 - RNA, 16 nt, Homo sapiens
ugaauuucccacauac

SEQ ID NO: 1642877 - RNA, 11 nt, Homo sapiens
ugaauuugacu

SEQ ID NO: 1642878 - RNA, 19 nt, Homo sapiens
ugacaaccugaauuaucua

SEQ ID NO: 1642879 - RNA, 21 nt, Homo sapiens
ugacaccccccuucugaauga

SEQ ID NO: 1642880 - RNA, 14 nt, Homo sapiens
ugacauuauaugca

SEQ ID NO: 1642881 - RNA, 22 nt, Homo sapiens
ugacauuuugccaaaauuauua

SEQ ID NO: 1642882 - RNA, 13 nt, Homo sapiens
ugaccauacuaau

SEQ ID NO: 1642883 - RNA, 13 nt, Homo sapiens
ugacccugucacu

SEQ ID NO: 1642884 - RNA, 15 nt, Homo sapiens
ugacccuuguggcac

SEQ ID NO: 1642885 - RNA, 20 nt, Homo sapiens
ugaccugaacucugcaacug

SEQ ID NO: 1642886 - RNA, 17 nt, Homo sapiens
ugaccugccucccuuca

SEQ ID NO: 1642887 - RNA, 23 nt, Homo sapiens
ugacucuccagaaagcucaucuc

SEQ ID NO: 1642888 - RNA, 16 nt, Homo sapiens
ugacugguuguucaaa

SEQ ID NO: 1642889 - RNA, 22 nt, Homo sapiens
ugacugugcccaagugggucca

SEQ ID NO: 1642890 - RNA, 19 nt, Homo sapiens
ugacuuuugaagaacaaaa

SEQ ID NO: 1642891 - RNA, 13 nt, Homo sapiens
ugagaaauccccc

SEQ ID NO: 1642892 - RNA, 15 nt, Homo sapiens
ugagacuccaccuca

SEQ ID NO: 1642893 - RNA, 17 nt, Homo sapiens
ugagacucugucucaaa

SEQ ID NO: 1642894 - RNA, 13 nt, Homo sapiens
ugagagcauguga

SEQ ID NO: 1642895 - RNA, 18 nt, Homo sapiens
ugcucuaagaagcugcaa

SEQ ID NO: 1642896 - RNA, 11 nt, Homo sapiens
ugcucucagga

SEQ ID NO: 1642897 - RNA, 15 nt, Homo sapiens
ugcugacuuuaaaag

SEQ ID NO: 1642898 - RNA, 22 nt, Homo sapiens
ugcugaguuccggggugcaaug

SEQ ID NO: 1642899 - RNA, 22 nt, Homo sapiens
ugcugcagauuugauauuugca

SEQ ID NO: 1642900 - RNA, 14 nt, Homo sapiens
ugcugccugccugg

SEQ ID NO: 1642901 - RNA, 14 nt, Homo sapiens
ugcuggcugugaaa

SEQ ID NO: 1642902 - RNA, 13 nt, Homo sapiens
ugcuggcugugac

SEQ ID NO: 1642903 - RNA, 18 nt, Homo sapiens
ugcugggggugaggacac

SEQ ID NO: 1642904 - RNA, 18 nt, Homo sapiens
ugcuguguaacagaacac

SEQ ID NO: 1642905 - RNA, 16 nt, Homo sapiens
ugcuguuaacuguuaa

SEQ ID NO: 1642906 - RNA, 13 nt, Homo sapiens
ugcuucagccucc

SEQ ID NO: 1642907 - RNA, 17 nt, Homo sapiens
ugcuugcacaaaccaau

SEQ ID NO: 1642908 - RNA, 15 nt, Homo sapiens
uggaaaaugugcaau

SEQ ID NO: 1642909 - RNA, 18 nt, Homo sapiens
uggaaagacaagcucaag

SEQ ID NO: 1642910 - RNA, 16 nt, Homo sapiens
uggaaauacacuguua

SEQ ID NO: 1642911 - RNA, 20 nt, Homo sapiens
uggaaauucccuucaucugg

SEQ ID NO: 1642912 - RNA, 20 nt, Homo sapiens
uggaaauuugggagagccau

SEQ ID NO: 1642913 - RNA, 19 nt, Homo sapiens
uggaacagauucacacugu

SEQ ID NO: 1642914 - RNA, 15 nt, Homo sapiens
uggaacagucuuccc

SEQ ID NO: 1642915 - RNA, 13 nt, Homo sapiens
uggaaccagccca

SEQ ID NO: 1642916 - RNA, 16 nt, Homo sapiens
uggaacucaaggaaau

SEQ ID NO: 1642917 - RNA, 21 nt, Homo sapiens
uggaacuuuuauuacuggggu

SEQ ID NO: 1642918 - RNA, 22 nt, Homo sapiens
uggaagacagagaccuccugcc

SEQ ID NO: 1642919 - RNA, 16 nt, Homo sapiens
uggaagagcacaagag

SEQ ID NO: 1642920 - RNA, 18 nt, Homo sapiens
uggaaggcuucuccgccc

SEQ ID NO: 1642921 - RNA, 19 nt, Homo sapiens
uggaaguugcauggcauca

SEQ ID NO: 1642922 - RNA, 23 nt, Homo sapiens
uggaaguugcauggcaucaccuc

SEQ ID NO: 1642923 - RNA, 18 nt, Homo sapiens
uggaauaauccuaaacau

SEQ ID NO: 1642924 - RNA, 20 nt, Homo sapiens
uggaaugggcagcucaucuc

SEQ ID NO: 1642925 - RNA, 14 nt, Homo sapiens
uggaauuggacaua

SEQ ID NO: 1642926 - RNA, 16 nt, Homo sapiens
uggacuuucuugcaag

SEQ ID NO: 1642927 - RNA, 19 nt, Homo sapiens
uggagcagaaauucaccuc

SEQ ID NO: 1642928 - RNA, 12 nt, Homo sapiens
uggauaugugua

SEQ ID NO: 1642929 - RNA, 13 nt, Homo sapiens
uggauucagaaua

SEQ ID NO: 1642930 - RNA, 23 nt, Homo sapiens
uggauugugccuaauguguuuga

SEQ ID NO: 1642931 - RNA, 22 nt, Homo sapiens
uggauuuaaaagccugcucaau

SEQ ID NO: 1642932 - RNA, 22 nt, Homo sapiens
uggcaaaucucuauuaggaaau

SEQ ID NO: 1642933 - RNA, 17 nt, Homo sapiens
uggcaacagaaaacaau

SEQ ID NO: 1642934 - RNA, 22 nt, Homo sapiens
uggcacagaugcccacguaugu

SEQ ID NO: 1642935 - RNA, 15 nt, Homo sapiens
uggcacccaugcacc

SEQ ID NO: 1642936 - RNA, 20 nt, Homo sapiens
uggcaccuuaguugcaugac

SEQ ID NO: 1642937 - RNA, 22 nt, Homo sapiens
uggcaccuuaguugcaugacca

SEQ ID NO: 1642938 - RNA, 13 nt, Homo sapiens
uggcagcucagag

SEQ ID NO: 1642939 - RNA, 22 nt, Homo sapiens
uggcaggagggcagugguggag

SEQ ID NO: 1642940 - RNA, 16 nt, Homo sapiens
uggcauggccaccacc

SEQ ID NO: 1642941 - RNA, 13 nt, Homo sapiens
uggcccaccccac

SEQ ID NO: 1642942 - RNA, 13 nt, Homo sapiens
uggccgggacccc

SEQ ID NO: 1642943 - RNA, 15 nt, Homo sapiens
uggccgggagccuga

SEQ ID NO: 1642944 - RNA, 16 nt, Homo sapiens
uggccuggggcuucug

SEQ ID NO: 1642945 - RNA, 22 nt, Homo sapiens
uggcgagucugcuuucuucuac

SEQ ID NO: 1642946 - RNA, 19 nt, Homo sapiens
uggcucacuauggugccaa

SEQ ID NO: 1642947 - RNA, 15 nt, Homo sapiens
uggcucaugccugua

SEQ ID NO: 1642948 - RNA, 14 nt, Homo sapiens
uggcuccaaacccu

SEQ ID NO: 1642949 - RNA, 17 nt, Homo sapiens
uggcugaaggacuguga

SEQ ID NO: 1642950 - RNA, 14 nt, Homo sapiens
uggcuuacuccagg

SEQ ID NO: 1642951 - RNA, 23 nt, Homo sapiens
uggcuucacagaugugugauuca

SEQ ID NO: 1642952 - RNA, 17 nt, Homo sapiens
ugggaacuccuaaauca

SEQ ID NO: 1642953 - RNA, 17 nt, Homo sapiens
ugggaauuaagcaaaau

SEQ ID NO: 1642954 - RNA, 17 nt, Homo sapiens
ugggaauuuucuuccaa

SEQ ID NO: 1642955 - RNA, 12 nt, Homo sapiens
ugggacacaguu

SEQ ID NO: 1642956 - RNA, 15 nt, Homo sapiens
ugggacacccuguga

SEQ ID NO: 1642957 - RNA, 22 nt, Homo sapiens
aaccuagccuuagaagucacac

SEQ ID NO: 1642958 - RNA, 21 nt, Homo sapiens
aaccuccuuucucuucucugu

SEQ ID NO: 1642959 - RNA, 18 nt, Homo sapiens
aaccucgagguuucucaa

SEQ ID NO: 1642960 - RNA, 16 nt, Homo sapiens
aaccucuaacccaggu

SEQ ID NO: 1642961 - RNA, 23 nt, Homo sapiens
aaccuggagggcuagaaccugga

SEQ ID NO: 1642962 - RNA, 23 nt, Homo sapiens
aaccuguaaagcaggugcccagg

SEQ ID NO: 1642963 - RNA, 22 nt, Homo sapiens
aaccuugaaaaaaaacagugga

SEQ ID NO: 1642964 - RNA, 19 nt, Homo sapiens
aacgauaaaagacagugaa

SEQ ID NO: 1642965 - RNA, 13 nt, Homo sapiens
aacgcaaauauua

SEQ ID NO: 1642966 - RNA, 22 nt, Homo sapiens
aacuaccagugggcauguauua

SEQ ID NO: 1642967 - RNA, 15 nt, Homo sapiens
aacuacuggcaauuu

SEQ ID NO: 1642968 - RNA, 14 nt, Homo sapiens
aacuagaaccugga

SEQ ID NO: 1642969 - RNA, 18 nt, Homo sapiens
aacuagcuuggaaacugg

SEQ ID NO: 1642970 - RNA, 16 nt, Homo sapiens
aacuauguaacaugua

SEQ ID NO: 1642971 - RNA, 20 nt, Homo sapiens
aacucaauauuuuccaugaa

SEQ ID NO: 1642972 - RNA, 14 nt, Homo sapiens
aacucagugugacu

SEQ ID NO: 1642973 - RNA, 17 nt, Homo sapiens
aacuccaucucuacuga

SEQ ID NO: 1642974 - RNA, 22 nt, Homo sapiens
aacuccaugucucugagcauua

SEQ ID NO: 1642975 - RNA, 23 nt, Homo sapiens
aacucccugccccccagcccucc

SEQ ID NO: 1642976 - RNA, 21 nt, Homo sapiens
aacucuguugguuuacugugu

SEQ ID NO: 1642977 - RNA, 16 nt, Homo sapiens
aacucuugaccucagg

SEQ ID NO: 1642978 - RNA, 15 nt, Homo sapiens
aacugaacauuccag

SEQ ID NO: 1642979 - RNA, 22 nt, Homo sapiens
aacugagcaucuccagcauucu

SEQ ID NO: 1642980 - RNA, 11 nt, Homo sapiens
aacuggcugca

SEQ ID NO: 1642981 - RNA, 20 nt, Homo sapiens
aacugguauuuuaucuuuga

SEQ ID NO: 1642982 - RNA, 20 nt, Homo sapiens
aacugguuuaggauuacuua

SEQ ID NO: 1642983 - RNA, 13 nt, Homo sapiens
aacuguauuugau

SEQ ID NO: 1642984 - RNA, 9 nt, Homo sapiens
aacugucau

SEQ ID NO: 1642985 - RNA, 17 nt, Homo sapiens
aacugugagagaauaau

SEQ ID NO: 1642986 - RNA, 16 nt, Homo sapiens
aacuguggugccacau

SEQ ID NO: 1642987 - RNA, 16 nt, Homo sapiens
aacuuacuuaguguua

SEQ ID NO: 1642988 - RNA, 14 nt, Homo sapiens
aacuuaucaucaca

SEQ ID NO: 1642989 - RNA, 22 nt, Homo sapiens
aacuuccaagucauucucaccu

SEQ ID NO: 1642990 - RNA, 19 nt, Homo sapiens
aacuuuuugcaaggcauuu

SEQ ID NO: 1642991 - RNA, 19 nt, Homo sapiens
aagaaacuucggggcugca

SEQ ID NO: 1642992 - RNA, 19 nt, Homo sapiens
aagaaagcaacuuuacuga

SEQ ID NO: 1642993 - RNA, 13 nt, Homo sapiens
aagaaauacuuuc

SEQ ID NO: 1642994 - RNA, 18 nt, Homo sapiens
aagaagagaaccaugaaa

SEQ ID NO: 1642995 - RNA, 14 nt, Homo sapiens
aagaagagaggcau

SEQ ID NO: 1642996 - RNA, 18 nt, Homo sapiens
aagaagcuuucaguauua

SEQ ID NO: 1642997 - RNA, 22 nt, Homo sapiens
aagaauuaugcaucugcuacug

SEQ ID NO: 1642998 - RNA, 23 nt, Homo sapiens
aagaauuggucuuaauguugaau

SEQ ID NO: 1642999 - RNA, 17 nt, Homo sapiens
aagacaccguucauuca

SEQ ID NO: 1643000 - RNA, 22 nt, Homo sapiens
aagacauaacguuuuuccuuua

SEQ ID NO: 1643001 - RNA, 22 nt, Homo sapiens
aagacccucucaggcuguccca

SEQ ID NO: 1643002 - RNA, 11 nt, Homo sapiens
aagagcacagc

SEQ ID NO: 1643003 - RNA, 18 nt, Homo sapiens
aagagcagcuaaaaccua

SEQ ID NO: 1643004 - RNA, 21 nt, Homo sapiens
aagaggaaggccucuguggca

SEQ ID NO: 1643005 - RNA, 18 nt, Homo sapiens
aagagggcacacacugug

SEQ ID NO: 1643006 - RNA, 18 nt, Homo sapiens
aagaguaggaagacuuug

SEQ ID NO: 1643007 - RNA, 19 nt, Homo sapiens
aagaguccagguaaauggu

SEQ ID NO: 1643008 - RNA, 17 nt, Homo sapiens
aagauacagaacucuuu

SEQ ID NO: 1643009 - RNA, 17 nt, Homo sapiens
aagauaucuaugacugu

SEQ ID NO: 1643010 - RNA, 18 nt, Homo sapiens
aagauaucuaugacugug

SEQ ID NO: 1643011 - RNA, 22 nt, Homo sapiens
aagauaucuaugacuguguuua

SEQ ID NO: 1643012 - RNA, 18 nt, Homo sapiens
aagaucacgccacuggac

SEQ ID NO: 1643013 - RNA, 15 nt, Homo sapiens
aagauuaacacuaau

SEQ ID NO: 1643014 - RNA, 16 nt, Homo sapiens
aagauuuuagcuacau

SEQ ID NO: 1643015 - RNA, 14 nt, Homo sapiens
aagcaaauggccaa

SEQ ID NO: 1643016 - RNA, 17 nt, Homo sapiens
aagcaacuuuacugaga

SEQ ID NO: 1643017 - RNA, 12 nt, Homo sapiens
aagcaagcuccc

SEQ ID NO: 1643018 - RNA, 11 nt, Homo sapiens
aagcaaggaaa

SEQ ID NO: 1643019 - RNA, 23 nt, Homo sapiens
aagcacucucgcacacacaguga

SEQ ID NO: 1643020 - RNA, 17 nt, Homo sapiens
aagcacuguuucucuca

SEQ ID NO: 1643021 - RNA, 18 nt, Homo sapiens
aagcagaguucuuugcaa

SEQ ID NO: 1643022 - RNA, 14 nt, Homo sapiens
aagcagccuccuua

SEQ ID NO: 1643023 - RNA, 15 nt, Homo sapiens
aagcaugaguggccu

SEQ ID NO: 1643024 - RNA, 22 nt, Homo sapiens
aagcauggcuuuggcuuugcaa

SEQ ID NO: 1643025 - RNA, 21 nt, Homo sapiens
aagcauuccuucuuugauaau

SEQ ID NO: 1643026 - RNA, 14 nt, Homo sapiens
aagcauuuacuuug

SEQ ID NO: 1643027 - RNA, 23 nt, Homo sapiens
aagcauuuucuagauaccacuua

SEQ ID NO: 1643028 - RNA, 17 nt, Homo sapiens
aagccaauaaaugaacu

SEQ ID NO: 1643029 - RNA, 18 nt, Homo sapiens
aagccaauaaaugaacug

SEQ ID NO: 1643030 - RNA, 13 nt, Homo sapiens
aagccagaaucac

SEQ ID NO: 1643031 - RNA, 19 nt, Homo sapiens
aagccagcaccggaccagc

SEQ ID NO: 1643032 - RNA, 12 nt, Homo sapiens
aagccagguuac

SEQ ID NO: 1643033 - RNA, 19 nt, Homo sapiens
aagccauguguuccaaggc

SEQ ID NO: 1643034 - RNA, 17 nt, Homo sapiens
aagcccauucauuccau

SEQ ID NO: 1643035 - RNA, 20 nt, Homo sapiens
aagcccuuguccccaugaaa

SEQ ID NO: 1643036 - RNA, 13 nt, Homo sapiens
aagccuggcaagg

SEQ ID NO: 1643037 - RNA, 18 nt, Homo sapiens
aagcucaucucagcuccu

SEQ ID NO: 1643038 - RNA, 17 nt, Homo sapiens
aagcucccaagggaugg

SEQ ID NO: 1643039 - RNA, 18 nt, Homo sapiens
aagcugaaggcugaggca

SEQ ID NO: 1643040 - RNA, 17 nt, Homo sapiens
aagcugccgguucuuaa

SEQ ID NO: 1643041 - RNA, 23 nt, Homo sapiens
aagcuggaggacuagaaccugga

SEQ ID NO: 1643042 - RNA, 22 nt, Homo sapiens
aagcugggacucauucacauuu

SEQ ID NO: 1643043 - RNA, 20 nt, Homo sapiens
aagcugugccacccugggcu

SEQ ID NO: 1643044 - RNA, 13 nt, Homo sapiens
aagcuucuucacu

SEQ ID NO: 1643045 - RNA, 23 nt, Homo sapiens
aaggaagaaauuccaggaaaauc

SEQ ID NO: 1643046 - RNA, 18 nt, Homo sapiens
aaggacaaaaaaccucag

SEQ ID NO: 1643047 - RNA, 13 nt, Homo sapiens
aaggacugugaca

SEQ ID NO: 1643048 - RNA, 21 nt, Homo sapiens
aaggagccaaacauccuacaa

SEQ ID NO: 1643049 - RNA, 16 nt, Homo sapiens
aaggagccccauuccu

SEQ ID NO: 1643050 - RNA, 15 nt, Homo sapiens
aaggagcugccugga

SEQ ID NO: 1643051 - RNA, 16 nt, Homo sapiens
aaggaggccacgugau

SEQ ID NO: 1643052 - RNA, 19 nt, Homo sapiens
aaggaugaucuaggaagac

SEQ ID NO: 1643053 - RNA, 14 nt, Homo sapiens
aaggcaaaugccca

SEQ ID NO: 1643054 - RNA, 19 nt, Homo sapiens
aaggcaaugccauccucaa

SEQ ID NO: 1643055 - RNA, 13 nt, Homo sapiens
aaggcagcaacaa

SEQ ID NO: 1643056 - RNA, 20 nt, Homo sapiens
aagggaauucggugugcacc

SEQ ID NO: 1643057 - RNA, 13 nt, Homo sapiens
aagggcauggguc

SEQ ID NO: 1643058 - RNA, 21 nt, Homo sapiens
aaggggagcucuucaacauua

SEQ ID NO: 1643059 - RNA, 12 nt, Homo sapiens
aaggugaaucua

SEQ ID NO: 1643060 - RNA, 14 nt, Homo sapiens
aagguggucacugu

SEQ ID NO: 1643061 - RNA, 18 nt, Homo sapiens
aagguuucugcacauugu

SEQ ID NO: 1643062 - RNA, 20 nt, Homo sapiens
aaguaagcagaguucuuugc

SEQ ID NO: 1643063 - RNA, 24 nt, Homo sapiens
aaguaagccuuuuugucaccucaa

SEQ ID NO: 1643064 - RNA, 21 nt, Homo sapiens
aaguacuacauuuucuuuugu

SEQ ID NO: 1643065 - RNA, 19 nt, Homo sapiens
aaguacuagcuuacuuuug

SEQ ID NO: 1643066 - RNA, 19 nt, Homo sapiens
cagaauaucagaauaugau

SEQ ID NO: 1643067 - RNA, 19 nt, Homo sapiens
cagaauccuacaacuucca

SEQ ID NO: 1643068 - RNA, 14 nt, Homo sapiens
cagaaucuccaucc

SEQ ID NO: 1643069 - RNA, 18 nt, Homo sapiens
cagaaucuccaucccuga

SEQ ID NO: 1643070 - RNA, 11 nt, Homo sapiens
cagaauggagg

SEQ ID NO: 1643071 - RNA, 18 nt, Homo sapiens
cagacacaggcccggcuc

SEQ ID NO: 1643072 - RNA, 20 nt, Homo sapiens
cagaccacugauaaaaccau

SEQ ID NO: 1643073 - RNA, 18 nt, Homo sapiens
cagaccuucaacuuccaa

SEQ ID NO: 1643074 - RNA, 21 nt, Homo sapiens
cagacucuuuuuguaccuggu

SEQ ID NO: 1643075 - RNA, 16 nt, Homo sapiens
cagacuuuugugaaca

SEQ ID NO: 1643076 - RNA, 15 nt, Homo sapiens
cagagaaaaugaauu

SEQ ID NO: 1643077 - RNA, 21 nt, Homo sapiens
cagagaagggcuuggacucaa

SEQ ID NO: 1643078 - RNA, 16 nt, Homo sapiens
cagagacugaauagau

SEQ ID NO: 1643079 - RNA, 20 nt, Homo sapiens
cagaggcauccggaucccag

SEQ ID NO: 1643080 - RNA, 20 nt, Homo sapiens
cagagguugcagugagccga

SEQ ID NO: 1643081 - RNA, 21 nt, Homo sapiens
cagaguauuggucuccucuca

SEQ ID NO: 1643082 - RNA, 24 nt, Homo sapiens
cagaguggaguugaaacugcuaua

SEQ ID NO: 1643083 - RNA, 17 nt, Homo sapiens
cagaguuccccaugcag

SEQ ID NO: 1643084 - RNA, 13 nt, Homo sapiens
cagauaauguccu

SEQ ID NO: 1643085 - RNA, 13 nt, Homo sapiens
cagauaaugugaa

SEQ ID NO: 1643086 - RNA, 22 nt, Homo sapiens
cagauacagggugcuccuuguc

SEQ ID NO: 1643087 - RNA, 14 nt, Homo sapiens
cagaugagaguaca

SEQ ID NO: 1643088 - RNA, 23 nt, Homo sapiens
cagaugagaguacaccccaacag

SEQ ID NO: 1643089 - RNA, 23 nt, Homo sapiens
cagaugcccacguaugugaaaca

SEQ ID NO: 1643090 - RNA, 19 nt, Homo sapiens
cagaugggggaaagcacag

SEQ ID NO: 1643091 - RNA, 13 nt, Homo sapiens
cagaugucccuga

SEQ ID NO: 1643092 - RNA, 13 nt, Homo sapiens
cagauguguuugc

SEQ ID NO: 1643093 - RNA, 15 nt, Homo sapiens
cagauucacacuguc

SEQ ID NO: 1643094 - RNA, 18 nt, Homo sapiens
cagauuccgcaccaauaa

SEQ ID NO: 1643095 - RNA, 15 nt, Homo sapiens
cagauuuaugaauuu

SEQ ID NO: 1643096 - RNA, 23 nt, Homo sapiens
cagauuuguaacauuaguuuuaa

SEQ ID NO: 1643097 - RNA, 22 nt, Homo sapiens
cagcaaagaaacagagugcuaa

SEQ ID NO: 1643098 - RNA, 15 nt, Homo sapiens
cagcaauucuccugc

SEQ ID NO: 1643099 - RNA, 11 nt, Homo sapiens
cagcacagcaa

SEQ ID NO: 1643100 - RNA, 15 nt, Homo sapiens
cagcacccucuccag

SEQ ID NO: 1643101 - RNA, 19 nt, Homo sapiens
cagcacccucuccagauga

SEQ ID NO: 1643102 - RNA, 17 nt, Homo sapiens
cagcacuaauucaacau

SEQ ID NO: 1643103 - RNA, 11 nt, Homo sapiens
cagcacugagg

SEQ ID NO: 1643104 - RNA, 21 nt, Homo sapiens
cagcagcuuuguacacgaaga

SEQ ID NO: 1643105 - RNA, 14 nt, Homo sapiens
cagcaguggacuca

SEQ ID NO: 1643106 - RNA, 16 nt, Homo sapiens
cagcaucaaacaugaa

SEQ ID NO: 1643107 - RNA, 21 nt, Homo sapiens
cagcauuuagacccugcauuu

SEQ ID NO: 1643108 - RNA, 18 nt, Homo sapiens
cagccaagccaagaggau

SEQ ID NO: 1643109 - RNA, 22 nt, Homo sapiens
cagccacaguguuaugcucugu

SEQ ID NO: 1643110 - RNA, 16 nt, Homo sapiens
cagccagguucugacu

SEQ ID NO: 1643111 - RNA, 16 nt, Homo sapiens
cagccccuccaugucu

SEQ ID NO: 1643112 - RNA, 19 nt, Homo sapiens
cagccucccgaguagcuga

SEQ ID NO: 1643113 - RNA, 22 nt, Homo sapiens
cagccucccgaguagcugagau

SEQ ID NO: 1643114 - RNA, 18 nt, Homo sapiens
cagccuggcgacaagagu

SEQ ID NO: 1643115 - RNA, 15 nt, Homo sapiens
cagcgugaagggauu

SEQ ID NO: 1643116 - RNA, 17 nt, Homo sapiens
cagcuaacaauugugaa

SEQ ID NO: 1643117 - RNA, 17 nt, Homo sapiens
cagcuaacuuaucauca

SEQ ID NO: 1643118 - RNA, 19 nt, Homo sapiens
cagcuccccagaguccucu

SEQ ID NO: 1643119 - RNA, 15 nt, Homo sapiens
cagcuccuguggcca

SEQ ID NO: 1643120 - RNA, 19 nt, Homo sapiens
cagcucgggcccucuguga

SEQ ID NO: 1643121 - RNA, 17 nt, Homo sapiens
cagcucuguccugggag

SEQ ID NO: 1643122 - RNA, 14 nt, Homo sapiens
cagcucuucugacu

SEQ ID NO: 1643123 - RNA, 19 nt, Homo sapiens
cagcugaagaacaucucga

SEQ ID NO: 1643124 - RNA, 16 nt, Homo sapiens
cagcugaugaacugug

SEQ ID NO: 1643125 - RNA, 20 nt, Homo sapiens
cagcugaugaacuguggugc

SEQ ID NO: 1643126 - RNA, 21 nt, Homo sapiens
cagcugcucaauaaaguacaa

SEQ ID NO: 1643127 - RNA, 17 nt, Homo sapiens
cagcugcuggcugugac

SEQ ID NO: 1643128 - RNA, 17 nt, Homo sapiens
cagcuggguggcacugc

SEQ ID NO: 1643129 - RNA, 18 nt, Homo sapiens
cagcuuauggcaucucau

SEQ ID NO: 1643130 - RNA, 13 nt, Homo sapiens
cagcuucagguua

SEQ ID NO: 1643131 - RNA, 16 nt, Homo sapiens
cagcuuucaaaagcaa

SEQ ID NO: 1643132 - RNA, 13 nt, Homo sapiens
caggaaacauauu

SEQ ID NO: 1643133 - RNA, 18 nt, Homo sapiens
caggaacauacagacaca

SEQ ID NO: 1643134 - RNA, 15 nt, Homo sapiens
caggaaccucagggc

SEQ ID NO: 1643135 - RNA, 13 nt, Homo sapiens
caggaagauguau

SEQ ID NO: 1643136 - RNA, 22 nt, Homo sapiens
caggaaggggaaacacagcuga

SEQ ID NO: 1643137 - RNA, 22 nt, Homo sapiens
caggacuuccaucugugccaua

SEQ ID NO: 1643138 - RNA, 13 nt, Homo sapiens
caggagaaucacu

SEQ ID NO: 1643139 - RNA, 13 nt, Homo sapiens
caggaguacaccc

SEQ ID NO: 1643140 - RNA, 17 nt, Homo sapiens
caggaguuccagugcug

SEQ ID NO: 1643141 - RNA, 14 nt, Homo sapiens
caggaugacuuuac

SEQ ID NO: 1643142 - RNA, 15 nt, Homo sapiens
caggcaacgcacaaa

SEQ ID NO: 1643143 - RNA, 16 nt, Homo sapiens
caggcaagcaccuccu

SEQ ID NO: 1643144 - RNA, 20 nt, Homo sapiens
caggcaaggggcauuucaca

SEQ ID NO: 1643145 - RNA, 13 nt, Homo sapiens
caggcacacugag

SEQ ID NO: 1643146 - RNA, 17 nt, Homo sapiens
caggcacccaccaucau

SEQ ID NO: 1643147 - RNA, 20 nt, Homo sapiens
caggcauggcuggugccuga

SEQ ID NO: 1643148 - RNA, 15 nt, Homo sapiens
caggccacaaaugug

SEQ ID NO: 1643149 - RNA, 15 nt, Homo sapiens
caggccacauggcua

SEQ ID NO: 1643150 - RNA, 16 nt, Homo sapiens
caggccugccuucuca

SEQ ID NO: 1643151 - RNA, 19 nt, Homo sapiens
caggccugccuucucaggg

SEQ ID NO: 1643152 - RNA, 19 nt, Homo sapiens
caggcgugagccaccgugc

SEQ ID NO: 1643153 - RNA, 14 nt, Homo sapiens
caggcuccugccac

SEQ ID NO: 1643154 - RNA, 11 nt, Homo sapiens
caggcucugag

SEQ ID NO: 1643155 - RNA, 20 nt, Homo sapiens
caggcuggagugcaguggca

SEQ ID NO: 1643156 - RNA, 16 nt, Homo sapiens
cagggaagucacuuca

SEQ ID NO: 1643157 - RNA, 21 nt, Homo sapiens
cagggaaugccugagugccug

SEQ ID NO: 1643158 - RNA, 18 nt, Homo sapiens
cagggagugggcuaagca

SEQ ID NO: 1643159 - RNA, 18 nt, Homo sapiens
cagggcaggaaggggaaa

SEQ ID NO: 1643160 - RNA, 21 nt, Homo sapiens
cagggucucacucugucgccc

SEQ ID NO: 1643161 - RNA, 19 nt, Homo sapiens
caggguugagguccagccc

SEQ ID NO: 1643162 - RNA, 20 nt, Homo sapiens
caggguuucaccauguuggc

SEQ ID NO: 1643163 - RNA, 20 nt, Homo sapiens
caggguuuugccauguuggc

SEQ ID NO: 1643164 - RNA, 14 nt, Homo sapiens
cagguacccaugaa

SEQ ID NO: 1643165 - RNA, 20 nt, Homo sapiens
cagguagaacacaaggucau

SEQ ID NO: 1643166 - RNA, 23 nt, Homo sapiens
cagguagauaacugcauuuugua

SEQ ID NO: 1643167 - RNA, 23 nt, Homo sapiens
caggucuccuccaccgccauggc

SEQ ID NO: 1643168 - RNA, 16 nt, Homo sapiens
caggucuucuccaagg

SEQ ID NO: 1643169 - RNA, 22 nt, Homo sapiens
caggucuucucuccaacucuuc

SEQ ID NO: 1643170 - RNA, 17 nt, Homo sapiens
caggugaagcaccaagc

SEQ ID NO: 1643171 - RNA, 14 nt, Homo sapiens
caggugcugccauc

SEQ ID NO: 1643172 - RNA, 15 nt, Homo sapiens
caggugcugccaucc

SEQ ID NO: 1643173 - RNA, 22 nt, Homo sapiens
caggugcugcucagcagaggau

SEQ ID NO: 1643174 - RNA, 17 nt, Homo sapiens
cagguucugacucuugg

SEQ ID NO: 1643175 - RNA, 23 nt, Homo sapiens
caguaaacagaggaguacaggug

SEQ ID NO: 1643176 - RNA, 18 nt, Homo sapiens
cuagaaccuguagagcua

SEQ ID NO: 1643177 - RNA, 13 nt, Homo sapiens
cuagaagggcuag

SEQ ID NO: 1643178 - RNA, 18 nt, Homo sapiens
cuagacccacuggacuca

SEQ ID NO: 1643179 - RNA, 14 nt, Homo sapiens
cuagauacucgugu

SEQ ID NO: 1643180 - RNA, 20 nt, Homo sapiens
cuagcacuuugggaggccaa

SEQ ID NO: 1643181 - RNA, 15 nt, Homo sapiens
cuagcgucaguauuu

SEQ ID NO: 1643182 - RNA, 22 nt, Homo sapiens
cuaggaaauccagggugguggu

SEQ ID NO: 1643183 - RNA, 17 nt, Homo sapiens
cuagggaaggguggugg

SEQ ID NO: 1643184 - RNA, 15 nt, Homo sapiens
cuagggaucccucau

SEQ ID NO: 1643185 - RNA, 19 nt, Homo sapiens
cuagggcuaguagaacugg

SEQ ID NO: 1643186 - RNA, 22 nt, Homo sapiens
cuaguacagguuuugcccugau

SEQ ID NO: 1643187 - RNA, 16 nt, Homo sapiens
cuauaacuauguugau

SEQ ID NO: 1643188 - RNA, 16 nt, Homo sapiens
cuauaauucuauugaa

SEQ ID NO: 1643189 - RNA, 20 nt, Homo sapiens
cuauaauuuaaauauaugcu

SEQ ID NO: 1643190 - RNA, 18 nt, Homo sapiens
cuauagccuaggugacag

SEQ ID NO: 1643191 - RNA, 23 nt, Homo sapiens
cuauagccuaggugacagaguga

SEQ ID NO: 1643192 - RNA, 19 nt, Homo sapiens
cuaucugacuucauacauc

SEQ ID NO: 1643193 - RNA, 18 nt, Homo sapiens
cuaucuucuuucacauau

SEQ ID NO: 1643194 - RNA, 16 nt, Homo sapiens
cuaugaaagacucaaa

SEQ ID NO: 1643195 - RNA, 18 nt, Homo sapiens
cuaugaaagacucaaaaa

SEQ ID NO: 1643196 - RNA, 13 nt, Homo sapiens
cuaugaaauauca

SEQ ID NO: 1643197 - RNA, 14 nt, Homo sapiens
cuauguauaucuuc

SEQ ID NO: 1643198 - RNA, 21 nt, Homo sapiens
cuaugugcaugcagcaucuaa

SEQ ID NO: 1643199 - RNA, 13 nt, Homo sapiens
cuauguugauaaa

SEQ ID NO: 1643200 - RNA, 23 nt, Homo sapiens
cuauuauagaauggaacucaagg

SEQ ID NO: 1643201 - RNA, 14 nt, Homo sapiens
cuauuauauucauu

SEQ ID NO: 1643202 - RNA, 15 nt, Homo sapiens
cuauuauauucauuc

SEQ ID NO: 1643203 - RNA, 20 nt, Homo sapiens
cuauuucaauacuuacauau

SEQ ID NO: 1643204 - RNA, 15 nt, Homo sapiens
cuauuugccaugggc

SEQ ID NO: 1643205 - RNA, 21 nt, Homo sapiens
cuauuuguagauuaggauuaa

SEQ ID NO: 1643206 - RNA, 16 nt, Homo sapiens
cucaaagaaauuucca

SEQ ID NO: 1643207 - RNA, 13 nt, Homo sapiens
cucaacuagggag

SEQ ID NO: 1643208 - RNA, 20 nt, Homo sapiens
cucaauauuuacuauuucaa

SEQ ID NO: 1643209 - RNA, 19 nt, Homo sapiens
cucaaucccugaggacuga

SEQ ID NO: 1643210 - RNA, 15 nt, Homo sapiens
cucaaugcacugaca

SEQ ID NO: 1643211 - RNA, 17 nt, Homo sapiens
cucacauaucugucauu

SEQ ID NO: 1643212 - RNA, 22 nt, Homo sapiens
cucacaucacuguccaccacca

SEQ ID NO: 1643213 - RNA, 12 nt, Homo sapiens
cucacaucuugg

SEQ ID NO: 1643214 - RNA, 21 nt, Homo sapiens
cucacauggcguccugcccuu

SEQ ID NO: 1643215 - RNA, 13 nt, Homo sapiens
cucaccacaugcg

SEQ ID NO: 1643216 - RNA, 14 nt, Homo sapiens
cucacuauggugcc

SEQ ID NO: 1643217 - RNA, 21 nt, Homo sapiens
cucacugcugcaaauacugua

SEQ ID NO: 1643218 - RNA, 18 nt, Homo sapiens
cucacugggacuuuguaa

SEQ ID NO: 1643219 - RNA, 14 nt, Homo sapiens
cucacuucuuccau

SEQ ID NO: 1643220 - RNA, 17 nt, Homo sapiens
cucagagagggugggag

SEQ ID NO: 1643221 - RNA, 19 nt, Homo sapiens
cucagccaggugcugugac

SEQ ID NO: 1643222 - RNA, 20 nt, Homo sapiens
cucagccucccaaaguucug

SEQ ID NO: 1643223 - RNA, 16 nt, Homo sapiens
cucagcuggaucucca

SEQ ID NO: 1643224 - RNA, 22 nt, Homo sapiens
cucaggcaaagaaaaugaaaug

SEQ ID NO: 1643225 - RNA, 21 nt, Homo sapiens
cucaggccaagcccaauacag

SEQ ID NO: 1643226 - RNA, 15 nt, Homo sapiens
cucagucaugcauaa

SEQ ID NO: 1643227 - RNA, 18 nt, Homo sapiens
cucagucaugcauaaaua

SEQ ID NO: 1643228 - RNA, 17 nt, Homo sapiens
cucagucuccugaguag

SEQ ID NO: 1643229 - RNA, 11 nt, Homo sapiens
cucagugccac

SEQ ID NO: 1643230 - RNA, 17 nt, Homo sapiens
cucagugugacuccuca

SEQ ID NO: 1643231 - RNA, 12 nt, Homo sapiens
cucaguuuucaa

SEQ ID NO: 1643232 - RNA, 13 nt, Homo sapiens
cucauacacagaa

SEQ ID NO: 1643233 - RNA, 19 nt, Homo sapiens
cucauagauguuaugcaaa

SEQ ID NO: 1643234 - RNA, 22 nt, Homo sapiens
cucaugcccugccaagcagcag

SEQ ID NO: 1643235 - RNA, 20 nt, Homo sapiens
cucaugccuguaaucccagc

SEQ ID NO: 1643236 - RNA, 18 nt, Homo sapiens
cucauuaccuugugcuaa

SEQ ID NO: 1643237 - RNA, 21 nt, Homo sapiens
cucauugcuuucuaagaucua

SEQ ID NO: 1643238 - RNA, 15 nt, Homo sapiens
cucauuuccaaucau

SEQ ID NO: 1643239 - RNA, 22 nt, Homo sapiens
cuccaaaacuggaccaccagag

SEQ ID NO: 1643240 - RNA, 20 nt, Homo sapiens
cuccacccucccucccugau

SEQ ID NO: 1643241 - RNA, 11 nt, Homo sapiens
cuccaccucaa

SEQ ID NO: 1643242 - RNA, 16 nt, Homo sapiens
cuccagggacagcaac

SEQ ID NO: 1643243 - RNA, 23 nt, Homo sapiens
cuccagucucaucuaugucauau

SEQ ID NO: 1643244 - RNA, 22 nt, Homo sapiens
cuccaguuuacccuucagguug

SEQ ID NO: 1643245 - RNA, 23 nt, Homo sapiens
cuccaucaguuagagcugacaca

SEQ ID NO: 1643246 - RNA, 21 nt, Homo sapiens
cucccaagggauggugcccug

SEQ ID NO: 1643247 - RNA, 13 nt, Homo sapiens
cucccacagugac

SEQ ID NO: 1643248 - RNA, 17 nt, Homo sapiens
cucccagauaaugugaa

SEQ ID NO: 1643249 - RNA, 23 nt, Homo sapiens
cuccccuauguaaaacuuagcaa

SEQ ID NO: 1643250 - RNA, 23 nt, Homo sapiens
cucccuaccugacugccacagaa

SEQ ID NO: 1643251 - RNA, 16 nt, Homo sapiens
cucccucaaagaaauc

SEQ ID NO: 1643252 - RNA, 21 nt, Homo sapiens
cucccuucguccaccacucua

SEQ ID NO: 1643253 - RNA, 20 nt, Homo sapiens
cuccuccccaaggagacaca

SEQ ID NO: 1643254 - RNA, 16 nt, Homo sapiens
cuccuccguggcacau

SEQ ID NO: 1643255 - RNA, 16 nt, Homo sapiens
cuccucuccccagcaa

SEQ ID NO: 1643256 - RNA, 20 nt, Homo sapiens
cuccugaguagcugggauua

SEQ ID NO: 1643257 - RNA, 20 nt, Homo sapiens
cuccuggccucaagugauuc

SEQ ID NO: 1643258 - RNA, 16 nt, Homo sapiens
cuccuguuuugcacag

SEQ ID NO: 1643259 - RNA, 17 nt, Homo sapiens
cuccuuaucaaaggaca

SEQ ID NO: 1643260 - RNA, 17 nt, Homo sapiens
cuccuuccagcacugac

SEQ ID NO: 1643261 - RNA, 20 nt, Homo sapiens
cuccuugagagaccaggcaa

SEQ ID NO: 1643262 - RNA, 21 nt, Homo sapiens
cuccuugucaauacugagcca

SEQ ID NO: 1643263 - RNA, 24 nt, Homo sapiens
cuccuuucaccacaugugcacaug

SEQ ID NO: 1643264 - RNA, 22 nt, Homo sapiens
cucgaggcggaucuuuggacag

SEQ ID NO: 1643265 - RNA, 21 nt, Homo sapiens
cucgauguccuccucugugaa

SEQ ID NO: 1643266 - RNA, 17 nt, Homo sapiens
cucggccucccaaagug

SEQ ID NO: 1643267 - RNA, 18 nt, Homo sapiens
cucggcucacugcauccu

SEQ ID NO: 1643268 - RNA, 19 nt, Homo sapiens
cucgugguaggacuguaga

SEQ ID NO: 1643269 - RNA, 19 nt, Homo sapiens
cucuaaugcuugauuuagg

SEQ ID NO: 1643270 - RNA, 17 nt, Homo sapiens
cucuaccugcacacugu

SEQ ID NO: 1643271 - RNA, 21 nt, Homo sapiens
cucuagguacgaugacagugu

SEQ ID NO: 1643272 - RNA, 16 nt, Homo sapiens
cucuaguauuuccaca

SEQ ID NO: 1643273 - RNA, 20 nt, Homo sapiens
cucuaucaccaaggagccaa

SEQ ID NO: 1643274 - RNA, 19 nt, Homo sapiens
cucucaacccaggagcauc

SEQ ID NO: 1643275 - RNA, 21 nt, Homo sapiens
cucucagucucugagcaguga

SEQ ID NO: 1643276 - RNA, 17 nt, Homo sapiens
cucuccaacaucuucaa

SEQ ID NO: 1643277 - RNA, 16 nt, Homo sapiens
cucuccaucucuagga

SEQ ID NO: 1643278 - RNA, 17 nt, Homo sapiens
cucuccccagcaaguga

SEQ ID NO: 1643279 - RNA, 15 nt, Homo sapiens
cucuccgaccagaca

SEQ ID NO: 1643280 - RNA, 17 nt, Homo sapiens
cucuccuccguggcaca

SEQ ID NO: 1643281 - RNA, 19 nt, Homo sapiens
cucucgcacacacagugau

SEQ ID NO: 1643282 - RNA, 12 nt, Homo sapiens
cucucugccaug

SEQ ID NO: 1643283 - RNA, 13 nt, Homo sapiens
cucucugccaugg

SEQ ID NO: 1643284 - RNA, 15 nt, Homo sapiens
cucugaaaccagugu

SEQ ID NO: 1643285 - RNA, 17 nt, Homo sapiens
gaauuucuguucuucca

SEQ ID NO: 1643286 - RNA, 14 nt, Homo sapiens
gacaaaucaaagca

SEQ ID NO: 1643287 - RNA, 11 nt, Homo sapiens
gacaacuggaa

SEQ ID NO: 1643288 - RNA, 17 nt, Homo sapiens
gacaagacccucucagg

SEQ ID NO: 1643289 - RNA, 18 nt, Homo sapiens
gacaagagugagacucca

SEQ ID NO: 1643290 - RNA, 20 nt, Homo sapiens
gacacaggaugaaggcaaug

SEQ ID NO: 1643291 - RNA, 16 nt, Homo sapiens
gacacaggcccggcuc

SEQ ID NO: 1643292 - RNA, 16 nt, Homo sapiens
gacacauguccaagaa

SEQ ID NO: 1643293 - RNA, 19 nt, Homo sapiens
gacaccaauaaauguuugu

SEQ ID NO: 1643294 - RNA, 22 nt, Homo sapiens
gacaccauccaggaagacccca

SEQ ID NO: 1643295 - RNA, 13 nt, Homo sapiens
gacagaagcagcu

SEQ ID NO: 1643296 - RNA, 13 nt, Homo sapiens
gacagacagcccu

SEQ ID NO: 1643297 - RNA, 14 nt, Homo sapiens
gacagagucucacu

SEQ ID NO: 1643298 - RNA, 22 nt, Homo sapiens
gacagagucucgcuauugucac

SEQ ID NO: 1643299 - RNA, 12 nt, Homo sapiens
gacagcacuccu

SEQ ID NO: 1643300 - RNA, 17 nt, Homo sapiens
gacagcugccugggauc

SEQ ID NO: 1643301 - RNA, 11 nt, Homo sapiens
gacagugaaag

SEQ ID NO: 1643302 - RNA, 22 nt, Homo sapiens
gacauagaaaguucauggaacu

SEQ ID NO: 1643303 - RNA, 20 nt, Homo sapiens
gacauaugacaauaagccac

SEQ ID NO: 1643304 - RNA, 21 nt, Homo sapiens
gacaugcuccaccgucagggg

SEQ ID NO: 1643305 - RNA, 21 nt, Homo sapiens
gacaugcugaagccaaagcca

SEQ ID NO: 1643306 - RNA, 21 nt, Homo sapiens
gacaugugguuacuaguacag

SEQ ID NO: 1643307 - RNA, 16 nt, Homo sapiens
gacauuguuggccaaa

SEQ ID NO: 1643308 - RNA, 18 nt, Homo sapiens
gacauuuuaugucuuucu

SEQ ID NO: 1643309 - RNA, 21 nt, Homo sapiens
gaccaccuagucuguaacucu

SEQ ID NO: 1643310 - RNA, 19 nt, Homo sapiens
gaccacgugagaucauuca

SEQ ID NO: 1643311 - RNA, 22 nt, Homo sapiens
gaccaggcaaugugacuuugca

SEQ ID NO: 1643312 - RNA, 17 nt, Homo sapiens
gaccaggccugggccag

SEQ ID NO: 1643313 - RNA, 21 nt, Homo sapiens
gaccccaccccucaucaggag

SEQ ID NO: 1643314 - RNA, 23 nt, Homo sapiens
gacccuccuggggcucucagugu

SEQ ID NO: 1643315 - RNA, 20 nt, Homo sapiens
gaccuaaaauuugcccuccc

SEQ ID NO: 1643316 - RNA, 22 nt, Homo sapiens
gaccuaaauuauuuacugcaaa

SEQ ID NO: 1643317 - RNA, 22 nt, Homo sapiens
gaccuacagugcuguguacccu

SEQ ID NO: 1643318 - RNA, 18 nt, Homo sapiens
gaccucugccugaaguca

SEQ ID NO: 1643319 - RNA, 21 nt, Homo sapiens
gaccucugggagcucaaguga

SEQ ID NO: 1643320 - RNA, 14 nt, Homo sapiens
gaccugaugaccug

SEQ ID NO: 1643321 - RNA, 17 nt, Homo sapiens
gaccuguggugcaaaag

SEQ ID NO: 1643322 - RNA, 17 nt, Homo sapiens
gaccuucaacuuccaaa

SEQ ID NO: 1643323 - RNA, 12 nt, Homo sapiens
gaccuucuagga

SEQ ID NO: 1643324 - RNA, 14 nt, Homo sapiens
gaccuucuccuuca

SEQ ID NO: 1643325 - RNA, 20 nt, Homo sapiens
gaccuucuccuucaccuuug

SEQ ID NO: 1643326 - RNA, 15 nt, Homo sapiens
gacgcagccugagaa

SEQ ID NO: 1643327 - RNA, 20 nt, Homo sapiens
gacggaggccuacucuucca

SEQ ID NO: 1643328 - RNA, 19 nt, Homo sapiens
gacgggguuucaccauguu

SEQ ID NO: 1643329 - RNA, 15 nt, Homo sapiens
gacguuguguaaugu

SEQ ID NO: 1643330 - RNA, 21 nt, Homo sapiens
gacuaagggcgcuugucccau

SEQ ID NO: 1643331 - RNA, 19 nt, Homo sapiens
gacuaaguguaccagagaa

SEQ ID NO: 1643332 - RNA, 12 nt, Homo sapiens
gacuacaggugu

SEQ ID NO: 1643333 - RNA, 16 nt, Homo sapiens
gacucacuuguucuca

SEQ ID NO: 1643334 - RNA, 16 nt, Homo sapiens
gacucaucauuuccau

SEQ ID NO: 1643335 - RNA, 13 nt, Homo sapiens
gacuccaguuaaa

SEQ ID NO: 1643336 - RNA, 21 nt, Homo sapiens
gacuccuaggcaggacaugcu

SEQ ID NO: 1643337 - RNA, 22 nt, Homo sapiens
gacuguaacgauugacaccaaa

SEQ ID NO: 1643338 - RNA, 16 nt, Homo sapiens
gacugucuaugaacuu

SEQ ID NO: 1643339 - RNA, 18 nt, Homo sapiens
gacuuccaucugugccau

SEQ ID NO: 1643340 - RNA, 17 nt, Homo sapiens
gacuucuaggauuuauu

SEQ ID NO: 1643341 - RNA, 23 nt, Homo sapiens
gacuuucuugaaaagaagcaagg

SEQ ID NO: 1643342 - RNA, 20 nt, Homo sapiens
gagaaaaagccuccagucca

SEQ ID NO: 1643343 - RNA, 14 nt, Homo sapiens
gagaaaagacauaa

SEQ ID NO: 1643344 - RNA, 16 nt, Homo sapiens
gagaaagaccaugcau

SEQ ID NO: 1643345 - RNA, 13 nt, Homo sapiens
gagaacacuguga

SEQ ID NO: 1643346 - RNA, 16 nt, Homo sapiens
gagaagggcucagaga

SEQ ID NO: 1643347 - RNA, 15 nt, Homo sapiens
gagaaguggggaccc

SEQ ID NO: 1643348 - RNA, 16 nt, Homo sapiens
gagaauguaagaacua

SEQ ID NO: 1643349 - RNA, 20 nt, Homo sapiens
gagaauuuccuuacucuuga

SEQ ID NO: 1643350 - RNA, 12 nt, Homo sapiens
gagacaggguuu

SEQ ID NO: 1643351 - RNA, 16 nt, Homo sapiens
gagacaggguuucacc

SEQ ID NO: 1643352 - RNA, 22 nt, Homo sapiens
gagaccaggcaaagcaagugau

SEQ ID NO: 1643353 - RNA, 13 nt, Homo sapiens
gagaccugccccu

SEQ ID NO: 1643354 - RNA, 17 nt, Homo sapiens
gagacgggguuucacca

SEQ ID NO: 1643355 - RNA, 22 nt, Homo sapiens
gagacuccuaggcaggacaugc

SEQ ID NO: 1643356 - RNA, 19 nt, Homo sapiens
gagacucgagaacuuucau

SEQ ID NO: 1643357 - RNA, 18 nt, Homo sapiens
gagacuugaaucaaguca

SEQ ID NO: 1643358 - RNA, 22 nt, Homo sapiens
gagagugggggugggggguccc

SEQ ID NO: 1643359 - RNA, 13 nt, Homo sapiens
gagaguuugccac

SEQ ID NO: 1643360 - RNA, 20 nt, Homo sapiens
gagaucgugccauugcacuc

SEQ ID NO: 1643361 - RNA, 17 nt, Homo sapiens
gagauuucaucugcucu

SEQ ID NO: 1643362 - RNA, 11 nt, Homo sapiens
gagcaaaggcu

SEQ ID NO: 1643363 - RNA, 12 nt, Homo sapiens
gagcacagugau

SEQ ID NO: 1643364 - RNA, 15 nt, Homo sapiens
gagcagaacuuucac

SEQ ID NO: 1643365 - RNA, 14 nt, Homo sapiens
gagcagcauggauu

SEQ ID NO: 1643366 - RNA, 22 nt, Homo sapiens
gagcagccucagaacaaaguga

SEQ ID NO: 1643367 - RNA, 21 nt, Homo sapiens
gagcagcuucugccacuuccc

SEQ ID NO: 1643368 - RNA, 14 nt, Homo sapiens
gagcaucugcagua

SEQ ID NO: 1643369 - RNA, 15 nt, Homo sapiens
gagcauuagauuucu

SEQ ID NO: 1643370 - RNA, 16 nt, Homo sapiens
gagccacguauguuuu

SEQ ID NO: 1643371 - RNA, 17 nt, Homo sapiens
gagccggacacuucuca

SEQ ID NO: 1643372 - RNA, 20 nt, Homo sapiens
gagccggacacuucucagga

SEQ ID NO: 1643373 - RNA, 12 nt, Homo sapiens
gagccuggacaa

SEQ ID NO: 1643374 - RNA, 19 nt, Homo sapiens
gagccuggcuccaaacccu

SEQ ID NO: 1643375 - RNA, 13 nt, Homo sapiens
gagccuggugccc

SEQ ID NO: 1643376 - RNA, 16 nt, Homo sapiens
gagcuacuugggccau

SEQ ID NO: 1643377 - RNA, 16 nt, Homo sapiens
gagcuagaaccuggag

SEQ ID NO: 1643378 - RNA, 15 nt, Homo sapiens
gagcugacacaggau

SEQ ID NO: 1643379 - RNA, 16 nt, Homo sapiens
gagcugacacaggaug

SEQ ID NO: 1643380 - RNA, 16 nt, Homo sapiens
gagcugauacuuugac

SEQ ID NO: 1643381 - RNA, 16 nt, Homo sapiens
gagcugggauguuucu

SEQ ID NO: 1643382 - RNA, 14 nt, Homo sapiens
gagcugggcagcug

SEQ ID NO: 1643383 - RNA, 11 nt, Homo sapiens
gagcugugcag

SEQ ID NO: 1643384 - RNA, 19 nt, Homo sapiens
gaggacagagcuggugaua

SEQ ID NO: 1643385 - RNA, 22 nt, Homo sapiens
gaggacucucuuaguucuuacc

SEQ ID NO: 1643386 - RNA, 14 nt, Homo sapiens
gaggagcagugcag

SEQ ID NO: 1643387 - RNA, 16 nt, Homo sapiens
gaggagccugcaacau

SEQ ID NO: 1643388 - RNA, 21 nt, Homo sapiens
gaggagggucggugccuucaa

SEQ ID NO: 1643389 - RNA, 20 nt, Homo sapiens
gaggauaugggugggagcga

SEQ ID NO: 1643390 - RNA, 21 nt, Homo sapiens
gaggccccuucuagguggcaa

SEQ ID NO: 1643391 - RNA, 22 nt, Homo sapiens
gaggccccuucuagguggcaag

SEQ ID NO: 1643392 - RNA, 14 nt, Homo sapiens
gaggcccucagggc

SEQ ID NO: 1643393 - RNA, 21 nt, Homo sapiens
gaggccgagucuguccuggaa

SEQ ID NO: 1643394 - RNA, 22 nt, Homo sapiens
gaggcuuauucaguucuuacac

SEQ ID NO: 1643395 - RNA, 19 nt, Homo sapiens
ggcccaaguuucuaaggga

SEQ ID NO: 1643396 - RNA, 16 nt, Homo sapiens
ggccccucucauuccc

SEQ ID NO: 1643397 - RNA, 24 nt, Homo sapiens
ggccuaugcagagguccacaacac

SEQ ID NO: 1643398 - RNA, 22 nt, Homo sapiens
ggccucccaaagugcugggauu

SEQ ID NO: 1643399 - RNA, 12 nt, Homo sapiens
ggccucucugac

SEQ ID NO: 1643400 - RNA, 13 nt, Homo sapiens
ggccuggccaugu

SEQ ID NO: 1643401 - RNA, 14 nt, Homo sapiens
ggccuuaaccauga

SEQ ID NO: 1643402 - RNA, 16 nt, Homo sapiens
ggcggaucuuuggaca

SEQ ID NO: 1643403 - RNA, 17 nt, Homo sapiens
ggcuagaaccuggagaa

SEQ ID NO: 1643404 - RNA, 23 nt, Homo sapiens
ggcuagucuucccuuaccucaaa

SEQ ID NO: 1643405 - RNA, 19 nt, Homo sapiens
ggcuauuuaaaacuuguaa

SEQ ID NO: 1643406 - RNA, 14 nt, Homo sapiens
ggcucacacugaga

SEQ ID NO: 1643407 - RNA, 23 nt, Homo sapiens
ggcuccacaccuccaaugcugcc

SEQ ID NO: 1643408 - RNA, 21 nt, Homo sapiens
ggcucgaagaaaauaauucuc

SEQ ID NO: 1643409 - RNA, 17 nt, Homo sapiens
ggcugaaggacugugac

SEQ ID NO: 1643410 - RNA, 19 nt, Homo sapiens
ggcugaaggacugugacag

SEQ ID NO: 1643411 - RNA, 22 nt, Homo sapiens
ggcugggggccucagugccacu

SEQ ID NO: 1643412 - RNA, 22 nt, Homo sapiens
ggcugguuagagguucccuuug

SEQ ID NO: 1643413 - RNA, 10 nt, Homo sapiens
ggcugugaaa

SEQ ID NO: 1643414 - RNA, 18 nt, Homo sapiens
ggcuucacuguauaaaua

SEQ ID NO: 1643415 - RNA, 21 nt, Homo sapiens
ggcuucagucuuuuccaugaa

SEQ ID NO: 1643416 - RNA, 16 nt, Homo sapiens
ggcuucaguggcagcu

SEQ ID NO: 1643417 - RNA, 20 nt, Homo sapiens
ggcuucuuaaucuuuucaca

SEQ ID NO: 1643418 - RNA, 21 nt, Homo sapiens
ggcuuuuuuugccuaccauuu

SEQ ID NO: 1643419 - RNA, 14 nt, Homo sapiens
gggaaaacauucca

SEQ ID NO: 1643420 - RNA, 22 nt, Homo sapiens
gggaaggaggccguccaucccg

SEQ ID NO: 1643421 - RNA, 20 nt, Homo sapiens
gggacuaaguguaccagaga

SEQ ID NO: 1643422 - RNA, 16 nt, Homo sapiens
gggacucaaugcacug

SEQ ID NO: 1643423 - RNA, 15 nt, Homo sapiens
gggagaaagaccaug

SEQ ID NO: 1643424 - RNA, 14 nt, Homo sapiens
gggagcgaaaguug

SEQ ID NO: 1643425 - RNA, 13 nt, Homo sapiens
gggauauguuaac

SEQ ID NO: 1643426 - RNA, 20 nt, Homo sapiens
gggcacccagccucuaggga

SEQ ID NO: 1643427 - RNA, 17 nt, Homo sapiens
gggcuaguagaacugga

SEQ ID NO: 1643428 - RNA, 22 nt, Homo sapiens
gggcuagucuucccuuaccuca

SEQ ID NO: 1643429 - RNA, 15 nt, Homo sapiens
gggcuccauguagaa

SEQ ID NO: 1643430 - RNA, 14 nt, Homo sapiens
gggcugacugggac

SEQ ID NO: 1643431 - RNA, 14 nt, Homo sapiens
ggggccuguuacac

SEQ ID NO: 1643432 - RNA, 23 nt, Homo sapiens
ggggcucagccaggugcugugac

SEQ ID NO: 1643433 - RNA, 17 nt, Homo sapiens
ggggucuggacaugugg

SEQ ID NO: 1643434 - RNA, 23 nt, Homo sapiens
ggguaucuaauaaauacuuaaga

SEQ ID NO: 1643435 - RNA, 16 nt, Homo sapiens
gggucauccuugccca

SEQ ID NO: 1643436 - RNA, 19 nt, Homo sapiens
ggguccuccuccagggaca

SEQ ID NO: 1643437 - RNA, 12 nt, Homo sapiens
gggugaggaccc

SEQ ID NO: 1643438 - RNA, 14 nt, Homo sapiens
gguaaaugguauga

SEQ ID NO: 1643439 - RNA, 23 nt, Homo sapiens
gguaagaugucuugaaaacaugu

SEQ ID NO: 1643440 - RNA, 18 nt, Homo sapiens
gguaauuaguaacaugug

SEQ ID NO: 1643441 - RNA, 17 nt, Homo sapiens
gguaccaagagacuccu

SEQ ID NO: 1643442 - RNA, 20 nt, Homo sapiens
gguauauuucuggguucuca

SEQ ID NO: 1643443 - RNA, 23 nt, Homo sapiens
gguaugaucacggcucacugcag

SEQ ID NO: 1643444 - RNA, 15 nt, Homo sapiens
ggucacuggaacuca

SEQ ID NO: 1643445 - RNA, 21 nt, Homo sapiens
ggucagaguuccgacugccau

SEQ ID NO: 1643446 - RNA, 22 nt, Homo sapiens
gguccacaacacacagauuuga

SEQ ID NO: 1643447 - RNA, 18 nt, Homo sapiens
gguccuccuccagggaca

SEQ ID NO: 1643448 - RNA, 16 nt, Homo sapiens
ggucuccauccuccau

SEQ ID NO: 1643449 - RNA, 16 nt, Homo sapiens
ggucucgaacuccuga

SEQ ID NO: 1643450 - RNA, 22 nt, Homo sapiens
ggucucugauagguagcauuuu

SEQ ID NO: 1643451 - RNA, 22 nt, Homo sapiens
ggucugaaauuugugauggaau

SEQ ID NO: 1643452 - RNA, 14 nt, Homo sapiens
ggucugugugauga

SEQ ID NO: 1643453 - RNA, 17 nt, Homo sapiens
ggugagacacugcacag

SEQ ID NO: 1643454 - RNA, 16 nt, Homo sapiens
ggugauauguccuaua

SEQ ID NO: 1643455 - RNA, 19 nt, Homo sapiens
ggugauuucuagaaugguu

SEQ ID NO: 1643456 - RNA, 15 nt, Homo sapiens
ggugcccuccuaucc

SEQ ID NO: 1643457 - RNA, 14 nt, Homo sapiens
ggugcugugacacc

SEQ ID NO: 1643458 - RNA, 15 nt, Homo sapiens
gguggaacaagcaca

SEQ ID NO: 1643459 - RNA, 13 nt, Homo sapiens
gguggaugccugg

SEQ ID NO: 1643460 - RNA, 18 nt, Homo sapiens
gguggauuccaugccgca

SEQ ID NO: 1643461 - RNA, 20 nt, Homo sapiens
ggugggcuucccaguggcug

SEQ ID NO: 1643462 - RNA, 15 nt, Homo sapiens
gguggggacagggau

SEQ ID NO: 1643463 - RNA, 13 nt, Homo sapiens
ggugggggguccc

SEQ ID NO: 1643464 - RNA, 20 nt, Homo sapiens
gguuagggaaaacauuccau

SEQ ID NO: 1643465 - RNA, 19 nt, Homo sapiens
gguucaccaggucagggag

SEQ ID NO: 1643466 - RNA, 21 nt, Homo sapiens
gguuccggcauggacaaugga

SEQ ID NO: 1643467 - RNA, 19 nt, Homo sapiens
gguuccugagcucacugaa

SEQ ID NO: 1643468 - RNA, 16 nt, Homo sapiens
gguucggccugugucc

SEQ ID NO: 1643469 - RNA, 15 nt, Homo sapiens
gguucugucauguaa

SEQ ID NO: 1643470 - RNA, 22 nt, Homo sapiens
gguuggaaaacaguauuuucca

SEQ ID NO: 1643471 - RNA, 23 nt, Homo sapiens
gguuuacaacaaacacugugaug

SEQ ID NO: 1643472 - RNA, 14 nt, Homo sapiens
gguuuaugcucaau

SEQ ID NO: 1643473 - RNA, 14 nt, Homo sapiens
gguuucaccauguu

SEQ ID NO: 1643474 - RNA, 21 nt, Homo sapiens
guaaaagcaucacaugaacuu

SEQ ID NO: 1643475 - RNA, 14 nt, Homo sapiens
guaaaauuauuuca

SEQ ID NO: 1643476 - RNA, 15 nt, Homo sapiens
guaaacaaaggaauu

SEQ ID NO: 1643477 - RNA, 13 nt, Homo sapiens
guaaacugugcac

SEQ ID NO: 1643478 - RNA, 14 nt, Homo sapiens
guaaacugugcacc

SEQ ID NO: 1643479 - RNA, 20 nt, Homo sapiens
guaaagggcgcaaagggcau

SEQ ID NO: 1643480 - RNA, 18 nt, Homo sapiens
guaaauaaagaacuagca

SEQ ID NO: 1643481 - RNA, 18 nt, Homo sapiens
guaaauuuugugaugaau

SEQ ID NO: 1643482 - RNA, 20 nt, Homo sapiens
guaacuuauuaucacuuugg

SEQ ID NO: 1643483 - RNA, 22 nt, Homo sapiens
guaacuuuguugcauuuuggca

SEQ ID NO: 1643484 - RNA, 19 nt, Homo sapiens
guaagacucgggauuagua

SEQ ID NO: 1643485 - RNA, 23 nt, Homo sapiens
guaagacucgggauuaguacaca

SEQ ID NO: 1643486 - RNA, 19 nt, Homo sapiens
guaaguacccgacuaaagu

SEQ ID NO: 1643487 - RNA, 14 nt, Homo sapiens
guaaguuucaggug

SEQ ID NO: 1643488 - RNA, 15 nt, Homo sapiens
guaauagaauaaagg

SEQ ID NO: 1643489 - RNA, 14 nt, Homo sapiens
guaaugaaauggag

SEQ ID NO: 1643490 - RNA, 15 nt, Homo sapiens
guaauggacuaugca

SEQ ID NO: 1643491 - RNA, 22 nt, Homo sapiens
guaauuggaaucuucaccucag

SEQ ID NO: 1643492 - RNA, 23 nt, Homo sapiens
guacacgaagaccauccauccuc

SEQ ID NO: 1643493 - RNA, 11 nt, Homo sapiens
guacauuuuaa

SEQ ID NO: 1643494 - RNA, 21 nt, Homo sapiens
guaccacuucgccuucuugcc

SEQ ID NO: 1643495 - RNA, 23 nt, Homo sapiens
guaccucugcuauuugcuguuau

SEQ ID NO: 1643496 - RNA, 12 nt, Homo sapiens
guaccuggugac

SEQ ID NO: 1643497 - RNA, 17 nt, Homo sapiens
guacguuaaaagcaaaa

SEQ ID NO: 1643498 - RNA, 18 nt, Homo sapiens
guacuacaguccucccau

SEQ ID NO: 1643499 - RNA, 22 nt, Homo sapiens
guacucaucugacuugaacucu

SEQ ID NO: 1643500 - RNA, 15 nt, Homo sapiens
guacuguuacugugu

SEQ ID NO: 1643501 - RNA, 22 nt, Homo sapiens
guagaaaauuuguuauuuugca

SEQ ID NO: 1643502 - RNA, 12 nt, Homo sapiens
guagaaagugau

SEQ ID NO: 1643503 - RNA, 13 nt, Homo sapiens
guagaacuuggau

SEQ ID NO: 1643504 - RNA, 13 nt, Homo sapiens
uucccccacugau

SEQ ID NO: 1643505 - RNA, 22 nt, Homo sapiens
uucccuccacaacucaguuuca

SEQ ID NO: 1643506 - RNA, 23 nt, Homo sapiens
uucccuccccagaauggaggcaa

SEQ ID NO: 1643507 - RNA, 22 nt, Homo sapiens
uucccuucacuccccuauccca

SEQ ID NO: 1643508 - RNA, 22 nt, Homo sapiens
uucccuucaucuggaaccauca

SEQ ID NO: 1643509 - RNA, 21 nt, Homo sapiens
uucccuuuuuuggcugcugaa

SEQ ID NO: 1643510 - RNA, 18 nt, Homo sapiens
uuccguggguucugucau

SEQ ID NO: 1643511 - RNA, 21 nt, Homo sapiens
uuccuauaauuuuagacauuc

SEQ ID NO: 1643512 - RNA, 17 nt, Homo sapiens
uuccucaaagcauuugc

SEQ ID NO: 1643513 - RNA, 16 nt, Homo sapiens
uuccucucauuucccu

SEQ ID NO: 1643514 - RNA, 16 nt, Homo sapiens
uuccugauaacuuuaa

SEQ ID NO: 1643515 - RNA, 19 nt, Homo sapiens
uuccuggacaccacccaga

SEQ ID NO: 1643516 - RNA, 22 nt, Homo sapiens
uuccuggcacugcuuccaguga

SEQ ID NO: 1643517 - RNA, 21 nt, Homo sapiens
uuccuucaugaucaucacaau

SEQ ID NO: 1643518 - RNA, 15 nt, Homo sapiens
uuccuuguccccaca

SEQ ID NO: 1643519 - RNA, 13 nt, Homo sapiens
uuccuuucauuua

SEQ ID NO: 1643520 - RNA, 19 nt, Homo sapiens
uuccuuucauuuacugugg

SEQ ID NO: 1643521 - RNA, 19 nt, Homo sapiens
uucguguauagcuguguga

SEQ ID NO: 1643522 - RNA, 22 nt, Homo sapiens
uucguuguucccacugaaaugg

SEQ ID NO: 1643523 - RNA, 17 nt, Homo sapiens
uucuaggaagcuccagu

SEQ ID NO: 1643524 - RNA, 16 nt, Homo sapiens
uucuaguggucuuugu

SEQ ID NO: 1643525 - RNA, 19 nt, Homo sapiens
uucuauuuaacaacugggu

SEQ ID NO: 1643526 - RNA, 22 nt, Homo sapiens
uucucaccuaaacccucuguga

SEQ ID NO: 1643527 - RNA, 17 nt, Homo sapiens
uucucagcucuucugac

SEQ ID NO: 1643528 - RNA, 16 nt, Homo sapiens
uucucaguuuucaaca

SEQ ID NO: 1643529 - RNA, 14 nt, Homo sapiens
uucucaucacauca

SEQ ID NO: 1643530 - RNA, 15 nt, Homo sapiens
uucucccucauuuca

SEQ ID NO: 1643531 - RNA, 14 nt, Homo sapiens
uucuccugccucag

SEQ ID NO: 1643532 - RNA, 18 nt, Homo sapiens
uucucuggacacugccac

SEQ ID NO: 1643533 - RNA, 20 nt, Homo sapiens
uucucuuuuccuuugguccu

SEQ ID NO: 1643534 - RNA, 23 nt, Homo sapiens
uucugacccaugcugcccuguga

SEQ ID NO: 1643535 - RNA, 19 nt, Homo sapiens
uucugauacguguaugaga

SEQ ID NO: 1643536 - RNA, 13 nt, Homo sapiens
uucugcacacagc

SEQ ID NO: 1643537 - RNA, 12 nt, Homo sapiens
uucugcauuuca

SEQ ID NO: 1643538 - RNA, 21 nt, Homo sapiens
uucuggacggcccagcagcuc

SEQ ID NO: 1643539 - RNA, 16 nt, Homo sapiens
uucuuacaaacaugug

SEQ ID NO: 1643540 - RNA, 15 nt, Homo sapiens
uucuuagcagugucu

SEQ ID NO: 1643541 - RNA, 20 nt, Homo sapiens
uucuucaagauuuauggaaa

SEQ ID NO: 1643542 - RNA, 11 nt, Homo sapiens
uucuucacuca

SEQ ID NO: 1643543 - RNA, 19 nt, Homo sapiens
uucuucagagacuccugca

SEQ ID NO: 1643544 - RNA, 12 nt, Homo sapiens
uucuuucacuca

SEQ ID NO: 1643545 - RNA, 15 nt, Homo sapiens
uucuuuucuuuacaa

SEQ ID NO: 1643546 - RNA, 18 nt, Homo sapiens
uucuuuuugaaaugucaa

SEQ ID NO: 1643547 - RNA, 21 nt, Homo sapiens
uugaaagaacuuaagucucga

SEQ ID NO: 1643548 - RNA, 12 nt, Homo sapiens
uugaaaugucaa

SEQ ID NO: 1643549 - RNA, 21 nt, Homo sapiens
uugaaguaggaaguaggaaau

SEQ ID NO: 1643550 - RNA, 18 nt, Homo sapiens
uugaagugacuucacaga

SEQ ID NO: 1643551 - RNA, 22 nt, Homo sapiens
uugaauuguaggugacuauuau

SEQ ID NO: 1643552 - RNA, 13 nt, Homo sapiens
uugaccaugugau

SEQ ID NO: 1643553 - RNA, 12 nt, Homo sapiens
uugaccucaggu

SEQ ID NO: 1643554 - RNA, 18 nt, Homo sapiens
uugaccuguggugcaaaa

SEQ ID NO: 1643555 - RNA, 15 nt, Homo sapiens
uugacucuccagaaa

SEQ ID NO: 1643556 - RNA, 22 nt, Homo sapiens
uugagcaucuauuuuaccauau

SEQ ID NO: 1643557 - RNA, 19 nt, Homo sapiens
uugagccugucaagaggca

SEQ ID NO: 1643558 - RNA, 15 nt, Homo sapiens
uugagcgugauucug

SEQ ID NO: 1643559 - RNA, 19 nt, Homo sapiens
uugagcuuaagaauuuuga

SEQ ID NO: 1643560 - RNA, 17 nt, Homo sapiens
uugaggauuuugaucca

SEQ ID NO: 1643561 - RNA, 22 nt, Homo sapiens
uugauaaaaaauuuauuauguc

SEQ ID NO: 1643562 - RNA, 23 nt, Homo sapiens
uugauaaaaaauuuauuaugucc

SEQ ID NO: 1643563 - RNA, 15 nt, Homo sapiens
uugauaaacuuugaa

SEQ ID NO: 1643564 - RNA, 22 nt, Homo sapiens
uugauaagagggcacacacugu

SEQ ID NO: 1643565 - RNA, 23 nt, Homo sapiens
uugauaagagggcacacacugug

SEQ ID NO: 1643566 - RNA, 12 nt, Homo sapiens
uugauacaguca

SEQ ID NO: 1643567 - RNA, 12 nt, Homo sapiens
uugauacuguug

SEQ ID NO: 1643568 - RNA, 19 nt, Homo sapiens
uugauacuguugcacgugu

SEQ ID NO: 1643569 - RNA, 16 nt, Homo sapiens
uugauauuugcauuga

SEQ ID NO: 1643570 - RNA, 14 nt, Homo sapiens
uugaugcaugcacu

SEQ ID NO: 1643571 - RNA, 16 nt, Homo sapiens
uugaugugauguggca

SEQ ID NO: 1643572 - RNA, 14 nt, Homo sapiens
uugauucuccuuca

SEQ ID NO: 1643573 - RNA, 12 nt, Homo sapiens
uugauugggaug

SEQ ID NO: 1643574 - RNA, 21 nt, Homo sapiens
uugauuucccugggagcuguu

SEQ ID NO: 1643575 - RNA, 19 nt, Homo sapiens
uugauuuugaaccugauga

SEQ ID NO: 1643576 - RNA, 14 nt, Homo sapiens
uugauuuugcaaau

SEQ ID NO: 1643577 - RNA, 14 nt, Homo sapiens
uugcacagccaaau

SEQ ID NO: 1643578 - RNA, 14 nt, Homo sapiens
uugcagacaggcaa

SEQ ID NO: 1643579 - RNA, 19 nt, Homo sapiens
uugcagucucucucugcca

SEQ ID NO: 1643580 - RNA, 20 nt, Homo sapiens
uugcagugagccgagaucac

SEQ ID NO: 1643581 - RNA, 14 nt, Homo sapiens
uugcauuaaucuaa

SEQ ID NO: 1643582 - RNA, 22 nt, Homo sapiens
uugccaacauggugaaacucca

SEQ ID NO: 1643583 - RNA, 14 nt, Homo sapiens
uugccauguuggcc

SEQ ID NO: 1643584 - RNA, 13 nt, Homo sapiens
uugccccaugaga

SEQ ID NO: 1643585 - RNA, 13 nt, Homo sapiens
uugcggacagcca

SEQ ID NO: 1643586 - RNA, 15 nt, Homo sapiens
uugcucccuaccuga

SEQ ID NO: 1643587 - RNA, 23 nt, Homo sapiens
uugcuggggcucgugcccugcau

SEQ ID NO: 1643588 - RNA, 11 nt, Homo sapiens
uugcuguagaa

SEQ ID NO: 1643589 - RNA, 19 nt, Homo sapiens
uugcuugcacaaaccaauu

SEQ ID NO: 1643590 - RNA, 21 nt, Homo sapiens
uuggaacuuuuauuacugggg

SEQ ID NO: 1643591 - RNA, 18 nt, Homo sapiens
uuggaaucuucaccucag

SEQ ID NO: 1643592 - RNA, 17 nt, Homo sapiens
uuggaaugggcagcuca

SEQ ID NO: 1643593 - RNA, 16 nt, Homo sapiens
uuggacagaagcagcu

SEQ ID NO: 1643594 - RNA, 15 nt, Homo sapiens
uuggagaaaaugggu

SEQ ID NO: 1643595 - RNA, 12 nt, Homo sapiens
uuggagacagag

SEQ ID NO: 1643596 - RNA, 16 nt, Homo sapiens
uuggaugcacuuuaua

SEQ ID NO: 1643597 - RNA, 13 nt, Homo sapiens
uuggcaaugccau

SEQ ID NO: 1643598 - RNA, 16 nt, Homo sapiens
uuggcucacacugaga

SEQ ID NO: 1643599 - RNA, 16 nt, Homo sapiens
uuggcuucuaaucaaa

SEQ ID NO: 1643600 - RNA, 20 nt, Homo sapiens
uugggauugagucugugcca

SEQ ID NO: 1643601 - RNA, 15 nt, Homo sapiens
uugggcccuuugagu

SEQ ID NO: 1643602 - RNA, 20 nt, Homo sapiens
uuggggcuaauuuaacaaga

SEQ ID NO: 1643603 - RNA, 13 nt, Homo sapiens
uuggggcuuuuac

SEQ ID NO: 1643604 - RNA, 16 nt, Homo sapiens
uuggucccccuuccau

SEQ ID NO: 1643605 - RNA, 15 nt, Homo sapiens
uuggugaacauugca

SEQ ID NO: 1643606 - RNA, 21 nt, Homo sapiens
uugguuauuuaaucacaguca

SEQ ID NO: 1643607 - RNA, 18 nt, Homo sapiens
uugguuuguugagccuaa

SEQ ID NO: 1643608 - RNA, 22 nt, Homo sapiens
uuguaagaaauauauuugauaa

SEQ ID NO: 1643609 - RNA, 14 nt, Homo sapiens
uuguaauugcauua

SEQ ID NO: 1643610 - RNA, 21 nt, Homo sapiens
uuguacauagugaggagcuuu

SEQ ID NO: 1643611 - RNA, 23 nt, Homo sapiens
uuguaguugcaauagaacagaga

SEQ ID NO: 1643612 - RNA, 18 nt, Homo sapiens
uuguaugauccuaaugaa

SEQ ID NO: 1643613 - RNA, 15 nt, Homo sapiens
uuguauugcauauau

SEQ ID NO: 1643614 - RNA, 12 nt, Homo sapiens
uuucaguauuag

SEQ ID NO: 1643615 - RNA, 15 nt, Homo sapiens
uuucaguguugacac

SEQ ID NO: 1643616 - RNA, 20 nt, Homo sapiens
uuucauacuguaacauucag

SEQ ID NO: 1643617 - RNA, 17 nt, Homo sapiens
uuucauuuuuuuccagg

SEQ ID NO: 1643618 - RNA, 20 nt, Homo sapiens
uuucccagagaccuucugau

SEQ ID NO: 1643619 - RNA, 18 nt, Homo sapiens
uuucccaucacuguaucc

SEQ ID NO: 1643620 - RNA, 13 nt, Homo sapiens
uuuccucuugggc

SEQ ID NO: 1643621 - RNA, 23 nt, Homo sapiens
uuuccuuauucaggaagauaaaa

SEQ ID NO: 1643622 - RNA, 15 nt, Homo sapiens
uuuccuuucauuuac

SEQ ID NO: 1643623 - RNA, 15 nt, Homo sapiens
uuuccuuugcgcaaa

SEQ ID NO: 1643624 - RNA, 16 nt, Homo sapiens
uuucuaaagacuugua

SEQ ID NO: 1643625 - RNA, 12 nt, Homo sapiens
uuucuacccagc

SEQ ID NO: 1643626 - RNA, 22 nt, Homo sapiens
uuucuacuuugaagucauacca

SEQ ID NO: 1643627 - RNA, 22 nt, Homo sapiens
uuucucaauauuaagucauugu

SEQ ID NO: 1643628 - RNA, 13 nt, Homo sapiens
uuucucuaaugcu

SEQ ID NO: 1643629 - RNA, 15 nt, Homo sapiens
uuucucuagcuugau

SEQ ID NO: 1643630 - RNA, 14 nt, Homo sapiens
uuucugcauuucaa

SEQ ID NO: 1643631 - RNA, 13 nt, Homo sapiens
uuucugccuaucu

SEQ ID NO: 1643632 - RNA, 16 nt, Homo sapiens
uuucugucacaucagc

SEQ ID NO: 1643633 - RNA, 14 nt, Homo sapiens
uuucuguugcccca

SEQ ID NO: 1643634 - RNA, 22 nt, Homo sapiens
uuucuugcaagcaacaagcuau

SEQ ID NO: 1643635 - RNA, 23 nt, Homo sapiens
uuucuuguaaggcauacugccuu

SEQ ID NO: 1643636 - RNA, 17 nt, Homo sapiens
uuucuuuuuuauacuca

SEQ ID NO: 1643637 - RNA, 19 nt, Homo sapiens
uuugaaaccaggacauuaa

SEQ ID NO: 1643638 - RNA, 16 nt, Homo sapiens
uuugaaauccaaagaa

SEQ ID NO: 1643639 - RNA, 18 nt, Homo sapiens
uuugaaauuaaccucuca

SEQ ID NO: 1643640 - RNA, 18 nt, Homo sapiens
uuugaagguagaauguuu

SEQ ID NO: 1643641 - RNA, 17 nt, Homo sapiens
uuugauauuugcauuga

SEQ ID NO: 1643642 - RNA, 13 nt, Homo sapiens
uuugcaagacaua

SEQ ID NO: 1643643 - RNA, 12 nt, Homo sapiens
uuugcagucucu

SEQ ID NO: 1643644 - RNA, 22 nt, Homo sapiens
uuugcucccuaccugacugcca

SEQ ID NO: 1643645 - RNA, 22 nt, Homo sapiens
uuuggcaagcucuaucaccaag

SEQ ID NO: 1643646 - RNA, 21 nt, Homo sapiens
uuuguacacgaagaccaucca

SEQ ID NO: 1643647 - RNA, 17 nt, Homo sapiens
uuuguauauuuacaugc

SEQ ID NO: 1643648 - RNA, 19 nt, Homo sapiens
uuuguauuuuuaguagaga

SEQ ID NO: 1643649 - RNA, 12 nt, Homo sapiens
uuugucaccuca

SEQ ID NO: 1643650 - RNA, 13 nt, Homo sapiens
uuugucucugcag

SEQ ID NO: 1643651 - RNA, 23 nt, Homo sapiens
uuuguuccccuccuccacucucc

SEQ ID NO: 1643652 - RNA, 21 nt, Homo sapiens
uuuuaaagaaaaugugucugc

SEQ ID NO: 1643653 - RNA, 17 nt, Homo sapiens
uuuuacacaccaccagc

SEQ ID NO: 1643654 - RNA, 12 nt, Homo sapiens
uuuuacaccagu

SEQ ID NO: 1643655 - RNA, 15 nt, Homo sapiens
uuuuacguaugagau

SEQ ID NO: 1643656 - RNA, 15 nt, Homo sapiens
uuuuagcuacaucua

SEQ ID NO: 1643657 - RNA, 18 nt, Homo sapiens
uuuuaucauuaccauuaa

SEQ ID NO: 1643658 - RNA, 14 nt, Homo sapiens
uuuucacaaauaaa

SEQ ID NO: 1643659 - RNA, 20 nt, Homo sapiens
uuuucuauuaaaagacucau

SEQ ID NO: 1643660 - RNA, 22 nt, Homo sapiens
uuuucuggaauggaauuggaca

SEQ ID NO: 1643661 - RNA, 14 nt, Homo sapiens
uuuugaaaugucaa

SEQ ID NO: 1643662 - RNA, 14 nt, Homo sapiens
uuuugcacauucua

SEQ ID NO: 1643663 - RNA, 23 nt, Homo sapiens
uuuuggcaaugacucaaagucug

SEQ ID NO: 1643664 - RNA, 17 nt, Homo sapiens
uuuugugguccuguaaa

SEQ ID NO: 1643665 - RNA, 12 nt, Homo sapiens
uuuuucucauga

SEQ ID NO: 1643666 - RNA, 15 nt, Homo sapiens
uuuuugagaaacagc

SEQ ID NO: 1643667 - RNA, 18 nt, Homo sapiens
ccugaggcaagccaugga

SEQ ID NO: 1643668 - RNA, 22 nt, Homo sapiens
ccugagguuugccagcauuuag

SEQ ID NO: 1643669 - RNA, 19 nt, Homo sapiens
ccugauuugcugggcaguu

SEQ ID NO: 1643670 - RNA, 21 nt, Homo sapiens
ccugcucacaucugaaucucc

SEQ ID NO: 1643671 - RNA, 12 nt, Homo sapiens
ccugcucacugg

SEQ ID NO: 1643672 - RNA, 14 nt, Homo sapiens
ccugcucccacaga

SEQ ID NO: 1643673 - RNA, 20 nt, Homo sapiens
ccuggaacaucaucaaggca

SEQ ID NO: 1643674 - RNA, 18 nt, Homo sapiens
ccuggauuccucacuuug

SEQ ID NO: 1643675 - RNA, 22 nt, Homo sapiens
ccuggcaaggacacagaugaaa

SEQ ID NO: 1643676 - RNA, 15 nt, Homo sapiens
ccuggcccaucagug

SEQ ID NO: 1643677 - RNA, 14 nt, Homo sapiens
ccuggggcuucuga

SEQ ID NO: 1643678 - RNA, 16 nt, Homo sapiens
ccugggggugccagga

SEQ ID NO: 1643679 - RNA, 12 nt, Homo sapiens
ccugggugacag

SEQ ID NO: 1643680 - RNA, 19 nt, Homo sapiens
ccuggugggcagagaggua

SEQ ID NO: 1643681 - RNA, 15 nt, Homo sapiens
ccuguaaucccagcu

SEQ ID NO: 1643682 - RNA, 16 nt, Homo sapiens
ccuguaccugugcacg

SEQ ID NO: 1643683 - RNA, 16 nt, Homo sapiens
ccuguguucugcacau

SEQ ID NO: 1643684 - RNA, 21 nt, Homo sapiens
ccuuaaaaauuaaauucucuc

SEQ ID NO: 1643685 - RNA, 13 nt, Homo sapiens
ccuuaaacucagg

SEQ ID NO: 1643686 - RNA, 14 nt, Homo sapiens
ccuuacaguaggag

SEQ ID NO: 1643687 - RNA, 13 nt, Homo sapiens
ccuuagacagucc

SEQ ID NO: 1643688 - RNA, 22 nt, Homo sapiens
ccuuagauguucuaagucuuuc

SEQ ID NO: 1643689 - RNA, 23 nt, Homo sapiens
ccuuagauguucuaagucuuucc

SEQ ID NO: 1643690 - RNA, 19 nt, Homo sapiens
ccuuauaagagauucacuc

SEQ ID NO: 1643691 - RNA, 20 nt, Homo sapiens
ccuuauuagagugucuuucc

SEQ ID NO: 1643692 - RNA, 22 nt, Homo sapiens
ccuucaaaauguucuauuuaac

SEQ ID NO: 1643693 - RNA, 12 nt, Homo sapiens
ccuucacagcua

SEQ ID NO: 1643694 - RNA, 20 nt, Homo sapiens
ccuucagggagugagggauu

SEQ ID NO: 1643695 - RNA, 12 nt, Homo sapiens
ccuuccacugag

SEQ ID NO: 1643696 - RNA, 18 nt, Homo sapiens
ccuucgccaccuggguuc

SEQ ID NO: 1643697 - RNA, 19 nt, Homo sapiens
ccuucuccauccacauggg

SEQ ID NO: 1643698 - RNA, 18 nt, Homo sapiens
ccuucugaaugaagccuu

SEQ ID NO: 1643699 - RNA, 13 nt, Homo sapiens
ccuucugaucucc

SEQ ID NO: 1643700 - RNA, 17 nt, Homo sapiens
ccuucugaucuccaaaa

SEQ ID NO: 1643701 - RNA, 23 nt, Homo sapiens
ccuugacucugccguuuccuaau

SEQ ID NO: 1643702 - RNA, 21 nt, Homo sapiens
ccuugagucaaaaaaucucaa

SEQ ID NO: 1643703 - RNA, 15 nt, Homo sapiens
ccuugccugcacaaa

SEQ ID NO: 1643704 - RNA, 15 nt, Homo sapiens
ccuugcuaucaagaa

SEQ ID NO: 1643705 - RNA, 14 nt, Homo sapiens
ccuugugacccagg

SEQ ID NO: 1643706 - RNA, 20 nt, Homo sapiens
ccuuuaaaaaugcaccacuu

SEQ ID NO: 1643707 - RNA, 17 nt, Homo sapiens
ccuuucacuaaaacaca

SEQ ID NO: 1643708 - RNA, 16 nt, Homo sapiens
uaaaaaugucaucuca

SEQ ID NO: 1643709 - RNA, 21 nt, Homo sapiens
uaaaacagguuauaacagugu

SEQ ID NO: 1643710 - RNA, 22 nt, Homo sapiens
uaaaacagguuauaacaguguu

SEQ ID NO: 1643711 - RNA, 14 nt, Homo sapiens
uaaaagacagugaa

SEQ ID NO: 1643712 - RNA, 18 nt, Homo sapiens
uaaaagauaaauuuguug

SEQ ID NO: 1643713 - RNA, 21 nt, Homo sapiens
uaaaagaugcauuaucuauga

SEQ ID NO: 1643714 - RNA, 20 nt, Homo sapiens
uaaaagcaggcuucuaugaa

SEQ ID NO: 1643715 - RNA, 17 nt, Homo sapiens
uaaaagcaucacaugaa

SEQ ID NO: 1643716 - RNA, 16 nt, Homo sapiens
uaaaauauuuucuaca

SEQ ID NO: 1643717 - RNA, 15 nt, Homo sapiens
uaaacacaugcauac

SEQ ID NO: 1643718 - RNA, 22 nt, Homo sapiens
uaaacagaggaguacaggugaa

SEQ ID NO: 1643719 - RNA, 21 nt, Homo sapiens
uaaaccaauuauaacuuauua

SEQ ID NO: 1643720 - RNA, 16 nt, Homo sapiens
uaaacccucugugaaa

SEQ ID NO: 1643721 - RNA, 17 nt, Homo sapiens
uaaaccuaauaaucuga

SEQ ID NO: 1643722 - RNA, 13 nt, Homo sapiens
uaaacugugcacc

SEQ ID NO: 1643723 - RNA, 19 nt, Homo sapiens
uaaagaaaaguuuuguaaa

SEQ ID NO: 1643724 - RNA, 17 nt, Homo sapiens
uaaagauguuuauuuca

SEQ ID NO: 1643725 - RNA, 23 nt, Homo sapiens
uaaagcaaagcaaaugaacacac

SEQ ID NO: 1643726 - RNA, 16 nt, Homo sapiens
uaaagcaggugcccag

SEQ ID NO: 1643727 - RNA, 17 nt, Homo sapiens
uaaaggacaaacaguga

SEQ ID NO: 1643728 - RNA, 22 nt, Homo sapiens
uaaaggauaauggugaacauuu

SEQ ID NO: 1643729 - RNA, 22 nt, Homo sapiens
uaaaggcaaugguuugugucaa

SEQ ID NO: 1643730 - RNA, 23 nt, Homo sapiens
uaaaggcaaugguuugugucaaa

SEQ ID NO: 1643731 - RNA, 19 nt, Homo sapiens
uaaagggcgcaaagggcau

SEQ ID NO: 1643732 - RNA, 20 nt, Homo sapiens
uaaaguaaauacaugcauau

SEQ ID NO: 1643733 - RNA, 18 nt, Homo sapiens
uaaagucuagcacaguuc

SEQ ID NO: 1643734 - RNA, 17 nt, Homo sapiens
uaaaguggaaguaugua

SEQ ID NO: 1643735 - RNA, 13 nt, Homo sapiens
uaaauaaauggaa

SEQ ID NO: 1643736 - RNA, 15 nt, Homo sapiens
uaaauacagucuucc

SEQ ID NO: 1643737 - RNA, 12 nt, Homo sapiens
uaaauagcucag

SEQ ID NO: 1643738 - RNA, 15 nt, Homo sapiens
uaaauauccugcuca

SEQ ID NO: 1643739 - RNA, 14 nt, Homo sapiens
uaaaucaaugcuau

SEQ ID NO: 1643740 - RNA, 15 nt, Homo sapiens
uaaaucacacauuca

SEQ ID NO: 1643741 - RNA, 16 nt, Homo sapiens
uaaauccaaugacaua

SEQ ID NO: 1643742 - RNA, 18 nt, Homo sapiens
uaaaucuaaugacauuca

SEQ ID NO: 1643743 - RNA, 14 nt, Homo sapiens
uaaaucuaguauac

SEQ ID NO: 1643744 - RNA, 16 nt, Homo sapiens
uaaauuauuuacugca

SEQ ID NO: 1643745 - RNA, 15 nt, Homo sapiens
uaaauuuuauuccaa

SEQ ID NO: 1643746 - RNA, 20 nt, Homo sapiens
uaaauuuuuuauaaaagugu

SEQ ID NO: 1643747 - RNA, 14 nt, Homo sapiens
uaacaacuaugauu

SEQ ID NO: 1643748 - RNA, 16 nt, Homo sapiens
uaacaaugacuuguac

SEQ ID NO: 1643749 - RNA, 13 nt, Homo sapiens
uaacacacagcua

SEQ ID NO: 1643750 - RNA, 18 nt, Homo sapiens
uaacacuguaauaucuuu

SEQ ID NO: 1643751 - RNA, 17 nt, Homo sapiens
uaacagguuuucuucua

SEQ ID NO: 1643752 - RNA, 18 nt, Homo sapiens
uaacaucauuguauuaac

SEQ ID NO: 1643753 - RNA, 23 nt, Homo sapiens
uaacccucacugggacuuuguaa

SEQ ID NO: 1643754 - RNA, 22 nt, Homo sapiens
uaaccucugagucaccaucuua

SEQ ID NO: 1643755 - RNA, 24 nt, Homo sapiens
uaaccuggguaaaugcagcgugaa

SEQ ID NO: 1643756 - RNA, 14 nt, Homo sapiens
uaacuauugcccag

SEQ ID NO: 1643757 - RNA, 17 nt, Homo sapiens
uaacucaauauuuucca

SEQ ID NO: 1643758 - RNA, 13 nt, Homo sapiens
uaagaaacugcca

SEQ ID NO: 1643759 - RNA, 18 nt, Homo sapiens
uaagacuagauacucgug

SEQ ID NO: 1643760 - RNA, 16 nt, Homo sapiens
uaagacugcugcugaa

SEQ ID NO: 1643761 - RNA, 15 nt, Homo sapiens
uaagagaacaaugug

SEQ ID NO: 1643762 - RNA, 15 nt, Homo sapiens
uaagaggccugugau

SEQ ID NO: 1643763 - RNA, 16 nt, Homo sapiens
uaagagggcacacacu

SEQ ID NO: 1643764 - RNA, 22 nt, Homo sapiens
uaagagggcacacacuguguac

SEQ ID NO: 1643765 - RNA, 16 nt, Homo sapiens
uaagcagaccacugau

SEQ ID NO: 1643766 - RNA, 19 nt, Homo sapiens
uaagccucaaauuugaaca

SEQ ID NO: 1643767 - RNA, 17 nt, Homo sapiens
uaagcuauuuugguuua

SEQ ID NO: 1643768 - RNA, 19 nt, Homo sapiens
uaaggaacauguacuguua

SEQ ID NO: 1643769 - RNA, 19 nt, Homo sapiens
uaaggauuauaaacaaccu

SEQ ID NO: 1643770 - RNA, 14 nt, Homo sapiens
uaaggcguggagcu

SEQ ID NO: 1643771 - RNA, 18 nt, Homo sapiens
uaaggugugaaaucauca

SEQ ID NO: 1643772 - RNA, 19 nt, Homo sapiens
uaaguagcaacccugugau

SEQ ID NO: 1643773 - RNA, 17 nt, Homo sapiens
uaagucaaccugccuga

SEQ ID NO: 1643774 - RNA, 22 nt, Homo sapiens
uaaguccuacuuuuaaagaauu

SEQ ID NO: 1643775 - RNA, 13 nt, Homo sapiens
uaagugugcaaaa

SEQ ID NO: 1643776 - RNA, 19 nt, Homo sapiens
uaaguugauggugaugaaa

SEQ ID NO: 1643777 - RNA, 20 nt, Homo sapiens
uaauaaugccuaccuuguga

SEQ ID NO: 1643778 - RNA, 20 nt, Homo sapiens
uaauaauguauguacagcug

SEQ ID NO: 1643779 - RNA, 18 nt, Homo sapiens
uaauacagacuaugucac

SEQ ID NO: 1643780 - RNA, 16 nt, Homo sapiens
uaauagaaacauugaa

SEQ ID NO: 1643781 - RNA, 13 nt, Homo sapiens
uaauagugccaag

SEQ ID NO: 1643782 - RNA, 22 nt, Homo sapiens
uaauauuuuauaccaaagccaa

SEQ ID NO: 1643783 - RNA, 15 nt, Homo sapiens
uaaucuaauacacuu

SEQ ID NO: 1643784 - RNA, 13 nt, Homo sapiens
uaaucuuuucaca

SEQ ID NO: 1643785 - RNA, 13 nt, Homo sapiens
uaaugaaugcaua

SEQ ID NO: 1643786 - RNA, 16 nt, Homo sapiens
uaaugcaagcaaagua

SEQ ID NO: 1643787 - RNA, 15 nt, Homo sapiens
uaaugcuuccaggga

SEQ ID NO: 1643788 - RNA, 18 nt, Homo sapiens
uaauguccuugcuuuaca

SEQ ID NO: 1643789 - RNA, 16 nt, Homo sapiens
uaauuaaaagacucca

SEQ ID NO: 1643790 - RNA, 15 nt, Homo sapiens
uaauuagaccuaggc

SEQ ID NO: 1643791 - RNA, 12 nt, Homo sapiens
uaauuagugaac

SEQ ID NO: 1643792 - RNA, 14 nt, Homo sapiens
uaauuauauuucua

SEQ ID NO: 1643793 - RNA, 20 nt, Homo sapiens
uaauucaguuauuugcacaa

SEQ ID NO: 1643794 - RNA, 16 nt, Homo sapiens
uaauucuagcuuugag

SEQ ID NO: 1643795 - RNA, 21 nt, Homo sapiens
uaauuugauaguauugugcau

SEQ ID NO: 1643796 - RNA, 17 nt, Homo sapiens
uaauuuugucagauuca

SEQ ID NO: 1643797 - RNA, 20 nt, Homo sapiens
uacaaaaccacuggaaaguu

SEQ ID NO: 1643798 - RNA, 21 nt, Homo sapiens
uacaaaauuucugaugagauu

SEQ ID NO: 1643799 - RNA, 13 nt, Homo sapiens
uacaaacaccugg

SEQ ID NO: 1643800 - RNA, 23 nt, Homo sapiens
uacaaaccauuuuguuauugacu

SEQ ID NO: 1643801 - RNA, 16 nt, Homo sapiens
uacaacuuccacucca

SEQ ID NO: 1643802 - RNA, 19 nt, Homo sapiens
uacaaguuaagguaucugg

SEQ ID NO: 1643803 - RNA, 14 nt, Homo sapiens
uacaauuacaucuc

SEQ ID NO: 1643804 - RNA, 12 nt, Homo sapiens
uacacaacaugu

SEQ ID NO: 1643805 - RNA, 21 nt, Homo sapiens
uacacacacacgcgugcacac

SEQ ID NO: 1643806 - RNA, 15 nt, Homo sapiens
uacacagcuguuucc

SEQ ID NO: 1643807 - RNA, 22 nt, Homo sapiens
uacacaguggccaagcggccau

SEQ ID NO: 1643808 - RNA, 20 nt, Homo sapiens
uacacauguauccuuucaca

SEQ ID NO: 1643809 - RNA, 15 nt, Homo sapiens
uacaccccaacagca

SEQ ID NO: 1643810 - RNA, 15 nt, Homo sapiens
uacacgaacugaaau

SEQ ID NO: 1643811 - RNA, 20 nt, Homo sapiens
uacacgaagaccauccaucc

SEQ ID NO: 1643812 - RNA, 17 nt, Homo sapiens
uacacuuuuuuccaaag

SEQ ID NO: 1643813 - RNA, 23 nt, Homo sapiens
uacagaauaaaagaauuacauau

SEQ ID NO: 1643814 - RNA, 20 nt, Homo sapiens
uacagcuggguggcacugcc

SEQ ID NO: 1643815 - RNA, 17 nt, Homo sapiens
uacaggcgccugccaca

SEQ ID NO: 1643816 - RNA, 22 nt, Homo sapiens
uacaguaggagcccagcucuga

SEQ ID NO: 1643817 - RNA, 16 nt, Homo sapiens
gucguugacuuuaggg

SEQ ID NO: 1643818 - RNA, 17 nt, Homo sapiens
gucuacguuaccaggca

SEQ ID NO: 1643819 - RNA, 14 nt, Homo sapiens
gucucaauugggaa

SEQ ID NO: 1643820 - RNA, 13 nt, Homo sapiens
gucucugugagac

SEQ ID NO: 1643821 - RNA, 16 nt, Homo sapiens
gucuggaaugcagugg

SEQ ID NO: 1643822 - RNA, 19 nt, Homo sapiens
gucuggcaaacaugugcaa

SEQ ID NO: 1643823 - RNA, 21 nt, Homo sapiens
gucuuaaacuaaaugugcaau

SEQ ID NO: 1643824 - RNA, 15 nt, Homo sapiens
gucuuaacucaccau

SEQ ID NO: 1643825 - RNA, 17 nt, Homo sapiens
gucuuacuuugugcaaa

SEQ ID NO: 1643826 - RNA, 15 nt, Homo sapiens
gucuuaucaacuggu

SEQ ID NO: 1643827 - RNA, 12 nt, Homo sapiens
gucuugaacucc

SEQ ID NO: 1643828 - RNA, 17 nt, Homo sapiens
gucuugcaauggcagcc

SEQ ID NO: 1643829 - RNA, 14 nt, Homo sapiens
gucuuuagugcucc

SEQ ID NO: 1643830 - RNA, 18 nt, Homo sapiens
gucuuuauaaugggauau

SEQ ID NO: 1643831 - RNA, 23 nt, Homo sapiens
gucuuugaagugacuucacagag

SEQ ID NO: 1643832 - RNA, 13 nt, Homo sapiens
gugaacauuuuaa

SEQ ID NO: 1643833 - RNA, 15 nt, Homo sapiens
gugaauaaaccauca

SEQ ID NO: 1643834 - RNA, 13 nt, Homo sapiens
gugaauuagcuca

SEQ ID NO: 1643835 - RNA, 16 nt, Homo sapiens
gugaauuagcucacuu

SEQ ID NO: 1643836 - RNA, 20 nt, Homo sapiens
gugaauuuuugcacauucua

SEQ ID NO: 1643837 - RNA, 17 nt, Homo sapiens
gugacaugugaaaccuu

SEQ ID NO: 1643838 - RNA, 19 nt, Homo sapiens
gugacauuuauuuuucuca

SEQ ID NO: 1643839 - RNA, 19 nt, Homo sapiens
gugacauuuccaugcauaa

SEQ ID NO: 1643840 - RNA, 17 nt, Homo sapiens
gugagaaggagauucaa

SEQ ID NO: 1643841 - RNA, 21 nt, Homo sapiens
gugagcacuaaggugugcucu

SEQ ID NO: 1643842 - RNA, 23 nt, Homo sapiens
gugagggauaguggggucagggc

SEQ ID NO: 1643843 - RNA, 18 nt, Homo sapiens
gugauccacccaccucag

SEQ ID NO: 1643844 - RNA, 18 nt, Homo sapiens
gugauccuuccaccucag

SEQ ID NO: 1643845 - RNA, 17 nt, Homo sapiens
gugaugucaucugucac

SEQ ID NO: 1643846 - RNA, 23 nt, Homo sapiens
gugcaaaagcagaaaauacagcu

SEQ ID NO: 1643847 - RNA, 20 nt, Homo sapiens
gugcagugagccgagaucac

SEQ ID NO: 1643848 - RNA, 19 nt, Homo sapiens
gugcaguggcacgaucuca

SEQ ID NO: 1643849 - RNA, 18 nt, Homo sapiens
gugcauagagccacguau

SEQ ID NO: 1643850 - RNA, 18 nt, Homo sapiens
gugccuggccaaagggau

SEQ ID NO: 1643851 - RNA, 12 nt, Homo sapiens
gugcgucugugu

SEQ ID NO: 1643852 - RNA, 23 nt, Homo sapiens
gugcugcagauuugauauuugca

SEQ ID NO: 1643853 - RNA, 15 nt, Homo sapiens
gugcuggagccacua

SEQ ID NO: 1643854 - RNA, 21 nt, Homo sapiens
gugcugggauuacagguguga

SEQ ID NO: 1643855 - RNA, 17 nt, Homo sapiens
guggccacagcagcuuu

SEQ ID NO: 1643856 - RNA, 20 nt, Homo sapiens
guggcccuccaguguaugag

SEQ ID NO: 1643857 - RNA, 19 nt, Homo sapiens
guggcucugggguccucac

SEQ ID NO: 1643858 - RNA, 14 nt, Homo sapiens
guguaaacaggauu

SEQ ID NO: 1643859 - RNA, 19 nt, Homo sapiens
guguacagucuuguauuaa

SEQ ID NO: 1643860 - RNA, 19 nt, Homo sapiens
guguaugagagggcccugc

SEQ ID NO: 1643861 - RNA, 14 nt, Homo sapiens
gugucaaaacuggu

SEQ ID NO: 1643862 - RNA, 15 nt, Homo sapiens
gugucaccugugcuu

SEQ ID NO: 1643863 - RNA, 17 nt, Homo sapiens
gugugaacguguaugua

SEQ ID NO: 1643864 - RNA, 22 nt, Homo sapiens
guguggggugaggggagggagu

SEQ ID NO: 1643865 - RNA, 22 nt, Homo sapiens
gugugugcacguacacacacau

SEQ ID NO: 1643866 - RNA, 14 nt, Homo sapiens
guguuaaaugugau

SEQ ID NO: 1643867 - RNA, 17 nt, Homo sapiens
guguugacaugugcuuu

SEQ ID NO: 1643868 - RNA, 22 nt, Homo sapiens
guguugauacuguugcacgugu

SEQ ID NO: 1643869 - RNA, 17 nt, Homo sapiens
guguuuuuuuacauacg

SEQ ID NO: 1643870 - RNA, 13 nt, Homo sapiens
guuaauaaagaag

SEQ ID NO: 1643871 - RNA, 16 nt, Homo sapiens
guuacagcacaaaaug

SEQ ID NO: 1643872 - RNA, 18 nt, Homo sapiens
guuagagaauuuccuuac

SEQ ID NO: 1643873 - RNA, 14 nt, Homo sapiens
guuagcaucuggcu

SEQ ID NO: 1643874 - RNA, 19 nt, Homo sapiens
guuaggccuggcacagugu

SEQ ID NO: 1643875 - RNA, 14 nt, Homo sapiens
guuaguguuuagaa

SEQ ID NO: 1643876 - RNA, 15 nt, Homo sapiens
guuauauuacuugcc

SEQ ID NO: 1643877 - RNA, 15 nt, Homo sapiens
guuauuuauagcugu

SEQ ID NO: 1643878 - RNA, 12 nt, Homo sapiens
guucaaagccag

SEQ ID NO: 1643879 - RNA, 14 nt, Homo sapiens
guucacaccauucu

SEQ ID NO: 1643880 - RNA, 18 nt, Homo sapiens
guuccccgauaccaugcu

SEQ ID NO: 1643881 - RNA, 13 nt, Homo sapiens
guucuacuugaua

SEQ ID NO: 1643882 - RNA, 21 nt, Homo sapiens
guucuauauaaaaaacauaau

SEQ ID NO: 1643883 - RNA, 18 nt, Homo sapiens
guucucaucuuucuugau

SEQ ID NO: 1643884 - RNA, 21 nt, Homo sapiens
guucuccagucauuauguuaa

SEQ ID NO: 1643885 - RNA, 19 nt, Homo sapiens
guucugggauuacaggugu

SEQ ID NO: 1643886 - RNA, 22 nt, Homo sapiens
guucuguauucgaaaugagcuc

SEQ ID NO: 1643887 - RNA, 19 nt, Homo sapiens
guugagcgugcgucugugu

SEQ ID NO: 1643888 - RNA, 23 nt, Homo sapiens
guugauuucagcaccuacagugu

SEQ ID NO: 1643889 - RNA, 15 nt, Homo sapiens
guugcuguaugucuc

SEQ ID NO: 1643890 - RNA, 13 nt, Homo sapiens
guuggaacauccu

SEQ ID NO: 1643891 - RNA, 14 nt, Homo sapiens
guuggcaguguuug

SEQ ID NO: 1643892 - RNA, 22 nt, Homo sapiens
guuggccagugugacaaggauu

SEQ ID NO: 1643893 - RNA, 13 nt, Homo sapiens
guuggugacaauu

SEQ ID NO: 1643894 - RNA, 20 nt, Homo sapiens
guuguagcagugauucagua

SEQ ID NO: 1643895 - RNA, 13 nt, Homo sapiens
guuguuaaaggca

SEQ ID NO: 1643896 - RNA, 21 nt, Homo sapiens
guuguuaauaaaaguacaugu

SEQ ID NO: 1643897 - RNA, 22 nt, Homo sapiens
guuguuugauucagacagcugc

SEQ ID NO: 1643898 - RNA, 20 nt, Homo sapiens
guuuaaacauaggaaagaag

SEQ ID NO: 1643899 - RNA, 15 nt, Homo sapiens
guuuaauaguauauc

SEQ ID NO: 1643900 - RNA, 18 nt, Homo sapiens
guuuacauuuuguauauu

SEQ ID NO: 1643901 - RNA, 14 nt, Homo sapiens
guuuaccuucaugg

SEQ ID NO: 1643902 - RNA, 23 nt, Homo sapiens
guuuagcauaguaccucugcuau

SEQ ID NO: 1643903 - RNA, 20 nt, Homo sapiens
guuuaugcauagauaaucuc

SEQ ID NO: 1643904 - RNA, 22 nt, Homo sapiens
guuuauuucaggcauuggauau

SEQ ID NO: 1643905 - RNA, 20 nt, Homo sapiens
guuuccguggguucugucau

SEQ ID NO: 1643906 - RNA, 15 nt, Homo sapiens
guuuccuuucauuua

SEQ ID NO: 1643907 - RNA, 23 nt, Homo sapiens
guuucugugcagauaaacagaaa

SEQ ID NO: 1643908 - RNA, 16 nt, Homo sapiens
guuucuuagcuuuuua

SEQ ID NO: 1643909 - RNA, 21 nt, Homo sapiens
guuugaacucuucuuugccag

SEQ ID NO: 1643910 - RNA, 14 nt, Homo sapiens
guuugaguuacuau

SEQ ID NO: 1643911 - RNA, 18 nt, Homo sapiens
guuugaugaggcccucca

SEQ ID NO: 1643912 - RNA, 17 nt, Homo sapiens
guuugauuauucagugu

SEQ ID NO: 1643913 - RNA, 15 nt, Homo sapiens
guuuggccaucucug

SEQ ID NO: 1643914 - RNA, 17 nt, Homo sapiens
guuuguaagguggucac

SEQ ID NO: 1643915 - RNA, 15 nt, Homo sapiens
guuuuaaacauucuu

SEQ ID NO: 1643916 - RNA, 17 nt, Homo sapiens
guuuuaacuguggauau

SEQ ID NO: 1643917 - RNA, 18 nt, Homo sapiens
guuuuaucuccugugauc

SEQ ID NO: 1643918 - RNA, 21 nt, Homo sapiens
guuuucuucuaaucauaacau

SEQ ID NO: 1643919 - RNA, 20 nt, Homo sapiens
guuuucuuuuucagauuuau

SEQ ID NO: 1643920 - RNA, 16 nt, Homo sapiens
guuuuuaauuguucau

SEQ ID NO: 1643921 - RNA, 21 nt, Homo sapiens
guuuuuuuaagucacuuugua

SEQ ID NO: 1643922 - RNA, 18 nt, Homo sapiens
uaaaaaaauuccaaguga

SEQ ID NO: 1643923 - RNA, 17 nt, Homo sapiens
uaaaaaccugaacuuuc

SEQ ID NO: 1643924 - RNA, 22 nt, Homo sapiens
uaaaaauauauagcgacauccu

SEQ ID NO: 1643925 - RNA, 23 nt, Homo sapiens
uaaaaauggcaggggguggaauu

SEQ ID NO: 1643926 - RNA, 23 nt, Homo sapiens
ggcuuugugauucccuccaguga

SEQ ID NO: 1643927 - RNA, 13 nt, Homo sapiens
gggaaaaccagac

SEQ ID NO: 1643928 - RNA, 20 nt, Homo sapiens
gggaagccaggauuggggac

SEQ ID NO: 1643929 - RNA, 20 nt, Homo sapiens
gggaagggugguggagccag

SEQ ID NO: 1643930 - RNA, 13 nt, Homo sapiens
gggacagggauga

SEQ ID NO: 1643931 - RNA, 15 nt, Homo sapiens
gggacccugcucaca

SEQ ID NO: 1643932 - RNA, 19 nt, Homo sapiens
gggacuggcgagucugcuu

SEQ ID NO: 1643933 - RNA, 23 nt, Homo sapiens
gggagagaaagcuuuauauuugu

SEQ ID NO: 1643934 - RNA, 14 nt, Homo sapiens
gggauuacagacau

SEQ ID NO: 1643935 - RNA, 16 nt, Homo sapiens
gggcaacuauucauga

SEQ ID NO: 1643936 - RNA, 16 nt, Homo sapiens
gggcaagggaccugcu

SEQ ID NO: 1643937 - RNA, 13 nt, Homo sapiens
gggcacacacugu

SEQ ID NO: 1643938 - RNA, 14 nt, Homo sapiens
gggcagucauuauc

SEQ ID NO: 1643939 - RNA, 13 nt, Homo sapiens
gggccacugccug

SEQ ID NO: 1643940 - RNA, 17 nt, Homo sapiens
gggcccugccugcugca

SEQ ID NO: 1643941 - RNA, 17 nt, Homo sapiens
gggcuaucccuuuccaa

SEQ ID NO: 1643942 - RNA, 14 nt, Homo sapiens
gggcucgugcccug

SEQ ID NO: 1643943 - RNA, 19 nt, Homo sapiens
gggcugcaaugcagcaugu

SEQ ID NO: 1643944 - RNA, 18 nt, Homo sapiens
gggcuggaaugauuucag

SEQ ID NO: 1643945 - RNA, 16 nt, Homo sapiens
gggcuuuuacaccagu

SEQ ID NO: 1643946 - RNA, 19 nt, Homo sapiens
ggggacucgguaagcacuu

SEQ ID NO: 1643947 - RNA, 14 nt, Homo sapiens
ggguaucuggugac

SEQ ID NO: 1643948 - RNA, 16 nt, Homo sapiens
gggucccucucuugac

SEQ ID NO: 1643949 - RNA, 23 nt, Homo sapiens
gggucccugauaacaaccuggag

SEQ ID NO: 1643950 - RNA, 22 nt, Homo sapiens
gggucucggugguaccaggucu

SEQ ID NO: 1643951 - RNA, 21 nt, Homo sapiens
ggguguggcgcagcauauuca

SEQ ID NO: 1643952 - RNA, 14 nt, Homo sapiens
ggguucaagugauu

SEQ ID NO: 1643953 - RNA, 24 nt, Homo sapiens
ggguucugucauguaacacgacau

SEQ ID NO: 1643954 - RNA, 22 nt, Homo sapiens
ggguuucccuugcccuuuccau

SEQ ID NO: 1643955 - RNA, 14 nt, Homo sapiens
gguaaaauacauau

SEQ ID NO: 1643956 - RNA, 19 nt, Homo sapiens
gguaaagggcgcaaagggc

SEQ ID NO: 1643957 - RNA, 14 nt, Homo sapiens
gguacauauuucuu

SEQ ID NO: 1643958 - RNA, 18 nt, Homo sapiens
gguaugaucacggcucac

SEQ ID NO: 1643959 - RNA, 19 nt, Homo sapiens
gguauguagcaguaucuca

SEQ ID NO: 1643960 - RNA, 23 nt, Homo sapiens
gguauuaacuuuauacacuugga

SEQ ID NO: 1643961 - RNA, 18 nt, Homo sapiens
ggucacuuccguuuaccu

SEQ ID NO: 1643962 - RNA, 14 nt, Homo sapiens
ggucaucacuuuga

SEQ ID NO: 1643963 - RNA, 19 nt, Homo sapiens
gguccugcugcuggcugcc

SEQ ID NO: 1643964 - RNA, 18 nt, Homo sapiens
ggucuaaagugagcucua

SEQ ID NO: 1643965 - RNA, 18 nt, Homo sapiens
ggucuuacuuugugcaaa

SEQ ID NO: 1643966 - RNA, 18 nt, Homo sapiens
ggucuucuccauccucac

SEQ ID NO: 1643967 - RNA, 19 nt, Homo sapiens
ggugagacacugcacagaa

SEQ ID NO: 1643968 - RNA, 12 nt, Homo sapiens
ggugaggacaca

SEQ ID NO: 1643969 - RNA, 23 nt, Homo sapiens
ggugcuacacccuuuuccagcug

SEQ ID NO: 1643970 - RNA, 20 nt, Homo sapiens
gguggaucacaaggucaaga

SEQ ID NO: 1643971 - RNA, 21 nt, Homo sapiens
gguggaugccugguggcagcu

SEQ ID NO: 1643972 - RNA, 17 nt, Homo sapiens
gguggauuccaugccgc

SEQ ID NO: 1643973 - RNA, 14 nt, Homo sapiens
gguggucacuggaa

SEQ ID NO: 1643974 - RNA, 16 nt, Homo sapiens
gguuccggcauggaca

SEQ ID NO: 1643975 - RNA, 16 nt, Homo sapiens
gguucuacccaggugc

SEQ ID NO: 1643976 - RNA, 16 nt, Homo sapiens
gguuuacaacaaacac

SEQ ID NO: 1643977 - RNA, 18 nt, Homo sapiens
gguuuaugcucaauccau

SEQ ID NO: 1643978 - RNA, 16 nt, Homo sapiens
gguuucacuugcacau

SEQ ID NO: 1643979 - RNA, 22 nt, Homo sapiens
guaaacagaggaguacagguga

SEQ ID NO: 1643980 - RNA, 17 nt, Homo sapiens
guaaagggcgcaaaggg

SEQ ID NO: 1643981 - RNA, 21 nt, Homo sapiens
guaaauuucucuacugucuca

SEQ ID NO: 1643982 - RNA, 19 nt, Homo sapiens
gcucagcggggacagcucc

SEQ ID NO: 1643983 - RNA, 18 nt, Homo sapiens
gcucaggaccaggcaaug

SEQ ID NO: 1643984 - RNA, 19 nt, Homo sapiens
gcucaggcuuuuccaggaa

SEQ ID NO: 1643985 - RNA, 19 nt, Homo sapiens
gcucagggaauaauccaga

SEQ ID NO: 1643986 - RNA, 22 nt, Homo sapiens
gcucagggcuaaacgggcauug

SEQ ID NO: 1643987 - RNA, 11 nt, Homo sapiens
gcucauuucag

SEQ ID NO: 1643988 - RNA, 16 nt, Homo sapiens
gcuccaccgucagggg

SEQ ID NO: 1643989 - RNA, 20 nt, Homo sapiens
gcuccauguagaagccacua

SEQ ID NO: 1643990 - RNA, 18 nt, Homo sapiens
gcuccauuuucuugucaa

SEQ ID NO: 1643991 - RNA, 19 nt, Homo sapiens
gcuccauuuuuagugaaau

SEQ ID NO: 1643992 - RNA, 23 nt, Homo sapiens
gcucccaagggauggugcccugu

SEQ ID NO: 1643993 - RNA, 21 nt, Homo sapiens
gcuccccuccccaacugacca

SEQ ID NO: 1643994 - RNA, 17 nt, Homo sapiens
gcucccuuuuaagccag

SEQ ID NO: 1643995 - RNA, 14 nt, Homo sapiens
gcucucuaauucca

SEQ ID NO: 1643996 - RNA, 15 nt, Homo sapiens
gcucuucucauuuca

SEQ ID NO: 1643997 - RNA, 16 nt, Homo sapiens
gcucuucucauuucac

SEQ ID NO: 1643998 - RNA, 18 nt, Homo sapiens
gcucuugaacuccugacc

SEQ ID NO: 1643999 - RNA, 13 nt, Homo sapiens
gcucuuuauaugu

SEQ ID NO: 1644000 - RNA, 16 nt, Homo sapiens
gcugaggcaagagaau

SEQ ID NO: 1644001 - RNA, 22 nt, Homo sapiens
gcugaguguuucacaccuuauc

SEQ ID NO: 1644002 - RNA, 19 nt, Homo sapiens
gcugaguuccggggugcaa

SEQ ID NO: 1644003 - RNA, 22 nt, Homo sapiens
gcugauacaaauugcagacugu

SEQ ID NO: 1644004 - RNA, 19 nt, Homo sapiens
gcugaugaacuguggugcc

SEQ ID NO: 1644005 - RNA, 14 nt, Homo sapiens
gcugcaaugcagca

SEQ ID NO: 1644006 - RNA, 17 nt, Homo sapiens
gcugccuccacucccac

SEQ ID NO: 1644007 - RNA, 16 nt, Homo sapiens
gcugccucuaccugac

SEQ ID NO: 1644008 - RNA, 19 nt, Homo sapiens
gcugccucuaccugacacu

SEQ ID NO: 1644009 - RNA, 23 nt, Homo sapiens
gcugccuggacccguucaugggg

SEQ ID NO: 1644010 - RNA, 17 nt, Homo sapiens
gcugcuggcugugacaa

SEQ ID NO: 1644011 - RNA, 17 nt, Homo sapiens
gcuggaaggcagcuugu

SEQ ID NO: 1644012 - RNA, 19 nt, Homo sapiens
gcuggaccugccugcugca

SEQ ID NO: 1644013 - RNA, 20 nt, Homo sapiens
gcuggagugcaguggcacca

SEQ ID NO: 1644014 - RNA, 20 nt, Homo sapiens
gcuggagugcaguggcacga

SEQ ID NO: 1644015 - RNA, 22 nt, Homo sapiens
gcuggcaccuuaguugcaugac

SEQ ID NO: 1644016 - RNA, 21 nt, Homo sapiens
gcuggcagagagcacagugau

SEQ ID NO: 1644017 - RNA, 23 nt, Homo sapiens
gcuggccucucugacauaugcua

SEQ ID NO: 1644018 - RNA, 16 nt, Homo sapiens
gcugggacuacaggug

SEQ ID NO: 1644019 - RNA, 15 nt, Homo sapiens
gcugggagcaggacu

SEQ ID NO: 1644020 - RNA, 16 nt, Homo sapiens
gcugggauuacaggug

SEQ ID NO: 1644021 - RNA, 12 nt, Homo sapiens
gcugggcagcug

SEQ ID NO: 1644022 - RNA, 15 nt, Homo sapiens
gcugggcagcuggaa

SEQ ID NO: 1644023 - RNA, 12 nt, Homo sapiens
gcuggugccuga

SEQ ID NO: 1644024 - RNA, 14 nt, Homo sapiens
gcuguagaagaugg

SEQ ID NO: 1644025 - RNA, 18 nt, Homo sapiens
gcuguuguaaagaauugg

SEQ ID NO: 1644026 - RNA, 21 nt, Homo sapiens
gcuuaauuauugauguuuuca

SEQ ID NO: 1644027 - RNA, 21 nt, Homo sapiens
gcuuagacuaaggccauuauu

SEQ ID NO: 1644028 - RNA, 20 nt, Homo sapiens
gcuuauaaauggcaccacau

SEQ ID NO: 1644029 - RNA, 17 nt, Homo sapiens
gcuuauuauagaauugc

SEQ ID NO: 1644030 - RNA, 19 nt, Homo sapiens
gcuucacagaugugugauu

SEQ ID NO: 1644031 - RNA, 13 nt, Homo sapiens
gcuucacaguacc

SEQ ID NO: 1644032 - RNA, 15 nt, Homo sapiens
gcuucaguggcagcu

SEQ ID NO: 1644033 - RNA, 22 nt, Homo sapiens
ccauuagcauuugucaacaaag

SEQ ID NO: 1644034 - RNA, 23 nt, Homo sapiens
ccauuuguuaaaaagacuguuau

SEQ ID NO: 1644035 - RNA, 16 nt, Homo sapiens
ccauuuuuagugaaau

SEQ ID NO: 1644036 - RNA, 17 nt, Homo sapiens
cccaaaaauuacuuugg

SEQ ID NO: 1644037 - RNA, 13 nt, Homo sapiens
cccaaacagugac

SEQ ID NO: 1644038 - RNA, 20 nt, Homo sapiens
cccaagagcuuccagagcuc

SEQ ID NO: 1644039 - RNA, 23 nt, Homo sapiens
cccaagugauccuuccaccucag

SEQ ID NO: 1644040 - RNA, 13 nt, Homo sapiens
cccacagguauga

SEQ ID NO: 1644041 - RNA, 16 nt, Homo sapiens
cccacugcucugguua

SEQ ID NO: 1644042 - RNA, 10 nt, Homo sapiens
cccacuuccc

SEQ ID NO: 1644043 - RNA, 17 nt, Homo sapiens
cccacuucugcacuugc

SEQ ID NO: 1644044 - RNA, 13 nt, Homo sapiens
cccagaauggagg

SEQ ID NO: 1644045 - RNA, 18 nt, Homo sapiens
cccagagguaacagaaca

SEQ ID NO: 1644046 - RNA, 12 nt, Homo sapiens
cccagauugcaa

SEQ ID NO: 1644047 - RNA, 14 nt, Homo sapiens
cccagcacagacuc

SEQ ID NO: 1644048 - RNA, 14 nt, Homo sapiens
cccagccccuccau

SEQ ID NO: 1644049 - RNA, 22 nt, Homo sapiens
cccagcugacaguccucuccac

SEQ ID NO: 1644050 - RNA, 13 nt, Homo sapiens
cccaggacugggc

SEQ ID NO: 1644051 - RNA, 21 nt, Homo sapiens
cccaguaauuauuuucuuccu

SEQ ID NO: 1644052 - RNA, 15 nt, Homo sapiens
cccaugaaugugagc

SEQ ID NO: 1644053 - RNA, 23 nt, Homo sapiens
ccccaacagcacccucuccagau

SEQ ID NO: 1644054 - RNA, 17 nt, Homo sapiens
ccccaaguuaguucaau

SEQ ID NO: 1644055 - RNA, 15 nt, Homo sapiens
ccccagccuggccca

SEQ ID NO: 1644056 - RNA, 15 nt, Homo sapiens
ccccagugcccacag

SEQ ID NO: 1644057 - RNA, 19 nt, Homo sapiens
ccccaguggacaccaauga

SEQ ID NO: 1644058 - RNA, 11 nt, Homo sapiens
cccccaacagc

SEQ ID NO: 1644059 - RNA, 19 nt, Homo sapiens
ccccuaacaaagaccauga

SEQ ID NO: 1644060 - RNA, 19 nt, Homo sapiens
ccccucccacagcgcuggc

SEQ ID NO: 1644061 - RNA, 20 nt, Homo sapiens
ccccucccagcugacagucc

SEQ ID NO: 1644062 - RNA, 13 nt, Homo sapiens
ccccuugcucuca

SEQ ID NO: 1644063 - RNA, 22 nt, Homo sapiens
cccgccacccucccacugccaa

SEQ ID NO: 1644064 - RNA, 17 nt, Homo sapiens
cccuaaaucuugacuac

SEQ ID NO: 1644065 - RNA, 18 nt, Homo sapiens
cccuaacaaagaccauga

SEQ ID NO: 1644066 - RNA, 21 nt, Homo sapiens
cccuaguuauuuucugaaaaa

SEQ ID NO: 1644067 - RNA, 17 nt, Homo sapiens
cccucaaaacuuggaau

SEQ ID NO: 1644068 - RNA, 20 nt, Homo sapiens
cccucaaaccuugaggagaa

SEQ ID NO: 1644069 - RNA, 14 nt, Homo sapiens
cccucccugccuaa

SEQ ID NO: 1644070 - RNA, 13 nt, Homo sapiens
cccucucaggcug

SEQ ID NO: 1644071 - RNA, 19 nt, Homo sapiens
cccucuccuccguggcaca

SEQ ID NO: 1644072 - RNA, 18 nt, Homo sapiens
cccucucuuauaauucca

SEQ ID NO: 1644073 - RNA, 14 nt, Homo sapiens
cauugaucugggau

SEQ ID NO: 1644074 - RNA, 18 nt, Homo sapiens
cauugccuuuucuagccc

SEQ ID NO: 1644075 - RNA, 14 nt, Homo sapiens
cauugggauauucu

SEQ ID NO: 1644076 - RNA, 21 nt, Homo sapiens
cauuuaaagggugauguacac

SEQ ID NO: 1644077 - RNA, 22 nt, Homo sapiens
cauuuaagagacagucacccca

SEQ ID NO: 1644078 - RNA, 19 nt, Homo sapiens
cauuuacuguggcuucuua

SEQ ID NO: 1644079 - RNA, 22 nt, Homo sapiens
cauuuaguuugauuauucagug

SEQ ID NO: 1644080 - RNA, 21 nt, Homo sapiens
cauuuaugauuuaauaaaaua

SEQ ID NO: 1644081 - RNA, 16 nt, Homo sapiens
cauuuauuuuucucau

SEQ ID NO: 1644082 - RNA, 16 nt, Homo sapiens
cauuugaaaucuauga

SEQ ID NO: 1644083 - RNA, 16 nt, Homo sapiens
cauuuggcaaugccau

SEQ ID NO: 1644084 - RNA, 19 nt, Homo sapiens
cauuuucagcaucaaacau

SEQ ID NO: 1644085 - RNA, 18 nt, Homo sapiens
cauuuucuugucaaugga

SEQ ID NO: 1644086 - RNA, 12 nt, Homo sapiens
cauuuuggcaac

SEQ ID NO: 1644087 - RNA, 15 nt, Homo sapiens
ccaaaaauuacuuug

SEQ ID NO: 1644088 - RNA, 22 nt, Homo sapiens
ccaaaauccccuucucaucacu

SEQ ID NO: 1644089 - RNA, 22 nt, Homo sapiens
ccaaaaugaaccuugcuaucaa

SEQ ID NO: 1644090 - RNA, 12 nt, Homo sapiens
ccaaacagugac

SEQ ID NO: 1644091 - RNA, 17 nt, Homo sapiens
ccaaacauccuacaaga

SEQ ID NO: 1644092 - RNA, 20 nt, Homo sapiens
ccaaagccaauaaaugaacu

SEQ ID NO: 1644093 - RNA, 11 nt, Homo sapiens
ccaaagggaua

SEQ ID NO: 1644094 - RNA, 13 nt, Homo sapiens
ccaaagugcugcg

SEQ ID NO: 1644095 - RNA, 15 nt, Homo sapiens
ccaaagugcugggau

SEQ ID NO: 1644096 - RNA, 17 nt, Homo sapiens
ccaaagugcugggauua

SEQ ID NO: 1644097 - RNA, 18 nt, Homo sapiens
ccaaagugcugggauuac

SEQ ID NO: 1644098 - RNA, 17 nt, Homo sapiens
ccaaauauuccagagac

SEQ ID NO: 1644099 - RNA, 14 nt, Homo sapiens
ccaaauguguauaa

SEQ ID NO: 1644100 - RNA, 15 nt, Homo sapiens
ccaacagcacccucu

SEQ ID NO: 1644101 - RNA, 11 nt, Homo sapiens
ccaacaugacu

SEQ ID NO: 1644102 - RNA, 14 nt, Homo sapiens
ccaacaugugcuca

SEQ ID NO: 1644103 - RNA, 16 nt, Homo sapiens
ccaacuauaauuauaa

SEQ ID NO: 1644104 - RNA, 17 nt, Homo sapiens
ccaagcucccaagagcu

SEQ ID NO: 1644105 - RNA, 15 nt, Homo sapiens
ccaaggaaaccacag

SEQ ID NO: 1644106 - RNA, 21 nt, Homo sapiens
ccaagggaugggaccugauga

SEQ ID NO: 1644107 - RNA, 18 nt, Homo sapiens
ccaagggcagaggggugc

SEQ ID NO: 1644108 - RNA, 18 nt, Homo sapiens
ccaaguccacaguggaac

SEQ ID NO: 1644109 - RNA, 16 nt, Homo sapiens
ccaagugauccuucca

SEQ ID NO: 1644110 - RNA, 21 nt, Homo sapiens
ccaaguucuuaguugcuguau

SEQ ID NO: 1644111 - RNA, 19 nt, Homo sapiens
ccaaucuuaaacauaauaa

SEQ ID NO: 1644112 - RNA, 13 nt, Homo sapiens
cagaugugugauu

SEQ ID NO: 1644113 - RNA, 14 nt, Homo sapiens
cagcaaaaacagcu

SEQ ID NO: 1644114 - RNA, 21 nt, Homo sapiens
cagcaacuggugauuguuuca

SEQ ID NO: 1644115 - RNA, 13 nt, Homo sapiens
cagcacccuauau

SEQ ID NO: 1644116 - RNA, 15 nt, Homo sapiens
cagcaccuacagugu

SEQ ID NO: 1644117 - RNA, 15 nt, Homo sapiens
cagcacuaauucaac

SEQ ID NO: 1644118 - RNA, 15 nt, Homo sapiens
cagcacugacuggaa

SEQ ID NO: 1644119 - RNA, 13 nt, Homo sapiens
cagccaagggaug

SEQ ID NO: 1644120 - RNA, 12 nt, Homo sapiens
cagccacagugu

SEQ ID NO: 1644121 - RNA, 12 nt, Homo sapiens
cagccacauaug

SEQ ID NO: 1644122 - RNA, 17 nt, Homo sapiens
cagccaggugcugugac

SEQ ID NO: 1644123 - RNA, 18 nt, Homo sapiens
cagccaggugcugugaca

SEQ ID NO: 1644124 - RNA, 17 nt, Homo sapiens
cagcccaagaugcuuua

SEQ ID NO: 1644125 - RNA, 16 nt, Homo sapiens
cagcccccacccggug

SEQ ID NO: 1644126 - RNA, 19 nt, Homo sapiens
cagccucccgaauagcugg

SEQ ID NO: 1644127 - RNA, 20 nt, Homo sapiens
cagccucccgaguagcugag

SEQ ID NO: 1644128 - RNA, 19 nt, Homo sapiens
cagccucccgaguagcugg

SEQ ID NO: 1644129 - RNA, 20 nt, Homo sapiens
cagccucccgaguagcuggg

SEQ ID NO: 1644130 - RNA, 14 nt, Homo sapiens
cagccucuagggac

SEQ ID NO: 1644131 - RNA, 13 nt, Homo sapiens
cagcuaaagcaau

SEQ ID NO: 1644132 - RNA, 16 nt, Homo sapiens
cagcuaacaauuguga

SEQ ID NO: 1644133 - RNA, 21 nt, Homo sapiens
cagcuaauugagaccacaggc

SEQ ID NO: 1644134 - RNA, 15 nt, Homo sapiens
cagcuccuucugucc

SEQ ID NO: 1644135 - RNA, 23 nt, Homo sapiens
cagcuggguuggaaaacaguauu

SEQ ID NO: 1644136 - RNA, 17 nt, Homo sapiens
cagcugugguacaaaug

SEQ ID NO: 1644137 - RNA, 20 nt, Homo sapiens
cagcuguuuaugcauagaua

SEQ ID NO: 1644138 - RNA, 13 nt, Homo sapiens
cagcuuauauuca

SEQ ID NO: 1644139 - RNA, 14 nt, Homo sapiens
cagcuucuacggug

SEQ ID NO: 1644140 - RNA, 19 nt, Homo sapiens
cagcuuguaaauagcucag

SEQ ID NO: 1644141 - RNA, 22 nt, Homo sapiens
cagcuuucaaaagcaagaacac

SEQ ID NO: 1644142 - RNA, 15 nt, Homo sapiens
caggaaaaucugcac

SEQ ID NO: 1644143 - RNA, 21 nt, Homo sapiens
caggagccggacacuucucag

SEQ ID NO: 1644144 - RNA, 23 nt, Homo sapiens
caggaggaggugccaacaguguu

SEQ ID NO: 1644145 - RNA, 19 nt, Homo sapiens
caggauccaauaauuuucc

SEQ ID NO: 1644146 - RNA, 19 nt, Homo sapiens
caggaugaggcagaaggaa

SEQ ID NO: 1644147 - RNA, 20 nt, Homo sapiens
caggcaacgcacaaaacaga

SEQ ID NO: 1644148 - RNA, 12 nt, Homo sapiens
caggcaccugcc

SEQ ID NO: 1644149 - RNA, 13 nt, Homo sapiens
caggcaccugcca

SEQ ID NO: 1644150 - RNA, 21 nt, Homo sapiens
caggcauggcuggugccugaa

SEQ ID NO: 1644151 - RNA, 13 nt, Homo sapiens
caggcauugccaa

SEQ ID NO: 1644152 - RNA, 14 nt, Homo sapiens
caggccaucaucag

SEQ ID NO: 1644153 - RNA, 14 nt, Homo sapiens
caggcgccugccac

SEQ ID NO: 1644154 - RNA, 15 nt, Homo sapiens
caggcguucagcuca

SEQ ID NO: 1644155 - RNA, 18 nt, Homo sapiens
caggcugcucuugaacuc

SEQ ID NO: 1644156 - RNA, 19 nt, Homo sapiens
caggcuggagugcaauggc

SEQ ID NO: 1644157 - RNA, 20 nt, Homo sapiens
caggcuggagugcaauggca

SEQ ID NO: 1644158 - RNA, 22 nt, Homo sapiens
caggcuggagugcaauggcaca

SEQ ID NO: 1644159 - RNA, 16 nt, Homo sapiens
caggcuggagugcagu

SEQ ID NO: 1644160 - RNA, 20 nt, Homo sapiens
caggcugggcuucaguggca

SEQ ID NO: 1644161 - RNA, 12 nt, Homo sapiens
caggcuugccug

SEQ ID NO: 1644162 - RNA, 22 nt, Homo sapiens
caggcuuuuccuccaaccugug

SEQ ID NO: 1644163 - RNA, 22 nt, Homo sapiens
cagggaauggagaaugguguuc

SEQ ID NO: 1644164 - RNA, 14 nt, Homo sapiens
cagggaggugaccc

SEQ ID NO: 1644165 - RNA, 15 nt, Homo sapiens
cagggcuguguguac

SEQ ID NO: 1644166 - RNA, 12 nt, Homo sapiens
cagggucucacu

SEQ ID NO: 1644167 - RNA, 19 nt, Homo sapiens
cagggucucacucugucac

SEQ ID NO: 1644168 - RNA, 14 nt, Homo sapiens
caggucaacucuga

SEQ ID NO: 1644169 - RNA, 12 nt, Homo sapiens
caggucuucucu

SEQ ID NO: 1644170 - RNA, 23 nt, Homo sapiens
caggucuucucuccaacucuuca

SEQ ID NO: 1644171 - RNA, 21 nt, Homo sapiens
caggugauccacccaccucag

SEQ ID NO: 1644172 - RNA, 13 nt, Homo sapiens
caggugcugugac

SEQ ID NO: 1644173 - RNA, 15 nt, Homo sapiens
caggugcugugacac

SEQ ID NO: 1644174 - RNA, 21 nt, Homo sapiens
caggugggguggagucccaga

SEQ ID NO: 1644175 - RNA, 19 nt, Homo sapiens
caggugugaaccaccacac

SEQ ID NO: 1644176 - RNA, 20 nt, Homo sapiens
caggugugagccaccgcgcc

SEQ ID NO: 1644177 - RNA, 19 nt, Homo sapiens
caggugugccgacagaagg

SEQ ID NO: 1644178 - RNA, 15 nt, Homo sapiens
cagguuuuuggucug

SEQ ID NO: 1644179 - RNA, 16 nt, Homo sapiens
caguaacgcaggggaa

SEQ ID NO: 1644180 - RNA, 15 nt, Homo sapiens
caguaaucagaguua

SEQ ID NO: 1644181 - RNA, 16 nt, Homo sapiens
caguaaucagaguuac

SEQ ID NO: 1644182 - RNA, 19 nt, Homo sapiens
caguaguggugacuguggg

SEQ ID NO: 1644183 - RNA, 17 nt, Homo sapiens
caguauagguguuugcu

SEQ ID NO: 1644184 - RNA, 17 nt, Homo sapiens
caguauuauguacucua

SEQ ID NO: 1644185 - RNA, 22 nt, Homo sapiens
caguauuuuccaaacuaccuuc

SEQ ID NO: 1644186 - RNA, 16 nt, Homo sapiens
cagucacguguaaaca

SEQ ID NO: 1644187 - RNA, 16 nt, Homo sapiens
caguccauagcagaga

SEQ ID NO: 1644188 - RNA, 19 nt, Homo sapiens
cagucucucucugccaugg

SEQ ID NO: 1644189 - RNA, 20 nt, Homo sapiens
cagucucucucugccauggc

SEQ ID NO: 1644190 - RNA, 18 nt, Homo sapiens
cagugacuccacucugag

SEQ ID NO: 1644191 - RNA, 19 nt, Homo sapiens
cagugagccgagaucacac

SEQ ID NO: 1644192 - RNA, 19 nt, Homo sapiens
cagugagggcuauacaugg

SEQ ID NO: 1644193 - RNA, 16 nt, Homo sapiens
cagugauauggcagaa

SEQ ID NO: 1644194 - RNA, 18 nt, Homo sapiens
cagugccagccccugcug

SEQ ID NO: 1644195 - RNA, 17 nt, Homo sapiens
cagugccaugggggcaa

SEQ ID NO: 1644196 - RNA, 21 nt, Homo sapiens
cagugcccagcugggggucaa

SEQ ID NO: 1644197 - RNA, 16 nt, Homo sapiens
cagugcccauuccuca

SEQ ID NO: 1644198 - RNA, 15 nt, Homo sapiens
cagugccuauugaua

SEQ ID NO: 1644199 - RNA, 20 nt, Homo sapiens
caguggcaccaccauggcuc

SEQ ID NO: 1644200 - RNA, 18 nt, Homo sapiens
caguggcugcugcccagg

SEQ ID NO: 1644201 - RNA, 18 nt, Homo sapiens
caguggguggagccaauc

SEQ ID NO: 1644202 - RNA, 15 nt, Homo sapiens
cagugguaugaucac

SEQ ID NO: 1644203 - RNA, 13 nt, Homo sapiens
cagugguggagcu

SEQ ID NO: 1644204 - RNA, 12 nt, Homo sapiens
caguguguuucu

SEQ ID NO: 1644205 - RNA, 20 nt, Homo sapiens
caguguguuucugaucugau

SEQ ID NO: 1644206 - RNA, 20 nt, Homo sapiens
caguuauuugcacaaguuca

SEQ ID NO: 1644207 - RNA, 21 nt, Homo sapiens
caguuccuuuagaaagcaguu

SEQ ID NO: 1644208 - RNA, 16 nt, Homo sapiens
caguuccuuucaaugg

SEQ ID NO: 1644209 - RNA, 17 nt, Homo sapiens
caguuucccacucugaa

SEQ ID NO: 1644210 - RNA, 13 nt, Homo sapiens
caguuucuuccau

SEQ ID NO: 1644211 - RNA, 12 nt, Homo sapiens
caguuugaacuc

SEQ ID NO: 1644212 - RNA, 16 nt, Homo sapiens
caguuugucacaugaa

SEQ ID NO: 1644213 - RNA, 18 nt, Homo sapiens
cauaaaagauauguugaa

SEQ ID NO: 1644214 - RNA, 21 nt, Homo sapiens
cauaagaaauaaaaucuaauu

SEQ ID NO: 1644215 - RNA, 22 nt, Homo sapiens
cauaaucccugucuucuuucca

SEQ ID NO: 1644216 - RNA, 14 nt, Homo sapiens
cauacaaguuucau

SEQ ID NO: 1644217 - RNA, 22 nt, Homo sapiens
cauacacacacacgcgugcaca

SEQ ID NO: 1644218 - RNA, 15 nt, Homo sapiens
cauacccuguuacca

SEQ ID NO: 1644219 - RNA, 22 nt, Homo sapiens
cauagagagcaagacgcugugc

SEQ ID NO: 1644220 - RNA, 21 nt, Homo sapiens
cauagaggacagcaacuggug

SEQ ID NO: 1644221 - RNA, 17 nt, Homo sapiens
cauagaguucagacuuu

SEQ ID NO: 1644222 - RNA, 20 nt, Homo sapiens
cacaaauuugggagggugag

SEQ ID NO: 1644223 - RNA, 13 nt, Homo sapiens
cacaagaccaucu

SEQ ID NO: 1644224 - RNA, 18 nt, Homo sapiens
cacaauacauguuuucac

SEQ ID NO: 1644225 - RNA, 18 nt, Homo sapiens
cacaauguuaaguuauau

SEQ ID NO: 1644226 - RNA, 13 nt, Homo sapiens
cacacacauacag

SEQ ID NO: 1644227 - RNA, 22 nt, Homo sapiens
cacacagcacgggggccaagga

SEQ ID NO: 1644228 - RNA, 13 nt, Homo sapiens
cacacagcuaaca

SEQ ID NO: 1644229 - RNA, 15 nt, Homo sapiens
cacacagugccugua

SEQ ID NO: 1644230 - RNA, 19 nt, Homo sapiens
cacaccuagcgucaguauu

SEQ ID NO: 1644231 - RNA, 19 nt, Homo sapiens
cacaccugcggcccaaucc

SEQ ID NO: 1644232 - RNA, 21 nt, Homo sapiens
cacacgucuggcuucacagau

SEQ ID NO: 1644233 - RNA, 16 nt, Homo sapiens
cacacucaguucugcu

SEQ ID NO: 1644234 - RNA, 16 nt, Homo sapiens
cacacuguccuauuau

SEQ ID NO: 1644235 - RNA, 20 nt, Homo sapiens
cacagaggggagucaccagc

SEQ ID NO: 1644236 - RNA, 16 nt, Homo sapiens
cacagaugugugauuc

SEQ ID NO: 1644237 - RNA, 16 nt, Homo sapiens
cacagcacuaauucaa

SEQ ID NO: 1644238 - RNA, 19 nt, Homo sapiens
cacaguaaugcaagcaaag

SEQ ID NO: 1644239 - RNA, 21 nt, Homo sapiens
cacaguggagagggcuacaaa

SEQ ID NO: 1644240 - RNA, 14 nt, Homo sapiens
cacaugcacgugug

SEQ ID NO: 1644241 - RNA, 12 nt, Homo sapiens
cacauuccugau

SEQ ID NO: 1644242 - RNA, 17 nt, Homo sapiens
cacauucgaguguuuca

SEQ ID NO: 1644243 - RNA, 19 nt, Homo sapiens
cacauugccccaugagaca

SEQ ID NO: 1644244 - RNA, 17 nt, Homo sapiens
cacauuuuucagauaua

SEQ ID NO: 1644245 - RNA, 16 nt, Homo sapiens
caccaauaaagccuuc

SEQ ID NO: 1644246 - RNA, 15 nt, Homo sapiens
caccaccagcuuaaa

SEQ ID NO: 1644247 - RNA, 15 nt, Homo sapiens
caccacgcccggcua

SEQ ID NO: 1644248 - RNA, 20 nt, Homo sapiens
caccacgguggucacuggaa

SEQ ID NO: 1644249 - RNA, 22 nt, Homo sapiens
caccaggagggaguggcagcua

SEQ ID NO: 1644250 - RNA, 19 nt, Homo sapiens
caccauguuggccaggcug

SEQ ID NO: 1644251 - RNA, 18 nt, Homo sapiens
caccauuuuccugccuca

SEQ ID NO: 1644252 - RNA, 14 nt, Homo sapiens
cacccaaugcauau

SEQ ID NO: 1644253 - RNA, 12 nt, Homo sapiens
caccccaacagc

SEQ ID NO: 1644254 - RNA, 14 nt, Homo sapiens
caccccucaucagg

SEQ ID NO: 1644255 - RNA, 22 nt, Homo sapiens
cacccuccuuucaccacaugug

SEQ ID NO: 1644256 - RNA, 24 nt, Homo sapiens
caccuaccuuacagugagggcuau

SEQ ID NO: 1644257 - RNA, 19 nt, Homo sapiens
caccuaguggcuguccagu

SEQ ID NO: 1644258 - RNA, 17 nt, Homo sapiens
caccuguguacugagua

SEQ ID NO: 1644259 - RNA, 16 nt, Homo sapiens
cacgaacugaaaugag

SEQ ID NO: 1644260 - RNA, 22 nt, Homo sapiens
cacgaucucaacucacugcaag

SEQ ID NO: 1644261 - RNA, 20 nt, Homo sapiens
cacgugagaucauucacuca

SEQ ID NO: 1644262 - RNA, 12 nt, Homo sapiens
cacguguaugca

SEQ ID NO: 1644263 - RNA, 16 nt, Homo sapiens
cacuaaggugugcucu

SEQ ID NO: 1644264 - RNA, 17 nt, Homo sapiens
cacuaaggugugcucug

SEQ ID NO: 1644265 - RNA, 21 nt, Homo sapiens
cacuagcaauaaaaugcuaau

SEQ ID NO: 1644266 - RNA, 23 nt, Homo sapiens
cacuauagccuaggugacagagu

SEQ ID NO: 1644267 - RNA, 15 nt, Homo sapiens
cacuaugagcuuuca

SEQ ID NO: 1644268 - RNA, 14 nt, Homo sapiens
cacucaguucugcu

SEQ ID NO: 1644269 - RNA, 21 nt, Homo sapiens
cacugacuauuacaguugcau

SEQ ID NO: 1644270 - RNA, 20 nt, Homo sapiens
cacugaucugcuagugcugu

SEQ ID NO: 1644271 - RNA, 13 nt, Homo sapiens
cacugauguauga

SEQ ID NO: 1644272 - RNA, 15 nt, Homo sapiens
cacugauugguguuu

SEQ ID NO: 1644273 - RNA, 14 nt, Homo sapiens
cacugcaggcauca

SEQ ID NO: 1644274 - RNA, 19 nt, Homo sapiens
cacugcaggcaucacagcu

SEQ ID NO: 1644275 - RNA, 21 nt, Homo sapiens
cacugccaaagaacuuggaaa

SEQ ID NO: 1644276 - RNA, 18 nt, Homo sapiens
cacugccaugcagggccu

SEQ ID NO: 1644277 - RNA, 23 nt, Homo sapiens
cacugccaugcagggccucacac

SEQ ID NO: 1644278 - RNA, 16 nt, Homo sapiens
cacuggacucaccucc

SEQ ID NO: 1644279 - RNA, 14 nt, Homo sapiens
cacuggacugucua

SEQ ID NO: 1644280 - RNA, 20 nt, Homo sapiens
cacuggacugucuaugaacu

SEQ ID NO: 1644281 - RNA, 15 nt, Homo sapiens
cacuggacuugucca

SEQ ID NO: 1644282 - RNA, 18 nt, Homo sapiens
cacugggacuugcaaaaa

SEQ ID NO: 1644283 - RNA, 14 nt, Homo sapiens
cacugggcuucuag

SEQ ID NO: 1644284 - RNA, 22 nt, Homo sapiens
cacugggcuucuagaaccaggc

SEQ ID NO: 1644285 - RNA, 10 nt, Homo sapiens
cacuguaaug

SEQ ID NO: 1644286 - RNA, 15 nt, Homo sapiens
cacugugaaaccccc

SEQ ID NO: 1644287 - RNA, 19 nt, Homo sapiens
cacugugccaugugccagg

SEQ ID NO: 1644288 - RNA, 17 nt, Homo sapiens
cacuguugcccaggcug

SEQ ID NO: 1644289 - RNA, 23 nt, Homo sapiens
cacuuauaaauauccugcucaca

SEQ ID NO: 1644290 - RNA, 12 nt, Homo sapiens
cacuucucagga

SEQ ID NO: 1644291 - RNA, 22 nt, Homo sapiens
cacuucugagaacucaucccua

SEQ ID NO: 1644292 - RNA, 11 nt, Homo sapiens
cacuugcacau

SEQ ID NO: 1644293 - RNA, 23 nt, Homo sapiens
cacuuuuuuuuuuuuuuugacag

SEQ ID NO: 1644294 - RNA, 17 nt, Homo sapiens
cagaaaaaaaaauggaa

SEQ ID NO: 1644295 - RNA, 17 nt, Homo sapiens
cagaaaaacugugggua

SEQ ID NO: 1644296 - RNA, 15 nt, Homo sapiens
cagaaaguuaugaaa

SEQ ID NO: 1644297 - RNA, 23 nt, Homo sapiens
cagaaauauucuacacauaucuu

SEQ ID NO: 1644298 - RNA, 18 nt, Homo sapiens
cagaaauuaaucuuacaa

SEQ ID NO: 1644299 - RNA, 15 nt, Homo sapiens
cagaacacacugaga

SEQ ID NO: 1644300 - RNA, 21 nt, Homo sapiens
cagaacacagcaauuccucag

SEQ ID NO: 1644301 - RNA, 22 nt, Homo sapiens
cagaacacugucuugaagacaa

SEQ ID NO: 1644302 - RNA, 16 nt, Homo sapiens
cagaagccagaaucac

SEQ ID NO: 1644303 - RNA, 15 nt, Homo sapiens
cagaaggggguggug

SEQ ID NO: 1644304 - RNA, 12 nt, Homo sapiens
cagaagugaaaa

SEQ ID NO: 1644305 - RNA, 11 nt, Homo sapiens
cagaauacugg

SEQ ID NO: 1644306 - RNA, 12 nt, Homo sapiens
cagaauggagcu

SEQ ID NO: 1644307 - RNA, 13 nt, Homo sapiens
cagaauggaggca

SEQ ID NO: 1644308 - RNA, 16 nt, Homo sapiens
cagacaggaccaggga

SEQ ID NO: 1644309 - RNA, 14 nt, Homo sapiens
cagacaugaacugc

SEQ ID NO: 1644310 - RNA, 12 nt, Homo sapiens
cagaccacugau

SEQ ID NO: 1644311 - RNA, 17 nt, Homo sapiens
cagacccugcccugugg

SEQ ID NO: 1644312 - RNA, 20 nt, Homo sapiens
cagacucuacagaggccaug

SEQ ID NO: 1644313 - RNA, 21 nt, Homo sapiens
cagacuugaaugcuaguuaua

SEQ ID NO: 1644314 - RNA, 14 nt, Homo sapiens
cagagaaaguacuu

SEQ ID NO: 1644315 - RNA, 22 nt, Homo sapiens
cagagacgcagacaugugcacu

SEQ ID NO: 1644316 - RNA, 16 nt, Homo sapiens
cagagagcacagugau

SEQ ID NO: 1644317 - RNA, 22 nt, Homo sapiens
cagagagggcaggcaugaaguu

SEQ ID NO: 1644318 - RNA, 17 nt, Homo sapiens
cagagcagaacuuucac

SEQ ID NO: 1644319 - RNA, 22 nt, Homo sapiens
cagagcagaugcagagagccau

SEQ ID NO: 1644320 - RNA, 15 nt, Homo sapiens
cagagcccaagggaa

SEQ ID NO: 1644321 - RNA, 18 nt, Homo sapiens
cagagcugcacaggguuu

SEQ ID NO: 1644322 - RNA, 15 nt, Homo sapiens
cagagcuucccugac

SEQ ID NO: 1644323 - RNA, 18 nt, Homo sapiens
cagaggaguacaggugaa

SEQ ID NO: 1644324 - RNA, 22 nt, Homo sapiens
cagagugagacccagcccucau

SEQ ID NO: 1644325 - RNA, 20 nt, Homo sapiens
cagagugagacucugucuca

SEQ ID NO: 1644326 - RNA, 18 nt, Homo sapiens
cagaguuccgacugccau

SEQ ID NO: 1644327 - RNA, 19 nt, Homo sapiens
cagauaugauggaaugcau

SEQ ID NO: 1644328 - RNA, 14 nt, Homo sapiens
cagaugaaugggag

SEQ ID NO: 1644329 - RNA, 17 nt, Homo sapiens
cagaugagaguacaccc

SEQ ID NO: 1644330 - RNA, 20 nt, Homo sapiens
cagauguccuugaugcucau

SEQ ID NO: 1644331 - RNA, 23 nt, Homo sapiens
cagaugucgcuggguccucugca

SEQ ID NO: 1644332 - RNA, 16 nt, Homo sapiens
accuagcgucaguauu

SEQ ID NO: 1644333 - RNA, 22 nt, Homo sapiens
accucagaguauggagcucaga

SEQ ID NO: 1644334 - RNA, 11 nt, Homo sapiens
accucagggcu

SEQ ID NO: 1644335 - RNA, 18 nt, Homo sapiens
accucauuccugggacua

SEQ ID NO: 1644336 - RNA, 14 nt, Homo sapiens
accuccugucucug

SEQ ID NO: 1644337 - RNA, 21 nt, Homo sapiens
accucgagguuucucaaagaa

SEQ ID NO: 1644338 - RNA, 19 nt, Homo sapiens
accucgugauccaccugcc

SEQ ID NO: 1644339 - RNA, 20 nt, Homo sapiens
accucugccugaagucacac

SEQ ID NO: 1644340 - RNA, 22 nt, Homo sapiens
accucugccugaagucacacag

SEQ ID NO: 1644341 - RNA, 23 nt, Homo sapiens
accucugccugaagucacacagu

SEQ ID NO: 1644342 - RNA, 17 nt, Homo sapiens
accucugggagcucaag

SEQ ID NO: 1644343 - RNA, 18 nt, Homo sapiens
accugaaaacacugugca

SEQ ID NO: 1644344 - RNA, 20 nt, Homo sapiens
accugaaaacacugugcaca

SEQ ID NO: 1644345 - RNA, 18 nt, Homo sapiens
accugaaauaaaauucau

SEQ ID NO: 1644346 - RNA, 14 nt, Homo sapiens
accugcuucuauua

SEQ ID NO: 1644347 - RNA, 22 nt, Homo sapiens
accuggagaacuagaaccugga

SEQ ID NO: 1644348 - RNA, 21 nt, Homo sapiens
accuggagagcuagaaccuag

SEQ ID NO: 1644349 - RNA, 22 nt, Homo sapiens
accuggagagcuagaaccuaga

SEQ ID NO: 1644350 - RNA, 22 nt, Homo sapiens
accuggagggcuagaaccuaga

SEQ ID NO: 1644351 - RNA, 22 nt, Homo sapiens
accuggaggggcuagaaccuag

SEQ ID NO: 1644352 - RNA, 16 nt, Homo sapiens
accuggcaaggacaca

SEQ ID NO: 1644353 - RNA, 21 nt, Homo sapiens
accuggcagguuagaaccuag

SEQ ID NO: 1644354 - RNA, 17 nt, Homo sapiens
accugggcuggcacugc

SEQ ID NO: 1644355 - RNA, 20 nt, Homo sapiens
accuggucccugcucucagu

SEQ ID NO: 1644356 - RNA, 21 nt, Homo sapiens
accugugcacguuggaacuuu

SEQ ID NO: 1644357 - RNA, 23 nt, Homo sapiens
accuuaaacuuucaauaucuuua

SEQ ID NO: 1644358 - RNA, 22 nt, Homo sapiens
accuuacauuugaaaucuauga

SEQ ID NO: 1644359 - RNA, 23 nt, Homo sapiens
accuuacauuugaaaucuaugaa

SEQ ID NO: 1644360 - RNA, 14 nt, Homo sapiens
accuuacuuuccca

SEQ ID NO: 1644361 - RNA, 22 nt, Homo sapiens
accuugaggagucuugugugca

SEQ ID NO: 1644362 - RNA, 15 nt, Homo sapiens
accuugugagggaga

SEQ ID NO: 1644363 - RNA, 15 nt, Homo sapiens
accuuuucccgggga

SEQ ID NO: 1644364 - RNA, 18 nt, Homo sapiens
accuuuugugguucucaa

SEQ ID NO: 1644365 - RNA, 14 nt, Homo sapiens
acgaggacagguug

SEQ ID NO: 1644366 - RNA, 14 nt, Homo sapiens
acgaggugcaguaa

SEQ ID NO: 1644367 - RNA, 17 nt, Homo sapiens
acgauugacaccaaaau

SEQ ID NO: 1644368 - RNA, 22 nt, Homo sapiens
acgcaggccccucuccuccgug

SEQ ID NO: 1644369 - RNA, 18 nt, Homo sapiens
acggaaaaugccuguaaa

SEQ ID NO: 1644370 - RNA, 20 nt, Homo sapiens
acggagccacuccucugacu

SEQ ID NO: 1644371 - RNA, 22 nt, Homo sapiens
acgugauucaauucaacacucc

SEQ ID NO: 1644372 - RNA, 14 nt, Homo sapiens
acguuaacagcgug

SEQ ID NO: 1644373 - RNA, 11 nt, Homo sapiens
acguuguguaa

SEQ ID NO: 1644374 - RNA, 16 nt, Homo sapiens
acuaauacagacuaug

SEQ ID NO: 1644375 - RNA, 20 nt, Homo sapiens
acuaauucugcaucugggca

SEQ ID NO: 1644376 - RNA, 23 nt, Homo sapiens
acuaccuugguucccccacugau

SEQ ID NO: 1644377 - RNA, 13 nt, Homo sapiens
acuagaaccugga

SEQ ID NO: 1644378 - RNA, 13 nt, Homo sapiens
acuagauacugaa

SEQ ID NO: 1644379 - RNA, 22 nt, Homo sapiens
acuagggaaaugaucaguuuuu

SEQ ID NO: 1644380 - RNA, 17 nt, Homo sapiens
acuagggcuagucuucc

SEQ ID NO: 1644381 - RNA, 22 nt, Homo sapiens
acuauagccuaggugacagagu

SEQ ID NO: 1644382 - RNA, 22 nt, Homo sapiens
acuauccaaauaaaaauaacau

SEQ ID NO: 1644383 - RNA, 17 nt, Homo sapiens
acuaugcaaaaguacaa

SEQ ID NO: 1644384 - RNA, 18 nt, Homo sapiens
acuauggcucuacuuuca

SEQ ID NO: 1644385 - RNA, 19 nt, Homo sapiens
acuauggcucuacuuucag

SEQ ID NO: 1644386 - RNA, 15 nt, Homo sapiens
acuauggugccaaug

SEQ ID NO: 1644387 - RNA, 15 nt, Homo sapiens
acuauguugcccagg

SEQ ID NO: 1644388 - RNA, 18 nt, Homo sapiens
acuauucuuaacuauuca

SEQ ID NO: 1644389 - RNA, 19 nt, Homo sapiens
acuauuucaauacuuacau

SEQ ID NO: 1644390 - RNA, 20 nt, Homo sapiens
acuauuucaauacuuacaua

SEQ ID NO: 1644391 - RNA, 21 nt, Homo sapiens
acucaaaacccaucugggcuc

SEQ ID NO: 1644392 - RNA, 21 nt, Homo sapiens
acucaagaagcaggcuacacu

SEQ ID NO: 1644393 - RNA, 14 nt, Homo sapiens
acucaaucauuucu

SEQ ID NO: 1644394 - RNA, 20 nt, Homo sapiens
acucacaucuuuuucacuga

SEQ ID NO: 1644395 - RNA, 17 nt, Homo sapiens
acucaccugcacuaaca

SEQ ID NO: 1644396 - RNA, 13 nt, Homo sapiens
acucagggcuccu

SEQ ID NO: 1644397 - RNA, 12 nt, Homo sapiens
acuccaccucaa

SEQ ID NO: 1644398 - RNA, 19 nt, Homo sapiens
acuccagccugggugacaa

SEQ ID NO: 1644399 - RNA, 20 nt, Homo sapiens
acuccagccugggugacaaa

SEQ ID NO: 1644400 - RNA, 17 nt, Homo sapiens
acuccaucucuacugaa

SEQ ID NO: 1644401 - RNA, 17 nt, Homo sapiens
acuccccuaaacuccag

SEQ ID NO: 1644402 - RNA, 14 nt, Homo sapiens
acuccuagggccac

SEQ ID NO: 1644403 - RNA, 13 nt, Homo sapiens
acuccucaggguu

SEQ ID NO: 1644404 - RNA, 19 nt, Homo sapiens
acucucgcacacacaguga

SEQ ID NO: 1644405 - RNA, 18 nt, Homo sapiens
acucugcucucaggagau

SEQ ID NO: 1644406 - RNA, 20 nt, Homo sapiens
acucuggaccucucuuguga

SEQ ID NO: 1644407 - RNA, 23 nt, Homo sapiens
acucuuucugaggagcuguuacu

SEQ ID NO: 1644408 - RNA, 21 nt, Homo sapiens
acugaaauggacugacuguaa

SEQ ID NO: 1644409 - RNA, 23 nt, Homo sapiens
acugaauauuaaaaagauagacu

SEQ ID NO: 1644410 - RNA, 19 nt, Homo sapiens
acugaaucugcuaccaaaa

SEQ ID NO: 1644411 - RNA, 13 nt, Homo sapiens
acugagaugcaaa

SEQ ID NO: 1644412 - RNA, 23 nt, Homo sapiens
acugaguauugauaaacuuugaa

SEQ ID NO: 1644413 - RNA, 18 nt, Homo sapiens
acugauagggauacaugc

SEQ ID NO: 1644414 - RNA, 20 nt, Homo sapiens
acugaucugcuagugcugua

SEQ ID NO: 1644415 - RNA, 14 nt, Homo sapiens
acugauguucaaua

SEQ ID NO: 1644416 - RNA, 22 nt, Homo sapiens
acugauuuagaaaaacaaauga

SEQ ID NO: 1644417 - RNA, 10 nt, Homo sapiens
acugcaauaa

SEQ ID NO: 1644418 - RNA, 16 nt, Homo sapiens
acugcacagaagacag

SEQ ID NO: 1644419 - RNA, 21 nt, Homo sapiens
acugcacuauagccuagguga

SEQ ID NO: 1644420 - RNA, 22 nt, Homo sapiens
acugcagcuaacuuaucaucac

SEQ ID NO: 1644421 - RNA, 14 nt, Homo sapiens
acuggacuugucca

SEQ ID NO: 1644422 - RNA, 20 nt, Homo sapiens
acuggaggggucauccuugc

SEQ ID NO: 1644423 - RNA, 12 nt, Homo sapiens
acuggaugcaug

SEQ ID NO: 1644424 - RNA, 19 nt, Homo sapiens
acuggcugccuccacuccc

SEQ ID NO: 1644425 - RNA, 23 nt, Homo sapiens
acugggacuaaguguaccagaga

SEQ ID NO: 1644426 - RNA, 13 nt, Homo sapiens
acugggcuucuag

SEQ ID NO: 1644427 - RNA, 20 nt, Homo sapiens
acugguaaaauacauauaaa

SEQ ID NO: 1644428 - RNA, 19 nt, Homo sapiens
acugguucauucuacguau

SEQ ID NO: 1644429 - RNA, 14 nt, Homo sapiens
acuguccuacccac

SEQ ID NO: 1644430 - RNA, 19 nt, Homo sapiens
acuguccugcuccacagug

SEQ ID NO: 1644431 - RNA, 13 nt, Homo sapiens
acugucuccaugg

SEQ ID NO: 1644432 - RNA, 16 nt, Homo sapiens
acugucuugaagacaa

SEQ ID NO: 1644433 - RNA, 21 nt, Homo sapiens
acugucuugaagacaauggcu

SEQ ID NO: 1644434 - RNA, 20 nt, Homo sapiens
acugugucaggaaacauauu

SEQ ID NO: 1644435 - RNA, 14 nt, Homo sapiens
acuguguggucuca

SEQ ID NO: 1644436 - RNA, 16 nt, Homo sapiens
acuguuacugugucag

SEQ ID NO: 1644437 - RNA, 13 nt, Homo sapiens
acuguugcccagg

SEQ ID NO: 1644438 - RNA, 19 nt, Homo sapiens
acuguuuuucucuaaugcu

SEQ ID NO: 1644439 - RNA, 12 nt, Homo sapiens
acuuaacagguu

SEQ ID NO: 1644440 - RNA, 19 nt, Homo sapiens
acuuaauagaaacauugaa

SEQ ID NO: 1644441 - RNA, 14 nt, Homo sapiens
agugcaauggcaca

SEQ ID NO: 1644442 - RNA, 16 nt, Homo sapiens
agugccaugggggcaa

SEQ ID NO: 1644443 - RNA, 17 nt, Homo sapiens
agugccaugggggcaac

SEQ ID NO: 1644444 - RNA, 15 nt, Homo sapiens
agugccccuagcuua

SEQ ID NO: 1644445 - RNA, 14 nt, Homo sapiens
agugcccucaucca

SEQ ID NO: 1644446 - RNA, 19 nt, Homo sapiens
agugccuggccaaagggau

SEQ ID NO: 1644447 - RNA, 20 nt, Homo sapiens
agugcuaauuuaguucucag

SEQ ID NO: 1644448 - RNA, 13 nt, Homo sapiens
agugcuucuugua

SEQ ID NO: 1644449 - RNA, 18 nt, Homo sapiens
agugcuucuuguaauauu

SEQ ID NO: 1644450 - RNA, 19 nt, Homo sapiens
aguggaguugaaacugcua

SEQ ID NO: 1644451 - RNA, 17 nt, Homo sapiens
aguggguccaaguggcu

SEQ ID NO: 1644452 - RNA, 17 nt, Homo sapiens
aguggucuuuguaagag

SEQ ID NO: 1644453 - RNA, 16 nt, Homo sapiens
aguguagaagcauucc

SEQ ID NO: 1644454 - RNA, 20 nt, Homo sapiens
aguguuaaagugaaucucaa

SEQ ID NO: 1644455 - RNA, 20 nt, Homo sapiens
aguguuccccgauaccaugc

SEQ ID NO: 1644456 - RNA, 15 nt, Homo sapiens
aguguugacacuuaa

SEQ ID NO: 1644457 - RNA, 21 nt, Homo sapiens
aguguuggaaaaugugcaaua

SEQ ID NO: 1644458 - RNA, 14 nt, Homo sapiens
aguguuuguauacc

SEQ ID NO: 1644459 - RNA, 23 nt, Homo sapiens
aguuaugaaaaauaagucacuua

SEQ ID NO: 1644460 - RNA, 17 nt, Homo sapiens
aguucaccagacucuau

SEQ ID NO: 1644461 - RNA, 13 nt, Homo sapiens
aguucagacuuuu

SEQ ID NO: 1644462 - RNA, 19 nt, Homo sapiens
aguucaggcucugagacac

SEQ ID NO: 1644463 - RNA, 19 nt, Homo sapiens
aguucauacccuguuacca

SEQ ID NO: 1644464 - RNA, 14 nt, Homo sapiens
aguuccaccaucaa

SEQ ID NO: 1644465 - RNA, 15 nt, Homo sapiens
aguuccagugcugca

SEQ ID NO: 1644466 - RNA, 15 nt, Homo sapiens
aguucccucccucaa

SEQ ID NO: 1644467 - RNA, 23 nt, Homo sapiens
aguuccucauuuuugaauacagg

SEQ ID NO: 1644468 - RNA, 19 nt, Homo sapiens
aguuccuugcauguuguag

SEQ ID NO: 1644469 - RNA, 17 nt, Homo sapiens
aguucuuacacauucca

SEQ ID NO: 1644470 - RNA, 18 nt, Homo sapiens
aguucuuacacauuccau

SEQ ID NO: 1644471 - RNA, 15 nt, Homo sapiens
aguugacuugacaga

SEQ ID NO: 1644472 - RNA, 15 nt, Homo sapiens
aguugccacauuuag

SEQ ID NO: 1644473 - RNA, 23 nt, Homo sapiens
aguugccacauuuaguccuguac

SEQ ID NO: 1644474 - RNA, 13 nt, Homo sapiens
aguugcuguaugu

SEQ ID NO: 1644475 - RNA, 18 nt, Homo sapiens
aguuggaagugugugauc

SEQ ID NO: 1644476 - RNA, 17 nt, Homo sapiens
aguuguaauagugccaa

SEQ ID NO: 1644477 - RNA, 19 nt, Homo sapiens
aguuuagugcccucaucca

SEQ ID NO: 1644478 - RNA, 15 nt, Homo sapiens
aguuuauacuucucu

SEQ ID NO: 1644479 - RNA, 19 nt, Homo sapiens
aguuucugcauuucaagaa

SEQ ID NO: 1644480 - RNA, 23 nt, Homo sapiens
aguuugaguuacuaucaugucaa

SEQ ID NO: 1644481 - RNA, 18 nt, Homo sapiens
aguuugauuauucagugu

SEQ ID NO: 1644482 - RNA, 21 nt, Homo sapiens
aguuuuuuuuuauacacugua

SEQ ID NO: 1644483 - RNA, 20 nt, Homo sapiens
auaaaaguacuagcuuacuu

SEQ ID NO: 1644484 - RNA, 16 nt, Homo sapiens
auaaaauucauuaguu

SEQ ID NO: 1644485 - RNA, 17 nt, Homo sapiens
auaaacccaguugccau

SEQ ID NO: 1644486 - RNA, 19 nt, Homo sapiens
auaaaccuaauaaucugaa

SEQ ID NO: 1644487 - RNA, 12 nt, Homo sapiens
auaaacuuugaa

SEQ ID NO: 1644488 - RNA, 22 nt, Homo sapiens
auaaaggacaggcuggugcuaa

SEQ ID NO: 1644489 - RNA, 19 nt, Homo sapiens
auaaauaaucuacuguaca

SEQ ID NO: 1644490 - RNA, 20 nt, Homo sapiens
auaaaucauucuuacuaaaa

SEQ ID NO: 1644491 - RNA, 21 nt, Homo sapiens
auaaaucuaaugacauucaau

SEQ ID NO: 1644492 - RNA, 14 nt, Homo sapiens
auaaauggacaaau

SEQ ID NO: 1644493 - RNA, 14 nt, Homo sapiens
auaaauugauuugu

SEQ ID NO: 1644494 - RNA, 18 nt, Homo sapiens
auaaauuuuauuccaaaa

SEQ ID NO: 1644495 - RNA, 12 nt, Homo sapiens
auaacaaugaaa

SEQ ID NO: 1644496 - RNA, 14 nt, Homo sapiens
auaacaauguuaag

SEQ ID NO: 1644497 - RNA, 21 nt, Homo sapiens
auaacauggugugcuucuuaa

SEQ ID NO: 1644498 - RNA, 14 nt, Homo sapiens
auaacauuuacuuu

SEQ ID NO: 1644499 - RNA, 15 nt, Homo sapiens
auaacauuuacuuuu

SEQ ID NO: 1644500 - RNA, 19 nt, Homo sapiens
auaaccagccauuggcuau

SEQ ID NO: 1644501 - RNA, 22 nt, Homo sapiens
auaaccguuuccuuucauuuac

SEQ ID NO: 1644502 - RNA, 15 nt, Homo sapiens
auaacuauguugaua

SEQ ID NO: 1644503 - RNA, 17 nt, Homo sapiens
auaacuuauuagcaguc

SEQ ID NO: 1644504 - RNA, 21 nt, Homo sapiens
auaagacuacugaaucugcua

SEQ ID NO: 1644505 - RNA, 15 nt, Homo sapiens
auaagcuguuuuuau

SEQ ID NO: 1644506 - RNA, 15 nt, Homo sapiens
auaagugcaugacau

SEQ ID NO: 1644507 - RNA, 16 nt, Homo sapiens
auaauacuagucuuau

SEQ ID NO: 1644508 - RNA, 16 nt, Homo sapiens
auaauuuuagacauuc

SEQ ID NO: 1644509 - RNA, 23 nt, Homo sapiens
auacaaagcggggagaggguaca

SEQ ID NO: 1644510 - RNA, 13 nt, Homo sapiens
auacaagugauaa

SEQ ID NO: 1644511 - RNA, 16 nt, Homo sapiens
auacaguaaacucugg

SEQ ID NO: 1644512 - RNA, 21 nt, Homo sapiens
auacauuuguugguaacuaau

SEQ ID NO: 1644513 - RNA, 14 nt, Homo sapiens
auaccucccuuaga

SEQ ID NO: 1644514 - RNA, 17 nt, Homo sapiens
auaccugucccccugac

SEQ ID NO: 1644515 - RNA, 17 nt, Homo sapiens
auacuaaaguaguuuaa

SEQ ID NO: 1644516 - RNA, 23 nt, Homo sapiens
auacuauuaccaccaccugcuca

SEQ ID NO: 1644517 - RNA, 17 nt, Homo sapiens
auacuauuuauauacaa

SEQ ID NO: 1644518 - RNA, 16 nt, Homo sapiens
auacucccaucuguga

SEQ ID NO: 1644519 - RNA, 17 nt, Homo sapiens
auacuggucucaggcca

SEQ ID NO: 1644520 - RNA, 16 nt, Homo sapiens
auacuguugcacgugu

SEQ ID NO: 1644521 - RNA, 17 nt, Homo sapiens
auacuuacauaucugac

SEQ ID NO: 1644522 - RNA, 16 nt, Homo sapiens
auacuuuucucaauau

SEQ ID NO: 1644523 - RNA, 13 nt, Homo sapiens
auagaauugcaca

SEQ ID NO: 1644524 - RNA, 23 nt, Homo sapiens
auagagaccaucuuugccaacau

SEQ ID NO: 1644525 - RNA, 13 nt, Homo sapiens
auagagccugagg

SEQ ID NO: 1644526 - RNA, 21 nt, Homo sapiens
auaggucagugcaaauacucu

SEQ ID NO: 1644527 - RNA, 15 nt, Homo sapiens
auaguauugugcaua

SEQ ID NO: 1644528 - RNA, 10 nt, Homo sapiens
auagugucuu

SEQ ID NO: 1644529 - RNA, 15 nt, Homo sapiens
auaguuuaaauucaa

SEQ ID NO: 1644530 - RNA, 22 nt, Homo sapiens
auauaagaagcuuucaguauua

SEQ ID NO: 1644531 - RNA, 22 nt, Homo sapiens
auauagauacccaauuguuuca

SEQ ID NO: 1644532 - RNA, 23 nt, Homo sapiens
auauaugauauauaaaugugauu

SEQ ID NO: 1644533 - RNA, 19 nt, Homo sapiens
auauauuuccuuauucaga

SEQ ID NO: 1644534 - RNA, 12 nt, Homo sapiens
auauauuuuaga

SEQ ID NO: 1644535 - RNA, 20 nt, Homo sapiens
auauauuuuugugcacauuu

SEQ ID NO: 1644536 - RNA, 11 nt, Homo sapiens
auaucagugaa

SEQ ID NO: 1644537 - RNA, 17 nt, Homo sapiens
auaucauuugugaagaa

SEQ ID NO: 1644538 - RNA, 17 nt, Homo sapiens
auauccaacaugugcuc

SEQ ID NO: 1644539 - RNA, 11 nt, Homo sapiens
auaugcaauau

SEQ ID NO: 1644540 - RNA, 22 nt, Homo sapiens
auaugcagugauauggcagaag

SEQ ID NO: 1644541 - RNA, 18 nt, Homo sapiens
auaugcuaauauauguau

SEQ ID NO: 1644542 - RNA, 20 nt, Homo sapiens
auauuaagucguucaauuca

SEQ ID NO: 1644543 - RNA, 19 nt, Homo sapiens
auauuaauuuuccaaugca

SEQ ID NO: 1644544 - RNA, 21 nt, Homo sapiens
auauuacugaucuuaccuuua

SEQ ID NO: 1644545 - RNA, 12 nt, Homo sapiens
auauuacuugcc

SEQ ID NO: 1644546 - RNA, 16 nt, Homo sapiens
auauucaggacuugaa

SEQ ID NO: 1644547 - RNA, 18 nt, Homo sapiens
auauucccacagcacuaa

SEQ ID NO: 1644548 - RNA, 18 nt, Homo sapiens
auauugauaacagcacug

SEQ ID NO: 1644549 - RNA, 23 nt, Homo sapiens
auauugauuucugccuuccuugc

SEQ ID NO: 1644550 - RNA, 19 nt, Homo sapiens
auauuuccuucaccaccuc

SEQ ID NO: 1644551 - RNA, 13 nt, Homo sapiens
cacagugcccaag

SEQ ID NO: 1644552 - RNA, 17 nt, Homo sapiens
cacagugcugaccagac

SEQ ID NO: 1644553 - RNA, 12 nt, Homo sapiens
cacagugugaau

SEQ ID NO: 1644554 - RNA, 23 nt, Homo sapiens
cacagugugaaucuuggugucua

SEQ ID NO: 1644555 - RNA, 23 nt, Homo sapiens
cacaucccuggaaggacauccau

SEQ ID NO: 1644556 - RNA, 16 nt, Homo sapiens
cacaucuaaccucauc

SEQ ID NO: 1644557 - RNA, 12 nt, Homo sapiens
cacaugccaagc

SEQ ID NO: 1644558 - RNA, 16 nt, Homo sapiens
cacaugccaagcacug

SEQ ID NO: 1644559 - RNA, 19 nt, Homo sapiens
cacauguccaagaagccca

SEQ ID NO: 1644560 - RNA, 13 nt, Homo sapiens
cacauuugccuug

SEQ ID NO: 1644561 - RNA, 22 nt, Homo sapiens
caccaaaucaucucucaucacu

SEQ ID NO: 1644562 - RNA, 14 nt, Homo sapiens
caccacaugugcac

SEQ ID NO: 1644563 - RNA, 20 nt, Homo sapiens
caccacuuuuaacagaacag

SEQ ID NO: 1644564 - RNA, 18 nt, Homo sapiens
caccauguuguacaggcu

SEQ ID NO: 1644565 - RNA, 16 nt, Homo sapiens
caccccccuucugaau

SEQ ID NO: 1644566 - RNA, 15 nt, Homo sapiens
caccccucaucagga

SEQ ID NO: 1644567 - RNA, 17 nt, Homo sapiens
cacccucccacugccaa

SEQ ID NO: 1644568 - RNA, 11 nt, Homo sapiens
caccuacuccu

SEQ ID NO: 1644569 - RNA, 21 nt, Homo sapiens
caccucagaguauggagcuca

SEQ ID NO: 1644570 - RNA, 17 nt, Homo sapiens
caccuccugccucaggu

SEQ ID NO: 1644571 - RNA, 20 nt, Homo sapiens
caccuccuguguugugcugg

SEQ ID NO: 1644572 - RNA, 19 nt, Homo sapiens
caccugcauucuucccuua

SEQ ID NO: 1644573 - RNA, 19 nt, Homo sapiens
caccugcccugcugagucc

SEQ ID NO: 1644574 - RNA, 14 nt, Homo sapiens
caccuugacagggc

SEQ ID NO: 1644575 - RNA, 17 nt, Homo sapiens
cacgaucucaacucacu

SEQ ID NO: 1644576 - RNA, 17 nt, Homo sapiens
cacgcuggagugcagug

SEQ ID NO: 1644577 - RNA, 16 nt, Homo sapiens
cacgugagaucauuca

SEQ ID NO: 1644578 - RNA, 15 nt, Homo sapiens
cacguucugcucauc

SEQ ID NO: 1644579 - RNA, 19 nt, Homo sapiens
cacuauagccuaggugaca

SEQ ID NO: 1644580 - RNA, 21 nt, Homo sapiens
cacuauagccuaggugacaga

SEQ ID NO: 1644581 - RNA, 17 nt, Homo sapiens
cacuaugagcuuucaga

SEQ ID NO: 1644582 - RNA, 14 nt, Homo sapiens
cacuauuacuggga

SEQ ID NO: 1644583 - RNA, 21 nt, Homo sapiens
cacucacauuuauucugcuca

SEQ ID NO: 1644584 - RNA, 16 nt, Homo sapiens
cacucauacaucuggc

SEQ ID NO: 1644585 - RNA, 21 nt, Homo sapiens
cacucauuuccaaucauacaa

SEQ ID NO: 1644586 - RNA, 19 nt, Homo sapiens
cacuccccuaucccauucu

SEQ ID NO: 1644587 - RNA, 22 nt, Homo sapiens
cacucuuauugcccacgcugga

SEQ ID NO: 1644588 - RNA, 13 nt, Homo sapiens
cacugacuauuac

SEQ ID NO: 1644589 - RNA, 21 nt, Homo sapiens
cacugaucugcuagugcugua

SEQ ID NO: 1644590 - RNA, 14 nt, Homo sapiens
cacugccugaggcu

SEQ ID NO: 1644591 - RNA, 13 nt, Homo sapiens
cacugccugaugg

SEQ ID NO: 1644592 - RNA, 15 nt, Homo sapiens
cacugcuugaggaaa

SEQ ID NO: 1644593 - RNA, 14 nt, Homo sapiens
cacuggaaaguuua

SEQ ID NO: 1644594 - RNA, 16 nt, Homo sapiens
cacuggcugccuccac

SEQ ID NO: 1644595 - RNA, 23 nt, Homo sapiens
cacugggacuuuguaaacuucca

SEQ ID NO: 1644596 - RNA, 14 nt, Homo sapiens
cacuguauccauuc

SEQ ID NO: 1644597 - RNA, 16 nt, Homo sapiens
cacuguccugcuccac

SEQ ID NO: 1644598 - RNA, 22 nt, Homo sapiens
cacugugcugagucugaaggcu

SEQ ID NO: 1644599 - RNA, 18 nt, Homo sapiens
cacuguuaucuucacuuu

SEQ ID NO: 1644600 - RNA, 19 nt, Homo sapiens
cacuguuaucuucacuuuu

SEQ ID NO: 1644601 - RNA, 15 nt, Homo sapiens
cacuguugugaaggu

SEQ ID NO: 1644602 - RNA, 14 nt, Homo sapiens
cacuguuucucuca

SEQ ID NO: 1644603 - RNA, 22 nt, Homo sapiens
cacuuaaugaaugaaugaauuc

SEQ ID NO: 1644604 - RNA, 17 nt, Homo sapiens
cacuuacuguuguccua

SEQ ID NO: 1644605 - RNA, 21 nt, Homo sapiens
cacuucccacuauugcuugca

SEQ ID NO: 1644606 - RNA, 16 nt, Homo sapiens
cacuuccccuccuacc

SEQ ID NO: 1644607 - RNA, 17 nt, Homo sapiens
cacuucgugggaucugc

SEQ ID NO: 1644608 - RNA, 16 nt, Homo sapiens
cacuugaagaugcugc

SEQ ID NO: 1644609 - RNA, 22 nt, Homo sapiens
cacuuggauuucauuuguaacu

SEQ ID NO: 1644610 - RNA, 15 nt, Homo sapiens
cacuuuagaaagcug

SEQ ID NO: 1644611 - RNA, 21 nt, Homo sapiens
cacuuuuauuuagcaccaggg

SEQ ID NO: 1644612 - RNA, 13 nt, Homo sapiens
cagaacacugucu

SEQ ID NO: 1644613 - RNA, 16 nt, Homo sapiens
cagaacacugucuuga

SEQ ID NO: 1644614 - RNA, 19 nt, Homo sapiens
cagaacagcuucagguuau

SEQ ID NO: 1644615 - RNA, 14 nt, Homo sapiens
cagaacucuuucaa

SEQ ID NO: 1644616 - RNA, 18 nt, Homo sapiens
cagaacugaagagacuag

SEQ ID NO: 1644617 - RNA, 20 nt, Homo sapiens
cagaaggaaaaaaacaugaa

SEQ ID NO: 1644618 - RNA, 24 nt, Homo sapiens
cagaaggaaccagcguguauauga

SEQ ID NO: 1644619 - RNA, 18 nt, Homo sapiens
cagaauaucagaauauga

SEQ ID NO: 1644620 - RNA, 22 nt, Homo sapiens
cagaaucagaucugagcuucau

SEQ ID NO: 1644621 - RNA, 21 nt, Homo sapiens
cagaaucucucuucuuuucaa

SEQ ID NO: 1644622 - RNA, 20 nt, Homo sapiens
cagacacuaacgaaauauca

SEQ ID NO: 1644623 - RNA, 16 nt, Homo sapiens
cagacagcccuccauc

SEQ ID NO: 1644624 - RNA, 22 nt, Homo sapiens
cagaccacuauucuuaacuauu

SEQ ID NO: 1644625 - RNA, 23 nt, Homo sapiens
cagacuaugucacccaaugcaua

SEQ ID NO: 1644626 - RNA, 21 nt, Homo sapiens
cagacucuacagaggccaugg

SEQ ID NO: 1644627 - RNA, 15 nt, Homo sapiens
cagagagcacaguga

SEQ ID NO: 1644628 - RNA, 23 nt, Homo sapiens
cagagagccauuuugugaaugga

SEQ ID NO: 1644629 - RNA, 16 nt, Homo sapiens
cagagauaaagaccuu

SEQ ID NO: 1644630 - RNA, 19 nt, Homo sapiens
cagagauaauucuagcuuu

SEQ ID NO: 1644631 - RNA, 16 nt, Homo sapiens
cagagcagaacuuuca

SEQ ID NO: 1644632 - RNA, 17 nt, Homo sapiens
cagagcugacacaggau

SEQ ID NO: 1644633 - RNA, 13 nt, Homo sapiens
cagagcuggugau

SEQ ID NO: 1644634 - RNA, 22 nt, Homo sapiens
cagagguccacaacacacagau

SEQ ID NO: 1644635 - RNA, 19 nt, Homo sapiens
cagagucucacuguugccc

SEQ ID NO: 1644636 - RNA, 23 nt, Homo sapiens
cagagugagacccagcccucauc

SEQ ID NO: 1644637 - RNA, 23 nt, Homo sapiens
cagagugcuaauuuaguucucag

SEQ ID NO: 1644638 - RNA, 21 nt, Homo sapiens
cagaugaaaccaggucacugg

SEQ ID NO: 1644639 - RNA, 20 nt, Homo sapiens
cagaugagaguacaccccaa

SEQ ID NO: 1644640 - RNA, 18 nt, Homo sapiens
cagauuagcuaggggaca

SEQ ID NO: 1644641 - RNA, 17 nt, Homo sapiens
cagauucacacaugcca

SEQ ID NO: 1644642 - RNA, 18 nt, Homo sapiens
cagauuggcucacacuga

SEQ ID NO: 1644643 - RNA, 17 nt, Homo sapiens
cagauuugggcuggaac

SEQ ID NO: 1644644 - RNA, 13 nt, Homo sapiens
cagauuuguaaca

SEQ ID NO: 1644645 - RNA, 23 nt, Homo sapiens
cagcaaggccagaugcacauccc

SEQ ID NO: 1644646 - RNA, 18 nt, Homo sapiens
cagcaagugagagcuggg

SEQ ID NO: 1644647 - RNA, 15 nt, Homo sapiens
cagcacagcugccaa

SEQ ID NO: 1644648 - RNA, 17 nt, Homo sapiens
cagcacccucuccagau

SEQ ID NO: 1644649 - RNA, 14 nt, Homo sapiens
cagcacuaauucaa

SEQ ID NO: 1644650 - RNA, 12 nt, Homo sapiens
cagcagcuccaa

SEQ ID NO: 1644651 - RNA, 22 nt, Homo sapiens
cagcaguggacucaaaacccau

SEQ ID NO: 1644652 - RNA, 13 nt, Homo sapiens
cagcaucccuuga

SEQ ID NO: 1644653 - RNA, 14 nt, Homo sapiens
cagcaucuaaguaa

SEQ ID NO: 1644654 - RNA, 15 nt, Homo sapiens
cagcauggagucaca

SEQ ID NO: 1644655 - RNA, 16 nt, Homo sapiens
cagcauggagucacag

SEQ ID NO: 1644656 - RNA, 17 nt, Homo sapiens
cagccaaaaaggacuuu

SEQ ID NO: 1644657 - RNA, 17 nt, Homo sapiens
cagccacaguguuaugc

SEQ ID NO: 1644658 - RNA, 19 nt, Homo sapiens
cagccccugauccugugaa

SEQ ID NO: 1644659 - RNA, 16 nt, Homo sapiens
cagcccggcacuccag

SEQ ID NO: 1644660 - RNA, 18 nt, Homo sapiens
ccacgcuggagugcagug

SEQ ID NO: 1644661 - RNA, 20 nt, Homo sapiens
ccacuaagaacaccugcauu

SEQ ID NO: 1644662 - RNA, 14 nt, Homo sapiens
ccacucccaggcag

SEQ ID NO: 1644663 - RNA, 15 nt, Homo sapiens
ccacugccaaagaac

SEQ ID NO: 1644664 - RNA, 14 nt, Homo sapiens
ccacugccuuugac

SEQ ID NO: 1644665 - RNA, 21 nt, Homo sapiens
ccacuucuggguggggcagug

SEQ ID NO: 1644666 - RNA, 14 nt, Homo sapiens
ccacuugauuuugc

SEQ ID NO: 1644667 - RNA, 17 nt, Homo sapiens
ccagaaagcucaucuca

SEQ ID NO: 1644668 - RNA, 15 nt, Homo sapiens
ccagagcagaugcag

SEQ ID NO: 1644669 - RNA, 17 nt, Homo sapiens
ccagagcagaugcagag

SEQ ID NO: 1644670 - RNA, 18 nt, Homo sapiens
ccagagcguguagugaau

SEQ ID NO: 1644671 - RNA, 20 nt, Homo sapiens
ccagaggauugcugccccau

SEQ ID NO: 1644672 - RNA, 17 nt, Homo sapiens
ccagaggggccugccac

SEQ ID NO: 1644673 - RNA, 15 nt, Homo sapiens
ccagaucugcaguca

SEQ ID NO: 1644674 - RNA, 23 nt, Homo sapiens
ccagaugggggaaagcacaggug

SEQ ID NO: 1644675 - RNA, 14 nt, Homo sapiens
ccagauuggcucac

SEQ ID NO: 1644676 - RNA, 22 nt, Homo sapiens
ccagauuggcucacacugagaa

SEQ ID NO: 1644677 - RNA, 22 nt, Homo sapiens
ccagcaccggccccauuuaccc

SEQ ID NO: 1644678 - RNA, 23 nt, Homo sapiens
ccagcaguggacucaaaacccau

SEQ ID NO: 1644679 - RNA, 12 nt, Homo sapiens
ccagcauucuca

SEQ ID NO: 1644680 - RNA, 19 nt, Homo sapiens
ccagccagaggaugcauag

SEQ ID NO: 1644681 - RNA, 15 nt, Homo sapiens
ccagccuggcccacc

SEQ ID NO: 1644682 - RNA, 20 nt, Homo sapiens
ccagccugggugacagagug

SEQ ID NO: 1644683 - RNA, 21 nt, Homo sapiens
ccaggaagaccccagcacaga

SEQ ID NO: 1644684 - RNA, 13 nt, Homo sapiens
ccaggacugggcc

SEQ ID NO: 1644685 - RNA, 21 nt, Homo sapiens
ccaggagccggacacuucuca

SEQ ID NO: 1644686 - RNA, 22 nt, Homo sapiens
ccaggagccggacacuucucag

SEQ ID NO: 1644687 - RNA, 23 nt, Homo sapiens
ccaggaguacaccccaacagcac

SEQ ID NO: 1644688 - RNA, 15 nt, Homo sapiens
ccaggaucauggugu

SEQ ID NO: 1644689 - RNA, 19 nt, Homo sapiens
ccaggaucaugguguaaua

SEQ ID NO: 1644690 - RNA, 13 nt, Homo sapiens
ccaggcaaagcaa

SEQ ID NO: 1644691 - RNA, 13 nt, Homo sapiens
ccaggcaugcaau

SEQ ID NO: 1644692 - RNA, 14 nt, Homo sapiens
ccaggcaugcaaug

SEQ ID NO: 1644693 - RNA, 15 nt, Homo sapiens
ccaggcaugcaaugc

SEQ ID NO: 1644694 - RNA, 18 nt, Homo sapiens
ccaggcuggagugcaaug

SEQ ID NO: 1644695 - RNA, 18 nt, Homo sapiens
ccaggcuggcgugcagug

SEQ ID NO: 1644696 - RNA, 20 nt, Homo sapiens
ccaggcuggcgugcaguggu

SEQ ID NO: 1644697 - RNA, 15 nt, Homo sapiens
ccagggagagcccag

SEQ ID NO: 1644698 - RNA, 16 nt, Homo sapiens
ccagggagagcccagg

SEQ ID NO: 1644699 - RNA, 18 nt, Homo sapiens
ccagggcuggacugaggc

SEQ ID NO: 1644700 - RNA, 14 nt, Homo sapiens
ccaggugcugugac

SEQ ID NO: 1644701 - RNA, 20 nt, Homo sapiens
ccagguggggugaggcagug

SEQ ID NO: 1644702 - RNA, 23 nt, Homo sapiens
ccaguaguggugacugugggcuc

SEQ ID NO: 1644703 - RNA, 20 nt, Homo sapiens
ccaguguguuucugaucuga

SEQ ID NO: 1644704 - RNA, 16 nt, Homo sapiens
ccauagagacuuugug

SEQ ID NO: 1644705 - RNA, 20 nt, Homo sapiens
ccauauuuucaccauuugau

SEQ ID NO: 1644706 - RNA, 21 nt, Homo sapiens
ccaucaguuagagcugacaca

SEQ ID NO: 1644707 - RNA, 15 nt, Homo sapiens
ccaucauuuacuuuu

SEQ ID NO: 1644708 - RNA, 17 nt, Homo sapiens
ccauccaauucuuugaa

SEQ ID NO: 1644709 - RNA, 16 nt, Homo sapiens
ccauccuacauaauac

SEQ ID NO: 1644710 - RNA, 23 nt, Homo sapiens
ccaugcacccucauacacagaaa

SEQ ID NO: 1644711 - RNA, 14 nt, Homo sapiens
ccaugcagacauga

SEQ ID NO: 1644712 - RNA, 23 nt, Homo sapiens
ccaugccucuccaacaucuucaa

SEQ ID NO: 1644713 - RNA, 21 nt, Homo sapiens
ccauggacagaagaaggcagc

SEQ ID NO: 1644714 - RNA, 16 nt, Homo sapiens
ccauggugugaucguc

SEQ ID NO: 1644715 - RNA, 17 nt, Homo sapiens
ccauguagaagcugcau

SEQ ID NO: 1644716 - RNA, 19 nt, Homo sapiens
ccauguuucauuaaucaag

SEQ ID NO: 1644717 - RNA, 21 nt, Homo sapiens
ccauuagcauuugucaacaaa

SEQ ID NO: 1644718 - RNA, 16 nt, Homo sapiens
ccauucuccugccuca

SEQ ID NO: 1644719 - RNA, 22 nt, Homo sapiens
ccauucuggaagugacuuuggc

SEQ ID NO: 1644720 - RNA, 20 nt, Homo sapiens
ccauuguguaugauuuugau

SEQ ID NO: 1644721 - RNA, 21 nt, Homo sapiens
ccauuuggcaaugccaucauc

SEQ ID NO: 1644722 - RNA, 14 nt, Homo sapiens
ccauuuugugaaug

SEQ ID NO: 1644723 - RNA, 22 nt, Homo sapiens
cccaaaagcccauucauuccau

SEQ ID NO: 1644724 - RNA, 13 nt, Homo sapiens
cccaacaugacug

SEQ ID NO: 1644725 - RNA, 20 nt, Homo sapiens
cccaagccuggcaagggaau

SEQ ID NO: 1644726 - RNA, 21 nt, Homo sapiens
cccacugccaaagaacuugga

SEQ ID NO: 1644727 - RNA, 13 nt, Homo sapiens
cccagcacugagg

SEQ ID NO: 1644728 - RNA, 18 nt, Homo sapiens
cccaggaccccauggcag

SEQ ID NO: 1644729 - RNA, 13 nt, Homo sapiens
cccaggaguacac

SEQ ID NO: 1644730 - RNA, 12 nt, Homo sapiens
cccaggccagga

SEQ ID NO: 1644731 - RNA, 22 nt, Homo sapiens
cccaggcccagaccuucuagga

SEQ ID NO: 1644732 - RNA, 18 nt, Homo sapiens
cccaggcugagccucagu

SEQ ID NO: 1644733 - RNA, 20 nt, Homo sapiens
cccaggcuggagugcaaugg

SEQ ID NO: 1644734 - RNA, 18 nt, Homo sapiens
cccagguacccaugaaug

SEQ ID NO: 1644735 - RNA, 11 nt, Homo sapiens
ccccaacagca

SEQ ID NO: 1644736 - RNA, 12 nt, Homo sapiens
ccccacagccca

SEQ ID NO: 1644737 - RNA, 20 nt, Homo sapiens
ccccagcccuacucugugua

SEQ ID NO: 1644738 - RNA, 16 nt, Homo sapiens
ccccagcccuccuuau

SEQ ID NO: 1644739 - RNA, 15 nt, Homo sapiens
ccccauccuggccca

SEQ ID NO: 1644740 - RNA, 15 nt, Homo sapiens
cccccagcacugagg

SEQ ID NO: 1644741 - RNA, 21 nt, Homo sapiens
cccccugacauuaucuuggau

SEQ ID NO: 1644742 - RNA, 12 nt, Homo sapiens
cccccugugcag

SEQ ID NO: 1644743 - RNA, 15 nt, Homo sapiens
cccccuuccauggac

SEQ ID NO: 1644744 - RNA, 18 nt, Homo sapiens
cccccuuuccucuugggc

SEQ ID NO: 1644745 - RNA, 15 nt, Homo sapiens
ccccucccugcuuca

SEQ ID NO: 1644746 - RNA, 14 nt, Homo sapiens
ccccuccugcugca

SEQ ID NO: 1644747 - RNA, 13 nt, Homo sapiens
ccccucuccuccg

SEQ ID NO: 1644748 - RNA, 16 nt, Homo sapiens
cccgagccuggcucca

SEQ ID NO: 1644749 - RNA, 20 nt, Homo sapiens
cccgcaggccugccuucuca

SEQ ID NO: 1644750 - RNA, 15 nt, Homo sapiens
cccgucgacguagaa

SEQ ID NO: 1644751 - RNA, 19 nt, Homo sapiens
cccuaaccucugagucacc

SEQ ID NO: 1644752 - RNA, 21 nt, Homo sapiens
cccucaugcugugugacucaa

SEQ ID NO: 1644753 - RNA, 14 nt, Homo sapiens
cccucccuuucucc

SEQ ID NO: 1644754 - RNA, 18 nt, Homo sapiens
cccuccuuaucaaaggac

SEQ ID NO: 1644755 - RNA, 22 nt, Homo sapiens
cccucgaggcggaucuuuggac

SEQ ID NO: 1644756 - RNA, 15 nt, Homo sapiens
cccucgcccaucagu

SEQ ID NO: 1644757 - RNA, 13 nt, Homo sapiens
cccucgugccagu

SEQ ID NO: 1644758 - RNA, 19 nt, Homo sapiens
cccucucuuauaauuccag

SEQ ID NO: 1644759 - RNA, 17 nt, Homo sapiens
cccucuggcuccagcug

SEQ ID NO: 1644760 - RNA, 21 nt, Homo sapiens
cccugacugggaguugaucgc

SEQ ID NO: 1644761 - RNA, 19 nt, Homo sapiens
cccugagcagaauacuggu

SEQ ID NO: 1644762 - RNA, 23 nt, Homo sapiens
cccugauuugcugggcaguuuuu

SEQ ID NO: 1644763 - RNA, 14 nt, Homo sapiens
cccuggggacagca

SEQ ID NO: 1644764 - RNA, 16 nt, Homo sapiens
cccugguggcagcuca

SEQ ID NO: 1644765 - RNA, 17 nt, Homo sapiens
cccuguaccugugcacg

SEQ ID NO: 1644766 - RNA, 18 nt, Homo sapiens
ccgagccuggcuccaaac

SEQ ID NO: 1644767 - RNA, 21 nt, Homo sapiens
ccgccacccucccacugccaa

SEQ ID NO: 1644768 - RNA, 17 nt, Homo sapiens
ccgguucuuaaauccau

SEQ ID NO: 1644769 - RNA, 14 nt, Homo sapiens
ccuaaaauuugccc

SEQ ID NO: 1644770 - RNA, 21 nt, Homo sapiens
guacuguauggaaacacugau

SEQ ID NO: 1644771 - RNA, 17 nt, Homo sapiens
guagaagccacuauuac

SEQ ID NO: 1644772 - RNA, 18 nt, Homo sapiens
guagauguggccuuugaa

SEQ ID NO: 1644773 - RNA, 20 nt, Homo sapiens
guagcaacccugugauacua

SEQ ID NO: 1644774 - RNA, 15 nt, Homo sapiens
guaggaagacuuugg

SEQ ID NO: 1644775 - RNA, 21 nt, Homo sapiens
guaguaaauuuugugaugaau

SEQ ID NO: 1644776 - RNA, 11 nt, Homo sapiens
guagugcaagc

SEQ ID NO: 1644777 - RNA, 20 nt, Homo sapiens
guaguuagcaacuagggcua

SEQ ID NO: 1644778 - RNA, 13 nt, Homo sapiens
guaguuuugccaa

SEQ ID NO: 1644779 - RNA, 18 nt, Homo sapiens
guauaucuucuacaugca

SEQ ID NO: 1644780 - RNA, 13 nt, Homo sapiens
guauaugcaauau

SEQ ID NO: 1644781 - RNA, 14 nt, Homo sapiens
guaucaaaugugac

SEQ ID NO: 1644782 - RNA, 16 nt, Homo sapiens
guaucaggugcugcca

SEQ ID NO: 1644783 - RNA, 18 nt, Homo sapiens
guaucccaugagccucag

SEQ ID NO: 1644784 - RNA, 22 nt, Homo sapiens
guaucugcauguaaaaucuuca

SEQ ID NO: 1644785 - RNA, 23 nt, Homo sapiens
guaugauccuaaugaaugcauaa

SEQ ID NO: 1644786 - RNA, 16 nt, Homo sapiens
guauggagcucagaga

SEQ ID NO: 1644787 - RNA, 17 nt, Homo sapiens
guaugugaaacacacau

SEQ ID NO: 1644788 - RNA, 21 nt, Homo sapiens
guauguuugggagacugcuga

SEQ ID NO: 1644789 - RNA, 17 nt, Homo sapiens
guauuacuaauuuccau

SEQ ID NO: 1644790 - RNA, 22 nt, Homo sapiens
guauucccaaaaauuacuuugg

SEQ ID NO: 1644791 - RNA, 18 nt, Homo sapiens
guauugauaaacuuugaa

SEQ ID NO: 1644792 - RNA, 17 nt, Homo sapiens
guauuuuaauccuguac

SEQ ID NO: 1644793 - RNA, 18 nt, Homo sapiens
guauuuucaguuugcccu

SEQ ID NO: 1644794 - RNA, 18 nt, Homo sapiens
guauuuuuucacuuguac

SEQ ID NO: 1644795 - RNA, 19 nt, Homo sapiens
gucaaccugccugacauuu

SEQ ID NO: 1644796 - RNA, 17 nt, Homo sapiens
gucaacuuucauuugaa

SEQ ID NO: 1644797 - RNA, 22 nt, Homo sapiens
gucaaggacaaaaaaccucagg

SEQ ID NO: 1644798 - RNA, 14 nt, Homo sapiens
gucaauacugagcc

SEQ ID NO: 1644799 - RNA, 17 nt, Homo sapiens
gucaauacugagccauu

SEQ ID NO: 1644800 - RNA, 13 nt, Homo sapiens
gucacagccacuu

SEQ ID NO: 1644801 - RNA, 20 nt, Homo sapiens
gucacaugaaacauuugcaa

SEQ ID NO: 1644802 - RNA, 22 nt, Homo sapiens
gucacguggaggagcagugcag

SEQ ID NO: 1644803 - RNA, 19 nt, Homo sapiens
gucacuugcuggcugugaa

SEQ ID NO: 1644804 - RNA, 18 nt, Homo sapiens
gucagacuccuagacuca

SEQ ID NO: 1644805 - RNA, 23 nt, Homo sapiens
gucagcacagaacacacugagac

SEQ ID NO: 1644806 - RNA, 16 nt, Homo sapiens
gucaggaaacauauuu

SEQ ID NO: 1644807 - RNA, 23 nt, Homo sapiens
guccaaggcuauauuucugggau

SEQ ID NO: 1644808 - RNA, 15 nt, Homo sapiens
guccaccaccaccug

SEQ ID NO: 1644809 - RNA, 21 nt, Homo sapiens
guccaucccgucgacguagaa

SEQ ID NO: 1644810 - RNA, 15 nt, Homo sapiens
guccauuaacugcuu

SEQ ID NO: 1644811 - RNA, 23 nt, Homo sapiens
guccauuaagcugagagugcuau

SEQ ID NO: 1644812 - RNA, 18 nt, Homo sapiens
guccuaaauccaaugaca

SEQ ID NO: 1644813 - RNA, 18 nt, Homo sapiens
guccuacucugugucagg

SEQ ID NO: 1644814 - RNA, 18 nt, Homo sapiens
guccuauaauucuauuga

SEQ ID NO: 1644815 - RNA, 15 nt, Homo sapiens
guccuccucugugaa

SEQ ID NO: 1644816 - RNA, 17 nt, Homo sapiens
guccugacagcacuccu

SEQ ID NO: 1644817 - RNA, 18 nt, Homo sapiens
guccugaugauuuuuauu

SEQ ID NO: 1644818 - RNA, 17 nt, Homo sapiens
guccugcuccacagugu

SEQ ID NO: 1644819 - RNA, 16 nt, Homo sapiens
gucgaacaauucauau

SEQ ID NO: 1644820 - RNA, 16 nt, Homo sapiens
gucggagccacugguc

SEQ ID NO: 1644821 - RNA, 14 nt, Homo sapiens
gucguucaauucau

SEQ ID NO: 1644822 - RNA, 13 nt, Homo sapiens
gucuaauguuugu

SEQ ID NO: 1644823 - RNA, 12 nt, Homo sapiens
gucuacacugug

SEQ ID NO: 1644824 - RNA, 17 nt, Homo sapiens
gucucacuauguugccc

SEQ ID NO: 1644825 - RNA, 14 nt, Homo sapiens
gucucacucuguca

SEQ ID NO: 1644826 - RNA, 17 nt, Homo sapiens
gucucgaacuccugacc

SEQ ID NO: 1644827 - RNA, 21 nt, Homo sapiens
gucucuuuaaugucacaggca

SEQ ID NO: 1644828 - RNA, 14 nt, Homo sapiens
gucuguaguguuuu

SEQ ID NO: 1644829 - RNA, 23 nt, Homo sapiens
gucuuaucaagcagccaagggau

SEQ ID NO: 1644830 - RNA, 21 nt, Homo sapiens
gucuugaccugaacucugcaa

SEQ ID NO: 1644831 - RNA, 13 nt, Homo sapiens
gucuuucuuugcu

SEQ ID NO: 1644832 - RNA, 19 nt, Homo sapiens
gucuuuggugaacauugca

SEQ ID NO: 1644833 - RNA, 12 nt, Homo sapiens
gugaaaauaugu

SEQ ID NO: 1644834 - RNA, 20 nt, Homo sapiens
gugaaauaaaaguagaauaa

SEQ ID NO: 1644835 - RNA, 23 nt, Homo sapiens
gugaaccaccacacccagcccac

SEQ ID NO: 1644836 - RNA, 19 nt, Homo sapiens
gugacaacacuuguguuau

SEQ ID NO: 1644837 - RNA, 17 nt, Homo sapiens
gugacaaugguuucacc

SEQ ID NO: 1644838 - RNA, 22 nt, Homo sapiens
gugaccugccaggcacacugag

SEQ ID NO: 1644839 - RNA, 16 nt, Homo sapiens
gugagacacugcacag

SEQ ID NO: 1644840 - RNA, 17 nt, Homo sapiens
gugagacacugcacaga

SEQ ID NO: 1644841 - RNA, 20 nt, Homo sapiens
gugagggcaccaccaagaau

SEQ ID NO: 1644842 - RNA, 19 nt, Homo sapiens
gugaggguugcuucaauga

SEQ ID NO: 1644843 - RNA, 14 nt, Homo sapiens
gugaucacagcagc

SEQ ID NO: 1644844 - RNA, 17 nt, Homo sapiens
gugaucacugagccauc

SEQ ID NO: 1644845 - RNA, 13 nt, Homo sapiens
gugauccacccac

SEQ ID NO: 1644846 - RNA, 13 nt, Homo sapiens
gugauccucccac

SEQ ID NO: 1644847 - RNA, 18 nt, Homo sapiens
gugauccucccaccucag

SEQ ID NO: 1644848 - RNA, 14 nt, Homo sapiens
gugcaaaguauaaa

SEQ ID NO: 1644849 - RNA, 13 nt, Homo sapiens
gugcaauauguga

SEQ ID NO: 1644850 - RNA, 16 nt, Homo sapiens
gugcacaucugugucu

SEQ ID NO: 1644851 - RNA, 20 nt, Homo sapiens
gugcaugcagcaucuaagua

SEQ ID NO: 1644852 - RNA, 12 nt, Homo sapiens
gugccaauguau

SEQ ID NO: 1644853 - RNA, 14 nt, Homo sapiens
gugcccuguucucu

SEQ ID NO: 1644854 - RNA, 17 nt, Homo sapiens
gugccugggccuagcac

SEQ ID NO: 1644855 - RNA, 18 nt, Homo sapiens
gugcuaaacgcacacagu

SEQ ID NO: 1644856 - RNA, 23 nt, Homo sapiens
gugcuaggaacacuccuucacag

SEQ ID NO: 1644857 - RNA, 19 nt, Homo sapiens
gugcuuauuuuguuucaau

SEQ ID NO: 1644858 - RNA, 20 nt, Homo sapiens
gugcuuuauaccccauuuga

SEQ ID NO: 1644859 - RNA, 15 nt, Homo sapiens
guggaagcuucuaaa

SEQ ID NO: 1644860 - RNA, 15 nt, Homo sapiens
guggaagucccucag

SEQ ID NO: 1644861 - RNA, 12 nt, Homo sapiens
guggacaggugu

SEQ ID NO: 1644862 - RNA, 17 nt, Homo sapiens
guggauacagucauuau

SEQ ID NO: 1644863 - RNA, 16 nt, Homo sapiens
guggauuggauuuguc

SEQ ID NO: 1644864 - RNA, 17 nt, Homo sapiens
guggcagcucaccucuc

SEQ ID NO: 1644865 - RNA, 22 nt, Homo sapiens
guggccacagcagcuuuguaca

SEQ ID NO: 1644866 - RNA, 16 nt, Homo sapiens
guggcugugacaucua

SEQ ID NO: 1644867 - RNA, 17 nt, Homo sapiens
guggcuucuuaaucuuu

SEQ ID NO: 1644868 - RNA, 14 nt, Homo sapiens
gugggauccuccag

SEQ ID NO: 1644869 - RNA, 22 nt, Homo sapiens
gugggcuaagcacgggccauau

SEQ ID NO: 1644870 - RNA, 15 nt, Homo sapiens
guggggcaaucuauu

SEQ ID NO: 1644871 - RNA, 17 nt, Homo sapiens
gugggucccacuucccc

SEQ ID NO: 1644872 - RNA, 17 nt, Homo sapiens
gugguccuuugggguga

SEQ ID NO: 1644873 - RNA, 12 nt, Homo sapiens
gugguuugaaaa

SEQ ID NO: 1644874 - RNA, 17 nt, Homo sapiens
gugucaggaaacauauu

SEQ ID NO: 1644875 - RNA, 18 nt, Homo sapiens
gugucccccauaaaagau

SEQ ID NO: 1644876 - RNA, 13 nt, Homo sapiens
gugucucuguaua

SEQ ID NO: 1644877 - RNA, 20 nt, Homo sapiens
gugugccccccauccuggcc

SEQ ID NO: 1644878 - RNA, 14 nt, Homo sapiens
gugugcgagucuga

SEQ ID NO: 1644879 - RNA, 19 nt, Homo sapiens
guguuaaagugaaucucaa

SEQ ID NO: 1644880 - RNA, 13 nt, Homo sapiens
ucaaaaauacuca

SEQ ID NO: 1644881 - RNA, 18 nt, Homo sapiens
ucaaaacccaacaugacu

SEQ ID NO: 1644882 - RNA, 22 nt, Homo sapiens
ucaaaagcacuuugugcugugu

SEQ ID NO: 1644883 - RNA, 19 nt, Homo sapiens
ucaaaccaaaucacugaac

SEQ ID NO: 1644884 - RNA, 14 nt, Homo sapiens
ucaaacuacuggca

SEQ ID NO: 1644885 - RNA, 16 nt, Homo sapiens
ucaaagaaauccucca

SEQ ID NO: 1644886 - RNA, 12 nt, Homo sapiens
ucaaagcacugu

SEQ ID NO: 1644887 - RNA, 21 nt, Homo sapiens
ucaaauggaagacacauugaa

SEQ ID NO: 1644888 - RNA, 20 nt, Homo sapiens
ucaacauuaaggcaguauga

SEQ ID NO: 1644889 - RNA, 19 nt, Homo sapiens
ucaaccaaaaacauguuuc

SEQ ID NO: 1644890 - RNA, 21 nt, Homo sapiens
ucaaccuccugggcuaaguga

SEQ ID NO: 1644891 - RNA, 18 nt, Homo sapiens
ucaaccugggcaaagccu

SEQ ID NO: 1644892 - RNA, 16 nt, Homo sapiens
ucaacugguuguauau

SEQ ID NO: 1644893 - RNA, 16 nt, Homo sapiens
ucaagagagauuugau

SEQ ID NO: 1644894 - RNA, 21 nt, Homo sapiens
ucaagagauagagaccaucuu

SEQ ID NO: 1644895 - RNA, 18 nt, Homo sapiens
ucaagcaguagacaagca

SEQ ID NO: 1644896 - RNA, 18 nt, Homo sapiens
ucaagcuucuucacucac

SEQ ID NO: 1644897 - RNA, 13 nt, Homo sapiens
ucaaggacuggua

SEQ ID NO: 1644898 - RNA, 15 nt, Homo sapiens
ucaaggccucccaca

SEQ ID NO: 1644899 - RNA, 22 nt, Homo sapiens
ucaagugauucucaugccucag

SEQ ID NO: 1644900 - RNA, 17 nt, Homo sapiens
ucaaguuccagugcaga

SEQ ID NO: 1644901 - RNA, 22 nt, Homo sapiens
ucaaguuggcuucuaaucaaag

SEQ ID NO: 1644902 - RNA, 14 nt, Homo sapiens
ucaauaaaguacaa

SEQ ID NO: 1644903 - RNA, 15 nt, Homo sapiens
ucaauaaaguacaag

SEQ ID NO: 1644904 - RNA, 16 nt, Homo sapiens
ucaauaaaguacaaga

SEQ ID NO: 1644905 - RNA, 14 nt, Homo sapiens
ucaauaucuuuauu

SEQ ID NO: 1644906 - RNA, 20 nt, Homo sapiens
ucaauccaagagucugauga

SEQ ID NO: 1644907 - RNA, 22 nt, Homo sapiens
ucaauccaagagucugaugauu

SEQ ID NO: 1644908 - RNA, 12 nt, Homo sapiens
ucaauccagcua

SEQ ID NO: 1644909 - RNA, 19 nt, Homo sapiens
ucaaugaaauggauuggua

SEQ ID NO: 1644910 - RNA, 14 nt, Homo sapiens
ucaaugcagguuug

SEQ ID NO: 1644911 - RNA, 23 nt, Homo sapiens
ucaauuuacuuuuuaaacagugu

SEQ ID NO: 1644912 - RNA, 10 nt, Homo sapiens
ucacaaagug

SEQ ID NO: 1644913 - RNA, 21 nt, Homo sapiens
ucacaaucaucaucauucuca

SEQ ID NO: 1644914 - RNA, 22 nt, Homo sapiens
ucacaaucaucaucauucucau

SEQ ID NO: 1644915 - RNA, 12 nt, Homo sapiens
ucacacauucag

SEQ ID NO: 1644916 - RNA, 18 nt, Homo sapiens
ucacagaugugugauuca

SEQ ID NO: 1644917 - RNA, 15 nt, Homo sapiens
ucacagguugaccaa

SEQ ID NO: 1644918 - RNA, 14 nt, Homo sapiens
ucacaguuacguga

SEQ ID NO: 1644919 - RNA, 16 nt, Homo sapiens
ucacaguuucuuccau

SEQ ID NO: 1644920 - RNA, 18 nt, Homo sapiens
ucacaucuuuuucacuga

SEQ ID NO: 1644921 - RNA, 19 nt, Homo sapiens
ucacauucgaguguuucag

SEQ ID NO: 1644922 - RNA, 18 nt, Homo sapiens
ucacauuuauucugcuca

SEQ ID NO: 1644923 - RNA, 12 nt, Homo sapiens
ucaccaagccca

SEQ ID NO: 1644924 - RNA, 16 nt, Homo sapiens
ucaccauaaaaaggaa

SEQ ID NO: 1644925 - RNA, 22 nt, Homo sapiens
ucaccauguuggccaggcugcu

SEQ ID NO: 1644926 - RNA, 17 nt, Homo sapiens
ucacccccaaacaguga

SEQ ID NO: 1644927 - RNA, 20 nt, Homo sapiens
ucaccuaaacccucugugaa

SEQ ID NO: 1644928 - RNA, 22 nt, Homo sapiens
ucaccuaaacccucugugaaau

SEQ ID NO: 1644929 - RNA, 22 nt, Homo sapiens
ucaccuggggcugcuggccuga

SEQ ID NO: 1644930 - RNA, 17 nt, Homo sapiens
ucaccuuuucccgggga

SEQ ID NO: 1644931 - RNA, 14 nt, Homo sapiens
ucacgccacugcac

SEQ ID NO: 1644932 - RNA, 16 nt, Homo sapiens
ucacggcucacugcag

SEQ ID NO: 1644933 - RNA, 17 nt, Homo sapiens
ucacguccaucacuggc

SEQ ID NO: 1644934 - RNA, 20 nt, Homo sapiens
ucacuaaaacacacaggugc

SEQ ID NO: 1644935 - RNA, 22 nt, Homo sapiens
ucacucaaucucugauucuguc

SEQ ID NO: 1644936 - RNA, 17 nt, Homo sapiens
ucacucugcucucagga

SEQ ID NO: 1644937 - RNA, 12 nt, Homo sapiens
ucacuucuucca

SEQ ID NO: 1644938 - RNA, 20 nt, Homo sapiens
ucacuucuuccauccaaaga

SEQ ID NO: 1644939 - RNA, 18 nt, Homo sapiens
ucacuugcuggcugugaa

SEQ ID NO: 1644940 - RNA, 18 nt, Homo sapiens
ucagaauauauucacuuu

SEQ ID NO: 1644941 - RNA, 16 nt, Homo sapiens
ucagaguauggagcuc

SEQ ID NO: 1644942 - RNA, 18 nt, Homo sapiens
ucagauaccgacuggggc

SEQ ID NO: 1644943 - RNA, 17 nt, Homo sapiens
ucagcaacagagcaaaa

SEQ ID NO: 1644944 - RNA, 19 nt, Homo sapiens
ucagccaggugcugugaca

SEQ ID NO: 1644945 - RNA, 18 nt, Homo sapiens
ucagcccuuggggguccu

SEQ ID NO: 1644946 - RNA, 23 nt, Homo sapiens
ucaggaaagagauuagaacauuu

SEQ ID NO: 1644947 - RNA, 19 nt, Homo sapiens
ucaggaccaggcaauguga

SEQ ID NO: 1644948 - RNA, 19 nt, Homo sapiens
ucaggagaucuggcuguga

SEQ ID NO: 1644949 - RNA, 21 nt, Homo sapiens
ucaggauugcgagagaugugu

SEQ ID NO: 1644950 - RNA, 21 nt, Homo sapiens
ucaggcaaggggcauuucaca

SEQ ID NO: 1644951 - RNA, 17 nt, Homo sapiens
ucagggaaagcauuuaa

SEQ ID NO: 1644952 - RNA, 14 nt, Homo sapiens
ucagggaacauauu

SEQ ID NO: 1644953 - RNA, 19 nt, Homo sapiens
ucagggaccacagcaaggc

SEQ ID NO: 1644954 - RNA, 15 nt, Homo sapiens
ucagggagcauuuau

SEQ ID NO: 1644955 - RNA, 16 nt, Homo sapiens
ucagggagugggcuaa

SEQ ID NO: 1644956 - RNA, 22 nt, Homo sapiens
ucaggugggguggagucccaga

SEQ ID NO: 1644957 - RNA, 21 nt, Homo sapiens
ucagugcucccucacauguca

SEQ ID NO: 1644958 - RNA, 14 nt, Homo sapiens
ucagugcugcugaa

SEQ ID NO: 1644959 - RNA, 15 nt, Homo sapiens
ucaguguuaaaugug

SEQ ID NO: 1644960 - RNA, 15 nt, Homo sapiens
ucauaaauauaaucu

SEQ ID NO: 1644961 - RNA, 16 nt, Homo sapiens
ucauaagugacaguuu

SEQ ID NO: 1644962 - RNA, 19 nt, Homo sapiens
ucauacaaauacuauccaa

SEQ ID NO: 1644963 - RNA, 18 nt, Homo sapiens
ucauagggaggccuuuag

SEQ ID NO: 1644964 - RNA, 10 nt, Homo sapiens
ucauauugau

SEQ ID NO: 1644965 - RNA, 14 nt, Homo sapiens
ucauauugcaucau

SEQ ID NO: 1644966 - RNA, 14 nt, Homo sapiens
ucauauuuugccac

SEQ ID NO: 1644967 - RNA, 19 nt, Homo sapiens
ucauauuuugccacugccu

SEQ ID NO: 1644968 - RNA, 20 nt, Homo sapiens
ucaucaaauggaagacacau

SEQ ID NO: 1644969 - RNA, 18 nt, Homo sapiens
ucaucacaucaugcuguu

SEQ ID NO: 1644970 - RNA, 15 nt, Homo sapiens
ucaucaggaguucca

SEQ ID NO: 1644971 - RNA, 21 nt, Homo sapiens
ucaucaguggagccauguuaa

SEQ ID NO: 1644972 - RNA, 18 nt, Homo sapiens
ucaucauucucugucuca

SEQ ID NO: 1644973 - RNA, 13 nt, Homo sapiens
ucaucauuuccau

SEQ ID NO: 1644974 - RNA, 22 nt, Homo sapiens
ucauccuugcccaucgggacca

SEQ ID NO: 1644975 - RNA, 16 nt, Homo sapiens
ucaucucucaucacuu

SEQ ID NO: 1644976 - RNA, 16 nt, Homo sapiens
ucaugaguaacugauu

SEQ ID NO: 1644977 - RNA, 23 nt, Homo sapiens
ucaugccuguaaucccagcacuu

SEQ ID NO: 1644978 - RNA, 20 nt, Homo sapiens
ucaugguccgccugccucag

SEQ ID NO: 1644979 - RNA, 19 nt, Homo sapiens
ucaugucuaagaacucuuu

SEQ ID NO: 1644980 - RNA, 14 nt, Homo sapiens
ucauuauguuaaua

SEQ ID NO: 1644981 - RNA, 15 nt, Homo sapiens
ucauucacucaacaa

SEQ ID NO: 1644982 - RNA, 12 nt, Homo sapiens
ucauucugugac

SEQ ID NO: 1644983 - RNA, 21 nt, Homo sapiens
ucauucuuuuugaaaugucaa

SEQ ID NO: 1644984 - RNA, 13 nt, Homo sapiens
ucauuuccaauca

SEQ ID NO: 1644985 - RNA, 14 nt, Homo sapiens
ucauuuugcacuga

SEQ ID NO: 1644986 - RNA, 17 nt, Homo sapiens
uccaaaugcugugcaaa

SEQ ID NO: 1644987 - RNA, 14 nt, Homo sapiens
uccaacaugugcuc

SEQ ID NO: 1644988 - RNA, 15 nt, Homo sapiens
uccaacaugugcuca

SEQ ID NO: 1644989 - RNA, 19 nt, Homo sapiens
uccaauaauuuuccuguga

SEQ ID NO: 1644990 - RNA, 17 nt, Homo sapiens
ugccagugggaacuccu

SEQ ID NO: 1644991 - RNA, 18 nt, Homo sapiens
ugccaucauuuacuuuua

SEQ ID NO: 1644992 - RNA, 20 nt, Homo sapiens
ugccaugggggcaacagcca

SEQ ID NO: 1644993 - RNA, 20 nt, Homo sapiens
ugcccacgcuggagugcagu

SEQ ID NO: 1644994 - RNA, 13 nt, Homo sapiens
ugcccccaacagc

SEQ ID NO: 1644995 - RNA, 14 nt, Homo sapiens
ugcccgaaaagcau

SEQ ID NO: 1644996 - RNA, 14 nt, Homo sapiens
ugcccucagauucc

SEQ ID NO: 1644997 - RNA, 18 nt, Homo sapiens
ugcccugauccaaguuua

SEQ ID NO: 1644998 - RNA, 15 nt, Homo sapiens
ugccuaucugacuuc

SEQ ID NO: 1644999 - RNA, 14 nt, Homo sapiens
ugccucacuucuuc

SEQ ID NO: 1645000 - RNA, 21 nt, Homo sapiens
ugccucauuaccuugugcuaa

SEQ ID NO: 1645001 - RNA, 18 nt, Homo sapiens
ugccucccuucaugcaug

SEQ ID NO: 1645002 - RNA, 15 nt, Homo sapiens
ugccucucugcucca

SEQ ID NO: 1645003 - RNA, 17 nt, Homo sapiens
ugccucugccucugaca

SEQ ID NO: 1645004 - RNA, 15 nt, Homo sapiens
ugccugaagucacac

SEQ ID NO: 1645005 - RNA, 15 nt, Homo sapiens
ugccuucaccuccuc

SEQ ID NO: 1645006 - RNA, 17 nt, Homo sapiens
ugcgagugcucauuuca

SEQ ID NO: 1645007 - RNA, 17 nt, Homo sapiens
ugcgaucuggguucacu

SEQ ID NO: 1645008 - RNA, 21 nt, Homo sapiens
ugcgggcauuuugaaugugau

SEQ ID NO: 1645009 - RNA, 18 nt, Homo sapiens
ugcgugugucuguguuga

SEQ ID NO: 1645010 - RNA, 23 nt, Homo sapiens
ugcuaaacgcacacaguaucuag

SEQ ID NO: 1645011 - RNA, 20 nt, Homo sapiens
ugcuaauaugacauaugaca

SEQ ID NO: 1645012 - RNA, 16 nt, Homo sapiens
ugcuaguuuauauaga

SEQ ID NO: 1645013 - RNA, 17 nt, Homo sapiens
ugcuauaacuauguuga

SEQ ID NO: 1645014 - RNA, 17 nt, Homo sapiens
ugcucaauaaaguacaa

SEQ ID NO: 1645015 - RNA, 13 nt, Homo sapiens
ugcucacauauga

SEQ ID NO: 1645016 - RNA, 22 nt, Homo sapiens
ugcucagggaauaauccagaaa

SEQ ID NO: 1645017 - RNA, 16 nt, Homo sapiens
ugcuccagccugacaa

SEQ ID NO: 1645018 - RNA, 14 nt, Homo sapiens
ugcucccacagaac

SEQ ID NO: 1645019 - RNA, 12 nt, Homo sapiens
ugcucuguggcu

SEQ ID NO: 1645020 - RNA, 18 nt, Homo sapiens
ugcugaccagacagccuc

SEQ ID NO: 1645021 - RNA, 17 nt, Homo sapiens
ugcugcaaauacuguau

SEQ ID NO: 1645022 - RNA, 20 nt, Homo sapiens
ugcuggcaguggaacuaaga

SEQ ID NO: 1645023 - RNA, 14 nt, Homo sapiens
ugcuguacaaaagc

SEQ ID NO: 1645024 - RNA, 11 nt, Homo sapiens
ugcugugcaaa

SEQ ID NO: 1645025 - RNA, 15 nt, Homo sapiens
ugcugugugacucaa

SEQ ID NO: 1645026 - RNA, 21 nt, Homo sapiens
ugcuguuauuuuaucugcuau

SEQ ID NO: 1645027 - RNA, 14 nt, Homo sapiens
ugcuuaaucuugcu

SEQ ID NO: 1645028 - RNA, 13 nt, Homo sapiens
ugcuucaaugauu

SEQ ID NO: 1645029 - RNA, 22 nt, Homo sapiens
ugcuucgggaagaaggggacaa

SEQ ID NO: 1645030 - RNA, 20 nt, Homo sapiens
ugcuuuauaccccauuugau

SEQ ID NO: 1645031 - RNA, 19 nt, Homo sapiens
ugcuuugcccagcauuuua

SEQ ID NO: 1645032 - RNA, 16 nt, Homo sapiens
uggaaaaaaaggaaga

SEQ ID NO: 1645033 - RNA, 14 nt, Homo sapiens
uggaaaaugugcaa

SEQ ID NO: 1645034 - RNA, 16 nt, Homo sapiens
uggaaaaugugcaaua

SEQ ID NO: 1645035 - RNA, 18 nt, Homo sapiens
uggaaagcauauacuaua

SEQ ID NO: 1645036 - RNA, 13 nt, Homo sapiens
uggaacaagcaca

SEQ ID NO: 1645037 - RNA, 14 nt, Homo sapiens
uggaacaagcacag

SEQ ID NO: 1645038 - RNA, 17 nt, Homo sapiens
uggaacaagcacagaug

SEQ ID NO: 1645039 - RNA, 15 nt, Homo sapiens
uggaacucaaggaaa

SEQ ID NO: 1645040 - RNA, 14 nt, Homo sapiens
uggaagcacagcuu

SEQ ID NO: 1645041 - RNA, 19 nt, Homo sapiens
uggaagguggggacaggga

SEQ ID NO: 1645042 - RNA, 23 nt, Homo sapiens
uggaagguggggacagggaugag

SEQ ID NO: 1645043 - RNA, 16 nt, Homo sapiens
uggaaucuucaccuca

SEQ ID NO: 1645044 - RNA, 17 nt, Homo sapiens
uggacagaagcagcucu

SEQ ID NO: 1645045 - RNA, 23 nt, Homo sapiens
uggaccugucacgauugucauca

SEQ ID NO: 1645046 - RNA, 16 nt, Homo sapiens
uggacuaugcacacuu

SEQ ID NO: 1645047 - RNA, 21 nt, Homo sapiens
uggacugucuaugaacuugca

SEQ ID NO: 1645048 - RNA, 15 nt, Homo sapiens
uggacuuucuugcaa

SEQ ID NO: 1645049 - RNA, 22 nt, Homo sapiens
uggagaaaauggguuuauucac

SEQ ID NO: 1645050 - RNA, 19 nt, Homo sapiens
uggagagcuagaaccugga

SEQ ID NO: 1645051 - RNA, 14 nt, Homo sapiens
uggagcugccugau

SEQ ID NO: 1645052 - RNA, 19 nt, Homo sapiens
uggaggacuagaaccugga

SEQ ID NO: 1645053 - RNA, 19 nt, Homo sapiens
uggagggcuagaaucugga

SEQ ID NO: 1645054 - RNA, 19 nt, Homo sapiens
uggaggggggaggugggau

SEQ ID NO: 1645055 - RNA, 18 nt, Homo sapiens
uggaguccgaugauucuc

SEQ ID NO: 1645056 - RNA, 17 nt, Homo sapiens
uggagugagacccagga

SEQ ID NO: 1645057 - RNA, 15 nt, Homo sapiens
uggauauugaugaaa

SEQ ID NO: 1645058 - RNA, 20 nt, Homo sapiens
uggaugcagccucacagucc

SEQ ID NO: 1645059 - RNA, 18 nt, Homo sapiens
uggaugccugauugccaa

SEQ ID NO: 1645060 - RNA, 20 nt, Homo sapiens
uggaugggggaaauggugcc

SEQ ID NO: 1645061 - RNA, 16 nt, Homo sapiens
uggauuccucacuuug

SEQ ID NO: 1645062 - RNA, 18 nt, Homo sapiens
uggauuccucacuuugaa

SEQ ID NO: 1645063 - RNA, 15 nt, Homo sapiens
uggauuucauuugua

SEQ ID NO: 1645064 - RNA, 13 nt, Homo sapiens
uggauuuugucaa

SEQ ID NO: 1645065 - RNA, 17 nt, Homo sapiens
uggcaaacaugugcaac

SEQ ID NO: 1645066 - RNA, 15 nt, Homo sapiens
uggcaaggugacauu

SEQ ID NO: 1645067 - RNA, 16 nt, Homo sapiens
uggcacagaugcccac

SEQ ID NO: 1645068 - RNA, 19 nt, Homo sapiens
uggcaccuuaguugcauga

SEQ ID NO: 1645069 - RNA, 23 nt, Homo sapiens
uggcagagagcacagugaucacc

SEQ ID NO: 1645070 - RNA, 15 nt, Homo sapiens
uggcagugguuugaa

SEQ ID NO: 1645071 - RNA, 15 nt, Homo sapiens
uggccagguaugcau

SEQ ID NO: 1645072 - RNA, 15 nt, Homo sapiens
uggccucccaacuca

SEQ ID NO: 1645073 - RNA, 13 nt, Homo sapiens
uggccucccccac

SEQ ID NO: 1645074 - RNA, 16 nt, Homo sapiens
uggccugugugauaca

SEQ ID NO: 1645075 - RNA, 22 nt, Homo sapiens
uggccuuuaaaaaugcaccacu

SEQ ID NO: 1645076 - RNA, 12 nt, Homo sapiens
uggccuuugaau

SEQ ID NO: 1645077 - RNA, 16 nt, Homo sapiens
uggcucacacugagaa

SEQ ID NO: 1645078 - RNA, 17 nt, Homo sapiens
uggcucacuauggugcc

SEQ ID NO: 1645079 - RNA, 12 nt, Homo sapiens
uggcuccaaacc

SEQ ID NO: 1645080 - RNA, 17 nt, Homo sapiens
uggcuccaggacagacc

SEQ ID NO: 1645081 - RNA, 17 nt, Homo sapiens
uggcucugggguccuca

SEQ ID NO: 1645082 - RNA, 21 nt, Homo sapiens
uggcugaaagguuaauucucu

SEQ ID NO: 1645083 - RNA, 14 nt, Homo sapiens
uggcuggugccuga

SEQ ID NO: 1645084 - RNA, 11 nt, Homo sapiens
uggcugugaca

SEQ ID NO: 1645085 - RNA, 12 nt, Homo sapiens
uggcugugacaa

SEQ ID NO: 1645086 - RNA, 23 nt, Homo sapiens
uggcugugaggcccucagggcag

SEQ ID NO: 1645087 - RNA, 21 nt, Homo sapiens
uggcuucacagaugugugauu

SEQ ID NO: 1645088 - RNA, 15 nt, Homo sapiens
ugggaaaaccagacu

SEQ ID NO: 1645089 - RNA, 15 nt, Homo sapiens
ugggaccugaugacc

SEQ ID NO: 1645090 - RNA, 14 nt, Homo sapiens
ugggacuacaggca

SEQ ID NO: 1645091 - RNA, 18 nt, Homo sapiens
ugggagacugcugaguca

SEQ ID NO: 1645092 - RNA, 15 nt, Homo sapiens
ugggagcaccgccug

SEQ ID NO: 1645093 - RNA, 19 nt, Homo sapiens
ugggagggguugaugccag

SEQ ID NO: 1645094 - RNA, 21 nt, Homo sapiens
ugggagugcccccaacagcac

SEQ ID NO: 1645095 - RNA, 17 nt, Homo sapiens
ugggauaaggaaacacu

SEQ ID NO: 1645096 - RNA, 20 nt, Homo sapiens
ugggauguuauauuugagaa

SEQ ID NO: 1645097 - RNA, 13 nt, Homo sapiens
ugggauuacaggc

SEQ ID NO: 1645098 - RNA, 17 nt, Homo sapiens
ugggauuacagguguga

SEQ ID NO: 1645099 - RNA, 19 nt, Homo sapiens
ugggauuacaggugugaac

SEQ ID NO: 1645100 - RNA, 18 nt, Homo sapiens
ugggcccaaugcacuuug

SEQ ID NO: 1645101 - RNA, 14 nt, Homo sapiens
uuugucaacaaagu

SEQ ID NO: 1645102 - RNA, 20 nt, Homo sapiens
uuugucagauucacacaugc

SEQ ID NO: 1645103 - RNA, 17 nt, Homo sapiens
uuugucuuggauauaua

SEQ ID NO: 1645104 - RNA, 16 nt, Homo sapiens
uuugugacuuuccuaa

SEQ ID NO: 1645105 - RNA, 21 nt, Homo sapiens
uuugugauucccuccagugaa

SEQ ID NO: 1645106 - RNA, 22 nt, Homo sapiens
uuugugcagagauaaagaccuu

SEQ ID NO: 1645107 - RNA, 14 nt, Homo sapiens
uuugugugcgucac

SEQ ID NO: 1645108 - RNA, 18 nt, Homo sapiens
uuuguuauuuuuccccaa

SEQ ID NO: 1645109 - RNA, 14 nt, Homo sapiens
uuuguugagccuaa

SEQ ID NO: 1645110 - RNA, 17 nt, Homo sapiens
uuuguugagccuaauau

SEQ ID NO: 1645111 - RNA, 22 nt, Homo sapiens
uuuuaaaaaaaacuauuuaaca

SEQ ID NO: 1645112 - RNA, 19 nt, Homo sapiens
uuuuaaaaaaauuccaagu

SEQ ID NO: 1645113 - RNA, 14 nt, Homo sapiens
uuuuaaacauucuu

SEQ ID NO: 1645114 - RNA, 14 nt, Homo sapiens
uuuuaaacuuugau

SEQ ID NO: 1645115 - RNA, 17 nt, Homo sapiens
uuuuaacaacuaugauu

SEQ ID NO: 1645116 - RNA, 17 nt, Homo sapiens
uuuuaacaguguucuca

SEQ ID NO: 1645117 - RNA, 15 nt, Homo sapiens
uuuuaguggaagcuu

SEQ ID NO: 1645118 - RNA, 22 nt, Homo sapiens
uuuuauagcugcuuggauucuc

SEQ ID NO: 1645119 - RNA, 12 nt, Homo sapiens
uuuuauauccac

SEQ ID NO: 1645120 - RNA, 12 nt, Homo sapiens
uuuucacuugua

SEQ ID NO: 1645121 - RNA, 15 nt, Homo sapiens
uuuuccuguucuuaa

SEQ ID NO: 1645122 - RNA, 16 nt, Homo sapiens
uuuucuaaacuuuaau

SEQ ID NO: 1645123 - RNA, 18 nt, Homo sapiens
uuuucuguugaagauuaa

SEQ ID NO: 1645124 - RNA, 16 nt, Homo sapiens
uuuugaaauccaaaga

SEQ ID NO: 1645125 - RNA, 18 nt, Homo sapiens
uuuugcacacuuugccau

SEQ ID NO: 1645126 - RNA, 13 nt, Homo sapiens
uuuugcuguagaa

SEQ ID NO: 1645127 - RNA, 20 nt, Homo sapiens
uuuugggagaauuagcauau

SEQ ID NO: 1645128 - RNA, 13 nt, Homo sapiens
uuuugugauugcc

SEQ ID NO: 1645129 - RNA, 19 nt, Homo sapiens
uuuuuaaaauguuggugca

SEQ ID NO: 1645130 - RNA, 11 nt, Homo sapiens
uuuuugcagcu

SEQ ID NO: 1645131 - RNA, 18 nt, Homo sapiens
uuuuuguucaaagccagc

SEQ ID NO: 1645132 - RNA, 13 nt, Homo sapiens
uuuuuuucuccuc

SEQ ID NO: 1645133 - RNA, 20 nt, Homo sapiens
acuaacgaaauaucaaaguc

SEQ ID NO: 1645134 - RNA, 17 nt, Homo sapiens
acuaaggugugcucuga

SEQ ID NO: 1645135 - RNA, 16 nt, Homo sapiens
acuacaggcaccugcc

SEQ ID NO: 1645136 - RNA, 17 nt, Homo sapiens
acuacaggcaccugcca

SEQ ID NO: 1645137 - RNA, 19 nt, Homo sapiens
acuacaggcgccugccaca

SEQ ID NO: 1645138 - RNA, 19 nt, Homo sapiens
acuaccagugggcauguau

SEQ ID NO: 1645139 - RNA, 23 nt, Homo sapiens
acuauggacggugcuccaggcag

SEQ ID NO: 1645140 - RNA, 15 nt, Homo sapiens
acuauguaacaugua

SEQ ID NO: 1645141 - RNA, 14 nt, Homo sapiens
acuauuuauauaca

SEQ ID NO: 1645142 - RNA, 19 nt, Homo sapiens
acucaagcuucuucacuca

SEQ ID NO: 1645143 - RNA, 23 nt, Homo sapiens
acucacugcugcaaauacuguau

SEQ ID NO: 1645144 - RNA, 17 nt, Homo sapiens
acucacuuagcaugaau

SEQ ID NO: 1645145 - RNA, 15 nt, Homo sapiens
acucacuuguucuca

SEQ ID NO: 1645146 - RNA, 16 nt, Homo sapiens
acucagaagacacuga

SEQ ID NO: 1645147 - RNA, 17 nt, Homo sapiens
acucagaagacacugau

SEQ ID NO: 1645148 - RNA, 22 nt, Homo sapiens
acucagccuggcugauuaucac

SEQ ID NO: 1645149 - RNA, 16 nt, Homo sapiens
acucagggaaagcauu

SEQ ID NO: 1645150 - RNA, 23 nt, Homo sapiens
acucauagcgggggccuaaaaaa

SEQ ID NO: 1645151 - RNA, 19 nt, Homo sapiens
acucaucccuaaugcugca

SEQ ID NO: 1645152 - RNA, 14 nt, Homo sapiens
acucauuaauucaa

SEQ ID NO: 1645153 - RNA, 13 nt, Homo sapiens
acuccaccucaaa

SEQ ID NO: 1645154 - RNA, 14 nt, Homo sapiens
acuccaucauucau

SEQ ID NO: 1645155 - RNA, 13 nt, Homo sapiens
acucccacuuccc

SEQ ID NO: 1645156 - RNA, 13 nt, Homo sapiens
acuccccucaaaa

SEQ ID NO: 1645157 - RNA, 13 nt, Homo sapiens
acuccuaaaucaa

SEQ ID NO: 1645158 - RNA, 20 nt, Homo sapiens
acuccuaggcaggacaugcu

SEQ ID NO: 1645159 - RNA, 15 nt, Homo sapiens
acucgagaacuuuca

SEQ ID NO: 1645160 - RNA, 22 nt, Homo sapiens
acucuccagaaagcucaucuca

SEQ ID NO: 1645161 - RNA, 18 nt, Homo sapiens
acucugugcccaugggca

SEQ ID NO: 1645162 - RNA, 14 nt, Homo sapiens
acucuugaacacaa

SEQ ID NO: 1645163 - RNA, 13 nt, Homo sapiens
acucuuuguucaa

SEQ ID NO: 1645164 - RNA, 12 nt, Homo sapiens
acugaaauggac

SEQ ID NO: 1645165 - RNA, 13 nt, Homo sapiens
acugaacuuugcu

SEQ ID NO: 1645166 - RNA, 18 nt, Homo sapiens
acugaauguaaacaaagg

SEQ ID NO: 1645167 - RNA, 18 nt, Homo sapiens
acugaauuuugucuuuau

SEQ ID NO: 1645168 - RNA, 14 nt, Homo sapiens
acugagaugcaaau

SEQ ID NO: 1645169 - RNA, 12 nt, Homo sapiens
acugagcuguca

SEQ ID NO: 1645170 - RNA, 14 nt, Homo sapiens
acugauaaccacuc

SEQ ID NO: 1645171 - RNA, 21 nt, Homo sapiens
acugauucauacauuaucuca

SEQ ID NO: 1645172 - RNA, 14 nt, Homo sapiens
acugcaacuuguga

SEQ ID NO: 1645173 - RNA, 19 nt, Homo sapiens
acugcacccccuccugcug

SEQ ID NO: 1645174 - RNA, 20 nt, Homo sapiens
acugcaccgggccacagaga

SEQ ID NO: 1645175 - RNA, 18 nt, Homo sapiens
acugcaggcaucacagcu

SEQ ID NO: 1645176 - RNA, 12 nt, Homo sapiens
acugccaaagaa

SEQ ID NO: 1645177 - RNA, 18 nt, Homo sapiens
acuggaacucagugugac

SEQ ID NO: 1645178 - RNA, 23 nt, Homo sapiens
acuggaagguggggacagggaug

SEQ ID NO: 1645179 - RNA, 23 nt, Homo sapiens
acuggaccaaaaaaauaaagcau

SEQ ID NO: 1645180 - RNA, 15 nt, Homo sapiens
acuggagaguggcaa

SEQ ID NO: 1645181 - RNA, 18 nt, Homo sapiens
acuggaggggucauccuu

SEQ ID NO: 1645182 - RNA, 14 nt, Homo sapiens
acuggcugcaaagg

SEQ ID NO: 1645183 - RNA, 19 nt, Homo sapiens
acugggccuccaaccaugu

SEQ ID NO: 1645184 - RNA, 19 nt, Homo sapiens
acugguaaaauacauauaa

SEQ ID NO: 1645185 - RNA, 16 nt, Homo sapiens
acuguaacgauugaca

SEQ ID NO: 1645186 - RNA, 16 nt, Homo sapiens
acuguccuacccaccc

SEQ ID NO: 1645187 - RNA, 16 nt, Homo sapiens
acugucuaugaacuug

SEQ ID NO: 1645188 - RNA, 22 nt, Homo sapiens
acugucuugaagacaauggcuu

SEQ ID NO: 1645189 - RNA, 18 nt, Homo sapiens
acugugccaugugccagg

SEQ ID NO: 1645190 - RNA, 21 nt, Homo sapiens
acugugcccaaguggguccaa

SEQ ID NO: 1645191 - RNA, 21 nt, Homo sapiens
acugugcuggagccacuaacu

SEQ ID NO: 1645192 - RNA, 11 nt, Homo sapiens
acuguggcuuc

SEQ ID NO: 1645193 - RNA, 12 nt, Homo sapiens
acugugggcucc

SEQ ID NO: 1645194 - RNA, 21 nt, Homo sapiens
acugugucaggaaacauauuu

SEQ ID NO: 1645195 - RNA, 20 nt, Homo sapiens
acugugucagggaacauauu

SEQ ID NO: 1645196 - RNA, 20 nt, Homo sapiens
acuguguuaguaaacugugc

SEQ ID NO: 1645197 - RNA, 10 nt, Homo sapiens
acuguugcac

SEQ ID NO: 1645198 - RNA, 19 nt, Homo sapiens
acuguuggcaaggugacau

SEQ ID NO: 1645199 - RNA, 14 nt, Homo sapiens
acuguuucucucac

SEQ ID NO: 1645200 - RNA, 14 nt, Homo sapiens
acuguuugucuucu

SEQ ID NO: 1645201 - RNA, 16 nt, Homo sapiens
acuguuugucuucucc

SEQ ID NO: 1645202 - RNA, 14 nt, Homo sapiens
acuuaagugugcaa

SEQ ID NO: 1645203 - RNA, 16 nt, Homo sapiens
acuuaagugugcaaaa

SEQ ID NO: 1645204 - RNA, 21 nt, Homo sapiens
acuuauuauuccagaucugca

SEQ ID NO: 1645205 - RNA, 20 nt, Homo sapiens
acuucaugcuggccugugug

SEQ ID NO: 1645206 - RNA, 15 nt, Homo sapiens
acuucuauccuguua

SEQ ID NO: 1645207 - RNA, 18 nt, Homo sapiens
acuucuauccuguuaaca

SEQ ID NO: 1645208 - RNA, 17 nt, Homo sapiens
acuugauucugcagucg

SEQ ID NO: 1645209 - RNA, 20 nt, Homo sapiens
acuugccuaucugacuucau

SEQ ID NO: 1645210 - RNA, 17 nt, Homo sapiens
acuugcuggcugugaaa

SEQ ID NO: 1645211 - RNA, 17 nt, Homo sapiens
acuuggaauucucucac

SEQ ID NO: 1645212 - RNA, 17 nt, Homo sapiens
acuuggcuacacaggga

SEQ ID NO: 1645213 - RNA, 18 nt, Homo sapiens
acuuguauagcaugaaau

SEQ ID NO: 1645214 - RNA, 15 nt, Homo sapiens
acuuguccaauuaau

SEQ ID NO: 1645215 - RNA, 16 nt, Homo sapiens
acuuguggacacagcu

SEQ ID NO: 1645216 - RNA, 14 nt, Homo sapiens
acuuguucauucug

SEQ ID NO: 1645217 - RNA, 19 nt, Homo sapiens
acuuuacugagacaaugua

SEQ ID NO: 1645218 - RNA, 14 nt, Homo sapiens
acuuugggacucac

SEQ ID NO: 1645219 - RNA, 13 nt, Homo sapiens
acuuuuauaagaa

SEQ ID NO: 1645220 - RNA, 16 nt, Homo sapiens
acuuuuguaaacagcu

SEQ ID NO: 1645221 - RNA, 17 nt, Homo sapiens
acuuuuuaaaacacaac

SEQ ID NO: 1645222 - RNA, 20 nt, Homo sapiens
agaaaauaacaauaaaagac

SEQ ID NO: 1645223 - RNA, 17 nt, Homo sapiens
agaaaauaauugcaaau

SEQ ID NO: 1645224 - RNA, 13 nt, Homo sapiens
agaaaaugaauuu

SEQ ID NO: 1645225 - RNA, 13 nt, Homo sapiens
agaaacacugggc

SEQ ID NO: 1645226 - RNA, 19 nt, Homo sapiens
agaaacugccaaacuauuu

SEQ ID NO: 1645227 - RNA, 14 nt, Homo sapiens
agaaagcucaucuc

SEQ ID NO: 1645228 - RNA, 15 nt, Homo sapiens
agaaagcucaucuca

SEQ ID NO: 1645229 - RNA, 22 nt, Homo sapiens
agaaaguacuucuccacccugc

SEQ ID NO: 1645230 - RNA, 13 nt, Homo sapiens
agaaagugaucca

SEQ ID NO: 1645231 - RNA, 15 nt, Homo sapiens
agaaagugauccaua

SEQ ID NO: 1645232 - RNA, 21 nt, Homo sapiens
agaaauauucuacacauaucu

SEQ ID NO: 1645233 - RNA, 21 nt, Homo sapiens
agaaaucauuuggguuaauau

SEQ ID NO: 1645234 - RNA, 15 nt, Homo sapiens
agaaauccaauugga

SEQ ID NO: 1645235 - RNA, 22 nt, Homo sapiens
agaaauuccaggaaaaucugca

SEQ ID NO: 1645236 - RNA, 23 nt, Homo sapiens
agaaauuccaggaaaaucugcac

SEQ ID NO: 1645237 - RNA, 18 nt, Homo sapiens
agaacggggcucuucuca

SEQ ID NO: 1645238 - RNA, 17 nt, Homo sapiens
agaacugggcaacuauu

SEQ ID NO: 1645239 - RNA, 24 nt, Homo sapiens
agaagaaaauuauggcauauauua

SEQ ID NO: 1645240 - RNA, 24 nt, Homo sapiens
agaaguaagcagaguucuuugcaa

SEQ ID NO: 1645241 - RNA, 13 nt, Homo sapiens
agaaguacuuugu

SEQ ID NO: 1645242 - RNA, 16 nt, Homo sapiens
agaaguaggcucugau

SEQ ID NO: 1645243 - RNA, 12 nt, Homo sapiens
agccaaagccaa

SEQ ID NO: 1645244 - RNA, 18 nt, Homo sapiens
agccaauaacacacagcu

SEQ ID NO: 1645245 - RNA, 20 nt, Homo sapiens
agccacaggccugagauuuc

SEQ ID NO: 1645246 - RNA, 14 nt, Homo sapiens
agccagggucucac

SEQ ID NO: 1645247 - RNA, 22 nt, Homo sapiens
agccagggugagagucuggguc

SEQ ID NO: 1645248 - RNA, 14 nt, Homo sapiens
agccaggugcugug

SEQ ID NO: 1645249 - RNA, 17 nt, Homo sapiens
agccaggugcugugaca

SEQ ID NO: 1645250 - RNA, 13 nt, Homo sapiens
agccauaugaaug

SEQ ID NO: 1645251 - RNA, 19 nt, Homo sapiens
agccaugggagacacugau

SEQ ID NO: 1645252 - RNA, 15 nt, Homo sapiens
agccauuuugugaau

SEQ ID NO: 1645253 - RNA, 21 nt, Homo sapiens
agcccaggagcuccccucccc

SEQ ID NO: 1645254 - RNA, 22 nt, Homo sapiens
agccccauucugccugcccagg

SEQ ID NO: 1645255 - RNA, 16 nt, Homo sapiens
agcccucacccugggg

SEQ ID NO: 1645256 - RNA, 13 nt, Homo sapiens
agcccucaucccg

SEQ ID NO: 1645257 - RNA, 16 nt, Homo sapiens
agcccuuagcagggaa

SEQ ID NO: 1645258 - RNA, 16 nt, Homo sapiens
agccggacacuucuca

SEQ ID NO: 1645259 - RNA, 19 nt, Homo sapiens
agccggacacuucucagga

SEQ ID NO: 1645260 - RNA, 16 nt, Homo sapiens
agccuaggugacagag

SEQ ID NO: 1645261 - RNA, 21 nt, Homo sapiens
agccuauguaugccauggagg

SEQ ID NO: 1645262 - RNA, 13 nt, Homo sapiens
agccucagucucc

SEQ ID NO: 1645263 - RNA, 23 nt, Homo sapiens
agccugacaacagccugagaaau

SEQ ID NO: 1645264 - RNA, 17 nt, Homo sapiens
agccugccccugugauc

SEQ ID NO: 1645265 - RNA, 13 nt, Homo sapiens
agccugucaagag

SEQ ID NO: 1645266 - RNA, 19 nt, Homo sapiens
agccuuagaagucacacag

SEQ ID NO: 1645267 - RNA, 11 nt, Homo sapiens
agccuuccagg

SEQ ID NO: 1645268 - RNA, 14 nt, Homo sapiens
agccuucugaccug

SEQ ID NO: 1645269 - RNA, 13 nt, Homo sapiens
agcgucaguauuu

SEQ ID NO: 1645270 - RNA, 13 nt, Homo sapiens
agcgugagccacu

SEQ ID NO: 1645271 - RNA, 15 nt, Homo sapiens
agcguggacaggugu

SEQ ID NO: 1645272 - RNA, 22 nt, Homo sapiens
agcuaagugaauuuuugcacau

SEQ ID NO: 1645273 - RNA, 14 nt, Homo sapiens
agcuagaaccugga

SEQ ID NO: 1645274 - RNA, 10 nt, Homo sapiens
agcuauuuaa

SEQ ID NO: 1645275 - RNA, 19 nt, Homo sapiens
agcuauuuugguuuagugc

SEQ ID NO: 1645276 - RNA, 22 nt, Homo sapiens
agcucaaagcguggacaggugu

SEQ ID NO: 1645277 - RNA, 12 nt, Homo sapiens
agcucaccagcc

SEQ ID NO: 1645278 - RNA, 16 nt, Homo sapiens
agcucaccucucccuu

SEQ ID NO: 1645279 - RNA, 20 nt, Homo sapiens
agcuccaaaacuggaccacc

SEQ ID NO: 1645280 - RNA, 18 nt, Homo sapiens
agcuccgcuuucuaccca

SEQ ID NO: 1645281 - RNA, 17 nt, Homo sapiens
agcucucaguugcagcc

SEQ ID NO: 1645282 - RNA, 22 nt, Homo sapiens
agcucugacccacagccuccaa

SEQ ID NO: 1645283 - RNA, 14 nt, Homo sapiens
agcucuucugacuu

SEQ ID NO: 1645284 - RNA, 18 nt, Homo sapiens
agcuggaaaaaguguccu

SEQ ID NO: 1645285 - RNA, 23 nt, Homo sapiens
agcuggaggacuagaaccuggag

SEQ ID NO: 1645286 - RNA, 22 nt, Homo sapiens
agcuggcgucaugcaaagucau

SEQ ID NO: 1645287 - RNA, 18 nt, Homo sapiens
agcugggauuacaggcuc

SEQ ID NO: 1645288 - RNA, 20 nt, Homo sapiens
agcugggcuuuccucuguga

SEQ ID NO: 1645289 - RNA, 15 nt, Homo sapiens
agcuggugagugaug

SEQ ID NO: 1645290 - RNA, 16 nt, Homo sapiens
agcugucccacaucac

SEQ ID NO: 1645291 - RNA, 23 nt, Homo sapiens
agcuguuuccucacguccaucac

SEQ ID NO: 1645292 - RNA, 15 nt, Homo sapiens
agcuucugcugggcu

SEQ ID NO: 1645293 - RNA, 14 nt, Homo sapiens
agcuuggaaacugg

SEQ ID NO: 1645294 - RNA, 22 nt, Homo sapiens
agcuuggaaacuggaugagguc

SEQ ID NO: 1645295 - RNA, 17 nt, Homo sapiens
agcuuucaaaagcaaga

SEQ ID NO: 1645296 - RNA, 23 nt, Homo sapiens
agcuuucagacuccagcugugaa

SEQ ID NO: 1645297 - RNA, 21 nt, Homo sapiens
agcuuugagcuuaagaauuuu

SEQ ID NO: 1645298 - RNA, 18 nt, Homo sapiens
aggaaaaugggaauuuau

SEQ ID NO: 1645299 - RNA, 14 nt, Homo sapiens
aggaaacacuucua

SEQ ID NO: 1645300 - RNA, 12 nt, Homo sapiens
aggaaacauauu

SEQ ID NO: 1645301 - RNA, 22 nt, Homo sapiens
aggaaaccacagcugcuggaga

SEQ ID NO: 1645302 - RNA, 16 nt, Homo sapiens
aggaaauaugagucau

SEQ ID NO: 1645303 - RNA, 14 nt, Homo sapiens
aggaaccucagggc

SEQ ID NO: 1645304 - RNA, 19 nt, Homo sapiens
aggaagaccccagcacaga

SEQ ID NO: 1645305 - RNA, 14 nt, Homo sapiens
aggaagcuccaguu

SEQ ID NO: 1645306 - RNA, 17 nt, Homo sapiens
aggaagcuuucugucuc

SEQ ID NO: 1645307 - RNA, 12 nt, Homo sapiens
aggaaggagcug

SEQ ID NO: 1645308 - RNA, 14 nt, Homo sapiens
aggaaggagcugcc

SEQ ID NO: 1645309 - RNA, 17 nt, Homo sapiens
aggaaggggaaacacag

SEQ ID NO: 1645310 - RNA, 12 nt, Homo sapiens
aggaagucugug

SEQ ID NO: 1645311 - RNA, 14 nt, Homo sapiens
aggaauaccugucc

SEQ ID NO: 1645312 - RNA, 13 nt, Homo sapiens
aggaauauuugca

SEQ ID NO: 1645313 - RNA, 21 nt, Homo sapiens
aggaauauuugcaagacauag

SEQ ID NO: 1645314 - RNA, 16 nt, Homo sapiens
aggaaucauucuguaa

SEQ ID NO: 1645315 - RNA, 16 nt, Homo sapiens
aggaauccacucccag

SEQ ID NO: 1645316 - RNA, 17 nt, Homo sapiens
aggacacccaguggggu

SEQ ID NO: 1645317 - RNA, 20 nt, Homo sapiens
aggaccaggcaaugugacuu

SEQ ID NO: 1645318 - RNA, 19 nt, Homo sapiens
aggaccccuucccaaauag

SEQ ID NO: 1645319 - RNA, 23 nt, Homo sapiens
aggacucucuuaguucuuaccuu

SEQ ID NO: 1645320 - RNA, 12 nt, Homo sapiens
aggacuguagaa

SEQ ID NO: 1645321 - RNA, 19 nt, Homo sapiens
aggagaugacuacauuuag

SEQ ID NO: 1645322 - RNA, 13 nt, Homo sapiens
aggagcagugcag

SEQ ID NO: 1645323 - RNA, 15 nt, Homo sapiens
aggagccggacacuu

SEQ ID NO: 1645324 - RNA, 13 nt, Homo sapiens
aggagcuguuacu

SEQ ID NO: 1645325 - RNA, 16 nt, Homo sapiens
aggagggcaguggugg

SEQ ID NO: 1645326 - RNA, 18 nt, Homo sapiens
aggagguucuaauauuca

SEQ ID NO: 1645327 - RNA, 22 nt, Homo sapiens
aggaguacaccccaacagcacc

SEQ ID NO: 1645328 - RNA, 13 nt, Homo sapiens
aggaguacaggug

SEQ ID NO: 1645329 - RNA, 20 nt, Homo sapiens
aggauacugaggcacacaga

SEQ ID NO: 1645330 - RNA, 17 nt, Homo sapiens
aggauguucugggacac

SEQ ID NO: 1645331 - RNA, 15 nt, Homo sapiens
aggcaaagaacaauu

SEQ ID NO: 1645332 - RNA, 12 nt, Homo sapiens
aggcaagcacuu

SEQ ID NO: 1645333 - RNA, 16 nt, Homo sapiens
aggcaaggggcauuuc

SEQ ID NO: 1645334 - RNA, 15 nt, Homo sapiens
aggcaggaacauaca

SEQ ID NO: 1645335 - RNA, 20 nt, Homo sapiens
aggcaggagaaucacucgaa

SEQ ID NO: 1645336 - RNA, 20 nt, Homo sapiens
aggcagugggucccacuucc

SEQ ID NO: 1645337 - RNA, 20 nt, Homo sapiens
aggcauacugccuuguuuaa

SEQ ID NO: 1645338 - RNA, 20 nt, Homo sapiens
aggccaagcccaauacagcc

SEQ ID NO: 1645339 - RNA, 15 nt, Homo sapiens
aggccagaugcacau

SEQ ID NO: 1645340 - RNA, 15 nt, Homo sapiens
aggccaucaucagug

SEQ ID NO: 1645341 - RNA, 12 nt, Homo sapiens
aggccugagauu

SEQ ID NO: 1645342 - RNA, 16 nt, Homo sapiens
aggccugagauuucau

SEQ ID NO: 1645343 - RNA, 16 nt, Homo sapiens
aggccugccuucucag

SEQ ID NO: 1645344 - RNA, 22 nt, Homo sapiens
aggccugccuucucagggacuu

SEQ ID NO: 1645345 - RNA, 16 nt, Homo sapiens
aggccuggcacagugu

SEQ ID NO: 1645346 - RNA, 23 nt, Homo sapiens
aggccuggccagaugcaccagcc

SEQ ID NO: 1645347 - RNA, 16 nt, Homo sapiens
aggccuggccaugugg

SEQ ID NO: 1645348 - RNA, 15 nt, Homo sapiens
aggcgccugccacaa

SEQ ID NO: 1645349 - RNA, 15 nt, Homo sapiens
aggcggaucuuugga

SEQ ID NO: 1645350 - RNA, 13 nt, Homo sapiens
aggcuacacugac

SEQ ID NO: 1645351 - RNA, 20 nt, Homo sapiens
aggcuauauuucugggauga

SEQ ID NO: 1645352 - RNA, 20 nt, Homo sapiens
aggcuccaggagcagccaca

SEQ ID NO: 1645353 - RNA, 15 nt, Homo sapiens
aggcucgagcaugcc

SEQ ID NO: 1645354 - RNA, 19 nt, Homo sapiens
aguuuacauuuuguauauu

SEQ ID NO: 1645355 - RNA, 19 nt, Homo sapiens
aguuuauacuucucuauua

SEQ ID NO: 1645356 - RNA, 15 nt, Homo sapiens
aguuucuuagcuuuu

SEQ ID NO: 1645357 - RNA, 12 nt, Homo sapiens
aguuucuuccau

SEQ ID NO: 1645358 - RNA, 14 nt, Homo sapiens
aguuucuuccauuc

SEQ ID NO: 1645359 - RNA, 14 nt, Homo sapiens
aguuuuaacugugg

SEQ ID NO: 1645360 - RNA, 18 nt, Homo sapiens
aguuuuauuuuuguagag

SEQ ID NO: 1645361 - RNA, 19 nt, Homo sapiens
aguuuuggaaacguauuca

SEQ ID NO: 1645362 - RNA, 14 nt, Homo sapiens
auaaaaaacauaau

SEQ ID NO: 1645363 - RNA, 20 nt, Homo sapiens
auaaaaccaagccucuggaa

SEQ ID NO: 1645364 - RNA, 21 nt, Homo sapiens
auaaaauuaaagcugaaaacu

SEQ ID NO: 1645365 - RNA, 17 nt, Homo sapiens
auaaacguccuacugua

SEQ ID NO: 1645366 - RNA, 15 nt, Homo sapiens
auaaacuuugaauuu

SEQ ID NO: 1645367 - RNA, 19 nt, Homo sapiens
auaaagguuagauaagucc

SEQ ID NO: 1645368 - RNA, 16 nt, Homo sapiens
auaaauguaccagaga

SEQ ID NO: 1645369 - RNA, 14 nt, Homo sapiens
auaaccuagccuua

SEQ ID NO: 1645370 - RNA, 21 nt, Homo sapiens
auaacuuuuuuuuaaguuaca

SEQ ID NO: 1645371 - RNA, 20 nt, Homo sapiens
auaagaagcuuucaguauua

SEQ ID NO: 1645372 - RNA, 14 nt, Homo sapiens
auaagacuacugaa

SEQ ID NO: 1645373 - RNA, 21 nt, Homo sapiens
auaagagggcacacacugugu

SEQ ID NO: 1645374 - RNA, 20 nt, Homo sapiens
auaaguccuuguguagcaaa

SEQ ID NO: 1645375 - RNA, 13 nt, Homo sapiens
auaauaacuggga

SEQ ID NO: 1645376 - RNA, 15 nt, Homo sapiens
auaaugcaccacuuu

SEQ ID NO: 1645377 - RNA, 17 nt, Homo sapiens
auaaugcaccacuuuua

SEQ ID NO: 1645378 - RNA, 16 nt, Homo sapiens
auaauuuuccugugac

SEQ ID NO: 1645379 - RNA, 17 nt, Homo sapiens
auaauuuuccugugaca

SEQ ID NO: 1645380 - RNA, 10 nt, Homo sapiens
auacacugua

SEQ ID NO: 1645381 - RNA, 13 nt, Homo sapiens
auacagaauuuua

SEQ ID NO: 1645382 - RNA, 17 nt, Homo sapiens
auacaguuugucacaug

SEQ ID NO: 1645383 - RNA, 13 nt, Homo sapiens
auacaucccucag

SEQ ID NO: 1645384 - RNA, 13 nt, Homo sapiens
auacaugcauaua

SEQ ID NO: 1645385 - RNA, 19 nt, Homo sapiens
auacauuaucucacuugug

SEQ ID NO: 1645386 - RNA, 22 nt, Homo sapiens
auacauuguacuuauacaccuu

SEQ ID NO: 1645387 - RNA, 14 nt, Homo sapiens
auacauugucucua

SEQ ID NO: 1645388 - RNA, 15 nt, Homo sapiens
auacccaaauccucu

SEQ ID NO: 1645389 - RNA, 21 nt, Homo sapiens
auaccuuacugagagcauguu

SEQ ID NO: 1645390 - RNA, 12 nt, Homo sapiens
auacguguauga

SEQ ID NO: 1645391 - RNA, 16 nt, Homo sapiens
auacucugaauuugga

SEQ ID NO: 1645392 - RNA, 20 nt, Homo sapiens
auacugaggaaugucuuuca

SEQ ID NO: 1645393 - RNA, 21 nt, Homo sapiens
auacugaggaaugucuuucag

SEQ ID NO: 1645394 - RNA, 15 nt, Homo sapiens
auacuggacucagga

SEQ ID NO: 1645395 - RNA, 19 nt, Homo sapiens
auacuucucuauuaucuca

SEQ ID NO: 1645396 - RNA, 15 nt, Homo sapiens
auagaacacaguuug

SEQ ID NO: 1645397 - RNA, 22 nt, Homo sapiens
auagacuguaacuuccaaauaa

SEQ ID NO: 1645398 - RNA, 15 nt, Homo sapiens
auagagccacguaug

SEQ ID NO: 1645399 - RNA, 19 nt, Homo sapiens
auagauaggucagugcaaa

SEQ ID NO: 1645400 - RNA, 20 nt, Homo sapiens
auagauccuaagccauaaaa

SEQ ID NO: 1645401 - RNA, 18 nt, Homo sapiens
auagcagcacagcugcca

SEQ ID NO: 1645402 - RNA, 17 nt, Homo sapiens
auagccuaggugacaga

SEQ ID NO: 1645403 - RNA, 16 nt, Homo sapiens
auaggacccauauucc

SEQ ID NO: 1645404 - RNA, 16 nt, Homo sapiens
auaguaccucugcuau

SEQ ID NO: 1645405 - RNA, 17 nt, Homo sapiens
auaguaccucugcuauu

SEQ ID NO: 1645406 - RNA, 18 nt, Homo sapiens
auaguaugaaaauggaaa

SEQ ID NO: 1645407 - RNA, 14 nt, Homo sapiens
auaguauugugcau

SEQ ID NO: 1645408 - RNA, 22 nt, Homo sapiens
auaguauugugcauagagccac

SEQ ID NO: 1645409 - RNA, 19 nt, Homo sapiens
auauaaaaauaaagcacuu

SEQ ID NO: 1645410 - RNA, 15 nt, Homo sapiens
auauaaacacuauau

SEQ ID NO: 1645411 - RNA, 15 nt, Homo sapiens
auauaaagauuaaca

SEQ ID NO: 1645412 - RNA, 21 nt, Homo sapiens
auauaaaugugauugcagcuu

SEQ ID NO: 1645413 - RNA, 16 nt, Homo sapiens
auauacaagugauaau

SEQ ID NO: 1645414 - RNA, 18 nt, Homo sapiens
auauacuauuuauauaca

SEQ ID NO: 1645415 - RNA, 15 nt, Homo sapiens
auauagaacagugcu

SEQ ID NO: 1645416 - RNA, 22 nt, Homo sapiens
auauagcucuacacaacaugua

SEQ ID NO: 1645417 - RNA, 20 nt, Homo sapiens
auauauauuuuugugcacau

SEQ ID NO: 1645418 - RNA, 22 nt, Homo sapiens
auauccaacaugugcucaggga

SEQ ID NO: 1645419 - RNA, 15 nt, Homo sapiens
auauccuauggucuu

SEQ ID NO: 1645420 - RNA, 17 nt, Homo sapiens
auaucugacuucuagga

SEQ ID NO: 1645421 - RNA, 16 nt, Homo sapiens
auaucuuguaugguuu

SEQ ID NO: 1645422 - RNA, 20 nt, Homo sapiens
auaugauauauaaaugugau

SEQ ID NO: 1645423 - RNA, 14 nt, Homo sapiens
auaugauucccuuu

SEQ ID NO: 1645424 - RNA, 16 nt, Homo sapiens
auauggcagugucuuu

SEQ ID NO: 1645425 - RNA, 21 nt, Homo sapiens
auauguguaaauguuaugacu

SEQ ID NO: 1645426 - RNA, 21 nt, Homo sapiens
auauguucacaccuagcguca

SEQ ID NO: 1645427 - RNA, 21 nt, Homo sapiens
auauguuuggaauauuccacu

SEQ ID NO: 1645428 - RNA, 13 nt, Homo sapiens
auauuaugccuga

SEQ ID NO: 1645429 - RNA, 17 nt, Homo sapiens
auauuguaaauacugga

SEQ ID NO: 1645430 - RNA, 19 nt, Homo sapiens
auauuucuggguucucaau

SEQ ID NO: 1645431 - RNA, 16 nt, Homo sapiens
auauuucuucaaguga

SEQ ID NO: 1645432 - RNA, 19 nt, Homo sapiens
auauuugugugaggacuuc

SEQ ID NO: 1645433 - RNA, 19 nt, Homo sapiens
auauuuuaaaaucugucac

SEQ ID NO: 1645434 - RNA, 12 nt, Homo sapiens
auauuuugccac

SEQ ID NO: 1645435 - RNA, 16 nt, Homo sapiens
auauuuuucuaaagaa

SEQ ID NO: 1645436 - RNA, 21 nt, Homo sapiens
aucaaaaagguuucugcacau

SEQ ID NO: 1645437 - RNA, 12 nt, Homo sapiens
aucaaacaugaa

SEQ ID NO: 1645438 - RNA, 17 nt, Homo sapiens
aucaaaggacaccauuu

SEQ ID NO: 1645439 - RNA, 18 nt, Homo sapiens
aucaagaaauacuuucga

SEQ ID NO: 1645440 - RNA, 12 nt, Homo sapiens
aucaagucagca

SEQ ID NO: 1645441 - RNA, 19 nt, Homo sapiens
aucaauaaaggacaggcug

SEQ ID NO: 1645442 - RNA, 21 nt, Homo sapiens
aucaauucuauuacgugcaau

SEQ ID NO: 1645443 - RNA, 22 nt, Homo sapiens
aucaauucuauuacgugcaaua

SEQ ID NO: 1645444 - RNA, 15 nt, Homo sapiens
aucacaaggucaaga

SEQ ID NO: 1645445 - RNA, 23 nt, Homo sapiens
aucacggcucacugcagccucaa

SEQ ID NO: 1645446 - RNA, 19 nt, Homo sapiens
aucagaacaucaauuccag

SEQ ID NO: 1645447 - RNA, 13 nt, Homo sapiens
aucagaauaucag

SEQ ID NO: 1645448 - RNA, 21 nt, Homo sapiens
aucagcuggcgucaugcaaag

SEQ ID NO: 1645449 - RNA, 17 nt, Homo sapiens
aucaggagaaaaagccu

SEQ ID NO: 1645450 - RNA, 22 nt, Homo sapiens
aucaguuuuuuuuuauacacug

SEQ ID NO: 1645451 - RNA, 16 nt, Homo sapiens
aucaucaucauucuca

SEQ ID NO: 1645452 - RNA, 13 nt, Homo sapiens
aucaucauucuca

SEQ ID NO: 1645453 - RNA, 23 nt, Homo sapiens
aucaucccucccugccuaaggaa

SEQ ID NO: 1645454 - RNA, 18 nt, Homo sapiens
aucaucuccugccuuccu

SEQ ID NO: 1645455 - RNA, 13 nt, Homo sapiens
aucauguagaaua

SEQ ID NO: 1645456 - RNA, 22 nt, Homo sapiens
aucauucauccaggacugagau

SEQ ID NO: 1645457 - RNA, 16 nt, Homo sapiens
aucauucucauucuca

SEQ ID NO: 1645458 - RNA, 17 nt, Homo sapiens
aucauuuccugggagaa

SEQ ID NO: 1645459 - RNA, 22 nt, Homo sapiens
aucauuucuauuucuccuccau

SEQ ID NO: 1645460 - RNA, 22 nt, Homo sapiens
aucauuugugaagaauuauuca

SEQ ID NO: 1645461 - RNA, 22 nt, Homo sapiens
auccaaauaaaaauaacaucau

SEQ ID NO: 1645462 - RNA, 17 nt, Homo sapiens
auccaaaugcugugcaa

SEQ ID NO: 1645463 - RNA, 17 nt, Homo sapiens
auccaacaugugcucag

SEQ ID NO: 1645464 - RNA, 15 nt, Homo sapiens
auguaaaaauacacu

SEQ ID NO: 1645465 - RNA, 16 nt, Homo sapiens
auguaaacugugcacc

SEQ ID NO: 1645466 - RNA, 17 nt, Homo sapiens
auguagaaagugaucca

SEQ ID NO: 1645467 - RNA, 21 nt, Homo sapiens
auguagaauauauuuccuuau

SEQ ID NO: 1645468 - RNA, 16 nt, Homo sapiens
auguauaucuucuaca

SEQ ID NO: 1645469 - RNA, 14 nt, Homo sapiens
auguauaugcacuu

SEQ ID NO: 1645470 - RNA, 24 nt, Homo sapiens
auguauguacagcuggugcuuagu

SEQ ID NO: 1645471 - RNA, 20 nt, Homo sapiens
augucccugaagucuugcau

SEQ ID NO: 1645472 - RNA, 15 nt, Homo sapiens
auguccuauguauau

SEQ ID NO: 1645473 - RNA, 21 nt, Homo sapiens
augucguuugaaucacaguau

SEQ ID NO: 1645474 - RNA, 18 nt, Homo sapiens
augucucugagcauuaga

SEQ ID NO: 1645475 - RNA, 21 nt, Homo sapiens
augucucugugagacucgaga

SEQ ID NO: 1645476 - RNA, 18 nt, Homo sapiens
augucuguaccuugauac

SEQ ID NO: 1645477 - RNA, 21 nt, Homo sapiens
augucuuuauuaaauguagaa

SEQ ID NO: 1645478 - RNA, 22 nt, Homo sapiens
augucuuugcugcagaacugaa

SEQ ID NO: 1645479 - RNA, 11 nt, Homo sapiens
augugaugaau

SEQ ID NO: 1645480 - RNA, 14 nt, Homo sapiens
augugauugcagcu

SEQ ID NO: 1645481 - RNA, 11 nt, Homo sapiens
augugcaauaa

SEQ ID NO: 1645482 - RNA, 11 nt, Homo sapiens
augugcaauau

SEQ ID NO: 1645483 - RNA, 21 nt, Homo sapiens
augugcucagggaauaaucca

SEQ ID NO: 1645484 - RNA, 18 nt, Homo sapiens
auguggguugugauauug

SEQ ID NO: 1645485 - RNA, 15 nt, Homo sapiens
augugguugcauccu

SEQ ID NO: 1645486 - RNA, 14 nt, Homo sapiens
auguguaaauguua

SEQ ID NO: 1645487 - RNA, 12 nt, Homo sapiens
augugugauuca

SEQ ID NO: 1645488 - RNA, 18 nt, Homo sapiens
auguguguugauacuguu

SEQ ID NO: 1645489 - RNA, 22 nt, Homo sapiens
auguguguugauacuguugcac

SEQ ID NO: 1645490 - RNA, 13 nt, Homo sapiens
auguguuccaagg

SEQ ID NO: 1645491 - RNA, 18 nt, Homo sapiens
auguuaaggaaacucuua

SEQ ID NO: 1645492 - RNA, 18 nt, Homo sapiens
auguuacuuaaacaucau

SEQ ID NO: 1645493 - RNA, 16 nt, Homo sapiens
auguucacuuccaaga

SEQ ID NO: 1645494 - RNA, 17 nt, Homo sapiens
auguucucugaggacac

SEQ ID NO: 1645495 - RNA, 22 nt, Homo sapiens
auguuguacaggcuggucucaa

SEQ ID NO: 1645496 - RNA, 17 nt, Homo sapiens
auguuugggucuuuuau

SEQ ID NO: 1645497 - RNA, 19 nt, Homo sapiens
auuaaaauugccauuuuau

SEQ ID NO: 1645498 - RNA, 20 nt, Homo sapiens
auuaaagaugaccuacagug

SEQ ID NO: 1645499 - RNA, 19 nt, Homo sapiens
auuaaauucucucuaacau

SEQ ID NO: 1645500 - RNA, 15 nt, Homo sapiens
auuaauucaaugaaa

SEQ ID NO: 1645501 - RNA, 22 nt, Homo sapiens
auuaauuugugaauuugcaaca

SEQ ID NO: 1645502 - RNA, 19 nt, Homo sapiens
auuaauuuuccaaugcaca

SEQ ID NO: 1645503 - RNA, 17 nt, Homo sapiens
auuacaggcgugagcca

SEQ ID NO: 1645504 - RNA, 16 nt, Homo sapiens
auuacaggcuccugcc

SEQ ID NO: 1645505 - RNA, 19 nt, Homo sapiens
auuaccaccaccugcucac

SEQ ID NO: 1645506 - RNA, 14 nt, Homo sapiens
auuacuucugcuac

SEQ ID NO: 1645507 - RNA, 14 nt, Homo sapiens
auuagaaauaucuu

SEQ ID NO: 1645508 - RNA, 17 nt, Homo sapiens
auuagaauuucauauga

SEQ ID NO: 1645509 - RNA, 14 nt, Homo sapiens
auuauaacuguaaa

SEQ ID NO: 1645510 - RNA, 13 nt, Homo sapiens
auuaucaacagca

SEQ ID NO: 1645511 - RNA, 16 nt, Homo sapiens
auuaucaacagcauuu

SEQ ID NO: 1645512 - RNA, 18 nt, Homo sapiens
auuaucucacuugugcca

SEQ ID NO: 1645513 - RNA, 13 nt, Homo sapiens
auuaugaagucau

SEQ ID NO: 1645514 - RNA, 14 nt, Homo sapiens
auuauggcauauau

SEQ ID NO: 1645515 - RNA, 22 nt, Homo sapiens
auuaugugaaaugcuuaugcuu

SEQ ID NO: 1645516 - RNA, 11 nt, Homo sapiens
auucaaaguga

SEQ ID NO: 1645517 - RNA, 18 nt, Homo sapiens
auucaagaaagauaucua

SEQ ID NO: 1645518 - RNA, 14 nt, Homo sapiens
auucacacaugcca

SEQ ID NO: 1645519 - RNA, 21 nt, Homo sapiens
auucacacaugccacuaugag

SEQ ID NO: 1645520 - RNA, 19 nt, Homo sapiens
auucacuuuuauuuagcac

SEQ ID NO: 1645521 - RNA, 14 nt, Homo sapiens
auucaggacuugaa

SEQ ID NO: 1645522 - RNA, 17 nt, Homo sapiens
auucaggcaacgcacaa

SEQ ID NO: 1645523 - RNA, 13 nt, Homo sapiens
auucauacauuau

SEQ ID NO: 1645524 - RNA, 15 nt, Homo sapiens
auucauacauuaucu

SEQ ID NO: 1645525 - RNA, 15 nt, Homo sapiens
auucaucaaauggaa

SEQ ID NO: 1645526 - RNA, 17 nt, Homo sapiens
auucaucucaaggaaua

SEQ ID NO: 1645527 - RNA, 19 nt, Homo sapiens
auucaucucucuuuaauau

SEQ ID NO: 1645528 - RNA, 14 nt, Homo sapiens
auucaucuuuucau

SEQ ID NO: 1645529 - RNA, 23 nt, Homo sapiens
auucauucuuuuugaaaugucaa

SEQ ID NO: 1645530 - RNA, 17 nt, Homo sapiens
auucauuuucugccuau

SEQ ID NO: 1645531 - RNA, 23 nt, Homo sapiens
auuccacuuguucauucugugac

SEQ ID NO: 1645532 - RNA, 22 nt, Homo sapiens
auuccauucuggaagugacuuu

SEQ ID NO: 1645533 - RNA, 22 nt, Homo sapiens
auuccccugcccaccuccuucc

SEQ ID NO: 1645534 - RNA, 23 nt, Homo sapiens
auucccuucaucuggaaccauca

SEQ ID NO: 1645535 - RNA, 15 nt, Homo sapiens
auuccuaaugcauua

SEQ ID NO: 1645536 - RNA, 15 nt, Homo sapiens
auuccucacuuugaa

SEQ ID NO: 1645537 - RNA, 21 nt, Homo sapiens
auuccugccccagauggcuuu

SEQ ID NO: 1645538 - RNA, 18 nt, Homo sapiens
auucuaacuuuuuugcua

SEQ ID NO: 1645539 - RNA, 11 nt, Homo sapiens
auucuacacau

SEQ ID NO: 1645540 - RNA, 23 nt, Homo sapiens
auucucaccuaaacccucuguga

SEQ ID NO: 1645541 - RNA, 13 nt, Homo sapiens
auucucauucuca

SEQ ID NO: 1645542 - RNA, 22 nt, Homo sapiens
auucuccaccugccagggacag

SEQ ID NO: 1645543 - RNA, 21 nt, Homo sapiens
auucucucaggcuugcugcca

SEQ ID NO: 1645544 - RNA, 19 nt, Homo sapiens
auucucucuaacauaacaa

SEQ ID NO: 1645545 - RNA, 18 nt, Homo sapiens
auucuguuggccagugug

SEQ ID NO: 1645546 - RNA, 20 nt, Homo sapiens
auucuuacaaacaugugguu

SEQ ID NO: 1645547 - RNA, 12 nt, Homo sapiens
auucuuccucaa

SEQ ID NO: 1645548 - RNA, 17 nt, Homo sapiens
auugaaacccuccaaau

SEQ ID NO: 1645549 - RNA, 21 nt, Homo sapiens
auugaaucccuuaaacucagg

SEQ ID NO: 1645550 - RNA, 23 nt, Homo sapiens
auugcgagagauguguguugaua

SEQ ID NO: 1645551 - RNA, 12 nt, Homo sapiens
auugcuugcaca

SEQ ID NO: 1645552 - RNA, 23 nt, Homo sapiens
auugguuaacaauaaagugacaa

SEQ ID NO: 1645553 - RNA, 22 nt, Homo sapiens
auuguucauugcuaguagauag

SEQ ID NO: 1645554 - RNA, 18 nt, Homo sapiens
auuguucuuguaagcuuu

SEQ ID NO: 1645555 - RNA, 15 nt, Homo sapiens
auuuaagccuuauaa

SEQ ID NO: 1645556 - RNA, 22 nt, Homo sapiens
auuuaauuggauauugaugaaa

SEQ ID NO: 1645557 - RNA, 18 nt, Homo sapiens
auuuaauuuguaugcuaa

SEQ ID NO: 1645558 - RNA, 24 nt, Homo sapiens
auuuacaggucuucucuccaacuc

SEQ ID NO: 1645559 - RNA, 11 nt, Homo sapiens
auuuacugugg

SEQ ID NO: 1645560 - RNA, 19 nt, Homo sapiens
auuuacuguggcuucuuaa

SEQ ID NO: 1645561 - RNA, 23 nt, Homo sapiens
auuuacuguggcuucuuaaucuu

SEQ ID NO: 1645562 - RNA, 18 nt, Homo sapiens
auuuagacccugcauuua

SEQ ID NO: 1645563 - RNA, 14 nt, Homo sapiens
auuuagagucaauu

SEQ ID NO: 1645564 - RNA, 15 nt, Homo sapiens
auuuagcaccaggga

SEQ ID NO: 1645565 - RNA, 20 nt, Homo sapiens
auuuagguuuucucuguuuu

SEQ ID NO: 1645566 - RNA, 13 nt, Homo sapiens
auuuaguccugua

SEQ ID NO: 1645567 - RNA, 16 nt, Homo sapiens
auuuaucauuuaguua

SEQ ID NO: 1645568 - RNA, 20 nt, Homo sapiens
auuuauggaaaauacucuga

SEQ ID NO: 1645569 - RNA, 13 nt, Homo sapiens
auuuaugucucag

SEQ ID NO: 1645570 - RNA, 22 nt, Homo sapiens
auuuaugucucagaccacuauu

SEQ ID NO: 1645571 - RNA, 13 nt, Homo sapiens
auuuauucugcuc

SEQ ID NO: 1645572 - RNA, 14 nt, Homo sapiens
auuuauuuauucau

SEQ ID NO: 1645573 - RNA, 17 nt, Homo sapiens
auuuauuuuuuuacuuc

SEQ ID NO: 1645574 - RNA, 14 nt, Homo sapiens
uccaggacugagau

SEQ ID NO: 1645575 - RNA, 14 nt, Homo sapiens
uccagggacagcaa

SEQ ID NO: 1645576 - RNA, 16 nt, Homo sapiens
uccagggcaaggccau

SEQ ID NO: 1645577 - RNA, 12 nt, Homo sapiens
uccaggggccac

SEQ ID NO: 1645578 - RNA, 23 nt, Homo sapiens
uccaggggugggacacccuguga

SEQ ID NO: 1645579 - RNA, 15 nt, Homo sapiens
uccaguccaaggaaa

SEQ ID NO: 1645580 - RNA, 21 nt, Homo sapiens
uccaguggaacagucuuccca

SEQ ID NO: 1645581 - RNA, 18 nt, Homo sapiens
uccaucacguuagcuguc

SEQ ID NO: 1645582 - RNA, 16 nt, Homo sapiens
uccauccuugagucaa

SEQ ID NO: 1645583 - RNA, 21 nt, Homo sapiens
uccauccuugagucaaaaaau

SEQ ID NO: 1645584 - RNA, 15 nt, Homo sapiens
uccaucugugccaua

SEQ ID NO: 1645585 - RNA, 16 nt, Homo sapiens
uccaucugugccauac

SEQ ID NO: 1645586 - RNA, 18 nt, Homo sapiens
uccaucugugccauacuu

SEQ ID NO: 1645587 - RNA, 18 nt, Homo sapiens
uccauggcccugccaugc

SEQ ID NO: 1645588 - RNA, 17 nt, Homo sapiens
ucccaaaagcccauuca

SEQ ID NO: 1645589 - RNA, 20 nt, Homo sapiens
ucccaaagugcugggauuac

SEQ ID NO: 1645590 - RNA, 18 nt, Homo sapiens
ucccaaauagcagcacag

SEQ ID NO: 1645591 - RNA, 22 nt, Homo sapiens
ucccaagagcuuccagagcucu

SEQ ID NO: 1645592 - RNA, 21 nt, Homo sapiens
ucccacagcgcuggccgggac

SEQ ID NO: 1645593 - RNA, 15 nt, Homo sapiens
ucccacugaaaugga

SEQ ID NO: 1645594 - RNA, 16 nt, Homo sapiens
ucccacugaaauggac

SEQ ID NO: 1645595 - RNA, 19 nt, Homo sapiens
ucccacugcaacuugugaa

SEQ ID NO: 1645596 - RNA, 18 nt, Homo sapiens
ucccagagaccuucugau

SEQ ID NO: 1645597 - RNA, 14 nt, Homo sapiens
ucccagcaguggac

SEQ ID NO: 1645598 - RNA, 15 nt, Homo sapiens
ucccagcuacuuggg

SEQ ID NO: 1645599 - RNA, 19 nt, Homo sapiens
ucccagcuauuccuacucu

SEQ ID NO: 1645600 - RNA, 11 nt, Homo sapiens
ucccagugucu

SEQ ID NO: 1645601 - RNA, 15 nt, Homo sapiens
ucccaguuccuuuag

SEQ ID NO: 1645602 - RNA, 16 nt, Homo sapiens
ucccaugacccaggcu

SEQ ID NO: 1645603 - RNA, 13 nt, Homo sapiens
ucccccagcacuu

SEQ ID NO: 1645604 - RNA, 21 nt, Homo sapiens
uccccggagccggcacugcau

SEQ ID NO: 1645605 - RNA, 16 nt, Homo sapiens
uccccuccaaccuggg

SEQ ID NO: 1645606 - RNA, 15 nt, Homo sapiens
uccccuuccacugag

SEQ ID NO: 1645607 - RNA, 20 nt, Homo sapiens
uccccuucucucaucucuua

SEQ ID NO: 1645608 - RNA, 15 nt, Homo sapiens
ucccucaucuguccc

SEQ ID NO: 1645609 - RNA, 19 nt, Homo sapiens
ucccugaagucuugcauug

SEQ ID NO: 1645610 - RNA, 20 nt, Homo sapiens
ucccugaagucuugcauuga

SEQ ID NO: 1645611 - RNA, 19 nt, Homo sapiens
ucccugauaacaaccugga

SEQ ID NO: 1645612 - RNA, 15 nt, Homo sapiens
ucccugccaauggac

SEQ ID NO: 1645613 - RNA, 13 nt, Homo sapiens
ucccugccuccac

SEQ ID NO: 1645614 - RNA, 16 nt, Homo sapiens
ucccugguucugauga

SEQ ID NO: 1645615 - RNA, 14 nt, Homo sapiens
aucaucauucucau

SEQ ID NO: 1645616 - RNA, 22 nt, Homo sapiens
aucauuccccugcccaccuccu

SEQ ID NO: 1645617 - RNA, 20 nt, Homo sapiens
aucauuuacuuuuaaacuuu

SEQ ID NO: 1645618 - RNA, 22 nt, Homo sapiens
auccaauaauuuuccugugaca

SEQ ID NO: 1645619 - RNA, 14 nt, Homo sapiens
auccacccaccuca

SEQ ID NO: 1645620 - RNA, 13 nt, Homo sapiens
auccacuccuucc

SEQ ID NO: 1645621 - RNA, 14 nt, Homo sapiens
auccacuccuuccu

SEQ ID NO: 1645622 - RNA, 20 nt, Homo sapiens
auccauucuuaaaguacuug

SEQ ID NO: 1645623 - RNA, 19 nt, Homo sapiens
aucccaacaugguccuagc

SEQ ID NO: 1645624 - RNA, 12 nt, Homo sapiens
aucccagccuug

SEQ ID NO: 1645625 - RNA, 22 nt, Homo sapiens
auccccaagccuggcaagggaa

SEQ ID NO: 1645626 - RNA, 13 nt, Homo sapiens
auccccaccuacu

SEQ ID NO: 1645627 - RNA, 17 nt, Homo sapiens
auccccaccuacuccug

SEQ ID NO: 1645628 - RNA, 17 nt, Homo sapiens
aucccgucgacguagaa

SEQ ID NO: 1645629 - RNA, 17 nt, Homo sapiens
aucccuaaugcugcaga

SEQ ID NO: 1645630 - RNA, 23 nt, Homo sapiens
aucccuacauuuuuuaauuaaag

SEQ ID NO: 1645631 - RNA, 22 nt, Homo sapiens
aucccugucuucuuuccauccc

SEQ ID NO: 1645632 - RNA, 16 nt, Homo sapiens
aucccuuuccaaaggc

SEQ ID NO: 1645633 - RNA, 23 nt, Homo sapiens
auccuaaaugaguaaacccagcu

SEQ ID NO: 1645634 - RNA, 12 nt, Homo sapiens
aaaaaagcuuuu

SEQ ID NO: 1645635 - RNA, 20 nt, Homo sapiens
aaaaaaguguccuauaauuc

SEQ ID NO: 1645636 - RNA, 17 nt, Homo sapiens
aaaaaauaacaaugaaa

SEQ ID NO: 1645637 - RNA, 12 nt, Homo sapiens
aaaaagccucca

SEQ ID NO: 1645638 - RNA, 22 nt, Homo sapiens
aaaaagccuccaguccaaggaa

SEQ ID NO: 1645639 - RNA, 20 nt, Homo sapiens
aaaaaggaaagaacugucau

SEQ ID NO: 1645640 - RNA, 17 nt, Homo sapiens
aaaaauacucacauggc

SEQ ID NO: 1645641 - RNA, 16 nt, Homo sapiens
aaaaaugcaccacuuu

SEQ ID NO: 1645642 - RNA, 16 nt, Homo sapiens
aaaacaauguuuuaaa

SEQ ID NO: 1645643 - RNA, 22 nt, Homo sapiens
aaaacagaaauuaaucuuacaa

SEQ ID NO: 1645644 - RNA, 21 nt, Homo sapiens
aaaaccagucucagauaucau

SEQ ID NO: 1645645 - RNA, 13 nt, Homo sapiens
aaaagacagugaa

SEQ ID NO: 1645646 - RNA, 13 nt, Homo sapiens
aaaagacugacca

SEQ ID NO: 1645647 - RNA, 22 nt, Homo sapiens
aaaagaugcauuaucuaugaua

SEQ ID NO: 1645648 - RNA, 20 nt, Homo sapiens
aaaagauuuuagcuacaucu

SEQ ID NO: 1645649 - RNA, 10 nt, Homo sapiens
aaaagcaaga

SEQ ID NO: 1645650 - RNA, 20 nt, Homo sapiens
aaaaggacucucaggaccaa

SEQ ID NO: 1645651 - RNA, 15 nt, Homo sapiens
aaaaguuuuguaaau

SEQ ID NO: 1645652 - RNA, 21 nt, Homo sapiens
aaaaguuuuguaaauuucucu

SEQ ID NO: 1645653 - RNA, 15 nt, Homo sapiens
aaaauaaaaaaugug

SEQ ID NO: 1645654 - RNA, 18 nt, Homo sapiens
aaaauaagaaaaauauua

SEQ ID NO: 1645655 - RNA, 19 nt, Homo sapiens
aaaauaaugcaccacuuuu

SEQ ID NO: 1645656 - RNA, 13 nt, Homo sapiens
aaaauacacuaau

SEQ ID NO: 1645657 - RNA, 18 nt, Homo sapiens
aaaauagagccugaggga

SEQ ID NO: 1645658 - RNA, 11 nt, Homo sapiens
aaaauagcuua

SEQ ID NO: 1645659 - RNA, 23 nt, Homo sapiens
aaaauauguuuggaauauuccac

SEQ ID NO: 1645660 - RNA, 22 nt, Homo sapiens
aaaauauuuuuaugugcaauaa

SEQ ID NO: 1645661 - RNA, 20 nt, Homo sapiens
aaaaucaccucccaccauaa

SEQ ID NO: 1645662 - RNA, 16 nt, Homo sapiens
aaaauccuacuuucau

SEQ ID NO: 1645663 - RNA, 19 nt, Homo sapiens
aaaaucucaauucuucccu

SEQ ID NO: 1645664 - RNA, 14 nt, Homo sapiens
aaaaucucccaaag

SEQ ID NO: 1645665 - RNA, 15 nt, Homo sapiens
aaaaucuuauaauuu

SEQ ID NO: 1645666 - RNA, 18 nt, Homo sapiens
aaaaugaaccuugcuauc

SEQ ID NO: 1645667 - RNA, 15 nt, Homo sapiens
aaaaugaauuugacu

SEQ ID NO: 1645668 - RNA, 22 nt, Homo sapiens
aaaaugauacuguguucccuca

SEQ ID NO: 1645669 - RNA, 23 nt, Homo sapiens
aaaaugauacuguguucccucau

SEQ ID NO: 1645670 - RNA, 15 nt, Homo sapiens
aaaaugccuuugaga

SEQ ID NO: 1645671 - RNA, 19 nt, Homo sapiens
aaaauggagguggaaagac

SEQ ID NO: 1645672 - RNA, 12 nt, Homo sapiens
aaaaugugacuc

SEQ ID NO: 1645673 - RNA, 13 nt, Homo sapiens
aaaaugugacuca

SEQ ID NO: 1645674 - RNA, 15 nt, Homo sapiens
aaaaugugucugcaa

SEQ ID NO: 1645675 - RNA, 15 nt, Homo sapiens
aaaauuauggcauau

SEQ ID NO: 1645676 - RNA, 18 nt, Homo sapiens
aaaauuauuugcauaaca

SEQ ID NO: 1645677 - RNA, 13 nt, Homo sapiens
aaacaaacaugac

SEQ ID NO: 1645678 - RNA, 15 nt, Homo sapiens
aaacaaauucaucaa

SEQ ID NO: 1645679 - RNA, 22 nt, Homo sapiens
aaacaauguuuuaaacauucuu

SEQ ID NO: 1645680 - RNA, 13 nt, Homo sapiens
aaacacacaugga

SEQ ID NO: 1645681 - RNA, 18 nt, Homo sapiens
aaacaccuuguacuuuau

SEQ ID NO: 1645682 - RNA, 20 nt, Homo sapiens
aaacaggcugauaccuuugu

SEQ ID NO: 1645683 - RNA, 18 nt, Homo sapiens
aaacaggugcuaauuugu

SEQ ID NO: 1645684 - RNA, 15 nt, Homo sapiens
aaacaucauuggaua

SEQ ID NO: 1645685 - RNA, 20 nt, Homo sapiens
aaacaugguggguccauggg

SEQ ID NO: 1645686 - RNA, 23 nt, Homo sapiens
aaacaugugguuaaugccaugga

SEQ ID NO: 1645687 - RNA, 22 nt, Homo sapiens
aaacauguuucugccuucuuua

SEQ ID NO: 1645688 - RNA, 23 nt, Homo sapiens
auguaaaaucuucagcuggugga

SEQ ID NO: 1645689 - RNA, 15 nt, Homo sapiens
auguaaacugugcac

SEQ ID NO: 1645690 - RNA, 15 nt, Homo sapiens
auguauaugcaauau

SEQ ID NO: 1645691 - RNA, 18 nt, Homo sapiens
augucagguacauaacau

SEQ ID NO: 1645692 - RNA, 22 nt, Homo sapiens
auguccaagaagcccaggaaag

SEQ ID NO: 1645693 - RNA, 20 nt, Homo sapiens
augucucuuuaaugucacag

SEQ ID NO: 1645694 - RNA, 13 nt, Homo sapiens
augucuuaagauu

SEQ ID NO: 1645695 - RNA, 19 nt, Homo sapiens
augucuugaaaacauguua

SEQ ID NO: 1645696 - RNA, 19 nt, Homo sapiens
augugacucaagacuucca

SEQ ID NO: 1645697 - RNA, 21 nt, Homo sapiens
augugagggcaccaccaagaa

SEQ ID NO: 1645698 - RNA, 17 nt, Homo sapiens
augugaucaucuuugcu

SEQ ID NO: 1645699 - RNA, 17 nt, Homo sapiens
augugcacuaccauagc

SEQ ID NO: 1645700 - RNA, 14 nt, Homo sapiens
augugcucagggaa

SEQ ID NO: 1645701 - RNA, 15 nt, Homo sapiens
auguggauacaguca

SEQ ID NO: 1645702 - RNA, 19 nt, Homo sapiens
augugggucaaggaauuaa

SEQ ID NO: 1645703 - RNA, 15 nt, Homo sapiens
auguggguugugaua

SEQ ID NO: 1645704 - RNA, 17 nt, Homo sapiens
augugucccagccacag

SEQ ID NO: 1645705 - RNA, 14 nt, Homo sapiens
augugucccaguga

SEQ ID NO: 1645706 - RNA, 15 nt, Homo sapiens
augugucccagugaa

SEQ ID NO: 1645707 - RNA, 13 nt, Homo sapiens
augugugauucac

SEQ ID NO: 1645708 - RNA, 22 nt, Homo sapiens
augugugugugcuuauguauga

SEQ ID NO: 1645709 - RNA, 20 nt, Homo sapiens
auguuagagaauuuccuuac

SEQ ID NO: 1645710 - RNA, 19 nt, Homo sapiens
auguuaugacuccuugaua

SEQ ID NO: 1645711 - RNA, 14 nt, Homo sapiens
auguuaugcaaaaa

SEQ ID NO: 1645712 - RNA, 22 nt, Homo sapiens
auguuauuuauagcuguagguu

SEQ ID NO: 1645713 - RNA, 22 nt, Homo sapiens
auguucacuuauugacuauuau

SEQ ID NO: 1645714 - RNA, 22 nt, Homo sapiens
auguucacuuuugacaaaggca

SEQ ID NO: 1645715 - RNA, 18 nt, Homo sapiens
auguucagacauuuaugu

SEQ ID NO: 1645716 - RNA, 17 nt, Homo sapiens
auguuccgagaagaaca

SEQ ID NO: 1645717 - RNA, 17 nt, Homo sapiens
auguucuaauacuuugu

SEQ ID NO: 1645718 - RNA, 16 nt, Homo sapiens
auguucugggacacag

SEQ ID NO: 1645719 - RNA, 16 nt, Homo sapiens
auguugcccagugugu

SEQ ID NO: 1645720 - RNA, 22 nt, Homo sapiens
auguugcccuggcaccuguggc

SEQ ID NO: 1645721 - RNA, 19 nt, Homo sapiens
auuuucuagauaccacuua

SEQ ID NO: 1645722 - RNA, 21 nt, Homo sapiens
auuuucuuguaugauagugac

SEQ ID NO: 1645723 - RNA, 16 nt, Homo sapiens
auuuuuagacagaguc

SEQ ID NO: 1645724 - RNA, 22 nt, Homo sapiens
auuuuuauagauuugaccuaca

SEQ ID NO: 1645725 - RNA, 18 nt, Homo sapiens
auuuuucagauauaaaag

SEQ ID NO: 1645726 - RNA, 18 nt, Homo sapiens
auuuuugcacauucuaca

SEQ ID NO: 1645727 - RNA, 14 nt, Homo sapiens
auuuuuugaacuuu

SEQ ID NO: 1645728 - RNA, 16 nt, Homo sapiens
auuuuuuuaaauuuca

SEQ ID NO: 1645729 - RNA, 22 nt, Homo sapiens
caaaaaaucucaauucuucccu

SEQ ID NO: 1645730 - RNA, 21 nt, Homo sapiens
caaaaacagcuggacuuauuu

SEQ ID NO: 1645731 - RNA, 13 nt, Homo sapiens
caaaaagauguau

SEQ ID NO: 1645732 - RNA, 18 nt, Homo sapiens
caaaaauacucacauggc

SEQ ID NO: 1645733 - RNA, 22 nt, Homo sapiens
caaaaccaaauauuccagagac

SEQ ID NO: 1645734 - RNA, 17 nt, Homo sapiens
caaaacccaacaugacu

SEQ ID NO: 1645735 - RNA, 19 nt, Homo sapiens
caaaacuggaccaccagag

SEQ ID NO: 1645736 - RNA, 23 nt, Homo sapiens
caaaacugguuuaggauuacuua

SEQ ID NO: 1645737 - RNA, 15 nt, Homo sapiens
caaaagcucagccag

SEQ ID NO: 1645738 - RNA, 21 nt, Homo sapiens
caaaauaaauaaucuacugua

SEQ ID NO: 1645739 - RNA, 18 nt, Homo sapiens
caaaauaaugcaccacuu

SEQ ID NO: 1645740 - RNA, 17 nt, Homo sapiens
caaaaucaagcaagccu

SEQ ID NO: 1645741 - RNA, 21 nt, Homo sapiens
caaaaugaaccuugcuaucaa

SEQ ID NO: 1645742 - RNA, 16 nt, Homo sapiens
caaaauguucuauuua

SEQ ID NO: 1645743 - RNA, 14 nt, Homo sapiens
caaaauuaauauga

SEQ ID NO: 1645744 - RNA, 15 nt, Homo sapiens
caaaauuaauaugau

SEQ ID NO: 1645745 - RNA, 14 nt, Homo sapiens
caaacaaaauggac

SEQ ID NO: 1645746 - RNA, 14 nt, Homo sapiens
caaacaaaauuucu

SEQ ID NO: 1645747 - RNA, 20 nt, Homo sapiens
caaacaauaguaauucucag

SEQ ID NO: 1645748 - RNA, 12 nt, Homo sapiens
caaacagaacua

SEQ ID NO: 1645749 - RNA, 14 nt, Homo sapiens
caaacuucaagggu

SEQ ID NO: 1645750 - RNA, 22 nt, Homo sapiens
caaagaaaaugaaaugcauauu

SEQ ID NO: 1645751 - RNA, 16 nt, Homo sapiens
caaagaccaugaggag

SEQ ID NO: 1645752 - RNA, 13 nt, Homo sapiens
caaagaggugacu

SEQ ID NO: 1645753 - RNA, 22 nt, Homo sapiens
caaagcccuuguccccaugaaa

SEQ ID NO: 1645754 - RNA, 17 nt, Homo sapiens
caaagcuuucauguaaa

SEQ ID NO: 1645755 - RNA, 20 nt, Homo sapiens
caaaggcugagaacacugug

SEQ ID NO: 1645756 - RNA, 16 nt, Homo sapiens
caaagucaugcaaagg

SEQ ID NO: 1645757 - RNA, 19 nt, Homo sapiens
caaagugcugggauuacag

SEQ ID NO: 1645758 - RNA, 22 nt, Homo sapiens
caaagugcugggauuacagaca

SEQ ID NO: 1645759 - RNA, 11 nt, Homo sapiens
caaaguuggcg

SEQ ID NO: 1645760 - RNA, 13 nt, Homo sapiens
caaauacuaucca

SEQ ID NO: 1645761 - RNA, 14 nt, Homo sapiens
caaauagcagcaca

SEQ ID NO: 1645762 - RNA, 13 nt, Homo sapiens
caaaucaaagcag

SEQ ID NO: 1645763 - RNA, 14 nt, Homo sapiens
caaauccucuccag

SEQ ID NO: 1645764 - RNA, 15 nt, Homo sapiens
caaaucugacauauu

SEQ ID NO: 1645765 - RNA, 15 nt, Homo sapiens
caaaugcccaaggga

SEQ ID NO: 1645766 - RNA, 16 nt, Homo sapiens
caaaugcccaagggaa

SEQ ID NO: 1645767 - RNA, 23 nt, Homo sapiens
caaaugcccuuacacuuacuguu

SEQ ID NO: 1645768 - RNA, 18 nt, Homo sapiens
caaaugggaaaaccagac

SEQ ID NO: 1645769 - RNA, 19 nt, Homo sapiens
caaauguggcuguauccac

SEQ ID NO: 1645770 - RNA, 11 nt, Homo sapiens
caaauguucuc

SEQ ID NO: 1645771 - RNA, 20 nt, Homo sapiens
caaauuacuccaagguuuau

SEQ ID NO: 1645772 - RNA, 15 nt, Homo sapiens
caacaaagucaccca

SEQ ID NO: 1645773 - RNA, 13 nt, Homo sapiens
caacaauuuaccu

SEQ ID NO: 1645774 - RNA, 11 nt, Homo sapiens
caacagcauuu

SEQ ID NO: 1645775 - RNA, 14 nt, Homo sapiens
caacagccugagaa

SEQ ID NO: 1645776 - RNA, 12 nt, Homo sapiens
caacaugacugu

SEQ ID NO: 1645777 - RNA, 13 nt, Homo sapiens
caacaugacuguu

SEQ ID NO: 1645778 - RNA, 18 nt, Homo sapiens
caacaugccagccacugu

SEQ ID NO: 1645779 - RNA, 21 nt, Homo sapiens
caacauggugaaacuccaucu

SEQ ID NO: 1645780 - RNA, 15 nt, Homo sapiens
caacauuacagggaa

SEQ ID NO: 1645781 - RNA, 20 nt, Homo sapiens
caacccucucaggugaccaa

SEQ ID NO: 1645782 - RNA, 20 nt, Homo sapiens
caaccucgcuggacucucag

SEQ ID NO: 1645783 - RNA, 14 nt, Homo sapiens
caaccugaagacac

SEQ ID NO: 1645784 - RNA, 20 nt, Homo sapiens
caacuagggagugagugcaa

SEQ ID NO: 1645785 - RNA, 19 nt, Homo sapiens
caacucuguacaaagcccu

SEQ ID NO: 1645786 - RNA, 12 nt, Homo sapiens
caagaacagaaa

SEQ ID NO: 1645787 - RNA, 12 nt, Homo sapiens
caagaacuugga

SEQ ID NO: 1645788 - RNA, 15 nt, Homo sapiens
caagacccucucagg

SEQ ID NO: 1645789 - RNA, 16 nt, Homo sapiens
caagaccucugugcac

SEQ ID NO: 1645790 - RNA, 14 nt, Homo sapiens
caagagucugauga

SEQ ID NO: 1645791 - RNA, 22 nt, Homo sapiens
caagagugagacuccaccucaa

SEQ ID NO: 1645792 - RNA, 14 nt, Homo sapiens
caagaucugaauuu

SEQ ID NO: 1645793 - RNA, 20 nt, Homo sapiens
caagauuguuuucagauaua

SEQ ID NO: 1645794 - RNA, 13 nt, Homo sapiens
caagcagccaagg

SEQ ID NO: 1645795 - RNA, 15 nt, Homo sapiens
uccuaccacuuugaa

SEQ ID NO: 1645796 - RNA, 20 nt, Homo sapiens
uccuagacucacuuguucuc

SEQ ID NO: 1645797 - RNA, 18 nt, Homo sapiens
uccuagcugugugaauac

SEQ ID NO: 1645798 - RNA, 21 nt, Homo sapiens
uccuauuuccccaaagacuua

SEQ ID NO: 1645799 - RNA, 14 nt, Homo sapiens
uccucaauccagcu

SEQ ID NO: 1645800 - RNA, 21 nt, Homo sapiens
uccucacguccaucacuggcu

SEQ ID NO: 1645801 - RNA, 22 nt, Homo sapiens
uccucauuuuugaauacaggca

SEQ ID NO: 1645802 - RNA, 18 nt, Homo sapiens
uccucuaugaacuaugga

SEQ ID NO: 1645803 - RNA, 19 nt, Homo sapiens
uccucuccccagcaaguga

SEQ ID NO: 1645804 - RNA, 15 nt, Homo sapiens
uccucucugcccuaa

SEQ ID NO: 1645805 - RNA, 21 nt, Homo sapiens
uccucugagcuguuaucuugu

SEQ ID NO: 1645806 - RNA, 22 nt, Homo sapiens
uccucugcaguguggcaagcaa

SEQ ID NO: 1645807 - RNA, 13 nt, Homo sapiens
uccucuuccugaa

SEQ ID NO: 1645808 - RNA, 20 nt, Homo sapiens
uccugaguagcugggauuac

SEQ ID NO: 1645809 - RNA, 17 nt, Homo sapiens
uccugcuccacaguguu

SEQ ID NO: 1645810 - RNA, 16 nt, Homo sapiens
uccuggggaacauaga

SEQ ID NO: 1645811 - RNA, 21 nt, Homo sapiens
uccuggggaggauacugaggc

SEQ ID NO: 1645812 - RNA, 22 nt, Homo sapiens
uccuguaaaagauacugaggaa

SEQ ID NO: 1645813 - RNA, 17 nt, Homo sapiens
uccuguacuguauggaa

SEQ ID NO: 1645814 - RNA, 19 nt, Homo sapiens
uccugucccaccaugcagu

SEQ ID NO: 1645815 - RNA, 20 nt, Homo sapiens
uccugugucuugcaauggca

SEQ ID NO: 1645816 - RNA, 21 nt, Homo sapiens
uccuuaacacugagcugucau

SEQ ID NO: 1645817 - RNA, 22 nt, Homo sapiens
uccuuaccagcagagcaccuua

SEQ ID NO: 1645818 - RNA, 16 nt, Homo sapiens
uccuuagaaguggaag

SEQ ID NO: 1645819 - RNA, 16 nt, Homo sapiens
uccuuauucagaauuu

SEQ ID NO: 1645820 - RNA, 14 nt, Homo sapiens
uccuucaccaccuc

SEQ ID NO: 1645821 - RNA, 18 nt, Homo sapiens
uccuucaugaucaucaca

SEQ ID NO: 1645822 - RNA, 15 nt, Homo sapiens
uccuuccaccucagu

SEQ ID NO: 1645823 - RNA, 13 nt, Homo sapiens
uccuucuuugaua

SEQ ID NO: 1645824 - RNA, 18 nt, Homo sapiens
uccuugacaccuuacuuu

SEQ ID NO: 1645825 - RNA, 23 nt, Homo sapiens
uccuugcauguuguagcagugau

SEQ ID NO: 1645826 - RNA, 13 nt, Homo sapiens
uccuugucaauac

SEQ ID NO: 1645827 - RNA, 18 nt, Homo sapiens
uccuuucauuuacugugg

SEQ ID NO: 1645828 - RNA, 17 nt, Homo sapiens
uccuuugguccuucaaa

SEQ ID NO: 1645829 - RNA, 17 nt, Homo sapiens
ucgaaaagaagguauuu

SEQ ID NO: 1645830 - RNA, 15 nt, Homo sapiens
ucgaacaauucauau

SEQ ID NO: 1645831 - RNA, 13 nt, Homo sapiens
ucgcaagagccau

SEQ ID NO: 1645832 - RNA, 16 nt, Homo sapiens
ucgcacacacagugau

SEQ ID NO: 1645833 - RNA, 20 nt, Homo sapiens
ucgcccaggcuggagugcaa

SEQ ID NO: 1645834 - RNA, 20 nt, Homo sapiens
ucgccuucuugccagccaca

SEQ ID NO: 1645835 - RNA, 15 nt, Homo sapiens
ucgggauuaguacac

SEQ ID NO: 1645836 - RNA, 19 nt, Homo sapiens
ucgugguaggacuguagaa

SEQ ID NO: 1645837 - RNA, 12 nt, Homo sapiens
ucguuacauugu

SEQ ID NO: 1645838 - RNA, 19 nt, Homo sapiens
ucguuugaaucacaguaua

SEQ ID NO: 1645839 - RNA, 12 nt, Homo sapiens
ucuaaaugccaa

SEQ ID NO: 1645840 - RNA, 15 nt, Homo sapiens
ucuaagaaagaaauu

SEQ ID NO: 1645841 - RNA, 18 nt, Homo sapiens
ucuaagauuaauagcauu

SEQ ID NO: 1645842 - RNA, 20 nt, Homo sapiens
ucuaagccuucugguuuuau

SEQ ID NO: 1645843 - RNA, 23 nt, Homo sapiens
ucuaauggcuguggcauuguuga

SEQ ID NO: 1645844 - RNA, 21 nt, Homo sapiens
ucuaauuagaucaauuacuua

SEQ ID NO: 1645845 - RNA, 22 nt, Homo sapiens
ucuaauuagaucaauuacuuau

SEQ ID NO: 1645846 - RNA, 14 nt, Homo sapiens
ugaaaaggcugccu

SEQ ID NO: 1645847 - RNA, 20 nt, Homo sapiens
ugaaaaugcuguauuaguca

SEQ ID NO: 1645848 - RNA, 15 nt, Homo sapiens
ugaaacacacaugga

SEQ ID NO: 1645849 - RNA, 17 nt, Homo sapiens
ugaaacacacauggaca

SEQ ID NO: 1645850 - RNA, 18 nt, Homo sapiens
ugaaacacacauggacau

SEQ ID NO: 1645851 - RNA, 14 nt, Homo sapiens
ugaaacagcugcca

SEQ ID NO: 1645852 - RNA, 20 nt, Homo sapiens
ugaaacuccaucucuacuga

SEQ ID NO: 1645853 - RNA, 22 nt, Homo sapiens
ugaaauggaggaucucuaaaga

SEQ ID NO: 1645854 - RNA, 11 nt, Homo sapiens
ugaacauucca

SEQ ID NO: 1645855 - RNA, 15 nt, Homo sapiens
ugaacgcuucugcuu

SEQ ID NO: 1645856 - RNA, 19 nt, Homo sapiens
ugaacguguauguaccuag

SEQ ID NO: 1645857 - RNA, 22 nt, Homo sapiens
ugaacuguggugccacaugacc

SEQ ID NO: 1645858 - RNA, 14 nt, Homo sapiens
ugaagaauuauuca

SEQ ID NO: 1645859 - RNA, 14 nt, Homo sapiens
ugaagacagaggca

SEQ ID NO: 1645860 - RNA, 15 nt, Homo sapiens
ugaagccaaagccaa

SEQ ID NO: 1645861 - RNA, 18 nt, Homo sapiens
ugaagccuauguaugcca

SEQ ID NO: 1645862 - RNA, 15 nt, Homo sapiens
ugaaggacugugaca

SEQ ID NO: 1645863 - RNA, 15 nt, Homo sapiens
ugaaggcaaugccau

SEQ ID NO: 1645864 - RNA, 21 nt, Homo sapiens
ugaaggcaaugccauccucaa

SEQ ID NO: 1645865 - RNA, 19 nt, Homo sapiens
ugaagguggaacaagcaca

SEQ ID NO: 1645866 - RNA, 14 nt, Homo sapiens
ugaaguaagcaaag

SEQ ID NO: 1645867 - RNA, 23 nt, Homo sapiens
ugaagucaguuucuaucauucug

SEQ ID NO: 1645868 - RNA, 16 nt, Homo sapiens
ugaaguugauucauau

SEQ ID NO: 1645869 - RNA, 20 nt, Homo sapiens
ugaaguugauucauauugca

SEQ ID NO: 1645870 - RNA, 16 nt, Homo sapiens
ugaaguuuaauugacu

SEQ ID NO: 1645871 - RNA, 15 nt, Homo sapiens
ugaaguuuccuuggc

SEQ ID NO: 1645872 - RNA, 16 nt, Homo sapiens
ugaauaaaccaguauc

SEQ ID NO: 1645873 - RNA, 17 nt, Homo sapiens
ugaauauaaacacuaua

SEQ ID NO: 1645874 - RNA, 14 nt, Homo sapiens
ugaaucacaguaua

SEQ ID NO: 1645875 - RNA, 22 nt, Homo sapiens
ugaaucacaguauacgcuccau

SEQ ID NO: 1645876 - RNA, 14 nt, Homo sapiens
ugaauccuacauac

SEQ ID NO: 1645877 - RNA, 17 nt, Homo sapiens
ugacaacagccugagaa

SEQ ID NO: 1645878 - RNA, 20 nt, Homo sapiens
ugacaaugguguuauuugaa

SEQ ID NO: 1645879 - RNA, 20 nt, Homo sapiens
ugacacucccuugggcuccc

SEQ ID NO: 1645880 - RNA, 14 nt, Homo sapiens
ugacagaacacugu

SEQ ID NO: 1645881 - RNA, 16 nt, Homo sapiens
ugacagacacaggccc

SEQ ID NO: 1645882 - RNA, 19 nt, Homo sapiens
ugacagaggcaaggaggca

SEQ ID NO: 1645883 - RNA, 12 nt, Homo sapiens
ugacagaucucu

SEQ ID NO: 1645884 - RNA, 14 nt, Homo sapiens
ugacaggcaaugcu

SEQ ID NO: 1645885 - RNA, 22 nt, Homo sapiens
ugacauaugcuaacccccaaau

SEQ ID NO: 1645886 - RNA, 16 nt, Homo sapiens
ugacauauuaugccug

SEQ ID NO: 1645887 - RNA, 17 nt, Homo sapiens
ugacauauuaugccuga

SEQ ID NO: 1645888 - RNA, 16 nt, Homo sapiens
ugacauucaugccugg

SEQ ID NO: 1645889 - RNA, 22 nt, Homo sapiens
ugacauuuauuuuucucaugaa

SEQ ID NO: 1645890 - RNA, 21 nt, Homo sapiens
ugacccaugcugcccugugag

SEQ ID NO: 1645891 - RNA, 14 nt, Homo sapiens
ugaccuaaauuauu

SEQ ID NO: 1645892 - RNA, 16 nt, Homo sapiens
ugaccugccaggcaca

SEQ ID NO: 1645893 - RNA, 21 nt, Homo sapiens
ugaccugccaggcacacugag

SEQ ID NO: 1645894 - RNA, 16 nt, Homo sapiens
ugaccugggaggacuc

SEQ ID NO: 1645895 - RNA, 17 nt, Homo sapiens
ugacgcagccugagaau

SEQ ID NO: 1645896 - RNA, 18 nt, Homo sapiens
ugacuguguauagugcca

SEQ ID NO: 1645897 - RNA, 18 nt, Homo sapiens
ugacuuuaaaaggauuaa

SEQ ID NO: 1645898 - RNA, 14 nt, Homo sapiens
ugagaaaaugucuu

SEQ ID NO: 1645899 - RNA, 12 nt, Homo sapiens
ugagaacacugu

SEQ ID NO: 1645900 - RNA, 14 nt, Homo sapiens
ugagaagaaugacu

SEQ ID NO: 1645901 - RNA, 18 nt, Homo sapiens
ugagaagcuucuaauuag

SEQ ID NO: 1645902 - RNA, 23 nt, Homo sapiens
ugagaagggcucagagaggacaa

SEQ ID NO: 1645903 - RNA, 15 nt, Homo sapiens
ugagaccacaggcuu

SEQ ID NO: 1645904 - RNA, 14 nt, Homo sapiens
ugagacuccaccuc

SEQ ID NO: 1645905 - RNA, 12 nt, Homo sapiens
ugagacuuucaa

SEQ ID NO: 1645906 - RNA, 17 nt, Homo sapiens
cuguuggcaaggugaca

SEQ ID NO: 1645907 - RNA, 19 nt, Homo sapiens
cuguuggccagugugacaa

SEQ ID NO: 1645908 - RNA, 22 nt, Homo sapiens
cuguuuaaaucuucugcuaaau

SEQ ID NO: 1645909 - RNA, 19 nt, Homo sapiens
cuguuuagaugaaugucag

SEQ ID NO: 1645910 - RNA, 21 nt, Homo sapiens
cuuaaacauaauaaaucacac

SEQ ID NO: 1645911 - RNA, 20 nt, Homo sapiens
cuuaaaccuuaagauacuaa

SEQ ID NO: 1645912 - RNA, 14 nt, Homo sapiens
cuuaaauccauccu

SEQ ID NO: 1645913 - RNA, 14 nt, Homo sapiens
cuuaacuauucaau

SEQ ID NO: 1645914 - RNA, 14 nt, Homo sapiens
cuuaaucuuuucac

SEQ ID NO: 1645915 - RNA, 17 nt, Homo sapiens
cuuacagucagcacaga

SEQ ID NO: 1645916 - RNA, 16 nt, Homo sapiens
cuuacaucauguguug

SEQ ID NO: 1645917 - RNA, 14 nt, Homo sapiens
cuuacauuagugau

SEQ ID NO: 1645918 - RNA, 14 nt, Homo sapiens
cuuaccacugugga

SEQ ID NO: 1645919 - RNA, 13 nt, Homo sapiens
cuuagaaaauuca

SEQ ID NO: 1645920 - RNA, 14 nt, Homo sapiens
cuuagaggcaaaga

SEQ ID NO: 1645921 - RNA, 14 nt, Homo sapiens
cuuagcaacuuggg

SEQ ID NO: 1645922 - RNA, 20 nt, Homo sapiens
cuuaguugcaugaccacaua

SEQ ID NO: 1645923 - RNA, 13 nt, Homo sapiens
cuuaguugcugua

SEQ ID NO: 1645924 - RNA, 20 nt, Homo sapiens
cuuauaaauauccugcucac

SEQ ID NO: 1645925 - RNA, 22 nt, Homo sapiens
cuuauauuuggcccaaacucau

SEQ ID NO: 1645926 - RNA, 15 nt, Homo sapiens
cuuaucaaaggacac

SEQ ID NO: 1645927 - RNA, 21 nt, Homo sapiens
cuucaagaccuucaccaaaca

SEQ ID NO: 1645928 - RNA, 23 nt, Homo sapiens
cuucacagaugugugauucacag

SEQ ID NO: 1645929 - RNA, 12 nt, Homo sapiens
cuucaccaccuc

SEQ ID NO: 1645930 - RNA, 23 nt, Homo sapiens
cuucacggaaagugccugcaaaa

SEQ ID NO: 1645931 - RNA, 16 nt, Homo sapiens
cuucagagcugacaca

SEQ ID NO: 1645932 - RNA, 20 nt, Homo sapiens
cuucaguguguugacuucua

SEQ ID NO: 1645933 - RNA, 19 nt, Homo sapiens
cuuccaaacagaacuaugg

SEQ ID NO: 1645934 - RNA, 22 nt, Homo sapiens
cuuccaagucauucucaccuaa

SEQ ID NO: 1645935 - RNA, 20 nt, Homo sapiens
cuucccuaaaaucagggaau

SEQ ID NO: 1645936 - RNA, 19 nt, Homo sapiens
cuucccugguaccuagcaa

SEQ ID NO: 1645937 - RNA, 16 nt, Homo sapiens
cuuccucagcuguaga

SEQ ID NO: 1645938 - RNA, 15 nt, Homo sapiens
cuucguguauagcug

SEQ ID NO: 1645939 - RNA, 22 nt, Homo sapiens
cuucuaggacgccacccagcaa

SEQ ID NO: 1645940 - RNA, 15 nt, Homo sapiens
cuucuaggauuuauu

SEQ ID NO: 1645941 - RNA, 14 nt, Homo sapiens
cuucucagccacaa

SEQ ID NO: 1645942 - RNA, 17 nt, Homo sapiens
cuucuccgcccauucug

SEQ ID NO: 1645943 - RNA, 21 nt, Homo sapiens
cuucucugucucaugugugcu

SEQ ID NO: 1645944 - RNA, 22 nt, Homo sapiens
cuucugaccugggcuggcacug

SEQ ID NO: 1645945 - RNA, 17 nt, Homo sapiens
cuucugacgcagccuga

SEQ ID NO: 1645946 - RNA, 18 nt, Homo sapiens
cuucuucuuagcaccaca

SEQ ID NO: 1645947 - RNA, 21 nt, Homo sapiens
cuucuuguaauauuucuucaa

SEQ ID NO: 1645948 - RNA, 18 nt, Homo sapiens
cuugaaaaaaaacagugg

SEQ ID NO: 1645949 - RNA, 16 nt, Homo sapiens
cuugaaaagaagcaag

SEQ ID NO: 1645950 - RNA, 18 nt, Homo sapiens
cuugaagacaauggcuua

SEQ ID NO: 1645951 - RNA, 19 nt, Homo sapiens
cuugaguuuuuaguggaag

SEQ ID NO: 1645952 - RNA, 22 nt, Homo sapiens
cuugaucaacaucuuuucuugc

SEQ ID NO: 1645953 - RNA, 13 nt, Homo sapiens
cuugcacaaacca

SEQ ID NO: 1645954 - RNA, 18 nt, Homo sapiens
cuugccuaucugacuuca

SEQ ID NO: 1645955 - RNA, 18 nt, Homo sapiens
cuugcucacagcugugcu

SEQ ID NO: 1645956 - RNA, 17 nt, Homo sapiens
cuugcucacaucuuggc

SEQ ID NO: 1645957 - RNA, 21 nt, Homo sapiens
cuuggaaauuggaagagcaca

SEQ ID NO: 1645958 - RNA, 19 nt, Homo sapiens
cuuggaguuugcauucuua

SEQ ID NO: 1645959 - RNA, 23 nt, Homo sapiens
cuuggauuucauuuguaacuuua

SEQ ID NO: 1645960 - RNA, 21 nt, Homo sapiens
cuugguucagguuucuuugaa

SEQ ID NO: 1645961 - RNA, 17 nt, Homo sapiens
cuuguaaaugugguaaa

SEQ ID NO: 1645962 - RNA, 18 nt, Homo sapiens
cuuguauagcaugaaaua

SEQ ID NO: 1645963 - RNA, 23 nt, Homo sapiens
cuuguauagcaugaaauaaaaua

SEQ ID NO: 1645964 - RNA, 16 nt, Homo sapiens
cuuguucucacugucu

SEQ ID NO: 1645965 - RNA, 18 nt, Homo sapiens
cuuguucucacugucugu

SEQ ID NO: 1645966 - RNA, 18 nt, Homo sapiens
cuuguuguuuaauguuua

SEQ ID NO: 1645967 - RNA, 16 nt, Homo sapiens
cuuuaaaaugcaaaau

SEQ ID NO: 1645968 - RNA, 21 nt, Homo sapiens
cuuuaacacaacucuuuguuc

SEQ ID NO: 1645969 - RNA, 15 nt, Homo sapiens
cuuuaagaacuaaaa

SEQ ID NO: 1645970 - RNA, 18 nt, Homo sapiens
cuuuaaucuguuguuuga

SEQ ID NO: 1645971 - RNA, 23 nt, Homo sapiens
gaggcuuagcuuugcucugccaa

SEQ ID NO: 1645972 - RNA, 24 nt, Homo sapiens
gagggagagaacugagcaucucca

SEQ ID NO: 1645973 - RNA, 15 nt, Homo sapiens
gagggaguggcagcu

SEQ ID NO: 1645974 - RNA, 16 nt, Homo sapiens
gagggaguggcagcua

SEQ ID NO: 1645975 - RNA, 22 nt, Homo sapiens
gagggauaguggggucagggcu

SEQ ID NO: 1645976 - RNA, 17 nt, Homo sapiens
gagggccacaugggagg

SEQ ID NO: 1645977 - RNA, 14 nt, Homo sapiens
gagggcuaauaucu

SEQ ID NO: 1645978 - RNA, 21 nt, Homo sapiens
gagggcuacaaaggaggacaa

SEQ ID NO: 1645979 - RNA, 20 nt, Homo sapiens
gagggcuagaaccuagaagg

SEQ ID NO: 1645980 - RNA, 14 nt, Homo sapiens
gagggggaagugag

SEQ ID NO: 1645981 - RNA, 15 nt, Homo sapiens
gaggugggauccucc

SEQ ID NO: 1645982 - RNA, 14 nt, Homo sapiens
gagguugcagugag

SEQ ID NO: 1645983 - RNA, 18 nt, Homo sapiens
gaguacuacaguccuccc

SEQ ID NO: 1645984 - RNA, 13 nt, Homo sapiens
gaguagcugagau

SEQ ID NO: 1645985 - RNA, 14 nt, Homo sapiens
gaguagcugggauu

SEQ ID NO: 1645986 - RNA, 19 nt, Homo sapiens
gagucagacagaugugguu

SEQ ID NO: 1645987 - RNA, 11 nt, Homo sapiens
gaguccucuau

SEQ ID NO: 1645988 - RNA, 20 nt, Homo sapiens
gagucucgcuauugucacca

SEQ ID NO: 1645989 - RNA, 20 nt, Homo sapiens
gagucuugugugcauugcug

SEQ ID NO: 1645990 - RNA, 14 nt, Homo sapiens
gagugcccccaaca

SEQ ID NO: 1645991 - RNA, 18 nt, Homo sapiens
gagugcccccaacagcac

SEQ ID NO: 1645992 - RNA, 14 nt, Homo sapiens
gagugcgugcucag

SEQ ID NO: 1645993 - RNA, 16 nt, Homo sapiens
gaguggaguugaaacu

SEQ ID NO: 1645994 - RNA, 17 nt, Homo sapiens
gaguuuagggucaagga

SEQ ID NO: 1645995 - RNA, 13 nt, Homo sapiens
gaguuuucagugg

SEQ ID NO: 1645996 - RNA, 18 nt, Homo sapiens
gaguuuuuaauggccauu

SEQ ID NO: 1645997 - RNA, 21 nt, Homo sapiens
gauaaaaaauuuauuaugucc

SEQ ID NO: 1645998 - RNA, 13 nt, Homo sapiens
gauaaacuuugaa

SEQ ID NO: 1645999 - RNA, 21 nt, Homo sapiens
gauaagagggcacacacugug

SEQ ID NO: 1646000 - RNA, 18 nt, Homo sapiens
gauacaggaaaagcugcu

SEQ ID NO: 1646001 - RNA, 19 nt, Homo sapiens
gauacaggaaaagcugcug

SEQ ID NO: 1646002 - RNA, 14 nt, Homo sapiens
gauaccacuuaaca

SEQ ID NO: 1646003 - RNA, 19 nt, Homo sapiens
gauaccacuuaacagguuu

SEQ ID NO: 1646004 - RNA, 13 nt, Homo sapiens
gauacgacaacuu

SEQ ID NO: 1646005 - RNA, 22 nt, Homo sapiens
gauacuauuaccaccaccugcu

SEQ ID NO: 1646006 - RNA, 19 nt, Homo sapiens
gauacuauuuaauuauuuc

SEQ ID NO: 1646007 - RNA, 18 nt, Homo sapiens
gauacuguguucccucau

SEQ ID NO: 1646008 - RNA, 18 nt, Homo sapiens
gauacuguugcacgugug

SEQ ID NO: 1646009 - RNA, 15 nt, Homo sapiens
gauagagaccaucuu

SEQ ID NO: 1646010 - RNA, 17 nt, Homo sapiens
gauaguggggucagggc

SEQ ID NO: 1646011 - RNA, 16 nt, Homo sapiens
gauauauaggcuauuu

SEQ ID NO: 1646012 - RNA, 17 nt, Homo sapiens
gauauauuaagugacug

SEQ ID NO: 1646013 - RNA, 20 nt, Homo sapiens
gauauauuuaagccuuauaa

SEQ ID NO: 1646014 - RNA, 12 nt, Homo sapiens
gauaucuucucc

SEQ ID NO: 1646015 - RNA, 13 nt, Homo sapiens
gauauugcagcuu

SEQ ID NO: 1646016 - RNA, 20 nt, Homo sapiens
gauauuuaaaagacaaacac

SEQ ID NO: 1646017 - RNA, 20 nt, Homo sapiens
gauauuuccuucaccaccuc

SEQ ID NO: 1646018 - RNA, 14 nt, Homo sapiens
gaucccaucuugau

SEQ ID NO: 1646019 - RNA, 14 nt, Homo sapiens
ugcuauaucaguuu

SEQ ID NO: 1646020 - RNA, 17 nt, Homo sapiens
ugcuaugucucuaucca

SEQ ID NO: 1646021 - RNA, 16 nt, Homo sapiens
ugcuauuugcuguuau

SEQ ID NO: 1646022 - RNA, 21 nt, Homo sapiens
ugcucaauaaaguacaagagc

SEQ ID NO: 1646023 - RNA, 22 nt, Homo sapiens
ugcucaauaaaguacaagagcu

SEQ ID NO: 1646024 - RNA, 14 nt, Homo sapiens
ugcuccacaguguu

SEQ ID NO: 1646025 - RNA, 15 nt, Homo sapiens
ugcucccucuguguu

SEQ ID NO: 1646026 - RNA, 19 nt, Homo sapiens
ugcucccugguucugauga

SEQ ID NO: 1646027 - RNA, 23 nt, Homo sapiens
ugcucuugaacuccugaccucag

SEQ ID NO: 1646028 - RNA, 21 nt, Homo sapiens
ugcucuuugauucaaagcacu

SEQ ID NO: 1646029 - RNA, 12 nt, Homo sapiens
ugcugaagccaa

SEQ ID NO: 1646030 - RNA, 20 nt, Homo sapiens
ugcugagaccccccaccacc

SEQ ID NO: 1646031 - RNA, 15 nt, Homo sapiens
ugcugauguccucac

SEQ ID NO: 1646032 - RNA, 13 nt, Homo sapiens
ugcugcuguggaa

SEQ ID NO: 1646033 - RNA, 14 nt, Homo sapiens
ugcuggcugugaca

SEQ ID NO: 1646034 - RNA, 21 nt, Homo sapiens
ugcuguaauauuguaaauacu

SEQ ID NO: 1646035 - RNA, 14 nt, Homo sapiens
ugcuguaugucucg

SEQ ID NO: 1646036 - RNA, 10 nt, Homo sapiens
ugcugugcaa

SEQ ID NO: 1646037 - RNA, 21 nt, Homo sapiens
ugcugugugacucaaaccaaa

SEQ ID NO: 1646038 - RNA, 16 nt, Homo sapiens
ugcuuaaucugagaau

SEQ ID NO: 1646039 - RNA, 16 nt, Homo sapiens
ugcuucgcagaugucc

SEQ ID NO: 1646040 - RNA, 12 nt, Homo sapiens
ugcuuuauuagu

SEQ ID NO: 1646041 - RNA, 17 nt, Homo sapiens
ugcuuucuauuaucuau

SEQ ID NO: 1646042 - RNA, 15 nt, Homo sapiens
ugcuuuucauuagca

SEQ ID NO: 1646043 - RNA, 14 nt, Homo sapiens
uggaaaauaaauca

SEQ ID NO: 1646044 - RNA, 17 nt, Homo sapiens
uggaaagacaagcucaa

SEQ ID NO: 1646045 - RNA, 18 nt, Homo sapiens
uggaaagaguaggaagac

SEQ ID NO: 1646046 - RNA, 17 nt, Homo sapiens
uggaaaguguguauuua

SEQ ID NO: 1646047 - RNA, 16 nt, Homo sapiens
uggaacaagcacagau

SEQ ID NO: 1646048 - RNA, 16 nt, Homo sapiens
uggaacagucuuccca

SEQ ID NO: 1646049 - RNA, 22 nt, Homo sapiens
uggaacaucaucaaggcacugc

SEQ ID NO: 1646050 - RNA, 18 nt, Homo sapiens
uggaaccaggcuugccug

SEQ ID NO: 1646051 - RNA, 22 nt, Homo sapiens
uggaagagaauauuccuacuug

SEQ ID NO: 1646052 - RNA, 15 nt, Homo sapiens
uggaagcacagcuuc

SEQ ID NO: 1646053 - RNA, 14 nt, Homo sapiens
uggaagucccucag

SEQ ID NO: 1646054 - RNA, 15 nt, Homo sapiens
uggaagugugugauc

SEQ ID NO: 1646055 - RNA, 17 nt, Homo sapiens
uggaauggaauuggaca

SEQ ID NO: 1646056 - RNA, 14 nt, Homo sapiens
uggaauucucucac

SEQ ID NO: 1646057 - RNA, 13 nt, Homo sapiens
uggaauugugcug

SEQ ID NO: 1646058 - RNA, 18 nt, Homo sapiens
uggacaauggaccggaga

SEQ ID NO: 1646059 - RNA, 12 nt, Homo sapiens
uggacacagcuc

SEQ ID NO: 1646060 - RNA, 20 nt, Homo sapiens
uggacacuugcucaugcccu

SEQ ID NO: 1646061 - RNA, 12 nt, Homo sapiens
uggacagaagca

SEQ ID NO: 1646062 - RNA, 19 nt, Homo sapiens
uggacauagcccaagaaca

SEQ ID NO: 1646063 - RNA, 21 nt, Homo sapiens
uggacaugugucccagccaca

SEQ ID NO: 1646064 - RNA, 19 nt, Homo sapiens
uggacccugaggcccagag

SEQ ID NO: 1646065 - RNA, 23 nt, Homo sapiens
uggagaagccacaggccugagau

SEQ ID NO: 1646066 - RNA, 15 nt, Homo sapiens
aucuccucagcaccc

SEQ ID NO: 1646067 - RNA, 22 nt, Homo sapiens
aucucugacuaaaaauacuuaa

SEQ ID NO: 1646068 - RNA, 22 nt, Homo sapiens
aucucugucccacuuggcauca

SEQ ID NO: 1646069 - RNA, 19 nt, Homo sapiens
aucugacuucauacauccc

SEQ ID NO: 1646070 - RNA, 12 nt, Homo sapiens
aucugacuucua

SEQ ID NO: 1646071 - RNA, 20 nt, Homo sapiens
aucugaguugacuugacaga

SEQ ID NO: 1646072 - RNA, 21 nt, Homo sapiens
aucugccuccccuucacuccc

SEQ ID NO: 1646073 - RNA, 14 nt, Homo sapiens
aucugcgugacaau

SEQ ID NO: 1646074 - RNA, 22 nt, Homo sapiens
aucuguugcaaacucagccuca

SEQ ID NO: 1646075 - RNA, 15 nt, Homo sapiens
aucuuaaacauaaua

SEQ ID NO: 1646076 - RNA, 22 nt, Homo sapiens
aucuuaaacauaauaaaucaca

SEQ ID NO: 1646077 - RNA, 18 nt, Homo sapiens
aucuuacauuagugauuc

SEQ ID NO: 1646078 - RNA, 19 nt, Homo sapiens
aucuugaucaaccaaaaac

SEQ ID NO: 1646079 - RNA, 18 nt, Homo sapiens
aucuuggauggugacauu

SEQ ID NO: 1646080 - RNA, 21 nt, Homo sapiens
aucuuuaacagcuuacacuga

SEQ ID NO: 1646081 - RNA, 18 nt, Homo sapiens
aucuuuauugcaugagaa

SEQ ID NO: 1646082 - RNA, 16 nt, Homo sapiens
aucuuucuaaaacugc

SEQ ID NO: 1646083 - RNA, 18 nt, Homo sapiens
aucuuugauucuccuuca

SEQ ID NO: 1646084 - RNA, 23 nt, Homo sapiens
aucuuuggacagaagcagcucuu

SEQ ID NO: 1646085 - RNA, 19 nt, Homo sapiens
augaaauggaggaucucua

SEQ ID NO: 1646086 - RNA, 16 nt, Homo sapiens
augaaauguaaauacu

SEQ ID NO: 1646087 - RNA, 15 nt, Homo sapiens
augaaccccagucag

SEQ ID NO: 1646088 - RNA, 20 nt, Homo sapiens
augaacuauggacggugcuc

SEQ ID NO: 1646089 - RNA, 17 nt, Homo sapiens
augaacuugcaaacagg

SEQ ID NO: 1646090 - RNA, 20 nt, Homo sapiens
augaaguuccacuugguuca

SEQ ID NO: 1646091 - RNA, 17 nt, Homo sapiens
augacauucaugccugg

SEQ ID NO: 1646092 - RNA, 21 nt, Homo sapiens
augaccacauagaacaugugu

SEQ ID NO: 1646093 - RNA, 16 nt, Homo sapiens
augacugguuguucaa

SEQ ID NO: 1646094 - RNA, 18 nt, Homo sapiens
augagaaaaugucuuuau

SEQ ID NO: 1646095 - RNA, 16 nt, Homo sapiens
augagaaguacuuugu

SEQ ID NO: 1646096 - RNA, 22 nt, Homo sapiens
augagacuaugcaaaaguacaa

SEQ ID NO: 1646097 - RNA, 21 nt, Homo sapiens
augagccucagcauccuggca

SEQ ID NO: 1646098 - RNA, 17 nt, Homo sapiens
augaggaauauuugcaa

SEQ ID NO: 1646099 - RNA, 22 nt, Homo sapiens
augaggaauuucuguucuucca

SEQ ID NO: 1646100 - RNA, 17 nt, Homo sapiens
augaggagcugcagauu

SEQ ID NO: 1646101 - RNA, 19 nt, Homo sapiens
augauaauauuguggugcc

SEQ ID NO: 1646102 - RNA, 20 nt, Homo sapiens
augaucacggcucacugcag

SEQ ID NO: 1646103 - RNA, 16 nt, Homo sapiens
augauccuaaugaaug

SEQ ID NO: 1646104 - RNA, 18 nt, Homo sapiens
augaucuaggaagacuuu

SEQ ID NO: 1646105 - RNA, 13 nt, Homo sapiens
augaucuuuucaa

SEQ ID NO: 1646106 - RNA, 17 nt, Homo sapiens
augaugcuaccaugccu

SEQ ID NO: 1646107 - RNA, 23 nt, Homo sapiens
augauguacaggcagaugaaacc

SEQ ID NO: 1646108 - RNA, 11 nt, Homo sapiens
augauguuuca

SEQ ID NO: 1646109 - RNA, 23 nt, Homo sapiens
augauucacccccaaacagugac

SEQ ID NO: 1646110 - RNA, 16 nt, Homo sapiens
augcaaagucaugcaa

SEQ ID NO: 1646111 - RNA, 21 nt, Homo sapiens
augcaagcaagaaacacuggg

SEQ ID NO: 1646112 - RNA, 14 nt, Homo sapiens
augcagcaucuaag

SEQ ID NO: 1646113 - RNA, 15 nt, Homo sapiens
augcauaaaauguua

SEQ ID NO: 1646114 - RNA, 18 nt, Homo sapiens
augcaucugcuacugugu

SEQ ID NO: 1646115 - RNA, 18 nt, Homo sapiens
augcauggaaauucccuu

SEQ ID NO: 1646116 - RNA, 19 nt, Homo sapiens
augccagccacugugauag

SEQ ID NO: 1646117 - RNA, 17 nt, Homo sapiens
augccaugugcaggugg

SEQ ID NO: 1646118 - RNA, 19 nt, Homo sapiens
augccucauuaccuugugc

SEQ ID NO: 1646119 - RNA, 16 nt, Homo sapiens
augccugauugccaag

SEQ ID NO: 1646120 - RNA, 17 nt, Homo sapiens
augccugguggcagcug

SEQ ID NO: 1646121 - RNA, 14 nt, Homo sapiens
augcggucuaggga

SEQ ID NO: 1646122 - RNA, 18 nt, Homo sapiens
augcuaagacucaguggg

SEQ ID NO: 1646123 - RNA, 14 nt, Homo sapiens
augcuaccaugccu

SEQ ID NO: 1646124 - RNA, 11 nt, Homo sapiens
augcucuccaa

SEQ ID NO: 1646125 - RNA, 21 nt, Homo sapiens
augcugauguccucaccacau

SEQ ID NO: 1646126 - RNA, 16 nt, Homo sapiens
augcuggcuguuggcu

SEQ ID NO: 1646127 - RNA, 14 nt, Homo sapiens
augcuuauaggugg

SEQ ID NO: 1646128 - RNA, 17 nt, Homo sapiens
augcuuauguguugcau

SEQ ID NO: 1646129 - RNA, 23 nt, Homo sapiens
auggacuuucuugcaagcaacaa

SEQ ID NO: 1646130 - RNA, 21 nt, Homo sapiens
auggaggaucucuaaagagca

SEQ ID NO: 1646131 - RNA, 13 nt, Homo sapiens
auggauuuaaucc

SEQ ID NO: 1646132 - RNA, 21 nt, Homo sapiens
auggcaucucauugaggacaa

SEQ ID NO: 1646133 - RNA, 19 nt, Homo sapiens
auggcuguggcauuguuga

SEQ ID NO: 1646134 - RNA, 18 nt, Homo sapiens
augggcuucacuguauaa

SEQ ID NO: 1646135 - RNA, 15 nt, Homo sapiens
auggggcaaacucaa

SEQ ID NO: 1646136 - RNA, 17 nt, Homo sapiens
augggggaaauggugcc

SEQ ID NO: 1646137 - RNA, 19 nt, Homo sapiens
augguaguuuuacaguguu

SEQ ID NO: 1646138 - RNA, 13 nt, Homo sapiens
augguaugaucaa

SEQ ID NO: 1646139 - RNA, 20 nt, Homo sapiens
auggugaaacuccaucucua

SEQ ID NO: 1646140 - RNA, 21 nt, Homo sapiens
augguuucaauaaaccuaaua

SEQ ID NO: 1646141 - RNA, 21 nt, Homo sapiens
augguuugcaaggaagccaca

SEQ ID NO: 1646142 - RNA, 17 nt, Homo sapiens
auugugucccccauaaa

SEQ ID NO: 1646143 - RNA, 16 nt, Homo sapiens
auuguugaugcucaca

SEQ ID NO: 1646144 - RNA, 21 nt, Homo sapiens
auuuaaagggugauguacaca

SEQ ID NO: 1646145 - RNA, 21 nt, Homo sapiens
auuuacuguggcuucuuaauc

SEQ ID NO: 1646146 - RNA, 22 nt, Homo sapiens
auuuaguuugauuauucagugu

SEQ ID NO: 1646147 - RNA, 18 nt, Homo sapiens
auuuauggaaucuaccaa

SEQ ID NO: 1646148 - RNA, 22 nt, Homo sapiens
auuuauuguuauauuacuugcc

SEQ ID NO: 1646149 - RNA, 20 nt, Homo sapiens
auuuauuuuuuuacuuccuc

SEQ ID NO: 1646150 - RNA, 13 nt, Homo sapiens
auuucaagaccuc

SEQ ID NO: 1646151 - RNA, 16 nt, Homo sapiens
auuucaauacuuacau

SEQ ID NO: 1646152 - RNA, 12 nt, Homo sapiens
auuucaucugcu

SEQ ID NO: 1646153 - RNA, 18 nt, Homo sapiens
auuucauuuguaacuuua

SEQ ID NO: 1646154 - RNA, 21 nt, Homo sapiens
auuuccucugagcuguuaucu

SEQ ID NO: 1646155 - RNA, 17 nt, Homo sapiens
auuuccuuugcgcaaac

SEQ ID NO: 1646156 - RNA, 21 nt, Homo sapiens
auuuccuuugcgcaaacuuua

SEQ ID NO: 1646157 - RNA, 16 nt, Homo sapiens
auuucuccuccauggg

SEQ ID NO: 1646158 - RNA, 16 nt, Homo sapiens
auuucuggguucucaa

SEQ ID NO: 1646159 - RNA, 23 nt, Homo sapiens
auuucuguuguuuuaagccacaa

SEQ ID NO: 1646160 - RNA, 14 nt, Homo sapiens
auuugaggaucuca

SEQ ID NO: 1646161 - RNA, 14 nt, Homo sapiens
auuugcaagacaua

SEQ ID NO: 1646162 - RNA, 14 nt, Homo sapiens
auuugcacaaguuc

SEQ ID NO: 1646163 - RNA, 11 nt, Homo sapiens
auuugcacuau

SEQ ID NO: 1646164 - RNA, 18 nt, Homo sapiens
auuugguuauuuaaucac

SEQ ID NO: 1646165 - RNA, 22 nt, Homo sapiens
auuugguuuguugagccuaaua

SEQ ID NO: 1646166 - RNA, 19 nt, Homo sapiens
auuuguaacuuuguugcau

SEQ ID NO: 1646167 - RNA, 20 nt, Homo sapiens
auuuguauuuccccaaugac

SEQ ID NO: 1646168 - RNA, 21 nt, Homo sapiens
auuugugaugacaacuggaau

SEQ ID NO: 1646169 - RNA, 16 nt, Homo sapiens
auuuuacaagggcaua

SEQ ID NO: 1646170 - RNA, 13 nt, Homo sapiens
auuuuagucacac

SEQ ID NO: 1646171 - RNA, 13 nt, Homo sapiens
auuuucagcauca

SEQ ID NO: 1646172 - RNA, 16 nt, Homo sapiens
auuuucagcaucaaac

SEQ ID NO: 1646173 - RNA, 14 nt, Homo sapiens
auuuucaguuauua

SEQ ID NO: 1646174 - RNA, 17 nt, Homo sapiens
auuuuccauaagcuauu

SEQ ID NO: 1646175 - RNA, 18 nt, Homo sapiens
auuuuccauaagcuauuu

SEQ ID NO: 1646176 - RNA, 21 nt, Homo sapiens
auuuuccuucagaauaucuua

SEQ ID NO: 1646177 - RNA, 20 nt, Homo sapiens
auacaguuugucacaugaaa

SEQ ID NO: 1646178 - RNA, 18 nt, Homo sapiens
auaccaaagccaauaaau

SEQ ID NO: 1646179 - RNA, 16 nt, Homo sapiens
auacccccugcaaagc

SEQ ID NO: 1646180 - RNA, 21 nt, Homo sapiens
auacccuccuuccaccaaguu

SEQ ID NO: 1646181 - RNA, 14 nt, Homo sapiens
auacgguaugauau

SEQ ID NO: 1646182 - RNA, 23 nt, Homo sapiens
auacuaauuuuccauaagcuauu

SEQ ID NO: 1646183 - RNA, 20 nt, Homo sapiens
auacuauuuaauuauuucac

SEQ ID NO: 1646184 - RNA, 23 nt, Homo sapiens
auacuauuuaauuauuucacuuu

SEQ ID NO: 1646185 - RNA, 17 nt, Homo sapiens
auacucccuuuaaagag

SEQ ID NO: 1646186 - RNA, 17 nt, Homo sapiens
auacugaggcacacaga

SEQ ID NO: 1646187 - RNA, 16 nt, Homo sapiens
auacuggacucaggaa

SEQ ID NO: 1646188 - RNA, 15 nt, Homo sapiens
auacuggucucaggc

SEQ ID NO: 1646189 - RNA, 19 nt, Homo sapiens
auacuguaacauucaggaa

SEQ ID NO: 1646190 - RNA, 18 nt, Homo sapiens
auacuguauauucaggac

SEQ ID NO: 1646191 - RNA, 16 nt, Homo sapiens
auacugugugcuaaaa

SEQ ID NO: 1646192 - RNA, 18 nt, Homo sapiens
auacuguugcacgugugu

SEQ ID NO: 1646193 - RNA, 17 nt, Homo sapiens
auacuucaauacuucau

SEQ ID NO: 1646194 - RNA, 21 nt, Homo sapiens
auacuuguuguuuaauguuua

SEQ ID NO: 1646195 - RNA, 17 nt, Homo sapiens
auagauaggucagugca

SEQ ID NO: 1646196 - RNA, 18 nt, Homo sapiens
auagcuacaucaguuuga

SEQ ID NO: 1646197 - RNA, 22 nt, Homo sapiens
auagguauguagcaguaucuca

SEQ ID NO: 1646198 - RNA, 16 nt, Homo sapiens
auagucuggcaccaaa

SEQ ID NO: 1646199 - RNA, 18 nt, Homo sapiens
auagugcuucuuguaaua

SEQ ID NO: 1646200 - RNA, 17 nt, Homo sapiens
auaguguagcugaggag

SEQ ID NO: 1646201 - RNA, 20 nt, Homo sapiens
auaguuuaaauucaauuaca

SEQ ID NO: 1646202 - RNA, 19 nt, Homo sapiens
auauaaagauuaacacuca

SEQ ID NO: 1646203 - RNA, 13 nt, Homo sapiens
auauaaauuuauc

SEQ ID NO: 1646204 - RNA, 14 nt, Homo sapiens
auauaccuuacuga

SEQ ID NO: 1646205 - RNA, 19 nt, Homo sapiens
auauauauuuuugugcaca

SEQ ID NO: 1646206 - RNA, 14 nt, Homo sapiens
auauauuaagugac

SEQ ID NO: 1646207 - RNA, 13 nt, Homo sapiens
auauauucacuuu

SEQ ID NO: 1646208 - RNA, 16 nt, Homo sapiens
auaucaaaauugcaau

SEQ ID NO: 1646209 - RNA, 20 nt, Homo sapiens
auaucaguuuuuacuuucuc

SEQ ID NO: 1646210 - RNA, 13 nt, Homo sapiens
auaucaugcucca

SEQ ID NO: 1646211 - RNA, 14 nt, Homo sapiens
auaucaugcuccau

SEQ ID NO: 1646212 - RNA, 16 nt, Homo sapiens
auauccucugcuuaaa

SEQ ID NO: 1646213 - RNA, 12 nt, Homo sapiens
auaucuaugacu

SEQ ID NO: 1646214 - RNA, 14 nt, Homo sapiens
auaugaagacauaa

SEQ ID NO: 1646215 - RNA, 17 nt, Homo sapiens
auaugaaugucaguagu

SEQ ID NO: 1646216 - RNA, 16 nt, Homo sapiens
auaugaucggccauca

SEQ ID NO: 1646217 - RNA, 23 nt, Homo sapiens
auaugcaugcccuuccuuucuau

SEQ ID NO: 1646218 - RNA, 18 nt, Homo sapiens
auaugcuaacccccaaau

SEQ ID NO: 1646219 - RNA, 18 nt, Homo sapiens
auauggacuuucuugcaa

SEQ ID NO: 1646220 - RNA, 13 nt, Homo sapiens
auauggcuugagu

SEQ ID NO: 1646221 - RNA, 17 nt, Homo sapiens
auauggcuugaguuuaa

SEQ ID NO: 1646222 - RNA, 23 nt, Homo sapiens
auauguguaaauguuaugacucc

SEQ ID NO: 1646223 - RNA, 13 nt, Homo sapiens
auauuaagucguu

SEQ ID NO: 1646224 - RNA, 22 nt, Homo sapiens
auauuaauuuuccaaugcacag

SEQ ID NO: 1646225 - RNA, 19 nt, Homo sapiens
auauugcagcuuauauuca

SEQ ID NO: 1646226 - RNA, 16 nt, Homo sapiens
auauuguaaauacugg

SEQ ID NO: 1646227 - RNA, 21 nt, Homo sapiens
auauuguaauccuagcacuuu

SEQ ID NO: 1646228 - RNA, 23 nt, Homo sapiens
auauuguucuuguaagcuuuaac

SEQ ID NO: 1646229 - RNA, 12 nt, Homo sapiens
auauuuacaugc

SEQ ID NO: 1646230 - RNA, 20 nt, Homo sapiens
auauuugggggggaauaaga

SEQ ID NO: 1646231 - RNA, 15 nt, Homo sapiens
auauuuucaccauuu

SEQ ID NO: 1646232 - RNA, 15 nt, Homo sapiens
auauuuuguuuacaa

SEQ ID NO: 1646233 - RNA, 18 nt, Homo sapiens
auauuuuguuuugugcag

SEQ ID NO: 1646234 - RNA, 18 nt, Homo sapiens
auauuuuuaugugcaaua

SEQ ID NO: 1646235 - RNA, 17 nt, Homo sapiens
auauuuuugugcacauu

SEQ ID NO: 1646236 - RNA, 19 nt, Homo sapiens
aucaaaacccaacaugacu

SEQ ID NO: 1646237 - RNA, 23 nt, Homo sapiens
aucaaauggaagacacauugaaa

SEQ ID NO: 1646238 - RNA, 22 nt, Homo sapiens
aucaaaugugacauuauaugca

SEQ ID NO: 1646239 - RNA, 13 nt, Homo sapiens
aucaagacuggaa

SEQ ID NO: 1646240 - RNA, 18 nt, Homo sapiens
aucaccaaggagccaaac

SEQ ID NO: 1646241 - RNA, 17 nt, Homo sapiens
aucacggcucacugcag

SEQ ID NO: 1646242 - RNA, 21 nt, Homo sapiens
aucacuggcucucuaauucca

SEQ ID NO: 1646243 - RNA, 23 nt, Homo sapiens
aucagcaacaaccagcaucccuu

SEQ ID NO: 1646244 - RNA, 19 nt, Homo sapiens
aucagugaauaaaccauca

SEQ ID NO: 1646245 - RNA, 21 nt, Homo sapiens
aucaguuuuuuuuuauacacu

SEQ ID NO: 1646246 - RNA, 17 nt, Homo sapiens
aucaucaagaaauacuu

SEQ ID NO: 1646247 - RNA, 19 nt, Homo sapiens
aucauccacugugccaugu

SEQ ID NO: 1646248 - RNA, 14 nt, Homo sapiens
aucaucuguggaac

SEQ ID NO: 1646249 - RNA, 15 nt, Homo sapiens
aucaugcuguuuuau

SEQ ID NO: 1646250 - RNA, 13 nt, Homo sapiens
aucauguauuuau

SEQ ID NO: 1646251 - RNA, 15 nt, Homo sapiens
aucauguguguccac

SEQ ID NO: 1646252 - RNA, 17 nt, Homo sapiens
aucauucucugucucau

SEQ ID NO: 1646253 - RNA, 21 nt, Homo sapiens
aucauuguauuaacgcaaaua

SEQ ID NO: 1646254 - RNA, 23 nt, Homo sapiens
aucauuuacuuuuaaacuuugau

SEQ ID NO: 1646255 - RNA, 13 nt, Homo sapiens
auccaaauaucau

SEQ ID NO: 1646256 - RNA, 20 nt, Homo sapiens
auccaauaauuuuccuguga

SEQ ID NO: 1646257 - RNA, 21 nt, Homo sapiens
auccaauucuuugaauuuccc

SEQ ID NO: 1646258 - RNA, 12 nt, Homo sapiens
auccacauggga

SEQ ID NO: 1646259 - RNA, 15 nt, Homo sapiens
auccacugugccaug

SEQ ID NO: 1646260 - RNA, 15 nt, Homo sapiens
auccagacccggcug

SEQ ID NO: 1646261 - RNA, 15 nt, Homo sapiens
auccaggacugagau

SEQ ID NO: 1646262 - RNA, 19 nt, Homo sapiens
auccagguaauccaagaua

SEQ ID NO: 1646263 - RNA, 17 nt, Homo sapiens
auccaugaaccaagacc

SEQ ID NO: 1646264 - RNA, 17 nt, Homo sapiens
auccauguaguagauau

SEQ ID NO: 1646265 - RNA, 16 nt, Homo sapiens
aucccucaguuucuua

SEQ ID NO: 1646266 - RNA, 14 nt, Homo sapiens
aucccucauccuca

SEQ ID NO: 1646267 - RNA, 15 nt, Homo sapiens
auccuacaacuucca

SEQ ID NO: 1646268 - RNA, 21 nt, Homo sapiens
auccuacaacuuccacuccaa

SEQ ID NO: 1646269 - RNA, 16 nt, Homo sapiens
auccuacaagacacag

SEQ ID NO: 1646270 - RNA, 20 nt, Homo sapiens
auccuacauaauacccagga

SEQ ID NO: 1646271 - RNA, 20 nt, Homo sapiens
auccuccgccucccggguuc

SEQ ID NO: 1646272 - RNA, 20 nt, Homo sapiens
auccugaauaaaccaguauc

SEQ ID NO: 1646273 - RNA, 21 nt, Homo sapiens
auccuggcucuuuggagauca

SEQ ID NO: 1646274 - RNA, 22 nt, Homo sapiens
auccuguaccaaaucugacaua

SEQ ID NO: 1646275 - RNA, 18 nt, Homo sapiens
auccugucccaccaugca

SEQ ID NO: 1646276 - RNA, 22 nt, Homo sapiens
auccuuauaagagauucacuca

SEQ ID NO: 1646277 - RNA, 13 nt, Homo sapiens
aucgcaagagcca

SEQ ID NO: 1646278 - RNA, 15 nt, Homo sapiens
aucgcugucaucuca

SEQ ID NO: 1646279 - RNA, 17 nt, Homo sapiens
aucgugaucacugagcc

SEQ ID NO: 1646280 - RNA, 17 nt, Homo sapiens
aucuaagaaaaggggag

SEQ ID NO: 1646281 - RNA, 14 nt, Homo sapiens
aucuaauaaauacu

SEQ ID NO: 1646282 - RNA, 17 nt, Homo sapiens
aucuaauaaauacuuaa

SEQ ID NO: 1646283 - RNA, 23 nt, Homo sapiens
aucuacauacacaguggccaagc

SEQ ID NO: 1646284 - RNA, 13 nt, Homo sapiens
aucuaugucauau

SEQ ID NO: 1646285 - RNA, 15 nt, Homo sapiens
aucucaaacuacugg

SEQ ID NO: 1646286 - RNA, 18 nt, Homo sapiens
aacccccagccccuccau

SEQ ID NO: 1646287 - RNA, 16 nt, Homo sapiens
aacccccugacauuau

SEQ ID NO: 1646288 - RNA, 23 nt, Homo sapiens
aacccccugacauuaucuuggau

SEQ ID NO: 1646289 - RNA, 19 nt, Homo sapiens
aacccuauugguaaagaau

SEQ ID NO: 1646290 - RNA, 13 nt, Homo sapiens
aacccucugugaa

SEQ ID NO: 1646291 - RNA, 20 nt, Homo sapiens
aaccguuuccuuucauuuac

SEQ ID NO: 1646292 - RNA, 23 nt, Homo sapiens
aaccguuuccuuucauuuacugu

SEQ ID NO: 1646293 - RNA, 21 nt, Homo sapiens
aaccuacucacuuagcaugaa

SEQ ID NO: 1646294 - RNA, 23 nt, Homo sapiens
aaccucagugauuggcucugugg

SEQ ID NO: 1646295 - RNA, 20 nt, Homo sapiens
aaccucccccccaaauacuc

SEQ ID NO: 1646296 - RNA, 15 nt, Homo sapiens
aaccugaacuuucau

SEQ ID NO: 1646297 - RNA, 22 nt, Homo sapiens
aaccuggaggggcuagaaccua

SEQ ID NO: 1646298 - RNA, 21 nt, Homo sapiens
aaccuggcagguuagaaccua

SEQ ID NO: 1646299 - RNA, 20 nt, Homo sapiens
aaccuucgccaccuggguuc

SEQ ID NO: 1646300 - RNA, 12 nt, Homo sapiens
aacgcacaaaac

SEQ ID NO: 1646301 - RNA, 17 nt, Homo sapiens
aacgcacacaguaucua

SEQ ID NO: 1646302 - RNA, 16 nt, Homo sapiens
aacuaccagugggcau

SEQ ID NO: 1646303 - RNA, 20 nt, Homo sapiens
aacuaccagugggcauguau

SEQ ID NO: 1646304 - RNA, 17 nt, Homo sapiens
aacuaguuaaaagccuu

SEQ ID NO: 1646305 - RNA, 19 nt, Homo sapiens
aacuaucagacuaagccag

SEQ ID NO: 1646306 - RNA, 14 nt, Homo sapiens
aacuaugacagaua

SEQ ID NO: 1646307 - RNA, 18 nt, Homo sapiens
aacuaugacagauauauu

SEQ ID NO: 1646308 - RNA, 15 nt, Homo sapiens
aacuauguaaugcuu

SEQ ID NO: 1646309 - RNA, 13 nt, Homo sapiens
aacucccugcccc

SEQ ID NO: 1646310 - RNA, 15 nt, Homo sapiens
aacucccuuucaugu

SEQ ID NO: 1646311 - RNA, 17 nt, Homo sapiens
aacuccuagguucacuu

SEQ ID NO: 1646312 - RNA, 16 nt, Homo sapiens
aacucuaccugcacac

SEQ ID NO: 1646313 - RNA, 16 nt, Homo sapiens
aacucugaaccaccuu

SEQ ID NO: 1646314 - RNA, 13 nt, Homo sapiens
aacucuuaucuca

SEQ ID NO: 1646315 - RNA, 13 nt, Homo sapiens
aacugguuguaua

SEQ ID NO: 1646316 - RNA, 13 nt, Homo sapiens
aacugucauguaa

SEQ ID NO: 1646317 - RNA, 21 nt, Homo sapiens
aacuguuggcaaggugacauu

SEQ ID NO: 1646318 - RNA, 15 nt, Homo sapiens
aacuuauuaucacuu

SEQ ID NO: 1646319 - RNA, 20 nt, Homo sapiens
aacuucaugcuggccugugu

SEQ ID NO: 1646320 - RNA, 17 nt, Homo sapiens
aacuucuuucacucaca

SEQ ID NO: 1646321 - RNA, 16 nt, Homo sapiens
aacuuuuauuacuggg

SEQ ID NO: 1646322 - RNA, 22 nt, Homo sapiens
aagaaaaauauuaauaagacaa

SEQ ID NO: 1646323 - RNA, 22 nt, Homo sapiens
aagaaaaguuuuguaaauuucu

SEQ ID NO: 1646324 - RNA, 18 nt, Homo sapiens
aagaaauaaaaucuaauu

SEQ ID NO: 1646325 - RNA, 13 nt, Homo sapiens
aagaaauauuccu

SEQ ID NO: 1646326 - RNA, 17 nt, Homo sapiens
aagaacaccugcauucu

SEQ ID NO: 1646327 - RNA, 22 nt, Homo sapiens
aagaacuauugugcucagagac

SEQ ID NO: 1646328 - RNA, 20 nt, Homo sapiens
aagaacuuggaggcaccauu

SEQ ID NO: 1646329 - RNA, 22 nt, Homo sapiens
aagaagcccaggaaaggcucca

SEQ ID NO: 1646330 - RNA, 15 nt, Homo sapiens
aagaaggggacaaug

SEQ ID NO: 1646331 - RNA, 22 nt, Homo sapiens
aagaagguguguccuaaaucca

SEQ ID NO: 1646332 - RNA, 14 nt, Homo sapiens
aagaaguugcucug

SEQ ID NO: 1646333 - RNA, 16 nt, Homo sapiens
aagaauuggccaucuu

SEQ ID NO: 1646334 - RNA, 17 nt, Homo sapiens
aagacaccagagcagau

SEQ ID NO: 1646335 - RNA, 13 nt, Homo sapiens
aagacccauuccu

SEQ ID NO: 1646336 - RNA, 13 nt, Homo sapiens
aagacuacugaag

SEQ ID NO: 1646337 - RNA, 13 nt, Homo sapiens
aagacuacugaau

SEQ ID NO: 1646338 - RNA, 21 nt, Homo sapiens
aagacucgggauuaguacaca

SEQ ID NO: 1646339 - RNA, 11 nt, Homo sapiens
aagacugacca

SEQ ID NO: 1646340 - RNA, 19 nt, Homo sapiens
aagagacuaggcgcugggg

SEQ ID NO: 1646341 - RNA, 19 nt, Homo sapiens
aagagauagagaccaucuu

SEQ ID NO: 1646342 - RNA, 20 nt, Homo sapiens
aagagggugauugcuggggc

SEQ ID NO: 1646343 - RNA, 21 nt, Homo sapiens
aagagugagacuccaccucaa

SEQ ID NO: 1646344 - RNA, 12 nt, Homo sapiens
aagauagacuuc

SEQ ID NO: 1646345 - RNA, 23 nt, Homo sapiens
aagauccccagacuucauagaau

SEQ ID NO: 1646346 - RNA, 14 nt, Homo sapiens
aagauccuacccca

SEQ ID NO: 1646347 - RNA, 23 nt, Homo sapiens
aagauccuaccccaauuccuugu

SEQ ID NO: 1646348 - RNA, 19 nt, Homo sapiens
aagauggcauuucaccaug

SEQ ID NO: 1646349 - RNA, 16 nt, Homo sapiens
aagauucuauguuaau

SEQ ID NO: 1646350 - RNA, 21 nt, Homo sapiens
aagauuucagauuugugacca

SEQ ID NO: 1646351 - RNA, 20 nt, Homo sapiens
aagauuuuagcuacaucuaa

SEQ ID NO: 1646352 - RNA, 14 nt, Homo sapiens
aagcaaaguaucaa

SEQ ID NO: 1646353 - RNA, 11 nt, Homo sapiens
aagcacugugc

SEQ ID NO: 1646354 - RNA, 20 nt, Homo sapiens
aagcacuuacaccaguuuga

SEQ ID NO: 1646355 - RNA, 12 nt, Homo sapiens
aagcacuugugg

SEQ ID NO: 1646356 - RNA, 14 nt, Homo sapiens
aagcaggcuucuau

SEQ ID NO: 1646357 - RNA, 16 nt, Homo sapiens
aagcaucacuugggau

SEQ ID NO: 1646358 - RNA, 23 nt, Homo sapiens
aagcaucuuucuguuacugaugu

SEQ ID NO: 1646359 - RNA, 16 nt, Homo sapiens
aagccaaagccaauaa

SEQ ID NO: 1646360 - RNA, 23 nt, Homo sapiens
aagccagguuacauucuaaaaau

SEQ ID NO: 1646361 - RNA, 18 nt, Homo sapiens
aagcccauucauuccauu

SEQ ID NO: 1646362 - RNA, 18 nt, Homo sapiens
aagccuauguaugccaug

SEQ ID NO: 1646363 - RNA, 20 nt, Homo sapiens
aagccuuuuugucaccucaa

SEQ ID NO: 1646364 - RNA, 22 nt, Homo sapiens
aagcggggagaggguacacaau

SEQ ID NO: 1646365 - RNA, 18 nt, Homo sapiens
aagcuacuuaacuuggua

SEQ ID NO: 1646366 - RNA, 20 nt, Homo sapiens
aagcuauuagccaggaucau

SEQ ID NO: 1646367 - RNA, 17 nt, Homo sapiens
aagcucaaguguucaca

SEQ ID NO: 1646368 - RNA, 22 nt, Homo sapiens
aagcucaucucagcuccugaaa

SEQ ID NO: 1646369 - RNA, 16 nt, Homo sapiens
aagcucccaagggaug

SEQ ID NO: 1646370 - RNA, 19 nt, Homo sapiens
aagcuuauuuagcacauuu

SEQ ID NO: 1646371 - RNA, 22 nt, Homo sapiens
aagcuuucauguaaacugugca

SEQ ID NO: 1646372 - RNA, 18 nt, Homo sapiens
aaggaagggccaccacac

SEQ ID NO: 1646373 - RNA, 16 nt, Homo sapiens
aaggacaaacagugaa

SEQ ID NO: 1646374 - RNA, 15 nt, Homo sapiens
aaggacacagaugaa

SEQ ID NO: 1646375 - RNA, 21 nt, Homo sapiens
aaggacaccauuuuggcaagc

SEQ ID NO: 1646376 - RNA, 19 nt, Homo sapiens
aaggacuaggguccugggg

SEQ ID NO: 1646377 - RNA, 12 nt, Homo sapiens
aaggacugguaa

SEQ ID NO: 1646378 - RNA, 20 nt, Homo sapiens
aaggagacacaacaacuccu

SEQ ID NO: 1646379 - RNA, 21 nt, Homo sapiens
aaggagauucaaacucaauga

SEQ ID NO: 1646380 - RNA, 24 nt, Homo sapiens
aaggagccaauugauuucaacaga

SEQ ID NO: 1646381 - RNA, 15 nt, Homo sapiens
aaggcacugccugau

SEQ ID NO: 1646382 - RNA, 17 nt, Homo sapiens
aaggccucauccugggg

SEQ ID NO: 1646383 - RNA, 17 nt, Homo sapiens
aaggccucccacaguga

SEQ ID NO: 1646384 - RNA, 22 nt, Homo sapiens
aaggcuucuccgcccauucuga

SEQ ID NO: 1646385 - RNA, 21 nt, Homo sapiens
aagggaaaguuuuguucugua

SEQ ID NO: 1646386 - RNA, 20 nt, Homo sapiens
aagggaauuucuucaacucc

SEQ ID NO: 1646387 - RNA, 16 nt, Homo sapiens
aagggauggugcccug

SEQ ID NO: 1646388 - RNA, 22 nt, Homo sapiens
aagggccagcuggaggugaaga

SEQ ID NO: 1646389 - RNA, 17 nt, Homo sapiens
aagggcuagaaccugga

SEQ ID NO: 1646390 - RNA, 19 nt, Homo sapiens
aaggggaaacacagcugau

SEQ ID NO: 1646391 - RNA, 15 nt, Homo sapiens
aaggguaucugguga

SEQ ID NO: 1646392 - RNA, 18 nt, Homo sapiens
aagguacugucaugggcu

SEQ ID NO: 1646393 - RNA, 19 nt, Homo sapiens
aagguggaacaagcacaga

SEQ ID NO: 1646394 - RNA, 11 nt, Homo sapiens
aagguucucuc

SEQ ID NO: 1646395 - RNA, 14 nt, Homo sapiens
aaagaaguggggac

SEQ ID NO: 1646396 - RNA, 16 nt, Homo sapiens
aaagacuguuauuuca

SEQ ID NO: 1646397 - RNA, 22 nt, Homo sapiens
aaagacuuaucagaugcucauu

SEQ ID NO: 1646398 - RNA, 19 nt, Homo sapiens
aaagaggagaugacuacau

SEQ ID NO: 1646399 - RNA, 15 nt, Homo sapiens
aaagaguaggaagac

SEQ ID NO: 1646400 - RNA, 18 nt, Homo sapiens
aaagagugaaggauuuau

SEQ ID NO: 1646401 - RNA, 22 nt, Homo sapiens
aaagaguucaagugucuguaua

SEQ ID NO: 1646402 - RNA, 21 nt, Homo sapiens
aaagaguuugaugaggcccuc

SEQ ID NO: 1646403 - RNA, 22 nt, Homo sapiens
aaagaugcauuaucuaugauau

SEQ ID NO: 1646404 - RNA, 18 nt, Homo sapiens
aaagcacuguuucucuca

SEQ ID NO: 1646405 - RNA, 15 nt, Homo sapiens
aaagcaggacuucag

SEQ ID NO: 1646406 - RNA, 16 nt, Homo sapiens
aaagcauuugcaauca

SEQ ID NO: 1646407 - RNA, 21 nt, Homo sapiens
aaagcccuuguccccaugaaa

SEQ ID NO: 1646408 - RNA, 16 nt, Homo sapiens
aaagccuuucauacca

SEQ ID NO: 1646409 - RNA, 19 nt, Homo sapiens
aaagcgagacuccaucuca

SEQ ID NO: 1646410 - RNA, 17 nt, Homo sapiens
aaagcguggacaggugu

SEQ ID NO: 1646411 - RNA, 21 nt, Homo sapiens
aaagcuccauuuuuagugaaa

SEQ ID NO: 1646412 - RNA, 18 nt, Homo sapiens
aaagcugaguguuucaca

SEQ ID NO: 1646413 - RNA, 17 nt, Homo sapiens
aaagcugcugacagugu

SEQ ID NO: 1646414 - RNA, 14 nt, Homo sapiens
aaaggaauccacuc

SEQ ID NO: 1646415 - RNA, 13 nt, Homo sapiens
aaaggaggggaua

SEQ ID NO: 1646416 - RNA, 20 nt, Homo sapiens
aaaggcaaaugcccaaggga

SEQ ID NO: 1646417 - RNA, 22 nt, Homo sapiens
aaaggcuaagcuucacuguaaa

SEQ ID NO: 1646418 - RNA, 20 nt, Homo sapiens
aaaggcugagaacacuguga

SEQ ID NO: 1646419 - RNA, 19 nt, Homo sapiens
aaaggcugggaccacguga

SEQ ID NO: 1646420 - RNA, 18 nt, Homo sapiens
aaagggcccagagagggu

SEQ ID NO: 1646421 - RNA, 18 nt, Homo sapiens
aaagggcgcaaagggcau

SEQ ID NO: 1646422 - RNA, 16 nt, Homo sapiens
aaaggggaacugucaa

SEQ ID NO: 1646423 - RNA, 17 nt, Homo sapiens
aaagguaaggugaaggu

SEQ ID NO: 1646424 - RNA, 16 nt, Homo sapiens
aaagguauauugugaa

SEQ ID NO: 1646425 - RNA, 14 nt, Homo sapiens
aaaguaaaggcaaa

SEQ ID NO: 1646426 - RNA, 17 nt, Homo sapiens
aaaguaaauacaugcau

SEQ ID NO: 1646427 - RNA, 22 nt, Homo sapiens
aaagucuuugaagugacuucac

SEQ ID NO: 1646428 - RNA, 23 nt, Homo sapiens
aaagucuuugaagugacuucaca

SEQ ID NO: 1646429 - RNA, 16 nt, Homo sapiens
aaagugauccauacuu

SEQ ID NO: 1646430 - RNA, 21 nt, Homo sapiens
aaagugcugggauuacagaca

SEQ ID NO: 1646431 - RNA, 20 nt, Homo sapiens
aaaguugauaaguacaugau

SEQ ID NO: 1646432 - RNA, 17 nt, Homo sapiens
aaaguuucucuuuucaa

SEQ ID NO: 1646433 - RNA, 20 nt, Homo sapiens
aaauaaaaucuaauuaauuc

SEQ ID NO: 1646434 - RNA, 17 nt, Homo sapiens
aaauaaacaguuugaca

SEQ ID NO: 1646435 - RNA, 21 nt, Homo sapiens
aaauaacuaggcguggacuua

SEQ ID NO: 1646436 - RNA, 22 nt, Homo sapiens
aaauaagcaugagacuauguaa

SEQ ID NO: 1646437 - RNA, 19 nt, Homo sapiens
aaauaaugcaccacuuuua

SEQ ID NO: 1646438 - RNA, 22 nt, Homo sapiens
aaauacacagugcugaccagac

SEQ ID NO: 1646439 - RNA, 23 nt, Homo sapiens
aaauacacagugcugaccagaca

SEQ ID NO: 1646440 - RNA, 11 nt, Homo sapiens
aaauacucuga

SEQ ID NO: 1646441 - RNA, 17 nt, Homo sapiens
aaauagagccugaggga

SEQ ID NO: 1646442 - RNA, 14 nt, Homo sapiens
aaauauauaucuaa

SEQ ID NO: 1646443 - RNA, 14 nt, Homo sapiens
aaauauauuauuca

SEQ ID NO: 1646444 - RNA, 18 nt, Homo sapiens
aaauaucaaagucauuaa

SEQ ID NO: 1646445 - RNA, 17 nt, Homo sapiens
aaauaugaagacauaaa

SEQ ID NO: 1646446 - RNA, 12 nt, Homo sapiens
aaauaugcagug

SEQ ID NO: 1646447 - RNA, 14 nt, Homo sapiens
aaauauuuucuaca

SEQ ID NO: 1646448 - RNA, 21 nt, Homo sapiens
aaauccacagaacuagccuua

SEQ ID NO: 1646449 - RNA, 21 nt, Homo sapiens
aaaucgugacaacacuugugu

SEQ ID NO: 1646450 - RNA, 18 nt, Homo sapiens
aaaucuaugaaauaucau

SEQ ID NO: 1646451 - RNA, 16 nt, Homo sapiens
aaaucuccagucucau

SEQ ID NO: 1646452 - RNA, 22 nt, Homo sapiens
aaaucugacauauuaugccuga

SEQ ID NO: 1646453 - RNA, 22 nt, Homo sapiens
aaaucugccugauaggacccau

SEQ ID NO: 1646454 - RNA, 13 nt, Homo sapiens
aaaugaaagugag

SEQ ID NO: 1646455 - RNA, 22 nt, Homo sapiens
aaaugacaaccugaauuaucua

SEQ ID NO: 1646456 - RNA, 13 nt, Homo sapiens
aaaugcaaaauaa

SEQ ID NO: 1646457 - RNA, 22 nt, Homo sapiens
aaaugcauauuugcaaagugua

SEQ ID NO: 1646458 - RNA, 13 nt, Homo sapiens
aaaugccaaugag

SEQ ID NO: 1646459 - RNA, 22 nt, Homo sapiens
aaaugcuguauuagucacagag

SEQ ID NO: 1646460 - RNA, 13 nt, Homo sapiens
aaaugcugugcaa

SEQ ID NO: 1646461 - RNA, 20 nt, Homo sapiens
aaaugcugugcaaacagugu

SEQ ID NO: 1646462 - RNA, 21 nt, Homo sapiens
aaaugucucuuuaaugucaca

SEQ ID NO: 1646463 - RNA, 21 nt, Homo sapiens
aaaugugacucaagacuucca

SEQ ID NO: 1646464 - RNA, 17 nt, Homo sapiens
aaaugugucugcaacau

SEQ ID NO: 1646465 - RNA, 21 nt, Homo sapiens
aaaugugucugcaacauggau

SEQ ID NO: 1646466 - RNA, 18 nt, Homo sapiens
aaauguuuguuauuuaca

SEQ ID NO: 1646467 - RNA, 16 nt, Homo sapiens
aaauuaacugcuccaa

SEQ ID NO: 1646468 - RNA, 20 nt, Homo sapiens
aaauucaucaaauggaagac

SEQ ID NO: 1646469 - RNA, 17 nt, Homo sapiens
aaauucuucaugaacau

SEQ ID NO: 1646470 - RNA, 13 nt, Homo sapiens
aaauugcucccua

SEQ ID NO: 1646471 - RNA, 15 nt, Homo sapiens
aaauuguauuacaaa

SEQ ID NO: 1646472 - RNA, 22 nt, Homo sapiens
aaauuguauuaucaacagcauu

SEQ ID NO: 1646473 - RNA, 18 nt, Homo sapiens
aaauuucgagcauaagaa

SEQ ID NO: 1646474 - RNA, 16 nt, Homo sapiens
aaauuugggaggguga

SEQ ID NO: 1646475 - RNA, 22 nt, Homo sapiens
aaauuuguugucauguguauga

SEQ ID NO: 1646476 - RNA, 21 nt, Homo sapiens
aacaaugacuuguacucugaa

SEQ ID NO: 1646477 - RNA, 19 nt, Homo sapiens
aacaauguuuuaaacauuc

SEQ ID NO: 1646478 - RNA, 13 nt, Homo sapiens
aacacacagauuu

SEQ ID NO: 1646479 - RNA, 15 nt, Homo sapiens
aacacacagcuccca

SEQ ID NO: 1646480 - RNA, 21 nt, Homo sapiens
aacaccugcauucuucccuua

SEQ ID NO: 1646481 - RNA, 13 nt, Homo sapiens
aacacggcagcug

SEQ ID NO: 1646482 - RNA, 23 nt, Homo sapiens
aacacucacauuuauucugcuca

SEQ ID NO: 1646483 - RNA, 20 nt, Homo sapiens
aacagaaauuaaucuuacaa

SEQ ID NO: 1646484 - RNA, 13 nt, Homo sapiens
aacagacuugaau

SEQ ID NO: 1646485 - RNA, 19 nt, Homo sapiens
aacagaggaguacagguga

SEQ ID NO: 1646486 - RNA, 13 nt, Homo sapiens
aacagcacccucu

SEQ ID NO: 1646487 - RNA, 10 nt, Homo sapiens
aacagcacug

SEQ ID NO: 1646488 - RNA, 18 nt, Homo sapiens
aacaguucuugugugguu

SEQ ID NO: 1646489 - RNA, 18 nt, Homo sapiens
aacauaagauauuguaca

SEQ ID NO: 1646490 - RNA, 16 nt, Homo sapiens
aacauauuuaagaaau

SEQ ID NO: 1646491 - RNA, 20 nt, Homo sapiens
aacaucaucaaggcacugcc

SEQ ID NO: 1646492 - RNA, 23 nt, Homo sapiens
aacaucuuuucuugccucugucc

SEQ ID NO: 1646493 - RNA, 17 nt, Homo sapiens
aacaugaaaacauugau

SEQ ID NO: 1646494 - RNA, 20 nt, Homo sapiens
aacaugaaaacauugaugaa

SEQ ID NO: 1646495 - RNA, 20 nt, Homo sapiens
aacaugccagccacugugau

SEQ ID NO: 1646496 - RNA, 22 nt, Homo sapiens
aacauggugaaacuccaucucu

SEQ ID NO: 1646497 - RNA, 20 nt, Homo sapiens
aacauguacuguuacugugu

SEQ ID NO: 1646498 - RNA, 22 nt, Homo sapiens
aacauguggcuugaauuaagaa

SEQ ID NO: 1646499 - RNA, 19 nt, Homo sapiens
aacauguuagucaaggacu

SEQ ID NO: 1646500 - RNA, 15 nt, Homo sapiens
aaccaugaaaauggg

SEQ ID NO: 1646501 - RNA, 15 nt, Homo sapiens
aaccauggcacuuga

SEQ ID NO: 1646502 - RNA, 15 nt, Homo sapiens
aacccaaagagacag

SEQ ID NO: 1646503 - RNA, 13 nt, Homo sapiens
uggagaaggugac

SEQ ID NO: 1646504 - RNA, 19 nt, Homo sapiens
uggagaaggugacaugaca

SEQ ID NO: 1646505 - RNA, 19 nt, Homo sapiens
uggagacagagucucgcua

SEQ ID NO: 1646506 - RNA, 21 nt, Homo sapiens
uggagacuccuaggcaggaca

SEQ ID NO: 1646507 - RNA, 13 nt, Homo sapiens
uggagauagggaa

SEQ ID NO: 1646508 - RNA, 16 nt, Homo sapiens
uggaggcaccauuugu

SEQ ID NO: 1646509 - RNA, 22 nt, Homo sapiens
uggaggcuucugauacguguau

SEQ ID NO: 1646510 - RNA, 20 nt, Homo sapiens
uggagggcacauuccuugcc

SEQ ID NO: 1646511 - RNA, 19 nt, Homo sapiens
uggagggcuagaaccugga

SEQ ID NO: 1646512 - RNA, 19 nt, Homo sapiens
uggagggcuggaaucugga

SEQ ID NO: 1646513 - RNA, 19 nt, Homo sapiens
uggagggguuuaugcucaa

SEQ ID NO: 1646514 - RNA, 18 nt, Homo sapiens
uggauauuuuuuacuuua

SEQ ID NO: 1646515 - RNA, 18 nt, Homo sapiens
uggaucuccauucucuca

SEQ ID NO: 1646516 - RNA, 20 nt, Homo sapiens
uggaugguggacccuacuau

SEQ ID NO: 1646517 - RNA, 20 nt, Homo sapiens
uggauucuuuaaacgcucua

SEQ ID NO: 1646518 - RNA, 17 nt, Homo sapiens
uggauuucauacuguaa

SEQ ID NO: 1646519 - RNA, 19 nt, Homo sapiens
uggauuucuuagagauuaa

SEQ ID NO: 1646520 - RNA, 22 nt, Homo sapiens
uggauuugucuuuggugaacau

SEQ ID NO: 1646521 - RNA, 18 nt, Homo sapiens
uggauuuuucuuuaacug

SEQ ID NO: 1646522 - RNA, 16 nt, Homo sapiens
uggcacccaugcaccu

SEQ ID NO: 1646523 - RNA, 15 nt, Homo sapiens
uggcacugccaugca

SEQ ID NO: 1646524 - RNA, 17 nt, Homo sapiens
uggcacuuauaaccaaa

SEQ ID NO: 1646525 - RNA, 19 nt, Homo sapiens
uggcagagagcacagugau

SEQ ID NO: 1646526 - RNA, 21 nt, Homo sapiens
uggcaguggaacuaagaaagc

SEQ ID NO: 1646527 - RNA, 21 nt, Homo sapiens
uggcagugggagcugccuguu

SEQ ID NO: 1646528 - RNA, 13 nt, Homo sapiens
uggcaguguuugu

SEQ ID NO: 1646529 - RNA, 20 nt, Homo sapiens
uggcauguggguugugauau

SEQ ID NO: 1646530 - RNA, 18 nt, Homo sapiens
uggcauuguugaugcuca

SEQ ID NO: 1646531 - RNA, 13 nt, Homo sapiens
uggccaaugagau

SEQ ID NO: 1646532 - RNA, 18 nt, Homo sapiens
uggccaggcuggucucaa

SEQ ID NO: 1646533 - RNA, 15 nt, Homo sapiens
uggccuagucccuuc

SEQ ID NO: 1646534 - RNA, 15 nt, Homo sapiens
uggccucaagugauu

SEQ ID NO: 1646535 - RNA, 23 nt, Homo sapiens
uggccuuuaaaaaugcaccacuu

SEQ ID NO: 1646536 - RNA, 15 nt, Homo sapiens
uggcuacacagggau

SEQ ID NO: 1646537 - RNA, 15 nt, Homo sapiens
uggcucacacugaga

SEQ ID NO: 1646538 - RNA, 21 nt, Homo sapiens
uggcuccaggacagaccuuca

SEQ ID NO: 1646539 - RNA, 15 nt, Homo sapiens
uggcucuacuuucag

SEQ ID NO: 1646540 - RNA, 17 nt, Homo sapiens
uggcucucugcagccuu

SEQ ID NO: 1646541 - RNA, 21 nt, Homo sapiens
uggcugacaguaacagcaucu

SEQ ID NO: 1646542 - RNA, 22 nt, Homo sapiens
uggcugagagaguggcauuggc

SEQ ID NO: 1646543 - RNA, 19 nt, Homo sapiens
uggcugauuaucaccaucc

SEQ ID NO: 1646544 - RNA, 19 nt, Homo sapiens
uggcugggggccucagugc

SEQ ID NO: 1646545 - RNA, 13 nt, Homo sapiens
ugggaacuccuaa

SEQ ID NO: 1646546 - RNA, 15 nt, Homo sapiens
ugggaacugcaauaa

SEQ ID NO: 1646547 - RNA, 20 nt, Homo sapiens
ugggaacuuugggacucacu

SEQ ID NO: 1646548 - RNA, 15 nt, Homo sapiens
ugggaagcuauuucc

SEQ ID NO: 1646549 - RNA, 22 nt, Homo sapiens
ugggaaguuggcuggugucccu

SEQ ID NO: 1646550 - RNA, 16 nt, Homo sapiens
ugggcagagcagagac

SEQ ID NO: 1646551 - RNA, 16 nt, Homo sapiens
ugggcccuuugagugc

SEQ ID NO: 1646552 - RNA, 17 nt, Homo sapiens
ugggcucuaaauccauu

SEQ ID NO: 1646553 - RNA, 14 nt, Homo sapiens
ugggcugggaacca

SEQ ID NO: 1646554 - RNA, 19 nt, Homo sapiens
ugggcuggugucaccugaa

SEQ ID NO: 1646555 - RNA, 13 nt, Homo sapiens
ugggcuucuagaa

SEQ ID NO: 1646556 - RNA, 17 nt, Homo sapiens
ugggcuuuugaacugua

SEQ ID NO: 1646557 - RNA, 22 nt, Homo sapiens
uggggacagagcagaacuuuca

SEQ ID NO: 1646558 - RNA, 18 nt, Homo sapiens
uggggcuuuuacaccagu

SEQ ID NO: 1646559 - RNA, 17 nt, Homo sapiens
ugggggugggggguccc

SEQ ID NO: 1646560 - RNA, 18 nt, Homo sapiens
ugggguaguuguguuuca

SEQ ID NO: 1646561 - RNA, 23 nt, Homo sapiens
ugggguuggagguuucacuugca

SEQ ID NO: 1646562 - RNA, 18 nt, Homo sapiens
uggguacuuguggacaca

SEQ ID NO: 1646563 - RNA, 15 nt, Homo sapiens
ugggugauuucuaga

SEQ ID NO: 1646564 - RNA, 23 nt, Homo sapiens
uggguuaggguguguguucaccu

SEQ ID NO: 1646565 - RNA, 17 nt, Homo sapiens
cuaauaauaaauuaaua

SEQ ID NO: 1646566 - RNA, 20 nt, Homo sapiens
cuaauaauaaauuaauaaca

SEQ ID NO: 1646567 - RNA, 14 nt, Homo sapiens
cuguauuagucaca

SEQ ID NO: 1646568 - RNA, 17 nt, Homo sapiens
cuguauuucaagaccuc

SEQ ID NO: 1646569 - RNA, 22 nt, Homo sapiens
cugucacuugcuggcugugaaa

SEQ ID NO: 1646570 - RNA, 18 nt, Homo sapiens
cugucccaccaugcagug

SEQ ID NO: 1646571 - RNA, 13 nt, Homo sapiens
cugucuccauggc

SEQ ID NO: 1646572 - RNA, 15 nt, Homo sapiens
cugugaauuagcuca

SEQ ID NO: 1646573 - RNA, 16 nt, Homo sapiens
cugugaauuagcucac

SEQ ID NO: 1646574 - RNA, 13 nt, Homo sapiens
cugugauggggcc

SEQ ID NO: 1646575 - RNA, 22 nt, Homo sapiens
cugugcagguggggagacuggg

SEQ ID NO: 1646576 - RNA, 14 nt, Homo sapiens
cugugcccucagau

SEQ ID NO: 1646577 - RNA, 20 nt, Homo sapiens
cugugucaggaaacauauuu

SEQ ID NO: 1646578 - RNA, 14 nt, Homo sapiens
cugugugacucaaa

SEQ ID NO: 1646579 - RNA, 13 nt, Homo sapiens
cugugugaugaug

SEQ ID NO: 1646580 - RNA, 18 nt, Homo sapiens
cugugugcgagucugagu

SEQ ID NO: 1646581 - RNA, 21 nt, Homo sapiens
cuguguuuaauaguauaucua

SEQ ID NO: 1646582 - RNA, 22 nt, Homo sapiens
cuguuaaaauuuuucaguguug

SEQ ID NO: 1646583 - RNA, 16 nt, Homo sapiens
cuguuaacuaugacag

SEQ ID NO: 1646584 - RNA, 17 nt, Homo sapiens
cuguuacugaauauuaa

SEQ ID NO: 1646585 - RNA, 18 nt, Homo sapiens
cuguuacugauguucaau

SEQ ID NO: 1646586 - RNA, 19 nt, Homo sapiens
cuguuauuuuaucugcuau

SEQ ID NO: 1646587 - RNA, 20 nt, Homo sapiens
cuguucaagagcacacuugg

SEQ ID NO: 1646588 - RNA, 16 nt, Homo sapiens
cuguuggccaguguga

SEQ ID NO: 1646589 - RNA, 16 nt, Homo sapiens
cuguuuccuagcugug

SEQ ID NO: 1646590 - RNA, 19 nt, Homo sapiens
cuguuuuugucuacacucu

SEQ ID NO: 1646591 - RNA, 13 nt, Homo sapiens
cuuaacagguuug

SEQ ID NO: 1646592 - RNA, 14 nt, Homo sapiens
cuuaacaguuuuag

SEQ ID NO: 1646593 - RNA, 14 nt, Homo sapiens
cuuaagugugcaaa

SEQ ID NO: 1646594 - RNA, 15 nt, Homo sapiens
cuuaagugugcaaaa

SEQ ID NO: 1646595 - RNA, 16 nt, Homo sapiens
cuuaagugugcaaaau

SEQ ID NO: 1646596 - RNA, 13 nt, Homo sapiens
cuuaaucuuuuca

SEQ ID NO: 1646597 - RNA, 16 nt, Homo sapiens
cuuaaucuuuucacaa

SEQ ID NO: 1646598 - RNA, 14 nt, Homo sapiens
cuuacaaacaugug

SEQ ID NO: 1646599 - RNA, 18 nt, Homo sapiens
cuuacaaacaugugguua

SEQ ID NO: 1646600 - RNA, 23 nt, Homo sapiens
cuuacagugagggcuauacaugg

SEQ ID NO: 1646601 - RNA, 19 nt, Homo sapiens
cuuacauuagugauuccau

SEQ ID NO: 1646602 - RNA, 21 nt, Homo sapiens
cuuaccagggucuuugcagau

SEQ ID NO: 1646603 - RNA, 18 nt, Homo sapiens
cuuaccuaccacaugcca

SEQ ID NO: 1646604 - RNA, 18 nt, Homo sapiens
cuuacucuugauuguggg

SEQ ID NO: 1646605 - RNA, 15 nt, Homo sapiens
cuuacuuugugcaaa

SEQ ID NO: 1646606 - RNA, 20 nt, Homo sapiens
cuuagaccaagggaugggac

SEQ ID NO: 1646607 - RNA, 21 nt, Homo sapiens
cuuagcaugaauccuacauac

SEQ ID NO: 1646608 - RNA, 13 nt, Homo sapiens
cuuauacuuuucu

SEQ ID NO: 1646609 - RNA, 20 nt, Homo sapiens
cuuauacuuuucucaauauu

SEQ ID NO: 1646610 - RNA, 12 nt, Homo sapiens
cuuaucaaagga

SEQ ID NO: 1646611 - RNA, 20 nt, Homo sapiens
cuuaucaagcagccaaggga

SEQ ID NO: 1646612 - RNA, 16 nt, Homo sapiens
cuuauccagcugguga

SEQ ID NO: 1646613 - RNA, 22 nt, Homo sapiens
cuuaucucagucaugcauaaau

SEQ ID NO: 1646614 - RNA, 18 nt, Homo sapiens
cuuaucuuucuaaaacug

SEQ ID NO: 1646615 - RNA, 18 nt, Homo sapiens
cuuauucaguucuuacac

SEQ ID NO: 1646616 - RNA, 16 nt, Homo sapiens
cuuauucaucagggag

SEQ ID NO: 1646617 - RNA, 15 nt, Homo sapiens
cuucaauacccaaau

SEQ ID NO: 1646618 - RNA, 12 nt, Homo sapiens
cuucacaguacc

SEQ ID NO: 1646619 - RNA, 16 nt, Homo sapiens
cuucacuguauaaaua

SEQ ID NO: 1646620 - RNA, 11 nt, Homo sapiens
cuucaguauua

SEQ ID NO: 1646621 - RNA, 21 nt, Homo sapiens
cuucaugaucaucacaaucau

SEQ ID NO: 1646622 - RNA, 16 nt, Homo sapiens
cuucaugcauuugcac

SEQ ID NO: 1646623 - RNA, 21 nt, Homo sapiens
cuuccaaacagaacuauggaa

SEQ ID NO: 1646624 - RNA, 21 nt, Homo sapiens
cuuccacuuggcuacacaggg

SEQ ID NO: 1646625 - RNA, 16 nt, Homo sapiens
cuuccagauaaugucc

SEQ ID NO: 1646626 - RNA, 19 nt, Homo sapiens
cuucccaaauagcagcaca

SEQ ID NO: 1646627 - RNA, 15 nt, Homo sapiens
cuuccccuuccuaau

SEQ ID NO: 1646628 - RNA, 13 nt, Homo sapiens
cuuccuugcuaau

SEQ ID NO: 1646629 - RNA, 20 nt, Homo sapiens
cuucuaggauuuauuguuau

SEQ ID NO: 1646630 - RNA, 18 nt, Homo sapiens
cuucuccauccacauggg

SEQ ID NO: 1646631 - RNA, 22 nt, Homo sapiens
cuucuccuaggauuccuaagac

SEQ ID NO: 1646632 - RNA, 17 nt, Homo sapiens
cuucugacuuaagugug

SEQ ID NO: 1646633 - RNA, 21 nt, Homo sapiens
cuucugacuuaagugugcaaa

SEQ ID NO: 1646634 - RNA, 17 nt, Homo sapiens
cuucugcuuaaucugag

SEQ ID NO: 1646635 - RNA, 13 nt, Homo sapiens
cuucugcuucuca

SEQ ID NO: 1646636 - RNA, 17 nt, Homo sapiens
cuucuguccuacucugu

SEQ ID NO: 1646637 - RNA, 16 nt, Homo sapiens
cuucuuaaucuuuuca

SEQ ID NO: 1646638 - RNA, 17 nt, Homo sapiens
cuucuuagcaccacaaa

SEQ ID NO: 1646639 - RNA, 20 nt, Homo sapiens
cuucuuuuuuuuugagaugg

SEQ ID NO: 1646640 - RNA, 18 nt, Homo sapiens
cuugaaaacacuguucuc

SEQ ID NO: 1646641 - RNA, 19 nt, Homo sapiens
cuugaaaagaagcaaggaa

SEQ ID NO: 1646642 - RNA, 19 nt, Homo sapiens
cuugaccucaggugaucca

SEQ ID NO: 1646643 - RNA, 18 nt, Homo sapiens
cuugaguuuaaauuguaa

SEQ ID NO: 1646644 - RNA, 15 nt, Homo sapiens
cuugauuaguguagu

SEQ ID NO: 1646645 - RNA, 16 nt, Homo sapiens
cuugcacaucauggag

SEQ ID NO: 1646646 - RNA, 11 nt, Homo sapiens
cuugcagagau

SEQ ID NO: 1646647 - RNA, 14 nt, Homo sapiens
cuugcuaucaagaa

SEQ ID NO: 1646648 - RNA, 12 nt, Homo sapiens
cuugcugccaaa

SEQ ID NO: 1646649 - RNA, 18 nt, Homo sapiens
cuugcugccaaaagccuu

SEQ ID NO: 1646650 - RNA, 20 nt, Homo sapiens
cuuggaauucucucaccucu

SEQ ID NO: 1646651 - RNA, 22 nt, Homo sapiens
cuuggagaaaauggguuuauuc

SEQ ID NO: 1646652 - RNA, 17 nt, Homo sapiens
cuuggaguuugcauucu

SEQ ID NO: 1646653 - RNA, 24 nt, Homo sapiens
cuuggcacauuuaagagacaguca

SEQ ID NO: 1646654 - RNA, 10 nt, Homo sapiens
cuuggcugug

SEQ ID NO: 1646655 - RNA, 15 nt, Homo sapiens
cuuggcugugcccuc

SEQ ID NO: 1646656 - RNA, 17 nt, Homo sapiens
cuugggagcaccgccug

SEQ ID NO: 1646657 - RNA, 17 nt, Homo sapiens
cuuggggccacugccug

SEQ ID NO: 1646658 - RNA, 19 nt, Homo sapiens
cuuguaaggcauacugccu

SEQ ID NO: 1646659 - RNA, 19 nt, Homo sapiens
cuuguauuuugugaagacu

SEQ ID NO: 1646660 - RNA, 13 nt, Homo sapiens
cuuguccccauga

SEQ ID NO: 1646661 - RNA, 14 nt, Homo sapiens
cuuguguuuuuaac

SEQ ID NO: 1646662 - RNA, 21 nt, Homo sapiens
cuuuaaacugcagcgucagaa

SEQ ID NO: 1646663 - RNA, 19 nt, Homo sapiens
cuuuaaagagaguuugcca

SEQ ID NO: 1646664 - RNA, 19 nt, Homo sapiens
cuuuaaugauuccuauaaa

SEQ ID NO: 1646665 - RNA, 15 nt, Homo sapiens
cuuuagcgcccaguu

SEQ ID NO: 1646666 - RNA, 22 nt, Homo sapiens
cuuuaguuuuugugaaguuuaa

SEQ ID NO: 1646667 - RNA, 20 nt, Homo sapiens
cuuucagaaaauucccauga

SEQ ID NO: 1646668 - RNA, 24 nt, Homo sapiens
cuuucaggccacauggcuaaagaa

SEQ ID NO: 1646669 - RNA, 12 nt, Homo sapiens
cuuucauuuacu

SEQ ID NO: 1646670 - RNA, 15 nt, Homo sapiens
cuuuccaaaggccau

SEQ ID NO: 1646671 - RNA, 18 nt, Homo sapiens
cuuuccauccccuagaaa

SEQ ID NO: 1646672 - RNA, 22 nt, Homo sapiens
cuuugaagugacuucacagaga

SEQ ID NO: 1646673 - RNA, 17 nt, Homo sapiens
cuuugaauuucccaguc

SEQ ID NO: 1646674 - RNA, 20 nt, Homo sapiens
cuuugaauuuuuuuaauugc

SEQ ID NO: 1646675 - RNA, 14 nt, Homo sapiens
cuuugacaguguuu

SEQ ID NO: 1646676 - RNA, 20 nt, Homo sapiens
cuuugaccuaaauuauuuac

SEQ ID NO: 1646677 - RNA, 16 nt, Homo sapiens
cuuugcauauuauaaa

SEQ ID NO: 1646678 - RNA, 23 nt, Homo sapiens
cuuugcugaaugucauuauuuga

SEQ ID NO: 1646679 - RNA, 17 nt, Homo sapiens
uaauuugugaauuugca

SEQ ID NO: 1646680 - RNA, 15 nt, Homo sapiens
uaauuuuccaaugca

SEQ ID NO: 1646681 - RNA, 19 nt, Homo sapiens
uaauuuuccaaugcacagu

SEQ ID NO: 1646682 - RNA, 10 nt, Homo sapiens
uaauuuuccu

SEQ ID NO: 1646683 - RNA, 16 nt, Homo sapiens
uaauuuuccugugaca

SEQ ID NO: 1646684 - RNA, 13 nt, Homo sapiens
uaauuuugucaga

SEQ ID NO: 1646685 - RNA, 20 nt, Homo sapiens
uacaaaaugacauuuugcca

SEQ ID NO: 1646686 - RNA, 12 nt, Homo sapiens
uacaaacaugug

SEQ ID NO: 1646687 - RNA, 15 nt, Homo sapiens
uacaaaggaggacaa

SEQ ID NO: 1646688 - RNA, 15 nt, Homo sapiens
uacaaauacuaucca

SEQ ID NO: 1646689 - RNA, 15 nt, Homo sapiens
uacaacaaacacugu

SEQ ID NO: 1646690 - RNA, 20 nt, Homo sapiens
uacaacaaacacugugaugu

SEQ ID NO: 1646691 - RNA, 21 nt, Homo sapiens
uacaacuuccacuccaaguga

SEQ ID NO: 1646692 - RNA, 13 nt, Homo sapiens
uacaagacacagu

SEQ ID NO: 1646693 - RNA, 14 nt, Homo sapiens
uacaagacacagug

SEQ ID NO: 1646694 - RNA, 17 nt, Homo sapiens
uacaagacacagugacc

SEQ ID NO: 1646695 - RNA, 14 nt, Homo sapiens
uacaagcgugagcc

SEQ ID NO: 1646696 - RNA, 21 nt, Homo sapiens
uacaaggaagggccaccacac

SEQ ID NO: 1646697 - RNA, 19 nt, Homo sapiens
uacaagugauaauacagau

SEQ ID NO: 1646698 - RNA, 20 nt, Homo sapiens
uacaccaguuugacugugcu

SEQ ID NO: 1646699 - RNA, 19 nt, Homo sapiens
uacaccccaacagcacccu

SEQ ID NO: 1646700 - RNA, 14 nt, Homo sapiens
uacagaacucuuuc

SEQ ID NO: 1646701 - RNA, 13 nt, Homo sapiens
uacagacaugaac

SEQ ID NO: 1646702 - RNA, 15 nt, Homo sapiens
uacagacaugaacug

SEQ ID NO: 1646703 - RNA, 18 nt, Homo sapiens
uacagagaaaagacauaa

SEQ ID NO: 1646704 - RNA, 19 nt, Homo sapiens
uacaggugugagccaccac

SEQ ID NO: 1646705 - RNA, 16 nt, Homo sapiens
uacaggugugagucac

SEQ ID NO: 1646706 - RNA, 21 nt, Homo sapiens
uacaguauugaaaaauuauca

SEQ ID NO: 1646707 - RNA, 18 nt, Homo sapiens
uacagucuuccauuugca

SEQ ID NO: 1646708 - RNA, 19 nt, Homo sapiens
uacaguuugucacaugaaa

SEQ ID NO: 1646709 - RNA, 17 nt, Homo sapiens
uacauaucugacuucua

SEQ ID NO: 1646710 - RNA, 21 nt, Homo sapiens
uacauauuucuuugccuuuau

SEQ ID NO: 1646711 - RNA, 13 nt, Homo sapiens
uacaucugugaug

SEQ ID NO: 1646712 - RNA, 15 nt, Homo sapiens
ucucacuguugugaa

SEQ ID NO: 1646713 - RNA, 19 nt, Homo sapiens
ucucaggaccaaagcuuuc

SEQ ID NO: 1646714 - RNA, 20 nt, Homo sapiens
ucucaggagaucuggcugug

SEQ ID NO: 1646715 - RNA, 15 nt, Homo sapiens
ucucaggcuguccca

SEQ ID NO: 1646716 - RNA, 16 nt, Homo sapiens
ucucagugugcccuuc

SEQ ID NO: 1646717 - RNA, 16 nt, Homo sapiens
ucucaucuuucuugau

SEQ ID NO: 1646718 - RNA, 19 nt, Homo sapiens
ucucaucuuucuugaucaa

SEQ ID NO: 1646719 - RNA, 17 nt, Homo sapiens
ucucauuucccuuugau

SEQ ID NO: 1646720 - RNA, 14 nt, Homo sapiens
ucuccaacucuuca

SEQ ID NO: 1646721 - RNA, 12 nt, Homo sapiens
ucuccagaugag

SEQ ID NO: 1646722 - RNA, 19 nt, Homo sapiens
ucuccagaugagaguacac

SEQ ID NO: 1646723 - RNA, 23 nt, Homo sapiens
ucuccagaugagaguacacccca

SEQ ID NO: 1646724 - RNA, 13 nt, Homo sapiens
ucuccagccucag

SEQ ID NO: 1646725 - RNA, 20 nt, Homo sapiens
ucuccagucauuauguuaau

SEQ ID NO: 1646726 - RNA, 18 nt, Homo sapiens
ucuccauggcccugccau

SEQ ID NO: 1646727 - RNA, 16 nt, Homo sapiens
ucuccccaggguucag

SEQ ID NO: 1646728 - RNA, 22 nt, Homo sapiens
ucucccucccuuggggccuaug

SEQ ID NO: 1646729 - RNA, 13 nt, Homo sapiens
ucuccugccucag

SEQ ID NO: 1646730 - RNA, 15 nt, Homo sapiens
ucuccugccucagcc

SEQ ID NO: 1646731 - RNA, 19 nt, Homo sapiens
ucuccugugauccuuugau

SEQ ID NO: 1646732 - RNA, 21 nt, Homo sapiens
ucuccugugaugucccaguuu

SEQ ID NO: 1646733 - RNA, 14 nt, Homo sapiens
ucuccuuaacacug

SEQ ID NO: 1646734 - RNA, 17 nt, Homo sapiens
ucuccuuagaaguggaa

SEQ ID NO: 1646735 - RNA, 16 nt, Homo sapiens
ucucgaacuccugacc

SEQ ID NO: 1646736 - RNA, 19 nt, Homo sapiens
ucucucaucucuuagcucc

SEQ ID NO: 1646737 - RNA, 14 nt, Homo sapiens
ucucucuucuuuuc

SEQ ID NO: 1646738 - RNA, 19 nt, Homo sapiens
ucucugagcagugaaugau

SEQ ID NO: 1646739 - RNA, 16 nt, Homo sapiens
ucucugcccuccaaga

SEQ ID NO: 1646740 - RNA, 21 nt, Homo sapiens
ucucugcuuuggaaaucacac

SEQ ID NO: 1646741 - RNA, 22 nt, Homo sapiens
ucucuguuuuuuuuuuuuuaac

SEQ ID NO: 1646742 - RNA, 22 nt, Homo sapiens
ucugaaauuugugauggaauca

SEQ ID NO: 1646743 - RNA, 19 nt, Homo sapiens
ucugagacacaccccaaca

SEQ ID NO: 1646744 - RNA, 14 nt, Homo sapiens
ucugagcugugcag

SEQ ID NO: 1646745 - RNA, 22 nt, Homo sapiens
ucugauccuaguuccaccauca

SEQ ID NO: 1646746 - RNA, 18 nt, Homo sapiens
ucugcaagauuuuaaaag

SEQ ID NO: 1646747 - RNA, 17 nt, Homo sapiens
ucugcaguacagucuua

SEQ ID NO: 1646748 - RNA, 21 nt, Homo sapiens
ucugccccucccugcuucaau

SEQ ID NO: 1646749 - RNA, 20 nt, Homo sapiens
ucugccuccccuucacuccc

SEQ ID NO: 1646750 - RNA, 18 nt, Homo sapiens
ucugccuuccuugcuaau

SEQ ID NO: 1646751 - RNA, 13 nt, Homo sapiens
ucugcgugacaau

SEQ ID NO: 1646752 - RNA, 13 nt, Homo sapiens
ucugcuaugcuau

SEQ ID NO: 1646753 - RNA, 18 nt, Homo sapiens
ucugcuaugcuauugaag

SEQ ID NO: 1646754 - RNA, 14 nt, Homo sapiens
ucugcuuaaucuga

SEQ ID NO: 1646755 - RNA, 19 nt, Homo sapiens
ucuggcaaacaugugcaac

SEQ ID NO: 1646756 - RNA, 17 nt, Homo sapiens
ucuggccuccaagucca

SEQ ID NO: 1646757 - RNA, 18 nt, Homo sapiens
ucuguacgucugacaggc

SEQ ID NO: 1646758 - RNA, 20 nt, Homo sapiens
ucuguauucgaaaugagcuc

SEQ ID NO: 1646759 - RNA, 15 nt, Homo sapiens
ucugucauguaacac

SEQ ID NO: 1646760 - RNA, 17 nt, Homo sapiens
ucuguggcacucagaua

SEQ ID NO: 1646761 - RNA, 15 nt, Homo sapiens
ucugugugugccugu

SEQ ID NO: 1646762 - RNA, 17 nt, Homo sapiens
ucuguuggccaguguga

SEQ ID NO: 1646763 - RNA, 20 nt, Homo sapiens
ucuguuggccagugugacaa

SEQ ID NO: 1646764 - RNA, 16 nt, Homo sapiens
ucuuaacuauucaaug

SEQ ID NO: 1646765 - RNA, 22 nt, Homo sapiens
ucuuaagcuaagacugauguca

SEQ ID NO: 1646766 - RNA, 14 nt, Homo sapiens
ucuuacuaaaaagu

SEQ ID NO: 1646767 - RNA, 16 nt, Homo sapiens
ucuuagcagugucucu

SEQ ID NO: 1646768 - RNA, 16 nt, Homo sapiens
ucuuaguucuuaccuu

SEQ ID NO: 1646769 - RNA, 17 nt, Homo sapiens
ucuuauucaucagggag

SEQ ID NO: 1646770 - RNA, 18 nt, Homo sapiens
ucuucacucaaucucuga

SEQ ID NO: 1646771 - RNA, 16 nt, Homo sapiens
ucuucagagcugacac

SEQ ID NO: 1646772 - RNA, 17 nt, Homo sapiens
ucuucagcugguggaug

SEQ ID NO: 1646773 - RNA, 20 nt, Homo sapiens
ucuugaaaagaagcaaggaa

SEQ ID NO: 1646774 - RNA, 22 nt, Homo sapiens
ucuugaccucaggugauccacc

SEQ ID NO: 1646775 - RNA, 19 nt, Homo sapiens
ucuugacuacagucaggaa

SEQ ID NO: 1646776 - RNA, 18 nt, Homo sapiens
ucuugauguucagacauu

SEQ ID NO: 1646777 - RNA, 19 nt, Homo sapiens
ucuugccagccacauauga

SEQ ID NO: 1646778 - RNA, 18 nt, Homo sapiens
ucuugugugcauugcugu

SEQ ID NO: 1646779 - RNA, 17 nt, Homo sapiens
ucuuuaaugucacaggc

SEQ ID NO: 1646780 - RNA, 16 nt, Homo sapiens
ucuuucuuacaaggaa

SEQ ID NO: 1646781 - RNA, 17 nt, Homo sapiens
ucuuucuuacaaggaag

SEQ ID NO: 1646782 - RNA, 15 nt, Homo sapiens
ucuuucuuugcugcu

SEQ ID NO: 1646783 - RNA, 21 nt, Homo sapiens
ucuuugagcgcccacuagacc

SEQ ID NO: 1646784 - RNA, 20 nt, Homo sapiens
ucuuuggacagaagcagcuc

SEQ ID NO: 1646785 - RNA, 16 nt, Homo sapiens
ucuuuuaagcuaucua

SEQ ID NO: 1646786 - RNA, 22 nt, Homo sapiens
ucuuuuauauugauaacagcac

SEQ ID NO: 1646787 - RNA, 14 nt, Homo sapiens
ucuuuuccaugaac

SEQ ID NO: 1646788 - RNA, 15 nt, Homo sapiens
ucuuuugcugaucuu

SEQ ID NO: 1646789 - RNA, 16 nt, Homo sapiens
ucuuuugcugaucuuu

SEQ ID NO: 1646790 - RNA, 18 nt, Homo sapiens
ucuuuuucagauuuauga

SEQ ID NO: 1646791 - RNA, 22 nt, Homo sapiens
ugaaaaugcuguauuagucaca

SEQ ID NO: 1646792 - RNA, 16 nt, Homo sapiens
ugaaaauuaacacugc

SEQ ID NO: 1646793 - RNA, 13 nt, Homo sapiens
ugaaacauuugca

SEQ ID NO: 1646794 - RNA, 22 nt, Homo sapiens
ugaaacccccacccuucugccu

SEQ ID NO: 1646795 - RNA, 20 nt, Homo sapiens
ugaaacccuccaaaucucca

SEQ ID NO: 1646796 - RNA, 15 nt, Homo sapiens
ugaaaccgucccuga

SEQ ID NO: 1646797 - RNA, 15 nt, Homo sapiens
ugaaagaaaauaacg

SEQ ID NO: 1646798 - RNA, 17 nt, Homo sapiens
ugaaagucaugcacaua

SEQ ID NO: 1646799 - RNA, 17 nt, Homo sapiens
ugaaagugagacuuuga

SEQ ID NO: 1646800 - RNA, 23 nt, Homo sapiens
ugaaauaccaaccugaagacacc

SEQ ID NO: 1646801 - RNA, 20 nt, Homo sapiens
ugaaauauuaaaaucacugu

SEQ ID NO: 1646802 - RNA, 13 nt, Homo sapiens
ugaaaucuaugaa

SEQ ID NO: 1646803 - RNA, 22 nt, Homo sapiens
ugaaauggauugguaagauguc

SEQ ID NO: 1646804 - RNA, 18 nt, Homo sapiens
ugaacauguggcuugaau

SEQ ID NO: 1646805 - RNA, 19 nt, Homo sapiens
ugaacauugcaauagaaau

SEQ ID NO: 1646806 - RNA, 13 nt, Homo sapiens
ugaaccacaucuu

SEQ ID NO: 1646807 - RNA, 19 nt, Homo sapiens
ugaacuaauuucugugucu

SEQ ID NO: 1646808 - RNA, 23 nt, Homo sapiens
ugaacuuccugcagguaaacagu

SEQ ID NO: 1646809 - RNA, 16 nt, Homo sapiens
ugaagaaaagagucca

SEQ ID NO: 1646810 - RNA, 19 nt, Homo sapiens
ugaagaagagaaugugaca

SEQ ID NO: 1646811 - RNA, 15 nt, Homo sapiens
ugaagaaucuguuuc

SEQ ID NO: 1646812 - RNA, 11 nt, Homo sapiens
ugaagacauaa

SEQ ID NO: 1646813 - RNA, 14 nt, Homo sapiens
ugaagaccuggacu

SEQ ID NO: 1646814 - RNA, 13 nt, Homo sapiens
ugaaggacuguga

SEQ ID NO: 1646815 - RNA, 19 nt, Homo sapiens
ugaagguagaauguuuuca

SEQ ID NO: 1646816 - RNA, 22 nt, Homo sapiens
ugaauaaaccaucaucuugcca

SEQ ID NO: 1646817 - RNA, 19 nt, Homo sapiens
ugaauaaagggaacaugca

SEQ ID NO: 1646818 - RNA, 14 nt, Homo sapiens
ugaauacaggcaua

SEQ ID NO: 1646819 - RNA, 13 nt, Homo sapiens
ugaauccuacaua

SEQ ID NO: 1646820 - RNA, 17 nt, Homo sapiens
ugaaucuuggugucuac

SEQ ID NO: 1646821 - RNA, 22 nt, Homo sapiens
ugaauguauuuugguugcugau

SEQ ID NO: 1646822 - RNA, 18 nt, Homo sapiens
ugccauauucuguuggcc

SEQ ID NO: 1646823 - RNA, 19 nt, Homo sapiens
ugcccacgcuggagugcag

SEQ ID NO: 1646824 - RNA, 19 nt, Homo sapiens
ugcccaggaaccucagggc

SEQ ID NO: 1646825 - RNA, 20 nt, Homo sapiens
ugcccaggcuggcgugcagu

SEQ ID NO: 1646826 - RNA, 16 nt, Homo sapiens
ugcccaguguguuucu

SEQ ID NO: 1646827 - RNA, 17 nt, Homo sapiens
ugccccuccucucugcc

SEQ ID NO: 1646828 - RNA, 17 nt, Homo sapiens
ugcccuccaagaccuuc

SEQ ID NO: 1646829 - RNA, 19 nt, Homo sapiens
ugcccugauccaaguuuac

SEQ ID NO: 1646830 - RNA, 21 nt, Homo sapiens
ugcccugggaggcagugaugg

SEQ ID NO: 1646831 - RNA, 16 nt, Homo sapiens
ugcccuugcuccagcc

SEQ ID NO: 1646832 - RNA, 19 nt, Homo sapiens
ugccgggacccugcucaca

SEQ ID NO: 1646833 - RNA, 18 nt, Homo sapiens
ugccgucuaccugagggg

SEQ ID NO: 1646834 - RNA, 21 nt, Homo sapiens
ugccucacuggacuuguccaa

SEQ ID NO: 1646835 - RNA, 22 nt, Homo sapiens
ugccucauuaccuugugcuaau

SEQ ID NO: 1646836 - RNA, 12 nt, Homo sapiens
ugccucauuuua

SEQ ID NO: 1646837 - RNA, 18 nt, Homo sapiens
ugccucgaacuggcugca

SEQ ID NO: 1646838 - RNA, 17 nt, Homo sapiens
ugccugagccccucaga

SEQ ID NO: 1646839 - RNA, 21 nt, Homo sapiens
ugccuguaaagucugaguaag

SEQ ID NO: 1646840 - RNA, 19 nt, Homo sapiens
ugccuucccaggaguacac

SEQ ID NO: 1646841 - RNA, 15 nt, Homo sapiens
ugccuuuauuugcug

SEQ ID NO: 1646842 - RNA, 18 nt, Homo sapiens
ugccuuucagaagugauu

SEQ ID NO: 1646843 - RNA, 13 nt, Homo sapiens
ugcgucacuguga

SEQ ID NO: 1646844 - RNA, 22 nt, Homo sapiens
ugcuaacccccaaauacucuga

SEQ ID NO: 1646845 - RNA, 21 nt, Homo sapiens
ugcuaaccuuguagcauguga

SEQ ID NO: 1646846 - RNA, 21 nt, Homo sapiens
ugcuacagggcucacagaauu

SEQ ID NO: 1646847 - RNA, 17 nt, Homo sapiens
ugcuaccaaaacaguua

SEQ ID NO: 1646848 - RNA, 20 nt, Homo sapiens
ugcuacuuuguauccucuga

SEQ ID NO: 1646849 - RNA, 20 nt, Homo sapiens
ugcuagauaauaaaauugcu

SEQ ID NO: 1646850 - RNA, 13 nt, Homo sapiens
ugcuaugcuauug

SEQ ID NO: 1646851 - RNA, 19 nt, Homo sapiens
ugcucaauaaaguacaaga

SEQ ID NO: 1646852 - RNA, 22 nt, Homo sapiens
ugcucacgucaaaugcauacaa

SEQ ID NO: 1646853 - RNA, 11 nt, Homo sapiens
ugcucacuggu

SEQ ID NO: 1646854 - RNA, 15 nt, Homo sapiens
ugcucagagacacug

SEQ ID NO: 1646855 - RNA, 23 nt, Homo sapiens
ugcucaugcccugccaagcagca

SEQ ID NO: 1646856 - RNA, 20 nt, Homo sapiens
ugcuccauuuucuugucaau

SEQ ID NO: 1646857 - RNA, 13 nt, Homo sapiens
ugcucccacagaa

SEQ ID NO: 1646858 - RNA, 20 nt, Homo sapiens
ugcucuaagaagcugcaaua

SEQ ID NO: 1646859 - RNA, 23 nt, Homo sapiens
ugcucuuugauucaaagcacugu

SEQ ID NO: 1646860 - RNA, 20 nt, Homo sapiens
ugcugaaugucauuauuuga

SEQ ID NO: 1646861 - RNA, 21 nt, Homo sapiens
ugcugcccagggucaguguau

SEQ ID NO: 1646862 - RNA, 22 nt, Homo sapiens
ugcugccccucccugccuccac

SEQ ID NO: 1646863 - RNA, 20 nt, Homo sapiens
ugcugggauuacagguguga

SEQ ID NO: 1646864 - RNA, 21 nt, Homo sapiens
ugcuguagaagauggcacuua

SEQ ID NO: 1646865 - RNA, 15 nt, Homo sapiens
ugcuuaaucugagaa

SEQ ID NO: 1646866 - RNA, 19 nt, Homo sapiens
ugcuucuuaaaauagccau

SEQ ID NO: 1646867 - RNA, 14 nt, Homo sapiens
ugcuuggauucucu

SEQ ID NO: 1646868 - RNA, 13 nt, Homo sapiens
ugcuuggcacuua

SEQ ID NO: 1646869 - RNA, 14 nt, Homo sapiens
ugcuuguuauuaga

SEQ ID NO: 1646870 - RNA, 20 nt, Homo sapiens
ugcuuucuccuucacagcua

SEQ ID NO: 1646871 - RNA, 16 nt, Homo sapiens
ugcuuuggaaaucaca

SEQ ID NO: 1646872 - RNA, 19 nt, Homo sapiens
uggaaaacaguauuuucca

SEQ ID NO: 1646873 - RNA, 14 nt, Homo sapiens
uggaaacguauuca

SEQ ID NO: 1646874 - RNA, 18 nt, Homo sapiens
uggaaauagugauuucca

SEQ ID NO: 1646875 - RNA, 19 nt, Homo sapiens
uggaaauagugauuuccac

SEQ ID NO: 1646876 - RNA, 15 nt, Homo sapiens
uggaaauucccuuca

SEQ ID NO: 1646877 - RNA, 20 nt, Homo sapiens
uggaacagauucacacuguc

SEQ ID NO: 1646878 - RNA, 15 nt, Homo sapiens
uggaacucaguguga

SEQ ID NO: 1646879 - RNA, 12 nt, Homo sapiens
uggaacuggagg

SEQ ID NO: 1646880 - RNA, 17 nt, Homo sapiens
uggaagacaauacuccc

SEQ ID NO: 1646881 - RNA, 18 nt, Homo sapiens
uggaagacacauugaaag

SEQ ID NO: 1646882 - RNA, 20 nt, Homo sapiens
uggaagguggggacagggau

SEQ ID NO: 1646883 - RNA, 23 nt, Homo sapiens
uggaauaauccuaaacauaugaa

SEQ ID NO: 1646884 - RNA, 13 nt, Homo sapiens
uggaauauuccac

SEQ ID NO: 1646885 - RNA, 21 nt, Homo sapiens
uggaauauuguccauugucca

SEQ ID NO: 1646886 - RNA, 16 nt, Homo sapiens
uggaaucagauuuuaa

SEQ ID NO: 1646887 - RNA, 12 nt, Homo sapiens
uggaaucuggag

SEQ ID NO: 1646888 - RNA, 21 nt, Homo sapiens
uggaaugggcagcucaucucu

SEQ ID NO: 1646889 - RNA, 14 nt, Homo sapiens
uggacacagaggaa

SEQ ID NO: 1646890 - RNA, 15 nt, Homo sapiens
uggacagaagcagcu

SEQ ID NO: 1646891 - RNA, 21 nt, Homo sapiens
uggacuauggcucuacuuuca

SEQ ID NO: 1646892 - RNA, 20 nt, Homo sapiens
uggacucaagcaagauuuca

SEQ ID NO: 1646893 - RNA, 13 nt, Homo sapiens
uggacucaccucc

SEQ ID NO: 1646894 - RNA, 15 nt, Homo sapiens
uggacuggaugcaug

SEQ ID NO: 1646895 - RNA, 13 nt, Homo sapiens
uggagaagcuccc

SEQ ID NO: 1646896 - RNA, 12 nt, Homo sapiens
uggagagccacc

SEQ ID NO: 1646897 - RNA, 23 nt, Homo sapiens
uggagaugucucuguguguuugu

SEQ ID NO: 1646898 - RNA, 20 nt, Homo sapiens
uggagggcuagaaccuggca

SEQ ID NO: 1646899 - RNA, 17 nt, Homo sapiens
uggagugacgcaucucc

SEQ ID NO: 1646900 - RNA, 16 nt, Homo sapiens
uggauacugcugccaa

SEQ ID NO: 1646901 - RNA, 19 nt, Homo sapiens
uggaucuccauucucucag

SEQ ID NO: 1646902 - RNA, 15 nt, Homo sapiens
uggauuugucuuugg

SEQ ID NO: 1646903 - RNA, 16 nt, Homo sapiens
uggcaagcucuaucac

SEQ ID NO: 1646904 - RNA, 18 nt, Homo sapiens
uggcaaggacacagauga

SEQ ID NO: 1646905 - RNA, 13 nt, Homo sapiens
uggccaaagccaa

SEQ ID NO: 1646906 - RNA, 21 nt, Homo sapiens
uggccaaugagaucauuguga

SEQ ID NO: 1646907 - RNA, 17 nt, Homo sapiens
uggccccugcccggcug

SEQ ID NO: 1646908 - RNA, 17 nt, Homo sapiens
uggccuuuaaaaaugca

SEQ ID NO: 1646909 - RNA, 18 nt, Homo sapiens
uggcgggugccuguaauc

SEQ ID NO: 1646910 - RNA, 17 nt, Homo sapiens
uggcucucuaauuccac

SEQ ID NO: 1646911 - RNA, 20 nt, Homo sapiens
uggcucugggguccucacau

SEQ ID NO: 1646912 - RNA, 13 nt, Homo sapiens
uggcugugacaau

SEQ ID NO: 1646913 - RNA, 20 nt, Homo sapiens
uggcuucuuaaucuuuucac

SEQ ID NO: 1646914 - RNA, 14 nt, Homo sapiens
ugggaaaaccagac

SEQ ID NO: 1646915 - RNA, 18 nt, Homo sapiens
ugggaacuagacucccaa

SEQ ID NO: 1646916 - RNA, 14 nt, Homo sapiens
ugggaagugacuua

SEQ ID NO: 1646917 - RNA, 18 nt, Homo sapiens
ugggacaugggaaagggg

SEQ ID NO: 1646918 - RNA, 14 nt, Homo sapiens
ugggaccugaugac

SEQ ID NO: 1646919 - RNA, 22 nt, Homo sapiens
ugggacuacaggugugagucac

SEQ ID NO: 1646920 - RNA, 17 nt, Homo sapiens
ugggagacacugaugua

SEQ ID NO: 1646921 - RNA, 14 nt, Homo sapiens
ugggagugagggau

SEQ ID NO: 1646922 - RNA, 23 nt, Homo sapiens
ugggauacuauuuaauuauuuca

SEQ ID NO: 1646923 - RNA, 13 nt, Homo sapiens
ugggauuacaggu

SEQ ID NO: 1646924 - RNA, 22 nt, Homo sapiens
ugggcaagggaccugcuucuau

SEQ ID NO: 1646925 - RNA, 14 nt, Homo sapiens
ugggcagagcccaa

SEQ ID NO: 1646926 - RNA, 20 nt, Homo sapiens
ugggccuccucacaacaugg

SEQ ID NO: 1646927 - RNA, 23 nt, Homo sapiens
uggggacagagcagaacuuucac

SEQ ID NO: 1646928 - RNA, 24 nt, Homo sapiens
uggggaccccaccccucaucagga

SEQ ID NO: 1646929 - RNA, 18 nt, Homo sapiens
ugggguacccacugcucu

SEQ ID NO: 1646930 - RNA, 13 nt, Homo sapiens
ugggucaugugca

SEQ ID NO: 1646931 - RNA, 12 nt, Homo sapiens
aaaaaaauggaa

SEQ ID NO: 1646932 - RNA, 21 nt, Homo sapiens
aaaaaaauuuuauagugucuu

SEQ ID NO: 1646933 - RNA, 17 nt, Homo sapiens
aaaaaauuuauuauguc

SEQ ID NO: 1646934 - RNA, 11 nt, Homo sapiens
aaaaacauguu

SEQ ID NO: 1646935 - RNA, 16 nt, Homo sapiens
aaaaauaaagcauuau

SEQ ID NO: 1646936 - RNA, 14 nt, Homo sapiens
aaaaauaaccuugc

SEQ ID NO: 1646937 - RNA, 17 nt, Homo sapiens
aaaaauagcaacuugug

SEQ ID NO: 1646938 - RNA, 15 nt, Homo sapiens
aaaaaucagugaaua

SEQ ID NO: 1646939 - RNA, 16 nt, Homo sapiens
aaaaauccuacuuuca

SEQ ID NO: 1646940 - RNA, 20 nt, Homo sapiens
aaaaauguauaugcacuuau

SEQ ID NO: 1646941 - RNA, 14 nt, Homo sapiens
aaaaauguaucaaa

SEQ ID NO: 1646942 - RNA, 16 nt, Homo sapiens
aaaacaagcauucaca

SEQ ID NO: 1646943 - RNA, 17 nt, Homo sapiens
aaaacacaaaaguuucu

SEQ ID NO: 1646944 - RNA, 11 nt, Homo sapiens
aaaacacugug

SEQ ID NO: 1646945 - RNA, 11 nt, Homo sapiens
aaaacauucca

SEQ ID NO: 1646946 - RNA, 13 nt, Homo sapiens
aaaacauuuuacu

SEQ ID NO: 1646947 - RNA, 23 nt, Homo sapiens
aaaacauuuuacuuuaaaaggag

SEQ ID NO: 1646948 - RNA, 20 nt, Homo sapiens
aaaaccacuggaaaguuuau

SEQ ID NO: 1646949 - RNA, 17 nt, Homo sapiens
aaaagaauaguugccaa

SEQ ID NO: 1646950 - RNA, 19 nt, Homo sapiens
aaaagcaucacaugaacuu

SEQ ID NO: 1646951 - RNA, 13 nt, Homo sapiens
aaaagcauuuucu

SEQ ID NO: 1646952 - RNA, 19 nt, Homo sapiens
aaaagcccauucauuccau

SEQ ID NO: 1646953 - RNA, 22 nt, Homo sapiens
aaaagcuauuagccaggaucau

SEQ ID NO: 1646954 - RNA, 22 nt, Homo sapiens
aaaaggcuaagcuucacuguaa

SEQ ID NO: 1646955 - RNA, 17 nt, Homo sapiens
aaaauaacaucauugua

SEQ ID NO: 1646956 - RNA, 22 nt, Homo sapiens
aaaauaguuuggauuacuuaaa

SEQ ID NO: 1646957 - RNA, 22 nt, Homo sapiens
aaaauauguuuggaauauucca

SEQ ID NO: 1646958 - RNA, 18 nt, Homo sapiens
aaaauauuuucuacaucu

SEQ ID NO: 1646959 - RNA, 19 nt, Homo sapiens
aaaauauuuuuaugugcaa

SEQ ID NO: 1646960 - RNA, 20 nt, Homo sapiens
aaaaucaaacaauucaggga

SEQ ID NO: 1646961 - RNA, 17 nt, Homo sapiens
aaaaucaccucccacca

SEQ ID NO: 1646962 - RNA, 15 nt, Homo sapiens
aaaaucuucagcugg

SEQ ID NO: 1646963 - RNA, 17 nt, Homo sapiens
aaaaugaauuugacugg

SEQ ID NO: 1646964 - RNA, 15 nt, Homo sapiens
aaaaugcaacaacau

SEQ ID NO: 1646965 - RNA, 14 nt, Homo sapiens
aaaaugcaccacuu

SEQ ID NO: 1646966 - RNA, 12 nt, Homo sapiens
aaaaugccuuug

SEQ ID NO: 1646967 - RNA, 12 nt, Homo sapiens
aaaaugugcaau

SEQ ID NO: 1646968 - RNA, 13 nt, Homo sapiens
aaaaugugcaaua

SEQ ID NO: 1646969 - RNA, 15 nt, Homo sapiens
aaaaugugcaauaug

SEQ ID NO: 1646970 - RNA, 18 nt, Homo sapiens
aaaauguucuauuuaaca

SEQ ID NO: 1646971 - RNA, 17 nt, Homo sapiens
aaaauuauggcauauau

SEQ ID NO: 1646972 - RNA, 12 nt, Homo sapiens
aaacaacucuuu

SEQ ID NO: 1646973 - RNA, 13 nt, Homo sapiens
aaacaccaaaaau

SEQ ID NO: 1646974 - RNA, 22 nt, Homo sapiens
aaacacuauauggcagugucuu

SEQ ID NO: 1646975 - RNA, 22 nt, Homo sapiens
aaacagaaaaaaaaauggaagc

SEQ ID NO: 1646976 - RNA, 21 nt, Homo sapiens
aaacagguuauaacaguguuu

SEQ ID NO: 1646977 - RNA, 23 nt, Homo sapiens
aaacauaauaaaucacacauuca

SEQ ID NO: 1646978 - RNA, 14 nt, Homo sapiens
aaacauauuuuaca

SEQ ID NO: 1646979 - RNA, 17 nt, Homo sapiens
aaacaugaaaacauuga

SEQ ID NO: 1646980 - RNA, 18 nt, Homo sapiens
aaacaugugcaacucuug

SEQ ID NO: 1646981 - RNA, 22 nt, Homo sapiens
aaacauguuuaucguauuugau

SEQ ID NO: 1646982 - RNA, 15 nt, Homo sapiens
aaaccaggacauuaa

SEQ ID NO: 1646983 - RNA, 13 nt, Homo sapiens
aaaccaguaucgu

SEQ ID NO: 1646984 - RNA, 22 nt, Homo sapiens
aaaccauuuuguuauugacuaa

SEQ ID NO: 1646985 - RNA, 16 nt, Homo sapiens
aaaccuacacagcugu

SEQ ID NO: 1646986 - RNA, 19 nt, Homo sapiens
aaacguggcaggacuucca

SEQ ID NO: 1646987 - RNA, 17 nt, Homo sapiens
aaacuauguaaugcuua

SEQ ID NO: 1646988 - RNA, 18 nt, Homo sapiens
aaacucaucuugaucaac

SEQ ID NO: 1646989 - RNA, 13 nt, Homo sapiens
aaacuccaucucu

SEQ ID NO: 1646990 - RNA, 19 nt, Homo sapiens
aaacucuggaugauucuuc

SEQ ID NO: 1646991 - RNA, 21 nt, Homo sapiens
aaacucuggaugauucuucca

SEQ ID NO: 1646992 - RNA, 20 nt, Homo sapiens
aaacucuugaccucagguga

SEQ ID NO: 1646993 - RNA, 17 nt, Homo sapiens
aaacugccaaacuauuu

SEQ ID NO: 1646994 - RNA, 16 nt, Homo sapiens
aaacuuagcaacuugg

SEQ ID NO: 1646995 - RNA, 19 nt, Homo sapiens
aaacuuggaauucucucac

SEQ ID NO: 1646996 - RNA, 22 nt, Homo sapiens
aaacuuuauauuguucuuguaa

SEQ ID NO: 1646997 - RNA, 19 nt, Homo sapiens
aaagaaauuuagagucaau

SEQ ID NO: 1646998 - RNA, 13 nt, Homo sapiens
aaagaaauuucca

SEQ ID NO: 1646999 - RNA, 21 nt, Homo sapiens
aaagacaagcucaaguguuca

SEQ ID NO: 1647000 - RNA, 12 nt, Homo sapiens
aaagacagugaa

SEQ ID NO: 1647001 - RNA, 23 nt, Homo sapiens
aaagacuaacaggagaaugcaca

SEQ ID NO: 1647002 - RNA, 19 nt, Homo sapiens
aaagagauuagaacauuua

SEQ ID NO: 1647003 - RNA, 15 nt, Homo sapiens
aaagcaggugcccag

SEQ ID NO: 1647004 - RNA, 15 nt, Homo sapiens
aaagcauuugcugug

SEQ ID NO: 1647005 - RNA, 19 nt, Homo sapiens
aaagccaauaaaugaacug

SEQ ID NO: 1647006 - RNA, 14 nt, Homo sapiens
aaagcccagcuuga

SEQ ID NO: 1647007 - RNA, 15 nt, Homo sapiens
aaagcccauucauuc

SEQ ID NO: 1647008 - RNA, 18 nt, Homo sapiens
aaagcccauucauuccau

SEQ ID NO: 1647009 - RNA, 17 nt, Homo sapiens
aaagcugaguguuucac

SEQ ID NO: 1647010 - RNA, 20 nt, Homo sapiens
aaagcuuaccaaggggaaug

SEQ ID NO: 1647011 - RNA, 12 nt, Homo sapiens
aaagcuucacag

SEQ ID NO: 1647012 - RNA, 16 nt, Homo sapiens
aaagcuucacaguacc

SEQ ID NO: 1647013 - RNA, 23 nt, Homo sapiens
aaagcuuucauguaaacugugca

SEQ ID NO: 1647014 - RNA, 17 nt, Homo sapiens
aaaggacaaacagugaa

SEQ ID NO: 1647015 - RNA, 16 nt, Homo sapiens
aaaggagauaaaucua

SEQ ID NO: 1647016 - RNA, 21 nt, Homo sapiens
aaaggagccaauugauuucaa

SEQ ID NO: 1647017 - RNA, 19 nt, Homo sapiens
aaagggcgcaaagggcaug

SEQ ID NO: 1647018 - RNA, 16 nt, Homo sapiens
aaagguugaagcacca

SEQ ID NO: 1647019 - RNA, 17 nt, Homo sapiens
aaaguacaagagcuuaa

SEQ ID NO: 1647020 - RNA, 14 nt, Homo sapiens
aaaguacuucucca

SEQ ID NO: 1647021 - RNA, 22 nt, Homo sapiens
aaagucugaguaagaaacuuca

SEQ ID NO: 1647022 - RNA, 12 nt, Homo sapiens
aaaguuaugaaa

SEQ ID NO: 1647023 - RNA, 19 nt, Homo sapiens
aaaguugccuuuauuugcu

SEQ ID NO: 1647024 - RNA, 14 nt, Homo sapiens
aaauaagucacuua

SEQ ID NO: 1647025 - RNA, 21 nt, Homo sapiens
aaauacagcuggauuggguua

SEQ ID NO: 1647026 - RNA, 17 nt, Homo sapiens
aaauacuggacucagga

SEQ ID NO: 1647027 - RNA, 15 nt, Homo sapiens
aaauagcagcacagc

SEQ ID NO: 1647028 - RNA, 16 nt, Homo sapiens
aaauagcagcacagcu

SEQ ID NO: 1647029 - RNA, 20 nt, Homo sapiens
aaauagcagcacagcugcca

SEQ ID NO: 1647030 - RNA, 21 nt, Homo sapiens
aaauaguuuggauuacuuaaa

SEQ ID NO: 1647031 - RNA, 23 nt, Homo sapiens
aaauauaauucuuaguggaagac

SEQ ID NO: 1647032 - RNA, 14 nt, Homo sapiens
aaauauccugcuca

SEQ ID NO: 1647033 - RNA, 16 nt, Homo sapiens
aaauauccugcucaca

SEQ ID NO: 1647034 - RNA, 13 nt, Homo sapiens
aaauaugagucau

SEQ ID NO: 1647035 - RNA, 22 nt, Homo sapiens
aaauaugcaccaaaucaucucu

SEQ ID NO: 1647036 - RNA, 13 nt, Homo sapiens
aaauaugcaguga

SEQ ID NO: 1647037 - RNA, 15 nt, Homo sapiens
aaaucaaucacagcu

SEQ ID NO: 1647038 - RNA, 16 nt, Homo sapiens
aaaucaaugcagguuu

SEQ ID NO: 1647039 - RNA, 15 nt, Homo sapiens
aaaucaccucccacc

SEQ ID NO: 1647040 - RNA, 12 nt, Homo sapiens
aaauccaaugac

SEQ ID NO: 1647041 - RNA, 15 nt, Homo sapiens
aaauccuccaaucaa

SEQ ID NO: 1647042 - RNA, 16 nt, Homo sapiens
aaaucucaauucuucc

SEQ ID NO: 1647043 - RNA, 13 nt, Homo sapiens
aaaucucccaaag

SEQ ID NO: 1647044 - RNA, 15 nt, Homo sapiens
aaaucuugacuacag

SEQ ID NO: 1647045 - RNA, 17 nt, Homo sapiens
aaaugaaaaugucuugu

SEQ ID NO: 1647046 - RNA, 12 nt, Homo sapiens
aaaugaacacau

SEQ ID NO: 1647047 - RNA, 20 nt, Homo sapiens
aaaugaaccuugcuaucaag

SEQ ID NO: 1647048 - RNA, 10 nt, Homo sapiens
aaaugagcuc

SEQ ID NO: 1647049 - RNA, 18 nt, Homo sapiens
aaaugaguaaacccagcu

SEQ ID NO: 1647050 - RNA, 18 nt, Homo sapiens
aaaugauuucacagugug

SEQ ID NO: 1647051 - RNA, 12 nt, Homo sapiens
aaaugcaaaaua

SEQ ID NO: 1647052 - RNA, 22 nt, Homo sapiens
aaaugcugagcagcauggauuc

SEQ ID NO: 1647053 - RNA, 16 nt, Homo sapiens
aaaugcugguuuuuca

SEQ ID NO: 1647054 - RNA, 16 nt, Homo sapiens
aaauggccaaugagau

SEQ ID NO: 1647055 - RNA, 17 nt, Homo sapiens
aaaugggaaaaccagac

SEQ ID NO: 1647056 - RNA, 23 nt, Homo sapiens
aaaugggaauuuauaacccagug

SEQ ID NO: 1647057 - RNA, 14 nt, Homo sapiens
aaauggugcugcag

SEQ ID NO: 1647058 - RNA, 22 nt, Homo sapiens
aaauggugcugcagauuugaua

SEQ ID NO: 1647059 - RNA, 17 nt, Homo sapiens
aaaugucacaguaaugc

SEQ ID NO: 1647060 - RNA, 13 nt, Homo sapiens
aaauuaaagcuga

SEQ ID NO: 1647061 - RNA, 17 nt, Homo sapiens
aaauucccaugagucag

SEQ ID NO: 1647062 - RNA, 17 nt, Homo sapiens
aaauucccuucaucugg

SEQ ID NO: 1647063 - RNA, 18 nt, Homo sapiens
aaauuguuguaauugcau

SEQ ID NO: 1647064 - RNA, 16 nt, Homo sapiens
aaauuuaauuaccuua

SEQ ID NO: 1647065 - RNA, 21 nt, Homo sapiens
aaauuuagagucaauuugcug

SEQ ID NO: 1647066 - RNA, 22 nt, Homo sapiens
aaauuucucauuagugguacug

SEQ ID NO: 1647067 - RNA, 15 nt, Homo sapiens
aaauuucucuacugu

SEQ ID NO: 1647068 - RNA, 21 nt, Homo sapiens
aaauuucuguaaaacagguua

SEQ ID NO: 1647069 - RNA, 16 nt, Homo sapiens
aaauuuugugaugaau

SEQ ID NO: 1647070 - RNA, 16 nt, Homo sapiens
aacaaaagcucaucca

SEQ ID NO: 1647071 - RNA, 13 nt, Homo sapiens
aacaaaaggcuuu

SEQ ID NO: 1647072 - RNA, 16 nt, Homo sapiens
aacaaagucacccacu

SEQ ID NO: 1647073 - RNA, 18 nt, Homo sapiens
aacaauccaaaugcauuc

SEQ ID NO: 1647074 - RNA, 14 nt, Homo sapiens
aacacuaauuauca

SEQ ID NO: 1647075 - RNA, 11 nt, Homo sapiens
aacacugugaa

SEQ ID NO: 1647076 - RNA, 17 nt, Homo sapiens
aacagaaauauucuaca

SEQ ID NO: 1647077 - RNA, 14 nt, Homo sapiens
aacagaacuaugga

SEQ ID NO: 1647078 - RNA, 15 nt, Homo sapiens
aacagcacccucucc

SEQ ID NO: 1647079 - RNA, 19 nt, Homo sapiens
aacagccaaaaaggacuuu

SEQ ID NO: 1647080 - RNA, 14 nt, Homo sapiens
aacagccugagaaa

SEQ ID NO: 1647081 - RNA, 21 nt, Homo sapiens
aacaggcugauaccuuuguga

SEQ ID NO: 1647082 - RNA, 13 nt, Homo sapiens
aacaguguucuca

SEQ ID NO: 1647083 - RNA, 14 nt, Homo sapiens
aacaguguucucag

SEQ ID NO: 1647084 - RNA, 21 nt, Homo sapiens
aacauaucauuugugaagaau

SEQ ID NO: 1647085 - RNA, 21 nt, Homo sapiens
aacaucaauuccaguggaaca

SEQ ID NO: 1647086 - RNA, 21 nt, Homo sapiens
aacaucaucaaggcacugccu

SEQ ID NO: 1647087 - RNA, 15 nt, Homo sapiens
aacauccuacaagac

SEQ ID NO: 1647088 - RNA, 16 nt, Homo sapiens
aacauccuacaagaca

SEQ ID NO: 1647089 - RNA, 14 nt, Homo sapiens
aacaugaguuauuc

SEQ ID NO: 1647090 - RNA, 18 nt, Homo sapiens
aacaugccugcaccugca

SEQ ID NO: 1647091 - RNA, 17 nt, Homo sapiens
aacauggaaaacagagu

SEQ ID NO: 1647092 - RNA, 23 nt, Homo sapiens
aacauggugaaacuccaucucua

SEQ ID NO: 1647093 - RNA, 14 nt, Homo sapiens
aacauggugugugu

SEQ ID NO: 1647094 - RNA, 23 nt, Homo sapiens
aacauguauguggauacagucau

SEQ ID NO: 1647095 - RNA, 16 nt, Homo sapiens
aacaugugcucaggga

SEQ ID NO: 1647096 - RNA, 19 nt, Homo sapiens
aacaugugguuaaugccau

SEQ ID NO: 1647097 - RNA, 14 nt, Homo sapiens
aacauguucacuua

SEQ ID NO: 1647098 - RNA, 21 nt, Homo sapiens
aacauguuuaucguauuugau

SEQ ID NO: 1647099 - RNA, 12 nt, Homo sapiens
aacauucaggaa

SEQ ID NO: 1647100 - RNA, 10 nt, Homo sapiens
aacauuccau

SEQ ID NO: 1647101 - RNA, 16 nt, Homo sapiens
aacauuuuguuuaugu

SEQ ID NO: 1647102 - RNA, 14 nt, Homo sapiens
aaccauuugcaaua

SEQ ID NO: 1647103 - RNA, 23 nt, Homo sapiens
aacccaggucuugacaccagcug

SEQ ID NO: 1647104 - RNA, 18 nt, Homo sapiens
aaccccccagcacugagg

SEQ ID NO: 1647105 - RNA, 23 nt, Homo sapiens
aaccccuuuucaguuugaacucu

SEQ ID NO: 1647106 - RNA, 15 nt, Homo sapiens
aacccucuaaaccau

SEQ ID NO: 1647107 - RNA, 14 nt, Homo sapiens
aacccucugugaaa

SEQ ID NO: 1647108 - RNA, 15 nt, Homo sapiens
aacccugugauacua

SEQ ID NO: 1647109 - RNA, 12 nt, Homo sapiens
aaccgucccuga

SEQ ID NO: 1647110 - RNA, 13 nt, Homo sapiens
aaccuacaguuuu

SEQ ID NO: 1647111 - RNA, 11 nt, Homo sapiens
aaccucagggc

SEQ ID NO: 1647112 - RNA, 19 nt, Homo sapiens
aaccucugagucaccaucu

SEQ ID NO: 1647113 - RNA, 21 nt, Homo sapiens
aaccugaauuaucuauuucau

SEQ ID NO: 1647114 - RNA, 14 nt, Homo sapiens
aaccuugcuaucaa

SEQ ID NO: 1647115 - RNA, 11 nt, Homo sapiens
aacguguaugu

SEQ ID NO: 1647116 - RNA, 16 nt, Homo sapiens
aacuauguaaugcuua

SEQ ID NO: 1647117 - RNA, 10 nt, Homo sapiens
aacuauuuaa

SEQ ID NO: 1647118 - RNA, 15 nt, Homo sapiens
aacuauuuaacauuc

SEQ ID NO: 1647119 - RNA, 22 nt, Homo sapiens
aacucaagcuucuucacucaca

SEQ ID NO: 1647120 - RNA, 11 nt, Homo sapiens
aacucaauauu

SEQ ID NO: 1647121 - RNA, 23 nt, Homo sapiens
aacucacuacggaggagaauuaa

SEQ ID NO: 1647122 - RNA, 16 nt, Homo sapiens
aacucauacugugcug

SEQ ID NO: 1647123 - RNA, 22 nt, Homo sapiens
aacucaugacugagucuggcaa

SEQ ID NO: 1647124 - RNA, 11 nt, Homo sapiens
aacuccugacc

SEQ ID NO: 1647125 - RNA, 22 nt, Homo sapiens
aacucugcaacugaauacuuga

SEQ ID NO: 1647126 - RNA, 12 nt, Homo sapiens
aacucuguacaa

SEQ ID NO: 1647127 - RNA, 14 nt, Homo sapiens
aacucuugaccuca

SEQ ID NO: 1647128 - RNA, 21 nt, Homo sapiens
aacucuuguauugcuccauuu

SEQ ID NO: 1647129 - RNA, 15 nt, Homo sapiens
aacugagcaucucca

SEQ ID NO: 1647130 - RNA, 18 nt, Homo sapiens
aacugccaucauuuacuu

SEQ ID NO: 1647131 - RNA, 23 nt, Homo sapiens
aacugcugagagacagagcuauu

SEQ ID NO: 1647132 - RNA, 16 nt, Homo sapiens
aacuggaugaggucau

SEQ ID NO: 1647133 - RNA, 15 nt, Homo sapiens
aacuguggugccaca

SEQ ID NO: 1647134 - RNA, 17 nt, Homo sapiens
aacuguuaacuaugaca

SEQ ID NO: 1647135 - RNA, 12 nt, Homo sapiens
aacuuccacucc

SEQ ID NO: 1647136 - RNA, 12 nt, Homo sapiens
aacuucuuucac

SEQ ID NO: 1647137 - RNA, 23 nt, Homo sapiens
aacuuggaaauagugauuuccac

SEQ ID NO: 1647138 - RNA, 19 nt, Homo sapiens
aacuuggauguaccugccc

SEQ ID NO: 1647139 - RNA, 21 nt, Homo sapiens
aacuugggggaccucauuccu

SEQ ID NO: 1647140 - RNA, 17 nt, Homo sapiens
aacuuuauacacuugga

SEQ ID NO: 1647141 - RNA, 18 nt, Homo sapiens
aagaaauccuccaaucaa

SEQ ID NO: 1647142 - RNA, 16 nt, Homo sapiens
aagaaccugucccagg

SEQ ID NO: 1647143 - RNA, 14 nt, Homo sapiens
aagaacuagcauaa

SEQ ID NO: 1647144 - RNA, 12 nt, Homo sapiens
aagaacuucccc

SEQ ID NO: 1647145 - RNA, 20 nt, Homo sapiens
aagaacuuccccauacaaau

SEQ ID NO: 1647146 - RNA, 22 nt, Homo sapiens
aagaagagcgagagaucaaaga

SEQ ID NO: 1647147 - RNA, 14 nt, Homo sapiens
aagaaguuaaauga

SEQ ID NO: 1647148 - RNA, 15 nt, Homo sapiens
aagaaguucauuuug

SEQ ID NO: 1647149 - RNA, 20 nt, Homo sapiens
aagaaugucuguaccuugau

SEQ ID NO: 1647150 - RNA, 15 nt, Homo sapiens
aagaauuacauauga

SEQ ID NO: 1647151 - RNA, 23 nt, Homo sapiens
aagaauuuuuauauccacuaaaa

SEQ ID NO: 1647152 - RNA, 13 nt, Homo sapiens
aagacaauggcuu

SEQ ID NO: 1647153 - RNA, 16 nt, Homo sapiens
aagacagagcugggau

SEQ ID NO: 1647154 - RNA, 16 nt, Homo sapiens
aagaccaccaccucag

SEQ ID NO: 1647155 - RNA, 18 nt, Homo sapiens
aagaccuucuccuucacc

SEQ ID NO: 1647156 - RNA, 14 nt, Homo sapiens
aagacgugauucaa

SEQ ID NO: 1647157 - RNA, 17 nt, Homo sapiens
aagacuauugugccuua

SEQ ID NO: 1647158 - RNA, 14 nt, Homo sapiens
aagacucagugggg

SEQ ID NO: 1647159 - RNA, 15 nt, Homo sapiens
aagacugcugcugaa

SEQ ID NO: 1647160 - RNA, 21 nt, Homo sapiens
aagacuguuauuucaccauuu

SEQ ID NO: 1647161 - RNA, 19 nt, Homo sapiens
aagacuuuggaaagacuuu

SEQ ID NO: 1647162 - RNA, 17 nt, Homo sapiens
aagagcacacuuggccc

SEQ ID NO: 1647163 - RNA, 22 nt, Homo sapiens
aagagcagugguaagaauagua

SEQ ID NO: 1647164 - RNA, 17 nt, Homo sapiens
aagagccaggugcugcu

SEQ ID NO: 1647165 - RNA, 17 nt, Homo sapiens
aagagcuuaacagugug

SEQ ID NO: 1647166 - RNA, 14 nt, Homo sapiens
aagaggcagggucu

SEQ ID NO: 1647167 - RNA, 14 nt, Homo sapiens
aagaggccugugau

SEQ ID NO: 1647168 - RNA, 19 nt, Homo sapiens
aagagggcacacacugugu

SEQ ID NO: 1647169 - RNA, 19 nt, Homo sapiens
aagaguaggaagacuuugg

SEQ ID NO: 1647170 - RNA, 19 nt, Homo sapiens
aagagugagacuccaccuc

SEQ ID NO: 1647171 - RNA, 23 nt, Homo sapiens
aagauacugaggaaugucuuuca

SEQ ID NO: 1647172 - RNA, 17 nt, Homo sapiens
aagauccaauucaucuu

SEQ ID NO: 1647173 - RNA, 20 nt, Homo sapiens
aagaugcauuaucuaugaua

SEQ ID NO: 1647174 - RNA, 23 nt, Homo sapiens
aagauguaugcuuugaaugcaaa

SEQ ID NO: 1647175 - RNA, 17 nt, Homo sapiens
aagcaaugguugaugau

SEQ ID NO: 1647176 - RNA, 19 nt, Homo sapiens
aagcacagauguucuucaa

SEQ ID NO: 1647177 - RNA, 14 nt, Homo sapiens
aagcaccaagcuca

SEQ ID NO: 1647178 - RNA, 15 nt, Homo sapiens
aagcagaccacugau

SEQ ID NO: 1647179 - RNA, 20 nt, Homo sapiens
aagcaggaaaugaaaauguc

SEQ ID NO: 1647180 - RNA, 20 nt, Homo sapiens
aagccacagcuggugguauc

SEQ ID NO: 1647181 - RNA, 18 nt, Homo sapiens
aagccacgaggugcagua

SEQ ID NO: 1647182 - RNA, 23 nt, Homo sapiens
aagccauggagugagacccagga

SEQ ID NO: 1647183 - RNA, 15 nt, Homo sapiens
aagccauguguucca

SEQ ID NO: 1647184 - RNA, 14 nt, Homo sapiens
aagcccauucauuc

SEQ ID NO: 1647185 - RNA, 23 nt, Homo sapiens
aagccucugugucacuggcugcc

SEQ ID NO: 1647186 - RNA, 16 nt, Homo sapiens
aagccugacccuguaa

SEQ ID NO: 1647187 - RNA, 22 nt, Homo sapiens
aagccugacccuguaaaaugga

SEQ ID NO: 1647188 - RNA, 16 nt, Homo sapiens
aagcgcuucuuucuga

SEQ ID NO: 1647189 - RNA, 17 nt, Homo sapiens
aagcgugagccacugca

SEQ ID NO: 1647190 - RNA, 15 nt, Homo sapiens
aagcuagaaccugga

SEQ ID NO: 1647191 - RNA, 18 nt, Homo sapiens
aagcucaggaccaggcaa

SEQ ID NO: 1647192 - RNA, 14 nt, Homo sapiens
aagcucauccauuu

SEQ ID NO: 1647193 - RNA, 13 nt, Homo sapiens
aagcucaucucag

SEQ ID NO: 1647194 - RNA, 23 nt, Homo sapiens
aagcugagucucccuaaggcaug

SEQ ID NO: 1647195 - RNA, 21 nt, Homo sapiens
aagcugugccacccugggcuc

SEQ ID NO: 1647196 - RNA, 17 nt, Homo sapiens
aagcuguuguacauuua

SEQ ID NO: 1647197 - RNA, 12 nt, Homo sapiens
aaggaaacacuu

SEQ ID NO: 1647198 - RNA, 16 nt, Homo sapiens
aaggaaacacuucuau

SEQ ID NO: 1647199 - RNA, 18 nt, Homo sapiens
aaggaacauguacuguua

SEQ ID NO: 1647200 - RNA, 15 nt, Homo sapiens
aaggaagccacagcu

SEQ ID NO: 1647201 - RNA, 14 nt, Homo sapiens
aaggaauccacucc

SEQ ID NO: 1647202 - RNA, 11 nt, Homo sapiens
aaggacucuca

SEQ ID NO: 1647203 - RNA, 22 nt, Homo sapiens
aaggagauucaaacucaaugau

SEQ ID NO: 1647204 - RNA, 15 nt, Homo sapiens
aaggagcugauacuu

SEQ ID NO: 1647205 - RNA, 18 nt, Homo sapiens
aaggaggccacgugaugu

SEQ ID NO: 1647206 - RNA, 13 nt, Homo sapiens
aaggauccaucuu

SEQ ID NO: 1647207 - RNA, 18 nt, Homo sapiens
aaggaugugggggaagac

SEQ ID NO: 1647208 - RNA, 17 nt, Homo sapiens
aaggcacgggagcugcc

SEQ ID NO: 1647209 - RNA, 13 nt, Homo sapiens
aaggccucugugg

SEQ ID NO: 1647210 - RNA, 19 nt, Homo sapiens
aaggcuauauuucugggau

SEQ ID NO: 1647211 - RNA, 13 nt, Homo sapiens
aagggaggcacuu

SEQ ID NO: 1647212 - RNA, 20 nt, Homo sapiens
aagggccagcuggaggugaa

SEQ ID NO: 1647213 - RNA, 16 nt, Homo sapiens
aagggcgcuuguccca

SEQ ID NO: 1647214 - RNA, 18 nt, Homo sapiens
aagggcucacgcauucag

SEQ ID NO: 1647215 - RNA, 20 nt, Homo sapiens
aagggcucagagaggacaaa

SEQ ID NO: 1647216 - RNA, 19 nt, Homo sapiens
aagggcuuggacucaagca

SEQ ID NO: 1647217 - RNA, 17 nt, Homo sapiens
aaggggacaauggcaga

SEQ ID NO: 1647218 - RNA, 14 nt, Homo sapiens
aagggucuguuuaa

SEQ ID NO: 1647219 - RNA, 17 nt, Homo sapiens
aagguauauugugaacc

SEQ ID NO: 1647220 - RNA, 14 nt, Homo sapiens
aaggugacaugaca

SEQ ID NO: 1647221 - RNA, 17 nt, Homo sapiens
aaggugagcaaagggcu

SEQ ID NO: 1647222 - RNA, 17 nt, Homo sapiens
aagguggggacagggau

SEQ ID NO: 1647223 - RNA, 19 nt, Homo sapiens
aagguggggacagggauga

SEQ ID NO: 1647224 - RNA, 15 nt, Homo sapiens
aagguggucacuguu

SEQ ID NO: 1647225 - RNA, 24 nt, Homo sapiens
aaggugugcucugaucauccacug

SEQ ID NO: 1647226 - RNA, 19 nt, Homo sapiens
aaguaauuccguagguuau

SEQ ID NO: 1647227 - RNA, 18 nt, Homo sapiens
aaguacauguuaaacuua

SEQ ID NO: 1647228 - RNA, 22 nt, Homo sapiens
aaguacuguaacugugucauga

SEQ ID NO: 1647229 - RNA, 16 nt, Homo sapiens
aagucauaccaaugaa

SEQ ID NO: 1647230 - RNA, 22 nt, Homo sapiens
aaguccuacuuuuaaagaauuu

SEQ ID NO: 1647231 - RNA, 16 nt, Homo sapiens
aagucgucuuaacuca

SEQ ID NO: 1647232 - RNA, 23 nt, Homo sapiens
aagucuuccauagagacuuugug

SEQ ID NO: 1647233 - RNA, 16 nt, Homo sapiens
aagugaauuguugaca

SEQ ID NO: 1647234 - RNA, 13 nt, Homo sapiens
aagugaguggcau

SEQ ID NO: 1647235 - RNA, 20 nt, Homo sapiens
aagugauccucccaccucag

SEQ ID NO: 1647236 - RNA, 20 nt, Homo sapiens
aagugauccuuccaccucag

SEQ ID NO: 1647237 - RNA, 21 nt, Homo sapiens
aagugauccuuccaccucagu

SEQ ID NO: 1647238 - RNA, 22 nt, Homo sapiens
aagugcacaacauuacagggaa

SEQ ID NO: 1647239 - RNA, 21 nt, Homo sapiens
aagugcugggauuacaggugu

SEQ ID NO: 1647240 - RNA, 20 nt, Homo sapiens
aagugugcuggccucucuga

SEQ ID NO: 1647241 - RNA, 17 nt, Homo sapiens
aaguucaggcucugaga

SEQ ID NO: 1647242 - RNA, 16 nt, Homo sapiens
aaguucauggaacuca

SEQ ID NO: 1647243 - RNA, 19 nt, Homo sapiens
aaguugauucauauugcau

SEQ ID NO: 1647244 - RNA, 17 nt, Homo sapiens
aaguugcucugaaguca

SEQ ID NO: 1647245 - RNA, 16 nt, Homo sapiens
aaguuuaauugacuua

SEQ ID NO: 1647246 - RNA, 17 nt, Homo sapiens
aaguuuagugcccucau

SEQ ID NO: 1647247 - RNA, 20 nt, Homo sapiens
aaguuuagugcccucaucca

SEQ ID NO: 1647248 - RNA, 19 nt, Homo sapiens
aaguuucuuaaagcaacac

SEQ ID NO: 1647249 - RNA, 20 nt, Homo sapiens
aaguuuuggaaagaguucaa

SEQ ID NO: 1647250 - RNA, 21 nt, Homo sapiens
aaguuuuguggaggagcucag

SEQ ID NO: 1647251 - RNA, 22 nt, Homo sapiens
aauaaaagaauaguugccaagg

SEQ ID NO: 1647252 - RNA, 18 nt, Homo sapiens
aauaaaguucuguacuca

SEQ ID NO: 1647253 - RNA, 14 nt, Homo sapiens
aauaaauacugcag

SEQ ID NO: 1647254 - RNA, 13 nt, Homo sapiens
aauaauaaauuaa

SEQ ID NO: 1647255 - RNA, 15 nt, Homo sapiens
aauaaugcaccacuu

SEQ ID NO: 1647256 - RNA, 17 nt, Homo sapiens
aauaauugcaaauaucc

SEQ ID NO: 1647257 - RNA, 17 nt, Homo sapiens
aauacaauuaaagcaaa

SEQ ID NO: 1647258 - RNA, 17 nt, Homo sapiens
aauacagauuuguaaca

SEQ ID NO: 1647259 - RNA, 19 nt, Homo sapiens
aauacauuguacuuauaca

SEQ ID NO: 1647260 - RNA, 13 nt, Homo sapiens
aauacucagggaa

SEQ ID NO: 1647261 - RNA, 19 nt, Homo sapiens
aauacucagggaaagcauu

SEQ ID NO: 1647262 - RNA, 21 nt, Homo sapiens
aauacucagggaaagcauuua

SEQ ID NO: 1647263 - RNA, 12 nt, Homo sapiens
aauagauaugaa

SEQ ID NO: 1647264 - RNA, 15 nt, Homo sapiens
aauagcaacuugugu

SEQ ID NO: 1647265 - RNA, 24 nt, Homo sapiens
aauaggagaggaugagagcccaga

SEQ ID NO: 1647266 - RNA, 21 nt, Homo sapiens
aauagucuaaggccauggcau

SEQ ID NO: 1647267 - RNA, 21 nt, Homo sapiens
aauauauuuuuugaacuuugu

SEQ ID NO: 1647268 - RNA, 18 nt, Homo sapiens
aauaucuuuaaaugaugu

SEQ ID NO: 1647269 - RNA, 15 nt, Homo sapiens
aauauuccuuugcau

SEQ ID NO: 1647270 - RNA, 17 nt, Homo sapiens
aauauuuauugaauuau

SEQ ID NO: 1647271 - RNA, 18 nt, Homo sapiens
aauauuugcaagacauag

SEQ ID NO: 1647272 - RNA, 18 nt, Homo sapiens
aauauuuuauaccaaagc

SEQ ID NO: 1647273 - RNA, 14 nt, Homo sapiens
aauauuuucuacau

SEQ ID NO: 1647274 - RNA, 20 nt, Homo sapiens
aaucaaagcagauauauuaa

SEQ ID NO: 1647275 - RNA, 20 nt, Homo sapiens
aaucaagucagcaacagagc

SEQ ID NO: 1647276 - RNA, 18 nt, Homo sapiens
aaucacuggcuguuaauc

SEQ ID NO: 1647277 - RNA, 23 nt, Homo sapiens
aaucacuggcuguuaaucuuuca

SEQ ID NO: 1647278 - RNA, 14 nt, Homo sapiens
aaucacugucaaua

SEQ ID NO: 1647279 - RNA, 20 nt, Homo sapiens
aaucaguguguuacuaucua

SEQ ID NO: 1647280 - RNA, 23 nt, Homo sapiens
aaucauaaauauaaucuaauaca

SEQ ID NO: 1647281 - RNA, 18 nt, Homo sapiens
aaucauacaaauacuauc

SEQ ID NO: 1647282 - RNA, 21 nt, Homo sapiens
aaucaucucucaucacuuuuc

SEQ ID NO: 1647283 - RNA, 15 nt, Homo sapiens
aauccaaaugcauuc

SEQ ID NO: 1647284 - RNA, 16 nt, Homo sapiens
aauccagacccggcug

SEQ ID NO: 1647285 - RNA, 12 nt, Homo sapiens
aauccaguauua

SEQ ID NO: 1647286 - RNA, 22 nt, Homo sapiens
aauccauucuuaaaguacuugu

SEQ ID NO: 1647287 - RNA, 24 nt, Homo sapiens
aauccauucuuaaaguacuuguua

SEQ ID NO: 1647288 - RNA, 13 nt, Homo sapiens
aaucccagcacuu

SEQ ID NO: 1647289 - RNA, 19 nt, Homo sapiens
aauccccagauauuuaugu

SEQ ID NO: 1647290 - RNA, 16 nt, Homo sapiens
aaucccccagcacuuc

SEQ ID NO: 1647291 - RNA, 10 nt, Homo sapiens
aaucccucaa

SEQ ID NO: 1647292 - RNA, 20 nt, Homo sapiens
aauccugaauaaaccaguau

SEQ ID NO: 1647293 - RNA, 22 nt, Homo sapiens
aauccuguaccaaaucugacau

SEQ ID NO: 1647294 - RNA, 23 nt, Homo sapiens
aaucuaccaacgaaagacgugau

SEQ ID NO: 1647295 - RNA, 14 nt, Homo sapiens
aaucuaugaugaag

SEQ ID NO: 1647296 - RNA, 14 nt, Homo sapiens
aaucugagaaucac

SEQ ID NO: 1647297 - RNA, 13 nt, Homo sapiens
aaucugcacugug

SEQ ID NO: 1647298 - RNA, 23 nt, Homo sapiens
aaucugccugauaggacccauau

SEQ ID NO: 1647299 - RNA, 23 nt, Homo sapiens
aaucuggagagcuagaaccugga

SEQ ID NO: 1647300 - RNA, 13 nt, Homo sapiens
aaucuggauucau

SEQ ID NO: 1647301 - RNA, 20 nt, Homo sapiens
aaucuuucaaagugucuuga

SEQ ID NO: 1647302 - RNA, 13 nt, Homo sapiens
aaucuuuucacaa

SEQ ID NO: 1647303 - RNA, 12 nt, Homo sapiens
aaugaaagugag

SEQ ID NO: 1647304 - RNA, 18 nt, Homo sapiens
aaugaaccuugcuaucaa

SEQ ID NO: 1647305 - RNA, 14 nt, Homo sapiens
aaugaauacuuuau

SEQ ID NO: 1647306 - RNA, 15 nt, Homo sapiens
aaugacauucaauaa

SEQ ID NO: 1647307 - RNA, 19 nt, Homo sapiens
aaugacguugagcaucuau

SEQ ID NO: 1647308 - RNA, 21 nt, Homo sapiens
aaugagaagaaugacuaugca

SEQ ID NO: 1647309 - RNA, 23 nt, Homo sapiens
aaugagcaaaaccaaauauucca

SEQ ID NO: 1647310 - RNA, 16 nt, Homo sapiens
aaugaucagcuauaua

SEQ ID NO: 1647311 - RNA, 14 nt, Homo sapiens
aaugauuaguuaaa

SEQ ID NO: 1647312 - RNA, 23 nt, Homo sapiens
aaugauuucacagugugugguca

SEQ ID NO: 1647313 - RNA, 12 nt, Homo sapiens
aaugcaccacuu

SEQ ID NO: 1647314 - RNA, 19 nt, Homo sapiens
aaugcauauccaacaugug

SEQ ID NO: 1647315 - RNA, 21 nt, Homo sapiens
aaugccauccucaaacacugc

SEQ ID NO: 1647316 - RNA, 23 nt, Homo sapiens
aaugcucugucuucaaugaucaa

SEQ ID NO: 1647317 - RNA, 18 nt, Homo sapiens
aaugggcagcucaucucu

SEQ ID NO: 1647318 - RNA, 17 nt, Homo sapiens
aaugguugaugauacuu

SEQ ID NO: 1647319 - RNA, 19 nt, Homo sapiens
aaugguuuucuaauaucuu

SEQ ID NO: 1647320 - RNA, 17 nt, Homo sapiens
aaugucuguaccuugau

SEQ ID NO: 1647321 - RNA, 23 nt, Homo sapiens
aaugucuuuauuaaauguagaaa

SEQ ID NO: 1647322 - RNA, 11 nt, Homo sapiens
aaugugcaaua

SEQ ID NO: 1647323 - RNA, 23 nt, Homo sapiens
aaugugguugaagagcaaugugu

SEQ ID NO: 1647324 - RNA, 19 nt, Homo sapiens
aaugugucugcaacaugga

SEQ ID NO: 1647325 - RNA, 16 nt, Homo sapiens
aauguuuuuaagauuu

SEQ ID NO: 1647326 - RNA, 17 nt, Homo sapiens
aauuaacugcuccaaau

SEQ ID NO: 1647327 - RNA, 12 nt, Homo sapiens
aauuaaguuaca

SEQ ID NO: 1647328 - RNA, 18 nt, Homo sapiens
aauuaccaugcuucacaa

SEQ ID NO: 1647329 - RNA, 21 nt, Homo sapiens
aauuacccuacuuucauuccu

SEQ ID NO: 1647330 - RNA, 17 nt, Homo sapiens
aauuacggaaaaugccu

SEQ ID NO: 1647331 - RNA, 15 nt, Homo sapiens
aauucggugugcacc

SEQ ID NO: 1647332 - RNA, 20 nt, Homo sapiens
aauucuagcuuugagcuuaa

SEQ ID NO: 1647333 - RNA, 16 nt, Homo sapiens
aauucucuagggcuag

SEQ ID NO: 1647334 - RNA, 24 nt, Homo sapiens
aauucucucaccucuaacaucaga

SEQ ID NO: 1647335 - RNA, 19 nt, Homo sapiens
aauucuuacaaacaugugg

SEQ ID NO: 1647336 - RNA, 17 nt, Homo sapiens
aauucuuagucacaaaa

SEQ ID NO: 1647337 - RNA, 21 nt, Homo sapiens
aauucuuaguggaagacaaua

SEQ ID NO: 1647338 - RNA, 15 nt, Homo sapiens
aauugaucauucaua

SEQ ID NO: 1647339 - RNA, 14 nt, Homo sapiens
aauugcacauaguu

SEQ ID NO: 1647340 - RNA, 22 nt, Homo sapiens
aauugcacauaguucugcccaa

SEQ ID NO: 1647341 - RNA, 21 nt, Homo sapiens
aauuguuguaauugcauuaua

SEQ ID NO: 1647342 - RNA, 12 nt, Homo sapiens
aauuuaacaaga

SEQ ID NO: 1647343 - RNA, 15 nt, Homo sapiens
aauuuagagucaauu

SEQ ID NO: 1647344 - RNA, 21 nt, Homo sapiens
aauuuauggaaucuaccaacu

SEQ ID NO: 1647345 - RNA, 21 nt, Homo sapiens
aauuugaaaccaggacauuaa

SEQ ID NO: 1647346 - RNA, 17 nt, Homo sapiens
aauuuggagauacguaa

SEQ ID NO: 1647347 - RNA, 17 nt, Homo sapiens
aauuugggagagccaua

SEQ ID NO: 1647348 - RNA, 20 nt, Homo sapiens
aauuugggagagccauacau

SEQ ID NO: 1647349 - RNA, 13 nt, Homo sapiens
acaaaaauuagcu

SEQ ID NO: 1647350 - RNA, 14 nt, Homo sapiens
acaaaaccacugga

SEQ ID NO: 1647351 - RNA, 13 nt, Homo sapiens
acaaaaggcuuug

SEQ ID NO: 1647352 - RNA, 11 nt, Homo sapiens
acaaacaguga

SEQ ID NO: 1647353 - RNA, 19 nt, Homo sapiens
acaaacuucuuucacucac

SEQ ID NO: 1647354 - RNA, 15 nt, Homo sapiens
acaaagaaacaaaga

SEQ ID NO: 1647355 - RNA, 22 nt, Homo sapiens
acaaauccaaugaaaugaguuu

SEQ ID NO: 1647356 - RNA, 13 nt, Homo sapiens
acaaauguaugau

SEQ ID NO: 1647357 - RNA, 14 nt, Homo sapiens
acaaaugugauaau

SEQ ID NO: 1647358 - RNA, 17 nt, Homo sapiens
acaacauguauaauauu

SEQ ID NO: 1647359 - RNA, 16 nt, Homo sapiens
acaacuaugauuugga

SEQ ID NO: 1647360 - RNA, 16 nt, Homo sapiens
acaacuuccacuccaa

SEQ ID NO: 1647361 - RNA, 21 nt, Homo sapiens
acaacuuccacuccaagugag

SEQ ID NO: 1647362 - RNA, 22 nt, Homo sapiens
acaagaccaucuacauacacag

SEQ ID NO: 1647363 - RNA, 21 nt, Homo sapiens
acaagagugagacuccaccuc

SEQ ID NO: 1647364 - RNA, 16 nt, Homo sapiens
acaaguuccugauaac

SEQ ID NO: 1647365 - RNA, 16 nt, Homo sapiens
acaauaaaacauuaau

SEQ ID NO: 1647366 - RNA, 18 nt, Homo sapiens
acaauaacgauaaaagac

SEQ ID NO: 1647367 - RNA, 16 nt, Homo sapiens
acaauaguaauucuca

SEQ ID NO: 1647368 - RNA, 18 nt, Homo sapiens
acaauauuuaaaauauua

SEQ ID NO: 1647369 - RNA, 14 nt, Homo sapiens
acaaucagcuccuu

SEQ ID NO: 1647370 - RNA, 17 nt, Homo sapiens
acaauggcuuacuccag

SEQ ID NO: 1647371 - RNA, 18 nt, Homo sapiens
acaaugguuucaccaucc

SEQ ID NO: 1647372 - RNA, 17 nt, Homo sapiens
acaauguugcacugaaa

SEQ ID NO: 1647373 - RNA, 20 nt, Homo sapiens
acaauguuuuaaacauucuu

SEQ ID NO: 1647374 - RNA, 13 nt, Homo sapiens
acaauucagugac

SEQ ID NO: 1647375 - RNA, 14 nt, Homo sapiens
acaauugugaaguc

SEQ ID NO: 1647376 - RNA, 13 nt, Homo sapiens
acacaacaacucc

SEQ ID NO: 1647377 - RNA, 13 nt, Homo sapiens
acacaacauguau

SEQ ID NO: 1647378 - RNA, 15 nt, Homo sapiens
acacaacauguaugu

SEQ ID NO: 1647379 - RNA, 18 nt, Homo sapiens
acacaauacauguuuuca

SEQ ID NO: 1647380 - RNA, 12 nt, Homo sapiens
acacacaguacg

SEQ ID NO: 1647381 - RNA, 12 nt, Homo sapiens
acacacauacag

SEQ ID NO: 1647382 - RNA, 23 nt, Homo sapiens
acacacuuguugauuaauggaaa

SEQ ID NO: 1647383 - RNA, 21 nt, Homo sapiens
acacagcacgggggccaagga

SEQ ID NO: 1647384 - RNA, 17 nt, Homo sapiens
acacagcucccauaacc

SEQ ID NO: 1647385 - RNA, 21 nt, Homo sapiens
acacaggcccggcuccaggcu

SEQ ID NO: 1647386 - RNA, 12 nt, Homo sapiens
acacauacacac

SEQ ID NO: 1647387 - RNA, 17 nt, Homo sapiens
acacauacagagcucuc

SEQ ID NO: 1647388 - RNA, 11 nt, Homo sapiens
acaccaaaaau

SEQ ID NO: 1647389 - RNA, 21 nt, Homo sapiens
acaccauccaggaagacccca

SEQ ID NO: 1647390 - RNA, 11 nt, Homo sapiens
acacccuguga

SEQ ID NO: 1647391 - RNA, 21 nt, Homo sapiens
acaccugcauucuucccuuau

SEQ ID NO: 1647392 - RNA, 21 nt, Homo sapiens
acaccugcggcccaauccaag

SEQ ID NO: 1647393 - RNA, 14 nt, Homo sapiens
acacgcgugcacac

SEQ ID NO: 1647394 - RNA, 21 nt, Homo sapiens
acacggcagcugcuggcugug

SEQ ID NO: 1647395 - RNA, 20 nt, Homo sapiens
acacucaagaagcaggcuac

SEQ ID NO: 1647396 - RNA, 23 nt, Homo sapiens
acacucaccugcacuaacagagu

SEQ ID NO: 1647397 - RNA, 22 nt, Homo sapiens
acacucauuuccaaucauacaa

SEQ ID NO: 1647398 - RNA, 22 nt, Homo sapiens
acacucuucugaauugacugua

SEQ ID NO: 1647399 - RNA, 17 nt, Homo sapiens
acacugagacuugaauc

SEQ ID NO: 1647400 - RNA, 23 nt, Homo sapiens
acacugagacuugaaucaaguca

SEQ ID NO: 1647401 - RNA, 15 nt, Homo sapiens
acacugcaggcauca

SEQ ID NO: 1647402 - RNA, 18 nt, Homo sapiens
acacuguuaucuucacuu

SEQ ID NO: 1647403 - RNA, 14 nt, Homo sapiens
acagaacacugucu

SEQ ID NO: 1647404 - RNA, 18 nt, Homo sapiens
acagaacagucucuggaa

SEQ ID NO: 1647405 - RNA, 15 nt, Homo sapiens
acagaagacagcagc

SEQ ID NO: 1647406 - RNA, 16 nt, Homo sapiens
acagacuugaaugcua

SEQ ID NO: 1647407 - RNA, 17 nt, Homo sapiens
acagagaaaagacauaa

SEQ ID NO: 1647408 - RNA, 16 nt, Homo sapiens
acagagcucucugagg

SEQ ID NO: 1647409 - RNA, 19 nt, Homo sapiens
acagagcuucccugacuca

SEQ ID NO: 1647410 - RNA, 22 nt, Homo sapiens
cuauagccuaagcggcuguuua

SEQ ID NO: 1647411 - RNA, 18 nt, Homo sapiens
cuaucccuuuccaaaggc

SEQ ID NO: 1647412 - RNA, 21 nt, Homo sapiens
cuaucuauaccuuacugcaau

SEQ ID NO: 1647413 - RNA, 18 nt, Homo sapiens
cuaucugacuucauacau

SEQ ID NO: 1647414 - RNA, 20 nt, Homo sapiens
cuaucuuugagcgcccacua

SEQ ID NO: 1647415 - RNA, 18 nt, Homo sapiens
cuaucuuugccacccuca

SEQ ID NO: 1647416 - RNA, 20 nt, Homo sapiens
cuaugaaauaucaugcucca

SEQ ID NO: 1647417 - RNA, 21 nt, Homo sapiens
cuaugaaauaucaugcuccau

SEQ ID NO: 1647418 - RNA, 16 nt, Homo sapiens
cuauggcacccaugca

SEQ ID NO: 1647419 - RNA, 14 nt, Homo sapiens
cuauguaacaugua

SEQ ID NO: 1647420 - RNA, 13 nt, Homo sapiens
cuaugugcaugca

SEQ ID NO: 1647421 - RNA, 14 nt, Homo sapiens
cuaugugcaugcag

SEQ ID NO: 1647422 - RNA, 14 nt, Homo sapiens
cuauguuauauuga

SEQ ID NO: 1647423 - RNA, 14 nt, Homo sapiens
cuauguugcccagg

SEQ ID NO: 1647424 - RNA, 12 nt, Homo sapiens
cuauuaucucaa

SEQ ID NO: 1647425 - RNA, 14 nt, Homo sapiens
cuauuuaacaacug

SEQ ID NO: 1647426 - RNA, 15 nt, Homo sapiens
cuauuuaacaacugg

SEQ ID NO: 1647427 - RNA, 16 nt, Homo sapiens
cuauuuaaugcuucca

SEQ ID NO: 1647428 - RNA, 21 nt, Homo sapiens
cuauuuaauuauuucacuuua

SEQ ID NO: 1647429 - RNA, 22 nt, Homo sapiens
cuauuuaauuauuucacuuuag

SEQ ID NO: 1647430 - RNA, 22 nt, Homo sapiens
cuauuuauuuauuuauucauua

SEQ ID NO: 1647431 - RNA, 21 nt, Homo sapiens
cuauuucaauacuuacauauc

SEQ ID NO: 1647432 - RNA, 12 nt, Homo sapiens
cuauuuucacaa

SEQ ID NO: 1647433 - RNA, 23 nt, Homo sapiens
cuauuuuuauuuguuugugcauu

SEQ ID NO: 1647434 - RNA, 18 nt, Homo sapiens
cucaagcuucuucacuca

SEQ ID NO: 1647435 - RNA, 15 nt, Homo sapiens
cucaaguuccagugc

SEQ ID NO: 1647436 - RNA, 17 nt, Homo sapiens
cucaaguuccagugcag

SEQ ID NO: 1647437 - RNA, 15 nt, Homo sapiens
cucaauucugucuca

SEQ ID NO: 1647438 - RNA, 13 nt, Homo sapiens
cucaauugggaaa

SEQ ID NO: 1647439 - RNA, 17 nt, Homo sapiens
cucacaucugaaucucc

SEQ ID NO: 1647440 - RNA, 20 nt, Homo sapiens
cucacaucuuuuucacugac

SEQ ID NO: 1647441 - RNA, 17 nt, Homo sapiens
cucacauuuauucugcu

SEQ ID NO: 1647442 - RNA, 21 nt, Homo sapiens
cucaccuaaacccucugugaa

SEQ ID NO: 1647443 - RNA, 14 nt, Homo sapiens
cucacguccaucac

SEQ ID NO: 1647444 - RNA, 10 nt, Homo sapiens
cucacuccuu

SEQ ID NO: 1647445 - RNA, 18 nt, Homo sapiens
cucacucugucacccagg

SEQ ID NO: 1647446 - RNA, 21 nt, Homo sapiens
cucacuggucaaaaccuacac

SEQ ID NO: 1647447 - RNA, 14 nt, Homo sapiens
cucacuguugugaa

SEQ ID NO: 1647448 - RNA, 23 nt, Homo sapiens
cucacuguugugaagguuguaga

SEQ ID NO: 1647449 - RNA, 19 nt, Homo sapiens
cucacuugauucugcaguc

SEQ ID NO: 1647450 - RNA, 22 nt, Homo sapiens
cucagccaggugcugugacacc

SEQ ID NO: 1647451 - RNA, 20 nt, Homo sapiens
cucagccuccugaguagcug

SEQ ID NO: 1647452 - RNA, 14 nt, Homo sapiens
cucaggacugcuga

SEQ ID NO: 1647453 - RNA, 21 nt, Homo sapiens
cucaggccaucaucaguggag

SEQ ID NO: 1647454 - RNA, 15 nt, Homo sapiens
cucagggcagggaua

SEQ ID NO: 1647455 - RNA, 16 nt, Homo sapiens
cucaggugaccaaaac

SEQ ID NO: 1647456 - RNA, 14 nt, Homo sapiens
cucauacacagaaa

SEQ ID NO: 1647457 - RNA, 15 nt, Homo sapiens
cucauccucauaccc

SEQ ID NO: 1647458 - RNA, 15 nt, Homo sapiens
cucaucugacuugaa

SEQ ID NO: 1647459 - RNA, 15 nt, Homo sapiens
cucaucuuucuugau

SEQ ID NO: 1647460 - RNA, 19 nt, Homo sapiens
cucaugcuaagacucagug

SEQ ID NO: 1647461 - RNA, 21 nt, Homo sapiens
cucauuggacccuuccauggu

SEQ ID NO: 1647462 - RNA, 19 nt, Homo sapiens
cucauuugucacacacuuu

SEQ ID NO: 1647463 - RNA, 15 nt, Homo sapiens
cucauuuuaggcaaa

SEQ ID NO: 1647464 - RNA, 23 nt, Homo sapiens
cuccaaccuggggggcaguggug

SEQ ID NO: 1647465 - RNA, 16 nt, Homo sapiens
cuccacccacagugga

SEQ ID NO: 1647466 - RNA, 17 nt, Homo sapiens
cuccaccgccauggcuu

SEQ ID NO: 1647467 - RNA, 20 nt, Homo sapiens
cuccaccuaguggcugucca

SEQ ID NO: 1647468 - RNA, 20 nt, Homo sapiens
cuccagauaguguagcugag

SEQ ID NO: 1647469 - RNA, 16 nt, Homo sapiens
cuccagcucaccagcc

SEQ ID NO: 1647470 - RNA, 19 nt, Homo sapiens
cuccauguagaagccacua

SEQ ID NO: 1647471 - RNA, 21 nt, Homo sapiens
cuccauguagaagccacuauu

SEQ ID NO: 1647472 - RNA, 12 nt, Homo sapiens
cucccacaguga

SEQ ID NO: 1647473 - RNA, 15 nt, Homo sapiens
cucccacagugacuc

SEQ ID NO: 1647474 - RNA, 18 nt, Homo sapiens
cucccagccagguucuga

SEQ ID NO: 1647475 - RNA, 20 nt, Homo sapiens
cucccaggcuggagugcagu

SEQ ID NO: 1647476 - RNA, 18 nt, Homo sapiens
cuccccagcaagugagag

SEQ ID NO: 1647477 - RNA, 20 nt, Homo sapiens
cuccccuaccacugucuucu

SEQ ID NO: 1647478 - RNA, 12 nt, Homo sapiens
cuccccucaaaa

SEQ ID NO: 1647479 - RNA, 17 nt, Homo sapiens
cuccccuucacucccac

SEQ ID NO: 1647480 - RNA, 12 nt, Homo sapiens
cucccuaccuga

SEQ ID NO: 1647481 - RNA, 13 nt, Homo sapiens
cucccucuguguu

SEQ ID NO: 1647482 - RNA, 21 nt, Homo sapiens
cucccugaucccgugugccac

SEQ ID NO: 1647483 - RNA, 19 nt, Homo sapiens
cucccugguucugaugaug

SEQ ID NO: 1647484 - RNA, 13 nt, Homo sapiens
cuccguggcacau

SEQ ID NO: 1647485 - RNA, 21 nt, Homo sapiens
cuccuagggccacugaagaua

SEQ ID NO: 1647486 - RNA, 18 nt, Homo sapiens
cuccuagguucacuuugg

SEQ ID NO: 1647487 - RNA, 12 nt, Homo sapiens
cuccuccaggga

SEQ ID NO: 1647488 - RNA, 22 nt, Homo sapiens
cuccucuuucaaccucagugau

SEQ ID NO: 1647489 - RNA, 20 nt, Homo sapiens
cuccugaguaguugggauua

SEQ ID NO: 1647490 - RNA, 19 nt, Homo sapiens
cuccugggcccaagugauc

SEQ ID NO: 1647491 - RNA, 15 nt, Homo sapiens
cuccuuagaagugga

SEQ ID NO: 1647492 - RNA, 18 nt, Homo sapiens
cucgaggcccuagcauuu

SEQ ID NO: 1647493 - RNA, 19 nt, Homo sapiens
cucgagguuucucaaagaa

SEQ ID NO: 1647494 - RNA, 20 nt, Homo sapiens
cucgugguaggacuguagaa

SEQ ID NO: 1647495 - RNA, 17 nt, Homo sapiens
cucuaaaccauggcacu

SEQ ID NO: 1647496 - RNA, 13 nt, Homo sapiens
cucuaaagagcau

SEQ ID NO: 1647497 - RNA, 24 nt, Homo sapiens
cucuaugaccucgcccuccacaaa

SEQ ID NO: 1647498 - RNA, 18 nt, Homo sapiens
cucucaccucuaacauca

SEQ ID NO: 1647499 - RNA, 17 nt, Homo sapiens
cucucacuauaccagua

SEQ ID NO: 1647500 - RNA, 19 nt, Homo sapiens
cucucaugucuuugcugca

SEQ ID NO: 1647501 - RNA, 11 nt, Homo sapiens
cucucauuucc

SEQ ID NO: 1647502 - RNA, 21 nt, Homo sapiens
cucucgcacacacagugauuc

SEQ ID NO: 1647503 - RNA, 12 nt, Homo sapiens
cucucucacuga

SEQ ID NO: 1647504 - RNA, 15 nt, Homo sapiens
cucucuugacccugu

SEQ ID NO: 1647505 - RNA, 14 nt, Homo sapiens
cucugaaaccagug

SEQ ID NO: 1647506 - RNA, 15 nt, Homo sapiens
cucugacacacagcu

SEQ ID NO: 1647507 - RNA, 22 nt, Homo sapiens
cucugacgccgcgcacucagcc

SEQ ID NO: 1647508 - RNA, 21 nt, Homo sapiens
cucugaggacacuaaccacgc

SEQ ID NO: 1647509 - RNA, 22 nt, Homo sapiens
cucugcagccucagagacauca

SEQ ID NO: 1647510 - RNA, 14 nt, Homo sapiens
cucugccauggccu

SEQ ID NO: 1647511 - RNA, 14 nt, Homo sapiens
cucugccugaaguc

SEQ ID NO: 1647512 - RNA, 19 nt, Homo sapiens
cucugcuauuugcuguuau

SEQ ID NO: 1647513 - RNA, 20 nt, Homo sapiens
cucuggacaggcauguucuc

SEQ ID NO: 1647514 - RNA, 22 nt, Homo sapiens
cucuggaugccugauugccaag

SEQ ID NO: 1647515 - RNA, 22 nt, Homo sapiens
cucugguguaguuucugcauuu

SEQ ID NO: 1647516 - RNA, 10 nt, Homo sapiens
cucuguccag

SEQ ID NO: 1647517 - RNA, 18 nt, Homo sapiens
cucugugggcuccaugua

SEQ ID NO: 1647518 - RNA, 15 nt, Homo sapiens
cucuucucauuucac

SEQ ID NO: 1647519 - RNA, 15 nt, Homo sapiens
cucuugacccuguca

SEQ ID NO: 1647520 - RNA, 17 nt, Homo sapiens
cugaaagucaugcacau

SEQ ID NO: 1647521 - RNA, 21 nt, Homo sapiens
cugaaauggacuuuuguacau

SEQ ID NO: 1647522 - RNA, 19 nt, Homo sapiens
cugaaggcugaaagacagg

SEQ ID NO: 1647523 - RNA, 13 nt, Homo sapiens
cugaagucacaca

SEQ ID NO: 1647524 - RNA, 18 nt, Homo sapiens
cugaaugacuccacuguu

SEQ ID NO: 1647525 - RNA, 18 nt, Homo sapiens
cugacaacagccugagaa

SEQ ID NO: 1647526 - RNA, 15 nt, Homo sapiens
cugacauauuaugcc

SEQ ID NO: 1647527 - RNA, 21 nt, Homo sapiens
cugaccaauauuguacaguuu

SEQ ID NO: 1647528 - RNA, 22 nt, Homo sapiens
cugaccaguuuaaccugaugca

SEQ ID NO: 1647529 - RNA, 21 nt, Homo sapiens
cugacccaugcugcccuguga

SEQ ID NO: 1647530 - RNA, 16 nt, Homo sapiens
cugacgcagccugaga

SEQ ID NO: 1647531 - RNA, 13 nt, Homo sapiens
cugacuugaacuc

SEQ ID NO: 1647532 - RNA, 16 nt, Homo sapiens
cugagaacacugugaa

SEQ ID NO: 1647533 - RNA, 19 nt, Homo sapiens
cugagcagaauacuggucu

SEQ ID NO: 1647534 - RNA, 13 nt, Homo sapiens
cugagcucacuga

SEQ ID NO: 1647535 - RNA, 15 nt, Homo sapiens
cugaggaaugucuuu

SEQ ID NO: 1647536 - RNA, 17 nt, Homo sapiens
cugaggaaugucuuuca

SEQ ID NO: 1647537 - RNA, 15 nt, Homo sapiens
cugaggcaagccaug

SEQ ID NO: 1647538 - RNA, 19 nt, Homo sapiens
cugagguuugccagcauuu

SEQ ID NO: 1647539 - RNA, 14 nt, Homo sapiens
cugagucaccaucu

SEQ ID NO: 1647540 - RNA, 19 nt, Homo sapiens
cugaguuccggggugcaau

SEQ ID NO: 1647541 - RNA, 19 nt, Homo sapiens
cugaguuuagggucaagga

SEQ ID NO: 1647542 - RNA, 13 nt, Homo sapiens
cugauacguguau

SEQ ID NO: 1647543 - RNA, 23 nt, Homo sapiens
cugauagguagcauuuuccagca

SEQ ID NO: 1647544 - RNA, 21 nt, Homo sapiens
cugaucauccacugugccaug

SEQ ID NO: 1647545 - RNA, 14 nt, Homo sapiens
cugauccugugaag

SEQ ID NO: 1647546 - RNA, 18 nt, Homo sapiens
cugaucugcuagugcugu

SEQ ID NO: 1647547 - RNA, 16 nt, Homo sapiens
cugauguuacugagau

SEQ ID NO: 1647548 - RNA, 21 nt, Homo sapiens
cugauguuuauaaacugagag

SEQ ID NO: 1647549 - RNA, 15 nt, Homo sapiens
cugauuucugagcau

SEQ ID NO: 1647550 - RNA, 15 nt, Homo sapiens
cugcaaauacuguau

SEQ ID NO: 1647551 - RNA, 19 nt, Homo sapiens
cugcacaaacucaccaucu

SEQ ID NO: 1647552 - RNA, 23 nt, Homo sapiens
cugcacuauagccuaggugacag

SEQ ID NO: 1647553 - RNA, 22 nt, Homo sapiens
cugcagauuagcuaggggacag

SEQ ID NO: 1647554 - RNA, 17 nt, Homo sapiens
cugcagccuccucugug

SEQ ID NO: 1647555 - RNA, 22 nt, Homo sapiens
cugcauuuauagcauacgguau

SEQ ID NO: 1647556 - RNA, 10 nt, Homo sapiens
cugcauuuca

SEQ ID NO: 1647557 - RNA, 22 nt, Homo sapiens
cugcauuucaagaagacuggca

SEQ ID NO: 1647558 - RNA, 18 nt, Homo sapiens
cugcauuuuguagccucu

SEQ ID NO: 1647559 - RNA, 20 nt, Homo sapiens
cugccaacacgcccggcuaa

SEQ ID NO: 1647560 - RNA, 22 nt, Homo sapiens
cugccaacacgcccggcuaauu

SEQ ID NO: 1647561 - RNA, 19 nt, Homo sapiens
cugccaguucccucccuca

SEQ ID NO: 1647562 - RNA, 20 nt, Homo sapiens
cugccaucauuuacuuuuaa

SEQ ID NO: 1647563 - RNA, 17 nt, Homo sapiens
cugcccugcucccacag

SEQ ID NO: 1647564 - RNA, 17 nt, Homo sapiens
cugccucggccucccaa

SEQ ID NO: 1647565 - RNA, 15 nt, Homo sapiens
cugccugaagucaca

SEQ ID NO: 1647566 - RNA, 16 nt, Homo sapiens
cugccugaagucacac

SEQ ID NO: 1647567 - RNA, 14 nt, Homo sapiens
cugccuucucaggg

SEQ ID NO: 1647568 - RNA, 19 nt, Homo sapiens
cugcuaguuuauauagaaa

SEQ ID NO: 1647569 - RNA, 22 nt, Homo sapiens
cugcuaugcuauugaaguuuug

SEQ ID NO: 1647570 - RNA, 18 nt, Homo sapiens
cugcuauuugcuguuauu

SEQ ID NO: 1647571 - RNA, 14 nt, Homo sapiens
cugcugacaguguu

SEQ ID NO: 1647572 - RNA, 22 nt, Homo sapiens
cugcugagagacagagcuauuc

SEQ ID NO: 1647573 - RNA, 18 nt, Homo sapiens
cugcuggcuggugccuga

SEQ ID NO: 1647574 - RNA, 14 nt, Homo sapiens
cugcuggcugugac

SEQ ID NO: 1647575 - RNA, 17 nt, Homo sapiens
cugcuuccagugaggcu

SEQ ID NO: 1647576 - RNA, 15 nt, Homo sapiens
cugcuuccucugaau

SEQ ID NO: 1647577 - RNA, 14 nt, Homo sapiens
cuggaacaucauca

SEQ ID NO: 1647578 - RNA, 18 nt, Homo sapiens
cuggaaccaggcuugccu

SEQ ID NO: 1647579 - RNA, 23 nt, Homo sapiens
cuggaaccaggcuugccugggac

SEQ ID NO: 1647580 - RNA, 15 nt, Homo sapiens
cuggaggagcccagg

SEQ ID NO: 1647581 - RNA, 15 nt, Homo sapiens
cuggaggcagggaac

SEQ ID NO: 1647582 - RNA, 13 nt, Homo sapiens
cuggagugcagug

SEQ ID NO: 1647583 - RNA, 22 nt, Homo sapiens
cuggagugcaguggcacgaucu

SEQ ID NO: 1647584 - RNA, 18 nt, Homo sapiens
cuggauuucauacuguaa

SEQ ID NO: 1647585 - RNA, 13 nt, Homo sapiens
cuggcacaguguc

SEQ ID NO: 1647586 - RNA, 20 nt, Homo sapiens
cuggcaccuguggccaguac

SEQ ID NO: 1647587 - RNA, 20 nt, Homo sapiens
cuggcagagagcacagugau

SEQ ID NO: 1647588 - RNA, 21 nt, Homo sapiens
cuggcagagagcacagugauc

SEQ ID NO: 1647589 - RNA, 14 nt, Homo sapiens
cuggcccaucagug

SEQ ID NO: 1647590 - RNA, 15 nt, Homo sapiens
cuggccgaugugggu

SEQ ID NO: 1647591 - RNA, 12 nt, Homo sapiens
cuggcuccaaac

SEQ ID NO: 1647592 - RNA, 16 nt, Homo sapiens
cuggcuccaaacccuc

SEQ ID NO: 1647593 - RNA, 14 nt, Homo sapiens
cuggcugauuauca

SEQ ID NO: 1647594 - RNA, 23 nt, Homo sapiens
cuggcugcaaaggguaucaggug

SEQ ID NO: 1647595 - RNA, 15 nt, Homo sapiens
cuggcuggugccuga

SEQ ID NO: 1647596 - RNA, 13 nt, Homo sapiens
cuggcugugacaa

SEQ ID NO: 1647597 - RNA, 20 nt, Homo sapiens
cuggcuucacagauguguga

SEQ ID NO: 1647598 - RNA, 15 nt, Homo sapiens
cugggacucauucac

SEQ ID NO: 1647599 - RNA, 20 nt, Homo sapiens
cugggagagccuuccagggg

SEQ ID NO: 1647600 - RNA, 19 nt, Homo sapiens
cugggaggacucucuuagu

SEQ ID NO: 1647601 - RNA, 22 nt, Homo sapiens
cugggcaaggaggccacgugau

SEQ ID NO: 1647602 - RNA, 23 nt, Homo sapiens
cugggcaaggaggccacgugaug

SEQ ID NO: 1647603 - RNA, 22 nt, Homo sapiens
cugggcccaagugauccuucca

SEQ ID NO: 1647604 - RNA, 22 nt, Homo sapiens
cugggcccucucugcucugcgu

SEQ ID NO: 1647605 - RNA, 12 nt, Homo sapiens
cugggccuagca

SEQ ID NO: 1647606 - RNA, 14 nt, Homo sapiens
cugggcuggcacug

SEQ ID NO: 1647607 - RNA, 16 nt, Homo sapiens
cugggggccucagugc

SEQ ID NO: 1647608 - RNA, 20 nt, Homo sapiens
cuggguaaaugcagcgugaa

SEQ ID NO: 1647609 - RNA, 15 nt, Homo sapiens
cuggguaagagcaca

SEQ ID NO: 1647610 - RNA, 22 nt, Homo sapiens
cuggguggcacugccaugcagg

SEQ ID NO: 1647611 - RNA, 16 nt, Homo sapiens
cuggucccacucaguc

SEQ ID NO: 1647612 - RNA, 21 nt, Homo sapiens
cuguagggaaaaaaaugcuuc

SEQ ID NO: 1647613 - RNA, 23 nt, Homo sapiens
cugucacaucagcuccacuuuca

SEQ ID NO: 1647614 - RNA, 19 nt, Homo sapiens
cugucacguagaacuugga

SEQ ID NO: 1647615 - RNA, 23 nt, Homo sapiens
cugucacuugcuggcugugaaac

SEQ ID NO: 1647616 - RNA, 17 nt, Homo sapiens
cugucauguaacacgac

SEQ ID NO: 1647617 - RNA, 17 nt, Homo sapiens
cuguccaccaccaccug

SEQ ID NO: 1647618 - RNA, 14 nt, Homo sapiens
cugucccaagcucc

SEQ ID NO: 1647619 - RNA, 17 nt, Homo sapiens
cuguccccuucucucau

SEQ ID NO: 1647620 - RNA, 21 nt, Homo sapiens
cuguccccuucucucaucucu

SEQ ID NO: 1647621 - RNA, 17 nt, Homo sapiens
cuguccuauuauauuca

SEQ ID NO: 1647622 - RNA, 19 nt, Homo sapiens
cuguccugcuccacagugu

SEQ ID NO: 1647623 - RNA, 14 nt, Homo sapiens
cugucgcccagucu

SEQ ID NO: 1647624 - RNA, 19 nt, Homo sapiens
cugucuccuuaacacugag

SEQ ID NO: 1647625 - RNA, 20 nt, Homo sapiens
cugucuccuuaacacugagc

SEQ ID NO: 1647626 - RNA, 22 nt, Homo sapiens
cugucuguuuuaauuuaaccca

SEQ ID NO: 1647627 - RNA, 13 nt, Homo sapiens
cugugaaugcuuc

SEQ ID NO: 1647628 - RNA, 17 nt, Homo sapiens
cugugacaaugguuuca

SEQ ID NO: 1647629 - RNA, 10 nt, Homo sapiens
cugugccugg

SEQ ID NO: 1647630 - RNA, 15 nt, Homo sapiens
cuguggcuucuuaau

SEQ ID NO: 1647631 - RNA, 20 nt, Homo sapiens
cugugucagggaacauauuu

SEQ ID NO: 1647632 - RNA, 16 nt, Homo sapiens
cugugugaacguguau

SEQ ID NO: 1647633 - RNA, 17 nt, Homo sapiens
cuguguguacuaauaca

SEQ ID NO: 1647634 - RNA, 17 nt, Homo sapiens
cuguguguuugugugua

SEQ ID NO: 1647635 - RNA, 14 nt, Homo sapiens
cuguuaacuaugac

SEQ ID NO: 1647636 - RNA, 22 nt, Homo sapiens
cuguuaacuaugacagauauau

SEQ ID NO: 1647637 - RNA, 15 nt, Homo sapiens
cuguuacacaugaca

SEQ ID NO: 1647638 - RNA, 12 nt, Homo sapiens
cuguucugugac

SEQ ID NO: 1647639 - RNA, 18 nt, Homo sapiens
cuguugaauuucccacau

SEQ ID NO: 1647640 - RNA, 16 nt, Homo sapiens
cuguugcugccucaug

SEQ ID NO: 1647641 - RNA, 21 nt, Homo sapiens
cuguuggccagugugacaagg

SEQ ID NO: 1647642 - RNA, 18 nt, Homo sapiens
cuguuucucucacugggc

SEQ ID NO: 1647643 - RNA, 13 nt, Homo sapiens
cuuaaaaacucac

SEQ ID NO: 1647644 - RNA, 14 nt, Homo sapiens
cuuaaaauagccau

SEQ ID NO: 1647645 - RNA, 16 nt, Homo sapiens
cuuaaaauagccauaa

SEQ ID NO: 1647646 - RNA, 12 nt, Homo sapiens
cuuaaacaucau

SEQ ID NO: 1647647 - RNA, 22 nt, Homo sapiens
cuuaagacgugauuuugcugua

SEQ ID NO: 1647648 - RNA, 17 nt, Homo sapiens
cuuaagagaugccucau

SEQ ID NO: 1647649 - RNA, 12 nt, Homo sapiens
cuuaagcuuuca

SEQ ID NO: 1647650 - RNA, 16 nt, Homo sapiens
cuuaaguuuaccaaau

SEQ ID NO: 1647651 - RNA, 17 nt, Homo sapiens
cuuaaucuuuucacaaa

SEQ ID NO: 1647652 - RNA, 19 nt, Homo sapiens
cuuaaucuuuucacaaaua

SEQ ID NO: 1647653 - RNA, 20 nt, Homo sapiens
cuuaaugaaugaaugaauuc

SEQ ID NO: 1647654 - RNA, 21 nt, Homo sapiens
cuuaauuauugauguuuucau

SEQ ID NO: 1647655 - RNA, 18 nt, Homo sapiens
cuuacagucagcacagaa

SEQ ID NO: 1647656 - RNA, 20 nt, Homo sapiens
cuuacauuugaaaucuauga

SEQ ID NO: 1647657 - RNA, 15 nt, Homo sapiens
cuuacuuaguguuau

SEQ ID NO: 1647658 - RNA, 23 nt, Homo sapiens
cuuacuuuuuuuggaaguuauuu

SEQ ID NO: 1647659 - RNA, 12 nt, Homo sapiens
cuuagaacaaag

SEQ ID NO: 1647660 - RNA, 13 nt, Homo sapiens
cuuagacaguccc

SEQ ID NO: 1647661 - RNA, 16 nt, Homo sapiens
cuuagacagucccugc

SEQ ID NO: 1647662 - RNA, 13 nt, Homo sapiens
cuuagagggguga

SEQ ID NO: 1647663 - RNA, 16 nt, Homo sapiens
cuuagcaccacaaaua

SEQ ID NO: 1647664 - RNA, 14 nt, Homo sapiens
cuuaggcaugacug

SEQ ID NO: 1647665 - RNA, 22 nt, Homo sapiens
cuuaggcaugacuguagaauuu

SEQ ID NO: 1647666 - RNA, 15 nt, Homo sapiens
cuuaguugcaugacc

SEQ ID NO: 1647667 - RNA, 14 nt, Homo sapiens
cuuauauucaucca

SEQ ID NO: 1647668 - RNA, 14 nt, Homo sapiens
cuuauggcaucuca

SEQ ID NO: 1647669 - RNA, 19 nt, Homo sapiens
cuuauuucucaucacauca

SEQ ID NO: 1647670 - RNA, 15 nt, Homo sapiens
cuucacucaaucucu

SEQ ID NO: 1647671 - RNA, 11 nt, Homo sapiens
cuucagaacag

SEQ ID NO: 1647672 - RNA, 23 nt, Homo sapiens
cuucagaagucacacauuacaaa

SEQ ID NO: 1647673 - RNA, 21 nt, Homo sapiens
cuucagagcugacacaggaug

SEQ ID NO: 1647674 - RNA, 22 nt, Homo sapiens
cuucagcccucaccccugguuc

SEQ ID NO: 1647675 - RNA, 23 nt, Homo sapiens
cuucaggguccugagauuuacac

SEQ ID NO: 1647676 - RNA, 22 nt, Homo sapiens
cuucagguuaucgaaauaacaa

SEQ ID NO: 1647677 - RNA, 17 nt, Homo sapiens
cuucagucuuuuccaug

SEQ ID NO: 1647678 - RNA, 12 nt, Homo sapiens
cuucaguguguu

SEQ ID NO: 1647679 - RNA, 20 nt, Homo sapiens
cuucauaauuucuucacuca

SEQ ID NO: 1647680 - RNA, 14 nt, Homo sapiens
cuucaugcauggaa

SEQ ID NO: 1647681 - RNA, 16 nt, Homo sapiens
cuuccaagucauucuc

SEQ ID NO: 1647682 - RNA, 14 nt, Homo sapiens
cuuccacugagggc

SEQ ID NO: 1647683 - RNA, 14 nt, Homo sapiens
cuuccaucaccucc

SEQ ID NO: 1647684 - RNA, 11 nt, Homo sapiens
cuuccauuugc

SEQ ID NO: 1647685 - RNA, 20 nt, Homo sapiens
cuucccaggaguacacccca

SEQ ID NO: 1647686 - RNA, 13 nt, Homo sapiens
cuuccccucucag

SEQ ID NO: 1647687 - RNA, 17 nt, Homo sapiens
cuuccuaauuccacagc

SEQ ID NO: 1647688 - RNA, 16 nt, Homo sapiens
cuuccuguucugugac

SEQ ID NO: 1647689 - RNA, 17 nt, Homo sapiens
cuucuaaucaaagcuuu

SEQ ID NO: 1647690 - RNA, 19 nt, Homo sapiens
cuucuaauuagaucaauua

SEQ ID NO: 1647691 - RNA, 13 nt, Homo sapiens
cuucuagaaccag

SEQ ID NO: 1647692 - RNA, 22 nt, Homo sapiens
cuucuaggauuuauuguuauau

SEQ ID NO: 1647693 - RNA, 17 nt, Homo sapiens
cuucuauuuaaugcuuc

SEQ ID NO: 1647694 - RNA, 19 nt, Homo sapiens
cuucuauuuaaugcuucca

SEQ ID NO: 1647695 - RNA, 19 nt, Homo sapiens
cuucucagccacaaacccu

SEQ ID NO: 1647696 - RNA, 13 nt, Homo sapiens
cuucuccuuagaa

SEQ ID NO: 1647697 - RNA, 14 nt, Homo sapiens
cuucugaaugaagc

SEQ ID NO: 1647698 - RNA, 23 nt, Homo sapiens
cuucugacuuaagugugcaaaau

SEQ ID NO: 1647699 - RNA, 23 nt, Homo sapiens
cuucugauacguguaugagacua

SEQ ID NO: 1647700 - RNA, 16 nt, Homo sapiens
cuucuucaccauuugg

SEQ ID NO: 1647701 - RNA, 19 nt, Homo sapiens
cuucuucagagcugacaca

SEQ ID NO: 1647702 - RNA, 14 nt, Homo sapiens
cuucuucuuagcac

SEQ ID NO: 1647703 - RNA, 17 nt, Homo sapiens
cuucuuuuuguucuuca

SEQ ID NO: 1647704 - RNA, 15 nt, Homo sapiens
cuugaaaucaagggc

SEQ ID NO: 1647705 - RNA, 16 nt, Homo sapiens
cuugaacauacuuggu

SEQ ID NO: 1647706 - RNA, 22 nt, Homo sapiens
cuugaaucaagucagcaacaga

SEQ ID NO: 1647707 - RNA, 18 nt, Homo sapiens
cuugaggaaaacaagcau

SEQ ID NO: 1647708 - RNA, 22 nt, Homo sapiens
cuugauauuuccuucaccaccu

SEQ ID NO: 1647709 - RNA, 15 nt, Homo sapiens
cuugcaguacaucaa

SEQ ID NO: 1647710 - RNA, 21 nt, Homo sapiens
cuugcauugaauuuagucauu

SEQ ID NO: 1647711 - RNA, 15 nt, Homo sapiens
cuugccuaucugacu

SEQ ID NO: 1647712 - RNA, 20 nt, Homo sapiens
cuugcucaugcccugccaag

SEQ ID NO: 1647713 - RNA, 13 nt, Homo sapiens
cuugggcucccug

SEQ ID NO: 1647714 - RNA, 15 nt, Homo sapiens
cuugguagccucgau

SEQ ID NO: 1647715 - RNA, 23 nt, Homo sapiens
cuuguaaauagcucagguguccc

SEQ ID NO: 1647716 - RNA, 18 nt, Homo sapiens
cuugucuuuggacccuga

SEQ ID NO: 1647717 - RNA, 20 nt, Homo sapiens
cuugugccaacacucaagaa

SEQ ID NO: 1647718 - RNA, 15 nt, Homo sapiens
cuuguguuaugaagc

SEQ ID NO: 1647719 - RNA, 15 nt, Homo sapiens
cuuguguucugagua

SEQ ID NO: 1647720 - RNA, 22 nt, Homo sapiens
cuuuaaaaauaugcaccaaauc

SEQ ID NO: 1647721 - RNA, 15 nt, Homo sapiens
cuuuaaagagaguuu

SEQ ID NO: 1647722 - RNA, 17 nt, Homo sapiens
cuuuaacccucacuggg

SEQ ID NO: 1647723 - RNA, 17 nt, Homo sapiens
cuuuacuucccaguaua

SEQ ID NO: 1647724 - RNA, 16 nt, Homo sapiens
cuuuagaaagcaguua

SEQ ID NO: 1647725 - RNA, 22 nt, Homo sapiens
cuuuagcagggaagucacuuca

SEQ ID NO: 1647726 - RNA, 13 nt, Homo sapiens
cuuuagugcucca

SEQ ID NO: 1647727 - RNA, 20 nt, Homo sapiens
cuuuaucuuuuaagcuaucu

SEQ ID NO: 1647728 - RNA, 17 nt, Homo sapiens
cuuuaugggaacccucu

SEQ ID NO: 1647729 - RNA, 14 nt, Homo sapiens
cuuucaaaagcaag

SEQ ID NO: 1647730 - RNA, 21 nt, Homo sapiens
cuuucaauaucuuuauugcau

SEQ ID NO: 1647731 - RNA, 19 nt, Homo sapiens
cuuucaccacaugugcaca

SEQ ID NO: 1647732 - RNA, 12 nt, Homo sapiens
cuuucaguauua

SEQ ID NO: 1647733 - RNA, 13 nt, Homo sapiens
cuuucaguauuag

SEQ ID NO: 1647734 - RNA, 16 nt, Homo sapiens
cuuucauuuacugugg

SEQ ID NO: 1647735 - RNA, 15 nt, Homo sapiens
cuuugacaguguuuu

SEQ ID NO: 1647736 - RNA, 16 nt, Homo sapiens
cuuugauucaaagcac

SEQ ID NO: 1647737 - RNA, 20 nt, Homo sapiens
cuuugcugagccuguaaaau

SEQ ID NO: 1647738 - RNA, 14 nt, Homo sapiens
cuuugcugcagaac

SEQ ID NO: 1647739 - RNA, 20 nt, Homo sapiens
cuuugcugcagaacugaaga

SEQ ID NO: 1647740 - RNA, 13 nt, Homo sapiens
cuuuggcaacaga

SEQ ID NO: 1647741 - RNA, 20 nt, Homo sapiens
cuuuguauccucugaccuac

SEQ ID NO: 1647742 - RNA, 15 nt, Homo sapiens
cuuugugauucccuc

SEQ ID NO: 1647743 - RNA, 19 nt, Homo sapiens
cuuuguucaaauguacuau

SEQ ID NO: 1647744 - RNA, 21 nt, Homo sapiens
cuuuuaaacccuauugguaaa

SEQ ID NO: 1647745 - RNA, 18 nt, Homo sapiens
cuuuuacauacagugaua

SEQ ID NO: 1647746 - RNA, 15 nt, Homo sapiens
cuuuuaguucauguc

SEQ ID NO: 1647747 - RNA, 14 nt, Homo sapiens
cuuuuauagcugcu

SEQ ID NO: 1647748 - RNA, 15 nt, Homo sapiens
cuuuuauuacugggg

SEQ ID NO: 1647749 - RNA, 19 nt, Homo sapiens
cuuuucaauguuagccaca

SEQ ID NO: 1647750 - RNA, 13 nt, Homo sapiens
cuuuucacaaaua

SEQ ID NO: 1647751 - RNA, 14 nt, Homo sapiens
cuuuucacaaauaa

SEQ ID NO: 1647752 - RNA, 15 nt, Homo sapiens
cuuuucauaaccuag

SEQ ID NO: 1647753 - RNA, 20 nt, Homo sapiens
cuuuuccuccaaccuguggc

SEQ ID NO: 1647754 - RNA, 19 nt, Homo sapiens
cuuuugaccuguggugcaa

SEQ ID NO: 1647755 - RNA, 20 nt, Homo sapiens
cuuuugaccuguggugcaaa

SEQ ID NO: 1647756 - RNA, 19 nt, Homo sapiens
cuuuugcauaagugcauga

SEQ ID NO: 1647757 - RNA, 21 nt, Homo sapiens
cuuuugcauaagugcaugaca

SEQ ID NO: 1647758 - RNA, 15 nt, Homo sapiens
cuuuugccuacguga

SEQ ID NO: 1647759 - RNA, 14 nt, Homo sapiens
cuuuugcucccuac

SEQ ID NO: 1647760 - RNA, 12 nt, Homo sapiens
cuuuugcugauc

SEQ ID NO: 1647761 - RNA, 21 nt, Homo sapiens
cuuuuuuggcugcugaaggcu

SEQ ID NO: 1647762 - RNA, 15 nt, Homo sapiens
gaaaaaaaaauggaa

SEQ ID NO: 1647763 - RNA, 15 nt, Homo sapiens
gaaaaaaaugcuucu

SEQ ID NO: 1647764 - RNA, 23 nt, Homo sapiens
gaaaaagaacuuccccauacaaa

SEQ ID NO: 1647765 - RNA, 17 nt, Homo sapiens
gaaaaagaccugcauuu

SEQ ID NO: 1647766 - RNA, 21 nt, Homo sapiens
gaaaaauauuaauaagacaaa

SEQ ID NO: 1647767 - RNA, 14 nt, Homo sapiens
gaaaaauugccaau

SEQ ID NO: 1647768 - RNA, 14 nt, Homo sapiens
gaaaacacugugca

SEQ ID NO: 1647769 - RNA, 15 nt, Homo sapiens
gaaaacacugugcac

SEQ ID NO: 1647770 - RNA, 19 nt, Homo sapiens
gaaaacacugugcacaucu

SEQ ID NO: 1647771 - RNA, 20 nt, Homo sapiens
gaaaagcugcugacaguguu

SEQ ID NO: 1647772 - RNA, 13 nt, Homo sapiens
gaaaaguuuugua

SEQ ID NO: 1647773 - RNA, 18 nt, Homo sapiens
gaaacaaaaggauaauga

SEQ ID NO: 1647774 - RNA, 19 nt, Homo sapiens
gaaacacacauggacaugu

SEQ ID NO: 1647775 - RNA, 21 nt, Homo sapiens
gaaaccaggacaagcuacuua

SEQ ID NO: 1647776 - RNA, 22 nt, Homo sapiens
gaaaccugggagagacuuggau

SEQ ID NO: 1647777 - RNA, 19 nt, Homo sapiens
gaaacuaauacaauacauu

SEQ ID NO: 1647778 - RNA, 13 nt, Homo sapiens
gaaacuccaucuc

SEQ ID NO: 1647779 - RNA, 14 nt, Homo sapiens
gaaagaacugucau

SEQ ID NO: 1647780 - RNA, 16 nt, Homo sapiens
gaaagacaagcucaag

SEQ ID NO: 1647781 - RNA, 17 nt, Homo sapiens
gaaagcugaguguuuca

SEQ ID NO: 1647782 - RNA, 19 nt, Homo sapiens
gaaagucaugcacauaccu

SEQ ID NO: 1647783 - RNA, 18 nt, Homo sapiens
gaaaguuucuuugaaaau

SEQ ID NO: 1647784 - RNA, 16 nt, Homo sapiens
gaaauaaaagcuuugc

SEQ ID NO: 1647785 - RNA, 15 nt, Homo sapiens
gaaauaacaauguua

SEQ ID NO: 1647786 - RNA, 13 nt, Homo sapiens
gaaauaggaaaua

SEQ ID NO: 1647787 - RNA, 13 nt, Homo sapiens
gaaauauauuuga

SEQ ID NO: 1647788 - RNA, 11 nt, Homo sapiens
gaaaugagcuc

SEQ ID NO: 1647789 - RNA, 23 nt, Homo sapiens
gaaaugcugguuuuucaguuuuc

SEQ ID NO: 1647790 - RNA, 17 nt, Homo sapiens
gaaauuaauuugugaau

SEQ ID NO: 1647791 - RNA, 17 nt, Homo sapiens
gaaauucguuguuccca

SEQ ID NO: 1647792 - RNA, 13 nt, Homo sapiens
gaacacacugaga

SEQ ID NO: 1647793 - RNA, 11 nt, Homo sapiens
gaacacuguga

SEQ ID NO: 1647794 - RNA, 15 nt, Homo sapiens
gaacagcuucagguu

SEQ ID NO: 1647795 - RNA, 15 nt, Homo sapiens
gaacagugcuugcca

SEQ ID NO: 1647796 - RNA, 17 nt, Homo sapiens
gaaccaagaagggcuag

SEQ ID NO: 1647797 - RNA, 15 nt, Homo sapiens
gaaccaggcaacuug

SEQ ID NO: 1647798 - RNA, 17 nt, Homo sapiens
gaacccuagcuguguca

SEQ ID NO: 1647799 - RNA, 19 nt, Homo sapiens
gaaccgaacauaucauuug

SEQ ID NO: 1647800 - RNA, 12 nt, Homo sapiens
gaaccucagggc

SEQ ID NO: 1647801 - RNA, 18 nt, Homo sapiens
gaaccugcccugcuccca

SEQ ID NO: 1647802 - RNA, 21 nt, Homo sapiens
gaaccugcccugcucccacag

SEQ ID NO: 1647803 - RNA, 22 nt, Homo sapiens
gaacgcucugcaccuucugacg

SEQ ID NO: 1647804 - RNA, 21 nt, Homo sapiens
gaacucaaggaaaucuguguc

SEQ ID NO: 1647805 - RNA, 14 nt, Homo sapiens
gaacuccugaccuc

SEQ ID NO: 1647806 - RNA, 17 nt, Homo sapiens
gaacucugaauaugccu

SEQ ID NO: 1647807 - RNA, 16 nt, Homo sapiens
gaacuggguacuugug

SEQ ID NO: 1647808 - RNA, 21 nt, Homo sapiens
gaacuguggugccacaugacc

SEQ ID NO: 1647809 - RNA, 12 nt, Homo sapiens
gaacuuccccau

SEQ ID NO: 1647810 - RNA, 20 nt, Homo sapiens
gaacuuugcugagccuguaa

SEQ ID NO: 1647811 - RNA, 16 nt, Homo sapiens
gaagaaaucuuuccag

SEQ ID NO: 1647812 - RNA, 17 nt, Homo sapiens
gaagaaucuguuuccca

SEQ ID NO: 1647813 - RNA, 18 nt, Homo sapiens
gaagacccauuccuuccc

SEQ ID NO: 1647814 - RNA, 19 nt, Homo sapiens
gaagacuauauuguacaca

SEQ ID NO: 1647815 - RNA, 18 nt, Homo sapiens
gaagacuuuuguuaugag

SEQ ID NO: 1647816 - RNA, 16 nt, Homo sapiens
gaagagaaugugacag

SEQ ID NO: 1647817 - RNA, 24 nt, Homo sapiens
gaagauccuaaaacaaaagcucau

SEQ ID NO: 1647818 - RNA, 18 nt, Homo sapiens
gaagccacaggccugaga

SEQ ID NO: 1647819 - RNA, 20 nt, Homo sapiens
gaagccacuauuacugggac

SEQ ID NO: 1647820 - RNA, 19 nt, Homo sapiens
gaagcuucuaaauggugcu

SEQ ID NO: 1647821 - RNA, 22 nt, Homo sapiens
gaagcuucuaaauggugcugca

SEQ ID NO: 1647822 - RNA, 17 nt, Homo sapiens
gaagcuucuaauuagau

SEQ ID NO: 1647823 - RNA, 14 nt, Homo sapiens
gaaggcaaugccau

SEQ ID NO: 1647824 - RNA, 22 nt, Homo sapiens
gaagggcucagagaggacaaaa

SEQ ID NO: 1647825 - RNA, 12 nt, Homo sapiens
gaaggggacaag

SEQ ID NO: 1647826 - RNA, 12 nt, Homo sapiens
gaagggucuguu

SEQ ID NO: 1647827 - RNA, 14 nt, Homo sapiens
gaagguacugucau

SEQ ID NO: 1647828 - RNA, 19 nt, Homo sapiens
gaagguggggacagggaug

SEQ ID NO: 1647829 - RNA, 20 nt, Homo sapiens
gaagguggggacagggauga

SEQ ID NO: 1647830 - RNA, 13 nt, Homo sapiens
gaagguugcaccu

SEQ ID NO: 1647831 - RNA, 12 nt, Homo sapiens
gaagucccucag

SEQ ID NO: 1647832 - RNA, 13 nt, Homo sapiens
gaagugugugauc

SEQ ID NO: 1647833 - RNA, 16 nt, Homo sapiens
gaaguuuuuucuacca

SEQ ID NO: 1647834 - RNA, 21 nt, Homo sapiens
gaauaaaagaauuacauauga

SEQ ID NO: 1647835 - RNA, 23 nt, Homo sapiens
gaauagauuuuagcaugaugaaa

SEQ ID NO: 1647836 - RNA, 22 nt, Homo sapiens
gaauaguguuggaaaaugugca

SEQ ID NO: 1647837 - RNA, 17 nt, Homo sapiens
gaauauaaacacuauau

SEQ ID NO: 1647838 - RNA, 20 nt, Homo sapiens
gaaucaagucagcaacagag

SEQ ID NO: 1647839 - RNA, 17 nt, Homo sapiens
gaaucacuggcuguuaa

SEQ ID NO: 1647840 - RNA, 16 nt, Homo sapiens
gaaucacuucugagaa

SEQ ID NO: 1647841 - RNA, 13 nt, Homo sapiens
gaaucaguguguu

SEQ ID NO: 1647842 - RNA, 14 nt, Homo sapiens
gaauccaauacugc

SEQ ID NO: 1647843 - RNA, 14 nt, Homo sapiens
gaaucuucaccuca

SEQ ID NO: 1647844 - RNA, 14 nt, Homo sapiens
gaaugauucagugu

SEQ ID NO: 1647845 - RNA, 19 nt, Homo sapiens
gaauggggugcaugaaggu

SEQ ID NO: 1647846 - RNA, 22 nt, Homo sapiens
gaaugucuuucagccaagccaa

SEQ ID NO: 1647847 - RNA, 17 nt, Homo sapiens
gaaugugagcuuaccag

SEQ ID NO: 1647848 - RNA, 20 nt, Homo sapiens
gaauguuuucaaauguucuc

SEQ ID NO: 1647849 - RNA, 12 nt, Homo sapiens
gaauuaagcaaa

SEQ ID NO: 1647850 - RNA, 16 nt, Homo sapiens
gaauuauaacuguaaa

SEQ ID NO: 1647851 - RNA, 15 nt, Homo sapiens
gaauuaucuauuuca

SEQ ID NO: 1647852 - RNA, 22 nt, Homo sapiens
gaauucuacuauuuaugugauc

SEQ ID NO: 1647853 - RNA, 16 nt, Homo sapiens
gaauucucucaccucu

SEQ ID NO: 1647854 - RNA, 12 nt, Homo sapiens
gaauuugagugc

SEQ ID NO: 1647855 - RNA, 18 nt, Homo sapiens
gaauuuguggccuaccuu

SEQ ID NO: 1647856 - RNA, 14 nt, Homo sapiens
gaauuuuugcacau

SEQ ID NO: 1647857 - RNA, 11 nt, Homo sapiens
gacaaaccucu

SEQ ID NO: 1647858 - RNA, 16 nt, Homo sapiens
gacaaacuucuuucac

SEQ ID NO: 1647859 - RNA, 16 nt, Homo sapiens
gacaacagccugagaa

SEQ ID NO: 1647860 - RNA, 17 nt, Homo sapiens
gacaacagccugagaaa

SEQ ID NO: 1647861 - RNA, 18 nt, Homo sapiens
gacaagacccucucaggc

SEQ ID NO: 1647862 - RNA, 17 nt, Homo sapiens
gacaaguggggacugca

SEQ ID NO: 1647863 - RNA, 21 nt, Homo sapiens
gacacagcucuucuccaggcu

SEQ ID NO: 1647864 - RNA, 22 nt, Homo sapiens
gacaccagagcagaugcagaga

SEQ ID NO: 1647865 - RNA, 17 nt, Homo sapiens
gacaccuugacagggca

SEQ ID NO: 1647866 - RNA, 14 nt, Homo sapiens
gacagaagcagcuc

SEQ ID NO: 1647867 - RNA, 14 nt, Homo sapiens
gacagagcugggau

SEQ ID NO: 1647868 - RNA, 20 nt, Homo sapiens
gacagagguuaucuguccca

SEQ ID NO: 1647869 - RNA, 19 nt, Homo sapiens
gacagagugagacucuguc

SEQ ID NO: 1647870 - RNA, 13 nt, Homo sapiens
gacagaugugguu

SEQ ID NO: 1647871 - RNA, 17 nt, Homo sapiens
gacagaugugguugcau

SEQ ID NO: 1647872 - RNA, 22 nt, Homo sapiens
gacaggguuucaccauguuggc

SEQ ID NO: 1647873 - RNA, 19 nt, Homo sapiens
gacagucccugccaaugga

SEQ ID NO: 1647874 - RNA, 22 nt, Homo sapiens
gacauauuaugccugaaugacu

SEQ ID NO: 1647875 - RNA, 15 nt, Homo sapiens
gacaugugaaaccuu

SEQ ID NO: 1647876 - RNA, 16 nt, Homo sapiens
gacaugugaaaccuuu

SEQ ID NO: 1647877 - RNA, 18 nt, Homo sapiens
gacauugcggacagccac

SEQ ID NO: 1647878 - RNA, 21 nt, Homo sapiens
gaccaauauuguacaguuuuu

SEQ ID NO: 1647879 - RNA, 19 nt, Homo sapiens
gaccacauagaacaugugu

SEQ ID NO: 1647880 - RNA, 15 nt, Homo sapiens
gaccaucuacauaca

SEQ ID NO: 1647881 - RNA, 15 nt, Homo sapiens
gacccacagccucca

SEQ ID NO: 1647882 - RNA, 13 nt, Homo sapiens
gacccaugcugcc

SEQ ID NO: 1647883 - RNA, 18 nt, Homo sapiens
gacccaugcugcccugug

SEQ ID NO: 1647884 - RNA, 16 nt, Homo sapiens
gacccauuccuuccca

SEQ ID NO: 1647885 - RNA, 20 nt, Homo sapiens
gaccucaggugauccaccca

SEQ ID NO: 1647886 - RNA, 16 nt, Homo sapiens
gaccucauuccuggga

SEQ ID NO: 1647887 - RNA, 12 nt, Homo sapiens
gaccugaugacc

SEQ ID NO: 1647888 - RNA, 15 nt, Homo sapiens
gaccugaugaccugg

SEQ ID NO: 1647889 - RNA, 20 nt, Homo sapiens
gaccugccaggcacacugag

SEQ ID NO: 1647890 - RNA, 12 nt, Homo sapiens
gaccugcuucua

SEQ ID NO: 1647891 - RNA, 23 nt, Homo sapiens
gaccuggcaaggacacagaugaa

SEQ ID NO: 1647892 - RNA, 24 nt, Homo sapiens
gaccugucacgauugucaucagga

SEQ ID NO: 1647893 - RNA, 13 nt, Homo sapiens
gaccuucuaggaa

SEQ ID NO: 1647894 - RNA, 22 nt, Homo sapiens
gacgaguacucuugaacacaag

SEQ ID NO: 1647895 - RNA, 13 nt, Homo sapiens
gacgcagccugag

SEQ ID NO: 1647896 - RNA, 15 nt, Homo sapiens
gacgccgcgcacuca

SEQ ID NO: 1647897 - RNA, 22 nt, Homo sapiens
gacgugauucaauucaacacuc

SEQ ID NO: 1647898 - RNA, 20 nt, Homo sapiens
gacgugauuuugcuguagaa

SEQ ID NO: 1647899 - RNA, 17 nt, Homo sapiens
gacuacaggcacccacc

SEQ ID NO: 1647900 - RNA, 16 nt, Homo sapiens
gacuaugcacacuuuu

SEQ ID NO: 1647901 - RNA, 20 nt, Homo sapiens
gacuauggcucuacuuucag

SEQ ID NO: 1647902 - RNA, 22 nt, Homo sapiens
gacuaugucacccaaugcauau

SEQ ID NO: 1647903 - RNA, 17 nt, Homo sapiens
gacucaaaaauagggaa

SEQ ID NO: 1647904 - RNA, 21 nt, Homo sapiens
gacucaagacuuccagagccu

SEQ ID NO: 1647905 - RNA, 12 nt, Homo sapiens
gacucaagcaag

SEQ ID NO: 1647906 - RNA, 16 nt, Homo sapiens
gacuccagcugugaag

SEQ ID NO: 1647907 - RNA, 21 nt, Homo sapiens
gacuccaggccgccugcagcc

SEQ ID NO: 1647908 - RNA, 21 nt, Homo sapiens
gacucgggauuaguacacacu

SEQ ID NO: 1647909 - RNA, 17 nt, Homo sapiens
gacucuuggcacagcau

SEQ ID NO: 1647910 - RNA, 13 nt, Homo sapiens
gacugcugcugaa

SEQ ID NO: 1647911 - RNA, 20 nt, Homo sapiens
gacuggguuuugugauugcc

SEQ ID NO: 1647912 - RNA, 14 nt, Homo sapiens
gacuucugcaucuu

SEQ ID NO: 1647913 - RNA, 20 nt, Homo sapiens
gacuugacagaacacugucu

SEQ ID NO: 1647914 - RNA, 23 nt, Homo sapiens
gacuuucuugcaagcaacaagcu

SEQ ID NO: 1647915 - RNA, 19 nt, Homo sapiens
gacuuugaggguguauauu

SEQ ID NO: 1647916 - RNA, 12 nt, Homo sapiens
gagaagcuucua

SEQ ID NO: 1647917 - RNA, 20 nt, Homo sapiens
gagaaguuggucuuacuuug

SEQ ID NO: 1647918 - RNA, 19 nt, Homo sapiens
gagacagaguuuucacucu

SEQ ID NO: 1647919 - RNA, 16 nt, Homo sapiens
gagaccaggcaaagca

SEQ ID NO: 1647920 - RNA, 15 nt, Homo sapiens
gagacugcugaguca

SEQ ID NO: 1647921 - RNA, 20 nt, Homo sapiens
gagacuuugacucuccagaa

SEQ ID NO: 1647922 - RNA, 21 nt, Homo sapiens
gagagaacugagcaucuccag

SEQ ID NO: 1647923 - RNA, 22 nt, Homo sapiens
gagagaaguuaauccacaucuu

SEQ ID NO: 1647924 - RNA, 13 nt, Homo sapiens
gagagaccaggca

SEQ ID NO: 1647925 - RNA, 14 nt, Homo sapiens
gagagcacagugau

SEQ ID NO: 1647926 - RNA, 16 nt, Homo sapiens
gagagccaccaagagg

SEQ ID NO: 1647927 - RNA, 22 nt, Homo sapiens
gagagcucgcuuugagugacug

SEQ ID NO: 1647928 - RNA, 20 nt, Homo sapiens
gagagcuucuguugcugccu

SEQ ID NO: 1647929 - RNA, 23 nt, Homo sapiens
gagagcuucuguugcugccucau

SEQ ID NO: 1647930 - RNA, 23 nt, Homo sapiens
gagaggagaaggagggagacaug

SEQ ID NO: 1647931 - RNA, 19 nt, Homo sapiens
gagaguacaccccaacagc

SEQ ID NO: 1647932 - RNA, 15 nt, Homo sapiens
gagagucugggucca

SEQ ID NO: 1647933 - RNA, 18 nt, Homo sapiens
gagauaauucuagcuuug

SEQ ID NO: 1647934 - RNA, 21 nt, Homo sapiens
gagaucgugccauugcacucc

SEQ ID NO: 1647935 - RNA, 14 nt, Homo sapiens
gagcaaacauuuua

SEQ ID NO: 1647936 - RNA, 16 nt, Homo sapiens
gagcacacuuggccca

SEQ ID NO: 1647937 - RNA, 21 nt, Homo sapiens
gagcagugaaugauucagugu

SEQ ID NO: 1647938 - RNA, 23 nt, Homo sapiens
gagcaugugagggguagugggau

SEQ ID NO: 1647939 - RNA, 18 nt, Homo sapiens
gagccauguuaauguaau

SEQ ID NO: 1647940 - RNA, 23 nt, Homo sapiens
gagcccacgcccccacuggugac

SEQ ID NO: 1647941 - RNA, 23 nt, Homo sapiens
gagcccggaguggacugauuuuc

SEQ ID NO: 1647942 - RNA, 22 nt, Homo sapiens
gagccggacacuucucaggaaa

SEQ ID NO: 1647943 - RNA, 12 nt, Homo sapiens
gagccugcaguu

SEQ ID NO: 1647944 - RNA, 11 nt, Homo sapiens
gagcuagaagc

SEQ ID NO: 1647945 - RNA, 22 nt, Homo sapiens
gagcucagagagggcaggcaug

SEQ ID NO: 1647946 - RNA, 12 nt, Homo sapiens
gagcucucugag

SEQ ID NO: 1647947 - RNA, 21 nt, Homo sapiens
gagcugauacuuugacagugu

SEQ ID NO: 1647948 - RNA, 17 nt, Homo sapiens
gagcugggcagcuggaa

SEQ ID NO: 1647949 - RNA, 21 nt, Homo sapiens
gagcuucuguugcugccucau

SEQ ID NO: 1647950 - RNA, 21 nt, Homo sapiens
gaggacaagacccucucaggc

SEQ ID NO: 1647951 - RNA, 16 nt, Homo sapiens
gaggaguacaggugaa

SEQ ID NO: 1647952 - RNA, 16 nt, Homo sapiens
gaggcaggagaaucac

SEQ ID NO: 1647953 - RNA, 12 nt, Homo sapiens
gaggcagggaac

SEQ ID NO: 1647954 - RNA, 13 nt, Homo sapiens
gaggccacgugau

SEQ ID NO: 1647955 - RNA, 14 nt, Homo sapiens
gaggcggaucuuug

SEQ ID NO: 1647956 - RNA, 20 nt, Homo sapiens
gaggcuucugauacguguau

SEQ ID NO: 1647957 - RNA, 22 nt, Homo sapiens
gaggcuucugauacguguauga

SEQ ID NO: 1647958 - RNA, 21 nt, Homo sapiens
gagggagaacccaaagagaca

SEQ ID NO: 1647959 - RNA, 16 nt, Homo sapiens
gagggcacacacugug

SEQ ID NO: 1647960 - RNA, 18 nt, Homo sapiens
gagggcuagaaccuggag

SEQ ID NO: 1647961 - RNA, 23 nt, Homo sapiens
gagggguugaugccagacaucac

SEQ ID NO: 1647962 - RNA, 17 nt, Homo sapiens
gagggugagacacugca

SEQ ID NO: 1647963 - RNA, 17 nt, Homo sapiens
gaggucaucacuuugac

SEQ ID NO: 1647964 - RNA, 17 nt, Homo sapiens
gagguuucacuugcaca

SEQ ID NO: 1647965 - RNA, 15 nt, Homo sapiens
gaguacaccccaaca

SEQ ID NO: 1647966 - RNA, 19 nt, Homo sapiens
gaguacaccccaacagcac

SEQ ID NO: 1647967 - RNA, 15 nt, Homo sapiens
gaguaccauaauucu

SEQ ID NO: 1647968 - RNA, 16 nt, Homo sapiens
gaguaggaagacuuug

SEQ ID NO: 1647969 - RNA, 23 nt, Homo sapiens
gagucacacgggggcagcugaua

SEQ ID NO: 1647970 - RNA, 15 nt, Homo sapiens
gagucagcugacccc

SEQ ID NO: 1647971 - RNA, 17 nt, Homo sapiens
gagucgaggacagggag

SEQ ID NO: 1647972 - RNA, 21 nt, Homo sapiens
gagucucccuaaggcaugugu

SEQ ID NO: 1647973 - RNA, 22 nt, Homo sapiens
gagugacgcaucuccaagccaa

SEQ ID NO: 1647974 - RNA, 20 nt, Homo sapiens
gagugacuacacacaguacg

SEQ ID NO: 1647975 - RNA, 16 nt, Homo sapiens
gagugcaguggcacga

SEQ ID NO: 1647976 - RNA, 17 nt, Homo sapiens
gagugcccccaacagca

SEQ ID NO: 1647977 - RNA, 15 nt, Homo sapiens
gagugggcuaagcac

SEQ ID NO: 1647978 - RNA, 21 nt, Homo sapiens
gagugggguuuucuugaacau

SEQ ID NO: 1647979 - RNA, 20 nt, Homo sapiens
gaguucauacccuguuacca

SEQ ID NO: 1647980 - RNA, 23 nt, Homo sapiens
gaguuccagcaaacaaaauggac

SEQ ID NO: 1647981 - RNA, 18 nt, Homo sapiens
gauaaaagacagugaaag

SEQ ID NO: 1647982 - RNA, 16 nt, Homo sapiens
gauaaauuuguugaau

SEQ ID NO: 1647983 - RNA, 14 nt, Homo sapiens
gauaacaaccugga

SEQ ID NO: 1647984 - RNA, 13 nt, Homo sapiens
gauaacagcacug

SEQ ID NO: 1647985 - RNA, 19 nt, Homo sapiens
gauaauggugaacauuuua

SEQ ID NO: 1647986 - RNA, 15 nt, Homo sapiens
gauacagaacucuuu

SEQ ID NO: 1647987 - RNA, 17 nt, Homo sapiens
gauacuguugcacgugu

SEQ ID NO: 1647988 - RNA, 15 nt, Homo sapiens
gauagggauacaugc

SEQ ID NO: 1647989 - RNA, 17 nt, Homo sapiens
gauagguauaaguggug

SEQ ID NO: 1647990 - RNA, 15 nt, Homo sapiens
gauauaaaagacuga

SEQ ID NO: 1647991 - RNA, 15 nt, Homo sapiens
gauauuaacugagaa

SEQ ID NO: 1647992 - RNA, 16 nt, Homo sapiens
gauauuagucuugggg

SEQ ID NO: 1647993 - RNA, 13 nt, Homo sapiens
gauauugaugaaa

SEQ ID NO: 1647994 - RNA, 20 nt, Homo sapiens
gaucaacaucuuuucuugcc

SEQ ID NO: 1647995 - RNA, 18 nt, Homo sapiens
gauccaaguuuacucaac

SEQ ID NO: 1647996 - RNA, 16 nt, Homo sapiens
gaucccaucuugauaa

SEQ ID NO: 1647997 - RNA, 22 nt, Homo sapiens
gauccuuccaccucagucuccc

SEQ ID NO: 1647998 - RNA, 17 nt, Homo sapiens
gaucuaggaagacuuug

SEQ ID NO: 1647999 - RNA, 17 nt, Homo sapiens
gaucugaugcaagcaag

SEQ ID NO: 1648000 - RNA, 22 nt, Homo sapiens
gaucuuaggcaugacuguagaa

SEQ ID NO: 1648001 - RNA, 14 nt, Homo sapiens
gaucuuuggacaga

SEQ ID NO: 1648002 - RNA, 14 nt, Homo sapiens
gaugaaaaccugca

SEQ ID NO: 1648003 - RNA, 13 nt, Homo sapiens
gaugauuuuggcc

SEQ ID NO: 1648004 - RNA, 23 nt, Homo sapiens
gaugauuuuggccucauuacuuu

SEQ ID NO: 1648005 - RNA, 13 nt, Homo sapiens
gaugcaagcaaga

SEQ ID NO: 1648006 - RNA, 20 nt, Homo sapiens
gaugggagugcccccaacag

SEQ ID NO: 1648007 - RNA, 15 nt, Homo sapiens
gaugggcaacuggcu

SEQ ID NO: 1648008 - RNA, 18 nt, Homo sapiens
gaugucguuugaaucaca

SEQ ID NO: 1648009 - RNA, 13 nt, Homo sapiens
gaugugagggcac

SEQ ID NO: 1648010 - RNA, 20 nt, Homo sapiens
gauuaaaaaaucucccaaag

SEQ ID NO: 1648011 - RNA, 20 nt, Homo sapiens
gauuaauggaaauguuuaca

SEQ ID NO: 1648012 - RNA, 21 nt, Homo sapiens
gauuaaugucaauucuugcca

SEQ ID NO: 1648013 - RNA, 17 nt, Homo sapiens
gauuaggaaucauucug

SEQ ID NO: 1648014 - RNA, 20 nt, Homo sapiens
gauuaggaaucauucuguaa

SEQ ID NO: 1648015 - RNA, 16 nt, Homo sapiens
gauuaguacacacuug

SEQ ID NO: 1648016 - RNA, 16 nt, Homo sapiens
gauuauaaacaaccua

SEQ ID NO: 1648017 - RNA, 21 nt, Homo sapiens
gauucacccccaaacagugac

SEQ ID NO: 1648018 - RNA, 17 nt, Homo sapiens
gauucauauugcaucau

SEQ ID NO: 1648019 - RNA, 23 nt, Homo sapiens
gauuccgcaccaauaaagccuuc

SEQ ID NO: 1648020 - RNA, 11 nt, Homo sapiens
gauucucaggg

SEQ ID NO: 1648021 - RNA, 15 nt, Homo sapiens
gauucucaugccuca

SEQ ID NO: 1648022 - RNA, 12 nt, Homo sapiens
gauucuccuuca

SEQ ID NO: 1648023 - RNA, 18 nt, Homo sapiens
gauuggcaggaguuggaa

SEQ ID NO: 1648024 - RNA, 21 nt, Homo sapiens
gauuguaaaaaaaaaugccuu

SEQ ID NO: 1648025 - RNA, 20 nt, Homo sapiens
gauuuagcaaugcugugaau

SEQ ID NO: 1648026 - RNA, 21 nt, Homo sapiens
gauuucaucugcucuccuucc

SEQ ID NO: 1648027 - RNA, 22 nt, Homo sapiens
gcaaaaccaaauauuccagaga

SEQ ID NO: 1648028 - RNA, 15 nt, Homo sapiens
gcaaacaaaauggac

SEQ ID NO: 1648029 - RNA, 21 nt, Homo sapiens
gcaaacugccaucauuuacuu

SEQ ID NO: 1648030 - RNA, 17 nt, Homo sapiens
gcaaauggccaaugaga

SEQ ID NO: 1648031 - RNA, 14 nt, Homo sapiens
gcaacaaccagcau

SEQ ID NO: 1648032 - RNA, 14 nt, Homo sapiens
gcaacagacuugaa

SEQ ID NO: 1648033 - RNA, 20 nt, Homo sapiens
gcaacuagggcuagucuucc

SEQ ID NO: 1648034 - RNA, 23 nt, Homo sapiens
gcaagaacaccauccuacauaau

SEQ ID NO: 1648035 - RNA, 16 nt, Homo sapiens
gcaagcucccaaggga

SEQ ID NO: 1648036 - RNA, 17 nt, Homo sapiens
gcaaggacacagaugaa

SEQ ID NO: 1648037 - RNA, 23 nt, Homo sapiens
gcaaggacacagaugaaacacaa

SEQ ID NO: 1648038 - RNA, 13 nt, Homo sapiens
gcaaggugacauu

SEQ ID NO: 1648039 - RNA, 16 nt, Homo sapiens
gcaaugacucaaaguc

SEQ ID NO: 1648040 - RNA, 13 nt, Homo sapiens
gcaaugcugugaa

SEQ ID NO: 1648041 - RNA, 18 nt, Homo sapiens
gcaauucuccugccucag

SEQ ID NO: 1648042 - RNA, 15 nt, Homo sapiens
gcacaaguucaguga

SEQ ID NO: 1648043 - RNA, 13 nt, Homo sapiens
gcacaauaguaac

SEQ ID NO: 1648044 - RNA, 17 nt, Homo sapiens
gcacaauaguaaccugg

SEQ ID NO: 1648045 - RNA, 23 nt, Homo sapiens
gcacagaagacagcagcaagugu

SEQ ID NO: 1648046 - RNA, 18 nt, Homo sapiens
gcacagaugcccacguau

SEQ ID NO: 1648047 - RNA, 18 nt, Homo sapiens
gcacauaucuccucuugg

SEQ ID NO: 1648048 - RNA, 20 nt, Homo sapiens
gcacauaucuccucuugggc

SEQ ID NO: 1648049 - RNA, 18 nt, Homo sapiens
gcaccaauaaagccuuca

SEQ ID NO: 1648050 - RNA, 13 nt, Homo sapiens
gcacccucuccag

SEQ ID NO: 1648051 - RNA, 14 nt, Homo sapiens
gcacccucuccaga

SEQ ID NO: 1648052 - RNA, 18 nt, Homo sapiens
gcaccgggccacagagaa

SEQ ID NO: 1648053 - RNA, 19 nt, Homo sapiens
gcacucagaagacacugau

SEQ ID NO: 1648054 - RNA, 21 nt, Homo sapiens
gcacucucgcacacacaguga

SEQ ID NO: 1648055 - RNA, 22 nt, Homo sapiens
gcacucucgcacacacagugau

SEQ ID NO: 1648056 - RNA, 22 nt, Homo sapiens
gcacugauaucaucgauuagaa

SEQ ID NO: 1648057 - RNA, 18 nt, Homo sapiens
gcacugcccgaaaagcau

SEQ ID NO: 1648058 - RNA, 20 nt, Homo sapiens
gcacuguucccccugugcag

SEQ ID NO: 1648059 - RNA, 13 nt, Homo sapiens
gcagaacugaaga

SEQ ID NO: 1648060 - RNA, 19 nt, Homo sapiens
gcagaacugaagagacuag

SEQ ID NO: 1648061 - RNA, 13 nt, Homo sapiens
gcagaacuuucac

SEQ ID NO: 1648062 - RNA, 21 nt, Homo sapiens
gcagaccacugauaaaaccau

SEQ ID NO: 1648063 - RNA, 14 nt, Homo sapiens
gcagacccugagca

SEQ ID NO: 1648064 - RNA, 16 nt, Homo sapiens
gcagagagcacaguga

SEQ ID NO: 1648065 - RNA, 16 nt, Homo sapiens
gcagaggggugcucau

SEQ ID NO: 1648066 - RNA, 19 nt, Homo sapiens
gcagauacaggaaaagcug

SEQ ID NO: 1648067 - RNA, 20 nt, Homo sapiens
gcagaucuaccccuuacuua

SEQ ID NO: 1648068 - RNA, 16 nt, Homo sapiens
gcagccacauuccuga

SEQ ID NO: 1648069 - RNA, 21 nt, Homo sapiens
gcagccuccucugugacuccc

SEQ ID NO: 1648070 - RNA, 16 nt, Homo sapiens
gcagcgcgcacacgca

SEQ ID NO: 1648071 - RNA, 14 nt, Homo sapiens
gcagcucaucucug

SEQ ID NO: 1648072 - RNA, 18 nt, Homo sapiens
gcaggaaaugaaaauguc

SEQ ID NO: 1648073 - RNA, 14 nt, Homo sapiens
gcaggagaaucacu

SEQ ID NO: 1648074 - RNA, 21 nt, Homo sapiens
gcaggcauggcuggugccuga

SEQ ID NO: 1648075 - RNA, 18 nt, Homo sapiens
gcaggcuggcccugcccu

SEQ ID NO: 1648076 - RNA, 13 nt, Homo sapiens
gcaggcuucucag

SEQ ID NO: 1648077 - RNA, 13 nt, Homo sapiens
gcaguagacaagc

SEQ ID NO: 1648078 - RNA, 20 nt, Homo sapiens
gcagucucucucugccaugg

SEQ ID NO: 1648079 - RNA, 16 nt, Homo sapiens
gcaguggaacuaagaa

SEQ ID NO: 1648080 - RNA, 20 nt, Homo sapiens
gcaguggacucaaaacccau

SEQ ID NO: 1648081 - RNA, 13 nt, Homo sapiens
gcagugguuugaa

SEQ ID NO: 1648082 - RNA, 19 nt, Homo sapiens
gcauaaauaugcagugaua

SEQ ID NO: 1648083 - RNA, 21 nt, Homo sapiens
gcauaauguuucuggauuuca

SEQ ID NO: 1648084 - RNA, 23 nt, Homo sapiens
gcauaggaggggucuggacaugu

SEQ ID NO: 1648085 - RNA, 18 nt, Homo sapiens
gcauaguaccucugcuau

SEQ ID NO: 1648086 - RNA, 13 nt, Homo sapiens
gcaucaaacauga

SEQ ID NO: 1648087 - RNA, 17 nt, Homo sapiens
gcaucagcaacaaccag

SEQ ID NO: 1648088 - RNA, 22 nt, Homo sapiens
gcaucccaggaucgcaagagcc

SEQ ID NO: 1648089 - RNA, 18 nt, Homo sapiens
gcaucuccagcauucuca

SEQ ID NO: 1648090 - RNA, 15 nt, Homo sapiens
gcaucugcaguacag

SEQ ID NO: 1648091 - RNA, 19 nt, Homo sapiens
gcaugcaggucuccaugaa

SEQ ID NO: 1648092 - RNA, 23 nt, Homo sapiens
gcauggcuuuggcuuugcaaaau

SEQ ID NO: 1648093 - RNA, 19 nt, Homo sapiens
gcauguaaaaucuucagcu

SEQ ID NO: 1648094 - RNA, 16 nt, Homo sapiens
gcauuguugaugcuca

SEQ ID NO: 1648095 - RNA, 19 nt, Homo sapiens
gcauuuacuuuguguucac

SEQ ID NO: 1648096 - RNA, 19 nt, Homo sapiens
gcauuucacaaaacagccu

SEQ ID NO: 1648097 - RNA, 13 nt, Homo sapiens
gccaaaauuauua

SEQ ID NO: 1648098 - RNA, 16 nt, Homo sapiens
gccaauaaaugaacug

SEQ ID NO: 1648099 - RNA, 17 nt, Homo sapiens
gccaauaacacacagcu

SEQ ID NO: 1648100 - RNA, 18 nt, Homo sapiens
gccaaucaguagccagca

SEQ ID NO: 1648101 - RNA, 17 nt, Homo sapiens
gccaauccacuccuucc

SEQ ID NO: 1648102 - RNA, 12 nt, Homo sapiens
gccaauuuacuu

SEQ ID NO: 1648103 - RNA, 22 nt, Homo sapiens
gccacaaaugugucccagugaa

SEQ ID NO: 1648104 - RNA, 19 nt, Homo sapiens
gccacagggccuuuggcag

SEQ ID NO: 1648105 - RNA, 21 nt, Homo sapiens
gccacguauguuuuuguguau

SEQ ID NO: 1648106 - RNA, 16 nt, Homo sapiens
gccacuauuacuggga

SEQ ID NO: 1648107 - RNA, 23 nt, Homo sapiens
gccacuccccuaaacuccaggau

SEQ ID NO: 1648108 - RNA, 14 nt, Homo sapiens
gccacucuccccau

SEQ ID NO: 1648109 - RNA, 22 nt, Homo sapiens
gccagaguauuggucuccucuc

SEQ ID NO: 1648110 - RNA, 12 nt, Homo sapiens
gccagcagcucc

SEQ ID NO: 1648111 - RNA, 16 nt, Homo sapiens
gccaggugcugugaca

SEQ ID NO: 1648112 - RNA, 20 nt, Homo sapiens
gccagguucugacucuuggc

SEQ ID NO: 1648113 - RNA, 22 nt, Homo sapiens
gccauaaaggggagggacucau

SEQ ID NO: 1648114 - RNA, 15 nt, Homo sapiens
gcccaauacagccau

SEQ ID NO: 1648115 - RNA, 20 nt, Homo sapiens
gcccacgcuggagugcagug

SEQ ID NO: 1648116 - RNA, 16 nt, Homo sapiens
gcccagcuaaagcaau

SEQ ID NO: 1648117 - RNA, 21 nt, Homo sapiens
gcccaggaaaggcuccaggag

SEQ ID NO: 1648118 - RNA, 17 nt, Homo sapiens
gcccaggccaucuucca

SEQ ID NO: 1648119 - RNA, 20 nt, Homo sapiens
gcccaggcuggcgugcagug

SEQ ID NO: 1648120 - RNA, 15 nt, Homo sapiens
gcccaguguguuucu

SEQ ID NO: 1648121 - RNA, 13 nt, Homo sapiens
gccccaugagaca

SEQ ID NO: 1648122 - RNA, 21 nt, Homo sapiens
gccccauggcgaggccccuug

SEQ ID NO: 1648123 - RNA, 13 nt, Homo sapiens
gcccccaacagca

SEQ ID NO: 1648124 - RNA, 21 nt, Homo sapiens
gcccccaguggacaccaauga

SEQ ID NO: 1648125 - RNA, 15 nt, Homo sapiens
gccccugcccggcug

SEQ ID NO: 1648126 - RNA, 16 nt, Homo sapiens
gcccuacuucuuugcu

SEQ ID NO: 1648127 - RNA, 13 nt, Homo sapiens
gcccuagcauuuc

SEQ ID NO: 1648128 - RNA, 21 nt, Homo sapiens
gcccuaggaaacuaauacaau

SEQ ID NO: 1648129 - RNA, 14 nt, Homo sapiens
gcccucagauuccg

SEQ ID NO: 1648130 - RNA, 22 nt, Homo sapiens
gcccucagggcagggauacaaa

SEQ ID NO: 1648131 - RNA, 16 nt, Homo sapiens
gcccucuguccugacu

SEQ ID NO: 1648132 - RNA, 14 nt, Homo sapiens
gcccugccaugcuc

SEQ ID NO: 1648133 - RNA, 15 nt, Homo sapiens
gcccuuggggguccu

SEQ ID NO: 1648134 - RNA, 20 nt, Homo sapiens
gccgagaucacaccacugua

SEQ ID NO: 1648135 - RNA, 21 nt, Homo sapiens
gccgagaucacgccacugcac

SEQ ID NO: 1648136 - RNA, 12 nt, Homo sapiens
gccggaugacag

SEQ ID NO: 1648137 - RNA, 17 nt, Homo sapiens
gccuacucuuccaucuu

SEQ ID NO: 1648138 - RNA, 16 nt, Homo sapiens
gccuagucccuuccac

SEQ ID NO: 1648139 - RNA, 16 nt, Homo sapiens
gccucagagacaucag

SEQ ID NO: 1648140 - RNA, 17 nt, Homo sapiens
gccucagagacaucagc

SEQ ID NO: 1648141 - RNA, 19 nt, Homo sapiens
gccucaguaagacgacaag

SEQ ID NO: 1648142 - RNA, 17 nt, Homo sapiens
gccucccuucaugcaug

SEQ ID NO: 1648143 - RNA, 21 nt, Homo sapiens
gccuccgccucaguaagacga

SEQ ID NO: 1648144 - RNA, 14 nt, Homo sapiens
gccucgaucaucaa

SEQ ID NO: 1648145 - RNA, 21 nt, Homo sapiens
gccucucugcuccaccuugug

SEQ ID NO: 1648146 - RNA, 16 nt, Homo sapiens
gccucugcacuccccu

SEQ ID NO: 1648147 - RNA, 23 nt, Homo sapiens
gccucuuugugugcgucacugug

SEQ ID NO: 1648148 - RNA, 17 nt, Homo sapiens
gccugaggcucacggua

SEQ ID NO: 1648149 - RNA, 15 nt, Homo sapiens
gccuggcauuucaca

SEQ ID NO: 1648150 - RNA, 16 nt, Homo sapiens
gccugggagccagggu

SEQ ID NO: 1648151 - RNA, 14 nt, Homo sapiens
gccugguggcagcu

SEQ ID NO: 1648152 - RNA, 18 nt, Homo sapiens
gccuguaacauaucugua

SEQ ID NO: 1648153 - RNA, 17 nt, Homo sapiens
gccuguuacacaugaca

SEQ ID NO: 1648154 - RNA, 19 nt, Homo sapiens
gccuucccaggaguacacc

SEQ ID NO: 1648155 - RNA, 16 nt, Homo sapiens
gccuucugaccugggc

SEQ ID NO: 1648156 - RNA, 19 nt, Homo sapiens
gccuuggcaggcugcugga

SEQ ID NO: 1648157 - RNA, 19 nt, Homo sapiens
gccuuggguuucugugcag

SEQ ID NO: 1648158 - RNA, 18 nt, Homo sapiens
gccuuuauuugcuguuaa

SEQ ID NO: 1648159 - RNA, 17 nt, Homo sapiens
gcgaaaaaaucagugaa

SEQ ID NO: 1648160 - RNA, 19 nt, Homo sapiens
gcgaaaccccucucuacua

SEQ ID NO: 1648161 - RNA, 15 nt, Homo sapiens
gcgaccccaucugcc

SEQ ID NO: 1648162 - RNA, 20 nt, Homo sapiens
gcgagcccugguggcagugg

SEQ ID NO: 1648163 - RNA, 20 nt, Homo sapiens
gcgaucuggguucacugcaa

SEQ ID NO: 1648164 - RNA, 18 nt, Homo sapiens
gcggaucuuuggacagaa

SEQ ID NO: 1648165 - RNA, 12 nt, Homo sapiens
gcuacuguguca

SEQ ID NO: 1648166 - RNA, 11 nt, Homo sapiens
gcuagaaccug

SEQ ID NO: 1648167 - RNA, 21 nt, Homo sapiens
gcucaaagcguggacaggugu

SEQ ID NO: 1648168 - RNA, 18 nt, Homo sapiens
gcucaccagccccagugc

SEQ ID NO: 1648169 - RNA, 23 nt, Homo sapiens
gcucagccccaccccagggcagc

SEQ ID NO: 1648170 - RNA, 15 nt, Homo sapiens
gcucaucauucucug

SEQ ID NO: 1648171 - RNA, 15 nt, Homo sapiens
gcucaucugcagccu

SEQ ID NO: 1648172 - RNA, 13 nt, Homo sapiens
gcuccagccugac

SEQ ID NO: 1648173 - RNA, 13 nt, Homo sapiens
gcuccauguagaa

SEQ ID NO: 1648174 - RNA, 16 nt, Homo sapiens
gcuccauucaaaguga

SEQ ID NO: 1648175 - RNA, 16 nt, Homo sapiens
gcucccaagagcuucc

SEQ ID NO: 1648176 - RNA, 15 nt, Homo sapiens
gcucccaagggaugg

SEQ ID NO: 1648177 - RNA, 23 nt, Homo sapiens
gcucgggcccaggccaucuucca

SEQ ID NO: 1648178 - RNA, 16 nt, Homo sapiens
gcucuaguauuuccac

SEQ ID NO: 1648179 - RNA, 14 nt, Homo sapiens
gcucuaucugcaau

SEQ ID NO: 1648180 - RNA, 16 nt, Homo sapiens
gcucugcugacagaca

SEQ ID NO: 1648181 - RNA, 14 nt, Homo sapiens
gcugagagugcuau

SEQ ID NO: 1648182 - RNA, 22 nt, Homo sapiens
gcugagcagcauggauucugca

SEQ ID NO: 1648183 - RNA, 15 nt, Homo sapiens
gcugagccucagucu

SEQ ID NO: 1648184 - RNA, 23 nt, Homo sapiens
gcugcaugcgauuaucuacccac

SEQ ID NO: 1648185 - RNA, 13 nt, Homo sapiens
gcugccugggauc

SEQ ID NO: 1648186 - RNA, 19 nt, Homo sapiens
gcuggaggacuagaaccug

SEQ ID NO: 1648187 - RNA, 19 nt, Homo sapiens
gcuggagugcaauggcaca

SEQ ID NO: 1648188 - RNA, 15 nt, Homo sapiens
gcuggccugugugau

SEQ ID NO: 1648189 - RNA, 16 nt, Homo sapiens
gcuggcuggugccuga

SEQ ID NO: 1648190 - RNA, 14 nt, Homo sapiens
gcuggcugugacaa

SEQ ID NO: 1648191 - RNA, 21 nt, Homo sapiens
gcugggauguuucugucacau

SEQ ID NO: 1648192 - RNA, 16 nt, Homo sapiens
gcugggauuuacacuu

SEQ ID NO: 1648193 - RNA, 21 nt, Homo sapiens
gcuggguaagagcacagguua

SEQ ID NO: 1648194 - RNA, 17 nt, Homo sapiens
gcuggguggcacugcca

SEQ ID NO: 1648195 - RNA, 13 nt, Homo sapiens
gcugucaucucag

SEQ ID NO: 1648196 - RNA, 12 nt, Homo sapiens
gcuuaacaguuu

SEQ ID NO: 1648197 - RNA, 23 nt, Homo sapiens
gcuuauaaauggcaccacaucuu

SEQ ID NO: 1648198 - RNA, 12 nt, Homo sapiens
gcuuauauucau

SEQ ID NO: 1648199 - RNA, 18 nt, Homo sapiens
gcuuaugcuuguguauau

SEQ ID NO: 1648200 - RNA, 15 nt, Homo sapiens
gcuucaauacccaaa

SEQ ID NO: 1648201 - RNA, 18 nt, Homo sapiens
gcuucgcaaaauguuuca

SEQ ID NO: 1648202 - RNA, 23 nt, Homo sapiens
gcuucuaaauggugcugcagauu

SEQ ID NO: 1648203 - RNA, 17 nt, Homo sapiens
gcuucuagaaccaggca

SEQ ID NO: 1648204 - RNA, 13 nt, Homo sapiens
gcuucuuaaucuu

SEQ ID NO: 1648205 - RNA, 16 nt, Homo sapiens
gcuuggcugugcccuc

SEQ ID NO: 1648206 - RNA, 23 nt, Homo sapiens
gcuuggcugugcccucagauucc

SEQ ID NO: 1648207 - RNA, 20 nt, Homo sapiens
gcuuguaaauagcucaggug

SEQ ID NO: 1648208 - RNA, 14 nt, Homo sapiens
gcuuguguuuuuaa

SEQ ID NO: 1648209 - RNA, 19 nt, Homo sapiens
gcuuuacaaaccaaccauu

SEQ ID NO: 1648210 - RNA, 14 nt, Homo sapiens
gcuuucaguauuag

SEQ ID NO: 1648211 - RNA, 20 nt, Homo sapiens
gcuuucauguaaacugugca

SEQ ID NO: 1648212 - RNA, 20 nt, Homo sapiens
ggaaaauaaaucaaugcuau

SEQ ID NO: 1648213 - RNA, 15 nt, Homo sapiens
ggaaaaugugcaaua

SEQ ID NO: 1648214 - RNA, 20 nt, Homo sapiens
ggaaacacugauuuuguaaa

SEQ ID NO: 1648215 - RNA, 15 nt, Homo sapiens
ggaaaccacagcugc

SEQ ID NO: 1648216 - RNA, 23 nt, Homo sapiens
ggaaagaaccaugcagaggaaua

SEQ ID NO: 1648217 - RNA, 15 nt, Homo sapiens
ggaaagaacugucau

SEQ ID NO: 1648218 - RNA, 16 nt, Homo sapiens
ggaaagaacugucaug

SEQ ID NO: 1648219 - RNA, 12 nt, Homo sapiens
ggaaagcauaua

SEQ ID NO: 1648220 - RNA, 17 nt, Homo sapiens
ggaaaguuucuuugaaa

SEQ ID NO: 1648221 - RNA, 18 nt, Homo sapiens
ggaaauagugauuuccac

SEQ ID NO: 1648222 - RNA, 14 nt, Homo sapiens
ggaaauaugaguca

SEQ ID NO: 1648223 - RNA, 11 nt, Homo sapiens
ggaaaucacac

SEQ ID NO: 1648224 - RNA, 17 nt, Homo sapiens
ggaaaugaucaguuuuu

SEQ ID NO: 1648225 - RNA, 15 nt, Homo sapiens
ggaaaugauguuuca

SEQ ID NO: 1648226 - RNA, 13 nt, Homo sapiens
ggaaccagcccag

SEQ ID NO: 1648227 - RNA, 13 nt, Homo sapiens
ggaagcuagcucc

SEQ ID NO: 1648228 - RNA, 21 nt, Homo sapiens
ggaagcuuucugucuccuuaa

SEQ ID NO: 1648229 - RNA, 17 nt, Homo sapiens
ggaaggacauccauguu

SEQ ID NO: 1648230 - RNA, 11 nt, Homo sapiens
ggaaguuauuu

SEQ ID NO: 1648231 - RNA, 22 nt, Homo sapiens
ggaaucacuggcuguuaaucuu

SEQ ID NO: 1648232 - RNA, 21 nt, Homo sapiens
ggaauccuggggaacauagaa

SEQ ID NO: 1648233 - RNA, 16 nt, Homo sapiens
ggaauggagucuccca

SEQ ID NO: 1648234 - RNA, 19 nt, Homo sapiens
ggaaugggcagcucaucuc

SEQ ID NO: 1648235 - RNA, 17 nt, Homo sapiens
ggaauguaugugcacau

SEQ ID NO: 1648236 - RNA, 16 nt, Homo sapiens
ggaauuaagcaaaauc

SEQ ID NO: 1648237 - RNA, 13 nt, Homo sapiens
ggaauucaucucu

SEQ ID NO: 1648238 - RNA, 15 nt, Homo sapiens
ggacacuucucagga

SEQ ID NO: 1648239 - RNA, 16 nt, Homo sapiens
ggacagaagcagcucu

SEQ ID NO: 1648240 - RNA, 19 nt, Homo sapiens
ggacaggcuggugcuaaca

SEQ ID NO: 1648241 - RNA, 17 nt, Homo sapiens
ggacaugaagauucuuu

SEQ ID NO: 1648242 - RNA, 22 nt, Homo sapiens
ggaccccaccccucaucaggag

SEQ ID NO: 1648243 - RNA, 22 nt, Homo sapiens
ggaccccgagccuggcuccaaa

SEQ ID NO: 1648244 - RNA, 18 nt, Homo sapiens
ggaccggagagugggggu

SEQ ID NO: 1648245 - RNA, 20 nt, Homo sapiens
ggacucucuuaguucuuacc

SEQ ID NO: 1648246 - RNA, 16 nt, Homo sapiens
ggacuuacuauuuauu

SEQ ID NO: 1648247 - RNA, 13 nt, Homo sapiens
ggacuuccaucug

SEQ ID NO: 1648248 - RNA, 14 nt, Homo sapiens
ggacuucugcaucu

SEQ ID NO: 1648249 - RNA, 22 nt, Homo sapiens
ggacuucugcaucuuacaguca

SEQ ID NO: 1648250 - RNA, 15 nt, Homo sapiens
ggacuuggaagcucc

SEQ ID NO: 1648251 - RNA, 10 nt, Homo sapiens
ggacuuuguu

SEQ ID NO: 1648252 - RNA, 13 nt, Homo sapiens
ggagaaugcacag

SEQ ID NO: 1648253 - RNA, 23 nt, Homo sapiens
ggagaauuaaguccuacuuuuaa

SEQ ID NO: 1648254 - RNA, 13 nt, Homo sapiens
ggagacugcugag

SEQ ID NO: 1648255 - RNA, 14 nt, Homo sapiens
ggagagagacucca

SEQ ID NO: 1648256 - RNA, 14 nt, Homo sapiens
ggagaggggacgca

SEQ ID NO: 1648257 - RNA, 14 nt, Homo sapiens
ggagcuggaccugc

SEQ ID NO: 1648258 - RNA, 21 nt, Homo sapiens
ggaggauacugaggcacacag

SEQ ID NO: 1648259 - RNA, 13 nt, Homo sapiens
ggaggcagugaug

SEQ ID NO: 1648260 - RNA, 20 nt, Homo sapiens
ggagggccugggccccaguu

SEQ ID NO: 1648261 - RNA, 15 nt, Homo sapiens
ggagggcuccagaca

SEQ ID NO: 1648262 - RNA, 20 nt, Homo sapiens
ggaggugaccccagguuucu

SEQ ID NO: 1648263 - RNA, 22 nt, Homo sapiens
ggaguacaccccaacagcaccc

SEQ ID NO: 1648264 - RNA, 17 nt, Homo sapiens
ggagugcaauggcacaa

SEQ ID NO: 1648265 - RNA, 18 nt, Homo sapiens
ggaguugaaacugcuaua

SEQ ID NO: 1648266 - RNA, 15 nt, Homo sapiens
ggaguuugcauucuu

SEQ ID NO: 1648267 - RNA, 20 nt, Homo sapiens
ggauauuugguuuggccauc

SEQ ID NO: 1648268 - RNA, 17 nt, Homo sapiens
ggaucaugguguaauaa

SEQ ID NO: 1648269 - RNA, 13 nt, Homo sapiens
ggaugggaccuga

SEQ ID NO: 1648270 - RNA, 20 nt, Homo sapiens
ggauuacaggcuccugccac

SEQ ID NO: 1648271 - RNA, 12 nt, Homo sapiens
ggauuguguuaa

SEQ ID NO: 1648272 - RNA, 16 nt, Homo sapiens
ggauuucauacuguaa

SEQ ID NO: 1648273 - RNA, 16 nt, Homo sapiens
ggcaagggaccugcuu

SEQ ID NO: 1648274 - RNA, 9 nt, Homo sapiens
ggcacauug

SEQ ID NO: 1648275 - RNA, 18 nt, Homo sapiens
ggcaccaaaguccaggac

SEQ ID NO: 1648276 - RNA, 20 nt, Homo sapiens
ggcacccagccucuagggac

SEQ ID NO: 1648277 - RNA, 18 nt, Homo sapiens
ggcacuacucaguuauua

SEQ ID NO: 1648278 - RNA, 19 nt, Homo sapiens
ggcacucagaagacacuga

SEQ ID NO: 1648279 - RNA, 20 nt, Homo sapiens
ggcacucagaagacacugau

SEQ ID NO: 1648280 - RNA, 14 nt, Homo sapiens
ggcagcucagagag

SEQ ID NO: 1648281 - RNA, 17 nt, Homo sapiens
ggcagcugcuggcugug

SEQ ID NO: 1648282 - RNA, 20 nt, Homo sapiens
ggcaggaaggggaaacacag

SEQ ID NO: 1648283 - RNA, 20 nt, Homo sapiens
ggcagugggucccacuuccc

SEQ ID NO: 1648284 - RNA, 13 nt, Homo sapiens
ggcaucacagcua

SEQ ID NO: 1648285 - RNA, 23 nt, Homo sapiens
ggcaucaccuccaccauacucca

SEQ ID NO: 1648286 - RNA, 19 nt, Homo sapiens
ggccagagggagugacaga

SEQ ID NO: 1648287 - RNA, 20 nt, Homo sapiens
ggccaggcugcucuugaacu

SEQ ID NO: 1648288 - RNA, 22 nt, Homo sapiens
ggccauccugucccaccaugca

SEQ ID NO: 1648289 - RNA, 12 nt, Homo sapiens
agcaaagacuuu

SEQ ID NO: 1648290 - RNA, 15 nt, Homo sapiens
agcaaaggcugagaa

SEQ ID NO: 1648291 - RNA, 23 nt, Homo sapiens
agcaaaggcugagaacacuguga

SEQ ID NO: 1648292 - RNA, 19 nt, Homo sapiens
agcaaaucccaacauuucu

SEQ ID NO: 1648293 - RNA, 13 nt, Homo sapiens
agcaacccuguga

SEQ ID NO: 1648294 - RNA, 14 nt, Homo sapiens
agcaacccugugau

SEQ ID NO: 1648295 - RNA, 22 nt, Homo sapiens
agcaacuaucagacuaagccag

SEQ ID NO: 1648296 - RNA, 23 nt, Homo sapiens
agcaacuuguguuacaaaaauac

SEQ ID NO: 1648297 - RNA, 17 nt, Homo sapiens
agcaagcucccaaggga

SEQ ID NO: 1648298 - RNA, 15 nt, Homo sapiens
agcaauaaaaugcua

SEQ ID NO: 1648299 - RNA, 16 nt, Homo sapiens
agcaauaugcauuuaa

SEQ ID NO: 1648300 - RNA, 15 nt, Homo sapiens
agcaaugcugugaau

SEQ ID NO: 1648301 - RNA, 13 nt, Homo sapiens
agcaauugcauaa

SEQ ID NO: 1648302 - RNA, 20 nt, Homo sapiens
agcacacuuggcccaagugg

SEQ ID NO: 1648303 - RNA, 23 nt, Homo sapiens
agcacagacucacauauggacga

SEQ ID NO: 1648304 - RNA, 11 nt, Homo sapiens
agcacaggugg

SEQ ID NO: 1648305 - RNA, 15 nt, Homo sapiens
agcacauuuugacac

SEQ ID NO: 1648306 - RNA, 23 nt, Homo sapiens
agcacuaaggugugcucugauca

SEQ ID NO: 1648307 - RNA, 18 nt, Homo sapiens
agcacuaauucaacauau

SEQ ID NO: 1648308 - RNA, 17 nt, Homo sapiens
agcagagacuugggaca

SEQ ID NO: 1648309 - RNA, 22 nt, Homo sapiens
agcagagcaccuuagacagucc

SEQ ID NO: 1648310 - RNA, 17 nt, Homo sapiens
agcagaguucuuugcaa

SEQ ID NO: 1648311 - RNA, 21 nt, Homo sapiens
agcagauauauuaagugacug

SEQ ID NO: 1648312 - RNA, 14 nt, Homo sapiens
agcagcaacugugu

SEQ ID NO: 1648313 - RNA, 15 nt, Homo sapiens
agcagcaacuguguc

SEQ ID NO: 1648314 - RNA, 21 nt, Homo sapiens
agcagcgccccucccaagagg

SEQ ID NO: 1648315 - RNA, 24 nt, Homo sapiens
agcagcuccaaaacuggaccacca

SEQ ID NO: 1648316 - RNA, 15 nt, Homo sapiens
agcagcuccuguggc

SEQ ID NO: 1648317 - RNA, 15 nt, Homo sapiens
agcagcugcagcuca

SEQ ID NO: 1648318 - RNA, 22 nt, Homo sapiens
agcagcuucugccacuucccag

SEQ ID NO: 1648319 - RNA, 19 nt, Homo sapiens
agcaggcguucagcucacu

SEQ ID NO: 1648320 - RNA, 15 nt, Homo sapiens
agcaggcuacacuga

SEQ ID NO: 1648321 - RNA, 16 nt, Homo sapiens
agcaggcuacacugac

SEQ ID NO: 1648322 - RNA, 14 nt, Homo sapiens
agcagguggcagaa

SEQ ID NO: 1648323 - RNA, 19 nt, Homo sapiens
agcagguuucuugcuucug

SEQ ID NO: 1648324 - RNA, 15 nt, Homo sapiens
agcagugauucagua

SEQ ID NO: 1648325 - RNA, 15 nt, Homo sapiens
agcagugcaggcaca

SEQ ID NO: 1648326 - RNA, 21 nt, Homo sapiens
agcaguggacucaaaacccau

SEQ ID NO: 1648327 - RNA, 22 nt, Homo sapiens
agcauaggaggggucuggacau

SEQ ID NO: 1648328 - RNA, 19 nt, Homo sapiens
agcaucccuugaccaggcc

SEQ ID NO: 1648329 - RNA, 23 nt, Homo sapiens
agcaucuccagcauucucagcca

SEQ ID NO: 1648330 - RNA, 18 nt, Homo sapiens
agcauuuaauguagccau

SEQ ID NO: 1648331 - RNA, 24 nt, Homo sapiens
agccaaagccaauaacacacagcu

SEQ ID NO: 1648332 - RNA, 11 nt, Homo sapiens
agccacaggcc

SEQ ID NO: 1648333 - RNA, 16 nt, Homo sapiens
agccacgaggugcagu

SEQ ID NO: 1648334 - RNA, 17 nt, Homo sapiens
agccacgaggugcagua

SEQ ID NO: 1648335 - RNA, 13 nt, Homo sapiens
agccaguugaauu

SEQ ID NO: 1648336 - RNA, 21 nt, Homo sapiens
agccaugggaccaaaccuagc

SEQ ID NO: 1648337 - RNA, 15 nt, Homo sapiens
agcccauucauucca

SEQ ID NO: 1648338 - RNA, 14 nt, Homo sapiens
agccccacagccca

SEQ ID NO: 1648339 - RNA, 15 nt, Homo sapiens
agcccggcacuccag

SEQ ID NO: 1648340 - RNA, 21 nt, Homo sapiens
agcccucaccccugguucuca

SEQ ID NO: 1648341 - RNA, 15 nt, Homo sapiens
agcccuccuuaucaa

SEQ ID NO: 1648342 - RNA, 17 nt, Homo sapiens
agccggacacuucucag

SEQ ID NO: 1648343 - RNA, 20 nt, Homo sapiens
agccucccgaguagcugaga

SEQ ID NO: 1648344 - RNA, 14 nt, Homo sapiens
agccuccucuguga

SEQ ID NO: 1648345 - RNA, 20 nt, Homo sapiens
agccuccugaguagcuggga

SEQ ID NO: 1648346 - RNA, 20 nt, Homo sapiens
agccugacaacagccugaga

SEQ ID NO: 1648347 - RNA, 19 nt, Homo sapiens
agccugagaaugaccugcc

SEQ ID NO: 1648348 - RNA, 14 nt, Homo sapiens
agccugggugacaa

SEQ ID NO: 1648349 - RNA, 15 nt, Homo sapiens
agccuuauuucucau

SEQ ID NO: 1648350 - RNA, 19 nt, Homo sapiens
agccuuuuugucaccucaa

SEQ ID NO: 1648351 - RNA, 18 nt, Homo sapiens
agcgaggaggcuccagag

SEQ ID NO: 1648352 - RNA, 20 nt, Homo sapiens
agcgcuaguggaggguugga

SEQ ID NO: 1648353 - RNA, 17 nt, Homo sapiens
agcgucagaaucguguu

SEQ ID NO: 1648354 - RNA, 14 nt, Homo sapiens
agcgugaagggauu

SEQ ID NO: 1648355 - RNA, 15 nt, Homo sapiens
agcgugcgucugugu

SEQ ID NO: 1648356 - RNA, 23 nt, Homo sapiens
agcuaaaaccuacucacuuagca

SEQ ID NO: 1648357 - RNA, 13 nt, Homo sapiens
agcuaacuuauca

SEQ ID NO: 1648358 - RNA, 14 nt, Homo sapiens
agcuaagaugccau

SEQ ID NO: 1648359 - RNA, 19 nt, Homo sapiens
agcuagaaaacaggcaaau

SEQ ID NO: 1648360 - RNA, 12 nt, Homo sapiens
agcuagaaccua

SEQ ID NO: 1648361 - RNA, 22 nt, Homo sapiens
agcuauucuccauguacuggca

SEQ ID NO: 1648362 - RNA, 12 nt, Homo sapiens
agcucaucucag

SEQ ID NO: 1648363 - RNA, 17 nt, Homo sapiens
agcuccaaaacuggacc

SEQ ID NO: 1648364 - RNA, 18 nt, Homo sapiens
agcucccaagagcuucca

SEQ ID NO: 1648365 - RNA, 13 nt, Homo sapiens
agcuccugccucu

SEQ ID NO: 1648366 - RNA, 15 nt, Homo sapiens
agcuccuguggccac

SEQ ID NO: 1648367 - RNA, 23 nt, Homo sapiens
agcuccuucuguccuacucugug

SEQ ID NO: 1648368 - RNA, 20 nt, Homo sapiens
agcucgggcccucugugaga

SEQ ID NO: 1648369 - RNA, 18 nt, Homo sapiens
agcucuacacaacaugua

SEQ ID NO: 1648370 - RNA, 14 nt, Homo sapiens
agcucuaucugcaa

SEQ ID NO: 1648371 - RNA, 15 nt, Homo sapiens
agcucucaguugcag

SEQ ID NO: 1648372 - RNA, 19 nt, Homo sapiens
agcucucuucaaugacaua

SEQ ID NO: 1648373 - RNA, 20 nt, Homo sapiens
agcucugaaaccaguguuag

SEQ ID NO: 1648374 - RNA, 18 nt, Homo sapiens
agcugacacaggaugaag

SEQ ID NO: 1648375 - RNA, 20 nt, Homo sapiens
agcugagucucccuaaggca

SEQ ID NO: 1648376 - RNA, 20 nt, Homo sapiens
agcugaugaacuguggugcc

SEQ ID NO: 1648377 - RNA, 18 nt, Homo sapiens
agcugccugggaucccuc

SEQ ID NO: 1648378 - RNA, 21 nt, Homo sapiens
agcuggcagagagcacaguga

SEQ ID NO: 1648379 - RNA, 22 nt, Homo sapiens
agcuggcagagagcacagugau

SEQ ID NO: 1648380 - RNA, 17 nt, Homo sapiens
agcugggacuacaggug

SEQ ID NO: 1648381 - RNA, 23 nt, Homo sapiens
agcugggauuacaggcuccugcc

SEQ ID NO: 1648382 - RNA, 13 nt, Homo sapiens
agcugggcagcug

SEQ ID NO: 1648383 - RNA, 21 nt, Homo sapiens
agcuggguuggaaaacaguau

SEQ ID NO: 1648384 - RNA, 18 nt, Homo sapiens
agcugguuggagagcuag

SEQ ID NO: 1648385 - RNA, 20 nt, Homo sapiens
agcuguuuaugcauagauaa

SEQ ID NO: 1648386 - RNA, 22 nt, Homo sapiens
agcuguuuccucacguccauca

SEQ ID NO: 1648387 - RNA, 18 nt, Homo sapiens
agcuuagacuaaggccau

SEQ ID NO: 1648388 - RNA, 15 nt, Homo sapiens
agcuuagagccuccc

SEQ ID NO: 1648389 - RNA, 19 nt, Homo sapiens
agcuuauuauagaauugca

SEQ ID NO: 1648390 - RNA, 17 nt, Homo sapiens
agcuucugccacuuccc

SEQ ID NO: 1648391 - RNA, 22 nt, Homo sapiens
agcuugcucacaucuuggcaca

SEQ ID NO: 1648392 - RNA, 18 nt, Homo sapiens
agcuuucaaaagcaagaa

SEQ ID NO: 1648393 - RNA, 15 nt, Homo sapiens
agcuuucucuaguuc

SEQ ID NO: 1648394 - RNA, 17 nt, Homo sapiens
agcuuucucuaguucaa

SEQ ID NO: 1648395 - RNA, 21 nt, Homo sapiens
agcuuuguacacgaagaccau

SEQ ID NO: 1648396 - RNA, 14 nt, Homo sapiens
aggaaaccacagcu

SEQ ID NO: 1648397 - RNA, 16 nt, Homo sapiens
aggaagauguaugcuu

SEQ ID NO: 1648398 - RNA, 20 nt, Homo sapiens
augcaccaaaucaucucuca

SEQ ID NO: 1648399 - RNA, 22 nt, Homo sapiens
augcacuguucccccugugcag

SEQ ID NO: 1648400 - RNA, 19 nt, Homo sapiens
augcagagguccacaacac

SEQ ID NO: 1648401 - RNA, 18 nt, Homo sapiens
augcaguauugagcacug

SEQ ID NO: 1648402 - RNA, 18 nt, Homo sapiens
augcagugauauggcaga

SEQ ID NO: 1648403 - RNA, 17 nt, Homo sapiens
augcauacaaguuucau

SEQ ID NO: 1648404 - RNA, 20 nt, Homo sapiens
augcauagccuggacacaga

SEQ ID NO: 1648405 - RNA, 21 nt, Homo sapiens
augcaucugcuacugugucag

SEQ ID NO: 1648406 - RNA, 17 nt, Homo sapiens
augcauggaaauucccu

SEQ ID NO: 1648407 - RNA, 21 nt, Homo sapiens
augcauguaauggacuaugca

SEQ ID NO: 1648408 - RNA, 20 nt, Homo sapiens
augcauguuuuccagcuccu

SEQ ID NO: 1648409 - RNA, 17 nt, Homo sapiens
augccaagcacugugcu

SEQ ID NO: 1648410 - RNA, 13 nt, Homo sapiens
augccacuaugag

SEQ ID NO: 1648411 - RNA, 16 nt, Homo sapiens
augccuaccuugugag

SEQ ID NO: 1648412 - RNA, 17 nt, Homo sapiens
augccucagccuccuga

SEQ ID NO: 1648413 - RNA, 22 nt, Homo sapiens
augccucauuaccuugugcuaa

SEQ ID NO: 1648414 - RNA, 17 nt, Homo sapiens
augccugauugccaagc

SEQ ID NO: 1648415 - RNA, 18 nt, Homo sapiens
augcgagugcucauuuca

SEQ ID NO: 1648416 - RNA, 18 nt, Homo sapiens
augcuauaacuauguuga

SEQ ID NO: 1648417 - RNA, 23 nt, Homo sapiens
augcucaaccuaaccaccuaccu

SEQ ID NO: 1648418 - RNA, 15 nt, Homo sapiens
augcuccaccgucag

SEQ ID NO: 1648419 - RNA, 14 nt, Homo sapiens
augcucccucugug

SEQ ID NO: 1648420 - RNA, 15 nt, Homo sapiens
augcucccucugugu

SEQ ID NO: 1648421 - RNA, 21 nt, Homo sapiens
augcuuauguguugcauaaac

SEQ ID NO: 1648422 - RNA, 23 nt, Homo sapiens
augcuugauuuagguagccuugu

SEQ ID NO: 1648423 - RNA, 18 nt, Homo sapiens
augcuuuaagugcacaac

SEQ ID NO: 1648424 - RNA, 18 nt, Homo sapiens
auggaaauguuuacagau

SEQ ID NO: 1648425 - RNA, 17 nt, Homo sapiens
auggaaauucccuucau

SEQ ID NO: 1648426 - RNA, 12 nt, Homo sapiens
auggacuuuguu

SEQ ID NO: 1648427 - RNA, 23 nt, Homo sapiens
auggauucugcaucgguucgcau

SEQ ID NO: 1648428 - RNA, 22 nt, Homo sapiens
auggcaucucauugaggacaaa

SEQ ID NO: 1648429 - RNA, 18 nt, Homo sapiens
auggcuuuuuuugccuac

SEQ ID NO: 1648430 - RNA, 16 nt, Homo sapiens
augggacucaaugcac

SEQ ID NO: 1648431 - RNA, 17 nt, Homo sapiens
augggcagcucaucucu

SEQ ID NO: 1648432 - RNA, 22 nt, Homo sapiens
auggguaucuaauaaauacuua

SEQ ID NO: 1648433 - RNA, 24 nt, Homo sapiens
augguaauucaguuauuugcacaa

SEQ ID NO: 1648434 - RNA, 19 nt, Homo sapiens
auggucuucuccauccuca

SEQ ID NO: 1648435 - RNA, 20 nt, Homo sapiens
augguggcucacaccuguaa

SEQ ID NO: 1648436 - RNA, 20 nt, Homo sapiens
augguuugugucaaaacugg

SEQ ID NO: 1648437 - RNA, 17 nt, Homo sapiens
auguacaagguauguac

SEQ ID NO: 1648438 - RNA, 20 nt, Homo sapiens
auguauaucuucuacaugca

SEQ ID NO: 1648439 - RNA, 21 nt, Homo sapiens
auguaugcuuugaaugcaaaa

SEQ ID NO: 1648440 - RNA, 17 nt, Homo sapiens
auguauuagccagucau

SEQ ID NO: 1648441 - RNA, 20 nt, Homo sapiens
augucacaguaaugcaagca

SEQ ID NO: 1648442 - RNA, 17 nt, Homo sapiens
augucagaggccccaug

SEQ ID NO: 1648443 - RNA, 18 nt, Homo sapiens
augucauauuuugccacu

SEQ ID NO: 1648444 - RNA, 19 nt, Homo sapiens
auguccauuauucaagaaa

SEQ ID NO: 1648445 - RNA, 16 nt, Homo sapiens
auguccuccucuguga

SEQ ID NO: 1648446 - RNA, 18 nt, Homo sapiens
auguccuccucugugaaa

SEQ ID NO: 1648447 - RNA, 19 nt, Homo sapiens
augucucuuuaaugucaca

SEQ ID NO: 1648448 - RNA, 15 nt, Homo sapiens
augucuuucagccaa

SEQ ID NO: 1648449 - RNA, 13 nt, Homo sapiens
augugaaacacac

SEQ ID NO: 1648450 - RNA, 10 nt, Homo sapiens
augugcaaua

SEQ ID NO: 1648451 - RNA, 14 nt, Homo sapiens
augugcacaugcac

SEQ ID NO: 1648452 - RNA, 18 nt, Homo sapiens
auguggcuguauccacuu

SEQ ID NO: 1648453 - RNA, 22 nt, Homo sapiens
augugucccagccacaguguua

SEQ ID NO: 1648454 - RNA, 17 nt, Homo sapiens
auguguucauucuggaa

SEQ ID NO: 1648455 - RNA, 11 nt, Homo sapiens
auguguugcau

SEQ ID NO: 1648456 - RNA, 13 nt, Homo sapiens
auguuacugagau

SEQ ID NO: 1648457 - RNA, 15 nt, Homo sapiens
auguuagucaaggac

SEQ ID NO: 1648458 - RNA, 13 nt, Homo sapiens
auguuauuaccua

SEQ ID NO: 1648459 - RNA, 21 nt, Homo sapiens
auguucuauuucagugccaau

SEQ ID NO: 1648460 - RNA, 20 nt, Homo sapiens
auguucugggacacaguuca

SEQ ID NO: 1648461 - RNA, 20 nt, Homo sapiens
auguugcccaguguguuucu

SEQ ID NO: 1648462 - RNA, 17 nt, Homo sapiens
auguuguagcagugauu

SEQ ID NO: 1648463 - RNA, 21 nt, Homo sapiens
auguugucaggucguucuuau

SEQ ID NO: 1648464 - RNA, 22 nt, Homo sapiens
auguuucugucacaucagcucc

SEQ ID NO: 1648465 - RNA, 21 nt, Homo sapiens
auguuuguuauuuacacuggu

SEQ ID NO: 1648466 - RNA, 23 nt, Homo sapiens
auguuuuuguguagaguggcgau

SEQ ID NO: 1648467 - RNA, 19 nt, Homo sapiens
auuaaaaagauagacuuca

SEQ ID NO: 1648468 - RNA, 18 nt, Homo sapiens
auuaaaguuaaacuguau

SEQ ID NO: 1648469 - RNA, 18 nt, Homo sapiens
auuaacacucauuuccaa

SEQ ID NO: 1648470 - RNA, 16 nt, Homo sapiens
auuaacggagugucua

SEQ ID NO: 1648471 - RNA, 22 nt, Homo sapiens
auuaaugaucagcuauauacua

SEQ ID NO: 1648472 - RNA, 21 nt, Homo sapiens
auuaauuugugaauuugcaac

SEQ ID NO: 1648473 - RNA, 22 nt, Homo sapiens
auuaauuuuccaaugcacaguu

SEQ ID NO: 1648474 - RNA, 17 nt, Homo sapiens
auuacaaauccaaugaa

SEQ ID NO: 1648475 - RNA, 14 nt, Homo sapiens
auuacagacaugaa

SEQ ID NO: 1648476 - RNA, 19 nt, Homo sapiens
auuacagggaaugccugag

SEQ ID NO: 1648477 - RNA, 23 nt, Homo sapiens
auuacaggugugaaccaccacac

SEQ ID NO: 1648478 - RNA, 17 nt, Homo sapiens
auuacaggugugagcca

SEQ ID NO: 1648479 - RNA, 16 nt, Homo sapiens
auuacauaguccagug

SEQ ID NO: 1648480 - RNA, 20 nt, Homo sapiens
auuacccccuuuccucuugg

SEQ ID NO: 1648481 - RNA, 16 nt, Homo sapiens
auuaccuccugagaaa

SEQ ID NO: 1648482 - RNA, 16 nt, Homo sapiens
auuauaaacaaccuag

SEQ ID NO: 1648483 - RNA, 23 nt, Homo sapiens
auuauacccccugcaaagcccag

SEQ ID NO: 1648484 - RNA, 13 nt, Homo sapiens
auuauagaaugga

SEQ ID NO: 1648485 - RNA, 17 nt, Homo sapiens
auuauaugcacuagcaa

SEQ ID NO: 1648486 - RNA, 20 nt, Homo sapiens
auuauauuaucauaucucuc

SEQ ID NO: 1648487 - RNA, 14 nt, Homo sapiens
auuauauucauucu

SEQ ID NO: 1648488 - RNA, 20 nt, Homo sapiens
auuauauuuacaaaugggaa

SEQ ID NO: 1648489 - RNA, 22 nt, Homo sapiens
auuaugcaucugcuacuguguc

SEQ ID NO: 1648490 - RNA, 14 nt, Homo sapiens
auuauuuuguuacu

SEQ ID NO: 1648491 - RNA, 15 nt, Homo sapiens
auucaaagcacuguu

SEQ ID NO: 1648492 - RNA, 20 nt, Homo sapiens
auucaacagagacugaauag

SEQ ID NO: 1648493 - RNA, 13 nt, Homo sapiens
auucacaguguga

SEQ ID NO: 1648494 - RNA, 21 nt, Homo sapiens
auucacccccaaacagugaca

SEQ ID NO: 1648495 - RNA, 23 nt, Homo sapiens
auucagaauuucuaaaaguuuaa

SEQ ID NO: 1648496 - RNA, 16 nt, Homo sapiens
auucagccaggagaug

SEQ ID NO: 1648497 - RNA, 20 nt, Homo sapiens
auucagugacuuaauaucua

SEQ ID NO: 1648498 - RNA, 22 nt, Homo sapiens
auucaguucuuacacauuccau

SEQ ID NO: 1648499 - RNA, 16 nt, Homo sapiens
auucauauugcaucau

SEQ ID NO: 1648500 - RNA, 13 nt, Homo sapiens
auucaucagggag

SEQ ID NO: 1648501 - RNA, 16 nt, Homo sapiens
auucaucucaaggaau

SEQ ID NO: 1648502 - RNA, 10 nt, Homo sapiens
auucauucca

SEQ ID NO: 1648503 - RNA, 21 nt, Homo sapiens
auuccacuauuugcagaggcu

SEQ ID NO: 1648504 - RNA, 14 nt, Homo sapiens
auuccaguggaaca

SEQ ID NO: 1648505 - RNA, 14 nt, Homo sapiens
auuccaucuuacau

SEQ ID NO: 1648506 - RNA, 18 nt, Homo sapiens
auucccacagcacuaauu

SEQ ID NO: 1648507 - RNA, 18 nt, Homo sapiens
cagcccuccuuaucaaag

SEQ ID NO: 1648508 - RNA, 15 nt, Homo sapiens
cagccucacaguccu

SEQ ID NO: 1648509 - RNA, 17 nt, Homo sapiens
cagccucagcucucagu

SEQ ID NO: 1648510 - RNA, 15 nt, Homo sapiens
cagccucaggaugag

SEQ ID NO: 1648511 - RNA, 18 nt, Homo sapiens
cagccuccugaguagcug

SEQ ID NO: 1648512 - RNA, 20 nt, Homo sapiens
cagccuccugaguagcuggg

SEQ ID NO: 1648513 - RNA, 23 nt, Homo sapiens
cagccuccugaguagcugggauu

SEQ ID NO: 1648514 - RNA, 19 nt, Homo sapiens
cagccuugaccucugggag

SEQ ID NO: 1648515 - RNA, 16 nt, Homo sapiens
cagcgagcccuggugg

SEQ ID NO: 1648516 - RNA, 20 nt, Homo sapiens
cagcuaacacacagcuccca

SEQ ID NO: 1648517 - RNA, 17 nt, Homo sapiens
cagcuaagaugccaugu

SEQ ID NO: 1648518 - RNA, 14 nt, Homo sapiens
cagcuaaugggaca

SEQ ID NO: 1648519 - RNA, 14 nt, Homo sapiens
cagcucacugcaac

SEQ ID NO: 1648520 - RNA, 22 nt, Homo sapiens
cagcuccaaaacuggaccacca

SEQ ID NO: 1648521 - RNA, 16 nt, Homo sapiens
cagcugacaguccucu

SEQ ID NO: 1648522 - RNA, 19 nt, Homo sapiens
cagcugcgguccacccagg

SEQ ID NO: 1648523 - RNA, 15 nt, Homo sapiens
cagcuggaucuccau

SEQ ID NO: 1648524 - RNA, 19 nt, Homo sapiens
cagcuggcgucaugcaaag

SEQ ID NO: 1648525 - RNA, 23 nt, Homo sapiens
cagcuggcgucaugcaaagucau

SEQ ID NO: 1648526 - RNA, 22 nt, Homo sapiens
cagcuuguaaauagcucaggug

SEQ ID NO: 1648527 - RNA, 20 nt, Homo sapiens
cagcuuuucccaaaagccca

SEQ ID NO: 1648528 - RNA, 17 nt, Homo sapiens
caggaaaggcuccagga

SEQ ID NO: 1648529 - RNA, 23 nt, Homo sapiens
caggaaccucagggcugugugua

SEQ ID NO: 1648530 - RNA, 15 nt, Homo sapiens
caggaagaaggugug

SEQ ID NO: 1648531 - RNA, 18 nt, Homo sapiens
caggaagaccccagcaca

SEQ ID NO: 1648532 - RNA, 19 nt, Homo sapiens
caggaaggggaaacacagc

SEQ ID NO: 1648533 - RNA, 20 nt, Homo sapiens
caggaggcagagguugcagu

SEQ ID NO: 1648534 - RNA, 15 nt, Homo sapiens
caggaguuccagugc

SEQ ID NO: 1648535 - RNA, 18 nt, Homo sapiens
caggaguuggaagugugu

SEQ ID NO: 1648536 - RNA, 23 nt, Homo sapiens
caggaguuggaagugugugaucu

SEQ ID NO: 1648537 - RNA, 14 nt, Homo sapiens
caggcaacgcacaa

SEQ ID NO: 1648538 - RNA, 13 nt, Homo sapiens
caggcaagcaccu

SEQ ID NO: 1648539 - RNA, 15 nt, Homo sapiens
caggcacagcacagg

SEQ ID NO: 1648540 - RNA, 12 nt, Homo sapiens
caggcacugaga

SEQ ID NO: 1648541 - RNA, 15 nt, Homo sapiens
caggcauguucucug

SEQ ID NO: 1648542 - RNA, 14 nt, Homo sapiens
caggccccugccac

SEQ ID NO: 1648543 - RNA, 18 nt, Homo sapiens
caggcccggcuccaggcu

SEQ ID NO: 1648544 - RNA, 15 nt, Homo sapiens
caggcgugaccugcc

SEQ ID NO: 1648545 - RNA, 20 nt, Homo sapiens
caggcgugagccaccgugcc

SEQ ID NO: 1648546 - RNA, 19 nt, Homo sapiens
caggcuacacugacacugg

SEQ ID NO: 1648547 - RNA, 16 nt, Homo sapiens
caggcuggagugcaau

SEQ ID NO: 1648548 - RNA, 17 nt, Homo sapiens
caggcuggagugcagug

SEQ ID NO: 1648549 - RNA, 13 nt, Homo sapiens
cagggaaaauaua

SEQ ID NO: 1648550 - RNA, 19 nt, Homo sapiens
cagggaaaauuauuugcau

SEQ ID NO: 1648551 - RNA, 23 nt, Homo sapiens
cagggcaggaaggggaaacacag

SEQ ID NO: 1648552 - RNA, 13 nt, Homo sapiens
cagggcugcaaug

SEQ ID NO: 1648553 - RNA, 20 nt, Homo sapiens
cagggucucacuauguugcc

SEQ ID NO: 1648554 - RNA, 21 nt, Homo sapiens
cagggucucacuauguugccc

SEQ ID NO: 1648555 - RNA, 19 nt, Homo sapiens
cagggucucacucugucgc

SEQ ID NO: 1648556 - RNA, 21 nt, Homo sapiens
caggguuuugccauguuggcc

SEQ ID NO: 1648557 - RNA, 19 nt, Homo sapiens
cagguaaaugguaugauca

SEQ ID NO: 1648558 - RNA, 21 nt, Homo sapiens
caggucuugacaccagcuguu

SEQ ID NO: 1648559 - RNA, 13 nt, Homo sapiens
caggugaagcacc

SEQ ID NO: 1648560 - RNA, 16 nt, Homo sapiens
caggugugaaccacca

SEQ ID NO: 1648561 - RNA, 14 nt, Homo sapiens
caggugugagucac

SEQ ID NO: 1648562 - RNA, 16 nt, Homo sapiens
cagguuccaaucagaa

SEQ ID NO: 1648563 - RNA, 21 nt, Homo sapiens
cagguucugacucuuggcaca

SEQ ID NO: 1648564 - RNA, 14 nt, Homo sapiens
caguaugauaucau

SEQ ID NO: 1648565 - RNA, 19 nt, Homo sapiens
cagucacguguaaacagga

SEQ ID NO: 1648566 - RNA, 18 nt, Homo sapiens
caguccaaggaaaccaca

SEQ ID NO: 1648567 - RNA, 12 nt, Homo sapiens
cagugacauuua

SEQ ID NO: 1648568 - RNA, 14 nt, Homo sapiens
cagugagaugcauu

SEQ ID NO: 1648569 - RNA, 22 nt, Homo sapiens
cagugagccgagaucacaccac

SEQ ID NO: 1648570 - RNA, 20 nt, Homo sapiens
cagugagccgagaucgugcc

SEQ ID NO: 1648571 - RNA, 23 nt, Homo sapiens
cagugcagagauccuacuucucu

SEQ ID NO: 1648572 - RNA, 17 nt, Homo sapiens
cagugcaggcacaguau

SEQ ID NO: 1648573 - RNA, 22 nt, Homo sapiens
cagugcccacaggaucagucug

SEQ ID NO: 1648574 - RNA, 18 nt, Homo sapiens
cagugcccauuccucacc

SEQ ID NO: 1648575 - RNA, 16 nt, Homo sapiens
cagugccccuagcuua

SEQ ID NO: 1648576 - RNA, 12 nt, Homo sapiens
cagugcucccuc

SEQ ID NO: 1648577 - RNA, 14 nt, Homo sapiens
caguggaacuaaga

SEQ ID NO: 1648578 - RNA, 19 nt, Homo sapiens
caguggacucaaaacccau

SEQ ID NO: 1648579 - RNA, 19 nt, Homo sapiens
caguggcuugcuuucuucu

SEQ ID NO: 1648580 - RNA, 13 nt, Homo sapiens
caguguacagucu

SEQ ID NO: 1648581 - RNA, 15 nt, Homo sapiens
cagugucuuccugug

SEQ ID NO: 1648582 - RNA, 17 nt, Homo sapiens
cagugucuuuccaccuu

SEQ ID NO: 1648583 - RNA, 22 nt, Homo sapiens
cagugugccccccauccuggcc

SEQ ID NO: 1648584 - RNA, 19 nt, Homo sapiens
caguguuaggccuggcaca

SEQ ID NO: 1648585 - RNA, 17 nt, Homo sapiens
caguguugacacuuaaa

SEQ ID NO: 1648586 - RNA, 16 nt, Homo sapiens
caguuacccaacagaa

SEQ ID NO: 1648587 - RNA, 20 nt, Homo sapiens
caguucagaaucacuucuga

SEQ ID NO: 1648588 - RNA, 17 nt, Homo sapiens
caguucccucccucaaa

SEQ ID NO: 1648589 - RNA, 20 nt, Homo sapiens
caguuuaaccugaugcaguc

SEQ ID NO: 1648590 - RNA, 19 nt, Homo sapiens
caguuucuuagcuuuuuaa

SEQ ID NO: 1648591 - RNA, 20 nt, Homo sapiens
cauaaaauccaauauuguaa

SEQ ID NO: 1648592 - RNA, 21 nt, Homo sapiens
cauaaagucuuugaagugacu

SEQ ID NO: 1648593 - RNA, 18 nt, Homo sapiens
cauaagugcaugacauau

SEQ ID NO: 1648594 - RNA, 21 nt, Homo sapiens
cauaauguuucuggauuucau

SEQ ID NO: 1648595 - RNA, 18 nt, Homo sapiens
cauaauuucuucacucaa

SEQ ID NO: 1648596 - RNA, 12 nt, Homo sapiens
cauacaaauacu

SEQ ID NO: 1648597 - RNA, 21 nt, Homo sapiens
cauacaaauacuauccaaaua

SEQ ID NO: 1648598 - RNA, 16 nt, Homo sapiens
cauacagcacaauguu

SEQ ID NO: 1648599 - RNA, 14 nt, Homo sapiens
cauacauuaucuca

SEQ ID NO: 1648600 - RNA, 22 nt, Homo sapiens
cauaccaaugaaaaaauguaua

SEQ ID NO: 1648601 - RNA, 13 nt, Homo sapiens
cauacuuguucug

SEQ ID NO: 1648602 - RNA, 16 nt, Homo sapiens
cauagcuccugcucca

SEQ ID NO: 1648603 - RNA, 19 nt, Homo sapiens
cauaggaggggucuggaca

SEQ ID NO: 1648604 - RNA, 23 nt, Homo sapiens
cauaggcccagugagaugcauuc

SEQ ID NO: 1648605 - RNA, 17 nt, Homo sapiens
cauaguaccucugcuau

SEQ ID NO: 1648606 - RNA, 23 nt, Homo sapiens
cauauauuugaaguggagccaua

SEQ ID NO: 1648607 - RNA, 15 nt, Homo sapiens
cauauauuuguauga

SEQ ID NO: 1648608 - RNA, 14 nt, Homo sapiens
cauauccaacaugu

SEQ ID NO: 1648609 - RNA, 18 nt, Homo sapiens
cauauccaacaugugcuc

SEQ ID NO: 1648610 - RNA, 20 nt, Homo sapiens
cauauccaacaugugcucag

SEQ ID NO: 1648611 - RNA, 23 nt, Homo sapiens
cauaugagagcucuaguauuucc

SEQ ID NO: 1648612 - RNA, 22 nt, Homo sapiens
cauauuaagaauagucucuggg

SEQ ID NO: 1648613 - RNA, 18 nt, Homo sapiens
cauauugaugugugucua

SEQ ID NO: 1648614 - RNA, 19 nt, Homo sapiens
cauauuuugccacugccuu

SEQ ID NO: 1648615 - RNA, 18 nt, Homo sapiens
caucaaggcacugccuga

SEQ ID NO: 1648616 - RNA, 22 nt, Homo sapiens
cgaaaagaagguauuuuuccaa

SEQ ID NO: 1648617 - RNA, 19 nt, Homo sapiens
cgaagaaaauaauucucua

SEQ ID NO: 1648618 - RNA, 13 nt, Homo sapiens
cgaagucuuccau

SEQ ID NO: 1648619 - RNA, 15 nt, Homo sapiens
cgacaacuugcacgu

SEQ ID NO: 1648620 - RNA, 17 nt, Homo sapiens
cgagaucacaccacugu

SEQ ID NO: 1648621 - RNA, 19 nt, Homo sapiens
cgagaucacgccacugcac

SEQ ID NO: 1648622 - RNA, 15 nt, Homo sapiens
cgagccuggcuccaa

SEQ ID NO: 1648623 - RNA, 19 nt, Homo sapiens
cgaggacagggaggugacc

SEQ ID NO: 1648624 - RNA, 21 nt, Homo sapiens
cgaggauggguuugagaagga

SEQ ID NO: 1648625 - RNA, 12 nt, Homo sapiens
cgaggugcagua

SEQ ID NO: 1648626 - RNA, 17 nt, Homo sapiens
cgaguagcugagauuau

SEQ ID NO: 1648627 - RNA, 17 nt, Homo sapiens
cgauaaaagacagugaa

SEQ ID NO: 1648628 - RNA, 12 nt, Homo sapiens
cgaucuggguuc

SEQ ID NO: 1648629 - RNA, 20 nt, Homo sapiens
cgaucuggguucacugcaac

SEQ ID NO: 1648630 - RNA, 14 nt, Homo sapiens
cgaugacaguguuc

SEQ ID NO: 1648631 - RNA, 20 nt, Homo sapiens
cgauguccuccucugugaaa

SEQ ID NO: 1648632 - RNA, 12 nt, Homo sapiens
cgcaaagggcau

SEQ ID NO: 1648633 - RNA, 15 nt, Homo sapiens
cgcacacacagugau

SEQ ID NO: 1648634 - RNA, 18 nt, Homo sapiens
cgcagauguccuugaugc

SEQ ID NO: 1648635 - RNA, 20 nt, Homo sapiens
cgccacccucccacugccaa

SEQ ID NO: 1648636 - RNA, 14 nt, Homo sapiens
cgccacgcuugugu

SEQ ID NO: 1648637 - RNA, 20 nt, Homo sapiens
cgcccaggcuggagugcaau

SEQ ID NO: 1648638 - RNA, 13 nt, Homo sapiens
cgcccuccacaaa

SEQ ID NO: 1648639 - RNA, 20 nt, Homo sapiens
cgccuucucccccccggggc

SEQ ID NO: 1648640 - RNA, 14 nt, Homo sapiens
cgcggccaccucac

SEQ ID NO: 1648641 - RNA, 22 nt, Homo sapiens
cgcuaaaugaaaaucgugacaa

SEQ ID NO: 1648642 - RNA, 13 nt, Homo sapiens
cgcuaucacagcu

SEQ ID NO: 1648643 - RNA, 16 nt, Homo sapiens
cgcuggaccuugaacu

SEQ ID NO: 1648644 - RNA, 15 nt, Homo sapiens
cgcuggagugcagug

SEQ ID NO: 1648645 - RNA, 17 nt, Homo sapiens
cgcuggguccucugcag

SEQ ID NO: 1648646 - RNA, 21 nt, Homo sapiens
cgcuucugcuuaaucugagaa

SEQ ID NO: 1648647 - RNA, 16 nt, Homo sapiens
cggacacuucucagga

SEQ ID NO: 1648648 - RNA, 15 nt, Homo sapiens
cggcaggcauggcug

SEQ ID NO: 1648649 - RNA, 16 nt, Homo sapiens
cggcccaauccaaggu

SEQ ID NO: 1648650 - RNA, 16 nt, Homo sapiens
cggcuguuuacugcuu

SEQ ID NO: 1648651 - RNA, 13 nt, Homo sapiens
cgggacagacuaa

SEQ ID NO: 1648652 - RNA, 23 nt, Homo sapiens
cgggggcuuggcugugcccucag

SEQ ID NO: 1648653 - RNA, 20 nt, Homo sapiens
cggguggaucacaaggucaa

SEQ ID NO: 1648654 - RNA, 19 nt, Homo sapiens
cguauaauuuagucccuua

SEQ ID NO: 1648655 - RNA, 17 nt, Homo sapiens
cgucaaagcugaaaugg

SEQ ID NO: 1648656 - RNA, 16 nt, Homo sapiens
cgugaaaaugcuguau

SEQ ID NO: 1648657 - RNA, 17 nt, Homo sapiens
cgugaucacugagccau

SEQ ID NO: 1648658 - RNA, 15 nt, Homo sapiens
cgugauccaccugcc

SEQ ID NO: 1648659 - RNA, 22 nt, Homo sapiens
cgugauguggagggcacauucc

SEQ ID NO: 1648660 - RNA, 19 nt, Homo sapiens
cgugauuuugcuguagaag

SEQ ID NO: 1648661 - RNA, 16 nt, Homo sapiens
cgugcacacaccagag

SEQ ID NO: 1648662 - RNA, 17 nt, Homo sapiens
cgugcacacaccagagc

SEQ ID NO: 1648663 - RNA, 20 nt, Homo sapiens
cgugcgucugugugugccug

SEQ ID NO: 1648664 - RNA, 13 nt, Homo sapiens
cgugggcucccug

SEQ ID NO: 1648665 - RNA, 19 nt, Homo sapiens
cgugguagugcaagcugaa

SEQ ID NO: 1648666 - RNA, 20 nt, Homo sapiens
cguugauguuggcugggaac

SEQ ID NO: 1648667 - RNA, 12 nt, Homo sapiens
cguuuaaucaca

SEQ ID NO: 1648668 - RNA, 13 nt, Homo sapiens
cguuuaaucacau

SEQ ID NO: 1648669 - RNA, 17 nt, Homo sapiens
cguuuccuuucauuuac

SEQ ID NO: 1648670 - RNA, 14 nt, Homo sapiens
cguuugaaucacag

SEQ ID NO: 1648671 - RNA, 21 nt, Homo sapiens
cguuuucgaggaagaaccugu

SEQ ID NO: 1648672 - RNA, 19 nt, Homo sapiens
cuaaaaauucuuaacuuuu

SEQ ID NO: 1648673 - RNA, 15 nt, Homo sapiens
cuaaaaccugagcua

SEQ ID NO: 1648674 - RNA, 21 nt, Homo sapiens
cuaaaauauuuuagauguuau

SEQ ID NO: 1648675 - RNA, 14 nt, Homo sapiens
cuaaaaucagggaa

SEQ ID NO: 1648676 - RNA, 16 nt, Homo sapiens
cuaaacccucugugaa

SEQ ID NO: 1648677 - RNA, 17 nt, Homo sapiens
cuaaacccucugugaaa

SEQ ID NO: 1648678 - RNA, 15 nt, Homo sapiens
cuaaagaagguuuca

SEQ ID NO: 1648679 - RNA, 14 nt, Homo sapiens
cuaaagccauugua

SEQ ID NO: 1648680 - RNA, 16 nt, Homo sapiens
cuaaagguuguauugc

SEQ ID NO: 1648681 - RNA, 21 nt, Homo sapiens
cuaaauauugauuucugccuu

SEQ ID NO: 1648682 - RNA, 14 nt, Homo sapiens
cuaaauccaaugac

SEQ ID NO: 1648683 - RNA, 18 nt, Homo sapiens
cuaaaugaguaaacccag

SEQ ID NO: 1648684 - RNA, 23 nt, Homo sapiens
cuaaauggugcugcagauuugau

SEQ ID NO: 1648685 - RNA, 15 nt, Homo sapiens
cuaacuagcauugua

SEQ ID NO: 1648686 - RNA, 13 nt, Homo sapiens
cuaacuagcuugg

SEQ ID NO: 1648687 - RNA, 21 nt, Homo sapiens
cuaacuuuuuugcuauccagc

SEQ ID NO: 1648688 - RNA, 16 nt, Homo sapiens
cuaagaagcugcaaua

SEQ ID NO: 1648689 - RNA, 17 nt, Homo sapiens
cuaagcacgggccauau

SEQ ID NO: 1648690 - RNA, 20 nt, Homo sapiens
cuaagcacgggccauaugaa

SEQ ID NO: 1648691 - RNA, 20 nt, Homo sapiens
cuaagcugccgguucuuaaa

SEQ ID NO: 1648692 - RNA, 23 nt, Homo sapiens
cuaagugauccucccaccucagc

SEQ ID NO: 1648693 - RNA, 16 nt, Homo sapiens
cuaaguguaccagaga

SEQ ID NO: 1648694 - RNA, 14 nt, Homo sapiens
cuaauaaauacuua

SEQ ID NO: 1648695 - RNA, 12 nt, Homo sapiens
cuaauacuuugu

SEQ ID NO: 1648696 - RNA, 18 nt, Homo sapiens
cuaauaucuuaaugaaua

SEQ ID NO: 1648697 - RNA, 17 nt, Homo sapiens
cuaauaugacauaugac

SEQ ID NO: 1648698 - RNA, 15 nt, Homo sapiens
cuaauucaacauaua

SEQ ID NO: 1648699 - RNA, 15 nt, Homo sapiens
cuaauuuaguucuca

SEQ ID NO: 1648700 - RNA, 20 nt, Homo sapiens
cuaauuuuggauaauauuca

SEQ ID NO: 1648701 - RNA, 17 nt, Homo sapiens
cuacaaaaccacuggaa

SEQ ID NO: 1648702 - RNA, 14 nt, Homo sapiens
cuacacacaguacg

SEQ ID NO: 1648703 - RNA, 19 nt, Homo sapiens
cuacacgagauacagaauu

SEQ ID NO: 1648704 - RNA, 18 nt, Homo sapiens
cuacaggauuugaaauug

SEQ ID NO: 1648705 - RNA, 11 nt, Homo sapiens
cuacaguauua

SEQ ID NO: 1648706 - RNA, 16 nt, Homo sapiens
cuacauaauacccagg

SEQ ID NO: 1648707 - RNA, 14 nt, Homo sapiens
cuacauacacagug

SEQ ID NO: 1648708 - RNA, 19 nt, Homo sapiens
cuacaucuuuuauacauuu

SEQ ID NO: 1648709 - RNA, 14 nt, Homo sapiens
cuacauuuagcccc

SEQ ID NO: 1648710 - RNA, 13 nt, Homo sapiens
cuaccacuuugaa

SEQ ID NO: 1648711 - RNA, 18 nt, Homo sapiens
cuaccauucaaaauugcu

SEQ ID NO: 1648712 - RNA, 22 nt, Homo sapiens
cuaccauucaaaauugcuucuu

SEQ ID NO: 1648713 - RNA, 14 nt, Homo sapiens
cuaccugacugcca

SEQ ID NO: 1648714 - RNA, 13 nt, Homo sapiens
cuagaaauccugg

SEQ ID NO: 1648715 - RNA, 19 nt, Homo sapiens
cuagaaccuagaagggcua

SEQ ID NO: 1648716 - RNA, 18 nt, Homo sapiens
cuagaaucuggagagcua

SEQ ID NO: 1648717 - RNA, 14 nt, Homo sapiens
cuagagguacuuuc

SEQ ID NO: 1648718 - RNA, 15 nt, Homo sapiens
cuagauacugaaugu

SEQ ID NO: 1648719 - RNA, 21 nt, Homo sapiens
cuagcaguaaaagauaaauuu

SEQ ID NO: 1648720 - RNA, 15 nt, Homo sapiens
cuagggaaaugauca

SEQ ID NO: 1648721 - RNA, 23 nt, Homo sapiens
cuaguuuuuuugaaauccaaaga

SEQ ID NO: 1648722 - RNA, 23 nt, Homo sapiens
cuauaauuauaaucaaaaucaau

SEQ ID NO: 1648723 - RNA, 19 nt, Homo sapiens
cuauacaugguagccaguu

SEQ ID NO: 1648724 - RNA, 21 nt, Homo sapiens
cuauacaugguagccaguuga

SEQ ID NO: 1648725 - RNA, 17 nt, Homo sapiens
cuauaccuuacugcaau

SEQ ID NO: 1648726 - RNA, 20 nt, Homo sapiens
uaagagggcacacacugugu

SEQ ID NO: 1648727 - RNA, 20 nt, Homo sapiens
uaagaucuaaaaugauacug

SEQ ID NO: 1648728 - RNA, 22 nt, Homo sapiens
uaagcuauuuugguuuagugca

SEQ ID NO: 1648729 - RNA, 18 nt, Homo sapiens
uaagcucuaucugcaaug

SEQ ID NO: 1648730 - RNA, 21 nt, Homo sapiens
uaaggaacauguacuguuacu

SEQ ID NO: 1648731 - RNA, 18 nt, Homo sapiens
uaaggcugugugaauuuu

SEQ ID NO: 1648732 - RNA, 20 nt, Homo sapiens
uaaguagcaacccugugaua

SEQ ID NO: 1648733 - RNA, 17 nt, Homo sapiens
uaaguuucaggugacau

SEQ ID NO: 1648734 - RNA, 14 nt, Homo sapiens
uaauaaauacugca

SEQ ID NO: 1648735 - RNA, 13 nt, Homo sapiens
uaauaaaucacac

SEQ ID NO: 1648736 - RNA, 14 nt, Homo sapiens
uaauaacuuaucua

SEQ ID NO: 1648737 - RNA, 15 nt, Homo sapiens
uaauagaaacauuga

SEQ ID NO: 1648738 - RNA, 17 nt, Homo sapiens
uaauaggcguaacuaau

SEQ ID NO: 1648739 - RNA, 16 nt, Homo sapiens
uaauaguauaucuaau

SEQ ID NO: 1648740 - RNA, 22 nt, Homo sapiens
uaauauauguauaugcaauaua

SEQ ID NO: 1648741 - RNA, 20 nt, Homo sapiens
uaauauucacauguucuaau

SEQ ID NO: 1648742 - RNA, 12 nt, Homo sapiens
uaaucauaacau

SEQ ID NO: 1648743 - RNA, 18 nt, Homo sapiens
uaauccagaaaaacugug

SEQ ID NO: 1648744 - RNA, 14 nt, Homo sapiens
uaaucccagcacuu

SEQ ID NO: 1648745 - RNA, 20 nt, Homo sapiens
uaaucccagcuacuugggag

SEQ ID NO: 1648746 - RNA, 18 nt, Homo sapiens
uaaucuaagaaaagggga

SEQ ID NO: 1648747 - RNA, 15 nt, Homo sapiens
uaaugaaauggagga

SEQ ID NO: 1648748 - RNA, 19 nt, Homo sapiens
uaaugaaguguuuagcaua

SEQ ID NO: 1648749 - RNA, 20 nt, Homo sapiens
uaaugacguugagcaucuau

SEQ ID NO: 1648750 - RNA, 15 nt, Homo sapiens
uaaugcaagcaaagu

SEQ ID NO: 1648751 - RNA, 13 nt, Homo sapiens
uaaugggacacua

SEQ ID NO: 1648752 - RNA, 12 nt, Homo sapiens
uaauuaccaugc

SEQ ID NO: 1648753 - RNA, 15 nt, Homo sapiens
uaauuauuucacuuu

SEQ ID NO: 1648754 - RNA, 17 nt, Homo sapiens
uaauuauuucacuuuag

SEQ ID NO: 1648755 - RNA, 18 nt, Homo sapiens
uaauucaacauauaccuu

SEQ ID NO: 1648756 - RNA, 19 nt, Homo sapiens
uaauucuuaggguacucau

SEQ ID NO: 1648757 - RNA, 19 nt, Homo sapiens
uaauuggauauugaugaaa

SEQ ID NO: 1648758 - RNA, 13 nt, Homo sapiens
uaauuuaguucuc

SEQ ID NO: 1648759 - RNA, 15 nt, Homo sapiens
uaauuuguaugcuaa

SEQ ID NO: 1648760 - RNA, 18 nt, Homo sapiens
uaauuugugaauuugcaa

SEQ ID NO: 1648761 - RNA, 18 nt, Homo sapiens
uaauuuuccaaugcacag

SEQ ID NO: 1648762 - RNA, 19 nt, Homo sapiens
uacaaaucaaucacagcuu

SEQ ID NO: 1648763 - RNA, 15 nt, Homo sapiens
uacaaaugcauuucu

SEQ ID NO: 1648764 - RNA, 17 nt, Homo sapiens
uacaagggcugagauuc

SEQ ID NO: 1648765 - RNA, 16 nt, Homo sapiens
uacaauuacaucucua

SEQ ID NO: 1648766 - RNA, 14 nt, Homo sapiens
uacacaacauguau

SEQ ID NO: 1648767 - RNA, 11 nt, Homo sapiens
uacacaugaca

SEQ ID NO: 1648768 - RNA, 23 nt, Homo sapiens
uacacauuccaucuuacauuagu

SEQ ID NO: 1648769 - RNA, 20 nt, Homo sapiens
uacacauuuuucagauauaa

SEQ ID NO: 1648770 - RNA, 21 nt, Homo sapiens
uacaccuaacucaccuaacuc

SEQ ID NO: 1648771 - RNA, 20 nt, Homo sapiens
uacagaaucaaaugcaauuu

SEQ ID NO: 1648772 - RNA, 21 nt, Homo sapiens
uacagcuggguggcacugcca

SEQ ID NO: 1648773 - RNA, 13 nt, Homo sapiens
uacaggugugaac

SEQ ID NO: 1648774 - RNA, 14 nt, Homo sapiens
uacaggugugaguc

SEQ ID NO: 1648775 - RNA, 19 nt, Homo sapiens
uacagucagcacagaacac

SEQ ID NO: 1648776 - RNA, 20 nt, Homo sapiens
uacagugcuguguacccugg

SEQ ID NO: 1648777 - RNA, 17 nt, Homo sapiens
uacaucuuuuauacauu

SEQ ID NO: 1648778 - RNA, 14 nt, Homo sapiens
uacaugcauauaau

SEQ ID NO: 1648779 - RNA, 15 nt, Homo sapiens
uacauucaacagaga

SEQ ID NO: 1648780 - RNA, 21 nt, Homo sapiens
uacauugggcacauaucuccu

SEQ ID NO: 1648781 - RNA, 18 nt, Homo sapiens
uaccacaugccaagcacu

SEQ ID NO: 1648782 - RNA, 22 nt, Homo sapiens
uaccacaugccaagcacugugc

SEQ ID NO: 1648783 - RNA, 18 nt, Homo sapiens
uaccaccacgcccggcua

SEQ ID NO: 1648784 - RNA, 22 nt, Homo sapiens
uaccacuguggaagucccucag

SEQ ID NO: 1648785 - RNA, 21 nt, Homo sapiens
uaccaguauaauugaguuuuc

SEQ ID NO: 1648786 - RNA, 16 nt, Homo sapiens
uaccagugggcaugua

SEQ ID NO: 1648787 - RNA, 15 nt, Homo sapiens
uacccaauuguuuca

SEQ ID NO: 1648788 - RNA, 21 nt, Homo sapiens
uaccugaaaacacugugcaca

SEQ ID NO: 1648789 - RNA, 21 nt, Homo sapiens
uaccugcccccaauccaugaa

SEQ ID NO: 1648790 - RNA, 13 nt, Homo sapiens
uaccuugugcuaa

SEQ ID NO: 1648791 - RNA, 20 nt, Homo sapiens
uaccuuuugugguucucaau

SEQ ID NO: 1648792 - RNA, 15 nt, Homo sapiens
uacgaugacaguguu

SEQ ID NO: 1648793 - RNA, 15 nt, Homo sapiens
uacguaucugcuacu

SEQ ID NO: 1648794 - RNA, 14 nt, Homo sapiens
uacgugacaacaca

SEQ ID NO: 1648795 - RNA, 19 nt, Homo sapiens
uacgugaccucugcaagac

SEQ ID NO: 1648796 - RNA, 18 nt, Homo sapiens
uacuaaugaugcuuuuau

SEQ ID NO: 1648797 - RNA, 21 nt, Homo sapiens
uacuaauuuuccauaagcuau

SEQ ID NO: 1648798 - RNA, 16 nt, Homo sapiens
uacuauuuaugugauc

SEQ ID NO: 1648799 - RNA, 16 nt, Homo sapiens
uacucuuccaucuuuc

SEQ ID NO: 1648800 - RNA, 20 nt, Homo sapiens
uacugaaucugcuaccaaaa

SEQ ID NO: 1648801 - RNA, 15 nt, Homo sapiens
uacuggucucaggcc

SEQ ID NO: 1648802 - RNA, 17 nt, Homo sapiens
uacuguauggaaacacu

SEQ ID NO: 1648803 - RNA, 14 nt, Homo sapiens
uacuguuacugugu

SEQ ID NO: 1648804 - RNA, 15 nt, Homo sapiens
uacuucccaguauaa

SEQ ID NO: 1648805 - RNA, 14 nt, Homo sapiens
uacuuguggacaca

SEQ ID NO: 1648806 - RNA, 20 nt, Homo sapiens
uacuuucucuagggagaaaa

SEQ ID NO: 1648807 - RNA, 17 nt, Homo sapiens
uacuuuuaaacuuugau

SEQ ID NO: 1648808 - RNA, 17 nt, Homo sapiens
uacuuuuuaaacagugu

SEQ ID NO: 1648809 - RNA, 15 nt, Homo sapiens
uagaaagaagaugaa

SEQ ID NO: 1648810 - RNA, 16 nt, Homo sapiens
uagaaauccaauugga

SEQ ID NO: 1648811 - RNA, 19 nt, Homo sapiens
uagaaccaccaacaagcaa

SEQ ID NO: 1648812 - RNA, 13 nt, Homo sapiens
uagaaccaggcaa

SEQ ID NO: 1648813 - RNA, 22 nt, Homo sapiens
uagaaccucgagguuucucaaa

SEQ ID NO: 1648814 - RNA, 15 nt, Homo sapiens
uagaagcaucacagg

SEQ ID NO: 1648815 - RNA, 22 nt, Homo sapiens
uagaagccacuauuacugggac

SEQ ID NO: 1648816 - RNA, 17 nt, Homo sapiens
uagaauaaaggccugcg

SEQ ID NO: 1648817 - RNA, 15 nt, Homo sapiens
uagaauacucaggga

SEQ ID NO: 1648818 - RNA, 21 nt, Homo sapiens
uagaauauccuacuucuccag

SEQ ID NO: 1648819 - RNA, 19 nt, Homo sapiens
uagagaaauuugccaauuu

SEQ ID NO: 1648820 - RNA, 21 nt, Homo sapiens
uagagacaggguuuugccaug

SEQ ID NO: 1648821 - RNA, 20 nt, Homo sapiens
uagagacgggguuucacugu

SEQ ID NO: 1648822 - RNA, 18 nt, Homo sapiens
uagagauuaccuccugag

SEQ ID NO: 1648823 - RNA, 20 nt, Homo sapiens
uagagcagcccuggagucau

SEQ ID NO: 1648824 - RNA, 20 nt, Homo sapiens
uagagcaggcguucagcuca

SEQ ID NO: 1648825 - RNA, 22 nt, Homo sapiens
uagagcaggcguucagcucacu

SEQ ID NO: 1648826 - RNA, 20 nt, Homo sapiens
uagaggauauugggucucag

SEQ ID NO: 1648827 - RNA, 23 nt, Homo sapiens
uagaggauauugggucucagccc

SEQ ID NO: 1648828 - RNA, 15 nt, Homo sapiens
uagaguggcgauuga

SEQ ID NO: 1648829 - RNA, 15 nt, Homo sapiens
uagaguucagacuuu

SEQ ID NO: 1648830 - RNA, 22 nt, Homo sapiens
uagauaaaaaccugaacuuuca

SEQ ID NO: 1648831 - RNA, 17 nt, Homo sapiens
uagauaauaaaauugcu

SEQ ID NO: 1648832 - RNA, 20 nt, Homo sapiens
uagauaauaaaauugcuccc

SEQ ID NO: 1648833 - RNA, 20 nt, Homo sapiens
uagcaaaauacaugacauuu

SEQ ID NO: 1648834 - RNA, 16 nt, Homo sapiens
uagcaacccugugaua

SEQ ID NO: 1648835 - RNA, 20 nt, Homo sapiens
ucucauuaaaauccaguauu

SEQ ID NO: 1648836 - RNA, 10 nt, Homo sapiens
ucucauuucu

SEQ ID NO: 1648837 - RNA, 22 nt, Homo sapiens
ucuccaucucuaggaugucguc

SEQ ID NO: 1648838 - RNA, 18 nt, Homo sapiens
ucucccaaagccccaaau

SEQ ID NO: 1648839 - RNA, 18 nt, Homo sapiens
ucucgugguaggacugua

SEQ ID NO: 1648840 - RNA, 17 nt, Homo sapiens
ucucucacugacuauua

SEQ ID NO: 1648841 - RNA, 12 nt, Homo sapiens
ucucucaucucu

SEQ ID NO: 1648842 - RNA, 13 nt, Homo sapiens
ucucucaucucuu

SEQ ID NO: 1648843 - RNA, 15 nt, Homo sapiens
ucucugacauaugcu

SEQ ID NO: 1648844 - RNA, 15 nt, Homo sapiens
ucucugagcagugaa

SEQ ID NO: 1648845 - RNA, 22 nt, Homo sapiens
ucucugccauggccuuggcagg

SEQ ID NO: 1648846 - RNA, 12 nt, Homo sapiens
ucucugcucugc

SEQ ID NO: 1648847 - RNA, 19 nt, Homo sapiens
ucucugucucaugugugcu

SEQ ID NO: 1648848 - RNA, 15 nt, Homo sapiens
ucucuuauaauucca

SEQ ID NO: 1648849 - RNA, 20 nt, Homo sapiens
ucucuuuacuucccaguaua

SEQ ID NO: 1648850 - RNA, 19 nt, Homo sapiens
ucugaaaauauaaccagcc

SEQ ID NO: 1648851 - RNA, 17 nt, Homo sapiens
ucugaagucaguuucua

SEQ ID NO: 1648852 - RNA, 13 nt, Homo sapiens
ucugaauugacug

SEQ ID NO: 1648853 - RNA, 15 nt, Homo sapiens
ucugaauugacugua

SEQ ID NO: 1648854 - RNA, 22 nt, Homo sapiens
ucugaccaguuuaaccugaugc

SEQ ID NO: 1648855 - RNA, 17 nt, Homo sapiens
ucugacucagggcuccu

SEQ ID NO: 1648856 - RNA, 11 nt, Homo sapiens
ucugagccuug

SEQ ID NO: 1648857 - RNA, 15 nt, Homo sapiens
ucugauacguguaug

SEQ ID NO: 1648858 - RNA, 16 nt, Homo sapiens
ucugaugcaagcaaga

SEQ ID NO: 1648859 - RNA, 21 nt, Homo sapiens
ucugaugcaagcaagaaacac

SEQ ID NO: 1648860 - RNA, 17 nt, Homo sapiens
ucugauguuacugagau

SEQ ID NO: 1648861 - RNA, 20 nt, Homo sapiens
ucugcagccuccucugugac

SEQ ID NO: 1648862 - RNA, 18 nt, Homo sapiens
ucugcaucuuacagucag

SEQ ID NO: 1648863 - RNA, 12 nt, Homo sapiens
ucugccacuucc

SEQ ID NO: 1648864 - RNA, 21 nt, Homo sapiens
ucugccuccccuucacuccca

SEQ ID NO: 1648865 - RNA, 14 nt, Homo sapiens
ucugccucugacac

SEQ ID NO: 1648866 - RNA, 15 nt, Homo sapiens
ucugccuucuuuaug

SEQ ID NO: 1648867 - RNA, 20 nt, Homo sapiens
ucugcucacauaucugucau

SEQ ID NO: 1648868 - RNA, 18 nt, Homo sapiens
ucugcucaucauucucug

SEQ ID NO: 1648869 - RNA, 15 nt, Homo sapiens
ucugcuuaaucugag

SEQ ID NO: 1648870 - RNA, 18 nt, Homo sapiens
ucugcuuaaucugagaau

SEQ ID NO: 1648871 - RNA, 14 nt, Homo sapiens
ucuggacacugcca

SEQ ID NO: 1648872 - RNA, 16 nt, Homo sapiens
ucuggaggucucugaa

SEQ ID NO: 1648873 - RNA, 16 nt, Homo sapiens
ucuggaucuccugacc

SEQ ID NO: 1648874 - RNA, 12 nt, Homo sapiens
ucuggauuucau

SEQ ID NO: 1648875 - RNA, 12 nt, Homo sapiens
ucuggcagcuca

SEQ ID NO: 1648876 - RNA, 17 nt, Homo sapiens
ucugggagcucaaguga

SEQ ID NO: 1648877 - RNA, 23 nt, Homo sapiens
ucugggcagacauuauguaaaag

SEQ ID NO: 1648878 - RNA, 13 nt, Homo sapiens
ucuguaaagucua

SEQ ID NO: 1648879 - RNA, 19 nt, Homo sapiens
ucuguaaagucuagcacag

SEQ ID NO: 1648880 - RNA, 15 nt, Homo sapiens
ucuguaaaugaacac

SEQ ID NO: 1648881 - RNA, 17 nt, Homo sapiens
ucuguaaaugaacacau

SEQ ID NO: 1648882 - RNA, 21 nt, Homo sapiens
ucuguaaaugaagggucauuu

SEQ ID NO: 1648883 - RNA, 20 nt, Homo sapiens
ucuguauauagcucuacaca

SEQ ID NO: 1648884 - RNA, 19 nt, Homo sapiens
ucugugggcuccauguaga

SEQ ID NO: 1648885 - RNA, 14 nt, Homo sapiens
ucuguguugagcgu

SEQ ID NO: 1648886 - RNA, 18 nt, Homo sapiens
ucuguucugcacacagca

SEQ ID NO: 1648887 - RNA, 19 nt, Homo sapiens
ucuguuguuuuaagccaca

SEQ ID NO: 1648888 - RNA, 17 nt, Homo sapiens
ucuuaaaauagccauaa

SEQ ID NO: 1648889 - RNA, 13 nt, Homo sapiens
ucuuaagacguga

SEQ ID NO: 1648890 - RNA, 16 nt, Homo sapiens
ucuuaaucuuuucaca

SEQ ID NO: 1648891 - RNA, 18 nt, Homo sapiens
ucuuagcagugucucuca

SEQ ID NO: 1648892 - RNA, 16 nt, Homo sapiens
ucuuaucucagucaug

SEQ ID NO: 1648893 - RNA, 21 nt, Homo sapiens
ucuucaacccccugacauuau

SEQ ID NO: 1648894 - RNA, 24 nt, Homo sapiens
ucuucaccauuuggcaaugccauc

SEQ ID NO: 1648895 - RNA, 16 nt, Homo sapiens
ucuucauaauuucuuc

SEQ ID NO: 1648896 - RNA, 13 nt, Homo sapiens
ucuucucauuuca

SEQ ID NO: 1648897 - RNA, 18 nt, Homo sapiens
ucuucuccauccucacac

SEQ ID NO: 1648898 - RNA, 13 nt, Homo sapiens
ucuucugacuuaa

SEQ ID NO: 1648899 - RNA, 15 nt, Homo sapiens
ucuucuuagcaccac

SEQ ID NO: 1648900 - RNA, 16 nt, Homo sapiens
ucuugaacuccugacc

SEQ ID NO: 1648901 - RNA, 15 nt, Homo sapiens
ucuugacccugucac

SEQ ID NO: 1648902 - RNA, 17 nt, Homo sapiens
ucuugaugcaugcacug

SEQ ID NO: 1648903 - RNA, 13 nt, Homo sapiens
ucuuggggaauau

SEQ ID NO: 1648904 - RNA, 16 nt, Homo sapiens
ucuuguguuaccugaa

SEQ ID NO: 1648905 - RNA, 20 nt, Homo sapiens
ucuuuaacccucacugggac

SEQ ID NO: 1648906 - RNA, 14 nt, Homo sapiens
ucuuucccaauuca

SEQ ID NO: 1648907 - RNA, 17 nt, Homo sapiens
ucuuucccaauucacau

SEQ ID NO: 1648908 - RNA, 16 nt, Homo sapiens
ucuuucuacaguauua

SEQ ID NO: 1648909 - RNA, 19 nt, Homo sapiens
ucuuugaacuguguggucu

SEQ ID NO: 1648910 - RNA, 15 nt, Homo sapiens
ucuuuggacagaagc

SEQ ID NO: 1648911 - RNA, 14 nt, Homo sapiens
ucuuuggugaacau

SEQ ID NO: 1648912 - RNA, 14 nt, Homo sapiens
ucuuuuccccauga

SEQ ID NO: 1648913 - RNA, 22 nt, Homo sapiens
ugaaaaaaaauuuuauaguguc

SEQ ID NO: 1648914 - RNA, 12 nt, Homo sapiens
ugaaaaaugccu

SEQ ID NO: 1648915 - RNA, 13 nt, Homo sapiens
ugaaaacacuguu

SEQ ID NO: 1648916 - RNA, 19 nt, Homo sapiens
ugaaaaugguccaggagaa

SEQ ID NO: 1648917 - RNA, 16 nt, Homo sapiens
ugaaacacacauggac

SEQ ID NO: 1648918 - RNA, 13 nt, Homo sapiens
ugaaacagcugcc

SEQ ID NO: 1648919 - RNA, 16 nt, Homo sapiens
ugaaacauuugcaaaa

SEQ ID NO: 1648920 - RNA, 17 nt, Homo sapiens
ugaaaccaggacauuaa

SEQ ID NO: 1648921 - RNA, 15 nt, Homo sapiens
ugaaagaaaauaaca

SEQ ID NO: 1648922 - RNA, 20 nt, Homo sapiens
ugaaagcaaccuucuugccu

SEQ ID NO: 1648923 - RNA, 21 nt, Homo sapiens
ugaacacaauacauguuuuca

SEQ ID NO: 1648924 - RNA, 12 nt, Homo sapiens
ugaacauuccag

SEQ ID NO: 1648925 - RNA, 13 nt, Homo sapiens
ugaacauugcaau

SEQ ID NO: 1648926 - RNA, 16 nt, Homo sapiens
ugaaccuugcuaucaa

SEQ ID NO: 1648927 - RNA, 16 nt, Homo sapiens
ugaacuccugaccuca

SEQ ID NO: 1648928 - RNA, 22 nt, Homo sapiens
ugaacuggguacuuguggacac

SEQ ID NO: 1648929 - RNA, 17 nt, Homo sapiens
ugaacuguggugccaca

SEQ ID NO: 1648930 - RNA, 21 nt, Homo sapiens
ugaacuguggugccacaugac

SEQ ID NO: 1648931 - RNA, 17 nt, Homo sapiens
ugaaggcaaugccaucc

SEQ ID NO: 1648932 - RNA, 14 nt, Homo sapiens
ugaagucacacagu

SEQ ID NO: 1648933 - RNA, 16 nt, Homo sapiens
ugaagucacacaguga

SEQ ID NO: 1648934 - RNA, 22 nt, Homo sapiens
ugaagucaugcguuuaaucaca

SEQ ID NO: 1648935 - RNA, 23 nt, Homo sapiens
ugaagucaugcguuuaaucacau

SEQ ID NO: 1648936 - RNA, 19 nt, Homo sapiens
ugaaugccuaugguggauc

SEQ ID NO: 1648937 - RNA, 22 nt, Homo sapiens
ugaauggagcagaaauucaccu

SEQ ID NO: 1648938 - RNA, 13 nt, Homo sapiens
ugaaugucauuau

SEQ ID NO: 1648939 - RNA, 23 nt, Homo sapiens
ugaaugucauuauuugauaacau

SEQ ID NO: 1648940 - RNA, 12 nt, Homo sapiens
ugaauucuacua

SEQ ID NO: 1648941 - RNA, 17 nt, Homo sapiens
ugaauuuugucuuuaug

SEQ ID NO: 1648942 - RNA, 15 nt, Homo sapiens
ugaauuuuugcacau

SEQ ID NO: 1648943 - RNA, 16 nt, Homo sapiens
ugaauuuuugcacauu

SEQ ID NO: 1648944 - RNA, 13 nt, Homo sapiens
ugacaacacaaau

SEQ ID NO: 1648945 - RNA, 15 nt, Homo sapiens
ugacagaacacuguc

SEQ ID NO: 1648946 - RNA, 15 nt, Homo sapiens
uguguucaguacaau

SEQ ID NO: 1648947 - RNA, 17 nt, Homo sapiens
uguguugauacuguugc

SEQ ID NO: 1648948 - RNA, 19 nt, Homo sapiens
uguuaagccauguguucca

SEQ ID NO: 1648949 - RNA, 23 nt, Homo sapiens
uguuaagccauguguuccaaggc

SEQ ID NO: 1648950 - RNA, 22 nt, Homo sapiens
uguuaaggaaacucuuaucuca

SEQ ID NO: 1648951 - RNA, 13 nt, Homo sapiens
uguuaaguugaug

SEQ ID NO: 1648952 - RNA, 23 nt, Homo sapiens
uguuaccugaaaacacugugcac

SEQ ID NO: 1648953 - RNA, 21 nt, Homo sapiens
uguuaggaagguacugucaug

SEQ ID NO: 1648954 - RNA, 14 nt, Homo sapiens
uguuaugcaaaaaa

SEQ ID NO: 1648955 - RNA, 13 nt, Homo sapiens
uguuauuuacacu
